United States Patent 11,926,839 (PLATFORM FOR T LYMPHOCYTE GENOME ENGINEERING AND IN VIVO HIGH-THROUGHPUT SCREENING THEREOF) - sequence listing, part 4

SEQ ID NO: 77611 - RNA, 20 nt, Artificial Sequence
  MKO10077611_B_Chic2
  gRNA
augugaaacgaacaacauga

SEQ ID NO: 77612 - RNA, 20 nt, Artificial Sequence
  MKO10077612_B_Chic2
  gRNA
cgauugagaaguuauuagaa

SEQ ID NO: 77613 - RNA, 20 nt, Artificial Sequence
  MKO10077613_B_Chid1
  gRNA
cucuucaguugcaaccagac

SEQ ID NO: 77614 - RNA, 20 nt, Artificial Sequence
  MKO10077614_B_Chid1
  gRNA
cgugagauguuugaaauuac

SEQ ID NO: 77615 - RNA, 20 nt, Artificial Sequence
  MKO10077615_B_Chid1
  gRNA
gcugucaagaagcaugccaa

SEQ ID NO: 77616 - RNA, 20 nt, Artificial Sequence
  MKO10077616_B_Chil1
  gRNA
gcgacaacaugcuuagcaca

SEQ ID NO: 77617 - RNA, 20 nt, Artificial Sequence
  MKO10077617_B_Chil1
  gRNA
agaagcuuccaacgccuucc

SEQ ID NO: 77618 - RNA, 20 nt, Artificial Sequence
  MKO10077618_B_Chil1
  gRNA
auuuccacccuccaacagac

SEQ ID NO: 77619 - RNA, 20 nt, Artificial Sequence
  MKO10077619_B_Chil3
  gRNA
cugacugaaugaauaucuga

SEQ ID NO: 77620 - RNA, 20 nt, Artificial Sequence
  MKO10077620_B_Chil3
  gRNA
cacugagcuaaaaacucucc

SEQ ID NO: 77621 - RNA, 20 nt, Artificial Sequence
  MKO10077621_B_Chil3
  gRNA
uccaaacuuccauccuccaa

SEQ ID NO: 77622 - RNA, 20 nt, Artificial Sequence
  MKO10077622_B_Chil4
  gRNA
aauucuucugaauguacagc

SEQ ID NO: 77623 - RNA, 20 nt, Artificial Sequence
  MKO10077623_B_Chil4
  gRNA
augcauaagguucaguucca

SEQ ID NO: 77624 - RNA, 20 nt, Artificial Sequence
  MKO10077624_B_Chil4
  gRNA
cacugagcuaaaaacucucc

SEQ ID NO: 77625 - RNA, 20 nt, Artificial Sequence
  MKO10077625_B_Chil6
  gRNA
ugauguguuacuucaacaac

SEQ ID NO: 77626 - RNA, 20 nt, Artificial Sequence
  MKO10077626_B_Chil6
  gRNA
ccuccuucugaaugcucaaa

SEQ ID NO: 77627 - RNA, 20 nt, Artificial Sequence
  MKO10077627_B_Chil6
  gRNA
uguugaaguaacacaucagc

SEQ ID NO: 77628 - RNA, 20 nt, Artificial Sequence
  MKO10077628_B_Chit1
  gRNA
caucaaaaccuugagugcgc

SEQ ID NO: 77629 - RNA, 20 nt, Artificial Sequence
  MKO10077629_B_Chit1
  gRNA
cuccggcucacuuagucuuu

SEQ ID NO: 77630 - RNA, 20 nt, Artificial Sequence
  MKO10077630_B_Chit1
  gRNA
uccagccuccaacggcuaac

SEQ ID NO: 77631 - RNA, 20 nt, Artificial Sequence
  MKO10077631_B_Chka
  gRNA
agccgcaagagcacuuuccg

SEQ ID NO: 77632 - RNA, 20 nt, Artificial Sequence
  MKO10077632_B_Chka
  gRNA
cucagguucucgagcucaag

SEQ ID NO: 77633 - RNA, 20 nt, Artificial Sequence
  MKO10077633_B_Chka
  gRNA
cuguuuccagagccggcgau

SEQ ID NO: 77634 - RNA, 20 nt, Artificial Sequence
  MKO10077634_B_Chkb
  gRNA
cucccgacaacacugggucc

SEQ ID NO: 77635 - RNA, 20 nt, Artificial Sequence
  MKO10077635_B_Chkb
  gRNA
uguucgccauucucgcagag

SEQ ID NO: 77636 - RNA, 20 nt, Artificial Sequence
  MKO10077636_B_Chkb
  gRNA
acaucucuaccagguucauc

SEQ ID NO: 77637 - RNA, 20 nt, Artificial Sequence
  MKO10077637_B_Chl1
  gRNA
uuacccugcaacccuccaaa

SEQ ID NO: 77638 - RNA, 20 nt, Artificial Sequence
  MKO10077638_B_Chl1
  gRNA
uguacaaucguucuuaauuu

SEQ ID NO: 77639 - RNA, 20 nt, Artificial Sequence
  MKO10077639_B_Chl1
  gRNA
caaauugaaugugaagcgaa

SEQ ID NO: 77640 - RNA, 20 nt, Artificial Sequence
  MKO10077640_B_Chml
  gRNA
gcagagaaguuccccccuag

SEQ ID NO: 77641 - RNA, 20 nt, Artificial Sequence
  MKO10077641_B_Chml
  gRNA
gugagccgaagcucauacug

SEQ ID NO: 77642 - RNA, 20 nt, Artificial Sequence
  MKO10077642_B_Chml
  gRNA
ucaaagccgcuguauucuca

SEQ ID NO: 77643 - RNA, 20 nt, Artificial Sequence
  MKO10077643_B_Chmp1a
  gRNA
aucccaggugaccaagaaua

SEQ ID NO: 77644 - RNA, 20 nt, Artificial Sequence
  MKO10077644_B_Chmp1a
  gRNA
uuaguucacagcgaagcagc

SEQ ID NO: 77645 - RNA, 20 nt, Artificial Sequence
  MKO10077645_B_Chmp1a
  gRNA
gccauccgcaagaagaauga

SEQ ID NO: 77646 - RNA, 20 nt, Artificial Sequence
  MKO10077646_B_Chmp1b
  gRNA
cgaacaccaguucgagacuc

SEQ ID NO: 77647 - RNA, 20 nt, Artificial Sequence
  MKO10077647_B_Chmp1b
  gRNA
auacacaguuacgcuaacuc

SEQ ID NO: 77648 - RNA, 20 nt, Artificial Sequence
  MKO10077648_B_Chmp1b
  gRNA
ccgcacgacgauguccaaca

SEQ ID NO: 77649 - RNA, 20 nt, Artificial Sequence
  MKO10077649_B_Chmp2a
  gRNA
uagugaugcuguuguguccc

SEQ ID NO: 77650 - RNA, 20 nt, Artificial Sequence
  MKO10077650_B_Chmp2a
  gRNA
cacuugacagcucaucugug

SEQ ID NO: 77651 - RNA, 20 nt, Artificial Sequence
  MKO10077651_B_Chmp2a
  gRNA
ggcucacucaguguggcagc

SEQ ID NO: 77652 - RNA, 20 nt, Artificial Sequence
  MKO10077652_B_Chmp2b
  gRNA
guuccucauagaugucauaa

SEQ ID NO: 77653 - RNA, 20 nt, Artificial Sequence
  MKO10077653_B_Chmp2b
  gRNA
ccgagcagccuuagagaaac

SEQ ID NO: 77654 - RNA, 20 nt, Artificial Sequence
  MKO10077654_B_Chmp2b
  gRNA
agccaucaaagaugucaucc

SEQ ID NO: 77655 - RNA, 20 nt, Artificial Sequence
  MKO10077655_B_Chmp3
  gRNA
ccuugaccugaucaucuccu

SEQ ID NO: 77656 - RNA, 20 nt, Artificial Sequence
  MKO10077656_B_Chmp3
  gRNA
gcagagaaccagcuacucgc

SEQ ID NO: 77657 - RNA, 20 nt, Artificial Sequence
  MKO10077657_B_Chmp3
  gRNA
ugugaaagaugcagccaaga

SEQ ID NO: 77658 - RNA, 20 nt, Artificial Sequence
  MKO10077658_B_Chmp4b
  gRNA
gcagcacauacauguugucg

SEQ ID NO: 77659 - RNA, 20 nt, Artificial Sequence
  MKO10077659_B_Chmp4b
  gRNA
guagcccuaccauccaaacc

SEQ ID NO: 77660 - RNA, 20 nt, Artificial Sequence
  MKO10077660_B_Chmp4b
  gRNA
cuggaacaguuacauggauc

SEQ ID NO: 77661 - RNA, 20 nt, Artificial Sequence
  MKO10077661_B_Chmp4c
  gRNA
guuugccgauggcuucgaug

SEQ ID NO: 77662 - RNA, 20 nt, Artificial Sequence
  MKO10077662_B_Chmp4c
  gRNA
ggaacagaccugcucgagac

SEQ ID NO: 77663 - RNA, 20 nt, Artificial Sequence
  MKO10077663_B_Chmp4c
  gRNA
gcaugcccuccuccgugcac

SEQ ID NO: 77664 - RNA, 20 nt, Artificial Sequence
  MKO10077664_B_Chmp5
  gRNA
uuagguugaugccaugaagu

SEQ ID NO: 77665 - RNA, 20 nt, Artificial Sequence
  MKO10077665_B_Chmp5
  gRNA
uuacaccauccagucacuaa

SEQ ID NO: 77666 - RNA, 20 nt, Artificial Sequence
  MKO10077666_B_Chmp5
  gRNA
ggaaaugaagaaggcauaua

SEQ ID NO: 77667 - RNA, 20 nt, Artificial Sequence
  MKO10077667_B_Chmp6
  gRNA
gcugcugcgugacccucuuc

SEQ ID NO: 77668 - RNA, 20 nt, Artificial Sequence
  MKO10077668_B_Chmp6
  gRNA
gaggauccuggacgagaccc

SEQ ID NO: 77669 - RNA, 20 nt, Artificial Sequence
  MKO10077669_B_Chmp6
  gRNA
augucugaauaagaugcacc

SEQ ID NO: 77670 - RNA, 20 nt, Artificial Sequence
  MKO10077670_B_Chmp7
  gRNA
aagacucgaccuuccgagag

SEQ ID NO: 77671 - RNA, 20 nt, Artificial Sequence
  MKO10077671_B_Chmp7
  gRNA
caggaagacgccgacccccc

SEQ ID NO: 77672 - RNA, 20 nt, Artificial Sequence
  MKO10077672_B_Chmp7
  gRNA
ggugcaaagaggaagcccgc

SEQ ID NO: 77673 - RNA, 20 nt, Artificial Sequence
  MKO10077673_B_Chm
  gRNA
agcuauucuucuuaguagca

SEQ ID NO: 77674 - RNA, 20 nt, Artificial Sequence
  MKO10077674_B_Chm
  gRNA
ugaacaugcagcugcaauga

SEQ ID NO: 77675 - RNA, 20 nt, Artificial Sequence
  MKO10077675_B_Chm
  gRNA
caguccugaaaagcugaaac

SEQ ID NO: 77676 - RNA, 20 nt, Artificial Sequence
  MKO10077676_B_Chn1
  gRNA
uaggcaucguaugugaugag

SEQ ID NO: 77677 - RNA, 20 nt, Artificial Sequence
  MKO10077677_B_Chn1
  gRNA
ucugauagcguaugucguuc

SEQ ID NO: 77678 - RNA, 20 nt, Artificial Sequence
  MKO10077678_B_Chn1
  gRNA
gugcacuuaaacuguacuuc

SEQ ID NO: 77679 - RNA, 20 nt, Artificial Sequence
  MKO10077679_B_Chn2
  gRNA
ggcucaucgcccagggaguc

SEQ ID NO: 77680 - RNA, 20 nt, Artificial Sequence
  MKO10077680_B_Chn2
  gRNA
ccugcaggauuaaagucaga

SEQ ID NO: 77681 - RNA, 20 nt, Artificial Sequence
  MKO10077681_B_Chn2
  gRNA
cuguucacagaucucuucac

SEQ ID NO: 77682 - RNA, 20 nt, Artificial Sequence
  MKO10077682_B_Chodl
  gRNA
cugggcaggcacccgauguu

SEQ ID NO: 77683 - RNA, 20 nt, Artificial Sequence
  MKO10077683_B_Chodl
  gRNA
agguagggaccuccuaggcc

SEQ ID NO: 77684 - RNA, 20 nt, Artificial Sequence
  MKO10077684_B_Chodl
  gRNA
ucagguugguuuguaagaua

SEQ ID NO: 77685 - RNA, 20 nt, Artificial Sequence
  MKO10077685_B_Chordc1
  gRNA
gauaaacuuaaacugucauc

SEQ ID NO: 77686 - RNA, 20 nt, Artificial Sequence
  MKO10077686_B_Chordc1
  gRNA
guuggucuugcuguaaaaga

SEQ ID NO: 77687 - RNA, 20 nt, Artificial Sequence
  MKO10077687_B_Chordc1
  gRNA
gaugcuugcacauaccaccc

SEQ ID NO: 77688 - RNA, 20 nt, Artificial Sequence
  MKO10077688_B_Chp1
  gRNA
cacucaccccucugagaaga

SEQ ID NO: 77689 - RNA, 20 nt, Artificial Sequence
  MKO10077689_B_Chp1
  gRNA
ggcucauuuccgacccauug

SEQ ID NO: 77690 - RNA, 20 nt, Artificial Sequence
  MKO10077690_B_Chp1
  gRNA
gcagccgggaagauuuccag

SEQ ID NO: 77691 - RNA, 20 nt, Artificial Sequence
  MKO10077691_B_Chp2
  gRNA
aucgggaugggaagaucucc

SEQ ID NO: 77692 - RNA, 20 nt, Artificial Sequence
  MKO10077692_B_Chp2
  gRNA
ggaagaagcugucuauaaug

SEQ ID NO: 77693 - RNA, 20 nt, Artificial Sequence
  MKO10077693_B_Chp2
  gRNA
cgccuagaccuccagcagau

SEQ ID NO: 77694 - RNA, 20 nt, Artificial Sequence
  MKO10077694_B_Chpf2
  gRNA
cgggggcagauuugaccggc

SEQ ID NO: 77695 - RNA, 20 nt, Artificial Sequence
  MKO10077695_B_Chpf2
  gRNA
gagugccuucgccguucacc

SEQ ID NO: 77696 - RNA, 20 nt, Artificial Sequence
  MKO10077696_B_Chpf2
  gRNA
acaguaucgcuccuucgaac

SEQ ID NO: 77697 - RNA, 20 nt, Artificial Sequence
  MKO10077697_B_Chpf
  gRNA
cggccgcaggacuucaucgg

SEQ ID NO: 77698 - RNA, 20 nt, Artificial Sequence
  MKO10077698_B_Chpf
  gRNA
gcgcagaaccucaaagcgug

SEQ ID NO: 77699 - RNA, 20 nt, Artificial Sequence
  MKO10077699_B_Chpf
  gRNA
agcccggauccgagcgcgag

SEQ ID NO: 77700 - RNA, 20 nt, Artificial Sequence
  MKO10077700_B_Chpt1
  gRNA
agcaacaaugugggacuaua

SEQ ID NO: 77701 - RNA, 20 nt, Artificial Sequence
  MKO10077701_B_Chpt1
  gRNA
agacgaucacuaaagcuacc

SEQ ID NO: 77702 - RNA, 20 nt, Artificial Sequence
  MKO10077702_B_Chpt1
  gRNA
gcuuccauugcuguucgccu

SEQ ID NO: 77703 - RNA, 20 nt, Artificial Sequence
  MKO10077703_B_Chrac1
  gRNA
uuacuagcuaaaaucuucuu

SEQ ID NO: 77704 - RNA, 20 nt, Artificial Sequence
  MKO10077704_B_Chrac1
  gRNA
aagcgaccuuggugaagccc

SEQ ID NO: 77705 - RNA, 20 nt, Artificial Sequence
  MKO10077705_B_Chrac1
  gRNA
cgacuuagccagcacugcag

SEQ ID NO: 77706 - RNA, 20 nt, Artificial Sequence
  MKO10077706_B_Chrdl1
  gRNA
ugagaaauggcaucccuacc

SEQ ID NO: 77707 - RNA, 20 nt, Artificial Sequence
  MKO10077707_B_Chrdl1
  gRNA
gaagacuuggacaucugacu

SEQ ID NO: 77708 - RNA, 20 nt, Artificial Sequence
  MKO10077708_B_Chrdl1
  gRNA
aacuggauuaccugggcagc

SEQ ID NO: 77709 - RNA, 20 nt, Artificial Sequence
  MKO10077709_B_Chrdl2
  gRNA
gucuuacaauacagcuacac

SEQ ID NO: 77710 - RNA, 20 nt, Artificial Sequence
  MKO10077710_B_Chrdl2
  gRNA
accuuugcaggucugacagc

SEQ ID NO: 77711 - RNA, 20 nt, Artificial Sequence
  MKO10077711_B_Chrdl2
  gRNA
aagcuacuuacccacacacc

SEQ ID NO: 77712 - RNA, 20 nt, Artificial Sequence
  MKO10077712_B_Chrd
  gRNA
ucuaugccuuggacgagacg

SEQ ID NO: 77713 - RNA, 20 nt, Artificial Sequence
  MKO10077713_B_Chrd
  gRNA
cagccucagugggcucgccg

SEQ ID NO: 77714 - RNA, 20 nt, Artificial Sequence
  MKO10077714_B_Chrd
  gRNA
cccuuggauacucgaagacc

SEQ ID NO: 77715 - RNA, 20 nt, Artificial Sequence
  MKO10077715_B_Chrm1
  gRNA
cagucauguguacgcuguac

SEQ ID NO: 77716 - RNA, 20 nt, Artificial Sequence
  MKO10077716_B_Chrm1
  gRNA
accaagaaaggccgagaccg

SEQ ID NO: 77717 - RNA, 20 nt, Artificial Sequence
  MKO10077717_B_Chrm1
  gRNA
gccagcgccgcuugucccag

SEQ ID NO: 77718 - RNA, 20 nt, Artificial Sequence
  MKO10077718_B_Chrm2
  gRNA
gaccuguagugugcgaccuu

SEQ ID NO: 77719 - RNA, 20 nt, Artificial Sequence
  MKO10077719_B_Chrm2
  gRNA
accgggucuugguuggccac

SEQ ID NO: 77720 - RNA, 20 nt, Artificial Sequence
  MKO10077720_B_Chrm2
  gRNA
gcaugaugauugcagcugcg

SEQ ID NO: 77721 - RNA, 20 nt, Artificial Sequence
  MKO10077721_B_Chrm3
  gRNA
acccggcagcuugaguacaa

SEQ ID NO: 77722 - RNA, 20 nt, Artificial Sequence
  MKO10077722_B_Chrm3
  gRNA
uaaugauguaggucgugaac

SEQ ID NO: 77723 - RNA, 20 nt, Artificial Sequence
  MKO10077723_B_Chrm3
  gRNA
cggcaacauccuugucauug

SEQ ID NO: 77724 - RNA, 20 nt, Artificial Sequence
  MKO10077724_B_Chrm4
  gRNA
uccucucgagaagcgccccc

SEQ ID NO: 77725 - RNA, 20 nt, Artificial Sequence
  MKO10077725_B_Chrm4
  gRNA
uguucacaagcaucgacccg

SEQ ID NO: 77726 - RNA, 20 nt, Artificial Sequence
  MKO10077726_B_Chrm4
  gRNA
cgugugcagaucucaucaua

SEQ ID NO: 77727 - RNA, 20 nt, Artificial Sequence
  MKO10077727_B_Chrm5
  gRNA
acgcuggguucucgggaguc

SEQ ID NO: 77728 - RNA, 20 nt, Artificial Sequence
  MKO10077728_B_Chrm5
  gRNA
gaccaagacauugccgacaa

SEQ ID NO: 77729 - RNA, 20 nt, Artificial Sequence
  MKO10077729_B_Chrm5
  gRNA
aguauggucaugacggagac

SEQ ID NO: 77730 - RNA, 20 nt, Artificial Sequence
  MKO10077730_B_Chrna10
  gRNA
cucaugacaagggcccgcug

SEQ ID NO: 77731 - RNA, 20 nt, Artificial Sequence
  MKO10077731_B_Chrna10
  gRNA
aauugcauccaagucaccgu

SEQ ID NO: 77732 - RNA, 20 nt, Artificial Sequence
  MKO10077732_B_Chrna10
  gRNA
ccccaaagccuacggugacu

SEQ ID NO: 77733 - RNA, 20 nt, Artificial Sequence
  MKO10077733_B_Chrna1
  gRNA
cuggaccuaugacggcucug

SEQ ID NO: 77734 - RNA, 20 nt, Artificial Sequence
  MKO10077734_B_Chrna1
  gRNA
uaccuguuucagacguacau

SEQ ID NO: 77735 - RNA, 20 nt, Artificial Sequence
  MKO10077735_B_Chrna1
  gRNA
gcugcaguucugcucaucga

SEQ ID NO: 77736 - RNA, 20 nt, Artificial Sequence
  MKO10077736_B_Chrna2
  gRNA
ggaaugacuacaagcugcgc

SEQ ID NO: 77737 - RNA, 20 nt, Artificial Sequence
  MKO10077737_B_Chrna2
  gRNA
ugaacaggcgguccucggca

SEQ ID NO: 77738 - RNA, 20 nt, Artificial Sequence
  MKO10077738_B_Chrna2
  gRNA
gcguccccucagagaugauc

SEQ ID NO: 77739 - RNA, 20 nt, Artificial Sequence
  MKO10077739_B_Chrna3
  gRNA
ucucguuguaaucuucaaac

SEQ ID NO: 77740 - RNA, 20 nt, Artificial Sequence
  MKO10077740_B_Chrna3
  gRNA
cucgcaugaacuccaccccu

SEQ ID NO: 77741 - RNA, 20 nt, Artificial Sequence
  MKO10077741_B_Chrna3
  gRNA
acccucugacuaccaagggg

SEQ ID NO: 77742 - RNA, 20 nt, Artificial Sequence
  MKO10077742_B_Chrna4
  gRNA
gugacauucucguagucacc

SEQ ID NO: 77743 - RNA, 20 nt, Artificial Sequence
  MKO10077743_B_Chrna4
  gRNA
ggcaugacuacaaacugcgc

SEQ ID NO: 77744 - RNA, 20 nt, Artificial Sequence
  MKO10077744_B_Chrna4
  gRNA
uaccugcuucacccacacgu

SEQ ID NO: 77745 - RNA, 20 nt, Artificial Sequence
  MKO10077745_B_Chrna5
  gRNA
uuaucaaacaaaacgauguc

SEQ ID NO: 77746 - RNA, 20 nt, Artificial Sequence
  MKO10077746_B_Chrna5
  gRNA
ccuugcaauaucucaguuag

SEQ ID NO: 77747 - RNA, 20 nt, Artificial Sequence
  MKO10077747_B_Chrna5
  gRNA
agcuaaugaccaccaacguc

SEQ ID NO: 77748 - RNA, 20 nt, Artificial Sequence
  MKO10077748_B_Chrna6
  gRNA
cagugcugucggcgacuucc

SEQ ID NO: 77749 - RNA, 20 nt, Artificial Sequence
  MKO10077749_B_Chrna6
  gRNA
cucacuacaaccgcuucauc

SEQ ID NO: 77750 - RNA, 20 nt, Artificial Sequence
  MKO10077750_B_Chrna6
  gRNA
ggaaggacuacagauugcgu

SEQ ID NO: 77751 - RNA, 20 nt, Artificial Sequence
  MKO10077751_B_Chrna7
  gRNA
uuggccaccggccucuccag

SEQ ID NO: 77752 - RNA, 20 nt, Artificial Sequence
  MKO10077752_B_Chrna7
  gRNA
agaugcauucaccaagacgu

SEQ ID NO: 77753 - RNA, 20 nt, Artificial Sequence
  MKO10077753_B_Chrna7
  gRNA
gaaugucugguuuccaaauc

SEQ ID NO: 77754 - RNA, 20 nt, Artificial Sequence
  MKO10077754_B_Chrna9
  gRNA
aagcccggccaguaccacac

SEQ ID NO: 77755 - RNA, 20 nt, Artificial Sequence
  MKO10077755_B_Chrna9
  gRNA
cgaugacgagucuucagagc

SEQ ID NO: 77756 - RNA, 20 nt, Artificial Sequence
  MKO10077756_B_Chrna9
  gRNA
ugaugagcccaucguaccgc

SEQ ID NO: 77757 - RNA, 20 nt, Artificial Sequence
  MKO10077757_B_Chrnb1
  gRNA
cgggaggugggagaccgcgu

SEQ ID NO: 77758 - RNA, 20 nt, Artificial Sequence
  MKO10077758_B_Chrnb1
  gRNA
ugggaccccgcagaacauga

SEQ ID NO: 77759 - RNA, 20 nt, Artificial Sequence
  MKO10077759_B_Chrnb1
  gRNA
ucugugcgcuggcaaccccc

SEQ ID NO: 77760 - RNA, 20 nt, Artificial Sequence
  MKO10077760_B_Chrnb2
  gRNA
gggaagauuaucgccucaca

SEQ ID NO: 77761 - RNA, 20 nt, Artificial Sequence
  MKO10077761_B_Chrnb2
  gRNA
agcucagagccauuaguagc

SEQ ID NO: 77762 - RNA, 20 nt, Artificial Sequence
  MKO10077762_B_Chrnb2
  gRNA
aaccugggucagccagacgu

SEQ ID NO: 77763 - RNA, 20 nt, Artificial Sequence
  MKO10077763_B_Chrnb3
  gRNA
ggacagaccaaaaauuacga

SEQ ID NO: 77764 - RNA, 20 nt, Artificial Sequence
  MKO10077764_B_Chrnb3
  gRNA
ugagagccaagaagacccgu

SEQ ID NO: 77765 - RNA, 20 nt, Artificial Sequence
  MKO10077765_B_Chrnb3
  gRNA
acgucaugacaggcuuccua

SEQ ID NO: 77766 - RNA, 20 nt, Artificial Sequence
  MKO10077766_B_Chrnb4
  gRNA
ggcggaucagguuguuguag

SEQ ID NO: 77767 - RNA, 20 nt, Artificial Sequence
  MKO10077767_B_Chrnb4
  gRNA
ggauuccugcaaagcgaguc

SEQ ID NO: 77768 - RNA, 20 nt, Artificial Sequence
  MKO10077768_B_Chrnb4
  gRNA
uuucccaggggacugccgcc

SEQ ID NO: 77769 - RNA, 20 nt, Artificial Sequence
  MKO10077769_B_Chrnd
  gRNA
ucaccuacuucccuuucgac

SEQ ID NO: 77770 - RNA, 20 nt, Artificial Sequence
  MKO10077770_B_Chrnd
  gRNA
cuacgacaaagaccugcggc

SEQ ID NO: 77771 - RNA, 20 nt, Artificial Sequence
  MKO10077771_B_Chrnd
  gRNA
agacccucaccaccaacgug

SEQ ID NO: 77772 - RNA, 20 nt, Artificial Sequence
  MKO10077772_B_Chrne
  gRNA
cacaaugccaauccagacac

SEQ ID NO: 77773 - RNA, 20 nt, Artificial Sequence
  MKO10077773_B_Chrne
  gRNA
cagcaauguucuagucuaug

SEQ ID NO: 77774 - RNA, 20 nt, Artificial Sequence
  MKO10077774_B_Chrne
  gRNA
gaucauaauugucgaagaga

SEQ ID NO: 77775 - RNA, 20 nt, Artificial Sequence
  MKO10077775_B_Chrng
  gRNA
acaucugagucgcgcucagc

SEQ ID NO: 77776 - RNA, 20 nt, Artificial Sequence
  MKO10077776_B_Chrng
  gRNA
ggugcgacuaucgccugcgc

SEQ ID NO: 77777 - RNA, 20 nt, Artificial Sequence
  MKO10077777_B_Chrng
  gRNA
cagccaguagauacaaccgu

SEQ ID NO: 77778 - RNA, 20 nt, Artificial Sequence
  MKO10077778_B_Chst10
  gRNA
guucaucacguugaccuuua

SEQ ID NO: 77779 - RNA, 20 nt, Artificial Sequence
  MKO10077779_B_Chst10
  gRNA
cacagacaaauauucgaucc

SEQ ID NO: 77780 - RNA, 20 nt, Artificial Sequence
  MKO10077780_B_Chst10
  gRNA
uccaggguauagugccaaac

SEQ ID NO: 77781 - RNA, 20 nt, Artificial Sequence
  MKO10077781_B_Chst11
  gRNA
gcagcagauguccacaccga

SEQ ID NO: 77782 - RNA, 20 nt, Artificial Sequence
  MKO10077782_B_Chst11
  gRNA
uuccaaaguauguugcaccc

SEQ ID NO: 77783 - RNA, 20 nt, Artificial Sequence
  MKO10077783_B_Chst11
  gRNA
agccaugaagccggcgcugc

SEQ ID NO: 77784 - RNA, 20 nt, Artificial Sequence
  MKO10077784_B_Chst12
  gRNA
cgaacugaaccaccugaucg

SEQ ID NO: 77785 - RNA, 20 nt, Artificial Sequence
  MKO10077785_B_Chst12
  gRNA
cuuccgcagcaaguucgagc

SEQ ID NO: 77786 - RNA, 20 nt, Artificial Sequence
  MKO10077786_B_Chst12
  gRNA
ccagauagacuaugacuucg

SEQ ID NO: 77787 - RNA, 20 nt, Artificial Sequence
  MKO10077787_B_Chst13
  gRNA
ccucacuccaccgaaccagc

SEQ ID NO: 77788 - RNA, 20 nt, Artificial Sequence
  MKO10077788_B_Chst13
  gRNA
cuugccggugguggcaaguc

SEQ ID NO: 77789 - RNA, 20 nt, Artificial Sequence
  MKO10077789_B_Chst13
  gRNA
ccuacagcuguugcgugacc

SEQ ID NO: 77790 - RNA, 20 nt, Artificial Sequence
  MKO10077790_B_Chst14
  gRNA
ccgaaauugucaggcgcuac

SEQ ID NO: 77791 - RNA, 20 nt, Artificial Sequence
  MKO10077791_B_Chst14
  gRNA
ggcggacauccacguuguuc

SEQ ID NO: 77792 - RNA, 20 nt, Artificial Sequence
  MKO10077792_B_Chst14
  gRNA
gaagggguuucaucuccgau

SEQ ID NO: 77793 - RNA, 20 nt, Artificial Sequence
  MKO10077793_B_Chst15
  gRNA
cucguaguccgucccgcagg

SEQ ID NO: 77794 - RNA, 20 nt, Artificial Sequence
  MKO10077794_B_Chst15
  gRNA
aggccagcgccucuacaaug

SEQ ID NO: 77795 - RNA, 20 nt, Artificial Sequence
  MKO10077795_B_Chst15
  gRNA
gagccuccgucacuuucucg

SEQ ID NO: 77796 - RNA, 20 nt, Artificial Sequence
  MKO10077796_B_Chst1
  gRNA
cagcuggugcgagacccucg

SEQ ID NO: 77797 - RNA, 20 nt, Artificial Sequence
  MKO10077797_B_Chst1
  gRNA
cuucucgcagugagaccuuc

SEQ ID NO: 77798 - RNA, 20 nt, Artificial Sequence
  MKO10077798_B_Chst1
  gRNA
acuggauccagaacaauacg

SEQ ID NO: 77799 - RNA, 20 nt, Artificial Sequence
  MKO10077799_B_Chst2
  gRNA
uugcgagcugacaccacgaa

SEQ ID NO: 77800 - RNA, 20 nt, Artificial Sequence
  MKO10077800_B_Chst2
  gRNA
gagcgcgguccgccaggcau

SEQ ID NO: 77801 - RNA, 20 nt, Artificial Sequence
  MKO10077801_B_Chst2
  gRNA
ucucuaccgcugcgaucuuu

SEQ ID NO: 77802 - RNA, 20 nt, Artificial Sequence
  MKO10077802_B_Chst3
  gRNA
guacacagccuaaagauucg

SEQ ID NO: 77803 - RNA, 20 nt, Artificial Sequence
  MKO10077803_B_Chst3
  gRNA
cauguaacgaccgcgcagcc

SEQ ID NO: 77804 - RNA, 20 nt, Artificial Sequence
  MKO10077804_B_Chst3
  gRNA
gugcacacccuucgucaaga

SEQ ID NO: 77805 - RNA, 20 nt, Artificial Sequence
  MKO10077805_B_Chst4
  gRNA
cccgggccguguuccgaucc

SEQ ID NO: 77806 - RNA, 20 nt, Artificial Sequence
  MKO10077806_B_Chst4
  gRNA
cugccgcucucacggcuucg

SEQ ID NO: 77807 - RNA, 20 nt, Artificial Sequence
  MKO10077807_B_Chst4
  gRNA
augccuuccauacuaacgcc

SEQ ID NO: 77808 - RNA, 20 nt, Artificial Sequence
  MKO10077808_B_Chst5
  gRNA
cuugcaagaucgcuaccgcc

SEQ ID NO: 77809 - RNA, 20 nt, Artificial Sequence
  MKO10077809_B_Chst5
  gRNA
ccggcugcgcguggucaacg

SEQ ID NO: 77810 - RNA, 20 nt, Artificial Sequence
  MKO10077810_B_Chst5
  gRNA
ugagcggaucaggucacgca

SEQ ID NO: 77811 - RNA, 20 nt, Artificial Sequence
  MKO10077811_B_Chst7
  gRNA
aacgcgacaggaagaccguc

SEQ ID NO: 77812 - RNA, 20 nt, Artificial Sequence
  MKO10077812_B_Chst7
  gRNA
cgcggacgugggacucgucg

SEQ ID NO: 77813 - RNA, 20 nt, Artificial Sequence
  MKO10077813_B_Chst7
  gRNA
acuugcggcacucggccucc

SEQ ID NO: 77814 - RNA, 20 nt, Artificial Sequence
  MKO10077814_B_Chst8
  gRNA
ccccggaugaccccacgacu

SEQ ID NO: 77815 - RNA, 20 nt, Artificial Sequence
  MKO10077815_B_Chst8
  gRNA
cagguauaaaguucagcauc

SEQ ID NO: 77816 - RNA, 20 nt, Artificial Sequence
  MKO10077816_B_Chst8
  gRNA
aacuuacaugcugggguugc

SEQ ID NO: 77817 - RNA, 20 nt, Artificial Sequence
  MKO10077817_B_Chst9
  gRNA
ccagaaacagaucacgaauc

SEQ ID NO: 77818 - RNA, 20 nt, Artificial Sequence
  MKO10077818_B_Chst9
  gRNA
gcccugcugucccaaacagc

SEQ ID NO: 77819 - RNA, 20 nt, Artificial Sequence
  MKO10077819_B_Chst9
  gRNA
ucuucauguacuugcaagca

SEQ ID NO: 77820 - RNA, 20 nt, Artificial Sequence
  MKO10077820_B_Chsy1
  gRNA
gcucgugcugggcuucgugc

SEQ ID NO: 77821 - RNA, 20 nt, Artificial Sequence
  MKO10077821_B_Chsy1
  gRNA
auaccugcagacccgcgccg

SEQ ID NO: 77822 - RNA, 20 nt, Artificial Sequence
  MKO10077822_B_Chsy1
  gRNA
gguggaguucuucucuagcg

SEQ ID NO: 77823 - RNA, 20 nt, Artificial Sequence
  MKO10077823_B_Chsy3
  gRNA
agaacucgacgucaaccguc

SEQ ID NO: 77824 - RNA, 20 nt, Artificial Sequence
  MKO10077824_B_Chsy3
  gRNA
ucacgcuccauccgaacaaa

SEQ ID NO: 77825 - RNA, 20 nt, Artificial Sequence
  MKO10077825_B_Chsy3
  gRNA
agguguguucgccguuucgg

SEQ ID NO: 77826 - RNA, 20 nt, Artificial Sequence
  MKO10077826_B_Chtf18
  gRNA
aucggacauacuggagggcg

SEQ ID NO: 77827 - RNA, 20 nt, Artificial Sequence
  MKO10077827_B_Chtf18
  gRNA
gacaguguccccaccagcga

SEQ ID NO: 77828 - RNA, 20 nt, Artificial Sequence
  MKO10077828_B_Chtf18
  gRNA
guuggccacagccucgccag

SEQ ID NO: 77829 - RNA, 20 nt, Artificial Sequence
  MKO10077829_B_Chtf8
  gRNA
ugauggcccacgaucagcac

SEQ ID NO: 77830 - RNA, 20 nt, Artificial Sequence
  MKO10077830_B_Chtf8
  gRNA
uggugcaaauuguuauuucc

SEQ ID NO: 77831 - RNA, 20 nt, Artificial Sequence
  MKO10077831_B_Chtf8
  gRNA
gggaaucccugugcugaucg

SEQ ID NO: 77832 - RNA, 20 nt, Artificial Sequence
  MKO10077832_B_Chtop
  gRNA
gucccccacguaguccuccu

SEQ ID NO: 77833 - RNA, 20 nt, Artificial Sequence
  MKO10077833_B_Chtop
  gRNA
auccagagaggcuugccccg

SEQ ID NO: 77834 - RNA, 20 nt, Artificial Sequence
  MKO10077834_B_Chtop
  gRNA
ggagaauagacccucugucc

SEQ ID NO: 77835 - RNA, 20 nt, Artificial Sequence
  MKO10077835_B_Chuk
  gRNA
aggccuuuacaacauucgca

SEQ ID NO: 77836 - RNA, 20 nt, Artificial Sequence
  MKO10077836_B_Chuk
  gRNA
guuccaaaaacagagagcga

SEQ ID NO: 77837 - RNA, 20 nt, Artificial Sequence
  MKO10077837_B_Chuk
  gRNA
aacaaaccagaaaauuguug

SEQ ID NO: 77838 - RNA, 20 nt, Artificial Sequence
  MKO10077838_B_Churc1
  gRNA
guauucucccugaugacccc

SEQ ID NO: 77839 - RNA, 20 nt, Artificial Sequence
  MKO10077839_B_Churc1
  gRNA
cgaguauacauucagcauca

SEQ ID NO: 77840 - RNA, 20 nt, Artificial Sequence
  MKO10077840_B_Churc1
  gRNA
accaugcugugucuguugug

SEQ ID NO: 77841 - RNA, 20 nt, Artificial Sequence
  MKO10077841_B_Ciao1
  gRNA
ggccccaucuggcaaccucu

SEQ ID NO: 77842 - RNA, 20 nt, Artificial Sequence
  MKO10077842_B_Ciao1
  gRNA
uguccucagcucucauacgc

SEQ ID NO: 77843 - RNA, 20 nt, Artificial Sequence
  MKO10077843_B_Ciao1
  gRNA
uugaugccaccacuuguauu

SEQ ID NO: 77844 - RNA, 20 nt, Artificial Sequence
  MKO10077844_B_Ciapin1
  gRNA
cugagauggcccggauccuc

SEQ ID NO: 77845 - RNA, 20 nt, Artificial Sequence
  MKO10077845_B_Ciapin1
  gRNA
ccucucagcaaaugacaugg

SEQ ID NO: 77846 - RNA, 20 nt, Artificial Sequence
  MKO10077846_B_Ciapin1
  gRNA
ugacucagugaagccuguug

SEQ ID NO: 77847 - RNA, 20 nt, Artificial Sequence
  MKO10077847_B_Cib1
  gRNA
augcagauucgcuccuugaa

SEQ ID NO: 77848 - RNA, 20 nt, Artificial Sequence
  MKO10077848_B_Cib1
  gRNA
ccugacguuccugaccaagc

SEQ ID NO: 77849 - RNA, 20 nt, Artificial Sequence
  MKO10077849_B_Cib1
  gRNA
uccuccacgguccgcugcuc

SEQ ID NO: 77850 - RNA, 20 nt, Artificial Sequence
  MKO10077850_B_Cib2
  gRNA
ccuggauggugacggcaagc

SEQ ID NO: 77851 - RNA, 20 nt, Artificial Sequence
  MKO10077851_B_Cib2
  gRNA
cucucaccuacccggagcuc

SEQ ID NO: 77852 - RNA, 20 nt, Artificial Sequence
  MKO10077852_B_Cib2
  gRNA
agaagacuuagagaugacgc

SEQ ID NO: 77853 - RNA, 20 nt, Artificial Sequence
  MKO10077853_B_Cib3
  gRNA
ggacuggucguguagucaag

SEQ ID NO: 77854 - RNA, 20 nt, Artificial Sequence
  MKO10077854_B_Cib3
  gRNA
ugcgagcuccagacuuccuc

SEQ ID NO: 77855 - RNA, 20 nt, Artificial Sequence
  MKO10077855_B_Cib3
  gRNA
gagcaugucagaugcggaug

SEQ ID NO: 77856 - RNA, 20 nt, Artificial Sequence
  MKO10077856_B_Cib4
  gRNA
gaguaugccuuucguaucua

SEQ ID NO: 77857 - RNA, 20 nt, Artificial Sequence
  MKO10077857_B_Cib4
  gRNA
gucuuagcacaaucuccucg

SEQ ID NO: 77858 - RNA, 20 nt, Artificial Sequence
  MKO10077858_B_Cib4
  gRNA
uccagacucacccucagagc

SEQ ID NO: 77859 - RNA, 20 nt, Artificial Sequence
  MKO10077859_B_Cic
  gRNA
aaaugucgaaccucguucug

SEQ ID NO: 77860 - RNA, 20 nt, Artificial Sequence
  MKO10077860_B_Cic
  gRNA
agaagaugagucucguuccu

SEQ ID NO: 77861 - RNA, 20 nt, Artificial Sequence
  MKO10077861_B_Cic
  gRNA
guugcucaugagcagccacc

SEQ ID NO: 77862 - RNA, 20 nt, Artificial Sequence
  MKO10077862_B_Cidea
  gRNA
uguaugugcccgcauagacc

SEQ ID NO: 77863 - RNA, 20 nt, Artificial Sequence
  MKO10077863_B_Cidea
  gRNA
gaaaugcguguugucccuua

SEQ ID NO: 77864 - RNA, 20 nt, Artificial Sequence
  MKO10077864_B_Cidea
  gRNA
gcgagcuggauguaugaggg

SEQ ID NO: 77865 - RNA, 20 nt, Artificial Sequence
  MKO10077865_B_Cideb
  gRNA
uccgcuuaugaucacagaca

SEQ ID NO: 77866 - RNA, 20 nt, Artificial Sequence
  MKO10077866_B_Cideb
  gRNA
agggggcugaucgauggcag

SEQ ID NO: 77867 - RNA, 20 nt, Artificial Sequence
  MKO10077867_B_Cideb
  gRNA
acgugucguccuccagcagc

SEQ ID NO: 77868 - RNA, 20 nt, Artificial Sequence
  MKO10077868_B_Cidec
  gRNA
gucguguuagcaccgcagau

SEQ ID NO: 77869 - RNA, 20 nt, Artificial Sequence
  MKO10077869_B_Cidec
  gRNA
aaggccgucaccuguucuga

SEQ ID NO: 77870 - RNA, 20 nt, Artificial Sequence
  MKO10077870_B_Cidec
  gRNA
ggaggaagauggcacaaucg

SEQ ID NO: 77871 - RNA, 20 nt, Artificial Sequence
  MKO10077871_B_Ciiua
  gRNA
auagagaucccuguagaagc

SEQ ID NO: 77872 - RNA, 20 nt, Artificial Sequence
  MKO10077872_B_Ciiua
  gRNA
ccaguucagcaagcuguugc

SEQ ID NO: 77873 - RNA, 20 nt, Artificial Sequence
  MKO10077873_B_Ciiua
  gRNA
uacugaagagguccuugcuc

SEQ ID NO: 77874 - RNA, 20 nt, Artificial Sequence
  MKO10077874_B_Cilp2
  gRNA
gugguucaacguggaucacc

SEQ ID NO: 77875 - RNA, 20 nt, Artificial Sequence
  MKO10077875_B_Cilp2
  gRNA
ggguguagcuccgacaccug

SEQ ID NO: 77876 - RNA, 20 nt, Artificial Sequence
  MKO10077876_B_Cilp2
  gRNA
ggcgagggcuggccgguauc

SEQ ID NO: 77877 - RNA, 20 nt, Artificial Sequence
  MKO10077877_B_Cilp
  gRNA
agcccucacggggacugccg

SEQ ID NO: 77878 - RNA, 20 nt, Artificial Sequence
  MKO10077878_B_Cilp
  gRNA
ccucacaaacuccgcauuga

SEQ ID NO: 77879 - RNA, 20 nt, Artificial Sequence
  MKO10077879_B_Cilp
  gRNA
gaucauaauuggggcaaacu

SEQ ID NO: 77880 - RNA, 20 nt, Artificial Sequence
  MKO10077880_B_Cinp
  gRNA
gcaggccaucuuggacggcu

SEQ ID NO: 77881 - RNA, 20 nt, Artificial Sequence
  MKO10077881_B_Cinp
  gRNA
ucuuaccaagccguccaaga

SEQ ID NO: 77882 - RNA, 20 nt, Artificial Sequence
  MKO10077882_B_Cinp
  gRNA
cugucuuaucagucagugcg

SEQ ID NO: 77883 - RNA, 20 nt, Artificial Sequence
  MKO10077883_B_Cir1
  gRNA
augcaaucaagaaaacaaag

SEQ ID NO: 77884 - RNA, 20 nt, Artificial Sequence
  MKO10077884_B_Cir1
  gRNA
gcaacaguaccuuaaagagc

SEQ ID NO: 77885 - RNA, 20 nt, Artificial Sequence
  MKO10077885_B_Cir1
  gRNA
cauacgacuccugcucuuua

SEQ ID NO: 77886 - RNA, 20 nt, Artificial Sequence
  MKO10077886_B_Cirbp
  gRNA
agggagacccagcgaucccg

SEQ ID NO: 77887 - RNA, 20 nt, Artificial Sequence
  MKO10077887_B_Cirbp
  gRNA
agcggccaccuccauagccc

SEQ ID NO: 77888 - RNA, 20 nt, Artificial Sequence
  MKO10077888_B_Cirbp
  gRNA
gagguggccgcuuugagucc

SEQ ID NO: 77889 - RNA, 20 nt, Artificial Sequence
  MKO10077889_B_Cirh1a
  gRNA
gguguugccuucuuguccga

SEQ ID NO: 77890 - RNA, 20 nt, Artificial Sequence
  MKO10077890_B_Cirh1a
  gRNA
agggagcauaauucguaaga

SEQ ID NO: 77891 - RNA, 20 nt, Artificial Sequence
  MKO10077891_B_Cirh1a
  gRNA
augccuuuggaggacccauc

SEQ ID NO: 77892 - RNA, 20 nt, Artificial Sequence
  MKO10077892_B_Cisd1
  gRNA
ggugcaugccuucgacaugg

SEQ ID NO: 77893 - RNA, 20 nt, Artificial Sequence
  MKO10077893_B_Cisd1
  gRNA
uccuaguuccccuucugcga

SEQ ID NO: 77894 - RNA, 20 nt, Artificial Sequence
  MKO10077894_B_Cisd1
  gRNA
uaugugagccccaucgcaga

SEQ ID NO: 77895 - RNA, 20 nt, Artificial Sequence
  MKO10077895_B_Cisd2
  gRNA
guuuaucucauucaccaccu

SEQ ID NO: 77896 - RNA, 20 nt, Artificial Sequence
  MKO10077896_B_Cisd2
  gRNA
gcuauacuucuuucuucuuc

SEQ ID NO: 77897 - RNA, 20 nt, Artificial Sequence
  MKO10077897_B_Cisd2
  gRNA
aauaagcauaaugaauugac

SEQ ID NO: 77898 - RNA, 20 nt, Artificial Sequence
  MKO10077898_B_Cisd3
  gRNA
cagcggcccccuuacuguga

SEQ ID NO: 77899 - RNA, 20 nt, Artificial Sequence
  MKO10077899_B_Cisd3
  gRNA
ucccuucccugaugggcuuc

SEQ ID NO: 77900 - RNA, 20 nt, Artificial Sequence
  MKO10077900_B_Cisd3
  gRNA
gagauuucccgccucugaua

SEQ ID NO: 77901 - RNA, 20 nt, Artificial Sequence
  MKO10077901_B_Cish
  gRNA
ggacaugguccuuugcguac

SEQ ID NO: 77902 - RNA, 20 nt, Artificial Sequence
  MKO10077902_B_Cish
  gRNA
cuguggagcaaauugggcgg

SEQ ID NO: 77903 - RNA, 20 nt, Artificial Sequence
  MKO10077903_B_Cish
  gRNA
gagacucaccagauucccga

SEQ ID NO: 77904 - RNA, 20 nt, Artificial Sequence
  MKO10077904_B_Cited1
  gRNA
ccugcacuugaugucaaggg

SEQ ID NO: 77905 - RNA, 20 nt, Artificial Sequence
  MKO10077905_B_Cited1
  gRNA
ugucgauccagaggagcuag

SEQ ID NO: 77906 - RNA, 20 nt, Artificial Sequence
  MKO10077906_B_Cited1
  gRNA
gucaccgccccucugguagu

SEQ ID NO: 77907 - RNA, 20 nt, Artificial Sequence
  MKO10077907_B_Cited2
  gRNA
aaccacgggcgcuuccccga

SEQ ID NO: 77908 - RNA, 20 nt, Artificial Sequence
  MKO10077908_B_Cited2
  gRNA
cgagcacauacacuacggcg

SEQ ID NO: 77909 - RNA, 20 nt, Artificial Sequence
  MKO10077909_B_Cited2
  gRNA
ggugcaaauccggcauguag

SEQ ID NO: 77910 - RNA, 20 nt, Artificial Sequence
  MKO10077910_B_Cited4
  gRNA
caccgagcucaucgacgaag

SEQ ID NO: 77911 - RNA, 20 nt, Artificial Sequence
  MKO10077911_B_Cited4
  gRNA
cggacucugcagccauacgc

SEQ ID NO: 77912 - RNA, 20 nt, Artificial Sequence
  MKO10077912_B_Cited4
  gRNA
acgucgcuggaacucgagcu

SEQ ID NO: 77913 - RNA, 20 nt, Artificial Sequence
  MKO10077913_B_Cit
  gRNA
ccaguuacaguacgccuuuc

SEQ ID NO: 77914 - RNA, 20 nt, Artificial Sequence
  MKO10077914_B_Cit
  gRNA
ggaucaugcucucaucuaau

SEQ ID NO: 77915 - RNA, 20 nt, Artificial Sequence
  MKO10077915_B_Cit
  gRNA
acucuucaaagagagcgaag

SEQ ID NO: 77916 - RNA, 20 nt, Artificial Sequence
  MKO10077916_B_Ciz1
  gRNA
gcagagacugucgaguagcc

SEQ ID NO: 77917 - RNA, 20 nt, Artificial Sequence
  MKO10077917_B_Ciz1
  gRNA
ccauaccuugcaacugcugu

SEQ ID NO: 77918 - RNA, 20 nt, Artificial Sequence
  MKO10077918_B_Ciz1
  gRNA
cacucgaccucccugcucaa

SEQ ID NO: 77919 - RNA, 20 nt, Artificial Sequence
  MKO10077919_B_Ckap2l
  gRNA
ggcagccaagggaaagcuaa

SEQ ID NO: 77920 - RNA, 20 nt, Artificial Sequence
  MKO10077920_B_Ckap2l
  gRNA
ugguuuggggcagauauucu

SEQ ID NO: 77921 - RNA, 20 nt, Artificial Sequence
  MKO10077921_B_Ckap2l
  gRNA
ucuuucaaugcucuuccaga

SEQ ID NO: 77922 - RNA, 20 nt, Artificial Sequence
  MKO10077922_B_Ckap2
  gRNA
uaguccaaaaggacccaacu

SEQ ID NO: 77923 - RNA, 20 nt, Artificial Sequence
  MKO10077923_B_Ckap2
  gRNA
aacaagaaaaucagauaucc

SEQ ID NO: 77924 - RNA, 20 nt, Artificial Sequence
  MKO10077924_B_Ckap2
  gRNA
ucagaaaaugauaacaucug

SEQ ID NO: 77925 - RNA, 20 nt, Artificial Sequence
  MKO10077925_B_Ckap4
  gRNA
ucuguagaacuucgcuaauu

SEQ ID NO: 77926 - RNA, 20 nt, Artificial Sequence
  MKO10077926_B_Ckap4
  gRNA
ugacguggcgaagaagccgc

SEQ ID NO: 77927 - RNA, 20 nt, Artificial Sequence
  MKO10077927_B_Ckap4
  gRNA
cccucugacgggagaagucc

SEQ ID NO: 77928 - RNA, 20 nt, Artificial Sequence
  MKO10077928_B_Ckap5
  gRNA
ucucgagauucaaauaguuu

SEQ ID NO: 77929 - RNA, 20 nt, Artificial Sequence
  MKO10077929_B_Ckap5
  gRNA
uguucacauuucugaucaac

SEQ ID NO: 77930 - RNA, 20 nt, Artificial Sequence
  MKO10077930_B_Ckap5
  gRNA
guugaaaaugcucauguugc

SEQ ID NO: 77931 - RNA, 20 nt, Artificial Sequence
  MKO10077931_B_Ckb
  gRNA
uaccauaugccacgagcauc

SEQ ID NO: 77932 - RNA, 20 nt, Artificial Sequence
  MKO10077932_B_Ckb
  gRNA
ccuccggcauggcccgggac

SEQ ID NO: 77933 - RNA, 20 nt, Artificial Sequence
  MKO10077933_B_Ckb
  gRNA
ccacccguacaucaugacug

SEQ ID NO: 77934 - RNA, 20 nt, Artificial Sequence
  MKO10077934_B_Cklf
  gRNA
uuaggauguuauuaacucaa

SEQ ID NO: 77935 - RNA, 20 nt, Artificial Sequence
  MKO10077935_B_Cklf
  gRNA
gcauuucagaguacagcaga

SEQ ID NO: 77936 - RNA, 20 nt, Artificial Sequence
  MKO10077936_B_Cklf
  gRNA
uccaaggauugucuuuguug

SEQ ID NO: 77937 - RNA, 20 nt, Artificial Sequence
  MKO10077937_B_Ckmt1
  gRNA
uaccagaucccucgagcauc

SEQ ID NO: 77938 - RNA, 20 nt, Artificial Sequence
  MKO10077938_B_Ckmt1
  gRNA
cagagccgugcauagacugc

SEQ ID NO: 77939 - RNA, 20 nt, Artificial Sequence
  MKO10077939_B_Ckmt1
  gRNA
uugacccugugauccaagag

SEQ ID NO: 77940 - RNA, 20 nt, Artificial Sequence
  MKO10077940_B_Ckmt2
  gRNA
cccgugacuggccugaugcc

SEQ ID NO: 77941 - RNA, 20 nt, Artificial Sequence
  MKO10077941_B_Ckmt2
  gRNA
guaggaugcuucaucacccu

SEQ ID NO: 77942 - RNA, 20 nt, Artificial Sequence
  MKO10077942_B_Ckmt2
  gRNA
ugucaucuuguuucggaguu

SEQ ID NO: 77943 - RNA, 20 nt, Artificial Sequence
  MKO10077943_B_Ckm
  gRNA
cagguccuugaagaccgugu

SEQ ID NO: 77944 - RNA, 20 nt, Artificial Sequence
  MKO10077944_B_Ckm
  gRNA
cgcucuccacgggagcagug

SEQ ID NO: 77945 - RNA, 20 nt, Artificial Sequence
  MKO10077945_B_Ckm
  gRNA
uccccaggguggagacgacc

SEQ ID NO: 77946 - RNA, 20 nt, Artificial Sequence
  MKO10077946_B_Cks1b
  gRNA
cgucggaacaguaagaugug

SEQ ID NO: 77947 - RNA, 20 nt, Artificial Sequence
  MKO10077947_B_Cks1b
  gRNA
acgacgaggaguucgaauac

SEQ ID NO: 77948 - RNA, 20 nt, Artificial Sequence
  MKO10077948_B_Cks1b
  gRNA
ccacaaacaaaucuacuauu

SEQ ID NO: 77949 - RNA, 20 nt, Artificial Sequence
  MKO10077949_B_Cks2
  gRNA
gaacccauccuagacucugu

SEQ ID NO: 77950 - RNA, 20 nt, Artificial Sequence
  MKO10077950_B_Cks2
  gRNA
cgucuaaagagaagaauaug

SEQ ID NO: 77951 - RNA, 20 nt, Artificial Sequence
  MKO10077951_B_Cks2
  gRNA
aacucaucugauguccgaag

SEQ ID NO: 77952 - RNA, 20 nt, Artificial Sequence
  MKO10077952_B_Clasp1
  gRNA
uggauggacucgcuaccucu

SEQ ID NO: 77953 - RNA, 20 nt, Artificial Sequence
  MKO10077953_B_Clasp1
  gRNA
cauggacauccugucggcac

SEQ ID NO: 77954 - RNA, 20 nt, Artificial Sequence
  MKO10077954_B_Clasp1
  gRNA
gcggagugaugaucuacaac

SEQ ID NO: 77955 - RNA, 20 nt, Artificial Sequence
  MKO10077955_B_Clasp2
  gRNA
aaggcugaagcagcugacga

SEQ ID NO: 77956 - RNA, 20 nt, Artificial Sequence
  MKO10077956_B_Clasp2
  gRNA
aagagacguuaaauaagauc

SEQ ID NO: 77957 - RNA, 20 nt, Artificial Sequence
  MKO10077957_B_Clasp2
  gRNA
ggaaaccuuaccugaacaga

SEQ ID NO: 77958 - RNA, 20 nt, Artificial Sequence
  MKO10077958_B_Clasrp
  gRNA
gaugugcacgaacaucaaag

SEQ ID NO: 77959 - RNA, 20 nt, Artificial Sequence
  MKO10077959_B_Clasrp
  gRNA
acguacaugguggugagcag

SEQ ID NO: 77960 - RNA, 20 nt, Artificial Sequence
  MKO10077960_B_Clasrp
  gRNA
agaccccgcucaguuccugc

SEQ ID NO: 77961 - RNA, 20 nt, Artificial Sequence
  MKO10077961_B_Clca1
  gRNA
uucugaaauaaacucuuccu

SEQ ID NO: 77962 - RNA, 20 nt, Artificial Sequence
  MKO10077962_B_Clca1
  gRNA
uuaggcagacgucauaguug

SEQ ID NO: 77963 - RNA, 20 nt, Artificial Sequence
  MKO10077963_B_Clca1
  gRNA
uacgcaaguuaucagugagu

SEQ ID NO: 77964 - RNA, 20 nt, Artificial Sequence
  MKO10077964_B_Clca2
  gRNA
uucuuucuagaaauguagaa

SEQ ID NO: 77965 - RNA, 20 nt, Artificial Sequence
  MKO10077965_B_Clca2
  gRNA
uccugaaauaaacucuuccu

SEQ ID NO: 77966 - RNA, 20 nt, Artificial Sequence
  MKO10077966_B_Clca2
  gRNA
uuaggcagacgucauaguug

SEQ ID NO: 77967 - RNA, 20 nt, Artificial Sequence
  MKO10077967_B_Clca3
  gRNA
gugagcccacucauggacaa

SEQ ID NO: 77968 - RNA, 20 nt, Artificial Sequence
  MKO10077968_B_Clca3
  gRNA
uagggcucaucauugccuag

SEQ ID NO: 77969 - RNA, 20 nt, Artificial Sequence
  MKO10077969_B_Clca3
  gRNA
gagaaguucuacuuauccaa

SEQ ID NO: 77970 - RNA, 20 nt, Artificial Sequence
  MKO10077970_B_Clca4
  gRNA
agaacacugucgaagcaaca

SEQ ID NO: 77971 - RNA, 20 nt, Artificial Sequence
  MKO10077971_B_Clca4
  gRNA
uggucauaugauucuuguuu

SEQ ID NO: 77972 - RNA, 20 nt, Artificial Sequence
  MKO10077972_B_Clca4
  gRNA
aguauuugaugaguauaaca

SEQ ID NO: 77973 - RNA, 20 nt, Artificial Sequence
  MKO10077973_B_Clca5
  gRNA
accucgcgcaccauagccug

SEQ ID NO: 77974 - RNA, 20 nt, Artificial Sequence
  MKO10077974_B_Clca5
  gRNA
gacaaaccguucuacgugaa

SEQ ID NO: 77975 - RNA, 20 nt, Artificial Sequence
  MKO10077975_B_Clca5
  gRNA
agguguucaucugacauuac

SEQ ID NO: 77976 - RNA, 20 nt, Artificial Sequence
  MKO10077976_B_Clca6
  gRNA
uucacacugugugaauugcc

SEQ ID NO: 77977 - RNA, 20 nt, Artificial Sequence
  MKO10077977_B_Clca6
  gRNA
uugccuuacaggaaaagugu

SEQ ID NO: 77978 - RNA, 20 nt, Artificial Sequence
  MKO10077978_B_Clca6
  gRNA
gggcucaucucugcccucaa

SEQ ID NO: 77979 - RNA, 20 nt, Artificial Sequence
  MKO10077979_B_Clcc1
  gRNA
gcuuccacuccucuccgcug

SEQ ID NO: 77980 - RNA, 20 nt, Artificial Sequence
  MKO10077980_B_Clcc1
  gRNA
cuuaacuaugacgcugcuuc

SEQ ID NO: 77981 - RNA, 20 nt, Artificial Sequence
  MKO10077981_B_Clcc1
  gRNA
uuuagauaucuccugaaaac

SEQ ID NO: 77982 - RNA, 20 nt, Artificial Sequence
  MKO10077982_B_Clcf1
  gRNA
ccuauucacaggggacucgu

SEQ ID NO: 77983 - RNA, 20 nt, Artificial Sequence
  MKO10077983_B_Clcf1
  gRNA
agccccauggaccuccgagc

SEQ ID NO: 77984 - RNA, 20 nt, Artificial Sequence
  MKO10077984_B_Clcf1
  gRNA
ccuaccugcucggaggucca

SEQ ID NO: 77985 - RNA, 20 nt, Artificial Sequence
  MKO10077985_B_Clcn1
  gRNA
uccugauggcucuagucagc

SEQ ID NO: 77986 - RNA, 20 nt, Artificial Sequence
  MKO10077986_B_Clcn1
  gRNA
cgggggaaugcccaagaaga

SEQ ID NO: 77987 - RNA, 20 nt, Artificial Sequence
  MKO10077987_B_Clcn1
  gRNA
caccuugacauuuagaauag

SEQ ID NO: 77988 - RNA, 20 nt, Artificial Sequence
  MKO10077988_B_Clcn2
  gRNA
cuuucagcaccacuccccga

SEQ ID NO: 77989 - RNA, 20 nt, Artificial Sequence
  MKO10077989_B_Clcn2
  gRNA
cuggaucuuacugcgacauc

SEQ ID NO: 77990 - RNA, 20 nt, Artificial Sequence
  MKO10077990_B_Clcn2
  gRNA
uguccagggucggugaagac

SEQ ID NO: 77991 - RNA, 20 nt, Artificial Sequence
  MKO10077991_B_Clcn3
  gRNA
caaaaagucuguaugacgcc

SEQ ID NO: 77992 - RNA, 20 nt, Artificial Sequence
  MKO10077992_B_Clcn3
  gRNA
auggcuuguuguuacacuga

SEQ ID NO: 77993 - RNA, 20 nt, Artificial Sequence
  MKO10077993_B_Clcn3
  gRNA
guuaaucauuggccaagcag

SEQ ID NO: 77994 - RNA, 20 nt, Artificial Sequence
  MKO10077994_B_Clcn4-2
  gRNA
guguucgcaccguaugccug

SEQ ID NO: 77995 - RNA, 20 nt, Artificial Sequence
  MKO10077995_B_Clcn4-2
  gRNA
ucaucgaucucgcuguggau

SEQ ID NO: 77996 - RNA, 20 nt, Artificial Sequence
  MKO10077996_B_Clcn4-2
  gRNA
gggucugucuguccgcauuc

SEQ ID NO: 77997 - RNA, 20 nt, Artificial Sequence
  MKO10077997_B_Clcn5
  gRNA
aucgcucacacugugaauua

SEQ ID NO: 77998 - RNA, 20 nt, Artificial Sequence
  MKO10077998_B_Clcn5
  gRNA
agugagcagagaugucuauc

SEQ ID NO: 77999 - RNA, 20 nt, Artificial Sequence
  MKO10077999_B_Clcn5
  gRNA
agugugagcgaugcuuucuc

SEQ ID NO: 78000 - RNA, 20 nt, Artificial Sequence
  MKO10078000_B_Clcn6
  gRNA
cugcaucaaugacccuuacc

SEQ ID NO: 78001 - RNA, 20 nt, Artificial Sequence
  MKO10078001_B_Clcn6
  gRNA
ugagcucaccuuauuaucca

SEQ ID NO: 78002 - RNA, 20 nt, Artificial Sequence
  MKO10078002_B_Clcn6
  gRNA
cucuucacccaacugaaguu

SEQ ID NO: 78003 - RNA, 20 nt, Artificial Sequence
  MKO10078003_B_Clcn7
  gRNA
gagaggagcuucucguugug

SEQ ID NO: 78004 - RNA, 20 nt, Artificial Sequence
  MKO10078004_B_Clcn7
  gRNA
cauucugcacuguuccgaau

SEQ ID NO: 78005 - RNA, 20 nt, Artificial Sequence
  MKO10078005_B_Clcn7
  gRNA
gagagcccaccucauacuug

SEQ ID NO: 78006 - RNA, 20 nt, Artificial Sequence
  MKO10078006_B_Clcnka
  gRNA
cagagcauuacgcccuucuc

SEQ ID NO: 78007 - RNA, 20 nt, Artificial Sequence
  MKO10078007_B_Clcnka
  gRNA
ccuuaccucaguauccccga

SEQ ID NO: 78008 - RNA, 20 nt, Artificial Sequence
  MKO10078008_B_Clcnka
  gRNA
caggacuacuccagacagca

SEQ ID NO: 78009 - RNA, 20 nt, Artificial Sequence
  MKO10078009_B_Clcnkb
  gRNA
gaagaccaucuugaccggag

SEQ ID NO: 78010 - RNA, 20 nt, Artificial Sequence
  MKO10078010_B_Clcnkb
  gRNA
gaaagagcggcucuuccgug

SEQ ID NO: 78011 - RNA, 20 nt, Artificial Sequence
  MKO10078011_B_Clcnkb
  gRNA
uagcacacaaguggcuguac

SEQ ID NO: 78012 - RNA, 20 nt, Artificial Sequence
  MKO10078012_B_Cldn10
  gRNA
accaaguaucaaggcggaga

SEQ ID NO: 78013 - RNA, 20 nt, Artificial Sequence
  MKO10078013_B_Cldn10
  gRNA
uugaucugagccuccgacuu

SEQ ID NO: 78014 - RNA, 20 nt, Artificial Sequence
  MKO10078014_B_Cldn10
  gRNA
uccuucuccgccuugauacu

SEQ ID NO: 78015 - RNA, 20 nt, Artificial Sequence
  MKO10078015_B_Cldn11
  gRNA
ugacgaaacccaccaccuga

SEQ ID NO: 78016 - RNA, 20 nt, Artificial Sequence
  MKO10078016_B_Cldn11
  gRNA
cuccaggcucguggcccauu

SEQ ID NO: 78017 - RNA, 20 nt, Artificial Sequence
  MKO10078017_B_Cldn11
  gRNA
cuuguucccaggcuacgugc

SEQ ID NO: 78018 - RNA, 20 nt, Artificial Sequence
  MKO10078018_B_Cldn12
  gRNA
ucucagcaucgugaucgcaa

SEQ ID NO: 78019 - RNA, 20 nt, Artificial Sequence
  MKO10078019_B_Cldn12
  gRNA
uuccgugccuaacaucaaac

SEQ ID NO: 78020 - RNA, 20 nt, Artificial Sequence
  MKO10078020_B_Cldn12
  gRNA
ccgcuguacucucacgcucc

SEQ ID NO: 78021 - RNA, 20 nt, Artificial Sequence
  MKO10078021_B_Cldn13
  gRNA
uguccugugcuaccaguauc

SEQ ID NO: 78022 - RNA, 20 nt, Artificial Sequence
  MKO10078022_B_Cldn13
  gRNA
aaaagugucucgagucuuua

SEQ ID NO: 78023 - RNA, 20 nt, Artificial Sequence
  MKO10078023_B_Cldn13
  gRNA
ugagcugcgugcugcccguu

SEQ ID NO: 78024 - RNA, 20 nt, Artificial Sequence
  MKO10078024_B_Cldn14
  gRNA
auucugcaccacgucauucg

SEQ ID NO: 78025 - RNA, 20 nt, Artificial Sequence
  MKO10078025_B_Cldn14
  gRNA
gucuguagggggccucgucc

SEQ ID NO: 78026 - RNA, 20 nt, Artificial Sequence
  MKO10078026_B_Cldn14
  gRNA
gacugccguauccuaccuga

SEQ ID NO: 78027 - RNA, 20 nt, Artificial Sequence
  MKO10078027_B_Cldn15
  gRNA
gagauccauguugcccacgu

SEQ ID NO: 78028 - RNA, 20 nt, Artificial Sequence
  MKO10078028_B_Cldn15
  gRNA
aggcacuccagcccaaguag

SEQ ID NO: 78029 - RNA, 20 nt, Artificial Sequence
  MKO10078029_B_Cldn15
  gRNA
cgagauagccaccaucccac

SEQ ID NO: 78030 - RNA, 20 nt, Artificial Sequence
  MKO10078030_B_Cldn16
  gRNA
uauauuguguaaaacgagag

SEQ ID NO: 78031 - RNA, 20 nt, Artificial Sequence
  MKO10078031_B_Cldn16
  gRNA
acuuuaauuugugggucauc

SEQ ID NO: 78032 - RNA, 20 nt, Artificial Sequence
  MKO10078032_B_Cldn16
  gRNA
guccgccuuugcuuuguugc

SEQ ID NO: 78033 - RNA, 20 nt, Artificial Sequence
  MKO10078033_B_Cldn17
  gRNA
uacgacccaaccguucaugc

SEQ ID NO: 78034 - RNA, 20 nt, Artificial Sequence
  MKO10078034_B_Cldn17
  gRNA
aaguaagccuuagacguagc

SEQ ID NO: 78035 - RNA, 20 nt, Artificial Sequence
  MKO10078035_B_Cldn17
  gRNA
ugcauaccgcgugccacaga

SEQ ID NO: 78036 - RNA, 20 nt, Artificial Sequence
  MKO10078036_B_Cldn18
  gRNA
agcggguuaccuggucugaa

SEQ ID NO: 78037 - RNA, 20 nt, Artificial Sequence
  MKO10078037_B_Cldn18
  gRNA
augaugugcaucgccugccg

SEQ ID NO: 78038 - RNA, 20 nt, Artificial Sequence
  MKO10078038_B_Cldn18
  gRNA
ggugaaguauggccggcacu

SEQ ID NO: 78039 - RNA, 20 nt, Artificial Sequence
  MKO10078039_B_Cldn19
  gRNA
caaacucuacgauucacucc

SEQ ID NO: 78040 - RNA, 20 nt, Artificial Sequence
  MKO10078040_B_Cldn19
  gRNA
ggagcacagccacgaccauc

SEQ ID NO: 78041 - RNA, 20 nt, Artificial Sequence
  MKO10078041_B_Cldn19
  gRNA
ccccacugccaagagccgug

SEQ ID NO: 78042 - RNA, 20 nt, Artificial Sequence
  MKO10078042_B_Cldn1
  gRNA
ggacaacaucgugaccgcuc

SEQ ID NO: 78043 - RNA, 20 nt, Artificial Sequence
  MKO10078043_B_Cldn1
  gRNA
cagcggcccagccaguaaag

SEQ ID NO: 78044 - RNA, 20 nt, Artificial Sequence
  MKO10078044_B_Cldn1
  gRNA
agauugcgaucagccccagc

SEQ ID NO: 78045 - RNA, 20 nt, Artificial Sequence
  MKO10078045_B_Cldn20
  gRNA
ccguccaugugcagacugcg

SEQ ID NO: 78046 - RNA, 20 nt, Artificial Sequence
  MKO10078046_B_Cldn20
  gRNA
ccgaaauaaacccaauguac

SEQ ID NO: 78047 - RNA, 20 nt, Artificial Sequence
  MKO10078047_B_Cldn20
  gRNA
aguaacaucauggccucggc

SEQ ID NO: 78048 - RNA, 20 nt, Artificial Sequence
  MKO10078048_B_Cldn22
  gRNA
uuacaaacuacuugccgcac

SEQ ID NO: 78049 - RNA, 20 nt, Artificial Sequence
  MKO10078049_B_Cldn22
  gRNA
agugcggcaaguaguuugua

SEQ ID NO: 78050 - RNA, 20 nt, Artificial Sequence
  MKO10078050_B_Cldn22
  gRNA
aggauaaaacccaucccagc

SEQ ID NO: 78051 - RNA, 20 nt, Artificial Sequence
  MKO10078051_B_Cldn23
  gRNA
gcguugucgccgcugucgca

SEQ ID NO: 78052 - RNA, 20 nt, Artificial Sequence
  MKO10078052_B_Cldn23
  gRNA
ugagccccacuacgggcuag

SEQ ID NO: 78053 - RNA, 20 nt, Artificial Sequence
  MKO10078053_B_Cldn23
  gRNA
aagauuaagcagcaacccgc

SEQ ID NO: 78054 - RNA, 20 nt, Artificial Sequence
  MKO10078054_B_Cldn24
  gRNA
ugcaggagcugggcucgagc

SEQ ID NO: 78055 - RNA, 20 nt, Artificial Sequence
  MKO10078055_B_Cldn24
  gRNA
cuuccagugugguagauaug

SEQ ID NO: 78056 - RNA, 20 nt, Artificial Sequence
  MKO10078056_B_Cldn24
  gRNA
uuaccacauaucuaccacac

SEQ ID NO: 78057 - RNA, 20 nt, Artificial Sequence
  MKO10078057_B_Cldn25
  gRNA
cacacgauaagccuucauua

SEQ ID NO: 78058 - RNA, 20 nt, Artificial Sequence
  MKO10078058_B_Cldn25
  gRNA
gccccaagcugccguuguau

SEQ ID NO: 78059 - RNA, 20 nt, Artificial Sequence
  MKO10078059_B_Cldn25
  gRNA
gaugccgcuauugugguugc

SEQ ID NO: 78060 - RNA, 20 nt, Artificial Sequence
  MKO10078060_B_Cldn26
  gRNA
caucaucgacaccgagaggc

SEQ ID NO: 78061 - RNA, 20 nt, Artificial Sequence
  MKO10078061_B_Cldn26
  gRNA
gccacucagucugaucguga

SEQ ID NO: 78062 - RNA, 20 nt, Artificial Sequence
  MKO10078062_B_Cldn26
  gRNA
cugggagaugcgggugcgcc

SEQ ID NO: 78063 - RNA, 20 nt, Artificial Sequence
  MKO10078063_B_Cldn2
  gRNA
ggguacuguagauaucgcac

SEQ ID NO: 78064 - RNA, 20 nt, Artificial Sequence
  MKO10078064_B_Cldn2
  gRNA
acgauugcccuggggcgagc

SEQ ID NO: 78065 - RNA, 20 nt, Artificial Sequence
  MKO10078065_B_Cldn2
  gRNA
ucgggacuucuacucgccgc

SEQ ID NO: 78066 - RNA, 20 nt, Artificial Sequence
  MKO10078066_B_Cldn3
  gRNA
cgaccaggacaccgguacua

SEQ ID NO: 78067 - RNA, 20 nt, Artificial Sequence
  MKO10078067_B_Cldn3
  gRNA
ccgaaacgcgccacauggga

SEQ ID NO: 78068 - RNA, 20 nt, Artificial Sequence
  MKO10078068_B_Cldn3
  gRNA
caaaauguacgacucgcugc

SEQ ID NO: 78069 - RNA, 20 nt, Artificial Sequence
  MKO10078069_B_Cldn4
  gRNA
uagggcuugucguugcuacg

SEQ ID NO: 78070 - RNA, 20 nt, Artificial Sequence
  MKO10078070_B_Cldn4
  gRNA
ugaguugugcgcuccccaug

SEQ ID NO: 78071 - RNA, 20 nt, Artificial Sequence
  MKO10078071_B_Cldn4
  gRNA
uccggcggugaucaugaucu

SEQ ID NO: 78072 - RNA, 20 nt, Artificial Sequence
  MKO10078072_B_Cldn5
  gRNA
gccucguguguugcggcgcc

SEQ ID NO: 78073 - RNA, 20 nt, Artificial Sequence
  MKO10078073_B_Cldn5
  gRNA
cuucuugucguaaucgccau

SEQ ID NO: 78074 - RNA, 20 nt, Artificial Sequence
  MKO10078074_B_Cldn5
  gRNA
cgcggcgcagaguacuugac

SEQ ID NO: 78075 - RNA, 20 nt, Artificial Sequence
  MKO10078075_B_Cldn6
  gRNA
ugaugcucaaaagcgggagc

SEQ ID NO: 78076 - RNA, 20 nt, Artificial Sequence
  MKO10078076_B_Cldn6
  gRNA
ucggaggguccccgagaaug

SEQ ID NO: 78077 - RNA, 20 nt, Artificial Sequence
  MKO10078077_B_Cldn6
  gRNA
ccaggacuucuacaaccccu

SEQ ID NO: 78078 - RNA, 20 nt, Artificial Sequence
  MKO10078078_B_Cldn7
  gRNA
caccaccauuaaggcucgag

SEQ ID NO: 78079 - RNA, 20 nt, Artificial Sequence
  MKO10078079_B_Cldn7
  gRNA
accugccaucuuuaucggcu

SEQ ID NO: 78080 - RNA, 20 nt, Artificial Sequence
  MKO10078080_B_Cldn7
  gRNA
ggagacuuacuuaacguuca

SEQ ID NO: 78081 - RNA, 20 nt, Artificial Sequence
  MKO10078081_B_Cldn8
  gRNA
cucaucgucccccgugcauc

SEQ ID NO: 78082 - RNA, 20 nt, Artificial Sequence
  MKO10078082_B_Cldn8
  gRNA
aacuccguugaguggugcga

SEQ ID NO: 78083 - RNA, 20 nt, Artificial Sequence
  MKO10078083_B_Cldn8
  gRNA
cuucucccagcucgcgcuuu

SEQ ID NO: 78084 - RNA, 20 nt, Artificial Sequence
  MKO10078084_B_Cldn9
  gRNA
cgcccgugauagccaccagc

SEQ ID NO: 78085 - RNA, 20 nt, Artificial Sequence
  MKO10078085_B_Cldn9
  gRNA
cggggacgcucaaaguguga

SEQ ID NO: 78086 - RNA, 20 nt, Artificial Sequence
  MKO10078086_B_Cldn9
  gRNA
cguauacuuugcacugcauc

SEQ ID NO: 78087 - RNA, 20 nt, Artificial Sequence
  MKO10078087_B_Cldnd2
  gRNA
ugccaacaccaugcacgcug

SEQ ID NO: 78088 - RNA, 20 nt, Artificial Sequence
  MKO10078088_B_Cldnd2
  gRNA
ggugcucugcaagaucaugu

SEQ ID NO: 78089 - RNA, 20 nt, Artificial Sequence
  MKO10078089_B_Cldnd2
  gRNA
ggcaguguccgcagcgugca

SEQ ID NO: 78090 - RNA, 20 nt, Artificial Sequence
  MKO10078090_B_Clec10a
  gRNA
ucucaccuuuaccaggcucu

SEQ ID NO: 78091 - RNA, 20 nt, Artificial Sequence
  MKO10078091_B_Clec10a
  gRNA
gcagcugacagcuucgaaaa

SEQ ID NO: 78092 - RNA, 20 nt, Artificial Sequence
  MKO10078092_B_Clec10a
  gRNA
ccuuaucagauucccaguua

SEQ ID NO: 78093 - RNA, 20 nt, Artificial Sequence
  MKO10078093_B_Clec11a
  gRNA
gcacguccgucugcacguuu

SEQ ID NO: 78094 - RNA, 20 nt, Artificial Sequence
  MKO10078094_B_Clec11a
  gRNA
ccuagggcugcccacugggg

SEQ ID NO: 78095 - RNA, 20 nt, Artificial Sequence
  MKO10078095_B_Clec11a
  gRNA
ucugacccagaaucuccagg

SEQ ID NO: 78096 - RNA, 20 nt, Artificial Sequence
  MKO10078096_B_Clec12a
  gRNA
ucggaaugccagccuccuga

SEQ ID NO: 78097 - RNA, 20 nt, Artificial Sequence
  MKO10078097_B_Clec12a
  gRNA
ccauuccaaugaacagcaga

SEQ ID NO: 78098 - RNA, 20 nt, Artificial Sequence
  MKO10078098_B_Clec12a
  gRNA
caaagacuuacucuucagag

SEQ ID NO: 78099 - RNA, 20 nt, Artificial Sequence
  MKO10078099_B_Clec12b
  gRNA
agauugacagcaccgaagaa

SEQ ID NO: 78100 - RNA, 20 nt, Artificial Sequence
  MKO10078100_B_Clec12b
  gRNA
uccauaccauugccaugucu

SEQ ID NO: 78101 - RNA, 20 nt, Artificial Sequence
  MKO10078101_B_Clec12b
  gRNA
gucccagaucucugcccuac

SEQ ID NO: 78102 - RNA, 20 nt, Artificial Sequence
  MKO10078102_B_Clec14a
  gRNA
cgcugucaucugcgcaccga

SEQ ID NO: 78103 - RNA, 20 nt, Artificial Sequence
  MKO10078103_B_Clec14a
  gRNA
cgggaccugcacgcaagagc

SEQ ID NO: 78104 - RNA, 20 nt, Artificial Sequence
  MKO10078104_B_Clec14a
  gRNA
cguuguggcucuuccaccca

SEQ ID NO: 78105 - RNA, 20 nt, Artificial Sequence
  MKO10078105_B_Clec16a
  gRNA
auacgccaugaucuccucgu

SEQ ID NO: 78106 - RNA, 20 nt, Artificial Sequence
  MKO10078106_B_Clec16a
  gRNA
uguugcgggaggacuugcug

SEQ ID NO: 78107 - RNA, 20 nt, Artificial Sequence
  MKO10078107_B_Clec16a
  gRNA
ccaucacugagauccugauu

SEQ ID NO: 78108 - RNA, 20 nt, Artificial Sequence
  MKO10078108_B_Clec18a
  gRNA
cacacaaccgacugcgcagc

SEQ ID NO: 78109 - RNA, 20 nt, Artificial Sequence
  MKO10078109_B_Clec18a
  gRNA
gaaugugcagcuaaugccca

SEQ ID NO: 78110 - RNA, 20 nt, Artificial Sequence
  MKO10078110_B_Clec18a
  gRNA
ugggcggcagccaugcuuug

SEQ ID NO: 78111 - RNA, 20 nt, Artificial Sequence
  MKO10078111_B_Clec1a
  gRNA
ccgacagcuacagucucucc

SEQ ID NO: 78112 - RNA, 20 nt, Artificial Sequence
  MKO10078112_B_Clec1a
  gRNA
aacgagcagcaccaaacaca

SEQ ID NO: 78113 - RNA, 20 nt, Artificial Sequence
  MKO10078113_B_Clec1a
  gRNA
gcaguccuugcccagaaaaa

SEQ ID NO: 78114 - RNA, 20 nt, Artificial Sequence
  MKO10078114_B_Clec1b
  gRNA
cacacagcaaaaguaucuac

SEQ ID NO: 78115 - RNA, 20 nt, Artificial Sequence
  MKO10078115_B_Clec1b
  gRNA
gguuguuggacucguggcuc

SEQ ID NO: 78116 - RNA, 20 nt, Artificial Sequence
  MKO10078116_B_Clec1b
  gRNA
ucacuuuaaacaucaagccc

SEQ ID NO: 78117 - RNA, 20 nt, Artificial Sequence
  MKO10078117_B_Clec2d
  gRNA
gcuaagcuuuacugcuacua

SEQ ID NO: 78118 - RNA, 20 nt, Artificial Sequence
  MKO10078118_B_Clec2d
  gRNA
cauugcuuaccagcucaucc

SEQ ID NO: 78119 - RNA, 20 nt, Artificial Sequence
  MKO10078119_B_Clec2d
  gRNA
uaaagcuuagcacaagacuc

SEQ ID NO: 78120 - RNA, 20 nt, Artificial Sequence
  MKO10078120_B_Clec2e
  gRNA
cuugagcauacagcauagca

SEQ ID NO: 78121 - RNA, 20 nt, Artificial Sequence
  MKO10078121_B_Clec2e
  gRNA
aaguuuaacacaagaugcag

SEQ ID NO: 78122 - RNA, 20 nt, Artificial Sequence
  MKO10078122_B_Clec2e
  gRNA
aaacuccaagcaaaaugucu

SEQ ID NO: 78123 - RNA, 20 nt, Artificial Sequence
  MKO10078123_B_Clec2f
  gRNA
gacacaugaauucuagccac

SEQ ID NO: 78124 - RNA, 20 nt, Artificial Sequence
  MKO10078124_B_Clec2f
  gRNA
cacaacuacaaugaggacca

SEQ ID NO: 78125 - RNA, 20 nt, Artificial Sequence
  MKO10078125_B_Clec2f
  gRNA
augcugcuugccugcaaaac

SEQ ID NO: 78126 - RNA, 20 nt, Artificial Sequence
  MKO10078126_B_Clec2g
  gRNA
augcugcuugcccgaaaaac

SEQ ID NO: 78127 - RNA, 20 nt, Artificial Sequence
  MKO10078127_B_Clec2g
  gRNA
agaauguacaccuccaguuc

SEQ ID NO: 78128 - RNA, 20 nt, Artificial Sequence
  MKO10078128_B_Clec2g
  gRNA
gcuaagcuuuacugcugcug

SEQ ID NO: 78129 - RNA, 20 nt, Artificial Sequence
  MKO10078129_B_Clec2h
  gRNA
ugcugaucccauuaucacuc

SEQ ID NO: 78130 - RNA, 20 nt, Artificial Sequence
  MKO10078130_B_Clec2h
  gRNA
gagcaucaacacagcacccu

SEQ ID NO: 78131 - RNA, 20 nt, Artificial Sequence
  MKO10078131_B_Clec2h
  gRNA
gcuguguugaugcucugugc

SEQ ID NO: 78132 - RNA, 20 nt, Artificial Sequence
  MKO10078132_B_Clec2i
  gRNA
auugcacaccuccaguucca

SEQ ID NO: 78133 - RNA, 20 nt, Artificial Sequence
  MKO10078133_B_Clec2i
  gRNA
guguuguuuguccacuucca

SEQ ID NO: 78134 - RNA, 20 nt, Artificial Sequence
  MKO10078134_B_Clec2i
  gRNA
aauggaccccuuggaacugg

SEQ ID NO: 78135 - RNA, 20 nt, Artificial Sequence
  MKO10078135_B_Clec2l
  gRNA
aaugucugacaacccguccc

SEQ ID NO: 78136 - RNA, 20 nt, Artificial Sequence
  MKO10078136_B_Clec2l
  gRNA
gcaguacugccauacacacg

SEQ ID NO: 78137 - RNA, 20 nt, Artificial Sequence
  MKO10078137_B_Clec2l
  gRNA
acauuccguugacaccagcc

SEQ ID NO: 78138 - RNA, 20 nt, Artificial Sequence
  MKO10078138_B_Clec3a
  gRNA
ugcagucuucguuggcuucg

SEQ ID NO: 78139 - RNA, 20 nt, Artificial Sequence
  MKO10078139_B_Clec3a
  gRNA
aaucucaaguugaaaagcug

SEQ ID NO: 78140 - RNA, 20 nt, Artificial Sequence
  MKO10078140_B_Clec3a
  gRNA
gagaugcaagcucugcagac

SEQ ID NO: 78141 - RNA, 20 nt, Artificial Sequence
  MKO10078141_B_Clec3b
  gRNA
ccugcacuuaccagucugua

SEQ ID NO: 78142 - RNA, 20 nt, Artificial Sequence
  MKO10078142_B_Clec3b
  gRNA
ugggugacucugcaaugacc

SEQ ID NO: 78143 - RNA, 20 nt, Artificial Sequence
  MKO10078143_B_Clec3b
  gRNA
gcagcagcaguaugggauuu

SEQ ID NO: 78144 - RNA, 20 nt, Artificial Sequence
  MKO10078144_B_Clec4a1
  gRNA
cuucccgugacacugcaucc

SEQ ID NO: 78145 - RNA, 20 nt, Artificial Sequence
  MKO10078145_B_Clec4a1
  gRNA
acuauucacaaaaguaaccc

SEQ ID NO: 78146 - RNA, 20 nt, Artificial Sequence
  MKO10078146_B_Clec4a1
  gRNA
cacgggaagugaaguagcag

SEQ ID NO: 78147 - RNA, 20 nt, Artificial Sequence
  MKO10078147_B_Clec4a2
  gRNA
ucuaguggugauccaaagcc

SEQ ID NO: 78148 - RNA, 20 nt, Artificial Sequence
  MKO10078148_B_Clec4a2
  gRNA
accuacucagaaucuccugc

SEQ ID NO: 78149 - RNA, 20 nt, Artificial Sequence
  MKO10078149_B_Clec4a2
  gRNA
agaaugugauugccagcagc

SEQ ID NO: 78150 - RNA, 20 nt, Artificial Sequence
  MKO10078150_B_Clec4a3
  gRNA
aaguugucacaaauucucua

SEQ ID NO: 78151 - RNA, 20 nt, Artificial Sequence
  MKO10078151_B_Clec4a3
  gRNA
cuguugacaaucuuauucuc

SEQ ID NO: 78152 - RNA, 20 nt, Artificial Sequence
  MKO10078152_B_Clec4a3
  gRNA
cuacuucacuucaacugacu

SEQ ID NO: 78153 - RNA, 20 nt, Artificial Sequence
  MKO10078153_B_Clec4a4
  gRNA
acaaaugguuuccaauccuu

SEQ ID NO: 78154 - RNA, 20 nt, Artificial Sequence
  MKO10078154_B_Clec4a4
  gRNA
ugaggagaagugcucccaca

SEQ ID NO: 78155 - RNA, 20 nt, Artificial Sequence
  MKO10078155_B_Clec4a4
  gRNA
ugcaaaaaauauaauguaca

SEQ ID NO: 78156 - RNA, 20 nt, Artificial Sequence
  MKO10078156_B_Clec4b1
  gRNA
guucaggaaagacagcuaca

SEQ ID NO: 78157 - RNA, 20 nt, Artificial Sequence
  MKO10078157_B_Clec4b1
  gRNA
cacgugacacuuucuucaua

SEQ ID NO: 78158 - RNA, 20 nt, Artificial Sequence
  MKO10078158_B_Clec4b1
  gRNA
uucccuuaggauuucaucac

SEQ ID NO: 78159 - RNA, 20 nt, Artificial Sequence
  MKO10078159_B_Clec4b2
  gRNA
ugacagggcagguagucugc

SEQ ID NO: 78160 - RNA, 20 nt, Artificial Sequence
  MKO10078160_B_Clec4b2
  gRNA
uguuucauugcgaguugugu

SEQ ID NO: 78161 - RNA, 20 nt, Artificial Sequence
  MKO10078161_B_Clec4b2
  gRNA
acuucuccucacucuuauuc

SEQ ID NO: 78162 - RNA, 20 nt, Artificial Sequence
  MKO10078162_B_Clec4d
  gRNA
gaaacaacagcgaagacgca

SEQ ID NO: 78163 - RNA, 20 nt, Artificial Sequence
  MKO10078163_B_Clec4d
  gRNA
caucaacaccgaagcagaac

SEQ ID NO: 78164 - RNA, 20 nt, Artificial Sequence
  MKO10078164_B_Clec4d
  gRNA
guuccucucgcucucaugcc

SEQ ID NO: 78165 - RNA, 20 nt, Artificial Sequence
  MKO10078165_B_Clec4e
  gRNA
ucagaacccaccgacacauc

SEQ ID NO: 78166 - RNA, 20 nt, Artificial Sequence
  MKO10078166_B_Clec4e
  gRNA
uuauauuggacugacagacc

SEQ ID NO: 78167 - RNA, 20 nt, Artificial Sequence
  MKO10078167_B_Clec4e
  gRNA
gccacugacccuccaccacc

SEQ ID NO: 78168 - RNA, 20 nt, Artificial Sequence
  MKO10078168_B_Clec4f
  gRNA
gagaacuaacauuguccauu

SEQ ID NO: 78169 - RNA, 20 nt, Artificial Sequence
  MKO10078169_B_Clec4f
  gRNA
aguuguugcuuccccgaagc

SEQ ID NO: 78170 - RNA, 20 nt, Artificial Sequence
  MKO10078170_B_Clec4f
  gRNA
aaaugcaaguggcuauccag

SEQ ID NO: 78171 - RNA, 20 nt, Artificial Sequence
  MKO10078171_B_Clec4g
  gRNA
gaugacguugaguucccuga

SEQ ID NO: 78172 - RNA, 20 nt, Artificial Sequence
  MKO10078172_B_Clec4g
  gRNA
uuucuuacagcaauuccugc

SEQ ID NO: 78173 - RNA, 20 nt, Artificial Sequence
  MKO10078173_B_Clec4g
  gRNA
cugagcacccuacuguccag

SEQ ID NO: 78174 - RNA, 20 nt, Artificial Sequence
  MKO10078174_B_Clec4n
  gRNA
cuuucggauccacaagguaa

SEQ ID NO: 78175 - RNA, 20 nt, Artificial Sequence
  MKO10078175_B_Clec4n
  gRNA
cuccuuucagucaaaauguc

SEQ ID NO: 78176 - RNA, 20 nt, Artificial Sequence
  MKO10078176_B_Clec4n
  gRNA
ccaaaugacuuccagugauu

SEQ ID NO: 78177 - RNA, 20 nt, Artificial Sequence
  MKO10078177_B_Clec5a
  gRNA
ccuguuccauagcuccuugu

SEQ ID NO: 78178 - RNA, 20 nt, Artificial Sequence
  MKO10078178_B_Clec5a
  gRNA
aguguugacaauugccagug

SEQ ID NO: 78179 - RNA, 20 nt, Artificial Sequence
  MKO10078179_B_Clec5a
  gRNA
gguauugagaauuacuuuau

SEQ ID NO: 78180 - RNA, 20 nt, Artificial Sequence
  MKO10078180_B_Clec7a
  gRNA
uucccaugcaugauccaauu

SEQ ID NO: 78181 - RNA, 20 nt, Artificial Sequence
  MKO10078181_B_Clec7a
  gRNA
aggcccauugcaguggguuu

SEQ ID NO: 78182 - RNA, 20 nt, Artificial Sequence
  MKO10078182_B_Clec7a
  gRNA
uccaaggcaucccaaacuac

SEQ ID NO: 78183 - RNA, 20 nt, Artificial Sequence
  MKO10078183_B_Clec9a
  gRNA
caauccccuagcaaauguuc

SEQ ID NO: 78184 - RNA, 20 nt, Artificial Sequence
  MKO10078184_B_Clec9a
  gRNA
uaggaguucaucagcaguau

SEQ ID NO: 78185 - RNA, 20 nt, Artificial Sequence
  MKO10078185_B_Clec9a
  gRNA
cugcugcuccaagacaagag

SEQ ID NO: 78186 - RNA, 20 nt, Artificial Sequence
  MKO10078186_B_Clgn
  gRNA
agaaccagcccucugucgcc

SEQ ID NO: 78187 - RNA, 20 nt, Artificial Sequence
  MKO10078187_B_Clgn
  gRNA
uuuacagaaacauuugauag

SEQ ID NO: 78188 - RNA, 20 nt, Artificial Sequence
  MKO10078188_B_Clgn
  gRNA
ggucuuaucaaaagcaaaga

SEQ ID NO: 78189 - RNA, 20 nt, Artificial Sequence
  MKO10078189_B_Clhc1
  gRNA
gcggccgccaugaggcauag

SEQ ID NO: 78190 - RNA, 20 nt, Artificial Sequence
  MKO10078190_B_Clhc1
  gRNA
cgugacaaaagaugcaaugc

SEQ ID NO: 78191 - RNA, 20 nt, Artificial Sequence
  MKO10078191_B_Clhc1
  gRNA
cagacacauuuaaucaaacu

SEQ ID NO: 78192 - RNA, 20 nt, Artificial Sequence
  MKO10078192_B_Clic1
  gRNA
cacagacaccaacaagaucg

SEQ ID NO: 78193 - RNA, 20 nt, Artificial Sequence
  MKO10078193_B_Clic1
  gRNA
caccuucaacguuaccacug

SEQ ID NO: 78194 - RNA, 20 nt, Artificial Sequence
  MKO10078194_B_Clic1
  gRNA
gccaaagcuucacauaguac

SEQ ID NO: 78195 - RNA, 20 nt, Artificial Sequence
  MKO10078195_B_Clic3
  gRNA
ucaccuucgaguguccacug

SEQ ID NO: 78196 - RNA, 20 nt, Artificial Sequence
  MKO10078196_B_Clic3
  gRNA
ugacauccccaucguacagc

SEQ ID NO: 78197 - RNA, 20 nt, Artificial Sequence
  MKO10078197_B_Clic3
  gRNA
cugcccauccugcuguacga

SEQ ID NO: 78198 - RNA, 20 nt, Artificial Sequence
  MKO10078198_B_Clic4
  gRNA
gcuguucucgucgauuucgu

SEQ ID NO: 78199 - RNA, 20 nt, Artificial Sequence
  MKO10078199_B_Clic4
  gRNA
cuucaacagcgaagucaaga

SEQ ID NO: 78200 - RNA, 20 nt, Artificial Sequence
  MKO10078200_B_Clic4
  gRNA
ugccuccaggccggaaguga

SEQ ID NO: 78201 - RNA, 20 nt, Artificial Sequence
  MKO10078201_B_Clic5
  gRNA
cguguucaaugucaccaccg

SEQ ID NO: 78202 - RNA, 20 nt, Artificial Sequence
  MKO10078202_B_Clic5
  gRNA
ccccauccaggaacuugcgc

SEQ ID NO: 78203 - RNA, 20 nt, Artificial Sequence
  MKO10078203_B_Clic5
  gRNA
ugcccgcgguguuagauucc

SEQ ID NO: 78204 - RNA, 20 nt, Artificial Sequence
  MKO10078204_B_Clic6
  gRNA
auauaacacccuuuagccag

SEQ ID NO: 78205 - RNA, 20 nt, Artificial Sequence
  MKO10078205_B_Clic6
  gRNA
aaucgaugccgacaguucag

SEQ ID NO: 78206 - RNA, 20 nt, Artificial Sequence
  MKO10078206_B_Clic6
  gRNA
caucgauuucgucuggcagc

SEQ ID NO: 78207 - RNA, 20 nt, Artificial Sequence
  MKO10078207_B_Clint1
  gRNA
gcuccgauccauuucuuaug

SEQ ID NO: 78208 - RNA, 20 nt, Artificial Sequence
  MKO10078208_B_Clint1
  gRNA
aagcaacgaaugaugauccc

SEQ ID NO: 78209 - RNA, 20 nt, Artificial Sequence
  MKO10078209_B_Clint1
  gRNA
ugaguaauucauaaccacau

SEQ ID NO: 78210 - RNA, 20 nt, Artificial Sequence
  MKO10078210_B_Clip1
  gRNA
cuaauuugagguguagccga

SEQ ID NO: 78211 - RNA, 20 nt, Artificial Sequence
  MKO10078211_B_Clip1
  gRNA
gggggcuuacuaguccuguc

SEQ ID NO: 78212 - RNA, 20 nt, Artificial Sequence
  MKO10078212_B_Clip1
  gRNA
uguggaguuagacgagccuu

SEQ ID NO: 78213 - RNA, 20 nt, Artificial Sequence
  MKO10078213_B_Clip2
  gRNA
agccaauucggaugaccuug

SEQ ID NO: 78214 - RNA, 20 nt, Artificial Sequence
  MKO10078214_B_Clip2
  gRNA
aagaacgacggggcgguggc

SEQ ID NO: 78215 - RNA, 20 nt, Artificial Sequence
  MKO10078215_B_Clip2
  gRNA
uggugcaaagagaccgaacu

SEQ ID NO: 78216 - RNA, 20 nt, Artificial Sequence
  MKO10078216_B_Clip3
  gRNA
ggggacccacuggcguacaa

SEQ ID NO: 78217 - RNA, 20 nt, Artificial Sequence
  MKO10078217_B_Clip3
  gRNA
uguucgccauuguacgccag

SEQ ID NO: 78218 - RNA, 20 nt, Artificial Sequence
  MKO10078218_B_Clip3
  gRNA
caaaauaggcggcauaguga

SEQ ID NO: 78219 - RNA, 20 nt, Artificial Sequence
  MKO10078219_B_Clip4
  gRNA
gcagcacauaacuugugugc

SEQ ID NO: 78220 - RNA, 20 nt, Artificial Sequence
  MKO10078220_B_Clip4
  gRNA
uccuggcaugaugcaucguu

SEQ ID NO: 78221 - RNA, 20 nt, Artificial Sequence
  MKO10078221_B_Clip4
  gRNA
cccuaacgaugcaucaugcc

SEQ ID NO: 78222 - RNA, 20 nt, Artificial Sequence
  MKO10078222_B_Clk1
  gRNA
auacugugaagcugcucaau

SEQ ID NO: 78223 - RNA, 20 nt, Artificial Sequence
  MKO10078223_B_Clk1
  gRNA
gugauacuuacaaaguacua

SEQ ID NO: 78224 - RNA, 20 nt, Artificial Sequence
  MKO10078224_B_Clk1
  gRNA
guguccagaagagucaccga

SEQ ID NO: 78225 - RNA, 20 nt, Artificial Sequence
  MKO10078225_B_Clk2
  gRNA
cuuaccuucgggaccgaacg

SEQ ID NO: 78226 - RNA, 20 nt, Artificial Sequence
  MKO10078226_B_Clk2
  gRNA
uccagaugccccauccccga

SEQ ID NO: 78227 - RNA, 20 nt, Artificial Sequence
  MKO10078227_B_Clk2
  gRNA
gaguguagaggacgacgcug

SEQ ID NO: 78228 - RNA, 20 nt, Artificial Sequence
  MKO10078228_B_Clk3
  gRNA
accgugacagugauacguau

SEQ ID NO: 78229 - RNA, 20 nt, Artificial Sequence
  MKO10078229_B_Clk3
  gRNA
cuuggagccaaucgccgauc

SEQ ID NO: 78230 - RNA, 20 nt, Artificial Sequence
  MKO10078230_B_Clk3
  gRNA
acccauaccugagcuaccgc

SEQ ID NO: 78231 - RNA, 20 nt, Artificial Sequence
  MKO10078231_B_Clk4
  gRNA
uacagaaaugacuacugcga

SEQ ID NO: 78232 - RNA, 20 nt, Artificial Sequence
  MKO10078232_B_Clk4
  gRNA
gcacucuacaacuuugccaa

SEQ ID NO: 78233 - RNA, 20 nt, Artificial Sequence
  MKO10078233_B_Clk4
  gRNA
uguucaagugcuccaauacu

SEQ ID NO: 78234 - RNA, 20 nt, Artificial Sequence
  MKO10078234_B_Clmn
  gRNA
gauaaaccuacaccucgaaa

SEQ ID NO: 78235 - RNA, 20 nt, Artificial Sequence
  MKO10078235_B_Clmn
  gRNA
ugacccaccucuagaaguua

SEQ ID NO: 78236 - RNA, 20 nt, Artificial Sequence
  MKO10078236_B_Clmn
  gRNA
ccgaaaaauacgaugugaug

SEQ ID NO: 78237 - RNA, 20 nt, Artificial Sequence
  MKO10078237_B_Clmp
  gRNA
ugucuacaauaacuugaccg

SEQ ID NO: 78238 - RNA, 20 nt, Artificial Sequence
  MKO10078238_B_Clmp
  gRNA
ccuacagauuacaacaaccc

SEQ ID NO: 78239 - RNA, 20 nt, Artificial Sequence
  MKO10078239_B_Clmp
  gRNA
ucucgggaagccccaguuga

SEQ ID NO: 78240 - RNA, 20 nt, Artificial Sequence
  MKO10078240_B_Cln3
  gRNA
cacccuugucaucaaacucc

SEQ ID NO: 78241 - RNA, 20 nt, Artificial Sequence
  MKO10078241_B_Cln3
  gRNA
caaaucgagaugagcuguug

SEQ ID NO: 78242 - RNA, 20 nt, Artificial Sequence
  MKO10078242_B_Cln3
  gRNA
cagacgccugcuccugcuug

SEQ ID NO: 78243 - RNA, 20 nt, Artificial Sequence
  MKO10078243_B_Cln5
  gRNA
gacaaaauucgaacagucgu

SEQ ID NO: 78244 - RNA, 20 nt, Artificial Sequence
  MKO10078244_B_Cln5
  gRNA
agucgguaaauguuguaugu

SEQ ID NO: 78245 - RNA, 20 nt, Artificial Sequence
  MKO10078245_B_Cln5
  gRNA
gaaacuuaugcaugacgccg

SEQ ID NO: 78246 - RNA, 20 nt, Artificial Sequence
  MKO10078246_B_Cln6
  gRNA
ugaaaguaguccccgacacu

SEQ ID NO: 78247 - RNA, 20 nt, Artificial Sequence
  MKO10078247_B_Cln6
  gRNA
cuucaccucagcuuauugag

SEQ ID NO: 78248 - RNA, 20 nt, Artificial Sequence
  MKO10078248_B_Cln6
  gRNA
ccucucaacaagccaagugu

SEQ ID NO: 78249 - RNA, 20 nt, Artificial Sequence
  MKO10078249_B_Cln8
  gRNA
ucauucgacagugaaacaug

SEQ ID NO: 78250 - RNA, 20 nt, Artificial Sequence
  MKO10078250_B_Cln8
  gRNA
ucuuccacgaagcguagucc

SEQ ID NO: 78251 - RNA, 20 nt, Artificial Sequence
  MKO10078251_B_Cln8
  gRNA
cucuaugccgacaaagcucu

SEQ ID NO: 78252 - RNA, 20 nt, Artificial Sequence
  MKO10078252_B_Clnk
  gRNA
cucaucccaggggcaauaaa

SEQ ID NO: 78253 - RNA, 20 nt, Artificial Sequence
  MKO10078253_B_Clnk
  gRNA
uuuaccagccagaccuaucc

SEQ ID NO: 78254 - RNA, 20 nt, Artificial Sequence
  MKO10078254_B_Clnk
  gRNA
acucaccuuuggcacugcug

SEQ ID NO: 78255 - RNA, 20 nt, Artificial Sequence
  MKO10078255_B_Clns1a
  gRNA
cccuucuaaucucuccaacg

SEQ ID NO: 78256 - RNA, 20 nt, Artificial Sequence
  MKO10078256_B_Clns1a
  gRNA
guuuguuuagaacaaggaca

SEQ ID NO: 78257 - RNA, 20 nt, Artificial Sequence
  MKO10078257_B_Clns1a
  gRNA
cucacaugcugacuuaucac

SEQ ID NO: 78258 - RNA, 20 nt, Artificial Sequence
  MKO10078258_B_Clock
  gRNA
acuagcaucugacugugcag

SEQ ID NO: 78259 - RNA, 20 nt, Artificial Sequence
  MKO10078259_B_Clock
  gRNA
auugguggaagaagaugaca

SEQ ID NO: 78260 - RNA, 20 nt, Artificial Sequence
  MKO10078260_B_Clock
  gRNA
uagaccccagcuccuuaaug

SEQ ID NO: 78261 - RNA, 20 nt, Artificial Sequence
  MKO10078261_B_Clp1
  gRNA
gacuguacaacgaauugaaa

SEQ ID NO: 78262 - RNA, 20 nt, Artificial Sequence
  MKO10078262_B_Clp1
  gRNA
ucuaguucaaacuuagucgu

SEQ ID NO: 78263 - RNA, 20 nt, Artificial Sequence
  MKO10078263_B_Clp1
  gRNA
cuccaacugaaccgauugag

SEQ ID NO: 78264 - RNA, 20 nt, Artificial Sequence
  MKO10078264_B_Clpb
  gRNA
cucaguccuagucacucgag

SEQ ID NO: 78265 - RNA, 20 nt, Artificial Sequence
  MKO10078265_B_Clpb
  gRNA
cauccaucagccacaaugag

SEQ ID NO: 78266 - RNA, 20 nt, Artificial Sequence
  MKO10078266_B_Clpb
  gRNA
gugcagguccugcuugcugc

SEQ ID NO: 78267 - RNA, 20 nt, Artificial Sequence
  MKO10078267_B_Clpp
  gRNA
ccugcagauugacgacagug

SEQ ID NO: 78268 - RNA, 20 nt, Artificial Sequence
  MKO10078268_B_Clpp
  gRNA
aucaugauccaccagcccuc

SEQ ID NO: 78269 - RNA, 20 nt, Artificial Sequence
  MKO10078269_B_Clpp
  gRNA
acacaccaagcagagccuac

SEQ ID NO: 78270 - RNA, 20 nt, Artificial Sequence
  MKO10078270_B_Clpsl2
  gRNA
gcaagcaccccaugccuaug

SEQ ID NO: 78271 - RNA, 20 nt, Artificial Sequence
  MKO10078271_B_Clpsl2
  gRNA
accguccuggcuuugcuugc

SEQ ID NO: 78272 - RNA, 20 nt, Artificial Sequence
  MKO10078272_B_Clpsl2
  gRNA
gggucccagcaagcaaagcc

SEQ ID NO: 78273 - RNA, 20 nt, Artificial Sequence
  MKO10078273_B_Clps
  gRNA
ccuaugcagcucccggaccc

SEQ ID NO: 78274 - RNA, 20 nt, Artificial Sequence
  MKO10078274_B_Clps
  gRNA
ccagguugauaauaagaccc

SEQ ID NO: 78275 - RNA, 20 nt, Artificial Sequence
  MKO10078275_B_Clps
  gRNA
cauugcccguugcacacaca

SEQ ID NO: 78276 - RNA, 20 nt, Artificial Sequence
  MKO10078276_B_Clptm1l
  gRNA
caaacccccaggauucagcu

SEQ ID NO: 78277 - RNA, 20 nt, Artificial Sequence
  MKO10078277_B_Clptm1l
  gRNA
gaagaaauuaacuugcucac

SEQ ID NO: 78278 - RNA, 20 nt, Artificial Sequence
  MKO10078278_B_Clptm1l
  gRNA
acauccacaccuuucaaauu

SEQ ID NO: 78279 - RNA, 20 nt, Artificial Sequence
  MKO10078279_B_Clptm1
  gRNA
uuaacuuacuccgggacaug

SEQ ID NO: 78280 - RNA, 20 nt, Artificial Sequence
  MKO10078280_B_Clptm1
  gRNA
gcucugagauguacacgugc

SEQ ID NO: 78281 - RNA, 20 nt, Artificial Sequence
  MKO10078281_B_Clptm1
  gRNA
cacagacuucaacgccaccu

SEQ ID NO: 78282 - RNA, 20 nt, Artificial Sequence
  MKO10078282_B_Clpx
  gRNA
cucccugcagguauuucgug

SEQ ID NO: 78283 - RNA, 20 nt, Artificial Sequence
  MKO10078283_B_Clpx
  gRNA
cgcuuguaccugcggcgcug

SEQ ID NO: 78284 - RNA, 20 nt, Artificial Sequence
  MKO10078284_B_Clpx
  gRNA
cagcuucgcuguccuaaaug

SEQ ID NO: 78285 - RNA, 20 nt, Artificial Sequence
  MKO10078285_B_Clrn1
  gRNA
gguuaagacgacaagaauca

SEQ ID NO: 78286 - RNA, 20 nt, Artificial Sequence
  MKO10078286_B_Clrn1
  gRNA
gauucuugucgucuuaacca

SEQ ID NO: 78287 - RNA, 20 nt, Artificial Sequence
  MKO10078287_B_Clrn1
  gRNA
aaaacuauaccaccucauuc

SEQ ID NO: 78288 - RNA, 20 nt, Artificial Sequence
  MKO10078288_B_Clrn2
  gRNA
ccacaaccaaguuugcugcg

SEQ ID NO: 78289 - RNA, 20 nt, Artificial Sequence
  MKO10078289_B_Clrn2
  gRNA
ggagcaagagaauugugacg

SEQ ID NO: 78290 - RNA, 20 nt, Artificial Sequence
  MKO10078290_B_Clrn2
  gRNA
uucaucggggacauuuacua

SEQ ID NO: 78291 - RNA, 20 nt, Artificial Sequence
  MKO10078291_B_Clrn3
  gRNA
caacccuuaccagacguucc

SEQ ID NO: 78292 - RNA, 20 nt, Artificial Sequence
  MKO10078292_B_Clrn3
  gRNA
agccgguggaauaugcucca

SEQ ID NO: 78293 - RNA, 20 nt, Artificial Sequence
  MKO10078293_B_Clrn3
  gRNA
gaccuaugggugucuauacc

SEQ ID NO: 78294 - RNA, 20 nt, Artificial Sequence
  MKO10078294_B_Clspn
  gRNA
uaccuuccucgcacugccuu

SEQ ID NO: 78295 - RNA, 20 nt, Artificial Sequence
  MKO10078295_B_Clspn
  gRNA
aaacaaggugaaaaaucgca

SEQ ID NO: 78296 - RNA, 20 nt, Artificial Sequence
  MKO10078296_B_Clspn
  gRNA
aguuauccaaaggcagugcg

SEQ ID NO: 78297 - RNA, 20 nt, Artificial Sequence
  MKO10078297_B_Clstn1
  gRNA
aguggauaaguccacgggug

SEQ ID NO: 78298 - RNA, 20 nt, Artificial Sequence
  MKO10078298_B_Clstn1
  gRNA
gauucaccgcuccgcuuugc

SEQ ID NO: 78299 - RNA, 20 nt, Artificial Sequence
  MKO10078299_B_Clstn1
  gRNA
ugcauaccugcaaagcggag

SEQ ID NO: 78300 - RNA, 20 nt, Artificial Sequence
  MKO10078300_B_Clstn2
  gRNA
guuucacguccaccugcacc

SEQ ID NO: 78301 - RNA, 20 nt, Artificial Sequence
  MKO10078301_B_Clstn2
  gRNA
acucauugacauccuucacc

SEQ ID NO: 78302 - RNA, 20 nt, Artificial Sequence
  MKO10078302_B_Clstn2
  gRNA
aggccccgcaccacagucau

SEQ ID NO: 78303 - RNA, 20 nt, Artificial Sequence
  MKO10078303_B_Clstn3
  gRNA
uaaggagcccguggacugug

SEQ ID NO: 78304 - RNA, 20 nt, Artificial Sequence
  MKO10078304_B_Clstn3
  gRNA
cuucacccguugccuugucc

SEQ ID NO: 78305 - RNA, 20 nt, Artificial Sequence
  MKO10078305_B_Clstn3
  gRNA
gaugcuccacugcgcuaugc

SEQ ID NO: 78306 - RNA, 20 nt, Artificial Sequence
  MKO10078306_B_Clua
  gRNA
cgcuucuugcuuccgagaau

SEQ ID NO: 78307 - RNA, 20 nt, Artificial Sequence
  MKO10078307_B_Clua
  gRNA
caaucgauccacuucugaaa

SEQ ID NO: 78308 - RNA, 20 nt, Artificial Sequence
  MKO10078308_B_Clua
  gRNA
gaugaauggugaauacuacc

SEQ ID NO: 78309 - RNA, 20 nt, Artificial Sequence
  MKO10078309_B_Cltb
  gRNA
acgggcaccuagcgggacag

SEQ ID NO: 78310 - RNA, 20 nt, Artificial Sequence
  MKO10078310_B_Cltb
  gRNA
gcucacagacgcugccucga

SEQ ID NO: 78311 - RNA, 20 nt, Artificial Sequence
  MKO10078311_B_Cltb
  gRNA
cgaacaggaguggcgggaga

SEQ ID NO: 78312 - RNA, 20 nt, Artificial Sequence
  MKO10078312_B_Cluc
  gRNA
uuauuugcagcaaaaucgug

SEQ ID NO: 78313 - RNA, 20 nt, Artificial Sequence
  MKO10078313_B_Cluc
  gRNA
caguuacauaucauugaagu

SEQ ID NO: 78314 - RNA, 20 nt, Artificial Sequence
  MKO10078314_B_Cluc
  gRNA
cuagcugcaugcccuucaau

SEQ ID NO: 78315 - RNA, 20 nt, Artificial Sequence
  MKO10078315_B_Cluap1
  gRNA
ggagggcuccaauguaggag

SEQ ID NO: 78316 - RNA, 20 nt, Artificial Sequence
  MKO10078316_B_Cluap1
  gRNA
gcgucugaaaucacugccaa

SEQ ID NO: 78317 - RNA, 20 nt, Artificial Sequence
  MKO10078317_B_Cluap1
  gRNA
gauuucagacgcaagcuguc

SEQ ID NO: 78318 - RNA, 20 nt, Artificial Sequence
  MKO10078318_B_Cluh
  gRNA
accauucaacagcaugaccg

SEQ ID NO: 78319 - RNA, 20 nt, Artificial Sequence
  MKO10078319_B_Cluh
  gRNA
ugcagccccagaaccgugac

SEQ ID NO: 78320 - RNA, 20 nt, Artificial Sequence
  MKO10078320_B_Cluh
  gRNA
uacgaugacaaguauccuca

SEQ ID NO: 78321 - RNA, 20 nt, Artificial Sequence
  MKO10078321_B_Clu
  gRNA
auggucucguuacacacuuc

SEQ ID NO: 78322 - RNA, 20 nt, Artificial Sequence
  MKO10078322_B_Clu
  gRNA
agaugaccgcacugugugca

SEQ ID NO: 78323 - RNA, 20 nt, Artificial Sequence
  MKO10078323_B_Clu
  gRNA
aguguguaacgagaccauga

SEQ ID NO: 78324 - RNA, 20 nt, Artificial Sequence
  MKO10078324_B_Clvs1
  gRNA
uuaaaaugaaaccguuuauc

SEQ ID NO: 78325 - RNA, 20 nt, Artificial Sequence
  MKO10078325_B_Clvs1
  gRNA
acucaucaagccauuccuua

SEQ ID NO: 78326 - RNA, 20 nt, Artificial Sequence
  MKO10078326_B_Clvs1
  gRNA
auggcuugaugaguguguac

SEQ ID NO: 78327 - RNA, 20 nt, Artificial Sequence
  MKO10078327_B_Clvs2
  gRNA
ugaugacagugaguacaacg

SEQ ID NO: 78328 - RNA, 20 nt, Artificial Sequence
  MKO10078328_B_Clvs2
  gRNA
augggcguaucacaguguac

SEQ ID NO: 78329 - RNA, 20 nt, Artificial Sequence
  MKO10078329_B_Clvs2
  gRNA
agcauaccucuucauggauu

SEQ ID NO: 78330 - RNA, 20 nt, Artificial Sequence
  MKO10078330_B_Clybl
  gRNA
acccauugcagucuccacaa

SEQ ID NO: 78331 - RNA, 20 nt, Artificial Sequence
  MKO10078331_B_Clybl
  gRNA
gcuuguagacacugaccacg

SEQ ID NO: 78332 - RNA, 20 nt, Artificial Sequence
  MKO10078332_B_Clybl
  gRNA
cuccaaaaacgacugcaucu

SEQ ID NO: 78333 - RNA, 20 nt, Artificial Sequence
  MKO10078333_B_Cma1
  gRNA
ucccacaccuaggguuagcu

SEQ ID NO: 78334 - RNA, 20 nt, Artificial Sequence
  MKO10078334_B_Cma1
  gRNA
aacuucaacuuuaucccacc

SEQ ID NO: 78335 - RNA, 20 nt, Artificial Sequence
  MKO10078335_B_Cma1
  gRNA
gcacaaaguuucuucuuauc

SEQ ID NO: 78336 - RNA, 20 nt, Artificial Sequence
  MKO10078336_B_Cma2
  gRNA
agaagaaugacugucacucu

SEQ ID NO: 78337 - RNA, 20 nt, Artificial Sequence
  MKO10078337_B_Cma2
  gRNA
uuggcaaagucagagggggc

SEQ ID NO: 78338 - RNA, 20 nt, Artificial Sequence
  MKO10078338_B_Cma2
  gRNA
cucuaugacucuguuaaucc

SEQ ID NO: 78339 - RNA, 20 nt, Artificial Sequence
  MKO10078339_B_Cmah
  gRNA
aacugaacccuccuaacccc

SEQ ID NO: 78340 - RNA, 20 nt, Artificial Sequence
  MKO10078340_B_Cmah
  gRNA
ccuguucaugaaagacaucg

SEQ ID NO: 78341 - RNA, 20 nt, Artificial Sequence
  MKO10078341_B_Cmah
  gRNA
uucgcuugucucccaacuug

SEQ ID NO: 78342 - RNA, 20 nt, Artificial Sequence
  MKO10078342_B_Cmas
  gRNA
ccucgucgacaagacuggga

SEQ ID NO: 78343 - RNA, 20 nt, Artificial Sequence
  MKO10078343_B_Cmas
  gRNA
uuucacuccaucgaaacuga

SEQ ID NO: 78344 - RNA, 20 nt, Artificial Sequence
  MKO10078344_B_Cmas
  gRNA
ucauaccauugugauaauuc

SEQ ID NO: 78345 - RNA, 20 nt, Artificial Sequence
  MKO10078345_B_Cmbl
  gRNA
cauacccggacaucagggcg

SEQ ID NO: 78346 - RNA, 20 nt, Artificial Sequence
  MKO10078346_B_Cmbl
  gRNA
ugccuacucaccugcucaag

SEQ ID NO: 78347 - RNA, 20 nt, Artificial Sequence
  MKO10078347_B_Cmbl
  gRNA
caaggaggaaccuaauugaa

SEQ ID NO: 78348 - RNA, 20 nt, Artificial Sequence
  MKO10078348_B_Cmc1
  gRNA
caguuugcauucuucauaga

SEQ ID NO: 78349 - RNA, 20 nt, Artificial Sequence
  MKO10078349_B_Cmc1
  gRNA
uccuuaugguauuaaaaugc

SEQ ID NO: 78350 - RNA, 20 nt, Artificial Sequence
  MKO10078350_B_Cmc1
  gRNA
cuucuaugaagaaugcaaac

SEQ ID NO: 78351 - RNA, 20 nt, Artificial Sequence
  MKO10078351_B_Cmc2
  gRNA
aaucaggacguugcauucuu

SEQ ID NO: 78352 - RNA, 20 nt, Artificial Sequence
  MKO10078352_B_Cmc2
  gRNA
cguucuuccaguacucagag

SEQ ID NO: 78353 - RNA, 20 nt, Artificial Sequence
  MKO10078353_B_Cmc2
  gRNA
gaggaaguguuugaagaaug

SEQ ID NO: 78354 - RNA, 20 nt, Artificial Sequence
  MKO10078354_B_Cmip
  gRNA
uccugaguaacccaagccgc

SEQ ID NO: 78355 - RNA, 20 nt, Artificial Sequence
  MKO10078355_B_Cmip
  gRNA
gauguucucgugcuccugag

SEQ ID NO: 78356 - RNA, 20 nt, Artificial Sequence
  MKO10078356_B_Cmip
  gRNA
acagcuaccugcgagaucag

SEQ ID NO: 78357 - RNA, 20 nt, Artificial Sequence
  MKO10078357_B_Cmklr1
  gRNA
ucuccgugcugcuccccguc

SEQ ID NO: 78358 - RNA, 20 nt, Artificial Sequence
  MKO10078358_B_Cmklr1
  gRNA
cacucgcaaguaguuuccac

SEQ ID NO: 78359 - RNA, 20 nt, Artificial Sequence
  MKO10078359_B_Cmklr1
  gRNA
caagcugcagcgcaaccgcc

SEQ ID NO: 78360 - RNA, 20 nt, Artificial Sequence
  MKO10078360_B_Cml1
  gRNA
agaauauacucaugaaguac

SEQ ID NO: 78361 - RNA, 20 nt, Artificial Sequence
  MKO10078361_B_Cml1
  gRNA
agccaccccuccuaggcaga

SEQ ID NO: 78362 - RNA, 20 nt, Artificial Sequence
  MKO10078362_B_Cml1
  gRNA
ugguacugucggaugugaua

SEQ ID NO: 78363 - RNA, 20 nt, Artificial Sequence
  MKO10078363_B_Cml2
  gRNA
cagugucagcaucugucgga

SEQ ID NO: 78364 - RNA, 20 nt, Artificial Sequence
  MKO10078364_B_Cml2
  gRNA
cagugugcaacauagugcuc

SEQ ID NO: 78365 - RNA, 20 nt, Artificial Sequence
  MKO10078365_B_Cml2
  gRNA
guugcacacugccagucuca

SEQ ID NO: 78366 - RNA, 20 nt, Artificial Sequence
  MKO10078366_B_Cml3
  gRNA
gcugcaguugcuucuucugc

SEQ ID NO: 78367 - RNA, 20 nt, Artificial Sequence
  MKO10078367_B_Cml3
  gRNA
ucauugcagcaccgaagaga

SEQ ID NO: 78368 - RNA, 20 nt, Artificial Sequence
  MKO10078368_B_Cml3
  gRNA
agacucagcuacccagaagc

SEQ ID NO: 78369 - RNA, 20 nt, Artificial Sequence
  MKO10078369_B_Cml5
  gRNA
gaugccucuaaccauagucc

SEQ ID NO: 78370 - RNA, 20 nt, Artificial Sequence
  MKO10078370_B_Cml5
  gRNA
acauauaacagccaguagcc

SEQ ID NO: 78371 - RNA, 20 nt, Artificial Sequence
  MKO10078371_B_Cml5
  gRNA
uuaucagauccgccaguacc

SEQ ID NO: 78372 - RNA, 20 nt, Artificial Sequence
  MKO10078372_B_Cmpk1
  gRNA
uuaggaaauggaccaaacaa

SEQ ID NO: 78373 - RNA, 20 nt, Artificial Sequence
  MKO10078373_B_Cmpk1
  gRNA
agaaaucaagacaaccuuca

SEQ ID NO: 78374 - RNA, 20 nt, Artificial Sequence
  MKO10078374_B_Cmpk1
  gRNA
ugacgacaacagagagagcu

SEQ ID NO: 78375 - RNA, 20 nt, Artificial Sequence
  MKO10078375_B_Cmpk2
  gRNA
acccaccugucuacaauaac

SEQ ID NO: 78376 - RNA, 20 nt, Artificial Sequence
  MKO10078376_B_Cmpk2
  gRNA
acaauuaacgaccagaacuc

SEQ ID NO: 78377 - RNA, 20 nt, Artificial Sequence
  MKO10078377_B_Cmpk2
  gRNA
ccuaguugaccagugcccaa

SEQ ID NO: 78378 - RNA, 20 nt, Artificial Sequence
  MKO10078378_B_Cmss1
  gRNA
cuuccgagaguccucugcuu

SEQ ID NO: 78379 - RNA, 20 nt, Artificial Sequence
  MKO10078379_B_Cmss1
  gRNA
ggucucugaucagcuucuga

SEQ ID NO: 78380 - RNA, 20 nt, Artificial Sequence
  MKO10078380_B_Cmss1
  gRNA
ggacacggaaaugacacagc

SEQ ID NO: 78381 - RNA, 20 nt, Artificial Sequence
  MKO10078381_B_Cmtm1
  gRNA
auaguugguauaguagucau

SEQ ID NO: 78382 - RNA, 20 nt, Artificial Sequence
  MKO10078382_B_Cmtm1
  gRNA
guuuguagucaucaugauuc

SEQ ID NO: 78383 - RNA, 20 nt, Artificial Sequence
  MKO10078383_B_Cmtm1
  gRNA
uacaggccaucgugguuuga

SEQ ID NO: 78384 - RNA, 20 nt, Artificial Sequence
  MKO10078384_B_Cmtm2a
  gRNA
ccgcuuccauacagaugagc

SEQ ID NO: 78385 - RNA, 20 nt, Artificial Sequence
  MKO10078385_B_Cmtm2a
  gRNA
cuuuaccauagcaguuaagu

SEQ ID NO: 78386 - RNA, 20 nt, Artificial Sequence
  MKO10078386_B_Cmtm2a
  gRNA
acacauacuuccuuaaccua

SEQ ID NO: 78387 - RNA, 20 nt, Artificial Sequence
  MKO10078387_B_Cmtm2b
  gRNA
uggcugcgcagucaccaucc

SEQ ID NO: 78388 - RNA, 20 nt, Artificial Sequence
  MKO10078388_B_Cmtm2b
  gRNA
ucaggaucugaugaacgacc

SEQ ID NO: 78389 - RNA, 20 nt, Artificial Sequence
  MKO10078389_B_Cmtm2b
  gRNA
agagugcaagucucugauua

SEQ ID NO: 78390 - RNA, 20 nt, Artificial Sequence
  MKO10078390_B_Cmtm3
  gRNA
guaagccccaucugaguauu

SEQ ID NO: 78391 - RNA, 20 nt, Artificial Sequence
  MKO10078391_B_Cmtm3
  gRNA
ccauuugucauucagcugca

SEQ ID NO: 78392 - RNA, 20 nt, Artificial Sequence
  MKO10078392_B_Cmtm3
  gRNA
uucagaagagaacuccaacu

SEQ ID NO: 78393 - RNA, 20 nt, Artificial Sequence
  MKO10078393_B_Cmtm4
  gRNA
ucgcaccgagucgagagaug

SEQ ID NO: 78394 - RNA, 20 nt, Artificial Sequence
  MKO10078394_B_Cmtm4
  gRNA
uagagcagccaacacgauug

SEQ ID NO: 78395 - RNA, 20 nt, Artificial Sequence
  MKO10078395_B_Cmtm4
  gRNA
uaucugcaucgagacuauca

SEQ ID NO: 78396 - RNA, 20 nt, Artificial Sequence
  MKO10078396_B_Cmtm5
  gRNA
cagcgccaucgucaucuucc

SEQ ID NO: 78397 - RNA, 20 nt, Artificial Sequence
  MKO10078397_B_Cmtm5
  gRNA
ccuuugcugcugugaccucg

SEQ ID NO: 78398 - RNA, 20 nt, Artificial Sequence
  MKO10078398_B_Cmtm5
  gRNA
caacucacccucagugguac

SEQ ID NO: 78399 - RNA, 20 nt, Artificial Sequence
  MKO10078399_B_Cmtm6
  gRNA
guauccacucugucgugcac

SEQ ID NO: 78400 - RNA, 20 nt, Artificial Sequence
  MKO10078400_B_Cmtm6
  gRNA
cugugucuuuaagcguucag

SEQ ID NO: 78401 - RNA, 20 nt, Artificial Sequence
  MKO10078401_B_Cmtm6
  gRNA
ugcaguacacgaucagcagg

SEQ ID NO: 78402 - RNA, 20 nt, Artificial Sequence
  MKO10078402_B_Cmtm7
  gRNA
gcacacgguagaagcggaag

SEQ ID NO: 78403 - RNA, 20 nt, Artificial Sequence
  MKO10078403_B_Cmtm7
  gRNA
uccucugccuagcgagcuug

SEQ ID NO: 78404 - RNA, 20 nt, Artificial Sequence
  MKO10078404_B_Cmtm7
  gRNA
aggacagccacaagcucgcu

SEQ ID NO: 78405 - RNA, 20 nt, Artificial Sequence
  MKO10078405_B_Cmtm8
  gRNA
ggggaauccugguguaaguc

SEQ ID NO: 78406 - RNA, 20 nt, Artificial Sequence
  MKO10078406_B_Cmtm8
  gRNA
cguacuucaguuucauagcc

SEQ ID NO: 78407 - RNA, 20 nt, Artificial Sequence
  MKO10078407_B_Cmtm8
  gRNA
guacuucucagcugccauag

SEQ ID NO: 78408 - RNA, 20 nt, Artificial Sequence
  MKO10078408_B_Cmtr1
  gRNA
ucacucauuucccgagaguc

SEQ ID NO: 78409 - RNA, 20 nt, Artificial Sequence
  MKO10078409_B_Cmtr1
  gRNA
cuucaaagcagauucccuug

SEQ ID NO: 78410 - RNA, 20 nt, Artificial Sequence
  MKO10078410_B_Cmtr1
  gRNA
gcaucugcuacaagccucag

SEQ ID NO: 78411 - RNA, 20 nt, Artificial Sequence
  MKO10078411_B_Cmtr2
  gRNA
gguuccgcacccuguucguc

SEQ ID NO: 78412 - RNA, 20 nt, Artificial Sequence
  MKO10078412_B_Cmtr2
  gRNA
uaagauugucguuugccucg

SEQ ID NO: 78413 - RNA, 20 nt, Artificial Sequence
  MKO10078413_B_Cmtr2
  gRNA
cugggucaccaucgugaagc

SEQ ID NO: 78414 - RNA, 20 nt, Artificial Sequence
  MKO10078414_B_Cmya5
  gRNA
aguggaccaucuggucaugc

SEQ ID NO: 78415 - RNA, 20 nt, Artificial Sequence
  MKO10078415_B_Cmya5
  gRNA
accuacaagaaaaauccuug

SEQ ID NO: 78416 - RNA, 20 nt, Artificial Sequence
  MKO10078416_B_Cmya5
  gRNA
uaccucaaugguauuaaaaa

SEQ ID NO: 78417 - RNA, 20 nt, Artificial Sequence
  MKO10078417_B_Cnbd2
  gRNA
ccguaucucguuuguuaccg

SEQ ID NO: 78418 - RNA, 20 nt, Artificial Sequence
  MKO10078418_B_Cnbd2
  gRNA
ccaaggucauacgcuuugaa

SEQ ID NO: 78419 - RNA, 20 nt, Artificial Sequence
  MKO10078419_B_Cnbd2
  gRNA
cuccugugcagcaaaguccu

SEQ ID NO: 78420 - RNA, 20 nt, Artificial Sequence
  MKO10078420_B_Cnbp
  gRNA
gaagucaacuguuaccgcug

SEQ ID NO: 78421 - RNA, 20 nt, Artificial Sequence
  MKO10078421_B_Cnbp
  gRNA
agcaacgaaugcuucaagug

SEQ ID NO: 78422 - RNA, 20 nt, Artificial Sequence
  MKO10078422_B_Cnbp
  gRNA
ccugacaucugcuaccgcug

SEQ ID NO: 78423 - RNA, 20 nt, Artificial Sequence
  MKO10078423_B_Cndp1
  gRNA
ccccauaccuccuauccuau

SEQ ID NO: 78424 - RNA, 20 nt, Artificial Sequence
  MKO10078424_B_Cndp1
  gRNA
ggcauugauccaagccaaga

SEQ ID NO: 78425 - RNA, 20 nt, Artificial Sequence
  MKO10078425_B_Cndp1
  gRNA
ugggguggaguccauagacu

SEQ ID NO: 78426 - RNA, 20 nt, Artificial Sequence
  MKO10078426_B_Cndp2
  gRNA
ccaugcggacacgcucugga

SEQ ID NO: 78427 - RNA, 20 nt, Artificial Sequence
  MKO10078427_B_Cndp2
  gRNA
ccauccagagcguguccgca

SEQ ID NO: 78428 - RNA, 20 nt, Artificial Sequence
  MKO10078428_B_Cndp2
  gRNA
ggacagcgagcccuucaccu

SEQ ID NO: 78429 - RNA, 20 nt, Artificial Sequence
  MKO10078429_B_Cnep1r1
  gRNA
uguccuucuucacgucauua

SEQ ID NO: 78430 - RNA, 20 nt, Artificial Sequence
  MKO10078430_B_Cnep1r1
  gRNA
cauugcuugcaaccugccac

SEQ ID NO: 78431 - RNA, 20 nt, Artificial Sequence
  MKO10078431_B_Cnep1r1
  gRNA
ucuguacagcuacuggugcc

SEQ ID NO: 78432 - RNA, 20 nt, Artificial Sequence
  MKO10078432_B_Cnfn
  gRNA
gggcaugucguugcaacagu

SEQ ID NO: 78433 - RNA, 20 nt, Artificial Sequence
  MKO10078433_B_Cnfn
  gRNA
uagcagguguuggcgcacug

SEQ ID NO: 78434 - RNA, 20 nt, Artificial Sequence
  MKO10078434_B_Cnfn
  gRNA
gagaugcacgaccacgugaa

SEQ ID NO: 78435 - RNA, 20 nt, Artificial Sequence
  MKO10078435_B_Cnga1
  gRNA
uccagggagcagcacuugcc

SEQ ID NO: 78436 - RNA, 20 nt, Artificial Sequence
  MKO10078436_B_Cnga1
  gRNA
uuacucuucuuucuucucuu

SEQ ID NO: 78437 - RNA, 20 nt, Artificial Sequence
  MKO10078437_B_Cnga1
  gRNA
cccagagaagaaaaagaaga

SEQ ID NO: 78438 - RNA, 20 nt, Artificial Sequence
  MKO10078438_B_Cnga2
  gRNA
ucccucuaggauuguccgcc

SEQ ID NO: 78439 - RNA, 20 nt, Artificial Sequence
  MKO10078439_B_Cnga2
  gRNA
cagagauggauacuccacgc

SEQ ID NO: 78440 - RNA, 20 nt, Artificial Sequence
  MKO10078440_B_Cnga2
  gRNA
ccaugccuguucuuuacaac

SEQ ID NO: 78441 - RNA, 20 nt, Artificial Sequence
  MKO10078441_B_Cnga3
  gRNA
ccagcaacaucuacuaccgc

SEQ ID NO: 78442 - RNA, 20 nt, Artificial Sequence
  MKO10078442_B_Cnga3
  gRNA
acgcacgaaucgagaugaug

SEQ ID NO: 78443 - RNA, 20 nt, Artificial Sequence
  MKO10078443_B_Cnga3
  gRNA
gcgcgauggcagucagccag

SEQ ID NO: 78444 - RNA, 20 nt, Artificial Sequence
  MKO10078444_B_Cnga4
  gRNA
cgaauacguaugccgcaaag

SEQ ID NO: 78445 - RNA, 20 nt, Artificial Sequence
  MKO10078445_B_Cnga4
  gRNA
agcguaccccaauaucuagu

SEQ ID NO: 78446 - RNA, 20 nt, Artificial Sequence
  MKO10078446_B_Cnga4
  gRNA
aucucaucaucguuguaugc

SEQ ID NO: 78447 - RNA, 20 nt, Artificial Sequence
  MKO10078447_B_Cngb1
  gRNA
uugcuguugccaaggugaac

SEQ ID NO: 78448 - RNA, 20 nt, Artificial Sequence
  MKO10078448_B_Cngb1
  gRNA
ucagcacucaccuugaaggc

SEQ ID NO: 78449 - RNA, 20 nt, Artificial Sequence
  MKO10078449_B_Cngb1
  gRNA
ccuggguccccagugccaca

SEQ ID NO: 78450 - RNA, 20 nt, Artificial Sequence
  MKO10078450_B_Cngb3
  gRNA
guuugaaagaaaacgugucu

SEQ ID NO: 78451 - RNA, 20 nt, Artificial Sequence
  MKO10078451_B_Cngb3
  gRNA
uguguaggagucuaugcuuc

SEQ ID NO: 78452 - RNA, 20 nt, Artificial Sequence
  MKO10078452_B_Cngb3
  gRNA
agcagaacucaccagaacaa

SEQ ID NO: 78453 - RNA, 20 nt, Artificial Sequence
  MKO10078453_B_Cnih1
  gRNA
caggguucaggguauugcac

SEQ ID NO: 78454 - RNA, 20 nt, Artificial Sequence
  MKO10078454_B_Cnih1
  gRNA
gggccucaauaugccccuuu

SEQ ID NO: 78455 - RNA, 20 nt, Artificial Sequence
  MKO10078455_B_Cnih1
  gRNA
uuucagcaugaucuauguuc

SEQ ID NO: 78456 - RNA, 20 nt, Artificial Sequence
  MKO10078456_B_Cnih2
  gRNA
cagguacuuccaccguccug

SEQ ID NO: 78457 - RNA, 20 nt, Artificial Sequence
  MKO10078457_B_Cnih2
  gRNA
aacgcaucugcugccuccug

SEQ ID NO: 78458 - RNA, 20 nt, Artificial Sequence
  MKO10078458_B_Cnih2
  gRNA
ucacacugaccuuccucagg

SEQ ID NO: 78459 - RNA, 20 nt, Artificial Sequence
  MKO10078459_B_Cnih3
  gRNA
caucauguuccugugcgcuc

SEQ ID NO: 78460 - RNA, 20 nt, Artificial Sequence
  MKO10078460_B_Cnih3
  gRNA
ugagcgcagcgcagagcacc

SEQ ID NO: 78461 - RNA, 20 nt, Artificial Sequence
  MKO10078461_B_Cnih3
  gRNA
auccccagagagaacggcug

SEQ ID NO: 78462 - RNA, 20 nt, Artificial Sequence
  MKO10078462_B_Cnih4
  gRNA
auguugcucaaaauuaaaca

SEQ ID NO: 78463 - RNA, 20 nt, Artificial Sequence
  MKO10078463_B_Cnih4
  gRNA
guuucuucauguaucucuau

SEQ ID NO: 78464 - RNA, 20 nt, Artificial Sequence
  MKO10078464_B_Cnih4
  gRNA
uggacugcagugggugaucc

SEQ ID NO: 78465 - RNA, 20 nt, Artificial Sequence
  MKO10078465_B_Cnksr1
  gRNA
cgcacagcacgccaaucucc

SEQ ID NO: 78466 - RNA, 20 nt, Artificial Sequence
  MKO10078466_B_Cnksr1
  gRNA
uagaugggguggaacagcuc

SEQ ID NO: 78467 - RNA, 20 nt, Artificial Sequence
  MKO10078467_B_Cnksr1
  gRNA
uggcgugcugugcggggagc

SEQ ID NO: 78468 - RNA, 20 nt, Artificial Sequence
  MKO10078468_B_Cnksr2
  gRNA
agaaggagcggccauuauga

SEQ ID NO: 78469 - RNA, 20 nt, Artificial Sequence
  MKO10078469_B_Cnksr2
  gRNA
uaacgucauacagcucugcu

SEQ ID NO: 78470 - RNA, 20 nt, Artificial Sequence
  MKO10078470_B_Cnksr2
  gRNA
aaucuacaaaacuucauaac

SEQ ID NO: 78471 - RNA, 20 nt, Artificial Sequence
  MKO10078471_B_Cnksr3
  gRNA
cccccaguuccucgagaucc

SEQ ID NO: 78472 - RNA, 20 nt, Artificial Sequence
  MKO10078472_B_Cnksr3
  gRNA
ggauugccucauagcagaaa

SEQ ID NO: 78473 - RNA, 20 nt, Artificial Sequence
  MKO10078473_B_Cnksr3
  gRNA
ucgaggaacugggggucaca

SEQ ID NO: 78474 - RNA, 20 nt, Artificial Sequence
  MKO10078474_B_Cnn1
  gRNA
caggaacaucauuggacugc

SEQ ID NO: 78475 - RNA, 20 nt, Artificial Sequence
  MKO10078475_B_Cnn1
  gRNA
gaaaccccacgacaucuuug

SEQ ID NO: 78476 - RNA, 20 nt, Artificial Sequence
  MKO10078476_B_Cnn1
  gRNA
gugggguuucaccccauacu

SEQ ID NO: 78477 - RNA, 20 nt, Artificial Sequence
  MKO10078477_B_Cnn2
  gRNA
aguuaaguauucggagaaac

SEQ ID NO: 78478 - RNA, 20 nt, Artificial Sequence
  MKO10078478_B_Cnn2
  gRNA
ucaaccgcucuaugcagaac

SEQ ID NO: 78479 - RNA, 20 nt, Artificial Sequence
  MKO10078479_B_Cnn2
  gRNA
gccaaugaccuguucgagag

SEQ ID NO: 78480 - RNA, 20 nt, Artificial Sequence
  MKO10078480_B_Cnn3
  gRNA
gacccagguucagacgacgc

SEQ ID NO: 78481 - RNA, 20 nt, Artificial Sequence
  MKO10078481_B_Cnn3
  gRNA
uguuuacaguuggagaauau

SEQ ID NO: 78482 - RNA, 20 nt, Artificial Sequence
  MKO10078482_B_Cnn3
  gRNA
ccaguugcgcagaucuuccu

SEQ ID NO: 78483 - RNA, 20 nt, Artificial Sequence
  MKO10078483_B_Cnnm1
  gRNA
ggaucuucuccgaaagguac

SEQ ID NO: 78484 - RNA, 20 nt, Artificial Sequence
  MKO10078484_B_Cnnm1
  gRNA
aggcuccguucucaaagcga

SEQ ID NO: 78485 - RNA, 20 nt, Artificial Sequence
  MKO10078485_B_Cnnm1
  gRNA
gcuugccacacaccgcuuca

SEQ ID NO: 78486 - RNA, 20 nt, Artificial Sequence
  MKO10078486_B_Cnnm2
  gRNA
ucucgucguacuucagcucc

SEQ ID NO: 78487 - RNA, 20 nt, Artificial Sequence
  MKO10078487_B_Cnnm2
  gRNA
cucgcuguccgucugcuuaa

SEQ ID NO: 78488 - RNA, 20 nt, Artificial Sequence
  MKO10078488_B_Cnnm2
  gRNA
auuguucacucgcugcacaa

SEQ ID NO: 78489 - RNA, 20 nt, Artificial Sequence
  MKO10078489_B_Cnnm3
  gRNA
ucucgucaaacgucaccucc

SEQ ID NO: 78490 - RNA, 20 nt, Artificial Sequence
  MKO10078490_B_Cnnm3
  gRNA
gaggaagaagaccgucgccc

SEQ ID NO: 78491 - RNA, 20 nt, Artificial Sequence
  MKO10078491_B_Cnnm3
  gRNA
guuugacgagagcaaccgcc

SEQ ID NO: 78492 - RNA, 20 nt, Artificial Sequence
  MKO10078492_B_Cnnm4
  gRNA
uguacauguccgacucaucg

SEQ ID NO: 78493 - RNA, 20 nt, Artificial Sequence
  MKO10078493_B_Cnnm4
  gRNA
guccgagauccucgaugagu

SEQ ID NO: 78494 - RNA, 20 nt, Artificial Sequence
  MKO10078494_B_Cnnm4
  gRNA
cuucucguacuauggaacca

SEQ ID NO: 78495 - RNA, 20 nt, Artificial Sequence
  MKO10078495_B_Cnot10
  gRNA
cacuucuuaccgugaaggcc

SEQ ID NO: 78496 - RNA, 20 nt, Artificial Sequence
  MKO10078496_B_Cnot10
  gRNA
cuuguauauauuaacccacc

SEQ ID NO: 78497 - RNA, 20 nt, Artificial Sequence
  MKO10078497_B_Cnot10
  gRNA
aggccaaucaucugggguca

SEQ ID NO: 78498 - RNA, 20 nt, Artificial Sequence
  MKO10078498_B_Cnot11
  gRNA
uaaagacucugugauccgag

SEQ ID NO: 78499 - RNA, 20 nt, Artificial Sequence
  MKO10078499_B_Cnot11
  gRNA
cauguuuccaacguccauca

SEQ ID NO: 78500 - RNA, 20 nt, Artificial Sequence
  MKO10078500_B_Cnot11
  gRNA
gucgucuccccaacagacac

SEQ ID NO: 78501 - RNA, 20 nt, Artificial Sequence
  MKO10078501_B_Cnot1
  gRNA
uuaccaaaaccccugagauc

SEQ ID NO: 78502 - RNA, 20 nt, Artificial Sequence
  MKO10078502_B_Cnot1
  gRNA
uaauccauugcacuaccaga

SEQ ID NO: 78503 - RNA, 20 nt, Artificial Sequence
  MKO10078503_B_Cnot1
  gRNA
uuguguuucagauugugaau

SEQ ID NO: 78504 - RNA, 20 nt, Artificial Sequence
  MKO10078504_B_Cnot2
  gRNA
uaggugacaaacagcauguu

SEQ ID NO: 78505 - RNA, 20 nt, Artificial Sequence
  MKO10078505_B_Cnot2
  gRNA
gcaucaugucaaaaagagau

SEQ ID NO: 78506 - RNA, 20 nt, Artificial Sequence
  MKO10078506_B_Cnot2
  gRNA
gacucuauggugaggacuga

SEQ ID NO: 78507 - RNA, 20 nt, Artificial Sequence
  MKO10078507_B_Cnot3
  gRNA
caaaaccaaagcguauagca

SEQ ID NO: 78508 - RNA, 20 nt, Artificial Sequence
  MKO10078508_B_Cnot3
  gRNA
uucaaacugcuccaccccuu

SEQ ID NO: 78509 - RNA, 20 nt, Artificial Sequence
  MKO10078509_B_Cnot3
  gRNA
augcuacccaugucuugauc

SEQ ID NO: 78510 - RNA, 20 nt, Artificial Sequence
  MKO10078510_B_Cnot4
  gRNA
cguuaccugugagccugcau

SEQ ID NO: 78511 - RNA, 20 nt, Artificial Sequence
  MKO10078511_B_Cnot4
  gRNA
uuaaaacgaccagaguauuu

SEQ ID NO: 78512 - RNA, 20 nt, Artificial Sequence
  MKO10078512_B_Cnot4
  gRNA
guuacauaagcacuggcacu

SEQ ID NO: 78513 - RNA, 20 nt, Artificial Sequence
  MKO10078513_B_Cnot6l
  gRNA
aagagccggccaaguucaua

SEQ ID NO: 78514 - RNA, 20 nt, Artificial Sequence
  MKO10078514_B_Cnot6l
  gRNA
uaccuccucugcggacauga

SEQ ID NO: 78515 - RNA, 20 nt, Artificial Sequence
  MKO10078515_B_Cnot6l
  gRNA
uuaugaagcuuggcaauauc

SEQ ID NO: 78516 - RNA, 20 nt, Artificial Sequence
  MKO10078516_B_Cnot6
  gRNA
ucggaaacaugguaucacuc

SEQ ID NO: 78517 - RNA, 20 nt, Artificial Sequence
  MKO10078517_B_Cnot6
  gRNA
cauugccaagcuucacaauc

SEQ ID NO: 78518 - RNA, 20 nt, Artificial Sequence
  MKO10078518_B_Cnot6
  gRNA
aacaaccaccuccaagaucu

SEQ ID NO: 78519 - RNA, 20 nt, Artificial Sequence
  MKO10078519_B_Cnot7
  gRNA
gcagaacuucuuaugacuuc

SEQ ID NO: 78520 - RNA, 20 nt, Artificial Sequence
  MKO10078520_B_Cnot7
  gRNA
ggaucugacucacugcuuac

SEQ ID NO: 78521 - RNA, 20 nt, Artificial Sequence
  MKO10078521_B_Cnot7
  gRNA
gcgcauaggcccucagcacc

SEQ ID NO: 78522 - RNA, 20 nt, Artificial Sequence
  MKO10078522_B_Cnot8
  gRNA
ccuuacguucaccaaugaga

SEQ ID NO: 78523 - RNA, 20 nt, Artificial Sequence
  MKO10078523_B_Cnot8
  gRNA
acccgucuggaaucaacaca

SEQ ID NO: 78524 - RNA, 20 nt, Artificial Sequence
  MKO10078524_B_Cnot8
  gRNA
uccuuuagugguuaugauuu

SEQ ID NO: 78525 - RNA, 20 nt, Artificial Sequence
  MKO10078525_B_Cnppd1
  gRNA
agcuaagugcucgaauccga

SEQ ID NO: 78526 - RNA, 20 nt, Artificial Sequence
  MKO10078526_B_Cnppd1
  gRNA
acucuauuauggcugggacu

SEQ ID NO: 78527 - RNA, 20 nt, Artificial Sequence
  MKO10078527_B_Cnppd1
  gRNA
cccaggcucaccgggacaca

SEQ ID NO: 78528 - RNA, 20 nt, Artificial Sequence
  MKO10078528_B_Cnpy1
  gRNA
gccuugcacagcucauccac

SEQ ID NO: 78529 - RNA, 20 nt, Artificial Sequence
  MKO10078529_B_Cnpy1
  gRNA
accagaccccuaugccagaa

SEQ ID NO: 78530 - RNA, 20 nt, Artificial Sequence
  MKO10078530_B_Cnpy1
  gRNA
augcugugcaaugaaaaauc

SEQ ID NO: 78531 - RNA, 20 nt, Artificial Sequence
  MKO10078531_B_Cnpy2
  gRNA
gccaucuggauugauucgga

SEQ ID NO: 78532 - RNA, 20 nt, Artificial Sequence
  MKO10078532_B_Cnpy2
  gRNA
uaucgaauucuucuccagag

SEQ ID NO: 78533 - RNA, 20 nt, Artificial Sequence
  MKO10078533_B_Cnpy2
  gRNA
uccgcagugugagagcauug

SEQ ID NO: 78534 - RNA, 20 nt, Artificial Sequence
  MKO10078534_B_Cnpy3
  gRNA
gccggugucaaucacuuccu

SEQ ID NO: 78535 - RNA, 20 nt, Artificial Sequence
  MKO10078535_B_Cnpy3
  gRNA
cuccagagcccuucccgucc

SEQ ID NO: 78536 - RNA, 20 nt, Artificial Sequence
  MKO10078536_B_Cnpy3
  gRNA
ucacugagaccauuugcaag

SEQ ID NO: 78537 - RNA, 20 nt, Artificial Sequence
  MKO10078537_B_Cnpy4
  gRNA
cagugagacgcggcuagaag

SEQ ID NO: 78538 - RNA, 20 nt, Artificial Sequence
  MKO10078538_B_Cnpy4
  gRNA
uucccagugugagacgaugc

SEQ ID NO: 78539 - RNA, 20 nt, Artificial Sequence
  MKO10078539_B_Cnpy4
  gRNA
aguggaucugggaaucccuu

SEQ ID NO: 78540 - RNA, 20 nt, Artificial Sequence
  MKO10078540_B_Cnp
  gRNA
ccagguggugcugaccgauc

SEQ ID NO: 78541 - RNA, 20 nt, Artificial Sequence
  MKO10078541_B_Cnp
  gRNA
cuugagcuggucagcuacuu

SEQ ID NO: 78542 - RNA, 20 nt, Artificial Sequence
  MKO10078542_B_Cnp
  gRNA
ggcagaagaauacgcccagc

SEQ ID NO: 78543 - RNA, 20 nt, Artificial Sequence
  MKO10078543_B_Cnr1
  gRNA
gagcacuguuaagaucgcca

SEQ ID NO: 78544 - RNA, 20 nt, Artificial Sequence
  MKO10078544_B_Cnr1
  gRNA
ccuggugacgauccucuuau

SEQ ID NO: 78545 - RNA, 20 nt, Artificial Sequence
  MKO10078545_B_Cnr1
  gRNA
acucccgcagucuccgaugc

SEQ ID NO: 78546 - RNA, 20 nt, Artificial Sequence
  MKO10078546_B_Cnr2
  gRNA
cucggaugcggcuagacgug

SEQ ID NO: 78547 - RNA, 20 nt, Artificial Sequence
  MKO10078547_B_Cnr2
  gRNA
gaagugaccaacggcuccaa

SEQ ID NO: 78548 - RNA, 20 nt, Artificial Sequence
  MKO10078548_B_Cnr2
  gRNA
uacaaagcucuagucacccg

SEQ ID NO: 78549 - RNA, 20 nt, Artificial Sequence
  MKO10078549_B_Cnrip1
  gRNA
augagacccgcagccucaug

SEQ ID NO: 78550 - RNA, 20 nt, Artificial Sequence
  MKO10078550_B_Cnrip1
  gRNA
ggguugucgcucuccacuuu

SEQ ID NO: 78551 - RNA, 20 nt, Artificial Sequence
  MKO10078551_B_Cnrip1
  gRNA
gguguagccccaaccaaaag

SEQ ID NO: 78552 - RNA, 20 nt, Artificial Sequence
  MKO10078552_B_Cnst
  gRNA
cuuaccccauuguuccugaa

SEQ ID NO: 78553 - RNA, 20 nt, Artificial Sequence
  MKO10078553_B_Cnst
  gRNA
gguagcugagaccuauuucc

SEQ ID NO: 78554 - RNA, 20 nt, Artificial Sequence
  MKO10078554_B_Cnst
  gRNA
aaaggauacaguccucuucc

SEQ ID NO: 78555 - RNA, 20 nt, Artificial Sequence
  MKO10078555_B_Cntd1
  gRNA
ggagaaaucggugagcuacc

SEQ ID NO: 78556 - RNA, 20 nt, Artificial Sequence
  MKO10078556_B_Cntd1
  gRNA
ccagacaccauuguucagac

SEQ ID NO: 78557 - RNA, 20 nt, Artificial Sequence
  MKO10078557_B_Cntd1
  gRNA
guucaugcagaagauagacc

SEQ ID NO: 78558 - RNA, 20 nt, Artificial Sequence
  MKO10078558_B_Cntfr
  gRNA
ucagcugagagccguugagc

SEQ ID NO: 78559 - RNA, 20 nt, Artificial Sequence
  MKO10078559_B_Cntfr
  gRNA
cacgcagaaacacaguccac

SEQ ID NO: 78560 - RNA, 20 nt, Artificial Sequence
  MKO10078560_B_Cntfr
  gRNA
guguuucugcguguagacag

SEQ ID NO: 78561 - RNA, 20 nt, Artificial Sequence
  MKO10078561_B_Cntf
  gRNA
caccucugacccuucaccgc

SEQ ID NO: 78562 - RNA, 20 nt, Artificial Sequence
  MKO10078562_B_Cntf
  gRNA
ccaccaucuccaauugugac

SEQ ID NO: 78563 - RNA, 20 nt, Artificial Sequence
  MKO10078563_B_Cntf
  gRNA
gcgccauuaacuccucuagc

SEQ ID NO: 78564 - RNA, 20 nt, Artificial Sequence
  MKO10078564_B_Cntln
  gRNA
cugacaguuugagugagauc

SEQ ID NO: 78565 - RNA, 20 nt, Artificial Sequence
  MKO10078565_B_Cntln
  gRNA
gucaacacaccuucacuucu

SEQ ID NO: 78566 - RNA, 20 nt, Artificial Sequence
  MKO10078566_B_Cntln
  gRNA
aggcugacaaggaauuugua

SEQ ID NO: 78567 - RNA, 20 nt, Artificial Sequence
  MKO10078567_B_Cntn1
  gRNA
gauuggcugcucuucaaaaa

SEQ ID NO: 78568 - RNA, 20 nt, Artificial Sequence
  MKO10078568_B_Cntn1
  gRNA
augaccauaucuucugugcc

SEQ ID NO: 78569 - RNA, 20 nt, Artificial Sequence
  MKO10078569_B_Cntn1
  gRNA
ucucgaccccuuuccucccg

SEQ ID NO: 78570 - RNA, 20 nt, Artificial Sequence
  MKO10078570_B_Cntn2
  gRNA
ggaucucacagccgaagcgg

SEQ ID NO: 78571 - RNA, 20 nt, Artificial Sequence
  MKO10078571_B_Cntn2
  gRNA
uccccacuuaccuggguagu

SEQ ID NO: 78572 - RNA, 20 nt, Artificial Sequence
  MKO10078572_B_Cntn2
  gRNA
uugcugacgacagugccuac

SEQ ID NO: 78573 - RNA, 20 nt, Artificial Sequence
  MKO10078573_B_Cntn3
  gRNA
cuccauucaguuuguaacga

SEQ ID NO: 78574 - RNA, 20 nt, Artificial Sequence
  MKO10078574_B_Cntn3
  gRNA
cuguaccuguaaugagguga

SEQ ID NO: 78575 - RNA, 20 nt, Artificial Sequence
  MKO10078575_B_Cntn3
  gRNA
gagaauucguugcaaaacac

SEQ ID NO: 78576 - RNA, 20 nt, Artificial Sequence
  MKO10078576_B_Cntn4
  gRNA
uuccgcuacaguguuguuga

SEQ ID NO: 78577 - RNA, 20 nt, Artificial Sequence
  MKO10078577_B_Cntn4
  gRNA
ucauucauguugugccuugc

SEQ ID NO: 78578 - RNA, 20 nt, Artificial Sequence
  MKO10078578_B_Cntn4
  gRNA
aaacucaguugugaaguuaa

SEQ ID NO: 78579 - RNA, 20 nt, Artificial Sequence
  MKO10078579_B_Cntn5
  gRNA
uauuuguagcuguccacgaa

SEQ ID NO: 78580 - RNA, 20 nt, Artificial Sequence
  MKO10078580_B_Cntn5
  gRNA
gaacagaaugagucuccaac

SEQ ID NO: 78581 - RNA, 20 nt, Artificial Sequence
  MKO10078581_B_Cntn5
  gRNA
uuucacugucacagcugcua

SEQ ID NO: 78582 - RNA, 20 nt, Artificial Sequence
  MKO10078582_B_Cntn6
  gRNA
guaccacuccuugaccuucu

SEQ ID NO: 78583 - RNA, 20 nt, Artificial Sequence
  MKO10078583_B_Cntn6
  gRNA
ccuuuagugcugcgcacuga

SEQ ID NO: 78584 - RNA, 20 nt, Artificial Sequence
  MKO10078584_B_Cntn6
  gRNA
cuuacaugcaaacuguagcu

SEQ ID NO: 78585 - RNA, 20 nt, Artificial Sequence
  MKO10078585_B_Cntnap1
  gRNA
ucgcuggaagcgguaugaga

SEQ ID NO: 78586 - RNA, 20 nt, Artificial Sequence
  MKO10078586_B_Cntnap1
  gRNA
ggauuggggacccgaauccc

SEQ ID NO: 78587 - RNA, 20 nt, Artificial Sequence
  MKO10078587_B_Cntnap1
  gRNA
cauuaagucgaucugcagcc

SEQ ID NO: 78588 - RNA, 20 nt, Artificial Sequence
  MKO10078588_B_Cntnap2
  gRNA
uaugccaagauuaauaaacg

SEQ ID NO: 78589 - RNA, 20 nt, Artificial Sequence
  MKO10078589_B_Cntnap2
  gRNA
auaaccaggugcauagcugc

SEQ ID NO: 78590 - RNA, 20 nt, Artificial Sequence
  MKO10078590_B_Cntnap2
  gRNA
guuauaugggaaaucagcac

SEQ ID NO: 78591 - RNA, 20 nt, Artificial Sequence
  MKO10078591_B_Cntnap3
  gRNA
uauaaucccgcuguucugca

SEQ ID NO: 78592 - RNA, 20 nt, Artificial Sequence
  MKO10078592_B_Cntnap3
  gRNA
ugcgcuuccuccccuuaacc

SEQ ID NO: 78593 - RNA, 20 nt, Artificial Sequence
  MKO10078593_B_Cntnap3
  gRNA
agccauaagaccaguaagag

SEQ ID NO: 78594 - RNA, 20 nt, Artificial Sequence
  MKO10078594_B_Cntnap4
  gRNA
ucgguuguaauugaucuuga

SEQ ID NO: 78595 - RNA, 20 nt, Artificial Sequence
  MKO10078595_B_Cntnap4
  gRNA
gcgaugggauccuacugcac

SEQ ID NO: 78596 - RNA, 20 nt, Artificial Sequence
  MKO10078596_B_Cntnap4
  gRNA
gcaaggcugaaucgaagaga

SEQ ID NO: 78597 - RNA, 20 nt, Artificial Sequence
  MKO10078597_B_Cntnap5a
  gRNA
gauugaccugcaaaacagag

SEQ ID NO: 78598 - RNA, 20 nt, Artificial Sequence
  MKO10078598_B_Cntnap5a
  gRNA
uucgcuuugugccccuagag

SEQ ID NO: 78599 - RNA, 20 nt, Artificial Sequence
  MKO10078599_B_Cntnap5a
  gRNA
guccaacuuccucucacuga

SEQ ID NO: 78600 - RNA, 20 nt, Artificial Sequence
  MKO10078600_B_Cntnap5b
  gRNA
uccagcucagcucaacugaa

SEQ ID NO: 78601 - RNA, 20 nt, Artificial Sequence
  MKO10078601_B_Cntnap5b
  gRNA
ccuuacccaaguucagguau

SEQ ID NO: 78602 - RNA, 20 nt, Artificial Sequence
  MKO10078602_B_Cntnap5b
  gRNA
ucacagcgugcaguagcuug

SEQ ID NO: 78603 - RNA, 20 nt, Artificial Sequence
  MKO10078603_B_Cntnap5c
  gRNA
ugagggugcucauugucuuc

SEQ ID NO: 78604 - RNA, 20 nt, Artificial Sequence
  MKO10078604_B_Cntnap5c
  gRNA
ccagcccagcucaacucaac

SEQ ID NO: 78605 - RNA, 20 nt, Artificial Sequence
  MKO10078605_B_Cntnap5c
  gRNA
ucacagaguucagcaguuug

SEQ ID NO: 78606 - RNA, 20 nt, Artificial Sequence
  MKO10078606_B_Cntrob
  gRNA
guugcaacaacagcuagcug

SEQ ID NO: 78607 - RNA, 20 nt, Artificial Sequence
  MKO10078607_B_Cntrob
  gRNA
caugauugaacaacuagaca

SEQ ID NO: 78608 - RNA, 20 nt, Artificial Sequence
  MKO10078608_B_Cntrob
  gRNA
gucuaagcacaucuuugaga

SEQ ID NO: 78609 - RNA, 20 nt, Artificial Sequence
  MKO10078609_B_Coa3
  gRNA
agaugguuacaccuucuacu

SEQ ID NO: 78610 - RNA, 20 nt, Artificial Sequence
  MKO10078610_B_Coa3
  gRNA
gggucgaugcgcugagcgaa

SEQ ID NO: 78611 - RNA, 20 nt, Artificial Sequence
  MKO10078611_B_Coa3
  gRNA
cggacccggaacaucaugac

SEQ ID NO: 78612 - RNA, 20 nt, Artificial Sequence
  MKO10078612_B_Coa4
  gRNA
agccagaccgggugaugagc

SEQ ID NO: 78613 - RNA, 20 nt, Artificial Sequence
  MKO10078613_B_Coa4
  gRNA
ccugcacuugcggcuggcac

SEQ ID NO: 78614 - RNA, 20 nt, Artificial Sequence
  MKO10078614_B_Coa4
  gRNA
ugaugaugaggaagacccgc

SEQ ID NO: 78615 - RNA, 20 nt, Artificial Sequence
  MKO10078615_B_Coa5
  gRNA
ucucccucugaaucuugauc

SEQ ID NO: 78616 - RNA, 20 nt, Artificial Sequence
  MKO10078616_B_Coa5
  gRNA
ccuuccuucaaacacugccg

SEQ ID NO: 78617 - RNA, 20 nt, Artificial Sequence
  MKO10078617_B_Coa5
  gRNA
gaugccagaucaagauucag

SEQ ID NO: 78618 - RNA, 20 nt, Artificial Sequence
  MKO10078618_B_Coa6
  gRNA
uuucagucgacugugaagac

SEQ ID NO: 78619 - RNA, 20 nt, Artificial Sequence
  MKO10078619_B_Coa6
  gRNA
cguccuccgcguugucgucc

SEQ ID NO: 78620 - RNA, 20 nt, Artificial Sequence
  MKO10078620_B_Coa6
  gRNA
gcgggacuuacccacugcug

SEQ ID NO: 78621 - RNA, 20 nt, Artificial Sequence
  MKO10078621_B_Coasy
  gRNA
gagaggccggagcucccguc

SEQ ID NO: 78622 - RNA, 20 nt, Artificial Sequence
  MKO10078622_B_Coasy
  gRNA
cagcuuucgccagcgaaucc

SEQ ID NO: 78623 - RNA, 20 nt, Artificial Sequence
  MKO10078623_B_Coasy
  gRNA
caggauucgcuggcgaaagc

SEQ ID NO: 78624 - RNA, 20 nt, Artificial Sequence
  MKO10078624_B_Cobll1
  gRNA
caagaucuugaaggggugcg

SEQ ID NO: 78625 - RNA, 20 nt, Artificial Sequence
  MKO10078625_B_Cobll1
  gRNA
acgacagcaguagauucuac

SEQ ID NO: 78626 - RNA, 20 nt, Artificial Sequence
  MKO10078626_B_Cobll1
  gRNA
acuaagagaguuauaugcca

SEQ ID NO: 78627 - RNA, 20 nt, Artificial Sequence
  MKO10078627_B_Cobl
  gRNA
gaacuaccugagaacgcaga

SEQ ID NO: 78628 - RNA, 20 nt, Artificial Sequence
  MKO10078628_B_Cobl
  gRNA
aucaccgugguucugcccag

SEQ ID NO: 78629 - RNA, 20 nt, Artificial Sequence
  MKO10078629_B_Cobl
  gRNA
cagaaccacggugaugucca

SEQ ID NO: 78630 - RNA, 20 nt, Artificial Sequence
  MKO10078630_B_Coch
  gRNA
gacagcagcgccgcagaugc

SEQ ID NO: 78631 - RNA, 20 nt, Artificial Sequence
  MKO10078631_B_Coch
  gRNA
gacacgcacaggucccccug

SEQ ID NO: 78632 - RNA, 20 nt, Artificial Sequence
  MKO10078632_B_Coch
  gRNA
uguggacacugcccguccug

SEQ ID NO: 78633 - RNA, 20 nt, Artificial Sequence
  MKO10078633_B_Cog1
  gRNA
gggucgggcagcacgccuuc

SEQ ID NO: 78634 - RNA, 20 nt, Artificial Sequence
  MKO10078634_B_Cog1
  gRNA
ugaugggaugugcgagaguu

SEQ ID NO: 78635 - RNA, 20 nt, Artificial Sequence
  MKO10078635_B_Cog1
  gRNA
cugcugccaccuggcggaug

SEQ ID NO: 78636 - RNA, 20 nt, Artificial Sequence
  MKO10078636_B_Cog2
  gRNA
ugcucaccagguuuguugag

SEQ ID NO: 78637 - RNA, 20 nt, Artificial Sequence
  MKO10078637_B_Cog2
  gRNA
ucuucucguaacugucccaa

SEQ ID NO: 78638 - RNA, 20 nt, Artificial Sequence
  MKO10078638_B_Cog2
  gRNA
cagaauuccuucacugacag

SEQ ID NO: 78639 - RNA, 20 nt, Artificial Sequence
  MKO10078639_B_Cog3
  gRNA
uacagaagacauccuguuaa

SEQ ID NO: 78640 - RNA, 20 nt, Artificial Sequence
  MKO10078640_B_Cog3
  gRNA
ugcaaaacugcaaacucaga

SEQ ID NO: 78641 - RNA, 20 nt, Artificial Sequence
  MKO10078641_B_Cog3
  gRNA
aggaugaaggaacuaaauau

SEQ ID NO: 78642 - RNA, 20 nt, Artificial Sequence
  MKO10078642_B_Cog4
  gRNA
ucuugaagaaucgcuccacc

SEQ ID NO: 78643 - RNA, 20 nt, Artificial Sequence
  MKO10078643_B_Cog4
  gRNA
caaaguccgucagcuugacc

SEQ ID NO: 78644 - RNA, 20 nt, Artificial Sequence
  MKO10078644_B_Cog4
  gRNA
cgucucccucaaucaacugc

SEQ ID NO: 78645 - RNA, 20 nt, Artificial Sequence
  MKO10078645_B_Cog5
  gRNA
gucuugccaguugugcagua

SEQ ID NO: 78646 - RNA, 20 nt, Artificial Sequence
  MKO10078646_B_Cog5
  gRNA
cucuacagggagcuguugau

SEQ ID NO: 78647 - RNA, 20 nt, Artificial Sequence
  MKO10078647_B_Cog5
  gRNA
uuacagcuugaugaauagau

SEQ ID NO: 78648 - RNA, 20 nt, Artificial Sequence
  MKO10078648_B_Cog6
  gRNA
aaagaccacuaagcugcaag

SEQ ID NO: 78649 - RNA, 20 nt, Artificial Sequence
  MKO10078649_B_Cog6
  gRNA
aagcaucaaugaagauguac

SEQ ID NO: 78650 - RNA, 20 nt, Artificial Sequence
  MKO10078650_B_Cog6
  gRNA
cagaagcuuagccaucaaug

SEQ ID NO: 78651 - RNA, 20 nt, Artificial Sequence
  MKO10078651_B_Cog7
  gRNA
gacacuuguaguaguaugca

SEQ ID NO: 78652 - RNA, 20 nt, Artificial Sequence
  MKO10078652_B_Cog7
  gRNA
guccaggaugcagcuugcug

SEQ ID NO: 78653 - RNA, 20 nt, Artificial Sequence
  MKO10078653_B_Cog7
  gRNA
gaacagcuugaugaugcuug

SEQ ID NO: 78654 - RNA, 20 nt, Artificial Sequence
  MKO10078654_B_Cog8
  gRNA
cgcugauguucacgugucca

SEQ ID NO: 78655 - RNA, 20 nt, Artificial Sequence
  MKO10078655_B_Cog8
  gRNA
cgugaacaucagcgccaucc

SEQ ID NO: 78656 - RNA, 20 nt, Artificial Sequence
  MKO10078656_B_Cog8
  gRNA
uuuagagauaccccagcuua

SEQ ID NO: 78657 - RNA, 20 nt, Artificial Sequence
  MKO10078657_B_Coil
  gRNA
uccaguagagccccccaaga

SEQ ID NO: 78658 - RNA, 20 nt, Artificial Sequence
  MKO10078658_B_Coil
  gRNA
cuauagucuauuaccacugu

SEQ ID NO: 78659 - RNA, 20 nt, Artificial Sequence
  MKO10078659_B_Coil
  gRNA
accuuguagucagagacauc

SEQ ID NO: 78660 - RNA, 20 nt, Artificial Sequence
  MKO10078660_B_Col10a1
  gRNA
ccauacgccauaaagaguaa

SEQ ID NO: 78661 - RNA, 20 nt, Artificial Sequence
  MKO10078661_B_Col10a1
  gRNA
ccgcuugucagugcuaacca

SEQ ID NO: 78662 - RNA, 20 nt, Artificial Sequence
  MKO10078662_B_Col10a1
  gRNA
ccucgagguccgguugggcc

SEQ ID NO: 78663 - RNA, 20 nt, Artificial Sequence
  MKO10078663_B_Col11a1
  gRNA
gaaugccauguucauuguag

SEQ ID NO: 78664 - RNA, 20 nt, Artificial Sequence
  MKO10078664_B_Col11a1
  gRNA
cauucagcaacucgguguug

SEQ ID NO: 78665 - RNA, 20 nt, Artificial Sequence
  MKO10078665_B_Col11a1
  gRNA
agucacaaucuggacuguaa

SEQ ID NO: 78666 - RNA, 20 nt, Artificial Sequence
  MKO10078666_B_Col11a2
  gRNA
aggcuuguggccguccccuc

SEQ ID NO: 78667 - RNA, 20 nt, Artificial Sequence
  MKO10078667_B_Col11a2
  gRNA
aucucugcagggcgauguuc

SEQ ID NO: 78668 - RNA, 20 nt, Artificial Sequence
  MKO10078668_B_Col11a2
  gRNA
cuuggacgccugggacaacg

SEQ ID NO: 78669 - RNA, 20 nt, Artificial Sequence
  MKO10078669_B_Col12a1
  gRNA
auaacaguggacccuacaac

SEQ ID NO: 78670 - RNA, 20 nt, Artificial Sequence
  MKO10078670_B_Col12a1
  gRNA
gcaaggguaaauucuuuagu

SEQ ID NO: 78671 - RNA, 20 nt, Artificial Sequence
  MKO10078671_B_Col12a1
  gRNA
uuugacucaguucaaacagg

SEQ ID NO: 78672 - RNA, 20 nt, Artificial Sequence
  MKO10078672_B_Col13a1
  gRNA
cagggggacaagggugccau

SEQ ID NO: 78673 - RNA, 20 nt, Artificial Sequence
  MKO10078673_B_Col13a1
  gRNA
gaguuacuuacugggagucc

SEQ ID NO: 78674 - RNA, 20 nt, Artificial Sequence
  MKO10078674_B_Col13a1
  gRNA
cagggucccacuggaagacc

SEQ ID NO: 78675 - RNA, 20 nt, Artificial Sequence
  MKO10078675_B_Col14a1
  gRNA
gcaacaaaagcgauuauuca

SEQ ID NO: 78676 - RNA, 20 nt, Artificial Sequence
  MKO10078676_B_Col14a1
  gRNA
aguaaaccaacuucaccaga

SEQ ID NO: 78677 - RNA, 20 nt, Artificial Sequence
  MKO10078677_B_Col14a1
  gRNA
uagccaccaaauuucccucu

SEQ ID NO: 78678 - RNA, 20 nt, Artificial Sequence
  MKO10078678_B_Col15a1
  gRNA
uucuugcaggaggaccgcgc

SEQ ID NO: 78679 - RNA, 20 nt, Artificial Sequence
  MKO10078679_B_Col15a1
  gRNA
uuaccaucuauucagacccc

SEQ ID NO: 78680 - RNA, 20 nt, Artificial Sequence
  MKO10078680_B_Col15a1
  gRNA
gcucaccggggcuugugugu

SEQ ID NO: 78681 - RNA, 20 nt, Artificial Sequence
  MKO10078681_B_Col16a1
  gRNA
caaguaccauguguuccgga

SEQ ID NO: 78682 - RNA, 20 nt, Artificial Sequence
  MKO10078682_B_Col16a1
  gRNA
cccagcucuucgaucugcgu

SEQ ID NO: 78683 - RNA, 20 nt, Artificial Sequence
  MKO10078683_B_Col16a1
  gRNA
cacagacgaguguucccucg

SEQ ID NO: 78684 - RNA, 20 nt, Artificial Sequence
  MKO10078684_B_Col17a1
  gRNA
cuccccugaguacccacgaa

SEQ ID NO: 78685 - RNA, 20 nt, Artificial Sequence
  MKO10078685_B_Col17a1
  gRNA
gacuuaccgaguuccuuucg

SEQ ID NO: 78686 - RNA, 20 nt, Artificial Sequence
  MKO10078686_B_Col17a1
  gRNA
ugauguagccgcugcugcca

SEQ ID NO: 78687 - RNA, 20 nt, Artificial Sequence
  MKO10078687_B_Col18a1
  gRNA
accuccuauagaaucuaccg

SEQ ID NO: 78688 - RNA, 20 nt, Artificial Sequence
  MKO10078688_B_Col18a1
  gRNA
ucuucauccagacagugcac

SEQ ID NO: 78689 - RNA, 20 nt, Artificial Sequence
  MKO10078689_B_Col18a1
  gRNA
ggugagcccugugcacuguc

SEQ ID NO: 78690 - RNA, 20 nt, Artificial Sequence
  MKO10078690_B_Col19a1
  gRNA
uuaccugggccauauucugc

SEQ ID NO: 78691 - RNA, 20 nt, Artificial Sequence
  MKO10078691_B_Col19a1
  gRNA
ugauaaaaccuguuucaagu

SEQ ID NO: 78692 - RNA, 20 nt, Artificial Sequence
  MKO10078692_B_Col19a1
  gRNA
cauaguaagauauuucccaa

SEQ ID NO: 78693 - RNA, 20 nt, Artificial Sequence
  MKO10078693_B_Col1a1
  gRNA
cagggacccguuggcccccc

SEQ ID NO: 78694 - RNA, 20 nt, Artificial Sequence
  MKO10078694_B_Col1a1
  gRNA
cgaugcuuacccuugggccu

SEQ ID NO: 78695 - RNA, 20 nt, Artificial Sequence
  MKO10078695_B_Col1a1
  gRNA
ucaccaaacucagaagaugu

SEQ ID NO: 78696 - RNA, 20 nt, Artificial Sequence
  MKO10078696_B_Col1a2
  gRNA
ucccucaacagauuugcaau

SEQ ID NO: 78697 - RNA, 20 nt, Artificial Sequence
  MKO10078697_B_Col1a2
  gRNA
uaucuuaccccaguaagacc

SEQ ID NO: 78698 - RNA, 20 nt, Artificial Sequence
  MKO10078698_B_Col1a2
  gRNA
uagggccccacuggagacag

SEQ ID NO: 78699 - RNA, 20 nt, Artificial Sequence
  MKO10078699_B_Col20a1
  gRNA
gugguuguggccgaugcucc

SEQ ID NO: 78700 - RNA, 20 nt, Artificial Sequence
  MKO10078700_B_Col20a1
  gRNA
uuggggguguacauuggaac

SEQ ID NO: 78701 - RNA, 20 nt, Artificial Sequence
  MKO10078701_B_Col20a1
  gRNA
gcauugccuuuaccuuaagc

SEQ ID NO: 78702 - RNA, 20 nt, Artificial Sequence
  MKO10078702_B_Col22a1
  gRNA
gugacaaaggcauacucauc

SEQ ID NO: 78703 - RNA, 20 nt, Artificial Sequence
  MKO10078703_B_Col22a1
  gRNA
gaaggaacccauccguacau

SEQ ID NO: 78704 - RNA, 20 nt, Artificial Sequence
  MKO10078704_B_Col22a1
  gRNA
gaucgguuuaaacauaccaa

SEQ ID NO: 78705 - RNA, 20 nt, Artificial Sequence
  MKO10078705_B_Col23a1
  gRNA
uucucgaacuguccugagcu

SEQ ID NO: 78706 - RNA, 20 nt, Artificial Sequence
  MKO10078706_B_Col23a1
  gRNA
caggggcaaucaggacgaga

SEQ ID NO: 78707 - RNA, 20 nt, Artificial Sequence
  MKO10078707_B_Col23a1
  gRNA
ccugcuuaggucccccugga

SEQ ID NO: 78708 - RNA, 20 nt, Artificial Sequence
  MKO10078708_B_Col24a1
  gRNA
ccugggauacccaucggacc

SEQ ID NO: 78709 - RNA, 20 nt, Artificial Sequence
  MKO10078709_B_Col24a1
  gRNA
ggcaacccgggauuuccaug

SEQ ID NO: 78710 - RNA, 20 nt, Artificial Sequence
  MKO10078710_B_Col24a1
  gRNA
aauuuacuuaccuuuggacc

SEQ ID NO: 78711 - RNA, 20 nt, Artificial Sequence
  MKO10078711_B_Col25a1
  gRNA
gcugggcaguugcacucuaa

SEQ ID NO: 78712 - RNA, 20 nt, Artificial Sequence
  MKO10078712_B_Col25a1
  gRNA
ucagguccuccagggaaacg

SEQ ID NO: 78713 - RNA, 20 nt, Artificial Sequence
  MKO10078713_B_Col25a1
  gRNA
ccucucuucccucguuuccc

SEQ ID NO: 78714 - RNA, 20 nt, Artificial Sequence
  MKO10078714_B_Col26a1
  gRNA
gacucgcuggaccaccgucu

SEQ ID NO: 78715 - RNA, 20 nt, Artificial Sequence
  MKO10078715_B_Col26a1
  gRNA
acuccagcgcagucaccgug

SEQ ID NO: 78716 - RNA, 20 nt, Artificial Sequence
  MKO10078716_B_Col26a1
  gRNA
ccggggcccuggaugugcga

SEQ ID NO: 78717 - RNA, 20 nt, Artificial Sequence
  MKO10078717_B_Col27a1
  gRNA
ggugggccuggguucccgua

SEQ ID NO: 78718 - RNA, 20 nt, Artificial Sequence
  MKO10078718_B_Col27a1
  gRNA
cuaggggguuucucuucgcc

SEQ ID NO: 78719 - RNA, 20 nt, Artificial Sequence
  MKO10078719_B_Col27a1
  gRNA
uccucuucaagggucccccu

SEQ ID NO: 78720 - RNA, 20 nt, Artificial Sequence
  MKO10078720_B_Col28a1
  gRNA
ccucgcucaccuuugauacc

SEQ ID NO: 78721 - RNA, 20 nt, Artificial Sequence
  MKO10078721_B_Col28a1
  gRNA
caagaucugugaaugugaaa

SEQ ID NO: 78722 - RNA, 20 nt, Artificial Sequence
  MKO10078722_B_Col28a1
  gRNA
ucuagggugucuuguuugaa

SEQ ID NO: 78723 - RNA, 20 nt, Artificial Sequence
  MKO10078723_B_Col2a1
  gRNA
cccuuucuuaccugagggcc

SEQ ID NO: 78724 - RNA, 20 nt, Artificial Sequence
  MKO10078724_B_Col2a1
  gRNA
acacagaucauaggacccag

SEQ ID NO: 78725 - RNA, 20 nt, Artificial Sequence
  MKO10078725_B_Col2a1
  gRNA
cuuacaucucugauaucucc

SEQ ID NO: 78726 - RNA, 20 nt, Artificial Sequence
  MKO10078726_B_Col3a1
  gRNA
ucuggguuggggcagucuag

SEQ ID NO: 78727 - RNA, 20 nt, Artificial Sequence
  MKO10078727_B_Col3a1
  gRNA
gacucauaugaugucaaguc

SEQ ID NO: 78728 - RNA, 20 nt, Artificial Sequence
  MKO10078728_B_Col3a1
  gRNA
ccagacaucucuagacucau

SEQ ID NO: 78729 - RNA, 20 nt, Artificial Sequence
  MKO10078729_B_Col4a1
  gRNA
uguggaaaaugugacuguca

SEQ ID NO: 78730 - RNA, 20 nt, Artificial Sequence
  MKO10078730_B_Col4a1
  gRNA
uuccuggcacaaaagggacg

SEQ ID NO: 78731 - RNA, 20 nt, Artificial Sequence
  MKO10078731_B_Col4a1
  gRNA
ccaggguagccagcugcucc

SEQ ID NO: 78732 - RNA, 20 nt, Artificial Sequence
  MKO10078732_B_Col4a2
  gRNA
acccguaccacaucuccuuu

SEQ ID NO: 78733 - RNA, 20 nt, Artificial Sequence
  MKO10078733_B_Col4a2
  gRNA
cccccaagacgcucugagcc

SEQ ID NO: 78734 - RNA, 20 nt, Artificial Sequence
  MKO10078734_B_Col4a2
  gRNA
cagggagcgagaggcgucuc

SEQ ID NO: 78735 - RNA, 20 nt, Artificial Sequence
  MKO10078735_B_Col4a3bp
  gRNA
agcccgacgaguuccagcuc

SEQ ID NO: 78736 - RNA, 20 nt, Artificial Sequence
  MKO10078736_B_Col4a3bp
  gRNA
ucaguguaaaugauaguguu

SEQ ID NO: 78737 - RNA, 20 nt, Artificial Sequence
  MKO10078737_B_Col4a3bp
  gRNA
cauuuacacugauaucaaac

SEQ ID NO: 78738 - RNA, 20 nt, Artificial Sequence
  MKO10078738_B_Col4a3
  gRNA
cuagggcuccccaggacuuc

SEQ ID NO: 78739 - RNA, 20 nt, Artificial Sequence
  MKO10078739_B_Col4a3
  gRNA
ccacauaccuugggucccug

SEQ ID NO: 78740 - RNA, 20 nt, Artificial Sequence
  MKO10078740_B_Col4a3
  gRNA
ucauuacuuacuggaagucc

SEQ ID NO: 78741 - RNA, 20 nt, Artificial Sequence
  MKO10078741_B_Col4a4
  gRNA
acagguacaccauccacacc

SEQ ID NO: 78742 - RNA, 20 nt, Artificial Sequence
  MKO10078742_B_Col4a4
  gRNA
cugggaccuauugggauucc

SEQ ID NO: 78743 - RNA, 20 nt, Artificial Sequence
  MKO10078743_B_Col4a4
  gRNA
cucacccgagaucccuucuc

SEQ ID NO: 78744 - RNA, 20 nt, Artificial Sequence
  MKO10078744_B_Col4a5
  gRNA
accauacuuacaggaagacc

SEQ ID NO: 78745 - RNA, 20 nt, Artificial Sequence
  MKO10078745_B_Col4a5
  gRNA
ggaucaaaaugugacugcag

SEQ ID NO: 78746 - RNA, 20 nt, Artificial Sequence
  MKO10078746_B_Col4a5
  gRNA
cagggugaugauggaauucc

SEQ ID NO: 78747 - RNA, 20 nt, Artificial Sequence
  MKO10078747_B_Col4a6
  gRNA
cuuaugcuugaccaaagaac

SEQ ID NO: 78748 - RNA, 20 nt, Artificial Sequence
  MKO10078748_B_Col4a6
  gRNA
uguuggcaucagugguauuc

SEQ ID NO: 78749 - RNA, 20 nt, Artificial Sequence
  MKO10078749_B_Col4a6
  gRNA
ccacugaugccaacaaagcc

SEQ ID NO: 78750 - RNA, 20 nt, Artificial Sequence
  MKO10078750_B_Col5a1
  gRNA
ucgaagaucuuccagcgagc

SEQ ID NO: 78751 - RNA, 20 nt, Artificial Sequence
  MKO10078751_B_Col5a1
  gRNA
uaaucuucuucuuacagucg

SEQ ID NO: 78752 - RNA, 20 nt, Artificial Sequence
  MKO10078752_B_Col5a1
  gRNA
agcucagccagcagaucuuc

SEQ ID NO: 78753 - RNA, 20 nt, Artificial Sequence
  MKO10078753_B_Col5a2
  gRNA
cuuacaacaggcacuaaucc

SEQ ID NO: 78754 - RNA, 20 nt, Artificial Sequence
  MKO10078754_B_Col5a2
  gRNA
gaaauagccuguacucaaca

SEQ ID NO: 78755 - RNA, 20 nt, Artificial Sequence
  MKO10078755_B_Col5a2
  gRNA
uagggacaaaaaggagaacc

SEQ ID NO: 78756 - RNA, 20 nt, Artificial Sequence
  MKO10078756_B_Col5a3
  gRNA
caggcuuccaguacguccac

SEQ ID NO: 78757 - RNA, 20 nt, Artificial Sequence
  MKO10078757_B_Col5a3
  gRNA
cacagggugaccgagcauuc

SEQ ID NO: 78758 - RNA, 20 nt, Artificial Sequence
  MKO10078758_B_Col5a3
  gRNA
ccccaagcaagucaacauua

SEQ ID NO: 78759 - RNA, 20 nt, Artificial Sequence
  MKO10078759_B_Col6a1
  gRNA
guacuugaccgcauccacgc

SEQ ID NO: 78760 - RNA, 20 nt, Artificial Sequence
  MKO10078760_B_Col6a1
  gRNA
gcauagccgcgaugcagaag

SEQ ID NO: 78761 - RNA, 20 nt, Artificial Sequence
  MKO10078761_B_Col6a1
  gRNA
gcaauuucacggcagcugac

SEQ ID NO: 78762 - RNA, 20 nt, Artificial Sequence
  MKO10078762_B_Col6a2
  gRNA
gugcuacaaggugagcugcc

SEQ ID NO: 78763 - RNA, 20 nt, Artificial Sequence
  MKO10078763_B_Col6a2
  gRNA
accugucguccuuucugucc

SEQ ID NO: 78764 - RNA, 20 nt, Artificial Sequence
  MKO10078764_B_Col6a2
  gRNA
cccuuggguccguggggucc

SEQ ID NO: 78765 - RNA, 20 nt, Artificial Sequence
  MKO10078765_B_Col6a3
  gRNA
aguacccgauaucccccuuc

SEQ ID NO: 78766 - RNA, 20 nt, Artificial Sequence
  MKO10078766_B_Col6a3
  gRNA
gcggaacgcccucuucuauc

SEQ ID NO: 78767 - RNA, 20 nt, Artificial Sequence
  MKO10078767_B_Col6a3
  gRNA
ccagagaagaucccguguac

SEQ ID NO: 78768 - RNA, 20 nt, Artificial Sequence
  MKO10078768_B_Col6a4
  gRNA
ugcccaagucuuacgccauc

SEQ ID NO: 78769 - RNA, 20 nt, Artificial Sequence
  MKO10078769_B_Col6a4
  gRNA
gcucgacgucagaagcgauc

SEQ ID NO: 78770 - RNA, 20 nt, Artificial Sequence
  MKO10078770_B_Col6a4
  gRNA
uggggucaaagacgcaucuc

SEQ ID NO: 78771 - RNA, 20 nt, Artificial Sequence
  MKO10078771_B_Col6a5
  gRNA
ccuugccgaccuuauauucu

SEQ ID NO: 78772 - RNA, 20 nt, Artificial Sequence
  MKO10078772_B_Col6a5
  gRNA
uccuaccugucuuaucaacg

SEQ ID NO: 78773 - RNA, 20 nt, Artificial Sequence
  MKO10078773_B_Col6a5
  gRNA
guucagcacgaguagaaacu

SEQ ID NO: 78774 - RNA, 20 nt, Artificial Sequence
  MKO10078774_B_Col6a6
  gRNA
aacaucagagugcaugcgau

SEQ ID NO: 78775 - RNA, 20 nt, Artificial Sequence
  MKO10078775_B_Col6a6
  gRNA
guggacagcuccgaucaccu

SEQ ID NO: 78776 - RNA, 20 nt, Artificial Sequence
  MKO10078776_B_Col6a6
  gRNA
ggcaaacacgcugaggucuc

SEQ ID NO: 78777 - RNA, 20 nt, Artificial Sequence
  MKO10078777_B_Col7a1
  gRNA
agcaguugugcacacccucc

SEQ ID NO: 78778 - RNA, 20 nt, Artificial Sequence
  MKO10078778_B_Col7a1
  gRNA
gggaacaccuuggggacacc

SEQ ID NO: 78779 - RNA, 20 nt, Artificial Sequence
  MKO10078779_B_Col7a1
  gRNA
cagcuguguccacuaaaucu

SEQ ID NO: 78780 - RNA, 20 nt, Artificial Sequence
  MKO10078780_B_Col8a1
  gRNA
gaaaggccaucuuugcccaa

SEQ ID NO: 78781 - RNA, 20 nt, Artificial Sequence
  MKO10078781_B_Col8a1
  gRNA
accuuguucuccgcgcaaac

SEQ ID NO: 78782 - RNA, 20 nt, Artificial Sequence
  MKO10078782_B_Col8a1
  gRNA
cucgucguauguguacauca

SEQ ID NO: 78783 - RNA, 20 nt, Artificial Sequence
  MKO10078783_B_Col8a2
  gRNA
acccccagcuccgccgccag

SEQ ID NO: 78784 - RNA, 20 nt, Artificial Sequence
  MKO10078784_B_Col8a2
  gRNA
uaccuggaccaggcuucggg

SEQ ID NO: 78785 - RNA, 20 nt, Artificial Sequence
  MKO10078785_B_Col8a2
  gRNA
gaaggcccgguucacccuuc

SEQ ID NO: 78786 - RNA, 20 nt, Artificial Sequence
  MKO10078786_B_Col9a1
  gRNA
caaggacggcaaauucaaga

SEQ ID NO: 78787 - RNA, 20 nt, Artificial Sequence
  MKO10078787_B_Col9a1
  gRNA
auuggccaagaugacuuacc

SEQ ID NO: 78788 - RNA, 20 nt, Artificial Sequence
  MKO10078788_B_Col9a1
  gRNA
gggauccacagccuuacaag

SEQ ID NO: 78789 - RNA, 20 nt, Artificial Sequence
  MKO10078789_B_Col9a2
  gRNA
ccuggucccguggggacccc

SEQ ID NO: 78790 - RNA, 20 nt, Artificial Sequence
  MKO10078790_B_Col9a2
  gRNA
gggguacucacaucaaugcc

SEQ ID NO: 78791 - RNA, 20 nt, Artificial Sequence
  MKO10078791_B_Col9a2
  gRNA
ugagcacgcaccuugacucc

SEQ ID NO: 78792 - RNA, 20 nt, Artificial Sequence
  MKO10078792_B_Col9a3
  gRNA
gauggacccgcaggacccaa

SEQ ID NO: 78793 - RNA, 20 nt, Artificial Sequence
  MKO10078793_B_Col9a3
  gRNA
cucccacccagggacccaaa

SEQ ID NO: 78794 - RNA, 20 nt, Artificial Sequence
  MKO10078794_B_Col9a3
  gRNA
cacaucaaugccauccuugc

SEQ ID NO: 78795 - RNA, 20 nt, Artificial Sequence
  MKO10078795_B_Colec10
  gRNA
ccggaaagugguuggacaac

SEQ ID NO: 78796 - RNA, 20 nt, Artificial Sequence
  MKO10078796_B_Colec10
  gRNA
aagggucugcuuggaauucc

SEQ ID NO: 78797 - RNA, 20 nt, Artificial Sequence
  MKO10078797_B_Colec10
  gRNA
uuucuauuuaggugacaaag

SEQ ID NO: 78798 - RNA, 20 nt, Artificial Sequence
  MKO10078798_B_Colec11
  gRNA
cauggaaaaauuggucccau

SEQ ID NO: 78799 - RNA, 20 nt, Artificial Sequence
  MKO10078799_B_Colec11
  gRNA
ugucguaccagguucuccac

SEQ ID NO: 78800 - RNA, 20 nt, Artificial Sequence
  MKO10078800_B_Colec11
  gRNA
uauuggggagauggacaacc

SEQ ID NO: 78801 - RNA, 20 nt, Artificial Sequence
  MKO10078801_B_Colec12
  gRNA
ugcaguccuucgguuacaag

SEQ ID NO: 78802 - RNA, 20 nt, Artificial Sequence
  MKO10078802_B_Colec12
  gRNA
ucuucuugcagguauucagg

SEQ ID NO: 78803 - RNA, 20 nt, Artificial Sequence
  MKO10078803_B_Colec12
  gRNA
ugaguuuguugucauaaguc

SEQ ID NO: 78804 - RNA, 20 nt, Artificial Sequence
  MKO10078804_B_Colgalt2
  gRNA
aagcagcccuucgaacugcg

SEQ ID NO: 78805 - RNA, 20 nt, Artificial Sequence
  MKO10078805_B_Colgalt2
  gRNA
guuucaugacgugagaaaac

SEQ ID NO: 78806 - RNA, 20 nt, Artificial Sequence
  MKO10078806_B_Colgalt2
  gRNA
acaauacaacggaaauacuc

SEQ ID NO: 78807 - RNA, 20 nt, Artificial Sequence
  MKO10078807_B_Colq
  gRNA
ugccccgcuucuucugaucc

SEQ ID NO: 78808 - RNA, 20 nt, Artificial Sequence
  MKO10078808_B_Colq
  gRNA
cagggggaccuuggccgccc

SEQ ID NO: 78809 - RNA, 20 nt, Artificial Sequence
  MKO10078809_B_Colq
  gRNA
ccauuguguaggguccaccu

SEQ ID NO: 78810 - RNA, 20 nt, Artificial Sequence
  MKO10078810_B_Commd10
  gRNA
gauucccacgacuucucagc

SEQ ID NO: 78811 - RNA, 20 nt, Artificial Sequence
  MKO10078811_B_Commd10
  gRNA
gcugauaaaugcaauagaca

SEQ ID NO: 78812 - RNA, 20 nt, Artificial Sequence
  MKO10078812_B_Commd10
  gRNA
gcagcuuugcuugagcagag

SEQ ID NO: 78813 - RNA, 20 nt, Artificial Sequence
  MKO10078813_B_Commd1
  gRNA
cccuguugccauaauagagc

SEQ ID NO: 78814 - RNA, 20 nt, Artificial Sequence
  MKO10078814_B_Commd1
  gRNA
aauccugaagaagcugucag

SEQ ID NO: 78815 - RNA, 20 nt, Artificial Sequence
  MKO10078815_B_Commd1
  gRNA
cuaccucugacagcuucuuc

SEQ ID NO: 78816 - RNA, 20 nt, Artificial Sequence
  MKO10078816_B_Commd2
  gRNA
caccgagagcucaaagcuua

SEQ ID NO: 78817 - RNA, 20 nt, Artificial Sequence
  MKO10078817_B_Commd2
  gRNA
uaccauaagcuuugagcucu

SEQ ID NO: 78818 - RNA, 20 nt, Artificial Sequence
  MKO10078818_B_Commd2
  gRNA
cugcuggcuuaaucuguugc

SEQ ID NO: 78819 - RNA, 20 nt, Artificial Sequence
  MKO10078819_B_Commd3
  gRNA
aaguugacaagucuacucua

SEQ ID NO: 78820 - RNA, 20 nt, Artificial Sequence
  MKO10078820_B_Commd3
  gRNA
caagaaacaucaguuauaug

SEQ ID NO: 78821 - RNA, 20 nt, Artificial Sequence
  MKO10078821_B_Commd3
  gRNA
acaguaccuaccuucccagu

SEQ ID NO: 78822 - RNA, 20 nt, Artificial Sequence
  MKO10078822_B_Commd4
  gRNA
gcugcgacugcuguguagcc

SEQ ID NO: 78823 - RNA, 20 nt, Artificial Sequence
  MKO10078823_B_Commd4
  gRNA
aguccagaucgccacagaac

SEQ ID NO: 78824 - RNA, 20 nt, Artificial Sequence
  MKO10078824_B_Commd4
  gRNA
ccagaagcuccuuuagcacc

SEQ ID NO: 78825 - RNA, 20 nt, Artificial Sequence
  MKO10078825_B_Commd5
  gRNA
ccagaucuccaaucauaucu

SEQ ID NO: 78826 - RNA, 20 nt, Artificial Sequence
  MKO10078826_B_Commd5
  gRNA
caaguuccuggaguucgucc

SEQ ID NO: 78827 - RNA, 20 nt, Artificial Sequence
  MKO10078827_B_Commd5
  gRNA
aaguuguugaaacucguagu

SEQ ID NO: 78828 - RNA, 20 nt, Artificial Sequence
  MKO10078828_B_Commd6
  gRNA
cgauggacuugcugcuuacu

SEQ ID NO: 78829 - RNA, 20 nt, Artificial Sequence
  MKO10078829_B_Commd6
  gRNA
cuccgacuuggcauccagca

SEQ ID NO: 78830 - RNA, 20 nt, Artificial Sequence
  MKO10078830_B_Commd6
  gRNA
ucacacagucucaauuacag

SEQ ID NO: 78831 - RNA, 20 nt, Artificial Sequence
  MKO10078831_B_Commd7
  gRNA
acucaccauuuggaaccagu

SEQ ID NO: 78832 - RNA, 20 nt, Artificial Sequence
  MKO10078832_B_Commd7
  gRNA
uccacuccauaucaaucagc

SEQ ID NO: 78833 - RNA, 20 nt, Artificial Sequence
  MKO10078833_B_Commd7
  gRNA
gagaucaguccgcaccugcu

SEQ ID NO: 78834 - RNA, 20 nt, Artificial Sequence
  MKO10078834_B_Commd8
  gRNA
uaucaacuauuucccccaac

SEQ ID NO: 78835 - RNA, 20 nt, Artificial Sequence
  MKO10078835_B_Commd8
  gRNA
aacgaccgcuuugaaaaacg

SEQ ID NO: 78836 - RNA, 20 nt, Artificial Sequence
  MKO10078836_B_Commd8
  gRNA
caaaaggggcaucugcaagg

SEQ ID NO: 78837 - RNA, 20 nt, Artificial Sequence
  MKO10078837_B_Commd9
  gRNA
cacagucucucugccacgcc

SEQ ID NO: 78838 - RNA, 20 nt, Artificial Sequence
  MKO10078838_B_Commd9
  gRNA
aguacucacucugguuugcu

SEQ ID NO: 78839 - RNA, 20 nt, Artificial Sequence
  MKO10078839_B_Commd9
  gRNA
ccugcugacaaaaaucaucg

SEQ ID NO: 78840 - RNA, 20 nt, Artificial Sequence
  MKO10078840_B_Comp
  gRNA
augcagcccgcacgcacucc

SEQ ID NO: 78841 - RNA, 20 nt, Artificial Sequence
  MKO10078841_B_Comp
  gRNA
gagagagcuguugcgacagc

SEQ ID NO: 78842 - RNA, 20 nt, Artificial Sequence
  MKO10078842_B_Comp
  gRNA
acagaugcugcgagaacuuc

SEQ ID NO: 78843 - RNA, 20 nt, Artificial Sequence
  MKO10078843_B_Comtd1
  gRNA
ccgcuccaugagagagcacc

SEQ ID NO: 78844 - RNA, 20 nt, Artificial Sequence
  MKO10078844_B_Comtd1
  gRNA
uggagcagaagaucgaccuu

SEQ ID NO: 78845 - RNA, 20 nt, Artificial Sequence
  MKO10078845_B_Comtd1
  gRNA
ggugcucacccaaugucugc

SEQ ID NO: 78846 - RNA, 20 nt, Artificial Sequence
  MKO10078846_B_Comt
  gRNA
uggcuacucagccgugcgaa

SEQ ID NO: 78847 - RNA, 20 nt, Artificial Sequence
  MKO10078847_B_Comt
  gRNA
agacccccagagcguccugg

SEQ ID NO: 78848 - RNA, 20 nt, Artificial Sequence
  MKO10078848_B_Comt
  gRNA
augcagugauucgggaguac

SEQ ID NO: 78849 - RNA, 20 nt, Artificial Sequence
  MKO10078849_B_Copa
  gRNA
ucgccuccagagacgaacag

SEQ ID NO: 78850 - RNA, 20 nt, Artificial Sequence
  MKO10078850_B_Copa
  gRNA
ccccauuguguaaacugguc

SEQ ID NO: 78851 - RNA, 20 nt, Artificial Sequence
  MKO10078851_B_Copa
  gRNA
aggcgaugauuauaagauua

SEQ ID NO: 78852 - RNA, 20 nt, Artificial Sequence
  MKO10078852_B_Copb1
  gRNA
cgaagcgaaugauugucauc

SEQ ID NO: 78853 - RNA, 20 nt, Artificial Sequence
  MKO10078853_B_Copb1
  gRNA
caccaucaaaaaguugcucc

SEQ ID NO: 78854 - RNA, 20 nt, Artificial Sequence
  MKO10078854_B_Copb1
  gRNA
auugaucaaguucagacauu

SEQ ID NO: 78855 - RNA, 20 nt, Artificial Sequence
  MKO10078855_B_Copb2
  gRNA
gguccugucgagagaugcac

SEQ ID NO: 78856 - RNA, 20 nt, Artificial Sequence
  MKO10078856_B_Copb2
  gRNA
acaaacuuugcagcucgaac

SEQ ID NO: 78857 - RNA, 20 nt, Artificial Sequence
  MKO10078857_B_Copb2
  gRNA
gagcugcaaaguuugucgca

SEQ ID NO: 78858 - RNA, 20 nt, Artificial Sequence
  MKO10078858_B_Cope
  gRNA
cuacuuccacgaccagaacc

SEQ ID NO: 78859 - RNA, 20 nt, Artificial Sequence
  MKO10078859_B_Cope
  gRNA
cagcaaacaugcgcacagcc

SEQ ID NO: 78860 - RNA, 20 nt, Artificial Sequence
  MKO10078860_B_Cope
  gRNA
gauucagauccuccucaagc

SEQ ID NO: 78861 - RNA, 20 nt, Artificial Sequence
  MKO10078861_B_Copg1
  gRNA
auucccacagggggagcacc

SEQ ID NO: 78862 - RNA, 20 nt, Artificial Sequence
  MKO10078862_B_Copg1
  gRNA
guguacuuacaucauuggac

SEQ ID NO: 78863 - RNA, 20 nt, Artificial Sequence
  MKO10078863_B_Copg1
  gRNA
gauccuuuaucucauaaacc

SEQ ID NO: 78864 - RNA, 20 nt, Artificial Sequence
  MKO10078864_B_Copg2
  gRNA
uuuacuuagggugaacacuu

SEQ ID NO: 78865 - RNA, 20 nt, Artificial Sequence
  MKO10078865_B_Copg2
  gRNA
augugaucauugucacaagc

SEQ ID NO: 78866 - RNA, 20 nt, Artificial Sequence
  MKO10078866_B_Copg2
  gRNA
cagcacucuucuccaaaugc

SEQ ID NO: 78867 - RNA, 20 nt, Artificial Sequence
  MKO10078867_B_Coprs
  gRNA
cuacuugccuagucgaucca

SEQ ID NO: 78868 - RNA, 20 nt, Artificial Sequence
  MKO10078868_B_Coprs
  gRNA
ugacauuccugcccaugccg

SEQ ID NO: 78869 - RNA, 20 nt, Artificial Sequence
  MKO10078869_B_Coprs
  gRNA
cugauggggaguuguaugcc

SEQ ID NO: 78870 - RNA, 20 nt, Artificial Sequence
  MKO10078870_B_Cops2
  gRNA
gucaucuucuuucagugcuu

SEQ ID NO: 78871 - RNA, 20 nt, Artificial Sequence
  MKO10078871_B_Cops2
  gRNA
augucagauggauuuacugc

SEQ ID NO: 78872 - RNA, 20 nt, Artificial Sequence
  MKO10078872_B_Cops2
  gRNA
gaucaagauuaacuucaagu

SEQ ID NO: 78873 - RNA, 20 nt, Artificial Sequence
  MKO10078873_B_Cops3
  gRNA
aguacaugccgaucucugcc

SEQ ID NO: 78874 - RNA, 20 nt, Artificial Sequence
  MKO10078874_B_Cops3
  gRNA
caagugcauuuguuagcuga

SEQ ID NO: 78875 - RNA, 20 nt, Artificial Sequence
  MKO10078875_B_Cops3
  gRNA
cuucgaaacacuauucucac

SEQ ID NO: 78876 - RNA, 20 nt, Artificial Sequence
  MKO10078876_B_Cops4
  gRNA
augucagccucgugaucuca

SEQ ID NO: 78877 - RNA, 20 nt, Artificial Sequence
  MKO10078877_B_Cops4
  gRNA
ugcuuccauaagacagcauc

SEQ ID NO: 78878 - RNA, 20 nt, Artificial Sequence
  MKO10078878_B_Cops4
  gRNA
aaaugcagcccaaguguugg

SEQ ID NO: 78879 - RNA, 20 nt, Artificial Sequence
  MKO10078879_B_Cops5
  gRNA
accaaccgauugcauucuca

SEQ ID NO: 78880 - RNA, 20 nt, Artificial Sequence
  MKO10078880_B_Cops5
  gRNA
agcugcugcguaugaguaua

SEQ ID NO: 78881 - RNA, 20 nt, Artificial Sequence
  MKO10078881_B_Cops5
  gRNA
uaccuuuggauauguccuaa

SEQ ID NO: 78882 - RNA, 20 nt, Artificial Sequence
  MKO10078882_B_Cops6
  gRNA
agacauccacguccauaagc

SEQ ID NO: 78883 - RNA, 20 nt, Artificial Sequence
  MKO10078883_B_Cops6
  gRNA
ugagcugcugucccacaccg

SEQ ID NO: 78884 - RNA, 20 nt, Artificial Sequence
  MKO10078884_B_Cops6
  gRNA
uuagugauuggggcucugau

SEQ ID NO: 78885 - RNA, 20 nt, Artificial Sequence
  MKO10078885_B_Cops7a
  gRNA
ugccgcccccuuagccgacu

SEQ ID NO: 78886 - RNA, 20 nt, Artificial Sequence
  MKO10078886_B_Cops7a
  gRNA
uuuaccuaaguaguccgcau

SEQ ID NO: 78887 - RNA, 20 nt, Artificial Sequence
  MKO10078887_B_Cops7a
  gRNA
uucuucugugcgucagucag

SEQ ID NO: 78888 - RNA, 20 nt, Artificial Sequence
  MKO10078888_B_Cops7b
  gRNA
gccaacucaccuauguaauc

SEQ ID NO: 78889 - RNA, 20 nt, Artificial Sequence
  MKO10078889_B_Cops7b
  gRNA
acuagaagaccuuaucauug

SEQ ID NO: 78890 - RNA, 20 nt, Artificial Sequence
  MKO10078890_B_Cops7b
  gRNA
uugcaggugugacggcugug

SEQ ID NO: 78891 - RNA, 20 nt, Artificial Sequence
  MKO10078891_B_Cops8
  gRNA
aaggagacgcgccuuugccc

SEQ ID NO: 78892 - RNA, 20 nt, Artificial Sequence
  MKO10078892_B_Cops8
  gRNA
caaccaucaacgcccaccag

SEQ ID NO: 78893 - RNA, 20 nt, Artificial Sequence
  MKO10078893_B_Cops8
  gRNA
ugcaaaaucaucugcgauga

SEQ ID NO: 78894 - RNA, 20 nt, Artificial Sequence
  MKO10078894_B_Copz1
  gRNA
uucucaacagcugaugcuua

SEQ ID NO: 78895 - RNA, 20 nt, Artificial Sequence
  MKO10078895_B_Copz1
  gRNA
ggccuugacaguguacaggg

SEQ ID NO: 78896 - RNA, 20 nt, Artificial Sequence
  MKO10078896_B_Copz1
  gRNA
cgacaccuaccccaguguca

SEQ ID NO: 78897 - RNA, 20 nt, Artificial Sequence
  MKO10078897_B_Copz2
  gRNA
gaaauucaccucauucucgg

SEQ ID NO: 78898 - RNA, 20 nt, Artificial Sequence
  MKO10078898_B_Copz2
  gRNA
acucucugagccacaucuua

SEQ ID NO: 78899 - RNA, 20 nt, Artificial Sequence
  MKO10078899_B_Copz2
  gRNA
cgacacauuucccuccguga

SEQ ID NO: 78900 - RNA, 20 nt, Artificial Sequence
  MKO10078900_B_Coq10a
  gRNA
uuucaggugacccuuacggc

SEQ ID NO: 78901 - RNA, 20 nt, Artificial Sequence
  MKO10078901_B_Coq10a
  gRNA
aucuccaaauagucucuaag

SEQ ID NO: 78902 - RNA, 20 nt, Artificial Sequence
  MKO10078902_B_Coq10a
  gRNA
auguugcugccuuugagcgc

SEQ ID NO: 78903 - RNA, 20 nt, Artificial Sequence
  MKO10078903_B_Coq10b
  gRNA
cucuggaccauacaguuuac

SEQ ID NO: 78904 - RNA, 20 nt, Artificial Sequence
  MKO10078904_B_Coq10b
  gRNA
acccuuaccuuuaccaagug

SEQ ID NO: 78905 - RNA, 20 nt, Artificial Sequence
  MKO10078905_B_Coq10b
  gRNA
gaaauguaugacguaguauc

SEQ ID NO: 78906 - RNA, 20 nt, Artificial Sequence
  MKO10078906_B_Coq2
  gRNA
ucuauuucuaguauagcaau

SEQ ID NO: 78907 - RNA, 20 nt, Artificial Sequence
  MKO10078907_B_Coq2
  gRNA
guaggugacgacaagaagua

SEQ ID NO: 78908 - RNA, 20 nt, Artificial Sequence
  MKO10078908_B_Coq2
  gRNA
caggcauacagccggaucac

SEQ ID NO: 78909 - RNA, 20 nt, Artificial Sequence
  MKO10078909_B_Coq3
  gRNA
aguuguuggaauugaucccg

SEQ ID NO: 78910 - RNA, 20 nt, Artificial Sequence
  MKO10078910_B_Coq3
  gRNA
acaagugcuagucaccaucc

SEQ ID NO: 78911 - RNA, 20 nt, Artificial Sequence
  MKO10078911_B_Coq3
  gRNA
uaaguccuuugauccagucc

SEQ ID NO: 78912 - RNA, 20 nt, Artificial Sequence
  MKO10078912_B_Coq4
  gRNA
ccgugaguaucuucgcuucc

SEQ ID NO: 78913 - RNA, 20 nt, Artificial Sequence
  MKO10078913_B_Coq4
  gRNA
ucugaagcuugcucaggucg

SEQ ID NO: 78914 - RNA, 20 nt, Artificial Sequence
  MKO10078914_B_Coq4
  gRNA
cucuacaaccccuaucgcca

SEQ ID NO: 78915 - RNA, 20 nt, Artificial Sequence
  MKO10078915_B_Coq5
  gRNA
gcaaauccuuccaagcucga

SEQ ID NO: 78916 - RNA, 20 nt, Artificial Sequence
  MKO10078916_B_Coq5
  gRNA
agcgcuaaccuggauaugag

SEQ ID NO: 78917 - RNA, 20 nt, Artificial Sequence
  MKO10078917_B_Coq5
  gRNA
uugucuuccaggacuggcgu

SEQ ID NO: 78918 - RNA, 20 nt, Artificial Sequence
  MKO10078918_B_Coq6
  gRNA
ggcggguccaaagaaagccc

SEQ ID NO: 78919 - RNA, 20 nt, Artificial Sequence
  MKO10078919_B_Coq6
  gRNA
aauguucgacagggacaacc

SEQ ID NO: 78920 - RNA, 20 nt, Artificial Sequence
  MKO10078920_B_Coq6
  gRNA
uuggacccgccuccagcaac

SEQ ID NO: 78921 - RNA, 20 nt, Artificial Sequence
  MKO10078921_B_Coq7
  gRNA
caaccagauccgcaugcuga

SEQ ID NO: 78922 - RNA, 20 nt, Artificial Sequence
  MKO10078922_B_Coq7
  gRNA
ugaacaccacgauacaggcc

SEQ ID NO: 78923 - RNA, 20 nt, Artificial Sequence
  MKO10078923_B_Coq7
  gRNA
aggagcaauggccugcaccg

SEQ ID NO: 78924 - RNA, 20 nt, Artificial Sequence
  MKO10078924_B_Coq9
  gRNA
acggcaguguggaaggcacg

SEQ ID NO: 78925 - RNA, 20 nt, Artificial Sequence
  MKO10078925_B_Coq9
  gRNA
ccggggccagugcucaaugu

SEQ ID NO: 78926 - RNA, 20 nt, Artificial Sequence
  MKO10078926_B_Coq9
  gRNA
ugauccccuacauugagcac

SEQ ID NO: 78927 - RNA, 20 nt, Artificial Sequence
  MKO10078927_B_Corin
  gRNA
cugcgcccucaucgugcugc

SEQ ID NO: 78928 - RNA, 20 nt, Artificial Sequence
  MKO10078928_B_Corin
  gRNA
gauggggaagcucgagugcc

SEQ ID NO: 78929 - RNA, 20 nt, Artificial Sequence
  MKO10078929_B_Corin
  gRNA
aggaggaguucaccauuccc

SEQ ID NO: 78930 - RNA, 20 nt, Artificial Sequence
  MKO10078930_B_Coro1a
  gRNA
ggccacgaugccaacccucu

SEQ ID NO: 78931 - RNA, 20 nt, Artificial Sequence
  MKO10078931_B_Coro1a
  gRNA
caccaagaggguuggcaucg

SEQ ID NO: 78932 - RNA, 20 nt, Artificial Sequence
  MKO10078932_B_Coro1a
  gRNA
acucaugcgacugaaacccg

SEQ ID NO: 78933 - RNA, 20 nt, Artificial Sequence
  MKO10078933_B_Coro1b
  gRNA
ggccuguucuggauauugac

SEQ ID NO: 78934 - RNA, 20 nt, Artificial Sequence
  MKO10078934_B_Coro1b
  gRNA
cccaucagguugugacaaug

SEQ ID NO: 78935 - RNA, 20 nt, Artificial Sequence
  MKO10078935_B_Coro1b
  gRNA
acgagggggcccggcccaug

SEQ ID NO: 78936 - RNA, 20 nt, Artificial Sequence
  MKO10078936_B_Coro1c
  gRNA
ccgcaugagcgagcggcagu

SEQ ID NO: 78937 - RNA, 20 nt, Artificial Sequence
  MKO10078937_B_Coro1c
  gRNA
gacggcaacgucuucacuac

SEQ ID NO: 78938 - RNA, 20 nt, Artificial Sequence
  MKO10078938_B_Coro1c
  gRNA
aaugaccaggucauugccag

SEQ ID NO: 78939 - RNA, 20 nt, Artificial Sequence
  MKO10078939_B_Coro2a
  gRNA
cgccaacaaaguacuguucc

SEQ ID NO: 78940 - RNA, 20 nt, Artificial Sequence
  MKO10078940_B_Coro2a
  gRNA
ccaugcucgcaggguggggc

SEQ ID NO: 78941 - RNA, 20 nt, Artificial Sequence
  MKO10078941_B_Coro2a
  gRNA
ccagccccacccugcgagca

SEQ ID NO: 78942 - RNA, 20 nt, Artificial Sequence
  MKO10078942_B_Coro2b
  gRNA
ugcagucaacgcccgcuucc

SEQ ID NO: 78943 - RNA, 20 nt, Artificial Sequence
  MKO10078943_B_Coro2b
  gRNA
uuccgcuucagcccaccguc

SEQ ID NO: 78944 - RNA, 20 nt, Artificial Sequence
  MKO10078944_B_Coro2b
  gRNA
ugcagaggaucacgucggug

SEQ ID NO: 78945 - RNA, 20 nt, Artificial Sequence
  MKO10078945_B_Coro6
  gRNA
agaaccugucaucacacucg

SEQ ID NO: 78946 - RNA, 20 nt, Artificial Sequence
  MKO10078946_B_Coro6
  gRNA
ugcucugccgaacaacacgc

SEQ ID NO: 78947 - RNA, 20 nt, Artificial Sequence
  MKO10078947_B_Coro6
  gRNA
uggcccucgagugugaugac

SEQ ID NO: 78948 - RNA, 20 nt, Artificial Sequence
  MKO10078948_B_Coro7
  gRNA
caccguccugucagcugaac

SEQ ID NO: 78949 - RNA, 20 nt, Artificial Sequence
  MKO10078949_B_Coro7
  gRNA
uggaacugcaguaccuccac

SEQ ID NO: 78950 - RNA, 20 nt, Artificial Sequence
  MKO10078950_B_Coro7
  gRNA
cuccgguucagcugacagga

SEQ ID NO: 78951 - RNA, 20 nt, Artificial Sequence
  MKO10078951_B_Cort
  gRNA
gugcacucaccacacugucc

SEQ ID NO: 78952 - RNA, 20 nt, Artificial Sequence
  MKO10078952_B_Cort
  gRNA
gccagcuccagcacccccgu

SEQ ID NO: 78953 - RNA, 20 nt, Artificial Sequence
  MKO10078953_B_Cort
  gRNA
ggaagcccacucgugccacc

SEQ ID NO: 78954 - RNA, 20 nt, Artificial Sequence
  MKO10078954_B_Cotl1
  gRNA
gccgguggugaagcgcacaa

SEQ ID NO: 78955 - RNA, 20 nt, Artificial Sequence
  MKO10078955_B_Cotl1
  gRNA
caccauuguccccggcgauc

SEQ ID NO: 78956 - RNA, 20 nt, Artificial Sequence
  MKO10078956_B_Cotl1
  gRNA
auuugugaucagcgaccgga

SEQ ID NO: 78957 - RNA, 20 nt, Artificial Sequence
  MKO10078957_B_Cox10
  gRNA
cuauucauguuugagucgaa

SEQ ID NO: 78958 - RNA, 20 nt, Artificial Sequence
  MKO10078958_B_Cox10
  gRNA
aaaggagacgccgguggcuc

SEQ ID NO: 78959 - RNA, 20 nt, Artificial Sequence
  MKO10078959_B_Cox10
  gRNA
cuugagcuuccucaagcgca

SEQ ID NO: 78960 - RNA, 20 nt, Artificial Sequence
  MKO10078960_B_Cox11
  gRNA
ugucaaggaccgggucauua

SEQ ID NO: 78961 - RNA, 20 nt, Artificial Sequence
  MKO10078961_B_Cox11
  gRNA
ccuacugacaaaccaguaau

SEQ ID NO: 78962 - RNA, 20 nt, Artificial Sequence
  MKO10078962_B_Cox11
  gRNA
acaguauuucaauaagauac

SEQ ID NO: 78963 - RNA, 20 nt, Artificial Sequence
  MKO10078963_B_Cox14
  gRNA
accuccagcugcgcagugcc

SEQ ID NO: 78964 - RNA, 20 nt, Artificial Sequence
  MKO10078964_B_Cox14
  gRNA
cacagugaggagcaucaucg

SEQ ID NO: 78965 - RNA, 20 nt, Artificial Sequence
  MKO10078965_B_Cox14
  gRNA
gcugcucuacaggacuccug

SEQ ID NO: 78966 - RNA, 20 nt, Artificial Sequence
  MKO10078966_B_Cox15
  gRNA
gguagacuggcaucugauaa

SEQ ID NO: 78967 - RNA, 20 nt, Artificial Sequence
  MKO10078967_B_Cox15
  gRNA
guaccgccucgcagcccacc

SEQ ID NO: 78968 - RNA, 20 nt, Artificial Sequence
  MKO10078968_B_Cox15
  gRNA
aggcgguacugacugacccg

SEQ ID NO: 78969 - RNA, 20 nt, Artificial Sequence
  MKO10078969_B_Cox16
  gRNA
ucuacagauugauccugaau

SEQ ID NO: 78970 - RNA, 20 nt, Artificial Sequence
  MKO10078970_B_Cox16
  gRNA
uaauugucacagcaucguac

SEQ ID NO: 78971 - RNA, 20 nt, Artificial Sequence
  MKO10078971_B_Cox16
  gRNA
gaguuucuggguuucguccu

SEQ ID NO: 78972 - RNA, 20 nt, Artificial Sequence
  MKO10078972_B_Cox17
  gRNA
acaucucauugaagcccaca

SEQ ID NO: 78973 - RNA, 20 nt, Artificial Sequence
  MKO10078973_B_Cox17
  gRNA
gccuggaaagaugccgggac

SEQ ID NO: 78974 - RNA, 20 nt, Artificial Sequence
  MKO10078974_B_Cox17
  gRNA
ccaagaaggcgcgugaugcg

SEQ ID NO: 78975 - RNA, 20 nt, Artificial Sequence
  MKO10078975_B_Cox18
  gRNA
caccgaccuccacuaucagu

SEQ ID NO: 78976 - RNA, 20 nt, Artificial Sequence
  MKO10078976_B_Cox18
  gRNA
gcagucugugcccgucaguu

SEQ ID NO: 78977 - RNA, 20 nt, Artificial Sequence
  MKO10078977_B_Cox18
  gRNA
ugcauaccuagccacucucu

SEQ ID NO: 78978 - RNA, 20 nt, Artificial Sequence
  MKO10078978_B_Cox19
  gRNA
cuaaagccgagcuucucuag

SEQ ID NO: 78979 - RNA, 20 nt, Artificial Sequence
  MKO10078979_B_Cox19
  gRNA
cuaaagaguauuuaaugugc

SEQ ID NO: 78980 - RNA, 20 nt, Artificial Sequence
  MKO10078980_B_Cox19
  gRNA
gcuuuaaagaaaaauucaug

SEQ ID NO: 78981 - RNA, 20 nt, Artificial Sequence
  MKO10078981_B_Cox20
  gRNA
uucuuacaagguuccacugu

SEQ ID NO: 78982 - RNA, 20 nt, Artificial Sequence
  MKO10078982_B_Cox20
  gRNA
ggugcccauggcggccgccc

SEQ ID NO: 78983 - RNA, 20 nt, Artificial Sequence
  MKO10078983_B_Cox20
  gRNA
aguugcuuagcugcuguugu

SEQ ID NO: 78984 - RNA, 20 nt, Artificial Sequence
  MKO10078984_B_Cox4i1
  gRNA
caugcagaccaagcgaaugc

SEQ ID NO: 78985 - RNA, 20 nt, Artificial Sequence
  MKO10078985_B_Cox4i1
  gRNA
cucauacuuucgaucgugac

SEQ ID NO: 78986 - RNA, 20 nt, Artificial Sequence
  MKO10078986_B_Cox4i1
  gRNA
cuuuccccacuuacgcugau

SEQ ID NO: 78987 - RNA, 20 nt, Artificial Sequence
  MKO10078987_B_Cox4i2
  gRNA
ugaaccaucgcuccaacgaa

SEQ ID NO: 78988 - RNA, 20 nt, Artificial Sequence
  MKO10078988_B_Cox4i2
  gRNA
ccggcaugggauaggagcgc

SEQ ID NO: 78989 - RNA, 20 nt, Artificial Sequence
  MKO10078989_B_Cox4i2
  gRNA
cccugcaguguucccuaaga

SEQ ID NO: 78990 - RNA, 20 nt, Artificial Sequence
  MKO10078990_B_Cox5a
  gRNA
cugcauugcgagcauguaga

SEQ ID NO: 78991 - RNA, 20 nt, Artificial Sequence
  MKO10078991_B_Cox5a
  gRNA
augaggaguuugaugcucgc

SEQ ID NO: 78992 - RNA, 20 nt, Artificial Sequence
  MKO10078992_B_Cox5a
  gRNA
ggacaaagcaggaccucaua

SEQ ID NO: 78993 - RNA, 20 nt, Artificial Sequence
  MKO10078993_B_Cox5b
  gRNA
aguagccugcuccucaucag

SEQ ID NO: 78994 - RNA, 20 nt, Artificial Sequence
  MKO10078994_B_Cox5b
  gRNA
cacuauucucuuguugcuga

SEQ ID NO: 78995 - RNA, 20 nt, Artificial Sequence
  MKO10078995_B_Cox5b
  gRNA
auacaauaugcuaccuccaa

SEQ ID NO: 78996 - RNA, 20 nt, Artificial Sequence
  MKO10078996_B_Cox6a1
  gRNA
gcccacggcgaggaggguuc

SEQ ID NO: 78997 - RNA, 20 nt, Artificial Sequence
  MKO10078997_B_Cox6a1
  gRNA
uaccugaacccuccucgccg

SEQ ID NO: 78998 - RNA, 20 nt, Artificial Sequence
  MKO10078998_B_Cox6a1
  gRNA
ucgcuccgcagcccuucccc

SEQ ID NO: 78999 - RNA, 20 nt, Artificial Sequence
  MKO10078999_B_Cox6a2
  gRNA
acaucaagggugcucauaac

SEQ ID NO: 79000 - RNA, 20 nt, Artificial Sequence
  MKO10079000_B_Cox6a2
  gRNA
agcauggccagcgcagccaa

SEQ ID NO: 79001 - RNA, 20 nt, Artificial Sequence
  MKO10079001_B_Cox6a2
  gRNA
acuuaccuccugccccucca

SEQ ID NO: 79002 - RNA, 20 nt, Artificial Sequence
  MKO10079002_B_Cox6b1
  gRNA
auagcugaaggcacauuucc

SEQ ID NO: 79003 - RNA, 20 nt, Artificial Sequence
  MKO10079003_B_Cox6b1
  gRNA
guuggggaagcggcugucaa

SEQ ID NO: 79004 - RNA, 20 nt, Artificial Sequence
  MKO10079004_B_Cox6b1
  gRNA
agaaccagacuaagaacugu

SEQ ID NO: 79005 - RNA, 20 nt, Artificial Sequence
  MKO10079005_B_Cox6b2
  gRNA
ggcguuguccauuggcccgg

SEQ ID NO: 79006 - RNA, 20 nt, Artificial Sequence
  MKO10079006_B_Cox6b2
  gRNA
gaucaagcagggaacuuucc

SEQ ID NO: 79007 - RNA, 20 nt, Artificial Sequence
  MKO10079007_B_Cox6b2
  gRNA
ugccacugcaggugcagcgc

SEQ ID NO: 79008 - RNA, 20 nt, Artificial Sequence
  MKO10079008_B_Cox6c
  gRNA
caucucuucgaaaucuuuca

SEQ ID NO: 79009 - RNA, 20 nt, Artificial Sequence
  MKO10079009_B_Cox6c
  gRNA
ucuucuggccaagcgucugc

SEQ ID NO: 79010 - RNA, 20 nt, Artificial Sequence
  MKO10079010_B_Cox6c
  gRNA
aauaugaacccgcagacgcu

SEQ ID NO: 79011 - RNA, 20 nt, Artificial Sequence
  MKO10079011_B_Cox7a1
  gRNA
gacgcaaaaugagggcccua

SEQ ID NO: 79012 - RNA, 20 nt, Artificial Sequence
  MKO10079012_B_Cox7a1
  gRNA
gcccaagcaguauaagcagu

SEQ ID NO: 79013 - RNA, 20 nt, Artificial Sequence
  MKO10079013_B_Cox7a1
  gRNA
aagccacuuagaaaaccgug

SEQ ID NO: 79014 - RNA, 20 nt, Artificial Sequence
  MKO10079014_B_Cox7a2l
  gRNA
aaaguguaccugcggggugu

SEQ ID NO: 79015 - RNA, 20 nt, Artificial Sequence
  MKO10079015_B_Cox7a2l
  gRNA
uuuacuucaguuugguccgu

SEQ ID NO: 79016 - RNA, 20 nt, Artificial Sequence
  MKO10079016_B_Cox7a2l
  gRNA
uagcaguuucacgcagaagu

SEQ ID NO: 79017 - RNA, 20 nt, Artificial Sequence
  MKO10079017_B_Cox7a2
  gRNA
acgacauuaguucugcuucu

SEQ ID NO: 79018 - RNA, 20 nt, Artificial Sequence
  MKO10079018_B_Cox7a2
  gRNA
uccucugggcaaucugacga

SEQ ID NO: 79019 - RNA, 20 nt, Artificial Sequence
  MKO10079019_B_Cox7a2
  gRNA
uucaaaaugccuucgugaag

SEQ ID NO: 79020 - RNA, 20 nt, Artificial Sequence
  MKO10079020_B_Cox7b2
  gRNA
uacaauuuauaugacacaga

SEQ ID NO: 79021 - RNA, 20 nt, Artificial Sequence
  MKO10079021_B_Cox7b2
  gRNA
gaagaaacucaugacaaaua

SEQ ID NO: 79022 - RNA, 20 nt, Artificial Sequence
  MKO10079022_B_Cox7b2
  gRNA
gucaugaguuucuucugaug

SEQ ID NO: 79023 - RNA, 20 nt, Artificial Sequence
  MKO10079023_B_Cox7b
  gRNA
ccauucuauuccaauuugug

SEQ ID NO: 79024 - RNA, 20 nt, Artificial Sequence
  MKO10079024_B_Cox7b
  gRNA
aacuaggugcccucuucugg

SEQ ID NO: 79025 - RNA, 20 nt, Artificial Sequence
  MKO10079025_B_Cox7b
  gRNA
uagcauucccauauuuguca

SEQ ID NO: 79026 - RNA, 20 nt, Artificial Sequence
  MKO10079026_B_Cox7c
  gRNA
ucuuacuauaaagaaaggug

SEQ ID NO: 79027 - RNA, 20 nt, Artificial Sequence
  MKO10079027_B_Cox7c
  gRNA
gguccgucgcagccacuaug

SEQ ID NO: 79028 - RNA, 20 nt, Artificial Sequence
  MKO10079028_B_Cox7c
  gRNA
ccacggaggucgugaaccuc

SEQ ID NO: 79029 - RNA, 20 nt, Artificial Sequence
  MKO10079029_B_Cox8a
  gRNA
ucuguguaggauaucaccau

SEQ ID NO: 79030 - RNA, 20 nt, Artificial Sequence
  MKO10079030_B_Cox8a
  gRNA
uucgaguggaccugagcccg

SEQ ID NO: 79031 - RNA, 20 nt, Artificial Sequence
  MKO10079031_B_Cox8a
  gRNA
uccucagcagcaguggcguc

SEQ ID NO: 79032 - RNA, 20 nt, Artificial Sequence
  MKO10079032_B_Cox8b
  gRNA
aaccaugaagccaacgacua

SEQ ID NO: 79033 - RNA, 20 nt, Artificial Sequence
  MKO10079033_B_Cox8b
  gRNA
guuacuuaccacggcggaag

SEQ ID NO: 79034 - RNA, 20 nt, Artificial Sequence
  MKO10079034_B_Cox8b
  gRNA
gcuuggagcagccgcaggau

SEQ ID NO: 79035 - RNA, 20 nt, Artificial Sequence
  MKO10079035_B_Cox8c
  gRNA
agcagucugaaguauuucaa

SEQ ID NO: 79036 - RNA, 20 nt, Artificial Sequence
  MKO10079036_B_Cox8c
  gRNA
gcaguccuguucucgaagcc

SEQ ID NO: 79037 - RNA, 20 nt, Artificial Sequence
  MKO10079037_B_Cox8c
  gRNA
aaaaaaaauccugucgccca

SEQ ID NO: 79038 - RNA, 20 nt, Artificial Sequence
  MKO10079038_B_Cpa1
  gRNA
cuucaaaggugcugccgauc

SEQ ID NO: 79039 - RNA, 20 nt, Artificial Sequence
  MKO10079039_B_Cpa1
  gRNA
cuucgucgguggcagagauu

SEQ ID NO: 79040 - RNA, 20 nt, Artificial Sequence
  MKO10079040_B_Cpa1
  gRNA
ucgucccaucaaugugcuga

SEQ ID NO: 79041 - RNA, 20 nt, Artificial Sequence
  MKO10079041_B_Cpa2
  gRNA
aauuaagacucugcugcaac

SEQ ID NO: 79042 - RNA, 20 nt, Artificial Sequence
  MKO10079042_B_Cpa2
  gRNA
aaguaauccccugggacucc

SEQ ID NO: 79043 - RNA, 20 nt, Artificial Sequence
  MKO10079043_B_Cpa2
  gRNA
ucggacauggacugucugcc

SEQ ID NO: 79044 - RNA, 20 nt, Artificial Sequence
  MKO10079044_B_Cpa3
  gRNA
ucagaccauccagucaaccu

SEQ ID NO: 79045 - RNA, 20 nt, Artificial Sequence
  MKO10079045_B_Cpa3
  gRNA
guuaugcaaaauacaaugac

SEQ ID NO: 79046 - RNA, 20 nt, Artificial Sequence
  MKO10079046_B_Cpa3
  gRNA
uaauccauuauauguccuca

SEQ ID NO: 79047 - RNA, 20 nt, Artificial Sequence
  MKO10079047_B_Cpa4
  gRNA
cuucaucuucguuaucuaaa

SEQ ID NO: 79048 - RNA, 20 nt, Artificial Sequence
  MKO10079048_B_Cpa4
  gRNA
cggaguggugacuucaacua

SEQ ID NO: 79049 - RNA, 20 nt, Artificial Sequence
  MKO10079049_B_Cpa4
  gRNA
ccuucagauuuaccacgaga

SEQ ID NO: 79050 - RNA, 20 nt, Artificial Sequence
  MKO10079050_B_Cpa5
  gRNA
ccgguccauucuuguccuga

SEQ ID NO: 79051 - RNA, 20 nt, Artificial Sequence
  MKO10079051_B_Cpa5
  gRNA
ugccuacagcaucaugauaa

SEQ ID NO: 79052 - RNA, 20 nt, Artificial Sequence
  MKO10079052_B_Cpa5
  gRNA
cuucaaauaagcuuuaacac

SEQ ID NO: 79053 - RNA, 20 nt, Artificial Sequence
  MKO10079053_B_Cpa6
  gRNA
ccucguaguuguauucagac

SEQ ID NO: 79054 - RNA, 20 nt, Artificial Sequence
  MKO10079054_B_Cpa6
  gRNA
gaucuguuaccuuaaguugg

SEQ ID NO: 79055 - RNA, 20 nt, Artificial Sequence
  MKO10079055_B_Cpa6
  gRNA
aacccuguuagcguucuuac

SEQ ID NO: 79056 - RNA, 20 nt, Artificial Sequence
  MKO10079056_B_Cpb1
  gRNA
agaugacgucagcuuaauuc

SEQ ID NO: 79057 - RNA, 20 nt, Artificial Sequence
  MKO10079057_B_Cpb1
  gRNA
cuucaucauguacacugaca

SEQ ID NO: 79058 - RNA, 20 nt, Artificial Sequence
  MKO10079058_B_Cpb1
  gRNA
uucacuuguguagcagaauc

SEQ ID NO: 79059 - RNA, 20 nt, Artificial Sequence
  MKO10079059_B_Cpb2
  gRNA
auacugcucauaguaugaag

SEQ ID NO: 79060 - RNA, 20 nt, Artificial Sequence
  MKO10079060_B_Cpb2
  gRNA
ucgaugaauucagcugucac

SEQ ID NO: 79061 - RNA, 20 nt, Artificial Sequence
  MKO10079061_B_Cpb2
  gRNA
uucaguuaugacuucuaucc

SEQ ID NO: 79062 - RNA, 20 nt, Artificial Sequence
  MKO10079062_B_Cpd
  gRNA
ugcucgggagaaucaucaaa

SEQ ID NO: 79063 - RNA, 20 nt, Artificial Sequence
  MKO10079063_B_Cpd
  gRNA
cugacaucacaguuggccga

SEQ ID NO: 79064 - RNA, 20 nt, Artificial Sequence
  MKO10079064_B_Cpd
  gRNA
guuacagccucaguugaacc

SEQ ID NO: 79065 - RNA, 20 nt, Artificial Sequence
  MKO10079065_B_Cpeb1
  gRNA
ccuggacacccggcccaucc

SEQ ID NO: 79066 - RNA, 20 nt, Artificial Sequence
  MKO10079066_B_Cpeb1
  gRNA
uguacaacaccuauaaaucg

SEQ ID NO: 79067 - RNA, 20 nt, Artificial Sequence
  MKO10079067_B_Cpeb1
  gRNA
ucugcgcaagaaucuccccg

SEQ ID NO: 79068 - RNA, 20 nt, Artificial Sequence
  MKO10079068_B_Cpeb2
  gRNA
uagcuugaauaugcacucuc

SEQ ID NO: 79069 - RNA, 20 nt, Artificial Sequence
  MKO10079069_B_Cpeb2
  gRNA
agcagagcacgauccucuca

SEQ ID NO: 79070 - RNA, 20 nt, Artificial Sequence
  MKO10079070_B_Cpeb2
  gRNA
gacaaucuguuaauguuaaa

SEQ ID NO: 79071 - RNA, 20 nt, Artificial Sequence
  MKO10079071_B_Cpeb3
  gRNA
aguggaacgcuacucuagaa

SEQ ID NO: 79072 - RNA, 20 nt, Artificial Sequence
  MKO10079072_B_Cpeb3
  gRNA
auuauaucagcgaaacucau

SEQ ID NO: 79073 - RNA, 20 nt, Artificial Sequence
  MKO10079073_B_Cpeb3
  gRNA
ggaauaaauuuccaccaucc

SEQ ID NO: 79074 - RNA, 20 nt, Artificial Sequence
  MKO10079074_B_Cpeb4
  gRNA
ucaaccucuucauagugguc

SEQ ID NO: 79075 - RNA, 20 nt, Artificial Sequence
  MKO10079075_B_Cpeb4
  gRNA
uguguucacaggaacgcccc

SEQ ID NO: 79076 - RNA, 20 nt, Artificial Sequence
  MKO10079076_B_Cpeb4
  gRNA
gauaguucucugcuuauuaa

SEQ ID NO: 79077 - RNA, 20 nt, Artificial Sequence
  MKO10079077_B_Cped1
  gRNA
ucccgagguuuccauacaug

SEQ ID NO: 79078 - RNA, 20 nt, Artificial Sequence
  MKO10079078_B_Cped1
  gRNA
gcagaagggccguccuccac

SEQ ID NO: 79079 - RNA, 20 nt, Artificial Sequence
  MKO10079079_B_Cped1
  gRNA
aagauuaccuggaaaucuuc

SEQ ID NO: 79080 - RNA, 20 nt, Artificial Sequence
  MKO10079080_B_Cpe
  gRNA
ggugcaugguacagcguccc

SEQ ID NO: 79081 - RNA, 20 nt, Artificial Sequence
  MKO10079081_B_Cpe
  gRNA
ugcggcuuucucaaagccgu

SEQ ID NO: 79082 - RNA, 20 nt, Artificial Sequence
  MKO10079082_B_Cpe
  gRNA
cuuugagaaagccgcaucgc

SEQ ID NO: 79083 - RNA, 20 nt, Artificial Sequence
  MKO10079083_B_Cphx1
  gRNA
ucagaauaaaagagccagau

SEQ ID NO: 79084 - RNA, 20 nt, Artificial Sequence
  MKO10079084_B_Cphx1
  gRNA
aguaagagaaugugaaauau

SEQ ID NO: 79085 - RNA, 20 nt, Artificial Sequence
  MKO10079085_B_Cphx1
  gRNA
gugcagcccccaaaagcuuc

SEQ ID NO: 79086 - RNA, 20 nt, Artificial Sequence
  MKO10079086_B_Cphx2
  gRNA
ucagaauaaaagagccagau

SEQ ID NO: 79087 - RNA, 20 nt, Artificial Sequence
  MKO10079087_B_Cphx2
  gRNA
aguaagagaaugugaaauau

SEQ ID NO: 79088 - RNA, 20 nt, Artificial Sequence
  MKO10079088_B_Cphx2
  gRNA
gugcagcccccaaaagcuuc

SEQ ID NO: 79089 - RNA, 20 nt, Artificial Sequence
  MKO10079089_B_Cplx1
  gRNA
gccauggaggccaacucgga

SEQ ID NO: 79090 - RNA, 20 nt, Artificial Sequence
  MKO10079090_B_Cplx1
  gRNA
caaagcaaaguacgccaaga

SEQ ID NO: 79091 - RNA, 20 nt, Artificial Sequence
  MKO10079091_B_Cplx1
  gRNA
uuguuucaucacgaacucca

SEQ ID NO: 79092 - RNA, 20 nt, Artificial Sequence
  MKO10079092_B_Cplx2
  gRNA
uggccuucuugggucggguc

SEQ ID NO: 79093 - RNA, 20 nt, Artificial Sequence
  MKO10079093_B_Cplx2
  gRNA
aagccugacccgacccaaga

SEQ ID NO: 79094 - RNA, 20 nt, Artificial Sequence
  MKO10079094_B_Cplx2
  gRNA
aagccgagcgcgagaagguc

SEQ ID NO: 79095 - RNA, 20 nt, Artificial Sequence
  MKO10079095_B_Cplx3
  gRNA
gcuagccaagaugaucgagg

SEQ ID NO: 79096 - RNA, 20 nt, Artificial Sequence
  MKO10079096_B_Cplx3
  gRNA
ucugaagugacuucgcagug

SEQ ID NO: 79097 - RNA, 20 nt, Artificial Sequence
  MKO10079097_B_Cplx3
  gRNA
agacaaauaccgucugccca

SEQ ID NO: 79098 - RNA, 20 nt, Artificial Sequence
  MKO10079098_B_Cplx4
  gRNA
aggcaccucagaccccgcgg

SEQ ID NO: 79099 - RNA, 20 nt, Artificial Sequence
  MKO10079099_B_Cplx4
  gRNA
agucaucccuuuagccgccg

SEQ ID NO: 79100 - RNA, 20 nt, Artificial Sequence
  MKO10079100_B_Cplx4
  gRNA
ccacaucgucuccagccagu

SEQ ID NO: 79101 - RNA, 20 nt, Artificial Sequence
  MKO10079101_B_Cpm
  gRNA
guagccguugauaaucccgu

SEQ ID NO: 79102 - RNA, 20 nt, Artificial Sequence
  MKO10079102_B_Cpm
  gRNA
accuuguacgccauuaucaa

SEQ ID NO: 79103 - RNA, 20 nt, Artificial Sequence
  MKO10079103_B_Cpm
  gRNA
guccucucugcgaaucucca

SEQ ID NO: 79104 - RNA, 20 nt, Artificial Sequence
  MKO10079104_B_Cpn1
  gRNA
aguucaaggagcgaauccac

SEQ ID NO: 79105 - RNA, 20 nt, Artificial Sequence
  MKO10079105_B_Cpn1
  gRNA
gucuggaagagcucgucauc

SEQ ID NO: 79106 - RNA, 20 nt, Artificial Sequence
  MKO10079106_B_Cpn1
  gRNA
ggaccugaaccgcaacuucc

SEQ ID NO: 79107 - RNA, 20 nt, Artificial Sequence
  MKO10079107_B_Cpn2
  gRNA
auagucucccgggcaagguu

SEQ ID NO: 79108 - RNA, 20 nt, Artificial Sequence
  MKO10079108_B_Cpn2
  gRNA
aaccagcugaccacgcuccc

SEQ ID NO: 79109 - RNA, 20 nt, Artificial Sequence
  MKO10079109_B_Cpn2
  gRNA
caacacucagguccgucacc

SEQ ID NO: 79110 - RNA, 20 nt, Artificial Sequence
  MKO10079110_B_Cpne1
  gRNA
aagucgucaucccccagcuc

SEQ ID NO: 79111 - RNA, 20 nt, Artificial Sequence
  MKO10079111_B_Cpne1
  gRNA
uuacccuugauguugaagcc

SEQ ID NO: 79112 - RNA, 20 nt, Artificial Sequence
  MKO10079112_B_Cpne1
  gRNA
ggacagccguguaguaacca

SEQ ID NO: 79113 - RNA, 20 nt, Artificial Sequence
  MKO10079113_B_Cpne2
  gRNA
ucuccagcaagaagaucacu

SEQ ID NO: 79114 - RNA, 20 nt, Artificial Sequence
  MKO10079114_B_Cpne2
  gRNA
ccgagucaucacacugagcc

SEQ ID NO: 79115 - RNA, 20 nt, Artificial Sequence
  MKO10079115_B_Cpne2
  gRNA
agaugauggcaaauggaugc

SEQ ID NO: 79116 - RNA, 20 nt, Artificial Sequence
  MKO10079116_B_Cpne3
  gRNA
guaauacucccuuucccugc

SEQ ID NO: 79117 - RNA, 20 nt, Artificial Sequence
  MKO10079117_B_Cpne3
  gRNA
uauugauuacuacuuugaag

SEQ ID NO: 79118 - RNA, 20 nt, Artificial Sequence
  MKO10079118_B_Cpne3
  gRNA
uuuaaauguaggaucuguuu

SEQ ID NO: 79119 - RNA, 20 nt, Artificial Sequence
  MKO10079119_B_Cpne4
  gRNA
agcggggaaauccuccauca

SEQ ID NO: 79120 - RNA, 20 nt, Artificial Sequence
  MKO10079120_B_Cpne4
  gRNA
guaaacagcuuugaguacac

SEQ ID NO: 79121 - RNA, 20 nt, Artificial Sequence
  MKO10079121_B_Cpne4
  gRNA
caguaaaucagacccauuuc

SEQ ID NO: 79122 - RNA, 20 nt, Artificial Sequence
  MKO10079122_B_Cpne5
  gRNA
ggagaacaagcaauggcgag

SEQ ID NO: 79123 - RNA, 20 nt, Artificial Sequence
  MKO10079123_B_Cpne5
  gRNA
cgauguugacuccaagagcc

SEQ ID NO: 79124 - RNA, 20 nt, Artificial Sequence
  MKO10079124_B_Cpne5
  gRNA
cucacguguuuagauagauc

SEQ ID NO: 79125 - RNA, 20 nt, Artificial Sequence
  MKO10079125_B_Cpne6
  gRNA
aggugcacuccguagacccg

SEQ ID NO: 79126 - RNA, 20 nt, Artificial Sequence
  MKO10079126_B_Cpne6
  gRNA
cacccgcagcuccacucgag

SEQ ID NO: 79127 - RNA, 20 nt, Artificial Sequence
  MKO10079127_B_Cpne6
  gRNA
ggcgggcaagucuacuauca

SEQ ID NO: 79128 - RNA, 20 nt, Artificial Sequence
  MKO10079128_B_Cpne7
  gRNA
uaugacacccacgggccuag

SEQ ID NO: 79129 - RNA, 20 nt, Artificial Sequence
  MKO10079129_B_Cpne7
  gRNA
ggagugagcagcucguguac

SEQ ID NO: 79130 - RNA, 20 nt, Artificial Sequence
  MKO10079130_B_Cpne7
  gRNA
cuccuuccaggcccggaaac

SEQ ID NO: 79131 - RNA, 20 nt, Artificial Sequence
  MKO10079131_B_Cpne8
  gRNA
uaaucaggaggcugcucccc

SEQ ID NO: 79132 - RNA, 20 nt, Artificial Sequence
  MKO10079132_B_Cpne8
  gRNA
ucccaacugcuuguguauau

SEQ ID NO: 79133 - RNA, 20 nt, Artificial Sequence
  MKO10079133_B_Cpne8
  gRNA
guccuauauacacaagcagu

SEQ ID NO: 79134 - RNA, 20 nt, Artificial Sequence
  MKO10079134_B_Cpne9
  gRNA
gcuuaccgguuuggagauau

SEQ ID NO: 79135 - RNA, 20 nt, Artificial Sequence
  MKO10079135_B_Cpne9
  gRNA
uaaagccaauaucuccaaac

SEQ ID NO: 79136 - RNA, 20 nt, Artificial Sequence
  MKO10079136_B_Cpne9
  gRNA
gacucaccucccgccacucc

SEQ ID NO: 79137 - RNA, 20 nt, Artificial Sequence
  MKO10079137_B_Cpox
  gRNA
ugggcgcauaaggauucuug

SEQ ID NO: 79138 - RNA, 20 nt, Artificial Sequence
  MKO10079138_B_Cpox
  gRNA
acgcccguccugaagcacac

SEQ ID NO: 79139 - RNA, 20 nt, Artificial Sequence
  MKO10079139_B_Cpox
  gRNA
accgacauacuugaaccaag

SEQ ID NO: 79140 - RNA, 20 nt, Artificial Sequence
  MKO10079140_B_Cpped1
  gRNA
uaccugaggaaaacgcgucc

SEQ ID NO: 79141 - RNA, 20 nt, Artificial Sequence
  MKO10079141_B_Cpped1
  gRNA
cggcuuucaguacucgcugc

SEQ ID NO: 79142 - RNA, 20 nt, Artificial Sequence
  MKO10079142_B_Cpped1
  gRNA
uaccuggcauggcaugaacg

SEQ ID NO: 79143 - RNA, 20 nt, Artificial Sequence
  MKO10079143_B_Cpq
  gRNA
uguccaaauguccacugacc

SEQ ID NO: 79144 - RNA, 20 nt, Artificial Sequence
  MKO10079144_B_Cpq
  gRNA
ccuuauguagcucauaauac

SEQ ID NO: 79145 - RNA, 20 nt, Artificial Sequence
  MKO10079145_B_Cpq
  gRNA
ugcaucuucuacugugauac

SEQ ID NO: 79146 - RNA, 20 nt, Artificial Sequence
  MKO10079146_B_Cps1
  gRNA
uuacaggucccugcaauuua

SEQ ID NO: 79147 - RNA, 20 nt, Artificial Sequence
  MKO10079147_B_Cps1
  gRNA
aagaugaaaggcuacuccuu

SEQ ID NO: 79148 - RNA, 20 nt, Artificial Sequence
  MKO10079148_B_Cps1
  gRNA
uuccuagguggcaggucugc

SEQ ID NO: 79149 - RNA, 20 nt, Artificial Sequence
  MKO10079149_B_Cpsf1
  gRNA
ccugucucuacacuacuuug

SEQ ID NO: 79150 - RNA, 20 nt, Artificial Sequence
  MKO10079150_B_Cpsf1
  gRNA
ccaccgagagaaacuagagc

SEQ ID NO: 79151 - RNA, 20 nt, Artificial Sequence
  MKO10079151_B_Cpsf1
  gRNA
ucucaguuucaaagacgcua

SEQ ID NO: 79152 - RNA, 20 nt, Artificial Sequence
  MKO10079152_B_Cpsf2
  gRNA
agaagaaauuguguaugccg

SEQ ID NO: 79153 - RNA, 20 nt, Artificial Sequence
  MKO10079153_B_Cpsf2
  gRNA
ccagggaacauccauuuaag

SEQ ID NO: 79154 - RNA, 20 nt, Artificial Sequence
  MKO10079154_B_Cpsf2
  gRNA
ccuccuaucauaugaccagc

SEQ ID NO: 79155 - RNA, 20 nt, Artificial Sequence
  MKO10079155_B_Cpsf3l
  gRNA
acuccgagcccacuuuaauc

SEQ ID NO: 79156 - RNA, 20 nt, Artificial Sequence
  MKO10079156_B_Cpsf3l
  gRNA
cuauaugacccauccuaccc

SEQ ID NO: 79157 - RNA, 20 nt, Artificial Sequence
  MKO10079157_B_Cpsf3l
  gRNA
ugcagcuucggccuacaucc

SEQ ID NO: 79158 - RNA, 20 nt, Artificial Sequence
  MKO10079158_B_Cpsf3
  gRNA
ucucagacuaugucaaaguc

SEQ ID NO: 79159 - RNA, 20 nt, Artificial Sequence
  MKO10079159_B_Cpsf3
  gRNA
gggcuccacagugauccaaa

SEQ ID NO: 79160 - RNA, 20 nt, Artificial Sequence
  MKO10079160_B_Cpsf3
  gRNA
gaagggcauccauuccuucc

SEQ ID NO: 79161 - RNA, 20 nt, Artificial Sequence
  MKO10079161_B_Cpsf4l
  gRNA
agucgcagcaaucacucuuc

SEQ ID NO: 79162 - RNA, 20 nt, Artificial Sequence
  MKO10079162_B_Cpsf4l
  gRNA
aucauacuuacugcccaaau

SEQ ID NO: 79163 - RNA, 20 nt, Artificial Sequence
  MKO10079163_B_Cpsf4l
  gRNA
accaugggcuuugccuggaa

SEQ ID NO: 79164 - RNA, 20 nt, Artificial Sequence
  MKO10079164_B_Cpsf4
  gRNA
gugugccgaugccuacacag

SEQ ID NO: 79165 - RNA, 20 nt, Artificial Sequence
  MKO10079165_B_Cpsf4
  gRNA
gggucucuuaccuuugccac

SEQ ID NO: 79166 - RNA, 20 nt, Artificial Sequence
  MKO10079166_B_Cpsf4
  gRNA
uuggaguaaaaguagcacuc

SEQ ID NO: 79167 - RNA, 20 nt, Artificial Sequence
  MKO10079167_B_Cpsf6
  gRNA
agaggacggggccgguuucc

SEQ ID NO: 79168 - RNA, 20 nt, Artificial Sequence
  MKO10079168_B_Cpsf6
  gRNA
aacugaggccguucauucuu

SEQ ID NO: 79169 - RNA, 20 nt, Artificial Sequence
  MKO10079169_B_Cpsf6
  gRNA
uuauugcauggaguuacaac

SEQ ID NO: 79170 - RNA, 20 nt, Artificial Sequence
  MKO10079170_B_Cpsf7
  gRNA
ugaaggaggacgguuaaagu

SEQ ID NO: 79171 - RNA, 20 nt, Artificial Sequence
  MKO10079171_B_Cpsf7
  gRNA
uguacccucaucugcucgug

SEQ ID NO: 79172 - RNA, 20 nt, Artificial Sequence
  MKO10079172_B_Cpsf7
  gRNA
uuugcagagaaucgugcaaa

SEQ ID NO: 79173 - RNA, 20 nt, Artificial Sequence
  MKO10079173_B_Cpt1a
  gRNA
gcaggcgcggcagagacguc

SEQ ID NO: 79174 - RNA, 20 nt, Artificial Sequence
  MKO10079174_B_Cpt1a
  gRNA
cugucaaagauaccgugagc

SEQ ID NO: 79175 - RNA, 20 nt, Artificial Sequence
  MKO10079175_B_Cpt1a
  gRNA
gggguccacuuugguaugca

SEQ ID NO: 79176 - RNA, 20 nt, Artificial Sequence
  MKO10079176_B_Cpt1b
  gRNA
gcgugccagccacaauucac

SEQ ID NO: 79177 - RNA, 20 nt, Artificial Sequence
  MKO10079177_B_Cpt1b
  gRNA
gaugcaaucgaccaguccca

SEQ ID NO: 79178 - RNA, 20 nt, Artificial Sequence
  MKO10079178_B_Cpt1b
  gRNA
aggucccuuaccuuuccggg

SEQ ID NO: 79179 - RNA, 20 nt, Artificial Sequence
  MKO10079179_B_Cpt1c
  gRNA
gcugucgcgggagcgcgcgu

SEQ ID NO: 79180 - RNA, 20 nt, Artificial Sequence
  MKO10079180_B_Cpt1c
  gRNA
uguccucacccacgaagacc

SEQ ID NO: 79181 - RNA, 20 nt, Artificial Sequence
  MKO10079181_B_Cpt1c
  gRNA
acauaccagccaggucuucg

SEQ ID NO: 79182 - RNA, 20 nt, Artificial Sequence
  MKO10079182_B_Cpt2
  gRNA
cguaugcuguucacgaugac

SEQ ID NO: 79183 - RNA, 20 nt, Artificial Sequence
  MKO10079183_B_Cpt2
  gRNA
ucuguuuauccugagcgagc

SEQ ID NO: 79184 - RNA, 20 nt, Artificial Sequence
  MKO10079184_B_Cpt2
  gRNA
gcaugcgcaccugcucgcuc

SEQ ID NO: 79185 - RNA, 20 nt, Artificial Sequence
  MKO10079185_B_Cpvl
  gRNA
augaacgacaagaguuaugc

SEQ ID NO: 79186 - RNA, 20 nt, Artificial Sequence
  MKO10079186_B_Cpvl
  gRNA
caugcucuacauugauaauc

SEQ ID NO: 79187 - RNA, 20 nt, Artificial Sequence
  MKO10079187_B_Cpvl
  gRNA
cggauuaucaauguagagca

SEQ ID NO: 79188 - RNA, 20 nt, Artificial Sequence
  MKO10079188_B_Cpxcr1
  gRNA
cgaaacaccaaaugccugug

SEQ ID NO: 79189 - RNA, 20 nt, Artificial Sequence
  MKO10079189_B_Cpxcr1
  gRNA
auucuacauaauauuaaccu

SEQ ID NO: 79190 - RNA, 20 nt, Artificial Sequence
  MKO10079190_B_Cpxcr1
  gRNA
cuaaaaaguugaccauucca

SEQ ID NO: 79191 - RNA, 20 nt, Artificial Sequence
  MKO10079191_B_Cpxm1
  gRNA
ccuggauauugagccguccu

SEQ ID NO: 79192 - RNA, 20 nt, Artificial Sequence
  MKO10079192_B_Cpxm1
  gRNA
ucuggcugucauugcugaac

SEQ ID NO: 79193 - RNA, 20 nt, Artificial Sequence
  MKO10079193_B_Cpxm1
  gRNA
uggaagaguaggaacaguac

SEQ ID NO: 79194 - RNA, 20 nt, Artificial Sequence
  MKO10079194_B_Cpxm2
  gRNA
ugaccccugugaacuugguc

SEQ ID NO: 79195 - RNA, 20 nt, Artificial Sequence
  MKO10079195_B_Cpxm2
  gRNA
ggugacauccuauaaaguca

SEQ ID NO: 79196 - RNA, 20 nt, Artificial Sequence
  MKO10079196_B_Cpxm2
  gRNA
aaagcugccagugaugacca

SEQ ID NO: 79197 - RNA, 20 nt, Artificial Sequence
  MKO10079197_B_Cpz
  gRNA
ccagcagguacuccgagcac

SEQ ID NO: 79198 - RNA, 20 nt, Artificial Sequence
  MKO10079198_B_Cpz
  gRNA
acgggaagugcucaucuacc

SEQ ID NO: 79199 - RNA, 20 nt, Artificial Sequence
  MKO10079199_B_Cpz
  gRNA
aucgaguucucgagccgccc

SEQ ID NO: 79200 - RNA, 20 nt, Artificial Sequence
  MKO10079200_B_Cp
  gRNA
gcugcacacaucgagagccc

SEQ ID NO: 79201 - RNA, 20 nt, Artificial Sequence
  MKO10079201_B_Cp
  gRNA
aacguacaccaaggaguaug

SEQ ID NO: 79202 - RNA, 20 nt, Artificial Sequence
  MKO10079202_B_Cp
  gRNA
cacccuaauugaugcuuaua

SEQ ID NO: 79203 - RNA, 20 nt, Artificial Sequence
  MKO10079203_B_Cr1l
  gRNA
uuguuguaugaaugucuccc

SEQ ID NO: 79204 - RNA, 20 nt, Artificial Sequence
  MKO10079204_B_Cr1l
  gRNA
acauguaccaagccauucuc

SEQ ID NO: 79205 - RNA, 20 nt, Artificial Sequence
  MKO10079205_B_Cr1l
  gRNA
uucaacuuacacucacaaau

SEQ ID NO: 79206 - RNA, 20 nt, Artificial Sequence
  MKO10079206_B_Cr2
  gRNA
ucaccuagcuaccgccucau

SEQ ID NO: 79207 - RNA, 20 nt, Artificial Sequence
  MKO10079207_B_Cr2
  gRNA
auguaccuaccuuuacauac

SEQ ID NO: 79208 - RNA, 20 nt, Artificial Sequence
  MKO10079208_B_Cr2
  gRNA
gucuucagguaccaauuaca

SEQ ID NO: 79209 - RNA, 20 nt, Artificial Sequence
  MKO10079209_B_Crabp1
  gRNA
gacauuuggcgccgaugaug

SEQ ID NO: 79210 - RNA, 20 nt, Artificial Sequence
  MKO10079210_B_Crabp1
  gRNA
gaauuucgacgagcuccuca

SEQ ID NO: 79211 - RNA, 20 nt, Artificial Sequence
  MKO10079211_B_Crabp1
  gRNA
ccagcuuacccaacgccuug

SEQ ID NO: 79212 - RNA, 20 nt, Artificial Sequence
  MKO10079212_B_Crabp2
  gRNA
uccuguuugaucucgacugc

SEQ ID NO: 79213 - RNA, 20 nt, Artificial Sequence
  MKO10079213_B_Crabp2
  gRNA
acaaaauggugugcgagcag

SEQ ID NO: 79214 - RNA, 20 nt, Artificial Sequence
  MKO10079214_B_Crabp2
  gRNA
gggagggccccaagaccucc

SEQ ID NO: 79215 - RNA, 20 nt, Artificial Sequence
  MKO10079215_B_Cradd
  gRNA
gucacagccgagcugccuac

SEQ ID NO: 79216 - RNA, 20 nt, Artificial Sequence
  MKO10079216_B_Cradd
  gRNA
ccaccugcgaaugcacguug

SEQ ID NO: 79217 - RNA, 20 nt, Artificial Sequence
  MKO10079217_B_Cradd
  gRNA
gcccuuguguaagcuuagga

SEQ ID NO: 79218 - RNA, 20 nt, Artificial Sequence
  MKO10079218_B_Cramp1l
  gRNA
cgcuccuccucccggaacau

SEQ ID NO: 79219 - RNA, 20 nt, Artificial Sequence
  MKO10079219_B_Cramp1l
  gRNA
aagucaucccaggaacucua

SEQ ID NO: 79220 - RNA, 20 nt, Artificial Sequence
  MKO10079220_B_Cramp1l
  gRNA
uuguucuucaccaugcuugc

SEQ ID NO: 79221 - RNA, 20 nt, Artificial Sequence
  MKO10079221_B_Crau
  gRNA
caauacacccucgaugaguu

SEQ ID NO: 79222 - RNA, 20 nt, Artificial Sequence
  MKO10079222_B_Crau
  gRNA
augggcucacaccaagcaac

SEQ ID NO: 79223 - RNA, 20 nt, Artificial Sequence
  MKO10079223_B_Crau
  gRNA
ggcuacucacuugucaauca

SEQ ID NO: 79224 - RNA, 20 nt, Artificial Sequence
  MKO10079224_B_Crb1
  gRNA
gcuugcacguagaauuguuu

SEQ ID NO: 79225 - RNA, 20 nt, Artificial Sequence
  MKO10079225_B_Crb1
  gRNA
gccacaugucaggacgcucc

SEQ ID NO: 79226 - RNA, 20 nt, Artificial Sequence
  MKO10079226_B_Crb1
  gRNA
guuuccauauagacccucug

SEQ ID NO: 79227 - RNA, 20 nt, Artificial Sequence
  MKO10079227_B_Crb2
  gRNA
cuaccgcugcgugugcgcgc

SEQ ID NO: 79228 - RNA, 20 nt, Artificial Sequence
  MKO10079228_B_Crb2
  gRNA
ggccugaacacccccguaca

SEQ ID NO: 79229 - RNA, 20 nt, Artificial Sequence
  MKO10079229_B_Crb2
  gRNA
ggaugaggacgaaugugcau

SEQ ID NO: 79230 - RNA, 20 nt, Artificial Sequence
  MKO10079230_B_Crb3
  gRNA
aauagcacaacucaaccccc

SEQ ID NO: 79231 - RNA, 20 nt, Artificial Sequence
  MKO10079231_B_Crb3
  gRNA
cugggggugcucuuggcguu

SEQ ID NO: 79232 - RNA, 20 nt, Artificial Sequence
  MKO10079232_B_Crb3
  gRNA
gggaguccuccuuauagcag

SEQ ID NO: 79233 - RNA, 20 nt, Artificial Sequence
  MKO10079233_B_Crbn
  gRNA
cuaugccuaucgagaagagc

SEQ ID NO: 79234 - RNA, 20 nt, Artificial Sequence
  MKO10079234_B_Crbn
  gRNA
aaccaccugccgcuucugcc

SEQ ID NO: 79235 - RNA, 20 nt, Artificial Sequence
  MKO10079235_B_Crbn
  gRNA
gcaugacgacgacagcugcc

SEQ ID NO: 79236 - RNA, 20 nt, Artificial Sequence
  MKO10079236_B_Crcp
  gRNA
cuagguguuccaguuacuaa

SEQ ID NO: 79237 - RNA, 20 nt, Artificial Sequence
  MKO10079237_B_Crcp
  gRNA
uuacuuacuuggucagcuug

SEQ ID NO: 79238 - RNA, 20 nt, Artificial Sequence
  MKO10079238_B_Crcp
  gRNA
gcuggacucugguuccuaca

SEQ ID NO: 79239 - RNA, 20 nt, Artificial Sequence
  MKO10079239_B_Crcu1
  gRNA
gccugaacucugauuguugc

SEQ ID NO: 79240 - RNA, 20 nt, Artificial Sequence
  MKO10079240_B_Crcu1
  gRNA
gcagccuccgccacagcaag

SEQ ID NO: 79241 - RNA, 20 nt, Artificial Sequence
  MKO10079241_B_Crcu1
  gRNA
uccugcaacaaucagaguuc

SEQ ID NO: 79242 - RNA, 20 nt, Artificial Sequence
  MKO10079242_B_Creb1
  gRNA
uaacugauucccaaaaacga

SEQ ID NO: 79243 - RNA, 20 nt, Artificial Sequence
  MKO10079243_B_Creb1
  gRNA
gaugauguugcaugagcugc

SEQ ID NO: 79244 - RNA, 20 nt, Artificial Sequence
  MKO10079244_B_Creb1
  gRNA
uuucaaggaggccuuccuac

SEQ ID NO: 79245 - RNA, 20 nt, Artificial Sequence
  MKO10079245_B_Creb3l1
  gRNA
gcacucuucucguccagcac

SEQ ID NO: 79246 - RNA, 20 nt, Artificial Sequence
  MKO10079246_B_Creb3l1
  gRNA
gggggcucugcuuugaucac

SEQ ID NO: 79247 - RNA, 20 nt, Artificial Sequence
  MKO10079247_B_Creb3l1
  gRNA
aggggaucuacaggcagcuc

SEQ ID NO: 79248 - RNA, 20 nt, Artificial Sequence
  MKO10079248_B_Creb3l2
  gRNA
cguucugggaaaacucgucu

SEQ ID NO: 79249 - RNA, 20 nt, Artificial Sequence
  MKO10079249_B_Creb3l2
  gRNA
ugaaaaagaagaguccccuc

SEQ ID NO: 79250 - RNA, 20 nt, Artificial Sequence
  MKO10079250_B_Creb3l2
  gRNA
agagucacugcugugacuac

SEQ ID NO: 79251 - RNA, 20 nt, Artificial Sequence
  MKO10079251_B_Creb3l3
  gRNA
gguucagugccacuacgagg

SEQ ID NO: 79252 - RNA, 20 nt, Artificial Sequence
  MKO10079252_B_Creb3l3
  gRNA
uaccaaguccccgcugccac

SEQ ID NO: 79253 - RNA, 20 nt, Artificial Sequence
  MKO10079253_B_Creb3l3
  gRNA
gagcacagauacccuguacc

SEQ ID NO: 79254 - RNA, 20 nt, Artificial Sequence
  MKO10079254_B_Creb3l4
  gRNA
cuaugauucagggacccuac

SEQ ID NO: 79255 - RNA, 20 nt, Artificial Sequence
  MKO10079255_B_Creb3l4
  gRNA
ccugagccgacugcuuguug

SEQ ID NO: 79256 - RNA, 20 nt, Artificial Sequence
  MKO10079256_B_Creb3l4
  gRNA
cgcauagacauauccugccu

SEQ ID NO: 79257 - RNA, 20 nt, Artificial Sequence
  MKO10079257_B_Creb3
  gRNA
agauacugagagcuucgaaa

SEQ ID NO: 79258 - RNA, 20 nt, Artificial Sequence
  MKO10079258_B_Creb3
  gRNA
aacaaguucugaaacgagug

SEQ ID NO: 79259 - RNA, 20 nt, Artificial Sequence
  MKO10079259_B_Creb3
  gRNA
uccauccuuaggagaugucu

SEQ ID NO: 79260 - RNA, 20 nt, Artificial Sequence
  MKO10079260_B_Creb5
  gRNA
gagcaccaucggacacauga

SEQ ID NO: 79261 - RNA, 20 nt, Artificial Sequence
  MKO10079261_B_Creb5
  gRNA
accuugcaugcccaugaugc

SEQ ID NO: 79262 - RNA, 20 nt, Artificial Sequence
  MKO10079262_B_Creb5
  gRNA
aaugcuuacaggcaucaaga

SEQ ID NO: 79263 - RNA, 20 nt, Artificial Sequence
  MKO10079263_B_Crebbp
  gRNA
ccauuggggaucagcucauc

SEQ ID NO: 79264 - RNA, 20 nt, Artificial Sequence
  MKO10079264_B_Crebbp
  gRNA
cacgacaaaucaucucucau

SEQ ID NO: 79265 - RNA, 20 nt, Artificial Sequence
  MKO10079265_B_Crebbp
  gRNA
ccugaugagcugauccccaa

SEQ ID NO: 79266 - RNA, 20 nt, Artificial Sequence
  MKO10079266_B_Crebl2
  gRNA
agccucagcagagcucaagc

SEQ ID NO: 79267 - RNA, 20 nt, Artificial Sequence
  MKO10079267_B_Crebl2
  gRNA
ugcggagauggaugacagca

SEQ ID NO: 79268 - RNA, 20 nt, Artificial Sequence
  MKO10079268_B_Crebl2
  gRNA
aagcgaaacuugagcgaagc

SEQ ID NO: 79269 - RNA, 20 nt, Artificial Sequence
  MKO10079269_B_Crebrf
  gRNA
auuacuuaguccucugacgc

SEQ ID NO: 79270 - RNA, 20 nt, Artificial Sequence
  MKO10079270_B_Crebrf
  gRNA
ccuaaaaaacuacuucagau

SEQ ID NO: 79271 - RNA, 20 nt, Artificial Sequence
  MKO10079271_B_Crebrf
  gRNA
guuaagggaagcucacuaac

SEQ ID NO: 79272 - RNA, 20 nt, Artificial Sequence
  MKO10079272_B_Crebzf
  gRNA
caagcgcgugcaagcacugc

SEQ ID NO: 79273 - RNA, 20 nt, Artificial Sequence
  MKO10079273_B_Crebzf
  gRNA
gcgagcuaguccggucucgu

SEQ ID NO: 79274 - RNA, 20 nt, Artificial Sequence
  MKO10079274_B_Crebzf
  gRNA
ucgcuaccuacgggccgucc

SEQ ID NO: 79275 - RNA, 20 nt, Artificial Sequence
  MKO10079275_B_Creg1
  gRNA
aauuaaaaauaagccguauc

SEQ ID NO: 79276 - RNA, 20 nt, Artificial Sequence
  MKO10079276_B_Creg1
  gRNA
gugacguuaaaauauucuuc

SEQ ID NO: 79277 - RNA, 20 nt, Artificial Sequence
  MKO10079277_B_Creg1
  gRNA
acaucauuauaugaacacac

SEQ ID NO: 79278 - RNA, 20 nt, Artificial Sequence
  MKO10079278_B_Creg2
  gRNA
gagguguaucugacaucccg

SEQ ID NO: 79279 - RNA, 20 nt, Artificial Sequence
  MKO10079279_B_Creg2
  gRNA
cagaagacccccgaugugcc

SEQ ID NO: 79280 - RNA, 20 nt, Artificial Sequence
  MKO10079280_B_Creg2
  gRNA
uccaagaagaugucgcuguc

SEQ ID NO: 79281 - RNA, 20 nt, Artificial Sequence
  MKO10079281_B_Creld1
  gRNA
uuccacccccgaaguugucc

SEQ ID NO: 79282 - RNA, 20 nt, Artificial Sequence
  MKO10079282_B_Creld1
  gRNA
ccgccugcucgagcugagcg

SEQ ID NO: 79283 - RNA, 20 nt, Artificial Sequence
  MKO10079283_B_Creld1
  gRNA
aagcccccgaccucuuccag

SEQ ID NO: 79284 - RNA, 20 nt, Artificial Sequence
  MKO10079284_B_Creld2
  gRNA
agcaccccaaccuauuugag

SEQ ID NO: 79285 - RNA, 20 nt, Artificial Sequence
  MKO10079285_B_Creld2
  gRNA
gagaggccuugcagcggaaa

SEQ ID NO: 79286 - RNA, 20 nt, Artificial Sequence
  MKO10079286_B_Creld2
  gRNA
uuucagugagauccggcuuc

SEQ ID NO: 79287 - RNA, 20 nt, Artificial Sequence
  MKO10079287_B_Crem
  gRNA
acugccaugguagcaauguu

SEQ ID NO: 79288 - RNA, 20 nt, Artificial Sequence
  MKO10079288_B_Crem
  gRNA
uggccuaccugagcuagagu

SEQ ID NO: 79289 - RNA, 20 nt, Artificial Sequence
  MKO10079289_B_Crem
  gRNA
accaccuaacauugcuacca

SEQ ID NO: 79290 - RNA, 20 nt, Artificial Sequence
  MKO10079290_B_Crhbp
  gRNA
ccuucaggaaauccccgccu

SEQ ID NO: 79291 - RNA, 20 nt, Artificial Sequence
  MKO10079291_B_Crhbp
  gRNA
guuaucgugaauccauuucc

SEQ ID NO: 79292 - RNA, 20 nt, Artificial Sequence
  MKO10079292_B_Crhbp
  gRNA
uucuuccggguccacgaacc

SEQ ID NO: 79293 - RNA, 20 nt, Artificial Sequence
  MKO10079293_B_Crhr1
  gRNA
aaugccuggccaacggcagc

SEQ ID NO: 79294 - RNA, 20 nt, Artificial Sequence
  MKO10079294_B_Crhr1
  gRNA
acgggcugcccagcugccgu

SEQ ID NO: 79295 - RNA, 20 nt, Artificial Sequence
  MKO10079295_B_Crhr1
  gRNA
aguugaugaugacggcaaug

SEQ ID NO: 79296 - RNA, 20 nt, Artificial Sequence
  MKO10079296_B_Crhr2
  gRNA
cggucucucuacuagggcuc

SEQ ID NO: 79297 - RNA, 20 nt, Artificial Sequence
  MKO10079297_B_Crhr2
  gRNA
cucacacugcgaacccauuu

SEQ ID NO: 79298 - RNA, 20 nt, Artificial Sequence
  MKO10079298_B_Crhr2
  gRNA
aguugacaaugagggcgauu

SEQ ID NO: 79299 - RNA, 20 nt, Artificial Sequence
  MKO10079299_B_Crh
  gRNA
gauccgucccccgagcgccg

SEQ ID NO: 79300 - RNA, 20 nt, Artificial Sequence
  MKO10079300_B_Crh
  gRNA
uuuccaagacuucccgcaga

SEQ ID NO: 79301 - RNA, 20 nt, Artificial Sequence
  MKO10079301_B_Crh
  gRNA
cagccgccccucgcacgacc

SEQ ID NO: 79302 - RNA, 20 nt, Artificial Sequence
  MKO10079302_B_Crim1
  gRNA
cuugcguuucguagcugucc

SEQ ID NO: 79303 - RNA, 20 nt, Artificial Sequence
  MKO10079303_B_Crim1
  gRNA
cacacgcagcggcuggguaa

SEQ ID NO: 79304 - RNA, 20 nt, Artificial Sequence
  MKO10079304_B_Crim1
  gRNA
caucuccacgagagacuauu

SEQ ID NO: 79305 - RNA, 20 nt, Artificial Sequence
  MKO10079305_B_Crip1
  gRNA
guagcagggaugauugcagu

SEQ ID NO: 79306 - RNA, 20 nt, Artificial Sequence
  MKO10079306_B_Crip1
  gRNA
ccucggucuacuugaaagug

SEQ ID NO: 79307 - RNA, 20 nt, Artificial Sequence
  MKO10079307_B_Crip1
  gRNA
gcugagcgagugacuucacu

SEQ ID NO: 79308 - RNA, 20 nt, Artificial Sequence
  MKO10079308_B_Crip2
  gRNA
ucuagugucaccacauucac

SEQ ID NO: 79309 - RNA, 20 nt, Artificial Sequence
  MKO10079309_B_Crip2
  gRNA
uacacucucuuguugcaucg

SEQ ID NO: 79310 - RNA, 20 nt, Artificial Sequence
  MKO10079310_B_Crip2
  gRNA
accuuuggguccaaacagcg

SEQ ID NO: 79311 - RNA, 20 nt, Artificial Sequence
  MKO10079311_B_Crip3
  gRNA
cucucugcaggggucaacau

SEQ ID NO: 79312 - RNA, 20 nt, Artificial Sequence
  MKO10079312_B_Crip3
  gRNA
acggugccaguucuugccua

SEQ ID NO: 79313 - RNA, 20 nt, Artificial Sequence
  MKO10079313_B_Crip3
  gRNA
ccaaagagagccccauagca

SEQ ID NO: 79314 - RNA, 20 nt, Artificial Sequence
  MKO10079314_B_Cript
  gRNA
uucucuagguuugauccaua

SEQ ID NO: 79315 - RNA, 20 nt, Artificial Sequence
  MKO10079315_B_Cript
  gRNA
aaacaguaccugugguguuc

SEQ ID NO: 79316 - RNA, 20 nt, Artificial Sequence
  MKO10079316_B_Cript
  gRNA
cuuugacuucgaaaaaagca

SEQ ID NO: 79317 - RNA, 20 nt, Artificial Sequence
  MKO10079317_B_Crisp1
  gRNA
caaacauaauaguaucucag

SEQ ID NO: 79318 - RNA, 20 nt, Artificial Sequence
  MKO10079318_B_Crisp1
  gRNA
gcacaaccaauugagacgaa

SEQ ID NO: 79319 - RNA, 20 nt, Artificial Sequence
  MKO10079319_B_Crisp1
  gRNA
cucaagugaaugcucagcaa

SEQ ID NO: 79320 - RNA, 20 nt, Artificial Sequence
  MKO10079320_B_Crisp2
  gRNA
ugucaacugauccuacccuc

SEQ ID NO: 79321 - RNA, 20 nt, Artificial Sequence
  MKO10079321_B_Crisp2
  gRNA
auacuuacauaggacaguaa

SEQ ID NO: 79322 - RNA, 20 nt, Artificial Sequence
  MKO10079322_B_Crisp2
  gRNA
auauuucagguugucuugau

SEQ ID NO: 79323 - RNA, 20 nt, Artificial Sequence
  MKO10079323_B_Crisp3
  gRNA
ucaaauuuacaaguugcaug

SEQ ID NO: 79324 - RNA, 20 nt, Artificial Sequence
  MKO10079324_B_Crisp3
  gRNA
caaacauaaaaguaucucag

SEQ ID NO: 79325 - RNA, 20 nt, Artificial Sequence
  MKO10079325_B_Crisp3
  gRNA
gcacaaccaauugagacgaa

SEQ ID NO: 79326 - RNA, 20 nt, Artificial Sequence
  MKO10079326_B_Crisp4
  gRNA
ugcagcuugucgcagacaaa

SEQ ID NO: 79327 - RNA, 20 nt, Artificial Sequence
  MKO10079327_B_Crisp4
  gRNA
cugcaacaucacagccaacg

SEQ ID NO: 79328 - RNA, 20 nt, Artificial Sequence
  MKO10079328_B_Crisp4
  gRNA
aguuucgaugucaucaucug

SEQ ID NO: 79329 - RNA, 20 nt, Artificial Sequence
  MKO10079329_B_Crispld1
  gRNA
uguuuguacacacuacacuc

SEQ ID NO: 79330 - RNA, 20 nt, Artificial Sequence
  MKO10079330_B_Crispld1
  gRNA
uacuguccuuucagauguuc

SEQ ID NO: 79331 - RNA, 20 nt, Artificial Sequence
  MKO10079331_B_Crispld1
  gRNA
gcgagccugcugcccuccau

SEQ ID NO: 79332 - RNA, 20 nt, Artificial Sequence
  MKO10079332_B_Crispld2
  gRNA
cugaacaaucuuugccaccg

SEQ ID NO: 79333 - RNA, 20 nt, Artificial Sequence
  MKO10079333_B_Crispld2
  gRNA
acccccacgagugcacucca

SEQ ID NO: 79334 - RNA, 20 nt, Artificial Sequence
  MKO10079334_B_Crispld2
  gRNA
gccggccuucugagguccau

SEQ ID NO: 79335 - RNA, 20 nt, Artificial Sequence
  MKO10079335_B_Crkl
  gRNA
cuuacguugaaaagcuugug

SEQ ID NO: 79336 - RNA, 20 nt, Artificial Sequence
  MKO10079336_B_Crkl
  gRNA
cauucaccucgccuucccau

SEQ ID NO: 79337 - RNA, 20 nt, Artificial Sequence
  MKO10079337_B_Crkl
  gRNA
cagcaaucacucguugucau

SEQ ID NO: 79338 - RNA, 20 nt, Artificial Sequence
  MKO10079338_B_Crk
  gRNA
guugacgcuggguugggcau

SEQ ID NO: 79339 - RNA, 20 nt, Artificial Sequence
  MKO10079339_B_Crk
  gRNA
auucacacauguccgucugc

SEQ ID NO: 79340 - RNA, 20 nt, Artificial Sequence
  MKO10079340_B_Crk
  gRNA
cguccugcaggucggugagc

SEQ ID NO: 79341 - RNA, 20 nt, Artificial Sequence
  MKO10079341_B_Crlf1
  gRNA
guggaagccaccaaucgccu

SEQ ID NO: 79342 - RNA, 20 nt, Artificial Sequence
  MKO10079342_B_Crlf1
  gRNA
ccuccacaggugguacgguc

SEQ ID NO: 79343 - RNA, 20 nt, Artificial Sequence
  MKO10079343_B_Crlf1
  gRNA
acgugagauccuucauguuc

SEQ ID NO: 79344 - RNA, 20 nt, Artificial Sequence
  MKO10079344_B_Crlf2
  gRNA
cccggggcgacgcccgaacc

SEQ ID NO: 79345 - RNA, 20 nt, Artificial Sequence
  MKO10079345_B_Crlf2
  gRNA
gagacagucacguccccguc

SEQ ID NO: 79346 - RNA, 20 nt, Artificial Sequence
  MKO10079346_B_Crlf2
  gRNA
aauaucgcgggcaggguugc

SEQ ID NO: 79347 - RNA, 20 nt, Artificial Sequence
  MKO10079347_B_Crlf3
  gRNA
cauaccaugaggcaccagug

SEQ ID NO: 79348 - RNA, 20 nt, Artificial Sequence
  MKO10079348_B_Crlf3
  gRNA
caucgcacuaugaugccucc

SEQ ID NO: 79349 - RNA, 20 nt, Artificial Sequence
  MKO10079349_B_Crlf3
  gRNA
caauucagagucugcgcccg

SEQ ID NO: 79350 - RNA, 20 nt, Artificial Sequence
  MKO10079350_B_Crls1
  gRNA
auaccgaacucugccaacac

SEQ ID NO: 79351 - RNA, 20 nt, Artificial Sequence
  MKO10079351_B_Crls1
  gRNA
uuaccgguguuggcagaguu

SEQ ID NO: 79352 - RNA, 20 nt, Artificial Sequence
  MKO10079352_B_Crls1
  gRNA
accuaugcagaucuuauucc

SEQ ID NO: 79353 - RNA, 20 nt, Artificial Sequence
  MKO10079353_B_Crmp1
  gRNA
ugaugcguccaccucugaug

SEQ ID NO: 79354 - RNA, 20 nt, Artificial Sequence
  MKO10079354_B_Crmp1
  gRNA
ccuuauacgccauguagacu

SEQ ID NO: 79355 - RNA, 20 nt, Artificial Sequence
  MKO10079355_B_Crmp1
  gRNA
gaccacguuguuccugaacc

SEQ ID NO: 79356 - RNA, 20 nt, Artificial Sequence
  MKO10079356_B_Crnkl1
  gRNA
uaccagaacugguugacgcg

SEQ ID NO: 79357 - RNA, 20 nt, Artificial Sequence
  MKO10079357_B_Crnkl1
  gRNA
cucggccguuaucugcacuu

SEQ ID NO: 79358 - RNA, 20 nt, Artificial Sequence
  MKO10079358_B_Crnkl1
  gRNA
acuaccgaaauauuacccuc

SEQ ID NO: 79359 - RNA, 20 nt, Artificial Sequence
  MKO10079359_B_Crnn
  gRNA
guaccagagugcaggcuacc

SEQ ID NO: 79360 - RNA, 20 nt, Artificial Sequence
  MKO10079360_B_Crnn
  gRNA
guguguagaaguuaccugcu

SEQ ID NO: 79361 - RNA, 20 nt, Artificial Sequence
  MKO10079361_B_Crnn
  gRNA
guggcugcaaaguacucacg

SEQ ID NO: 79362 - RNA, 20 nt, Artificial Sequence
  MKO10079362_B_Crocc
  gRNA
ucugagcgaggacauacgca

SEQ ID NO: 79363 - RNA, 20 nt, Artificial Sequence
  MKO10079363_B_Crocc
  gRNA
ugacuggacccgcagcugua

SEQ ID NO: 79364 - RNA, 20 nt, Artificial Sequence
  MKO10079364_B_Crocc
  gRNA
gggccagcagguccuccacg

SEQ ID NO: 79365 - RNA, 20 nt, Artificial Sequence
  MKO10079365_B_Crot
  gRNA
ugucuuugauguacuacaug

SEQ ID NO: 79366 - RNA, 20 nt, Artificial Sequence
  MKO10079366_B_Crot
  gRNA
aaauugccuguacauaaauc

SEQ ID NO: 79367 - RNA, 20 nt, Artificial Sequence
  MKO10079367_B_Crot
  gRNA
uguggcacaacuugaacuac

SEQ ID NO: 79368 - RNA, 20 nt, Artificial Sequence
  MKO10079368_B_Crp
  gRNA
ugaucaugaucagcuucucu

SEQ ID NO: 79369 - RNA, 20 nt, Artificial Sequence
  MKO10079369_B_Crp
  gRNA
ugcccgccaguucaaaacau

SEQ ID NO: 79370 - RNA, 20 nt, Artificial Sequence
  MKO10079370_B_Crp
  gRNA
uggugcugaaguacgauuca

SEQ ID NO: 79371 - RNA, 20 nt, Artificial Sequence
  MKO10079371_B_Cruac1
  gRNA
uguucaaauuccgaaauaac

SEQ ID NO: 79372 - RNA, 20 nt, Artificial Sequence
  MKO10079372_B_Cruac1
  gRNA
cacaucaccauaggcauagu

SEQ ID NO: 79373 - RNA, 20 nt, Artificial Sequence
  MKO10079373_B_Cruac1
  gRNA
ggacuucgagaucguugugg

SEQ ID NO: 79374 - RNA, 20 nt, Artificial Sequence
  MKO10079374_B_Cruam
  gRNA
agcccccgccacaaaucacc

SEQ ID NO: 79375 - RNA, 20 nt, Artificial Sequence
  MKO10079375_B_Cruam
  gRNA
caagugagagugaccguguu

SEQ ID NO: 79376 - RNA, 20 nt, Artificial Sequence
  MKO10079376_B_Cruam
  gRNA
caaaaaacgucucucuccag

SEQ ID NO: 79377 - RNA, 20 nt, Artificial Sequence
  MKO10079377_B_Cruap
  gRNA
ggcacucguagaaggccuug

SEQ ID NO: 79378 - RNA, 20 nt, Artificial Sequence
  MKO10079378_B_Cruap
  gRNA
ggaguguaagauucguugug

SEQ ID NO: 79379 - RNA, 20 nt, Artificial Sequence
  MKO10079379_B_Cruap
  gRNA
agcagguagcugacggcaca

SEQ ID NO: 79380 - RNA, 20 nt, Artificial Sequence
  MKO10079380_B_Cruc1
  gRNA
cccagccguggccaguacua

SEQ ID NO: 79381 - RNA, 20 nt, Artificial Sequence
  MKO10079381_B_Cruc1
  gRNA
gcagggacccaccguaguac

SEQ ID NO: 79382 - RNA, 20 nt, Artificial Sequence
  MKO10079382_B_Cruc1
  gRNA
guccuucacaggcggguccc

SEQ ID NO: 79383 - RNA, 20 nt, Artificial Sequence
  MKO10079383_B_Cruc2
  gRNA
acaggcccaaaaacugcgac

SEQ ID NO: 79384 - RNA, 20 nt, Artificial Sequence
  MKO10079384_B_Cruc2
  gRNA
gacugccgucugcacuuaac

SEQ ID NO: 79385 - RNA, 20 nt, Artificial Sequence
  MKO10079385_B_Cruc2
  gRNA
ucuauccuaggaugaugccc

SEQ ID NO: 79386 - RNA, 20 nt, Artificial Sequence
  MKO10079386_B_Cruc3
  gRNA
gcuuccacccccuucaccga

SEQ ID NO: 79387 - RNA, 20 nt, Artificial Sequence
  MKO10079387_B_Cruc3
  gRNA
gcagauguuagccugaaucc

SEQ ID NO: 79388 - RNA, 20 nt, Artificial Sequence
  MKO10079388_B_Cruc3
  gRNA
accguggccagcucucaucc

SEQ ID NO: 79389 - RNA, 20 nt, Artificial Sequence
  MKO10079389_B_Crxos
  gRNA
cucgugauggaagaaaucga

SEQ ID NO: 79390 - RNA, 20 nt, Artificial Sequence
  MKO10079390_B_Crxos
  gRNA
gacagaccguugcccuaaug

SEQ ID NO: 79391 - RNA, 20 nt, Artificial Sequence
  MKO10079391_B_Crxos
  gRNA
gccugcagcacagggcuuug

SEQ ID NO: 79392 - RNA, 20 nt, Artificial Sequence
  MKO10079392_B_Crx
  gRNA
caauguggaccugaugcacc

SEQ ID NO: 79393 - RNA, 20 nt, Artificial Sequence
  MKO10079393_B_Crx
  gRNA
caugauggcauauaugaacc

SEQ ID NO: 79394 - RNA, 20 nt, Artificial Sequence
  MKO10079394_B_Crx
  gRNA
guuugccaagacccaguacc

SEQ ID NO: 79395 - RNA, 20 nt, Artificial Sequence
  MKO10079395_B_Cry1
  gRNA
auucucgucuguuugugauu

SEQ ID NO: 79396 - RNA, 20 nt, Artificial Sequence
  MKO10079396_B_Cry1
  gRNA
accaucacaucagaugugau

SEQ ID NO: 79397 - RNA, 20 nt, Artificial Sequence
  MKO10079397_B_Cry1
  gRNA
agaugcagcuaucaagaagc

SEQ ID NO: 79398 - RNA, 20 nt, Artificial Sequence
  MKO10079398_B_Cry2
  gRNA
auucgcgucuguuuguaguc

SEQ ID NO: 79399 - RNA, 20 nt, Artificial Sequence
  MKO10079399_B_Cry2
  gRNA
cuuaccugucuaggucauag

SEQ ID NO: 79400 - RNA, 20 nt, Artificial Sequence
  MKO10079400_B_Cry2
  gRNA
uccguuccaagugcuugucc

SEQ ID NO: 79401 - RNA, 20 nt, Artificial Sequence
  MKO10079401_B_Cryaa
  gRNA
gcagcaggucguacucaaaa

SEQ ID NO: 79402 - RNA, 20 nt, Artificial Sequence
  MKO10079402_B_Cryaa
  gRNA
gguagcgacggugaaauuca

SEQ ID NO: 79403 - RNA, 20 nt, Artificial Sequence
  MKO10079403_B_Cryaa
  gRNA
gugaggccagcucaggacga

SEQ ID NO: 79404 - RNA, 20 nt, Artificial Sequence
  MKO10079404_B_Cryab
  gRNA
ugagaggauccacaucggcu

SEQ ID NO: 79405 - RNA, 20 nt, Artificial Sequence
  MKO10079405_B_Cryab
  gRNA
gaagaaggggcgccggaucc

SEQ ID NO: 79406 - RNA, 20 nt, Artificial Sequence
  MKO10079406_B_Cryab
  gRNA
guaccggaucccagccgaug

SEQ ID NO: 79407 - RNA, 20 nt, Artificial Sequence
  MKO10079407_B_Cryba1
  gRNA
cuacgaucaagagaacuucc

SEQ ID NO: 79408 - RNA, 20 nt, Artificial Sequence
  MKO10079408_B_Cryba1
  gRNA
cacacuccaccuuaagugac

SEQ ID NO: 79409 - RNA, 20 nt, Artificial Sequence
  MKO10079409_B_Cryba1
  gRNA
aaaguucucuuucucgaaga

SEQ ID NO: 79410 - RNA, 20 nt, Artificial Sequence
  MKO10079410_B_Cryba2
  gRNA
cgcccguuugccucacacuc

SEQ ID NO: 79411 - RNA, 20 nt, Artificial Sequence
  MKO10079411_B_Cryba2
  gRNA
cuaaugcuggacucuucgaa

SEQ ID NO: 79412 - RNA, 20 nt, Artificial Sequence
  MKO10079412_B_Cryba2
  gRNA
cagccgcgugacacuguuug

SEQ ID NO: 79413 - RNA, 20 nt, Artificial Sequence
  MKO10079413_B_Cryba4
  gRNA
cuuacgccccagauugaaca

SEQ ID NO: 79414 - RNA, 20 nt, Artificial Sequence
  MKO10079414_B_Cryba4
  gRNA
gacagacucacgcuccgcuc

SEQ ID NO: 79415 - RNA, 20 nt, Artificial Sequence
  MKO10079415_B_Cryba4
  gRNA
aagaaggcuuccagggccga

SEQ ID NO: 79416 - RNA, 20 nt, Artificial Sequence
  MKO10079416_B_Crybb1
  gRNA
agccuggcgacuuccggcac

SEQ ID NO: 79417 - RNA, 20 nt, Artificial Sequence
  MKO10079417_B_Crybb1
  gRNA
uuugagcaaucugccuuccg

SEQ ID NO: 79418 - RNA, 20 nt, Artificial Sequence
  MKO10079418_B_Crybb1
  gRNA
gcaccgggaagcagcccucu

SEQ ID NO: 79419 - RNA, 20 nt, Artificial Sequence
  MKO10079419_B_Crybb2
  gRNA
ugcgacgcacagacugcacc

SEQ ID NO: 79420 - RNA, 20 nt, Artificial Sequence
  MKO10079420_B_Crybb2
  gRNA
aaggggcuuaccacuuugau

SEQ ID NO: 79421 - RNA, 20 nt, Artificial Sequence
  MKO10079421_B_Crybb2
  gRNA
ccagaucaucaucuucgaac

SEQ ID NO: 79422 - RNA, 20 nt, Artificial Sequence
  MKO10079422_B_Crybb3
  gRNA
cuuacgucccguugaugaca

SEQ ID NO: 79423 - RNA, 20 nt, Artificial Sequence
  MKO10079423_B_Crybb3
  gRNA
ggcgccaguacguguucgag

SEQ ID NO: 79424 - RNA, 20 nt, Artificial Sequence
  MKO10079424_B_Crybb3
  gRNA
cucacgguccagacuccacu

SEQ ID NO: 79425 - RNA, 20 nt, Artificial Sequence
  MKO10079425_B_Crybg3
  gRNA
acauccgucacugugaaguc

SEQ ID NO: 79426 - RNA, 20 nt, Artificial Sequence
  MKO10079426_B_Crybg3
  gRNA
acaucccugaugcuacaaca

SEQ ID NO: 79427 - RNA, 20 nt, Artificial Sequence
  MKO10079427_B_Crybg3
  gRNA
gggcacugauaaaaguugua

SEQ ID NO: 79428 - RNA, 20 nt, Artificial Sequence
  MKO10079428_B_Cryga
  gRNA
uacucacguauggaauggaa

SEQ ID NO: 79429 - RNA, 20 nt, Artificial Sequence
  MKO10079429_B_Cryga
  gRNA
gcagcccuccagcacgugca

SEQ ID NO: 79430 - RNA, 20 nt, Artificial Sequence
  MKO10079430_B_Cryga
  gRNA
ccgucucagagagccgaccu

SEQ ID NO: 79431 - RNA, 20 nt, Artificial Sequence
  MKO10079431_B_Crygb
  gRNA
cuuacagaucaccuucuucg

SEQ ID NO: 79432 - RNA, 20 nt, Artificial Sequence
  MKO10079432_B_Crygb
  gRNA
acggcaguaccugcuaaggc

SEQ ID NO: 79433 - RNA, 20 nt, Artificial Sequence
  MKO10079433_B_Crygb
  gRNA
agauaucuccuguacucccc

SEQ ID NO: 79434 - RNA, 20 nt, Artificial Sequence
  MKO10079434_B_Crygc
  gRNA
caggacucacaugggggaug

SEQ ID NO: 79435 - RNA, 20 nt, Artificial Sequence
  MKO10079435_B_Crygc
  gRNA
gcagcgagcgcaccucacug

SEQ ID NO: 79436 - RNA, 20 nt, Artificial Sequence
  MKO10079436_B_Crygc
  gRNA
ucucauacagccgcauucug

SEQ ID NO: 79437 - RNA, 20 nt, Artificial Sequence
  MKO10079437_B_Crygd
  gRNA
cuaugagcagcccaacuuca

SEQ ID NO: 79438 - RNA, 20 nt, Artificial Sequence
  MKO10079438_B_Crygd
  gRNA
cuacucccucaaugugcuag

SEQ ID NO: 79439 - RNA, 20 nt, Artificial Sequence
  MKO10079439_B_Crygd
  gRNA
ccugccaggccggcucucac

SEQ ID NO: 79440 - RNA, 20 nt, Artificial Sequence
  MKO10079440_B_Cryge
  gRNA
cuuacagaucaccuucuaug

SEQ ID NO: 79441 - RNA, 20 nt, Artificial Sequence
  MKO10079441_B_Cryge
  gRNA
uguacuccccaggccugagc

SEQ ID NO: 79442 - RNA, 20 nt, Artificial Sequence
  MKO10079442_B_Cryge
  gRNA
cggcaguaccugcucaggcc

SEQ ID NO: 79443 - RNA, 20 nt, Artificial Sequence
  MKO10079443_B_Crygf
  gRNA
agaaacucacgugggggaug

SEQ ID NO: 79444 - RNA, 20 nt, Artificial Sequence
  MKO10079444_B_Crygf
  gRNA
cgucugugaucuccaccauc

SEQ ID NO: 79445 - RNA, 20 nt, Artificial Sequence
  MKO10079445_B_Crygf
  gRNA
gauccugauccugugagaag

SEQ ID NO: 79446 - RNA, 20 nt, Artificial Sequence
  MKO10079446_B_Crygn
  gRNA
cuuucccgagcguugcgcca

SEQ ID NO: 79447 - RNA, 20 nt, Artificial Sequence
  MKO10079447_B_Crygn
  gRNA
auacaccauggcgcaacgcu

SEQ ID NO: 79448 - RNA, 20 nt, Artificial Sequence
  MKO10079448_B_Crygn
  gRNA
ggcaguccuccacgaacucu

SEQ ID NO: 79449 - RNA, 20 nt, Artificial Sequence
  MKO10079449_B_Crygs
  gRNA
aguacccugaauaccagcgu

SEQ ID NO: 79450 - RNA, 20 nt, Artificial Sequence
  MKO10079450_B_Crygs
  gRNA
gcacauacaaugucuaaaac

SEQ ID NO: 79451 - RNA, 20 nt, Artificial Sequence
  MKO10079451_B_Crygs
  gRNA
cggucagauguacgaaacca

SEQ ID NO: 79452 - RNA, 20 nt, Artificial Sequence
  MKO10079452_B_Cryl1
  gRNA
cagcugccgcucugcgcuca

SEQ ID NO: 79453 - RNA, 20 nt, Artificial Sequence
  MKO10079453_B_Cryl1
  gRNA
cacagcgcccucuacugcuu

SEQ ID NO: 79454 - RNA, 20 nt, Artificial Sequence
  MKO10079454_B_Cryl1
  gRNA
acagcagauaacagacgccc

SEQ ID NO: 79455 - RNA, 20 nt, Artificial Sequence
  MKO10079455_B_Crym
  gRNA
aagccgggggcucacaucaa

SEQ ID NO: 79456 - RNA, 20 nt, Artificial Sequence
  MKO10079456_B_Crym
  gRNA
aggggaccgcuguguugcug

SEQ ID NO: 79457 - RNA, 20 nt, Artificial Sequence
  MKO10079457_B_Crym
  gRNA
ucgggucuguucaucagugc

SEQ ID NO: 79458 - RNA, 20 nt, Artificial Sequence
  MKO10079458_B_Cryzl1
  gRNA
ccagaaacuucucuuccaac

SEQ ID NO: 79459 - RNA, 20 nt, Artificial Sequence
  MKO10079459_B_Cryzl1
  gRNA
cccguaccuuuguguuuaug

SEQ ID NO: 79460 - RNA, 20 nt, Artificial Sequence
  MKO10079460_B_Cryzl1
  gRNA
ccuguuggaagagaaguuuc

SEQ ID NO: 79461 - RNA, 20 nt, Artificial Sequence
  MKO10079461_B_Cryz
  gRNA
caggggguagauagugucau

SEQ ID NO: 79462 - RNA, 20 nt, Artificial Sequence
  MKO10079462_B_Cryz
  gRNA
cuaaucaaaguccacgccug

SEQ ID NO: 79463 - RNA, 20 nt, Artificial Sequence
  MKO10079463_B_Cryz
  gRNA
ugcagugcccgugcucgagc

SEQ ID NO: 79464 - RNA, 20 nt, Artificial Sequence
  MKO10079464_B_Csad
  gRNA
agcagauccuggagcgcugc

SEQ ID NO: 79465 - RNA, 20 nt, Artificial Sequence
  MKO10079465_B_Csad
  gRNA
caacauguacgccaugaacc

SEQ ID NO: 79466 - RNA, 20 nt, Artificial Sequence
  MKO10079466_B_Csad
  gRNA
cugaaagcgggccagguuca

SEQ ID NO: 79467 - RNA, 20 nt, Artificial Sequence
  MKO10079467_B_Csdc2
  gRNA
cuuacagacgcccuugaaca

SEQ ID NO: 79468 - RNA, 20 nt, Artificial Sequence
  MKO10079468_B_Csdc2
  gRNA
ucucaggcgugaugaagccg

SEQ ID NO: 79469 - RNA, 20 nt, Artificial Sequence
  MKO10079469_B_Csdc2
  gRNA
ggggaugggacaaaucuugu

SEQ ID NO: 79470 - RNA, 20 nt, Artificial Sequence
  MKO10079470_B_Csde1
  gRNA
uguccguucauucguucuuc

SEQ ID NO: 79471 - RNA, 20 nt, Artificial Sequence
  MKO10079471_B_Csde1
  gRNA
aauuugaaguaucaucugac

SEQ ID NO: 79472 - RNA, 20 nt, Artificial Sequence
  MKO10079472_B_Csde1
  gRNA
auucccuuccacaucuucag

SEQ ID NO: 79473 - RNA, 20 nt, Artificial Sequence
  MKO10079473_B_Cse1l
  gRNA
accuugaauagauuagucaa

SEQ ID NO: 79474 - RNA, 20 nt, Artificial Sequence
  MKO10079474_B_Cse1l
  gRNA
cagcaucagaugcacuaugu

SEQ ID NO: 79475 - RNA, 20 nt, Artificial Sequence
  MKO10079475_B_Cse1l
  gRNA
gccuuugacuaaucuauuca

SEQ ID NO: 79476 - RNA, 20 nt, Artificial Sequence
  MKO10079476_B_Csf1r
  gRNA
uucaacguuauccucaaacg

SEQ ID NO: 79477 - RNA, 20 nt, Artificial Sequence
  MKO10079477_B_Csf1r
  gRNA
gcuguggacuuccaagacgc

SEQ ID NO: 79478 - RNA, 20 nt, Artificial Sequence
  MKO10079478_B_Csf1r
  gRNA
uuugaaggucgcguuucuug

SEQ ID NO: 79479 - RNA, 20 nt, Artificial Sequence
  MKO10079479_B_Csf1
  gRNA
gaguuccuggagccucucgg

SEQ ID NO: 79480 - RNA, 20 nt, Artificial Sequence
  MKO10079480_B_Csf1
  gRNA
gguguccauucccaaucaug

SEQ ID NO: 79481 - RNA, 20 nt, Artificial Sequence
  MKO10079481_B_Csf1
  gRNA
gaacacuguagccacaugau

SEQ ID NO: 79482 - RNA, 20 nt, Artificial Sequence
  MKO10079482_B_Csf2ra
  gRNA
ugcgaacgacuugucacugc

SEQ ID NO: 79483 - RNA, 20 nt, Artificial Sequence
  MKO10079483_B_Csf2ra
  gRNA
ucguagccaccacgucgucc

SEQ ID NO: 79484 - RNA, 20 nt, Artificial Sequence
  MKO10079484_B_Csf2ra
  gRNA
ccccgccucccgcgagguca

SEQ ID NO: 79485 - RNA, 20 nt, Artificial Sequence
  MKO10079485_B_Csf2rb2
  gRNA
ccaaccguaucaucugcagc

SEQ ID NO: 79486 - RNA, 20 nt, Artificial Sequence
  MKO10079486_B_Csf2rb2
  gRNA
gagauacacuccauuccagc

SEQ ID NO: 79487 - RNA, 20 nt, Artificial Sequence
  MKO10079487_B_Csf2rb2
  gRNA
acauccacaucagccccucu

SEQ ID NO: 79488 - RNA, 20 nt, Artificial Sequence
  MKO10079488_B_Csf2rb
  gRNA
ggagcugaugcugacguucu

SEQ ID NO: 79489 - RNA, 20 nt, Artificial Sequence
  MKO10079489_B_Csf2rb
  gRNA
cucccagacaagcuugaacc

SEQ ID NO: 79490 - RNA, 20 nt, Artificial Sequence
  MKO10079490_B_Csf2rb
  gRNA
ccgcccagcugcagaugaug

SEQ ID NO: 79491 - RNA, 20 nt, Artificial Sequence
  MKO10079491_B_Csf2
  gRNA
cccucacucaccaacgugac

SEQ ID NO: 79492 - RNA, 20 nt, Artificial Sequence
  MKO10079492_B_Csf2
  gRNA
aacacaaguuaccaccuaug

SEQ ID NO: 79493 - RNA, 20 nt, Artificial Sequence
  MKO10079493_B_Csf2
  gRNA
ggcuguagaccacaaugccc

SEQ ID NO: 79494 - RNA, 20 nt, Artificial Sequence
  MKO10079494_B_Csf3r
  gRNA
cgcuaccagccacagcucaa

SEQ ID NO: 79495 - RNA, 20 nt, Artificial Sequence
  MKO10079495_B_Csf3r
  gRNA
cgugaagcucagcuugaucc

SEQ ID NO: 79496 - RNA, 20 nt, Artificial Sequence
  MKO10079496_B_Csf3r
  gRNA
gcuucauccuaaagagcuuc

SEQ ID NO: 79497 - RNA, 20 nt, Artificial Sequence
  MKO10079497_B_Csf3
  gRNA
ugcacuauggucaggacgag

SEQ ID NO: 79498 - RNA, 20 nt, Artificial Sequence
  MKO10079498_B_Csf3
  gRNA
aaauacccgauagagccugc

SEQ ID NO: 79499 - RNA, 20 nt, Artificial Sequence
  MKO10079499_B_Csf3
  gRNA
gcagagcgcugacagugacc

SEQ ID NO: 79500 - RNA, 20 nt, Artificial Sequence
  MKO10079500_B_Csgalnacu1
  gRNA
gucgaaauaggacaagucgc

SEQ ID NO: 79501 - RNA, 20 nt, Artificial Sequence
  MKO10079501_B_Csgalnacu1
  gRNA
uguuggagcccgcuucugga

SEQ ID NO: 79502 - RNA, 20 nt, Artificial Sequence
  MKO10079502_B_Csgalnacu1
  gRNA
auucucccggggaaagggac

SEQ ID NO: 79503 - RNA, 20 nt, Artificial Sequence
  MKO10079503_B_Csgalnacu2
  gRNA
uaauaucauugugccacuug

SEQ ID NO: 79504 - RNA, 20 nt, Artificial Sequence
  MKO10079504_B_Csgalnacu2
  gRNA
guccugguuggcauagacaa

SEQ ID NO: 79505 - RNA, 20 nt, Artificial Sequence
  MKO10079505_B_Csgalnacu2
  gRNA
ugccauugucuaugccaacc

SEQ ID NO: 79506 - RNA, 20 nt, Artificial Sequence
  MKO10079506_B_Csk
  gRNA
caacuauguccagaagcgug

SEQ ID NO: 79507 - RNA, 20 nt, Artificial Sequence
  MKO10079507_B_Csk
  gRNA
cacucgccucaucaaaccaa

SEQ ID NO: 79508 - RNA, 20 nt, Artificial Sequence
  MKO10079508_B_Csk
  gRNA
uaccuuggugacagccacga

SEQ ID NO: 79509 - RNA, 20 nt, Artificial Sequence
  MKO10079509_B_Csl
  gRNA
cagcacgucuuucaaguucg

SEQ ID NO: 79510 - RNA, 20 nt, Artificial Sequence
  MKO10079510_B_Csl
  gRNA
ccaguccagcuuagagucaa

SEQ ID NO: 79511 - RNA, 20 nt, Artificial Sequence
  MKO10079511_B_Csl
  gRNA
ucauucccugcgcauaugcc

SEQ ID NO: 79512 - RNA, 20 nt, Artificial Sequence
  MKO10079512_B_Csmd1
  gRNA
acaauaaugccgacugcacg

SEQ ID NO: 79513 - RNA, 20 nt, Artificial Sequence
  MKO10079513_B_Csmd1
  gRNA
uccccuuaggguucccccgc

SEQ ID NO: 79514 - RNA, 20 nt, Artificial Sequence
  MKO10079514_B_Csmd1
  gRNA
gcauaguugggguacccaug

SEQ ID NO: 79515 - RNA, 20 nt, Artificial Sequence
  MKO10079515_B_Csmd2os
  gRNA
aagcugagaacgggcugacc

SEQ ID NO: 79516 - RNA, 20 nt, Artificial Sequence
  MKO10079516_B_Csmd2os
  gRNA
ugcauuucuagcagugucca

SEQ ID NO: 79517 - RNA, 20 nt, Artificial Sequence
  MKO10079517_B_Csmd2os
  gRNA
acaagaccacgcuccugcag

SEQ ID NO: 79518 - RNA, 20 nt, Artificial Sequence
  MKO10079518_B_Csmd2
  gRNA
cccacagcggaugacgccug

SEQ ID NO: 79519 - RNA, 20 nt, Artificial Sequence
  MKO10079519_B_Csmd2
  gRNA
gcuccgagaacagugccacg

SEQ ID NO: 79520 - RNA, 20 nt, Artificial Sequence
  MKO10079520_B_Csmd2
  gRNA
guucuuccgagucacacuug

SEQ ID NO: 79521 - RNA, 20 nt, Artificial Sequence
  MKO10079521_B_Csmd3
  gRNA
uucauuaggaaaacccgggc

SEQ ID NO: 79522 - RNA, 20 nt, Artificial Sequence
  MKO10079522_B_Csmd3
  gRNA
auccaguuacacagcuguag

SEQ ID NO: 79523 - RNA, 20 nt, Artificial Sequence
  MKO10079523_B_Csmd3
  gRNA
uccacuuaccauauuguagg

SEQ ID NO: 79524 - RNA, 20 nt, Artificial Sequence
  MKO10079524_B_Csn1s1
  gRNA
gcaacagcauagcagcagug

SEQ ID NO: 79525 - RNA, 20 nt, Artificial Sequence
  MKO10079525_B_Csn1s2a
  gRNA
ucaucugccagcaucuaccc

SEQ ID NO: 79526 - RNA, 20 nt, Artificial Sequence
  MKO10079526_B_Csn1s2a
  gRNA
acuuacuccuggguagaugc

SEQ ID NO: 79527 - RNA, 20 nt, Artificial Sequence
  MKO10079527_B_Csn1s2b
  gRNA
guagaacuuuaagcagaaua

SEQ ID NO: 79528 - RNA, 20 nt, Artificial Sequence
  MKO10079528_B_Csn1s2b
  gRNA
gaacauuuacauuccccaaa

SEQ ID NO: 79529 - RNA, 20 nt, Artificial Sequence
  MKO10079529_B_Csn2
  gRNA
uacauuuacuguauccucug

SEQ ID NO: 79530 - RNA, 20 nt, Artificial Sequence
  MKO10079530_B_Csn2
  gRNA
gaaucucaugggacagcugc

SEQ ID NO: 79531 - RNA, 20 nt, Artificial Sequence
  MKO10079531_B_Csn3
  gRNA
uaucguaguugugaauauuc

SEQ ID NO: 79532 - RNA, 20 nt, Artificial Sequence
  MKO10079532_B_Csn3
  gRNA
auguaugggcuagcaguagc

SEQ ID NO: 79533 - RNA, 20 nt, Artificial Sequence
  MKO10079533_B_Csn3
  gRNA
ggccuguagugguaguaauu

SEQ ID NO: 79534 - RNA, 20 nt, Artificial Sequence
  MKO10079534_B_Csnk1a1
  gRNA
uauugggcgucacuguaaua

SEQ ID NO: 79535 - RNA, 20 nt, Artificial Sequence
  MKO10079535_B_Csnk1a1
  gRNA
cuggucagcuaacauaagua

SEQ ID NO: 79536 - RNA, 20 nt, Artificial Sequence
  MKO10079536_B_Csnk1a1
  gRNA
agugacgcccaauacccauu

SEQ ID NO: 79537 - RNA, 20 nt, Artificial Sequence
  MKO10079537_B_Csnk1d
  gRNA
gcgugcaucccgauacuucu

SEQ ID NO: 79538 - RNA, 20 nt, Artificial Sequence
  MKO10079538_B_Csnk1d
  gRNA
guaagguacggacauugcug

SEQ ID NO: 79539 - RNA, 20 nt, Artificial Sequence
  MKO10079539_B_Csnk1d
  gRNA
ugggcaucccuaccaucaga

SEQ ID NO: 79540 - RNA, 20 nt, Artificial Sequence
  MKO10079540_B_Csnk1e
  gRNA
uggggaucccguccaucaag

SEQ ID NO: 79541 - RNA, 20 nt, Artificial Sequence
  MKO10079541_B_Csnk1e
  gRNA
gcuggugugugcgggcaucg

SEQ ID NO: 79542 - RNA, 20 nt, Artificial Sequence
  MKO10079542_B_Csnk1e
  gRNA
aguugucgggcuucacaucc

SEQ ID NO: 79543 - RNA, 20 nt, Artificial Sequence
  MKO10079543_B_Csnk1g1
  gRNA
agagagcacaaaaguuugac

SEQ ID NO: 79544 - RNA, 20 nt, Artificial Sequence
  MKO10079544_B_Csnk1g1
  gRNA
cuguacucuaaaugaaguug

SEQ ID NO: 79545 - RNA, 20 nt, Artificial Sequence
  MKO10079545_B_Csnk1g1
  gRNA
ugaauauguagccauuaaac

SEQ ID NO: 79546 - RNA, 20 nt, Artificial Sequence
  MKO10079546_B_Csnk1g2
  gRNA
uugggcggccgggcagcaag

SEQ ID NO: 79547 - RNA, 20 nt, Artificial Sequence
  MKO10079547_B_Csnk1g2
  gRNA
cgcaggagcccaucaagucc

SEQ ID NO: 79548 - RNA, 20 nt, Artificial Sequence
  MKO10079548_B_Csnk1g2
  gRNA
uacaagcagcucagcacgac

SEQ ID NO: 79549 - RNA, 20 nt, Artificial Sequence
  MKO10079549_B_Csnk1g3
  gRNA
uacagauucuauaagcaguu

SEQ ID NO: 79550 - RNA, 20 nt, Artificial Sequence
  MKO10079550_B_Csnk1g3
  gRNA
cagagcaccacagcugcauu

SEQ ID NO: 79551 - RNA, 20 nt, Artificial Sequence
  MKO10079551_B_Csnk1g3
  gRNA
uuuauacacaaaugaauaug

SEQ ID NO: 79552 - RNA, 20 nt, Artificial Sequence
  MKO10079552_B_Csnk2a1
  gRNA
uguaaacaacacagacuuca

SEQ ID NO: 79553 - RNA, 20 nt, Artificial Sequence
  MKO10079553_B_Csnk2a1
  gRNA
uaucagcuuguucgaaaauu

SEQ ID NO: 79554 - RNA, 20 nt, Artificial Sequence
  MKO10079554_B_Csnk2a1
  gRNA
gucugcaagugugaugaugu

SEQ ID NO: 79555 - RNA, 20 nt, Artificial Sequence
  MKO10079555_B_Csnk2a2
  gRNA
uaaucaagaugauuaccaac

SEQ ID NO: 79556 - RNA, 20 nt, Artificial Sequence
  MKO10079556_B_Csnk2a2
  gRNA
uacaaccacccucucauugu

SEQ ID NO: 79557 - RNA, 20 nt, Artificial Sequence
  MKO10079557_B_Csnk2a2
  gRNA
ucagucaaagacaccagcuu

SEQ ID NO: 79558 - RNA, 20 nt, Artificial Sequence
  MKO10079558_B_Csnk2b
  gRNA
gccucacuaucgacaagcuc

SEQ ID NO: 79559 - RNA, 20 nt, Artificial Sequence
  MKO10079559_B_Csnk2b
  gRNA
ccuguucgaucaagucgcuc

SEQ ID NO: 79560 - RNA, 20 nt, Artificial Sequence
  MKO10079560_B_Csnk2b
  gRNA
uccagagcuugucgauagug

SEQ ID NO: 79561 - RNA, 20 nt, Artificial Sequence
  MKO10079561_B_Csnka2ip
  gRNA
aagagccccagucuauugac

SEQ ID NO: 79562 - RNA, 20 nt, Artificial Sequence
  MKO10079562_B_Csnka2ip
  gRNA
uucgaguugugagaccucac

SEQ ID NO: 79563 - RNA, 20 nt, Artificial Sequence
  MKO10079563_B_Csnka2ip
  gRNA
accggagugggaucuaccca

SEQ ID NO: 79564 - RNA, 20 nt, Artificial Sequence
  MKO10079564_B_Cspg4
  gRNA
aucaccagguagccggcguu

SEQ ID NO: 79565 - RNA, 20 nt, Artificial Sequence
  MKO10079565_B_Cspg4
  gRNA
gcuccucugcugaagcgccg

SEQ ID NO: 79566 - RNA, 20 nt, Artificial Sequence
  MKO10079566_B_Cspg4
  gRNA
cacuuccaucaugcacguag

SEQ ID NO: 79567 - RNA, 20 nt, Artificial Sequence
  MKO10079567_B_Cspg5
  gRNA
uccuuguagguguaacaccc

SEQ ID NO: 79568 - RNA, 20 nt, Artificial Sequence
  MKO10079568_B_Cspg5
  gRNA
aguucacccccaagucaucc

SEQ ID NO: 79569 - RNA, 20 nt, Artificial Sequence
  MKO10079569_B_Cspg5
  gRNA
cagcgcuccccacaaaaucc

SEQ ID NO: 79570 - RNA, 20 nt, Artificial Sequence
  MKO10079570_B_Cspp1
  gRNA
uguucauaaucuucuccaag

SEQ ID NO: 79571 - RNA, 20 nt, Artificial Sequence
  MKO10079571_B_Cspp1
  gRNA
ugaaacagacccaucuacuc

SEQ ID NO: 79572 - RNA, 20 nt, Artificial Sequence
  MKO10079572_B_Cspp1
  gRNA
gagaauacaaucaguuucuc

SEQ ID NO: 79573 - RNA, 20 nt, Artificial Sequence
  MKO10079573_B_Csprs
  gRNA
gaccacugcucagcugucag

SEQ ID NO: 79574 - RNA, 20 nt, Artificial Sequence
  MKO10079574_B_Csprs
  gRNA
acagucauacucaagaaugu

SEQ ID NO: 79575 - RNA, 20 nt, Artificial Sequence
  MKO10079575_B_Csprs
  gRNA
aagaaugacagauaaaagaa

SEQ ID NO: 79576 - RNA, 20 nt, Artificial Sequence
  MKO10079576_B_Csrnp1
  gRNA
uucgaacgccggaagcccga

SEQ ID NO: 79577 - RNA, 20 nt, Artificial Sequence
  MKO10079577_B_Csrnp1
  gRNA
auugaauuccacucgaccau

SEQ ID NO: 79578 - RNA, 20 nt, Artificial Sequence
  MKO10079578_B_Csrnp1
  gRNA
gcucccgaggagcccgcuuc

SEQ ID NO: 79579 - RNA, 20 nt, Artificial Sequence
  MKO10079579_B_Csrnp2
  gRNA
gcuguccgcacuaucacugc

SEQ ID NO: 79580 - RNA, 20 nt, Artificial Sequence
  MKO10079580_B_Csrnp2
  gRNA
agaaugggggccgcgaggcc

SEQ ID NO: 79581 - RNA, 20 nt, Artificial Sequence
  MKO10079581_B_Csrnp2
  gRNA
aagccaauggaugcguucuc

SEQ ID NO: 79582 - RNA, 20 nt, Artificial Sequence
  MKO10079582_B_Csrnp3
  gRNA
aaucucgaaauugucugcga

SEQ ID NO: 79583 - RNA, 20 nt, Artificial Sequence
  MKO10079583_B_Csrnp3
  gRNA
uuccgaugacgauauugauc

SEQ ID NO: 79584 - RNA, 20 nt, Artificial Sequence
  MKO10079584_B_Csrnp3
  gRNA
cucacgggugaagugauuug

SEQ ID NO: 79585 - RNA, 20 nt, Artificial Sequence
  MKO10079585_B_Csrp1
  gRNA
ucggaagcaggacuuaugcc

SEQ ID NO: 79586 - RNA, 20 nt, Artificial Sequence
  MKO10079586_B_Csrp1
  gRNA
gcgcuguccccgcuguagcc

SEQ ID NO: 79587 - RNA, 20 nt, Artificial Sequence
  MKO10079587_B_Csrp1
  gRNA
aucuauugcaagucauguua

SEQ ID NO: 79588 - RNA, 20 nt, Artificial Sequence
  MKO10079588_B_Csrp2bp
  gRNA
agcccuguuuauuuccgguc

SEQ ID NO: 79589 - RNA, 20 nt, Artificial Sequence
  MKO10079589_B_Csrp2bp
  gRNA
ugaaaaaguuaucgcccuuc

SEQ ID NO: 79590 - RNA, 20 nt, Artificial Sequence
  MKO10079590_B_Csrp2bp
  gRNA
guggacgucaagguuauuuc

SEQ ID NO: 79591 - RNA, 20 nt, Artificial Sequence
  MKO10079591_B_Csrp2
  gRNA
uaugcugcggagaagaucau

SEQ ID NO: 79592 - RNA, 20 nt, Artificial Sequence
  MKO10079592_B_Csrp2
  gRNA
uugaccauagccaaaucccu

SEQ ID NO: 79593 - RNA, 20 nt, Artificial Sequence
  MKO10079593_B_Csrp2
  gRNA
aagggauuuggcuaugguca

SEQ ID NO: 79594 - RNA, 20 nt, Artificial Sequence
  MKO10079594_B_Csrp3
  gRNA
gucgguauacgcugcugaga

SEQ ID NO: 79595 - RNA, 20 nt, Artificial Sequence
  MKO10079595_B_Csrp3
  gRNA
cagugacauuuguagacucc

SEQ ID NO: 79596 - RNA, 20 nt, Artificial Sequence
  MKO10079596_B_Csrp3
  gRNA
gucuacaaaugucacugaca

SEQ ID NO: 79597 - RNA, 20 nt, Artificial Sequence
  MKO10079597_B_Cst10
  gRNA
gagccccucgaugccugugu

SEQ ID NO: 79598 - RNA, 20 nt, Artificial Sequence
  MKO10079598_B_Cst10
  gRNA
uacuacuugaaaauugagcu

SEQ ID NO: 79599 - RNA, 20 nt, Artificial Sequence
  MKO10079599_B_Cst10
  gRNA
uaccaaaacugagucuaauu

SEQ ID NO: 79600 - RNA, 20 nt, Artificial Sequence
  MKO10079600_B_Cst11
  gRNA
cguacacugagaaguagcac

SEQ ID NO: 79601 - RNA, 20 nt, Artificial Sequence
  MKO10079601_B_Cst11
  gRNA
gcucgucucugucuucaagc

SEQ ID NO: 79602 - RNA, 20 nt, Artificial Sequence
  MKO10079602_B_Cst11
  gRNA
ucucaguguacgccauuccc

SEQ ID NO: 79603 - RNA, 20 nt, Artificial Sequence
  MKO10079603_B_Cst12
  gRNA
uguaggcaaaaucgucaucc

SEQ ID NO: 79604 - RNA, 20 nt, Artificial Sequence
  MKO10079604_B_Cst12
  gRNA
gguacgcugcacuuacauug

SEQ ID NO: 79605 - RNA, 20 nt, Artificial Sequence
  MKO10079605_B_Cst12
  gRNA
ccccacuuaagucugcacac

SEQ ID NO: 79606 - RNA, 20 nt, Artificial Sequence
  MKO10079606_B_Cst13
  gRNA
acaaugugcaagaagauugc

SEQ ID NO: 79607 - RNA, 20 nt, Artificial Sequence
  MKO10079607_B_Cst13
  gRNA
uuauuguuagcuccaaacca

SEQ ID NO: 79608 - RNA, 20 nt, Artificial Sequence
  MKO10079608_B_Cst13
  gRNA
gguggauauccuaaaaucuc

SEQ ID NO: 79609 - RNA, 20 nt, Artificial Sequence
  MKO10079609_B_Cst3
  gRNA
gacagucagucaaauuuguc

SEQ ID NO: 79610 - RNA, 20 nt, Artificial Sequence
  MKO10079610_B_Cst3
  gRNA
uccagggcacgcuguagauc

SEQ ID NO: 79611 - RNA, 20 nt, Artificial Sequence
  MKO10079611_B_Cst3
  gRNA
aaguaccuacccucaucaga

SEQ ID NO: 79612 - RNA, 20 nt, Artificial Sequence
  MKO10079612_B_Cst6
  gRNA
ugccgaaagaccagagucuc

SEQ ID NO: 79613 - RNA, 20 nt, Artificial Sequence
  MKO10079613_B_Cst6
  gRNA
uugagcuccuugaagucccc

SEQ ID NO: 79614 - RNA, 20 nt, Artificial Sequence
  MKO10079614_B_Cst6
  gRNA
aagcugaguaguguucuucc

SEQ ID NO: 79615 - RNA, 20 nt, Artificial Sequence
  MKO10079615_B_Cst7
  gRNA
uauauugcuacucugaaguc

SEQ ID NO: 79616 - RNA, 20 nt, Artificial Sequence
  MKO10079616_B_Cst7
  gRNA
acaauagagaccaauaaccc

SEQ ID NO: 79617 - RNA, 20 nt, Artificial Sequence
  MKO10079617_B_Cst7
  gRNA
cugcuuacccgcuucaaggc

SEQ ID NO: 79618 - RNA, 20 nt, Artificial Sequence
  MKO10079618_B_Cst8
  gRNA
gaaaaugaguugcagcuuuc

SEQ ID NO: 79619 - RNA, 20 nt, Artificial Sequence
  MKO10079619_B_Cst8
  gRNA
gggagaucugaacaucaauu

SEQ ID NO: 79620 - RNA, 20 nt, Artificial Sequence
  MKO10079620_B_Cst8
  gRNA
cuuuacauucuuugcucaac

SEQ ID NO: 79621 - RNA, 20 nt, Artificial Sequence
  MKO10079621_B_Cst9
  gRNA
ugccgugaacacauucaacc

SEQ ID NO: 79622 - RNA, 20 nt, Artificial Sequence
  MKO10079622_B_Cst9
  gRNA
gccuuacauuauucagacca

SEQ ID NO: 79623 - RNA, 20 nt, Artificial Sequence
  MKO10079623_B_Cst9
  gRNA
uaacaaaauucaagcucuuc

SEQ ID NO: 79624 - RNA, 20 nt, Artificial Sequence
  MKO10079624_B_Csuad
  gRNA
cugccuggggaauucuguac

SEQ ID NO: 79625 - RNA, 20 nt, Artificial Sequence
  MKO10079625_B_Csuad
  gRNA
ggagcucagcugagccauaa

SEQ ID NO: 79626 - RNA, 20 nt, Artificial Sequence
  MKO10079626_B_Csuad
  gRNA
cuuccaguacagaauucccc

SEQ ID NO: 79627 - RNA, 20 nt, Artificial Sequence
  MKO10079627_B_Csua
  gRNA
ucuuucuggaaagaauaauu

SEQ ID NO: 79628 - RNA, 20 nt, Artificial Sequence
  MKO10079628_B_Csua
  gRNA
augucuuucagauggaugua

SEQ ID NO: 79629 - RNA, 20 nt, Artificial Sequence
  MKO10079629_B_Csua
  gRNA
gaauauuucauauuucucau

SEQ ID NO: 79630 - RNA, 20 nt, Artificial Sequence
  MKO10079630_B_Cstb
  gRNA
uuccuccagguugauguugg

SEQ ID NO: 79631 - RNA, 20 nt, Artificial Sequence
  MKO10079631_B_Cstb
  gRNA
uggcaccaaccucuucauca

SEQ ID NO: 79632 - RNA, 20 nt, Artificial Sequence
  MKO10079632_B_Cstb
  gRNA
auccuucaagagacagauag

SEQ ID NO: 79633 - RNA, 20 nt, Artificial Sequence
  MKO10079633_B_Cstf1
  gRNA
aaccgugucagagcgaccaa

SEQ ID NO: 79634 - RNA, 20 nt, Artificial Sequence
  MKO10079634_B_Cstf1
  gRNA
ucguaaagaguucggaucac

SEQ ID NO: 79635 - RNA, 20 nt, Artificial Sequence
  MKO10079635_B_Cstf1
  gRNA
ccacgcggcacgggccuuug

SEQ ID NO: 79636 - RNA, 20 nt, Artificial Sequence
  MKO10079636_B_Cstf2t
  gRNA
ccuagaccuccgaugccucg

SEQ ID NO: 79637 - RNA, 20 nt, Artificial Sequence
  MKO10079637_B_Cstf2t
  gRNA
uccgaugacugguggaaucc

SEQ ID NO: 79638 - RNA, 20 nt, Artificial Sequence
  MKO10079638_B_Cstf2t
  gRNA
ucucucuaucguagacgaga

SEQ ID NO: 79639 - RNA, 20 nt, Artificial Sequence
  MKO10079639_B_Cstf2
  gRNA
acgcccauucaaguuccgca

SEQ ID NO: 79640 - RNA, 20 nt, Artificial Sequence
  MKO10079640_B_Cstf2
  gRNA
ccugucauagagucaccuua

SEQ ID NO: 79641 - RNA, 20 nt, Artificial Sequence
  MKO10079641_B_Cstf2
  gRNA
gggcugaugcuuucuccaua

SEQ ID NO: 79642 - RNA, 20 nt, Artificial Sequence
  MKO10079642_B_Cstf3
  gRNA
ugagaaugcuccaagcauca

SEQ ID NO: 79643 - RNA, 20 nt, Artificial Sequence
  MKO10079643_B_Cstf3
  gRNA
cauucucauucgagaggcac

SEQ ID NO: 79644 - RNA, 20 nt, Artificial Sequence
  MKO10079644_B_Cstf3
  gRNA
gucuuccgugcuuugucuau

SEQ ID NO: 79645 - RNA, 20 nt, Artificial Sequence
  MKO10079645_B_Cstl1
  gRNA
cacugauauacucuguaccc

SEQ ID NO: 79646 - RNA, 20 nt, Artificial Sequence
  MKO10079646_B_Cstl1
  gRNA
uauuugguuacugugaagau

SEQ ID NO: 79647 - RNA, 20 nt, Artificial Sequence
  MKO10079647_B_Cstl1
  gRNA
cuucucugcaguugaccaca

SEQ ID NO: 79648 - RNA, 20 nt, Artificial Sequence
  MKO10079648_B_Cs
  gRNA
ucuuaccguggaagaagcac

SEQ ID NO: 79649 - RNA, 20 nt, Artificial Sequence
  MKO10079649_B_Cs
  gRNA
cagauguacgguggcaugag

SEQ ID NO: 79650 - RNA, 20 nt, Artificial Sequence
  MKO10079650_B_Cs
  gRNA
cuucccauguugcugcuuga

SEQ ID NO: 79651 - RNA, 20 nt, Artificial Sequence
  MKO10079651_B_Cuag2
  gRNA
guuccguaacagugccguuc

SEQ ID NO: 79652 - RNA, 20 nt, Artificial Sequence
  MKO10079652_B_Cuag2
  gRNA
uuggucaagaaaggcauuga

SEQ ID NO: 79653 - RNA, 20 nt, Artificial Sequence
  MKO10079653_B_Cuag2
  gRNA
aaacauugcaugcagaaccc

SEQ ID NO: 79654 - RNA, 20 nt, Artificial Sequence
  MKO10079654_B_Cuage5
  gRNA
caauuccaacgaaaaaccac

SEQ ID NO: 79655 - RNA, 20 nt, Artificial Sequence
  MKO10079655_B_Cuage5
  gRNA
acaacuuacccacauaaaau

SEQ ID NO: 79656 - RNA, 20 nt, Artificial Sequence
  MKO10079656_B_Cuage5
  gRNA
caaagucagcauuguucaaa

SEQ ID NO: 79657 - RNA, 20 nt, Artificial Sequence
  MKO10079657_B_Ctbp1
  gRNA
cuuagaaucaucguccgaau

SEQ ID NO: 79658 - RNA, 20 nt, Artificial Sequence
  MKO10079658_B_Ctbp1
  gRNA
ugucaaacccgcugccaauu

SEQ ID NO: 79659 - RNA, 20 nt, Artificial Sequence
  MKO10079659_B_Ctbp1
  gRNA
gguguagccaggugguucgu

SEQ ID NO: 79660 - RNA, 20 nt, Artificial Sequence
  MKO10079660_B_Ctbp2
  gRNA
gcagggggccguucaugauc

SEQ ID NO: 79661 - RNA, 20 nt, Artificial Sequence
  MKO10079661_B_Ctbp2
  gRNA
gcuguucgagccaaggccuu

SEQ ID NO: 79662 - RNA, 20 nt, Artificial Sequence
  MKO10079662_B_Ctbp2
  gRNA
ucaggagcugcucggauccg

SEQ ID NO: 79663 - RNA, 20 nt, Artificial Sequence
  MKO10079663_B_Ctbs
  gRNA
caccaaagcgcauagacaaa

SEQ ID NO: 79664 - RNA, 20 nt, Artificial Sequence
  MKO10079664_B_Ctbs
  gRNA
ugagcauagcacauaaguuc

SEQ ID NO: 79665 - RNA, 20 nt, Artificial Sequence
  MKO10079665_B_Ctbs
  gRNA
uagcccuaagaaacuuguaa

SEQ ID NO: 79666 - RNA, 20 nt, Artificial Sequence
  MKO10079666_B_Cuc1
  gRNA
uugcuugugugaaggagacg

SEQ ID NO: 79667 - RNA, 20 nt, Artificial Sequence
  MKO10079667_B_Cuc1
  gRNA
aaaauuaccuguaucugagc

SEQ ID NO: 79668 - RNA, 20 nt, Artificial Sequence
  MKO10079668_B_Cuc1
  gRNA
uaacucugcccuucagcuac

SEQ ID NO: 79669 - RNA, 20 nt, Artificial Sequence
  MKO10079669_B_Cucfl
  gRNA
gugcaaguacgccagcgucg

SEQ ID NO: 79670 - RNA, 20 nt, Artificial Sequence
  MKO10079670_B_Cucfl
  gRNA
ucccggcacacuugucugau

SEQ ID NO: 79671 - RNA, 20 nt, Artificial Sequence
  MKO10079671_B_Cucfl
  gRNA
gcgucacauccgcucacaca

SEQ ID NO: 79672 - RNA, 20 nt, Artificial Sequence
  MKO10079672_B_Cucf
  gRNA
gacgauccaaauuugaacgc

SEQ ID NO: 79673 - RNA, 20 nt, Artificial Sequence
  MKO10079673_B_Cucf
  gRNA
guuugugcaguuaugccagc

SEQ ID NO: 79674 - RNA, 20 nt, Artificial Sequence
  MKO10079674_B_Cucf
  gRNA
aauguuauauuugucacgcu

SEQ ID NO: 79675 - RNA, 20 nt, Artificial Sequence
  MKO10079675_B_Ctdnep1
  gRNA
uguacauaagaggccccaug

SEQ ID NO: 79676 - RNA, 20 nt, Artificial Sequence
  MKO10079676_B_Ctdnep1
  gRNA
uaauagacaaacacccaguc

SEQ ID NO: 79677 - RNA, 20 nt, Artificial Sequence
  MKO10079677_B_Ctdnep1
  gRNA
cucuacuucagguaagccag

SEQ ID NO: 79678 - RNA, 20 nt, Artificial Sequence
  MKO10079678_B_Ctdp1
  gRNA
aacgugcagcucauacagcu

SEQ ID NO: 79679 - RNA, 20 nt, Artificial Sequence
  MKO10079679_B_Ctdp1
  gRNA
ccaugcugcacacgcgccug

SEQ ID NO: 79680 - RNA, 20 nt, Artificial Sequence
  MKO10079680_B_Ctdp1
  gRNA
cacucacuuuguuggacauc

SEQ ID NO: 79681 - RNA, 20 nt, Artificial Sequence
  MKO10079681_B_Ctdsp1
  gRNA
cuuacagccagugaacaaug

SEQ ID NO: 79682 - RNA, 20 nt, Artificial Sequence
  MKO10079682_B_Ctdsp1
  gRNA
gaucugcgucgucaucgacc

SEQ ID NO: 79683 - RNA, 20 nt, Artificial Sequence
  MKO10079683_B_Ctdsp1
  gRNA
cccggcagacacagcagaag

SEQ ID NO: 79684 - RNA, 20 nt, Artificial Sequence
  MKO10079684_B_Ctdsp2
  gRNA
cccaggugccugugcagucc

SEQ ID NO: 79685 - RNA, 20 nt, Artificial Sequence
  MKO10079685_B_Ctdsp2
  gRNA
uguucucuucacugccagcu

SEQ ID NO: 79686 - RNA, 20 nt, Artificial Sequence
  MKO10079686_B_Ctdsp2
  gRNA
ugacccugugacugaucucc

SEQ ID NO: 79687 - RNA, 20 nt, Artificial Sequence
  MKO10079687_B_Ctdspl2
  gRNA
auaaacaaaccuccauugac

SEQ ID NO: 79688 - RNA, 20 nt, Artificial Sequence
  MKO10079688_B_Ctdspl2
  gRNA
caaaucaagcaguucaagug

SEQ ID NO: 79689 - RNA, 20 nt, Artificial Sequence
  MKO10079689_B_Ctdspl2
  gRNA
acgucaggcucagauucccc

SEQ ID NO: 79690 - RNA, 20 nt, Artificial Sequence
  MKO10079690_B_Ctdspl
  gRNA
ccccagugugcuuccgccac

SEQ ID NO: 79691 - RNA, 20 nt, Artificial Sequence
  MKO10079691_B_Ctdspl
  gRNA
aagauacauacgcuugguac

SEQ ID NO: 79692 - RNA, 20 nt, Artificial Sequence
  MKO10079692_B_Ctdspl
  gRNA
cugcuuccgagacuacaaug

SEQ ID NO: 79693 - RNA, 20 nt, Artificial Sequence
  MKO10079693_B_Ctf1
  gRNA
aaucucauuccuaccccauu

SEQ ID NO: 79694 - RNA, 20 nt, Artificial Sequence
  MKO10079694_B_Ctf1
  gRNA
uacccagacuucccucccuc

SEQ ID NO: 79695 - RNA, 20 nt, Artificial Sequence
  MKO10079695_B_Ctf1
  gRNA
cuggggccagcaugagccag

SEQ ID NO: 79696 - RNA, 20 nt, Artificial Sequence
  MKO10079696_B_Ctf2
  gRNA
gcuugaccgaugggcucuga

SEQ ID NO: 79697 - RNA, 20 nt, Artificial Sequence
  MKO10079697_B_Ctf2
  gRNA
agggaggauguacugccugc

SEQ ID NO: 79698 - RNA, 20 nt, Artificial Sequence
  MKO10079698_B_Ctf2
  gRNA
acucugggguuugucccuuu

SEQ ID NO: 79699 - RNA, 20 nt, Artificial Sequence
  MKO10079699_B_Cugf
  gRNA
caguuggcucgcaucauagu

SEQ ID NO: 79700 - RNA, 20 nt, Artificial Sequence
  MKO10079700_B_Cugf
  gRNA
cguacaucuuccuguaguac

SEQ ID NO: 79701 - RNA, 20 nt, Artificial Sequence
  MKO10079701_B_Cugf
  gRNA
gccaacugcugugcgguccu

SEQ ID NO: 79702 - RNA, 20 nt, Artificial Sequence
  MKO10079702_B_Cthrc1
  gRNA
aggugugccaggaaugccgu

SEQ ID NO: 79703 - RNA, 20 nt, Artificial Sequence
  MKO10079703_B_Cthrc1
  gRNA
ugaagcaaaaagcgcugauc

SEQ ID NO: 79704 - RNA, 20 nt, Artificial Sequence
  MKO10079704_B_Cthrc1
  gRNA
uccaguagaagcgucuccuu

SEQ ID NO: 79705 - RNA, 20 nt, Artificial Sequence
  MKO10079705_B_Cth
  gRNA
aaaugaugucuccacguuug

SEQ ID NO: 79706 - RNA, 20 nt, Artificial Sequence
  MKO10079706_B_Cth
  gRNA
aaagcaguggcugcguugga

SEQ ID NO: 79707 - RNA, 20 nt, Artificial Sequence
  MKO10079707_B_Cth
  gRNA
auuugcauggaugaagugua

SEQ ID NO: 79708 - RNA, 20 nt, Artificial Sequence
  MKO10079708_B_Ctif
  gRNA
gguagcuguuccuucuccag

SEQ ID NO: 79709 - RNA, 20 nt, Artificial Sequence
  MKO10079709_B_Ctif
  gRNA
ugaggaccuaccugccaggu

SEQ ID NO: 79710 - RNA, 20 nt, Artificial Sequence
  MKO10079710_B_Ctif
  gRNA
ccaauaccuuugauuccuuc

SEQ ID NO: 79711 - RNA, 20 nt, Artificial Sequence
  MKO10079711_B_Ctla2a
  gRNA
uccacccccugauccaaguu

SEQ ID NO: 79712 - RNA, 20 nt, Artificial Sequence
  MKO10079712_B_Ctla2a
  gRNA
ugucauaccugagcccuucc

SEQ ID NO: 79713 - RNA, 20 nt, Artificial Sequence
  MKO10079713_B_Ctla2a
  gRNA
ccaagucacuaaauugauuc

SEQ ID NO: 79714 - RNA, 20 nt, Artificial Sequence
  MKO10079714_B_Ctla2b
  gRNA
uguuauaccugagcccuucc

SEQ ID NO: 79715 - RNA, 20 nt, Artificial Sequence
  MKO10079715_B_Ctla2b
  gRNA
aaagacacagaagacucaug

SEQ ID NO: 79716 - RNA, 20 nt, Artificial Sequence
  MKO10079716_B_Ctla2b
  gRNA
ccaagucacuaaauugauuc

SEQ ID NO: 79717 - RNA, 20 nt, Artificial Sequence
  MKO10079717_B_Ctla4
  gRNA
accccaagcuaacugcgaca

SEQ ID NO: 79718 - RNA, 20 nt, Artificial Sequence
  MKO10079718_B_Ctla4
  gRNA
acauagaccccuguuguaag

SEQ ID NO: 79719 - RNA, 20 nt, Artificial Sequence
  MKO10079719_B_Ctla4
  gRNA
cacugcagaagggguaaucu

SEQ ID NO: 79720 - RNA, 20 nt, Artificial Sequence
  MKO10079720_B_Ctnna1
  gRNA
guagaagauguucgaaaaca

SEQ ID NO: 79721 - RNA, 20 nt, Artificial Sequence
  MKO10079721_B_Ctnna1
  gRNA
gggccgucuaauaaaaagag

SEQ ID NO: 79722 - RNA, 20 nt, Artificial Sequence
  MKO10079722_B_Ctnna1
  gRNA
cuuugcucucugccgucacc

SEQ ID NO: 79723 - RNA, 20 nt, Artificial Sequence
  MKO10079723_B_Ctnna2
  gRNA
gcaaaccgauuuaaagaguu

SEQ ID NO: 79724 - RNA, 20 nt, Artificial Sequence
  MKO10079724_B_Ctnna2
  gRNA
auuucaggucgaggaggccu

SEQ ID NO: 79725 - RNA, 20 nt, Artificial Sequence
  MKO10079725_B_Ctnna2
  gRNA
guagaggaugugcggaagca

SEQ ID NO: 79726 - RNA, 20 nt, Artificial Sequence
  MKO10079726_B_Ctnna3
  gRNA
gauucugcggacaauucacc

SEQ ID NO: 79727 - RNA, 20 nt, Artificial Sequence
  MKO10079727_B_Ctnna3
  gRNA
uccuaccugcuggcguuuga

SEQ ID NO: 79728 - RNA, 20 nt, Artificial Sequence
  MKO10079728_B_Ctnna3
  gRNA
accccuguuaccucccgaaa

SEQ ID NO: 79729 - RNA, 20 nt, Artificial Sequence
  MKO10079729_B_Ctnnal1
  gRNA
guucagauauucagccaguu

SEQ ID NO: 79730 - RNA, 20 nt, Artificial Sequence
  MKO10079730_B_Ctnnal1
  gRNA
ccauuuggaaucagaugguc

SEQ ID NO: 79731 - RNA, 20 nt, Artificial Sequence
  MKO10079731_B_Ctnnal1
  gRNA
ggcgagggcugugcuugaaa

SEQ ID NO: 79732 - RNA, 20 nt, Artificial Sequence
  MKO10079732_B_Ctnnb1
  gRNA
gagauuaugcagugucguga

SEQ ID NO: 79733 - RNA, 20 nt, Artificial Sequence
  MKO10079733_B_Ctnnb1
  gRNA
agccaagcgcuggacauuag

SEQ ID NO: 79734 - RNA, 20 nt, Artificial Sequence
  MKO10079734_B_Ctnnb1
  gRNA
uucacgcaagagcaaguagc

SEQ ID NO: 79735 - RNA, 20 nt, Artificial Sequence
  MKO10079735_B_Ctnnbip1
  gRNA
gccacagcacuccaucgacc

SEQ ID NO: 79736 - RNA, 20 nt, Artificial Sequence
  MKO10079736_B_Ctnnbip1
  gRNA
gggcuuccagcuacugccuc

SEQ ID NO: 79737 - RNA, 20 nt, Artificial Sequence
  MKO10079737_B_Ctnnbip1
  gRNA
gucugcaggugcagaggacg

SEQ ID NO: 79738 - RNA, 20 nt, Artificial Sequence
  MKO10079738_B_Ctnnbl1
  gRNA
gcuuacuucuccggauuguc

SEQ ID NO: 79739 - RNA, 20 nt, Artificial Sequence
  MKO10079739_B_Ctnnbl1
  gRNA
agugccgugcagucacuucu

SEQ ID NO: 79740 - RNA, 20 nt, Artificial Sequence
  MKO10079740_B_Ctnnbl1
  gRNA
acccuccacgagagugaaga

SEQ ID NO: 79741 - RNA, 20 nt, Artificial Sequence
  MKO10079741_B_Ctnnd1
  gRNA
cuuaugcuaccgcaaugaca

SEQ ID NO: 79742 - RNA, 20 nt, Artificial Sequence
  MKO10079742_B_Ctnnd1
  gRNA
gccuauaccgcuccucaauu

SEQ ID NO: 79743 - RNA, 20 nt, Artificial Sequence
  MKO10079743_B_Ctnnd1
  gRNA
gcccaccugaggcgucgucg

SEQ ID NO: 79744 - RNA, 20 nt, Artificial Sequence
  MKO10079744_B_Ctnnd2
  gRNA
ccuugccuccgucaaagaac

SEQ ID NO: 79745 - RNA, 20 nt, Artificial Sequence
  MKO10079745_B_Ctnnd2
  gRNA
caagcuugcaucgcuccagc

SEQ ID NO: 79746 - RNA, 20 nt, Artificial Sequence
  MKO10079746_B_Ctnnd2
  gRNA
gucaggcauucuggacccac

SEQ ID NO: 79747 - RNA, 20 nt, Artificial Sequence
  MKO10079747_B_Ctns
  gRNA
aaucguuagcaucauaaacc

SEQ ID NO: 79748 - RNA, 20 nt, Artificial Sequence
  MKO10079748_B_Ctns
  gRNA
gcauccacuaaauucgaccu

SEQ ID NO: 79749 - RNA, 20 nt, Artificial Sequence
  MKO10079749_B_Ctns
  gRNA
accagccuaccaggucuggu

SEQ ID NO: 79750 - RNA, 20 nt, Artificial Sequence
  MKO10079750_B_Ctps2
  gRNA
uccccagauauguguuauug

SEQ ID NO: 79751 - RNA, 20 nt, Artificial Sequence
  MKO10079751_B_Ctps2
  gRNA
uaccuggggaaaacuguuca

SEQ ID NO: 79752 - RNA, 20 nt, Artificial Sequence
  MKO10079752_B_Ctps2
  gRNA
agcaugugaucaacaaagag

SEQ ID NO: 79753 - RNA, 20 nt, Artificial Sequence
  MKO10079753_B_Ctps
  gRNA
uaaguucccgaacacuguuc

SEQ ID NO: 79754 - RNA, 20 nt, Artificial Sequence
  MKO10079754_B_Ctps
  gRNA
gcuccuuguuaaugacguac

SEQ ID NO: 79755 - RNA, 20 nt, Artificial Sequence
  MKO10079755_B_Ctps
  gRNA
guaaaacagccaaguucaac

SEQ ID NO: 79756 - RNA, 20 nt, Artificial Sequence
  MKO10079756_B_Ctr9
  gRNA
aaaagcauugcgcacuaacc

SEQ ID NO: 79757 - RNA, 20 nt, Artificial Sequence
  MKO10079757_B_Ctr9
  gRNA
agcacggauagauggcaauu

SEQ ID NO: 79758 - RNA, 20 nt, Artificial Sequence
  MKO10079758_B_Ctr9
  gRNA
cugaugacuucgucucccuc

SEQ ID NO: 79759 - RNA, 20 nt, Artificial Sequence
  MKO10079759_B_Ctrb1
  gRNA
guugacgaugacuucccugc

SEQ ID NO: 79760 - RNA, 20 nt, Artificial Sequence
  MKO10079760_B_Ctrb1
  gRNA
ggacucacuugaccccgcag

SEQ ID NO: 79761 - RNA, 20 nt, Artificial Sequence
  MKO10079761_B_Ctrb1
  gRNA
guccaggaucgucaacggag

SEQ ID NO: 79762 - RNA, 20 nt, Artificial Sequence
  MKO10079762_B_Ctrc
  gRNA
cucccacucacuugaugcag

SEQ ID NO: 79763 - RNA, 20 nt, Artificial Sequence
  MKO10079763_B_Ctrc
  gRNA
gacuaucccugcuaugucac

SEQ ID NO: 79764 - RNA, 20 nt, Artificial Sequence
  MKO10079764_B_Ctrc
  gRNA
gacacuuggaggcacaccug

SEQ ID NO: 79765 - RNA, 20 nt, Artificial Sequence
  MKO10079765_B_Ctrl
  gRNA
ugaagcuugccucgccagcc

SEQ ID NO: 79766 - RNA, 20 nt, Artificial Sequence
  MKO10079766_B_Ctrl
  gRNA
aggccaucacacacccuaac

SEQ ID NO: 79767 - RNA, 20 nt, Artificial Sequence
  MKO10079767_B_Ctrl
  gRNA
gcagccgugaccacccaguu

SEQ ID NO: 79768 - RNA, 20 nt, Artificial Sequence
  MKO10079768_B_Cts3
  gRNA
ugaguuuaucccaaacaaug

SEQ ID NO: 79769 - RNA, 20 nt, Artificial Sequence
  MKO10079769_B_Cts3
  gRNA
agccauaccuguguccgcac

SEQ ID NO: 79770 - RNA, 20 nt, Artificial Sequence
  MKO10079770_B_Cts3
  gRNA
uaaagacacuugaagaauuc

SEQ ID NO: 79771 - RNA, 20 nt, Artificial Sequence
  MKO10079771_B_Cts6
  gRNA
ugauguucuacccaaauuug

SEQ ID NO: 79772 - RNA, 20 nt, Artificial Sequence
  MKO10079772_B_Cts6
  gRNA
guagaaacugaaucuguuaa

SEQ ID NO: 79773 - RNA, 20 nt, Artificial Sequence
  MKO10079773_B_Cts6
  gRNA
auucacagcaaaagcccaac

SEQ ID NO: 79774 - RNA, 20 nt, Artificial Sequence
  MKO10079774_B_Cts7
  gRNA
uccugaacguucuguuguua

SEQ ID NO: 79775 - RNA, 20 nt, Artificial Sequence
  MKO10079775_B_Cts7
  gRNA
ugugacuccagugcgaagac

SEQ ID NO: 79776 - RNA, 20 nt, Artificial Sequence
  MKO10079776_B_Cts7
  gRNA
ucugugacugcaugcauaga

SEQ ID NO: 79777 - RNA, 20 nt, Artificial Sequence
  MKO10079777_B_Cts8
  gRNA
accauggaugucaaugccuu

SEQ ID NO: 79778 - RNA, 20 nt, Artificial Sequence
  MKO10079778_B_Cts8
  gRNA
auuuaaaggacggacacugc

SEQ ID NO: 79779 - RNA, 20 nt, Artificial Sequence
  MKO10079779_B_Cts8
  gRNA
acugagcacacaaaaucuag

SEQ ID NO: 79780 - RNA, 20 nt, Artificial Sequence
  MKO10079780_B_Ctsa
  gRNA
ggacucgauauacagcacgu

SEQ ID NO: 79781 - RNA, 20 nt, Artificial Sequence
  MKO10079781_B_Ctsa
  gRNA
cuuuggcuuaacgggggucc

SEQ ID NO: 79782 - RNA, 20 nt, Artificial Sequence
  MKO10079782_B_Ctsa
  gRNA
uggaguacaaccccuaugcu

SEQ ID NO: 79783 - RNA, 20 nt, Artificial Sequence
  MKO10079783_B_Ctsb
  gRNA
cuggguggacccaaacugcc

SEQ ID NO: 79784 - RNA, 20 nt, Artificial Sequence
  MKO10079784_B_Ctsb
  gRNA
uguagacuccaccugaaacc

SEQ ID NO: 79785 - RNA, 20 nt, Artificial Sequence
  MKO10079785_B_Ctsb
  gRNA
cgaaccugcauucacaccaa

SEQ ID NO: 79786 - RNA, 20 nt, Artificial Sequence
  MKO10079786_B_Ctsc
  gRNA
ucaacacaaucucgaagccu

SEQ ID NO: 79787 - RNA, 20 nt, Artificial Sequence
  MKO10079787_B_Ctsc
  gRNA
guuagcccuguucgaaacca

SEQ ID NO: 79788 - RNA, 20 nt, Artificial Sequence
  MKO10079788_B_Ctsc
  gRNA
aauaugaaugcagcacaucu

SEQ ID NO: 79789 - RNA, 20 nt, Artificial Sequence
  MKO10079789_B_Ctsd
  gRNA
ugccgauaucgccauaguac

SEQ ID NO: 79790 - RNA, 20 nt, Artificial Sequence
  MKO10079790_B_Ctsd
  gRNA
auguaagucugaccagucaa

SEQ ID NO: 79791 - RNA, 20 nt, Artificial Sequence
  MKO10079791_B_Ctsd
  gRNA
ggacgugccguucuucacau

SEQ ID NO: 79792 - RNA, 20 nt, Artificial Sequence
  MKO10079792_B_Ctse
  gRNA
gggucugggauaccccucau

SEQ ID NO: 79793 - RNA, 20 nt, Artificial Sequence
  MKO10079793_B_Ctse
  gRNA
gacacucgaauacacauuac

SEQ ID NO: 79794 - RNA, 20 nt, Artificial Sequence
  MKO10079794_B_Ctse
  gRNA
ucagguggaaggguugacug

SEQ ID NO: 79795 - RNA, 20 nt, Artificial Sequence
  MKO10079795_B_Ctsf
  gRNA
cuucccuugauucauaaguc

SEQ ID NO: 79796 - RNA, 20 nt, Artificial Sequence
  MKO10079796_B_Ctsf
  gRNA
acuucaugaccaccuauaac

SEQ ID NO: 79797 - RNA, 20 nt, Artificial Sequence
  MKO10079797_B_Ctsf
  gRNA
aaucccagcaccugugaccu

SEQ ID NO: 79798 - RNA, 20 nt, Artificial Sequence
  MKO10079798_B_Ctsg
  gRNA
gucuccuauggaagcaacaa

SEQ ID NO: 79799 - RNA, 20 nt, Artificial Sequence
  MKO10079799_B_Ctsg
  gRNA
gcuucaccgauccacuccuc

SEQ ID NO: 79800 - RNA, 20 nt, Artificial Sequence
  MKO10079800_B_Ctsg
  gRNA
guuguagaacuggaagcgau

SEQ ID NO: 79801 - RNA, 20 nt, Artificial Sequence
  MKO10079801_B_Ctsh
  gRNA
agauucaagcccacaaccag

SEQ ID NO: 79802 - RNA, 20 nt, Artificial Sequence
  MKO10079802_B_Ctsh
  gRNA
uugaaucuuccuccaguugu

SEQ ID NO: 79803 - RNA, 20 nt, Artificial Sequence
  MKO10079803_B_Ctsh
  gRNA
aaaaguuucacuuuaaguca

SEQ ID NO: 79804 - RNA, 20 nt, Artificial Sequence
  MKO10079804_B_Ctsj
  gRNA
cgauuauaaggauuggagag

SEQ ID NO: 79805 - RNA, 20 nt, Artificial Sequence
  MKO10079805_B_Ctsj
  gRNA
cucucuccaauccuuauaau

SEQ ID NO: 79806 - RNA, 20 nt, Artificial Sequence
  MKO10079806_B_Ctsj
  gRNA
ucuaagugugcagaaccuau

SEQ ID NO: 79807 - RNA, 20 nt, Artificial Sequence
  MKO10079807_B_Ctsk
  gRNA
aaguuguauguauaacgcca

SEQ ID NO: 79808 - RNA, 20 nt, Artificial Sequence
  MKO10079808_B_Ctsk
  gRNA
gcauuuagcugccuuugccg

SEQ ID NO: 79809 - RNA, 20 nt, Artificial Sequence
  MKO10079809_B_Ctsk
  gRNA
ugaagaugcuuacccauaug

SEQ ID NO: 79810 - RNA, 20 nt, Artificial Sequence
  MKO10079810_B_Ctsll3
  gRNA
gaugaucgaccugcacaaug

SEQ ID NO: 79811 - RNA, 20 nt, Artificial Sequence
  MKO10079811_B_Ctsll3
  gRNA
ucagauaguccucauugugc

SEQ ID NO: 79812 - RNA, 20 nt, Artificial Sequence
  MKO10079812_B_Ctsll3
  gRNA
acuuacccuccuuguagaac

SEQ ID NO: 79813 - RNA, 20 nt, Artificial Sequence
  MKO10079813_B_Ctsl
  gRNA
cauuaccugaacuauagaac

SEQ ID NO: 79814 - RNA, 20 nt, Artificial Sequence
  MKO10079814_B_Ctsl
  gRNA
gaauacagcaacgggcagca

SEQ ID NO: 79815 - RNA, 20 nt, Artificial Sequence
  MKO10079815_B_Ctsl
  gRNA
uguauuccccguuguguagc

SEQ ID NO: 79816 - RNA, 20 nt, Artificial Sequence
  MKO10079816_B_Ctsm
  gRNA
ugcaucgauugcaacagaaa

SEQ ID NO: 79817 - RNA, 20 nt, Artificial Sequence
  MKO10079817_B_Ctsm
  gRNA
agccauaccugugucugcac

SEQ ID NO: 79818 - RNA, 20 nt, Artificial Sequence
  MKO10079818_B_Ctsm
  gRNA
ugucacuccugugcagacac

SEQ ID NO: 79819 - RNA, 20 nt, Artificial Sequence
  MKO10079819_B_Ctso
  gRNA
gaaacuccagcuugugauug

SEQ ID NO: 79820 - RNA, 20 nt, Artificial Sequence
  MKO10079820_B_Ctso
  gRNA
cuuugccauugagauuugac

SEQ ID NO: 79821 - RNA, 20 nt, Artificial Sequence
  MKO10079821_B_Ctso
  gRNA
ucccuccagucaaaucucaa

SEQ ID NO: 79822 - RNA, 20 nt, Artificial Sequence
  MKO10079822_B_Ctsq
  gRNA
aaaggauuaaacugcauaac

SEQ ID NO: 79823 - RNA, 20 nt, Artificial Sequence
  MKO10079823_B_Ctsq
  gRNA
cuccauugugcaaaacguac

SEQ ID NO: 79824 - RNA, 20 nt, Artificial Sequence
  MKO10079824_B_Ctsq
  gRNA
aaggcuaugugacucgugug

SEQ ID NO: 79825 - RNA, 20 nt, Artificial Sequence
  MKO10079825_B_Ctsr
  gRNA
agggagauugugaugcuugu

SEQ ID NO: 79826 - RNA, 20 nt, Artificial Sequence
  MKO10079826_B_Ctsr
  gRNA
ugugucccucccccaaagug

SEQ ID NO: 79827 - RNA, 20 nt, Artificial Sequence
  MKO10079827_B_Ctsr
  gRNA
ugagucuuucaagaacuaua

SEQ ID NO: 79828 - RNA, 20 nt, Artificial Sequence
  MKO10079828_B_Ctss
  gRNA
ccaaugaagaaaucuugugu

SEQ ID NO: 79829 - RNA, 20 nt, Artificial Sequence
  MKO10079829_B_Ctss
  gRNA
acugcagagagacccuaccc

SEQ ID NO: 79830 - RNA, 20 nt, Artificial Sequence
  MKO10079830_B_Ctss
  gRNA
ccgacacaagauuucuucau

SEQ ID NO: 79831 - RNA, 20 nt, Artificial Sequence
  MKO10079831_B_Ctsw
  gRNA
guuugaugcgccacagagcc

SEQ ID NO: 79832 - RNA, 20 nt, Artificial Sequence
  MKO10079832_B_Ctsw
  gRNA
gagcaucuuugcccacaauc

SEQ ID NO: 79833 - RNA, 20 nt, Artificial Sequence
  MKO10079833_B_Ctsw
  gRNA
cggaguuacuggaacccagc

SEQ ID NO: 79834 - RNA, 20 nt, Artificial Sequence
  MKO10079834_B_Ctsz
  gRNA
gaaauucauggggcgaaccc

SEQ ID NO: 79835 - RNA, 20 nt, Artificial Sequence
  MKO10079835_B_Ctsz
  gRNA
cguaaucacccacucuccag

SEQ ID NO: 79836 - RNA, 20 nt, Artificial Sequence
  MKO10079836_B_Ctsz
  gRNA
ucaacuaugccagcgucacc

SEQ ID NO: 79837 - RNA, 20 nt, Artificial Sequence
  MKO10079837_B_Cuunbp2nl
  gRNA
agcuggccgcagccgagagc

SEQ ID NO: 79838 - RNA, 20 nt, Artificial Sequence
  MKO10079838_B_Cuunbp2nl
  gRNA
ccuuguuauagaagcuuuaa

SEQ ID NO: 79839 - RNA, 20 nt, Artificial Sequence
  MKO10079839_B_Cuunbp2nl
  gRNA
acacuguucaguauccuuga

SEQ ID NO: 79840 - RNA, 20 nt, Artificial Sequence
  MKO10079840_B_Cuunbp2
  gRNA
guguucauccaggaacggua

SEQ ID NO: 79841 - RNA, 20 nt, Artificial Sequence
  MKO10079841_B_Cuunbp2
  gRNA
guucaccuuccaucacgcua

SEQ ID NO: 79842 - RNA, 20 nt, Artificial Sequence
  MKO10079842_B_Cuunbp2
  gRNA
auaaauuacuccugcgaaga

SEQ ID NO: 79843 - RNA, 20 nt, Artificial Sequence
  MKO10079843_B_Cuun
  gRNA
gugacuccuaccacaaaauc

SEQ ID NO: 79844 - RNA, 20 nt, Artificial Sequence
  MKO10079844_B_Cuun
  gRNA
cacggcuauggcgggaaguu

SEQ ID NO: 79845 - RNA, 20 nt, Artificial Sequence
  MKO10079845_B_Cuun
  gRNA
aaagcuucgacugguacuca

SEQ ID NO: 79846 - RNA, 20 nt, Artificial Sequence
  MKO10079846_B_Ctu1
  gRNA
cuacagcgcccggcggcagc

SEQ ID NO: 79847 - RNA, 20 nt, Artificial Sequence
  MKO10079847_B_Ctu1
  gRNA
aagugcgcaccccucgcccg

SEQ ID NO: 79848 - RNA, 20 nt, Artificial Sequence
  MKO10079848_B_Ctu1
  gRNA
cagccaugucgucagcguug

SEQ ID NO: 79849 - RNA, 20 nt, Artificial Sequence
  MKO10079849_B_Ctu2
  gRNA
gccggugguggugauacgag

SEQ ID NO: 79850 - RNA, 20 nt, Artificial Sequence
  MKO10079850_B_Ctu2
  gRNA
acacaucguaccuucucccc

SEQ ID NO: 79851 - RNA, 20 nt, Artificial Sequence
  MKO10079851_B_Ctu2
  gRNA
ccaucaacauagaugacucc

SEQ ID NO: 79852 - RNA, 20 nt, Artificial Sequence
  MKO10079852_B_Ctxn1
  gRNA
cgcguucgagcgccuccuug

SEQ ID NO: 79853 - RNA, 20 nt, Artificial Sequence
  MKO10079853_B_Ctxn1
  gRNA
cccaccgggggccccgucga

SEQ ID NO: 79854 - RNA, 20 nt, Artificial Sequence
  MKO10079854_B_Ctxn1
  gRNA
gccgcaugcccgccucgucc

SEQ ID NO: 79855 - RNA, 20 nt, Artificial Sequence
  MKO10079855_B_Ctxn2
  gRNA
aaagaccggcuuugccuuug

SEQ ID NO: 79856 - RNA, 20 nt, Artificial Sequence
  MKO10079856_B_Ctxn2
  gRNA
aaugcacaagaugcccacaa

SEQ ID NO: 79857 - RNA, 20 nt, Artificial Sequence
  MKO10079857_B_Ctxn2
  gRNA
uucaucuucccauguagaag

SEQ ID NO: 79858 - RNA, 20 nt, Artificial Sequence
  MKO10079858_B_Ctxn3
  gRNA
ugcccaaaaagaugaacaac

SEQ ID NO: 79859 - RNA, 20 nt, Artificial Sequence
  MKO10079859_B_Ctxn3
  gRNA
ccaaccucaacaugggcuga

SEQ ID NO: 79860 - RNA, 20 nt, Artificial Sequence
  MKO10079860_B_Ctxn3
  gRNA
gauaugggucuagaagaauu

SEQ ID NO: 79861 - RNA, 20 nt, Artificial Sequence
  MKO10079861_B_Cubn
  gRNA
cccuccuccguagucauccg

SEQ ID NO: 79862 - RNA, 20 nt, Artificial Sequence
  MKO10079862_B_Cubn
  gRNA
uacaaauaaaggagucgugc

SEQ ID NO: 79863 - RNA, 20 nt, Artificial Sequence
  MKO10079863_B_Cubn
  gRNA
ugacacaggugccaccauug

SEQ ID NO: 79864 - RNA, 20 nt, Artificial Sequence
  MKO10079864_B_Cuedc1
  gRNA
cuugcagguuguccggagcc

SEQ ID NO: 79865 - RNA, 20 nt, Artificial Sequence
  MKO10079865_B_Cuedc1
  gRNA
gaggcccaccuccggcgcca

SEQ ID NO: 79866 - RNA, 20 nt, Artificial Sequence
  MKO10079866_B_Cuedc1
  gRNA
uccaguuucuguagcgucuc

SEQ ID NO: 79867 - RNA, 20 nt, Artificial Sequence
  MKO10079867_B_Cuedc2
  gRNA
cugagcgaugcuaggaacaa

SEQ ID NO: 79868 - RNA, 20 nt, Artificial Sequence
  MKO10079868_B_Cuedc2
  gRNA
uaccucaucuaggguguucc

SEQ ID NO: 79869 - RNA, 20 nt, Artificial Sequence
  MKO10079869_B_Cuedc2
  gRNA
cuggaggaccugggccccuc

SEQ ID NO: 79870 - RNA, 20 nt, Artificial Sequence
  MKO10079870_B_Cul1
  gRNA
guucaggccauugaauaaac

SEQ ID NO: 79871 - RNA, 20 nt, Artificial Sequence
  MKO10079871_B_Cul1
  gRNA
ugcaucaguccaaccaagcc

SEQ ID NO: 79872 - RNA, 20 nt, Artificial Sequence
  MKO10079872_B_Cul1
  gRNA
acuaaucagucuuguauuga

SEQ ID NO: 79873 - RNA, 20 nt, Artificial Sequence
  MKO10079873_B_Cul2
  gRNA
acuauauggacugcuuauau

SEQ ID NO: 79874 - RNA, 20 nt, Artificial Sequence
  MKO10079874_B_Cul2
  gRNA
accucuccuauuuccauaag

SEQ ID NO: 79875 - RNA, 20 nt, Artificial Sequence
  MKO10079875_B_Cul2
  gRNA
agauaugaaugaaccacuua

SEQ ID NO: 79876 - RNA, 20 nt, Artificial Sequence
  MKO10079876_B_Cul3
  gRNA
gaccuaaaaucauuaacauc

SEQ ID NO: 79877 - RNA, 20 nt, Artificial Sequence
  MKO10079877_B_Cul3
  gRNA
ugaaggaagaucagucuaug

SEQ ID NO: 79878 - RNA, 20 nt, Artificial Sequence
  MKO10079878_B_Cul3
  gRNA
uucaaacacuaaaucaagcu

SEQ ID NO: 79879 - RNA, 20 nt, Artificial Sequence
  MKO10079879_B_Cul4a
  gRNA
gcucuacaagcagcugcgcc

SEQ ID NO: 79880 - RNA, 20 nt, Artificial Sequence
  MKO10079880_B_Cul4a
  gRNA
guguccugaguguaguuguc

SEQ ID NO: 79881 - RNA, 20 nt, Artificial Sequence
  MKO10079881_B_Cul4a
  gRNA
auuccaugcugccuucuauc

SEQ ID NO: 79882 - RNA, 20 nt, Artificial Sequence
  MKO10079882_B_Cul4b
  gRNA
ccuccaaucaagagcgccga

SEQ ID NO: 79883 - RNA, 20 nt, Artificial Sequence
  MKO10079883_B_Cul4b
  gRNA
caauuuagaagaacucuacc

SEQ ID NO: 79884 - RNA, 20 nt, Artificial Sequence
  MKO10079884_B_Cul4b
  gRNA
uaaauuaccagaaaacuaua

SEQ ID NO: 79885 - RNA, 20 nt, Artificial Sequence
  MKO10079885_B_Cul5
  gRNA
gcaaagcugugucaucuuga

SEQ ID NO: 79886 - RNA, 20 nt, Artificial Sequence
  MKO10079886_B_Cul5
  gRNA
aggcucaucaaaaauucauc

SEQ ID NO: 79887 - RNA, 20 nt, Artificial Sequence
  MKO10079887_B_Cul5
  gRNA
ugaguuuauuaagcaagcac

SEQ ID NO: 79888 - RNA, 20 nt, Artificial Sequence
  MKO10079888_B_Cul7
  gRNA
cagucccgccgucccagcgc

SEQ ID NO: 79889 - RNA, 20 nt, Artificial Sequence
  MKO10079889_B_Cul7
  gRNA
gcucuuugccgagccuuacg

SEQ ID NO: 79890 - RNA, 20 nt, Artificial Sequence
  MKO10079890_B_Cul7
  gRNA
cagguguugugggauucaac

SEQ ID NO: 79891 - RNA, 20 nt, Artificial Sequence
  MKO10079891_B_Cul9
  gRNA
gcugcucgaugccgucgugc

SEQ ID NO: 79892 - RNA, 20 nt, Artificial Sequence
  MKO10079892_B_Cul9
  gRNA
ugacagccgcuacacuuuac

SEQ ID NO: 79893 - RNA, 20 nt, Artificial Sequence
  MKO10079893_B_Cul9
  gRNA
ggauucagcguccgcagcug

SEQ ID NO: 79894 - RNA, 20 nt, Artificial Sequence
  MKO10079894_B_Cuual
  gRNA
ggccauccuggauaagaaga

SEQ ID NO: 79895 - RNA, 20 nt, Artificial Sequence
  MKO10079895_B_Cuual
  gRNA
acgaagccaucuucuuaucc

SEQ ID NO: 79896 - RNA, 20 nt, Artificial Sequence
  MKO10079896_B_Cuual
  gRNA
accucauauaggcaaacagc

SEQ ID NO: 79897 - RNA, 20 nt, Artificial Sequence
  MKO10079897_B_Cuua
  gRNA
acucacauggaugugaucug

SEQ ID NO: 79898 - RNA, 20 nt, Artificial Sequence
  MKO10079898_B_Cuua
  gRNA
cgaacaaacucugucagagc

SEQ ID NO: 79899 - RNA, 20 nt, Artificial Sequence
  MKO10079899_B_Cuua
  gRNA
aaagaucgaggaagauagug

SEQ ID NO: 79900 - RNA, 20 nt, Artificial Sequence
  MKO10079900_B_Cuuc
  gRNA
gggaggaaccacacccagua

SEQ ID NO: 79901 - RNA, 20 nt, Artificial Sequence
  MKO10079901_B_Cuuc
  gRNA
auacuuacccauacugggug

SEQ ID NO: 79902 - RNA, 20 nt, Artificial Sequence
  MKO10079902_B_Cuuc
  gRNA
acgcgggaagcaugaagaaa

SEQ ID NO: 79903 - RNA, 20 nt, Artificial Sequence
  MKO10079903_B_Cux1
  gRNA
ucucaagauggcggccaaug

SEQ ID NO: 79904 - RNA, 20 nt, Artificial Sequence
  MKO10079904_B_Cux1
  gRNA
aagagacuaauugauguucc

SEQ ID NO: 79905 - RNA, 20 nt, Artificial Sequence
  MKO10079905_B_Cux1
  gRNA
ccuguuugccaauacuguug

SEQ ID NO: 79906 - RNA, 20 nt, Artificial Sequence
  MKO10079906_B_Cux2
  gRNA
aagcaauugauugaagcacc

SEQ ID NO: 79907 - RNA, 20 nt, Artificial Sequence
  MKO10079907_B_Cux2
  gRNA
guuggcuggcgugugccccg

SEQ ID NO: 79908 - RNA, 20 nt, Artificial Sequence
  MKO10079908_B_Cux2
  gRNA
ucaauugcuuauaaacacuc

SEQ ID NO: 79909 - RNA, 20 nt, Artificial Sequence
  MKO10079909_B_Cuzd1
  gRNA
cgcaggucaccaccgcaguu

SEQ ID NO: 79910 - RNA, 20 nt, Artificial Sequence
  MKO10079910_B_Cuzd1
  gRNA
uaucugaaaugucaucgagu

SEQ ID NO: 79911 - RNA, 20 nt, Artificial Sequence
  MKO10079911_B_Cuzd1
  gRNA
ggugaccugcgagcauugga

SEQ ID NO: 79912 - RNA, 20 nt, Artificial Sequence
  MKO10079912_B_Cwc15
  gRNA
gaggcugggacgggccagug

SEQ ID NO: 79913 - RNA, 20 nt, Artificial Sequence
  MKO10079913_B_Cwc15
  gRNA
aacccucuccuaaaccucac

SEQ ID NO: 79914 - RNA, 20 nt, Artificial Sequence
  MKO10079914_B_Cwc15
  gRNA
gggcuucuuugacacugaag

SEQ ID NO: 79915 - RNA, 20 nt, Artificial Sequence
  MKO10079915_B_Cwc22
  gRNA
agacccacaguucauaccgc

SEQ ID NO: 79916 - RNA, 20 nt, Artificial Sequence
  MKO10079916_B_Cwc22
  gRNA
uuagauacacagagcaagag

SEQ ID NO: 79917 - RNA, 20 nt, Artificial Sequence
  MKO10079917_B_Cwc22
  gRNA
aaucagaguaaccucuaucc

SEQ ID NO: 79918 - RNA, 20 nt, Artificial Sequence
  MKO10079918_B_Cwc25
  gRNA
ucaccaugccacccggaccu

SEQ ID NO: 79919 - RNA, 20 nt, Artificial Sequence
  MKO10079919_B_Cwc25
  gRNA
gcucugcucauccucgcugc

SEQ ID NO: 79920 - RNA, 20 nt, Artificial Sequence
  MKO10079920_B_Cwc25
  gRNA
gcaaaugagccuugagaaaa

SEQ ID NO: 79921 - RNA, 20 nt, Artificial Sequence
  MKO10079921_B_Cwc27
  gRNA
aacuggcugccauuaucaug

SEQ ID NO: 79922 - RNA, 20 nt, Artificial Sequence
  MKO10079922_B_Cwc27
  gRNA
aaugcugguccacaugauaa

SEQ ID NO: 79923 - RNA, 20 nt, Artificial Sequence
  MKO10079923_B_Cwc27
  gRNA
ucacaacucuugauucuaug

SEQ ID NO: 79924 - RNA, 20 nt, Artificial Sequence
  MKO10079924_B_Cwf19l1
  gRNA
ccuauucagacauaugugcu

SEQ ID NO: 79925 - RNA, 20 nt, Artificial Sequence
  MKO10079925_B_Cwf19l1
  gRNA
gagugggaggaguauaagac

SEQ ID NO: 79926 - RNA, 20 nt, Artificial Sequence
  MKO10079926_B_Cwf19l1
  gRNA
uucucuaccuuucuuguugc

SEQ ID NO: 79927 - RNA, 20 nt, Artificial Sequence
  MKO10079927_B_Cwf19l2
  gRNA
uggugcucaccugaauaucg

SEQ ID NO: 79928 - RNA, 20 nt, Artificial Sequence
  MKO10079928_B_Cwf19l2
  gRNA
uucuuaccugcucuaacacu

SEQ ID NO: 79929 - RNA, 20 nt, Artificial Sequence
  MKO10079929_B_Cwf19l2
  gRNA
uucagcuuugagugaugaug

SEQ ID NO: 79930 - RNA, 20 nt, Artificial Sequence
  MKO10079930_B_Cwh43
  gRNA
uucuucuuguccuccgaaua

SEQ ID NO: 79931 - RNA, 20 nt, Artificial Sequence
  MKO10079931_B_Cwh43
  gRNA
cuccgaagauccagugaguu

SEQ ID NO: 79932 - RNA, 20 nt, Artificial Sequence
  MKO10079932_B_Cwh43
  gRNA
cugugagcuccagcguuugc

SEQ ID NO: 79933 - RNA, 20 nt, Artificial Sequence
  MKO10079933_B_Cx3cl1
  gRNA
cgcuacgucccccguagcug

SEQ ID NO: 79934 - RNA, 20 nt, Artificial Sequence
  MKO10079934_B_Cx3cl1
  gRNA
ucuuccaauguggcggauuc

SEQ ID NO: 79935 - RNA, 20 nt, Artificial Sequence
  MKO10079935_B_Cx3cl1
  gRNA
aggcgcagcagccacgcgag

SEQ ID NO: 79936 - RNA, 20 nt, Artificial Sequence
  MKO10079936_B_Cx3cr1
  gRNA
gcacggugucaccauuaguc

SEQ ID NO: 79937 - RNA, 20 nt, Artificial Sequence
  MKO10079937_B_Cx3cr1
  gRNA
guggcccgugcuccgcaacu

SEQ ID NO: 79938 - RNA, 20 nt, Artificial Sequence
  MKO10079938_B_Cx3cr1
  gRNA
ugaguaugacgauucugcug

SEQ ID NO: 79939 - RNA, 20 nt, Artificial Sequence
  MKO10079939_B_Cxadr
  gRNA
acgaguaacgaugucaaguc

SEQ ID NO: 79940 - RNA, 20 nt, Artificial Sequence
  MKO10079940_B_Cxadr
  gRNA
cccagacaaugccuacgcca

SEQ ID NO: 79941 - RNA, 20 nt, Artificial Sequence
  MKO10079941_B_Cxadr
  gRNA
aagaugcuucguggauggau

SEQ ID NO: 79942 - RNA, 20 nt, Artificial Sequence
  MKO10079942_B_Cxcl10
  gRNA
cagaaaaugacggcagcacu

SEQ ID NO: 79943 - RNA, 20 nt, Artificial Sequence
  MKO10079943_B_Cxcl10
  gRNA
ugagcagagaugucugaauc

SEQ ID NO: 79944 - RNA, 20 nt, Artificial Sequence
  MKO10079944_B_Cxcl10
  gRNA
gagucccacucagacccagc

SEQ ID NO: 79945 - RNA, 20 nt, Artificial Sequence
  MKO10079945_B_Cxcl11
  gRNA
ggcaaccuaccugcauuaug

SEQ ID NO: 79946 - RNA, 20 nt, Artificial Sequence
  MKO10079946_B_Cxcl11
  gRNA
cgcugucuuugcaucggccc

SEQ ID NO: 79947 - RNA, 20 nt, Artificial Sequence
  MKO10079947_B_Cxcl11
  gRNA
gcaagcucgccucauaaugc

SEQ ID NO: 79948 - RNA, 20 nt, Artificial Sequence
  MKO10079948_B_Cxcl12
  gRNA
gcauugacccgaaauuaaag

SEQ ID NO: 79949 - RNA, 20 nt, Artificial Sequence
  MKO10079949_B_Cxcl12
  gRNA
cgccgugcuggcccuggugc

SEQ ID NO: 79950 - RNA, 20 nt, Artificial Sequence
  MKO10079950_B_Cxcl12
  gRNA
acuuguuuaaagcuuucucc

SEQ ID NO: 79951 - RNA, 20 nt, Artificial Sequence
  MKO10079951_B_Cxcl13
  gRNA
gauuauuaagacauguccaa

SEQ ID NO: 79952 - RNA, 20 nt, Artificial Sequence
  MKO10079952_B_Cxcl13
  gRNA
ggagugauuucaacuguugu

SEQ ID NO: 79953 - RNA, 20 nt, Artificial Sequence
  MKO10079953_B_Cxcl13
  gRNA
gcagcucuucucuuacucac

SEQ ID NO: 79954 - RNA, 20 nt, Artificial Sequence
  MKO10079954_B_Cxcl14
  gRNA
augccuggaacgagaagcgc

SEQ ID NO: 79955 - RNA, 20 nt, Artificial Sequence
  MKO10079955_B_Cxcl14
  gRNA
gcaccaaacgcuucaucaag

SEQ ID NO: 79956 - RNA, 20 nt, Artificial Sequence
  MKO10079956_B_Cxcl14
  gRNA
ucccagggucuacgaagaau

SEQ ID NO: 79957 - RNA, 20 nt, Artificial Sequence
  MKO10079957_B_Cxcl15
  gRNA
guuuggauccugaugcucca

SEQ ID NO: 79958 - RNA, 20 nt, Artificial Sequence
  MKO10079958_B_Cxcl15
  gRNA
cuauacagaagcuucauugc

SEQ ID NO: 79959 - RNA, 20 nt, Artificial Sequence
  MKO10079959_B_Cxcl15
  gRNA
uaaaucagcaaagugucuag

SEQ ID NO: 79960 - RNA, 20 nt, Artificial Sequence
  MKO10079960_B_Cxcl16
  gRNA
uccauuaggcgauggcaacc

SEQ ID NO: 79961 - RNA, 20 nt, Artificial Sequence
  MKO10079961_B_Cxcl16
  gRNA
ugcuguaggcgcuagggucu

SEQ ID NO: 79962 - RNA, 20 nt, Artificial Sequence
  MKO10079962_B_Cxcl16
  gRNA
gcuuccagaccauagccuga

SEQ ID NO: 79963 - RNA, 20 nt, Artificial Sequence
  MKO10079963_B_Cxcl17
  gRNA
auuucucaaacgaugucacc

SEQ ID NO: 79964 - RNA, 20 nt, Artificial Sequence
  MKO10079964_B_Cxcl17
  gRNA
gacaucguuugagaaauugc

SEQ ID NO: 79965 - RNA, 20 nt, Artificial Sequence
  MKO10079965_B_Cxcl17
  gRNA
uccagugaugcucaugucca

SEQ ID NO: 79966 - RNA, 20 nt, Artificial Sequence
  MKO10079966_B_Cxcl1
  gRNA
uucugaaccaagggagcuuc

SEQ ID NO: 79967 - RNA, 20 nt, Artificial Sequence
  MKO10079967_B_Cxcl1
  gRNA
caagaacauccagagcuuga

SEQ ID NO: 79968 - RNA, 20 nt, Artificial Sequence
  MKO10079968_B_Cxcl1
  gRNA
cugugcagcgcugcugcugc

SEQ ID NO: 79969 - RNA, 20 nt, Artificial Sequence
  MKO10079969_B_Cxcl2
  gRNA
uucugaaccaggggggcuuc

SEQ ID NO: 79970 - RNA, 20 nt, Artificial Sequence
  MKO10079970_B_Cxcl2
  gRNA
gaaucccaccuguagccugg

SEQ ID NO: 79971 - RNA, 20 nt, Artificial Sequence
  MKO10079971_B_Cxcl2
  gRNA
ccauggccccucccaccugc

SEQ ID NO: 79972 - RNA, 20 nt, Artificial Sequence
  MKO10079972_B_Cxcl3
  gRNA
uucuugaccauccuugagag

SEQ ID NO: 79973 - RNA, 20 nt, Artificial Sequence
  MKO10079973_B_Cxcl3
  gRNA
gaaucccaccuguagccugg

SEQ ID NO: 79974 - RNA, 20 nt, Artificial Sequence
  MKO10079974_B_Cxcl3
  gRNA
ccauggccccucccaccugc

SEQ ID NO: 79975 - RNA, 20 nt, Artificial Sequence
  MKO10079975_B_Cxcl5
  gRNA
acucacaugacuuccaccgu

SEQ ID NO: 79976 - RNA, 20 nt, Artificial Sequence
  MKO10079976_B_Cxcl5
  gRNA
gauccagacagaccuccuuc

SEQ ID NO: 79977 - RNA, 20 nt, Artificial Sequence
  MKO10079977_B_Cxcl5
  gRNA
ugcacucgcaguggaaagaa

SEQ ID NO: 79978 - RNA, 20 nt, Artificial Sequence
  MKO10079978_B_Cxcl9
  gRNA
auuuguaguggaucgugccu

SEQ ID NO: 79979 - RNA, 20 nt, Artificial Sequence
  MKO10079979_B_Cxcl9
  gRNA
uucuucacauuugccgaguc

SEQ ID NO: 79980 - RNA, 20 nt, Artificial Sequence
  MKO10079980_B_Cxcl9
  gRNA
cucgaacuccacacugcucc

SEQ ID NO: 79981 - RNA, 20 nt, Artificial Sequence
  MKO10079981_B_Cxcr1
  gRNA
cggggucugucccacauauu

SEQ ID NO: 79982 - RNA, 20 nt, Artificial Sequence
  MKO10079982_B_Cxcr1
  gRNA
auuuaaccaaguagcgcuuu

SEQ ID NO: 79983 - RNA, 20 nt, Artificial Sequence
  MKO10079983_B_Cxcr1
  gRNA
ugaugcugguuaucuuauac

SEQ ID NO: 79984 - RNA, 20 nt, Artificial Sequence
  MKO10079984_B_Cxcr2
  gRNA
gcgccgcgaugacauugaca

SEQ ID NO: 79985 - RNA, 20 nt, Artificial Sequence
  MKO10079985_B_Cxcr2
  gRNA
gacagcgaagaugacccgca

SEQ ID NO: 79986 - RNA, 20 nt, Artificial Sequence
  MKO10079986_B_Cxcr2
  gRNA
guaacaauacaucccguuug

SEQ ID NO: 79987 - RNA, 20 nt, Artificial Sequence
  MKO10079987_B_Cxcr3
  gRNA
agaacuuaccucaagguaca

SEQ ID NO: 79988 - RNA, 20 nt, Artificial Sequence
  MKO10079988_B_Cxcr3
  gRNA
ucauagcucgaaaacgccuc

SEQ ID NO: 79989 - RNA, 20 nt, Artificial Sequence
  MKO10079989_B_Cxcr3
  gRNA
acgccacccagaucuaccgc

SEQ ID NO: 79990 - RNA, 20 nt, Artificial Sequence
  MKO10079990_B_Cxcr4
  gRNA
caucuuugccgacgucagcc

SEQ ID NO: 79991 - RNA, 20 nt, Artificial Sequence
  MKO10079991_B_Cxcr4
  gRNA
cggcaauggauuggugaucc

SEQ ID NO: 79992 - RNA, 20 nt, Artificial Sequence
  MKO10079992_B_Cxcr4
  gRNA
acgucggcaaagaugaaguc

SEQ ID NO: 79993 - RNA, 20 nt, Artificial Sequence
  MKO10079993_B_Cxcr5
  gRNA
agcccauguccaggguuagu

SEQ ID NO: 79994 - RNA, 20 nt, Artificial Sequence
  MKO10079994_B_Cxcr5
  gRNA
cggcuuccuguucgccuuac

SEQ ID NO: 79995 - RNA, 20 nt, Artificial Sequence
  MKO10079995_B_Cxcr5
  gRNA
gagacuacucuugcgccagu

SEQ ID NO: 79996 - RNA, 20 nt, Artificial Sequence
  MKO10079996_B_Cxcr6
  gRNA
gucaugugcaaaacucuucg

SEQ ID NO: 79997 - RNA, 20 nt, Artificial Sequence
  MKO10079997_B_Cxcr6
  gRNA
uaaguuuccagacguucuuc

SEQ ID NO: 79998 - RNA, 20 nt, Artificial Sequence
  MKO10079998_B_Cxcr6
  gRNA
guucuccuggcuguuaucac

SEQ ID NO: 79999 - RNA, 20 nt, Artificial Sequence
  MKO10079999_B_Cxx1a
  gRNA
ccuguugugccugagcaugu

SEQ ID NO: 80000 - RNA, 20 nt, Artificial Sequence
  MKO10080000_B_Cxx1a
  gRNA
guucgggugggaggaggaug

SEQ ID NO: 80001 - RNA, 20 nt, Artificial Sequence
  MKO10080001_B_Cxx1a
  gRNA
ucggccucuuuaccuugccu

SEQ ID NO: 80002 - RNA, 20 nt, Artificial Sequence
  MKO10080002_B_Cxx1b
  gRNA
ccuguugugccugagcaugu

SEQ ID NO: 80003 - RNA, 20 nt, Artificial Sequence
  MKO10080003_B_Cxx1b
  gRNA
guucgggugggaggaggaug

SEQ ID NO: 80004 - RNA, 20 nt, Artificial Sequence
  MKO10080004_B_Cxx1b
  gRNA
ucggccucuuuaccuugccu

SEQ ID NO: 80005 - RNA, 20 nt, Artificial Sequence
  MKO10080005_B_Cxx1c
  gRNA
ccgagcugcguaaaggccgu

SEQ ID NO: 80006 - RNA, 20 nt, Artificial Sequence
  MKO10080006_B_Cxx1c
  gRNA
cuugcguuugucggugucga

SEQ ID NO: 80007 - RNA, 20 nt, Artificial Sequence
  MKO10080007_B_Cxx1c
  gRNA
gccggaguaauuguugagca

SEQ ID NO: 80008 - RNA, 20 nt, Artificial Sequence
  MKO10080008_B_Cxxc1
  gRNA
cacuucugccggaucuuguu

SEQ ID NO: 80009 - RNA, 20 nt, Artificial Sequence
  MKO10080009_B_Cxxc1
  gRNA
gaugugacaacugcaacgag

SEQ ID NO: 80010 - RNA, 20 nt, Artificial Sequence
  MKO10080010_B_Cxxc1
  gRNA
uuugcgacagaugcaguaga

SEQ ID NO: 80011 - RNA, 20 nt, Artificial Sequence
  MKO10080011_B_Cxxc4
  gRNA
aacgcuucagcgcugggaac

SEQ ID NO: 80012 - RNA, 20 nt, Artificial Sequence
  MKO10080012_B_Cxxc4
  gRNA
gguggugaugcgcgcgaucu

SEQ ID NO: 80013 - RNA, 20 nt, Artificial Sequence
  MKO10080013_B_Cxxc4
  gRNA
cugcgggaaggcgcccccgu

SEQ ID NO: 80014 - RNA, 20 nt, Artificial Sequence
  MKO10080014_B_Cxxc5
  gRNA
acugaaaucacugaaaccac

SEQ ID NO: 80015 - RNA, 20 nt, Artificial Sequence
  MKO10080015_B_Cxxc5
  gRNA
cguccugggagccaccgccg

SEQ ID NO: 80016 - RNA, 20 nt, Artificial Sequence
  MKO10080016_B_Cxxc5
  gRNA
ccaguccgacuuccccuauc

SEQ ID NO: 80017 - RNA, 20 nt, Artificial Sequence
  MKO10080017_B_Cyb561a3
  gRNA
gaaaagcuucucauugaugc

SEQ ID NO: 80018 - RNA, 20 nt, Artificial Sequence
  MKO10080018_B_Cyb561a3
  gRNA
uccagccccuguugcaugac

SEQ ID NO: 80019 - RNA, 20 nt, Artificial Sequence
  MKO10080019_B_Cyb561a3
  gRNA
aggagcucugacugauagac

SEQ ID NO: 80020 - RNA, 20 nt, Artificial Sequence
  MKO10080020_B_Cyb561d1
  gRNA
cuuggcgcaccugauagcuu

SEQ ID NO: 80021 - RNA, 20 nt, Artificial Sequence
  MKO10080021_B_Cyb561d1
  gRNA
cccuguguucauggccuugg

SEQ ID NO: 80022 - RNA, 20 nt, Artificial Sequence
  MKO10080022_B_Cyb561d1
  gRNA
gcaccguuacuguagccauc

SEQ ID NO: 80023 - RNA, 20 nt, Artificial Sequence
  MKO10080023_B_Cyb561d2
  gRNA
ugguaaagccuaacgccacg

SEQ ID NO: 80024 - RNA, 20 nt, Artificial Sequence
  MKO10080024_B_Cyb561d2
  gRNA
ucauuccaggucuguucucc

SEQ ID NO: 80025 - RNA, 20 nt, Artificial Sequence
  MKO10080025_B_Cyb561d2
  gRNA
uacagccagagacauaagaa

SEQ ID NO: 80026 - RNA, 20 nt, Artificial Sequence
  MKO10080026_B_Cyb561
  gRNA
ggugguugugcucuacaucu

SEQ ID NO: 80027 - RNA, 20 nt, Artificial Sequence
  MKO10080027_B_Cyb561
  gRNA
cuucgccuucaucaucgccc

SEQ ID NO: 80028 - RNA, 20 nt, Artificial Sequence
  MKO10080028_B_Cyb561
  gRNA
cuuaccccaauuuaaacagc

SEQ ID NO: 80029 - RNA, 20 nt, Artificial Sequence
  MKO10080029_B_Cyb5b
  gRNA
agcagaaccucuuccccgcc

SEQ ID NO: 80030 - RNA, 20 nt, Artificial Sequence
  MKO10080030_B_Cyb5b
  gRNA
ccaagaacaauucaugccaa

SEQ ID NO: 80031 - RNA, 20 nt, Artificial Sequence
  MKO10080031_B_Cyb5b
  gRNA
ccuuuggcaugaauuguucu

SEQ ID NO: 80032 - RNA, 20 nt, Artificial Sequence
  MKO10080032_B_Cyb5d1
  gRNA
acacccauagguccucgagc

SEQ ID NO: 80033 - RNA, 20 nt, Artificial Sequence
  MKO10080033_B_Cyb5d1
  gRNA
uauucuucaggugggggcuc

SEQ ID NO: 80034 - RNA, 20 nt, Artificial Sequence
  MKO10080034_B_Cyb5d1
  gRNA
acaaccagcucgaggaccua

SEQ ID NO: 80035 - RNA, 20 nt, Artificial Sequence
  MKO10080035_B_Cyb5d2
  gRNA
ucccaccaugcaauuccgag

SEQ ID NO: 80036 - RNA, 20 nt, Artificial Sequence
  MKO10080036_B_Cyb5d2
  gRNA
acccacuucagaacuaaccc

SEQ ID NO: 80037 - RNA, 20 nt, Artificial Sequence
  MKO10080037_B_Cyb5d2
  gRNA
agauacugacgcugcacaac

SEQ ID NO: 80038 - RNA, 20 nt, Artificial Sequence
  MKO10080038_B_Cyb5r1
  gRNA
uaccucucugcccgaauuga

SEQ ID NO: 80039 - RNA, 20 nt, Artificial Sequence
  MKO10080039_B_Cyb5r1
  gRNA
uggaguuccgggggccgagc

SEQ ID NO: 80040 - RNA, 20 nt, Artificial Sequence
  MKO10080040_B_Cyb5r1
  gRNA
ugaccagacugccaucaauu

SEQ ID NO: 80041 - RNA, 20 nt, Artificial Sequence
  MKO10080041_B_Cyb5r2
  gRNA
gcccucaccagaccaugucc

SEQ ID NO: 80042 - RNA, 20 nt, Artificial Sequence
  MKO10080042_B_Cyb5r2
  gRNA
cgccuguucuacaaugagcc

SEQ ID NO: 80043 - RNA, 20 nt, Artificial Sequence
  MKO10080043_B_Cyb5r2
  gRNA
uuaacaaugaauuggugauc

SEQ ID NO: 80044 - RNA, 20 nt, Artificial Sequence
  MKO10080044_B_Cyb5r3
  gRNA
acuugaugucgggguucucg

SEQ ID NO: 80045 - RNA, 20 nt, Artificial Sequence
  MKO10080045_B_Cyb5r3
  gRNA
cugguagaccaguagcccau

SEQ ID NO: 80046 - RNA, 20 nt, Artificial Sequence
  MKO10080046_B_Cyb5r3
  gRNA
agggaaaaugucucaguacc

SEQ ID NO: 80047 - RNA, 20 nt, Artificial Sequence
  MKO10080047_B_Cyb5r4
  gRNA
auuaaaaagaucuguuccau

SEQ ID NO: 80048 - RNA, 20 nt, Artificial Sequence
  MKO10080048_B_Cyb5r4
  gRNA
gugaagccugcuguuccaaa

SEQ ID NO: 80049 - RNA, 20 nt, Artificial Sequence
  MKO10080049_B_Cyb5r4
  gRNA
ccaaauacagacugucauga

SEQ ID NO: 80050 - RNA, 20 nt, Artificial Sequence
  MKO10080050_B_Cyb5rl
  gRNA
ccugcauguaccguaggaug

SEQ ID NO: 80051 - RNA, 20 nt, Artificial Sequence
  MKO10080051_B_Cyb5rl
  gRNA
cggcugcuucaagaccuucg

SEQ ID NO: 80052 - RNA, 20 nt, Artificial Sequence
  MKO10080052_B_Cyb5rl
  gRNA
ucauauaagaagcuuccgaa

SEQ ID NO: 80053 - RNA, 20 nt, Artificial Sequence
  MKO10080053_B_Cyb5
  gRNA
uuccccgaugauguauguuu

SEQ ID NO: 80054 - RNA, 20 nt, Artificial Sequence
  MKO10080054_B_Cyb5
  gRNA
uuucuaguugguggaccaac

SEQ ID NO: 80055 - RNA, 20 nt, Artificial Sequence
  MKO10080055_B_Cyb5
  gRNA
aucaaagauagccaagccuu

SEQ ID NO: 80056 - RNA, 20 nt, Artificial Sequence
  MKO10080056_B_Cyba
  gRNA
cugcuggacguuucacacag

SEQ ID NO: 80057 - RNA, 20 nt, Artificial Sequence
  MKO10080057_B_Cyba
  gRNA
uggccaagcagacggucccc

SEQ ID NO: 80058 - RNA, 20 nt, Artificial Sequence
  MKO10080058_B_Cyba
  gRNA
cccgaaaagcuucaccacag

SEQ ID NO: 80059 - RNA, 20 nt, Artificial Sequence
  MKO10080059_B_Cybb
  gRNA
cauauagucagcacuggcuc

SEQ ID NO: 80060 - RNA, 20 nt, Artificial Sequence
  MKO10080060_B_Cybb
  gRNA
ccagagucgggauuucugac

SEQ ID NO: 80061 - RNA, 20 nt, Artificial Sequence
  MKO10080061_B_Cybb
  gRNA
ucauccaagcuaccaucuua

SEQ ID NO: 80062 - RNA, 20 nt, Artificial Sequence
  MKO10080062_B_Cybrd1
  gRNA
uaacuggcacccggugcucg

SEQ ID NO: 80063 - RNA, 20 nt, Artificial Sequence
  MKO10080063_B_Cybrd1
  gRNA
uggcagucuguacacgauga

SEQ ID NO: 80064 - RNA, 20 nt, Artificial Sequence
  MKO10080064_B_Cybrd1
  gRNA
aauaagcuccgcccacagua

SEQ ID NO: 80065 - RNA, 20 nt, Artificial Sequence
  MKO10080065_B_Cyc1
  gRNA
ucgagaagggccagacuucg

SEQ ID NO: 80066 - RNA, 20 nt, Artificial Sequence
  MKO10080066_B_Cyc1
  gRNA
guguccuuguccucgaaguc

SEQ ID NO: 80067 - RNA, 20 nt, Artificial Sequence
  MKO10080067_B_Cyc1
  gRNA
ccguguagcacacucccacc

SEQ ID NO: 80068 - RNA, 20 nt, Artificial Sequence
  MKO10080068_B_Cycs
  gRNA
ggauacccugauggaguauu

SEQ ID NO: 80069 - RNA, 20 nt, Artificial Sequence
  MKO10080069_B_Cycs
  gRNA
gugugcccagugccacacug

SEQ ID NO: 80070 - RNA, 20 nt, Artificial Sequence
  MKO10080070_B_Cycs
  gRNA
uguaagagaauccagcagcc

SEQ ID NO: 80071 - RNA, 20 nt, Artificial Sequence
  MKO10080071_B_Cycu
  gRNA
uacuucacuucaugaggaug

SEQ ID NO: 80072 - RNA, 20 nt, Artificial Sequence
  MKO10080072_B_Cycu
  gRNA
gcauccguguaagaaaaucc

SEQ ID NO: 80073 - RNA, 20 nt, Artificial Sequence
  MKO10080073_B_Cycu
  gRNA
ccaaaucucuggggccucuu

SEQ ID NO: 80074 - RNA, 20 nt, Artificial Sequence
  MKO10080074_B_Cyfip1
  gRNA
gauacauuaccaugcuagag

SEQ ID NO: 80075 - RNA, 20 nt, Artificial Sequence
  MKO10080075_B_Cyfip1
  gRNA
ugaaauuuaugagaaaaccg

SEQ ID NO: 80076 - RNA, 20 nt, Artificial Sequence
  MKO10080076_B_Cyfip1
  gRNA
acagcaugacagcauacucu

SEQ ID NO: 80077 - RNA, 20 nt, Artificial Sequence
  MKO10080077_B_Cyfip2
  gRNA
cucgcuacagaagcgcucga

SEQ ID NO: 80078 - RNA, 20 nt, Artificial Sequence
  MKO10080078_B_Cyfip2
  gRNA
caucgagcgcuucuguagcg

SEQ ID NO: 80079 - RNA, 20 nt, Artificial Sequence
  MKO10080079_B_Cyfip2
  gRNA
acagcaugacugcauagucg

SEQ ID NO: 80080 - RNA, 20 nt, Artificial Sequence
  MKO10080080_B_Cygb
  gRNA
ggaaggcgguucaggcuacg

SEQ ID NO: 80081 - RNA, 20 nt, Artificial Sequence
  MKO10080081_B_Cygb
  gRNA
ccggcuguaugccaacugcg

SEQ ID NO: 80082 - RNA, 20 nt, Artificial Sequence
  MKO10080082_B_Cygb
  gRNA
cauucuggaggugaucgccg

SEQ ID NO: 80083 - RNA, 20 nt, Artificial Sequence
  MKO10080083_B_Cyhr1
  gRNA
acugaucucacaacgacagu

SEQ ID NO: 80084 - RNA, 20 nt, Artificial Sequence
  MKO10080084_B_Cyhr1
  gRNA
ugugcucacccgaccaagac

SEQ ID NO: 80085 - RNA, 20 nt, Artificial Sequence
  MKO10080085_B_Cyhr1
  gRNA
cagguaguugggccuauugc

SEQ ID NO: 80086 - RNA, 20 nt, Artificial Sequence
  MKO10080086_B_Cylc1
  gRNA
acugcaacuucuaauucuga

SEQ ID NO: 80087 - RNA, 20 nt, Artificial Sequence
  MKO10080087_B_Cylc1
  gRNA
aaacuucaaguucuuccugu

SEQ ID NO: 80088 - RNA, 20 nt, Artificial Sequence
  MKO10080088_B_Cylc1
  gRNA
ccagauaaaaagaagagauc

SEQ ID NO: 80089 - RNA, 20 nt, Artificial Sequence
  MKO10080089_B_Cylc2
  gRNA
gagcuguauuguucuguaac

SEQ ID NO: 80090 - RNA, 20 nt, Artificial Sequence
  MKO10080090_B_Cylc2
  gRNA
uggcauuucccaaaccacca

SEQ ID NO: 80091 - RNA, 20 nt, Artificial Sequence
  MKO10080091_B_Cylc2
  gRNA
gaccacuaaaaaagaaucca

SEQ ID NO: 80092 - RNA, 20 nt, Artificial Sequence
  MKO10080092_B_Cyld
  gRNA
cauuucuaggauaacccuau

SEQ ID NO: 80093 - RNA, 20 nt, Artificial Sequence
  MKO10080093_B_Cyld
  gRNA
ucucuuuaggaagaaggucg

SEQ ID NO: 80094 - RNA, 20 nt, Artificial Sequence
  MKO10080094_B_Cyld
  gRNA
gcagguugaaccucccccuu

SEQ ID NO: 80095 - RNA, 20 nt, Artificial Sequence
  MKO10080095_B_Cym
  gRNA
aagccccuguuuguccagua

SEQ ID NO: 80096 - RNA, 20 nt, Artificial Sequence
  MKO10080096_B_Cym
  gRNA
agaacaggucuugggccacc

SEQ ID NO: 80097 - RNA, 20 nt, Artificial Sequence
  MKO10080097_B_Cym
  gRNA
acuuacugugacagugucgu

SEQ ID NO: 80098 - RNA, 20 nt, Artificial Sequence
  MKO10080098_B_Cyp11a1
  gRNA
gucgauacucuucucaugcg

SEQ ID NO: 80099 - RNA, 20 nt, Artificial Sequence
  MKO10080099_B_Cyp11a1
  gRNA
aacauuaccgagaugcuggc

SEQ ID NO: 80100 - RNA, 20 nt, Artificial Sequence
  MKO10080100_B_Cyp11a1
  gRNA
gacuccucagaacuaagacc

SEQ ID NO: 80101 - RNA, 20 nt, Artificial Sequence
  MKO10080101_B_Cyp11b1
  gRNA
cagagggucguccacagucc

SEQ ID NO: 80102 - RNA, 20 nt, Artificial Sequence
  MKO10080102_B_Cyp11b1
  gRNA
caagaauguguaucgagagc

SEQ ID NO: 80103 - RNA, 20 nt, Artificial Sequence
  MKO10080103_B_Cyp11b1
  gRNA
guguucaacuauaccauaga

SEQ ID NO: 80104 - RNA, 20 nt, Artificial Sequence
  MKO10080104_B_Cyp11b2
  gRNA
cgccaucaaagcgaacucua

SEQ ID NO: 80105 - RNA, 20 nt, Artificial Sequence
  MKO10080105_B_Cyp11b2
  gRNA
caccgcugggagcguugaca

SEQ ID NO: 80106 - RNA, 20 nt, Artificial Sequence
  MKO10080106_B_Cyp11b2
  gRNA
uguccagcgagucaagcucu

SEQ ID NO: 80107 - RNA, 20 nt, Artificial Sequence
  MKO10080107_B_Cyp17a1
  gRNA
aggaaaaggcgucgccuuug

SEQ ID NO: 80108 - RNA, 20 nt, Artificial Sequence
  MKO10080108_B_Cyp17a1
  gRNA
ucaccucaggauugugcacc

SEQ ID NO: 80109 - RNA, 20 nt, Artificial Sequence
  MKO10080109_B_Cyp17a1
  gRNA
auauguccaccagaucgcug

SEQ ID NO: 80110 - RNA, 20 nt, Artificial Sequence
  MKO10080110_B_Cyp19a1
  gRNA
gggcgaagucaccgacaccu

SEQ ID NO: 80111 - RNA, 20 nt, Artificial Sequence
  MKO10080111_B_Cyp19a1
  gRNA
auugggccccucauuuccca

SEQ ID NO: 80112 - RNA, 20 nt, Artificial Sequence
  MKO10080112_B_Cyp19a1
  gRNA
caucuuauuguaguaguugc

SEQ ID NO: 80113 - RNA, 20 nt, Artificial Sequence
  MKO10080113_B_Cyp1a1
  gRNA
ggucaugguuaaccugccac

SEQ ID NO: 80114 - RNA, 20 nt, Artificial Sequence
  MKO10080114_B_Cyp1a1
  gRNA
uguaccugguaaccaacccu

SEQ ID NO: 80115 - RNA, 20 nt, Artificial Sequence
  MKO10080115_B_Cyp1a1
  gRNA
aggggacgaaggaugaaugc

SEQ ID NO: 80116 - RNA, 20 nt, Artificial Sequence
  MKO10080116_B_Cyp1a2
  gRNA
cgugcagaggaagauccaug

SEQ ID NO: 80117 - RNA, 20 nt, Artificial Sequence
  MKO10080117_B_Cyp1a2
  gRNA
acgagggacaccucacugaa

SEQ ID NO: 80118 - RNA, 20 nt, Artificial Sequence
  MKO10080118_B_Cyp1a2
  gRNA
aguucucgcugugcuugaac

SEQ ID NO: 80119 - RNA, 20 nt, Artificial Sequence
  MKO10080119_B_Cyp1b1
  gRNA
caaacggaggugcaucggug

SEQ ID NO: 80120 - RNA, 20 nt, Artificial Sequence
  MKO10080120_B_Cyp1b1
  gRNA
cuaggaacuccgcaucgucg

SEQ ID NO: 80121 - RNA, 20 nt, Artificial Sequence
  MKO10080121_B_Cyp1b1
  gRNA
cuggaagacgcagcgacgcu

SEQ ID NO: 80122 - RNA, 20 nt, Artificial Sequence
  MKO10080122_B_Cyp20a1
  gRNA
aagcaaaaccgagcauaugc

SEQ ID NO: 80123 - RNA, 20 nt, Artificial Sequence
  MKO10080123_B_Cyp20a1
  gRNA
cacgugaggaggaaacugua

SEQ ID NO: 80124 - RNA, 20 nt, Artificial Sequence
  MKO10080124_B_Cyp20a1
  gRNA
cuuccacuguuuacaauguc

SEQ ID NO: 80125 - RNA, 20 nt, Artificial Sequence
  MKO10080125_B_Cyp21a1
  gRNA
agucucgcaugcccagcauc

SEQ ID NO: 80126 - RNA, 20 nt, Artificial Sequence
  MKO10080126_B_Cyp21a1
  gRNA
cucucgcucagcccugaugc

SEQ ID NO: 80127 - RNA, 20 nt, Artificial Sequence
  MKO10080127_B_Cyp21a1
  gRNA
uccacagcgcaugcgagccc

SEQ ID NO: 80128 - RNA, 20 nt, Artificial Sequence
  MKO10080128_B_Cyp24a1
  gRNA
uguacagcgagcugaacaaa

SEQ ID NO: 80129 - RNA, 20 nt, Artificial Sequence
  MKO10080129_B_Cyp24a1
  gRNA
ucagcucgcuguacaagucu

SEQ ID NO: 80130 - RNA, 20 nt, Artificial Sequence
  MKO10080130_B_Cyp24a1
  gRNA
guccagcuucaugauuucca

SEQ ID NO: 80131 - RNA, 20 nt, Artificial Sequence
  MKO10080131_B_Cyp26a1
  gRNA
cuacgugcccgugaucgcug

SEQ ID NO: 80132 - RNA, 20 nt, Artificial Sequence
  MKO10080132_B_Cyp26a1
  gRNA
ccuuauacacgcgcgcaucg

SEQ ID NO: 80133 - RNA, 20 nt, Artificial Sequence
  MKO10080133_B_Cyp26a1
  gRNA
accgguuggugucggugcac

SEQ ID NO: 80134 - RNA, 20 nt, Artificial Sequence
  MKO10080134_B_Cyp26b1
  gRNA
cguccgaguagucuuugccc

SEQ ID NO: 80135 - RNA, 20 nt, Artificial Sequence
  MKO10080135_B_Cyp26b1
  gRNA
ccggcuuccagucgucgcgc

SEQ ID NO: 80136 - RNA, 20 nt, Artificial Sequence
  MKO10080136_B_Cyp26b1
  gRNA
ugugcuugcacuggccgucg

SEQ ID NO: 80137 - RNA, 20 nt, Artificial Sequence
  MKO10080137_B_Cyp26c1
  gRNA
cuacgucgacugcguaguca

SEQ ID NO: 80138 - RNA, 20 nt, Artificial Sequence
  MKO10080138_B_Cyp26c1
  gRNA
ucaccuuacgccguugccga

SEQ ID NO: 80139 - RNA, 20 nt, Artificial Sequence
  MKO10080139_B_Cyp26c1
  gRNA
cgaagcgcgaugcaccgagc

SEQ ID NO: 80140 - RNA, 20 nt, Artificial Sequence
  MKO10080140_B_Cyp27a1
  gRNA
ccagauggaguccggguauc

SEQ ID NO: 80141 - RNA, 20 nt, Artificial Sequence
  MKO10080141_B_Cyp27a1
  gRNA
gaaggaccaccgagaccaca

SEQ ID NO: 80142 - RNA, 20 nt, Artificial Sequence
  MKO10080142_B_Cyp27a1
  gRNA
cgcguccucugcugcccuuu

SEQ ID NO: 80143 - RNA, 20 nt, Artificial Sequence
  MKO10080143_B_Cyp27b1
  gRNA
ccaaagcugccagaccauau

SEQ ID NO: 80144 - RNA, 20 nt, Artificial Sequence
  MKO10080144_B_Cyp27b1
  gRNA
cgccgccaccagcgugcuug

SEQ ID NO: 80145 - RNA, 20 nt, Artificial Sequence
  MKO10080145_B_Cyp27b1
  gRNA
uuagucgucgcacaagguca

SEQ ID NO: 80146 - RNA, 20 nt, Artificial Sequence
  MKO10080146_B_Cyp2a12
  gRNA
gcagguacuucauaacugaa

SEQ ID NO: 80147 - RNA, 20 nt, Artificial Sequence
  MKO10080147_B_Cyp2a12
  gRNA
gaagcagaaccagaguaccc

SEQ ID NO: 80148 - RNA, 20 nt, Artificial Sequence
  MKO10080148_B_Cyp2a12
  gRNA
cuuuguccucauaguugaag

SEQ ID NO: 80149 - RNA, 20 nt, Artificial Sequence
  MKO10080149_B_Cyp2a22
  gRNA
gagucuguuaccugaccugu

SEQ ID NO: 80150 - RNA, 20 nt, Artificial Sequence
  MKO10080150_B_Cyp2a22
  gRNA
aaggagucaaugaagccucg

SEQ ID NO: 80151 - RNA, 20 nt, Artificial Sequence
  MKO10080151_B_Cyp2a22
  gRNA
aauugggguccaggguacug

SEQ ID NO: 80152 - RNA, 20 nt, Artificial Sequence
  MKO10080152_B_Cyp2a4
  gRNA
uccuguauucaccaucuauc

SEQ ID NO: 80153 - RNA, 20 nt, Artificial Sequence
  MKO10080153_B_Cyp2a4
  gRNA
gcuucuccaucaccacgcug

SEQ ID NO: 80154 - RNA, 20 nt, Artificial Sequence
  MKO10080154_B_Cyp2a4
  gRNA
ccaggcauagccuucagcag

SEQ ID NO: 80155 - RNA, 20 nt, Artificial Sequence
  MKO10080155_B_Cyp2a5
  gRNA
ccaggcguagccuucagcag

SEQ ID NO: 80156 - RNA, 20 nt, Artificial Sequence
  MKO10080156_B_Cyp2a5
  gRNA
gucacugcuucgaaugaugc

SEQ ID NO: 80157 - RNA, 20 nt, Artificial Sequence
  MKO10080157_B_Cyp2a5
  gRNA
gcaucauucgaagcagugac

SEQ ID NO: 80158 - RNA, 20 nt, Artificial Sequence
  MKO10080158_B_Cyp2ab1
  gRNA
agcccucaucaauucaaccc

SEQ ID NO: 80159 - RNA, 20 nt, Artificial Sequence
  MKO10080159_B_Cyp2ab1
  gRNA
auucgggcaagcugcucccc

SEQ ID NO: 80160 - RNA, 20 nt, Artificial Sequence
  MKO10080160_B_Cyp2ab1
  gRNA
aaccaucauccugcccaauc

SEQ ID NO: 80161 - RNA, 20 nt, Artificial Sequence
  MKO10080161_B_Cyp2b10
  gRNA
ugucguugagccaaccuuca

SEQ ID NO: 80162 - RNA, 20 nt, Artificial Sequence
  MKO10080162_B_Cyp2b10
  gRNA
uguagucgaggaguuccugc

SEQ ID NO: 80163 - RNA, 20 nt, Artificial Sequence
  MKO10080163_B_Cyp2b10
  gRNA
agucuuaccauauuccuuga

SEQ ID NO: 80164 - RNA, 20 nt, Artificial Sequence
  MKO10080164_B_Cyp2b13
  gRNA
ucaucgauaccuaucugcug

SEQ ID NO: 80165 - RNA, 20 nt, Artificial Sequence
  MKO10080165_B_Cyp2b13
  gRNA
aacuagcugagcugcagcaa

SEQ ID NO: 80166 - RNA, 20 nt, Artificial Sequence
  MKO10080166_B_Cyp2b13
  gRNA
uggcagcuucaagaaaaaca

SEQ ID NO: 80167 - RNA, 20 nt, Artificial Sequence
  MKO10080167_B_Cyp2b19
  gRNA
ugauaccuaccuucugcgca

SEQ ID NO: 80168 - RNA, 20 nt, Artificial Sequence
  MKO10080168_B_Cyp2b19
  gRNA
agaucagauuuagcagaugc

SEQ ID NO: 80169 - RNA, 20 nt, Artificial Sequence
  MKO10080169_B_Cyp2b19
  gRNA
uguagucaaggauuuccugc

SEQ ID NO: 80170 - RNA, 20 nt, Artificial Sequence
  MKO10080170_B_Cyp2b23
  gRNA
gagugccaggaaaguacuuc

SEQ ID NO: 80171 - RNA, 20 nt, Artificial Sequence
  MKO10080171_B_Cyp2b23
  gRNA
uaaccuucuccaugcgcaaa

SEQ ID NO: 80172 - RNA, 20 nt, Artificial Sequence
  MKO10080172_B_Cyp2b23
  gRNA
ucaccuuccaggagcccccc

SEQ ID NO: 80173 - RNA, 20 nt, Artificial Sequence
  MKO10080173_B_Cyp2b9
  gRNA
acauugauaccuaccuucug

SEQ ID NO: 80174 - RNA, 20 nt, Artificial Sequence
  MKO10080174_B_Cyp2b9
  gRNA
ucacucuuaagcucauucuc

SEQ ID NO: 80175 - RNA, 20 nt, Artificial Sequence
  MKO10080175_B_Cyp2b9
  gRNA
ucaauuccuccaccaaacau

SEQ ID NO: 80176 - RNA, 20 nt, Artificial Sequence
  MKO10080176_B_Cyp2c29
  gRNA
acucaugacccugcgaaauu

SEQ ID NO: 80177 - RNA, 20 nt, Artificial Sequence
  MKO10080177_B_Cyp2c29
  gRNA
ucacucauugacuauugucc

SEQ ID NO: 80178 - RNA, 20 nt, Artificial Sequence
  MKO10080178_B_Cyp2c29
  gRNA
uccccaugcccaaauuucgc

SEQ ID NO: 80179 - RNA, 20 nt, Artificial Sequence
  MKO10080179_B_Cyp2c37
  gRNA
aaaaauuguuuaugacuucc

SEQ ID NO: 80180 - RNA, 20 nt, Artificial Sequence
  MKO10080180_B_Cyp2c37
  gRNA
uucuaguuaucaaaaguuua

SEQ ID NO: 80181 - RNA, 20 nt, Artificial Sequence
  MKO10080181_B_Cyp2c37
  gRNA
aaauaaucaauaaagucacg

SEQ ID NO: 80182 - RNA, 20 nt, Artificial Sequence
  MKO10080182_B_Cyp2c38
  gRNA
aaauaaucgauaaagucacg

SEQ ID NO: 80183 - RNA, 20 nt, Artificial Sequence
  MKO10080183_B_Cyp2c38
  gRNA
uuuccugauuaaacaaaaac

SEQ ID NO: 80184 - RNA, 20 nt, Artificial Sequence
  MKO10080184_B_Cyp2c38
  gRNA
uccccaugcccaaauuccuu

SEQ ID NO: 80185 - RNA, 20 nt, Artificial Sequence
  MKO10080185_B_Cyp2c39
  gRNA
acucacgacccugcgaaauu

SEQ ID NO: 80186 - RNA, 20 nt, Artificial Sequence
  MKO10080186_B_Cyp2c39
  gRNA
uaauaaucaauaaaaucacg

SEQ ID NO: 80187 - RNA, 20 nt, Artificial Sequence
  MKO10080187_B_Cyp2c39
  gRNA
uuacuugauuaaacaaaaac

SEQ ID NO: 80188 - RNA, 20 nt, Artificial Sequence
  MKO10080188_B_Cyp2c40
  gRNA
cucuugcacuuuguucucaa

SEQ ID NO: 80189 - RNA, 20 nt, Artificial Sequence
  MKO10080189_B_Cyp2c40
  gRNA
aaauguauggaaagccacaa

SEQ ID NO: 80190 - RNA, 20 nt, Artificial Sequence
  MKO10080190_B_Cyp2c40
  gRNA
ugugauccccaauucaucau

SEQ ID NO: 80191 - RNA, 20 nt, Artificial Sequence
  MKO10080191_B_Cyp2c44
  gRNA
gaaucgcucguugaaaagga

SEQ ID NO: 80192 - RNA, 20 nt, Artificial Sequence
  MKO10080192_B_Cyp2c44
  gRNA
cuaucuucgauaaugggcag

SEQ ID NO: 80193 - RNA, 20 nt, Artificial Sequence
  MKO10080193_B_Cyp2c44
  gRNA
ggauccauauagaguucagu

SEQ ID NO: 80194 - RNA, 20 nt, Artificial Sequence
  MKO10080194_B_Cyp2c50
  gRNA
uuaggcauuauauuuaguaa

SEQ ID NO: 80195 - RNA, 20 nt, Artificial Sequence
  MKO10080195_B_Cyp2c50
  gRNA
gacaggagagggugaacacc

SEQ ID NO: 80196 - RNA, 20 nt, Artificial Sequence
  MKO10080196_B_Cyp2c50
  gRNA
uccuaguuaucaaaaguuua

SEQ ID NO: 80197 - RNA, 20 nt, Artificial Sequence
  MKO10080197_B_Cyp2c54
  gRNA
uuccagcaaagacaucccca

SEQ ID NO: 80198 - RNA, 20 nt, Artificial Sequence
  MKO10080198_B_Cyp2c54
  gRNA
uuaggcauuggauuuaguaa

SEQ ID NO: 80199 - RNA, 20 nt, Artificial Sequence
  MKO10080199_B_Cyp2c54
  gRNA
ccaagauucugagcaccccc

SEQ ID NO: 80200 - RNA, 20 nt, Artificial Sequence
  MKO10080200_B_Cyp2c55
  gRNA
gcuucucaaucaugaccuug

SEQ ID NO: 80201 - RNA, 20 nt, Artificial Sequence
  MKO10080201_B_Cyp2c55
  gRNA
cuuugacucaccugcaucca

SEQ ID NO: 80202 - RNA, 20 nt, Artificial Sequence
  MKO10080202_B_Cyp2c55
  gRNA
ucuuagcucuuccacaagac

SEQ ID NO: 80203 - RNA, 20 nt, Artificial Sequence
  MKO10080203_B_Cyp2c65
  gRNA
aaagaagccuuuacugauca

SEQ ID NO: 80204 - RNA, 20 nt, Artificial Sequence
  MKO10080204_B_Cyp2c65
  gRNA
aaaacagcaucaagagucac

SEQ ID NO: 80205 - RNA, 20 nt, Artificial Sequence
  MKO10080205_B_Cyp2c65
  gRNA
caaaaaguaauguucugcaa

SEQ ID NO: 80206 - RNA, 20 nt, Artificial Sequence
  MKO10080206_B_Cyp2c66
  gRNA
aauacagcauaaagagucac

SEQ ID NO: 80207 - RNA, 20 nt, Artificial Sequence
  MKO10080207_B_Cyp2c66
  gRNA
uucauuuaagaugucuauaa

SEQ ID NO: 80208 - RNA, 20 nt, Artificial Sequence
  MKO10080208_B_Cyp2c66
  gRNA
gcuaucauugauuaucuacc

SEQ ID NO: 80209 - RNA, 20 nt, Artificial Sequence
  MKO10080209_B_Cyp2c67
  gRNA
cuuccuaauucaaagauguc

SEQ ID NO: 80210 - RNA, 20 nt, Artificial Sequence
  MKO10080210_B_Cyp2c67
  gRNA
auugauugugaagacccuug

SEQ ID NO: 80211 - RNA, 20 nt, Artificial Sequence
  MKO10080211_B_Cyp2c67
  gRNA
uuaccugacaucuuugaauu

SEQ ID NO: 80212 - RNA, 20 nt, Artificial Sequence
  MKO10080212_B_Cyp2c68
  gRNA
uuugagcucuccugaguguc

SEQ ID NO: 80213 - RNA, 20 nt, Artificial Sequence
  MKO10080213_B_Cyp2c68
  gRNA
aaguaaucaacgaagucccg

SEQ ID NO: 80214 - RNA, 20 nt, Artificial Sequence
  MKO10080214_B_Cyp2c68
  gRNA
cuuggcuuuaccugacacuc

SEQ ID NO: 80215 - RNA, 20 nt, Artificial Sequence
  MKO10080215_B_Cyp2c69
  gRNA
uuagaaaccuugucaaaaaa

SEQ ID NO: 80216 - RNA, 20 nt, Artificial Sequence
  MKO10080216_B_Cyp2c69
  gRNA
cucuugcacuuuguucucaa

SEQ ID NO: 80217 - RNA, 20 nt, Artificial Sequence
  MKO10080217_B_Cyp2c69
  gRNA
ugugauccccaauucaucau

SEQ ID NO: 80218 - RNA, 20 nt, Artificial Sequence
  MKO10080218_B_Cyp2c70
  gRNA
cccagguauacaguaaacac

SEQ ID NO: 80219 - RNA, 20 nt, Artificial Sequence
  MKO10080219_B_Cyp2c70
  gRNA
ccgaaccaaaccugggacca

SEQ ID NO: 80220 - RNA, 20 nt, Artificial Sequence
  MKO10080220_B_Cyp2c70
  gRNA
ccagggagauaguauaaaau

SEQ ID NO: 80221 - RNA, 20 nt, Artificial Sequence
  MKO10080221_B_Cyp2d10
  gRNA
guacuuucugcauccugaug

SEQ ID NO: 80222 - RNA, 20 nt, Artificial Sequence
  MKO10080222_B_Cyp2d10
  gRNA
cgucagcuucaaaaccgcua

SEQ ID NO: 80223 - RNA, 20 nt, Artificial Sequence
  MKO10080223_B_Cyp2d10
  gRNA
agcccuuuaccuugggaucc

SEQ ID NO: 80224 - RNA, 20 nt, Artificial Sequence
  MKO10080224_B_Cyp2d11
  gRNA
ccaugaaggacuucugaccu

SEQ ID NO: 80225 - RNA, 20 nt, Artificial Sequence
  MKO10080225_B_Cyp2d11
  gRNA
cuucagcuucaaaaccgcua

SEQ ID NO: 80226 - RNA, 20 nt, Artificial Sequence
  MKO10080226_B_Cyp2d11
  gRNA
agcccuuuaccuugggaucc

SEQ ID NO: 80227 - RNA, 20 nt, Artificial Sequence
  MKO10080227_B_Cyp2d12
  gRNA
gguugugaucaacagaauga

SEQ ID NO: 80228 - RNA, 20 nt, Artificial Sequence
  MKO10080228_B_Cyp2d12
  gRNA
auaaccuguugacugaaaac

SEQ ID NO: 80229 - RNA, 20 nt, Artificial Sequence
  MKO10080229_B_Cyp2d12
  gRNA
ugaaggacuucugacuuugc

SEQ ID NO: 80230 - RNA, 20 nt, Artificial Sequence
  MKO10080230_B_Cyp2d22
  gRNA
gucaucguacucaaagcggc

SEQ ID NO: 80231 - RNA, 20 nt, Artificial Sequence
  MKO10080231_B_Cyp2d22
  gRNA
acgaugacccacgcuucauc

SEQ ID NO: 80232 - RNA, 20 nt, Artificial Sequence
  MKO10080232_B_Cyp2d22
  gRNA
guuucaccagugccucucgc

SEQ ID NO: 80233 - RNA, 20 nt, Artificial Sequence
  MKO10080233_B_Cyp2d26
  gRNA
gugucuacccugcgugacuu

SEQ ID NO: 80234 - RNA, 20 nt, Artificial Sequence
  MKO10080234_B_Cyp2d26
  gRNA
acaucacccaccggccuccu

SEQ ID NO: 80235 - RNA, 20 nt, Artificial Sequence
  MKO10080235_B_Cyp2d26
  gRNA
ccaaugcuacuacacauccc

SEQ ID NO: 80236 - RNA, 20 nt, Artificial Sequence
  MKO10080236_B_Cyp2d34
  gRNA
ggugugguccuugcaucuua

SEQ ID NO: 80237 - RNA, 20 nt, Artificial Sequence
  MKO10080237_B_Cyp2d34
  gRNA
gggauuugcucuuaaaaccu

SEQ ID NO: 80238 - RNA, 20 nt, Artificial Sequence
  MKO10080238_B_Cyp2d34
  gRNA
gucagcaguguccuugccac

SEQ ID NO: 80239 - RNA, 20 nt, Artificial Sequence
  MKO10080239_B_Cyp2d40
  gRNA
agucaccagcuuauccacca

SEQ ID NO: 80240 - RNA, 20 nt, Artificial Sequence
  MKO10080240_B_Cyp2d40
  gRNA
cgucuccaucucagccauaa

SEQ ID NO: 80241 - RNA, 20 nt, Artificial Sequence
  MKO10080241_B_Cyp2d40
  gRNA
cuuuccaggccgagugcaag

SEQ ID NO: 80242 - RNA, 20 nt, Artificial Sequence
  MKO10080242_B_Cyp2d9
  gRNA
gaaggcaucacagaggugau

SEQ ID NO: 80243 - RNA, 20 nt, Artificial Sequence
  MKO10080243_B_Cyp2d9
  gRNA
ugacguguucagccuacaga

SEQ ID NO: 80244 - RNA, 20 nt, Artificial Sequence
  MKO10080244_B_Cyp2d9
  gRNA
cagcaugggguugggauuga

SEQ ID NO: 80245 - RNA, 20 nt, Artificial Sequence
  MKO10080245_B_Cyp2e1
  gRNA
aggcgcaucgugguccugca

SEQ ID NO: 80246 - RNA, 20 nt, Artificial Sequence
  MKO10080246_B_Cyp2e1
  gRNA
aauauccgcaaugacauugc

SEQ ID NO: 80247 - RNA, 20 nt, Artificial Sequence
  MKO10080247_B_Cyp2e1
  gRNA
uuacgaugacaagaaguguc

SEQ ID NO: 80248 - RNA, 20 nt, Artificial Sequence
  MKO10080248_B_Cyp2f2
  gRNA
gucgguguucacgguguacc

SEQ ID NO: 80249 - RNA, 20 nt, Artificial Sequence
  MKO10080249_B_Cyp2f2
  gRNA
ccaggcaucgccuucuccga

SEQ ID NO: 80250 - RNA, 20 nt, Artificial Sequence
  MKO10080250_B_Cyp2f2
  gRNA
guccaaauccugcggaacuu

SEQ ID NO: 80251 - RNA, 20 nt, Artificial Sequence
  MKO10080251_B_Cyp2g1
  gRNA
uccccaucccaaaguuucga

SEQ ID NO: 80252 - RNA, 20 nt, Artificial Sequence
  MKO10080252_B_Cyp2g1
  gRNA
aggccagugguugucuuaug

SEQ ID NO: 80253 - RNA, 20 nt, Artificial Sequence
  MKO10080253_B_Cyp2g1
  gRNA
ugcaguuauaugauauguac

SEQ ID NO: 80254 - RNA, 20 nt, Artificial Sequence
  MKO10080254_B_Cyp2j11
  gRNA
ggagcaguguauacaagaag

SEQ ID NO: 80255 - RNA, 20 nt, Artificial Sequence
  MKO10080255_B_Cyp2j11
  gRNA
aaagcgcuccccaaagauga

SEQ ID NO: 80256 - RNA, 20 nt, Artificial Sequence
  MKO10080256_B_Cyp2j11
  gRNA
cugacaauacucaagaauuu

SEQ ID NO: 80257 - RNA, 20 nt, Artificial Sequence
  MKO10080257_B_Cyp2j12
  gRNA
uccauaauucaauauguucc

SEQ ID NO: 80258 - RNA, 20 nt, Artificial Sequence
  MKO10080258_B_Cyp2j12
  gRNA
cauugaugccuccaaacacg

SEQ ID NO: 80259 - RNA, 20 nt, Artificial Sequence
  MKO10080259_B_Cyp2j12
  gRNA
aaacgugucuuuaauaacaa

SEQ ID NO: 80260 - RNA, 20 nt, Artificial Sequence
  MKO10080260_B_Cyp2j13
  gRNA
aaaccguuccccaaagguga

SEQ ID NO: 80261 - RNA, 20 nt, Artificial Sequence
  MKO10080261_B_Cyp2j13
  gRNA
uugacaaucaccgcaaagac

SEQ ID NO: 80262 - RNA, 20 nt, Artificial Sequence
  MKO10080262_B_Cyp2j13
  gRNA
ggaggccucccaccuggugg

SEQ ID NO: 80263 - RNA, 20 nt, Artificial Sequence
  MKO10080263_B_Cyp2j5
  gRNA
ucaccaguggugguuguauc

SEQ ID NO: 80264 - RNA, 20 nt, Artificial Sequence
  MKO10080264_B_Cyp2j5
  gRNA
uuaugaggacugccaguuuc

SEQ ID NO: 80265 - RNA, 20 nt, Artificial Sequence
  MKO10080265_B_Cyp2j5
  gRNA
agcuucaaaugaggauuaaa

SEQ ID NO: 80266 - RNA, 20 nt, Artificial Sequence
  MKO10080266_B_Cyp2j6
  gRNA
cuuguaugauugaugaucac

SEQ ID NO: 80267 - RNA, 20 nt, Artificial Sequence
  MKO10080267_B_Cyp2j6
  gRNA
aaguuaugucaccaagauuc

SEQ ID NO: 80268 - RNA, 20 nt, Artificial Sequence
  MKO10080268_B_Cyp2j6
  gRNA
caucgggguuccagucuuuc

SEQ ID NO: 80269 - RNA, 20 nt, Artificial Sequence
  MKO10080269_B_Cyp2j8
  gRNA
aucauuuguuccaucacuau

SEQ ID NO: 80270 - RNA, 20 nt, Artificial Sequence
  MKO10080270_B_Cyp2j8
  gRNA
aaccuaauuagccuggauuu

SEQ ID NO: 80271 - RNA, 20 nt, Artificial Sequence
  MKO10080271_B_Cyp2j8
  gRNA
ugaugcuuuccuuacagaaa

SEQ ID NO: 80272 - RNA, 20 nt, Artificial Sequence
  MKO10080272_B_Cyp2j9
  gRNA
gcauugcugauauugaagug

SEQ ID NO: 80273 - RNA, 20 nt, Artificial Sequence
  MKO10080273_B_Cyp2j9
  gRNA
augccaguuauaaccacuga

SEQ ID NO: 80274 - RNA, 20 nt, Artificial Sequence
  MKO10080274_B_Cyp2j9
  gRNA
ggaagauacugaaguauccu

SEQ ID NO: 80275 - RNA, 20 nt, Artificial Sequence
  MKO10080275_B_Cyp2r1
  gRNA
uuguaaugucaugcccaacc

SEQ ID NO: 80276 - RNA, 20 nt, Artificial Sequence
  MKO10080276_B_Cyp2r1
  gRNA
aauccauccucuaccauauc

SEQ ID NO: 80277 - RNA, 20 nt, Artificial Sequence
  MKO10080277_B_Cyp2r1
  gRNA
auaucaacugucguucuaaa

SEQ ID NO: 80278 - RNA, 20 nt, Artificial Sequence
  MKO10080278_B_Cyp2s1
  gRNA
aauucacccugcucgcucua

SEQ ID NO: 80279 - RNA, 20 nt, Artificial Sequence
  MKO10080279_B_Cyp2s1
  gRNA
cuggaacucuuuaucgucau

SEQ ID NO: 80280 - RNA, 20 nt, Artificial Sequence
  MKO10080280_B_Cyp2s1
  gRNA
ccagggugcccaaguggugc

SEQ ID NO: 80281 - RNA, 20 nt, Artificial Sequence
  MKO10080281_B_Cyp2t4
  gRNA
cugggccucaccguuuccgc

SEQ ID NO: 80282 - RNA, 20 nt, Artificial Sequence
  MKO10080282_B_Cyp2t4
  gRNA
uuuaggagccuccggaacuc

SEQ ID NO: 80283 - RNA, 20 nt, Artificial Sequence
  MKO10080283_B_Cyp2t4
  gRNA
ucuguaucaugaguucccga

SEQ ID NO: 80284 - RNA, 20 nt, Artificial Sequence
  MKO10080284_B_Cyp2u1
  gRNA
cgaugaggacagaagucguc

SEQ ID NO: 80285 - RNA, 20 nt, Artificial Sequence
  MKO10080285_B_Cyp2u1
  gRNA
gcaucaggcucacgaacauc

SEQ ID NO: 80286 - RNA, 20 nt, Artificial Sequence
  MKO10080286_B_Cyp2u1
  gRNA
uguccgugagggaaggugca

SEQ ID NO: 80287 - RNA, 20 nt, Artificial Sequence
  MKO10080287_B_Cyp2w1
  gRNA
gagggcgggucgccaauuca

SEQ ID NO: 80288 - RNA, 20 nt, Artificial Sequence
  MKO10080288_B_Cyp2w1
  gRNA
gcggagaccacccuugccaa

SEQ ID NO: 80289 - RNA, 20 nt, Artificial Sequence
  MKO10080289_B_Cyp2w1
  gRNA
agcuucuacauaacucugcg

SEQ ID NO: 80290 - RNA, 20 nt, Artificial Sequence
  MKO10080290_B_Cyp39a1
  gRNA
uucaacacacaucacuuuac

SEQ ID NO: 80291 - RNA, 20 nt, Artificial Sequence
  MKO10080291_B_Cyp39a1
  gRNA
caguuaccugugugauagac

SEQ ID NO: 80292 - RNA, 20 nt, Artificial Sequence
  MKO10080292_B_Cyp39a1
  gRNA
ucgguuucccauagcaaaga

SEQ ID NO: 80293 - RNA, 20 nt, Artificial Sequence
  MKO10080293_B_Cyp3a11
  gRNA
cacugugcugaauuauuaca

SEQ ID NO: 80294 - RNA, 20 nt, Artificial Sequence
  MKO10080294_B_Cyp3a11
  gRNA
uccccacacagguuguuuga

SEQ ID NO: 80295 - RNA, 20 nt, Artificial Sequence
  MKO10080295_B_Cyp3a11
  gRNA
agcacauucuuaaucgucuc

SEQ ID NO: 80296 - RNA, 20 nt, Artificial Sequence
  MKO10080296_B_Cyp3a13
  gRNA
gcaagaaucguccccaagaa

SEQ ID NO: 80297 - RNA, 20 nt, Artificial Sequence
  MKO10080297_B_Cyp3a13
  gRNA
ugccaaugcagguuguauga

SEQ ID NO: 80298 - RNA, 20 nt, Artificial Sequence
  MKO10080298_B_Cyp3a13
  gRNA
uaccuccuugagccucccac

SEQ ID NO: 80299 - RNA, 20 nt, Artificial Sequence
  MKO10080299_B_Cyp3a16
  gRNA
augaaaaguauggaaaaacg

SEQ ID NO: 80300 - RNA, 20 nt, Artificial Sequence
  MKO10080300_B_Cyp3a16
  gRNA
aauaccucucuuugucauca

SEQ ID NO: 80301 - RNA, 20 nt, Artificial Sequence
  MKO10080301_B_Cyp3a16
  gRNA
cacuguccugaauuauuaca

SEQ ID NO: 80302 - RNA, 20 nt, Artificial Sequence
  MKO10080302_B_Cyp3a25
  gRNA
gaagauugcuauaaaaagua

SEQ ID NO: 80303 - RNA, 20 nt, Artificial Sequence
  MKO10080303_B_Cyp3a25
  gRNA
agcacaaucuugaugaucuc

SEQ ID NO: 80304 - RNA, 20 nt, Artificial Sequence
  MKO10080304_B_Cyp3a25
  gRNA
acagccuauauuggcuauca

SEQ ID NO: 80305 - RNA, 20 nt, Artificial Sequence
  MKO10080305_B_Cyp3a41a
  gRNA
augaaaaguauggaaaaaca

SEQ ID NO: 80306 - RNA, 20 nt, Artificial Sequence
  MKO10080306_B_Cyp3a41a
  gRNA
uuccuacacagguuguuuga

SEQ ID NO: 80307 - RNA, 20 nt, Artificial Sequence
  MKO10080307_B_Cyp3a41a
  gRNA
agaacauucuuaaucaucuc

SEQ ID NO: 80308 - RNA, 20 nt, Artificial Sequence
  MKO10080308_B_Cyp3a41b
  gRNA
ggguuuauggaaauuugaca

SEQ ID NO: 80309 - RNA, 20 nt, Artificial Sequence
  MKO10080309_B_Cyp3a41b
  gRNA
augaaaaguauggaaaaaca

SEQ ID NO: 80310 - RNA, 20 nt, Artificial Sequence
  MKO10080310_B_Cyp3a41b
  gRNA
uuccuacacagguuguuuga

SEQ ID NO: 80311 - RNA, 20 nt, Artificial Sequence
  MKO10080311_B_Cyp3a44
  gRNA
agauaugggacccguacaca

SEQ ID NO: 80312 - RNA, 20 nt, Artificial Sequence
  MKO10080312_B_Cyp3a44
  gRNA
uucagcacagugccuaaaaa

SEQ ID NO: 80313 - RNA, 20 nt, Artificial Sequence
  MKO10080313_B_Cyp3a44
  gRNA
augaaaaguauggaaaaaca

SEQ ID NO: 80314 - RNA, 20 nt, Artificial Sequence
  MKO10080314_B_Cyp3a57
  gRNA
uugauaauguugccaaauaa

SEQ ID NO: 80315 - RNA, 20 nt, Artificial Sequence
  MKO10080315_B_Cyp3a57
  gRNA
cuucaccaguagcaaacuca

SEQ ID NO: 80316 - RNA, 20 nt, Artificial Sequence
  MKO10080316_B_Cyp3a57
  gRNA
gaugauugcuauaaaaaaua

SEQ ID NO: 80317 - RNA, 20 nt, Artificial Sequence
  MKO10080317_B_Cyp3a59
  gRNA
ccaaauaaagguagagguuu

SEQ ID NO: 80318 - RNA, 20 nt, Artificial Sequence
  MKO10080318_B_Cyp3a59
  gRNA
aaagccuauauuggcuauca

SEQ ID NO: 80319 - RNA, 20 nt, Artificial Sequence
  MKO10080319_B_Cyp3a59
  gRNA
gaagauugcuauaaaaagua

SEQ ID NO: 80320 - RNA, 20 nt, Artificial Sequence
  MKO10080320_B_Cyp46a1
  gRNA
cucagucauugucacgaguc

SEQ ID NO: 80321 - RNA, 20 nt, Artificial Sequence
  MKO10080321_B_Cyp46a1
  gRNA
guccccagggcuaagaagua

SEQ ID NO: 80322 - RNA, 20 nt, Artificial Sequence
  MKO10080322_B_Cyp46a1
  gRNA
ugugcuccaagauguguuuc

SEQ ID NO: 80323 - RNA, 20 nt, Artificial Sequence
  MKO10080323_B_Cyp4a10
  gRNA
agccaugguuccagcacagg

SEQ ID NO: 80324 - RNA, 20 nt, Artificial Sequence
  MKO10080324_B_Cyp4a10
  gRNA
gaaaugugccuucagccaca

SEQ ID NO: 80325 - RNA, 20 nt, Artificial Sequence
  MKO10080325_B_Cyp4a10
  gRNA
cacauuucaugacagugucu

SEQ ID NO: 80326 - RNA, 20 nt, Artificial Sequence
  MKO10080326_B_Cyp4a12a
  gRNA
auauuccuaaccuguccaac

SEQ ID NO: 80327 - RNA, 20 nt, Artificial Sequence
  MKO10080327_B_Cyp4a12a
  gRNA
agaaucagcuucauguaguc

SEQ ID NO: 80328 - RNA, 20 nt, Artificial Sequence
  MKO10080328_B_Cyp4a12a
  gRNA
auaucagaucuuaaaggacc

SEQ ID NO: 80329 - RNA, 20 nt, Artificial Sequence
  MKO10080329_B_Cyp4a12b
  gRNA
auauuccugaccuguccaac

SEQ ID NO: 80330 - RNA, 20 nt, Artificial Sequence
  MKO10080330_B_Cyp4a12b
  gRNA
agaaucagcuucauguaguc

SEQ ID NO: 80331 - RNA, 20 nt, Artificial Sequence
  MKO10080331_B_Cyp4a12b
  gRNA
auaucagaucuuaaaggacc

SEQ ID NO: 80332 - RNA, 20 nt, Artificial Sequence
  MKO10080332_B_Cyp4a14
  gRNA
accacuucuucccauucaac

SEQ ID NO: 80333 - RNA, 20 nt, Artificial Sequence
  MKO10080333_B_Cyp4a14
  gRNA
agaucuccagaggguggucc

SEQ ID NO: 80334 - RNA, 20 nt, Artificial Sequence
  MKO10080334_B_Cyp4a14
  gRNA
cauccaacugaacacugccu

SEQ ID NO: 80335 - RNA, 20 nt, Artificial Sequence
  MKO10080335_B_Cyp4a29-ps
  gRNA
guggcaguucaaaguggaug

SEQ ID NO: 80336 - RNA, 20 nt, Artificial Sequence
  MKO10080336_B_Cyp4a29-ps
  gRNA
gucugccaugauccccacau

SEQ ID NO: 80337 - RNA, 20 nt, Artificial Sequence
  MKO10080337_B_Cyp4a29-ps
  gRNA
acaguuacauaccaagccaa

SEQ ID NO: 80338 - RNA, 20 nt, Artificial Sequence
  MKO10080338_B_Cyp4a30b-ps
  gRNA
ugauauccuuaagccuuaug

SEQ ID NO: 80339 - RNA, 20 nt, Artificial Sequence
  MKO10080339_B_Cyp4a30b-ps
  gRNA
agacauauccuugaugacca

SEQ ID NO: 80340 - RNA, 20 nt, Artificial Sequence
  MKO10080340_B_Cyp4a30b-ps
  gRNA
ccuacaguuucuuugcuccc

SEQ ID NO: 80341 - RNA, 20 nt, Artificial Sequence
  MKO10080341_B_Cyp4a31
  gRNA
uugcucccccagaaccaucg

SEQ ID NO: 80342 - RNA, 20 nt, Artificial Sequence
  MKO10080342_B_Cyp4a31
  gRNA
ggguuagcaucuuccggugc

SEQ ID NO: 80343 - RNA, 20 nt, Artificial Sequence
  MKO10080343_B_Cyp4a31
  gRNA
ucccaagugccuuuccucga

SEQ ID NO: 80344 - RNA, 20 nt, Artificial Sequence
  MKO10080344_B_Cyp4a32
  gRNA
ggguuagcauccuccggugc

SEQ ID NO: 80345 - RNA, 20 nt, Artificial Sequence
  MKO10080345_B_Cyp4a32
  gRNA
guguugaaaaaucucuauug

SEQ ID NO: 80346 - RNA, 20 nt, Artificial Sequence
  MKO10080346_B_Cyp4a32
  gRNA
ucuacagauugcuagcuccu

SEQ ID NO: 80347 - RNA, 20 nt, Artificial Sequence
  MKO10080347_B_Cyp4b1
  gRNA
gcuaaagcuguauacagccg

SEQ ID NO: 80348 - RNA, 20 nt, Artificial Sequence
  MKO10080348_B_Cyp4b1
  gRNA
ucauacacauaugcagccuu

SEQ ID NO: 80349 - RNA, 20 nt, Artificial Sequence
  MKO10080349_B_Cyp4b1
  gRNA
uuucucaggaaaaggccuac

SEQ ID NO: 80350 - RNA, 20 nt, Artificial Sequence
  MKO10080350_B_Cyp4f13
  gRNA
acacagguccaacccaagag

SEQ ID NO: 80351 - RNA, 20 nt, Artificial Sequence
  MKO10080351_B_Cyp4f13
  gRNA
acuugucaccagcacucauc

SEQ ID NO: 80352 - RNA, 20 nt, Artificial Sequence
  MKO10080352_B_Cyp4f13
  gRNA
caggugucagcaggcgucgg

SEQ ID NO: 80353 - RNA, 20 nt, Artificial Sequence
  MKO10080353_B_Cyp4f14
  gRNA
uucagauggcagugcccguc

SEQ ID NO: 80354 - RNA, 20 nt, Artificial Sequence
  MKO10080354_B_Cyp4f14
  gRNA
gugucagcaugcgacgaugg

SEQ ID NO: 80355 - RNA, 20 nt, Artificial Sequence
  MKO10080355_B_Cyp4f14
  gRNA
ucuacagcauccuaaagccu

SEQ ID NO: 80356 - RNA, 20 nt, Artificial Sequence
  MKO10080356_B_Cyp4f15
  gRNA
acccaagaaccaauuccauu

SEQ ID NO: 80357 - RNA, 20 nt, Artificial Sequence
  MKO10080357_B_Cyp4f15
  gRNA
gagacucacaugcauuaugu

SEQ ID NO: 80358 - RNA, 20 nt, Artificial Sequence
  MKO10080358_B_Cyp4f15
  gRNA
caggacacgggccaagagcc

SEQ ID NO: 80359 - RNA, 20 nt, Artificial Sequence
  MKO10080359_B_Cyp4f16
  gRNA
uccacuugucaccugaacuc

SEQ ID NO: 80360 - RNA, 20 nt, Artificial Sequence
  MKO10080360_B_Cyp4f16
  gRNA
cguaaaaaugucauguccuu

SEQ ID NO: 80361 - RNA, 20 nt, Artificial Sequence
  MKO10080361_B_Cyp4f16
  gRNA
acucacccagccagggcuuc

SEQ ID NO: 80362 - RNA, 20 nt, Artificial Sequence
  MKO10080362_B_Cyp4f17
  gRNA
gguggucagacgcugccacu

SEQ ID NO: 80363 - RNA, 20 nt, Artificial Sequence
  MKO10080363_B_Cyp4f17
  gRNA
aacugccugucuggacaugu

SEQ ID NO: 80364 - RNA, 20 nt, Artificial Sequence
  MKO10080364_B_Cyp4f17
  gRNA
ccucccaggggauggacugu

SEQ ID NO: 80365 - RNA, 20 nt, Artificial Sequence
  MKO10080365_B_Cyp4f18
  gRNA
accagcuuuaguugccccca

SEQ ID NO: 80366 - RNA, 20 nt, Artificial Sequence
  MKO10080366_B_Cyp4f18
  gRNA
cuaggccaaguggcagcgcc

SEQ ID NO: 80367 - RNA, 20 nt, Artificial Sequence
  MKO10080367_B_Cyp4f18
  gRNA
ugucaccaguacucaucaag

SEQ ID NO: 80368 - RNA, 20 nt, Artificial Sequence
  MKO10080368_B_Cyp4f37
  gRNA
uucucagauugagcacaaug

SEQ ID NO: 80369 - RNA, 20 nt, Artificial Sequence
  MKO10080369_B_Cyp4f37
  gRNA
uccacuugucaccugaauuc

SEQ ID NO: 80370 - RNA, 20 nt, Artificial Sequence
  MKO10080370_B_Cyp4f37
  gRNA
gaugggcucuuccugaauuc

SEQ ID NO: 80371 - RNA, 20 nt, Artificial Sequence
  MKO10080371_B_Cyp4f39
  gRNA
gauggacuucugaucagcaa

SEQ ID NO: 80372 - RNA, 20 nt, Artificial Sequence
  MKO10080372_B_Cyp4f39
  gRNA
caccaugcaccacaucaucc

SEQ ID NO: 80373 - RNA, 20 nt, Artificial Sequence
  MKO10080373_B_Cyp4f39
  gRNA
cucccuuacaggcuaaaugg

SEQ ID NO: 80374 - RNA, 20 nt, Artificial Sequence
  MKO10080374_B_Cyp4f40
  gRNA
cgaucuguccucagcgccuc

SEQ ID NO: 80375 - RNA, 20 nt, Artificial Sequence
  MKO10080375_B_Cyp4f40
  gRNA
cuguagaagaugucguccuu

SEQ ID NO: 80376 - RNA, 20 nt, Artificial Sequence
  MKO10080376_B_Cyp4f40
  gRNA
gcauuucugcaaagugucca

SEQ ID NO: 80377 - RNA, 20 nt, Artificial Sequence
  MKO10080377_B_Cyp4v3
  gRNA
cugccuuauaaagugccacc

SEQ ID NO: 80378 - RNA, 20 nt, Artificial Sequence
  MKO10080378_B_Cyp4v3
  gRNA
ugggacuaggacuucuuaca

SEQ ID NO: 80379 - RNA, 20 nt, Artificial Sequence
  MKO10080379_B_Cyp4v3
  gRNA
uuuaucaauuugcuuagaac

SEQ ID NO: 80380 - RNA, 20 nt, Artificial Sequence
  MKO10080380_B_Cyp4x1
  gRNA
aaaaccauguguggacacga

SEQ ID NO: 80381 - RNA, 20 nt, Artificial Sequence
  MKO10080381_B_Cyp4x1
  gRNA
gcagcgguguuggaaccacc

SEQ ID NO: 80382 - RNA, 20 nt, Artificial Sequence
  MKO10080382_B_Cyp4x1
  gRNA
acauaccaaugcauggaguc

SEQ ID NO: 80383 - RNA, 20 nt, Artificial Sequence
  MKO10080383_B_Cyp51
  gRNA
uagaagucaacucaacgaga

SEQ ID NO: 80384 - RNA, 20 nt, Artificial Sequence
  MKO10080384_B_Cyp51
  gRNA
caagaccuucacuuaccuuc

SEQ ID NO: 80385 - RNA, 20 nt, Artificial Sequence
  MKO10080385_B_Cyp51
  gRNA
gaaaaguccaauugaguuuc

SEQ ID NO: 80386 - RNA, 20 nt, Artificial Sequence
  MKO10080386_B_Cyp7a1
  gRNA
ggauccaagugcauuaacug

SEQ ID NO: 80387 - RNA, 20 nt, Artificial Sequence
  MKO10080387_B_Cyp7a1
  gRNA
ucauuacacuacuucugcga

SEQ ID NO: 80388 - RNA, 20 nt, Artificial Sequence
  MKO10080388_B_Cyp7a1
  gRNA
caagcauaccuaguacuggc

SEQ ID NO: 80389 - RNA, 20 nt, Artificial Sequence
  MKO10080389_B_Cyp7b1
  gRNA
caagcuguccaauuguucuc

SEQ ID NO: 80390 - RNA, 20 nt, Artificial Sequence
  MKO10080390_B_Cyp7b1
  gRNA
cagcaucauccgagaagugc

SEQ ID NO: 80391 - RNA, 20 nt, Artificial Sequence
  MKO10080391_B_Cyp7b1
  gRNA
uuuggagcaucgaagauuuc

SEQ ID NO: 80392 - RNA, 20 nt, Artificial Sequence
  MKO10080392_B_Cyp8b1
  gRNA
gagccaccuuaucuccgcga

SEQ ID NO: 80393 - RNA, 20 nt, Artificial Sequence
  MKO10080393_B_Cyp8b1
  gRNA
uccucaacccggauggcacc

SEQ ID NO: 80394 - RNA, 20 nt, Artificial Sequence
  MKO10080394_B_Cyp8b1
  gRNA
cgugaagacauccccgugcu

SEQ ID NO: 80395 - RNA, 20 nt, Artificial Sequence
  MKO10080395_B_Cypt10
  gRNA
uuuggacccauucggagucu

SEQ ID NO: 80396 - RNA, 20 nt, Artificial Sequence
  MKO10080396_B_Cypt10
  gRNA
gccaacuccuagacuccgaa

SEQ ID NO: 80397 - RNA, 20 nt, Artificial Sequence
  MKO10080397_B_Cypt10
  gRNA
ccaauucuccauucggagcc

SEQ ID NO: 80398 - RNA, 20 nt, Artificial Sequence
  MKO10080398_B_Cypt12
  gRNA
guagagcuuccuauggucga

SEQ ID NO: 80399 - RNA, 20 nt, Artificial Sequence
  MKO10080399_B_Cypt12
  gRNA
ugcgacgacgcgaagcacgu

SEQ ID NO: 80400 - RNA, 20 nt, Artificial Sequence
  MKO10080400_B_Cypt12
  gRNA
aagcugacauucucauucac

SEQ ID NO: 80401 - RNA, 20 nt, Artificial Sequence
  MKO10080401_B_Cypt14
  gRNA
guuacuucagauaacaggaa

SEQ ID NO: 80402 - RNA, 20 nt, Artificial Sequence
  MKO10080402_B_Cypt14
  gRNA
guugcucgugcauaggcagu

SEQ ID NO: 80403 - RNA, 20 nt, Artificial Sequence
  MKO10080403_B_Cypt14
  gRNA
agccuuacauuucuuuggcu

SEQ ID NO: 80404 - RNA, 20 nt, Artificial Sequence
  MKO10080404_B_Cypt15
  gRNA
cucauucacuuacugguagg

SEQ ID NO: 80405 - RNA, 20 nt, Artificial Sequence
  MKO10080405_B_Cypt15
  gRNA
gagcaccaguauggcacaug

SEQ ID NO: 80406 - RNA, 20 nt, Artificial Sequence
  MKO10080406_B_Cypt15
  gRNA
guugcccgugcauaggcagu

SEQ ID NO: 80407 - RNA, 20 nt, Artificial Sequence
  MKO10080407_B_Cypt1
  gRNA
cuucucaagcuucgaaauuu

SEQ ID NO: 80408 - RNA, 20 nt, Artificial Sequence
  MKO10080408_B_Cypt1
  gRNA
gaucgaaccggaaccgacca

SEQ ID NO: 80409 - RNA, 20 nt, Artificial Sequence
  MKO10080409_B_Cypt1
  gRNA
uccaaagccauggucgguuc

SEQ ID NO: 80410 - RNA, 20 nt, Artificial Sequence
  MKO10080410_B_Cypt2
  gRNA
uuuauucguucucguuccug

SEQ ID NO: 80411 - RNA, 20 nt, Artificial Sequence
  MKO10080411_B_Cypt2
  gRNA
ucgauugaugcagagccacc

SEQ ID NO: 80412 - RNA, 20 nt, Artificial Sequence
  MKO10080412_B_Cypt2
  gRNA
aagcuggccaagucuacauu

SEQ ID NO: 80413 - RNA, 20 nt, Artificial Sequence
  MKO10080413_B_Cypt3
  gRNA
accuggucacugucaaugca

SEQ ID NO: 80414 - RNA, 20 nt, Artificial Sequence
  MKO10080414_B_Cypt3
  gRNA
cugaaaaagagaacgaauua

SEQ ID NO: 80415 - RNA, 20 nt, Artificial Sequence
  MKO10080415_B_Cypt3
  gRNA
uccaaagccauagucgguuc

SEQ ID NO: 80416 - RNA, 20 nt, Artificial Sequence
  MKO10080416_B_Cypt4
  gRNA
gccaggucucugucgaggua

SEQ ID NO: 80417 - RNA, 20 nt, Artificial Sequence
  MKO10080417_B_Cypt4
  gRNA
gagcuccgcuaugacucggg

SEQ ID NO: 80418 - RNA, 20 nt, Artificial Sequence
  MKO10080418_B_Cypt4
  gRNA
acgagaaugagaacgaauua

SEQ ID NO: 80419 - RNA, 20 nt, Artificial Sequence
  MKO10080419_B_Cypt7
  gRNA
cugcugcugcgcuagaccag

SEQ ID NO: 80420 - RNA, 20 nt, Artificial Sequence
  MKO10080420_B_Cypt7
  gRNA
gacagugacccauuuccgaa

SEQ ID NO: 80421 - RNA, 20 nt, Artificial Sequence
  MKO10080421_B_Cypt7
  gRNA
gccaguuccuagaccccgaa

SEQ ID NO: 80422 - RNA, 20 nt, Artificial Sequence
  MKO10080422_B_Cypt8
  gRNA
cugcugcugcgcuagaccag

SEQ ID NO: 80423 - RNA, 20 nt, Artificial Sequence
  MKO10080423_B_Cypt8
  gRNA
gacagugacccauuuccgaa

SEQ ID NO: 80424 - RNA, 20 nt, Artificial Sequence
  MKO10080424_B_Cypt8
  gRNA
gccaguuccuagaccccgaa

SEQ ID NO: 80425 - RNA, 20 nt, Artificial Sequence
  MKO10080425_B_Cypt9
  gRNA
uuuggacccauucggagucu

SEQ ID NO: 80426 - RNA, 20 nt, Artificial Sequence
  MKO10080426_B_Cypt9
  gRNA
gccaacuccuagacuccgaa

SEQ ID NO: 80427 - RNA, 20 nt, Artificial Sequence
  MKO10080427_B_Cypt9
  gRNA
ccaauucuccauucggagcc

SEQ ID NO: 80428 - RNA, 20 nt, Artificial Sequence
  MKO10080428_B_Cyr61
  gRNA
cugcgcuaaacaacucaacg

SEQ ID NO: 80429 - RNA, 20 nt, Artificial Sequence
  MKO10080429_B_Cyr61
  gRNA
aacaaugaguuaaucgcaau

SEQ ID NO: 80430 - RNA, 20 nt, Artificial Sequence
  MKO10080430_B_Cyr61
  gRNA
gcaucguucagaccacgucu

SEQ ID NO: 80431 - RNA, 20 nt, Artificial Sequence
  MKO10080431_B_Cys1
  gRNA
cgacugccccucgggucucu

SEQ ID NO: 80432 - RNA, 20 nt, Artificial Sequence
  MKO10080432_B_Cys1
  gRNA
uugccuuuaaccuucuucuc

SEQ ID NO: 80433 - RNA, 20 nt, Artificial Sequence
  MKO10080433_B_Cys1
  gRNA
caagguguccccagagaaga

SEQ ID NO: 80434 - RNA, 20 nt, Artificial Sequence
  MKO10080434_B_Cysltr1
  gRNA
ccuauagccuuccuacgacu

SEQ ID NO: 80435 - RNA, 20 nt, Artificial Sequence
  MKO10080435_B_Cysltr1
  gRNA
aaagccagguucguuugcau

SEQ ID NO: 80436 - RNA, 20 nt, Artificial Sequence
  MKO10080436_B_Cysltr1
  gRNA
aauuccaaugcaaacgaacc

SEQ ID NO: 80437 - RNA, 20 nt, Artificial Sequence
  MKO10080437_B_Cysltr2
  gRNA
cccccagcaguuauaguaac

SEQ ID NO: 80438 - RNA, 20 nt, Artificial Sequence
  MKO10080438_B_Cysltr2
  gRNA
uccacgugcugcucauagga

SEQ ID NO: 80439 - RNA, 20 nt, Artificial Sequence
  MKO10080439_B_Cysltr2
  gRNA
gccuuccuaugagcagcacg

SEQ ID NO: 80440 - RNA, 20 nt, Artificial Sequence
  MKO10080440_B_Cystm1
  gRNA
ccccuccccaguguacauuu

SEQ ID NO: 80441 - RNA, 20 nt, Artificial Sequence
  MKO10080441_B_Cystm1
  gRNA
acgcgccuaccuguggucuu

SEQ ID NO: 80442 - RNA, 20 nt, Artificial Sequence
  MKO10080442_B_Cystm1
  gRNA
ccacccugccagccguacug

SEQ ID NO: 80443 - RNA, 20 nt, Artificial Sequence
  MKO10080443_B_Cyth1
  gRNA
gcagcuccugcuuccuccgc

SEQ ID NO: 80444 - RNA, 20 nt, Artificial Sequence
  MKO10080444_B_Cyth1
  gRNA
guuaaauuucuuucugccca

SEQ ID NO: 80445 - RNA, 20 nt, Artificial Sequence
  MKO10080445_B_Cyth1
  gRNA
ugcuaaugaaauugaaagcc

SEQ ID NO: 80446 - RNA, 20 nt, Artificial Sequence
  MKO10080446_B_Cyth2
  gRNA
guucaugcuccaccaagaau

SEQ ID NO: 80447 - RNA, 20 nt, Artificial Sequence
  MKO10080447_B_Cyth2
  gRNA
ugaguucaccgaccucaacc

SEQ ID NO: 80448 - RNA, 20 nt, Artificial Sequence
  MKO10080448_B_Cyth2
  gRNA
uuugcaguaagaccuugcag

SEQ ID NO: 80449 - RNA, 20 nt, Artificial Sequence
  MKO10080449_B_Cyth3
  gRNA
accucuccuccacugaaguc

SEQ ID NO: 80450 - RNA, 20 nt, Artificial Sequence
  MKO10080450_B_Cyth3
  gRNA
gauugacaaccugacuucag

SEQ ID NO: 80451 - RNA, 20 nt, Artificial Sequence
  MKO10080451_B_Cyth3
  gRNA
ccaauagcaaaacuacucag

SEQ ID NO: 80452 - RNA, 20 nt, Artificial Sequence
  MKO10080452_B_Cyth4
  gRNA
ggcgauguccuggacaucag

SEQ ID NO: 80453 - RNA, 20 nt, Artificial Sequence
  MKO10080453_B_Cyth4
  gRNA
ccuucucuuucugcgccauc

SEQ ID NO: 80454 - RNA, 20 nt, Artificial Sequence
  MKO10080454_B_Cyth4
  gRNA
ccggauggcgcagaaagaga

SEQ ID NO: 80455 - RNA, 20 nt, Artificial Sequence
  MKO10080455_B_Cytip
  gRNA
aagcaggacaauggaacauu

SEQ ID NO: 80456 - RNA, 20 nt, Artificial Sequence
  MKO10080456_B_Cytip
  gRNA
uuagcagauuuccugaugau

SEQ ID NO: 80457 - RNA, 20 nt, Artificial Sequence
  MKO10080457_B_Cytip
  gRNA
cacuaugaucugcaaagugc

SEQ ID NO: 80458 - RNA, 20 nt, Artificial Sequence
  MKO10080458_B_Cytl1
  gRNA
ggucagcauccgagaguagc

SEQ ID NO: 80459 - RNA, 20 nt, Artificial Sequence
  MKO10080459_B_Cytl1
  gRNA
ggccgaaguggacacucuga

SEQ ID NO: 80460 - RNA, 20 nt, Artificial Sequence
  MKO10080460_B_Cytl1
  gRNA
ccggggcaaguaccucacac

SEQ ID NO: 80461 - RNA, 20 nt, Artificial Sequence
  MKO10080461_B_Cyyr1
  gRNA
acucuuugccacacugcgcc

SEQ ID NO: 80462 - RNA, 20 nt, Artificial Sequence
  MKO10080462_B_Cyyr1
  gRNA
ugcuccuacuacgccuauau

SEQ ID NO: 80463 - RNA, 20 nt, Artificial Sequence
  MKO10080463_B_Cyyr1
  gRNA
cuauacuuaugaccacgaga

SEQ ID NO: 80464 - RNA, 20 nt, Artificial Sequence
  MKO10080464_B_D030056L22Rik
  gRNA
uaaagcagccugaagaguuu

SEQ ID NO: 80465 - RNA, 20 nt, Artificial Sequence
  MKO10080465_B_D030056L22Rik
  gRNA
uaccuggcugugcaccccgu

SEQ ID NO: 80466 - RNA, 20 nt, Artificial Sequence
  MKO10080466_B_D030056L22Rik
  gRNA
gcaggaggaaccccgggccg

SEQ ID NO: 80467 - RNA, 20 nt, Artificial Sequence
  MKO10080467_B_D10Bwg1379e
  gRNA
acaugcuuuggcaggaaugc

SEQ ID NO: 80468 - RNA, 20 nt, Artificial Sequence
  MKO10080468_B_D10Bwg1379e
  gRNA
gcauuccugccaaagcaugu

SEQ ID NO: 80469 - RNA, 20 nt, Artificial Sequence
  MKO10080469_B_D10Bwg1379e
  gRNA
ggaucuucacaacagugucc

SEQ ID NO: 80470 - RNA, 20 nt, Artificial Sequence
  MKO10080470_B_D10Jhu81e
  gRNA
uggucaaucacgugcaucug

SEQ ID NO: 80471 - RNA, 20 nt, Artificial Sequence
  MKO10080471_B_D10Jhu81e
  gRNA
caccuacccaaugggcuucu

SEQ ID NO: 80472 - RNA, 20 nt, Artificial Sequence
  MKO10080472_B_D10Jhu81e
  gRNA
ccgaggcaagauuaccagcc

SEQ ID NO: 80473 - RNA, 20 nt, Artificial Sequence
  MKO10080473_B_D10Wsu102e
  gRNA
gucuucuguagccugcucgc

SEQ ID NO: 80474 - RNA, 20 nt, Artificial Sequence
  MKO10080474_B_D10Wsu102e
  gRNA
ccgaacuguuugaaguguag

SEQ ID NO: 80475 - RNA, 20 nt, Artificial Sequence
  MKO10080475_B_D10Wsu102e
  gRNA
ucaauauugaagugaccagc

SEQ ID NO: 80476 - RNA, 20 nt, Artificial Sequence
  MKO10080476_B_D11Wsu47e
  gRNA
ggucucacgaugcucuucgc

SEQ ID NO: 80477 - RNA, 20 nt, Artificial Sequence
  MKO10080477_B_D11Wsu47e
  gRNA
cacauaccgcccucgaacuu

SEQ ID NO: 80478 - RNA, 20 nt, Artificial Sequence
  MKO10080478_B_D11Wsu47e
  gRNA
acuuuauccugugcuguaac

SEQ ID NO: 80479 - RNA, 20 nt, Artificial Sequence
  MKO10080479_B_D130040H23Rik
  gRNA
ucaugucacaguugucuuug

SEQ ID NO: 80480 - RNA, 20 nt, Artificial Sequence
  MKO10080480_B_D130040H23Rik
  gRNA
gcacaacacagucaucuuca

SEQ ID NO: 80481 - RNA, 20 nt, Artificial Sequence
  MKO10080481_B_D130040H23Rik
  gRNA
aagacuacugugacauauaa

SEQ ID NO: 80482 - RNA, 20 nt, Artificial Sequence
  MKO10080482_B_D130043K22Rik
  gRNA
uagcccagugaggacuguac

SEQ ID NO: 80483 - RNA, 20 nt, Artificial Sequence
  MKO10080483_B_D130043K22Rik
  gRNA
ccuaccaguacaguccucac

SEQ ID NO: 80484 - RNA, 20 nt, Artificial Sequence
  MKO10080484_B_D130043K22Rik
  gRNA
auacaacuuacuccuaugaa

SEQ ID NO: 80485 - RNA, 20 nt, Artificial Sequence
  MKO10080485_B_D14Abb1e
  gRNA
guucagagcauaugugaaaa

SEQ ID NO: 80486 - RNA, 20 nt, Artificial Sequence
  MKO10080486_B_D14Abb1e
  gRNA
agaaucuuaugcauuucuca

SEQ ID NO: 80487 - RNA, 20 nt, Artificial Sequence
  MKO10080487_B_D14Abb1e
  gRNA
agaagagaauugaaguuuga

SEQ ID NO: 80488 - RNA, 20 nt, Artificial Sequence
  MKO10080488_B_D15Ertd621e
  gRNA
aagaucugcacugauucauc

SEQ ID NO: 80489 - RNA, 20 nt, Artificial Sequence
  MKO10080489_B_D15Ertd621e
  gRNA
uugcgcuacagaaauaaccu

SEQ ID NO: 80490 - RNA, 20 nt, Artificial Sequence
  MKO10080490_B_D15Ertd621e
  gRNA
cagucagcagcaguaaaauu

SEQ ID NO: 80491 - RNA, 20 nt, Artificial Sequence
  MKO10080491_B_D16Ertd472e
  gRNA
guguguaaaagauucgacuu

SEQ ID NO: 80492 - RNA, 20 nt, Artificial Sequence
  MKO10080492_B_D16Ertd472e
  gRNA
gauuuagcucgaagcaaaug

SEQ ID NO: 80493 - RNA, 20 nt, Artificial Sequence
  MKO10080493_B_D16Ertd472e
  gRNA
guuuaucuucuuacucacga

SEQ ID NO: 80494 - RNA, 20 nt, Artificial Sequence
  MKO10080494_B_D17H6S53E
  gRNA
gcucagucauguuccuucga

SEQ ID NO: 80495 - RNA, 20 nt, Artificial Sequence
  MKO10080495_B_D17H6S53E
  gRNA
uucacgccaccugaauccac

SEQ ID NO: 80496 - RNA, 20 nt, Artificial Sequence
  MKO10080496_B_D17H6S53E
  gRNA
ggugccuagucucccuugag

SEQ ID NO: 80497 - RNA, 20 nt, Artificial Sequence
  MKO10080497_B_D17Wsu104e
  gRNA
ugcugagaucgaguaugcca

SEQ ID NO: 80498 - RNA, 20 nt, Artificial Sequence
  MKO10080498_B_D17Wsu104e
  gRNA
ugaugucccccugaaaagug

SEQ ID NO: 80499 - RNA, 20 nt, Artificial Sequence
  MKO10080499_B_D17Wsu104e
  gRNA
ccagcaauggcagaugagcc

SEQ ID NO: 80500 - RNA, 20 nt, Artificial Sequence
  MKO10080500_B_D17Wsu92e
  gRNA
aggaacuuacaagcagcgau

SEQ ID NO: 80501 - RNA, 20 nt, Artificial Sequence
  MKO10080501_B_D17Wsu92e
  gRNA
cgcugacgucugcgaucucu

SEQ ID NO: 80502 - RNA, 20 nt, Artificial Sequence
  MKO10080502_B_D17Wsu92e
  gRNA
ccauguucacauguccaaac

SEQ ID NO: 80503 - RNA, 20 nt, Artificial Sequence
  MKO10080503_B_D19Bwg1357e
  gRNA
ugcuucacaccuuucuugcc

SEQ ID NO: 80504 - RNA, 20 nt, Artificial Sequence
  MKO10080504_B_D19Bwg1357e
  gRNA
caagaccaacuaugacaucg

SEQ ID NO: 80505 - RNA, 20 nt, Artificial Sequence
  MKO10080505_B_D19Bwg1357e
  gRNA
gccacaaaaccuggcaagaa

SEQ ID NO: 80506 - RNA, 20 nt, Artificial Sequence
  MKO10080506_B_D19Ertd737e
  gRNA
aguccucaaaugagacccag

SEQ ID NO: 80507 - RNA, 20 nt, Artificial Sequence
  MKO10080507_B_D19Ertd737e
  gRNA
aaaagaaaacgcuccaaaaa

SEQ ID NO: 80508 - RNA, 20 nt, Artificial Sequence
  MKO10080508_B_D19Ertd737e
  gRNA
aggcaaauugaagaaugaaa

SEQ ID NO: 80509 - RNA, 20 nt, Artificial Sequence
  MKO10080509_B_D1Ertd622e
  gRNA
ggugcacuugucuccugagc

SEQ ID NO: 80510 - RNA, 20 nt, Artificial Sequence
  MKO10080510_B_D1Ertd622e
  gRNA
cacccugcucgcccaugcgc

SEQ ID NO: 80511 - RNA, 20 nt, Artificial Sequence
  MKO10080511_B_D1Ertd622e
  gRNA
cuucagcaccugacccuccg

SEQ ID NO: 80512 - RNA, 20 nt, Artificial Sequence
  MKO10080512_B_D1Pas1
  gRNA
aucauaucuacuagccgucc

SEQ ID NO: 80513 - RNA, 20 nt, Artificial Sequence
  MKO10080513_B_D1Pas1
  gRNA
aaggcguucuacgacaaaga

SEQ ID NO: 80514 - RNA, 20 nt, Artificial Sequence
  MKO10080514_B_D1Pas1
  gRNA
agcggggcgggaacagucgc

SEQ ID NO: 80515 - RNA, 20 nt, Artificial Sequence
  MKO10080515_B_D230025D16Rik
  gRNA
acuuggcuuaccuccaggau

SEQ ID NO: 80516 - RNA, 20 nt, Artificial Sequence
  MKO10080516_B_D230025D16Rik
  gRNA
cuuuauuucaggaaugccuc

SEQ ID NO: 80517 - RNA, 20 nt, Artificial Sequence
  MKO10080517_B_D230025D16Rik
  gRNA
caaaaguaaaguuaaaguau

SEQ ID NO: 80518 - RNA, 20 nt, Artificial Sequence
  MKO10080518_B_D2Wsu81e
  gRNA
acuguaggaugcgggccagc

SEQ ID NO: 80519 - RNA, 20 nt, Artificial Sequence
  MKO10080519_B_D2Wsu81e
  gRNA
gcuuaccuugguugcuccuc

SEQ ID NO: 80520 - RNA, 20 nt, Artificial Sequence
  MKO10080520_B_D2Wsu81e
  gRNA
gcggcccagaggagcaacca

SEQ ID NO: 80521 - RNA, 20 nt, Artificial Sequence
  MKO10080521_B_D2hgdh
  gRNA
caucuucuuaccuaagaauc

SEQ ID NO: 80522 - RNA, 20 nt, Artificial Sequence
  MKO10080522_B_D2hgdh
  gRNA
uguuguugcagguuguagua

SEQ ID NO: 80523 - RNA, 20 nt, Artificial Sequence
  MKO10080523_B_D2hgdh
  gRNA
agcugaugacuugauucaug

SEQ ID NO: 80524 - RNA, 20 nt, Artificial Sequence
  MKO10080524_B_D330045A20Rik
  gRNA
augauaacuauguuaguugg

SEQ ID NO: 80525 - RNA, 20 nt, Artificial Sequence
  MKO10080525_B_D330045A20Rik
  gRNA
gggucaggcuggauucuuaa

SEQ ID NO: 80526 - RNA, 20 nt, Artificial Sequence
  MKO10080526_B_D330045A20Rik
  gRNA
gcauggugucagugauucug

SEQ ID NO: 80527 - RNA, 20 nt, Artificial Sequence
  MKO10080527_B_D3Bwg0562e
  gRNA
ucaguucuuaccguaauugc

SEQ ID NO: 80528 - RNA, 20 nt, Artificial Sequence
  MKO10080528_B_D3Bwg0562e
  gRNA
aggcagcgagggucgcaugu

SEQ ID NO: 80529 - RNA, 20 nt, Artificial Sequence
  MKO10080529_B_D3Bwg0562e
  gRNA
acaaauaucuuccacgaugu

SEQ ID NO: 80530 - RNA, 20 nt, Artificial Sequence
  MKO10080530_B_D3Ertd254e
  gRNA
cccggcacccuacagacgca

SEQ ID NO: 80531 - RNA, 20 nt, Artificial Sequence
  MKO10080531_B_D3Ertd254e
  gRNA
uucaggaacaguugaccuuc

SEQ ID NO: 80532 - RNA, 20 nt, Artificial Sequence
  MKO10080532_B_D3Ertd254e
  gRNA
uguaaagacgcaaaagacca

SEQ ID NO: 80533 - RNA, 20 nt, Artificial Sequence
  MKO10080533_B_D3Ertd751e
  gRNA
aucuucacucccugcucaca

SEQ ID NO: 80534 - RNA, 20 nt, Artificial Sequence
  MKO10080534_B_D3Ertd751e
  gRNA
cacacuggcucaugucucac

SEQ ID NO: 80535 - RNA, 20 nt, Artificial Sequence
  MKO10080535_B_D3Ertd751e
  gRNA
uucaguuucaacacacugcu

SEQ ID NO: 80536 - RNA, 20 nt, Artificial Sequence
  MKO10080536_B_D430019H16Rik
  gRNA
uacucccuguuuaacucccc

SEQ ID NO: 80537 - RNA, 20 nt, Artificial Sequence
  MKO10080537_B_D430019H16Rik
  gRNA
cauugccaggggaguuaaac

SEQ ID NO: 80538 - RNA, 20 nt, Artificial Sequence
  MKO10080538_B_D430019H16Rik
  gRNA
caugaacgcuccucccauca

SEQ ID NO: 80539 - RNA, 20 nt, Artificial Sequence
  MKO10080539_B_D430041D05Rik
  gRNA
agcugcgcugacguccauga

SEQ ID NO: 80540 - RNA, 20 nt, Artificial Sequence
  MKO10080540_B_D430041D05Rik
  gRNA
agcacguccaucaccacagc

SEQ ID NO: 80541 - RNA, 20 nt, Artificial Sequence
  MKO10080541_B_D430041D05Rik
  gRNA
caccgccacagacuguaagu

SEQ ID NO: 80542 - RNA, 20 nt, Artificial Sequence
  MKO10080542_B_D430042O09Rik
  gRNA
ggcuucucuccaccuuccgc

SEQ ID NO: 80543 - RNA, 20 nt, Artificial Sequence
  MKO10080543_B_D430042O09Rik
  gRNA
gagaagccgguccugcucuc

SEQ ID NO: 80544 - RNA, 20 nt, Artificial Sequence
  MKO10080544_B_D430042O09Rik
  gRNA
ucuguaugcacagcuuuccg

SEQ ID NO: 80545 - RNA, 20 nt, Artificial Sequence
  MKO10080545_B_D4Wsu53e
  gRNA
aaggcacuuaccuccaccuu

SEQ ID NO: 80546 - RNA, 20 nt, Artificial Sequence
  MKO10080546_B_D4Wsu53e
  gRNA
gccagcaagucuccgagcca

SEQ ID NO: 80547 - RNA, 20 nt, Artificial Sequence
  MKO10080547_B_D4Wsu53e
  gRNA
uucacuuacauuggagcuga

SEQ ID NO: 80548 - RNA, 20 nt, Artificial Sequence
  MKO10080548_B_D5Ertd577e
  gRNA
ccacaggaggccaaaacuuc

SEQ ID NO: 80549 - RNA, 20 nt, Artificial Sequence
  MKO10080549_B_D5Ertd577e
  gRNA
uauccauguuuacugcaaac

SEQ ID NO: 80550 - RNA, 20 nt, Artificial Sequence
  MKO10080550_B_D5Ertd577e
  gRNA
ccuaauuucacagacagacu

SEQ ID NO: 80551 - RNA, 20 nt, Artificial Sequence
  MKO10080551_B_D5Ertd579e
  gRNA
caauaccuaccuguuccugc

SEQ ID NO: 80552 - RNA, 20 nt, Artificial Sequence
  MKO10080552_B_D5Ertd579e
  gRNA
cguucuguuggaauccggag

SEQ ID NO: 80553 - RNA, 20 nt, Artificial Sequence
  MKO10080553_B_D5Ertd579e
  gRNA
cccuacagcaaaagaucaag

SEQ ID NO: 80554 - RNA, 20 nt, Artificial Sequence
  MKO10080554_B_D630003M21Rik
  gRNA
ggcuccuggacuccgacuuc

SEQ ID NO: 80555 - RNA, 20 nt, Artificial Sequence
  MKO10080555_B_D630003M21Rik
  gRNA
uaguccuagaacacuccucc

SEQ ID NO: 80556 - RNA, 20 nt, Artificial Sequence
  MKO10080556_B_D630003M21Rik
  gRNA
uucgccuggaggaguguucu

SEQ ID NO: 80557 - RNA, 20 nt, Artificial Sequence
  MKO10080557_B_D630023F18Rik
  gRNA
acacuuaccuugguagaauc

SEQ ID NO: 80558 - RNA, 20 nt, Artificial Sequence
  MKO10080558_B_D630023F18Rik
  gRNA
auuccaggcccacuaugacu

SEQ ID NO: 80559 - RNA, 20 nt, Artificial Sequence
  MKO10080559_B_D630023F18Rik
  gRNA
cacugauggccaagucauag

SEQ ID NO: 80560 - RNA, 20 nt, Artificial Sequence
  MKO10080560_B_D630033O11Rik
  gRNA
agcucagcccaccaguugug

SEQ ID NO: 80561 - RNA, 20 nt, Artificial Sequence
  MKO10080561_B_D630033O11Rik
  gRNA
cccuuccagucaugcgaaug

SEQ ID NO: 80562 - RNA, 20 nt, Artificial Sequence
  MKO10080562_B_D630033O11Rik
  gRNA
cucaagucauaaguuccaua

SEQ ID NO: 80563 - RNA, 20 nt, Artificial Sequence
  MKO10080563_B_D630039A03Rik
  gRNA
caccuaaugguguucccuaa

SEQ ID NO: 80564 - RNA, 20 nt, Artificial Sequence
  MKO10080564_B_D630039A03Rik
  gRNA
uugaccuggcgccugagucc

SEQ ID NO: 80565 - RNA, 20 nt, Artificial Sequence
  MKO10080565_B_D630039A03Rik
  gRNA
aaggagcucgcugucaccag

SEQ ID NO: 80566 - RNA, 20 nt, Artificial Sequence
  MKO10080566_B_D630045J12Rik
  gRNA
gauaucgccguguaaacaaa

SEQ ID NO: 80567 - RNA, 20 nt, Artificial Sequence
  MKO10080567_B_D630045J12Rik
  gRNA
aucaauagcaaacuugugcg

SEQ ID NO: 80568 - RNA, 20 nt, Artificial Sequence
  MKO10080568_B_D630045J12Rik
  gRNA
cagaagccaguaucgacacu

SEQ ID NO: 80569 - RNA, 20 nt, Artificial Sequence
  MKO10080569_B_D6Ertd527e
  gRNA
gucuggggccacuguugccg

SEQ ID NO: 80570 - RNA, 20 nt, Artificial Sequence
  MKO10080570_B_D6Ertd527e
  gRNA
cccuuaggaaaucauuccca

SEQ ID NO: 80571 - RNA, 20 nt, Artificial Sequence
  MKO10080571_B_D6Ertd527e
  gRNA
guugccauaguugcugaugu

SEQ ID NO: 80572 - RNA, 20 nt, Artificial Sequence
  MKO10080572_B_D6Wsu163e
  gRNA
gugggccaaagcuuacgcug

SEQ ID NO: 80573 - RNA, 20 nt, Artificial Sequence
  MKO10080573_B_D6Wsu163e
  gRNA
augggugauaaagcuucauc

SEQ ID NO: 80574 - RNA, 20 nt, Artificial Sequence
  MKO10080574_B_D6Wsu163e
  gRNA
accccaacaacagcucccuc

SEQ ID NO: 80575 - RNA, 20 nt, Artificial Sequence
  MKO10080575_B_D730048I06Rik
  gRNA
cauacauacugcuguaguca

SEQ ID NO: 80576 - RNA, 20 nt, Artificial Sequence
  MKO10080576_B_D730048I06Rik
  gRNA
gagaaaugaaaaacuuccug

SEQ ID NO: 80577 - RNA, 20 nt, Artificial Sequence
  MKO10080577_B_D730048I06Rik
  gRNA
gaagaaagagacacagccuc

SEQ ID NO: 80578 - RNA, 20 nt, Artificial Sequence
  MKO10080578_B_D7Ertd443e
  gRNA
uguaaagggcaauaaaaccc

SEQ ID NO: 80579 - RNA, 20 nt, Artificial Sequence
  MKO10080579_B_D7Ertd443e
  gRNA
guagcuuaccacuaagagga

SEQ ID NO: 80580 - RNA, 20 nt, Artificial Sequence
  MKO10080580_B_D7Ertd443e
  gRNA
gccucucauuggacucugaa

SEQ ID NO: 80581 - RNA, 20 nt, Artificial Sequence
  MKO10080581_B_D830030K20Rik
  gRNA
acaacaugagaagacaaugu

SEQ ID NO: 80582 - RNA, 20 nt, Artificial Sequence
  MKO10080582_B_D830030K20Rik
  gRNA
ucauccuaccugcugcuccu

SEQ ID NO: 80583 - RNA, 20 nt, Artificial Sequence
  MKO10080583_B_D830030K20Rik
  gRNA
cucaacucagcgaaaaagua

SEQ ID NO: 80584 - RNA, 20 nt, Artificial Sequence
  MKO10080584_B_D830031N03Rik
  gRNA
ggcuccgcuccggccgcacg

SEQ ID NO: 80585 - RNA, 20 nt, Artificial Sequence
  MKO10080585_B_D830031N03Rik
  gRNA
ggguuccgccuuaaacaguc

SEQ ID NO: 80586 - RNA, 20 nt, Artificial Sequence
  MKO10080586_B_D830031N03Rik
  gRNA
gcucgccccccucgugcggc

SEQ ID NO: 80587 - RNA, 20 nt, Artificial Sequence
  MKO10080587_B_D8Ertd738e
  gRNA
gaagaagauugagcaugacg

SEQ ID NO: 80588 - RNA, 20 nt, Artificial Sequence
  MKO10080588_B_D8Ertd738e
  gRNA
cgucaugcucaaucuucuuc

SEQ ID NO: 80589 - RNA, 20 nt, Artificial Sequence
  MKO10080589_B_D8Ertd738e
  gRNA
accuaaaagcaaggcugccg

SEQ ID NO: 80590 - RNA, 20 nt, Artificial Sequence
  MKO10080590_B_D8Ertd82e
  gRNA
gcauaaccuggaggcccgcg

SEQ ID NO: 80591 - RNA, 20 nt, Artificial Sequence
  MKO10080591_B_D8Ertd82e
  gRNA
guuguuaccuccaucgcugc

SEQ ID NO: 80592 - RNA, 20 nt, Artificial Sequence
  MKO10080592_B_D8Ertd82e
  gRNA
uggagguggccgcucugcac

SEQ ID NO: 80593 - RNA, 20 nt, Artificial Sequence
  MKO10080593_B_D930015E06Rik
  gRNA
cagccgucaguucuagauuu

SEQ ID NO: 80594 - RNA, 20 nt, Artificial Sequence
  MKO10080594_B_D930015E06Rik
  gRNA
augugccgccuguccauugc

SEQ ID NO: 80595 - RNA, 20 nt, Artificial Sequence
  MKO10080595_B_D930015E06Rik
  gRNA
acuacagggugauucugaag

SEQ ID NO: 80596 - RNA, 20 nt, Artificial Sequence
  MKO10080596_B_D930020B18Rik
  gRNA
aucaagcacaaacgaacccc

SEQ ID NO: 80597 - RNA, 20 nt, Artificial Sequence
  MKO10080597_B_D930020B18Rik
  gRNA
gaugacaucauugugcucgc

SEQ ID NO: 80598 - RNA, 20 nt, Artificial Sequence
  MKO10080598_B_D930020B18Rik
  gRNA
agcgagcacaaugaugucau

SEQ ID NO: 80599 - RNA, 20 nt, Artificial Sequence
  MKO10080599_B_DXBay18
  gRNA
ucugcagaguauguacucug

SEQ ID NO: 80600 - RNA, 20 nt, Artificial Sequence
  MKO10080600_B_DXBay18
  gRNA
gacgaucccuucuaaggagu

SEQ ID NO: 80601 - RNA, 20 nt, Artificial Sequence
  MKO10080601_B_DXBay18
  gRNA
gagggaaccagcuuguuuca

SEQ ID NO: 80602 - RNA, 20 nt, Artificial Sequence
  MKO10080602_B_Daam1
  gRNA
gagcugaucaauguagaacu

SEQ ID NO: 80603 - RNA, 20 nt, Artificial Sequence
  MKO10080603_B_Daam1
  gRNA
cacugagaaccaagcccaug

SEQ ID NO: 80604 - RNA, 20 nt, Artificial Sequence
  MKO10080604_B_Daam1
  gRNA
uuuauagaggaaaucucugc

SEQ ID NO: 80605 - RNA, 20 nt, Artificial Sequence
  MKO10080605_B_Daam2
  gRNA
cauugaucguaucaaugcca

SEQ ID NO: 80606 - RNA, 20 nt, Artificial Sequence
  MKO10080606_B_Daam2
  gRNA
ccucacagauaaaaaccgag

SEQ ID NO: 80607 - RNA, 20 nt, Artificial Sequence
  MKO10080607_B_Daam2
  gRNA
gucaccucauggguuguguc

SEQ ID NO: 80608 - RNA, 20 nt, Artificial Sequence
  MKO10080608_B_Dab1
  gRNA
aucacagaucaucgggcuuu

SEQ ID NO: 80609 - RNA, 20 nt, Artificial Sequence
  MKO10080609_B_Dab1
  gRNA
ucccaacaggguguuguugc

SEQ ID NO: 80610 - RNA, 20 nt, Artificial Sequence
  MKO10080610_B_Dab1
  gRNA
gaaagagaucucucaagucc

SEQ ID NO: 80611 - RNA, 20 nt, Artificial Sequence
  MKO10080611_B_Dab2ip
  gRNA
cauccacuuaucgcgcucag

SEQ ID NO: 80612 - RNA, 20 nt, Artificial Sequence
  MKO10080612_B_Dab2ip
  gRNA
agccgacgccaucuccuccu

SEQ ID NO: 80613 - RNA, 20 nt, Artificial Sequence
  MKO10080613_B_Dab2ip
  gRNA
cgaagcaguaguccugaccc

SEQ ID NO: 80614 - RNA, 20 nt, Artificial Sequence
  MKO10080614_B_Dab2
  gRNA
ugucacaucacgagcaauga

SEQ ID NO: 80615 - RNA, 20 nt, Artificial Sequence
  MKO10080615_B_Dab2
  gRNA
gaugaugugccugaugcucg

SEQ ID NO: 80616 - RNA, 20 nt, Artificial Sequence
  MKO10080616_B_Dab2
  gRNA
uuauagcaaaaaauugaugc

SEQ ID NO: 80617 - RNA, 20 nt, Artificial Sequence
  MKO10080617_B_Dach1
  gRNA
ccuggaaucauuccaccaac

SEQ ID NO: 80618 - RNA, 20 nt, Artificial Sequence
  MKO10080618_B_Dach1
  gRNA
ccuguugguggaaugauucc

SEQ ID NO: 80619 - RNA, 20 nt, Artificial Sequence
  MKO10080619_B_Dach1
  gRNA
caugccaguaacaaccaaca

SEQ ID NO: 80620 - RNA, 20 nt, Artificial Sequence
  MKO10080620_B_Dach2
  gRNA
caggcccccuaagcguucuu

SEQ ID NO: 80621 - RNA, 20 nt, Artificial Sequence
  MKO10080621_B_Dach2
  gRNA
ucaccgauugcaccaacgcc

SEQ ID NO: 80622 - RNA, 20 nt, Artificial Sequence
  MKO10080622_B_Dach2
  gRNA
acucaccugucguagaauua

SEQ ID NO: 80623 - RNA, 20 nt, Artificial Sequence
  MKO10080623_B_Dacu1
  gRNA
uccggcucgcgcgcugcguc

SEQ ID NO: 80624 - RNA, 20 nt, Artificial Sequence
  MKO10080624_B_Dacu1
  gRNA
gcaaccgucugagaugguca

SEQ ID NO: 80625 - RNA, 20 nt, Artificial Sequence
  MKO10080625_B_Dacu1
  gRNA
gcggccuugaccaucucaga

SEQ ID NO: 80626 - RNA, 20 nt, Artificial Sequence
  MKO10080626_B_Dacu2
  gRNA
caccauugccgagaccagcg

SEQ ID NO: 80627 - RNA, 20 nt, Artificial Sequence
  MKO10080627_B_Dacu2
  gRNA
gccggaacaugcccgucagc

SEQ ID NO: 80628 - RNA, 20 nt, Artificial Sequence
  MKO10080628_B_Dacu2
  gRNA
uuaccuccuagucacggcua

SEQ ID NO: 80629 - RNA, 20 nt, Artificial Sequence
  MKO10080629_B_Dacu3
  gRNA
ucaccgggaacgagaaggcc

SEQ ID NO: 80630 - RNA, 20 nt, Artificial Sequence
  MKO10080630_B_Dacu3
  gRNA
gacaguggcuucuccggauc

SEQ ID NO: 80631 - RNA, 20 nt, Artificial Sequence
  MKO10080631_B_Dacu3
  gRNA
aguugcauuggcuccgagag

SEQ ID NO: 80632 - RNA, 20 nt, Artificial Sequence
  MKO10080632_B_Dad1
  gRNA
gcaggaucgugcuggcaaag

SEQ ID NO: 80633 - RNA, 20 nt, Artificial Sequence
  MKO10080633_B_Dad1
  gRNA
uggagcucaaguacuccucc

SEQ ID NO: 80634 - RNA, 20 nt, Artificial Sequence
  MKO10080634_B_Dad1
  gRNA
guccgucaucucccgguucc

SEQ ID NO: 80635 - RNA, 20 nt, Artificial Sequence
  MKO10080635_B_Daf2
  gRNA
cuccagacauuccuaaugcc

SEQ ID NO: 80636 - RNA, 20 nt, Artificial Sequence
  MKO10080636_B_Daf2
  gRNA
uacucucacagaauguuucg

SEQ ID NO: 80637 - RNA, 20 nt, Artificial Sequence
  MKO10080637_B_Daf2
  gRNA
cuauuguggaauaugagugu

SEQ ID NO: 80638 - RNA, 20 nt, Artificial Sequence
  MKO10080638_B_Dag1
  gRNA
auuucgagugagcauuccaa

SEQ ID NO: 80639 - RNA, 20 nt, Artificial Sequence
  MKO10080639_B_Dag1
  gRNA
cguuaggauccucaucccgc

SEQ ID NO: 80640 - RNA, 20 nt, Artificial Sequence
  MKO10080640_B_Dag1
  gRNA
ggcguaggcacuauccgcga

SEQ ID NO: 80641 - RNA, 20 nt, Artificial Sequence
  MKO10080641_B_Dagla
  gRNA
caggaauggucgucugcaac

SEQ ID NO: 80642 - RNA, 20 nt, Artificial Sequence
  MKO10080642_B_Dagla
  gRNA
ccuucacaggcaccgguuag

SEQ ID NO: 80643 - RNA, 20 nt, Artificial Sequence
  MKO10080643_B_Dagla
  gRNA
cucucagcuugacgaaggug

SEQ ID NO: 80644 - RNA, 20 nt, Artificial Sequence
  MKO10080644_B_Daglb
  gRNA
cggugcauauaauaacugcc

SEQ ID NO: 80645 - RNA, 20 nt, Artificial Sequence
  MKO10080645_B_Daglb
  gRNA
uaagcugcucuauauccgcc

SEQ ID NO: 80646 - RNA, 20 nt, Artificial Sequence
  MKO10080646_B_Daglb
  gRNA
agcuuagacauagacuuccg

SEQ ID NO: 80647 - RNA, 20 nt, Artificial Sequence
  MKO10080647_B_Dak
  gRNA
gcucaacuuuggacuugcca

SEQ ID NO: 80648 - RNA, 20 nt, Artificial Sequence
  MKO10080648_B_Dak
  gRNA
cacgccggccugccuucuug

SEQ ID NO: 80649 - RNA, 20 nt, Artificial Sequence
  MKO10080649_B_Dak
  gRNA
gagcgugaucgccaagacca

SEQ ID NO: 80650 - RNA, 20 nt, Artificial Sequence
  MKO10080650_B_Dalrd3
  gRNA
gccauuccacccgaaguuuc

SEQ ID NO: 80651 - RNA, 20 nt, Artificial Sequence
  MKO10080651_B_Dalrd3
  gRNA
ugacugcgugguuauacacg

SEQ ID NO: 80652 - RNA, 20 nt, Artificial Sequence
  MKO10080652_B_Dalrd3
  gRNA
agccacucaccgggccuggg

SEQ ID NO: 80653 - RNA, 20 nt, Artificial Sequence
  MKO10080653_B_Dand5
  gRNA
gcucugauugauagcagucc

SEQ ID NO: 80654 - RNA, 20 nt, Artificial Sequence
  MKO10080654_B_Dand5
  gRNA
acacuucuggaccaauaccg

SEQ ID NO: 80655 - RNA, 20 nt, Artificial Sequence
  MKO10080655_B_Dand5
  gRNA
gcuggacaucggugacgcug

SEQ ID NO: 80656 - RNA, 20 nt, Artificial Sequence
  MKO10080656_B_Dao
  gRNA
cgagagacuccaccuuccga

SEQ ID NO: 80657 - RNA, 20 nt, Artificial Sequence
  MKO10080657_B_Dao
  gRNA
ggcucaccggaacuucaucu

SEQ ID NO: 80658 - RNA, 20 nt, Artificial Sequence
  MKO10080658_B_Dao
  gRNA
ccucuuccgagaugaaguuc

SEQ ID NO: 80659 - RNA, 20 nt, Artificial Sequence
  MKO10080659_B_Dap3
  gRNA
acaguucugggacgcucagc

SEQ ID NO: 80660 - RNA, 20 nt, Artificial Sequence
  MKO10080660_B_Dap3
  gRNA
agagcaaagaccaugcugac

SEQ ID NO: 80661 - RNA, 20 nt, Artificial Sequence
  MKO10080661_B_Dap3
  gRNA
ccuuguuauuccugucagca

SEQ ID NO: 80662 - RNA, 20 nt, Artificial Sequence
  MKO10080662_B_Dapk1
  gRNA
ggcucauaguugacuaucuc

SEQ ID NO: 80663 - RNA, 20 nt, Artificial Sequence
  MKO10080663_B_Dapk1
  gRNA
gccggaaaacauaaugcuuc

SEQ ID NO: 80664 - RNA, 20 nt, Artificial Sequence
  MKO10080664_B_Dapk1
  gRNA
gauagucaacuaugagcccc

SEQ ID NO: 80665 - RNA, 20 nt, Artificial Sequence
  MKO10080665_B_Dapk2
  gRNA
aaucgugaacuaugagccac

SEQ ID NO: 80666 - RNA, 20 nt, Artificial Sequence
  MKO10080666_B_Dapk2
  gRNA
gugucuuccagaguguccgg

SEQ ID NO: 80667 - RNA, 20 nt, Artificial Sequence
  MKO10080667_B_Dapk2
  gRNA
caucuucuauuucgugagcc

SEQ ID NO: 80668 - RNA, 20 nt, Artificial Sequence
  MKO10080668_B_Dapk3
  gRNA
ccgggaggagaucgaacgcg

SEQ ID NO: 80669 - RNA, 20 nt, Artificial Sequence
  MKO10080669_B_Dapk3
  gRNA
cucauaguucacgaucucgg

SEQ ID NO: 80670 - RNA, 20 nt, Artificial Sequence
  MKO10080670_B_Dapk3
  gRNA
augucagccuccaagccaag

SEQ ID NO: 80671 - RNA, 20 nt, Artificial Sequence
  MKO10080671_B_Dapl1
  gRNA
agcauccaacaucuguaucu

SEQ ID NO: 80672 - RNA, 20 nt, Artificial Sequence
  MKO10080672_B_Dapl1
  gRNA
ucugacggacacacuggaca

SEQ ID NO: 80673 - RNA, 20 nt, Artificial Sequence
  MKO10080673_B_Dapl1
  gRNA
ggggcauaccgcccuuucag

SEQ ID NO: 80674 - RNA, 20 nt, Artificial Sequence
  MKO10080674_B_Dapp1
  gRNA
ccugucucgcuuccaaucaa

SEQ ID NO: 80675 - RNA, 20 nt, Artificial Sequence
  MKO10080675_B_Dapp1
  gRNA
guucacacagcgaugcagac

SEQ ID NO: 80676 - RNA, 20 nt, Artificial Sequence
  MKO10080676_B_Dapp1
  gRNA
cacuuucauguugaauauac

SEQ ID NO: 80677 - RNA, 20 nt, Artificial Sequence
  MKO10080677_B_Dap
  gRNA
uguuggauaugcugcguucu

SEQ ID NO: 80678 - RNA, 20 nt, Artificial Sequence
  MKO10080678_B_Dap
  gRNA
uccuucuggaggcgaagaca

SEQ ID NO: 80679 - RNA, 20 nt, Artificial Sequence
  MKO10080679_B_Dap
  gRNA
uguauuucagugaaagccgg

SEQ ID NO: 80680 - RNA, 20 nt, Artificial Sequence
  MKO10080680_B_Darc
  gRNA
cggauacagacaguucccca

SEQ ID NO: 80681 - RNA, 20 nt, Artificial Sequence
  MKO10080681_B_Darc
  gRNA
gaguugaccaauauucaguc

SEQ ID NO: 80682 - RNA, 20 nt, Artificial Sequence
  MKO10080682_B_Darc
  gRNA
ucucaaauggaugcccuugc

SEQ ID NO: 80683 - RNA, 20 nt, Artificial Sequence
  MKO10080683_B_Dars2
  gRNA
acaguaaucucccguccucc

SEQ ID NO: 80684 - RNA, 20 nt, Artificial Sequence
  MKO10080684_B_Dars2
  gRNA
uucuucuaagaaaaugccga

SEQ ID NO: 80685 - RNA, 20 nt, Artificial Sequence
  MKO10080685_B_Dars2
  gRNA
cgaaccggauucucuugucc

SEQ ID NO: 80686 - RNA, 20 nt, Artificial Sequence
  MKO10080686_B_Dars
  gRNA
guguauuacagauagaguuu

SEQ ID NO: 80687 - RNA, 20 nt, Artificial Sequence
  MKO10080687_B_Dars
  gRNA
gauuaugcuaaagagagaua

SEQ ID NO: 80688 - RNA, 20 nt, Artificial Sequence
  MKO10080688_B_Dars
  gRNA
auacaaucacaagaaaagcc

SEQ ID NO: 80689 - RNA, 20 nt, Artificial Sequence
  MKO10080689_B_Daw1
  gRNA
cgccgugucccacaccuugc

SEQ ID NO: 80690 - RNA, 20 nt, Artificial Sequence
  MKO10080690_B_Daw1
  gRNA
ugcuuuguugagugccacgu

SEQ ID NO: 80691 - RNA, 20 nt, Artificial Sequence
  MKO10080691_B_Daw1
  gRNA
acugaugucaacacccuagu

SEQ ID NO: 80692 - RNA, 20 nt, Artificial Sequence
  MKO10080692_B_Daxx
  gRNA
uccugggaugccauuccgcu

SEQ ID NO: 80693 - RNA, 20 nt, Artificial Sequence
  MKO10080693_B_Daxx
  gRNA
cccucaggguccuagcggaa

SEQ ID NO: 80694 - RNA, 20 nt, Artificial Sequence
  MKO10080694_B_Daxx
  gRNA
ccauaccucaccagauuccg

SEQ ID NO: 80695 - RNA, 20 nt, Artificial Sequence
  MKO10080695_B_Dazap1
  gRNA
cuggacuggaguaccacuca

SEQ ID NO: 80696 - RNA, 20 nt, Artificial Sequence
  MKO10080696_B_Dazap1
  gRNA
guuuaaagaccccaauugug

SEQ ID NO: 80697 - RNA, 20 nt, Artificial Sequence
  MKO10080697_B_Dazap1
  gRNA
cacuuacauuucggccaucu

SEQ ID NO: 80698 - RNA, 20 nt, Artificial Sequence
  MKO10080698_B_Dazap2
  gRNA
uucuucauggguggcucaga

SEQ ID NO: 80699 - RNA, 20 nt, Artificial Sequence
  MKO10080699_B_Dazap2
  gRNA
accaacuggauaauaagcca

SEQ ID NO: 80700 - RNA, 20 nt, Artificial Sequence
  MKO10080700_B_Dazap2
  gRNA
ggccuugccuuugcuguuca

SEQ ID NO: 80701 - RNA, 20 nt, Artificial Sequence
  MKO10080701_B_Dazl
  gRNA
agauggaugaaaccgaaauc

SEQ ID NO: 80702 - RNA, 20 nt, Artificial Sequence
  MKO10080702_B_Dazl
  gRNA
caaaacauauccuugacuug

SEQ ID NO: 80703 - RNA, 20 nt, Artificial Sequence
  MKO10080703_B_Dazl
  gRNA
uagucacagauaaauuucca

SEQ ID NO: 80704 - RNA, 20 nt, Artificial Sequence
  MKO10080704_B_Dbf4
  gRNA
ucugcaguauaugcagauuc

SEQ ID NO: 80705 - RNA, 20 nt, Artificial Sequence
  MKO10080705_B_Dbf4
  gRNA
aauccaaauauaagccccuu

SEQ ID NO: 80706 - RNA, 20 nt, Artificial Sequence
  MKO10080706_B_Dbf4
  gRNA
accauccuugaaaucccuga

SEQ ID NO: 80707 - RNA, 20 nt, Artificial Sequence
  MKO10080707_B_Dbh
  gRNA
guccuccccguuucuccgac

SEQ ID NO: 80708 - RNA, 20 nt, Artificial Sequence
  MKO10080708_B_Dbh
  gRNA
cugaccgacucaacuacugc

SEQ ID NO: 80709 - RNA, 20 nt, Artificial Sequence
  MKO10080709_B_Dbh
  gRNA
uaccucaaugacauaauccu

SEQ ID NO: 80710 - RNA, 20 nt, Artificial Sequence
  MKO10080710_B_Dbil5
  gRNA
uuuagcaauguagauccuca

SEQ ID NO: 80711 - RNA, 20 nt, Artificial Sequence
  MKO10080711_B_Dbil5
  gRNA
gaggccuggaugguaaacaa

SEQ ID NO: 80712 - RNA, 20 nt, Artificial Sequence
  MKO10080712_B_Dbil5
  gRNA
caucccuuuguuuaccaucc

SEQ ID NO: 80713 - RNA, 20 nt, Artificial Sequence
  MKO10080713_B_Dbi
  gRNA
cuuguuccacgagucccacu

SEQ ID NO: 80714 - RNA, 20 nt, Artificial Sequence
  MKO10080714_B_Dbi
  gRNA
ugaauuugacaaagccgcug

SEQ ID NO: 80715 - RNA, 20 nt, Artificial Sequence
  MKO10080715_B_Dbi
  gRNA
gacgagcuaaagaagaaaua

SEQ ID NO: 80716 - RNA, 20 nt, Artificial Sequence
  MKO10080716_B_Dbn1
  gRNA
augugcuugcgccagucaug

SEQ ID NO: 80717 - RNA, 20 nt, Artificial Sequence
  MKO10080717_B_Dbn1
  gRNA
cuccugacgcugcaagcuug

SEQ ID NO: 80718 - RNA, 20 nt, Artificial Sequence
  MKO10080718_B_Dbn1
  gRNA
cuggaagaauucagccaccu

SEQ ID NO: 80719 - RNA, 20 nt, Artificial Sequence
  MKO10080719_B_Dbndd1
  gRNA
aucggaguccgcaaagaccu

SEQ ID NO: 80720 - RNA, 20 nt, Artificial Sequence
  MKO10080720_B_Dbndd1
  gRNA
uggccgcauggagucucccg

SEQ ID NO: 80721 - RNA, 20 nt, Artificial Sequence
  MKO10080721_B_Dbndd1
  gRNA
aggcagcuggcucgagauag

SEQ ID NO: 80722 - RNA, 20 nt, Artificial Sequence
  MKO10080722_B_Dbndd2
  gRNA
auuuggacugcgcagguugg

SEQ ID NO: 80723 - RNA, 20 nt, Artificial Sequence
  MKO10080723_B_Dbndd2
  gRNA
gccgcagcuguuggcgcucc

SEQ ID NO: 80724 - RNA, 20 nt, Artificial Sequence
  MKO10080724_B_Dbndd2
  gRNA
agcgccaacagcugcggcuc

SEQ ID NO: 80725 - RNA, 20 nt, Artificial Sequence
  MKO10080725_B_Dbnl
  gRNA
aggugauguacgccuucugc

SEQ ID NO: 80726 - RNA, 20 nt, Artificial Sequence
  MKO10080726_B_Dbnl
  gRNA
ugccaaccacgucagcacca

SEQ ID NO: 80727 - RNA, 20 nt, Artificial Sequence
  MKO10080727_B_Dbnl
  gRNA
caacagcaaugacauccgug

SEQ ID NO: 80728 - RNA, 20 nt, Artificial Sequence
  MKO10080728_B_Dbpht2
  gRNA
gagaaauacagagaaaauca

SEQ ID NO: 80729 - RNA, 20 nt, Artificial Sequence
  MKO10080729_B_Dbpht2
  gRNA
gagaaacagacacaaagaga

SEQ ID NO: 80730 - RNA, 20 nt, Artificial Sequence
  MKO10080730_B_Dbpht2
  gRNA
cacacauacacacagagaga

SEQ ID NO: 80731 - RNA, 20 nt, Artificial Sequence
  MKO10080731_B_Dbp
  gRNA
ugcugugcuuucacgcuacc

SEQ ID NO: 80732 - RNA, 20 nt, Artificial Sequence
  MKO10080732_B_Dbp
  gRNA
ccaagcagcgcucccccgcc

SEQ ID NO: 80733 - RNA, 20 nt, Artificial Sequence
  MKO10080733_B_Dbp
  gRNA
cucgcccugucaagcauucc

SEQ ID NO: 80734 - RNA, 20 nt, Artificial Sequence
  MKO10080734_B_Dbr1
  gRNA
cgcagcccugaugcagcauc

SEQ ID NO: 80735 - RNA, 20 nt, Artificial Sequence
  MKO10080735_B_Dbr1
  gRNA
gcugguguugucaaauaccg

SEQ ID NO: 80736 - RNA, 20 nt, Artificial Sequence
  MKO10080736_B_Dbr1
  gRNA
cuuauaauucaucuaccaua

SEQ ID NO: 80737 - RNA, 20 nt, Artificial Sequence
  MKO10080737_B_Dbt
  gRNA
auugccagccgacgcacugc

SEQ ID NO: 80738 - RNA, 20 nt, Artificial Sequence
  MKO10080738_B_Dbt
  gRNA
uagcaacgccugcagugcgu

SEQ ID NO: 80739 - RNA, 20 nt, Artificial Sequence
  MKO10080739_B_Dbt
  gRNA
acucaccggccgcuguucuc

SEQ ID NO: 80740 - RNA, 20 nt, Artificial Sequence
  MKO10080740_B_Dbx1
  gRNA
uccagcgucgugccuauccc

SEQ ID NO: 80741 - RNA, 20 nt, Artificial Sequence
  MKO10080741_B_Dbx1
  gRNA
uucgccuuuccauacuucga

SEQ ID NO: 80742 - RNA, 20 nt, Artificial Sequence
  MKO10080742_B_Dbx1
  gRNA
uggaacgagccuucgaagua

SEQ ID NO: 80743 - RNA, 20 nt, Artificial Sequence
  MKO10080743_B_Dbx2
  gRNA
uaaaaucccccugcgagcuu

SEQ ID NO: 80744 - RNA, 20 nt, Artificial Sequence
  MKO10080744_B_Dbx2
  gRNA
guucccgucaaauggugcuc

SEQ ID NO: 80745 - RNA, 20 nt, Artificial Sequence
  MKO10080745_B_Dbx2
  gRNA
agcugaccgcgaguuuccuu

SEQ ID NO: 80746 - RNA, 20 nt, Artificial Sequence
  MKO10080746_B_Dcaf10
  gRNA
acaagacucuuaguaacauc

SEQ ID NO: 80747 - RNA, 20 nt, Artificial Sequence
  MKO10080747_B_Dcaf10
  gRNA
cagaucccauagugcuauug

SEQ ID NO: 80748 - RNA, 20 nt, Artificial Sequence
  MKO10080748_B_Dcaf10
  gRNA
aagauugugugaauaauauc

SEQ ID NO: 80749 - RNA, 20 nt, Artificial Sequence
  MKO10080749_B_Dcaf11
  gRNA
gggauuggccacggggcggc

SEQ ID NO: 80750 - RNA, 20 nt, Artificial Sequence
  MKO10080750_B_Dcaf11
  gRNA
gagaacggggccucugccac

SEQ ID NO: 80751 - RNA, 20 nt, Artificial Sequence
  MKO10080751_B_Dcaf11
  gRNA
agaagcuuccccgguggcag

SEQ ID NO: 80752 - RNA, 20 nt, Artificial Sequence
  MKO10080752_B_Dcaf12l1
  gRNA
gcauuccucugaugcgcgac

SEQ ID NO: 80753 - RNA, 20 nt, Artificial Sequence
  MKO10080753_B_Dcaf12l1
  gRNA
gcagcgccgauggcgacagc

SEQ ID NO: 80754 - RNA, 20 nt, Artificial Sequence
  MKO10080754_B_Dcaf12l1
  gRNA
cccucgaagccagcgagccc

SEQ ID NO: 80755 - RNA, 20 nt, Artificial Sequence
  MKO10080755_B_Dcaf12l2
  gRNA
cgccuggaugagugauaccg

SEQ ID NO: 80756 - RNA, 20 nt, Artificial Sequence
  MKO10080756_B_Dcaf12l2
  gRNA
gcugggacuucuucguugcc

SEQ ID NO: 80757 - RNA, 20 nt, Artificial Sequence
  MKO10080757_B_Dcaf12l2
  gRNA
agcgcccugcucgaccuccg

SEQ ID NO: 80758 - RNA, 20 nt, Artificial Sequence
  MKO10080758_B_Dcaf12
  gRNA
aacgauacuauggcaguguc

SEQ ID NO: 80759 - RNA, 20 nt, Artificial Sequence
  MKO10080759_B_Dcaf12
  gRNA
cuccuuggggauauccuuua

SEQ ID NO: 80760 - RNA, 20 nt, Artificial Sequence
  MKO10080760_B_Dcaf12
  gRNA
ucuagaacacuccuagccac

SEQ ID NO: 80761 - RNA, 20 nt, Artificial Sequence
  MKO10080761_B_Dcaf13
  gRNA
gcccugugugcucaaugaac

SEQ ID NO: 80762 - RNA, 20 nt, Artificial Sequence
  MKO10080762_B_Dcaf13
  gRNA
cgaacaauacaagcacauga

SEQ ID NO: 80763 - RNA, 20 nt, Artificial Sequence
  MKO10080763_B_Dcaf13
  gRNA
ccccaguucauugagcacac

SEQ ID NO: 80764 - RNA, 20 nt, Artificial Sequence
  MKO10080764_B_Dcaf15
  gRNA
cacuguagaucuccucgucc

SEQ ID NO: 80765 - RNA, 20 nt, Artificial Sequence
  MKO10080765_B_Dcaf15
  gRNA
ccucaagaacaucguagaug

SEQ ID NO: 80766 - RNA, 20 nt, Artificial Sequence
  MKO10080766_B_Dcaf15
  gRNA
ccucaucuacgauguucuug

SEQ ID NO: 80767 - RNA, 20 nt, Artificial Sequence
  MKO10080767_B_Dcaf17
  gRNA
uagcccugacugcucauaau

SEQ ID NO: 80768 - RNA, 20 nt, Artificial Sequence
  MKO10080768_B_Dcaf17
  gRNA
ucaccuauagccuaugagag

SEQ ID NO: 80769 - RNA, 20 nt, Artificial Sequence
  MKO10080769_B_Dcaf17
  gRNA
uuuauuaugggaaugcccag

SEQ ID NO: 80770 - RNA, 20 nt, Artificial Sequence
  MKO10080770_B_Dcaf4
  gRNA
ucaaccucguccagcagaac

SEQ ID NO: 80771 - RNA, 20 nt, Artificial Sequence
  MKO10080771_B_Dcaf4
  gRNA
uugacggggacucagcauca

SEQ ID NO: 80772 - RNA, 20 nt, Artificial Sequence
  MKO10080772_B_Dcaf4
  gRNA
ugaccgguuuaacuucauca

SEQ ID NO: 80773 - RNA, 20 nt, Artificial Sequence
  MKO10080773_B_Dcaf5
  gRNA
gcucaugaagaugcaguaua

SEQ ID NO: 80774 - RNA, 20 nt, Artificial Sequence
  MKO10080774_B_Dcaf5
  gRNA
uggaacaagcuauccauucc

SEQ ID NO: 80775 - RNA, 20 nt, Artificial Sequence
  MKO10080775_B_Dcaf5
  gRNA
ccggccaucaucugaagagc

SEQ ID NO: 80776 - RNA, 20 nt, Artificial Sequence
  MKO10080776_B_Dcaf6
  gRNA
uuuagguuaauacaaucugu

SEQ ID NO: 80777 - RNA, 20 nt, Artificial Sequence
  MKO10080777_B_Dcaf6
  gRNA
uaguaauccauacagcagaa

SEQ ID NO: 80778 - RNA, 20 nt, Artificial Sequence
  MKO10080778_B_Dcaf6
  gRNA
aacaguuccaucuucaccac

SEQ ID NO: 80779 - RNA, 20 nt, Artificial Sequence
  MKO10080779_B_Dcaf7
  gRNA
gcacguugugucaaugcuug

SEQ ID NO: 80780 - RNA, 20 nt, Artificial Sequence
  MKO10080780_B_Dcaf7
  gRNA
acuagagaccgggcaagugc

SEQ ID NO: 80781 - RNA, 20 nt, Artificial Sequence
  MKO10080781_B_Dcaf7
  gRNA
ggauagacgcccuuuguguc

SEQ ID NO: 80782 - RNA, 20 nt, Artificial Sequence
  MKO10080782_B_Dcaf8
  gRNA
guuaaacuuacgaagcuggc

SEQ ID NO: 80783 - RNA, 20 nt, Artificial Sequence
  MKO10080783_B_Dcaf8
  gRNA
cugcaagaacaccaagcgug

SEQ ID NO: 80784 - RNA, 20 nt, Artificial Sequence
  MKO10080784_B_Dcaf8
  gRNA
caucccgggcacacauagcc

SEQ ID NO: 80785 - RNA, 20 nt, Artificial Sequence
  MKO10080785_B_Dcakd
  gRNA
ccgcauggccaaucacguuc

SEQ ID NO: 80786 - RNA, 20 nt, Artificial Sequence
  MKO10080786_B_Dcakd
  gRNA
gaauggcgacaucgaccgca

SEQ ID NO: 80787 - RNA, 20 nt, Artificial Sequence
  MKO10080787_B_Dcakd
  gRNA
aggcuaccgauacgugauuc

SEQ ID NO: 80788 - RNA, 20 nt, Artificial Sequence
  MKO10080788_B_Dcbld1
  gRNA
auagucagaagcgcaggucu

SEQ ID NO: 80789 - RNA, 20 nt, Artificial Sequence
  MKO10080789_B_Dcbld1
  gRNA
ucacuucguuugaguucagc

SEQ ID NO: 80790 - RNA, 20 nt, Artificial Sequence
  MKO10080790_B_Dcbld1
  gRNA
gacauagcaggagauauuuc

SEQ ID NO: 80791 - RNA, 20 nt, Artificial Sequence
  MKO10080791_B_Dcbld2
  gRNA
ucauuccuaggcaaauacug

SEQ ID NO: 80792 - RNA, 20 nt, Artificial Sequence
  MKO10080792_B_Dcbld2
  gRNA
cucaguaaguacugcccagc

SEQ ID NO: 80793 - RNA, 20 nt, Artificial Sequence
  MKO10080793_B_Dcbld2
  gRNA
guuccagauauuucagcaaa

SEQ ID NO: 80794 - RNA, 20 nt, Artificial Sequence
  MKO10080794_B_Dcc
  gRNA
ugcucugcagaguccgaccg

SEQ ID NO: 80795 - RNA, 20 nt, Artificial Sequence
  MKO10080795_B_Dcc
  gRNA
ugauagauuccgucugggaa

SEQ ID NO: 80796 - RNA, 20 nt, Artificial Sequence
  MKO10080796_B_Dcc
  gRNA
cguguggucgucuugcccuc

SEQ ID NO: 80797 - RNA, 20 nt, Artificial Sequence
  MKO10080797_B_Dcdc2a
  gRNA
ggcgagaagccgggcuuaug

SEQ ID NO: 80798 - RNA, 20 nt, Artificial Sequence
  MKO10080798_B_Dcdc2a
  gRNA
uccaacuuacaaaauggugc

SEQ ID NO: 80799 - RNA, 20 nt, Artificial Sequence
  MKO10080799_B_Dcdc2a
  gRNA
accuguggacagccccacuc

SEQ ID NO: 80800 - RNA, 20 nt, Artificial Sequence
  MKO10080800_B_Dcdc2b
  gRNA
cggggauccuuccccuuacu

SEQ ID NO: 80801 - RNA, 20 nt, Artificial Sequence
  MKO10080801_B_Dcdc2b
  gRNA
ggccauccacuuucuaugcc

SEQ ID NO: 80802 - RNA, 20 nt, Artificial Sequence
  MKO10080802_B_Dcdc2b
  gRNA
guggauggcccaguuucccc

SEQ ID NO: 80803 - RNA, 20 nt, Artificial Sequence
  MKO10080803_B_Dcdc2c
  gRNA
guccucauggguccccagug

SEQ ID NO: 80804 - RNA, 20 nt, Artificial Sequence
  MKO10080804_B_Dcdc2c
  gRNA
uugccuuucaggagauuugg

SEQ ID NO: 80805 - RNA, 20 nt, Artificial Sequence
  MKO10080805_B_Dcdc2c
  gRNA
uucaacuuucucaucuuuga

SEQ ID NO: 80806 - RNA, 20 nt, Artificial Sequence
  MKO10080806_B_Dchs1
  gRNA
agaauuagcccgucugccua

SEQ ID NO: 80807 - RNA, 20 nt, Artificial Sequence
  MKO10080807_B_Dchs1
  gRNA
auuaugcccacacuggugcc

SEQ ID NO: 80808 - RNA, 20 nt, Artificial Sequence
  MKO10080808_B_Dchs1
  gRNA
aaagucgcccaugggguccc

SEQ ID NO: 80809 - RNA, 20 nt, Artificial Sequence
  MKO10080809_B_Dck
  gRNA
gcucugcacguugcaccacc

SEQ ID NO: 80810 - RNA, 20 nt, Artificial Sequence
  MKO10080810_B_Dck
  gRNA
aaggugaaagaccaccguuc

SEQ ID NO: 80811 - RNA, 20 nt, Artificial Sequence
  MKO10080811_B_Dck
  gRNA
ggcucggauccggcugagac

SEQ ID NO: 80812 - RNA, 20 nt, Artificial Sequence
  MKO10080812_B_Dclk1
  gRNA
cuuggugacuugcccgagcg

SEQ ID NO: 80813 - RNA, 20 nt, Artificial Sequence
  MKO10080813_B_Dclk1
  gRNA
ucuuuccccagaaugucgag

SEQ ID NO: 80814 - RNA, 20 nt, Artificial Sequence
  MKO10080814_B_Dclk1
  gRNA
auagcaucagcgucccgcag

SEQ ID NO: 80815 - RNA, 20 nt, Artificial Sequence
  MKO10080815_B_Dclk2
  gRNA
gccucagcugcgaaguauuc

SEQ ID NO: 80816 - RNA, 20 nt, Artificial Sequence
  MKO10080816_B_Dclk2
  gRNA
uugucucaccgcuaugaucc

SEQ ID NO: 80817 - RNA, 20 nt, Artificial Sequence
  MKO10080817_B_Dclk2
  gRNA
uggacuucggaguggaaagc

SEQ ID NO: 80818 - RNA, 20 nt, Artificial Sequence
  MKO10080818_B_Dclk3
  gRNA
ugauguugaagagcucgucu

SEQ ID NO: 80819 - RNA, 20 nt, Artificial Sequence
  MKO10080819_B_Dclk3
  gRNA
ggaggagucccccaacaguu

SEQ ID NO: 80820 - RNA, 20 nt, Artificial Sequence
  MKO10080820_B_Dclk3
  gRNA
ucccucucaggacuucggaa

SEQ ID NO: 80821 - RNA, 20 nt, Artificial Sequence
  MKO10080821_B_Dclre1a
  gRNA
cuuaccucgcugcaauagac

SEQ ID NO: 80822 - RNA, 20 nt, Artificial Sequence
  MKO10080822_B_Dclre1a
  gRNA
cagcauggaacgcucucgcc

SEQ ID NO: 80823 - RNA, 20 nt, Artificial Sequence
  MKO10080823_B_Dclre1a
  gRNA
uuccauucugaucauuacgc

SEQ ID NO: 80824 - RNA, 20 nt, Artificial Sequence
  MKO10080824_B_Dclre1b
  gRNA
cacuugcuugucgaaguucc

SEQ ID NO: 80825 - RNA, 20 nt, Artificial Sequence
  MKO10080825_B_Dclre1b
  gRNA
aucuaugagcguuacaguca

SEQ ID NO: 80826 - RNA, 20 nt, Artificial Sequence
  MKO10080826_B_Dclre1b
  gRNA
ucuugcccaauuucaucuag

SEQ ID NO: 80827 - RNA, 20 nt, Artificial Sequence
  MKO10080827_B_Dclre1c
  gRNA
cuagcccaaaguacagauuc

SEQ ID NO: 80828 - RNA, 20 nt, Artificial Sequence
  MKO10080828_B_Dclre1c
  gRNA
gcagauaucuuuaguugaug

SEQ ID NO: 80829 - RNA, 20 nt, Artificial Sequence
  MKO10080829_B_Dclre1c
  gRNA
aacaacagcuccuuagugac

SEQ ID NO: 80830 - RNA, 20 nt, Artificial Sequence
  MKO10080830_B_Dcn
  gRNA
uugagggaucgcaguuaugu

SEQ ID NO: 80831 - RNA, 20 nt, Artificial Sequence
  MKO10080831_B_Dcn
  gRNA
gaucagcaaaaucaguccag

SEQ ID NO: 80832 - RNA, 20 nt, Artificial Sequence
  MKO10080832_B_Dcn
  gRNA
uagguuuggacaaagugccc

SEQ ID NO: 80833 - RNA, 20 nt, Artificial Sequence
  MKO10080833_B_Dcp1a
  gRNA
ucaucgcauagcaaaacuca

SEQ ID NO: 80834 - RNA, 20 nt, Artificial Sequence
  MKO10080834_B_Dcp1a
  gRNA
ugagccagugaauaaagauu

SEQ ID NO: 80835 - RNA, 20 nt, Artificial Sequence
  MKO10080835_B_Dcp1a
  gRNA
acaaugguaaagccauggua

SEQ ID NO: 80836 - RNA, 20 nt, Artificial Sequence
  MKO10080836_B_Dcp1b
  gRNA
ucccccgugaccuugagcuc

SEQ ID NO: 80837 - RNA, 20 nt, Artificial Sequence
  MKO10080837_B_Dcp1b
  gRNA
agaacccauuacuaaagacc

SEQ ID NO: 80838 - RNA, 20 nt, Artificial Sequence
  MKO10080838_B_Dcp1b
  gRNA
cauuaugaauaggcucagca

SEQ ID NO: 80839 - RNA, 20 nt, Artificial Sequence
  MKO10080839_B_Dcp2
  gRNA
aagucucuuaucccgcacug

SEQ ID NO: 80840 - RNA, 20 nt, Artificial Sequence
  MKO10080840_B_Dcp2
  gRNA
gcucgcuuguacaucauucc

SEQ ID NO: 80841 - RNA, 20 nt, Artificial Sequence
  MKO10080841_B_Dcp2
  gRNA
ugauguacaagcgagcaagc

SEQ ID NO: 80842 - RNA, 20 nt, Artificial Sequence
  MKO10080842_B_Dcpp1
  gRNA
aucuacccuuaagaaauacc

SEQ ID NO: 80843 - RNA, 20 nt, Artificial Sequence
  MKO10080843_B_Dcpp1
  gRNA
ugacuuaccuugugucaaaa

SEQ ID NO: 80844 - RNA, 20 nt, Artificial Sequence
  MKO10080844_B_Dcpp1
  gRNA
agacuuugagauguuccagc

SEQ ID NO: 80845 - RNA, 20 nt, Artificial Sequence
  MKO10080845_B_Dcpp2
  gRNA
cuucaggcuagauugauugu

SEQ ID NO: 80846 - RNA, 20 nt, Artificial Sequence
  MKO10080846_B_Dcpp2
  gRNA
agacuuugagauguuccagc

SEQ ID NO: 80847 - RNA, 20 nt, Artificial Sequence
  MKO10080847_B_Dcpp2
  gRNA
aucuagccugaagaaauacc

SEQ ID NO: 80848 - RNA, 20 nt, Artificial Sequence
  MKO10080848_B_Dcpp3
  gRNA
aaaaaaauauaacaaguauc

SEQ ID NO: 80849 - RNA, 20 nt, Artificial Sequence
  MKO10080849_B_Dcpp3
  gRNA
ugacuuaccuugugucaaaa

SEQ ID NO: 80850 - RNA, 20 nt, Artificial Sequence
  MKO10080850_B_Dcpp3
  gRNA
agacuuugagauguuccagc

SEQ ID NO: 80851 - RNA, 20 nt, Artificial Sequence
  MKO10080851_B_Dcps
  gRNA
gaccaucaccuuacccuacc

SEQ ID NO: 80852 - RNA, 20 nt, Artificial Sequence
  MKO10080852_B_Dcps
  gRNA
gccacguguucuaccugaaa

SEQ ID NO: 80853 - RNA, 20 nt, Artificial Sequence
  MKO10080853_B_Dcps
  gRNA
acacguggcgcagcuccuaa

SEQ ID NO: 80854 - RNA, 20 nt, Artificial Sequence
  MKO10080854_B_Dcst1
  gRNA
ccaauaggcuugggggccau

SEQ ID NO: 80855 - RNA, 20 nt, Artificial Sequence
  MKO10080855_B_Dcst1
  gRNA
ucgccacaggaaccggaucc

SEQ ID NO: 80856 - RNA, 20 nt, Artificial Sequence
  MKO10080856_B_Dcst1
  gRNA
aggggaggugccccagccga

SEQ ID NO: 80857 - RNA, 20 nt, Artificial Sequence
  MKO10080857_B_Dcsuamp
  gRNA
cagaaucauggacgacuccu

SEQ ID NO: 80858 - RNA, 20 nt, Artificial Sequence
  MKO10080858_B_Dcsuamp
  gRNA
cauagaucaucuucauuugc

SEQ ID NO: 80859 - RNA, 20 nt, Artificial Sequence
  MKO10080859_B_Dcsuamp
  gRNA
uuccaguccugaaaaugauu

SEQ ID NO: 80860 - RNA, 20 nt, Artificial Sequence
  MKO10080860_B_Dcud
  gRNA
aguuuagcacauucguuaca

SEQ ID NO: 80861 - RNA, 20 nt, Artificial Sequence
  MKO10080861_B_Dcud
  gRNA
aggucaucacugcacccauu

SEQ ID NO: 80862 - RNA, 20 nt, Artificial Sequence
  MKO10080862_B_Dcud
  gRNA
ggguacaauggcaugccaaa

SEQ ID NO: 80863 - RNA, 20 nt, Artificial Sequence
  MKO10080863_B_Dcun1
  gRNA
gcugccagcggagucugagc

SEQ ID NO: 80864 - RNA, 20 nt, Artificial Sequence
  MKO10080864_B_Dcun1
  gRNA
cugcuccaucuucaaauacu

SEQ ID NO: 80865 - RNA, 20 nt, Artificial Sequence
  MKO10080865_B_Dcun1
  gRNA
cagauccaaguauuugaaga

SEQ ID NO: 80866 - RNA, 20 nt, Artificial Sequence
  MKO10080866_B_Dcun2
  gRNA
acagauuucucagaucgcau

SEQ ID NO: 80867 - RNA, 20 nt, Artificial Sequence
  MKO10080867_B_Dcun2
  gRNA
ucucuagcuuggagaggguc

SEQ ID NO: 80868 - RNA, 20 nt, Artificial Sequence
  MKO10080868_B_Dcun2
  gRNA
cuuguccuugaacuugucgu

SEQ ID NO: 80869 - RNA, 20 nt, Artificial Sequence
  MKO10080869_B_Dcun3
  gRNA
agacuguagccgcugcacau

SEQ ID NO: 80870 - RNA, 20 nt, Artificial Sequence
  MKO10080870_B_Dcun3
  gRNA
cgcuggguguacgggccggg

SEQ ID NO: 80871 - RNA, 20 nt, Artificial Sequence
  MKO10080871_B_Dcun3
  gRNA
gcaaugcgaucaauguacuc

SEQ ID NO: 80872 - RNA, 20 nt, Artificial Sequence
  MKO10080872_B_Dcun4
  gRNA
gcgaagaaauuacaugccuu

SEQ ID NO: 80873 - RNA, 20 nt, Artificial Sequence
  MKO10080873_B_Dcun4
  gRNA
guacuuacccguugugugug

SEQ ID NO: 80874 - RNA, 20 nt, Artificial Sequence
  MKO10080874_B_Dcun4
  gRNA
cagaaaacccucacacacaa

SEQ ID NO: 80875 - RNA, 20 nt, Artificial Sequence
  MKO10080875_B_Dcun5
  gRNA
ugcccuuuaccuugccauug

SEQ ID NO: 80876 - RNA, 20 nt, Artificial Sequence
  MKO10080876_B_Dcun5
  gRNA
aucaacauuaccugggcagc

SEQ ID NO: 80877 - RNA, 20 nt, Artificial Sequence
  MKO10080877_B_Dcun5
  gRNA
aguauuacccccagaaacug

SEQ ID NO: 80878 - RNA, 20 nt, Artificial Sequence
  MKO10080878_B_Dcun6
  gRNA
uguguagaaagcgaaaucag

SEQ ID NO: 80879 - RNA, 20 nt, Artificial Sequence
  MKO10080879_B_Dcun6
  gRNA
caccaacaacguauuugaag

SEQ ID NO: 80880 - RNA, 20 nt, Artificial Sequence
  MKO10080880_B_Dcun6
  gRNA
uacagugugaagauugcucc

SEQ ID NO: 80881 - RNA, 20 nt, Artificial Sequence
  MKO10080881_B_Dcupp1
  gRNA
cgucgcuaagcuccuccuga

SEQ ID NO: 80882 - RNA, 20 nt, Artificial Sequence
  MKO10080882_B_Dcupp1
  gRNA
cuagcagcagguuccgaggc

SEQ ID NO: 80883 - RNA, 20 nt, Artificial Sequence
  MKO10080883_B_Dcupp1
  gRNA
gggagcaguuccaccagccu

SEQ ID NO: 80884 - RNA, 20 nt, Artificial Sequence
  MKO10080884_B_Dcu
  gRNA
augacccaacgcugauuagu

SEQ ID NO: 80885 - RNA, 20 nt, Artificial Sequence
  MKO10080885_B_Dcu
  gRNA
agguccaggacgccccuaua

SEQ ID NO: 80886 - RNA, 20 nt, Artificial Sequence
  MKO10080886_B_Dcu
  gRNA
gcuuggaugacuacaaccgc

SEQ ID NO: 80887 - RNA, 20 nt, Artificial Sequence
  MKO10080887_B_Dcun1d1
  gRNA
guugucuuucucaaaaugac

SEQ ID NO: 80888 - RNA, 20 nt, Artificial Sequence
  MKO10080888_B_Dcun1d1
  gRNA
ccucaggaugaaaauaaaau

SEQ ID NO: 80889 - RNA, 20 nt, Artificial Sequence
  MKO10080889_B_Dcun1d1
  gRNA
ugacagcauagaaaaacuaa

SEQ ID NO: 80890 - RNA, 20 nt, Artificial Sequence
  MKO10080890_B_Dcun1d2
  gRNA
ccccgccaguaucagcguuu

SEQ ID NO: 80891 - RNA, 20 nt, Artificial Sequence
  MKO10080891_B_Dcun1d2
  gRNA
caguuucuuccaaaaccccg

SEQ ID NO: 80892 - RNA, 20 nt, Artificial Sequence
  MKO10080892_B_Dcun1d2
  gRNA
cacugcucuucauagacucu

SEQ ID NO: 80893 - RNA, 20 nt, Artificial Sequence
  MKO10080893_B_Dcun1d3
  gRNA
cuguuaggaaauuuagccac

SEQ ID NO: 80894 - RNA, 20 nt, Artificial Sequence
  MKO10080894_B_Dcun1d3
  gRNA
ggcuagccaccgugaggaac

SEQ ID NO: 80895 - RNA, 20 nt, Artificial Sequence
  MKO10080895_B_Dcun1d3
  gRNA
uaccgguuuacauuucaguu

SEQ ID NO: 80896 - RNA, 20 nt, Artificial Sequence
  MKO10080896_B_Dcun1d4
  gRNA
uuagcaaagugaugccaccc

SEQ ID NO: 80897 - RNA, 20 nt, Artificial Sequence
  MKO10080897_B_Dcun1d4
  gRNA
cuaccauacccuuaacaagc

SEQ ID NO: 80898 - RNA, 20 nt, Artificial Sequence
  MKO10080898_B_Dcun1d4
  gRNA
cagaaucugacagaagacgu

SEQ ID NO: 80899 - RNA, 20 nt, Artificial Sequence
  MKO10080899_B_Dcun1d5
  gRNA
gaagguccugaugaaguugu

SEQ ID NO: 80900 - RNA, 20 nt, Artificial Sequence
  MKO10080900_B_Dcun1d5
  gRNA
uaccaaggaagaaugguuaa

SEQ ID NO: 80901 - RNA, 20 nt, Artificial Sequence
  MKO10080901_B_Dcun1d5
  gRNA
aaauuggaggcugaaagcau

SEQ ID NO: 80902 - RNA, 20 nt, Artificial Sequence
  MKO10080902_B_Dcxr
  gRNA
uccccgagcuaucaugcccu

SEQ ID NO: 80903 - RNA, 20 nt, Artificial Sequence
  MKO10080903_B_Dcxr
  gRNA
aauaacgcaguguccuggug

SEQ ID NO: 80904 - RNA, 20 nt, Artificial Sequence
  MKO10080904_B_Dcxr
  gRNA
agcccgaagauucacauuga

SEQ ID NO: 80905 - RNA, 20 nt, Artificial Sequence
  MKO10080905_B_Dcx
  gRNA
caauggggaccguuacuuca

SEQ ID NO: 80906 - RNA, 20 nt, Artificial Sequence
  MKO10080906_B_Dcx
  gRNA
gcgguagaaacguaccuucu

SEQ ID NO: 80907 - RNA, 20 nt, Artificial Sequence
  MKO10080907_B_Dcx
  gRNA
agaaaucaucuugagcauag

SEQ ID NO: 80908 - RNA, 20 nt, Artificial Sequence
  MKO10080908_B_Dda1
  gRNA
ccacgcggacucugugugca

SEQ ID NO: 80909 - RNA, 20 nt, Artificial Sequence
  MKO10080909_B_Dda1
  gRNA
aaaagacgaacauacuucug

SEQ ID NO: 80910 - RNA, 20 nt, Artificial Sequence
  MKO10080910_B_Dda1
  gRNA
cacaggaccuagguguccuc

SEQ ID NO: 80911 - RNA, 20 nt, Artificial Sequence
  MKO10080911_B_Ddah1
  gRNA
ggacccaaccugauugcaau

SEQ ID NO: 80912 - RNA, 20 nt, Artificial Sequence
  MKO10080912_B_Ddah1
  gRNA
ggccuucugugcagauucgc

SEQ ID NO: 80913 - RNA, 20 nt, Artificial Sequence
  MKO10080913_B_Ddah1
  gRNA
uccaaaagaacaaaucaacg

SEQ ID NO: 80914 - RNA, 20 nt, Artificial Sequence
  MKO10080914_B_Ddah2
  gRNA
uggagugcguaaagcccucc

SEQ ID NO: 80915 - RNA, 20 nt, Artificial Sequence
  MKO10080915_B_Ddah2
  gRNA
gaugagaaugcgacgcugga

SEQ ID NO: 80916 - RNA, 20 nt, Artificial Sequence
  MKO10080916_B_Ddah2
  gRNA
cuaggacuucgcugucucaa

SEQ ID NO: 80917 - RNA, 20 nt, Artificial Sequence
  MKO10080917_B_Ddb1
  gRNA
cucucgaagagacaccucau

SEQ ID NO: 80918 - RNA, 20 nt, Artificial Sequence
  MKO10080918_B_Ddb1
  gRNA
gggucuucggccagucaaag

SEQ ID NO: 80919 - RNA, 20 nt, Artificial Sequence
  MKO10080919_B_Ddb1
  gRNA
cugcuuauacuccaagauac

SEQ ID NO: 80920 - RNA, 20 nt, Artificial Sequence
  MKO10080920_B_Ddb2
  gRNA
ggacguaguccuccugucaa

SEQ ID NO: 80921 - RNA, 20 nt, Artificial Sequence
  MKO10080921_B_Ddb2
  gRNA
gccuuuaaaauccugcagcc

SEQ ID NO: 80922 - RNA, 20 nt, Artificial Sequence
  MKO10080922_B_Ddb2
  gRNA
ucacuugcaagaguuugagc

SEQ ID NO: 80923 - RNA, 20 nt, Artificial Sequence
  MKO10080923_B_Ddc
  gRNA
gguugcuuacacaucugauc

SEQ ID NO: 80924 - RNA, 20 nt, Artificial Sequence
  MKO10080924_B_Ddc
  gRNA
ccuccccacaggugacacac

SEQ ID NO: 80925 - RNA, 20 nt, Artificial Sequence
  MKO10080925_B_Ddc
  gRNA
ccaugagagcuucugcccuu

SEQ ID NO: 80926 - RNA, 20 nt, Artificial Sequence
  MKO10080926_B_Ddhd1
  gRNA
agugguuuauugaugggacg

SEQ ID NO: 80927 - RNA, 20 nt, Artificial Sequence
  MKO10080927_B_Ddhd1
  gRNA
acgauaugagaagucugcga

SEQ ID NO: 80928 - RNA, 20 nt, Artificial Sequence
  MKO10080928_B_Ddhd1
  gRNA
gagaaccguuacccaaaaac

SEQ ID NO: 80929 - RNA, 20 nt, Artificial Sequence
  MKO10080929_B_Ddhd2
  gRNA
guacaccgucucacuuccga

SEQ ID NO: 80930 - RNA, 20 nt, Artificial Sequence
  MKO10080930_B_Ddhd2
  gRNA
gugcauuaccagccaauugc

SEQ ID NO: 80931 - RNA, 20 nt, Artificial Sequence
  MKO10080931_B_Ddhd2
  gRNA
uuucgaagcauuguucaaug

SEQ ID NO: 80932 - RNA, 20 nt, Artificial Sequence
  MKO10080932_B_Ddi1
  gRNA
aaagcagcaugcuucgaauc

SEQ ID NO: 80933 - RNA, 20 nt, Artificial Sequence
  MKO10080933_B_Ddi1
  gRNA
uagcaaccccaccccaccgu

SEQ ID NO: 80934 - RNA, 20 nt, Artificial Sequence
  MKO10080934_B_Ddi1
  gRNA
cucuacuaacccauuugauc

SEQ ID NO: 80935 - RNA, 20 nt, Artificial Sequence
  MKO10080935_B_Ddi2
  gRNA
uggguugcgcuccuucagca

SEQ ID NO: 80936 - RNA, 20 nt, Artificial Sequence
  MKO10080936_B_Ddi2
  gRNA
gguuggccagcagcaugucu

SEQ ID NO: 80937 - RNA, 20 nt, Artificial Sequence
  MKO10080937_B_Ddi2
  gRNA
ccccuuugaucucgaagcuc

SEQ ID NO: 80938 - RNA, 20 nt, Artificial Sequence
  MKO10080938_B_Ddit3
  gRNA
ggugcccccaauuucaucug

SEQ ID NO: 80939 - RNA, 20 nt, Artificial Sequence
  MKO10080939_B_Ddit3
  gRNA
gucgaucagagcccgccgug

SEQ ID NO: 80940 - RNA, 20 nt, Artificial Sequence
  MKO10080940_B_Ddit3
  gRNA
agccugguaugaggaucugc

SEQ ID NO: 80941 - RNA, 20 nt, Artificial Sequence
  MKO10080941_B_Ddit4l
  gRNA
caaacugcccguugcaacca

SEQ ID NO: 80942 - RNA, 20 nt, Artificial Sequence
  MKO10080942_B_Ddit4l
  gRNA
uucuuucagauuucgacuac

SEQ ID NO: 80943 - RNA, 20 nt, Artificial Sequence
  MKO10080943_B_Ddit4l
  gRNA
cuucaaauaccaccucguug

SEQ ID NO: 80944 - RNA, 20 nt, Artificial Sequence
  MKO10080944_B_Ddit4
  gRNA
uucguccucgucucgaacuc

SEQ ID NO: 80945 - RNA, 20 nt, Artificial Sequence
  MKO10080945_B_Ddit4
  gRNA
gccgcgagcccaaucgcgcc

SEQ ID NO: 80946 - RNA, 20 nt, Artificial Sequence
  MKO10080946_B_Ddit4
  gRNA
cguccagcagugccccccgc

SEQ ID NO: 80947 - RNA, 20 nt, Artificial Sequence
  MKO10080947_B_Ddn
  gRNA
cgcuccuucucgacagucca

SEQ ID NO: 80948 - RNA, 20 nt, Artificial Sequence
  MKO10080948_B_Ddn
  gRNA
gcuucgucugaguccgaauc

SEQ ID NO: 80949 - RNA, 20 nt, Artificial Sequence
  MKO10080949_B_Ddn
  gRNA
ccgaccauccgugcucccgc

SEQ ID NO: 80950 - RNA, 20 nt, Artificial Sequence
  MKO10080950_B_Ddost
  gRNA
uucgcagcacacacucauug

SEQ ID NO: 80951 - RNA, 20 nt, Artificial Sequence
  MKO10080951_B_Ddost
  gRNA
guggcugccagcucugauau

SEQ ID NO: 80952 - RNA, 20 nt, Artificial Sequence
  MKO10080952_B_Ddost
  gRNA
ucacugcccagcucccgaag

SEQ ID NO: 80953 - RNA, 20 nt, Artificial Sequence
  MKO10080953_B_Ddo
  gRNA
ugucagcuacagcuucgaca

SEQ ID NO: 80954 - RNA, 20 nt, Artificial Sequence
  MKO10080954_B_Ddo
  gRNA
aggcagaagucucgcacuuc

SEQ ID NO: 80955 - RNA, 20 nt, Artificial Sequence
  MKO10080955_B_Ddo
  gRNA
ugcagaugcggguguucacc

SEQ ID NO: 80956 - RNA, 20 nt, Artificial Sequence
  MKO10080956_B_Ddr1
  gRNA
ucccgggggaguagugcuga

SEQ ID NO: 80957 - RNA, 20 nt, Artificial Sequence
  MKO10080957_B_Ddr1
  gRNA
cuaccgcugcccgccacagc

SEQ ID NO: 80958 - RNA, 20 nt, Artificial Sequence
  MKO10080958_B_Ddr1
  gRNA
agagauaucgcugucaggaa

SEQ ID NO: 80959 - RNA, 20 nt, Artificial Sequence
  MKO10080959_B_Ddr2
  gRNA
aacccucaugcacacguuca

SEQ ID NO: 80960 - RNA, 20 nt, Artificial Sequence
  MKO10080960_B_Ddr2
  gRNA
guauccuacaaugcuccagc

SEQ ID NO: 80961 - RNA, 20 nt, Artificial Sequence
  MKO10080961_B_Ddr2
  gRNA
cagcaguuuguacucccugg

SEQ ID NO: 80962 - RNA, 20 nt, Artificial Sequence
  MKO10080962_B_Ddrgk1
  gRNA
ccuguugggugaacuucugc

SEQ ID NO: 80963 - RNA, 20 nt, Artificial Sequence
  MKO10080963_B_Ddrgk1
  gRNA
acgccuagagucccaacgug

SEQ ID NO: 80964 - RNA, 20 nt, Artificial Sequence
  MKO10080964_B_Ddrgk1
  gRNA
ccagcagaaguucacccaac

SEQ ID NO: 80965 - RNA, 20 nt, Artificial Sequence
  MKO10080965_B_Ddt
  gRNA
ccccgauggaagagaccaga

SEQ ID NO: 80966 - RNA, 20 nt, Artificial Sequence
  MKO10080966_B_Ddt
  gRNA
gcuuggcagaucggaaagaa

SEQ ID NO: 80967 - RNA, 20 nt, Artificial Sequence
  MKO10080967_B_Ddt
  gRNA
uccgaucugccaagccucca

SEQ ID NO: 80968 - RNA, 20 nt, Artificial Sequence
  MKO10080968_B_Ddx10
  gRNA
auguguugaagaagucgacc

SEQ ID NO: 80969 - RNA, 20 nt, Artificial Sequence
  MKO10080969_B_Ddx10
  gRNA
gcaagaagcacaguaccgcu

SEQ ID NO: 80970 - RNA, 20 nt, Artificial Sequence
  MKO10080970_B_Ddx10
  gRNA
accuugcaaagccaacccua

SEQ ID NO: 80971 - RNA, 20 nt, Artificial Sequence
  MKO10080971_B_Ddx11
  gRNA
aggcucuccugcgccucagc

SEQ ID NO: 80972 - RNA, 20 nt, Artificial Sequence
  MKO10080972_B_Ddx11
  gRNA
uccuaggguggacgaggcug

SEQ ID NO: 80973 - RNA, 20 nt, Artificial Sequence
  MKO10080973_B_Ddx11
  gRNA
ggaggaagaacauauaacca

SEQ ID NO: 80974 - RNA, 20 nt, Artificial Sequence
  MKO10080974_B_Ddx17
  gRNA
uacguggaaaguuagcauga

SEQ ID NO: 80975 - RNA, 20 nt, Artificial Sequence
  MKO10080975_B_Ddx17
  gRNA
agcgguuacgaaaaaagaag

SEQ ID NO: 80976 - RNA, 20 nt, Artificial Sequence
  MKO10080976_B_Ddx17
  gRNA
uauaaaccaccagccauacu

SEQ ID NO: 80977 - RNA, 20 nt, Artificial Sequence
  MKO10080977_B_Ddx18
  gRNA
aauacuaagggaccuucugg

SEQ ID NO: 80978 - RNA, 20 nt, Artificial Sequence
  MKO10080978_B_Ddx18
  gRNA
ccauaccugccuuccagaag

SEQ ID NO: 80979 - RNA, 20 nt, Artificial Sequence
  MKO10080979_B_Ddx18
  gRNA
gaggugcccagccugccccu

SEQ ID NO: 80980 - RNA, 20 nt, Artificial Sequence
  MKO10080980_B_Ddx19a
  gRNA
aaagucaaagcagacaccaa

SEQ ID NO: 80981 - RNA, 20 nt, Artificial Sequence
  MKO10080981_B_Ddx19a
  gRNA
aggaaaccucagcuucucca

SEQ ID NO: 80982 - RNA, 20 nt, Artificial Sequence
  MKO10080982_B_Ddx19a
  gRNA
gcugaucagaagcaaucuug

SEQ ID NO: 80983 - RNA, 20 nt, Artificial Sequence
  MKO10080983_B_Ddx19b
  gRNA
guugagcaacuugcaucuua

SEQ ID NO: 80984 - RNA, 20 nt, Artificial Sequence
  MKO10080984_B_Ddx19b
  gRNA
ugucuucucuguguuugcau

SEQ ID NO: 80985 - RNA, 20 nt, Artificial Sequence
  MKO10080985_B_Ddx19b
  gRNA
ugcaaacacagagaagacag

SEQ ID NO: 80986 - RNA, 20 nt, Artificial Sequence
  MKO10080986_B_Ddx1
  gRNA
gaaucuaucccauugauccu

SEQ ID NO: 80987 - RNA, 20 nt, Artificial Sequence
  MKO10080987_B_Ddx1
  gRNA
ccuauucaggcugcagaaac

SEQ ID NO: 80988 - RNA, 20 nt, Artificial Sequence
  MKO10080988_B_Ddx1
  gRNA
gggaaaacaacuauuaaaac

SEQ ID NO: 80989 - RNA, 20 nt, Artificial Sequence
  MKO10080989_B_Ddx20
  gRNA
cugaacagcaauuucucuug

SEQ ID NO: 80990 - RNA, 20 nt, Artificial Sequence
  MKO10080990_B_Ddx20
  gRNA
ugcuacuuacccugaaguuu

SEQ ID NO: 80991 - RNA, 20 nt, Artificial Sequence
  MKO10080991_B_Ddx20
  gRNA
agaacuugacuaccugaauc

SEQ ID NO: 80992 - RNA, 20 nt, Artificial Sequence
  MKO10080992_B_Ddx21
  gRNA
ccuugaaguuucucaauuaa

SEQ ID NO: 80993 - RNA, 20 nt, Artificial Sequence
  MKO10080993_B_Ddx21
  gRNA
gcuuugauaggaaauaccug

SEQ ID NO: 80994 - RNA, 20 nt, Artificial Sequence
  MKO10080994_B_Ddx21
  gRNA
accuuucaucauguguacag

SEQ ID NO: 80995 - RNA, 20 nt, Artificial Sequence
  MKO10080995_B_Ddx23
  gRNA
acaaggaccgaaaaagaucc

SEQ ID NO: 80996 - RNA, 20 nt, Artificial Sequence
  MKO10080996_B_Ddx23
  gRNA
gcucccgcuccuucuuacuc

SEQ ID NO: 80997 - RNA, 20 nt, Artificial Sequence
  MKO10080997_B_Ddx23
  gRNA
ggaacuucuggccaagaaaa

SEQ ID NO: 80998 - RNA, 20 nt, Artificial Sequence
  MKO10080998_B_Ddx24
  gRNA
cccagagaggcguuugaugc

SEQ ID NO: 80999 - RNA, 20 nt, Artificial Sequence
  MKO10080999_B_Ddx24
  gRNA
gugccacggcuugccaacuu

SEQ ID NO: 81000 - RNA, 20 nt, Artificial Sequence
  MKO10081000_B_Ddx24
  gRNA
gcugacuccuacucgagagc

SEQ ID NO: 81001 - RNA, 20 nt, Artificial Sequence
  MKO10081001_B_Ddx25
  gRNA
ucacgggugugcuagcauca

SEQ ID NO: 81002 - RNA, 20 nt, Artificial Sequence
  MKO10081002_B_Ddx25
  gRNA
uggauucuauuaaggacuga

SEQ ID NO: 81003 - RNA, 20 nt, Artificial Sequence
  MKO10081003_B_Ddx25
  gRNA
gagggccaucucuuggauuu

SEQ ID NO: 81004 - RNA, 20 nt, Artificial Sequence
  MKO10081004_B_Ddx26b
  gRNA
ccuguuuaccuugaugcagu

SEQ ID NO: 81005 - RNA, 20 nt, Artificial Sequence
  MKO10081005_B_Ddx26b
  gRNA
uggacugacuacucuugguc

SEQ ID NO: 81006 - RNA, 20 nt, Artificial Sequence
  MKO10081006_B_Ddx26b
  gRNA
uacugcuagcguucaagaag

SEQ ID NO: 81007 - RNA, 20 nt, Artificial Sequence
  MKO10081007_B_Ddx27
  gRNA
ucggccuaccugcuuuggug

SEQ ID NO: 81008 - RNA, 20 nt, Artificial Sequence
  MKO10081008_B_Ddx27
  gRNA
aaucuucucaucuaguguag

SEQ ID NO: 81009 - RNA, 20 nt, Artificial Sequence
  MKO10081009_B_Ddx27
  gRNA
augagaagauugagaaaguc

SEQ ID NO: 81010 - RNA, 20 nt, Artificial Sequence
  MKO10081010_B_Ddx28
  gRNA
gccgccgcgccgagaccagc

SEQ ID NO: 81011 - RNA, 20 nt, Artificial Sequence
  MKO10081011_B_Ddx28
  gRNA
ugcacagacaucgccucccg

SEQ ID NO: 81012 - RNA, 20 nt, Artificial Sequence
  MKO10081012_B_Ddx28
  gRNA
acuucagcuguauagacgac

SEQ ID NO: 81013 - RNA, 20 nt, Artificial Sequence
  MKO10081013_B_Ddx31
  gRNA
gcagaguaucccagugcugc

SEQ ID NO: 81014 - RNA, 20 nt, Artificial Sequence
  MKO10081014_B_Ddx31
  gRNA
gugaugcuccaccagcaaaa

SEQ ID NO: 81015 - RNA, 20 nt, Artificial Sequence
  MKO10081015_B_Ddx31
  gRNA
uaaaaauguccaguaugacc

SEQ ID NO: 81016 - RNA, 20 nt, Artificial Sequence
  MKO10081016_B_Ddx39b
  gRNA
cagcagcuggagcccguuac

SEQ ID NO: 81017 - RNA, 20 nt, Artificial Sequence
  MKO10081017_B_Ddx39b
  gRNA
gggucaugcgaaaaauuucc

SEQ ID NO: 81018 - RNA, 20 nt, Artificial Sequence
  MKO10081018_B_Ddx39b
  gRNA
cuccccugcagacaugcguc

SEQ ID NO: 81019 - RNA, 20 nt, Artificial Sequence
  MKO10081019_B_Ddx39
  gRNA
ccggaucuccuugcucaggg

SEQ ID NO: 81020 - RNA, 20 nt, Artificial Sequence
  MKO10081020_B_Ddx39
  gRNA
ccagcaugaguguauucccc

SEQ ID NO: 81021 - RNA, 20 nt, Artificial Sequence
  MKO10081021_B_Ddx39
  gRNA
caugugccacacgagggagc

SEQ ID NO: 81022 - RNA, 20 nt, Artificial Sequence
  MKO10081022_B_Ddx3x
  gRNA
agaucguggaaguggaucaa

SEQ ID NO: 81023 - RNA, 20 nt, Artificial Sequence
  MKO10081023_B_Ddx3x
  gRNA
agagggaagucuagcuucuu

SEQ ID NO: 81024 - RNA, 20 nt, Artificial Sequence
  MKO10081024_B_Ddx3x
  gRNA
ucugauuaucugaagaguuc

SEQ ID NO: 81025 - RNA, 20 nt, Artificial Sequence
  MKO10081025_B_Ddx3y
  gRNA
gcuauauaccuccucacuua

SEQ ID NO: 81026 - RNA, 20 nt, Artificial Sequence
  MKO10081026_B_Ddx3y
  gRNA
cuugaaaggggucugugaua

SEQ ID NO: 81027 - RNA, 20 nt, Artificial Sequence
  MKO10081027_B_Ddx3y
  gRNA
guuucucuguuccuuaagug

SEQ ID NO: 81028 - RNA, 20 nt, Artificial Sequence
  MKO10081028_B_Ddx41
  gRNA
gcugcugcagcgaagacgca

SEQ ID NO: 81029 - RNA, 20 nt, Artificial Sequence
  MKO10081029_B_Ddx41
  gRNA
agcacgcaaggaguccgcca

SEQ ID NO: 81030 - RNA, 20 nt, Artificial Sequence
  MKO10081030_B_Ddx41
  gRNA
augacgauccaaucaaaacu

SEQ ID NO: 81031 - RNA, 20 nt, Artificial Sequence
  MKO10081031_B_Ddx42
  gRNA
uucagccaugaaugccucua

SEQ ID NO: 81032 - RNA, 20 nt, Artificial Sequence
  MKO10081032_B_Ddx42
  gRNA
cagugaugaugaccccuuag

SEQ ID NO: 81033 - RNA, 20 nt, Artificial Sequence
  MKO10081033_B_Ddx42
  gRNA
caugaagagacuugaagaaa

SEQ ID NO: 81034 - RNA, 20 nt, Artificial Sequence
  MKO10081034_B_Ddx43
  gRNA
uccaaaauacaacgaacacu

SEQ ID NO: 81035 - RNA, 20 nt, Artificial Sequence
  MKO10081035_B_Ddx43
  gRNA
cacaagugcaaauagacaac

SEQ ID NO: 81036 - RNA, 20 nt, Artificial Sequence
  MKO10081036_B_Ddx43
  gRNA
uccuaguguucguuguauuu

SEQ ID NO: 81037 - RNA, 20 nt, Artificial Sequence
  MKO10081037_B_Ddx46
  gRNA
uggagcuuggaggacgacga

SEQ ID NO: 81038 - RNA, 20 nt, Artificial Sequence
  MKO10081038_B_Ddx46
  gRNA
acaagagaagaucucgguca

SEQ ID NO: 81039 - RNA, 20 nt, Artificial Sequence
  MKO10081039_B_Ddx46
  gRNA
agagcagcguaagaaggcua

SEQ ID NO: 81040 - RNA, 20 nt, Artificial Sequence
  MKO10081040_B_Ddx47
  gRNA
uggccgacugauugaccacu

SEQ ID NO: 81041 - RNA, 20 nt, Artificial Sequence
  MKO10081041_B_Ddx47
  gRNA
aauagcuucgaucuggaucu

SEQ ID NO: 81042 - RNA, 20 nt, Artificial Sequence
  MKO10081042_B_Ddx47
  gRNA
ccagaucgaagcuauuccuu

SEQ ID NO: 81043 - RNA, 20 nt, Artificial Sequence
  MKO10081043_B_Ddx49
  gRNA
aacugcgcagguggucagcc

SEQ ID NO: 81044 - RNA, 20 nt, Artificial Sequence
  MKO10081044_B_Ddx49
  gRNA
gggguggcaaucacuacaug

SEQ ID NO: 81045 - RNA, 20 nt, Artificial Sequence
  MKO10081045_B_Ddx49
  gRNA
cccuuauggcaucuucugcu

SEQ ID NO: 81046 - RNA, 20 nt, Artificial Sequence
  MKO10081046_B_Ddx4
  gRNA
uuacaggauaaauauucuuc

SEQ ID NO: 81047 - RNA, 20 nt, Artificial Sequence
  MKO10081047_B_Ddx4
  gRNA
gauagcucugguuucuggaa

SEQ ID NO: 81048 - RNA, 20 nt, Artificial Sequence
  MKO10081048_B_Ddx4
  gRNA
uuuggaagaggaaagggcuu

SEQ ID NO: 81049 - RNA, 20 nt, Artificial Sequence
  MKO10081049_B_Ddx50
  gRNA
uacucauccacaucuccauu

SEQ ID NO: 81050 - RNA, 20 nt, Artificial Sequence
  MKO10081050_B_Ddx50
  gRNA
uuugucuacagagugauaga

SEQ ID NO: 81051 - RNA, 20 nt, Artificial Sequence
  MKO10081051_B_Ddx50
  gRNA
uaaaaaaagccgcucaccaa

SEQ ID NO: 81052 - RNA, 20 nt, Artificial Sequence
  MKO10081052_B_Ddx51
  gRNA
cuccucgaaagugcugacca

SEQ ID NO: 81053 - RNA, 20 nt, Artificial Sequence
  MKO10081053_B_Ddx51
  gRNA
acugguuguacuucccacua

SEQ ID NO: 81054 - RNA, 20 nt, Artificial Sequence
  MKO10081054_B_Ddx51
  gRNA
ucagcacuuucgaggagggc

SEQ ID NO: 81055 - RNA, 20 nt, Artificial Sequence
  MKO10081055_B_Ddx52
  gRNA
uuguuagggucgggaacuuc

SEQ ID NO: 81056 - RNA, 20 nt, Artificial Sequence
  MKO10081056_B_Ddx52
  gRNA
cuccagaauauucuagacgc

SEQ ID NO: 81057 - RNA, 20 nt, Artificial Sequence
  MKO10081057_B_Ddx52
  gRNA
uacauuucagcaacuugacc

SEQ ID NO: 81058 - RNA, 20 nt, Artificial Sequence
  MKO10081058_B_Ddx54
  gRNA
cacaucugauacgcacucug

SEQ ID NO: 81059 - RNA, 20 nt, Artificial Sequence
  MKO10081059_B_Ddx54
  gRNA
auccuuacuugucuccaccc

SEQ ID NO: 81060 - RNA, 20 nt, Artificial Sequence
  MKO10081060_B_Ddx54
  gRNA
ccucaagacugccuugaucc

SEQ ID NO: 81061 - RNA, 20 nt, Artificial Sequence
  MKO10081061_B_Ddx55
  gRNA
cgaagcacuuuccgcaguuc

SEQ ID NO: 81062 - RNA, 20 nt, Artificial Sequence
  MKO10081062_B_Ddx55
  gRNA
aaacaaagauguugccgcag

SEQ ID NO: 81063 - RNA, 20 nt, Artificial Sequence
  MKO10081063_B_Ddx55
  gRNA
uauuugcaggugacagguag

SEQ ID NO: 81064 - RNA, 20 nt, Artificial Sequence
  MKO10081064_B_Ddx56
  gRNA
ucgcacaucccgagcacagu

SEQ ID NO: 81065 - RNA, 20 nt, Artificial Sequence
  MKO10081065_B_Ddx56
  gRNA
agaaaagccugguaaauccg

SEQ ID NO: 81066 - RNA, 20 nt, Artificial Sequence
  MKO10081066_B_Ddx56
  gRNA
gaguucauccucaaagccaa

SEQ ID NO: 81067 - RNA, 20 nt, Artificial Sequence
  MKO10081067_B_Ddx58
  gRNA
gucggaucugauaagacauu

SEQ ID NO: 81068 - RNA, 20 nt, Artificial Sequence
  MKO10081068_B_Ddx58
  gRNA
agaggaggugcaguacauuc

SEQ ID NO: 81069 - RNA, 20 nt, Artificial Sequence
  MKO10081069_B_Ddx58
  gRNA
uuggaugcccuguaccaugc

SEQ ID NO: 81070 - RNA, 20 nt, Artificial Sequence
  MKO10081070_B_Ddx59
  gRNA
gugagcuguucuaugcuauc

SEQ ID NO: 81071 - RNA, 20 nt, Artificial Sequence
  MKO10081071_B_Ddx59
  gRNA
agaagcacugucuucaugcg

SEQ ID NO: 81072 - RNA, 20 nt, Artificial Sequence
  MKO10081072_B_Ddx59
  gRNA
aggcgcagaucuguugagcg

SEQ ID NO: 81073 - RNA, 20 nt, Artificial Sequence
  MKO10081073_B_Ddx5
  gRNA
cuggugguuuauguguacaa

SEQ ID NO: 81074 - RNA, 20 nt, Artificial Sequence
  MKO10081074_B_Ddx5
  gRNA
agauacauacagaagaagca

SEQ ID NO: 81075 - RNA, 20 nt, Artificial Sequence
  MKO10081075_B_Ddx5
  gRNA
gcggugcgccuugccaaauc

SEQ ID NO: 81076 - RNA, 20 nt, Artificial Sequence
  MKO10081076_B_Ddx60
  gRNA
cuuugcuaauaacauccaac

SEQ ID NO: 81077 - RNA, 20 nt, Artificial Sequence
  MKO10081077_B_Ddx60
  gRNA
caaaagccugauucaacagc

SEQ ID NO: 81078 - RNA, 20 nt, Artificial Sequence
  MKO10081078_B_Ddx60
  gRNA
auggcuuuagcacaucuguu

SEQ ID NO: 81079 - RNA, 20 nt, Artificial Sequence
  MKO10081079_B_Ddx6
  gRNA
ggaaaaaccaucuccuaucc

SEQ ID NO: 81080 - RNA, 20 nt, Artificial Sequence
  MKO10081080_B_Ddx6
  gRNA
cugaagaaggacaauauuca

SEQ ID NO: 81081 - RNA, 20 nt, Artificial Sequence
  MKO10081081_B_Ddx6
  gRNA
uaggaugugaccuccacaaa

SEQ ID NO: 81082 - RNA, 20 nt, Artificial Sequence
  MKO10081082_B_Deaf1
  gRNA
aagagaagcauccgcuaugc

SEQ ID NO: 81083 - RNA, 20 nt, Artificial Sequence
  MKO10081083_B_Deaf1
  gRNA
aucgauaucaggacaugucc

SEQ ID NO: 81084 - RNA, 20 nt, Artificial Sequence
  MKO10081084_B_Deaf1
  gRNA
ugugaagacguuaucugcag

SEQ ID NO: 81085 - RNA, 20 nt, Artificial Sequence
  MKO10081085_B_Dear1
  gRNA
aagugucaaccauaaugagc

SEQ ID NO: 81086 - RNA, 20 nt, Artificial Sequence
  MKO10081086_B_Dear1
  gRNA
ugacagccccuuaccucuuu

SEQ ID NO: 81087 - RNA, 20 nt, Artificial Sequence
  MKO10081087_B_Dear1
  gRNA
gacaaacugcuauagccuuu

SEQ ID NO: 81088 - RNA, 20 nt, Artificial Sequence
  MKO10081088_B_Deb1
  gRNA
ucaaucaagagacaauccag

SEQ ID NO: 81089 - RNA, 20 nt, Artificial Sequence
  MKO10081089_B_Deb1
  gRNA
cuuugugagacugcuugugu

SEQ ID NO: 81090 - RNA, 20 nt, Artificial Sequence
  MKO10081090_B_Deb1
  gRNA
caacacaagcagucucacaa

SEQ ID NO: 81091 - RNA, 20 nt, Artificial Sequence
  MKO10081091_B_Decr1
  gRNA
aaaguggcuuucauuacugg

SEQ ID NO: 81092 - RNA, 20 nt, Artificial Sequence
  MKO10081092_B_Decr1
  gRNA
cuggaacugaucaaaguugc

SEQ ID NO: 81093 - RNA, 20 nt, Artificial Sequence
  MKO10081093_B_Decr1
  gRNA
aaguugucauugccuugcca

SEQ ID NO: 81094 - RNA, 20 nt, Artificial Sequence
  MKO10081094_B_Decr2
  gRNA
ucaugaaaaucucugcgauc

SEQ ID NO: 81095 - RNA, 20 nt, Artificial Sequence
  MKO10081095_B_Decr2
  gRNA
gcggugccucccucugucua

SEQ ID NO: 81096 - RNA, 20 nt, Artificial Sequence
  MKO10081096_B_Decr2
  gRNA
acucggacauccauagacag

SEQ ID NO: 81097 - RNA, 20 nt, Artificial Sequence
  MKO10081097_B_Dedd2
  gRNA
ugcucgccugucgccgacgc

SEQ ID NO: 81098 - RNA, 20 nt, Artificial Sequence
  MKO10081098_B_Dedd2
  gRNA
agucggggccgcccuagcag

SEQ ID NO: 81099 - RNA, 20 nt, Artificial Sequence
  MKO10081099_B_Dedd2
  gRNA
ccggcgucgccuguugcuga

SEQ ID NO: 81100 - RNA, 20 nt, Artificial Sequence
  MKO10081100_B_Dedd
  gRNA
ccagcgaaaacgccggaagu

SEQ ID NO: 81101 - RNA, 20 nt, Artificial Sequence
  MKO10081101_B_Dedd
  gRNA
agucucgccagaaugcgucg

SEQ ID NO: 81102 - RNA, 20 nt, Artificial Sequence
  MKO10081102_B_Dedd
  gRNA
gcccgagggagaaccacacu

SEQ ID NO: 81103 - RNA, 20 nt, Artificial Sequence
  MKO10081103_B_Def6
  gRNA
ucaucgggaaccaugaucag

SEQ ID NO: 81104 - RNA, 20 nt, Artificial Sequence
  MKO10081104_B_Def6
  gRNA
gaacaucccccaugaccccg

SEQ ID NO: 81105 - RNA, 20 nt, Artificial Sequence
  MKO10081105_B_Def6
  gRNA
uccggccacagggcuaucug

SEQ ID NO: 81106 - RNA, 20 nt, Artificial Sequence
  MKO10081106_B_Def8
  gRNA
acccaacauccggguucucc

SEQ ID NO: 81107 - RNA, 20 nt, Artificial Sequence
  MKO10081107_B_Def8
  gRNA
ggccaucgaagaaugcaaac

SEQ ID NO: 81108 - RNA, 20 nt, Artificial Sequence
  MKO10081108_B_Def8
  gRNA
ccuuguagaagcgauguucc

SEQ ID NO: 81109 - RNA, 20 nt, Artificial Sequence
  MKO10081109_B_Defa-rs1
  gRNA
cagccuuuaugcuguguauu

SEQ ID NO: 81110 - RNA, 20 nt, Artificial Sequence
  MKO10081110_B_Defa-rs1
  gRNA
agagccuucugugccuccaa

SEQ ID NO: 81111 - RNA, 20 nt, Artificial Sequence
  MKO10081111_B_Defa-rs1
  gRNA
agaugaagagacuaaaacug

SEQ ID NO: 81112 - RNA, 20 nt, Artificial Sequence
  MKO10081112_B_Defa-rs7
  gRNA
gucuccagcguugagagauc

SEQ ID NO: 81113 - RNA, 20 nt, Artificial Sequence
  MKO10081113_B_Defa-rs7
  gRNA
caaaagagacagacacagcc

SEQ ID NO: 81114 - RNA, 20 nt, Artificial Sequence
  MKO10081114_B_Defa-rs7
  gRNA
agaugaagagacuaaaacug

SEQ ID NO: 81115 - RNA, 20 nt, Artificial Sequence
  MKO10081115_B_Defa17
  gRNA
gucuccagcguugagagauc

SEQ ID NO: 81116 - RNA, 20 nt, Artificial Sequence
  MKO10081116_B_Defa17
  gRNA
caaaagagacagacacagcc

SEQ ID NO: 81117 - RNA, 20 nt, Artificial Sequence
  MKO10081117_B_Defa17
  gRNA
agaugaagagacuaaaacug

SEQ ID NO: 81118 - RNA, 20 nt, Artificial Sequence
  MKO10081118_B_Defa20
  gRNA
cugauaugcuauuguagaaa

SEQ ID NO: 81119 - RNA, 20 nt, Artificial Sequence
  MKO10081119_B_Defa20
  gRNA
caaaggagacagacacagcc

SEQ ID NO: 81120 - RNA, 20 nt, Artificial Sequence
  MKO10081120_B_Defa20
  gRNA
uccuauccaaaacacagaug

SEQ ID NO: 81121 - RNA, 20 nt, Artificial Sequence
  MKO10081121_B_Defa21
  gRNA
caugaagagcagauccuucu

SEQ ID NO: 81122 - RNA, 20 nt, Artificial Sequence
  MKO10081122_B_Defa21
  gRNA
ccucucugcccucauccugc

SEQ ID NO: 81123 - RNA, 20 nt, Artificial Sequence
  MKO10081123_B_Defa21
  gRNA
caaaggagacagacacagcc

SEQ ID NO: 81124 - RNA, 20 nt, Artificial Sequence
  MKO10081124_B_Defa22
  gRNA
aucugcacucucagcggcgg

SEQ ID NO: 81125 - RNA, 20 nt, Artificial Sequence
  MKO10081125_B_Defa22
  gRNA
caaaggagacagacacagcc

SEQ ID NO: 81126 - RNA, 20 nt, Artificial Sequence
  MKO10081126_B_Defa22
  gRNA
agaugaagagacuaauacug

SEQ ID NO: 81127 - RNA, 20 nt, Artificial Sequence
  MKO10081127_B_Defa23
  gRNA
gucuccagcguugagagauc

SEQ ID NO: 81128 - RNA, 20 nt, Artificial Sequence
  MKO10081128_B_Defa23
  gRNA
caaaagagacagacacagcc

SEQ ID NO: 81129 - RNA, 20 nt, Artificial Sequence
  MKO10081129_B_Defa23
  gRNA
agaugaagagacuaaaacug

SEQ ID NO: 81130 - RNA, 20 nt, Artificial Sequence
  MKO10081130_B_Defa24
  gRNA
uagucucuucaucuguauuu

SEQ ID NO: 81131 - RNA, 20 nt, Artificial Sequence
  MKO10081131_B_Defa24
  gRNA
ccucucugcccucguccugc

SEQ ID NO: 81132 - RNA, 20 nt, Artificial Sequence
  MKO10081132_B_Defa24
  gRNA
caaaagagacagacacagcc

SEQ ID NO: 81133 - RNA, 20 nt, Artificial Sequence
  MKO10081133_B_Defa25
  gRNA
cauuaaaugacccuuucugc

SEQ ID NO: 81134 - RNA, 20 nt, Artificial Sequence
  MKO10081134_B_Defa25
  gRNA
caaaggagacagaaacagcu

SEQ ID NO: 81135 - RNA, 20 nt, Artificial Sequence
  MKO10081135_B_Defa25
  gRNA
aguaaaauugaugagcagcc

SEQ ID NO: 81136 - RNA, 20 nt, Artificial Sequence
  MKO10081136_B_Defa26
  gRNA
guccccagcguugagagauc

SEQ ID NO: 81137 - RNA, 20 nt, Artificial Sequence
  MKO10081137_B_Defa26
  gRNA
caaaggagacagacacagcc

SEQ ID NO: 81138 - RNA, 20 nt, Artificial Sequence
  MKO10081138_B_Defa26
  gRNA
agaugaagagacuaauacug

SEQ ID NO: 81139 - RNA, 20 nt, Artificial Sequence
  MKO10081139_B_Defa2
  gRNA
cugauaugcuauuguagaaa

SEQ ID NO: 81140 - RNA, 20 nt, Artificial Sequence
  MKO10081140_B_Defa2
  gRNA
caaaggagacagacacagcc

SEQ ID NO: 81141 - RNA, 20 nt, Artificial Sequence
  MKO10081141_B_Defa2
  gRNA
uccuauccaaaacacagaug

SEQ ID NO: 81142 - RNA, 20 nt, Artificial Sequence
  MKO10081142_B_Defa3
  gRNA
gucuccagcguugagagauc

SEQ ID NO: 81143 - RNA, 20 nt, Artificial Sequence
  MKO10081143_B_Defa3
  gRNA
caaaagagacagacacagcc

SEQ ID NO: 81144 - RNA, 20 nt, Artificial Sequence
  MKO10081144_B_Defa3
  gRNA
agaugaagagacuaaaacug

SEQ ID NO: 81145 - RNA, 20 nt, Artificial Sequence
  MKO10081145_B_Defa4
  gRNA
agaugaagagacuaauacug

SEQ ID NO: 81146 - RNA, 20 nt, Artificial Sequence
  MKO10081146_B_Defa4
  gRNA
gcagccaggggaagaggacc

SEQ ID NO: 81147 - RNA, 20 nt, Artificial Sequence
  MKO10081147_B_Defa4
  gRNA
aggaucagccuggaccugga

SEQ ID NO: 81148 - RNA, 20 nt, Artificial Sequence
  MKO10081148_B_Defa5
  gRNA
auaugcuauuguagaauaag

SEQ ID NO: 81149 - RNA, 20 nt, Artificial Sequence
  MKO10081149_B_Defa5
  gRNA
caaaggagauagacacagcc

SEQ ID NO: 81150 - RNA, 20 nt, Artificial Sequence
  MKO10081150_B_Defa5
  gRNA
agaugaagagacuaauacug

SEQ ID NO: 81151 - RNA, 20 nt, Artificial Sequence
  MKO10081151_B_Defa6
  gRNA
uagucucuucaucuguauuu

SEQ ID NO: 81152 - RNA, 20 nt, Artificial Sequence
  MKO10081152_B_Defa6
  gRNA
ccucucugcccucguccugc

SEQ ID NO: 81153 - RNA, 20 nt, Artificial Sequence
  MKO10081153_B_Defa6
  gRNA
caaaagagacagacacagcc

SEQ ID NO: 81154 - RNA, 20 nt, Artificial Sequence
  MKO10081154_B_Defb10
  gRNA
cagagagcagagaguccuca

SEQ ID NO: 81155 - RNA, 20 nt, Artificial Sequence
  MKO10081155_B_Defb10
  gRNA
ugucacuauaauauuugucc

SEQ ID NO: 81156 - RNA, 20 nt, Artificial Sequence
  MKO10081156_B_Defb11
  gRNA
cagagagcagagaguccuca

SEQ ID NO: 81157 - RNA, 20 nt, Artificial Sequence
  MKO10081157_B_Defb11
  gRNA
cuuucauguuuaugcaacag

SEQ ID NO: 81158 - RNA, 20 nt, Artificial Sequence
  MKO10081158_B_Defb11
  gRNA
uacucaaagcacaacuugca

SEQ ID NO: 81159 - RNA, 20 nt, Artificial Sequence
  MKO10081159_B_Defb12
  gRNA
auuuaccuccuggaaaugac

SEQ ID NO: 81160 - RNA, 20 nt, Artificial Sequence
  MKO10081160_B_Defb12
  gRNA
uugcugugugcgagacaugc

SEQ ID NO: 81161 - RNA, 20 nt, Artificial Sequence
  MKO10081161_B_Defb12
  gRNA
cauagagagugagaagauug

SEQ ID NO: 81162 - RNA, 20 nt, Artificial Sequence
  MKO10081162_B_Defb13
  gRNA
uaaagcacucagcuucacau

SEQ ID NO: 81163 - RNA, 20 nt, Artificial Sequence
  MKO10081163_B_Defb13
  gRNA
ccuggggcacauuguacaga

SEQ ID NO: 81164 - RNA, 20 nt, Artificial Sequence
  MKO10081164_B_Defb13
  gRNA
aagccaauuuccugugcugc

SEQ ID NO: 81165 - RNA, 20 nt, Artificial Sequence
  MKO10081165_B_Defb14
  gRNA
caggcaccaagaacaagaug

SEQ ID NO: 81166 - RNA, 20 nt, Artificial Sequence
  MKO10081166_B_Defb14
  gRNA
gggucuucuacuucuucuuu

SEQ ID NO: 81167 - RNA, 20 nt, Artificial Sequence
  MKO10081167_B_Defb14
  gRNA
cuauuuguucuuccuuucca

SEQ ID NO: 81168 - RNA, 20 nt, Artificial Sequence
  MKO10081168_B_Defb15
  gRNA
ugugugacaguccagcccug

SEQ ID NO: 81169 - RNA, 20 nt, Artificial Sequence
  MKO10081169_B_Defb15
  gRNA
guugcucuugcucuuuccac

SEQ ID NO: 81170 - RNA, 20 nt, Artificial Sequence
  MKO10081170_B_Defb15
  gRNA
cucaucaaaaaaugcauucu

SEQ ID NO: 81171 - RNA, 20 nt, Artificial Sequence
  MKO10081171_B_Defb18
  gRNA
caaucaacaaugaagauguu

SEQ ID NO: 81172 - RNA, 20 nt, Artificial Sequence
  MKO10081172_B_Defb18
  gRNA
auucagacuugcauguacca

SEQ ID NO: 81173 - RNA, 20 nt, Artificial Sequence
  MKO10081173_B_Defb18
  gRNA
aagaacacacaaauguuccc

SEQ ID NO: 81174 - RNA, 20 nt, Artificial Sequence
  MKO10081174_B_Defb19
  gRNA
ccugcuucuugccauacuug

SEQ ID NO: 81175 - RNA, 20 nt, Artificial Sequence
  MKO10081175_B_Defb19
  gRNA
gcugccuccaguccuacgug

SEQ ID NO: 81176 - RNA, 20 nt, Artificial Sequence
  MKO10081176_B_Defb19
  gRNA
uuccugcaaaaagagugaac

SEQ ID NO: 81177 - RNA, 20 nt, Artificial Sequence
  MKO10081177_B_Defb1
  gRNA
aaagcuuaccuggcuccauc

SEQ ID NO: 81178 - RNA, 20 nt, Artificial Sequence
  MKO10081178_B_Defb1
  gRNA
guuggcauucucacaagucu

SEQ ID NO: 81179 - RNA, 20 nt, Artificial Sequence
  MKO10081179_B_Defb1
  gRNA
uuuacagguucccuguaguu

SEQ ID NO: 81180 - RNA, 20 nt, Artificial Sequence
  MKO10081180_B_Defb20
  gRNA
ugaagacaugaagcugcuuc

SEQ ID NO: 81181 - RNA, 20 nt, Artificial Sequence
  MKO10081181_B_Defb20
  gRNA
caagaagcacucagucguug

SEQ ID NO: 81182 - RNA, 20 nt, Artificial Sequence
  MKO10081182_B_Defb20
  gRNA
cacaacaguauuucccaugc

SEQ ID NO: 81183 - RNA, 20 nt, Artificial Sequence
  MKO10081183_B_Defb21
  gRNA
ucuaccucccaagagccaug

SEQ ID NO: 81184 - RNA, 20 nt, Artificial Sequence
  MKO10081184_B_Defb21
  gRNA
aaguacaccuaugaaaucug

SEQ ID NO: 81185 - RNA, 20 nt, Artificial Sequence
  MKO10081185_B_Defb21
  gRNA
gaucuguccucagauuucau

SEQ ID NO: 81186 - RNA, 20 nt, Artificial Sequence
  MKO10081186_B_Defb22
  gRNA
ugaucacaagaguagacagu

SEQ ID NO: 81187 - RNA, 20 nt, Artificial Sequence
  MKO10081187_B_Defb22
  gRNA
aauugccagcacucccgcac

SEQ ID NO: 81188 - RNA, 20 nt, Artificial Sequence
  MKO10081188_B_Defb22
  gRNA
guucuggacuucaaaauuag

SEQ ID NO: 81189 - RNA, 20 nt, Artificial Sequence
  MKO10081189_B_Defb23
  gRNA
cagucucaugcuucagucuc

SEQ ID NO: 81190 - RNA, 20 nt, Artificial Sequence
  MKO10081190_B_Defb23
  gRNA
aucucuacgauguccucauc

SEQ ID NO: 81191 - RNA, 20 nt, Artificial Sequence
  MKO10081191_B_Defb23
  gRNA
guccaauaccaacucugcua

SEQ ID NO: 81192 - RNA, 20 nt, Artificial Sequence
  MKO10081192_B_Defb25
  gRNA
gagcagaauccacuuugcca

SEQ ID NO: 81193 - RNA, 20 nt, Artificial Sequence
  MKO10081193_B_Defb25
  gRNA
gaccuucaugcaccuguguc

SEQ ID NO: 81194 - RNA, 20 nt, Artificial Sequence
  MKO10081194_B_Defb25
  gRNA
ucaagccuucacgccccuca

SEQ ID NO: 81195 - RNA, 20 nt, Artificial Sequence
  MKO10081195_B_Defb26
  gRNA
uguccauggguugcuaacuc

SEQ ID NO: 81196 - RNA, 20 nt, Artificial Sequence
  MKO10081196_B_Defb26
  gRNA
uucacugguauauugaaacu

SEQ ID NO: 81197 - RNA, 20 nt, Artificial Sequence
  MKO10081197_B_Defb26
  gRNA
ucagaagacaaacuacccuc

SEQ ID NO: 81198 - RNA, 20 nt, Artificial Sequence
  MKO10081198_B_Defb28
  gRNA
acauuccagugaccaaagau

SEQ ID NO: 81199 - RNA, 20 nt, Artificial Sequence
  MKO10081199_B_Defb28
  gRNA
uaccuggggaugucugagcc

SEQ ID NO: 81200 - RNA, 20 nt, Artificial Sequence
  MKO10081200_B_Defb28
  gRNA
ccacaaggacagcuaagguc

SEQ ID NO: 81201 - RNA, 20 nt, Artificial Sequence
  MKO10081201_B_Defb29
  gRNA
auccugguugacgagaccac

SEQ ID NO: 81202 - RNA, 20 nt, Artificial Sequence
  MKO10081202_B_Defb29
  gRNA
gauugcgugugagcuuuacc

SEQ ID NO: 81203 - RNA, 20 nt, Artificial Sequence
  MKO10081203_B_Defb29
  gRNA
uaaagcucacacgcaaucca

SEQ ID NO: 81204 - RNA, 20 nt, Artificial Sequence
  MKO10081204_B_Defb2
  gRNA
cagagagcagagaguccuca

SEQ ID NO: 81205 - RNA, 20 nt, Artificial Sequence
  MKO10081205_B_Defb2
  gRNA
ucugacacaguacccuccau

SEQ ID NO: 81206 - RNA, 20 nt, Artificial Sequence
  MKO10081206_B_Defb2
  gRNA
uucucugggaaacagcuccc

SEQ ID NO: 81207 - RNA, 20 nt, Artificial Sequence
  MKO10081207_B_Defb30
  gRNA
agagcaagacaaagagcacg

SEQ ID NO: 81208 - RNA, 20 nt, Artificial Sequence
  MKO10081208_B_Defb30
  gRNA
ucuguuugcaguuagaagug

SEQ ID NO: 81209 - RNA, 20 nt, Artificial Sequence
  MKO10081209_B_Defb30
  gRNA
guugugcugcuuagagaaaa

SEQ ID NO: 81210 - RNA, 20 nt, Artificial Sequence
  MKO10081210_B_Defb33
  gRNA
gagaagaaauaacagccuca

SEQ ID NO: 81211 - RNA, 20 nt, Artificial Sequence
  MKO10081211_B_Defb33
  gRNA
uaucgacucuugcauucugc

SEQ ID NO: 81212 - RNA, 20 nt, Artificial Sequence
  MKO10081212_B_Defb33
  gRNA
uagucugagcaagacacaca

SEQ ID NO: 81213 - RNA, 20 nt, Artificial Sequence
  MKO10081213_B_Defb34
  gRNA
aagaacuuguugcucucugc

SEQ ID NO: 81214 - RNA, 20 nt, Artificial Sequence
  MKO10081214_B_Defb34
  gRNA
guugcccuugcuccuuccac

SEQ ID NO: 81215 - RNA, 20 nt, Artificial Sequence
  MKO10081215_B_Defb34
  gRNA
aagggcaaccagucagauga

SEQ ID NO: 81216 - RNA, 20 nt, Artificial Sequence
  MKO10081216_B_Defb35
  gRNA
uugcugugugcgagacaugc

SEQ ID NO: 81217 - RNA, 20 nt, Artificial Sequence
  MKO10081217_B_Defb35
  gRNA
cauagagagugagaagauug

SEQ ID NO: 81218 - RNA, 20 nt, Artificial Sequence
  MKO10081218_B_Defb35
  gRNA
acuucuucugcugucgagag

SEQ ID NO: 81219 - RNA, 20 nt, Artificial Sequence
  MKO10081219_B_Defb36
  gRNA
cuacauuaccuggagugagc

SEQ ID NO: 81220 - RNA, 20 nt, Artificial Sequence
  MKO10081220_B_Defb36
  gRNA
gacguagacgcucuccuucc

SEQ ID NO: 81221 - RNA, 20 nt, Artificial Sequence
  MKO10081221_B_Defb36
  gRNA
cuuuggcuucggcugguauu

SEQ ID NO: 81222 - RNA, 20 nt, Artificial Sequence
  MKO10081222_B_Defb37
  gRNA
uccaacuuccagaacaaccc

SEQ ID NO: 81223 - RNA, 20 nt, Artificial Sequence
  MKO10081223_B_Defb37
  gRNA
gaggagcagcagcagaaagu

SEQ ID NO: 81224 - RNA, 20 nt, Artificial Sequence
  MKO10081224_B_Defb38
  gRNA
uauuucuuccagaucaacca

SEQ ID NO: 81225 - RNA, 20 nt, Artificial Sequence
  MKO10081225_B_Defb38
  gRNA
ccaacagaauaauacaacca

SEQ ID NO: 81226 - RNA, 20 nt, Artificial Sequence
  MKO10081226_B_Defb38
  gRNA
gaggaucaguagcagaaagc

SEQ ID NO: 81227 - RNA, 20 nt, Artificial Sequence
  MKO10081227_B_Defb39
  gRNA
cugcugcugauccucucucu

SEQ ID NO: 81228 - RNA, 20 nt, Artificial Sequence
  MKO10081228_B_Defb39
  gRNA
gaggaucagcagcagaaagu

SEQ ID NO: 81229 - RNA, 20 nt, Artificial Sequence
  MKO10081229_B_Defb3
  gRNA
ccuucuguuugcauuucucc

SEQ ID NO: 81230 - RNA, 20 nt, Artificial Sequence
  MKO10081230_B_Defb3
  gRNA
acaauccaguaaguuguuug

SEQ ID NO: 81231 - RNA, 20 nt, Artificial Sequence
  MKO10081231_B_Defb3
  gRNA
aaggaggcagaugcuggaau

SEQ ID NO: 81232 - RNA, 20 nt, Artificial Sequence
  MKO10081232_B_Defb40
  gRNA
ucaugcuuucagaucaaccc

SEQ ID NO: 81233 - RNA, 20 nt, Artificial Sequence
  MKO10081233_B_Defb40
  gRNA
cacaugguacacaugauuuc

SEQ ID NO: 81234 - RNA, 20 nt, Artificial Sequence
  MKO10081234_B_Defb40
  gRNA
ugugacaguuguuguuuccu

SEQ ID NO: 81235 - RNA, 20 nt, Artificial Sequence
  MKO10081235_B_Defb41
  gRNA
gaaaaauagaugaaacuuca

SEQ ID NO: 81236 - RNA, 20 nt, Artificial Sequence
  MKO10081236_B_Defb41
  gRNA
cuugaugucaauaugacuuc

SEQ ID NO: 81237 - RNA, 20 nt, Artificial Sequence
  MKO10081237_B_Defb41
  gRNA
auacucaucaauaucacaga

SEQ ID NO: 81238 - RNA, 20 nt, Artificial Sequence
  MKO10081238_B_Defb42
  gRNA
uucaugcuuacuguucaucc

SEQ ID NO: 81239 - RNA, 20 nt, Artificial Sequence
  MKO10081239_B_Defb42
  gRNA
ucuucaggucgcuguucgau

SEQ ID NO: 81240 - RNA, 20 nt, Artificial Sequence
  MKO10081240_B_Defb42
  gRNA
aucgguauccuuucuacaac

SEQ ID NO: 81241 - RNA, 20 nt, Artificial Sequence
  MKO10081241_B_Defb43
  gRNA
ugucuuacccagaggaacua

SEQ ID NO: 81242 - RNA, 20 nt, Artificial Sequence
  MKO10081242_B_Defb43
  gRNA
ccaguccucgcaguaucuga

SEQ ID NO: 81243 - RNA, 20 nt, Artificial Sequence
  MKO10081243_B_Defb43
  gRNA
cuucuucacccgacagcaga

SEQ ID NO: 81244 - RNA, 20 nt, Artificial Sequence
  MKO10081244_B_Defb45
  gRNA
uccugaagucaugaagacug

SEQ ID NO: 81245 - RNA, 20 nt, Artificial Sequence
  MKO10081245_B_Defb45
  gRNA
aaagacuuccagcaucuuuc

SEQ ID NO: 81246 - RNA, 20 nt, Artificial Sequence
  MKO10081246_B_Defb45
  gRNA
aaucuaaauucugugaccac

SEQ ID NO: 81247 - RNA, 20 nt, Artificial Sequence
  MKO10081247_B_Defb46
  gRNA
ccuucucuuugcauuucucc

SEQ ID NO: 81248 - RNA, 20 nt, Artificial Sequence
  MKO10081248_B_Defb46
  gRNA
acuagagagauuggcauguc

SEQ ID NO: 81249 - RNA, 20 nt, Artificial Sequence
  MKO10081249_B_Defb46
  gRNA
cucuuauugaacuaauuauu

SEQ ID NO: 81250 - RNA, 20 nt, Artificial Sequence
  MKO10081250_B_Defb47
  gRNA
uuugugaugaugaugcugag

SEQ ID NO: 81251 - RNA, 20 nt, Artificial Sequence
  MKO10081251_B_Defb47
  gRNA
acauccucagacgauacuau

SEQ ID NO: 81252 - RNA, 20 nt, Artificial Sequence
  MKO10081252_B_Defb47
  gRNA
aagcagugcauuucguugaa

SEQ ID NO: 81253 - RNA, 20 nt, Artificial Sequence
  MKO10081253_B_Defb48
  gRNA
cucuacucuauucuuccucu

SEQ ID NO: 81254 - RNA, 20 nt, Artificial Sequence
  MKO10081254_B_Defb48
  gRNA
gacgcucugcgucagucugc

SEQ ID NO: 81255 - RNA, 20 nt, Artificial Sequence
  MKO10081255_B_Defb48
  gRNA
aaacugauagaagacgagau

SEQ ID NO: 81256 - RNA, 20 nt, Artificial Sequence
  MKO10081256_B_Defb4
  gRNA
ccuucucuucacauuucucc

SEQ ID NO: 81257 - RNA, 20 nt, Artificial Sequence
  MKO10081257_B_Defb4
  gRNA
ccauuggucaugcauguuau

SEQ ID NO: 81258 - RNA, 20 nt, Artificial Sequence
  MKO10081258_B_Defb4
  gRNA
ccaauaacaugcaugaccaa

SEQ ID NO: 81259 - RNA, 20 nt, Artificial Sequence
  MKO10081259_B_Defb50
  gRNA
ugcuuucuguugcugacauc

SEQ ID NO: 81260 - RNA, 20 nt, Artificial Sequence
  MKO10081260_B_Defb50
  gRNA
ucagguguuggcagucaccc

SEQ ID NO: 81261 - RNA, 20 nt, Artificial Sequence
  MKO10081261_B_Defb50
  gRNA
uugcucuuucuauagcagca

SEQ ID NO: 81262 - RNA, 20 nt, Artificial Sequence
  MKO10081262_B_Defb5
  gRNA
ccuucucuuugcauuucucc

SEQ ID NO: 81263 - RNA, 20 nt, Artificial Sequence
  MKO10081263_B_Defb5
  gRNA
auucuucagaauggcaguug

SEQ ID NO: 81264 - RNA, 20 nt, Artificial Sequence
  MKO10081264_B_Defb5
  gRNA
cauaugcagguaucugugca

SEQ ID NO: 81265 - RNA, 20 nt, Artificial Sequence
  MKO10081265_B_Defb6
  gRNA
uaaaggcaaagagcagguaa

SEQ ID NO: 81266 - RNA, 20 nt, Artificial Sequence
  MKO10081266_B_Defb6
  gRNA
ucaugccagcguucaugcaa

SEQ ID NO: 81267 - RNA, 20 nt, Artificial Sequence
  MKO10081267_B_Defb6
  gRNA
ccauagcucaugcauguuac

SEQ ID NO: 81268 - RNA, 20 nt, Artificial Sequence
  MKO10081268_B_Defb7
  gRNA
uguucuguucgcauuucucc

SEQ ID NO: 81269 - RNA, 20 nt, Artificial Sequence
  MKO10081269_B_Defb7
  gRNA
cucguuuacuguugaugucu

SEQ ID NO: 81270 - RNA, 20 nt, Artificial Sequence
  MKO10081270_B_Defb7
  gRNA
aaguuccaaucuuaugaaaa

SEQ ID NO: 81271 - RNA, 20 nt, Artificial Sequence
  MKO10081271_B_Defb8
  gRNA
caaguggagacagcagcacc

SEQ ID NO: 81272 - RNA, 20 nt, Artificial Sequence
  MKO10081272_B_Defb8
  gRNA
aaguuccaaucuuaugccua

SEQ ID NO: 81273 - RNA, 20 nt, Artificial Sequence
  MKO10081273_B_Defb8
  gRNA
auaugccaguaucggugcau

SEQ ID NO: 81274 - RNA, 20 nt, Artificial Sequence
  MKO10081274_B_Defb9
  gRNA
cagagagcagagaguccuca

SEQ ID NO: 81275 - RNA, 20 nt, Artificial Sequence
  MKO10081275_B_Defb9
  gRNA
uuuauguucuugcagcaccu

SEQ ID NO: 81276 - RNA, 20 nt, Artificial Sequence
  MKO10081276_B_Defb9
  gRNA
aacaguacccuccuuucuug

SEQ ID NO: 81277 - RNA, 20 nt, Artificial Sequence
  MKO10081277_B_Degs1
  gRNA
cggaccagccccacgccgcc

SEQ ID NO: 81278 - RNA, 20 nt, Artificial Sequence
  MKO10081278_B_Degs1
  gRNA
caccuaagaucuccuugcgc

SEQ ID NO: 81279 - RNA, 20 nt, Artificial Sequence
  MKO10081279_B_Degs1
  gRNA
acacaauaagucccuacucg

SEQ ID NO: 81280 - RNA, 20 nt, Artificial Sequence
  MKO10081280_B_Degs2
  gRNA
agacccacucgaagucgcug

SEQ ID NO: 81281 - RNA, 20 nt, Artificial Sequence
  MKO10081281_B_Degs2
  gRNA
cuuacacuugcgcuuaaccc

SEQ ID NO: 81282 - RNA, 20 nt, Artificial Sequence
  MKO10081282_B_Degs2
  gRNA
gcgcaaguguaagcuggcga

SEQ ID NO: 81283 - RNA, 20 nt, Artificial Sequence
  MKO10081283_B_Dek
  gRNA
ucuagaaaagagucuuaucg

SEQ ID NO: 81284 - RNA, 20 nt, Artificial Sequence
  MKO10081284_B_Dek
  gRNA
guggcccuuacuuugccaga

SEQ ID NO: 81285 - RNA, 20 nt, Artificial Sequence
  MKO10081285_B_Dek
  gRNA
ucaccuugugucacuguaaa

SEQ ID NO: 81286 - RNA, 20 nt, Artificial Sequence
  MKO10081286_B_Dennd1a
  gRNA
gacuacauuugaaguguaug

SEQ ID NO: 81287 - RNA, 20 nt, Artificial Sequence
  MKO10081287_B_Dennd1a
  gRNA
uuacagauccugaggugcag

SEQ ID NO: 81288 - RNA, 20 nt, Artificial Sequence
  MKO10081288_B_Dennd1a
  gRNA
gaaagagugccaccuguccu

SEQ ID NO: 81289 - RNA, 20 nt, Artificial Sequence
  MKO10081289_B_Dennd1b
  gRNA
cuauaaccacccaguaccaa

SEQ ID NO: 81290 - RNA, 20 nt, Artificial Sequence
  MKO10081290_B_Dennd1b
  gRNA
cuuaccacacucaaguugac

SEQ ID NO: 81291 - RNA, 20 nt, Artificial Sequence
  MKO10081291_B_Dennd1b
  gRNA
agauuacuuggccaaggaac

SEQ ID NO: 81292 - RNA, 20 nt, Artificial Sequence
  MKO10081292_B_Dennd1c
  gRNA
guuuccccuucgacauagaa

SEQ ID NO: 81293 - RNA, 20 nt, Artificial Sequence
  MKO10081293_B_Dennd1c
  gRNA
aucccccugccauguuugac

SEQ ID NO: 81294 - RNA, 20 nt, Artificial Sequence
  MKO10081294_B_Dennd1c
  gRNA
cuacagauccccccauccug

SEQ ID NO: 81295 - RNA, 20 nt, Artificial Sequence
  MKO10081295_B_Dennd2a
  gRNA
aguaccuugguggacguguc

SEQ ID NO: 81296 - RNA, 20 nt, Artificial Sequence
  MKO10081296_B_Dennd2a
  gRNA
caguccacggagagcaacuc

SEQ ID NO: 81297 - RNA, 20 nt, Artificial Sequence
  MKO10081297_B_Dennd2a
  gRNA
acuaggaagcuuagucggga

SEQ ID NO: 81298 - RNA, 20 nt, Artificial Sequence
  MKO10081298_B_Dennd2c
  gRNA
gguggcagccuccacgcuga

SEQ ID NO: 81299 - RNA, 20 nt, Artificial Sequence
  MKO10081299_B_Dennd2c
  gRNA
acuuuacuacacacaguccg

SEQ ID NO: 81300 - RNA, 20 nt, Artificial Sequence
  MKO10081300_B_Dennd2c
  gRNA
uagucuuccgcugaaagaac

SEQ ID NO: 81301 - RNA, 20 nt, Artificial Sequence
  MKO10081301_B_Dennd2d
  gRNA
ggacaaucccagaacaaucc

SEQ ID NO: 81302 - RNA, 20 nt, Artificial Sequence
  MKO10081302_B_Dennd2d
  gRNA
cucauuuguccugaccaaug

SEQ ID NO: 81303 - RNA, 20 nt, Artificial Sequence
  MKO10081303_B_Dennd2d
  gRNA
cagagggagaaccugcuccg

SEQ ID NO: 81304 - RNA, 20 nt, Artificial Sequence
  MKO10081304_B_Dennd3
  gRNA
uuaauaccuaguccaccgcc

SEQ ID NO: 81305 - RNA, 20 nt, Artificial Sequence
  MKO10081305_B_Dennd3
  gRNA
cuucucucgcuucuuccgga

SEQ ID NO: 81306 - RNA, 20 nt, Artificial Sequence
  MKO10081306_B_Dennd3
  gRNA
caugcaggggucgauaguac

SEQ ID NO: 81307 - RNA, 20 nt, Artificial Sequence
  MKO10081307_B_Dennd4a
  gRNA
aaacacgacucagaauacgc

SEQ ID NO: 81308 - RNA, 20 nt, Artificial Sequence
  MKO10081308_B_Dennd4a
  gRNA
aacgacucguaaucuucuug

SEQ ID NO: 81309 - RNA, 20 nt, Artificial Sequence
  MKO10081309_B_Dennd4a
  gRNA
cguacgcaccuucucagcug

SEQ ID NO: 81310 - RNA, 20 nt, Artificial Sequence
  MKO10081310_B_Dennd4b
  gRNA
cccgcaccuaccucauguau

SEQ ID NO: 81311 - RNA, 20 nt, Artificial Sequence
  MKO10081311_B_Dennd4b
  gRNA
gcugcugggccgcuacccag

SEQ ID NO: 81312 - RNA, 20 nt, Artificial Sequence
  MKO10081312_B_Dennd4b
  gRNA
agcaguguaccugugcuaca

SEQ ID NO: 81313 - RNA, 20 nt, Artificial Sequence
  MKO10081313_B_Dennd4c
  gRNA
uaugcuauugcauuugaagc

SEQ ID NO: 81314 - RNA, 20 nt, Artificial Sequence
  MKO10081314_B_Dennd4c
  gRNA
aaagacucauagucuucuuc

SEQ ID NO: 81315 - RNA, 20 nt, Artificial Sequence
  MKO10081315_B_Dennd4c
  gRNA
cuuguaacacagaaacacgu

SEQ ID NO: 81316 - RNA, 20 nt, Artificial Sequence
  MKO10081316_B_Dennd5a
  gRNA
gaggaugguucucggacauu

SEQ ID NO: 81317 - RNA, 20 nt, Artificial Sequence
  MKO10081317_B_Dennd5a
  gRNA
uucauuucaaguacgacuga

SEQ ID NO: 81318 - RNA, 20 nt, Artificial Sequence
  MKO10081318_B_Dennd5a
  gRNA
gacuugaauguucgucucaa

SEQ ID NO: 81319 - RNA, 20 nt, Artificial Sequence
  MKO10081319_B_Dennd5b
  gRNA
cucgcagcuguacauugagc

SEQ ID NO: 81320 - RNA, 20 nt, Artificial Sequence
  MKO10081320_B_Dennd5b
  gRNA
uaaauuagaacuuccucaag

SEQ ID NO: 81321 - RNA, 20 nt, Artificial Sequence
  MKO10081321_B_Dennd5b
  gRNA
acuauccucaaaacauagaa

SEQ ID NO: 81322 - RNA, 20 nt, Artificial Sequence
  MKO10081322_B_Dennd6a
  gRNA
cgagauaaaacucuuaaaag

SEQ ID NO: 81323 - RNA, 20 nt, Artificial Sequence
  MKO10081323_B_Dennd6a
  gRNA
uacuucuuuaucaguaaguu

SEQ ID NO: 81324 - RNA, 20 nt, Artificial Sequence
  MKO10081324_B_Dennd6a
  gRNA
acauauccauaaaaauaugc

SEQ ID NO: 81325 - RNA, 20 nt, Artificial Sequence
  MKO10081325_B_Dennd6b
  gRNA
gagggagccagcacacuauc

SEQ ID NO: 81326 - RNA, 20 nt, Artificial Sequence
  MKO10081326_B_Dennd6b
  gRNA
caccuaccugagugcgaguc

SEQ ID NO: 81327 - RNA, 20 nt, Artificial Sequence
  MKO10081327_B_Dennd6b
  gRNA
gaaaagcagcaucugcuacc

SEQ ID NO: 81328 - RNA, 20 nt, Artificial Sequence
  MKO10081328_B_Denr
  gRNA
gaauuugcaaaacuuacugu

SEQ ID NO: 81329 - RNA, 20 nt, Artificial Sequence
  MKO10081329_B_Denr
  gRNA
cuaguacugugaauacaugc

SEQ ID NO: 81330 - RNA, 20 nt, Artificial Sequence
  MKO10081330_B_Denr
  gRNA
aguaauuccaguuucuuguu

SEQ ID NO: 81331 - RNA, 20 nt, Artificial Sequence
  MKO10081331_B_Depdc1a
  gRNA
auaguugauuguugucauca

SEQ ID NO: 81332 - RNA, 20 nt, Artificial Sequence
  MKO10081332_B_Depdc1a
  gRNA
aaaaauaccaucuuugucuu

SEQ ID NO: 81333 - RNA, 20 nt, Artificial Sequence
  MKO10081333_B_Depdc1a
  gRNA
uugauuucuguaugucuuug

SEQ ID NO: 81334 - RNA, 20 nt, Artificial Sequence
  MKO10081334_B_Depdc1b
  gRNA
ccucggucagcugucugcgg

SEQ ID NO: 81335 - RNA, 20 nt, Artificial Sequence
  MKO10081335_B_Depdc1b
  gRNA
aagcgccacaguauugcuau

SEQ ID NO: 81336 - RNA, 20 nt, Artificial Sequence
  MKO10081336_B_Depdc1b
  gRNA
cgagcauugcuucacugcau

SEQ ID NO: 81337 - RNA, 20 nt, Artificial Sequence
  MKO10081337_B_Depdc5
  gRNA
ugugaauguuguagacccca

SEQ ID NO: 81338 - RNA, 20 nt, Artificial Sequence
  MKO10081338_B_Depdc5
  gRNA
uucacauagacaucuugaua

SEQ ID NO: 81339 - RNA, 20 nt, Artificial Sequence
  MKO10081339_B_Depdc5
  gRNA
gacaaguuuguagaccuuug

SEQ ID NO: 81340 - RNA, 20 nt, Artificial Sequence
  MKO10081340_B_Depdc7
  gRNA
aagguauuccaagcagucga

SEQ ID NO: 81341 - RNA, 20 nt, Artificial Sequence
  MKO10081341_B_Depdc7
  gRNA
ccuucccgaccagaugguug

SEQ ID NO: 81342 - RNA, 20 nt, Artificial Sequence
  MKO10081342_B_Depdc7
  gRNA
accagcaacuaucuggaucg

SEQ ID NO: 81343 - RNA, 20 nt, Artificial Sequence
  MKO10081343_B_Deptor
  gRNA
uaaaacucuucuaccgcuuu

SEQ ID NO: 81344 - RNA, 20 nt, Artificial Sequence
  MKO10081344_B_Deptor
  gRNA
aguucagaaugaacuuccgu

SEQ ID NO: 81345 - RNA, 20 nt, Artificial Sequence
  MKO10081345_B_Deptor
  gRNA
ugagacguccccguccucuc

SEQ ID NO: 81346 - RNA, 20 nt, Artificial Sequence
  MKO10081346_B_Dera
  gRNA
cagucugcguuuaucccgcc

SEQ ID NO: 81347 - RNA, 20 nt, Artificial Sequence
  MKO10081347_B_Dera
  gRNA
uggagcuacugaaauugacg

SEQ ID NO: 81348 - RNA, 20 nt, Artificial Sequence
  MKO10081348_B_Dera
  gRNA
ucuucacgcuucugcgagcc

SEQ ID NO: 81349 - RNA, 20 nt, Artificial Sequence
  MKO10081349_B_Derl1
  gRNA
aaauacagaaauccaguccc

SEQ ID NO: 81350 - RNA, 20 nt, Artificial Sequence
  MKO10081350_B_Derl1
  gRNA
agcaugaauaaauagucugc

SEQ ID NO: 81351 - RNA, 20 nt, Artificial Sequence
  MKO10081351_B_Derl1
  gRNA
uauucaugcuucucuuuaac

SEQ ID NO: 81352 - RNA, 20 nt, Artificial Sequence
  MKO10081352_B_Derl2
  gRNA
ccaggccuuuacaauaaugc

SEQ ID NO: 81353 - RNA, 20 nt, Artificial Sequence
  MKO10081353_B_Derl2
  gRNA
aacaaaaaauugaauccaac

SEQ ID NO: 81354 - RNA, 20 nt, Artificial Sequence
  MKO10081354_B_Derl2
  gRNA
aaauguuuaaaaauuaauuc

SEQ ID NO: 81355 - RNA, 20 nt, Artificial Sequence
  MKO10081355_B_Derl3
  gRNA
ggguucuuuccguggccgca

SEQ ID NO: 81356 - RNA, 20 nt, Artificial Sequence
  MKO10081356_B_Derl3
  gRNA
guuccgcuacugccgcaugc

SEQ ID NO: 81357 - RNA, 20 nt, Artificial Sequence
  MKO10081357_B_Derl3
  gRNA
gcucuacuucaacccgcacc

SEQ ID NO: 81358 - RNA, 20 nt, Artificial Sequence
  MKO10081358_B_Desi1
  gRNA
gaguucuucuucggcagcag

SEQ ID NO: 81359 - RNA, 20 nt, Artificial Sequence
  MKO10081359_B_Desi1
  gRNA
cccugggggagucucuguuc

SEQ ID NO: 81360 - RNA, 20 nt, Artificial Sequence
  MKO10081360_B_Desi1
  gRNA
accggaacagagacuccccc

SEQ ID NO: 81361 - RNA, 20 nt, Artificial Sequence
  MKO10081361_B_Desi2
  gRNA
aaugaauacaccucaucuau

SEQ ID NO: 81362 - RNA, 20 nt, Artificial Sequence
  MKO10081362_B_Desi2
  gRNA
agagaaaauuguagaagaac

SEQ ID NO: 81363 - RNA, 20 nt, Artificial Sequence
  MKO10081363_B_Desi2
  gRNA
auuucaaauauuccagaaaa

SEQ ID NO: 81364 - RNA, 20 nt, Artificial Sequence
  MKO10081364_B_Des
  gRNA
caaucucgcagguguaggac

SEQ ID NO: 81365 - RNA, 20 nt, Artificial Sequence
  MKO10081365_B_Des
  gRNA
cagcgcaucguuguucuuau

SEQ ID NO: 81366 - RNA, 20 nt, Artificial Sequence
  MKO10081366_B_Des
  gRNA
ggagauggacauguccaagc

SEQ ID NO: 81367 - RNA, 20 nt, Artificial Sequence
  MKO10081367_B_Det1
  gRNA
ccacgaggcgucgcacugug

SEQ ID NO: 81368 - RNA, 20 nt, Artificial Sequence
  MKO10081368_B_Det1
  gRNA
gaggcugugcgccgacugcu

SEQ ID NO: 81369 - RNA, 20 nt, Artificial Sequence
  MKO10081369_B_Det1
  gRNA
auggagcgacccaagacuug

SEQ ID NO: 81370 - RNA, 20 nt, Artificial Sequence
  MKO10081370_B_Dexi
  gRNA
cgcagcccaccuggacgcuc

SEQ ID NO: 81371 - RNA, 20 nt, Artificial Sequence
  MKO10081371_B_Dexi
  gRNA
ccuuuacuacgccuuccuua

SEQ ID NO: 81372 - RNA, 20 nt, Artificial Sequence
  MKO10081372_B_Dexi
  gRNA
cguccaggugggcugcgacc

SEQ ID NO: 81373 - RNA, 20 nt, Artificial Sequence
  MKO10081373_B_Dffa
  gRNA
cggcgucagggacuuaucaa

SEQ ID NO: 81374 - RNA, 20 nt, Artificial Sequence
  MKO10081374_B_Dffa
  gRNA
acuggcgggcuuccucucuc

SEQ ID NO: 81375 - RNA, 20 nt, Artificial Sequence
  MKO10081375_B_Dffa
  gRNA
gggagucuuaccuuucuggu

SEQ ID NO: 81376 - RNA, 20 nt, Artificial Sequence
  MKO10081376_B_Dffb
  gRNA
acauggagccaaggacucgc

SEQ ID NO: 81377 - RNA, 20 nt, Artificial Sequence
  MKO10081377_B_Dffb
  gRNA
ggugagcgcuuacaccucua

SEQ ID NO: 81378 - RNA, 20 nt, Artificial Sequence
  MKO10081378_B_Dffb
  gRNA
gggucucugcaguaauauuc

SEQ ID NO: 81379 - RNA, 20 nt, Artificial Sequence
  MKO10081379_B_Dfna5
  gRNA
cuacagagaguucgccuuuc

SEQ ID NO: 81380 - RNA, 20 nt, Artificial Sequence
  MKO10081380_B_Dfna5
  gRNA
agaaaucacgcacuucugcg

SEQ ID NO: 81381 - RNA, 20 nt, Artificial Sequence
  MKO10081381_B_Dfna5
  gRNA
agggaucuccagcacuacau

SEQ ID NO: 81382 - RNA, 20 nt, Artificial Sequence
  MKO10081382_B_Dfnb59
  gRNA
ugcucucugucagugcacgc

SEQ ID NO: 81383 - RNA, 20 nt, Artificial Sequence
  MKO10081383_B_Dfnb59
  gRNA
acaguuugauccgccaauca

SEQ ID NO: 81384 - RNA, 20 nt, Artificial Sequence
  MKO10081384_B_Dfnb59
  gRNA
aaagcuauaguugugugugc

SEQ ID NO: 81385 - RNA, 20 nt, Artificial Sequence
  MKO10081385_B_Dgau1
  gRNA
cacucucagguauggcaucc

SEQ ID NO: 81386 - RNA, 20 nt, Artificial Sequence
  MKO10081386_B_Dgau1
  gRNA
auuaucgugguauccugaau

SEQ ID NO: 81387 - RNA, 20 nt, Artificial Sequence
  MKO10081387_B_Dgau1
  gRNA
aaaauaaccuugcauuacuc

SEQ ID NO: 81388 - RNA, 20 nt, Artificial Sequence
  MKO10081388_B_Dgau2l6
  gRNA
aucuaccucaaaaaacgcca

SEQ ID NO: 81389 - RNA, 20 nt, Artificial Sequence
  MKO10081389_B_Dgau2l6
  gRNA
gccauaagguagugaacagc

SEQ ID NO: 81390 - RNA, 20 nt, Artificial Sequence
  MKO10081390_B_Dgau2l6
  gRNA
uccugcuguucacuaccuua

SEQ ID NO: 81391 - RNA, 20 nt, Artificial Sequence
  MKO10081391_B_Dgau2
  gRNA
caccuuagaucuguugagcc

SEQ ID NO: 81392 - RNA, 20 nt, Artificial Sequence
  MKO10081392_B_Dgau2
  gRNA
gacuggaacacgcccaagaa

SEQ ID NO: 81393 - RNA, 20 nt, Artificial Sequence
  MKO10081393_B_Dgau2
  gRNA
ccgagacuacuuucccaucc

SEQ ID NO: 81394 - RNA, 20 nt, Artificial Sequence
  MKO10081394_B_Dgcr14
  gRNA
acucaccaucaucuaggucu

SEQ ID NO: 81395 - RNA, 20 nt, Artificial Sequence
  MKO10081395_B_Dgcr14
  gRNA
uucccgagauaucuugccca

SEQ ID NO: 81396 - RNA, 20 nt, Artificial Sequence
  MKO10081396_B_Dgcr14
  gRNA
cucucucauguacuaucccg

SEQ ID NO: 81397 - RNA, 20 nt, Artificial Sequence
  MKO10081397_B_Dgcr2
  gRNA
ucacucuuauccucacacgu

SEQ ID NO: 81398 - RNA, 20 nt, Artificial Sequence
  MKO10081398_B_Dgcr2
  gRNA
ucacugucaccgagccgcug

SEQ ID NO: 81399 - RNA, 20 nt, Artificial Sequence
  MKO10081399_B_Dgcr2
  gRNA
agugaugaagccgacugucc

SEQ ID NO: 81400 - RNA, 20 nt, Artificial Sequence
  MKO10081400_B_Dgcr6
  gRNA
ccgaaagauuguccuggagc

SEQ ID NO: 81401 - RNA, 20 nt, Artificial Sequence
  MKO10081401_B_Dgcr6
  gRNA
gacgcugcagaugaaccuau

SEQ ID NO: 81402 - RNA, 20 nt, Artificial Sequence
  MKO10081402_B_Dgcr6
  gRNA
cagugcucagacagacucua

SEQ ID NO: 81403 - RNA, 20 nt, Artificial Sequence
  MKO10081403_B_Dgcr8
  gRNA
gacuccauggguggagacuc

SEQ ID NO: 81404 - RNA, 20 nt, Artificial Sequence
  MKO10081404_B_Dgcr8
  gRNA
uugguccagacccuacuucu

SEQ ID NO: 81405 - RNA, 20 nt, Artificial Sequence
  MKO10081405_B_Dgcr8
  gRNA
caaagucaaaacgcuucuca

SEQ ID NO: 81406 - RNA, 20 nt, Artificial Sequence
  MKO10081406_B_Dgka
  gRNA
guccaugucauauagcuuga

SEQ ID NO: 81407 - RNA, 20 nt, Artificial Sequence
  MKO10081407_B_Dgka
  gRNA
ugcuacuucacccuccuaga

SEQ ID NO: 81408 - RNA, 20 nt, Artificial Sequence
  MKO10081408_B_Dgka
  gRNA
cuuacucagacuccaccaaa

SEQ ID NO: 81409 - RNA, 20 nt, Artificial Sequence
  MKO10081409_B_Dgkb
  gRNA
uaccugucucuucucgaaag

SEQ ID NO: 81410 - RNA, 20 nt, Artificial Sequence
  MKO10081410_B_Dgkb
  gRNA
aguaagcccgcucuucuuuc

SEQ ID NO: 81411 - RNA, 20 nt, Artificial Sequence
  MKO10081411_B_Dgkb
  gRNA
uugcaagcacgccauuacca

SEQ ID NO: 81412 - RNA, 20 nt, Artificial Sequence
  MKO10081412_B_Dgkd
  gRNA
ccagucgauuauauuugaug

SEQ ID NO: 81413 - RNA, 20 nt, Artificial Sequence
  MKO10081413_B_Dgkd
  gRNA
ucaucuugugugccgacaac

SEQ ID NO: 81414 - RNA, 20 nt, Artificial Sequence
  MKO10081414_B_Dgkd
  gRNA
cugcuacgcuggcaucaguc

SEQ ID NO: 81415 - RNA, 20 nt, Artificial Sequence
  MKO10081415_B_Dgke
  gRNA
ugccucgcaugcacucgucg

SEQ ID NO: 81416 - RNA, 20 nt, Artificial Sequence
  MKO10081416_B_Dgke
  gRNA
ucaguucgaguccuuguuug

SEQ ID NO: 81417 - RNA, 20 nt, Artificial Sequence
  MKO10081417_B_Dgke
  gRNA
gcggucuuaccucugggaac

SEQ ID NO: 81418 - RNA, 20 nt, Artificial Sequence
  MKO10081418_B_Dgkg
  gRNA
ggaccuuguaccugagacau

SEQ ID NO: 81419 - RNA, 20 nt, Artificial Sequence
  MKO10081419_B_Dgkg
  gRNA
uuguucccuagauuauaauu

SEQ ID NO: 81420 - RNA, 20 nt, Artificial Sequence
  MKO10081420_B_Dgkg
  gRNA
uuaaugaagguggaagccuc

SEQ ID NO: 81421 - RNA, 20 nt, Artificial Sequence
  MKO10081421_B_Dgkh
  gRNA
aagagauacuucaagcuucg

SEQ ID NO: 81422 - RNA, 20 nt, Artificial Sequence
  MKO10081422_B_Dgkh
  gRNA
ucccacggccuguccuguga

SEQ ID NO: 81423 - RNA, 20 nt, Artificial Sequence
  MKO10081423_B_Dgkh
  gRNA
guagguggcccaguucaaug

SEQ ID NO: 81424 - RNA, 20 nt, Artificial Sequence
  MKO10081424_B_Dgki
  gRNA
uucgcuggaccguuagccac

SEQ ID NO: 81425 - RNA, 20 nt, Artificial Sequence
  MKO10081425_B_Dgki
  gRNA
uacucacugcaaaucggacu

SEQ ID NO: 81426 - RNA, 20 nt, Artificial Sequence
  MKO10081426_B_Dgki
  gRNA
acucacuucucuuggcgauc

SEQ ID NO: 81427 - RNA, 20 nt, Artificial Sequence
  MKO10081427_B_Dgkk
  gRNA
uucuuccaugucuugccgag

SEQ ID NO: 81428 - RNA, 20 nt, Artificial Sequence
  MKO10081428_B_Dgkk
  gRNA
gcuacuuacuauuucaucag

SEQ ID NO: 81429 - RNA, 20 nt, Artificial Sequence
  MKO10081429_B_Dgkk
  gRNA
uagaagaaggucaucaguca

SEQ ID NO: 81430 - RNA, 20 nt, Artificial Sequence
  MKO10081430_B_Dgkq
  gRNA
gcauugcaccaagccucguc

SEQ ID NO: 81431 - RNA, 20 nt, Artificial Sequence
  MKO10081431_B_Dgkq
  gRNA
uggcugguguacgcugcgag

SEQ ID NO: 81432 - RNA, 20 nt, Artificial Sequence
  MKO10081432_B_Dgkq
  gRNA
gguaccuucacagcggaaug

SEQ ID NO: 81433 - RNA, 20 nt, Artificial Sequence
  MKO10081433_B_Dgkz
  gRNA
ugcuccucagauucaccgca

SEQ ID NO: 81434 - RNA, 20 nt, Artificial Sequence
  MKO10081434_B_Dgkz
  gRNA
cccgacauagcagaagucac

SEQ ID NO: 81435 - RNA, 20 nt, Artificial Sequence
  MKO10081435_B_Dgkz
  gRNA
gugugcagccuguaagaucg

SEQ ID NO: 81436 - RNA, 20 nt, Artificial Sequence
  MKO10081436_B_Dguok
  gRNA
uagcaaguuuccaagacguu

SEQ ID NO: 81437 - RNA, 20 nt, Artificial Sequence
  MKO10081437_B_Dguok
  gRNA
cuugcuagaaaugauguacc

SEQ ID NO: 81438 - RNA, 20 nt, Artificial Sequence
  MKO10081438_B_Dguok
  gRNA
gaguuaccuggggugaagcc

SEQ ID NO: 81439 - RNA, 20 nt, Artificial Sequence
  MKO10081439_B_Dhcr24
  gRNA
gagucaucgucccacaagua

SEQ ID NO: 81440 - RNA, 20 nt, Artificial Sequence
  MKO10081440_B_Dhcr24
  gRNA
gcacaaagcugccgucugcc

SEQ ID NO: 81441 - RNA, 20 nt, Artificial Sequence
  MKO10081441_B_Dhcr24
  gRNA
cucacugucucgcugcgagu

SEQ ID NO: 81442 - RNA, 20 nt, Artificial Sequence
  MKO10081442_B_Dhcr7
  gRNA
uggacgccucccacauaacc

SEQ ID NO: 81443 - RNA, 20 nt, Artificial Sequence
  MKO10081443_B_Dhcr7
  gRNA
cucccugacugcccccgcau

SEQ ID NO: 81444 - RNA, 20 nt, Artificial Sequence
  MKO10081444_B_Dhcr7
  gRNA
ccuguagcuauauccaaugc

SEQ ID NO: 81445 - RNA, 20 nt, Artificial Sequence
  MKO10081445_B_Dhdds
  gRNA
ucgcuaugccaagaaguguc

SEQ ID NO: 81446 - RNA, 20 nt, Artificial Sequence
  MKO10081446_B_Dhdds
  gRNA
gggcguggaacaaggucugc

SEQ ID NO: 81447 - RNA, 20 nt, Artificial Sequence
  MKO10081447_B_Dhdds
  gRNA
gaguccgucaaccucacucu

SEQ ID NO: 81448 - RNA, 20 nt, Artificial Sequence
  MKO10081448_B_Dhdh
  gRNA
guugccaaagcccguucuca

SEQ ID NO: 81449 - RNA, 20 nt, Artificial Sequence
  MKO10081449_B_Dhdh
  gRNA
ccaacagcugaaaucuucuc

SEQ ID NO: 81450 - RNA, 20 nt, Artificial Sequence
  MKO10081450_B_Dhdh
  gRNA
gaauuucugugcgaacuccu

SEQ ID NO: 81451 - RNA, 20 nt, Artificial Sequence
  MKO10081451_B_Dhfr
  gRNA
aaugaccacaaccucuucag

SEQ ID NO: 81452 - RNA, 20 nt, Artificial Sequence
  MKO10081452_B_Dhfr
  gRNA
uccuugucacaaagagucug

SEQ ID NO: 81453 - RNA, 20 nt, Artificial Sequence
  MKO10081453_B_Dhfr
  gRNA
accucagacucuuugugaca

SEQ ID NO: 81454 - RNA, 20 nt, Artificial Sequence
  MKO10081454_B_Dhh
  gRNA
acucucuagaaccgcguagc

SEQ ID NO: 81455 - RNA, 20 nt, Artificial Sequence
  MKO10081455_B_Dhh
  gRNA
ccacuacgaaggccgugccu

SEQ ID NO: 81456 - RNA, 20 nt, Artificial Sequence
  MKO10081456_B_Dhh
  gRNA
cgggccgaggaccgguuggc

SEQ ID NO: 81457 - RNA, 20 nt, Artificial Sequence
  MKO10081457_B_Dhodh
  gRNA
guuccaccgcugagagcccg

SEQ ID NO: 81458 - RNA, 20 nt, Artificial Sequence
  MKO10081458_B_Dhodh
  gRNA
cacguuaaccaccagguagu

SEQ ID NO: 81459 - RNA, 20 nt, Artificial Sequence
  MKO10081459_B_Dhodh
  gRNA
aaugacacaccuuggacagc

SEQ ID NO: 81460 - RNA, 20 nt, Artificial Sequence
  MKO10081460_B_Dhps
  gRNA
cccugaggcugaacucgcca

SEQ ID NO: 81461 - RNA, 20 nt, Artificial Sequence
  MKO10081461_B_Dhps
  gRNA
caugcccauucuggaccaga

SEQ ID NO: 81462 - RNA, 20 nt, Artificial Sequence
  MKO10081462_B_Dhps
  gRNA
ucccaugauagggugugaag

SEQ ID NO: 81463 - RNA, 20 nt, Artificial Sequence
  MKO10081463_B_Dhrs11
  gRNA
uuggcccaguguaucucucc

SEQ ID NO: 81464 - RNA, 20 nt, Artificial Sequence
  MKO10081464_B_Dhrs11
  gRNA
cuucccccggguccuuguca

SEQ ID NO: 81465 - RNA, 20 nt, Artificial Sequence
  MKO10081465_B_Dhrs11
  gRNA
ggcacaucauuaacaucaac

SEQ ID NO: 81466 - RNA, 20 nt, Artificial Sequence
  MKO10081466_B_Dhrs13
  gRNA
ugaagucgagacgaccacgu

SEQ ID NO: 81467 - RNA, 20 nt, Artificial Sequence
  MKO10081467_B_Dhrs13
  gRNA
aaaauaggacgcagccaucc

SEQ ID NO: 81468 - RNA, 20 nt, Artificial Sequence
  MKO10081468_B_Dhrs13
  gRNA
accccuguacugcgcucugc

SEQ ID NO: 81469 - RNA, 20 nt, Artificial Sequence
  MKO10081469_B_Dhrs1
  gRNA
gccuguucgagcaaguagau

SEQ ID NO: 81470 - RNA, 20 nt, Artificial Sequence
  MKO10081470_B_Dhrs1
  gRNA
aucgugauugucuccucccc

SEQ ID NO: 81471 - RNA, 20 nt, Artificial Sequence
  MKO10081471_B_Dhrs1
  gRNA
uugccaaccuucuuaaauag

SEQ ID NO: 81472 - RNA, 20 nt, Artificial Sequence
  MKO10081472_B_Dhrs2
  gRNA
ugaccacaugugccccaucc

SEQ ID NO: 81473 - RNA, 20 nt, Artificial Sequence
  MKO10081473_B_Dhrs2
  gRNA
cuugucccagaucuguucac

SEQ ID NO: 81474 - RNA, 20 nt, Artificial Sequence
  MKO10081474_B_Dhrs2
  gRNA
aacugguacauaagccacuc

SEQ ID NO: 81475 - RNA, 20 nt, Artificial Sequence
  MKO10081475_B_Dhrs3
  gRNA
acggugguggcgcugacacc

SEQ ID NO: 81476 - RNA, 20 nt, Artificial Sequence
  MKO10081476_B_Dhrs3
  gRNA
gaccuucucucggacagcuu

SEQ ID NO: 81477 - RNA, 20 nt, Artificial Sequence
  MKO10081477_B_Dhrs3
  gRNA
ccgggaagagguguaccaga

SEQ ID NO: 81478 - RNA, 20 nt, Artificial Sequence
  MKO10081478_B_Dhrs4
  gRNA
caccaccgcuuuaaucauca

SEQ ID NO: 81479 - RNA, 20 nt, Artificial Sequence
  MKO10081479_B_Dhrs4
  gRNA
guucuguagcaggcuucacu

SEQ ID NO: 81480 - RNA, 20 nt, Artificial Sequence
  MKO10081480_B_Dhrs4
  gRNA
uacagccaugaugauuaaag

SEQ ID NO: 81481 - RNA, 20 nt, Artificial Sequence
  MKO10081481_B_Dhrs7b
  gRNA
gaucagcauuccuuuccgau

SEQ ID NO: 81482 - RNA, 20 nt, Artificial Sequence
  MKO10081482_B_Dhrs7b
  gRNA
ccaguuuagcccccgcagca

SEQ ID NO: 81483 - RNA, 20 nt, Artificial Sequence
  MKO10081483_B_Dhrs7b
  gRNA
acgggcgccaccucaggucu

SEQ ID NO: 81484 - RNA, 20 nt, Artificial Sequence
  MKO10081484_B_Dhrs7c
  gRNA
cgguaggagcggaugaaagu

SEQ ID NO: 81485 - RNA, 20 nt, Artificial Sequence
  MKO10081485_B_Dhrs7c
  gRNA
gccugcccacaagauuuccc

SEQ ID NO: 81486 - RNA, 20 nt, Artificial Sequence
  MKO10081486_B_Dhrs7c
  gRNA
aacaacauccaagcgaaguu

SEQ ID NO: 81487 - RNA, 20 nt, Artificial Sequence
  MKO10081487_B_Dhrs7
  gRNA
uuucuagaacuaaggaacgc

SEQ ID NO: 81488 - RNA, 20 nt, Artificial Sequence
  MKO10081488_B_Dhrs7
  gRNA
uacccgaagagcaugcuugc

SEQ ID NO: 81489 - RNA, 20 nt, Artificial Sequence
  MKO10081489_B_Dhrs7
  gRNA
acguugcaaaauguuaugcc

SEQ ID NO: 81490 - RNA, 20 nt, Artificial Sequence
  MKO10081490_B_Dhrs9
  gRNA
cccagcaauguaccgagucu

SEQ ID NO: 81491 - RNA, 20 nt, Artificial Sequence
  MKO10081491_B_Dhrs9
  gRNA
aggcgggauaugaaagcuuu

SEQ ID NO: 81492 - RNA, 20 nt, Artificial Sequence
  MKO10081492_B_Dhrs9
  gRNA
caugucucaugcauugaacc

SEQ ID NO: 81493 - RNA, 20 nt, Artificial Sequence
  MKO10081493_B_Dhrsx
  gRNA
gucgcgggcgaagccucgga

SEQ ID NO: 81494 - RNA, 20 nt, Artificial Sequence
  MKO10081494_B_Dhrsx
  gRNA
ccucaccguuguugacgagc

SEQ ID NO: 81495 - RNA, 20 nt, Artificial Sequence
  MKO10081495_B_Dhrsx
  gRNA
agcugucgccccugucacga

SEQ ID NO: 81496 - RNA, 20 nt, Artificial Sequence
  MKO10081496_B_Dhtkd1
  gRNA
ugggcgguuucgauagaaau

SEQ ID NO: 81497 - RNA, 20 nt, Artificial Sequence
  MKO10081497_B_Dhtkd1
  gRNA
gauggggacuacuccccgaa

SEQ ID NO: 81498 - RNA, 20 nt, Artificial Sequence
  MKO10081498_B_Dhtkd1
  gRNA
cagggacccuucacuaccac

SEQ ID NO: 81499 - RNA, 20 nt, Artificial Sequence
  MKO10081499_B_Dhx15
  gRNA
acugcagucuucaaaucgaa

SEQ ID NO: 81500 - RNA, 20 nt, Artificial Sequence
  MKO10081500_B_Dhx15
  gRNA
agccaugaacgauccccuuc

SEQ ID NO: 81501 - RNA, 20 nt, Artificial Sequence
  MKO10081501_B_Dhx15
  gRNA
augagugcuacccuagaugc

SEQ ID NO: 81502 - RNA, 20 nt, Artificial Sequence
  MKO10081502_B_Dhx16
  gRNA
uucggcaacgggacaaggac

SEQ ID NO: 81503 - RNA, 20 nt, Artificial Sequence
  MKO10081503_B_Dhx16
  gRNA
cuaccggcaggugccacgga

SEQ ID NO: 81504 - RNA, 20 nt, Artificial Sequence
  MKO10081504_B_Dhx16
  gRNA
aaaccguucuuauaaguugu

SEQ ID NO: 81505 - RNA, 20 nt, Artificial Sequence
  MKO10081505_B_Dhx29
  gRNA
ggaggaagacccuaaaauua

SEQ ID NO: 81506 - RNA, 20 nt, Artificial Sequence
  MKO10081506_B_Dhx29
  gRNA
auuccagucuguacaaauac

SEQ ID NO: 81507 - RNA, 20 nt, Artificial Sequence
  MKO10081507_B_Dhx29
  gRNA
guccagauuugcagagccac

SEQ ID NO: 81508 - RNA, 20 nt, Artificial Sequence
  MKO10081508_B_Dhx30
  gRNA
gaagauugaugcugagcguc

SEQ ID NO: 81509 - RNA, 20 nt, Artificial Sequence
  MKO10081509_B_Dhx30
  gRNA
uuccaaucacgcuguugaga

SEQ ID NO: 81510 - RNA, 20 nt, Artificial Sequence
  MKO10081510_B_Dhx30
  gRNA
gguugcaaucugaaucacuu

SEQ ID NO: 81511 - RNA, 20 nt, Artificial Sequence
  MKO10081511_B_Dhx32
  gRNA
ccacccgucucugauacacu

SEQ ID NO: 81512 - RNA, 20 nt, Artificial Sequence
  MKO10081512_B_Dhx32
  gRNA
caaugacaaauuugaccgug

SEQ ID NO: 81513 - RNA, 20 nt, Artificial Sequence
  MKO10081513_B_Dhx32
  gRNA
gauauucacauccaucucgu

SEQ ID NO: 81514 - RNA, 20 nt, Artificial Sequence
  MKO10081514_B_Dhx33
  gRNA
gugccuugcgaugucucugc

SEQ ID NO: 81515 - RNA, 20 nt, Artificial Sequence
  MKO10081515_B_Dhx33
  gRNA
acagcuguacuuccgaagca

SEQ ID NO: 81516 - RNA, 20 nt, Artificial Sequence
  MKO10081516_B_Dhx33
  gRNA
gagagauggcagccacucga

SEQ ID NO: 81517 - RNA, 20 nt, Artificial Sequence
  MKO10081517_B_Dhx34
  gRNA
guaggagcagccccaccguc

SEQ ID NO: 81518 - RNA, 20 nt, Artificial Sequence
  MKO10081518_B_Dhx34
  gRNA
acccugcggauuuccgggac

SEQ ID NO: 81519 - RNA, 20 nt, Artificial Sequence
  MKO10081519_B_Dhx34
  gRNA
cguggaccucguccacgauc

SEQ ID NO: 81520 - RNA, 20 nt, Artificial Sequence
  MKO10081520_B_Dhx35
  gRNA
gucacggcagccacucugcg

SEQ ID NO: 81521 - RNA, 20 nt, Artificial Sequence
  MKO10081521_B_Dhx35
  gRNA
agcguagggauuguaaauga

SEQ ID NO: 81522 - RNA, 20 nt, Artificial Sequence
  MKO10081522_B_Dhx35
  gRNA
cuggacagcggaaggacgag

SEQ ID NO: 81523 - RNA, 20 nt, Artificial Sequence
  MKO10081523_B_Dhx36
  gRNA
ucagguuacgcaguucaucu

SEQ ID NO: 81524 - RNA, 20 nt, Artificial Sequence
  MKO10081524_B_Dhx36
  gRNA
accuucugcauuccauauga

SEQ ID NO: 81525 - RNA, 20 nt, Artificial Sequence
  MKO10081525_B_Dhx36
  gRNA
acaguaauaaguggugaaac

SEQ ID NO: 81526 - RNA, 20 nt, Artificial Sequence
  MKO10081526_B_Dhx37
  gRNA
uucacggggaugaauacagc

SEQ ID NO: 81527 - RNA, 20 nt, Artificial Sequence
  MKO10081527_B_Dhx37
  gRNA
gcuuccggugggccccgcug

SEQ ID NO: 81528 - RNA, 20 nt, Artificial Sequence
  MKO10081528_B_Dhx37
  gRNA
acugagugaaguccaaguau

SEQ ID NO: 81529 - RNA, 20 nt, Artificial Sequence
  MKO10081529_B_Dhx38
  gRNA
aaccugagaguccucgacau

SEQ ID NO: 81530 - RNA, 20 nt, Artificial Sequence
  MKO10081530_B_Dhx38
  gRNA
ccuccuauaaguacaaugaa

SEQ ID NO: 81531 - RNA, 20 nt, Artificial Sequence
  MKO10081531_B_Dhx38
  gRNA
ucaggcauuaccgaucugcu

SEQ ID NO: 81532 - RNA, 20 nt, Artificial Sequence
  MKO10081532_B_Dhx40
  gRNA
cuguauuuccaguaacgaug

SEQ ID NO: 81533 - RNA, 20 nt, Artificial Sequence
  MKO10081533_B_Dhx40
  gRNA
ccgccauaucaguugcucag

SEQ ID NO: 81534 - RNA, 20 nt, Artificial Sequence
  MKO10081534_B_Dhx40
  gRNA
acacugaauuugcuaagauu

SEQ ID NO: 81535 - RNA, 20 nt, Artificial Sequence
  MKO10081535_B_Dhx57
  gRNA
gguacuggagggacguucac

SEQ ID NO: 81536 - RNA, 20 nt, Artificial Sequence
  MKO10081536_B_Dhx57
  gRNA
aggaccugcaucaauuaucg

SEQ ID NO: 81537 - RNA, 20 nt, Artificial Sequence
  MKO10081537_B_Dhx57
  gRNA
cugagcccaagcgcccgucc

SEQ ID NO: 81538 - RNA, 20 nt, Artificial Sequence
  MKO10081538_B_Dhx58
  gRNA
aauucuuuggcgacaugaug

SEQ ID NO: 81539 - RNA, 20 nt, Artificial Sequence
  MKO10081539_B_Dhx58
  gRNA
ccugacuugaagcaacaauu

SEQ ID NO: 81540 - RNA, 20 nt, Artificial Sequence
  MKO10081540_B_Dhx58
  gRNA
ccacgaccugcucaucugua

SEQ ID NO: 81541 - RNA, 20 nt, Artificial Sequence
  MKO10081541_B_Dhx8
  gRNA
gcauggucuguaugagacgc

SEQ ID NO: 81542 - RNA, 20 nt, Artificial Sequence
  MKO10081542_B_Dhx8
  gRNA
ugcgucucauacagaccaug

SEQ ID NO: 81543 - RNA, 20 nt, Artificial Sequence
  MKO10081543_B_Dhx8
  gRNA
guuguccggcuggcagagga

SEQ ID NO: 81544 - RNA, 20 nt, Artificial Sequence
  MKO10081544_B_Dhx9
  gRNA
gccuaugaaauuagagcagu

SEQ ID NO: 81545 - RNA, 20 nt, Artificial Sequence
  MKO10081545_B_Dhx9
  gRNA
uucuugaguaguaaucuuua

SEQ ID NO: 81546 - RNA, 20 nt, Artificial Sequence
  MKO10081546_B_Dhx9
  gRNA
uaaagauuacuacucaagaa

SEQ ID NO: 81547 - RNA, 20 nt, Artificial Sequence
  MKO10081547_B_Diablo
  gRNA
cgacaauauacaaguuuacu

SEQ ID NO: 81548 - RNA, 20 nt, Artificial Sequence
  MKO10081548_B_Diablo
  gRNA
gugugcgguuccuauugcuc

SEQ ID NO: 81549 - RNA, 20 nt, Artificial Sequence
  MKO10081549_B_Diablo
  gRNA
cagucccuuaccugagcaau

SEQ ID NO: 81550 - RNA, 20 nt, Artificial Sequence
  MKO10081550_B_Diap1
  gRNA
ugagggccuagccuccuuau

SEQ ID NO: 81551 - RNA, 20 nt, Artificial Sequence
  MKO10081551_B_Diap1
  gRNA
acgacuccaugaugagaaag

SEQ ID NO: 81552 - RNA, 20 nt, Artificial Sequence
  MKO10081552_B_Diap1
  gRNA
gcaauaucugcacacuucca

SEQ ID NO: 81553 - RNA, 20 nt, Artificial Sequence
  MKO10081553_B_Diap2
  gRNA
ucaucauguacuaucagagc

SEQ ID NO: 81554 - RNA, 20 nt, Artificial Sequence
  MKO10081554_B_Diap2
  gRNA
uauugauuaucaaacugcag

SEQ ID NO: 81555 - RNA, 20 nt, Artificial Sequence
  MKO10081555_B_Diap2
  gRNA
cuuuaaccagccauccuguc

SEQ ID NO: 81556 - RNA, 20 nt, Artificial Sequence
  MKO10081556_B_Diap3
  gRNA
uagccgacagaucucaccuc

SEQ ID NO: 81557 - RNA, 20 nt, Artificial Sequence
  MKO10081557_B_Diap3
  gRNA
uuugccaguauaagaauucc

SEQ ID NO: 81558 - RNA, 20 nt, Artificial Sequence
  MKO10081558_B_Diap3
  gRNA
uagaacacugacagaugaua

SEQ ID NO: 81559 - RNA, 20 nt, Artificial Sequence
  MKO10081559_B_Dicer1
  gRNA
uaccuucauaauuucacgau

SEQ ID NO: 81560 - RNA, 20 nt, Artificial Sequence
  MKO10081560_B_Dicer1
  gRNA
accucaacccgcaugcaaaa

SEQ ID NO: 81561 - RNA, 20 nt, Artificial Sequence
  MKO10081561_B_Dicer1
  gRNA
accuagaaguaaaugcaucu

SEQ ID NO: 81562 - RNA, 20 nt, Artificial Sequence
  MKO10081562_B_Dido1
  gRNA
gcuccuaaaugcauuggccc

SEQ ID NO: 81563 - RNA, 20 nt, Artificial Sequence
  MKO10081563_B_Dido1
  gRNA
ccaaugcauuuaggagcacc

SEQ ID NO: 81564 - RNA, 20 nt, Artificial Sequence
  MKO10081564_B_Dido1
  gRNA
gauacguacauuuacucaau

SEQ ID NO: 81565 - RNA, 20 nt, Artificial Sequence
  MKO10081565_B_Diexf
  gRNA
ucucaccuugggauggccuc

SEQ ID NO: 81566 - RNA, 20 nt, Artificial Sequence
  MKO10081566_B_Diexf
  gRNA
acacgagucacuguucagcc

SEQ ID NO: 81567 - RNA, 20 nt, Artificial Sequence
  MKO10081567_B_Diexf
  gRNA
auuaccagcugacaaaucug

SEQ ID NO: 81568 - RNA, 20 nt, Artificial Sequence
  MKO10081568_B_Dimt1
  gRNA
ugcuuuaagaccuaccgaug

SEQ ID NO: 81569 - RNA, 20 nt, Artificial Sequence
  MKO10081569_B_Dimt1
  gRNA
ugaaguucagcuacuagccu

SEQ ID NO: 81570 - RNA, 20 nt, Artificial Sequence
  MKO10081570_B_Dimt1
  gRNA
uugccugugaacuugaucca

SEQ ID NO: 81571 - RNA, 20 nt, Artificial Sequence
  MKO10081571_B_Dio1
  gRNA
cccgauucgccccugacaac

SEQ ID NO: 81572 - RNA, 20 nt, Artificial Sequence
  MKO10081572_B_Dio1
  gRNA
auugaagaagcucacgccac

SEQ ID NO: 81573 - RNA, 20 nt, Artificial Sequence
  MKO10081573_B_Dio1
  gRNA
caucuacgagucucuugaac

SEQ ID NO: 81574 - RNA, 20 nt, Artificial Sequence
  MKO10081574_B_Dio2
  gRNA
cacgaugcacacacguucaa

SEQ ID NO: 81575 - RNA, 20 nt, Artificial Sequence
  MKO10081575_B_Dio2
  gRNA
ugaccgagucauagagcgcc

SEQ ID NO: 81576 - RNA, 20 nt, Artificial Sequence
  MKO10081576_B_Dio2
  gRNA
ccucaucaauguauaccaac

SEQ ID NO: 81577 - RNA, 20 nt, Artificial Sequence
  MKO10081577_B_Dio3
  gRNA
ggaagcgcgggaacagcacg

SEQ ID NO: 81578 - RNA, 20 nt, Artificial Sequence
  MKO10081578_B_Dio3
  gRNA
cgacaaccgucugugcaccc

SEQ ID NO: 81579 - RNA, 20 nt, Artificial Sequence
  MKO10081579_B_Dio3
  gRNA
guacucucgcugcgcugaca

SEQ ID NO: 81580 - RNA, 20 nt, Artificial Sequence
  MKO10081580_B_Dip2a
  gRNA
caucgagcccuggcucgaca

SEQ ID NO: 81581 - RNA, 20 nt, Artificial Sequence
  MKO10081581_B_Dip2a
  gRNA
guugagaccuacacgccucc

SEQ ID NO: 81582 - RNA, 20 nt, Artificial Sequence
  MKO10081582_B_Dip2a
  gRNA
acuccagggaugagcgcuuc

SEQ ID NO: 81583 - RNA, 20 nt, Artificial Sequence
  MKO10081583_B_Dip2b
  gRNA
gucauuguugggguaaacca

SEQ ID NO: 81584 - RNA, 20 nt, Artificial Sequence
  MKO10081584_B_Dip2b
  gRNA
uuacacacugcuuaauaaac

SEQ ID NO: 81585 - RNA, 20 nt, Artificial Sequence
  MKO10081585_B_Dip2b
  gRNA
agaaguaccccugaccagaa

SEQ ID NO: 81586 - RNA, 20 nt, Artificial Sequence
  MKO10081586_B_Dip2c
  gRNA
auggaugccuacacuccccc

SEQ ID NO: 81587 - RNA, 20 nt, Artificial Sequence
  MKO10081587_B_Dip2c
  gRNA
caguggggcagcacaccggc

SEQ ID NO: 81588 - RNA, 20 nt, Artificial Sequence
  MKO10081588_B_Dip2c
  gRNA
gucauggcccagacacacau

SEQ ID NO: 81589 - RNA, 20 nt, Artificial Sequence
  MKO10081589_B_Diras1
  gRNA
cguguucggcgcaggcggcg

SEQ ID NO: 81590 - RNA, 20 nt, Artificial Sequence
  MKO10081590_B_Diras1
  gRNA
agcguuugccguccacgcug

SEQ ID NO: 81591 - RNA, 20 nt, Artificial Sequence
  MKO10081591_B_Diras1
  gRNA
cugcacgaucaacuuguaga

SEQ ID NO: 81592 - RNA, 20 nt, Artificial Sequence
  MKO10081592_B_Diras2
  gRNA
cgcacuuccaugugcgggcu

SEQ ID NO: 81593 - RNA, 20 nt, Artificial Sequence
  MKO10081593_B_Diras2
  gRNA
caagcucaaccacaacguga

SEQ ID NO: 81594 - RNA, 20 nt, Artificial Sequence
  MKO10081594_B_Diras2
  gRNA
accgugagccuccagaucga

SEQ ID NO: 81595 - RNA, 20 nt, Artificial Sequence
  MKO10081595_B_Dirc2
  gRNA
gggcggaaaauaagcuagcg

SEQ ID NO: 81596 - RNA, 20 nt, Artificial Sequence
  MKO10081596_B_Dirc2
  gRNA
uuagcauacgcaauaccacu

SEQ ID NO: 81597 - RNA, 20 nt, Artificial Sequence
  MKO10081597_B_Dirc2
  gRNA
cuuacuugacugacaugcac

SEQ ID NO: 81598 - RNA, 20 nt, Artificial Sequence
  MKO10081598_B_Dis3l2
  gRNA
cuccaauuuaggauggugau

SEQ ID NO: 81599 - RNA, 20 nt, Artificial Sequence
  MKO10081599_B_Dis3l2
  gRNA
ucuauaccucuggggguccc

SEQ ID NO: 81600 - RNA, 20 nt, Artificial Sequence
  MKO10081600_B_Dis3l2
  gRNA
agcacucgggccaaccacag

SEQ ID NO: 81601 - RNA, 20 nt, Artificial Sequence
  MKO10081601_B_Dis3l
  gRNA
agcagcacuguuaccucccc

SEQ ID NO: 81602 - RNA, 20 nt, Artificial Sequence
  MKO10081602_B_Dis3l
  gRNA
caaacugcgaaaccuccuga

SEQ ID NO: 81603 - RNA, 20 nt, Artificial Sequence
  MKO10081603_B_Dis3l
  gRNA
uugguacuaucaccacugug

SEQ ID NO: 81604 - RNA, 20 nt, Artificial Sequence
  MKO10081604_B_Dis3
  gRNA
gauugauguccucgaacacc

SEQ ID NO: 81605 - RNA, 20 nt, Artificial Sequence
  MKO10081605_B_Dis3
  gRNA
cccccaucuacaagcgaauc

SEQ ID NO: 81606 - RNA, 20 nt, Artificial Sequence
  MKO10081606_B_Dis3
  gRNA
cccuuaagcaagcuccaaca

SEQ ID NO: 81607 - RNA, 20 nt, Artificial Sequence
  MKO10081607_B_Disc1
  gRNA
ggacagugcggacuugaccc

SEQ ID NO: 81608 - RNA, 20 nt, Artificial Sequence
  MKO10081608_B_Disc1
  gRNA
ccgauccacaguccgagcca

SEQ ID NO: 81609 - RNA, 20 nt, Artificial Sequence
  MKO10081609_B_Disc1
  gRNA
ccuugcauggagccacccaa

SEQ ID NO: 81610 - RNA, 20 nt, Artificial Sequence
  MKO10081610_B_Disp1
  gRNA
aauaacaugaugcgaaacac

SEQ ID NO: 81611 - RNA, 20 nt, Artificial Sequence
  MKO10081611_B_Disp1
  gRNA
ucagccaccgggaugaccga

SEQ ID NO: 81612 - RNA, 20 nt, Artificial Sequence
  MKO10081612_B_Disp1
  gRNA
gaccuuucaaguucccgaga

SEQ ID NO: 81613 - RNA, 20 nt, Artificial Sequence
  MKO10081613_B_Disp2
  gRNA
acaggcaggaacgcacuuuc

SEQ ID NO: 81614 - RNA, 20 nt, Artificial Sequence
  MKO10081614_B_Disp2
  gRNA
gguccggaccacacuuuccu

SEQ ID NO: 81615 - RNA, 20 nt, Artificial Sequence
  MKO10081615_B_Disp2
  gRNA
gagccucgagacacagagau

SEQ ID NO: 81616 - RNA, 20 nt, Artificial Sequence
  MKO10081616_B_Dixdc1
  gRNA
accacacugugccaccgcug

SEQ ID NO: 81617 - RNA, 20 nt, Artificial Sequence
  MKO10081617_B_Dixdc1
  gRNA
guccugaccgugacacguca

SEQ ID NO: 81618 - RNA, 20 nt, Artificial Sequence
  MKO10081618_B_Dixdc1
  gRNA
augcaucagacgucagcgaa

SEQ ID NO: 81619 - RNA, 20 nt, Artificial Sequence
  MKO10081619_B_Dkc1
  gRNA
cacuauacaccucuuccuug

SEQ ID NO: 81620 - RNA, 20 nt, Artificial Sequence
  MKO10081620_B_Dkc1
  gRNA
aaaacauaccuuuaguaaca

SEQ ID NO: 81621 - RNA, 20 nt, Artificial Sequence
  MKO10081621_B_Dkc1
  gRNA
aauugagccacuuuagauuc

SEQ ID NO: 81622 - RNA, 20 nt, Artificial Sequence
  MKO10081622_B_Dkk1
  gRNA
cgaucaucagacugugccgc

SEQ ID NO: 81623 - RNA, 20 nt, Artificial Sequence
  MKO10081623_B_Dkk1
  gRNA
cuuggccguguuuacaauga

SEQ ID NO: 81624 - RNA, 20 nt, Artificial Sequence
  MKO10081624_B_Dkk1
  gRNA
ugcagcgcuuccugcgcuuu

SEQ ID NO: 81625 - RNA, 20 nt, Artificial Sequence
  MKO10081625_B_Dkk2
  gRNA
ccugguacccgcugcaauaa

SEQ ID NO: 81626 - RNA, 20 nt, Artificial Sequence
  MKO10081626_B_Dkk2
  gRNA
cggcauagagaucgcaacca

SEQ ID NO: 81627 - RNA, 20 nt, Artificial Sequence
  MKO10081627_B_Dkk2
  gRNA
caaugcagucugaugaccgu

SEQ ID NO: 81628 - RNA, 20 nt, Artificial Sequence
  MKO10081628_B_Dkk3
  gRNA
cccuuaccuugugaacuucc

SEQ ID NO: 81629 - RNA, 20 nt, Artificial Sequence
  MKO10081629_B_Dkk3
  gRNA
cuggcagguguacuugaagc

SEQ ID NO: 81630 - RNA, 20 nt, Artificial Sequence
  MKO10081630_B_Dkk3
  gRNA
cuaucacaaugagaccagca

SEQ ID NO: 81631 - RNA, 20 nt, Artificial Sequence
  MKO10081631_B_Dkk4
  gRNA
caagacggcgccuaugcaga

SEQ ID NO: 81632 - RNA, 20 nt, Artificial Sequence
  MKO10081632_B_Dkk4
  gRNA
gcuuugugauuucuucguac

SEQ ID NO: 81633 - RNA, 20 nt, Artificial Sequence
  MKO10081633_B_Dkk4
  gRNA
uguuguuaaaguccagaacc

SEQ ID NO: 81634 - RNA, 20 nt, Artificial Sequence
  MKO10081634_B_Dkkl1
  gRNA
ggaacagucgacuaaagcuu

SEQ ID NO: 81635 - RNA, 20 nt, Artificial Sequence
  MKO10081635_B_Dkkl1
  gRNA
cauugagccagaacggaacc

SEQ ID NO: 81636 - RNA, 20 nt, Artificial Sequence
  MKO10081636_B_Dkkl1
  gRNA
aguuguccaggucucguagc

SEQ ID NO: 81637 - RNA, 20 nt, Artificial Sequence
  MKO10081637_B_Dlau
  gRNA
accgugcccauggucauggu

SEQ ID NO: 81638 - RNA, 20 nt, Artificial Sequence
  MKO10081638_B_Dlau
  gRNA
gagccuggaggagugcuaua

SEQ ID NO: 81639 - RNA, 20 nt, Artificial Sequence
  MKO10081639_B_Dlau
  gRNA
ugagggugaucuaauugcag

SEQ ID NO: 81640 - RNA, 20 nt, Artificial Sequence
  MKO10081640_B_Dlc1
  gRNA
guacucacucgcuuccggug

SEQ ID NO: 81641 - RNA, 20 nt, Artificial Sequence
  MKO10081641_B_Dlc1
  gRNA
cagccagucgcaagcuuccu

SEQ ID NO: 81642 - RNA, 20 nt, Artificial Sequence
  MKO10081642_B_Dlc1
  gRNA
guucccuauugauauugcgc

SEQ ID NO: 81643 - RNA, 20 nt, Artificial Sequence
  MKO10081643_B_Dld
  gRNA
cguugguuguauuccuucaa

SEQ ID NO: 81644 - RNA, 20 nt, Artificial Sequence
  MKO10081644_B_Dld
  gRNA
gccaucaaaucugcccaguu

SEQ ID NO: 81645 - RNA, 20 nt, Artificial Sequence
  MKO10081645_B_Dld
  gRNA
uaauucucauuauuaccaua

SEQ ID NO: 81646 - RNA, 20 nt, Artificial Sequence
  MKO10081646_B_Dlec1
  gRNA
auccagacgcuguuuauaga

SEQ ID NO: 81647 - RNA, 20 nt, Artificial Sequence
  MKO10081647_B_Dlec1
  gRNA
uucccgccuaacacaccaca

SEQ ID NO: 81648 - RNA, 20 nt, Artificial Sequence
  MKO10081648_B_Dlec1
  gRNA
acgucagcuuugaacaucca

SEQ ID NO: 81649 - RNA, 20 nt, Artificial Sequence
  MKO10081649_B_Dleu7
  gRNA
gcaaccacgugggcaucuga

SEQ ID NO: 81650 - RNA, 20 nt, Artificial Sequence
  MKO10081650_B_Dleu7
  gRNA
ggaccacgugcccaucgccc

SEQ ID NO: 81651 - RNA, 20 nt, Artificial Sequence
  MKO10081651_B_Dleu7
  gRNA
uacagggcccgcggucccgg

SEQ ID NO: 81652 - RNA, 20 nt, Artificial Sequence
  MKO10081652_B_Dlg1
  gRNA
uugugcgauuguaugugaaa

SEQ ID NO: 81653 - RNA, 20 nt, Artificial Sequence
  MKO10081653_B_Dlg1
  gRNA
cugucuguguugaccagcac

SEQ ID NO: 81654 - RNA, 20 nt, Artificial Sequence
  MKO10081654_B_Dlg1
  gRNA
ugaugcagauuaugaauaug

SEQ ID NO: 81655 - RNA, 20 nt, Artificial Sequence
  MKO10081655_B_Dlg2
  gRNA
auacacucaccgacaagauc

SEQ ID NO: 81656 - RNA, 20 nt, Artificial Sequence
  MKO10081656_B_Dlg2
  gRNA
cuuugugaaggacuaccuug

SEQ ID NO: 81657 - RNA, 20 nt, Artificial Sequence
  MKO10081657_B_Dlg2
  gRNA
cugaugccuaccugacauac

SEQ ID NO: 81658 - RNA, 20 nt, Artificial Sequence
  MKO10081658_B_Dlg3
  gRNA
ucuuaccuucaggucuauac

SEQ ID NO: 81659 - RNA, 20 nt, Artificial Sequence
  MKO10081659_B_Dlg3
  gRNA
cucuccgaaccagugagaag

SEQ ID NO: 81660 - RNA, 20 nt, Artificial Sequence
  MKO10081660_B_Dlg3
  gRNA
ucauuuguucccgcaaguca

SEQ ID NO: 81661 - RNA, 20 nt, Artificial Sequence
  MKO10081661_B_Dlg4
  gRNA
gggcguuuaccugguugggg

SEQ ID NO: 81662 - RNA, 20 nt, Artificial Sequence
  MKO10081662_B_Dlg4
  gRNA
agaugaagacacgcccccuc

SEQ ID NO: 81663 - RNA, 20 nt, Artificial Sequence
  MKO10081663_B_Dlg4
  gRNA
ggaguaugaggagaucacau

SEQ ID NO: 81664 - RNA, 20 nt, Artificial Sequence
  MKO10081664_B_Dlg5
  gRNA
ccgacauggcccgcacacac

SEQ ID NO: 81665 - RNA, 20 nt, Artificial Sequence
  MKO10081665_B_Dlg5
  gRNA
caugaagcggcuccgggaag

SEQ ID NO: 81666 - RNA, 20 nt, Artificial Sequence
  MKO10081666_B_Dlg5
  gRNA
gagugaccagacgcagcuga

SEQ ID NO: 81667 - RNA, 20 nt, Artificial Sequence
  MKO10081667_B_Dlgap1
  gRNA
gcgacacgcauucgucgucc

SEQ ID NO: 81668 - RNA, 20 nt, Artificial Sequence
  MKO10081668_B_Dlgap1
  gRNA
cggcccagcaagucaacaua

SEQ ID NO: 81669 - RNA, 20 nt, Artificial Sequence
  MKO10081669_B_Dlgap1
  gRNA
cagcaacuccaccgaaaguc

SEQ ID NO: 81670 - RNA, 20 nt, Artificial Sequence
  MKO10081670_B_Dlgap2
  gRNA
gagucucagugcacccuuug

SEQ ID NO: 81671 - RNA, 20 nt, Artificial Sequence
  MKO10081671_B_Dlgap2
  gRNA
caccuucuggcucuccacaa

SEQ ID NO: 81672 - RNA, 20 nt, Artificial Sequence
  MKO10081672_B_Dlgap2
  gRNA
ccgggaagcugaggcccggc

SEQ ID NO: 81673 - RNA, 20 nt, Artificial Sequence
  MKO10081673_B_Dlgap3
  gRNA
gguccagggcguccacggcc

SEQ ID NO: 81674 - RNA, 20 nt, Artificial Sequence
  MKO10081674_B_Dlgap3
  gRNA
gccgugugcggguccguguu

SEQ ID NO: 81675 - RNA, 20 nt, Artificial Sequence
  MKO10081675_B_Dlgap3
  gRNA
agcugccgcuccgcauccug

SEQ ID NO: 81676 - RNA, 20 nt, Artificial Sequence
  MKO10081676_B_Dlgap4
  gRNA
ugguggagacccccgagaag

SEQ ID NO: 81677 - RNA, 20 nt, Artificial Sequence
  MKO10081677_B_Dlgap4
  gRNA
caacccccguccgacagccc

SEQ ID NO: 81678 - RNA, 20 nt, Artificial Sequence
  MKO10081678_B_Dlgap4
  gRNA
gcgcuugaucugggcaaucu

SEQ ID NO: 81679 - RNA, 20 nt, Artificial Sequence
  MKO10081679_B_Dlgap5
  gRNA
cuuguaauccguccaguaug

SEQ ID NO: 81680 - RNA, 20 nt, Artificial Sequence
  MKO10081680_B_Dlgap5
  gRNA
agucugcuccauauauucuu

SEQ ID NO: 81681 - RNA, 20 nt, Artificial Sequence
  MKO10081681_B_Dlgap5
  gRNA
ucucuucacagauugguagc

SEQ ID NO: 81682 - RNA, 20 nt, Artificial Sequence
  MKO10081682_B_Dlk1
  gRNA
gcgcguccucuugcuccugc

SEQ ID NO: 81683 - RNA, 20 nt, Artificial Sequence
  MKO10081683_B_Dlk1
  gRNA
gacgggaaauucugcgaaau

SEQ ID NO: 81684 - RNA, 20 nt, Artificial Sequence
  MKO10081684_B_Dlk1
  gRNA
cagacuccauugacacagcc

SEQ ID NO: 81685 - RNA, 20 nt, Artificial Sequence
  MKO10081685_B_Dlk2
  gRNA
aaguaccugcaggagccguc

SEQ ID NO: 81686 - RNA, 20 nt, Artificial Sequence
  MKO10081686_B_Dlk2
  gRNA
uggacguggcugugagcgca

SEQ ID NO: 81687 - RNA, 20 nt, Artificial Sequence
  MKO10081687_B_Dlk2
  gRNA
cacggcugcugcgcuccuga

SEQ ID NO: 81688 - RNA, 20 nt, Artificial Sequence
  MKO10081688_B_Dll1
  gRNA
gugugugacgagcacuacua

SEQ ID NO: 81689 - RNA, 20 nt, Artificial Sequence
  MKO10081689_B_Dll1
  gRNA
uggccaaaggcgucaucccg

SEQ ID NO: 81690 - RNA, 20 nt, Artificial Sequence
  MKO10081690_B_Dll1
  gRNA
cuuaccuguugcgaggucau

SEQ ID NO: 81691 - RNA, 20 nt, Artificial Sequence
  MKO10081691_B_Dll3
  gRNA
ggcacacguacgaggccauc

SEQ ID NO: 81692 - RNA, 20 nt, Artificial Sequence
  MKO10081692_B_Dll3
  gRNA
gccugaugaaugccguugcc

SEQ ID NO: 81693 - RNA, 20 nt, Artificial Sequence
  MKO10081693_B_Dll3
  gRNA
ucucccucgucauugaaacc

SEQ ID NO: 81694 - RNA, 20 nt, Artificial Sequence
  MKO10081694_B_Dll4
  gRNA
cauuggccagcauaccgcgc

SEQ ID NO: 81695 - RNA, 20 nt, Artificial Sequence
  MKO10081695_B_Dll4
  gRNA
acacaccgggagacgaccug

SEQ ID NO: 81696 - RNA, 20 nt, Artificial Sequence
  MKO10081696_B_Dll4
  gRNA
ccuggccgcaggucgucucc

SEQ ID NO: 81697 - RNA, 20 nt, Artificial Sequence
  MKO10081697_B_Dlst
  gRNA
uacuuaacugcacacagccg

SEQ ID NO: 81698 - RNA, 20 nt, Artificial Sequence
  MKO10081698_B_Dlst
  gRNA
uugcaggggucuccuuaugu

SEQ ID NO: 81699 - RNA, 20 nt, Artificial Sequence
  MKO10081699_B_Dlst
  gRNA
ggcagggaacgucucccuag

SEQ ID NO: 81700 - RNA, 20 nt, Artificial Sequence
  MKO10081700_B_Dlx1
  gRNA
ccccaccgguaccacccggc

SEQ ID NO: 81701 - RNA, 20 nt, Artificial Sequence
  MKO10081701_B_Dlx1
  gRNA
cgauccugcaggucaagaua

SEQ ID NO: 81702 - RNA, 20 nt, Artificial Sequence
  MKO10081702_B_Dlx1
  gRNA
ggcggcgaggugcgcuuuaa

SEQ ID NO: 81703 - RNA, 20 nt, Artificial Sequence
  MKO10081703_B_Dlx2
  gRNA
ggccucgcccuacgcgcaca

SEQ ID NO: 81704 - RNA, 20 nt, Artificial Sequence
  MKO10081704_B_Dlx2
  gRNA
cgcccccgccugcguggugg

SEQ ID NO: 81705 - RNA, 20 nt, Artificial Sequence
  MKO10081705_B_Dlx2
  gRNA
ccugccagagcgagccgagc

SEQ ID NO: 81706 - RNA, 20 nt, Artificial Sequence
  MKO10081706_B_Dlx3
  gRNA
gcugcugagcuugcgaucga

SEQ ID NO: 81707 - RNA, 20 nt, Artificial Sequence
  MKO10081707_B_Dlx3
  gRNA
caccgccgucaccagcacuc

SEQ ID NO: 81708 - RNA, 20 nt, Artificial Sequence
  MKO10081708_B_Dlx3
  gRNA
uggggucguccagguaguug

SEQ ID NO: 81709 - RNA, 20 nt, Artificial Sequence
  MKO10081709_B_Dlx4
  gRNA
uggggagcgaugcugauacc

SEQ ID NO: 81710 - RNA, 20 nt, Artificial Sequence
  MKO10081710_B_Dlx4
  gRNA
gcaucgcuccccagaugugc

SEQ ID NO: 81711 - RNA, 20 nt, Artificial Sequence
  MKO10081711_B_Dlx4
  gRNA
acucggacucacccaaaccc

SEQ ID NO: 81712 - RNA, 20 nt, Artificial Sequence
  MKO10081712_B_Dlx5
  gRNA
ccaacuccgcgcguucuggc

SEQ ID NO: 81713 - RNA, 20 nt, Artificial Sequence
  MKO10081713_B_Dlx5
  gRNA
gucccccgcguccagcuacc

SEQ ID NO: 81714 - RNA, 20 nt, Artificial Sequence
  MKO10081714_B_Dlx5
  gRNA
ccucgcccugccagaacgcg

SEQ ID NO: 81715 - RNA, 20 nt, Artificial Sequence
  MKO10081715_B_Dlx6
  gRNA
ggaaaucagguucaacggaa

SEQ ID NO: 81716 - RNA, 20 nt, Artificial Sequence
  MKO10081716_B_Dlx6
  gRNA
ccuucccgagagagccgaac

SEQ ID NO: 81717 - RNA, 20 nt, Artificial Sequence
  MKO10081717_B_Dlx6
  gRNA
gggaggcauacugacgcccu

SEQ ID NO: 81718 - RNA, 20 nt, Artificial Sequence
  MKO10081718_B_Dmap1
  gRNA
uuacaaccgaaccccagagc

SEQ ID NO: 81719 - RNA, 20 nt, Artificial Sequence
  MKO10081719_B_Dmap1
  gRNA
ugauccucagaagcguucug

SEQ ID NO: 81720 - RNA, 20 nt, Artificial Sequence
  MKO10081720_B_Dmap1
  gRNA
accucccgaugcaugcccuc

SEQ ID NO: 81721 - RNA, 20 nt, Artificial Sequence
  MKO10081721_B_Dmbt1
  gRNA
gccagguuuggacagggcuc

SEQ ID NO: 81722 - RNA, 20 nt, Artificial Sequence
  MKO10081722_B_Dmbt1
  gRNA
cccugagcccuguccaaacc

SEQ ID NO: 81723 - RNA, 20 nt, Artificial Sequence
  MKO10081723_B_Dmbt1
  gRNA
caaacaagcagucccacacc

SEQ ID NO: 81724 - RNA, 20 nt, Artificial Sequence
  MKO10081724_B_Dmbx1
  gRNA
caagcagcacgccgcauccc

SEQ ID NO: 81725 - RNA, 20 nt, Artificial Sequence
  MKO10081725_B_Dmbx1
  gRNA
ccauaacgcccgcagcccca

SEQ ID NO: 81726 - RNA, 20 nt, Artificial Sequence
  MKO10081726_B_Dmbx1
  gRNA
cggcacgggaguccucuuca

SEQ ID NO: 81727 - RNA, 20 nt, Artificial Sequence
  MKO10081727_B_Dmc1
  gRNA
augguauuccauaucacuac

SEQ ID NO: 81728 - RNA, 20 nt, Artificial Sequence
  MKO10081728_B_Dmc1
  gRNA
agagcccucugcaaugucaa

SEQ ID NO: 81729 - RNA, 20 nt, Artificial Sequence
  MKO10081729_B_Dmc1
  gRNA
auugaccuguugcagaagca

SEQ ID NO: 81730 - RNA, 20 nt, Artificial Sequence
  MKO10081730_B_Dmd
  gRNA
uuuggaauauaauccuccac

SEQ ID NO: 81731 - RNA, 20 nt, Artificial Sequence
  MKO10081731_B_Dmd
  gRNA
aggccuuacagggcaaaaac

SEQ ID NO: 81732 - RNA, 20 nt, Artificial Sequence
  MKO10081732_B_Dmd
  gRNA
ugcccugaacaaugucaaca

SEQ ID NO: 81733 - RNA, 20 nt, Artificial Sequence
  MKO10081733_B_Dmgdh
  gRNA
acagcaucaaacuuuacgag

SEQ ID NO: 81734 - RNA, 20 nt, Artificial Sequence
  MKO10081734_B_Dmgdh
  gRNA
uuagccggacuguauaaccc

SEQ ID NO: 81735 - RNA, 20 nt, Artificial Sequence
  MKO10081735_B_Dmgdh
  gRNA
agcucaccgcuggcucuacc

SEQ ID NO: 81736 - RNA, 20 nt, Artificial Sequence
  MKO10081736_B_Dmkn
  gRNA
gaaagaucuugucuugcuuc

SEQ ID NO: 81737 - RNA, 20 nt, Artificial Sequence
  MKO10081737_B_Dmkn
  gRNA
ucuuucagcugacucaucca

SEQ ID NO: 81738 - RNA, 20 nt, Artificial Sequence
  MKO10081738_B_Dmkn
  gRNA
agucacaccuucaucuuccu

SEQ ID NO: 81739 - RNA, 20 nt, Artificial Sequence
  MKO10081739_B_Dmp1
  gRNA
ucuacacagggugauuuggc

SEQ ID NO: 81740 - RNA, 20 nt, Artificial Sequence
  MKO10081740_B_Dmp1
  gRNA
ugucuaauuaccugucccuc

SEQ ID NO: 81741 - RNA, 20 nt, Artificial Sequence
  MKO10081741_B_Dmp1
  gRNA
agcuuucagauucaguauug

SEQ ID NO: 81742 - RNA, 20 nt, Artificial Sequence
  MKO10081742_B_Dmpk
  gRNA
cuccuuaagccuugcugcaa

SEQ ID NO: 81743 - RNA, 20 nt, Artificial Sequence
  MKO10081743_B_Dmpk
  gRNA
gcagcugugugauccagcgc

SEQ ID NO: 81744 - RNA, 20 nt, Artificial Sequence
  MKO10081744_B_Dmpk
  gRNA
uuaaggagguccgacugcag

SEQ ID NO: 81745 - RNA, 20 nt, Artificial Sequence
  MKO10081745_B_Dmrt1
  gRNA
ccuuacgugccugcucagac

SEQ ID NO: 81746 - RNA, 20 nt, Artificial Sequence
  MKO10081746_B_Dmrt1
  gRNA
ugguugacggcguagcugcu

SEQ ID NO: 81747 - RNA, 20 nt, Artificial Sequence
  MKO10081747_B_Dmrt1
  gRNA
gucccagaucuuuaccuucg

SEQ ID NO: 81748 - RNA, 20 nt, Artificial Sequence
  MKO10081748_B_Dmrt2
  gRNA
gccagcgacagaaucgcuug

SEQ ID NO: 81749 - RNA, 20 nt, Artificial Sequence
  MKO10081749_B_Dmrt2
  gRNA
ucggcgcccugacuugccuc

SEQ ID NO: 81750 - RNA, 20 nt, Artificial Sequence
  MKO10081750_B_Dmrt2
  gRNA
ggaaacagaacaauuucgau

SEQ ID NO: 81751 - RNA, 20 nt, Artificial Sequence
  MKO10081751_B_Dmrt3
  gRNA
cccgcugccgcucgaugauc

SEQ ID NO: 81752 - RNA, 20 nt, Artificial Sequence
  MKO10081752_B_Dmrt3
  gRNA
uucauccacggacacgaucu

SEQ ID NO: 81753 - RNA, 20 nt, Artificial Sequence
  MKO10081753_B_Dmrt3
  gRNA
gccucaucccggacucgcug

SEQ ID NO: 81754 - RNA, 20 nt, Artificial Sequence
  MKO10081754_B_Dmrua1
  gRNA
uucuccucccgauugauccg

SEQ ID NO: 81755 - RNA, 20 nt, Artificial Sequence
  MKO10081755_B_Dmrua1
  gRNA
ccccgacgacaccgaccgcg

SEQ ID NO: 81756 - RNA, 20 nt, Artificial Sequence
  MKO10081756_B_Dmrua1
  gRNA
cugcgaucgaccgcaagcuc

SEQ ID NO: 81757 - RNA, 20 nt, Artificial Sequence
  MKO10081757_B_Dmrua2
  gRNA
acccguggcaucgguggcgu

SEQ ID NO: 81758 - RNA, 20 nt, Artificial Sequence
  MKO10081758_B_Dmrua2
  gRNA
gcccuugucgcccgacggcg

SEQ ID NO: 81759 - RNA, 20 nt, Artificial Sequence
  MKO10081759_B_Dmrua2
  gRNA
cagaggguaggcgcccgcgu

SEQ ID NO: 81760 - RNA, 20 nt, Artificial Sequence
  MKO10081760_B_Dmrtb1
  gRNA
gcugaccuacgauacagaca

SEQ ID NO: 81761 - RNA, 20 nt, Artificial Sequence
  MKO10081761_B_Dmrtb1
  gRNA
gaauccuggccuuccgaaag

SEQ ID NO: 81762 - RNA, 20 nt, Artificial Sequence
  MKO10081762_B_Dmrtb1
  gRNA
cagcuuaguuggacugcucc

SEQ ID NO: 81763 - RNA, 20 nt, Artificial Sequence
  MKO10081763_B_Dmruc1a
  gRNA
uugcaguagcauagggucag

SEQ ID NO: 81764 - RNA, 20 nt, Artificial Sequence
  MKO10081764_B_Dmruc1a
  gRNA
gaggucccauggggcucccc

SEQ ID NO: 81765 - RNA, 20 nt, Artificial Sequence
  MKO10081765_B_Dmruc1a
  gRNA
cuacauaccuggcaugccac

SEQ ID NO: 81766 - RNA, 20 nt, Artificial Sequence
  MKO10081766_B_Dmruc1b
  gRNA
ucuuaccucccgugggguuu

SEQ ID NO: 81767 - RNA, 20 nt, Artificial Sequence
  MKO10081767_B_Dmruc1b
  gRNA
cuaugcacaagcaugagacc

SEQ ID NO: 81768 - RNA, 20 nt, Artificial Sequence
  MKO10081768_B_Dmruc1b
  gRNA
cuccugcagggaaguuccca

SEQ ID NO: 81769 - RNA, 20 nt, Artificial Sequence
  MKO10081769_B_Dmruc1c1
  gRNA
cuauugaagggaccacggcg

SEQ ID NO: 81770 - RNA, 20 nt, Artificial Sequence
  MKO10081770_B_Dmruc1c1
  gRNA
accuccugggggcuugcuug

SEQ ID NO: 81771 - RNA, 20 nt, Artificial Sequence
  MKO10081771_B_Dmruc1c1
  gRNA
ccugccucaagcaagccccc

SEQ ID NO: 81772 - RNA, 20 nt, Artificial Sequence
  MKO10081772_B_Dmruc1c2
  gRNA
cucacggcgaccucuuccuu

SEQ ID NO: 81773 - RNA, 20 nt, Artificial Sequence
  MKO10081773_B_Dmruc1c2
  gRNA
ccugccucaagcaagccccc

SEQ ID NO: 81774 - RNA, 20 nt, Artificial Sequence
  MKO10081774_B_Dmruc1c2
  gRNA
accuccugggggcuugcuug

SEQ ID NO: 81775 - RNA, 20 nt, Artificial Sequence
  MKO10081775_B_Dmruc2
  gRNA
uuccuacuuacgugugaggc

SEQ ID NO: 81776 - RNA, 20 nt, Artificial Sequence
  MKO10081776_B_Dmruc2
  gRNA
acugcugcucagccgccccc

SEQ ID NO: 81777 - RNA, 20 nt, Artificial Sequence
  MKO10081777_B_Dmruc2
  gRNA
agcuccccuccgugucaaga

SEQ ID NO: 81778 - RNA, 20 nt, Artificial Sequence
  MKO10081778_B_Dmtf1
  gRNA
gaccaugacggcaacuacag

SEQ ID NO: 81779 - RNA, 20 nt, Artificial Sequence
  MKO10081779_B_Dmtf1
  gRNA
caccucuguaguugccguca

SEQ ID NO: 81780 - RNA, 20 nt, Artificial Sequence
  MKO10081780_B_Dmtf1
  gRNA
guacugaaccuccacauaag

SEQ ID NO: 81781 - RNA, 20 nt, Artificial Sequence
  MKO10081781_B_Dmtn
  gRNA
gauccuuguagcccaacacc

SEQ ID NO: 81782 - RNA, 20 nt, Artificial Sequence
  MKO10081782_B_Dmtn
  gRNA
aucccccccaccgucuccag

SEQ ID NO: 81783 - RNA, 20 nt, Artificial Sequence
  MKO10081783_B_Dmtn
  gRNA
ucucucaggcuucaacccca

SEQ ID NO: 81784 - RNA, 20 nt, Artificial Sequence
  MKO10081784_B_Dmwd
  gRNA
ucaacaagcccaucgacaag

SEQ ID NO: 81785 - RNA, 20 nt, Artificial Sequence
  MKO10081785_B_Dmwd
  gRNA
acccagcaagucaguuguag

SEQ ID NO: 81786 - RNA, 20 nt, Artificial Sequence
  MKO10081786_B_Dmwd
  gRNA
gucucccuaguucacagacg

SEQ ID NO: 81787 - RNA, 20 nt, Artificial Sequence
  MKO10081787_B_Dmxl1
  gRNA
auauuuccaugcuuagcgcc

SEQ ID NO: 81788 - RNA, 20 nt, Artificial Sequence
  MKO10081788_B_Dmxl1
  gRNA
caauagcacauaauauaacc

SEQ ID NO: 81789 - RNA, 20 nt, Artificial Sequence
  MKO10081789_B_Dmxl1
  gRNA
aacagagauaacguucccau

SEQ ID NO: 81790 - RNA, 20 nt, Artificial Sequence
  MKO10081790_B_Dmxl2
  gRNA
gaacauccaagucaguugug

SEQ ID NO: 81791 - RNA, 20 nt, Artificial Sequence
  MKO10081791_B_Dmxl2
  gRNA
ccaugcuaaguuguauguca

SEQ ID NO: 81792 - RNA, 20 nt, Artificial Sequence
  MKO10081792_B_Dmxl2
  gRNA
ucuuaugagaauuuacaccc

SEQ ID NO: 81793 - RNA, 20 nt, Artificial Sequence
  MKO10081793_B_Dna2
  gRNA
gcugcuagcgacgcuugugc

SEQ ID NO: 81794 - RNA, 20 nt, Artificial Sequence
  MKO10081794_B_Dna2
  gRNA
ucgcuuucugaaagacuucg

SEQ ID NO: 81795 - RNA, 20 nt, Artificial Sequence
  MKO10081795_B_Dna2
  gRNA
ggagaagcgcuugcacguca

SEQ ID NO: 81796 - RNA, 20 nt, Artificial Sequence
  MKO10081796_B_Dnaaf1
  gRNA
ccacaaccgccuggagacgg

SEQ ID NO: 81797 - RNA, 20 nt, Artificial Sequence
  MKO10081797_B_Dnaaf1
  gRNA
cacccuuaaagugcaaauac

SEQ ID NO: 81798 - RNA, 20 nt, Artificial Sequence
  MKO10081798_B_Dnaaf1
  gRNA
cuugggcaggauguugugca

SEQ ID NO: 81799 - RNA, 20 nt, Artificial Sequence
  MKO10081799_B_Dnaaf2
  gRNA
ugaagaaccucaaucagcgg

SEQ ID NO: 81800 - RNA, 20 nt, Artificial Sequence
  MKO10081800_B_Dnaaf2
  gRNA
uaguacuaccuacucgacug

SEQ ID NO: 81801 - RNA, 20 nt, Artificial Sequence
  MKO10081801_B_Dnaaf2
  gRNA
uauaaaagagacgaauaugc

SEQ ID NO: 81802 - RNA, 20 nt, Artificial Sequence
  MKO10081802_B_Dnaaf3
  gRNA
acagucgaaaacagagcgca

SEQ ID NO: 81803 - RNA, 20 nt, Artificial Sequence
  MKO10081803_B_Dnaaf3
  gRNA
aguugcuccuccaggcgauc

SEQ ID NO: 81804 - RNA, 20 nt, Artificial Sequence
  MKO10081804_B_Dnaaf3
  gRNA
gaacuggaugcccugcuguu

SEQ ID NO: 81805 - RNA, 20 nt, Artificial Sequence
  MKO10081805_B_Dnah10
  gRNA
gagugacuaucaaaaaguag

SEQ ID NO: 81806 - RNA, 20 nt, Artificial Sequence
  MKO10081806_B_Dnah10
  gRNA
aaaacgcaucaucaacaagc

SEQ ID NO: 81807 - RNA, 20 nt, Artificial Sequence
  MKO10081807_B_Dnah10
  gRNA
gucauccauaucaaauagag

SEQ ID NO: 81808 - RNA, 20 nt, Artificial Sequence
  MKO10081808_B_Dnah11
  gRNA
uacauguguaagcaaugacc

SEQ ID NO: 81809 - RNA, 20 nt, Artificial Sequence
  MKO10081809_B_Dnah11
  gRNA
ucagcacacccucucuugag

SEQ ID NO: 81810 - RNA, 20 nt, Artificial Sequence
  MKO10081810_B_Dnah11
  gRNA
ggcuccaauuguccucaaga

SEQ ID NO: 81811 - RNA, 20 nt, Artificial Sequence
  MKO10081811_B_Dnah17
  gRNA
gcugccuauccccgagcacc

SEQ ID NO: 81812 - RNA, 20 nt, Artificial Sequence
  MKO10081812_B_Dnah17
  gRNA
gaacaagauaguugagaucc

SEQ ID NO: 81813 - RNA, 20 nt, Artificial Sequence
  MKO10081813_B_Dnah17
  gRNA
gaagccccugcgcauccugu

SEQ ID NO: 81814 - RNA, 20 nt, Artificial Sequence
  MKO10081814_B_Dnah1
  gRNA
gugccccagaucgucgucug

SEQ ID NO: 81815 - RNA, 20 nt, Artificial Sequence
  MKO10081815_B_Dnah1
  gRNA
cucucgaucucaaucuuccg

SEQ ID NO: 81816 - RNA, 20 nt, Artificial Sequence
  MKO10081816_B_Dnah1
  gRNA
cucgacaaguucaccccaaa

SEQ ID NO: 81817 - RNA, 20 nt, Artificial Sequence
  MKO10081817_B_Dnah2
  gRNA
caucaccccagagaacuucg

SEQ ID NO: 81818 - RNA, 20 nt, Artificial Sequence
  MKO10081818_B_Dnah2
  gRNA
ccuacaucccggcuuugcuc

SEQ ID NO: 81819 - RNA, 20 nt, Artificial Sequence
  MKO10081819_B_Dnah2
  gRNA
uuagccucuccaugaagcgc

SEQ ID NO: 81820 - RNA, 20 nt, Artificial Sequence
  MKO10081820_B_Dnah5
  gRNA
uuacgccugagaacauccac

SEQ ID NO: 81821 - RNA, 20 nt, Artificial Sequence
  MKO10081821_B_Dnah5
  gRNA
gccaagagggcccgucugga

SEQ ID NO: 81822 - RNA, 20 nt, Artificial Sequence
  MKO10081822_B_Dnah5
  gRNA
agucaugccgcccauccaga

SEQ ID NO: 81823 - RNA, 20 nt, Artificial Sequence
  MKO10081823_B_Dnah6
  gRNA
gaagcucugucagccgugcu

SEQ ID NO: 81824 - RNA, 20 nt, Artificial Sequence
  MKO10081824_B_Dnah6
  gRNA
guacggcagagaucauguaa

SEQ ID NO: 81825 - RNA, 20 nt, Artificial Sequence
  MKO10081825_B_Dnah6
  gRNA
cgaugucaucauuguaaacg

SEQ ID NO: 81826 - RNA, 20 nt, Artificial Sequence
  MKO10081826_B_Dnah7a
  gRNA
uaaauuaccaaagauaacug

SEQ ID NO: 81827 - RNA, 20 nt, Artificial Sequence
  MKO10081827_B_Dnah7a
  gRNA
cgucuuugauuugccuuuag

SEQ ID NO: 81828 - RNA, 20 nt, Artificial Sequence
  MKO10081828_B_Dnah7a
  gRNA
accuuugaucuugaaguuga

SEQ ID NO: 81829 - RNA, 20 nt, Artificial Sequence
  MKO10081829_B_Dnah7b
  gRNA
auggagcuaucugcugccac

SEQ ID NO: 81830 - RNA, 20 nt, Artificial Sequence
  MKO10081830_B_Dnah7b
  gRNA
caaggacuugcgggccaggc

SEQ ID NO: 81831 - RNA, 20 nt, Artificial Sequence
  MKO10081831_B_Dnah7b
  gRNA
uaaauuaccgaaguuaacug

SEQ ID NO: 81832 - RNA, 20 nt, Artificial Sequence
  MKO10081832_B_Dnah8
  gRNA
ccauccuugcaacuagcaac

SEQ ID NO: 81833 - RNA, 20 nt, Artificial Sequence
  MKO10081833_B_Dnah8
  gRNA
agcuuuaaaccaguccaagc

SEQ ID NO: 81834 - RNA, 20 nt, Artificial Sequence
  MKO10081834_B_Dnah8
  gRNA
uggguuggacuuaguaacug

SEQ ID NO: 81835 - RNA, 20 nt, Artificial Sequence
  MKO10081835_B_Dnah9
  gRNA
ggaacgguaccauuugcagg

SEQ ID NO: 81836 - RNA, 20 nt, Artificial Sequence
  MKO10081836_B_Dnah9
  gRNA
acucaagagggagucuucuc

SEQ ID NO: 81837 - RNA, 20 nt, Artificial Sequence
  MKO10081837_B_Dnah9
  gRNA
ugcuucaacgucucugaaca

SEQ ID NO: 81838 - RNA, 20 nt, Artificial Sequence
  MKO10081838_B_Dnaic1
  gRNA
augcaccccagaauauuguc

SEQ ID NO: 81839 - RNA, 20 nt, Artificial Sequence
  MKO10081839_B_Dnaic1
  gRNA
agggggucgcacgguggcuu

SEQ ID NO: 81840 - RNA, 20 nt, Artificial Sequence
  MKO10081840_B_Dnaic1
  gRNA
gagggcacauauaaacuuau

SEQ ID NO: 81841 - RNA, 20 nt, Artificial Sequence
  MKO10081841_B_Dnaic2
  gRNA
cuguuuaggccaacaccgag

SEQ ID NO: 81842 - RNA, 20 nt, Artificial Sequence
  MKO10081842_B_Dnaic2
  gRNA
guugucuccucucgucaccc

SEQ ID NO: 81843 - RNA, 20 nt, Artificial Sequence
  MKO10081843_B_Dnaic2
  gRNA
caacgccaucgacaucuacg

SEQ ID NO: 81844 - RNA, 20 nt, Artificial Sequence
  MKO10081844_B_Dnaja1
  gRNA
gaacauaucaaagauaucca

SEQ ID NO: 81845 - RNA, 20 nt, Artificial Sequence
  MKO10081845_B_Dnaja1
  gRNA
uucuugcugauuccaaaaaa

SEQ ID NO: 81846 - RNA, 20 nt, Artificial Sequence
  MKO10081846_B_Dnaja1
  gRNA
accauuauauaagucuucua

SEQ ID NO: 81847 - RNA, 20 nt, Artificial Sequence
  MKO10081847_B_Dnaja2
  gRNA
cuccgccgcugccuucccgu

SEQ ID NO: 81848 - RNA, 20 nt, Artificial Sequence
  MKO10081848_B_Dnaja2
  gRNA
auucuugcuaaguuguaguu

SEQ ID NO: 81849 - RNA, 20 nt, Artificial Sequence
  MKO10081849_B_Dnaja2
  gRNA
cuuaucagggugguauucuu

SEQ ID NO: 81850 - RNA, 20 nt, Artificial Sequence
  MKO10081850_B_Dnaja3
  gRNA
uaugacgcuuacggcucugc

SEQ ID NO: 81851 - RNA, 20 nt, Artificial Sequence
  MKO10081851_B_Dnaja3
  gRNA
aggucccucuguugaccccg

SEQ ID NO: 81852 - RNA, 20 nt, Artificial Sequence
  MKO10081852_B_Dnaja3
  gRNA
agaugauuauuaccagaucc

SEQ ID NO: 81853 - RNA, 20 nt, Artificial Sequence
  MKO10081853_B_Dnaja4
  gRNA
gauaauugugcuugaucaga

SEQ ID NO: 81854 - RNA, 20 nt, Artificial Sequence
  MKO10081854_B_Dnaja4
  gRNA
uaauugccuguucuccaccu

SEQ ID NO: 81855 - RNA, 20 nt, Artificial Sequence
  MKO10081855_B_Dnaja4
  gRNA
aaaguuuaaacuuauauccc

SEQ ID NO: 81856 - RNA, 20 nt, Artificial Sequence
  MKO10081856_B_Dnajb11
  gRNA
acucgucacaaaccacuucc

SEQ ID NO: 81857 - RNA, 20 nt, Artificial Sequence
  MKO10081857_B_Dnajb11
  gRNA
uggaggaaccccucgucagc

SEQ ID NO: 81858 - RNA, 20 nt, Artificial Sequence
  MKO10081858_B_Dnajb11
  gRNA
caguugcauuuccguuugcc

SEQ ID NO: 81859 - RNA, 20 nt, Artificial Sequence
  MKO10081859_B_Dnajb12
  gRNA
accgaaacccccucagccaa

SEQ ID NO: 81860 - RNA, 20 nt, Artificial Sequence
  MKO10081860_B_Dnajb12
  gRNA
ccagacaagaaccaugcgcc

SEQ ID NO: 81861 - RNA, 20 nt, Artificial Sequence
  MKO10081861_B_Dnajb12
  gRNA
gggugaucaccgguggacug

SEQ ID NO: 81862 - RNA, 20 nt, Artificial Sequence
  MKO10081862_B_Dnajb13
  gRNA
aaaaaauuaagaucucccga

SEQ ID NO: 81863 - RNA, 20 nt, Artificial Sequence
  MKO10081863_B_Dnajb13
  gRNA
caucuaugacaaguuuggug

SEQ ID NO: 81864 - RNA, 20 nt, Artificial Sequence
  MKO10081864_B_Dnajb13
  gRNA
cugaccaucgaugugagacc

SEQ ID NO: 81865 - RNA, 20 nt, Artificial Sequence
  MKO10081865_B_Dnajb14
  gRNA
caauuuccaccggggcugug

SEQ ID NO: 81866 - RNA, 20 nt, Artificial Sequence
  MKO10081866_B_Dnajb14
  gRNA
ccagacaaaaaccacgcccc

SEQ ID NO: 81867 - RNA, 20 nt, Artificial Sequence
  MKO10081867_B_Dnajb14
  gRNA
cucuuucaugcccacugugu

SEQ ID NO: 81868 - RNA, 20 nt, Artificial Sequence
  MKO10081868_B_Dnajb1
  gRNA
cccguugcgcugcccaaaaa

SEQ ID NO: 81869 - RNA, 20 nt, Artificial Sequence
  MKO10081869_B_Dnajb1
  gRNA
gguaugcggcggaaaguccc

SEQ ID NO: 81870 - RNA, 20 nt, Artificial Sequence
  MKO10081870_B_Dnajb1
  gRNA
cgucucauccagaaccaucc

SEQ ID NO: 81871 - RNA, 20 nt, Artificial Sequence
  MKO10081871_B_Dnajb2
  gRNA
gacuuccucggggcuacgga

SEQ ID NO: 81872 - RNA, 20 nt, Artificial Sequence
  MKO10081872_B_Dnajb2
  gRNA
uuccugcagguaccgaaaga

SEQ ID NO: 81873 - RNA, 20 nt, Artificial Sequence
  MKO10081873_B_Dnajb2
  gRNA
cagugcuuaccggaguuggc

SEQ ID NO: 81874 - RNA, 20 nt, Artificial Sequence
  MKO10081874_B_Dnajb3
  gRNA
ggccgagaggcgguucaagc

SEQ ID NO: 81875 - RNA, 20 nt, Artificial Sequence
  MKO10081875_B_Dnajb3
  gRNA
accgcaagcuugcgcucaag

SEQ ID NO: 81876 - RNA, 20 nt, Artificial Sequence
  MKO10081876_B_Dnajb3
  gRNA
gcaggccuacgaggucuuau

SEQ ID NO: 81877 - RNA, 20 nt, Artificial Sequence
  MKO10081877_B_Dnajb4
  gRNA
ucuuguccgggugaaauuug

SEQ ID NO: 81878 - RNA, 20 nt, Artificial Sequence
  MKO10081878_B_Dnajb4
  gRNA
gcaagcccucaaauuucacc

SEQ ID NO: 81879 - RNA, 20 nt, Artificial Sequence
  MKO10081879_B_Dnajb4
  gRNA
agguuucuuccguccauugu

SEQ ID NO: 81880 - RNA, 20 nt, Artificial Sequence
  MKO10081880_B_Dnajb5
  gRNA
ucguacaggcuccgcuucuu

SEQ ID NO: 81881 - RNA, 20 nt, Artificial Sequence
  MKO10081881_B_Dnajb5
  gRNA
caccgugaaaagacuccgug

SEQ ID NO: 81882 - RNA, 20 nt, Artificial Sequence
  MKO10081882_B_Dnajb5
  gRNA
gugaacauucccaccauuga

SEQ ID NO: 81883 - RNA, 20 nt, Artificial Sequence
  MKO10081883_B_Dnajb6
  gRNA
gguggauuacuaugaagugc

SEQ ID NO: 81884 - RNA, 20 nt, Artificial Sequence
  MKO10081884_B_Dnajb6
  gRNA
gcagagacaugccucaccug

SEQ ID NO: 81885 - RNA, 20 nt, Artificial Sequence
  MKO10081885_B_Dnajb6
  gRNA
aaaauaaagaagaagcagag

SEQ ID NO: 81886 - RNA, 20 nt, Artificial Sequence
  MKO10081886_B_Dnajb7
  gRNA
uaugaccacccagcgcuuuc

SEQ ID NO: 81887 - RNA, 20 nt, Artificial Sequence
  MKO10081887_B_Dnajb7
  gRNA
agagcccggaaagcgcuggg

SEQ ID NO: 81888 - RNA, 20 nt, Artificial Sequence
  MKO10081888_B_Dnajb7
  gRNA
ugaauacccugugucguaag

SEQ ID NO: 81889 - RNA, 20 nt, Artificial Sequence
  MKO10081889_B_Dnajb8
  gRNA
cuccggucaguaacugucaa

SEQ ID NO: 81890 - RNA, 20 nt, Artificial Sequence
  MKO10081890_B_Dnajb8
  gRNA
ggccaacuacuaugaagugc

SEQ ID NO: 81891 - RNA, 20 nt, Artificial Sequence
  MKO10081891_B_Dnajb8
  gRNA
guucucaaugauucgcuugg

SEQ ID NO: 81892 - RNA, 20 nt, Artificial Sequence
  MKO10081892_B_Dnajb9
  gRNA
aaaagcuacuaugauaucuu

SEQ ID NO: 81893 - RNA, 20 nt, Artificial Sequence
  MKO10081893_B_Dnajb9
  gRNA
uucagcguaugaaacacucu

SEQ ID NO: 81894 - RNA, 20 nt, Artificial Sequence
  MKO10081894_B_Dnajb9
  gRNA
aggacugucacucaacgaag

SEQ ID NO: 81895 - RNA, 20 nt, Artificial Sequence
  MKO10081895_B_Dnajc10
  gRNA
ucaccuuaccgaaaucguaa

SEQ ID NO: 81896 - RNA, 20 nt, Artificial Sequence
  MKO10081896_B_Dnajc10
  gRNA
cggaugcucugccgaaugaa

SEQ ID NO: 81897 - RNA, 20 nt, Artificial Sequence
  MKO10081897_B_Dnajc10
  gRNA
ucagaugcugcugucaacuc

SEQ ID NO: 81898 - RNA, 20 nt, Artificial Sequence
  MKO10081898_B_Dnajc11
  gRNA
cccaccgaccuucauaagcc

SEQ ID NO: 81899 - RNA, 20 nt, Artificial Sequence
  MKO10081899_B_Dnajc11
  gRNA
acaacagcgaacgaacccca

SEQ ID NO: 81900 - RNA, 20 nt, Artificial Sequence
  MKO10081900_B_Dnajc11
  gRNA
uccagagagagcgcgaagag

SEQ ID NO: 81901 - RNA, 20 nt, Artificial Sequence
  MKO10081901_B_Dnajc12
  gRNA
caccuucguuuccgcugguc

SEQ ID NO: 81902 - RNA, 20 nt, Artificial Sequence
  MKO10081902_B_Dnajc12
  gRNA
aauuaaucuagucgaugcau

SEQ ID NO: 81903 - RNA, 20 nt, Artificial Sequence
  MKO10081903_B_Dnajc12
  gRNA
ugcucacuccguuccuuguu

SEQ ID NO: 81904 - RNA, 20 nt, Artificial Sequence
  MKO10081904_B_Dnajc13
  gRNA
uucaaccucacauuucguaa

SEQ ID NO: 81905 - RNA, 20 nt, Artificial Sequence
  MKO10081905_B_Dnajc13
  gRNA
gauuauagguaguaacugca

SEQ ID NO: 81906 - RNA, 20 nt, Artificial Sequence
  MKO10081906_B_Dnajc13
  gRNA
uaccuuagaaguaacaaauc

SEQ ID NO: 81907 - RNA, 20 nt, Artificial Sequence
  MKO10081907_B_Dnajc14
  gRNA
caccuaccucugccggccac

SEQ ID NO: 81908 - RNA, 20 nt, Artificial Sequence
  MKO10081908_B_Dnajc14
  gRNA
ucauauuccuuccgccucuc

SEQ ID NO: 81909 - RNA, 20 nt, Artificial Sequence
  MKO10081909_B_Dnajc14
  gRNA
acagaaacucauucacugac

SEQ ID NO: 81910 - RNA, 20 nt, Artificial Sequence
  MKO10081910_B_Dnajc15
  gRNA
cuugugugcuguucuaaucu

SEQ ID NO: 81911 - RNA, 20 nt, Artificial Sequence
  MKO10081911_B_Dnajc15
  gRNA
guugcagcuguugcauuugc

SEQ ID NO: 81912 - RNA, 20 nt, Artificial Sequence
  MKO10081912_B_Dnajc15
  gRNA
accaccuaccuuugucugga

SEQ ID NO: 81913 - RNA, 20 nt, Artificial Sequence
  MKO10081913_B_Dnajc16
  gRNA
ugaaaaccuacggcaguucg

SEQ ID NO: 81914 - RNA, 20 nt, Artificial Sequence
  MKO10081914_B_Dnajc16
  gRNA
cugcuggugucuggccgaac

SEQ ID NO: 81915 - RNA, 20 nt, Artificial Sequence
  MKO10081915_B_Dnajc16
  gRNA
uccauuaccuuguacaucag

SEQ ID NO: 81916 - RNA, 20 nt, Artificial Sequence
  MKO10081916_B_Dnajc17
  gRNA
gcucaccuccugcucuagug

SEQ ID NO: 81917 - RNA, 20 nt, Artificial Sequence
  MKO10081917_B_Dnajc17
  gRNA
uuaccugcucugggguuauc

SEQ ID NO: 81918 - RNA, 20 nt, Artificial Sequence
  MKO10081918_B_Dnajc17
  gRNA
cgccaccacacuagagcagg

SEQ ID NO: 81919 - RNA, 20 nt, Artificial Sequence
  MKO10081919_B_Dnajc18
  gRNA
gucucuugucgggauugcuc

SEQ ID NO: 81920 - RNA, 20 nt, Artificial Sequence
  MKO10081920_B_Dnajc18
  gRNA
uacacagaggaacagcuacg

SEQ ID NO: 81921 - RNA, 20 nt, Artificial Sequence
  MKO10081921_B_Dnajc18
  gRNA
agacuccgcuaugaugaaua

SEQ ID NO: 81922 - RNA, 20 nt, Artificial Sequence
  MKO10081922_B_Dnajc19
  gRNA
ggguugaccauugcugcugc

SEQ ID NO: 81923 - RNA, 20 nt, Artificial Sequence
  MKO10081923_B_Dnajc19
  gRNA
uuuacaagccaugaagcaug

SEQ ID NO: 81924 - RNA, 20 nt, Artificial Sequence
  MKO10081924_B_Dnajc19
  gRNA
ucauggcuuguaaaacauaa

SEQ ID NO: 81925 - RNA, 20 nt, Artificial Sequence
  MKO10081925_B_Dnajc1
  gRNA
caugguaaggaugaacugcu

SEQ ID NO: 81926 - RNA, 20 nt, Artificial Sequence
  MKO10081926_B_Dnajc1
  gRNA
auccuuuaaaacuucauaaa

SEQ ID NO: 81927 - RNA, 20 nt, Artificial Sequence
  MKO10081927_B_Dnajc1
  gRNA
ugugguuugguccaucuacc

SEQ ID NO: 81928 - RNA, 20 nt, Artificial Sequence
  MKO10081928_B_Dnajc21
  gRNA
aaaugaacuggugcgccagc

SEQ ID NO: 81929 - RNA, 20 nt, Artificial Sequence
  MKO10081929_B_Dnajc21
  gRNA
uuacuuaaaggagggcucga

SEQ ID NO: 81930 - RNA, 20 nt, Artificial Sequence
  MKO10081930_B_Dnajc21
  gRNA
acuuaccacgcucuuuccug

SEQ ID NO: 81931 - RNA, 20 nt, Artificial Sequence
  MKO10081931_B_Dnajc22
  gRNA
cugggugccagacuuucacc

SEQ ID NO: 81932 - RNA, 20 nt, Artificial Sequence
  MKO10081932_B_Dnajc22
  gRNA
cuuuguaucgucgaugcuuc

SEQ ID NO: 81933 - RNA, 20 nt, Artificial Sequence
  MKO10081933_B_Dnajc22
  gRNA
agcugccaccauuaacuacg

SEQ ID NO: 81934 - RNA, 20 nt, Artificial Sequence
  MKO10081934_B_Dnajc24
  gRNA
aggcgcaccugugcaucuac

SEQ ID NO: 81935 - RNA, 20 nt, Artificial Sequence
  MKO10081935_B_Dnajc24
  gRNA
gaaguuuauugaaauugauc

SEQ ID NO: 81936 - RNA, 20 nt, Artificial Sequence
  MKO10081936_B_Dnajc24
  gRNA
ugcgccuugaagagaugucc

SEQ ID NO: 81937 - RNA, 20 nt, Artificial Sequence
  MKO10081937_B_Dnajc25
  gRNA
auagauccaccuacaauacc

SEQ ID NO: 81938 - RNA, 20 nt, Artificial Sequence
  MKO10081938_B_Dnajc25
  gRNA
agugcccaaguaccgcaucc

SEQ ID NO: 81939 - RNA, 20 nt, Artificial Sequence
  MKO10081939_B_Dnajc25
  gRNA
ccaggcgccugcuguaguag

SEQ ID NO: 81940 - RNA, 20 nt, Artificial Sequence
  MKO10081940_B_Dnajc27
  gRNA
gacuccauagucaaucccga

SEQ ID NO: 81941 - RNA, 20 nt, Artificial Sequence
  MKO10081941_B_Dnajc27
  gRNA
gugcugauguuucaaaguac

SEQ ID NO: 81942 - RNA, 20 nt, Artificial Sequence
  MKO10081942_B_Dnajc27
  gRNA
gagauuugugucuaaauacc

SEQ ID NO: 81943 - RNA, 20 nt, Artificial Sequence
  MKO10081943_B_Dnajc28
  gRNA
uuacugauccuuugaaugua

SEQ ID NO: 81944 - RNA, 20 nt, Artificial Sequence
  MKO10081944_B_Dnajc28
  gRNA
aacucaagccaucgagcgcc

SEQ ID NO: 81945 - RNA, 20 nt, Artificial Sequence
  MKO10081945_B_Dnajc28
  gRNA
cgacauuacuuaagcuucga

SEQ ID NO: 81946 - RNA, 20 nt, Artificial Sequence
  MKO10081946_B_Dnajc2
  gRNA
agcaaauaccuuccaaucuu

SEQ ID NO: 81947 - RNA, 20 nt, Artificial Sequence
  MKO10081947_B_Dnajc2
  gRNA
ucagaaucaagaucauuaug

SEQ ID NO: 81948 - RNA, 20 nt, Artificial Sequence
  MKO10081948_B_Dnajc2
  gRNA
guguagcuguguaucugacg

SEQ ID NO: 81949 - RNA, 20 nt, Artificial Sequence
  MKO10081949_B_Dnajc30
  gRNA
gcugcucuccguagugcgcc

SEQ ID NO: 81950 - RNA, 20 nt, Artificial Sequence
  MKO10081950_B_Dnajc30
  gRNA
gcgcgucuccgaagcuuacc

SEQ ID NO: 81951 - RNA, 20 nt, Artificial Sequence
  MKO10081951_B_Dnajc30
  gRNA
ggagacgcgcgugaagcgcu

SEQ ID NO: 81952 - RNA, 20 nt, Artificial Sequence
  MKO10081952_B_Dnajc3
  gRNA
auaacuauaucgcauacuau

SEQ ID NO: 81953 - RNA, 20 nt, Artificial Sequence
  MKO10081953_B_Dnajc3
  gRNA
gaggucgggcagcgcugcuu

SEQ ID NO: 81954 - RNA, 20 nt, Artificial Sequence
  MKO10081954_B_Dnajc3
  gRNA
ucacaguuucacgcugcagu

SEQ ID NO: 81955 - RNA, 20 nt, Artificial Sequence
  MKO10081955_B_Dnajc4
  gRNA
acguuuaaucucuucagcgc

SEQ ID NO: 81956 - RNA, 20 nt, Artificial Sequence
  MKO10081956_B_Dnajc4
  gRNA
auaucgagugcucagucgug

SEQ ID NO: 81957 - RNA, 20 nt, Artificial Sequence
  MKO10081957_B_Dnajc4
  gRNA
cuacacccugaucgagaccc

SEQ ID NO: 81958 - RNA, 20 nt, Artificial Sequence
  MKO10081958_B_Dnajc5b
  gRNA
acgcacccaaccaaagacag

SEQ ID NO: 81959 - RNA, 20 nt, Artificial Sequence
  MKO10081959_B_Dnajc5b
  gRNA
aaaacacagcuaaucagaga

SEQ ID NO: 81960 - RNA, 20 nt, Artificial Sequence
  MKO10081960_B_Dnajc5b
  gRNA
gucauauauguuucucuuug

SEQ ID NO: 81961 - RNA, 20 nt, Artificial Sequence
  MKO10081961_B_Dnajc5g
  gRNA
acccagcgacuaucuagaac

SEQ ID NO: 81962 - RNA, 20 nt, Artificial Sequence
  MKO10081962_B_Dnajc5g
  gRNA
uuauaccuguaugaccauuu

SEQ ID NO: 81963 - RNA, 20 nt, Artificial Sequence
  MKO10081963_B_Dnajc5g
  gRNA
uguuccucacuugaucuuga

SEQ ID NO: 81964 - RNA, 20 nt, Artificial Sequence
  MKO10081964_B_Dnajc5
  gRNA
cugaauuuaguugaacccgu

SEQ ID NO: 81965 - RNA, 20 nt, Artificial Sequence
  MKO10081965_B_Dnajc5
  gRNA
caccccagcuaucacaccga

SEQ ID NO: 81966 - RNA, 20 nt, Artificial Sequence
  MKO10081966_B_Dnajc5
  gRNA
gcucaccuuggcccaccagc

SEQ ID NO: 81967 - RNA, 20 nt, Artificial Sequence
  MKO10081967_B_Dnajc6
  gRNA
guacacaccugcuaacagac

SEQ ID NO: 81968 - RNA, 20 nt, Artificial Sequence
  MKO10081968_B_Dnajc6
  gRNA
gucuggaauccaaaaagcua

SEQ ID NO: 81969 - RNA, 20 nt, Artificial Sequence
  MKO10081969_B_Dnajc6
  gRNA
acaaguuguauacuguguag

SEQ ID NO: 81970 - RNA, 20 nt, Artificial Sequence
  MKO10081970_B_Dnajc7
  gRNA
ccuaacaaugccagcuauua

SEQ ID NO: 81971 - RNA, 20 nt, Artificial Sequence
  MKO10081971_B_Dnajc7
  gRNA
gaaugcauauuaugcuaaga

SEQ ID NO: 81972 - RNA, 20 nt, Artificial Sequence
  MKO10081972_B_Dnajc7
  gRNA
ccucucacuugggaaugcaa

SEQ ID NO: 81973 - RNA, 20 nt, Artificial Sequence
  MKO10081973_B_Dnajc8
  gRNA
ucaggcaggaaaagaauacg

SEQ ID NO: 81974 - RNA, 20 nt, Artificial Sequence
  MKO10081974_B_Dnajc8
  gRNA
ggaacaaaagaagagggccc

SEQ ID NO: 81975 - RNA, 20 nt, Artificial Sequence
  MKO10081975_B_Dnajc8
  gRNA
uggguucagauuaaaguaag

SEQ ID NO: 81976 - RNA, 20 nt, Artificial Sequence
  MKO10081976_B_Dnajc9
  gRNA
gaaagcaguguacgaugaac

SEQ ID NO: 81977 - RNA, 20 nt, Artificial Sequence
  MKO10081977_B_Dnajc9
  gRNA
uaacuugaaagcacucaucc

SEQ ID NO: 81978 - RNA, 20 nt, Artificial Sequence
  MKO10081978_B_Dnajc9
  gRNA
uucugucuaggcucaggaag

SEQ ID NO: 81979 - RNA, 20 nt, Artificial Sequence
  MKO10081979_B_Dnal1
  gRNA
gucacuuacuuaggccauuc

SEQ ID NO: 81980 - RNA, 20 nt, Artificial Sequence
  MKO10081980_B_Dnal1
  gRNA
ggcauacagcuugauuucuu

SEQ ID NO: 81981 - RNA, 20 nt, Artificial Sequence
  MKO10081981_B_Dnal1
  gRNA
uuucaaugcaguuuguagac

SEQ ID NO: 81982 - RNA, 20 nt, Artificial Sequence
  MKO10081982_B_Dnal4
  gRNA
cuagcacucggacaugccag

SEQ ID NO: 81983 - RNA, 20 nt, Artificial Sequence
  MKO10081983_B_Dnal4
  gRNA
ugcagaccuucccccugguc

SEQ ID NO: 81984 - RNA, 20 nt, Artificial Sequence
  MKO10081984_B_Dnal4
  gRNA
cucaggcuuacccugaccag

SEQ ID NO: 81985 - RNA, 20 nt, Artificial Sequence
  MKO10081985_B_Dnali1
  gRNA
ugaacagaaggcgaaaugcg

SEQ ID NO: 81986 - RNA, 20 nt, Artificial Sequence
  MKO10081986_B_Dnali1
  gRNA
ugucccagauccuaccaaac

SEQ ID NO: 81987 - RNA, 20 nt, Artificial Sequence
  MKO10081987_B_Dnali1
  gRNA
uacuagaggguccaggcugc

SEQ ID NO: 81988 - RNA, 20 nt, Artificial Sequence
  MKO10081988_B_Dnase1l1
  gRNA
cuaccucauucugccagcgc

SEQ ID NO: 81989 - RNA, 20 nt, Artificial Sequence
  MKO10081989_B_Dnase1l1
  gRNA
gaagcaccaugauaucacau

SEQ ID NO: 81990 - RNA, 20 nt, Artificial Sequence
  MKO10081990_B_Dnase1l1
  gRNA
ucccaggucugacaagacac

SEQ ID NO: 81991 - RNA, 20 nt, Artificial Sequence
  MKO10081991_B_Dnase1l2
  gRNA
ggucucguaccucuugcacc

SEQ ID NO: 81992 - RNA, 20 nt, Artificial Sequence
  MKO10081992_B_Dnase1l2
  gRNA
cacaaagccguacucgugcu

SEQ ID NO: 81993 - RNA, 20 nt, Artificial Sequence
  MKO10081993_B_Dnase1l2
  gRNA
cgucgaucucugccaccgcc

SEQ ID NO: 81994 - RNA, 20 nt, Artificial Sequence
  MKO10081994_B_Dnase1l3
  gRNA
ggucucgggaguugugugca

SEQ ID NO: 81995 - RNA, 20 nt, Artificial Sequence
  MKO10081995_B_Dnase1l3
  gRNA
auaccacuaccaugacuauc

SEQ ID NO: 81996 - RNA, 20 nt, Artificial Sequence
  MKO10081996_B_Dnase1l3
  gRNA
ugguuccauucccccuuuac

SEQ ID NO: 81997 - RNA, 20 nt, Artificial Sequence
  MKO10081997_B_Dnase1
  gRNA
gccugaccaggugucuauuc

SEQ ID NO: 81998 - RNA, 20 nt, Artificial Sequence
  MKO10081998_B_Dnase1
  gRNA
ggcuuuaccuguacacaaaa

SEQ ID NO: 81999 - RNA, 20 nt, Artificial Sequence
  MKO10081999_B_Dnase1
  gRNA
acgauguuuaccuagauguc

SEQ ID NO: 82000 - RNA, 20 nt, Artificial Sequence
  MKO10082000_B_Dnase2a
  gRNA
ccgaagguuugagcauuagg

SEQ ID NO: 82001 - RNA, 20 nt, Artificial Sequence
  MKO10082001_B_Dnase2a
  gRNA
uacauggaccagaacuccga

SEQ ID NO: 82002 - RNA, 20 nt, Artificial Sequence
  MKO10082002_B_Dnase2a
  gRNA
gguucuugaucaccgucucu

SEQ ID NO: 82003 - RNA, 20 nt, Artificial Sequence
  MKO10082003_B_Dnase2b
  gRNA
uuguccauaucgccuccccg

SEQ ID NO: 82004 - RNA, 20 nt, Artificial Sequence
  MKO10082004_B_Dnase2b
  gRNA
guuccuuaaagaucccuguc

SEQ ID NO: 82005 - RNA, 20 nt, Artificial Sequence
  MKO10082005_B_Dnase2b
  gRNA
guaugacacacauaauucca

SEQ ID NO: 82006 - RNA, 20 nt, Artificial Sequence
  MKO10082006_B_Dnd1
  gRNA
gucaacgggcaaaggaagua

SEQ ID NO: 82007 - RNA, 20 nt, Artificial Sequence
  MKO10082007_B_Dnd1
  gRNA
uccguugacacagcaguugc

SEQ ID NO: 82008 - RNA, 20 nt, Artificial Sequence
  MKO10082008_B_Dnd1
  gRNA
ucccccagcaauggugugag

SEQ ID NO: 82009 - RNA, 20 nt, Artificial Sequence
  MKO10082009_B_Dner
  gRNA
gcguuuaacacuugugguga

SEQ ID NO: 82010 - RNA, 20 nt, Artificial Sequence
  MKO10082010_B_Dner
  gRNA
caaccgugacacugccaacu

SEQ ID NO: 82011 - RNA, 20 nt, Artificial Sequence
  MKO10082011_B_Dner
  gRNA
cauaauccugccccgcucuc

SEQ ID NO: 82012 - RNA, 20 nt, Artificial Sequence
  MKO10082012_B_Dnlz
  gRNA
ggccaacuuugagaugcgcu

SEQ ID NO: 82013 - RNA, 20 nt, Artificial Sequence
  MKO10082013_B_Dnlz
  gRNA
gaggagguacgccgaguguc

SEQ ID NO: 82014 - RNA, 20 nt, Artificial Sequence
  MKO10082014_B_Dnlz
  gRNA
ucggcguaccuccucuccuc

SEQ ID NO: 82015 - RNA, 20 nt, Artificial Sequence
  MKO10082015_B_Dnm1l
  gRNA
ggcagggaccuucuucccag

SEQ ID NO: 82016 - RNA, 20 nt, Artificial Sequence
  MKO10082016_B_Dnm1l
  gRNA
auuucuucacaccaaaaaca

SEQ ID NO: 82017 - RNA, 20 nt, Artificial Sequence
  MKO10082017_B_Dnm1l
  gRNA
uaggaguugaagcagaagaa

SEQ ID NO: 82018 - RNA, 20 nt, Artificial Sequence
  MKO10082018_B_Dnm1
  gRNA
agaguuggccaaauccgagu

SEQ ID NO: 82019 - RNA, 20 nt, Artificial Sequence
  MKO10082019_B_Dnm1
  gRNA
gcugagaccgaucgagucac

SEQ ID NO: 82020 - RNA, 20 nt, Artificial Sequence
  MKO10082020_B_Dnm1
  gRNA
caacuuggugaugaccccaa

SEQ ID NO: 82021 - RNA, 20 nt, Artificial Sequence
  MKO10082021_B_Dnm2
  gRNA
gcaggaucauguccuugauc

SEQ ID NO: 82022 - RNA, 20 nt, Artificial Sequence
  MKO10082022_B_Dnm2
  gRNA
agacaucgaguaccagauca

SEQ ID NO: 82023 - RNA, 20 nt, Artificial Sequence
  MKO10082023_B_Dnm2
  gRNA
gugacaauuccugauccucg

SEQ ID NO: 82024 - RNA, 20 nt, Artificial Sequence
  MKO10082024_B_Dnm3
  gRNA
aguguauuaccccugcgaag

SEQ ID NO: 82025 - RNA, 20 nt, Artificial Sequence
  MKO10082025_B_Dnm3
  gRNA
cuuuauucauuccuguuacg

SEQ ID NO: 82026 - RNA, 20 nt, Artificial Sequence
  MKO10082026_B_Dnm3
  gRNA
cuggaguacaagaggccguc

SEQ ID NO: 82027 - RNA, 20 nt, Artificial Sequence
  MKO10082027_B_Dnmbp
  gRNA
gcuuugcuuaccccgaugga

SEQ ID NO: 82028 - RNA, 20 nt, Artificial Sequence
  MKO10082028_B_Dnmbp
  gRNA
caaaagcuccgccaccaccu

SEQ ID NO: 82029 - RNA, 20 nt, Artificial Sequence
  MKO10082029_B_Dnmbp
  gRNA
uuggaaaucagcgaugcugu

SEQ ID NO: 82030 - RNA, 20 nt, Artificial Sequence
  MKO10082030_B_Dnmt1
  gRNA
caaauagauccccaagaucc

SEQ ID NO: 82031 - RNA, 20 nt, Artificial Sequence
  MKO10082031_B_Dnmt1
  gRNA
ugugugacagccccacuaaa

SEQ ID NO: 82032 - RNA, 20 nt, Artificial Sequence
  MKO10082032_B_Dnmt1
  gRNA
cgaggcuugggccuggaucu

SEQ ID NO: 82033 - RNA, 20 nt, Artificial Sequence
  MKO10082033_B_Dnmt3a
  gRNA
uagguggccagcagccgugc

SEQ ID NO: 82034 - RNA, 20 nt, Artificial Sequence
  MKO10082034_B_Dnmt3a
  gRNA
caccuggaggacuucguaga

SEQ ID NO: 82035 - RNA, 20 nt, Artificial Sequence
  MKO10082035_B_Dnmt3a
  gRNA
cuggaaacagcuucccggca

SEQ ID NO: 82036 - RNA, 20 nt, Artificial Sequence
  MKO10082036_B_Dnmt3b
  gRNA
aaugcacuccucauacccgc

SEQ ID NO: 82037 - RNA, 20 nt, Artificial Sequence
  MKO10082037_B_Dnmt3b
  gRNA
guccgaacccgacauagcaa

SEQ ID NO: 82038 - RNA, 20 nt, Artificial Sequence
  MKO10082038_B_Dnmt3b
  gRNA
caggacgcgcucugaaagcc

SEQ ID NO: 82039 - RNA, 20 nt, Artificial Sequence
  MKO10082039_B_Dnmt3l
  gRNA
acucaccuucaaugcuccgu

SEQ ID NO: 82040 - RNA, 20 nt, Artificial Sequence
  MKO10082040_B_Dnmt3l
  gRNA
cacucggcaccccuuguuug

SEQ ID NO: 82041 - RNA, 20 nt, Artificial Sequence
  MKO10082041_B_Dnmt3l
  gRNA
ucccccuccucgccuccgac

SEQ ID NO: 82042 - RNA, 20 nt, Artificial Sequence
  MKO10082042_B_Dnpep
  gRNA
uguccgugugggccccaaug

SEQ ID NO: 82043 - RNA, 20 nt, Artificial Sequence
  MKO10082043_B_Dnpep
  gRNA
cauugauauuucgcugcaga

SEQ ID NO: 82044 - RNA, 20 nt, Artificial Sequence
  MKO10082044_B_Dnpep
  gRNA
cagccucauuggggcccaca

SEQ ID NO: 82045 - RNA, 20 nt, Artificial Sequence
  MKO10082045_B_Dnph1
  gRNA
ucgagccaucggcugcuccc

SEQ ID NO: 82046 - RNA, 20 nt, Artificial Sequence
  MKO10082046_B_Dnph1
  gRNA
gauaagccucaaaguaccga

SEQ ID NO: 82047 - RNA, 20 nt, Artificial Sequence
  MKO10082047_B_Dnph1
  gRNA
guguuggcuacgaauugggc

SEQ ID NO: 82048 - RNA, 20 nt, Artificial Sequence
  MKO10082048_B_Dnuuip1
  gRNA
gcacauucagcgcugccuuc

SEQ ID NO: 82049 - RNA, 20 nt, Artificial Sequence
  MKO10082049_B_Dnuuip1
  gRNA
ugucuucaacaaguacauga

SEQ ID NO: 82050 - RNA, 20 nt, Artificial Sequence
  MKO10082050_B_Dnuuip1
  gRNA
uguacuuguugaagacaccc

SEQ ID NO: 82051 - RNA, 20 nt, Artificial Sequence
  MKO10082051_B_Dnuuip2
  gRNA
cugcuucugaagucgaugcu

SEQ ID NO: 82052 - RNA, 20 nt, Artificial Sequence
  MKO10082052_B_Dnuuip2
  gRNA
caugccaaaccaaccauuac

SEQ ID NO: 82053 - RNA, 20 nt, Artificial Sequence
  MKO10082053_B_Dnuuip2
  gRNA
acaaguagcagcauagaccc

SEQ ID NO: 82054 - RNA, 20 nt, Artificial Sequence
  MKO10082054_B_Dnuu
  gRNA
ugauucggucacccacauug

SEQ ID NO: 82055 - RNA, 20 nt, Artificial Sequence
  MKO10082055_B_Dnuu
  gRNA
aacucgaagagccuuccuca

SEQ ID NO: 82056 - RNA, 20 nt, Artificial Sequence
  MKO10082056_B_Dnuu
  gRNA
uguuuaaugugguucuucgc

SEQ ID NO: 82057 - RNA, 20 nt, Artificial Sequence
  MKO10082057_B_Doc2a
  gRNA
ugcugcacuguagaauccuc

SEQ ID NO: 82058 - RNA, 20 nt, Artificial Sequence
  MKO10082058_B_Doc2a
  gRNA
uaacaucugccuugagcgcc

SEQ ID NO: 82059 - RNA, 20 nt, Artificial Sequence
  MKO10082059_B_Doc2a
  gRNA
caggaggugaagcuuuacau

SEQ ID NO: 82060 - RNA, 20 nt, Artificial Sequence
  MKO10082060_B_Doc2b
  gRNA
agugcagugcguuguucucc

SEQ ID NO: 82061 - RNA, 20 nt, Artificial Sequence
  MKO10082061_B_Doc2b
  gRNA
acaugguccgaaagacccug

SEQ ID NO: 82062 - RNA, 20 nt, Artificial Sequence
  MKO10082062_B_Doc2b
  gRNA
uacucagggccugaagccga

SEQ ID NO: 82063 - RNA, 20 nt, Artificial Sequence
  MKO10082063_B_Doc2g
  gRNA
cacgcacuguucgaggcacc

SEQ ID NO: 82064 - RNA, 20 nt, Artificial Sequence
  MKO10082064_B_Doc2g
  gRNA
gggagcuacgagugccccug

SEQ ID NO: 82065 - RNA, 20 nt, Artificial Sequence
  MKO10082065_B_Doc2g
  gRNA
gucaaagccaacuuacuacc

SEQ ID NO: 82066 - RNA, 20 nt, Artificial Sequence
  MKO10082066_B_Dock10
  gRNA
acuuacugagaagucaucac

SEQ ID NO: 82067 - RNA, 20 nt, Artificial Sequence
  MKO10082067_B_Dock10
  gRNA
guaaauucuacaguucccag

SEQ ID NO: 82068 - RNA, 20 nt, Artificial Sequence
  MKO10082068_B_Dock10
  gRNA
aagaacuugaaaagaccuau

SEQ ID NO: 82069 - RNA, 20 nt, Artificial Sequence
  MKO10082069_B_Dock11
  gRNA
uuaagaccuacagcacagau

SEQ ID NO: 82070 - RNA, 20 nt, Artificial Sequence
  MKO10082070_B_Dock11
  gRNA
ugaagauugcgagaaagaug

SEQ ID NO: 82071 - RNA, 20 nt, Artificial Sequence
  MKO10082071_B_Dock11
  gRNA
ucaaucucaaacacaugauu

SEQ ID NO: 82072 - RNA, 20 nt, Artificial Sequence
  MKO10082072_B_Dock1
  gRNA
ccuggcaucguaguuguaaa

SEQ ID NO: 82073 - RNA, 20 nt, Artificial Sequence
  MKO10082073_B_Dock1
  gRNA
cuuaaagaagccauuguuga

SEQ ID NO: 82074 - RNA, 20 nt, Artificial Sequence
  MKO10082074_B_Dock1
  gRNA
uuaagaugaauauaugaagc

SEQ ID NO: 82075 - RNA, 20 nt, Artificial Sequence
  MKO10082075_B_Dock2
  gRNA
uacauccuuuauccaucuca

SEQ ID NO: 82076 - RNA, 20 nt, Artificial Sequence
  MKO10082076_B_Dock2
  gRNA
cucuuugcagacugguacag

SEQ ID NO: 82077 - RNA, 20 nt, Artificial Sequence
  MKO10082077_B_Dock2
  gRNA
guacgaauacaggagaccug

SEQ ID NO: 82078 - RNA, 20 nt, Artificial Sequence
  MKO10082078_B_Dock3
  gRNA
caaggccuggucuuagaaau

SEQ ID NO: 82079 - RNA, 20 nt, Artificial Sequence
  MKO10082079_B_Dock3
  gRNA
guuuccauuaccuuuacauu

SEQ ID NO: 82080 - RNA, 20 nt, Artificial Sequence
  MKO10082080_B_Dock3
  gRNA
aacaaagaagccuaauguaa

SEQ ID NO: 82081 - RNA, 20 nt, Artificial Sequence
  MKO10082081_B_Dock4
  gRNA
uucuccgcaggcugguacag

SEQ ID NO: 82082 - RNA, 20 nt, Artificial Sequence
  MKO10082082_B_Dock4
  gRNA
ccuuaaaguugaugucaucu

SEQ ID NO: 82083 - RNA, 20 nt, Artificial Sequence
  MKO10082083_B_Dock4
  gRNA
uuacccuuuguucuuuacac

SEQ ID NO: 82084 - RNA, 20 nt, Artificial Sequence
  MKO10082084_B_Dock5
  gRNA
cggcgacaccguccacaucc

SEQ ID NO: 82085 - RNA, 20 nt, Artificial Sequence
  MKO10082085_B_Dock5
  gRNA
gcuccagaacagaucuaaaa

SEQ ID NO: 82086 - RNA, 20 nt, Artificial Sequence
  MKO10082086_B_Dock5
  gRNA
ccccccacaggcugguacag

SEQ ID NO: 82087 - RNA, 20 nt, Artificial Sequence
  MKO10082087_B_Dock6
  gRNA
gaagcacaucuucgaagucc

SEQ ID NO: 82088 - RNA, 20 nt, Artificial Sequence
  MKO10082088_B_Dock6
  gRNA
caggugucccgggaacgcag

SEQ ID NO: 82089 - RNA, 20 nt, Artificial Sequence
  MKO10082089_B_Dock6
  gRNA
auccugcucgaagacuuggc

SEQ ID NO: 82090 - RNA, 20 nt, Artificial Sequence
  MKO10082090_B_Dock7
  gRNA
gggggaaccacuguauuguc

SEQ ID NO: 82091 - RNA, 20 nt, Artificial Sequence
  MKO10082091_B_Dock7
  gRNA
uaaauccuguucccaguuua

SEQ ID NO: 82092 - RNA, 20 nt, Artificial Sequence
  MKO10082092_B_Dock7
  gRNA
cuuauacaaucucuaacaug

SEQ ID NO: 82093 - RNA, 20 nt, Artificial Sequence
  MKO10082093_B_Dock8
  gRNA
ggccacaugcaggucgucau

SEQ ID NO: 82094 - RNA, 20 nt, Artificial Sequence
  MKO10082094_B_Dock8
  gRNA
uuuacgcucccacccaaccu

SEQ ID NO: 82095 - RNA, 20 nt, Artificial Sequence
  MKO10082095_B_Dock8
  gRNA
aaucagccacucucgaauau

SEQ ID NO: 82096 - RNA, 20 nt, Artificial Sequence
  MKO10082096_B_Dock9
  gRNA
ucucccgcaggcagucguuu

SEQ ID NO: 82097 - RNA, 20 nt, Artificial Sequence
  MKO10082097_B_Dock9
  gRNA
ccucaucgacuucauagacg

SEQ ID NO: 82098 - RNA, 20 nt, Artificial Sequence
  MKO10082098_B_Dock9
  gRNA
agauccuaaacgacugccug

SEQ ID NO: 82099 - RNA, 20 nt, Artificial Sequence
  MKO10082099_B_Dohh
  gRNA
ugcgcacucgugccgcacca

SEQ ID NO: 82100 - RNA, 20 nt, Artificial Sequence
  MKO10082100_B_Dohh
  gRNA
uggcccgugcgucccucauc

SEQ ID NO: 82101 - RNA, 20 nt, Artificial Sequence
  MKO10082101_B_Dohh
  gRNA
cucagugguccgcgccaaug

SEQ ID NO: 82102 - RNA, 20 nt, Artificial Sequence
  MKO10082102_B_Dok1
  gRNA
uacacucuguugcgucgcua

SEQ ID NO: 82103 - RNA, 20 nt, Artificial Sequence
  MKO10082103_B_Dok1
  gRNA
gcagcggcgaccagcuucaa

SEQ ID NO: 82104 - RNA, 20 nt, Artificial Sequence
  MKO10082104_B_Dok1
  gRNA
auagcgacgcaacagagugu

SEQ ID NO: 82105 - RNA, 20 nt, Artificial Sequence
  MKO10082105_B_Dok2
  gRNA
guccccgagaagacacggcg

SEQ ID NO: 82106 - RNA, 20 nt, Artificial Sequence
  MKO10082106_B_Dok2
  gRNA
aaagcgucgaagaaaccugu

SEQ ID NO: 82107 - RNA, 20 nt, Artificial Sequence
  MKO10082107_B_Dok2
  gRNA
uuugaguucgaaacacgaca

SEQ ID NO: 82108 - RNA, 20 nt, Artificial Sequence
  MKO10082108_B_Dok3
  gRNA
gguaccggagaauguucguc

SEQ ID NO: 82109 - RNA, 20 nt, Artificial Sequence
  MKO10082109_B_Dok3
  gRNA
gaguacagugaccgaguuuc

SEQ ID NO: 82110 - RNA, 20 nt, Artificial Sequence
  MKO10082110_B_Dok3
  gRNA
ggaacgccgggucauacgcu

SEQ ID NO: 82111 - RNA, 20 nt, Artificial Sequence
  MKO10082111_B_Dok4
  gRNA
gagaaguccgugugccuccg

SEQ ID NO: 82112 - RNA, 20 nt, Artificial Sequence
  MKO10082112_B_Dok4
  gRNA
gacacuguccguggaauguc

SEQ ID NO: 82113 - RNA, 20 nt, Artificial Sequence
  MKO10082113_B_Dok4
  gRNA
ggagucgucugugaauauga

SEQ ID NO: 82114 - RNA, 20 nt, Artificial Sequence
  MKO10082114_B_Dok5
  gRNA
gugguaacaccugaaguacg

SEQ ID NO: 82115 - RNA, 20 nt, Artificial Sequence
  MKO10082115_B_Dok5
  gRNA
gagccugauuuauuggcuac

SEQ ID NO: 82116 - RNA, 20 nt, Artificial Sequence
  MKO10082116_B_Dok5
  gRNA
gcucugcucgcguuccaccc

SEQ ID NO: 82117 - RNA, 20 nt, Artificial Sequence
  MKO10082117_B_Dok6
  gRNA
gcugcaccccagcugccagu

SEQ ID NO: 82118 - RNA, 20 nt, Artificial Sequence
  MKO10082118_B_Dok6
  gRNA
uucagauauucagacgaugc

SEQ ID NO: 82119 - RNA, 20 nt, Artificial Sequence
  MKO10082119_B_Dok6
  gRNA
gcaugcuucuuugucucucg

SEQ ID NO: 82120 - RNA, 20 nt, Artificial Sequence
  MKO10082120_B_Dok7
  gRNA
uccccgaccaaaggcccguu

SEQ ID NO: 82121 - RNA, 20 nt, Artificial Sequence
  MKO10082121_B_Dok7
  gRNA
cacaccucgaagccugcgcc

SEQ ID NO: 82122 - RNA, 20 nt, Artificial Sequence
  MKO10082122_B_Dok7
  gRNA
cguuacggggcuguuccgaa

SEQ ID NO: 82123 - RNA, 20 nt, Artificial Sequence
  MKO10082123_B_Dolk
  gRNA
caguguaggcgaggugaucg

SEQ ID NO: 82124 - RNA, 20 nt, Artificial Sequence
  MKO10082124_B_Dolk
  gRNA
ccgauacuccuggugcgcgg

SEQ ID NO: 82125 - RNA, 20 nt, Artificial Sequence
  MKO10082125_B_Dolk
  gRNA
aagacgaccgcuuagcauuc

SEQ ID NO: 82126 - RNA, 20 nt, Artificial Sequence
  MKO10082126_B_Dolpp1
  gRNA
gauucagugccaguccccca

SEQ ID NO: 82127 - RNA, 20 nt, Artificial Sequence
  MKO10082127_B_Dolpp1
  gRNA
uaggcucucaccuuaaauac

SEQ ID NO: 82128 - RNA, 20 nt, Artificial Sequence
  MKO10082128_B_Dolpp1
  gRNA
ccuuucucgucuccuauagc

SEQ ID NO: 82129 - RNA, 20 nt, Artificial Sequence
  MKO10082129_B_Donson
  gRNA
gacuuuaccccagaguauac

SEQ ID NO: 82130 - RNA, 20 nt, Artificial Sequence
  MKO10082130_B_Donson
  gRNA
agcaugcuuuaaugagcgac

SEQ ID NO: 82131 - RNA, 20 nt, Artificial Sequence
  MKO10082131_B_Donson
  gRNA
aucaguucaccguccuguuc

SEQ ID NO: 82132 - RNA, 20 nt, Artificial Sequence
  MKO10082132_B_Dopey1
  gRNA
acuuguacagagaagcacgc

SEQ ID NO: 82133 - RNA, 20 nt, Artificial Sequence
  MKO10082133_B_Dopey1
  gRNA
uccgacccuucuucuaagcc

SEQ ID NO: 82134 - RNA, 20 nt, Artificial Sequence
  MKO10082134_B_Dopey1
  gRNA
ugucugcacccagcauuacc

SEQ ID NO: 82135 - RNA, 20 nt, Artificial Sequence
  MKO10082135_B_Dopey2
  gRNA
uugcugaugaugagccgccg

SEQ ID NO: 82136 - RNA, 20 nt, Artificial Sequence
  MKO10082136_B_Dopey2
  gRNA
gggaauacuucagguugcuc

SEQ ID NO: 82137 - RNA, 20 nt, Artificial Sequence
  MKO10082137_B_Dopey2
  gRNA
cucaccaggcagguauaaaa

SEQ ID NO: 82138 - RNA, 20 nt, Artificial Sequence
  MKO10082138_B_Dos
  gRNA
gaagaccaccacuacuuauc

SEQ ID NO: 82139 - RNA, 20 nt, Artificial Sequence
  MKO10082139_B_Dos
  gRNA
uccucacagaccccgacugc

SEQ ID NO: 82140 - RNA, 20 nt, Artificial Sequence
  MKO10082140_B_Dos
  gRNA
uacuauccaugagugugauu

SEQ ID NO: 82141 - RNA, 20 nt, Artificial Sequence
  MKO10082141_B_Dot1l
  gRNA
augagauuauugagacuauc

SEQ ID NO: 82142 - RNA, 20 nt, Artificial Sequence
  MKO10082142_B_Dot1l
  gRNA
ccauuucaggugggucugcg

SEQ ID NO: 82143 - RNA, 20 nt, Artificial Sequence
  MKO10082143_B_Dot1l
  gRNA
caucgacagcauccaccagc

SEQ ID NO: 82144 - RNA, 20 nt, Artificial Sequence
  MKO10082144_B_Doxl2
  gRNA
cuccagcagcccaagacgcc

SEQ ID NO: 82145 - RNA, 20 nt, Artificial Sequence
  MKO10082145_B_Doxl2
  gRNA
ucuuuaagcgauagcugcgc

SEQ ID NO: 82146 - RNA, 20 nt, Artificial Sequence
  MKO10082146_B_Doxl2
  gRNA
gugauucugguuguagaugc

SEQ ID NO: 82147 - RNA, 20 nt, Artificial Sequence
  MKO10082147_B_Dpagu1
  gRNA
cuuuggcaauacaaccaucg

SEQ ID NO: 82148 - RNA, 20 nt, Artificial Sequence
  MKO10082148_B_Dpagu1
  gRNA
ccccuuccugaacugcuucg

SEQ ID NO: 82149 - RNA, 20 nt, Artificial Sequence
  MKO10082149_B_Dpagu1
  gRNA
cagcaccgcugaucacuccc

SEQ ID NO: 82150 - RNA, 20 nt, Artificial Sequence
  MKO10082150_B_Dpcd
  gRNA
guggcgugugaaaaaugccc

SEQ ID NO: 82151 - RNA, 20 nt, Artificial Sequence
  MKO10082151_B_Dpcd
  gRNA
agcuggugucugucuagguc

SEQ ID NO: 82152 - RNA, 20 nt, Artificial Sequence
  MKO10082152_B_Dpcd
  gRNA
ucugccauuuccuucccguc

SEQ ID NO: 82153 - RNA, 20 nt, Artificial Sequence
  MKO10082153_B_Dpcr1
  gRNA
gacauggcucagccgaccag

SEQ ID NO: 82154 - RNA, 20 nt, Artificial Sequence
  MKO10082154_B_Dpcr1
  gRNA
uugcggcucccuuugucuuc

SEQ ID NO: 82155 - RNA, 20 nt, Artificial Sequence
  MKO10082155_B_Dpcr1
  gRNA
cuaccugccucccaagaagc

SEQ ID NO: 82156 - RNA, 20 nt, Artificial Sequence
  MKO10082156_B_Dpep1
  gRNA
auguguguuaccaauaguuc

SEQ ID NO: 82157 - RNA, 20 nt, Artificial Sequence
  MKO10082157_B_Dpep1
  gRNA
ugggacacuaccugaacuau

SEQ ID NO: 82158 - RNA, 20 nt, Artificial Sequence
  MKO10082158_B_Dpep1
  gRNA
ucaggcacaacgacuugccu

SEQ ID NO: 82159 - RNA, 20 nt, Artificial Sequence
  MKO10082159_B_Dpep2
  gRNA
gcuucgaaguuucuaccugc

SEQ ID NO: 82160 - RNA, 20 nt, Artificial Sequence
  MKO10082160_B_Dpep2
  gRNA
agaaacuucgaagcacagcg

SEQ ID NO: 82161 - RNA, 20 nt, Artificial Sequence
  MKO10082161_B_Dpep2
  gRNA
ucccgguccugcgucuggca

SEQ ID NO: 82162 - RNA, 20 nt, Artificial Sequence
  MKO10082162_B_Dpep3
  gRNA
ggaugccguacgccuagccc

SEQ ID NO: 82163 - RNA, 20 nt, Artificial Sequence
  MKO10082163_B_Dpep3
  gRNA
agaaacugcgcaacacagcg

SEQ ID NO: 82164 - RNA, 20 nt, Artificial Sequence
  MKO10082164_B_Dpep3
  gRNA
gaccacccucuacaccaaug

SEQ ID NO: 82165 - RNA, 20 nt, Artificial Sequence
  MKO10082165_B_Dpf1
  gRNA
gccuuggcgaggacuucuac

SEQ ID NO: 82166 - RNA, 20 nt, Artificial Sequence
  MKO10082166_B_Dpf1
  gRNA
cccggaagggccaguccucg

SEQ ID NO: 82167 - RNA, 20 nt, Artificial Sequence
  MKO10082167_B_Dpf1
  gRNA
ucuucuaccucgagaucaug

SEQ ID NO: 82168 - RNA, 20 nt, Artificial Sequence
  MKO10082168_B_Dpf2
  gRNA
cuuuguaguauugcucgcca

SEQ ID NO: 82169 - RNA, 20 nt, Artificial Sequence
  MKO10082169_B_Dpf2
  gRNA
gaaaagcgacaccggggacc

SEQ ID NO: 82170 - RNA, 20 nt, Artificial Sequence
  MKO10082170_B_Dpf2
  gRNA
uuccccuucccccgacgcuu

SEQ ID NO: 82171 - RNA, 20 nt, Artificial Sequence
  MKO10082171_B_Dpf3
  gRNA
gagcgugcgucuccccuucc

SEQ ID NO: 82172 - RNA, 20 nt, Artificial Sequence
  MKO10082172_B_Dpf3
  gRNA
gucuuacuuacgcuuucagg

SEQ ID NO: 82173 - RNA, 20 nt, Artificial Sequence
  MKO10082173_B_Dpf3
  gRNA
ucuguccgcaggccucgcuc

SEQ ID NO: 82174 - RNA, 20 nt, Artificial Sequence
  MKO10082174_B_Dph1
  gRNA
ccugaacaacccccaguuac

SEQ ID NO: 82175 - RNA, 20 nt, Artificial Sequence
  MKO10082175_B_Dph1
  gRNA
guugacuuccuggugcacua

SEQ ID NO: 82176 - RNA, 20 nt, Artificial Sequence
  MKO10082176_B_Dph1
  gRNA
ggguuguucaggaccucagg

SEQ ID NO: 82177 - RNA, 20 nt, Artificial Sequence
  MKO10082177_B_Dph2
  gRNA
cuuaauuccgaggccccaac

SEQ ID NO: 82178 - RNA, 20 nt, Artificial Sequence
  MKO10082178_B_Dph2
  gRNA
ggcucacucagcaguaccac

SEQ ID NO: 82179 - RNA, 20 nt, Artificial Sequence
  MKO10082179_B_Dph2
  gRNA
cgaggcuggggggcuuaagc

SEQ ID NO: 82180 - RNA, 20 nt, Artificial Sequence
  MKO10082180_B_Dph3
  gRNA
gcauuuaacuaacuccuugu

SEQ ID NO: 82181 - RNA, 20 nt, Artificial Sequence
  MKO10082181_B_Dph3
  gRNA
uuuauaaugagugagcagcu

SEQ ID NO: 82182 - RNA, 20 nt, Artificial Sequence
  MKO10082182_B_Dph3
  gRNA
uuguaggaagauuuggaaaa

SEQ ID NO: 82183 - RNA, 20 nt, Artificial Sequence
  MKO10082183_B_Dph5
  gRNA
augcacacgcugugcuuacu

SEQ ID NO: 82184 - RNA, 20 nt, Artificial Sequence
  MKO10082184_B_Dph5
  gRNA
agucucuggagaaccucauc

SEQ ID NO: 82185 - RNA, 20 nt, Artificial Sequence
  MKO10082185_B_Dph5
  gRNA
cccugcagauaucaaaguga

SEQ ID NO: 82186 - RNA, 20 nt, Artificial Sequence
  MKO10082186_B_Dph6
  gRNA
gaugauagcuucuaauauca

SEQ ID NO: 82187 - RNA, 20 nt, Artificial Sequence
  MKO10082187_B_Dph6
  gRNA
cuuugccaaagauaagcuaa

SEQ ID NO: 82188 - RNA, 20 nt, Artificial Sequence
  MKO10082188_B_Dph6
  gRNA
cuaagaccagaugaaaacca

SEQ ID NO: 82189 - RNA, 20 nt, Artificial Sequence
  MKO10082189_B_Dph7
  gRNA
cauagggcugcuccgccuga

SEQ ID NO: 82190 - RNA, 20 nt, Artificial Sequence
  MKO10082190_B_Dph7
  gRNA
gccaauauccagccucgccc

SEQ ID NO: 82191 - RNA, 20 nt, Artificial Sequence
  MKO10082191_B_Dph7
  gRNA
cgaggcuggauauuggcugc

SEQ ID NO: 82192 - RNA, 20 nt, Artificial Sequence
  MKO10082192_B_Dpm1
  gRNA
cugugacuuacaauucuguc

SEQ ID NO: 82193 - RNA, 20 nt, Artificial Sequence
  MKO10082193_B_Dpm1
  gRNA
ggggaacuaugugaucauca

SEQ ID NO: 82194 - RNA, 20 nt, Artificial Sequence
  MKO10082194_B_Dpm1
  gRNA
aagaccacgagagaaaaagc

SEQ ID NO: 82195 - RNA, 20 nt, Artificial Sequence
  MKO10082195_B_Dpm2
  gRNA
accgggacagaccaagcagu

SEQ ID NO: 82196 - RNA, 20 nt, Artificial Sequence
  MKO10082196_B_Dpm2
  gRNA
cuggcucuucagcaucacau

SEQ ID NO: 82197 - RNA, 20 nt, Artificial Sequence
  MKO10082197_B_Dpm2
  gRNA
gagccagaagauaaccaaga

SEQ ID NO: 82198 - RNA, 20 nt, Artificial Sequence
  MKO10082198_B_Dpm3
  gRNA
cccugcgugcuaaaucagcu

SEQ ID NO: 82199 - RNA, 20 nt, Artificial Sequence
  MKO10082199_B_Dpm3
  gRNA
guugccuuuccccugccgag

SEQ ID NO: 82200 - RNA, 20 nt, Artificial Sequence
  MKO10082200_B_Dpm3
  gRNA
cuccgcuggcugcuaugccc

SEQ ID NO: 82201 - RNA, 20 nt, Artificial Sequence
  MKO10082201_B_Dpp10
  gRNA
caccuaccauugauccaccg

SEQ ID NO: 82202 - RNA, 20 nt, Artificial Sequence
  MKO10082202_B_Dpp10
  gRNA
ugaguuguccaauaacaaug

SEQ ID NO: 82203 - RNA, 20 nt, Artificial Sequence
  MKO10082203_B_Dpp10
  gRNA
agaaacaagacugucacuag

SEQ ID NO: 82204 - RNA, 20 nt, Artificial Sequence
  MKO10082204_B_Dpp3
  gRNA
gucccacuaugaggugcggc

SEQ ID NO: 82205 - RNA, 20 nt, Artificial Sequence
  MKO10082205_B_Dpp3
  gRNA
augggcaacuacaaguccuu

SEQ ID NO: 82206 - RNA, 20 nt, Artificial Sequence
  MKO10082206_B_Dpp3
  gRNA
ggagaacauaagguccccac

SEQ ID NO: 82207 - RNA, 20 nt, Artificial Sequence
  MKO10082207_B_Dpp4
  gRNA
ucaaguccuacucuuugugg

SEQ ID NO: 82208 - RNA, 20 nt, Artificial Sequence
  MKO10082208_B_Dpp4
  gRNA
ccaauaguucugcugagcaa

SEQ ID NO: 82209 - RNA, 20 nt, Artificial Sequence
  MKO10082209_B_Dpp4
  gRNA
uugcugcucaaugcugaaca

SEQ ID NO: 82210 - RNA, 20 nt, Artificial Sequence
  MKO10082210_B_Dpp6
  gRNA
cugcuuauccacuuugccuc

SEQ ID NO: 82211 - RNA, 20 nt, Artificial Sequence
  MKO10082211_B_Dpp6
  gRNA
cuucaaaauccaugacccag

SEQ ID NO: 82212 - RNA, 20 nt, Artificial Sequence
  MKO10082212_B_Dpp6
  gRNA
ugugcuguucuccuauaaug

SEQ ID NO: 82213 - RNA, 20 nt, Artificial Sequence
  MKO10082213_B_Dpp7
  gRNA
ugguccuucgcuaacaacuc

SEQ ID NO: 82214 - RNA, 20 nt, Artificial Sequence
  MKO10082214_B_Dpp7
  gRNA
ggccagcgguuccuaguguc

SEQ ID NO: 82215 - RNA, 20 nt, Artificial Sequence
  MKO10082215_B_Dpp7
  gRNA
aacagcuacaacaggagcgc

SEQ ID NO: 82216 - RNA, 20 nt, Artificial Sequence
  MKO10082216_B_Dpp8
  gRNA
uccuaggcgacacuagacua

SEQ ID NO: 82217 - RNA, 20 nt, Artificial Sequence
  MKO10082217_B_Dpp8
  gRNA
uaugcccugcugauccagac

SEQ ID NO: 82218 - RNA, 20 nt, Artificial Sequence
  MKO10082218_B_Dpp8
  gRNA
uaagacugcugcucuguuga

SEQ ID NO: 82219 - RNA, 20 nt, Artificial Sequence
  MKO10082219_B_Dpp9
  gRNA
cgcaagcgccugggcgucuu

SEQ ID NO: 82220 - RNA, 20 nt, Artificial Sequence
  MKO10082220_B_Dpp9
  gRNA
ggcaaacaucgagacugggg

SEQ ID NO: 82221 - RNA, 20 nt, Artificial Sequence
  MKO10082221_B_Dpp9
  gRNA
gcaauagccuguuccacugc

SEQ ID NO: 82222 - RNA, 20 nt, Artificial Sequence
  MKO10082222_B_Dppa1
  gRNA
cucccugaagaucuccacua

SEQ ID NO: 82223 - RNA, 20 nt, Artificial Sequence
  MKO10082223_B_Dppa1
  gRNA
cuuacagugugauuauucca

SEQ ID NO: 82224 - RNA, 20 nt, Artificial Sequence
  MKO10082224_B_Dppa1
  gRNA
gucaugugaaaaugucacag

SEQ ID NO: 82225 - RNA, 20 nt, Artificial Sequence
  MKO10082225_B_Dppa2
  gRNA
gaggucuuaccaguggcuug

SEQ ID NO: 82226 - RNA, 20 nt, Artificial Sequence
  MKO10082226_B_Dppa2
  gRNA
uacacauucuuguuuagaau

SEQ ID NO: 82227 - RNA, 20 nt, Artificial Sequence
  MKO10082227_B_Dppa2
  gRNA
aguauauucccaauacaucu

SEQ ID NO: 82228 - RNA, 20 nt, Artificial Sequence
  MKO10082228_B_Dppa3
  gRNA
uccucuucaucuuucuucug

SEQ ID NO: 82229 - RNA, 20 nt, Artificial Sequence
  MKO10082229_B_Dppa3
  gRNA
agagaaagucgacccaauga

SEQ ID NO: 82230 - RNA, 20 nt, Artificial Sequence
  MKO10082230_B_Dppa3
  gRNA
cuuucugccauuaucaaaga

SEQ ID NO: 82231 - RNA, 20 nt, Artificial Sequence
  MKO10082231_B_Dppa4
  gRNA
accuuccuacgagucugucc

SEQ ID NO: 82232 - RNA, 20 nt, Artificial Sequence
  MKO10082232_B_Dppa4
  gRNA
guggagcgcagaagagccga

SEQ ID NO: 82233 - RNA, 20 nt, Artificial Sequence
  MKO10082233_B_Dppa4
  gRNA
auucucaagauggagacugc

SEQ ID NO: 82234 - RNA, 20 nt, Artificial Sequence
  MKO10082234_B_Dppa5a
  gRNA
cauguuugagcugaagaacc

SEQ ID NO: 82235 - RNA, 20 nt, Artificial Sequence
  MKO10082235_B_Dppa5a
  gRNA
ucacgcaggagugcugaagc

SEQ ID NO: 82236 - RNA, 20 nt, Artificial Sequence
  MKO10082236_B_Dppa5a
  gRNA
acuggcuucacucgauacac

SEQ ID NO: 82237 - RNA, 20 nt, Artificial Sequence
  MKO10082237_B_Dpt
  gRNA
ccagcacugauucgaaguag

SEQ ID NO: 82238 - RNA, 20 nt, Artificial Sequence
  MKO10082238_B_Dpt
  gRNA
ccuccuacagggaucgccag

SEQ ID NO: 82239 - RNA, 20 nt, Artificial Sequence
  MKO10082239_B_Dpt
  gRNA
ugggugaaucuuaaccgcca

SEQ ID NO: 82240 - RNA, 20 nt, Artificial Sequence
  MKO10082240_B_Dpy19l1
  gRNA
ccagugcaauagagcugcaa

SEQ ID NO: 82241 - RNA, 20 nt, Artificial Sequence
  MKO10082241_B_Dpy19l1
  gRNA
caguccgauugagagcugug

SEQ ID NO: 82242 - RNA, 20 nt, Artificial Sequence
  MKO10082242_B_Dpy19l1
  gRNA
ccuuugcagcucuauugcac

SEQ ID NO: 82243 - RNA, 20 nt, Artificial Sequence
  MKO10082243_B_Dpy19l2
  gRNA
uucgauaauggucuugaagu

SEQ ID NO: 82244 - RNA, 20 nt, Artificial Sequence
  MKO10082244_B_Dpy19l2
  gRNA
ucucccguuccaaagaugaa

SEQ ID NO: 82245 - RNA, 20 nt, Artificial Sequence
  MKO10082245_B_Dpy19l2
  gRNA
uucucuuccagcuaucuuug

SEQ ID NO: 82246 - RNA, 20 nt, Artificial Sequence
  MKO10082246_B_Dpy19l3
  gRNA
aaauguucauccguugaagg

SEQ ID NO: 82247 - RNA, 20 nt, Artificial Sequence
  MKO10082247_B_Dpy19l3
  gRNA
cccucugguacgucaccaac

SEQ ID NO: 82248 - RNA, 20 nt, Artificial Sequence
  MKO10082248_B_Dpy19l3
  gRNA
caccuggcugucgggacugu

SEQ ID NO: 82249 - RNA, 20 nt, Artificial Sequence
  MKO10082249_B_Dpy19l4
  gRNA
aaaaccagaauuuccguuca

SEQ ID NO: 82250 - RNA, 20 nt, Artificial Sequence
  MKO10082250_B_Dpy19l4
  gRNA
aguguucucuaucaagcaac

SEQ ID NO: 82251 - RNA, 20 nt, Artificial Sequence
  MKO10082251_B_Dpy19l4
  gRNA
caucuguagaaccccgccaa

SEQ ID NO: 82252 - RNA, 20 nt, Artificial Sequence
  MKO10082252_B_Dpy30
  gRNA
cagcaucugcuccgacucca

SEQ ID NO: 82253 - RNA, 20 nt, Artificial Sequence
  MKO10082253_B_Dpy30
  gRNA
cauggagucggagcagaugc

SEQ ID NO: 82254 - RNA, 20 nt, Artificial Sequence
  MKO10082254_B_Dpy30
  gRNA
gaaaacccucacucugagua

SEQ ID NO: 82255 - RNA, 20 nt, Artificial Sequence
  MKO10082255_B_Dpyd
  gRNA
guugcaugagcuuguacucg

SEQ ID NO: 82256 - RNA, 20 nt, Artificial Sequence
  MKO10082256_B_Dpyd
  gRNA
ugcagcccaccaauauuaau

SEQ ID NO: 82257 - RNA, 20 nt, Artificial Sequence
  MKO10082257_B_Dpyd
  gRNA
gagcucuccgagaagcagug

SEQ ID NO: 82258 - RNA, 20 nt, Artificial Sequence
  MKO10082258_B_Dpysl2
  gRNA
aauaggcucgucccgggcuc

SEQ ID NO: 82259 - RNA, 20 nt, Artificial Sequence
  MKO10082259_B_Dpysl2
  gRNA
agcgaucgucuucugaucaa

SEQ ID NO: 82260 - RNA, 20 nt, Artificial Sequence
  MKO10082260_B_Dpysl2
  gRNA
uuaccugggaauccgucagc

SEQ ID NO: 82261 - RNA, 20 nt, Artificial Sequence
  MKO10082261_B_Dpysl3
  gRNA
caucuucccguuggccucga

SEQ ID NO: 82262 - RNA, 20 nt, Artificial Sequence
  MKO10082262_B_Dpysl3
  gRNA
acaaaggcugccuuagcggg

SEQ ID NO: 82263 - RNA, 20 nt, Artificial Sequence
  MKO10082263_B_Dpysl3
  gRNA
gagugaccgucuucuaauca

SEQ ID NO: 82264 - RNA, 20 nt, Artificial Sequence
  MKO10082264_B_Dpysl4
  gRNA
gugugaacgucaacuccccc

SEQ ID NO: 82265 - RNA, 20 nt, Artificial Sequence
  MKO10082265_B_Dpysl4
  gRNA
ucaccugaccgucaguacac

SEQ ID NO: 82266 - RNA, 20 nt, Artificial Sequence
  MKO10082266_B_Dpysl4
  gRNA
cugugacuacuccuuacaug

SEQ ID NO: 82267 - RNA, 20 nt, Artificial Sequence
  MKO10082267_B_Dpysl5
  gRNA
gcugcuuacccgguuugcaa

SEQ ID NO: 82268 - RNA, 20 nt, Artificial Sequence
  MKO10082268_B_Dpysl5
  gRNA
ccccggguccacgcugaaaa

SEQ ID NO: 82269 - RNA, 20 nt, Artificial Sequence
  MKO10082269_B_Dpysl5
  gRNA
aaucgagaucagccauccag

SEQ ID NO: 82270 - RNA, 20 nt, Artificial Sequence
  MKO10082270_B_Dpys
  gRNA
gaaccaauugcagcgggucu

SEQ ID NO: 82271 - RNA, 20 nt, Artificial Sequence
  MKO10082271_B_Dpys
  gRNA
guagccgaugcgaggagagc

SEQ ID NO: 82272 - RNA, 20 nt, Artificial Sequence
  MKO10082272_B_Dpys
  gRNA
gcucaggugcacgccgagaa

SEQ ID NO: 82273 - RNA, 20 nt, Artificial Sequence
  MKO10082273_B_Dqx1
  gRNA
cgggugcuaccccuucaccc

SEQ ID NO: 82274 - RNA, 20 nt, Artificial Sequence
  MKO10082274_B_Dqx1
  gRNA
cacugucccuaccgaccugg

SEQ ID NO: 82275 - RNA, 20 nt, Artificial Sequence
  MKO10082275_B_Dqx1
  gRNA
auccaacacgucauugacuc

SEQ ID NO: 82276 - RNA, 20 nt, Artificial Sequence
  MKO10082276_B_Dr1
  gRNA
uugugaagauccugcuugag

SEQ ID NO: 82277 - RNA, 20 nt, Artificial Sequence
  MKO10082277_B_Dr1
  gRNA
ggaauuauugagacagcaac

SEQ ID NO: 82278 - RNA, 20 nt, Artificial Sequence
  MKO10082278_B_Dr1
  gRNA
aguucucguuuggaaaaccu

SEQ ID NO: 82279 - RNA, 20 nt, Artificial Sequence
  MKO10082279_B_Dram1
  gRNA
aacgggagugcugaaguagc

SEQ ID NO: 82280 - RNA, 20 nt, Artificial Sequence
  MKO10082280_B_Dram1
  gRNA
uauagaaaugagugaagcac

SEQ ID NO: 82281 - RNA, 20 nt, Artificial Sequence
  MKO10082281_B_Dram1
  gRNA
ggaacaacuccuccagagag

SEQ ID NO: 82282 - RNA, 20 nt, Artificial Sequence
  MKO10082282_B_Dram2
  gRNA
uugcuuguaacgaacauaca

SEQ ID NO: 82283 - RNA, 20 nt, Artificial Sequence
  MKO10082283_B_Dram2
  gRNA
cuugggauacugaguuguuu

SEQ ID NO: 82284 - RNA, 20 nt, Artificial Sequence
  MKO10082284_B_Dram2
  gRNA
ucagggcuaugugcuucacc

SEQ ID NO: 82285 - RNA, 20 nt, Artificial Sequence
  MKO10082285_B_Drap1
  gRNA
auggggacaaggguccucga

SEQ ID NO: 82286 - RNA, 20 nt, Artificial Sequence
  MKO10082286_B_Drap1
  gRNA
ggccacucacaggugggacg

SEQ ID NO: 82287 - RNA, 20 nt, Artificial Sequence
  MKO10082287_B_Drap1
  gRNA
aguaggauacagaugaugac

SEQ ID NO: 82288 - RNA, 20 nt, Artificial Sequence
  MKO10082288_B_Draxin
  gRNA
caucaccuccccgucagacc

SEQ ID NO: 82289 - RNA, 20 nt, Artificial Sequence
  MKO10082289_B_Draxin
  gRNA
cgccuacuacagaagagucc

SEQ ID NO: 82290 - RNA, 20 nt, Artificial Sequence
  MKO10082290_B_Draxin
  gRNA
cgucgaaacauuuguuguug

SEQ ID NO: 82291 - RNA, 20 nt, Artificial Sequence
  MKO10082291_B_Drc1
  gRNA
cagacggaagcggauucccc

SEQ ID NO: 82292 - RNA, 20 nt, Artificial Sequence
  MKO10082292_B_Drc1
  gRNA
ugugaugaagaacuuccgcc

SEQ ID NO: 82293 - RNA, 20 nt, Artificial Sequence
  MKO10082293_B_Drc1
  gRNA
cagacgucagagagauccac

SEQ ID NO: 82294 - RNA, 20 nt, Artificial Sequence
  MKO10082294_B_Drd1a
  gRNA
uaaccucugugugaucagcg

SEQ ID NO: 82295 - RNA, 20 nt, Artificial Sequence
  MKO10082295_B_Drd1a
  gRNA
cugggcaauccuguagauac

SEQ ID NO: 82296 - RNA, 20 nt, Artificial Sequence
  MKO10082296_B_Drd1a
  gRNA
gaagcuguccccggccuuau

SEQ ID NO: 82297 - RNA, 20 nt, Artificial Sequence
  MKO10082297_B_Drd2
  gRNA
cugucaugaucgccauuguc

SEQ ID NO: 82298 - RNA, 20 nt, Artificial Sequence
  MKO10082298_B_Drd2
  gRNA
gggcaacuguacccacccug

SEQ ID NO: 82299 - RNA, 20 nt, Artificial Sequence
  MKO10082299_B_Drd2
  gRNA
accguuaucaugaagucuaa

SEQ ID NO: 82300 - RNA, 20 nt, Artificial Sequence
  MKO10082300_B_Drd3
  gRNA
acuggcuguucugucgagug

SEQ ID NO: 82301 - RNA, 20 nt, Artificial Sequence
  MKO10082301_B_Drd3
  gRNA
caguguaucagcaucagacc

SEQ ID NO: 82302 - RNA, 20 nt, Artificial Sequence
  MKO10082302_B_Drd3
  gRNA
ccuuauugaaaacugccgaa

SEQ ID NO: 82303 - RNA, 20 nt, Artificial Sequence
  MKO10082303_B_Drd4
  gRNA
cuuuccgcggccugcggcgc

SEQ ID NO: 82304 - RNA, 20 nt, Artificial Sequence
  MKO10082304_B_Drd4
  gRNA
caucacgcgggcgcuguguc

SEQ ID NO: 82305 - RNA, 20 nt, Artificial Sequence
  MKO10082305_B_Drd4
  gRNA
gggugucugcagcgugcgcu

SEQ ID NO: 82306 - RNA, 20 nt, Artificial Sequence
  MKO10082306_B_Drd5
  gRNA
ccccagccgcgcccgaugug

SEQ ID NO: 82307 - RNA, 20 nt, Artificial Sequence
  MKO10082307_B_Drd5
  gRNA
gcgcaucuaccgcauugcac

SEQ ID NO: 82308 - RNA, 20 nt, Artificial Sequence
  MKO10082308_B_Drd5
  gRNA
ccaccuucgacauauucguc

SEQ ID NO: 82309 - RNA, 20 nt, Artificial Sequence
  MKO10082309_B_Drg1
  gRNA
caauaauacccgggagaucc

SEQ ID NO: 82310 - RNA, 20 nt, Artificial Sequence
  MKO10082310_B_Drg1
  gRNA
acucugcuaaguaacuuagc

SEQ ID NO: 82311 - RNA, 20 nt, Artificial Sequence
  MKO10082311_B_Drg1
  gRNA
agagaacucaucacuccuaa

SEQ ID NO: 82312 - RNA, 20 nt, Artificial Sequence
  MKO10082312_B_Drg2
  gRNA
cgucagggugguaaacucau

SEQ ID NO: 82313 - RNA, 20 nt, Artificial Sequence
  MKO10082313_B_Drg2
  gRNA
accacccugacgugcauccc

SEQ ID NO: 82314 - RNA, 20 nt, Artificial Sequence
  MKO10082314_B_Drg2
  gRNA
uccaaauccgccucauccaa

SEQ ID NO: 82315 - RNA, 20 nt, Artificial Sequence
  MKO10082315_B_Drosha
  gRNA
uguguacagcgaauccacac

SEQ ID NO: 82316 - RNA, 20 nt, Artificial Sequence
  MKO10082316_B_Drosha
  gRNA
ccaguugcuccugagcccgc

SEQ ID NO: 82317 - RNA, 20 nt, Artificial Sequence
  MKO10082317_B_Drosha
  gRNA
aagagcuccuuaagccugug

SEQ ID NO: 82318 - RNA, 20 nt, Artificial Sequence
  MKO10082318_B_Drp2
  gRNA
cucugugcuugaauccgccc

SEQ ID NO: 82319 - RNA, 20 nt, Artificial Sequence
  MKO10082319_B_Drp2
  gRNA
aaaaccuuagucgcuuugua

SEQ ID NO: 82320 - RNA, 20 nt, Artificial Sequence
  MKO10082320_B_Drp2
  gRNA
acagucccguucaagagcuu

SEQ ID NO: 82321 - RNA, 20 nt, Artificial Sequence
  MKO10082321_B_Dsc1
  gRNA
cagaccugcugaauguguug

SEQ ID NO: 82322 - RNA, 20 nt, Artificial Sequence
  MKO10082322_B_Dsc1
  gRNA
aaaauuggucauacuguuca

SEQ ID NO: 82323 - RNA, 20 nt, Artificial Sequence
  MKO10082323_B_Dsc1
  gRNA
gccgucuucuagaauucuga

SEQ ID NO: 82324 - RNA, 20 nt, Artificial Sequence
  MKO10082324_B_Dsc2
  gRNA
acuggaaaccuguauugcac

SEQ ID NO: 82325 - RNA, 20 nt, Artificial Sequence
  MKO10082325_B_Dsc2
  gRNA
ccucuacugggcccucuaaa

SEQ ID NO: 82326 - RNA, 20 nt, Artificial Sequence
  MKO10082326_B_Dsc2
  gRNA
cuaccugccgagaaauuugu

SEQ ID NO: 82327 - RNA, 20 nt, Artificial Sequence
  MKO10082327_B_Dsc3
  gRNA
uugucugccucuaguguuga

SEQ ID NO: 82328 - RNA, 20 nt, Artificial Sequence
  MKO10082328_B_Dsc3
  gRNA
ccuaccuguugaagaaacaa

SEQ ID NO: 82329 - RNA, 20 nt, Artificial Sequence
  MKO10082329_B_Dsc3
  gRNA
cuucccauuguuucuucaac

SEQ ID NO: 82330 - RNA, 20 nt, Artificial Sequence
  MKO10082330_B_Dscaml1
  gRNA
ucagggaacccuacaccguc

SEQ ID NO: 82331 - RNA, 20 nt, Artificial Sequence
  MKO10082331_B_Dscaml1
  gRNA
guacaucucggacgugcaga

SEQ ID NO: 82332 - RNA, 20 nt, Artificial Sequence
  MKO10082332_B_Dscaml1
  gRNA
ccugcuuugaugcgaauguu

SEQ ID NO: 82333 - RNA, 20 nt, Artificial Sequence
  MKO10082333_B_Dscam
  gRNA
cguacgucacugucgucuca

SEQ ID NO: 82334 - RNA, 20 nt, Artificial Sequence
  MKO10082334_B_Dscam
  gRNA
agcgcgagacuguucguguc

SEQ ID NO: 82335 - RNA, 20 nt, Artificial Sequence
  MKO10082335_B_Dscam
  gRNA
guccuccacacggacuguau

SEQ ID NO: 82336 - RNA, 20 nt, Artificial Sequence
  MKO10082336_B_Dscc1
  gRNA
agauuugcuuaaucauauuc

SEQ ID NO: 82337 - RNA, 20 nt, Artificial Sequence
  MKO10082337_B_Dscc1
  gRNA
ccccuugacugugugccugc

SEQ ID NO: 82338 - RNA, 20 nt, Artificial Sequence
  MKO10082338_B_Dscc1
  gRNA
gaaccaugugacucagcuug

SEQ ID NO: 82339 - RNA, 20 nt, Artificial Sequence
  MKO10082339_B_Dscr3
  gRNA
uggucagguccuuggccaac

SEQ ID NO: 82340 - RNA, 20 nt, Artificial Sequence
  MKO10082340_B_Dscr3
  gRNA
gaauguugacaaacacgccg

SEQ ID NO: 82341 - RNA, 20 nt, Artificial Sequence
  MKO10082341_B_Dscr3
  gRNA
uucgaacacacccacacuuu

SEQ ID NO: 82342 - RNA, 20 nt, Artificial Sequence
  MKO10082342_B_Dsel
  gRNA
ccugugcucagcuuaaguag

SEQ ID NO: 82343 - RNA, 20 nt, Artificial Sequence
  MKO10082343_B_Dsel
  gRNA
aauauuccaagauucgauca

SEQ ID NO: 82344 - RNA, 20 nt, Artificial Sequence
  MKO10082344_B_Dsel
  gRNA
cugcugaauuuaagaaacgg

SEQ ID NO: 82345 - RNA, 20 nt, Artificial Sequence
  MKO10082345_B_Dse
  gRNA
auaaauuugucaugcguaac

SEQ ID NO: 82346 - RNA, 20 nt, Artificial Sequence
  MKO10082346_B_Dse
  gRNA
aguuucauacauauagcccg

SEQ ID NO: 82347 - RNA, 20 nt, Artificial Sequence
  MKO10082347_B_Dse
  gRNA
gguuggugaaagaugcgccu

SEQ ID NO: 82348 - RNA, 20 nt, Artificial Sequence
  MKO10082348_B_Dsg1a
  gRNA
agagaucauaacgccaaaaa

SEQ ID NO: 82349 - RNA, 20 nt, Artificial Sequence
  MKO10082349_B_Dsg1a
  gRNA
aguccacuuacaaugaaaaa

SEQ ID NO: 82350 - RNA, 20 nt, Artificial Sequence
  MKO10082350_B_Dsg1a
  gRNA
aauguagucauugaaaacac

SEQ ID NO: 82351 - RNA, 20 nt, Artificial Sequence
  MKO10082351_B_Dsg1b
  gRNA
uaacagugaauuucaaaucc

SEQ ID NO: 82352 - RNA, 20 nt, Artificial Sequence
  MKO10082352_B_Dsg1b
  gRNA
uucucacuuacuuuggcaau

SEQ ID NO: 82353 - RNA, 20 nt, Artificial Sequence
  MKO10082353_B_Dsg1b
  gRNA
aguccacuuacaaugaaaaa

SEQ ID NO: 82354 - RNA, 20 nt, Artificial Sequence
  MKO10082354_B_Dsg1c
  gRNA
aguccacuuacaaugaaaaa

SEQ ID NO: 82355 - RNA, 20 nt, Artificial Sequence
  MKO10082355_B_Dsg1c
  gRNA
accagugacauaccgcaucu

SEQ ID NO: 82356 - RNA, 20 nt, Artificial Sequence
  MKO10082356_B_Dsg1c
  gRNA
aauguagucauugaaaacac

SEQ ID NO: 82357 - RNA, 20 nt, Artificial Sequence
  MKO10082357_B_Dsg2
  gRNA
cagaaagaacccgauugcca

SEQ ID NO: 82358 - RNA, 20 nt, Artificial Sequence
  MKO10082358_B_Dsg2
  gRNA
ggucuuuguuggguccauug

SEQ ID NO: 82359 - RNA, 20 nt, Artificial Sequence
  MKO10082359_B_Dsg2
  gRNA
cgaaccaagugagugugcuu

SEQ ID NO: 82360 - RNA, 20 nt, Artificial Sequence
  MKO10082360_B_Dsg3
  gRNA
aagacgaaacccaauugcca

SEQ ID NO: 82361 - RNA, 20 nt, Artificial Sequence
  MKO10082361_B_Dsg3
  gRNA
augccgugcacuaaaugccc

SEQ ID NO: 82362 - RNA, 20 nt, Artificial Sequence
  MKO10082362_B_Dsg3
  gRNA
uucaauuucacccuugaaua

SEQ ID NO: 82363 - RNA, 20 nt, Artificial Sequence
  MKO10082363_B_Dsg4
  gRNA
aaacagugaauuuaucguug

SEQ ID NO: 82364 - RNA, 20 nt, Artificial Sequence
  MKO10082364_B_Dsg4
  gRNA
ucaaguuugcggcagccugu

SEQ ID NO: 82365 - RNA, 20 nt, Artificial Sequence
  MKO10082365_B_Dsg4
  gRNA
gucgcuguucucuucaaugu

SEQ ID NO: 82366 - RNA, 20 nt, Artificial Sequence
  MKO10082366_B_Dsn1
  gRNA
cuuucgcucuaaaacauuca

SEQ ID NO: 82367 - RNA, 20 nt, Artificial Sequence
  MKO10082367_B_Dsn1
  gRNA
ugaaguuagcccagagccaa

SEQ ID NO: 82368 - RNA, 20 nt, Artificial Sequence
  MKO10082368_B_Dsn1
  gRNA
accuuucuuaaagaacacua

SEQ ID NO: 82369 - RNA, 20 nt, Artificial Sequence
  MKO10082369_B_Dspp
  gRNA
uccucuaccccguucccgcu

SEQ ID NO: 82370 - RNA, 20 nt, Artificial Sequence
  MKO10082370_B_Dspp
  gRNA
caugaugggguacaugcgag

SEQ ID NO: 82371 - RNA, 20 nt, Artificial Sequence
  MKO10082371_B_Dspp
  gRNA
gguuccccaguuaguaccac

SEQ ID NO: 82372 - RNA, 20 nt, Artificial Sequence
  MKO10082372_B_Dsp
  gRNA
ugaaccagcguccacacccc

SEQ ID NO: 82373 - RNA, 20 nt, Artificial Sequence
  MKO10082373_B_Dsp
  gRNA
uaugauuuccaucugaucgu

SEQ ID NO: 82374 - RNA, 20 nt, Artificial Sequence
  MKO10082374_B_Dsp
  gRNA
uacacaagccaacgaucaga

SEQ ID NO: 82375 - RNA, 20 nt, Artificial Sequence
  MKO10082375_B_Dstn
  gRNA
ugacgccagcuuugagacca

SEQ ID NO: 82376 - RNA, 20 nt, Artificial Sequence
  MKO10082376_B_Dstn
  gRNA
accuguauugcugaaaagcu

SEQ ID NO: 82377 - RNA, 20 nt, Artificial Sequence
  MKO10082377_B_Dstn
  gRNA
gccaucaagaagaaauuucc

SEQ ID NO: 82378 - RNA, 20 nt, Artificial Sequence
  MKO10082378_B_Dstyk
  gRNA
ucaugugcuagcugaccucg

SEQ ID NO: 82379 - RNA, 20 nt, Artificial Sequence
  MKO10082379_B_Dstyk
  gRNA
ucccaacaaagcuuucccgc

SEQ ID NO: 82380 - RNA, 20 nt, Artificial Sequence
  MKO10082380_B_Dstyk
  gRNA
acucgggauccucaguuacu

SEQ ID NO: 82381 - RNA, 20 nt, Artificial Sequence
  MKO10082381_B_Dst
  gRNA
ucguaccuuuguaccucucc

SEQ ID NO: 82382 - RNA, 20 nt, Artificial Sequence
  MKO10082382_B_Dst
  gRNA
cugcuccuccacguacaugu

SEQ ID NO: 82383 - RNA, 20 nt, Artificial Sequence
  MKO10082383_B_Dst
  gRNA
gcacaauuugaucucccucc

SEQ ID NO: 82384 - RNA, 20 nt, Artificial Sequence
  MKO10082384_B_Dtd1
  gRNA
gacacagaugccccguccga

SEQ ID NO: 82385 - RNA, 20 nt, Artificial Sequence
  MKO10082385_B_Dtd1
  gRNA
agggugacgugucuucugag

SEQ ID NO: 82386 - RNA, 20 nt, Artificial Sequence
  MKO10082386_B_Dtd1
  gRNA
gaagaccgcagcgccagcag

SEQ ID NO: 82387 - RNA, 20 nt, Artificial Sequence
  MKO10082387_B_Dtd2
  gRNA
gggaugaucagaacaucgcc

SEQ ID NO: 82388 - RNA, 20 nt, Artificial Sequence
  MKO10082388_B_Dtd2
  gRNA
cucacagauucggagaggau

SEQ ID NO: 82389 - RNA, 20 nt, Artificial Sequence
  MKO10082389_B_Dtd2
  gRNA
cacagaccuucuccccaaaa

SEQ ID NO: 82390 - RNA, 20 nt, Artificial Sequence
  MKO10082390_B_Dtl
  gRNA
cuacagacuugaggcugcac

SEQ ID NO: 82391 - RNA, 20 nt, Artificial Sequence
  MKO10082391_B_Dtl
  gRNA
cucacaaguuuaaguucacc

SEQ ID NO: 82392 - RNA, 20 nt, Artificial Sequence
  MKO10082392_B_Dtl
  gRNA
agcucuuacaucccaaaauu

SEQ ID NO: 82393 - RNA, 20 nt, Artificial Sequence
  MKO10082393_B_Dtna
  gRNA
cacagaaugauugaagauag

SEQ ID NO: 82394 - RNA, 20 nt, Artificial Sequence
  MKO10082394_B_Dtna
  gRNA
cugacuaggggcucaagauc

SEQ ID NO: 82395 - RNA, 20 nt, Artificial Sequence
  MKO10082395_B_Dtna
  gRNA
auuguguggaggaaagauca

SEQ ID NO: 82396 - RNA, 20 nt, Artificial Sequence
  MKO10082396_B_Dtnbp1
  gRNA
guugcagcugguggacagcg

SEQ ID NO: 82397 - RNA, 20 nt, Artificial Sequence
  MKO10082397_B_Dtnbp1
  gRNA
gccagcgucugcacacuccu

SEQ ID NO: 82398 - RNA, 20 nt, Artificial Sequence
  MKO10082398_B_Dtnbp1
  gRNA
ugcacuucacagaagagcca

SEQ ID NO: 82399 - RNA, 20 nt, Artificial Sequence
  MKO10082399_B_Dtnb
  gRNA
aucucuaggaugauugagga

SEQ ID NO: 82400 - RNA, 20 nt, Artificial Sequence
  MKO10082400_B_Dtnb
  gRNA
gagcugccucuucuccgcca

SEQ ID NO: 82401 - RNA, 20 nt, Artificial Sequence
  MKO10082401_B_Dtnb
  gRNA
cauagcuuuaacugaaaaca

SEQ ID NO: 82402 - RNA, 20 nt, Artificial Sequence
  MKO10082402_B_Dtwd1
  gRNA
ugauccuucccuucguacuc

SEQ ID NO: 82403 - RNA, 20 nt, Artificial Sequence
  MKO10082403_B_Dtwd1
  gRNA
aggucccggugucgccaaug

SEQ ID NO: 82404 - RNA, 20 nt, Artificial Sequence
  MKO10082404_B_Dtwd1
  gRNA
aaacuuaugcuuagcgucuc

SEQ ID NO: 82405 - RNA, 20 nt, Artificial Sequence
  MKO10082405_B_Dtwd2
  gRNA
uguacaaguggguagagauc

SEQ ID NO: 82406 - RNA, 20 nt, Artificial Sequence
  MKO10082406_B_Dtwd2
  gRNA
ucugagcgccaugcugaagc

SEQ ID NO: 82407 - RNA, 20 nt, Artificial Sequence
  MKO10082407_B_Dtwd2
  gRNA
agugggcgcacugggagaua

SEQ ID NO: 82408 - RNA, 20 nt, Artificial Sequence
  MKO10082408_B_Dtx1
  gRNA
cggcacacgccgggcacucc

SEQ ID NO: 82409 - RNA, 20 nt, Artificial Sequence
  MKO10082409_B_Dtx1
  gRNA
agcgacgugaagccugugcc

SEQ ID NO: 82410 - RNA, 20 nt, Artificial Sequence
  MKO10082410_B_Dtx1
  gRNA
ggcuggcucaccucaucagg

SEQ ID NO: 82411 - RNA, 20 nt, Artificial Sequence
  MKO10082411_B_Dtx2
  gRNA
accugcggcagagacgagcu

SEQ ID NO: 82412 - RNA, 20 nt, Artificial Sequence
  MKO10082412_B_Dtx2
  gRNA
ggugaucagaaaguacaccg

SEQ ID NO: 82413 - RNA, 20 nt, Artificial Sequence
  MKO10082413_B_Dtx2
  gRNA
acuuaccugcaagcgccugc

SEQ ID NO: 82414 - RNA, 20 nt, Artificial Sequence
  MKO10082414_B_Dtx3l
  gRNA
gcuccuccuugacacguuuc

SEQ ID NO: 82415 - RNA, 20 nt, Artificial Sequence
  MKO10082415_B_Dtx3l
  gRNA
aaagagcgaacacgagaugu

SEQ ID NO: 82416 - RNA, 20 nt, Artificial Sequence
  MKO10082416_B_Dtx3l
  gRNA
ugauuaccugaaacguguca

SEQ ID NO: 82417 - RNA, 20 nt, Artificial Sequence
  MKO10082417_B_Dtx3
  gRNA
ggcgcuggucaaaugccuuu

SEQ ID NO: 82418 - RNA, 20 nt, Artificial Sequence
  MKO10082418_B_Dtx3
  gRNA
uugccccagguuuggguauc

SEQ ID NO: 82419 - RNA, 20 nt, Artificial Sequence
  MKO10082419_B_Dtx3
  gRNA
guuccucuugcacccuaguc

SEQ ID NO: 82420 - RNA, 20 nt, Artificial Sequence
  MKO10082420_B_Dtx4
  gRNA
cgcugcacucaugaguaucc

SEQ ID NO: 82421 - RNA, 20 nt, Artificial Sequence
  MKO10082421_B_Dtx4
  gRNA
ccccauagguaaaaccccag

SEQ ID NO: 82422 - RNA, 20 nt, Artificial Sequence
  MKO10082422_B_Dtx4
  gRNA
uacuucuuuagcacuuccuc

SEQ ID NO: 82423 - RNA, 20 nt, Artificial Sequence
  MKO10082423_B_Dtymk
  gRNA
ccgguuguuuacaccaaucc

SEQ ID NO: 82424 - RNA, 20 nt, Artificial Sequence
  MKO10082424_B_Dtymk
  gRNA
uucaacuucgccuuaauuaa

SEQ ID NO: 82425 - RNA, 20 nt, Artificial Sequence
  MKO10082425_B_Dtymk
  gRNA
aggcguaucuguccaaaaca

SEQ ID NO: 82426 - RNA, 20 nt, Artificial Sequence
  MKO10082426_B_Duox1
  gRNA
cucaacauuuacaucccgca

SEQ ID NO: 82427 - RNA, 20 nt, Artificial Sequence
  MKO10082427_B_Duox1
  gRNA
agguacagcgauuugaugga

SEQ ID NO: 82428 - RNA, 20 nt, Artificial Sequence
  MKO10082428_B_Duox1
  gRNA
agccgcugggaccgcaacac

SEQ ID NO: 82429 - RNA, 20 nt, Artificial Sequence
  MKO10082429_B_Duox2
  gRNA
uagcgacagcaucgcuuagc

SEQ ID NO: 82430 - RNA, 20 nt, Artificial Sequence
  MKO10082430_B_Duox2
  gRNA
uuccgcgggaaagcaggguc

SEQ ID NO: 82431 - RNA, 20 nt, Artificial Sequence
  MKO10082431_B_Duox2
  gRNA
gccucaccauacaccccuug

SEQ ID NO: 82432 - RNA, 20 nt, Artificial Sequence
  MKO10082432_B_Duoxa1
  gRNA
guggugaccagcuuauucau

SEQ ID NO: 82433 - RNA, 20 nt, Artificial Sequence
  MKO10082433_B_Duoxa1
  gRNA
gaaggcuuuguacguugugu

SEQ ID NO: 82434 - RNA, 20 nt, Artificial Sequence
  MKO10082434_B_Duoxa1
  gRNA
aguguccugccaggcgguac

SEQ ID NO: 82435 - RNA, 20 nt, Artificial Sequence
  MKO10082435_B_Duoxa2
  gRNA
aggcgccguaguaaggcgug

SEQ ID NO: 82436 - RNA, 20 nt, Artificial Sequence
  MKO10082436_B_Duoxa2
  gRNA
gccccacgugcagaccgaca

SEQ ID NO: 82437 - RNA, 20 nt, Artificial Sequence
  MKO10082437_B_Duoxa2
  gRNA
gcuguaccaccaauaucacc

SEQ ID NO: 82438 - RNA, 20 nt, Artificial Sequence
  MKO10082438_B_Dupd1
  gRNA
acugugccaugggccgaagu

SEQ ID NO: 82439 - RNA, 20 nt, Artificial Sequence
  MKO10082439_B_Dupd1
  gRNA
ccagaguugcugaccgacuu

SEQ ID NO: 82440 - RNA, 20 nt, Artificial Sequence
  MKO10082440_B_Dupd1
  gRNA
ccucauugacguguguauac

SEQ ID NO: 82441 - RNA, 20 nt, Artificial Sequence
  MKO10082441_B_Dus1l
  gRNA
cucacugucuugucaauuuc

SEQ ID NO: 82442 - RNA, 20 nt, Artificial Sequence
  MKO10082442_B_Dus1l
  gRNA
uccuagcugcugacugugca

SEQ ID NO: 82443 - RNA, 20 nt, Artificial Sequence
  MKO10082443_B_Dus1l
  gRNA
cagaaauugacaagacagug

SEQ ID NO: 82444 - RNA, 20 nt, Artificial Sequence
  MKO10082444_B_Dus2
  gRNA
uccaaaagaguauuccacua

SEQ ID NO: 82445 - RNA, 20 nt, Artificial Sequence
  MKO10082445_B_Dus2
  gRNA
acuuuguugcuccugaugac

SEQ ID NO: 82446 - RNA, 20 nt, Artificial Sequence
  MKO10082446_B_Dus2
  gRNA
ucuguucucuuucacacgua

SEQ ID NO: 82447 - RNA, 20 nt, Artificial Sequence
  MKO10082447_B_Dus3l
  gRNA
aggggccaaaagaauucgcc

SEQ ID NO: 82448 - RNA, 20 nt, Artificial Sequence
  MKO10082448_B_Dus3l
  gRNA
ccaccuccuaccgugguuaa

SEQ ID NO: 82449 - RNA, 20 nt, Artificial Sequence
  MKO10082449_B_Dus3l
  gRNA
uggcaauugaaucccgugaa

SEQ ID NO: 82450 - RNA, 20 nt, Artificial Sequence
  MKO10082450_B_Dus4l
  gRNA
ucucucaaggugggcgaugg

SEQ ID NO: 82451 - RNA, 20 nt, Artificial Sequence
  MKO10082451_B_Dus4l
  gRNA
uuaacugugguugcccucag

SEQ ID NO: 82452 - RNA, 20 nt, Artificial Sequence
  MKO10082452_B_Dus4l
  gRNA
gcagcaaacugaacaaucaa

SEQ ID NO: 82453 - RNA, 20 nt, Artificial Sequence
  MKO10082453_B_Dusp10
  gRNA
aaccuacgacaaggaucauc

SEQ ID NO: 82454 - RNA, 20 nt, Artificial Sequence
  MKO10082454_B_Dusp10
  gRNA
auaguuaccgaugaacucga

SEQ ID NO: 82455 - RNA, 20 nt, Artificial Sequence
  MKO10082455_B_Dusp10
  gRNA
agcucugcguucucgauguc

SEQ ID NO: 82456 - RNA, 20 nt, Artificial Sequence
  MKO10082456_B_Dusp11
  gRNA
agccaguccuauuuaagcca

SEQ ID NO: 82457 - RNA, 20 nt, Artificial Sequence
  MKO10082457_B_Dusp11
  gRNA
ugaaagauagugucauuauc

SEQ ID NO: 82458 - RNA, 20 nt, Artificial Sequence
  MKO10082458_B_Dusp11
  gRNA
uggaaagacuaucucccagu

SEQ ID NO: 82459 - RNA, 20 nt, Artificial Sequence
  MKO10082459_B_Dusp12
  gRNA
aaaaagccuacgacauccuc

SEQ ID NO: 82460 - RNA, 20 nt, Artificial Sequence
  MKO10082460_B_Dusp12
  gRNA
caagcaguaccguuuacaaa

SEQ ID NO: 82461 - RNA, 20 nt, Artificial Sequence
  MKO10082461_B_Dusp12
  gRNA
auggcaacugaaacuguaug

SEQ ID NO: 82462 - RNA, 20 nt, Artificial Sequence
  MKO10082462_B_Dusp13
  gRNA
ggggcuagcguucucacaga

SEQ ID NO: 82463 - RNA, 20 nt, Artificial Sequence
  MKO10082463_B_Dusp13
  gRNA
gugagaacgcuagccccacu

SEQ ID NO: 82464 - RNA, 20 nt, Artificial Sequence
  MKO10082464_B_Dusp13
  gRNA
cacgauuggggaagauccau

SEQ ID NO: 82465 - RNA, 20 nt, Artificial Sequence
  MKO10082465_B_Dusp14
  gRNA
cacgcucccacggacucuca

SEQ ID NO: 82466 - RNA, 20 nt, Artificial Sequence
  MKO10082466_B_Dusp14
  gRNA
ugaugacgcaggugaugccg

SEQ ID NO: 82467 - RNA, 20 nt, Artificial Sequence
  MKO10082467_B_Dusp14
  gRNA
gagccagcguggccuccaac

SEQ ID NO: 82468 - RNA, 20 nt, Artificial Sequence
  MKO10082468_B_Dusp15
  gRNA
gcucaccaaugaaguuucca

SEQ ID NO: 82469 - RNA, 20 nt, Artificial Sequence
  MKO10082469_B_Dusp15
  gRNA
cauggggaauggcaugacca

SEQ ID NO: 82470 - RNA, 20 nt, Artificial Sequence
  MKO10082470_B_Dusp15
  gRNA
ugauaugugugaucuuauuc

SEQ ID NO: 82471 - RNA, 20 nt, Artificial Sequence
  MKO10082471_B_Dusp16
  gRNA
acgacagagaaccaacaucu

SEQ ID NO: 82472 - RNA, 20 nt, Artificial Sequence
  MKO10082472_B_Dusp16
  gRNA
uaugaagucaggcuuuggac

SEQ ID NO: 82473 - RNA, 20 nt, Artificial Sequence
  MKO10082473_B_Dusp16
  gRNA
ugacauugacugcaaucaga

SEQ ID NO: 82474 - RNA, 20 nt, Artificial Sequence
  MKO10082474_B_Dusp18
  gRNA
agucaucaacgucucaguag

SEQ ID NO: 82475 - RNA, 20 nt, Artificial Sequence
  MKO10082475_B_Dusp18
  gRNA
cuuacagugggaucaucaaa

SEQ ID NO: 82476 - RNA, 20 nt, Artificial Sequence
  MKO10082476_B_Dusp18
  gRNA
auacuggauauccucguaga

SEQ ID NO: 82477 - RNA, 20 nt, Artificial Sequence
  MKO10082477_B_Dusp19
  gRNA
gcuuaauaacgccaacuugc

SEQ ID NO: 82478 - RNA, 20 nt, Artificial Sequence
  MKO10082478_B_Dusp19
  gRNA
acaggaugcugcucaugacc

SEQ ID NO: 82479 - RNA, 20 nt, Artificial Sequence
  MKO10082479_B_Dusp19
  gRNA
auauaagaccauuucuauac

SEQ ID NO: 82480 - RNA, 20 nt, Artificial Sequence
  MKO10082480_B_Dusp1
  gRNA
uaguaccccucucuacgauc

SEQ ID NO: 82481 - RNA, 20 nt, Artificial Sequence
  MKO10082481_B_Dusp1
  gRNA
gucaauagccucguugaacc

SEQ ID NO: 82482 - RNA, 20 nt, Artificial Sequence
  MKO10082482_B_Dusp1
  gRNA
auuggcugagacguugauca

SEQ ID NO: 82483 - RNA, 20 nt, Artificial Sequence
  MKO10082483_B_Dusp21
  gRNA
acgcuguugcacugugccgc

SEQ ID NO: 82484 - RNA, 20 nt, Artificial Sequence
  MKO10082484_B_Dusp21
  gRNA
uccgucucaagcuacccaac

SEQ ID NO: 82485 - RNA, 20 nt, Artificial Sequence
  MKO10082485_B_Dusp21
  gRNA
uggggucgaaaaagucauag

SEQ ID NO: 82486 - RNA, 20 nt, Artificial Sequence
  MKO10082486_B_Dusp22
  gRNA
ccggcgcggccauggggagu

SEQ ID NO: 82487 - RNA, 20 nt, Artificial Sequence
  MKO10082487_B_Dusp22
  gRNA
cuuugaaguugccaauguac

SEQ ID NO: 82488 - RNA, 20 nt, Artificial Sequence
  MKO10082488_B_Dusp22
  gRNA
gagaugcagaacaguugagc

SEQ ID NO: 82489 - RNA, 20 nt, Artificial Sequence
  MKO10082489_B_Dusp23
  gRNA
cgaggccaaugcccggggag

SEQ ID NO: 82490 - RNA, 20 nt, Artificial Sequence
  MKO10082490_B_Dusp23
  gRNA
cuccuguucauacgucucaa

SEQ ID NO: 82491 - RNA, 20 nt, Artificial Sequence
  MKO10082491_B_Dusp23
  gRNA
gccaguccggccagccgucc

SEQ ID NO: 82492 - RNA, 20 nt, Artificial Sequence
  MKO10082492_B_Dusp26
  gRNA
cuggcuggcucagcgcccga

SEQ ID NO: 82493 - RNA, 20 nt, Artificial Sequence
  MKO10082493_B_Dusp26
  gRNA
cccccaaccggggcuucuug

SEQ ID NO: 82494 - RNA, 20 nt, Artificial Sequence
  MKO10082494_B_Dusp26
  gRNA
agugagcagauccgcuaccc

SEQ ID NO: 82495 - RNA, 20 nt, Artificial Sequence
  MKO10082495_B_Dusp27
  gRNA
accuucguugaugaucuguu

SEQ ID NO: 82496 - RNA, 20 nt, Artificial Sequence
  MKO10082496_B_Dusp27
  gRNA
caaccguguccgugagaaga

SEQ ID NO: 82497 - RNA, 20 nt, Artificial Sequence
  MKO10082497_B_Dusp27
  gRNA
gcaagaggccccucggaaug

SEQ ID NO: 82498 - RNA, 20 nt, Artificial Sequence
  MKO10082498_B_Dusp28
  gRNA
ccgagcccaauuugggguuc

SEQ ID NO: 82499 - RNA, 20 nt, Artificial Sequence
  MKO10082499_B_Dusp28
  gRNA
cguguucgacgacccagcug

SEQ ID NO: 82500 - RNA, 20 nt, Artificial Sequence
  MKO10082500_B_Dusp28
  gRNA
cucagcugggucgucgaaca

SEQ ID NO: 82501 - RNA, 20 nt, Artificial Sequence
  MKO10082501_B_Dusp2
  gRNA
gagaacugcugugaugccgc

SEQ ID NO: 82502 - RNA, 20 nt, Artificial Sequence
  MKO10082502_B_Dusp2
  gRNA
uugacuuuguuaagcaacgu

SEQ ID NO: 82503 - RNA, 20 nt, Artificial Sequence
  MKO10082503_B_Dusp2
  gRNA
cuaugaagcugauagccucc

SEQ ID NO: 82504 - RNA, 20 nt, Artificial Sequence
  MKO10082504_B_Dusp3
  gRNA
caccgagaguucgaacgagc

SEQ ID NO: 82505 - RNA, 20 nt, Artificial Sequence
  MKO10082505_B_Dusp3
  gRNA
caccagugcuagcuucuacg

SEQ ID NO: 82506 - RNA, 20 nt, Artificial Sequence
  MKO10082506_B_Dusp3
  gRNA
ccacguccugaaugcugccg

SEQ ID NO: 82507 - RNA, 20 nt, Artificial Sequence
  MKO10082507_B_Dusp4
  gRNA
ccuugugguugucuucgacg

SEQ ID NO: 82508 - RNA, 20 nt, Artificial Sequence
  MKO10082508_B_Dusp4
  gRNA
uggaaccccgcugcacgacc

SEQ ID NO: 82509 - RNA, 20 nt, Artificial Sequence
  MKO10082509_B_Dusp4
  gRNA
uucugccgcagacgcaguaa

SEQ ID NO: 82510 - RNA, 20 nt, Artificial Sequence
  MKO10082510_B_Dusp5
  gRNA
ggaacucgcacuuggaugcg

SEQ ID NO: 82511 - RNA, 20 nt, Artificial Sequence
  MKO10082511_B_Dusp5
  gRNA
ccucugcuugacguaaucga

SEQ ID NO: 82512 - RNA, 20 nt, Artificial Sequence
  MKO10082512_B_Dusp5
  gRNA
ccuucgauuacgucaagcag

SEQ ID NO: 82513 - RNA, 20 nt, Artificial Sequence
  MKO10082513_B_Dusp6
  gRNA
gcugcacgagccgucuagau

SEQ ID NO: 82514 - RNA, 20 nt, Artificial Sequence
  MKO10082514_B_Dusp6
  gRNA
cucuuccaacacguccaagu

SEQ ID NO: 82515 - RNA, 20 nt, Artificial Sequence
  MKO10082515_B_Dusp6
  gRNA
gugccuuucacguagacugc

SEQ ID NO: 82516 - RNA, 20 nt, Artificial Sequence
  MKO10082516_B_Dusp7
  gRNA
guggacucgagcguguugau

SEQ ID NO: 82517 - RNA, 20 nt, Artificial Sequence
  MKO10082517_B_Dusp7
  gRNA
cguauuugccaaguacaucc

SEQ ID NO: 82518 - RNA, 20 nt, Artificial Sequence
  MKO10082518_B_Dusp7
  gRNA
auccgacucaguggcacugc

SEQ ID NO: 82519 - RNA, 20 nt, Artificial Sequence
  MKO10082519_B_Dusp8
  gRNA
cgcguacaucaugaaaacca

SEQ ID NO: 82520 - RNA, 20 nt, Artificial Sequence
  MKO10082520_B_Dusp8
  gRNA
gaggcucauggacgguagag

SEQ ID NO: 82521 - RNA, 20 nt, Artificial Sequence
  MKO10082521_B_Dusp8
  gRNA
gacaaguccaucgaguuuau

SEQ ID NO: 82522 - RNA, 20 nt, Artificial Sequence
  MKO10082522_B_Dusp9
  gRNA
ucggugcggucgcucuugcc

SEQ ID NO: 82523 - RNA, 20 nt, Artificial Sequence
  MKO10082523_B_Dusp9
  gRNA
ugcucgagauucagccaauu

SEQ ID NO: 82524 - RNA, 20 nt, Artificial Sequence
  MKO10082524_B_Dusp9
  gRNA
gaccgugacaccuugagcug

SEQ ID NO: 82525 - RNA, 20 nt, Artificial Sequence
  MKO10082525_B_Duu
  gRNA
uccagcuggugucauagacg

SEQ ID NO: 82526 - RNA, 20 nt, Artificial Sequence
  MKO10082526_B_Duu
  gRNA
ugauuauacaauaucaccca

SEQ ID NO: 82527 - RNA, 20 nt, Artificial Sequence
  MKO10082527_B_Duu
  gRNA
uuuacagccaagccagaacg

SEQ ID NO: 82528 - RNA, 20 nt, Artificial Sequence
  MKO10082528_B_Duxbl1
  gRNA
uucaaaagcauagaaaaaua

SEQ ID NO: 82529 - RNA, 20 nt, Artificial Sequence
  MKO10082529_B_Duxbl1
  gRNA
cguacaugaauccuggauuc

SEQ ID NO: 82530 - RNA, 20 nt, Artificial Sequence
  MKO10082530_B_Duxbl1
  gRNA
aaucaguuaaagaagcuaga

SEQ ID NO: 82531 - RNA, 20 nt, Artificial Sequence
  MKO10082531_B_Duxbl2
  gRNA
uucaaaagcauagaaaaaua

SEQ ID NO: 82532 - RNA, 20 nt, Artificial Sequence
  MKO10082532_B_Duxbl2
  gRNA
cguacaugaauccuggauuc

SEQ ID NO: 82533 - RNA, 20 nt, Artificial Sequence
  MKO10082533_B_Duxbl2
  gRNA
aaucaguuaaagaagcuaga

SEQ ID NO: 82534 - RNA, 20 nt, Artificial Sequence
  MKO10082534_B_Duxbl3
  gRNA
uucaaaagcauagaaaaaua

SEQ ID NO: 82535 - RNA, 20 nt, Artificial Sequence
  MKO10082535_B_Duxbl3
  gRNA
cguacaugaauccuggauuc

SEQ ID NO: 82536 - RNA, 20 nt, Artificial Sequence
  MKO10082536_B_Duxbl3
  gRNA
aaucaguuaaagaagcuaga

SEQ ID NO: 82537 - RNA, 20 nt, Artificial Sequence
  MKO10082537_B_Dux
  gRNA
uguggcgccgccgagcucuu

SEQ ID NO: 82538 - RNA, 20 nt, Artificial Sequence
  MKO10082538_B_Dux
  gRNA
ccguggagcaggccaacaag

SEQ ID NO: 82539 - RNA, 20 nt, Artificial Sequence
  MKO10082539_B_Dux
  gRNA
cagaaggagggcaagucgcu

SEQ ID NO: 82540 - RNA, 20 nt, Artificial Sequence
  MKO10082540_B_Dvl1
  gRNA
ucccgccgccgauccccucu

SEQ ID NO: 82541 - RNA, 20 nt, Artificial Sequence
  MKO10082541_B_Dvl1
  gRNA
caggcggcauuggggacucc

SEQ ID NO: 82542 - RNA, 20 nt, Artificial Sequence
  MKO10082542_B_Dvl1
  gRNA
ccgagugagcgcccucagcc

SEQ ID NO: 82543 - RNA, 20 nt, Artificial Sequence
  MKO10082543_B_Dvl2
  gRNA
ccucagugauacgacagauu

SEQ ID NO: 82544 - RNA, 20 nt, Artificial Sequence
  MKO10082544_B_Dvl2
  gRNA
cauccucauccgagucuccu

SEQ ID NO: 82545 - RNA, 20 nt, Artificial Sequence
  MKO10082545_B_Dvl2
  gRNA
ccaguggaauuggggacuca

SEQ ID NO: 82546 - RNA, 20 nt, Artificial Sequence
  MKO10082546_B_Dvl3
  gRNA
ccuccugugcguuccaucga

SEQ ID NO: 82547 - RNA, 20 nt, Artificial Sequence
  MKO10082547_B_Dvl3
  gRNA
cccuuuagcccucaugcuag

SEQ ID NO: 82548 - RNA, 20 nt, Artificial Sequence
  MKO10082548_B_Dvl3
  gRNA
gacggguugucagcacagaa

SEQ ID NO: 82549 - RNA, 20 nt, Artificial Sequence
  MKO10082549_B_Dxo
  gRNA
cucugugcuacgcagccgcc

SEQ ID NO: 82550 - RNA, 20 nt, Artificial Sequence
  MKO10082550_B_Dxo
  gRNA
uuugagcaguacaugugcgc

SEQ ID NO: 82551 - RNA, 20 nt, Artificial Sequence
  MKO10082551_B_Dxo
  gRNA
ccccuccagaaugaccgaga

SEQ ID NO: 82552 - RNA, 20 nt, Artificial Sequence
  MKO10082552_B_Dydc1
  gRNA
acagagagaaaugauuacgu

SEQ ID NO: 82553 - RNA, 20 nt, Artificial Sequence
  MKO10082553_B_Dydc1
  gRNA
ugagagagaauuagccauga

SEQ ID NO: 82554 - RNA, 20 nt, Artificial Sequence
  MKO10082554_B_Dydc1
  gRNA
guagcaguuggcauuccagu

SEQ ID NO: 82555 - RNA, 20 nt, Artificial Sequence
  MKO10082555_B_Dydc2
  gRNA
cuacaguuauacuccuauaa

SEQ ID NO: 82556 - RNA, 20 nt, Artificial Sequence
  MKO10082556_B_Dydc2
  gRNA
cccuugaggagaagacuaug

SEQ ID NO: 82557 - RNA, 20 nt, Artificial Sequence
  MKO10082557_B_Dydc2
  gRNA
auuacccuagagaaggcaag

SEQ ID NO: 82558 - RNA, 20 nt, Artificial Sequence
  MKO10082558_B_Dym
  gRNA
cuauuacuuacuguagcugc

SEQ ID NO: 82559 - RNA, 20 nt, Artificial Sequence
  MKO10082559_B_Dym
  gRNA
caguucugaguugaagcuau

SEQ ID NO: 82560 - RNA, 20 nt, Artificial Sequence
  MKO10082560_B_Dym
  gRNA
ugcagagcaacucuuccaga

SEQ ID NO: 82561 - RNA, 20 nt, Artificial Sequence
  MKO10082561_B_Dynap
  gRNA
cuugaauguugagcaaaacg

SEQ ID NO: 82562 - RNA, 20 nt, Artificial Sequence
  MKO10082562_B_Dynap
  gRNA
aaggaguccuuacuguucaa

SEQ ID NO: 82563 - RNA, 20 nt, Artificial Sequence
  MKO10082563_B_Dynap
  gRNA
ugugguuggagaugacguag

SEQ ID NO: 82564 - RNA, 20 nt, Artificial Sequence
  MKO10082564_B_Dync1h1
  gRNA
caaaggugaccaagcuugac

SEQ ID NO: 82565 - RNA, 20 nt, Artificial Sequence
  MKO10082565_B_Dync1h1
  gRNA
ggcuugucugcaucaaucac

SEQ ID NO: 82566 - RNA, 20 nt, Artificial Sequence
  MKO10082566_B_Dync1h1
  gRNA
aaagagugcagugucucaua

SEQ ID NO: 82567 - RNA, 20 nt, Artificial Sequence
  MKO10082567_B_Dync1i1
  gRNA
gcgcuuagcacagauaagag

SEQ ID NO: 82568 - RNA, 20 nt, Artificial Sequence
  MKO10082568_B_Dync1i1
  gRNA
gccccagaucgcccgagucu

SEQ ID NO: 82569 - RNA, 20 nt, Artificial Sequence
  MKO10082569_B_Dync1i1
  gRNA
caggagacgacugcacaagc

SEQ ID NO: 82570 - RNA, 20 nt, Artificial Sequence
  MKO10082570_B_Dync1i2
  gRNA
ucaaagcaugggacuaacua

SEQ ID NO: 82571 - RNA, 20 nt, Artificial Sequence
  MKO10082571_B_Dync1i2
  gRNA
gugcucaccgacuuggagga

SEQ ID NO: 82572 - RNA, 20 nt, Artificial Sequence
  MKO10082572_B_Dync1i2
  gRNA
aagugauuuaaaagcugagu

SEQ ID NO: 82573 - RNA, 20 nt, Artificial Sequence
  MKO10082573_B_Dync1li1
  gRNA
uaaaugugcacgacgaagac

SEQ ID NO: 82574 - RNA, 20 nt, Artificial Sequence
  MKO10082574_B_Dync1li1
  gRNA
cgucgugcacauuuaaguac

SEQ ID NO: 82575 - RNA, 20 nt, Artificial Sequence
  MKO10082575_B_Dync1li1
  gRNA
gagcuuggagcgcgagcgcg

SEQ ID NO: 82576 - RNA, 20 nt, Artificial Sequence
  MKO10082576_B_Dync1li2
  gRNA
gauuauaucgagccugaaga

SEQ ID NO: 82577 - RNA, 20 nt, Artificial Sequence
  MKO10082577_B_Dync1li2
  gRNA
gguccucaucaugaacgcug

SEQ ID NO: 82578 - RNA, 20 nt, Artificial Sequence
  MKO10082578_B_Dync1li2
  gRNA
gcgaaguguccacccgugcc

SEQ ID NO: 82579 - RNA, 20 nt, Artificial Sequence
  MKO10082579_B_Dync2h1
  gRNA
agaugcagcauacgugacuc

SEQ ID NO: 82580 - RNA, 20 nt, Artificial Sequence
  MKO10082580_B_Dync2h1
  gRNA
caaacaccugucguacugcu

SEQ ID NO: 82581 - RNA, 20 nt, Artificial Sequence
  MKO10082581_B_Dync2h1
  gRNA
gucuuccuuaaguuucagcu

SEQ ID NO: 82582 - RNA, 20 nt, Artificial Sequence
  MKO10082582_B_Dync2li1
  gRNA
ggguggaggaaccuccuugc

SEQ ID NO: 82583 - RNA, 20 nt, Artificial Sequence
  MKO10082583_B_Dync2li1
  gRNA
acuuaugcagugaaacucuc

SEQ ID NO: 82584 - RNA, 20 nt, Artificial Sequence
  MKO10082584_B_Dync2li1
  gRNA
cuuaccugucaagacaccuu

SEQ ID NO: 82585 - RNA, 20 nt, Artificial Sequence
  MKO10082585_B_Dynll1
  gRNA
accagauuugaacagaagaa

SEQ ID NO: 82586 - RNA, 20 nt, Artificial Sequence
  MKO10082586_B_Dynll1
  gRNA
ggagaaguacaacaucgaga

SEQ ID NO: 82587 - RNA, 20 nt, Artificial Sequence
  MKO10082587_B_Dynll1
  gRNA
gaucaaaaaugcagacaugu

SEQ ID NO: 82588 - RNA, 20 nt, Artificial Sequence
  MKO10082588_B_Dynll2
  gRNA
ccagcuuaccuucuugauau

SEQ ID NO: 82589 - RNA, 20 nt, Artificial Sequence
  MKO10082589_B_Dynll2
  gRNA
cccacgauacaaugccaggu

SEQ ID NO: 82590 - RNA, 20 nt, Artificial Sequence
  MKO10082590_B_Dynll2
  gRNA
ugcaauccuccucuucaagu

SEQ ID NO: 82591 - RNA, 20 nt, Artificial Sequence
  MKO10082591_B_Dynlrb1
  gRNA
ugaugcccugcacuccuuuc

SEQ ID NO: 82592 - RNA, 20 nt, Artificial Sequence
  MKO10082592_B_Dynlrb1
  gRNA
aucaucguggugaacacaga

SEQ ID NO: 82593 - RNA, 20 nt, Artificial Sequence
  MKO10082593_B_Dynlrb1
  gRNA
caugcacaacuucaucuuga

SEQ ID NO: 82594 - RNA, 20 nt, Artificial Sequence
  MKO10082594_B_Dynlrb2
  gRNA
ucacagcaggucuacucaca

SEQ ID NO: 82595 - RNA, 20 nt, Artificial Sequence
  MKO10082595_B_Dynlrb2
  gRNA
acgaugguggucaaugcaga

SEQ ID NO: 82596 - RNA, 20 nt, Artificial Sequence
  MKO10082596_B_Dynlrb2
  gRNA
uuguccaggguuguucggau

SEQ ID NO: 82597 - RNA, 20 nt, Artificial Sequence
  MKO10082597_B_Dynlt1a
  gRNA
ugugugaucaugcagaagaa

SEQ ID NO: 82598 - RNA, 20 nt, Artificial Sequence
  MKO10082598_B_Dynlt1a
  gRNA
uguggagcugucccagaagc

SEQ ID NO: 82599 - RNA, 20 nt, Artificial Sequence
  MKO10082599_B_Dynlt1a
  gRNA
caggaagcugcacaguccga

SEQ ID NO: 82600 - RNA, 20 nt, Artificial Sequence
  MKO10082600_B_Dynlt1b
  gRNA
uguggagcugucccagaagc

SEQ ID NO: 82601 - RNA, 20 nt, Artificial Sequence
  MKO10082601_B_Dynlt1b
  gRNA
ugugugaucaugcagaagaa

SEQ ID NO: 82602 - RNA, 20 nt, Artificial Sequence
  MKO10082602_B_Dynlt1b
  gRNA
uggucagauggacaguccga

SEQ ID NO: 82603 - RNA, 20 nt, Artificial Sequence
  MKO10082603_B_Dynlt1c
  gRNA
uguggagcugucccagaagc

SEQ ID NO: 82604 - RNA, 20 nt, Artificial Sequence
  MKO10082604_B_Dynlt1c
  gRNA
ugugugaucaugcagaagaa

SEQ ID NO: 82605 - RNA, 20 nt, Artificial Sequence
  MKO10082605_B_Dynlt1c
  gRNA
uggucagauggacaguccga

SEQ ID NO: 82606 - RNA, 20 nt, Artificial Sequence
  MKO10082606_B_Dynlt1f
  gRNA
ugugugaucaugcagaagaa

SEQ ID NO: 82607 - RNA, 20 nt, Artificial Sequence
  MKO10082607_B_Dynlt1f
  gRNA
uguggagcugucccagaagc

SEQ ID NO: 82608 - RNA, 20 nt, Artificial Sequence
  MKO10082608_B_Dynlt1f
  gRNA
caggaagcugcacaguccga

SEQ ID NO: 82609 - RNA, 20 nt, Artificial Sequence
  MKO10082609_B_Dynlt3
  gRNA
guucucccaucugaugguac

SEQ ID NO: 82610 - RNA, 20 nt, Artificial Sequence
  MKO10082610_B_Dynlt3
  gRNA
agauguuguaucccaaaaac

SEQ ID NO: 82611 - RNA, 20 nt, Artificial Sequence
  MKO10082611_B_Dynlt3
  gRNA
caggaaccuguaccaucaga

SEQ ID NO: 82612 - RNA, 20 nt, Artificial Sequence
  MKO10082612_B_Dyrk1a
  gRNA
caagcagccgcacuucuauc

SEQ ID NO: 82613 - RNA, 20 nt, Artificial Sequence
  MKO10082613_B_Dyrk1a
  gRNA
aucaagcccagauagaagug

SEQ ID NO: 82614 - RNA, 20 nt, Artificial Sequence
  MKO10082614_B_Dyrk1a
  gRNA
gcagcauggaaugagaacga

SEQ ID NO: 82615 - RNA, 20 nt, Artificial Sequence
  MKO10082615_B_Dyrk1b
  gRNA
ggcccaacaggcgccacccc

SEQ ID NO: 82616 - RNA, 20 nt, Artificial Sequence
  MKO10082616_B_Dyrk1b
  gRNA
auggccuggugggacggcca

SEQ ID NO: 82617 - RNA, 20 nt, Artificial Sequence
  MKO10082617_B_Dyrk1b
  gRNA
cccaccauggccgucccacc

SEQ ID NO: 82618 - RNA, 20 nt, Artificial Sequence
  MKO10082618_B_Dyrk2
  gRNA
cgaccagggaucguacgugc

SEQ ID NO: 82619 - RNA, 20 nt, Artificial Sequence
  MKO10082619_B_Dyrk2
  gRNA
agcggcggccgaagguuucc

SEQ ID NO: 82620 - RNA, 20 nt, Artificial Sequence
  MKO10082620_B_Dyrk2
  gRNA
caccgccguucgccagcuuc

SEQ ID NO: 82621 - RNA, 20 nt, Artificial Sequence
  MKO10082621_B_Dyrk3
  gRNA
cguccuuccucccgcgaucg

SEQ ID NO: 82622 - RNA, 20 nt, Artificial Sequence
  MKO10082622_B_Dyrk3
  gRNA
guugcugaauguguccgaau

SEQ ID NO: 82623 - RNA, 20 nt, Artificial Sequence
  MKO10082623_B_Dyrk3
  gRNA
ccuacuuacauuuagccuuc

SEQ ID NO: 82624 - RNA, 20 nt, Artificial Sequence
  MKO10082624_B_Dyrk4
  gRNA
aaagucccucuuacaguagc

SEQ ID NO: 82625 - RNA, 20 nt, Artificial Sequence
  MKO10082625_B_Dyrk4
  gRNA
aucuuaccugcuacuguaag

SEQ ID NO: 82626 - RNA, 20 nt, Artificial Sequence
  MKO10082626_B_Dyrk4
  gRNA
gcagaguuucaccucuguga

SEQ ID NO: 82627 - RNA, 20 nt, Artificial Sequence
  MKO10082627_B_Dysf
  gRNA
uacccccguggguugcugcu

SEQ ID NO: 82628 - RNA, 20 nt, Artificial Sequence
  MKO10082628_B_Dysf
  gRNA
ccaggcaccagauccauguc

SEQ ID NO: 82629 - RNA, 20 nt, Artificial Sequence
  MKO10082629_B_Dysf
  gRNA
ggucaaggaccaugagacga

SEQ ID NO: 82630 - RNA, 20 nt, Artificial Sequence
  MKO10082630_B_Dytn
  gRNA
cagugcgcugaaacagcucc

SEQ ID NO: 82631 - RNA, 20 nt, Artificial Sequence
  MKO10082631_B_Dytn
  gRNA
ucaaaacucuucgggucaug

SEQ ID NO: 82632 - RNA, 20 nt, Artificial Sequence
  MKO10082632_B_Dytn
  gRNA
cugcuguagaucuguuagua

SEQ ID NO: 82633 - RNA, 20 nt, Artificial Sequence
  MKO10082633_B_Dyx1c1
  gRNA
acuuaccacccggcacagaa

SEQ ID NO: 82634 - RNA, 20 nt, Artificial Sequence
  MKO10082634_B_Dyx1c1
  gRNA
gcugauuugaauacugccag

SEQ ID NO: 82635 - RNA, 20 nt, Artificial Sequence
  MKO10082635_B_Dyx1c1
  gRNA
cucuaugcuccuauagauga

SEQ ID NO: 82636 - RNA, 20 nt, Artificial Sequence
  MKO10082636_B_Dzank1
  gRNA
ugucaacauauauuacaccc

SEQ ID NO: 82637 - RNA, 20 nt, Artificial Sequence
  MKO10082637_B_Dzank1
  gRNA
guuaaccuuagacggcuugc

SEQ ID NO: 82638 - RNA, 20 nt, Artificial Sequence
  MKO10082638_B_Dzank1
  gRNA
ggacuaugaaccaccgaaga

SEQ ID NO: 82639 - RNA, 20 nt, Artificial Sequence
  MKO10082639_B_Dzip1l
  gRNA
cccuuggguccacuugagcu

SEQ ID NO: 82640 - RNA, 20 nt, Artificial Sequence
  MKO10082640_B_Dzip1l
  gRNA
cacauccaacgcagacaugc

SEQ ID NO: 82641 - RNA, 20 nt, Artificial Sequence
  MKO10082641_B_Dzip1l
  gRNA
gagaaagguggcauucauga

SEQ ID NO: 82642 - RNA, 20 nt, Artificial Sequence
  MKO10082642_B_Dzip1
  gRNA
ucaugcaguucgcuucucua

SEQ ID NO: 82643 - RNA, 20 nt, Artificial Sequence
  MKO10082643_B_Dzip1
  gRNA
uugcacagaguauaauacaa

SEQ ID NO: 82644 - RNA, 20 nt, Artificial Sequence
  MKO10082644_B_Dzip1
  gRNA
cgaggugagagucuucagua

SEQ ID NO: 82645 - RNA, 20 nt, Artificial Sequence
  MKO10082645_B_Dzip3
  gRNA
uuaaaguggaaauccugaug

SEQ ID NO: 82646 - RNA, 20 nt, Artificial Sequence
  MKO10082646_B_Dzip3
  gRNA
uuucuuaccagcugagugac

SEQ ID NO: 82647 - RNA, 20 nt, Artificial Sequence
  MKO10082647_B_Dzip3
  gRNA
aaaaaauguaauguuagagc

SEQ ID NO: 82648 - RNA, 20 nt, Artificial Sequence
  MKO10082648_B_E030002O03Rik
  gRNA
gaacaguccuccagacaccc

SEQ ID NO: 82649 - RNA, 20 nt, Artificial Sequence
  MKO10082649_B_E030002O03Rik
  gRNA
cccucucacacucacuuagu

SEQ ID NO: 82650 - RNA, 20 nt, Artificial Sequence
  MKO10082650_B_E030002O03Rik
  gRNA
ugaaggauggauugucauau

SEQ ID NO: 82651 - RNA, 20 nt, Artificial Sequence
  MKO10082651_B_E030018B13Rik
  gRNA
gaggccagagaugcagaccg

SEQ ID NO: 82652 - RNA, 20 nt, Artificial Sequence
  MKO10082652_B_E030018B13Rik
  gRNA
ucuuaguuuguccuucaucc

SEQ ID NO: 82653 - RNA, 20 nt, Artificial Sequence
  MKO10082653_B_E030018B13Rik
  gRNA
cauacuuacucaaaucucca

SEQ ID NO: 82654 - RNA, 20 nt, Artificial Sequence
  MKO10082654_B_E030019B06Rik
  gRNA
ggggcucuccaugcucaacg

SEQ ID NO: 82655 - RNA, 20 nt, Artificial Sequence
  MKO10082655_B_E030019B06Rik
  gRNA
ugcugagacucugagugcac

SEQ ID NO: 82656 - RNA, 20 nt, Artificial Sequence
  MKO10082656_B_E030019B06Rik
  gRNA
gguaguccuccaugugcucc

SEQ ID NO: 82657 - RNA, 20 nt, Artificial Sequence
  MKO10082657_B_E030030I06Rik
  gRNA
agccugaaaccuguuugcuc

SEQ ID NO: 82658 - RNA, 20 nt, Artificial Sequence
  MKO10082658_B_E030030I06Rik
  gRNA
ucuaagcagagcauucauau

SEQ ID NO: 82659 - RNA, 20 nt, Artificial Sequence
  MKO10082659_B_E030030I06Rik
  gRNA
agaugaggaacaugcaaaug

SEQ ID NO: 82660 - RNA, 20 nt, Artificial Sequence
  MKO10082660_B_E130012A19Rik
  gRNA
acacuccaaguuugcgccga

SEQ ID NO: 82661 - RNA, 20 nt, Artificial Sequence
  MKO10082661_B_E130012A19Rik
  gRNA
gccggggagcucacgucgcu

SEQ ID NO: 82662 - RNA, 20 nt, Artificial Sequence
  MKO10082662_B_E130012A19Rik
  gRNA
ccgcgacgucugcauccucg

SEQ ID NO: 82663 - RNA, 20 nt, Artificial Sequence
  MKO10082663_B_E130308A19Rik
  gRNA
gugccggccaugcguaccac

SEQ ID NO: 82664 - RNA, 20 nt, Artificial Sequence
  MKO10082664_B_E130308A19Rik
  gRNA
cagaucgagcuucgcugcaa

SEQ ID NO: 82665 - RNA, 20 nt, Artificial Sequence
  MKO10082665_B_E130308A19Rik
  gRNA
gugggcccagcugaccaauu

SEQ ID NO: 82666 - RNA, 20 nt, Artificial Sequence
  MKO10082666_B_E130309D02Rik
  gRNA
cgugugucggauccccgugu

SEQ ID NO: 82667 - RNA, 20 nt, Artificial Sequence
  MKO10082667_B_E130309D02Rik
  gRNA
gcuccaccugagcguccugc

SEQ ID NO: 82668 - RNA, 20 nt, Artificial Sequence
  MKO10082668_B_E130309D02Rik
  gRNA
cggucacggacguuaugaac

SEQ ID NO: 82669 - RNA, 20 nt, Artificial Sequence
  MKO10082669_B_E130309D14Rik
  gRNA
auccaugagcgcagcuagcg

SEQ ID NO: 82670 - RNA, 20 nt, Artificial Sequence
  MKO10082670_B_E130309D14Rik
  gRNA
ccaggugcaggucucgaagc

SEQ ID NO: 82671 - RNA, 20 nt, Artificial Sequence
  MKO10082671_B_E130309D14Rik
  gRNA
ccugcuucgagaccugcacc

SEQ ID NO: 82672 - RNA, 20 nt, Artificial Sequence
  MKO10082672_B_E130309F12Rik
  gRNA
aagugauagaaaaagcucgg

SEQ ID NO: 82673 - RNA, 20 nt, Artificial Sequence
  MKO10082673_B_E130309F12Rik
  gRNA
gaggagaaaaugauccugac

SEQ ID NO: 82674 - RNA, 20 nt, Artificial Sequence
  MKO10082674_B_E130309F12Rik
  gRNA
aaugcucagagcagcauguu

SEQ ID NO: 82675 - RNA, 20 nt, Artificial Sequence
  MKO10082675_B_E130311K13Rik
  gRNA
gagccgaggucugcuccagc

SEQ ID NO: 82676 - RNA, 20 nt, Artificial Sequence
  MKO10082676_B_E130311K13Rik
  gRNA
uacuugccuuguucacuagu

SEQ ID NO: 82677 - RNA, 20 nt, Artificial Sequence
  MKO10082677_B_E130311K13Rik
  gRNA
uuacagcggauaacugagug

SEQ ID NO: 82678 - RNA, 20 nt, Artificial Sequence
  MKO10082678_B_E230008N13Rik
  gRNA
guucaccuauguuguccaug

SEQ ID NO: 82679 - RNA, 20 nt, Artificial Sequence
  MKO10082679_B_E230008N13Rik
  gRNA
gaaagcucgccagugcgcuc

SEQ ID NO: 82680 - RNA, 20 nt, Artificial Sequence
  MKO10082680_B_E230008N13Rik
  gRNA
ugacaugauugcuucucaag

SEQ ID NO: 82681 - RNA, 20 nt, Artificial Sequence
  MKO10082681_B_E230019M04Rik
  gRNA
ugaaauucaaauugacaucc

SEQ ID NO: 82682 - RNA, 20 nt, Artificial Sequence
  MKO10082682_B_E230019M04Rik
  gRNA
ucacagccauuccugaaccc

SEQ ID NO: 82683 - RNA, 20 nt, Artificial Sequence
  MKO10082683_B_E230019M04Rik
  gRNA
gugaugaaagugaaaacauc

SEQ ID NO: 82684 - RNA, 20 nt, Artificial Sequence
  MKO10082684_B_E230025N22Rik
  gRNA
ggucccgagccuguccaaua

SEQ ID NO: 82685 - RNA, 20 nt, Artificial Sequence
  MKO10082685_B_E230025N22Rik
  gRNA
ugccucugagcuguaccuaa

SEQ ID NO: 82686 - RNA, 20 nt, Artificial Sequence
  MKO10082686_B_E230025N22Rik
  gRNA
ugugcuuugcacucucaguc

SEQ ID NO: 82687 - RNA, 20 nt, Artificial Sequence
  MKO10082687_B_E2f1
  gRNA
ucugaccaccaaacgcuucu

SEQ ID NO: 82688 - RNA, 20 nt, Artificial Sequence
  MKO10082688_B_E2f1
  gRNA
cugcaaugcugcgaaggucc

SEQ ID NO: 82689 - RNA, 20 nt, Artificial Sequence
  MKO10082689_B_E2f1
  gRNA
aguccaagaaucauauccag

SEQ ID NO: 82690 - RNA, 20 nt, Artificial Sequence
  MKO10082690_B_E2f2
  gRNA
guccggaauucagggaccgu

SEQ ID NO: 82691 - RNA, 20 nt, Artificial Sequence
  MKO10082691_B_E2f2
  gRNA
cuucuaaccucggcccuguc

SEQ ID NO: 82692 - RNA, 20 nt, Artificial Sequence
  MKO10082692_B_E2f2
  gRNA
cauuuaccuccugagcgagu

SEQ ID NO: 82693 - RNA, 20 nt, Artificial Sequence
  MKO10082693_B_E2f3
  gRNA
acuucuuggugagcagaccg

SEQ ID NO: 82694 - RNA, 20 nt, Artificial Sequence
  MKO10082694_B_E2f3
  gRNA
ucugacuacaggcaaagcga

SEQ ID NO: 82695 - RNA, 20 nt, Artificial Sequence
  MKO10082695_B_E2f3
  gRNA
gggucuuuagaccaucugag

SEQ ID NO: 82696 - RNA, 20 nt, Artificial Sequence
  MKO10082696_B_E2f4
  gRNA
gaugucuucaugagucacgu

SEQ ID NO: 82697 - RNA, 20 nt, Artificial Sequence
  MKO10082697_B_E2f4
  gRNA
gccaucgggcaccagucuag

SEQ ID NO: 82698 - RNA, 20 nt, Artificial Sequence
  MKO10082698_B_E2f4
  gRNA
accgaugccuuccagcacgu

SEQ ID NO: 82699 - RNA, 20 nt, Artificial Sequence
  MKO10082699_B_E2f5
  gRNA
cuacauaccauuucuggaau

SEQ ID NO: 82700 - RNA, 20 nt, Artificial Sequence
  MKO10082700_B_E2f5
  gRNA
aucaauucccucuaagacau

SEQ ID NO: 82701 - RNA, 20 nt, Artificial Sequence
  MKO10082701_B_E2f5
  gRNA
gacaucugcaauugcuuuca

SEQ ID NO: 82702 - RNA, 20 nt, Artificial Sequence
  MKO10082702_B_E2f6
  gRNA
aaugccgugaauauccugau

SEQ ID NO: 82703 - RNA, 20 nt, Artificial Sequence
  MKO10082703_B_E2f6
  gRNA
acucuccgaccugucggcca

SEQ ID NO: 82704 - RNA, 20 nt, Artificial Sequence
  MKO10082704_B_E2f6
  gRNA
uucgaugccauccaagacau

SEQ ID NO: 82705 - RNA, 20 nt, Artificial Sequence
  MKO10082705_B_E2f7
  gRNA
cucauccacagcgccgucac

SEQ ID NO: 82706 - RNA, 20 nt, Artificial Sequence
  MKO10082706_B_E2f7
  gRNA
agucgcugcaucuggucagc

SEQ ID NO: 82707 - RNA, 20 nt, Artificial Sequence
  MKO10082707_B_E2f7
  gRNA
cauacugauucuuagccacc

SEQ ID NO: 82708 - RNA, 20 nt, Artificial Sequence
  MKO10082708_B_E2f8
  gRNA
cccccugcauccguccucga

SEQ ID NO: 82709 - RNA, 20 nt, Artificial Sequence
  MKO10082709_B_E2f8
  gRNA
cgcguaaggacuugucuuug

SEQ ID NO: 82710 - RNA, 20 nt, Artificial Sequence
  MKO10082710_B_E2f8
  gRNA
ggaagaccacguggaagauc

SEQ ID NO: 82711 - RNA, 20 nt, Artificial Sequence
  MKO10082711_B_E330009J07Rik
  gRNA
uacauauagcggugaauaga

SEQ ID NO: 82712 - RNA, 20 nt, Artificial Sequence
  MKO10082712_B_E330009J07Rik
  gRNA
gccagaugagaguaaugucc

SEQ ID NO: 82713 - RNA, 20 nt, Artificial Sequence
  MKO10082713_B_E330009J07Rik
  gRNA
gaguucaagucuauggccag

SEQ ID NO: 82714 - RNA, 20 nt, Artificial Sequence
  MKO10082714_B_E330014E10Rik
  gRNA
ccacaggaggccaaaacuuc

SEQ ID NO: 82715 - RNA, 20 nt, Artificial Sequence
  MKO10082715_B_E330014E10Rik
  gRNA
uauccauguuuacugcaaac

SEQ ID NO: 82716 - RNA, 20 nt, Artificial Sequence
  MKO10082716_B_E330014E10Rik
  gRNA
ccuaauuucacagacagacu

SEQ ID NO: 82717 - RNA, 20 nt, Artificial Sequence
  MKO10082717_B_E330017A01Rik
  gRNA
accuaaaagugccuuacuaa

SEQ ID NO: 82718 - RNA, 20 nt, Artificial Sequence
  MKO10082718_B_E330017A01Rik
  gRNA
gugguggcuuuaugaucucc

SEQ ID NO: 82719 - RNA, 20 nt, Artificial Sequence
  MKO10082719_B_E330017A01Rik
  gRNA
cacgacgugcagcagccuuu

SEQ ID NO: 82720 - RNA, 20 nt, Artificial Sequence
  MKO10082720_B_E330021D16Rik
  gRNA
cgaguccuacccaucuucac

SEQ ID NO: 82721 - RNA, 20 nt, Artificial Sequence
  MKO10082721_B_E330021D16Rik
  gRNA
ucucuguacaagcaacuauc

SEQ ID NO: 82722 - RNA, 20 nt, Artificial Sequence
  MKO10082722_B_E330021D16Rik
  gRNA
aacacgacucgaacaaaugg

SEQ ID NO: 82723 - RNA, 20 nt, Artificial Sequence
  MKO10082723_B_E330034G19Rik
  gRNA
ucacagcugcagaccugaac

SEQ ID NO: 82724 - RNA, 20 nt, Artificial Sequence
  MKO10082724_B_E330034G19Rik
  gRNA
agcaauuccuccguucuuuc

SEQ ID NO: 82725 - RNA, 20 nt, Artificial Sequence
  MKO10082725_B_E330034G19Rik
  gRNA
aaaacagcaguauuacuuug

SEQ ID NO: 82726 - RNA, 20 nt, Artificial Sequence
  MKO10082726_B_E430018J23Rik
  gRNA
cagagcgaugcgugaaagcu

SEQ ID NO: 82727 - RNA, 20 nt, Artificial Sequence
  MKO10082727_B_E430018J23Rik
  gRNA
acaaaccagcgcucaucugc

SEQ ID NO: 82728 - RNA, 20 nt, Artificial Sequence
  MKO10082728_B_E430018J23Rik
  gRNA
uccacccagcagaugagcgc

SEQ ID NO: 82729 - RNA, 20 nt, Artificial Sequence
  MKO10082729_B_E430025E21Rik
  gRNA
uaccucgaugaccucaauga

SEQ ID NO: 82730 - RNA, 20 nt, Artificial Sequence
  MKO10082730_B_E430025E21Rik
  gRNA
ugugaagcccuguacuuaua

SEQ ID NO: 82731 - RNA, 20 nt, Artificial Sequence
  MKO10082731_B_E430025E21Rik
  gRNA
aauacauuguagacuuaaac

SEQ ID NO: 82732 - RNA, 20 nt, Artificial Sequence
  MKO10082732_B_E4f1
  gRNA
ccaaguggaauucacugccu

SEQ ID NO: 82733 - RNA, 20 nt, Artificial Sequence
  MKO10082733_B_E4f1
  gRNA
ucugccaucucgacaucccc

SEQ ID NO: 82734 - RNA, 20 nt, Artificial Sequence
  MKO10082734_B_E4f1
  gRNA
ccaaggcagugaauuccacu

SEQ ID NO: 82735 - RNA, 20 nt, Artificial Sequence
  MKO10082735_B_EU599041
  gRNA
augacacugauuuauuuaua

SEQ ID NO: 82736 - RNA, 20 nt, Artificial Sequence
  MKO10082736_B_EU599041
  gRNA
uuguaaagucucuucugaga

SEQ ID NO: 82737 - RNA, 20 nt, Artificial Sequence
  MKO10082737_B_EU599041
  gRNA
augugcauguacacuucacu

SEQ ID NO: 82738 - RNA, 20 nt, Artificial Sequence
  MKO10082738_B_Eaf1
  gRNA
gggguccacgccgccaauga

SEQ ID NO: 82739 - RNA, 20 nt, Artificial Sequence
  MKO10082739_B_Eaf1
  gRNA
gcugcugcuccauucgagcu

SEQ ID NO: 82740 - RNA, 20 nt, Artificial Sequence
  MKO10082740_B_Eaf1
  gRNA
caguaaaauccaagcucgaa

SEQ ID NO: 82741 - RNA, 20 nt, Artificial Sequence
  MKO10082741_B_Eaf2
  gRNA
agcaaauguggaaucugccu

SEQ ID NO: 82742 - RNA, 20 nt, Artificial Sequence
  MKO10082742_B_Eaf2
  gRNA
ugagucagaaagcgacagug

SEQ ID NO: 82743 - RNA, 20 nt, Artificial Sequence
  MKO10082743_B_Eaf2
  gRNA
caagaaguaucaauagaagc

SEQ ID NO: 82744 - RNA, 20 nt, Artificial Sequence
  MKO10082744_B_Eapp
  gRNA
acaggcuguuguuucugacg

SEQ ID NO: 82745 - RNA, 20 nt, Artificial Sequence
  MKO10082745_B_Eapp
  gRNA
ccuggguugacgccaagagg

SEQ ID NO: 82746 - RNA, 20 nt, Artificial Sequence
  MKO10082746_B_Eapp
  gRNA
gguuugguagggucuucuuc

SEQ ID NO: 82747 - RNA, 20 nt, Artificial Sequence
  MKO10082747_B_Ear10
  gRNA
auuugccuccugcugcugcu

SEQ ID NO: 82748 - RNA, 20 nt, Artificial Sequence
  MKO10082748_B_Ear10
  gRNA
aaugucccauccaagugaac

SEQ ID NO: 82749 - RNA, 20 nt, Artificial Sequence
  MKO10082749_B_Ear10
  gRNA
auucgggacucaagcagcuu

SEQ ID NO: 82750 - RNA, 20 nt, Artificial Sequence
  MKO10082750_B_Ear11
  gRNA
auugucaugauaguucaaau

SEQ ID NO: 82751 - RNA, 20 nt, Artificial Sequence
  MKO10082751_B_Ear11
  gRNA
cacuccuguguaacuguuaa

SEQ ID NO: 82752 - RNA, 20 nt, Artificial Sequence
  MKO10082752_B_Ear11
  gRNA
aggcucuguuauagauaugc

SEQ ID NO: 82753 - RNA, 20 nt, Artificial Sequence
  MKO10082753_B_Ear12
  gRNA
cuguaaccccagaacuccac

SEQ ID NO: 82754 - RNA, 20 nt, Artificial Sequence
  MKO10082754_B_Ear12
  gRNA
aaugucccauccaagugaac

SEQ ID NO: 82755 - RNA, 20 nt, Artificial Sequence
  MKO10082755_B_Ear12
  gRNA
cuuugucuccugcugcugcu

SEQ ID NO: 82756 - RNA, 20 nt, Artificial Sequence
  MKO10082756_B_Ear14
  gRNA
ggugcuauuauagauauacu

SEQ ID NO: 82757 - RNA, 20 nt, Artificial Sequence
  MKO10082757_B_Ear14
  gRNA
cccucauuacagcaucacau

SEQ ID NO: 82758 - RNA, 20 nt, Artificial Sequence
  MKO10082758_B_Ear14
  gRNA
ucugggaaaggauuugugcc

SEQ ID NO: 82759 - RNA, 20 nt, Artificial Sequence
  MKO10082759_B_Ear1
  gRNA
cuuugucuccugcugcugcu

SEQ ID NO: 82760 - RNA, 20 nt, Artificial Sequence
  MKO10082760_B_Ear1
  gRNA
aaugucccauccaagugaac

SEQ ID NO: 82761 - RNA, 20 nt, Artificial Sequence
  MKO10082761_B_Ear1
  gRNA
agucgggacucaagcagcuu

SEQ ID NO: 82762 - RNA, 20 nt, Artificial Sequence
  MKO10082762_B_Ear2
  gRNA
cuguaaccccagaacuccac

SEQ ID NO: 82763 - RNA, 20 nt, Artificial Sequence
  MKO10082763_B_Ear2
  gRNA
aaugucccauccaagugaac

SEQ ID NO: 82764 - RNA, 20 nt, Artificial Sequence
  MKO10082764_B_Ear2
  gRNA
cuuugucuccugcugcugcu

SEQ ID NO: 82765 - RNA, 20 nt, Artificial Sequence
  MKO10082765_B_Ear3
  gRNA
cuguaaccccagaacuccac

SEQ ID NO: 82766 - RNA, 20 nt, Artificial Sequence
  MKO10082766_B_Ear3
  gRNA
aaugucccauccaagugaac

SEQ ID NO: 82767 - RNA, 20 nt, Artificial Sequence
  MKO10082767_B_Ear3
  gRNA
cuuugucuccugcugcugcu

SEQ ID NO: 82768 - RNA, 20 nt, Artificial Sequence
  MKO10082768_B_Ear4
  gRNA
ggugcuauuauagauauacu

SEQ ID NO: 82769 - RNA, 20 nt, Artificial Sequence
  MKO10082769_B_Ear4
  gRNA
cccucauuacagcaucacau

SEQ ID NO: 82770 - RNA, 20 nt, Artificial Sequence
  MKO10082770_B_Ear4
  gRNA
ucugggaaaggauuugugcc

SEQ ID NO: 82771 - RNA, 20 nt, Artificial Sequence
  MKO10082771_B_Ear5
  gRNA
gcuggcaugagacaagcguu

SEQ ID NO: 82772 - RNA, 20 nt, Artificial Sequence
  MKO10082772_B_Ear5
  gRNA
ucccaccuauccaguaguuc

SEQ ID NO: 82773 - RNA, 20 nt, Artificial Sequence
  MKO10082773_B_Ear5
  gRNA
ccacccaagacuugcaaaga

SEQ ID NO: 82774 - RNA, 20 nt, Artificial Sequence
  MKO10082774_B_Ear6
  gRNA
uggcuuuauaagugauaugc

SEQ ID NO: 82775 - RNA, 20 nt, Artificial Sequence
  MKO10082775_B_Ear6
  gRNA
ccaauguaauguugaaaugc

SEQ ID NO: 82776 - RNA, 20 nt, Artificial Sequence
  MKO10082776_B_Ear6
  gRNA
guauuuaagcccuuacaucu

SEQ ID NO: 82777 - RNA, 20 nt, Artificial Sequence
  MKO10082777_B_Ear7
  gRNA
uggcuuuauaagugauaugc

SEQ ID NO: 82778 - RNA, 20 nt, Artificial Sequence
  MKO10082778_B_Ear7
  gRNA
ccaauguaauguugaaaugc

SEQ ID NO: 82779 - RNA, 20 nt, Artificial Sequence
  MKO10082779_B_Ear7
  gRNA
guauuuaagcccuuacaucu

SEQ ID NO: 82780 - RNA, 20 nt, Artificial Sequence
  MKO10082780_B_Ears2
  gRNA
ugcuauccgcuuccgucuag

SEQ ID NO: 82781 - RNA, 20 nt, Artificial Sequence
  MKO10082781_B_Ears2
  gRNA
aggggcagaugagcaaaucg

SEQ ID NO: 82782 - RNA, 20 nt, Artificial Sequence
  MKO10082782_B_Ears2
  gRNA
uucagaagcuccagccgcug

SEQ ID NO: 82783 - RNA, 20 nt, Artificial Sequence
  MKO10082783_B_Ebag9
  gRNA
guuucuuucagaucuggcag

SEQ ID NO: 82784 - RNA, 20 nt, Artificial Sequence
  MKO10082784_B_Ebag9
  gRNA
aauuaggugacuuagauaca

SEQ ID NO: 82785 - RNA, 20 nt, Artificial Sequence
  MKO10082785_B_Ebag9
  gRNA
uuguguagcugccaaucuac

SEQ ID NO: 82786 - RNA, 20 nt, Artificial Sequence
  MKO10082786_B_Ebf1
  gRNA
ucucgugugugagcaauacu

SEQ ID NO: 82787 - RNA, 20 nt, Artificial Sequence
  MKO10082787_B_Ebf1
  gRNA
cgacagacagggccagcccg

SEQ ID NO: 82788 - RNA, 20 nt, Artificial Sequence
  MKO10082788_B_Ebf1
  gRNA
cccagggauacggacagaac

SEQ ID NO: 82789 - RNA, 20 nt, Artificial Sequence
  MKO10082789_B_Ebf2
  gRNA
gccacuuaccguugcuguaa

SEQ ID NO: 82790 - RNA, 20 nt, Artificial Sequence
  MKO10082790_B_Ebf2
  gRNA
cagaguucugcugacacacg

SEQ ID NO: 82791 - RNA, 20 nt, Artificial Sequence
  MKO10082791_B_Ebf2
  gRNA
gauugagcgcacagccuucg

SEQ ID NO: 82792 - RNA, 20 nt, Artificial Sequence
  MKO10082792_B_Ebf3
  gRNA
cuuguagugaaugccguugu

SEQ ID NO: 82793 - RNA, 20 nt, Artificial Sequence
  MKO10082793_B_Ebf3
  gRNA
guuuggucauugaaucuaug

SEQ ID NO: 82794 - RNA, 20 nt, Artificial Sequence
  MKO10082794_B_Ebf3
  gRNA
cauagauucaaugaccaaac

SEQ ID NO: 82795 - RNA, 20 nt, Artificial Sequence
  MKO10082795_B_Ebf4
  gRNA
agucaauaaggcgcacguag

SEQ ID NO: 82796 - RNA, 20 nt, Artificial Sequence
  MKO10082796_B_Ebf4
  gRNA
cauuauuauacaccagccga

SEQ ID NO: 82797 - RNA, 20 nt, Artificial Sequence
  MKO10082797_B_Ebf4
  gRNA
uccccaggcuaucaucuaug

SEQ ID NO: 82798 - RNA, 20 nt, Artificial Sequence
  MKO10082798_B_Ebi3
  gRNA
gugaaagucguggcuucaau

SEQ ID NO: 82799 - RNA, 20 nt, Artificial Sequence
  MKO10082799_B_Ebi3
  gRNA
cguccuucauugccacuuac

SEQ ID NO: 82800 - RNA, 20 nt, Artificial Sequence
  MKO10082800_B_Ebi3
  gRNA
cguggagaacaggugcacgu

SEQ ID NO: 82801 - RNA, 20 nt, Artificial Sequence
  MKO10082801_B_Ebna1bp2
  gRNA
agcuccaagucccuacgaag

SEQ ID NO: 82802 - RNA, 20 nt, Artificial Sequence
  MKO10082802_B_Ebna1bp2
  gRNA
aauucagacgggaucuggag

SEQ ID NO: 82803 - RNA, 20 nt, Artificial Sequence
  MKO10082803_B_Ebna1bp2
  gRNA
ucuagcacgacauugagacc

SEQ ID NO: 82804 - RNA, 20 nt, Artificial Sequence
  MKO10082804_B_Ebpl
  gRNA
ugaucccaccguugugucuu

SEQ ID NO: 82805 - RNA, 20 nt, Artificial Sequence
  MKO10082805_B_Ebpl
  gRNA
caggcccagcgcgcacccua

SEQ ID NO: 82806 - RNA, 20 nt, Artificial Sequence
  MKO10082806_B_Ebpl
  gRNA
ucuucgcuaaauuagccucu

SEQ ID NO: 82807 - RNA, 20 nt, Artificial Sequence
  MKO10082807_B_Ebp
  gRNA
ugacagcuucgucgucugua

SEQ ID NO: 82808 - RNA, 20 nt, Artificial Sequence
  MKO10082808_B_Ebp
  gRNA
acagcacauccccguauauc

SEQ ID NO: 82809 - RNA, 20 nt, Artificial Sequence
  MKO10082809_B_Ebp
  gRNA
gaaaggcaaucacuacccau

SEQ ID NO: 82810 - RNA, 20 nt, Artificial Sequence
  MKO10082810_B_Ecd
  gRNA
acccuguuggcacuguuauc

SEQ ID NO: 82811 - RNA, 20 nt, Artificial Sequence
  MKO10082811_B_Ecd
  gRNA
ugugcauuauuccugugccg

SEQ ID NO: 82812 - RNA, 20 nt, Artificial Sequence
  MKO10082812_B_Ecd
  gRNA
agauuauacucaaagcuugc

SEQ ID NO: 82813 - RNA, 20 nt, Artificial Sequence
  MKO10082813_B_Ece1
  gRNA
cuggugacgcuucuggcggc

SEQ ID NO: 82814 - RNA, 20 nt, Artificial Sequence
  MKO10082814_B_Ece1
  gRNA
ugcaccuacuugucugguac

SEQ ID NO: 82815 - RNA, 20 nt, Artificial Sequence
  MKO10082815_B_Ece1
  gRNA
gugcgugcaugaacgaaacu

SEQ ID NO: 82816 - RNA, 20 nt, Artificial Sequence
  MKO10082816_B_Ece2
  gRNA
guccagugcucgaacaucca

SEQ ID NO: 82817 - RNA, 20 nt, Artificial Sequence
  MKO10082817_B_Ece2
  gRNA
guaagccgguugcuaguucc

SEQ ID NO: 82818 - RNA, 20 nt, Artificial Sequence
  MKO10082818_B_Ece2
  gRNA
augcucaaucccguuaugac

SEQ ID NO: 82819 - RNA, 20 nt, Artificial Sequence
  MKO10082819_B_Ecel1
  gRNA
cacucuccucgucuugagcu

SEQ ID NO: 82820 - RNA, 20 nt, Artificial Sequence
  MKO10082820_B_Ecel1
  gRNA
ccuguaccuagcucaagacg

SEQ ID NO: 82821 - RNA, 20 nt, Artificial Sequence
  MKO10082821_B_Ecel1
  gRNA
cagagucacuuuguuguacg

SEQ ID NO: 82822 - RNA, 20 nt, Artificial Sequence
  MKO10082822_B_Ech1
  gRNA
uucuccacgugcagcuaaac

SEQ ID NO: 82823 - RNA, 20 nt, Artificial Sequence
  MKO10082823_B_Ech1
  gRNA
gccaaugcagccuccgugaa

SEQ ID NO: 82824 - RNA, 20 nt, Artificial Sequence
  MKO10082824_B_Ech1
  gRNA
cacggagguaccaggcuaug

SEQ ID NO: 82825 - RNA, 20 nt, Artificial Sequence
  MKO10082825_B_Echdc1
  gRNA
acacguuaacaagauuuaug

SEQ ID NO: 82826 - RNA, 20 nt, Artificial Sequence
  MKO10082826_B_Echdc1
  gRNA
gggaaaggccucauuaucca

SEQ ID NO: 82827 - RNA, 20 nt, Artificial Sequence
  MKO10082827_B_Echdc1
  gRNA
ugucaugaugcuacaacuuu

SEQ ID NO: 82828 - RNA, 20 nt, Artificial Sequence
  MKO10082828_B_Echdc2
  gRNA
cgaggccugaugagugagau

SEQ ID NO: 82829 - RNA, 20 nt, Artificial Sequence
  MKO10082829_B_Echdc2
  gRNA
ucucaccgaucucacucauc

SEQ ID NO: 82830 - RNA, 20 nt, Artificial Sequence
  MKO10082830_B_Echdc2
  gRNA
cuugcuggucuucccgaagc

SEQ ID NO: 82831 - RNA, 20 nt, Artificial Sequence
  MKO10082831_B_Echdc3
  gRNA
ggccagcugugauauugcug

SEQ ID NO: 82832 - RNA, 20 nt, Artificial Sequence
  MKO10082832_B_Echdc3
  gRNA
aaaaguccaacauucacucc

SEQ ID NO: 82833 - RNA, 20 nt, Artificial Sequence
  MKO10082833_B_Echdc3
  gRNA
acauugucuuaagcaauccc

SEQ ID NO: 82834 - RNA, 20 nt, Artificial Sequence
  MKO10082834_B_Echs1
  gRNA
cuagcgauuugccgacugcu

SEQ ID NO: 82835 - RNA, 20 nt, Artificial Sequence
  MKO10082835_B_Echs1
  gRNA
gcacucaaugcacuuugcaa

SEQ ID NO: 82836 - RNA, 20 nt, Artificial Sequence
  MKO10082836_B_Echs1
  gRNA
ccauugacagcugcgaugac

SEQ ID NO: 82837 - RNA, 20 nt, Artificial Sequence
  MKO10082837_B_Eci1
  gRNA
ggcagacacuaagaucaugu

SEQ ID NO: 82838 - RNA, 20 nt, Artificial Sequence
  MKO10082838_B_Eci1
  gRNA
gggaagcgguggacggcgcg

SEQ ID NO: 82839 - RNA, 20 nt, Artificial Sequence
  MKO10082839_B_Eci1
  gRNA
gacaaccccaaauauacuau

SEQ ID NO: 82840 - RNA, 20 nt, Artificial Sequence
  MKO10082840_B_Eci2
  gRNA
cuuugaaaaugcauugaacc

SEQ ID NO: 82841 - RNA, 20 nt, Artificial Sequence
  MKO10082841_B_Eci2
  gRNA
cagcacugauaacacuguca

SEQ ID NO: 82842 - RNA, 20 nt, Artificial Sequence
  MKO10082842_B_Eci2
  gRNA
gagauccacauaguucugcc

SEQ ID NO: 82843 - RNA, 20 nt, Artificial Sequence
  MKO10082843_B_Eci3
  gRNA
agacagcaucaaauagugcc

SEQ ID NO: 82844 - RNA, 20 nt, Artificial Sequence
  MKO10082844_B_Eci3
  gRNA
uauagacuuuccgaagccuc

SEQ ID NO: 82845 - RNA, 20 nt, Artificial Sequence
  MKO10082845_B_Eci3
  gRNA
gagauccacauaguucuucc

SEQ ID NO: 82846 - RNA, 20 nt, Artificial Sequence
  MKO10082846_B_Ecm1
  gRNA
ccccgacucaccucccucag

SEQ ID NO: 82847 - RNA, 20 nt, Artificial Sequence
  MKO10082847_B_Ecm1
  gRNA
cuaaacccuaauguagauaa

SEQ ID NO: 82848 - RNA, 20 nt, Artificial Sequence
  MKO10082848_B_Ecm1
  gRNA
ucucaccuucauggaggugc

SEQ ID NO: 82849 - RNA, 20 nt, Artificial Sequence
  MKO10082849_B_Ecm2
  gRNA
agcaccagaaguaacgaacc

SEQ ID NO: 82850 - RNA, 20 nt, Artificial Sequence
  MKO10082850_B_Ecm2
  gRNA
gaauucgaucaucuccauuc

SEQ ID NO: 82851 - RNA, 20 nt, Artificial Sequence
  MKO10082851_B_Ecm2
  gRNA
gaaguuaaugcgucugaaca

SEQ ID NO: 82852 - RNA, 20 nt, Artificial Sequence
  MKO10082852_B_Ecscr
  gRNA
aucagagucagugcuaacug

SEQ ID NO: 82853 - RNA, 20 nt, Artificial Sequence
  MKO10082853_B_Ecscr
  gRNA
uuauccauggugcuugaccu

SEQ ID NO: 82854 - RNA, 20 nt, Artificial Sequence
  MKO10082854_B_Ecscr
  gRNA
cacaggcugauuggauacca

SEQ ID NO: 82855 - RNA, 20 nt, Artificial Sequence
  MKO10082855_B_Ecsit
  gRNA
ugaaccacagcuucauccgc

SEQ ID NO: 82856 - RNA, 20 nt, Artificial Sequence
  MKO10082856_B_Ecsit
  gRNA
ucuuugcccagugacucgac

SEQ ID NO: 82857 - RNA, 20 nt, Artificial Sequence
  MKO10082857_B_Ecsit
  gRNA
ggggccuuaccuacaaugug

SEQ ID NO: 82858 - RNA, 20 nt, Artificial Sequence
  MKO10082858_B_Ecu2l
  gRNA
augccgaaaugcacuaaguu

SEQ ID NO: 82859 - RNA, 20 nt, Artificial Sequence
  MKO10082859_B_Ecu2l
  gRNA
augccucuuacucuugcgga

SEQ ID NO: 82860 - RNA, 20 nt, Artificial Sequence
  MKO10082860_B_Ecu2l
  gRNA
gugcagccgcucaagucagc

SEQ ID NO: 82861 - RNA, 20 nt, Artificial Sequence
  MKO10082861_B_Ecu2
  gRNA
cuuaauagaagaaaugccgc

SEQ ID NO: 82862 - RNA, 20 nt, Artificial Sequence
  MKO10082862_B_Ecu2
  gRNA
gcgucuacuucaaauguuga

SEQ ID NO: 82863 - RNA, 20 nt, Artificial Sequence
  MKO10082863_B_Ecu2
  gRNA
gccaagcuaguuaucucaga

SEQ ID NO: 82864 - RNA, 20 nt, Artificial Sequence
  MKO10082864_B_Eda2r
  gRNA
aggagauucguugcaauaug

SEQ ID NO: 82865 - RNA, 20 nt, Artificial Sequence
  MKO10082865_B_Eda2r
  gRNA
cuaccuucacuaagcucaac

SEQ ID NO: 82866 - RNA, 20 nt, Artificial Sequence
  MKO10082866_B_Eda2r
  gRNA
cccgaaaguauaaaagcacu

SEQ ID NO: 82867 - RNA, 20 nt, Artificial Sequence
  MKO10082867_B_Edaradd
  gRNA
guucuuaccuuuagggaggc

SEQ ID NO: 82868 - RNA, 20 nt, Artificial Sequence
  MKO10082868_B_Edaradd
  gRNA
cauggcaaaggauaaagugc

SEQ ID NO: 82869 - RNA, 20 nt, Artificial Sequence
  MKO10082869_B_Edaradd
  gRNA
cuucccagaucacauggcaa

SEQ ID NO: 82870 - RNA, 20 nt, Artificial Sequence
  MKO10082870_B_Edar
  gRNA
gaauaccacaaccagacuac

SEQ ID NO: 82871 - RNA, 20 nt, Artificial Sequence
  MKO10082871_B_Edar
  gRNA
gaccaugccauagauguucc

SEQ ID NO: 82872 - RNA, 20 nt, Artificial Sequence
  MKO10082872_B_Edar
  gRNA
guauucguucucaccacagu

SEQ ID NO: 82873 - RNA, 20 nt, Artificial Sequence
  MKO10082873_B_Eda
  gRNA
ccugggcccaacggcccccc

SEQ ID NO: 82874 - RNA, 20 nt, Artificial Sequence
  MKO10082874_B_Eda
  gRNA
gcaggugcugcugauaaaac

SEQ ID NO: 82875 - RNA, 20 nt, Artificial Sequence
  MKO10082875_B_Eda
  gRNA
cgcaauaagagaagcaaaag

SEQ ID NO: 82876 - RNA, 20 nt, Artificial Sequence
  MKO10082876_B_Edc3
  gRNA
uaccuagcaggacguucauu

SEQ ID NO: 82877 - RNA, 20 nt, Artificial Sequence
  MKO10082877_B_Edc3
  gRNA
caucucaagucuccgcucua

SEQ ID NO: 82878 - RNA, 20 nt, Artificial Sequence
  MKO10082878_B_Edc3
  gRNA
cucuccuuggaggacccaac

SEQ ID NO: 82879 - RNA, 20 nt, Artificial Sequence
  MKO10082879_B_Edc4
  gRNA
ccuaauggcguaugccaaga

SEQ ID NO: 82880 - RNA, 20 nt, Artificial Sequence
  MKO10082880_B_Edc4
  gRNA
gaugacagcuccaccugcau

SEQ ID NO: 82881 - RNA, 20 nt, Artificial Sequence
  MKO10082881_B_Edc4
  gRNA
agccugucgccaaguaugac

SEQ ID NO: 82882 - RNA, 20 nt, Artificial Sequence
  MKO10082882_B_Eddm3b
  gRNA
agacucccauuaagguccuc

SEQ ID NO: 82883 - RNA, 20 nt, Artificial Sequence
  MKO10082883_B_Eddm3b
  gRNA
cgacagcauagaggacauaa

SEQ ID NO: 82884 - RNA, 20 nt, Artificial Sequence
  MKO10082884_B_Eddm3b
  gRNA
cauacccaucagcauugcaa

SEQ ID NO: 82885 - RNA, 20 nt, Artificial Sequence
  MKO10082885_B_Edem1
  gRNA
agaaccggcccccgcugugc

SEQ ID NO: 82886 - RNA, 20 nt, Artificial Sequence
  MKO10082886_B_Edem1
  gRNA
cucaauugucaugucaccaa

SEQ ID NO: 82887 - RNA, 20 nt, Artificial Sequence
  MKO10082887_B_Edem1
  gRNA
gagucagagaguaauucccu

SEQ ID NO: 82888 - RNA, 20 nt, Artificial Sequence
  MKO10082888_B_Edem2
  gRNA
ucugacgcuaauugaugccc

SEQ ID NO: 82889 - RNA, 20 nt, Artificial Sequence
  MKO10082889_B_Edem2
  gRNA
guguucgaaaccaacauccg

SEQ ID NO: 82890 - RNA, 20 nt, Artificial Sequence
  MKO10082890_B_Edem2
  gRNA
gcagcccggaaacuccuccc

SEQ ID NO: 82891 - RNA, 20 nt, Artificial Sequence
  MKO10082891_B_Edem3
  gRNA
ucaugcuuauggcaacuaua

SEQ ID NO: 82892 - RNA, 20 nt, Artificial Sequence
  MKO10082892_B_Edem3
  gRNA
ccagguauuaaacaaaacua

SEQ ID NO: 82893 - RNA, 20 nt, Artificial Sequence
  MKO10082893_B_Edem3
  gRNA
ccaaagaaucaaucaguguu

SEQ ID NO: 82894 - RNA, 20 nt, Artificial Sequence
  MKO10082894_B_Edf1
  gRNA
ucaccguggccagguccuuc

SEQ ID NO: 82895 - RNA, 20 nt, Artificial Sequence
  MKO10082895_B_Edf1
  gRNA
ucgucgcugagccgcuaaga

SEQ ID NO: 82896 - RNA, 20 nt, Artificial Sequence
  MKO10082896_B_Edf1
  gRNA
aaaacacagccaagcucgac

SEQ ID NO: 82897 - RNA, 20 nt, Artificial Sequence
  MKO10082897_B_Edil3
  gRNA
cauauuccgccauuucugca

SEQ ID NO: 82898 - RNA, 20 nt, Artificial Sequence
  MKO10082898_B_Edil3
  gRNA
ccaccucaccuuugccgaac

SEQ ID NO: 82899 - RNA, 20 nt, Artificial Sequence
  MKO10082899_B_Edil3
  gRNA
uccgaacugcucuaguguug

SEQ ID NO: 82900 - RNA, 20 nt, Artificial Sequence
  MKO10082900_B_Edn1
  gRNA
gacacacuccuuguccauca

SEQ ID NO: 82901 - RNA, 20 nt, Artificial Sequence
  MKO10082901_B_Edn1
  gRNA
ugccuugaugcuauugcuga

SEQ ID NO: 82902 - RNA, 20 nt, Artificial Sequence
  MKO10082902_B_Edn1
  gRNA
gauacacuucuuucccaacu

SEQ ID NO: 82903 - RNA, 20 nt, Artificial Sequence
  MKO10082903_B_Edn2
  gRNA
gccucggcccuugggugccg

SEQ ID NO: 82904 - RNA, 20 nt, Artificial Sequence
  MKO10082904_B_Edn2
  gRNA
gcguugugagugcucuacug

SEQ ID NO: 82905 - RNA, 20 nt, Artificial Sequence
  MKO10082905_B_Edn2
  gRNA
uagccuggcaaagcggagcu

SEQ ID NO: 82906 - RNA, 20 nt, Artificial Sequence
  MKO10082906_B_Edn3
  gRNA
cugcacgugcuucacuuaca

SEQ ID NO: 82907 - RNA, 20 nt, Artificial Sequence
  MKO10082907_B_Edn3
  gRNA
gaacgggcaccaggcagguc

SEQ ID NO: 82908 - RNA, 20 nt, Artificial Sequence
  MKO10082908_B_Edn3
  gRNA
ccugucuucaccuuugacgu

SEQ ID NO: 82909 - RNA, 20 nt, Artificial Sequence
  MKO10082909_B_Ednra
  gRNA
ccuuucgaccacaaugauuu

SEQ ID NO: 82910 - RNA, 20 nt, Artificial Sequence
  MKO10082910_B_Ednra
  gRNA
uugucaucuucgcccugugc

SEQ ID NO: 82911 - RNA, 20 nt, Artificial Sequence
  MKO10082911_B_Ednra
  gRNA
uugcccuuagcgucgagaag

SEQ ID NO: 82912 - RNA, 20 nt, Artificial Sequence
  MKO10082912_B_Ednrb
  gRNA
acugaacagccaccaaucuu

SEQ ID NO: 82913 - RNA, 20 nt, Artificial Sequence
  MKO10082913_B_Ednrb
  gRNA
cucuaugcaguugcucgcag

SEQ ID NO: 82914 - RNA, 20 nt, Artificial Sequence
  MKO10082914_B_Ednrb
  gRNA
ucuguuucagagacgagaag

SEQ ID NO: 82915 - RNA, 20 nt, Artificial Sequence
  MKO10082915_B_Eea1
  gRNA
guaccgugucaaagcaagac

SEQ ID NO: 82916 - RNA, 20 nt, Artificial Sequence
  MKO10082916_B_Eea1
  gRNA
aggccggucuugcuuugaca

SEQ ID NO: 82917 - RNA, 20 nt, Artificial Sequence
  MKO10082917_B_Eea1
  gRNA
agaccuacaggccucacuua

SEQ ID NO: 82918 - RNA, 20 nt, Artificial Sequence
  MKO10082918_B_Eed
  gRNA
cacccucuauuagcaguugc

SEQ ID NO: 82919 - RNA, 20 nt, Artificial Sequence
  MKO10082919_B_Eed
  gRNA
gauccagcaacugcuaauag

SEQ ID NO: 82920 - RNA, 20 nt, Artificial Sequence
  MKO10082920_B_Eed
  gRNA
acaaauacgccaaaugcacc

SEQ ID NO: 82921 - RNA, 20 nt, Artificial Sequence
  MKO10082921_B_Eef1a1
  gRNA
gccccugcgacugccccucc

SEQ ID NO: 82922 - RNA, 20 nt, Artificial Sequence
  MKO10082922_B_Eef1a1
  gRNA
agggcuccuucaaguacgcc

SEQ ID NO: 82923 - RNA, 20 nt, Artificial Sequence
  MKO10082923_B_Eef1a1
  gRNA
uugaugaagucucugugucc

SEQ ID NO: 82924 - RNA, 20 nt, Artificial Sequence
  MKO10082924_B_Eef1a2
  gRNA
aucaccaucaucgaugcucc

SEQ ID NO: 82925 - RNA, 20 nt, Artificial Sequence
  MKO10082925_B_Eef1a2
  gRNA
auucgccggggcaaugucug

SEQ ID NO: 82926 - RNA, 20 nt, Artificial Sequence
  MKO10082926_B_Eef1a2
  gRNA
ugcaagcggcgugucccugc

SEQ ID NO: 82927 - RNA, 20 nt, Artificial Sequence
  MKO10082927_B_Eef1b2
  gRNA
uccuacuagacgugaagccu

SEQ ID NO: 82928 - RNA, 20 nt, Artificial Sequence
  MKO10082928_B_Eef1b2
  gRNA
gaugacgacauugaucucuu

SEQ ID NO: 82929 - RNA, 20 nt, Artificial Sequence
  MKO10082929_B_Eef1b2
  gRNA
agcaguguagaagacaccac

SEQ ID NO: 82930 - RNA, 20 nt, Artificial Sequence
  MKO10082930_B_Eef1d
  gRNA
ccucaccgccucgaagguuc

SEQ ID NO: 82931 - RNA, 20 nt, Artificial Sequence
  MKO10082931_B_Eef1d
  gRNA
aguggugcaagauuugcagc

SEQ ID NO: 82932 - RNA, 20 nt, Artificial Sequence
  MKO10082932_B_Eef1d
  gRNA
ucacuccagccaaggauuuc

SEQ ID NO: 82933 - RNA, 20 nt, Artificial Sequence
  MKO10082933_B_Eef1e1
  gRNA
aauaucuuaaugugucucgc

SEQ ID NO: 82934 - RNA, 20 nt, Artificial Sequence
  MKO10082934_B_Eef1e1
  gRNA
ccccagcaagugcuccuuac

SEQ ID NO: 82935 - RNA, 20 nt, Artificial Sequence
  MKO10082935_B_Eef1e1
  gRNA
cuccagcagccucaacuccg

SEQ ID NO: 82936 - RNA, 20 nt, Artificial Sequence
  MKO10082936_B_Eef1g
  gRNA
uccccacucaccuugccggc

SEQ ID NO: 82937 - RNA, 20 nt, Artificial Sequence
  MKO10082937_B_Eef1g
  gRNA
ugccuuugcaguaagcaaug

SEQ ID NO: 82938 - RNA, 20 nt, Artificial Sequence
  MKO10082938_B_Eef1g
  gRNA
uguacacauacccugaaaau

SEQ ID NO: 82939 - RNA, 20 nt, Artificial Sequence
  MKO10082939_B_Eef2k
  gRNA
agacgagguucugaucaaga

SEQ ID NO: 82940 - RNA, 20 nt, Artificial Sequence
  MKO10082940_B_Eef2k
  gRNA
ucgccacagaacaugcuacu

SEQ ID NO: 82941 - RNA, 20 nt, Artificial Sequence
  MKO10082941_B_Eef2k
  gRNA
uguagguacaacgcugucac

SEQ ID NO: 82942 - RNA, 20 nt, Artificial Sequence
  MKO10082942_B_Eef2
  gRNA
cacgcucggcugcgcucagc

SEQ ID NO: 82943 - RNA, 20 nt, Artificial Sequence
  MKO10082943_B_Eef2
  gRNA
ucgcaccaugauauugccca

SEQ ID NO: 82944 - RNA, 20 nt, Artificial Sequence
  MKO10082944_B_Eef2
  gRNA
cccacucucgcccucgccgu

SEQ ID NO: 82945 - RNA, 20 nt, Artificial Sequence
  MKO10082945_B_Eefsec
  gRNA
cgccucgucaucaccuucug

SEQ ID NO: 82946 - RNA, 20 nt, Artificial Sequence
  MKO10082946_B_Eefsec
  gRNA
aggcgaucuggccaaucaca

SEQ ID NO: 82947 - RNA, 20 nt, Artificial Sequence
  MKO10082947_B_Eefsec
  gRNA
cacggugccuugacccuuga

SEQ ID NO: 82948 - RNA, 20 nt, Artificial Sequence
  MKO10082948_B_Eepd1
  gRNA
cagguaccuugaaucuggcg

SEQ ID NO: 82949 - RNA, 20 nt, Artificial Sequence
  MKO10082949_B_Eepd1
  gRNA
gaacuuugcacuaacccucc

SEQ ID NO: 82950 - RNA, 20 nt, Artificial Sequence
  MKO10082950_B_Eepd1
  gRNA
uaaccuccagcugacagccc

SEQ ID NO: 82951 - RNA, 20 nt, Artificial Sequence
  MKO10082951_B_Efcab10
  gRNA
aaaugccacguguguugccu

SEQ ID NO: 82952 - RNA, 20 nt, Artificial Sequence
  MKO10082952_B_Efcab10
  gRNA
ugaagcucccggucagccac

SEQ ID NO: 82953 - RNA, 20 nt, Artificial Sequence
  MKO10082953_B_Efcab10
  gRNA
uuuccuuaggaacaagagga

SEQ ID NO: 82954 - RNA, 20 nt, Artificial Sequence
  MKO10082954_B_Efcab11
  gRNA
ucgcaaccuuaaaguccucu

SEQ ID NO: 82955 - RNA, 20 nt, Artificial Sequence
  MKO10082955_B_Efcab11
  gRNA
accuccagcacuguccucgc

SEQ ID NO: 82956 - RNA, 20 nt, Artificial Sequence
  MKO10082956_B_Efcab11
  gRNA
ucaguaaaucccaacacuuc

SEQ ID NO: 82957 - RNA, 20 nt, Artificial Sequence
  MKO10082957_B_Efcab12
  gRNA
ccuugcuggugguuucaucg

SEQ ID NO: 82958 - RNA, 20 nt, Artificial Sequence
  MKO10082958_B_Efcab12
  gRNA
uccgccugccaaagagccgc

SEQ ID NO: 82959 - RNA, 20 nt, Artificial Sequence
  MKO10082959_B_Efcab12
  gRNA
ugggcagacgguaccgagag

SEQ ID NO: 82960 - RNA, 20 nt, Artificial Sequence
  MKO10082960_B_Efcab14
  gRNA
acugcccugcaguaacccca

SEQ ID NO: 82961 - RNA, 20 nt, Artificial Sequence
  MKO10082961_B_Efcab14
  gRNA
gagaaguuccucauuaaguu

SEQ ID NO: 82962 - RNA, 20 nt, Artificial Sequence
  MKO10082962_B_Efcab14
  gRNA
ggaggaucuggauguccuca

SEQ ID NO: 82963 - RNA, 20 nt, Artificial Sequence
  MKO10082963_B_Efcab1
  gRNA
aacaucuugcaugugacauu

SEQ ID NO: 82964 - RNA, 20 nt, Artificial Sequence
  MKO10082964_B_Efcab1
  gRNA
aaauacauuacgaucuaguc

SEQ ID NO: 82965 - RNA, 20 nt, Artificial Sequence
  MKO10082965_B_Efcab1
  gRNA
uuugaaguguuugaucugaa

SEQ ID NO: 82966 - RNA, 20 nt, Artificial Sequence
  MKO10082966_B_Efcab2
  gRNA
gagagauugggacaauuauc

SEQ ID NO: 82967 - RNA, 20 nt, Artificial Sequence
  MKO10082967_B_Efcab2
  gRNA
cgaauaauacaguagaugug

SEQ ID NO: 82968 - RNA, 20 nt, Artificial Sequence
  MKO10082968_B_Efcab2
  gRNA
uucaaaucgaauguagccag

SEQ ID NO: 82969 - RNA, 20 nt, Artificial Sequence
  MKO10082969_B_Efcab3
  gRNA
uuagauuuagcuaacaaccc

SEQ ID NO: 82970 - RNA, 20 nt, Artificial Sequence
  MKO10082970_B_Efcab3
  gRNA
aauacagccaguucuauccu

SEQ ID NO: 82971 - RNA, 20 nt, Artificial Sequence
  MKO10082971_B_Efcab3
  gRNA
cugaguccugcacaacuuga

SEQ ID NO: 82972 - RNA, 20 nt, Artificial Sequence
  MKO10082972_B_Efcab4a
  gRNA
uccacuuacgccugaacagc

SEQ ID NO: 82973 - RNA, 20 nt, Artificial Sequence
  MKO10082973_B_Efcab4a
  gRNA
gcgcggacuguaugaagaac

SEQ ID NO: 82974 - RNA, 20 nt, Artificial Sequence
  MKO10082974_B_Efcab4a
  gRNA
caacucacucgcccaggacc

SEQ ID NO: 82975 - RNA, 20 nt, Artificial Sequence
  MKO10082975_B_Efcab4b
  gRNA
gccccuaagucuagaagaau

SEQ ID NO: 82976 - RNA, 20 nt, Artificial Sequence
  MKO10082976_B_Efcab4b
  gRNA
agcagcagaucaaaagugag

SEQ ID NO: 82977 - RNA, 20 nt, Artificial Sequence
  MKO10082977_B_Efcab4b
  gRNA
gaaauugugcuucuucauca

SEQ ID NO: 82978 - RNA, 20 nt, Artificial Sequence
  MKO10082978_B_Efcab5
  gRNA
ucccgcagaguaucacuuac

SEQ ID NO: 82979 - RNA, 20 nt, Artificial Sequence
  MKO10082979_B_Efcab5
  gRNA
cucuuccuacagugcgacag

SEQ ID NO: 82980 - RNA, 20 nt, Artificial Sequence
  MKO10082980_B_Efcab5
  gRNA
auucuucugcgcuguggcac

SEQ ID NO: 82981 - RNA, 20 nt, Artificial Sequence
  MKO10082981_B_Efcab6
  gRNA
acguuacccaagcugcugau

SEQ ID NO: 82982 - RNA, 20 nt, Artificial Sequence
  MKO10082982_B_Efcab6
  gRNA
ugaguacucacuugaugaag

SEQ ID NO: 82983 - RNA, 20 nt, Artificial Sequence
  MKO10082983_B_Efcab6
  gRNA
aaaugucgauuauaccagaa

SEQ ID NO: 82984 - RNA, 20 nt, Artificial Sequence
  MKO10082984_B_Efcab7
  gRNA
uugacgccucaguuuacugu

SEQ ID NO: 82985 - RNA, 20 nt, Artificial Sequence
  MKO10082985_B_Efcab7
  gRNA
uccacuugacucagauauaa

SEQ ID NO: 82986 - RNA, 20 nt, Artificial Sequence
  MKO10082986_B_Efcab7
  gRNA
gaaauucccacuaacugaac

SEQ ID NO: 82987 - RNA, 20 nt, Artificial Sequence
  MKO10082987_B_Efcab9
  gRNA
aucuucuggaugugcaccac

SEQ ID NO: 82988 - RNA, 20 nt, Artificial Sequence
  MKO10082988_B_Efcab9
  gRNA
auucaucuauguuaagccac

SEQ ID NO: 82989 - RNA, 20 nt, Artificial Sequence
  MKO10082989_B_Efcab9
  gRNA
ucccgaucugugacuuguuc

SEQ ID NO: 82990 - RNA, 20 nt, Artificial Sequence
  MKO10082990_B_Efcc1
  gRNA
uggaguaguguccgaaucuc

SEQ ID NO: 82991 - RNA, 20 nt, Artificial Sequence
  MKO10082991_B_Efcc1
  gRNA
agauucggacacuacuccag

SEQ ID NO: 82992 - RNA, 20 nt, Artificial Sequence
  MKO10082992_B_Efcc1
  gRNA
ccuugagcgucucagcuguc

SEQ ID NO: 82993 - RNA, 20 nt, Artificial Sequence
  MKO10082993_B_Efemp1
  gRNA
ccagcugcagaagcuucguc

SEQ ID NO: 82994 - RNA, 20 nt, Artificial Sequence
  MKO10082994_B_Efemp1
  gRNA
uucuacugccagugcagucc

SEQ ID NO: 82995 - RNA, 20 nt, Artificial Sequence
  MKO10082995_B_Efemp1
  gRNA
acacaucuuugguggcaaua

SEQ ID NO: 82996 - RNA, 20 nt, Artificial Sequence
  MKO10082996_B_Efemp2
  gRNA
aaaaauuggacccgaaugug

SEQ ID NO: 82997 - RNA, 20 nt, Artificial Sequence
  MKO10082997_B_Efemp2
  gRNA
gcaugacugucgcccuaguc

SEQ ID NO: 82998 - RNA, 20 nt, Artificial Sequence
  MKO10082998_B_Efemp2
  gRNA
acaaccaaacccuugcccgc

SEQ ID NO: 82999 - RNA, 20 nt, Artificial Sequence
  MKO10082999_B_Efhb
  gRNA
gggaagcuucucagucaaac

SEQ ID NO: 83000 - RNA, 20 nt, Artificial Sequence
  MKO10083000_B_Efhb
  gRNA
guuugacugagaagcuuccc

SEQ ID NO: 83001 - RNA, 20 nt, Artificial Sequence
  MKO10083001_B_Efhb
  gRNA
cuuaguccaugugucaaaua

SEQ ID NO: 83002 - RNA, 20 nt, Artificial Sequence
  MKO10083002_B_Efhc1
  gRNA
uugucaaaagccacaugcgc

SEQ ID NO: 83003 - RNA, 20 nt, Artificial Sequence
  MKO10083003_B_Efhc1
  gRNA
auaugggagaccacuaccac

SEQ ID NO: 83004 - RNA, 20 nt, Artificial Sequence
  MKO10083004_B_Efhc1
  gRNA
aguaguaaauguucacgugg

SEQ ID NO: 83005 - RNA, 20 nt, Artificial Sequence
  MKO10083005_B_Efhc2
  gRNA
auggaaccgaugcaccaucc

SEQ ID NO: 83006 - RNA, 20 nt, Artificial Sequence
  MKO10083006_B_Efhc2
  gRNA
ucgaucccuacaugaagaug

SEQ ID NO: 83007 - RNA, 20 nt, Artificial Sequence
  MKO10083007_B_Efhc2
  gRNA
aguccacuauuuaucacuuc

SEQ ID NO: 83008 - RNA, 20 nt, Artificial Sequence
  MKO10083008_B_Efhd1
  gRNA
gugcccggcuggggcaucgc

SEQ ID NO: 83009 - RNA, 20 nt, Artificial Sequence
  MKO10083009_B_Efhd1
  gRNA
agguggaugaggacuucgac

SEQ ID NO: 83010 - RNA, 20 nt, Artificial Sequence
  MKO10083010_B_Efhd1
  gRNA
ggacggcuuuauugaccuga

SEQ ID NO: 83011 - RNA, 20 nt, Artificial Sequence
  MKO10083011_B_Efhd2
  gRNA
cgaaauccucguccaccucc

SEQ ID NO: 83012 - RNA, 20 nt, Artificial Sequence
  MKO10083012_B_Efhd2
  gRNA
gggccucaagaguaugaucc

SEQ ID NO: 83013 - RNA, 20 nt, Artificial Sequence
  MKO10083013_B_Efhd2
  gRNA
uggcucuggcuacuugaacg

SEQ ID NO: 83014 - RNA, 20 nt, Artificial Sequence
  MKO10083014_B_Efna1
  gRNA
agccaaaccuaucuaccauc

SEQ ID NO: 83015 - RNA, 20 nt, Artificial Sequence
  MKO10083015_B_Efna1
  gRNA
uuccugaugguagauagguu

SEQ ID NO: 83016 - RNA, 20 nt, Artificial Sequence
  MKO10083016_B_Efna1
  gRNA
cugugcaaaaccuguacuuc

SEQ ID NO: 83017 - RNA, 20 nt, Artificial Sequence
  MKO10083017_B_Efna2
  gRNA
ugauggcggcggcuauaccg

SEQ ID NO: 83018 - RNA, 20 nt, Artificial Sequence
  MKO10083018_B_Efna2
  gRNA
cagggucgguccacgagguu

SEQ ID NO: 83019 - RNA, 20 nt, Artificial Sequence
  MKO10083019_B_Efna2
  gRNA
gcacauaaaccuugagucgc

SEQ ID NO: 83020 - RNA, 20 nt, Artificial Sequence
  MKO10083020_B_Efna3
  gRNA
aggaggccaagagcgucaug

SEQ ID NO: 83021 - RNA, 20 nt, Artificial Sequence
  MKO10083021_B_Efna3
  gRNA
aaggcgaugcccacggccag

SEQ ID NO: 83022 - RNA, 20 nt, Artificial Sequence
  MKO10083022_B_Efna3
  gRNA
caaugugaagaucaacgugu

SEQ ID NO: 83023 - RNA, 20 nt, Artificial Sequence
  MKO10083023_B_Efna4
  gRNA
cgcguguccuccccgccacc

SEQ ID NO: 83024 - RNA, 20 nt, Artificial Sequence
  MKO10083024_B_Efna4
  gRNA
auuugcccccucugccgugc

SEQ ID NO: 83025 - RNA, 20 nt, Artificial Sequence
  MKO10083025_B_Efna4
  gRNA
gccuccgccacccaaucuac

SEQ ID NO: 83026 - RNA, 20 nt, Artificial Sequence
  MKO10083026_B_Efna5
  gRNA
gccugcgaccacacguccaa

SEQ ID NO: 83027 - RNA, 20 nt, Artificial Sequence
  MKO10083027_B_Efna5
  gRNA
agaacgcggcgcagacacca

SEQ ID NO: 83028 - RNA, 20 nt, Artificial Sequence
  MKO10083028_B_Efna5
  gRNA
ugagcgcuacguccuguaca

SEQ ID NO: 83029 - RNA, 20 nt, Artificial Sequence
  MKO10083029_B_Efnb1
  gRNA
cacauguaauguaguaaucg

SEQ ID NO: 83030 - RNA, 20 nt, Artificial Sequence
  MKO10083030_B_Efnb1
  gRNA
uuuccuacagcaacguccaa

SEQ ID NO: 83031 - RNA, 20 nt, Artificial Sequence
  MKO10083031_B_Efnb1
  gRNA
ccggcugguagucaacugcu

SEQ ID NO: 83032 - RNA, 20 nt, Artificial Sequence
  MKO10083032_B_Efnb2
  gRNA
guauaguaccaggccuuguc

SEQ ID NO: 83033 - RNA, 20 nt, Artificial Sequence
  MKO10083033_B_Efnb2
  gRNA
uuucacaucuuggucugguc

SEQ ID NO: 83034 - RNA, 20 nt, Artificial Sequence
  MKO10083034_B_Efnb2
  gRNA
uuuggagggccuggauaacc

SEQ ID NO: 83035 - RNA, 20 nt, Artificial Sequence
  MKO10083035_B_Efnb3
  gRNA
uucccgggucccgucugaug

SEQ ID NO: 83036 - RNA, 20 nt, Artificial Sequence
  MKO10083036_B_Efnb3
  gRNA
gagacggcgggccaagccuu

SEQ ID NO: 83037 - RNA, 20 nt, Artificial Sequence
  MKO10083037_B_Efnb3
  gRNA
cagaagcaccuucaugccuc

SEQ ID NO: 83038 - RNA, 20 nt, Artificial Sequence
  MKO10083038_B_Efr3a
  gRNA
acauacucgguucguauuuc

SEQ ID NO: 83039 - RNA, 20 nt, Artificial Sequence
  MKO10083039_B_Efr3a
  gRNA
gaagucauaacgucuaugau

SEQ ID NO: 83040 - RNA, 20 nt, Artificial Sequence
  MKO10083040_B_Efr3a
  gRNA
ccagagaaacucgaucgaau

SEQ ID NO: 83041 - RNA, 20 nt, Artificial Sequence
  MKO10083041_B_Efr3b
  gRNA
cucuuaccgaguuggugcca

SEQ ID NO: 83042 - RNA, 20 nt, Artificial Sequence
  MKO10083042_B_Efr3b
  gRNA
ccacucaagccacgaugacc

SEQ ID NO: 83043 - RNA, 20 nt, Artificial Sequence
  MKO10083043_B_Efr3b
  gRNA
ccagaguaucaaccucuucg

SEQ ID NO: 83044 - RNA, 20 nt, Artificial Sequence
  MKO10083044_B_Efs
  gRNA
caguguugucguacaaugcc

SEQ ID NO: 83045 - RNA, 20 nt, Artificial Sequence
  MKO10083045_B_Efs
  gRNA
aguccccucuccagcaauuc

SEQ ID NO: 83046 - RNA, 20 nt, Artificial Sequence
  MKO10083046_B_Efs
  gRNA
ggaucuagcuggaagucccg

SEQ ID NO: 83047 - RNA, 20 nt, Artificial Sequence
  MKO10083047_B_Eftud1
  gRNA
gagagucuaucagauuaauc

SEQ ID NO: 83048 - RNA, 20 nt, Artificial Sequence
  MKO10083048_B_Eftud1
  gRNA
aucaucuccagccgccuggc

SEQ ID NO: 83049 - RNA, 20 nt, Artificial Sequence
  MKO10083049_B_Eftud1
  gRNA
aucucacuacauuaugcaga

SEQ ID NO: 83050 - RNA, 20 nt, Artificial Sequence
  MKO10083050_B_Eftud2
  gRNA
cuccaucucauacaccguga

SEQ ID NO: 83051 - RNA, 20 nt, Artificial Sequence
  MKO10083051_B_Eftud2
  gRNA
agccucucaccuugccgugg

SEQ ID NO: 83052 - RNA, 20 nt, Artificial Sequence
  MKO10083052_B_Eftud2
  gRNA
aucagaaacguaaccuugug

SEQ ID NO: 83053 - RNA, 20 nt, Artificial Sequence
  MKO10083053_B_Egfbp2
  gRNA
ccccacaaauguguuccuuu

SEQ ID NO: 83054 - RNA, 20 nt, Artificial Sequence
  MKO10083054_B_Egfbp2
  gRNA
gguggcuguguacuaccaaa

SEQ ID NO: 83055 - RNA, 20 nt, Artificial Sequence
  MKO10083055_B_Egfbp2
  gRNA
ggccauuugaugugguuccu

SEQ ID NO: 83056 - RNA, 20 nt, Artificial Sequence
  MKO10083056_B_Egfem1
  gRNA
gcgucugggccgcugccaac

SEQ ID NO: 83057 - RNA, 20 nt, Artificial Sequence
  MKO10083057_B_Egfem1
  gRNA
ucaucccauuggauccaacc

SEQ ID NO: 83058 - RNA, 20 nt, Artificial Sequence
  MKO10083058_B_Egfem1
  gRNA
cauggaccccacugucaaua

SEQ ID NO: 83059 - RNA, 20 nt, Artificial Sequence
  MKO10083059_B_Egfl6
  gRNA
gguguacugaccuugagugc

SEQ ID NO: 83060 - RNA, 20 nt, Artificial Sequence
  MKO10083060_B_Egfl6
  gRNA
aacaacaagggaguaugcga

SEQ ID NO: 83061 - RNA, 20 nt, Artificial Sequence
  MKO10083061_B_Egfl6
  gRNA
guuccauacugacagacccc

SEQ ID NO: 83062 - RNA, 20 nt, Artificial Sequence
  MKO10083062_B_Egfl7
  gRNA
ccggagaacugcuuguagca

SEQ ID NO: 83063 - RNA, 20 nt, Artificial Sequence
  MKO10083063_B_Egfl7
  gRNA
acugccuaucgccguagccc

SEQ ID NO: 83064 - RNA, 20 nt, Artificial Sequence
  MKO10083064_B_Egfl7
  gRNA
cugguauacacgcugcacaa

SEQ ID NO: 83065 - RNA, 20 nt, Artificial Sequence
  MKO10083065_B_Egfl8
  gRNA
uucuaggaccacauaccgug

SEQ ID NO: 83066 - RNA, 20 nt, Artificial Sequence
  MKO10083066_B_Egfl8
  gRNA
cucgauggacgcaccugugc

SEQ ID NO: 83067 - RNA, 20 nt, Artificial Sequence
  MKO10083067_B_Egfl8
  gRNA
aacuagaugucgaugaaugc

SEQ ID NO: 83068 - RNA, 20 nt, Artificial Sequence
  MKO10083068_B_Egflam
  gRNA
ccuaaugaauuccacagagu

SEQ ID NO: 83069 - RNA, 20 nt, Artificial Sequence
  MKO10083069_B_Egflam
  gRNA
cccaauucaguccuacucug

SEQ ID NO: 83070 - RNA, 20 nt, Artificial Sequence
  MKO10083070_B_Egflam
  gRNA
guagcagccuacagucagac

SEQ ID NO: 83071 - RNA, 20 nt, Artificial Sequence
  MKO10083071_B_Egfr
  gRNA
ugaaucgcacagcaccaauc

SEQ ID NO: 83072 - RNA, 20 nt, Artificial Sequence
  MKO10083072_B_Egfr
  gRNA
ccucauugcccucaacaccg

SEQ ID NO: 83073 - RNA, 20 nt, Artificial Sequence
  MKO10083073_B_Egfr
  gRNA
cugaccgcgcucugcgccgc

SEQ ID NO: 83074 - RNA, 20 nt, Artificial Sequence
  MKO10083074_B_Egf
  gRNA
gaggacgcugcuaaggaucc

SEQ ID NO: 83075 - RNA, 20 nt, Artificial Sequence
  MKO10083075_B_Egf
  gRNA
acauccgucaaauauagcag

SEQ ID NO: 83076 - RNA, 20 nt, Artificial Sequence
  MKO10083076_B_Egf
  gRNA
gggaauaucggugcugacuc

SEQ ID NO: 83077 - RNA, 20 nt, Artificial Sequence
  MKO10083077_B_Egln1
  gRNA
cgucacguugauaacccaaa

SEQ ID NO: 83078 - RNA, 20 nt, Artificial Sequence
  MKO10083078_B_Egln1
  gRNA
cuagguacgcaauaacuguu

SEQ ID NO: 83079 - RNA, 20 nt, Artificial Sequence
  MKO10083079_B_Egln1
  gRNA
uugcaggugagaaaggugug

SEQ ID NO: 83080 - RNA, 20 nt, Artificial Sequence
  MKO10083080_B_Egln2
  gRNA
ucaccucauguggguuccgu

SEQ ID NO: 83081 - RNA, 20 nt, Artificial Sequence
  MKO10083081_B_Egln2
  gRNA
ggccauuagguagguguagu

SEQ ID NO: 83082 - RNA, 20 nt, Artificial Sequence
  MKO10083082_B_Egln2
  gRNA
acaucgagccacucuuugac

SEQ ID NO: 83083 - RNA, 20 nt, Artificial Sequence
  MKO10083083_B_Egln3
  gRNA
uggcgucccaauucuuauuc

SEQ ID NO: 83084 - RNA, 20 nt, Artificial Sequence
  MKO10083084_B_Egln3
  gRNA
acagguacgcuaugacuguc

SEQ ID NO: 83085 - RNA, 20 nt, Artificial Sequence
  MKO10083085_B_Egln3
  gRNA
cagaagccaaaaagaaauuc

SEQ ID NO: 83086 - RNA, 20 nt, Artificial Sequence
  MKO10083086_B_Egr1
  gRNA
cuauuaccgccgcugcccuc

SEQ ID NO: 83087 - RNA, 20 nt, Artificial Sequence
  MKO10083087_B_Egr1
  gRNA
ggugggcgcagccgaguaga

SEQ ID NO: 83088 - RNA, 20 nt, Artificial Sequence
  MKO10083088_B_Egr1
  gRNA
gcucauccgagcgagaaaag

SEQ ID NO: 83089 - RNA, 20 nt, Artificial Sequence
  MKO10083089_B_Egr2
  gRNA
gaccucgaaaguacccuaac

SEQ ID NO: 83090 - RNA, 20 nt, Artificial Sequence
  MKO10083090_B_Egr2
  gRNA
cagggaaacggcuuucgauc

SEQ ID NO: 83091 - RNA, 20 nt, Artificial Sequence
  MKO10083091_B_Egr2
  gRNA
cugugcgguaacagcgccau

SEQ ID NO: 83092 - RNA, 20 nt, Artificial Sequence
  MKO10083092_B_Egr3
  gRNA
cagcuucucggcgaguuugc

SEQ ID NO: 83093 - RNA, 20 nt, Artificial Sequence
  MKO10083093_B_Egr3
  gRNA
cugcguacugagcgccccug

SEQ ID NO: 83094 - RNA, 20 nt, Artificial Sequence
  MKO10083094_B_Egr3
  gRNA
gcuuggccgauugguaaucc

SEQ ID NO: 83095 - RNA, 20 nt, Artificial Sequence
  MKO10083095_B_Egr4
  gRNA
gccugcuagggacgcucccu

SEQ ID NO: 83096 - RNA, 20 nt, Artificial Sequence
  MKO10083096_B_Egr4
  gRNA
caucggggcccgcggggaaa

SEQ ID NO: 83097 - RNA, 20 nt, Artificial Sequence
  MKO10083097_B_Egr4
  gRNA
cgcugcggcugaaguugcgc

SEQ ID NO: 83098 - RNA, 20 nt, Artificial Sequence
  MKO10083098_B_Ehbp1l1
  gRNA
ggcauccagaacccauaccg

SEQ ID NO: 83099 - RNA, 20 nt, Artificial Sequence
  MKO10083099_B_Ehbp1l1
  gRNA
cauaccaccaccagcuuguc

SEQ ID NO: 83100 - RNA, 20 nt, Artificial Sequence
  MKO10083100_B_Ehbp1l1
  gRNA
uuucauacugguccacauga

SEQ ID NO: 83101 - RNA, 20 nt, Artificial Sequence
  MKO10083101_B_Ehbp1
  gRNA
cuaucaccauggcuucaguu

SEQ ID NO: 83102 - RNA, 20 nt, Artificial Sequence
  MKO10083102_B_Ehbp1
  gRNA
ugauaggcaaccagauaaac

SEQ ID NO: 83103 - RNA, 20 nt, Artificial Sequence
  MKO10083103_B_Ehbp1
  gRNA
aaucacugugacgcuguuua

SEQ ID NO: 83104 - RNA, 20 nt, Artificial Sequence
  MKO10083104_B_Ehd1
  gRNA
ggaagucgccggaggagauc

SEQ ID NO: 83105 - RNA, 20 nt, Artificial Sequence
  MKO10083105_B_Ehd1
  gRNA
guuguucgacgcccacaagc

SEQ ID NO: 83106 - RNA, 20 nt, Artificial Sequence
  MKO10083106_B_Ehd1
  gRNA
gcucucuuucccgaaaacau

SEQ ID NO: 83107 - RNA, 20 nt, Artificial Sequence
  MKO10083107_B_Ehd2
  gRNA
cugagcgaugucgaccgaga

SEQ ID NO: 83108 - RNA, 20 nt, Artificial Sequence
  MKO10083108_B_Ehd2
  gRNA
caucuuugcgaagauccagc

SEQ ID NO: 83109 - RNA, 20 nt, Artificial Sequence
  MKO10083109_B_Ehd2
  gRNA
ggcuccgcaccugcaucuuc

SEQ ID NO: 83110 - RNA, 20 nt, Artificial Sequence
  MKO10083110_B_Ehd3
  gRNA
uccggccauagaucucagcc

SEQ ID NO: 83111 - RNA, 20 nt, Artificial Sequence
  MKO10083111_B_Ehd3
  gRNA
uucagaaagcucaacgccuu

SEQ ID NO: 83112 - RNA, 20 nt, Artificial Sequence
  MKO10083112_B_Ehd3
  gRNA
uuucuuuggauccaccacca

SEQ ID NO: 83113 - RNA, 20 nt, Artificial Sequence
  MKO10083113_B_Ehd4
  gRNA
uuccgaaagcuuagucgcuu

SEQ ID NO: 83114 - RNA, 20 nt, Artificial Sequence
  MKO10083114_B_Ehd4
  gRNA
cgagaauaccagauuucugc

SEQ ID NO: 83115 - RNA, 20 nt, Artificial Sequence
  MKO10083115_B_Ehd4
  gRNA
uuccaaagcgacuaagcuuu

SEQ ID NO: 83116 - RNA, 20 nt, Artificial Sequence
  MKO10083116_B_Ehf
  gRNA
uggacaguaagacuuucugc

SEQ ID NO: 83117 - RNA, 20 nt, Artificial Sequence
  MKO10083117_B_Ehf
  gRNA
cuuaccaacuggaaggugac

SEQ ID NO: 83118 - RNA, 20 nt, Artificial Sequence
  MKO10083118_B_Ehf
  gRNA
accuacugugcuaccauagc

SEQ ID NO: 83119 - RNA, 20 nt, Artificial Sequence
  MKO10083119_B_Ehhadh
  gRNA
gcucuugacuuaauuaccuc

SEQ ID NO: 83120 - RNA, 20 nt, Artificial Sequence
  MKO10083120_B_Ehhadh
  gRNA
aaccgucugagcaaauuuga

SEQ ID NO: 83121 - RNA, 20 nt, Artificial Sequence
  MKO10083121_B_Ehhadh
  gRNA
uaugguccaaacuagcuuuc

SEQ ID NO: 83122 - RNA, 20 nt, Artificial Sequence
  MKO10083122_B_Ehmt1
  gRNA
uauggucuugaacuucucua

SEQ ID NO: 83123 - RNA, 20 nt, Artificial Sequence
  MKO10083123_B_Ehmt1
  gRNA
uuucaugcagcaauccugcu

SEQ ID NO: 83124 - RNA, 20 nt, Artificial Sequence
  MKO10083124_B_Ehmt1
  gRNA
gcaugaaaacugagcugcua

SEQ ID NO: 83125 - RNA, 20 nt, Artificial Sequence
  MKO10083125_B_Ehmt2
  gRNA
cggggacgaacccgagagcc

SEQ ID NO: 83126 - RNA, 20 nt, Artificial Sequence
  MKO10083126_B_Ehmt2
  gRNA
acuucagggggccgcuucuc

SEQ ID NO: 83127 - RNA, 20 nt, Artificial Sequence
  MKO10083127_B_Ehmt2
  gRNA
gggggaggcccccgcugaga

SEQ ID NO: 83128 - RNA, 20 nt, Artificial Sequence
  MKO10083128_B_Ei24
  gRNA
caacuuugcuaagcacaaac

SEQ ID NO: 83129 - RNA, 20 nt, Artificial Sequence
  MKO10083129_B_Ei24
  gRNA
uacuucagucaguaacagcc

SEQ ID NO: 83130 - RNA, 20 nt, Artificial Sequence
  MKO10083130_B_Ei24
  gRNA
caccauuccaagcacaacac

SEQ ID NO: 83131 - RNA, 20 nt, Artificial Sequence
  MKO10083131_B_Eid1
  gRNA
aaucgacugaccgaagagcu

SEQ ID NO: 83132 - RNA, 20 nt, Artificial Sequence
  MKO10083132_B_Eid1
  gRNA
agguaggccgcggggcccgc

SEQ ID NO: 83133 - RNA, 20 nt, Artificial Sequence
  MKO10083133_B_Eid1
  gRNA
caucaaacucgucgccuucc

SEQ ID NO: 83134 - RNA, 20 nt, Artificial Sequence
  MKO10083134_B_Eid2b
  gRNA
ggcgucgaaggccgccuccc

SEQ ID NO: 83135 - RNA, 20 nt, Artificial Sequence
  MKO10083135_B_Eid2b
  gRNA
acgucgccgacgccguucau

SEQ ID NO: 83136 - RNA, 20 nt, Artificial Sequence
  MKO10083136_B_Eid2b
  gRNA
cucacggccuccgacgcccg

SEQ ID NO: 83137 - RNA, 20 nt, Artificial Sequence
  MKO10083137_B_Eid2
  gRNA
gagcagcgagccgcgaccgc

SEQ ID NO: 83138 - RNA, 20 nt, Artificial Sequence
  MKO10083138_B_Eid2
  gRNA
ucguggaggccugccgagcc

SEQ ID NO: 83139 - RNA, 20 nt, Artificial Sequence
  MKO10083139_B_Eid2
  gRNA
ggagacccggggacgcccaa

SEQ ID NO: 83140 - RNA, 20 nt, Artificial Sequence
  MKO10083140_B_Eid3
  gRNA
agaagugccgcaaaauccgc

SEQ ID NO: 83141 - RNA, 20 nt, Artificial Sequence
  MKO10083141_B_Eid3
  gRNA
gugauuccuauucguacugc

SEQ ID NO: 83142 - RNA, 20 nt, Artificial Sequence
  MKO10083142_B_Eid3
  gRNA
cacuccgucaaacagcacgu

SEQ ID NO: 83143 - RNA, 20 nt, Artificial Sequence
  MKO10083143_B_Eif1ad
  gRNA
accucaugcagauuguuccc

SEQ ID NO: 83144 - RNA, 20 nt, Artificial Sequence
  MKO10083144_B_Eif1ad
  gRNA
cucaugauacugucugugau

SEQ ID NO: 83145 - RNA, 20 nt, Artificial Sequence
  MKO10083145_B_Eif1ad
  gRNA
gacccuccuucuguagagag

SEQ ID NO: 83146 - RNA, 20 nt, Artificial Sequence
  MKO10083146_B_Eif1ax
  gRNA
augcucuggaagcucgccau

SEQ ID NO: 83147 - RNA, 20 nt, Artificial Sequence
  MKO10083147_B_Eif1ax
  gRNA
aaagcgagagcuuguguuca

SEQ ID NO: 83148 - RNA, 20 nt, Artificial Sequence
  MKO10083148_B_Eif1ax
  gRNA
aagagacugugccacaucag

SEQ ID NO: 83149 - RNA, 20 nt, Artificial Sequence
  MKO10083149_B_Eif1a
  gRNA
ucaaaaugcugggaaaugga

SEQ ID NO: 83150 - RNA, 20 nt, Artificial Sequence
  MKO10083150_B_Eif1a
  gRNA
ggaugggcaggaguaugcuc

SEQ ID NO: 83151 - RNA, 20 nt, Artificial Sequence
  MKO10083151_B_Eif1a
  gRNA
aggaggcugugccauauaag

SEQ ID NO: 83152 - RNA, 20 nt, Artificial Sequence
  MKO10083152_B_Eif1b
  gRNA
ugaauaaccucuccguacuc

SEQ ID NO: 83153 - RNA, 20 nt, Artificial Sequence
  MKO10083153_B_Eif1b
  gRNA
uucacagguuggcaucguca

SEQ ID NO: 83154 - RNA, 20 nt, Artificial Sequence
  MKO10083154_B_Eif1b
  gRNA
cacucaccuccagaagaaac

SEQ ID NO: 83155 - RNA, 20 nt, Artificial Sequence
  MKO10083155_B_Eif1
  gRNA
auccagaaccuccacucuuu

SEQ ID NO: 83156 - RNA, 20 nt, Artificial Sequence
  MKO10083156_B_Eif1
  gRNA
cauaugccaguuccugauag

SEQ ID NO: 83157 - RNA, 20 nt, Artificial Sequence
  MKO10083157_B_Eif1
  gRNA
cguaaucaucagcgaucccu

SEQ ID NO: 83158 - RNA, 20 nt, Artificial Sequence
  MKO10083158_B_Eif2ak1
  gRNA
uaccugacggacucucucuu

SEQ ID NO: 83159 - RNA, 20 nt, Artificial Sequence
  MKO10083159_B_Eif2ak1
  gRNA
gcugaccaucuaauuuguuc

SEQ ID NO: 83160 - RNA, 20 nt, Artificial Sequence
  MKO10083160_B_Eif2ak1
  gRNA
uuugaagagcuugccaucuu

SEQ ID NO: 83161 - RNA, 20 nt, Artificial Sequence
  MKO10083161_B_Eif2ak2
  gRNA
uguagaugugacaacgcuag

SEQ ID NO: 83162 - RNA, 20 nt, Artificial Sequence
  MKO10083162_B_Eif2ak2
  gRNA
cuccugcuuugaucuaccuu

SEQ ID NO: 83163 - RNA, 20 nt, Artificial Sequence
  MKO10083163_B_Eif2ak2
  gRNA
aaguauaucaacagcuaauu

SEQ ID NO: 83164 - RNA, 20 nt, Artificial Sequence
  MKO10083164_B_Eif2ak3
  gRNA
ccgccuggaaugggaguacc

SEQ ID NO: 83165 - RNA, 20 nt, Artificial Sequence
  MKO10083165_B_Eif2ak3
  gRNA
uaaaaguuuccguugcugau

SEQ ID NO: 83166 - RNA, 20 nt, Artificial Sequence
  MKO10083166_B_Eif2ak3
  gRNA
gcacuggaugccgagaauga

SEQ ID NO: 83167 - RNA, 20 nt, Artificial Sequence
  MKO10083167_B_Eif2ak4
  gRNA
cuuuccuucucugaaucucg

SEQ ID NO: 83168 - RNA, 20 nt, Artificial Sequence
  MKO10083168_B_Eif2ak4
  gRNA
uccuccacgagauucagaga

SEQ ID NO: 83169 - RNA, 20 nt, Artificial Sequence
  MKO10083169_B_Eif2ak4
  gRNA
acucacacaucuggguaugu

SEQ ID NO: 83170 - RNA, 20 nt, Artificial Sequence
  MKO10083170_B_Eif2a
  gRNA
acauuguuugccuggagcaa

SEQ ID NO: 83171 - RNA, 20 nt, Artificial Sequence
  MKO10083171_B_Eif2a
  gRNA
uucuuuagucagaggaucag

SEQ ID NO: 83172 - RNA, 20 nt, Artificial Sequence
  MKO10083172_B_Eif2a
  gRNA
caacuuuaugacaugaaaac

SEQ ID NO: 83173 - RNA, 20 nt, Artificial Sequence
  MKO10083173_B_Eif2b1
  gRNA
cggggcuuacagaguauucc

SEQ ID NO: 83174 - RNA, 20 nt, Artificial Sequence
  MKO10083174_B_Eif2b1
  gRNA
ucgacagggauauucuucuc

SEQ ID NO: 83175 - RNA, 20 nt, Artificial Sequence
  MKO10083175_B_Eif2b1
  gRNA
uccuaaaauggccucagcug

SEQ ID NO: 83176 - RNA, 20 nt, Artificial Sequence
  MKO10083176_B_Eif2b2
  gRNA
cagugacgagagcgaucagc

SEQ ID NO: 83177 - RNA, 20 nt, Artificial Sequence
  MKO10083177_B_Eif2b2
  gRNA
uguuaugucgagagucaaca

SEQ ID NO: 83178 - RNA, 20 nt, Artificial Sequence
  MKO10083178_B_Eif2b2
  gRNA
ggagaguccucaagaucauc

SEQ ID NO: 83179 - RNA, 20 nt, Artificial Sequence
  MKO10083179_B_Eif2b3
  gRNA
guggagcagcgugacuucau

SEQ ID NO: 83180 - RNA, 20 nt, Artificial Sequence
  MKO10083180_B_Eif2b3
  gRNA
caaauccaacacgcucaagc

SEQ ID NO: 83181 - RNA, 20 nt, Artificial Sequence
  MKO10083181_B_Eif2b3
  gRNA
auucugcgcagagagccuuu

SEQ ID NO: 83182 - RNA, 20 nt, Artificial Sequence
  MKO10083182_B_Eif2b4
  gRNA
cgccgaaaggagagccaagc

SEQ ID NO: 83183 - RNA, 20 nt, Artificial Sequence
  MKO10083183_B_Eif2b4
  gRNA
cccucacuuaccccgggccg

SEQ ID NO: 83184 - RNA, 20 nt, Artificial Sequence
  MKO10083184_B_Eif2b4
  gRNA
acacagcagagccaauuucu

SEQ ID NO: 83185 - RNA, 20 nt, Artificial Sequence
  MKO10083185_B_Eif2b5
  gRNA
aaauguuuccuguacacccg

SEQ ID NO: 83186 - RNA, 20 nt, Artificial Sequence
  MKO10083186_B_Eif2b5
  gRNA
ggagauucgauaugauuugu

SEQ ID NO: 83187 - RNA, 20 nt, Artificial Sequence
  MKO10083187_B_Eif2b5
  gRNA
ccaauggaaaggaaaagcgc

SEQ ID NO: 83188 - RNA, 20 nt, Artificial Sequence
  MKO10083188_B_Eif2d
  gRNA
ucaccuguccgagcccuuga

SEQ ID NO: 83189 - RNA, 20 nt, Artificial Sequence
  MKO10083189_B_Eif2d
  gRNA
cagaucucugaauugauacc

SEQ ID NO: 83190 - RNA, 20 nt, Artificial Sequence
  MKO10083190_B_Eif2d
  gRNA
uguguuggacuugacccgaa

SEQ ID NO: 83191 - RNA, 20 nt, Artificial Sequence
  MKO10083191_B_Eif2s1
  gRNA
guacuugucaucgaagaccc

SEQ ID NO: 83192 - RNA, 20 nt, Artificial Sequence
  MKO10083192_B_Eif2s1
  gRNA
ugcaugcuuaaaagcaucgu

SEQ ID NO: 83193 - RNA, 20 nt, Artificial Sequence
  MKO10083193_B_Eif2s1
  gRNA
ucucagagacccaucuaucu

SEQ ID NO: 83194 - RNA, 20 nt, Artificial Sequence
  MKO10083194_B_Eif2s2
  gRNA
ugaagcugaagaagcuauaa

SEQ ID NO: 83195 - RNA, 20 nt, Artificial Sequence
  MKO10083195_B_Eif2s2
  gRNA
ucaagagccagccgagccag

SEQ ID NO: 83196 - RNA, 20 nt, Artificial Sequence
  MKO10083196_B_Eif2s2
  gRNA
gaagacagcaaaaaagauga

SEQ ID NO: 83197 - RNA, 20 nt, Artificial Sequence
  MKO10083197_B_Eif2s3x
  gRNA
agacaagcuacaauuaauau

SEQ ID NO: 83198 - RNA, 20 nt, Artificial Sequence
  MKO10083198_B_Eif2s3x
  gRNA
cugauaacuucaugugaaag

SEQ ID NO: 83199 - RNA, 20 nt, Artificial Sequence
  MKO10083199_B_Eif2s3x
  gRNA
acaauuggucacguagcuca

SEQ ID NO: 83200 - RNA, 20 nt, Artificial Sequence
  MKO10083200_B_Eif2s3y
  gRNA
aaggaaacuucagacuaguc

SEQ ID NO: 83201 - RNA, 20 nt, Artificial Sequence
  MKO10083201_B_Eif2s3y
  gRNA
acaguuguaaaagccauuuc

SEQ ID NO: 83202 - RNA, 20 nt, Artificial Sequence
  MKO10083202_B_Eif2s3y
  gRNA
uugauggcaacuaugcugaa

SEQ ID NO: 83203 - RNA, 20 nt, Artificial Sequence
  MKO10083203_B_Eif3a
  gRNA
acucagccuuccgaguauac

SEQ ID NO: 83204 - RNA, 20 nt, Artificial Sequence
  MKO10083204_B_Eif3a
  gRNA
gccaauuaugcugaaauacu

SEQ ID NO: 83205 - RNA, 20 nt, Artificial Sequence
  MKO10083205_B_Eif3a
  gRNA
uccaaguauuucagcauaau

SEQ ID NO: 83206 - RNA, 20 nt, Artificial Sequence
  MKO10083206_B_Eif3b
  gRNA
aaacgccgauggcuacaagc

SEQ ID NO: 83207 - RNA, 20 nt, Artificial Sequence
  MKO10083207_B_Eif3b
  gRNA
acaugacgaucagcgaugag

SEQ ID NO: 83208 - RNA, 20 nt, Artificial Sequence
  MKO10083208_B_Eif3b
  gRNA
caucuucuggaaugacguca

SEQ ID NO: 83209 - RNA, 20 nt, Artificial Sequence
  MKO10083209_B_Eif3c
  gRNA
guaccuugcgccagaagauc

SEQ ID NO: 83210 - RNA, 20 nt, Artificial Sequence
  MKO10083210_B_Eif3c
  gRNA
caggccuuuguuacugagcg

SEQ ID NO: 83211 - RNA, 20 nt, Artificial Sequence
  MKO10083211_B_Eif3c
  gRNA
cucgaaucuucauggcauua

SEQ ID NO: 83212 - RNA, 20 nt, Artificial Sequence
  MKO10083212_B_Eif3d
  gRNA
gggacacuaccugugacuuc

SEQ ID NO: 83213 - RNA, 20 nt, Artificial Sequence
  MKO10083213_B_Eif3d
  gRNA
gggccacauaccaggacaag

SEQ ID NO: 83214 - RNA, 20 nt, Artificial Sequence
  MKO10083214_B_Eif3d
  gRNA
cacucuugggcagggucugu

SEQ ID NO: 83215 - RNA, 20 nt, Artificial Sequence
  MKO10083215_B_Eif3e
  gRNA
caggauguuauuugacuacc

SEQ ID NO: 83216 - RNA, 20 nt, Artificial Sequence
  MKO10083216_B_Eif3e
  gRNA
uuucagcugcgcaacaacug

SEQ ID NO: 83217 - RNA, 20 nt, Artificial Sequence
  MKO10083217_B_Eif3e
  gRNA
cauagcaaaauccaccauau

SEQ ID NO: 83218 - RNA, 20 nt, Artificial Sequence
  MKO10083218_B_Eif3f
  gRNA
cccgaaccccauucaccuca

SEQ ID NO: 83219 - RNA, 20 nt, Artificial Sequence
  MKO10083219_B_Eif3f
  gRNA
cccuuagguggcuguugaca

SEQ ID NO: 83220 - RNA, 20 nt, Artificial Sequence
  MKO10083220_B_Eif3f
  gRNA
ucaucuucugacucauugug

SEQ ID NO: 83221 - RNA, 20 nt, Artificial Sequence
  MKO10083221_B_Eif3g
  gRNA
agugacugaguacaagauag

SEQ ID NO: 83222 - RNA, 20 nt, Artificial Sequence
  MKO10083222_B_Eif3g
  gRNA
agacccgcugccaccuccca

SEQ ID NO: 83223 - RNA, 20 nt, Artificial Sequence
  MKO10083223_B_Eif3g
  gRNA
ccacagccuuugaugccuuc

SEQ ID NO: 83224 - RNA, 20 nt, Artificial Sequence
  MKO10083224_B_Eif3h
  gRNA
uccuccaguacaguaucaga

SEQ ID NO: 83225 - RNA, 20 nt, Artificial Sequence
  MKO10083225_B_Eif3h
  gRNA
cgugcuccugggucugguug

SEQ ID NO: 83226 - RNA, 20 nt, Artificial Sequence
  MKO10083226_B_Eif3h
  gRNA
cagacugacuccuaaacuga

SEQ ID NO: 83227 - RNA, 20 nt, Artificial Sequence
  MKO10083227_B_Eif3i
  gRNA
cgguccucaccgaucuggcu

SEQ ID NO: 83228 - RNA, 20 nt, Artificial Sequence
  MKO10083228_B_Eif3i
  gRNA
gcccccaaagucaaagccgc

SEQ ID NO: 83229 - RNA, 20 nt, Artificial Sequence
  MKO10083229_B_Eif3i
  gRNA
cugacaacagcugucgucuc

SEQ ID NO: 83230 - RNA, 20 nt, Artificial Sequence
  MKO10083230_B_Eif3j1
  gRNA
aaaagauaaaagagaaagaa

SEQ ID NO: 83231 - RNA, 20 nt, Artificial Sequence
  MKO10083231_B_Eif3j1
  gRNA
ggcaagaagaaauuaaaaag

SEQ ID NO: 83232 - RNA, 20 nt, Artificial Sequence
  MKO10083232_B_Eif3j1
  gRNA
agcaauuagcagauaaacuc

SEQ ID NO: 83233 - RNA, 20 nt, Artificial Sequence
  MKO10083233_B_Eif3j2
  gRNA
ccgguucgagauggcggcgg

SEQ ID NO: 83234 - RNA, 20 nt, Artificial Sequence
  MKO10083234_B_Eif3j2
  gRNA
cauauccaccauaaucugcc

SEQ ID NO: 83235 - RNA, 20 nt, Artificial Sequence
  MKO10083235_B_Eif3j2
  gRNA
ggcaagaagaaauuaaaaag

SEQ ID NO: 83236 - RNA, 20 nt, Artificial Sequence
  MKO10083236_B_Eif3k
  gRNA
ugagggcuuucagcagaauc

SEQ ID NO: 83237 - RNA, 20 nt, Artificial Sequence
  MKO10083237_B_Eif3k
  gRNA
caaagagaaugccuaugauc

SEQ ID NO: 83238 - RNA, 20 nt, Artificial Sequence
  MKO10083238_B_Eif3k
  gRNA
ccugccacuuucaagccuuc

SEQ ID NO: 83239 - RNA, 20 nt, Artificial Sequence
  MKO10083239_B_Eif3l
  gRNA
cugcucauacugccgcucau

SEQ ID NO: 83240 - RNA, 20 nt, Artificial Sequence
  MKO10083240_B_Eif3l
  gRNA
caagaauacaccguggccug

SEQ ID NO: 83241 - RNA, 20 nt, Artificial Sequence
  MKO10083241_B_Eif3l
  gRNA
uacaccuaccauugccaacu

SEQ ID NO: 83242 - RNA, 20 nt, Artificial Sequence
  MKO10083242_B_Eif3m
  gRNA
ggccauccaguacaucccaa

SEQ ID NO: 83243 - RNA, 20 nt, Artificial Sequence
  MKO10083243_B_Eif3m
  gRNA
ugagcucucagaagaaaacu

SEQ ID NO: 83244 - RNA, 20 nt, Artificial Sequence
  MKO10083244_B_Eif3m
  gRNA
uuccuucagacacacaucac

SEQ ID NO: 83245 - RNA, 20 nt, Artificial Sequence
  MKO10083245_B_Eif4a1
  gRNA
cugcauucagauacaaaagg

SEQ ID NO: 83246 - RNA, 20 nt, Artificial Sequence
  MKO10083246_B_Eif4a1
  gRNA
aucaacagauccagagacaa

SEQ ID NO: 83247 - RNA, 20 nt, Artificial Sequence
  MKO10083247_B_Eif4a1
  gRNA
gaguaacuggaacgagauug

SEQ ID NO: 83248 - RNA, 20 nt, Artificial Sequence
  MKO10083248_B_Eif4a2
  gRNA
auggaucaaaauguucguuu

SEQ ID NO: 83249 - RNA, 20 nt, Artificial Sequence
  MKO10083249_B_Eif4a2
  gRNA
gcuauuaucccuuguauuaa

SEQ ID NO: 83250 - RNA, 20 nt, Artificial Sequence
  MKO10083250_B_Eif4a2
  gRNA
gcucuuugcugaauagcuga

SEQ ID NO: 83251 - RNA, 20 nt, Artificial Sequence
  MKO10083251_B_Eif4a3
  gRNA
gcacgcugcugaaucgcuga

SEQ ID NO: 83252 - RNA, 20 nt, Artificial Sequence
  MKO10083252_B_Eif4a3
  gRNA
cugcagcacugagacacuga

SEQ ID NO: 83253 - RNA, 20 nt, Artificial Sequence
  MKO10083253_B_Eif4a3
  gRNA
ugucucagugcugcagugcu

SEQ ID NO: 83254 - RNA, 20 nt, Artificial Sequence
  MKO10083254_B_Eif4b
  gRNA
ucagcgcuguacgcuuacca

SEQ ID NO: 83255 - RNA, 20 nt, Artificial Sequence
  MKO10083255_B_Eif4b
  gRNA
gcucucagucucuagguaac

SEQ ID NO: 83256 - RNA, 20 nt, Artificial Sequence
  MKO10083256_B_Eif4b
  gRNA
ugcucugagucucaaugaag

SEQ ID NO: 83257 - RNA, 20 nt, Artificial Sequence
  MKO10083257_B_Eif4e1b
  gRNA
uaauccucagguggguucug

SEQ ID NO: 83258 - RNA, 20 nt, Artificial Sequence
  MKO10083258_B_Eif4e1b
  gRNA
gcuugcuggccagcuugaua

SEQ ID NO: 83259 - RNA, 20 nt, Artificial Sequence
  MKO10083259_B_Eif4e1b
  gRNA
agucaccaaguuuaacacug

SEQ ID NO: 83260 - RNA, 20 nt, Artificial Sequence
  MKO10083260_B_Eif4e2
  gRNA
auugcuccccgagcauagcc

SEQ ID NO: 83261 - RNA, 20 nt, Artificial Sequence
  MKO10083261_B_Eif4e2
  gRNA
uacagccacaugguacgucc

SEQ ID NO: 83262 - RNA, 20 nt, Artificial Sequence
  MKO10083262_B_Eif4e2
  gRNA
gguccccaggacguaccaug

SEQ ID NO: 83263 - RNA, 20 nt, Artificial Sequence
  MKO10083263_B_Eif4e3
  gRNA
uguaguuaucacuuaaugag

SEQ ID NO: 83264 - RNA, 20 nt, Artificial Sequence
  MKO10083264_B_Eif4e3
  gRNA
ggaggaggagaguaaugcga

SEQ ID NO: 83265 - RNA, 20 nt, Artificial Sequence
  MKO10083265_B_Eif4e3
  gRNA
aagugauaacuacaucucaa

SEQ ID NO: 83266 - RNA, 20 nt, Artificial Sequence
  MKO10083266_B_Eif4ebp1
  gRNA
gaaccaggauuaucuaugac

SEQ ID NO: 83267 - RNA, 20 nt, Artificial Sequence
  MKO10083267_B_Eif4ebp1
  gRNA
ugaagagucacaauuugaga

SEQ ID NO: 83268 - RNA, 20 nt, Artificial Sequence
  MKO10083268_B_Eif4ebp1
  gRNA
ggagcugcacgccaucgccg

SEQ ID NO: 83269 - RNA, 20 nt, Artificial Sequence
  MKO10083269_B_Eif4ebp2
  gRNA
uucaauuaaggcgccaggac

SEQ ID NO: 83270 - RNA, 20 nt, Artificial Sequence
  MKO10083270_B_Eif4ebp2
  gRNA
ggaugaggcucaguuugaga

SEQ ID NO: 83271 - RNA, 20 nt, Artificial Sequence
  MKO10083271_B_Eif4ebp2
  gRNA
accaccggccgacgcggaca

SEQ ID NO: 83272 - RNA, 20 nt, Artificial Sequence
  MKO10083272_B_Eif4ebp3
  gRNA
agcaguaccacccuccaagu

SEQ ID NO: 83273 - RNA, 20 nt, Artificial Sequence
  MKO10083273_B_Eif4ebp3
  gRNA
agaugacgaacaguuugaaa

SEQ ID NO: 83274 - RNA, 20 nt, Artificial Sequence
  MKO10083274_B_Eif4ebp3
  gRNA
cccuggaauugggcaacucg

SEQ ID NO: 83275 - RNA, 20 nt, Artificial Sequence
  MKO10083275_B_Eif4enif1
  gRNA
gcuguuagcucccgacgauc

SEQ ID NO: 83276 - RNA, 20 nt, Artificial Sequence
  MKO10083276_B_Eif4enif1
  gRNA
gcuauucugcgcaccagaga

SEQ ID NO: 83277 - RNA, 20 nt, Artificial Sequence
  MKO10083277_B_Eif4enif1
  gRNA
gccucucugaaaaauaugac

SEQ ID NO: 83278 - RNA, 20 nt, Artificial Sequence
  MKO10083278_B_Eif4e
  gRNA
uaaucccccaccugcagaag

SEQ ID NO: 83279 - RNA, 20 nt, Artificial Sequence
  MKO10083279_B_Eif4e
  gRNA
caaacuuagagaucaaucga

SEQ ID NO: 83280 - RNA, 20 nt, Artificial Sequence
  MKO10083280_B_Eif4e
  gRNA
aaaaugauaaaagcaaaacu

SEQ ID NO: 83281 - RNA, 20 nt, Artificial Sequence
  MKO10083281_B_Eif4g1
  gRNA
cacgccuucucagccccgcc

SEQ ID NO: 83282 - RNA, 20 nt, Artificial Sequence
  MKO10083282_B_Eif4g1
  gRNA
guguucauuugugucgcuug

SEQ ID NO: 83283 - RNA, 20 nt, Artificial Sequence
  MKO10083283_B_Eif4g1
  gRNA
uugauuaccugugggagucc

SEQ ID NO: 83284 - RNA, 20 nt, Artificial Sequence
  MKO10083284_B_Eif4g2
  gRNA
ccagcaguaugaccccuuua

SEQ ID NO: 83285 - RNA, 20 nt, Artificial Sequence
  MKO10083285_B_Eif4g2
  gRNA
gagucuaaacucauccuuaa

SEQ ID NO: 83286 - RNA, 20 nt, Artificial Sequence
  MKO10083286_B_Eif4g2
  gRNA
auaccuguugccagcagucu

SEQ ID NO: 83287 - RNA, 20 nt, Artificial Sequence
  MKO10083287_B_Eif4g3
  gRNA
caugccguaccccgugaccc

SEQ ID NO: 83288 - RNA, 20 nt, Artificial Sequence
  MKO10083288_B_Eif4g3
  gRNA
gggaggauucagacccaucc

SEQ ID NO: 83289 - RNA, 20 nt, Artificial Sequence
  MKO10083289_B_Eif4g3
  gRNA
uacaguaccugaugaugggc

SEQ ID NO: 83290 - RNA, 20 nt, Artificial Sequence
  MKO10083290_B_Eif4h
  gRNA
ucccgggaugacuucaacuc

SEQ ID NO: 83291 - RNA, 20 nt, Artificial Sequence
  MKO10083291_B_Eif4h
  gRNA
cuucguguggacauugcaga

SEQ ID NO: 83292 - RNA, 20 nt, Artificial Sequence
  MKO10083292_B_Eif4h
  gRNA
uaccagaguugaagucaucc

SEQ ID NO: 83293 - RNA, 20 nt, Artificial Sequence
  MKO10083293_B_Eif5a2
  gRNA
uacagcguauucuucacuca

SEQ ID NO: 83294 - RNA, 20 nt, Artificial Sequence
  MKO10083294_B_Eif5a2
  gRNA
gcagggcuugucuauuugca

SEQ ID NO: 83295 - RNA, 20 nt, Artificial Sequence
  MKO10083295_B_Eif5a2
  gRNA
cuaauagcucauaugcauuc

SEQ ID NO: 83296 - RNA, 20 nt, Artificial Sequence
  MKO10083296_B_Eif5a
  gRNA
cucguaccuccccacugucc

SEQ ID NO: 83297 - RNA, 20 nt, Artificial Sequence
  MKO10083297_B_Eif5a
  gRNA
uggguaccuaucccugcucc

SEQ ID NO: 83298 - RNA, 20 nt, Artificial Sequence
  MKO10083298_B_Eif5a
  gRNA
agcuguugcaaucaaggcca

SEQ ID NO: 83299 - RNA, 20 nt, Artificial Sequence
  MKO10083299_B_Eif5b
  gRNA
cagagacgccgcugcaguca

SEQ ID NO: 83300 - RNA, 20 nt, Artificial Sequence
  MKO10083300_B_Eif5b
  gRNA
gcccaaaucaguaucauccu

SEQ ID NO: 83301 - RNA, 20 nt, Artificial Sequence
  MKO10083301_B_Eif5b
  gRNA
aucuacuguuaaagcuaucc

SEQ ID NO: 83302 - RNA, 20 nt, Artificial Sequence
  MKO10083302_B_Eif5
  gRNA
uuccuuuagguugagggcaa

SEQ ID NO: 83303 - RNA, 20 nt, Artificial Sequence
  MKO10083303_B_Eif5
  gRNA
ccuguagagaauagugacau

SEQ ID NO: 83304 - RNA, 20 nt, Artificial Sequence
  MKO10083304_B_Eif5
  gRNA
uucauucucaaaaacccacc

SEQ ID NO: 83305 - RNA, 20 nt, Artificial Sequence
  MKO10083305_B_Eif6
  gRNA
cuccacccgccguaucugca

SEQ ID NO: 83306 - RNA, 20 nt, Artificial Sequence
  MKO10083306_B_Eif6
  gRNA
acccaacaacaccaccgacc

SEQ ID NO: 83307 - RNA, 20 nt, Artificial Sequence
  MKO10083307_B_Eif6
  gRNA
aguagcuuccuacuagcacc

SEQ ID NO: 83308 - RNA, 20 nt, Artificial Sequence
  MKO10083308_B_Elac1
  gRNA
gauaaagucccgaagcccga

SEQ ID NO: 83309 - RNA, 20 nt, Artificial Sequence
  MKO10083309_B_Elac1
  gRNA
acuagcucgugaaccacgua

SEQ ID NO: 83310 - RNA, 20 nt, Artificial Sequence
  MKO10083310_B_Elac1
  gRNA
caaagcugugccgugccaag

SEQ ID NO: 83311 - RNA, 20 nt, Artificial Sequence
  MKO10083311_B_Elac2
  gRNA
uguguuccugcauaagucgu

SEQ ID NO: 83312 - RNA, 20 nt, Artificial Sequence
  MKO10083312_B_Elac2
  gRNA
uccauugaaaggaauagaac

SEQ ID NO: 83313 - RNA, 20 nt, Artificial Sequence
  MKO10083313_B_Elac2
  gRNA
cuucccaaauguguucuguc

SEQ ID NO: 83314 - RNA, 20 nt, Artificial Sequence
  MKO10083314_B_Elane
  gRNA
ccggccaccaacaaucucug

SEQ ID NO: 83315 - RNA, 20 nt, Artificial Sequence
  MKO10083315_B_Elane
  gRNA
auugacuccuucauccgagg

SEQ ID NO: 83316 - RNA, 20 nt, Artificial Sequence
  MKO10083316_B_Elane
  gRNA
gaacgacauugugauuaucc

SEQ ID NO: 83317 - RNA, 20 nt, Artificial Sequence
  MKO10083317_B_Elavl1
  gRNA
guagccguucagacuugcua

SEQ ID NO: 83318 - RNA, 20 nt, Artificial Sequence
  MKO10083318_B_Elavl1
  gRNA
agcuguaccacucgccugcu

SEQ ID NO: 83319 - RNA, 20 nt, Artificial Sequence
  MKO10083319_B_Elavl1
  gRNA
guccuuguggaucagaccac

SEQ ID NO: 83320 - RNA, 20 nt, Artificial Sequence
  MKO10083320_B_Elavl2
  gRNA
aagguaguugacuauuaggu

SEQ ID NO: 83321 - RNA, 20 nt, Artificial Sequence
  MKO10083321_B_Elavl2
  gRNA
ugcuccucaccaguugacuc

SEQ ID NO: 83322 - RNA, 20 nt, Artificial Sequence
  MKO10083322_B_Elavl2
  gRNA
cgcugugccugcugagcuag

SEQ ID NO: 83323 - RNA, 20 nt, Artificial Sequence
  MKO10083323_B_Elavl3
  gRNA
aucccggauagaggcagaac

SEQ ID NO: 83324 - RNA, 20 nt, Artificial Sequence
  MKO10083324_B_Elavl3
  gRNA
cagggggccggcguagcgcc

SEQ ID NO: 83325 - RNA, 20 nt, Artificial Sequence
  MKO10083325_B_Elavl3
  gRNA
cuuaucccgaaccaacuugc

SEQ ID NO: 83326 - RNA, 20 nt, Artificial Sequence
  MKO10083326_B_Elavl4
  gRNA
gggguaaauaguugacgaug

SEQ ID NO: 83327 - RNA, 20 nt, Artificial Sequence
  MKO10083327_B_Elavl4
  gRNA
ccgacauccaauacaagcaa

SEQ ID NO: 83328 - RNA, 20 nt, Artificial Sequence
  MKO10083328_B_Elavl4
  gRNA
agggccaggguaucgccugu

SEQ ID NO: 83329 - RNA, 20 nt, Artificial Sequence
  MKO10083329_B_Elf1
  gRNA
ggcaacgaugucaucuucag

SEQ ID NO: 83330 - RNA, 20 nt, Artificial Sequence
  MKO10083330_B_Elf1
  gRNA
cuauugagaauaucagcacc

SEQ ID NO: 83331 - RNA, 20 nt, Artificial Sequence
  MKO10083331_B_Elf1
  gRNA
guugaggcuucuugucauaa

SEQ ID NO: 83332 - RNA, 20 nt, Artificial Sequence
  MKO10083332_B_Elf2
  gRNA
aguuuauccaugcugcgaug

SEQ ID NO: 83333 - RNA, 20 nt, Artificial Sequence
  MKO10083333_B_Elf2
  gRNA
aucgcagcauggauaaacuc

SEQ ID NO: 83334 - RNA, 20 nt, Artificial Sequence
  MKO10083334_B_Elf2
  gRNA
ugcugaagcccugcuucaua

SEQ ID NO: 83335 - RNA, 20 nt, Artificial Sequence
  MKO10083335_B_Elf3
  gRNA
acuccuggaugauggccgcc

SEQ ID NO: 83336 - RNA, 20 nt, Artificial Sequence
  MKO10083336_B_Elf3
  gRNA
cccuacuacugcaguaccua

SEQ ID NO: 83337 - RNA, 20 nt, Artificial Sequence
  MKO10083337_B_Elf3
  gRNA
ccuggaccucaccgagagca

SEQ ID NO: 83338 - RNA, 20 nt, Artificial Sequence
  MKO10083338_B_Elf4
  gRNA
cugacccuagcaugccuaua

SEQ ID NO: 83339 - RNA, 20 nt, Artificial Sequence
  MKO10083339_B_Elf4
  gRNA
uucuuccguauaggcaugcu

SEQ ID NO: 83340 - RNA, 20 nt, Artificial Sequence
  MKO10083340_B_Elf4
  gRNA
ugggaguugccacauugaau

SEQ ID NO: 83341 - RNA, 20 nt, Artificial Sequence
  MKO10083341_B_Elf5
  gRNA
agucucugacaaauucccac

SEQ ID NO: 83342 - RNA, 20 nt, Artificial Sequence
  MKO10083342_B_Elf5
  gRNA
agugguuaagucagaagccc

SEQ ID NO: 83343 - RNA, 20 nt, Artificial Sequence
  MKO10083343_B_Elf5
  gRNA
acagucuuugaugccagucu

SEQ ID NO: 83344 - RNA, 20 nt, Artificial Sequence
  MKO10083344_B_Elfn1
  gRNA
gccgacaagagucgccagua

SEQ ID NO: 83345 - RNA, 20 nt, Artificial Sequence
  MKO10083345_B_Elfn1
  gRNA
cccacccgcgugcaguaacg

SEQ ID NO: 83346 - RNA, 20 nt, Artificial Sequence
  MKO10083346_B_Elfn1
  gRNA
accaucaucgagcuuaagua

SEQ ID NO: 83347 - RNA, 20 nt, Artificial Sequence
  MKO10083347_B_Elfn2
  gRNA
ccauguauaccuccucgcga

SEQ ID NO: 83348 - RNA, 20 nt, Artificial Sequence
  MKO10083348_B_Elfn2
  gRNA
gaacgagauuuccuacaucg

SEQ ID NO: 83349 - RNA, 20 nt, Artificial Sequence
  MKO10083349_B_Elfn2
  gRNA
acuaucuuagagaugcgcua

SEQ ID NO: 83350 - RNA, 20 nt, Artificial Sequence
  MKO10083350_B_Elk1
  gRNA
ggcacucaccaagguaugug

SEQ ID NO: 83351 - RNA, 20 nt, Artificial Sequence
  MKO10083351_B_Elk1
  gRNA
acccccguggugcucucccc

SEQ ID NO: 83352 - RNA, 20 nt, Artificial Sequence
  MKO10083352_B_Elk1
  gRNA
ugcccccuagcauccauuuc

SEQ ID NO: 83353 - RNA, 20 nt, Artificial Sequence
  MKO10083353_B_Elk3
  gRNA
cguucgauguccagcagaug

SEQ ID NO: 83354 - RNA, 20 nt, Artificial Sequence
  MKO10083354_B_Elk3
  gRNA
uggagagugcaaucacgcug

SEQ ID NO: 83355 - RNA, 20 nt, Artificial Sequence
  MKO10083355_B_Elk3
  gRNA
caugugaccguugagcagug

SEQ ID NO: 83356 - RNA, 20 nt, Artificial Sequence
  MKO10083356_B_Elk4
  gRNA
cguauuagcaccuugcaguc

SEQ ID NO: 83357 - RNA, 20 nt, Artificial Sequence
  MKO10083357_B_Elk4
  gRNA
guccugggaggcuccuuuag

SEQ ID NO: 83358 - RNA, 20 nt, Artificial Sequence
  MKO10083358_B_Elk4
  gRNA
uggagaaaaugggcccggag

SEQ ID NO: 83359 - RNA, 20 nt, Artificial Sequence
  MKO10083359_B_Ell2
  gRNA
uaacuucuacuugucaaacg

SEQ ID NO: 83360 - RNA, 20 nt, Artificial Sequence
  MKO10083360_B_Ell2
  gRNA
agccucccagcucaauugcc

SEQ ID NO: 83361 - RNA, 20 nt, Artificial Sequence
  MKO10083361_B_Ell2
  gRNA
uacucaccccuuggaguccu

SEQ ID NO: 83362 - RNA, 20 nt, Artificial Sequence
  MKO10083362_B_Ell3
  gRNA
aaauagugagucgcucucua

SEQ ID NO: 83363 - RNA, 20 nt, Artificial Sequence
  MKO10083363_B_Ell3
  gRNA
caccaugaacagucacuccc

SEQ ID NO: 83364 - RNA, 20 nt, Artificial Sequence
  MKO10083364_B_Ell3
  gRNA
gccgaacugucuccacugcc

SEQ ID NO: 83365 - RNA, 20 nt, Artificial Sequence
  MKO10083365_B_Ell
  gRNA
uaauggggguagcacgcuuc

SEQ ID NO: 83366 - RNA, 20 nt, Artificial Sequence
  MKO10083366_B_Ell
  gRNA
gccuccagccuuaaugacga

SEQ ID NO: 83367 - RNA, 20 nt, Artificial Sequence
  MKO10083367_B_Ell
  gRNA
agaccuuccauccgauuuga

SEQ ID NO: 83368 - RNA, 20 nt, Artificial Sequence
  MKO10083368_B_Elmo1
  gRNA
gcugcagugcaaaauauuca

SEQ ID NO: 83369 - RNA, 20 nt, Artificial Sequence
  MKO10083369_B_Elmo1
  gRNA
gccacugucugccauuauaa

SEQ ID NO: 83370 - RNA, 20 nt, Artificial Sequence
  MKO10083370_B_Elmo1
  gRNA
aaucgcaacgaaauaaaaaa

SEQ ID NO: 83371 - RNA, 20 nt, Artificial Sequence
  MKO10083371_B_Elmo2
  gRNA
ucagcucuacgucacggagc

SEQ ID NO: 83372 - RNA, 20 nt, Artificial Sequence
  MKO10083372_B_Elmo2
  gRNA
cuuacaacuggccgucuccc

SEQ ID NO: 83373 - RNA, 20 nt, Artificial Sequence
  MKO10083373_B_Elmo2
  gRNA
acuuugacaaugucagacgg

SEQ ID NO: 83374 - RNA, 20 nt, Artificial Sequence
  MKO10083374_B_Elmo3
  gRNA
cagguggagccugacucauc

SEQ ID NO: 83375 - RNA, 20 nt, Artificial Sequence
  MKO10083375_B_Elmo3
  gRNA
gcagucuacccaguagcugc

SEQ ID NO: 83376 - RNA, 20 nt, Artificial Sequence
  MKO10083376_B_Elmo3
  gRNA
ccacuuacaggcaaagcccc

SEQ ID NO: 83377 - RNA, 20 nt, Artificial Sequence
  MKO10083377_B_Elmod1
  gRNA
uagguuggggaucucucucc

SEQ ID NO: 83378 - RNA, 20 nt, Artificial Sequence
  MKO10083378_B_Elmod1
  gRNA
ucuuacuguggauugauguc

SEQ ID NO: 83379 - RNA, 20 nt, Artificial Sequence
  MKO10083379_B_Elmod1
  gRNA
aaagacuauugaugacauca

SEQ ID NO: 83380 - RNA, 20 nt, Artificial Sequence
  MKO10083380_B_Elmod2
  gRNA
caacucguguugcauucugu

SEQ ID NO: 83381 - RNA, 20 nt, Artificial Sequence
  MKO10083381_B_Elmod2
  gRNA
accacgauguagaaaaugug

SEQ ID NO: 83382 - RNA, 20 nt, Artificial Sequence
  MKO10083382_B_Elmod2
  gRNA
cuugacauauuccaagaaua

SEQ ID NO: 83383 - RNA, 20 nt, Artificial Sequence
  MKO10083383_B_Elmod3
  gRNA
cucuucaucguacaaggaca

SEQ ID NO: 83384 - RNA, 20 nt, Artificial Sequence
  MKO10083384_B_Elmod3
  gRNA
ccucguugaaggagaugagc

SEQ ID NO: 83385 - RNA, 20 nt, Artificial Sequence
  MKO10083385_B_Elmod3
  gRNA
cacacuuaccuaugucugga

SEQ ID NO: 83386 - RNA, 20 nt, Artificial Sequence
  MKO10083386_B_Elmsan1
  gRNA
ggcgaugaaagugcccgccu

SEQ ID NO: 83387 - RNA, 20 nt, Artificial Sequence
  MKO10083387_B_Elmsan1
  gRNA
augaugaggggcuccggccg

SEQ ID NO: 83388 - RNA, 20 nt, Artificial Sequence
  MKO10083388_B_Elmsan1
  gRNA
caugaugagagaccgagcgc

SEQ ID NO: 83389 - RNA, 20 nt, Artificial Sequence
  MKO10083389_B_Eln
  gRNA
uggcucuuaccuggcuuagg

SEQ ID NO: 83390 - RNA, 20 nt, Artificial Sequence
  MKO10083390_B_Eln
  gRNA
uccaaacguucccagaaguc

SEQ ID NO: 83391 - RNA, 20 nt, Artificial Sequence
  MKO10083391_B_Eln
  gRNA
cacacaacaggggcugguau

SEQ ID NO: 83392 - RNA, 20 nt, Artificial Sequence
  MKO10083392_B_Elof1
  gRNA
ucacaucacaagacuucucg

SEQ ID NO: 83393 - RNA, 20 nt, Artificial Sequence
  MKO10083393_B_Elof1
  gRNA
cuacugauuggcugccucgc

SEQ ID NO: 83394 - RNA, 20 nt, Artificial Sequence
  MKO10083394_B_Elof1
  gRNA
acagguaugugauggguguc

SEQ ID NO: 83395 - RNA, 20 nt, Artificial Sequence
  MKO10083395_B_Elovl1
  gRNA
ucacuugcccguccuucuuc

SEQ ID NO: 83396 - RNA, 20 nt, Artificial Sequence
  MKO10083396_B_Elovl1
  gRNA
gcaccgagugguggaagaca

SEQ ID NO: 83397 - RNA, 20 nt, Artificial Sequence
  MKO10083397_B_Elovl1
  gRNA
guccaucagcucaaugaccu

SEQ ID NO: 83398 - RNA, 20 nt, Artificial Sequence
  MKO10083398_B_Elovl2
  gRNA
acgcguggugauagacauga

SEQ ID NO: 83399 - RNA, 20 nt, Artificial Sequence
  MKO10083399_B_Elovl2
  gRNA
ugucagaaucucgacagugc

SEQ ID NO: 83400 - RNA, 20 nt, Artificial Sequence
  MKO10083400_B_Elovl2
  gRNA
ggcagcucauccucuccagc

SEQ ID NO: 83401 - RNA, 20 nt, Artificial Sequence
  MKO10083401_B_Elovl3
  gRNA
augacgccguagucagauuc

SEQ ID NO: 83402 - RNA, 20 nt, Artificial Sequence
  MKO10083402_B_Elovl3
  gRNA
ucuuccaccgagccuaccuc

SEQ ID NO: 83403 - RNA, 20 nt, Artificial Sequence
  MKO10083403_B_Elovl3
  gRNA
uaucuguugcucaucguugu

SEQ ID NO: 83404 - RNA, 20 nt, Artificial Sequence
  MKO10083404_B_Elovl4
  gRNA
uuaugaguacuaagcgcauu

SEQ ID NO: 83405 - RNA, 20 nt, Artificial Sequence
  MKO10083405_B_Elovl4
  gRNA
uacagauagcuggcgcccug

SEQ ID NO: 83406 - RNA, 20 nt, Artificial Sequence
  MKO10083406_B_Elovl4
  gRNA
gaacgcagucagcccauagu

SEQ ID NO: 83407 - RNA, 20 nt, Artificial Sequence
  MKO10083407_B_Elovl5
  gRNA
cucggcaagagaacggcugc

SEQ ID NO: 83408 - RNA, 20 nt, Artificial Sequence
  MKO10083408_B_Elovl5
  gRNA
guccaagguuauacaacugc

SEQ ID NO: 83409 - RNA, 20 nt, Artificial Sequence
  MKO10083409_B_Elovl5
  gRNA
ccauuacucacaauggccgc

SEQ ID NO: 83410 - RNA, 20 nt, Artificial Sequence
  MKO10083410_B_Elovl6
  gRNA
cuguacauucugaugaccaa

SEQ ID NO: 83411 - RNA, 20 nt, Artificial Sequence
  MKO10083411_B_Elovl6
  gRNA
auauucggugcucuucgaac

SEQ ID NO: 83412 - RNA, 20 nt, Artificial Sequence
  MKO10083412_B_Elovl6
  gRNA
acgagaacgaagccauccaa

SEQ ID NO: 83413 - RNA, 20 nt, Artificial Sequence
  MKO10083413_B_Elovl7
  gRNA
cucagucgccaagagcaaug

SEQ ID NO: 83414 - RNA, 20 nt, Artificial Sequence
  MKO10083414_B_Elovl7
  gRNA
uuccgguucuccaugagcuu

SEQ ID NO: 83415 - RNA, 20 nt, Artificial Sequence
  MKO10083415_B_Elovl7
  gRNA
aaacuuacccucauugcucu

SEQ ID NO: 83416 - RNA, 20 nt, Artificial Sequence
  MKO10083416_B_Elp2
  gRNA
gugguuauuaccaaucugaa

SEQ ID NO: 83417 - RNA, 20 nt, Artificial Sequence
  MKO10083417_B_Elp2
  gRNA
auagcgugcacagcacaaac

SEQ ID NO: 83418 - RNA, 20 nt, Artificial Sequence
  MKO10083418_B_Elp2
  gRNA
uccagccccuuccaaugagc

SEQ ID NO: 83419 - RNA, 20 nt, Artificial Sequence
  MKO10083419_B_Elp3
  gRNA
ccucauagcccguguaagac

SEQ ID NO: 83420 - RNA, 20 nt, Artificial Sequence
  MKO10083420_B_Elp3
  gRNA
uguccacacaucaguuucac

SEQ ID NO: 83421 - RNA, 20 nt, Artificial Sequence
  MKO10083421_B_Elp3
  gRNA
cucugcaggggaccucagcc

SEQ ID NO: 83422 - RNA, 20 nt, Artificial Sequence
  MKO10083422_B_Elp4
  gRNA
caucaaugggcauacucugu

SEQ ID NO: 83423 - RNA, 20 nt, Artificial Sequence
  MKO10083423_B_Elp4
  gRNA
uuacuauuaucaucaaguag

SEQ ID NO: 83424 - RNA, 20 nt, Artificial Sequence
  MKO10083424_B_Elp4
  gRNA
ccagguggaggguuagcugu

SEQ ID NO: 83425 - RNA, 20 nt, Artificial Sequence
  MKO10083425_B_Elp5
  gRNA
uggggagcagguccacguuc

SEQ ID NO: 83426 - RNA, 20 nt, Artificial Sequence
  MKO10083426_B_Elp5
  gRNA
ucuccccagauuccguggag

SEQ ID NO: 83427 - RNA, 20 nt, Artificial Sequence
  MKO10083427_B_Elp5
  gRNA
ccaggcuuugaccaguuaag

SEQ ID NO: 83428 - RNA, 20 nt, Artificial Sequence
  MKO10083428_B_Elp6
  gRNA
ucacauaccuuucagguaga

SEQ ID NO: 83429 - RNA, 20 nt, Artificial Sequence
  MKO10083429_B_Elp6
  gRNA
ucugucccacaauauuguaa

SEQ ID NO: 83430 - RNA, 20 nt, Artificial Sequence
  MKO10083430_B_Elp6
  gRNA
cuucagccauuacaauauug

SEQ ID NO: 83431 - RNA, 20 nt, Artificial Sequence
  MKO10083431_B_Eltd1
  gRNA
aagguuaucagaccgccacg

SEQ ID NO: 83432 - RNA, 20 nt, Artificial Sequence
  MKO10083432_B_Eltd1
  gRNA
aagguuaucagaccgcuacg

SEQ ID NO: 83433 - RNA, 20 nt, Artificial Sequence
  MKO10083433_B_Eltd1
  gRNA
gaacugugacuuccccguag

SEQ ID NO: 83434 - RNA, 20 nt, Artificial Sequence
  MKO10083434_B_Emb
  gRNA
augcguguacacagcaacua

SEQ ID NO: 83435 - RNA, 20 nt, Artificial Sequence
  MKO10083435_B_Emb
  gRNA
ugaagucacccguagucuca

SEQ ID NO: 83436 - RNA, 20 nt, Artificial Sequence
  MKO10083436_B_Emb
  gRNA
gccaucauuucuucucgaac

SEQ ID NO: 83437 - RNA, 20 nt, Artificial Sequence
  MKO10083437_B_Emc10
  gRNA
cccuugcagaccggggccga

SEQ ID NO: 83438 - RNA, 20 nt, Artificial Sequence
  MKO10083438_B_Emc10
  gRNA
gcugucgcuguguugccgac

SEQ ID NO: 83439 - RNA, 20 nt, Artificial Sequence
  MKO10083439_B_Emc10
  gRNA
ggaccagcugaccuugcacg

SEQ ID NO: 83440 - RNA, 20 nt, Artificial Sequence
  MKO10083440_B_Emc1
  gRNA
ccaacaucgggggccugaac

SEQ ID NO: 83441 - RNA, 20 nt, Artificial Sequence
  MKO10083441_B_Emc1
  gRNA
acaaccaacuucuuggaucc

SEQ ID NO: 83442 - RNA, 20 nt, Artificial Sequence
  MKO10083442_B_Emc1
  gRNA
uuccccuggauccaagaagu

SEQ ID NO: 83443 - RNA, 20 nt, Artificial Sequence
  MKO10083443_B_Emc2
  gRNA
aggcaugcgauuugaagcua

SEQ ID NO: 83444 - RNA, 20 nt, Artificial Sequence
  MKO10083444_B_Emc2
  gRNA
aaugauuaugcuucuaagcu

SEQ ID NO: 83445 - RNA, 20 nt, Artificial Sequence
  MKO10083445_B_Emc2
  gRNA
aagaaauagugaacaaauua

SEQ ID NO: 83446 - RNA, 20 nt, Artificial Sequence
  MKO10083446_B_Emc3
  gRNA
uaauucgaagcagaguccuc

SEQ ID NO: 83447 - RNA, 20 nt, Artificial Sequence
  MKO10083447_B_Emc3
  gRNA
auauuacuucaacaacccag

SEQ ID NO: 83448 - RNA, 20 nt, Artificial Sequence
  MKO10083448_B_Emc3
  gRNA
aagcgaagugucaguggaaa

SEQ ID NO: 83449 - RNA, 20 nt, Artificial Sequence
  MKO10083449_B_Emc4
  gRNA
gcgcugcugggacaucgccu

SEQ ID NO: 83450 - RNA, 20 nt, Artificial Sequence
  MKO10083450_B_Emc4
  gRNA
uaccucagggggcucaauaa

SEQ ID NO: 83451 - RNA, 20 nt, Artificial Sequence
  MKO10083451_B_Emc4
  gRNA
cccaacagcuuucaagaugc

SEQ ID NO: 83452 - RNA, 20 nt, Artificial Sequence
  MKO10083452_B_Emc6
  gRNA
gccggcauccucggccucac

SEQ ID NO: 83453 - RNA, 20 nt, Artificial Sequence
  MKO10083453_B_Emc6
  gRNA
uucccgcuuggccaccaccg

SEQ ID NO: 83454 - RNA, 20 nt, Artificial Sequence
  MKO10083454_B_Emc6
  gRNA
agacgugcaccaugccauag

SEQ ID NO: 83455 - RNA, 20 nt, Artificial Sequence
  MKO10083455_B_Emc7
  gRNA
uuacaucaaaacgucagaag

SEQ ID NO: 83456 - RNA, 20 nt, Artificial Sequence
  MKO10083456_B_Emc7
  gRNA
acagggucaaacuuguaagc

SEQ ID NO: 83457 - RNA, 20 nt, Artificial Sequence
  MKO10083457_B_Emc7
  gRNA
caagugauccugacaugaga

SEQ ID NO: 83458 - RNA, 20 nt, Artificial Sequence
  MKO10083458_B_Emc8
  gRNA
uguacgagcagcacgagaac

SEQ ID NO: 83459 - RNA, 20 nt, Artificial Sequence
  MKO10083459_B_Emc8
  gRNA
accgaagcccucugcgaucc

SEQ ID NO: 83460 - RNA, 20 nt, Artificial Sequence
  MKO10083460_B_Emc8
  gRNA
auaaucaucuggacgacauu

SEQ ID NO: 83461 - RNA, 20 nt, Artificial Sequence
  MKO10083461_B_Emc9
  gRNA
cuggucauccaaaaccgcau

SEQ ID NO: 83462 - RNA, 20 nt, Artificial Sequence
  MKO10083462_B_Emc9
  gRNA
ccugccgaaugucaucaaga

SEQ ID NO: 83463 - RNA, 20 nt, Artificial Sequence
  MKO10083463_B_Emc9
  gRNA
caccauaauaagcacugccc

SEQ ID NO: 83464 - RNA, 20 nt, Artificial Sequence
  MKO10083464_B_Emcn
  gRNA
ugacguaucccaaacaucuu

SEQ ID NO: 83465 - RNA, 20 nt, Artificial Sequence
  MKO10083465_B_Emcn
  gRNA
uuugucacugacacgaugcc

SEQ ID NO: 83466 - RNA, 20 nt, Artificial Sequence
  MKO10083466_B_Emcn
  gRNA
caauacucaccuucauguuu

SEQ ID NO: 83467 - RNA, 20 nt, Artificial Sequence
  MKO10083467_B_Emd
  gRNA
uauuugaccaccaagacaua

SEQ ID NO: 83468 - RNA, 20 nt, Artificial Sequence
  MKO10083468_B_Emd
  gRNA
guccaagagcuuccgccagc

SEQ ID NO: 83469 - RNA, 20 nt, Artificial Sequence
  MKO10083469_B_Emd
  gRNA
gggguaagagucuccuucuc

SEQ ID NO: 83470 - RNA, 20 nt, Artificial Sequence
  MKO10083470_B_Eme1
  gRNA
agagucuagcacgggacuca

SEQ ID NO: 83471 - RNA, 20 nt, Artificial Sequence
  MKO10083471_B_Eme1
  gRNA
agcauugucacuggugauug

SEQ ID NO: 83472 - RNA, 20 nt, Artificial Sequence
  MKO10083472_B_Eme1
  gRNA
accuaccugcuuuaaguugu

SEQ ID NO: 83473 - RNA, 20 nt, Artificial Sequence
  MKO10083473_B_Eme2
  gRNA
gagucucacccgcucccauc

SEQ ID NO: 83474 - RNA, 20 nt, Artificial Sequence
  MKO10083474_B_Eme2
  gRNA
cagcacccugaagaaauucc

SEQ ID NO: 83475 - RNA, 20 nt, Artificial Sequence
  MKO10083475_B_Eme2
  gRNA
uccccuauaggugccucugg

SEQ ID NO: 83476 - RNA, 20 nt, Artificial Sequence
  MKO10083476_B_Emg1
  gRNA
gauaccuggugggugauguc

SEQ ID NO: 83477 - RNA, 20 nt, Artificial Sequence
  MKO10083477_B_Emg1
  gRNA
acgagcuacucaacugugac

SEQ ID NO: 83478 - RNA, 20 nt, Artificial Sequence
  MKO10083478_B_Emg1
  gRNA
cacccaugaggccacaaaau

SEQ ID NO: 83479 - RNA, 20 nt, Artificial Sequence
  MKO10083479_B_Emid1
  gRNA
ggcaguucuguagcacucgc

SEQ ID NO: 83480 - RNA, 20 nt, Artificial Sequence
  MKO10083480_B_Emid1
  gRNA
cagggcagcaccuccauucu

SEQ ID NO: 83481 - RNA, 20 nt, Artificial Sequence
  MKO10083481_B_Emid1
  gRNA
uucuuucagcuacagaaccg

SEQ ID NO: 83482 - RNA, 20 nt, Artificial Sequence
  MKO10083482_B_Emilin1
  gRNA
caacauaccuggugggccaa

SEQ ID NO: 83483 - RNA, 20 nt, Artificial Sequence
  MKO10083483_B_Emilin1
  gRNA
caggaacuggugugccuacg

SEQ ID NO: 83484 - RNA, 20 nt, Artificial Sequence
  MKO10083484_B_Emilin1
  gRNA
gacagugagcugcguccuug

SEQ ID NO: 83485 - RNA, 20 nt, Artificial Sequence
  MKO10083485_B_Emilin2
  gRNA
cacguucuuauucacgaugu

SEQ ID NO: 83486 - RNA, 20 nt, Artificial Sequence
  MKO10083486_B_Emilin2
  gRNA
aagggcaaccccgugcgacc

SEQ ID NO: 83487 - RNA, 20 nt, Artificial Sequence
  MKO10083487_B_Emilin2
  gRNA
acgggguugcccuucuugcc

SEQ ID NO: 83488 - RNA, 20 nt, Artificial Sequence
  MKO10083488_B_Emilin3
  gRNA
agggcaccccucuccucgcg

SEQ ID NO: 83489 - RNA, 20 nt, Artificial Sequence
  MKO10083489_B_Emilin3
  gRNA
cuacaagaccgugacagacc

SEQ ID NO: 83490 - RNA, 20 nt, Artificial Sequence
  MKO10083490_B_Emilin3
  gRNA
ccaacugcccuucaacaguc

SEQ ID NO: 83491 - RNA, 20 nt, Artificial Sequence
  MKO10083491_B_Eml1
  gRNA
agcuacugguugagcccgug

SEQ ID NO: 83492 - RNA, 20 nt, Artificial Sequence
  MKO10083492_B_Eml1
  gRNA
uugagaaccaccgucaacaa

SEQ ID NO: 83493 - RNA, 20 nt, Artificial Sequence
  MKO10083493_B_Eml1
  gRNA
uucucuugcagcgaggccac

SEQ ID NO: 83494 - RNA, 20 nt, Artificial Sequence
  MKO10083494_B_Eml2
  gRNA
acacccagucuagcuuuagc

SEQ ID NO: 83495 - RNA, 20 nt, Artificial Sequence
  MKO10083495_B_Eml2
  gRNA
ugccaccuguccuguggcga

SEQ ID NO: 83496 - RNA, 20 nt, Artificial Sequence
  MKO10083496_B_Eml2
  gRNA
ucuggcuguccauccagaua

SEQ ID NO: 83497 - RNA, 20 nt, Artificial Sequence
  MKO10083497_B_Eml3
  gRNA
uacgugucagaacgcugaag

SEQ ID NO: 83498 - RNA, 20 nt, Artificial Sequence
  MKO10083498_B_Eml3
  gRNA
ugcucccugaccgcaauagc

SEQ ID NO: 83499 - RNA, 20 nt, Artificial Sequence
  MKO10083499_B_Eml3
  gRNA
ccucagcuaaccugcuauug

SEQ ID NO: 83500 - RNA, 20 nt, Artificial Sequence
  MKO10083500_B_Eml4
  gRNA
gccggacucaccgaggcugc

SEQ ID NO: 83501 - RNA, 20 nt, Artificial Sequence
  MKO10083501_B_Eml4
  gRNA
acauagaaauagcuucucga

SEQ ID NO: 83502 - RNA, 20 nt, Artificial Sequence
  MKO10083502_B_Eml4
  gRNA
cuaauuaccuuuacuuggca

SEQ ID NO: 83503 - RNA, 20 nt, Artificial Sequence
  MKO10083503_B_Eml5
  gRNA
aacauccuucagaaccgaca

SEQ ID NO: 83504 - RNA, 20 nt, Artificial Sequence
  MKO10083504_B_Eml5
  gRNA
aaucuuauacgaacaauaca

SEQ ID NO: 83505 - RNA, 20 nt, Artificial Sequence
  MKO10083505_B_Eml5
  gRNA
auccagcgcuugguuucagu

SEQ ID NO: 83506 - RNA, 20 nt, Artificial Sequence
  MKO10083506_B_Eml6
  gRNA
cugcggagugaagcauauaa

SEQ ID NO: 83507 - RNA, 20 nt, Artificial Sequence
  MKO10083507_B_Eml6
  gRNA
aaggucuuacccggucagaa

SEQ ID NO: 83508 - RNA, 20 nt, Artificial Sequence
  MKO10083508_B_Eml6
  gRNA
ccgcagcuaaccauucuguu

SEQ ID NO: 83509 - RNA, 20 nt, Artificial Sequence
  MKO10083509_B_Emp1
  gRNA
augcauaccuucauugccgu

SEQ ID NO: 83510 - RNA, 20 nt, Artificial Sequence
  MKO10083510_B_Emp1
  gRNA
cguguuccagcucuucacua

SEQ ID NO: 83511 - RNA, 20 nt, Artificial Sequence
  MKO10083511_B_Emp1
  gRNA
uguagauugacacuccaacc

SEQ ID NO: 83512 - RNA, 20 nt, Artificial Sequence
  MKO10083512_B_Emp2
  gRNA
gaagcugucgccuacccacc

SEQ ID NO: 83513 - RNA, 20 nt, Artificial Sequence
  MKO10083513_B_Emp2
  gRNA
ugucuuccacaucgugucca

SEQ ID NO: 83514 - RNA, 20 nt, Artificial Sequence
  MKO10083514_B_Emp2
  gRNA
uucacuuacaggacaugagc

SEQ ID NO: 83515 - RNA, 20 nt, Artificial Sequence
  MKO10083515_B_Emp3
  gRNA
auucucacugacguuacugc

SEQ ID NO: 83516 - RNA, 20 nt, Artificial Sequence
  MKO10083516_B_Emp3
  gRNA
ggagggcucuucuacgcuac

SEQ ID NO: 83517 - RNA, 20 nt, Artificial Sequence
  MKO10083517_B_Emp3
  gRNA
uccacgugcagucauaccac

SEQ ID NO: 83518 - RNA, 20 nt, Artificial Sequence
  MKO10083518_B_Emr1
  gRNA
gccaagugcagcugucuuag

SEQ ID NO: 83519 - RNA, 20 nt, Artificial Sequence
  MKO10083519_B_Emr1
  gRNA
guguugcaaaccuucacaaa

SEQ ID NO: 83520 - RNA, 20 nt, Artificial Sequence
  MKO10083520_B_Emr1
  gRNA
cucagucugcaccaauaucc

SEQ ID NO: 83521 - RNA, 20 nt, Artificial Sequence
  MKO10083521_B_Emr4
  gRNA
gaccagauaagcagcauucc

SEQ ID NO: 83522 - RNA, 20 nt, Artificial Sequence
  MKO10083522_B_Emr4
  gRNA
acccacuguguuuguaaaga

SEQ ID NO: 83523 - RNA, 20 nt, Artificial Sequence
  MKO10083523_B_Emr4
  gRNA
gagccccaugagaaauguca

SEQ ID NO: 83524 - RNA, 20 nt, Artificial Sequence
  MKO10083524_B_Emx1
  gRNA
cgugcaaaagcagcccgucc

SEQ ID NO: 83525 - RNA, 20 nt, Artificial Sequence
  MKO10083525_B_Emx1
  gRNA
agcucaccugcgucucggag

SEQ ID NO: 83526 - RNA, 20 nt, Artificial Sequence
  MKO10083526_B_Emx1
  gRNA
aucgccacgaagcaggccaa

SEQ ID NO: 83527 - RNA, 20 nt, Artificial Sequence
  MKO10083527_B_Emx2
  gRNA
caauucuccaccgguuaaug

SEQ ID NO: 83528 - RNA, 20 nt, Artificial Sequence
  MKO10083528_B_Emx2
  gRNA
aaggcgguucgaauccgcuu

SEQ ID NO: 83529 - RNA, 20 nt, Artificial Sequence
  MKO10083529_B_Emx2
  gRNA
uuccuccggacucgccugcu

SEQ ID NO: 83530 - RNA, 20 nt, Artificial Sequence
  MKO10083530_B_En1
  gRNA
gcggcgacagacccucgccc

SEQ ID NO: 83531 - RNA, 20 nt, Artificial Sequence
  MKO10083531_B_En1
  gRNA
ggucuacugcacacgcuauu

SEQ ID NO: 83532 - RNA, 20 nt, Artificial Sequence
  MKO10083532_B_En1
  gRNA
cguuagccgaacccaugagu

SEQ ID NO: 83533 - RNA, 20 nt, Artificial Sequence
  MKO10083533_B_En2
  gRNA
gggcaagucggacagcgagu

SEQ ID NO: 83534 - RNA, 20 nt, Artificial Sequence
  MKO10083534_B_En2
  gRNA
ggagagcguuccucccgcgc

SEQ ID NO: 83535 - RNA, 20 nt, Artificial Sequence
  MKO10083535_B_En2
  gRNA
gccaaaaaacccggcgaucc

SEQ ID NO: 83536 - RNA, 20 nt, Artificial Sequence
  MKO10083536_B_Enah
  gRNA
gugccagcugguggcucaac

SEQ ID NO: 83537 - RNA, 20 nt, Artificial Sequence
  MKO10083537_B_Enah
  gRNA
cuaccugcucaaguucaaaa

SEQ ID NO: 83538 - RNA, 20 nt, Artificial Sequence
  MKO10083538_B_Enah
  gRNA
aagagcuggaaauccagaga

SEQ ID NO: 83539 - RNA, 20 nt, Artificial Sequence
  MKO10083539_B_Enam
  gRNA
aggagacucaucuuuacauu

SEQ ID NO: 83540 - RNA, 20 nt, Artificial Sequence
  MKO10083540_B_Enam
  gRNA
auuuagcaguaaaagugaag

SEQ ID NO: 83541 - RNA, 20 nt, Artificial Sequence
  MKO10083541_B_Enam
  gRNA
cagagacaccaagcagaccc

SEQ ID NO: 83542 - RNA, 20 nt, Artificial Sequence
  MKO10083542_B_Enc1
  gRNA
gggaacaagcuuuacguagu

SEQ ID NO: 83543 - RNA, 20 nt, Artificial Sequence
  MKO10083543_B_Enc1
  gRNA
cauucagcgcugcaagacuu

SEQ ID NO: 83544 - RNA, 20 nt, Artificial Sequence
  MKO10083544_B_Enc1
  gRNA
agugagaacgcuguccgcgu

SEQ ID NO: 83545 - RNA, 20 nt, Artificial Sequence
  MKO10083545_B_Endod1
  gRNA
cagcccccgugaggauauac

SEQ ID NO: 83546 - RNA, 20 nt, Artificial Sequence
  MKO10083546_B_Endod1
  gRNA
cgcguuucgcgcugcgcgcc

SEQ ID NO: 83547 - RNA, 20 nt, Artificial Sequence
  MKO10083547_B_Endod1
  gRNA
guacagaguggcgaagcgcu

SEQ ID NO: 83548 - RNA, 20 nt, Artificial Sequence
  MKO10083548_B_Endog
  gRNA
ggcccgcucgaugcucucga

SEQ ID NO: 83549 - RNA, 20 nt, Artificial Sequence
  MKO10083549_B_Endog
  gRNA
agcugcggcuguaccucuca

SEQ ID NO: 83550 - RNA, 20 nt, Artificial Sequence
  MKO10083550_B_Endog
  gRNA
uguuccaggcauucugguug

SEQ ID NO: 83551 - RNA, 20 nt, Artificial Sequence
  MKO10083551_B_Endou
  gRNA
aaugaccgcugcccagaguu

SEQ ID NO: 83552 - RNA, 20 nt, Artificial Sequence
  MKO10083552_B_Endou
  gRNA
acuuacucaacaauuaccag

SEQ ID NO: 83553 - RNA, 20 nt, Artificial Sequence
  MKO10083553_B_Endou
  gRNA
gaaaugcuccccguggccug

SEQ ID NO: 83554 - RNA, 20 nt, Artificial Sequence
  MKO10083554_B_Endov
  gRNA
gccgcuguaccaacuccacc

SEQ ID NO: 83555 - RNA, 20 nt, Artificial Sequence
  MKO10083555_B_Endov
  gRNA
augugucuccuccggccugc

SEQ ID NO: 83556 - RNA, 20 nt, Artificial Sequence
  MKO10083556_B_Endov
  gRNA
uucuuggccaccccgaugca

SEQ ID NO: 83557 - RNA, 20 nt, Artificial Sequence
  MKO10083557_B_Engase
  gRNA
ccugcugugccacgacauga

SEQ ID NO: 83558 - RNA, 20 nt, Artificial Sequence
  MKO10083558_B_Engase
  gRNA
uucaccccggauccuuuacc

SEQ ID NO: 83559 - RNA, 20 nt, Artificial Sequence
  MKO10083559_B_Engase
  gRNA
aggagggcucauccccggcc

SEQ ID NO: 83560 - RNA, 20 nt, Artificial Sequence
  MKO10083560_B_Eng
  gRNA
ccaaagcaucguccuccagu

SEQ ID NO: 83561 - RNA, 20 nt, Artificial Sequence
  MKO10083561_B_Eng
  gRNA
cucacguaggccaagugcaa

SEQ ID NO: 83562 - RNA, 20 nt, Artificial Sequence
  MKO10083562_B_Eng
  gRNA
cccggaaaucccauugcacu

SEQ ID NO: 83563 - RNA, 20 nt, Artificial Sequence
  MKO10083563_B_Enho
  gRNA
guagcagcaagaagccuacg

SEQ ID NO: 83564 - RNA, 20 nt, Artificial Sequence
  MKO10083564_B_Enho
  gRNA
ugguggcgccuucucaggac

SEQ ID NO: 83565 - RNA, 20 nt, Artificial Sequence
  MKO10083565_B_Enho
  gRNA
augggggcagccaucuccca

SEQ ID NO: 83566 - RNA, 20 nt, Artificial Sequence
  MKO10083566_B_Enkd1
  gRNA
ucucugcagggacccggccu

SEQ ID NO: 83567 - RNA, 20 nt, Artificial Sequence
  MKO10083567_B_Enkd1
  gRNA
gggagugugcccgcagaaag

SEQ ID NO: 83568 - RNA, 20 nt, Artificial Sequence
  MKO10083568_B_Enkd1
  gRNA
ccuguucccggcugcguucc

SEQ ID NO: 83569 - RNA, 20 nt, Artificial Sequence
  MKO10083569_B_Enkur
  gRNA
agagacucucugacgaagaa

SEQ ID NO: 83570 - RNA, 20 nt, Artificial Sequence
  MKO10083570_B_Enkur
  gRNA
gaagauucgcaagcagaagc

SEQ ID NO: 83571 - RNA, 20 nt, Artificial Sequence
  MKO10083571_B_Enkur
  gRNA
cagaaucaaugaagaccgag

SEQ ID NO: 83572 - RNA, 20 nt, Artificial Sequence
  MKO10083572_B_Eno1
  gRNA
ccuaccuugcuaaccagagc

SEQ ID NO: 83573 - RNA, 20 nt, Artificial Sequence
  MKO10083573_B_Eno1
  gRNA
ccuuacccuuccccaugaag

SEQ ID NO: 83574 - RNA, 20 nt, Artificial Sequence
  MKO10083574_B_Eno1
  gRNA
guuccuucuaggugucucac

SEQ ID NO: 83575 - RNA, 20 nt, Artificial Sequence
  MKO10083575_B_Eno2
  gRNA
cgccacauugcucagcuagc

SEQ ID NO: 83576 - RNA, 20 nt, Artificial Sequence
  MKO10083576_B_Eno2
  gRNA
cgggccucacugagcugaug

SEQ ID NO: 83577 - RNA, 20 nt, Artificial Sequence
  MKO10083577_B_Eno2
  gRNA
gugcaauccugcuguugaug

SEQ ID NO: 83578 - RNA, 20 nt, Artificial Sequence
  MKO10083578_B_Eno3
  gRNA
cagugcuucauagauacccg

SEQ ID NO: 83579 - RNA, 20 nt, Artificial Sequence
  MKO10083579_B_Eno3
  gRNA
cuuccagaaacuaaguguug

SEQ ID NO: 83580 - RNA, 20 nt, Artificial Sequence
  MKO10083580_B_Eno3
  gRNA
accucacucacacuuauucu

SEQ ID NO: 83581 - RNA, 20 nt, Artificial Sequence
  MKO10083581_B_Eno4
  gRNA
ggcggcggcagcguuacugg

SEQ ID NO: 83582 - RNA, 20 nt, Artificial Sequence
  MKO10083582_B_Eno4
  gRNA
ggccaaagccagcgcaaccu

SEQ ID NO: 83583 - RNA, 20 nt, Artificial Sequence
  MKO10083583_B_Eno4
  gRNA
gugcgggaaccagcuccucc

SEQ ID NO: 83584 - RNA, 20 nt, Artificial Sequence
  MKO10083584_B_Enoph1
  gRNA
guccacuuuguguccaaucu

SEQ ID NO: 83585 - RNA, 20 nt, Artificial Sequence
  MKO10083585_B_Enoph1
  gRNA
aagguauacaucuauucuuc

SEQ ID NO: 83586 - RNA, 20 nt, Artificial Sequence
  MKO10083586_B_Enoph1
  gRNA
cucaagaaugucucccucug

SEQ ID NO: 83587 - RNA, 20 nt, Artificial Sequence
  MKO10083587_B_Enox1
  gRNA
gcaagcaaaggaugcgcgcc

SEQ ID NO: 83588 - RNA, 20 nt, Artificial Sequence
  MKO10083588_B_Enox1
  gRNA
uccacaagagaacgaccucc

SEQ ID NO: 83589 - RNA, 20 nt, Artificial Sequence
  MKO10083589_B_Enox1
  gRNA
ccaggcugugggaucgguga

SEQ ID NO: 83590 - RNA, 20 nt, Artificial Sequence
  MKO10083590_B_Enox2
  gRNA
cauauaagucaucccgagcc

SEQ ID NO: 83591 - RNA, 20 nt, Artificial Sequence
  MKO10083591_B_Enox2
  gRNA
ucagacuucgauccugcccu

SEQ ID NO: 83592 - RNA, 20 nt, Artificial Sequence
  MKO10083592_B_Enox2
  gRNA
caccaccugcaacacgagaa

SEQ ID NO: 83593 - RNA, 20 nt, Artificial Sequence
  MKO10083593_B_Enpep
  gRNA
ugucccaaugagcacuuacc

SEQ ID NO: 83594 - RNA, 20 nt, Artificial Sequence
  MKO10083594_B_Enpep
  gRNA
acucacugguuugccgcucc

SEQ ID NO: 83595 - RNA, 20 nt, Artificial Sequence
  MKO10083595_B_Enpep
  gRNA
accaugaaccaacagaugcc

SEQ ID NO: 83596 - RNA, 20 nt, Artificial Sequence
  MKO10083596_B_Enpp1
  gRNA
ugcacaggagcacacgaacc

SEQ ID NO: 83597 - RNA, 20 nt, Artificial Sequence
  MKO10083597_B_Enpp1
  gRNA
uauggacuugcaacaaauuc

SEQ ID NO: 83598 - RNA, 20 nt, Artificial Sequence
  MKO10083598_B_Enpp1
  gRNA
acacuuacuugguuccacac

SEQ ID NO: 83599 - RNA, 20 nt, Artificial Sequence
  MKO10083599_B_Enpp2
  gRNA
cugcuguaccaacuaccaag

SEQ ID NO: 83600 - RNA, 20 nt, Artificial Sequence
  MKO10083600_B_Enpp2
  gRNA
guugauuucagcucgaggcu

SEQ ID NO: 83601 - RNA, 20 nt, Artificial Sequence
  MKO10083601_B_Enpp2
  gRNA
caguguuaucugacucucca

SEQ ID NO: 83602 - RNA, 20 nt, Artificial Sequence
  MKO10083602_B_Enpp3
  gRNA
gcuuugcaggcgaaagccca

SEQ ID NO: 83603 - RNA, 20 nt, Artificial Sequence
  MKO10083603_B_Enpp3
  gRNA
aggcuuacccugguggacac

SEQ ID NO: 83604 - RNA, 20 nt, Artificial Sequence
  MKO10083604_B_Enpp3
  gRNA
ugauuguaucgcuuggauug

SEQ ID NO: 83605 - RNA, 20 nt, Artificial Sequence
  MKO10083605_B_Enpp4
  gRNA
aauuguuguuagugcacuau

SEQ ID NO: 83606 - RNA, 20 nt, Artificial Sequence
  MKO10083606_B_Enpp4
  gRNA
ucgaauucagcccauuauuu

SEQ ID NO: 83607 - RNA, 20 nt, Artificial Sequence
  MKO10083607_B_Enpp4
  gRNA
gcugaauucgacugcugugu

SEQ ID NO: 83608 - RNA, 20 nt, Artificial Sequence
  MKO10083608_B_Enpp5
  gRNA
ugaugaagucuaugaugcgc

SEQ ID NO: 83609 - RNA, 20 nt, Artificial Sequence
  MKO10083609_B_Enpp5
  gRNA
ggaccgugggcuaaaaauau

SEQ ID NO: 83610 - RNA, 20 nt, Artificial Sequence
  MKO10083610_B_Enpp5
  gRNA
aagcacuaagcuuggaguaa

SEQ ID NO: 83611 - RNA, 20 nt, Artificial Sequence
  MKO10083611_B_Enpp6
  gRNA
agaugaucggcaacuacaug

SEQ ID NO: 83612 - RNA, 20 nt, Artificial Sequence
  MKO10083612_B_Enpp6
  gRNA
uucgcaaaguugauaucugu

SEQ ID NO: 83613 - RNA, 20 nt, Artificial Sequence
  MKO10083613_B_Enpp6
  gRNA
cugagaagaggaugacguuu

SEQ ID NO: 83614 - RNA, 20 nt, Artificial Sequence
  MKO10083614_B_Enpp7
  gRNA
ggccguaacgaugagccgga

SEQ ID NO: 83615 - RNA, 20 nt, Artificial Sequence
  MKO10083615_B_Enpp7
  gRNA
gaagaccaucuuccgggccg

SEQ ID NO: 83616 - RNA, 20 nt, Artificial Sequence
  MKO10083616_B_Enpp7
  gRNA
ugccguugucccaccaccuc

SEQ ID NO: 83617 - RNA, 20 nt, Artificial Sequence
  MKO10083617_B_Ensa
  gRNA
ccucaccugcuucuccucgc

SEQ ID NO: 83618 - RNA, 20 nt, Artificial Sequence
  MKO10083618_B_Ensa
  gRNA
ggagaccggcgaggagaagc

SEQ ID NO: 83619 - RNA, 20 nt, Artificial Sequence
  MKO10083619_B_Ensa
  gRNA
cucaugaagagacuccagaa

SEQ ID NO: 83620 - RNA, 20 nt, Artificial Sequence
  MKO10083620_B_Enthd1
  gRNA
caacaccuuuaccagcauuc

SEQ ID NO: 83621 - RNA, 20 nt, Artificial Sequence
  MKO10083621_B_Enthd1
  gRNA
auccgaagcaaccugugaca

SEQ ID NO: 83622 - RNA, 20 nt, Artificial Sequence
  MKO10083622_B_Enthd1
  gRNA
cgcuuccccuucugacagcc

SEQ ID NO: 83623 - RNA, 20 nt, Artificial Sequence
  MKO10083623_B_Enthd2
  gRNA
gggcagccgcccgcaccuuc

SEQ ID NO: 83624 - RNA, 20 nt, Artificial Sequence
  MKO10083624_B_Enthd2
  gRNA
acaugggaugcuaucaucug

SEQ ID NO: 83625 - RNA, 20 nt, Artificial Sequence
  MKO10083625_B_Enthd2
  gRNA
uuuccauacccguggcuucu

SEQ ID NO: 83626 - RNA, 20 nt, Artificial Sequence
  MKO10083626_B_Entpd1
  gRNA
uagaauggaaagcgaacaau

SEQ ID NO: 83627 - RNA, 20 nt, Artificial Sequence
  MKO10083627_B_Entpd1
  gRNA
acaguuccaugcauucggcc

SEQ ID NO: 83628 - RNA, 20 nt, Artificial Sequence
  MKO10083628_B_Entpd1
  gRNA
cccucaguaugggauugugu

SEQ ID NO: 83629 - RNA, 20 nt, Artificial Sequence
  MKO10083629_B_Entpd2
  gRNA
ccgguggauacggccaagga

SEQ ID NO: 83630 - RNA, 20 nt, Artificial Sequence
  MKO10083630_B_Entpd2
  gRNA
gcuacgcaaaugacccuucu

SEQ ID NO: 83631 - RNA, 20 nt, Artificial Sequence
  MKO10083631_B_Entpd2
  gRNA
gcgggcaccacggaagucaa

SEQ ID NO: 83632 - RNA, 20 nt, Artificial Sequence
  MKO10083632_B_Entpd3
  gRNA
aaaugcggguggauccgugg

SEQ ID NO: 83633 - RNA, 20 nt, Artificial Sequence
  MKO10083633_B_Entpd3
  gRNA
uuggggguuauucucauagc

SEQ ID NO: 83634 - RNA, 20 nt, Artificial Sequence
  MKO10083634_B_Entpd3
  gRNA
ccacugauacacguagacag

SEQ ID NO: 83635 - RNA, 20 nt, Artificial Sequence
  MKO10083635_B_Entpd4
  gRNA
ggcccgagucacagacguug

SEQ ID NO: 83636 - RNA, 20 nt, Artificial Sequence
  MKO10083636_B_Entpd4
  gRNA
aggaagaucaccuuucagga

SEQ ID NO: 83637 - RNA, 20 nt, Artificial Sequence
  MKO10083637_B_Entpd4
  gRNA
uugcugcagaacaugugccu

SEQ ID NO: 83638 - RNA, 20 nt, Artificial Sequence
  MKO10083638_B_Entpd5
  gRNA
gccguugcuuucagaaccac

SEQ ID NO: 83639 - RNA, 20 nt, Artificial Sequence
  MKO10083639_B_Entpd5
  gRNA
aauaggacagcuccccuuuc

SEQ ID NO: 83640 - RNA, 20 nt, Artificial Sequence
  MKO10083640_B_Entpd5
  gRNA
agauggcagcguuagcauca

SEQ ID NO: 83641 - RNA, 20 nt, Artificial Sequence
  MKO10083641_B_Entpd6
  gRNA
cagcaggcgcaaaccagcug

SEQ ID NO: 83642 - RNA, 20 nt, Artificial Sequence
  MKO10083642_B_Entpd6
  gRNA
gcugguuugcgccugcugcc

SEQ ID NO: 83643 - RNA, 20 nt, Artificial Sequence
  MKO10083643_B_Entpd6
  gRNA
uuacgcugaugauguugaaa

SEQ ID NO: 83644 - RNA, 20 nt, Artificial Sequence
  MKO10083644_B_Entpd7
  gRNA
ugagcccguuucuccgucag

SEQ ID NO: 83645 - RNA, 20 nt, Artificial Sequence
  MKO10083645_B_Entpd7
  gRNA
acgaguccauaauucagauu

SEQ ID NO: 83646 - RNA, 20 nt, Artificial Sequence
  MKO10083646_B_Entpd7
  gRNA
gccucaugcccgcagugcag

SEQ ID NO: 83647 - RNA, 20 nt, Artificial Sequence
  MKO10083647_B_Entpd8
  gRNA
gcagaucagcuucgugccuc

SEQ ID NO: 83648 - RNA, 20 nt, Artificial Sequence
  MKO10083648_B_Entpd8
  gRNA
guugauggugauccaaccaa

SEQ ID NO: 83649 - RNA, 20 nt, Artificial Sequence
  MKO10083649_B_Entpd8
  gRNA
gaucaccaucaacuaugucc

SEQ ID NO: 83650 - RNA, 20 nt, Artificial Sequence
  MKO10083650_B_Eny2
  gRNA
agcuccuucuuuacacuguc

SEQ ID NO: 83651 - RNA, 20 nt, Artificial Sequence
  MKO10083651_B_Eny2
  gRNA
cuccaguuucuauuaacuuu

SEQ ID NO: 83652 - RNA, 20 nt, Artificial Sequence
  MKO10083652_B_Eny2
  gRNA
aaccaaaaguuaauagaaac

SEQ ID NO: 83653 - RNA, 20 nt, Artificial Sequence
  MKO10083653_B_Eogu
  gRNA
auuucagagcgacucaaguc

SEQ ID NO: 83654 - RNA, 20 nt, Artificial Sequence
  MKO10083654_B_Eogu
  gRNA
ugcgcaccagaguuuagauu

SEQ ID NO: 83655 - RNA, 20 nt, Artificial Sequence
  MKO10083655_B_Eogu
  gRNA
aaucacguuaccaagacugc

SEQ ID NO: 83656 - RNA, 20 nt, Artificial Sequence
  MKO10083656_B_Eomes
  gRNA
gggcacucacauccguguuu

SEQ ID NO: 83657 - RNA, 20 nt, Artificial Sequence
  MKO10083657_B_Eomes
  gRNA
ugccccccuggaagcgccag

SEQ ID NO: 83658 - RNA, 20 nt, Artificial Sequence
  MKO10083658_B_Eomes
  gRNA
gcacaucguggaagugacag

SEQ ID NO: 83659 - RNA, 20 nt, Artificial Sequence
  MKO10083659_B_Ep300
  gRNA
augcucacaagugccagcgc

SEQ ID NO: 83660 - RNA, 20 nt, Artificial Sequence
  MKO10083660_B_Ep300
  gRNA
ucaccauacacucagaauuc

SEQ ID NO: 83661 - RNA, 20 nt, Artificial Sequence
  MKO10083661_B_Ep300
  gRNA
cucgacaaaucauuucacac

SEQ ID NO: 83662 - RNA, 20 nt, Artificial Sequence
  MKO10083662_B_Ep400
  gRNA
guuuauccugagaaccgucc

SEQ ID NO: 83663 - RNA, 20 nt, Artificial Sequence
  MKO10083663_B_Ep400
  gRNA
ucggaacauguagggccggc

SEQ ID NO: 83664 - RNA, 20 nt, Artificial Sequence
  MKO10083664_B_Ep400
  gRNA
cagaagccgaccccuuuaag

SEQ ID NO: 83665 - RNA, 20 nt, Artificial Sequence
  MKO10083665_B_Epas1
  gRNA
caaagccuccaucaugcgcc

SEQ ID NO: 83666 - RNA, 20 nt, Artificial Sequence
  MKO10083666_B_Epas1
  gRNA
cggaucuccucauggucgca

SEQ ID NO: 83667 - RNA, 20 nt, Artificial Sequence
  MKO10083667_B_Epas1
  gRNA
gguacaaguuauccauuugc

SEQ ID NO: 83668 - RNA, 20 nt, Artificial Sequence
  MKO10083668_B_Epb4.1l1
  gRNA
gaccgaaguaguccuucucc

SEQ ID NO: 83669 - RNA, 20 nt, Artificial Sequence
  MKO10083669_B_Epb4.1l1
  gRNA
cugugagcaccuuaaccucc

SEQ ID NO: 83670 - RNA, 20 nt, Artificial Sequence
  MKO10083670_B_Epb4.1l1
  gRNA
aggguagaacuugacuguga

SEQ ID NO: 83671 - RNA, 20 nt, Artificial Sequence
  MKO10083671_B_Epb4.1l2
  gRNA
gugcgagcaccugaaccucu

SEQ ID NO: 83672 - RNA, 20 nt, Artificial Sequence
  MKO10083672_B_Epb4.1l2
  gRNA
gaacuggcuagauccugcaa

SEQ ID NO: 83673 - RNA, 20 nt, Artificial Sequence
  MKO10083673_B_Epb4.1l2
  gRNA
caagaagaccaagacugucc

SEQ ID NO: 83674 - RNA, 20 nt, Artificial Sequence
  MKO10083674_B_Epb4.1l3
  gRNA
gcagugcaaagugacgcuuc

SEQ ID NO: 83675 - RNA, 20 nt, Artificial Sequence
  MKO10083675_B_Epb4.1l3
  gRNA
ccccgcugaagaucgugaaa

SEQ ID NO: 83676 - RNA, 20 nt, Artificial Sequence
  MKO10083676_B_Epb4.1l3
  gRNA
agcuaucagaagauaucacc

SEQ ID NO: 83677 - RNA, 20 nt, Artificial Sequence
  MKO10083677_B_Epb4.1l4a
  gRNA
gcaaggcagccggcccugaa

SEQ ID NO: 83678 - RNA, 20 nt, Artificial Sequence
  MKO10083678_B_Epb4.1l4a
  gRNA
ucagcuccuuguguucugca

SEQ ID NO: 83679 - RNA, 20 nt, Artificial Sequence
  MKO10083679_B_Epb4.1l4a
  gRNA
aaaaacccuugcagaacaca

SEQ ID NO: 83680 - RNA, 20 nt, Artificial Sequence
  MKO10083680_B_Epb4.1l4b
  gRNA
agaaccaaacaaccuucgag

SEQ ID NO: 83681 - RNA, 20 nt, Artificial Sequence
  MKO10083681_B_Epb4.1l4b
  gRNA
gccugaguuguaaaacaaac

SEQ ID NO: 83682 - RNA, 20 nt, Artificial Sequence
  MKO10083682_B_Epb4.1l4b
  gRNA
accuuucaucuguuucuuua

SEQ ID NO: 83683 - RNA, 20 nt, Artificial Sequence
  MKO10083683_B_Epb4.1l5
  gRNA
uguuuacagcauugguugga

SEQ ID NO: 83684 - RNA, 20 nt, Artificial Sequence
  MKO10083684_B_Epb4.1l5
  gRNA
ugaccaaaucauguaucacc

SEQ ID NO: 83685 - RNA, 20 nt, Artificial Sequence
  MKO10083685_B_Epb4.1l5
  gRNA
aacucgaagaugaagacaau

SEQ ID NO: 83686 - RNA, 20 nt, Artificial Sequence
  MKO10083686_B_Epb4.1
  gRNA
cucccaagcggccgcagcug

SEQ ID NO: 83687 - RNA, 20 nt, Artificial Sequence
  MKO10083687_B_Epb4.1
  gRNA
gugcgagcaccucaaccuuu

SEQ ID NO: 83688 - RNA, 20 nt, Artificial Sequence
  MKO10083688_B_Epb4.1
  gRNA
auguguuggaguguccccau

SEQ ID NO: 83689 - RNA, 20 nt, Artificial Sequence
  MKO10083689_B_Epb4.2
  gRNA
ccacgcagcagaaaacaacg

SEQ ID NO: 83690 - RNA, 20 nt, Artificial Sequence
  MKO10083690_B_Epb4.2
  gRNA
ccacuacucacucuugcuuc

SEQ ID NO: 83691 - RNA, 20 nt, Artificial Sequence
  MKO10083691_B_Epb4.2
  gRNA
gaaugcagucagcugugccc

SEQ ID NO: 83692 - RNA, 20 nt, Artificial Sequence
  MKO10083692_B_Epc1
  gRNA
ucagaauccagaucguaauc

SEQ ID NO: 83693 - RNA, 20 nt, Artificial Sequence
  MKO10083693_B_Epc1
  gRNA
agcugcgccgcgaucucagc

SEQ ID NO: 83694 - RNA, 20 nt, Artificial Sequence
  MKO10083694_B_Epc1
  gRNA
ugacagcccggcugagaucg

SEQ ID NO: 83695 - RNA, 20 nt, Artificial Sequence
  MKO10083695_B_Epc2
  gRNA
gcgcugaaauagcucgcugu

SEQ ID NO: 83696 - RNA, 20 nt, Artificial Sequence
  MKO10083696_B_Epc2
  gRNA
uauuacaaucgcuuguacaa

SEQ ID NO: 83697 - RNA, 20 nt, Artificial Sequence
  MKO10083697_B_Epc2
  gRNA
uuaaagcuguauaugacuac

SEQ ID NO: 83698 - RNA, 20 nt, Artificial Sequence
  MKO10083698_B_Epcam
  gRNA
cucacgucugcaagcucuga

SEQ ID NO: 83699 - RNA, 20 nt, Artificial Sequence
  MKO10083699_B_Epcam
  gRNA
ugucugugacaacuacaagc

SEQ ID NO: 83700 - RNA, 20 nt, Artificial Sequence
  MKO10083700_B_Epcam
  gRNA
gaaugccaguguacuuccua

SEQ ID NO: 83701 - RNA, 20 nt, Artificial Sequence
  MKO10083701_B_Epdr1
  gRNA
cguccagcacccgcacgcgc

SEQ ID NO: 83702 - RNA, 20 nt, Artificial Sequence
  MKO10083702_B_Epdr1
  gRNA
cugcuccugaggcccuccga

SEQ ID NO: 83703 - RNA, 20 nt, Artificial Sequence
  MKO10083703_B_Epdr1
  gRNA
gaucuuugcacacuguuugg

SEQ ID NO: 83704 - RNA, 20 nt, Artificial Sequence
  MKO10083704_B_Epg5
  gRNA
ggaugaaggucccccgguac

SEQ ID NO: 83705 - RNA, 20 nt, Artificial Sequence
  MKO10083705_B_Epg5
  gRNA
uuucauucaucucuacucgc

SEQ ID NO: 83706 - RNA, 20 nt, Artificial Sequence
  MKO10083706_B_Epg5
  gRNA
gagaucuuuagcaguuuauc

SEQ ID NO: 83707 - RNA, 20 nt, Artificial Sequence
  MKO10083707_B_Epgn
  gRNA
cccuccagagcagaugaugu

SEQ ID NO: 83708 - RNA, 20 nt, Artificial Sequence
  MKO10083708_B_Epgn
  gRNA
cauuaaugcaguaacuauua

SEQ ID NO: 83709 - RNA, 20 nt, Artificial Sequence
  MKO10083709_B_Epgn
  gRNA
ucacccuacaucaucugcuc

SEQ ID NO: 83710 - RNA, 20 nt, Artificial Sequence
  MKO10083710_B_Epha10
  gRNA
gugguaucaggcagacgaac

SEQ ID NO: 83711 - RNA, 20 nt, Artificial Sequence
  MKO10083711_B_Epha10
  gRNA
ccuccccuuaguuauccucc

SEQ ID NO: 83712 - RNA, 20 nt, Artificial Sequence
  MKO10083712_B_Epha10
  gRNA
uggacugcacugccaagcac

SEQ ID NO: 83713 - RNA, 20 nt, Artificial Sequence
  MKO10083713_B_Epha1
  gRNA
gaauguagaacgcugcucgu

SEQ ID NO: 83714 - RNA, 20 nt, Artificial Sequence
  MKO10083714_B_Epha1
  gRNA
acauuaucgagccccugggg

SEQ ID NO: 83715 - RNA, 20 nt, Artificial Sequence
  MKO10083715_B_Epha1
  gRNA
uccacucgauagaaaccagu

SEQ ID NO: 83716 - RNA, 20 nt, Artificial Sequence
  MKO10083716_B_Epha2
  gRNA
gugccaaaguagaacugcgu

SEQ ID NO: 83717 - RNA, 20 nt, Artificial Sequence
  MKO10083717_B_Epha2
  gRNA
cucacgcaccccuauggcaa

SEQ ID NO: 83718 - RNA, 20 nt, Artificial Sequence
  MKO10083718_B_Epha2
  gRNA
uuuacucaccccuuugccau

SEQ ID NO: 83719 - RNA, 20 nt, Artificial Sequence
  MKO10083719_B_Epha3
  gRNA
acuccaguccaggauaaccg

SEQ ID NO: 83720 - RNA, 20 nt, Artificial Sequence
  MKO10083720_B_Epha3
  gRNA
auuuaacucaccccauggga

SEQ ID NO: 83721 - RNA, 20 nt, Artificial Sequence
  MKO10083721_B_Epha3
  gRNA
uugucugcagcuugucgacc

SEQ ID NO: 83722 - RNA, 20 nt, Artificial Sequence
  MKO10083722_B_Epha4
  gRNA
guaguggacuccacuuccac

SEQ ID NO: 83723 - RNA, 20 nt, Artificial Sequence
  MKO10083723_B_Epha4
  gRNA
ucaggacauuucuuacaacg

SEQ ID NO: 83724 - RNA, 20 nt, Artificial Sequence
  MKO10083724_B_Epha4
  gRNA
cuuggcacaggaggcguccg

SEQ ID NO: 83725 - RNA, 20 nt, Artificial Sequence
  MKO10083725_B_Epha5
  gRNA
aaagaacuuaccccguucuu

SEQ ID NO: 83726 - RNA, 20 nt, Artificial Sequence
  MKO10083726_B_Epha5
  gRNA
agagaccaguauuacagccg

SEQ ID NO: 83727 - RNA, 20 nt, Artificial Sequence
  MKO10083727_B_Epha5
  gRNA
cgcacugucaugggggaccu

SEQ ID NO: 83728 - RNA, 20 nt, Artificial Sequence
  MKO10083728_B_Epha6
  gRNA
gacugacguugcuuccacgu

SEQ ID NO: 83729 - RNA, 20 nt, Artificial Sequence
  MKO10083729_B_Epha6
  gRNA
acagugacuacagaucacga

SEQ ID NO: 83730 - RNA, 20 nt, Artificial Sequence
  MKO10083730_B_Epha6
  gRNA
caacaauucugugguaguac

SEQ ID NO: 83731 - RNA, 20 nt, Artificial Sequence
  MKO10083731_B_Epha7
  gRNA
cacuccgauaagaacauacc

SEQ ID NO: 83732 - RNA, 20 nt, Artificial Sequence
  MKO10083732_B_Epha7
  gRNA
uuuguagaaccugcggccac

SEQ ID NO: 83733 - RNA, 20 nt, Artificial Sequence
  MKO10083733_B_Epha7
  gRNA
gcaccaugguuguucaaacu

SEQ ID NO: 83734 - RNA, 20 nt, Artificial Sequence
  MKO10083734_B_Epha8
  gRNA
aggccgcgcgguaguagcug

SEQ ID NO: 83735 - RNA, 20 nt, Artificial Sequence
  MKO10083735_B_Epha8
  gRNA
ugaccucagcuacuaccgcg

SEQ ID NO: 83736 - RNA, 20 nt, Artificial Sequence
  MKO10083736_B_Epha8
  gRNA
uggcucacguaucccgcuca

SEQ ID NO: 83737 - RNA, 20 nt, Artificial Sequence
  MKO10083737_B_Ephb1
  gRNA
guucgaagacguugcacacu

SEQ ID NO: 83738 - RNA, 20 nt, Artificial Sequence
  MKO10083738_B_Ephb1
  gRNA
cagcucgguaauagccaguc

SEQ ID NO: 83739 - RNA, 20 nt, Artificial Sequence
  MKO10083739_B_Ephb1
  gRNA
gcgauacucaccccagaggc

SEQ ID NO: 83740 - RNA, 20 nt, Artificial Sequence
  MKO10083740_B_Ephb2
  gRNA
cgcagcgcgugcaugcgccc

SEQ ID NO: 83741 - RNA, 20 nt, Artificial Sequence
  MKO10083741_B_Ephb2
  gRNA
gcaggcuucguccccuuggu

SEQ ID NO: 83742 - RNA, 20 nt, Artificial Sequence
  MKO10083742_B_Ephb2
  gRNA
cggcccuguaguagccguug

SEQ ID NO: 83743 - RNA, 20 nt, Artificial Sequence
  MKO10083743_B_Ephb3
  gRNA
ugccgggcgugucaacacca

SEQ ID NO: 83744 - RNA, 20 nt, Artificial Sequence
  MKO10083744_B_Ephb3
  gRNA
caauagccgcaccaccucgc

SEQ ID NO: 83745 - RNA, 20 nt, Artificial Sequence
  MKO10083745_B_Ephb3
  gRNA
cgagguggugcggcuauugg

SEQ ID NO: 83746 - RNA, 20 nt, Artificial Sequence
  MKO10083746_B_Ephb4
  gRNA
gagcucccgaggcaccgucu

SEQ ID NO: 83747 - RNA, 20 nt, Artificial Sequence
  MKO10083747_B_Ephb4
  gRNA
gaaaugggugacuuacccuc

SEQ ID NO: 83748 - RNA, 20 nt, Artificial Sequence
  MKO10083748_B_Ephb4
  gRNA
ucccucgccacugcuuuaga

SEQ ID NO: 83749 - RNA, 20 nt, Artificial Sequence
  MKO10083749_B_Ephb6
  gRNA
ggggaugugucgccgcugca

SEQ ID NO: 83750 - RNA, 20 nt, Artificial Sequence
  MKO10083750_B_Ephb6
  gRNA
uggcucaccuacccgccagg

SEQ ID NO: 83751 - RNA, 20 nt, Artificial Sequence
  MKO10083751_B_Ephb6
  gRNA
ggccaguucggacccaccag

SEQ ID NO: 83752 - RNA, 20 nt, Artificial Sequence
  MKO10083752_B_Ephx1
  gRNA
caagaaaucucccaaaacgu

SEQ ID NO: 83753 - RNA, 20 nt, Artificial Sequence
  MKO10083753_B_Ephx1
  gRNA
gagguuucacguggaugaag

SEQ ID NO: 83754 - RNA, 20 nt, Artificial Sequence
  MKO10083754_B_Ephx1
  gRNA
guuccgggcauccccaccuu

SEQ ID NO: 83755 - RNA, 20 nt, Artificial Sequence
  MKO10083755_B_Ephx2
  gRNA
guaccagacggaauucccag

SEQ ID NO: 83756 - RNA, 20 nt, Artificial Sequence
  MKO10083756_B_Ephx2
  gRNA
gucccucugggaauuccguc

SEQ ID NO: 83757 - RNA, 20 nt, Artificial Sequence
  MKO10083757_B_Ephx2
  gRNA
caucaaccgccccaugcuuc

SEQ ID NO: 83758 - RNA, 20 nt, Artificial Sequence
  MKO10083758_B_Ephx3
  gRNA
gcaugucuacagccacgaca

SEQ ID NO: 83759 - RNA, 20 nt, Artificial Sequence
  MKO10083759_B_Ephx3
  gRNA
ccaugcagaaauagcaugag

SEQ ID NO: 83760 - RNA, 20 nt, Artificial Sequence
  MKO10083760_B_Ephx3
  gRNA
cgucugcacuaugucucugc

SEQ ID NO: 83761 - RNA, 20 nt, Artificial Sequence
  MKO10083761_B_Ephx4
  gRNA
cuauuucagaguauauacug

SEQ ID NO: 83762 - RNA, 20 nt, Artificial Sequence
  MKO10083762_B_Ephx4
  gRNA
uuguaacucucuugaugagc

SEQ ID NO: 83763 - RNA, 20 nt, Artificial Sequence
  MKO10083763_B_Ephx4
  gRNA
aacauagugaaaucuuaacc

SEQ ID NO: 83764 - RNA, 20 nt, Artificial Sequence
  MKO10083764_B_Epm2aip1
  gRNA
cacgucgcguucccgaguag

SEQ ID NO: 83765 - RNA, 20 nt, Artificial Sequence
  MKO10083765_B_Epm2aip1
  gRNA
ccguggcgucggccgcgacc

SEQ ID NO: 83766 - RNA, 20 nt, Artificial Sequence
  MKO10083766_B_Epm2aip1
  gRNA
ccuggucgagcgucugcggc

SEQ ID NO: 83767 - RNA, 20 nt, Artificial Sequence
  MKO10083767_B_Epm2a
  gRNA
uccucgucaauguagaccgc

SEQ ID NO: 83768 - RNA, 20 nt, Artificial Sequence
  MKO10083768_B_Epm2a
  gRNA
ucacauguuccaguuggcga

SEQ ID NO: 83769 - RNA, 20 nt, Artificial Sequence
  MKO10083769_B_Epm2a
  gRNA
ggguagcugcccucgccaac

SEQ ID NO: 83770 - RNA, 20 nt, Artificial Sequence
  MKO10083770_B_Epn1
  gRNA
gagccgagaggagcacgaua

SEQ ID NO: 83771 - RNA, 20 nt, Artificial Sequence
  MKO10083771_B_Epn1
  gRNA
ugaccuuaucgugcuccucu

SEQ ID NO: 83772 - RNA, 20 nt, Artificial Sequence
  MKO10083772_B_Epn1
  gRNA
caugccugcuccgccucggg

SEQ ID NO: 83773 - RNA, 20 nt, Artificial Sequence
  MKO10083773_B_Epn2
  gRNA
cuucgaacauuacugacccg

SEQ ID NO: 83774 - RNA, 20 nt, Artificial Sequence
  MKO10083774_B_Epn2
  gRNA
cugcuaaccagaccaacccc

SEQ ID NO: 83775 - RNA, 20 nt, Artificial Sequence
  MKO10083775_B_Epn2
  gRNA
ccgggccugcucuaacucag

SEQ ID NO: 83776 - RNA, 20 nt, Artificial Sequence
  MKO10083776_B_Epn3
  gRNA
cugcuggccaacgucgucaa

SEQ ID NO: 83777 - RNA, 20 nt, Artificial Sequence
  MKO10083777_B_Epn3
  gRNA
ugacaucuucgcaccugccc

SEQ ID NO: 83778 - RNA, 20 nt, Artificial Sequence
  MKO10083778_B_Epn3
  gRNA
cgaagaugucagccaagucc

SEQ ID NO: 83779 - RNA, 20 nt, Artificial Sequence
  MKO10083779_B_Epor
  gRNA
uccgcggcuccgugcguuuc

SEQ ID NO: 83780 - RNA, 20 nt, Artificial Sequence
  MKO10083780_B_Epor
  gRNA
cacccacauccgauaugaag

SEQ ID NO: 83781 - RNA, 20 nt, Artificial Sequence
  MKO10083781_B_Epor
  gRNA
aaacucgauguguccgcugu

SEQ ID NO: 83782 - RNA, 20 nt, Artificial Sequence
  MKO10083782_B_Epo
  gRNA
acugaagcuguacacgggag

SEQ ID NO: 83783 - RNA, 20 nt, Artificial Sequence
  MKO10083783_B_Epo
  gRNA
ccaagcauagaaguugacuu

SEQ ID NO: 83784 - RNA, 20 nt, Artificial Sequence
  MKO10083784_B_Epo
  gRNA
acuccccuagguggaagaac

SEQ ID NO: 83785 - RNA, 20 nt, Artificial Sequence
  MKO10083785_B_Eppin
  gRNA
aacagcaagucagcuagacu

SEQ ID NO: 83786 - RNA, 20 nt, Artificial Sequence
  MKO10083786_B_Eppin
  gRNA
aaaugcuuaaacccccaaca

SEQ ID NO: 83787 - RNA, 20 nt, Artificial Sequence
  MKO10083787_B_Eppin
  gRNA
cucgccagaaugaagcuuuc

SEQ ID NO: 83788 - RNA, 20 nt, Artificial Sequence
  MKO10083788_B_Eppk1
  gRNA
cgcgccacaagcauuuaaau

SEQ ID NO: 83789 - RNA, 20 nt, Artificial Sequence
  MKO10083789_B_Eppk1
  gRNA
ggcagcuccugcaacguuau

SEQ ID NO: 83790 - RNA, 20 nt, Artificial Sequence
  MKO10083790_B_Eppk1
  gRNA
uuccagauaacgucgcaccu

SEQ ID NO: 83791 - RNA, 20 nt, Artificial Sequence
  MKO10083791_B_Eprs
  gRNA
gaauucaauccugcgcuacc

SEQ ID NO: 83792 - RNA, 20 nt, Artificial Sequence
  MKO10083792_B_Eprs
  gRNA
cuagaauugcaacuacgucu

SEQ ID NO: 83793 - RNA, 20 nt, Artificial Sequence
  MKO10083793_B_Eprs
  gRNA
ucucugagaacauaccuagu

SEQ ID NO: 83794 - RNA, 20 nt, Artificial Sequence
  MKO10083794_B_Eps15l1
  gRNA
uagguggacccugccuacac

SEQ ID NO: 83795 - RNA, 20 nt, Artificial Sequence
  MKO10083795_B_Eps15l1
  gRNA
guccaagaacccuuuaccuu

SEQ ID NO: 83796 - RNA, 20 nt, Artificial Sequence
  MKO10083796_B_Eps15l1
  gRNA
ccccgaagguaaaggguucu

SEQ ID NO: 83797 - RNA, 20 nt, Artificial Sequence
  MKO10083797_B_Eps15
  gRNA
caacaguucuuccucauaac

SEQ ID NO: 83798 - RNA, 20 nt, Artificial Sequence
  MKO10083798_B_Eps15
  gRNA
uauuaaucuacaaaaacugc

SEQ ID NO: 83799 - RNA, 20 nt, Artificial Sequence
  MKO10083799_B_Eps15
  gRNA
ucugcucauccaguucaccc

SEQ ID NO: 83800 - RNA, 20 nt, Artificial Sequence
  MKO10083800_B_Eps8l1
  gRNA
gagaaaacguuacuccaccg

SEQ ID NO: 83801 - RNA, 20 nt, Artificial Sequence
  MKO10083801_B_Eps8l1
  gRNA
ccugugcccagacacgcccc

SEQ ID NO: 83802 - RNA, 20 nt, Artificial Sequence
  MKO10083802_B_Eps8l1
  gRNA
ccaagugcaaagucuaucua

SEQ ID NO: 83803 - RNA, 20 nt, Artificial Sequence
  MKO10083803_B_Eps8l2
  gRNA
ugugcccaggaugagcgcaa

SEQ ID NO: 83804 - RNA, 20 nt, Artificial Sequence
  MKO10083804_B_Eps8l2
  gRNA
acuugucguucaccugcagc

SEQ ID NO: 83805 - RNA, 20 nt, Artificial Sequence
  MKO10083805_B_Eps8l2
  gRNA
agucucaugcaugaugacgu

SEQ ID NO: 83806 - RNA, 20 nt, Artificial Sequence
  MKO10083806_B_Eps8l3
  gRNA
gagucaagaccuguuccugc

SEQ ID NO: 83807 - RNA, 20 nt, Artificial Sequence
  MKO10083807_B_Eps8l3
  gRNA
aguuauaggagcagguguua

SEQ ID NO: 83808 - RNA, 20 nt, Artificial Sequence
  MKO10083808_B_Eps8l3
  gRNA
aaccuacccuccuacagcac

SEQ ID NO: 83809 - RNA, 20 nt, Artificial Sequence
  MKO10083809_B_Eps8
  gRNA
agaugcaaugaucacugucg

SEQ ID NO: 83810 - RNA, 20 nt, Artificial Sequence
  MKO10083810_B_Eps8
  gRNA
uuugcauaccaaggcgagaa

SEQ ID NO: 83811 - RNA, 20 nt, Artificial Sequence
  MKO10083811_B_Eps8
  gRNA
uucaccacccuauucccaga

SEQ ID NO: 83812 - RNA, 20 nt, Artificial Sequence
  MKO10083812_B_Epsti1
  gRNA
gcguucuaaauaccagcaaa

SEQ ID NO: 83813 - RNA, 20 nt, Artificial Sequence
  MKO10083813_B_Epsti1
  gRNA
uagcaccaaacgagagcaga

SEQ ID NO: 83814 - RNA, 20 nt, Artificial Sequence
  MKO10083814_B_Epsti1
  gRNA
gucugacuucagccucagac

SEQ ID NO: 83815 - RNA, 20 nt, Artificial Sequence
  MKO10083815_B_Ept1
  gRNA
accaauuccagcaccccguu

SEQ ID NO: 83816 - RNA, 20 nt, Artificial Sequence
  MKO10083816_B_Ept1
  gRNA
gucauaagcaugugccugac

SEQ ID NO: 83817 - RNA, 20 nt, Artificial Sequence
  MKO10083817_B_Ept1
  gRNA
uuaccugaagcauagaaguc

SEQ ID NO: 83818 - RNA, 20 nt, Artificial Sequence
  MKO10083818_B_Epx
  gRNA
ccuucgagacugcauagcag

SEQ ID NO: 83819 - RNA, 20 nt, Artificial Sequence
  MKO10083819_B_Epx
  gRNA
aagccauuacgccucuuucc

SEQ ID NO: 83820 - RNA, 20 nt, Artificial Sequence
  MKO10083820_B_Epx
  gRNA
guuguugcaucucccuguua

SEQ ID NO: 83821 - RNA, 20 nt, Artificial Sequence
  MKO10083821_B_Epyc
  gRNA
ugaagagcccgcagacuuuc

SEQ ID NO: 83822 - RNA, 20 nt, Artificial Sequence
  MKO10083822_B_Epyc
  gRNA
auuugaccuucguuggugug

SEQ ID NO: 83823 - RNA, 20 nt, Artificial Sequence
  MKO10083823_B_Epyc
  gRNA
gaggaauagcguccaguuca

SEQ ID NO: 83824 - RNA, 20 nt, Artificial Sequence
  MKO10083824_B_Eqtn
  gRNA
ucaucugaaagugucacacc

SEQ ID NO: 83825 - RNA, 20 nt, Artificial Sequence
  MKO10083825_B_Eqtn
  gRNA
uucuguugcuuuacauaaau

SEQ ID NO: 83826 - RNA, 20 nt, Artificial Sequence
  MKO10083826_B_Eqtn
  gRNA
cccccaauauaccugcauuu

SEQ ID NO: 83827 - RNA, 20 nt, Artificial Sequence
  MKO10083827_B_Eral1
  gRNA
ccccagagcuugacaucgag

SEQ ID NO: 83828 - RNA, 20 nt, Artificial Sequence
  MKO10083828_B_Eral1
  gRNA
ccguggauucucaggcaugu

SEQ ID NO: 83829 - RNA, 20 nt, Artificial Sequence
  MKO10083829_B_Eral1
  gRNA
caccacucgaugucaagcuc

SEQ ID NO: 83830 - RNA, 20 nt, Artificial Sequence
  MKO10083830_B_Erap1
  gRNA
gaagaugaguaccuaccuag

SEQ ID NO: 83831 - RNA, 20 nt, Artificial Sequence
  MKO10083831_B_Erap1
  gRNA
gcaaucccagacuuucaguc

SEQ ID NO: 83832 - RNA, 20 nt, Artificial Sequence
  MKO10083832_B_Erap1
  gRNA
ggccaucuccaacaugcccc

SEQ ID NO: 83833 - RNA, 20 nt, Artificial Sequence
  MKO10083833_B_Eras
  gRNA
caucugggcaggauauucac

SEQ ID NO: 83834 - RNA, 20 nt, Artificial Sequence
  MKO10083834_B_Eras
  gRNA
ccacuauccaagauuccuac

SEQ ID NO: 83835 - RNA, 20 nt, Artificial Sequence
  MKO10083835_B_Eras
  gRNA
uuguugcccacuaguaccag

SEQ ID NO: 83836 - RNA, 20 nt, Artificial Sequence
  MKO10083836_B_Erbb2ip
  gRNA
agcagcugagaaaacccauc

SEQ ID NO: 83837 - RNA, 20 nt, Artificial Sequence
  MKO10083837_B_Erbb2ip
  gRNA
gagagacuuacuuagaaaua

SEQ ID NO: 83838 - RNA, 20 nt, Artificial Sequence
  MKO10083838_B_Erbb2ip
  gRNA
uuucucuaaguucuagaauc

SEQ ID NO: 83839 - RNA, 20 nt, Artificial Sequence
  MKO10083839_B_Erbb2
  gRNA
ugacguuguccaaagggucu

SEQ ID NO: 83840 - RNA, 20 nt, Artificial Sequence
  MKO10083840_B_Erbb2
  gRNA
caugcuucgccaccucuacc

SEQ ID NO: 83841 - RNA, 20 nt, Artificial Sequence
  MKO10083841_B_Erbb2
  gRNA
agggagucgcaacuucaugu

SEQ ID NO: 83842 - RNA, 20 nt, Artificial Sequence
  MKO10083842_B_Erbb3
  gRNA
cucagcccguuuagaguccc

SEQ ID NO: 83843 - RNA, 20 nt, Artificial Sequence
  MKO10083843_B_Erbb3
  gRNA
gucccguaagcacaaucucc

SEQ ID NO: 83844 - RNA, 20 nt, Artificial Sequence
  MKO10083844_B_Erbb3
  gRNA
uugacuggagggacaucgug

SEQ ID NO: 83845 - RNA, 20 nt, Artificial Sequence
  MKO10083845_B_Erbb4
  gRNA
aucggccagugcaagacuua

SEQ ID NO: 83846 - RNA, 20 nt, Artificial Sequence
  MKO10083846_B_Erbb4
  gRNA
gcucgaugcuggugaucucc

SEQ ID NO: 83847 - RNA, 20 nt, Artificial Sequence
  MKO10083847_B_Erbb4
  gRNA
guauagugucagcauaacau

SEQ ID NO: 83848 - RNA, 20 nt, Artificial Sequence
  MKO10083848_B_Erc1
  gRNA
gcccgcucuuucuuuaacuc

SEQ ID NO: 83849 - RNA, 20 nt, Artificial Sequence
  MKO10083849_B_Erc1
  gRNA
ugggcuccgagaccuggaag

SEQ ID NO: 83850 - RNA, 20 nt, Artificial Sequence
  MKO10083850_B_Erc1
  gRNA
auucagaugcugaagucaaa

SEQ ID NO: 83851 - RNA, 20 nt, Artificial Sequence
  MKO10083851_B_Erc2
  gRNA
ggaggagaucaaacaaaucg

SEQ ID NO: 83852 - RNA, 20 nt, Artificial Sequence
  MKO10083852_B_Erc2
  gRNA
uauugccgcucucuugcugc

SEQ ID NO: 83853 - RNA, 20 nt, Artificial Sequence
  MKO10083853_B_Erc2
  gRNA
gcguaacauccgggaccugg

SEQ ID NO: 83854 - RNA, 20 nt, Artificial Sequence
  MKO10083854_B_Ercc1
  gRNA
cuugaaccagcagcacacga

SEQ ID NO: 83855 - RNA, 20 nt, Artificial Sequence
  MKO10083855_B_Ercc1
  gRNA
aaucaccucaccgaauuccc

SEQ ID NO: 83856 - RNA, 20 nt, Artificial Sequence
  MKO10083856_B_Ercc1
  gRNA
ggugauucccgauuaugugc

SEQ ID NO: 83857 - RNA, 20 nt, Artificial Sequence
  MKO10083857_B_Ercc2
  gRNA
ccgugagcaguagauaaguu

SEQ ID NO: 83858 - RNA, 20 nt, Artificial Sequence
  MKO10083858_B_Ercc2
  gRNA
ucaccucgggaugaaugcac

SEQ ID NO: 83859 - RNA, 20 nt, Artificial Sequence
  MKO10083859_B_Ercc2
  gRNA
cccgcugauaggccacaauc

SEQ ID NO: 83860 - RNA, 20 nt, Artificial Sequence
  MKO10083860_B_Ercc3
  gRNA
cguuccucaagcgacauucc

SEQ ID NO: 83861 - RNA, 20 nt, Artificial Sequence
  MKO10083861_B_Ercc3
  gRNA
cgccuacucccucuaugcag

SEQ ID NO: 83862 - RNA, 20 nt, Artificial Sequence
  MKO10083862_B_Ercc3
  gRNA
gaggcggugcccuccgccgc

SEQ ID NO: 83863 - RNA, 20 nt, Artificial Sequence
  MKO10083863_B_Ercc4
  gRNA
ugcaacaagccgaauacucg

SEQ ID NO: 83864 - RNA, 20 nt, Artificial Sequence
  MKO10083864_B_Ercc4
  gRNA
aagaaguggaccuugucgaa

SEQ ID NO: 83865 - RNA, 20 nt, Artificial Sequence
  MKO10083865_B_Ercc4
  gRNA
uugucacuagaaaacgcucu

SEQ ID NO: 83866 - RNA, 20 nt, Artificial Sequence
  MKO10083866_B_Ercc5
  gRNA
cucggacuccuuuaagugcu

SEQ ID NO: 83867 - RNA, 20 nt, Artificial Sequence
  MKO10083867_B_Ercc5
  gRNA
ucuuugaaccugagugagac

SEQ ID NO: 83868 - RNA, 20 nt, Artificial Sequence
  MKO10083868_B_Ercc5
  gRNA
aaacugcuuucagaagcuca

SEQ ID NO: 83869 - RNA, 20 nt, Artificial Sequence
  MKO10083869_B_Ercc6l2
  gRNA
ccgaguuacagaaguuauga

SEQ ID NO: 83870 - RNA, 20 nt, Artificial Sequence
  MKO10083870_B_Ercc6l2
  gRNA
aguaacucugaaauaucccc

SEQ ID NO: 83871 - RNA, 20 nt, Artificial Sequence
  MKO10083871_B_Ercc6l2
  gRNA
ugaaacacugcgcuuguguc

SEQ ID NO: 83872 - RNA, 20 nt, Artificial Sequence
  MKO10083872_B_Ercc6l
  gRNA
aacauaccucagguaacucu

SEQ ID NO: 83873 - RNA, 20 nt, Artificial Sequence
  MKO10083873_B_Ercc6l
  gRNA
aaggacguauucacuucacc

SEQ ID NO: 83874 - RNA, 20 nt, Artificial Sequence
  MKO10083874_B_Ercc6l
  gRNA
uaugagagucuuguagcucg

SEQ ID NO: 83875 - RNA, 20 nt, Artificial Sequence
  MKO10083875_B_Ercc6
  gRNA
ucaucgucgaucuccugaac

SEQ ID NO: 83876 - RNA, 20 nt, Artificial Sequence
  MKO10083876_B_Ercc6
  gRNA
cagccccuccgagaauggcc

SEQ ID NO: 83877 - RNA, 20 nt, Artificial Sequence
  MKO10083877_B_Ercc6
  gRNA
cggaggggcugggguccaag

SEQ ID NO: 83878 - RNA, 20 nt, Artificial Sequence
  MKO10083878_B_Ercc8
  gRNA
uguaaagcaguguguuccgu

SEQ ID NO: 83879 - RNA, 20 nt, Artificial Sequence
  MKO10083879_B_Ercc8
  gRNA
cacgcuguauuugugaacau

SEQ ID NO: 83880 - RNA, 20 nt, Artificial Sequence
  MKO10083880_B_Ercc8
  gRNA
ggguguuaaccccacugcca

SEQ ID NO: 83881 - RNA, 20 nt, Artificial Sequence
  MKO10083881_B_Erdr1
  gRNA
cgaaagcacacacguagaag

SEQ ID NO: 83882 - RNA, 20 nt, Artificial Sequence
  MKO10083882_B_Erdr1
  gRNA
uccaggugcgcgugucgccg

SEQ ID NO: 83883 - RNA, 20 nt, Artificial Sequence
  MKO10083883_B_Erdr1
  gRNA
ggacauuucuguacgcaguc

SEQ ID NO: 83884 - RNA, 20 nt, Artificial Sequence
  MKO10083884_B_Ereg
  gRNA
gaggauaacuguaccgccuu

SEQ ID NO: 83885 - RNA, 20 nt, Artificial Sequence
  MKO10083885_B_Ereg
  gRNA
cuguuucucaucauaaccgc

SEQ ID NO: 83886 - RNA, 20 nt, Artificial Sequence
  MKO10083886_B_Ereg
  gRNA
gcauggccagugcaucuacc

SEQ ID NO: 83887 - RNA, 20 nt, Artificial Sequence
  MKO10083887_B_Erf
  gRNA
ucagcuugucauaguucauc

SEQ ID NO: 83888 - RNA, 20 nt, Artificial Sequence
  MKO10083888_B_Erf
  gRNA
ugcacuugcggaccccccag

SEQ ID NO: 83889 - RNA, 20 nt, Artificial Sequence
  MKO10083889_B_Erf
  gRNA
caauuacccuuucaucgaua

SEQ ID NO: 83890 - RNA, 20 nt, Artificial Sequence
  MKO10083890_B_Ergic1
  gRNA
ugaauccagugagcuccgac

SEQ ID NO: 83891 - RNA, 20 nt, Artificial Sequence
  MKO10083891_B_Ergic1
  gRNA
cagccggcuccauuauucag

SEQ ID NO: 83892 - RNA, 20 nt, Artificial Sequence
  MKO10083892_B_Ergic1
  gRNA
cucacacagccgacauauac

SEQ ID NO: 83893 - RNA, 20 nt, Artificial Sequence
  MKO10083893_B_Ergic2
  gRNA
agauguuggagcagauguac

SEQ ID NO: 83894 - RNA, 20 nt, Artificial Sequence
  MKO10083894_B_Ergic2
  gRNA
ucucagucuaucaagauaca

SEQ ID NO: 83895 - RNA, 20 nt, Artificial Sequence
  MKO10083895_B_Ergic2
  gRNA
accaugguugcuucugcaga

SEQ ID NO: 83896 - RNA, 20 nt, Artificial Sequence
  MKO10083896_B_Ergic3
  gRNA
gacuuguccacguagagcuc

SEQ ID NO: 83897 - RNA, 20 nt, Artificial Sequence
  MKO10083897_B_Ergic3
  gRNA
uggcguccccgugagcucag

SEQ ID NO: 83898 - RNA, 20 nt, Artificial Sequence
  MKO10083898_B_Ergic3
  gRNA
agacuugagcaucgaugcca

SEQ ID NO: 83899 - RNA, 20 nt, Artificial Sequence
  MKO10083899_B_Erg
  gRNA
uaaagccuuaucaacgucau

SEQ ID NO: 83900 - RNA, 20 nt, Artificial Sequence
  MKO10083900_B_Erg
  gRNA
agaaugucggcauuguagcu

SEQ ID NO: 83901 - RNA, 20 nt, Artificial Sequence
  MKO10083901_B_Erg
  gRNA
cgcagagugaucgucccugc

SEQ ID NO: 83902 - RNA, 20 nt, Artificial Sequence
  MKO10083902_B_Erh
  gRNA
uguaugaagaacaucugaag

SEQ ID NO: 83903 - RNA, 20 nt, Artificial Sequence
  MKO10083903_B_Erh
  gRNA
accagccguauaacaaagac

SEQ ID NO: 83904 - RNA, 20 nt, Artificial Sequence
  MKO10083904_B_Erh
  gRNA
ucaauuacuucccagccugu

SEQ ID NO: 83905 - RNA, 20 nt, Artificial Sequence
  MKO10083905_B_Eri1
  gRNA
gaaagcugaucauugacuuc

SEQ ID NO: 83906 - RNA, 20 nt, Artificial Sequence
  MKO10083906_B_Eri1
  gRNA
aaguacuguauacuaacaga

SEQ ID NO: 83907 - RNA, 20 nt, Artificial Sequence
  MKO10083907_B_Eri1
  gRNA
augcugaaagagagcuccgc

SEQ ID NO: 83908 - RNA, 20 nt, Artificial Sequence
  MKO10083908_B_Eri2
  gRNA
cacuuauuucagggcuacug

SEQ ID NO: 83909 - RNA, 20 nt, Artificial Sequence
  MKO10083909_B_Eri2
  gRNA
aguuucacuucagaaguaga

SEQ ID NO: 83910 - RNA, 20 nt, Artificial Sequence
  MKO10083910_B_Eri2
  gRNA
gugcaaaauucagaaagaau

SEQ ID NO: 83911 - RNA, 20 nt, Artificial Sequence
  MKO10083911_B_Eri3
  gRNA
ccggccauuuaacuucagga

SEQ ID NO: 83912 - RNA, 20 nt, Artificial Sequence
  MKO10083912_B_Eri3
  gRNA
uacuucgaagaugccaagac

SEQ ID NO: 83913 - RNA, 20 nt, Artificial Sequence
  MKO10083913_B_Eri3
  gRNA
caccgggaucauucaagcca

SEQ ID NO: 83914 - RNA, 20 nt, Artificial Sequence
  MKO10083914_B_Erich1
  gRNA
gcacacagcuggaucgucuc

SEQ ID NO: 83915 - RNA, 20 nt, Artificial Sequence
  MKO10083915_B_Erich1
  gRNA
gccuuacaauaacgucacug

SEQ ID NO: 83916 - RNA, 20 nt, Artificial Sequence
  MKO10083916_B_Erich1
  gRNA
gcccgaaccgaccagcugug

SEQ ID NO: 83917 - RNA, 20 nt, Artificial Sequence
  MKO10083917_B_Erich2
  gRNA
gucacacuaccuuaagcaac

SEQ ID NO: 83918 - RNA, 20 nt, Artificial Sequence
  MKO10083918_B_Erich2
  gRNA
acuacauaccugggaauuuc

SEQ ID NO: 83919 - RNA, 20 nt, Artificial Sequence
  MKO10083919_B_Erich2
  gRNA
uuuccuucaacguguucucc

SEQ ID NO: 83920 - RNA, 20 nt, Artificial Sequence
  MKO10083920_B_Erlec1
  gRNA
ccccaauccaagagagcuuu

SEQ ID NO: 83921 - RNA, 20 nt, Artificial Sequence
  MKO10083921_B_Erlec1
  gRNA
aauauucaugaauacuaccu

SEQ ID NO: 83922 - RNA, 20 nt, Artificial Sequence
  MKO10083922_B_Erlec1
  gRNA
ucauccccacuugucacaag

SEQ ID NO: 83923 - RNA, 20 nt, Artificial Sequence
  MKO10083923_B_Erlin1
  gRNA
ugcaaaacugguucagcuca

SEQ ID NO: 83924 - RNA, 20 nt, Artificial Sequence
  MKO10083924_B_Erlin1
  gRNA
gaucugaauguuguaaugaa

SEQ ID NO: 83925 - RNA, 20 nt, Artificial Sequence
  MKO10083925_B_Erlin1
  gRNA
gcuuugcuaacgagccccag

SEQ ID NO: 83926 - RNA, 20 nt, Artificial Sequence
  MKO10083926_B_Erlin2
  gRNA
ugaugaacgggagcaugaga

SEQ ID NO: 83927 - RNA, 20 nt, Artificial Sequence
  MKO10083927_B_Erlin2
  gRNA
gaguaugaacgcugcagaac

SEQ ID NO: 83928 - RNA, 20 nt, Artificial Sequence
  MKO10083928_B_Erlin2
  gRNA
cguucuucacuucaucaguu

SEQ ID NO: 83929 - RNA, 20 nt, Artificial Sequence
  MKO10083929_B_Ermap
  gRNA
accacagaaagagccaccgc

SEQ ID NO: 83930 - RNA, 20 nt, Artificial Sequence
  MKO10083930_B_Ermap
  gRNA
ucccaaagccguggacugag

SEQ ID NO: 83931 - RNA, 20 nt, Artificial Sequence
  MKO10083931_B_Ermap
  gRNA
uucuguggucuugcccgucu

SEQ ID NO: 83932 - RNA, 20 nt, Artificial Sequence
  MKO10083932_B_Ermard
  gRNA
auccaagccauuuauagcac

SEQ ID NO: 83933 - RNA, 20 nt, Artificial Sequence
  MKO10083933_B_Ermard
  gRNA
cgcccuuaucacgaacagca

SEQ ID NO: 83934 - RNA, 20 nt, Artificial Sequence
  MKO10083934_B_Ermard
  gRNA
cuugcuaauuaaagaguugc

SEQ ID NO: 83935 - RNA, 20 nt, Artificial Sequence
  MKO10083935_B_Ermn
  gRNA
uucggaggaaucuucuucca

SEQ ID NO: 83936 - RNA, 20 nt, Artificial Sequence
  MKO10083936_B_Ermn
  gRNA
aacugaugcagaugagaccc

SEQ ID NO: 83937 - RNA, 20 nt, Artificial Sequence
  MKO10083937_B_Ermn
  gRNA
acaacgaagagguucucuuc

SEQ ID NO: 83938 - RNA, 20 nt, Artificial Sequence
  MKO10083938_B_Ermp1
  gRNA
gcaucuccguagauauacag

SEQ ID NO: 83939 - RNA, 20 nt, Artificial Sequence
  MKO10083939_B_Ermp1
  gRNA
ggugggccgcuguauaucua

SEQ ID NO: 83940 - RNA, 20 nt, Artificial Sequence
  MKO10083940_B_Ermp1
  gRNA
guuccucuuuaauggcgcag

SEQ ID NO: 83941 - RNA, 20 nt, Artificial Sequence
  MKO10083941_B_Ern1
  gRNA
uccccaugccgaaguucaga

SEQ ID NO: 83942 - RNA, 20 nt, Artificial Sequence
  MKO10083942_B_Ern1
  gRNA
ggggaggccugaaccaauuc

SEQ ID NO: 83943 - RNA, 20 nt, Artificial Sequence
  MKO10083943_B_Ern1
  gRNA
uuccucccagaucccaauga

SEQ ID NO: 83944 - RNA, 20 nt, Artificial Sequence
  MKO10083944_B_Ern2
  gRNA
cccuacagaccccaucaucc

SEQ ID NO: 83945 - RNA, 20 nt, Artificial Sequence
  MKO10083945_B_Ern2
  gRNA
ccaucagccccuguuguuuc

SEQ ID NO: 83946 - RNA, 20 nt, Artificial Sequence
  MKO10083946_B_Ern2
  gRNA
acuuacucugugacauacau

SEQ ID NO: 83947 - RNA, 20 nt, Artificial Sequence
  MKO10083947_B_Ero1lb
  gRNA
ugaaacgaccauguccuuuc

SEQ ID NO: 83948 - RNA, 20 nt, Artificial Sequence
  MKO10083948_B_Ero1lb
  gRNA
uugccuuagcgugcuguuga

SEQ ID NO: 83949 - RNA, 20 nt, Artificial Sequence
  MKO10083949_B_Ero1lb
  gRNA
cauacucuuacuucuggaca

SEQ ID NO: 83950 - RNA, 20 nt, Artificial Sequence
  MKO10083950_B_Ero1l
  gRNA
aauuaagucugcgagcuaca

SEQ ID NO: 83951 - RNA, 20 nt, Artificial Sequence
  MKO10083951_B_Ero1l
  gRNA
ugacuacuuuagauauuaca

SEQ ID NO: 83952 - RNA, 20 nt, Artificial Sequence
  MKO10083952_B_Ero1l
  gRNA
cuugcucacauucuucaaug

SEQ ID NO: 83953 - RNA, 20 nt, Artificial Sequence
  MKO10083953_B_Erp27
  gRNA
cacagacgucccagccaccg

SEQ ID NO: 83954 - RNA, 20 nt, Artificial Sequence
  MKO10083954_B_Erp27
  gRNA
gguuguucacgugaauaaaa

SEQ ID NO: 83955 - RNA, 20 nt, Artificial Sequence
  MKO10083955_B_Erp27
  gRNA
cgcaugcucucuucauacuc

SEQ ID NO: 83956 - RNA, 20 nt, Artificial Sequence
  MKO10083956_B_Erp29
  gRNA
ccaaguccccaucccggaau

SEQ ID NO: 83957 - RNA, 20 nt, Artificial Sequence
  MKO10083957_B_Erp29
  gRNA
ucccaaaagcaaguucgucu

SEQ ID NO: 83958 - RNA, 20 nt, Artificial Sequence
  MKO10083958_B_Erp29
  gRNA
gcaagaugaguucaagcguc

SEQ ID NO: 83959 - RNA, 20 nt, Artificial Sequence
  MKO10083959_B_Erp44
  gRNA
cuugcuauuucagcuguuau

SEQ ID NO: 83960 - RNA, 20 nt, Artificial Sequence
  MKO10083960_B_Erp44
  gRNA
ucagaugcuuccucaaaaau

SEQ ID NO: 83961 - RNA, 20 nt, Artificial Sequence
  MKO10083961_B_Erp44
  gRNA
acccugaaauuauuucguaa

SEQ ID NO: 83962 - RNA, 20 nt, Artificial Sequence
  MKO10083962_B_Errfi1
  gRNA
agcaggggaguucagauugu

SEQ ID NO: 83963 - RNA, 20 nt, Artificial Sequence
  MKO10083963_B_Errfi1
  gRNA
uccccaaggccugaccauua

SEQ ID NO: 83964 - RNA, 20 nt, Artificial Sequence
  MKO10083964_B_Errfi1
  gRNA
caaucugaacuccccugcuc

SEQ ID NO: 83965 - RNA, 20 nt, Artificial Sequence
  MKO10083965_B_Erv3
  gRNA
uguauucgaucccugacccc

SEQ ID NO: 83966 - RNA, 20 nt, Artificial Sequence
  MKO10083966_B_Erv3
  gRNA
acagaccagaccauccccua

SEQ ID NO: 83967 - RNA, 20 nt, Artificial Sequence
  MKO10083967_B_Erv3
  gRNA
uaagccucaccuuugauaua

SEQ ID NO: 83968 - RNA, 20 nt, Artificial Sequence
  MKO10083968_B_Esam
  gRNA
acggaaugugucccugcgcc

SEQ ID NO: 83969 - RNA, 20 nt, Artificial Sequence
  MKO10083969_B_Esam
  gRNA
gcccccgggccucaacaaau

SEQ ID NO: 83970 - RNA, 20 nt, Artificial Sequence
  MKO10083970_B_Esam
  gRNA
ggguacacccuguaaacuac

SEQ ID NO: 83971 - RNA, 20 nt, Artificial Sequence
  MKO10083971_B_Esco1
  gRNA
acuuuacagcgcuuauaaac

SEQ ID NO: 83972 - RNA, 20 nt, Artificial Sequence
  MKO10083972_B_Esco1
  gRNA
uauaagcgcuguaaaguaug

SEQ ID NO: 83973 - RNA, 20 nt, Artificial Sequence
  MKO10083973_B_Esco1
  gRNA
cgucuaucaacagaaagaac

SEQ ID NO: 83974 - RNA, 20 nt, Artificial Sequence
  MKO10083974_B_Esco2
  gRNA
caagaaguuaguacaugcag

SEQ ID NO: 83975 - RNA, 20 nt, Artificial Sequence
  MKO10083975_B_Esco2
  gRNA
aggugcaguaguuucuucaa

SEQ ID NO: 83976 - RNA, 20 nt, Artificial Sequence
  MKO10083976_B_Esco2
  gRNA
ugaagaaacuacugcaccug

SEQ ID NO: 83977 - RNA, 20 nt, Artificial Sequence
  MKO10083977_B_Esd
  gRNA
gaccacaaggccgugcucug

SEQ ID NO: 83978 - RNA, 20 nt, Artificial Sequence
  MKO10083978_B_Esd
  gRNA
ccagacagccaguaaagcgc

SEQ ID NO: 83979 - RNA, 20 nt, Artificial Sequence
  MKO10083979_B_Esd
  gRNA
ugcugucuaccuaccacccc

SEQ ID NO: 83980 - RNA, 20 nt, Artificial Sequence
  MKO10083980_B_Esf1
  gRNA
uguagugguuccagucauaa

SEQ ID NO: 83981 - RNA, 20 nt, Artificial Sequence
  MKO10083981_B_Esf1
  gRNA
aguagaguuacuaaguauuc

SEQ ID NO: 83982 - RNA, 20 nt, Artificial Sequence
  MKO10083982_B_Esf1
  gRNA
auuaaaggcgaaagauuugc

SEQ ID NO: 83983 - RNA, 20 nt, Artificial Sequence
  MKO10083983_B_Esm1
  gRNA
cucuuugcauuccaucccga

SEQ ID NO: 83984 - RNA, 20 nt, Artificial Sequence
  MKO10083984_B_Esm1
  gRNA
cucggcccuccgugaugaaa

SEQ ID NO: 83985 - RNA, 20 nt, Artificial Sequence
  MKO10083985_B_Esm1
  gRNA
ucucacagcguugccaucuc

SEQ ID NO: 83986 - RNA, 20 nt, Artificial Sequence
  MKO10083986_B_Esp15
  gRNA
auuccuucaagaaguauugu

SEQ ID NO: 83987 - RNA, 20 nt, Artificial Sequence
  MKO10083987_B_Esp15
  gRNA
acauaguuaaacuacauuca

SEQ ID NO: 83988 - RNA, 20 nt, Artificial Sequence
  MKO10083988_B_Esp15
  gRNA
augaugagaaaauacaucag

SEQ ID NO: 83989 - RNA, 20 nt, Artificial Sequence
  MKO10083989_B_Esp16
  gRNA
uuuaaacuuaccauuccuuc

SEQ ID NO: 83990 - RNA, 20 nt, Artificial Sequence
  MKO10083990_B_Esp16
  gRNA
acauaguuaaacuauauuca

SEQ ID NO: 83991 - RNA, 20 nt, Artificial Sequence
  MKO10083991_B_Esp16
  gRNA
uuuccaacaauacuuccuga

SEQ ID NO: 83992 - RNA, 20 nt, Artificial Sequence
  MKO10083992_B_Esp18
  gRNA
uuugauacaccagaaugaug

SEQ ID NO: 83993 - RNA, 20 nt, Artificial Sequence
  MKO10083993_B_Esp18
  gRNA
uuucagaucagcagauaucu

SEQ ID NO: 83994 - RNA, 20 nt, Artificial Sequence
  MKO10083994_B_Esp18
  gRNA
gccucgaauaaaguuuaacu

SEQ ID NO: 83995 - RNA, 20 nt, Artificial Sequence
  MKO10083995_B_Esp1
  gRNA
auuaugagaaauaacaacac

SEQ ID NO: 83996 - RNA, 20 nt, Artificial Sequence
  MKO10083996_B_Esp1
  gRNA
ccaacuugucuaauucacca

SEQ ID NO: 83997 - RNA, 20 nt, Artificial Sequence
  MKO10083997_B_Esp1
  gRNA
cuagugaacgacauuugcuc

SEQ ID NO: 83998 - RNA, 20 nt, Artificial Sequence
  MKO10083998_B_Esp23
  gRNA
ucaauuugaauauaaugaac

SEQ ID NO: 83999 - RNA, 20 nt, Artificial Sequence
  MKO10083999_B_Esp23
  gRNA
uucauuauauucaaauugau

SEQ ID NO: 84000 - RNA, 20 nt, Artificial Sequence
  MKO10084000_B_Esp23
  gRNA
cucagguucugccagauccu

SEQ ID NO: 84001 - RNA, 20 nt, Artificial Sequence
  MKO10084001_B_Esp24
  gRNA
cugaugagaaaagacaucac

SEQ ID NO: 84002 - RNA, 20 nt, Artificial Sequence
  MKO10084002_B_Esp24
  gRNA
uauguugacaacuaauuaag

SEQ ID NO: 84003 - RNA, 20 nt, Artificial Sequence
  MKO10084003_B_Esp24
  gRNA
cacgugaucagcagauaugg

SEQ ID NO: 84004 - RNA, 20 nt, Artificial Sequence
  MKO10084004_B_Esp31
  gRNA
caucacugggaaugagucca

SEQ ID NO: 84005 - RNA, 20 nt, Artificial Sequence
  MKO10084005_B_Esp31
  gRNA
caauugaucuuuauugaaug

SEQ ID NO: 84006 - RNA, 20 nt, Artificial Sequence
  MKO10084006_B_Esp31
  gRNA
ccuaacaaaagucccuugau

SEQ ID NO: 84007 - RNA, 20 nt, Artificial Sequence
  MKO10084007_B_Esp34
  gRNA
uuaccaucaauguucacuga

SEQ ID NO: 84008 - RNA, 20 nt, Artificial Sequence
  MKO10084008_B_Esp34
  gRNA
uguuugaaaagauaauugau

SEQ ID NO: 84009 - RNA, 20 nt, Artificial Sequence
  MKO10084009_B_Esp34
  gRNA
uuaagaauucuuguauauau

SEQ ID NO: 84010 - RNA, 20 nt, Artificial Sequence
  MKO10084010_B_Esp36
  gRNA
cuaccaucaaugcucacuga

SEQ ID NO: 84011 - RNA, 20 nt, Artificial Sequence
  MKO10084011_B_Esp36
  gRNA
cuugugaucagcagauauuu

SEQ ID NO: 84012 - RNA, 20 nt, Artificial Sequence
  MKO10084012_B_Esp36
  gRNA
caaauuaauauacaguuuca

SEQ ID NO: 84013 - RNA, 20 nt, Artificial Sequence
  MKO10084013_B_Esp38
  gRNA
augaugaagaaauacaucag

SEQ ID NO: 84014 - RNA, 20 nt, Artificial Sequence
  MKO10084014_B_Esp38
  gRNA
guguguaaaacaaaucugaa

SEQ ID NO: 84015 - RNA, 20 nt, Artificial Sequence
  MKO10084015_B_Esp38
  gRNA
ccauauaucugcugaucuca

SEQ ID NO: 84016 - RNA, 20 nt, Artificial Sequence
  MKO10084016_B_Esp3
  gRNA
ucaaaguccucuugaauguu

SEQ ID NO: 84017 - RNA, 20 nt, Artificial Sequence
  MKO10084017_B_Esp3
  gRNA
ggagacaagugugacagccu

SEQ ID NO: 84018 - RNA, 20 nt, Artificial Sequence
  MKO10084018_B_Esp3
  gRNA
agcaacuccugcuaagacua

SEQ ID NO: 84019 - RNA, 20 nt, Artificial Sequence
  MKO10084019_B_Esp4
  gRNA
cacccuuccuucagugagca

SEQ ID NO: 84020 - RNA, 20 nt, Artificial Sequence
  MKO10084020_B_Esp4
  gRNA
uuuacugcccugaguaaaug

SEQ ID NO: 84021 - RNA, 20 nt, Artificial Sequence
  MKO10084021_B_Esp4
  gRNA
ucugagcaccacauuuacuc

SEQ ID NO: 84022 - RNA, 20 nt, Artificial Sequence
  MKO10084022_B_Esp5
  gRNA
cagaagugguucugcaucau

SEQ ID NO: 84023 - RNA, 20 nt, Artificial Sequence
  MKO10084023_B_Esp5
  gRNA
cuuccaucagugugcauuga

SEQ ID NO: 84024 - RNA, 20 nt, Artificial Sequence
  MKO10084024_B_Esp5
  gRNA
uuaccaucaaugcacacuga

SEQ ID NO: 84025 - RNA, 20 nt, Artificial Sequence
  MKO10084025_B_Esp6-esp5
  gRNA
ucauugauuaguuuaagcca

SEQ ID NO: 84026 - RNA, 20 nt, Artificial Sequence
  MKO10084026_B_Esp6-esp5
  gRNA
uuaccaucaaugcacacuga

SEQ ID NO: 84027 - RNA, 20 nt, Artificial Sequence
  MKO10084027_B_Esp6-esp5
  gRNA
aggccaucugugcuuacuga

SEQ ID NO: 84028 - RNA, 20 nt, Artificial Sequence
  MKO10084028_B_Esp6
  gRNA
auuacaagaaauaucaucau

SEQ ID NO: 84029 - RNA, 20 nt, Artificial Sequence
  MKO10084029_B_Esp6
  gRNA
ucaauggccucuuugaugcu

SEQ ID NO: 84030 - RNA, 20 nt, Artificial Sequence
  MKO10084030_B_Esp6
  gRNA
uuucuggucagcagauauag

SEQ ID NO: 84031 - RNA, 20 nt, Artificial Sequence
  MKO10084031_B_Esp8
  gRNA
cuuucuucagagcaaauuga

SEQ ID NO: 84032 - RNA, 20 nt, Artificial Sequence
  MKO10084032_B_Esp8
  gRNA
auuucagaagaaugccccau

SEQ ID NO: 84033 - RNA, 20 nt, Artificial Sequence
  MKO10084033_B_Esp8
  gRNA
ucugaguacaacauuugcuc

SEQ ID NO: 84034 - RNA, 20 nt, Artificial Sequence
  MKO10084034_B_Espl1
  gRNA
gcugacuaccugagcaugac

SEQ ID NO: 84035 - RNA, 20 nt, Artificial Sequence
  MKO10084035_B_Espl1
  gRNA
ggcacuaaccagucaugcuc

SEQ ID NO: 84036 - RNA, 20 nt, Artificial Sequence
  MKO10084036_B_Espl1
  gRNA
agcaaagucauacacaaucc

SEQ ID NO: 84037 - RNA, 20 nt, Artificial Sequence
  MKO10084037_B_Espnl
  gRNA
cggccccgcagucuuucacc

SEQ ID NO: 84038 - RNA, 20 nt, Artificial Sequence
  MKO10084038_B_Espnl
  gRNA
gccacacaccuauucucgac

SEQ ID NO: 84039 - RNA, 20 nt, Artificial Sequence
  MKO10084039_B_Espnl
  gRNA
cacggaguaaccacuccacc

SEQ ID NO: 84040 - RNA, 20 nt, Artificial Sequence
  MKO10084040_B_Espn
  gRNA
agcucugaguuaucacccgu

SEQ ID NO: 84041 - RNA, 20 nt, Artificial Sequence
  MKO10084041_B_Espn
  gRNA
gggcgggcggcggcgaacuc

SEQ ID NO: 84042 - RNA, 20 nt, Artificial Sequence
  MKO10084042_B_Espn
  gRNA
auugaucccgggacaagacu

SEQ ID NO: 84043 - RNA, 20 nt, Artificial Sequence
  MKO10084043_B_Esr1
  gRNA
agcugguucauaugaucaac

SEQ ID NO: 84044 - RNA, 20 nt, Artificial Sequence
  MKO10084044_B_Esr1
  gRNA
uauggggucugguccugcga

SEQ ID NO: 84045 - RNA, 20 nt, Artificial Sequence
  MKO10084045_B_Esr1
  gRNA
uucugaugauuggucucguc

SEQ ID NO: 84046 - RNA, 20 nt, Artificial Sequence
  MKO10084046_B_Esr2
  gRNA
gcugagaccuacgcaagaca

SEQ ID NO: 84047 - RNA, 20 nt, Artificial Sequence
  MKO10084047_B_Esr2
  gRNA
gucuaugguacacugauucg

SEQ ID NO: 84048 - RNA, 20 nt, Artificial Sequence
  MKO10084048_B_Esr2
  gRNA
gaugaugucccucacgaagc

SEQ ID NO: 84049 - RNA, 20 nt, Artificial Sequence
  MKO10084049_B_Esrp1
  gRNA
uaggcagaucuugcaucccg

SEQ ID NO: 84050 - RNA, 20 nt, Artificial Sequence
  MKO10084050_B_Esrp1
  gRNA
gcacgaaguacuaguuagac

SEQ ID NO: 84051 - RNA, 20 nt, Artificial Sequence
  MKO10084051_B_Esrp1
  gRNA
ccagcugcggcgcggaagac

SEQ ID NO: 84052 - RNA, 20 nt, Artificial Sequence
  MKO10084052_B_Esrp2
  gRNA
uucucugcggaggucguaga

SEQ ID NO: 84053 - RNA, 20 nt, Artificial Sequence
  MKO10084053_B_Esrp2
  gRNA
guuauucuccaccuacuuga

SEQ ID NO: 84054 - RNA, 20 nt, Artificial Sequence
  MKO10084054_B_Esrp2
  gRNA
aggugcuugggugcugcaua

SEQ ID NO: 84055 - RNA, 20 nt, Artificial Sequence
  MKO10084055_B_Esrra
  gRNA
ccacuaucucucgaucaaaa

SEQ ID NO: 84056 - RNA, 20 nt, Artificial Sequence
  MKO10084056_B_Esrra
  gRNA
uacaauucaaggugugcguc

SEQ ID NO: 84057 - RNA, 20 nt, Artificial Sequence
  MKO10084057_B_Esrra
  gRNA
gagcaucgaguacagcuguc

SEQ ID NO: 84058 - RNA, 20 nt, Artificial Sequence
  MKO10084058_B_Esrrb
  gRNA
gugcgccuugaccgaguucg

SEQ ID NO: 84059 - RNA, 20 nt, Artificial Sequence
  MKO10084059_B_Esrrb
  gRNA
gccucccaacgauauccccg

SEQ ID NO: 84060 - RNA, 20 nt, Artificial Sequence
  MKO10084060_B_Esrrb
  gRNA
aagaucgucucgaaucuacu

SEQ ID NO: 84061 - RNA, 20 nt, Artificial Sequence
  MKO10084061_B_Esrrg
  gRNA
cgagaguuggugguuaucau

SEQ ID NO: 84062 - RNA, 20 nt, Artificial Sequence
  MKO10084062_B_Esrrg
  gRNA
caagauugucucgcauuugu

SEQ ID NO: 84063 - RNA, 20 nt, Artificial Sequence
  MKO10084063_B_Esrrg
  gRNA
gcgcagacgcaaauccugcc

SEQ ID NO: 84064 - RNA, 20 nt, Artificial Sequence
  MKO10084064_B_Esx1
  gRNA
aguggagcuugcccgacgcc

SEQ ID NO: 84065 - RNA, 20 nt, Artificial Sequence
  MKO10084065_B_Esx1
  gRNA
uagcuugagcucaacgcuuu

SEQ ID NO: 84066 - RNA, 20 nt, Artificial Sequence
  MKO10084066_B_Esx1
  gRNA
gguggaggcauucugaaucc

SEQ ID NO: 84067 - RNA, 20 nt, Artificial Sequence
  MKO10084067_B_Esyt1
  gRNA
uuccucccagaucguggcuc

SEQ ID NO: 84068 - RNA, 20 nt, Artificial Sequence
  MKO10084068_B_Esyt1
  gRNA
gcccuuccuaggccaguaua

SEQ ID NO: 84069 - RNA, 20 nt, Artificial Sequence
  MKO10084069_B_Esyt1
  gRNA
aaaggccgaauggcugaaca

SEQ ID NO: 84070 - RNA, 20 nt, Artificial Sequence
  MKO10084070_B_Esyt2
  gRNA
aggaaauugugagauugauu

SEQ ID NO: 84071 - RNA, 20 nt, Artificial Sequence
  MKO10084071_B_Esyt2
  gRNA
uaaaaacuuaccuaaucuga

SEQ ID NO: 84072 - RNA, 20 nt, Artificial Sequence
  MKO10084072_B_Esyt2
  gRNA
cauucugcucuuucaguguc

SEQ ID NO: 84073 - RNA, 20 nt, Artificial Sequence
  MKO10084073_B_Esyt3
  gRNA
augcucuucucccggaucuu

SEQ ID NO: 84074 - RNA, 20 nt, Artificial Sequence
  MKO10084074_B_Esyt3
  gRNA
cggggacugugagaucagcg

SEQ ID NO: 84075 - RNA, 20 nt, Artificial Sequence
  MKO10084075_B_Esyt3
  gRNA
uacacacggacaaacgcaac

SEQ ID NO: 84076 - RNA, 20 nt, Artificial Sequence
  MKO10084076_B_Euaa1
  gRNA
uacuuaccugaggagcaaua

SEQ ID NO: 84077 - RNA, 20 nt, Artificial Sequence
  MKO10084077_B_Euaa1
  gRNA
uguuaaccguauugcuccuc

SEQ ID NO: 84078 - RNA, 20 nt, Artificial Sequence
  MKO10084078_B_Euaa1
  gRNA
acugcuauuccuuguacucc

SEQ ID NO: 84079 - RNA, 20 nt, Artificial Sequence
  MKO10084079_B_Etf1
  gRNA
uuuauuguaauagacggaag

SEQ ID NO: 84080 - RNA, 20 nt, Artificial Sequence
  MKO10084080_B_Etf1
  gRNA
gauccacagugaauuugugc

SEQ ID NO: 84081 - RNA, 20 nt, Artificial Sequence
  MKO10084081_B_Etf1
  gRNA
caguaaacaaccagaccauu

SEQ ID NO: 84082 - RNA, 20 nt, Artificial Sequence
  MKO10084082_B_Etfa
  gRNA
aguuacacacacaucugugc

SEQ ID NO: 84083 - RNA, 20 nt, Artificial Sequence
  MKO10084083_B_Etfa
  gRNA
uucugaguuuccaaaaucaa

SEQ ID NO: 84084 - RNA, 20 nt, Artificial Sequence
  MKO10084084_B_Etfa
  gRNA
cuaaauacuaucacugcagc

SEQ ID NO: 84085 - RNA, 20 nt, Artificial Sequence
  MKO10084085_B_Etfb
  gRNA
gaugaugacuguaaccagac

SEQ ID NO: 84086 - RNA, 20 nt, Artificial Sequence
  MKO10084086_B_Etfb
  gRNA
gugaccacuccagacuuguc

SEQ ID NO: 84087 - RNA, 20 nt, Artificial Sequence
  MKO10084087_B_Etfb
  gRNA
ccaggguacauucgccucuc

SEQ ID NO: 84088 - RNA, 20 nt, Artificial Sequence
  MKO10084088_B_Etfdh
  gRNA
agcuauucggcuaaagcagc

SEQ ID NO: 84089 - RNA, 20 nt, Artificial Sequence
  MKO10084089_B_Etfdh
  gRNA
cucacuacacuguucauccc

SEQ ID NO: 84090 - RNA, 20 nt, Artificial Sequence
  MKO10084090_B_Etfdh
  gRNA
ucuguuacaggaguauuaag

SEQ ID NO: 84091 - RNA, 20 nt, Artificial Sequence
  MKO10084091_B_Ethe1
  gRNA
ggaccggagaacccccgugc

SEQ ID NO: 84092 - RNA, 20 nt, Artificial Sequence
  MKO10084092_B_Ethe1
  gRNA
aguucugaucgaccccguuc

SEQ ID NO: 84093 - RNA, 20 nt, Artificial Sequence
  MKO10084093_B_Ethe1
  gRNA
gaaggugauuccauccgcuu

SEQ ID NO: 84094 - RNA, 20 nt, Artificial Sequence
  MKO10084094_B_Etl4
  gRNA
uccauuagaaaggcguuccc

SEQ ID NO: 84095 - RNA, 20 nt, Artificial Sequence
  MKO10084095_B_Etl4
  gRNA
gccuuucuaauggaaacgcc

SEQ ID NO: 84096 - RNA, 20 nt, Artificial Sequence
  MKO10084096_B_Etl4
  gRNA
gggcgacuccagcaucuuca

SEQ ID NO: 84097 - RNA, 20 nt, Artificial Sequence
  MKO10084097_B_Etnk1
  gRNA
cauugugcgcaugaauagca

SEQ ID NO: 84098 - RNA, 20 nt, Artificial Sequence
  MKO10084098_B_Etnk1
  gRNA
aacuaccuggcauaugauau

SEQ ID NO: 84099 - RNA, 20 nt, Artificial Sequence
  MKO10084099_B_Etnk1
  gRNA
ucguuauggcaaaggaccac

SEQ ID NO: 84100 - RNA, 20 nt, Artificial Sequence
  MKO10084100_B_Etnk2
  gRNA
ggacagguguuccuucaacc

SEQ ID NO: 84101 - RNA, 20 nt, Artificial Sequence
  MKO10084101_B_Etnk2
  gRNA
gccugccuaagcccacgcuc

SEQ ID NO: 84102 - RNA, 20 nt, Artificial Sequence
  MKO10084102_B_Etnk2
  gRNA
aacuaccaggcauuugacau

SEQ ID NO: 84103 - RNA, 20 nt, Artificial Sequence
  MKO10084103_B_Etnppl
  gRNA
caaugacuuagccuuacguc

SEQ ID NO: 84104 - RNA, 20 nt, Artificial Sequence
  MKO10084104_B_Etnppl
  gRNA
caaacucaaugauguugucg

SEQ ID NO: 84105 - RNA, 20 nt, Artificial Sequence
  MKO10084105_B_Etnppl
  gRNA
caaagcugccgcgaaacaga

SEQ ID NO: 84106 - RNA, 20 nt, Artificial Sequence
  MKO10084106_B_Etohi1
  gRNA
guucacauguacgucaucau

SEQ ID NO: 84107 - RNA, 20 nt, Artificial Sequence
  MKO10084107_B_Etohi1
  gRNA
uauagcugugagauuccuau

SEQ ID NO: 84108 - RNA, 20 nt, Artificial Sequence
  MKO10084108_B_Etohi1
  gRNA
uuccaugacuucuagaaguu

SEQ ID NO: 84109 - RNA, 20 nt, Artificial Sequence
  MKO10084109_B_Ets1
  gRNA
uuggcuccauuaaccugaua

SEQ ID NO: 84110 - RNA, 20 nt, Artificial Sequence
  MKO10084110_B_Ets1
  gRNA
caucuagagauccugcagaa

SEQ ID NO: 84111 - RNA, 20 nt, Artificial Sequence
  MKO10084111_B_Ets1
  gRNA
cacaaaagaacagcagcgac

SEQ ID NO: 84112 - RNA, 20 nt, Artificial Sequence
  MKO10084112_B_Ets2
  gRNA
cguucaugccaaacuggugc

SEQ ID NO: 84113 - RNA, 20 nt, Artificial Sequence
  MKO10084113_B_Ets2
  gRNA
ggccaccaacgaguucagcc

SEQ ID NO: 84114 - RNA, 20 nt, Artificial Sequence
  MKO10084114_B_Ets2
  gRNA
ccagccuuugacaccuucga

SEQ ID NO: 84115 - RNA, 20 nt, Artificial Sequence
  MKO10084115_B_Etv1
  gRNA
caacuuucagccugauaguc

SEQ ID NO: 84116 - RNA, 20 nt, Artificial Sequence
  MKO10084116_B_Etv1
  gRNA
gcaguuuguuccagacuauc

SEQ ID NO: 84117 - RNA, 20 nt, Artificial Sequence
  MKO10084117_B_Etv1
  gRNA
cuaugaucagaagccacaag

SEQ ID NO: 84118 - RNA, 20 nt, Artificial Sequence
  MKO10084118_B_Etv2
  gRNA
uacgucuucgugagguaaag

SEQ ID NO: 84119 - RNA, 20 nt, Artificial Sequence
  MKO10084119_B_Etv2
  gRNA
cgccccuucaaagccgacga

SEQ ID NO: 84120 - RNA, 20 nt, Artificial Sequence
  MKO10084120_B_Etv2
  gRNA
agcugcugcgagccccgucg

SEQ ID NO: 84121 - RNA, 20 nt, Artificial Sequence
  MKO10084121_B_Etv3
  gRNA
cucgagcgaauguugaugaa

SEQ ID NO: 84122 - RNA, 20 nt, Artificial Sequence
  MKO10084122_B_Etv3
  gRNA
cuacaaagccgagucgucgc

SEQ ID NO: 84123 - RNA, 20 nt, Artificial Sequence
  MKO10084123_B_Etv3
  gRNA
cggcgacgacucggcuuugu

SEQ ID NO: 84124 - RNA, 20 nt, Artificial Sequence
  MKO10084124_B_Etv4
  gRNA
ucagucacuuccaagagacg

SEQ ID NO: 84125 - RNA, 20 nt, Artificial Sequence
  MKO10084125_B_Etv4
  gRNA
cugccgccuuccgacucaga

SEQ ID NO: 84126 - RNA, 20 nt, Artificial Sequence
  MKO10084126_B_Etv4
  gRNA
cuggggcucaccuggaguaa

SEQ ID NO: 84127 - RNA, 20 nt, Artificial Sequence
  MKO10084127_B_Etv5
  gRNA
gaucuggcucacgauucuga

SEQ ID NO: 84128 - RNA, 20 nt, Artificial Sequence
  MKO10084128_B_Etv5
  gRNA
cuaaccaagccuccugcagc

SEQ ID NO: 84129 - RNA, 20 nt, Artificial Sequence
  MKO10084129_B_Etv5
  gRNA
caguuaucagacugaaaauc

SEQ ID NO: 84130 - RNA, 20 nt, Artificial Sequence
  MKO10084130_B_Etv6
  gRNA
cagguuugcagccgauuuac

SEQ ID NO: 84131 - RNA, 20 nt, Artificial Sequence
  MKO10084131_B_Etv6
  gRNA
acacagugccucgagcgcuc

SEQ ID NO: 84132 - RNA, 20 nt, Artificial Sequence
  MKO10084132_B_Etv6
  gRNA
cgcuaccgaucuccucauuc

SEQ ID NO: 84133 - RNA, 20 nt, Artificial Sequence
  MKO10084133_B_Eva1a
  gRNA
cccaccugagauauaagacc

SEQ ID NO: 84134 - RNA, 20 nt, Artificial Sequence
  MKO10084134_B_Eva1a
  gRNA
gagccugaaccgauacuacu

SEQ ID NO: 84135 - RNA, 20 nt, Artificial Sequence
  MKO10084135_B_Eva1a
  gRNA
acugccggcgagguccccgg

SEQ ID NO: 84136 - RNA, 20 nt, Artificial Sequence
  MKO10084136_B_Eva1b
  gRNA
ggagcuacucagcaacagcc

SEQ ID NO: 84137 - RNA, 20 nt, Artificial Sequence
  MKO10084137_B_Eva1b
  gRNA
agacgccaagcacgaaguag

SEQ ID NO: 84138 - RNA, 20 nt, Artificial Sequence
  MKO10084138_B_Eva1b
  gRNA
gggucccgaugacacgcugc

SEQ ID NO: 84139 - RNA, 20 nt, Artificial Sequence
  MKO10084139_B_Eva1c
  gRNA
acacuuauuguugaaugccg

SEQ ID NO: 84140 - RNA, 20 nt, Artificial Sequence
  MKO10084140_B_Eva1c
  gRNA
auucagauaguccccgucac

SEQ ID NO: 84141 - RNA, 20 nt, Artificial Sequence
  MKO10084141_B_Eva1c
  gRNA
cuggucaauagccgagucuu

SEQ ID NO: 84142 - RNA, 20 nt, Artificial Sequence
  MKO10084142_B_Evc2
  gRNA
gauauuucaagagaagcccg

SEQ ID NO: 84143 - RNA, 20 nt, Artificial Sequence
  MKO10084143_B_Evc2
  gRNA
caucuuucagagccccucac

SEQ ID NO: 84144 - RNA, 20 nt, Artificial Sequence
  MKO10084144_B_Evc2
  gRNA
agcccccuuuaccaucacag

SEQ ID NO: 84145 - RNA, 20 nt, Artificial Sequence
  MKO10084145_B_Evc
  gRNA
gcgccgugucuaccugaagc

SEQ ID NO: 84146 - RNA, 20 nt, Artificial Sequence
  MKO10084146_B_Evc
  gRNA
ugccgugauguugccacuca

SEQ ID NO: 84147 - RNA, 20 nt, Artificial Sequence
  MKO10084147_B_Evc
  gRNA
aggggcgucuucaucccgag

SEQ ID NO: 84148 - RNA, 20 nt, Artificial Sequence
  MKO10084148_B_Evi2a-evi2b
  gRNA
gugugccauaccacgaagac

SEQ ID NO: 84149 - RNA, 20 nt, Artificial Sequence
  MKO10084149_B_Evi2a-evi2b
  gRNA
uggcuuacgaagugacggcu

SEQ ID NO: 84150 - RNA, 20 nt, Artificial Sequence
  MKO10084150_B_Evi2a-evi2b
  gRNA
gacauguaguugaguugcag

SEQ ID NO: 84151 - RNA, 20 nt, Artificial Sequence
  MKO10084151_B_Evi2a
  gRNA
aaguaggcaagcgccagccg

SEQ ID NO: 84152 - RNA, 20 nt, Artificial Sequence
  MKO10084152_B_Evi2a
  gRNA
ggcgcucaccuugugaccca

SEQ ID NO: 84153 - RNA, 20 nt, Artificial Sequence
  MKO10084153_B_Evi2a
  gRNA
aaccuccuauugcaaucucc

SEQ ID NO: 84154 - RNA, 20 nt, Artificial Sequence
  MKO10084154_B_Evi2b
  gRNA
gcaauugcugccauauuaau

SEQ ID NO: 84155 - RNA, 20 nt, Artificial Sequence
  MKO10084155_B_Evi2b
  gRNA
cugagaaaaacguauugucc

SEQ ID NO: 84156 - RNA, 20 nt, Artificial Sequence
  MKO10084156_B_Evi2b
  gRNA
uuggucaaagugaacccaga

SEQ ID NO: 84157 - RNA, 20 nt, Artificial Sequence
  MKO10084157_B_Evi5l
  gRNA
agcccaccucccgaucaacc

SEQ ID NO: 84158 - RNA, 20 nt, Artificial Sequence
  MKO10084158_B_Evi5l
  gRNA
ccgaauugccaacgaguggg

SEQ ID NO: 84159 - RNA, 20 nt, Artificial Sequence
  MKO10084159_B_Evi5l
  gRNA
ccaguuugaauacaugcuac

SEQ ID NO: 84160 - RNA, 20 nt, Artificial Sequence
  MKO10084160_B_Evi5
  gRNA
aucacuucagagcaauagug

SEQ ID NO: 84161 - RNA, 20 nt, Artificial Sequence
  MKO10084161_B_Evi5
  gRNA
uccuuaaaaaaguuguguuc

SEQ ID NO: 84162 - RNA, 20 nt, Artificial Sequence
  MKO10084162_B_Evi5
  gRNA
cuaagcuggaggaacaaaac

SEQ ID NO: 84163 - RNA, 20 nt, Artificial Sequence
  MKO10084163_B_Evl
  gRNA
aguuuaagccauagaccuga

SEQ ID NO: 84164 - RNA, 20 nt, Artificial Sequence
  MKO10084164_B_Evl
  gRNA
acgaugacaccaguaagaag

SEQ ID NO: 84165 - RNA, 20 nt, Artificial Sequence
  MKO10084165_B_Evl
  gRNA
aggccccuccacacagcguc

SEQ ID NO: 84166 - RNA, 20 nt, Artificial Sequence
  MKO10084166_B_Evpl
  gRNA
uuccgccugauguggggccc

SEQ ID NO: 84167 - RNA, 20 nt, Artificial Sequence
  MKO10084167_B_Evpl
  gRNA
caugcaagccaacgcugacc

SEQ ID NO: 84168 - RNA, 20 nt, Artificial Sequence
  MKO10084168_B_Evpl
  gRNA
ucugcagaaucugguccgug

SEQ ID NO: 84169 - RNA, 20 nt, Artificial Sequence
  MKO10084169_B_Evx1
  gRNA
gcguucccgguggcgcaguc

SEQ ID NO: 84170 - RNA, 20 nt, Artificial Sequence
  MKO10084170_B_Evx1
  gRNA
gguugccugagcccgcgagc

SEQ ID NO: 84171 - RNA, 20 nt, Artificial Sequence
  MKO10084171_B_Evx1
  gRNA
gcugccaguucgcaucuccg

SEQ ID NO: 84172 - RNA, 20 nt, Artificial Sequence
  MKO10084172_B_Evx2
  gRNA
cuccgguuccggcgccgauc

SEQ ID NO: 84173 - RNA, 20 nt, Artificial Sequence
  MKO10084173_B_Evx2
  gRNA
uccaguuuguccgauucagc

SEQ ID NO: 84174 - RNA, 20 nt, Artificial Sequence
  MKO10084174_B_Evx2
  gRNA
ggccgacaugagcagcgacg

SEQ ID NO: 84175 - RNA, 20 nt, Artificial Sequence
  MKO10084175_B_Ewsr1
  gRNA
uacugaugucagcuauacuc

SEQ ID NO: 84176 - RNA, 20 nt, Artificial Sequence
  MKO10084176_B_Ewsr1
  gRNA
uagucaagcugcagcccagc

SEQ ID NO: 84177 - RNA, 20 nt, Artificial Sequence
  MKO10084177_B_Ewsr1
  gRNA
cugggcugcagcuugacuau

SEQ ID NO: 84178 - RNA, 20 nt, Artificial Sequence
  MKO10084178_B_Exd1
  gRNA
augaagcagaaggugcaucg

SEQ ID NO: 84179 - RNA, 20 nt, Artificial Sequence
  MKO10084179_B_Exd1
  gRNA
ccaggggugaaaguguucuu

SEQ ID NO: 84180 - RNA, 20 nt, Artificial Sequence
  MKO10084180_B_Exd1
  gRNA
gaucaguuccagcagaaguu

SEQ ID NO: 84181 - RNA, 20 nt, Artificial Sequence
  MKO10084181_B_Exd2
  gRNA
uucuacuucguugcagcaac

SEQ ID NO: 84182 - RNA, 20 nt, Artificial Sequence
  MKO10084182_B_Exd2
  gRNA
cgcuugcccaggcugauaua

SEQ ID NO: 84183 - RNA, 20 nt, Artificial Sequence
  MKO10084183_B_Exd2
  gRNA
ccuugugcaccugugaccgc

SEQ ID NO: 84184 - RNA, 20 nt, Artificial Sequence
  MKO10084184_B_Exo1
  gRNA
cuccccuaccuucacgauau

SEQ ID NO: 84185 - RNA, 20 nt, Artificial Sequence
  MKO10084185_B_Exo1
  gRNA
uagagcgagcgaagcagucu

SEQ ID NO: 84186 - RNA, 20 nt, Artificial Sequence
  MKO10084186_B_Exo1
  gRNA
gacucugaccuccucgcauu

SEQ ID NO: 84187 - RNA, 20 nt, Artificial Sequence
  MKO10084187_B_Exo5
  gRNA
uccuccacaucaacgccuug

SEQ ID NO: 84188 - RNA, 20 nt, Artificial Sequence
  MKO10084188_B_Exo5
  gRNA
aagcaaggugcagcauuacg

SEQ ID NO: 84189 - RNA, 20 nt, Artificial Sequence
  MKO10084189_B_Exo5
  gRNA
ucaagagacugccacuauac

SEQ ID NO: 84190 - RNA, 20 nt, Artificial Sequence
  MKO10084190_B_Exoc1
  gRNA
guucuucucagccgugcugc

SEQ ID NO: 84191 - RNA, 20 nt, Artificial Sequence
  MKO10084191_B_Exoc1
  gRNA
gagaaucagaguguagcggg

SEQ ID NO: 84192 - RNA, 20 nt, Artificial Sequence
  MKO10084192_B_Exoc1
  gRNA
uaauguuagcucgcagcuuu

SEQ ID NO: 84193 - RNA, 20 nt, Artificial Sequence
  MKO10084193_B_Exoc2
  gRNA
gaguaaaauugucugucgag

SEQ ID NO: 84194 - RNA, 20 nt, Artificial Sequence
  MKO10084194_B_Exoc2
  gRNA
auucgcaggacggagagaca

SEQ ID NO: 84195 - RNA, 20 nt, Artificial Sequence
  MKO10084195_B_Exoc2
  gRNA
ggucaccaaccucaaaaggc

SEQ ID NO: 84196 - RNA, 20 nt, Artificial Sequence
  MKO10084196_B_Exoc3l4
  gRNA
gaaucgcugggaagccgacg

SEQ ID NO: 84197 - RNA, 20 nt, Artificial Sequence
  MKO10084197_B_Exoc3l4
  gRNA
gcgcacgcgcgcagaucugc

SEQ ID NO: 84198 - RNA, 20 nt, Artificial Sequence
  MKO10084198_B_Exoc3l4
  gRNA
gcgcaccaugugcacaucga

SEQ ID NO: 84199 - RNA, 20 nt, Artificial Sequence
  MKO10084199_B_Exoc3l
  gRNA
aacucgugaagcuuugagcc

SEQ ID NO: 84200 - RNA, 20 nt, Artificial Sequence
  MKO10084200_B_Exoc3l
  gRNA
gucaguggugcaguccuacc

SEQ ID NO: 84201 - RNA, 20 nt, Artificial Sequence
  MKO10084201_B_Exoc3l
  gRNA
aauaguuacgcuguauuuca

SEQ ID NO: 84202 - RNA, 20 nt, Artificial Sequence
  MKO10084202_B_Exoc3
  gRNA
guaccccaucuaguugagac

SEQ ID NO: 84203 - RNA, 20 nt, Artificial Sequence
  MKO10084203_B_Exoc3
  gRNA
uagucugauaguaaccaucc

SEQ ID NO: 84204 - RNA, 20 nt, Artificial Sequence
  MKO10084204_B_Exoc3
  gRNA
uuccagugcuuuccgaagcc

SEQ ID NO: 84205 - RNA, 20 nt, Artificial Sequence
  MKO10084205_B_Exoc4
  gRNA
ugaugcguucugugauacuc

SEQ ID NO: 84206 - RNA, 20 nt, Artificial Sequence
  MKO10084206_B_Exoc4
  gRNA
gguacagcguaacaaggaaa

SEQ ID NO: 84207 - RNA, 20 nt, Artificial Sequence
  MKO10084207_B_Exoc4
  gRNA
uguauaucaaauccacuagc

SEQ ID NO: 84208 - RNA, 20 nt, Artificial Sequence
  MKO10084208_B_Exoc5
  gRNA
gagacguucaauguauucau

SEQ ID NO: 84209 - RNA, 20 nt, Artificial Sequence
  MKO10084209_B_Exoc5
  gRNA
uggaagggguaaacacaccu

SEQ ID NO: 84210 - RNA, 20 nt, Artificial Sequence
  MKO10084210_B_Exoc5
  gRNA
agcuaaggaguuugcuaaga

SEQ ID NO: 84211 - RNA, 20 nt, Artificial Sequence
  MKO10084211_B_Exoc6b
  gRNA
aaugugcaacuuucacuacc

SEQ ID NO: 84212 - RNA, 20 nt, Artificial Sequence
  MKO10084212_B_Exoc6b
  gRNA
uaauaggaaacugcagcacg

SEQ ID NO: 84213 - RNA, 20 nt, Artificial Sequence
  MKO10084213_B_Exoc6b
  gRNA
ucaguuugcuguacaucucu

SEQ ID NO: 84214 - RNA, 20 nt, Artificial Sequence
  MKO10084214_B_Exoc6
  gRNA
accgaauaauaucuucuguu

SEQ ID NO: 84215 - RNA, 20 nt, Artificial Sequence
  MKO10084215_B_Exoc6
  gRNA
aaauuacaguuaugccuccc

SEQ ID NO: 84216 - RNA, 20 nt, Artificial Sequence
  MKO10084216_B_Exoc6
  gRNA
ggagauguacaguaagcuga

SEQ ID NO: 84217 - RNA, 20 nt, Artificial Sequence
  MKO10084217_B_Exoc7
  gRNA
cgcccggcggcgggagaucg

SEQ ID NO: 84218 - RNA, 20 nt, Artificial Sequence
  MKO10084218_B_Exoc7
  gRNA
cgcugcuaugauucccccgc

SEQ ID NO: 84219 - RNA, 20 nt, Artificial Sequence
  MKO10084219_B_Exoc7
  gRNA
guacucuuccagccuaccug

SEQ ID NO: 84220 - RNA, 20 nt, Artificial Sequence
  MKO10084220_B_Exoc8
  gRNA
gguccgcaucguauuccacc

SEQ ID NO: 84221 - RNA, 20 nt, Artificial Sequence
  MKO10084221_B_Exoc8
  gRNA
ucgcacucguucguccacuu

SEQ ID NO: 84222 - RNA, 20 nt, Artificial Sequence
  MKO10084222_B_Exoc8
  gRNA
augccaagaucaagcgcgag

SEQ ID NO: 84223 - RNA, 20 nt, Artificial Sequence
  MKO10084223_B_Exog
  gRNA
ucccgauauagucuucauug

SEQ ID NO: 84224 - RNA, 20 nt, Artificial Sequence
  MKO10084224_B_Exog
  gRNA
gcccucaaugaagacuauau

SEQ ID NO: 84225 - RNA, 20 nt, Artificial Sequence
  MKO10084225_B_Exog
  gRNA
ccuaccgaugaucuuguccu

SEQ ID NO: 84226 - RNA, 20 nt, Artificial Sequence
  MKO10084226_B_Exosc10
  gRNA
agucggguaaugcaguacca

SEQ ID NO: 84227 - RNA, 20 nt, Artificial Sequence
  MKO10084227_B_Exosc10
  gRNA
acaucgugcgaccucagcuc

SEQ ID NO: 84228 - RNA, 20 nt, Artificial Sequence
  MKO10084228_B_Exosc10
  gRNA
guggcaguuaccaaggcauc

SEQ ID NO: 84229 - RNA, 20 nt, Artificial Sequence
  MKO10084229_B_Exosc1
  gRNA
gugacgacagcucccacauc

SEQ ID NO: 84230 - RNA, 20 nt, Artificial Sequence
  MKO10084230_B_Exosc1
  gRNA
uuggccaaaacuaugucacc

SEQ ID NO: 84231 - RNA, 20 nt, Artificial Sequence
  MKO10084231_B_Exosc1
  gRNA
gguggcaagcauggcaccac

SEQ ID NO: 84232 - RNA, 20 nt, Artificial Sequence
  MKO10084232_B_Exosc2
  gRNA
ucucacagguucaacagaag

SEQ ID NO: 84233 - RNA, 20 nt, Artificial Sequence
  MKO10084233_B_Exosc2
  gRNA
caggggccaugggacauaca

SEQ ID NO: 84234 - RNA, 20 nt, Artificial Sequence
  MKO10084234_B_Exosc2
  gRNA
uguaguggggagaaucacag

SEQ ID NO: 84235 - RNA, 20 nt, Artificial Sequence
  MKO10084235_B_Exosc3
  gRNA
cgaucacuaugccaaucacg

SEQ ID NO: 84236 - RNA, 20 nt, Artificial Sequence
  MKO10084236_B_Exosc3
  gRNA
cuuuauuagcgaccacacac

SEQ ID NO: 84237 - RNA, 20 nt, Artificial Sequence
  MKO10084237_B_Exosc3
  gRNA
uguggucgcuaauaaagaca

SEQ ID NO: 84238 - RNA, 20 nt, Artificial Sequence
  MKO10084238_B_Exosc4
  gRNA
gcgcauacaaagucccgcau

SEQ ID NO: 84239 - RNA, 20 nt, Artificial Sequence
  MKO10084239_B_Exosc4
  gRNA
ucagaucgacaucuacgugc

SEQ ID NO: 84240 - RNA, 20 nt, Artificial Sequence
  MKO10084240_B_Exosc4
  gRNA
gggcucgagaccgggagccc

SEQ ID NO: 84241 - RNA, 20 nt, Artificial Sequence
  MKO10084241_B_Exosc5
  gRNA
gcaagcagcguucaagcaac

SEQ ID NO: 84242 - RNA, 20 nt, Artificial Sequence
  MKO10084242_B_Exosc5
  gRNA
cucaaucaccguggugcugc

SEQ ID NO: 84243 - RNA, 20 nt, Artificial Sequence
  MKO10084243_B_Exosc5
  gRNA
cccaugcgagcccucuucug

SEQ ID NO: 84244 - RNA, 20 nt, Artificial Sequence
  MKO10084244_B_Exosc6
  gRNA
uccucgaauccucgucgcuc

SEQ ID NO: 84245 - RNA, 20 nt, Artificial Sequence
  MKO10084245_B_Exosc6
  gRNA
ccgcugcucgcgacccgacg

SEQ ID NO: 84246 - RNA, 20 nt, Artificial Sequence
  MKO10084246_B_Exosc6
  gRNA
uacaccgggcggagccgcgu

SEQ ID NO: 84247 - RNA, 20 nt, Artificial Sequence
  MKO10084247_B_Exosc7
  gRNA
acaagagcagcguagaccug

SEQ ID NO: 84248 - RNA, 20 nt, Artificial Sequence
  MKO10084248_B_Exosc7
  gRNA
ugggucugccagagucaagc

SEQ ID NO: 84249 - RNA, 20 nt, Artificial Sequence
  MKO10084249_B_Exosc7
  gRNA
aagcugcucucuucaacaca

SEQ ID NO: 84250 - RNA, 20 nt, Artificial Sequence
  MKO10084250_B_Exosc8
  gRNA
uuucagaacuguggagccgc

SEQ ID NO: 84251 - RNA, 20 nt, Artificial Sequence
  MKO10084251_B_Exosc8
  gRNA
uggcucugcucucgugaagc

SEQ ID NO: 84252 - RNA, 20 nt, Artificial Sequence
  MKO10084252_B_Exosc8
  gRNA
aaggaaaacugccguccuga

SEQ ID NO: 84253 - RNA, 20 nt, Artificial Sequence
  MKO10084253_B_Exosc9
  gRNA
aggucuucggaagugacaca

SEQ ID NO: 84254 - RNA, 20 nt, Artificial Sequence
  MKO10084254_B_Exosc9
  gRNA
agcugaaucgacucuuagaa

SEQ ID NO: 84255 - RNA, 20 nt, Artificial Sequence
  MKO10084255_B_Exosc9
  gRNA
uccguugcccuauugaguuu

SEQ ID NO: 84256 - RNA, 20 nt, Artificial Sequence
  MKO10084256_B_Exph5
  gRNA
uaaacucaccgguuuggucu

SEQ ID NO: 84257 - RNA, 20 nt, Artificial Sequence
  MKO10084257_B_Exph5
  gRNA
aaaauauacaauucaccugu

SEQ ID NO: 84258 - RNA, 20 nt, Artificial Sequence
  MKO10084258_B_Exph5
  gRNA
agauggcuucaaggagcaac

SEQ ID NO: 84259 - RNA, 20 nt, Artificial Sequence
  MKO10084259_B_Ext1
  gRNA
ccuuacuacuaugcuaauuu

SEQ ID NO: 84260 - RNA, 20 nt, Artificial Sequence
  MKO10084260_B_Ext1
  gRNA
uuccucguggucgcaggcuu

SEQ ID NO: 84261 - RNA, 20 nt, Artificial Sequence
  MKO10084261_B_Ext1
  gRNA
accgcaguauucaucuuacc

SEQ ID NO: 84262 - RNA, 20 nt, Artificial Sequence
  MKO10084262_B_Ext2
  gRNA
uuucucaauaggugggaucg

SEQ ID NO: 84263 - RNA, 20 nt, Artificial Sequence
  MKO10084263_B_Ext2
  gRNA
cccagauuacaacacugccc

SEQ ID NO: 84264 - RNA, 20 nt, Artificial Sequence
  MKO10084264_B_Ext2
  gRNA
ggugcugagcgauguccuac

SEQ ID NO: 84265 - RNA, 20 nt, Artificial Sequence
  MKO10084265_B_Extl1
  gRNA
caggucaccccucacugaug

SEQ ID NO: 84266 - RNA, 20 nt, Artificial Sequence
  MKO10084266_B_Extl1
  gRNA
cuuucucugaagucaucgac

SEQ ID NO: 84267 - RNA, 20 nt, Artificial Sequence
  MKO10084267_B_Extl1
  gRNA
ccgugcuccucagcccccgc

SEQ ID NO: 84268 - RNA, 20 nt, Artificial Sequence
  MKO10084268_B_Extl2
  gRNA
uuccaucgcagcgguguuga

SEQ ID NO: 84269 - RNA, 20 nt, Artificial Sequence
  MKO10084269_B_Extl2
  gRNA
ucauggggauucgagugcuc

SEQ ID NO: 84270 - RNA, 20 nt, Artificial Sequence
  MKO10084270_B_Extl2
  gRNA
acgaucaccuugugcagacu

SEQ ID NO: 84271 - RNA, 20 nt, Artificial Sequence
  MKO10084271_B_Extl3
  gRNA
augggacgcaccuugauggg

SEQ ID NO: 84272 - RNA, 20 nt, Artificial Sequence
  MKO10084272_B_Extl3
  gRNA
uguacucguccaccaugucc

SEQ ID NO: 84273 - RNA, 20 nt, Artificial Sequence
  MKO10084273_B_Extl3
  gRNA
cuagaugaacuugaagcacu

SEQ ID NO: 84274 - RNA, 20 nt, Artificial Sequence
  MKO10084274_B_Eya1
  gRNA
cagacgggauuucuuagcua

SEQ ID NO: 84275 - RNA, 20 nt, Artificial Sequence
  MKO10084275_B_Eya1
  gRNA
gagaacgggugagcuggucu

SEQ ID NO: 84276 - RNA, 20 nt, Artificial Sequence
  MKO10084276_B_Eya1
  gRNA
gcuauuucacugcugcucau

SEQ ID NO: 84277 - RNA, 20 nt, Artificial Sequence
  MKO10084277_B_Eya2
  gRNA
uccaggcaucgccaaaucag

SEQ ID NO: 84278 - RNA, 20 nt, Artificial Sequence
  MKO10084278_B_Eya2
  gRNA
ggcgccuugauagagcccag

SEQ ID NO: 84279 - RNA, 20 nt, Artificial Sequence
  MKO10084279_B_Eya2
  gRNA
ggggcucuguccagcaggcg

SEQ ID NO: 84280 - RNA, 20 nt, Artificial Sequence
  MKO10084280_B_Eya3
  gRNA
accggagggaagccucugug

SEQ ID NO: 84281 - RNA, 20 nt, Artificial Sequence
  MKO10084281_B_Eya3
  gRNA
agcugaugccagcucuuccc

SEQ ID NO: 84282 - RNA, 20 nt, Artificial Sequence
  MKO10084282_B_Eya3
  gRNA
ggacaaaggugggcuugcag

SEQ ID NO: 84283 - RNA, 20 nt, Artificial Sequence
  MKO10084283_B_Eya4
  gRNA
uacuuggagggguacagcug

SEQ ID NO: 84284 - RNA, 20 nt, Artificial Sequence
  MKO10084284_B_Eya4
  gRNA
agcuccaagcuggauaaauc

SEQ ID NO: 84285 - RNA, 20 nt, Artificial Sequence
  MKO10084285_B_Eya4
  gRNA
uguaucacugccuccaacca

SEQ ID NO: 84286 - RNA, 20 nt, Artificial Sequence
  MKO10084286_B_Ezh1
  gRNA
acagccaggauauguugaug

SEQ ID NO: 84287 - RNA, 20 nt, Artificial Sequence
  MKO10084287_B_Ezh1
  gRNA
gagcugaucaauaacuauga

SEQ ID NO: 84288 - RNA, 20 nt, Artificial Sequence
  MKO10084288_B_Ezh1
  gRNA
ccuuugcucccauauuugcc

SEQ ID NO: 84289 - RNA, 20 nt, Artificial Sequence
  MKO10084289_B_Ezh2
  gRNA
agaguacauuauaggcaccg

SEQ ID NO: 84290 - RNA, 20 nt, Artificial Sequence
  MKO10084290_B_Ezh2
  gRNA
agaauaaucaugggccagac

SEQ ID NO: 84291 - RNA, 20 nt, Artificial Sequence
  MKO10084291_B_Ezh2
  gRNA
gacccugaaugcagucgccu

SEQ ID NO: 84292 - RNA, 20 nt, Artificial Sequence
  MKO10084292_B_Ezr
  gRNA
ccagugggaggaccggaucc

SEQ ID NO: 84293 - RNA, 20 nt, Artificial Sequence
  MKO10084293_B_Ezr
  gRNA
cuccgggaagugugguacuu

SEQ ID NO: 84294 - RNA, 20 nt, Artificial Sequence
  MKO10084294_B_Ezr
  gRNA
gaccaccauggaugccgagc

SEQ ID NO: 84295 - RNA, 20 nt, Artificial Sequence
  MKO10084295_B_F10
  gRNA
gaguugcaccgggcucccca

SEQ ID NO: 84296 - RNA, 20 nt, Artificial Sequence
  MKO10084296_B_F10
  gRNA
cuucgaggacgacgagaaga

SEQ ID NO: 84297 - RNA, 20 nt, Artificial Sequence
  MKO10084297_B_F10
  gRNA
agaugucucaccuuuauauu

SEQ ID NO: 84298 - RNA, 20 nt, Artificial Sequence
  MKO10084298_B_F11r
  gRNA
ugcugaccuccccguaguuc

SEQ ID NO: 84299 - RNA, 20 nt, Artificial Sequence
  MKO10084299_B_F11r
  gRNA
gcccaacucacacucguucu

SEQ ID NO: 84300 - RNA, 20 nt, Artificial Sequence
  MKO10084300_B_F11r
  gRNA
auucacuauugauccaaagu

SEQ ID NO: 84301 - RNA, 20 nt, Artificial Sequence
  MKO10084301_B_F11
  gRNA
cuucacagaaugcguuacua

SEQ ID NO: 84302 - RNA, 20 nt, Artificial Sequence
  MKO10084302_B_F11
  gRNA
gcgccugucauguuuaccau

SEQ ID NO: 84303 - RNA, 20 nt, Artificial Sequence
  MKO10084303_B_F11
  gRNA
cacucaccgaugguccacac

SEQ ID NO: 84304 - RNA, 20 nt, Artificial Sequence
  MKO10084304_B_F12
  gRNA
acauguaucaacacccccaa

SEQ ID NO: 84305 - RNA, 20 nt, Artificial Sequence
  MKO10084305_B_F12
  gRNA
uagcugacggugguacugaa

SEQ ID NO: 84306 - RNA, 20 nt, Artificial Sequence
  MKO10084306_B_F12
  gRNA
aaacacaacccgugccacaa

SEQ ID NO: 84307 - RNA, 20 nt, Artificial Sequence
  MKO10084307_B_F13a1
  gRNA
acaguucgaagacggcaucc

SEQ ID NO: 84308 - RNA, 20 nt, Artificial Sequence
  MKO10084308_B_F13a1
  gRNA
agggacgguugaagucaauc

SEQ ID NO: 84309 - RNA, 20 nt, Artificial Sequence
  MKO10084309_B_F13a1
  gRNA
aauaaguugauuguccgcag

SEQ ID NO: 84310 - RNA, 20 nt, Artificial Sequence
  MKO10084310_B_F13b
  gRNA
acguagccauuccuuagguc

SEQ ID NO: 84311 - RNA, 20 nt, Artificial Sequence
  MKO10084311_B_F13b
  gRNA
ugagggaccagccauuagcc

SEQ ID NO: 84312 - RNA, 20 nt, Artificial Sequence
  MKO10084312_B_F13b
  gRNA
acugacuuacuguagcaccu

SEQ ID NO: 84313 - RNA, 20 nt, Artificial Sequence
  MKO10084313_B_F2rl1
  gRNA
cucacccggugcaagguucu

SEQ ID NO: 84314 - RNA, 20 nt, Artificial Sequence
  MKO10084314_B_F2rl1
  gRNA
cgucuugaucaugagcacgu

SEQ ID NO: 84315 - RNA, 20 nt, Artificial Sequence
  MKO10084315_B_F2rl1
  gRNA
acaccccgccgugauuuaca

SEQ ID NO: 84316 - RNA, 20 nt, Artificial Sequence
  MKO10084316_B_F2rl2
  gRNA
ccacuuuggcaaacagugac

SEQ ID NO: 84317 - RNA, 20 nt, Artificial Sequence
  MKO10084317_B_F2rl2
  gRNA
uggugaucucggaguggacg

SEQ ID NO: 84318 - RNA, 20 nt, Artificial Sequence
  MKO10084318_B_F2rl2
  gRNA
gacgaaguaguagaaucgga

SEQ ID NO: 84319 - RNA, 20 nt, Artificial Sequence
  MKO10084319_B_F2rl3
  gRNA
cucuacaucaucguagaugc

SEQ ID NO: 84320 - RNA, 20 nt, Artificial Sequence
  MKO10084320_B_F2rl3
  gRNA
cgacuggcuuaccacuugcg

SEQ ID NO: 84321 - RNA, 20 nt, Artificial Sequence
  MKO10084321_B_F2rl3
  gRNA
uugcgggcccgugcacugcg

SEQ ID NO: 84322 - RNA, 20 nt, Artificial Sequence
  MKO10084322_B_F2r
  gRNA
cgcuugcugaucgucgcccu

SEQ ID NO: 84323 - RNA, 20 nt, Artificial Sequence
  MKO10084323_B_F2r
  gRNA
ccucaagacgaacacugcga

SEQ ID NO: 84324 - RNA, 20 nt, Artificial Sequence
  MKO10084324_B_F2r
  gRNA
cauguucccguaaaacgcug

SEQ ID NO: 84325 - RNA, 20 nt, Artificial Sequence
  MKO10084325_B_F2
  gRNA
aucugggugugaacuaccuu

SEQ ID NO: 84326 - RNA, 20 nt, Artificial Sequence
  MKO10084326_B_F2
  gRNA
uguuggcucugcggacccgc

SEQ ID NO: 84327 - RNA, 20 nt, Artificial Sequence
  MKO10084327_B_F2
  gRNA
uugcuuuguaggacguguuc

SEQ ID NO: 84328 - RNA, 20 nt, Artificial Sequence
  MKO10084328_B_F3
  gRNA
guacagugugcaccgagcaa

SEQ ID NO: 84329 - RNA, 20 nt, Artificial Sequence
  MKO10084329_B_F3
  gRNA
caaugaauucucgauugaug

SEQ ID NO: 84330 - RNA, 20 nt, Artificial Sequence
  MKO10084330_B_F3
  gRNA
ccuugccaaagacuugccgc

SEQ ID NO: 84331 - RNA, 20 nt, Artificial Sequence
  MKO10084331_B_F5
  gRNA
ccaacuucagcguauaaagu

SEQ ID NO: 84332 - RNA, 20 nt, Artificial Sequence
  MKO10084332_B_F5
  gRNA
uuugugaauaagacgaugcc

SEQ ID NO: 84333 - RNA, 20 nt, Artificial Sequence
  MKO10084333_B_F5
  gRNA
ucucucaggcacccugaccg

SEQ ID NO: 84334 - RNA, 20 nt, Artificial Sequence
  MKO10084334_B_F7
  gRNA
gccucgaauccaugucagaa

SEQ ID NO: 84335 - RNA, 20 nt, Artificial Sequence
  MKO10084335_B_F7
  gRNA
ggggcacucacgguccucuc

SEQ ID NO: 84336 - RNA, 20 nt, Artificial Sequence
  MKO10084336_B_F7
  gRNA
ugacugugaccaguacugca

SEQ ID NO: 84337 - RNA, 20 nt, Artificial Sequence
  MKO10084337_B_F830016B08Rik
  gRNA
aguuguaaauaauagauugc

SEQ ID NO: 84338 - RNA, 20 nt, Artificial Sequence
  MKO10084338_B_F830016B08Rik
  gRNA
aauccuuagccaccaacucc

SEQ ID NO: 84339 - RNA, 20 nt, Artificial Sequence
  MKO10084339_B_F830016B08Rik
  gRNA
uggcuagaagccuucaagau

SEQ ID NO: 84340 - RNA, 20 nt, Artificial Sequence
  MKO10084340_B_F830045P16Rik
  gRNA
guugacauguaccacgugug

SEQ ID NO: 84341 - RNA, 20 nt, Artificial Sequence
  MKO10084341_B_F830045P16Rik
  gRNA
ugaucaaguacucacuugca

SEQ ID NO: 84342 - RNA, 20 nt, Artificial Sequence
  MKO10084342_B_F830045P16Rik
  gRNA
gcaagugacagucaccaaac

SEQ ID NO: 84343 - RNA, 20 nt, Artificial Sequence
  MKO10084343_B_F8a
  gRNA
gcgcgacuacacaggcgccc

SEQ ID NO: 84344 - RNA, 20 nt, Artificial Sequence
  MKO10084344_B_F8a
  gRNA
gggacuucuuggcacgcuau

SEQ ID NO: 84345 - RNA, 20 nt, Artificial Sequence
  MKO10084345_B_F8a
  gRNA
gugcgcuugcaccucgagcu

SEQ ID NO: 84346 - RNA, 20 nt, Artificial Sequence
  MKO10084346_B_F8
  gRNA
uuacucauauaugucucaug

SEQ ID NO: 84347 - RNA, 20 nt, Artificial Sequence
  MKO10084347_B_F8
  gRNA
acccucagaagcuuuccagu

SEQ ID NO: 84348 - RNA, 20 nt, Artificial Sequence
  MKO10084348_B_F8
  gRNA
gccaucagaagauacuaccu

SEQ ID NO: 84349 - RNA, 20 nt, Artificial Sequence
  MKO10084349_B_F9
  gRNA
auauuaguuccuaugaaugc

SEQ ID NO: 84350 - RNA, 20 nt, Artificial Sequence
  MKO10084350_B_F9
  gRNA
gaacaaauuaccuuguuauc

SEQ ID NO: 84351 - RNA, 20 nt, Artificial Sequence
  MKO10084351_B_F9
  gRNA
gccaaguuggauuugaagga

SEQ ID NO: 84352 - RNA, 20 nt, Artificial Sequence
  MKO10084352_B_Fa2h
  gRNA
cuuccacucagaccucaucg

SEQ ID NO: 84353 - RNA, 20 nt, Artificial Sequence
  MKO10084353_B_Fa2h
  gRNA
cucuucgcaucacucacaag

SEQ ID NO: 84354 - RNA, 20 nt, Artificial Sequence
  MKO10084354_B_Fa2h
  gRNA
guggaugacguauuccacaa

SEQ ID NO: 84355 - RNA, 20 nt, Artificial Sequence
  MKO10084355_B_Faah
  gRNA
uuacccgcagaauccugacc

SEQ ID NO: 84356 - RNA, 20 nt, Artificial Sequence
  MKO10084356_B_Faah
  gRNA
guucauggucuggccaaaga

SEQ ID NO: 84357 - RNA, 20 nt, Artificial Sequence
  MKO10084357_B_Faah
  gRNA
ucacggggacgccauagagc

SEQ ID NO: 84358 - RNA, 20 nt, Artificial Sequence
  MKO10084358_B_Fabp12
  gRNA
uuugaggaaaccacaccaag

SEQ ID NO: 84359 - RNA, 20 nt, Artificial Sequence
  MKO10084359_B_Fabp12
  gRNA
aaacuccucucccagcuuga

SEQ ID NO: 84360 - RNA, 20 nt, Artificial Sequence
  MKO10084360_B_Fabp12
  gRNA
aucuaccagucuccugcaga

SEQ ID NO: 84361 - RNA, 20 nt, Artificial Sequence
  MKO10084361_B_Fabp1
  gRNA
gugucagaaaucgugcauga

SEQ ID NO: 84362 - RNA, 20 nt, Artificial Sequence
  MKO10084362_B_Fabp1
  gRNA
gacaaugucgcccaauguca

SEQ ID NO: 84363 - RNA, 20 nt, Artificial Sequence
  MKO10084363_B_Fabp1
  gRNA
ucaccuauugccuucaugaa

SEQ ID NO: 84364 - RNA, 20 nt, Artificial Sequence
  MKO10084364_B_Fabp2
  gRNA
gcugagaucauggcauucga

SEQ ID NO: 84365 - RNA, 20 nt, Artificial Sequence
  MKO10084365_B_Fabp2
  gRNA
uucugguaaugaacuaaucc

SEQ ID NO: 84366 - RNA, 20 nt, Artificial Sequence
  MKO10084366_B_Fabp2
  gRNA
uuccuucuuaaagaaucgcu

SEQ ID NO: 84367 - RNA, 20 nt, Artificial Sequence
  MKO10084367_B_Fabp3
  gRNA
ucuuucuagacucucacuca

SEQ ID NO: 84368 - RNA, 20 nt, Artificial Sequence
  MKO10084368_B_Fabp3
  gRNA
cuugcuguccacuagcuucc

SEQ ID NO: 84369 - RNA, 20 nt, Artificial Sequence
  MKO10084369_B_Fabp3
  gRNA
uaggugugggcuuugccacc

SEQ ID NO: 84370 - RNA, 20 nt, Artificial Sequence
  MKO10084370_B_Fabp4
  gRNA
cagagcaucauaacccuaga

SEQ ID NO: 84371 - RNA, 20 nt, Artificial Sequence
  MKO10084371_B_Fabp4
  gRNA
gucuaggaauguguuaugaa

SEQ ID NO: 84372 - RNA, 20 nt, Artificial Sequence
  MKO10084372_B_Fabp4
  gRNA
cgaugauuacaugaaagaag

SEQ ID NO: 84373 - RNA, 20 nt, Artificial Sequence
  MKO10084373_B_Fabp5
  gRNA
gacuguguucucuuguaacc

SEQ ID NO: 84374 - RNA, 20 nt, Artificial Sequence
  MKO10084374_B_Fabp5
  gRNA
ucuccuucccgucccauugc

SEQ ID NO: 84375 - RNA, 20 nt, Artificial Sequence
  MKO10084375_B_Fabp5
  gRNA
acggucugcaccuuccaaga

SEQ ID NO: 84376 - RNA, 20 nt, Artificial Sequence
  MKO10084376_B_Fabp6
  gRNA
ccucuugcuuacgcgcucau

SEQ ID NO: 84377 - RNA, 20 nt, Artificial Sequence
  MKO10084377_B_Fabp6
  gRNA
cgaugaguucaugaagcgcc

SEQ ID NO: 84378 - RNA, 20 nt, Artificial Sequence
  MKO10084378_B_Fabp6
  gRNA
ccccuuucaaucacgucucc

SEQ ID NO: 84379 - RNA, 20 nt, Artificial Sequence
  MKO10084379_B_Fabp7
  gRNA
uccugacugauaaucacagu

SEQ ID NO: 84380 - RNA, 20 nt, Artificial Sequence
  MKO10084380_B_Fabp7
  gRNA
cuauuucagacucuuaccuu

SEQ ID NO: 84381 - RNA, 20 nt, Artificial Sequence
  MKO10084381_B_Fabp7
  gRNA
ugaugaguacaugaaagcuc

SEQ ID NO: 84382 - RNA, 20 nt, Artificial Sequence
  MKO10084382_B_Fabp9
  gRNA
uuauuaaacaugcgacuuuc

SEQ ID NO: 84383 - RNA, 20 nt, Artificial Sequence
  MKO10084383_B_Fabp9
  gRNA
acgaugauugagcccuucuu

SEQ ID NO: 84384 - RNA, 20 nt, Artificial Sequence
  MKO10084384_B_Fabp9
  gRNA
caguuuccaggugccuaaga

SEQ ID NO: 84385 - RNA, 20 nt, Artificial Sequence
  MKO10084385_B_Fadd
  gRNA
ccaucagaucguugcccgac

SEQ ID NO: 84386 - RNA, 20 nt, Artificial Sequence
  MKO10084386_B_Fadd
  gRNA
cgggcugcugcgcgaguugc

SEQ ID NO: 84387 - RNA, 20 nt, Artificial Sequence
  MKO10084387_B_Fadd
  gRNA
gcgcgugagcaaacgaaagc

SEQ ID NO: 84388 - RNA, 20 nt, Artificial Sequence
  MKO10084388_B_Fads1
  gRNA
caagccuaacugcuuccgca

SEQ ID NO: 84389 - RNA, 20 nt, Artificial Sequence
  MKO10084389_B_Fads1
  gRNA
aagcgcuaacugaugaauuc

SEQ ID NO: 84390 - RNA, 20 nt, Artificial Sequence
  MKO10084390_B_Fads1
  gRNA
caaucacaaaaugauguagc

SEQ ID NO: 84391 - RNA, 20 nt, Artificial Sequence
  MKO10084391_B_Fads2
  gRNA
ggcuuuccaugacgaugaug

SEQ ID NO: 84392 - RNA, 20 nt, Artificial Sequence
  MKO10084392_B_Fads2
  gRNA
uucuugaagccccugcugau

SEQ ID NO: 84393 - RNA, 20 nt, Artificial Sequence
  MKO10084393_B_Fads2
  gRNA
cauguugcagccauccagcu

SEQ ID NO: 84394 - RNA, 20 nt, Artificial Sequence
  MKO10084394_B_Fads3
  gRNA
gggcuagcucuccaaucaac

SEQ ID NO: 84395 - RNA, 20 nt, Artificial Sequence
  MKO10084395_B_Fads3
  gRNA
acugccccaucacgaacugc

SEQ ID NO: 84396 - RNA, 20 nt, Artificial Sequence
  MKO10084396_B_Fads3
  gRNA
ucaggaacuugcgcacaaaa

SEQ ID NO: 84397 - RNA, 20 nt, Artificial Sequence
  MKO10084397_B_Fads6
  gRNA
acccaagauugugaugcccg

SEQ ID NO: 84398 - RNA, 20 nt, Artificial Sequence
  MKO10084398_B_Fads6
  gRNA
gaacccccagggucaucaug

SEQ ID NO: 84399 - RNA, 20 nt, Artificial Sequence
  MKO10084399_B_Fads6
  gRNA
caagaaccccaguucagcac

SEQ ID NO: 84400 - RNA, 20 nt, Artificial Sequence
  MKO10084400_B_Faf1
  gRNA
cacugcuugagcaaaauaac

SEQ ID NO: 84401 - RNA, 20 nt, Artificial Sequence
  MKO10084401_B_Faf1
  gRNA
gugccuaaaaugcuguuaaa

SEQ ID NO: 84402 - RNA, 20 nt, Artificial Sequence
  MKO10084402_B_Faf1
  gRNA
aggaaaauggcauucuacaa

SEQ ID NO: 84403 - RNA, 20 nt, Artificial Sequence
  MKO10084403_B_Faf2
  gRNA
ucagcuguauuaaccuguag

SEQ ID NO: 84404 - RNA, 20 nt, Artificial Sequence
  MKO10084404_B_Faf2
  gRNA
agguuaauacagcugaccac

SEQ ID NO: 84405 - RNA, 20 nt, Artificial Sequence
  MKO10084405_B_Faf2
  gRNA
uugcuuuggagcagcauaac

SEQ ID NO: 84406 - RNA, 20 nt, Artificial Sequence
  MKO10084406_B_Fahd1
  gRNA
cacgaaggcacugaccgggc

SEQ ID NO: 84407 - RNA, 20 nt, Artificial Sequence
  MKO10084407_B_Fahd1
  gRNA
cugccgcaaccuccaccacg

SEQ ID NO: 84408 - RNA, 20 nt, Artificial Sequence
  MKO10084408_B_Fahd1
  gRNA
ccaaaccgcugucucguuuc

SEQ ID NO: 84409 - RNA, 20 nt, Artificial Sequence
  MKO10084409_B_Fahd2a
  gRNA
cccacacauaucaccuuguc

SEQ ID NO: 84410 - RNA, 20 nt, Artificial Sequence
  MKO10084410_B_Fahd2a
  gRNA
ccacuuugcaggaaguugac

SEQ ID NO: 84411 - RNA, 20 nt, Artificial Sequence
  MKO10084411_B_Fahd2a
  gRNA
guuaccaaggauaccauagc

SEQ ID NO: 84412 - RNA, 20 nt, Artificial Sequence
  MKO10084412_B_Fah
  gRNA
aaagggcagguccgguaaag

SEQ ID NO: 84413 - RNA, 20 nt, Artificial Sequence
  MKO10084413_B_Fah
  gRNA
augcaccuuccugcuaccau

SEQ ID NO: 84414 - RNA, 20 nt, Artificial Sequence
  MKO10084414_B_Fah
  gRNA
ucugaacauaaugccaacau

SEQ ID NO: 84415 - RNA, 20 nt, Artificial Sequence
  MKO10084415_B_Faim2
  gRNA
cucggcgccacccuccuaug

SEQ ID NO: 84416 - RNA, 20 nt, Artificial Sequence
  MKO10084416_B_Faim2
  gRNA
ugaagagccgacgaacuuuc

SEQ ID NO: 84417 - RNA, 20 nt, Artificial Sequence
  MKO10084417_B_Faim2
  gRNA
auguccaggcuaaccccggc

SEQ ID NO: 84418 - RNA, 20 nt, Artificial Sequence
  MKO10084418_B_Faim3
  gRNA
auguucacucccguggagcc

SEQ ID NO: 84419 - RNA, 20 nt, Artificial Sequence
  MKO10084419_B_Faim3
  gRNA
cggucuucucucccauagug

SEQ ID NO: 84420 - RNA, 20 nt, Artificial Sequence
  MKO10084420_B_Faim3
  gRNA
cuuccacucagcaagcaauc

SEQ ID NO: 84421 - RNA, 20 nt, Artificial Sequence
  MKO10084421_B_Faim
  gRNA
aggcaagcggguuguguacg

SEQ ID NO: 84422 - RNA, 20 nt, Artificial Sequence
  MKO10084422_B_Faim
  gRNA
auggugcaauggucagaaaa

SEQ ID NO: 84423 - RNA, 20 nt, Artificial Sequence
  MKO10084423_B_Faim
  gRNA
uacauaaaagcugugagcag

SEQ ID NO: 84424 - RNA, 20 nt, Artificial Sequence
  MKO10084424_B_Fam101a
  gRNA
uugcuggacagucccgauuc

SEQ ID NO: 84425 - RNA, 20 nt, Artificial Sequence
  MKO10084425_B_Fam101a
  gRNA
acgcgggagcagagccgcga

SEQ ID NO: 84426 - RNA, 20 nt, Artificial Sequence
  MKO10084426_B_Fam101a
  gRNA
cgugaccucaucuccagagc

SEQ ID NO: 84427 - RNA, 20 nt, Artificial Sequence
  MKO10084427_B_Fam101b
  gRNA
aaacucaacuccuucgccga

SEQ ID NO: 84428 - RNA, 20 nt, Artificial Sequence
  MKO10084428_B_Fam101b
  gRNA
auaguuucgccaagugcagu

SEQ ID NO: 84429 - RNA, 20 nt, Artificial Sequence
  MKO10084429_B_Fam101b
  gRNA
guuugaccccuugccaccaa

SEQ ID NO: 84430 - RNA, 20 nt, Artificial Sequence
  MKO10084430_B_Fam102a
  gRNA
cuuucgagugucugugcgca

SEQ ID NO: 84431 - RNA, 20 nt, Artificial Sequence
  MKO10084431_B_Fam102a
  gRNA
caccguccgcugcugccuau

SEQ ID NO: 84432 - RNA, 20 nt, Artificial Sequence
  MKO10084432_B_Fam102a
  gRNA
ucucugcaggagcugaaagg

SEQ ID NO: 84433 - RNA, 20 nt, Artificial Sequence
  MKO10084433_B_Fam102b
  gRNA
aucaguaugcagcugauguc

SEQ ID NO: 84434 - RNA, 20 nt, Artificial Sequence
  MKO10084434_B_Fam102b
  gRNA
gggcuuugcagaucuaaacc

SEQ ID NO: 84435 - RNA, 20 nt, Artificial Sequence
  MKO10084435_B_Fam102b
  gRNA
uguuugcaggaauuaaaagg

SEQ ID NO: 84436 - RNA, 20 nt, Artificial Sequence
  MKO10084436_B_Fam103a1
  gRNA
caagacaacagacaauuuag

SEQ ID NO: 84437 - RNA, 20 nt, Artificial Sequence
  MKO10084437_B_Fam103a1
  gRNA
cuauuccauuccucaacaau

SEQ ID NO: 84438 - RNA, 20 nt, Artificial Sequence
  MKO10084438_B_Fam103a1
  gRNA
ugaguccccuccaauuguug

SEQ ID NO: 84439 - RNA, 20 nt, Artificial Sequence
  MKO10084439_B_Fam104a
  gRNA
cagucuucaagcagcgacag

SEQ ID NO: 84440 - RNA, 20 nt, Artificial Sequence
  MKO10084440_B_Fam104a
  gRNA
uucagaaaaaggagaagaaa

SEQ ID NO: 84441 - RNA, 20 nt, Artificial Sequence
  MKO10084441_B_Fam104a
  gRNA
ucugccuaccucuguguccc

SEQ ID NO: 84442 - RNA, 20 nt, Artificial Sequence
  MKO10084442_B_Fam105a
  gRNA
caggcccgaaacuguacugc

SEQ ID NO: 84443 - RNA, 20 nt, Artificial Sequence
  MKO10084443_B_Fam105a
  gRNA
acauaccuuccgcaucaguc

SEQ ID NO: 84444 - RNA, 20 nt, Artificial Sequence
  MKO10084444_B_Fam105a
  gRNA
uggauccagcaguacaguuu

SEQ ID NO: 84445 - RNA, 20 nt, Artificial Sequence
  MKO10084445_B_Fam105b
  gRNA
uaguccaugauauccauuuc

SEQ ID NO: 84446 - RNA, 20 nt, Artificial Sequence
  MKO10084446_B_Fam105b
  gRNA
gugauaacuacugugcacug

SEQ ID NO: 84447 - RNA, 20 nt, Artificial Sequence
  MKO10084447_B_Fam105b
  gRNA
gaauugcuaauacaugaaag

SEQ ID NO: 84448 - RNA, 20 nt, Artificial Sequence
  MKO10084448_B_Fam107a
  gRNA
uacccgcaggggcuugggua

SEQ ID NO: 84449 - RNA, 20 nt, Artificial Sequence
  MKO10084449_B_Fam107a
  gRNA
gcgugguccucgucucucug

SEQ ID NO: 84450 - RNA, 20 nt, Artificial Sequence
  MKO10084450_B_Fam107a
  gRNA
ggcugacaucgagggacuca

SEQ ID NO: 84451 - RNA, 20 nt, Artificial Sequence
  MKO10084451_B_Fam107b
  gRNA
aaaugccccagaguuuguga

SEQ ID NO: 84452 - RNA, 20 nt, Artificial Sequence
  MKO10084452_B_Fam107b
  gRNA
gcuuuaauaguucuauuucc

SEQ ID NO: 84453 - RNA, 20 nt, Artificial Sequence
  MKO10084453_B_Fam107b
  gRNA
ccaagagguggcucaggccc

SEQ ID NO: 84454 - RNA, 20 nt, Artificial Sequence
  MKO10084454_B_Fam109a
  gRNA
guccauaucgcgcaugcagc

SEQ ID NO: 84455 - RNA, 20 nt, Artificial Sequence
  MKO10084455_B_Fam109a
  gRNA
cuacgcaaccugcgaugccc

SEQ ID NO: 84456 - RNA, 20 nt, Artificial Sequence
  MKO10084456_B_Fam109a
  gRNA
cucagcggccaacgggcccu

SEQ ID NO: 84457 - RNA, 20 nt, Artificial Sequence
  MKO10084457_B_Fam109b
  gRNA
acacuggcuuucugcguagu

SEQ ID NO: 84458 - RNA, 20 nt, Artificial Sequence
  MKO10084458_B_Fam109b
  gRNA
gcgacuuguggugcgagaau

SEQ ID NO: 84459 - RNA, 20 nt, Artificial Sequence
  MKO10084459_B_Fam109b
  gRNA
ugcaucgcugugcaucccag

SEQ ID NO: 84460 - RNA, 20 nt, Artificial Sequence
  MKO10084460_B_Fam110a
  gRNA
cccaauccucgcgcuuccuc

SEQ ID NO: 84461 - RNA, 20 nt, Artificial Sequence
  MKO10084461_B_Fam110a
  gRNA
gccggcggccagaacagggc

SEQ ID NO: 84462 - RNA, 20 nt, Artificial Sequence
  MKO10084462_B_Fam110a
  gRNA
ggcggguguuggccacacgc

SEQ ID NO: 84463 - RNA, 20 nt, Artificial Sequence
  MKO10084463_B_Fam110b
  gRNA
acccgacuacuuccgcaggc

SEQ ID NO: 84464 - RNA, 20 nt, Artificial Sequence
  MKO10084464_B_Fam110b
  gRNA
cuccuggcucuugacguauu

SEQ ID NO: 84465 - RNA, 20 nt, Artificial Sequence
  MKO10084465_B_Fam110b
  gRNA
ggcuuuaaggggcuucacac

SEQ ID NO: 84466 - RNA, 20 nt, Artificial Sequence
  MKO10084466_B_Fam110c
  gRNA
gcgauagcccugcgugcuac

SEQ ID NO: 84467 - RNA, 20 nt, Artificial Sequence
  MKO10084467_B_Fam110c
  gRNA
cagaaaugugaauucguacg

SEQ ID NO: 84468 - RNA, 20 nt, Artificial Sequence
  MKO10084468_B_Fam110c
  gRNA
gcaccgcaacccgaucccuu

SEQ ID NO: 84469 - RNA, 20 nt, Artificial Sequence
  MKO10084469_B_Fam111a
  gRNA
ccaaaaugagcuguaagaag

SEQ ID NO: 84470 - RNA, 20 nt, Artificial Sequence
  MKO10084470_B_Fam111a
  gRNA
gucuauugauugcuguacag

SEQ ID NO: 84471 - RNA, 20 nt, Artificial Sequence
  MKO10084471_B_Fam111a
  gRNA
gacaaaauguaaugacgaca

SEQ ID NO: 84472 - RNA, 20 nt, Artificial Sequence
  MKO10084472_B_Fam114a1
  gRNA
ggcuguggaccccucaucac

SEQ ID NO: 84473 - RNA, 20 nt, Artificial Sequence
  MKO10084473_B_Fam114a1
  gRNA
gccccaacugaugcugaaaa

SEQ ID NO: 84474 - RNA, 20 nt, Artificial Sequence
  MKO10084474_B_Fam114a1
  gRNA
gcugucagcccucaccaaug

SEQ ID NO: 84475 - RNA, 20 nt, Artificial Sequence
  MKO10084475_B_Fam114a2
  gRNA
ugagaauggaagcuuacuag

SEQ ID NO: 84476 - RNA, 20 nt, Artificial Sequence
  MKO10084476_B_Fam114a2
  gRNA
ccagagucuccagugguaac

SEQ ID NO: 84477 - RNA, 20 nt, Artificial Sequence
  MKO10084477_B_Fam114a2
  gRNA
gacuucagcugaaauuucag

SEQ ID NO: 84478 - RNA, 20 nt, Artificial Sequence
  MKO10084478_B_Fam115a
  gRNA
agcaccggacucuacauacc

SEQ ID NO: 84479 - RNA, 20 nt, Artificial Sequence
  MKO10084479_B_Fam115a
  gRNA
gaggcccccuugugauuaac

SEQ ID NO: 84480 - RNA, 20 nt, Artificial Sequence
  MKO10084480_B_Fam115a
  gRNA
cagcguucgaagauuugcag

SEQ ID NO: 84481 - RNA, 20 nt, Artificial Sequence
  MKO10084481_B_Fam115c
  gRNA
acaucagcgacaauucucuc

SEQ ID NO: 84482 - RNA, 20 nt, Artificial Sequence
  MKO10084482_B_Fam115c
  gRNA
ugccaggugaccgugauguc

SEQ ID NO: 84483 - RNA, 20 nt, Artificial Sequence
  MKO10084483_B_Fam115c
  gRNA
ggcaggcacugcauucguga

SEQ ID NO: 84484 - RNA, 20 nt, Artificial Sequence
  MKO10084484_B_Fam115e
  gRNA
uacuuacccagccugaagua

SEQ ID NO: 84485 - RNA, 20 nt, Artificial Sequence
  MKO10084485_B_Fam115e
  gRNA
agcagauacagccccacgga

SEQ ID NO: 84486 - RNA, 20 nt, Artificial Sequence
  MKO10084486_B_Fam115e
  gRNA
gguaagggcuguagccaagc

SEQ ID NO: 84487 - RNA, 20 nt, Artificial Sequence
  MKO10084487_B_Fam117a
  gRNA
cagcacagaccaccgaaaag

SEQ ID NO: 84488 - RNA, 20 nt, Artificial Sequence
  MKO10084488_B_Fam117a
  gRNA
gaccaugcugcgcugggagc

SEQ ID NO: 84489 - RNA, 20 nt, Artificial Sequence
  MKO10084489_B_Fam117a
  gRNA
gagcggagcugcccugucca

SEQ ID NO: 84490 - RNA, 20 nt, Artificial Sequence
  MKO10084490_B_Fam117b
  gRNA
uauccagggaagaugugcgu

SEQ ID NO: 84491 - RNA, 20 nt, Artificial Sequence
  MKO10084491_B_Fam117b
  gRNA
uacaauagaccgagagugca

SEQ ID NO: 84492 - RNA, 20 nt, Artificial Sequence
  MKO10084492_B_Fam117b
  gRNA
cucauaagcgcucaucaucc

SEQ ID NO: 84493 - RNA, 20 nt, Artificial Sequence
  MKO10084493_B_Fam118a
  gRNA
caccaacuacgacaaccugc

SEQ ID NO: 84494 - RNA, 20 nt, Artificial Sequence
  MKO10084494_B_Fam118a
  gRNA
cguugcugaguuccggagga

SEQ ID NO: 84495 - RNA, 20 nt, Artificial Sequence
  MKO10084495_B_Fam118a
  gRNA
gugacaucuuuauagcccga

SEQ ID NO: 84496 - RNA, 20 nt, Artificial Sequence
  MKO10084496_B_Fam118b
  gRNA
aaagccucgagaacuugugc

SEQ ID NO: 84497 - RNA, 20 nt, Artificial Sequence
  MKO10084497_B_Fam118b
  gRNA
auuuaugcuugacggccucu

SEQ ID NO: 84498 - RNA, 20 nt, Artificial Sequence
  MKO10084498_B_Fam118b
  gRNA
agcacauucugauauccagc

SEQ ID NO: 84499 - RNA, 20 nt, Artificial Sequence
  MKO10084499_B_Fam120a
  gRNA
ucagguccgagcccaccagc

SEQ ID NO: 84500 - RNA, 20 nt, Artificial Sequence
  MKO10084500_B_Fam120a
  gRNA
gcauccacucgccucacuga

SEQ ID NO: 84501 - RNA, 20 nt, Artificial Sequence
  MKO10084501_B_Fam120a
  gRNA
uguaccuucagugaggcgag

SEQ ID NO: 84502 - RNA, 20 nt, Artificial Sequence
  MKO10084502_B_Fam120b
  gRNA
uuuagggggaacaccuagcu

SEQ ID NO: 84503 - RNA, 20 nt, Artificial Sequence
  MKO10084503_B_Fam120b
  gRNA
ccucugcagaugaccguuca

SEQ ID NO: 84504 - RNA, 20 nt, Artificial Sequence
  MKO10084504_B_Fam120b
  gRNA
ccuugaacggucaucugcag

SEQ ID NO: 84505 - RNA, 20 nt, Artificial Sequence
  MKO10084505_B_Fam120c
  gRNA
acauccucuugcaucacuua

SEQ ID NO: 84506 - RNA, 20 nt, Artificial Sequence
  MKO10084506_B_Fam120c
  gRNA
auuaccuuaagugaugcaag

SEQ ID NO: 84507 - RNA, 20 nt, Artificial Sequence
  MKO10084507_B_Fam120c
  gRNA
uccagcucagcuucagcgca

SEQ ID NO: 84508 - RNA, 20 nt, Artificial Sequence
  MKO10084508_B_Fam122a
  gRNA
gaacgucgugcuguuccguc

SEQ ID NO: 84509 - RNA, 20 nt, Artificial Sequence
  MKO10084509_B_Fam122a
  gRNA
ccgaggcgcccagcgccaga

SEQ ID NO: 84510 - RNA, 20 nt, Artificial Sequence
  MKO10084510_B_Fam122a
  gRNA
agagaccguucacgagcgcg

SEQ ID NO: 84511 - RNA, 20 nt, Artificial Sequence
  MKO10084511_B_Fam122b
  gRNA
ugauacuuaccaagcuauga

SEQ ID NO: 84512 - RNA, 20 nt, Artificial Sequence
  MKO10084512_B_Fam122b
  gRNA
gaugcagauaagccagucau

SEQ ID NO: 84513 - RNA, 20 nt, Artificial Sequence
  MKO10084513_B_Fam122b
  gRNA
auccuuauaggaagaaggcc

SEQ ID NO: 84514 - RNA, 20 nt, Artificial Sequence
  MKO10084514_B_Fam122c
  gRNA
gguuggcagauguacgacug

SEQ ID NO: 84515 - RNA, 20 nt, Artificial Sequence
  MKO10084515_B_Fam122c
  gRNA
caauccaugcugauucagaa

SEQ ID NO: 84516 - RNA, 20 nt, Artificial Sequence
  MKO10084516_B_Fam122c
  gRNA
auacugcaaugcagauaagu

SEQ ID NO: 84517 - RNA, 20 nt, Artificial Sequence
  MKO10084517_B_Fam124a
  gRNA
cugccagcgccccucgcuga

SEQ ID NO: 84518 - RNA, 20 nt, Artificial Sequence
  MKO10084518_B_Fam124a
  gRNA
gcccauccaaccagauagcc

SEQ ID NO: 84519 - RNA, 20 nt, Artificial Sequence
  MKO10084519_B_Fam124a
  gRNA
ucuuccucaccgcccgccuu

SEQ ID NO: 84520 - RNA, 20 nt, Artificial Sequence
  MKO10084520_B_Fam124b
  gRNA
acuuccuacggcguucaccc

SEQ ID NO: 84521 - RNA, 20 nt, Artificial Sequence
  MKO10084521_B_Fam124b
  gRNA
ucugcucggaaaagaucgcc

SEQ ID NO: 84522 - RNA, 20 nt, Artificial Sequence
  MKO10084522_B_Fam124b
  gRNA
ucauagguccauccgaagcc

SEQ ID NO: 84523 - RNA, 20 nt, Artificial Sequence
  MKO10084523_B_Fam126a
  gRNA
uuaucaaaagucguguacag

SEQ ID NO: 84524 - RNA, 20 nt, Artificial Sequence
  MKO10084524_B_Fam126a
  gRNA
aauguacuuaccucacucug

SEQ ID NO: 84525 - RNA, 20 nt, Artificial Sequence
  MKO10084525_B_Fam126a
  gRNA
cuuacuucaugauauacaga

SEQ ID NO: 84526 - RNA, 20 nt, Artificial Sequence
  MKO10084526_B_Fam126b
  gRNA
guuaugcagcaaccuugcac

SEQ ID NO: 84527 - RNA, 20 nt, Artificial Sequence
  MKO10084527_B_Fam126b
  gRNA
uaugucagcaugaucucauc

SEQ ID NO: 84528 - RNA, 20 nt, Artificial Sequence
  MKO10084528_B_Fam126b
  gRNA
uaacugguaaucugaguguc

SEQ ID NO: 84529 - RNA, 20 nt, Artificial Sequence
  MKO10084529_B_Fam129a
  gRNA
gcuucauacaaaaccguucc

SEQ ID NO: 84530 - RNA, 20 nt, Artificial Sequence
  MKO10084530_B_Fam129a
  gRNA
ucuuccuaggccuaucagag

SEQ ID NO: 84531 - RNA, 20 nt, Artificial Sequence
  MKO10084531_B_Fam129a
  gRNA
uuuaagcccccacuggaacc

SEQ ID NO: 84532 - RNA, 20 nt, Artificial Sequence
  MKO10084532_B_Fam129b
  gRNA
uagcaugcgccaugagaucg

SEQ ID NO: 84533 - RNA, 20 nt, Artificial Sequence
  MKO10084533_B_Fam129b
  gRNA
acagggaccacaucgaaauc

SEQ ID NO: 84534 - RNA, 20 nt, Artificial Sequence
  MKO10084534_B_Fam129b
  gRNA
gcccggugcccucgaucuca

SEQ ID NO: 84535 - RNA, 20 nt, Artificial Sequence
  MKO10084535_B_Fam129c
  gRNA
ugcagaagcugccucgaguc

SEQ ID NO: 84536 - RNA, 20 nt, Artificial Sequence
  MKO10084536_B_Fam129c
  gRNA
cucacuacaggucaggugaa

SEQ ID NO: 84537 - RNA, 20 nt, Artificial Sequence
  MKO10084537_B_Fam129c
  gRNA
ccuuccugcccuguuaccgu

SEQ ID NO: 84538 - RNA, 20 nt, Artificial Sequence
  MKO10084538_B_Fam131a
  gRNA
cauaccaugcagggacgauc

SEQ ID NO: 84539 - RNA, 20 nt, Artificial Sequence
  MKO10084539_B_Fam131a
  gRNA
ggaucugcucgaacucuccg

SEQ ID NO: 84540 - RNA, 20 nt, Artificial Sequence
  MKO10084540_B_Fam131a
  gRNA
cauccaggagaucgcugcac

SEQ ID NO: 84541 - RNA, 20 nt, Artificial Sequence
  MKO10084541_B_Fam131b
  gRNA
agggaucucgaggagcauga

SEQ ID NO: 84542 - RNA, 20 nt, Artificial Sequence
  MKO10084542_B_Fam131b
  gRNA
uccagccuuaccucugucga

SEQ ID NO: 84543 - RNA, 20 nt, Artificial Sequence
  MKO10084543_B_Fam131b
  gRNA
uuagaguuucgcuuaagcuu

SEQ ID NO: 84544 - RNA, 20 nt, Artificial Sequence
  MKO10084544_B_Fam131c
  gRNA
uggagggcaggucccgauuc

SEQ ID NO: 84545 - RNA, 20 nt, Artificial Sequence
  MKO10084545_B_Fam131c
  gRNA
ccuggcuacgucaucccuug

SEQ ID NO: 84546 - RNA, 20 nt, Artificial Sequence
  MKO10084546_B_Fam131c
  gRNA
gugcccacaaaaacagcccc

SEQ ID NO: 84547 - RNA, 20 nt, Artificial Sequence
  MKO10084547_B_Fam132a
  gRNA
gccuuaccgacuucuugucc

SEQ ID NO: 84548 - RNA, 20 nt, Artificial Sequence
  MKO10084548_B_Fam132a
  gRNA
auuuccacagccuacuacuc

SEQ ID NO: 84549 - RNA, 20 nt, Artificial Sequence
  MKO10084549_B_Fam132a
  gRNA
ucugggguaacgcccacacc

SEQ ID NO: 84550 - RNA, 20 nt, Artificial Sequence
  MKO10084550_B_Fam132b
  gRNA
caguacaccgcaccuguggc

SEQ ID NO: 84551 - RNA, 20 nt, Artificial Sequence
  MKO10084551_B_Fam132b
  gRNA
guucgucaagcagagugaca

SEQ ID NO: 84552 - RNA, 20 nt, Artificial Sequence
  MKO10084552_B_Fam132b
  gRNA
cauugcgcaugcacacagug

SEQ ID NO: 84553 - RNA, 20 nt, Artificial Sequence
  MKO10084553_B_Fam133b
  gRNA
uucaaacucagccaaagccu

SEQ ID NO: 84554 - RNA, 20 nt, Artificial Sequence
  MKO10084554_B_Fam133b
  gRNA
uguucuaagggaggaaguca

SEQ ID NO: 84555 - RNA, 20 nt, Artificial Sequence
  MKO10084555_B_Fam133b
  gRNA
cauagagaaaaauuauuaag

SEQ ID NO: 84556 - RNA, 20 nt, Artificial Sequence
  MKO10084556_B_Fam134a
  gRNA
cugaagaaccacacucugac

SEQ ID NO: 84557 - RNA, 20 nt, Artificial Sequence
  MKO10084557_B_Fam134a
  gRNA
uguguugggacacuauguuc

SEQ ID NO: 84558 - RNA, 20 nt, Artificial Sequence
  MKO10084558_B_Fam134a
  gRNA
uauacucaccugucagagug

SEQ ID NO: 84559 - RNA, 20 nt, Artificial Sequence
  MKO10084559_B_Fam134b
  gRNA
cuguuuaaauguaaugauau

SEQ ID NO: 84560 - RNA, 20 nt, Artificial Sequence
  MKO10084560_B_Fam134b
  gRNA
agguagcugaguaugacccc

SEQ ID NO: 84561 - RNA, 20 nt, Artificial Sequence
  MKO10084561_B_Fam134b
  gRNA
augugcacacacugcagacc

SEQ ID NO: 84562 - RNA, 20 nt, Artificial Sequence
  MKO10084562_B_Fam134c
  gRNA
aucugugauagccaauuccc

SEQ ID NO: 84563 - RNA, 20 nt, Artificial Sequence
  MKO10084563_B_Fam134c
  gRNA
ggcacauuuaaccugucaag

SEQ ID NO: 84564 - RNA, 20 nt, Artificial Sequence
  MKO10084564_B_Fam134c
  gRNA
cauaggcucgaucccacaga

SEQ ID NO: 84565 - RNA, 20 nt, Artificial Sequence
  MKO10084565_B_Fam135a
  gRNA
accuguugcguguaacaaac

SEQ ID NO: 84566 - RNA, 20 nt, Artificial Sequence
  MKO10084566_B_Fam135a
  gRNA
agcuuccguucaugaugcuc

SEQ ID NO: 84567 - RNA, 20 nt, Artificial Sequence
  MKO10084567_B_Fam135a
  gRNA
cuucaaaguuaaaaugcugu

SEQ ID NO: 84568 - RNA, 20 nt, Artificial Sequence
  MKO10084568_B_Fam135b
  gRNA
gguagaagaugcgcugagug

SEQ ID NO: 84569 - RNA, 20 nt, Artificial Sequence
  MKO10084569_B_Fam135b
  gRNA
cgauagaagcacucagccug

SEQ ID NO: 84570 - RNA, 20 nt, Artificial Sequence
  MKO10084570_B_Fam135b
  gRNA
gacugugcacagcacucucg

SEQ ID NO: 84571 - RNA, 20 nt, Artificial Sequence
  MKO10084571_B_Fam136a
  gRNA
uuguugggaugaggugcaug

SEQ ID NO: 84572 - RNA, 20 nt, Artificial Sequence
  MKO10084572_B_Fam136a
  gRNA
ggugcagcaacuccgagugc

SEQ ID NO: 84573 - RNA, 20 nt, Artificial Sequence
  MKO10084573_B_Fam136a
  gRNA
ugacaaagccaaagacucaa

SEQ ID NO: 84574 - RNA, 20 nt, Artificial Sequence
  MKO10084574_B_Fam13a
  gRNA
gucagcaauguuucaacaac

SEQ ID NO: 84575 - RNA, 20 nt, Artificial Sequence
  MKO10084575_B_Fam13a
  gRNA
gacucuuagaaagaaccauc

SEQ ID NO: 84576 - RNA, 20 nt, Artificial Sequence
  MKO10084576_B_Fam13a
  gRNA
aauacauaccucagauagaa

SEQ ID NO: 84577 - RNA, 20 nt, Artificial Sequence
  MKO10084577_B_Fam13b
  gRNA
cucccugagcccgucauacc

SEQ ID NO: 84578 - RNA, 20 nt, Artificial Sequence
  MKO10084578_B_Fam13b
  gRNA
guagguuaaugaacuuucug

SEQ ID NO: 84579 - RNA, 20 nt, Artificial Sequence
  MKO10084579_B_Fam13b
  gRNA
uuugaguucaauuacugagc

SEQ ID NO: 84580 - RNA, 20 nt, Artificial Sequence
  MKO10084580_B_Fam13c
  gRNA
cuccgcguuucugacgaccc

SEQ ID NO: 84581 - RNA, 20 nt, Artificial Sequence
  MKO10084581_B_Fam13c
  gRNA
uccgaccacucucggcucug

SEQ ID NO: 84582 - RNA, 20 nt, Artificial Sequence
  MKO10084582_B_Fam13c
  gRNA
ucggaaccacggagaaagcc

SEQ ID NO: 84583 - RNA, 20 nt, Artificial Sequence
  MKO10084583_B_Fam149a
  gRNA
ccgcuccguagacaaucccg

SEQ ID NO: 84584 - RNA, 20 nt, Artificial Sequence
  MKO10084584_B_Fam149a
  gRNA
cucgucccacccaccgauga

SEQ ID NO: 84585 - RNA, 20 nt, Artificial Sequence
  MKO10084585_B_Fam149a
  gRNA
cccauucgcugcauucagcc

SEQ ID NO: 84586 - RNA, 20 nt, Artificial Sequence
  MKO10084586_B_Fam149b
  gRNA
cccagugucaguugauguaa

SEQ ID NO: 84587 - RNA, 20 nt, Artificial Sequence
  MKO10084587_B_Fam149b
  gRNA
gaaaugucauccagucgcuc

SEQ ID NO: 84588 - RNA, 20 nt, Artificial Sequence
  MKO10084588_B_Fam149b
  gRNA
ccacccccuuccagagcgac

SEQ ID NO: 84589 - RNA, 20 nt, Artificial Sequence
  MKO10084589_B_Fam150a
  gRNA
cacgcgcugccaagcuucuc

SEQ ID NO: 84590 - RNA, 20 nt, Artificial Sequence
  MKO10084590_B_Fam150a
  gRNA
uccuaggucugggagcauag

SEQ ID NO: 84591 - RNA, 20 nt, Artificial Sequence
  MKO10084591_B_Fam150a
  gRNA
uccacuaugcucccagaccu

SEQ ID NO: 84592 - RNA, 20 nt, Artificial Sequence
  MKO10084592_B_Fam150b
  gRNA
agauuguuccucgagaucua

SEQ ID NO: 84593 - RNA, 20 nt, Artificial Sequence
  MKO10084593_B_Fam150b
  gRNA
uccuucauccuuagaucucg

SEQ ID NO: 84594 - RNA, 20 nt, Artificial Sequence
  MKO10084594_B_Fam150b
  gRNA
ggcggucagucccaugugca

SEQ ID NO: 84595 - RNA, 20 nt, Artificial Sequence
  MKO10084595_B_Fam151a
  gRNA
acauaaagagugguaaagcc

SEQ ID NO: 84596 - RNA, 20 nt, Artificial Sequence
  MKO10084596_B_Fam151a
  gRNA
ccuccuucggcagcugacug

SEQ ID NO: 84597 - RNA, 20 nt, Artificial Sequence
  MKO10084597_B_Fam151a
  gRNA
cgugucaugacagcucucac

SEQ ID NO: 84598 - RNA, 20 nt, Artificial Sequence
  MKO10084598_B_Fam151b
  gRNA
agucguguccucaguugcuc

SEQ ID NO: 84599 - RNA, 20 nt, Artificial Sequence
  MKO10084599_B_Fam151b
  gRNA
gcaucaaguuggauuucaag

SEQ ID NO: 84600 - RNA, 20 nt, Artificial Sequence
  MKO10084600_B_Fam151b
  gRNA
auuaaugccgauauucuucc

SEQ ID NO: 84601 - RNA, 20 nt, Artificial Sequence
  MKO10084601_B_Fam154a
  gRNA
uaccuuacccgcaggagcac

SEQ ID NO: 84602 - RNA, 20 nt, Artificial Sequence
  MKO10084602_B_Fam154a
  gRNA
uguuccgagucaagagacua

SEQ ID NO: 84603 - RNA, 20 nt, Artificial Sequence
  MKO10084603_B_Fam154a
  gRNA
cugauagaucggauaauucu

SEQ ID NO: 84604 - RNA, 20 nt, Artificial Sequence
  MKO10084604_B_Fam154b
  gRNA
gacagguuaccuuuauaagu

SEQ ID NO: 84605 - RNA, 20 nt, Artificial Sequence
  MKO10084605_B_Fam154b
  gRNA
uacagccuuugauaaaaguc

SEQ ID NO: 84606 - RNA, 20 nt, Artificial Sequence
  MKO10084606_B_Fam154b
  gRNA
cugugccagauuugcaccug

SEQ ID NO: 84607 - RNA, 20 nt, Artificial Sequence
  MKO10084607_B_Fam155a
  gRNA
ggguggccuccccacgcucg

SEQ ID NO: 84608 - RNA, 20 nt, Artificial Sequence
  MKO10084608_B_Fam155a
  gRNA
gacaaugacgaagucauuua

SEQ ID NO: 84609 - RNA, 20 nt, Artificial Sequence
  MKO10084609_B_Fam155a
  gRNA
guaaaugacuucgucauugu

SEQ ID NO: 84610 - RNA, 20 nt, Artificial Sequence
  MKO10084610_B_Fam159a
  gRNA
ugccggggagagcuuacccc

SEQ ID NO: 84611 - RNA, 20 nt, Artificial Sequence
  MKO10084611_B_Fam159a
  gRNA
guggggacagagaucucguc

SEQ ID NO: 84612 - RNA, 20 nt, Artificial Sequence
  MKO10084612_B_Fam159a
  gRNA
gaggcuuugagcugaugaac

SEQ ID NO: 84613 - RNA, 20 nt, Artificial Sequence
  MKO10084613_B_Fam159b
  gRNA
gagacaucuucuacccuaga

SEQ ID NO: 84614 - RNA, 20 nt, Artificial Sequence
  MKO10084614_B_Fam159b
  gRNA
uugaauuugauacugcauug

SEQ ID NO: 84615 - RNA, 20 nt, Artificial Sequence
  MKO10084615_B_Fam159b
  gRNA
cccaucgucagcuucauaga

SEQ ID NO: 84616 - RNA, 20 nt, Artificial Sequence
  MKO10084616_B_Fam160a1
  gRNA
uuggucgcaggugacggugg

SEQ ID NO: 84617 - RNA, 20 nt, Artificial Sequence
  MKO10084617_B_Fam160a1
  gRNA
gcgaguucaugaacugcacg

SEQ ID NO: 84618 - RNA, 20 nt, Artificial Sequence
  MKO10084618_B_Fam160a1
  gRNA
uccgaaucaggugcuugcaa

SEQ ID NO: 84619 - RNA, 20 nt, Artificial Sequence
  MKO10084619_B_Fam160a2
  gRNA
cucacugccucgaaagauug

SEQ ID NO: 84620 - RNA, 20 nt, Artificial Sequence
  MKO10084620_B_Fam160a2
  gRNA
aaccuuaccuugugcagggc

SEQ ID NO: 84621 - RNA, 20 nt, Artificial Sequence
  MKO10084621_B_Fam160a2
  gRNA
caucuagguagcucacccgc

SEQ ID NO: 84622 - RNA, 20 nt, Artificial Sequence
  MKO10084622_B_Fam160b1
  gRNA
ugagguccuugcaacgccaa

SEQ ID NO: 84623 - RNA, 20 nt, Artificial Sequence
  MKO10084623_B_Fam160b1
  gRNA
gggauguuugugucggucac

SEQ ID NO: 84624 - RNA, 20 nt, Artificial Sequence
  MKO10084624_B_Fam160b1
  gRNA
ggccuguguacguugaugug

SEQ ID NO: 84625 - RNA, 20 nt, Artificial Sequence
  MKO10084625_B_Fam160b2
  gRNA
gccuuuccaauguuccacga

SEQ ID NO: 84626 - RNA, 20 nt, Artificial Sequence
  MKO10084626_B_Fam160b2
  gRNA
agcgcuuaccucuagaauau

SEQ ID NO: 84627 - RNA, 20 nt, Artificial Sequence
  MKO10084627_B_Fam160b2
  gRNA
ccucugcucuaagauacagc

SEQ ID NO: 84628 - RNA, 20 nt, Artificial Sequence
  MKO10084628_B_Fam161a
  gRNA
caucccugaugaaccccgcc

SEQ ID NO: 84629 - RNA, 20 nt, Artificial Sequence
  MKO10084629_B_Fam161a
  gRNA
gugacucuuucaaacaacau

SEQ ID NO: 84630 - RNA, 20 nt, Artificial Sequence
  MKO10084630_B_Fam161a
  gRNA
ccuaaccaauaaacacaacc

SEQ ID NO: 84631 - RNA, 20 nt, Artificial Sequence
  MKO10084631_B_Fam161b
  gRNA
agauucuacuuccgacucca

SEQ ID NO: 84632 - RNA, 20 nt, Artificial Sequence
  MKO10084632_B_Fam161b
  gRNA
ucacgcagugucaugcggaa

SEQ ID NO: 84633 - RNA, 20 nt, Artificial Sequence
  MKO10084633_B_Fam161b
  gRNA
cagugaucugaacgacgcug

SEQ ID NO: 84634 - RNA, 20 nt, Artificial Sequence
  MKO10084634_B_Fam162a
  gRNA
uggauucugcaccaagccac

SEQ ID NO: 84635 - RNA, 20 nt, Artificial Sequence
  MKO10084635_B_Fam162a
  gRNA
gucuuuaacaagcuugaacc

SEQ ID NO: 84636 - RNA, 20 nt, Artificial Sequence
  MKO10084636_B_Fam162a
  gRNA
augcugcgaagaacaagcuc

SEQ ID NO: 84637 - RNA, 20 nt, Artificial Sequence
  MKO10084637_B_Fam162b
  gRNA
agccuagucgcagaacgcug

SEQ ID NO: 84638 - RNA, 20 nt, Artificial Sequence
  MKO10084638_B_Fam162b
  gRNA
ugccagauuccaacuuguua

SEQ ID NO: 84639 - RNA, 20 nt, Artificial Sequence
  MKO10084639_B_Fam162b
  gRNA
auccuuaacaaguuggaauc

SEQ ID NO: 84640 - RNA, 20 nt, Artificial Sequence
  MKO10084640_B_Fam163a
  gRNA
cgggcggaugacagcgggaa

SEQ ID NO: 84641 - RNA, 20 nt, Artificial Sequence
  MKO10084641_B_Fam163a
  gRNA
caggucaccggguaauucug

SEQ ID NO: 84642 - RNA, 20 nt, Artificial Sequence
  MKO10084642_B_Fam163a
  gRNA
cgccccuacacacuacaaag

SEQ ID NO: 84643 - RNA, 20 nt, Artificial Sequence
  MKO10084643_B_Fam163b
  gRNA
ucgcuguucugugcuacugu

SEQ ID NO: 84644 - RNA, 20 nt, Artificial Sequence
  MKO10084644_B_Fam163b
  gRNA
gguugggguugagcgccugc

SEQ ID NO: 84645 - RNA, 20 nt, Artificial Sequence
  MKO10084645_B_Fam163b
  gRNA
uuucagccaaaaguccccgc

SEQ ID NO: 84646 - RNA, 20 nt, Artificial Sequence
  MKO10084646_B_Fam166a
  gRNA
guuaugccggcuucgucccc

SEQ ID NO: 84647 - RNA, 20 nt, Artificial Sequence
  MKO10084647_B_Fam166a
  gRNA
uaccugagauggccuugcgu

SEQ ID NO: 84648 - RNA, 20 nt, Artificial Sequence
  MKO10084648_B_Fam166a
  gRNA
caugccggguaggguggaua

SEQ ID NO: 84649 - RNA, 20 nt, Artificial Sequence
  MKO10084649_B_Fam166b
  gRNA
cuaugagugaauuuacacga

SEQ ID NO: 84650 - RNA, 20 nt, Artificial Sequence
  MKO10084650_B_Fam166b
  gRNA
ucuuacccuggaauauaaug

SEQ ID NO: 84651 - RNA, 20 nt, Artificial Sequence
  MKO10084651_B_Fam166b
  gRNA
gcaaaaaugaacugugcccg

SEQ ID NO: 84652 - RNA, 20 nt, Artificial Sequence
  MKO10084652_B_Fam167a
  gRNA
cggcaucguugagcauccuc

SEQ ID NO: 84653 - RNA, 20 nt, Artificial Sequence
  MKO10084653_B_Fam167a
  gRNA
cucccaccuuccgcgagugc

SEQ ID NO: 84654 - RNA, 20 nt, Artificial Sequence
  MKO10084654_B_Fam167a
  gRNA
gugacgccaaugagcuugag

SEQ ID NO: 84655 - RNA, 20 nt, Artificial Sequence
  MKO10084655_B_Fam167b
  gRNA
gugagucccagaugccgcag

SEQ ID NO: 84656 - RNA, 20 nt, Artificial Sequence
  MKO10084656_B_Fam167b
  gRNA
ucgggucugcaguugaagcu

SEQ ID NO: 84657 - RNA, 20 nt, Artificial Sequence
  MKO10084657_B_Fam167b
  gRNA
cgacuggcucaggucuagcu

SEQ ID NO: 84658 - RNA, 20 nt, Artificial Sequence
  MKO10084658_B_Fam168a
  gRNA
guauuuacugaaagccgcag

SEQ ID NO: 84659 - RNA, 20 nt, Artificial Sequence
  MKO10084659_B_Fam168a
  gRNA
aacagcccuaguuaugcucc

SEQ ID NO: 84660 - RNA, 20 nt, Artificial Sequence
  MKO10084660_B_Fam168a
  gRNA
gcuggacaaccguggugugg

SEQ ID NO: 84661 - RNA, 20 nt, Artificial Sequence
  MKO10084661_B_Fam168b
  gRNA
gccauugggcugcaccaccg

SEQ ID NO: 84662 - RNA, 20 nt, Artificial Sequence
  MKO10084662_B_Fam168b
  gRNA
uucgcuccaggguacauguu

SEQ ID NO: 84663 - RNA, 20 nt, Artificial Sequence
  MKO10084663_B_Fam168b
  gRNA
ggagcaggguagacuguugc

SEQ ID NO: 84664 - RNA, 20 nt, Artificial Sequence
  MKO10084664_B_Fam169a
  gRNA
uagcauagucaguacugcua

SEQ ID NO: 84665 - RNA, 20 nt, Artificial Sequence
  MKO10084665_B_Fam169a
  gRNA
gcuguggcacuuuaccuugu

SEQ ID NO: 84666 - RNA, 20 nt, Artificial Sequence
  MKO10084666_B_Fam169a
  gRNA
ugcuucagccccucucuaga

SEQ ID NO: 84667 - RNA, 20 nt, Artificial Sequence
  MKO10084667_B_Fam169b
  gRNA
aucuuagcuugcuccuucgc

SEQ ID NO: 84668 - RNA, 20 nt, Artificial Sequence
  MKO10084668_B_Fam169b
  gRNA
agcccuccgcgucauccucc

SEQ ID NO: 84669 - RNA, 20 nt, Artificial Sequence
  MKO10084669_B_Fam169b
  gRNA
uccuacagaggcuuacccug

SEQ ID NO: 84670 - RNA, 20 nt, Artificial Sequence
  MKO10084670_B_Fam170a
  gRNA
ccaugaaacggcgacaaaag

SEQ ID NO: 84671 - RNA, 20 nt, Artificial Sequence
  MKO10084671_B_Fam170a
  gRNA
aaagcucauccaucguagua

SEQ ID NO: 84672 - RNA, 20 nt, Artificial Sequence
  MKO10084672_B_Fam170a
  gRNA
ucuucaaccgcgggagaccc

SEQ ID NO: 84673 - RNA, 20 nt, Artificial Sequence
  MKO10084673_B_Fam170b
  gRNA
ggccagcccagacgccgcag

SEQ ID NO: 84674 - RNA, 20 nt, Artificial Sequence
  MKO10084674_B_Fam170b
  gRNA
cugaguucaucaagcgucag

SEQ ID NO: 84675 - RNA, 20 nt, Artificial Sequence
  MKO10084675_B_Fam170b
  gRNA
acugauacucggaggacgac

SEQ ID NO: 84676 - RNA, 20 nt, Artificial Sequence
  MKO10084676_B_Fam171a1
  gRNA
aaaccgccaugcugcgacau

SEQ ID NO: 84677 - RNA, 20 nt, Artificial Sequence
  MKO10084677_B_Fam171a1
  gRNA
gaugucguccaaauagucuc

SEQ ID NO: 84678 - RNA, 20 nt, Artificial Sequence
  MKO10084678_B_Fam171a1
  gRNA
acgugccaaacucugccccg

SEQ ID NO: 84679 - RNA, 20 nt, Artificial Sequence
  MKO10084679_B_Fam171a2
  gRNA
acucuuggggucaaaccucc

SEQ ID NO: 84680 - RNA, 20 nt, Artificial Sequence
  MKO10084680_B_Fam171a2
  gRNA
cacauccuccuaggcucgcc

SEQ ID NO: 84681 - RNA, 20 nt, Artificial Sequence
  MKO10084681_B_Fam171a2
  gRNA
ucuacgcuggaacugcaccc

SEQ ID NO: 84682 - RNA, 20 nt, Artificial Sequence
  MKO10084682_B_Fam171b
  gRNA
uuauaagugacuccagucgc

SEQ ID NO: 84683 - RNA, 20 nt, Artificial Sequence
  MKO10084683_B_Fam171b
  gRNA
cgcaaagccaagcaaauaua

SEQ ID NO: 84684 - RNA, 20 nt, Artificial Sequence
  MKO10084684_B_Fam171b
  gRNA
uucauaucaaauguccaagc

SEQ ID NO: 84685 - RNA, 20 nt, Artificial Sequence
  MKO10084685_B_Fam172a
  gRNA
ucaaagccuuccaguguauc

SEQ ID NO: 84686 - RNA, 20 nt, Artificial Sequence
  MKO10084686_B_Fam172a
  gRNA
aagauauguuuaugagcucc

SEQ ID NO: 84687 - RNA, 20 nt, Artificial Sequence
  MKO10084687_B_Fam172a
  gRNA
uccaccuguguaagucuucu

SEQ ID NO: 84688 - RNA, 20 nt, Artificial Sequence
  MKO10084688_B_Fam173a
  gRNA
aacgugcugucacuguugcg

SEQ ID NO: 84689 - RNA, 20 nt, Artificial Sequence
  MKO10084689_B_Fam173a
  gRNA
ggaaucguccagauaccaca

SEQ ID NO: 84690 - RNA, 20 nt, Artificial Sequence
  MKO10084690_B_Fam173a
  gRNA
gacgauucccccuucccacc

SEQ ID NO: 84691 - RNA, 20 nt, Artificial Sequence
  MKO10084691_B_Fam173b
  gRNA
uggccgacccacuccugauu

SEQ ID NO: 84692 - RNA, 20 nt, Artificial Sequence
  MKO10084692_B_Fam173b
  gRNA
cgugccugcaacuucgaagc

SEQ ID NO: 84693 - RNA, 20 nt, Artificial Sequence
  MKO10084693_B_Fam173b
  gRNA
uucaauucauaccccaccgc

SEQ ID NO: 84694 - RNA, 20 nt, Artificial Sequence
  MKO10084694_B_Fam174a
  gRNA
accuuuagagcaagacgaug

SEQ ID NO: 84695 - RNA, 20 nt, Artificial Sequence
  MKO10084695_B_Fam174a
  gRNA
cgccccggacccgcucagag

SEQ ID NO: 84696 - RNA, 20 nt, Artificial Sequence
  MKO10084696_B_Fam174a
  gRNA
ucugaggcggacggccucga

SEQ ID NO: 84697 - RNA, 20 nt, Artificial Sequence
  MKO10084697_B_Fam174b
  gRNA
ucaucguccuccucauucag

SEQ ID NO: 84698 - RNA, 20 nt, Artificial Sequence
  MKO10084698_B_Fam174b
  gRNA
cuccaacagcagcgucgacg

SEQ ID NO: 84699 - RNA, 20 nt, Artificial Sequence
  MKO10084699_B_Fam174b
  gRNA
gucugcugcugcgcgucuuc

SEQ ID NO: 84700 - RNA, 20 nt, Artificial Sequence
  MKO10084700_B_Fam175a
  gRNA
uagcauuacugauucacaga

SEQ ID NO: 84701 - RNA, 20 nt, Artificial Sequence
  MKO10084701_B_Fam175a
  gRNA
aaacgaacaugcacugaaga

SEQ ID NO: 84702 - RNA, 20 nt, Artificial Sequence
  MKO10084702_B_Fam175a
  gRNA
cuauuacucaccuaaaaagc

SEQ ID NO: 84703 - RNA, 20 nt, Artificial Sequence
  MKO10084703_B_Fam175b
  gRNA
acagaguuucugcaaguaau

SEQ ID NO: 84704 - RNA, 20 nt, Artificial Sequence
  MKO10084704_B_Fam175b
  gRNA
agccuuguucacaacucuuc

SEQ ID NO: 84705 - RNA, 20 nt, Artificial Sequence
  MKO10084705_B_Fam175b
  gRNA
uaccugaagaguugugaaca

SEQ ID NO: 84706 - RNA, 20 nt, Artificial Sequence
  MKO10084706_B_Fam177a
  gRNA
uguugcagacaaaacuuacc

SEQ ID NO: 84707 - RNA, 20 nt, Artificial Sequence
  MKO10084707_B_Fam177a
  gRNA
gacacaccuccuucuucauc

SEQ ID NO: 84708 - RNA, 20 nt, Artificial Sequence
  MKO10084708_B_Fam177a
  gRNA
ucucuagugugugacuuucu

SEQ ID NO: 84709 - RNA, 20 nt, Artificial Sequence
  MKO10084709_B_Fam178a
  gRNA
cuguuucuaaugaaucguca

SEQ ID NO: 84710 - RNA, 20 nt, Artificial Sequence
  MKO10084710_B_Fam178a
  gRNA
aaagaucaucuucagacucg

SEQ ID NO: 84711 - RNA, 20 nt, Artificial Sequence
  MKO10084711_B_Fam178a
  gRNA
uucaagccagcugcaaaaca

SEQ ID NO: 84712 - RNA, 20 nt, Artificial Sequence
  MKO10084712_B_Fam178b
  gRNA
gguccuucuccaaguccuca

SEQ ID NO: 84713 - RNA, 20 nt, Artificial Sequence
  MKO10084713_B_Fam178b
  gRNA
ggagagcugcucgggcagcg

SEQ ID NO: 84714 - RNA, 20 nt, Artificial Sequence
  MKO10084714_B_Fam178b
  gRNA
guagcauugugagcucccag

SEQ ID NO: 84715 - RNA, 20 nt, Artificial Sequence
  MKO10084715_B_Fam179a
  gRNA
gccucccaccggauccagag

SEQ ID NO: 84716 - RNA, 20 nt, Artificial Sequence
  MKO10084716_B_Fam179a
  gRNA
gcaucggccuggguacccuc

SEQ ID NO: 84717 - RNA, 20 nt, Artificial Sequence
  MKO10084717_B_Fam179a
  gRNA
agucuucuugcucacgauga

SEQ ID NO: 84718 - RNA, 20 nt, Artificial Sequence
  MKO10084718_B_Fam179b
  gRNA
gaacgaacuucuucauacuc

SEQ ID NO: 84719 - RNA, 20 nt, Artificial Sequence
  MKO10084719_B_Fam179b
  gRNA
ccuugagagggcuuuaauuu

SEQ ID NO: 84720 - RNA, 20 nt, Artificial Sequence
  MKO10084720_B_Fam179b
  gRNA
cagcuuggauugucacagau

SEQ ID NO: 84721 - RNA, 20 nt, Artificial Sequence
  MKO10084721_B_Fam180a
  gRNA
acaaggaccucuuuggccga

SEQ ID NO: 84722 - RNA, 20 nt, Artificial Sequence
  MKO10084722_B_Fam180a
  gRNA
gucugcaggacuggauucaa

SEQ ID NO: 84723 - RNA, 20 nt, Artificial Sequence
  MKO10084723_B_Fam180a
  gRNA
gcugguauucuccagcaccc

SEQ ID NO: 84724 - RNA, 20 nt, Artificial Sequence
  MKO10084724_B_Fam181a
  gRNA
aacuacgggucuguacacuu

SEQ ID NO: 84725 - RNA, 20 nt, Artificial Sequence
  MKO10084725_B_Fam181a
  gRNA
gacagcugcccgccucguuc

SEQ ID NO: 84726 - RNA, 20 nt, Artificial Sequence
  MKO10084726_B_Fam181a
  gRNA
ccucccuaaagggggucccc

SEQ ID NO: 84727 - RNA, 20 nt, Artificial Sequence
  MKO10084727_B_Fam181b
  gRNA
cgagcagacagcgccucgcc

SEQ ID NO: 84728 - RNA, 20 nt, Artificial Sequence
  MKO10084728_B_Fam181b
  gRNA
ggcggcggcaacgcacaauc

SEQ ID NO: 84729 - RNA, 20 nt, Artificial Sequence
  MKO10084729_B_Fam181b
  gRNA
agaggcugggguaaaccgcg

SEQ ID NO: 84730 - RNA, 20 nt, Artificial Sequence
  MKO10084730_B_Fam183b
  gRNA
ggccagcucacccuugcgca

SEQ ID NO: 84731 - RNA, 20 nt, Artificial Sequence
  MKO10084731_B_Fam183b
  gRNA
cagaccgaagcccaagaaau

SEQ ID NO: 84732 - RNA, 20 nt, Artificial Sequence
  MKO10084732_B_Fam183b
  gRNA
uucuaguucacacaauuacc

SEQ ID NO: 84733 - RNA, 20 nt, Artificial Sequence
  MKO10084733_B_Fam184a
  gRNA
uaagaaccugcaaaaucgau

SEQ ID NO: 84734 - RNA, 20 nt, Artificial Sequence
  MKO10084734_B_Fam184a
  gRNA
agagguggcucaguuaaacg

SEQ ID NO: 84735 - RNA, 20 nt, Artificial Sequence
  MKO10084735_B_Fam184a
  gRNA
cuugcucuugcaaucgcucc

SEQ ID NO: 84736 - RNA, 20 nt, Artificial Sequence
  MKO10084736_B_Fam184b
  gRNA
aguuggcuauugccaaagac

SEQ ID NO: 84737 - RNA, 20 nt, Artificial Sequence
  MKO10084737_B_Fam184b
  gRNA
gcacaccgacuucauuucca

SEQ ID NO: 84738 - RNA, 20 nt, Artificial Sequence
  MKO10084738_B_Fam184b
  gRNA
ccuggggaaaagagaugacc

SEQ ID NO: 84739 - RNA, 20 nt, Artificial Sequence
  MKO10084739_B_Fam185a
  gRNA
uaucaucuuacaaagcaaga

SEQ ID NO: 84740 - RNA, 20 nt, Artificial Sequence
  MKO10084740_B_Fam185a
  gRNA
aaguugcauguucaaaccaa

SEQ ID NO: 84741 - RNA, 20 nt, Artificial Sequence
  MKO10084741_B_Fam185a
  gRNA
auugcacuaggaaauguuca

SEQ ID NO: 84742 - RNA, 20 nt, Artificial Sequence
  MKO10084742_B_Fam186b
  gRNA
ucacuucgauccauucgucu

SEQ ID NO: 84743 - RNA, 20 nt, Artificial Sequence
  MKO10084743_B_Fam186b
  gRNA
cugugccaucaaccgcuucc

SEQ ID NO: 84744 - RNA, 20 nt, Artificial Sequence
  MKO10084744_B_Fam186b
  gRNA
gguaacucuuguuugucgaa

SEQ ID NO: 84745 - RNA, 20 nt, Artificial Sequence
  MKO10084745_B_Fam187a
  gRNA
cguggagaacaguggcgcuu

SEQ ID NO: 84746 - RNA, 20 nt, Artificial Sequence
  MKO10084746_B_Fam187a
  gRNA
gaccgagucuuaauguagcg

SEQ ID NO: 84747 - RNA, 20 nt, Artificial Sequence
  MKO10084747_B_Fam187a
  gRNA
gcugccuacgcgaacgugag

SEQ ID NO: 84748 - RNA, 20 nt, Artificial Sequence
  MKO10084748_B_Fam187b
  gRNA
gucucucagugggguugaac

SEQ ID NO: 84749 - RNA, 20 nt, Artificial Sequence
  MKO10084749_B_Fam187b
  gRNA
ggucuccguggcggugucac

SEQ ID NO: 84750 - RNA, 20 nt, Artificial Sequence
  MKO10084750_B_Fam187b
  gRNA
caacgguuacaaucuugcca

SEQ ID NO: 84751 - RNA, 20 nt, Artificial Sequence
  MKO10084751_B_Fam188a
  gRNA
ggacccccgaggaagcggcu

SEQ ID NO: 84752 - RNA, 20 nt, Artificial Sequence
  MKO10084752_B_Fam188a
  gRNA
gacaggugcaauaacagcac

SEQ ID NO: 84753 - RNA, 20 nt, Artificial Sequence
  MKO10084753_B_Fam188a
  gRNA
ucuccuccgagaagucgucc

SEQ ID NO: 84754 - RNA, 20 nt, Artificial Sequence
  MKO10084754_B_Fam188b
  gRNA
uccgcaaacgcucucugaga

SEQ ID NO: 84755 - RNA, 20 nt, Artificial Sequence
  MKO10084755_B_Fam188b
  gRNA
cggacaucauggucagaagc

SEQ ID NO: 84756 - RNA, 20 nt, Artificial Sequence
  MKO10084756_B_Fam188b
  gRNA
ucuccgcaaaguucugcauc

SEQ ID NO: 84757 - RNA, 20 nt, Artificial Sequence
  MKO10084757_B_Fam189a1
  gRNA
cagcucgucagcucccucga

SEQ ID NO: 84758 - RNA, 20 nt, Artificial Sequence
  MKO10084758_B_Fam189a1
  gRNA
ucaccaacuggcagccuucg

SEQ ID NO: 84759 - RNA, 20 nt, Artificial Sequence
  MKO10084759_B_Fam189a1
  gRNA
cuccaccauugugugugccu

SEQ ID NO: 84760 - RNA, 20 nt, Artificial Sequence
  MKO10084760_B_Fam189a2
  gRNA
caaagaucuggagguagcgc

SEQ ID NO: 84761 - RNA, 20 nt, Artificial Sequence
  MKO10084761_B_Fam189a2
  gRNA
gccaucauaccuuaagcaga

SEQ ID NO: 84762 - RNA, 20 nt, Artificial Sequence
  MKO10084762_B_Fam189a2
  gRNA
uuggauugacgacuuggaaa

SEQ ID NO: 84763 - RNA, 20 nt, Artificial Sequence
  MKO10084763_B_Fam189b
  gRNA
cuucaccuugagggccccuc

SEQ ID NO: 84764 - RNA, 20 nt, Artificial Sequence
  MKO10084764_B_Fam189b
  gRNA
agccagcugagcauucuuac

SEQ ID NO: 84765 - RNA, 20 nt, Artificial Sequence
  MKO10084765_B_Fam189b
  gRNA
ggacuuccgagagugcucca

SEQ ID NO: 84766 - RNA, 20 nt, Artificial Sequence
  MKO10084766_B_Fam192a
  gRNA
agaccccgacccagaugaca

SEQ ID NO: 84767 - RNA, 20 nt, Artificial Sequence
  MKO10084767_B_Fam192a
  gRNA
caggagcugugaaacauaag

SEQ ID NO: 84768 - RNA, 20 nt, Artificial Sequence
  MKO10084768_B_Fam192a
  gRNA
aacucacaguaaucucaaca

SEQ ID NO: 84769 - RNA, 20 nt, Artificial Sequence
  MKO10084769_B_Fam193a
  gRNA
aggacaccacccuaccccgc

SEQ ID NO: 84770 - RNA, 20 nt, Artificial Sequence
  MKO10084770_B_Fam193a
  gRNA
aguuaagacugcgagcaaau

SEQ ID NO: 84771 - RNA, 20 nt, Artificial Sequence
  MKO10084771_B_Fam193a
  gRNA
cguggugccuagcccugaug

SEQ ID NO: 84772 - RNA, 20 nt, Artificial Sequence
  MKO10084772_B_Fam193b
  gRNA
aauuugugccccuugcaccc

SEQ ID NO: 84773 - RNA, 20 nt, Artificial Sequence
  MKO10084773_B_Fam193b
  gRNA
uggguaggacgccgagcuga

SEQ ID NO: 84774 - RNA, 20 nt, Artificial Sequence
  MKO10084774_B_Fam193b
  gRNA
uggcugcaccccgagagugg

SEQ ID NO: 84775 - RNA, 20 nt, Artificial Sequence
  MKO10084775_B_Fam194a
  gRNA
ugaacucuuucauacaaacu

SEQ ID NO: 84776 - RNA, 20 nt, Artificial Sequence
  MKO10084776_B_Fam194a
  gRNA
cucacauaaaaugcuuagcu

SEQ ID NO: 84777 - RNA, 20 nt, Artificial Sequence
  MKO10084777_B_Fam194a
  gRNA
uacaaacagaagaugaaagu

SEQ ID NO: 84778 - RNA, 20 nt, Artificial Sequence
  MKO10084778_B_Fam195a
  gRNA
ucuuggguccccucgaggga

SEQ ID NO: 84779 - RNA, 20 nt, Artificial Sequence
  MKO10084779_B_Fam195a
  gRNA
cgugggccacucucaucggc

SEQ ID NO: 84780 - RNA, 20 nt, Artificial Sequence
  MKO10084780_B_Fam195a
  gRNA
ggcggcccugccgaugagag

SEQ ID NO: 84781 - RNA, 20 nt, Artificial Sequence
  MKO10084781_B_Fam195b
  gRNA
aaugugcgcuucauuuauga

SEQ ID NO: 84782 - RNA, 20 nt, Artificial Sequence
  MKO10084782_B_Fam195b
  gRNA
gucucgcucaacacccugcc

SEQ ID NO: 84783 - RNA, 20 nt, Artificial Sequence
  MKO10084783_B_Fam195b
  gRNA
gugccuaguggaggaguaug

SEQ ID NO: 84784 - RNA, 20 nt, Artificial Sequence
  MKO10084784_B_Fam196a
  gRNA
augaccugaguuuccucgac

SEQ ID NO: 84785 - RNA, 20 nt, Artificial Sequence
  MKO10084785_B_Fam196a
  gRNA
gagaaaacugcacccugucg

SEQ ID NO: 84786 - RNA, 20 nt, Artificial Sequence
  MKO10084786_B_Fam196a
  gRNA
uaucuuguaggcuuucauau

SEQ ID NO: 84787 - RNA, 20 nt, Artificial Sequence
  MKO10084787_B_Fam196b
  gRNA
ccgccguaaguccuguuucu

SEQ ID NO: 84788 - RNA, 20 nt, Artificial Sequence
  MKO10084788_B_Fam196b
  gRNA
acacagcaugcaucauauac

SEQ ID NO: 84789 - RNA, 20 nt, Artificial Sequence
  MKO10084789_B_Fam196b
  gRNA
ccaguguagaguaugauuuc

SEQ ID NO: 84790 - RNA, 20 nt, Artificial Sequence
  MKO10084790_B_Fam198a
  gRNA
ucuauauacaccaagcgaga

SEQ ID NO: 84791 - RNA, 20 nt, Artificial Sequence
  MKO10084791_B_Fam198a
  gRNA
caagcucaacuuucggcugc

SEQ ID NO: 84792 - RNA, 20 nt, Artificial Sequence
  MKO10084792_B_Fam198a
  gRNA
agccacagcaguagcgaucc

SEQ ID NO: 84793 - RNA, 20 nt, Artificial Sequence
  MKO10084793_B_Fam198b
  gRNA
caaccgcugauaaguucccc

SEQ ID NO: 84794 - RNA, 20 nt, Artificial Sequence
  MKO10084794_B_Fam198b
  gRNA
agccccgugugcguugaugu

SEQ ID NO: 84795 - RNA, 20 nt, Artificial Sequence
  MKO10084795_B_Fam198b
  gRNA
agcuuaucgacgugauagag

SEQ ID NO: 84796 - RNA, 20 nt, Artificial Sequence
  MKO10084796_B_Fam199x
  gRNA
gccuucgucagcggccuaca

SEQ ID NO: 84797 - RNA, 20 nt, Artificial Sequence
  MKO10084797_B_Fam199x
  gRNA
ugcgaugacaaaugaugagc

SEQ ID NO: 84798 - RNA, 20 nt, Artificial Sequence
  MKO10084798_B_Fam199x
  gRNA
caaggugaacuuggaauacu

SEQ ID NO: 84799 - RNA, 20 nt, Artificial Sequence
  MKO10084799_B_Fam19a1
  gRNA
ccaccauuucccaauuacua

SEQ ID NO: 84800 - RNA, 20 nt, Artificial Sequence
  MKO10084800_B_Fam19a1
  gRNA
aagacacucccugacaauuc

SEQ ID NO: 84801 - RNA, 20 nt, Artificial Sequence
  MKO10084801_B_Fam19a1
  gRNA
caauggucucugcaaugucc

SEQ ID NO: 84802 - RNA, 20 nt, Artificial Sequence
  MKO10084802_B_Fam19a2
  gRNA
aaaguccuuccagaucgcaa

SEQ ID NO: 84803 - RNA, 20 nt, Artificial Sequence
  MKO10084803_B_Fam19a2
  gRNA
uccagcgccaaccaucacaa

SEQ ID NO: 84804 - RNA, 20 nt, Artificial Sequence
  MKO10084804_B_Fam19a2
  gRNA
agcaggagcacuugaccguu

SEQ ID NO: 84805 - RNA, 20 nt, Artificial Sequence
  MKO10084805_B_Fam19a3
  gRNA
ugcuugcacugugccucgcc

SEQ ID NO: 84806 - RNA, 20 nt, Artificial Sequence
  MKO10084806_B_Fam19a3
  gRNA
ccuccaucguccugcagaag

SEQ ID NO: 84807 - RNA, 20 nt, Artificial Sequence
  MKO10084807_B_Fam19a3
  gRNA
ugcugcagcuccacccugac

SEQ ID NO: 84808 - RNA, 20 nt, Artificial Sequence
  MKO10084808_B_Fam19a4
  gRNA
gugccacaugaauccuugcu

SEQ ID NO: 84809 - RNA, 20 nt, Artificial Sequence
  MKO10084809_B_Fam19a4
  gRNA
ccgccucgagccagcaccuc

SEQ ID NO: 84810 - RNA, 20 nt, Artificial Sequence
  MKO10084810_B_Fam19a4
  gRNA
gacuuuauugccacugcuac

SEQ ID NO: 84811 - RNA, 20 nt, Artificial Sequence
  MKO10084811_B_Fam19a5
  gRNA
cucuuaccguccacacaagc

SEQ ID NO: 84812 - RNA, 20 nt, Artificial Sequence
  MKO10084812_B_Fam19a5
  gRNA
cuccgcgaugcagcuccuga

SEQ ID NO: 84813 - RNA, 20 nt, Artificial Sequence
  MKO10084813_B_Fam19a5
  gRNA
gcugugacuuguuaaucaac

SEQ ID NO: 84814 - RNA, 20 nt, Artificial Sequence
  MKO10084814_B_Fam203a
  gRNA
gccagagcccgaugugcgga

SEQ ID NO: 84815 - RNA, 20 nt, Artificial Sequence
  MKO10084815_B_Fam203a
  gRNA
uccggcucccguugcuuguc

SEQ ID NO: 84816 - RNA, 20 nt, Artificial Sequence
  MKO10084816_B_Fam203a
  gRNA
aaaaggggagaaugucgacu

SEQ ID NO: 84817 - RNA, 20 nt, Artificial Sequence
  MKO10084817_B_Fam207a
  gRNA
uaggcgaccugcacccccug

SEQ ID NO: 84818 - RNA, 20 nt, Artificial Sequence
  MKO10084818_B_Fam207a
  gRNA
gccgaaugaccacaguacag

SEQ ID NO: 84819 - RNA, 20 nt, Artificial Sequence
  MKO10084819_B_Fam207a
  gRNA
uacucuguaaccaucgcuca

SEQ ID NO: 84820 - RNA, 20 nt, Artificial Sequence
  MKO10084820_B_Fam209
  gRNA
ucaccaauuccaucucgagc

SEQ ID NO: 84821 - RNA, 20 nt, Artificial Sequence
  MKO10084821_B_Fam209
  gRNA
ugccuugcggcggacacuuc

SEQ ID NO: 84822 - RNA, 20 nt, Artificial Sequence
  MKO10084822_B_Fam209
  gRNA
ccgccgcaaggcaccuuccc

SEQ ID NO: 84823 - RNA, 20 nt, Artificial Sequence
  MKO10084823_B_Fam20a
  gRNA
aagccauguucaaacccaug

SEQ ID NO: 84824 - RNA, 20 nt, Artificial Sequence
  MKO10084824_B_Fam20a
  gRNA
cucacaguugugaaacccag

SEQ ID NO: 84825 - RNA, 20 nt, Artificial Sequence
  MKO10084825_B_Fam20a
  gRNA
ugagaucgcagcuuuccacc

SEQ ID NO: 84826 - RNA, 20 nt, Artificial Sequence
  MKO10084826_B_Fam20b
  gRNA
uggcggccuuccauuuggac

SEQ ID NO: 84827 - RNA, 20 nt, Artificial Sequence
  MKO10084827_B_Fam20b
  gRNA
ggguuuccgccgcgcucccu

SEQ ID NO: 84828 - RNA, 20 nt, Artificial Sequence
  MKO10084828_B_Fam20b
  gRNA
ugucugucauaaccagcgua

SEQ ID NO: 84829 - RNA, 20 nt, Artificial Sequence
  MKO10084829_B_Fam20c
  gRNA
ucucagaagaucaccagcgu

SEQ ID NO: 84830 - RNA, 20 nt, Artificial Sequence
  MKO10084830_B_Fam20c
  gRNA
auagcgccugcccguaauuc

SEQ ID NO: 84831 - RNA, 20 nt, Artificial Sequence
  MKO10084831_B_Fam20c
  gRNA
ccuccugcagccaugaaguc

SEQ ID NO: 84832 - RNA, 20 nt, Artificial Sequence
  MKO10084832_B_Fam210a
  gRNA
ugcccgcuacaccgugaccu

SEQ ID NO: 84833 - RNA, 20 nt, Artificial Sequence
  MKO10084833_B_Fam210a
  gRNA
acccaccuuaaacauggcgu

SEQ ID NO: 84834 - RNA, 20 nt, Artificial Sequence
  MKO10084834_B_Fam210a
  gRNA
aggauguccacgauacuguc

SEQ ID NO: 84835 - RNA, 20 nt, Artificial Sequence
  MKO10084835_B_Fam210b
  gRNA
guuuaaagaguccaacgcug

SEQ ID NO: 84836 - RNA, 20 nt, Artificial Sequence
  MKO10084836_B_Fam210b
  gRNA
gugcgcagcagucgggcguc

SEQ ID NO: 84837 - RNA, 20 nt, Artificial Sequence
  MKO10084837_B_Fam210b
  gRNA
aaugcacauugggaucuccc

SEQ ID NO: 84838 - RNA, 20 nt, Artificial Sequence
  MKO10084838_B_Fam211a
  gRNA
accgaucagcaggacccuau

SEQ ID NO: 84839 - RNA, 20 nt, Artificial Sequence
  MKO10084839_B_Fam211a
  gRNA
agccuuaaggcccuccuauc

SEQ ID NO: 84840 - RNA, 20 nt, Artificial Sequence
  MKO10084840_B_Fam211a
  gRNA
agcgguacagcacaucaucc

SEQ ID NO: 84841 - RNA, 20 nt, Artificial Sequence
  MKO10084841_B_Fam211b
  gRNA
cugccgacagaucuuguccg

SEQ ID NO: 84842 - RNA, 20 nt, Artificial Sequence
  MKO10084842_B_Fam211b
  gRNA
uucgcuuggagugcggagug

SEQ ID NO: 84843 - RNA, 20 nt, Artificial Sequence
  MKO10084843_B_Fam211b
  gRNA
cacugccaaguuccccgugu

SEQ ID NO: 84844 - RNA, 20 nt, Artificial Sequence
  MKO10084844_B_Fam212a
  gRNA
gcaccagcaugcacagcgcu

SEQ ID NO: 84845 - RNA, 20 nt, Artificial Sequence
  MKO10084845_B_Fam212a
  gRNA
ucucugagcagcuacggcgu

SEQ ID NO: 84846 - RNA, 20 nt, Artificial Sequence
  MKO10084846_B_Fam212a
  gRNA
gcaaaucgugagaugucugc

SEQ ID NO: 84847 - RNA, 20 nt, Artificial Sequence
  MKO10084847_B_Fam212b
  gRNA
gcgaaugacaaaggagagca

SEQ ID NO: 84848 - RNA, 20 nt, Artificial Sequence
  MKO10084848_B_Fam212b
  gRNA
aaucuagccaguuacccacc

SEQ ID NO: 84849 - RNA, 20 nt, Artificial Sequence
  MKO10084849_B_Fam212b
  gRNA
ccaaugccgucugcacuugu

SEQ ID NO: 84850 - RNA, 20 nt, Artificial Sequence
  MKO10084850_B_Fam213a
  gRNA
gacaccuagcucauccaacu

SEQ ID NO: 84851 - RNA, 20 nt, Artificial Sequence
  MKO10084851_B_Fam213a
  gRNA
aagcuacagacuccagcguc

SEQ ID NO: 84852 - RNA, 20 nt, Artificial Sequence
  MKO10084852_B_Fam213a
  gRNA
agugaacccacucucuguuc

SEQ ID NO: 84853 - RNA, 20 nt, Artificial Sequence
  MKO10084853_B_Fam213b
  gRNA
uguucgugauguagccucca

SEQ ID NO: 84854 - RNA, 20 nt, Artificial Sequence
  MKO10084854_B_Fam213b
  gRNA
ucuggugaccugcugcaaag

SEQ ID NO: 84855 - RNA, 20 nt, Artificial Sequence
  MKO10084855_B_Fam213b
  gRNA
agauuugcuugcucucauca

SEQ ID NO: 84856 - RNA, 20 nt, Artificial Sequence
  MKO10084856_B_Fam214a
  gRNA
gugccuucucuucgaugaag

SEQ ID NO: 84857 - RNA, 20 nt, Artificial Sequence
  MKO10084857_B_Fam214a
  gRNA
acaacucacugucggggaac

SEQ ID NO: 84858 - RNA, 20 nt, Artificial Sequence
  MKO10084858_B_Fam214a
  gRNA
acaugaaugcagcgacaagc

SEQ ID NO: 84859 - RNA, 20 nt, Artificial Sequence
  MKO10084859_B_Fam214b
  gRNA
agucguggaccugacuccuc

SEQ ID NO: 84860 - RNA, 20 nt, Artificial Sequence
  MKO10084860_B_Fam214b
  gRNA
guccggcugacagcaggggu

SEQ ID NO: 84861 - RNA, 20 nt, Artificial Sequence
  MKO10084861_B_Fam214b
  gRNA
gccuuucagccuccgcccca

SEQ ID NO: 84862 - RNA, 20 nt, Artificial Sequence
  MKO10084862_B_Fam216a
  gRNA
gugaguagcgagagcucaua

SEQ ID NO: 84863 - RNA, 20 nt, Artificial Sequence
  MKO10084863_B_Fam216a
  gRNA
ggugugcucacucaccacag

SEQ ID NO: 84864 - RNA, 20 nt, Artificial Sequence
  MKO10084864_B_Fam216a
  gRNA
cauguacugccucuucauca

SEQ ID NO: 84865 - RNA, 20 nt, Artificial Sequence
  MKO10084865_B_Fam216b
  gRNA
uucugacaggaccuaaauca

SEQ ID NO: 84866 - RNA, 20 nt, Artificial Sequence
  MKO10084866_B_Fam216b
  gRNA
gaauugucagcagccgcugc

SEQ ID NO: 84867 - RNA, 20 nt, Artificial Sequence
  MKO10084867_B_Fam216b
  gRNA
acccgcuacauucacagccu

SEQ ID NO: 84868 - RNA, 20 nt, Artificial Sequence
  MKO10084868_B_Fam217a
  gRNA
guagagccaucuggaaaauc

SEQ ID NO: 84869 - RNA, 20 nt, Artificial Sequence
  MKO10084869_B_Fam217a
  gRNA
caaagaguucuucugcaucc

SEQ ID NO: 84870 - RNA, 20 nt, Artificial Sequence
  MKO10084870_B_Fam217a
  gRNA
accuucucaucugaaaauga

SEQ ID NO: 84871 - RNA, 20 nt, Artificial Sequence
  MKO10084871_B_Fam217b
  gRNA
uugagcucuggaggcgugaa

SEQ ID NO: 84872 - RNA, 20 nt, Artificial Sequence
  MKO10084872_B_Fam217b
  gRNA
uugccguuggcuuccauugc

SEQ ID NO: 84873 - RNA, 20 nt, Artificial Sequence
  MKO10084873_B_Fam217b
  gRNA
ugaggcccugccucgggcca

SEQ ID NO: 84874 - RNA, 20 nt, Artificial Sequence
  MKO10084874_B_Fam219a
  gRNA
ucugugucaagagcuaccag

SEQ ID NO: 84875 - RNA, 20 nt, Artificial Sequence
  MKO10084875_B_Fam219a
  gRNA
ccucccgggcgucacagucu

SEQ ID NO: 84876 - RNA, 20 nt, Artificial Sequence
  MKO10084876_B_Fam219a
  gRNA
ucugagauagaggcugcggc

SEQ ID NO: 84877 - RNA, 20 nt, Artificial Sequence
  MKO10084877_B_Fam219b
  gRNA
accaugccaaggccguucug

SEQ ID NO: 84878 - RNA, 20 nt, Artificial Sequence
  MKO10084878_B_Fam219b
  gRNA
gcacucaccugucagagucg

SEQ ID NO: 84879 - RNA, 20 nt, Artificial Sequence
  MKO10084879_B_Fam219b
  gRNA
caggucagugaaguuuaaca

SEQ ID NO: 84880 - RNA, 20 nt, Artificial Sequence
  MKO10084880_B_Fam21
  gRNA
gcggguguacgaugaagaag

SEQ ID NO: 84881 - RNA, 20 nt, Artificial Sequence
  MKO10084881_B_Fam21
  gRNA
gagcuuugacccgaugagau

SEQ ID NO: 84882 - RNA, 20 nt, Artificial Sequence
  MKO10084882_B_Fam21
  gRNA
caucgggucaaagcucuuca

SEQ ID NO: 84883 - RNA, 20 nt, Artificial Sequence
  MKO10084883_B_Fam220a
  gRNA
agaggugaaccaccaagugc

SEQ ID NO: 84884 - RNA, 20 nt, Artificial Sequence
  MKO10084884_B_Fam220a
  gRNA
acacaccucagcucgccuuc

SEQ ID NO: 84885 - RNA, 20 nt, Artificial Sequence
  MKO10084885_B_Fam220a
  gRNA
aaacucucaaguucuucaga

SEQ ID NO: 84886 - RNA, 20 nt, Artificial Sequence
  MKO10084886_B_Fam221a
  gRNA
gagcggcugacguugccucc

SEQ ID NO: 84887 - RNA, 20 nt, Artificial Sequence
  MKO10084887_B_Fam221a
  gRNA
aaaccucccauugccgcaua

SEQ ID NO: 84888 - RNA, 20 nt, Artificial Sequence
  MKO10084888_B_Fam221a
  gRNA
aggcaacgucagccgcucca

SEQ ID NO: 84889 - RNA, 20 nt, Artificial Sequence
  MKO10084889_B_Fam221b
  gRNA
gaguguguuuacagcgacau

SEQ ID NO: 84890 - RNA, 20 nt, Artificial Sequence
  MKO10084890_B_Fam221b
  gRNA
caugagacguucuuugagac

SEQ ID NO: 84891 - RNA, 20 nt, Artificial Sequence
  MKO10084891_B_Fam221b
  gRNA
agaguuaccacggugccugc

SEQ ID NO: 84892 - RNA, 20 nt, Artificial Sequence
  MKO10084892_B_Fam222a
  gRNA
gaacccaccaggccaacacc

SEQ ID NO: 84893 - RNA, 20 nt, Artificial Sequence
  MKO10084893_B_Fam222a
  gRNA
guuggcuaccuucuccgcgu

SEQ ID NO: 84894 - RNA, 20 nt, Artificial Sequence
  MKO10084894_B_Fam222a
  gRNA
aggcccgagaguacgucucc

SEQ ID NO: 84895 - RNA, 20 nt, Artificial Sequence
  MKO10084895_B_Fam222b
  gRNA
gccaugcuagccugucuccc

SEQ ID NO: 84896 - RNA, 20 nt, Artificial Sequence
  MKO10084896_B_Fam222b
  gRNA
cuuagcauacgcguccaauu

SEQ ID NO: 84897 - RNA, 20 nt, Artificial Sequence
  MKO10084897_B_Fam222b
  gRNA
augagcagacugcgacuaau

SEQ ID NO: 84898 - RNA, 20 nt, Artificial Sequence
  MKO10084898_B_Fam227a
  gRNA
uuaccaaggugcugaucauc

SEQ ID NO: 84899 - RNA, 20 nt, Artificial Sequence
  MKO10084899_B_Fam227a
  gRNA
ggcaauugaagacuaugagu

SEQ ID NO: 84900 - RNA, 20 nt, Artificial Sequence
  MKO10084900_B_Fam227a
  gRNA
ccauaauccucugauucacc

SEQ ID NO: 84901 - RNA, 20 nt, Artificial Sequence
  MKO10084901_B_Fam227b
  gRNA
uuuccagcuuucagaucgaa

SEQ ID NO: 84902 - RNA, 20 nt, Artificial Sequence
  MKO10084902_B_Fam227b
  gRNA
uaaagggucauauacaaacc

SEQ ID NO: 84903 - RNA, 20 nt, Artificial Sequence
  MKO10084903_B_Fam227b
  gRNA
caaaugcuuuguagcguucc

SEQ ID NO: 84904 - RNA, 20 nt, Artificial Sequence
  MKO10084904_B_Fam228a
  gRNA
gcaaagcaccucugccaugu

SEQ ID NO: 84905 - RNA, 20 nt, Artificial Sequence
  MKO10084905_B_Fam228a
  gRNA
accaguuaccaacauggcag

SEQ ID NO: 84906 - RNA, 20 nt, Artificial Sequence
  MKO10084906_B_Fam228a
  gRNA
uagagaaaacuauguuguga

SEQ ID NO: 84907 - RNA, 20 nt, Artificial Sequence
  MKO10084907_B_Fam228b
  gRNA
ccugccuaccuucagaaaau

SEQ ID NO: 84908 - RNA, 20 nt, Artificial Sequence
  MKO10084908_B_Fam228b
  gRNA
aagagaugcuguauaaaaag

SEQ ID NO: 84909 - RNA, 20 nt, Artificial Sequence
  MKO10084909_B_Fam228b
  gRNA
uagagaaaauuauauuauga

SEQ ID NO: 84910 - RNA, 20 nt, Artificial Sequence
  MKO10084910_B_Fam229a
  gRNA
auggggaaucuucgacccug

SEQ ID NO: 84911 - RNA, 20 nt, Artificial Sequence
  MKO10084911_B_Fam229a
  gRNA
cgugcccaucgacgucuacc

SEQ ID NO: 84912 - RNA, 20 nt, Artificial Sequence
  MKO10084912_B_Fam229a
  gRNA
cgaagauuccccauugaggc

SEQ ID NO: 84913 - RNA, 20 nt, Artificial Sequence
  MKO10084913_B_Fam229b
  gRNA
aggcaacuccgaagaugccc

SEQ ID NO: 84914 - RNA, 20 nt, Artificial Sequence
  MKO10084914_B_Fam229b
  gRNA
uacaggaagcacuagagcuc

SEQ ID NO: 84915 - RNA, 20 nt, Artificial Sequence
  MKO10084915_B_Fam229b
  gRNA
cauuguugcauagacaguga

SEQ ID NO: 84916 - RNA, 20 nt, Artificial Sequence
  MKO10084916_B_Fam24a
  gRNA
caagacucacuucagggccu

SEQ ID NO: 84917 - RNA, 20 nt, Artificial Sequence
  MKO10084917_B_Fam24a
  gRNA
ugacgacuguagcaucuaua

SEQ ID NO: 84918 - RNA, 20 nt, Artificial Sequence
  MKO10084918_B_Fam24a
  gRNA
ucauuugugacacaauagca

SEQ ID NO: 84919 - RNA, 20 nt, Artificial Sequence
  MKO10084919_B_Fam25c
  gRNA
ucucuuuccaguucacgcag

SEQ ID NO: 84920 - RNA, 20 nt, Artificial Sequence
  MKO10084920_B_Fam25c
  gRNA
cacugaugcuguuacccaug

SEQ ID NO: 84921 - RNA, 20 nt, Artificial Sequence
  MKO10084921_B_Fam25c
  gRNA
agagguggugagcgaggugg

SEQ ID NO: 84922 - RNA, 20 nt, Artificial Sequence
  MKO10084922_B_Fam26d
  gRNA
caaagagcacucucucguug

SEQ ID NO: 84923 - RNA, 20 nt, Artificial Sequence
  MKO10084923_B_Fam26d
  gRNA
uucaguuguccgugucaagu

SEQ ID NO: 84924 - RNA, 20 nt, Artificial Sequence
  MKO10084924_B_Fam26d
  gRNA
gcugcagcagcaguacucgc

SEQ ID NO: 84925 - RNA, 20 nt, Artificial Sequence
  MKO10084925_B_Fam26e
  gRNA
uagcgaacgucucuucucgc

SEQ ID NO: 84926 - RNA, 20 nt, Artificial Sequence
  MKO10084926_B_Fam26e
  gRNA
uguagugcucacggucuuga

SEQ ID NO: 84927 - RNA, 20 nt, Artificial Sequence
  MKO10084927_B_Fam26e
  gRNA
gugcuaacaaguuaagugag

SEQ ID NO: 84928 - RNA, 20 nt, Artificial Sequence
  MKO10084928_B_Fam26f
  gRNA
uaguucgugaguguuaguca

SEQ ID NO: 84929 - RNA, 20 nt, Artificial Sequence
  MKO10084929_B_Fam26f
  gRNA
cugcaaugccacgcuaccgc

SEQ ID NO: 84930 - RNA, 20 nt, Artificial Sequence
  MKO10084930_B_Fam26f
  gRNA
gagaaagcaccgcaacgccc

SEQ ID NO: 84931 - RNA, 20 nt, Artificial Sequence
  MKO10084931_B_Fam32a
  gRNA
acaggacuucaaccgacacc

SEQ ID NO: 84932 - RNA, 20 nt, Artificial Sequence
  MKO10084932_B_Fam32a
  gRNA
ucaccuccacucucuguuug

SEQ ID NO: 84933 - RNA, 20 nt, Artificial Sequence
  MKO10084933_B_Fam32a
  gRNA
gcgccggcgugcgcuugucc

SEQ ID NO: 84934 - RNA, 20 nt, Artificial Sequence
  MKO10084934_B_Fam35a
  gRNA
uaaguccugaaguauaacau

SEQ ID NO: 84935 - RNA, 20 nt, Artificial Sequence
  MKO10084935_B_Fam35a
  gRNA
cucuugugucaucaucaaau

SEQ ID NO: 84936 - RNA, 20 nt, Artificial Sequence
  MKO10084936_B_Fam35a
  gRNA
aagaaaaguuguguuaaccg

SEQ ID NO: 84937 - RNA, 20 nt, Artificial Sequence
  MKO10084937_B_Fam3a
  gRNA
cgggcccaagaucugccucg

SEQ ID NO: 84938 - RNA, 20 nt, Artificial Sequence
  MKO10084938_B_Fam3a
  gRNA
ugagacccauaaugaugauu

SEQ ID NO: 84939 - RNA, 20 nt, Artificial Sequence
  MKO10084939_B_Fam3a
  gRNA
gguggacucaccauucacca

SEQ ID NO: 84940 - RNA, 20 nt, Artificial Sequence
  MKO10084940_B_Fam3b
  gRNA
guaugccaagaucugcuuug

SEQ ID NO: 84941 - RNA, 20 nt, Artificial Sequence
  MKO10084941_B_Fam3b
  gRNA
aaguacuuugauauguauga

SEQ ID NO: 84942 - RNA, 20 nt, Artificial Sequence
  MKO10084942_B_Fam3b
  gRNA
caggcuaauaggagagaaga

SEQ ID NO: 84943 - RNA, 20 nt, Artificial Sequence
  MKO10084943_B_Fam3c
  gRNA
gagaucccacacuuguaccu

SEQ ID NO: 84944 - RNA, 20 nt, Artificial Sequence
  MKO10084944_B_Fam3c
  gRNA
gugaagaauaaugucggaag

SEQ ID NO: 84945 - RNA, 20 nt, Artificial Sequence
  MKO10084945_B_Fam3c
  gRNA
gcaaguuuaggaaaucuauu

SEQ ID NO: 84946 - RNA, 20 nt, Artificial Sequence
  MKO10084946_B_Fam43a
  gRNA
ucuggcagcuuagcccgagu

SEQ ID NO: 84947 - RNA, 20 nt, Artificial Sequence
  MKO10084947_B_Fam43a
  gRNA
auccaggccuccgcccucga

SEQ ID NO: 84948 - RNA, 20 nt, Artificial Sequence
  MKO10084948_B_Fam43a
  gRNA
gcuuggacaccagcaccgcg

SEQ ID NO: 84949 - RNA, 20 nt, Artificial Sequence
  MKO10084949_B_Fam43b
  gRNA
gcacguggcgcgcaucgcuc

SEQ ID NO: 84950 - RNA, 20 nt, Artificial Sequence
  MKO10084950_B_Fam43b
  gRNA
gcuccgcgaccgcgcucgcc

SEQ ID NO: 84951 - RNA, 20 nt, Artificial Sequence
  MKO10084951_B_Fam43b
  gRNA
gccgcgcaucaccuacugcg

SEQ ID NO: 84952 - RNA, 20 nt, Artificial Sequence
  MKO10084952_B_Fam45a
  gRNA
cuucuccacccuuucgucuu

SEQ ID NO: 84953 - RNA, 20 nt, Artificial Sequence
  MKO10084953_B_Fam45a
  gRNA
gaccaucaaagucucuacua

SEQ ID NO: 84954 - RNA, 20 nt, Artificial Sequence
  MKO10084954_B_Fam45a
  gRNA
ccccaaaauagaagcugucc

SEQ ID NO: 84955 - RNA, 20 nt, Artificial Sequence
  MKO10084955_B_Fam46a
  gRNA
auagacacucucaccgauga

SEQ ID NO: 84956 - RNA, 20 nt, Artificial Sequence
  MKO10084956_B_Fam46a
  gRNA
agaugcaucagagauacuuu

SEQ ID NO: 84957 - RNA, 20 nt, Artificial Sequence
  MKO10084957_B_Fam46a
  gRNA
cggcggcccuuacauccccc

SEQ ID NO: 84958 - RNA, 20 nt, Artificial Sequence
  MKO10084958_B_Fam46b
  gRNA
gaaguugccucguccgugaa

SEQ ID NO: 84959 - RNA, 20 nt, Artificial Sequence
  MKO10084959_B_Fam46b
  gRNA
ccguuucuucaucgacuuuc

SEQ ID NO: 84960 - RNA, 20 nt, Artificial Sequence
  MKO10084960_B_Fam46b
  gRNA
gccuuccacccuacggugac

SEQ ID NO: 84961 - RNA, 20 nt, Artificial Sequence
  MKO10084961_B_Fam46c
  gRNA
cgcugaacucaaacugccgc

SEQ ID NO: 84962 - RNA, 20 nt, Artificial Sequence
  MKO10084962_B_Fam46c
  gRNA
caucgacuuccccgacaucc

SEQ ID NO: 84963 - RNA, 20 nt, Artificial Sequence
  MKO10084963_B_Fam46c
  gRNA
cguugucuuugaccaaaacg

SEQ ID NO: 84964 - RNA, 20 nt, Artificial Sequence
  MKO10084964_B_Fam46d
  gRNA
gcaaguuacguugucuguac

SEQ ID NO: 84965 - RNA, 20 nt, Artificial Sequence
  MKO10084965_B_Fam46d
  gRNA
cccagaugcuacauaauaac

SEQ ID NO: 84966 - RNA, 20 nt, Artificial Sequence
  MKO10084966_B_Fam46d
  gRNA
aaauugccccuuccaugaau

SEQ ID NO: 84967 - RNA, 20 nt, Artificial Sequence
  MKO10084967_B_Fam47c
  gRNA
cgaaugaucauaccuucacu

SEQ ID NO: 84968 - RNA, 20 nt, Artificial Sequence
  MKO10084968_B_Fam47c
  gRNA
auacuguauuuacgugaccc

SEQ ID NO: 84969 - RNA, 20 nt, Artificial Sequence
  MKO10084969_B_Fam47c
  gRNA
aaaacugacccagcguccuu

SEQ ID NO: 84970 - RNA, 20 nt, Artificial Sequence
  MKO10084970_B_Fam47e
  gRNA
gcauagccgaagccacgcaa

SEQ ID NO: 84971 - RNA, 20 nt, Artificial Sequence
  MKO10084971_B_Fam47e
  gRNA
uugcaucauccgugagcacc

SEQ ID NO: 84972 - RNA, 20 nt, Artificial Sequence
  MKO10084972_B_Fam47e
  gRNA
ucauucuaagcaggggcuac

SEQ ID NO: 84973 - RNA, 20 nt, Artificial Sequence
  MKO10084973_B_Fam49a
  gRNA
uacgaauucuccauccgucu

SEQ ID NO: 84974 - RNA, 20 nt, Artificial Sequence
  MKO10084974_B_Fam49a
  gRNA
aguauacucaccaagacgga

SEQ ID NO: 84975 - RNA, 20 nt, Artificial Sequence
  MKO10084975_B_Fam49a
  gRNA
ccuggaggacagcacugauc

SEQ ID NO: 84976 - RNA, 20 nt, Artificial Sequence
  MKO10084976_B_Fam49b
  gRNA
cgaguauggcguacuaguca

SEQ ID NO: 84977 - RNA, 20 nt, Artificial Sequence
  MKO10084977_B_Fam49b
  gRNA
ccaacaucuagagcgagagc

SEQ ID NO: 84978 - RNA, 20 nt, Artificial Sequence
  MKO10084978_B_Fam49b
  gRNA
cgaugagaaguugcaagaga

SEQ ID NO: 84979 - RNA, 20 nt, Artificial Sequence
  MKO10084979_B_Fam50a
  gRNA
acacaagcuucuugccugac

SEQ ID NO: 84980 - RNA, 20 nt, Artificial Sequence
  MKO10084980_B_Fam50a
  gRNA
guccugcucacccacaguac

SEQ ID NO: 84981 - RNA, 20 nt, Artificial Sequence
  MKO10084981_B_Fam50a
  gRNA
aagaagcuuguguccacauc

SEQ ID NO: 84982 - RNA, 20 nt, Artificial Sequence
  MKO10084982_B_Fam50b
  gRNA
ugcucaugcgcaccgugcgc

SEQ ID NO: 84983 - RNA, 20 nt, Artificial Sequence
  MKO10084983_B_Fam50b
  gRNA
ggaggagaaccgguugcgcg

SEQ ID NO: 84984 - RNA, 20 nt, Artificial Sequence
  MKO10084984_B_Fam50b
  gRNA
gccgcaguuccucgcgcaac

SEQ ID NO: 84985 - RNA, 20 nt, Artificial Sequence
  MKO10084985_B_Fam53a
  gRNA
cacuuaccgcugaucuccaa

SEQ ID NO: 84986 - RNA, 20 nt, Artificial Sequence
  MKO10084986_B_Fam53a
  gRNA
gcccugacagccccaguauc

SEQ ID NO: 84987 - RNA, 20 nt, Artificial Sequence
  MKO10084987_B_Fam53a
  gRNA
acucaccgggccagccucac

SEQ ID NO: 84988 - RNA, 20 nt, Artificial Sequence
  MKO10084988_B_Fam53b
  gRNA
agggggauccggccacaucc

SEQ ID NO: 84989 - RNA, 20 nt, Artificial Sequence
  MKO10084989_B_Fam53b
  gRNA
guagguccuugacucaucuu

SEQ ID NO: 84990 - RNA, 20 nt, Artificial Sequence
  MKO10084990_B_Fam53b
  gRNA
cacacgccaaagaugaguca

SEQ ID NO: 84991 - RNA, 20 nt, Artificial Sequence
  MKO10084991_B_Fam53c
  gRNA
ugcuuccugcagucccgucg

SEQ ID NO: 84992 - RNA, 20 nt, Artificial Sequence
  MKO10084992_B_Fam53c
  gRNA
gcgugcauuucagcucaucc

SEQ ID NO: 84993 - RNA, 20 nt, Artificial Sequence
  MKO10084993_B_Fam53c
  gRNA
ugaacccucgacgggacugc

SEQ ID NO: 84994 - RNA, 20 nt, Artificial Sequence
  MKO10084994_B_Fam57a
  gRNA
gcagcauacgcuucuuuaca

SEQ ID NO: 84995 - RNA, 20 nt, Artificial Sequence
  MKO10084995_B_Fam57a
  gRNA
caucaucuccugcaagaacg

SEQ ID NO: 84996 - RNA, 20 nt, Artificial Sequence
  MKO10084996_B_Fam57a
  gRNA
acagaaagguggucaccgug

SEQ ID NO: 84997 - RNA, 20 nt, Artificial Sequence
  MKO10084997_B_Fam57b
  gRNA
cgaggagcagugcggcgccc

SEQ ID NO: 84998 - RNA, 20 nt, Artificial Sequence
  MKO10084998_B_Fam57b
  gRNA
cagcacuccuuucgucugcc

SEQ ID NO: 84999 - RNA, 20 nt, Artificial Sequence
  MKO10084999_B_Fam57b
  gRNA
uuccccuagguguggcgaca

SEQ ID NO: 85000 - RNA, 20 nt, Artificial Sequence
  MKO10085000_B_Fam58b
  gRNA
aauggugcaagcgguggcga

SEQ ID NO: 85001 - RNA, 20 nt, Artificial Sequence
  MKO10085001_B_Fam58b
  gRNA
agacagcugcgaaagcgggc

SEQ ID NO: 85002 - RNA, 20 nt, Artificial Sequence
  MKO10085002_B_Fam58b
  gRNA
cggcgccgcgagccgaggag

SEQ ID NO: 85003 - RNA, 20 nt, Artificial Sequence
  MKO10085003_B_Fam60a
  gRNA
gugugcugcuugugaaaaga

SEQ ID NO: 85004 - RNA, 20 nt, Artificial Sequence
  MKO10085004_B_Fam60a
  gRNA
ccuucugcaguuugcugauc

SEQ ID NO: 85005 - RNA, 20 nt, Artificial Sequence
  MKO10085005_B_Fam60a
  gRNA
cuacaguaaccagucagaug

SEQ ID NO: 85006 - RNA, 20 nt, Artificial Sequence
  MKO10085006_B_Fam63a
  gRNA
ccuucaacuuaacuuucagc

SEQ ID NO: 85007 - RNA, 20 nt, Artificial Sequence
  MKO10085007_B_Fam63a
  gRNA
cgggguccguucucccuucc

SEQ ID NO: 85008 - RNA, 20 nt, Artificial Sequence
  MKO10085008_B_Fam63a
  gRNA
aucacucaccaagguguguc

SEQ ID NO: 85009 - RNA, 20 nt, Artificial Sequence
  MKO10085009_B_Fam63b
  gRNA
gacgugaaugucagguucac

SEQ ID NO: 85010 - RNA, 20 nt, Artificial Sequence
  MKO10085010_B_Fam63b
  gRNA
cauaacugcggagcagcuga

SEQ ID NO: 85011 - RNA, 20 nt, Artificial Sequence
  MKO10085011_B_Fam63b
  gRNA
ggugaaacuuccaccaauga

SEQ ID NO: 85012 - RNA, 20 nt, Artificial Sequence
  MKO10085012_B_Fam64a
  gRNA
cgcaugcccaucgccgucag

SEQ ID NO: 85013 - RNA, 20 nt, Artificial Sequence
  MKO10085013_B_Fam64a
  gRNA
gucucccuuauccgugaaug

SEQ ID NO: 85014 - RNA, 20 nt, Artificial Sequence
  MKO10085014_B_Fam64a
  gRNA
gcuguccucauucacggaua

SEQ ID NO: 85015 - RNA, 20 nt, Artificial Sequence
  MKO10085015_B_Fam65a
  gRNA
cacuaggcgggaauuccuuu

SEQ ID NO: 85016 - RNA, 20 nt, Artificial Sequence
  MKO10085016_B_Fam65a
  gRNA
guagggcuuccuguaugacu

SEQ ID NO: 85017 - RNA, 20 nt, Artificial Sequence
  MKO10085017_B_Fam65a
  gRNA
uuaccuuguccaagucauac

SEQ ID NO: 85018 - RNA, 20 nt, Artificial Sequence
  MKO10085018_B_Fam65b
  gRNA
uaugaagagaaacucucgcc

SEQ ID NO: 85019 - RNA, 20 nt, Artificial Sequence
  MKO10085019_B_Fam65b
  gRNA
uagaccuccuccacucucuu

SEQ ID NO: 85020 - RNA, 20 nt, Artificial Sequence
  MKO10085020_B_Fam65b
  gRNA
cugaggcuucuugagagccg

SEQ ID NO: 85021 - RNA, 20 nt, Artificial Sequence
  MKO10085021_B_Fam65c
  gRNA
gcaggccuucuacuaugacc

SEQ ID NO: 85022 - RNA, 20 nt, Artificial Sequence
  MKO10085022_B_Fam65c
  gRNA
aucuuugacgcuuugaagag

SEQ ID NO: 85023 - RNA, 20 nt, Artificial Sequence
  MKO10085023_B_Fam65c
  gRNA
cugggggaagcaacugcgcc

SEQ ID NO: 85024 - RNA, 20 nt, Artificial Sequence
  MKO10085024_B_Fam69a
  gRNA
ugcagguccgucaauaacuc

SEQ ID NO: 85025 - RNA, 20 nt, Artificial Sequence
  MKO10085025_B_Fam69a
  gRNA
ugcuauuugauaaaccaacc

SEQ ID NO: 85026 - RNA, 20 nt, Artificial Sequence
  MKO10085026_B_Fam69a
  gRNA
uuucuguacaguaguucccc

SEQ ID NO: 85027 - RNA, 20 nt, Artificial Sequence
  MKO10085027_B_Fam69b
  gRNA
caucucccggaacuccuuga

SEQ ID NO: 85028 - RNA, 20 nt, Artificial Sequence
  MKO10085028_B_Fam69b
  gRNA
gcagacuuacgaucaccacc

SEQ ID NO: 85029 - RNA, 20 nt, Artificial Sequence
  MKO10085029_B_Fam69b
  gRNA
acuccuucuagguguacagu

SEQ ID NO: 85030 - RNA, 20 nt, Artificial Sequence
  MKO10085030_B_Fam69c
  gRNA
cugagaacuucgccaucaag

SEQ ID NO: 85031 - RNA, 20 nt, Artificial Sequence
  MKO10085031_B_Fam69c
  gRNA
gcuucggcugcagcuacagc

SEQ ID NO: 85032 - RNA, 20 nt, Artificial Sequence
  MKO10085032_B_Fam69c
  gRNA
ggcuguccaggaauuccccg

SEQ ID NO: 85033 - RNA, 20 nt, Artificial Sequence
  MKO10085033_B_Fam71a
  gRNA
gcccacccucuugcucguag

SEQ ID NO: 85034 - RNA, 20 nt, Artificial Sequence
  MKO10085034_B_Fam71a
  gRNA
ugccgacuucagcaccacuc

SEQ ID NO: 85035 - RNA, 20 nt, Artificial Sequence
  MKO10085035_B_Fam71a
  gRNA
gcugaagucggcauguucaa

SEQ ID NO: 85036 - RNA, 20 nt, Artificial Sequence
  MKO10085036_B_Fam71b
  gRNA
ggaaaaguucccaccaccgc

SEQ ID NO: 85037 - RNA, 20 nt, Artificial Sequence
  MKO10085037_B_Fam71b
  gRNA
gucaacgcuugucucgccag

SEQ ID NO: 85038 - RNA, 20 nt, Artificial Sequence
  MKO10085038_B_Fam71b
  gRNA
gugcaucgcaucuaccagcc

SEQ ID NO: 85039 - RNA, 20 nt, Artificial Sequence
  MKO10085039_B_Fam71d
  gRNA
cgcaggcucgauggacauca

SEQ ID NO: 85040 - RNA, 20 nt, Artificial Sequence
  MKO10085040_B_Fam71d
  gRNA
ugcuacugaccuggauuccg

SEQ ID NO: 85041 - RNA, 20 nt, Artificial Sequence
  MKO10085041_B_Fam71d
  gRNA
cuuguagacuccuauguuuc

SEQ ID NO: 85042 - RNA, 20 nt, Artificial Sequence
  MKO10085042_B_Fam71e1
  gRNA
uguuggcgacuucuccaaac

SEQ ID NO: 85043 - RNA, 20 nt, Artificial Sequence
  MKO10085043_B_Fam71e1
  gRNA
agguggcguuggaggcgccc

SEQ ID NO: 85044 - RNA, 20 nt, Artificial Sequence
  MKO10085044_B_Fam71e1
  gRNA
ggcagccucuaguccugccc

SEQ ID NO: 85045 - RNA, 20 nt, Artificial Sequence
  MKO10085045_B_Fam71e2
  gRNA
gacacccauagucagcuugu

SEQ ID NO: 85046 - RNA, 20 nt, Artificial Sequence
  MKO10085046_B_Fam71e2
  gRNA
gaccaagaugaagcugacca

SEQ ID NO: 85047 - RNA, 20 nt, Artificial Sequence
  MKO10085047_B_Fam71e2
  gRNA
caccuuggucagcuucaucu

SEQ ID NO: 85048 - RNA, 20 nt, Artificial Sequence
  MKO10085048_B_Fam71f1
  gRNA
ccuuaugcagaauuugaacc

SEQ ID NO: 85049 - RNA, 20 nt, Artificial Sequence
  MKO10085049_B_Fam71f1
  gRNA
uuagugcagaagaaaucgaa

SEQ ID NO: 85050 - RNA, 20 nt, Artificial Sequence
  MKO10085050_B_Fam71f1
  gRNA
cuguuucugcugaugcaagu

SEQ ID NO: 85051 - RNA, 20 nt, Artificial Sequence
  MKO10085051_B_Fam71f2
  gRNA
gcauuauggccucgcuguuc

SEQ ID NO: 85052 - RNA, 20 nt, Artificial Sequence
  MKO10085052_B_Fam71f2
  gRNA
ggcaccaagugugcuacagg

SEQ ID NO: 85053 - RNA, 20 nt, Artificial Sequence
  MKO10085053_B_Fam71f2
  gRNA
cucccuaggagagaacuugu

SEQ ID NO: 85054 - RNA, 20 nt, Artificial Sequence
  MKO10085054_B_Fam72a
  gRNA
ccagaaguguccauuguugc

SEQ ID NO: 85055 - RNA, 20 nt, Artificial Sequence
  MKO10085055_B_Fam72a
  gRNA
cagguguaaaccuccuacuu

SEQ ID NO: 85056 - RNA, 20 nt, Artificial Sequence
  MKO10085056_B_Fam72a
  gRNA
uccagcacaguggauuucau

SEQ ID NO: 85057 - RNA, 20 nt, Artificial Sequence
  MKO10085057_B_Fam73a
  gRNA
aucaucgucugcuuuguccc

SEQ ID NO: 85058 - RNA, 20 nt, Artificial Sequence
  MKO10085058_B_Fam73a
  gRNA
aggaggugcucggguuccca

SEQ ID NO: 85059 - RNA, 20 nt, Artificial Sequence
  MKO10085059_B_Fam73a
  gRNA
augaacagcuucuuagcuac

SEQ ID NO: 85060 - RNA, 20 nt, Artificial Sequence
  MKO10085060_B_Fam73b
  gRNA
aagagcaacgacacucuuag

SEQ ID NO: 85061 - RNA, 20 nt, Artificial Sequence
  MKO10085061_B_Fam73b
  gRNA
ggguucuggaggcugucgcc

SEQ ID NO: 85062 - RNA, 20 nt, Artificial Sequence
  MKO10085062_B_Fam73b
  gRNA
agcccuacagcugcgugcuc

SEQ ID NO: 85063 - RNA, 20 nt, Artificial Sequence
  MKO10085063_B_Fam76a
  gRNA
gcucagaauguacaguugua

SEQ ID NO: 85064 - RNA, 20 nt, Artificial Sequence
  MKO10085064_B_Fam76a
  gRNA
acaaauucagagaagaagua

SEQ ID NO: 85065 - RNA, 20 nt, Artificial Sequence
  MKO10085065_B_Fam76a
  gRNA
ucaggggcagcagcugugca

SEQ ID NO: 85066 - RNA, 20 nt, Artificial Sequence
  MKO10085066_B_Fam76b
  gRNA
uaaaacucucuuguaugaca

SEQ ID NO: 85067 - RNA, 20 nt, Artificial Sequence
  MKO10085067_B_Fam76b
  gRNA
auuauguuacaguacugaca

SEQ ID NO: 85068 - RNA, 20 nt, Artificial Sequence
  MKO10085068_B_Fam76b
  gRNA
cugcagaucagaauuucagc

SEQ ID NO: 85069 - RNA, 20 nt, Artificial Sequence
  MKO10085069_B_Fam78a
  gRNA
ggugggccccacaaucgugc

SEQ ID NO: 85070 - RNA, 20 nt, Artificial Sequence
  MKO10085070_B_Fam78a
  gRNA
acaugcccugcuccccguac

SEQ ID NO: 85071 - RNA, 20 nt, Artificial Sequence
  MKO10085071_B_Fam78a
  gRNA
gcucuggucccgguagaugu

SEQ ID NO: 85072 - RNA, 20 nt, Artificial Sequence
  MKO10085072_B_Fam78b
  gRNA
ucugucguguucccguacca

SEQ ID NO: 85073 - RNA, 20 nt, Artificial Sequence
  MKO10085073_B_Fam78b
  gRNA
acaccacgauguucucgcgc

SEQ ID NO: 85074 - RNA, 20 nt, Artificial Sequence
  MKO10085074_B_Fam78b
  gRNA
ccagugccccacgcgcaucg

SEQ ID NO: 85075 - RNA, 20 nt, Artificial Sequence
  MKO10085075_B_Fam81a
  gRNA
uaauucugccuuaaagacgc

SEQ ID NO: 85076 - RNA, 20 nt, Artificial Sequence
  MKO10085076_B_Fam81a
  gRNA
ccgauucaguugcuucacaa

SEQ ID NO: 85077 - RNA, 20 nt, Artificial Sequence
  MKO10085077_B_Fam81a
  gRNA
ggguggcuuacuuagugucc

SEQ ID NO: 85078 - RNA, 20 nt, Artificial Sequence
  MKO10085078_B_Fam83a
  gRNA
caguacucaccuguaugauc

SEQ ID NO: 85079 - RNA, 20 nt, Artificial Sequence
  MKO10085079_B_Fam83a
  gRNA
caccgcuugccccgugaacu

SEQ ID NO: 85080 - RNA, 20 nt, Artificial Sequence
  MKO10085080_B_Fam83a
  gRNA
cgccccguuccaacccaaca

SEQ ID NO: 85081 - RNA, 20 nt, Artificial Sequence
  MKO10085081_B_Fam83b
  gRNA
uacgugaugcccggacucuu

SEQ ID NO: 85082 - RNA, 20 nt, Artificial Sequence
  MKO10085082_B_Fam83b
  gRNA
guugucaaauucaacgucuc

SEQ ID NO: 85083 - RNA, 20 nt, Artificial Sequence
  MKO10085083_B_Fam83b
  gRNA
aauugcagaacauucgcaua

SEQ ID NO: 85084 - RNA, 20 nt, Artificial Sequence
  MKO10085084_B_Fam83c
  gRNA
gaucugaaaguugacgauac

SEQ ID NO: 85085 - RNA, 20 nt, Artificial Sequence
  MKO10085085_B_Fam83c
  gRNA
caacggccgcguggaaggcu

SEQ ID NO: 85086 - RNA, 20 nt, Artificial Sequence
  MKO10085086_B_Fam83c
  gRNA
aggccuccaucaggucgcac

SEQ ID NO: 85087 - RNA, 20 nt, Artificial Sequence
  MKO10085087_B_Fam83d
  gRNA
cgacaucuuccgagaccugc

SEQ ID NO: 85088 - RNA, 20 nt, Artificial Sequence
  MKO10085088_B_Fam83d
  gRNA
ugggcaaucugcugcgaaug

SEQ ID NO: 85089 - RNA, 20 nt, Artificial Sequence
  MKO10085089_B_Fam83d
  gRNA
ggguggcaacaggcucuuac

SEQ ID NO: 85090 - RNA, 20 nt, Artificial Sequence
  MKO10085090_B_Fam83e
  gRNA
ggagugacucacgccugcac

SEQ ID NO: 85091 - RNA, 20 nt, Artificial Sequence
  MKO10085091_B_Fam83e
  gRNA
uggaugcugcuacccgccga

SEQ ID NO: 85092 - RNA, 20 nt, Artificial Sequence
  MKO10085092_B_Fam83e
  gRNA
cgggcuggaaucgaggguag

SEQ ID NO: 85093 - RNA, 20 nt, Artificial Sequence
  MKO10085093_B_Fam83f
  gRNA
uacaggaacccggcguuuac

SEQ ID NO: 85094 - RNA, 20 nt, Artificial Sequence
  MKO10085094_B_Fam83f
  gRNA
cuuuguccccaucgaccauc

SEQ ID NO: 85095 - RNA, 20 nt, Artificial Sequence
  MKO10085095_B_Fam83f
  gRNA
aauuggguucuacaugccca

SEQ ID NO: 85096 - RNA, 20 nt, Artificial Sequence
  MKO10085096_B_Fam83g
  gRNA
gcccgggaugguagugauau

SEQ ID NO: 85097 - RNA, 20 nt, Artificial Sequence
  MKO10085097_B_Fam83g
  gRNA
caugcaccuggggcaccuca

SEQ ID NO: 85098 - RNA, 20 nt, Artificial Sequence
  MKO10085098_B_Fam83g
  gRNA
gggccguguguggcuccuac

SEQ ID NO: 85099 - RNA, 20 nt, Artificial Sequence
  MKO10085099_B_Fam83h
  gRNA
gacugugccguagugaugag

SEQ ID NO: 85100 - RNA, 20 nt, Artificial Sequence
  MKO10085100_B_Fam83h
  gRNA
gaugauccgcucugcccagc

SEQ ID NO: 85101 - RNA, 20 nt, Artificial Sequence
  MKO10085101_B_Fam83h
  gRNA
uggcggcggcuguaccagug

SEQ ID NO: 85102 - RNA, 20 nt, Artificial Sequence
  MKO10085102_B_Fam84a
  gRNA
aagcgucgcauagacgccag

SEQ ID NO: 85103 - RNA, 20 nt, Artificial Sequence
  MKO10085103_B_Fam84a
  gRNA
uguccuggcggaucucgccu

SEQ ID NO: 85104 - RNA, 20 nt, Artificial Sequence
  MKO10085104_B_Fam84a
  gRNA
gaccgcguagacacucaagu

SEQ ID NO: 85105 - RNA, 20 nt, Artificial Sequence
  MKO10085105_B_Fam84b
  gRNA
gcaccgccgcgcguccgauc

SEQ ID NO: 85106 - RNA, 20 nt, Artificial Sequence
  MKO10085106_B_Fam84b
  gRNA
ugaacucgcguuugccauag

SEQ ID NO: 85107 - RNA, 20 nt, Artificial Sequence
  MKO10085107_B_Fam84b
  gRNA
cgagacgaugggccccgcau

SEQ ID NO: 85108 - RNA, 20 nt, Artificial Sequence
  MKO10085108_B_Fam86
  gRNA
agcacugccaucguguccca

SEQ ID NO: 85109 - RNA, 20 nt, Artificial Sequence
  MKO10085109_B_Fam86
  gRNA
caccacaggcuugguuacau

SEQ ID NO: 85110 - RNA, 20 nt, Artificial Sequence
  MKO10085110_B_Fam86
  gRNA
cagcaacagcucagaacccg

SEQ ID NO: 85111 - RNA, 20 nt, Artificial Sequence
  MKO10085111_B_Fam89a
  gRNA
gaagccauucuccagcgcau

SEQ ID NO: 85112 - RNA, 20 nt, Artificial Sequence
  MKO10085112_B_Fam89a
  gRNA
ccgagugcagcagcccgcuc

SEQ ID NO: 85113 - RNA, 20 nt, Artificial Sequence
  MKO10085113_B_Fam89a
  gRNA
cgcgcuggcgcuguugcgca

SEQ ID NO: 85114 - RNA, 20 nt, Artificial Sequence
  MKO10085114_B_Fam89b
  gRNA
cucacaaugcccgugaccag

SEQ ID NO: 85115 - RNA, 20 nt, Artificial Sequence
  MKO10085115_B_Fam89b
  gRNA
ugcacuagccgcgcugcgca

SEQ ID NO: 85116 - RNA, 20 nt, Artificial Sequence
  MKO10085116_B_Fam89b
  gRNA
ccgcugaggccgcgcgguag

SEQ ID NO: 85117 - RNA, 20 nt, Artificial Sequence
  MKO10085117_B_Fam92a
  gRNA
uucuaacugagauagcuguu

SEQ ID NO: 85118 - RNA, 20 nt, Artificial Sequence
  MKO10085118_B_Fam92a
  gRNA
uacucgcuucaucuuuacaa

SEQ ID NO: 85119 - RNA, 20 nt, Artificial Sequence
  MKO10085119_B_Fam92a
  gRNA
uuucaaagguucaacuacuu

SEQ ID NO: 85120 - RNA, 20 nt, Artificial Sequence
  MKO10085120_B_Fam92b
  gRNA
ucacccgggucugcuuuauu

SEQ ID NO: 85121 - RNA, 20 nt, Artificial Sequence
  MKO10085121_B_Fam92b
  gRNA
guuguuuaaucucguuauuu

SEQ ID NO: 85122 - RNA, 20 nt, Artificial Sequence
  MKO10085122_B_Fam92b
  gRNA
ugcccaaauaaagcagaccc

SEQ ID NO: 85123 - RNA, 20 nt, Artificial Sequence
  MKO10085123_B_Fam96a
  gRNA
uagauuugauucgaacuauc

SEQ ID NO: 85124 - RNA, 20 nt, Artificial Sequence
  MKO10085124_B_Fam96a
  gRNA
uuccaguucuucuaaaguau

SEQ ID NO: 85125 - RNA, 20 nt, Artificial Sequence
  MKO10085125_B_Fam96a
  gRNA
cuucuuaccuuguguuugaa

SEQ ID NO: 85126 - RNA, 20 nt, Artificial Sequence
  MKO10085126_B_Fam96b
  gRNA
uccacacuaaccugcaugcu

SEQ ID NO: 85127 - RNA, 20 nt, Artificial Sequence
  MKO10085127_B_Fam96b
  gRNA
ggagaauacacaccugcuug

SEQ ID NO: 85128 - RNA, 20 nt, Artificial Sequence
  MKO10085128_B_Fam96b
  gRNA
gcuccgggucauuaauggag

SEQ ID NO: 85129 - RNA, 20 nt, Artificial Sequence
  MKO10085129_B_Fam98a
  gRNA
aaaaguuccgccuaaucaug

SEQ ID NO: 85130 - RNA, 20 nt, Artificial Sequence
  MKO10085130_B_Fam98a
  gRNA
ccguauccuucucugacauc

SEQ ID NO: 85131 - RNA, 20 nt, Artificial Sequence
  MKO10085131_B_Fam98a
  gRNA
cuucucaacaagaaggcgcu

SEQ ID NO: 85132 - RNA, 20 nt, Artificial Sequence
  MKO10085132_B_Fam98b
  gRNA
uaaagagcgccucacaaaga

SEQ ID NO: 85133 - RNA, 20 nt, Artificial Sequence
  MKO10085133_B_Fam98b
  gRNA
cuuaaaucaaccuuuagcaa

SEQ ID NO: 85134 - RNA, 20 nt, Artificial Sequence
  MKO10085134_B_Fam98b
  gRNA
caagcuguaugugaugcccu

SEQ ID NO: 85135 - RNA, 20 nt, Artificial Sequence
  MKO10085135_B_Fam98c
  gRNA
ccgccgcagagcgcgcgauc

SEQ ID NO: 85136 - RNA, 20 nt, Artificial Sequence
  MKO10085136_B_Fam98c
  gRNA
gacgcuaacucuucaagccc

SEQ ID NO: 85137 - RNA, 20 nt, Artificial Sequence
  MKO10085137_B_Fam98c
  gRNA
gugcaacgcccgcagccagc

SEQ ID NO: 85138 - RNA, 20 nt, Artificial Sequence
  MKO10085138_B_Fan1
  gRNA
aacagcgcucagucugcacg

SEQ ID NO: 85139 - RNA, 20 nt, Artificial Sequence
  MKO10085139_B_Fan1
  gRNA
ucuuucaacguaaauuaacc

SEQ ID NO: 85140 - RNA, 20 nt, Artificial Sequence
  MKO10085140_B_Fan1
  gRNA
cgugcagacugagcgcuguu

SEQ ID NO: 85141 - RNA, 20 nt, Artificial Sequence
  MKO10085141_B_Fanca
  gRNA
cacacugcgagcaaacacuu

SEQ ID NO: 85142 - RNA, 20 nt, Artificial Sequence
  MKO10085142_B_Fanca
  gRNA
cuuccuuacuaaugauugcc

SEQ ID NO: 85143 - RNA, 20 nt, Artificial Sequence
  MKO10085143_B_Fanca
  gRNA
cucccgucucaccuucuguc

SEQ ID NO: 85144 - RNA, 20 nt, Artificial Sequence
  MKO10085144_B_Fancb
  gRNA
cuaagucaucaucuaguaca

SEQ ID NO: 85145 - RNA, 20 nt, Artificial Sequence
  MKO10085145_B_Fancb
  gRNA
ugaagacccuuuggcugaag

SEQ ID NO: 85146 - RNA, 20 nt, Artificial Sequence
  MKO10085146_B_Fancb
  gRNA
ucuuucagguuguugcuaag

SEQ ID NO: 85147 - RNA, 20 nt, Artificial Sequence
  MKO10085147_B_Fancc
  gRNA
gucugaugaacaaagaaccu

SEQ ID NO: 85148 - RNA, 20 nt, Artificial Sequence
  MKO10085148_B_Fancc
  gRNA
cucagagagagucaucuuaa

SEQ ID NO: 85149 - RNA, 20 nt, Artificial Sequence
  MKO10085149_B_Fancc
  gRNA
agacucauauccaagacuuu

SEQ ID NO: 85150 - RNA, 20 nt, Artificial Sequence
  MKO10085150_B_Fancd2os
  gRNA
uguaagucgcauacagcaag

SEQ ID NO: 85151 - RNA, 20 nt, Artificial Sequence
  MKO10085151_B_Fancd2os
  gRNA
caccccuuucuuguuacuca

SEQ ID NO: 85152 - RNA, 20 nt, Artificial Sequence
  MKO10085152_B_Fancd2os
  gRNA
uguccuagacagaccacuug

SEQ ID NO: 85153 - RNA, 20 nt, Artificial Sequence
  MKO10085153_B_Fancd2
  gRNA
aaguagcuugaucagacucu

SEQ ID NO: 85154 - RNA, 20 nt, Artificial Sequence
  MKO10085154_B_Fancd2
  gRNA
gugagacuucuuugccagcu

SEQ ID NO: 85155 - RNA, 20 nt, Artificial Sequence
  MKO10085155_B_Fancd2
  gRNA
gcugucuugugagcgccugc

SEQ ID NO: 85156 - RNA, 20 nt, Artificial Sequence
  MKO10085156_B_Fance
  gRNA
accggaggagagacccacgc

SEQ ID NO: 85157 - RNA, 20 nt, Artificial Sequence
  MKO10085157_B_Fance
  gRNA
ucaugaauguagucccagcg

SEQ ID NO: 85158 - RNA, 20 nt, Artificial Sequence
  MKO10085158_B_Fance
  gRNA
agagcuugucaccuccugga

SEQ ID NO: 85159 - RNA, 20 nt, Artificial Sequence
  MKO10085159_B_Fancf
  gRNA
ccgcgaagcgucgguacacg

SEQ ID NO: 85160 - RNA, 20 nt, Artificial Sequence
  MKO10085160_B_Fancf
  gRNA
cagaucauagugcagccgcg

SEQ ID NO: 85161 - RNA, 20 nt, Artificial Sequence
  MKO10085161_B_Fancf
  gRNA
acgucgagcacgugcucccg

SEQ ID NO: 85162 - RNA, 20 nt, Artificial Sequence
  MKO10085162_B_Fancg
  gRNA
cgauugcugucgccucagag

SEQ ID NO: 85163 - RNA, 20 nt, Artificial Sequence
  MKO10085163_B_Fancg
  gRNA
cucucugaggcgacagcaau

SEQ ID NO: 85164 - RNA, 20 nt, Artificial Sequence
  MKO10085164_B_Fancg
  gRNA
gauugcuagaccuuggcggc

SEQ ID NO: 85165 - RNA, 20 nt, Artificial Sequence
  MKO10085165_B_Fanci
  gRNA
cagcucuuccuuucaccgcu

SEQ ID NO: 85166 - RNA, 20 nt, Artificial Sequence
  MKO10085166_B_Fanci
  gRNA
aaucaccuuucccacaagcg

SEQ ID NO: 85167 - RNA, 20 nt, Artificial Sequence
  MKO10085167_B_Fanci
  gRNA
gcgccaaucaccuuugagga

SEQ ID NO: 85168 - RNA, 20 nt, Artificial Sequence
  MKO10085168_B_Fancl
  gRNA
accuugccuucuugagcugc

SEQ ID NO: 85169 - RNA, 20 nt, Artificial Sequence
  MKO10085169_B_Fancl
  gRNA
gacauacuuaucccaaccaa

SEQ ID NO: 85170 - RNA, 20 nt, Artificial Sequence
  MKO10085170_B_Fancl
  gRNA
aucauaaaacucauuagauc

SEQ ID NO: 85171 - RNA, 20 nt, Artificial Sequence
  MKO10085171_B_Fancm
  gRNA
caccacucacuuucguaucu

SEQ ID NO: 85172 - RNA, 20 nt, Artificial Sequence
  MKO10085172_B_Fancm
  gRNA
uucuguauaggcugugcaac

SEQ ID NO: 85173 - RNA, 20 nt, Artificial Sequence
  MKO10085173_B_Fancm
  gRNA
cacgccagguagugauauca

SEQ ID NO: 85174 - RNA, 20 nt, Artificial Sequence
  MKO10085174_B_Fank1
  gRNA
agaucuccugcuucgaauuu

SEQ ID NO: 85175 - RNA, 20 nt, Artificial Sequence
  MKO10085175_B_Fank1
  gRNA
aucacagcaucgaauuguac

SEQ ID NO: 85176 - RNA, 20 nt, Artificial Sequence
  MKO10085176_B_Fank1
  gRNA
ugggcacgucaaucaugaca

SEQ ID NO: 85177 - RNA, 20 nt, Artificial Sequence
  MKO10085177_B_Fap
  gRNA
ccauuuaccugaaauccagu

SEQ ID NO: 85178 - RNA, 20 nt, Artificial Sequence
  MKO10085178_B_Fap
  gRNA
agugugaaugcuacagauua

SEQ ID NO: 85179 - RNA, 20 nt, Artificial Sequence
  MKO10085179_B_Fap
  gRNA
agaauaucuucaucaaucug

SEQ ID NO: 85180 - RNA, 20 nt, Artificial Sequence
  MKO10085180_B_Far1
  gRNA
guguagcuaucacauuuaac

SEQ ID NO: 85181 - RNA, 20 nt, Artificial Sequence
  MKO10085181_B_Far1
  gRNA
accgcaaugaagagaccacu

SEQ ID NO: 85182 - RNA, 20 nt, Artificial Sequence
  MKO10085182_B_Far1
  gRNA
ugaacuuacccaaccuaaac

SEQ ID NO: 85183 - RNA, 20 nt, Artificial Sequence
  MKO10085183_B_Far2
  gRNA
gagaucacuccuaagcugau

SEQ ID NO: 85184 - RNA, 20 nt, Artificial Sequence
  MKO10085184_B_Far2
  gRNA
gguagaugaccucaucaaug

SEQ ID NO: 85185 - RNA, 20 nt, Artificial Sequence
  MKO10085185_B_Far2
  gRNA
gcgugacuucgccaucagca

SEQ ID NO: 85186 - RNA, 20 nt, Artificial Sequence
  MKO10085186_B_Farp1
  gRNA
gcuucaccugcagagcgaac

SEQ ID NO: 85187 - RNA, 20 nt, Artificial Sequence
  MKO10085187_B_Farp1
  gRNA
acuucgaaucugcuucacaa

SEQ ID NO: 85188 - RNA, 20 nt, Artificial Sequence
  MKO10085188_B_Farp1
  gRNA
cagguaccuguucgcucugc

SEQ ID NO: 85189 - RNA, 20 nt, Artificial Sequence
  MKO10085189_B_Farp2
  gRNA
acuucguacuugccuaauga

SEQ ID NO: 85190 - RNA, 20 nt, Artificial Sequence
  MKO10085190_B_Farp2
  gRNA
aaccuaugaaacccaucauu

SEQ ID NO: 85191 - RNA, 20 nt, Artificial Sequence
  MKO10085191_B_Farp2
  gRNA
gcaacucaagagagaccucc

SEQ ID NO: 85192 - RNA, 20 nt, Artificial Sequence
  MKO10085192_B_Fars2
  gRNA
gccuagucaguacuuguuua

SEQ ID NO: 85193 - RNA, 20 nt, Artificial Sequence
  MKO10085193_B_Fars2
  gRNA
gcuccaucacaccgcagcca

SEQ ID NO: 85194 - RNA, 20 nt, Artificial Sequence
  MKO10085194_B_Fars2
  gRNA
agaucaacuuccguggagaa

SEQ ID NO: 85195 - RNA, 20 nt, Artificial Sequence
  MKO10085195_B_Farsa
  gRNA
cuuagacacgcuugugcuga

SEQ ID NO: 85196 - RNA, 20 nt, Artificial Sequence
  MKO10085196_B_Farsa
  gRNA
agugcagaagcgguugcagc

SEQ ID NO: 85197 - RNA, 20 nt, Artificial Sequence
  MKO10085197_B_Farsa
  gRNA
guuuagaagcaucccucucg

SEQ ID NO: 85198 - RNA, 20 nt, Artificial Sequence
  MKO10085198_B_Farsb
  gRNA
cagauacgaccuccuguguc

SEQ ID NO: 85199 - RNA, 20 nt, Artificial Sequence
  MKO10085199_B_Farsb
  gRNA
auauaagcgagugaugccca

SEQ ID NO: 85200 - RNA, 20 nt, Artificial Sequence
  MKO10085200_B_Farsb
  gRNA
aggacuggcucggggccucc

SEQ ID NO: 85201 - RNA, 20 nt, Artificial Sequence
  MKO10085201_B_Fasl
  gRNA
ccucugaaaaaaaagagccg

SEQ ID NO: 85202 - RNA, 20 nt, Artificial Sequence
  MKO10085202_B_Fasl
  gRNA
guaauucaugggcugcugca

SEQ ID NO: 85203 - RNA, 20 nt, Artificial Sequence
  MKO10085203_B_Fasl
  gRNA
cagacacaaaccuguuaaau

SEQ ID NO: 85204 - RNA, 20 nt, Artificial Sequence
  MKO10085204_B_Fasn
  gRNA
gccuaccaggccauccguag

SEQ ID NO: 85205 - RNA, 20 nt, Artificial Sequence
  MKO10085205_B_Fasn
  gRNA
aaaaaaggaggcgucgaacu

SEQ ID NO: 85206 - RNA, 20 nt, Artificial Sequence
  MKO10085206_B_Fasn
  gRNA
ggcucuauggauuacccaag

SEQ ID NO: 85207 - RNA, 20 nt, Artificial Sequence
  MKO10085207_B_Fastkd1
  gRNA
gucauuacccacuguuagag

SEQ ID NO: 85208 - RNA, 20 nt, Artificial Sequence
  MKO10085208_B_Fastkd1
  gRNA
ucacccacuaaucgaagcac

SEQ ID NO: 85209 - RNA, 20 nt, Artificial Sequence
  MKO10085209_B_Fastkd1
  gRNA
guaaccagugcuucgauuag

SEQ ID NO: 85210 - RNA, 20 nt, Artificial Sequence
  MKO10085210_B_Fastkd2
  gRNA
cuaagacuucaaacaugugc

SEQ ID NO: 85211 - RNA, 20 nt, Artificial Sequence
  MKO10085211_B_Fastkd2
  gRNA
uccuaguugaucagcaaguu

SEQ ID NO: 85212 - RNA, 20 nt, Artificial Sequence
  MKO10085212_B_Fastkd2
  gRNA
ccuucugaaugaaugcagua

SEQ ID NO: 85213 - RNA, 20 nt, Artificial Sequence
  MKO10085213_B_Fastkd3
  gRNA
cugcuccuuagagacgcccc

SEQ ID NO: 85214 - RNA, 20 nt, Artificial Sequence
  MKO10085214_B_Fastkd3
  gRNA
ccuagaguguccguucuaua

SEQ ID NO: 85215 - RNA, 20 nt, Artificial Sequence
  MKO10085215_B_Fastkd3
  gRNA
auauccucauccacuguaca

SEQ ID NO: 85216 - RNA, 20 nt, Artificial Sequence
  MKO10085216_B_Fastkd5
  gRNA
ugaaaaucgucaaguaccac

SEQ ID NO: 85217 - RNA, 20 nt, Artificial Sequence
  MKO10085217_B_Fastkd5
  gRNA
cuugagagcggcugacauuc

SEQ ID NO: 85218 - RNA, 20 nt, Artificial Sequence
  MKO10085218_B_Fastkd5
  gRNA
auagcuagcuucacuaaugg

SEQ ID NO: 85219 - RNA, 20 nt, Artificial Sequence
  MKO10085219_B_Fastk
  gRNA
gaaguugggguucccgcaag

SEQ ID NO: 85220 - RNA, 20 nt, Artificial Sequence
  MKO10085220_B_Fastk
  gRNA
cugccaucuaugguggucaa

SEQ ID NO: 85221 - RNA, 20 nt, Artificial Sequence
  MKO10085221_B_Fastk
  gRNA
aauuuaugcccugccuugag

SEQ ID NO: 85222 - RNA, 20 nt, Artificial Sequence
  MKO10085222_B_Fas
  gRNA
caguuaagaguucauacuca

SEQ ID NO: 85223 - RNA, 20 nt, Artificial Sequence
  MKO10085223_B_Fas
  gRNA
cugcagacaugcuguggauc

SEQ ID NO: 85224 - RNA, 20 nt, Artificial Sequence
  MKO10085224_B_Fas
  gRNA
ccuccucagcuuuaaacucu

SEQ ID NO: 85225 - RNA, 20 nt, Artificial Sequence
  MKO10085225_B_Fau1
  gRNA
ccgggucaaaagccucaauc

SEQ ID NO: 85226 - RNA, 20 nt, Artificial Sequence
  MKO10085226_B_Fau1
  gRNA
gagagucgacuucccacuac

SEQ ID NO: 85227 - RNA, 20 nt, Artificial Sequence
  MKO10085227_B_Fau1
  gRNA
gucucaucacaaccacgucg

SEQ ID NO: 85228 - RNA, 20 nt, Artificial Sequence
  MKO10085228_B_Fau2
  gRNA
acaauggggaccccccacua

SEQ ID NO: 85229 - RNA, 20 nt, Artificial Sequence
  MKO10085229_B_Fau2
  gRNA
gaauccacucgauguguagc

SEQ ID NO: 85230 - RNA, 20 nt, Artificial Sequence
  MKO10085230_B_Fau2
  gRNA
cccaggaaugcucgagacuc

SEQ ID NO: 85231 - RNA, 20 nt, Artificial Sequence
  MKO10085231_B_Fau3
  gRNA
ccgacgaugucaaaccauag

SEQ ID NO: 85232 - RNA, 20 nt, Artificial Sequence
  MKO10085232_B_Fau3
  gRNA
cagaacgugaccgcaagaag

SEQ ID NO: 85233 - RNA, 20 nt, Artificial Sequence
  MKO10085233_B_Fau3
  gRNA
uucuggaugaaaacgacaac

SEQ ID NO: 85234 - RNA, 20 nt, Artificial Sequence
  MKO10085234_B_Fau4
  gRNA
uauguaccgagugcagauua

SEQ ID NO: 85235 - RNA, 20 nt, Artificial Sequence
  MKO10085235_B_Fau4
  gRNA
gacguuaaacacaaggaccg

SEQ ID NO: 85236 - RNA, 20 nt, Artificial Sequence
  MKO10085236_B_Fau4
  gRNA
cgacauaccaucaucugcau

SEQ ID NO: 85237 - RNA, 20 nt, Artificial Sequence
  MKO10085237_B_Fau
  gRNA
agcacucaccucccagcaug

SEQ ID NO: 85238 - RNA, 20 nt, Artificial Sequence
  MKO10085238_B_Fau
  gRNA
ugaucugggcgaccgucucc

SEQ ID NO: 85239 - RNA, 20 nt, Artificial Sequence
  MKO10085239_B_Fau
  gRNA
gcagcucuuuguccgcgccc

SEQ ID NO: 85240 - RNA, 20 nt, Artificial Sequence
  MKO10085240_B_Faxc
  gRNA
ccacggcauuggccgcuucu

SEQ ID NO: 85241 - RNA, 20 nt, Artificial Sequence
  MKO10085241_B_Faxc
  gRNA
cucaagagccgugaccaaga

SEQ ID NO: 85242 - RNA, 20 nt, Artificial Sequence
  MKO10085242_B_Faxc
  gRNA
agaauucauaaucgacuuuc

SEQ ID NO: 85243 - RNA, 20 nt, Artificial Sequence
  MKO10085243_B_Fbf1
  gRNA
acacagcgagcucaccucag

SEQ ID NO: 85244 - RNA, 20 nt, Artificial Sequence
  MKO10085244_B_Fbf1
  gRNA
gggacuuacugucaucuccc

SEQ ID NO: 85245 - RNA, 20 nt, Artificial Sequence
  MKO10085245_B_Fbf1
  gRNA
gucuccaaggacauccucaa

SEQ ID NO: 85246 - RNA, 20 nt, Artificial Sequence
  MKO10085246_B_Fblim1
  gRNA
ucacgccauacccucggaag

SEQ ID NO: 85247 - RNA, 20 nt, Artificial Sequence
  MKO10085247_B_Fblim1
  gRNA
ucgucuguccacccuccgcc

SEQ ID NO: 85248 - RNA, 20 nt, Artificial Sequence
  MKO10085248_B_Fblim1
  gRNA
ucaaaguuuaccuguggcgg

SEQ ID NO: 85249 - RNA, 20 nt, Artificial Sequence
  MKO10085249_B_Fbll1
  gRNA
ccgucgucgucggggucuau

SEQ ID NO: 85250 - RNA, 20 nt, Artificial Sequence
  MKO10085250_B_Fbll1
  gRNA
gccacgaugcgcgacugauc

SEQ ID NO: 85251 - RNA, 20 nt, Artificial Sequence
  MKO10085251_B_Fbll1
  gRNA
gagggcguguucaucuaccg

SEQ ID NO: 85252 - RNA, 20 nt, Artificial Sequence
  MKO10085252_B_Fbln1
  gRNA
uaucaugacaauggguucac

SEQ ID NO: 85253 - RNA, 20 nt, Artificial Sequence
  MKO10085253_B_Fbln1
  gRNA
gucaugauaagcuaccagug

SEQ ID NO: 85254 - RNA, 20 nt, Artificial Sequence
  MKO10085254_B_Fbln1
  gRNA
gccguacaccucagaaucca

SEQ ID NO: 85255 - RNA, 20 nt, Artificial Sequence
  MKO10085255_B_Fbln2
  gRNA
cauugucgauggcccacugc

SEQ ID NO: 85256 - RNA, 20 nt, Artificial Sequence
  MKO10085256_B_Fbln2
  gRNA
cugcacaacaggucucgauu

SEQ ID NO: 85257 - RNA, 20 nt, Artificial Sequence
  MKO10085257_B_Fbln2
  gRNA
gggacuccgagugcgggcug

SEQ ID NO: 85258 - RNA, 20 nt, Artificial Sequence
  MKO10085258_B_Fbln5
  gRNA
uuccagaagccaguacccau

SEQ ID NO: 85259 - RNA, 20 nt, Artificial Sequence
  MKO10085259_B_Fbln5
  gRNA
uacaccugcuccugcaccga

SEQ ID NO: 85260 - RNA, 20 nt, Artificial Sequence
  MKO10085260_B_Fbln5
  gRNA
gauacucacuguuaccaucu

SEQ ID NO: 85261 - RNA, 20 nt, Artificial Sequence
  MKO10085261_B_Fbln7
  gRNA
gcggcugaaggcggggucac

SEQ ID NO: 85262 - RNA, 20 nt, Artificial Sequence
  MKO10085262_B_Fbln7
  gRNA
ccgaaacaugaagagccggc

SEQ ID NO: 85263 - RNA, 20 nt, Artificial Sequence
  MKO10085263_B_Fbln7
  gRNA
agcaagacacaccacgcugc

SEQ ID NO: 85264 - RNA, 20 nt, Artificial Sequence
  MKO10085264_B_Fbl
  gRNA
ccaggugucuuuaucugucg

SEQ ID NO: 85265 - RNA, 20 nt, Artificial Sequence
  MKO10085265_B_Fbl
  gRNA
ggcgguggacgaggaggcuu

SEQ ID NO: 85266 - RNA, 20 nt, Artificial Sequence
  MKO10085266_B_Fbl
  gRNA
ucuccauacacagacucucc

SEQ ID NO: 85267 - RNA, 20 nt, Artificial Sequence
  MKO10085267_B_Fbn1
  gRNA
aauaugugcacuugcccguc

SEQ ID NO: 85268 - RNA, 20 nt, Artificial Sequence
  MKO10085268_B_Fbn1
  gRNA
ugcagcauccgcuguaugaa

SEQ ID NO: 85269 - RNA, 20 nt, Artificial Sequence
  MKO10085269_B_Fbn1
  gRNA
cgagcagaauccauccccac

SEQ ID NO: 85270 - RNA, 20 nt, Artificial Sequence
  MKO10085270_B_Fbn2
  gRNA
aaguuccgauguaucccuuc

SEQ ID NO: 85271 - RNA, 20 nt, Artificial Sequence
  MKO10085271_B_Fbn2
  gRNA
cucuacaggcccaacgugug

SEQ ID NO: 85272 - RNA, 20 nt, Artificial Sequence
  MKO10085272_B_Fbn2
  gRNA
cuugauuuggcuccgcaugu

SEQ ID NO: 85273 - RNA, 20 nt, Artificial Sequence
  MKO10085273_B_Fbp1
  gRNA
acugccauagagcgcauacc

SEQ ID NO: 85274 - RNA, 20 nt, Artificial Sequence
  MKO10085274_B_Fbp1
  gRNA
gucuguuucgauccccuuga

SEQ ID NO: 85275 - RNA, 20 nt, Artificial Sequence
  MKO10085275_B_Fbp1
  gRNA
uaacaucuacagccuuaaug

SEQ ID NO: 85276 - RNA, 20 nt, Artificial Sequence
  MKO10085276_B_Fbp2
  gRNA
ucuuggagaauucgugcuag

SEQ ID NO: 85277 - RNA, 20 nt, Artificial Sequence
  MKO10085277_B_Fbp2
  gRNA
ggacgugcuguccaacuccc

SEQ ID NO: 85278 - RNA, 20 nt, Artificial Sequence
  MKO10085278_B_Fbp2
  gRNA
ugugauguaggggaaauaug

SEQ ID NO: 85279 - RNA, 20 nt, Artificial Sequence
  MKO10085279_B_Fbrsl1
  gRNA
aagugugaacugcacucgac

SEQ ID NO: 85280 - RNA, 20 nt, Artificial Sequence
  MKO10085280_B_Fbrsl1
  gRNA
aggcugcuggcgggcaacgc

SEQ ID NO: 85281 - RNA, 20 nt, Artificial Sequence
  MKO10085281_B_Fbrsl1
  gRNA
ucaaacucaaucgaaauaac

SEQ ID NO: 85282 - RNA, 20 nt, Artificial Sequence
  MKO10085282_B_Fbrs
  gRNA
gcugagcgggcuaccccaga

SEQ ID NO: 85283 - RNA, 20 nt, Artificial Sequence
  MKO10085283_B_Fbrs
  gRNA
cccagaucccugaucauuuc

SEQ ID NO: 85284 - RNA, 20 nt, Artificial Sequence
  MKO10085284_B_Fbrs
  gRNA
accaaacucacccucaaagg

SEQ ID NO: 85285 - RNA, 20 nt, Artificial Sequence
  MKO10085285_B_Fbxl12
  gRNA
cgcauaccguguagagcguc

SEQ ID NO: 85286 - RNA, 20 nt, Artificial Sequence
  MKO10085286_B_Fbxl12
  gRNA
gaggucaaacagagucgcca

SEQ ID NO: 85287 - RNA, 20 nt, Artificial Sequence
  MKO10085287_B_Fbxl12
  gRNA
aucuccaagagcaccaaguc

SEQ ID NO: 85288 - RNA, 20 nt, Artificial Sequence
  MKO10085288_B_Fbxl13
  gRNA
cgaacucuugacuucaguga

SEQ ID NO: 85289 - RNA, 20 nt, Artificial Sequence
  MKO10085289_B_Fbxl13
  gRNA
auccuagcuaucauuaaaag

SEQ ID NO: 85290 - RNA, 20 nt, Artificial Sequence
  MKO10085290_B_Fbxl13
  gRNA
aagacugucugaaacuuacu

SEQ ID NO: 85291 - RNA, 20 nt, Artificial Sequence
  MKO10085291_B_Fbxl14
  gRNA
ggcgacagcugcggagauua

SEQ ID NO: 85292 - RNA, 20 nt, Artificial Sequence
  MKO10085292_B_Fbxl14
  gRNA
gcgccgcgcgacccuugucu

SEQ ID NO: 85293 - RNA, 20 nt, Artificial Sequence
  MKO10085293_B_Fbxl14
  gRNA
ggcagcgcugcgcgucaugc

SEQ ID NO: 85294 - RNA, 20 nt, Artificial Sequence
  MKO10085294_B_Fbxl15
  gRNA
caccgccugucgucaacuca

SEQ ID NO: 85295 - RNA, 20 nt, Artificial Sequence
  MKO10085295_B_Fbxl15
  gRNA
ccacaccacgcuuccgcaag

SEQ ID NO: 85296 - RNA, 20 nt, Artificial Sequence
  MKO10085296_B_Fbxl15
  gRNA
acccgcagagagcgcagcgc

SEQ ID NO: 85297 - RNA, 20 nt, Artificial Sequence
  MKO10085297_B_Fbxl16
  gRNA
ccagcucuugcaguugcacg

SEQ ID NO: 85298 - RNA, 20 nt, Artificial Sequence
  MKO10085298_B_Fbxl16
  gRNA
guaccuggcagcaccaucgc

SEQ ID NO: 85299 - RNA, 20 nt, Artificial Sequence
  MKO10085299_B_Fbxl16
  gRNA
ccacagguguguacgcauca

SEQ ID NO: 85300 - RNA, 20 nt, Artificial Sequence
  MKO10085300_B_Fbxl17
  gRNA
gcuuguccugguugccuacg

SEQ ID NO: 85301 - RNA, 20 nt, Artificial Sequence
  MKO10085301_B_Fbxl17
  gRNA
aacccaugaagccaacauac

SEQ ID NO: 85302 - RNA, 20 nt, Artificial Sequence
  MKO10085302_B_Fbxl17
  gRNA
gguuaagugaaugacuccuu

SEQ ID NO: 85303 - RNA, 20 nt, Artificial Sequence
  MKO10085303_B_Fbxl18
  gRNA
gggugccgcugcgagauacc

SEQ ID NO: 85304 - RNA, 20 nt, Artificial Sequence
  MKO10085304_B_Fbxl18
  gRNA
uccggaggagcgacugcugc

SEQ ID NO: 85305 - RNA, 20 nt, Artificial Sequence
  MKO10085305_B_Fbxl18
  gRNA
cugaggaaccgcccaaccua

SEQ ID NO: 85306 - RNA, 20 nt, Artificial Sequence
  MKO10085306_B_Fbxl19
  gRNA
ugcagauuguacacuccaug

SEQ ID NO: 85307 - RNA, 20 nt, Artificial Sequence
  MKO10085307_B_Fbxl19
  gRNA
ucgggggcacucccagcagu

SEQ ID NO: 85308 - RNA, 20 nt, Artificial Sequence
  MKO10085308_B_Fbxl19
  gRNA
uuccagccuccccgcacaag

SEQ ID NO: 85309 - RNA, 20 nt, Artificial Sequence
  MKO10085309_B_Fbxl20
  gRNA
aguuacugccauccagagcu

SEQ ID NO: 85310 - RNA, 20 nt, Artificial Sequence
  MKO10085310_B_Fbxl20
  gRNA
agaccugagcacagcgacac

SEQ ID NO: 85311 - RNA, 20 nt, Artificial Sequence
  MKO10085311_B_Fbxl20
  gRNA
gauguucucaaacagugaug

SEQ ID NO: 85312 - RNA, 20 nt, Artificial Sequence
  MKO10085312_B_Fbxl21
  gRNA
cuaccaucagaugaaacgug

SEQ ID NO: 85313 - RNA, 20 nt, Artificial Sequence
  MKO10085313_B_Fbxl21
  gRNA
guagugaaacagcccaaacg

SEQ ID NO: 85314 - RNA, 20 nt, Artificial Sequence
  MKO10085314_B_Fbxl21
  gRNA
guuaucaucgauuaaaauug

SEQ ID NO: 85315 - RNA, 20 nt, Artificial Sequence
  MKO10085315_B_Fbxl22
  gRNA
gcagacacucccgauugagc

SEQ ID NO: 85316 - RNA, 20 nt, Artificial Sequence
  MKO10085316_B_Fbxl22
  gRNA
gcgcguuaccaaccgcacgc

SEQ ID NO: 85317 - RNA, 20 nt, Artificial Sequence
  MKO10085317_B_Fbxl22
  gRNA
ccacgucacggacgacugcc

SEQ ID NO: 85318 - RNA, 20 nt, Artificial Sequence
  MKO10085318_B_Fbxl2
  gRNA
uagaguuacgauguccaaga

SEQ ID NO: 85319 - RNA, 20 nt, Artificial Sequence
  MKO10085319_B_Fbxl2
  gRNA
aacuuaccucuacaucuguc

SEQ ID NO: 85320 - RNA, 20 nt, Artificial Sequence
  MKO10085320_B_Fbxl2
  gRNA
uaucaacaagaagcuaccca

SEQ ID NO: 85321 - RNA, 20 nt, Artificial Sequence
  MKO10085321_B_Fbxl3
  gRNA
gcuuucaaguaagaugucgc

SEQ ID NO: 85322 - RNA, 20 nt, Artificial Sequence
  MKO10085322_B_Fbxl3
  gRNA
uuugguagauccauaaagcu

SEQ ID NO: 85323 - RNA, 20 nt, Artificial Sequence
  MKO10085323_B_Fbxl3
  gRNA
gagcgcuccugugucguccu

SEQ ID NO: 85324 - RNA, 20 nt, Artificial Sequence
  MKO10085324_B_Fbxl4
  gRNA
ccagugacgugucguccagc

SEQ ID NO: 85325 - RNA, 20 nt, Artificial Sequence
  MKO10085325_B_Fbxl4
  gRNA
cugcgauaaacucccaccuc

SEQ ID NO: 85326 - RNA, 20 nt, Artificial Sequence
  MKO10085326_B_Fbxl4
  gRNA
ucucuaucggacaaaaguag

SEQ ID NO: 85327 - RNA, 20 nt, Artificial Sequence
  MKO10085327_B_Fbxl5
  gRNA
agcacggaagucauuguugu

SEQ ID NO: 85328 - RNA, 20 nt, Artificial Sequence
  MKO10085328_B_Fbxl5
  gRNA
gaaaguucucaaguacucug

SEQ ID NO: 85329 - RNA, 20 nt, Artificial Sequence
  MKO10085329_B_Fbxl5
  gRNA
gucuuuauaugcuacuuuca

SEQ ID NO: 85330 - RNA, 20 nt, Artificial Sequence
  MKO10085330_B_Fbxl6
  gRNA
uaccagcagugcgcccaaga

SEQ ID NO: 85331 - RNA, 20 nt, Artificial Sequence
  MKO10085331_B_Fbxl6
  gRNA
aguguacuugagacuuccag

SEQ ID NO: 85332 - RNA, 20 nt, Artificial Sequence
  MKO10085332_B_Fbxl6
  gRNA
ugguuagcaaguucugcccu

SEQ ID NO: 85333 - RNA, 20 nt, Artificial Sequence
  MKO10085333_B_Fbxl7
  gRNA
gacaggaugggcgcgaacaa

SEQ ID NO: 85334 - RNA, 20 nt, Artificial Sequence
  MKO10085334_B_Fbxl7
  gRNA
caaagucggugggcauauca

SEQ ID NO: 85335 - RNA, 20 nt, Artificial Sequence
  MKO10085335_B_Fbxl7
  gRNA
aucugugcuugaacucacgu

SEQ ID NO: 85336 - RNA, 20 nt, Artificial Sequence
  MKO10085336_B_Fbxl8
  gRNA
auugucgaccagcuccccca

SEQ ID NO: 85337 - RNA, 20 nt, Artificial Sequence
  MKO10085337_B_Fbxl8
  gRNA
augcggacgcgcgcaccucg

SEQ ID NO: 85338 - RNA, 20 nt, Artificial Sequence
  MKO10085338_B_Fbxl8
  gRNA
ucggaaggcguccaguaccg

SEQ ID NO: 85339 - RNA, 20 nt, Artificial Sequence
  MKO10085339_B_Fbxo10
  gRNA
cuguuuagaucgucaugcuc

SEQ ID NO: 85340 - RNA, 20 nt, Artificial Sequence
  MKO10085340_B_Fbxo10
  gRNA
cugcgcgccccuugaagaug

SEQ ID NO: 85341 - RNA, 20 nt, Artificial Sequence
  MKO10085341_B_Fbxo10
  gRNA
cgaucuggcauuguuguccu

SEQ ID NO: 85342 - RNA, 20 nt, Artificial Sequence
  MKO10085342_B_Fbxo11
  gRNA
acccgcugaacaguaucuuc

SEQ ID NO: 85343 - RNA, 20 nt, Artificial Sequence
  MKO10085343_B_Fbxo11
  gRNA
gcaaagcgugcaagaguguc

SEQ ID NO: 85344 - RNA, 20 nt, Artificial Sequence
  MKO10085344_B_Fbxo11
  gRNA
guguccuacaaagagcagua

SEQ ID NO: 85345 - RNA, 20 nt, Artificial Sequence
  MKO10085345_B_Fbxo15
  gRNA
agcaacgcuucucgcugugc

SEQ ID NO: 85346 - RNA, 20 nt, Artificial Sequence
  MKO10085346_B_Fbxo15
  gRNA
cuuacagucuuauuuggguc

SEQ ID NO: 85347 - RNA, 20 nt, Artificial Sequence
  MKO10085347_B_Fbxo15
  gRNA
uguggcaccauacaaaucca

SEQ ID NO: 85348 - RNA, 20 nt, Artificial Sequence
  MKO10085348_B_Fbxo16
  gRNA
cuccccaacgcccuuugaac

SEQ ID NO: 85349 - RNA, 20 nt, Artificial Sequence
  MKO10085349_B_Fbxo16
  gRNA
gccgauguucagccaauucc

SEQ ID NO: 85350 - RNA, 20 nt, Artificial Sequence
  MKO10085350_B_Fbxo16
  gRNA
acagggaacagcgcucuagu

SEQ ID NO: 85351 - RNA, 20 nt, Artificial Sequence
  MKO10085351_B_Fbxo17
  gRNA
gaaguggagcacggcggaaa

SEQ ID NO: 85352 - RNA, 20 nt, Artificial Sequence
  MKO10085352_B_Fbxo17
  gRNA
cucccagguggugcuccaag

SEQ ID NO: 85353 - RNA, 20 nt, Artificial Sequence
  MKO10085353_B_Fbxo17
  gRNA
gacuggucggcuaggacaga

SEQ ID NO: 85354 - RNA, 20 nt, Artificial Sequence
  MKO10085354_B_Fbxo18
  gRNA
gagggaucauccucuacuuu

SEQ ID NO: 85355 - RNA, 20 nt, Artificial Sequence
  MKO10085355_B_Fbxo18
  gRNA
aguggucgacugccaucauu

SEQ ID NO: 85356 - RNA, 20 nt, Artificial Sequence
  MKO10085356_B_Fbxo18
  gRNA
cuaggauagagaccaugguu

SEQ ID NO: 85357 - RNA, 20 nt, Artificial Sequence
  MKO10085357_B_Fbxo21
  gRNA
gcaguacuggucgauguaaa

SEQ ID NO: 85358 - RNA, 20 nt, Artificial Sequence
  MKO10085358_B_Fbxo21
  gRNA
gccccaccgacuacgucaau

SEQ ID NO: 85359 - RNA, 20 nt, Artificial Sequence
  MKO10085359_B_Fbxo21
  gRNA
gguggcggcuguugaugcca

SEQ ID NO: 85360 - RNA, 20 nt, Artificial Sequence
  MKO10085360_B_Fbxo22
  gRNA
cgauugcuaccugaucccau

SEQ ID NO: 85361 - RNA, 20 nt, Artificial Sequence
  MKO10085361_B_Fbxo22
  gRNA
aucagguagcaaucgaccuc

SEQ ID NO: 85362 - RNA, 20 nt, Artificial Sequence
  MKO10085362_B_Fbxo22
  gRNA
gauugugaccccgggaauug

SEQ ID NO: 85363 - RNA, 20 nt, Artificial Sequence
  MKO10085363_B_Fbxo24
  gRNA
uguggaggcgcaucugucga

SEQ ID NO: 85364 - RNA, 20 nt, Artificial Sequence
  MKO10085364_B_Fbxo24
  gRNA
gagcuucaagcagaucgugc

SEQ ID NO: 85365 - RNA, 20 nt, Artificial Sequence
  MKO10085365_B_Fbxo24
  gRNA
uacucgggaacagccggcag

SEQ ID NO: 85366 - RNA, 20 nt, Artificial Sequence
  MKO10085366_B_Fbxo25
  gRNA
cguccauaaggaaagcacaa

SEQ ID NO: 85367 - RNA, 20 nt, Artificial Sequence
  MKO10085367_B_Fbxo25
  gRNA
ucccaguuaaccucacugag

SEQ ID NO: 85368 - RNA, 20 nt, Artificial Sequence
  MKO10085368_B_Fbxo25
  gRNA
cugugccacuccacucagug

SEQ ID NO: 85369 - RNA, 20 nt, Artificial Sequence
  MKO10085369_B_Fbxo27
  gRNA
cuacagaaggccugcgcaaa

SEQ ID NO: 85370 - RNA, 20 nt, Artificial Sequence
  MKO10085370_B_Fbxo27
  gRNA
uggggagcucgacaugacag

SEQ ID NO: 85371 - RNA, 20 nt, Artificial Sequence
  MKO10085371_B_Fbxo27
  gRNA
agaacuuaucuaugacguuc

SEQ ID NO: 85372 - RNA, 20 nt, Artificial Sequence
  MKO10085372_B_Fbxo28
  gRNA
agcaccucgugagcucgcug

SEQ ID NO: 85373 - RNA, 20 nt, Artificial Sequence
  MKO10085373_B_Fbxo28
  gRNA
ucaacauucucugacagacc

SEQ ID NO: 85374 - RNA, 20 nt, Artificial Sequence
  MKO10085374_B_Fbxo28
  gRNA
cugcaugacgagcuaaagaa

SEQ ID NO: 85375 - RNA, 20 nt, Artificial Sequence
  MKO10085375_B_Fbxo2
  gRNA
uucuccuuacucgaaggagg

SEQ ID NO: 85376 - RNA, 20 nt, Artificial Sequence
  MKO10085376_B_Fbxo2
  gRNA
gucggagaacgaagaugugc

SEQ ID NO: 85377 - RNA, 20 nt, Artificial Sequence
  MKO10085377_B_Fbxo2
  gRNA
gccgccuggugugccugcgc

SEQ ID NO: 85378 - RNA, 20 nt, Artificial Sequence
  MKO10085378_B_Fbxo30
  gRNA
acucgagagcuuacaaaaga

SEQ ID NO: 85379 - RNA, 20 nt, Artificial Sequence
  MKO10085379_B_Fbxo30
  gRNA
ucauacaugaucgccauuua

SEQ ID NO: 85380 - RNA, 20 nt, Artificial Sequence
  MKO10085380_B_Fbxo30
  gRNA
ggcaguuuacuucagucucg

SEQ ID NO: 85381 - RNA, 20 nt, Artificial Sequence
  MKO10085381_B_Fbxo31
  gRNA
guggacggacuguucaucau

SEQ ID NO: 85382 - RNA, 20 nt, Artificial Sequence
  MKO10085382_B_Fbxo31
  gRNA
ucacgcggaagauugugaag

SEQ ID NO: 85383 - RNA, 20 nt, Artificial Sequence
  MKO10085383_B_Fbxo31
  gRNA
cugugaucuccagcuuccgc

SEQ ID NO: 85384 - RNA, 20 nt, Artificial Sequence
  MKO10085384_B_Fbxo32
  gRNA
ccauuccaguuacugcaaca

SEQ ID NO: 85385 - RNA, 20 nt, Artificial Sequence
  MKO10085385_B_Fbxo32
  gRNA
uagacuuccaucaagaaaag

SEQ ID NO: 85386 - RNA, 20 nt, Artificial Sequence
  MKO10085386_B_Fbxo32
  gRNA
aaaugacuuacacugaguuu

SEQ ID NO: 85387 - RNA, 20 nt, Artificial Sequence
  MKO10085387_B_Fbxo33
  gRNA
aguacagaaccuuauugagc

SEQ ID NO: 85388 - RNA, 20 nt, Artificial Sequence
  MKO10085388_B_Fbxo33
  gRNA
caaccgaaacgaagauccau

SEQ ID NO: 85389 - RNA, 20 nt, Artificial Sequence
  MKO10085389_B_Fbxo33
  gRNA
agcuacgucacuugugucuc

SEQ ID NO: 85390 - RNA, 20 nt, Artificial Sequence
  MKO10085390_B_Fbxo34
  gRNA
accaggagcucagcgcugag

SEQ ID NO: 85391 - RNA, 20 nt, Artificial Sequence
  MKO10085391_B_Fbxo34
  gRNA
gccgcucagcgcugagcucc

SEQ ID NO: 85392 - RNA, 20 nt, Artificial Sequence
  MKO10085392_B_Fbxo34
  gRNA
gcaauccauaagaagacgag

SEQ ID NO: 85393 - RNA, 20 nt, Artificial Sequence
  MKO10085393_B_Fbxo36
  gRNA
gaguccgggugaucaacaac

SEQ ID NO: 85394 - RNA, 20 nt, Artificial Sequence
  MKO10085394_B_Fbxo36
  gRNA
ccuuggcgaaaaacaugggc

SEQ ID NO: 85395 - RNA, 20 nt, Artificial Sequence
  MKO10085395_B_Fbxo36
  gRNA
cuuggagaugagaguuaucu

SEQ ID NO: 85396 - RNA, 20 nt, Artificial Sequence
  MKO10085396_B_Fbxo38
  gRNA
aaguucgcaagcugaugcaa

SEQ ID NO: 85397 - RNA, 20 nt, Artificial Sequence
  MKO10085397_B_Fbxo38
  gRNA
accuagguaccugccacuac

SEQ ID NO: 85398 - RNA, 20 nt, Artificial Sequence
  MKO10085398_B_Fbxo38
  gRNA
gucucacccacuucauguac

SEQ ID NO: 85399 - RNA, 20 nt, Artificial Sequence
  MKO10085399_B_Fbxo39
  gRNA
gcuccacaaacuuaacgucc

SEQ ID NO: 85400 - RNA, 20 nt, Artificial Sequence
  MKO10085400_B_Fbxo39
  gRNA
ggacccuacgggaaauuuac

SEQ ID NO: 85401 - RNA, 20 nt, Artificial Sequence
  MKO10085401_B_Fbxo39
  gRNA
auuuccuguaaauuucccgu

SEQ ID NO: 85402 - RNA, 20 nt, Artificial Sequence
  MKO10085402_B_Fbxo3
  gRNA
cgagacggggcugcugaccc

SEQ ID NO: 85403 - RNA, 20 nt, Artificial Sequence
  MKO10085403_B_Fbxo3
  gRNA
guaccuccccacgucugagu

SEQ ID NO: 85404 - RNA, 20 nt, Artificial Sequence
  MKO10085404_B_Fbxo3
  gRNA
augauuaucgcuguucauac

SEQ ID NO: 85405 - RNA, 20 nt, Artificial Sequence
  MKO10085405_B_Fbxo40
  gRNA
uuccgcuccacgauguugaa

SEQ ID NO: 85406 - RNA, 20 nt, Artificial Sequence
  MKO10085406_B_Fbxo40
  gRNA
accagccaucgagacucgac

SEQ ID NO: 85407 - RNA, 20 nt, Artificial Sequence
  MKO10085407_B_Fbxo40
  gRNA
gaugccugcuuguacgccca

SEQ ID NO: 85408 - RNA, 20 nt, Artificial Sequence
  MKO10085408_B_Fbxo41
  gRNA
cgucuuaggccugaacuacg

SEQ ID NO: 85409 - RNA, 20 nt, Artificial Sequence
  MKO10085409_B_Fbxo41
  gRNA
cgugauacggcguaugugcu

SEQ ID NO: 85410 - RNA, 20 nt, Artificial Sequence
  MKO10085410_B_Fbxo41
  gRNA
cccgagcugccgucuccuuc

SEQ ID NO: 85411 - RNA, 20 nt, Artificial Sequence
  MKO10085411_B_Fbxo42
  gRNA
guccuuguacacgaccagag

SEQ ID NO: 85412 - RNA, 20 nt, Artificial Sequence
  MKO10085412_B_Fbxo42
  gRNA
aacugcauugucaccacgca

SEQ ID NO: 85413 - RNA, 20 nt, Artificial Sequence
  MKO10085413_B_Fbxo42
  gRNA
uucccggauaaggguaaguc

SEQ ID NO: 85414 - RNA, 20 nt, Artificial Sequence
  MKO10085414_B_Fbxo43
  gRNA
acuguuccuguuuacuccgu

SEQ ID NO: 85415 - RNA, 20 nt, Artificial Sequence
  MKO10085415_B_Fbxo43
  gRNA
uuaugucugugcgcuuauca

SEQ ID NO: 85416 - RNA, 20 nt, Artificial Sequence
  MKO10085416_B_Fbxo43
  gRNA
uuagcaggggauuggcaccu

SEQ ID NO: 85417 - RNA, 20 nt, Artificial Sequence
  MKO10085417_B_Fbxo44
  gRNA
cuggcgagaccucauugacc

SEQ ID NO: 85418 - RNA, 20 nt, Artificial Sequence
  MKO10085418_B_Fbxo44
  gRNA
ugguacuuggacccgcaguc

SEQ ID NO: 85419 - RNA, 20 nt, Artificial Sequence
  MKO10085419_B_Fbxo44
  gRNA
aggcguggacacucacuacu

SEQ ID NO: 85420 - RNA, 20 nt, Artificial Sequence
  MKO10085420_B_Fbxo45
  gRNA
caacaacgcaccaaaguauc

SEQ ID NO: 85421 - RNA, 20 nt, Artificial Sequence
  MKO10085421_B_Fbxo45
  gRNA
uuccuggggguugccuuucg

SEQ ID NO: 85422 - RNA, 20 nt, Artificial Sequence
  MKO10085422_B_Fbxo45
  gRNA
agagagaauccgagucaucc

SEQ ID NO: 85423 - RNA, 20 nt, Artificial Sequence
  MKO10085423_B_Fbxo46
  gRNA
uggggcgcggauaacucugc

SEQ ID NO: 85424 - RNA, 20 nt, Artificial Sequence
  MKO10085424_B_Fbxo46
  gRNA
cgugugacacaugccgguac

SEQ ID NO: 85425 - RNA, 20 nt, Artificial Sequence
  MKO10085425_B_Fbxo46
  gRNA
gauaagcugguacaagucgc

SEQ ID NO: 85426 - RNA, 20 nt, Artificial Sequence
  MKO10085426_B_Fbxo47
  gRNA
uuucaugaccuugaucugcc

SEQ ID NO: 85427 - RNA, 20 nt, Artificial Sequence
  MKO10085427_B_Fbxo47
  gRNA
aauuauaucucaacaucauc

SEQ ID NO: 85428 - RNA, 20 nt, Artificial Sequence
  MKO10085428_B_Fbxo47
  gRNA
guauccugcuuuaaauucag

SEQ ID NO: 85429 - RNA, 20 nt, Artificial Sequence
  MKO10085429_B_Fbxo48
  gRNA
cccccacguaucugcaucca

SEQ ID NO: 85430 - RNA, 20 nt, Artificial Sequence
  MKO10085430_B_Fbxo48
  gRNA
auuccaaccugugcaugucc

SEQ ID NO: 85431 - RNA, 20 nt, Artificial Sequence
  MKO10085431_B_Fbxo48
  gRNA
auaaacucugaaugucuagc

SEQ ID NO: 85432 - RNA, 20 nt, Artificial Sequence
  MKO10085432_B_Fbxo4
  gRNA
gaacaucuuguuaacggugc

SEQ ID NO: 85433 - RNA, 20 nt, Artificial Sequence
  MKO10085433_B_Fbxo4
  gRNA
aaagccagccguccuaugua

SEQ ID NO: 85434 - RNA, 20 nt, Artificial Sequence
  MKO10085434_B_Fbxo4
  gRNA
guaaucaagacaagugcugu

SEQ ID NO: 85435 - RNA, 20 nt, Artificial Sequence
  MKO10085435_B_Fbxo5
  gRNA
ccuggagcaccuagacaucc

SEQ ID NO: 85436 - RNA, 20 nt, Artificial Sequence
  MKO10085436_B_Fbxo5
  gRNA
uugcagucuaaaguucccgc

SEQ ID NO: 85437 - RNA, 20 nt, Artificial Sequence
  MKO10085437_B_Fbxo5
  gRNA
agggaaauuacagcgaacac

SEQ ID NO: 85438 - RNA, 20 nt, Artificial Sequence
  MKO10085438_B_Fbxo6
  gRNA
cucugcggacuacauugucu

SEQ ID NO: 85439 - RNA, 20 nt, Artificial Sequence
  MKO10085439_B_Fbxo6
  gRNA
caaagcugagggcuacugcg

SEQ ID NO: 85440 - RNA, 20 nt, Artificial Sequence
  MKO10085440_B_Fbxo6
  gRNA
ucccccugccagaacucuac

SEQ ID NO: 85441 - RNA, 20 nt, Artificial Sequence
  MKO10085441_B_Fbxo7
  gRNA
uucuacuccagcagcaacgu

SEQ ID NO: 85442 - RNA, 20 nt, Artificial Sequence
  MKO10085442_B_Fbxo7
  gRNA
caucuccugaugcucgaguc

SEQ ID NO: 85443 - RNA, 20 nt, Artificial Sequence
  MKO10085443_B_Fbxo7
  gRNA
caccauacugucaucagucc

SEQ ID NO: 85444 - RNA, 20 nt, Artificial Sequence
  MKO10085444_B_Fbxo8
  gRNA
uacaauaagaacccaccuuu

SEQ ID NO: 85445 - RNA, 20 nt, Artificial Sequence
  MKO10085445_B_Fbxo8
  gRNA
agugagcuacuuuaugucca

SEQ ID NO: 85446 - RNA, 20 nt, Artificial Sequence
  MKO10085446_B_Fbxo8
  gRNA
uaugacaacaucuaccuuau

SEQ ID NO: 85447 - RNA, 20 nt, Artificial Sequence
  MKO10085447_B_Fbxo9
  gRNA
ugccaguuccugucguccuu

SEQ ID NO: 85448 - RNA, 20 nt, Artificial Sequence
  MKO10085448_B_Fbxo9
  gRNA
ccaugacuggagccuacacc

SEQ ID NO: 85449 - RNA, 20 nt, Artificial Sequence
  MKO10085449_B_Fbxo9
  gRNA
caaaauggagcucucuauga

SEQ ID NO: 85450 - RNA, 20 nt, Artificial Sequence
  MKO10085450_B_Fbxw10
  gRNA
gugcccaagauaguagauga

SEQ ID NO: 85451 - RNA, 20 nt, Artificial Sequence
  MKO10085451_B_Fbxw10
  gRNA
aggacaccucauaugucucu

SEQ ID NO: 85452 - RNA, 20 nt, Artificial Sequence
  MKO10085452_B_Fbxw10
  gRNA
aaaagggggcauguccaggc

SEQ ID NO: 85453 - RNA, 20 nt, Artificial Sequence
  MKO10085453_B_Fbxw11
  gRNA
gugcgcacaugcucucuacc

SEQ ID NO: 85454 - RNA, 20 nt, Artificial Sequence
  MKO10085454_B_Fbxw11
  gRNA
uggugcgcaccgacccucuc

SEQ ID NO: 85455 - RNA, 20 nt, Artificial Sequence
  MKO10085455_B_Fbxw11
  gRNA
uggcagcgagugaucucaga

SEQ ID NO: 85456 - RNA, 20 nt, Artificial Sequence
  MKO10085456_B_Fbxw13
  gRNA
ccacgcccugagauauaaca

SEQ ID NO: 85457 - RNA, 20 nt, Artificial Sequence
  MKO10085457_B_Fbxw13
  gRNA
ugaaaucuucucgaauugcc

SEQ ID NO: 85458 - RNA, 20 nt, Artificial Sequence
  MKO10085458_B_Fbxw13
  gRNA
aguucuucguuucccgaaca

SEQ ID NO: 85459 - RNA, 20 nt, Artificial Sequence
  MKO10085459_B_Fbxw14
  gRNA
uugcaagcagugauguccug

SEQ ID NO: 85460 - RNA, 20 nt, Artificial Sequence
  MKO10085460_B_Fbxw14
  gRNA
cagaauuucgggcacaucca

SEQ ID NO: 85461 - RNA, 20 nt, Artificial Sequence
  MKO10085461_B_Fbxw14
  gRNA
acucaccucgugaauauccc

SEQ ID NO: 85462 - RNA, 20 nt, Artificial Sequence
  MKO10085462_B_Fbxw15
  gRNA
ggauaugcauguuauaucuc

SEQ ID NO: 85463 - RNA, 20 nt, Artificial Sequence
  MKO10085463_B_Fbxw15
  gRNA
uugccagcagugauguccug

SEQ ID NO: 85464 - RNA, 20 nt, Artificial Sequence
  MKO10085464_B_Fbxw15
  gRNA
ccuccacaggacaucacugc

SEQ ID NO: 85465 - RNA, 20 nt, Artificial Sequence
  MKO10085465_B_Fbxw16
  gRNA
cuuaugcauauuauaucuca

SEQ ID NO: 85466 - RNA, 20 nt, Artificial Sequence
  MKO10085466_B_Fbxw16
  gRNA
uugccagcagugauguccug

SEQ ID NO: 85467 - RNA, 20 nt, Artificial Sequence
  MKO10085467_B_Fbxw16
  gRNA
ccuccacaggacaucacugc

SEQ ID NO: 85468 - RNA, 20 nt, Artificial Sequence
  MKO10085468_B_Fbxw17
  gRNA
gaagaaggcccacucagacc

SEQ ID NO: 85469 - RNA, 20 nt, Artificial Sequence
  MKO10085469_B_Fbxw17
  gRNA
accuugccccuucaucaaag

SEQ ID NO: 85470 - RNA, 20 nt, Artificial Sequence
  MKO10085470_B_Fbxw17
  gRNA
cagacuguacugugcgugcc

SEQ ID NO: 85471 - RNA, 20 nt, Artificial Sequence
  MKO10085471_B_Fbxw18
  gRNA
cuguaauagcagugaugcuc

SEQ ID NO: 85472 - RNA, 20 nt, Artificial Sequence
  MKO10085472_B_Fbxw18
  gRNA
ccaugaccaagauuuccacc

SEQ ID NO: 85473 - RNA, 20 nt, Artificial Sequence
  MKO10085473_B_Fbxw18
  gRNA
gcauaugcauguuauaucuc

SEQ ID NO: 85474 - RNA, 20 nt, Artificial Sequence
  MKO10085474_B_Fbxw19
  gRNA
guauggugacuuccacgaau

SEQ ID NO: 85475 - RNA, 20 nt, Artificial Sequence
  MKO10085475_B_Fbxw19
  gRNA
uucgaccugggauguucacg

SEQ ID NO: 85476 - RNA, 20 nt, Artificial Sequence
  MKO10085476_B_Fbxw19
  gRNA
ggcguguucuugccauguuc

SEQ ID NO: 85477 - RNA, 20 nt, Artificial Sequence
  MKO10085477_B_Fbxw20
  gRNA
cacagcuuucaguaauuuac

SEQ ID NO: 85478 - RNA, 20 nt, Artificial Sequence
  MKO10085478_B_Fbxw20
  gRNA
gcuuccaugucucugugccc

SEQ ID NO: 85479 - RNA, 20 nt, Artificial Sequence
  MKO10085479_B_Fbxw20
  gRNA
uugcaagcagugauguccug

SEQ ID NO: 85480 - RNA, 20 nt, Artificial Sequence
  MKO10085480_B_Fbxw21
  gRNA
gcauguuauaucucagagca

SEQ ID NO: 85481 - RNA, 20 nt, Artificial Sequence
  MKO10085481_B_Fbxw21
  gRNA
guauggcgacuuccaugaac

SEQ ID NO: 85482 - RNA, 20 nt, Artificial Sequence
  MKO10085482_B_Fbxw21
  gRNA
aguucuucauuuaccgaaca

SEQ ID NO: 85483 - RNA, 20 nt, Artificial Sequence
  MKO10085483_B_Fbxw22
  gRNA
guauggugacuuccgugaac

SEQ ID NO: 85484 - RNA, 20 nt, Artificial Sequence
  MKO10085484_B_Fbxw22
  gRNA
aagcuuauaccaaacuucac

SEQ ID NO: 85485 - RNA, 20 nt, Artificial Sequence
  MKO10085485_B_Fbxw22
  gRNA
auggucacccuaccgcucca

SEQ ID NO: 85486 - RNA, 20 nt, Artificial Sequence
  MKO10085486_B_Fbxw24
  gRNA
gucaacaacuugaugcuugc

SEQ ID NO: 85487 - RNA, 20 nt, Artificial Sequence
  MKO10085487_B_Fbxw24
  gRNA
aguucuuuguuuaccgaaca

SEQ ID NO: 85488 - RNA, 20 nt, Artificial Sequence
  MKO10085488_B_Fbxw24
  gRNA
uugcaagcaaugauuuccug

SEQ ID NO: 85489 - RNA, 20 nt, Artificial Sequence
  MKO10085489_B_Fbxw26
  gRNA
aguucuucguuuaccgaacc

SEQ ID NO: 85490 - RNA, 20 nt, Artificial Sequence
  MKO10085490_B_Fbxw26
  gRNA
gcauauuauaucucaaaaca

SEQ ID NO: 85491 - RNA, 20 nt, Artificial Sequence
  MKO10085491_B_Fbxw26
  gRNA
uugcaagcagugauguccug

SEQ ID NO: 85492 - RNA, 20 nt, Artificial Sequence
  MKO10085492_B_Fbxw28
  gRNA
ggaugccuacaguuugcuac

SEQ ID NO: 85493 - RNA, 20 nt, Artificial Sequence
  MKO10085493_B_Fbxw28
  gRNA
uugcaagcagugauguccug

SEQ ID NO: 85494 - RNA, 20 nt, Artificial Sequence
  MKO10085494_B_Fbxw28
  gRNA
ggaaguugugucagaagaga

SEQ ID NO: 85495 - RNA, 20 nt, Artificial Sequence
  MKO10085495_B_Fbxw2
  gRNA
uaugcccagugaguguauuc

SEQ ID NO: 85496 - RNA, 20 nt, Artificial Sequence
  MKO10085496_B_Fbxw2
  gRNA
uugacaacacuguggccugc

SEQ ID NO: 85497 - RNA, 20 nt, Artificial Sequence
  MKO10085497_B_Fbxw2
  gRNA
cacccgcccccgugugcccc

SEQ ID NO: 85498 - RNA, 20 nt, Artificial Sequence
  MKO10085498_B_Fbxw4
  gRNA
ggcuggggcgcugccgagau

SEQ ID NO: 85499 - RNA, 20 nt, Artificial Sequence
  MKO10085499_B_Fbxw4
  gRNA
auggugcaagcuugaaccga

SEQ ID NO: 85500 - RNA, 20 nt, Artificial Sequence
  MKO10085500_B_Fbxw4
  gRNA
gucucccuuaccugaguaau

SEQ ID NO: 85501 - RNA, 20 nt, Artificial Sequence
  MKO10085501_B_Fbxw5
  gRNA
guaccaugucauagagccgc

SEQ ID NO: 85502 - RNA, 20 nt, Artificial Sequence
  MKO10085502_B_Fbxw5
  gRNA
caccuucaccgugcaguccu

SEQ ID NO: 85503 - RNA, 20 nt, Artificial Sequence
  MKO10085503_B_Fbxw5
  gRNA
gaugacagcuaucucgccug

SEQ ID NO: 85504 - RNA, 20 nt, Artificial Sequence
  MKO10085504_B_Fbxw7
  gRNA
uugucgauacuggagaauuu

SEQ ID NO: 85505 - RNA, 20 nt, Artificial Sequence
  MKO10085505_B_Fbxw7
  gRNA
caucuccuugcuuccuaaag

SEQ ID NO: 85506 - RNA, 20 nt, Artificial Sequence
  MKO10085506_B_Fbxw7
  gRNA
agaugaagucucgcuggaac

SEQ ID NO: 85507 - RNA, 20 nt, Artificial Sequence
  MKO10085507_B_Fbxw8
  gRNA
uaccggcugugccgacagga

SEQ ID NO: 85508 - RNA, 20 nt, Artificial Sequence
  MKO10085508_B_Fbxw8
  gRNA
caaaggugccgugagcgagc

SEQ ID NO: 85509 - RNA, 20 nt, Artificial Sequence
  MKO10085509_B_Fbxw8
  gRNA
uucucuuccagauacacguc

SEQ ID NO: 85510 - RNA, 20 nt, Artificial Sequence
  MKO10085510_B_Fbxw9
  gRNA
gagcagcaacaccgcaucaa

SEQ ID NO: 85511 - RNA, 20 nt, Artificial Sequence
  MKO10085511_B_Fbxw9
  gRNA
ugucauagguaccagucacc

SEQ ID NO: 85512 - RNA, 20 nt, Artificial Sequence
  MKO10085512_B_Fbxw9
  gRNA
gcggcugaugggcagcaguu

SEQ ID NO: 85513 - RNA, 20 nt, Artificial Sequence
  MKO10085513_B_Fcamr
  gRNA
caggacccaucucuacaaug

SEQ ID NO: 85514 - RNA, 20 nt, Artificial Sequence
  MKO10085514_B_Fcamr
  gRNA
gugcuuccacauuguagaga

SEQ ID NO: 85515 - RNA, 20 nt, Artificial Sequence
  MKO10085515_B_Fcamr
  gRNA
agcuaagcccagugaacaaa

SEQ ID NO: 85516 - RNA, 20 nt, Artificial Sequence
  MKO10085516_B_Fcer1a
  gRNA
ccacaaugguaccgucucug

SEQ ID NO: 85517 - RNA, 20 nt, Artificial Sequence
  MKO10085517_B_Fcer1a
  gRNA
gcucuugaugucauucugac

SEQ ID NO: 85518 - RNA, 20 nt, Artificial Sequence
  MKO10085518_B_Fcer1a
  gRNA
aacagaaucgccaccaacaa

SEQ ID NO: 85519 - RNA, 20 nt, Artificial Sequence
  MKO10085519_B_Fcer1g
  gRNA
cuguucugaagcuacugggg

SEQ ID NO: 85520 - RNA, 20 nt, Artificial Sequence
  MKO10085520_B_Fcer1g
  gRNA
ggcuggcuauagcugccuuu

SEQ ID NO: 85521 - RNA, 20 nt, Artificial Sequence
  MKO10085521_B_Fcer1g
  gRNA
ucagagucucauaugucucc

SEQ ID NO: 85522 - RNA, 20 nt, Artificial Sequence
  MKO10085522_B_Fcer2a
  gRNA
cuggcucacccugggacuuc

SEQ ID NO: 85523 - RNA, 20 nt, Artificial Sequence
  MKO10085523_B_Fcer2a
  gRNA
cuucccccuagacugggaaa

SEQ ID NO: 85524 - RNA, 20 nt, Artificial Sequence
  MKO10085524_B_Fcer2a
  gRNA
ucauuugcuucuguucagcu

SEQ ID NO: 85525 - RNA, 20 nt, Artificial Sequence
  MKO10085525_B_Fcf1
  gRNA
uuugcaguaaagaaaaggau

SEQ ID NO: 85526 - RNA, 20 nt, Artificial Sequence
  MKO10085526_B_Fcf1
  gRNA
aggggaagcaaaagaaaaca

SEQ ID NO: 85527 - RNA, 20 nt, Artificial Sequence
  MKO10085527_B_Fcf1
  gRNA
ucucuuuccuucagcgcgcu

SEQ ID NO: 85528 - RNA, 20 nt, Artificial Sequence
  MKO10085528_B_Fcgbp
  gRNA
gaagauucagguguaccgcc

SEQ ID NO: 85529 - RNA, 20 nt, Artificial Sequence
  MKO10085529_B_Fcgbp
  gRNA
uacaagggagaccgucucug

SEQ ID NO: 85530 - RNA, 20 nt, Artificial Sequence
  MKO10085530_B_Fcgbp
  gRNA
acauugcagcgcucaccacu

SEQ ID NO: 85531 - RNA, 20 nt, Artificial Sequence
  MKO10085531_B_Fcgr1
  gRNA
ucacccacuuccccaccgac

SEQ ID NO: 85532 - RNA, 20 nt, Artificial Sequence
  MKO10085532_B_Fcgr1
  gRNA
ugggaugcuauaacuaggcg

SEQ ID NO: 85533 - RNA, 20 nt, Artificial Sequence
  MKO10085533_B_Fcgr1
  gRNA
agacaccgcuacacaucugc

SEQ ID NO: 85534 - RNA, 20 nt, Artificial Sequence
  MKO10085534_B_Fcgr2b
  gRNA
cggcuguccacaguagcaua

SEQ ID NO: 85535 - RNA, 20 nt, Artificial Sequence
  MKO10085535_B_Fcgr2b
  gRNA
ccacuuaccuuggacaguga

SEQ ID NO: 85536 - RNA, 20 nt, Artificial Sequence
  MKO10085536_B_Fcgr2b
  gRNA
acuguagugaugauaccuca

SEQ ID NO: 85537 - RNA, 20 nt, Artificial Sequence
  MKO10085537_B_Fcgr3
  gRNA
uggugaaacuggacccccca

SEQ ID NO: 85538 - RNA, 20 nt, Artificial Sequence
  MKO10085538_B_Fcgr3
  gRNA
ccuuccagaaacacccgcug

SEQ ID NO: 85539 - RNA, 20 nt, Artificial Sequence
  MKO10085539_B_Fcgr3
  gRNA
uuuguagugaugauaccuca

SEQ ID NO: 85540 - RNA, 20 nt, Artificial Sequence
  MKO10085540_B_Fcgr4
  gRNA
gaugaauggggucccccucc

SEQ ID NO: 85541 - RNA, 20 nt, Artificial Sequence
  MKO10085541_B_Fcgr4
  gRNA
cuccauccauguuuccaccg

SEQ ID NO: 85542 - RNA, 20 nt, Artificial Sequence
  MKO10085542_B_Fcgr4
  gRNA
acccaagauucaauggagca

SEQ ID NO: 85543 - RNA, 20 nt, Artificial Sequence
  MKO10085543_B_Fcgrt
  gRNA
cugaggcuagcccauugcgc

SEQ ID NO: 85544 - RNA, 20 nt, Artificial Sequence
  MKO10085544_B_Fcgrt
  gRNA
aggaugcgcagcggucugcc

SEQ ID NO: 85545 - RNA, 20 nt, Artificial Sequence
  MKO10085545_B_Fcgrt
  gRNA
gccgugagaugauacaucag

SEQ ID NO: 85546 - RNA, 20 nt, Artificial Sequence
  MKO10085546_B_Fcho1
  gRNA
cuuaaggaugugcugcgcua

SEQ ID NO: 85547 - RNA, 20 nt, Artificial Sequence
  MKO10085547_B_Fcho1
  gRNA
cgaguaugucuccucgaugu

SEQ ID NO: 85548 - RNA, 20 nt, Artificial Sequence
  MKO10085548_B_Fcho1
  gRNA
gaugcagugcagauguuguc

SEQ ID NO: 85549 - RNA, 20 nt, Artificial Sequence
  MKO10085549_B_Fcho2
  gRNA
uaacagagcuacaauagaag

SEQ ID NO: 85550 - RNA, 20 nt, Artificial Sequence
  MKO10085550_B_Fcho2
  gRNA
ucuguccaugcuucauauua

SEQ ID NO: 85551 - RNA, 20 nt, Artificial Sequence
  MKO10085551_B_Fcho2
  gRNA
cuguaccauaauaugaagca

SEQ ID NO: 85552 - RNA, 20 nt, Artificial Sequence
  MKO10085552_B_Fchsd1
  gRNA
gcagccauugaacgggagua

SEQ ID NO: 85553 - RNA, 20 nt, Artificial Sequence
  MKO10085553_B_Fchsd1
  gRNA
aaaagcgaaguuuaaccucc

SEQ ID NO: 85554 - RNA, 20 nt, Artificial Sequence
  MKO10085554_B_Fchsd1
  gRNA
auggcccagccagcuucugg

SEQ ID NO: 85555 - RNA, 20 nt, Artificial Sequence
  MKO10085555_B_Fchsd2
  gRNA
uauugaaagagaguaugcac

SEQ ID NO: 85556 - RNA, 20 nt, Artificial Sequence
  MKO10085556_B_Fchsd2
  gRNA
gucaauaccugaagagagau

SEQ ID NO: 85557 - RNA, 20 nt, Artificial Sequence
  MKO10085557_B_Fchsd2
  gRNA
gucacauucugccugauguu

SEQ ID NO: 85558 - RNA, 20 nt, Artificial Sequence
  MKO10085558_B_Fcna
  gRNA
uacaggagaacggggcuuuc

SEQ ID NO: 85559 - RNA, 20 nt, Artificial Sequence
  MKO10085559_B_Fcna
  gRNA
ccaggaaagaugggaccugc

SEQ ID NO: 85560 - RNA, 20 nt, Artificial Sequence
  MKO10085560_B_Fcna
  gRNA
cuaggcucaccuuuaacucc

SEQ ID NO: 85561 - RNA, 20 nt, Artificial Sequence
  MKO10085561_B_Fcnb
  gRNA
agaacugaagguccuagauc

SEQ ID NO: 85562 - RNA, 20 nt, Artificial Sequence
  MKO10085562_B_Fcnb
  gRNA
cccucucagucaugugcuac

SEQ ID NO: 85563 - RNA, 20 nt, Artificial Sequence
  MKO10085563_B_Fcnb
  gRNA
ccuggaaaagaaggaccaac

SEQ ID NO: 85564 - RNA, 20 nt, Artificial Sequence
  MKO10085564_B_Fcrl1
  gRNA
gcucuaccgugugaaccugc

SEQ ID NO: 85565 - RNA, 20 nt, Artificial Sequence
  MKO10085565_B_Fcrl1
  gRNA
cugggaauauaacuuacuuc

SEQ ID NO: 85566 - RNA, 20 nt, Artificial Sequence
  MKO10085566_B_Fcrl1
  gRNA
gccugguccucaugcuaccu

SEQ ID NO: 85567 - RNA, 20 nt, Artificial Sequence
  MKO10085567_B_Fcrl5
  gRNA
uauucaucgugcaaaucuga

SEQ ID NO: 85568 - RNA, 20 nt, Artificial Sequence
  MKO10085568_B_Fcrl5
  gRNA
ucaccaugcuguccauugac

SEQ ID NO: 85569 - RNA, 20 nt, Artificial Sequence
  MKO10085569_B_Fcrl5
  gRNA
acagauguggcugacucuac

SEQ ID NO: 85570 - RNA, 20 nt, Artificial Sequence
  MKO10085570_B_Fcrl6
  gRNA
uagcauguugcucuugaucc

SEQ ID NO: 85571 - RNA, 20 nt, Artificial Sequence
  MKO10085571_B_Fcrl6
  gRNA
ugagcucaagaaguuccccu

SEQ ID NO: 85572 - RNA, 20 nt, Artificial Sequence
  MKO10085572_B_Fcrl6
  gRNA
agagcaacaugcuaccuauc

SEQ ID NO: 85573 - RNA, 20 nt, Artificial Sequence
  MKO10085573_B_Fcrla
  gRNA
accuucuagugagccccaag

SEQ ID NO: 85574 - RNA, 20 nt, Artificial Sequence
  MKO10085574_B_Fcrla
  gRNA
guuacugagccucccucuug

SEQ ID NO: 85575 - RNA, 20 nt, Artificial Sequence
  MKO10085575_B_Fcrla
  gRNA
uuccaucucagcguguccua

SEQ ID NO: 85576 - RNA, 20 nt, Artificial Sequence
  MKO10085576_B_Fcrlb
  gRNA
ucgcccaccuugcacgguca

SEQ ID NO: 85577 - RNA, 20 nt, Artificial Sequence
  MKO10085577_B_Fcrlb
  gRNA
guguaucgaugucagacacg

SEQ ID NO: 85578 - RNA, 20 nt, Artificial Sequence
  MKO10085578_B_Fcrlb
  gRNA
cauuagcacucucugguacc

SEQ ID NO: 85579 - RNA, 20 nt, Artificial Sequence
  MKO10085579_B_Fcrls
  gRNA
gugcuucaagcuacaccauu

SEQ ID NO: 85580 - RNA, 20 nt, Artificial Sequence
  MKO10085580_B_Fcrls
  gRNA
uccagcccgauugcaaagug

SEQ ID NO: 85581 - RNA, 20 nt, Artificial Sequence
  MKO10085581_B_Fcrls
  gRNA
ggcuccccuucaacgaccag

SEQ ID NO: 85582 - RNA, 20 nt, Artificial Sequence
  MKO10085582_B_Fdft1
  gRNA
aaccuugucccaguccuguu

SEQ ID NO: 85583 - RNA, 20 nt, Artificial Sequence
  MKO10085583_B_Fdft1
  gRNA
cucucagugaaccgccacuc

SEQ ID NO: 85584 - RNA, 20 nt, Artificial Sequence
  MKO10085584_B_Fdft1
  gRNA
cugccaucccacaccccauc

SEQ ID NO: 85585 - RNA, 20 nt, Artificial Sequence
  MKO10085585_B_Fdps
  gRNA
ccugcagaaagagcuccagc

SEQ ID NO: 85586 - RNA, 20 nt, Artificial Sequence
  MKO10085586_B_Fdps
  gRNA
guccuagaguacaaugccuu

SEQ ID NO: 85587 - RNA, 20 nt, Artificial Sequence
  MKO10085587_B_Fdps
  gRNA
ccuugugucagaugacauca

SEQ ID NO: 85588 - RNA, 20 nt, Artificial Sequence
  MKO10085588_B_Fdx1l
  gRNA
uaccuuccagguccaccccg

SEQ ID NO: 85589 - RNA, 20 nt, Artificial Sequence
  MKO10085589_B_Fdx1l
  gRNA
acaggccagggaugcuucgc

SEQ ID NO: 85590 - RNA, 20 nt, Artificial Sequence
  MKO10085590_B_Fdx1l
  gRNA
aauucaacucccucuagcuc

SEQ ID NO: 85591 - RNA, 20 nt, Artificial Sequence
  MKO10085591_B_Fdx1
  gRNA
gagaacaacuuagauaucga

SEQ ID NO: 85592 - RNA, 20 nt, Artificial Sequence
  MKO10085592_B_Fdx1
  gRNA
uuuccuuacaggucaagguu

SEQ ID NO: 85593 - RNA, 20 nt, Artificial Sequence
  MKO10085593_B_Fdx1
  gRNA
agucauauuguccauagccu

SEQ ID NO: 85594 - RNA, 20 nt, Artificial Sequence
  MKO10085594_B_Fdxacb1
  gRNA
acuaacgucaugcacauagc

SEQ ID NO: 85595 - RNA, 20 nt, Artificial Sequence
  MKO10085595_B_Fdxacb1
  gRNA
uacccagugcacuuguaucc

SEQ ID NO: 85596 - RNA, 20 nt, Artificial Sequence
  MKO10085596_B_Fdxacb1
  gRNA
agcucucaaaggguaagcuc

SEQ ID NO: 85597 - RNA, 20 nt, Artificial Sequence
  MKO10085597_B_Fdxr
  gRNA
gcuucucguagaugucuacg

SEQ ID NO: 85598 - RNA, 20 nt, Artificial Sequence
  MKO10085598_B_Fdxr
  gRNA
ucgggaagccuaccaugcug

SEQ ID NO: 85599 - RNA, 20 nt, Artificial Sequence
  MKO10085599_B_Fdxr
  gRNA
cugccagaaguucuccacac

SEQ ID NO: 85600 - RNA, 20 nt, Artificial Sequence
  MKO10085600_B_Fech
  gRNA
gaugaguuauccccugccac

SEQ ID NO: 85601 - RNA, 20 nt, Artificial Sequence
  MKO10085601_B_Fech
  gRNA
gugguggagcagcuauacug

SEQ ID NO: 85602 - RNA, 20 nt, Artificial Sequence
  MKO10085602_B_Fech
  gRNA
cguccauccccugacagaag

SEQ ID NO: 85603 - RNA, 20 nt, Artificial Sequence
  MKO10085603_B_Fem1a
  gRNA
agcggcuccgugcacuucga

SEQ ID NO: 85604 - RNA, 20 nt, Artificial Sequence
  MKO10085604_B_Fem1a
  gRNA
ggcgauggaacuccgucacc

SEQ ID NO: 85605 - RNA, 20 nt, Artificial Sequence
  MKO10085605_B_Fem1a
  gRNA
cacacgauaccggcccacgu

SEQ ID NO: 85606 - RNA, 20 nt, Artificial Sequence
  MKO10085606_B_Fem1b
  gRNA
aaauccguucccgaacuaua

SEQ ID NO: 85607 - RNA, 20 nt, Artificial Sequence
  MKO10085607_B_Fem1b
  gRNA
gauguaccuacccgucgaag

SEQ ID NO: 85608 - RNA, 20 nt, Artificial Sequence
  MKO10085608_B_Fem1b
  gRNA
uguuguacuggacgauaaug

SEQ ID NO: 85609 - RNA, 20 nt, Artificial Sequence
  MKO10085609_B_Fem1c
  gRNA
uuaagcgaugcaucaaccua

SEQ ID NO: 85610 - RNA, 20 nt, Artificial Sequence
  MKO10085610_B_Fem1c
  gRNA
ucgagggggcccccccuuua

SEQ ID NO: 85611 - RNA, 20 nt, Artificial Sequence
  MKO10085611_B_Fem1c
  gRNA
gggcucuguuaacuuugacg

SEQ ID NO: 85612 - RNA, 20 nt, Artificial Sequence
  MKO10085612_B_Fen1
  gRNA
gcggcugaguaagagccgcc

SEQ ID NO: 85613 - RNA, 20 nt, Artificial Sequence
  MKO10085613_B_Fen1
  gRNA
uugccaucaaagacguacac

SEQ ID NO: 85614 - RNA, 20 nt, Artificial Sequence
  MKO10085614_B_Fen1
  gRNA
ccaucugagccgcguccugc

SEQ ID NO: 85615 - RNA, 20 nt, Artificial Sequence
  MKO10085615_B_Fer1l4
  gRNA
guccacuuaccggggacacc

SEQ ID NO: 85616 - RNA, 20 nt, Artificial Sequence
  MKO10085616_B_Fer1l4
  gRNA
gcugcugcagcgaaaucacc

SEQ ID NO: 85617 - RNA, 20 nt, Artificial Sequence
  MKO10085617_B_Fer1l4
  gRNA
ccuguuccuagcuguuucgu

SEQ ID NO: 85618 - RNA, 20 nt, Artificial Sequence
  MKO10085618_B_Fer1l5
  gRNA
cuuugugccagccgcuugag

SEQ ID NO: 85619 - RNA, 20 nt, Artificial Sequence
  MKO10085619_B_Fer1l5
  gRNA
uaugaugaaaagaacucgag

SEQ ID NO: 85620 - RNA, 20 nt, Artificial Sequence
  MKO10085620_B_Fer1l5
  gRNA
guguacugucacccuacaug

SEQ ID NO: 85621 - RNA, 20 nt, Artificial Sequence
  MKO10085621_B_Ferd3l
  gRNA
cuucgaccagcugcgcagaa

SEQ ID NO: 85622 - RNA, 20 nt, Artificial Sequence
  MKO10085622_B_Ferd3l
  gRNA
ccaacauucgcgagaggaag

SEQ ID NO: 85623 - RNA, 20 nt, Artificial Sequence
  MKO10085623_B_Ferd3l
  gRNA
cagucucuucucauaagcga

SEQ ID NO: 85624 - RNA, 20 nt, Artificial Sequence
  MKO10085624_B_Fermt1
  gRNA
ugucaaccaaagaucgaggc

SEQ ID NO: 85625 - RNA, 20 nt, Artificial Sequence
  MKO10085625_B_Fermt1
  gRNA
aacaugucggcaaggacauc

SEQ ID NO: 85626 - RNA, 20 nt, Artificial Sequence
  MKO10085626_B_Fermt1
  gRNA
ccugaaugcuuugcuccaua

SEQ ID NO: 85627 - RNA, 20 nt, Artificial Sequence
  MKO10085627_B_Fermt2
  gRNA
ugaagacgaagcgcuugagc

SEQ ID NO: 85628 - RNA, 20 nt, Artificial Sequence
  MKO10085628_B_Fermt2
  gRNA
cuucucugaccgagucuuca

SEQ ID NO: 85629 - RNA, 20 nt, Artificial Sequence
  MKO10085629_B_Fermt2
  gRNA
cuuggcugcuuaagacacac

SEQ ID NO: 85630 - RNA, 20 nt, Artificial Sequence
  MKO10085630_B_Fermt3
  gRNA
cagcuaagacaaccuuuguc

SEQ ID NO: 85631 - RNA, 20 nt, Artificial Sequence
  MKO10085631_B_Fermt3
  gRNA
guggcacccacuuuauucag

SEQ ID NO: 85632 - RNA, 20 nt, Artificial Sequence
  MKO10085632_B_Fermt3
  gRNA
ucgcagccaaagcacauccc

SEQ ID NO: 85633 - RNA, 20 nt, Artificial Sequence
  MKO10085633_B_Fert2
  gRNA
ggccccuggcggagcaugac

SEQ ID NO: 85634 - RNA, 20 nt, Artificial Sequence
  MKO10085634_B_Fert2
  gRNA
ucuauucgucauucaauugc

SEQ ID NO: 85635 - RNA, 20 nt, Artificial Sequence
  MKO10085635_B_Fert2
  gRNA
cuccgcccuaccuuugggau

SEQ ID NO: 85636 - RNA, 20 nt, Artificial Sequence
  MKO10085636_B_Fes
  gRNA
ccugggugcuaucucguacc

SEQ ID NO: 85637 - RNA, 20 nt, Artificial Sequence
  MKO10085637_B_Fes
  gRNA
caggcagcaugaaccggugg

SEQ ID NO: 85638 - RNA, 20 nt, Artificial Sequence
  MKO10085638_B_Fes
  gRNA
ccugguacgagauagcaccc

SEQ ID NO: 85639 - RNA, 20 nt, Artificial Sequence
  MKO10085639_B_Fetub
  gRNA
ugaacucgucaaagucacca

SEQ ID NO: 85640 - RNA, 20 nt, Artificial Sequence
  MKO10085640_B_Fetub
  gRNA
cacagaaggacugcaaaccg

SEQ ID NO: 85641 - RNA, 20 nt, Artificial Sequence
  MKO10085641_B_Fetub
  gRNA
accgacucauagaacauccu

SEQ ID NO: 85642 - RNA, 20 nt, Artificial Sequence
  MKO10085642_B_Fev
  gRNA
gccgcagaucccgucggaga

SEQ ID NO: 85643 - RNA, 20 nt, Artificial Sequence
  MKO10085643_B_Fev
  gRNA
ccggcagcgaugagacagag

SEQ ID NO: 85644 - RNA, 20 nt, Artificial Sequence
  MKO10085644_B_Fev
  gRNA
cugaucaacauguaccugcc

SEQ ID NO: 85645 - RNA, 20 nt, Artificial Sequence
  MKO10085645_B_Fez1
  gRNA
auaggaccaguuguuguuga

SEQ ID NO: 85646 - RNA, 20 nt, Artificial Sequence
  MKO10085646_B_Fez1
  gRNA
uggaggagaaaucucauccc

SEQ ID NO: 85647 - RNA, 20 nt, Artificial Sequence
  MKO10085647_B_Fez1
  gRNA
ccuucuacagauucaugaga

SEQ ID NO: 85648 - RNA, 20 nt, Artificial Sequence
  MKO10085648_B_Fez2
  gRNA
agaugaacucgaguucgaga

SEQ ID NO: 85649 - RNA, 20 nt, Artificial Sequence
  MKO10085649_B_Fez2
  gRNA
gcaaaugcaagguccuugua

SEQ ID NO: 85650 - RNA, 20 nt, Artificial Sequence
  MKO10085650_B_Fez2
  gRNA
cacuuaccccuuucuccgag

SEQ ID NO: 85651 - RNA, 20 nt, Artificial Sequence
  MKO10085651_B_Fezf1
  gRNA
uaacuuaacccgucacaugc

SEQ ID NO: 85652 - RNA, 20 nt, Artificial Sequence
  MKO10085652_B_Fezf1
  gRNA
cagccuacauugccgccucc

SEQ ID NO: 85653 - RNA, 20 nt, Artificial Sequence
  MKO10085653_B_Fezf1
  gRNA
cacacauacccgaauucacg

SEQ ID NO: 85654 - RNA, 20 nt, Artificial Sequence
  MKO10085654_B_Fezf2
  gRNA
gcuuguagcccgcguggaug

SEQ ID NO: 85655 - RNA, 20 nt, Artificial Sequence
  MKO10085655_B_Fezf2
  gRNA
gcaaaaaccuuugccgcaag

SEQ ID NO: 85656 - RNA, 20 nt, Artificial Sequence
  MKO10085656_B_Fezf2
  gRNA
gccacaaaacucgcagacga

SEQ ID NO: 85657 - RNA, 20 nt, Artificial Sequence
  MKO10085657_B_Ffar1
  gRNA
cugcccugagcuuccguuug

SEQ ID NO: 85658 - RNA, 20 nt, Artificial Sequence
  MKO10085658_B_Ffar1
  gRNA
cacuuugcuccccucuacgc

SEQ ID NO: 85659 - RNA, 20 nt, Artificial Sequence
  MKO10085659_B_Ffar1
  gRNA
aguuucauaaacccggaccu

SEQ ID NO: 85660 - RNA, 20 nt, Artificial Sequence
  MKO10085660_B_Ffar2
  gRNA
aguucucguagcagguuauu

SEQ ID NO: 85661 - RNA, 20 nt, Artificial Sequence
  MKO10085661_B_Ffar2
  gRNA
gucagcgcgcacacgaucuu

SEQ ID NO: 85662 - RNA, 20 nt, Artificial Sequence
  MKO10085662_B_Ffar2
  gRNA
gucgccucugagccccaacg

SEQ ID NO: 85663 - RNA, 20 nt, Artificial Sequence
  MKO10085663_B_Ffar3
  gRNA
cacuacagugagccgaugcc

SEQ ID NO: 85664 - RNA, 20 nt, Artificial Sequence
  MKO10085664_B_Ffar3
  gRNA
gggacucccccucaacguga

SEQ ID NO: 85665 - RNA, 20 nt, Artificial Sequence
  MKO10085665_B_Ffar3
  gRNA
guucgaugcucaccgccguc

SEQ ID NO: 85666 - RNA, 20 nt, Artificial Sequence
  MKO10085666_B_Ffar4
  gRNA
ccagguccugccggaaguuu

SEQ ID NO: 85667 - RNA, 20 nt, Artificial Sequence
  MKO10085667_B_Ffar4
  gRNA
ggaaauuccgauuugcacau

SEQ ID NO: 85668 - RNA, 20 nt, Artificial Sequence
  MKO10085668_B_Ffar4
  gRNA
cugaucacaaugaccagucc

SEQ ID NO: 85669 - RNA, 20 nt, Artificial Sequence
  MKO10085669_B_Fga
  gRNA
ggcgcagaauugagauccug

SEQ ID NO: 85670 - RNA, 20 nt, Artificial Sequence
  MKO10085670_B_Fga
  gRNA
caccugccucaucuugagcg

SEQ ID NO: 85671 - RNA, 20 nt, Artificial Sequence
  MKO10085671_B_Fga
  gRNA
acuacagauaccgaagauaa

SEQ ID NO: 85672 - RNA, 20 nt, Artificial Sequence
  MKO10085672_B_Fgb
  gRNA
ucgugugcuccgcucaaucc

SEQ ID NO: 85673 - RNA, 20 nt, Artificial Sequence
  MKO10085673_B_Fgb
  gRNA
gcaacaaacguuguuaaacc

SEQ ID NO: 85674 - RNA, 20 nt, Artificial Sequence
  MKO10085674_B_Fgb
  gRNA
agcggagcacacgaagauua

SEQ ID NO: 85675 - RNA, 20 nt, Artificial Sequence
  MKO10085675_B_Fgd1
  gRNA
agaaauuccagugcccccga

SEQ ID NO: 85676 - RNA, 20 nt, Artificial Sequence
  MKO10085676_B_Fgd1
  gRNA
cauaggccuucucaguuugc

SEQ ID NO: 85677 - RNA, 20 nt, Artificial Sequence
  MKO10085677_B_Fgd1
  gRNA
agcucuggggacgagucccu

SEQ ID NO: 85678 - RNA, 20 nt, Artificial Sequence
  MKO10085678_B_Fgd2
  gRNA
cucaagaacaaguuaucgag

SEQ ID NO: 85679 - RNA, 20 nt, Artificial Sequence
  MKO10085679_B_Fgd2
  gRNA
agggcagccacgccccgcau

SEQ ID NO: 85680 - RNA, 20 nt, Artificial Sequence
  MKO10085680_B_Fgd2
  gRNA
cacucgauaacuuguucuug

SEQ ID NO: 85681 - RNA, 20 nt, Artificial Sequence
  MKO10085681_B_Fgd3
  gRNA
gaagcugcuucauauugccc

SEQ ID NO: 85682 - RNA, 20 nt, Artificial Sequence
  MKO10085682_B_Fgd3
  gRNA
acuaccuaaagaggcucccc

SEQ ID NO: 85683 - RNA, 20 nt, Artificial Sequence
  MKO10085683_B_Fgd3
  gRNA
ggaggaacugcccauggaaa

SEQ ID NO: 85684 - RNA, 20 nt, Artificial Sequence
  MKO10085684_B_Fgd4
  gRNA
aaggauggaggagucuaauc

SEQ ID NO: 85685 - RNA, 20 nt, Artificial Sequence
  MKO10085685_B_Fgd4
  gRNA
uaaauuccuauuaccugagc

SEQ ID NO: 85686 - RNA, 20 nt, Artificial Sequence
  MKO10085686_B_Fgd4
  gRNA
uaauaggaauuuacuaugga

SEQ ID NO: 85687 - RNA, 20 nt, Artificial Sequence
  MKO10085687_B_Fgd5
  gRNA
gauguugcagcacuuaagcc

SEQ ID NO: 85688 - RNA, 20 nt, Artificial Sequence
  MKO10085688_B_Fgd5
  gRNA
gcagcuccugagcgaugaca

SEQ ID NO: 85689 - RNA, 20 nt, Artificial Sequence
  MKO10085689_B_Fgd5
  gRNA
cucacaucagacgaagaaca

SEQ ID NO: 85690 - RNA, 20 nt, Artificial Sequence
  MKO10085690_B_Fgd6
  gRNA
augcaguucuggaacauccc

SEQ ID NO: 85691 - RNA, 20 nt, Artificial Sequence
  MKO10085691_B_Fgd6
  gRNA
cucggagcucaugaucuccu

SEQ ID NO: 85692 - RNA, 20 nt, Artificial Sequence
  MKO10085692_B_Fgd6
  gRNA
caaaguucaucauauugcca

SEQ ID NO: 85693 - RNA, 20 nt, Artificial Sequence
  MKO10085693_B_Fgf10
  gRNA
uuuccacugauguuaucucc

SEQ ID NO: 85694 - RNA, 20 nt, Artificial Sequence
  MKO10085694_B_Fgf10
  gRNA
cugccaguuaaaagaugcau

SEQ ID NO: 85695 - RNA, 20 nt, Artificial Sequence
  MKO10085695_B_Fgf10
  gRNA
uguccuggagauaacaucag

SEQ ID NO: 85696 - RNA, 20 nt, Artificial Sequence
  MKO10085696_B_Fgf11
  gRNA
caauagccccucagcguuca

SEQ ID NO: 85697 - RNA, 20 nt, Artificial Sequence
  MKO10085697_B_Fgf11
  gRNA
cuacauggccaugaacgcug

SEQ ID NO: 85698 - RNA, 20 nt, Artificial Sequence
  MKO10085698_B_Fgf11
  gRNA
ggugcccuggauacucccau

SEQ ID NO: 85699 - RNA, 20 nt, Artificial Sequence
  MKO10085699_B_Fgf12
  gRNA
gccaccacacgcaguccuac

SEQ ID NO: 85700 - RNA, 20 nt, Artificial Sequence
  MKO10085700_B_Fgf12
  gRNA
gguuaaagccagccuuuaug

SEQ ID NO: 85701 - RNA, 20 nt, Artificial Sequence
  MKO10085701_B_Fgf12
  gRNA
ucuccaauuucguguaguga

SEQ ID NO: 85702 - RNA, 20 nt, Artificial Sequence
  MKO10085702_B_Fgf13
  gRNA
aucuaccgucagcagcaauc

SEQ ID NO: 85703 - RNA, 20 nt, Artificial Sequence
  MKO10085703_B_Fgf13
  gRNA
gccuugucggcuguauaguu

SEQ ID NO: 85704 - RNA, 20 nt, Artificial Sequence
  MKO10085704_B_Fgf13
  gRNA
accaaacuauacagccgaca

SEQ ID NO: 85705 - RNA, 20 nt, Artificial Sequence
  MKO10085705_B_Fgf14
  gRNA
gcaacaacgcgcagucccac

SEQ ID NO: 85706 - RNA, 20 nt, Artificial Sequence
  MKO10085706_B_Fgf14
  gRNA
gacucuuuaaacuugcauuc

SEQ ID NO: 85707 - RNA, 20 nt, Artificial Sequence
  MKO10085707_B_Fgf14
  gRNA
ugaaacagucccgaaagcug

SEQ ID NO: 85708 - RNA, 20 nt, Artificial Sequence
  MKO10085708_B_Fgf15
  gRNA
gugacagcauggauccguuc

SEQ ID NO: 85709 - RNA, 20 nt, Artificial Sequence
  MKO10085709_B_Fgf15
  gRNA
uucuccaaagauucgcuacu

SEQ ID NO: 85710 - RNA, 20 nt, Artificial Sequence
  MKO10085710_B_Fgf15
  gRNA
cagcggaguacagguacugc

SEQ ID NO: 85711 - RNA, 20 nt, Artificial Sequence
  MKO10085711_B_Fgf16
  gRNA
aguagagcuggcggcgccgc

SEQ ID NO: 85712 - RNA, 20 nt, Artificial Sequence
  MKO10085712_B_Fgf16
  gRNA
aaugagcgaggagagcucua

SEQ ID NO: 85713 - RNA, 20 nt, Artificial Sequence
  MKO10085713_B_Fgf16
  gRNA
cuguggggcugaucagcauc

SEQ ID NO: 85714 - RNA, 20 nt, Artificial Sequence
  MKO10085714_B_Fgf17
  gRNA
cggcagcagaguccgcauca

SEQ ID NO: 85715 - RNA, 20 nt, Artificial Sequence
  MKO10085715_B_Fgf17
  gRNA
cgcucucugcccccuugaug

SEQ ID NO: 85716 - RNA, 20 nt, Artificial Sequence
  MKO10085716_B_Fgf17
  gRNA
cgcccuggucccucacguac

SEQ ID NO: 85717 - RNA, 20 nt, Artificial Sequence
  MKO10085717_B_Fgf18
  gRNA
cuucaugaagcguuacccca

SEQ ID NO: 85718 - RNA, 20 nt, Artificial Sequence
  MKO10085718_B_Fgf18
  gRNA
uaccuguguaugaaccgaaa

SEQ ID NO: 85719 - RNA, 20 nt, Artificial Sequence
  MKO10085719_B_Fgf18
  gRNA
auaccuucgggagucaaguc

SEQ ID NO: 85720 - RNA, 20 nt, Artificial Sequence
  MKO10085720_B_Fgf1
  gRNA
ccucucggucagggcugcga

SEQ ID NO: 85721 - RNA, 20 nt, Artificial Sequence
  MKO10085721_B_Fgf1
  gRNA
uacggagaccggccaguacu

SEQ ID NO: 85722 - RNA, 20 nt, Artificial Sequence
  MKO10085722_B_Fgf1
  gRNA
guucuucuccgcaugcuucu

SEQ ID NO: 85723 - RNA, 20 nt, Artificial Sequence
  MKO10085723_B_Fgf20
  gRNA
cuacuggucuugguaaaaag

SEQ ID NO: 85724 - RNA, 20 nt, Artificial Sequence
  MKO10085724_B_Fgf20
  gRNA
gugggacuggucaguaucag

SEQ ID NO: 85725 - RNA, 20 nt, Artificial Sequence
  MKO10085725_B_Fgf20
  gRNA
guggacaguggccuguaccu

SEQ ID NO: 85726 - RNA, 20 nt, Artificial Sequence
  MKO10085726_B_Fgf21
  gRNA
augcuugguagacccccagc

SEQ ID NO: 85727 - RNA, 20 nt, Artificial Sequence
  MKO10085727_B_Fgf21
  gRNA
cccaggauuugaaugacccc

SEQ ID NO: 85728 - RNA, 20 nt, Artificial Sequence
  MKO10085728_B_Fgf21
  gRNA
uccugggugucaaagccucu

SEQ ID NO: 85729 - RNA, 20 nt, Artificial Sequence
  MKO10085729_B_Fgf22
  gRNA
acacauacgccucgcgacgu

SEQ ID NO: 85730 - RNA, 20 nt, Artificial Sequence
  MKO10085730_B_Fgf22
  gRNA
ucuauguggccaugaaucgc

SEQ ID NO: 85731 - RNA, 20 nt, Artificial Sequence
  MKO10085731_B_Fgf22
  gRNA
ggagauccguucuguccgug

SEQ ID NO: 85732 - RNA, 20 nt, Artificial Sequence
  MKO10085732_B_Fgf23
  gRNA
ccggacacuuccccauugcu

SEQ ID NO: 85733 - RNA, 20 nt, Artificial Sequence
  MKO10085733_B_Fgf23
  gRNA
acaaaggaaccuucgaguca

SEQ ID NO: 85734 - RNA, 20 nt, Artificial Sequence
  MKO10085734_B_Fgf23
  gRNA
acucacuguagauggucuga

SEQ ID NO: 85735 - RNA, 20 nt, Artificial Sequence
  MKO10085735_B_Fgf2
  gRNA
uuucagugccacauaccaac

SEQ ID NO: 85736 - RNA, 20 nt, Artificial Sequence
  MKO10085736_B_Fgf2
  gRNA
ucaagggagugugugccaac

SEQ ID NO: 85737 - RNA, 20 nt, Artificial Sequence
  MKO10085737_B_Fgf2
  gRNA
guccaucuuccuucauagca

SEQ ID NO: 85738 - RNA, 20 nt, Artificial Sequence
  MKO10085738_B_Fgf3
  gRNA
gcuucccgccuguaccgcac

SEQ ID NO: 85739 - RNA, 20 nt, Artificial Sequence
  MKO10085739_B_Fgf3
  gRNA
cuuccaccgcaguaaucucc

SEQ ID NO: 85740 - RNA, 20 nt, Artificial Sequence
  MKO10085740_B_Fgf3
  gRNA
gagaggacggcuguaugcuu

SEQ ID NO: 85741 - RNA, 20 nt, Artificial Sequence
  MKO10085741_B_Fgf4
  gRNA
ccgagugucgccuaccauga

SEQ ID NO: 85742 - RNA, 20 nt, Artificial Sequence
  MKO10085742_B_Fgf4
  gRNA
aguggccagccgguucuucg

SEQ ID NO: 85743 - RNA, 20 nt, Artificial Sequence
  MKO10085743_B_Fgf4
  gRNA
cucaccacgccucgcugcac

SEQ ID NO: 85744 - RNA, 20 nt, Artificial Sequence
  MKO10085744_B_Fgf5
  gRNA
gaaggaaaguuccgguugcu

SEQ ID NO: 85745 - RNA, 20 nt, Artificial Sequence
  MKO10085745_B_Fgf5
  gRNA
ggaaauauuugcugugucuc

SEQ ID NO: 85746 - RNA, 20 nt, Artificial Sequence
  MKO10085746_B_Fgf5
  gRNA
acgucgcgcuacuucugccc

SEQ ID NO: 85747 - RNA, 20 nt, Artificial Sequence
  MKO10085747_B_Fgf6
  gRNA
caccacaccccguucuaccg

SEQ ID NO: 85748 - RNA, 20 nt, Artificial Sequence
  MKO10085748_B_Fgf6
  gRNA
ucuguacaggucugacucgu

SEQ ID NO: 85749 - RNA, 20 nt, Artificial Sequence
  MKO10085749_B_Fgf6
  gRNA
gagcacucuucaccccgaag

SEQ ID NO: 85750 - RNA, 20 nt, Artificial Sequence
  MKO10085750_B_Fgf7
  gRNA
acaccuaugcaucagcuaaa

SEQ ID NO: 85751 - RNA, 20 nt, Artificial Sequence
  MKO10085751_B_Fgf7
  gRNA
ugccacaauuccaacugcca

SEQ ID NO: 85752 - RNA, 20 nt, Artificial Sequence
  MKO10085752_B_Fgf7
  gRNA
guuggaauuguggcaaucaa

SEQ ID NO: 85753 - RNA, 20 nt, Artificial Sequence
  MKO10085753_B_Fgf8
  gRNA
ccugacagcgaagcucauug

SEQ ID NO: 85754 - RNA, 20 nt, Artificial Sequence
  MKO10085754_B_Fgf8
  gRNA
uacucacaggcagcucagcg

SEQ ID NO: 85755 - RNA, 20 nt, Artificial Sequence
  MKO10085755_B_Fgf8
  gRNA
ccacaggcuguugcacuugc

SEQ ID NO: 85756 - RNA, 20 nt, Artificial Sequence
  MKO10085756_B_Fgf9
  gRNA
cccccuucucguucaugccg

SEQ ID NO: 85757 - RNA, 20 nt, Artificial Sequence
  MKO10085757_B_Fgf9
  gRNA
uuucuggugccguuuagucc

SEQ ID NO: 85758 - RNA, 20 nt, Artificial Sequence
  MKO10085758_B_Fgf9
  gRNA
uugucaggguccacuggucu

SEQ ID NO: 85759 - RNA, 20 nt, Artificial Sequence
  MKO10085759_B_Fgfbp1
  gRNA
gaggguucagcucccucguu

SEQ ID NO: 85760 - RNA, 20 nt, Artificial Sequence
  MKO10085760_B_Fgfbp1
  gRNA
cugagaacgccugaguagcc

SEQ ID NO: 85761 - RNA, 20 nt, Artificial Sequence
  MKO10085761_B_Fgfbp1
  gRNA
acaucuaaaucucugacgca

SEQ ID NO: 85762 - RNA, 20 nt, Artificial Sequence
  MKO10085762_B_Fgfbp3
  gRNA
cgcuuuccucccgcccgagu

SEQ ID NO: 85763 - RNA, 20 nt, Artificial Sequence
  MKO10085763_B_Fgfbp3
  gRNA
gagagcgacgcccgcggccu

SEQ ID NO: 85764 - RNA, 20 nt, Artificial Sequence
  MKO10085764_B_Fgfbp3
  gRNA
ggcgcgcgcacuacuggaga

SEQ ID NO: 85765 - RNA, 20 nt, Artificial Sequence
  MKO10085765_B_Fgfr1op2
  gRNA
uauugaaauugacgagcagc

SEQ ID NO: 85766 - RNA, 20 nt, Artificial Sequence
  MKO10085766_B_Fgfr1op2
  gRNA
uuaaugaaguagcaagacau

SEQ ID NO: 85767 - RNA, 20 nt, Artificial Sequence
  MKO10085767_B_Fgfr1op2
  gRNA
gaauuacaacaagaaaacaa

SEQ ID NO: 85768 - RNA, 20 nt, Artificial Sequence
  MKO10085768_B_Fgfr1op
  gRNA
uuugaaggcugaacucagag

SEQ ID NO: 85769 - RNA, 20 nt, Artificial Sequence
  MKO10085769_B_Fgfr1op
  gRNA
ucuccagcgucugcaccagc

SEQ ID NO: 85770 - RNA, 20 nt, Artificial Sequence
  MKO10085770_B_Fgfr1op
  gRNA
gauggcggcgacuaccgccg

SEQ ID NO: 85771 - RNA, 20 nt, Artificial Sequence
  MKO10085771_B_Fgfr1
  gRNA
uuuaagccugaccaccgaau

SEQ ID NO: 85772 - RNA, 20 nt, Artificial Sequence
  MKO10085772_B_Fgfr1
  gRNA
caccuaccagcuugacgucg

SEQ ID NO: 85773 - RNA, 20 nt, Artificial Sequence
  MKO10085773_B_Fgfr1
  gRNA
ucuuacccacgacgucaagc

SEQ ID NO: 85774 - RNA, 20 nt, Artificial Sequence
  MKO10085774_B_Fgfr2
  gRNA
caaacucaccaacgacaucg

SEQ ID NO: 85775 - RNA, 20 nt, Artificial Sequence
  MKO10085775_B_Fgfr2
  gRNA
cugacucaggagcaccguac

SEQ ID NO: 85776 - RNA, 20 nt, Artificial Sequence
  MKO10085776_B_Fgfr2
  gRNA
cacauccccuccgaccaccg

SEQ ID NO: 85777 - RNA, 20 nt, Artificial Sequence
  MKO10085777_B_Fgfr3
  gRNA
agcagguggccuucggcagu

SEQ ID NO: 85778 - RNA, 20 nt, Artificial Sequence
  MKO10085778_B_Fgfr3
  gRNA
gcggaagcggacaguguuug

SEQ ID NO: 85779 - RNA, 20 nt, Artificial Sequence
  MKO10085779_B_Fgfr3
  gRNA
cacgcagaacacuagcacgc

SEQ ID NO: 85780 - RNA, 20 nt, Artificial Sequence
  MKO10085780_B_Fgfr4
  gRNA
uggguagacaugaccacucg

SEQ ID NO: 85781 - RNA, 20 nt, Artificial Sequence
  MKO10085781_B_Fgfr4
  gRNA
cuccaauacgauucuccccg

SEQ ID NO: 85782 - RNA, 20 nt, Artificial Sequence
  MKO10085782_B_Fgfr4
  gRNA
ggggucuucaucauuacuga

SEQ ID NO: 85783 - RNA, 20 nt, Artificial Sequence
  MKO10085783_B_Fgfrl1
  gRNA
aaucacucggcgccucaucu

SEQ ID NO: 85784 - RNA, 20 nt, Artificial Sequence
  MKO10085784_B_Fgfrl1
  gRNA
ccgugaccacacaucacccg

SEQ ID NO: 85785 - RNA, 20 nt, Artificial Sequence
  MKO10085785_B_Fgfrl1
  gRNA
uggccccccgaagaaccacc

SEQ ID NO: 85786 - RNA, 20 nt, Artificial Sequence
  MKO10085786_B_Fggy
  gRNA
ccucucgaaacguuaucaug

SEQ ID NO: 85787 - RNA, 20 nt, Artificial Sequence
  MKO10085787_B_Fggy
  gRNA
auugaugcacaucgaauccg

SEQ ID NO: 85788 - RNA, 20 nt, Artificial Sequence
  MKO10085788_B_Fggy
  gRNA
ccuuuaccaguaaaccauga

SEQ ID NO: 85789 - RNA, 20 nt, Artificial Sequence
  MKO10085789_B_Fgg
  gRNA
uacuuacgaaucucucaucu

SEQ ID NO: 85790 - RNA, 20 nt, Artificial Sequence
  MKO10085790_B_Fgg
  gRNA
uaacccacgagacaagcauu

SEQ ID NO: 85791 - RNA, 20 nt, Artificial Sequence
  MKO10085791_B_Fgg
  gRNA
gugcaaauccaugacacaac

SEQ ID NO: 85792 - RNA, 20 nt, Artificial Sequence
  MKO10085792_B_Fgl1
  gRNA
guaauucagagacgaucuga

SEQ ID NO: 85793 - RNA, 20 nt, Artificial Sequence
  MKO10085793_B_Fgl1
  gRNA
gguuggaaugacuaugaaaa

SEQ ID NO: 85794 - RNA, 20 nt, Artificial Sequence
  MKO10085794_B_Fgl1
  gRNA
guuuauugugacaugucuga

SEQ ID NO: 85795 - RNA, 20 nt, Artificial Sequence
  MKO10085795_B_Fgl2
  gRNA
uaccgaucguugucucuguc

SEQ ID NO: 85796 - RNA, 20 nt, Artificial Sequence
  MKO10085796_B_Fgl2
  gRNA
cgcugaccauccagcucccg

SEQ ID NO: 85797 - RNA, 20 nt, Artificial Sequence
  MKO10085797_B_Fgl2
  gRNA
ccaaccaaaauucucguuca

SEQ ID NO: 85798 - RNA, 20 nt, Artificial Sequence
  MKO10085798_B_Fgr
  gRNA
cacccauguagugccgcacu

SEQ ID NO: 85799 - RNA, 20 nt, Artificial Sequence
  MKO10085799_B_Fgr
  gRNA
gaggcucgcucccugagcuc

SEQ ID NO: 85800 - RNA, 20 nt, Artificial Sequence
  MKO10085800_B_Fgr
  gRNA
gugucuacagggaguaugac

SEQ ID NO: 85801 - RNA, 20 nt, Artificial Sequence
  MKO10085801_B_Fh1
  gRNA
augccgaaagcuugaaugac

SEQ ID NO: 85802 - RNA, 20 nt, Artificial Sequence
  MKO10085802_B_Fh1
  gRNA
guuccaaccgauaaguauua

SEQ ID NO: 85803 - RNA, 20 nt, Artificial Sequence
  MKO10085803_B_Fh1
  gRNA
agcugcugcugaaguaaacc

SEQ ID NO: 85804 - RNA, 20 nt, Artificial Sequence
  MKO10085804_B_Fhad1
  gRNA
cguugacaaacgugccguug

SEQ ID NO: 85805 - RNA, 20 nt, Artificial Sequence
  MKO10085805_B_Fhad1
  gRNA
cgcagugugggccaacgcua

SEQ ID NO: 85806 - RNA, 20 nt, Artificial Sequence
  MKO10085806_B_Fhad1
  gRNA
cacauaccuugguugaugac

SEQ ID NO: 85807 - RNA, 20 nt, Artificial Sequence
  MKO10085807_B_Fhdc1
  gRNA
gcaaagcgaaguaugaacau

SEQ ID NO: 85808 - RNA, 20 nt, Artificial Sequence
  MKO10085808_B_Fhdc1
  gRNA
acuucgcuuugcauccaaga

SEQ ID NO: 85809 - RNA, 20 nt, Artificial Sequence
  MKO10085809_B_Fhdc1
  gRNA
ccuuaugucuuugaacagag

SEQ ID NO: 85810 - RNA, 20 nt, Artificial Sequence
  MKO10085810_B_Fhit
  gRNA
uacauguccacguucuuccc

SEQ ID NO: 85811 - RNA, 20 nt, Artificial Sequence
  MKO10085811_B_Fhit
  gRNA
uucuaggaugguccugaagc

SEQ ID NO: 85812 - RNA, 20 nt, Artificial Sequence
  MKO10085812_B_Fhit
  gRNA
cuccuucucagaucuccaaa

SEQ ID NO: 85813 - RNA, 20 nt, Artificial Sequence
  MKO10085813_B_Fhl1
  gRNA
ugugcaacaagugcgcuacu

SEQ ID NO: 85814 - RNA, 20 nt, Artificial Sequence
  MKO10085814_B_Fhl1
  gRNA
ugcauuauaagaaucgcuac

SEQ ID NO: 85815 - RNA, 20 nt, Artificial Sequence
  MKO10085815_B_Fhl1
  gRNA
cacaaagcacucggcaugcc

SEQ ID NO: 85816 - RNA, 20 nt, Artificial Sequence
  MKO10085816_B_Fhl2
  gRNA
acacuuaccacuaauggggu

SEQ ID NO: 85817 - RNA, 20 nt, Artificial Sequence
  MKO10085817_B_Fhl2
  gRNA
ugcguucugaccuggcauga

SEQ ID NO: 85818 - RNA, 20 nt, Artificial Sequence
  MKO10085818_B_Fhl2
  gRNA
ccgguaaguaacaccuccug

SEQ ID NO: 85819 - RNA, 20 nt, Artificial Sequence
  MKO10085819_B_Fhl3
  gRNA
guccccacagacgcugaccc

SEQ ID NO: 85820 - RNA, 20 nt, Artificial Sequence
  MKO10085820_B_Fhl3
  gRNA
ccccacagggucccggaagc

SEQ ID NO: 85821 - RNA, 20 nt, Artificial Sequence
  MKO10085821_B_Fhl3
  gRNA
uguccuucgaagaccgacau

SEQ ID NO: 85822 - RNA, 20 nt, Artificial Sequence
  MKO10085822_B_Fhl4
  gRNA
cuccuuauaacacaccuccu

SEQ ID NO: 85823 - RNA, 20 nt, Artificial Sequence
  MKO10085823_B_Fhl4
  gRNA
uggacagcguuucacugcua

SEQ ID NO: 85824 - RNA, 20 nt, Artificial Sequence
  MKO10085824_B_Fhl4
  gRNA
guugaagcaguagucaugcc

SEQ ID NO: 85825 - RNA, 20 nt, Artificial Sequence
  MKO10085825_B_Fhl5
  gRNA
ucugcuuucaagaccgccag

SEQ ID NO: 85826 - RNA, 20 nt, Artificial Sequence
  MKO10085826_B_Fhl5
  gRNA
ccggaucucaccuggcauga

SEQ ID NO: 85827 - RNA, 20 nt, Artificial Sequence
  MKO10085827_B_Fhl5
  gRNA
uaaccuuccgugaucagaua

SEQ ID NO: 85828 - RNA, 20 nt, Artificial Sequence
  MKO10085828_B_Fhod1
  gRNA
cuccggguccagguaguauc

SEQ ID NO: 85829 - RNA, 20 nt, Artificial Sequence
  MKO10085829_B_Fhod1
  gRNA
cgugagggucaaugcuaucu

SEQ ID NO: 85830 - RNA, 20 nt, Artificial Sequence
  MKO10085830_B_Fhod1
  gRNA
gcaucucccgcuguucuucu

SEQ ID NO: 85831 - RNA, 20 nt, Artificial Sequence
  MKO10085831_B_Fhod3
  gRNA
gugaggguccaugccugcau

SEQ ID NO: 85832 - RNA, 20 nt, Artificial Sequence
  MKO10085832_B_Fhod3
  gRNA
gaaaagcuguacaacuccag

SEQ ID NO: 85833 - RNA, 20 nt, Artificial Sequence
  MKO10085833_B_Fhod3
  gRNA
ccuucuuagaucucggccac

SEQ ID NO: 85834 - RNA, 20 nt, Artificial Sequence
  MKO10085834_B_Fibcd1
  gRNA
ccuugcagguauuucagcgc

SEQ ID NO: 85835 - RNA, 20 nt, Artificial Sequence
  MKO10085835_B_Fibcd1
  gRNA
ccuugacacggggccggccu

SEQ ID NO: 85836 - RNA, 20 nt, Artificial Sequence
  MKO10085836_B_Fibcd1
  gRNA
agaacauccaggcagucccg

SEQ ID NO: 85837 - RNA, 20 nt, Artificial Sequence
  MKO10085837_B_Fibin
  gRNA
guucacaguacugggccgcc

SEQ ID NO: 85838 - RNA, 20 nt, Artificial Sequence
  MKO10085838_B_Fibin
  gRNA
caucaaaguagccucgacac

SEQ ID NO: 85839 - RNA, 20 nt, Artificial Sequence
  MKO10085839_B_Fibin
  gRNA
ugguguucccgaaguugauc

SEQ ID NO: 85840 - RNA, 20 nt, Artificial Sequence
  MKO10085840_B_Fibp
  gRNA
gcccaagaccucccgaacaa

SEQ ID NO: 85841 - RNA, 20 nt, Artificial Sequence
  MKO10085841_B_Fibp
  gRNA
gggccucaccgacggcucca

SEQ ID NO: 85842 - RNA, 20 nt, Artificial Sequence
  MKO10085842_B_Fibp
  gRNA
cuggugagcaccucucgaug

SEQ ID NO: 85843 - RNA, 20 nt, Artificial Sequence
  MKO10085843_B_Ficd
  gRNA
acugccaccaccgacgccau

SEQ ID NO: 85844 - RNA, 20 nt, Artificial Sequence
  MKO10085844_B_Ficd
  gRNA
gagacccgcuacgccgugcc

SEQ ID NO: 85845 - RNA, 20 nt, Artificial Sequence
  MKO10085845_B_Ficd
  gRNA
gccagggccgcgaacucgac

SEQ ID NO: 85846 - RNA, 20 nt, Artificial Sequence
  MKO10085846_B_Fig4
  gRNA
aauugauagaacagaaccga

SEQ ID NO: 85847 - RNA, 20 nt, Artificial Sequence
  MKO10085847_B_Fig4
  gRNA
uuucgagccgucucagcuuu

SEQ ID NO: 85848 - RNA, 20 nt, Artificial Sequence
  MKO10085848_B_Fig4
  gRNA
acaacccggaggauccuuuc

SEQ ID NO: 85849 - RNA, 20 nt, Artificial Sequence
  MKO10085849_B_Figf
  gRNA
uggaggcugcugcaacgaag

SEQ ID NO: 85850 - RNA, 20 nt, Artificial Sequence
  MKO10085850_B_Figf
  gRNA
cguagaagucgccagugagc

SEQ ID NO: 85851 - RNA, 20 nt, Artificial Sequence
  MKO10085851_B_Figf
  gRNA
uuaucccacagcaugucaau

SEQ ID NO: 85852 - RNA, 20 nt, Artificial Sequence
  MKO10085852_B_Figla
  gRNA
caaccuaccagcugugcgag

SEQ ID NO: 85853 - RNA, 20 nt, Artificial Sequence
  MKO10085853_B_Figla
  gRNA
ugccguuucuaccacagagc

SEQ ID NO: 85854 - RNA, 20 nt, Artificial Sequence
  MKO10085854_B_Figla
  gRNA
cuguguucuggaagaagcga

SEQ ID NO: 85855 - RNA, 20 nt, Artificial Sequence
  MKO10085855_B_Fignl1
  gRNA
aggcggugggcucuuuacac

SEQ ID NO: 85856 - RNA, 20 nt, Artificial Sequence
  MKO10085856_B_Fignl1
  gRNA
uaaagagcccaccgccuuug

SEQ ID NO: 85857 - RNA, 20 nt, Artificial Sequence
  MKO10085857_B_Fignl1
  gRNA
gggacugguaaaacucugau

SEQ ID NO: 85858 - RNA, 20 nt, Artificial Sequence
  MKO10085858_B_Fignl2
  gRNA
gcucguuugcgcgcaguagc

SEQ ID NO: 85859 - RNA, 20 nt, Artificial Sequence
  MKO10085859_B_Fignl2
  gRNA
guagcccgccgcguacucag

SEQ ID NO: 85860 - RNA, 20 nt, Artificial Sequence
  MKO10085860_B_Fignl2
  gRNA
cgcuacgccgagaaguacuc

SEQ ID NO: 85861 - RNA, 20 nt, Artificial Sequence
  MKO10085861_B_Fign
  gRNA
aucaguagcaccaguguuua

SEQ ID NO: 85862 - RNA, 20 nt, Artificial Sequence
  MKO10085862_B_Fign
  gRNA
cgaccauucacgaguccuga

SEQ ID NO: 85863 - RNA, 20 nt, Artificial Sequence
  MKO10085863_B_Fign
  gRNA
ccuggugaaggcgguuauua

SEQ ID NO: 85864 - RNA, 20 nt, Artificial Sequence
  MKO10085864_B_Filip1l
  gRNA
gaccccuucugacucacacg

SEQ ID NO: 85865 - RNA, 20 nt, Artificial Sequence
  MKO10085865_B_Filip1l
  gRNA
aucccaccggcaaaccauaa

SEQ ID NO: 85866 - RNA, 20 nt, Artificial Sequence
  MKO10085866_B_Filip1l
  gRNA
gaccccucgugugagucaga

SEQ ID NO: 85867 - RNA, 20 nt, Artificial Sequence
  MKO10085867_B_Filip1
  gRNA
auaaugcgccuccagaaccu

SEQ ID NO: 85868 - RNA, 20 nt, Artificial Sequence
  MKO10085868_B_Filip1
  gRNA
gaagaccaagcccgagguuc

SEQ ID NO: 85869 - RNA, 20 nt, Artificial Sequence
  MKO10085869_B_Filip1
  gRNA
gucgcucuuguucauguagu

SEQ ID NO: 85870 - RNA, 20 nt, Artificial Sequence
  MKO10085870_B_Fip1l1
  gRNA
cugugcacaugcacguccca

SEQ ID NO: 85871 - RNA, 20 nt, Artificial Sequence
  MKO10085871_B_Fip1l1
  gRNA
gcuucuucuucaauuccaga

SEQ ID NO: 85872 - RNA, 20 nt, Artificial Sequence
  MKO10085872_B_Fip1l1
  gRNA
cgugcaugugcacagugacu

SEQ ID NO: 85873 - RNA, 20 nt, Artificial Sequence
  MKO10085873_B_Fis1
  gRNA
aaucaggcguuccagcuccu

SEQ ID NO: 85874 - RNA, 20 nt, Artificial Sequence
  MKO10085874_B_Fis1
  gRNA
auauucaaauugcgugcucu

SEQ ID NO: 85875 - RNA, 20 nt, Artificial Sequence
  MKO10085875_B_Fis1
  gRNA
cauuguauuugcuucgaacc

SEQ ID NO: 85876 - RNA, 20 nt, Artificial Sequence
  MKO10085876_B_Fitm1
  gRNA
ugaacaagccgcccgccucc

SEQ ID NO: 85877 - RNA, 20 nt, Artificial Sequence
  MKO10085877_B_Fitm1
  gRNA
ccgucagguccucgaugagu

SEQ ID NO: 85878 - RNA, 20 nt, Artificial Sequence
  MKO10085878_B_Fitm1
  gRNA
agacgcaguggggcgccagc

SEQ ID NO: 85879 - RNA, 20 nt, Artificial Sequence
  MKO10085879_B_Fitm2
  gRNA
ucgcccucaccagcgucccg

SEQ ID NO: 85880 - RNA, 20 nt, Artificial Sequence
  MKO10085880_B_Fitm2
  gRNA
uccaacauugagcacuauac

SEQ ID NO: 85881 - RNA, 20 nt, Artificial Sequence
  MKO10085881_B_Fitm2
  gRNA
gcuggcgggcucggucguca

SEQ ID NO: 85882 - RNA, 20 nt, Artificial Sequence
  MKO10085882_B_Fiz1
  gRNA
gccucaggucugaucgguaa

SEQ ID NO: 85883 - RNA, 20 nt, Artificial Sequence
  MKO10085883_B_Fiz1
  gRNA
gccgcuugagauggcggccc

SEQ ID NO: 85884 - RNA, 20 nt, Artificial Sequence
  MKO10085884_B_Fiz1
  gRNA
guuccguucaccucgagacc

SEQ ID NO: 85885 - RNA, 20 nt, Artificial Sequence
  MKO10085885_B_Fjx1
  gRNA
gcgguucguggcgacuguag

SEQ ID NO: 85886 - RNA, 20 nt, Artificial Sequence
  MKO10085886_B_Fjx1
  gRNA
gcuacgagcaaccugcaccg

SEQ ID NO: 85887 - RNA, 20 nt, Artificial Sequence
  MKO10085887_B_Fjx1
  gRNA
cuaccggguagccggcaugu

SEQ ID NO: 85888 - RNA, 20 nt, Artificial Sequence
  MKO10085888_B_Fkbp10
  gRNA
uguccacaacccgaaggaca

SEQ ID NO: 85889 - RNA, 20 nt, Artificial Sequence
  MKO10085889_B_Fkbp10
  gRNA
ggcacuuaugacaccuacau

SEQ ID NO: 85890 - RNA, 20 nt, Artificial Sequence
  MKO10085890_B_Fkbp10
  gRNA
cuuuguuccacacguccagc

SEQ ID NO: 85891 - RNA, 20 nt, Artificial Sequence
  MKO10085891_B_Fkbp11
  gRNA
acccucgcuuuccauaagcc

SEQ ID NO: 85892 - RNA, 20 nt, Artificial Sequence
  MKO10085892_B_Fkbp11
  gRNA
uaccuggaaucaccugcuuu

SEQ ID NO: 85893 - RNA, 20 nt, Artificial Sequence
  MKO10085893_B_Fkbp11
  gRNA
uucuaugaccagaggaucuc

SEQ ID NO: 85894 - RNA, 20 nt, Artificial Sequence
  MKO10085894_B_Fkbp14
  gRNA
ugaaagccaucacgaugcuu

SEQ ID NO: 85895 - RNA, 20 nt, Artificial Sequence
  MKO10085895_B_Fkbp14
  gRNA
uuacuuacguggaaugaaac

SEQ ID NO: 85896 - RNA, 20 nt, Artificial Sequence
  MKO10085896_B_Fkbp14
  gRNA
uuucuaaauagccuucguag

SEQ ID NO: 85897 - RNA, 20 nt, Artificial Sequence
  MKO10085897_B_Fkbp15
  gRNA
aaauggucaauaugcaaagc

SEQ ID NO: 85898 - RNA, 20 nt, Artificial Sequence
  MKO10085898_B_Fkbp15
  gRNA
gcgguaugcaugcacugcag

SEQ ID NO: 85899 - RNA, 20 nt, Artificial Sequence
  MKO10085899_B_Fkbp15
  gRNA
ucaucugaacuuugagcuaa

SEQ ID NO: 85900 - RNA, 20 nt, Artificial Sequence
  MKO10085900_B_Fkbp1a
  gRNA
cgccgccgccaugggagugc

SEQ ID NO: 85901 - RNA, 20 nt, Artificial Sequence
  MKO10085901_B_Fkbp1a
  gRNA
aucuccucagacuaugccua

SEQ ID NO: 85902 - RNA, 20 nt, Artificial Sequence
  MKO10085902_B_Fkbp1a
  gRNA
ggcuccauaggcauagucug

SEQ ID NO: 85903 - RNA, 20 nt, Artificial Sequence
  MKO10085903_B_Fkbp1b
  gRNA
gagaucgagaccaucucccc

SEQ ID NO: 85904 - RNA, 20 nt, Artificial Sequence
  MKO10085904_B_Fkbp1b
  gRNA
aggaaggacauucccuaaga

SEQ ID NO: 85905 - RNA, 20 nt, Artificial Sequence
  MKO10085905_B_Fkbp1b
  gRNA
auauguguggugcacuacac

SEQ ID NO: 85906 - RNA, 20 nt, Artificial Sequence
  MKO10085906_B_Fkbp2
  gRNA
ggagcccccccaaagauccc

SEQ ID NO: 85907 - RNA, 20 nt, Artificial Sequence
  MKO10085907_B_Fkbp2
  gRNA
ugauaaccuggccagugcca

SEQ ID NO: 85908 - RNA, 20 nt, Artificial Sequence
  MKO10085908_B_Fkbp2
  gRNA
gcagcuccaccucaaacacc

SEQ ID NO: 85909 - RNA, 20 nt, Artificial Sequence
  MKO10085909_B_Fkbp3
  gRNA
augguccuuauuagcagucu

SEQ ID NO: 85910 - RNA, 20 nt, Artificial Sequence
  MKO10085910_B_Fkbp3
  gRNA
uauaaguaaagugucugaac

SEQ ID NO: 85911 - RNA, 20 nt, Artificial Sequence
  MKO10085911_B_Fkbp3
  gRNA
uaaaaccaacuuuccuaaaa

SEQ ID NO: 85912 - RNA, 20 nt, Artificial Sequence
  MKO10085912_B_Fkbp4
  gRNA
caacgccacacuuguauuug

SEQ ID NO: 85913 - RNA, 20 nt, Artificial Sequence
  MKO10085913_B_Fkbp4
  gRNA
uuuguccuugcgguccagac

SEQ ID NO: 85914 - RNA, 20 nt, Artificial Sequence
  MKO10085914_B_Fkbp4
  gRNA
ccaucguguaccucaaaccu

SEQ ID NO: 85915 - RNA, 20 nt, Artificial Sequence
  MKO10085915_B_Fkbp5
  gRNA
ggauacucaaacccaaacga

SEQ ID NO: 85916 - RNA, 20 nt, Artificial Sequence
  MKO10085916_B_Fkbp5
  gRNA
uuuaccguugcuccuucguu

SEQ ID NO: 85917 - RNA, 20 nt, Artificial Sequence
  MKO10085917_B_Fkbp5
  gRNA
uaggccagguuaucaaagcc

SEQ ID NO: 85918 - RNA, 20 nt, Artificial Sequence
  MKO10085918_B_Fkbp6
  gRNA
caaucagcucgaucucaaac

SEQ ID NO: 85919 - RNA, 20 nt, Artificial Sequence
  MKO10085919_B_Fkbp6
  gRNA
uacccgcuuguaucucacuu

SEQ ID NO: 85920 - RNA, 20 nt, Artificial Sequence
  MKO10085920_B_Fkbp6
  gRNA
caucacagaagcgauucugg

SEQ ID NO: 85921 - RNA, 20 nt, Artificial Sequence
  MKO10085921_B_Fkbp7
  gRNA
ccgugacaagucauaucaga

SEQ ID NO: 85922 - RNA, 20 nt, Artificial Sequence
  MKO10085922_B_Fkbp7
  gRNA
auaccgccuucguuugcaua

SEQ ID NO: 85923 - RNA, 20 nt, Artificial Sequence
  MKO10085923_B_Fkbp7
  gRNA
uugcuaaaugcccauuacga

SEQ ID NO: 85924 - RNA, 20 nt, Artificial Sequence
  MKO10085924_B_Fkbp8
  gRNA
cggcuagagccuuucgggcc

SEQ ID NO: 85925 - RNA, 20 nt, Artificial Sequence
  MKO10085925_B_Fkbp8
  gRNA
ggaccucagugucccgcuca

SEQ ID NO: 85926 - RNA, 20 nt, Artificial Sequence
  MKO10085926_B_Fkbp8
  gRNA
gcugacuccaaguacugcua

SEQ ID NO: 85927 - RNA, 20 nt, Artificial Sequence
  MKO10085927_B_Fkbp9
  gRNA
uugggaugugcguaaacgag

SEQ ID NO: 85928 - RNA, 20 nt, Artificial Sequence
  MKO10085928_B_Fkbp9
  gRNA
ccacuacaacggaacguucu

SEQ ID NO: 85929 - RNA, 20 nt, Artificial Sequence
  MKO10085929_B_Fkbp9
  gRNA
acggcacucucuuugacucc

SEQ ID NO: 85930 - RNA, 20 nt, Artificial Sequence
  MKO10085930_B_Fkbpl
  gRNA
ucaccaauggccgggacucc

SEQ ID NO: 85931 - RNA, 20 nt, Artificial Sequence
  MKO10085931_B_Fkbpl
  gRNA
uauaccgaagggggguugcu

SEQ ID NO: 85932 - RNA, 20 nt, Artificial Sequence
  MKO10085932_B_Fkbpl
  gRNA
cagcccgagcaaccccccuu

SEQ ID NO: 85933 - RNA, 20 nt, Artificial Sequence
  MKO10085933_B_Fkrp
  gRNA
agggagcagcgcgcgccuag

SEQ ID NO: 85934 - RNA, 20 nt, Artificial Sequence
  MKO10085934_B_Fkrp
  gRNA
gcuggacuugaccuucgccg

SEQ ID NO: 85935 - RNA, 20 nt, Artificial Sequence
  MKO10085935_B_Fkrp
  gRNA
ugccgaagcuggcucgguag

SEQ ID NO: 85936 - RNA, 20 nt, Artificial Sequence
  MKO10085936_B_Fktn
  gRNA
aaauccaacucgauucccuu

SEQ ID NO: 85937 - RNA, 20 nt, Artificial Sequence
  MKO10085937_B_Fktn
  gRNA
ccaaacuguaacuuucgaaa

SEQ ID NO: 85938 - RNA, 20 nt, Artificial Sequence
  MKO10085938_B_Fktn
  gRNA
ucgcacugcaguaucaccug

SEQ ID NO: 85939 - RNA, 20 nt, Artificial Sequence
  MKO10085939_B_Flad1
  gRNA
gcgagaugcuacgaauguac

SEQ ID NO: 85940 - RNA, 20 nt, Artificial Sequence
  MKO10085940_B_Flad1
  gRNA
cauugaagcccacgcagagc

SEQ ID NO: 85941 - RNA, 20 nt, Artificial Sequence
  MKO10085941_B_Flad1
  gRNA
cuguccugaugggcacucga

SEQ ID NO: 85942 - RNA, 20 nt, Artificial Sequence
  MKO10085942_B_Flcn
  gRNA
cgaugaugcuguaccagcgc

SEQ ID NO: 85943 - RNA, 20 nt, Artificial Sequence
  MKO10085943_B_Flcn
  gRNA
gggcagcguugccguuccuc

SEQ ID NO: 85944 - RNA, 20 nt, Artificial Sequence
  MKO10085944_B_Flcn
  gRNA
gccugcuaccgcaugccuuc

SEQ ID NO: 85945 - RNA, 20 nt, Artificial Sequence
  MKO10085945_B_Flg2
  gRNA
gcacuucuggucugacuggu

SEQ ID NO: 85946 - RNA, 20 nt, Artificial Sequence
  MKO10085946_B_Flg2
  gRNA
uuuguagaauacaucaauga

SEQ ID NO: 85947 - RNA, 20 nt, Artificial Sequence
  MKO10085947_B_Flg2
  gRNA
cagaccagaagugcccacuc

SEQ ID NO: 85948 - RNA, 20 nt, Artificial Sequence
  MKO10085948_B_Fli1
  gRNA
cacaggagcacguucgacag

SEQ ID NO: 85949 - RNA, 20 nt, Artificial Sequence
  MKO10085949_B_Fli1
  gRNA
ccaacaugaccaccaacgaa

SEQ ID NO: 85950 - RNA, 20 nt, Artificial Sequence
  MKO10085950_B_Fli1
  gRNA
ugucgcaccucaguuaccuc

SEQ ID NO: 85951 - RNA, 20 nt, Artificial Sequence
  MKO10085951_B_Flii
  gRNA
ugucuagccugccuucgcuu

SEQ ID NO: 85952 - RNA, 20 nt, Artificial Sequence
  MKO10085952_B_Flii
  gRNA
gauucagcuuuagccaucgc

SEQ ID NO: 85953 - RNA, 20 nt, Artificial Sequence
  MKO10085953_B_Flii
  gRNA
ugcucaaccucagccacaac

SEQ ID NO: 85954 - RNA, 20 nt, Artificial Sequence
  MKO10085954_B_Flna
  gRNA
gggagaagugcuuguauaug

SEQ ID NO: 85955 - RNA, 20 nt, Artificial Sequence
  MKO10085955_B_Flna
  gRNA
uuguaggccuauguccugac

SEQ ID NO: 85956 - RNA, 20 nt, Artificial Sequence
  MKO10085956_B_Flna
  gRNA
aacagaaugcucaucuacau

SEQ ID NO: 85957 - RNA, 20 nt, Artificial Sequence
  MKO10085957_B_Flnb
  gRNA
ugggacgcccagccagucau

SEQ ID NO: 85958 - RNA, 20 nt, Artificial Sequence
  MKO10085958_B_Flnb
  gRNA
acuccaucuccaugcccgua

SEQ ID NO: 85959 - RNA, 20 nt, Artificial Sequence
  MKO10085959_B_Flnb
  gRNA
cccagacaguaaagccaucg

SEQ ID NO: 85960 - RNA, 20 nt, Artificial Sequence
  MKO10085960_B_Flnc
  gRNA
uccacgcguaccaggcccau

SEQ ID NO: 85961 - RNA, 20 nt, Artificial Sequence
  MKO10085961_B_Flnc
  gRNA
uucagcugcuuagagcgaac

SEQ ID NO: 85962 - RNA, 20 nt, Artificial Sequence
  MKO10085962_B_Flnc
  gRNA
uaccuccuccgugugucccu

SEQ ID NO: 85963 - RNA, 20 nt, Artificial Sequence
  MKO10085963_B_Flot1
  gRNA
caaaguggccuccuccgacc

SEQ ID NO: 85964 - RNA, 20 nt, Artificial Sequence
  MKO10085964_B_Flot1
  gRNA
cgggguccccaucucaguca

SEQ ID NO: 85965 - RNA, 20 nt, Artificial Sequence
  MKO10085965_B_Flot1
  gRNA
ggcaaugcccgugacugaga

SEQ ID NO: 85966 - RNA, 20 nt, Artificial Sequence
  MKO10085966_B_Flot2
  gRNA
uagagcguagaugccccucc

SEQ ID NO: 85967 - RNA, 20 nt, Artificial Sequence
  MKO10085967_B_Flot2
  gRNA
gacguugcagccccgcugug

SEQ ID NO: 85968 - RNA, 20 nt, Artificial Sequence
  MKO10085968_B_Flot2
  gRNA
ggggguagcuuuaacuguga

SEQ ID NO: 85969 - RNA, 20 nt, Artificial Sequence
  MKO10085969_B_Flrt1
  gRNA
uuuggcucgcaucccgcugc

SEQ ID NO: 85970 - RNA, 20 nt, Artificial Sequence
  MKO10085970_B_Flrt1
  gRNA
caacccguaccgcuccaaag

SEQ ID NO: 85971 - RNA, 20 nt, Artificial Sequence
  MKO10085971_B_Flrt1
  gRNA
gauugauagggaacucgucc

SEQ ID NO: 85972 - RNA, 20 nt, Artificial Sequence
  MKO10085972_B_Flrt2
  gRNA
gaguagaagacggagcguuc

SEQ ID NO: 85973 - RNA, 20 nt, Artificial Sequence
  MKO10085973_B_Flrt2
  gRNA
ugcguucaacuaccgcacug

SEQ ID NO: 85974 - RNA, 20 nt, Artificial Sequence
  MKO10085974_B_Flrt2
  gRNA
uccgcgcagugaguuguuuc

SEQ ID NO: 85975 - RNA, 20 nt, Artificial Sequence
  MKO10085975_B_Flrt3
  gRNA
uuccucaucgggacuaaaau

SEQ ID NO: 85976 - RNA, 20 nt, Artificial Sequence
  MKO10085976_B_Flrt3
  gRNA
ugauucuucgcaacaauccu

SEQ ID NO: 85977 - RNA, 20 nt, Artificial Sequence
  MKO10085977_B_Flrt3
  gRNA
ucuguaugucgcugugacgc

SEQ ID NO: 85978 - RNA, 20 nt, Artificial Sequence
  MKO10085978_B_Flt1
  gRNA
uuugauacucuuaccccuga

SEQ ID NO: 85979 - RNA, 20 nt, Artificial Sequence
  MKO10085979_B_Flt1
  gRNA
uuccgucaugugcacaaguu

SEQ ID NO: 85980 - RNA, 20 nt, Artificial Sequence
  MKO10085980_B_Flt1
  gRNA
acccaaacuugugcacauga

SEQ ID NO: 85981 - RNA, 20 nt, Artificial Sequence
  MKO10085981_B_Flt3l
  gRNA
uggacgaaucgcagacauuc

SEQ ID NO: 85982 - RNA, 20 nt, Artificial Sequence
  MKO10085982_B_Flt3l
  gRNA
gucuaagaugcaaacgcuuc

SEQ ID NO: 85983 - RNA, 20 nt, Artificial Sequence
  MKO10085983_B_Flt3l
  gRNA
ugacuggguaaucuuuaagc

SEQ ID NO: 85984 - RNA, 20 nt, Artificial Sequence
  MKO10085984_B_Flt3
  gRNA
aagaccuccagugugccccg

SEQ ID NO: 85985 - RNA, 20 nt, Artificial Sequence
  MKO10085985_B_Flt3
  gRNA
ccgcagaggaaucguuucca

SEQ ID NO: 85986 - RNA, 20 nt, Artificial Sequence
  MKO10085986_B_Flt3
  gRNA
cgcacugcucugcaucuccg

SEQ ID NO: 85987 - RNA, 20 nt, Artificial Sequence
  MKO10085987_B_Flt4
  gRNA
cagcuguggugcccucaauc

SEQ ID NO: 85988 - RNA, 20 nt, Artificial Sequence
  MKO10085988_B_Flt4
  gRNA
caacaaaccugacacgcucc

SEQ ID NO: 85989 - RNA, 20 nt, Artificial Sequence
  MKO10085989_B_Flt4
  gRNA
ccgagcgcagugugauguug

SEQ ID NO: 85990 - RNA, 20 nt, Artificial Sequence
  MKO10085990_B_Flywch1
  gRNA
gcuccacaggguacaaccau

SEQ ID NO: 85991 - RNA, 20 nt, Artificial Sequence
  MKO10085991_B_Flywch1
  gRNA
uacccccauagcaagucuuc

SEQ ID NO: 85992 - RNA, 20 nt, Artificial Sequence
  MKO10085992_B_Flywch1
  gRNA
ucuuggacuucagcgcccuc

SEQ ID NO: 85993 - RNA, 20 nt, Artificial Sequence
  MKO10085993_B_Flywch2
  gRNA
ccugacccuccauugucuuc

SEQ ID NO: 85994 - RNA, 20 nt, Artificial Sequence
  MKO10085994_B_Flywch2
  gRNA
agugcacugcaucauguccc

SEQ ID NO: 85995 - RNA, 20 nt, Artificial Sequence
  MKO10085995_B_Flywch2
  gRNA
agggccuuagccaagguggc

SEQ ID NO: 85996 - RNA, 20 nt, Artificial Sequence
  MKO10085996_B_Fmn1
  gRNA
ccaaaccccuccauccuuau

SEQ ID NO: 85997 - RNA, 20 nt, Artificial Sequence
  MKO10085997_B_Fmn1
  gRNA
cugcuauccuacaucugaag

SEQ ID NO: 85998 - RNA, 20 nt, Artificial Sequence
  MKO10085998_B_Fmn1
  gRNA
ugugcucccucuucagaugu

SEQ ID NO: 85999 - RNA, 20 nt, Artificial Sequence
  MKO10085999_B_Fmn2
  gRNA
gaagacccauggcgaugauc

SEQ ID NO: 86000 - RNA, 20 nt, Artificial Sequence
  MKO10086000_B_Fmn2
  gRNA
ggagguggaacccccauacc

SEQ ID NO: 86001 - RNA, 20 nt, Artificial Sequence
  MKO10086001_B_Fmn2
  gRNA
agaaccuaaauccucuauuu

SEQ ID NO: 86002 - RNA, 20 nt, Artificial Sequence
  MKO10086002_B_Fmnl1
  gRNA
uaccgguggggucagccgaa

SEQ ID NO: 86003 - RNA, 20 nt, Artificial Sequence
  MKO10086003_B_Fmnl1
  gRNA
aucugauuggauguccaacc

SEQ ID NO: 86004 - RNA, 20 nt, Artificial Sequence
  MKO10086004_B_Fmnl1
  gRNA
uacacaggugcugcgggaac

SEQ ID NO: 86005 - RNA, 20 nt, Artificial Sequence
  MKO10086005_B_Fmnl2
  gRNA
accuaccuccugacaaagcc

SEQ ID NO: 86006 - RNA, 20 nt, Artificial Sequence
  MKO10086006_B_Fmnl2
  gRNA
ucauuaagaaccaaccacau

SEQ ID NO: 86007 - RNA, 20 nt, Artificial Sequence
  MKO10086007_B_Fmnl2
  gRNA
acguacauacagaagcucaa

SEQ ID NO: 86008 - RNA, 20 nt, Artificial Sequence
  MKO10086008_B_Fmnl3
  gRNA
cuuuaccuuccguguuacau

SEQ ID NO: 86009 - RNA, 20 nt, Artificial Sequence
  MKO10086009_B_Fmnl3
  gRNA
ugucauacugucgcagcagc

SEQ ID NO: 86010 - RNA, 20 nt, Artificial Sequence
  MKO10086010_B_Fmnl3
  gRNA
guacuuacaugacagaacac

SEQ ID NO: 86011 - RNA, 20 nt, Artificial Sequence
  MKO10086011_B_Fmo1
  gRNA
gagcuacaccguaauucacg

SEQ ID NO: 86012 - RNA, 20 nt, Artificial Sequence
  MKO10086012_B_Fmo1
  gRNA
gcgaguccuuguaguuggaa

SEQ ID NO: 86013 - RNA, 20 nt, Artificial Sequence
  MKO10086013_B_Fmo1
  gRNA
ugugccaaauucucuauucc

SEQ ID NO: 86014 - RNA, 20 nt, Artificial Sequence
  MKO10086014_B_Fmo2
  gRNA
agagauucgacucaugaccc

SEQ ID NO: 86015 - RNA, 20 nt, Artificial Sequence
  MKO10086015_B_Fmo2
  gRNA
ugcccagaagaugcgaaguc

SEQ ID NO: 86016 - RNA, 20 nt, Artificial Sequence
  MKO10086016_B_Fmo2
  gRNA
acuucgcaucuucugggcaa

SEQ ID NO: 86017 - RNA, 20 nt, Artificial Sequence
  MKO10086017_B_Fmo3
  gRNA
gaugcuacaaugauuuguuc

SEQ ID NO: 86018 - RNA, 20 nt, Artificial Sequence
  MKO10086018_B_Fmo3
  gRNA
uucacaggaccauauagaag

SEQ ID NO: 86019 - RNA, 20 nt, Artificial Sequence
  MKO10086019_B_Fmo3
  gRNA
ugucacagccugaguucccc

SEQ ID NO: 86020 - RNA, 20 nt, Artificial Sequence
  MKO10086020_B_Fmo4
  gRNA
cuuccggggcaagcgcaucc

SEQ ID NO: 86021 - RNA, 20 nt, Artificial Sequence
  MKO10086021_B_Fmo4
  gRNA
guccaguuuauaaaacguga

SEQ ID NO: 86022 - RNA, 20 nt, Artificial Sequence
  MKO10086022_B_Fmo4
  gRNA
guguuucucagcacuagaac

SEQ ID NO: 86023 - RNA, 20 nt, Artificial Sequence
  MKO10086023_B_Fmo5
  gRNA
gcuuggaucuugaaccgugu

SEQ ID NO: 86024 - RNA, 20 nt, Artificial Sequence
  MKO10086024_B_Fmo5
  gRNA
uacuacuugucacguaucug

SEQ ID NO: 86025 - RNA, 20 nt, Artificial Sequence
  MKO10086025_B_Fmo5
  gRNA
ggugugcacgggucaucaca

SEQ ID NO: 86026 - RNA, 20 nt, Artificial Sequence
  MKO10086026_B_Fmo6
  gRNA
uuaggucuagagcacuuucg

SEQ ID NO: 86027 - RNA, 20 nt, Artificial Sequence
  MKO10086027_B_Fmo6
  gRNA
cacgucguucgcucagaaga

SEQ ID NO: 86028 - RNA, 20 nt, Artificial Sequence
  MKO10086028_B_Fmo6
  gRNA
ugcuguugagcucagucguc

SEQ ID NO: 86029 - RNA, 20 nt, Artificial Sequence
  MKO10086029_B_Fmo9
  gRNA
uggcauugggaauuccggug

SEQ ID NO: 86030 - RNA, 20 nt, Artificial Sequence
  MKO10086030_B_Fmo9
  gRNA
cgccaagcgcuucagucuuc

SEQ ID NO: 86031 - RNA, 20 nt, Artificial Sequence
  MKO10086031_B_Fmo9
  gRNA
auccagaagacugaagcgcu

SEQ ID NO: 86032 - RNA, 20 nt, Artificial Sequence
  MKO10086032_B_Fmod
  gRNA
gcuugaucucguucccaucc

SEQ ID NO: 86033 - RNA, 20 nt, Artificial Sequence
  MKO10086033_B_Fmod
  gRNA
guagacguacuucaugcggg

SEQ ID NO: 86034 - RNA, 20 nt, Artificial Sequence
  MKO10086034_B_Fmod
  gRNA
aggccccucagaucucgaug

SEQ ID NO: 86035 - RNA, 20 nt, Artificial Sequence
  MKO10086035_B_Fmr1nb
  gRNA
ggccuccgagugccgaccag

SEQ ID NO: 86036 - RNA, 20 nt, Artificial Sequence
  MKO10086036_B_Fmr1nb
  gRNA
ucugacgccuuccuuccuuu

SEQ ID NO: 86037 - RNA, 20 nt, Artificial Sequence
  MKO10086037_B_Fmr1nb
  gRNA
cuuuaaggaagaggaugaac

SEQ ID NO: 86038 - RNA, 20 nt, Artificial Sequence
  MKO10086038_B_Fmr1
  gRNA
uacuuuccauaagaucaagc

SEQ ID NO: 86039 - RNA, 20 nt, Artificial Sequence
  MKO10086039_B_Fmr1
  gRNA
gugagauucccaccaccugu

SEQ ID NO: 86040 - RNA, 20 nt, Artificial Sequence
  MKO10086040_B_Fmr1
  gRNA
agcuaaagugaggaugauaa

SEQ ID NO: 86041 - RNA, 20 nt, Artificial Sequence
  MKO10086041_B_Fn1
  gRNA
ccuacgucgugggggagacc

SEQ ID NO: 86042 - RNA, 20 nt, Artificial Sequence
  MKO10086042_B_Fn1
  gRNA
gacuguaccugcaucggggc

SEQ ID NO: 86043 - RNA, 20 nt, Artificial Sequence
  MKO10086043_B_Fn1
  gRNA
ccacuuaccuauagguuugc

SEQ ID NO: 86044 - RNA, 20 nt, Artificial Sequence
  MKO10086044_B_Fn3krp
  gRNA
caugcucgugauggagcauu

SEQ ID NO: 86045 - RNA, 20 nt, Artificial Sequence
  MKO10086045_B_Fn3krp
  gRNA
uuuagucaugccaccaagcu

SEQ ID NO: 86046 - RNA, 20 nt, Artificial Sequence
  MKO10086046_B_Fn3krp
  gRNA
cacuugugcagguaaaugac

SEQ ID NO: 86047 - RNA, 20 nt, Artificial Sequence
  MKO10086047_B_Fn3k
  gRNA
cuggaggcccuccgcaacac

SEQ ID NO: 86048 - RNA, 20 nt, Artificial Sequence
  MKO10086048_B_Fn3k
  gRNA
ccccagggugugaccaaguu

SEQ ID NO: 86049 - RNA, 20 nt, Artificial Sequence
  MKO10086049_B_Fn3k
  gRNA
cacuguguucugccgagucu

SEQ ID NO: 86050 - RNA, 20 nt, Artificial Sequence
  MKO10086050_B_Fnbp1l
  gRNA
ugagcuggggcaccgagcug

SEQ ID NO: 86051 - RNA, 20 nt, Artificial Sequence
  MKO10086051_B_Fnbp1l
  gRNA
cauagucguuuaacucauua

SEQ ID NO: 86052 - RNA, 20 nt, Artificial Sequence
  MKO10086052_B_Fnbp1l
  gRNA
cagcucggugccccagcuca

SEQ ID NO: 86053 - RNA, 20 nt, Artificial Sequence
  MKO10086053_B_Fnbp1
  gRNA
gguaguauucccauugcucc

SEQ ID NO: 86054 - RNA, 20 nt, Artificial Sequence
  MKO10086054_B_Fnbp1
  gRNA
ucucgaaguacugcugugcc

SEQ ID NO: 86055 - RNA, 20 nt, Artificial Sequence
  MKO10086055_B_Fnbp1
  gRNA
gcugagccuuccguccauca

SEQ ID NO: 86056 - RNA, 20 nt, Artificial Sequence
  MKO10086056_B_Fnbp4
  gRNA
gucggucugguggucaugac

SEQ ID NO: 86057 - RNA, 20 nt, Artificial Sequence
  MKO10086057_B_Fnbp4
  gRNA
gcagguguugccgcuucuuu

SEQ ID NO: 86058 - RNA, 20 nt, Artificial Sequence
  MKO10086058_B_Fnbp4
  gRNA
cagugugcugucaaugucag

SEQ ID NO: 86059 - RNA, 20 nt, Artificial Sequence
  MKO10086059_B_Fnd3c2
  gRNA
uaauucuaugucauuugaau

SEQ ID NO: 86060 - RNA, 20 nt, Artificial Sequence
  MKO10086060_B_Fnd3c2
  gRNA
uuagaacacaauacagagaa

SEQ ID NO: 86061 - RNA, 20 nt, Artificial Sequence
  MKO10086061_B_Fnd3c2
  gRNA
cccgaucugcuacuguuuca

SEQ ID NO: 86062 - RNA, 20 nt, Artificial Sequence
  MKO10086062_B_Fndc1
  gRNA
agaaaaccccgagaucuucg

SEQ ID NO: 86063 - RNA, 20 nt, Artificial Sequence
  MKO10086063_B_Fndc1
  gRNA
acccggacacuaaugucuuc

SEQ ID NO: 86064 - RNA, 20 nt, Artificial Sequence
  MKO10086064_B_Fndc1
  gRNA
ggcagagucagcccgucuau

SEQ ID NO: 86065 - RNA, 20 nt, Artificial Sequence
  MKO10086065_B_Fndc3a
  gRNA
gaagggcauuucugcgguga

SEQ ID NO: 86066 - RNA, 20 nt, Artificial Sequence
  MKO10086066_B_Fndc3a
  gRNA
gacaucauuggaaccugagc

SEQ ID NO: 86067 - RNA, 20 nt, Artificial Sequence
  MKO10086067_B_Fndc3a
  gRNA
cauaccuguggggcauaucc

SEQ ID NO: 86068 - RNA, 20 nt, Artificial Sequence
  MKO10086068_B_Fndc3b
  gRNA
cccacaauauauagcgagcc

SEQ ID NO: 86069 - RNA, 20 nt, Artificial Sequence
  MKO10086069_B_Fndc3b
  gRNA
auucuuguccaagugaaccc

SEQ ID NO: 86070 - RNA, 20 nt, Artificial Sequence
  MKO10086070_B_Fndc3b
  gRNA
gaccuuuaccaucagagccg

SEQ ID NO: 86071 - RNA, 20 nt, Artificial Sequence
  MKO10086071_B_Fndc3c1
  gRNA
guauuuguucaaguuaaccc

SEQ ID NO: 86072 - RNA, 20 nt, Artificial Sequence
  MKO10086072_B_Fndc3c1
  gRNA
aauagaaauguugccgcugg

SEQ ID NO: 86073 - RNA, 20 nt, Artificial Sequence
  MKO10086073_B_Fndc3c1
  gRNA
caucaucagccuuuauggua

SEQ ID NO: 86074 - RNA, 20 nt, Artificial Sequence
  MKO10086074_B_Fndc4
  gRNA
ggagagcggccauugcagac

SEQ ID NO: 86075 - RNA, 20 nt, Artificial Sequence
  MKO10086075_B_Fndc4
  gRNA
ucucugauuacacgcugccc

SEQ ID NO: 86076 - RNA, 20 nt, Artificial Sequence
  MKO10086076_B_Fndc4
  gRNA
cuucuuaggugauauuacag

SEQ ID NO: 86077 - RNA, 20 nt, Artificial Sequence
  MKO10086077_B_Fndc5
  gRNA
agaauauaucguccaugugc

SEQ ID NO: 86078 - RNA, 20 nt, Artificial Sequence
  MKO10086078_B_Fndc5
  gRNA
ccccugugaacgugaccguc

SEQ ID NO: 86079 - RNA, 20 nt, Artificial Sequence
  MKO10086079_B_Fndc5
  gRNA
ccucccccguucgcagcugc

SEQ ID NO: 86080 - RNA, 20 nt, Artificial Sequence
  MKO10086080_B_Fndc7
  gRNA
gcaauaguaucaccguagaa

SEQ ID NO: 86081 - RNA, 20 nt, Artificial Sequence
  MKO10086081_B_Fndc7
  gRNA
cagguuauuucaucuaaaac

SEQ ID NO: 86082 - RNA, 20 nt, Artificial Sequence
  MKO10086082_B_Fndc7
  gRNA
cacucuccucugucugaaaa

SEQ ID NO: 86083 - RNA, 20 nt, Artificial Sequence
  MKO10086083_B_Fndc8
  gRNA
uugggcguguccuugucagc

SEQ ID NO: 86084 - RNA, 20 nt, Artificial Sequence
  MKO10086084_B_Fndc8
  gRNA
uucaucagaguggacggaau

SEQ ID NO: 86085 - RNA, 20 nt, Artificial Sequence
  MKO10086085_B_Fndc8
  gRNA
augagguuguuugcguugca

SEQ ID NO: 86086 - RNA, 20 nt, Artificial Sequence
  MKO10086086_B_Fndc9
  gRNA
gucuuacagagccggccaaa

SEQ ID NO: 86087 - RNA, 20 nt, Artificial Sequence
  MKO10086087_B_Fndc9
  gRNA
acaguagugacuauacggga

SEQ ID NO: 86088 - RNA, 20 nt, Artificial Sequence
  MKO10086088_B_Fndc9
  gRNA
gaacugccacgaaagaacuc

SEQ ID NO: 86089 - RNA, 20 nt, Artificial Sequence
  MKO10086089_B_Fnip1
  gRNA
caucaucucuccaagcauau

SEQ ID NO: 86090 - RNA, 20 nt, Artificial Sequence
  MKO10086090_B_Fnip1
  gRNA
ccuuaaaaauucaucagauc

SEQ ID NO: 86091 - RNA, 20 nt, Artificial Sequence
  MKO10086091_B_Fnip1
  gRNA
agugauagagcuauccaaag

SEQ ID NO: 86092 - RNA, 20 nt, Artificial Sequence
  MKO10086092_B_Fnip2
  gRNA
acuuuacuaaucaucaguug

SEQ ID NO: 86093 - RNA, 20 nt, Artificial Sequence
  MKO10086093_B_Fnip2
  gRNA
acaugucuuacuugguacuu

SEQ ID NO: 86094 - RNA, 20 nt, Artificial Sequence
  MKO10086094_B_Fnip2
  gRNA
gcaucugaugucagcaugcu

SEQ ID NO: 86095 - RNA, 20 nt, Artificial Sequence
  MKO10086095_B_Fnua
  gRNA
caucgcgcugcagaacagcu

SEQ ID NO: 86096 - RNA, 20 nt, Artificial Sequence
  MKO10086096_B_Fnua
  gRNA
cuggguuagggccgucauuc

SEQ ID NO: 86097 - RNA, 20 nt, Artificial Sequence
  MKO10086097_B_Fnua
  gRNA
cuacaucacugcgauaauug

SEQ ID NO: 86098 - RNA, 20 nt, Artificial Sequence
  MKO10086098_B_Fntb
  gRNA
cgaacccaucccccagauag

SEQ ID NO: 86099 - RNA, 20 nt, Artificial Sequence
  MKO10086099_B_Fntb
  gRNA
gucuggaugccagccgcccc

SEQ ID NO: 86100 - RNA, 20 nt, Artificial Sequence
  MKO10086100_B_Fntb
  gRNA
aguuuaaccaccuuguacca

SEQ ID NO: 86101 - RNA, 20 nt, Artificial Sequence
  MKO10086101_B_Focad
  gRNA
gauacaccaauccacaaacc

SEQ ID NO: 86102 - RNA, 20 nt, Artificial Sequence
  MKO10086102_B_Focad
  gRNA
guuaccuuucagggcauugc

SEQ ID NO: 86103 - RNA, 20 nt, Artificial Sequence
  MKO10086103_B_Focad
  gRNA
aagcggggaaaaggacauuc

SEQ ID NO: 86104 - RNA, 20 nt, Artificial Sequence
  MKO10086104_B_Folh1
  gRNA
aacauuaccaguagcuucau

SEQ ID NO: 86105 - RNA, 20 nt, Artificial Sequence
  MKO10086105_B_Folh1
  gRNA
aggacagcaagacaucguaa

SEQ ID NO: 86106 - RNA, 20 nt, Artificial Sequence
  MKO10086106_B_Folh1
  gRNA
ccuucaccagcaauuucaca

SEQ ID NO: 86107 - RNA, 20 nt, Artificial Sequence
  MKO10086107_B_Folr1
  gRNA
aguggcgagguucuaugccg

SEQ ID NO: 86108 - RNA, 20 nt, Artificial Sequence
  MKO10086108_B_Folr1
  gRNA
agggcauaacgaguguccug

SEQ ID NO: 86109 - RNA, 20 nt, Artificial Sequence
  MKO10086109_B_Folr1
  gRNA
uccgcucuuugcgccagcuc

SEQ ID NO: 86110 - RNA, 20 nt, Artificial Sequence
  MKO10086110_B_Folr2
  gRNA
guaguacucaaacgugugac

SEQ ID NO: 86111 - RNA, 20 nt, Artificial Sequence
  MKO10086111_B_Folr2
  gRNA
aacuucaccacguccucauu

SEQ ID NO: 86112 - RNA, 20 nt, Artificial Sequence
  MKO10086112_B_Folr2
  gRNA
cauccaugcaaacguugagu

SEQ ID NO: 86113 - RNA, 20 nt, Artificial Sequence
  MKO10086113_B_Folr4
  gRNA
aagcgccacaagcaagaacc

SEQ ID NO: 86114 - RNA, 20 nt, Artificial Sequence
  MKO10086114_B_Folr4
  gRNA
gcugcacacguuccacaagu

SEQ ID NO: 86115 - RNA, 20 nt, Artificial Sequence
  MKO10086115_B_Folr4
  gRNA
aaggugggcuucccaacuug

SEQ ID NO: 86116 - RNA, 20 nt, Artificial Sequence
  MKO10086116_B_Fopnl
  gRNA
cagcugagaugcuugguugc

SEQ ID NO: 86117 - RNA, 20 nt, Artificial Sequence
  MKO10086117_B_Fopnl
  gRNA
acagccucuguccucauagc

SEQ ID NO: 86118 - RNA, 20 nt, Artificial Sequence
  MKO10086118_B_Fopnl
  gRNA
uggucaaccuguaguuccau

SEQ ID NO: 86119 - RNA, 20 nt, Artificial Sequence
  MKO10086119_B_Fosb
  gRNA
gagccggagucguagucucc

SEQ ID NO: 86120 - RNA, 20 nt, Artificial Sequence
  MKO10086120_B_Fosb
  gRNA
ccguaggagugcgccggucu

SEQ ID NO: 86121 - RNA, 20 nt, Artificial Sequence
  MKO10086121_B_Fosb
  gRNA
cgaaggaguccaccgaagac

SEQ ID NO: 86122 - RNA, 20 nt, Artificial Sequence
  MKO10086122_B_Fosl1
  gRNA
ccuagggcucguaugacucc

SEQ ID NO: 86123 - RNA, 20 nt, Artificial Sequence
  MKO10086123_B_Fosl1
  gRNA
cagggcauguaccgagacua

SEQ ID NO: 86124 - RNA, 20 nt, Artificial Sequence
  MKO10086124_B_Fosl1
  gRNA
uggugggcugcuagcaccgc

SEQ ID NO: 86125 - RNA, 20 nt, Artificial Sequence
  MKO10086125_B_Fosl2
  gRNA
cacgccgaguccuacuccag

SEQ ID NO: 86126 - RNA, 20 nt, Artificial Sequence
  MKO10086126_B_Fosl2
  gRNA
aaguuccggguagauaugcc

SEQ ID NO: 86127 - RNA, 20 nt, Artificial Sequence
  MKO10086127_B_Fosl2
  gRNA
gaacuuugacaccucguccc

SEQ ID NO: 86128 - RNA, 20 nt, Artificial Sequence
  MKO10086128_B_Fos
  gRNA
ccgcugcaguagcgccuccc

SEQ ID NO: 86129 - RNA, 20 nt, Artificial Sequence
  MKO10086129_B_Fos
  gRNA
cugugccgcugcccaccgaa

SEQ ID NO: 86130 - RNA, 20 nt, Artificial Sequence
  MKO10086130_B_Fos
  gRNA
guugaaacccgagaacauca

SEQ ID NO: 86131 - RNA, 20 nt, Artificial Sequence
  MKO10086131_B_Foxa1
  gRNA
aagggcaugagagcaacgac

SEQ ID NO: 86132 - RNA, 20 nt, Artificial Sequence
  MKO10086132_B_Foxa1
  gRNA
gggcgucacggccaugggua

SEQ ID NO: 86133 - RNA, 20 nt, Artificial Sequence
  MKO10086133_B_Foxa1
  gRNA
cgggcucagcgccguaccca

SEQ ID NO: 86134 - RNA, 20 nt, Artificial Sequence
  MKO10086134_B_Foxa2
  gRNA
cagcuacuacgcggagcccg

SEQ ID NO: 86135 - RNA, 20 nt, Artificial Sequence
  MKO10086135_B_Foxa2
  gRNA
caggccggccugcccguaca

SEQ ID NO: 86136 - RNA, 20 nt, Artificial Sequence
  MKO10086136_B_Foxa2
  gRNA
gaacaggucaugcacuaccc

SEQ ID NO: 86137 - RNA, 20 nt, Artificial Sequence
  MKO10086137_B_Foxa3
  gRNA
cuacuacccggaggcgggcg

SEQ ID NO: 86138 - RNA, 20 nt, Artificial Sequence
  MKO10086138_B_Foxa3
  gRNA
gacaucgacaccuuccaaac

SEQ ID NO: 86139 - RNA, 20 nt, Artificial Sequence
  MKO10086139_B_Foxa3
  gRNA
ccagcaggaaugguacugcg

SEQ ID NO: 86140 - RNA, 20 nt, Artificial Sequence
  MKO10086140_B_Foxb1
  gRNA
cucgaacauguccccgcagc

SEQ ID NO: 86141 - RNA, 20 nt, Artificial Sequence
  MKO10086141_B_Foxb1
  gRNA
gugcacggccaccgagugca

SEQ ID NO: 86142 - RNA, 20 nt, Artificial Sequence
  MKO10086142_B_Foxb1
  gRNA
aacuuguagaucucgcugag

SEQ ID NO: 86143 - RNA, 20 nt, Artificial Sequence
  MKO10086143_B_Foxb2
  gRNA
acccgugaccacgcugccgc

SEQ ID NO: 86144 - RNA, 20 nt, Artificial Sequence
  MKO10086144_B_Foxb2
  gRNA
gucccgguaggcccggagua

SEQ ID NO: 86145 - RNA, 20 nt, Artificial Sequence
  MKO10086145_B_Foxb2
  gRNA
ccgcccgaugauguucucua

SEQ ID NO: 86146 - RNA, 20 nt, Artificial Sequence
  MKO10086146_B_Foxc1
  gRNA
cgaacauuucccgcaccgag

SEQ ID NO: 86147 - RNA, 20 nt, Artificial Sequence
  MKO10086147_B_Foxc1
  gRNA
aguagcucugcucgccgccg

SEQ ID NO: 86148 - RNA, 20 nt, Artificial Sequence
  MKO10086148_B_Foxc1
  gRNA
gggcggcuacaccgccaugc

SEQ ID NO: 86149 - RNA, 20 nt, Artificial Sequence
  MKO10086149_B_Foxc2
  gRNA
guugaacaucucccggacgu

SEQ ID NO: 86150 - RNA, 20 nt, Artificial Sequence
  MKO10086150_B_Foxc2
  gRNA
caccacgccgcggcgccuaa

SEQ ID NO: 86151 - RNA, 20 nt, Artificial Sequence
  MKO10086151_B_Foxc2
  gRNA
uccuugggcccgucagcuac

SEQ ID NO: 86152 - RNA, 20 nt, Artificial Sequence
  MKO10086152_B_Foxd1
  gRNA
gccgcguggggagcgaguag

SEQ ID NO: 86153 - RNA, 20 nt, Artificial Sequence
  MKO10086153_B_Foxd1
  gRNA
cguguccucguccgccgcgc

SEQ ID NO: 86154 - RNA, 20 nt, Artificial Sequence
  MKO10086154_B_Foxd1
  gRNA
gagcuggcgcggaccgccuu

SEQ ID NO: 86155 - RNA, 20 nt, Artificial Sequence
  MKO10086155_B_Foxd2
  gRNA
cgcgacuuugcuggcaaacg

SEQ ID NO: 86156 - RNA, 20 nt, Artificial Sequence
  MKO10086156_B_Foxd2
  gRNA
caccacgucuaugucugcgu

SEQ ID NO: 86157 - RNA, 20 nt, Artificial Sequence
  MKO10086157_B_Foxd2
  gRNA
ucgccauucgccgcagccgc

SEQ ID NO: 86158 - RNA, 20 nt, Artificial Sequence
  MKO10086158_B_Foxd3
  gRNA
uuugcggcccagcucgcccg

SEQ ID NO: 86159 - RNA, 20 nt, Artificial Sequence
  MKO10086159_B_Foxd3
  gRNA
cagucguccggcucagcgac

SEQ ID NO: 86160 - RNA, 20 nt, Artificial Sequence
  MKO10086160_B_Foxd3
  gRNA
ggccgcaaagcggccgccuu

SEQ ID NO: 86161 - RNA, 20 nt, Artificial Sequence
  MKO10086161_B_Foxd4
  gRNA
ggggaacuuacggcgguaau

SEQ ID NO: 86162 - RNA, 20 nt, Artificial Sequence
  MKO10086162_B_Foxd4
  gRNA
uugccucagcagcgccgcaa

SEQ ID NO: 86163 - RNA, 20 nt, Artificial Sequence
  MKO10086163_B_Foxd4
  gRNA
caauauuguccgggaaccug

SEQ ID NO: 86164 - RNA, 20 nt, Artificial Sequence
  MKO10086164_B_Foxe1
  gRNA
cccgacggcgcguacccgca

SEQ ID NO: 86165 - RNA, 20 nt, Artificial Sequence
  MKO10086165_B_Foxe1
  gRNA
guaguagaccggcggaggcg

SEQ ID NO: 86166 - RNA, 20 nt, Artificial Sequence
  MKO10086166_B_Foxe1
  gRNA
cacgaaccgauccaccgcgc

SEQ ID NO: 86167 - RNA, 20 nt, Artificial Sequence
  MKO10086167_B_Foxe3
  gRNA
gguucggcucccgccagcgu

SEQ ID NO: 86168 - RNA, 20 nt, Artificial Sequence
  MKO10086168_B_Foxe3
  gRNA
gcaaggcggcucgggcgcca

SEQ ID NO: 86169 - RNA, 20 nt, Artificial Sequence
  MKO10086169_B_Foxe3
  gRNA
accgcgacagcccgcgcaag

SEQ ID NO: 86170 - RNA, 20 nt, Artificial Sequence
  MKO10086170_B_Foxf1
  gRNA
aggaucuuacuaucaccagc

SEQ ID NO: 86171 - RNA, 20 nt, Artificial Sequence
  MKO10086171_B_Foxf1
  gRNA
ggcuagcgaguuuauguucg

SEQ ID NO: 86172 - RNA, 20 nt, Artificial Sequence
  MKO10086172_B_Foxf1
  gRNA
cgcagccacccauguacgag

SEQ ID NO: 86173 - RNA, 20 nt, Artificial Sequence
  MKO10086173_B_Foxf2
  gRNA
acuccacuccagugugcgac

SEQ ID NO: 86174 - RNA, 20 nt, Artificial Sequence
  MKO10086174_B_Foxf2
  gRNA
cacuuccgccugaagccgcg

SEQ ID NO: 86175 - RNA, 20 nt, Artificial Sequence
  MKO10086175_B_Foxf2
  gRNA
acuccgccgcgcgugcagcc

SEQ ID NO: 86176 - RNA, 20 nt, Artificial Sequence
  MKO10086176_B_Foxg1
  gRNA
guccuccucuacgucgccgc

SEQ ID NO: 86177 - RNA, 20 nt, Artificial Sequence
  MKO10086177_B_Foxg1
  gRNA
gggggccugcggcgacguag

SEQ ID NO: 86178 - RNA, 20 nt, Artificial Sequence
  MKO10086178_B_Foxg1
  gRNA
gaggcgcgccccgcgcuuaa

SEQ ID NO: 86179 - RNA, 20 nt, Artificial Sequence
  MKO10086179_B_Foxh1
  gRNA
uacuacauugggcguauaga

SEQ ID NO: 86180 - RNA, 20 nt, Artificial Sequence
  MKO10086180_B_Foxh1
  gRNA
gggugcggccugaauuacca

SEQ ID NO: 86181 - RNA, 20 nt, Artificial Sequence
  MKO10086181_B_Foxh1
  gRNA
cugauuucagauuauccguc

SEQ ID NO: 86182 - RNA, 20 nt, Artificial Sequence
  MKO10086182_B_Foxi1
  gRNA
gaaaacggagaacggucucc

SEQ ID NO: 86183 - RNA, 20 nt, Artificial Sequence
  MKO10086183_B_Foxi1
  gRNA
gggcgcaccguggauugcca

SEQ ID NO: 86184 - RNA, 20 nt, Artificial Sequence
  MKO10086184_B_Foxi1
  gRNA
ccccgagaugaggacgaccc

SEQ ID NO: 86185 - RNA, 20 nt, Artificial Sequence
  MKO10086185_B_Foxi2
  gRNA
gcgaagccuggcgcgguguu

SEQ ID NO: 86186 - RNA, 20 nt, Artificial Sequence
  MKO10086186_B_Foxi2
  gRNA
cgcccuacgcgacgggacca

SEQ ID NO: 86187 - RNA, 20 nt, Artificial Sequence
  MKO10086187_B_Foxi2
  gRNA
guagcucgggggaugcgcga

SEQ ID NO: 86188 - RNA, 20 nt, Artificial Sequence
  MKO10086188_B_Foxi3
  gRNA
gguuacugcuggccuccgcg

SEQ ID NO: 86189 - RNA, 20 nt, Artificial Sequence
  MKO10086189_B_Foxi3
  gRNA
gccgacauggcccuguauug

SEQ ID NO: 86190 - RNA, 20 nt, Artificial Sequence
  MKO10086190_B_Foxi3
  gRNA
cggcgacgaacugguaaaug

SEQ ID NO: 86191 - RNA, 20 nt, Artificial Sequence
  MKO10086191_B_Foxj1
  gRNA
ugagcaggcgcucugcguac

SEQ ID NO: 86192 - RNA, 20 nt, Artificial Sequence
  MKO10086192_B_Foxj1
  gRNA
gaguaggguggcuucacgug

SEQ ID NO: 86193 - RNA, 20 nt, Artificial Sequence
  MKO10086193_B_Foxj1
  gRNA
cuccgggacccgcuccgcag

SEQ ID NO: 86194 - RNA, 20 nt, Artificial Sequence
  MKO10086194_B_Foxj2
  gRNA
agucaugguugguguuguag

SEQ ID NO: 86195 - RNA, 20 nt, Artificial Sequence
  MKO10086195_B_Foxj2
  gRNA
acuucagagccccuccuccg

SEQ ID NO: 86196 - RNA, 20 nt, Artificial Sequence
  MKO10086196_B_Foxj2
  gRNA
cuucucuuccgggaaauguc

SEQ ID NO: 86197 - RNA, 20 nt, Artificial Sequence
  MKO10086197_B_Foxj3
  gRNA
uaccuuuccgggaucauccu

SEQ ID NO: 86198 - RNA, 20 nt, Artificial Sequence
  MKO10086198_B_Foxj3
  gRNA
guaaccaguccauagauguu

SEQ ID NO: 86199 - RNA, 20 nt, Artificial Sequence
  MKO10086199_B_Foxj3
  gRNA
gggaagugccucuccaacuc

SEQ ID NO: 86200 - RNA, 20 nt, Artificial Sequence
  MKO10086200_B_Foxk1
  gRNA
cccgaagggggugcggaagc

SEQ ID NO: 86201 - RNA, 20 nt, Artificial Sequence
  MKO10086201_B_Foxk1
  gRNA
uaugguauagcgaugugaac

SEQ ID NO: 86202 - RNA, 20 nt, Artificial Sequence
  MKO10086202_B_Foxk1
  gRNA
ugugaccuccgaccuucagc

SEQ ID NO: 86203 - RNA, 20 nt, Artificial Sequence
  MKO10086203_B_Foxk2
  gRNA
caucaacauuccagacacga

SEQ ID NO: 86204 - RNA, 20 nt, Artificial Sequence
  MKO10086204_B_Foxk2
  gRNA
cuaaaaacuauccauacuac

SEQ ID NO: 86205 - RNA, 20 nt, Artificial Sequence
  MKO10086205_B_Foxk2
  gRNA
caucaaagugccacguuccc

SEQ ID NO: 86206 - RNA, 20 nt, Artificial Sequence
  MKO10086206_B_Foxl1
  gRNA
gagcgauccggcgcgcgcgu

SEQ ID NO: 86207 - RNA, 20 nt, Artificial Sequence
  MKO10086207_B_Foxl1
  gRNA
ggccgcgcggugccuacugc

SEQ ID NO: 86208 - RNA, 20 nt, Artificial Sequence
  MKO10086208_B_Foxl1
  gRNA
gcuucugcgggggcucgacg

SEQ ID NO: 86209 - RNA, 20 nt, Artificial Sequence
  MKO10086209_B_Foxl2
  gRNA
ugcgcggggucugguuucuc

SEQ ID NO: 86210 - RNA, 20 nt, Artificial Sequence
  MKO10086210_B_Foxl2
  gRNA
augcucugcacgcgcgagua

SEQ ID NO: 86211 - RNA, 20 nt, Artificial Sequence
  MKO10086211_B_Foxl2
  gRNA
uugacugcgcguccgcucuc

SEQ ID NO: 86212 - RNA, 20 nt, Artificial Sequence
  MKO10086212_B_Foxm1
  gRNA
caguuccugcuuaacgcugc

SEQ ID NO: 86213 - RNA, 20 nt, Artificial Sequence
  MKO10086213_B_Foxm1
  gRNA
ggacacucaccuuaaacacu

SEQ ID NO: 86214 - RNA, 20 nt, Artificial Sequence
  MKO10086214_B_Foxm1
  gRNA
cuacagguugaggagcccuc

SEQ ID NO: 86215 - RNA, 20 nt, Artificial Sequence
  MKO10086215_B_Foxn1
  gRNA
ccccuacaguacuccccggg

SEQ ID NO: 86216 - RNA, 20 nt, Artificial Sequence
  MKO10086216_B_Foxn1
  gRNA
ggcugguagcaguacauccc

SEQ ID NO: 86217 - RNA, 20 nt, Artificial Sequence
  MKO10086217_B_Foxn1
  gRNA
uuccggucuuacuguucuua

SEQ ID NO: 86218 - RNA, 20 nt, Artificial Sequence
  MKO10086218_B_Foxn2
  gRNA
agccaagugcaaacucucca

SEQ ID NO: 86219 - RNA, 20 nt, Artificial Sequence
  MKO10086219_B_Foxn2
  gRNA
uaccuuggagaguuugcacu

SEQ ID NO: 86220 - RNA, 20 nt, Artificial Sequence
  MKO10086220_B_Foxn2
  gRNA
uaccuuuguggagaagaaaa

SEQ ID NO: 86221 - RNA, 20 nt, Artificial Sequence
  MKO10086221_B_Foxn3
  gRNA
cugagucgagggcuguuucc

SEQ ID NO: 86222 - RNA, 20 nt, Artificial Sequence
  MKO10086222_B_Foxn3
  gRNA
acuuaccuuugauaagccug

SEQ ID NO: 86223 - RNA, 20 nt, Artificial Sequence
  MKO10086223_B_Foxn3
  gRNA
uagacaccuaccuugcagga

SEQ ID NO: 86224 - RNA, 20 nt, Artificial Sequence
  MKO10086224_B_Foxn4
  gRNA
uaggaaggccgagccgaaaa

SEQ ID NO: 86225 - RNA, 20 nt, Artificial Sequence
  MKO10086225_B_Foxn4
  gRNA
gugcugggcuugagcccuau

SEQ ID NO: 86226 - RNA, 20 nt, Artificial Sequence
  MKO10086226_B_Foxn4
  gRNA
guggggccgcacccacaugc

SEQ ID NO: 86227 - RNA, 20 nt, Artificial Sequence
  MKO10086227_B_Foxo1
  gRNA
uacgcuggcaugaccgaauu

SEQ ID NO: 86228 - RNA, 20 nt, Artificial Sequence
  MKO10086228_B_Foxo1
  gRNA
cgcguugcggcgcgacgagc

SEQ ID NO: 86229 - RNA, 20 nt, Artificial Sequence
  MKO10086229_B_Foxo1
  gRNA
aauucggucaugccagcgua

SEQ ID NO: 86230 - RNA, 20 nt, Artificial Sequence
  MKO10086230_B_Foxo3
  gRNA
gcuccucgcggcggaaugcc

SEQ ID NO: 86231 - RNA, 20 nt, Artificial Sequence
  MKO10086231_B_Foxo3
  gRNA
cguuggaauuggugcgcgag

SEQ ID NO: 86232 - RNA, 20 nt, Artificial Sequence
  MKO10086232_B_Foxo3
  gRNA
uguccgcccagaaugcccgc

SEQ ID NO: 86233 - RNA, 20 nt, Artificial Sequence
  MKO10086233_B_Foxo4
  gRNA
ccuguguccuacgccgcuag

SEQ ID NO: 86234 - RNA, 20 nt, Artificial Sequence
  MKO10086234_B_Foxo4
  gRNA
gccacacgaaccguccgagg

SEQ ID NO: 86235 - RNA, 20 nt, Artificial Sequence
  MKO10086235_B_Foxo4
  gRNA
uccaccucggacgguucgug

SEQ ID NO: 86236 - RNA, 20 nt, Artificial Sequence
  MKO10086236_B_Foxo6
  gRNA
ugcgcugcccgggcccuacg

SEQ ID NO: 86237 - RNA, 20 nt, Artificial Sequence
  MKO10086237_B_Foxo6
  gRNA
ggcuucgggccgcccgcucu

SEQ ID NO: 86238 - RNA, 20 nt, Artificial Sequence
  MKO10086238_B_Foxo6
  gRNA
uucauccgcgugcagaacga

SEQ ID NO: 86239 - RNA, 20 nt, Artificial Sequence
  MKO10086239_B_Foxp1
  gRNA
uuguuaggaggccuuggcgc

SEQ ID NO: 86240 - RNA, 20 nt, Artificial Sequence
  MKO10086240_B_Foxp1
  gRNA
aguggcuaugaugacaccuc

SEQ ID NO: 86241 - RNA, 20 nt, Artificial Sequence
  MKO10086241_B_Foxp1
  gRNA
gcaggcccucaugcuucaac

SEQ ID NO: 86242 - RNA, 20 nt, Artificial Sequence
  MKO10086242_B_Foxp2
  gRNA
gcaagcugugauguugcagc

SEQ ID NO: 86243 - RNA, 20 nt, Artificial Sequence
  MKO10086243_B_Foxp2
  gRNA
uuguuacagcagcaaaccag

SEQ ID NO: 86244 - RNA, 20 nt, Artificial Sequence
  MKO10086244_B_Foxp2
  gRNA
gaucacuuggggagucauca

SEQ ID NO: 86245 - RNA, 20 nt, Artificial Sequence
  MKO10086245_B_Foxp3
  gRNA
ggaccuagucgggccccaga

SEQ ID NO: 86246 - RNA, 20 nt, Artificial Sequence
  MKO10086246_B_Foxp3
  gRNA
ucgaagaccuucucacaacc

SEQ ID NO: 86247 - RNA, 20 nt, Artificial Sequence
  MKO10086247_B_Foxp3
  gRNA
ccuggacacccauuccagac

SEQ ID NO: 86248 - RNA, 20 nt, Artificial Sequence
  MKO10086248_B_Foxp4
  gRNA
ccugcucaccugcaccgcag

SEQ ID NO: 86249 - RNA, 20 nt, Artificial Sequence
  MKO10086249_B_Foxp4
  gRNA
ccugcagcugagguggcgac

SEQ ID NO: 86250 - RNA, 20 nt, Artificial Sequence
  MKO10086250_B_Foxp4
  gRNA
ugucuuacaggcucuccagg

SEQ ID NO: 86251 - RNA, 20 nt, Artificial Sequence
  MKO10086251_B_Foxq1
  gRNA
cgcgggcggacgccugacac

SEQ ID NO: 86252 - RNA, 20 nt, Artificial Sequence
  MKO10086252_B_Foxq1
  gRNA
ggcuugggccgccgcgugua

SEQ ID NO: 86253 - RNA, 20 nt, Artificial Sequence
  MKO10086253_B_Foxq1
  gRNA
uccgguggcugaggcgcuug

SEQ ID NO: 86254 - RNA, 20 nt, Artificial Sequence
  MKO10086254_B_Foxr1
  gRNA
ggaaggcagacagcgcacuc

SEQ ID NO: 86255 - RNA, 20 nt, Artificial Sequence
  MKO10086255_B_Foxr1
  gRNA
auggcuugcggaagccucca

SEQ ID NO: 86256 - RNA, 20 nt, Artificial Sequence
  MKO10086256_B_Foxr1
  gRNA
cagacauuaagcccaaucug

SEQ ID NO: 86257 - RNA, 20 nt, Artificial Sequence
  MKO10086257_B_Foxr2
  gRNA
cccaccgggagaaggagucc

SEQ ID NO: 86258 - RNA, 20 nt, Artificial Sequence
  MKO10086258_B_Foxr2
  gRNA
cuguaguugaguggagggcg

SEQ ID NO: 86259 - RNA, 20 nt, Artificial Sequence
  MKO10086259_B_Foxr2
  gRNA
ugugugccccaucaacagca

SEQ ID NO: 86260 - RNA, 20 nt, Artificial Sequence
  MKO10086260_B_Foxred1
  gRNA
augaccacauccgccuguuc

SEQ ID NO: 86261 - RNA, 20 nt, Artificial Sequence
  MKO10086261_B_Foxred1
  gRNA
ugccaaaucccgcccacaga

SEQ ID NO: 86262 - RNA, 20 nt, Artificial Sequence
  MKO10086262_B_Foxred1
  gRNA
gauguggucaucauaggagg

SEQ ID NO: 86263 - RNA, 20 nt, Artificial Sequence
  MKO10086263_B_Foxred2
  gRNA
gggcuacucacuccuucaac

SEQ ID NO: 86264 - RNA, 20 nt, Artificial Sequence
  MKO10086264_B_Foxred2
  gRNA
cgaccgugucauccgcugcc

SEQ ID NO: 86265 - RNA, 20 nt, Artificial Sequence
  MKO10086265_B_Foxred2
  gRNA
gggguacgagucuguguccg

SEQ ID NO: 86266 - RNA, 20 nt, Artificial Sequence
  MKO10086266_B_Foxs1
  gRNA
ugccacgacauguuccagca

SEQ ID NO: 86267 - RNA, 20 nt, Artificial Sequence
  MKO10086267_B_Foxs1
  gRNA
agacgcuucaccaaacgcac

SEQ ID NO: 86268 - RNA, 20 nt, Artificial Sequence
  MKO10086268_B_Foxs1
  gRNA
acccucaaagcuuaagcccu

SEQ ID NO: 86269 - RNA, 20 nt, Artificial Sequence
  MKO10086269_B_Fpgs
  gRNA
gcgccaacggagugaccccc

SEQ ID NO: 86270 - RNA, 20 nt, Artificial Sequence
  MKO10086270_B_Fpgs
  gRNA
cuaaacauuauucaugucac

SEQ ID NO: 86271 - RNA, 20 nt, Artificial Sequence
  MKO10086271_B_Fpgs
  gRNA
ugacaugaauaauguuuagc

SEQ ID NO: 86272 - RNA, 20 nt, Artificial Sequence
  MKO10086272_B_Fpgu
  gRNA
cuuagcccauccgucuaguc

SEQ ID NO: 86273 - RNA, 20 nt, Artificial Sequence
  MKO10086273_B_Fpgu
  gRNA
aagguccugcuaauccacuc

SEQ ID NO: 86274 - RNA, 20 nt, Artificial Sequence
  MKO10086274_B_Fpgu
  gRNA
acaugguauugaacuccaag

SEQ ID NO: 86275 - RNA, 20 nt, Artificial Sequence
  MKO10086275_B_Fpr-rs3
  gRNA
uggagagaacuaucacugag

SEQ ID NO: 86276 - RNA, 20 nt, Artificial Sequence
  MKO10086276_B_Fpr-rs3
  gRNA
auauucccugucugccaguc

SEQ ID NO: 86277 - RNA, 20 nt, Artificial Sequence
  MKO10086277_B_Fpr-rs3
  gRNA
ucgcagcgcccucuccagac

SEQ ID NO: 86278 - RNA, 20 nt, Artificial Sequence
  MKO10086278_B_Fpr-rs4
  gRNA
uaaagagaaccacuaaugag

SEQ ID NO: 86279 - RNA, 20 nt, Artificial Sequence
  MKO10086279_B_Fpr-rs4
  gRNA
cucuguaugccagucuagag

SEQ ID NO: 86280 - RNA, 20 nt, Artificial Sequence
  MKO10086280_B_Fpr-rs4
  gRNA
ccuaaucacucuuauugcca

SEQ ID NO: 86281 - RNA, 20 nt, Artificial Sequence
  MKO10086281_B_Fpr-rs6
  gRNA
ucuuugugaagacaaguuuc

SEQ ID NO: 86282 - RNA, 20 nt, Artificial Sequence
  MKO10086282_B_Fpr-rs6
  gRNA
guaaccaucaguuucauuau

SEQ ID NO: 86283 - RNA, 20 nt, Artificial Sequence
  MKO10086283_B_Fpr-rs6
  gRNA
auugucugacuucucuuaca

SEQ ID NO: 86284 - RNA, 20 nt, Artificial Sequence
  MKO10086284_B_Fpr1
  gRNA
uacagcgguccagugcaaug

SEQ ID NO: 86285 - RNA, 20 nt, Artificial Sequence
  MKO10086285_B_Fpr1
  gRNA
ugggcaacgggcucgugauc

SEQ ID NO: 86286 - RNA, 20 nt, Artificial Sequence
  MKO10086286_B_Fpr1
  gRNA
ucauguucuucaaccguuca

SEQ ID NO: 86287 - RNA, 20 nt, Artificial Sequence
  MKO10086287_B_Fpr2
  gRNA
agaacuggugcuugaaucac

SEQ ID NO: 86288 - RNA, 20 nt, Artificial Sequence
  MKO10086288_B_Fpr2
  gRNA
acugcuguaaggacucguaa

SEQ ID NO: 86289 - RNA, 20 nt, Artificial Sequence
  MKO10086289_B_Fpr2
  gRNA
uguuaacccaacaagcucau

SEQ ID NO: 86290 - RNA, 20 nt, Artificial Sequence
  MKO10086290_B_Fpr3
  gRNA
ucuaugauucuaccaucucc

SEQ ID NO: 86291 - RNA, 20 nt, Artificial Sequence
  MKO10086291_B_Fpr3
  gRNA
gaaaugugguuguugggucc

SEQ ID NO: 86292 - RNA, 20 nt, Artificial Sequence
  MKO10086292_B_Fpr3
  gRNA
cguccuuuccgaguucuuac

SEQ ID NO: 86293 - RNA, 20 nt, Artificial Sequence
  MKO10086293_B_Fra10ac1
  gRNA
ggagaaugauaagacagauc

SEQ ID NO: 86294 - RNA, 20 nt, Artificial Sequence
  MKO10086294_B_Fra10ac1
  gRNA
gcaaaagagaggacuuuaag

SEQ ID NO: 86295 - RNA, 20 nt, Artificial Sequence
  MKO10086295_B_Fra10ac1
  gRNA
cuucauccuccucauuccaa

SEQ ID NO: 86296 - RNA, 20 nt, Artificial Sequence
  MKO10086296_B_Fras1
  gRNA
augauaauggggugcauugu

SEQ ID NO: 86297 - RNA, 20 nt, Artificial Sequence
  MKO10086297_B_Fras1
  gRNA
cacaggugcuugucuguauc

SEQ ID NO: 86298 - RNA, 20 nt, Artificial Sequence
  MKO10086298_B_Fras1
  gRNA
gcugcccacagugugcaccc

SEQ ID NO: 86299 - RNA, 20 nt, Artificial Sequence
  MKO10086299_B_Frau1
  gRNA
ugguggacucgagcauuauu

SEQ ID NO: 86300 - RNA, 20 nt, Artificial Sequence
  MKO10086300_B_Frau1
  gRNA
ggucgucgucgucgccagug

SEQ ID NO: 86301 - RNA, 20 nt, Artificial Sequence
  MKO10086301_B_Frau1
  gRNA
cugagugugcuucccguccg

SEQ ID NO: 86302 - RNA, 20 nt, Artificial Sequence
  MKO10086302_B_Frau2
  gRNA
ggcgaucuccgcaacgcagu

SEQ ID NO: 86303 - RNA, 20 nt, Artificial Sequence
  MKO10086303_B_Frau2
  gRNA
cggggguggccgaagcggac

SEQ ID NO: 86304 - RNA, 20 nt, Artificial Sequence
  MKO10086304_B_Frau2
  gRNA
cugcguugcggagaucgccc

SEQ ID NO: 86305 - RNA, 20 nt, Artificial Sequence
  MKO10086305_B_Frem1
  gRNA
aaggagcaaaaccguauaca

SEQ ID NO: 86306 - RNA, 20 nt, Artificial Sequence
  MKO10086306_B_Frem1
  gRNA
aauggggauguaaucaaugu

SEQ ID NO: 86307 - RNA, 20 nt, Artificial Sequence
  MKO10086307_B_Frem1
  gRNA
ugaacgagcccguaacccag

SEQ ID NO: 86308 - RNA, 20 nt, Artificial Sequence
  MKO10086308_B_Frem2
  gRNA
cccaauucagucgaaaaugc

SEQ ID NO: 86309 - RNA, 20 nt, Artificial Sequence
  MKO10086309_B_Frem2
  gRNA
cuucaacagaguacucagac

SEQ ID NO: 86310 - RNA, 20 nt, Artificial Sequence
  MKO10086310_B_Frem2
  gRNA
cgucaucuuccacuaugaaa

SEQ ID NO: 86311 - RNA, 20 nt, Artificial Sequence
  MKO10086311_B_Frem3
  gRNA
aacuccagugcagccgcgcc

SEQ ID NO: 86312 - RNA, 20 nt, Artificial Sequence
  MKO10086312_B_Frem3
  gRNA
uacuucucuguugaaacccg

SEQ ID NO: 86313 - RNA, 20 nt, Artificial Sequence
  MKO10086313_B_Frem3
  gRNA
gucuacuacauccugaacaa

SEQ ID NO: 86314 - RNA, 20 nt, Artificial Sequence
  MKO10086314_B_Frg1
  gRNA
ugguggacuguauccaacuu

SEQ ID NO: 86315 - RNA, 20 nt, Artificial Sequence
  MKO10086315_B_Frg1
  gRNA
ggagacccaacuugauauug

SEQ ID NO: 86316 - RNA, 20 nt, Artificial Sequence
  MKO10086316_B_Frg1
  gRNA
uugacagcaguaaacugcuc

SEQ ID NO: 86317 - RNA, 20 nt, Artificial Sequence
  MKO10086317_B_Frk
  gRNA
uacuacaccacaacaaguga

SEQ ID NO: 86318 - RNA, 20 nt, Artificial Sequence
  MKO10086318_B_Frk
  gRNA
uggauccaaaugacuuccug

SEQ ID NO: 86319 - RNA, 20 nt, Artificial Sequence
  MKO10086319_B_Frk
  gRNA
uacuuuggagauauucuugc

SEQ ID NO: 86320 - RNA, 20 nt, Artificial Sequence
  MKO10086320_B_Frmd3
  gRNA
ccuuuacagagggaaacgaa

SEQ ID NO: 86321 - RNA, 20 nt, Artificial Sequence
  MKO10086321_B_Frmd3
  gRNA
gagcucuucuuuaaucuuca

SEQ ID NO: 86322 - RNA, 20 nt, Artificial Sequence
  MKO10086322_B_Frmd3
  gRNA
gaauuucacucuaaagcaca

SEQ ID NO: 86323 - RNA, 20 nt, Artificial Sequence
  MKO10086323_B_Frmd4a
  gRNA
ccaauucuccuccgaacaau

SEQ ID NO: 86324 - RNA, 20 nt, Artificial Sequence
  MKO10086324_B_Frmd4a
  gRNA
ugguuccucgccuggaucca

SEQ ID NO: 86325 - RNA, 20 nt, Artificial Sequence
  MKO10086325_B_Frmd4a
  gRNA
uggaggagacgcugcgccag

SEQ ID NO: 86326 - RNA, 20 nt, Artificial Sequence
  MKO10086326_B_Frmd4b
  gRNA
cgagagcauauccuuccuaa

SEQ ID NO: 86327 - RNA, 20 nt, Artificial Sequence
  MKO10086327_B_Frmd4b
  gRNA
cagugagaccaucuucaagu

SEQ ID NO: 86328 - RNA, 20 nt, Artificial Sequence
  MKO10086328_B_Frmd4b
  gRNA
cucgcaggggucaagagaac

SEQ ID NO: 86329 - RNA, 20 nt, Artificial Sequence
  MKO10086329_B_Frmd5
  gRNA
uuagcggccuauauccuuca

SEQ ID NO: 86330 - RNA, 20 nt, Artificial Sequence
  MKO10086330_B_Frmd5
  gRNA
gucauuaccuugaaggauau

SEQ ID NO: 86331 - RNA, 20 nt, Artificial Sequence
  MKO10086331_B_Frmd5
  gRNA
gguggcaaaggaggucaaac

SEQ ID NO: 86332 - RNA, 20 nt, Artificial Sequence
  MKO10086332_B_Frmd6
  gRNA
aaaaggaggccagcaaggua

SEQ ID NO: 86333 - RNA, 20 nt, Artificial Sequence
  MKO10086333_B_Frmd6
  gRNA
guauaacacugagaccaaag

SEQ ID NO: 86334 - RNA, 20 nt, Artificial Sequence
  MKO10086334_B_Frmd6
  gRNA
aauucugugucaccaguugc

SEQ ID NO: 86335 - RNA, 20 nt, Artificial Sequence
  MKO10086335_B_Frmd7
  gRNA
cacuuacauuauuuccagaa

SEQ ID NO: 86336 - RNA, 20 nt, Artificial Sequence
  MKO10086336_B_Frmd7
  gRNA
gcugugcaguugucacugca

SEQ ID NO: 86337 - RNA, 20 nt, Artificial Sequence
  MKO10086337_B_Frmd7
  gRNA
ugacaacugcacagcuuuaa

SEQ ID NO: 86338 - RNA, 20 nt, Artificial Sequence
  MKO10086338_B_Frmd8
  gRNA
agcggucagcacauugcccu

SEQ ID NO: 86339 - RNA, 20 nt, Artificial Sequence
  MKO10086339_B_Frmd8
  gRNA
ggucuugcggcugcucuaug

SEQ ID NO: 86340 - RNA, 20 nt, Artificial Sequence
  MKO10086340_B_Frmd8
  gRNA
cuccgaugaugaugucgcca

SEQ ID NO: 86341 - RNA, 20 nt, Artificial Sequence
  MKO10086341_B_Frmpd1
  gRNA
agaccuuuccugugaacgag

SEQ ID NO: 86342 - RNA, 20 nt, Artificial Sequence
  MKO10086342_B_Frmpd1
  gRNA
gauguccuccuccagaacua

SEQ ID NO: 86343 - RNA, 20 nt, Artificial Sequence
  MKO10086343_B_Frmpd1
  gRNA
ccgcuucuccucagucaaga

SEQ ID NO: 86344 - RNA, 20 nt, Artificial Sequence
  MKO10086344_B_Frmpd3
  gRNA
cauguaccuuaacagugguc

SEQ ID NO: 86345 - RNA, 20 nt, Artificial Sequence
  MKO10086345_B_Frmpd3
  gRNA
ccucauccccaacguccuga

SEQ ID NO: 86346 - RNA, 20 nt, Artificial Sequence
  MKO10086346_B_Frmpd3
  gRNA
gcucuugugcuugaguauac

SEQ ID NO: 86347 - RNA, 20 nt, Artificial Sequence
  MKO10086347_B_Frmpd4
  gRNA
aagagagagagucaucgacc

SEQ ID NO: 86348 - RNA, 20 nt, Artificial Sequence
  MKO10086348_B_Frmpd4
  gRNA
aggucgaugacucucucucu

SEQ ID NO: 86349 - RNA, 20 nt, Artificial Sequence
  MKO10086349_B_Frmpd4
  gRNA
caaucccauuugaugacccu

SEQ ID NO: 86350 - RNA, 20 nt, Artificial Sequence
  MKO10086350_B_Frrs1l
  gRNA
ucacgacauagacucuccac

SEQ ID NO: 86351 - RNA, 20 nt, Artificial Sequence
  MKO10086351_B_Frrs1l
  gRNA
cugacaacgcgcucugaagc

SEQ ID NO: 86352 - RNA, 20 nt, Artificial Sequence
  MKO10086352_B_Frrs1l
  gRNA
cccauucgccaaaaucaagg

SEQ ID NO: 86353 - RNA, 20 nt, Artificial Sequence
  MKO10086353_B_Frrs1
  gRNA
cuucuuguucccacacucga

SEQ ID NO: 86354 - RNA, 20 nt, Artificial Sequence
  MKO10086354_B_Frrs1
  gRNA
cacagaaaucguaugugauc

SEQ ID NO: 86355 - RNA, 20 nt, Artificial Sequence
  MKO10086355_B_Frrs1
  gRNA
gauuagcugugagucauaca

SEQ ID NO: 86356 - RNA, 20 nt, Artificial Sequence
  MKO10086356_B_Frs2
  gRNA
aaauagacuauucgaagcgc

SEQ ID NO: 86357 - RNA, 20 nt, Artificial Sequence
  MKO10086357_B_Frs2
  gRNA
uacucacuuguagguguccg

SEQ ID NO: 86358 - RNA, 20 nt, Artificial Sequence
  MKO10086358_B_Frs2
  gRNA
uauccccgcuaccccucguu

SEQ ID NO: 86359 - RNA, 20 nt, Artificial Sequence
  MKO10086359_B_Frs3
  gRNA
uaccucugccugcggcgcua

SEQ ID NO: 86360 - RNA, 20 nt, Artificial Sequence
  MKO10086360_B_Frs3
  gRNA
gacguucucguaggugcauu

SEQ ID NO: 86361 - RNA, 20 nt, Artificial Sequence
  MKO10086361_B_Frs3
  gRNA
cugcuccgcgugaugaugac

SEQ ID NO: 86362 - RNA, 20 nt, Artificial Sequence
  MKO10086362_B_Fryl
  gRNA
guacccguaggauucaucgu

SEQ ID NO: 86363 - RNA, 20 nt, Artificial Sequence
  MKO10086363_B_Fryl
  gRNA
cuaaaucccgccgcuccagg

SEQ ID NO: 86364 - RNA, 20 nt, Artificial Sequence
  MKO10086364_B_Fryl
  gRNA
uucaccccucugaagagauc

SEQ ID NO: 86365 - RNA, 20 nt, Artificial Sequence
  MKO10086365_B_Fry
  gRNA
cgcugcagagacuucgucaa

SEQ ID NO: 86366 - RNA, 20 nt, Artificial Sequence
  MKO10086366_B_Fry
  gRNA
gcguaagauucgaaucauca

SEQ ID NO: 86367 - RNA, 20 nt, Artificial Sequence
  MKO10086367_B_Fry
  gRNA
gaugauucgaaucuuacgcu

SEQ ID NO: 86368 - RNA, 20 nt, Artificial Sequence
  MKO10086368_B_Frzb
  gRNA
ugcagguuacucuugguaga

SEQ ID NO: 86369 - RNA, 20 nt, Artificial Sequence
  MKO10086369_B_Frzb
  gRNA
cucuauagcugagaagugga

SEQ ID NO: 86370 - RNA, 20 nt, Artificial Sequence
  MKO10086370_B_Frzb
  gRNA
ucaaguacuggacacugcag

SEQ ID NO: 86371 - RNA, 20 nt, Artificial Sequence
  MKO10086371_B_Fsbp
  gRNA
gccuacgcagccuuuacaaa

SEQ ID NO: 86372 - RNA, 20 nt, Artificial Sequence
  MKO10086372_B_Fsbp
  gRNA
uugcugcaauagcuccuguu

SEQ ID NO: 86373 - RNA, 20 nt, Artificial Sequence
  MKO10086373_B_Fsbp
  gRNA
cguaggcccugagcugugcg

SEQ ID NO: 86374 - RNA, 20 nt, Artificial Sequence
  MKO10086374_B_Fscb
  gRNA
cgguugaagagagcccuaaa

SEQ ID NO: 86375 - RNA, 20 nt, Artificial Sequence
  MKO10086375_B_Fscb
  gRNA
uacaacugcaaaagacguug

SEQ ID NO: 86376 - RNA, 20 nt, Artificial Sequence
  MKO10086376_B_Fscb
  gRNA
gcaguggacucaccugauaa

SEQ ID NO: 86377 - RNA, 20 nt, Artificial Sequence
  MKO10086377_B_Fscn1
  gRNA
ggggucgauagucuccgcgc

SEQ ID NO: 86378 - RNA, 20 nt, Artificial Sequence
  MKO10086378_B_Fscn1
  gRNA
ggugggcggccgcuaccuga

SEQ ID NO: 86379 - RNA, 20 nt, Artificial Sequence
  MKO10086379_B_Fscn1
  gRNA
aggcacacuuucuugugucg

SEQ ID NO: 86380 - RNA, 20 nt, Artificial Sequence
  MKO10086380_B_Fscn2
  gRNA
gcacacaaaacgcccguugc

SEQ ID NO: 86381 - RNA, 20 nt, Artificial Sequence
  MKO10086381_B_Fscn2
  gRNA
ggccgccaucagcgacuuug

SEQ ID NO: 86382 - RNA, 20 nt, Artificial Sequence
  MKO10086382_B_Fscn2
  gRNA
gcucaucaaucgaccccucc

SEQ ID NO: 86383 - RNA, 20 nt, Artificial Sequence
  MKO10086383_B_Fscn3
  gRNA
uugcaacuucguucagccaa

SEQ ID NO: 86384 - RNA, 20 nt, Artificial Sequence
  MKO10086384_B_Fscn3
  gRNA
cgccccuuucucgucuuacg

SEQ ID NO: 86385 - RNA, 20 nt, Artificial Sequence
  MKO10086385_B_Fscn3
  gRNA
caucgcugacggacacccca

SEQ ID NO: 86386 - RNA, 20 nt, Artificial Sequence
  MKO10086386_B_Fsd1l
  gRNA
gcgcaagucccaggaguuac

SEQ ID NO: 86387 - RNA, 20 nt, Artificial Sequence
  MKO10086387_B_Fsd1l
  gRNA
cagucaauguaacaaugccc

SEQ ID NO: 86388 - RNA, 20 nt, Artificial Sequence
  MKO10086388_B_Fsd1l
  gRNA
acaaagaaucauuucaacuc

SEQ ID NO: 86389 - RNA, 20 nt, Artificial Sequence
  MKO10086389_B_Fsd1
  gRNA
agacagcgaggacuucaguc

SEQ ID NO: 86390 - RNA, 20 nt, Artificial Sequence
  MKO10086390_B_Fsd1
  gRNA
gccgccaaggaaaucaaaga

SEQ ID NO: 86391 - RNA, 20 nt, Artificial Sequence
  MKO10086391_B_Fsd1
  gRNA
gcagauguugcugaauguag

SEQ ID NO: 86392 - RNA, 20 nt, Artificial Sequence
  MKO10086392_B_Fsd2
  gRNA
uacggacaacuggucagcug

SEQ ID NO: 86393 - RNA, 20 nt, Artificial Sequence
  MKO10086393_B_Fsd2
  gRNA
aaccccaaucagcaaagcuc

SEQ ID NO: 86394 - RNA, 20 nt, Artificial Sequence
  MKO10086394_B_Fsd2
  gRNA
augcaguggcuaugacugac

SEQ ID NO: 86395 - RNA, 20 nt, Artificial Sequence
  MKO10086395_B_Fshb
  gRNA
uucuggguauugggccgagc

SEQ ID NO: 86396 - RNA, 20 nt, Artificial Sequence
  MKO10086396_B_Fshb
  gRNA
gugcgggcuacugcuacacu

SEQ ID NO: 86397 - RNA, 20 nt, Artificial Sequence
  MKO10086397_B_Fshb
  gRNA
cucguauaccagcuccuuga

SEQ ID NO: 86398 - RNA, 20 nt, Artificial Sequence
  MKO10086398_B_Fshr
  gRNA
gacuggaucuugugaaaggc

SEQ ID NO: 86399 - RNA, 20 nt, Artificial Sequence
  MKO10086399_B_Fshr
  gRNA
ugcuuacauuucaugcaagu

SEQ ID NO: 86400 - RNA, 20 nt, Artificial Sequence
  MKO10086400_B_Fshr
  gRNA
gaucucucagaaugaugucu

SEQ ID NO: 86401 - RNA, 20 nt, Artificial Sequence
  MKO10086401_B_Fsip1
  gRNA
gcacagacucgacaagcuau

SEQ ID NO: 86402 - RNA, 20 nt, Artificial Sequence
  MKO10086402_B_Fsip1
  gRNA
ugaagacuuagaaaaugacg

SEQ ID NO: 86403 - RNA, 20 nt, Artificial Sequence
  MKO10086403_B_Fsip1
  gRNA
ugcuugacuucagaaucugc

SEQ ID NO: 86404 - RNA, 20 nt, Artificial Sequence
  MKO10086404_B_Fstl1
  gRNA
gcccacgugccucugcauug

SEQ ID NO: 86405 - RNA, 20 nt, Artificial Sequence
  MKO10086405_B_Fstl1
  gRNA
aagauccagguugauuauga

SEQ ID NO: 86406 - RNA, 20 nt, Artificial Sequence
  MKO10086406_B_Fstl1
  gRNA
ggaaugugccgucacagaga

SEQ ID NO: 86407 - RNA, 20 nt, Artificial Sequence
  MKO10086407_B_Fstl3
  gRNA
cucgucgugucaccugcgcc

SEQ ID NO: 86408 - RNA, 20 nt, Artificial Sequence
  MKO10086408_B_Fstl3
  gRNA
ccggcaacaucaacaccgcc

SEQ ID NO: 86409 - RNA, 20 nt, Artificial Sequence
  MKO10086409_B_Fstl3
  gRNA
uccaaauagguggcgugugc

SEQ ID NO: 86410 - RNA, 20 nt, Artificial Sequence
  MKO10086410_B_Fstl4
  gRNA
cgccucacaguaugugcuaa

SEQ ID NO: 86411 - RNA, 20 nt, Artificial Sequence
  MKO10086411_B_Fstl4
  gRNA
cucccgucggagccacacac

SEQ ID NO: 86412 - RNA, 20 nt, Artificial Sequence
  MKO10086412_B_Fstl4
  gRNA
cgccucccagaagcgccucu

SEQ ID NO: 86413 - RNA, 20 nt, Artificial Sequence
  MKO10086413_B_Fstl5
  gRNA
uguuacaggggacaacugca

SEQ ID NO: 86414 - RNA, 20 nt, Artificial Sequence
  MKO10086414_B_Fstl5
  gRNA
uugaacauuugauccaccaa

SEQ ID NO: 86415 - RNA, 20 nt, Artificial Sequence
  MKO10086415_B_Fstl5
  gRNA
cuguuuacaaagguccaugc

SEQ ID NO: 86416 - RNA, 20 nt, Artificial Sequence
  MKO10086416_B_Fst
  gRNA
caacgaaugugcacuccuca

SEQ ID NO: 86417 - RNA, 20 nt, Artificial Sequence
  MKO10086417_B_Fst
  gRNA
ugaggagugcacauucguug

SEQ ID NO: 86418 - RNA, 20 nt, Artificial Sequence
  MKO10086418_B_Fst
  gRNA
cgccagcgagugugccauga

SEQ ID NO: 86419 - RNA, 20 nt, Artificial Sequence
  MKO10086419_B_Fucd
  gRNA
cgcaggugagcacccucgaa

SEQ ID NO: 86420 - RNA, 20 nt, Artificial Sequence
  MKO10086420_B_Fucd
  gRNA
cccgcagguuaagagcaaua

SEQ ID NO: 86421 - RNA, 20 nt, Artificial Sequence
  MKO10086421_B_Fucd
  gRNA
cucauacucuccagcccgga

SEQ ID NO: 86422 - RNA, 20 nt, Artificial Sequence
  MKO10086422_B_Fth1
  gRNA
caccauagacagauagacgu

SEQ ID NO: 86423 - RNA, 20 nt, Artificial Sequence
  MKO10086423_B_Fth1
  gRNA
aaucuuccugcaggauauaa

SEQ ID NO: 86424 - RNA, 20 nt, Artificial Sequence
  MKO10086424_B_Fth1
  gRNA
gcccgcucucccagucauca

SEQ ID NO: 86425 - RNA, 20 nt, Artificial Sequence
  MKO10086425_B_Fthl17
  gRNA
agaaacgcuugaaguucucc

SEQ ID NO: 86426 - RNA, 20 nt, Artificial Sequence
  MKO10086426_B_Fthl17
  gRNA
ccugaccaaccugcgccaga

SEQ ID NO: 86427 - RNA, 20 nt, Artificial Sequence
  MKO10086427_B_Fthl17
  gRNA
ugccaucgacauguacucgu

SEQ ID NO: 86428 - RNA, 20 nt, Artificial Sequence
  MKO10086428_B_Ftl1
  gRNA
gcugcucaccagagagaggu

SEQ ID NO: 86429 - RNA, 20 nt, Artificial Sequence
  MKO10086429_B_Ftl1
  gRNA
uuuacagcucugugacuucc

SEQ ID NO: 86430 - RNA, 20 nt, Artificial Sequence
  MKO10086430_B_Ftl1
  gRNA
gauacucgcccagagacccc

SEQ ID NO: 86431 - RNA, 20 nt, Artificial Sequence
  MKO10086431_B_Ftmt
  gRNA
uugauagcagccuccgaguc

SEQ ID NO: 86432 - RNA, 20 nt, Artificial Sequence
  MKO10086432_B_Ftmt
  gRNA
gugaaaguucuggcggaccc

SEQ ID NO: 86433 - RNA, 20 nt, Artificial Sequence
  MKO10086433_B_Ftmt
  gRNA
accgaggccaggaggcgucg

SEQ ID NO: 86434 - RNA, 20 nt, Artificial Sequence
  MKO10086434_B_Fto
  gRNA
ugaagagggauuguuaaucc

SEQ ID NO: 86435 - RNA, 20 nt, Artificial Sequence
  MKO10086435_B_Fto
  gRNA
agaugaugaguucuaucagc

SEQ ID NO: 86436 - RNA, 20 nt, Artificial Sequence
  MKO10086436_B_Fto
  gRNA
auuaacaaucccucuucacc

SEQ ID NO: 86437 - RNA, 20 nt, Artificial Sequence
  MKO10086437_B_Ftsj1
  gRNA
agucacuggucuccaugaug

SEQ ID NO: 86438 - RNA, 20 nt, Artificial Sequence
  MKO10086438_B_Ftsj1
  gRNA
agccauagccuguaagucca

SEQ ID NO: 86439 - RNA, 20 nt, Artificial Sequence
  MKO10086439_B_Ftsj1
  gRNA
gcauguacucauccacauca

SEQ ID NO: 86440 - RNA, 20 nt, Artificial Sequence
  MKO10086440_B_Ftsj2
  gRNA
uguguaaccuccgaaccuua

SEQ ID NO: 86441 - RNA, 20 nt, Artificial Sequence
  MKO10086441_B_Ftsj2
  gRNA
ugcccuuccccccacgguac

SEQ ID NO: 86442 - RNA, 20 nt, Artificial Sequence
  MKO10086442_B_Ftsj2
  gRNA
cuguuagccacccaguaccg

SEQ ID NO: 86443 - RNA, 20 nt, Artificial Sequence
  MKO10086443_B_Ftsj3
  gRNA
guccaugacgcuuacuccca

SEQ ID NO: 86444 - RNA, 20 nt, Artificial Sequence
  MKO10086444_B_Ftsj3
  gRNA
auaucacaacagaacgcugu

SEQ ID NO: 86445 - RNA, 20 nt, Artificial Sequence
  MKO10086445_B_Ftsj3
  gRNA
guucuguugugauauccucc

SEQ ID NO: 86446 - RNA, 20 nt, Artificial Sequence
  MKO10086446_B_Fubp1
  gRNA
uuuaagauugcagcaaaaau

SEQ ID NO: 86447 - RNA, 20 nt, Artificial Sequence
  MKO10086447_B_Fubp1
  gRNA
cuccaaugcaucagcagcaa

SEQ ID NO: 86448 - RNA, 20 nt, Artificial Sequence
  MKO10086448_B_Fubp1
  gRNA
gaagaauacaaagucccaga

SEQ ID NO: 86449 - RNA, 20 nt, Artificial Sequence
  MKO10086449_B_Fubp3
  gRNA
uuucauugcaguuauuggca

SEQ ID NO: 86450 - RNA, 20 nt, Artificial Sequence
  MKO10086450_B_Fubp3
  gRNA
ugcuuaccuuugauguacca

SEQ ID NO: 86451 - RNA, 20 nt, Artificial Sequence
  MKO10086451_B_Fubp3
  gRNA
auucaaagugccugauaaaa

SEQ ID NO: 86452 - RNA, 20 nt, Artificial Sequence
  MKO10086452_B_Fuca1
  gRNA
ccgugauuuggucggugagu

SEQ ID NO: 86453 - RNA, 20 nt, Artificial Sequence
  MKO10086453_B_Fuca1
  gRNA
guaguacccuccaugaugac

SEQ ID NO: 86454 - RNA, 20 nt, Artificial Sequence
  MKO10086454_B_Fuca1
  gRNA
aacuggaacucgaaggacgu

SEQ ID NO: 86455 - RNA, 20 nt, Artificial Sequence
  MKO10086455_B_Fuca2
  gRNA
cuuguggaaacagucgcaug

SEQ ID NO: 86456 - RNA, 20 nt, Artificial Sequence
  MKO10086456_B_Fuca2
  gRNA
cagucgaugaggggccaaag

SEQ ID NO: 86457 - RNA, 20 nt, Artificial Sequence
  MKO10086457_B_Fuca2
  gRNA
uucacuucuaaacaucacga

SEQ ID NO: 86458 - RNA, 20 nt, Artificial Sequence
  MKO10086458_B_Fuk
  gRNA
gcaugcucaccaggguuugg

SEQ ID NO: 86459 - RNA, 20 nt, Artificial Sequence
  MKO10086459_B_Fuk
  gRNA
ggugggucaugauauccaac

SEQ ID NO: 86460 - RNA, 20 nt, Artificial Sequence
  MKO10086460_B_Fuk
  gRNA
ugcuuaccaugugcaagaug

SEQ ID NO: 86461 - RNA, 20 nt, Artificial Sequence
  MKO10086461_B_Fundc1
  gRNA
aaacuugcugcaacugcagu

SEQ ID NO: 86462 - RNA, 20 nt, Artificial Sequence
  MKO10086462_B_Fundc1
  gRNA
cagaacauugugauauccag

SEQ ID NO: 86463 - RNA, 20 nt, Artificial Sequence
  MKO10086463_B_Fundc1
  gRNA
cuguacauagccacugugac

SEQ ID NO: 86464 - RNA, 20 nt, Artificial Sequence
  MKO10086464_B_Fundc2
  gRNA
ccaaacagcuuacgccacca

SEQ ID NO: 86465 - RNA, 20 nt, Artificial Sequence
  MKO10086465_B_Fundc2
  gRNA
caacuuugauguauccagua

SEQ ID NO: 86466 - RNA, 20 nt, Artificial Sequence
  MKO10086466_B_Fundc2
  gRNA
uaacacccccaauuaccagc

SEQ ID NO: 86467 - RNA, 20 nt, Artificial Sequence
  MKO10086467_B_Fuom
  gRNA
ccgucugcucggaucuccac

SEQ ID NO: 86468 - RNA, 20 nt, Artificial Sequence
  MKO10086468_B_Fuom
  gRNA
cauuugcugugguugcaacc

SEQ ID NO: 86469 - RNA, 20 nt, Artificial Sequence
  MKO10086469_B_Fuom
  gRNA
caaaucucucuagcuucauc

SEQ ID NO: 86470 - RNA, 20 nt, Artificial Sequence
  MKO10086470_B_Furin
  gRNA
cuggucauucacgucaaaac

SEQ ID NO: 86471 - RNA, 20 nt, Artificial Sequence
  MKO10086471_B_Furin
  gRNA
cuccugauacacgucccucu

SEQ ID NO: 86472 - RNA, 20 nt, Artificial Sequence
  MKO10086472_B_Furin
  gRNA
ucggugacuauuaccacuuc

SEQ ID NO: 86473 - RNA, 20 nt, Artificial Sequence
  MKO10086473_B_Fus
  gRNA
cauaagaagauugugaacuu

SEQ ID NO: 86474 - RNA, 20 nt, Artificial Sequence
  MKO10086474_B_Fus
  gRNA
cuccacugcuacuguuguac

SEQ ID NO: 86475 - RNA, 20 nt, Artificial Sequence
  MKO10086475_B_Fus
  gRNA
aaccaguacaacaguagcag

SEQ ID NO: 86476 - RNA, 20 nt, Artificial Sequence
  MKO10086476_B_Fuu10
  gRNA
guucuguaaacacucgccau

SEQ ID NO: 86477 - RNA, 20 nt, Artificial Sequence
  MKO10086477_B_Fuu10
  gRNA
guagcuaccccaucgugcug

SEQ ID NO: 86478 - RNA, 20 nt, Artificial Sequence
  MKO10086478_B_Fuu10
  gRNA
gacagcgacugucuuucuga

SEQ ID NO: 86479 - RNA, 20 nt, Artificial Sequence
  MKO10086479_B_Fuu11
  gRNA
agagggugauccacgauaca

SEQ ID NO: 86480 - RNA, 20 nt, Artificial Sequence
  MKO10086480_B_Fuu11
  gRNA
uuauuggcaaggucucuauc

SEQ ID NO: 86481 - RNA, 20 nt, Artificial Sequence
  MKO10086481_B_Fuu11
  gRNA
acaacaaugagacacagcag

SEQ ID NO: 86482 - RNA, 20 nt, Artificial Sequence
  MKO10086482_B_Fuu1
  gRNA
ggugaugcccaaucgcugga

SEQ ID NO: 86483 - RNA, 20 nt, Artificial Sequence
  MKO10086483_B_Fuu1
  gRNA
ggggcaguaugcuacauugc

SEQ ID NO: 86484 - RNA, 20 nt, Artificial Sequence
  MKO10086484_B_Fuu1
  gRNA
auguagcauacugccccauc

SEQ ID NO: 86485 - RNA, 20 nt, Artificial Sequence
  MKO10086485_B_Fuu2
  gRNA
ggagcuucacuauucguugc

SEQ ID NO: 86486 - RNA, 20 nt, Artificial Sequence
  MKO10086486_B_Fuu2
  gRNA
ggcaagccgaccguucaucc

SEQ ID NO: 86487 - RNA, 20 nt, Artificial Sequence
  MKO10086487_B_Fuu2
  gRNA
agaauccggaaggguguagu

SEQ ID NO: 86488 - RNA, 20 nt, Artificial Sequence
  MKO10086488_B_Fuu4
  gRNA
uaugagcgcuucgugccucg

SEQ ID NO: 86489 - RNA, 20 nt, Artificial Sequence
  MKO10086489_B_Fuu4
  gRNA
acuguccuaccggaccgacu

SEQ ID NO: 86490 - RNA, 20 nt, Artificial Sequence
  MKO10086490_B_Fuu4
  gRNA
ccacgcguccaccguccgug

SEQ ID NO: 86491 - RNA, 20 nt, Artificial Sequence
  MKO10086491_B_Fuu7
  gRNA
aggcuccagaugaauuguau

SEQ ID NO: 86492 - RNA, 20 nt, Artificial Sequence
  MKO10086492_B_Fuu7
  gRNA
gcauacaaaccuugaacugu

SEQ ID NO: 86493 - RNA, 20 nt, Artificial Sequence
  MKO10086493_B_Fuu7
  gRNA
augaaugagagucguuaucg

SEQ ID NO: 86494 - RNA, 20 nt, Artificial Sequence
  MKO10086494_B_Fuu8
  gRNA
ggagauauguuauucuccgc

SEQ ID NO: 86495 - RNA, 20 nt, Artificial Sequence
  MKO10086495_B_Fuu8
  gRNA
auugaccaggggacagcuac

SEQ ID NO: 86496 - RNA, 20 nt, Artificial Sequence
  MKO10086496_B_Fuu8
  gRNA
aaaauggagcuaaagagcuc

SEQ ID NO: 86497 - RNA, 20 nt, Artificial Sequence
  MKO10086497_B_Fuu9
  gRNA
cucguuguaauacuugaccc

SEQ ID NO: 86498 - RNA, 20 nt, Artificial Sequence
  MKO10086498_B_Fuu9
  gRNA
cucaccgucaagaagccaua

SEQ ID NO: 86499 - RNA, 20 nt, Artificial Sequence
  MKO10086499_B_Fuu9
  gRNA
ugguucaguaccuguugucc

SEQ ID NO: 86500 - RNA, 20 nt, Artificial Sequence
  MKO10086500_B_Fuz
  gRNA
auggaaguucuuccacacua

SEQ ID NO: 86501 - RNA, 20 nt, Artificial Sequence
  MKO10086501_B_Fuz
  gRNA
agaaugcuccacaugguguu

SEQ ID NO: 86502 - RNA, 20 nt, Artificial Sequence
  MKO10086502_B_Fuz
  gRNA
gcugucgaugagacaguagc

SEQ ID NO: 86503 - RNA, 20 nt, Artificial Sequence
  MKO10086503_B_Fv1
  gRNA
ccucaauagaauaccacucc

SEQ ID NO: 86504 - RNA, 20 nt, Artificial Sequence
  MKO10086504_B_Fv1
  gRNA
gcccgcacuguugaagauaa

SEQ ID NO: 86505 - RNA, 20 nt, Artificial Sequence
  MKO10086505_B_Fv1
  gRNA
gagaaaccagcaagcgcacg

SEQ ID NO: 86506 - RNA, 20 nt, Artificial Sequence
  MKO10086506_B_Fxn
  gRNA
cgagacagcguaugaaagac

SEQ ID NO: 86507 - RNA, 20 nt, Artificial Sequence
  MKO10086507_B_Fxn
  gRNA
gcggccccaagcgcuaugac

SEQ ID NO: 86508 - RNA, 20 nt, Artificial Sequence
  MKO10086508_B_Fxn
  gRNA
gacagccagauuugcuuguu

SEQ ID NO: 86509 - RNA, 20 nt, Artificial Sequence
  MKO10086509_B_Fxr1
  gRNA
caguuggcaaccagaacgcc

SEQ ID NO: 86510 - RNA, 20 nt, Artificial Sequence
  MKO10086510_B_Fxr1
  gRNA
uaccuuguagaaagccccgu

SEQ ID NO: 86511 - RNA, 20 nt, Artificial Sequence
  MKO10086511_B_Fxr1
  gRNA
uuagccagccaccauccaca

SEQ ID NO: 86512 - RNA, 20 nt, Artificial Sequence
  MKO10086512_B_Fxr2
  gRNA
cuauucgagagccaaugaac

SEQ ID NO: 86513 - RNA, 20 nt, Artificial Sequence
  MKO10086513_B_Fxr2
  gRNA
cuacaaugagauugucacuc

SEQ ID NO: 86514 - RNA, 20 nt, Artificial Sequence
  MKO10086514_B_Fxr2
  gRNA
gccuccagcugacuacaaua

SEQ ID NO: 86515 - RNA, 20 nt, Artificial Sequence
  MKO10086515_B_Fxyd1
  gRNA
agaggaucccagcgauagug

SEQ ID NO: 86516 - RNA, 20 nt, Artificial Sequence
  MKO10086516_B_Fxyd1
  gRNA
aaaguucccuccucuucguc

SEQ ID NO: 86517 - RNA, 20 nt, Artificial Sequence
  MKO10086517_B_Fxyd1
  gRNA
ggaccacucaccucugcugu

SEQ ID NO: 86518 - RNA, 20 nt, Artificial Sequence
  MKO10086518_B_Fxyd2
  gRNA
guuucuuaccgcccccacag

SEQ ID NO: 86519 - RNA, 20 nt, Artificial Sequence
  MKO10086519_B_Fxyd2
  gRNA
acagagaaucccuucgagua

SEQ ID NO: 86520 - RNA, 20 nt, Artificial Sequence
  MKO10086520_B_Fxyd2
  gRNA
caaggcaaaagguuccgcug

SEQ ID NO: 86521 - RNA, 20 nt, Artificial Sequence
  MKO10086521_B_Fxyd3
  gRNA
cccugcaggccugccuacuu

SEQ ID NO: 86522 - RNA, 20 nt, Artificial Sequence
  MKO10086522_B_Fxyd3
  gRNA
gcaaguucagacagaaaccc

SEQ ID NO: 86523 - RNA, 20 nt, Artificial Sequence
  MKO10086523_B_Fxyd3
  gRNA
aaaaaugauccuuucuacua

SEQ ID NO: 86524 - RNA, 20 nt, Artificial Sequence
  MKO10086524_B_Fxyd4
  gRNA
uacugucuuaccugggcuua

SEQ ID NO: 86525 - RNA, 20 nt, Artificial Sequence
  MKO10086525_B_Fxyd4
  gRNA
ucacccaggucugccggccu

SEQ ID NO: 86526 - RNA, 20 nt, Artificial Sequence
  MKO10086526_B_Fxyd4
  gRNA
aaagacagucccuucuacua

SEQ ID NO: 86527 - RNA, 20 nt, Artificial Sequence
  MKO10086527_B_Fxyd5
  gRNA
uggaucugacacuggauucg

SEQ ID NO: 86528 - RNA, 20 nt, Artificial Sequence
  MKO10086528_B_Fxyd5
  gRNA
acccaguggauguucaaugu

SEQ ID NO: 86529 - RNA, 20 nt, Artificial Sequence
  MKO10086529_B_Fxyd5
  gRNA
cacgaguagucgcagaaguc

SEQ ID NO: 86530 - RNA, 20 nt, Artificial Sequence
  MKO10086530_B_Fxyd6
  gRNA
gaaaaggauccuuucuauua

SEQ ID NO: 86531 - RNA, 20 nt, Artificial Sequence
  MKO10086531_B_Fxyd6
  gRNA
gcaguuucaaucagaagccc

SEQ ID NO: 86532 - RNA, 20 nt, Artificial Sequence
  MKO10086532_B_Fxyd6
  gRNA
acaccaaccccccaauccuc

SEQ ID NO: 86533 - RNA, 20 nt, Artificial Sequence
  MKO10086533_B_Fxyd7
  gRNA
aggcggauuccaggucugag

SEQ ID NO: 86534 - RNA, 20 nt, Artificial Sequence
  MKO10086534_B_Fxyd7
  gRNA
ccccagcacgaacaugauag

SEQ ID NO: 86535 - RNA, 20 nt, Artificial Sequence
  MKO10086535_B_Fxyd7
  gRNA
caacacucaccauagaaaaa

SEQ ID NO: 86536 - RNA, 20 nt, Artificial Sequence
  MKO10086536_B_Fyb
  gRNA
auaaaugacgaaaaucaaga

SEQ ID NO: 86537 - RNA, 20 nt, Artificial Sequence
  MKO10086537_B_Fyb
  gRNA
ugacaggaacaagagaguga

SEQ ID NO: 86538 - RNA, 20 nt, Artificial Sequence
  MKO10086538_B_Fyb
  gRNA
cuggcuggauguguaggcgg

SEQ ID NO: 86539 - RNA, 20 nt, Artificial Sequence
  MKO10086539_B_Fyco1
  gRNA
caaccagaccuuguagauca

SEQ ID NO: 86540 - RNA, 20 nt, Artificial Sequence
  MKO10086540_B_Fyco1
  gRNA
cacugaagugauagccugcu

SEQ ID NO: 86541 - RNA, 20 nt, Artificial Sequence
  MKO10086541_B_Fyco1
  gRNA
cuccgccuuccuuaaauuca

SEQ ID NO: 86542 - RNA, 20 nt, Artificial Sequence
  MKO10086542_B_Fyn
  gRNA
cugucccuccucucgugcgu

SEQ ID NO: 86543 - RNA, 20 nt, Artificial Sequence
  MKO10086543_B_Fyn
  gRNA
cuuuggugguuucgcucucg

SEQ ID NO: 86544 - RNA, 20 nt, Artificial Sequence
  MKO10086544_B_Fyn
  gRNA
accaguuuccccgguuguca

SEQ ID NO: 86545 - RNA, 20 nt, Artificial Sequence
  MKO10086545_B_Fyuud1
  gRNA
cuaccaaccgggugccaaac

SEQ ID NO: 86546 - RNA, 20 nt, Artificial Sequence
  MKO10086546_B_Fyuud1
  gRNA
guacucucauccugaauugc

SEQ ID NO: 86547 - RNA, 20 nt, Artificial Sequence
  MKO10086547_B_Fyuud1
  gRNA
uggagucuucuauuuagucu

SEQ ID NO: 86548 - RNA, 20 nt, Artificial Sequence
  MKO10086548_B_Fzd10
  gRNA
gcacgaguucgcgccgcucg

SEQ ID NO: 86549 - RNA, 20 nt, Artificial Sequence
  MKO10086549_B_Fzd10
  gRNA
agaagcucaugguacgcaua

SEQ ID NO: 86550 - RNA, 20 nt, Artificial Sequence
  MKO10086550_B_Fzd10
  gRNA
ugggcgcguacagcgaacac

SEQ ID NO: 86551 - RNA, 20 nt, Artificial Sequence
  MKO10086551_B_Fzd1
  gRNA
acuugucguugcacaccacc

SEQ ID NO: 86552 - RNA, 20 nt, Artificial Sequence
  MKO10086552_B_Fzd1
  gRNA
cacggaccagaugccuaucc

SEQ ID NO: 86553 - RNA, 20 nt, Artificial Sequence
  MKO10086553_B_Fzd1
  gRNA
gcagcaguacaacggcgaac

SEQ ID NO: 86554 - RNA, 20 nt, Artificial Sequence
  MKO10086554_B_Fzd2
  gRNA
gccggaccggcccaguucca

SEQ ID NO: 86555 - RNA, 20 nt, Artificial Sequence
  MKO10086555_B_Fzd2
  gRNA
cgguuaucgcacgguggugc

SEQ ID NO: 86556 - RNA, 20 nt, Artificial Sequence
  MKO10086556_B_Fzd2
  gRNA
aucugcuccgcgccgugacg

SEQ ID NO: 86557 - RNA, 20 nt, Artificial Sequence
  MKO10086557_B_Fzd3
  gRNA
ugucccguggccugaagaua

SEQ ID NO: 86558 - RNA, 20 nt, Artificial Sequence
  MKO10086558_B_Fzd3
  gRNA
cuaggauagugaaugagagc

SEQ ID NO: 86559 - RNA, 20 nt, Artificial Sequence
  MKO10086559_B_Fzd3
  gRNA
accugccaucccgugaccug

SEQ ID NO: 86560 - RNA, 20 nt, Artificial Sequence
  MKO10086560_B_Fzd4
  gRNA
cuuguacagccgcucagcua

SEQ ID NO: 86561 - RNA, 20 nt, Artificial Sequence
  MKO10086561_B_Fzd4
  gRNA
ucuuggucacguuguagccg

SEQ ID NO: 86562 - RNA, 20 nt, Artificial Sequence
  MKO10086562_B_Fzd4
  gRNA
cuuauuuccacaucgcagcc

SEQ ID NO: 86563 - RNA, 20 nt, Artificial Sequence
  MKO10086563_B_Fzd5
  gRNA
acgcggugguggcuucgcuu

SEQ ID NO: 86564 - RNA, 20 nt, Artificial Sequence
  MKO10086564_B_Fzd5
  gRNA
cacgcgccaaacccgaguac

SEQ ID NO: 86565 - RNA, 20 nt, Artificial Sequence
  MKO10086565_B_Fzd5
  gRNA
cgacgccgagguucugugua

SEQ ID NO: 86566 - RNA, 20 nt, Artificial Sequence
  MKO10086566_B_Fzd6
  gRNA
cucggcuuucccugccguuc

SEQ ID NO: 86567 - RNA, 20 nt, Artificial Sequence
  MKO10086567_B_Fzd6
  gRNA
uuccccacagucccgaucuu

SEQ ID NO: 86568 - RNA, 20 nt, Artificial Sequence
  MKO10086568_B_Fzd6
  gRNA
uccaaaagcucgaccagaau

SEQ ID NO: 86569 - RNA, 20 nt, Artificial Sequence
  MKO10086569_B_Fzd7
  gRNA
uuagcacggcccggcucaca

SEQ ID NO: 86570 - RNA, 20 nt, Artificial Sequence
  MKO10086570_B_Fzd7
  gRNA
ugcauugcggggcuucgugc

SEQ ID NO: 86571 - RNA, 20 nt, Artificial Sequence
  MKO10086571_B_Fzd7
  gRNA
augccuuucucgccgugaua

SEQ ID NO: 86572 - RNA, 20 nt, Artificial Sequence
  MKO10086572_B_Fzd8
  gRNA
ccuagugcacaacgcgcgcc

SEQ ID NO: 86573 - RNA, 20 nt, Artificial Sequence
  MKO10086573_B_Fzd8
  gRNA
uaaagcgcuccauaucgaug

SEQ ID NO: 86574 - RNA, 20 nt, Artificial Sequence
  MKO10086574_B_Fzd8
  gRNA
agcgcuuuaaguacccggaa

SEQ ID NO: 86575 - RNA, 20 nt, Artificial Sequence
  MKO10086575_B_Fzd9
  gRNA
uguggcagccguacugcacg

SEQ ID NO: 86576 - RNA, 20 nt, Artificial Sequence
  MKO10086576_B_Fzd9
  gRNA
agcgacucuucuccacguac

SEQ ID NO: 86577 - RNA, 20 nt, Artificial Sequence
  MKO10086577_B_Fzd9
  gRNA
cgcucgugcgcuccgcgcug

SEQ ID NO: 86578 - RNA, 20 nt, Artificial Sequence
  MKO10086578_B_Fzr1
  gRNA
cgguacucacauugauccug

SEQ ID NO: 86579 - RNA, 20 nt, Artificial Sequence
  MKO10086579_B_Fzr1
  gRNA
ugaccgcuucauccccucgc

SEQ ID NO: 86580 - RNA, 20 nt, Artificial Sequence
  MKO10086580_B_Fzr1
  gRNA
cguccuuggcuuugcgguuc

SEQ ID NO: 86581 - RNA, 20 nt, Artificial Sequence
  MKO10086581_B_G0s2
  gRNA
gcuagugaagcuauacgugc

SEQ ID NO: 86582 - RNA, 20 nt, Artificial Sequence
  MKO10086582_B_G0s2
  gRNA
agacggcuggcggcugugaa

SEQ ID NO: 86583 - RNA, 20 nt, Artificial Sequence
  MKO10086583_B_G0s2
  gRNA
acagcagucccuccacaagc

SEQ ID NO: 86584 - RNA, 20 nt, Artificial Sequence
  MKO10086584_B_G2e3
  gRNA
aguccagagagccuccaaac

SEQ ID NO: 86585 - RNA, 20 nt, Artificial Sequence
  MKO10086585_B_G2e3
  gRNA
gaugacugucccaauaaaua

SEQ ID NO: 86586 - RNA, 20 nt, Artificial Sequence
  MKO10086586_B_G2e3
  gRNA
gcuuccuaauagaagacauc

SEQ ID NO: 86587 - RNA, 20 nt, Artificial Sequence
  MKO10086587_B_G3bp1
  gRNA
ccauuccucaggaaauccac

SEQ ID NO: 86588 - RNA, 20 nt, Artificial Sequence
  MKO10086588_B_G3bp1
  gRNA
cuuugucacagagccucaag

SEQ ID NO: 86589 - RNA, 20 nt, Artificial Sequence
  MKO10086589_B_G3bp1
  gRNA
ugcccguagacugcaucugc

SEQ ID NO: 86590 - RNA, 20 nt, Artificial Sequence
  MKO10086590_B_G3bp2
  gRNA
gacuuugcagguucuauggc

SEQ ID NO: 86591 - RNA, 20 nt, Artificial Sequence
  MKO10086591_B_G3bp2
  gRNA
gaagcccaguccgcugcuug

SEQ ID NO: 86592 - RNA, 20 nt, Artificial Sequence
  MKO10086592_B_G3bp2
  gRNA
cguuaugaagaugaaguguu

SEQ ID NO: 86593 - RNA, 20 nt, Artificial Sequence
  MKO10086593_B_G630090E17Rik
  gRNA
cuucuuaggaaugucaaugu

SEQ ID NO: 86594 - RNA, 20 nt, Artificial Sequence
  MKO10086594_B_G630090E17Rik
  gRNA
ucgaucacauuacagaugua

SEQ ID NO: 86595 - RNA, 20 nt, Artificial Sequence
  MKO10086595_B_G630090E17Rik
  gRNA
ccccccaaagagucaagaug

SEQ ID NO: 86596 - RNA, 20 nt, Artificial Sequence
  MKO10086596_B_G6b
  gRNA
aguuggggucccucucgucg

SEQ ID NO: 86597 - RNA, 20 nt, Artificial Sequence
  MKO10086597_B_G6b
  gRNA
ccuaggguacgaguauccca

SEQ ID NO: 86598 - RNA, 20 nt, Artificial Sequence
  MKO10086598_B_G6b
  gRNA
cugauuccgcuccugggcgu

SEQ ID NO: 86599 - RNA, 20 nt, Artificial Sequence
  MKO10086599_B_G6pc2
  gRNA
cgcacgaugagcccauugcg

SEQ ID NO: 86600 - RNA, 20 nt, Artificial Sequence
  MKO10086600_B_G6pc2
  gRNA
gggccuguuucacacguagu

SEQ ID NO: 86601 - RNA, 20 nt, Artificial Sequence
  MKO10086601_B_G6pc2
  gRNA
uuuccuacuacgugugaaac

SEQ ID NO: 86602 - RNA, 20 nt, Artificial Sequence
  MKO10086602_B_G6pc3
  gRNA
ccaggaaucacccucaccca

SEQ ID NO: 86603 - RNA, 20 nt, Artificial Sequence
  MKO10086603_B_G6pc3
  gRNA
cugcgccugugaucaugcag

SEQ ID NO: 86604 - RNA, 20 nt, Artificial Sequence
  MKO10086604_B_G6pc3
  gRNA
ggugaaucuggauuggaguc

SEQ ID NO: 86605 - RNA, 20 nt, Artificial Sequence
  MKO10086605_B_G6pc
  gRNA
guauacaccugcugcgccca

SEQ ID NO: 86606 - RNA, 20 nt, Artificial Sequence
  MKO10086606_B_G6pc
  gRNA
cauuguagaugccccggaug

SEQ ID NO: 86607 - RNA, 20 nt, Artificial Sequence
  MKO10086607_B_G6pc
  gRNA
uguccaggacccaccaauac

SEQ ID NO: 86608 - RNA, 20 nt, Artificial Sequence
  MKO10086608_B_G6pd2
  gRNA
gcucauuacgcuugcacuuc

SEQ ID NO: 86609 - RNA, 20 nt, Artificial Sequence
  MKO10086609_B_G6pd2
  gRNA
uuguccguacugaugaacuc

SEQ ID NO: 86610 - RNA, 20 nt, Artificial Sequence
  MKO10086610_B_G6pd2
  gRNA
agaugucgccugguauaucu

SEQ ID NO: 86611 - RNA, 20 nt, Artificial Sequence
  MKO10086611_B_G6pdx
  gRNA
gaugugguucgacaguugau

SEQ ID NO: 86612 - RNA, 20 nt, Artificial Sequence
  MKO10086612_B_G6pdx
  gRNA
cccacaaugaagguaucuuc

SEQ ID NO: 86613 - RNA, 20 nt, Artificial Sequence
  MKO10086613_B_G6pdx
  gRNA
accugaagauaccuucauug

SEQ ID NO: 86614 - RNA, 20 nt, Artificial Sequence
  MKO10086614_B_Gaa
  gRNA
uauuguugcacaacgcucuu

SEQ ID NO: 86615 - RNA, 20 nt, Artificial Sequence
  MKO10086615_B_Gaa
  gRNA
agaaaggaugugacccguag

SEQ ID NO: 86616 - RNA, 20 nt, Artificial Sequence
  MKO10086616_B_Gaa
  gRNA
gagcguugugcaacaauacc

SEQ ID NO: 86617 - RNA, 20 nt, Artificial Sequence
  MKO10086617_B_Gab1
  gRNA
uugcgcaguggccguuugac

SEQ ID NO: 86618 - RNA, 20 nt, Artificial Sequence
  MKO10086618_B_Gab1
  gRNA
agggaacuagaucuaucgcu

SEQ ID NO: 86619 - RNA, 20 nt, Artificial Sequence
  MKO10086619_B_Gab1
  gRNA
gauccugugaagccgcugac

SEQ ID NO: 86620 - RNA, 20 nt, Artificial Sequence
  MKO10086620_B_Gab2
  gRNA
gacaacagccgacuccaucg

SEQ ID NO: 86621 - RNA, 20 nt, Artificial Sequence
  MKO10086621_B_Gab2
  gRNA
cugugagaccuacgaguacc

SEQ ID NO: 86622 - RNA, 20 nt, Artificial Sequence
  MKO10086622_B_Gab2
  gRNA
cuuguccaccagugcaccuc

SEQ ID NO: 86623 - RNA, 20 nt, Artificial Sequence
  MKO10086623_B_Gab3
  gRNA
uucccaccagaugugauagc

SEQ ID NO: 86624 - RNA, 20 nt, Artificial Sequence
  MKO10086624_B_Gab3
  gRNA
caagaucagcccuuguugac

SEQ ID NO: 86625 - RNA, 20 nt, Artificial Sequence
  MKO10086625_B_Gab3
  gRNA
cagaaacucugacucacguc

SEQ ID NO: 86626 - RNA, 20 nt, Artificial Sequence
  MKO10086626_B_Gabarapl1
  gRNA
cuucuaggucaucguggaga

SEQ ID NO: 86627 - RNA, 20 nt, Artificial Sequence
  MKO10086627_B_Gabarapl1
  gRNA
uacuuccucuuauccagauc

SEQ ID NO: 86628 - RNA, 20 nt, Artificial Sequence
  MKO10086628_B_Gabarapl1
  gRNA
acagaaaauagucuuccucg

SEQ ID NO: 86629 - RNA, 20 nt, Artificial Sequence
  MKO10086629_B_Gabarapl2
  gRNA
uuccccagaacacagaugcg

SEQ ID NO: 86630 - RNA, 20 nt, Artificial Sequence
  MKO10086630_B_Gabarapl2
  gRNA
acacuucuuaccuggacugu

SEQ ID NO: 86631 - RNA, 20 nt, Artificial Sequence
  MKO10086631_B_Gabarapl2
  gRNA
cuccuuaaacauccacuuca

SEQ ID NO: 86632 - RNA, 20 nt, Artificial Sequence
  MKO10086632_B_Gabarap
  gRNA
cugguacagcugacccaucg

SEQ ID NO: 86633 - RNA, 20 nt, Artificial Sequence
  MKO10086633_B_Gabarap
  gRNA
uacagugaugaaagcgucua

SEQ ID NO: 86634 - RNA, 20 nt, Artificial Sequence
  MKO10086634_B_Gabarap
  gRNA
cccucaccuguaagaucaga

SEQ ID NO: 86635 - RNA, 20 nt, Artificial Sequence
  MKO10086635_B_Gabbr1
  gRNA
auaagcuugagcucguaguc

SEQ ID NO: 86636 - RNA, 20 nt, Artificial Sequence
  MKO10086636_B_Gabbr1
  gRNA
gugaaucgaacgccacacuc

SEQ ID NO: 86637 - RNA, 20 nt, Artificial Sequence
  MKO10086637_B_Gabbr1
  gRNA
augugaccccgacuuccauc

SEQ ID NO: 86638 - RNA, 20 nt, Artificial Sequence
  MKO10086638_B_Gabbr2
  gRNA
ccgaaccauuugaugguguu

SEQ ID NO: 86639 - RNA, 20 nt, Artificial Sequence
  MKO10086639_B_Gabbr2
  gRNA
caggugaggaacgaccugac

SEQ ID NO: 86640 - RNA, 20 nt, Artificial Sequence
  MKO10086640_B_Gabbr2
  gRNA
ccccguacagaaccccaguc

SEQ ID NO: 86641 - RNA, 20 nt, Artificial Sequence
  MKO10086641_B_Gabpa
  gRNA
gccuuaccugaauaucuugc

SEQ ID NO: 86642 - RNA, 20 nt, Artificial Sequence
  MKO10086642_B_Gabpa
  gRNA
ucuucccgaaauguugagug

SEQ ID NO: 86643 - RNA, 20 nt, Artificial Sequence
  MKO10086643_B_Gabpa
  gRNA
cuccuugaucaaacaagcuu

SEQ ID NO: 86644 - RNA, 20 nt, Artificial Sequence
  MKO10086644_B_Gabpb1
  gRNA
uuuacccagucuguaguaaa

SEQ ID NO: 86645 - RNA, 20 nt, Artificial Sequence
  MKO10086645_B_Gabpb1
  gRNA
uguccgguccacuuuggucc

SEQ ID NO: 86646 - RNA, 20 nt, Artificial Sequence
  MKO10086646_B_Gabpb1
  gRNA
uggugcugacgucaaugcaa

SEQ ID NO: 86647 - RNA, 20 nt, Artificial Sequence
  MKO10086647_B_Gabpb2
  gRNA
gucgaguuacuuaucaaaua

SEQ ID NO: 86648 - RNA, 20 nt, Artificial Sequence
  MKO10086648_B_Gabpb2
  gRNA
gcagaagugcuccuucgagc

SEQ ID NO: 86649 - RNA, 20 nt, Artificial Sequence
  MKO10086649_B_Gabpb2
  gRNA
ugacuccucgacccagcaag

SEQ ID NO: 86650 - RNA, 20 nt, Artificial Sequence
  MKO10086650_B_Gabra1
  gRNA
gcuccggcuaaacaaccuua

SEQ ID NO: 86651 - RNA, 20 nt, Artificial Sequence
  MKO10086651_B_Gabra1
  gRNA
uaugacaaucgucugagacc

SEQ ID NO: 86652 - RNA, 20 nt, Artificial Sequence
  MKO10086652_B_Gabra1
  gRNA
ugucauaaccguccagcagu

SEQ ID NO: 86653 - RNA, 20 nt, Artificial Sequence
  MKO10086653_B_Gabra2
  gRNA
uaugauaaucggcuuagacc

SEQ ID NO: 86654 - RNA, 20 nt, Artificial Sequence
  MKO10086654_B_Gabra2
  gRNA
aacauuuacgugaccaguuu

SEQ ID NO: 86655 - RNA, 20 nt, Artificial Sequence
  MKO10086655_B_Gabra2
  gRNA
cauccaucgggaaauccucc

SEQ ID NO: 86656 - RNA, 20 nt, Artificial Sequence
  MKO10086656_B_Gabra3
  gRNA
ucucuuaccucauuguauag

SEQ ID NO: 86657 - RNA, 20 nt, Artificial Sequence
  MKO10086657_B_Gabra3
  gRNA
cacuaucuucacuagaaucu

SEQ ID NO: 86658 - RNA, 20 nt, Artificial Sequence
  MKO10086658_B_Gabra3
  gRNA
gacaucuaugugaccaguuu

SEQ ID NO: 86659 - RNA, 20 nt, Artificial Sequence
  MKO10086659_B_Gabra4
  gRNA
gcccguuucugauguugaaa

SEQ ID NO: 86660 - RNA, 20 nt, Artificial Sequence
  MKO10086660_B_Gabra4
  gRNA
aggaaaauccaccagucuca

SEQ ID NO: 86661 - RNA, 20 nt, Artificial Sequence
  MKO10086661_B_Gabra4
  gRNA
uucagccucaagauuucaau

SEQ ID NO: 86662 - RNA, 20 nt, Artificial Sequence
  MKO10086662_B_Gabra5
  gRNA
uaugacaacagacugcggcc

SEQ ID NO: 86663 - RNA, 20 nt, Artificial Sequence
  MKO10086663_B_Gabra5
  gRNA
ugucgucauguugugugcaa

SEQ ID NO: 86664 - RNA, 20 nt, Artificial Sequence
  MKO10086664_B_Gabra5
  gRNA
accauuuccgugucagacac

SEQ ID NO: 86665 - RNA, 20 nt, Artificial Sequence
  MKO10086665_B_Gabra6
  gRNA
cuucaucuucaaguugagcu

SEQ ID NO: 86666 - RNA, 20 nt, Artificial Sequence
  MKO10086666_B_Gabra6
  gRNA
ggauggucuugcuucucccc

SEQ ID NO: 86667 - RNA, 20 nt, Artificial Sequence
  MKO10086667_B_Gabra6
  gRNA
ccauagaauaaugaagagcc

SEQ ID NO: 86668 - RNA, 20 nt, Artificial Sequence
  MKO10086668_B_Gabrb1
  gRNA
aaggauaugacauucgcuug

SEQ ID NO: 86669 - RNA, 20 nt, Artificial Sequence
  MKO10086669_B_Gabrb1
  gRNA
ccauagagaacaguuccauc

SEQ ID NO: 86670 - RNA, 20 nt, Artificial Sequence
  MKO10086670_B_Gabrb1
  gRNA
cagugaaaaaccgaaugauc

SEQ ID NO: 86671 - RNA, 20 nt, Artificial Sequence
  MKO10086671_B_Gabrb2
  gRNA
ccgccuuagguccaucaugc

SEQ ID NO: 86672 - RNA, 20 nt, Artificial Sequence
  MKO10086672_B_Gabrb2
  gRNA
uuaaccagcgacauauuacu

SEQ ID NO: 86673 - RNA, 20 nt, Artificial Sequence
  MKO10086673_B_Gabrb2
  gRNA
cugccugcaugauggaccua

SEQ ID NO: 86674 - RNA, 20 nt, Artificial Sequence
  MKO10086674_B_Gabrb3
  gRNA
auucgccugagacccgacuu

SEQ ID NO: 86675 - RNA, 20 nt, Artificial Sequence
  MKO10086675_B_Gabrb3
  gRNA
cgcaggucccccagucugcg

SEQ ID NO: 86676 - RNA, 20 nt, Artificial Sequence
  MKO10086676_B_Gabrb3
  gRNA
uacgacagcagcgugcauga

SEQ ID NO: 86677 - RNA, 20 nt, Artificial Sequence
  MKO10086677_B_Gabrd
  gRNA
aaccauaccaacgagaccuu

SEQ ID NO: 86678 - RNA, 20 nt, Artificial Sequence
  MKO10086678_B_Gabrd
  gRNA
agggcaagcgccacauucac

SEQ ID NO: 86679 - RNA, 20 nt, Artificial Sequence
  MKO10086679_B_Gabrd
  gRNA
ggacuacgugggcuccaacc

SEQ ID NO: 86680 - RNA, 20 nt, Artificial Sequence
  MKO10086680_B_Gabre
  gRNA
ccacguugccaugcagaaua

SEQ ID NO: 86681 - RNA, 20 nt, Artificial Sequence
  MKO10086681_B_Gabre
  gRNA
ccauuggaaaauugagcaug

SEQ ID NO: 86682 - RNA, 20 nt, Artificial Sequence
  MKO10086682_B_Gabre
  gRNA
acuucaacagugaccacagu

SEQ ID NO: 86683 - RNA, 20 nt, Artificial Sequence
  MKO10086683_B_Gabrg1
  gRNA
aacaaacuucguccagauau

SEQ ID NO: 86684 - RNA, 20 nt, Artificial Sequence
  MKO10086684_B_Gabrg1
  gRNA
acagcucuuaccauguuuau

SEQ ID NO: 86685 - RNA, 20 nt, Artificial Sequence
  MKO10086685_B_Gabrg1
  gRNA
accuguggaucccauaaaca

SEQ ID NO: 86686 - RNA, 20 nt, Artificial Sequence
  MKO10086686_B_Gabrg2
  gRNA
acaguaccauuaaaguucuc

SEQ ID NO: 86687 - RNA, 20 nt, Artificial Sequence
  MKO10086687_B_Gabrg2
  gRNA
acuuacaacuggagaacucc

SEQ ID NO: 86688 - RNA, 20 nt, Artificial Sequence
  MKO10086688_B_Gabrg2
  gRNA
uccagugaaugcuaucaaua

SEQ ID NO: 86689 - RNA, 20 nt, Artificial Sequence
  MKO10086689_B_Gabrg3
  gRNA
aaaaccaacugugaucgaug

SEQ ID NO: 86690 - RNA, 20 nt, Artificial Sequence
  MKO10086690_B_Gabrg3
  gRNA
uggcacucacuuccaauguc

SEQ ID NO: 86691 - RNA, 20 nt, Artificial Sequence
  MKO10086691_B_Gabrg3
  gRNA
gcaacugcauaacuucccua

SEQ ID NO: 86692 - RNA, 20 nt, Artificial Sequence
  MKO10086692_B_Gabrp
  gRNA
agagucagugcuauccgaac

SEQ ID NO: 86693 - RNA, 20 nt, Artificial Sequence
  MKO10086693_B_Gabrp
  gRNA
caggauauaacaaauuccuc

SEQ ID NO: 86694 - RNA, 20 nt, Artificial Sequence
  MKO10086694_B_Gabrp
  gRNA
acuuucuagcugcagcuugc

SEQ ID NO: 86695 - RNA, 20 nt, Artificial Sequence
  MKO10086695_B_Gabrq
  gRNA
guccgacuuagaccaaauuu

SEQ ID NO: 86696 - RNA, 20 nt, Artificial Sequence
  MKO10086696_B_Gabrq
  gRNA
ggacaaacaauccugcaagc

SEQ ID NO: 86697 - RNA, 20 nt, Artificial Sequence
  MKO10086697_B_Gabrq
  gRNA
uucugagaucuguucaauac

SEQ ID NO: 86698 - RNA, 20 nt, Artificial Sequence
  MKO10086698_B_Gabrr1
  gRNA
uuaugucagagcuucgucuc

SEQ ID NO: 86699 - RNA, 20 nt, Artificial Sequence
  MKO10086699_B_Gabrr1
  gRNA
acgaccaugauuucagcaug

SEQ ID NO: 86700 - RNA, 20 nt, Artificial Sequence
  MKO10086700_B_Gabrr1
  gRNA
accugcacauccacgcccac

SEQ ID NO: 86701 - RNA, 20 nt, Artificial Sequence
  MKO10086701_B_Gabrr2
  gRNA
accugcacguccacaccuac

SEQ ID NO: 86702 - RNA, 20 nt, Artificial Sequence
  MKO10086702_B_Gabrr2
  gRNA
aggaccacgacuucaccaug

SEQ ID NO: 86703 - RNA, 20 nt, Artificial Sequence
  MKO10086703_B_Gabrr2
  gRNA
acaggccccgccaucccugu

SEQ ID NO: 86704 - RNA, 20 nt, Artificial Sequence
  MKO10086704_B_Gabrr3
  gRNA
cuucauccacgacacaaccg

SEQ ID NO: 86705 - RNA, 20 nt, Artificial Sequence
  MKO10086705_B_Gabrr3
  gRNA
ugaaggcucaccagugcccg

SEQ ID NO: 86706 - RNA, 20 nt, Artificial Sequence
  MKO10086706_B_Gabrr3
  gRNA
augcuucgaguacaucccga

SEQ ID NO: 86707 - RNA, 20 nt, Artificial Sequence
  MKO10086707_B_Gad1
  gRNA
gucgucuugugagcgccuuc

SEQ ID NO: 86708 - RNA, 20 nt, Artificial Sequence
  MKO10086708_B_Gad1
  gRNA
ggagacuuacauauugguau

SEQ ID NO: 86709 - RNA, 20 nt, Artificial Sequence
  MKO10086709_B_Gad1
  gRNA
gugguggaaauccagaaccu

SEQ ID NO: 86710 - RNA, 20 nt, Artificial Sequence
  MKO10086710_B_Gad2
  gRNA
ggcagaccaaccgcaaaauc

SEQ ID NO: 86711 - RNA, 20 nt, Artificial Sequence
  MKO10086711_B_Gad2
  gRNA
cgaugccgcccgugaacuuu

SEQ ID NO: 86712 - RNA, 20 nt, Artificial Sequence
  MKO10086712_B_Gad2
  gRNA
gaccugcugccagcguguga

SEQ ID NO: 86713 - RNA, 20 nt, Artificial Sequence
  MKO10086713_B_Gadd45a
  gRNA
ccgugauuaaucucccggaa

SEQ ID NO: 86714 - RNA, 20 nt, Artificial Sequence
  MKO10086714_B_Gadd45a
  gRNA
uucggaugccaucaccguuc

SEQ ID NO: 86715 - RNA, 20 nt, Artificial Sequence
  MKO10086715_B_Gadd45a
  gRNA
ccgcagagaccccgauaacg

SEQ ID NO: 86716 - RNA, 20 nt, Artificial Sequence
  MKO10086716_B_Gadd45b
  gRNA
gcguuccucuagagagauau

SEQ ID NO: 86717 - RNA, 20 nt, Artificial Sequence
  MKO10086717_B_Gadd45b
  gRNA
ccucguacacccccacggug

SEQ ID NO: 86718 - RNA, 20 nt, Artificial Sequence
  MKO10086718_B_Gadd45b
  gRNA
gguccccuauaucucucuag

SEQ ID NO: 86719 - RNA, 20 nt, Artificial Sequence
  MKO10086719_B_Gadd45gip1
  gRNA
gcagcguaucgcagagugca

SEQ ID NO: 86720 - RNA, 20 nt, Artificial Sequence
  MKO10086720_B_Gadd45gip1
  gRNA
agaaccugcugaccccgcga

SEQ ID NO: 86721 - RNA, 20 nt, Artificial Sequence
  MKO10086721_B_Gadd45gip1
  gRNA
caagcgcagcgacucuugca

SEQ ID NO: 86722 - RNA, 20 nt, Artificial Sequence
  MKO10086722_B_Gadd45g
  gRNA
cgccagggcugucugaccgc

SEQ ID NO: 86723 - RNA, 20 nt, Artificial Sequence
  MKO10086723_B_Gadd45g
  gRNA
gcacccagucguugaagcug

SEQ ID NO: 86724 - RNA, 20 nt, Artificial Sequence
  MKO10086724_B_Gadd45g
  gRNA
ugccaggcugucacucggga

SEQ ID NO: 86725 - RNA, 20 nt, Artificial Sequence
  MKO10086725_B_Gadl1
  gRNA
ggggauggaauauuuaaccc

SEQ ID NO: 86726 - RNA, 20 nt, Artificial Sequence
  MKO10086726_B_Gadl1
  gRNA
gagggacacaggcgagucac

SEQ ID NO: 86727 - RNA, 20 nt, Artificial Sequence
  MKO10086727_B_Gadl1
  gRNA
uuaccucugccgaugugaaa

SEQ ID NO: 86728 - RNA, 20 nt, Artificial Sequence
  MKO10086728_B_Gak
  gRNA
uggcagagaguaugcauuaa

SEQ ID NO: 86729 - RNA, 20 nt, Artificial Sequence
  MKO10086729_B_Gak
  gRNA
gagcagugcagcacaugcac

SEQ ID NO: 86730 - RNA, 20 nt, Artificial Sequence
  MKO10086730_B_Gak
  gRNA
uguuuaugaagcucaagauc

SEQ ID NO: 86731 - RNA, 20 nt, Artificial Sequence
  MKO10086731_B_Gal3st1
  gRNA
cacucacgugaaggccaugu

SEQ ID NO: 86732 - RNA, 20 nt, Artificial Sequence
  MKO10086732_B_Gal3st1
  gRNA
augaacacaauaucucgccg

SEQ ID NO: 86733 - RNA, 20 nt, Artificial Sequence
  MKO10086733_B_Gal3st1
  gRNA
ggcgcaugugcucguucgcu

SEQ ID NO: 86734 - RNA, 20 nt, Artificial Sequence
  MKO10086734_B_Gal3st2
  gRNA
aggauaauguccauccugag

SEQ ID NO: 86735 - RNA, 20 nt, Artificial Sequence
  MKO10086735_B_Gal3st2
  gRNA
guagucugaaguccacaugc

SEQ ID NO: 86736 - RNA, 20 nt, Artificial Sequence
  MKO10086736_B_Gal3st2
  gRNA
ugcccacagguccuuccagg

SEQ ID NO: 86737 - RNA, 20 nt, Artificial Sequence
  MKO10086737_B_Gal3st3
  gRNA
cguaagccuccucauccacc

SEQ ID NO: 86738 - RNA, 20 nt, Artificial Sequence
  MKO10086738_B_Gal3st3
  gRNA
gacuuuccugcgcgcacccg

SEQ ID NO: 86739 - RNA, 20 nt, Artificial Sequence
  MKO10086739_B_Gal3st3
  gRNA
gcgcgccacgcgacgccaga

SEQ ID NO: 86740 - RNA, 20 nt, Artificial Sequence
  MKO10086740_B_Gal3st4
  gRNA
gacugcagcuccgacagucc

SEQ ID NO: 86741 - RNA, 20 nt, Artificial Sequence
  MKO10086741_B_Gal3st4
  gRNA
agacucccagagccaccccc

SEQ ID NO: 86742 - RNA, 20 nt, Artificial Sequence
  MKO10086742_B_Gal3st4
  gRNA
uccucuggaaugaucccccc

SEQ ID NO: 86743 - RNA, 20 nt, Artificial Sequence
  MKO10086743_B_Galc
  gRNA
auccaguauuucagaacgau

SEQ ID NO: 86744 - RNA, 20 nt, Artificial Sequence
  MKO10086744_B_Galc
  gRNA
uagcucauagugcaugugcg

SEQ ID NO: 86745 - RNA, 20 nt, Artificial Sequence
  MKO10086745_B_Galc
  gRNA
cuagaugagaauuauuuccg

SEQ ID NO: 86746 - RNA, 20 nt, Artificial Sequence
  MKO10086746_B_Gale
  gRNA
cccauaggcgcccacgccuc

SEQ ID NO: 86747 - RNA, 20 nt, Artificial Sequence
  MKO10086747_B_Gale
  gRNA
ucaacuccuggacccggcgc

SEQ ID NO: 86748 - RNA, 20 nt, Artificial Sequence
  MKO10086748_B_Gale
  gRNA
gggguugguacagccccccg

SEQ ID NO: 86749 - RNA, 20 nt, Artificial Sequence
  MKO10086749_B_Galk1
  gRNA
ucacacugucgccgacgaac

SEQ ID NO: 86750 - RNA, 20 nt, Artificial Sequence
  MKO10086750_B_Galk1
  gRNA
cccgcagcuuccccgcucgu

SEQ ID NO: 86751 - RNA, 20 nt, Artificial Sequence
  MKO10086751_B_Galk1
  gRNA
acugcacugaagccaacgag

SEQ ID NO: 86752 - RNA, 20 nt, Artificial Sequence
  MKO10086752_B_Galk2
  gRNA
aagaaguaguugugccauag

SEQ ID NO: 86753 - RNA, 20 nt, Artificial Sequence
  MKO10086753_B_Galk2
  gRNA
ggugagcacauagauuacug

SEQ ID NO: 86754 - RNA, 20 nt, Artificial Sequence
  MKO10086754_B_Galk2
  gRNA
ccuauuauguugacucuucc

SEQ ID NO: 86755 - RNA, 20 nt, Artificial Sequence
  MKO10086755_B_Galm
  gRNA
cuggacugacucgaaagaac

SEQ ID NO: 86756 - RNA, 20 nt, Artificial Sequence
  MKO10086756_B_Galm
  gRNA
acgccauuggucaacaccug

SEQ ID NO: 86757 - RNA, 20 nt, Artificial Sequence
  MKO10086757_B_Galm
  gRNA
cgaccauaauuucugucuga

SEQ ID NO: 86758 - RNA, 20 nt, Artificial Sequence
  MKO10086758_B_Galns
  gRNA
acacaaccaacgcucaugca

SEQ ID NO: 86759 - RNA, 20 nt, Artificial Sequence
  MKO10086759_B_Galns
  gRNA
ccacuugcccacgaucuugu

SEQ ID NO: 86760 - RNA, 20 nt, Artificial Sequence
  MKO10086760_B_Galns
  gRNA
acucgucaaauccaugcuuc

SEQ ID NO: 86761 - RNA, 20 nt, Artificial Sequence
  MKO10086761_B_Galnt10
  gRNA
acaaucuccgccacuagcuc

SEQ ID NO: 86762 - RNA, 20 nt, Artificial Sequence
  MKO10086762_B_Galnt10
  gRNA
caugaccgaugccgagagag

SEQ ID NO: 86763 - RNA, 20 nt, Artificial Sequence
  MKO10086763_B_Galnt10
  gRNA
accagcccucguuguggaag

SEQ ID NO: 86764 - RNA, 20 nt, Artificial Sequence
  MKO10086764_B_Galnt11
  gRNA
cauaagaaauaugaagcgcg

SEQ ID NO: 86765 - RNA, 20 nt, Artificial Sequence
  MKO10086765_B_Galnt11
  gRNA
acagagacgugccggacacc

SEQ ID NO: 86766 - RNA, 20 nt, Artificial Sequence
  MKO10086766_B_Galnt11
  gRNA
uaugcucauuaguaaccgcu

SEQ ID NO: 86767 - RNA, 20 nt, Artificial Sequence
  MKO10086767_B_Galnt12
  gRNA
cgacugcggacuccuucucg

SEQ ID NO: 86768 - RNA, 20 nt, Artificial Sequence
  MKO10086768_B_Galnt12
  gRNA
guagaugacuacagcgacag

SEQ ID NO: 86769 - RNA, 20 nt, Artificial Sequence
  MKO10086769_B_Galnt12
  gRNA
gaacacuguaaacuguccga

SEQ ID NO: 86770 - RNA, 20 nt, Artificial Sequence
  MKO10086770_B_Galnt13
  gRNA
ugaugauacguuugaguaca

SEQ ID NO: 86771 - RNA, 20 nt, Artificial Sequence
  MKO10086771_B_Galnt13
  gRNA
guuaagugcgaucaagucac

SEQ ID NO: 86772 - RNA, 20 nt, Artificial Sequence
  MKO10086772_B_Galnt13
  gRNA
acuggaagcuaaauuuccga

SEQ ID NO: 86773 - RNA, 20 nt, Artificial Sequence
  MKO10086773_B_Galnt14
  gRNA
uucgcugcuuguguauugca

SEQ ID NO: 86774 - RNA, 20 nt, Artificial Sequence
  MKO10086774_B_Galnt14
  gRNA
agugcuugcgcaacaaugag

SEQ ID NO: 86775 - RNA, 20 nt, Artificial Sequence
  MKO10086775_B_Galnt14
  gRNA
aaccccuaugcaucugaucc

SEQ ID NO: 86776 - RNA, 20 nt, Artificial Sequence
  MKO10086776_B_Galnt15
  gRNA
aguucucaagagcgugggcc

SEQ ID NO: 86777 - RNA, 20 nt, Artificial Sequence
  MKO10086777_B_Galnt15
  gRNA
aauaggaggcucggcaccau

SEQ ID NO: 86778 - RNA, 20 nt, Artificial Sequence
  MKO10086778_B_Galnt15
  gRNA
gaagaccagcacguccccug

SEQ ID NO: 86779 - RNA, 20 nt, Artificial Sequence
  MKO10086779_B_Galnt16
  gRNA
guguggagcgagccucguug

SEQ ID NO: 86780 - RNA, 20 nt, Artificial Sequence
  MKO10086780_B_Galnt16
  gRNA
agcuggcaggaguucgguuc

SEQ ID NO: 86781 - RNA, 20 nt, Artificial Sequence
  MKO10086781_B_Galnt16
  gRNA
acaacaugccuucaaccaac

SEQ ID NO: 86782 - RNA, 20 nt, Artificial Sequence
  MKO10086782_B_Galnt18
  gRNA
gaguacccgcuagccgccca

SEQ ID NO: 86783 - RNA, 20 nt, Artificial Sequence
  MKO10086783_B_Galnt18
  gRNA
cgcacaacuuugaugaagcc

SEQ ID NO: 86784 - RNA, 20 nt, Artificial Sequence
  MKO10086784_B_Galnt18
  gRNA
accaguccucacccgcauca

SEQ ID NO: 86785 - RNA, 20 nt, Artificial Sequence
  MKO10086785_B_Galnt1
  gRNA
gcucacugugaaugcaccgc

SEQ ID NO: 86786 - RNA, 20 nt, Artificial Sequence
  MKO10086786_B_Galnt1
  gRNA
cuagugcagaaaccucauga

SEQ ID NO: 86787 - RNA, 20 nt, Artificial Sequence
  MKO10086787_B_Galnt1
  gRNA
ugaugacacuuucgaguaca

SEQ ID NO: 86788 - RNA, 20 nt, Artificial Sequence
  MKO10086788_B_Galnt2
  gRNA
accugaccaccguccgcagc

SEQ ID NO: 86789 - RNA, 20 nt, Artificial Sequence
  MKO10086789_B_Galnt2
  gRNA
cguugcuguagucauccacc

SEQ ID NO: 86790 - RNA, 20 nt, Artificial Sequence
  MKO10086790_B_Galnt2
  gRNA
agacacgguaccuggaggga

SEQ ID NO: 86791 - RNA, 20 nt, Artificial Sequence
  MKO10086791_B_Galnt3
  gRNA
uucaggacccccaccuuugc

SEQ ID NO: 86792 - RNA, 20 nt, Artificial Sequence
  MKO10086792_B_Galnt3
  gRNA
agcugagaacuacacugccg

SEQ ID NO: 86793 - RNA, 20 nt, Artificial Sequence
  MKO10086793_B_Galnt3
  gRNA
uucaccugccauacugcuga

SEQ ID NO: 86794 - RNA, 20 nt, Artificial Sequence
  MKO10086794_B_Galnt4
  gRNA
gauccacccaugcucgcacg

SEQ ID NO: 86795 - RNA, 20 nt, Artificial Sequence
  MKO10086795_B_Galnt4
  gRNA
uaaucaagcgaacucucucc

SEQ ID NO: 86796 - RNA, 20 nt, Artificial Sequence
  MKO10086796_B_Galnt4
  gRNA
acuuccuacagaauaccgcg

SEQ ID NO: 86797 - RNA, 20 nt, Artificial Sequence
  MKO10086797_B_Galnt5
  gRNA
uacacuccacaugagagucu

SEQ ID NO: 86798 - RNA, 20 nt, Artificial Sequence
  MKO10086798_B_Galnt5
  gRNA
gggcuggcuggaaccucuac

SEQ ID NO: 86799 - RNA, 20 nt, Artificial Sequence
  MKO10086799_B_Galnt5
  gRNA
uacaaagcacaugaugaugc

SEQ ID NO: 86800 - RNA, 20 nt, Artificial Sequence
  MKO10086800_B_Galnt6
  gRNA
uuguguuccacaacgaagcc

SEQ ID NO: 86801 - RNA, 20 nt, Artificial Sequence
  MKO10086801_B_Galnt6
  gRNA
gccagguccccgacguuugc

SEQ ID NO: 86802 - RNA, 20 nt, Artificial Sequence
  MKO10086802_B_Galnt6
  gRNA
uucggcagcgggagcggaag

SEQ ID NO: 86803 - RNA, 20 nt, Artificial Sequence
  MKO10086803_B_Galnt7
  gRNA
uugauucaagcucggagcau

SEQ ID NO: 86804 - RNA, 20 nt, Artificial Sequence
  MKO10086804_B_Galnt7
  gRNA
gcucuggucgucgggccgcg

SEQ ID NO: 86805 - RNA, 20 nt, Artificial Sequence
  MKO10086805_B_Galnt7
  gRNA
guucaucuuacgcaguuugc

SEQ ID NO: 86806 - RNA, 20 nt, Artificial Sequence
  MKO10086806_B_Galnt9
  gRNA
cuggugcgcuacagugccga

SEQ ID NO: 86807 - RNA, 20 nt, Artificial Sequence
  MKO10086807_B_Galnt9
  gRNA
agaacguguaccccgagaug

SEQ ID NO: 86808 - RNA, 20 nt, Artificial Sequence
  MKO10086808_B_Galnt9
  gRNA
ggucaucgucuucugccccc

SEQ ID NO: 86809 - RNA, 20 nt, Artificial Sequence
  MKO10086809_B_Galntl5
  gRNA
ucaccacacucgacacugcc

SEQ ID NO: 86810 - RNA, 20 nt, Artificial Sequence
  MKO10086810_B_Galntl5
  gRNA
gcccagucuucuacucauga

SEQ ID NO: 86811 - RNA, 20 nt, Artificial Sequence
  MKO10086811_B_Galntl5
  gRNA
guggaugacaugagugaauu

SEQ ID NO: 86812 - RNA, 20 nt, Artificial Sequence
  MKO10086812_B_Galntl6
  gRNA
ggugcguacaauucucacuu

SEQ ID NO: 86813 - RNA, 20 nt, Artificial Sequence
  MKO10086813_B_Galntl6
  gRNA
auuaucccauuucacaacga

SEQ ID NO: 86814 - RNA, 20 nt, Artificial Sequence
  MKO10086814_B_Galntl6
  gRNA
accgggaugacucagcuuac

SEQ ID NO: 86815 - RNA, 20 nt, Artificial Sequence
  MKO10086815_B_Galp
  gRNA
cggccuuggaggaaacgggg

SEQ ID NO: 86816 - RNA, 20 nt, Artificial Sequence
  MKO10086816_B_Galp
  gRNA
auggcuaacucucugagucc

SEQ ID NO: 86817 - RNA, 20 nt, Artificial Sequence
  MKO10086817_B_Galp
  gRNA
ccuuccagggacgaggaggc

SEQ ID NO: 86818 - RNA, 20 nt, Artificial Sequence
  MKO10086818_B_Galr1
  gRNA
caaauacuacaacgaccacc

SEQ ID NO: 86819 - RNA, 20 nt, Artificial Sequence
  MKO10086819_B_Galr1
  gRNA
gucugaagcauccaagaaaa

SEQ ID NO: 86820 - RNA, 20 nt, Artificial Sequence
  MKO10086820_B_Galr1
  gRNA
uccaggccgcucuucggcau

SEQ ID NO: 86821 - RNA, 20 nt, Artificial Sequence
  MKO10086821_B_Galr2
  gRNA
ccaucuauacccuggacgau

SEQ ID NO: 86822 - RNA, 20 nt, Artificial Sequence
  MKO10086822_B_Galr2
  gRNA
cgucguggugcgcuccacgc

SEQ ID NO: 86823 - RNA, 20 nt, Artificial Sequence
  MKO10086823_B_Galr2
  gRNA
agguuuccgcaaaaucugcg

SEQ ID NO: 86824 - RNA, 20 nt, Artificial Sequence
  MKO10086824_B_Galr3
  gRNA
ugacauccagaacauuucgc

SEQ ID NO: 86825 - RNA, 20 nt, Artificial Sequence
  MKO10086825_B_Galr3
  gRNA
gcagcgggugucgcaccgcc

SEQ ID NO: 86826 - RNA, 20 nt, Artificial Sequence
  MKO10086826_B_Galr3
  gRNA
gaagcacagcgugcguccgu

SEQ ID NO: 86827 - RNA, 20 nt, Artificial Sequence
  MKO10086827_B_Galt
  gRNA
gguaccuggauccggagcau

SEQ ID NO: 86828 - RNA, 20 nt, Artificial Sequence
  MKO10086828_B_Galt
  gRNA
uccgagcugucaucgaugca

SEQ ID NO: 86829 - RNA, 20 nt, Artificial Sequence
  MKO10086829_B_Galt
  gRNA
uaggugaauccccacuauga

SEQ ID NO: 86830 - RNA, 20 nt, Artificial Sequence
  MKO10086830_B_Gal
  gRNA
gcuugucgcuaaaugaucug

SEQ ID NO: 86831 - RNA, 20 nt, Artificial Sequence
  MKO10086831_B_Gal
  gRNA
cucaguuucuugcaccuuaa

SEQ ID NO: 86832 - RNA, 20 nt, Artificial Sequence
  MKO10086832_B_Gal
  gRNA
ggggcccucgacagccugcc

SEQ ID NO: 86833 - RNA, 20 nt, Artificial Sequence
  MKO10086833_B_Gamt
  gRNA
aggcccccauagaggaacac

SEQ ID NO: 86834 - RNA, 20 nt, Artificial Sequence
  MKO10086834_B_Gamt
  gRNA
ucaccaucaaagugaccguc

SEQ ID NO: 86835 - RNA, 20 nt, Artificial Sequence
  MKO10086835_B_Gamt
  gRNA
cgcccccggucuucagcaag

SEQ ID NO: 86836 - RNA, 20 nt, Artificial Sequence
  MKO10086836_B_Ganab
  gRNA
ggcauacuuaggggucuguc

SEQ ID NO: 86837 - RNA, 20 nt, Artificial Sequence
  MKO10086837_B_Ganab
  gRNA
ggaucgaugagcuagagccc

SEQ ID NO: 86838 - RNA, 20 nt, Artificial Sequence
  MKO10086838_B_Ganab
  gRNA
gcucaaaggccauaaguccu

SEQ ID NO: 86839 - RNA, 20 nt, Artificial Sequence
  MKO10086839_B_Ganc
  gRNA
uaguugcuucacugaugauu

SEQ ID NO: 86840 - RNA, 20 nt, Artificial Sequence
  MKO10086840_B_Ganc
  gRNA
ccauaaacuucagccacgag

SEQ ID NO: 86841 - RNA, 20 nt, Artificial Sequence
  MKO10086841_B_Ganc
  gRNA
caccaagacuaccaccuacc

SEQ ID NO: 86842 - RNA, 20 nt, Artificial Sequence
  MKO10086842_B_Gan
  gRNA
gagagggcacauacaucgca

SEQ ID NO: 86843 - RNA, 20 nt, Artificial Sequence
  MKO10086843_B_Gan
  gRNA
gcccucucuacgacccuaac

SEQ ID NO: 86844 - RNA, 20 nt, Artificial Sequence
  MKO10086844_B_Gan
  gRNA
ccagguaaugcacguggugc

SEQ ID NO: 86845 - RNA, 20 nt, Artificial Sequence
  MKO10086845_B_Gap43
  gRNA
ugaggguaaagaagaccccg

SEQ ID NO: 86846 - RNA, 20 nt, Artificial Sequence
  MKO10086846_B_Gap43
  gRNA
cuguaugagaagaaccaaac

SEQ ID NO: 86847 - RNA, 20 nt, Artificial Sequence
  MKO10086847_B_Gap43
  gRNA
ucuucucauacagcacagca

SEQ ID NO: 86848 - RNA, 20 nt, Artificial Sequence
  MKO10086848_B_Gapdhs
  gRNA
uuggacagauuuggacgcau

SEQ ID NO: 86849 - RNA, 20 nt, Artificial Sequence
  MKO10086849_B_Gapdhs
  gRNA
uugagaucaacacguaccag

SEQ ID NO: 86850 - RNA, 20 nt, Artificial Sequence
  MKO10086850_B_Gapdhs
  gRNA
ucuggugcugcgagucugca

SEQ ID NO: 86851 - RNA, 20 nt, Artificial Sequence
  MKO10086851_B_Gapdh
  gRNA
ccacaaugccaaaguuguca

SEQ ID NO: 86852 - RNA, 20 nt, Artificial Sequence
  MKO10086852_B_Gapdh
  gRNA
cacugccacccagaagacug

SEQ ID NO: 86853 - RNA, 20 nt, Artificial Sequence
  MKO10086853_B_Gapdh
  gRNA
ccauacauacagguuucucc

SEQ ID NO: 86854 - RNA, 20 nt, Artificial Sequence
  MKO10086854_B_Gapt
  gRNA
acacgucuacgggaaucaaa

SEQ ID NO: 86855 - RNA, 20 nt, Artificial Sequence
  MKO10086855_B_Gapt
  gRNA
caugcuugggcuaaucacgu

SEQ ID NO: 86856 - RNA, 20 nt, Artificial Sequence
  MKO10086856_B_Gapt
  gRNA
gugcuuggcacuggaaucgc

SEQ ID NO: 86857 - RNA, 20 nt, Artificial Sequence
  MKO10086857_B_Gapvd1
  gRNA
agguaaucgauucuucuugu

SEQ ID NO: 86858 - RNA, 20 nt, Artificial Sequence
  MKO10086858_B_Gapvd1
  gRNA
aagaagaaucgauuaccuau

SEQ ID NO: 86859 - RNA, 20 nt, Artificial Sequence
  MKO10086859_B_Gapvd1
  gRNA
uuggcggagucuccacugca

SEQ ID NO: 86860 - RNA, 20 nt, Artificial Sequence
  MKO10086860_B_Gar1
  gRNA
ccuuucucaccaggaggacg

SEQ ID NO: 86861 - RNA, 20 nt, Artificial Sequence
  MKO10086861_B_Gar1
  gRNA
guagggcaccuuguucuccu

SEQ ID NO: 86862 - RNA, 20 nt, Artificial Sequence
  MKO10086862_B_Gar1
  gRNA
uaaguugucagaaaacauga

SEQ ID NO: 86863 - RNA, 20 nt, Artificial Sequence
  MKO10086863_B_Gareml
  gRNA
ugauccacuccugccgccag

SEQ ID NO: 86864 - RNA, 20 nt, Artificial Sequence
  MKO10086864_B_Gareml
  gRNA
uggcuuccaucacgaagauu

SEQ ID NO: 86865 - RNA, 20 nt, Artificial Sequence
  MKO10086865_B_Gareml
  gRNA
gacaucccccugcaguaccc

SEQ ID NO: 86866 - RNA, 20 nt, Artificial Sequence
  MKO10086866_B_Garem
  gRNA
acacaccauccgaaacaucg

SEQ ID NO: 86867 - RNA, 20 nt, Artificial Sequence
  MKO10086867_B_Garem
  gRNA
uuugcacuucggggcggcac

SEQ ID NO: 86868 - RNA, 20 nt, Artificial Sequence
  MKO10086868_B_Garem
  gRNA
gcaauauuucaacagcgugg

SEQ ID NO: 86869 - RNA, 20 nt, Artificial Sequence
  MKO10086869_B_Garnl3
  gRNA
cucaguaucgugcaauucuu

SEQ ID NO: 86870 - RNA, 20 nt, Artificial Sequence
  MKO10086870_B_Garnl3
  gRNA
ugcccuuuggauggcuccau

SEQ ID NO: 86871 - RNA, 20 nt, Artificial Sequence
  MKO10086871_B_Garnl3
  gRNA
ucuguccuucgccaagugcc

SEQ ID NO: 86872 - RNA, 20 nt, Artificial Sequence
  MKO10086872_B_Gars
  gRNA
gcucuguccacauccacuug

SEQ ID NO: 86873 - RNA, 20 nt, Artificial Sequence
  MKO10086873_B_Gars
  gRNA
ucuaucuacgaugucaucuu

SEQ ID NO: 86874 - RNA, 20 nt, Artificial Sequence
  MKO10086874_B_Gars
  gRNA
caucguagauagagcaaaaa

SEQ ID NO: 86875 - RNA, 20 nt, Artificial Sequence
  MKO10086875_B_Gart
  gRNA
cagcgcgaacuuuccugcuu

SEQ ID NO: 86876 - RNA, 20 nt, Artificial Sequence
  MKO10086876_B_Gart
  gRNA
cuggccuucacaaccaaagc

SEQ ID NO: 86877 - RNA, 20 nt, Artificial Sequence
  MKO10086877_B_Gart
  gRNA
ugcccucgcucaguucugca

SEQ ID NO: 86878 - RNA, 20 nt, Artificial Sequence
  MKO10086878_B_Gas1
  gRNA
cagcucaaccacacgcgccg

SEQ ID NO: 86879 - RNA, 20 nt, Artificial Sequence
  MKO10086879_B_Gas1
  gRNA
gcauguccucgaugaccgcg

SEQ ID NO: 86880 - RNA, 20 nt, Artificial Sequence
  MKO10086880_B_Gas1
  gRNA
cgccuacagccaguacgccg

SEQ ID NO: 86881 - RNA, 20 nt, Artificial Sequence
  MKO10086881_B_Gas2l1
  gRNA
cuagaagacgagcagcgaca

SEQ ID NO: 86882 - RNA, 20 nt, Artificial Sequence
  MKO10086882_B_Gas2l1
  gRNA
guaacccccaucagccugcg

SEQ ID NO: 86883 - RNA, 20 nt, Artificial Sequence
  MKO10086883_B_Gas2l1
  gRNA
cgaccaguuucccaugauca

SEQ ID NO: 86884 - RNA, 20 nt, Artificial Sequence
  MKO10086884_B_Gas2l2
  gRNA
auugugauagcccacaagcc

SEQ ID NO: 86885 - RNA, 20 nt, Artificial Sequence
  MKO10086885_B_Gas2l2
  gRNA
ggucauguuuauccagauaa

SEQ ID NO: 86886 - RNA, 20 nt, Artificial Sequence
  MKO10086886_B_Gas2l2
  gRNA
augcccagugcaauucucca

SEQ ID NO: 86887 - RNA, 20 nt, Artificial Sequence
  MKO10086887_B_Gas2l3
  gRNA
ggcugccacucugacgagcc

SEQ ID NO: 86888 - RNA, 20 nt, Artificial Sequence
  MKO10086888_B_Gas2l3
  gRNA
ucaccccuggcucgucagag

SEQ ID NO: 86889 - RNA, 20 nt, Artificial Sequence
  MKO10086889_B_Gas2l3
  gRNA
uggcaaacgucagccagucc

SEQ ID NO: 86890 - RNA, 20 nt, Artificial Sequence
  MKO10086890_B_Gas2
  gRNA
ggaugccaacaagccugcca

SEQ ID NO: 86891 - RNA, 20 nt, Artificial Sequence
  MKO10086891_B_Gas2
  gRNA
gaagaguacuggaaacuuac

SEQ ID NO: 86892 - RNA, 20 nt, Artificial Sequence
  MKO10086892_B_Gas2
  gRNA
agguaugguguggagccucc

SEQ ID NO: 86893 - RNA, 20 nt, Artificial Sequence
  MKO10086893_B_Gas6
  gRNA
uuuaacucaccuugauaucg

SEQ ID NO: 86894 - RNA, 20 nt, Artificial Sequence
  MKO10086894_B_Gas6
  gRNA
ugaguacccuucuuaucaca

SEQ ID NO: 86895 - RNA, 20 nt, Artificial Sequence
  MKO10086895_B_Gas6
  gRNA
cccaaacccuugugauaaga

SEQ ID NO: 86896 - RNA, 20 nt, Artificial Sequence
  MKO10086896_B_Gas7
  gRNA
agaacugcugggacguuccc

SEQ ID NO: 86897 - RNA, 20 nt, Artificial Sequence
  MKO10086897_B_Gas7
  gRNA
gcagucucuggagggugcgc

SEQ ID NO: 86898 - RNA, 20 nt, Artificial Sequence
  MKO10086898_B_Gas7
  gRNA
aacgucccagcaguucuccu

SEQ ID NO: 86899 - RNA, 20 nt, Artificial Sequence
  MKO10086899_B_Gas8
  gRNA
aaagggaccgcgauuguuga

SEQ ID NO: 86900 - RNA, 20 nt, Artificial Sequence
  MKO10086900_B_Gas8
  gRNA
ggaucuugucgcgcuccagc

SEQ ID NO: 86901 - RNA, 20 nt, Artificial Sequence
  MKO10086901_B_Gas8
  gRNA
ugcgacgccaucaacaaucg

SEQ ID NO: 86902 - RNA, 20 nt, Artificial Sequence
  MKO10086902_B_Gast
  gRNA
cuuuggccgccgcagugcug

SEQ ID NO: 86903 - RNA, 20 nt, Artificial Sequence
  MKO10086903_B_Gast
  gRNA
aucuggaccagggaccaaug

SEQ ID NO: 86904 - RNA, 20 nt, Artificial Sequence
  MKO10086904_B_Gast
  gRNA
gcucagccucucaccaucga

SEQ ID NO: 86905 - RNA, 20 nt, Artificial Sequence
  MKO10086905_B_Gaua1
  gRNA
auugcauaccggaucuccgc

SEQ ID NO: 86906 - RNA, 20 nt, Artificial Sequence
  MKO10086906_B_Gaua1
  gRNA
gaggaaugccagcggagauc

SEQ ID NO: 86907 - RNA, 20 nt, Artificial Sequence
  MKO10086907_B_Gaua1
  gRNA
aauccagacgaggaaccgca

SEQ ID NO: 86908 - RNA, 20 nt, Artificial Sequence
  MKO10086908_B_Gaua2
  gRNA
aggcggcaguccccugcgcc

SEQ ID NO: 86909 - RNA, 20 nt, Artificial Sequence
  MKO10086909_B_Gaua2
  gRNA
accccucucuggcgacgaga

SEQ ID NO: 86910 - RNA, 20 nt, Artificial Sequence
  MKO10086910_B_Gaua2
  gRNA
agacgacaaccaccaccuua

SEQ ID NO: 86911 - RNA, 20 nt, Artificial Sequence
  MKO10086911_B_Gaua3
  gRNA
cgacccggcggaucccgggg

SEQ ID NO: 86912 - RNA, 20 nt, Artificial Sequence
  MKO10086912_B_Gaua3
  gRNA
guaccaucucgccgccacag

SEQ ID NO: 86913 - RNA, 20 nt, Artificial Sequence
  MKO10086913_B_Gaua3
  gRNA
gaggaacgcuaauggggacc

SEQ ID NO: 86914 - RNA, 20 nt, Artificial Sequence
  MKO10086914_B_Gaua4
  gRNA
auuacgacgccacagcgugg

SEQ ID NO: 86915 - RNA, 20 nt, Artificial Sequence
  MKO10086915_B_Gaua4
  gRNA
cccuccuuccgcauugcaag

SEQ ID NO: 86916 - RNA, 20 nt, Artificial Sequence
  MKO10086916_B_Gaua4
  gRNA
auugcuggaguuaccgcugg

SEQ ID NO: 86917 - RNA, 20 nt, Artificial Sequence
  MKO10086917_B_Gaua5
  gRNA
ccuccgaguugcgccuccag

SEQ ID NO: 86918 - RNA, 20 nt, Artificial Sequence
  MKO10086918_B_Gaua5
  gRNA
ccuuaccugggaggugauag

SEQ ID NO: 86919 - RNA, 20 nt, Artificial Sequence
  MKO10086919_B_Gaua5
  gRNA
accugaggagcccuugauuu

SEQ ID NO: 86920 - RNA, 20 nt, Artificial Sequence
  MKO10086920_B_Gaua6
  gRNA
aguccaagccgccgugauga

SEQ ID NO: 86921 - RNA, 20 nt, Artificial Sequence
  MKO10086921_B_Gaua6
  gRNA
ucuacacaagcgaccaccuc

SEQ ID NO: 86922 - RNA, 20 nt, Artificial Sequence
  MKO10086922_B_Gaua6
  gRNA
gagguggucgcuuguguaga

SEQ ID NO: 86923 - RNA, 20 nt, Artificial Sequence
  MKO10086923_B_Gauad1
  gRNA
ggcuacauauggacucacgu

SEQ ID NO: 86924 - RNA, 20 nt, Artificial Sequence
  MKO10086924_B_Gauad1
  gRNA
agccguacuaugcucagauc

SEQ ID NO: 86925 - RNA, 20 nt, Artificial Sequence
  MKO10086925_B_Gauad1
  gRNA
agcuggagccgauuuguauu

SEQ ID NO: 86926 - RNA, 20 nt, Artificial Sequence
  MKO10086926_B_Gauad2a
  gRNA
gcuguuaggagacgggccug

SEQ ID NO: 86927 - RNA, 20 nt, Artificial Sequence
  MKO10086927_B_Gauad2a
  gRNA
ccauucacccuugggcucga

SEQ ID NO: 86928 - RNA, 20 nt, Artificial Sequence
  MKO10086928_B_Gauad2a
  gRNA
caccaagagcgccucagugc

SEQ ID NO: 86929 - RNA, 20 nt, Artificial Sequence
  MKO10086929_B_Gauad2b
  gRNA
ggaguuagccuuccucgguc

SEQ ID NO: 86930 - RNA, 20 nt, Artificial Sequence
  MKO10086930_B_Gauad2b
  gRNA
cagcgggguccaccgaagcc

SEQ ID NO: 86931 - RNA, 20 nt, Artificial Sequence
  MKO10086931_B_Gauad2b
  gRNA
ucuaagcuucccucccgacc

SEQ ID NO: 86932 - RNA, 20 nt, Artificial Sequence
  MKO10086932_B_Gauc
  gRNA
acagaauuccaaucacguug

SEQ ID NO: 86933 - RNA, 20 nt, Artificial Sequence
  MKO10086933_B_Gauc
  gRNA
ggaaucuuguuuaccauguc

SEQ ID NO: 86934 - RNA, 20 nt, Artificial Sequence
  MKO10086934_B_Gauc
  gRNA
ccagaauagcuacucugcug

SEQ ID NO: 86935 - RNA, 20 nt, Artificial Sequence
  MKO10086935_B_Gaum
  gRNA
ggcggccugaccccaucgac

SEQ ID NO: 86936 - RNA, 20 nt, Artificial Sequence
  MKO10086936_B_Gaum
  gRNA
gaauuaucccauccauuccg

SEQ ID NO: 86937 - RNA, 20 nt, Artificial Sequence
  MKO10086937_B_Gaum
  gRNA
cagacacaaauuggccgcuc

SEQ ID NO: 86938 - RNA, 20 nt, Artificial Sequence
  MKO10086938_B_Gausl2
  gRNA
acccuccucaucuacgauga

SEQ ID NO: 86939 - RNA, 20 nt, Artificial Sequence
  MKO10086939_B_Gausl2
  gRNA
cuacaccaucaucguagaug

SEQ ID NO: 86940 - RNA, 20 nt, Artificial Sequence
  MKO10086940_B_Gausl2
  gRNA
cgccgucgccacccuucuca

SEQ ID NO: 86941 - RNA, 20 nt, Artificial Sequence
  MKO10086941_B_Gausl3
  gRNA
ccagcggggcaaugacagac

SEQ ID NO: 86942 - RNA, 20 nt, Artificial Sequence
  MKO10086942_B_Gausl3
  gRNA
ggggagccugugcccguuac

SEQ ID NO: 86943 - RNA, 20 nt, Artificial Sequence
  MKO10086943_B_Gausl3
  gRNA
augagggugguggcgacagc

SEQ ID NO: 86944 - RNA, 20 nt, Artificial Sequence
  MKO10086944_B_Gba2
  gRNA
gaauugagcaugucgaugaa

SEQ ID NO: 86945 - RNA, 20 nt, Artificial Sequence
  MKO10086945_B_Gba2
  gRNA
aggaagcugauagaccgucc

SEQ ID NO: 86946 - RNA, 20 nt, Artificial Sequence
  MKO10086946_B_Gba2
  gRNA
ggagaggccaguucugucgu

SEQ ID NO: 86947 - RNA, 20 nt, Artificial Sequence
  MKO10086947_B_Gbas
  gRNA
guuuauucaugaccuccgug

SEQ ID NO: 86948 - RNA, 20 nt, Artificial Sequence
  MKO10086948_B_Gbas
  gRNA
aucgaccuuucugacaaaca

SEQ ID NO: 86949 - RNA, 20 nt, Artificial Sequence
  MKO10086949_B_Gbas
  gRNA
cuccaaccuccuagccaaaa

SEQ ID NO: 86950 - RNA, 20 nt, Artificial Sequence
  MKO10086950_B_Gba
  gRNA
uuggauaacuggaagucguu

SEQ ID NO: 86951 - RNA, 20 nt, Artificial Sequence
  MKO10086951_B_Gba
  gRNA
gucuggugaaagauaucccc

SEQ ID NO: 86952 - RNA, 20 nt, Artificial Sequence
  MKO10086952_B_Gba
  gRNA
cucaccguugguagagaagu

SEQ ID NO: 86953 - RNA, 20 nt, Artificial Sequence
  MKO10086953_B_Gbe1
  gRNA
acaacaacgugaacuaugau

SEQ ID NO: 86954 - RNA, 20 nt, Artificial Sequence
  MKO10086954_B_Gbe1
  gRNA
aaauccccccugauaccuca

SEQ ID NO: 86955 - RNA, 20 nt, Artificial Sequence
  MKO10086955_B_Gbe1
  gRNA
cuccaaugucaugcaaaacc

SEQ ID NO: 86956 - RNA, 20 nt, Artificial Sequence
  MKO10086956_B_Gbf1
  gRNA
cugggguuagcaacagaguu

SEQ ID NO: 86957 - RNA, 20 nt, Artificial Sequence
  MKO10086957_B_Gbf1
  gRNA
aacucuguugcuaaccccag

SEQ ID NO: 86958 - RNA, 20 nt, Artificial Sequence
  MKO10086958_B_Gbf1
  gRNA
caguuucaguaaccugaaag

SEQ ID NO: 86959 - RNA, 20 nt, Artificial Sequence
  MKO10086959_B_Gbgu1
  gRNA
gcaacaugaagcugcccuuc

SEQ ID NO: 86960 - RNA, 20 nt, Artificial Sequence
  MKO10086960_B_Gbgu1
  gRNA
uacugugucacaggcugcaa

SEQ ID NO: 86961 - RNA, 20 nt, Artificial Sequence
  MKO10086961_B_Gbgu1
  gRNA
ggggagguaauaggguaugu

SEQ ID NO: 86962 - RNA, 20 nt, Artificial Sequence
  MKO10086962_B_Gbp10
  gRNA
gugauccuaagaacgacuug

SEQ ID NO: 86963 - RNA, 20 nt, Artificial Sequence
  MKO10086963_B_Gbp10
  gRNA
aaggauacugcagcugcucc

SEQ ID NO: 86964 - RNA, 20 nt, Artificial Sequence
  MKO10086964_B_Gbp10
  gRNA
aagucuuccccaaauccugc

SEQ ID NO: 86965 - RNA, 20 nt, Artificial Sequence
  MKO10086965_B_Gbp11
  gRNA
acacugaagcugaaguuaaa

SEQ ID NO: 86966 - RNA, 20 nt, Artificial Sequence
  MKO10086966_B_Gbp11
  gRNA
aaggauacugcagcuucucc

SEQ ID NO: 86967 - RNA, 20 nt, Artificial Sequence
  MKO10086967_B_Gbp11
  gRNA
cuucccuucaggcuucccuc

SEQ ID NO: 86968 - RNA, 20 nt, Artificial Sequence
  MKO10086968_B_Gbp2b
  gRNA
uguucuggcuucucgggaug

SEQ ID NO: 86969 - RNA, 20 nt, Artificial Sequence
  MKO10086969_B_Gbp2b
  gRNA
gagggauuucucccuggauc

SEQ ID NO: 86970 - RNA, 20 nt, Artificial Sequence
  MKO10086970_B_Gbp2b
  gRNA
cgagaagccagaacauaccc

SEQ ID NO: 86971 - RNA, 20 nt, Artificial Sequence
  MKO10086971_B_Gbp2
  gRNA
augagccgcgacugugcauc

SEQ ID NO: 86972 - RNA, 20 nt, Artificial Sequence
  MKO10086972_B_Gbp2
  gRNA
gugugugccucaccccaaga

SEQ ID NO: 86973 - RNA, 20 nt, Artificial Sequence
  MKO10086973_B_Gbp2
  gRNA
gugacaaccagaaugacugc

SEQ ID NO: 86974 - RNA, 20 nt, Artificial Sequence
  MKO10086974_B_Gbp3
  gRNA
cacagugcaauccgaaacca

SEQ ID NO: 86975 - RNA, 20 nt, Artificial Sequence
  MKO10086975_B_Gbp3
  gRNA
cuucaguguccaaaaggacc

SEQ ID NO: 86976 - RNA, 20 nt, Artificial Sequence
  MKO10086976_B_Gbp3
  gRNA
cgaacagcccagauaaaguc

SEQ ID NO: 86977 - RNA, 20 nt, Artificial Sequence
  MKO10086977_B_Gbp4
  gRNA
guccaggaggaccagugcuc

SEQ ID NO: 86978 - RNA, 20 nt, Artificial Sequence
  MKO10086978_B_Gbp4
  gRNA
caccaucaaccaccaagccc

SEQ ID NO: 86979 - RNA, 20 nt, Artificial Sequence
  MKO10086979_B_Gbp4
  gRNA
guucaugcuguuguagacga

SEQ ID NO: 86980 - RNA, 20 nt, Artificial Sequence
  MKO10086980_B_Gbp5
  gRNA
cagauauucaucugauguga

SEQ ID NO: 86981 - RNA, 20 nt, Artificial Sequence
  MKO10086981_B_Gbp5
  gRNA
caucacaucagaugaauauc

SEQ ID NO: 86982 - RNA, 20 nt, Artificial Sequence
  MKO10086982_B_Gbp5
  gRNA
guucauaguguuguauacaa

SEQ ID NO: 86983 - RNA, 20 nt, Artificial Sequence
  MKO10086983_B_Gbp6
  gRNA
aaggauacugcagcugcucc

SEQ ID NO: 86984 - RNA, 20 nt, Artificial Sequence
  MKO10086984_B_Gbp6
  gRNA
aagucuuccccaaauccugc

SEQ ID NO: 86985 - RNA, 20 nt, Artificial Sequence
  MKO10086985_B_Gbp6
  gRNA
uguaccugggaucagcuuca

SEQ ID NO: 86986 - RNA, 20 nt, Artificial Sequence
  MKO10086986_B_Gbp7
  gRNA
gacaacgauucccucuuuca

SEQ ID NO: 86987 - RNA, 20 nt, Artificial Sequence
  MKO10086987_B_Gbp7
  gRNA
cgaacaguccagauaaaauc

SEQ ID NO: 86988 - RNA, 20 nt, Artificial Sequence
  MKO10086988_B_Gbp7
  gRNA
cacaguuaggucugaaacua

SEQ ID NO: 86989 - RNA, 20 nt, Artificial Sequence
  MKO10086989_B_Gbp8
  gRNA
acuguugauggcaucuacau

SEQ ID NO: 86990 - RNA, 20 nt, Artificial Sequence
  MKO10086990_B_Gbp8
  gRNA
cacuaaaccagagcacaccc

SEQ ID NO: 86991 - RNA, 20 nt, Artificial Sequence
  MKO10086991_B_Gbp8
  gRNA
ccuucccacagacacgcucc

SEQ ID NO: 86992 - RNA, 20 nt, Artificial Sequence
  MKO10086992_B_Gbp9
  gRNA
ucuuuauuccguggggauuu

SEQ ID NO: 86993 - RNA, 20 nt, Artificial Sequence
  MKO10086993_B_Gbp9
  gRNA
ugcugcucagaagcacacuu

SEQ ID NO: 86994 - RNA, 20 nt, Artificial Sequence
  MKO10086994_B_Gbp9
  gRNA
ugugcucuggcuuggugggg

SEQ ID NO: 86995 - RNA, 20 nt, Artificial Sequence
  MKO10086995_B_Gbx1
  gRNA
gcaaaccuguugacgugcac

SEQ ID NO: 86996 - RNA, 20 nt, Artificial Sequence
  MKO10086996_B_Gbx1
  gRNA
gggcccguaguaggcguccg

SEQ ID NO: 86997 - RNA, 20 nt, Artificial Sequence
  MKO10086997_B_Gbx1
  gRNA
caccgccucgcgaagcaacc

SEQ ID NO: 86998 - RNA, 20 nt, Artificial Sequence
  MKO10086998_B_Gbx2
  gRNA
gcgaaccugcuaacgugaac

SEQ ID NO: 86999 - RNA, 20 nt, Artificial Sequence
  MKO10086999_B_Gbx2
  gRNA
cuccaagcggaugcggaaga

SEQ ID NO: 87000 - RNA, 20 nt, Artificial Sequence
  MKO10087000_B_Gbx2
  gRNA
cggcaacuucgacaaagccg

SEQ ID NO: 87001 - RNA, 20 nt, Artificial Sequence
  MKO10087001_B_Gcau
  gRNA
caccucaaauaggccagcgu

SEQ ID NO: 87002 - RNA, 20 nt, Artificial Sequence
  MKO10087002_B_Gcau
  gRNA
agcuguuucgaugccaacgc

SEQ ID NO: 87003 - RNA, 20 nt, Artificial Sequence
  MKO10087003_B_Gcau
  gRNA
aguucuacucgauuuaucug

SEQ ID NO: 87004 - RNA, 20 nt, Artificial Sequence
  MKO10087004_B_Gca
  gRNA
gcaggucccaauauguucuc

SEQ ID NO: 87005 - RNA, 20 nt, Artificial Sequence
  MKO10087005_B_Gca
  gRNA
aaguuccacuaauuccagac

SEQ ID NO: 87006 - RNA, 20 nt, Artificial Sequence
  MKO10087006_B_Gca
  gRNA
cauggcaaucauaauucugc

SEQ ID NO: 87007 - RNA, 20 nt, Artificial Sequence
  MKO10087007_B_Gcc1
  gRNA
auucgucgccauggauguca

SEQ ID NO: 87008 - RNA, 20 nt, Artificial Sequence
  MKO10087008_B_Gcc1
  gRNA
agaggccuacauccgccucg

SEQ ID NO: 87009 - RNA, 20 nt, Artificial Sequence
  MKO10087009_B_Gcc1
  gRNA
gcuggagcaacuacguucug

SEQ ID NO: 87010 - RNA, 20 nt, Artificial Sequence
  MKO10087010_B_Gcc2
  gRNA
cccggagggugcugcagcua

SEQ ID NO: 87011 - RNA, 20 nt, Artificial Sequence
  MKO10087011_B_Gcc2
  gRNA
ucaucaguuccuccaucaac

SEQ ID NO: 87012 - RNA, 20 nt, Artificial Sequence
  MKO10087012_B_Gcc2
  gRNA
cucaaaucaaaaccuguuga

SEQ ID NO: 87013 - RNA, 20 nt, Artificial Sequence
  MKO10087013_B_Gcdh
  gRNA
guguugggacccaccauuaa

SEQ ID NO: 87014 - RNA, 20 nt, Artificial Sequence
  MKO10087014_B_Gcdh
  gRNA
ucgcuguuccucgcucccau

SEQ ID NO: 87015 - RNA, 20 nt, Artificial Sequence
  MKO10087015_B_Gcdh
  gRNA
augcaccccaucuauaccua

SEQ ID NO: 87016 - RNA, 20 nt, Artificial Sequence
  MKO10087016_B_Gcfc2
  gRNA
gaaagagacguuucacccau

SEQ ID NO: 87017 - RNA, 20 nt, Artificial Sequence
  MKO10087017_B_Gcfc2
  gRNA
uggaaguaucaaacuucuuc

SEQ ID NO: 87018 - RNA, 20 nt, Artificial Sequence
  MKO10087018_B_Gcfc2
  gRNA
uuuaauagcaaucaggagug

SEQ ID NO: 87019 - RNA, 20 nt, Artificial Sequence
  MKO10087019_B_Gcgr
  gRNA
caacgccucccaaugucagu

SEQ ID NO: 87020 - RNA, 20 nt, Artificial Sequence
  MKO10087020_B_Gcgr
  gRNA
gcgcaaggagcaaggccccc

SEQ ID NO: 87021 - RNA, 20 nt, Artificial Sequence
  MKO10087021_B_Gcgr
  gRNA
ccacgguguacaucaccugc

SEQ ID NO: 87022 - RNA, 20 nt, Artificial Sequence
  MKO10087022_B_Gcg
  gRNA
gugccugcggccgaguuccu

SEQ ID NO: 87023 - RNA, 20 nt, Artificial Sequence
  MKO10087023_B_Gcg
  gRNA
cagugaugugaguucuuacu

SEQ ID NO: 87024 - RNA, 20 nt, Artificial Sequence
  MKO10087024_B_Gcg
  gRNA
cucaaauucaucaugacguu

SEQ ID NO: 87025 - RNA, 20 nt, Artificial Sequence
  MKO10087025_B_Gch1
  gRNA
uguuaggaagauagccaaua

SEQ ID NO: 87026 - RNA, 20 nt, Artificial Sequence
  MKO10087026_B_Gch1
  gRNA
caucaccuuguuccauuugu

SEQ ID NO: 87027 - RNA, 20 nt, Artificial Sequence
  MKO10087027_B_Gch1
  gRNA
uggcaaguuuacugagacca

SEQ ID NO: 87028 - RNA, 20 nt, Artificial Sequence
  MKO10087028_B_Gchfr
  gRNA
gcaggaggugggccccacca

SEQ ID NO: 87029 - RNA, 20 nt, Artificial Sequence
  MKO10087029_B_Gchfr
  gRNA
uuccgagugcugagcaugac

SEQ ID NO: 87030 - RNA, 20 nt, Artificial Sequence
  MKO10087030_B_Gchfr
  gRNA
cugagugcugaugagcagau

SEQ ID NO: 87031 - RNA, 20 nt, Artificial Sequence
  MKO10087031_B_Gckr
  gRNA
accugucacccccugcaaug

SEQ ID NO: 87032 - RNA, 20 nt, Artificial Sequence
  MKO10087032_B_Gckr
  gRNA
aaggaaugccauacgaccag

SEQ ID NO: 87033 - RNA, 20 nt, Artificial Sequence
  MKO10087033_B_Gckr
  gRNA
cuugccagccacuugcaaca

SEQ ID NO: 87034 - RNA, 20 nt, Artificial Sequence
  MKO10087034_B_Gck
  gRNA
ggugggcaacaucuuuacac

SEQ ID NO: 87035 - RNA, 20 nt, Artificial Sequence
  MKO10087035_B_Gck
  gRNA
agcccuugguccaguugagc

SEQ ID NO: 87036 - RNA, 20 nt, Artificial Sequence
  MKO10087036_B_Gck
  gRNA
uacagggcauccugcucaac

SEQ ID NO: 87037 - RNA, 20 nt, Artificial Sequence
  MKO10087037_B_Gclc
  gRNA
auaaacaagcacccccgcuu

SEQ ID NO: 87038 - RNA, 20 nt, Artificial Sequence
  MKO10087038_B_Gclc
  gRNA
cgccuccauucaguaacaac

SEQ ID NO: 87039 - RNA, 20 nt, Artificial Sequence
  MKO10087039_B_Gclc
  gRNA
cgauguucuugagacucugc

SEQ ID NO: 87040 - RNA, 20 nt, Artificial Sequence
  MKO10087040_B_Gclm
  gRNA
agauuaacuccaucuucaau

SEQ ID NO: 87041 - RNA, 20 nt, Artificial Sequence
  MKO10087041_B_Gclm
  gRNA
ccuucagcaugcuccguccu

SEQ ID NO: 87042 - RNA, 20 nt, Artificial Sequence
  MKO10087042_B_Gclm
  gRNA
augcaccaugucccaugcag

SEQ ID NO: 87043 - RNA, 20 nt, Artificial Sequence
  MKO10087043_B_Gcm1
  gRNA
agaacgugaaaacgacugac

SEQ ID NO: 87044 - RNA, 20 nt, Artificial Sequence
  MKO10087044_B_Gcm1
  gRNA
cugaagcuuauucccugccg

SEQ ID NO: 87045 - RNA, 20 nt, Artificial Sequence
  MKO10087045_B_Gcm1
  gRNA
ugucacagauggcgggucuc

SEQ ID NO: 87046 - RNA, 20 nt, Artificial Sequence
  MKO10087046_B_Gcm2
  gRNA
ugcacgcgcuugcgcccuga

SEQ ID NO: 87047 - RNA, 20 nt, Artificial Sequence
  MKO10087047_B_Gcm2
  gRNA
ggggugaucaugaacuccuu

SEQ ID NO: 87048 - RNA, 20 nt, Artificial Sequence
  MKO10087048_B_Gcm2
  gRNA
aagaagccaucugucucuug

SEQ ID NO: 87049 - RNA, 20 nt, Artificial Sequence
  MKO10087049_B_Gcn1l1
  gRNA
ggggaaagacaauucgcacu

SEQ ID NO: 87050 - RNA, 20 nt, Artificial Sequence
  MKO10087050_B_Gcn1l1
  gRNA
ccaagcggcaaggagacauc

SEQ ID NO: 87051 - RNA, 20 nt, Artificial Sequence
  MKO10087051_B_Gcn1l1
  gRNA
agguucuuggcgguggccuc

SEQ ID NO: 87052 - RNA, 20 nt, Artificial Sequence
  MKO10087052_B_Gcnt1
  gRNA
gccccuuauccaccgugcag

SEQ ID NO: 87053 - RNA, 20 nt, Artificial Sequence
  MKO10087053_B_Gcnt1
  gRNA
gugcgcucugugugcgucuu

SEQ ID NO: 87054 - RNA, 20 nt, Artificial Sequence
  MKO10087054_B_Gcnt1
  gRNA
gcccugcaccgcggcuaaaa

SEQ ID NO: 87055 - RNA, 20 nt, Artificial Sequence
  MKO10087055_B_Gcnt2
  gRNA
uuacccguccaggaugcguu

SEQ ID NO: 87056 - RNA, 20 nt, Artificial Sequence
  MKO10087056_B_Gcnt2
  gRNA
augaccaugacauacgccaa

SEQ ID NO: 87057 - RNA, 20 nt, Artificial Sequence
  MKO10087057_B_Gcnt2
  gRNA
agaucgccauacagccgagc

SEQ ID NO: 87058 - RNA, 20 nt, Artificial Sequence
  MKO10087058_B_Gcnt3
  gRNA
gaagugugacuucgaugcca

SEQ ID NO: 87059 - RNA, 20 nt, Artificial Sequence
  MKO10087059_B_Gcnt3
  gRNA
uuacccacucgaucaguugc

SEQ ID NO: 87060 - RNA, 20 nt, Artificial Sequence
  MKO10087060_B_Gcnt3
  gRNA
gcaccuuacacgucuugcuc

SEQ ID NO: 87061 - RNA, 20 nt, Artificial Sequence
  MKO10087061_B_Gcnt4
  gRNA
gaaccucuccgucuuagcac

SEQ ID NO: 87062 - RNA, 20 nt, Artificial Sequence
  MKO10087062_B_Gcnt4
  gRNA
guggcccaaaagugcucguc

SEQ ID NO: 87063 - RNA, 20 nt, Artificial Sequence
  MKO10087063_B_Gcnt4
  gRNA
cgagcaguuaacguuguccc

SEQ ID NO: 87064 - RNA, 20 nt, Artificial Sequence
  MKO10087064_B_Gcnt7
  gRNA
uacucccaccagcgggucug

SEQ ID NO: 87065 - RNA, 20 nt, Artificial Sequence
  MKO10087065_B_Gcnt7
  gRNA
gcccuccucagacccgcugg

SEQ ID NO: 87066 - RNA, 20 nt, Artificial Sequence
  MKO10087066_B_Gcnt7
  gRNA
ccaggugccacaccagaugc

SEQ ID NO: 87067 - RNA, 20 nt, Artificial Sequence
  MKO10087067_B_Gcsam
  gRNA
cuuuacuuaccaaggaaggc

SEQ ID NO: 87068 - RNA, 20 nt, Artificial Sequence
  MKO10087068_B_Gcsam
  gRNA
uugcuuuggagacucuuguc

SEQ ID NO: 87069 - RNA, 20 nt, Artificial Sequence
  MKO10087069_B_Gcsam
  gRNA
aucucucucagauacuucag

SEQ ID NO: 87070 - RNA, 20 nt, Artificial Sequence
  MKO10087070_B_Gcsh
  gRNA
aucaauucauccaucucuga

SEQ ID NO: 87071 - RNA, 20 nt, Artificial Sequence
  MKO10087071_B_Gcsh
  gRNA
aauucacagagaaacaugag

SEQ ID NO: 87072 - RNA, 20 nt, Artificial Sequence
  MKO10087072_B_Gcsh
  gRNA
auaacgacagaggaagguau

SEQ ID NO: 87073 - RNA, 20 nt, Artificial Sequence
  MKO10087073_B_Gc
  gRNA
accccaccugcuacgacacc

SEQ ID NO: 87074 - RNA, 20 nt, Artificial Sequence
  MKO10087074_B_Gc
  gRNA
acguaggugggaaauuccug

SEQ ID NO: 87075 - RNA, 20 nt, Artificial Sequence
  MKO10087075_B_Gc
  gRNA
ugcccucagucaccagccgc

SEQ ID NO: 87076 - RNA, 20 nt, Artificial Sequence
  MKO10087076_B_Gdap1l1
  gRNA
ugcagcacucgggcguguug

SEQ ID NO: 87077 - RNA, 20 nt, Artificial Sequence
  MKO10087077_B_Gdap1l1
  gRNA
cugcccguaggccaagaucc

SEQ ID NO: 87078 - RNA, 20 nt, Artificial Sequence
  MKO10087078_B_Gdap1l1
  gRNA
agcucacgucaucgugcucc

SEQ ID NO: 87079 - RNA, 20 nt, Artificial Sequence
  MKO10087079_B_Gdap1
  gRNA
uccccgcuuaugcaaccaca

SEQ ID NO: 87080 - RNA, 20 nt, Artificial Sequence
  MKO10087080_B_Gdap1
  gRNA
auguaugccucuuguaaguc

SEQ ID NO: 87081 - RNA, 20 nt, Artificial Sequence
  MKO10087081_B_Gdap1
  gRNA
gaagaaaauucuugaugagu

SEQ ID NO: 87082 - RNA, 20 nt, Artificial Sequence
  MKO10087082_B_Gdap2
  gRNA
cuucuuuagguacugugagg

SEQ ID NO: 87083 - RNA, 20 nt, Artificial Sequence
  MKO10087083_B_Gdap2
  gRNA
auguguguugcaucuucuag

SEQ ID NO: 87084 - RNA, 20 nt, Artificial Sequence
  MKO10087084_B_Gdap2
  gRNA
aucugugaggcuuucauugc

SEQ ID NO: 87085 - RNA, 20 nt, Artificial Sequence
  MKO10087085_B_Gda
  gRNA
accaccacggcuugcuacuu

SEQ ID NO: 87086 - RNA, 20 nt, Artificial Sequence
  MKO10087086_B_Gda
  gRNA
uguuccaaaguagcaagccg

SEQ ID NO: 87087 - RNA, 20 nt, Artificial Sequence
  MKO10087087_B_Gda
  gRNA
gaccaccgaggagucaguca

SEQ ID NO: 87088 - RNA, 20 nt, Artificial Sequence
  MKO10087088_B_Gde1
  gRNA
guguuaucgugcaucaagac

SEQ ID NO: 87089 - RNA, 20 nt, Artificial Sequence
  MKO10087089_B_Gde1
  gRNA
gaaacgaguucccugaugaa

SEQ ID NO: 87090 - RNA, 20 nt, Artificial Sequence
  MKO10087090_B_Gde1
  gRNA
acagcuguacaauaacagua

SEQ ID NO: 87091 - RNA, 20 nt, Artificial Sequence
  MKO10087091_B_Gdf10
  gRNA
uaugagaaguacaaccgaag

SEQ ID NO: 87092 - RNA, 20 nt, Artificial Sequence
  MKO10087092_B_Gdf10
  gRNA
ccguagagaccugugccugu

SEQ ID NO: 87093 - RNA, 20 nt, Artificial Sequence
  MKO10087093_B_Gdf10
  gRNA
ccacagcucugacgaugcuc

SEQ ID NO: 87094 - RNA, 20 nt, Artificial Sequence
  MKO10087094_B_Gdf11
  gRNA
cugccgauauccucucacag

SEQ ID NO: 87095 - RNA, 20 nt, Artificial Sequence
  MKO10087095_B_Gdf11
  gRNA
guuucagucguaagaucugc

SEQ ID NO: 87096 - RNA, 20 nt, Artificial Sequence
  MKO10087096_B_Gdf11
  gRNA
guagcucaaucuuuagugaa

SEQ ID NO: 87097 - RNA, 20 nt, Artificial Sequence
  MKO10087097_B_Gdf15
  gRNA
cgucaggcgcaggcguaaug

SEQ ID NO: 87098 - RNA, 20 nt, Artificial Sequence
  MKO10087098_B_Gdf15
  gRNA
gacccugacucagcgacgcc

SEQ ID NO: 87099 - RNA, 20 nt, Artificial Sequence
  MKO10087099_B_Gdf15
  gRNA
gaucugcgcaugcguguucg

SEQ ID NO: 87100 - RNA, 20 nt, Artificial Sequence
  MKO10087100_B_Gdf1
  gRNA
cgcgggggccagggucgucg

SEQ ID NO: 87101 - RNA, 20 nt, Artificial Sequence
  MKO10087101_B_Gdf1
  gRNA
gcgcacuacccgaaacgcug

SEQ ID NO: 87102 - RNA, 20 nt, Artificial Sequence
  MKO10087102_B_Gdf1
  gRNA
cacgcgcgcgcuuagaguug

SEQ ID NO: 87103 - RNA, 20 nt, Artificial Sequence
  MKO10087103_B_Gdf2
  gRNA
ggugucacgucaucagccaa

SEQ ID NO: 87104 - RNA, 20 nt, Artificial Sequence
  MKO10087104_B_Gdf2
  gRNA
uguacaagucgaucauguac

SEQ ID NO: 87105 - RNA, 20 nt, Artificial Sequence
  MKO10087105_B_Gdf2
  gRNA
ugaacuuugaggacaucggc

SEQ ID NO: 87106 - RNA, 20 nt, Artificial Sequence
  MKO10087106_B_Gdf3
  gRNA
aauccuuaagcgcacccugc

SEQ ID NO: 87107 - RNA, 20 nt, Artificial Sequence
  MKO10087107_B_Gdf3
  gRNA
agcgccagaagccguugaua

SEQ ID NO: 87108 - RNA, 20 nt, Artificial Sequence
  MKO10087108_B_Gdf3
  gRNA
cgaccaugcagccuuaucaa

SEQ ID NO: 87109 - RNA, 20 nt, Artificial Sequence
  MKO10087109_B_Gdf5
  gRNA
uugggcucucgagggguccc

SEQ ID NO: 87110 - RNA, 20 nt, Artificial Sequence
  MKO10087110_B_Gdf5
  gRNA
cuuugaacgcacugcccgac

SEQ ID NO: 87111 - RNA, 20 nt, Artificial Sequence
  MKO10087111_B_Gdf5
  gRNA
gcugggagguguucgacauc

SEQ ID NO: 87112 - RNA, 20 nt, Artificial Sequence
  MKO10087112_B_Gdf6
  gRNA
gccggacgcccccggagcac

SEQ ID NO: 87113 - RNA, 20 nt, Artificial Sequence
  MKO10087113_B_Gdf6
  gRNA
cgcgcgcgcccccguauccc

SEQ ID NO: 87114 - RNA, 20 nt, Artificial Sequence
  MKO10087114_B_Gdf6
  gRNA
ggauacgggggcgcgcgcga

SEQ ID NO: 87115 - RNA, 20 nt, Artificial Sequence
  MKO10087115_B_Gdf7
  gRNA
agcugccgcggugcuccgag

SEQ ID NO: 87116 - RNA, 20 nt, Artificial Sequence
  MKO10087116_B_Gdf7
  gRNA
gcugcgcgcggugacggccu

SEQ ID NO: 87117 - RNA, 20 nt, Artificial Sequence
  MKO10087117_B_Gdf7
  gRNA
caucgcgccauuagacuacg

SEQ ID NO: 87118 - RNA, 20 nt, Artificial Sequence
  MKO10087118_B_Gdf9
  gRNA
agagccggacgguauuguag

SEQ ID NO: 87119 - RNA, 20 nt, Artificial Sequence
  MKO10087119_B_Gdf9
  gRNA
guccuagggcggucaggcau

SEQ ID NO: 87120 - RNA, 20 nt, Artificial Sequence
  MKO10087120_B_Gdf9
  gRNA
acuggaucguggccccgcac

SEQ ID NO: 87121 - RNA, 20 nt, Artificial Sequence
  MKO10087121_B_Gdi1
  gRNA
ccagcaugcgugaugucuac

SEQ ID NO: 87122 - RNA, 20 nt, Artificial Sequence
  MKO10087122_B_Gdi1
  gRNA
ccccggcccauugauucagg

SEQ ID NO: 87123 - RNA, 20 nt, Artificial Sequence
  MKO10087123_B_Gdi1
  gRNA
ggcccccugaaucaaugggc

SEQ ID NO: 87124 - RNA, 20 nt, Artificial Sequence
  MKO10087124_B_Gdi2
  gRNA
aggacaaccgccagcaucaa

SEQ ID NO: 87125 - RNA, 20 nt, Artificial Sequence
  MKO10087125_B_Gdi2
  gRNA
uaucuuuaccauuggccaua

SEQ ID NO: 87126 - RNA, 20 nt, Artificial Sequence
  MKO10087126_B_Gdi2
  gRNA
gaagcuuugucuacaaggga

SEQ ID NO: 87127 - RNA, 20 nt, Artificial Sequence
  MKO10087127_B_Gdnf
  gRNA
uuagccuucuacuccgagac

SEQ ID NO: 87128 - RNA, 20 nt, Artificial Sequence
  MKO10087128_B_Gdnf
  gRNA
cgcuucgagaagccucuuac

SEQ ID NO: 87129 - RNA, 20 nt, Artificial Sequence
  MKO10087129_B_Gdnf
  gRNA
ggucuccguagacccccagu

SEQ ID NO: 87130 - RNA, 20 nt, Artificial Sequence
  MKO10087130_B_Gdpd1
  gRNA
acauccagcuugcaaaggua

SEQ ID NO: 87131 - RNA, 20 nt, Artificial Sequence
  MKO10087131_B_Gdpd1
  gRNA
uacccggauccccuugcuga

SEQ ID NO: 87132 - RNA, 20 nt, Artificial Sequence
  MKO10087132_B_Gdpd1
  gRNA
ugaccccaguugaccucuuc

SEQ ID NO: 87133 - RNA, 20 nt, Artificial Sequence
  MKO10087133_B_Gdpd2
  gRNA
cuuugcagugcgacuguauc

SEQ ID NO: 87134 - RNA, 20 nt, Artificial Sequence
  MKO10087134_B_Gdpd2
  gRNA
uggugggccuggauauccaa

SEQ ID NO: 87135 - RNA, 20 nt, Artificial Sequence
  MKO10087135_B_Gdpd2
  gRNA
gcccgauguacagccauccc

SEQ ID NO: 87136 - RNA, 20 nt, Artificial Sequence
  MKO10087136_B_Gdpd3
  gRNA
ccuccaaacuaaucaugugc

SEQ ID NO: 87137 - RNA, 20 nt, Artificial Sequence
  MKO10087137_B_Gdpd3
  gRNA
uuggaaauuuacuucucacc

SEQ ID NO: 87138 - RNA, 20 nt, Artificial Sequence
  MKO10087138_B_Gdpd3
  gRNA
cacagggucuggggagcgac

SEQ ID NO: 87139 - RNA, 20 nt, Artificial Sequence
  MKO10087139_B_Gdpd4
  gRNA
acaagaugaaugcuauuacc

SEQ ID NO: 87140 - RNA, 20 nt, Artificial Sequence
  MKO10087140_B_Gdpd4
  gRNA
aaggacaaguggcugauagc

SEQ ID NO: 87141 - RNA, 20 nt, Artificial Sequence
  MKO10087141_B_Gdpd4
  gRNA
gccacuuguccuuccagaaa

SEQ ID NO: 87142 - RNA, 20 nt, Artificial Sequence
  MKO10087142_B_Gdpd5
  gRNA
agucgcuccaguagcccaug

SEQ ID NO: 87143 - RNA, 20 nt, Artificial Sequence
  MKO10087143_B_Gdpd5
  gRNA
ggcacuaugucacaucgcug

SEQ ID NO: 87144 - RNA, 20 nt, Artificial Sequence
  MKO10087144_B_Gdpd5
  gRNA
uuaccuuguguauccagugc

SEQ ID NO: 87145 - RNA, 20 nt, Artificial Sequence
  MKO10087145_B_Gdpgp1
  gRNA
aacuucaauaaaauucgacc

SEQ ID NO: 87146 - RNA, 20 nt, Artificial Sequence
  MKO10087146_B_Gdpgp1
  gRNA
cagggucggcuucaacagcc

SEQ ID NO: 87147 - RNA, 20 nt, Artificial Sequence
  MKO10087147_B_Gdpgp1
  gRNA
gccgcugccuccacgcagag

SEQ ID NO: 87148 - RNA, 20 nt, Artificial Sequence
  MKO10087148_B_Gemin2
  gRNA
acaacaguuggacaguaaug

SEQ ID NO: 87149 - RNA, 20 nt, Artificial Sequence
  MKO10087149_B_Gemin2
  gRNA
ggaugccagccugcgccuga

SEQ ID NO: 87150 - RNA, 20 nt, Artificial Sequence
  MKO10087150_B_Gemin2
  gRNA
uacacaagcauagaaaucac

SEQ ID NO: 87151 - RNA, 20 nt, Artificial Sequence
  MKO10087151_B_Gemin4
  gRNA
acacgguggccgacaccucc

SEQ ID NO: 87152 - RNA, 20 nt, Artificial Sequence
  MKO10087152_B_Gemin4
  gRNA
agacgaguggguugccugcc

SEQ ID NO: 87153 - RNA, 20 nt, Artificial Sequence
  MKO10087153_B_Gemin4
  gRNA
cuucagcccguuaagcaaca

SEQ ID NO: 87154 - RNA, 20 nt, Artificial Sequence
  MKO10087154_B_Gemin5
  gRNA
acgagauccacuccauagcc

SEQ ID NO: 87155 - RNA, 20 nt, Artificial Sequence
  MKO10087155_B_Gemin5
  gRNA
guuaaggacuuaauagucuc

SEQ ID NO: 87156 - RNA, 20 nt, Artificial Sequence
  MKO10087156_B_Gemin5
  gRNA
ugugccaccagcucagacga

SEQ ID NO: 87157 - RNA, 20 nt, Artificial Sequence
  MKO10087157_B_Gemin6
  gRNA
uuucuucauccauucgcuca

SEQ ID NO: 87158 - RNA, 20 nt, Artificial Sequence
  MKO10087158_B_Gemin6
  gRNA
ccacauuccugucaccgagc

SEQ ID NO: 87159 - RNA, 20 nt, Artificial Sequence
  MKO10087159_B_Gemin6
  gRNA
cauacucacuuggcagagac

SEQ ID NO: 87160 - RNA, 20 nt, Artificial Sequence
  MKO10087160_B_Gemin7
  gRNA
agcgcucucgcagaguggcu

SEQ ID NO: 87161 - RNA, 20 nt, Artificial Sequence
  MKO10087161_B_Gemin7
  gRNA
gaugguccuacguccaucag

SEQ ID NO: 87162 - RNA, 20 nt, Artificial Sequence
  MKO10087162_B_Gemin7
  gRNA
accggcacaggaauggucag

SEQ ID NO: 87163 - RNA, 20 nt, Artificial Sequence
  MKO10087163_B_Gemin8
  gRNA
aacccccaucugagaagccc

SEQ ID NO: 87164 - RNA, 20 nt, Artificial Sequence
  MKO10087164_B_Gemin8
  gRNA
gcguaauagcaguagaaccc

SEQ ID NO: 87165 - RNA, 20 nt, Artificial Sequence
  MKO10087165_B_Gemin8
  gRNA
acuccugcugcgccaugugc

SEQ ID NO: 87166 - RNA, 20 nt, Artificial Sequence
  MKO10087166_B_Gem
  gRNA
uacuaccgaguagugcuuau

SEQ ID NO: 87167 - RNA, 20 nt, Artificial Sequence
  MKO10087167_B_Gem
  gRNA
gaaugcucucccgccucuuc

SEQ ID NO: 87168 - RNA, 20 nt, Artificial Sequence
  MKO10087168_B_Gem
  gRNA
cacucucuccgucaacgacc

SEQ ID NO: 87169 - RNA, 20 nt, Artificial Sequence
  MKO10087169_B_Gen1
  gRNA
gauggcugccucaccaacga

SEQ ID NO: 87170 - RNA, 20 nt, Artificial Sequence
  MKO10087170_B_Gen1
  gRNA
auaucguguaacagucaaca

SEQ ID NO: 87171 - RNA, 20 nt, Artificial Sequence
  MKO10087171_B_Gen1
  gRNA
aagcugaugucauaagcaag

SEQ ID NO: 87172 - RNA, 20 nt, Artificial Sequence
  MKO10087172_B_Get4
  gRNA
gacacaaaagcuacucguuc

SEQ ID NO: 87173 - RNA, 20 nt, Artificial Sequence
  MKO10087173_B_Get4
  gRNA
cucaucagcuacguccaccu

SEQ ID NO: 87174 - RNA, 20 nt, Artificial Sequence
  MKO10087174_B_Get4
  gRNA
gccuaccuuuccauaaugug

SEQ ID NO: 87175 - RNA, 20 nt, Artificial Sequence
  MKO10087175_B_Gfap
  gRNA
caaccuggcugcguauagac

SEQ ID NO: 87176 - RNA, 20 nt, Artificial Sequence
  MKO10087176_B_Gfap
  gRNA
ucuccaaauccacacgagcc

SEQ ID NO: 87177 - RNA, 20 nt, Artificial Sequence
  MKO10087177_B_Gfap
  gRNA
ugaccugucuauacgcagcc

SEQ ID NO: 87178 - RNA, 20 nt, Artificial Sequence
  MKO10087178_B_Gfer
  gRNA
gucuuccgcacauuccucgc

SEQ ID NO: 87179 - RNA, 20 nt, Artificial Sequence
  MKO10087179_B_Gfer
  gRNA
cgucucuaugccuugcgccg

SEQ ID NO: 87180 - RNA, 20 nt, Artificial Sequence
  MKO10087180_B_Gfer
  gRNA
acucucgagcagucaaaauc

SEQ ID NO: 87181 - RNA, 20 nt, Artificial Sequence
  MKO10087181_B_Gfi1b
  gRNA
gccggguuccgcugugagag

SEQ ID NO: 87182 - RNA, 20 nt, Artificial Sequence
  MKO10087182_B_Gfi1b
  gRNA
accgcuuccaagccagaccu

SEQ ID NO: 87183 - RNA, 20 nt, Artificial Sequence
  MKO10087183_B_Gfi1b
  gRNA
gacucaccaggaauuacagc

SEQ ID NO: 87184 - RNA, 20 nt, Artificial Sequence
  MKO10087184_B_Gfi1
  gRNA
cuaucaccagccgcguucuc

SEQ ID NO: 87185 - RNA, 20 nt, Artificial Sequence
  MKO10087185_B_Gfi1
  gRNA
agucgggggacaaacgcucu

SEQ ID NO: 87186 - RNA, 20 nt, Artificial Sequence
  MKO10087186_B_Gfi1
  gRNA
gcgucccccaacagcugcga

SEQ ID NO: 87187 - RNA, 20 nt, Artificial Sequence
  MKO10087187_B_Gfm1
  gRNA
gaacgagcuauuuacuuuga

SEQ ID NO: 87188 - RNA, 20 nt, Artificial Sequence
  MKO10087188_B_Gfm1
  gRNA
cugcaccguccaggacccgc

SEQ ID NO: 87189 - RNA, 20 nt, Artificial Sequence
  MKO10087189_B_Gfm1
  gRNA
cagcagcuacguauaccaug

SEQ ID NO: 87190 - RNA, 20 nt, Artificial Sequence
  MKO10087190_B_Gfm2
  gRNA
auuauggcacauauugaugc

SEQ ID NO: 87191 - RNA, 20 nt, Artificial Sequence
  MKO10087191_B_Gfm2
  gRNA
gaacuguaguuucuuguaag

SEQ ID NO: 87192 - RNA, 20 nt, Artificial Sequence
  MKO10087192_B_Gfm2
  gRNA
aguacuuacuuggccacagg

SEQ ID NO: 87193 - RNA, 20 nt, Artificial Sequence
  MKO10087193_B_Gfod1
  gRNA
gcaggagcaccucgucgaug

SEQ ID NO: 87194 - RNA, 20 nt, Artificial Sequence
  MKO10087194_B_Gfod1
  gRNA
ggguuccgcugggcggcucc

SEQ ID NO: 87195 - RNA, 20 nt, Artificial Sequence
  MKO10087195_B_Gfod1
  gRNA
agcugcgacgaccugauggg

SEQ ID NO: 87196 - RNA, 20 nt, Artificial Sequence
  MKO10087196_B_Gfod2
  gRNA
gucccgaacacaccgacucc

SEQ ID NO: 87197 - RNA, 20 nt, Artificial Sequence
  MKO10087197_B_Gfod2
  gRNA
ccgggcaacaaggcgcccug

SEQ ID NO: 87198 - RNA, 20 nt, Artificial Sequence
  MKO10087198_B_Gfod2
  gRNA
ugcgacgcucgcaucuacuc

SEQ ID NO: 87199 - RNA, 20 nt, Artificial Sequence
  MKO10087199_B_Gfpt1
  gRNA
aagauuucucgucuuguucg

SEQ ID NO: 87200 - RNA, 20 nt, Artificial Sequence
  MKO10087200_B_Gfpt1
  gRNA
aauuuaggugugggacuuga

SEQ ID NO: 87201 - RNA, 20 nt, Artificial Sequence
  MKO10087201_B_Gfpt1
  gRNA
caaagacuugaaaaaguuuc

SEQ ID NO: 87202 - RNA, 20 nt, Artificial Sequence
  MKO10087202_B_Gfpt2
  gRNA
aauuagugaugaucccguug

SEQ ID NO: 87203 - RNA, 20 nt, Artificial Sequence
  MKO10087203_B_Gfpt2
  gRNA
cacccgcagagucauagccc

SEQ ID NO: 87204 - RNA, 20 nt, Artificial Sequence
  MKO10087204_B_Gfpt2
  gRNA
gucugcagcggcuggaguac

SEQ ID NO: 87205 - RNA, 20 nt, Artificial Sequence
  MKO10087205_B_Gfra1
  gRNA
ggaugagugccgcagcgcua

SEQ ID NO: 87206 - RNA, 20 nt, Artificial Sequence
  MKO10087206_B_Gfra1
  gRNA
agaauugucugcguaucuac

SEQ ID NO: 87207 - RNA, 20 nt, Artificial Sequence
  MKO10087207_B_Gfra1
  gRNA
cgggcagucccguucauauc

SEQ ID NO: 87208 - RNA, 20 nt, Artificial Sequence
  MKO10087208_B_Gfra2
  gRNA
caugcgguagguauacucgc

SEQ ID NO: 87209 - RNA, 20 nt, Artificial Sequence
  MKO10087209_B_Gfra2
  gRNA
cgagccugaagauguccgag

SEQ ID NO: 87210 - RNA, 20 nt, Artificial Sequence
  MKO10087210_B_Gfra2
  gRNA
cugcccugcggacaacuacc

SEQ ID NO: 87211 - RNA, 20 nt, Artificial Sequence
  MKO10087211_B_Gfra3
  gRNA
cccugagcaugccuccccgu

SEQ ID NO: 87212 - RNA, 20 nt, Artificial Sequence
  MKO10087212_B_Gfra3
  gRNA
uucuuccagaucacgccuga

SEQ ID NO: 87213 - RNA, 20 nt, Artificial Sequence
  MKO10087213_B_Gfra3
  gRNA
gguccaauaaauguccagac

SEQ ID NO: 87214 - RNA, 20 nt, Artificial Sequence
  MKO10087214_B_Gfra4
  gRNA
cugcgccgcuucuucgcgcg

SEQ ID NO: 87215 - RNA, 20 nt, Artificial Sequence
  MKO10087215_B_Gfra4
  gRNA
cgcgcgcgcucacguugucc

SEQ ID NO: 87216 - RNA, 20 nt, Artificial Sequence
  MKO10087216_B_Gfra4
  gRNA
aggcuucgcauucuucgcgc

SEQ ID NO: 87217 - RNA, 20 nt, Artificial Sequence
  MKO10087217_B_Gfral
  gRNA
acaaauauuaccugucuuau

SEQ ID NO: 87218 - RNA, 20 nt, Artificial Sequence
  MKO10087218_B_Gfral
  gRNA
augauauuaccaugauagaa

SEQ ID NO: 87219 - RNA, 20 nt, Artificial Sequence
  MKO10087219_B_Gfral
  gRNA
aaugugcacaaucauuuguu

SEQ ID NO: 87220 - RNA, 20 nt, Artificial Sequence
  MKO10087220_B_Gfy
  gRNA
gccccaccgacggagccucg

SEQ ID NO: 87221 - RNA, 20 nt, Artificial Sequence
  MKO10087221_B_Gfy
  gRNA
cacagucaacacuaucaucg

SEQ ID NO: 87222 - RNA, 20 nt, Artificial Sequence
  MKO10087222_B_Gfy
  gRNA
guggcaacucgggugacugc

SEQ ID NO: 87223 - RNA, 20 nt, Artificial Sequence
  MKO10087223_B_Gga1
  gRNA
agccacaaauccccugaaca

SEQ ID NO: 87224 - RNA, 20 nt, Artificial Sequence
  MKO10087224_B_Gga1
  gRNA
cuugugggccagcaagcgag

SEQ ID NO: 87225 - RNA, 20 nt, Artificial Sequence
  MKO10087225_B_Gga1
  gRNA
ucuucaccuucucagauguc

SEQ ID NO: 87226 - RNA, 20 nt, Artificial Sequence
  MKO10087226_B_Gga2
  gRNA
gaugucuuccggaaaccaga

SEQ ID NO: 87227 - RNA, 20 nt, Artificial Sequence
  MKO10087227_B_Gga2
  gRNA
gcuuacuuacccacuggggu

SEQ ID NO: 87228 - RNA, 20 nt, Artificial Sequence
  MKO10087228_B_Gga2
  gRNA
gaucaaaguauuguccccaa

SEQ ID NO: 87229 - RNA, 20 nt, Artificial Sequence
  MKO10087229_B_Gga3
  gRNA
gaggcguguaugaagaacug

SEQ ID NO: 87230 - RNA, 20 nt, Artificial Sequence
  MKO10087230_B_Gga3
  gRNA
ccagauugcugugcgacucc

SEQ ID NO: 87231 - RNA, 20 nt, Artificial Sequence
  MKO10087231_B_Gga3
  gRNA
ccaggagucgcacagcaauc

SEQ ID NO: 87232 - RNA, 20 nt, Artificial Sequence
  MKO10087232_B_Ggacu
  gRNA
caggcgagcacaacauaccu

SEQ ID NO: 87233 - RNA, 20 nt, Artificial Sequence
  MKO10087233_B_Ggacu
  gRNA
gggugccauacacgaagaug

SEQ ID NO: 87234 - RNA, 20 nt, Artificial Sequence
  MKO10087234_B_Ggacu
  gRNA
auggcccacaucuucgugua

SEQ ID NO: 87235 - RNA, 20 nt, Artificial Sequence
  MKO10087235_B_Ggcu
  gRNA
auuaaaguuucaacucgaga

SEQ ID NO: 87236 - RNA, 20 nt, Artificial Sequence
  MKO10087236_B_Ggcu
  gRNA
acuccccacacuucgucgcc

SEQ ID NO: 87237 - RNA, 20 nt, Artificial Sequence
  MKO10087237_B_Ggcu
  gRNA
caaaagcaauauaaguuccc

SEQ ID NO: 87238 - RNA, 20 nt, Artificial Sequence
  MKO10087238_B_Ggcx
  gRNA
ccgaaaauacuuggaugggc

SEQ ID NO: 87239 - RNA, 20 nt, Artificial Sequence
  MKO10087239_B_Ggcx
  gRNA
agaaugcucacgugccccuu

SEQ ID NO: 87240 - RNA, 20 nt, Artificial Sequence
  MKO10087240_B_Ggcx
  gRNA
acugaaacagggcagccgaa

SEQ ID NO: 87241 - RNA, 20 nt, Artificial Sequence
  MKO10087241_B_Ggh
  gRNA
ggugcuaaccuaacagauuc

SEQ ID NO: 87242 - RNA, 20 nt, Artificial Sequence
  MKO10087242_B_Ggh
  gRNA
guaguaaugcaagaauguuu

SEQ ID NO: 87243 - RNA, 20 nt, Artificial Sequence
  MKO10087243_B_Ggh
  gRNA
cucccaaagagcuuugauaa

SEQ ID NO: 87244 - RNA, 20 nt, Artificial Sequence
  MKO10087244_B_Ggnbp1
  gRNA
gcauccuuaccaaacucaau

SEQ ID NO: 87245 - RNA, 20 nt, Artificial Sequence
  MKO10087245_B_Ggnbp1
  gRNA
gcgacgagagcugucccaag

SEQ ID NO: 87246 - RNA, 20 nt, Artificial Sequence
  MKO10087246_B_Ggnbp1
  gRNA
accccguggaacuaucuccu

SEQ ID NO: 87247 - RNA, 20 nt, Artificial Sequence
  MKO10087247_B_Ggnbp2
  gRNA
ucuacuuaccccagagguuu

SEQ ID NO: 87248 - RNA, 20 nt, Artificial Sequence
  MKO10087248_B_Ggnbp2
  gRNA
uguuugggaacucauguccc

SEQ ID NO: 87249 - RNA, 20 nt, Artificial Sequence
  MKO10087249_B_Ggnbp2
  gRNA
aucuaucauaucauuuaguu

SEQ ID NO: 87250 - RNA, 20 nt, Artificial Sequence
  MKO10087250_B_Ggn
  gRNA
ccacccacgguggcucgcuc

SEQ ID NO: 87251 - RNA, 20 nt, Artificial Sequence
  MKO10087251_B_Ggn
  gRNA
gccaucaacgucgucaccgu

SEQ ID NO: 87252 - RNA, 20 nt, Artificial Sequence
  MKO10087252_B_Ggn
  gRNA
aaggcacuggccgccuuucg

SEQ ID NO: 87253 - RNA, 20 nt, Artificial Sequence
  MKO10087253_B_Ggps1
  gRNA
uauaccuguagcuugucuuc

SEQ ID NO: 87254 - RNA, 20 nt, Artificial Sequence
  MKO10087254_B_Ggps1
  gRNA
aaacuaaagagaaagcugag

SEQ ID NO: 87255 - RNA, 20 nt, Artificial Sequence
  MKO10087255_B_Ggps1
  gRNA
uaacugaaguaaguaccuau

SEQ ID NO: 87256 - RNA, 20 nt, Artificial Sequence
  MKO10087256_B_Ggu1
  gRNA
agcgagguguucugccgcca

SEQ ID NO: 87257 - RNA, 20 nt, Artificial Sequence
  MKO10087257_B_Ggu1
  gRNA
ugaaauccgugguuaugagc

SEQ ID NO: 87258 - RNA, 20 nt, Artificial Sequence
  MKO10087258_B_Ggu1
  gRNA
augcccgugagguagcuccc

SEQ ID NO: 87259 - RNA, 20 nt, Artificial Sequence
  MKO10087259_B_Ggu5
  gRNA
ggugcggaggucuuauacac

SEQ ID NO: 87260 - RNA, 20 nt, Artificial Sequence
  MKO10087260_B_Ggu5
  gRNA
uaagaccuccgcacccuccu

SEQ ID NO: 87261 - RNA, 20 nt, Artificial Sequence
  MKO10087261_B_Ggu5
  gRNA
ggaugccgccaucgcugccc

SEQ ID NO: 87262 - RNA, 20 nt, Artificial Sequence
  MKO10087262_B_Ggu6
  gRNA
ccuuucugcaggaacgaggu

SEQ ID NO: 87263 - RNA, 20 nt, Artificial Sequence
  MKO10087263_B_Ggu6
  gRNA
ggagacuccaaaauaccccc

SEQ ID NO: 87264 - RNA, 20 nt, Artificial Sequence
  MKO10087264_B_Ggu6
  gRNA
cugaccugccgggcugauaa

SEQ ID NO: 87265 - RNA, 20 nt, Artificial Sequence
  MKO10087265_B_Ggu7
  gRNA
ccccagugggggcgugaugu

SEQ ID NO: 87266 - RNA, 20 nt, Artificial Sequence
  MKO10087266_B_Ggu7
  gRNA
auguaacccuuucaccauuc

SEQ ID NO: 87267 - RNA, 20 nt, Artificial Sequence
  MKO10087267_B_Ggu7
  gRNA
gacggaugccuccaguugca

SEQ ID NO: 87268 - RNA, 20 nt, Artificial Sequence
  MKO10087268_B_Ggua1
  gRNA
acauggagaucuuguugaca

SEQ ID NO: 87269 - RNA, 20 nt, Artificial Sequence
  MKO10087269_B_Ggua1
  gRNA
uaucaagaagacaacguaga

SEQ ID NO: 87270 - RNA, 20 nt, Artificial Sequence
  MKO10087270_B_Ggua1
  gRNA
uucccaagcugguuuaaaaa

SEQ ID NO: 87271 - RNA, 20 nt, Artificial Sequence
  MKO10087271_B_Ghdc
  gRNA
uaccuacaaucaguguccug

SEQ ID NO: 87272 - RNA, 20 nt, Artificial Sequence
  MKO10087272_B_Ghdc
  gRNA
uauugagcugcuuccaauca

SEQ ID NO: 87273 - RNA, 20 nt, Artificial Sequence
  MKO10087273_B_Ghdc
  gRNA
ccugcaaagaggcgucucca

SEQ ID NO: 87274 - RNA, 20 nt, Artificial Sequence
  MKO10087274_B_Ghitm
  gRNA
ucuacuuacauguacuuagc

SEQ ID NO: 87275 - RNA, 20 nt, Artificial Sequence
  MKO10087275_B_Ghitm
  gRNA
gcgaccuuugcagccaugau

SEQ ID NO: 87276 - RNA, 20 nt, Artificial Sequence
  MKO10087276_B_Ghitm
  gRNA
cuggcuuggaugcugcauuc

SEQ ID NO: 87277 - RNA, 20 nt, Artificial Sequence
  MKO10087277_B_Ghrhr
  gRNA
ggggaccaacaacaccuccc

SEQ ID NO: 87278 - RNA, 20 nt, Artificial Sequence
  MKO10087278_B_Ghrhr
  gRNA
cgaugagcuugcaugucuuc

SEQ ID NO: 87279 - RNA, 20 nt, Artificial Sequence
  MKO10087279_B_Ghrhr
  gRNA
cugcugugcuggcccccgac

SEQ ID NO: 87280 - RNA, 20 nt, Artificial Sequence
  MKO10087280_B_Ghrh
  gRNA
aacccauagggagaggaucc

SEQ ID NO: 87281 - RNA, 20 nt, Artificial Sequence
  MKO10087281_B_Ghrh
  gRNA
ccaucuucaccaccaacuac

SEQ ID NO: 87282 - RNA, 20 nt, Artificial Sequence
  MKO10087282_B_Ghrh
  gRNA
gugauccucauccucaccag

SEQ ID NO: 87283 - RNA, 20 nt, Artificial Sequence
  MKO10087283_B_Ghrl
  gRNA
guccgugguuacuugucagc

SEQ ID NO: 87284 - RNA, 20 nt, Artificial Sequence
  MKO10087284_B_Ghrl
  gRNA
caguuuagcugguggcuucu

SEQ ID NO: 87285 - RNA, 20 nt, Artificial Sequence
  MKO10087285_B_Ghrl
  gRNA
acugacugaccugggcuuuc

SEQ ID NO: 87286 - RNA, 20 nt, Artificial Sequence
  MKO10087286_B_Ghr
  gRNA
ucagcuacaccagcuacucu

SEQ ID NO: 87287 - RNA, 20 nt, Artificial Sequence
  MKO10087287_B_Ghr
  gRNA
gcaaagaaucaauccaagcc

SEQ ID NO: 87288 - RNA, 20 nt, Artificial Sequence
  MKO10087288_B_Ghr
  gRNA
aaagccaacgacaagcugca

SEQ ID NO: 87289 - RNA, 20 nt, Artificial Sequence
  MKO10087289_B_Ghsr
  gRNA
auugaugcucgacuuugucc

SEQ ID NO: 87290 - RNA, 20 nt, Artificial Sequence
  MKO10087290_B_Ghsr
  gRNA
cgcggcacucguuggugucc

SEQ ID NO: 87291 - RNA, 20 nt, Artificial Sequence
  MKO10087291_B_Ghsr
  gRNA
guagcgcucgacgcucagcg

SEQ ID NO: 87292 - RNA, 20 nt, Artificial Sequence
  MKO10087292_B_Gh
  gRNA
cucuagacucucggaccucc

SEQ ID NO: 87293 - RNA, 20 nt, Artificial Sequence
  MKO10087293_B_Gh
  gRNA
ggugccgaacaucaggcugu

SEQ ID NO: 87294 - RNA, 20 nt, Artificial Sequence
  MKO10087294_B_Gh
  gRNA
ggaacuuacgaacucuuugu

SEQ ID NO: 87295 - RNA, 20 nt, Artificial Sequence
  MKO10087295_B_Gid4
  gRNA
uguggguaccuaaagauuaa

SEQ ID NO: 87296 - RNA, 20 nt, Artificial Sequence
  MKO10087296_B_Gid4
  gRNA
ucuuuacagcacguggacac

SEQ ID NO: 87297 - RNA, 20 nt, Artificial Sequence
  MKO10087297_B_Gid4
  gRNA
acccuuacaaccuucuuuga

SEQ ID NO: 87298 - RNA, 20 nt, Artificial Sequence
  MKO10087298_B_Gid8
  gRNA
ucuccaaaaggcgacuccuc

SEQ ID NO: 87299 - RNA, 20 nt, Artificial Sequence
  MKO10087299_B_Gid8
  gRNA
gucugggaucgaaccaagug

SEQ ID NO: 87300 - RNA, 20 nt, Artificial Sequence
  MKO10087300_B_Gid8
  gRNA
ccugcucugccaguuguguc

SEQ ID NO: 87301 - RNA, 20 nt, Artificial Sequence
  MKO10087301_B_Gif
  gRNA
gcagcuugcccucaccguua

SEQ ID NO: 87302 - RNA, 20 nt, Artificial Sequence
  MKO10087302_B_Gif
  gRNA
acgugagagccauaacggug

SEQ ID NO: 87303 - RNA, 20 nt, Artificial Sequence
  MKO10087303_B_Gif
  gRNA
cgauggccuacaagcgcuca

SEQ ID NO: 87304 - RNA, 20 nt, Artificial Sequence
  MKO10087304_B_Gigyf1
  gRNA
ucuucuucagggcgaggccg

SEQ ID NO: 87305 - RNA, 20 nt, Artificial Sequence
  MKO10087305_B_Gigyf1
  gRNA
aggggcagcacucggagccg

SEQ ID NO: 87306 - RNA, 20 nt, Artificial Sequence
  MKO10087306_B_Gigyf1
  gRNA
ucagagaaacuucucgcugu

SEQ ID NO: 87307 - RNA, 20 nt, Artificial Sequence
  MKO10087307_B_Gigyf2
  gRNA
agaauuccugccuauccuac

SEQ ID NO: 87308 - RNA, 20 nt, Artificial Sequence
  MKO10087308_B_Gigyf2
  gRNA
uacuagagccaaugguggca

SEQ ID NO: 87309 - RNA, 20 nt, Artificial Sequence
  MKO10087309_B_Gigyf2
  gRNA
gaaacacagacacuaaacuu

SEQ ID NO: 87310 - RNA, 20 nt, Artificial Sequence
  MKO10087310_B_Gimap1
  gRNA
uucuaagaagcaugggagga

SEQ ID NO: 87311 - RNA, 20 nt, Artificial Sequence
  MKO10087311_B_Gimap1
  gRNA
gggcgcgcacuacuccaaug

SEQ ID NO: 87312 - RNA, 20 nt, Artificial Sequence
  MKO10087312_B_Gimap1
  gRNA
gcccucaacaaccgcgccac

SEQ ID NO: 87313 - RNA, 20 nt, Artificial Sequence
  MKO10087313_B_Gimap3
  gRNA
acucccacaggcggaaagaa

SEQ ID NO: 87314 - RNA, 20 nt, Artificial Sequence
  MKO10087314_B_Gimap3
  gRNA
gccgagacacuccuuagaga

SEQ ID NO: 87315 - RNA, 20 nt, Artificial Sequence
  MKO10087315_B_Gimap3
  gRNA
gaaaacgaagaagauuaaua

SEQ ID NO: 87316 - RNA, 20 nt, Artificial Sequence
  MKO10087316_B_Gimap4
  gRNA
gaagaugcaauuguugaccu

SEQ ID NO: 87317 - RNA, 20 nt, Artificial Sequence
  MKO10087317_B_Gimap4
  gRNA
caaguaagacaauucucagu

SEQ ID NO: 87318 - RNA, 20 nt, Artificial Sequence
  MKO10087318_B_Gimap4
  gRNA
caacugagaauugucuuacu

SEQ ID NO: 87319 - RNA, 20 nt, Artificial Sequence
  MKO10087319_B_Gimap5
  gRNA
caccuucagaagagcacaua

SEQ ID NO: 87320 - RNA, 20 nt, Artificial Sequence
  MKO10087320_B_Gimap5
  gRNA
ugugcucuucuuauugugcu

SEQ ID NO: 87321 - RNA, 20 nt, Artificial Sequence
  MKO10087321_B_Gimap5
  gRNA
uacaagaaucuagcugccug

SEQ ID NO: 87322 - RNA, 20 nt, Artificial Sequence
  MKO10087322_B_Gimap6
  gRNA
aucuacauuucgaccccacc

SEQ ID NO: 87323 - RNA, 20 nt, Artificial Sequence
  MKO10087323_B_Gimap6
  gRNA
ucaauccuuguccagagucc

SEQ ID NO: 87324 - RNA, 20 nt, Artificial Sequence
  MKO10087324_B_Gimap6
  gRNA
uggccccuggacucuggaca

SEQ ID NO: 87325 - RNA, 20 nt, Artificial Sequence
  MKO10087325_B_Gimap7
  gRNA
cuugcucuuccaccgugaag

SEQ ID NO: 87326 - RNA, 20 nt, Artificial Sequence
  MKO10087326_B_Gimap7
  gRNA
acugucagagugacucccgc

SEQ ID NO: 87327 - RNA, 20 nt, Artificial Sequence
  MKO10087327_B_Gimap7
  gRNA
cuccugguuguugauacccc

SEQ ID NO: 87328 - RNA, 20 nt, Artificial Sequence
  MKO10087328_B_Gimap8
  gRNA
gccgcaguguggacguuccc

SEQ ID NO: 87329 - RNA, 20 nt, Artificial Sequence
  MKO10087329_B_Gimap8
  gRNA
ucccauuggccacuauacag

SEQ ID NO: 87330 - RNA, 20 nt, Artificial Sequence
  MKO10087330_B_Gimap8
  gRNA
accgucccaacuggagaacc

SEQ ID NO: 87331 - RNA, 20 nt, Artificial Sequence
  MKO10087331_B_Gimap9
  gRNA
caggcugaaccauugucuag

SEQ ID NO: 87332 - RNA, 20 nt, Artificial Sequence
  MKO10087332_B_Gimap9
  gRNA
cacugaagugaggaucauuc

SEQ ID NO: 87333 - RNA, 20 nt, Artificial Sequence
  MKO10087333_B_Gimap9
  gRNA
acaagaugaucauguacuuc

SEQ ID NO: 87334 - RNA, 20 nt, Artificial Sequence
  MKO10087334_B_Gin1
  gRNA
ugaccaaugacgucaagcag

SEQ ID NO: 87335 - RNA, 20 nt, Artificial Sequence
  MKO10087335_B_Gin1
  gRNA
auuguaauuucucgugcuuc

SEQ ID NO: 87336 - RNA, 20 nt, Artificial Sequence
  MKO10087336_B_Gin1
  gRNA
caugacuucuguugcuugua

SEQ ID NO: 87337 - RNA, 20 nt, Artificial Sequence
  MKO10087337_B_Ginm1
  gRNA
guaacuacccugagcaagag

SEQ ID NO: 87338 - RNA, 20 nt, Artificial Sequence
  MKO10087338_B_Ginm1
  gRNA
gagcuggcacuguacgucac

SEQ ID NO: 87339 - RNA, 20 nt, Artificial Sequence
  MKO10087339_B_Ginm1
  gRNA
uugaauaucugaguacucuc

SEQ ID NO: 87340 - RNA, 20 nt, Artificial Sequence
  MKO10087340_B_Gins1
  gRNA
agucucuugcuacuuacaug

SEQ ID NO: 87341 - RNA, 20 nt, Artificial Sequence
  MKO10087341_B_Gins1
  gRNA
auccccucguccagcugacu

SEQ ID NO: 87342 - RNA, 20 nt, Artificial Sequence
  MKO10087342_B_Gins1
  gRNA
ggacggacucagacaaguuc

SEQ ID NO: 87343 - RNA, 20 nt, Artificial Sequence
  MKO10087343_B_Gins2
  gRNA
gucagcagacacucgaagcu

SEQ ID NO: 87344 - RNA, 20 nt, Artificial Sequence
  MKO10087344_B_Gins2
  gRNA
cuggcuagaaguccugcgac

SEQ ID NO: 87345 - RNA, 20 nt, Artificial Sequence
  MKO10087345_B_Gins2
  gRNA
uucgugaucuccauguagug

SEQ ID NO: 87346 - RNA, 20 nt, Artificial Sequence
  MKO10087346_B_Gins3
  gRNA
caaugaagacacuucagcgc

SEQ ID NO: 87347 - RNA, 20 nt, Artificial Sequence
  MKO10087347_B_Gins3
  gRNA
gugagccaaacccauagaaa

SEQ ID NO: 87348 - RNA, 20 nt, Artificial Sequence
  MKO10087348_B_Gins3
  gRNA
gucuaaaugacuuucagagu

SEQ ID NO: 87349 - RNA, 20 nt, Artificial Sequence
  MKO10087349_B_Gins4
  gRNA
uccaccuucugcagguuggg

SEQ ID NO: 87350 - RNA, 20 nt, Artificial Sequence
  MKO10087350_B_Gins4
  gRNA
aaaguuugccccugagcucc

SEQ ID NO: 87351 - RNA, 20 nt, Artificial Sequence
  MKO10087351_B_Gins4
  gRNA
uuccagguauauggaccaca

SEQ ID NO: 87352 - RNA, 20 nt, Artificial Sequence
  MKO10087352_B_Gipc1
  gRNA
gggcucaccaucaccgacaa

SEQ ID NO: 87353 - RNA, 20 nt, Artificial Sequence
  MKO10087353_B_Gipc1
  gRNA
uccacagccgucggccuuug

SEQ ID NO: 87354 - RNA, 20 nt, Artificial Sequence
  MKO10087354_B_Gipc1
  gRNA
ggcucaccaaaggccuuucg

SEQ ID NO: 87355 - RNA, 20 nt, Artificial Sequence
  MKO10087355_B_Gipc2
  gRNA
cucaguuaaaacgaucugug

SEQ ID NO: 87356 - RNA, 20 nt, Artificial Sequence
  MKO10087356_B_Gipc2
  gRNA
ugaucuccuugagcuguaca

SEQ ID NO: 87357 - RNA, 20 nt, Artificial Sequence
  MKO10087357_B_Gipc2
  gRNA
uucauauuugcccacgugaa

SEQ ID NO: 87358 - RNA, 20 nt, Artificial Sequence
  MKO10087358_B_Gipc3
  gRNA
gaaacauuacgccugcgcuc

SEQ ID NO: 87359 - RNA, 20 nt, Artificial Sequence
  MKO10087359_B_Gipc3
  gRNA
caccuugaugaaggcguauc

SEQ ID NO: 87360 - RNA, 20 nt, Artificial Sequence
  MKO10087360_B_Gipc3
  gRNA
cugcacuagacgcaggguga

SEQ ID NO: 87361 - RNA, 20 nt, Artificial Sequence
  MKO10087361_B_Gipr
  gRNA
cgggggagcuguaccagcgc

SEQ ID NO: 87362 - RNA, 20 nt, Artificial Sequence
  MKO10087362_B_Gipr
  gRNA
ccugcagaucauguauaccg

SEQ ID NO: 87363 - RNA, 20 nt, Artificial Sequence
  MKO10087363_B_Gipr
  gRNA
ggcggccguguaguuccagc

SEQ ID NO: 87364 - RNA, 20 nt, Artificial Sequence
  MKO10087364_B_Gip
  gRNA
ugagucggcagagcucuguu

SEQ ID NO: 87365 - RNA, 20 nt, Artificial Sequence
  MKO10087365_B_Gip
  gRNA
gcccugccagcaccaaagcc

SEQ ID NO: 87366 - RNA, 20 nt, Artificial Sequence
  MKO10087366_B_Gip
  gRNA
acacaacaucacccagagag

SEQ ID NO: 87367 - RNA, 20 nt, Artificial Sequence
  MKO10087367_B_Git1
  gRNA
ugugcacgaacgccagcauc

SEQ ID NO: 87368 - RNA, 20 nt, Artificial Sequence
  MKO10087368_B_Git1
  gRNA
cugcgcaagugcaaaguggc

SEQ ID NO: 87369 - RNA, 20 nt, Artificial Sequence
  MKO10087369_B_Git1
  gRNA
cugcugauagaugcccagcc

SEQ ID NO: 87370 - RNA, 20 nt, Artificial Sequence
  MKO10087370_B_Git2
  gRNA
ccgucacgcugucguccucg

SEQ ID NO: 87371 - RNA, 20 nt, Artificial Sequence
  MKO10087371_B_Git2
  gRNA
uccccuauuuacugacgccc

SEQ ID NO: 87372 - RNA, 20 nt, Artificial Sequence
  MKO10087372_B_Git2
  gRNA
ccgccucccacucaugauag

SEQ ID NO: 87373 - RNA, 20 nt, Artificial Sequence
  MKO10087373_B_Gja10
  gRNA
guaacagauauuguugcaac

SEQ ID NO: 87374 - RNA, 20 nt, Artificial Sequence
  MKO10087374_B_Gja10
  gRNA
gcaaggccagcuuucuaucg

SEQ ID NO: 87375 - RNA, 20 nt, Artificial Sequence
  MKO10087375_B_Gja10
  gRNA
auucuggcacugcggucaug

SEQ ID NO: 87376 - RNA, 20 nt, Artificial Sequence
  MKO10087376_B_Gja1
  gRNA
caucuccacguugaccccgu

SEQ ID NO: 87377 - RNA, 20 nt, Artificial Sequence
  MKO10087377_B_Gja1
  gRNA
uugcuuguuguaauugcggc

SEQ ID NO: 87378 - RNA, 20 nt, Artificial Sequence
  MKO10087378_B_Gja1
  gRNA
uuguugaguguuacagcgaa

SEQ ID NO: 87379 - RNA, 20 nt, Artificial Sequence
  MKO10087379_B_Gja3
  gRNA
cacuuuaccgcugcgaccgc

SEQ ID NO: 87380 - RNA, 20 nt, Artificial Sequence
  MKO10087380_B_Gja3
  gRNA
cgugcuacacaucgugcgca

SEQ ID NO: 87381 - RNA, 20 nt, Artificial Sequence
  MKO10087381_B_Gja3
  gRNA
ugcgcacgauguguagcacg

SEQ ID NO: 87382 - RNA, 20 nt, Artificial Sequence
  MKO10087382_B_Gja4
  gRNA
ggcgcucauggguaccuaug

SEQ ID NO: 87383 - RNA, 20 nt, Artificial Sequence
  MKO10087383_B_Gja4
  gRNA
ccaucucccacauccgauac

SEQ ID NO: 87384 - RNA, 20 nt, Artificial Sequence
  MKO10087384_B_Gja4
  gRNA
gccacgucaucuaccugucu

SEQ ID NO: 87385 - RNA, 20 nt, Artificial Sequence
  MKO10087385_B_Gja5
  gRNA
acucauaggcaccagugcgg

SEQ ID NO: 87386 - RNA, 20 nt, Artificial Sequence
  MKO10087386_B_Gja5
  gRNA
gcaguacccaauaacgaaug

SEQ ID NO: 87387 - RNA, 20 nt, Artificial Sequence
  MKO10087387_B_Gja5
  gRNA
caggcugaaugguaucgcac

SEQ ID NO: 87388 - RNA, 20 nt, Artificial Sequence
  MKO10087388_B_Gja6
  gRNA
gcacagauacgaaaaugacc

SEQ ID NO: 87389 - RNA, 20 nt, Artificial Sequence
  MKO10087389_B_Gja6
  gRNA
agcagucuccuugcccacgu

SEQ ID NO: 87390 - RNA, 20 nt, Artificial Sequence
  MKO10087390_B_Gja6
  gRNA
cgccugcucacuagaaucua

SEQ ID NO: 87391 - RNA, 20 nt, Artificial Sequence
  MKO10087391_B_Gja8
  gRNA
ugccccacguacaucagcga

SEQ ID NO: 87392 - RNA, 20 nt, Artificial Sequence
  MKO10087392_B_Gja8
  gRNA
aacuccgugacauaucugcc

SEQ ID NO: 87393 - RNA, 20 nt, Artificial Sequence
  MKO10087393_B_Gja8
  gRNA
gccaccggcugcagcgauag

SEQ ID NO: 87394 - RNA, 20 nt, Artificial Sequence
  MKO10087394_B_Gjb1
  gRNA
gucuuuaugcucgcagccuc

SEQ ID NO: 87395 - RNA, 20 nt, Artificial Sequence
  MKO10087395_B_Gjb1
  gRNA
ccuugcucaguggcgugaau

SEQ ID NO: 87396 - RNA, 20 nt, Artificial Sequence
  MKO10087396_B_Gjb1
  gRNA
ccgauucacgccacugagca

SEQ ID NO: 87397 - RNA, 20 nt, Artificial Sequence
  MKO10087397_B_Gjb2
  gRNA
gucuggugaaaugcaacgcu

SEQ ID NO: 87398 - RNA, 20 nt, Artificial Sequence
  MKO10087398_B_Gjb2
  gRNA
aguguuuguugacacccccg

SEQ ID NO: 87399 - RNA, 20 nt, Artificial Sequence
  MKO10087399_B_Gjb2
  gRNA
gaugacccggaagaagaugc

SEQ ID NO: 87400 - RNA, 20 nt, Artificial Sequence
  MKO10087400_B_Gjb3
  gRNA
ccugcauguagccuaccgcg

SEQ ID NO: 87401 - RNA, 20 nt, Artificial Sequence
  MKO10087401_B_Gjb3
  gRNA
acugguucacgccacucaau

SEQ ID NO: 87402 - RNA, 20 nt, Artificial Sequence
  MKO10087402_B_Gjb3
  gRNA
uggcuucaccaugccgcguc

SEQ ID NO: 87403 - RNA, 20 nt, Artificial Sequence
  MKO10087403_B_Gjb4
  gRNA
ccuuucucgcucuucacgau

SEQ ID NO: 87404 - RNA, 20 nt, Artificial Sequence
  MKO10087404_B_Gjb4
  gRNA
ggugugggacgacgaucaaa

SEQ ID NO: 87405 - RNA, 20 nt, Artificial Sequence
  MKO10087405_B_Gjb4
  gRNA
aggaucacgcucucaucuug

SEQ ID NO: 87406 - RNA, 20 nt, Artificial Sequence
  MKO10087406_B_Gjb5
  gRNA
cucaugcgaccucaucuuuc

SEQ ID NO: 87407 - RNA, 20 nt, Artificial Sequence
  MKO10087407_B_Gjb5
  gRNA
uauaucugggauagaaugcg

SEQ ID NO: 87408 - RNA, 20 nt, Artificial Sequence
  MKO10087408_B_Gjb5
  gRNA
cgagggcggucugguaacag

SEQ ID NO: 87409 - RNA, 20 nt, Artificial Sequence
  MKO10087409_B_Gjb6
  gRNA
aaugaagcaguccacgagau

SEQ ID NO: 87410 - RNA, 20 nt, Artificial Sequence
  MKO10087410_B_Gjb6
  gRNA
ccaccacuaggaucaugacu

SEQ ID NO: 87411 - RNA, 20 nt, Artificial Sequence
  MKO10087411_B_Gjb6
  gRNA
ugaccccugccccaaucucg

SEQ ID NO: 87412 - RNA, 20 nt, Artificial Sequence
  MKO10087412_B_Gjc1
  gRNA
cgaauuguccuaacugcugu

SEQ ID NO: 87413 - RNA, 20 nt, Artificial Sequence
  MKO10087413_B_Gjc1
  gRNA
ggaauacccagaagcgcacg

SEQ ID NO: 87414 - RNA, 20 nt, Artificial Sequence
  MKO10087414_B_Gjc1
  gRNA
ucuucccuacaaaugucgaa

SEQ ID NO: 87415 - RNA, 20 nt, Artificial Sequence
  MKO10087415_B_Gjc2
  gRNA
cccaacggugccccccgacg

SEQ ID NO: 87416 - RNA, 20 nt, Artificial Sequence
  MKO10087416_B_Gjc2
  gRNA
gcaccucgaagccguacagu

SEQ ID NO: 87417 - RNA, 20 nt, Artificial Sequence
  MKO10087417_B_Gjc2
  gRNA
augcaguccaccgcuuggcg

SEQ ID NO: 87418 - RNA, 20 nt, Artificial Sequence
  MKO10087418_B_Gjc3
  gRNA
ucugugguugaugcuucugc

SEQ ID NO: 87419 - RNA, 20 nt, Artificial Sequence
  MKO10087419_B_Gjc3
  gRNA
uuggugacaggaugugcggc

SEQ ID NO: 87420 - RNA, 20 nt, Artificial Sequence
  MKO10087420_B_Gjc3
  gRNA
ugaucccaaacaugauguug

SEQ ID NO: 87421 - RNA, 20 nt, Artificial Sequence
  MKO10087421_B_Gjd2
  gRNA
cccuuaccucccaaucauag

SEQ ID NO: 87422 - RNA, 20 nt, Artificial Sequence
  MKO10087422_B_Gjd2
  gRNA
aggcgcggucauagcaggcc

SEQ ID NO: 87423 - RNA, 20 nt, Artificial Sequence
  MKO10087423_B_Gjd2
  gRNA
gaucuuccggauacucauug

SEQ ID NO: 87424 - RNA, 20 nt, Artificial Sequence
  MKO10087424_B_Gjd3
  gRNA
guagcugcaccgcguccagc

SEQ ID NO: 87425 - RNA, 20 nt, Artificial Sequence
  MKO10087425_B_Gjd3
  gRNA
ggcccggcgcacgcguagug

SEQ ID NO: 87426 - RNA, 20 nt, Artificial Sequence
  MKO10087426_B_Gjd3
  gRNA
ucgcccucgcugucgccugc

SEQ ID NO: 87427 - RNA, 20 nt, Artificial Sequence
  MKO10087427_B_Gjd4
  gRNA
aaacuguaacgugaccauca

SEQ ID NO: 87428 - RNA, 20 nt, Artificial Sequence
  MKO10087428_B_Gjd4
  gRNA
cuguggacugcuacgugucg

SEQ ID NO: 87429 - RNA, 20 nt, Artificial Sequence
  MKO10087429_B_Gjd4
  gRNA
ugcacuagccagaaucgcag

SEQ ID NO: 87430 - RNA, 20 nt, Artificial Sequence
  MKO10087430_B_Gje1
  gRNA
ucagugcggauguucuuccu

SEQ ID NO: 87431 - RNA, 20 nt, Artificial Sequence
  MKO10087431_B_Gje1
  gRNA
uacaucaagaacuucuauga

SEQ ID NO: 87432 - RNA, 20 nt, Artificial Sequence
  MKO10087432_B_Gje1
  gRNA
cacugugauuuacguccucu

SEQ ID NO: 87433 - RNA, 20 nt, Artificial Sequence
  MKO10087433_B_Gk2
  gRNA
ucccgcagagguuugcuucg

SEQ ID NO: 87434 - RNA, 20 nt, Artificial Sequence
  MKO10087434_B_Gk2
  gRNA
aagaucguagacaaaucuuc

SEQ ID NO: 87435 - RNA, 20 nt, Artificial Sequence
  MKO10087435_B_Gk2
  gRNA
uagcuggugcuguuauucgc

SEQ ID NO: 87436 - RNA, 20 nt, Artificial Sequence
  MKO10087436_B_Gk5
  gRNA
cauuaugagagaauuauucc

SEQ ID NO: 87437 - RNA, 20 nt, Artificial Sequence
  MKO10087437_B_Gk5
  gRNA
uuacaaguucagcugcccuu

SEQ ID NO: 87438 - RNA, 20 nt, Artificial Sequence
  MKO10087438_B_Gk5
  gRNA
auuucaacccagccagguug

SEQ ID NO: 87439 - RNA, 20 nt, Artificial Sequence
  MKO10087439_B_Gkap1
  gRNA
aucgccaaacccagcacaga

SEQ ID NO: 87440 - RNA, 20 nt, Artificial Sequence
  MKO10087440_B_Gkap1
  gRNA
cucaaagacuuccaguguga

SEQ ID NO: 87441 - RNA, 20 nt, Artificial Sequence
  MKO10087441_B_Gkap1
  gRNA
uacagaucauauuaguaaaa

SEQ ID NO: 87442 - RNA, 20 nt, Artificial Sequence
  MKO10087442_B_Gkn1
  gRNA
gacggaguacaucaaguccu

SEQ ID NO: 87443 - RNA, 20 nt, Artificial Sequence
  MKO10087443_B_Gkn1
  gRNA
acauucggaccaaagauugc

SEQ ID NO: 87444 - RNA, 20 nt, Artificial Sequence
  MKO10087444_B_Gkn1
  gRNA
gccguuauuguugucgauau

SEQ ID NO: 87445 - RNA, 20 nt, Artificial Sequence
  MKO10087445_B_Gkn2
  gRNA
cguuggaguuuguccagagc

SEQ ID NO: 87446 - RNA, 20 nt, Artificial Sequence
  MKO10087446_B_Gkn2
  gRNA
caucuuuggaauacaaucgc

SEQ ID NO: 87447 - RNA, 20 nt, Artificial Sequence
  MKO10087447_B_Gkn2
  gRNA
aucuucgucccaagcaaaaa

SEQ ID NO: 87448 - RNA, 20 nt, Artificial Sequence
  MKO10087448_B_Gkn3
  gRNA
acccagccgaaucaaaaacu

SEQ ID NO: 87449 - RNA, 20 nt, Artificial Sequence
  MKO10087449_B_Gkn3
  gRNA
guguaggucaguccucgagu

SEQ ID NO: 87450 - RNA, 20 nt, Artificial Sequence
  MKO10087450_B_Gkn3
  gRNA
uggguaauaucauccaaacu

SEQ ID NO: 87451 - RNA, 20 nt, Artificial Sequence
  MKO10087451_B_Gla
  gRNA
gcauuguauacuccugugag

SEQ ID NO: 87452 - RNA, 20 nt, Artificial Sequence
  MKO10087452_B_Gla
  gRNA
acucccggggaaaccugcac

SEQ ID NO: 87453 - RNA, 20 nt, Artificial Sequence
  MKO10087453_B_Gla
  gRNA
cgacuucaacaaucuccuuc

SEQ ID NO: 87454 - RNA, 20 nt, Artificial Sequence
  MKO10087454_B_Glb1l2
  gRNA
ucuuagggccuuuauccagc

SEQ ID NO: 87455 - RNA, 20 nt, Artificial Sequence
  MKO10087455_B_Glb1l2
  gRNA
gcggucccuccaguauuccc

SEQ ID NO: 87456 - RNA, 20 nt, Artificial Sequence
  MKO10087456_B_Glb1l2
  gRNA
aucuguagugagauugaccu

SEQ ID NO: 87457 - RNA, 20 nt, Artificial Sequence
  MKO10087457_B_Glb1l3
  gRNA
cucaccuagguaauccaccc

SEQ ID NO: 87458 - RNA, 20 nt, Artificial Sequence
  MKO10087458_B_Glb1l3
  gRNA
caucugugcugagguugacc

SEQ ID NO: 87459 - RNA, 20 nt, Artificial Sequence
  MKO10087459_B_Glb1l3
  gRNA
cacaaauucaugaucguugg

SEQ ID NO: 87460 - RNA, 20 nt, Artificial Sequence
  MKO10087460_B_Glb1l
  gRNA
ccauuaaaguuauagauccc

SEQ ID NO: 87461 - RNA, 20 nt, Artificial Sequence
  MKO10087461_B_Glb1l
  gRNA
uaaugauguugcccccauug

SEQ ID NO: 87462 - RNA, 20 nt, Artificial Sequence
  MKO10087462_B_Glb1l
  gRNA
accuuacaucugugcugagu

SEQ ID NO: 87463 - RNA, 20 nt, Artificial Sequence
  MKO10087463_B_Glb1
  gRNA
uccggauaccccgcuucuac

SEQ ID NO: 87464 - RNA, 20 nt, Artificial Sequence
  MKO10087464_B_Glb1
  gRNA
agaaacaaucuaucguucuc

SEQ ID NO: 87465 - RNA, 20 nt, Artificial Sequence
  MKO10087465_B_Glb1
  gRNA
acagccauuccgauacaucu

SEQ ID NO: 87466 - RNA, 20 nt, Artificial Sequence
  MKO10087466_B_Glcci1
  gRNA
caugagagauaaagccacuc

SEQ ID NO: 87467 - RNA, 20 nt, Artificial Sequence
  MKO10087467_B_Glcci1
  gRNA
uuguagcuguugccuaaguu

SEQ ID NO: 87468 - RNA, 20 nt, Artificial Sequence
  MKO10087468_B_Glcci1
  gRNA
gcuuuaucucucaugcauga

SEQ ID NO: 87469 - RNA, 20 nt, Artificial Sequence
  MKO10087469_B_Glce
  gRNA
uugcucccaaccuggcccgc

SEQ ID NO: 87470 - RNA, 20 nt, Artificial Sequence
  MKO10087470_B_Glce
  gRNA
ugugcccaaggggugcuuca

SEQ ID NO: 87471 - RNA, 20 nt, Artificial Sequence
  MKO10087471_B_Glce
  gRNA
uuagcccauacugugcaauc

SEQ ID NO: 87472 - RNA, 20 nt, Artificial Sequence
  MKO10087472_B_Gldc
  gRNA
cuggcugauacggaguguac

SEQ ID NO: 87473 - RNA, 20 nt, Artificial Sequence
  MKO10087473_B_Gldc
  gRNA
ucaauuacuuggcucgaguc

SEQ ID NO: 87474 - RNA, 20 nt, Artificial Sequence
  MKO10087474_B_Gldc
  gRNA
caauauacgaccuccagauc

SEQ ID NO: 87475 - RNA, 20 nt, Artificial Sequence
  MKO10087475_B_Gldn
  gRNA
guaggaccaccgggcccacc

SEQ ID NO: 87476 - RNA, 20 nt, Artificial Sequence
  MKO10087476_B_Gldn
  gRNA
gaguacuuaccuggugggcc

SEQ ID NO: 87477 - RNA, 20 nt, Artificial Sequence
  MKO10087477_B_Gldn
  gRNA
ccaggccacaauggaucaga

SEQ ID NO: 87478 - RNA, 20 nt, Artificial Sequence
  MKO10087478_B_Gle1
  gRNA
ccgucacccucaucaccaaa

SEQ ID NO: 87479 - RNA, 20 nt, Artificial Sequence
  MKO10087479_B_Gle1
  gRNA
uaucaguaccagggaggccc

SEQ ID NO: 87480 - RNA, 20 nt, Artificial Sequence
  MKO10087480_B_Gle1
  gRNA
gcuccgaugccaucucugag

SEQ ID NO: 87481 - RNA, 20 nt, Artificial Sequence
  MKO10087481_B_Glg1
  gRNA
gucugaagaaaucucguucu

SEQ ID NO: 87482 - RNA, 20 nt, Artificial Sequence
  MKO10087482_B_Glg1
  gRNA
aguugacuugcaaaccuccc

SEQ ID NO: 87483 - RNA, 20 nt, Artificial Sequence
  MKO10087483_B_Glg1
  gRNA
uugcaagucaacuauuuccg

SEQ ID NO: 87484 - RNA, 20 nt, Artificial Sequence
  MKO10087484_B_Gli1
  gRNA
gaaccccgaguagagucaug

SEQ ID NO: 87485 - RNA, 20 nt, Artificial Sequence
  MKO10087485_B_Gli1
  gRNA
uaugaugguuggcaagugcc

SEQ ID NO: 87486 - RNA, 20 nt, Artificial Sequence
  MKO10087486_B_Gli1
  gRNA
augucuagccccaacuccac

SEQ ID NO: 87487 - RNA, 20 nt, Artificial Sequence
  MKO10087487_B_Gli2
  gRNA
cuccauauggggguucacgu

SEQ ID NO: 87488 - RNA, 20 nt, Artificial Sequence
  MKO10087488_B_Gli2
  gRNA
ugucucaugucaaucggcaa

SEQ ID NO: 87489 - RNA, 20 nt, Artificial Sequence
  MKO10087489_B_Gli2
  gRNA
gaccuucuaaugcagagcgg

SEQ ID NO: 87490 - RNA, 20 nt, Artificial Sequence
  MKO10087490_B_Gli3
  gRNA
agagagggcuccgccagaug

SEQ ID NO: 87491 - RNA, 20 nt, Artificial Sequence
  MKO10087491_B_Gli3
  gRNA
ugcggaauacuaucaccaga

SEQ ID NO: 87492 - RNA, 20 nt, Artificial Sequence
  MKO10087492_B_Gli3
  gRNA
aauacuuacacauguaaugg

SEQ ID NO: 87493 - RNA, 20 nt, Artificial Sequence
  MKO10087493_B_Glipr1l1
  gRNA
acaacgauacgaaugucuug

SEQ ID NO: 87494 - RNA, 20 nt, Artificial Sequence
  MKO10087494_B_Glipr1l1
  gRNA
ggagacucuugcucuaugug

SEQ ID NO: 87495 - RNA, 20 nt, Artificial Sequence
  MKO10087495_B_Glipr1l1
  gRNA
uucaaauuguccuaaucuca

SEQ ID NO: 87496 - RNA, 20 nt, Artificial Sequence
  MKO10087496_B_Glipr1l2
  gRNA
cauccaguauuuacugaaau

SEQ ID NO: 87497 - RNA, 20 nt, Artificial Sequence
  MKO10087497_B_Glipr1l2
  gRNA
ugcauagguagucugugcau

SEQ ID NO: 87498 - RNA, 20 nt, Artificial Sequence
  MKO10087498_B_Glipr1l2
  gRNA
uucauaugcaauuaugcacc

SEQ ID NO: 87499 - RNA, 20 nt, Artificial Sequence
  MKO10087499_B_Glipr1
  gRNA
acacccaaauuucaccgccc

SEQ ID NO: 87500 - RNA, 20 nt, Artificial Sequence
  MKO10087500_B_Glipr1
  gRNA
gcagugcaacuuugcccuaa

SEQ ID NO: 87501 - RNA, 20 nt, Artificial Sequence
  MKO10087501_B_Glipr1
  gRNA
acaacccacagcugcauuca

SEQ ID NO: 87502 - RNA, 20 nt, Artificial Sequence
  MKO10087502_B_Glipr2
  gRNA
uguccuaccugucugaucau

SEQ ID NO: 87503 - RNA, 20 nt, Artificial Sequence
  MKO10087503_B_Glipr2
  gRNA
gcuggcgagagcuacuucuu

SEQ ID NO: 87504 - RNA, 20 nt, Artificial Sequence
  MKO10087504_B_Glipr2
  gRNA
gaaguaucuagccaccacaa

SEQ ID NO: 87505 - RNA, 20 nt, Artificial Sequence
  MKO10087505_B_Glis1
  gRNA
ccaacgcacccaccucgaca

SEQ ID NO: 87506 - RNA, 20 nt, Artificial Sequence
  MKO10087506_B_Glis1
  gRNA
cccccagugaacgggagcua

SEQ ID NO: 87507 - RNA, 20 nt, Artificial Sequence
  MKO10087507_B_Glis1
  gRNA
agugggccuucacgugcuug

SEQ ID NO: 87508 - RNA, 20 nt, Artificial Sequence
  MKO10087508_B_Glis2
  gRNA
uuuccagccacuucgcuauu

SEQ ID NO: 87509 - RNA, 20 nt, Artificial Sequence
  MKO10087509_B_Glis2
  gRNA
augcucgauacugcugucau

SEQ ID NO: 87510 - RNA, 20 nt, Artificial Sequence
  MKO10087510_B_Glis2
  gRNA
gcaucggugcggcuucucgu

SEQ ID NO: 87511 - RNA, 20 nt, Artificial Sequence
  MKO10087511_B_Glis3
  gRNA
gccauacuugugccagcauc

SEQ ID NO: 87512 - RNA, 20 nt, Artificial Sequence
  MKO10087512_B_Glis3
  gRNA
aaucuugagguucucgagcc

SEQ ID NO: 87513 - RNA, 20 nt, Artificial Sequence
  MKO10087513_B_Glis3
  gRNA
ucccagucgcugaaccauca

SEQ ID NO: 87514 - RNA, 20 nt, Artificial Sequence
  MKO10087514_B_Glmn
  gRNA
cuugaauaaucucuagcagc

SEQ ID NO: 87515 - RNA, 20 nt, Artificial Sequence
  MKO10087515_B_Glmn
  gRNA
uuugaccugcuaacugaaag

SEQ ID NO: 87516 - RNA, 20 nt, Artificial Sequence
  MKO10087516_B_Glmn
  gRNA
uuacugcaaccauuacaaac

SEQ ID NO: 87517 - RNA, 20 nt, Artificial Sequence
  MKO10087517_B_Glo1
  gRNA
gcaaacgaugcuaagaauua

SEQ ID NO: 87518 - RNA, 20 nt, Artificial Sequence
  MKO10087518_B_Glo1
  gRNA
gaacccucguauaaaaaucc

SEQ ID NO: 87519 - RNA, 20 nt, Artificial Sequence
  MKO10087519_B_Glo1
  gRNA
gagacucagaguuaccacaa

SEQ ID NO: 87520 - RNA, 20 nt, Artificial Sequence
  MKO10087520_B_Glod4
  gRNA
gcuagagucaccuuuaauac

SEQ ID NO: 87521 - RNA, 20 nt, Artificial Sequence
  MKO10087521_B_Glod4
  gRNA
ccacugaguaaaguugcaga

SEQ ID NO: 87522 - RNA, 20 nt, Artificial Sequence
  MKO10087522_B_Glod4
  gRNA
ugcaacaaaaugaucauccu

SEQ ID NO: 87523 - RNA, 20 nt, Artificial Sequence
  MKO10087523_B_Glod5
  gRNA
cggaaguagauggauagaau

SEQ ID NO: 87524 - RNA, 20 nt, Artificial Sequence
  MKO10087524_B_Glod5
  gRNA
ugauccaacaucugaaaguc

SEQ ID NO: 87525 - RNA, 20 nt, Artificial Sequence
  MKO10087525_B_Glod5
  gRNA
cauggaggucacuacuuuca

SEQ ID NO: 87526 - RNA, 20 nt, Artificial Sequence
  MKO10087526_B_Glp1r
  gRNA
ccacuguguagauaauguac

SEQ ID NO: 87527 - RNA, 20 nt, Artificial Sequence
  MKO10087527_B_Glp1r
  gRNA
ugcuacaaggccauguguac

SEQ ID NO: 87528 - RNA, 20 nt, Artificial Sequence
  MKO10087528_B_Glp1r
  gRNA
ggggcagcugacauucacga

SEQ ID NO: 87529 - RNA, 20 nt, Artificial Sequence
  MKO10087529_B_Glp2r
  gRNA
uacuacaggaucucuccuug

SEQ ID NO: 87530 - RNA, 20 nt, Artificial Sequence
  MKO10087530_B_Glp2r
  gRNA
ucauuaccuuuauuccacca

SEQ ID NO: 87531 - RNA, 20 nt, Artificial Sequence
  MKO10087531_B_Glp2r
  gRNA
cacaguguacaucagcugca

SEQ ID NO: 87532 - RNA, 20 nt, Artificial Sequence
  MKO10087532_B_Glra1
  gRNA
gucaucaggguauucauugu

SEQ ID NO: 87533 - RNA, 20 nt, Artificial Sequence
  MKO10087533_B_Glra1
  gRNA
caccaugguugucucagcga

SEQ ID NO: 87534 - RNA, 20 nt, Artificial Sequence
  MKO10087534_B_Glra1
  gRNA
ggaccugaagaauuucccga

SEQ ID NO: 87535 - RNA, 20 nt, Artificial Sequence
  MKO10087535_B_Glra2
  gRNA
ucugcaaagaccaugacucc

SEQ ID NO: 87536 - RNA, 20 nt, Artificial Sequence
  MKO10087536_B_Glra2
  gRNA
aaauuaaugggaagaacauc

SEQ ID NO: 87537 - RNA, 20 nt, Artificial Sequence
  MKO10087537_B_Glra2
  gRNA
acucuccagcugcauuguac

SEQ ID NO: 87538 - RNA, 20 nt, Artificial Sequence
  MKO10087538_B_Glra3
  gRNA
auuaacacucuccuguccaa

SEQ ID NO: 87539 - RNA, 20 nt, Artificial Sequence
  MKO10087539_B_Glra3
  gRNA
uaccauagucgucucugcaa

SEQ ID NO: 87540 - RNA, 20 nt, Artificial Sequence
  MKO10087540_B_Glra3
  gRNA
auucuugagauccauuggac

SEQ ID NO: 87541 - RNA, 20 nt, Artificial Sequence
  MKO10087541_B_Glra4
  gRNA
cuccgucacugagaccacca

SEQ ID NO: 87542 - RNA, 20 nt, Artificial Sequence
  MKO10087542_B_Glra4
  gRNA
aagcuuguccaagaaaucag

SEQ ID NO: 87543 - RNA, 20 nt, Artificial Sequence
  MKO10087543_B_Glra4
  gRNA
uaccaugguggucucaguga

SEQ ID NO: 87544 - RNA, 20 nt, Artificial Sequence
  MKO10087544_B_Glrb
  gRNA
ccaccauguauaagugcuug

SEQ ID NO: 87545 - RNA, 20 nt, Artificial Sequence
  MKO10087545_B_Glrb
  gRNA
cuuuagucagcagucacccg

SEQ ID NO: 87546 - RNA, 20 nt, Artificial Sequence
  MKO10087546_B_Glrb
  gRNA
uuugcagcguugugugucca

SEQ ID NO: 87547 - RNA, 20 nt, Artificial Sequence
  MKO10087547_B_Glrp1
  gRNA
gcugcuggugcugguccugc

SEQ ID NO: 87548 - RNA, 20 nt, Artificial Sequence
  MKO10087548_B_Glrp1
  gRNA
ugauagcaacaucucugaag

SEQ ID NO: 87549 - RNA, 20 nt, Artificial Sequence
  MKO10087549_B_Glrp1
  gRNA
gaaagagaagggccuacucu

SEQ ID NO: 87550 - RNA, 20 nt, Artificial Sequence
  MKO10087550_B_Glrx2
  gRNA
cgagcgggaggaucuuggcg

SEQ ID NO: 87551 - RNA, 20 nt, Artificial Sequence
  MKO10087551_B_Glrx2
  gRNA
gaugcgcuucacaagaugac

SEQ ID NO: 87552 - RNA, 20 nt, Artificial Sequence
  MKO10087552_B_Glrx2
  gRNA
ugugaagcgcaucuugaaac

SEQ ID NO: 87553 - RNA, 20 nt, Artificial Sequence
  MKO10087553_B_Glrx3
  gRNA
acaccucaagaaccacgcug

SEQ ID NO: 87554 - RNA, 20 nt, Artificial Sequence
  MKO10087554_B_Glrx3
  gRNA
cccucauguuucauuuguga

SEQ ID NO: 87555 - RNA, 20 nt, Artificial Sequence
  MKO10087555_B_Glrx3
  gRNA
ugcagguuucagcaagcaga

SEQ ID NO: 87556 - RNA, 20 nt, Artificial Sequence
  MKO10087556_B_Glrx5
  gRNA
aucccgcaaguguaccucaa

SEQ ID NO: 87557 - RNA, 20 nt, Artificial Sequence
  MKO10087557_B_Glrx5
  gRNA
cgagcucgccgcccgcacgc

SEQ ID NO: 87558 - RNA, 20 nt, Artificial Sequence
  MKO10087558_B_Glrx5
  gRNA
ccugcccggagccggcgugc

SEQ ID NO: 87559 - RNA, 20 nt, Artificial Sequence
  MKO10087559_B_Glrx
  gRNA
cacacucacuguucucgcuc

SEQ ID NO: 87560 - RNA, 20 nt, Artificial Sequence
  MKO10087560_B_Glrx
  gRNA
cuaaucuccaugcaacagac

SEQ ID NO: 87561 - RNA, 20 nt, Artificial Sequence
  MKO10087561_B_Glrx
  gRNA
gauuauuuacaacagcucac

SEQ ID NO: 87562 - RNA, 20 nt, Artificial Sequence
  MKO10087562_B_Gls2
  gRNA
cccgugaacuccucaaaguc

SEQ ID NO: 87563 - RNA, 20 nt, Artificial Sequence
  MKO10087563_B_Gls2
  gRNA
ggcagccuacaucccgcacc

SEQ ID NO: 87564 - RNA, 20 nt, Artificial Sequence
  MKO10087564_B_Gls2
  gRNA
cacucaccguggugaacuug

SEQ ID NO: 87565 - RNA, 20 nt, Artificial Sequence
  MKO10087565_B_Gls
  gRNA
acuguaauaaacuugugaac

SEQ ID NO: 87566 - RNA, 20 nt, Artificial Sequence
  MKO10087566_B_Gls
  gRNA
gaaagugcuaaaaagcaguc

SEQ ID NO: 87567 - RNA, 20 nt, Artificial Sequence
  MKO10087567_B_Gls
  gRNA
acucuucagacaacgucaga

SEQ ID NO: 87568 - RNA, 20 nt, Artificial Sequence
  MKO10087568_B_Glt1d1
  gRNA
ugaaauugccaaccugauca

SEQ ID NO: 87569 - RNA, 20 nt, Artificial Sequence
  MKO10087569_B_Glt1d1
  gRNA
aagaucuucccaguugcaug

SEQ ID NO: 87570 - RNA, 20 nt, Artificial Sequence
  MKO10087570_B_Glt1d1
  gRNA
gcaggucacagcauuccuuu

SEQ ID NO: 87571 - RNA, 20 nt, Artificial Sequence
  MKO10087571_B_Glt25d1
  gRNA
agcucuuacccagacgaaga

SEQ ID NO: 87572 - RNA, 20 nt, Artificial Sequence
  MKO10087572_B_Glt25d1
  gRNA
guuucaugacaugcucguag

SEQ ID NO: 87573 - RNA, 20 nt, Artificial Sequence
  MKO10087573_B_Glt25d1
  gRNA
ggcgaccggcagaggaaccc

SEQ ID NO: 87574 - RNA, 20 nt, Artificial Sequence
  MKO10087574_B_Glt28d2
  gRNA
gaacaaucaucaguuugaac

SEQ ID NO: 87575 - RNA, 20 nt, Artificial Sequence
  MKO10087575_B_Glt28d2
  gRNA
cguucagauccucaagaauc

SEQ ID NO: 87576 - RNA, 20 nt, Artificial Sequence
  MKO10087576_B_Glt28d2
  gRNA
aaccaacuuguccuccaaau

SEQ ID NO: 87577 - RNA, 20 nt, Artificial Sequence
  MKO10087577_B_Glt6d1
  gRNA
aaaggugccuucccauauga

SEQ ID NO: 87578 - RNA, 20 nt, Artificial Sequence
  MKO10087578_B_Glt6d1
  gRNA
augucaucacgaccacagac

SEQ ID NO: 87579 - RNA, 20 nt, Artificial Sequence
  MKO10087579_B_Glt6d1
  gRNA
uaccaggaaccaccaggaag

SEQ ID NO: 87580 - RNA, 20 nt, Artificial Sequence
  MKO10087580_B_Glt8d1
  gRNA
aguaaagcaggauccugacc

SEQ ID NO: 87581 - RNA, 20 nt, Artificial Sequence
  MKO10087581_B_Glt8d1
  gRNA
gacaucaucauccauguaua

SEQ ID NO: 87582 - RNA, 20 nt, Artificial Sequence
  MKO10087582_B_Glt8d1
  gRNA
acagcacagcagaccaucuc

SEQ ID NO: 87583 - RNA, 20 nt, Artificial Sequence
  MKO10087583_B_Glt8d2
  gRNA
gccgugcuuaaggacaaagc

SEQ ID NO: 87584 - RNA, 20 nt, Artificial Sequence
  MKO10087584_B_Glt8d2
  gRNA
guucaauccuacaguccuca

SEQ ID NO: 87585 - RNA, 20 nt, Artificial Sequence
  MKO10087585_B_Glt8d2
  gRNA
aauagaugacuuucucaugc

SEQ ID NO: 87586 - RNA, 20 nt, Artificial Sequence
  MKO10087586_B_Gltpd1
  gRNA
cugcuggaccacuauauugc

SEQ ID NO: 87587 - RNA, 20 nt, Artificial Sequence
  MKO10087587_B_Gltpd1
  gRNA
cuagcguaguguucagacug

SEQ ID NO: 87588 - RNA, 20 nt, Artificial Sequence
  MKO10087588_B_Gltpd1
  gRNA
acgccuagggcaggucuagc

SEQ ID NO: 87589 - RNA, 20 nt, Artificial Sequence
  MKO10087589_B_Gltpd2
  gRNA
cauggcggaaccagcguccc

SEQ ID NO: 87590 - RNA, 20 nt, Artificial Sequence
  MKO10087590_B_Gltpd2
  gRNA
augcgacccagcgccccaug

SEQ ID NO: 87591 - RNA, 20 nt, Artificial Sequence
  MKO10087591_B_Gltpd2
  gRNA
accacuaggggucuggccgc

SEQ ID NO: 87592 - RNA, 20 nt, Artificial Sequence
  MKO10087592_B_Gltp
  gRNA
uguuggcguugacucggaug

SEQ ID NO: 87593 - RNA, 20 nt, Artificial Sequence
  MKO10087593_B_Gltp
  gRNA
gcgugaauaccggggaccca

SEQ ID NO: 87594 - RNA, 20 nt, Artificial Sequence
  MKO10087594_B_Gltp
  gRNA
gccuaaagugggggccacuc

SEQ ID NO: 87595 - RNA, 20 nt, Artificial Sequence
  MKO10087595_B_Gltscr1l
  gRNA
ucacuuaccgauuuacugcu

SEQ ID NO: 87596 - RNA, 20 nt, Artificial Sequence
  MKO10087596_B_Gltscr1l
  gRNA
cucuugagcaccgcacugcc

SEQ ID NO: 87597 - RNA, 20 nt, Artificial Sequence
  MKO10087597_B_Gltscr1l
  gRNA
ccucaagccgucuguggucu

SEQ ID NO: 87598 - RNA, 20 nt, Artificial Sequence
  MKO10087598_B_Gltscr1
  gRNA
acgcccgucaccaaaggagc

SEQ ID NO: 87599 - RNA, 20 nt, Artificial Sequence
  MKO10087599_B_Gltscr1
  gRNA
gcuggacagcgaugaccucc

SEQ ID NO: 87600 - RNA, 20 nt, Artificial Sequence
  MKO10087600_B_Gltscr1
  gRNA
gcccucaaugauuucuugca

SEQ ID NO: 87601 - RNA, 20 nt, Artificial Sequence
  MKO10087601_B_Gltscr2
  gRNA
ggucaacccguaaggguuuc

SEQ ID NO: 87602 - RNA, 20 nt, Artificial Sequence
  MKO10087602_B_Gltscr2
  gRNA
cuucaguggcuuguuggcag

SEQ ID NO: 87603 - RNA, 20 nt, Artificial Sequence
  MKO10087603_B_Gltscr2
  gRNA
uacccucacgccuuucuucu

SEQ ID NO: 87604 - RNA, 20 nt, Artificial Sequence
  MKO10087604_B_Glud1
  gRNA
aaugacauacaagugcgcug

SEQ ID NO: 87605 - RNA, 20 nt, Artificial Sequence
  MKO10087605_B_Glud1
  gRNA
ucucucucagauguaccguu

SEQ ID NO: 87606 - RNA, 20 nt, Artificial Sequence
  MKO10087606_B_Glud1
  gRNA
ccugcuuuagcaccuccaaa

SEQ ID NO: 87607 - RNA, 20 nt, Artificial Sequence
  MKO10087607_B_Glul
  gRNA
cagacggccacccauuuggu

SEQ ID NO: 87608 - RNA, 20 nt, Artificial Sequence
  MKO10087608_B_Glul
  gRNA
cuugcccagaguuaccugag

SEQ ID NO: 87609 - RNA, 20 nt, Artificial Sequence
  MKO10087609_B_Glul
  gRNA
gcggaaggggucucgaaaca

SEQ ID NO: 87610 - RNA, 20 nt, Artificial Sequence
  MKO10087610_B_Glyaul3
  gRNA
cauguucuuccaauagcugu

SEQ ID NO: 87611 - RNA, 20 nt, Artificial Sequence
  MKO10087611_B_Glyaul3
  gRNA
acuucaaaguuaucaucacc

SEQ ID NO: 87612 - RNA, 20 nt, Artificial Sequence
  MKO10087612_B_Glyaul3
  gRNA
cagagcuuaccaacagcuau

SEQ ID NO: 87613 - RNA, 20 nt, Artificial Sequence
  MKO10087613_B_Glyau
  gRNA
uaaaagcccuaguugacaag

SEQ ID NO: 87614 - RNA, 20 nt, Artificial Sequence
  MKO10087614_B_Glyau
  gRNA
uuucuacaucaauacuuacc

SEQ ID NO: 87615 - RNA, 20 nt, Artificial Sequence
  MKO10087615_B_Glyau
  gRNA
auaaauucuuuguauccagc

SEQ ID NO: 87616 - RNA, 20 nt, Artificial Sequence
  MKO10087616_B_Glycam1
  gRNA
augagacuuacuggcaucug

SEQ ID NO: 87617 - RNA, 20 nt, Artificial Sequence
  MKO10087617_B_Glycam1
  gRNA
cuucauuugaaguucaucuu

SEQ ID NO: 87618 - RNA, 20 nt, Artificial Sequence
  MKO10087618_B_Glycam1
  gRNA
aauuacagcaaccaccucag

SEQ ID NO: 87619 - RNA, 20 nt, Artificial Sequence
  MKO10087619_B_Glycuk
  gRNA
ccucggcgcccucgaacacc

SEQ ID NO: 87620 - RNA, 20 nt, Artificial Sequence
  MKO10087620_B_Glycuk
  gRNA
gcccggagugcaucccgauc

SEQ ID NO: 87621 - RNA, 20 nt, Artificial Sequence
  MKO10087621_B_Glycuk
  gRNA
cuccacccuucagcugcgac

SEQ ID NO: 87622 - RNA, 20 nt, Artificial Sequence
  MKO10087622_B_Glyr1
  gRNA
ugcacucaccuuuccuggcc

SEQ ID NO: 87623 - RNA, 20 nt, Artificial Sequence
  MKO10087623_B_Glyr1
  gRNA
aagaagcauuucuuuccacg

SEQ ID NO: 87624 - RNA, 20 nt, Artificial Sequence
  MKO10087624_B_Glyr1
  gRNA
agauggcggcugugagucug

SEQ ID NO: 87625 - RNA, 20 nt, Artificial Sequence
  MKO10087625_B_Gm10024
  gRNA
uagacacacagcaggaugac

SEQ ID NO: 87626 - RNA, 20 nt, Artificial Sequence
  MKO10087626_B_Gm10024
  gRNA
gcagcuuacaggcacacagc

SEQ ID NO: 87627 - RNA, 20 nt, Artificial Sequence
  MKO10087627_B_Gm10024
  gRNA
ucugcagcaugcugacuggc

SEQ ID NO: 87628 - RNA, 20 nt, Artificial Sequence
  MKO10087628_B_Gm10057
  gRNA
acacagaaaaccagaaccac

SEQ ID NO: 87629 - RNA, 20 nt, Artificial Sequence
  MKO10087629_B_Gm10057
  gRNA
aacaagcaaacauuuaacug

SEQ ID NO: 87630 - RNA, 20 nt, Artificial Sequence
  MKO10087630_B_Gm10057
  gRNA
ucaaaauggcccauacuacc

SEQ ID NO: 87631 - RNA, 20 nt, Artificial Sequence
  MKO10087631_B_Gm10058
  gRNA
agaaaacguaaguuucucag

SEQ ID NO: 87632 - RNA, 20 nt, Artificial Sequence
  MKO10087632_B_Gm10058
  gRNA
acguucuguagagacaccaa

SEQ ID NO: 87633 - RNA, 20 nt, Artificial Sequence
  MKO10087633_B_Gm10058
  gRNA
aauccaguaacucaugauga

SEQ ID NO: 87634 - RNA, 20 nt, Artificial Sequence
  MKO10087634_B_Gm10081
  gRNA
ccacgaagaacuucucaagc

SEQ ID NO: 87635 - RNA, 20 nt, Artificial Sequence
  MKO10087635_B_Gm10081
  gRNA
ggagaaucaccacccccaug

SEQ ID NO: 87636 - RNA, 20 nt, Artificial Sequence
  MKO10087636_B_Gm10081
  gRNA
auggugcuagaguaauguaa

SEQ ID NO: 87637 - RNA, 20 nt, Artificial Sequence
  MKO10087637_B_Gm10094
  gRNA
ggucucauccucccugacga

SEQ ID NO: 87638 - RNA, 20 nt, Artificial Sequence
  MKO10087638_B_Gm10094
  gRNA
gacuagcucaugcucgccgc

SEQ ID NO: 87639 - RNA, 20 nt, Artificial Sequence
  MKO10087639_B_Gm10094
  gRNA
cgcgggagaacucguccauu

SEQ ID NO: 87640 - RNA, 20 nt, Artificial Sequence
  MKO10087640_B_Gm10096
  gRNA
agaaaacguaaguuucucag

SEQ ID NO: 87641 - RNA, 20 nt, Artificial Sequence
  MKO10087641_B_Gm10096
  gRNA
acguucuguagagacaccaa

SEQ ID NO: 87642 - RNA, 20 nt, Artificial Sequence
  MKO10087642_B_Gm10096
  gRNA
aauccaguaacucaugauga

SEQ ID NO: 87643 - RNA, 20 nt, Artificial Sequence
  MKO10087643_B_Gm10100
  gRNA
cuggcagccugaggagcagc

SEQ ID NO: 87644 - RNA, 20 nt, Artificial Sequence
  MKO10087644_B_Gm10100
  gRNA
gcuggcagccuccagaugac

SEQ ID NO: 87645 - RNA, 20 nt, Artificial Sequence
  MKO10087645_B_Gm10100
  gRNA
uagacacacagcaggauggc

SEQ ID NO: 87646 - RNA, 20 nt, Artificial Sequence
  MKO10087646_B_Gm10104
  gRNA
auaugcuauuguagaauaag

SEQ ID NO: 87647 - RNA, 20 nt, Artificial Sequence
  MKO10087647_B_Gm10104
  gRNA
caaaagagauagacacagcc

SEQ ID NO: 87648 - RNA, 20 nt, Artificial Sequence
  MKO10087648_B_Gm10104
  gRNA
agaugaagagacuaauacug

SEQ ID NO: 87649 - RNA, 20 nt, Artificial Sequence
  MKO10087649_B_Gm10142
  gRNA
ggugacaggccugcagacca

SEQ ID NO: 87650 - RNA, 20 nt, Artificial Sequence
  MKO10087650_B_Gm10142
  gRNA
agacacuggucagcagcaag

SEQ ID NO: 87651 - RNA, 20 nt, Artificial Sequence
  MKO10087651_B_Gm10142
  gRNA
gagcuggacaugcagcagga

SEQ ID NO: 87652 - RNA, 20 nt, Artificial Sequence
  MKO10087652_B_Gm10147
  gRNA
agaaaacguaaguuucucag

SEQ ID NO: 87653 - RNA, 20 nt, Artificial Sequence
  MKO10087653_B_Gm10147
  gRNA
acguucuguagagacaccaa

SEQ ID NO: 87654 - RNA, 20 nt, Artificial Sequence
  MKO10087654_B_Gm10147
  gRNA
aauccaguaacucaugauga

SEQ ID NO: 87655 - RNA, 20 nt, Artificial Sequence
  MKO10087655_B_Gm101
  gRNA
aaguccagguuauucaagac

SEQ ID NO: 87656 - RNA, 20 nt, Artificial Sequence
  MKO10087656_B_Gm101
  gRNA
aggccaggcauaguccacuu

SEQ ID NO: 87657 - RNA, 20 nt, Artificial Sequence
  MKO10087657_B_Gm101
  gRNA
ucuguggugguaaaauauga

SEQ ID NO: 87658 - RNA, 20 nt, Artificial Sequence
  MKO10087658_B_Gm10220
  gRNA
caauguauaccucuuguuca

SEQ ID NO: 87659 - RNA, 20 nt, Artificial Sequence
  MKO10087659_B_Gm10220
  gRNA
cuggggucaggcccuaccac

SEQ ID NO: 87660 - RNA, 20 nt, Artificial Sequence
  MKO10087660_B_Gm10220
  gRNA
ugagcuccugauuguucucu

SEQ ID NO: 87661 - RNA, 20 nt, Artificial Sequence
  MKO10087661_B_Gm10228
  gRNA
uacuauggcggcagaggcua

SEQ ID NO: 87662 - RNA, 20 nt, Artificial Sequence
  MKO10087662_B_Gm10228
  gRNA
aggagccauagccacagccc

SEQ ID NO: 87663 - RNA, 20 nt, Artificial Sequence
  MKO10087663_B_Gm10228
  gRNA
cugcuguggcuauggaggcc

SEQ ID NO: 87664 - RNA, 20 nt, Artificial Sequence
  MKO10087664_B_Gm10229
  gRNA
aggagccauaaccacagccc

SEQ ID NO: 87665 - RNA, 20 nt, Artificial Sequence
  MKO10087665_B_Gm10229
  gRNA
uacuauggcggcagaggcua

SEQ ID NO: 87666 - RNA, 20 nt, Artificial Sequence
  MKO10087666_B_Gm10229
  gRNA
guuuccguaguagccacaca

SEQ ID NO: 87667 - RNA, 20 nt, Artificial Sequence
  MKO10087667_B_Gm10230
  gRNA
agaaaacguaaguuucucag

SEQ ID NO: 87668 - RNA, 20 nt, Artificial Sequence
  MKO10087668_B_Gm10230
  gRNA
acguucuguagagacaccaa

SEQ ID NO: 87669 - RNA, 20 nt, Artificial Sequence
  MKO10087669_B_Gm10230
  gRNA
aauccaguaacucaugauga

SEQ ID NO: 87670 - RNA, 20 nt, Artificial Sequence
  MKO10087670_B_Gm10256
  gRNA
cgugaaacuaagaagucuag

SEQ ID NO: 87671 - RNA, 20 nt, Artificial Sequence
  MKO10087671_B_Gm10256
  gRNA
cccaaguucccuucacauga

SEQ ID NO: 87672 - RNA, 20 nt, Artificial Sequence
  MKO10087672_B_Gm10256
  gRNA
gaauuaaaguaaaacaagcc

SEQ ID NO: 87673 - RNA, 20 nt, Artificial Sequence
  MKO10087673_B_Gm10267
  gRNA
uuuaucuacagagaaaauga

SEQ ID NO: 87674 - RNA, 20 nt, Artificial Sequence
  MKO10087674_B_Gm10267
  gRNA
cucaccagaacaaagaagaa

SEQ ID NO: 87675 - RNA, 20 nt, Artificial Sequence
  MKO10087675_B_Gm10267
  gRNA
uuauccuuucuucuuuguuc

SEQ ID NO: 87676 - RNA, 20 nt, Artificial Sequence
  MKO10087676_B_Gm10318
  gRNA
gaacuaucccccugacuccc

SEQ ID NO: 87677 - RNA, 20 nt, Artificial Sequence
  MKO10087677_B_Gm10318
  gRNA
uaucuuugguaucagccauu

SEQ ID NO: 87678 - RNA, 20 nt, Artificial Sequence
  MKO10087678_B_Gm10318
  gRNA
ccacaucaggaacagaguag

SEQ ID NO: 87679 - RNA, 20 nt, Artificial Sequence
  MKO10087679_B_Gm10324
  gRNA
ugaauuucacuaaagaagaa

SEQ ID NO: 87680 - RNA, 20 nt, Artificial Sequence
  MKO10087680_B_Gm10324
  gRNA
gacaugauucuucaauauga

SEQ ID NO: 87681 - RNA, 20 nt, Artificial Sequence
  MKO10087681_B_Gm10324
  gRNA
aaaguucucgaagacauaca

SEQ ID NO: 87682 - RNA, 20 nt, Artificial Sequence
  MKO10087682_B_Gm10334
  gRNA
augagacacugagugccagc

SEQ ID NO: 87683 - RNA, 20 nt, Artificial Sequence
  MKO10087683_B_Gm10334
  gRNA
accagaccugcuccagugcc

SEQ ID NO: 87684 - RNA, 20 nt, Artificial Sequence
  MKO10087684_B_Gm10334
  gRNA
aggaauccuugccucccucu

SEQ ID NO: 87685 - RNA, 20 nt, Artificial Sequence
  MKO10087685_B_Gm10352
  gRNA
cgugaaacuaagaagucuag

SEQ ID NO: 87686 - RNA, 20 nt, Artificial Sequence
  MKO10087686_B_Gm10352
  gRNA
cccaaguucccuucacauga

SEQ ID NO: 87687 - RNA, 20 nt, Artificial Sequence
  MKO10087687_B_Gm10352
  gRNA
gaauuaaaguaaaacaagcc

SEQ ID NO: 87688 - RNA, 20 nt, Artificial Sequence
  MKO10087688_B_Gm10354
  gRNA
gaaguugaugccauugcagc

SEQ ID NO: 87689 - RNA, 20 nt, Artificial Sequence
  MKO10087689_B_Gm10354
  gRNA
cuggggcaaggcccuaccac

SEQ ID NO: 87690 - RNA, 20 nt, Artificial Sequence
  MKO10087690_B_Gm10354
  gRNA
cuccuucuugagcuccugcu

SEQ ID NO: 87691 - RNA, 20 nt, Artificial Sequence
  MKO10087691_B_Gm10375
  gRNA
cuaaagaaaaucaauuauac

SEQ ID NO: 87692 - RNA, 20 nt, Artificial Sequence
  MKO10087692_B_Gm10375
  gRNA
accucauccagcacaaaguc

SEQ ID NO: 87693 - RNA, 20 nt, Artificial Sequence
  MKO10087693_B_Gm10375
  gRNA
uauauucgucuuugaucuuc

SEQ ID NO: 87694 - RNA, 20 nt, Artificial Sequence
  MKO10087694_B_Gm10377
  gRNA
cuaaagaaaaucaauuauac

SEQ ID NO: 87695 - RNA, 20 nt, Artificial Sequence
  MKO10087695_B_Gm10377
  gRNA
accucauccagcacaaaguc

SEQ ID NO: 87696 - RNA, 20 nt, Artificial Sequence
  MKO10087696_B_Gm10377
  gRNA
uauauucgucuuugaucuuc

SEQ ID NO: 87697 - RNA, 20 nt, Artificial Sequence
  MKO10087697_B_Gm10406
  gRNA
acaacaugagaagacaaugu

SEQ ID NO: 87698 - RNA, 20 nt, Artificial Sequence
  MKO10087698_B_Gm10406
  gRNA
guuaucuucuaucaguuccu

SEQ ID NO: 87699 - RNA, 20 nt, Artificial Sequence
  MKO10087699_B_Gm10406
  gRNA
cucaacucaacgaaaacgua

SEQ ID NO: 87700 - RNA, 20 nt, Artificial Sequence
  MKO10087700_B_Gm10408
  gRNA
acaacaugagaagacaaugu

SEQ ID NO: 87701 - RNA, 20 nt, Artificial Sequence
  MKO10087701_B_Gm10408
  gRNA
ucauccuaccugcugcuccu

SEQ ID NO: 87702 - RNA, 20 nt, Artificial Sequence
  MKO10087702_B_Gm10408
  gRNA
cucaacucagcgaaaaagua

SEQ ID NO: 87703 - RNA, 20 nt, Artificial Sequence
  MKO10087703_B_Gm10413
  gRNA
gaacuucauggaaauaauua

SEQ ID NO: 87704 - RNA, 20 nt, Artificial Sequence
  MKO10087704_B_Gm10413
  gRNA
ucauccuaccugcugcuccu

SEQ ID NO: 87705 - RNA, 20 nt, Artificial Sequence
  MKO10087705_B_Gm10413
  gRNA
ccgugagugcacucaacuaa

SEQ ID NO: 87706 - RNA, 20 nt, Artificial Sequence
  MKO10087706_B_Gm10436
  gRNA
auugguuucauguuguauag

SEQ ID NO: 87707 - RNA, 20 nt, Artificial Sequence
  MKO10087707_B_Gm10436
  gRNA
cuuagccauuucugcucuca

SEQ ID NO: 87708 - RNA, 20 nt, Artificial Sequence
  MKO10087708_B_Gm10436
  gRNA
guauauaaugauucauagca

SEQ ID NO: 87709 - RNA, 20 nt, Artificial Sequence
  MKO10087709_B_Gm10439
  gRNA
uguacuuuaccucucccucg

SEQ ID NO: 87710 - RNA, 20 nt, Artificial Sequence
  MKO10087710_B_Gm10439
  gRNA
uucugaagaagaauacaaug

SEQ ID NO: 87711 - RNA, 20 nt, Artificial Sequence
  MKO10087711_B_Gm10439
  gRNA
ucacuuaccagaugaaguag

SEQ ID NO: 87712 - RNA, 20 nt, Artificial Sequence
  MKO10087712_B_Gm1045
  gRNA
uuggugguaacuacagcaga

SEQ ID NO: 87713 - RNA, 20 nt, Artificial Sequence
  MKO10087713_B_Gm1045
  gRNA
cgcgagguagacugaucccu

SEQ ID NO: 87714 - RNA, 20 nt, Artificial Sequence
  MKO10087714_B_Gm1045
  gRNA
ggggagaagcccggcccccu

SEQ ID NO: 87715 - RNA, 20 nt, Artificial Sequence
  MKO10087715_B_Gm10471
  gRNA
caauguauaccucuuguuca

SEQ ID NO: 87716 - RNA, 20 nt, Artificial Sequence
  MKO10087716_B_Gm10471
  gRNA
cuggggucaggcccuaccac

SEQ ID NO: 87717 - RNA, 20 nt, Artificial Sequence
  MKO10087717_B_Gm10471
  gRNA
ugagcuccugcuuguucucu

SEQ ID NO: 87718 - RNA, 20 nt, Artificial Sequence
  MKO10087718_B_Gm10486
  gRNA
agaaaacguaaguuucucag

SEQ ID NO: 87719 - RNA, 20 nt, Artificial Sequence
  MKO10087719_B_Gm10486
  gRNA
acguucuguagagacaccaa

SEQ ID NO: 87720 - RNA, 20 nt, Artificial Sequence
  MKO10087720_B_Gm10486
  gRNA
guaucuccaacuacuucuuc

SEQ ID NO: 87721 - RNA, 20 nt, Artificial Sequence
  MKO10087721_B_Gm10487
  gRNA
agaaaacguaaguuucucag

SEQ ID NO: 87722 - RNA, 20 nt, Artificial Sequence
  MKO10087722_B_Gm10487
  gRNA
acguucuguagagacaccaa

SEQ ID NO: 87723 - RNA, 20 nt, Artificial Sequence
  MKO10087723_B_Gm10487
  gRNA
aauccaguaacucaugauga

SEQ ID NO: 87724 - RNA, 20 nt, Artificial Sequence
  MKO10087724_B_Gm10488
  gRNA
agaaaacguaaguuucucag

SEQ ID NO: 87725 - RNA, 20 nt, Artificial Sequence
  MKO10087725_B_Gm10488
  gRNA
acguucuguagagacaccaa

SEQ ID NO: 87726 - RNA, 20 nt, Artificial Sequence
  MKO10087726_B_Gm10488
  gRNA
guaucuccaacuacuucuuc

SEQ ID NO: 87727 - RNA, 20 nt, Artificial Sequence
  MKO10087727_B_Gm10591
  gRNA
uaccuugcaggcagugaugg

SEQ ID NO: 87728 - RNA, 20 nt, Artificial Sequence
  MKO10087728_B_Gm10591
  gRNA
gccucaccucuugcagcccu

SEQ ID NO: 87729 - RNA, 20 nt, Artificial Sequence
  MKO10087729_B_Gm10591
  gRNA
caacccucagguucuuaccc

SEQ ID NO: 87730 - RNA, 20 nt, Artificial Sequence
  MKO10087730_B_Gm10639
  gRNA
agagaaguuuauacagaguc

SEQ ID NO: 87731 - RNA, 20 nt, Artificial Sequence
  MKO10087731_B_Gm10639
  gRNA
gauuuggaaaagcuaaaaaa

SEQ ID NO: 87732 - RNA, 20 nt, Artificial Sequence
  MKO10087732_B_Gm10639
  gRNA
ccuucauguccuucccauag

SEQ ID NO: 87733 - RNA, 20 nt, Artificial Sequence
  MKO10087733_B_Gm10662
  gRNA
ccuaaacuccagauaucuac

SEQ ID NO: 87734 - RNA, 20 nt, Artificial Sequence
  MKO10087734_B_Gm10662
  gRNA
uagaggagagcgagacucga

SEQ ID NO: 87735 - RNA, 20 nt, Artificial Sequence
  MKO10087735_B_Gm10662
  gRNA
uucucugcuugcaagaguuc

SEQ ID NO: 87736 - RNA, 20 nt, Artificial Sequence
  MKO10087736_B_Gm10665
  gRNA
guuauucuuguuacgguugu

SEQ ID NO: 87737 - RNA, 20 nt, Artificial Sequence
  MKO10087737_B_Gm10665
  gRNA
ucuuacagugaauccagaag

SEQ ID NO: 87738 - RNA, 20 nt, Artificial Sequence
  MKO10087738_B_Gm10665
  gRNA
uaacauucacauuccaauua

SEQ ID NO: 87739 - RNA, 20 nt, Artificial Sequence
  MKO10087739_B_Gm10666
  gRNA
guuauucuuguuacgguugu

SEQ ID NO: 87740 - RNA, 20 nt, Artificial Sequence
  MKO10087740_B_Gm10666
  gRNA
ucuuacagugaauccagaag

SEQ ID NO: 87741 - RNA, 20 nt, Artificial Sequence
  MKO10087741_B_Gm10666
  gRNA
uaacauccacauuccaauua

SEQ ID NO: 87742 - RNA, 20 nt, Artificial Sequence
  MKO10087742_B_Gm10670
  gRNA
guuauucuuguuacgguugu

SEQ ID NO: 87743 - RNA, 20 nt, Artificial Sequence
  MKO10087743_B_Gm10670
  gRNA
ucuuacagugaauccagaag

SEQ ID NO: 87744 - RNA, 20 nt, Artificial Sequence
  MKO10087744_B_Gm10670
  gRNA
uaacauucacauuccaauua

SEQ ID NO: 87745 - RNA, 20 nt, Artificial Sequence
  MKO10087745_B_Gm10681
  gRNA
caccuuucagauugacaucu

SEQ ID NO: 87746 - RNA, 20 nt, Artificial Sequence
  MKO10087746_B_Gm10681
  gRNA
ggcagguacucagcuccuac

SEQ ID NO: 87747 - RNA, 20 nt, Artificial Sequence
  MKO10087747_B_Gm10681
  gRNA
uaguguuccgauccacucug

SEQ ID NO: 87748 - RNA, 20 nt, Artificial Sequence
  MKO10087748_B_Gm10696
  gRNA
agcagaaaugucaggagaca

SEQ ID NO: 87749 - RNA, 20 nt, Artificial Sequence
  MKO10087749_B_Gm10696
  gRNA
gaaaacgccgugcagaagcc

SEQ ID NO: 87750 - RNA, 20 nt, Artificial Sequence
  MKO10087750_B_Gm10696
  gRNA
caucaucuccuugaagacuu

SEQ ID NO: 87751 - RNA, 20 nt, Artificial Sequence
  MKO10087751_B_Gm10697
  gRNA
ggauucaaaaaguucauccu

SEQ ID NO: 87752 - RNA, 20 nt, Artificial Sequence
  MKO10087752_B_Gm10697
  gRNA
cuccauuucauguucaaaca

SEQ ID NO: 87753 - RNA, 20 nt, Artificial Sequence
  MKO10087753_B_Gm10697
  gRNA
uccucaucucucauccacgu

SEQ ID NO: 87754 - RNA, 20 nt, Artificial Sequence
  MKO10087754_B_Gm10767
  gRNA
aucaguggcauggauggaca

SEQ ID NO: 87755 - RNA, 20 nt, Artificial Sequence
  MKO10087755_B_Gm10767
  gRNA
uguguacuauuguugauagu

SEQ ID NO: 87756 - RNA, 20 nt, Artificial Sequence
  MKO10087756_B_Gm10767
  gRNA
gcaaacaugucuucaaaauu

SEQ ID NO: 87757 - RNA, 20 nt, Artificial Sequence
  MKO10087757_B_Gm10778
  gRNA
uuaggaugcggugaccuaug

SEQ ID NO: 87758 - RNA, 20 nt, Artificial Sequence
  MKO10087758_B_Gm10778
  gRNA
cuuccacauccucuagaacu

SEQ ID NO: 87759 - RNA, 20 nt, Artificial Sequence
  MKO10087759_B_Gm10778
  gRNA
gagcacuguccaaguucuag

SEQ ID NO: 87760 - RNA, 20 nt, Artificial Sequence
  MKO10087760_B_Gm10921
  gRNA
ggauuugucaauaacaccuc

SEQ ID NO: 87761 - RNA, 20 nt, Artificial Sequence
  MKO10087761_B_Gm10921
  gRNA
uggcagcagcaugccugcuu

SEQ ID NO: 87762 - RNA, 20 nt, Artificial Sequence
  MKO10087762_B_Gm10921
  gRNA
uguuaucaacauaugccaug

SEQ ID NO: 87763 - RNA, 20 nt, Artificial Sequence
  MKO10087763_B_Gm10922
  gRNA
aaaucugaucauuaagaaug

SEQ ID NO: 87764 - RNA, 20 nt, Artificial Sequence
  MKO10087764_B_Gm10922
  gRNA
uguuaucaacauaugccaug

SEQ ID NO: 87765 - RNA, 20 nt, Artificial Sequence
  MKO10087765_B_Gm10922
  gRNA
ggauuugucaauaacaccuc

SEQ ID NO: 87766 - RNA, 20 nt, Artificial Sequence
  MKO10087766_B_Gm1110
  gRNA
uagacuacuuccggauaccu

SEQ ID NO: 87767 - RNA, 20 nt, Artificial Sequence
  MKO10087767_B_Gm1110
  gRNA
cccguaauaggcauauuccu

SEQ ID NO: 87768 - RNA, 20 nt, Artificial Sequence
  MKO10087768_B_Gm1110
  gRNA
auuggcagugacuuagaccu

SEQ ID NO: 87769 - RNA, 20 nt, Artificial Sequence
  MKO10087769_B_Gm11127
  gRNA
uccauccaccgacucuaaca

SEQ ID NO: 87770 - RNA, 20 nt, Artificial Sequence
  MKO10087770_B_Gm11127
  gRNA
aaccgaggcuccccgaagcc

SEQ ID NO: 87771 - RNA, 20 nt, Artificial Sequence
  MKO10087771_B_Gm11127
  gRNA
aaccuccuuaccccaucuca

SEQ ID NO: 87772 - RNA, 20 nt, Artificial Sequence
  MKO10087772_B_Gm11128
  gRNA
gguggcugcucggccaguga

SEQ ID NO: 87773 - RNA, 20 nt, Artificial Sequence
  MKO10087773_B_Gm11128
  gRNA
gcugcaguugcuucuucugc

SEQ ID NO: 87774 - RNA, 20 nt, Artificial Sequence
  MKO10087774_B_Gm11128
  gRNA
ucauugcagcaccgaagaga

SEQ ID NO: 87775 - RNA, 20 nt, Artificial Sequence
  MKO10087775_B_Gm11236
  gRNA
cagguccgugugauagcccg

SEQ ID NO: 87776 - RNA, 20 nt, Artificial Sequence
  MKO10087776_B_Gm11236
  gRNA
aaagugcauaccuagagaga

SEQ ID NO: 87777 - RNA, 20 nt, Artificial Sequence
  MKO10087777_B_Gm11236
  gRNA
cacucagguccuugguuuga

SEQ ID NO: 87778 - RNA, 20 nt, Artificial Sequence
  MKO10087778_B_Gm11237
  gRNA
cagguccgugugauagcccg

SEQ ID NO: 87779 - RNA, 20 nt, Artificial Sequence
  MKO10087779_B_Gm11237
  gRNA
aaagugcauaccuagagaga

SEQ ID NO: 87780 - RNA, 20 nt, Artificial Sequence
  MKO10087780_B_Gm11237
  gRNA
cacucagguccuugguuuga

SEQ ID NO: 87781 - RNA, 20 nt, Artificial Sequence
  MKO10087781_B_Gm1123
  gRNA
aaggaccguuggacauugag

SEQ ID NO: 87782 - RNA, 20 nt, Artificial Sequence
  MKO10087782_B_Gm1123
  gRNA
aagugccagcauccgagagc

SEQ ID NO: 87783 - RNA, 20 nt, Artificial Sequence
  MKO10087783_B_Gm1123
  gRNA
uacuccagagcagacaauuc

SEQ ID NO: 87784 - RNA, 20 nt, Artificial Sequence
  MKO10087784_B_Gm1140
  gRNA
aacuugucagcauuuauaaa

SEQ ID NO: 87785 - RNA, 20 nt, Artificial Sequence
  MKO10087785_B_Gm1140
  gRNA
uccagucuuuguuucaacag

SEQ ID NO: 87786 - RNA, 20 nt, Artificial Sequence
  MKO10087786_B_Gm1140
  gRNA
cccacuguugaaacaaagac

SEQ ID NO: 87787 - RNA, 20 nt, Artificial Sequence
  MKO10087787_B_Gm11435
  gRNA
ccuuuaaccuuugccacuuc

SEQ ID NO: 87788 - RNA, 20 nt, Artificial Sequence
  MKO10087788_B_Gm11435
  gRNA
ccugcccuuguccuguuaca

SEQ ID NO: 87789 - RNA, 20 nt, Artificial Sequence
  MKO10087789_B_Gm11435
  gRNA
uagcacuguucauccucuug

SEQ ID NO: 87790 - RNA, 20 nt, Artificial Sequence
  MKO10087790_B_Gm11437
  gRNA
uuccagagccaagacaccgc

SEQ ID NO: 87791 - RNA, 20 nt, Artificial Sequence
  MKO10087791_B_Gm11437
  gRNA
augcacggucuacucagcua

SEQ ID NO: 87792 - RNA, 20 nt, Artificial Sequence
  MKO10087792_B_Gm11437
  gRNA
gcauagacauguccuuaaag

SEQ ID NO: 87793 - RNA, 20 nt, Artificial Sequence
  MKO10087793_B_Gm11487
  gRNA
gcuuguauucgacuuaugau

SEQ ID NO: 87794 - RNA, 20 nt, Artificial Sequence
  MKO10087794_B_Gm11487
  gRNA
cagguccgugugauagcccu

SEQ ID NO: 87795 - RNA, 20 nt, Artificial Sequence
  MKO10087795_B_Gm11487
  gRNA
uaugcacauucccucugcau

SEQ ID NO: 87796 - RNA, 20 nt, Artificial Sequence
  MKO10087796_B_Gm11541
  gRNA
uuugaugagaugaagacgcg

SEQ ID NO: 87797 - RNA, 20 nt, Artificial Sequence
  MKO10087797_B_Gm11541
  gRNA
gacucuccagaugcaauucg

SEQ ID NO: 87798 - RNA, 20 nt, Artificial Sequence
  MKO10087798_B_Gm11541
  gRNA
cuucuucaaaugaguccacc

SEQ ID NO: 87799 - RNA, 20 nt, Artificial Sequence
  MKO10087799_B_Gm11544
  gRNA
aucuugcaaaugaccacuuu

SEQ ID NO: 87800 - RNA, 20 nt, Artificial Sequence
  MKO10087800_B_Gm11544
  gRNA
auguucuguccucccuucag

SEQ ID NO: 87801 - RNA, 20 nt, Artificial Sequence
  MKO10087801_B_Gm11544
  gRNA
cuaacuagaaacuguaccaa

SEQ ID NO: 87802 - RNA, 20 nt, Artificial Sequence
  MKO10087802_B_Gm11545
  gRNA
cuagaccgcagaugcauaag

SEQ ID NO: 87803 - RNA, 20 nt, Artificial Sequence
  MKO10087803_B_Gm11545
  gRNA
cuaacuagaaacugccccaa

SEQ ID NO: 87804 - RNA, 20 nt, Artificial Sequence
  MKO10087804_B_Gm11545
  gRNA
ggaccccagaccuuucuuuc

SEQ ID NO: 87805 - RNA, 20 nt, Artificial Sequence
  MKO10087805_B_Gm11554
  gRNA
uaggcuggcagcacacagac

SEQ ID NO: 87806 - RNA, 20 nt, Artificial Sequence
  MKO10087806_B_Gm11554
  gRNA
gcacuggggccugcagcagc

SEQ ID NO: 87807 - RNA, 20 nt, Artificial Sequence
  MKO10087807_B_Gm11554
  gRNA
acagcuggggcggcagcagc

SEQ ID NO: 87808 - RNA, 20 nt, Artificial Sequence
  MKO10087808_B_Gm11559
  gRNA
gcagcugggcuggcagcagc

SEQ ID NO: 87809 - RNA, 20 nt, Artificial Sequence
  MKO10087809_B_Gm11559
  gRNA
acagcagcugggcuggcagc

SEQ ID NO: 87810 - RNA, 20 nt, Artificial Sequence
  MKO10087810_B_Gm11559
  gRNA
gcagcuggacacacagcagc

SEQ ID NO: 87811 - RNA, 20 nt, Artificial Sequence
  MKO10087811_B_Gm11562
  gRNA
cagggcgacacacugugguc

SEQ ID NO: 87812 - RNA, 20 nt, Artificial Sequence
  MKO10087812_B_Gm11562
  gRNA
ggacacugggcggcagcagc

SEQ ID NO: 87813 - RNA, 20 nt, Artificial Sequence
  MKO10087813_B_Gm11562
  gRNA
ggucccugcagcagcagggc

SEQ ID NO: 87814 - RNA, 20 nt, Artificial Sequence
  MKO10087814_B_Gm11563
  gRNA
ugcuguuugagaccagucug

SEQ ID NO: 87815 - RNA, 20 nt, Artificial Sequence
  MKO10087815_B_Gm11563
  gRNA
uaggcuggcaacacacagac

SEQ ID NO: 87816 - RNA, 20 nt, Artificial Sequence
  MKO10087816_B_Gm11563
  gRNA
acuauggucagcuccuguug

SEQ ID NO: 87817 - RNA, 20 nt, Artificial Sequence
  MKO10087817_B_Gm11564
  gRNA
ucuggugguuccagcuguug

SEQ ID NO: 87818 - RNA, 20 nt, Artificial Sequence
  MKO10087818_B_Gm11564
  gRNA
gcagcagcuggacacacaac

SEQ ID NO: 87819 - RNA, 20 nt, Artificial Sequence
  MKO10087819_B_Gm11564
  gRNA
acagcaggugcucuggcagc

SEQ ID NO: 87820 - RNA, 20 nt, Artificial Sequence
  MKO10087820_B_Gm11565
  gRNA
cacacagcagauggucacac

SEQ ID NO: 87821 - RNA, 20 nt, Artificial Sequence
  MKO10087821_B_Gm11565
  gRNA
gaagugucacagcagguugg

SEQ ID NO: 87822 - RNA, 20 nt, Artificial Sequence
  MKO10087822_B_Gm11565
  gRNA
aaacccaccugugugaucau

SEQ ID NO: 87823 - RNA, 20 nt, Artificial Sequence
  MKO10087823_B_Gm11567
  gRNA
ccaggcacacagacacaugu

SEQ ID NO: 87824 - RNA, 20 nt, Artificial Sequence
  MKO10087824_B_Gm11567
  gRNA
acagcuggacugacaacagc

SEQ ID NO: 87825 - RNA, 20 nt, Artificial Sequence
  MKO10087825_B_Gm11567
  gRNA
gcugccagcccaccugcugc

SEQ ID NO: 87826 - RNA, 20 nt, Artificial Sequence
  MKO10087826_B_Gm11568
  gRNA
gcugccagcccaccugcugc

SEQ ID NO: 87827 - RNA, 20 nt, Artificial Sequence
  MKO10087827_B_Gm11568
  gRNA
gcagcuggagauacagcacc

SEQ ID NO: 87828 - RNA, 20 nt, Artificial Sequence
  MKO10087828_B_Gm11568
  gRNA
uccagcugcugugagcccug

SEQ ID NO: 87829 - RNA, 20 nt, Artificial Sequence
  MKO10087829_B_Gm11569
  gRNA
uaggcuggcagcacacagac

SEQ ID NO: 87830 - RNA, 20 nt, Artificial Sequence
  MKO10087830_B_Gm11569
  gRNA
gcacuggggccugcagcagc

SEQ ID NO: 87831 - RNA, 20 nt, Artificial Sequence
  MKO10087831_B_Gm11569
  gRNA
acagcuggggcggcagcagc

SEQ ID NO: 87832 - RNA, 20 nt, Artificial Sequence
  MKO10087832_B_Gm11570
  gRNA
caaggcggcuugcaggaacu

SEQ ID NO: 87833 - RNA, 20 nt, Artificial Sequence
  MKO10087833_B_Gm11570
  gRNA
auuugucgccccaucuguuc

SEQ ID NO: 87834 - RNA, 20 nt, Artificial Sequence
  MKO10087834_B_Gm11570
  gRNA
aaaguccgaggggggcaagc

SEQ ID NO: 87835 - RNA, 20 nt, Artificial Sequence
  MKO10087835_B_Gm11595
  gRNA
acaacuagaacuaccacagc

SEQ ID NO: 87836 - RNA, 20 nt, Artificial Sequence
  MKO10087836_B_Gm11595
  gRNA
ugucgcccagcaugcucuag

SEQ ID NO: 87837 - RNA, 20 nt, Artificial Sequence
  MKO10087837_B_Gm11595
  gRNA
agcugcugucgccccugcug

SEQ ID NO: 87838 - RNA, 20 nt, Artificial Sequence
  MKO10087838_B_Gm11596
  gRNA
cagcugggacugcagcaaga

SEQ ID NO: 87839 - RNA, 20 nt, Artificial Sequence
  MKO10087839_B_Gm11596
  gRNA
ugugauaguuccagcugcug

SEQ ID NO: 87840 - RNA, 20 nt, Artificial Sequence
  MKO10087840_B_Gm11596
  gRNA
uaggcuggcagcacagagac

SEQ ID NO: 87841 - RNA, 20 nt, Artificial Sequence
  MKO10087841_B_Gm11710
  gRNA
guucacguuaacuuuaaaca

SEQ ID NO: 87842 - RNA, 20 nt, Artificial Sequence
  MKO10087842_B_Gm11710
  gRNA
ggauccagucacagguccag

SEQ ID NO: 87843 - RNA, 20 nt, Artificial Sequence
  MKO10087843_B_Gm11710
  gRNA
auccacaguucugacaucca

SEQ ID NO: 87844 - RNA, 20 nt, Artificial Sequence
  MKO10087844_B_Gm11711
  gRNA
ggauccagucacagguccag

SEQ ID NO: 87845 - RNA, 20 nt, Artificial Sequence
  MKO10087845_B_Gm11711
  gRNA
gacacccacaacaccaacca

SEQ ID NO: 87846 - RNA, 20 nt, Artificial Sequence
  MKO10087846_B_Gm11711
  gRNA
agagagaguucugagucacc

SEQ ID NO: 87847 - RNA, 20 nt, Artificial Sequence
  MKO10087847_B_Gm11744
  gRNA
ggagugacggucuacuucac

SEQ ID NO: 87848 - RNA, 20 nt, Artificial Sequence
  MKO10087848_B_Gm11744
  gRNA
gacugucccguccacucugc

SEQ ID NO: 87849 - RNA, 20 nt, Artificial Sequence
  MKO10087849_B_Gm11744
  gRNA
caguuucucacgguuccacu

SEQ ID NO: 87850 - RNA, 20 nt, Artificial Sequence
  MKO10087850_B_Gm11757
  gRNA
caccuggcacauagccuccc

SEQ ID NO: 87851 - RNA, 20 nt, Artificial Sequence
  MKO10087851_B_Gm11757
  gRNA
cacucaggucuuugguuuga

SEQ ID NO: 87852 - RNA, 20 nt, Artificial Sequence
  MKO10087852_B_Gm11757
  gRNA
aaugugcauaccuggagaga

SEQ ID NO: 87853 - RNA, 20 nt, Artificial Sequence
  MKO10087853_B_Gm11758
  gRNA
caccuggcacauagccuccc

SEQ ID NO: 87854 - RNA, 20 nt, Artificial Sequence
  MKO10087854_B_Gm11758
  gRNA
cacucaggucuuugguuuga

SEQ ID NO: 87855 - RNA, 20 nt, Artificial Sequence
  MKO10087855_B_Gm11758
  gRNA
aaugugcauaccuggagaga

SEQ ID NO: 87856 - RNA, 20 nt, Artificial Sequence
  MKO10087856_B_Gm11780
  gRNA
ggguaaauucgguauguagc

SEQ ID NO: 87857 - RNA, 20 nt, Artificial Sequence
  MKO10087857_B_Gm11780
  gRNA
gcuaggaagggcacccgugc

SEQ ID NO: 87858 - RNA, 20 nt, Artificial Sequence
  MKO10087858_B_Gm11780
  gRNA
cccugaagcgcgacagugac

SEQ ID NO: 87859 - RNA, 20 nt, Artificial Sequence
  MKO10087859_B_Gm11837
  gRNA
agcacucaaugcuuacaaag

SEQ ID NO: 87860 - RNA, 20 nt, Artificial Sequence
  MKO10087860_B_Gm11837
  gRNA
ccauugucauaaagaccuug

SEQ ID NO: 87861 - RNA, 20 nt, Artificial Sequence
  MKO10087861_B_Gm11837
  gRNA
uguaagcauugagugcugca

SEQ ID NO: 87862 - RNA, 20 nt, Artificial Sequence
  MKO10087862_B_Gm11937
  gRNA
cagggcgacacacugugguc

SEQ ID NO: 87863 - RNA, 20 nt, Artificial Sequence
  MKO10087863_B_Gm11937
  gRNA
ggacacugggcggcagcagc

SEQ ID NO: 87864 - RNA, 20 nt, Artificial Sequence
  MKO10087864_B_Gm11937
  gRNA
ggucccugcagcagcagggc

SEQ ID NO: 87865 - RNA, 20 nt, Artificial Sequence
  MKO10087865_B_Gm11938
  gRNA
ccuggugcaauggggcacac

SEQ ID NO: 87866 - RNA, 20 nt, Artificial Sequence
  MKO10087866_B_Gm11938
  gRNA
accaugacaggcuccugcug

SEQ ID NO: 87867 - RNA, 20 nt, Artificial Sequence
  MKO10087867_B_Gm11938
  gRNA
gcucagcagcagguguugca

SEQ ID NO: 87868 - RNA, 20 nt, Artificial Sequence
  MKO10087868_B_Gm11992
  gRNA
ggucuccauaccagauuaca

SEQ ID NO: 87869 - RNA, 20 nt, Artificial Sequence
  MKO10087869_B_Gm11992
  gRNA
uagccuacucccugccagac

SEQ ID NO: 87870 - RNA, 20 nt, Artificial Sequence
  MKO10087870_B_Gm11992
  gRNA
cuguggugaauauaccaguc

SEQ ID NO: 87871 - RNA, 20 nt, Artificial Sequence
  MKO10087871_B_Gm12169
  gRNA
gaugcuaagccauuagacac

SEQ ID NO: 87872 - RNA, 20 nt, Artificial Sequence
  MKO10087872_B_Gm12169
  gRNA
ugacgucuucaaaccacccu

SEQ ID NO: 87873 - RNA, 20 nt, Artificial Sequence
  MKO10087873_B_Gm12169
  gRNA
cuuacaguauuauuauucca

SEQ ID NO: 87874 - RNA, 20 nt, Artificial Sequence
  MKO10087874_B_Gm12171
  gRNA
cccuuguguaagcacauccc

SEQ ID NO: 87875 - RNA, 20 nt, Artificial Sequence
  MKO10087875_B_Gm12171
  gRNA
ggaagucgggaggaguugaa

SEQ ID NO: 87876 - RNA, 20 nt, Artificial Sequence
  MKO10087876_B_Gm12171
  gRNA
gaaaaaagaagagucuagaa

SEQ ID NO: 87877 - RNA, 20 nt, Artificial Sequence
  MKO10087877_B_Gm12185
  gRNA
ucucaaagaacguuuccagc

SEQ ID NO: 87878 - RNA, 20 nt, Artificial Sequence
  MKO10087878_B_Gm12185
  gRNA
guucuuugagauuacuugaa

SEQ ID NO: 87879 - RNA, 20 nt, Artificial Sequence
  MKO10087879_B_Gm12185
  gRNA
ggauccuccuuugacauuuc

SEQ ID NO: 87880 - RNA, 20 nt, Artificial Sequence
  MKO10087880_B_Gm12250
  gRNA
ugcagacggaagcucuucac

SEQ ID NO: 87881 - RNA, 20 nt, Artificial Sequence
  MKO10087881_B_Gm12250
  gRNA
uuguccgccacagauucauu

SEQ ID NO: 87882 - RNA, 20 nt, Artificial Sequence
  MKO10087882_B_Gm12250
  gRNA
cuaaacccaguuccuacaau

SEQ ID NO: 87883 - RNA, 20 nt, Artificial Sequence
  MKO10087883_B_Gm12253
  gRNA
cccgugcacuuuaguaaaac

SEQ ID NO: 87884 - RNA, 20 nt, Artificial Sequence
  MKO10087884_B_Gm12253
  gRNA
cuguagcaaagagcccauua

SEQ ID NO: 87885 - RNA, 20 nt, Artificial Sequence
  MKO10087885_B_Gm12253
  gRNA
aaauuuaagauuauccguga

SEQ ID NO: 87886 - RNA, 20 nt, Artificial Sequence
  MKO10087886_B_Gm12429
  gRNA
caagugugucagaauuacca

SEQ ID NO: 87887 - RNA, 20 nt, Artificial Sequence
  MKO10087887_B_Gm12429
  gRNA
uuaagcgucaucaaaaaguc

SEQ ID NO: 87888 - RNA, 20 nt, Artificial Sequence
  MKO10087888_B_Gm12429
  gRNA
gcuaaagaugcagcgucaag

SEQ ID NO: 87889 - RNA, 20 nt, Artificial Sequence
  MKO10087889_B_Gm12597
  gRNA
caagagagccuugacccucc

SEQ ID NO: 87890 - RNA, 20 nt, Artificial Sequence
  MKO10087890_B_Gm12597
  gRNA
uagucuuccugggucagggg

SEQ ID NO: 87891 - RNA, 20 nt, Artificial Sequence
  MKO10087891_B_Gm12597
  gRNA
aagacuaccugcuggcugug

SEQ ID NO: 87892 - RNA, 20 nt, Artificial Sequence
  MKO10087892_B_Gm12657
  gRNA
ucuuauuaacagccacuaaa

SEQ ID NO: 87893 - RNA, 20 nt, Artificial Sequence
  MKO10087893_B_Gm12657
  gRNA
uaacucacccaggaaacaac

SEQ ID NO: 87894 - RNA, 20 nt, Artificial Sequence
  MKO10087894_B_Gm12657
  gRNA
uuaaauguuuccccucauag

SEQ ID NO: 87895 - RNA, 20 nt, Artificial Sequence
  MKO10087895_B_Gm12695
  gRNA
cagcuggauauaguaacuca

SEQ ID NO: 87896 - RNA, 20 nt, Artificial Sequence
  MKO10087896_B_Gm12695
  gRNA
aacugcuaacccagcugaga

SEQ ID NO: 87897 - RNA, 20 nt, Artificial Sequence
  MKO10087897_B_Gm12695
  gRNA
uaaccagaguauucaguaac

SEQ ID NO: 87898 - RNA, 20 nt, Artificial Sequence
  MKO10087898_B_Gm12789
  gRNA
uugcagcaucuccacaccag

SEQ ID NO: 87899 - RNA, 20 nt, Artificial Sequence
  MKO10087899_B_Gm12789
  gRNA
ugcacaguuaucaaacugac

SEQ ID NO: 87900 - RNA, 20 nt, Artificial Sequence
  MKO10087900_B_Gm12789
  gRNA
aaggugcaagcuucaagugu

SEQ ID NO: 87901 - RNA, 20 nt, Artificial Sequence
  MKO10087901_B_Gm12794
  gRNA
augcugcaagcugugcucga

SEQ ID NO: 87902 - RNA, 20 nt, Artificial Sequence
  MKO10087902_B_Gm12794
  gRNA
cuucucuuugcugccaacaa

SEQ ID NO: 87903 - RNA, 20 nt, Artificial Sequence
  MKO10087903_B_Gm12794
  gRNA
uagaugccugaagagccccu

SEQ ID NO: 87904 - RNA, 20 nt, Artificial Sequence
  MKO10087904_B_Gm12886
  gRNA
ccagugcucaagacugcaac

SEQ ID NO: 87905 - RNA, 20 nt, Artificial Sequence
  MKO10087905_B_Gm12886
  gRNA
ucuaacgaaacaccgaaauc

SEQ ID NO: 87906 - RNA, 20 nt, Artificial Sequence
  MKO10087906_B_Gm12886
  gRNA
ugcaccauggcuacauucuu

SEQ ID NO: 87907 - RNA, 20 nt, Artificial Sequence
  MKO10087907_B_Gm12887
  gRNA
ggauguggagaauaaagucc

SEQ ID NO: 87908 - RNA, 20 nt, Artificial Sequence
  MKO10087908_B_Gm12887
  gRNA
cauuguuguugcauacuuua

SEQ ID NO: 87909 - RNA, 20 nt, Artificial Sequence
  MKO10087909_B_Gm12887
  gRNA
ucuucccauccuguagagcc

SEQ ID NO: 87910 - RNA, 20 nt, Artificial Sequence
  MKO10087910_B_Gm12888
  gRNA
cauuguuagggcauacuuua

SEQ ID NO: 87911 - RNA, 20 nt, Artificial Sequence
  MKO10087911_B_Gm12888
  gRNA
gagcaagacucugacauacu

SEQ ID NO: 87912 - RNA, 20 nt, Artificial Sequence
  MKO10087912_B_Gm12888
  gRNA
ucauggaaaccacgaucaua

SEQ ID NO: 87913 - RNA, 20 nt, Artificial Sequence
  MKO10087913_B_Gm128
  gRNA
cuuucugggcgccuucgagu

SEQ ID NO: 87914 - RNA, 20 nt, Artificial Sequence
  MKO10087914_B_Gm128
  gRNA
uagcggucgggguagucguu

SEQ ID NO: 87915 - RNA, 20 nt, Artificial Sequence
  MKO10087915_B_Gm128
  gRNA
gacccgcugcaucccaaucg

SEQ ID NO: 87916 - RNA, 20 nt, Artificial Sequence
  MKO10087916_B_Gm12942
  gRNA
gcucuugauccuacucauga

SEQ ID NO: 87917 - RNA, 20 nt, Artificial Sequence
  MKO10087917_B_Gm12942
  gRNA
aagacucaauugccgugugc

SEQ ID NO: 87918 - RNA, 20 nt, Artificial Sequence
  MKO10087918_B_Gm12942
  gRNA
ugguagccgaacaccuucaa

SEQ ID NO: 87919 - RNA, 20 nt, Artificial Sequence
  MKO10087919_B_Gm129
  gRNA
uaggcaggacaggcggacau

SEQ ID NO: 87920 - RNA, 20 nt, Artificial Sequence
  MKO10087920_B_Gm129
  gRNA
uucagaucaccagggacgac

SEQ ID NO: 87921 - RNA, 20 nt, Artificial Sequence
  MKO10087921_B_Gm129
  gRNA
cuacaguguaaagaacucca

SEQ ID NO: 87922 - RNA, 20 nt, Artificial Sequence
  MKO10087922_B_Gm12
  gRNA
ccgccucccugguguuuacc

SEQ ID NO: 87923 - RNA, 20 nt, Artificial Sequence
  MKO10087923_B_Gm12
  gRNA
aacagacauuccgcugcagc

SEQ ID NO: 87924 - RNA, 20 nt, Artificial Sequence
  MKO10087924_B_Gm12
  gRNA
cgacacccgaaagcuuuacc

SEQ ID NO: 87925 - RNA, 20 nt, Artificial Sequence
  MKO10087925_B_Gm13011
  gRNA
aacuccgaaugugugaacug

SEQ ID NO: 87926 - RNA, 20 nt, Artificial Sequence
  MKO10087926_B_Gm13011
  gRNA
ucccacccaucucauacuga

SEQ ID NO: 87927 - RNA, 20 nt, Artificial Sequence
  MKO10087927_B_Gm13011
  gRNA
ucaccucuagccucaggcug

SEQ ID NO: 87928 - RNA, 20 nt, Artificial Sequence
  MKO10087928_B_Gm13023
  gRNA
cuucuaugcagauacgucuu

SEQ ID NO: 87929 - RNA, 20 nt, Artificial Sequence
  MKO10087929_B_Gm13023
  gRNA
gagaucaugacuugaacuua

SEQ ID NO: 87930 - RNA, 20 nt, Artificial Sequence
  MKO10087930_B_Gm13023
  gRNA
gacuuugaaggcuauccuug

SEQ ID NO: 87931 - RNA, 20 nt, Artificial Sequence
  MKO10087931_B_Gm13040
  gRNA
acacgagcaauucauucaug

SEQ ID NO: 87932 - RNA, 20 nt, Artificial Sequence
  MKO10087932_B_Gm13040
  gRNA
aaagaggaagcuucaagugc

SEQ ID NO: 87933 - RNA, 20 nt, Artificial Sequence
  MKO10087933_B_Gm13040
  gRNA
cuccuauuuacuggcaacaa

SEQ ID NO: 87934 - RNA, 20 nt, Artificial Sequence
  MKO10087934_B_Gm13043
  gRNA
aaagaggaagcuucaagugc

SEQ ID NO: 87935 - RNA, 20 nt, Artificial Sequence
  MKO10087935_B_Gm13043
  gRNA
cuccuauuuacuggcaacaa

SEQ ID NO: 87936 - RNA, 20 nt, Artificial Sequence
  MKO10087936_B_Gm13043
  gRNA
uaggugucugaagacuccgc

SEQ ID NO: 87937 - RNA, 20 nt, Artificial Sequence
  MKO10087937_B_Gm13051
  gRNA
ucacauacauucuauuugua

SEQ ID NO: 87938 - RNA, 20 nt, Artificial Sequence
  MKO10087938_B_Gm13051
  gRNA
ucagaaaaucauugcauacg

SEQ ID NO: 87939 - RNA, 20 nt, Artificial Sequence
  MKO10087939_B_Gm13051
  gRNA
cguggccuuggacuucucac

SEQ ID NO: 87940 - RNA, 20 nt, Artificial Sequence
  MKO10087940_B_Gm13057
  gRNA
acacgagcaauucauucaug

SEQ ID NO: 87941 - RNA, 20 nt, Artificial Sequence
  MKO10087941_B_Gm13057
  gRNA
aaagaggaagcuucaagugc

SEQ ID NO: 87942 - RNA, 20 nt, Artificial Sequence
  MKO10087942_B_Gm13057
  gRNA
cuccuauuuacuggcaacaa

SEQ ID NO: 87943 - RNA, 20 nt, Artificial Sequence
  MKO10087943_B_Gm13078
  gRNA
uguucuguagcaacuucuuc

SEQ ID NO: 87944 - RNA, 20 nt, Artificial Sequence
  MKO10087944_B_Gm13078
  gRNA
ccugaugaagauuccucacc

SEQ ID NO: 87945 - RNA, 20 nt, Artificial Sequence
  MKO10087945_B_Gm13078
  gRNA
caaaguugcaaaaaucuguc

SEQ ID NO: 87946 - RNA, 20 nt, Artificial Sequence
  MKO10087946_B_Gm13083
  gRNA
acccuugccucgcuagcccc

SEQ ID NO: 87947 - RNA, 20 nt, Artificial Sequence
  MKO10087947_B_Gm13083
  gRNA
aggucccaaggccuauccca

SEQ ID NO: 87948 - RNA, 20 nt, Artificial Sequence
  MKO10087948_B_Gm13083
  gRNA
uuucagauaugcagaugaua

SEQ ID NO: 87949 - RNA, 20 nt, Artificial Sequence
  MKO10087949_B_Gm13084
  gRNA
guagauugcucaucuguuuc

SEQ ID NO: 87950 - RNA, 20 nt, Artificial Sequence
  MKO10087950_B_Gm13084
  gRNA
caggugccuaaggaagcccu

SEQ ID NO: 87951 - RNA, 20 nt, Artificial Sequence
  MKO10087951_B_Gm13084
  gRNA
cuguuaucauagcacuccug

SEQ ID NO: 87952 - RNA, 20 nt, Artificial Sequence
  MKO10087952_B_Gm13088
  gRNA
guuuggcccugagcauaucc

SEQ ID NO: 87953 - RNA, 20 nt, Artificial Sequence
  MKO10087953_B_Gm13088
  gRNA
aaugcacaggcuacugagag

SEQ ID NO: 87954 - RNA, 20 nt, Artificial Sequence
  MKO10087954_B_Gm13088
  gRNA
ugaaagccaugauaccugag

SEQ ID NO: 87955 - RNA, 20 nt, Artificial Sequence
  MKO10087955_B_Gm13102
  gRNA
uccuuucuuaccugagcauu

SEQ ID NO: 87956 - RNA, 20 nt, Artificial Sequence
  MKO10087956_B_Gm13102
  gRNA
ugauuugcgagaugcccacc

SEQ ID NO: 87957 - RNA, 20 nt, Artificial Sequence
  MKO10087957_B_Gm13102
  gRNA
ccacgaccucuccuucuuaa

SEQ ID NO: 87958 - RNA, 20 nt, Artificial Sequence
  MKO10087958_B_Gm13103
  gRNA
uucucuuugccuacaagauc

SEQ ID NO: 87959 - RNA, 20 nt, Artificial Sequence
  MKO10087959_B_Gm13103
  gRNA
uugcacaaaagcuucacucc

SEQ ID NO: 87960 - RNA, 20 nt, Artificial Sequence
  MKO10087960_B_Gm13103
  gRNA
uguguauugccagcuucagc

SEQ ID NO: 87961 - RNA, 20 nt, Artificial Sequence
  MKO10087961_B_Gm13119
  gRNA
ugaacauacuucgcacuguu

SEQ ID NO: 87962 - RNA, 20 nt, Artificial Sequence
  MKO10087962_B_Gm13119
  gRNA
augcaucaggaugagcuucc

SEQ ID NO: 87963 - RNA, 20 nt, Artificial Sequence
  MKO10087963_B_Gm13119
  gRNA
gcuugcaauacugucauguc

SEQ ID NO: 87964 - RNA, 20 nt, Artificial Sequence
  MKO10087964_B_Gm13124
  gRNA
accuccucuggcccccggaa

SEQ ID NO: 87965 - RNA, 20 nt, Artificial Sequence
  MKO10087965_B_Gm13124
  gRNA
uuaccaaugcuauugucagc

SEQ ID NO: 87966 - RNA, 20 nt, Artificial Sequence
  MKO10087966_B_Gm13124
  gRNA
ugagacagauucggugguaa

SEQ ID NO: 87967 - RNA, 20 nt, Artificial Sequence
  MKO10087967_B_Gm13125
  gRNA
gugguguaguagguccuuca

SEQ ID NO: 87968 - RNA, 20 nt, Artificial Sequence
  MKO10087968_B_Gm13125
  gRNA
uaaguacugcaaagcgcuga

SEQ ID NO: 87969 - RNA, 20 nt, Artificial Sequence
  MKO10087969_B_Gm13125
  gRNA
augguacuccccucaugcaa

SEQ ID NO: 87970 - RNA, 20 nt, Artificial Sequence
  MKO10087970_B_Gm13128
  gRNA
acguguaucacagucauaac

SEQ ID NO: 87971 - RNA, 20 nt, Artificial Sequence
  MKO10087971_B_Gm13128
  gRNA
uauaccugagaagcaagaag

SEQ ID NO: 87972 - RNA, 20 nt, Artificial Sequence
  MKO10087972_B_Gm13128
  gRNA
cccacccacucuccugcagc

SEQ ID NO: 87973 - RNA, 20 nt, Artificial Sequence
  MKO10087973_B_Gm13139
  gRNA
cuccuguaugaauucucuga

SEQ ID NO: 87974 - RNA, 20 nt, Artificial Sequence
  MKO10087974_B_Gm13139
  gRNA
ucagaaaaucauugcauaug

SEQ ID NO: 87975 - RNA, 20 nt, Artificial Sequence
  MKO10087975_B_Gm13139
  gRNA
cguggccuuggacuucucac

SEQ ID NO: 87976 - RNA, 20 nt, Artificial Sequence
  MKO10087976_B_Gm13152
  gRNA
uuccuccagugagaauucca

SEQ ID NO: 87977 - RNA, 20 nt, Artificial Sequence
  MKO10087977_B_Gm13152
  gRNA
aacaagaaugaguguguguc

SEQ ID NO: 87978 - RNA, 20 nt, Artificial Sequence
  MKO10087978_B_Gm13152
  gRNA
cauuucauaugugcaaagug

SEQ ID NO: 87979 - RNA, 20 nt, Artificial Sequence
  MKO10087979_B_Gm13154
  gRNA
acuguacauugaugugaugu

SEQ ID NO: 87980 - RNA, 20 nt, Artificial Sequence
  MKO10087980_B_Gm13154
  gRNA
uuccuccagugagaagucca

SEQ ID NO: 87981 - RNA, 20 nt, Artificial Sequence
  MKO10087981_B_Gm13154
  gRNA
aucccaucuuaauauucauc

SEQ ID NO: 87982 - RNA, 20 nt, Artificial Sequence
  MKO10087982_B_Gm13157
  gRNA
ccagggucuguuaaccuuca

SEQ ID NO: 87983 - RNA, 20 nt, Artificial Sequence
  MKO10087983_B_Gm13157
  gRNA
ucagaaaaucauugcauaca

SEQ ID NO: 87984 - RNA, 20 nt, Artificial Sequence
  MKO10087984_B_Gm13157
  gRNA
uuccuccagugagaaguaca

SEQ ID NO: 87985 - RNA, 20 nt, Artificial Sequence
  MKO10087985_B_Gm13177
  gRNA
gguagaaaauaaugccucga

SEQ ID NO: 87986 - RNA, 20 nt, Artificial Sequence
  MKO10087986_B_Gm13177
  gRNA
gcucauuacuccaaguaugc

SEQ ID NO: 87987 - RNA, 20 nt, Artificial Sequence
  MKO10087987_B_Gm13177
  gRNA
aaauugaucgccugcauacu

SEQ ID NO: 87988 - RNA, 20 nt, Artificial Sequence
  MKO10087988_B_Gm13178
  gRNA
aggugccguauguggaaguc

SEQ ID NO: 87989 - RNA, 20 nt, Artificial Sequence
  MKO10087989_B_Gm13178
  gRNA
cuuacccagacuuccacaua

SEQ ID NO: 87990 - RNA, 20 nt, Artificial Sequence
  MKO10087990_B_Gm13178
  gRNA
agggcugcucacauucuucc

SEQ ID NO: 87991 - RNA, 20 nt, Artificial Sequence
  MKO10087991_B_Gm13212
  gRNA
ucucugaugaauauuaagau

SEQ ID NO: 87992 - RNA, 20 nt, Artificial Sequence
  MKO10087992_B_Gm13212
  gRNA
ucagaaaaucauugcauaug

SEQ ID NO: 87993 - RNA, 20 nt, Artificial Sequence
  MKO10087993_B_Gm13212
  gRNA
ucacauguaaacuauuugua

SEQ ID NO: 87994 - RNA, 20 nt, Artificial Sequence
  MKO10087994_B_Gm1322
  gRNA
caugccugauguccauuagu

SEQ ID NO: 87995 - RNA, 20 nt, Artificial Sequence
  MKO10087995_B_Gm1322
  gRNA
auaagcugcuugugcaaacc

SEQ ID NO: 87996 - RNA, 20 nt, Artificial Sequence
  MKO10087996_B_Gm1322
  gRNA
ucugauacauguuguguuga

SEQ ID NO: 87997 - RNA, 20 nt, Artificial Sequence
  MKO10087997_B_Gm13242
  gRNA
uuugcuccucaccaagaauc

SEQ ID NO: 87998 - RNA, 20 nt, Artificial Sequence
  MKO10087998_B_Gm13242
  gRNA
guccaaaaacacguccuuga

SEQ ID NO: 87999 - RNA, 20 nt, Artificial Sequence
  MKO10087999_B_Gm13242
  gRNA
acagugucuauuaaccuuca

SEQ ID NO: 88000 - RNA, 20 nt, Artificial Sequence
  MKO10088000_B_Gm13247
  gRNA
auuggaauguggcaucucuu

SEQ ID NO: 88001 - RNA, 20 nt, Artificial Sequence
  MKO10088001_B_Gm13247
  gRNA
ucuguuaaccuucaacgaug

SEQ ID NO: 88002 - RNA, 20 nt, Artificial Sequence
  MKO10088002_B_Gm13247
  gRNA
cuguggaggguuuaccagag

SEQ ID NO: 88003 - RNA, 20 nt, Artificial Sequence
  MKO10088003_B_Gm13251
  gRNA
ucacauacaaacuauuugua

SEQ ID NO: 88004 - RNA, 20 nt, Artificial Sequence
  MKO10088004_B_Gm13251
  gRNA
ucagaaaaucauugcauaug

SEQ ID NO: 88005 - RNA, 20 nt, Artificial Sequence
  MKO10088005_B_Gm13251
  gRNA
cguggccuuggacuucucac

SEQ ID NO: 88006 - RNA, 20 nt, Artificial Sequence
  MKO10088006_B_Gm13271
  gRNA
gucaucagugccugcgggac

SEQ ID NO: 88007 - RNA, 20 nt, Artificial Sequence
  MKO10088007_B_Gm13271
  gRNA
aguguucuuccgcuaucuga

SEQ ID NO: 88008 - RNA, 20 nt, Artificial Sequence
  MKO10088008_B_Gm13271
  gRNA
acugaugacccggcacgcuu

SEQ ID NO: 88009 - RNA, 20 nt, Artificial Sequence
  MKO10088009_B_Gm13272
  gRNA
ggaggaccugccugaggguc

SEQ ID NO: 88010 - RNA, 20 nt, Artificial Sequence
  MKO10088010_B_Gm13272
  gRNA
gcagagcugccuggcacgag

SEQ ID NO: 88011 - RNA, 20 nt, Artificial Sequence
  MKO10088011_B_Gm13272
  gRNA
gugguuucucccagagucau

SEQ ID NO: 88012 - RNA, 20 nt, Artificial Sequence
  MKO10088012_B_Gm13275
  gRNA
gcagagcugccuggcacgag

SEQ ID NO: 88013 - RNA, 20 nt, Artificial Sequence
  MKO10088013_B_Gm13275
  gRNA
gugguuucucccagagucau

SEQ ID NO: 88014 - RNA, 20 nt, Artificial Sequence
  MKO10088014_B_Gm13275
  gRNA
accagcuacuaucuagccug

SEQ ID NO: 88015 - RNA, 20 nt, Artificial Sequence
  MKO10088015_B_Gm13276
  gRNA
gcagagcugccuggcacgag

SEQ ID NO: 88016 - RNA, 20 nt, Artificial Sequence
  MKO10088016_B_Gm13276
  gRNA
gauguuaguuccuuccuucc

SEQ ID NO: 88017 - RNA, 20 nt, Artificial Sequence
  MKO10088017_B_Gm13276
  gRNA
accagcuacuaucuagccug

SEQ ID NO: 88018 - RNA, 20 nt, Artificial Sequence
  MKO10088018_B_Gm13277
  gRNA
gcagagcugccuggcacgag

SEQ ID NO: 88019 - RNA, 20 nt, Artificial Sequence
  MKO10088019_B_Gm13277
  gRNA
gugguuucucccagagucau

SEQ ID NO: 88020 - RNA, 20 nt, Artificial Sequence
  MKO10088020_B_Gm13277
  gRNA
accagcuacuaucuagccug

SEQ ID NO: 88021 - RNA, 20 nt, Artificial Sequence
  MKO10088021_B_Gm13278
  gRNA
gcagagcugccuggcacgag

SEQ ID NO: 88022 - RNA, 20 nt, Artificial Sequence
  MKO10088022_B_Gm13278
  gRNA
gugguuucucccagagucau

SEQ ID NO: 88023 - RNA, 20 nt, Artificial Sequence
  MKO10088023_B_Gm13278
  gRNA
accagcuacuaucuagccug

SEQ ID NO: 88024 - RNA, 20 nt, Artificial Sequence
  MKO10088024_B_Gm13279
  gRNA
gcagagcugccuggcacgag

SEQ ID NO: 88025 - RNA, 20 nt, Artificial Sequence
  MKO10088025_B_Gm13279
  gRNA
gugguuucucccagagucau

SEQ ID NO: 88026 - RNA, 20 nt, Artificial Sequence
  MKO10088026_B_Gm13279
  gRNA
accagcuacuaucuagccug

SEQ ID NO: 88027 - RNA, 20 nt, Artificial Sequence
  MKO10088027_B_Gm13280
  gRNA
cauuuguaucaagaguguca

SEQ ID NO: 88028 - RNA, 20 nt, Artificial Sequence
  MKO10088028_B_Gm13280
  gRNA
ugacacucuugauacaaaug

SEQ ID NO: 88029 - RNA, 20 nt, Artificial Sequence
  MKO10088029_B_Gm13280
  gRNA
ucaucacagccagaaccauc

SEQ ID NO: 88030 - RNA, 20 nt, Artificial Sequence
  MKO10088030_B_Gm13283
  gRNA
gcugccugugcaucuauucc

SEQ ID NO: 88031 - RNA, 20 nt, Artificial Sequence
  MKO10088031_B_Gm13283
  gRNA
ggaggaccugccugaggcuc

SEQ ID NO: 88032 - RNA, 20 nt, Artificial Sequence
  MKO10088032_B_Gm13283
  gRNA
gcagagcugccuggcacgag

SEQ ID NO: 88033 - RNA, 20 nt, Artificial Sequence
  MKO10088033_B_Gm13285
  gRNA
gcagagcugccuggcacgag

SEQ ID NO: 88034 - RNA, 20 nt, Artificial Sequence
  MKO10088034_B_Gm13285
  gRNA
gugguuucucccagagucau

SEQ ID NO: 88035 - RNA, 20 nt, Artificial Sequence
  MKO10088035_B_Gm13285
  gRNA
accagcuacuaucuagccug

SEQ ID NO: 88036 - RNA, 20 nt, Artificial Sequence
  MKO10088036_B_Gm13286
  gRNA
gggccucaucucgcagacag

SEQ ID NO: 88037 - RNA, 20 nt, Artificial Sequence
  MKO10088037_B_Gm13286
  gRNA
gcugccugugcaucuauucc

SEQ ID NO: 88038 - RNA, 20 nt, Artificial Sequence
  MKO10088038_B_Gm13286
  gRNA
ggaggacaugccugaggguc

SEQ ID NO: 88039 - RNA, 20 nt, Artificial Sequence
  MKO10088039_B_Gm13287
  gRNA
gcagagcugccuggcacgag

SEQ ID NO: 88040 - RNA, 20 nt, Artificial Sequence
  MKO10088040_B_Gm13287
  gRNA
gugguuucucccagagucau

SEQ ID NO: 88041 - RNA, 20 nt, Artificial Sequence
  MKO10088041_B_Gm13287
  gRNA
accagcuacuaucuagccug

SEQ ID NO: 88042 - RNA, 20 nt, Artificial Sequence
  MKO10088042_B_Gm13288
  gRNA
gcagagcugccuggcacgag

SEQ ID NO: 88043 - RNA, 20 nt, Artificial Sequence
  MKO10088043_B_Gm13288
  gRNA
gugguuucucccagagucau

SEQ ID NO: 88044 - RNA, 20 nt, Artificial Sequence
  MKO10088044_B_Gm13288
  gRNA
accagcuacuaucuagccug

SEQ ID NO: 88045 - RNA, 20 nt, Artificial Sequence
  MKO10088045_B_Gm13289
  gRNA
gcagagcugccuggcacgag

SEQ ID NO: 88046 - RNA, 20 nt, Artificial Sequence
  MKO10088046_B_Gm13289
  gRNA
gugguuucucccagagucau

SEQ ID NO: 88047 - RNA, 20 nt, Artificial Sequence
  MKO10088047_B_Gm13289
  gRNA
accagcuacuaucuagccug

SEQ ID NO: 88048 - RNA, 20 nt, Artificial Sequence
  MKO10088048_B_Gm13290
  gRNA
gcagagcugccuggcacgag

SEQ ID NO: 88049 - RNA, 20 nt, Artificial Sequence
  MKO10088049_B_Gm13290
  gRNA
gugguuucucccagagucau

SEQ ID NO: 88050 - RNA, 20 nt, Artificial Sequence
  MKO10088050_B_Gm13290
  gRNA
accagcuacuaucuagccug

SEQ ID NO: 88051 - RNA, 20 nt, Artificial Sequence
  MKO10088051_B_Gm13304
  gRNA
uaccuugcaggcagugaugg

SEQ ID NO: 88052 - RNA, 20 nt, Artificial Sequence
  MKO10088052_B_Gm13304
  gRNA
gccucaccucuugcagcccu

SEQ ID NO: 88053 - RNA, 20 nt, Artificial Sequence
  MKO10088053_B_Gm13304
  gRNA
caacccucagguucuuaccc

SEQ ID NO: 88054 - RNA, 20 nt, Artificial Sequence
  MKO10088054_B_Gm13305
  gRNA
cuaacucacagcccagcuuc

SEQ ID NO: 88055 - RNA, 20 nt, Artificial Sequence
  MKO10088055_B_Gm13305
  gRNA
uccugaagucucuugccaag

SEQ ID NO: 88056 - RNA, 20 nt, Artificial Sequence
  MKO10088056_B_Gm13305
  gRNA
acacauaccuguaggaagua

SEQ ID NO: 88057 - RNA, 20 nt, Artificial Sequence
  MKO10088057_B_Gm13306
  gRNA
gcugagugagcaugauggag

SEQ ID NO: 88058 - RNA, 20 nt, Artificial Sequence
  MKO10088058_B_Gm13306
  gRNA
gcagagcucacacgacagcc

SEQ ID NO: 88059 - RNA, 20 nt, Artificial Sequence
  MKO10088059_B_Gm13306
  gRNA
auagacagccacucccaagc

SEQ ID NO: 88060 - RNA, 20 nt, Artificial Sequence
  MKO10088060_B_Gm13308
  gRNA
ugucuuugcaggaucuacug

SEQ ID NO: 88061 - RNA, 20 nt, Artificial Sequence
  MKO10088061_B_Gm13308
  gRNA
acuuuaaaucuuuaaugcac

SEQ ID NO: 88062 - RNA, 20 nt, Artificial Sequence
  MKO10088062_B_Gm13308
  gRNA
ccuacagcucggcgcacccc

SEQ ID NO: 88063 - RNA, 20 nt, Artificial Sequence
  MKO10088063_B_Gm13547
  gRNA
cgacuaaugagaucagcauc

SEQ ID NO: 88064 - RNA, 20 nt, Artificial Sequence
  MKO10088064_B_Gm13547
  gRNA
ccuugugucugagauaccac

SEQ ID NO: 88065 - RNA, 20 nt, Artificial Sequence
  MKO10088065_B_Gm13547
  gRNA
ccugugguaucucagacaca

SEQ ID NO: 88066 - RNA, 20 nt, Artificial Sequence
  MKO10088066_B_Gm136
  gRNA
guuucgagagacuguguuca

SEQ ID NO: 88067 - RNA, 20 nt, Artificial Sequence
  MKO10088067_B_Gm136
  gRNA
cacagcugcagaacagcgua

SEQ ID NO: 88068 - RNA, 20 nt, Artificial Sequence
  MKO10088068_B_Gm136
  gRNA
ucggauccagaggauuauga

SEQ ID NO: 88069 - RNA, 20 nt, Artificial Sequence
  MKO10088069_B_Gm13718
  gRNA
uccccacaggaaucugaacc

SEQ ID NO: 88070 - RNA, 20 nt, Artificial Sequence
  MKO10088070_B_Gm13718
  gRNA
aaaaagaacgcacaguugua

SEQ ID NO: 88071 - RNA, 20 nt, Artificial Sequence
  MKO10088071_B_Gm13718
  gRNA
aaaacacaccacucugcugc

SEQ ID NO: 88072 - RNA, 20 nt, Artificial Sequence
  MKO10088072_B_Gm13769
  gRNA
guguacaguccuuguaggaa

SEQ ID NO: 88073 - RNA, 20 nt, Artificial Sequence
  MKO10088073_B_Gm13769
  gRNA
agcggaagaugagaagaacu

SEQ ID NO: 88074 - RNA, 20 nt, Artificial Sequence
  MKO10088074_B_Gm13769
  gRNA
aucuuccgcuugcccuucug

SEQ ID NO: 88075 - RNA, 20 nt, Artificial Sequence
  MKO10088075_B_Gm13826
  gRNA
acaccacacacacgcacugc

SEQ ID NO: 88076 - RNA, 20 nt, Artificial Sequence
  MKO10088076_B_Gm13826
  gRNA
gggaggcuggcauccuugug

SEQ ID NO: 88077 - RNA, 20 nt, Artificial Sequence
  MKO10088077_B_Gm13826
  gRNA
ucugccugccucugccuccc

SEQ ID NO: 88078 - RNA, 20 nt, Artificial Sequence
  MKO10088078_B_Gm13871
  gRNA
caccuggcacauagccuccc

SEQ ID NO: 88079 - RNA, 20 nt, Artificial Sequence
  MKO10088079_B_Gm13871
  gRNA
cacucaggucuuugguuuga

SEQ ID NO: 88080 - RNA, 20 nt, Artificial Sequence
  MKO10088080_B_Gm13871
  gRNA
aaugugcauaccuggagaga

SEQ ID NO: 88081 - RNA, 20 nt, Artificial Sequence
  MKO10088081_B_Gm13889
  gRNA
accgccucacagggccgagu

SEQ ID NO: 88082 - RNA, 20 nt, Artificial Sequence
  MKO10088082_B_Gm13889
  gRNA
gaccgaugaguucccgcagc

SEQ ID NO: 88083 - RNA, 20 nt, Artificial Sequence
  MKO10088083_B_Gm13889
  gRNA
cgcugucgccguguaccccg

SEQ ID NO: 88084 - RNA, 20 nt, Artificial Sequence
  MKO10088084_B_Gm14085
  gRNA
ugguucucgacacagcucaa

SEQ ID NO: 88085 - RNA, 20 nt, Artificial Sequence
  MKO10088085_B_Gm14085
  gRNA
cgagaaccagccacaagauc

SEQ ID NO: 88086 - RNA, 20 nt, Artificial Sequence
  MKO10088086_B_Gm14085
  gRNA
aaugacccaagccauccucc

SEQ ID NO: 88087 - RNA, 20 nt, Artificial Sequence
  MKO10088087_B_Gm14092
  gRNA
gauccuuaaagugcacaaua

SEQ ID NO: 88088 - RNA, 20 nt, Artificial Sequence
  MKO10088088_B_Gm14092
  gRNA
gaugcaauuuccacucuacc

SEQ ID NO: 88089 - RNA, 20 nt, Artificial Sequence
  MKO10088089_B_Gm14092
  gRNA
uuuccauauugugcacuuua

SEQ ID NO: 88090 - RNA, 20 nt, Artificial Sequence
  MKO10088090_B_Gm14124
  gRNA
auauuucuagaagauaugaa

SEQ ID NO: 88091 - RNA, 20 nt, Artificial Sequence
  MKO10088091_B_Gm14124
  gRNA
uauagcagcgagauuccugu

SEQ ID NO: 88092 - RNA, 20 nt, Artificial Sequence
  MKO10088092_B_Gm14124
  gRNA
augugcaugugaacuucacu

SEQ ID NO: 88093 - RNA, 20 nt, Artificial Sequence
  MKO10088093_B_Gm14137
  gRNA
acggccggcgucugcccuug

SEQ ID NO: 88094 - RNA, 20 nt, Artificial Sequence
  MKO10088094_B_Gm14137
  gRNA
gcggaaggagccuuuccgcc

SEQ ID NO: 88095 - RNA, 20 nt, Artificial Sequence
  MKO10088095_B_Gm14137
  gRNA
gcauccccgagccacccuac

SEQ ID NO: 88096 - RNA, 20 nt, Artificial Sequence
  MKO10088096_B_Gm14139
  gRNA
uaugaauucuuucuugucuu

SEQ ID NO: 88097 - RNA, 20 nt, Artificial Sequence
  MKO10088097_B_Gm14139
  gRNA
ucccucagagcacccagcag

SEQ ID NO: 88098 - RNA, 20 nt, Artificial Sequence
  MKO10088098_B_Gm14139
  gRNA
ucucuacaaagaagugaugc

SEQ ID NO: 88099 - RNA, 20 nt, Artificial Sequence
  MKO10088099_B_Gm14151
  gRNA
cucacccuuggccuccuucc

SEQ ID NO: 88100 - RNA, 20 nt, Artificial Sequence
  MKO10088100_B_Gm14151
  gRNA
aauguaaagcuuacugauuu

SEQ ID NO: 88101 - RNA, 20 nt, Artificial Sequence
  MKO10088101_B_Gm14151
  gRNA
acccagcuguagucacaaug

SEQ ID NO: 88102 - RNA, 20 nt, Artificial Sequence
  MKO10088102_B_Gm14288
  gRNA
uuccaugacuucuagaaguu

SEQ ID NO: 88103 - RNA, 20 nt, Artificial Sequence
  MKO10088103_B_Gm14288
  gRNA
ucucagaagagucucuacaa

SEQ ID NO: 88104 - RNA, 20 nt, Artificial Sequence
  MKO10088104_B_Gm14288
  gRNA
guucacaugcacgucaucau

SEQ ID NO: 88105 - RNA, 20 nt, Artificial Sequence
  MKO10088105_B_Gm14295
  gRNA
acuggguuuagguuacauuu

SEQ ID NO: 88106 - RNA, 20 nt, Artificial Sequence
  MKO10088106_B_Gm14295
  gRNA
agucaccuaugaugacgugc

SEQ ID NO: 88107 - RNA, 20 nt, Artificial Sequence
  MKO10088107_B_Gm14295
  gRNA
uuguagagacucuucugaga

SEQ ID NO: 88108 - RNA, 20 nt, Artificial Sequence
  MKO10088108_B_Gm14305
  gRNA
gacuucgagaaguuugaaaa

SEQ ID NO: 88109 - RNA, 20 nt, Artificial Sequence
  MKO10088109_B_Gm14305
  gRNA
acuggguuuagguuacauuu

SEQ ID NO: 88110 - RNA, 20 nt, Artificial Sequence
  MKO10088110_B_Gm14305
  gRNA
cuccuguauguguucgcuua

SEQ ID NO: 88111 - RNA, 20 nt, Artificial Sequence
  MKO10088111_B_Gm14306
  gRNA
cgugcaugugaacuucacuc

SEQ ID NO: 88112 - RNA, 20 nt, Artificial Sequence
  MKO10088112_B_Gm14306
  gRNA
uuccaagacuucuagaaguu

SEQ ID NO: 88113 - RNA, 20 nt, Artificial Sequence
  MKO10088113_B_Gm14306
  gRNA
acuguguuuagguuacaguu

SEQ ID NO: 88114 - RNA, 20 nt, Artificial Sequence
  MKO10088114_B_Gm14308
  gRNA
gacuucuagaaguuugaaaa

SEQ ID NO: 88115 - RNA, 20 nt, Artificial Sequence
  MKO10088115_B_Gm14308
  gRNA
cccucugaguuuauucaaug

SEQ ID NO: 88116 - RNA, 20 nt, Artificial Sequence
  MKO10088116_B_Gm14308
  gRNA
cuccuguauauguucgcuua

SEQ ID NO: 88117 - RNA, 20 nt, Artificial Sequence
  MKO10088117_B_Gm14322
  gRNA
uuccaugacuucuagaaguu

SEQ ID NO: 88118 - RNA, 20 nt, Artificial Sequence
  MKO10088118_B_Gm14322
  gRNA
acuggguuuagguuacauuu

SEQ ID NO: 88119 - RNA, 20 nt, Artificial Sequence
  MKO10088119_B_Gm14322
  gRNA
uauguguuugcuuauguauu

SEQ ID NO: 88120 - RNA, 20 nt, Artificial Sequence
  MKO10088120_B_Gm14325
  gRNA
cgugcaugugaacuuuacuc

SEQ ID NO: 88121 - RNA, 20 nt, Artificial Sequence
  MKO10088121_B_Gm14325
  gRNA
cuucaaacuucuagaaguca

SEQ ID NO: 88122 - RNA, 20 nt, Artificial Sequence
  MKO10088122_B_Gm14325
  gRNA
uguguucugcgugacucuac

SEQ ID NO: 88123 - RNA, 20 nt, Artificial Sequence
  MKO10088123_B_Gm14326
  gRNA
uauagcugugagauuccuau

SEQ ID NO: 88124 - RNA, 20 nt, Artificial Sequence
  MKO10088124_B_Gm14326
  gRNA
acuggguuuagguuacauuu

SEQ ID NO: 88125 - RNA, 20 nt, Artificial Sequence
  MKO10088125_B_Gm14326
  gRNA
gacuucuagaaguuugaaaa

SEQ ID NO: 88126 - RNA, 20 nt, Artificial Sequence
  MKO10088126_B_Gm14345
  gRNA
aaaucugaucauuaagaaug

SEQ ID NO: 88127 - RNA, 20 nt, Artificial Sequence
  MKO10088127_B_Gm14345
  gRNA
uguuaucaacauaugccaug

SEQ ID NO: 88128 - RNA, 20 nt, Artificial Sequence
  MKO10088128_B_Gm14345
  gRNA
ggauuugucaauaacaccuc

SEQ ID NO: 88129 - RNA, 20 nt, Artificial Sequence
  MKO10088129_B_Gm14346
  gRNA
aucuuguucaagaauaguug

SEQ ID NO: 88130 - RNA, 20 nt, Artificial Sequence
  MKO10088130_B_Gm14346
  gRNA
ggauuugucaauaacaccuc

SEQ ID NO: 88131 - RNA, 20 nt, Artificial Sequence
  MKO10088131_B_Gm14346
  gRNA
uguuaucaacauaugccaug

SEQ ID NO: 88132 - RNA, 20 nt, Artificial Sequence
  MKO10088132_B_Gm14347
  gRNA
aaaucugaucauuaagaaug

SEQ ID NO: 88133 - RNA, 20 nt, Artificial Sequence
  MKO10088133_B_Gm14347
  gRNA
uguuaucaacauaugccaug

SEQ ID NO: 88134 - RNA, 20 nt, Artificial Sequence
  MKO10088134_B_Gm14347
  gRNA
ggauuugucaauaacaccuc

SEQ ID NO: 88135 - RNA, 20 nt, Artificial Sequence
  MKO10088135_B_Gm14351
  gRNA
aucuuguucaagaauaguug

SEQ ID NO: 88136 - RNA, 20 nt, Artificial Sequence
  MKO10088136_B_Gm14351
  gRNA
ggauuugucaauaacaccuc

SEQ ID NO: 88137 - RNA, 20 nt, Artificial Sequence
  MKO10088137_B_Gm14351
  gRNA
uguuaucaacauaugccaug

SEQ ID NO: 88138 - RNA, 20 nt, Artificial Sequence
  MKO10088138_B_Gm14374
  gRNA
aaaucugaucauuaagaaug

SEQ ID NO: 88139 - RNA, 20 nt, Artificial Sequence
  MKO10088139_B_Gm14374
  gRNA
uguuaucaacauaugccaug

SEQ ID NO: 88140 - RNA, 20 nt, Artificial Sequence
  MKO10088140_B_Gm14374
  gRNA
ggauuugucaauaacaccuc

SEQ ID NO: 88141 - RNA, 20 nt, Artificial Sequence
  MKO10088141_B_Gm14378
  gRNA
ggucucgucugcgcacacuc

SEQ ID NO: 88142 - RNA, 20 nt, Artificial Sequence
  MKO10088142_B_Gm14378
  gRNA
gacgcguucccucgccgcgc

SEQ ID NO: 88143 - RNA, 20 nt, Artificial Sequence
  MKO10088143_B_Gm14378
  gRNA
cuguccgccggaaccuccag

SEQ ID NO: 88144 - RNA, 20 nt, Artificial Sequence
  MKO10088144_B_Gm14391
  gRNA
gacuucuagaaguuugaaaa

SEQ ID NO: 88145 - RNA, 20 nt, Artificial Sequence
  MKO10088145_B_Gm14391
  gRNA
cccucugaguuuauucaaug

SEQ ID NO: 88146 - RNA, 20 nt, Artificial Sequence
  MKO10088146_B_Gm14391
  gRNA
accauacuaguuacauucau

SEQ ID NO: 88147 - RNA, 20 nt, Artificial Sequence
  MKO10088147_B_Gm14393
  gRNA
uuccaugacuucuagaaguu

SEQ ID NO: 88148 - RNA, 20 nt, Artificial Sequence
  MKO10088148_B_Gm14393
  gRNA
cccucugaguuuauucaaug

SEQ ID NO: 88149 - RNA, 20 nt, Artificial Sequence
  MKO10088149_B_Gm14393
  gRNA
cauaugagaguuguagucaa

SEQ ID NO: 88150 - RNA, 20 nt, Artificial Sequence
  MKO10088150_B_Gm14420
  gRNA
cgugcaugugaacuucacuc

SEQ ID NO: 88151 - RNA, 20 nt, Artificial Sequence
  MKO10088151_B_Gm14420
  gRNA
uuccaugacuucuagaaguu

SEQ ID NO: 88152 - RNA, 20 nt, Artificial Sequence
  MKO10088152_B_Gm14420
  gRNA
acuguguuuagguuacaguu

SEQ ID NO: 88153 - RNA, 20 nt, Artificial Sequence
  MKO10088153_B_Gm14430
  gRNA
uauagcugugagauucuuau

SEQ ID NO: 88154 - RNA, 20 nt, Artificial Sequence
  MKO10088154_B_Gm14430
  gRNA
uacuggguuuagguuacauu

SEQ ID NO: 88155 - RNA, 20 nt, Artificial Sequence
  MKO10088155_B_Gm14430
  gRNA
gacuucuagaaguuugaaaa

SEQ ID NO: 88156 - RNA, 20 nt, Artificial Sequence
  MKO10088156_B_Gm14431
  gRNA
cgugcaugugaacuucacuc

SEQ ID NO: 88157 - RNA, 20 nt, Artificial Sequence
  MKO10088157_B_Gm14431
  gRNA
uuccaugacuucuagaaguu

SEQ ID NO: 88158 - RNA, 20 nt, Artificial Sequence
  MKO10088158_B_Gm14431
  gRNA
acuguguuuagguuacaguu

SEQ ID NO: 88159 - RNA, 20 nt, Artificial Sequence
  MKO10088159_B_Gm14434
  gRNA
gacuucuagaaguuugaaaa

SEQ ID NO: 88160 - RNA, 20 nt, Artificial Sequence
  MKO10088160_B_Gm14434
  gRNA
cccucugaguuuauucaaug

SEQ ID NO: 88161 - RNA, 20 nt, Artificial Sequence
  MKO10088161_B_Gm14434
  gRNA
cuccuguauauguucgcuua

SEQ ID NO: 88162 - RNA, 20 nt, Artificial Sequence
  MKO10088162_B_Gm14436
  gRNA
cgugcaugugaacuucacuc

SEQ ID NO: 88163 - RNA, 20 nt, Artificial Sequence
  MKO10088163_B_Gm14436
  gRNA
uuccaagacuucuagaaguu

SEQ ID NO: 88164 - RNA, 20 nt, Artificial Sequence
  MKO10088164_B_Gm14436
  gRNA
acuguguuuagguuacaguu

SEQ ID NO: 88165 - RNA, 20 nt, Artificial Sequence
  MKO10088165_B_Gm14440
  gRNA
accacauggcuugcaaacau

SEQ ID NO: 88166 - RNA, 20 nt, Artificial Sequence
  MKO10088166_B_Gm14440
  gRNA
acuguguuuagguuacaguu

SEQ ID NO: 88167 - RNA, 20 nt, Artificial Sequence
  MKO10088167_B_Gm14440
  gRNA
cgcuauacuacaucucuaug

SEQ ID NO: 88168 - RNA, 20 nt, Artificial Sequence
  MKO10088168_B_Gm14446
  gRNA
uucugagucccagcaacgug

SEQ ID NO: 88169 - RNA, 20 nt, Artificial Sequence
  MKO10088169_B_Gm14446
  gRNA
uucugagucccagcaacaug

SEQ ID NO: 88170 - RNA, 20 nt, Artificial Sequence
  MKO10088170_B_Gm14446
  gRNA
aagccuuuaccucauguugc

SEQ ID NO: 88171 - RNA, 20 nt, Artificial Sequence
  MKO10088171_B_Gm14458
  gRNA
ccugaccaaccugcgccaga

SEQ ID NO: 88172 - RNA, 20 nt, Artificial Sequence
  MKO10088172_B_Gm14458
  gRNA
agaaacgcuugaaguucucc

SEQ ID NO: 88173 - RNA, 20 nt, Artificial Sequence
  MKO10088173_B_Gm14458
  gRNA
ugccaucgacauguacucgu

SEQ ID NO: 88174 - RNA, 20 nt, Artificial Sequence
  MKO10088174_B_Gm14459
  gRNA
cauacuucucugaugaagag

SEQ ID NO: 88175 - RNA, 20 nt, Artificial Sequence
  MKO10088175_B_Gm14459
  gRNA
uacaucagaaugacugaccu

SEQ ID NO: 88176 - RNA, 20 nt, Artificial Sequence
  MKO10088176_B_Gm14459
  gRNA
ucuguagaugaaugcuuuga

SEQ ID NO: 88177 - RNA, 20 nt, Artificial Sequence
  MKO10088177_B_Gm14461
  gRNA
gcacaagugacagauuugac

SEQ ID NO: 88178 - RNA, 20 nt, Artificial Sequence
  MKO10088178_B_Gm14461
  gRNA
cuggugguauuccacuucca

SEQ ID NO: 88179 - RNA, 20 nt, Artificial Sequence
  MKO10088179_B_Gm14461
  gRNA
aauguugcccaccgugugau

SEQ ID NO: 88180 - RNA, 20 nt, Artificial Sequence
  MKO10088180_B_Gm14474
  gRNA
aaaagaacccgcucccagag

SEQ ID NO: 88181 - RNA, 20 nt, Artificial Sequence
  MKO10088181_B_Gm14474
  gRNA
agcuaugcgcuuccugccag

SEQ ID NO: 88182 - RNA, 20 nt, Artificial Sequence
  MKO10088182_B_Gm14474
  gRNA
uguagaucguuuccuacgag

SEQ ID NO: 88183 - RNA, 20 nt, Artificial Sequence
  MKO10088183_B_Gm14475
  gRNA
aaaagaacccgcucccagag

SEQ ID NO: 88184 - RNA, 20 nt, Artificial Sequence
  MKO10088184_B_Gm14475
  gRNA
agcuaugcgcuuccugccag

SEQ ID NO: 88185 - RNA, 20 nt, Artificial Sequence
  MKO10088185_B_Gm14475
  gRNA
uguagaucguuuccuacgag

SEQ ID NO: 88186 - RNA, 20 nt, Artificial Sequence
  MKO10088186_B_Gm14476
  gRNA
aaaagaacccgcucccagag

SEQ ID NO: 88187 - RNA, 20 nt, Artificial Sequence
  MKO10088187_B_Gm14476
  gRNA
agcuaugcgcuuccugccag

SEQ ID NO: 88188 - RNA, 20 nt, Artificial Sequence
  MKO10088188_B_Gm14476
  gRNA
uguagaucguuuccuacgag

SEQ ID NO: 88189 - RNA, 20 nt, Artificial Sequence
  MKO10088189_B_Gm14477
  gRNA
aaaagaacccgcucccagag

SEQ ID NO: 88190 - RNA, 20 nt, Artificial Sequence
  MKO10088190_B_Gm14477
  gRNA
agcuaugcgcuuccugccag

SEQ ID NO: 88191 - RNA, 20 nt, Artificial Sequence
  MKO10088191_B_Gm14477
  gRNA
uguagaucguuuccuacgag

SEQ ID NO: 88192 - RNA, 20 nt, Artificial Sequence
  MKO10088192_B_Gm14478
  gRNA
aaaagaacccgcucccagag

SEQ ID NO: 88193 - RNA, 20 nt, Artificial Sequence
  MKO10088193_B_Gm14478
  gRNA
agcuaugcgcuuccugccag

SEQ ID NO: 88194 - RNA, 20 nt, Artificial Sequence
  MKO10088194_B_Gm14478
  gRNA
uguagaucguuuccuacgag

SEQ ID NO: 88195 - RNA, 20 nt, Artificial Sequence
  MKO10088195_B_Gm14479
  gRNA
aaaagaacccgcucccagag

SEQ ID NO: 88196 - RNA, 20 nt, Artificial Sequence
  MKO10088196_B_Gm14479
  gRNA
agcuaugcgcuuccugccag

SEQ ID NO: 88197 - RNA, 20 nt, Artificial Sequence
  MKO10088197_B_Gm14479
  gRNA
uguagaucguuuccuacgag

SEQ ID NO: 88198 - RNA, 20 nt, Artificial Sequence
  MKO10088198_B_Gm14482
  gRNA
aaaagaacccgcucccagag

SEQ ID NO: 88199 - RNA, 20 nt, Artificial Sequence
  MKO10088199_B_Gm14482
  gRNA
agcuaugcgcuuccugccag

SEQ ID NO: 88200 - RNA, 20 nt, Artificial Sequence
  MKO10088200_B_Gm14482
  gRNA
uguagaucguuuccuacgag

SEQ ID NO: 88201 - RNA, 20 nt, Artificial Sequence
  MKO10088201_B_Gm14483
  gRNA
aaaagaacccgcucccagag

SEQ ID NO: 88202 - RNA, 20 nt, Artificial Sequence
  MKO10088202_B_Gm14483
  gRNA
agcuaugcgcuuccugccag

SEQ ID NO: 88203 - RNA, 20 nt, Artificial Sequence
  MKO10088203_B_Gm14483
  gRNA
uguagaucguuuccuacgag

SEQ ID NO: 88204 - RNA, 20 nt, Artificial Sequence
  MKO10088204_B_Gm14484
  gRNA
aaaagaacccgcucccagag

SEQ ID NO: 88205 - RNA, 20 nt, Artificial Sequence
  MKO10088205_B_Gm14484
  gRNA
agcuaugcgcuuccugccag

SEQ ID NO: 88206 - RNA, 20 nt, Artificial Sequence
  MKO10088206_B_Gm14484
  gRNA
uguagaucguuuccuacgag

SEQ ID NO: 88207 - RNA, 20 nt, Artificial Sequence
  MKO10088207_B_Gm14496
  gRNA
aauggauucuucgaugccaa

SEQ ID NO: 88208 - RNA, 20 nt, Artificial Sequence
  MKO10088208_B_Gm14496
  gRNA
uaucuuccuugcugaaaacc

SEQ ID NO: 88209 - RNA, 20 nt, Artificial Sequence
  MKO10088209_B_Gm14496
  gRNA
aguacaugucauacuacaca

SEQ ID NO: 88210 - RNA, 20 nt, Artificial Sequence
  MKO10088210_B_Gm14499
  gRNA
cuacuuugaccgugaugacg

SEQ ID NO: 88211 - RNA, 20 nt, Artificial Sequence
  MKO10088211_B_Gm14499
  gRNA
ccugaccaaccugcgccaga

SEQ ID NO: 88212 - RNA, 20 nt, Artificial Sequence
  MKO10088212_B_Gm14499
  gRNA
ucaaaaccaacaugaacauc

SEQ ID NO: 88213 - RNA, 20 nt, Artificial Sequence
  MKO10088213_B_Gm14501
  gRNA
aaaagaacccgcucccagag

SEQ ID NO: 88214 - RNA, 20 nt, Artificial Sequence
  MKO10088214_B_Gm14501
  gRNA
agcuaugcgcuuccugccag

SEQ ID NO: 88215 - RNA, 20 nt, Artificial Sequence
  MKO10088215_B_Gm14501
  gRNA
uguagaucguuuccuacgag

SEQ ID NO: 88216 - RNA, 20 nt, Artificial Sequence
  MKO10088216_B_Gm14511
  gRNA
ugaacaucucugcacugguc

SEQ ID NO: 88217 - RNA, 20 nt, Artificial Sequence
  MKO10088217_B_Gm14511
  gRNA
agaaacgcuugaaguucucc

SEQ ID NO: 88218 - RNA, 20 nt, Artificial Sequence
  MKO10088218_B_Gm14511
  gRNA
ccugaccaaccugcgccaga

SEQ ID NO: 88219 - RNA, 20 nt, Artificial Sequence
  MKO10088219_B_Gm14525
  gRNA
agaaaauguaaguuucucag

SEQ ID NO: 88220 - RNA, 20 nt, Artificial Sequence
  MKO10088220_B_Gm14525
  gRNA
acguucuguagagacaccaa

SEQ ID NO: 88221 - RNA, 20 nt, Artificial Sequence
  MKO10088221_B_Gm14525
  gRNA
aauccaguaacucaugauga

SEQ ID NO: 88222 - RNA, 20 nt, Artificial Sequence
  MKO10088222_B_Gm14548
  gRNA
cuucuggagaccacagagug

SEQ ID NO: 88223 - RNA, 20 nt, Artificial Sequence
  MKO10088223_B_Gm14548
  gRNA
caggacugacucugagccuc

SEQ ID NO: 88224 - RNA, 20 nt, Artificial Sequence
  MKO10088224_B_Gm14548
  gRNA
acacacucaccugucagcac

SEQ ID NO: 88225 - RNA, 20 nt, Artificial Sequence
  MKO10088225_B_Gm14625
  gRNA
uagagacaccaauagaaaac

SEQ ID NO: 88226 - RNA, 20 nt, Artificial Sequence
  MKO10088226_B_Gm14625
  gRNA
guaucuccaacuauuucuuc

SEQ ID NO: 88227 - RNA, 20 nt, Artificial Sequence
  MKO10088227_B_Gm14625
  gRNA
gaaauuccugaagaaauagu

SEQ ID NO: 88228 - RNA, 20 nt, Artificial Sequence
  MKO10088228_B_Gm14632
  gRNA
agaaaacguaaguuucucag

SEQ ID NO: 88229 - RNA, 20 nt, Artificial Sequence
  MKO10088229_B_Gm14632
  gRNA
acguucuguagagacaccaa

SEQ ID NO: 88230 - RNA, 20 nt, Artificial Sequence
  MKO10088230_B_Gm14632
  gRNA
guaucuccaacuacuucuuc

SEQ ID NO: 88231 - RNA, 20 nt, Artificial Sequence
  MKO10088231_B_Gm14685
  gRNA
ucugcagaguauguacucug

SEQ ID NO: 88232 - RNA, 20 nt, Artificial Sequence
  MKO10088232_B_Gm14685
  gRNA
ggccacuucuugcaaauguc

SEQ ID NO: 88233 - RNA, 20 nt, Artificial Sequence
  MKO10088233_B_Gm14685
  gRNA
gagggaaccagcuuguuuca

SEQ ID NO: 88234 - RNA, 20 nt, Artificial Sequence
  MKO10088234_B_Gm14692
  gRNA
aacuugucagcauuuauaaa

SEQ ID NO: 88235 - RNA, 20 nt, Artificial Sequence
  MKO10088235_B_Gm14692
  gRNA
cccacuguugaaacaaagac

SEQ ID NO: 88236 - RNA, 20 nt, Artificial Sequence
  MKO10088236_B_Gm14692
  gRNA
uccagucuuuguuucaacag

SEQ ID NO: 88237 - RNA, 20 nt, Artificial Sequence
  MKO10088237_B_Gm14725
  gRNA
agaucuuaauuuacugccac

SEQ ID NO: 88238 - RNA, 20 nt, Artificial Sequence
  MKO10088238_B_Gm14725
  gRNA
aacaacugucuuagaaaguc

SEQ ID NO: 88239 - RNA, 20 nt, Artificial Sequence
  MKO10088239_B_Gm14725
  gRNA
gguuuauguguagccugagu

SEQ ID NO: 88240 - RNA, 20 nt, Artificial Sequence
  MKO10088240_B_Gm14743
  gRNA
auugacaagauagagacgag

SEQ ID NO: 88241 - RNA, 20 nt, Artificial Sequence
  MKO10088241_B_Gm14743
  gRNA
ugcucauugaccacagucac

SEQ ID NO: 88242 - RNA, 20 nt, Artificial Sequence
  MKO10088242_B_Gm14743
  gRNA
uugcuuauacccagugacug

SEQ ID NO: 88243 - RNA, 20 nt, Artificial Sequence
  MKO10088243_B_Gm14744
  gRNA
ccuuguccgcagcuauguaa

SEQ ID NO: 88244 - RNA, 20 nt, Artificial Sequence
  MKO10088244_B_Gm14744
  gRNA
gugucagacacacacuguug

SEQ ID NO: 88245 - RNA, 20 nt, Artificial Sequence
  MKO10088245_B_Gm14744
  gRNA
gagaaaaacaagaagauggg

SEQ ID NO: 88246 - RNA, 20 nt, Artificial Sequence
  MKO10088246_B_Gm14781
  gRNA
uccucaaaaagaugagucuc

SEQ ID NO: 88247 - RNA, 20 nt, Artificial Sequence
  MKO10088247_B_Gm14781
  gRNA
uaaauaaaaugcuuccuccc

SEQ ID NO: 88248 - RNA, 20 nt, Artificial Sequence
  MKO10088248_B_Gm14781
  gRNA
ggcagggguuuaccaaaaac

SEQ ID NO: 88249 - RNA, 20 nt, Artificial Sequence
  MKO10088249_B_Gm14819
  gRNA
agaaaacguaaguuucucag

SEQ ID NO: 88250 - RNA, 20 nt, Artificial Sequence
  MKO10088250_B_Gm14819
  gRNA
acguucuguagagacaccaa

SEQ ID NO: 88251 - RNA, 20 nt, Artificial Sequence
  MKO10088251_B_Gm14819
  gRNA
guaucuccaacuacuucuuc

SEQ ID NO: 88252 - RNA, 20 nt, Artificial Sequence
  MKO10088252_B_Gm14850
  gRNA
auaugcuauuguagaauaag

SEQ ID NO: 88253 - RNA, 20 nt, Artificial Sequence
  MKO10088253_B_Gm14850
  gRNA
caaaagagauagacacagcc

SEQ ID NO: 88254 - RNA, 20 nt, Artificial Sequence
  MKO10088254_B_Gm14850
  gRNA
agaugaagagacuaauacug

SEQ ID NO: 88255 - RNA, 20 nt, Artificial Sequence
  MKO10088255_B_Gm14851
  gRNA
agagccuucugugccuccaa

SEQ ID NO: 88256 - RNA, 20 nt, Artificial Sequence
  MKO10088256_B_Gm14851
  gRNA
agaugaagagacuaaaacug

SEQ ID NO: 88257 - RNA, 20 nt, Artificial Sequence
  MKO10088257_B_Gm14851
  gRNA
acagccugguccucuuccuc

SEQ ID NO: 88258 - RNA, 20 nt, Artificial Sequence
  MKO10088258_B_Gm14920
  gRNA
ugcaaagaucagcucagcuc

SEQ ID NO: 88259 - RNA, 20 nt, Artificial Sequence
  MKO10088259_B_Gm14920
  gRNA
gcuaguagcuagcgaugagc

SEQ ID NO: 88260 - RNA, 20 nt, Artificial Sequence
  MKO10088260_B_Gm14920
  gRNA
aggccaccaugccaaggaac

SEQ ID NO: 88261 - RNA, 20 nt, Artificial Sequence
  MKO10088261_B_Gm15023
  gRNA
gagucguaugaaccaccuga

SEQ ID NO: 88262 - RNA, 20 nt, Artificial Sequence
  MKO10088262_B_Gm15023
  gRNA
cagaguacuaucugcugauu

SEQ ID NO: 88263 - RNA, 20 nt, Artificial Sequence
  MKO10088263_B_Gm15023
  gRNA
aaugccaccucccauagcaa

SEQ ID NO: 88264 - RNA, 20 nt, Artificial Sequence
  MKO10088264_B_Gm15056
  gRNA
uguaugagaaccaugaccug

SEQ ID NO: 88265 - RNA, 20 nt, Artificial Sequence
  MKO10088265_B_Gm15056
  gRNA
gagaagguaaaguaauuuca

SEQ ID NO: 88266 - RNA, 20 nt, Artificial Sequence
  MKO10088266_B_Gm15056
  gRNA
ccauggcuugagaaaucaag

SEQ ID NO: 88267 - RNA, 20 nt, Artificial Sequence
  MKO10088267_B_Gm15070
  gRNA
ccuagaccucagcuaauucc

SEQ ID NO: 88268 - RNA, 20 nt, Artificial Sequence
  MKO10088268_B_Gm15070
  gRNA
uucuuaccuggaauuagcug

SEQ ID NO: 88269 - RNA, 20 nt, Artificial Sequence
  MKO10088269_B_Gm15070
  gRNA
gguuguugcaggagcauuug

SEQ ID NO: 88270 - RNA, 20 nt, Artificial Sequence
  MKO10088270_B_Gm15080
  gRNA
ucacuuaccagaugaaguag

SEQ ID NO: 88271 - RNA, 20 nt, Artificial Sequence
  MKO10088271_B_Gm15080
  gRNA
caggacacagacgugacagu

SEQ ID NO: 88272 - RNA, 20 nt, Artificial Sequence
  MKO10088272_B_Gm15080
  gRNA
uguuucuaccugucaauuuc

SEQ ID NO: 88273 - RNA, 20 nt, Artificial Sequence
  MKO10088273_B_Gm15085
  gRNA
caggacacagacgugacagu

SEQ ID NO: 88274 - RNA, 20 nt, Artificial Sequence
  MKO10088274_B_Gm15085
  gRNA
uguuucuaccugucaauuuc

SEQ ID NO: 88275 - RNA, 20 nt, Artificial Sequence
  MKO10088275_B_Gm15085
  gRNA
ucaaccuagaaagucuaaca

SEQ ID NO: 88276 - RNA, 20 nt, Artificial Sequence
  MKO10088276_B_Gm15091
  gRNA
ucacuuaccagaugaaguag

SEQ ID NO: 88277 - RNA, 20 nt, Artificial Sequence
  MKO10088277_B_Gm15091
  gRNA
caggacacagacgugacagu

SEQ ID NO: 88278 - RNA, 20 nt, Artificial Sequence
  MKO10088278_B_Gm15091
  gRNA
uguuucuaccugacaauuuc

SEQ ID NO: 88279 - RNA, 20 nt, Artificial Sequence
  MKO10088279_B_Gm15093
  gRNA
caggacacagacgugacagu

SEQ ID NO: 88280 - RNA, 20 nt, Artificial Sequence
  MKO10088280_B_Gm15093
  gRNA
uguuucuaccugucaauuuc

SEQ ID NO: 88281 - RNA, 20 nt, Artificial Sequence
  MKO10088281_B_Gm15093
  gRNA
ucaaccuagaaagucuaaca

SEQ ID NO: 88282 - RNA, 20 nt, Artificial Sequence
  MKO10088282_B_Gm15097
  gRNA
uucugaagaagaauacaaug

SEQ ID NO: 88283 - RNA, 20 nt, Artificial Sequence
  MKO10088283_B_Gm15097
  gRNA
ucacuuaccagaugaaguag

SEQ ID NO: 88284 - RNA, 20 nt, Artificial Sequence
  MKO10088284_B_Gm15097
  gRNA
caggacacagacgugacagu

SEQ ID NO: 88285 - RNA, 20 nt, Artificial Sequence
  MKO10088285_B_Gm15104
  gRNA
ugccgccacugccagaugug

SEQ ID NO: 88286 - RNA, 20 nt, Artificial Sequence
  MKO10088286_B_Gm15104
  gRNA
guuaccccauaaagcugaca

SEQ ID NO: 88287 - RNA, 20 nt, Artificial Sequence
  MKO10088287_B_Gm15104
  gRNA
auauggugucuugcacaaga

SEQ ID NO: 88288 - RNA, 20 nt, Artificial Sequence
  MKO10088288_B_Gm15107
  gRNA
caggacacagacgugacagu

SEQ ID NO: 88289 - RNA, 20 nt, Artificial Sequence
  MKO10088289_B_Gm15107
  gRNA
uguuucuaccugucaauuuc

SEQ ID NO: 88290 - RNA, 20 nt, Artificial Sequence
  MKO10088290_B_Gm15107
  gRNA
ucaaccuagaaagucuaaca

SEQ ID NO: 88291 - RNA, 20 nt, Artificial Sequence
  MKO10088291_B_Gm15114
  gRNA
uucugaagaagaauacaaug

SEQ ID NO: 88292 - RNA, 20 nt, Artificial Sequence
  MKO10088292_B_Gm15114
  gRNA
ucacuuaccagaugaaguag

SEQ ID NO: 88293 - RNA, 20 nt, Artificial Sequence
  MKO10088293_B_Gm15114
  gRNA
caggacacagacgugacagu

SEQ ID NO: 88294 - RNA, 20 nt, Artificial Sequence
  MKO10088294_B_Gm15127
  gRNA
uucugaagaagaauacaaug

SEQ ID NO: 88295 - RNA, 20 nt, Artificial Sequence
  MKO10088295_B_Gm15127
  gRNA
ucacuuaccagaugaaguag

SEQ ID NO: 88296 - RNA, 20 nt, Artificial Sequence
  MKO10088296_B_Gm15127
  gRNA
caggacacagacgugacagu

SEQ ID NO: 88297 - RNA, 20 nt, Artificial Sequence
  MKO10088297_B_Gm15140
  gRNA
uaucacuucacgcaucuaga

SEQ ID NO: 88298 - RNA, 20 nt, Artificial Sequence
  MKO10088298_B_Gm15140
  gRNA
acacagaaaaccagaaccac

SEQ ID NO: 88299 - RNA, 20 nt, Artificial Sequence
  MKO10088299_B_Gm15140
  gRNA
aacaagcaaacauuuaacug

SEQ ID NO: 88300 - RNA, 20 nt, Artificial Sequence
  MKO10088300_B_Gm1527
  gRNA
cacaagaacagaaagaucag

SEQ ID NO: 88301 - RNA, 20 nt, Artificial Sequence
  MKO10088301_B_Gm1527
  gRNA
ucacauacacugucacaggu

SEQ ID NO: 88302 - RNA, 20 nt, Artificial Sequence
  MKO10088302_B_Gm1527
  gRNA
cuuacacgcauucuuaucau

SEQ ID NO: 88303 - RNA, 20 nt, Artificial Sequence
  MKO10088303_B_Gm15284
  gRNA
gucuccagcguugagagauc

SEQ ID NO: 88304 - RNA, 20 nt, Artificial Sequence
  MKO10088304_B_Gm15284
  gRNA
caaaagagacagacacagcc

SEQ ID NO: 88305 - RNA, 20 nt, Artificial Sequence
  MKO10088305_B_Gm15284
  gRNA
agaugaagagacuaaaacug

SEQ ID NO: 88306 - RNA, 20 nt, Artificial Sequence
  MKO10088306_B_Gm15292
  gRNA
guccccagcguugagagauc

SEQ ID NO: 88307 - RNA, 20 nt, Artificial Sequence
  MKO10088307_B_Gm15292
  gRNA
ucuugaagaucagagccuuc

SEQ ID NO: 88308 - RNA, 20 nt, Artificial Sequence
  MKO10088308_B_Gm15292
  gRNA
agaugaagagacuaauacug

SEQ ID NO: 88309 - RNA, 20 nt, Artificial Sequence
  MKO10088309_B_Gm15293
  gRNA
auaugcuauuguagaauaag

SEQ ID NO: 88310 - RNA, 20 nt, Artificial Sequence
  MKO10088310_B_Gm15293
  gRNA
caugaagagcagacccuucu

SEQ ID NO: 88311 - RNA, 20 nt, Artificial Sequence
  MKO10088311_B_Gm15293
  gRNA
ccucucugcccuuguccugc

SEQ ID NO: 88312 - RNA, 20 nt, Artificial Sequence
  MKO10088312_B_Gm15299
  gRNA
auaugcuauuguagaacaag

SEQ ID NO: 88313 - RNA, 20 nt, Artificial Sequence
  MKO10088313_B_Gm15299
  gRNA
ccucucugcccuugcccugc

SEQ ID NO: 88314 - RNA, 20 nt, Artificial Sequence
  MKO10088314_B_Gm15299
  gRNA
caaaggagacagaaacagcu

SEQ ID NO: 88315 - RNA, 20 nt, Artificial Sequence
  MKO10088315_B_Gm15308
  gRNA
cugauaugcuauuguagaaa

SEQ ID NO: 88316 - RNA, 20 nt, Artificial Sequence
  MKO10088316_B_Gm15308
  gRNA
caaaggagacagacacagcc

SEQ ID NO: 88317 - RNA, 20 nt, Artificial Sequence
  MKO10088317_B_Gm15308
  gRNA
uccuauccaaaacacagaug

SEQ ID NO: 88318 - RNA, 20 nt, Artificial Sequence
  MKO10088318_B_Gm15315
  gRNA
auaugcuauuguagaauaag

SEQ ID NO: 88319 - RNA, 20 nt, Artificial Sequence
  MKO10088319_B_Gm15315
  gRNA
caaaggagauagacacagcc

SEQ ID NO: 88320 - RNA, 20 nt, Artificial Sequence
  MKO10088320_B_Gm15315
  gRNA
agaugaagagacuaauacug

SEQ ID NO: 88321 - RNA, 20 nt, Artificial Sequence
  MKO10088321_B_Gm15319
  gRNA
ggccacccaacgagacaaug

SEQ ID NO: 88322 - RNA, 20 nt, Artificial Sequence
  MKO10088322_B_Gm15319
  gRNA
caaugucuacguugugcuca

SEQ ID NO: 88323 - RNA, 20 nt, Artificial Sequence
  MKO10088323_B_Gm15319
  gRNA
auuugaacagaaaccugaaa

SEQ ID NO: 88324 - RNA, 20 nt, Artificial Sequence
  MKO10088324_B_Gm15386
  gRNA
gaaaaauagaugaaacuuca

SEQ ID NO: 88325 - RNA, 20 nt, Artificial Sequence
  MKO10088325_B_Gm15386
  gRNA
auuucuuucugcauaagacc

SEQ ID NO: 88326 - RNA, 20 nt, Artificial Sequence
  MKO10088326_B_Gm15386
  gRNA
uacaugcaacagugaguucc

SEQ ID NO: 88327 - RNA, 20 nt, Artificial Sequence
  MKO10088327_B_Gm15455
  gRNA
agagcccucccucgacagcc

SEQ ID NO: 88328 - RNA, 20 nt, Artificial Sequence
  MKO10088328_B_Gm15455
  gRNA
ucccagcucugccuuaccac

SEQ ID NO: 88329 - RNA, 20 nt, Artificial Sequence
  MKO10088329_B_Gm15455
  gRNA
gagcaaagugcagagauccg

SEQ ID NO: 88330 - RNA, 20 nt, Artificial Sequence
  MKO10088330_B_Gm1553
  gRNA
cgucuacugauaaugucuuu

SEQ ID NO: 88331 - RNA, 20 nt, Artificial Sequence
  MKO10088331_B_Gm1553
  gRNA
gauuauucuguauucacuuc

SEQ ID NO: 88332 - RNA, 20 nt, Artificial Sequence
  MKO10088332_B_Gm1553
  gRNA
auccacuccaaacacuguuu

SEQ ID NO: 88333 - RNA, 20 nt, Artificial Sequence
  MKO10088333_B_Gm1564
  gRNA
agaccaauuaaaacccguag

SEQ ID NO: 88334 - RNA, 20 nt, Artificial Sequence
  MKO10088334_B_Gm1564
  gRNA
ucgucuccguaaguagacca

SEQ ID NO: 88335 - RNA, 20 nt, Artificial Sequence
  MKO10088335_B_Gm1564
  gRNA
acgaagacaauguagaccua

SEQ ID NO: 88336 - RNA, 20 nt, Artificial Sequence
  MKO10088336_B_Gm156
  gRNA
ugaggcauccugcaaagucc

SEQ ID NO: 88337 - RNA, 20 nt, Artificial Sequence
  MKO10088337_B_Gm156
  gRNA
agaauguacuacuuccauug

SEQ ID NO: 88338 - RNA, 20 nt, Artificial Sequence
  MKO10088338_B_Gm156
  gRNA
gcgcauaaguguugugaucc

SEQ ID NO: 88339 - RNA, 20 nt, Artificial Sequence
  MKO10088339_B_Gm15800
  gRNA
gccgcugucucaccgcagau

SEQ ID NO: 88340 - RNA, 20 nt, Artificial Sequence
  MKO10088340_B_Gm15800
  gRNA
guguuugcccccaagcaaac

SEQ ID NO: 88341 - RNA, 20 nt, Artificial Sequence
  MKO10088341_B_Gm15800
  gRNA
ggauccccauccuguuugcu

SEQ ID NO: 88342 - RNA, 20 nt, Artificial Sequence
  MKO10088342_B_Gm15816
  gRNA
aucuuucuuacaguggcagc

SEQ ID NO: 88343 - RNA, 20 nt, Artificial Sequence
  MKO10088343_B_Gm15816
  gRNA
gucaggagguuguaaguuuc

SEQ ID NO: 88344 - RNA, 20 nt, Artificial Sequence
  MKO10088344_B_Gm15816
  gRNA
uauucugaagcucauccccc

SEQ ID NO: 88345 - RNA, 20 nt, Artificial Sequence
  MKO10088345_B_Gm1587
  gRNA
gaaccccaccacccugugua

SEQ ID NO: 88346 - RNA, 20 nt, Artificial Sequence
  MKO10088346_B_Gm1587
  gRNA
uuggcugcucaaugagagcc

SEQ ID NO: 88347 - RNA, 20 nt, Artificial Sequence
  MKO10088347_B_Gm1587
  gRNA
agggcagcagcauucauccc

SEQ ID NO: 88348 - RNA, 20 nt, Artificial Sequence
  MKO10088348_B_Gm15881
  gRNA
augaaccgcacauaagucau

SEQ ID NO: 88349 - RNA, 20 nt, Artificial Sequence
  MKO10088349_B_Gm15881
  gRNA
ccaccauaaucaaagagucc

SEQ ID NO: 88350 - RNA, 20 nt, Artificial Sequence
  MKO10088350_B_Gm15881
  gRNA
ucaaggccuggauauaucac

SEQ ID NO: 88351 - RNA, 20 nt, Artificial Sequence
  MKO10088351_B_Gm1604b
  gRNA
cuguuaucagaccgccgaag

SEQ ID NO: 88352 - RNA, 20 nt, Artificial Sequence
  MKO10088352_B_Gm1604b
  gRNA
uccuaccucugcggacgaug

SEQ ID NO: 88353 - RNA, 20 nt, Artificial Sequence
  MKO10088353_B_Gm1604b
  gRNA
agccuccucaucguccgcag

SEQ ID NO: 88354 - RNA, 20 nt, Artificial Sequence
  MKO10088354_B_Gm16130
  gRNA
ugcacagcugaggcgcuacc

SEQ ID NO: 88355 - RNA, 20 nt, Artificial Sequence
  MKO10088355_B_Gm16130
  gRNA
auggcaguccagcccccaag

SEQ ID NO: 88356 - RNA, 20 nt, Artificial Sequence
  MKO10088356_B_Gm16130
  gRNA
ccggcgggccaugcagaaga

SEQ ID NO: 88357 - RNA, 20 nt, Artificial Sequence
  MKO10088357_B_Gm16367
  gRNA
augguucuugaagugggccc

SEQ ID NO: 88358 - RNA, 20 nt, Artificial Sequence
  MKO10088358_B_Gm16367
  gRNA
uuugcucaagucacuguaga

SEQ ID NO: 88359 - RNA, 20 nt, Artificial Sequence
  MKO10088359_B_Gm16367
  gRNA
ugguguugugcauguagccc

SEQ ID NO: 88360 - RNA, 20 nt, Artificial Sequence
  MKO10088360_B_Gm16381
  gRNA
cauagucucccagagacacg

SEQ ID NO: 88361 - RNA, 20 nt, Artificial Sequence
  MKO10088361_B_Gm16381
  gRNA
ugacuugaagaaacugauag

SEQ ID NO: 88362 - RNA, 20 nt, Artificial Sequence
  MKO10088362_B_Gm16381
  gRNA
uaagaaugaucuuauuccag

SEQ ID NO: 88363 - RNA, 20 nt, Artificial Sequence
  MKO10088363_B_Gm16390
  gRNA
cuuucuucaaauuuagacau

SEQ ID NO: 88364 - RNA, 20 nt, Artificial Sequence
  MKO10088364_B_Gm16390
  gRNA
cuaugucuaaauuugaagaa

SEQ ID NO: 88365 - RNA, 20 nt, Artificial Sequence
  MKO10088365_B_Gm16390
  gRNA
augccguugaaaaagugcca

SEQ ID NO: 88366 - RNA, 20 nt, Artificial Sequence
  MKO10088366_B_Gm16404
  gRNA
uagagacaccaauagaaaac

SEQ ID NO: 88367 - RNA, 20 nt, Artificial Sequence
  MKO10088367_B_Gm16404
  gRNA
guaucuccaacuauuucuuc

SEQ ID NO: 88368 - RNA, 20 nt, Artificial Sequence
  MKO10088368_B_Gm16404
  gRNA
gaaauuccugaagaaauagu

SEQ ID NO: 88369 - RNA, 20 nt, Artificial Sequence
  MKO10088369_B_Gm16405
  gRNA
gaaauuccugaagaaaucgu

SEQ ID NO: 88370 - RNA, 20 nt, Artificial Sequence
  MKO10088370_B_Gm16405
  gRNA
cuuguuguucauugaaauuc

SEQ ID NO: 88371 - RNA, 20 nt, Artificial Sequence
  MKO10088371_B_Gm16405
  gRNA
uacauuucagaaguuugaua

SEQ ID NO: 88372 - RNA, 20 nt, Artificial Sequence
  MKO10088372_B_Gm16430
  gRNA
gaaauuccugaagaaaucgu

SEQ ID NO: 88373 - RNA, 20 nt, Artificial Sequence
  MKO10088373_B_Gm16430
  gRNA
cuuguuguucauugaaauuc

SEQ ID NO: 88374 - RNA, 20 nt, Artificial Sequence
  MKO10088374_B_Gm16430
  gRNA
uacauuucagaaguuugaua

SEQ ID NO: 88375 - RNA, 20 nt, Artificial Sequence
  MKO10088375_B_Gm16432
  gRNA
agacaacacuacacugcaaa

SEQ ID NO: 88376 - RNA, 20 nt, Artificial Sequence
  MKO10088376_B_Gm16432
  gRNA
cuuccauccaggaaguggaa

SEQ ID NO: 88377 - RNA, 20 nt, Artificial Sequence
  MKO10088377_B_Gm16432
  gRNA
auucuuauauuugcuacuug

SEQ ID NO: 88378 - RNA, 20 nt, Artificial Sequence
  MKO10088378_B_Gm16442
  gRNA
gccuacacugaauccagaag

SEQ ID NO: 88379 - RNA, 20 nt, Artificial Sequence
  MKO10088379_B_Gm16442
  gRNA
uagagcaagugucacaaaca

SEQ ID NO: 88380 - RNA, 20 nt, Artificial Sequence
  MKO10088380_B_Gm16442
  gRNA
guguuauugucuguuaucug

SEQ ID NO: 88381 - RNA, 20 nt, Artificial Sequence
  MKO10088381_B_Gm16445
  gRNA
guugugcaauuuguguccuu

SEQ ID NO: 88382 - RNA, 20 nt, Artificial Sequence
  MKO10088382_B_Gm16445
  gRNA
uuaaugugagucucuaacac

SEQ ID NO: 88383 - RNA, 20 nt, Artificial Sequence
  MKO10088383_B_Gm16445
  gRNA
gcacuucaaugaaaagauaa

SEQ ID NO: 88384 - RNA, 20 nt, Artificial Sequence
  MKO10088384_B_Gm16451
  gRNA
gccuacacugaauccagaag

SEQ ID NO: 88385 - RNA, 20 nt, Artificial Sequence
  MKO10088385_B_Gm16451
  gRNA
uagagcaagugucacaaaca

SEQ ID NO: 88386 - RNA, 20 nt, Artificial Sequence
  MKO10088386_B_Gm16451
  gRNA
guguuauugucuguuaucug

SEQ ID NO: 88387 - RNA, 20 nt, Artificial Sequence
  MKO10088387_B_Gm1647
  gRNA
ucaugggcuguucagacuuc

SEQ ID NO: 88388 - RNA, 20 nt, Artificial Sequence
  MKO10088388_B_Gm1647
  gRNA
agcaucugcagucgugacuc

SEQ ID NO: 88389 - RNA, 20 nt, Artificial Sequence
  MKO10088389_B_Gm1647
  gRNA
gcugagauucugccgcaucc

SEQ ID NO: 88390 - RNA, 20 nt, Artificial Sequence
  MKO10088390_B_Gm16501
  gRNA
agccguguagaucguuuccu

SEQ ID NO: 88391 - RNA, 20 nt, Artificial Sequence
  MKO10088391_B_Gm16501
  gRNA
ugccaccuuguuugaagagu

SEQ ID NO: 88392 - RNA, 20 nt, Artificial Sequence
  MKO10088392_B_Gm16501
  gRNA
accaccugacacacaugcuc

SEQ ID NO: 88393 - RNA, 20 nt, Artificial Sequence
  MKO10088393_B_Gm16515
  gRNA
ccacgcccacgguaagcauc

SEQ ID NO: 88394 - RNA, 20 nt, Artificial Sequence
  MKO10088394_B_Gm16515
  gRNA
auacuucuggauguaccagc

SEQ ID NO: 88395 - RNA, 20 nt, Artificial Sequence
  MKO10088395_B_Gm16515
  gRNA
cuuccuccaccacgaagucc

SEQ ID NO: 88396 - RNA, 20 nt, Artificial Sequence
  MKO10088396_B_Gm16532
  gRNA
ggaguggcauggcuucuccc

SEQ ID NO: 88397 - RNA, 20 nt, Artificial Sequence
  MKO10088397_B_Gm16532
  gRNA
agacacagggacuacugccu

SEQ ID NO: 88398 - RNA, 20 nt, Artificial Sequence
  MKO10088398_B_Gm16532
  gRNA
ccugagauagcccagucucu

SEQ ID NO: 88399 - RNA, 20 nt, Artificial Sequence
  MKO10088399_B_Gm1661
  gRNA
cguagagaagaucaacgaag

SEQ ID NO: 88400 - RNA, 20 nt, Artificial Sequence
  MKO10088400_B_Gm1661
  gRNA
gcagguucugcuggaaacgu

SEQ ID NO: 88401 - RNA, 20 nt, Artificial Sequence
  MKO10088401_B_Gm1661
  gRNA
guccccgaaagcccagcgac

SEQ ID NO: 88402 - RNA, 20 nt, Artificial Sequence
  MKO10088402_B_Gm166
  gRNA
uccaugacaaaagagaacgc

SEQ ID NO: 88403 - RNA, 20 nt, Artificial Sequence
  MKO10088403_B_Gm166
  gRNA
cauccauucuaugcacagac

SEQ ID NO: 88404 - RNA, 20 nt, Artificial Sequence
  MKO10088404_B_Gm166
  gRNA
ucuccagucugugcauagaa

SEQ ID NO: 88405 - RNA, 20 nt, Artificial Sequence
  MKO10088405_B_Gm1673
  gRNA
guauacucacccgugcgucc

SEQ ID NO: 88406 - RNA, 20 nt, Artificial Sequence
  MKO10088406_B_Gm1673
  gRNA
cugagcggggacagcgcucc

SEQ ID NO: 88407 - RNA, 20 nt, Artificial Sequence
  MKO10088407_B_Gm1673
  gRNA
ucagguccuugcugucgcca

SEQ ID NO: 88408 - RNA, 20 nt, Artificial Sequence
  MKO10088408_B_Gm17019
  gRNA
cuggggcaaggcccuaccac

SEQ ID NO: 88409 - RNA, 20 nt, Artificial Sequence
  MKO10088409_B_Gm17019
  gRNA
ugagcuccugcuuguucucu

SEQ ID NO: 88410 - RNA, 20 nt, Artificial Sequence
  MKO10088410_B_Gm17019
  gRNA
cuuacaguaaccugcacagc

SEQ ID NO: 88411 - RNA, 20 nt, Artificial Sequence
  MKO10088411_B_Gm17252
  gRNA
cugaacagcugguaaaguac

SEQ ID NO: 88412 - RNA, 20 nt, Artificial Sequence
  MKO10088412_B_Gm17252
  gRNA
auguacugcaacagcagaag

SEQ ID NO: 88413 - RNA, 20 nt, Artificial Sequence
  MKO10088413_B_Gm17252
  gRNA
gaagacuuucccagccauac

SEQ ID NO: 88414 - RNA, 20 nt, Artificial Sequence
  MKO10088414_B_Gm17296
  gRNA
agaaggcgugauccacuucu

SEQ ID NO: 88415 - RNA, 20 nt, Artificial Sequence
  MKO10088415_B_Gm17296
  gRNA
guuugaaugcgcagugucag

SEQ ID NO: 88416 - RNA, 20 nt, Artificial Sequence
  MKO10088416_B_Gm17296
  gRNA
ucaaacagccuguuuagcuu

SEQ ID NO: 88417 - RNA, 20 nt, Artificial Sequence
  MKO10088417_B_Gm17359
  gRNA
uguauccuaguugcuuguuc

SEQ ID NO: 88418 - RNA, 20 nt, Artificial Sequence
  MKO10088418_B_Gm17359
  gRNA
uauaaacacgaguacaccug

SEQ ID NO: 88419 - RNA, 20 nt, Artificial Sequence
  MKO10088419_B_Gm17359
  gRNA
uucauagucacucauauucc

SEQ ID NO: 88420 - RNA, 20 nt, Artificial Sequence
  MKO10088420_B_Gm17365
  gRNA
cucccucuucuacuucauug

SEQ ID NO: 88421 - RNA, 20 nt, Artificial Sequence
  MKO10088421_B_Gm17365
  gRNA
cagucagaccacugcagaag

SEQ ID NO: 88422 - RNA, 20 nt, Artificial Sequence
  MKO10088422_B_Gm17365
  gRNA
cacccacaaugaaguagaag

SEQ ID NO: 88423 - RNA, 20 nt, Artificial Sequence
  MKO10088423_B_Gm17384
  gRNA
agcucaugucauuaguuauc

SEQ ID NO: 88424 - RNA, 20 nt, Artificial Sequence
  MKO10088424_B_Gm17384
  gRNA
aacuccugcaggauaacuga

SEQ ID NO: 88425 - RNA, 20 nt, Artificial Sequence
  MKO10088425_B_Gm17384
  gRNA
acugguggacauuacugaau

SEQ ID NO: 88426 - RNA, 20 nt, Artificial Sequence
  MKO10088426_B_Gm17455
  gRNA
cuuacgaccccugccgcuuc

SEQ ID NO: 88427 - RNA, 20 nt, Artificial Sequence
  MKO10088427_B_Gm17455
  gRNA
gagagcgucgcagcgagccc

SEQ ID NO: 88428 - RNA, 20 nt, Artificial Sequence
  MKO10088428_B_Gm17455
  gRNA
ggauagcaggccugccucgu

SEQ ID NO: 88429 - RNA, 20 nt, Artificial Sequence
  MKO10088429_B_Gm17660
  gRNA
cuguucacuggaacuuccuc

SEQ ID NO: 88430 - RNA, 20 nt, Artificial Sequence
  MKO10088430_B_Gm17660
  gRNA
cgacuuaccagaggagccug

SEQ ID NO: 88431 - RNA, 20 nt, Artificial Sequence
  MKO10088431_B_Gm17660
  gRNA
uuuaccuccagaagcugauu

SEQ ID NO: 88432 - RNA, 20 nt, Artificial Sequence
  MKO10088432_B_Gm17677
  gRNA
gcaugcaaagucaggauauc

SEQ ID NO: 88433 - RNA, 20 nt, Artificial Sequence
  MKO10088433_B_Gm17677
  gRNA
gcaguagcuuucauugcagc

SEQ ID NO: 88434 - RNA, 20 nt, Artificial Sequence
  MKO10088434_B_Gm17677
  gRNA
uuuguacaagucucauucaa

SEQ ID NO: 88435 - RNA, 20 nt, Artificial Sequence
  MKO10088435_B_Gm17689
  gRNA
gugaacaaauacauuauuag

SEQ ID NO: 88436 - RNA, 20 nt, Artificial Sequence
  MKO10088436_B_Gm17689
  gRNA
aaacugguuacacaaagaac

SEQ ID NO: 88437 - RNA, 20 nt, Artificial Sequence
  MKO10088437_B_Gm17689
  gRNA
cuggcaaggagaugccaagc

SEQ ID NO: 88438 - RNA, 20 nt, Artificial Sequence
  MKO10088438_B_Gm17727
  gRNA
acaacagaugaauauuacua

SEQ ID NO: 88439 - RNA, 20 nt, Artificial Sequence
  MKO10088439_B_Gm17727
  gRNA
agaacaugcacugccaaaga

SEQ ID NO: 88440 - RNA, 20 nt, Artificial Sequence
  MKO10088440_B_Gm17727
  gRNA
cuugucugacugugagauug

SEQ ID NO: 88441 - RNA, 20 nt, Artificial Sequence
  MKO10088441_B_Gm19345
  gRNA
gccaacaugggggguaucca

SEQ ID NO: 88442 - RNA, 20 nt, Artificial Sequence
  MKO10088442_B_Gm19345
  gRNA
cucaccugcagcacggaugc

SEQ ID NO: 88443 - RNA, 20 nt, Artificial Sequence
  MKO10088443_B_Gm19345
  gRNA
ugcacgccagacauaugcca

SEQ ID NO: 88444 - RNA, 20 nt, Artificial Sequence
  MKO10088444_B_Gm19402
  gRNA
gcagcagagggucauacagc

SEQ ID NO: 88445 - RNA, 20 nt, Artificial Sequence
  MKO10088445_B_Gm19402
  gRNA
acuggagcagacagacaugg

SEQ ID NO: 88446 - RNA, 20 nt, Artificial Sequence
  MKO10088446_B_Gm19402
  gRNA
cagcuuggcuggcagcugcu

SEQ ID NO: 88447 - RNA, 20 nt, Artificial Sequence
  MKO10088447_B_Gm1965
  gRNA
uaggauugccuugagacuac

SEQ ID NO: 88448 - RNA, 20 nt, Artificial Sequence
  MKO10088448_B_Gm1965
  gRNA
cucgaguuggugauagaagu

SEQ ID NO: 88449 - RNA, 20 nt, Artificial Sequence
  MKO10088449_B_Gm1965
  gRNA
ccgcuucauauuauagccca

SEQ ID NO: 88450 - RNA, 20 nt, Artificial Sequence
  MKO10088450_B_Gm19668
  gRNA
acaauugucugccugccaug

SEQ ID NO: 88451 - RNA, 20 nt, Artificial Sequence
  MKO10088451_B_Gm19668
  gRNA
uggcugacaccugcugcaca

SEQ ID NO: 88452 - RNA, 20 nt, Artificial Sequence
  MKO10088452_B_Gm19668
  gRNA
auuacuggagcagacagaug

SEQ ID NO: 88453 - RNA, 20 nt, Artificial Sequence
  MKO10088453_B_Gm1966
  gRNA
uacaaacaucagugacgaag

SEQ ID NO: 88454 - RNA, 20 nt, Artificial Sequence
  MKO10088454_B_Gm1966
  gRNA
ccaucugcugaggcuuagaa

SEQ ID NO: 88455 - RNA, 20 nt, Artificial Sequence
  MKO10088455_B_Gm1966
  gRNA
uggaaaacaguagagcugac

SEQ ID NO: 88456 - RNA, 20 nt, Artificial Sequence
  MKO10088456_B_Gm1979
  gRNA
cuggggccaggcccuaccac

SEQ ID NO: 88457 - RNA, 20 nt, Artificial Sequence
  MKO10088457_B_Gm1979
  gRNA
uuuccaguaaccugcacacc

SEQ ID NO: 88458 - RNA, 20 nt, Artificial Sequence
  MKO10088458_B_Gm1979
  gRNA
ccugauguucuugagucucc

SEQ ID NO: 88459 - RNA, 20 nt, Artificial Sequence
  MKO10088459_B_Gm1987
  gRNA
gccucaccucuugcagcccu

SEQ ID NO: 88460 - RNA, 20 nt, Artificial Sequence
  MKO10088460_B_Gm1987
  gRNA
gaacagacacagcccucaag

SEQ ID NO: 88461 - RNA, 20 nt, Artificial Sequence
  MKO10088461_B_Gm1987
  gRNA
acagcaggacuguccccucu

SEQ ID NO: 88462 - RNA, 20 nt, Artificial Sequence
  MKO10088462_B_Gm1993
  gRNA
agaugaacaagacaguaugu

SEQ ID NO: 88463 - RNA, 20 nt, Artificial Sequence
  MKO10088463_B_Gm1993
  gRNA
agaaaacguaaguuucucag

SEQ ID NO: 88464 - RNA, 20 nt, Artificial Sequence
  MKO10088464_B_Gm1993
  gRNA
aauccaguaacucaugauga

SEQ ID NO: 88465 - RNA, 20 nt, Artificial Sequence
  MKO10088465_B_Gm2002
  gRNA
uaccuggaggaccccaagcu

SEQ ID NO: 88466 - RNA, 20 nt, Artificial Sequence
  MKO10088466_B_Gm2002
  gRNA
cacuuacccagcacucacuc

SEQ ID NO: 88467 - RNA, 20 nt, Artificial Sequence
  MKO10088467_B_Gm2002
  gRNA
cccgugaugcugugcugccc

SEQ ID NO: 88468 - RNA, 20 nt, Artificial Sequence
  MKO10088468_B_Gm2012
  gRNA
agaugaacaagacaguaugu

SEQ ID NO: 88469 - RNA, 20 nt, Artificial Sequence
  MKO10088469_B_Gm2012
  gRNA
acguucuguagagacaccaa

SEQ ID NO: 88470 - RNA, 20 nt, Artificial Sequence
  MKO10088470_B_Gm2012
  gRNA
aauccaguaacucaugauga

SEQ ID NO: 88471 - RNA, 20 nt, Artificial Sequence
  MKO10088471_B_Gm2016
  gRNA
gaaaucguguuugaugauau

SEQ ID NO: 88472 - RNA, 20 nt, Artificial Sequence
  MKO10088472_B_Gm2016
  gRNA
auguucuggaaguucuccau

SEQ ID NO: 88473 - RNA, 20 nt, Artificial Sequence
  MKO10088473_B_Gm2016
  gRNA
ggaggcaaaaacaggcgcag

SEQ ID NO: 88474 - RNA, 20 nt, Artificial Sequence
  MKO10088474_B_Gm20172
  gRNA
uagugugcuucaaauacccc

SEQ ID NO: 88475 - RNA, 20 nt, Artificial Sequence
  MKO10088475_B_Gm20172
  gRNA
ucgcuugcuuaucuuuaagc

SEQ ID NO: 88476 - RNA, 20 nt, Artificial Sequence
  MKO10088476_B_Gm20172
  gRNA
uguacucaccauauuuagca

SEQ ID NO: 88477 - RNA, 20 nt, Artificial Sequence
  MKO10088477_B_Gm2022
  gRNA
gugaguaccaucuucuuuga

SEQ ID NO: 88478 - RNA, 20 nt, Artificial Sequence
  MKO10088478_B_Gm2022
  gRNA
ugagcaaucuucaaagaacu

SEQ ID NO: 88479 - RNA, 20 nt, Artificial Sequence
  MKO10088479_B_Gm2022
  gRNA
caacaagggcuacaaaugaa

SEQ ID NO: 88480 - RNA, 20 nt, Artificial Sequence
  MKO10088480_B_Gm2030
  gRNA
agaaaacauaaguuucucag

SEQ ID NO: 88481 - RNA, 20 nt, Artificial Sequence
  MKO10088481_B_Gm2030
  gRNA
acguucuguagagacaccaa

SEQ ID NO: 88482 - RNA, 20 nt, Artificial Sequence
  MKO10088482_B_Gm2030
  gRNA
aauccaguaacucaugauga

SEQ ID NO: 88483 - RNA, 20 nt, Artificial Sequence
  MKO10088483_B_Gm2042
  gRNA
uucuuuagaagaagucacag

SEQ ID NO: 88484 - RNA, 20 nt, Artificial Sequence
  MKO10088484_B_Gm2042
  gRNA
cagccagcacuguucucaau

SEQ ID NO: 88485 - RNA, 20 nt, Artificial Sequence
  MKO10088485_B_Gm2042
  gRNA
gcaaacucagaguaauuaau

SEQ ID NO: 88486 - RNA, 20 nt, Artificial Sequence
  MKO10088486_B_Gm20594
  gRNA
auuucagccucuucacugaa

SEQ ID NO: 88487 - RNA, 20 nt, Artificial Sequence
  MKO10088487_B_Gm20594
  gRNA
aaauugaccuuucagugaag

SEQ ID NO: 88488 - RNA, 20 nt, Artificial Sequence
  MKO10088488_B_Gm20604
  gRNA
cgcgucucccgacgccucac

SEQ ID NO: 88489 - RNA, 20 nt, Artificial Sequence
  MKO10088489_B_Gm20604
  gRNA
gauccggacgacgcuuugga

SEQ ID NO: 88490 - RNA, 20 nt, Artificial Sequence
  MKO10088490_B_Gm20604
  gRNA
guacucgcccgaaagcucca

SEQ ID NO: 88491 - RNA, 20 nt, Artificial Sequence
  MKO10088491_B_Gm20736
  gRNA
ugcaaaaucuuucuaauuuc

SEQ ID NO: 88492 - RNA, 20 nt, Artificial Sequence
  MKO10088492_B_Gm20736
  gRNA
cgcuucacauaaagagaaaa

SEQ ID NO: 88493 - RNA, 20 nt, Artificial Sequence
  MKO10088493_B_Gm20736
  gRNA
uacauuucagaagucugaua

SEQ ID NO: 88494 - RNA, 20 nt, Artificial Sequence
  MKO10088494_B_Gm20738
  gRNA
ucugucuccugauacagacc

SEQ ID NO: 88495 - RNA, 20 nt, Artificial Sequence
  MKO10088495_B_Gm20738
  gRNA
guuguaccucucugcaaacc

SEQ ID NO: 88496 - RNA, 20 nt, Artificial Sequence
  MKO10088496_B_Gm20738
  gRNA
ucauauauaugaauuccuga

SEQ ID NO: 88497 - RNA, 20 nt, Artificial Sequence
  MKO10088497_B_Gm20747
  gRNA
aacaaacccuucucuuuauu

SEQ ID NO: 88498 - RNA, 20 nt, Artificial Sequence
  MKO10088498_B_Gm20747
  gRNA
gaggugcuagaauccauuca

SEQ ID NO: 88499 - RNA, 20 nt, Artificial Sequence
  MKO10088499_B_Gm20747
  gRNA
ugccaaccagugcgccugcg

SEQ ID NO: 88500 - RNA, 20 nt, Artificial Sequence
  MKO10088500_B_Gm20765
  gRNA
cugaguaacugcuagauccu

SEQ ID NO: 88501 - RNA, 20 nt, Artificial Sequence
  MKO10088501_B_Gm20765
  gRNA
gccuccaaguguccauuucu

SEQ ID NO: 88502 - RNA, 20 nt, Artificial Sequence
  MKO10088502_B_Gm20765
  gRNA
gcugugcacuaugaucgcug

SEQ ID NO: 88503 - RNA, 20 nt, Artificial Sequence
  MKO10088503_B_Gm20767
  gRNA
gccuuucucacuucuucuuc

SEQ ID NO: 88504 - RNA, 20 nt, Artificial Sequence
  MKO10088504_B_Gm20767
  gRNA
cacacucucaaauacacaaa

SEQ ID NO: 88505 - RNA, 20 nt, Artificial Sequence
  MKO10088505_B_Gm20767
  gRNA
cuggaucuugcaaccuguga

SEQ ID NO: 88506 - RNA, 20 nt, Artificial Sequence
  MKO10088506_B_Gm20806
  gRNA
aggagcuccacagcgaugag

SEQ ID NO: 88507 - RNA, 20 nt, Artificial Sequence
  MKO10088507_B_Gm20806
  gRNA
ugccaaccagugcgccugcg

SEQ ID NO: 88508 - RNA, 20 nt, Artificial Sequence
  MKO10088508_B_Gm20806
  gRNA
ugaggaaaaacuacuuugug

SEQ ID NO: 88509 - RNA, 20 nt, Artificial Sequence
  MKO10088509_B_Gm20809
  gRNA
guuguaccucucugcaaacc

SEQ ID NO: 88510 - RNA, 20 nt, Artificial Sequence
  MKO10088510_B_Gm20809
  gRNA
gacggaauugacagugucua

SEQ ID NO: 88511 - RNA, 20 nt, Artificial Sequence
  MKO10088511_B_Gm20809
  gRNA
ugaagaaaaacuacuuugug

SEQ ID NO: 88512 - RNA, 20 nt, Artificial Sequence
  MKO10088512_B_Gm20815
  gRNA
ucuaucuccugauacagacc

SEQ ID NO: 88513 - RNA, 20 nt, Artificial Sequence
  MKO10088513_B_Gm20815
  gRNA
gggcaugagauugagaguau

SEQ ID NO: 88514 - RNA, 20 nt, Artificial Sequence
  MKO10088514_B_Gm20815
  gRNA
cgggacauagauagaaucuc

SEQ ID NO: 88515 - RNA, 20 nt, Artificial Sequence
  MKO10088515_B_Gm20816
  gRNA
guuguaccucucugcaaacc

SEQ ID NO: 88516 - RNA, 20 nt, Artificial Sequence
  MKO10088516_B_Gm20816
  gRNA
agcccaggugccauucuuac

SEQ ID NO: 88517 - RNA, 20 nt, Artificial Sequence
  MKO10088517_B_Gm20816
  gRNA
uaaaaauaguccuguaagaa

SEQ ID NO: 88518 - RNA, 20 nt, Artificial Sequence
  MKO10088518_B_Gm20822
  gRNA
uuaaaauccucucaucgcug

SEQ ID NO: 88519 - RNA, 20 nt, Artificial Sequence
  MKO10088519_B_Gm20822
  gRNA
aagauggcucugaggacaac

SEQ ID NO: 88520 - RNA, 20 nt, Artificial Sequence
  MKO10088520_B_Gm20822
  gRNA
uacuucaccaaauaaagaga

SEQ ID NO: 88521 - RNA, 20 nt, Artificial Sequence
  MKO10088521_B_Gm20823
  gRNA
ugaguucacuaucuucacag

SEQ ID NO: 88522 - RNA, 20 nt, Artificial Sequence
  MKO10088522_B_Gm20823
  gRNA
ucugucuccugauacagacc

SEQ ID NO: 88523 - RNA, 20 nt, Artificial Sequence
  MKO10088523_B_Gm20823
  gRNA
uaaaaauaguccuguaagaa

SEQ ID NO: 88524 - RNA, 20 nt, Artificial Sequence
  MKO10088524_B_Gm20826
  gRNA
aguuggacaucccucaccug

SEQ ID NO: 88525 - RNA, 20 nt, Artificial Sequence
  MKO10088525_B_Gm20826
  gRNA
aagauggcucugaggacaac

SEQ ID NO: 88526 - RNA, 20 nt, Artificial Sequence
  MKO10088526_B_Gm20826
  gRNA
uuaaaauccucucaucgcug

SEQ ID NO: 88527 - RNA, 20 nt, Artificial Sequence
  MKO10088527_B_Gm20831
  gRNA
agcugauaagcauagagagc

SEQ ID NO: 88528 - RNA, 20 nt, Artificial Sequence
  MKO10088528_B_Gm20831
  gRNA
uaggugaugucacagagcac

SEQ ID NO: 88529 - RNA, 20 nt, Artificial Sequence
  MKO10088529_B_Gm20831
  gRNA
caaaagcuugaggaacaagu

SEQ ID NO: 88530 - RNA, 20 nt, Artificial Sequence
  MKO10088530_B_Gm2083
  gRNA
gucagcaaccauagauaauu

SEQ ID NO: 88531 - RNA, 20 nt, Artificial Sequence
  MKO10088531_B_Gm2083
  gRNA
agacuaugauaacuuucuua

SEQ ID NO: 88532 - RNA, 20 nt, Artificial Sequence
  MKO10088532_B_Gm2083
  gRNA
uaccauagagccccaucagc

SEQ ID NO: 88533 - RNA, 20 nt, Artificial Sequence
  MKO10088533_B_Gm20854
  gRNA
agguggacaucccucaccug

SEQ ID NO: 88534 - RNA, 20 nt, Artificial Sequence
  MKO10088534_B_Gm20854
  gRNA
uguccaccucgccagcgccc

SEQ ID NO: 88535 - RNA, 20 nt, Artificial Sequence
  MKO10088535_B_Gm20854
  gRNA
uaccuuccuuguagucaucc

SEQ ID NO: 88536 - RNA, 20 nt, Artificial Sequence
  MKO10088536_B_Gm20865
  gRNA
aggagcuccacagcgaugag

SEQ ID NO: 88537 - RNA, 20 nt, Artificial Sequence
  MKO10088537_B_Gm20865
  gRNA
ugaguagaaacuacuuugug

SEQ ID NO: 88538 - RNA, 20 nt, Artificial Sequence
  MKO10088538_B_Gm20865
  gRNA
ucacaaaguaguuucuacuc

SEQ ID NO: 88539 - RNA, 20 nt, Artificial Sequence
  MKO10088539_B_Gm20867
  gRNA
guuguaccucucugcaaacc

SEQ ID NO: 88540 - RNA, 20 nt, Artificial Sequence
  MKO10088540_B_Gm20867
  gRNA
uaaaaauaguccuguaagaa

SEQ ID NO: 88541 - RNA, 20 nt, Artificial Sequence
  MKO10088541_B_Gm20867
  gRNA
ccucuacgucuaucagcucc

SEQ ID NO: 88542 - RNA, 20 nt, Artificial Sequence
  MKO10088542_B_Gm20877
  gRNA
guuguaccucuaugccaacc

SEQ ID NO: 88543 - RNA, 20 nt, Artificial Sequence
  MKO10088543_B_Gm20877
  gRNA
uuucgugcuuguucuguauc

SEQ ID NO: 88544 - RNA, 20 nt, Artificial Sequence
  MKO10088544_B_Gm20877
  gRNA
guaaugugccugccacccau

SEQ ID NO: 88545 - RNA, 20 nt, Artificial Sequence
  MKO10088545_B_Gm20878
  gRNA
ugucuuugcaggaucuacug

SEQ ID NO: 88546 - RNA, 20 nt, Artificial Sequence
  MKO10088546_B_Gm20878
  gRNA
acuuuaaaucuuuaaugcac

SEQ ID NO: 88547 - RNA, 20 nt, Artificial Sequence
  MKO10088547_B_Gm20878
  gRNA
ccuacagcucggcgcacccc

SEQ ID NO: 88548 - RNA, 20 nt, Artificial Sequence
  MKO10088548_B_Gm20917
  gRNA
gacagaauugacagugucua

SEQ ID NO: 88549 - RNA, 20 nt, Artificial Sequence
  MKO10088549_B_Gm20917
  gRNA
ugccaaccagugcgccugcg

SEQ ID NO: 88550 - RNA, 20 nt, Artificial Sequence
  MKO10088550_B_Gm20917
  gRNA
ugaggaaaaacuacuuugug

SEQ ID NO: 88551 - RNA, 20 nt, Artificial Sequence
  MKO10088551_B_Gm20939
  gRNA
cuuugcugaacccuacacag

SEQ ID NO: 88552 - RNA, 20 nt, Artificial Sequence
  MKO10088552_B_Gm20939
  gRNA
uaugaauucuuucauacuuu

SEQ ID NO: 88553 - RNA, 20 nt, Artificial Sequence
  MKO10088553_B_Gm20939
  gRNA
gacaauauucuucaguguuu

SEQ ID NO: 88554 - RNA, 20 nt, Artificial Sequence
  MKO10088554_B_Gm21002
  gRNA
cugauaugcuauuguagaaa

SEQ ID NO: 88555 - RNA, 20 nt, Artificial Sequence
  MKO10088555_B_Gm21002
  gRNA
caaaggagacagacacagcc

SEQ ID NO: 88556 - RNA, 20 nt, Artificial Sequence
  MKO10088556_B_Gm21002
  gRNA
uccuauccaaaacacagaug

SEQ ID NO: 88557 - RNA, 20 nt, Artificial Sequence
  MKO10088557_B_Gm21119
  gRNA
ggccacccaacgagacaaug

SEQ ID NO: 88558 - RNA, 20 nt, Artificial Sequence
  MKO10088558_B_Gm21119
  gRNA
gcuaaaaauucuaccauuuc

SEQ ID NO: 88559 - RNA, 20 nt, Artificial Sequence
  MKO10088559_B_Gm21119
  gRNA
auuugaacagaaaccugaaa

SEQ ID NO: 88560 - RNA, 20 nt, Artificial Sequence
  MKO10088560_B_Gm21293
  gRNA
cugaguaacugcuagauccu

SEQ ID NO: 88561 - RNA, 20 nt, Artificial Sequence
  MKO10088561_B_Gm21293
  gRNA
gccuccaaguguccauuucu

SEQ ID NO: 88562 - RNA, 20 nt, Artificial Sequence
  MKO10088562_B_Gm21293
  gRNA
gcugugcacuaugaucgcug

SEQ ID NO: 88563 - RNA, 20 nt, Artificial Sequence
  MKO10088563_B_Gm21304
  gRNA
cugaguaacugcuagauccu

SEQ ID NO: 88564 - RNA, 20 nt, Artificial Sequence
  MKO10088564_B_Gm21304
  gRNA
gccuccaaguguccauuucu

SEQ ID NO: 88565 - RNA, 20 nt, Artificial Sequence
  MKO10088565_B_Gm21304
  gRNA
gcugugcacuaugaucgcug

SEQ ID NO: 88566 - RNA, 20 nt, Artificial Sequence
  MKO10088566_B_Gm21312
  gRNA
cugaguaacugcuagauccu

SEQ ID NO: 88567 - RNA, 20 nt, Artificial Sequence
  MKO10088567_B_Gm21312
  gRNA
gccuccaaguguccauuucu

SEQ ID NO: 88568 - RNA, 20 nt, Artificial Sequence
  MKO10088568_B_Gm21312
  gRNA
gcugugcacuaugaucgcug

SEQ ID NO: 88569 - RNA, 20 nt, Artificial Sequence
  MKO10088569_B_Gm21319
  gRNA
uccaucaugccaaagaauaa

SEQ ID NO: 88570 - RNA, 20 nt, Artificial Sequence
  MKO10088570_B_Gm21319
  gRNA
acgauuucaucaucaucccc

SEQ ID NO: 88571 - RNA, 20 nt, Artificial Sequence
  MKO10088571_B_Gm21319
  gRNA
acaugccaaaaucaaugaaa

SEQ ID NO: 88572 - RNA, 20 nt, Artificial Sequence
  MKO10088572_B_Gm21498
  gRNA
auaugcuauuguagaauaag

SEQ ID NO: 88573 - RNA, 20 nt, Artificial Sequence
  MKO10088573_B_Gm21498
  gRNA
caaaagagauagacacagcc

SEQ ID NO: 88574 - RNA, 20 nt, Artificial Sequence
  MKO10088574_B_Gm21498
  gRNA
agaugaagagacuaauacug

SEQ ID NO: 88575 - RNA, 20 nt, Artificial Sequence
  MKO10088575_B_Gm21541
  gRNA
uaccuugcaggcagugaugg

SEQ ID NO: 88576 - RNA, 20 nt, Artificial Sequence
  MKO10088576_B_Gm21541
  gRNA
gccucaccucuugcagcccu

SEQ ID NO: 88577 - RNA, 20 nt, Artificial Sequence
  MKO10088577_B_Gm21541
  gRNA
caacccucagguucuuaccc

SEQ ID NO: 88578 - RNA, 20 nt, Artificial Sequence
  MKO10088578_B_Gm21586
  gRNA
ugucuuugcaggaucuacug

SEQ ID NO: 88579 - RNA, 20 nt, Artificial Sequence
  MKO10088579_B_Gm21586
  gRNA
acuuuaaaucuuuaaugcac

SEQ ID NO: 88580 - RNA, 20 nt, Artificial Sequence
  MKO10088580_B_Gm21586
  gRNA
ccuacagcucggcgcacccc

SEQ ID NO: 88581 - RNA, 20 nt, Artificial Sequence
  MKO10088581_B_Gm21637
  gRNA
agcauggcucuaaggaagag

SEQ ID NO: 88582 - RNA, 20 nt, Artificial Sequence
  MKO10088582_B_Gm21637
  gRNA
aaagcuggaaucagugacuc

SEQ ID NO: 88583 - RNA, 20 nt, Artificial Sequence
  MKO10088583_B_Gm21637
  gRNA
ccugagccaagcgccuaucu

SEQ ID NO: 88584 - RNA, 20 nt, Artificial Sequence
  MKO10088584_B_Gm21671
  gRNA
cuggggucaggcccuaccac

SEQ ID NO: 88585 - RNA, 20 nt, Artificial Sequence
  MKO10088585_B_Gm21671
  gRNA
uuuccaguaaccugcacacc

SEQ ID NO: 88586 - RNA, 20 nt, Artificial Sequence
  MKO10088586_B_Gm21671
  gRNA
ccugauguucuugagucucc

SEQ ID NO: 88587 - RNA, 20 nt, Artificial Sequence
  MKO10088587_B_Gm21677
  gRNA
cagcauucuuagcaucugca

SEQ ID NO: 88588 - RNA, 20 nt, Artificial Sequence
  MKO10088588_B_Gm21677
  gRNA
cccaaguucccuucacauga

SEQ ID NO: 88589 - RNA, 20 nt, Artificial Sequence
  MKO10088589_B_Gm21677
  gRNA
gaauuaaaguaaaacaagcc

SEQ ID NO: 88590 - RNA, 20 nt, Artificial Sequence
  MKO10088590_B_Gm21693
  gRNA
cagcauucuuagcaucugca

SEQ ID NO: 88591 - RNA, 20 nt, Artificial Sequence
  MKO10088591_B_Gm21693
  gRNA
cccaaguucccuucacauga

SEQ ID NO: 88592 - RNA, 20 nt, Artificial Sequence
  MKO10088592_B_Gm21693
  gRNA
gaauuaaaguaaaacaagcc

SEQ ID NO: 88593 - RNA, 20 nt, Artificial Sequence
  MKO10088593_B_Gm216
  gRNA
uuccuagacaaaucgcugug

SEQ ID NO: 88594 - RNA, 20 nt, Artificial Sequence
  MKO10088594_B_Gm216
  gRNA
gcugauggaacagcacaguc

SEQ ID NO: 88595 - RNA, 20 nt, Artificial Sequence
  MKO10088595_B_Gm216
  gRNA
gaagaugagcguccugaagc

SEQ ID NO: 88596 - RNA, 20 nt, Artificial Sequence
  MKO10088596_B_Gm21704
  gRNA
cgugaaacuaagaagucuag

SEQ ID NO: 88597 - RNA, 20 nt, Artificial Sequence
  MKO10088597_B_Gm21704
  gRNA
cccaaguucccuucacauga

SEQ ID NO: 88598 - RNA, 20 nt, Artificial Sequence
  MKO10088598_B_Gm21704
  gRNA
gaauuaaaguaaaacaagcc

SEQ ID NO: 88599 - RNA, 20 nt, Artificial Sequence
  MKO10088599_B_Gm21708
  gRNA
aaauaugaaucaacauccag

SEQ ID NO: 88600 - RNA, 20 nt, Artificial Sequence
  MKO10088600_B_Gm21708
  gRNA
uuuaccuaucauuagaagac

SEQ ID NO: 88601 - RNA, 20 nt, Artificial Sequence
  MKO10088601_B_Gm21708
  gRNA
auuucuagaaauaugccaag

SEQ ID NO: 88602 - RNA, 20 nt, Artificial Sequence
  MKO10088602_B_Gm21943
  gRNA
aagaucuccugauacagacc

SEQ ID NO: 88603 - RNA, 20 nt, Artificial Sequence
  MKO10088603_B_Gm21943
  gRNA
uaaaaauaguccuguaagaa

SEQ ID NO: 88604 - RNA, 20 nt, Artificial Sequence
  MKO10088604_B_Gm21943
  gRNA
aacaaacccuucucuuuauu

SEQ ID NO: 88605 - RNA, 20 nt, Artificial Sequence
  MKO10088605_B_Gm21949
  gRNA
ccuuuagaacaaguugacga

SEQ ID NO: 88606 - RNA, 20 nt, Artificial Sequence
  MKO10088606_B_Gm21949
  gRNA
ccaucgucaacuuguucuaa

SEQ ID NO: 88607 - RNA, 20 nt, Artificial Sequence
  MKO10088607_B_Gm21949
  gRNA
ucugcagcauccagcgagca

SEQ ID NO: 88608 - RNA, 20 nt, Artificial Sequence
  MKO10088608_B_Gm21950
  gRNA
uacuuuacuaacauucucaa

SEQ ID NO: 88609 - RNA, 20 nt, Artificial Sequence
  MKO10088609_B_Gm21950
  gRNA
cuuuacgcgugaccuuuacc

SEQ ID NO: 88610 - RNA, 20 nt, Artificial Sequence
  MKO10088610_B_Gm21950
  gRNA
caaccacuguuguuuguaaa

SEQ ID NO: 88611 - RNA, 20 nt, Artificial Sequence
  MKO10088611_B_Gm21951
  gRNA
aaaucugaucauuaagaaug

SEQ ID NO: 88612 - RNA, 20 nt, Artificial Sequence
  MKO10088612_B_Gm21951
  gRNA
uguuaucaauauaugccaug

SEQ ID NO: 88613 - RNA, 20 nt, Artificial Sequence
  MKO10088613_B_Gm21951
  gRNA
ggauuugucaauaacaccuc

SEQ ID NO: 88614 - RNA, 20 nt, Artificial Sequence
  MKO10088614_B_Gm2382
  gRNA
gccaggaauggcggcgguca

SEQ ID NO: 88615 - RNA, 20 nt, Artificial Sequence
  MKO10088615_B_Gm2382
  gRNA
caugcaagaugaaguugaga

SEQ ID NO: 88616 - RNA, 20 nt, Artificial Sequence
  MKO10088616_B_Gm2382
  gRNA
cuugaccucaucuuccuucc

SEQ ID NO: 88617 - RNA, 20 nt, Artificial Sequence
  MKO10088617_B_Gm2663
  gRNA
ugucugcaauggagagaucc

SEQ ID NO: 88618 - RNA, 20 nt, Artificial Sequence
  MKO10088618_B_Gm2663
  gRNA
agaagacuccagguucgccu

SEQ ID NO: 88619 - RNA, 20 nt, Artificial Sequence
  MKO10088619_B_Gm2663
  gRNA
uauuuccccagccagaaaca

SEQ ID NO: 88620 - RNA, 20 nt, Artificial Sequence
  MKO10088620_B_Gm266
  gRNA
uggcccgccgagagguucau

SEQ ID NO: 88621 - RNA, 20 nt, Artificial Sequence
  MKO10088621_B_Gm266
  gRNA
gcaccaccugcgugaacacg

SEQ ID NO: 88622 - RNA, 20 nt, Artificial Sequence
  MKO10088622_B_Gm266
  gRNA
cuggccacgcaguucgcgug

SEQ ID NO: 88623 - RNA, 20 nt, Artificial Sequence
  MKO10088623_B_Gm2696
  gRNA
acagcuggccugucugcagc

SEQ ID NO: 88624 - RNA, 20 nt, Artificial Sequence
  MKO10088624_B_Gm2696
  gRNA
auggggcacagcagcugggc

SEQ ID NO: 88625 - RNA, 20 nt, Artificial Sequence
  MKO10088625_B_Gm2696
  gRNA
ggaggaggcacaacaggaag

SEQ ID NO: 88626 - RNA, 20 nt, Artificial Sequence
  MKO10088626_B_Gm2799
  gRNA
acuuggagagaaucacacca

SEQ ID NO: 88627 - RNA, 20 nt, Artificial Sequence
  MKO10088627_B_Gm2799
  gRNA
aucuuguucaagaauaguug

SEQ ID NO: 88628 - RNA, 20 nt, Artificial Sequence
  MKO10088628_B_Gm2799
  gRNA
aaaucugaucauuaagaaug

SEQ ID NO: 88629 - RNA, 20 nt, Artificial Sequence
  MKO10088629_B_Gm2825
  gRNA
aaaucugaucauuaagaaug

SEQ ID NO: 88630 - RNA, 20 nt, Artificial Sequence
  MKO10088630_B_Gm2825
  gRNA
uguuaucaacauaugccaug

SEQ ID NO: 88631 - RNA, 20 nt, Artificial Sequence
  MKO10088631_B_Gm2825
  gRNA
ggauuugucaauaacaccuc

SEQ ID NO: 88632 - RNA, 20 nt, Artificial Sequence
  MKO10088632_B_Gm2863
  gRNA
aucuuguucaagaauaguug

SEQ ID NO: 88633 - RNA, 20 nt, Artificial Sequence
  MKO10088633_B_Gm2863
  gRNA
aaaucugaucauuaagaaug

SEQ ID NO: 88634 - RNA, 20 nt, Artificial Sequence
  MKO10088634_B_Gm2863
  gRNA
uguuaucaacauaugccaug

SEQ ID NO: 88635 - RNA, 20 nt, Artificial Sequence
  MKO10088635_B_Gm2897
  gRNA
acaacaugagaagacaaugu

SEQ ID NO: 88636 - RNA, 20 nt, Artificial Sequence
  MKO10088636_B_Gm2897
  gRNA
ucauccuaccugcuguuccu

SEQ ID NO: 88637 - RNA, 20 nt, Artificial Sequence
  MKO10088637_B_Gm2897
  gRNA
cucaacucaacgaaaacgua

SEQ ID NO: 88638 - RNA, 20 nt, Artificial Sequence
  MKO10088638_B_Gm2913
  gRNA
uacuuugcuaacauucucaa

SEQ ID NO: 88639 - RNA, 20 nt, Artificial Sequence
  MKO10088639_B_Gm2913
  gRNA
uugcuccuccuuauauucaa

SEQ ID NO: 88640 - RNA, 20 nt, Artificial Sequence
  MKO10088640_B_Gm2913
  gRNA
acuuggagagaaucacacca

SEQ ID NO: 88641 - RNA, 20 nt, Artificial Sequence
  MKO10088641_B_Gm2927
  gRNA
uacuuugcuaacauucucaa

SEQ ID NO: 88642 - RNA, 20 nt, Artificial Sequence
  MKO10088642_B_Gm2927
  gRNA
uuauucugaauaugacauuu

SEQ ID NO: 88643 - RNA, 20 nt, Artificial Sequence
  MKO10088643_B_Gm2927
  gRNA
acuuggagagaaucacacca

SEQ ID NO: 88644 - RNA, 20 nt, Artificial Sequence
  MKO10088644_B_Gm2933
  gRNA
aaaucugaucauuaagaaug

SEQ ID NO: 88645 - RNA, 20 nt, Artificial Sequence
  MKO10088645_B_Gm2933
  gRNA
aucuuguucaagaauaguug

SEQ ID NO: 88646 - RNA, 20 nt, Artificial Sequence
  MKO10088646_B_Gm2933
  gRNA
ggauuugucaauaacaccuc

SEQ ID NO: 88647 - RNA, 20 nt, Artificial Sequence
  MKO10088647_B_Gm2a
  gRNA
aggcacugugaaguugcucg

SEQ ID NO: 88648 - RNA, 20 nt, Artificial Sequence
  MKO10088648_B_Gm2a
  gRNA
gugacagguggagcucaccg

SEQ ID NO: 88649 - RNA, 20 nt, Artificial Sequence
  MKO10088649_B_Gm2a
  gRNA
agauguagucgucagccuug

SEQ ID NO: 88650 - RNA, 20 nt, Artificial Sequence
  MKO10088650_B_Gm3139
  gRNA
ccacaggaggccaaaacuuc

SEQ ID NO: 88651 - RNA, 20 nt, Artificial Sequence
  MKO10088651_B_Gm3139
  gRNA
uauccauguuuacugcaaac

SEQ ID NO: 88652 - RNA, 20 nt, Artificial Sequence
  MKO10088652_B_Gm3139
  gRNA
ccuaauuucacagacagacu

SEQ ID NO: 88653 - RNA, 20 nt, Artificial Sequence
  MKO10088653_B_Gm3238
  gRNA
augcucucaccaacuccucu

SEQ ID NO: 88654 - RNA, 20 nt, Artificial Sequence
  MKO10088654_B_Gm3238
  gRNA
gccacagccacugggcuggc

SEQ ID NO: 88655 - RNA, 20 nt, Artificial Sequence
  MKO10088655_B_Gm3238
  gRNA
gcagucauccaccugccaag

SEQ ID NO: 88656 - RNA, 20 nt, Artificial Sequence
  MKO10088656_B_Gm3258
  gRNA
aggaaccuguguugucgcau

SEQ ID NO: 88657 - RNA, 20 nt, Artificial Sequence
  MKO10088657_B_Gm3258
  gRNA
ccucaccgaugcgacaacac

SEQ ID NO: 88658 - RNA, 20 nt, Artificial Sequence
  MKO10088658_B_Gm3258
  gRNA
ggcccuggagacgguaccga

SEQ ID NO: 88659 - RNA, 20 nt, Artificial Sequence
  MKO10088659_B_Gm3259
  gRNA
ccacaggagggcaaaacuuc

SEQ ID NO: 88660 - RNA, 20 nt, Artificial Sequence
  MKO10088660_B_Gm3259
  gRNA
ugaaaacaagaacaaaauau

SEQ ID NO: 88661 - RNA, 20 nt, Artificial Sequence
  MKO10088661_B_Gm3259
  gRNA
uaggugccugaugacacccu

SEQ ID NO: 88662 - RNA, 20 nt, Artificial Sequence
  MKO10088662_B_Gm3264
  gRNA
acaacaugagaagacaaugu

SEQ ID NO: 88663 - RNA, 20 nt, Artificial Sequence
  MKO10088663_B_Gm3264
  gRNA
ucauccuaccugcuguuccu

SEQ ID NO: 88664 - RNA, 20 nt, Artificial Sequence
  MKO10088664_B_Gm3264
  gRNA
cucaacuccacgaaaacgua

SEQ ID NO: 88665 - RNA, 20 nt, Artificial Sequence
  MKO10088665_B_Gm3285
  gRNA
agccagcuggcaccaggaac

SEQ ID NO: 88666 - RNA, 20 nt, Artificial Sequence
  MKO10088666_B_Gm3285
  gRNA
ggaggaggagccagagcaga

SEQ ID NO: 88667 - RNA, 20 nt, Artificial Sequence
  MKO10088667_B_Gm3285
  gRNA
cacacaggcuugcagcagac

SEQ ID NO: 88668 - RNA, 20 nt, Artificial Sequence
  MKO10088668_B_Gm3286
  gRNA
ccuaauuucacagacagacu

SEQ ID NO: 88669 - RNA, 20 nt, Artificial Sequence
  MKO10088669_B_Gm3286
  gRNA
agguuaugcauauuuaucaa

SEQ ID NO: 88670 - RNA, 20 nt, Artificial Sequence
  MKO10088670_B_Gm3286
  gRNA
acugcugagagaugaggcuu

SEQ ID NO: 88671 - RNA, 20 nt, Artificial Sequence
  MKO10088671_B_Gm3317
  gRNA
acaacaugagaagacaaugu

SEQ ID NO: 88672 - RNA, 20 nt, Artificial Sequence
  MKO10088672_B_Gm3317
  gRNA
ucauccuaccugcuguuccu

SEQ ID NO: 88673 - RNA, 20 nt, Artificial Sequence
  MKO10088673_B_Gm3317
  gRNA
cucaacuccacgaaaaugua

SEQ ID NO: 88674 - RNA, 20 nt, Artificial Sequence
  MKO10088674_B_Gm3336
  gRNA
uagauaccguauccagauua

SEQ ID NO: 88675 - RNA, 20 nt, Artificial Sequence
  MKO10088675_B_Gm3336
  gRNA
uccacgaacuugccuccaca

SEQ ID NO: 88676 - RNA, 20 nt, Artificial Sequence
  MKO10088676_B_Gm3336
  gRNA
ccucugagagucacgacugu

SEQ ID NO: 88677 - RNA, 20 nt, Artificial Sequence
  MKO10088677_B_Gm3376
  gRNA
cgugaaacuaagaagucuag

SEQ ID NO: 88678 - RNA, 20 nt, Artificial Sequence
  MKO10088678_B_Gm3376
  gRNA
cccaaguucccuucacauga

SEQ ID NO: 88679 - RNA, 20 nt, Artificial Sequence
  MKO10088679_B_Gm3376
  gRNA
gaauuaaaguaaaacaagcc

SEQ ID NO: 88680 - RNA, 20 nt, Artificial Sequence
  MKO10088680_B_Gm3383
  gRNA
ucaaauccucauacauguaa

SEQ ID NO: 88681 - RNA, 20 nt, Artificial Sequence
  MKO10088681_B_Gm3383
  gRNA
acaacaugagaagacaaugu

SEQ ID NO: 88682 - RNA, 20 nt, Artificial Sequence
  MKO10088682_B_Gm3383
  gRNA
guuaucuucuaucaguuccu

SEQ ID NO: 88683 - RNA, 20 nt, Artificial Sequence
  MKO10088683_B_Gm3402
  gRNA
gccacagguaugcauccuuc

SEQ ID NO: 88684 - RNA, 20 nt, Artificial Sequence
  MKO10088684_B_Gm3402
  gRNA
ugccuccugaucuuccagca

SEQ ID NO: 88685 - RNA, 20 nt, Artificial Sequence
  MKO10088685_B_Gm3402
  gRNA
cuucccccagagccauauuc

SEQ ID NO: 88686 - RNA, 20 nt, Artificial Sequence
  MKO10088686_B_Gm3404
  gRNA
gccacagguaugcauccuuc

SEQ ID NO: 88687 - RNA, 20 nt, Artificial Sequence
  MKO10088687_B_Gm3404
  gRNA
ugccuccugaucuuccagca

SEQ ID NO: 88688 - RNA, 20 nt, Artificial Sequence
  MKO10088688_B_Gm3404
  gRNA
cuucccccagagccauauuc

SEQ ID NO: 88689 - RNA, 20 nt, Artificial Sequence
  MKO10088689_B_Gm3409
  gRNA
ggucuguucucaaaaugaac

SEQ ID NO: 88690 - RNA, 20 nt, Artificial Sequence
  MKO10088690_B_Gm3409
  gRNA
ccacucaccucuuaguuugc

SEQ ID NO: 88691 - RNA, 20 nt, Artificial Sequence
  MKO10088691_B_Gm3409
  gRNA
gccacagguaugcauccuuc

SEQ ID NO: 88692 - RNA, 20 nt, Artificial Sequence
  MKO10088692_B_Gm3415
  gRNA
gccacagguaugcauccuuc

SEQ ID NO: 88693 - RNA, 20 nt, Artificial Sequence
  MKO10088693_B_Gm3415
  gRNA
ugccuccugaucuuccagca

SEQ ID NO: 88694 - RNA, 20 nt, Artificial Sequence
  MKO10088694_B_Gm3415
  gRNA
cuucccccagagccauauuc

SEQ ID NO: 88695 - RNA, 20 nt, Artificial Sequence
  MKO10088695_B_Gm3417
  gRNA
gaugacucaauugcugaugu

SEQ ID NO: 88696 - RNA, 20 nt, Artificial Sequence
  MKO10088696_B_Gm3417
  gRNA
cccucauuugucacuugaau

SEQ ID NO: 88697 - RNA, 20 nt, Artificial Sequence
  MKO10088697_B_Gm3417
  gRNA
guauaaugaauuuauaacga

SEQ ID NO: 88698 - RNA, 20 nt, Artificial Sequence
  MKO10088698_B_Gm3435
  gRNA
ccuccuaucagggcgaaguc

SEQ ID NO: 88699 - RNA, 20 nt, Artificial Sequence
  MKO10088699_B_Gm3435
  gRNA
gccgagggcucgcuccagac

SEQ ID NO: 88700 - RNA, 20 nt, Artificial Sequence
  MKO10088700_B_Gm3435
  gRNA
cagccugcugccgucucccu

SEQ ID NO: 88701 - RNA, 20 nt, Artificial Sequence
  MKO10088701_B_Gm3448
  gRNA
gaugacucaauugcugaugu

SEQ ID NO: 88702 - RNA, 20 nt, Artificial Sequence
  MKO10088702_B_Gm3448
  gRNA
cccucauuugucacuugaau

SEQ ID NO: 88703 - RNA, 20 nt, Artificial Sequence
  MKO10088703_B_Gm3448
  gRNA
guauaaugaauuuauaacga

SEQ ID NO: 88704 - RNA, 20 nt, Artificial Sequence
  MKO10088704_B_Gm3488
  gRNA
acaacaugagaagacaaugu

SEQ ID NO: 88705 - RNA, 20 nt, Artificial Sequence
  MKO10088705_B_Gm3488
  gRNA
ucauccuaccugcuguuccu

SEQ ID NO: 88706 - RNA, 20 nt, Artificial Sequence
  MKO10088706_B_Gm3488
  gRNA
cucaacuccacgaaaaugua

SEQ ID NO: 88707 - RNA, 20 nt, Artificial Sequence
  MKO10088707_B_Gm3500
  gRNA
guuaucuucuaucaguuccu

SEQ ID NO: 88708 - RNA, 20 nt, Artificial Sequence
  MKO10088708_B_Gm3500
  gRNA
cucaacucaacgaaaacgua

SEQ ID NO: 88709 - RNA, 20 nt, Artificial Sequence
  MKO10088709_B_Gm3500
  gRNA
ucauccuaccugcuguuccu

SEQ ID NO: 88710 - RNA, 20 nt, Artificial Sequence
  MKO10088710_B_Gm3558
  gRNA
guuaucuucuaucaguuccu

SEQ ID NO: 88711 - RNA, 20 nt, Artificial Sequence
  MKO10088711_B_Gm3558
  gRNA
cucaacuccacgaaaacgua

SEQ ID NO: 88712 - RNA, 20 nt, Artificial Sequence
  MKO10088712_B_Gm3558
  gRNA
ucauccuaccugcugcuccu

SEQ ID NO: 88713 - RNA, 20 nt, Artificial Sequence
  MKO10088713_B_Gm3604
  gRNA
aucuuucagcuugcuugcaa

SEQ ID NO: 88714 - RNA, 20 nt, Artificial Sequence
  MKO10088714_B_Gm3604
  gRNA
cuagaaugcagugacuuaug

SEQ ID NO: 88715 - RNA, 20 nt, Artificial Sequence
  MKO10088715_B_Gm3604
  gRNA
caaauuuaccuauagcauug

SEQ ID NO: 88716 - RNA, 20 nt, Artificial Sequence
  MKO10088716_B_Gm362
  gRNA
acaucucuaagaagcuaauc

SEQ ID NO: 88717 - RNA, 20 nt, Artificial Sequence
  MKO10088717_B_Gm362
  gRNA
gaugagcgggaaauacuucg

SEQ ID NO: 88718 - RNA, 20 nt, Artificial Sequence
  MKO10088718_B_Gm362
  gRNA
ugaaguagaacugauuccga

SEQ ID NO: 88719 - RNA, 20 nt, Artificial Sequence
  MKO10088719_B_Gm3646
  gRNA
cugauaaagcauacgacaaa

SEQ ID NO: 88720 - RNA, 20 nt, Artificial Sequence
  MKO10088720_B_Gm3646
  gRNA
gguugaacccagggauacgg

SEQ ID NO: 88721 - RNA, 20 nt, Artificial Sequence
  MKO10088721_B_Gm3646
  gRNA
caagcucaucaaaugacaac

SEQ ID NO: 88722 - RNA, 20 nt, Artificial Sequence
  MKO10088722_B_Gm364
  gRNA
gaagaacaccauugcauguc

SEQ ID NO: 88723 - RNA, 20 nt, Artificial Sequence
  MKO10088723_B_Gm364
  gRNA
ugcugauaaauuauacucag

SEQ ID NO: 88724 - RNA, 20 nt, Artificial Sequence
  MKO10088724_B_Gm364
  gRNA
aauuuguccaagagucucag

SEQ ID NO: 88725 - RNA, 20 nt, Artificial Sequence
  MKO10088725_B_Gm3696
  gRNA
acaacaugagaagacaaugu

SEQ ID NO: 88726 - RNA, 20 nt, Artificial Sequence
  MKO10088726_B_Gm3696
  gRNA
guuaucuucuaucaguuccu

SEQ ID NO: 88727 - RNA, 20 nt, Artificial Sequence
  MKO10088727_B_Gm3696
  gRNA
cucaacucaacgaaaacgua

SEQ ID NO: 88728 - RNA, 20 nt, Artificial Sequence
  MKO10088728_B_Gm3701
  gRNA
aaauugcagaauauacacau

SEQ ID NO: 88729 - RNA, 20 nt, Artificial Sequence
  MKO10088729_B_Gm3701
  gRNA
uacuuugcuaacauucucaa

SEQ ID NO: 88730 - RNA, 20 nt, Artificial Sequence
  MKO10088730_B_Gm3701
  gRNA
uugcuccuccuuauauucaa

SEQ ID NO: 88731 - RNA, 20 nt, Artificial Sequence
  MKO10088731_B_Gm3706
  gRNA
guucacaacaguuucaacaa

SEQ ID NO: 88732 - RNA, 20 nt, Artificial Sequence
  MKO10088732_B_Gm3706
  gRNA
aaauugcagaauauacacau

SEQ ID NO: 88733 - RNA, 20 nt, Artificial Sequence
  MKO10088733_B_Gm3706
  gRNA
uugcuccuccuuauauucaa

SEQ ID NO: 88734 - RNA, 20 nt, Artificial Sequence
  MKO10088734_B_Gm3750
  gRNA
ggauuugucaauaacaccuc

SEQ ID NO: 88735 - RNA, 20 nt, Artificial Sequence
  MKO10088735_B_Gm3750
  gRNA
uguuaucaacauaugccaug

SEQ ID NO: 88736 - RNA, 20 nt, Artificial Sequence
  MKO10088736_B_Gm3750
  gRNA
uggcagcagcaugccugcuu

SEQ ID NO: 88737 - RNA, 20 nt, Artificial Sequence
  MKO10088737_B_Gm3763
  gRNA
acuuggagagaaucacacca

SEQ ID NO: 88738 - RNA, 20 nt, Artificial Sequence
  MKO10088738_B_Gm3763
  gRNA
aucuuguucaagaauaguug

SEQ ID NO: 88739 - RNA, 20 nt, Artificial Sequence
  MKO10088739_B_Gm3763
  gRNA
aaaucugaucauuaagaaug

SEQ ID NO: 88740 - RNA, 20 nt, Artificial Sequence
  MKO10088740_B_Gm3776
  gRNA
gauuuggaaaagcuaaaaaa

SEQ ID NO: 88741 - RNA, 20 nt, Artificial Sequence
  MKO10088741_B_Gm3776
  gRNA
ccuucauguccuucccauag

SEQ ID NO: 88742 - RNA, 20 nt, Artificial Sequence
  MKO10088742_B_Gm3776
  gRNA
gauguuugaccaagugccca

SEQ ID NO: 88743 - RNA, 20 nt, Artificial Sequence
  MKO10088743_B_Gm382
  gRNA
ugguuuacgcaaacuaguaa

SEQ ID NO: 88744 - RNA, 20 nt, Artificial Sequence
  MKO10088744_B_Gm382
  gRNA
gagguaaacguauaucuacu

SEQ ID NO: 88745 - RNA, 20 nt, Artificial Sequence
  MKO10088745_B_Gm382
  gRNA
uaacauugccacgaaccugc

SEQ ID NO: 88746 - RNA, 20 nt, Artificial Sequence
  MKO10088746_B_Gm3985
  gRNA
uauuacuaacgccaacaucu

SEQ ID NO: 88747 - RNA, 20 nt, Artificial Sequence
  MKO10088747_B_Gm3985
  gRNA
augagccgaccaguagaacc

SEQ ID NO: 88748 - RNA, 20 nt, Artificial Sequence
  MKO10088748_B_Gm3985
  gRNA
caccaagaugaacuucacua

SEQ ID NO: 88749 - RNA, 20 nt, Artificial Sequence
  MKO10088749_B_Gm4027
  gRNA
acaugccaaaaucaaugaaa

SEQ ID NO: 88750 - RNA, 20 nt, Artificial Sequence
  MKO10088750_B_Gm4027
  gRNA
gaaaucguguuugaugauau

SEQ ID NO: 88751 - RNA, 20 nt, Artificial Sequence
  MKO10088751_B_Gm4027
  gRNA
auguucuggaaguucuccau

SEQ ID NO: 88752 - RNA, 20 nt, Artificial Sequence
  MKO10088752_B_Gm4064
  gRNA
cgugaaacuaagaagucuag

SEQ ID NO: 88753 - RNA, 20 nt, Artificial Sequence
  MKO10088753_B_Gm4064
  gRNA
cccaaguucccuucacauga

SEQ ID NO: 88754 - RNA, 20 nt, Artificial Sequence
  MKO10088754_B_Gm4064
  gRNA
gaauuaaaguaaaacaagcc

SEQ ID NO: 88755 - RNA, 20 nt, Artificial Sequence
  MKO10088755_B_Gm4070
  gRNA
gaagagacuggagcagaaac

SEQ ID NO: 88756 - RNA, 20 nt, Artificial Sequence
  MKO10088756_B_Gm4070
  gRNA
agccucagcuacaaagcaga

SEQ ID NO: 88757 - RNA, 20 nt, Artificial Sequence
  MKO10088757_B_Gm4070
  gRNA
cugaaagccuugcagucaga

SEQ ID NO: 88758 - RNA, 20 nt, Artificial Sequence
  MKO10088758_B_Gm410
  gRNA
guaugacugcaacacccuca

SEQ ID NO: 88759 - RNA, 20 nt, Artificial Sequence
  MKO10088759_B_Gm410
  gRNA
uaucuugagcugauguaugc

SEQ ID NO: 88760 - RNA, 20 nt, Artificial Sequence
  MKO10088760_B_Gm410
  gRNA
ugauuuagcuuccauacuug

SEQ ID NO: 88761 - RNA, 20 nt, Artificial Sequence
  MKO10088761_B_Gm4133
  gRNA
gccuacacugaauccagaag

SEQ ID NO: 88762 - RNA, 20 nt, Artificial Sequence
  MKO10088762_B_Gm4133
  gRNA
uagagcaagugucacaaaca

SEQ ID NO: 88763 - RNA, 20 nt, Artificial Sequence
  MKO10088763_B_Gm4133
  gRNA
guguuauugucuguuaucug

SEQ ID NO: 88764 - RNA, 20 nt, Artificial Sequence
  MKO10088764_B_Gm4141
  gRNA
gccuacaaugaauccagaag

SEQ ID NO: 88765 - RNA, 20 nt, Artificial Sequence
  MKO10088765_B_Gm4141
  gRNA
guguuauugucuguuaucug

SEQ ID NO: 88766 - RNA, 20 nt, Artificial Sequence
  MKO10088766_B_Gm4141
  gRNA
guaacauccacauuccaauu

SEQ ID NO: 88767 - RNA, 20 nt, Artificial Sequence
  MKO10088767_B_Gm4175
  gRNA
guuauucuuguuaugguugu

SEQ ID NO: 88768 - RNA, 20 nt, Artificial Sequence
  MKO10088768_B_Gm4175
  gRNA
ucuuacagugaauccagaag

SEQ ID NO: 88769 - RNA, 20 nt, Artificial Sequence
  MKO10088769_B_Gm4175
  gRNA
uaacauccacauuccaauua

SEQ ID NO: 88770 - RNA, 20 nt, Artificial Sequence
  MKO10088770_B_Gm4177
  gRNA
gccuacaaugaauccagaag

SEQ ID NO: 88771 - RNA, 20 nt, Artificial Sequence
  MKO10088771_B_Gm4177
  gRNA
aacuuguucuguuccacuuc

SEQ ID NO: 88772 - RNA, 20 nt, Artificial Sequence
  MKO10088772_B_Gm4177
  gRNA
guguuauugucuguuaucug

SEQ ID NO: 88773 - RNA, 20 nt, Artificial Sequence
  MKO10088773_B_Gm4187
  gRNA
gccuacacugaauccagaag

SEQ ID NO: 88774 - RNA, 20 nt, Artificial Sequence
  MKO10088774_B_Gm4187
  gRNA
uagagcaagugucacaaaca

SEQ ID NO: 88775 - RNA, 20 nt, Artificial Sequence
  MKO10088775_B_Gm4187
  gRNA
guguuauugucuguuaucug

SEQ ID NO: 88776 - RNA, 20 nt, Artificial Sequence
  MKO10088776_B_Gm4201
  gRNA
gccuacaaugaauccagaag

SEQ ID NO: 88777 - RNA, 20 nt, Artificial Sequence
  MKO10088777_B_Gm4201
  gRNA
guguuauugucuguuaucug

SEQ ID NO: 88778 - RNA, 20 nt, Artificial Sequence
  MKO10088778_B_Gm4201
  gRNA
guaacauccacauuccaauu

SEQ ID NO: 88779 - RNA, 20 nt, Artificial Sequence
  MKO10088779_B_Gm4214
  gRNA
guuauucuuguuaugguugu

SEQ ID NO: 88780 - RNA, 20 nt, Artificial Sequence
  MKO10088780_B_Gm4214
  gRNA
ucuuacagugaauccagaag

SEQ ID NO: 88781 - RNA, 20 nt, Artificial Sequence
  MKO10088781_B_Gm4214
  gRNA
uaacauccacauuccaauua

SEQ ID NO: 88782 - RNA, 20 nt, Artificial Sequence
  MKO10088782_B_Gm4216
  gRNA
gccuacaaugaauccagaag

SEQ ID NO: 88783 - RNA, 20 nt, Artificial Sequence
  MKO10088783_B_Gm4216
  gRNA
aacuuguucuguuccacuuc

SEQ ID NO: 88784 - RNA, 20 nt, Artificial Sequence
  MKO10088784_B_Gm4216
  gRNA
guguuauugucuguuaucug

SEQ ID NO: 88785 - RNA, 20 nt, Artificial Sequence
  MKO10088785_B_Gm428
  gRNA
cagguccgugugauagcccg

SEQ ID NO: 88786 - RNA, 20 nt, Artificial Sequence
  MKO10088786_B_Gm428
  gRNA
aacgugcauaccuagagaga

SEQ ID NO: 88787 - RNA, 20 nt, Artificial Sequence
  MKO10088787_B_Gm428
  gRNA
cacucagguccuugguuuga

SEQ ID NO: 88788 - RNA, 20 nt, Artificial Sequence
  MKO10088788_B_Gm4297
  gRNA
auaguaaagaggccagcauu

SEQ ID NO: 88789 - RNA, 20 nt, Artificial Sequence
  MKO10088789_B_Gm4297
  gRNA
uagaagcagaugaaaauaua

SEQ ID NO: 88790 - RNA, 20 nt, Artificial Sequence
  MKO10088790_B_Gm4297
  gRNA
aauccaguaacucaugauga

SEQ ID NO: 88791 - RNA, 20 nt, Artificial Sequence
  MKO10088791_B_Gm4301
  gRNA
uuccugucaaaucugcacuu

SEQ ID NO: 88792 - RNA, 20 nt, Artificial Sequence
  MKO10088792_B_Gm4301
  gRNA
cuccgaagugcagauuugac

SEQ ID NO: 88793 - RNA, 20 nt, Artificial Sequence
  MKO10088793_B_Gm4301
  gRNA
cagcuacucuuugcugaauu

SEQ ID NO: 88794 - RNA, 20 nt, Artificial Sequence
  MKO10088794_B_Gm4302
  gRNA
uuccugucaaaucugcacuu

SEQ ID NO: 88795 - RNA, 20 nt, Artificial Sequence
  MKO10088795_B_Gm4302
  gRNA
cuccgaagugcagauuugac

SEQ ID NO: 88796 - RNA, 20 nt, Artificial Sequence
  MKO10088796_B_Gm4302
  gRNA
cagcuacucuuugcugaauu

SEQ ID NO: 88797 - RNA, 20 nt, Artificial Sequence
  MKO10088797_B_Gm4303
  gRNA
uuccugucaaaucugcacuu

SEQ ID NO: 88798 - RNA, 20 nt, Artificial Sequence
  MKO10088798_B_Gm4303
  gRNA
cuccgaagugcagauuugac

SEQ ID NO: 88799 - RNA, 20 nt, Artificial Sequence
  MKO10088799_B_Gm4303
  gRNA
cagcuacucuuugcugaauu

SEQ ID NO: 88800 - RNA, 20 nt, Artificial Sequence
  MKO10088800_B_Gm4305
  gRNA
uuccugucaaaucugcacuu

SEQ ID NO: 88801 - RNA, 20 nt, Artificial Sequence
  MKO10088801_B_Gm4305
  gRNA
cuccgaagugcagauuugac

SEQ ID NO: 88802 - RNA, 20 nt, Artificial Sequence
  MKO10088802_B_Gm4305
  gRNA
cagcuacucuuugcugaauu

SEQ ID NO: 88803 - RNA, 20 nt, Artificial Sequence
  MKO10088803_B_Gm4307
  gRNA
uuccugucaaaucugcacuu

SEQ ID NO: 88804 - RNA, 20 nt, Artificial Sequence
  MKO10088804_B_Gm4307
  gRNA
cuccgaagugcagauuugac

SEQ ID NO: 88805 - RNA, 20 nt, Artificial Sequence
  MKO10088805_B_Gm4307
  gRNA
cagcuacucuuugcugaauu

SEQ ID NO: 88806 - RNA, 20 nt, Artificial Sequence
  MKO10088806_B_Gm4312
  gRNA
uuccugucaaaucugcacuu

SEQ ID NO: 88807 - RNA, 20 nt, Artificial Sequence
  MKO10088807_B_Gm4312
  gRNA
cagcuacucuuugcugaauu

SEQ ID NO: 88808 - RNA, 20 nt, Artificial Sequence
  MKO10088808_B_Gm4312
  gRNA
cuccgaagugcagauuugac

SEQ ID NO: 88809 - RNA, 20 nt, Artificial Sequence
  MKO10088809_B_Gm4340
  gRNA
cugaguaacugcuagauccu

SEQ ID NO: 88810 - RNA, 20 nt, Artificial Sequence
  MKO10088810_B_Gm4340
  gRNA
cucagucucacacagcaagc

SEQ ID NO: 88811 - RNA, 20 nt, Artificial Sequence
  MKO10088811_B_Gm4340
  gRNA
agcuucgacugaacaauugu

SEQ ID NO: 88812 - RNA, 20 nt, Artificial Sequence
  MKO10088812_B_Gm436
  gRNA
ugcaugauuuagugcccaua

SEQ ID NO: 88813 - RNA, 20 nt, Artificial Sequence
  MKO10088813_B_Gm436
  gRNA
cugugucugcuacugcuagu

SEQ ID NO: 88814 - RNA, 20 nt, Artificial Sequence
  MKO10088814_B_Gm436
  gRNA
ugcauacaccugaacuugac

SEQ ID NO: 88815 - RNA, 20 nt, Artificial Sequence
  MKO10088815_B_Gm438
  gRNA
guuaugauaacauccccaga

SEQ ID NO: 88816 - RNA, 20 nt, Artificial Sequence
  MKO10088816_B_Gm438
  gRNA
ugaagcauccagccaaauua

SEQ ID NO: 88817 - RNA, 20 nt, Artificial Sequence
  MKO10088817_B_Gm438
  gRNA
ucucuugcagauacuuacca

SEQ ID NO: 88818 - RNA, 20 nt, Artificial Sequence
  MKO10088818_B_Gm4461
  gRNA
gaagggggugaggacuguau

SEQ ID NO: 88819 - RNA, 20 nt, Artificial Sequence
  MKO10088819_B_Gm4461
  gRNA
auguggagagaauguauugg

SEQ ID NO: 88820 - RNA, 20 nt, Artificial Sequence
  MKO10088820_B_Gm4461
  gRNA
ucugggaggagauacucuga

SEQ ID NO: 88821 - RNA, 20 nt, Artificial Sequence
  MKO10088821_B_Gm4477
  gRNA
gaucacagguccccuuccca

SEQ ID NO: 88822 - RNA, 20 nt, Artificial Sequence
  MKO10088822_B_Gm4477
  gRNA
gguggcugcucggccaguga

SEQ ID NO: 88823 - RNA, 20 nt, Artificial Sequence
  MKO10088823_B_Gm4477
  gRNA
ucauugcagcaccgaagaga

SEQ ID NO: 88824 - RNA, 20 nt, Artificial Sequence
  MKO10088824_B_Gm4498
  gRNA
guguuauugucuguuaucug

SEQ ID NO: 88825 - RNA, 20 nt, Artificial Sequence
  MKO10088825_B_Gm4498
  gRNA
guaacauccacauuccaauu

SEQ ID NO: 88826 - RNA, 20 nt, Artificial Sequence
  MKO10088826_B_Gm4498
  gRNA
cagugacccuaauuggaaug

SEQ ID NO: 88827 - RNA, 20 nt, Artificial Sequence
  MKO10088827_B_Gm44
  gRNA
uuucgugaagcuaaaguaug

SEQ ID NO: 88828 - RNA, 20 nt, Artificial Sequence
  MKO10088828_B_Gm44
  gRNA
gaguccucuccuaaaucaug

SEQ ID NO: 88829 - RNA, 20 nt, Artificial Sequence
  MKO10088829_B_Gm44
  gRNA
uaucuuggugacuaauagug

SEQ ID NO: 88830 - RNA, 20 nt, Artificial Sequence
  MKO10088830_B_Gm4559
  gRNA
gcacacagguuugcaacagc

SEQ ID NO: 88831 - RNA, 20 nt, Artificial Sequence
  MKO10088831_B_Gm4559
  gRNA
accagaaccaugaccugcug

SEQ ID NO: 88832 - RNA, 20 nt, Artificial Sequence
  MKO10088832_B_Gm4559
  gRNA
ucagcagcuguccugacagc

SEQ ID NO: 88833 - RNA, 20 nt, Artificial Sequence
  MKO10088833_B_Gm4567
  gRNA
guuugcccagauaguacaug

SEQ ID NO: 88834 - RNA, 20 nt, Artificial Sequence
  MKO10088834_B_Gm4567
  gRNA
caagccaaaaucacacagcu

SEQ ID NO: 88835 - RNA, 20 nt, Artificial Sequence
  MKO10088835_B_Gm4567
  gRNA
cauuguccauagagacauaa

SEQ ID NO: 88836 - RNA, 20 nt, Artificial Sequence
  MKO10088836_B_Gm4724
  gRNA
gacuucuagaaguuugaaaa

SEQ ID NO: 88837 - RNA, 20 nt, Artificial Sequence
  MKO10088837_B_Gm4724
  gRNA
cccucugaguuuauucaaug

SEQ ID NO: 88838 - RNA, 20 nt, Artificial Sequence
  MKO10088838_B_Gm4724
  gRNA
cuccuguauauguucgcuua

SEQ ID NO: 88839 - RNA, 20 nt, Artificial Sequence
  MKO10088839_B_Gm4736
  gRNA
cagcagagacccacucagcc

SEQ ID NO: 88840 - RNA, 20 nt, Artificial Sequence
  MKO10088840_B_Gm4736
  gRNA
gacucaaauucucagcuccu

SEQ ID NO: 88841 - RNA, 20 nt, Artificial Sequence
  MKO10088841_B_Gm4736
  gRNA
cugagaauuugagucuucgu

SEQ ID NO: 88842 - RNA, 20 nt, Artificial Sequence
  MKO10088842_B_Gm4745
  gRNA
uucgaagccacuugaaguuu

SEQ ID NO: 88843 - RNA, 20 nt, Artificial Sequence
  MKO10088843_B_Gm4745
  gRNA
accaaaugugccugaacaga

SEQ ID NO: 88844 - RNA, 20 nt, Artificial Sequence
  MKO10088844_B_Gm4745
  gRNA
cucaggccugaaaacaauac

SEQ ID NO: 88845 - RNA, 20 nt, Artificial Sequence
  MKO10088845_B_Gm4763
  gRNA
agaagauuccgauugaaguu

SEQ ID NO: 88846 - RNA, 20 nt, Artificial Sequence
  MKO10088846_B_Gm4763
  gRNA
uaagaggcagucacuauucc

SEQ ID NO: 88847 - RNA, 20 nt, Artificial Sequence
  MKO10088847_B_Gm4763
  gRNA
uaaaagugucaaugaugucc

SEQ ID NO: 88848 - RNA, 20 nt, Artificial Sequence
  MKO10088848_B_Gm4787
  gRNA
uguggcguuagaaucaaacg

SEQ ID NO: 88849 - RNA, 20 nt, Artificial Sequence
  MKO10088849_B_Gm4787
  gRNA
uccauuacaagcccuauuuc

SEQ ID NO: 88850 - RNA, 20 nt, Artificial Sequence
  MKO10088850_B_Gm4787
  gRNA
guaauggauggugcaacuug

SEQ ID NO: 88851 - RNA, 20 nt, Artificial Sequence
  MKO10088851_B_Gm4788
  gRNA
uaccuucguugcacaguaca

SEQ ID NO: 88852 - RNA, 20 nt, Artificial Sequence
  MKO10088852_B_Gm4788
  gRNA
uagucccagaaaaucccaga

SEQ ID NO: 88853 - RNA, 20 nt, Artificial Sequence
  MKO10088853_B_Gm4788
  gRNA
auuguccauucuccacauaa

SEQ ID NO: 88854 - RNA, 20 nt, Artificial Sequence
  MKO10088854_B_Gm4791
  gRNA
ugaugaacugugccugccug

SEQ ID NO: 88855 - RNA, 20 nt, Artificial Sequence
  MKO10088855_B_Gm4791
  gRNA
auccucugcuguaugugucu

SEQ ID NO: 88856 - RNA, 20 nt, Artificial Sequence
  MKO10088856_B_Gm4791
  gRNA
agggaggcugaaagaagcug

SEQ ID NO: 88857 - RNA, 20 nt, Artificial Sequence
  MKO10088857_B_Gm4794
  gRNA
auguguucauuguuugcucg

SEQ ID NO: 88858 - RNA, 20 nt, Artificial Sequence
  MKO10088858_B_Gm4794
  gRNA
acucaaagcuucagauacuc

SEQ ID NO: 88859 - RNA, 20 nt, Artificial Sequence
  MKO10088859_B_Gm4794
  gRNA
uugcagugguaggaagccuu

SEQ ID NO: 88860 - RNA, 20 nt, Artificial Sequence
  MKO10088860_B_Gm4832
  gRNA
gcaggcugauucuucaggcu

SEQ ID NO: 88861 - RNA, 20 nt, Artificial Sequence
  MKO10088861_B_Gm4832
  gRNA
auucaugauggcuacagcuc

SEQ ID NO: 88862 - RNA, 20 nt, Artificial Sequence
  MKO10088862_B_Gm4832
  gRNA
ugucuugcgaguccguguuu

SEQ ID NO: 88863 - RNA, 20 nt, Artificial Sequence
  MKO10088863_B_Gm4836
  gRNA
agaaaacguaaguuucucag

SEQ ID NO: 88864 - RNA, 20 nt, Artificial Sequence
  MKO10088864_B_Gm4836
  gRNA
acguucuguagagacaccaa

SEQ ID NO: 88865 - RNA, 20 nt, Artificial Sequence
  MKO10088865_B_Gm4836
  gRNA
aauccaguaacucaugauga

SEQ ID NO: 88866 - RNA, 20 nt, Artificial Sequence
  MKO10088866_B_Gm4841
  gRNA
uucuaacuuuguaaaucgug

SEQ ID NO: 88867 - RNA, 20 nt, Artificial Sequence
  MKO10088867_B_Gm4841
  gRNA
gcucuucucucauauaccua

SEQ ID NO: 88868 - RNA, 20 nt, Artificial Sequence
  MKO10088868_B_Gm4841
  gRNA
cgccaaaaguccauccuucg

SEQ ID NO: 88869 - RNA, 20 nt, Artificial Sequence
  MKO10088869_B_Gm4846
  gRNA
ccuccaccacaacgucccac

SEQ ID NO: 88870 - RNA, 20 nt, Artificial Sequence
  MKO10088870_B_Gm4846
  gRNA
uuuaaccugcaauacaucca

SEQ ID NO: 88871 - RNA, 20 nt, Artificial Sequence
  MKO10088871_B_Gm4846
  gRNA
ugagaaguaucugcccuugc

SEQ ID NO: 88872 - RNA, 20 nt, Artificial Sequence
  MKO10088872_B_Gm4847
  gRNA
uaccacaucccauugaccag

SEQ ID NO: 88873 - RNA, 20 nt, Artificial Sequence
  MKO10088873_B_Gm4847
  gRNA
caaacaccccgacaacuuug

SEQ ID NO: 88874 - RNA, 20 nt, Artificial Sequence
  MKO10088874_B_Gm4847
  gRNA
cuuuaggagauaccaaaaag

SEQ ID NO: 88875 - RNA, 20 nt, Artificial Sequence
  MKO10088875_B_Gm4858
  gRNA
augaacagaaauugugcuac

SEQ ID NO: 88876 - RNA, 20 nt, Artificial Sequence
  MKO10088876_B_Gm4858
  gRNA
cauuacaguuuaugcuuccg

SEQ ID NO: 88877 - RNA, 20 nt, Artificial Sequence
  MKO10088877_B_Gm4858
  gRNA
acaccuccacagcuacucua

SEQ ID NO: 88878 - RNA, 20 nt, Artificial Sequence
  MKO10088878_B_Gm4861
  gRNA
uuauaugauagauccaguuc

SEQ ID NO: 88879 - RNA, 20 nt, Artificial Sequence
  MKO10088879_B_Gm4861
  gRNA
gaguggaaagcaucgaggag

SEQ ID NO: 88880 - RNA, 20 nt, Artificial Sequence
  MKO10088880_B_Gm4861
  gRNA
uguuagugauuccuuacuuc

SEQ ID NO: 88881 - RNA, 20 nt, Artificial Sequence
  MKO10088881_B_Gm4871
  gRNA
guaagauagaaauaacugcu

SEQ ID NO: 88882 - RNA, 20 nt, Artificial Sequence
  MKO10088882_B_Gm4871
  gRNA
gugggccagaaaguugaaua

SEQ ID NO: 88883 - RNA, 20 nt, Artificial Sequence
  MKO10088883_B_Gm4871
  gRNA
acuauccaucagccuauucc

SEQ ID NO: 88884 - RNA, 20 nt, Artificial Sequence
  MKO10088884_B_Gm4884
  gRNA
uguuuggaguugcucagcag

SEQ ID NO: 88885 - RNA, 20 nt, Artificial Sequence
  MKO10088885_B_Gm4884
  gRNA
cagugcaaccuaccacacuc

SEQ ID NO: 88886 - RNA, 20 nt, Artificial Sequence
  MKO10088886_B_Gm4884
  gRNA
ucugcagcugacaguauguc

SEQ ID NO: 88887 - RNA, 20 nt, Artificial Sequence
  MKO10088887_B_Gm4894
  gRNA
caguucaggagucccuaccc

SEQ ID NO: 88888 - RNA, 20 nt, Artificial Sequence
  MKO10088888_B_Gm4894
  gRNA
gucuuaaauguugauaaaug

SEQ ID NO: 88889 - RNA, 20 nt, Artificial Sequence
  MKO10088889_B_Gm4894
  gRNA
cagaacucuguaaucauuuc

SEQ ID NO: 88890 - RNA, 20 nt, Artificial Sequence
  MKO10088890_B_Gm4906
  gRNA
ccuuggucaucaguugucau

SEQ ID NO: 88891 - RNA, 20 nt, Artificial Sequence
  MKO10088891_B_Gm4906
  gRNA
uuacaggugcagaagagcuc

SEQ ID NO: 88892 - RNA, 20 nt, Artificial Sequence
  MKO10088892_B_Gm4906
  gRNA
ggugagguggccuacaccac

SEQ ID NO: 88893 - RNA, 20 nt, Artificial Sequence
  MKO10088893_B_Gm4907
  gRNA
ucucauuguaagacaaccca

SEQ ID NO: 88894 - RNA, 20 nt, Artificial Sequence
  MKO10088894_B_Gm4907
  gRNA
aucauauguaacaguguuaa

SEQ ID NO: 88895 - RNA, 20 nt, Artificial Sequence
  MKO10088895_B_Gm4907
  gRNA
accuugagcauucauaucag

SEQ ID NO: 88896 - RNA, 20 nt, Artificial Sequence
  MKO10088896_B_Gm4922
  gRNA
ucacuucaguagugccaugc

SEQ ID NO: 88897 - RNA, 20 nt, Artificial Sequence
  MKO10088897_B_Gm4922
  gRNA
uucaccaugacaguagccua

SEQ ID NO: 88898 - RNA, 20 nt, Artificial Sequence
  MKO10088898_B_Gm4922
  gRNA
uguuauuggcaacaaacgca

SEQ ID NO: 88899 - RNA, 20 nt, Artificial Sequence
  MKO10088899_B_Gm4925
  gRNA
gguuacagguggauccgacc

SEQ ID NO: 88900 - RNA, 20 nt, Artificial Sequence
  MKO10088900_B_Gm4925
  gRNA
cuccgaagccgagagcgcaa

SEQ ID NO: 88901 - RNA, 20 nt, Artificial Sequence
  MKO10088901_B_Gm4925
  gRNA
uccucuaaaugcauucccgc

SEQ ID NO: 88902 - RNA, 20 nt, Artificial Sequence
  MKO10088902_B_Gm4937
  gRNA
gaugggaagugccacggcuu

SEQ ID NO: 88903 - RNA, 20 nt, Artificial Sequence
  MKO10088903_B_Gm4937
  gRNA
aguaugccugaaagucuaaa

SEQ ID NO: 88904 - RNA, 20 nt, Artificial Sequence
  MKO10088904_B_Gm4937
  gRNA
ugcaauccauuuagacuuuc

SEQ ID NO: 88905 - RNA, 20 nt, Artificial Sequence
  MKO10088905_B_Gm4944
  gRNA
augucuugacugugcucagc

SEQ ID NO: 88906 - RNA, 20 nt, Artificial Sequence
  MKO10088906_B_Gm4944
  gRNA
uucucuccuaaaugcuccuc

SEQ ID NO: 88907 - RNA, 20 nt, Artificial Sequence
  MKO10088907_B_Gm4944
  gRNA
cacugaccugaggagcauuu

SEQ ID NO: 88908 - RNA, 20 nt, Artificial Sequence
  MKO10088908_B_Gm4951
  gRNA
aaugaccgaaucuguaauau

SEQ ID NO: 88909 - RNA, 20 nt, Artificial Sequence
  MKO10088909_B_Gm4951
  gRNA
auucuacuucgugagaacac

SEQ ID NO: 88910 - RNA, 20 nt, Artificial Sequence
  MKO10088910_B_Gm4951
  gRNA
ugaugcaucuuugcagagau

SEQ ID NO: 88911 - RNA, 20 nt, Artificial Sequence
  MKO10088911_B_Gm4952
  gRNA
auauaacuuaccuguucccg

SEQ ID NO: 88912 - RNA, 20 nt, Artificial Sequence
  MKO10088912_B_Gm4952
  gRNA
uacagcgcccaaugaaucuc

SEQ ID NO: 88913 - RNA, 20 nt, Artificial Sequence
  MKO10088913_B_Gm4952
  gRNA
gcacaccagaugucaucaac

SEQ ID NO: 88914 - RNA, 20 nt, Artificial Sequence
  MKO10088914_B_Gm4975
  gRNA
gauaccaaagaaguaguauc

SEQ ID NO: 88915 - RNA, 20 nt, Artificial Sequence
  MKO10088915_B_Gm4975
  gRNA
cagacaauucuucuauguuc

SEQ ID NO: 88916 - RNA, 20 nt, Artificial Sequence
  MKO10088916_B_Gm4975
  gRNA
aauugcagcuaacaaauuau

SEQ ID NO: 88917 - RNA, 20 nt, Artificial Sequence
  MKO10088917_B_Gm4980
  gRNA
aaccuagucgcgccucgucc

SEQ ID NO: 88918 - RNA, 20 nt, Artificial Sequence
  MKO10088918_B_Gm4980
  gRNA
accgccgcggcauccaacgc

SEQ ID NO: 88919 - RNA, 20 nt, Artificial Sequence
  MKO10088919_B_Gm4980
  gRNA
acuacagcucaaucacgcgc

SEQ ID NO: 88920 - RNA, 20 nt, Artificial Sequence
  MKO10088920_B_Gm4981
  gRNA
caggggccaugaaguugcac

SEQ ID NO: 88921 - RNA, 20 nt, Artificial Sequence
  MKO10088921_B_Gm4981
  gRNA
uggguagugauccuggcgcc

SEQ ID NO: 88922 - RNA, 20 nt, Artificial Sequence
  MKO10088922_B_Gm4981
  gRNA
agagcaugugccagacccuu

SEQ ID NO: 88923 - RNA, 20 nt, Artificial Sequence
  MKO10088923_B_Gm4984
  gRNA
gcccuuccguaugauugcug

SEQ ID NO: 88924 - RNA, 20 nt, Artificial Sequence
  MKO10088924_B_Gm4984
  gRNA
ccaaauaggccucaugacug

SEQ ID NO: 88925 - RNA, 20 nt, Artificial Sequence
  MKO10088925_B_Gm4984
  gRNA
ugacguccucagcugacuug

SEQ ID NO: 88926 - RNA, 20 nt, Artificial Sequence
  MKO10088926_B_Gm5071
  gRNA
acccaguacaccaugccuag

SEQ ID NO: 88927 - RNA, 20 nt, Artificial Sequence
  MKO10088927_B_Gm5071
  gRNA
aauggcuagcuaaauguggg

SEQ ID NO: 88928 - RNA, 20 nt, Artificial Sequence
  MKO10088928_B_Gm5071
  gRNA
cacgcagagauccucugacc

SEQ ID NO: 88929 - RNA, 20 nt, Artificial Sequence
  MKO10088929_B_Gm5072
  gRNA
caagguacuucacuaucugc

SEQ ID NO: 88930 - RNA, 20 nt, Artificial Sequence
  MKO10088930_B_Gm5072
  gRNA
ccuucaugaagaucauaccc

SEQ ID NO: 88931 - RNA, 20 nt, Artificial Sequence
  MKO10088931_B_Gm5072
  gRNA
aaaggaugagcaaccuguag

SEQ ID NO: 88932 - RNA, 20 nt, Artificial Sequence
  MKO10088932_B_Gm5077
  gRNA
aguguaguaugcugcaaagc

SEQ ID NO: 88933 - RNA, 20 nt, Artificial Sequence
  MKO10088933_B_Gm5077
  gRNA
ccuguccccuaacuaucccc

SEQ ID NO: 88934 - RNA, 20 nt, Artificial Sequence
  MKO10088934_B_Gm5077
  gRNA
ugaauaccagauucaacugc

SEQ ID NO: 88935 - RNA, 20 nt, Artificial Sequence
  MKO10088935_B_Gm5082
  gRNA
gucaauucccaauaacauua

SEQ ID NO: 88936 - RNA, 20 nt, Artificial Sequence
  MKO10088936_B_Gm5082
  gRNA
cuaaaaucccaagaacuaaa

SEQ ID NO: 88937 - RNA, 20 nt, Artificial Sequence
  MKO10088937_B_Gm5082
  gRNA
agacaauucagaaaguauca

SEQ ID NO: 88938 - RNA, 20 nt, Artificial Sequence
  MKO10088938_B_Gm5087
  gRNA
caaguuaacauagaagauga

SEQ ID NO: 88939 - RNA, 20 nt, Artificial Sequence
  MKO10088939_B_Gm5087
  gRNA
gucauagaaguuaucauucg

SEQ ID NO: 88940 - RNA, 20 nt, Artificial Sequence
  MKO10088940_B_Gm5087
  gRNA
gaaggaucuuuguuguguuu

SEQ ID NO: 88941 - RNA, 20 nt, Artificial Sequence
  MKO10088941_B_Gm5108
  gRNA
uggacuucaauaauuaauug

SEQ ID NO: 88942 - RNA, 20 nt, Artificial Sequence
  MKO10088942_B_Gm5108
  gRNA
agccucguucugauauucuc

SEQ ID NO: 88943 - RNA, 20 nt, Artificial Sequence
  MKO10088943_B_Gm5108
  gRNA
gcugcauuucucucucagaa

SEQ ID NO: 88944 - RNA, 20 nt, Artificial Sequence
  MKO10088944_B_Gm5111
  gRNA
gagaaccaacccugcccagu

SEQ ID NO: 88945 - RNA, 20 nt, Artificial Sequence
  MKO10088945_B_Gm5111
  gRNA
ccuuaccagaagugacaucc

SEQ ID NO: 88946 - RNA, 20 nt, Artificial Sequence
  MKO10088946_B_Gm5111
  gRNA
cuaagaauucguugagacug

SEQ ID NO: 88947 - RNA, 20 nt, Artificial Sequence
  MKO10088947_B_Gm5113
  gRNA
gagcugggagacaccgauaa

SEQ ID NO: 88948 - RNA, 20 nt, Artificial Sequence
  MKO10088948_B_Gm5113
  gRNA
acgagaagcccugccuaugc

SEQ ID NO: 88949 - RNA, 20 nt, Artificial Sequence
  MKO10088949_B_Gm5113
  gRNA
ugacagacccuuggcaugua

SEQ ID NO: 88950 - RNA, 20 nt, Artificial Sequence
  MKO10088950_B_Gm5114
  gRNA
uguagcaccaucaccuucuc

SEQ ID NO: 88951 - RNA, 20 nt, Artificial Sequence
  MKO10088951_B_Gm5114
  gRNA
uuggagcuggacacaaggcu

SEQ ID NO: 88952 - RNA, 20 nt, Artificial Sequence
  MKO10088952_B_Gm5114
  gRNA
uauucuugacuuagcaucug

SEQ ID NO: 88953 - RNA, 20 nt, Artificial Sequence
  MKO10088953_B_Gm5127
  gRNA
caguagagacacgccacaua

SEQ ID NO: 88954 - RNA, 20 nt, Artificial Sequence
  MKO10088954_B_Gm5127
  gRNA
guuuauugguagcauagcuc

SEQ ID NO: 88955 - RNA, 20 nt, Artificial Sequence
  MKO10088955_B_Gm5127
  gRNA
cacaucuaacauuccuuaug

SEQ ID NO: 88956 - RNA, 20 nt, Artificial Sequence
  MKO10088956_B_Gm5128
  gRNA
ccuacaggagcccuaaacug

SEQ ID NO: 88957 - RNA, 20 nt, Artificial Sequence
  MKO10088957_B_Gm5128
  gRNA
aaugccaccucccauagcaa

SEQ ID NO: 88958 - RNA, 20 nt, Artificial Sequence
  MKO10088958_B_Gm5128
  gRNA
cagaguacuaucugcugauu

SEQ ID NO: 88959 - RNA, 20 nt, Artificial Sequence
  MKO10088959_B_Gm5132
  gRNA
aaaugaucuacaaggcuaag

SEQ ID NO: 88960 - RNA, 20 nt, Artificial Sequence
  MKO10088960_B_Gm5132
  gRNA
uguagaucauuuccuacgag

SEQ ID NO: 88961 - RNA, 20 nt, Artificial Sequence
  MKO10088961_B_Gm5132
  gRNA
aaaagaaccugcucccagag

SEQ ID NO: 88962 - RNA, 20 nt, Artificial Sequence
  MKO10088962_B_Gm5134
  gRNA
uaaucgucuauaucuucagc

SEQ ID NO: 88963 - RNA, 20 nt, Artificial Sequence
  MKO10088963_B_Gm5134
  gRNA
aagcugcaccuaugccagcc

SEQ ID NO: 88964 - RNA, 20 nt, Artificial Sequence
  MKO10088964_B_Gm5134
  gRNA
auuugugcccaucuauagca

SEQ ID NO: 88965 - RNA, 20 nt, Artificial Sequence
  MKO10088965_B_Gm5136
  gRNA
aguccgugcccuuucguccu

SEQ ID NO: 88966 - RNA, 20 nt, Artificial Sequence
  MKO10088966_B_Gm5136
  gRNA
gcaggcgguuuaccuugaau

SEQ ID NO: 88967 - RNA, 20 nt, Artificial Sequence
  MKO10088967_B_Gm5136
  gRNA
acugucccgauggugguacg

SEQ ID NO: 88968 - RNA, 20 nt, Artificial Sequence
  MKO10088968_B_Gm5141
  gRNA
auugccagcgaucuacaacc

SEQ ID NO: 88969 - RNA, 20 nt, Artificial Sequence
  MKO10088969_B_Gm5141
  gRNA
cuagaaugcagugacuuaug

SEQ ID NO: 88970 - RNA, 20 nt, Artificial Sequence
  MKO10088970_B_Gm5141
  gRNA
caaauguaccuaaagcacug

SEQ ID NO: 88971 - RNA, 20 nt, Artificial Sequence
  MKO10088971_B_Gm5142
  gRNA
cucucccaagaaagcaccga

SEQ ID NO: 88972 - RNA, 20 nt, Artificial Sequence
  MKO10088972_B_Gm5142
  gRNA
gggcauggccaucaugaaag

SEQ ID NO: 88973 - RNA, 20 nt, Artificial Sequence
  MKO10088973_B_Gm5142
  gRNA
ucuauccaucggugcuuucu

SEQ ID NO: 88974 - RNA, 20 nt, Artificial Sequence
  MKO10088974_B_Gm5148
  gRNA
aaucccucaauguugaagag

SEQ ID NO: 88975 - RNA, 20 nt, Artificial Sequence
  MKO10088975_B_Gm5148
  gRNA
ucucccucucuucaacauug

SEQ ID NO: 88976 - RNA, 20 nt, Artificial Sequence
  MKO10088976_B_Gm5148
  gRNA
acaauacagcacccugccug

SEQ ID NO: 88977 - RNA, 20 nt, Artificial Sequence
  MKO10088977_B_Gm514
  gRNA
agcaggucgggugcugaauc

SEQ ID NO: 88978 - RNA, 20 nt, Artificial Sequence
  MKO10088978_B_Gm514
  gRNA
gcugcggcagggcuacgacg

SEQ ID NO: 88979 - RNA, 20 nt, Artificial Sequence
  MKO10088979_B_Gm514
  gRNA
cugccgcagcagccugucgc

SEQ ID NO: 88980 - RNA, 20 nt, Artificial Sequence
  MKO10088980_B_Gm5150
  gRNA
caccuucaacucuuucccag

SEQ ID NO: 88981 - RNA, 20 nt, Artificial Sequence
  MKO10088981_B_Gm5150
  gRNA
auccaaggagcacagcugca

SEQ ID NO: 88982 - RNA, 20 nt, Artificial Sequence
  MKO10088982_B_Gm5150
  gRNA
agccgcuggaaaagaguuga

SEQ ID NO: 88983 - RNA, 20 nt, Artificial Sequence
  MKO10088983_B_Gm5168
  gRNA
agaaaacguaaguuucucag

SEQ ID NO: 88984 - RNA, 20 nt, Artificial Sequence
  MKO10088984_B_Gm5168
  gRNA
uaaguggugaacagcaaguu

SEQ ID NO: 88985 - RNA, 20 nt, Artificial Sequence
  MKO10088985_B_Gm5168
  gRNA
aauccaguaacucaugauga

SEQ ID NO: 88986 - RNA, 20 nt, Artificial Sequence
  MKO10088986_B_Gm5169
  gRNA
agaaaauguaaguuucucag

SEQ ID NO: 88987 - RNA, 20 nt, Artificial Sequence
  MKO10088987_B_Gm5169
  gRNA
acguucuguagagacaccaa

SEQ ID NO: 88988 - RNA, 20 nt, Artificial Sequence
  MKO10088988_B_Gm5169
  gRNA
aauccaguaacucaugauga

SEQ ID NO: 88989 - RNA, 20 nt, Artificial Sequence
  MKO10088989_B_Gm525
  gRNA
ggaguauaugcaucaucucc

SEQ ID NO: 88990 - RNA, 20 nt, Artificial Sequence
  MKO10088990_B_Gm525
  gRNA
cauggagaagcuguuugucu

SEQ ID NO: 88991 - RNA, 20 nt, Artificial Sequence
  MKO10088991_B_Gm525
  gRNA
uaccugaggagaaagccagc

SEQ ID NO: 88992 - RNA, 20 nt, Artificial Sequence
  MKO10088992_B_Gm527
  gRNA
gcauccaauguccgucaauc

SEQ ID NO: 88993 - RNA, 20 nt, Artificial Sequence
  MKO10088993_B_Gm527
  gRNA
gccuccaaaaugaucgaucu

SEQ ID NO: 88994 - RNA, 20 nt, Artificial Sequence
  MKO10088994_B_Gm527
  gRNA
agucguaucaaguuuccaug

SEQ ID NO: 88995 - RNA, 20 nt, Artificial Sequence
  MKO10088995_B_Gm5294
  gRNA
gacgcugacgacuacccugc

SEQ ID NO: 88996 - RNA, 20 nt, Artificial Sequence
  MKO10088996_B_Gm5294
  gRNA
ccccucgaaccaacagcgcg

SEQ ID NO: 88997 - RNA, 20 nt, Artificial Sequence
  MKO10088997_B_Gm5294
  gRNA
acgaggaaaagcggcuuaca

SEQ ID NO: 88998 - RNA, 20 nt, Artificial Sequence
  MKO10088998_B_Gm5346
  gRNA
uccaacuacagaaugcaucu

SEQ ID NO: 88999 - RNA, 20 nt, Artificial Sequence
  MKO10088999_B_Gm5346
  gRNA
uggaaugucaacgacaugau

SEQ ID NO: 89000 - RNA, 20 nt, Artificial Sequence
  MKO10089000_B_Gm5346
  gRNA
uuaucaccagaaucugauuc

SEQ ID NO: 89001 - RNA, 20 nt, Artificial Sequence
  MKO10089001_B_Gm5347
  gRNA
auagacaguggaccaucuuc

SEQ ID NO: 89002 - RNA, 20 nt, Artificial Sequence
  MKO10089002_B_Gm5347
  gRNA
uccuauugacuaguauucau

SEQ ID NO: 89003 - RNA, 20 nt, Artificial Sequence
  MKO10089003_B_Gm5347
  gRNA
cccuaugaauacuagucaau

SEQ ID NO: 89004 - RNA, 20 nt, Artificial Sequence
  MKO10089004_B_Gm5382
  gRNA
cuccgccaacucuucaaauc

SEQ ID NO: 89005 - RNA, 20 nt, Artificial Sequence
  MKO10089005_B_Gm5382
  gRNA
ucuucgccuuugcauuaucu

SEQ ID NO: 89006 - RNA, 20 nt, Artificial Sequence
  MKO10089006_B_Gm5382
  gRNA
ucauggccaagauaaugcaa

SEQ ID NO: 89007 - RNA, 20 nt, Artificial Sequence
  MKO10089007_B_Gm5409
  gRNA
cccagaccugcuccaaugcc

SEQ ID NO: 89008 - RNA, 20 nt, Artificial Sequence
  MKO10089008_B_Gm5409
  gRNA
cccuuccagggugacucuga

SEQ ID NO: 89009 - RNA, 20 nt, Artificial Sequence
  MKO10089009_B_Gm5409
  gRNA
gcaguggggcauccaggcau

SEQ ID NO: 89010 - RNA, 20 nt, Artificial Sequence
  MKO10089010_B_Gm5414
  gRNA
ucaaauagagucucuaccuc

SEQ ID NO: 89011 - RNA, 20 nt, Artificial Sequence
  MKO10089011_B_Gm5414
  gRNA
cgagaaugaacuuacagcca

SEQ ID NO: 89012 - RNA, 20 nt, Artificial Sequence
  MKO10089012_B_Gm5414
  gRNA
agcucaccuucuucaggguc

SEQ ID NO: 89013 - RNA, 20 nt, Artificial Sequence
  MKO10089013_B_Gm5415
  gRNA
acuguucuauagcaagcucu

SEQ ID NO: 89014 - RNA, 20 nt, Artificial Sequence
  MKO10089014_B_Gm5415
  gRNA
uggaacaacgaugguauuua

SEQ ID NO: 89015 - RNA, 20 nt, Artificial Sequence
  MKO10089015_B_Gm5415
  gRNA
ugagccacugaccauucuuc

SEQ ID NO: 89016 - RNA, 20 nt, Artificial Sequence
  MKO10089016_B_Gm5416
  gRNA
uauaaaucucaauucgucgc

SEQ ID NO: 89017 - RNA, 20 nt, Artificial Sequence
  MKO10089017_B_Gm5416
  gRNA
gaauugagauuuauacucaa

SEQ ID NO: 89018 - RNA, 20 nt, Artificial Sequence
  MKO10089018_B_Gm5416
  gRNA
ucaccuuguuagcaaucucc

SEQ ID NO: 89019 - RNA, 20 nt, Artificial Sequence
  MKO10089019_B_Gm5431
  gRNA
ugaaaagcucuucuuuacug

SEQ ID NO: 89020 - RNA, 20 nt, Artificial Sequence
  MKO10089020_B_Gm5431
  gRNA
aggucagagaggcacgaucc

SEQ ID NO: 89021 - RNA, 20 nt, Artificial Sequence
  MKO10089021_B_Gm5431
  gRNA
uucaccccuuacuccccuca

SEQ ID NO: 89022 - RNA, 20 nt, Artificial Sequence
  MKO10089022_B_Gm5458
  gRNA
ucaaauccucauacauguaa

SEQ ID NO: 89023 - RNA, 20 nt, Artificial Sequence
  MKO10089023_B_Gm5458
  gRNA
acaacaugagaagacaaugu

SEQ ID NO: 89024 - RNA, 20 nt, Artificial Sequence
  MKO10089024_B_Gm5458
  gRNA
ugcuuccaugaaguucuccg

SEQ ID NO: 89025 - RNA, 20 nt, Artificial Sequence
  MKO10089025_B_Gm5460
  gRNA
cagacccaccacagcacuac

SEQ ID NO: 89026 - RNA, 20 nt, Artificial Sequence
  MKO10089026_B_Gm5460
  gRNA
guucccugcaccucuaagac

SEQ ID NO: 89027 - RNA, 20 nt, Artificial Sequence
  MKO10089027_B_Gm5460
  gRNA
agcaccuguaccacaaccaa

SEQ ID NO: 89028 - RNA, 20 nt, Artificial Sequence
  MKO10089028_B_Gm5464
  gRNA
ccugcccgcgcgccaauccg

SEQ ID NO: 89029 - RNA, 20 nt, Artificial Sequence
  MKO10089029_B_Gm5464
  gRNA
gcaggcgugugcaugccgcc

SEQ ID NO: 89030 - RNA, 20 nt, Artificial Sequence
  MKO10089030_B_Gm5464
  gRNA
agagccaauggccucgcuga

SEQ ID NO: 89031 - RNA, 20 nt, Artificial Sequence
  MKO10089031_B_Gm5483
  gRNA
cucaucagaaugaugccugg

SEQ ID NO: 89032 - RNA, 20 nt, Artificial Sequence
  MKO10089032_B_Gm5483
  gRNA
gaacacuucauauuucucau

SEQ ID NO: 89033 - RNA, 20 nt, Artificial Sequence
  MKO10089033_B_Gm5483
  gRNA
uauaaaucucaagucgucgc

SEQ ID NO: 89034 - RNA, 20 nt, Artificial Sequence
  MKO10089034_B_Gm5506
  gRNA
uuugagcaagaggcaguugc

SEQ ID NO: 89035 - RNA, 20 nt, Artificial Sequence
  MKO10089035_B_Gm5506
  gRNA
acagagaauaaaucuaaauu

SEQ ID NO: 89036 - RNA, 20 nt, Artificial Sequence
  MKO10089036_B_Gm5506
  gRNA
gcagccuuggcaauccgcuu

SEQ ID NO: 89037 - RNA, 20 nt, Artificial Sequence
  MKO10089037_B_Gm5531
  gRNA
uuaacaaagggaugccucca

SEQ ID NO: 89038 - RNA, 20 nt, Artificial Sequence
  MKO10089038_B_Gm5531
  gRNA
ggcuggcugaagauagugac

SEQ ID NO: 89039 - RNA, 20 nt, Artificial Sequence
  MKO10089039_B_Gm5531
  gRNA
gccaagcugaaaauaucuua

SEQ ID NO: 89040 - RNA, 20 nt, Artificial Sequence
  MKO10089040_B_Gm5535
  gRNA
aucugcuuccagguugauuc

SEQ ID NO: 89041 - RNA, 20 nt, Artificial Sequence
  MKO10089041_B_Gm5535
  gRNA
guccacaagagcccaguaac

SEQ ID NO: 89042 - RNA, 20 nt, Artificial Sequence
  MKO10089042_B_Gm5535
  gRNA
gccaacagccugaaucaacc

SEQ ID NO: 89043 - RNA, 20 nt, Artificial Sequence
  MKO10089043_B_Gm5538
  gRNA
cccacucgcauuuguauuuc

SEQ ID NO: 89044 - RNA, 20 nt, Artificial Sequence
  MKO10089044_B_Gm5538
  gRNA
caguuguacuuucacuaaua

SEQ ID NO: 89045 - RNA, 20 nt, Artificial Sequence
  MKO10089045_B_Gm5538
  gRNA
gggcaaaauguuugaaauca

SEQ ID NO: 89046 - RNA, 20 nt, Artificial Sequence
  MKO10089046_B_Gm5544
  gRNA
gaauaguugcucucuguuug

SEQ ID NO: 89047 - RNA, 20 nt, Artificial Sequence
  MKO10089047_B_Gm5544
  gRNA
aaggcuaugguaccaagucc

SEQ ID NO: 89048 - RNA, 20 nt, Artificial Sequence
  MKO10089048_B_Gm5544
  gRNA
ugugugcaaucauuguaucc

SEQ ID NO: 89049 - RNA, 20 nt, Artificial Sequence
  MKO10089049_B_Gm5549
  gRNA
gacagccauguaauucuuac

SEQ ID NO: 89050 - RNA, 20 nt, Artificial Sequence
  MKO10089050_B_Gm5549
  gRNA
cguaaccaaagagugcagcc

SEQ ID NO: 89051 - RNA, 20 nt, Artificial Sequence
  MKO10089051_B_Gm5549
  gRNA
cuccauggcuucaugcgucg

SEQ ID NO: 89052 - RNA, 20 nt, Artificial Sequence
  MKO10089052_B_Gm5591
  gRNA
caugaagaguugugcucaac

SEQ ID NO: 89053 - RNA, 20 nt, Artificial Sequence
  MKO10089053_B_Gm5591
  gRNA
caguacgagcugccccugcc

SEQ ID NO: 89054 - RNA, 20 nt, Artificial Sequence
  MKO10089054_B_Gm5591
  gRNA
uaaaauccagcaccaagacc

SEQ ID NO: 89055 - RNA, 20 nt, Artificial Sequence
  MKO10089055_B_Gm5592
  gRNA
acaaagcuggaagacagugu

SEQ ID NO: 89056 - RNA, 20 nt, Artificial Sequence
  MKO10089056_B_Gm5592
  gRNA
ggagagguucucuucugcuu

SEQ ID NO: 89057 - RNA, 20 nt, Artificial Sequence
  MKO10089057_B_Gm5592
  gRNA
ggggccacuggugacugucc

SEQ ID NO: 89058 - RNA, 20 nt, Artificial Sequence
  MKO10089058_B_Gm5595
  gRNA
uuguaaagucucuucugaga

SEQ ID NO: 89059 - RNA, 20 nt, Artificial Sequence
  MKO10089059_B_Gm5595
  gRNA
ugucaaaaugauagaagaua

SEQ ID NO: 89060 - RNA, 20 nt, Artificial Sequence
  MKO10089060_B_Gm5595
  gRNA
gacaauguucuucaauguua

SEQ ID NO: 89061 - RNA, 20 nt, Artificial Sequence
  MKO10089061_B_Gm5615
  gRNA
uagaguugaacaaagugcac

SEQ ID NO: 89062 - RNA, 20 nt, Artificial Sequence
  MKO10089062_B_Gm5615
  gRNA
cacaagugugagaacauucc

SEQ ID NO: 89063 - RNA, 20 nt, Artificial Sequence
  MKO10089063_B_Gm5615
  gRNA
uuuacccuuuaucugcuuug

SEQ ID NO: 89064 - RNA, 20 nt, Artificial Sequence
  MKO10089064_B_Gm5617
  gRNA
uaggcuggauccgaaucagc

SEQ ID NO: 89065 - RNA, 20 nt, Artificial Sequence
  MKO10089065_B_Gm5617
  gRNA
ucggauccagccuaguaacc

SEQ ID NO: 89066 - RNA, 20 nt, Artificial Sequence
  MKO10089066_B_Gm5617
  gRNA
ccgacggguugagaucuccu

SEQ ID NO: 89067 - RNA, 20 nt, Artificial Sequence
  MKO10089067_B_Gm561
  gRNA
ucagcagcuguucacgcuug

SEQ ID NO: 89068 - RNA, 20 nt, Artificial Sequence
  MKO10089068_B_Gm561
  gRNA
ucaggaaccuuugaguggcu

SEQ ID NO: 89069 - RNA, 20 nt, Artificial Sequence
  MKO10089069_B_Gm561
  gRNA
uccugaccuaucugaaguca

SEQ ID NO: 89070 - RNA, 20 nt, Artificial Sequence
  MKO10089070_B_Gm5622
  gRNA
ugaauacugauuugaacuac

SEQ ID NO: 89071 - RNA, 20 nt, Artificial Sequence
  MKO10089071_B_Gm5622
  gRNA
accugcugcugcuuugcacu

SEQ ID NO: 89072 - RNA, 20 nt, Artificial Sequence
  MKO10089072_B_Gm5622
  gRNA
aucaauugaagaaaaaagua

SEQ ID NO: 89073 - RNA, 20 nt, Artificial Sequence
  MKO10089073_B_Gm5634
  gRNA
ugaacaucucugcacugguc

SEQ ID NO: 89074 - RNA, 20 nt, Artificial Sequence
  MKO10089074_B_Gm5634
  gRNA
agaaacgcuugaaguucucc

SEQ ID NO: 89075 - RNA, 20 nt, Artificial Sequence
  MKO10089075_B_Gm5634
  gRNA
ccugaccaaccugcgccaga

SEQ ID NO: 89076 - RNA, 20 nt, Artificial Sequence
  MKO10089076_B_Gm5635
  gRNA
cuccuaugaguacaugucga

SEQ ID NO: 89077 - RNA, 20 nt, Artificial Sequence
  MKO10089077_B_Gm5635
  gRNA
agaggcugagcuugucaaag

SEQ ID NO: 89078 - RNA, 20 nt, Artificial Sequence
  MKO10089078_B_Gm5635
  gRNA
gauggaaugugccuuccaca

SEQ ID NO: 89079 - RNA, 20 nt, Artificial Sequence
  MKO10089079_B_Gm5640
  gRNA
ucaccugaggacaaagagac

SEQ ID NO: 89080 - RNA, 20 nt, Artificial Sequence
  MKO10089080_B_Gm5640
  gRNA
ugugugacagcaccuuaccc

SEQ ID NO: 89081 - RNA, 20 nt, Artificial Sequence
  MKO10089081_B_Gm5640
  gRNA
agacaacacgagcgagcaag

SEQ ID NO: 89082 - RNA, 20 nt, Artificial Sequence
  MKO10089082_B_Gm5662
  gRNA
gaaaucguguuugaugauau

SEQ ID NO: 89083 - RNA, 20 nt, Artificial Sequence
  MKO10089083_B_Gm5662
  gRNA
ggaggcaaaaacaggcgcag

SEQ ID NO: 89084 - RNA, 20 nt, Artificial Sequence
  MKO10089084_B_Gm5662
  gRNA
auguucuggaaguucuccau

SEQ ID NO: 89085 - RNA, 20 nt, Artificial Sequence
  MKO10089085_B_Gm5725
  gRNA
gcccacacugaauccagaag

SEQ ID NO: 89086 - RNA, 20 nt, Artificial Sequence
  MKO10089086_B_Gm5725
  gRNA
guuauucuucuugcaguugu

SEQ ID NO: 89087 - RNA, 20 nt, Artificial Sequence
  MKO10089087_B_Gm5725
  gRNA
guguuauugucuguuaucug

SEQ ID NO: 89088 - RNA, 20 nt, Artificial Sequence
  MKO10089088_B_Gm5726
  gRNA
gacaaugcccacacugaauc

SEQ ID NO: 89089 - RNA, 20 nt, Artificial Sequence
  MKO10089089_B_Gm5726
  gRNA
guuauucuucuuacaguuau

SEQ ID NO: 89090 - RNA, 20 nt, Artificial Sequence
  MKO10089090_B_Gm5726
  gRNA
guguuauugucugcuaucug

SEQ ID NO: 89091 - RNA, 20 nt, Artificial Sequence
  MKO10089091_B_Gm5728
  gRNA
guguuauugucuguuaucug

SEQ ID NO: 89092 - RNA, 20 nt, Artificial Sequence
  MKO10089092_B_Gm5728
  gRNA
ugccacauucaugagcauca

SEQ ID NO: 89093 - RNA, 20 nt, Artificial Sequence
  MKO10089093_B_Gm5728
  gRNA
cagugaccuuaauuggaaug

SEQ ID NO: 89094 - RNA, 20 nt, Artificial Sequence
  MKO10089094_B_Gm572
  gRNA
aucuuccgagcacuguacuc

SEQ ID NO: 89095 - RNA, 20 nt, Artificial Sequence
  MKO10089095_B_Gm572
  gRNA
agagcgaucgcuacauaaug

SEQ ID NO: 89096 - RNA, 20 nt, Artificial Sequence
  MKO10089096_B_Gm572
  gRNA
ccagcgcauggagcucugac

SEQ ID NO: 89097 - RNA, 20 nt, Artificial Sequence
  MKO10089097_B_Gm5741
  gRNA
caagagcgaccccuuccuug

SEQ ID NO: 89098 - RNA, 20 nt, Artificial Sequence
  MKO10089098_B_Gm5741
  gRNA
gcaguugcuccacugcccga

SEQ ID NO: 89099 - RNA, 20 nt, Artificial Sequence
  MKO10089099_B_Gm5741
  gRNA
cuguccgaugucacugccag

SEQ ID NO: 89100 - RNA, 20 nt, Artificial Sequence
  MKO10089100_B_Gm5771
  gRNA
uuggggcuauggcugugccc

SEQ ID NO: 89101 - RNA, 20 nt, Artificial Sequence
  MKO10089101_B_Gm5771
  gRNA
acacaccaggauugucugcc

SEQ ID NO: 89102 - RNA, 20 nt, Artificial Sequence
  MKO10089102_B_Gm5771
  gRNA
gagcugcagacaccacccac

SEQ ID NO: 89103 - RNA, 20 nt, Artificial Sequence
  MKO10089103_B_Gm5795
  gRNA
gaacuucauggaaauaauua

SEQ ID NO: 89104 - RNA, 20 nt, Artificial Sequence
  MKO10089104_B_Gm5795
  gRNA
ucauccuaccugcugcuccu

SEQ ID NO: 89105 - RNA, 20 nt, Artificial Sequence
  MKO10089105_B_Gm5795
  gRNA
ccgugagugcacucaacuaa

SEQ ID NO: 89106 - RNA, 20 nt, Artificial Sequence
  MKO10089106_B_Gm5796
  gRNA
guuaucuucuaucaguuccu

SEQ ID NO: 89107 - RNA, 20 nt, Artificial Sequence
  MKO10089107_B_Gm5796
  gRNA
acaacaugagaagacaaugu

SEQ ID NO: 89108 - RNA, 20 nt, Artificial Sequence
  MKO10089108_B_Gm5796
  gRNA
ucauccuaccugcuguuccu

SEQ ID NO: 89109 - RNA, 20 nt, Artificial Sequence
  MKO10089109_B_Gm5797
  gRNA
caguuccucagagaacuuca

SEQ ID NO: 89110 - RNA, 20 nt, Artificial Sequence
  MKO10089110_B_Gm5797
  gRNA
ccgugagugcacucaacuaa

SEQ ID NO: 89111 - RNA, 20 nt, Artificial Sequence
  MKO10089111_B_Gm5797
  gRNA
ucauccuaccugcugcuccu

SEQ ID NO: 89112 - RNA, 20 nt, Artificial Sequence
  MKO10089112_B_Gm5800
  gRNA
uguagucaacuccuuguacu

SEQ ID NO: 89113 - RNA, 20 nt, Artificial Sequence
  MKO10089113_B_Gm5800
  gRNA
gcagccuucucccuacuucc

SEQ ID NO: 89114 - RNA, 20 nt, Artificial Sequence
  MKO10089114_B_Gm5800
  gRNA
accacaucaagcagaaaguc

SEQ ID NO: 89115 - RNA, 20 nt, Artificial Sequence
  MKO10089115_B_Gm5803
  gRNA
ccauagccaccuugguucug

SEQ ID NO: 89116 - RNA, 20 nt, Artificial Sequence
  MKO10089116_B_Gm5803
  gRNA
gaagcuagaaacaacgcaga

SEQ ID NO: 89117 - RNA, 20 nt, Artificial Sequence
  MKO10089117_B_Gm5803
  gRNA
agacaagauucucagcgacc

SEQ ID NO: 89118 - RNA, 20 nt, Artificial Sequence
  MKO10089118_B_Gm5820
  gRNA
ucggaccacauaccugagug

SEQ ID NO: 89119 - RNA, 20 nt, Artificial Sequence
  MKO10089119_B_Gm5820
  gRNA
ccagucgagcuguaaaauuc

SEQ ID NO: 89120 - RNA, 20 nt, Artificial Sequence
  MKO10089120_B_Gm5820
  gRNA
ucaagcaacagacuaguucc

SEQ ID NO: 89121 - RNA, 20 nt, Artificial Sequence
  MKO10089121_B_Gm5862
  gRNA
ugagcuccugauuguucucu

SEQ ID NO: 89122 - RNA, 20 nt, Artificial Sequence
  MKO10089122_B_Gm5862
  gRNA
uuuccaguaaccugcacacc

SEQ ID NO: 89123 - RNA, 20 nt, Artificial Sequence
  MKO10089123_B_Gm5862
  gRNA
ccugauguucuugagucucc

SEQ ID NO: 89124 - RNA, 20 nt, Artificial Sequence
  MKO10089124_B_Gm5868
  gRNA
cauucccacaacuguuuacg

SEQ ID NO: 89125 - RNA, 20 nt, Artificial Sequence
  MKO10089125_B_Gm5868
  gRNA
aggcauggcuguagauccag

SEQ ID NO: 89126 - RNA, 20 nt, Artificial Sequence
  MKO10089126_B_Gm5868
  gRNA
acacacaguccucuugcagu

SEQ ID NO: 89127 - RNA, 20 nt, Artificial Sequence
  MKO10089127_B_Gm5878
  gRNA
uuucacaggugcuggacacc

SEQ ID NO: 89128 - RNA, 20 nt, Artificial Sequence
  MKO10089128_B_Gm5878
  gRNA
ucaguguuacaugaauuccu

SEQ ID NO: 89129 - RNA, 20 nt, Artificial Sequence
  MKO10089129_B_Gm5878
  gRNA
aauucauguaacacugaaga

SEQ ID NO: 89130 - RNA, 20 nt, Artificial Sequence
  MKO10089130_B_Gm5885
  gRNA
aauauguccuucagauguaa

SEQ ID NO: 89131 - RNA, 20 nt, Artificial Sequence
  MKO10089131_B_Gm5885
  gRNA
cugcccucugagcugagcuc

SEQ ID NO: 89132 - RNA, 20 nt, Artificial Sequence
  MKO10089132_B_Gm5885
  gRNA
agccucuuccaagaugcuug

SEQ ID NO: 89133 - RNA, 20 nt, Artificial Sequence
  MKO10089133_B_Gm5886
  gRNA
acaucugauguccaagaaca

SEQ ID NO: 89134 - RNA, 20 nt, Artificial Sequence
  MKO10089134_B_Gm5886
  gRNA
cuuggacaucagauguacuc

SEQ ID NO: 89135 - RNA, 20 nt, Artificial Sequence
  MKO10089135_B_Gm5886
  gRNA
aaccuucuccaagaugcuug

SEQ ID NO: 89136 - RNA, 20 nt, Artificial Sequence
  MKO10089136_B_Gm5891
  gRNA
ccuaaacuccagauaucuac

SEQ ID NO: 89137 - RNA, 20 nt, Artificial Sequence
  MKO10089137_B_Gm5891
  gRNA
uagaggagagcgagacucga

SEQ ID NO: 89138 - RNA, 20 nt, Artificial Sequence
  MKO10089138_B_Gm5891
  gRNA
uucucugcuugcaagaguuc

SEQ ID NO: 89139 - RNA, 20 nt, Artificial Sequence
  MKO10089139_B_Gm5901
  gRNA
ugccacuugggcccucauca

SEQ ID NO: 89140 - RNA, 20 nt, Artificial Sequence
  MKO10089140_B_Gm5901
  gRNA
gcuccugguggaggguugcg

SEQ ID NO: 89141 - RNA, 20 nt, Artificial Sequence
  MKO10089141_B_Gm5901
  gRNA
cugcuucauccaguguuagc

SEQ ID NO: 89142 - RNA, 20 nt, Artificial Sequence
  MKO10089142_B_Gm590
  gRNA
caaucaguauguccgucgag

SEQ ID NO: 89143 - RNA, 20 nt, Artificial Sequence
  MKO10089143_B_Gm590
  gRNA
uccugcagaagaccucucga

SEQ ID NO: 89144 - RNA, 20 nt, Artificial Sequence
  MKO10089144_B_Gm590
  gRNA
gggguuuaacuggcuucuaa

SEQ ID NO: 89145 - RNA, 20 nt, Artificial Sequence
  MKO10089145_B_Gm5916
  gRNA
ccuuaccuguuugugagaau

SEQ ID NO: 89146 - RNA, 20 nt, Artificial Sequence
  MKO10089146_B_Gm5916
  gRNA
gagcaaaagaccccagcauc

SEQ ID NO: 89147 - RNA, 20 nt, Artificial Sequence
  MKO10089147_B_Gm5916
  gRNA
ccuacucuuucuccugaugc

SEQ ID NO: 89148 - RNA, 20 nt, Artificial Sequence
  MKO10089148_B_Gm5934
  gRNA
uagaagcagaugaaaauaua

SEQ ID NO: 89149 - RNA, 20 nt, Artificial Sequence
  MKO10089149_B_Gm5934
  gRNA
agaaaacguaaguuucucag

SEQ ID NO: 89150 - RNA, 20 nt, Artificial Sequence
  MKO10089150_B_Gm5934
  gRNA
acguucuguagagacaccaa

SEQ ID NO: 89151 - RNA, 20 nt, Artificial Sequence
  MKO10089151_B_Gm5935
  gRNA
agaaaacguaaguuucucag

SEQ ID NO: 89152 - RNA, 20 nt, Artificial Sequence
  MKO10089152_B_Gm5935
  gRNA
acguucuguagagacaccaa

SEQ ID NO: 89153 - RNA, 20 nt, Artificial Sequence
  MKO10089153_B_Gm5935
  gRNA
aauccaguaacucaugauga

SEQ ID NO: 89154 - RNA, 20 nt, Artificial Sequence
  MKO10089154_B_Gm5936
  gRNA
cucccgcgcucugaaaugga

SEQ ID NO: 89155 - RNA, 20 nt, Artificial Sequence
  MKO10089155_B_Gm5936
  gRNA
ggaccccagcccauaguaaa

SEQ ID NO: 89156 - RNA, 20 nt, Artificial Sequence
  MKO10089156_B_Gm5936
  gRNA
gagugccccagccuccagaa

SEQ ID NO: 89157 - RNA, 20 nt, Artificial Sequence
  MKO10089157_B_Gm5938
  gRNA
cuauaaaauacuaaguucuc

SEQ ID NO: 89158 - RNA, 20 nt, Artificial Sequence
  MKO10089158_B_Gm5938
  gRNA
agaguagacaagauagagag

SEQ ID NO: 89159 - RNA, 20 nt, Artificial Sequence
  MKO10089159_B_Gm5938
  gRNA
ucguagccuuaccugugaaa

SEQ ID NO: 89160 - RNA, 20 nt, Artificial Sequence
  MKO10089160_B_Gm5941
  gRNA
aggcaaaucuucacugucuu

SEQ ID NO: 89161 - RNA, 20 nt, Artificial Sequence
  MKO10089161_B_Gm5941
  gRNA
ucuaaucuucuugcuacauu

SEQ ID NO: 89162 - RNA, 20 nt, Artificial Sequence
  MKO10089162_B_Gm5941
  gRNA
cagaugcugugccaucaacc

SEQ ID NO: 89163 - RNA, 20 nt, Artificial Sequence
  MKO10089163_B_Gm595
  gRNA
acaggcaguuuggccccgag

SEQ ID NO: 89164 - RNA, 20 nt, Artificial Sequence
  MKO10089164_B_Gm595
  gRNA
ugacccauauuguaaacuga

SEQ ID NO: 89165 - RNA, 20 nt, Artificial Sequence
  MKO10089165_B_Gm595
  gRNA
ucaacacacuuuauuauugc

SEQ ID NO: 89166 - RNA, 20 nt, Artificial Sequence
  MKO10089166_B_Gm597
  gRNA
gauccccacuccaaguauaa

SEQ ID NO: 89167 - RNA, 20 nt, Artificial Sequence
  MKO10089167_B_Gm597
  gRNA
guccuucgcaacacugauau

SEQ ID NO: 89168 - RNA, 20 nt, Artificial Sequence
  MKO10089168_B_Gm597
  gRNA
aauaaccaccgcuguuuguu

SEQ ID NO: 89169 - RNA, 20 nt, Artificial Sequence
  MKO10089169_B_Gm6026
  gRNA
agccguguagaucguuuccu

SEQ ID NO: 89170 - RNA, 20 nt, Artificial Sequence
  MKO10089170_B_Gm6026
  gRNA
ugccaccuuguuugaagagu

SEQ ID NO: 89171 - RNA, 20 nt, Artificial Sequence
  MKO10089171_B_Gm6026
  gRNA
accaccugacacacaugcuc

SEQ ID NO: 89172 - RNA, 20 nt, Artificial Sequence
  MKO10089172_B_Gm6034
  gRNA
caggcccucucaugggacac

SEQ ID NO: 89173 - RNA, 20 nt, Artificial Sequence
  MKO10089173_B_Gm6034
  gRNA
cucagaucacucaacacaaa

SEQ ID NO: 89174 - RNA, 20 nt, Artificial Sequence
  MKO10089174_B_Gm6034
  gRNA
gagaacaagggagcugagag

SEQ ID NO: 89175 - RNA, 20 nt, Artificial Sequence
  MKO10089175_B_Gm6040
  gRNA
gcuucaggcagauaccuccu

SEQ ID NO: 89176 - RNA, 20 nt, Artificial Sequence
  MKO10089176_B_Gm6040
  gRNA
uccacaauaaugagacucca

SEQ ID NO: 89177 - RNA, 20 nt, Artificial Sequence
  MKO10089177_B_Gm6040
  gRNA
ccaaacugugagccuuucag

SEQ ID NO: 89178 - RNA, 20 nt, Artificial Sequence
  MKO10089178_B_Gm6086
  gRNA
caaccagcaggaacacggcc

SEQ ID NO: 89179 - RNA, 20 nt, Artificial Sequence
  MKO10089179_B_Gm6086
  gRNA
ccuauccacagcgcugcccg

SEQ ID NO: 89180 - RNA, 20 nt, Artificial Sequence
  MKO10089180_B_Gm6086
  gRNA
auaccgugucacaaaaagcc

SEQ ID NO: 89181 - RNA, 20 nt, Artificial Sequence
  MKO10089181_B_Gm608
  gRNA
cagcuccguuauguacuuaa

SEQ ID NO: 89182 - RNA, 20 nt, Artificial Sequence
  MKO10089182_B_Gm608
  gRNA
aaccgagagacacacaaugc

SEQ ID NO: 89183 - RNA, 20 nt, Artificial Sequence
  MKO10089183_B_Gm608
  gRNA
uaccugcauugugugucucu

SEQ ID NO: 89184 - RNA, 20 nt, Artificial Sequence
  MKO10089184_B_Gm609
  gRNA
caaucaauuaugucucagac

SEQ ID NO: 89185 - RNA, 20 nt, Artificial Sequence
  MKO10089185_B_Gm609
  gRNA
uaaagcauaacacuuaugag

SEQ ID NO: 89186 - RNA, 20 nt, Artificial Sequence
  MKO10089186_B_Gm609
  gRNA
ggcucauuaccucaaaauau

SEQ ID NO: 89187 - RNA, 20 nt, Artificial Sequence
  MKO10089187_B_Gm6121
  gRNA
agaaaacguaaguuucucag

SEQ ID NO: 89188 - RNA, 20 nt, Artificial Sequence
  MKO10089188_B_Gm6121
  gRNA
acguucuguagagacaccaa

SEQ ID NO: 89189 - RNA, 20 nt, Artificial Sequence
  MKO10089189_B_Gm6121
  gRNA
aauccaguaacucaugauga

SEQ ID NO: 89190 - RNA, 20 nt, Artificial Sequence
  MKO10089190_B_Gm614
  gRNA
uagcacaagcagucaacuga

SEQ ID NO: 89191 - RNA, 20 nt, Artificial Sequence
  MKO10089191_B_Gm614
  gRNA
caugggcacaauagcuuugu

SEQ ID NO: 89192 - RNA, 20 nt, Artificial Sequence
  MKO10089192_B_Gm614
  gRNA
aauccagaaccugaacuagu

SEQ ID NO: 89193 - RNA, 20 nt, Artificial Sequence
  MKO10089193_B_Gm6164
  gRNA
gcccacacugaauccagaag

SEQ ID NO: 89194 - RNA, 20 nt, Artificial Sequence
  MKO10089194_B_Gm6164
  gRNA
guuauucuucuuacaguugu

SEQ ID NO: 89195 - RNA, 20 nt, Artificial Sequence
  MKO10089195_B_Gm6164
  gRNA
guguuauugucuguuaucug

SEQ ID NO: 89196 - RNA, 20 nt, Artificial Sequence
  MKO10089196_B_Gm6251
  gRNA
ccaccucguaggcagcacca

SEQ ID NO: 89197 - RNA, 20 nt, Artificial Sequence
  MKO10089197_B_Gm6251
  gRNA
aacccagaggcaucgaccac

SEQ ID NO: 89198 - RNA, 20 nt, Artificial Sequence
  MKO10089198_B_Gm6251
  gRNA
ggccccuucuccgcacccug

SEQ ID NO: 89199 - RNA, 20 nt, Artificial Sequence
  MKO10089199_B_Gm6289
  gRNA
aagugucugacaucugaagc

SEQ ID NO: 89200 - RNA, 20 nt, Artificial Sequence
  MKO10089200_B_Gm6289
  gRNA
uuucuucccaguacaaaguc

SEQ ID NO: 89201 - RNA, 20 nt, Artificial Sequence
  MKO10089201_B_Gm6289
  gRNA
aagacaguccccauuacaga

SEQ ID NO: 89202 - RNA, 20 nt, Artificial Sequence
  MKO10089202_B_Gm6370
  gRNA
ccacucaccucuuaguuugc

SEQ ID NO: 89203 - RNA, 20 nt, Artificial Sequence
  MKO10089203_B_Gm6370
  gRNA
gccacagguaugcauccuuc

SEQ ID NO: 89204 - RNA, 20 nt, Artificial Sequence
  MKO10089204_B_Gm6370
  gRNA
ugccuccugaucuuccagca

SEQ ID NO: 89205 - RNA, 20 nt, Artificial Sequence
  MKO10089205_B_Gm6377
  gRNA
auacaaauucccgacuagcu

SEQ ID NO: 89206 - RNA, 20 nt, Artificial Sequence
  MKO10089206_B_Gm6377
  gRNA
gauugcauagugcuaaagag

SEQ ID NO: 89207 - RNA, 20 nt, Artificial Sequence
  MKO10089207_B_Gm6377
  gRNA
aauuagccuucaaaucucuc

SEQ ID NO: 89208 - RNA, 20 nt, Artificial Sequence
  MKO10089208_B_Gm6406
  gRNA
ggguugugucaugagucccu

SEQ ID NO: 89209 - RNA, 20 nt, Artificial Sequence
  MKO10089209_B_Gm6406
  gRNA
aguacucacagguuuccucc

SEQ ID NO: 89210 - RNA, 20 nt, Artificial Sequence
  MKO10089210_B_Gm6406
  gRNA
gcgucgaccccgcgcccugc

SEQ ID NO: 89211 - RNA, 20 nt, Artificial Sequence
  MKO10089211_B_Gm6408
  gRNA
guggaauagaaaccugaaua

SEQ ID NO: 89212 - RNA, 20 nt, Artificial Sequence
  MKO10089212_B_Gm6408
  gRNA
ccacucacguugucaucagc

SEQ ID NO: 89213 - RNA, 20 nt, Artificial Sequence
  MKO10089213_B_Gm6408
  gRNA
ggucuguucucaaaaugaac

SEQ ID NO: 89214 - RNA, 20 nt, Artificial Sequence
  MKO10089214_B_Gm6432
  gRNA
cacaacucguuugccugaug

SEQ ID NO: 89215 - RNA, 20 nt, Artificial Sequence
  MKO10089215_B_Gm6432
  gRNA
aggcaaacgaguuguguacg

SEQ ID NO: 89216 - RNA, 20 nt, Artificial Sequence
  MKO10089216_B_Gm6432
  gRNA
uaaugguaaaauaguagagu

SEQ ID NO: 89217 - RNA, 20 nt, Artificial Sequence
  MKO10089217_B_Gm6460
  gRNA
acugagaucaacgaagaacc

SEQ ID NO: 89218 - RNA, 20 nt, Artificial Sequence
  MKO10089218_B_Gm6460
  gRNA
uuguugggucucaugguugc

SEQ ID NO: 89219 - RNA, 20 nt, Artificial Sequence
  MKO10089219_B_Gm6460
  gRNA
ccuacauagccagcucuuga

SEQ ID NO: 89220 - RNA, 20 nt, Artificial Sequence
  MKO10089220_B_Gm6484
  gRNA
cccgcugcugucgcugcacg

SEQ ID NO: 89221 - RNA, 20 nt, Artificial Sequence
  MKO10089221_B_Gm6484
  gRNA
ggaaguggcccgggcccagc

SEQ ID NO: 89222 - RNA, 20 nt, Artificial Sequence
  MKO10089222_B_Gm6484
  gRNA
auaagcagagccaccucuua

SEQ ID NO: 89223 - RNA, 20 nt, Artificial Sequence
  MKO10089223_B_Gm648
  gRNA
aggggcauaccaugcugaaa

SEQ ID NO: 89224 - RNA, 20 nt, Artificial Sequence
  MKO10089224_B_Gm648
  gRNA
ccaguaucuucuccagauac

SEQ ID NO: 89225 - RNA, 20 nt, Artificial Sequence
  MKO10089225_B_Gm648
  gRNA
aucucuugaagcuucagcug

SEQ ID NO: 89226 - RNA, 20 nt, Artificial Sequence
  MKO10089226_B_Gm6531
  gRNA
gcccaaggacauagacaagu

SEQ ID NO: 89227 - RNA, 20 nt, Artificial Sequence
  MKO10089227_B_Gm6531
  gRNA
uucacaucuuacuguuccag

SEQ ID NO: 89228 - RNA, 20 nt, Artificial Sequence
  MKO10089228_B_Gm6531
  gRNA
gaccaacuugucuauguccu

SEQ ID NO: 89229 - RNA, 20 nt, Artificial Sequence
  MKO10089229_B_Gm6537
  gRNA
gcuaacccgcugucuagcag

SEQ ID NO: 89230 - RNA, 20 nt, Artificial Sequence
  MKO10089230_B_Gm6537
  gRNA
cccgagagccuccccuagca

SEQ ID NO: 89231 - RNA, 20 nt, Artificial Sequence
  MKO10089231_B_Gm6537
  gRNA
auugaugcccagacccucca

SEQ ID NO: 89232 - RNA, 20 nt, Artificial Sequence
  MKO10089232_B_Gm6583
  gRNA
ugagccgucuauuaagugcc

SEQ ID NO: 89233 - RNA, 20 nt, Artificial Sequence
  MKO10089233_B_Gm6583
  gRNA
gcaccaggaacaaacgaucc

SEQ ID NO: 89234 - RNA, 20 nt, Artificial Sequence
  MKO10089234_B_Gm6583
  gRNA
gccugccgugcgggagguga

SEQ ID NO: 89235 - RNA, 20 nt, Artificial Sequence
  MKO10089235_B_Gm6588
  gRNA
ugugccucgcgguccaggaa

SEQ ID NO: 89236 - RNA, 20 nt, Artificial Sequence
  MKO10089236_B_Gm6588
  gRNA
ggagaggauucauacgaugu

SEQ ID NO: 89237 - RNA, 20 nt, Artificial Sequence
  MKO10089237_B_Gm6588
  gRNA
gugagcuuucugucgagaua

SEQ ID NO: 89238 - RNA, 20 nt, Artificial Sequence
  MKO10089238_B_Gm6592
  gRNA
gauauuucuacauacuucuc

SEQ ID NO: 89239 - RNA, 20 nt, Artificial Sequence
  MKO10089239_B_Gm6592
  gRNA
gaaugcuuugaagaaucuuu

SEQ ID NO: 89240 - RNA, 20 nt, Artificial Sequence
  MKO10089240_B_Gm6592
  gRNA
gacaccaagaaaacgaauga

SEQ ID NO: 89241 - RNA, 20 nt, Artificial Sequence
  MKO10089241_B_Gm6614
  gRNA
cugguaggaaauauuauacg

SEQ ID NO: 89242 - RNA, 20 nt, Artificial Sequence
  MKO10089242_B_Gm6614
  gRNA
acacacaaaaagcuguuuga

SEQ ID NO: 89243 - RNA, 20 nt, Artificial Sequence
  MKO10089243_B_Gm6614
  gRNA
aagauguuuggcccaguaau

SEQ ID NO: 89244 - RNA, 20 nt, Artificial Sequence
  MKO10089244_B_Gm6696
  gRNA
cauuaaaugacccuuucugc

SEQ ID NO: 89245 - RNA, 20 nt, Artificial Sequence
  MKO10089245_B_Gm6696
  gRNA
caaaggagacagaaacagcu

SEQ ID NO: 89246 - RNA, 20 nt, Artificial Sequence
  MKO10089246_B_Gm6696
  gRNA
aguaaaauugaugagcagcc

SEQ ID NO: 89247 - RNA, 20 nt, Artificial Sequence
  MKO10089247_B_Gm6710
  gRNA
acuggguuuagguuacauuu

SEQ ID NO: 89248 - RNA, 20 nt, Artificial Sequence
  MKO10089248_B_Gm6710
  gRNA
accauacuaguuacauucau

SEQ ID NO: 89249 - RNA, 20 nt, Artificial Sequence
  MKO10089249_B_Gm6710
  gRNA
cccucugaguuuauucaaug

SEQ ID NO: 89250 - RNA, 20 nt, Artificial Sequence
  MKO10089250_B_Gm6760
  gRNA
gccuacacaaagcaauaccu

SEQ ID NO: 89251 - RNA, 20 nt, Artificial Sequence
  MKO10089251_B_Gm6760
  gRNA
gccagucacuggguguuauu

SEQ ID NO: 89252 - RNA, 20 nt, Artificial Sequence
  MKO10089252_B_Gm6760
  gRNA
ucagaacaagcgagaugaga

SEQ ID NO: 89253 - RNA, 20 nt, Artificial Sequence
  MKO10089253_B_Gm6763
  gRNA
cugaguaacugcuagauccu

SEQ ID NO: 89254 - RNA, 20 nt, Artificial Sequence
  MKO10089254_B_Gm6763
  gRNA
gccuccaaguguccauuucu

SEQ ID NO: 89255 - RNA, 20 nt, Artificial Sequence
  MKO10089255_B_Gm6763
  gRNA
gcugugcacuaugaucgcug

SEQ ID NO: 89256 - RNA, 20 nt, Artificial Sequence
  MKO10089256_B_Gm6772
  gRNA
ugaagcugaauugacaccuc

SEQ ID NO: 89257 - RNA, 20 nt, Artificial Sequence
  MKO10089257_B_Gm6772
  gRNA
cacuacacccaccaguuugc

SEQ ID NO: 89258 - RNA, 20 nt, Artificial Sequence
  MKO10089258_B_Gm6772
  gRNA
agagcgaagaguuauucucc

SEQ ID NO: 89259 - RNA, 20 nt, Artificial Sequence
  MKO10089259_B_Gm6812
  gRNA
gcuguccagcucauagcuug

SEQ ID NO: 89260 - RNA, 20 nt, Artificial Sequence
  MKO10089260_B_Gm6812
  gRNA
ucucauucuucuucacagcu

SEQ ID NO: 89261 - RNA, 20 nt, Artificial Sequence
  MKO10089261_B_Gm6812
  gRNA
cguaaaugagaagccuaacc

SEQ ID NO: 89262 - RNA, 20 nt, Artificial Sequence
  MKO10089262_B_Gm684
  gRNA
acuaccaugccaucuuccgc

SEQ ID NO: 89263 - RNA, 20 nt, Artificial Sequence
  MKO10089263_B_Gm684
  gRNA
cuguacugaccugcggaaga

SEQ ID NO: 89264 - RNA, 20 nt, Artificial Sequence
  MKO10089264_B_Gm684
  gRNA
gaauuaccaggcucugguug

SEQ ID NO: 89265 - RNA, 20 nt, Artificial Sequence
  MKO10089265_B_Gm6878
  gRNA
ccagggcuugcugccuguau

SEQ ID NO: 89266 - RNA, 20 nt, Artificial Sequence
  MKO10089266_B_Gm6878
  gRNA
agcccaaacagcacaccaac

SEQ ID NO: 89267 - RNA, 20 nt, Artificial Sequence
  MKO10089267_B_Gm6878
  gRNA
cacugugcagucucuccagu

SEQ ID NO: 89268 - RNA, 20 nt, Artificial Sequence
  MKO10089268_B_Gm6880
  gRNA
gcucuguaacagugccuuuc

SEQ ID NO: 89269 - RNA, 20 nt, Artificial Sequence
  MKO10089269_B_Gm6880
  gRNA
uuuccuugaccagcucuccc

SEQ ID NO: 89270 - RNA, 20 nt, Artificial Sequence
  MKO10089270_B_Gm6880
  gRNA
ugacaacagccacaaacucc

SEQ ID NO: 89271 - RNA, 20 nt, Artificial Sequence
  MKO10089271_B_Gm6890
  gRNA
aggcauggcccgcagauccc

SEQ ID NO: 89272 - RNA, 20 nt, Artificial Sequence
  MKO10089272_B_Gm6890
  gRNA
ugacaacagccacaaacucc

SEQ ID NO: 89273 - RNA, 20 nt, Artificial Sequence
  MKO10089273_B_Gm6890
  gRNA
uuuccuugaccagcucuccc

SEQ ID NO: 89274 - RNA, 20 nt, Artificial Sequence
  MKO10089274_B_Gm6902
  gRNA
cauuguccauagagacauaa

SEQ ID NO: 89275 - RNA, 20 nt, Artificial Sequence
  MKO10089275_B_Gm6902
  gRNA
caagccaaaaucacacagcu

SEQ ID NO: 89276 - RNA, 20 nt, Artificial Sequence
  MKO10089276_B_Gm6902
  gRNA
gcaacaucuugaucgacuac

SEQ ID NO: 89277 - RNA, 20 nt, Artificial Sequence
  MKO10089277_B_Gm6904
  gRNA
auccugcagcuguauucauc

SEQ ID NO: 89278 - RNA, 20 nt, Artificial Sequence
  MKO10089278_B_Gm6904
  gRNA
ucaaaguuucuaacuguauu

SEQ ID NO: 89279 - RNA, 20 nt, Artificial Sequence
  MKO10089279_B_Gm6904
  gRNA
uuaccacuuauccugugcca

SEQ ID NO: 89280 - RNA, 20 nt, Artificial Sequence
  MKO10089280_B_Gm6927
  gRNA
gagccuaccacagucuuuau

SEQ ID NO: 89281 - RNA, 20 nt, Artificial Sequence
  MKO10089281_B_Gm6927
  gRNA
ccaaagcaaaaccuccgacu

SEQ ID NO: 89282 - RNA, 20 nt, Artificial Sequence
  MKO10089282_B_Gm6927
  gRNA
cgaugacagcuuuaucccuu

SEQ ID NO: 89283 - RNA, 20 nt, Artificial Sequence
  MKO10089283_B_Gm694
  gRNA
ggagcgcauggcuuucucaa

SEQ ID NO: 89284 - RNA, 20 nt, Artificial Sequence
  MKO10089284_B_Gm694
  gRNA
ugaugcgugggguggcgccg

SEQ ID NO: 89285 - RNA, 20 nt, Artificial Sequence
  MKO10089285_B_Gm694
  gRNA
aagaccuucguuauguuccg

SEQ ID NO: 89286 - RNA, 20 nt, Artificial Sequence
  MKO10089286_B_Gm7030
  gRNA
ggagccccgguucaccgccg

SEQ ID NO: 89287 - RNA, 20 nt, Artificial Sequence
  MKO10089287_B_Gm7030
  gRNA
cccucuacuucuccugcugc

SEQ ID NO: 89288 - RNA, 20 nt, Artificial Sequence
  MKO10089288_B_Gm7030
  gRNA
gcagcugucguggugccuuu

SEQ ID NO: 89289 - RNA, 20 nt, Artificial Sequence
  MKO10089289_B_Gm7073
  gRNA
aaacuuacccuccugguggc

SEQ ID NO: 89290 - RNA, 20 nt, Artificial Sequence
  MKO10089290_B_Gm7073
  gRNA
uucaccugacacagguauag

SEQ ID NO: 89291 - RNA, 20 nt, Artificial Sequence
  MKO10089291_B_Gm7073
  gRNA
aacucuaugauauauucuac

SEQ ID NO: 89292 - RNA, 20 nt, Artificial Sequence
  MKO10089292_B_Gm7092
  gRNA
cccccgccagaagggaaccc

SEQ ID NO: 89293 - RNA, 20 nt, Artificial Sequence
  MKO10089293_B_Gm7092
  gRNA
gccugaccgggguucccuuc

SEQ ID NO: 89294 - RNA, 20 nt, Artificial Sequence
  MKO10089294_B_Gm7092
  gRNA
gacuucgagaugaccaucug

SEQ ID NO: 89295 - RNA, 20 nt, Artificial Sequence
  MKO10089295_B_Gm7102
  gRNA
ccgcuucgcgucuccguccc

SEQ ID NO: 89296 - RNA, 20 nt, Artificial Sequence
  MKO10089296_B_Gm7102
  gRNA
cagcacagcagcaacuucuc

SEQ ID NO: 89297 - RNA, 20 nt, Artificial Sequence
  MKO10089297_B_Gm7102
  gRNA
uagauguccuuggagaaccc

SEQ ID NO: 89298 - RNA, 20 nt, Artificial Sequence
  MKO10089298_B_Gm711
  gRNA
uaccuccuccagggccuugu

SEQ ID NO: 89299 - RNA, 20 nt, Artificial Sequence
  MKO10089299_B_Gm711
  gRNA
accaugagauguucaucaug

SEQ ID NO: 89300 - RNA, 20 nt, Artificial Sequence
  MKO10089300_B_Gm711
  gRNA
uccacaugaugaacaucuca

SEQ ID NO: 89301 - RNA, 20 nt, Artificial Sequence
  MKO10089301_B_Gm7120
  gRNA
cuccacugugauacccaucg

SEQ ID NO: 89302 - RNA, 20 nt, Artificial Sequence
  MKO10089302_B_Gm7120
  gRNA
agcuagaucccuaucuuuac

SEQ ID NO: 89303 - RNA, 20 nt, Artificial Sequence
  MKO10089303_B_Gm7120
  gRNA
guguacuauguuaucugaga

SEQ ID NO: 89304 - RNA, 20 nt, Artificial Sequence
  MKO10089304_B_Gm7157
  gRNA
acugucaccuacaaugccuu

SEQ ID NO: 89305 - RNA, 20 nt, Artificial Sequence
  MKO10089305_B_Gm7157
  gRNA
gccauccuguucuuguguag

SEQ ID NO: 89306 - RNA, 20 nt, Artificial Sequence
  MKO10089306_B_Gm7157
  gRNA
aauccccuccuuguuuauga

SEQ ID NO: 89307 - RNA, 20 nt, Artificial Sequence
  MKO10089307_B_Gm715
  gRNA
gcaagcaucagcaugcgauc

SEQ ID NO: 89308 - RNA, 20 nt, Artificial Sequence
  MKO10089308_B_Gm715
  gRNA
ggcucaagaucgagcgccag

SEQ ID NO: 89309 - RNA, 20 nt, Artificial Sequence
  MKO10089309_B_Gm715
  gRNA
auugcacaagcguaaccgaa

SEQ ID NO: 89310 - RNA, 20 nt, Artificial Sequence
  MKO10089310_B_Gm7168
  gRNA
gaagaguagaccaugcccac

SEQ ID NO: 89311 - RNA, 20 nt, Artificial Sequence
  MKO10089311_B_Gm7168
  gRNA
cgaagcuucaccagcaucca

SEQ ID NO: 89312 - RNA, 20 nt, Artificial Sequence
  MKO10089312_B_Gm7168
  gRNA
agagccagccuauguccaga

SEQ ID NO: 89313 - RNA, 20 nt, Artificial Sequence
  MKO10089313_B_Gm7173
  gRNA
aaugugccaaaaucaacuac

SEQ ID NO: 89314 - RNA, 20 nt, Artificial Sequence
  MKO10089314_B_Gm7173
  gRNA
ugacaauagguaacugaccc

SEQ ID NO: 89315 - RNA, 20 nt, Artificial Sequence
  MKO10089315_B_Gm7173
  gRNA
aaauuggaauguauacgauu

SEQ ID NO: 89316 - RNA, 20 nt, Artificial Sequence
  MKO10089316_B_Gm7244
  gRNA
gaagauacucaccuuucuug

SEQ ID NO: 89317 - RNA, 20 nt, Artificial Sequence
  MKO10089317_B_Gm7244
  gRNA
gaaucaugaggaggacgaua

SEQ ID NO: 89318 - RNA, 20 nt, Artificial Sequence
  MKO10089318_B_Gm7244
  gRNA
gggcgguuccccuccguaag

SEQ ID NO: 89319 - RNA, 20 nt, Artificial Sequence
  MKO10089319_B_Gm7257
  gRNA
ugugcuaacauuugcuucac

SEQ ID NO: 89320 - RNA, 20 nt, Artificial Sequence
  MKO10089320_B_Gm7257
  gRNA
agcaaauguuagcacaucuu

SEQ ID NO: 89321 - RNA, 20 nt, Artificial Sequence
  MKO10089321_B_Gm7257
  gRNA
gcacaucuugcagcuccugc

SEQ ID NO: 89322 - RNA, 20 nt, Artificial Sequence
  MKO10089322_B_Gm7325
  gRNA
uuuacagugcagcuuucuuc

SEQ ID NO: 89323 - RNA, 20 nt, Artificial Sequence
  MKO10089323_B_Gm7325
  gRNA
accuccugcccuugcugcgc

SEQ ID NO: 89324 - RNA, 20 nt, Artificial Sequence
  MKO10089324_B_Gm7325
  gRNA
gcugcugccuguugcccgcc

SEQ ID NO: 89325 - RNA, 20 nt, Artificial Sequence
  MKO10089325_B_Gm732
  gRNA
uagaaaugguccugcacauc

SEQ ID NO: 89326 - RNA, 20 nt, Artificial Sequence
  MKO10089326_B_Gm732
  gRNA
aauaacguaucuaugaauaa

SEQ ID NO: 89327 - RNA, 20 nt, Artificial Sequence
  MKO10089327_B_Gm732
  gRNA
ucuaaacgaccaucugcuca

SEQ ID NO: 89328 - RNA, 20 nt, Artificial Sequence
  MKO10089328_B_Gm7361
  gRNA
caccaaaaguuggugaauga

SEQ ID NO: 89329 - RNA, 20 nt, Artificial Sequence
  MKO10089329_B_Gm7361
  gRNA
caauguauaccucuuguuca

SEQ ID NO: 89330 - RNA, 20 nt, Artificial Sequence
  MKO10089330_B_Gm7361
  gRNA
aagcaaaaagcaguuugaga

SEQ ID NO: 89331 - RNA, 20 nt, Artificial Sequence
  MKO10089331_B_Gm7534
  gRNA
ucaucggguccaggucguuc

SEQ ID NO: 89332 - RNA, 20 nt, Artificial Sequence
  MKO10089332_B_Gm7534
  gRNA
aagccccguugcucaagucc

SEQ ID NO: 89333 - RNA, 20 nt, Artificial Sequence
  MKO10089333_B_Gm7534
  gRNA
agauagcaacccugcgcugc

SEQ ID NO: 89334 - RNA, 20 nt, Artificial Sequence
  MKO10089334_B_Gm757
  gRNA
uagauaguaaugcgaaccca

SEQ ID NO: 89335 - RNA, 20 nt, Artificial Sequence
  MKO10089335_B_Gm757
  gRNA
uagccagagucagacuacuu

SEQ ID NO: 89336 - RNA, 20 nt, Artificial Sequence
  MKO10089336_B_Gm757
  gRNA
ucuaugccucuuguaaaccc

SEQ ID NO: 89337 - RNA, 20 nt, Artificial Sequence
  MKO10089337_B_Gm7609
  gRNA
agaagccugugcagacacca

SEQ ID NO: 89338 - RNA, 20 nt, Artificial Sequence
  MKO10089338_B_Gm7609
  gRNA
ucuacgaaugagauucaaau

SEQ ID NO: 89339 - RNA, 20 nt, Artificial Sequence
  MKO10089339_B_Gm7609
  gRNA
gcuagauuccuguagaucgc

SEQ ID NO: 89340 - RNA, 20 nt, Artificial Sequence
  MKO10089340_B_Gm7616
  gRNA
ucacagcuaggagacugagu

SEQ ID NO: 89341 - RNA, 20 nt, Artificial Sequence
  MKO10089341_B_Gm7616
  gRNA
ccccacucacaugucuaugc

SEQ ID NO: 89342 - RNA, 20 nt, Artificial Sequence
  MKO10089342_B_Gm7616
  gRNA
agcccugaagaaugcccuga

SEQ ID NO: 89343 - RNA, 20 nt, Artificial Sequence
  MKO10089343_B_Gm765
  gRNA
gaugaacugaaguauuaguu

SEQ ID NO: 89344 - RNA, 20 nt, Artificial Sequence
  MKO10089344_B_Gm765
  gRNA
ucagaugucagaaauugagu

SEQ ID NO: 89345 - RNA, 20 nt, Artificial Sequence
  MKO10089345_B_Gm765
  gRNA
aaccuuccuugguuaaaaga

SEQ ID NO: 89346 - RNA, 20 nt, Artificial Sequence
  MKO10089346_B_Gm766
  gRNA
ugggguugucccuguaguag

SEQ ID NO: 89347 - RNA, 20 nt, Artificial Sequence
  MKO10089347_B_Gm766
  gRNA
acucaaaacgugaucaaacc

SEQ ID NO: 89348 - RNA, 20 nt, Artificial Sequence
  MKO10089348_B_Gm766
  gRNA
cuacaucgucagaaauccga

SEQ ID NO: 89349 - RNA, 20 nt, Artificial Sequence
  MKO10089349_B_Gm7694
  gRNA
gccccaggcucuaucgcccc

SEQ ID NO: 89350 - RNA, 20 nt, Artificial Sequence
  MKO10089350_B_Gm7694
  gRNA
cuggaaguccgugccugcgg

SEQ ID NO: 89351 - RNA, 20 nt, Artificial Sequence
  MKO10089351_B_Gm7694
  gRNA
ccggagucuaccauugaaau

SEQ ID NO: 89352 - RNA, 20 nt, Artificial Sequence
  MKO10089352_B_Gm7714
  gRNA
gcuucuuauaggaugcuucc

SEQ ID NO: 89353 - RNA, 20 nt, Artificial Sequence
  MKO10089353_B_Gm7714
  gRNA
uagaccaaauuguccaugcu

SEQ ID NO: 89354 - RNA, 20 nt, Artificial Sequence
  MKO10089354_B_Gm7714
  gRNA
ugaugaguugaaggagcgag

SEQ ID NO: 89355 - RNA, 20 nt, Artificial Sequence
  MKO10089355_B_Gm773
  gRNA
acaagcauaucaaacaacau

SEQ ID NO: 89356 - RNA, 20 nt, Artificial Sequence
  MKO10089356_B_Gm773
  gRNA
acagaaaugaaguaaagaau

SEQ ID NO: 89357 - RNA, 20 nt, Artificial Sequence
  MKO10089357_B_Gm773
  gRNA
uuauaacucuguuucagcag

SEQ ID NO: 89358 - RNA, 20 nt, Artificial Sequence
  MKO10089358_B_Gm7849
  gRNA
cagccuuuaugauguguauu

SEQ ID NO: 89359 - RNA, 20 nt, Artificial Sequence
  MKO10089359_B_Gm7849
  gRNA
agaugaagagacuaaaacuc

SEQ ID NO: 89360 - RNA, 20 nt, Artificial Sequence
  MKO10089360_B_Gm7849
  gRNA
acagccugguccucuucccc

SEQ ID NO: 89361 - RNA, 20 nt, Artificial Sequence
  MKO10089361_B_Gm7861
  gRNA
cagccuuuaugauguguauu

SEQ ID NO: 89362 - RNA, 20 nt, Artificial Sequence
  MKO10089362_B_Gm7861
  gRNA
agaugaagagacuaaaacuc

SEQ ID NO: 89363 - RNA, 20 nt, Artificial Sequence
  MKO10089363_B_Gm7861
  gRNA
acagccugguccucuucccc

SEQ ID NO: 89364 - RNA, 20 nt, Artificial Sequence
  MKO10089364_B_Gm7903
  gRNA
ccuacaggagcccuaaacug

SEQ ID NO: 89365 - RNA, 20 nt, Artificial Sequence
  MKO10089365_B_Gm7903
  gRNA
aaugccaccucccauagcaa

SEQ ID NO: 89366 - RNA, 20 nt, Artificial Sequence
  MKO10089366_B_Gm7903
  gRNA
cagaguacuaucugcugauu

SEQ ID NO: 89367 - RNA, 20 nt, Artificial Sequence
  MKO10089367_B_Gm7978
  gRNA
accugaagaccugacucaug

SEQ ID NO: 89368 - RNA, 20 nt, Artificial Sequence
  MKO10089368_B_Gm7978
  gRNA
uaggugcuugaugacacccu

SEQ ID NO: 89369 - RNA, 20 nt, Artificial Sequence
  MKO10089369_B_Gm7978
  gRNA
ccgccagcaaaaacaaaguc

SEQ ID NO: 89370 - RNA, 20 nt, Artificial Sequence
  MKO10089370_B_Gm806
  gRNA
auguacucccgcacagcuuc

SEQ ID NO: 89371 - RNA, 20 nt, Artificial Sequence
  MKO10089371_B_Gm806
  gRNA
agucugguggacagucuuca

SEQ ID NO: 89372 - RNA, 20 nt, Artificial Sequence
  MKO10089372_B_Gm806
  gRNA
ugguugcaacaacuugguac

SEQ ID NO: 89373 - RNA, 20 nt, Artificial Sequence
  MKO10089373_B_Gm813
  gRNA
ugcgauagauauucuaaaca

SEQ ID NO: 89374 - RNA, 20 nt, Artificial Sequence
  MKO10089374_B_Gm813
  gRNA
ggucugcauuccggaaauuc

SEQ ID NO: 89375 - RNA, 20 nt, Artificial Sequence
  MKO10089375_B_Gm813
  gRNA
cagugaugcuuauauguucu

SEQ ID NO: 89376 - RNA, 20 nt, Artificial Sequence
  MKO10089376_B_Gm815
  gRNA
cucacuaggugccucaagag

SEQ ID NO: 89377 - RNA, 20 nt, Artificial Sequence
  MKO10089377_B_Gm815
  gRNA
agcaguucuaaacguagaga

SEQ ID NO: 89378 - RNA, 20 nt, Artificial Sequence
  MKO10089378_B_Gm815
  gRNA
uuucaugauggcccugucug

SEQ ID NO: 89379 - RNA, 20 nt, Artificial Sequence
  MKO10089379_B_Gm8267
  gRNA
agacuauuucacagggagaa

SEQ ID NO: 89380 - RNA, 20 nt, Artificial Sequence
  MKO10089380_B_Gm8267
  gRNA
ugaacacugauuugaacuac

SEQ ID NO: 89381 - RNA, 20 nt, Artificial Sequence
  MKO10089381_B_Gm8267
  gRNA
gcaagaaaaaaaaaaaguaa

SEQ ID NO: 89382 - RNA, 20 nt, Artificial Sequence
  MKO10089382_B_Gm826
  gRNA
accaccacgagcucccuguc

SEQ ID NO: 89383 - RNA, 20 nt, Artificial Sequence
  MKO10089383_B_Gm826
  gRNA
ggaaccagacagggagcucg

SEQ ID NO: 89384 - RNA, 20 nt, Artificial Sequence
  MKO10089384_B_Gm826
  gRNA
uucagcagccccgcucagcc

SEQ ID NO: 89385 - RNA, 20 nt, Artificial Sequence
  MKO10089385_B_Gm8298
  gRNA
caucgguuuacagaaucaua

SEQ ID NO: 89386 - RNA, 20 nt, Artificial Sequence
  MKO10089386_B_Gm8298
  gRNA
uccugaaauacagaugcgag

SEQ ID NO: 89387 - RNA, 20 nt, Artificial Sequence
  MKO10089387_B_Gm8298
  gRNA
aguucuugcaaaauauggag

SEQ ID NO: 89388 - RNA, 20 nt, Artificial Sequence
  MKO10089388_B_Gm829
  gRNA
gacgggagucuuguccuaac

SEQ ID NO: 89389 - RNA, 20 nt, Artificial Sequence
  MKO10089389_B_Gm829
  gRNA
cugugaacgcccuaggaguc

SEQ ID NO: 89390 - RNA, 20 nt, Artificial Sequence
  MKO10089390_B_Gm829
  gRNA
acaauaugaccugcccuguu

SEQ ID NO: 89391 - RNA, 20 nt, Artificial Sequence
  MKO10089391_B_Gm8300
  gRNA
acaugccaaaaucaaugaaa

SEQ ID NO: 89392 - RNA, 20 nt, Artificial Sequence
  MKO10089392_B_Gm8300
  gRNA
gaaaucguguuugaugauau

SEQ ID NO: 89393 - RNA, 20 nt, Artificial Sequence
  MKO10089393_B_Gm8300
  gRNA
uguguccauuucauugauuu

SEQ ID NO: 89394 - RNA, 20 nt, Artificial Sequence
  MKO10089394_B_Gm8369
  gRNA
caccucucuggaguuacagc

SEQ ID NO: 89395 - RNA, 20 nt, Artificial Sequence
  MKO10089395_B_Gm8369
  gRNA
agugaaaacuacaaaaagcc

SEQ ID NO: 89396 - RNA, 20 nt, Artificial Sequence
  MKO10089396_B_Gm8369
  gRNA
gcuguguccaucucugcauu

SEQ ID NO: 89397 - RNA, 20 nt, Artificial Sequence
  MKO10089397_B_Gm8439
  gRNA
cacacagccaagcuucuugu

SEQ ID NO: 89398 - RNA, 20 nt, Artificial Sequence
  MKO10089398_B_Gm8439
  gRNA
accucaggaggggagaacag

SEQ ID NO: 89399 - RNA, 20 nt, Artificial Sequence
  MKO10089399_B_Gm8439
  gRNA
accucuguucuccccuccug

SEQ ID NO: 89400 - RNA, 20 nt, Artificial Sequence
  MKO10089400_B_Gm8453
  gRNA
guguuauugucuguuaucug

SEQ ID NO: 89401 - RNA, 20 nt, Artificial Sequence
  MKO10089401_B_Gm8453
  gRNA
guaacauccacauuccaauu

SEQ ID NO: 89402 - RNA, 20 nt, Artificial Sequence
  MKO10089402_B_Gm8453
  gRNA
cagugacccuaauuggaaug

SEQ ID NO: 89403 - RNA, 20 nt, Artificial Sequence
  MKO10089403_B_Gm853
  gRNA
augugcuggucagccgccau

SEQ ID NO: 89404 - RNA, 20 nt, Artificial Sequence
  MKO10089404_B_Gm853
  gRNA
agcccaucucaaacacacga

SEQ ID NO: 89405 - RNA, 20 nt, Artificial Sequence
  MKO10089405_B_Gm853
  gRNA
gggccgccaagaugccuuca

SEQ ID NO: 89406 - RNA, 20 nt, Artificial Sequence
  MKO10089406_B_Gm8653
  gRNA
gcccacacugaauccagaag

SEQ ID NO: 89407 - RNA, 20 nt, Artificial Sequence
  MKO10089407_B_Gm8653
  gRNA
guuauucuucuuacaguugu

SEQ ID NO: 89408 - RNA, 20 nt, Artificial Sequence
  MKO10089408_B_Gm8653
  gRNA
guguuauugucuguuaucug

SEQ ID NO: 89409 - RNA, 20 nt, Artificial Sequence
  MKO10089409_B_Gm8660
  gRNA
guguuauugucuguuaucug

SEQ ID NO: 89410 - RNA, 20 nt, Artificial Sequence
  MKO10089410_B_Gm8660
  gRNA
ugccacauucaugagcauca

SEQ ID NO: 89411 - RNA, 20 nt, Artificial Sequence
  MKO10089411_B_Gm8660
  gRNA
cagugaccuuaauuggaaug

SEQ ID NO: 89412 - RNA, 20 nt, Artificial Sequence
  MKO10089412_B_Gm8677
  gRNA
gacaaugcccacacugaauc

SEQ ID NO: 89413 - RNA, 20 nt, Artificial Sequence
  MKO10089413_B_Gm8677
  gRNA
guuauucuucuuacaguuau

SEQ ID NO: 89414 - RNA, 20 nt, Artificial Sequence
  MKO10089414_B_Gm8677
  gRNA
guguuauugucugcuaucug

SEQ ID NO: 89415 - RNA, 20 nt, Artificial Sequence
  MKO10089415_B_Gm867
  gRNA
acuuacuaaugaccuguacc

SEQ ID NO: 89416 - RNA, 20 nt, Artificial Sequence
  MKO10089416_B_Gm867
  gRNA
gaugcaccgugaaguucagc

SEQ ID NO: 89417 - RNA, 20 nt, Artificial Sequence
  MKO10089417_B_Gm867
  gRNA
ggaacaagugaccuaugucc

SEQ ID NO: 89418 - RNA, 20 nt, Artificial Sequence
  MKO10089418_B_Gm8693
  gRNA
guuauucuuguuacaguugu

SEQ ID NO: 89419 - RNA, 20 nt, Artificial Sequence
  MKO10089419_B_Gm8693
  gRNA
guguuauugucuguuaucug

SEQ ID NO: 89420 - RNA, 20 nt, Artificial Sequence
  MKO10089420_B_Gm8693
  gRNA
uaacauccacauuccaauua

SEQ ID NO: 89421 - RNA, 20 nt, Artificial Sequence
  MKO10089421_B_Gm8720
  gRNA
gcccacacugaauccagaag

SEQ ID NO: 89422 - RNA, 20 nt, Artificial Sequence
  MKO10089422_B_Gm8720
  gRNA
guuauucuucuugcaguugu

SEQ ID NO: 89423 - RNA, 20 nt, Artificial Sequence
  MKO10089423_B_Gm8720
  gRNA
guguuauugucuguuaucug

SEQ ID NO: 89424 - RNA, 20 nt, Artificial Sequence
  MKO10089424_B_Gm8764
  gRNA
cugaguaacugcuagauccu

SEQ ID NO: 89425 - RNA, 20 nt, Artificial Sequence
  MKO10089425_B_Gm8764
  gRNA
gccuccaaguguccauuucu

SEQ ID NO: 89426 - RNA, 20 nt, Artificial Sequence
  MKO10089426_B_Gm8764
  gRNA
gcugugcacuaugaucgcug

SEQ ID NO: 89427 - RNA, 20 nt, Artificial Sequence
  MKO10089427_B_Gm8765
  gRNA
cugcauugcgauucagaaga

SEQ ID NO: 89428 - RNA, 20 nt, Artificial Sequence
  MKO10089428_B_Gm8765
  gRNA
auuacuggcaggaugugaag

SEQ ID NO: 89429 - RNA, 20 nt, Artificial Sequence
  MKO10089429_B_Gm8765
  gRNA
accaguaagaaaacagcuac

SEQ ID NO: 89430 - RNA, 20 nt, Artificial Sequence
  MKO10089430_B_Gm8787
  gRNA
uguauaauuaggcacuauua

SEQ ID NO: 89431 - RNA, 20 nt, Artificial Sequence
  MKO10089431_B_Gm8787
  gRNA
cuucagaucucucaauagug

SEQ ID NO: 89432 - RNA, 20 nt, Artificial Sequence
  MKO10089432_B_Gm8787
  gRNA
ggauacuggauaguuucacc

SEQ ID NO: 89433 - RNA, 20 nt, Artificial Sequence
  MKO10089433_B_Gm8817
  gRNA
gccucuuguuauaaaucacc

SEQ ID NO: 89434 - RNA, 20 nt, Artificial Sequence
  MKO10089434_B_Gm8817
  gRNA
agcucuugaacucauugaug

SEQ ID NO: 89435 - RNA, 20 nt, Artificial Sequence
  MKO10089435_B_Gm8817
  gRNA
gacugacuaaauagaagcug

SEQ ID NO: 89436 - RNA, 20 nt, Artificial Sequence
  MKO10089436_B_Gm884
  gRNA
cucacaauuucucaguccaa

SEQ ID NO: 89437 - RNA, 20 nt, Artificial Sequence
  MKO10089437_B_Gm884
  gRNA
ucaccugacugaauuacaua

SEQ ID NO: 89438 - RNA, 20 nt, Artificial Sequence
  MKO10089438_B_Gm884
  gRNA
ccgugaguaaauugcaccca

SEQ ID NO: 89439 - RNA, 20 nt, Artificial Sequence
  MKO10089439_B_Gm8882
  gRNA
ccagcaaagccgcugugagc

SEQ ID NO: 89440 - RNA, 20 nt, Artificial Sequence
  MKO10089440_B_Gm8882
  gRNA
gacucaaauucucagcuccu

SEQ ID NO: 89441 - RNA, 20 nt, Artificial Sequence
  MKO10089441_B_Gm8882
  gRNA
cugagaauuugagucuucgu

SEQ ID NO: 89442 - RNA, 20 nt, Artificial Sequence
  MKO10089442_B_Gm8898
  gRNA
uauagcugugagauuccuau

SEQ ID NO: 89443 - RNA, 20 nt, Artificial Sequence
  MKO10089443_B_Gm8898
  gRNA
acuguguuuagguuacaguu

SEQ ID NO: 89444 - RNA, 20 nt, Artificial Sequence
  MKO10089444_B_Gm8898
  gRNA
uuccaugacuucuagaaguu

SEQ ID NO: 89445 - RNA, 20 nt, Artificial Sequence
  MKO10089445_B_Gm8909
  gRNA
ucccagagccucguccaucc

SEQ ID NO: 89446 - RNA, 20 nt, Artificial Sequence
  MKO10089446_B_Gm8909
  gRNA
cuccugcucuucaacacaaa

SEQ ID NO: 89447 - RNA, 20 nt, Artificial Sequence
  MKO10089447_B_Gm8909
  gRNA
ucccuuggaaacccugcuca

SEQ ID NO: 89448 - RNA, 20 nt, Artificial Sequence
  MKO10089448_B_Gm8994
  gRNA
gacauuggugcccccaacgc

SEQ ID NO: 89449 - RNA, 20 nt, Artificial Sequence
  MKO10089449_B_Gm8994
  gRNA
gccucgagcccagacaucug

SEQ ID NO: 89450 - RNA, 20 nt, Artificial Sequence
  MKO10089450_B_Gm8994
  gRNA
gucaucgcacagucucaguc

SEQ ID NO: 89451 - RNA, 20 nt, Artificial Sequence
  MKO10089451_B_Gm9047
  gRNA
gcucagagggccagaucucg

SEQ ID NO: 89452 - RNA, 20 nt, Artificial Sequence
  MKO10089452_B_Gm9047
  gRNA
caugucgaggcagcucaaca

SEQ ID NO: 89453 - RNA, 20 nt, Artificial Sequence
  MKO10089453_B_Gm9047
  gRNA
gggaacagguaacgcgucuc

SEQ ID NO: 89454 - RNA, 20 nt, Artificial Sequence
  MKO10089454_B_Gm904
  gRNA
accaguaagaaaacugcuac

SEQ ID NO: 89455 - RNA, 20 nt, Artificial Sequence
  MKO10089455_B_Gm904
  gRNA
uacauuuccauagguuguga

SEQ ID NO: 89456 - RNA, 20 nt, Artificial Sequence
  MKO10089456_B_Gm904
  gRNA
ucuccagguuguacagauuc

SEQ ID NO: 89457 - RNA, 20 nt, Artificial Sequence
  MKO10089457_B_Gm906
  gRNA
cuaucucuagguuguacaga

SEQ ID NO: 89458 - RNA, 20 nt, Artificial Sequence
  MKO10089458_B_Gm906
  gRNA
cuccauucauucucagaugc

SEQ ID NO: 89459 - RNA, 20 nt, Artificial Sequence
  MKO10089459_B_Gm906
  gRNA
auuacuggcaggaugugaag

SEQ ID NO: 89460 - RNA, 20 nt, Artificial Sequence
  MKO10089460_B_Gm9112
  gRNA
gugccagagcucucugcaag

SEQ ID NO: 89461 - RNA, 20 nt, Artificial Sequence
  MKO10089461_B_Gm9112
  gRNA
gggccgcuugcagagagcuc

SEQ ID NO: 89462 - RNA, 20 nt, Artificial Sequence
  MKO10089462_B_Gm9112
  gRNA
ccccuccaggaccuuguggg

SEQ ID NO: 89463 - RNA, 20 nt, Artificial Sequence
  MKO10089463_B_Gm9125
  gRNA
gcacaucacaggccauggag

SEQ ID NO: 89464 - RNA, 20 nt, Artificial Sequence
  MKO10089464_B_Gm9125
  gRNA
aaacauaacaccugcaauca

SEQ ID NO: 89465 - RNA, 20 nt, Artificial Sequence
  MKO10089465_B_Gm9125
  gRNA
ucaucaucuccuugaagacu

SEQ ID NO: 89466 - RNA, 20 nt, Artificial Sequence
  MKO10089466_B_Gm9268
  gRNA
caacuaauuaauuauaacug

SEQ ID NO: 89467 - RNA, 20 nt, Artificial Sequence
  MKO10089467_B_Gm9268
  gRNA
gaaugccauuccgucuccau

SEQ ID NO: 89468 - RNA, 20 nt, Artificial Sequence
  MKO10089468_B_Gm9268
  gRNA
ucaguuuaaaacucucuauc

SEQ ID NO: 89469 - RNA, 20 nt, Artificial Sequence
  MKO10089469_B_Gm933
  gRNA
gaggauuauggcugcaagag

SEQ ID NO: 89470 - RNA, 20 nt, Artificial Sequence
  MKO10089470_B_Gm933
  gRNA
uaccaaaucuugauuguucc

SEQ ID NO: 89471 - RNA, 20 nt, Artificial Sequence
  MKO10089471_B_Gm933
  gRNA
agccaggaacaaucaagauu

SEQ ID NO: 89472 - RNA, 20 nt, Artificial Sequence
  MKO10089472_B_Gm9376
  gRNA
cucagcgucgaagaaugaug

SEQ ID NO: 89473 - RNA, 20 nt, Artificial Sequence
  MKO10089473_B_Gm9376
  gRNA
acacauagaagaucugacaa

SEQ ID NO: 89474 - RNA, 20 nt, Artificial Sequence
  MKO10089474_B_Gm9376
  gRNA
ucgacgcugagugaugaacc

SEQ ID NO: 89475 - RNA, 20 nt, Artificial Sequence
  MKO10089475_B_Gm94
  gRNA
ugcuuacgauccucuggaca

SEQ ID NO: 89476 - RNA, 20 nt, Artificial Sequence
  MKO10089476_B_Gm94
  gRNA
ccuucaaaagugaccuccua

SEQ ID NO: 89477 - RNA, 20 nt, Artificial Sequence
  MKO10089477_B_Gm94
  gRNA
ucuaguaaaaauccagagcc

SEQ ID NO: 89478 - RNA, 20 nt, Artificial Sequence
  MKO10089478_B_Gm9513
  gRNA
uugcuggugaugucccugca

SEQ ID NO: 89479 - RNA, 20 nt, Artificial Sequence
  MKO10089479_B_Gm9513
  gRNA
uaacagucccagugaagcaa

SEQ ID NO: 89480 - RNA, 20 nt, Artificial Sequence
  MKO10089480_B_Gm9513
  gRNA
gcacgucuugcagcuccugc

SEQ ID NO: 89481 - RNA, 20 nt, Artificial Sequence
  MKO10089481_B_Gm9573
  gRNA
ucaaugucguagagaugaca

SEQ ID NO: 89482 - RNA, 20 nt, Artificial Sequence
  MKO10089482_B_Gm9573
  gRNA
acucaccacuuccuaaaagc

SEQ ID NO: 89483 - RNA, 20 nt, Artificial Sequence
  MKO10089483_B_Gm9573
  gRNA
ugcagaggagaagcagccuc

SEQ ID NO: 89484 - RNA, 20 nt, Artificial Sequence
  MKO10089484_B_Gm960
  gRNA
aaucaucauaguucaucaca

SEQ ID NO: 89485 - RNA, 20 nt, Artificial Sequence
  MKO10089485_B_Gm960
  gRNA
caagccaccauaaacacuuc

SEQ ID NO: 89486 - RNA, 20 nt, Artificial Sequence
  MKO10089486_B_Gm960
  gRNA
gcuucuaccagaaguguuua

SEQ ID NO: 89487 - RNA, 20 nt, Artificial Sequence
  MKO10089487_B_Gm9733
  gRNA
caaguguaacauuacugaug

SEQ ID NO: 89488 - RNA, 20 nt, Artificial Sequence
  MKO10089488_B_Gm9733
  gRNA
uuauugucucugucauguac

SEQ ID NO: 89489 - RNA, 20 nt, Artificial Sequence
  MKO10089489_B_Gm9733
  gRNA
gacaauaaccagaagaaguu

SEQ ID NO: 89490 - RNA, 20 nt, Artificial Sequence
  MKO10089490_B_Gm973
  gRNA
aauugauacauacauggacc

SEQ ID NO: 89491 - RNA, 20 nt, Artificial Sequence
  MKO10089491_B_Gm973
  gRNA
cccgaagugugugcagucca

SEQ ID NO: 89492 - RNA, 20 nt, Artificial Sequence
  MKO10089492_B_Gm973
  gRNA
ggcccccugacaucaugcac

SEQ ID NO: 89493 - RNA, 20 nt, Artificial Sequence
  MKO10089493_B_Gm9758
  gRNA
cuggggcaaggcccuaccac

SEQ ID NO: 89494 - RNA, 20 nt, Artificial Sequence
  MKO10089494_B_Gm9758
  gRNA
ugagcuccugcuuguucucu

SEQ ID NO: 89495 - RNA, 20 nt, Artificial Sequence
  MKO10089495_B_Gm9758
  gRNA
cuuacaguaaccugcacagc

SEQ ID NO: 89496 - RNA, 20 nt, Artificial Sequence
  MKO10089496_B_Gm9839
  gRNA
uauugcauacuucgauucca

SEQ ID NO: 89497 - RNA, 20 nt, Artificial Sequence
  MKO10089497_B_Gm9839
  gRNA
agacccugaagaacagucag

SEQ ID NO: 89498 - RNA, 20 nt, Artificial Sequence
  MKO10089498_B_Gm9839
  gRNA
uggaacaaagaugguauuua

SEQ ID NO: 89499 - RNA, 20 nt, Artificial Sequence
  MKO10089499_B_Gm996
  gRNA
ccgccaacuacgccgccugc

SEQ ID NO: 89500 - RNA, 20 nt, Artificial Sequence
  MKO10089500_B_Gm996
  gRNA
cucgcgucugugccgccgag

SEQ ID NO: 89501 - RNA, 20 nt, Artificial Sequence
  MKO10089501_B_Gm996
  gRNA
uucucucgcauagcgcgcgu

SEQ ID NO: 89502 - RNA, 20 nt, Artificial Sequence
  MKO10089502_B_Gm9992
  gRNA
aggggcuguaccaguuggca

SEQ ID NO: 89503 - RNA, 20 nt, Artificial Sequence
  MKO10089503_B_Gm9992
  gRNA
cuuuguagaggccaucccag

SEQ ID NO: 89504 - RNA, 20 nt, Artificial Sequence
  MKO10089504_B_Gm9992
  gRNA
uguguagaucagcugcugug

SEQ ID NO: 89505 - RNA, 20 nt, Artificial Sequence
  MKO10089505_B_Gm9994
  gRNA
ccucaggauaguugaaccga

SEQ ID NO: 89506 - RNA, 20 nt, Artificial Sequence
  MKO10089506_B_Gm9994
  gRNA
uccauucagggacaaggucc

SEQ ID NO: 89507 - RNA, 20 nt, Artificial Sequence
  MKO10089507_B_Gm9994
  gRNA
aggugcagaaagucaugccc

SEQ ID NO: 89508 - RNA, 20 nt, Artificial Sequence
  MKO10089508_B_Gm9
  gRNA
ccucccucaacauugaucau

SEQ ID NO: 89509 - RNA, 20 nt, Artificial Sequence
  MKO10089509_B_Gm9
  gRNA
gugcccaacggauucagcuu

SEQ ID NO: 89510 - RNA, 20 nt, Artificial Sequence
  MKO10089510_B_Gm9
  gRNA
ccgaagacacaucaauuccg

SEQ ID NO: 89511 - RNA, 20 nt, Artificial Sequence
  MKO10089511_B_Gmcl1l
  gRNA
aucuuguucaagaauaguug

SEQ ID NO: 89512 - RNA, 20 nt, Artificial Sequence
  MKO10089512_B_Gmcl1l
  gRNA
aaaucugaucauuaagaaug

SEQ ID NO: 89513 - RNA, 20 nt, Artificial Sequence
  MKO10089513_B_Gmcl1l
  gRNA
uguuaucaacauaugccaug

SEQ ID NO: 89514 - RNA, 20 nt, Artificial Sequence
  MKO10089514_B_Gmcl1
  gRNA
caccauucaaaaacagcguu

SEQ ID NO: 89515 - RNA, 20 nt, Artificial Sequence
  MKO10089515_B_Gmcl1
  gRNA
cagcaugaauauuauugaac

SEQ ID NO: 89516 - RNA, 20 nt, Artificial Sequence
  MKO10089516_B_Gmcl1
  gRNA
cuuuacagagucuaguccau

SEQ ID NO: 89517 - RNA, 20 nt, Artificial Sequence
  MKO10089517_B_Gmds
  gRNA
uccuuaccauagggugaccu

SEQ ID NO: 89518 - RNA, 20 nt, Artificial Sequence
  MKO10089518_B_Gmds
  gRNA
aaagacaugaaguugcacua

SEQ ID NO: 89519 - RNA, 20 nt, Artificial Sequence
  MKO10089519_B_Gmds
  gRNA
gccucaccuugacauggcuc

SEQ ID NO: 89520 - RNA, 20 nt, Artificial Sequence
  MKO10089520_B_Gmeb1
  gRNA
ugagcaugaugccgccuaga

SEQ ID NO: 89521 - RNA, 20 nt, Artificial Sequence
  MKO10089521_B_Gmeb1
  gRNA
accuccugaucagcagugcg

SEQ ID NO: 89522 - RNA, 20 nt, Artificial Sequence
  MKO10089522_B_Gmeb1
  gRNA
acacacuucacguuuauucc

SEQ ID NO: 89523 - RNA, 20 nt, Artificial Sequence
  MKO10089523_B_Gmeb2
  gRNA
aagagagccauccggaugaa

SEQ ID NO: 89524 - RNA, 20 nt, Artificial Sequence
  MKO10089524_B_Gmeb2
  gRNA
gggauacacgugccccugaa

SEQ ID NO: 89525 - RNA, 20 nt, Artificial Sequence
  MKO10089525_B_Gmeb2
  gRNA
ugagcaugaugccauucauc

SEQ ID NO: 89526 - RNA, 20 nt, Artificial Sequence
  MKO10089526_B_Gmfb
  gRNA
cauuguagugaagauugaca

SEQ ID NO: 89527 - RNA, 20 nt, Artificial Sequence
  MKO10089527_B_Gmfb
  gRNA
gcuccucauccagcaccacc

SEQ ID NO: 89528 - RNA, 20 nt, Artificial Sequence
  MKO10089528_B_Gmfb
  gRNA
uauaaauaccaacaugauga

SEQ ID NO: 89529 - RNA, 20 nt, Artificial Sequence
  MKO10089529_B_Gmfg
  gRNA
auauaccugggcugucucuc

SEQ ID NO: 89530 - RNA, 20 nt, Artificial Sequence
  MKO10089530_B_Gmfg
  gRNA
ggugcuggaggaugaacucc

SEQ ID NO: 89531 - RNA, 20 nt, Artificial Sequence
  MKO10089531_B_Gmfg
  gRNA
ccauuggcagucggacuccc

SEQ ID NO: 89532 - RNA, 20 nt, Artificial Sequence
  MKO10089532_B_Gmip
  gRNA
acaaccucgagauaucauug

SEQ ID NO: 89533 - RNA, 20 nt, Artificial Sequence
  MKO10089533_B_Gmip
  gRNA
ugcguacagggucuccagcc

SEQ ID NO: 89534 - RNA, 20 nt, Artificial Sequence
  MKO10089534_B_Gmip
  gRNA
cccuggaguaugcuaaagca

SEQ ID NO: 89535 - RNA, 20 nt, Artificial Sequence
  MKO10089535_B_Gml
  gRNA
caugaauggcaucucaucug

SEQ ID NO: 89536 - RNA, 20 nt, Artificial Sequence
  MKO10089536_B_Gml
  gRNA
cuucuucuugucaauucuca

SEQ ID NO: 89537 - RNA, 20 nt, Artificial Sequence
  MKO10089537_B_Gml
  gRNA
auacuuacaucuaggcucaa

SEQ ID NO: 89538 - RNA, 20 nt, Artificial Sequence
  MKO10089538_B_Gmnc
  gRNA
uccacuacaacgucagaauc

SEQ ID NO: 89539 - RNA, 20 nt, Artificial Sequence
  MKO10089539_B_Gmnc
  gRNA
ccaggauacucuacugcaga

SEQ ID NO: 89540 - RNA, 20 nt, Artificial Sequence
  MKO10089540_B_Gmnc
  gRNA
ccuucugcaguagaguaucc

SEQ ID NO: 89541 - RNA, 20 nt, Artificial Sequence
  MKO10089541_B_Gmnn
  gRNA
agaacccaucuucucaguau

SEQ ID NO: 89542 - RNA, 20 nt, Artificial Sequence
  MKO10089542_B_Gmnn
  gRNA
uuuagaauaguccuguccca

SEQ ID NO: 89543 - RNA, 20 nt, Artificial Sequence
  MKO10089543_B_Gmnn
  gRNA
aagaaguggcagagcagcgg

SEQ ID NO: 89544 - RNA, 20 nt, Artificial Sequence
  MKO10089544_B_Gmppa
  gRNA
uccucucagggacucgcuuc

SEQ ID NO: 89545 - RNA, 20 nt, Artificial Sequence
  MKO10089545_B_Gmppa
  gRNA
aucaugggaacgccugccac

SEQ ID NO: 89546 - RNA, 20 nt, Artificial Sequence
  MKO10089546_B_Gmppa
  gRNA
cugcaggaguuugccccccu

SEQ ID NO: 89547 - RNA, 20 nt, Artificial Sequence
  MKO10089547_B_Gmppb
  gRNA
cagucucagauaguaggucu

SEQ ID NO: 89548 - RNA, 20 nt, Artificial Sequence
  MKO10089548_B_Gmppb
  gRNA
ucacuguugagaacgaagaa

SEQ ID NO: 89549 - RNA, 20 nt, Artificial Sequence
  MKO10089549_B_Gmppb
  gRNA
agguguggaccacgugaucc

SEQ ID NO: 89550 - RNA, 20 nt, Artificial Sequence
  MKO10089550_B_Gmpr2
  gRNA
agcacuacagcauccaucag

SEQ ID NO: 89551 - RNA, 20 nt, Artificial Sequence
  MKO10089551_B_Gmpr2
  gRNA
agccauuucaaaagugccca

SEQ ID NO: 89552 - RNA, 20 nt, Artificial Sequence
  MKO10089552_B_Gmpr2
  gRNA
guagaagaguuaauccuuuc

SEQ ID NO: 89553 - RNA, 20 nt, Artificial Sequence
  MKO10089553_B_Gmpr
  gRNA
ccugucgcaggcagggaacg

SEQ ID NO: 89554 - RNA, 20 nt, Artificial Sequence
  MKO10089554_B_Gmpr
  gRNA
gcgggcagaaugaucuugag

SEQ ID NO: 89555 - RNA, 20 nt, Artificial Sequence
  MKO10089555_B_Gmpr
  gRNA
ucccaucauuguggccaaca

SEQ ID NO: 89556 - RNA, 20 nt, Artificial Sequence
  MKO10089556_B_Gmps
  gRNA
cacagggcuauuaucauauc

SEQ ID NO: 89557 - RNA, 20 nt, Artificial Sequence
  MKO10089557_B_Gmps
  gRNA
auaauacguguucauuauuc

SEQ ID NO: 89558 - RNA, 20 nt, Artificial Sequence
  MKO10089558_B_Gmps
  gRNA
uugccaaugguaaauauugc

SEQ ID NO: 89559 - RNA, 20 nt, Artificial Sequence
  MKO10089559_B_Gna11
  gRNA
gccugcgaucguaacacucc

SEQ ID NO: 89560 - RNA, 20 nt, Artificial Sequence
  MKO10089560_B_Gna11
  gRNA
cggguacucgaugaugccag

SEQ ID NO: 89561 - RNA, 20 nt, Artificial Sequence
  MKO10089561_B_Gna11
  gRNA
gcauggcgguaaagauguuc

SEQ ID NO: 89562 - RNA, 20 nt, Artificial Sequence
  MKO10089562_B_Gna12
  gRNA
guccucgagcgaguaugacc

SEQ ID NO: 89563 - RNA, 20 nt, Artificial Sequence
  MKO10089563_B_Gna12
  gRNA
gagacaagcucggcauuccc

SEQ ID NO: 89564 - RNA, 20 nt, Artificial Sequence
  MKO10089564_B_Gna12
  gRNA
ccagcuggaacucgcuucug

SEQ ID NO: 89565 - RNA, 20 nt, Artificial Sequence
  MKO10089565_B_Gna13
  gRNA
aaugcuuccgggggaaacgc

SEQ ID NO: 89566 - RNA, 20 nt, Artificial Sequence
  MKO10089566_B_Gna13
  gRNA
auuugauacccgcgccccca

SEQ ID NO: 89567 - RNA, 20 nt, Artificial Sequence
  MKO10089567_B_Gna13
  gRNA
cuuggauaaacuuggaguac

SEQ ID NO: 89568 - RNA, 20 nt, Artificial Sequence
  MKO10089568_B_Gna14
  gRNA
cauagaauauccauucgacc

SEQ ID NO: 89569 - RNA, 20 nt, Artificial Sequence
  MKO10089569_B_Gna14
  gRNA
uccuccugucguaacacucc

SEQ ID NO: 89570 - RNA, 20 nt, Artificial Sequence
  MKO10089570_B_Gna14
  gRNA
gaauccaggaguguuacgac

SEQ ID NO: 89571 - RNA, 20 nt, Artificial Sequence
  MKO10089571_B_Gna15
  gRNA
cgcagucgcaugcccaccac

SEQ ID NO: 89572 - RNA, 20 nt, Artificial Sequence
  MKO10089572_B_Gna15
  gRNA
cgaguaugaccagugccuag

SEQ ID NO: 89573 - RNA, 20 nt, Artificial Sequence
  MKO10089573_B_Gna15
  gRNA
cgugauugcccucaucuacc

SEQ ID NO: 89574 - RNA, 20 nt, Artificial Sequence
  MKO10089574_B_Gnai1
  gRNA
acacuccucuuccgaguagc

SEQ ID NO: 89575 - RNA, 20 nt, Artificial Sequence
  MKO10089575_B_Gnai1
  gRNA
guggguuuccacaaucccug

SEQ ID NO: 89576 - RNA, 20 nt, Artificial Sequence
  MKO10089576_B_Gnai1
  gRNA
augcagcuaucugaaugacu

SEQ ID NO: 89577 - RNA, 20 nt, Artificial Sequence
  MKO10089577_B_Gnai2
  gRNA
guguguuuccacgaugcccg

SEQ ID NO: 89578 - RNA, 20 nt, Artificial Sequence
  MKO10089578_B_Gnai2
  gRNA
caaugcgcuccagaucauuc

SEQ ID NO: 89579 - RNA, 20 nt, Artificial Sequence
  MKO10089579_B_Gnai2
  gRNA
augacaccggacaggucuuc

SEQ ID NO: 89580 - RNA, 20 nt, Artificial Sequence
  MKO10089580_B_Gnai3
  gRNA
aucauugagcugauauuccc

SEQ ID NO: 89581 - RNA, 20 nt, Artificial Sequence
  MKO10089581_B_Gnai3
  gRNA
cuugaaguagaguuccuuga

SEQ ID NO: 89582 - RNA, 20 nt, Artificial Sequence
  MKO10089582_B_Gnai3
  gRNA
auuuagcuaccuaaaugauu

SEQ ID NO: 89583 - RNA, 20 nt, Artificial Sequence
  MKO10089583_B_Gnal
  gRNA
cucguuggaucucucaaagc

SEQ ID NO: 89584 - RNA, 20 nt, Artificial Sequence
  MKO10089584_B_Gnal
  gRNA
ccaacccugagaaccaguuc

SEQ ID NO: 89585 - RNA, 20 nt, Artificial Sequence
  MKO10089585_B_Gnal
  gRNA
cacugacuuugaauauuccc

SEQ ID NO: 89586 - RNA, 20 nt, Artificial Sequence
  MKO10089586_B_Gnao1
  gRNA
cuccacgcccaaagugucca

SEQ ID NO: 89587 - RNA, 20 nt, Artificial Sequence
  MKO10089587_B_Gnao1
  gRNA
cgaaccagagucaaaacaac

SEQ ID NO: 89588 - RNA, 20 nt, Artificial Sequence
  MKO10089588_B_Gnao1
  gRNA
cgugaagcaguacaagccug

SEQ ID NO: 89589 - RNA, 20 nt, Artificial Sequence
  MKO10089589_B_Gnaq
  gRNA
ccuugcagaauggucgaugu

SEQ ID NO: 89590 - RNA, 20 nt, Artificial Sequence
  MKO10089590_B_Gnaq
  gRNA
uacucugacgaagacaagcg

SEQ ID NO: 89591 - RNA, 20 nt, Artificial Sequence
  MKO10089591_B_Gnaq
  gRNA
cgaauaugaucaaguucuug

SEQ ID NO: 89592 - RNA, 20 nt, Artificial Sequence
  MKO10089592_B_Gnas
  gRNA
gaccgaggaccagcgcaacg

SEQ ID NO: 89593 - RNA, 20 nt, Artificial Sequence
  MKO10089593_B_Gnas
  gRNA
gcgccuucuccucguugcgc

SEQ ID NO: 89594 - RNA, 20 nt, Artificial Sequence
  MKO10089594_B_Gnas
  gRNA
gcggucacgaacaaucgagc

SEQ ID NO: 89595 - RNA, 20 nt, Artificial Sequence
  MKO10089595_B_Gnau1
  gRNA
acgcaacacguccugcucag

SEQ ID NO: 89596 - RNA, 20 nt, Artificial Sequence
  MKO10089596_B_Gnau1
  gRNA
agccggcggagucauugagc

SEQ ID NO: 89597 - RNA, 20 nt, Artificial Sequence
  MKO10089597_B_Gnau1
  gRNA
uugagucucgauaauaccag

SEQ ID NO: 89598 - RNA, 20 nt, Artificial Sequence
  MKO10089598_B_Gnau2
  gRNA
gaaucacguaccgcacagcu

SEQ ID NO: 89599 - RNA, 20 nt, Artificial Sequence
  MKO10089599_B_Gnau2
  gRNA
cugaugacguccaccaacuc

SEQ ID NO: 89600 - RNA, 20 nt, Artificial Sequence
  MKO10089600_B_Gnau2
  gRNA
aggcaugguccccuccucgg

SEQ ID NO: 89601 - RNA, 20 nt, Artificial Sequence
  MKO10089601_B_Gnau3
  gRNA
ugagucugucuaagucauua

SEQ ID NO: 89602 - RNA, 20 nt, Artificial Sequence
  MKO10089602_B_Gnau3
  gRNA
cugaaaucauuaaacgacug

SEQ ID NO: 89603 - RNA, 20 nt, Artificial Sequence
  MKO10089603_B_Gnau3
  gRNA
uugaguuucaaugauaccag

SEQ ID NO: 89604 - RNA, 20 nt, Artificial Sequence
  MKO10089604_B_Gnaz
  gRNA
ugagguccucgaacugacgu

SEQ ID NO: 89605 - RNA, 20 nt, Artificial Sequence
  MKO10089605_B_Gnaz
  gRNA
acgccaucgacucgcugacc

SEQ ID NO: 89606 - RNA, 20 nt, Artificial Sequence
  MKO10089606_B_Gnaz
  gRNA
ugauuucacggcgcugccgc

SEQ ID NO: 89607 - RNA, 20 nt, Artificial Sequence
  MKO10089607_B_Gnb1l
  gRNA
agaauaguuaccacucuaaa

SEQ ID NO: 89608 - RNA, 20 nt, Artificial Sequence
  MKO10089608_B_Gnb1l
  gRNA
ucagccagggucgagaccug

SEQ ID NO: 89609 - RNA, 20 nt, Artificial Sequence
  MKO10089609_B_Gnb1l
  gRNA
cagggugcacacugacgucu

SEQ ID NO: 89610 - RNA, 20 nt, Artificial Sequence
  MKO10089610_B_Gnb1
  gRNA
uaccugagaaagagucgcau

SEQ ID NO: 89611 - RNA, 20 nt, Artificial Sequence
  MKO10089611_B_Gnb1
  gRNA
ugugcgugugagucgugagc

SEQ ID NO: 89612 - RNA, 20 nt, Artificial Sequence
  MKO10089612_B_Gnb1
  gRNA
gcuccuugucagcgccucuc

SEQ ID NO: 89613 - RNA, 20 nt, Artificial Sequence
  MKO10089613_B_Gnb2l1
  gRNA
uaacaacaucacuaacgaag

SEQ ID NO: 89614 - RNA, 20 nt, Artificial Sequence
  MKO10089614_B_Gnb2l1
  gRNA
gaccagcuugucccauccgc

SEQ ID NO: 89615 - RNA, 20 nt, Artificial Sequence
  MKO10089615_B_Gnb2l1
  gRNA
aacccuaucaucgucuccug

SEQ ID NO: 89616 - RNA, 20 nt, Artificial Sequence
  MKO10089616_B_Gnb2
  gRNA
cuauagucucaagacccgag

SEQ ID NO: 89617 - RNA, 20 nt, Artificial Sequence
  MKO10089617_B_Gnb2
  gRNA
ggacagcuacaccacuaaca

SEQ ID NO: 89618 - RNA, 20 nt, Artificial Sequence
  MKO10089618_B_Gnb2
  gRNA
ggcgaauucagaugagaaca

SEQ ID NO: 89619 - RNA, 20 nt, Artificial Sequence
  MKO10089619_B_Gnb3
  gRNA
auguccuccguguccgcauc

SEQ ID NO: 89620 - RNA, 20 nt, Artificial Sequence
  MKO10089620_B_Gnb3
  gRNA
agccagagugauguccgcac

SEQ ID NO: 89621 - RNA, 20 nt, Artificial Sequence
  MKO10089621_B_Gnb3
  gRNA
ugaccuugacauugcccucg

SEQ ID NO: 89622 - RNA, 20 nt, Artificial Sequence
  MKO10089622_B_Gnb4
  gRNA
gccgaauacaaaugcgaaca

SEQ ID NO: 89623 - RNA, 20 nt, Artificial Sequence
  MKO10089623_B_Gnb4
  gRNA
ggauagcuauacgacaaaua

SEQ ID NO: 89624 - RNA, 20 nt, Artificial Sequence
  MKO10089624_B_Gnb4
  gRNA
cuagucagugcuucgcaaga

SEQ ID NO: 89625 - RNA, 20 nt, Artificial Sequence
  MKO10089625_B_Gnb5
  gRNA
ccucaccuuguucguaguga

SEQ ID NO: 89626 - RNA, 20 nt, Artificial Sequence
  MKO10089626_B_Gnb5
  gRNA
ccuccacccgcucggccacc

SEQ ID NO: 89627 - RNA, 20 nt, Artificial Sequence
  MKO10089627_B_Gnb5
  gRNA
gagaaucgugagcuccucac

SEQ ID NO: 89628 - RNA, 20 nt, Artificial Sequence
  MKO10089628_B_Gne
  gRNA
cucacccauagucgucaauc

SEQ ID NO: 89629 - RNA, 20 nt, Artificial Sequence
  MKO10089629_B_Gne
  gRNA
gugcuugacugcacggaaau

SEQ ID NO: 89630 - RNA, 20 nt, Artificial Sequence
  MKO10089630_B_Gne
  gRNA
cggaacacccgugaucaacc

SEQ ID NO: 89631 - RNA, 20 nt, Artificial Sequence
  MKO10089631_B_Gng10
  gRNA
gcaaccccuuccgggagccc

SEQ ID NO: 89632 - RNA, 20 nt, Artificial Sequence
  MKO10089632_B_Gng10
  gRNA
ccuuagccgccaugucuucc

SEQ ID NO: 89633 - RNA, 20 nt, Artificial Sequence
  MKO10089633_B_Gng10
  gRNA
cggaagggguugcuuccagc

SEQ ID NO: 89634 - RNA, 20 nt, Artificial Sequence
  MKO10089634_B_Gng11
  gRNA
auagguaucuaaauguucug

SEQ ID NO: 89635 - RNA, 20 nt, Artificial Sequence
  MKO10089635_B_Gng11
  gRNA
ucugggauucccuuuaccag

SEQ ID NO: 89636 - RNA, 20 nt, Artificial Sequence
  MKO10089636_B_Gng11
  gRNA
caagaaucccuucaaagaaa

SEQ ID NO: 89637 - RNA, 20 nt, Artificial Sequence
  MKO10089637_B_Gng12
  gRNA
acuugccuuuauucuuucga

SEQ ID NO: 89638 - RNA, 20 nt, Artificial Sequence
  MKO10089638_B_Gng12
  gRNA
ucgguaugcccaucagcagg

SEQ ID NO: 89639 - RNA, 20 nt, Artificial Sequence
  MKO10089639_B_Gng12
  gRNA
ccggagcgacccccugcuga

SEQ ID NO: 89640 - RNA, 20 nt, Artificial Sequence
  MKO10089640_B_Gng13
  gRNA
agagagccucaaguaccaac

SEQ ID NO: 89641 - RNA, 20 nt, Artificial Sequence
  MKO10089641_B_Gng13
  gRNA
cacucacucggggauggucu

SEQ ID NO: 89642 - RNA, 20 nt, Artificial Sequence
  MKO10089642_B_Gng13
  gRNA
cccaaggguuguucuucauc

SEQ ID NO: 89643 - RNA, 20 nt, Artificial Sequence
  MKO10089643_B_Gng2
  gRNA
cagcuguucuaccagcuucc

SEQ ID NO: 89644 - RNA, 20 nt, Artificial Sequence
  MKO10089644_B_Gng2
  gRNA
cagccucagaaaaccccuuu

SEQ ID NO: 89645 - RNA, 20 nt, Artificial Sequence
  MKO10089645_B_Gng2
  gRNA
cuacugugaggcacaugcca

SEQ ID NO: 89646 - RNA, 20 nt, Artificial Sequence
  MKO10089646_B_Gng3
  gRNA
guuaacagcacuaugaguau

SEQ ID NO: 89647 - RNA, 20 nt, Artificial Sequence
  MKO10089647_B_Gng3
  gRNA
gguggaacagcuuaagauug

SEQ ID NO: 89648 - RNA, 20 nt, Artificial Sequence
  MKO10089648_B_Gng3
  gRNA
ggguucucggaagugggcac

SEQ ID NO: 89649 - RNA, 20 nt, Artificial Sequence
  MKO10089649_B_Gng4
  gRNA
cugccucagaaaaccccuuc

SEQ ID NO: 89650 - RNA, 20 nt, Artificial Sequence
  MKO10089650_B_Gng4
  gRNA
ccuacugugaagcccacgug

SEQ ID NO: 89651 - RNA, 20 nt, Artificial Sequence
  MKO10089651_B_Gng4
  gRNA
acaguaggccaggaggucug

SEQ ID NO: 89652 - RNA, 20 nt, Artificial Sequence
  MKO10089652_B_Gng5
  gRNA
caacaugacccucugcugac

SEQ ID NO: 89653 - RNA, 20 nt, Artificial Sequence
  MKO10089653_B_Gng5
  gRNA
cugcuggaccaccuucuuca

SEQ ID NO: 89654 - RNA, 20 nt, Artificial Sequence
  MKO10089654_B_Gng5
  gRNA
gguccagcagcuccggcugg

SEQ ID NO: 89655 - RNA, 20 nt, Artificial Sequence
  MKO10089655_B_Gng7
  gRNA
gagcagcugcgcauugaagc

SEQ ID NO: 89656 - RNA, 20 nt, Artificial Sequence
  MKO10089656_B_Gng7
  gRNA
caaggccucgucagaccuga

SEQ ID NO: 89657 - RNA, 20 nt, Artificial Sequence
  MKO10089657_B_Gng7
  gRNA
guugcucacaguagcccauc

SEQ ID NO: 89658 - RNA, 20 nt, Artificial Sequence
  MKO10089658_B_Gng8
  gRNA
ugcugaggcccgcaagaccg

SEQ ID NO: 89659 - RNA, 20 nt, Artificial Sequence
  MKO10089659_B_Gng8
  gRNA
ggauucucggcggcagggac

SEQ ID NO: 89660 - RNA, 20 nt, Artificial Sequence
  MKO10089660_B_Gng8
  gRNA
cuugcgggccucagcaaucu

SEQ ID NO: 89661 - RNA, 20 nt, Artificial Sequence
  MKO10089661_B_Gngu1
  gRNA
aggaggcugugugauuucau

SEQ ID NO: 89662 - RNA, 20 nt, Artificial Sequence
  MKO10089662_B_Gngu1
  gRNA
caucgaagaccugacagaaa

SEQ ID NO: 89663 - RNA, 20 nt, Artificial Sequence
  MKO10089663_B_Gngu1
  gRNA
ucucacuucuucacaacauu

SEQ ID NO: 89664 - RNA, 20 nt, Artificial Sequence
  MKO10089664_B_Gngu2
  gRNA
ggaaaucaaggauuauguag

SEQ ID NO: 89665 - RNA, 20 nt, Artificial Sequence
  MKO10089665_B_Gngu2
  gRNA
acaagugccuuucuccuuga

SEQ ID NO: 89666 - RNA, 20 nt, Artificial Sequence
  MKO10089666_B_Gngu2
  gRNA
ucaacagcuccuucucacug

SEQ ID NO: 89667 - RNA, 20 nt, Artificial Sequence
  MKO10089667_B_Gnl1
  gRNA
cauuacugacauccgacauc

SEQ ID NO: 89668 - RNA, 20 nt, Artificial Sequence
  MKO10089668_B_Gnl1
  gRNA
augccccguguaucuuccca

SEQ ID NO: 89669 - RNA, 20 nt, Artificial Sequence
  MKO10089669_B_Gnl1
  gRNA
gucggaugucaguaaugagc

SEQ ID NO: 89670 - RNA, 20 nt, Artificial Sequence
  MKO10089670_B_Gnl2
  gRNA
ccucaacuuaggaacagucg

SEQ ID NO: 89671 - RNA, 20 nt, Artificial Sequence
  MKO10089671_B_Gnl2
  gRNA
gucuacugagagcuaugacc

SEQ ID NO: 89672 - RNA, 20 nt, Artificial Sequence
  MKO10089672_B_Gnl2
  gRNA
aaauacucgugugaucaagc

SEQ ID NO: 89673 - RNA, 20 nt, Artificial Sequence
  MKO10089673_B_Gnl3l
  gRNA
ucugcuccccagauuguuca

SEQ ID NO: 89674 - RNA, 20 nt, Artificial Sequence
  MKO10089674_B_Gnl3l
  gRNA
cuuccggaauuccuuguaau

SEQ ID NO: 89675 - RNA, 20 nt, Artificial Sequence
  MKO10089675_B_Gnl3l
  gRNA
acuuaccuucuuacagccuu

SEQ ID NO: 89676 - RNA, 20 nt, Artificial Sequence
  MKO10089676_B_Gnl3
  gRNA
uccaaagaaguuacauugcc

SEQ ID NO: 89677 - RNA, 20 nt, Artificial Sequence
  MKO10089677_B_Gnl3
  gRNA
agaaaacuugaaguuagccc

SEQ ID NO: 89678 - RNA, 20 nt, Artificial Sequence
  MKO10089678_B_Gnl3
  gRNA
gcgauauaaaauucaaaaaa

SEQ ID NO: 89679 - RNA, 20 nt, Artificial Sequence
  MKO10089679_B_Gnmt
  gRNA
gucgaucaccagcaggcccc

SEQ ID NO: 89680 - RNA, 20 nt, Artificial Sequence
  MKO10089680_B_Gnmt
  gRNA
uuuguccagcgucaaccagu

SEQ ID NO: 89681 - RNA, 20 nt, Artificial Sequence
  MKO10089681_B_Gnmt
  gRNA
uacugacgucguaauguccu

SEQ ID NO: 89682 - RNA, 20 nt, Artificial Sequence
  MKO10089682_B_Gnpau
  gRNA
uggcuccuaugcgcaguuug

SEQ ID NO: 89683 - RNA, 20 nt, Artificial Sequence
  MKO10089683_B_Gnpau
  gRNA
uucuucaugcgacgcacuuu

SEQ ID NO: 89684 - RNA, 20 nt, Artificial Sequence
  MKO10089684_B_Gnpau
  gRNA
augagccacaaacugcgcau

SEQ ID NO: 89685 - RNA, 20 nt, Artificial Sequence
  MKO10089685_B_Gnpda1
  gRNA
uauaguacucgaucagcuuc

SEQ ID NO: 89686 - RNA, 20 nt, Artificial Sequence
  MKO10089686_B_Gnpda1
  gRNA
ugcucuguacaaagccaucg

SEQ ID NO: 89687 - RNA, 20 nt, Artificial Sequence
  MKO10089687_B_Gnpda1
  gRNA
gggcgugaaccacaugugga

SEQ ID NO: 89688 - RNA, 20 nt, Artificial Sequence
  MKO10089688_B_Gnpda2
  gRNA
ccuugugcgcaccuguuaug

SEQ ID NO: 89689 - RNA, 20 nt, Artificial Sequence
  MKO10089689_B_Gnpda2
  gRNA
gagauuaaagacgcuagcaa

SEQ ID NO: 89690 - RNA, 20 nt, Artificial Sequence
  MKO10089690_B_Gnpda2
  gRNA
aacaaugcucacauccucga

SEQ ID NO: 89691 - RNA, 20 nt, Artificial Sequence
  MKO10089691_B_Gnpnau1
  gRNA
auuuauccauucaugugcua

SEQ ID NO: 89692 - RNA, 20 nt, Artificial Sequence
  MKO10089692_B_Gnpnau1
  gRNA
uugggucagcugacagagac

SEQ ID NO: 89693 - RNA, 20 nt, Artificial Sequence
  MKO10089693_B_Gnpnau1
  gRNA
gaaugucuaccacaaaaugu

SEQ ID NO: 89694 - RNA, 20 nt, Artificial Sequence
  MKO10089694_B_Gnpuab
  gRNA
caaccgaaccgacaaagaag

SEQ ID NO: 89695 - RNA, 20 nt, Artificial Sequence
  MKO10089695_B_Gnpuab
  gRNA
uucgguuguguucuucccga

SEQ ID NO: 89696 - RNA, 20 nt, Artificial Sequence
  MKO10089696_B_Gnpuab
  gRNA
ucugcugacgcacugcauua

SEQ ID NO: 89697 - RNA, 20 nt, Artificial Sequence
  MKO10089697_B_Gnpug
  gRNA
cgcucaccggauacagcuga

SEQ ID NO: 89698 - RNA, 20 nt, Artificial Sequence
  MKO10089698_B_Gnpug
  gRNA
ugggcugaaggcggcuugcc

SEQ ID NO: 89699 - RNA, 20 nt, Artificial Sequence
  MKO10089699_B_Gnpug
  gRNA
uggaggagccuaacacauuc

SEQ ID NO: 89700 - RNA, 20 nt, Artificial Sequence
  MKO10089700_B_Gnrh1
  gRNA
gcaacccauaggaccagugc

SEQ ID NO: 89701 - RNA, 20 nt, Artificial Sequence
  MKO10089701_B_Gnrh1
  gRNA
ucaggaaagucugauugaag

SEQ ID NO: 89702 - RNA, 20 nt, Artificial Sequence
  MKO10089702_B_Gnrh1
  gRNA
caucuacaucuucuucugcc

SEQ ID NO: 89703 - RNA, 20 nt, Artificial Sequence
  MKO10089703_B_Gnrhr
  gRNA
gauuagccuggaccgcuccc

SEQ ID NO: 89704 - RNA, 20 nt, Artificial Sequence
  MKO10089704_B_Gnrhr
  gRNA
gggaguccagcagacgacaa

SEQ ID NO: 89705 - RNA, 20 nt, Artificial Sequence
  MKO10089705_B_Gnrhr
  gRNA
aucuaccuagcagacggcuc

SEQ ID NO: 89706 - RNA, 20 nt, Artificial Sequence
  MKO10089706_B_Gns
  gRNA
ccaaaguguuguuaacgacg

SEQ ID NO: 89707 - RNA, 20 nt, Artificial Sequence
  MKO10089707_B_Gns
  gRNA
cuuccgugccuucccguuga

SEQ ID NO: 89708 - RNA, 20 nt, Artificial Sequence
  MKO10089708_B_Gns
  gRNA
caguauggagccccagacgc

SEQ ID NO: 89709 - RNA, 20 nt, Artificial Sequence
  MKO10089709_B_Golga1
  gRNA
uuaauacauaccagaaaguc

SEQ ID NO: 89710 - RNA, 20 nt, Artificial Sequence
  MKO10089710_B_Golga1
  gRNA
guucauuucuucucaaaagc

SEQ ID NO: 89711 - RNA, 20 nt, Artificial Sequence
  MKO10089711_B_Golga1
  gRNA
aauugcauuagaaaaacacc

SEQ ID NO: 89712 - RNA, 20 nt, Artificial Sequence
  MKO10089712_B_Golga2
  gRNA
guaucagcagaagaacagcc

SEQ ID NO: 89713 - RNA, 20 nt, Artificial Sequence
  MKO10089713_B_Golga2
  gRNA
gcuacugacacuauguuucu

SEQ ID NO: 89714 - RNA, 20 nt, Artificial Sequence
  MKO10089714_B_Golga2
  gRNA
cucuggugacugacagucac

SEQ ID NO: 89715 - RNA, 20 nt, Artificial Sequence
  MKO10089715_B_Golga3
  gRNA
agacacucacccuuucccga

SEQ ID NO: 89716 - RNA, 20 nt, Artificial Sequence
  MKO10089716_B_Golga3
  gRNA
ccaccuggcuggaucuaucu

SEQ ID NO: 89717 - RNA, 20 nt, Artificial Sequence
  MKO10089717_B_Golga3
  gRNA
uccacaccuguagaggcauc

SEQ ID NO: 89718 - RNA, 20 nt, Artificial Sequence
  MKO10089718_B_Golga4
  gRNA
ugacgugacacccaacagag

SEQ ID NO: 89719 - RNA, 20 nt, Artificial Sequence
  MKO10089719_B_Golga4
  gRNA
agaugagucgucccccucuc

SEQ ID NO: 89720 - RNA, 20 nt, Artificial Sequence
  MKO10089720_B_Golga4
  gRNA
ucaucuuuacugacaccauc

SEQ ID NO: 89721 - RNA, 20 nt, Artificial Sequence
  MKO10089721_B_Golga5
  gRNA
ccuccugcagucgcacuuug

SEQ ID NO: 89722 - RNA, 20 nt, Artificial Sequence
  MKO10089722_B_Golga5
  gRNA
ugcugcacgccuuaacaaaa

SEQ ID NO: 89723 - RNA, 20 nt, Artificial Sequence
  MKO10089723_B_Golga5
  gRNA
aagcuuggagucggcuaagc

SEQ ID NO: 89724 - RNA, 20 nt, Artificial Sequence
  MKO10089724_B_Golga7b
  gRNA
acccucauuccgcguuccac

SEQ ID NO: 89725 - RNA, 20 nt, Artificial Sequence
  MKO10089725_B_Golga7b
  gRNA
ccuccgcauaaaaaccauug

SEQ ID NO: 89726 - RNA, 20 nt, Artificial Sequence
  MKO10089726_B_Golga7b
  gRNA
gcugcaccgguccucauaga

SEQ ID NO: 89727 - RNA, 20 nt, Artificial Sequence
  MKO10089727_B_Golga7
  gRNA
aguuuccaugcauaagaaga

SEQ ID NO: 89728 - RNA, 20 nt, Artificial Sequence
  MKO10089728_B_Golga7
  gRNA
gagaagauauaugcucccca

SEQ ID NO: 89729 - RNA, 20 nt, Artificial Sequence
  MKO10089729_B_Golga7
  gRNA
aacucgaaguccucucucaa

SEQ ID NO: 89730 - RNA, 20 nt, Artificial Sequence
  MKO10089730_B_Golgb1
  gRNA
ccugcgaggcuuguucugau

SEQ ID NO: 89731 - RNA, 20 nt, Artificial Sequence
  MKO10089731_B_Golgb1
  gRNA
acaugaucuuggccuuugca

SEQ ID NO: 89732 - RNA, 20 nt, Artificial Sequence
  MKO10089732_B_Golgb1
  gRNA
aacacagcucagccagacac

SEQ ID NO: 89733 - RNA, 20 nt, Artificial Sequence
  MKO10089733_B_Golim4
  gRNA
uuacuuucagcaucugaugu

SEQ ID NO: 89734 - RNA, 20 nt, Artificial Sequence
  MKO10089734_B_Golim4
  gRNA
aagaggaacaccggaagcaa

SEQ ID NO: 89735 - RNA, 20 nt, Artificial Sequence
  MKO10089735_B_Golim4
  gRNA
gcacaagaaacacuuaacaa

SEQ ID NO: 89736 - RNA, 20 nt, Artificial Sequence
  MKO10089736_B_Golm1
  gRNA
cagaaagcgaaacgaagcac

SEQ ID NO: 89737 - RNA, 20 nt, Artificial Sequence
  MKO10089737_B_Golm1
  gRNA
cuagacgcgcauuguagagc

SEQ ID NO: 89738 - RNA, 20 nt, Artificial Sequence
  MKO10089738_B_Golm1
  gRNA
gaaugucaacaagcuacacc

SEQ ID NO: 89739 - RNA, 20 nt, Artificial Sequence
  MKO10089739_B_Golph3l
  gRNA
ccgccuaggguacgggaaac

SEQ ID NO: 89740 - RNA, 20 nt, Artificial Sequence
  MKO10089740_B_Golph3l
  gRNA
gaguggucaugucgaagagc

SEQ ID NO: 89741 - RNA, 20 nt, Artificial Sequence
  MKO10089741_B_Golph3l
  gRNA
gauccacgucugcacaguuu

SEQ ID NO: 89742 - RNA, 20 nt, Artificial Sequence
  MKO10089742_B_Golph3
  gRNA
acgcugcuuaauguuguuau

SEQ ID NO: 89743 - RNA, 20 nt, Artificial Sequence
  MKO10089743_B_Golph3
  gRNA
uguauaucaucuggauuacg

SEQ ID NO: 89744 - RNA, 20 nt, Artificial Sequence
  MKO10089744_B_Golph3
  gRNA
uaaguaacucaauccaguuc

SEQ ID NO: 89745 - RNA, 20 nt, Artificial Sequence
  MKO10089745_B_Golt1a
  gRNA
ggauguuaaacgcacugccc

SEQ ID NO: 89746 - RNA, 20 nt, Artificial Sequence
  MKO10089746_B_Golt1a
  gRNA
guacuuugacuccgugcucu

SEQ ID NO: 89747 - RNA, 20 nt, Artificial Sequence
  MKO10089747_B_Golt1a
  gRNA
aguacaggagaaucccaaag

SEQ ID NO: 89748 - RNA, 20 nt, Artificial Sequence
  MKO10089748_B_Golt1b
  gRNA
gguguguucgugguccucau

SEQ ID NO: 89749 - RNA, 20 nt, Artificial Sequence
  MKO10089749_B_Golt1b
  gRNA
uuacaguucguagacaaagu

SEQ ID NO: 89750 - RNA, 20 nt, Artificial Sequence
  MKO10089750_B_Golt1b
  gRNA
uuauguugcagaaauuggca

SEQ ID NO: 89751 - RNA, 20 nt, Artificial Sequence
  MKO10089751_B_Gon4l
  gRNA
cuacuuccuucaguuuagag

SEQ ID NO: 89752 - RNA, 20 nt, Artificial Sequence
  MKO10089752_B_Gon4l
  gRNA
aaucacaaaugaacauguug

SEQ ID NO: 89753 - RNA, 20 nt, Artificial Sequence
  MKO10089753_B_Gon4l
  gRNA
caugucuucugucucacuga

SEQ ID NO: 89754 - RNA, 20 nt, Artificial Sequence
  MKO10089754_B_Gopc
  gRNA
ucgccccauaaacuucagcc

SEQ ID NO: 89755 - RNA, 20 nt, Artificial Sequence
  MKO10089755_B_Gopc
  gRNA
aggagaacgaggcucuucga

SEQ ID NO: 89756 - RNA, 20 nt, Artificial Sequence
  MKO10089756_B_Gopc
  gRNA
gcagcuguaaaagcugcucg

SEQ ID NO: 89757 - RNA, 20 nt, Artificial Sequence
  MKO10089757_B_Gorab
  gRNA
agguagcuuuccaucgccag

SEQ ID NO: 89758 - RNA, 20 nt, Artificial Sequence
  MKO10089758_B_Gorab
  gRNA
ucaggcaagagaaaucucgu

SEQ ID NO: 89759 - RNA, 20 nt, Artificial Sequence
  MKO10089759_B_Gorab
  gRNA
guugcaggccuuagacgaca

SEQ ID NO: 89760 - RNA, 20 nt, Artificial Sequence
  MKO10089760_B_Gorasp1
  gRNA
acagguacaagagaacucgc

SEQ ID NO: 89761 - RNA, 20 nt, Artificial Sequence
  MKO10089761_B_Gorasp1
  gRNA
uuauacaccaucagcuucag

SEQ ID NO: 89762 - RNA, 20 nt, Artificial Sequence
  MKO10089762_B_Gorasp1
  gRNA
ccaacuauguagucugugua

SEQ ID NO: 89763 - RNA, 20 nt, Artificial Sequence
  MKO10089763_B_Gorasp2
  gRNA
uugcuucgugggucucaaua

SEQ ID NO: 89764 - RNA, 20 nt, Artificial Sequence
  MKO10089764_B_Gorasp2
  gRNA
cucaauccugccagcgcugc

SEQ ID NO: 89765 - RNA, 20 nt, Artificial Sequence
  MKO10089765_B_Gorasp2
  gRNA
uguuguacacguagagcuuc

SEQ ID NO: 89766 - RNA, 20 nt, Artificial Sequence
  MKO10089766_B_Gosr1
  gRNA
gucgcugcagcgugugcauc

SEQ ID NO: 89767 - RNA, 20 nt, Artificial Sequence
  MKO10089767_B_Gosr1
  gRNA
gacacaacaccgcuauuaaa

SEQ ID NO: 89768 - RNA, 20 nt, Artificial Sequence
  MKO10089768_B_Gosr1
  gRNA
uacaggaguaaacgacaaaa

SEQ ID NO: 89769 - RNA, 20 nt, Artificial Sequence
  MKO10089769_B_Gosr2
  gRNA
gccggugcugaaaguuccug

SEQ ID NO: 89770 - RNA, 20 nt, Artificial Sequence
  MKO10089770_B_Gosr2
  gRNA
auauuugcucuaugcuugcu

SEQ ID NO: 89771 - RNA, 20 nt, Artificial Sequence
  MKO10089771_B_Gosr2
  gRNA
ccuugcuugacaaaaucucc

SEQ ID NO: 89772 - RNA, 20 nt, Artificial Sequence
  MKO10089772_B_Got1l1
  gRNA
guugggggugugcacaucgu

SEQ ID NO: 89773 - RNA, 20 nt, Artificial Sequence
  MKO10089773_B_Got1l1
  gRNA
gaguacuuccacgaacaugc

SEQ ID NO: 89774 - RNA, 20 nt, Artificial Sequence
  MKO10089774_B_Got1l1
  gRNA
gacccgccugcagauugcag

SEQ ID NO: 89775 - RNA, 20 nt, Artificial Sequence
  MKO10089775_B_Got1
  gRNA
guuggugaugauacguagau

SEQ ID NO: 89776 - RNA, 20 nt, Artificial Sequence
  MKO10089776_B_Got1
  gRNA
ucuacguaucaucaccaacc

SEQ ID NO: 89777 - RNA, 20 nt, Artificial Sequence
  MKO10089777_B_Got1
  gRNA
ccacgaguaccugcccaucc

SEQ ID NO: 89778 - RNA, 20 nt, Artificial Sequence
  MKO10089778_B_Got2
  gRNA
cacuuacugauaugucuucu

SEQ ID NO: 89779 - RNA, 20 nt, Artificial Sequence
  MKO10089779_B_Got2
  gRNA
acacuucauuguucucgccc

SEQ ID NO: 89780 - RNA, 20 nt, Artificial Sequence
  MKO10089780_B_Got2
  gRNA
acaaagaauaccugcccauu

SEQ ID NO: 89781 - RNA, 20 nt, Artificial Sequence
  MKO10089781_B_Gp1ba
  gRNA
cagcucacgcaauuuguugu

SEQ ID NO: 89782 - RNA, 20 nt, Artificial Sequence
  MKO10089782_B_Gp1ba
  gRNA
caguguacgaugugccaacu

SEQ ID NO: 89783 - RNA, 20 nt, Artificial Sequence
  MKO10089783_B_Gp1ba
  gRNA
agaggccccacucgcccauu

SEQ ID NO: 89784 - RNA, 20 nt, Artificial Sequence
  MKO10089784_B_Gp1bb
  gRNA
gcugcuacacgcgcugcuau

SEQ ID NO: 89785 - RNA, 20 nt, Artificial Sequence
  MKO10089785_B_Gp1bb
  gRNA
cagcgccgucagguuguugc

SEQ ID NO: 89786 - RNA, 20 nt, Artificial Sequence
  MKO10089786_B_Gp1bb
  gRNA
ccgcuugcugcccuacgugg

SEQ ID NO: 89787 - RNA, 20 nt, Artificial Sequence
  MKO10089787_B_Gp2
  gRNA
gacaauaccuuacaaugggc

SEQ ID NO: 89788 - RNA, 20 nt, Artificial Sequence
  MKO10089788_B_Gp2
  gRNA
gcaugguaccauugcaguuc

SEQ ID NO: 89789 - RNA, 20 nt, Artificial Sequence
  MKO10089789_B_Gp2
  gRNA
cacaggaccaguuguuauuu

SEQ ID NO: 89790 - RNA, 20 nt, Artificial Sequence
  MKO10089790_B_Gp49a
  gRNA
ugagcugcacuuaaaggaua

SEQ ID NO: 89791 - RNA, 20 nt, Artificial Sequence
  MKO10089791_B_Gp49a
  gRNA
cccgcacuuaccaucuucag

SEQ ID NO: 89792 - RNA, 20 nt, Artificial Sequence
  MKO10089792_B_Gp49a
  gRNA
uccuguacacccacugaaga

SEQ ID NO: 89793 - RNA, 20 nt, Artificial Sequence
  MKO10089793_B_Gp5
  gRNA
agagccgcgaacacgucucc

SEQ ID NO: 89794 - RNA, 20 nt, Artificial Sequence
  MKO10089794_B_Gp5
  gRNA
ccgaggcggucgaaggcacc

SEQ ID NO: 89795 - RNA, 20 nt, Artificial Sequence
  MKO10089795_B_Gp5
  gRNA
acgcaagagugcgagcaccg

SEQ ID NO: 89796 - RNA, 20 nt, Artificial Sequence
  MKO10089796_B_Gp6
  gRNA
cucggggcugaccacaggua

SEQ ID NO: 89797 - RNA, 20 nt, Artificial Sequence
  MKO10089797_B_Gp6
  gRNA
cauacucaccacucuguguu

SEQ ID NO: 89798 - RNA, 20 nt, Artificial Sequence
  MKO10089798_B_Gp6
  gRNA
cacaggaaaugauucuuccg

SEQ ID NO: 89799 - RNA, 20 nt, Artificial Sequence
  MKO10089799_B_Gp9
  gRNA
agccugcguucagugccacc

SEQ ID NO: 89800 - RNA, 20 nt, Artificial Sequence
  MKO10089800_B_Gp9
  gRNA
ucgaccacuugccucagcug

SEQ ID NO: 89801 - RNA, 20 nt, Artificial Sequence
  MKO10089801_B_Gp9
  gRNA
aaguggucgaaggcaccugg

SEQ ID NO: 89802 - RNA, 20 nt, Artificial Sequence
  MKO10089802_B_Gpa33
  gRNA
caccuauguuucagaccgag

SEQ ID NO: 89803 - RNA, 20 nt, Artificial Sequence
  MKO10089803_B_Gpa33
  gRNA
gagucccuaccgucugacuu

SEQ ID NO: 89804 - RNA, 20 nt, Artificial Sequence
  MKO10089804_B_Gpa33
  gRNA
agaguccugcaacaucaccg

SEQ ID NO: 89805 - RNA, 20 nt, Artificial Sequence
  MKO10089805_B_Gpaa1
  gRNA
gugucagguaccaacgugua

SEQ ID NO: 89806 - RNA, 20 nt, Artificial Sequence
  MKO10089806_B_Gpaa1
  gRNA
uggcagaacguggggcccgc

SEQ ID NO: 89807 - RNA, 20 nt, Artificial Sequence
  MKO10089807_B_Gpaa1
  gRNA
gguaacagaccaugaucuuc

SEQ ID NO: 89808 - RNA, 20 nt, Artificial Sequence
  MKO10089808_B_Gpalpp1
  gRNA
acuguccucgucacugucug

SEQ ID NO: 89809 - RNA, 20 nt, Artificial Sequence
  MKO10089809_B_Gpalpp1
  gRNA
gucaucauucuucaacucag

SEQ ID NO: 89810 - RNA, 20 nt, Artificial Sequence
  MKO10089810_B_Gpalpp1
  gRNA
aagaaugaugacacuugccc

SEQ ID NO: 89811 - RNA, 20 nt, Artificial Sequence
  MKO10089811_B_Gpam
  gRNA
agagccuuaugagccggaag

SEQ ID NO: 89812 - RNA, 20 nt, Artificial Sequence
  MKO10089812_B_Gpam
  gRNA
auggucgccaccgucucccc

SEQ ID NO: 89813 - RNA, 20 nt, Artificial Sequence
  MKO10089813_B_Gpam
  gRNA
agacgguggcgaccaucucc

SEQ ID NO: 89814 - RNA, 20 nt, Artificial Sequence
  MKO10089814_B_Gpank1
  gRNA
guuggcacggccuucacccc

SEQ ID NO: 89815 - RNA, 20 nt, Artificial Sequence
  MKO10089815_B_Gpank1
  gRNA
cuucaucgaauuuaccccag

SEQ ID NO: 89816 - RNA, 20 nt, Artificial Sequence
  MKO10089816_B_Gpank1
  gRNA
ccucaccgguucugguucuc

SEQ ID NO: 89817 - RNA, 20 nt, Artificial Sequence
  MKO10089817_B_Gpau2
  gRNA
acacuaccucuugaccauug

SEQ ID NO: 89818 - RNA, 20 nt, Artificial Sequence
  MKO10089818_B_Gpau2
  gRNA
cuucccccagguuccggggc

SEQ ID NO: 89819 - RNA, 20 nt, Artificial Sequence
  MKO10089819_B_Gpau2
  gRNA
ugaugccucccagaagauca

SEQ ID NO: 89820 - RNA, 20 nt, Artificial Sequence
  MKO10089820_B_Gpauch11
  gRNA
aucggguugaagaaugcacu

SEQ ID NO: 89821 - RNA, 20 nt, Artificial Sequence
  MKO10089821_B_Gpauch11
  gRNA
gucaucauuaaaacggaaag

SEQ ID NO: 89822 - RNA, 20 nt, Artificial Sequence
  MKO10089822_B_Gpauch11
  gRNA
ccagcgagcuugccagcagc

SEQ ID NO: 89823 - RNA, 20 nt, Artificial Sequence
  MKO10089823_B_Gpauch1
  gRNA
cguaccuuccuuugagccga

SEQ ID NO: 89824 - RNA, 20 nt, Artificial Sequence
  MKO10089824_B_Gpauch1
  gRNA
gcugguuacuucaauaccgu

SEQ ID NO: 89825 - RNA, 20 nt, Artificial Sequence
  MKO10089825_B_Gpauch1
  gRNA
gcuugaugaccucaucacac

SEQ ID NO: 89826 - RNA, 20 nt, Artificial Sequence
  MKO10089826_B_Gpauch2l
  gRNA
cccacuugggcagaagguua

SEQ ID NO: 89827 - RNA, 20 nt, Artificial Sequence
  MKO10089827_B_Gpauch2l
  gRNA
ucuacuucagugcagugauc

SEQ ID NO: 89828 - RNA, 20 nt, Artificial Sequence
  MKO10089828_B_Gpauch2l
  gRNA
accuugucguccuucaucau

SEQ ID NO: 89829 - RNA, 20 nt, Artificial Sequence
  MKO10089829_B_Gpauch2
  gRNA
ggauugcuggagucgugccc

SEQ ID NO: 89830 - RNA, 20 nt, Artificial Sequence
  MKO10089830_B_Gpauch2
  gRNA
gaaggcgacugagucuagcu

SEQ ID NO: 89831 - RNA, 20 nt, Artificial Sequence
  MKO10089831_B_Gpauch2
  gRNA
accuugucuucccucaucgu

SEQ ID NO: 89832 - RNA, 20 nt, Artificial Sequence
  MKO10089832_B_Gpauch3
  gRNA
ucaacucuaaaaagacccgc

SEQ ID NO: 89833 - RNA, 20 nt, Artificial Sequence
  MKO10089833_B_Gpauch3
  gRNA
augagcgucuacuacgacag

SEQ ID NO: 89834 - RNA, 20 nt, Artificial Sequence
  MKO10089834_B_Gpauch3
  gRNA
ucuacaccgacgcucaguuc

SEQ ID NO: 89835 - RNA, 20 nt, Artificial Sequence
  MKO10089835_B_Gpauch4
  gRNA
gucucacaucuuugggggcg

SEQ ID NO: 89836 - RNA, 20 nt, Artificial Sequence
  MKO10089836_B_Gpauch4
  gRNA
cuccucuacaggcaagggcc

SEQ ID NO: 89837 - RNA, 20 nt, Artificial Sequence
  MKO10089837_B_Gpauch4
  gRNA
gcagauaagacgucuuucca

SEQ ID NO: 89838 - RNA, 20 nt, Artificial Sequence
  MKO10089838_B_Gpauch8
  gRNA
caugggucgaauggaaaugg

SEQ ID NO: 89839 - RNA, 20 nt, Artificial Sequence
  MKO10089839_B_Gpauch8
  gRNA
ccuugacaagcccauagaau

SEQ ID NO: 89840 - RNA, 20 nt, Artificial Sequence
  MKO10089840_B_Gpauch8
  gRNA
acgccguucgguagcauccu

SEQ ID NO: 89841 - RNA, 20 nt, Artificial Sequence
  MKO10089841_B_Gpbar1
  gRNA
uaugagcgucgcccaccacu

SEQ ID NO: 89842 - RNA, 20 nt, Artificial Sequence
  MKO10089842_B_Gpbar1
  gRNA
cgaugacgaugaggcuugcc

SEQ ID NO: 89843 - RNA, 20 nt, Artificial Sequence
  MKO10089843_B_Gpbar1
  gRNA
ccuucucucuguccgcgugu

SEQ ID NO: 89844 - RNA, 20 nt, Artificial Sequence
  MKO10089844_B_Gpbp1l1
  gRNA
uaccuaccccacacuccaga

SEQ ID NO: 89845 - RNA, 20 nt, Artificial Sequence
  MKO10089845_B_Gpbp1l1
  gRNA
ggaagagccaugccaaccug

SEQ ID NO: 89846 - RNA, 20 nt, Artificial Sequence
  MKO10089846_B_Gpbp1l1
  gRNA
aaucagcccugcagaccugu

SEQ ID NO: 89847 - RNA, 20 nt, Artificial Sequence
  MKO10089847_B_Gpbp1
  gRNA
ggaaaauacugcuacgagaa

SEQ ID NO: 89848 - RNA, 20 nt, Artificial Sequence
  MKO10089848_B_Gpbp1
  gRNA
agcaugacuuugcuccagcc

SEQ ID NO: 89849 - RNA, 20 nt, Artificial Sequence
  MKO10089849_B_Gpbp1
  gRNA
ucagaauaaaucuuuagcug

SEQ ID NO: 89850 - RNA, 20 nt, Artificial Sequence
  MKO10089850_B_Gpc1
  gRNA
uaguacagcaaguguagccc

SEQ ID NO: 89851 - RNA, 20 nt, Artificial Sequence
  MKO10089851_B_Gpc1
  gRNA
gagcacauuucggcaauagu

SEQ ID NO: 89852 - RNA, 20 nt, Artificial Sequence
  MKO10089852_B_Gpc1
  gRNA
uuuggccaaccacagccgaa

SEQ ID NO: 89853 - RNA, 20 nt, Artificial Sequence
  MKO10089853_B_Gpc2
  gRNA
gaaggaacuccccgacaaag

SEQ ID NO: 89854 - RNA, 20 nt, Artificial Sequence
  MKO10089854_B_Gpc2
  gRNA
gcccggcauagaaaguuuaa

SEQ ID NO: 89855 - RNA, 20 nt, Artificial Sequence
  MKO10089855_B_Gpc2
  gRNA
gaugcugaagucacauuccg

SEQ ID NO: 89856 - RNA, 20 nt, Artificial Sequence
  MKO10089856_B_Gpc3
  gRNA
ugaguuccauacucgcagac

SEQ ID NO: 89857 - RNA, 20 nt, Artificial Sequence
  MKO10089857_B_Gpc3
  gRNA
uguucagccgugcuguuagu

SEQ ID NO: 89858 - RNA, 20 nt, Artificial Sequence
  MKO10089858_B_Gpc3
  gRNA
aaaccuuauccagccgaaga

SEQ ID NO: 89859 - RNA, 20 nt, Artificial Sequence
  MKO10089859_B_Gpc4
  gRNA
uuucaacauugaguccguua

SEQ ID NO: 89860 - RNA, 20 nt, Artificial Sequence
  MKO10089860_B_Gpc4
  gRNA
ucccguuacaagaaguuuga

SEQ ID NO: 89861 - RNA, 20 nt, Artificial Sequence
  MKO10089861_B_Gpc4
  gRNA
gagaacagcauguauaaucc

SEQ ID NO: 89862 - RNA, 20 nt, Artificial Sequence
  MKO10089862_B_Gpc5
  gRNA
ugaaaggugaauacgauuug

SEQ ID NO: 89863 - RNA, 20 nt, Artificial Sequence
  MKO10089863_B_Gpc5
  gRNA
cugcauggguccuucuaugg

SEQ ID NO: 89864 - RNA, 20 nt, Artificial Sequence
  MKO10089864_B_Gpc5
  gRNA
uagcaacuuuaauguugagc

SEQ ID NO: 89865 - RNA, 20 nt, Artificial Sequence
  MKO10089865_B_Gpc6
  gRNA
cugcauguacagcaucccgu

SEQ ID NO: 89866 - RNA, 20 nt, Artificial Sequence
  MKO10089866_B_Gpc6
  gRNA
ggcagcccuucaugacguug

SEQ ID NO: 89867 - RNA, 20 nt, Artificial Sequence
  MKO10089867_B_Gpc6
  gRNA
aguguccaaaucugccugau

SEQ ID NO: 89868 - RNA, 20 nt, Artificial Sequence
  MKO10089868_B_Gpcpd1
  gRNA
agugaaaucauuauugacga

SEQ ID NO: 89869 - RNA, 20 nt, Artificial Sequence
  MKO10089869_B_Gpcpd1
  gRNA
gcagugauugcucucaauag

SEQ ID NO: 89870 - RNA, 20 nt, Artificial Sequence
  MKO10089870_B_Gpcpd1
  gRNA
cuuauuaaugaaaacgagac

SEQ ID NO: 89871 - RNA, 20 nt, Artificial Sequence
  MKO10089871_B_Gpd1l
  gRNA
ugucagcuuccucccguuca

SEQ ID NO: 89872 - RNA, 20 nt, Artificial Sequence
  MKO10089872_B_Gpd1l
  gRNA
accccucuagggcauagaug

SEQ ID NO: 89873 - RNA, 20 nt, Artificial Sequence
  MKO10089873_B_Gpd1l
  gRNA
gucuuugaggagaccgugaa

SEQ ID NO: 89874 - RNA, 20 nt, Artificial Sequence
  MKO10089874_B_Gpd1
  gRNA
uaccacagugaugcgaaagu

SEQ ID NO: 89875 - RNA, 20 nt, Artificial Sequence
  MKO10089875_B_Gpd1
  gRNA
ugucagcgccuguugcagcc

SEQ ID NO: 89876 - RNA, 20 nt, Artificial Sequence
  MKO10089876_B_Gpd1
  gRNA
cucagccauugccaagaucg

SEQ ID NO: 89877 - RNA, 20 nt, Artificial Sequence
  MKO10089877_B_Gpd2
  gRNA
gcacuagaugccgucaccag

SEQ ID NO: 89878 - RNA, 20 nt, Artificial Sequence
  MKO10089878_B_Gpd2
  gRNA
gguggcaguuaccuuauuac

SEQ ID NO: 89879 - RNA, 20 nt, Artificial Sequence
  MKO10089879_B_Gpd2
  gRNA
cugcugcuuccacauaugcc

SEQ ID NO: 89880 - RNA, 20 nt, Artificial Sequence
  MKO10089880_B_Gper1
  gRNA
ccacugcgaagaucauccuc

SEQ ID NO: 89881 - RNA, 20 nt, Artificial Sequence
  MKO10089881_B_Gper1
  gRNA
gaugccccggggaaccucac

SEQ ID NO: 89882 - RNA, 20 nt, Artificial Sequence
  MKO10089882_B_Gper1
  gRNA
cuucgacagguaccuagcgc

SEQ ID NO: 89883 - RNA, 20 nt, Artificial Sequence
  MKO10089883_B_Gpha2
  gRNA
agcuugagaucuuuacugca

SEQ ID NO: 89884 - RNA, 20 nt, Artificial Sequence
  MKO10089884_B_Gpha2
  gRNA
agucuugcuccuuugccugc

SEQ ID NO: 89885 - RNA, 20 nt, Artificial Sequence
  MKO10089885_B_Gpha2
  gRNA
ucacggugcaaguggcagcc

SEQ ID NO: 89886 - RNA, 20 nt, Artificial Sequence
  MKO10089886_B_Gphb5
  gRNA
ucaccucccaggucucgcag

SEQ ID NO: 89887 - RNA, 20 nt, Artificial Sequence
  MKO10089887_B_Gphb5
  gRNA
ucgacuccaggggcacaguu

SEQ ID NO: 89888 - RNA, 20 nt, Artificial Sequence
  MKO10089888_B_Gphb5
  gRNA
auccgaaguccccugcagcc

SEQ ID NO: 89889 - RNA, 20 nt, Artificial Sequence
  MKO10089889_B_Gphn
  gRNA
accucuggagugacaucucg

SEQ ID NO: 89890 - RNA, 20 nt, Artificial Sequence
  MKO10089890_B_Gphn
  gRNA
aaucuugcagaagaccgcag

SEQ ID NO: 89891 - RNA, 20 nt, Artificial Sequence
  MKO10089891_B_Gphn
  gRNA
uuuaggaaacacucauagac

SEQ ID NO: 89892 - RNA, 20 nt, Artificial Sequence
  MKO10089892_B_Gpi1
  gRNA
aucuuugccguccaccuuga

SEQ ID NO: 89893 - RNA, 20 nt, Artificial Sequence
  MKO10089893_B_Gpi1
  gRNA
ccgugcagccuccacgccuc

SEQ ID NO: 89894 - RNA, 20 nt, Artificial Sequence
  MKO10089894_B_Gpi1
  gRNA
ggacggcaaagaugugaugc

SEQ ID NO: 89895 - RNA, 20 nt, Artificial Sequence
  MKO10089895_B_Gpihbp1
  gRNA
ucaucguaguuguaguucuc

SEQ ID NO: 89896 - RNA, 20 nt, Artificial Sequence
  MKO10089896_B_Gpihbp1
  gRNA
aucacgcucgucucccacag

SEQ ID NO: 89897 - RNA, 20 nt, Artificial Sequence
  MKO10089897_B_Gpihbp1
  gRNA
guccacuuaguagcaagauc

SEQ ID NO: 89898 - RNA, 20 nt, Artificial Sequence
  MKO10089898_B_Gpkow
  gRNA
gccucauagucggcuuccuc

SEQ ID NO: 89899 - RNA, 20 nt, Artificial Sequence
  MKO10089899_B_Gpkow
  gRNA
acuauccccaugauccagaa

SEQ ID NO: 89900 - RNA, 20 nt, Artificial Sequence
  MKO10089900_B_Gpkow
  gRNA
uguguugucccaggcuguga

SEQ ID NO: 89901 - RNA, 20 nt, Artificial Sequence
  MKO10089901_B_Gpld1
  gRNA
gguaguucucucgaauauaa

SEQ ID NO: 89902 - RNA, 20 nt, Artificial Sequence
  MKO10089902_B_Gpld1
  gRNA
aauaucaugacguuucugag

SEQ ID NO: 89903 - RNA, 20 nt, Artificial Sequence
  MKO10089903_B_Gpld1
  gRNA
uggacgcauuaacuacaaag

SEQ ID NO: 89904 - RNA, 20 nt, Artificial Sequence
  MKO10089904_B_Gpm6a
  gRNA
cgagugcugcauuaaaugcc

SEQ ID NO: 89905 - RNA, 20 nt, Artificial Sequence
  MKO10089905_B_Gpm6a
  gRNA
auuguagggauugugacaau

SEQ ID NO: 89906 - RNA, 20 nt, Artificial Sequence
  MKO10089906_B_Gpm6a
  gRNA
agcgcucacacaucugccac

SEQ ID NO: 89907 - RNA, 20 nt, Artificial Sequence
  MKO10089907_B_Gpm6b
  gRNA
cguguuccucaccuaugugc

SEQ ID NO: 89908 - RNA, 20 nt, Artificial Sequence
  MKO10089908_B_Gpm6b
  gRNA
guguugcucaagaauugcca

SEQ ID NO: 89909 - RNA, 20 nt, Artificial Sequence
  MKO10089909_B_Gpm6b
  gRNA
gccaccauccuauguuucuc

SEQ ID NO: 89910 - RNA, 20 nt, Artificial Sequence
  MKO10089910_B_Gpn1
  gRNA
ucaccuaccugaauguguuc

SEQ ID NO: 89911 - RNA, 20 nt, Artificial Sequence
  MKO10089911_B_Gpn1
  gRNA
cuuugcuaccagauuugauc

SEQ ID NO: 89912 - RNA, 20 nt, Artificial Sequence
  MKO10089912_B_Gpn1
  gRNA
ggugaugaaauuuauugaga

SEQ ID NO: 89913 - RNA, 20 nt, Artificial Sequence
  MKO10089913_B_Gpn2
  gRNA
cugcucugcggucugcuccg

SEQ ID NO: 89914 - RNA, 20 nt, Artificial Sequence
  MKO10089914_B_Gpn2
  gRNA
cucggagcagaccgcagagc

SEQ ID NO: 89915 - RNA, 20 nt, Artificial Sequence
  MKO10089915_B_Gpn2
  gRNA
gcuucccauaguguucaaua

SEQ ID NO: 89916 - RNA, 20 nt, Artificial Sequence
  MKO10089916_B_Gpn3
  gRNA
ccaguuuaucuccggcaucc

SEQ ID NO: 89917 - RNA, 20 nt, Artificial Sequence
  MKO10089917_B_Gpn3
  gRNA
uucgucaugauguuaaccug

SEQ ID NO: 89918 - RNA, 20 nt, Artificial Sequence
  MKO10089918_B_Gpn3
  gRNA
cguccaccucgaucagcucc

SEQ ID NO: 89919 - RNA, 20 nt, Artificial Sequence
  MKO10089919_B_Gpnmb
  gRNA
ccugagaugcuggcuucggc

SEQ ID NO: 89920 - RNA, 20 nt, Artificial Sequence
  MKO10089920_B_Gpnmb
  gRNA
cgagggaagggccuccuguc

SEQ ID NO: 89921 - RNA, 20 nt, Artificial Sequence
  MKO10089921_B_Gpnmb
  gRNA
ugcccuaggaggccgugugc

SEQ ID NO: 89922 - RNA, 20 nt, Artificial Sequence
  MKO10089922_B_Gpr101
  gRNA
ucauuucaacgacgauguug

SEQ ID NO: 89923 - RNA, 20 nt, Artificial Sequence
  MKO10089923_B_Gpr101
  gRNA
acuacgucgguuggucaucu

SEQ ID NO: 89924 - RNA, 20 nt, Artificial Sequence
  MKO10089924_B_Gpr101
  gRNA
gggugaucaccauaauaauc

SEQ ID NO: 89925 - RNA, 20 nt, Artificial Sequence
  MKO10089925_B_Gpr107
  gRNA
gucagauccccaccagaagc

SEQ ID NO: 89926 - RNA, 20 nt, Artificial Sequence
  MKO10089926_B_Gpr107
  gRNA
ucuccgagccucacugucuu

SEQ ID NO: 89927 - RNA, 20 nt, Artificial Sequence
  MKO10089927_B_Gpr107
  gRNA
cuugucaucuuagacaucuc

SEQ ID NO: 89928 - RNA, 20 nt, Artificial Sequence
  MKO10089928_B_Gpr108
  gRNA
cuccacucaccgaguaggag

SEQ ID NO: 89929 - RNA, 20 nt, Artificial Sequence
  MKO10089929_B_Gpr108
  gRNA
gaacucccaugaaugcccuc

SEQ ID NO: 89930 - RNA, 20 nt, Artificial Sequence
  MKO10089930_B_Gpr108
  gRNA
gcagguccuugauauugaug

SEQ ID NO: 89931 - RNA, 20 nt, Artificial Sequence
  MKO10089931_B_Gpr110
  gRNA
ccugcgaagacagcuauacg

SEQ ID NO: 89932 - RNA, 20 nt, Artificial Sequence
  MKO10089932_B_Gpr110
  gRNA
caucagaugaugaauuccaa

SEQ ID NO: 89933 - RNA, 20 nt, Artificial Sequence
  MKO10089933_B_Gpr110
  gRNA
uuucaauuccaacuguguag

SEQ ID NO: 89934 - RNA, 20 nt, Artificial Sequence
  MKO10089934_B_Gpr111
  gRNA
ucuaaccaaagacgucaaug

SEQ ID NO: 89935 - RNA, 20 nt, Artificial Sequence
  MKO10089935_B_Gpr111
  gRNA
uuccaucaacguauccauua

SEQ ID NO: 89936 - RNA, 20 nt, Artificial Sequence
  MKO10089936_B_Gpr111
  gRNA
ucaggccuccagcaaaagca

SEQ ID NO: 89937 - RNA, 20 nt, Artificial Sequence
  MKO10089937_B_Gpr113
  gRNA
cuuuacucuuccuaccgccc

SEQ ID NO: 89938 - RNA, 20 nt, Artificial Sequence
  MKO10089938_B_Gpr113
  gRNA
gaguguuaccugcccaauga

SEQ ID NO: 89939 - RNA, 20 nt, Artificial Sequence
  MKO10089939_B_Gpr113
  gRNA
aguagccaguaacaggaccg

SEQ ID NO: 89940 - RNA, 20 nt, Artificial Sequence
  MKO10089940_B_Gpr114
  gRNA
ggggcuugucuuccagagcg

SEQ ID NO: 89941 - RNA, 20 nt, Artificial Sequence
  MKO10089941_B_Gpr114
  gRNA
aagcugagcugcgacuuucc

SEQ ID NO: 89942 - RNA, 20 nt, Artificial Sequence
  MKO10089942_B_Gpr114
  gRNA
cagaugagucgaagcucagc

SEQ ID NO: 89943 - RNA, 20 nt, Artificial Sequence
  MKO10089943_B_Gpr115
  gRNA
aacaaugcaaacguaguccu

SEQ ID NO: 89944 - RNA, 20 nt, Artificial Sequence
  MKO10089944_B_Gpr115
  gRNA
gcaugaguuuagaccaagac

SEQ ID NO: 89945 - RNA, 20 nt, Artificial Sequence
  MKO10089945_B_Gpr115
  gRNA
augugaauacgauuucucca

SEQ ID NO: 89946 - RNA, 20 nt, Artificial Sequence
  MKO10089946_B_Gpr116
  gRNA
auuucguaccuucugggagc

SEQ ID NO: 89947 - RNA, 20 nt, Artificial Sequence
  MKO10089947_B_Gpr116
  gRNA
gggcagaagacguguucuuu

SEQ ID NO: 89948 - RNA, 20 nt, Artificial Sequence
  MKO10089948_B_Gpr116
  gRNA
agugagcucugauggacucc

SEQ ID NO: 89949 - RNA, 20 nt, Artificial Sequence
  MKO10089949_B_Gpr119
  gRNA
ccgucuuagccaucgagcuc

SEQ ID NO: 89950 - RNA, 20 nt, Artificial Sequence
  MKO10089950_B_Gpr119
  gRNA
uugaagucauugacagaccg

SEQ ID NO: 89951 - RNA, 20 nt, Artificial Sequence
  MKO10089951_B_Gpr119
  gRNA
ccucucuggaccacgauucc

SEQ ID NO: 89952 - RNA, 20 nt, Artificial Sequence
  MKO10089952_B_Gpr123
  gRNA
gugaccccacagaugaugaa

SEQ ID NO: 89953 - RNA, 20 nt, Artificial Sequence
  MKO10089953_B_Gpr123
  gRNA
uacgguggcuggucugcucc

SEQ ID NO: 89954 - RNA, 20 nt, Artificial Sequence
  MKO10089954_B_Gpr123
  gRNA
gacagguucuaccucaucag

SEQ ID NO: 89955 - RNA, 20 nt, Artificial Sequence
  MKO10089955_B_Gpr124
  gRNA
gcacuuacaacuucuccaac

SEQ ID NO: 89956 - RNA, 20 nt, Artificial Sequence
  MKO10089956_B_Gpr124
  gRNA
cuagagaucucuccaacaau

SEQ ID NO: 89957 - RNA, 20 nt, Artificial Sequence
  MKO10089957_B_Gpr124
  gRNA
gucaucagcacugugcagcc

SEQ ID NO: 89958 - RNA, 20 nt, Artificial Sequence
  MKO10089958_B_Gpr125
  gRNA
uacuuacagccgaaccagau

SEQ ID NO: 89959 - RNA, 20 nt, Artificial Sequence
  MKO10089959_B_Gpr125
  gRNA
uugauuaucuuggcucguug

SEQ ID NO: 89960 - RNA, 20 nt, Artificial Sequence
  MKO10089960_B_Gpr125
  gRNA
agaauacucacagucuuucg

SEQ ID NO: 89961 - RNA, 20 nt, Artificial Sequence
  MKO10089961_B_Gpr126
  gRNA
ggaggguccacgaacaagac

SEQ ID NO: 89962 - RNA, 20 nt, Artificial Sequence
  MKO10089962_B_Gpr126
  gRNA
gcugacaaacuguucagaac

SEQ ID NO: 89963 - RNA, 20 nt, Artificial Sequence
  MKO10089963_B_Gpr126
  gRNA
caguuugucagcucugcugc

SEQ ID NO: 89964 - RNA, 20 nt, Artificial Sequence
  MKO10089964_B_Gpr128
  gRNA
uugcacagccgaguugcuuu

SEQ ID NO: 89965 - RNA, 20 nt, Artificial Sequence
  MKO10089965_B_Gpr128
  gRNA
guaucccuguacaguucugc

SEQ ID NO: 89966 - RNA, 20 nt, Artificial Sequence
  MKO10089966_B_Gpr128
  gRNA
uauucucagcacuugcuguu

SEQ ID NO: 89967 - RNA, 20 nt, Artificial Sequence
  MKO10089967_B_Gpr12
  gRNA
agaggcgacaaugaguccga

SEQ ID NO: 89968 - RNA, 20 nt, Artificial Sequence
  MKO10089968_B_Gpr12
  gRNA
agaaggcugcuacacaucgc

SEQ ID NO: 89969 - RNA, 20 nt, Artificial Sequence
  MKO10089969_B_Gpr12
  gRNA
ccgagcucguugucaacccc

SEQ ID NO: 89970 - RNA, 20 nt, Artificial Sequence
  MKO10089970_B_Gpr132
  gRNA
ucagaaccuaccaaugcagc

SEQ ID NO: 89971 - RNA, 20 nt, Artificial Sequence
  MKO10089971_B_Gpr132
  gRNA
uggacacuucuugccgagag

SEQ ID NO: 89972 - RNA, 20 nt, Artificial Sequence
  MKO10089972_B_Gpr132
  gRNA
uguucuucugcgcagcgcuc

SEQ ID NO: 89973 - RNA, 20 nt, Artificial Sequence
  MKO10089973_B_Gpr133
  gRNA
accuacagucgcagacaagu

SEQ ID NO: 89974 - RNA, 20 nt, Artificial Sequence
  MKO10089974_B_Gpr133
  gRNA
ccucccuuagauaucaugga

SEQ ID NO: 89975 - RNA, 20 nt, Artificial Sequence
  MKO10089975_B_Gpr133
  gRNA
ggaugggauccuugagcuuc

SEQ ID NO: 89976 - RNA, 20 nt, Artificial Sequence
  MKO10089976_B_Gpr135
  gRNA
cgucgccuacagcgugggac

SEQ ID NO: 89977 - RNA, 20 nt, Artificial Sequence
  MKO10089977_B_Gpr135
  gRNA
ggccgcgagugcaaccuugc

SEQ ID NO: 89978 - RNA, 20 nt, Artificial Sequence
  MKO10089978_B_Gpr135
  gRNA
agucgcaaucgccuucgaaa

SEQ ID NO: 89979 - RNA, 20 nt, Artificial Sequence
  MKO10089979_B_Gpr137b
  gRNA
ucaucuugcucuacaccucu

SEQ ID NO: 89980 - RNA, 20 nt, Artificial Sequence
  MKO10089980_B_Gpr137b
  gRNA
caacaucuacuuggagucaa

SEQ ID NO: 89981 - RNA, 20 nt, Artificial Sequence
  MKO10089981_B_Gpr137b
  gRNA
agagguguagagcaagauga

SEQ ID NO: 89982 - RNA, 20 nt, Artificial Sequence
  MKO10089982_B_Gpr137c
  gRNA
aauaguaccacugaccaugc

SEQ ID NO: 89983 - RNA, 20 nt, Artificial Sequence
  MKO10089983_B_Gpr137c
  gRNA
cugggauaaucuuucagaua

SEQ ID NO: 89984 - RNA, 20 nt, Artificial Sequence
  MKO10089984_B_Gpr137c
  gRNA
ggaggagacuacauugucuu

SEQ ID NO: 89985 - RNA, 20 nt, Artificial Sequence
  MKO10089985_B_Gpr137
  gRNA
agcaccagucgaauccucaa

SEQ ID NO: 89986 - RNA, 20 nt, Artificial Sequence
  MKO10089986_B_Gpr137
  gRNA
ugggcuucuuccggguacac

SEQ ID NO: 89987 - RNA, 20 nt, Artificial Sequence
  MKO10089987_B_Gpr137
  gRNA
ggcaguugguauggugccau

SEQ ID NO: 89988 - RNA, 20 nt, Artificial Sequence
  MKO10089988_B_Gpr139
  gRNA
cagcaagcgcuuccguacca

SEQ ID NO: 89989 - RNA, 20 nt, Artificial Sequence
  MKO10089989_B_Gpr139
  gRNA
ccaccucgcugcgaauagcu

SEQ ID NO: 89990 - RNA, 20 nt, Artificial Sequence
  MKO10089990_B_Gpr139
  gRNA
ccguaauccaaauagaagug

SEQ ID NO: 89991 - RNA, 20 nt, Artificial Sequence
  MKO10089991_B_Gpr141
  gRNA
agcaaaagauugucgacaug

SEQ ID NO: 89992 - RNA, 20 nt, Artificial Sequence
  MKO10089992_B_Gpr141
  gRNA
ugccaguauagggucacaag

SEQ ID NO: 89993 - RNA, 20 nt, Artificial Sequence
  MKO10089993_B_Gpr141
  gRNA
ugaaguaaaucgauguuaag

SEQ ID NO: 89994 - RNA, 20 nt, Artificial Sequence
  MKO10089994_B_Gpr142
  gRNA
uaacccaagauacgauggug

SEQ ID NO: 89995 - RNA, 20 nt, Artificial Sequence
  MKO10089995_B_Gpr142
  gRNA
accaacaugcugaucuucua

SEQ ID NO: 89996 - RNA, 20 nt, Artificial Sequence
  MKO10089996_B_Gpr142
  gRNA
ggcgucacagauguagcugu

SEQ ID NO: 89997 - RNA, 20 nt, Artificial Sequence
  MKO10089997_B_Gpr143
  gRNA
aaugucuguugcauucacau

SEQ ID NO: 89998 - RNA, 20 nt, Artificial Sequence
  MKO10089998_B_Gpr143
  gRNA
cuaugcaguugauguauacu

SEQ ID NO: 89999 - RNA, 20 nt, Artificial Sequence
  MKO10089999_B_Gpr143
  gRNA
aagucacugucuugugaaac

SEQ ID NO: 90000 - RNA, 20 nt, Artificial Sequence
  MKO10090000_B_Gpr146
  gRNA
cgauucucgagaugagugcc

SEQ ID NO: 90001 - RNA, 20 nt, Artificial Sequence
  MKO10090001_B_Gpr146
  gRNA
gguccucucgcugcucuacc

SEQ ID NO: 90002 - RNA, 20 nt, Artificial Sequence
  MKO10090002_B_Gpr146
  gRNA
acugcucauccuguucaacg

SEQ ID NO: 90003 - RNA, 20 nt, Artificial Sequence
  MKO10090003_B_Gpr149
  gRNA
acccggggcaaacaccacgu

SEQ ID NO: 90004 - RNA, 20 nt, Artificial Sequence
  MKO10090004_B_Gpr149
  gRNA
accuacuccguugccuucga

SEQ ID NO: 90005 - RNA, 20 nt, Artificial Sequence
  MKO10090005_B_Gpr149
  gRNA
aaucagcaccacgccaccgc

SEQ ID NO: 90006 - RNA, 20 nt, Artificial Sequence
  MKO10090006_B_Gpr150
  gRNA
aaguccaucuugcgacgcuu

SEQ ID NO: 90007 - RNA, 20 nt, Artificial Sequence
  MKO10090007_B_Gpr150
  gRNA
agugguguugccagcuaccg

SEQ ID NO: 90008 - RNA, 20 nt, Artificial Sequence
  MKO10090008_B_Gpr150
  gRNA
gcccuacuucgccgcucgcu

SEQ ID NO: 90009 - RNA, 20 nt, Artificial Sequence
  MKO10090009_B_Gpr151
  gRNA
ugcauacgcgaagcaugcuu

SEQ ID NO: 90010 - RNA, 20 nt, Artificial Sequence
  MKO10090010_B_Gpr151
  gRNA
agcaccaccagacgucacgc

SEQ ID NO: 90011 - RNA, 20 nt, Artificial Sequence
  MKO10090011_B_Gpr151
  gRNA
cagcauacuccaagggcguu

SEQ ID NO: 90012 - RNA, 20 nt, Artificial Sequence
  MKO10090012_B_Gpr152
  gRNA
ugggucaggggguccacuug

SEQ ID NO: 90013 - RNA, 20 nt, Artificial Sequence
  MKO10090013_B_Gpr152
  gRNA
aggagagcacaguucgcagc

SEQ ID NO: 90014 - RNA, 20 nt, Artificial Sequence
  MKO10090014_B_Gpr152
  gRNA
gacgagucagccucuaaccc

SEQ ID NO: 90015 - RNA, 20 nt, Artificial Sequence
  MKO10090015_B_Gpr153
  gRNA
ucguuaccgggcggaucuca

SEQ ID NO: 90016 - RNA, 20 nt, Artificial Sequence
  MKO10090016_B_Gpr153
  gRNA
cgcuucaucguggccgagau

SEQ ID NO: 90017 - RNA, 20 nt, Artificial Sequence
  MKO10090017_B_Gpr153
  gRNA
agagcgcuccaauaccaugu

SEQ ID NO: 90018 - RNA, 20 nt, Artificial Sequence
  MKO10090018_B_Gpr155
  gRNA
acagaacccgauaguauuua

SEQ ID NO: 90019 - RNA, 20 nt, Artificial Sequence
  MKO10090019_B_Gpr155
  gRNA
aaguucgcugugagcauaug

SEQ ID NO: 90020 - RNA, 20 nt, Artificial Sequence
  MKO10090020_B_Gpr155
  gRNA
guugcaaagauagccacucc

SEQ ID NO: 90021 - RNA, 20 nt, Artificial Sequence
  MKO10090021_B_Gpr156
  gRNA
caacuuaccacucucuuguc

SEQ ID NO: 90022 - RNA, 20 nt, Artificial Sequence
  MKO10090022_B_Gpr156
  gRNA
cacauaauccccaagagggc

SEQ ID NO: 90023 - RNA, 20 nt, Artificial Sequence
  MKO10090023_B_Gpr156
  gRNA
uucaguagaagcucucauuc

SEQ ID NO: 90024 - RNA, 20 nt, Artificial Sequence
  MKO10090024_B_Gpr157
  gRNA
aguaccggcccaucugcgag

SEQ ID NO: 90025 - RNA, 20 nt, Artificial Sequence
  MKO10090025_B_Gpr157
  gRNA
ccggggaaccacagagcguc

SEQ ID NO: 90026 - RNA, 20 nt, Artificial Sequence
  MKO10090026_B_Gpr157
  gRNA
gcuccuacgccccccaagau

SEQ ID NO: 90027 - RNA, 20 nt, Artificial Sequence
  MKO10090027_B_Gpr158
  gRNA
acgaaucccaggccuuugau

SEQ ID NO: 90028 - RNA, 20 nt, Artificial Sequence
  MKO10090028_B_Gpr158
  gRNA
cuguaguguaugccaaucaa

SEQ ID NO: 90029 - RNA, 20 nt, Artificial Sequence
  MKO10090029_B_Gpr158
  gRNA
uuaccuuugcuuugcgaaaa

SEQ ID NO: 90030 - RNA, 20 nt, Artificial Sequence
  MKO10090030_B_Gpr15
  gRNA
uaaagaugucgaucaaucuu

SEQ ID NO: 90031 - RNA, 20 nt, Artificial Sequence
  MKO10090031_B_Gpr15
  gRNA
cgcaauaauaacgaucuuua

SEQ ID NO: 90032 - RNA, 20 nt, Artificial Sequence
  MKO10090032_B_Gpr15
  gRNA
ucuuugacagcuauauccgc

SEQ ID NO: 90033 - RNA, 20 nt, Artificial Sequence
  MKO10090033_B_Gpr160
  gRNA
gagggcggccuugcucuuau

SEQ ID NO: 90034 - RNA, 20 nt, Artificial Sequence
  MKO10090034_B_Gpr160
  gRNA
accaauaaacugcagcgaug

SEQ ID NO: 90035 - RNA, 20 nt, Artificial Sequence
  MKO10090035_B_Gpr160
  gRNA
uccucaucgcugcaguuuau

SEQ ID NO: 90036 - RNA, 20 nt, Artificial Sequence
  MKO10090036_B_Gpr161
  gRNA
caucacuguccucgucugcc

SEQ ID NO: 90037 - RNA, 20 nt, Artificial Sequence
  MKO10090037_B_Gpr161
  gRNA
gccaugagcgccgugagaug

SEQ ID NO: 90038 - RNA, 20 nt, Artificial Sequence
  MKO10090038_B_Gpr161
  gRNA
cauggcaggcggacaguccc

SEQ ID NO: 90039 - RNA, 20 nt, Artificial Sequence
  MKO10090039_B_Gpr162
  gRNA
cccguuguugugccagccga

SEQ ID NO: 90040 - RNA, 20 nt, Artificial Sequence
  MKO10090040_B_Gpr162
  gRNA
ggggagcgcuacuaugcccg

SEQ ID NO: 90041 - RNA, 20 nt, Artificial Sequence
  MKO10090041_B_Gpr162
  gRNA
gcacaugcucuucccaccgc

SEQ ID NO: 90042 - RNA, 20 nt, Artificial Sequence
  MKO10090042_B_Gpr165
  gRNA
cauauacuucuaaauccacg

SEQ ID NO: 90043 - RNA, 20 nt, Artificial Sequence
  MKO10090043_B_Gpr165
  gRNA
gcgcuaucuguguaauuccu

SEQ ID NO: 90044 - RNA, 20 nt, Artificial Sequence
  MKO10090044_B_Gpr165
  gRNA
aguacugggcaaagcgacug

SEQ ID NO: 90045 - RNA, 20 nt, Artificial Sequence
  MKO10090045_B_Gpr171
  gRNA
gucaaaagccuuucgacuaa

SEQ ID NO: 90046 - RNA, 20 nt, Artificial Sequence
  MKO10090046_B_Gpr171
  gRNA
aaacaguucaacguucuguc

SEQ ID NO: 90047 - RNA, 20 nt, Artificial Sequence
  MKO10090047_B_Gpr171
  gRNA
auauaccgaauacaagaacc

SEQ ID NO: 90048 - RNA, 20 nt, Artificial Sequence
  MKO10090048_B_Gpr173
  gRNA
guguaaucgcguagaacauu

SEQ ID NO: 90049 - RNA, 20 nt, Artificial Sequence
  MKO10090049_B_Gpr173
  gRNA
cauacauuguggccugcuac

SEQ ID NO: 90050 - RNA, 20 nt, Artificial Sequence
  MKO10090050_B_Gpr173
  gRNA
cagugcgccgcucaccucuu

SEQ ID NO: 90051 - RNA, 20 nt, Artificial Sequence
  MKO10090051_B_Gpr174
  gRNA
aacuagaaacaccccugcac

SEQ ID NO: 90052 - RNA, 20 nt, Artificial Sequence
  MKO10090052_B_Gpr174
  gRNA
uccuaucaggaauguuaauc

SEQ ID NO: 90053 - RNA, 20 nt, Artificial Sequence
  MKO10090053_B_Gpr174
  gRNA
agaaccaaugaugauacucc

SEQ ID NO: 90054 - RNA, 20 nt, Artificial Sequence
  MKO10090054_B_Gpr176
  gRNA
aucggcugagccgagauacu

SEQ ID NO: 90055 - RNA, 20 nt, Artificial Sequence
  MKO10090055_B_Gpr176
  gRNA
uaccuguccagggcaauagc

SEQ ID NO: 90056 - RNA, 20 nt, Artificial Sequence
  MKO10090056_B_Gpr176
  gRNA
cuauacgaugcucuucugca

SEQ ID NO: 90057 - RNA, 20 nt, Artificial Sequence
  MKO10090057_B_Gpr179
  gRNA
acugguugauguccacacuu

SEQ ID NO: 90058 - RNA, 20 nt, Artificial Sequence
  MKO10090058_B_Gpr179
  gRNA
uaucucugccgcugccgacc

SEQ ID NO: 90059 - RNA, 20 nt, Artificial Sequence
  MKO10090059_B_Gpr179
  gRNA
gacaucaaccagugugcaag

SEQ ID NO: 90060 - RNA, 20 nt, Artificial Sequence
  MKO10090060_B_Gpr17
  gRNA
gaaccggucagcgcugaugc

SEQ ID NO: 90061 - RNA, 20 nt, Artificial Sequence
  MKO10090061_B_Gpr17
  gRNA
augcggacaagagacccccc

SEQ ID NO: 90062 - RNA, 20 nt, Artificial Sequence
  MKO10090062_B_Gpr17
  gRNA
cggcaugggaucuccccaaa

SEQ ID NO: 90063 - RNA, 20 nt, Artificial Sequence
  MKO10090063_B_Gpr180
  gRNA
acgcagucacaaaguacacu

SEQ ID NO: 90064 - RNA, 20 nt, Artificial Sequence
  MKO10090064_B_Gpr180
  gRNA
cuagcccgagcucagcugac

SEQ ID NO: 90065 - RNA, 20 nt, Artificial Sequence
  MKO10090065_B_Gpr180
  gRNA
gcaucuaugcgcagucucug

SEQ ID NO: 90066 - RNA, 20 nt, Artificial Sequence
  MKO10090066_B_Gpr182
  gRNA
agcgccaccagcaccgaaua

SEQ ID NO: 90067 - RNA, 20 nt, Artificial Sequence
  MKO10090067_B_Gpr182
  gRNA
uacuaagccuaccacgaaga

SEQ ID NO: 90068 - RNA, 20 nt, Artificial Sequence
  MKO10090068_B_Gpr182
  gRNA
ugugucaacugccgccguuc

SEQ ID NO: 90069 - RNA, 20 nt, Artificial Sequence
  MKO10090069_B_Gpr183
  gRNA
uugccaugagacguugccag

SEQ ID NO: 90070 - RNA, 20 nt, Artificial Sequence
  MKO10090070_B_Gpr183
  gRNA
uaaaagaaucgaauacgcaa

SEQ ID NO: 90071 - RNA, 20 nt, Artificial Sequence
  MKO10090071_B_Gpr183
  gRNA
uucuacaucaacacguacgc

SEQ ID NO: 90072 - RNA, 20 nt, Artificial Sequence
  MKO10090072_B_Gpr18
  gRNA
guuuggaaacgauguaguag

SEQ ID NO: 90073 - RNA, 20 nt, Artificial Sequence
  MKO10090073_B_Gpr18
  gRNA
uuugccguccugaugcuaca

SEQ ID NO: 90074 - RNA, 20 nt, Artificial Sequence
  MKO10090074_B_Gpr18
  gRNA
aucauucacagucuccuccg

SEQ ID NO: 90075 - RNA, 20 nt, Artificial Sequence
  MKO10090075_B_Gpr19
  gRNA
gcugcgguagcauuucaucg

SEQ ID NO: 90076 - RNA, 20 nt, Artificial Sequence
  MKO10090076_B_Gpr19
  gRNA
gaagcucagcggguagacga

SEQ ID NO: 90077 - RNA, 20 nt, Artificial Sequence
  MKO10090077_B_Gpr19
  gRNA
uuaugguccugcucacggga

SEQ ID NO: 90078 - RNA, 20 nt, Artificial Sequence
  MKO10090078_B_Gpr1
  gRNA
agauccagugaacgaguccc

SEQ ID NO: 90079 - RNA, 20 nt, Artificial Sequence
  MKO10090079_B_Gpr1
  gRNA
cauguucaguugggcaauga

SEQ ID NO: 90080 - RNA, 20 nt, Artificial Sequence
  MKO10090080_B_Gpr1
  gRNA
cccggaggagaagguguacc

SEQ ID NO: 90081 - RNA, 20 nt, Artificial Sequence
  MKO10090081_B_Gpr20
  gRNA
ucacgcgccgcugacggccc

SEQ ID NO: 90082 - RNA, 20 nt, Artificial Sequence
  MKO10090082_B_Gpr20
  gRNA
ugucuuugcucugaccguuc

SEQ ID NO: 90083 - RNA, 20 nt, Artificial Sequence
  MKO10090083_B_Gpr20
  gRNA
ucgacagcgcacacaugauc

SEQ ID NO: 90084 - RNA, 20 nt, Artificial Sequence
  MKO10090084_B_Gpr21
  gRNA
agcacgagaugaacuccacc

SEQ ID NO: 90085 - RNA, 20 nt, Artificial Sequence
  MKO10090085_B_Gpr21
  gRNA
accauggcauagcgcuuauc

SEQ ID NO: 90086 - RNA, 20 nt, Artificial Sequence
  MKO10090086_B_Gpr21
  gRNA
ggcagcuuaccccaaccaag

SEQ ID NO: 90087 - RNA, 20 nt, Artificial Sequence
  MKO10090087_B_Gpr22
  gRNA
ugacaucauguaucaauuug

SEQ ID NO: 90088 - RNA, 20 nt, Artificial Sequence
  MKO10090088_B_Gpr22
  gRNA
uggcagcaaccuuaccgucc

SEQ ID NO: 90089 - RNA, 20 nt, Artificial Sequence
  MKO10090089_B_Gpr22
  gRNA
ucugccguucucgucguucc

SEQ ID NO: 90090 - RNA, 20 nt, Artificial Sequence
  MKO10090090_B_Gpr25
  gRNA
acacgcgccaguagcagauc

SEQ ID NO: 90091 - RNA, 20 nt, Artificial Sequence
  MKO10090091_B_Gpr25
  gRNA
ccaugcaguccaccgaaccc

SEQ ID NO: 90092 - RNA, 20 nt, Artificial Sequence
  MKO10090092_B_Gpr25
  gRNA
guuccggggccgguccccga

SEQ ID NO: 90093 - RNA, 20 nt, Artificial Sequence
  MKO10090093_B_Gpr26
  gRNA
gggcgcgcaccaugaacucg

SEQ ID NO: 90094 - RNA, 20 nt, Artificial Sequence
  MKO10090094_B_Gpr26
  gRNA
cacaaggaaggucccuauga

SEQ ID NO: 90095 - RNA, 20 nt, Artificial Sequence
  MKO10090095_B_Gpr26
  gRNA
uugcacccuaugugauuacc

SEQ ID NO: 90096 - RNA, 20 nt, Artificial Sequence
  MKO10090096_B_Gpr27
  gRNA
gccgaagcccgccguccagu

SEQ ID NO: 90097 - RNA, 20 nt, Artificial Sequence
  MKO10090097_B_Gpr27
  gRNA
cgcgaaugucagccacaccg

SEQ ID NO: 90098 - RNA, 20 nt, Artificial Sequence
  MKO10090098_B_Gpr27
  gRNA
uguucgcgcugcucaucgug

SEQ ID NO: 90099 - RNA, 20 nt, Artificial Sequence
  MKO10090099_B_Gpr31b
  gRNA
gaguuaacuugcugucucug

SEQ ID NO: 90100 - RNA, 20 nt, Artificial Sequence
  MKO10090100_B_Gpr31b
  gRNA
ugggcuguuugucagacucu

SEQ ID NO: 90101 - RNA, 20 nt, Artificial Sequence
  MKO10090101_B_Gpr31b
  gRNA
ggggcaucuccagccucauc

SEQ ID NO: 90102 - RNA, 20 nt, Artificial Sequence
  MKO10090102_B_Gpr33
  gRNA
accagugcuguuuguuaacg

SEQ ID NO: 90103 - RNA, 20 nt, Artificial Sequence
  MKO10090103_B_Gpr33
  gRNA
accucguuaacaaacagcac

SEQ ID NO: 90104 - RNA, 20 nt, Artificial Sequence
  MKO10090104_B_Gpr33
  gRNA
agcagcaccgaaccccacac

SEQ ID NO: 90105 - RNA, 20 nt, Artificial Sequence
  MKO10090105_B_Gpr34
  gRNA
uguuuccaaccagucccacg

SEQ ID NO: 90106 - RNA, 20 nt, Artificial Sequence
  MKO10090106_B_Gpr34
  gRNA
caaaacuaacgagaucaugc

SEQ ID NO: 90107 - RNA, 20 nt, Artificial Sequence
  MKO10090107_B_Gpr34
  gRNA
cuacuacuucaguugacagc

SEQ ID NO: 90108 - RNA, 20 nt, Artificial Sequence
  MKO10090108_B_Gpr35
  gRNA
gguguguuggaagacguggc

SEQ ID NO: 90109 - RNA, 20 nt, Artificial Sequence
  MKO10090109_B_Gpr35
  gRNA
ucugcuaucgcaugcaccag

SEQ ID NO: 90110 - RNA, 20 nt, Artificial Sequence
  MKO10090110_B_Gpr35
  gRNA
cccugcgugcgcgugagcug

SEQ ID NO: 90111 - RNA, 20 nt, Artificial Sequence
  MKO10090111_B_Gpr37l1
  gRNA
aauugauugacaucgcucaa

SEQ ID NO: 90112 - RNA, 20 nt, Artificial Sequence
  MKO10090112_B_Gpr37l1
  gRNA
caugauggcguaggcgcugu

SEQ ID NO: 90113 - RNA, 20 nt, Artificial Sequence
  MKO10090113_B_Gpr37l1
  gRNA
caccagcgaauagacagauu

SEQ ID NO: 90114 - RNA, 20 nt, Artificial Sequence
  MKO10090114_B_Gpr37
  gRNA
cgcccuucaguacuauccgc

SEQ ID NO: 90115 - RNA, 20 nt, Artificial Sequence
  MKO10090115_B_Gpr37
  gRNA
cuucaaucucacgcgccgcg

SEQ ID NO: 90116 - RNA, 20 nt, Artificial Sequence
  MKO10090116_B_Gpr37
  gRNA
gaccaaggggguccacgccg

SEQ ID NO: 90117 - RNA, 20 nt, Artificial Sequence
  MKO10090117_B_Gpr39
  gRNA
gggcacgcuggcguuucucu

SEQ ID NO: 90118 - RNA, 20 nt, Artificial Sequence
  MKO10090118_B_Gpr39
  gRNA
guaugcccugaaguacguuc

SEQ ID NO: 90119 - RNA, 20 nt, Artificial Sequence
  MKO10090119_B_Gpr39
  gRNA
caauaccugcguaacccuga

SEQ ID NO: 90120 - RNA, 20 nt, Artificial Sequence
  MKO10090120_B_Gpr3
  gRNA
gguguccugcgagaacgcgc

SEQ ID NO: 90121 - RNA, 20 nt, Artificial Sequence
  MKO10090121_B_Gpr3
  gRNA
ccgggaccggaauggaaucu

SEQ ID NO: 90122 - RNA, 20 nt, Artificial Sequence
  MKO10090122_B_Gpr3
  gRNA
agaagucagccgcaaagugc

SEQ ID NO: 90123 - RNA, 20 nt, Artificial Sequence
  MKO10090123_B_Gpr44
  gRNA
gacaggccgcuuugugcgcc

SEQ ID NO: 90124 - RNA, 20 nt, Artificial Sequence
  MKO10090124_B_Gpr44
  gRNA
ccgcuacaucgaccacgugu

SEQ ID NO: 90125 - RNA, 20 nt, Artificial Sequence
  MKO10090125_B_Gpr44
  gRNA
uacguggcucgaggcaauua

SEQ ID NO: 90126 - RNA, 20 nt, Artificial Sequence
  MKO10090126_B_Gpr45
  gRNA
aggcgcuguaauagaaccgc

SEQ ID NO: 90127 - RNA, 20 nt, Artificial Sequence
  MKO10090127_B_Gpr45
  gRNA
ggagcacaacaugacgccga

SEQ ID NO: 90128 - RNA, 20 nt, Artificial Sequence
  MKO10090128_B_Gpr45
  gRNA
aggauuccuuggcaacacgg

SEQ ID NO: 90129 - RNA, 20 nt, Artificial Sequence
  MKO10090129_B_Gpr4
  gRNA
gucucgcagcgccgucuacc

SEQ ID NO: 90130 - RNA, 20 nt, Artificial Sequence
  MKO10090130_B_Gpr4
  gRNA
cucauguugcugugcuaccg

SEQ ID NO: 90131 - RNA, 20 nt, Artificial Sequence
  MKO10090131_B_Gpr4
  gRNA
cgcaggcgugcaaagcgcag

SEQ ID NO: 90132 - RNA, 20 nt, Artificial Sequence
  MKO10090132_B_Gpr50
  gRNA
agaacauuccggacguuccu

SEQ ID NO: 90133 - RNA, 20 nt, Artificial Sequence
  MKO10090133_B_Gpr50
  gRNA
gucacaggacugagcguagu

SEQ ID NO: 90134 - RNA, 20 nt, Artificial Sequence
  MKO10090134_B_Gpr50
  gRNA
ggauagggugccgcauagca

SEQ ID NO: 90135 - RNA, 20 nt, Artificial Sequence
  MKO10090135_B_Gpr52
  gRNA
gccucuauccuacaaucaac

SEQ ID NO: 90136 - RNA, 20 nt, Artificial Sequence
  MKO10090136_B_Gpr52
  gRNA
auuugcccgucuccuagguu

SEQ ID NO: 90137 - RNA, 20 nt, Artificial Sequence
  MKO10090137_B_Gpr52
  gRNA
acuauugcuuaucgcaagcc

SEQ ID NO: 90138 - RNA, 20 nt, Artificial Sequence
  MKO10090138_B_Gpr55
  gRNA
cuagccaucuccggucgccc

SEQ ID NO: 90139 - RNA, 20 nt, Artificial Sequence
  MKO10090139_B_Gpr55
  gRNA
ucuuccugggcgaccggaga

SEQ ID NO: 90140 - RNA, 20 nt, Artificial Sequence
  MKO10090140_B_Gpr55
  gRNA
ccggcccuccacaaucaagc

SEQ ID NO: 90141 - RNA, 20 nt, Artificial Sequence
  MKO10090141_B_Gpr56
  gRNA
gggagacuccacuugcgcua

SEQ ID NO: 90142 - RNA, 20 nt, Artificial Sequence
  MKO10090142_B_Gpr56
  gRNA
gccacccacagccggucuag

SEQ ID NO: 90143 - RNA, 20 nt, Artificial Sequence
  MKO10090143_B_Gpr56
  gRNA
uuacuggcugaugaacgcug

SEQ ID NO: 90144 - RNA, 20 nt, Artificial Sequence
  MKO10090144_B_Gpr61
  gRNA
cuacugcagcauguuucgag

SEQ ID NO: 90145 - RNA, 20 nt, Artificial Sequence
  MKO10090145_B_Gpr61
  gRNA
acuguuugcuaagcucgccc

SEQ ID NO: 90146 - RNA, 20 nt, Artificial Sequence
  MKO10090146_B_Gpr61
  gRNA
guuguugacuuucgaauccc

SEQ ID NO: 90147 - RNA, 20 nt, Artificial Sequence
  MKO10090147_B_Gpr62
  gRNA
cuuagcgcacuugugcgucg

SEQ ID NO: 90148 - RNA, 20 nt, Artificial Sequence
  MKO10090148_B_Gpr62
  gRNA
gugagccgcgaaggcggagu

SEQ ID NO: 90149 - RNA, 20 nt, Artificial Sequence
  MKO10090149_B_Gpr62
  gRNA
gccucauagugcauccgcug

SEQ ID NO: 90150 - RNA, 20 nt, Artificial Sequence
  MKO10090150_B_Gpr63
  gRNA
uccucaaggcauuaugccga

SEQ ID NO: 90151 - RNA, 20 nt, Artificial Sequence
  MKO10090151_B_Gpr63
  gRNA
auccgucgccuugugugacc

SEQ ID NO: 90152 - RNA, 20 nt, Artificial Sequence
  MKO10090152_B_Gpr63
  gRNA
gcggagccguaauauucacg

SEQ ID NO: 90153 - RNA, 20 nt, Artificial Sequence
  MKO10090153_B_Gpr64
  gRNA
uugucgacuuuaaacaaaac

SEQ ID NO: 90154 - RNA, 20 nt, Artificial Sequence
  MKO10090154_B_Gpr64
  gRNA
acaaauugcagauauuucuc

SEQ ID NO: 90155 - RNA, 20 nt, Artificial Sequence
  MKO10090155_B_Gpr64
  gRNA
ucaucucuuugcaaugacuc

SEQ ID NO: 90156 - RNA, 20 nt, Artificial Sequence
  MKO10090156_B_Gpr65
  gRNA
uacgcauaaagauccgaugu

SEQ ID NO: 90157 - RNA, 20 nt, Artificial Sequence
  MKO10090157_B_Gpr65
  gRNA
agcccaugcacguccgaaac

SEQ ID NO: 90158 - RNA, 20 nt, Artificial Sequence
  MKO10090158_B_Gpr65
  gRNA
caacacaguuuagacucguc

SEQ ID NO: 90159 - RNA, 20 nt, Artificial Sequence
  MKO10090159_B_Gpr68
  gRNA
acgugcuucagcacgacgac

SEQ ID NO: 90160 - RNA, 20 nt, Artificial Sequence
  MKO10090160_B_Gpr68
  gRNA
ccaccaguuccgcacccuga

SEQ ID NO: 90161 - RNA, 20 nt, Artificial Sequence
  MKO10090161_B_Gpr68
  gRNA
ugagaacauuuacaucagcg

SEQ ID NO: 90162 - RNA, 20 nt, Artificial Sequence
  MKO10090162_B_Gpr6
  gRNA
cgcgcucaacgagucccaag

SEQ ID NO: 90163 - RNA, 20 nt, Artificial Sequence
  MKO10090163_B_Gpr6
  gRNA
cuuguacgugcgcaucugcc

SEQ ID NO: 90164 - RNA, 20 nt, Artificial Sequence
  MKO10090164_B_Gpr6
  gRNA
cacuugggacucguugagcg

SEQ ID NO: 90165 - RNA, 20 nt, Artificial Sequence
  MKO10090165_B_Gpr75
  gRNA
gcgagucccaaaguuucugc

SEQ ID NO: 90166 - RNA, 20 nt, Artificial Sequence
  MKO10090166_B_Gpr75
  gRNA
uugccggaccgcucuccugc

SEQ ID NO: 90167 - RNA, 20 nt, Artificial Sequence
  MKO10090167_B_Gpr75
  gRNA
cucagccagucgacuccagc

SEQ ID NO: 90168 - RNA, 20 nt, Artificial Sequence
  MKO10090168_B_Gpr81
  gRNA
uggagauaucgccugucgcc

SEQ ID NO: 90169 - RNA, 20 nt, Artificial Sequence
  MKO10090169_B_Gpr81
  gRNA
caugacaucgugccacccgu

SEQ ID NO: 90170 - RNA, 20 nt, Artificial Sequence
  MKO10090170_B_Gpr81
  gRNA
gagggccacccgguucauca

SEQ ID NO: 90171 - RNA, 20 nt, Artificial Sequence
  MKO10090171_B_Gpr82
  gRNA
aaacauucucucguagcaug

SEQ ID NO: 90172 - RNA, 20 nt, Artificial Sequence
  MKO10090172_B_Gpr82
  gRNA
augagacccgcaaucugaga

SEQ ID NO: 90173 - RNA, 20 nt, Artificial Sequence
  MKO10090173_B_Gpr82
  gRNA
agguccuuacucuucgcaga

SEQ ID NO: 90174 - RNA, 20 nt, Artificial Sequence
  MKO10090174_B_Gpr83
  gRNA
uggucuucuucuugcgucgc

SEQ ID NO: 90175 - RNA, 20 nt, Artificial Sequence
  MKO10090175_B_Gpr83
  gRNA
ugguggccgagugcaugcgc

SEQ ID NO: 90176 - RNA, 20 nt, Artificial Sequence
  MKO10090176_B_Gpr83
  gRNA
ucauauauauugcugucauc

SEQ ID NO: 90177 - RNA, 20 nt, Artificial Sequence
  MKO10090177_B_Gpr84
  gRNA
aacucuguggcccgcguuuc

SEQ ID NO: 90178 - RNA, 20 nt, Artificial Sequence
  MKO10090178_B_Gpr84
  gRNA
uggccugaugcagcccguau

SEQ ID NO: 90179 - RNA, 20 nt, Artificial Sequence
  MKO10090179_B_Gpr84
  gRNA
ugcagcuuugaccgcaugcg

SEQ ID NO: 90180 - RNA, 20 nt, Artificial Sequence
  MKO10090180_B_Gpr85
  gRNA
gcagcugccaauuggcuagc

SEQ ID NO: 90181 - RNA, 20 nt, Artificial Sequence
  MKO10090181_B_Gpr85
  gRNA
gcggcuguuagaaauccccc

SEQ ID NO: 90182 - RNA, 20 nt, Artificial Sequence
  MKO10090182_B_Gpr85
  gRNA
cagaaggcggcuauuggucu

SEQ ID NO: 90183 - RNA, 20 nt, Artificial Sequence
  MKO10090183_B_Gpr87
  gRNA
gucugcgugcaacgugugcc

SEQ ID NO: 90184 - RNA, 20 nt, Artificial Sequence
  MKO10090184_B_Gpr87
  gRNA
caugaaacucaaaaguccgc

SEQ ID NO: 90185 - RNA, 20 nt, Artificial Sequence
  MKO10090185_B_Gpr87
  gRNA
uuggcuuaugaauugccugc

SEQ ID NO: 90186 - RNA, 20 nt, Artificial Sequence
  MKO10090186_B_Gpr88
  gRNA
gcgugcgcgucagcgucaag

SEQ ID NO: 90187 - RNA, 20 nt, Artificial Sequence
  MKO10090187_B_Gpr88
  gRNA
agcaacgccuucaucgugaa

SEQ ID NO: 90188 - RNA, 20 nt, Artificial Sequence
  MKO10090188_B_Gpr88
  gRNA
cccggguacccaguugcgcc

SEQ ID NO: 90189 - RNA, 20 nt, Artificial Sequence
  MKO10090189_B_Gpr89
  gRNA
ccucauaguccuuaaacaac

SEQ ID NO: 90190 - RNA, 20 nt, Artificial Sequence
  MKO10090190_B_Gpr89
  gRNA
ugaccuuuauguacuucuuc

SEQ ID NO: 90191 - RNA, 20 nt, Artificial Sequence
  MKO10090191_B_Gpr89
  gRNA
cuuccagaagaaguacauaa

SEQ ID NO: 90192 - RNA, 20 nt, Artificial Sequence
  MKO10090192_B_Gpr97
  gRNA
ucacaggugguugacgcuca

SEQ ID NO: 90193 - RNA, 20 nt, Artificial Sequence
  MKO10090193_B_Gpr97
  gRNA
agacauccgugcugauguuc

SEQ ID NO: 90194 - RNA, 20 nt, Artificial Sequence
  MKO10090194_B_Gpr97
  gRNA
gaacuaugaguccuaccugc

SEQ ID NO: 90195 - RNA, 20 nt, Artificial Sequence
  MKO10090195_B_Gpr98
  gRNA
aaugacaagacgaauaacug

SEQ ID NO: 90196 - RNA, 20 nt, Artificial Sequence
  MKO10090196_B_Gpr98
  gRNA
ucaauagcccucaucaaucu

SEQ ID NO: 90197 - RNA, 20 nt, Artificial Sequence
  MKO10090197_B_Gpr98
  gRNA
uuauucgucuugucauugag

SEQ ID NO: 90198 - RNA, 20 nt, Artificial Sequence
  MKO10090198_B_Gprasp1
  gRNA
gucaauccggacaacugauc

SEQ ID NO: 90199 - RNA, 20 nt, Artificial Sequence
  MKO10090199_B_Gprasp1
  gRNA
guccguguugaauccacuuc

SEQ ID NO: 90200 - RNA, 20 nt, Artificial Sequence
  MKO10090200_B_Gprasp1
  gRNA
accgauaugaaguaugcagc

SEQ ID NO: 90201 - RNA, 20 nt, Artificial Sequence
  MKO10090201_B_Gprasp2
  gRNA
gcaaucugugacgcugaacc

SEQ ID NO: 90202 - RNA, 20 nt, Artificial Sequence
  MKO10090202_B_Gprasp2
  gRNA
ccgaaucgcgaaugaaaucc

SEQ ID NO: 90203 - RNA, 20 nt, Artificial Sequence
  MKO10090203_B_Gprasp2
  gRNA
ccaaaccagggcucgauucc

SEQ ID NO: 90204 - RNA, 20 nt, Artificial Sequence
  MKO10090204_B_Gprc5a
  gRNA
cgcccuucguagucauugua

SEQ ID NO: 90205 - RNA, 20 nt, Artificial Sequence
  MKO10090205_B_Gprc5a
  gRNA
cacuuaccuguagcugaaaa

SEQ ID NO: 90206 - RNA, 20 nt, Artificial Sequence
  MKO10090206_B_Gprc5a
  gRNA
cucuguuucaggucuugaga

SEQ ID NO: 90207 - RNA, 20 nt, Artificial Sequence
  MKO10090207_B_Gprc5b
  gRNA
agucccuccauugagcacga

SEQ ID NO: 90208 - RNA, 20 nt, Artificial Sequence
  MKO10090208_B_Gprc5b
  gRNA
uggugucuucccgugugaga

SEQ ID NO: 90209 - RNA, 20 nt, Artificial Sequence
  MKO10090209_B_Gprc5b
  gRNA
aacugcuccgccaucucaca

SEQ ID NO: 90210 - RNA, 20 nt, Artificial Sequence
  MKO10090210_B_Gprc5c
  gRNA
ucaccgggccuuugugcauc

SEQ ID NO: 90211 - RNA, 20 nt, Artificial Sequence
  MKO10090211_B_Gprc5c
  gRNA
cguguaccagcccaccgaga

SEQ ID NO: 90212 - RNA, 20 nt, Artificial Sequence
  MKO10090212_B_Gprc5c
  gRNA
cauacgacgucauccuccca

SEQ ID NO: 90213 - RNA, 20 nt, Artificial Sequence
  MKO10090213_B_Gprc5d
  gRNA
cuuucagcccgagacaguga

SEQ ID NO: 90214 - RNA, 20 nt, Artificial Sequence
  MKO10090214_B_Gprc5d
  gRNA
aguccugaaccuuccgcaug

SEQ ID NO: 90215 - RNA, 20 nt, Artificial Sequence
  MKO10090215_B_Gprc5d
  gRNA
gccccucguugucacagaag

SEQ ID NO: 90216 - RNA, 20 nt, Artificial Sequence
  MKO10090216_B_Gprc6a
  gRNA
uuuaaauacugguuaugacg

SEQ ID NO: 90217 - RNA, 20 nt, Artificial Sequence
  MKO10090217_B_Gprc6a
  gRNA
cuacucugaaacauccaucg

SEQ ID NO: 90218 - RNA, 20 nt, Artificial Sequence
  MKO10090218_B_Gprc6a
  gRNA
ugaugaagacgucacgcugc

SEQ ID NO: 90219 - RNA, 20 nt, Artificial Sequence
  MKO10090219_B_Gprin1
  gRNA
agccggugcgcgacgugagc

SEQ ID NO: 90220 - RNA, 20 nt, Artificial Sequence
  MKO10090220_B_Gprin1
  gRNA
ggcgcuccggcgucccacga

SEQ ID NO: 90221 - RNA, 20 nt, Artificial Sequence
  MKO10090221_B_Gprin1
  gRNA
aucgaggagcacggccgcca

SEQ ID NO: 90222 - RNA, 20 nt, Artificial Sequence
  MKO10090222_B_Gprin2
  gRNA
ucggugaucugugucgccua

SEQ ID NO: 90223 - RNA, 20 nt, Artificial Sequence
  MKO10090223_B_Gprin2
  gRNA
cuggcacucuugcgaagcuc

SEQ ID NO: 90224 - RNA, 20 nt, Artificial Sequence
  MKO10090224_B_Gprin2
  gRNA
ugacgaugccugucguaggc

SEQ ID NO: 90225 - RNA, 20 nt, Artificial Sequence
  MKO10090225_B_Gprin3
  gRNA
agguuccuuggugaaauccg

SEQ ID NO: 90226 - RNA, 20 nt, Artificial Sequence
  MKO10090226_B_Gprin3
  gRNA
ccuucagcugguugguucgc

SEQ ID NO: 90227 - RNA, 20 nt, Artificial Sequence
  MKO10090227_B_Gprin3
  gRNA
ugccaacaaagacuaccccc

SEQ ID NO: 90228 - RNA, 20 nt, Artificial Sequence
  MKO10090228_B_Gps1
  gRNA
uccaccacauaguugacauc

SEQ ID NO: 90229 - RNA, 20 nt, Artificial Sequence
  MKO10090229_B_Gps1
  gRNA
caguaugcagccagcuacag

SEQ ID NO: 90230 - RNA, 20 nt, Artificial Sequence
  MKO10090230_B_Gps1
  gRNA
caacagagccuucuuccgag

SEQ ID NO: 90231 - RNA, 20 nt, Artificial Sequence
  MKO10090231_B_Gps2
  gRNA
caaucgcccagguacucuga

SEQ ID NO: 90232 - RNA, 20 nt, Artificial Sequence
  MKO10090232_B_Gps2
  gRNA
ugcauaccagcagagccuga

SEQ ID NO: 90233 - RNA, 20 nt, Artificial Sequence
  MKO10090233_B_Gps2
  gRNA
aacggaggcgaaaggaacag

SEQ ID NO: 90234 - RNA, 20 nt, Artificial Sequence
  MKO10090234_B_Gpsm1
  gRNA
gaaggaacuaggcgaccggg

SEQ ID NO: 90235 - RNA, 20 nt, Artificial Sequence
  MKO10090235_B_Gpsm1
  gRNA
agacgauugccucaucgaau

SEQ ID NO: 90236 - RNA, 20 nt, Artificial Sequence
  MKO10090236_B_Gpsm1
  gRNA
auguccgcgagacacugcac

SEQ ID NO: 90237 - RNA, 20 nt, Artificial Sequence
  MKO10090237_B_Gpsm2
  gRNA
gcuaaagccagcggcaaucu

SEQ ID NO: 90238 - RNA, 20 nt, Artificial Sequence
  MKO10090238_B_Gpsm2
  gRNA
accgugcaagaguuaaguca

SEQ ID NO: 90239 - RNA, 20 nt, Artificial Sequence
  MKO10090239_B_Gpsm2
  gRNA
aguguguugccagcgacacc

SEQ ID NO: 90240 - RNA, 20 nt, Artificial Sequence
  MKO10090240_B_Gpsm3
  gRNA
gccagcggauugaagcccaa

SEQ ID NO: 90241 - RNA, 20 nt, Artificial Sequence
  MKO10090241_B_Gpsm3
  gRNA
uugguaucagagucucccgc

SEQ ID NO: 90242 - RNA, 20 nt, Artificial Sequence
  MKO10090242_B_Gpsm3
  gRNA
ccccugugaaugccaccgcu

SEQ ID NO: 90243 - RNA, 20 nt, Artificial Sequence
  MKO10090243_B_Gpt2
  gRNA
gucgagcucagagaugaccg

SEQ ID NO: 90244 - RNA, 20 nt, Artificial Sequence
  MKO10090244_B_Gpt2
  gRNA
gcucguuucuuagcgucuuc

SEQ ID NO: 90245 - RNA, 20 nt, Artificial Sequence
  MKO10090245_B_Gpt2
  gRNA
uaacuguauccgugaagaug

SEQ ID NO: 90246 - RNA, 20 nt, Artificial Sequence
  MKO10090246_B_Gpt
  gRNA
guccggacugcucagaagau

SEQ ID NO: 90247 - RNA, 20 nt, Artificial Sequence
  MKO10090247_B_Gpt
  gRNA
ugcgccacauccucccgaau

SEQ ID NO: 90248 - RNA, 20 nt, Artificial Sequence
  MKO10090248_B_Gpt
  gRNA
cagccuaaccuggcggaaga

SEQ ID NO: 90249 - RNA, 20 nt, Artificial Sequence
  MKO10090249_B_Gpx1
  gRNA
cuucuccgcgcgcccgcuga

SEQ ID NO: 90250 - RNA, 20 nt, Artificial Sequence
  MKO10090250_B_Gpx1
  gRNA
gcgcgcggagaaggcauaca

SEQ ID NO: 90251 - RNA, 20 nt, Artificial Sequence
  MKO10090251_B_Gpx1
  gRNA
ccgacgguguucccgugcgc

SEQ ID NO: 90252 - RNA, 20 nt, Artificial Sequence
  MKO10090252_B_Gpx2
  gRNA
gugggcugguacccaccccc

SEQ ID NO: 90253 - RNA, 20 nt, Artificial Sequence
  MKO10090253_B_Gpx2
  gRNA
auagacuucaauacguucag

SEQ ID NO: 90254 - RNA, 20 nt, Artificial Sequence
  MKO10090254_B_Gpx2
  gRNA
gacauugcagcucauugagc

SEQ ID NO: 90255 - RNA, 20 nt, Artificial Sequence
  MKO10090255_B_Gpx3
  gRNA
agugguaccaucuacgagua

SEQ ID NO: 90256 - RNA, 20 nt, Artificial Sequence
  MKO10090256_B_Gpx3
  gRNA
aauguauuccuccccaucga

SEQ ID NO: 90257 - RNA, 20 nt, Artificial Sequence
  MKO10090257_B_Gpx3
  gRNA
gccauuuggcuuggucauuc

SEQ ID NO: 90258 - RNA, 20 nt, Artificial Sequence
  MKO10090258_B_Gpx4
  gRNA
ccccucccagugccaucaaa

SEQ ID NO: 90259 - RNA, 20 nt, Artificial Sequence
  MKO10090259_B_Gpx4
  gRNA
agugugcaucccgcgaugau

SEQ ID NO: 90260 - RNA, 20 nt, Artificial Sequence
  MKO10090260_B_Gpx4
  gRNA
ucccagcaugccccugcccu

SEQ ID NO: 90261 - RNA, 20 nt, Artificial Sequence
  MKO10090261_B_Gpx5
  gRNA
auggcaucccugucaugcgc

SEQ ID NO: 90262 - RNA, 20 nt, Artificial Sequence
  MKO10090262_B_Gpx5
  gRNA
ggcuuucccugcaaccaauu

SEQ ID NO: 90263 - RNA, 20 nt, Artificial Sequence
  MKO10090263_B_Gpx5
  gRNA
gacaauuuagagauucuucc

SEQ ID NO: 90264 - RNA, 20 nt, Artificial Sequence
  MKO10090264_B_Gpx6
  gRNA
uuggggacauagccaccgcc

SEQ ID NO: 90265 - RNA, 20 nt, Artificial Sequence
  MKO10090265_B_Gpx6
  gRNA
cccaaaaccgugacguugaa

SEQ ID NO: 90266 - RNA, 20 nt, Artificial Sequence
  MKO10090266_B_Gpx6
  gRNA
gcugaagccauucaacguca

SEQ ID NO: 90267 - RNA, 20 nt, Artificial Sequence
  MKO10090267_B_Gpx7
  gRNA
gcucccaccaccuuuccguc

SEQ ID NO: 90268 - RNA, 20 nt, Artificial Sequence
  MKO10090268_B_Gpx7
  gRNA
acaagucuucucguuuccga

SEQ ID NO: 90269 - RNA, 20 nt, Artificial Sequence
  MKO10090269_B_Gpx7
  gRNA
acuucaaggcggucaacauc

SEQ ID NO: 90270 - RNA, 20 nt, Artificial Sequence
  MKO10090270_B_Gpx8
  gRNA
aacuucacgacuugucccuc

SEQ ID NO: 90271 - RNA, 20 nt, Artificial Sequence
  MKO10090271_B_Gpx8
  gRNA
agcuguugguucucggcuuc

SEQ ID NO: 90272 - RNA, 20 nt, Artificial Sequence
  MKO10090272_B_Gpx8
  gRNA
agggacaagucgugaaguuc

SEQ ID NO: 90273 - RNA, 20 nt, Artificial Sequence
  MKO10090273_B_Gramd1a
  gRNA
cucguugcguuguuuguaug

SEQ ID NO: 90274 - RNA, 20 nt, Artificial Sequence
  MKO10090274_B_Gramd1a
  gRNA
auuacuccugcgcccugcag

SEQ ID NO: 90275 - RNA, 20 nt, Artificial Sequence
  MKO10090275_B_Gramd1a
  gRNA
ggaggaggaucucccucugc

SEQ ID NO: 90276 - RNA, 20 nt, Artificial Sequence
  MKO10090276_B_Gramd1b
  gRNA
acaaugaggcgcuccguguc

SEQ ID NO: 90277 - RNA, 20 nt, Artificial Sequence
  MKO10090277_B_Gramd1b
  gRNA
gguggacggggacuuguccg

SEQ ID NO: 90278 - RNA, 20 nt, Artificial Sequence
  MKO10090278_B_Gramd1b
  gRNA
uacuuacauuguaccaacuc

SEQ ID NO: 90279 - RNA, 20 nt, Artificial Sequence
  MKO10090279_B_Gramd1c
  gRNA
uucggugaguucccguccaa

SEQ ID NO: 90280 - RNA, 20 nt, Artificial Sequence
  MKO10090280_B_Gramd1c
  gRNA
cuuauucaaguccagugacu

SEQ ID NO: 90281 - RNA, 20 nt, Artificial Sequence
  MKO10090281_B_Gramd1c
  gRNA
ucauccacgcugcuucuucc

SEQ ID NO: 90282 - RNA, 20 nt, Artificial Sequence
  MKO10090282_B_Gramd2
  gRNA
acgacuccuucccaauggac

SEQ ID NO: 90283 - RNA, 20 nt, Artificial Sequence
  MKO10090283_B_Gramd2
  gRNA
ugauggccaguccauuggga

SEQ ID NO: 90284 - RNA, 20 nt, Artificial Sequence
  MKO10090284_B_Gramd2
  gRNA
ggcucuauaucucucccaac

SEQ ID NO: 90285 - RNA, 20 nt, Artificial Sequence
  MKO10090285_B_Gramd3
  gRNA
gcacuuucacaaguuauucc

SEQ ID NO: 90286 - RNA, 20 nt, Artificial Sequence
  MKO10090286_B_Gramd3
  gRNA
aaagucuucaucgucuaguc

SEQ ID NO: 90287 - RNA, 20 nt, Artificial Sequence
  MKO10090287_B_Gramd3
  gRNA
ccgacacaaagagcuuuccu

SEQ ID NO: 90288 - RNA, 20 nt, Artificial Sequence
  MKO10090288_B_Gramd4
  gRNA
uuggggacucggcuagauca

SEQ ID NO: 90289 - RNA, 20 nt, Artificial Sequence
  MKO10090289_B_Gramd4
  gRNA
uggaucgggagcggcagcgc

SEQ ID NO: 90290 - RNA, 20 nt, Artificial Sequence
  MKO10090290_B_Gramd4
  gRNA
cugccgcagcaucucugagu

SEQ ID NO: 90291 - RNA, 20 nt, Artificial Sequence
  MKO10090291_B_Grap2
  gRNA
uuucugcuugaugucgagag

SEQ ID NO: 90292 - RNA, 20 nt, Artificial Sequence
  MKO10090292_B_Grap2
  gRNA
caucuagauacuaagcaacc

SEQ ID NO: 90293 - RNA, 20 nt, Artificial Sequence
  MKO10090293_B_Grap2
  gRNA
gggucaccggggcaacagcc

SEQ ID NO: 90294 - RNA, 20 nt, Artificial Sequence
  MKO10090294_B_Grap
  gRNA
gaacaaaacccuccgcuccu

SEQ ID NO: 90295 - RNA, 20 nt, Artificial Sequence
  MKO10090295_B_Grap
  gRNA
cguggaaguuguggagcgug

SEQ ID NO: 90296 - RNA, 20 nt, Artificial Sequence
  MKO10090296_B_Grap
  gRNA
gcccggccccgccaccagug

SEQ ID NO: 90297 - RNA, 20 nt, Artificial Sequence
  MKO10090297_B_Grasp
  gRNA
gugacucaccguugcuguuc

SEQ ID NO: 90298 - RNA, 20 nt, Artificial Sequence
  MKO10090298_B_Grasp
  gRNA
cugcaggaagguucuaacuu

SEQ ID NO: 90299 - RNA, 20 nt, Artificial Sequence
  MKO10090299_B_Grasp
  gRNA
ucucuacacgcugcuccucu

SEQ ID NO: 90300 - RNA, 20 nt, Artificial Sequence
  MKO10090300_B_Grb10
  gRNA
uccuuauaggcgccuucagg

SEQ ID NO: 90301 - RNA, 20 nt, Artificial Sequence
  MKO10090301_B_Grb10
  gRNA
uucuaaccgacaugacagcc

SEQ ID NO: 90302 - RNA, 20 nt, Artificial Sequence
  MKO10090302_B_Grb10
  gRNA
uagaaucuccaccacuuugc

SEQ ID NO: 90303 - RNA, 20 nt, Artificial Sequence
  MKO10090303_B_Grb14
  gRNA
auccccuacacagauacugc

SEQ ID NO: 90304 - RNA, 20 nt, Artificial Sequence
  MKO10090304_B_Grb14
  gRNA
cagugagacagcacuucagu

SEQ ID NO: 90305 - RNA, 20 nt, Artificial Sequence
  MKO10090305_B_Grb14
  gRNA
gcugacagcacagauguaag

SEQ ID NO: 90306 - RNA, 20 nt, Artificial Sequence
  MKO10090306_B_Grb2
  gRNA
ggucaaagucaaagagcgcc

SEQ ID NO: 90307 - RNA, 20 nt, Artificial Sequence
  MKO10090307_B_Grb2
  gRNA
gcagcagccaaccuacgucc

SEQ ID NO: 90308 - RNA, 20 nt, Artificial Sequence
  MKO10090308_B_Grb2
  gRNA
gcagaacucaaugggaaaga

SEQ ID NO: 90309 - RNA, 20 nt, Artificial Sequence
  MKO10090309_B_Grb7
  gRNA
ccauaggaaacuucgagaag

SEQ ID NO: 90310 - RNA, 20 nt, Artificial Sequence
  MKO10090310_B_Grb7
  gRNA
gcucuugaauaguucauacu

SEQ ID NO: 90311 - RNA, 20 nt, Artificial Sequence
  MKO10090311_B_Grb7
  gRNA
acaacucacacagaggcggc

SEQ ID NO: 90312 - RNA, 20 nt, Artificial Sequence
  MKO10090312_B_Grcc10
  gRNA
ccuuggccugcuccgcgcuc

SEQ ID NO: 90313 - RNA, 20 nt, Artificial Sequence
  MKO10090313_B_Grcc10
  gRNA
cccgagauugccagccuguc

SEQ ID NO: 90314 - RNA, 20 nt, Artificial Sequence
  MKO10090314_B_Grcc10
  gRNA
uguccuuaaguuugcccgcc

SEQ ID NO: 90315 - RNA, 20 nt, Artificial Sequence
  MKO10090315_B_Greb1l
  gRNA
acuuaaaguacuaccuaguc

SEQ ID NO: 90316 - RNA, 20 nt, Artificial Sequence
  MKO10090316_B_Greb1l
  gRNA
cccaccagcaggaacccggc

SEQ ID NO: 90317 - RNA, 20 nt, Artificial Sequence
  MKO10090317_B_Greb1l
  gRNA
aaagcaggcuucacggugac

SEQ ID NO: 90318 - RNA, 20 nt, Artificial Sequence
  MKO10090318_B_Greb1
  gRNA
agguucuugcccgaugacaa

SEQ ID NO: 90319 - RNA, 20 nt, Artificial Sequence
  MKO10090319_B_Greb1
  gRNA
gcacaaggggcacugaccaa

SEQ ID NO: 90320 - RNA, 20 nt, Artificial Sequence
  MKO10090320_B_Greb1
  gRNA
cggcagccgagcagacaaug

SEQ ID NO: 90321 - RNA, 20 nt, Artificial Sequence
  MKO10090321_B_Grem1
  gRNA
guugcagcccuccucgugga

SEQ ID NO: 90322 - RNA, 20 nt, Artificial Sequence
  MKO10090322_B_Grem1
  gRNA
gaaucgcaccgcauacacug

SEQ ID NO: 90323 - RNA, 20 nt, Artificial Sequence
  MKO10090323_B_Grem1
  gRNA
gcaaguaucugaagcgagau

SEQ ID NO: 90324 - RNA, 20 nt, Artificial Sequence
  MKO10090324_B_Grem2
  gRNA
acuugcgcucggugacuacc

SEQ ID NO: 90325 - RNA, 20 nt, Artificial Sequence
  MKO10090325_B_Grem2
  gRNA
cgccauccccucgccuuaca

SEQ ID NO: 90326 - RNA, 20 nt, Artificial Sequence
  MKO10090326_B_Grem2
  gRNA
uccuccuucuucacgugucg

SEQ ID NO: 90327 - RNA, 20 nt, Artificial Sequence
  MKO10090327_B_Grhl1
  gRNA
uaguccucugaauucaugcc

SEQ ID NO: 90328 - RNA, 20 nt, Artificial Sequence
  MKO10090328_B_Grhl1
  gRNA
gaacaacuuugaguauaccc

SEQ ID NO: 90329 - RNA, 20 nt, Artificial Sequence
  MKO10090329_B_Grhl1
  gRNA
cuggcacucccgucagcaca

SEQ ID NO: 90330 - RNA, 20 nt, Artificial Sequence
  MKO10090330_B_Grhl2
  gRNA
uggugaccuaccuucccguc

SEQ ID NO: 90331 - RNA, 20 nt, Artificial Sequence
  MKO10090331_B_Grhl2
  gRNA
cccccugacugcggccacca

SEQ ID NO: 90332 - RNA, 20 nt, Artificial Sequence
  MKO10090332_B_Grhl2
  gRNA
cgaguauacauaugaccaga

SEQ ID NO: 90333 - RNA, 20 nt, Artificial Sequence
  MKO10090333_B_Grhl3
  gRNA
cuaccauauaguagucguag

SEQ ID NO: 90334 - RNA, 20 nt, Artificial Sequence
  MKO10090334_B_Grhl3
  gRNA
ccaugcccagaggauuaucc

SEQ ID NO: 90335 - RNA, 20 nt, Artificial Sequence
  MKO10090335_B_Grhl3
  gRNA
auuccggccaccagugcugg

SEQ ID NO: 90336 - RNA, 20 nt, Artificial Sequence
  MKO10090336_B_Grhpr
  gRNA
caccuggcguguagcccacc

SEQ ID NO: 90337 - RNA, 20 nt, Artificial Sequence
  MKO10090337_B_Grhpr
  gRNA
cugccgccucucugaccgug

SEQ ID NO: 90338 - RNA, 20 nt, Artificial Sequence
  MKO10090338_B_Grhpr
  gRNA
aagaaacuucuggaugccgc

SEQ ID NO: 90339 - RNA, 20 nt, Artificial Sequence
  MKO10090339_B_Gria1
  gRNA
ccacuacauccucgccaacc

SEQ ID NO: 90340 - RNA, 20 nt, Artificial Sequence
  MKO10090340_B_Gria1
  gRNA
cguacacuccuuuggagaac

SEQ ID NO: 90341 - RNA, 20 nt, Artificial Sequence
  MKO10090341_B_Gria1
  gRNA
cucuacucaccagguuggcg

SEQ ID NO: 90342 - RNA, 20 nt, Artificial Sequence
  MKO10090342_B_Gria2
  gRNA
gcuugauugaguacuaccaa

SEQ ID NO: 90343 - RNA, 20 nt, Artificial Sequence
  MKO10090343_B_Gria2
  gRNA
guguaauccuugacugcgaa

SEQ ID NO: 90344 - RNA, 20 nt, Artificial Sequence
  MKO10090344_B_Gria2
  gRNA
cuuuaucccuuucgcaguca

SEQ ID NO: 90345 - RNA, 20 nt, Artificial Sequence
  MKO10090345_B_Gria3
  gRNA
aaacugcacaucggcaucag

SEQ ID NO: 90346 - RNA, 20 nt, Artificial Sequence
  MKO10090346_B_Gria3
  gRNA
ugauugacugugaagucgaa

SEQ ID NO: 90347 - RNA, 20 nt, Artificial Sequence
  MKO10090347_B_Gria3
  gRNA
cagacgcaucauugaagaaa

SEQ ID NO: 90348 - RNA, 20 nt, Artificial Sequence
  MKO10090348_B_Gria4
  gRNA
uuuccgagcagcguucaaau

SEQ ID NO: 90349 - RNA, 20 nt, Artificial Sequence
  MKO10090349_B_Gria4
  gRNA
cuuuauccgaaacacagacc

SEQ ID NO: 90350 - RNA, 20 nt, Artificial Sequence
  MKO10090350_B_Gria4
  gRNA
uucaauacuucaagcuauaa

SEQ ID NO: 90351 - RNA, 20 nt, Artificial Sequence
  MKO10090351_B_Grid1
  gRNA
agaacgcagccaaggacgac

SEQ ID NO: 90352 - RNA, 20 nt, Artificial Sequence
  MKO10090352_B_Grid1
  gRNA
cgaggccaauaauccguucc

SEQ ID NO: 90353 - RNA, 20 nt, Artificial Sequence
  MKO10090353_B_Grid1
  gRNA
cgccgucagggcuaggguuc

SEQ ID NO: 90354 - RNA, 20 nt, Artificial Sequence
  MKO10090354_B_Grid2ip
  gRNA
aggacgguucgaguuuauaa

SEQ ID NO: 90355 - RNA, 20 nt, Artificial Sequence
  MKO10090355_B_Grid2ip
  gRNA
acagucucaccacuggcgaa

SEQ ID NO: 90356 - RNA, 20 nt, Artificial Sequence
  MKO10090356_B_Grid2ip
  gRNA
aguuucggcuucacucugcg

SEQ ID NO: 90357 - RNA, 20 nt, Artificial Sequence
  MKO10090357_B_Grid2
  gRNA
cuaggugguggagacgaauc

SEQ ID NO: 90358 - RNA, 20 nt, Artificial Sequence
  MKO10090358_B_Grid2
  gRNA
agccaaauccuucauaagug

SEQ ID NO: 90359 - RNA, 20 nt, Artificial Sequence
  MKO10090359_B_Grid2
  gRNA
ucacuggaucaucauuaaug

SEQ ID NO: 90360 - RNA, 20 nt, Artificial Sequence
  MKO10090360_B_Grifin
  gRNA
cucacugagcacucgcacuc

SEQ ID NO: 90361 - RNA, 20 nt, Artificial Sequence
  MKO10090361_B_Grifin
  gRNA
caguucgaagccuucugugc

SEQ ID NO: 90362 - RNA, 20 nt, Artificial Sequence
  MKO10090362_B_Grifin
  gRNA
ggccagacccccugcacaga

SEQ ID NO: 90363 - RNA, 20 nt, Artificial Sequence
  MKO10090363_B_Grik1
  gRNA
ugagacguuccagcaaaucg

SEQ ID NO: 90364 - RNA, 20 nt, Artificial Sequence
  MKO10090364_B_Grik1
  gRNA
cggccaccccaagagccagu

SEQ ID NO: 90365 - RNA, 20 nt, Artificial Sequence
  MKO10090365_B_Grik1
  gRNA
cuugggguggccgcccucuu

SEQ ID NO: 90366 - RNA, 20 nt, Artificial Sequence
  MKO10090366_B_Grik2
  gRNA
cuucgacugcagccaugaaa

SEQ ID NO: 90367 - RNA, 20 nt, Artificial Sequence
  MKO10090367_B_Grik2
  gRNA
cgauccacaacaagcagagc

SEQ ID NO: 90368 - RNA, 20 nt, Artificial Sequence
  MKO10090368_B_Grik2
  gRNA
aauccuuauugucugacacc

SEQ ID NO: 90369 - RNA, 20 nt, Artificial Sequence
  MKO10090369_B_Grik3
  gRNA
aacucaucauggccccuucg

SEQ ID NO: 90370 - RNA, 20 nt, Artificial Sequence
  MKO10090370_B_Grik3
  gRNA
cccugacuuacgacauucag

SEQ ID NO: 90371 - RNA, 20 nt, Artificial Sequence
  MKO10090371_B_Grik3
  gRNA
uccucugaaugucguaaguc

SEQ ID NO: 90372 - RNA, 20 nt, Artificial Sequence
  MKO10090372_B_Grik4
  gRNA
aaagauguccacuucgaccu

SEQ ID NO: 90373 - RNA, 20 nt, Artificial Sequence
  MKO10090373_B_Grik4
  gRNA
cagcaacaccgacaucagcg

SEQ ID NO: 90374 - RNA, 20 nt, Artificial Sequence
  MKO10090374_B_Grik4
  gRNA
uggccccagaggaauuuguc

SEQ ID NO: 90375 - RNA, 20 nt, Artificial Sequence
  MKO10090375_B_Grik5
  gRNA
ggcugacagaugcgaagcga

SEQ ID NO: 90376 - RNA, 20 nt, Artificial Sequence
  MKO10090376_B_Grik5
  gRNA
agcuagccucaucugcgcca

SEQ ID NO: 90377 - RNA, 20 nt, Artificial Sequence
  MKO10090377_B_Grik5
  gRNA
cgcauuggcaucaaugauga

SEQ ID NO: 90378 - RNA, 20 nt, Artificial Sequence
  MKO10090378_B_Grin1os
  gRNA
uuaugcgcgcccgguguccc

SEQ ID NO: 90379 - RNA, 20 nt, Artificial Sequence
  MKO10090379_B_Grin1os
  gRNA
ggacgacuggggccuagcau

SEQ ID NO: 90380 - RNA, 20 nt, Artificial Sequence
  MKO10090380_B_Grin1os
  gRNA
cauggaagaugcaacacgca

SEQ ID NO: 90381 - RNA, 20 nt, Artificial Sequence
  MKO10090381_B_Grin1
  gRNA
acauucggguagucagcccc

SEQ ID NO: 90382 - RNA, 20 nt, Artificial Sequence
  MKO10090382_B_Grin1
  gRNA
agaugaugcgcgucuacaac

SEQ ID NO: 90383 - RNA, 20 nt, Artificial Sequence
  MKO10090383_B_Grin1
  gRNA
gcuggucagcgaugaccacg

SEQ ID NO: 90384 - RNA, 20 nt, Artificial Sequence
  MKO10090384_B_Grin2a
  gRNA
caagagagcgagccucgcuc

SEQ ID NO: 90385 - RNA, 20 nt, Artificial Sequence
  MKO10090385_B_Grin2a
  gRNA
ggcagcaauucaaccaacga

SEQ ID NO: 90386 - RNA, 20 nt, Artificial Sequence
  MKO10090386_B_Grin2a
  gRNA
uguggugaucgugcugaaua

SEQ ID NO: 90387 - RNA, 20 nt, Artificial Sequence
  MKO10090387_B_Grin2b
  gRNA
ggaggcaccguuugucauug

SEQ ID NO: 90388 - RNA, 20 nt, Artificial Sequence
  MKO10090388_B_Grin2b
  gRNA
cuaccagaugcauccgaagc

SEQ ID NO: 90389 - RNA, 20 nt, Artificial Sequence
  MKO10090389_B_Grin2b
  gRNA
ucaccagcuucggaugcauc

SEQ ID NO: 90390 - RNA, 20 nt, Artificial Sequence
  MKO10090390_B_Grin2c
  gRNA
cucucaaccggcaucgccuc

SEQ ID NO: 90391 - RNA, 20 nt, Artificial Sequence
  MKO10090391_B_Grin2c
  gRNA
ccaacggcaagcacggcaag

SEQ ID NO: 90392 - RNA, 20 nt, Artificial Sequence
  MKO10090392_B_Grin2c
  gRNA
ucuacggcagggcacagugu

SEQ ID NO: 90393 - RNA, 20 nt, Artificial Sequence
  MKO10090393_B_Grin2d
  gRNA
gcgugucauccaccggcugc

SEQ ID NO: 90394 - RNA, 20 nt, Artificial Sequence
  MKO10090394_B_Grin2d
  gRNA
ucugaugcaagugccgcuga

SEQ ID NO: 90395 - RNA, 20 nt, Artificial Sequence
  MKO10090395_B_Grin2d
  gRNA
aagcauggcaagaagaucga

SEQ ID NO: 90396 - RNA, 20 nt, Artificial Sequence
  MKO10090396_B_Grin3a
  gRNA
gacugcaagcuucugaccgu

SEQ ID NO: 90397 - RNA, 20 nt, Artificial Sequence
  MKO10090397_B_Grin3a
  gRNA
cggugauauuccagucuucc

SEQ ID NO: 90398 - RNA, 20 nt, Artificial Sequence
  MKO10090398_B_Grin3a
  gRNA
aauguaccagccaccccuga

SEQ ID NO: 90399 - RNA, 20 nt, Artificial Sequence
  MKO10090399_B_Grin3b
  gRNA
aagcguccgguaggacacuu

SEQ ID NO: 90400 - RNA, 20 nt, Artificial Sequence
  MKO10090400_B_Grin3b
  gRNA
gggcacaccacugcccgccg

SEQ ID NO: 90401 - RNA, 20 nt, Artificial Sequence
  MKO10090401_B_Grin3b
  gRNA
uccucacaauuuacugccgc

SEQ ID NO: 90402 - RNA, 20 nt, Artificial Sequence
  MKO10090402_B_Grina
  gRNA
acuuccggcgaaagcauccc

SEQ ID NO: 90403 - RNA, 20 nt, Artificial Sequence
  MKO10090403_B_Grina
  gRNA
uccauccuacuaugacaacc

SEQ ID NO: 90404 - RNA, 20 nt, Artificial Sequence
  MKO10090404_B_Grina
  gRNA
cuaugacuucaccucgugca

SEQ ID NO: 90405 - RNA, 20 nt, Artificial Sequence
  MKO10090405_B_Grip1
  gRNA
caguguuauguuccgaacug

SEQ ID NO: 90406 - RNA, 20 nt, Artificial Sequence
  MKO10090406_B_Grip1
  gRNA
gugauaaccuguguucgucc

SEQ ID NO: 90407 - RNA, 20 nt, Artificial Sequence
  MKO10090407_B_Grip1
  gRNA
uagggggagcgcaugaugac

SEQ ID NO: 90408 - RNA, 20 nt, Artificial Sequence
  MKO10090408_B_Grip2
  gRNA
gguggaguugaucaaacgug

SEQ ID NO: 90409 - RNA, 20 nt, Artificial Sequence
  MKO10090409_B_Grip2
  gRNA
acguuugaucaacuccacca

SEQ ID NO: 90410 - RNA, 20 nt, Artificial Sequence
  MKO10090410_B_Grip2
  gRNA
gcggcauaccagagccccgu

SEQ ID NO: 90411 - RNA, 20 nt, Artificial Sequence
  MKO10090411_B_Gripap1
  gRNA
aguuauuuguccggagcucc

SEQ ID NO: 90412 - RNA, 20 nt, Artificial Sequence
  MKO10090412_B_Gripap1
  gRNA
caccagcaccuugcugaacu

SEQ ID NO: 90413 - RNA, 20 nt, Artificial Sequence
  MKO10090413_B_Gripap1
  gRNA
uuugcagaacaguacacuua

SEQ ID NO: 90414 - RNA, 20 nt, Artificial Sequence
  MKO10090414_B_Grk1
  gRNA
cacgucaccuccguucauga

SEQ ID NO: 90415 - RNA, 20 nt, Artificial Sequence
  MKO10090415_B_Grk1
  gRNA
uggggucccugcguagcccu

SEQ ID NO: 90416 - RNA, 20 nt, Artificial Sequence
  MKO10090416_B_Grk1
  gRNA
cuaugcguucgagaccaaga

SEQ ID NO: 90417 - RNA, 20 nt, Artificial Sequence
  MKO10090417_B_Grk4
  gRNA
cauggaacucgagaacuucg

SEQ ID NO: 90418 - RNA, 20 nt, Artificial Sequence
  MKO10090418_B_Grk4
  gRNA
gcaugugcacugaauuaaga

SEQ ID NO: 90419 - RNA, 20 nt, Artificial Sequence
  MKO10090419_B_Grk4
  gRNA
cuaaaaagaagucuuccaau

SEQ ID NO: 90420 - RNA, 20 nt, Artificial Sequence
  MKO10090420_B_Grk5
  gRNA
cuaugugacaagcaaccaau

SEQ ID NO: 90421 - RNA, 20 nt, Artificial Sequence
  MKO10090421_B_Grk5
  gRNA
gaccaaguaccucacuccaa

SEQ ID NO: 90422 - RNA, 20 nt, Artificial Sequence
  MKO10090422_B_Grk5
  gRNA
auuacuccagaugaaaaccu

SEQ ID NO: 90423 - RNA, 20 nt, Artificial Sequence
  MKO10090423_B_Grk6
  gRNA
ggugguggcgggaaucgcaa

SEQ ID NO: 90424 - RNA, 20 nt, Artificial Sequence
  MKO10090424_B_Grk6
  gRNA
cacagaacucacgaaauaac

SEQ ID NO: 90425 - RNA, 20 nt, Artificial Sequence
  MKO10090425_B_Grk6
  gRNA
ucagaaaguucugcauuagu

SEQ ID NO: 90426 - RNA, 20 nt, Artificial Sequence
  MKO10090426_B_Grlf1
  gRNA
cccaaaauaguuacucuccc

SEQ ID NO: 90427 - RNA, 20 nt, Artificial Sequence
  MKO10090427_B_Grlf1
  gRNA
uccacaggacuaagcacuga

SEQ ID NO: 90428 - RNA, 20 nt, Artificial Sequence
  MKO10090428_B_Grlf1
  gRNA
aagucaaucugcaugcugua

SEQ ID NO: 90429 - RNA, 20 nt, Artificial Sequence
  MKO10090429_B_Grm1
  gRNA
ucaccagccuccagccgaaa

SEQ ID NO: 90430 - RNA, 20 nt, Artificial Sequence
  MKO10090430_B_Grm1
  gRNA
ucaucaaacgaccugaccuc

SEQ ID NO: 90431 - RNA, 20 nt, Artificial Sequence
  MKO10090431_B_Grm1
  gRNA
cgcuuccagugucgccuacc

SEQ ID NO: 90432 - RNA, 20 nt, Artificial Sequence
  MKO10090432_B_Grm2
  gRNA
ugcccgagccucgagcucga

SEQ ID NO: 90433 - RNA, 20 nt, Artificial Sequence
  MKO10090433_B_Grm2
  gRNA
gacggacacgcacaucguag

SEQ ID NO: 90434 - RNA, 20 nt, Artificial Sequence
  MKO10090434_B_Grm2
  gRNA
cgggcaccuaccagccgcuu

SEQ ID NO: 90435 - RNA, 20 nt, Artificial Sequence
  MKO10090435_B_Grm3
  gRNA
gcgagcgaugcaguuugucu

SEQ ID NO: 90436 - RNA, 20 nt, Artificial Sequence
  MKO10090436_B_Grm3
  gRNA
ugcaucuccguuagcuugag

SEQ ID NO: 90437 - RNA, 20 nt, Artificial Sequence
  MKO10090437_B_Grm3
  gRNA
cacgaaaccacucaagcuaa

SEQ ID NO: 90438 - RNA, 20 nt, Artificial Sequence
  MKO10090438_B_Grm4
  gRNA
cuaccugauaucauccucgu

SEQ ID NO: 90439 - RNA, 20 nt, Artificial Sequence
  MKO10090439_B_Grm4
  gRNA
gccuguuguugucaagcgug

SEQ ID NO: 90440 - RNA, 20 nt, Artificial Sequence
  MKO10090440_B_Grm4
  gRNA
cccguggaaucuucaccgac

SEQ ID NO: 90441 - RNA, 20 nt, Artificial Sequence
  MKO10090441_B_Grm5
  gRNA
ccugugcaaacccuucuagc

SEQ ID NO: 90442 - RNA, 20 nt, Artificial Sequence
  MKO10090442_B_Grm5
  gRNA
ucaucaaaccacuugacauc

SEQ ID NO: 90443 - RNA, 20 nt, Artificial Sequence
  MKO10090443_B_Grm5
  gRNA
aaaaguuuccgcccaucaau

SEQ ID NO: 90444 - RNA, 20 nt, Artificial Sequence
  MKO10090444_B_Grm6
  gRNA
gguggacauugugcgggcac

SEQ ID NO: 90445 - RNA, 20 nt, Artificial Sequence
  MKO10090445_B_Grm6
  gRNA
cuaugacuucuucucccgag

SEQ ID NO: 90446 - RNA, 20 nt, Artificial Sequence
  MKO10090446_B_Grm6
  gRNA
ccaucaccaucuugcccaaa

SEQ ID NO: 90447 - RNA, 20 nt, Artificial Sequence
  MKO10090447_B_Grm7
  gRNA
uuacuuuauauccucaucgu

SEQ ID NO: 90448 - RNA, 20 nt, Artificial Sequence
  MKO10090448_B_Grm7
  gRNA
acauuguaaaggcauugggc

SEQ ID NO: 90449 - RNA, 20 nt, Artificial Sequence
  MKO10090449_B_Grm7
  gRNA
uuccccaagaacgcaaagac

SEQ ID NO: 90450 - RNA, 20 nt, Artificial Sequence
  MKO10090450_B_Grm8
  gRNA
aauagcaccugucuaucagc

SEQ ID NO: 90451 - RNA, 20 nt, Artificial Sequence
  MKO10090451_B_Grm8
  gRNA
ccacacauuucuucgauuau

SEQ ID NO: 90452 - RNA, 20 nt, Artificial Sequence
  MKO10090452_B_Grm8
  gRNA
gaguucggcuucuaaaguau

SEQ ID NO: 90453 - RNA, 20 nt, Artificial Sequence
  MKO10090453_B_Grn
  gRNA
accaucaaccauaaugcagc

SEQ ID NO: 90454 - RNA, 20 nt, Artificial Sequence
  MKO10090454_B_Grn
  gRNA
agaugauggcucguuauucu

SEQ ID NO: 90455 - RNA, 20 nt, Artificial Sequence
  MKO10090455_B_Grn
  gRNA
ucuauuugcagauaaccccu

SEQ ID NO: 90456 - RNA, 20 nt, Artificial Sequence
  MKO10090456_B_Grpel1
  gRNA
cgggggcagucauggcggcu

SEQ ID NO: 90457 - RNA, 20 nt, Artificial Sequence
  MKO10090457_B_Grpel1
  gRNA
ugucugcuuaccauauaacu

SEQ ID NO: 90458 - RNA, 20 nt, Artificial Sequence
  MKO10090458_B_Grpel1
  gRNA
cugaacgacagugccaaagc

SEQ ID NO: 90459 - RNA, 20 nt, Artificial Sequence
  MKO10090459_B_Grpel2
  gRNA
acugccacccaaagaacugc

SEQ ID NO: 90460 - RNA, 20 nt, Artificial Sequence
  MKO10090460_B_Grpel2
  gRNA
gcucucugacauagcccccg

SEQ ID NO: 90461 - RNA, 20 nt, Artificial Sequence
  MKO10090461_B_Grpel2
  gRNA
ugggguacagccuggcaccg

SEQ ID NO: 90462 - RNA, 20 nt, Artificial Sequence
  MKO10090462_B_Grpr
  gRNA
uuccugcucagaucgaaucc

SEQ ID NO: 90463 - RNA, 20 nt, Artificial Sequence
  MKO10090463_B_Grpr
  gRNA
augauaagcccauaaacugc

SEQ ID NO: 90464 - RNA, 20 nt, Artificial Sequence
  MKO10090464_B_Grpr
  gRNA
gggcacaacuaaugaagguu

SEQ ID NO: 90465 - RNA, 20 nt, Artificial Sequence
  MKO10090465_B_Grp
  gRNA
ccagcugccccggugucgac

SEQ ID NO: 90466 - RNA, 20 nt, Artificial Sequence
  MKO10090466_B_Grp
  gRNA
guugguagacucucugcucc

SEQ ID NO: 90467 - RNA, 20 nt, Artificial Sequence
  MKO10090467_B_Grp
  gRNA
ccaccugcgccugucgacac

SEQ ID NO: 90468 - RNA, 20 nt, Artificial Sequence
  MKO10090468_B_Grrp1
  gRNA
ggcggcgacguugcgaccug

SEQ ID NO: 90469 - RNA, 20 nt, Artificial Sequence
  MKO10090469_B_Grrp1
  gRNA
aaaggcgucguacuagcccc

SEQ ID NO: 90470 - RNA, 20 nt, Artificial Sequence
  MKO10090470_B_Grrp1
  gRNA
gcaacgcgcgcgucauccag

SEQ ID NO: 90471 - RNA, 20 nt, Artificial Sequence
  MKO10090471_B_Grsf1
  gRNA
gggcgaugccuuaauagaga

SEQ ID NO: 90472 - RNA, 20 nt, Artificial Sequence
  MKO10090472_B_Grsf1
  gRNA
cccugugcuuuagaagcgcu

SEQ ID NO: 90473 - RNA, 20 nt, Artificial Sequence
  MKO10090473_B_Grsf1
  gRNA
ugccuuaaugaagagccugc

SEQ ID NO: 90474 - RNA, 20 nt, Artificial Sequence
  MKO10090474_B_Grtp1
  gRNA
gguguccggaaaagcgugac

SEQ ID NO: 90475 - RNA, 20 nt, Artificial Sequence
  MKO10090475_B_Grtp1
  gRNA
gacccuguacaacgugcucc

SEQ ID NO: 90476 - RNA, 20 nt, Artificial Sequence
  MKO10090476_B_Grtp1
  gRNA
augccaggagcacguuguac

SEQ ID NO: 90477 - RNA, 20 nt, Artificial Sequence
  MKO10090477_B_Grwd1
  gRNA
acgguggcaucaaccgaguu

SEQ ID NO: 90478 - RNA, 20 nt, Artificial Sequence
  MKO10090478_B_Grwd1
  gRNA
gauccuccacagaccgugug

SEQ ID NO: 90479 - RNA, 20 nt, Artificial Sequence
  MKO10090479_B_Grwd1
  gRNA
gcagugcgaacaccuccacu

SEQ ID NO: 90480 - RNA, 20 nt, Artificial Sequence
  MKO10090480_B_Grxcr1
  gRNA
auucgaaaccggacuuuccg

SEQ ID NO: 90481 - RNA, 20 nt, Artificial Sequence
  MKO10090481_B_Grxcr1
  gRNA
cauuauccucugauccaaug

SEQ ID NO: 90482 - RNA, 20 nt, Artificial Sequence
  MKO10090482_B_Grxcr1
  gRNA
acacugacaucuugcuuccg

SEQ ID NO: 90483 - RNA, 20 nt, Artificial Sequence
  MKO10090483_B_Grxcr2
  gRNA
cgggcuaugggcugcaaauu

SEQ ID NO: 90484 - RNA, 20 nt, Artificial Sequence
  MKO10090484_B_Grxcr2
  gRNA
gacccauaaacgccauccau

SEQ ID NO: 90485 - RNA, 20 nt, Artificial Sequence
  MKO10090485_B_Grxcr2
  gRNA
gaaccaauggauggcguuua

SEQ ID NO: 90486 - RNA, 20 nt, Artificial Sequence
  MKO10090486_B_Gsap
  gRNA
uauaauuaccucauucuguc

SEQ ID NO: 90487 - RNA, 20 nt, Artificial Sequence
  MKO10090487_B_Gsap
  gRNA
guacuaaacaucgaaagaaa

SEQ ID NO: 90488 - RNA, 20 nt, Artificial Sequence
  MKO10090488_B_Gsap
  gRNA
gcaucuguacaccuuugaga

SEQ ID NO: 90489 - RNA, 20 nt, Artificial Sequence
  MKO10090489_B_Gsc2
  gRNA
gguccgcauccgccugcgag

SEQ ID NO: 90490 - RNA, 20 nt, Artificial Sequence
  MKO10090490_B_Gsc2
  gRNA
aaaagcgugcuuccucaucg

SEQ ID NO: 90491 - RNA, 20 nt, Artificial Sequence
  MKO10090491_B_Gsc2
  gRNA
ucgaugaggaagcacgcuuu

SEQ ID NO: 90492 - RNA, 20 nt, Artificial Sequence
  MKO10090492_B_Gsc
  gRNA
gacguccucaaaagccucgc

SEQ ID NO: 90493 - RNA, 20 nt, Artificial Sequence
  MKO10090493_B_Gsc
  gRNA
cagcgugcccacguucaugu

SEQ ID NO: 90494 - RNA, 20 nt, Artificial Sequence
  MKO10090494_B_Gsc
  gRNA
agucagaaaacgccgagaag

SEQ ID NO: 90495 - RNA, 20 nt, Artificial Sequence
  MKO10090495_B_Gsdma2
  gRNA
ccugucacaaagcagcacgc

SEQ ID NO: 90496 - RNA, 20 nt, Artificial Sequence
  MKO10090496_B_Gsdma2
  gRNA
agcagaccacccguuccuga

SEQ ID NO: 90497 - RNA, 20 nt, Artificial Sequence
  MKO10090497_B_Gsdma2
  gRNA
agacuuuaccagauaucauc

SEQ ID NO: 90498 - RNA, 20 nt, Artificial Sequence
  MKO10090498_B_Gsdma3
  gRNA
gggauccuugaacaacaaca

SEQ ID NO: 90499 - RNA, 20 nt, Artificial Sequence
  MKO10090499_B_Gsdma3
  gRNA
ucuccuacccagaugauauc

SEQ ID NO: 90500 - RNA, 20 nt, Artificial Sequence
  MKO10090500_B_Gsdma3
  gRNA
acucguuccugaacgagaug

SEQ ID NO: 90501 - RNA, 20 nt, Artificial Sequence
  MKO10090501_B_Gsdma
  gRNA
gcaccuaccuccaggaggga

SEQ ID NO: 90502 - RNA, 20 nt, Artificial Sequence
  MKO10090502_B_Gsdma
  gRNA
ugcucgaguagagggagaug

SEQ ID NO: 90503 - RNA, 20 nt, Artificial Sequence
  MKO10090503_B_Gsdma
  gRNA
agcaugcaaaccuucccucc

SEQ ID NO: 90504 - RNA, 20 nt, Artificial Sequence
  MKO10090504_B_Gsdmc2
  gRNA
aaugucgcagacauugcaag

SEQ ID NO: 90505 - RNA, 20 nt, Artificial Sequence
  MKO10090505_B_Gsdmc2
  gRNA
gccugucagcauaguauccu

SEQ ID NO: 90506 - RNA, 20 nt, Artificial Sequence
  MKO10090506_B_Gsdmc2
  gRNA
gucuccccagguucgaggca

SEQ ID NO: 90507 - RNA, 20 nt, Artificial Sequence
  MKO10090507_B_Gsdmc3
  gRNA
aagccucugucaccacauac

SEQ ID NO: 90508 - RNA, 20 nt, Artificial Sequence
  MKO10090508_B_Gsdmc3
  gRNA
cuucauacauguccaaucaa

SEQ ID NO: 90509 - RNA, 20 nt, Artificial Sequence
  MKO10090509_B_Gsdmc3
  gRNA
aaugucgcagacauugcaag

SEQ ID NO: 90510 - RNA, 20 nt, Artificial Sequence
  MKO10090510_B_Gsdmc4
  gRNA
uccugucagcauaguauccu

SEQ ID NO: 90511 - RNA, 20 nt, Artificial Sequence
  MKO10090511_B_Gsdmc4
  gRNA
uguugauuggacauguauga

SEQ ID NO: 90512 - RNA, 20 nt, Artificial Sequence
  MKO10090512_B_Gsdmc4
  gRNA
ggaaaggaagaaccuguaug

SEQ ID NO: 90513 - RNA, 20 nt, Artificial Sequence
  MKO10090513_B_Gsdmc
  gRNA
gaucaucaaccagcuuguca

SEQ ID NO: 90514 - RNA, 20 nt, Artificial Sequence
  MKO10090514_B_Gsdmc
  gRNA
gacauucccacaaaucucau

SEQ ID NO: 90515 - RNA, 20 nt, Artificial Sequence
  MKO10090515_B_Gsdmc
  gRNA
ccacauuuaugaagacuugc

SEQ ID NO: 90516 - RNA, 20 nt, Artificial Sequence
  MKO10090516_B_Gsdmd
  gRNA
cgaguggcccaacugcuuau

SEQ ID NO: 90517 - RNA, 20 nt, Artificial Sequence
  MKO10090517_B_Gsdmd
  gRNA
auuuagagccaauaagcagu

SEQ ID NO: 90518 - RNA, 20 nt, Artificial Sequence
  MKO10090518_B_Gsdmd
  gRNA
ugcgugugacucagaagacc

SEQ ID NO: 90519 - RNA, 20 nt, Artificial Sequence
  MKO10090519_B_Gse1
  gRNA
gcccccacuaaaaccgucaa

SEQ ID NO: 90520 - RNA, 20 nt, Artificial Sequence
  MKO10090520_B_Gse1
  gRNA
gccccaucaucguccccccc

SEQ ID NO: 90521 - RNA, 20 nt, Artificial Sequence
  MKO10090521_B_Gse1
  gRNA
cucagcaccccguaccccuu

SEQ ID NO: 90522 - RNA, 20 nt, Artificial Sequence
  MKO10090522_B_Gsg1l
  gRNA
cagcccgucuaugacgcugc

SEQ ID NO: 90523 - RNA, 20 nt, Artificial Sequence
  MKO10090523_B_Gsg1l
  gRNA
augucgcagcuucauugacc

SEQ ID NO: 90524 - RNA, 20 nt, Artificial Sequence
  MKO10090524_B_Gsg1l
  gRNA
gaaggaccacccauaguccc

SEQ ID NO: 90525 - RNA, 20 nt, Artificial Sequence
  MKO10090525_B_Gsg1
  gRNA
aacugccaacuuagguccgg

SEQ ID NO: 90526 - RNA, 20 nt, Artificial Sequence
  MKO10090526_B_Gsg1
  gRNA
guacuugccacgggccccca

SEQ ID NO: 90527 - RNA, 20 nt, Artificial Sequence
  MKO10090527_B_Gsg1
  gRNA
gcuauauucacaagucuucc

SEQ ID NO: 90528 - RNA, 20 nt, Artificial Sequence
  MKO10090528_B_Gsg2
  gRNA
ccggggaagucggggucguc

SEQ ID NO: 90529 - RNA, 20 nt, Artificial Sequence
  MKO10090529_B_Gsg2
  gRNA
gcgacucguuacugucgcug

SEQ ID NO: 90530 - RNA, 20 nt, Artificial Sequence
  MKO10090530_B_Gsg2
  gRNA
uucggcucggagggcccucc

SEQ ID NO: 90531 - RNA, 20 nt, Artificial Sequence
  MKO10090531_B_Gsk3a
  gRNA
caagccccagaauuugcuug

SEQ ID NO: 90532 - RNA, 20 nt, Artificial Sequence
  MKO10090532_B_Gsk3a
  gRNA
ccuaccuugauguagaugau

SEQ ID NO: 90533 - RNA, 20 nt, Artificial Sequence
  MKO10090533_B_Gsk3a
  gRNA
uacgcauaaucugcaguucu

SEQ ID NO: 90534 - RNA, 20 nt, Artificial Sequence
  MKO10090534_B_Gsk3b
  gRNA
gccaggaguugccacuacug

SEQ ID NO: 90535 - RNA, 20 nt, Artificial Sequence
  MKO10090535_B_Gsk3b
  gRNA
uauacagacacgaaagugau

SEQ ID NO: 90536 - RNA, 20 nt, Artificial Sequence
  MKO10090536_B_Gsk3b
  gRNA
cuuggcucgacuauaguguc

SEQ ID NO: 90537 - RNA, 20 nt, Artificial Sequence
  MKO10090537_B_Gskip
  gRNA
uccgagcucaauggguuuga

SEQ ID NO: 90538 - RNA, 20 nt, Artificial Sequence
  MKO10090538_B_Gskip
  gRNA
uuugcaaaugauccuccacc

SEQ ID NO: 90539 - RNA, 20 nt, Artificial Sequence
  MKO10090539_B_Gskip
  gRNA
uacaucguuuacaacugccu

SEQ ID NO: 90540 - RNA, 20 nt, Artificial Sequence
  MKO10090540_B_Gsn
  gRNA
gcuguacagcccggccguuc

SEQ ID NO: 90541 - RNA, 20 nt, Artificial Sequence
  MKO10090541_B_Gsn
  gRNA
cucguugucccggaugcccu

SEQ ID NO: 90542 - RNA, 20 nt, Artificial Sequence
  MKO10090542_B_Gsn
  gRNA
auccgggacaacgagaggag

SEQ ID NO: 90543 - RNA, 20 nt, Artificial Sequence
  MKO10090543_B_Gspt1
  gRNA
ucucaagaccagucguguga

SEQ ID NO: 90544 - RNA, 20 nt, Artificial Sequence
  MKO10090544_B_Gspt1
  gRNA
aauaccgaaaccuaagucag

SEQ ID NO: 90545 - RNA, 20 nt, Artificial Sequence
  MKO10090545_B_Gspt1
  gRNA
gguggugccaccgcugacuu

SEQ ID NO: 90546 - RNA, 20 nt, Artificial Sequence
  MKO10090546_B_Gspt2
  gRNA
ucaagccgauuuagcugugc

SEQ ID NO: 90547 - RNA, 20 nt, Artificial Sequence
  MKO10090547_B_Gspt2
  gRNA
uggaaucgcccccgcagcca

SEQ ID NO: 90548 - RNA, 20 nt, Artificial Sequence
  MKO10090548_B_Gspt2
  gRNA
cuccccggcgccaccgaugc

SEQ ID NO: 90549 - RNA, 20 nt, Artificial Sequence
  MKO10090549_B_Gsr
  gRNA
uguuggauguguacccaaaa

SEQ ID NO: 90550 - RNA, 20 nt, Artificial Sequence
  MKO10090550_B_Gsr
  gRNA
gcugugaggguaaauucagu

SEQ ID NO: 90551 - RNA, 20 nt, Artificial Sequence
  MKO10090551_B_Gsr
  gRNA
acagugucaucaagcagaaa

SEQ ID NO: 90552 - RNA, 20 nt, Artificial Sequence
  MKO10090552_B_Gss
  gRNA
cuccucuagcaccaucaaaa

SEQ ID NO: 90553 - RNA, 20 nt, Artificial Sequence
  MKO10090553_B_Gss
  gRNA
ccuguccaauaaccccagca

SEQ ID NO: 90554 - RNA, 20 nt, Artificial Sequence
  MKO10090554_B_Gss
  gRNA
ccugggcaaugcccucuuuc

SEQ ID NO: 90555 - RNA, 20 nt, Artificial Sequence
  MKO10090555_B_Gsua1
  gRNA
gauguuugaccaagugccca

SEQ ID NO: 90556 - RNA, 20 nt, Artificial Sequence
  MKO10090556_B_Gsua1
  gRNA
aggauugacauguauucaga

SEQ ID NO: 90557 - RNA, 20 nt, Artificial Sequence
  MKO10090557_B_Gsua1
  gRNA
uuagaucugacugaaaugau

SEQ ID NO: 90558 - RNA, 20 nt, Artificial Sequence
  MKO10090558_B_Gsua2
  gRNA
gauguuugaccaagugccca

SEQ ID NO: 90559 - RNA, 20 nt, Artificial Sequence
  MKO10090559_B_Gsua2
  gRNA
ccuucauguccuucccauag

SEQ ID NO: 90560 - RNA, 20 nt, Artificial Sequence
  MKO10090560_B_Gsua2
  gRNA
aggauugacauguauacaga

SEQ ID NO: 90561 - RNA, 20 nt, Artificial Sequence
  MKO10090561_B_Gsua3
  gRNA
uaccacuucguaaccuugcc

SEQ ID NO: 90562 - RNA, 20 nt, Artificial Sequence
  MKO10090562_B_Gsua3
  gRNA
uuacccccacaugcccccug

SEQ ID NO: 90563 - RNA, 20 nt, Artificial Sequence
  MKO10090563_B_Gsua3
  gRNA
caucccgucgaucucuacca

SEQ ID NO: 90564 - RNA, 20 nt, Artificial Sequence
  MKO10090564_B_Gsua4
  gRNA
cuucccauacaaguuguacu

SEQ ID NO: 90565 - RNA, 20 nt, Artificial Sequence
  MKO10090565_B_Gsua4
  gRNA
ccugaugaugaugauugccg

SEQ ID NO: 90566 - RNA, 20 nt, Artificial Sequence
  MKO10090566_B_Gsua4
  gRNA
ccacggcaaucaucaucauc

SEQ ID NO: 90567 - RNA, 20 nt, Artificial Sequence
  MKO10090567_B_Gsucd
  gRNA
aguuuccacuacuaaccucu

SEQ ID NO: 90568 - RNA, 20 nt, Artificial Sequence
  MKO10090568_B_Gsucd
  gRNA
uguccacugaccgagcucug

SEQ ID NO: 90569 - RNA, 20 nt, Artificial Sequence
  MKO10090569_B_Gsucd
  gRNA
uaccaaaaaguggugaauac

SEQ ID NO: 90570 - RNA, 20 nt, Artificial Sequence
  MKO10090570_B_Gstk1
  gRNA
uacacgcauccauaucucuc

SEQ ID NO: 90571 - RNA, 20 nt, Artificial Sequence
  MKO10090571_B_Gstk1
  gRNA
aggaaaccaaccaccugcua

SEQ ID NO: 90572 - RNA, 20 nt, Artificial Sequence
  MKO10090572_B_Gstk1
  gRNA
gaaucucuuugaagauguac

SEQ ID NO: 90573 - RNA, 20 nt, Artificial Sequence
  MKO10090573_B_Gstm1
  gRNA
acacccgauccgcaugcucc

SEQ ID NO: 90574 - RNA, 20 nt, Artificial Sequence
  MKO10090574_B_Gstm1
  gRNA
ccgacuuugacagaagccag

SEQ ID NO: 90575 - RNA, 20 nt, Artificial Sequence
  MKO10090575_B_Gstm1
  gRNA
ugcugcagauggagagacag

SEQ ID NO: 90576 - RNA, 20 nt, Artificial Sequence
  MKO10090576_B_Gstm2
  gRNA
aagaaauacaccauggggga

SEQ ID NO: 90577 - RNA, 20 nt, Artificial Sequence
  MKO10090577_B_Gstm2
  gRNA
cugagugagaaguucaagcu

SEQ ID NO: 90578 - RNA, 20 nt, Artificial Sequence
  MKO10090578_B_Gstm2
  gRNA
cugacuaugaccgaagccag

SEQ ID NO: 90579 - RNA, 20 nt, Artificial Sequence
  MKO10090579_B_Gstm3
  gRNA
aagagauaugucauggggga

SEQ ID NO: 90580 - RNA, 20 nt, Artificial Sequence
  MKO10090580_B_Gstm3
  gRNA
ccaacuuugaccgaagccag

SEQ ID NO: 90581 - RNA, 20 nt, Artificial Sequence
  MKO10090581_B_Gstm3
  gRNA
cagcugcccuacuuaauuga

SEQ ID NO: 90582 - RNA, 20 nt, Artificial Sequence
  MKO10090582_B_Gstm4
  gRNA
caguugccuuacuugauuga

SEQ ID NO: 90583 - RNA, 20 nt, Artificial Sequence
  MKO10090583_B_Gstm4
  gRNA
cugagugagaaguucaaauu

SEQ ID NO: 90584 - RNA, 20 nt, Artificial Sequence
  MKO10090584_B_Gstm4
  gRNA
ugugacccaucaaucaagua

SEQ ID NO: 90585 - RNA, 20 nt, Artificial Sequence
  MKO10090585_B_Gstm5
  gRNA
guaccguuucuccucauagc

SEQ ID NO: 90586 - RNA, 20 nt, Artificial Sequence
  MKO10090586_B_Gstm5
  gRNA
cgugaaauucaagcuagauc

SEQ ID NO: 90587 - RNA, 20 nt, Artificial Sequence
  MKO10090587_B_Gstm5
  gRNA
ugaauuucacguccagccau

SEQ ID NO: 90588 - RNA, 20 nt, Artificial Sequence
  MKO10090588_B_Gstm6
  gRNA
ugaacuugucauucagccac

SEQ ID NO: 90589 - RNA, 20 nt, Artificial Sequence
  MKO10090589_B_Gstm6
  gRNA
ucacgccauccgccugcucc

SEQ ID NO: 90590 - RNA, 20 nt, Artificial Sequence
  MKO10090590_B_Gstm6
  gRNA
aaugucauuaccguccccca

SEQ ID NO: 90591 - RNA, 20 nt, Artificial Sequence
  MKO10090591_B_Gstm7
  gRNA
aaggauccguguggauauuc

SEQ ID NO: 90592 - RNA, 20 nt, Artificial Sequence
  MKO10090592_B_Gstm7
  gRNA
gugugacccaucgaucaagu

SEQ ID NO: 90593 - RNA, 20 nt, Artificial Sequence
  MKO10090593_B_Gstm7
  gRNA
gaugcagucaccaucaccca

SEQ ID NO: 90594 - RNA, 20 nt, Artificial Sequence
  MKO10090594_B_Gsto1
  gRNA
accugaagaauaagcccgag

SEQ ID NO: 90595 - RNA, 20 nt, Artificial Sequence
  MKO10090595_B_Gsto1
  gRNA
aggaagacucuccgaaccua

SEQ ID NO: 90596 - RNA, 20 nt, Artificial Sequence
  MKO10090596_B_Gsto1
  gRNA
cuaugguugauuaucuuacu

SEQ ID NO: 90597 - RNA, 20 nt, Artificial Sequence
  MKO10090597_B_Gsto2
  gRNA
uucccggguagacgucaucc

SEQ ID NO: 90598 - RNA, 20 nt, Artificial Sequence
  MKO10090598_B_Gsto2
  gRNA
caggcgugcccugugcgagu

SEQ ID NO: 90599 - RNA, 20 nt, Artificial Sequence
  MKO10090599_B_Gsto2
  gRNA
cuacucgcacagggcacgcc

SEQ ID NO: 90600 - RNA, 20 nt, Artificial Sequence
  MKO10090600_B_Gstp1
  gRNA
caucauucaccauauccauc

SEQ ID NO: 90601 - RNA, 20 nt, Artificial Sequence
  MKO10090601_B_Gstp1
  gRNA
ucgaacugggaaguagacaa

SEQ ID NO: 90602 - RNA, 20 nt, Artificial Sequence
  MKO10090602_B_Gstp1
  gRNA
gcgaaugcugcuggcugacc

SEQ ID NO: 90603 - RNA, 20 nt, Artificial Sequence
  MKO10090603_B_Gstp2
  gRNA
uggacuugggaaguagacaa

SEQ ID NO: 90604 - RNA, 20 nt, Artificial Sequence
  MKO10090604_B_Gstp2
  gRNA
auugucuacuucccaagucc

SEQ ID NO: 90605 - RNA, 20 nt, Artificial Sequence
  MKO10090605_B_Gstp2
  gRNA
ugggcagcuccccaaguuug

SEQ ID NO: 90606 - RNA, 20 nt, Artificial Sequence
  MKO10090606_B_Gsuu1
  gRNA
ccggucuuaccuuaugccac

SEQ ID NO: 90607 - RNA, 20 nt, Artificial Sequence
  MKO10090607_B_Gsuu1
  gRNA
ccacagcugccuccacucgc

SEQ ID NO: 90608 - RNA, 20 nt, Artificial Sequence
  MKO10090608_B_Gsuu1
  gRNA
ggcugcaugguaccagcgag

SEQ ID NO: 90609 - RNA, 20 nt, Artificial Sequence
  MKO10090609_B_Gsuu2
  gRNA
aauguuaccaguacccccuc

SEQ ID NO: 90610 - RNA, 20 nt, Artificial Sequence
  MKO10090610_B_Gsuu2
  gRNA
gcaugcagcuucgaauugcu

SEQ ID NO: 90611 - RNA, 20 nt, Artificial Sequence
  MKO10090611_B_Gsuu2
  gRNA
cuuuguuuaagcaguucacc

SEQ ID NO: 90612 - RNA, 20 nt, Artificial Sequence
  MKO10090612_B_Gsuu3
  gRNA
uaaggaaggccugguuccgc

SEQ ID NO: 90613 - RNA, 20 nt, Artificial Sequence
  MKO10090613_B_Gsuu3
  gRNA
cccuggugcaacaacuccgc

SEQ ID NO: 90614 - RNA, 20 nt, Artificial Sequence
  MKO10090614_B_Gsuu3
  gRNA
cuuugagagccgacccaaac

SEQ ID NO: 90615 - RNA, 20 nt, Artificial Sequence
  MKO10090615_B_Gsuu4
  gRNA
agaugaacuugccguccuug

SEQ ID NO: 90616 - RNA, 20 nt, Artificial Sequence
  MKO10090616_B_Gsuu4
  gRNA
guugauaaucccaaugauca

SEQ ID NO: 90617 - RNA, 20 nt, Artificial Sequence
  MKO10090617_B_Gsuu4
  gRNA
ucugcacaugcgugcccgcg

SEQ ID NO: 90618 - RNA, 20 nt, Artificial Sequence
  MKO10090618_B_Gstz1
  gRNA
auuuccgaagcuccuguuca

SEQ ID NO: 90619 - RNA, 20 nt, Artificial Sequence
  MKO10090619_B_Gstz1
  gRNA
guugcccgccauccuuuaug

SEQ ID NO: 90620 - RNA, 20 nt, Artificial Sequence
  MKO10090620_B_Gstz1
  gRNA
cuccuagcucuggcguuaaa

SEQ ID NO: 90621 - RNA, 20 nt, Artificial Sequence
  MKO10090621_B_Gsx1
  gRNA
gggcccgugcagcugcgaag

SEQ ID NO: 90622 - RNA, 20 nt, Artificial Sequence
  MKO10090622_B_Gsx1
  gRNA
caguacugcgauccgaaggg

SEQ ID NO: 90623 - RNA, 20 nt, Artificial Sequence
  MKO10090623_B_Gsx1
  gRNA
gucgucguccucugagcauu

SEQ ID NO: 90624 - RNA, 20 nt, Artificial Sequence
  MKO10090624_B_Gsx2
  gRNA
augucgcgaucucgauucuc

SEQ ID NO: 90625 - RNA, 20 nt, Artificial Sequence
  MKO10090625_B_Gsx2
  gRNA
ugggugcgauuccggcagcg

SEQ ID NO: 90626 - RNA, 20 nt, Artificial Sequence
  MKO10090626_B_Gsx2
  gRNA
gggcaaaacugcgcgucccc

SEQ ID NO: 90627 - RNA, 20 nt, Artificial Sequence
  MKO10090627_B_Gtdc1
  gRNA
gcagcucuaccagcugucga

SEQ ID NO: 90628 - RNA, 20 nt, Artificial Sequence
  MKO10090628_B_Gtdc1
  gRNA
ucagauuuccugaugugagc

SEQ ID NO: 90629 - RNA, 20 nt, Artificial Sequence
  MKO10090629_B_Gtdc1
  gRNA
ugaagcugauuccugaucac

SEQ ID NO: 90630 - RNA, 20 nt, Artificial Sequence
  MKO10090630_B_Gtf2a1l
  gRNA
cucggcagaguucuaccagc

SEQ ID NO: 90631 - RNA, 20 nt, Artificial Sequence
  MKO10090631_B_Gtf2a1l
  gRNA
uguaauugaagaugucaucg

SEQ ID NO: 90632 - RNA, 20 nt, Artificial Sequence
  MKO10090632_B_Gtf2a1l
  gRNA
cgugcgggaccuguuugcug

SEQ ID NO: 90633 - RNA, 20 nt, Artificial Sequence
  MKO10090633_B_Gtf2a1
  gRNA
uguuguagcaacuuagaauc

SEQ ID NO: 90634 - RNA, 20 nt, Artificial Sequence
  MKO10090634_B_Gtf2a1
  gRNA
uaugaaugcaucaaguauua

SEQ ID NO: 90635 - RNA, 20 nt, Artificial Sequence
  MKO10090635_B_Gtf2a1
  gRNA
cacuccugcaggcagugcca

SEQ ID NO: 90636 - RNA, 20 nt, Artificial Sequence
  MKO10090636_B_Gtf2a2
  gRNA
guagaacuugaagcgcaagc

SEQ ID NO: 90637 - RNA, 20 nt, Artificial Sequence
  MKO10090637_B_Gtf2a2
  gRNA
gcaccuguaugagcucauca

SEQ ID NO: 90638 - RNA, 20 nt, Artificial Sequence
  MKO10090638_B_Gtf2a2
  gRNA
gugaaaauuguagccuguga

SEQ ID NO: 90639 - RNA, 20 nt, Artificial Sequence
  MKO10090639_B_Gtf2b
  gRNA
acaaaagacccaucuagagu

SEQ ID NO: 90640 - RNA, 20 nt, Artificial Sequence
  MKO10090640_B_Gtf2b
  gRNA
aagccuaccuuuaaaugucc

SEQ ID NO: 90641 - RNA, 20 nt, Artificial Sequence
  MKO10090641_B_Gtf2b
  gRNA
accuacaacuaggccacauu

SEQ ID NO: 90642 - RNA, 20 nt, Artificial Sequence
  MKO10090642_B_Gtf2e1
  gRNA
aaaagaugcucgcacgcuuu

SEQ ID NO: 90643 - RNA, 20 nt, Artificial Sequence
  MKO10090643_B_Gtf2e1
  gRNA
acuuccagguggcaucgaug

SEQ ID NO: 90644 - RNA, 20 nt, Artificial Sequence
  MKO10090644_B_Gtf2e1
  gRNA
gcucaaugccauaaaagccc

SEQ ID NO: 90645 - RNA, 20 nt, Artificial Sequence
  MKO10090645_B_Gtf2e2
  gRNA
caauccuaaaauugaaguag

SEQ ID NO: 90646 - RNA, 20 nt, Artificial Sequence
  MKO10090646_B_Gtf2e2
  gRNA
uuuaacuugaaagcucuguc

SEQ ID NO: 90647 - RNA, 20 nt, Artificial Sequence
  MKO10090647_B_Gtf2e2
  gRNA
agaaucucuuccaacguuag

SEQ ID NO: 90648 - RNA, 20 nt, Artificial Sequence
  MKO10090648_B_Gtf2f1
  gRNA
aaauuguaccaguucuguac

SEQ ID NO: 90649 - RNA, 20 nt, Artificial Sequence
  MKO10090649_B_Gtf2f1
  gRNA
cggggacuuacuuggggacu

SEQ ID NO: 90650 - RNA, 20 nt, Artificial Sequence
  MKO10090650_B_Gtf2f1
  gRNA
acaccgcacacucacugcug

SEQ ID NO: 90651 - RNA, 20 nt, Artificial Sequence
  MKO10090651_B_Gtf2f2
  gRNA
cauucaagauaaacugucau

SEQ ID NO: 90652 - RNA, 20 nt, Artificial Sequence
  MKO10090652_B_Gtf2f2
  gRNA
cuaaauauuugucccagcaa

SEQ ID NO: 90653 - RNA, 20 nt, Artificial Sequence
  MKO10090653_B_Gtf2f2
  gRNA
aggaauaguggugcagagag

SEQ ID NO: 90654 - RNA, 20 nt, Artificial Sequence
  MKO10090654_B_Gtf2h1
  gRNA
ccccaaacggauggcuguaa

SEQ ID NO: 90655 - RNA, 20 nt, Artificial Sequence
  MKO10090655_B_Gtf2h1
  gRNA
gaccauuacagccauccguu

SEQ ID NO: 90656 - RNA, 20 nt, Artificial Sequence
  MKO10090656_B_Gtf2h1
  gRNA
accaacauccugcuugugac

SEQ ID NO: 90657 - RNA, 20 nt, Artificial Sequence
  MKO10090657_B_Gtf2h2
  gRNA
gguggauggaucgagaacaa

SEQ ID NO: 90658 - RNA, 20 nt, Artificial Sequence
  MKO10090658_B_Gtf2h2
  gRNA
ccuaacauaccauuccaagu

SEQ ID NO: 90659 - RNA, 20 nt, Artificial Sequence
  MKO10090659_B_Gtf2h2
  gRNA
aacagaguguuugagcacca

SEQ ID NO: 90660 - RNA, 20 nt, Artificial Sequence
  MKO10090660_B_Gtf2h3
  gRNA
ccaguagugucuccguaugc

SEQ ID NO: 90661 - RNA, 20 nt, Artificial Sequence
  MKO10090661_B_Gtf2h3
  gRNA
ugucaacuaugaucaccaga

SEQ ID NO: 90662 - RNA, 20 nt, Artificial Sequence
  MKO10090662_B_Gtf2h3
  gRNA
ccagcauacggagacacuac

SEQ ID NO: 90663 - RNA, 20 nt, Artificial Sequence
  MKO10090663_B_Gtf2h4
  gRNA
uuacagggagcuccccucuu

SEQ ID NO: 90664 - RNA, 20 nt, Artificial Sequence
  MKO10090664_B_Gtf2h4
  gRNA
ugcccgggacguccccucac

SEQ ID NO: 90665 - RNA, 20 nt, Artificial Sequence
  MKO10090665_B_Gtf2h4
  gRNA
gccaccgcagccugugguag

SEQ ID NO: 90666 - RNA, 20 nt, Artificial Sequence
  MKO10090666_B_Gtf2h5
  gRNA
aacguccuccaggagcgagu

SEQ ID NO: 90667 - RNA, 20 nt, Artificial Sequence
  MKO10090667_B_Gtf2h5
  gRNA
gaagcaguucuugcuguacu

SEQ ID NO: 90668 - RNA, 20 nt, Artificial Sequence
  MKO10090668_B_Gtf2h5
  gRNA
aaugaugaacuucuucccca

SEQ ID NO: 90669 - RNA, 20 nt, Artificial Sequence
  MKO10090669_B_Gtf2ird1
  gRNA
cugcuucuggaucguuccac

SEQ ID NO: 90670 - RNA, 20 nt, Artificial Sequence
  MKO10090670_B_Gtf2ird1
  gRNA
uccugagcuuaaaccgaauu

SEQ ID NO: 90671 - RNA, 20 nt, Artificial Sequence
  MKO10090671_B_Gtf2ird1
  gRNA
cucauuguguaccgccacgc

SEQ ID NO: 90672 - RNA, 20 nt, Artificial Sequence
  MKO10090672_B_Gtf2ird2
  gRNA
ucccuacgagcagaugcuac

SEQ ID NO: 90673 - RNA, 20 nt, Artificial Sequence
  MKO10090673_B_Gtf2ird2
  gRNA
gcacggcucuccugagcagc

SEQ ID NO: 90674 - RNA, 20 nt, Artificial Sequence
  MKO10090674_B_Gtf2ird2
  gRNA
guguuugcaggccaggggga

SEQ ID NO: 90675 - RNA, 20 nt, Artificial Sequence
  MKO10090675_B_Gtf2i
  gRNA
gagaccgacguguuuguugu

SEQ ID NO: 90676 - RNA, 20 nt, Artificial Sequence
  MKO10090676_B_Gtf2i
  gRNA
gcaaggcagacaucacuacu

SEQ ID NO: 90677 - RNA, 20 nt, Artificial Sequence
  MKO10090677_B_Gtf2i
  gRNA
gacaaaagcacgcccucuuu

SEQ ID NO: 90678 - RNA, 20 nt, Artificial Sequence
  MKO10090678_B_Gtf3a
  gRNA
agcacuuugccucgcccagc

SEQ ID NO: 90679 - RNA, 20 nt, Artificial Sequence
  MKO10090679_B_Gtf3a
  gRNA
caaccugaagagcggcucgc

SEQ ID NO: 90680 - RNA, 20 nt, Artificial Sequence
  MKO10090680_B_Gtf3a
  gRNA
cccucauagucgcaaacaaa

SEQ ID NO: 90681 - RNA, 20 nt, Artificial Sequence
  MKO10090681_B_Gtf3c1
  gRNA
gggcuccugccgauacuuua

SEQ ID NO: 90682 - RNA, 20 nt, Artificial Sequence
  MKO10090682_B_Gtf3c1
  gRNA
uucuccugcaggguugacgc

SEQ ID NO: 90683 - RNA, 20 nt, Artificial Sequence
  MKO10090683_B_Gtf3c1
  gRNA
gcuugcccagagucucaauc

SEQ ID NO: 90684 - RNA, 20 nt, Artificial Sequence
  MKO10090684_B_Gtf3c2
  gRNA
uggacaacuucaauaguagc

SEQ ID NO: 90685 - RNA, 20 nt, Artificial Sequence
  MKO10090685_B_Gtf3c2
  gRNA
gauggagguuuacguugcug

SEQ ID NO: 90686 - RNA, 20 nt, Artificial Sequence
  MKO10090686_B_Gtf3c2
  gRNA
uggcuuacccaauuacauca

SEQ ID NO: 90687 - RNA, 20 nt, Artificial Sequence
  MKO10090687_B_Gtf3c3
  gRNA
ggcagagucaauuccugaug

SEQ ID NO: 90688 - RNA, 20 nt, Artificial Sequence
  MKO10090688_B_Gtf3c3
  gRNA
cgauguauuuguguuggaga

SEQ ID NO: 90689 - RNA, 20 nt, Artificial Sequence
  MKO10090689_B_Gtf3c3
  gRNA
uccuuaggagaaacaucaga

SEQ ID NO: 90690 - RNA, 20 nt, Artificial Sequence
  MKO10090690_B_Gtf3c4
  gRNA
ugcuccaugacagcaucgcc

SEQ ID NO: 90691 - RNA, 20 nt, Artificial Sequence
  MKO10090691_B_Gtf3c4
  gRNA
agcaaccucuuaauccaguc

SEQ ID NO: 90692 - RNA, 20 nt, Artificial Sequence
  MKO10090692_B_Gtf3c4
  gRNA
cagauccugacuggauuaag

SEQ ID NO: 90693 - RNA, 20 nt, Artificial Sequence
  MKO10090693_B_Gtf3c5
  gRNA
gcgauagaaauaguccacag

SEQ ID NO: 90694 - RNA, 20 nt, Artificial Sequence
  MKO10090694_B_Gtf3c5
  gRNA
ucuuugacauccguccuguu

SEQ ID NO: 90695 - RNA, 20 nt, Artificial Sequence
  MKO10090695_B_Gtf3c5
  gRNA
cugugugcacugccaaguac

SEQ ID NO: 90696 - RNA, 20 nt, Artificial Sequence
  MKO10090696_B_Gtf3c6
  gRNA
ccaccaggagcaguuuguuc

SEQ ID NO: 90697 - RNA, 20 nt, Artificial Sequence
  MKO10090697_B_Gtf3c6
  gRNA
ucuguuauagggaauugaca

SEQ ID NO: 90698 - RNA, 20 nt, Artificial Sequence
  MKO10090698_B_Gtf3c6
  gRNA
accuucuucaaauauaacac

SEQ ID NO: 90699 - RNA, 20 nt, Artificial Sequence
  MKO10090699_B_Gtl3
  gRNA
cacauacaucacguguccug

SEQ ID NO: 90700 - RNA, 20 nt, Artificial Sequence
  MKO10090700_B_Gtl3
  gRNA
acuuuggccuuguucugaac

SEQ ID NO: 90701 - RNA, 20 nt, Artificial Sequence
  MKO10090701_B_Gtl3
  gRNA
ucccuucaaucucuagcacc

SEQ ID NO: 90702 - RNA, 20 nt, Artificial Sequence
  MKO10090702_B_Gtpbp10
  gRNA
ccggaggaggagcaaacagu

SEQ ID NO: 90703 - RNA, 20 nt, Artificial Sequence
  MKO10090703_B_Gtpbp10
  gRNA
ccgacuguuugcuccuccuc

SEQ ID NO: 90704 - RNA, 20 nt, Artificial Sequence
  MKO10090704_B_Gtpbp10
  gRNA
ucaguuacugagauacccac

SEQ ID NO: 90705 - RNA, 20 nt, Artificial Sequence
  MKO10090705_B_Gtpbp1
  gRNA
guggccagccaagucgauga

SEQ ID NO: 90706 - RNA, 20 nt, Artificial Sequence
  MKO10090706_B_Gtpbp1
  gRNA
ucucccacaucugccgaagu

SEQ ID NO: 90707 - RNA, 20 nt, Artificial Sequence
  MKO10090707_B_Gtpbp1
  gRNA
agcaguaugacagccuacuu

SEQ ID NO: 90708 - RNA, 20 nt, Artificial Sequence
  MKO10090708_B_Gtpbp2
  gRNA
gcgcauacuucucugccauc

SEQ ID NO: 90709 - RNA, 20 nt, Artificial Sequence
  MKO10090709_B_Gtpbp2
  gRNA
ucaguaccgcuuugagcacu

SEQ ID NO: 90710 - RNA, 20 nt, Artificial Sequence
  MKO10090710_B_Gtpbp2
  gRNA
agcuggacaacgggcggggc

SEQ ID NO: 90711 - RNA, 20 nt, Artificial Sequence
  MKO10090711_B_Gtpbp3
  gRNA
ugcguggaguuucacguaca

SEQ ID NO: 90712 - RNA, 20 nt, Artificial Sequence
  MKO10090712_B_Gtpbp3
  gRNA
gccucagagccugucgacgc

SEQ ID NO: 90713 - RNA, 20 nt, Artificial Sequence
  MKO10090713_B_Gtpbp3
  gRNA
ggccuacauugacuucggag

SEQ ID NO: 90714 - RNA, 20 nt, Artificial Sequence
  MKO10090714_B_Gtpbp4
  gRNA
uaauguuuaugaauaaccgu

SEQ ID NO: 90715 - RNA, 20 nt, Artificial Sequence
  MKO10090715_B_Gtpbp4
  gRNA
accaaccuuguugaugaagc

SEQ ID NO: 90716 - RNA, 20 nt, Artificial Sequence
  MKO10090716_B_Gtpbp4
  gRNA
gaaauccagcuucaucaaca

SEQ ID NO: 90717 - RNA, 20 nt, Artificial Sequence
  MKO10090717_B_Gtpbp6
  gRNA
cccucgugcgugcguuacaa

SEQ ID NO: 90718 - RNA, 20 nt, Artificial Sequence
  MKO10090718_B_Gtpbp6
  gRNA
uaccugaccccaugauguac

SEQ ID NO: 90719 - RNA, 20 nt, Artificial Sequence
  MKO10090719_B_Gtpbp6
  gRNA
cacaagggaaccuuggucgg

SEQ ID NO: 90720 - RNA, 20 nt, Artificial Sequence
  MKO10090720_B_Gtpbp8
  gRNA
agaauuugcauugccuuaug

SEQ ID NO: 90721 - RNA, 20 nt, Artificial Sequence
  MKO10090721_B_Gtpbp8
  gRNA
cagccuuagcacuucugcga

SEQ ID NO: 90722 - RNA, 20 nt, Artificial Sequence
  MKO10090722_B_Gtpbp8
  gRNA
uggccccugauguagaaguc

SEQ ID NO: 90723 - RNA, 20 nt, Artificial Sequence
  MKO10090723_B_Gtse1
  gRNA
accuguagacaccagacucg

SEQ ID NO: 90724 - RNA, 20 nt, Artificial Sequence
  MKO10090724_B_Gtse1
  gRNA
aagaugcauugcugccaguu

SEQ ID NO: 90725 - RNA, 20 nt, Artificial Sequence
  MKO10090725_B_Gtse1
  gRNA
ucugcuucaagccucgaguc

SEQ ID NO: 90726 - RNA, 20 nt, Artificial Sequence
  MKO10090726_B_Gtsf1l
  gRNA
ccucccacagccgcagaacc

SEQ ID NO: 90727 - RNA, 20 nt, Artificial Sequence
  MKO10090727_B_Gtsf1l
  gRNA
aacgaaccuguagugugucc

SEQ ID NO: 90728 - RNA, 20 nt, Artificial Sequence
  MKO10090728_B_Gtsf1l
  gRNA
gcaggcguuguauuuacagc

SEQ ID NO: 90729 - RNA, 20 nt, Artificial Sequence
  MKO10090729_B_Gtsf1
  gRNA
gcccuccuugugaugaagac

SEQ ID NO: 90730 - RNA, 20 nt, Artificial Sequence
  MKO10090730_B_Gtsf1
  gRNA
agacuagcaccccauuuguc

SEQ ID NO: 90731 - RNA, 20 nt, Artificial Sequence
  MKO10090731_B_Gtsf1
  gRNA
gucuugcagucaaccaaacc

SEQ ID NO: 90732 - RNA, 20 nt, Artificial Sequence
  MKO10090732_B_Guca1a
  gRNA
uucaagcucuacgacgucga

SEQ ID NO: 90733 - RNA, 20 nt, Artificial Sequence
  MKO10090733_B_Guca1a
  gRNA
gcacgaugccggucaagucc

SEQ ID NO: 90734 - RNA, 20 nt, Artificial Sequence
  MKO10090734_B_Guca1a
  gRNA
aaguggaacagaaguugcgc

SEQ ID NO: 90735 - RNA, 20 nt, Artificial Sequence
  MKO10090735_B_Guca1b
  gRNA
ccuuaccccauucuugucga

SEQ ID NO: 90736 - RNA, 20 nt, Artificial Sequence
  MKO10090736_B_Guca1b
  gRNA
gggccagcugcucacgcccg

SEQ ID NO: 90737 - RNA, 20 nt, Artificial Sequence
  MKO10090737_B_Guca1b
  gRNA
cgucuccauucucguccacc

SEQ ID NO: 90738 - RNA, 20 nt, Artificial Sequence
  MKO10090738_B_Guca2a
  gRNA
gcacagugaccccuucuacc

SEQ ID NO: 90739 - RNA, 20 nt, Artificial Sequence
  MKO10090739_B_Guca2a
  gRNA
cugugccuacgcugccugua

SEQ ID NO: 90740 - RNA, 20 nt, Artificial Sequence
  MKO10090740_B_Guca2a
  gRNA
gccuuggcuguccugguaga

SEQ ID NO: 90741 - RNA, 20 nt, Artificial Sequence
  MKO10090741_B_Guca2b
  gRNA
agauguccaauccccagccu

SEQ ID NO: 90742 - RNA, 20 nt, Artificial Sequence
  MKO10090742_B_Guca2b
  gRNA
auccuuacucaaggccuuga

SEQ ID NO: 90743 - RNA, 20 nt, Artificial Sequence
  MKO10090743_B_Guca2b
  gRNA
agacacccugugcacucugc

SEQ ID NO: 90744 - RNA, 20 nt, Artificial Sequence
  MKO10090744_B_Gucd1
  gRNA
uaccugggccagcucgacga

SEQ ID NO: 90745 - RNA, 20 nt, Artificial Sequence
  MKO10090745_B_Gucd1
  gRNA
cgcucaccgaagcaccaucc

SEQ ID NO: 90746 - RNA, 20 nt, Artificial Sequence
  MKO10090746_B_Gucd1
  gRNA
ucauccagcagcuauaucac

SEQ ID NO: 90747 - RNA, 20 nt, Artificial Sequence
  MKO10090747_B_Gucy1a2
  gRNA
ugcucaguguacucccaugc

SEQ ID NO: 90748 - RNA, 20 nt, Artificial Sequence
  MKO10090748_B_Gucy1a2
  gRNA
acaagauuugaucaccagug

SEQ ID NO: 90749 - RNA, 20 nt, Artificial Sequence
  MKO10090749_B_Gucy1a2
  gRNA
cagugcacugcuaauguacu

SEQ ID NO: 90750 - RNA, 20 nt, Artificial Sequence
  MKO10090750_B_Gucy1a3
  gRNA
agcaucgugaugaccugcag

SEQ ID NO: 90751 - RNA, 20 nt, Artificial Sequence
  MKO10090751_B_Gucy1a3
  gRNA
gcagaagaagcaauugcagc

SEQ ID NO: 90752 - RNA, 20 nt, Artificial Sequence
  MKO10090752_B_Gucy1a3
  gRNA
ccuugcacuucagagaaccu

SEQ ID NO: 90753 - RNA, 20 nt, Artificial Sequence
  MKO10090753_B_Gucy1b2
  gRNA
uuggaugagcuuaacgguga

SEQ ID NO: 90754 - RNA, 20 nt, Artificial Sequence
  MKO10090754_B_Gucy1b2
  gRNA
agacacgacgcuggacacca

SEQ ID NO: 90755 - RNA, 20 nt, Artificial Sequence
  MKO10090755_B_Gucy1b2
  gRNA
ugucuuacccagagccuugc

SEQ ID NO: 90756 - RNA, 20 nt, Artificial Sequence
  MKO10090756_B_Gucy1b3
  gRNA
ugauaccaucuugcgugucc

SEQ ID NO: 90757 - RNA, 20 nt, Artificial Sequence
  MKO10090757_B_Gucy1b3
  gRNA
aaggaaggcgcgcgcauccc

SEQ ID NO: 90758 - RNA, 20 nt, Artificial Sequence
  MKO10090758_B_Gucy1b3
  gRNA
uacaaaacagaccucaaugc

SEQ ID NO: 90759 - RNA, 20 nt, Artificial Sequence
  MKO10090759_B_Gucy2c
  gRNA
ugacuuaugaaucagaccgu

SEQ ID NO: 90760 - RNA, 20 nt, Artificial Sequence
  MKO10090760_B_Gucy2c
  gRNA
gauaguucaacucugugucg

SEQ ID NO: 90761 - RNA, 20 nt, Artificial Sequence
  MKO10090761_B_Gucy2c
  gRNA
uguacuucuuggucgauuuc

SEQ ID NO: 90762 - RNA, 20 nt, Artificial Sequence
  MKO10090762_B_Gucy2d
  gRNA
ggcaaagagcagcgugucgu

SEQ ID NO: 90763 - RNA, 20 nt, Artificial Sequence
  MKO10090763_B_Gucy2d
  gRNA
gacagugaguacugcgucau

SEQ ID NO: 90764 - RNA, 20 nt, Artificial Sequence
  MKO10090764_B_Gucy2d
  gRNA
caaagaggucaccaguccga

SEQ ID NO: 90765 - RNA, 20 nt, Artificial Sequence
  MKO10090765_B_Gucy2e
  gRNA
caacgucaagaugaucuugu

SEQ ID NO: 90766 - RNA, 20 nt, Artificial Sequence
  MKO10090766_B_Gucy2e
  gRNA
agacuugugcuucccguacu

SEQ ID NO: 90767 - RNA, 20 nt, Artificial Sequence
  MKO10090767_B_Gucy2e
  gRNA
caacaagaucaucuugacgu

SEQ ID NO: 90768 - RNA, 20 nt, Artificial Sequence
  MKO10090768_B_Gucy2f
  gRNA
cugccgccagggaaaugaau

SEQ ID NO: 90769 - RNA, 20 nt, Artificial Sequence
  MKO10090769_B_Gucy2f
  gRNA
uguuggguccuuuaaucaac

SEQ ID NO: 90770 - RNA, 20 nt, Artificial Sequence
  MKO10090770_B_Gucy2f
  gRNA
uacuuaccuuacugccaaag

SEQ ID NO: 90771 - RNA, 20 nt, Artificial Sequence
  MKO10090771_B_Gucy2g
  gRNA
guggaccugggacucgacac

SEQ ID NO: 90772 - RNA, 20 nt, Artificial Sequence
  MKO10090772_B_Gucy2g
  gRNA
aaacaccgacucauagacuu

SEQ ID NO: 90773 - RNA, 20 nt, Artificial Sequence
  MKO10090773_B_Gucy2g
  gRNA
cauccuccgagcugcagauu

SEQ ID NO: 90774 - RNA, 20 nt, Artificial Sequence
  MKO10090774_B_Guf1
  gRNA
uuucaguaucauugcacaug

SEQ ID NO: 90775 - RNA, 20 nt, Artificial Sequence
  MKO10090775_B_Guf1
  gRNA
ggguauucaagcucaaacug

SEQ ID NO: 90776 - RNA, 20 nt, Artificial Sequence
  MKO10090776_B_Guf1
  gRNA
auaaaauaccuguuagcucc

SEQ ID NO: 90777 - RNA, 20 nt, Artificial Sequence
  MKO10090777_B_Guk1
  gRNA
acuacaaggaacccacgacc

SEQ ID NO: 90778 - RNA, 20 nt, Artificial Sequence
  MKO10090778_B_Guk1
  gRNA
cagcccaccuugucccguac

SEQ ID NO: 90779 - RNA, 20 nt, Artificial Sequence
  MKO10090779_B_Guk1
  gRNA
augcagcgugauauugcagc

SEQ ID NO: 90780 - RNA, 20 nt, Artificial Sequence
  MKO10090780_B_Gulo
  gRNA
gcacgguauccuggccaccc

SEQ ID NO: 90781 - RNA, 20 nt, Artificial Sequence
  MKO10090781_B_Gulo
  gRNA
caaaacugggcgaagaccua

SEQ ID NO: 90782 - RNA, 20 nt, Artificial Sequence
  MKO10090782_B_Gulo
  gRNA
accaaccgucacaucagaca

SEQ ID NO: 90783 - RNA, 20 nt, Artificial Sequence
  MKO10090783_B_Gulp1
  gRNA
aauucucgaacccaaaacaa

SEQ ID NO: 90784 - RNA, 20 nt, Artificial Sequence
  MKO10090784_B_Gulp1
  gRNA
gaauugcaaauaucaauuua

SEQ ID NO: 90785 - RNA, 20 nt, Artificial Sequence
  MKO10090785_B_Gulp1
  gRNA
cagaugauaaaacugacaag

SEQ ID NO: 90786 - RNA, 20 nt, Artificial Sequence
  MKO10090786_B_Gusb
  gRNA
gguggcaaagucguggccca

SEQ ID NO: 90787 - RNA, 20 nt, Artificial Sequence
  MKO10090787_B_Gusb
  gRNA
agugauaucaucgauguaag

SEQ ID NO: 90788 - RNA, 20 nt, Artificial Sequence
  MKO10090788_B_Gusb
  gRNA
uccccggcggaaggguauga

SEQ ID NO: 90789 - RNA, 20 nt, Artificial Sequence
  MKO10090789_B_Gvin1
  gRNA
cugaaagccuugcagucaga

SEQ ID NO: 90790 - RNA, 20 nt, Artificial Sequence
  MKO10090790_B_Gvin1
  gRNA
cacuguggucuccuucaugc

SEQ ID NO: 90791 - RNA, 20 nt, Artificial Sequence
  MKO10090791_B_Gvin1
  gRNA
cuacaguucacagucagugc

SEQ ID NO: 90792 - RNA, 20 nt, Artificial Sequence
  MKO10090792_B_Gxylt1
  gRNA
aguugacucacuguuguaug

SEQ ID NO: 90793 - RNA, 20 nt, Artificial Sequence
  MKO10090793_B_Gxylt1
  gRNA
uuugcccggcacccguacua

SEQ ID NO: 90794 - RNA, 20 nt, Artificial Sequence
  MKO10090794_B_Gxylt1
  gRNA
gcaaagauguggacgugcag

SEQ ID NO: 90795 - RNA, 20 nt, Artificial Sequence
  MKO10090795_B_Gxylt2
  gRNA
ugcaagcuccucguuucccc

SEQ ID NO: 90796 - RNA, 20 nt, Artificial Sequence
  MKO10090796_B_Gxylt2
  gRNA
cuaccgggagaaagagccuc

SEQ ID NO: 90797 - RNA, 20 nt, Artificial Sequence
  MKO10090797_B_Gxylt2
  gRNA
uuuccgacggaaaaugugau

SEQ ID NO: 90798 - RNA, 20 nt, Artificial Sequence
  MKO10090798_B_Gyg
  gRNA
acaaacgaugccuaugccaa

SEQ ID NO: 90799 - RNA, 20 nt, Artificial Sequence
  MKO10090799_B_Gyg
  gRNA
uggccugacuguuucaauuc

SEQ ID NO: 90800 - RNA, 20 nt, Artificial Sequence
  MKO10090800_B_Gyg
  gRNA
acuccagaauugaaacaguc

SEQ ID NO: 90801 - RNA, 20 nt, Artificial Sequence
  MKO10090801_B_Gykl1
  gRNA
cauccaaaaucucccgcguu

SEQ ID NO: 90802 - RNA, 20 nt, Artificial Sequence
  MKO10090802_B_Gykl1
  gRNA
agacuaucguaguuucccgc

SEQ ID NO: 90803 - RNA, 20 nt, Artificial Sequence
  MKO10090803_B_Gykl1
  gRNA
cgguugauucguggcuuauc

SEQ ID NO: 90804 - RNA, 20 nt, Artificial Sequence
  MKO10090804_B_Gyk
  gRNA
agccgcgaagaaagcaguuc

SEQ ID NO: 90805 - RNA, 20 nt, Artificial Sequence
  MKO10090805_B_Gyk
  gRNA
auggguagaacaagacccga

SEQ ID NO: 90806 - RNA, 20 nt, Artificial Sequence
  MKO10090806_B_Gyk
  gRNA
acagacugcagaauuuccuu

SEQ ID NO: 90807 - RNA, 20 nt, Artificial Sequence
  MKO10090807_B_Gyltl1b
  gRNA
ccauugcccgggggcgaccu

SEQ ID NO: 90808 - RNA, 20 nt, Artificial Sequence
  MKO10090808_B_Gyltl1b
  gRNA
cgaagucccugcuauucuac

SEQ ID NO: 90809 - RNA, 20 nt, Artificial Sequence
  MKO10090809_B_Gyltl1b
  gRNA
uagaagcugaccaccaccgc

SEQ ID NO: 90810 - RNA, 20 nt, Artificial Sequence
  MKO10090810_B_Gypa
  gRNA
aacgcagcagacacuucagu

SEQ ID NO: 90811 - RNA, 20 nt, Artificial Sequence
  MKO10090811_B_Gypa
  gRNA
ucuucaaauaaccacuccug

SEQ ID NO: 90812 - RNA, 20 nt, Artificial Sequence
  MKO10090812_B_Gypa
  gRNA
ucuugguaauguugacuuga

SEQ ID NO: 90813 - RNA, 20 nt, Artificial Sequence
  MKO10090813_B_Gypc
  gRNA
ccgcguggcaaugagcagcc

SEQ ID NO: 90814 - RNA, 20 nt, Artificial Sequence
  MKO10090814_B_Gypc
  gRNA
agguacccuugugccuguac

SEQ ID NO: 90815 - RNA, 20 nt, Artificial Sequence
  MKO10090815_B_Gypc
  gRNA
uuauccacagagccuaaccc

SEQ ID NO: 90816 - RNA, 20 nt, Artificial Sequence
  MKO10090816_B_Gys1
  gRNA
aucccagaucaccgcaaucg

SEQ ID NO: 90817 - RNA, 20 nt, Artificial Sequence
  MKO10090817_B_Gys1
  gRNA
ggugacaacuacuaucuggu

SEQ ID NO: 90818 - RNA, 20 nt, Artificial Sequence
  MKO10090818_B_Gys1
  gRNA
gccgaacaggacagcgucau

SEQ ID NO: 90819 - RNA, 20 nt, Artificial Sequence
  MKO10090819_B_Gys2
  gRNA
augcccgcuccaugcaguag

SEQ ID NO: 90820 - RNA, 20 nt, Artificial Sequence
  MKO10090820_B_Gys2
  gRNA
gauauaccaccgcuacugca

SEQ ID NO: 90821 - RNA, 20 nt, Artificial Sequence
  MKO10090821_B_Gys2
  gRNA
ccaaaacgacagccgaugag

SEQ ID NO: 90822 - RNA, 20 nt, Artificial Sequence
  MKO10090822_B_Gzf1
  gRNA
ucagaucgauuacuaucuuu

SEQ ID NO: 90823 - RNA, 20 nt, Artificial Sequence
  MKO10090823_B_Gzf1
  gRNA
ccguguggacuuuaauaugc

SEQ ID NO: 90824 - RNA, 20 nt, Artificial Sequence
  MKO10090824_B_Gzf1
  gRNA
cacuuacugagguaugccuc

SEQ ID NO: 90825 - RNA, 20 nt, Artificial Sequence
  MKO10090825_B_Gzma
  gRNA
cuaugaugaauauacacgug

SEQ ID NO: 90826 - RNA, 20 nt, Artificial Sequence
  MKO10090826_B_Gzma
  gRNA
ggaaccagaugccgaguagc

SEQ ID NO: 90827 - RNA, 20 nt, Artificial Sequence
  MKO10090827_B_Gzma
  gRNA
ucucagauaaacaccucaau

SEQ ID NO: 90828 - RNA, 20 nt, Artificial Sequence
  MKO10090828_B_Gzmb
  gRNA
cuucacauugacauugcgcc

SEQ ID NO: 90829 - RNA, 20 nt, Artificial Sequence
  MKO10090829_B_Gzmb
  gRNA
gacccagcaagucaucccua

SEQ ID NO: 90830 - RNA, 20 nt, Artificial Sequence
  MKO10090830_B_Gzmb
  gRNA
cccgcuuguguguaaaaaag

SEQ ID NO: 90831 - RNA, 20 nt, Artificial Sequence
  MKO10090831_B_Gzmc
  gRNA
gucuccuacgggcaaacuga

SEQ ID NO: 90832 - RNA, 20 nt, Artificial Sequence
  MKO10090832_B_Gzmc
  gRNA
caucaggauuauagucugga

SEQ ID NO: 90833 - RNA, 20 nt, Artificial Sequence
  MKO10090833_B_Gzmc
  gRNA
cgcaaugcucaugugaagcc

SEQ ID NO: 90834 - RNA, 20 nt, Artificial Sequence
  MKO10090834_B_Gzmd
  gRNA
ugaccaguugaaccucucgc

SEQ ID NO: 90835 - RNA, 20 nt, Artificial Sequence
  MKO10090835_B_Gzmd
  gRNA
aagauaguagcauuauaauc

SEQ ID NO: 90836 - RNA, 20 nt, Artificial Sequence
  MKO10090836_B_Gzmd
  gRNA
ggcccacaacaucacggcua

SEQ ID NO: 90837 - RNA, 20 nt, Artificial Sequence
  MKO10090837_B_Gzme
  gRNA
gugugugacaacaaagcuua

SEQ ID NO: 90838 - RNA, 20 nt, Artificial Sequence
  MKO10090838_B_Gzme
  gRNA
gagauacuguggaggcuucu

SEQ ID NO: 90839 - RNA, 20 nt, Artificial Sequence
  MKO10090839_B_Gzme
  gRNA
ucugcccacagggugacucu

SEQ ID NO: 90840 - RNA, 20 nt, Artificial Sequence
  MKO10090840_B_Gzmf
  gRNA
gauuguccuguuuagcccau

SEQ ID NO: 90841 - RNA, 20 nt, Artificial Sequence
  MKO10090841_B_Gzmf
  gRNA
acugaucauccagaaggaua

SEQ ID NO: 90842 - RNA, 20 nt, Artificial Sequence
  MKO10090842_B_Gzmf
  gRNA
aagaucuuccugccuacgag

SEQ ID NO: 90843 - RNA, 20 nt, Artificial Sequence
  MKO10090843_B_Gzmg
  gRNA
aaaaguacaggcuccuuacg

SEQ ID NO: 90844 - RNA, 20 nt, Artificial Sequence
  MKO10090844_B_Gzmg
  gRNA
ccaugcuuucuauuaaaagc

SEQ ID NO: 90845 - RNA, 20 nt, Artificial Sequence
  MKO10090845_B_Gzmg
  gRNA
gaaauacugcggaggcuucu

SEQ ID NO: 90846 - RNA, 20 nt, Artificial Sequence
  MKO10090846_B_Gzmk
  gRNA
ucccuccaauaauuucagua

SEQ ID NO: 90847 - RNA, 20 nt, Artificial Sequence
  MKO10090847_B_Gzmk
  gRNA
caaucucaaugugcacguga

SEQ ID NO: 90848 - RNA, 20 nt, Artificial Sequence
  MKO10090848_B_Gzmk
  gRNA
uaccgcagcaagcauauuug

SEQ ID NO: 90849 - RNA, 20 nt, Artificial Sequence
  MKO10090849_B_Gzmm
  gRNA
uaccuucugccggcuuggau

SEQ ID NO: 90850 - RNA, 20 nt, Artificial Sequence
  MKO10090850_B_Gzmm
  gRNA
gggauacucacggcucagac

SEQ ID NO: 90851 - RNA, 20 nt, Artificial Sequence
  MKO10090851_B_Gzmm
  gRNA
cccgcaccuuaagcagugcc

SEQ ID NO: 90852 - RNA, 20 nt, Artificial Sequence
  MKO10090852_B_Gzmn
  gRNA
aaguuccuguggcggcuucc

SEQ ID NO: 90853 - RNA, 20 nt, Artificial Sequence
  MKO10090853_B_Gzmn
  gRNA
gacuccugaagagaucuucu

SEQ ID NO: 90854 - RNA, 20 nt, Artificial Sequence
  MKO10090854_B_Gzmn
  gRNA
acguccaucaauaccacuga

SEQ ID NO: 90855 - RNA, 20 nt, Artificial Sequence
  MKO10090855_B_H13
  gRNA
guccauguauuucuucgugc

SEQ ID NO: 90856 - RNA, 20 nt, Artificial Sequence
  MKO10090856_B_H13
  gRNA
gcaagagguugauguacucc

SEQ ID NO: 90857 - RNA, 20 nt, Artificial Sequence
  MKO10090857_B_H13
  gRNA
caucgccagcugcacacucc

SEQ ID NO: 90858 - RNA, 20 nt, Artificial Sequence
  MKO10090858_B_H1f0
  gRNA
ccaagggcgaugagcccaaa

SEQ ID NO: 90859 - RNA, 20 nt, Artificial Sequence
  MKO10090859_B_H1f0
  gRNA
ggagguggaguucucgguca

SEQ ID NO: 90860 - RNA, 20 nt, Artificial Sequence
  MKO10090860_B_H1f0
  gRNA
cuugaaagccaccgaccuuu

SEQ ID NO: 90861 - RNA, 20 nt, Artificial Sequence
  MKO10090861_B_H1fnt
  gRNA
gggacaaucccgguugacgc

SEQ ID NO: 90862 - RNA, 20 nt, Artificial Sequence
  MKO10090862_B_H1fnt
  gRNA
gcgucgcaaggcagccaaga

SEQ ID NO: 90863 - RNA, 20 nt, Artificial Sequence
  MKO10090863_B_H1fnt
  gRNA
aguggcugcccagcgucaac

SEQ ID NO: 90864 - RNA, 20 nt, Artificial Sequence
  MKO10090864_B_H1foo
  gRNA
guaccuguugaagcaagcuc

SEQ ID NO: 90865 - RNA, 20 nt, Artificial Sequence
  MKO10090865_B_H1foo
  gRNA
ucccacugcguuugaccuuc

SEQ ID NO: 90866 - RNA, 20 nt, Artificial Sequence
  MKO10090866_B_H1foo
  gRNA
aggugagaaaucgaagcccu

SEQ ID NO: 90867 - RNA, 20 nt, Artificial Sequence
  MKO10090867_B_H1fx
  gRNA
cggcggacagaacgcccgcc

SEQ ID NO: 90868 - RNA, 20 nt, Artificial Sequence
  MKO10090868_B_H1fx
  gRNA
cuugaaggauccguuggcgc

SEQ ID NO: 90869 - RNA, 20 nt, Artificial Sequence
  MKO10090869_B_H1fx
  gRNA
uaucguucugcaccagcgcc

SEQ ID NO: 90870 - RNA, 20 nt, Artificial Sequence
  MKO10090870_B_H2-Aa
  gRNA
aauagcaagucagucgcaga

SEQ ID NO: 90871 - RNA, 20 nt, Artificial Sequence
  MKO10090871_B_H2-Aa
  gRNA
gagcacguaccauugguagc

SEQ ID NO: 90872 - RNA, 20 nt, Artificial Sequence
  MKO10090872_B_H2-Aa
  gRNA
gguggcaccuccagacaccc

SEQ ID NO: 90873 - RNA, 20 nt, Artificial Sequence
  MKO10090873_B_H2-Ab1
  gRNA
gaaccagcgcacuuugaucu

SEQ ID NO: 90874 - RNA, 20 nt, Artificial Sequence
  MKO10090874_B_H2-Ab1
  gRNA
agcaagauguugagcggcau

SEQ ID NO: 90875 - RNA, 20 nt, Artificial Sequence
  MKO10090875_B_H2-Ab1
  gRNA
gccgcucaacaucuugcucc

SEQ ID NO: 90876 - RNA, 20 nt, Artificial Sequence
  MKO10090876_B_H2-Bl
  gRNA
agagcuauacaaguucuacc

SEQ ID NO: 90877 - RNA, 20 nt, Artificial Sequence
  MKO10090877_B_H2-Bl
  gRNA
ugugaucaucauugaagcua

SEQ ID NO: 90878 - RNA, 20 nt, Artificial Sequence
  MKO10090878_B_H2-Bl
  gRNA
acccaucaucccagaccugc

SEQ ID NO: 90879 - RNA, 20 nt, Artificial Sequence
  MKO10090879_B_H2-D1
  gRNA
agucacagccagacaucugc

SEQ ID NO: 90880 - RNA, 20 nt, Artificial Sequence
  MKO10090880_B_H2-D1
  gRNA
acuccacgcacucgcccucc

SEQ ID NO: 90881 - RNA, 20 nt, Artificial Sequence
  MKO10090881_B_H2-D1
  gRNA
acccaucaccccagaucuaa

SEQ ID NO: 90882 - RNA, 20 nt, Artificial Sequence
  MKO10090882_B_H2-DMa
  gRNA
cuauguugggaaucccgucc

SEQ ID NO: 90883 - RNA, 20 nt, Artificial Sequence
  MKO10090883_B_H2-DMa
  gRNA
acauccaucucagcugucga

SEQ ID NO: 90884 - RNA, 20 nt, Artificial Sequence
  MKO10090884_B_H2-DMa
  gRNA
gaagaguucguccucgucau

SEQ ID NO: 90885 - RNA, 20 nt, Artificial Sequence
  MKO10090885_B_H2-DMb1
  gRNA
gaccucugagcccauccgag

SEQ ID NO: 90886 - RNA, 20 nt, Artificial Sequence
  MKO10090886_B_H2-DMb1
  gRNA
cacacuuacuccaguccccu

SEQ ID NO: 90887 - RNA, 20 nt, Artificial Sequence
  MKO10090887_B_H2-DMb1
  gRNA
cuaggcuacacuccucucuc

SEQ ID NO: 90888 - RNA, 20 nt, Artificial Sequence
  MKO10090888_B_H2-DMb2
  gRNA
cacacuuacuccaguccccg

SEQ ID NO: 90889 - RNA, 20 nt, Artificial Sequence
  MKO10090889_B_H2-DMb2
  gRNA
acaaauguuaccuucugggu

SEQ ID NO: 90890 - RNA, 20 nt, Artificial Sequence
  MKO10090890_B_H2-DMb2
  gRNA
cuaggcuacacuccucuccc

SEQ ID NO: 90891 - RNA, 20 nt, Artificial Sequence
  MKO10090891_B_H2-Ea-ps
  gRNA
auagaacuccgccuggauga

SEQ ID NO: 90892 - RNA, 20 nt, Artificial Sequence
  MKO10090892_B_H2-Ea-ps
  gRNA
aacgcucuuucaugacaucc

SEQ ID NO: 90893 - RNA, 20 nt, Artificial Sequence
  MKO10090893_B_H2-Ea-ps
  gRNA
acgacauucucuuuaguuuc

SEQ ID NO: 90894 - RNA, 20 nt, Artificial Sequence
  MKO10090894_B_H2-Eb1
  gRNA
ccacgucgcugucgaagcgc

SEQ ID NO: 90895 - RNA, 20 nt, Artificial Sequence
  MKO10090895_B_H2-Eb1
  gRNA
cggggcuguucaucuacuuc

SEQ ID NO: 90896 - RNA, 20 nt, Artificial Sequence
  MKO10090896_B_H2-Eb1
  gRNA
agaugaacagccccgcuccc

SEQ ID NO: 90897 - RNA, 20 nt, Artificial Sequence
  MKO10090897_B_H2-Eb2
  gRNA
agaagaacagccccacugcg

SEQ ID NO: 90898 - RNA, 20 nt, Artificial Sequence
  MKO10090898_B_H2-Eb2
  gRNA
gacugauccaaaauagagac

SEQ ID NO: 90899 - RNA, 20 nt, Artificial Sequence
  MKO10090899_B_H2-Eb2
  gRNA
aggucuguucauccucgcag

SEQ ID NO: 90900 - RNA, 20 nt, Artificial Sequence
  MKO10090900_B_H2-K1
  gRNA
cuaccuggagggcacgugcg

SEQ ID NO: 90901 - RNA, 20 nt, Artificial Sequence
  MKO10090901_B_H2-K1
  gRNA
cucagggugacuuuaucuuc

SEQ ID NO: 90902 - RNA, 20 nt, Artificial Sequence
  MKO10090902_B_H2-K1
  gRNA
cagugacuauugcagcucca

SEQ ID NO: 90903 - RNA, 20 nt, Artificial Sequence
  MKO10090903_B_H2-Ke2
  gRNA
caacguggucuuuaagcuuc

SEQ ID NO: 90904 - RNA, 20 nt, Artificial Sequence
  MKO10090904_B_H2-Ke2
  gRNA
acugauccaaaagaagcugc

SEQ ID NO: 90905 - RNA, 20 nt, Artificial Sequence
  MKO10090905_B_H2-Ke2
  gRNA
ccucucccugcagcuucuuu

SEQ ID NO: 90906 - RNA, 20 nt, Artificial Sequence
  MKO10090906_B_H2-Ke6
  gRNA
aucgcgugugaugcccgcac

SEQ ID NO: 90907 - RNA, 20 nt, Artificial Sequence
  MKO10090907_B_H2-Ke6
  gRNA
cgccacuggacacuaaagcc

SEQ ID NO: 90908 - RNA, 20 nt, Artificial Sequence
  MKO10090908_B_H2-Ke6
  gRNA
gggcaccuuccuagucacuc

SEQ ID NO: 90909 - RNA, 20 nt, Artificial Sequence
  MKO10090909_B_H2-L
  gRNA
ucacccgcgcgggucugagu

SEQ ID NO: 90910 - RNA, 20 nt, Artificial Sequence
  MKO10090910_B_H2-L
  gRNA
cucgaggccgggccgggaca

SEQ ID NO: 90911 - RNA, 20 nt, Artificial Sequence
  MKO10090911_B_H2-L
  gRNA
guuucccgcucccaauacuc

SEQ ID NO: 90912 - RNA, 20 nt, Artificial Sequence
  MKO10090912_B_H2-M10.1
  gRNA
ugagucgguagugaccgccg

SEQ ID NO: 90913 - RNA, 20 nt, Artificial Sequence
  MKO10090913_B_H2-M10.1
  gRNA
ccugguucuuggaaccuugg

SEQ ID NO: 90914 - RNA, 20 nt, Artificial Sequence
  MKO10090914_B_H2-M10.1
  gRNA
guaucuuagcucuucuccag

SEQ ID NO: 90915 - RNA, 20 nt, Artificial Sequence
  MKO10090915_B_H2-M10.2
  gRNA
guuggagccccggaucaucc

SEQ ID NO: 90916 - RNA, 20 nt, Artificial Sequence
  MKO10090916_B_H2-M10.2
  gRNA
aaaccaccacaguuccuacc

SEQ ID NO: 90917 - RNA, 20 nt, Artificial Sequence
  MKO10090917_B_H2-M10.2
  gRNA
agaugggaaaaacuacaccc

SEQ ID NO: 90918 - RNA, 20 nt, Artificial Sequence
  MKO10090918_B_H2-M10.3
  gRNA
ugagccggaagugaccguga

SEQ ID NO: 90919 - RNA, 20 nt, Artificial Sequence
  MKO10090919_B_H2-M10.3
  gRNA
cccaucauagcaauccucau

SEQ ID NO: 90920 - RNA, 20 nt, Artificial Sequence
  MKO10090920_B_H2-M10.3
  gRNA
acauggagcugccagauacc

SEQ ID NO: 90921 - RNA, 20 nt, Artificial Sequence
  MKO10090921_B_H2-M10.4
  gRNA
aagacgaacucuuauauaca

SEQ ID NO: 90922 - RNA, 20 nt, Artificial Sequence
  MKO10090922_B_H2-M10.4
  gRNA
acccacaaaguaacaccuga

SEQ ID NO: 90923 - RNA, 20 nt, Artificial Sequence
  MKO10090923_B_H2-M10.4
  gRNA
ucccuucagguguuacuuug

SEQ ID NO: 90924 - RNA, 20 nt, Artificial Sequence
  MKO10090924_B_H2-M10.5
  gRNA
gcuuccucggcggucacuuc

SEQ ID NO: 90925 - RNA, 20 nt, Artificial Sequence
  MKO10090925_B_H2-M10.5
  gRNA
uuaccccauuucagcuugag

SEQ ID NO: 90926 - RNA, 20 nt, Artificial Sequence
  MKO10090926_B_H2-M10.5
  gRNA
cugagccucucaagcugaaa

SEQ ID NO: 90927 - RNA, 20 nt, Artificial Sequence
  MKO10090927_B_H2-M10.6
  gRNA
uuccugacagugagaagcuc

SEQ ID NO: 90928 - RNA, 20 nt, Artificial Sequence
  MKO10090928_B_H2-M10.6
  gRNA
guguaucucagcucuucucc

SEQ ID NO: 90929 - RNA, 20 nt, Artificial Sequence
  MKO10090929_B_H2-M10.6
  gRNA
ggauggaaaaaaccacaccc

SEQ ID NO: 90930 - RNA, 20 nt, Artificial Sequence
  MKO10090930_B_H2-M11
  gRNA
ccugaaaauagcucagaacg

SEQ ID NO: 90931 - RNA, 20 nt, Artificial Sequence
  MKO10090931_B_H2-M11
  gRNA
cuaugaugacuuugcugaua

SEQ ID NO: 90932 - RNA, 20 nt, Artificial Sequence
  MKO10090932_B_H2-M11
  gRNA
ucuccgugaccuccaugucc

SEQ ID NO: 90933 - RNA, 20 nt, Artificial Sequence
  MKO10090933_B_H2-M1
  gRNA
cacagacgcuacuucaguca

SEQ ID NO: 90934 - RNA, 20 nt, Artificial Sequence
  MKO10090934_B_H2-M1
  gRNA
auguauauacccuccuguca

SEQ ID NO: 90935 - RNA, 20 nt, Artificial Sequence
  MKO10090935_B_H2-M1
  gRNA
auagccccucaugauuuacg

SEQ ID NO: 90936 - RNA, 20 nt, Artificial Sequence
  MKO10090936_B_H2-M2
  gRNA
cuucacgcauaccgucaguu

SEQ ID NO: 90937 - RNA, 20 nt, Artificial Sequence
  MKO10090937_B_H2-M2
  gRNA
caccuuuaaaggucugugcc

SEQ ID NO: 90938 - RNA, 20 nt, Artificial Sequence
  MKO10090938_B_H2-M2
  gRNA
gcccuggcacagaccuuuaa

SEQ ID NO: 90939 - RNA, 20 nt, Artificial Sequence
  MKO10090939_B_H2-M3
  gRNA
uucuccauccaaggugcacg

SEQ ID NO: 90940 - RNA, 20 nt, Artificial Sequence
  MKO10090940_B_H2-M3
  gRNA
ggauggaaccucgugcaccu

SEQ ID NO: 90941 - RNA, 20 nt, Artificial Sequence
  MKO10090941_B_H2-M3
  gRNA
gcccaucacccgagacccaa

SEQ ID NO: 90942 - RNA, 20 nt, Artificial Sequence
  MKO10090942_B_H2-M5
  gRNA
gaauggagccacgcgcucug

SEQ ID NO: 90943 - RNA, 20 nt, Artificial Sequence
  MKO10090943_B_H2-M5
  gRNA
gugaugggucacaugugccu

SEQ ID NO: 90944 - RNA, 20 nt, Artificial Sequence
  MKO10090944_B_H2-M5
  gRNA
ccaacagugauucccaugau

SEQ ID NO: 90945 - RNA, 20 nt, Artificial Sequence
  MKO10090945_B_H2-M9
  gRNA
uuguguccaccuucuuauca

SEQ ID NO: 90946 - RNA, 20 nt, Artificial Sequence
  MKO10090946_B_H2-M9
  gRNA
auagccccucaugauuuaca

SEQ ID NO: 90947 - RNA, 20 nt, Artificial Sequence
  MKO10090947_B_H2-M9
  gRNA
agaaccagagcaauaaucau

SEQ ID NO: 90948 - RNA, 20 nt, Artificial Sequence
  MKO10090948_B_H2-Oa
  gRNA
ggauguguacgacugcaagg

SEQ ID NO: 90949 - RNA, 20 nt, Artificial Sequence
  MKO10090949_B_H2-Oa
  gRNA
guccagaagcgucguaagau

SEQ ID NO: 90950 - RNA, 20 nt, Artificial Sequence
  MKO10090950_B_H2-Oa
  gRNA
cacgcaggcccaguauccgc

SEQ ID NO: 90951 - RNA, 20 nt, Artificial Sequence
  MKO10090951_B_H2-Ob
  gRNA
ggaggccggggugcuccacg

SEQ ID NO: 90952 - RNA, 20 nt, Artificial Sequence
  MKO10090952_B_H2-Ob
  gRNA
ggaagacaaucagcccaagc

SEQ ID NO: 90953 - RNA, 20 nt, Artificial Sequence
  MKO10090953_B_H2-Ob
  gRNA
agagugcuuaccucauugcc

SEQ ID NO: 90954 - RNA, 20 nt, Artificial Sequence
  MKO10090954_B_H2-Q10
  gRNA
caggcucucacacgauccag

SEQ ID NO: 90955 - RNA, 20 nt, Artificial Sequence
  MKO10090955_B_H2-Q10
  gRNA
cacacauugcugaucugcug

SEQ ID NO: 90956 - RNA, 20 nt, Artificial Sequence
  MKO10090956_B_H2-Q10
  gRNA
cguaaccgacaauaaugaac

SEQ ID NO: 90957 - RNA, 20 nt, Artificial Sequence
  MKO10090957_B_H2-Q1
  gRNA
ggugacaucaccuugagauc

SEQ ID NO: 90958 - RNA, 20 nt, Artificial Sequence
  MKO10090958_B_H2-Q1
  gRNA
cuuucacacagaccccccaa

SEQ ID NO: 90959 - RNA, 20 nt, Artificial Sequence
  MKO10090959_B_H2-Q1
  gRNA
aguauugggaacggaacaca

SEQ ID NO: 90960 - RNA, 20 nt, Artificial Sequence
  MKO10090960_B_H2-Q2
  gRNA
aguagcucagugcggucccc

SEQ ID NO: 90961 - RNA, 20 nt, Artificial Sequence
  MKO10090961_B_H2-Q2
  gRNA
gccuagauacacaugccaug

SEQ ID NO: 90962 - RNA, 20 nt, Artificial Sequence
  MKO10090962_B_H2-Q2
  gRNA
ggugacaucaccuugagaac

SEQ ID NO: 90963 - RNA, 20 nt, Artificial Sequence
  MKO10090963_B_H2-Q4
  gRNA
cuuccacacagauccuccaa

SEQ ID NO: 90964 - RNA, 20 nt, Artificial Sequence
  MKO10090964_B_H2-Q4
  gRNA
acaugucaccacagaucuga

SEQ ID NO: 90965 - RNA, 20 nt, Artificial Sequence
  MKO10090965_B_H2-Q4
  gRNA
aacagcuacguucgccaugu

SEQ ID NO: 90966 - RNA, 20 nt, Artificial Sequence
  MKO10090966_B_H2-Q6
  gRNA
aauagcuacguucgccaugu

SEQ ID NO: 90967 - RNA, 20 nt, Artificial Sequence
  MKO10090967_B_H2-Q6
  gRNA
aguaucucugugcgguccuc

SEQ ID NO: 90968 - RNA, 20 nt, Artificial Sequence
  MKO10090968_B_H2-Q6
  gRNA
uucugguuguccuuguagcu

SEQ ID NO: 90969 - RNA, 20 nt, Artificial Sequence
  MKO10090969_B_H2-Q7
  gRNA
ugguauugcagagaaagacc

SEQ ID NO: 90970 - RNA, 20 nt, Artificial Sequence
  MKO10090970_B_H2-Q7
  gRNA
cugagccccuuacccugaga

SEQ ID NO: 90971 - RNA, 20 nt, Artificial Sequence
  MKO10090971_B_H2-Q7
  gRNA
cacccgcgcgggucucgauc

SEQ ID NO: 90972 - RNA, 20 nt, Artificial Sequence
  MKO10090972_B_H2-Q8
  gRNA
aauagcuacguucgccaugu

SEQ ID NO: 90973 - RNA, 20 nt, Artificial Sequence
  MKO10090973_B_H2-Q8
  gRNA
aguaucucugugcgguccuc

SEQ ID NO: 90974 - RNA, 20 nt, Artificial Sequence
  MKO10090974_B_H2-Q8
  gRNA
uucugguuguccuuguagcu

SEQ ID NO: 90975 - RNA, 20 nt, Artificial Sequence
  MKO10090975_B_H2-Q9
  gRNA
ugguauugcagagaaagacc

SEQ ID NO: 90976 - RNA, 20 nt, Artificial Sequence
  MKO10090976_B_H2-Q9
  gRNA
cugagccccuuacccugaga

SEQ ID NO: 90977 - RNA, 20 nt, Artificial Sequence
  MKO10090977_B_H2-Q9
  gRNA
uaccccaucucccccaucuc

SEQ ID NO: 90978 - RNA, 20 nt, Artificial Sequence
  MKO10090978_B_H2-T10
  gRNA
accucagaucucucagcacc

SEQ ID NO: 90979 - RNA, 20 nt, Artificial Sequence
  MKO10090979_B_H2-T10
  gRNA
uccaggugcugagagaucug

SEQ ID NO: 90980 - RNA, 20 nt, Artificial Sequence
  MKO10090980_B_H2-T10
  gRNA
cugcccagucccagaugucc

SEQ ID NO: 90981 - RNA, 20 nt, Artificial Sequence
  MKO10090981_B_H2-T22
  gRNA
auagccgacgauuaugaacc

SEQ ID NO: 90982 - RNA, 20 nt, Artificial Sequence
  MKO10090982_B_H2-T22
  gRNA
guucaucauuugucucugug

SEQ ID NO: 90983 - RNA, 20 nt, Artificial Sequence
  MKO10090983_B_H2-T22
  gRNA
gaugaacaaaaugaaaacca

SEQ ID NO: 90984 - RNA, 20 nt, Artificial Sequence
  MKO10090984_B_H2-T23
  gRNA
gugaaauaccgcagcgagug

SEQ ID NO: 90985 - RNA, 20 nt, Artificial Sequence
  MKO10090985_B_H2-T23
  gRNA
caaaagccaccacagcucca

SEQ ID NO: 90986 - RNA, 20 nt, Artificial Sequence
  MKO10090986_B_H2-T23
  gRNA
gugacuucaucuucagaucu

SEQ ID NO: 90987 - RNA, 20 nt, Artificial Sequence
  MKO10090987_B_H2-T24
  gRNA
ccuagcauauacuccugucg

SEQ ID NO: 90988 - RNA, 20 nt, Artificial Sequence
  MKO10090988_B_H2-T24
  gRNA
cagcucaccacgcccacgac

SEQ ID NO: 90989 - RNA, 20 nt, Artificial Sequence
  MKO10090989_B_H2-T24
  gRNA
cuggaaaaucuucauccgau

SEQ ID NO: 90990 - RNA, 20 nt, Artificial Sequence
  MKO10090990_B_H2-T3
  gRNA
uuccgcgcuuaugagcagca

SEQ ID NO: 90991 - RNA, 20 nt, Artificial Sequence
  MKO10090991_B_H2-T3
  gRNA
cucagaccaguaugcccaac

SEQ ID NO: 90992 - RNA, 20 nt, Artificial Sequence
  MKO10090992_B_H2-T3
  gRNA
accacuguucgugcucuccu

SEQ ID NO: 90993 - RNA, 20 nt, Artificial Sequence
  MKO10090993_B_H2-T9
  gRNA
agugcuguuucccacuguac

SEQ ID NO: 90994 - RNA, 20 nt, Artificial Sequence
  MKO10090994_B_H2-T9
  gRNA
auagccgacgauuaugaacc

SEQ ID NO: 90995 - RNA, 20 nt, Artificial Sequence
  MKO10090995_B_H2-T9
  gRNA
ccuuaccccaucucaggaug

SEQ ID NO: 90996 - RNA, 20 nt, Artificial Sequence
  MKO10090996_B_H2afb1
  gRNA
uccagagcaugugugccgug

SEQ ID NO: 90997 - RNA, 20 nt, Artificial Sequence
  MKO10090997_B_H2afb1
  gRNA
uucugcuccuguauuccucg

SEQ ID NO: 90998 - RNA, 20 nt, Artificial Sequence
  MKO10090998_B_H2afb1
  gRNA
aaacgauccacacggcuaac

SEQ ID NO: 90999 - RNA, 20 nt, Artificial Sequence
  MKO10090999_B_H2afb2-ps
  gRNA
cacuccucaaccgcuggacu

SEQ ID NO: 91000 - RNA, 20 nt, Artificial Sequence
  MKO10091000_B_H2afb2-ps
  gRNA
aacugucuucaaaggucuuc

SEQ ID NO: 91001 - RNA, 20 nt, Artificial Sequence
  MKO10091001_B_H2afb2-ps
  gRNA
ggaacuccaggauggcuacc

SEQ ID NO: 91002 - RNA, 20 nt, Artificial Sequence
  MKO10091002_B_H2afb3-ps
  gRNA
gcuaaucuuugcugugagcc

SEQ ID NO: 91003 - RNA, 20 nt, Artificial Sequence
  MKO10091003_B_H2afb3-ps
  gRNA
agcaaagauuagcucagcuc

SEQ ID NO: 91004 - RNA, 20 nt, Artificial Sequence
  MKO10091004_B_H2afb3-ps
  gRNA
cggcaagcuccagcaaccug

SEQ ID NO: 91005 - RNA, 20 nt, Artificial Sequence
  MKO10091005_B_H2afj
  gRNA
accgcccugcuugccucgcc

SEQ ID NO: 91006 - RNA, 20 nt, Artificial Sequence
  MKO10091006_B_H2afj
  gRNA
caagucgcgcucgucgcgcg

SEQ ID NO: 91007 - RNA, 20 nt, Artificial Sequence
  MKO10091007_B_H2afj
  gRNA
cgcgggagcgcccguguacc

SEQ ID NO: 91008 - RNA, 20 nt, Artificial Sequence
  MKO10091008_B_H2afv
  gRNA
cacuuacagcuugcaauccg

SEQ ID NO: 91009 - RNA, 20 nt, Artificial Sequence
  MKO10091009_B_H2afv
  gRNA
gugucucguucccagcgagc

SEQ ID NO: 91010 - RNA, 20 nt, Artificial Sequence
  MKO10091010_B_H2afv
  gRNA
aagacucgcaccacaagcca

SEQ ID NO: 91011 - RNA, 20 nt, Artificial Sequence
  MKO10091011_B_H2afx
  gRNA
ucguacacuauguccggacg

SEQ ID NO: 91012 - RNA, 20 nt, Artificial Sequence
  MKO10091012_B_H2afx
  gRNA
ggcgccggcggucggcaaga

SEQ ID NO: 91013 - RNA, 20 nt, Artificial Sequence
  MKO10091013_B_H2afx
  gRNA
cuuggcgcgggccuugccgc

SEQ ID NO: 91014 - RNA, 20 nt, Artificial Sequence
  MKO10091014_B_H2afy2
  gRNA
cugguugaguuccucgucgu

SEQ ID NO: 91015 - RNA, 20 nt, Artificial Sequence
  MKO10091015_B_H2afy2
  gRNA
cgaucucggcugugguuggg

SEQ ID NO: 91016 - RNA, 20 nt, Artificial Sequence
  MKO10091016_B_H2afy2
  gRNA
uuaccuucugccccagaacg

SEQ ID NO: 91017 - RNA, 20 nt, Artificial Sequence
  MKO10091017_B_H2afy
  gRNA
cccuaaguauaggaucggag

SEQ ID NO: 91018 - RNA, 20 nt, Artificial Sequence
  MKO10091018_B_H2afy
  gRNA
gcugucgccaugucgagccg

SEQ ID NO: 91019 - RNA, 20 nt, Artificial Sequence
  MKO10091019_B_H2afy
  gRNA
cuccgucguacugucugcgc

SEQ ID NO: 91020 - RNA, 20 nt, Artificial Sequence
  MKO10091020_B_H2afz
  gRNA
gcaagccggcucgcugcgag

SEQ ID NO: 91021 - RNA, 20 nt, Artificial Sequence
  MKO10091021_B_H2afz
  gRNA
uucaucgacaccugaaaucu

SEQ ID NO: 91022 - RNA, 20 nt, Artificial Sequence
  MKO10091022_B_H2afz
  gRNA
auagcaagcugcaagugacg

SEQ ID NO: 91023 - RNA, 20 nt, Artificial Sequence
  MKO10091023_B_H2bfm
  gRNA
uguucacagaccgcugcgag

SEQ ID NO: 91024 - RNA, 20 nt, Artificial Sequence
  MKO10091024_B_H2bfm
  gRNA
aggaagcagaagucgaauag

SEQ ID NO: 91025 - RNA, 20 nt, Artificial Sequence
  MKO10091025_B_H2bfm
  gRNA
acgcgccaagaagcuggcuu

SEQ ID NO: 91026 - RNA, 20 nt, Artificial Sequence
  MKO10091026_B_H3f3a
  gRNA
aagcaccaauagcugcacuc

SEQ ID NO: 91027 - RNA, 20 nt, Artificial Sequence
  MKO10091027_B_H3f3a
  gRNA
caagcuccccuuucagcguc

SEQ ID NO: 91028 - RNA, 20 nt, Artificial Sequence
  MKO10091028_B_H3f3a
  gRNA
aagcacguucuccgcguaug

SEQ ID NO: 91029 - RNA, 20 nt, Artificial Sequence
  MKO10091029_B_H3f3b
  gRNA
ugacugcaggccagggaccg

SEQ ID NO: 91030 - RNA, 20 nt, Artificial Sequence
  MKO10091030_B_H3f3b
  gRNA
ugauggugacucucuuggcg

SEQ ID NO: 91031 - RNA, 20 nt, Artificial Sequence
  MKO10091031_B_H3f3b
  gRNA
ggaggcuagcgaagcauacc

SEQ ID NO: 91032 - RNA, 20 nt, Artificial Sequence
  MKO10091032_B_H60b
  gRNA
uuuauccacuuaauaugacc

SEQ ID NO: 91033 - RNA, 20 nt, Artificial Sequence
  MKO10091033_B_H60b
  gRNA
aacuguugaucagguuguag

SEQ ID NO: 91034 - RNA, 20 nt, Artificial Sequence
  MKO10091034_B_H60b
  gRNA
ccaacauaauucugacaccc

SEQ ID NO: 91035 - RNA, 20 nt, Artificial Sequence
  MKO10091035_B_H60c
  gRNA
uuuauccacuuaauaagacc

SEQ ID NO: 91036 - RNA, 20 nt, Artificial Sequence
  MKO10091036_B_H60c
  gRNA
gacuugcaugccauggaucg

SEQ ID NO: 91037 - RNA, 20 nt, Artificial Sequence
  MKO10091037_B_H60c
  gRNA
ugacagugaguuugcaauuu

SEQ ID NO: 91038 - RNA, 20 nt, Artificial Sequence
  MKO10091038_B_H6pd
  gRNA
cuugcgguucugaucucgga

SEQ ID NO: 91039 - RNA, 20 nt, Artificial Sequence
  MKO10091039_B_H6pd
  gRNA
gggccaagcacauugccgcu

SEQ ID NO: 91040 - RNA, 20 nt, Artificial Sequence
  MKO10091040_B_H6pd
  gRNA
ucacgcaccuuccgcaucua

SEQ ID NO: 91041 - RNA, 20 nt, Artificial Sequence
  MKO10091041_B_Haao
  gRNA
cagcucaaaaucauguucgu

SEQ ID NO: 91042 - RNA, 20 nt, Artificial Sequence
  MKO10091042_B_Haao
  gRNA
aggauguccucuucgagaaa

SEQ ID NO: 91043 - RNA, 20 nt, Artificial Sequence
  MKO10091043_B_Haao
  gRNA
uggcaaaccucugcggggag

SEQ ID NO: 91044 - RNA, 20 nt, Artificial Sequence
  MKO10091044_B_Habp2
  gRNA
acaguccccgccguguucac

SEQ ID NO: 91045 - RNA, 20 nt, Artificial Sequence
  MKO10091045_B_Habp2
  gRNA
ucccguguaaggguauuugc

SEQ ID NO: 91046 - RNA, 20 nt, Artificial Sequence
  MKO10091046_B_Habp2
  gRNA
cacagaauuuccccuuauac

SEQ ID NO: 91047 - RNA, 20 nt, Artificial Sequence
  MKO10091047_B_Habp4
  gRNA
cuggcacuccuccaucaucg

SEQ ID NO: 91048 - RNA, 20 nt, Artificial Sequence
  MKO10091048_B_Habp4
  gRNA
gaucgagacagaccacugag

SEQ ID NO: 91049 - RNA, 20 nt, Artificial Sequence
  MKO10091049_B_Habp4
  gRNA
agcagaggccgaggcggucc

SEQ ID NO: 91050 - RNA, 20 nt, Artificial Sequence
  MKO10091050_B_Hace1
  gRNA
gucaacauuuguaauaauga

SEQ ID NO: 91051 - RNA, 20 nt, Artificial Sequence
  MKO10091051_B_Hace1
  gRNA
gaaaugcaugaguaaauuac

SEQ ID NO: 91052 - RNA, 20 nt, Artificial Sequence
  MKO10091052_B_Hace1
  gRNA
uguuuacacacugaugccaa

SEQ ID NO: 91053 - RNA, 20 nt, Artificial Sequence
  MKO10091053_B_Hacl1
  gRNA
acuuuauuuaccugccuguc

SEQ ID NO: 91054 - RNA, 20 nt, Artificial Sequence
  MKO10091054_B_Hacl1
  gRNA
caggauguggaguacauguu

SEQ ID NO: 91055 - RNA, 20 nt, Artificial Sequence
  MKO10091055_B_Hacl1
  gRNA
uggauaccuguggaaacucc

SEQ ID NO: 91056 - RNA, 20 nt, Artificial Sequence
  MKO10091056_B_Hadha
  gRNA
uaaggacagcacuccugauu

SEQ ID NO: 91057 - RNA, 20 nt, Artificial Sequence
  MKO10091057_B_Hadha
  gRNA
gccccugcgacaaagcagcc

SEQ ID NO: 91058 - RNA, 20 nt, Artificial Sequence
  MKO10091058_B_Hadha
  gRNA
aaggggauguggcaguuauu

SEQ ID NO: 91059 - RNA, 20 nt, Artificial Sequence
  MKO10091059_B_Hadhb
  gRNA
gaagugccugacagcagaaa

SEQ ID NO: 91060 - RNA, 20 nt, Artificial Sequence
  MKO10091060_B_Hadhb
  gRNA
gcagcucuagccaagucaug

SEQ ID NO: 91061 - RNA, 20 nt, Artificial Sequence
  MKO10091061_B_Hadhb
  gRNA
agaccuaaugccacaugacu

SEQ ID NO: 91062 - RNA, 20 nt, Artificial Sequence
  MKO10091062_B_Hadh
  gRNA
uugccaggaugucuuccguu

SEQ ID NO: 91063 - RNA, 20 nt, Artificial Sequence
  MKO10091063_B_Hadh
  gRNA
aguaguauugguggaccaaa

SEQ ID NO: 91064 - RNA, 20 nt, Artificial Sequence
  MKO10091064_B_Hadh
  gRNA
ccuuucaaccagcaccgaug

SEQ ID NO: 91065 - RNA, 20 nt, Artificial Sequence
  MKO10091065_B_Haghl
  gRNA
cgaaggcucaccgucucggg

SEQ ID NO: 91066 - RNA, 20 nt, Artificial Sequence
  MKO10091066_B_Haghl
  gRNA
ggguacccuuccacccgaga

SEQ ID NO: 91067 - RNA, 20 nt, Artificial Sequence
  MKO10091067_B_Haghl
  gRNA
gcuccgcauuuccacgugug

SEQ ID NO: 91068 - RNA, 20 nt, Artificial Sequence
  MKO10091068_B_Hagh
  gRNA
aacagaugugucccgaagua

SEQ ID NO: 91069 - RNA, 20 nt, Artificial Sequence
  MKO10091069_B_Hagh
  gRNA
caucggagccuugacucaca

SEQ ID NO: 91070 - RNA, 20 nt, Artificial Sequence
  MKO10091070_B_Hagh
  gRNA
gucaacacccugccauacuu

SEQ ID NO: 91071 - RNA, 20 nt, Artificial Sequence
  MKO10091071_B_Hal
  gRNA
gcuuuagauacagcaaauac

SEQ ID NO: 91072 - RNA, 20 nt, Artificial Sequence
  MKO10091072_B_Hal
  gRNA
ggauacaggaaaacuccuuc

SEQ ID NO: 91073 - RNA, 20 nt, Artificial Sequence
  MKO10091073_B_Hal
  gRNA
ugaugcugucgaugaccucc

SEQ ID NO: 91074 - RNA, 20 nt, Artificial Sequence
  MKO10091074_B_Hamp2
  gRNA
gcucaccuguugcuggagau

SEQ ID NO: 91075 - RNA, 20 nt, Artificial Sequence
  MKO10091075_B_Hamp2
  gRNA
acagagcugcagccuuugca

SEQ ID NO: 91076 - RNA, 20 nt, Artificial Sequence
  MKO10091076_B_Hamp2
  gRNA
cugcuuucuuccccgugcaa

SEQ ID NO: 91077 - RNA, 20 nt, Artificial Sequence
  MKO10091077_B_Hamp
  gRNA
uuuacagcagaagaugcaga

SEQ ID NO: 91078 - RNA, 20 nt, Artificial Sequence
  MKO10091078_B_Hamp
  gRNA
acagagcugcagccuuugca

SEQ ID NO: 91079 - RNA, 20 nt, Artificial Sequence
  MKO10091079_B_Hamp
  gRNA
cugcuuucuuccccgugcaa

SEQ ID NO: 91080 - RNA, 20 nt, Artificial Sequence
  MKO10091080_B_Hand1
  gRNA
ccggcuggccucagcaaguc

SEQ ID NO: 91081 - RNA, 20 nt, Artificial Sequence
  MKO10091081_B_Hand1
  gRNA
guaggugguggcccgccggc

SEQ ID NO: 91082 - RNA, 20 nt, Artificial Sequence
  MKO10091082_B_Hand1
  gRNA
cccggccucgcguugccacc

SEQ ID NO: 91083 - RNA, 20 nt, Artificial Sequence
  MKO10091083_B_Hand2
  gRNA
cgugcuguggccagccuguc

SEQ ID NO: 91084 - RNA, 20 nt, Artificial Sequence
  MKO10091084_B_Hand2
  gRNA
gcggugccccggcgcuucac

SEQ ID NO: 91085 - RNA, 20 nt, Artificial Sequence
  MKO10091085_B_Hand2
  gRNA
gaguccugcgccgcuccuug

SEQ ID NO: 91086 - RNA, 20 nt, Artificial Sequence
  MKO10091086_B_Hao1
  gRNA
uguuccgcacgucaucaaug

SEQ ID NO: 91087 - RNA, 20 nt, Artificial Sequence
  MKO10091087_B_Hao1
  gRNA
gucagcaugccaauaugugu

SEQ ID NO: 91088 - RNA, 20 nt, Artificial Sequence
  MKO10091088_B_Hao1
  gRNA
caguggacuugcugaauaug

SEQ ID NO: 91089 - RNA, 20 nt, Artificial Sequence
  MKO10091089_B_Hao2
  gRNA
ugcuuguugaugucccaguc

SEQ ID NO: 91090 - RNA, 20 nt, Artificial Sequence
  MKO10091090_B_Hao2
  gRNA
caucaagcugccucccgcca

SEQ ID NO: 91091 - RNA, 20 nt, Artificial Sequence
  MKO10091091_B_Hao2
  gRNA
ugccuucaacacaucauugc

SEQ ID NO: 91092 - RNA, 20 nt, Artificial Sequence
  MKO10091092_B_Hap1
  gRNA
cgauccgggcggcuguguuc

SEQ ID NO: 91093 - RNA, 20 nt, Artificial Sequence
  MKO10091093_B_Hap1
  gRNA
cagcagcacgaccaccccua

SEQ ID NO: 91094 - RNA, 20 nt, Artificial Sequence
  MKO10091094_B_Hap1
  gRNA
uucuucgugggugguggauu

SEQ ID NO: 91095 - RNA, 20 nt, Artificial Sequence
  MKO10091095_B_Hapln1
  gRNA
uccacaaaauccgcaucaag

SEQ ID NO: 91096 - RNA, 20 nt, Artificial Sequence
  MKO10091096_B_Hapln1
  gRNA
caucacggaucuuacccugg

SEQ ID NO: 91097 - RNA, 20 nt, Artificial Sequence
  MKO10091097_B_Hapln1
  gRNA
ugcugucuuaccguugaagu

SEQ ID NO: 91098 - RNA, 20 nt, Artificial Sequence
  MKO10091098_B_Hapln2
  gRNA
gaucaucaagaacgugcguc

SEQ ID NO: 91099 - RNA, 20 nt, Artificial Sequence
  MKO10091099_B_Hapln2
  gRNA
ucgcuucgaaguaauugaac

SEQ ID NO: 91100 - RNA, 20 nt, Artificial Sequence
  MKO10091100_B_Hapln2
  gRNA
ucaauuacuucgaagcgaag

SEQ ID NO: 91101 - RNA, 20 nt, Artificial Sequence
  MKO10091101_B_Hapln3
  gRNA
gucucaguugaacucgcccu

SEQ ID NO: 91102 - RNA, 20 nt, Artificial Sequence
  MKO10091102_B_Hapln3
  gRNA
gagccuggaguacggaccuu

SEQ ID NO: 91103 - RNA, 20 nt, Artificial Sequence
  MKO10091103_B_Hapln3
  gRNA
cgcuccuuuggggacuacca

SEQ ID NO: 91104 - RNA, 20 nt, Artificial Sequence
  MKO10091104_B_Hapln4
  gRNA
gucuacugcuaccgcgcucc

SEQ ID NO: 91105 - RNA, 20 nt, Artificial Sequence
  MKO10091105_B_Hapln4
  gRNA
ggcuuucgccgaugucuucg

SEQ ID NO: 91106 - RNA, 20 nt, Artificial Sequence
  MKO10091106_B_Hapln4
  gRNA
agcgcacgcgcgcacugccc

SEQ ID NO: 91107 - RNA, 20 nt, Artificial Sequence
  MKO10091107_B_Harbi1
  gRNA
cggugccuggacggauccaa

SEQ ID NO: 91108 - RNA, 20 nt, Artificial Sequence
  MKO10091108_B_Harbi1
  gRNA
uaagagaggucuuccgcauu

SEQ ID NO: 91109 - RNA, 20 nt, Artificial Sequence
  MKO10091109_B_Harbi1
  gRNA
ugcaacgcagcgacucauag

SEQ ID NO: 91110 - RNA, 20 nt, Artificial Sequence
  MKO10091110_B_Hars2
  gRNA
ggaaccuugaugacaaaauu

SEQ ID NO: 91111 - RNA, 20 nt, Artificial Sequence
  MKO10091111_B_Hars2
  gRNA
gccuccagaccuuuccaacu

SEQ ID NO: 91112 - RNA, 20 nt, Artificial Sequence
  MKO10091112_B_Hars2
  gRNA
gaaguugucuucauacuucu

SEQ ID NO: 91113 - RNA, 20 nt, Artificial Sequence
  MKO10091113_B_Hars
  gRNA
guuugugcucaaaaccccca

SEQ ID NO: 91114 - RNA, 20 nt, Artificial Sequence
  MKO10091114_B_Hars
  gRNA
gcacgagagacuauaguccc

SEQ ID NO: 91115 - RNA, 20 nt, Artificial Sequence
  MKO10091115_B_Hars
  gRNA
cccuccacagaucgaggagg

SEQ ID NO: 91116 - RNA, 20 nt, Artificial Sequence
  MKO10091116_B_Has1
  gRNA
cgaguagcaucuggagcgcg

SEQ ID NO: 91117 - RNA, 20 nt, Artificial Sequence
  MKO10091117_B_Has1
  gRNA
ucuugagcagucuucgauac

SEQ ID NO: 91118 - RNA, 20 nt, Artificial Sequence
  MKO10091118_B_Has1
  gRNA
gacccccggguaggggcugu

SEQ ID NO: 91119 - RNA, 20 nt, Artificial Sequence
  MKO10091119_B_Has2
  gRNA
uaccaacaggguguugaguc

SEQ ID NO: 91120 - RNA, 20 nt, Artificial Sequence
  MKO10091120_B_Has2
  gRNA
ggucuuagaggaagacccua

SEQ ID NO: 91121 - RNA, 20 nt, Artificial Sequence
  MKO10091121_B_Has2
  gRNA
ccuccaacaccuccaaccau

SEQ ID NO: 91122 - RNA, 20 nt, Artificial Sequence
  MKO10091122_B_Has3
  gRNA
caagacucgaagcaucucaa

SEQ ID NO: 91123 - RNA, 20 nt, Artificial Sequence
  MKO10091123_B_Has3
  gRNA
ggcucaaucagcaaacccgc

SEQ ID NO: 91124 - RNA, 20 nt, Artificial Sequence
  MKO10091124_B_Has3
  gRNA
gauccccaaguaggaggugu

SEQ ID NO: 91125 - RNA, 20 nt, Artificial Sequence
  MKO10091125_B_Hau1
  gRNA
guuucaccuccugucugacu

SEQ ID NO: 91126 - RNA, 20 nt, Artificial Sequence
  MKO10091126_B_Hau1
  gRNA
gaauauacccaucagcucuu

SEQ ID NO: 91127 - RNA, 20 nt, Artificial Sequence
  MKO10091127_B_Hau1
  gRNA
augucauucucaagaucuuc

SEQ ID NO: 91128 - RNA, 20 nt, Artificial Sequence
  MKO10091128_B_Haus1
  gRNA
ccagacuuagacagauuggc

SEQ ID NO: 91129 - RNA, 20 nt, Artificial Sequence
  MKO10091129_B_Haus1
  gRNA
ugacagucgccuucagaaua

SEQ ID NO: 91130 - RNA, 20 nt, Artificial Sequence
  MKO10091130_B_Haus1
  gRNA
cugaaggcgacugucaaccu

SEQ ID NO: 91131 - RNA, 20 nt, Artificial Sequence
  MKO10091131_B_Haus2
  gRNA
ugauacucaccauuugcuuu

SEQ ID NO: 91132 - RNA, 20 nt, Artificial Sequence
  MKO10091132_B_Haus2
  gRNA
cagauaugugguacauaugu

SEQ ID NO: 91133 - RNA, 20 nt, Artificial Sequence
  MKO10091133_B_Haus2
  gRNA
uauucaagcugaaaucuacc

SEQ ID NO: 91134 - RNA, 20 nt, Artificial Sequence
  MKO10091134_B_Haus3
  gRNA
ucaaaaucgcccuuuacaac

SEQ ID NO: 91135 - RNA, 20 nt, Artificial Sequence
  MKO10091135_B_Haus3
  gRNA
uucuguaauacaagaucagu

SEQ ID NO: 91136 - RNA, 20 nt, Artificial Sequence
  MKO10091136_B_Haus3
  gRNA
guccacaucauuauucaguu

SEQ ID NO: 91137 - RNA, 20 nt, Artificial Sequence
  MKO10091137_B_Haus4
  gRNA
uugaggcguggagugaaguu

SEQ ID NO: 91138 - RNA, 20 nt, Artificial Sequence
  MKO10091138_B_Haus4
  gRNA
ugugccucuaggauuucgug

SEQ ID NO: 91139 - RNA, 20 nt, Artificial Sequence
  MKO10091139_B_Haus4
  gRNA
aguuauccaagagcugcucg

SEQ ID NO: 91140 - RNA, 20 nt, Artificial Sequence
  MKO10091140_B_Haus5
  gRNA
uuucucuaggcaugccuauc

SEQ ID NO: 91141 - RNA, 20 nt, Artificial Sequence
  MKO10091141_B_Haus5
  gRNA
uaccuuuggauuguccugau

SEQ ID NO: 91142 - RNA, 20 nt, Artificial Sequence
  MKO10091142_B_Haus5
  gRNA
cuucaggcugugucugaguc

SEQ ID NO: 91143 - RNA, 20 nt, Artificial Sequence
  MKO10091143_B_Haus6
  gRNA
uuauguuaugcaaaaauacc

SEQ ID NO: 91144 - RNA, 20 nt, Artificial Sequence
  MKO10091144_B_Haus6
  gRNA
agcaaugagccaacaacuug

SEQ ID NO: 91145 - RNA, 20 nt, Artificial Sequence
  MKO10091145_B_Haus6
  gRNA
gucuuuccuaggcugaaugu

SEQ ID NO: 91146 - RNA, 20 nt, Artificial Sequence
  MKO10091146_B_Haus7
  gRNA
ugacagcuacuacaaagaug

SEQ ID NO: 91147 - RNA, 20 nt, Artificial Sequence
  MKO10091147_B_Haus7
  gRNA
ugagaugaacuugucuugca

SEQ ID NO: 91148 - RNA, 20 nt, Artificial Sequence
  MKO10091148_B_Haus7
  gRNA
uucuuaccauuagaagaucc

SEQ ID NO: 91149 - RNA, 20 nt, Artificial Sequence
  MKO10091149_B_Haus8
  gRNA
gaauggcggauuccucagaa

SEQ ID NO: 91150 - RNA, 20 nt, Artificial Sequence
  MKO10091150_B_Haus8
  gRNA
gucucucgcaggaagaagag

SEQ ID NO: 91151 - RNA, 20 nt, Artificial Sequence
  MKO10091151_B_Haus8
  gRNA
gugcuggcuuuccuucccuc

SEQ ID NO: 91152 - RNA, 20 nt, Artificial Sequence
  MKO10091152_B_Havcr1
  gRNA
aauggcacugugacauccuc

SEQ ID NO: 91153 - RNA, 20 nt, Artificial Sequence
  MKO10091153_B_Havcr1
  gRNA
agcugugggccuuguaguug

SEQ ID NO: 91154 - RNA, 20 nt, Artificial Sequence
  MKO10091154_B_Havcr1
  gRNA
caagaagacccacaacuaca

SEQ ID NO: 91155 - RNA, 20 nt, Artificial Sequence
  MKO10091155_B_Havcr2
  gRNA
cagagacucccacuccaaug

SEQ ID NO: 91156 - RNA, 20 nt, Artificial Sequence
  MKO10091156_B_Havcr2
  gRNA
uucuccaagaacccuaacca

SEQ ID NO: 91157 - RNA, 20 nt, Artificial Sequence
  MKO10091157_B_Havcr2
  gRNA
accugaaccauuucucuccg

SEQ ID NO: 91158 - RNA, 20 nt, Artificial Sequence
  MKO10091158_B_Hax1
  gRNA
uucuacaguuggaugauaca

SEQ ID NO: 91159 - RNA, 20 nt, Artificial Sequence
  MKO10091159_B_Hax1
  gRNA
agacuuaccuuuguccucuu

SEQ ID NO: 91160 - RNA, 20 nt, Artificial Sequence
  MKO10091160_B_Hax1
  gRNA
cgagagagcuaugcguuuga

SEQ ID NO: 91161 - RNA, 20 nt, Artificial Sequence
  MKO10091161_B_Hba-a1
  gRNA
agcgcauaccuugaaguuga

SEQ ID NO: 91162 - RNA, 20 nt, Artificial Sequence
  MKO10091162_B_Hba-a1
  gRNA
ccucacuuugauguaagcca

SEQ ID NO: 91163 - RNA, 20 nt, Artificial Sequence
  MKO10091163_B_Hba-a1
  gRNA
gaaggcagcuuaacgguacu

SEQ ID NO: 91164 - RNA, 20 nt, Artificial Sequence
  MKO10091164_B_Hba-a2
  gRNA
agcgcauaccuugaaguuga

SEQ ID NO: 91165 - RNA, 20 nt, Artificial Sequence
  MKO10091165_B_Hba-a2
  gRNA
ccucacuuugauguaagcca

SEQ ID NO: 91166 - RNA, 20 nt, Artificial Sequence
  MKO10091166_B_Hba-a2
  gRNA
gaaggcagcuuaacgguacu

SEQ ID NO: 91167 - RNA, 20 nt, Artificial Sequence
  MKO10091167_B_Hba-x
  gRNA
gcucuuaaccgcauccccua

SEQ ID NO: 91168 - RNA, 20 nt, Artificial Sequence
  MKO10091168_B_Hba-x
  gRNA
ucccgccgacuucaccccug

SEQ ID NO: 91169 - RNA, 20 nt, Artificial Sequence
  MKO10091169_B_Hba-x
  gRNA
gagcuaucaucauguccaug

SEQ ID NO: 91170 - RNA, 20 nt, Artificial Sequence
  MKO10091170_B_Hbb-b1
  gRNA
cuaugucagaagcaaaugug

SEQ ID NO: 91171 - RNA, 20 nt, Artificial Sequence
  MKO10091171_B_Hbb-b1
  gRNA
ggcugcugguugucuacccu

SEQ ID NO: 91172 - RNA, 20 nt, Artificial Sequence
  MKO10091172_B_Hbb-b1
  gRNA
agacucacccugaaguucuc

SEQ ID NO: 91173 - RNA, 20 nt, Artificial Sequence
  MKO10091173_B_Hbb-b2
  gRNA
ggccucaccaccaacuucau

SEQ ID NO: 91174 - RNA, 20 nt, Artificial Sequence
  MKO10091174_B_Hbb-b2
  gRNA
ggcugcugguugucuacccu

SEQ ID NO: 91175 - RNA, 20 nt, Artificial Sequence
  MKO10091175_B_Hbb-b2
  gRNA
agacucacccugaaguucuc

SEQ ID NO: 91176 - RNA, 20 nt, Artificial Sequence
  MKO10091176_B_Hbb-bh1
  gRNA
caaucaccaacauguugccc

SEQ ID NO: 91177 - RNA, 20 nt, Artificial Sequence
  MKO10091177_B_Hbb-bh1
  gRNA
aggcagcuaucacaagcauc

SEQ ID NO: 91178 - RNA, 20 nt, Artificial Sequence
  MKO10091178_B_Hbb-bh1
  gRNA
aaaguggacuuggaaaaagu

SEQ ID NO: 91179 - RNA, 20 nt, Artificial Sequence
  MKO10091179_B_Hbb-bh2
  gRNA
auugugaugucuccacacuu

SEQ ID NO: 91180 - RNA, 20 nt, Artificial Sequence
  MKO10091180_B_Hbb-bh2
  gRNA
caaucacuaucaugcugccc

SEQ ID NO: 91181 - RNA, 20 nt, Artificial Sequence
  MKO10091181_B_Hbb-bh2
  gRNA
uaugguggagcucacugcag

SEQ ID NO: 91182 - RNA, 20 nt, Artificial Sequence
  MKO10091182_B_Hbb-bs
  gRNA
ggcugcugguugucuacccu

SEQ ID NO: 91183 - RNA, 20 nt, Artificial Sequence
  MKO10091183_B_Hbb-bs
  gRNA
agacucacccugaaguucuc

SEQ ID NO: 91184 - RNA, 20 nt, Artificial Sequence
  MKO10091184_B_Hbb-bs
  gRNA
caauaugaucgugauugugc

SEQ ID NO: 91185 - RNA, 20 nt, Artificial Sequence
  MKO10091185_B_Hbb-bt
  gRNA
ggcugcugguugucuacccu

SEQ ID NO: 91186 - RNA, 20 nt, Artificial Sequence
  MKO10091186_B_Hbb-bt
  gRNA
agacucacccugaaguucuc

SEQ ID NO: 91187 - RNA, 20 nt, Artificial Sequence
  MKO10091187_B_Hbb-bt
  gRNA
caauaugaucgugauugugc

SEQ ID NO: 91188 - RNA, 20 nt, Artificial Sequence
  MKO10091188_B_Hbb-y
  gRNA
ggcuucuuguuguguaccca

SEQ ID NO: 91189 - RNA, 20 nt, Artificial Sequence
  MKO10091189_B_Hbb-y
  gRNA
acagcucuuggguaaugugc

SEQ ID NO: 91190 - RNA, 20 nt, Artificial Sequence
  MKO10091190_B_Hbb-y
  gRNA
ugaauucacagcugagaugc

SEQ ID NO: 91191 - RNA, 20 nt, Artificial Sequence
  MKO10091191_B_Hbegf
  gRNA
cugagcacgaucaccucccg

SEQ ID NO: 91192 - RNA, 20 nt, Artificial Sequence
  MKO10091192_B_Hbegf
  gRNA
gcccaugacaccuguguccg

SEQ ID NO: 91193 - RNA, 20 nt, Artificial Sequence
  MKO10091193_B_Hbegf
  gRNA
uacaaggacuacugcaucca

SEQ ID NO: 91194 - RNA, 20 nt, Artificial Sequence
  MKO10091194_B_Hbp1
  gRNA
gagauacaucugaacuuagc

SEQ ID NO: 91195 - RNA, 20 nt, Artificial Sequence
  MKO10091195_B_Hbp1
  gRNA
cacugguggugggcgugcau

SEQ ID NO: 91196 - RNA, 20 nt, Artificial Sequence
  MKO10091196_B_Hbp1
  gRNA
cuaguagcuaugauguguac

SEQ ID NO: 91197 - RNA, 20 nt, Artificial Sequence
  MKO10091197_B_Hbq1a
  gRNA
ggcguaccucuccaaggccu

SEQ ID NO: 91198 - RNA, 20 nt, Artificial Sequence
  MKO10091198_B_Hbq1a
  gRNA
ggacucaccuggaaguuagc

SEQ ID NO: 91199 - RNA, 20 nt, Artificial Sequence
  MKO10091199_B_Hbq1a
  gRNA
caaaaccuacuucccacacu

SEQ ID NO: 91200 - RNA, 20 nt, Artificial Sequence
  MKO10091200_B_Hbq1b
  gRNA
guuucugggucacgugacuu

SEQ ID NO: 91201 - RNA, 20 nt, Artificial Sequence
  MKO10091201_B_Hbq1b
  gRNA
ggacucaccuggaaguuagc

SEQ ID NO: 91202 - RNA, 20 nt, Artificial Sequence
  MKO10091202_B_Hbq1b
  gRNA
caaaaccuacuucccacacu

SEQ ID NO: 91203 - RNA, 20 nt, Artificial Sequence
  MKO10091203_B_Hbs1l
  gRNA
cuucaucguaguuauauccc

SEQ ID NO: 91204 - RNA, 20 nt, Artificial Sequence
  MKO10091204_B_Hbs1l
  gRNA
uuugaagaugaugaucugua

SEQ ID NO: 91205 - RNA, 20 nt, Artificial Sequence
  MKO10091205_B_Hbs1l
  gRNA
cuuggucaauuucacuuaau

SEQ ID NO: 91206 - RNA, 20 nt, Artificial Sequence
  MKO10091206_B_Hccs
  gRNA
caagagcaagaauucguucc

SEQ ID NO: 91207 - RNA, 20 nt, Artificial Sequence
  MKO10091207_B_Hccs
  gRNA
auuccacauaaucauaggcc

SEQ ID NO: 91208 - RNA, 20 nt, Artificial Sequence
  MKO10091208_B_Hccs
  gRNA
gagccucgauccuucaaacc

SEQ ID NO: 91209 - RNA, 20 nt, Artificial Sequence
  MKO10091209_B_Hcfc1r1
  gRNA
gugccuaccugagugguggc

SEQ ID NO: 91210 - RNA, 20 nt, Artificial Sequence
  MKO10091210_B_Hcfc1r1
  gRNA
ggacgcaggguaguagggac

SEQ ID NO: 91211 - RNA, 20 nt, Artificial Sequence
  MKO10091211_B_Hcfc1r1
  gRNA
ucuucuccagucuuuccccc

SEQ ID NO: 91212 - RNA, 20 nt, Artificial Sequence
  MKO10091212_B_Hcfc1
  gRNA
gggugccaccccacuaaggc

SEQ ID NO: 91213 - RNA, 20 nt, Artificial Sequence
  MKO10091213_B_Hcfc1
  gRNA
caacgaccucuaugaacucc

SEQ ID NO: 91214 - RNA, 20 nt, Artificial Sequence
  MKO10091214_B_Hcfc1
  gRNA
acucgccuauugguguuugg

SEQ ID NO: 91215 - RNA, 20 nt, Artificial Sequence
  MKO10091215_B_Hcfc2
  gRNA
uucccuccuuguccgcggcu

SEQ ID NO: 91216 - RNA, 20 nt, Artificial Sequence
  MKO10091216_B_Hcfc2
  gRNA
auacuuguuuccuauaacac

SEQ ID NO: 91217 - RNA, 20 nt, Artificial Sequence
  MKO10091217_B_Hcfc2
  gRNA
uucaacuaguuacaaaccag

SEQ ID NO: 91218 - RNA, 20 nt, Artificial Sequence
  MKO10091218_B_Hck
  gRNA
gcuuccaucucggaggaacc

SEQ ID NO: 91219 - RNA, 20 nt, Artificial Sequence
  MKO10091219_B_Hck
  gRNA
acuccuccagaaccaccauc

SEQ ID NO: 91220 - RNA, 20 nt, Artificial Sequence
  MKO10091220_B_Hck
  gRNA
acucgagccacauaguugcu

SEQ ID NO: 91221 - RNA, 20 nt, Artificial Sequence
  MKO10091221_B_Hcls1
  gRNA
cuauggcggucgguuuggag

SEQ ID NO: 91222 - RNA, 20 nt, Artificial Sequence
  MKO10091222_B_Hcls1
  gRNA
guagaaugacaucuccgaga

SEQ ID NO: 91223 - RNA, 20 nt, Artificial Sequence
  MKO10091223_B_Hcls1
  gRNA
uccccaccguugcuccuucu

SEQ ID NO: 91224 - RNA, 20 nt, Artificial Sequence
  MKO10091224_B_Hcn1
  gRNA
gccaacaaacauugcguagc

SEQ ID NO: 91225 - RNA, 20 nt, Artificial Sequence
  MKO10091225_B_Hcn1
  gRNA
uacuaugagcaccgauacca

SEQ ID NO: 91226 - RNA, 20 nt, Artificial Sequence
  MKO10091226_B_Hcn1
  gRNA
gcuuaaugauccucugagag

SEQ ID NO: 91227 - RNA, 20 nt, Artificial Sequence
  MKO10091227_B_Hcn2
  gRNA
accgguguucauaguaaucg

SEQ ID NO: 91228 - RNA, 20 nt, Artificial Sequence
  MKO10091228_B_Hcn2
  gRNA
aggacgagaccaccgcgccc

SEQ ID NO: 91229 - RNA, 20 nt, Artificial Sequence
  MKO10091229_B_Hcn2
  gRNA
aagacuuccccagcgacugc

SEQ ID NO: 91230 - RNA, 20 nt, Artificial Sequence
  MKO10091230_B_Hcn3
  gRNA
guacuacgagcaucgcuacc

SEQ ID NO: 91231 - RNA, 20 nt, Artificial Sequence
  MKO10091231_B_Hcn3
  gRNA
ucucaccaccaugcgguuca

SEQ ID NO: 91232 - RNA, 20 nt, Artificial Sequence
  MKO10091232_B_Hcn3
  gRNA
cugggucuccaugaaccgca

SEQ ID NO: 91233 - RNA, 20 nt, Artificial Sequence
  MKO10091233_B_Hcn4
  gRNA
ucauucgauacauucaucag

SEQ ID NO: 91234 - RNA, 20 nt, Artificial Sequence
  MKO10091234_B_Hcn4
  gRNA
uauggacggcaggcacccgu

SEQ ID NO: 91235 - RNA, 20 nt, Artificial Sequence
  MKO10091235_B_Hcn4
  gRNA
guacgcaucgugaaccucau

SEQ ID NO: 91236 - RNA, 20 nt, Artificial Sequence
  MKO10091236_B_Hcrtr1
  gRNA
uccagaucuuccgcaagcuc

SEQ ID NO: 91237 - RNA, 20 nt, Artificial Sequence
  MKO10091237_B_Hcrtr1
  gRNA
gcggaacuggaaacggcccu

SEQ ID NO: 91238 - RNA, 20 nt, Artificial Sequence
  MKO10091238_B_Hcrtr1
  gRNA
cuggccgaagagccacgacu

SEQ ID NO: 91239 - RNA, 20 nt, Artificial Sequence
  MKO10091239_B_Hcrtr2
  gRNA
uuuaccucuuuagcacauug

SEQ ID NO: 91240 - RNA, 20 nt, Artificial Sequence
  MKO10091240_B_Hcrtr2
  gRNA
uccaaauauuccguaaacuc

SEQ ID NO: 91241 - RNA, 20 nt, Artificial Sequence
  MKO10091241_B_Hcrtr2
  gRNA
ucucagugaugucaacaacg

SEQ ID NO: 91242 - RNA, 20 nt, Artificial Sequence
  MKO10091242_B_Hcrt
  gRNA
caugaacuuuccuucuacaa

SEQ ID NO: 91243 - RNA, 20 nt, Artificial Sequence
  MKO10091243_B_Hcrt
  gRNA
cgcugcggguauccugacuc

SEQ ID NO: 91244 - RNA, 20 nt, Artificial Sequence
  MKO10091244_B_Hcrt
  gRNA
cuaccaccgcuuuagcaccc

SEQ ID NO: 91245 - RNA, 20 nt, Artificial Sequence
  MKO10091245_B_Hcst
  gRNA
agagucuacaucaacaugcc

SEQ ID NO: 91246 - RNA, 20 nt, Artificial Sequence
  MKO10091246_B_Hcst
  gRNA
ugccguggucagccucugcc

SEQ ID NO: 91247 - RNA, 20 nt, Artificial Sequence
  MKO10091247_B_Hcst
  gRNA
aguggcugcaagucagacau

SEQ ID NO: 91248 - RNA, 20 nt, Artificial Sequence
  MKO10091248_B_Hc
  gRNA
acgacuugaagccagccaaa

SEQ ID NO: 91249 - RNA, 20 nt, Artificial Sequence
  MKO10091249_B_Hc
  gRNA
cccagucucucacguguauc

SEQ ID NO: 91250 - RNA, 20 nt, Artificial Sequence
  MKO10091250_B_Hc
  gRNA
uguacuuacuugggauuaga

SEQ ID NO: 91251 - RNA, 20 nt, Artificial Sequence
  MKO10091251_B_Hdac10
  gRNA
gcuccucuuuauccaggguc

SEQ ID NO: 91252 - RNA, 20 nt, Artificial Sequence
  MKO10091252_B_Hdac10
  gRNA
gugcagcccccgcugccagc

SEQ ID NO: 91253 - RNA, 20 nt, Artificial Sequence
  MKO10091253_B_Hdac10
  gRNA
agcgggggcugcacugcagc

SEQ ID NO: 91254 - RNA, 20 nt, Artificial Sequence
  MKO10091254_B_Hdac11
  gRNA
ccagcacucaccaacauuga

SEQ ID NO: 91255 - RNA, 20 nt, Artificial Sequence
  MKO10091255_B_Hdac11
  gRNA
aaggugaucaacuuccugaa

SEQ ID NO: 91256 - RNA, 20 nt, Artificial Sequence
  MKO10091256_B_Hdac11
  gRNA
aggccccugcggacccagac

SEQ ID NO: 91257 - RNA, 20 nt, Artificial Sequence
  MKO10091257_B_Hdac1
  gRNA
aggcauacuuuagcaguucc

SEQ ID NO: 91258 - RNA, 20 nt, Artificial Sequence
  MKO10091258_B_Hdac1
  gRNA
gauguuggaaacuacuauua

SEQ ID NO: 91259 - RNA, 20 nt, Artificial Sequence
  MKO10091259_B_Hdac1
  gRNA
cacaauuugcugcucaacua

SEQ ID NO: 91260 - RNA, 20 nt, Artificial Sequence
  MKO10091260_B_Hdac2
  gRNA
acuugauauacucaucgcug

SEQ ID NO: 91261 - RNA, 20 nt, Artificial Sequence
  MKO10091261_B_Hdac2
  gRNA
uaacuuacuuaaguaauucg

SEQ ID NO: 91262 - RNA, 20 nt, Artificial Sequence
  MKO10091262_B_Hdac2
  gRNA
ccaugaagccucauagaauc

SEQ ID NO: 91263 - RNA, 20 nt, Artificial Sequence
  MKO10091263_B_Hdac3
  gRNA
agucagccccaccaauaugc

SEQ ID NO: 91264 - RNA, 20 nt, Artificial Sequence
  MKO10091264_B_Hdac3
  gRNA
cccaaugaaaccucaucgcc

SEQ ID NO: 91265 - RNA, 20 nt, Artificial Sequence
  MKO10091265_B_Hdac3
  gRNA
cauagccuaguccugcauua

SEQ ID NO: 91266 - RNA, 20 nt, Artificial Sequence
  MKO10091266_B_Hdac4
  gRNA
cugcaaugaguaucugccgc

SEQ ID NO: 91267 - RNA, 20 nt, Artificial Sequence
  MKO10091267_B_Hdac4
  gRNA
agcaccagcggaaacuggag

SEQ ID NO: 91268 - RNA, 20 nt, Artificial Sequence
  MKO10091268_B_Hdac4
  gRNA
gcugcagcagcucaagaaca

SEQ ID NO: 91269 - RNA, 20 nt, Artificial Sequence
  MKO10091269_B_Hdac5
  gRNA
aguccguggcaggauuucca

SEQ ID NO: 91270 - RNA, 20 nt, Artificial Sequence
  MKO10091270_B_Hdac5
  gRNA
gcugcucauccugcgcaaca

SEQ ID NO: 91271 - RNA, 20 nt, Artificial Sequence
  MKO10091271_B_Hdac5
  gRNA
uggcgugggcuccuuugacu

SEQ ID NO: 91272 - RNA, 20 nt, Artificial Sequence
  MKO10091272_B_Hdac6
  gRNA
gcccuugaagccccacaacu

SEQ ID NO: 91273 - RNA, 20 nt, Artificial Sequence
  MKO10091273_B_Hdac6
  gRNA
gggccgcuguguguccuuuc

SEQ ID NO: 91274 - RNA, 20 nt, Artificial Sequence
  MKO10091274_B_Hdac6
  gRNA
gcuccuccuucucagcgaac

SEQ ID NO: 91275 - RNA, 20 nt, Artificial Sequence
  MKO10091275_B_Hdac7
  gRNA
cacuuucccuugcguaaaac

SEQ ID NO: 91276 - RNA, 20 nt, Artificial Sequence
  MKO10091276_B_Hdac7
  gRNA
cuccauggacccaccaaugc

SEQ ID NO: 91277 - RNA, 20 nt, Artificial Sequence
  MKO10091277_B_Hdac7
  gRNA
gcagccccaguauucccuac

SEQ ID NO: 91278 - RNA, 20 nt, Artificial Sequence
  MKO10091278_B_Hdac8
  gRNA
cuuaccuaguccauauucua

SEQ ID NO: 91279 - RNA, 20 nt, Artificial Sequence
  MKO10091279_B_Hdac8
  gRNA
aguguaaaguagccaucaac

SEQ ID NO: 91280 - RNA, 20 nt, Artificial Sequence
  MKO10091280_B_Hdac8
  gRNA
gaugguccucaucaccuucu

SEQ ID NO: 91281 - RNA, 20 nt, Artificial Sequence
  MKO10091281_B_Hdac9
  gRNA
agcagcacgagaauuugaca

SEQ ID NO: 91282 - RNA, 20 nt, Artificial Sequence
  MKO10091282_B_Hdac9
  gRNA
cacggaaugauucuuuccau

SEQ ID NO: 91283 - RNA, 20 nt, Artificial Sequence
  MKO10091283_B_Hdac9
  gRNA
uccuugcuaucuugagcucc

SEQ ID NO: 91284 - RNA, 20 nt, Artificial Sequence
  MKO10091284_B_Hdc
  gRNA
auugaacgagucaucaugcc

SEQ ID NO: 91285 - RNA, 20 nt, Artificial Sequence
  MKO10091285_B_Hdc
  gRNA
cggccagcaugucuccuagc

SEQ ID NO: 91286 - RNA, 20 nt, Artificial Sequence
  MKO10091286_B_Hdc
  gRNA
cgugaauccuaagcaguuaa

SEQ ID NO: 91287 - RNA, 20 nt, Artificial Sequence
  MKO10091287_B_Hddc2
  gRNA
cuguauacccagccaguccg

SEQ ID NO: 91288 - RNA, 20 nt, Artificial Sequence
  MKO10091288_B_Hddc2
  gRNA
agccaaauucgugaagcagc

SEQ ID NO: 91289 - RNA, 20 nt, Artificial Sequence
  MKO10091289_B_Hddc2
  gRNA
ccagugugaaaugauccuuc

SEQ ID NO: 91290 - RNA, 20 nt, Artificial Sequence
  MKO10091290_B_Hddc3
  gRNA
ggcacuaaagcagcuguucg

SEQ ID NO: 91291 - RNA, 20 nt, Artificial Sequence
  MKO10091291_B_Hddc3
  gRNA
guacuucgagugggcagccc

SEQ ID NO: 91292 - RNA, 20 nt, Artificial Sequence
  MKO10091292_B_Hddc3
  gRNA
caccagcgcaaugggcucgg

SEQ ID NO: 91293 - RNA, 20 nt, Artificial Sequence
  MKO10091293_B_Hdgfl1
  gRNA
ucagccucgcgcucuucagc

SEQ ID NO: 91294 - RNA, 20 nt, Artificial Sequence
  MKO10091294_B_Hdgfl1
  gRNA
ggaggcggcuccuggugcgu

SEQ ID NO: 91295 - RNA, 20 nt, Artificial Sequence
  MKO10091295_B_Hdgfl1
  gRNA
gcuccuccacggcguccagc

SEQ ID NO: 91296 - RNA, 20 nt, Artificial Sequence
  MKO10091296_B_Hdgfrp2
  gRNA
ccacgucgcugccacaaccc

SEQ ID NO: 91297 - RNA, 20 nt, Artificial Sequence
  MKO10091297_B_Hdgfrp2
  gRNA
gcggaagacaccagucuuga

SEQ ID NO: 91298 - RNA, 20 nt, Artificial Sequence
  MKO10091298_B_Hdgfrp2
  gRNA
caguguguccccaucagaag

SEQ ID NO: 91299 - RNA, 20 nt, Artificial Sequence
  MKO10091299_B_Hdgfrp3
  gRNA
agaagucuucuaaacagucc

SEQ ID NO: 91300 - RNA, 20 nt, Artificial Sequence
  MKO10091300_B_Hdgfrp3
  gRNA
auagauugaugaacucccag

SEQ ID NO: 91301 - RNA, 20 nt, Artificial Sequence
  MKO10091301_B_Hdgfrp3
  gRNA
aauccaggagugaaauuuac

SEQ ID NO: 91302 - RNA, 20 nt, Artificial Sequence
  MKO10091302_B_Hdgf
  gRNA
ugagaggccccugccuguag

SEQ ID NO: 91303 - RNA, 20 nt, Artificial Sequence
  MKO10091303_B_Hdgf
  gRNA
gguggagcccgaagcccaug

SEQ ID NO: 91304 - RNA, 20 nt, Artificial Sequence
  MKO10091304_B_Hdgf
  gRNA
ucucaugaucucugacgccc

SEQ ID NO: 91305 - RNA, 20 nt, Artificial Sequence
  MKO10091305_B_Hdhd1a
  gRNA
ccuucacccuuauuccguaa

SEQ ID NO: 91306 - RNA, 20 nt, Artificial Sequence
  MKO10091306_B_Hdhd1a
  gRNA
acaguucaggcuugaagucg

SEQ ID NO: 91307 - RNA, 20 nt, Artificial Sequence
  MKO10091307_B_Hdhd1a
  gRNA
gaucaucccccagaacgaug

SEQ ID NO: 91308 - RNA, 20 nt, Artificial Sequence
  MKO10091308_B_Hdhd2
  gRNA
cgcgcacugccugaguucac

SEQ ID NO: 91309 - RNA, 20 nt, Artificial Sequence
  MKO10091309_B_Hdhd2
  gRNA
uuaagagcuuccugugcgcc

SEQ ID NO: 91310 - RNA, 20 nt, Artificial Sequence
  MKO10091310_B_Hdhd2
  gRNA
caacgcuguggucauuggac

SEQ ID NO: 91311 - RNA, 20 nt, Artificial Sequence
  MKO10091311_B_Hdhd3
  gRNA
agagguaacuaucccccacg

SEQ ID NO: 91312 - RNA, 20 nt, Artificial Sequence
  MKO10091312_B_Hdhd3
  gRNA
ccagcuucagaccccgcuua

SEQ ID NO: 91313 - RNA, 20 nt, Artificial Sequence
  MKO10091313_B_Hdhd3
  gRNA
aaaauccgugggucggguuu

SEQ ID NO: 91314 - RNA, 20 nt, Artificial Sequence
  MKO10091314_B_Hdlbp
  gRNA
cguacagaaaucgucuucac

SEQ ID NO: 91315 - RNA, 20 nt, Artificial Sequence
  MKO10091315_B_Hdlbp
  gRNA
gggccggaucuuguuacucc

SEQ ID NO: 91316 - RNA, 20 nt, Artificial Sequence
  MKO10091316_B_Hdlbp
  gRNA
ucgcauuaagaagauuuaug

SEQ ID NO: 91317 - RNA, 20 nt, Artificial Sequence
  MKO10091317_B_Hdx
  gRNA
uuguccgaagcaagcucuca

SEQ ID NO: 91318 - RNA, 20 nt, Artificial Sequence
  MKO10091318_B_Hdx
  gRNA
acuagaugcuguaugcaaug

SEQ ID NO: 91319 - RNA, 20 nt, Artificial Sequence
  MKO10091319_B_Hdx
  gRNA
augucgacugugaaauaguu

SEQ ID NO: 91320 - RNA, 20 nt, Artificial Sequence
  MKO10091320_B_Heaur1
  gRNA
gcacaaauacccgugucuca

SEQ ID NO: 91321 - RNA, 20 nt, Artificial Sequence
  MKO10091321_B_Heaur1
  gRNA
ccuagugacgagaucuguga

SEQ ID NO: 91322 - RNA, 20 nt, Artificial Sequence
  MKO10091322_B_Heaur1
  gRNA
cauuccagacacuucugcgc

SEQ ID NO: 91323 - RNA, 20 nt, Artificial Sequence
  MKO10091323_B_Heaur2
  gRNA
cucccucuagagagccgccc

SEQ ID NO: 91324 - RNA, 20 nt, Artificial Sequence
  MKO10091324_B_Heaur2
  gRNA
cucaccgugcucaggguagu

SEQ ID NO: 91325 - RNA, 20 nt, Artificial Sequence
  MKO10091325_B_Heaur2
  gRNA
cagccaucccccgaccaccg

SEQ ID NO: 91326 - RNA, 20 nt, Artificial Sequence
  MKO10091326_B_Heaur3
  gRNA
aaaggacaucaugacgcccc

SEQ ID NO: 91327 - RNA, 20 nt, Artificial Sequence
  MKO10091327_B_Heaur3
  gRNA
uuguguuacaguacuuacgu

SEQ ID NO: 91328 - RNA, 20 nt, Artificial Sequence
  MKO10091328_B_Heaur3
  gRNA
uguagagagcauagccaaug

SEQ ID NO: 91329 - RNA, 20 nt, Artificial Sequence
  MKO10091329_B_Heaur5a
  gRNA
agucugcagaguauacugac

SEQ ID NO: 91330 - RNA, 20 nt, Artificial Sequence
  MKO10091330_B_Heaur5a
  gRNA
cuuuauguggagcacagacg

SEQ ID NO: 91331 - RNA, 20 nt, Artificial Sequence
  MKO10091331_B_Heaur5a
  gRNA
cuucuuuguaggaggacguc

SEQ ID NO: 91332 - RNA, 20 nt, Artificial Sequence
  MKO10091332_B_Heaur5b
  gRNA
cucgaucccuccugaccgac

SEQ ID NO: 91333 - RNA, 20 nt, Artificial Sequence
  MKO10091333_B_Heaur5b
  gRNA
cuugcagcccuuuauagcau

SEQ ID NO: 91334 - RNA, 20 nt, Artificial Sequence
  MKO10091334_B_Heaur5b
  gRNA
aaguauccccaaugcuauaa

SEQ ID NO: 91335 - RNA, 20 nt, Artificial Sequence
  MKO10091335_B_Heaur6
  gRNA
ucuugugcgagcuugucagc

SEQ ID NO: 91336 - RNA, 20 nt, Artificial Sequence
  MKO10091336_B_Heaur6
  gRNA
ccacucuugcccagcaaguc

SEQ ID NO: 91337 - RNA, 20 nt, Artificial Sequence
  MKO10091337_B_Heaur6
  gRNA
gucaacaggaaaucuaaguu

SEQ ID NO: 91338 - RNA, 20 nt, Artificial Sequence
  MKO10091338_B_Hebp1
  gRNA
ucacaagccagaccucguua

SEQ ID NO: 91339 - RNA, 20 nt, Artificial Sequence
  MKO10091339_B_Hebp1
  gRNA
uaacgaggucuggcuuguga

SEQ ID NO: 91340 - RNA, 20 nt, Artificial Sequence
  MKO10091340_B_Hebp1
  gRNA
agggggcaaguuugcuacug

SEQ ID NO: 91341 - RNA, 20 nt, Artificial Sequence
  MKO10091341_B_Hebp2
  gRNA
cugagcccucggccaccccg

SEQ ID NO: 91342 - RNA, 20 nt, Artificial Sequence
  MKO10091342_B_Hebp2
  gRNA
gccagaccucgggguggccg

SEQ ID NO: 91343 - RNA, 20 nt, Artificial Sequence
  MKO10091343_B_Hebp2
  gRNA
cguuauuucuaucaaguaau

SEQ ID NO: 91344 - RNA, 20 nt, Artificial Sequence
  MKO10091344_B_Heca
  gRNA
cauguauaccuacgacaucc

SEQ ID NO: 91345 - RNA, 20 nt, Artificial Sequence
  MKO10091345_B_Heca
  gRNA
gcggcgucgcccggcgcggu

SEQ ID NO: 91346 - RNA, 20 nt, Artificial Sequence
  MKO10091346_B_Heca
  gRNA
caucgucuuccauccgaaca

SEQ ID NO: 91347 - RNA, 20 nt, Artificial Sequence
  MKO10091347_B_Hecud1
  gRNA
uacagucuauaagcugccga

SEQ ID NO: 91348 - RNA, 20 nt, Artificial Sequence
  MKO10091348_B_Hecud1
  gRNA
cucauagaugcgauugacac

SEQ ID NO: 91349 - RNA, 20 nt, Artificial Sequence
  MKO10091349_B_Hecud1
  gRNA
ccgugccauaacauacuacc

SEQ ID NO: 91350 - RNA, 20 nt, Artificial Sequence
  MKO10091350_B_Hecud2
  gRNA
ggcgggaccuucacuucaga

SEQ ID NO: 91351 - RNA, 20 nt, Artificial Sequence
  MKO10091351_B_Hecud2
  gRNA
ugucuuuagggcuuggacag

SEQ ID NO: 91352 - RNA, 20 nt, Artificial Sequence
  MKO10091352_B_Hecud2
  gRNA
cucgacugucacccagaaga

SEQ ID NO: 91353 - RNA, 20 nt, Artificial Sequence
  MKO10091353_B_Hecud3
  gRNA
uuagcuaugugcccccaaca

SEQ ID NO: 91354 - RNA, 20 nt, Artificial Sequence
  MKO10091354_B_Hecud3
  gRNA
ggaucccaggcgaugugaau

SEQ ID NO: 91355 - RNA, 20 nt, Artificial Sequence
  MKO10091355_B_Hecud3
  gRNA
uaucugcguugcuaucuguc

SEQ ID NO: 91356 - RNA, 20 nt, Artificial Sequence
  MKO10091356_B_Hecw1
  gRNA
uauaagaaccguggagucaa

SEQ ID NO: 91357 - RNA, 20 nt, Artificial Sequence
  MKO10091357_B_Hecw1
  gRNA
gggagaagcugaucagccuc

SEQ ID NO: 91358 - RNA, 20 nt, Artificial Sequence
  MKO10091358_B_Hecw1
  gRNA
acauuccacaaaguaagagc

SEQ ID NO: 91359 - RNA, 20 nt, Artificial Sequence
  MKO10091359_B_Hecw2
  gRNA
guucuucacgguaauacagg

SEQ ID NO: 91360 - RNA, 20 nt, Artificial Sequence
  MKO10091360_B_Hecw2
  gRNA
gcagggcuccacuaauacca

SEQ ID NO: 91361 - RNA, 20 nt, Artificial Sequence
  MKO10091361_B_Hecw2
  gRNA
cucgucagcuucacauuguc

SEQ ID NO: 91362 - RNA, 20 nt, Artificial Sequence
  MKO10091362_B_Heg1
  gRNA
ggcggguugcugcacucgag

SEQ ID NO: 91363 - RNA, 20 nt, Artificial Sequence
  MKO10091363_B_Heg1
  gRNA
ccugcgcgccccacuccacg

SEQ ID NO: 91364 - RNA, 20 nt, Artificial Sequence
  MKO10091364_B_Heg1
  gRNA
acuccgggccaccauucucc

SEQ ID NO: 91365 - RNA, 20 nt, Artificial Sequence
  MKO10091365_B_Helb
  gRNA
aaauuccuguaugcgcucag

SEQ ID NO: 91366 - RNA, 20 nt, Artificial Sequence
  MKO10091366_B_Helb
  gRNA
cuuagccucugagcgcauac

SEQ ID NO: 91367 - RNA, 20 nt, Artificial Sequence
  MKO10091367_B_Helb
  gRNA
auucuccacgguucgaguuc

SEQ ID NO: 91368 - RNA, 20 nt, Artificial Sequence
  MKO10091368_B_Hells
  gRNA
caagcaaaugcugaagucug

SEQ ID NO: 91369 - RNA, 20 nt, Artificial Sequence
  MKO10091369_B_Hells
  gRNA
ugaaucuuauaauauuucag

SEQ ID NO: 91370 - RNA, 20 nt, Artificial Sequence
  MKO10091370_B_Hells
  gRNA
auagucaugaaaaagaaaag

SEQ ID NO: 91371 - RNA, 20 nt, Artificial Sequence
  MKO10091371_B_Helq
  gRNA
uuucccgccacucguuggca

SEQ ID NO: 91372 - RNA, 20 nt, Artificial Sequence
  MKO10091372_B_Helq
  gRNA
ucaaacgaaagaucgcuucc

SEQ ID NO: 91373 - RNA, 20 nt, Artificial Sequence
  MKO10091373_B_Helq
  gRNA
augccuugaucgaaaccagc

SEQ ID NO: 91374 - RNA, 20 nt, Artificial Sequence
  MKO10091374_B_Helt
  gRNA
caaacguuaccuguuucgcc

SEQ ID NO: 91375 - RNA, 20 nt, Artificial Sequence
  MKO10091375_B_Helt
  gRNA
uuugcagaguuccgggaaac

SEQ ID NO: 91376 - RNA, 20 nt, Artificial Sequence
  MKO10091376_B_Helt
  gRNA
cgcacaccagaaugucugac

SEQ ID NO: 91377 - RNA, 20 nt, Artificial Sequence
  MKO10091377_B_Helz2
  gRNA
gguagauuggacacccgagc

SEQ ID NO: 91378 - RNA, 20 nt, Artificial Sequence
  MKO10091378_B_Helz2
  gRNA
auacuucuuugcugcugcgc

SEQ ID NO: 91379 - RNA, 20 nt, Artificial Sequence
  MKO10091379_B_Helz2
  gRNA
agacauggaacugcgagaac

SEQ ID NO: 91380 - RNA, 20 nt, Artificial Sequence
  MKO10091380_B_Helz
  gRNA
agacuccccugacagugacu

SEQ ID NO: 91381 - RNA, 20 nt, Artificial Sequence
  MKO10091381_B_Helz
  gRNA
cugugcugcaugcagcugaa

SEQ ID NO: 91382 - RNA, 20 nt, Artificial Sequence
  MKO10091382_B_Helz
  gRNA
gacacuucucacagaaacag

SEQ ID NO: 91383 - RNA, 20 nt, Artificial Sequence
  MKO10091383_B_Hemgn
  gRNA
aucguggcaagauggacaug

SEQ ID NO: 91384 - RNA, 20 nt, Artificial Sequence
  MKO10091384_B_Hemgn
  gRNA
caggucucuugagaaccuug

SEQ ID NO: 91385 - RNA, 20 nt, Artificial Sequence
  MKO10091385_B_Hemgn
  gRNA
auugugaugucugccucccc

SEQ ID NO: 91386 - RNA, 20 nt, Artificial Sequence
  MKO10091386_B_Hemk1
  gRNA
uauguggccguagauuacag

SEQ ID NO: 91387 - RNA, 20 nt, Artificial Sequence
  MKO10091387_B_Hemk1
  gRNA
gacagccuaccuuggggagc

SEQ ID NO: 91388 - RNA, 20 nt, Artificial Sequence
  MKO10091388_B_Hemk1
  gRNA
gcagagucgaguuguugcug

SEQ ID NO: 91389 - RNA, 20 nt, Artificial Sequence
  MKO10091389_B_Hemt1
  gRNA
uguuacuuauguagcacuua

SEQ ID NO: 91390 - RNA, 20 nt, Artificial Sequence
  MKO10091390_B_Hemt1
  gRNA
auacuuacaucuaggcucaa

SEQ ID NO: 91391 - RNA, 20 nt, Artificial Sequence
  MKO10091391_B_Hemt1
  gRNA
cuucuucuugucaauucuca

SEQ ID NO: 91392 - RNA, 20 nt, Artificial Sequence
  MKO10091392_B_Henmt1
  gRNA
gagagagacucccgcuugcu

SEQ ID NO: 91393 - RNA, 20 nt, Artificial Sequence
  MKO10091393_B_Henmt1
  gRNA
ugauaccguuguuuguauaa

SEQ ID NO: 91394 - RNA, 20 nt, Artificial Sequence
  MKO10091394_B_Henmt1
  gRNA
gcgucccucagggugacugu

SEQ ID NO: 91395 - RNA, 20 nt, Artificial Sequence
  MKO10091395_B_Hepacam2
  gRNA
acagucaucauaacuuccgu

SEQ ID NO: 91396 - RNA, 20 nt, Artificial Sequence
  MKO10091396_B_Hepacam2
  gRNA
gucaaaccccgucagugaga

SEQ ID NO: 91397 - RNA, 20 nt, Artificial Sequence
  MKO10091397_B_Hepacam2
  gRNA
caauccaaaggguguuguuu

SEQ ID NO: 91398 - RNA, 20 nt, Artificial Sequence
  MKO10091398_B_Hepacam
  gRNA
ggagcauucgggagucauug

SEQ ID NO: 91399 - RNA, 20 nt, Artificial Sequence
  MKO10091399_B_Hepacam
  gRNA
gaugaccgccuaaaaucaga

SEQ ID NO: 91400 - RNA, 20 nt, Artificial Sequence
  MKO10091400_B_Hepacam
  gRNA
cucuauaucaucuugucuac

SEQ ID NO: 91401 - RNA, 20 nt, Artificial Sequence
  MKO10091401_B_Hephl1
  gRNA
ugggcuaauuggcccccugc

SEQ ID NO: 91402 - RNA, 20 nt, Artificial Sequence
  MKO10091402_B_Hephl1
  gRNA
cagacuugcgaccuuauuuc

SEQ ID NO: 91403 - RNA, 20 nt, Artificial Sequence
  MKO10091403_B_Hephl1
  gRNA
ccugagccugagaugugcgu

SEQ ID NO: 91404 - RNA, 20 nt, Artificial Sequence
  MKO10091404_B_Heph
  gRNA
guaggcucacuauacccaga

SEQ ID NO: 91405 - RNA, 20 nt, Artificial Sequence
  MKO10091405_B_Heph
  gRNA
gcuccaagagacauugcaac

SEQ ID NO: 91406 - RNA, 20 nt, Artificial Sequence
  MKO10091406_B_Heph
  gRNA
uucucauaaaaaacaccgug

SEQ ID NO: 91407 - RNA, 20 nt, Artificial Sequence
  MKO10091407_B_Herc1
  gRNA
guaguaguuuguguaucagc

SEQ ID NO: 91408 - RNA, 20 nt, Artificial Sequence
  MKO10091408_B_Herc1
  gRNA
ucaccagucugaaugcuauc

SEQ ID NO: 91409 - RNA, 20 nt, Artificial Sequence
  MKO10091409_B_Herc1
  gRNA
aagccuucagauguucuagu

SEQ ID NO: 91410 - RNA, 20 nt, Artificial Sequence
  MKO10091410_B_Herc2
  gRNA
auugacuuggcucuauacac

SEQ ID NO: 91411 - RNA, 20 nt, Artificial Sequence
  MKO10091411_B_Herc2
  gRNA
agaguguagugguagcugac

SEQ ID NO: 91412 - RNA, 20 nt, Artificial Sequence
  MKO10091412_B_Herc2
  gRNA
cuguggucuguggaacgaaa

SEQ ID NO: 91413 - RNA, 20 nt, Artificial Sequence
  MKO10091413_B_Herc3
  gRNA
ugaucagcauaucauacacg

SEQ ID NO: 91414 - RNA, 20 nt, Artificial Sequence
  MKO10091414_B_Herc3
  gRNA
aaacagcucccgagagagac

SEQ ID NO: 91415 - RNA, 20 nt, Artificial Sequence
  MKO10091415_B_Herc3
  gRNA
aaacuuguaauauggucugc

SEQ ID NO: 91416 - RNA, 20 nt, Artificial Sequence
  MKO10091416_B_Herc4
  gRNA
ccauucaugcaagucgcagc

SEQ ID NO: 91417 - RNA, 20 nt, Artificial Sequence
  MKO10091417_B_Herc4
  gRNA
ggauggggacguaacaaauu

SEQ ID NO: 91418 - RNA, 20 nt, Artificial Sequence
  MKO10091418_B_Herc4
  gRNA
cacacgcaaccuguacuauc

SEQ ID NO: 91419 - RNA, 20 nt, Artificial Sequence
  MKO10091419_B_Herc6
  gRNA
cacucuuuggccuuaucaga

SEQ ID NO: 91420 - RNA, 20 nt, Artificial Sequence
  MKO10091420_B_Herc6
  gRNA
agccgguucugaagggcagc

SEQ ID NO: 91421 - RNA, 20 nt, Artificial Sequence
  MKO10091421_B_Herc6
  gRNA
caaagagugguaguguccac

SEQ ID NO: 91422 - RNA, 20 nt, Artificial Sequence
  MKO10091422_B_Herpud1
  gRNA
acugccuugcauagaucugc

SEQ ID NO: 91423 - RNA, 20 nt, Artificial Sequence
  MKO10091423_B_Herpud1
  gRNA
aucagcguccagaggaccag

SEQ ID NO: 91424 - RNA, 20 nt, Artificial Sequence
  MKO10091424_B_Herpud1
  gRNA
cauaccuuugugcugguuuc

SEQ ID NO: 91425 - RNA, 20 nt, Artificial Sequence
  MKO10091425_B_Herpud2
  gRNA
ugcuucgugacuuccucuau

SEQ ID NO: 91426 - RNA, 20 nt, Artificial Sequence
  MKO10091426_B_Herpud2
  gRNA
ugccagaauacaccaaccuc

SEQ ID NO: 91427 - RNA, 20 nt, Artificial Sequence
  MKO10091427_B_Herpud2
  gRNA
gcacaccuugcccaggaaac

SEQ ID NO: 91428 - RNA, 20 nt, Artificial Sequence
  MKO10091428_B_Hes1
  gRNA
cugcagcgggcgcagaugac

SEQ ID NO: 91429 - RNA, 20 nt, Artificial Sequence
  MKO10091429_B_Hes1
  gRNA
guccggugucguguugacac

SEQ ID NO: 91430 - RNA, 20 nt, Artificial Sequence
  MKO10091430_B_Hes1
  gRNA
agccagugucaacacgacac

SEQ ID NO: 91431 - RNA, 20 nt, Artificial Sequence
  MKO10091431_B_Hes2
  gRNA
ccgagccugucuggcgcgac

SEQ ID NO: 91432 - RNA, 20 nt, Artificial Sequence
  MKO10091432_B_Hes2
  gRNA
gcagaaccuaaagccgcugc

SEQ ID NO: 91433 - RNA, 20 nt, Artificial Sequence
  MKO10091433_B_Hes2
  gRNA
aaugacugugcgcuuccuac

SEQ ID NO: 91434 - RNA, 20 nt, Artificial Sequence
  MKO10091434_B_Hes3
  gRNA
gugacacguugaugcgugca

SEQ ID NO: 91435 - RNA, 20 nt, Artificial Sequence
  MKO10091435_B_Hes3
  gRNA
cacuaccuugcagugaguuc

SEQ ID NO: 91436 - RNA, 20 nt, Artificial Sequence
  MKO10091436_B_Hes3
  gRNA
uguacuuaacacucagcucc

SEQ ID NO: 91437 - RNA, 20 nt, Artificial Sequence
  MKO10091437_B_Hes5
  gRNA
aggcauggccccaaguaccg

SEQ ID NO: 91438 - RNA, 20 nt, Artificial Sequence
  MKO10091438_B_Hes5
  gRNA
cgacgcaucuucuccaccac

SEQ ID NO: 91439 - RNA, 20 nt, Artificial Sequence
  MKO10091439_B_Hes5
  gRNA
acugagcaucuccaccgcca

SEQ ID NO: 91440 - RNA, 20 nt, Artificial Sequence
  MKO10091440_B_Hes6
  gRNA
gcaagcgagcgcuucgcugc

SEQ ID NO: 91441 - RNA, 20 nt, Artificial Sequence
  MKO10091441_B_Hes6
  gRNA
aaccucggcguucucuagcu

SEQ ID NO: 91442 - RNA, 20 nt, Artificial Sequence
  MKO10091442_B_Hes6
  gRNA
guagaccauggcuccguccc

SEQ ID NO: 91443 - RNA, 20 nt, Artificial Sequence
  MKO10091443_B_Hes7
  gRNA
cccuauucucagcucgcucc

SEQ ID NO: 91444 - RNA, 20 nt, Artificial Sequence
  MKO10091444_B_Hes7
  gRNA
cggcgccgcuucuccaccaa

SEQ ID NO: 91445 - RNA, 20 nt, Artificial Sequence
  MKO10091445_B_Hes7
  gRNA
gcuacuugagggagcgaagc

SEQ ID NO: 91446 - RNA, 20 nt, Artificial Sequence
  MKO10091446_B_Hesx1
  gRNA
cagcauaccugagucaccgc

SEQ ID NO: 91447 - RNA, 20 nt, Artificial Sequence
  MKO10091447_B_Hesx1
  gRNA
cugagcaccuucccgaaggc

SEQ ID NO: 91448 - RNA, 20 nt, Artificial Sequence
  MKO10091448_B_Hesx1
  gRNA
aucgccgagcaaagaugaaa

SEQ ID NO: 91449 - RNA, 20 nt, Artificial Sequence
  MKO10091449_B_Hexa
  gRNA
agacuuucagucagcuuguu

SEQ ID NO: 91450 - RNA, 20 nt, Artificial Sequence
  MKO10091450_B_Hexa
  gRNA
uacucgccucugagacuguc

SEQ ID NO: 91451 - RNA, 20 nt, Artificial Sequence
  MKO10091451_B_Hexa
  gRNA
agcgccccagacagucucag

SEQ ID NO: 91452 - RNA, 20 nt, Artificial Sequence
  MKO10091452_B_Hexb
  gRNA
aggacucgcacucugacucg

SEQ ID NO: 91453 - RNA, 20 nt, Artificial Sequence
  MKO10091453_B_Hexb
  gRNA
uuacagucccgaaagagucu

SEQ ID NO: 91454 - RNA, 20 nt, Artificial Sequence
  MKO10091454_B_Hexb
  gRNA
uuaguuuaccaagacucuuu

SEQ ID NO: 91455 - RNA, 20 nt, Artificial Sequence
  MKO10091455_B_Hexdc
  gRNA
ugagggccaagcaugcauac

SEQ ID NO: 91456 - RNA, 20 nt, Artificial Sequence
  MKO10091456_B_Hexdc
  gRNA
agggggaaaccucaaaacag

SEQ ID NO: 91457 - RNA, 20 nt, Artificial Sequence
  MKO10091457_B_Hexdc
  gRNA
aucccucaggaacagcuaaa

SEQ ID NO: 91458 - RNA, 20 nt, Artificial Sequence
  MKO10091458_B_Hexim1
  gRNA
ucgagccgagauguucgcca

SEQ ID NO: 91459 - RNA, 20 nt, Artificial Sequence
  MKO10091459_B_Hexim1
  gRNA
gugguguuauagggcgcaac

SEQ ID NO: 91460 - RNA, 20 nt, Artificial Sequence
  MKO10091460_B_Hexim1
  gRNA
aucggcucucccuccgccga

SEQ ID NO: 91461 - RNA, 20 nt, Artificial Sequence
  MKO10091461_B_Hexim2
  gRNA
cacagcgucaccagcugcuc

SEQ ID NO: 91462 - RNA, 20 nt, Artificial Sequence
  MKO10091462_B_Hexim2
  gRNA
cccgaaagaagcaccguagg

SEQ ID NO: 91463 - RNA, 20 nt, Artificial Sequence
  MKO10091463_B_Hexim2
  gRNA
agggcccgugaagcacaucg

SEQ ID NO: 91464 - RNA, 20 nt, Artificial Sequence
  MKO10091464_B_Hey1
  gRNA
aaaaccugggacgaugucgu

SEQ ID NO: 91465 - RNA, 20 nt, Artificial Sequence
  MKO10091465_B_Hey1
  gRNA
acaguuugucugagcugaga

SEQ ID NO: 91466 - RNA, 20 nt, Artificial Sequence
  MKO10091466_B_Hey1
  gRNA
uuccauuaccugcuucucaa

SEQ ID NO: 91467 - RNA, 20 nt, Artificial Sequence
  MKO10091467_B_Hey2
  gRNA
gggaucugccaaguuagaaa

SEQ ID NO: 91468 - RNA, 20 nt, Artificial Sequence
  MKO10091468_B_Hey2
  gRNA
gacaacuaccucucagauua

SEQ ID NO: 91469 - RNA, 20 nt, Artificial Sequence
  MKO10091469_B_Hey2
  gRNA
uugaagaugcuccaggcuac

SEQ ID NO: 91470 - RNA, 20 nt, Artificial Sequence
  MKO10091470_B_Heyl
  gRNA
cggaauuuguugcccagccg

SEQ ID NO: 91471 - RNA, 20 nt, Artificial Sequence
  MKO10091471_B_Heyl
  gRNA
gcccuucgcagaugcaagcc

SEQ ID NO: 91472 - RNA, 20 nt, Artificial Sequence
  MKO10091472_B_Heyl
  gRNA
ucaccccucugcgcuucuuc

SEQ ID NO: 91473 - RNA, 20 nt, Artificial Sequence
  MKO10091473_B_Hfe2
  gRNA
cgcucagagcgcaaccgccg

SEQ ID NO: 91474 - RNA, 20 nt, Artificial Sequence
  MKO10091474_B_Hfe2
  gRNA
agggcugccguggggggacc

SEQ ID NO: 91475 - RNA, 20 nt, Artificial Sequence
  MKO10091475_B_Hfe2
  gRNA
ugggccaguccccuaguccc

SEQ ID NO: 91476 - RNA, 20 nt, Artificial Sequence
  MKO10091476_B_Hfe
  gRNA
acggcgacucucaugauugu

SEQ ID NO: 91477 - RNA, 20 nt, Artificial Sequence
  MKO10091477_B_Hfe
  gRNA
uuuagagcccuugcaaucuc

SEQ ID NO: 91478 - RNA, 20 nt, Artificial Sequence
  MKO10091478_B_Hfe
  gRNA
uuuauuuccagucacgaagu

SEQ ID NO: 91479 - RNA, 20 nt, Artificial Sequence
  MKO10091479_B_Hfm1
  gRNA
ucucagccucaugauauuca

SEQ ID NO: 91480 - RNA, 20 nt, Artificial Sequence
  MKO10091480_B_Hfm1
  gRNA
aaauuaccuugaauaucaug

SEQ ID NO: 91481 - RNA, 20 nt, Artificial Sequence
  MKO10091481_B_Hfm1
  gRNA
auuucugaaaucaguggagc

SEQ ID NO: 91482 - RNA, 20 nt, Artificial Sequence
  MKO10091482_B_Hgd
  gRNA
ccgagagcugcucagcguag

SEQ ID NO: 91483 - RNA, 20 nt, Artificial Sequence
  MKO10091483_B_Hgd
  gRNA
acuuucuucucagacgcuuu

SEQ ID NO: 91484 - RNA, 20 nt, Artificial Sequence
  MKO10091484_B_Hgd
  gRNA
ucagaggauccucgcugucc

SEQ ID NO: 91485 - RNA, 20 nt, Artificial Sequence
  MKO10091485_B_Hgfac
  gRNA
uccacagugcucaccgaguc

SEQ ID NO: 91486 - RNA, 20 nt, Artificial Sequence
  MKO10091486_B_Hgfac
  gRNA
cccacgaucccugugaucuc

SEQ ID NO: 91487 - RNA, 20 nt, Artificial Sequence
  MKO10091487_B_Hgfac
  gRNA
uguuccaguacacaugacca

SEQ ID NO: 91488 - RNA, 20 nt, Artificial Sequence
  MKO10091488_B_Hgf
  gRNA
ccacuugacauacuauugaa

SEQ ID NO: 91489 - RNA, 20 nt, Artificial Sequence
  MKO10091489_B_Hgf
  gRNA
ggaucauggaauuccaaggc

SEQ ID NO: 91490 - RNA, 20 nt, Artificial Sequence
  MKO10091490_B_Hgf
  gRNA
uuugaugccacucuuaguga

SEQ ID NO: 91491 - RNA, 20 nt, Artificial Sequence
  MKO10091491_B_Hgsnau
  gRNA
ucacgaagguuacuguccac

SEQ ID NO: 91492 - RNA, 20 nt, Artificial Sequence
  MKO10091492_B_Hgsnau
  gRNA
gugagcaucgcauuccuugu

SEQ ID NO: 91493 - RNA, 20 nt, Artificial Sequence
  MKO10091493_B_Hgsnau
  gRNA
caucgucaaugagaauccag

SEQ ID NO: 91494 - RNA, 20 nt, Artificial Sequence
  MKO10091494_B_Hgs
  gRNA
ggcaaguggaaguuaauguu

SEQ ID NO: 91495 - RNA, 20 nt, Artificial Sequence
  MKO10091495_B_Hgs
  gRNA
caggucgcagaucuguagaa

SEQ ID NO: 91496 - RNA, 20 nt, Artificial Sequence
  MKO10091496_B_Hgs
  gRNA
agagcauacaaagccacgug

SEQ ID NO: 91497 - RNA, 20 nt, Artificial Sequence
  MKO10091497_B_Hhaul
  gRNA
guuugccaaacucugcacga

SEQ ID NO: 91498 - RNA, 20 nt, Artificial Sequence
  MKO10091498_B_Hhaul
  gRNA
ggccagcuuggcguccuuca

SEQ ID NO: 91499 - RNA, 20 nt, Artificial Sequence
  MKO10091499_B_Hhaul
  gRNA
gacaaugacauuucggaagu

SEQ ID NO: 91500 - RNA, 20 nt, Artificial Sequence
  MKO10091500_B_Hhau
  gRNA
caaccuacuccaucugcgca

SEQ ID NO: 91501 - RNA, 20 nt, Artificial Sequence
  MKO10091501_B_Hhau
  gRNA
uaccuucuuugugaguaacg

SEQ ID NO: 91502 - RNA, 20 nt, Artificial Sequence
  MKO10091502_B_Hhau
  gRNA
acuggaucaagaauuugagc

SEQ ID NO: 91503 - RNA, 20 nt, Artificial Sequence
  MKO10091503_B_Hhex
  gRNA
caacgaccagaccgucgagc

SEQ ID NO: 91504 - RNA, 20 nt, Artificial Sequence
  MKO10091504_B_Hhex
  gRNA
acacugcgaacgauccaaag

SEQ ID NO: 91505 - RNA, 20 nt, Artificial Sequence
  MKO10091505_B_Hhex
  gRNA
ccccgacucggagaucucag

SEQ ID NO: 91506 - RNA, 20 nt, Artificial Sequence
  MKO10091506_B_Hhipl1
  gRNA
cgagaaccucaacucgaacc

SEQ ID NO: 91507 - RNA, 20 nt, Artificial Sequence
  MKO10091507_B_Hhipl1
  gRNA
cccccauugugauuggaagc

SEQ ID NO: 91508 - RNA, 20 nt, Artificial Sequence
  MKO10091508_B_Hhipl1
  gRNA
uuucgccuacccacacaagc

SEQ ID NO: 91509 - RNA, 20 nt, Artificial Sequence
  MKO10091509_B_Hhipl2
  gRNA
cgaucaacucaaccgcaacc

SEQ ID NO: 91510 - RNA, 20 nt, Artificial Sequence
  MKO10091510_B_Hhipl2
  gRNA
agcauuuccgaacuugccaa

SEQ ID NO: 91511 - RNA, 20 nt, Artificial Sequence
  MKO10091511_B_Hhipl2
  gRNA
ugugaaucccccaaucucaa

SEQ ID NO: 91512 - RNA, 20 nt, Artificial Sequence
  MKO10091512_B_Hhip
  gRNA
aucuaacuacuugggccaga

SEQ ID NO: 91513 - RNA, 20 nt, Artificial Sequence
  MKO10091513_B_Hhip
  gRNA
gaagugcuagguccccaucc

SEQ ID NO: 91514 - RNA, 20 nt, Artificial Sequence
  MKO10091514_B_Hhip
  gRNA
uucccgagaaagcaagucag

SEQ ID NO: 91515 - RNA, 20 nt, Artificial Sequence
  MKO10091515_B_Hhla1
  gRNA
auuguagugucuggucuuaa

SEQ ID NO: 91516 - RNA, 20 nt, Artificial Sequence
  MKO10091516_B_Hhla1
  gRNA
uguaccugcugcaugaagaa

SEQ ID NO: 91517 - RNA, 20 nt, Artificial Sequence
  MKO10091517_B_Hhla1
  gRNA
gacagauccacugaccuugc

SEQ ID NO: 91518 - RNA, 20 nt, Artificial Sequence
  MKO10091518_B_Hiau1
  gRNA
cacgggcugaucuucaucag

SEQ ID NO: 91519 - RNA, 20 nt, Artificial Sequence
  MKO10091519_B_Hiau1
  gRNA
aaacauacauuucugaugaa

SEQ ID NO: 91520 - RNA, 20 nt, Artificial Sequence
  MKO10091520_B_Hiau1
  gRNA
auauaacucaagagcaugaa

SEQ ID NO: 91521 - RNA, 20 nt, Artificial Sequence
  MKO10091521_B_Hiaul1
  gRNA
caugaaagaaguacugcuua

SEQ ID NO: 91522 - RNA, 20 nt, Artificial Sequence
  MKO10091522_B_Hiaul1
  gRNA
cuugaaugagcccauucaug

SEQ ID NO: 91523 - RNA, 20 nt, Artificial Sequence
  MKO10091523_B_Hiaul1
  gRNA
uugagugaagucagcuacau

SEQ ID NO: 91524 - RNA, 20 nt, Artificial Sequence
  MKO10091524_B_Hibadh
  gRNA
cccagcagaaguagccgaaa

SEQ ID NO: 91525 - RNA, 20 nt, Artificial Sequence
  MKO10091525_B_Hibadh
  gRNA
aacacgucauagaggaugag

SEQ ID NO: 91526 - RNA, 20 nt, Artificial Sequence
  MKO10091526_B_Hibadh
  gRNA
cagcacuuaccaccggagac

SEQ ID NO: 91527 - RNA, 20 nt, Artificial Sequence
  MKO10091527_B_Hibch
  gRNA
cagcguuauucugcaacauc

SEQ ID NO: 91528 - RNA, 20 nt, Artificial Sequence
  MKO10091528_B_Hibch
  gRNA
uacaucuugaacaaugcaau

SEQ ID NO: 91529 - RNA, 20 nt, Artificial Sequence
  MKO10091529_B_Hibch
  gRNA
ggaggaaaggccuucugugc

SEQ ID NO: 91530 - RNA, 20 nt, Artificial Sequence
  MKO10091530_B_Hic1
  gRNA
cgaaccggcagacgcugccg

SEQ ID NO: 91531 - RNA, 20 nt, Artificial Sequence
  MKO10091531_B_Hic1
  gRNA
cgucgcugcuccccgcuuug

SEQ ID NO: 91532 - RNA, 20 nt, Artificial Sequence
  MKO10091532_B_Hic1
  gRNA
agcagcucuccuaguccgcc

SEQ ID NO: 91533 - RNA, 20 nt, Artificial Sequence
  MKO10091533_B_Hic2
  gRNA
cugcugcucacaugguuucu

SEQ ID NO: 91534 - RNA, 20 nt, Artificial Sequence
  MKO10091534_B_Hic2
  gRNA
ggcgaccaacccgcagucag

SEQ ID NO: 91535 - RNA, 20 nt, Artificial Sequence
  MKO10091535_B_Hic2
  gRNA
auacauagugggcgccagua

SEQ ID NO: 91536 - RNA, 20 nt, Artificial Sequence
  MKO10091536_B_Hid1
  gRNA
cagcucaccgguucauguca

SEQ ID NO: 91537 - RNA, 20 nt, Artificial Sequence
  MKO10091537_B_Hid1
  gRNA
gcagaagagcaaaucggcaa

SEQ ID NO: 91538 - RNA, 20 nt, Artificial Sequence
  MKO10091538_B_Hid1
  gRNA
agugcugccuuacaucuucg

SEQ ID NO: 91539 - RNA, 20 nt, Artificial Sequence
  MKO10091539_B_Hif1an
  gRNA
cuacaagcuauacagcagcg

SEQ ID NO: 91540 - RNA, 20 nt, Artificial Sequence
  MKO10091540_B_Hif1an
  gRNA
cuuccaugccaaugagcaac

SEQ ID NO: 91541 - RNA, 20 nt, Artificial Sequence
  MKO10091541_B_Hif1an
  gRNA
gcagacacucaaugacaccg

SEQ ID NO: 91542 - RNA, 20 nt, Artificial Sequence
  MKO10091542_B_Hif1a
  gRNA
caagaugugagcucacauug

SEQ ID NO: 91543 - RNA, 20 nt, Artificial Sequence
  MKO10091543_B_Hif1a
  gRNA
uguuugcaguuugaacuaac

SEQ ID NO: 91544 - RNA, 20 nt, Artificial Sequence
  MKO10091544_B_Hif1a
  gRNA
gugauggugcuaacagauga

SEQ ID NO: 91545 - RNA, 20 nt, Artificial Sequence
  MKO10091545_B_Hif3a
  gRNA
gcgcacgcucaaccucaaag

SEQ ID NO: 91546 - RNA, 20 nt, Artificial Sequence
  MKO10091546_B_Hif3a
  gRNA
ugggcacucacucggccugg

SEQ ID NO: 91547 - RNA, 20 nt, Artificial Sequence
  MKO10091547_B_Hif3a
  gRNA
cgucaugguacucaccgccg

SEQ ID NO: 91548 - RNA, 20 nt, Artificial Sequence
  MKO10091548_B_Higd1a
  gRNA
uuugcagcgauuguugccua

SEQ ID NO: 91549 - RNA, 20 nt, Artificial Sequence
  MKO10091549_B_Higd1a
  gRNA
uaugggcuacuccauguauc

SEQ ID NO: 91550 - RNA, 20 nt, Artificial Sequence
  MKO10091550_B_Higd1a
  gRNA
caccagcucuucuaaggcuu

SEQ ID NO: 91551 - RNA, 20 nt, Artificial Sequence
  MKO10091551_B_Higd1b
  gRNA
uagaaccccgagccuucagc

SEQ ID NO: 91552 - RNA, 20 nt, Artificial Sequence
  MKO10091552_B_Higd1b
  gRNA
agguuguccucacccucagg

SEQ ID NO: 91553 - RNA, 20 nt, Artificial Sequence
  MKO10091553_B_Higd1b
  gRNA
caggaucaugucugcuaaca

SEQ ID NO: 91554 - RNA, 20 nt, Artificial Sequence
  MKO10091554_B_Higd1c
  gRNA
gccagcugucccgacuccuc

SEQ ID NO: 91555 - RNA, 20 nt, Artificial Sequence
  MKO10091555_B_Higd1c
  gRNA
uguucucuacucuauguaua

SEQ ID NO: 91556 - RNA, 20 nt, Artificial Sequence
  MKO10091556_B_Higd1c
  gRNA
ugccgcccaaggaugugugg

SEQ ID NO: 91557 - RNA, 20 nt, Artificial Sequence
  MKO10091557_B_Higd2a
  gRNA
ugccgcuaaccccaacaaga

SEQ ID NO: 91558 - RNA, 20 nt, Artificial Sequence
  MKO10091558_B_Higd2a
  gRNA
ggccuuuacugcuuccaccg

SEQ ID NO: 91559 - RNA, 20 nt, Artificial Sequence
  MKO10091559_B_Higd2a
  gRNA
cacggucguagccaucuugu

SEQ ID NO: 91560 - RNA, 20 nt, Artificial Sequence
  MKO10091560_B_Hilpda
  gRNA
cuccaucacucuaacaaaga

SEQ ID NO: 91561 - RNA, 20 nt, Artificial Sequence
  MKO10091561_B_Hilpda
  gRNA
gggagguucacugcacuccu

SEQ ID NO: 91562 - RNA, 20 nt, Artificial Sequence
  MKO10091562_B_Hilpda
  gRNA
ggauggucuggcaggcccuu

SEQ ID NO: 91563 - RNA, 20 nt, Artificial Sequence
  MKO10091563_B_Hils1
  gRNA
gggcccucaaguccaaccac

SEQ ID NO: 91564 - RNA, 20 nt, Artificial Sequence
  MKO10091564_B_Hils1
  gRNA
cuucagaaucacauacgaca

SEQ ID NO: 91565 - RNA, 20 nt, Artificial Sequence
  MKO10091565_B_Hils1
  gRNA
ugccuuuaucgaguagauuc

SEQ ID NO: 91566 - RNA, 20 nt, Artificial Sequence
  MKO10091566_B_Hinfp
  gRNA
acucaccaugguuccgcaug

SEQ ID NO: 91567 - RNA, 20 nt, Artificial Sequence
  MKO10091567_B_Hinfp
  gRNA
gugucuucgacaauccugag

SEQ ID NO: 91568 - RNA, 20 nt, Artificial Sequence
  MKO10091568_B_Hinfp
  gRNA
cguuccggcucugaaagucc

SEQ ID NO: 91569 - RNA, 20 nt, Artificial Sequence
  MKO10091569_B_Hint1
  gRNA
gguaucaccagaaagugugu

SEQ ID NO: 91570 - RNA, 20 nt, Artificial Sequence
  MKO10091570_B_Hint1
  gRNA
aguucaucugccgaccccca

SEQ ID NO: 91571 - RNA, 20 nt, Artificial Sequence
  MKO10091571_B_Hint1
  gRNA
ucaagcaccaacacacuuuc

SEQ ID NO: 91572 - RNA, 20 nt, Artificial Sequence
  MKO10091572_B_Hint2
  gRNA
cuccaaguacgugaaugugc

SEQ ID NO: 91573 - RNA, 20 nt, Artificial Sequence
  MKO10091573_B_Hint2
  gRNA
guuccgugacguagcuccuc

SEQ ID NO: 91574 - RNA, 20 nt, Artificial Sequence
  MKO10091574_B_Hint2
  gRNA
ucuaggacacuuacuccuug

SEQ ID NO: 91575 - RNA, 20 nt, Artificial Sequence
  MKO10091575_B_Hint3
  gRNA
cugggaaaaccaugcuugag

SEQ ID NO: 91576 - RNA, 20 nt, Artificial Sequence
  MKO10091576_B_Hint3
  gRNA
ucuuaucaaagcugguuuac

SEQ ID NO: 91577 - RNA, 20 nt, Artificial Sequence
  MKO10091577_B_Hint3
  gRNA
ugauaucuuugaaacaaacc

SEQ ID NO: 91578 - RNA, 20 nt, Artificial Sequence
  MKO10091578_B_Hip1r
  gRNA
agguccugcaugacuaucag

SEQ ID NO: 91579 - RNA, 20 nt, Artificial Sequence
  MKO10091579_B_Hip1r
  gRNA
ggccaccuucgugaccagua

SEQ ID NO: 91580 - RNA, 20 nt, Artificial Sequence
  MKO10091580_B_Hip1r
  gRNA
uauucaccagguguccauac

SEQ ID NO: 91581 - RNA, 20 nt, Artificial Sequence
  MKO10091581_B_Hip1
  gRNA
gcuguccauaccccucgcuc

SEQ ID NO: 91582 - RNA, 20 nt, Artificial Sequence
  MKO10091582_B_Hip1
  gRNA
augaguuaagcgacaugagc

SEQ ID NO: 91583 - RNA, 20 nt, Artificial Sequence
  MKO10091583_B_Hip1
  gRNA
ccgugaaagagaaacaugcc

SEQ ID NO: 91584 - RNA, 20 nt, Artificial Sequence
  MKO10091584_B_Hipk1
  gRNA
ugugacgaugagucaccucc

SEQ ID NO: 91585 - RNA, 20 nt, Artificial Sequence
  MKO10091585_B_Hipk1
  gRNA
aggaucucuguuaaaaaacc

SEQ ID NO: 91586 - RNA, 20 nt, Artificial Sequence
  MKO10091586_B_Hipk1
  gRNA
guacccacuguggaggcuua

SEQ ID NO: 91587 - RNA, 20 nt, Artificial Sequence
  MKO10091587_B_Hipk2
  gRNA
guucagcaaugacacaacca

SEQ ID NO: 91588 - RNA, 20 nt, Artificial Sequence
  MKO10091588_B_Hipk2
  gRNA
cagacucaccguauccuuug

SEQ ID NO: 91589 - RNA, 20 nt, Artificial Sequence
  MKO10091589_B_Hipk2
  gRNA
uaauucccgucucugcuuca

SEQ ID NO: 91590 - RNA, 20 nt, Artificial Sequence
  MKO10091590_B_Hipk3
  gRNA
aggagagcaauuguugaaug

SEQ ID NO: 91591 - RNA, 20 nt, Artificial Sequence
  MKO10091591_B_Hipk3
  gRNA
gaaacagauaugucucauuc

SEQ ID NO: 91592 - RNA, 20 nt, Artificial Sequence
  MKO10091592_B_Hipk3
  gRNA
gacaggaaugaagucuaaag

SEQ ID NO: 91593 - RNA, 20 nt, Artificial Sequence
  MKO10091593_B_Hipk4
  gRNA
ggggugacgcagggccgcac

SEQ ID NO: 91594 - RNA, 20 nt, Artificial Sequence
  MKO10091594_B_Hipk4
  gRNA
ccgauugaccggccgccaua

SEQ ID NO: 91595 - RNA, 20 nt, Artificial Sequence
  MKO10091595_B_Hipk4
  gRNA
cucggccagcauauucagug

SEQ ID NO: 91596 - RNA, 20 nt, Artificial Sequence
  MKO10091596_B_Hira
  gRNA
uuguccuccaguugcaaacu

SEQ ID NO: 91597 - RNA, 20 nt, Artificial Sequence
  MKO10091597_B_Hira
  gRNA
uucauuccagggcaggauuc

SEQ ID NO: 91598 - RNA, 20 nt, Artificial Sequence
  MKO10091598_B_Hira
  gRNA
uaccuaagugauuguccauc

SEQ ID NO: 91599 - RNA, 20 nt, Artificial Sequence
  MKO10091599_B_Hirip3
  gRNA
ucaggacccagaccgagagu

SEQ ID NO: 91600 - RNA, 20 nt, Artificial Sequence
  MKO10091600_B_Hirip3
  gRNA
cugucucgcaagccuccagu

SEQ ID NO: 91601 - RNA, 20 nt, Artificial Sequence
  MKO10091601_B_Hirip3
  gRNA
cacaggcggaugcugguacc

SEQ ID NO: 91602 - RNA, 20 nt, Artificial Sequence
  MKO10091602_B_Hist1h1a
  gRNA
gaacaacagccgcaucaaac

SEQ ID NO: 91603 - RNA, 20 nt, Artificial Sequence
  MKO10091603_B_Hist1h1a
  gRNA
guagaagcagccugagcgac

SEQ ID NO: 91604 - RNA, 20 nt, Artificial Sequence
  MKO10091604_B_Hist1h1a
  gRNA
uggcuuugucacuuucgccu

SEQ ID NO: 91605 - RNA, 20 nt, Artificial Sequence
  MKO10091605_B_Hist1h1b
  gRNA
gcggcgaagcgcaaggccac

SEQ ID NO: 91606 - RNA, 20 nt, Artificial Sequence
  MKO10091606_B_Hist1h1b
  gRNA
uuugcccccgcagucuucuu

SEQ ID NO: 91607 - RNA, 20 nt, Artificial Sequence
  MKO10091607_B_Hist1h1b
  gRNA
cacgccgccgcgcuccuuag

SEQ ID NO: 91608 - RNA, 20 nt, Artificial Sequence
  MKO10091608_B_Hist1h1c
  gRNA
ccgcgccugccuucuuagcc

SEQ ID NO: 91609 - RNA, 20 nt, Artificial Sequence
  MKO10091609_B_Hist1h1c
  gRNA
uucuggcgaggccaaacccc

SEQ ID NO: 91610 - RNA, 20 nt, Artificial Sequence
  MKO10091610_B_Hist1h1c
  gRNA
gucuaaagccguaaagccaa

SEQ ID NO: 91611 - RNA, 20 nt, Artificial Sequence
  MKO10091611_B_Hist1h1d
  gRNA
aggcgccgcgggagcggucu

SEQ ID NO: 91612 - RNA, 20 nt, Artificial Sequence
  MKO10091612_B_Hist1h1d
  gRNA
gccuaaagcuucuaagccga

SEQ ID NO: 91613 - RNA, 20 nt, Artificial Sequence
  MKO10091613_B_Hist1h1d
  gRNA
cuuggaaacuuucuuggcgc

SEQ ID NO: 91614 - RNA, 20 nt, Artificial Sequence
  MKO10091614_B_Hist1h1e
  gRNA
ggcgcgaagcgcaaaaccuc

SEQ ID NO: 91615 - RNA, 20 nt, Artificial Sequence
  MKO10091615_B_Hist1h1e
  gRNA
gagcccugccaaggcgaaaa

SEQ ID NO: 91616 - RNA, 20 nt, Artificial Sequence
  MKO10091616_B_Hist1h1e
  gRNA
cuucucggcgggggccggug

SEQ ID NO: 91617 - RNA, 20 nt, Artificial Sequence
  MKO10091617_B_Hist1h1t
  gRNA
cgucguaaccagccgcagcc

SEQ ID NO: 91618 - RNA, 20 nt, Artificial Sequence
  MKO10091618_B_Hist1h1t
  gRNA
guaaaagccccgccaaagcc

SEQ ID NO: 91619 - RNA, 20 nt, Artificial Sequence
  MKO10091619_B_Hist1h1t
  gRNA
ucaugcagaagaccgaucug

SEQ ID NO: 91620 - RNA, 20 nt, Artificial Sequence
  MKO10091620_B_Hist1h2aa
  gRNA
agcuggcgggcaacgcagcc

SEQ ID NO: 91621 - RNA, 20 nt, Artificial Sequence
  MKO10091621_B_Hist1h2aa
  gRNA
aggucaagucucgcucuucc

SEQ ID NO: 91622 - RNA, 20 nt, Artificial Sequence
  MKO10091622_B_Hist1h2aa
  gRNA
gcuagaauacuugacagcug

SEQ ID NO: 91623 - RNA, 20 nt, Artificial Sequence
  MKO10091623_B_Hist1h2ab
  gRNA
ggguggcaaggcccgcgcua

SEQ ID NO: 91624 - RNA, 20 nt, Artificial Sequence
  MKO10091624_B_Hist1h2ab
  gRNA
cagccgaugcacgcggccua

SEQ ID NO: 91625 - RNA, 20 nt, Artificial Sequence
  MKO10091625_B_Hist1h2ab
  gRNA
uccccguaggccgcgugcau

SEQ ID NO: 91626 - RNA, 20 nt, Artificial Sequence
  MKO10091626_B_Hist1h2ac
  gRNA
gcuccgcaaggguaacuacu

SEQ ID NO: 91627 - RNA, 20 nt, Artificial Sequence
  MKO10091627_B_Hist1h2ac
  gRNA
cgaggagcucaacaagcugc

SEQ ID NO: 91628 - RNA, 20 nt, Artificial Sequence
  MKO10091628_B_Hist1h2ac
  gRNA
cgccagguagaccggggcgc

SEQ ID NO: 91629 - RNA, 20 nt, Artificial Sequence
  MKO10091629_B_Hist1h2ad
  gRNA
cgaggagcucaacaagcugc

SEQ ID NO: 91630 - RNA, 20 nt, Artificial Sequence
  MKO10091630_B_Hist1h2ad
  gRNA
gcuccgaguaguugcccuug

SEQ ID NO: 91631 - RNA, 20 nt, Artificial Sequence
  MKO10091631_B_Hist1h2ad
  gRNA
cgcgugaccaucgcgcaggg

SEQ ID NO: 91632 - RNA, 20 nt, Artificial Sequence
  MKO10091632_B_Hist1h2ae
  gRNA
aaacugcaggccggcccggg

SEQ ID NO: 91633 - RNA, 20 nt, Artificial Sequence
  MKO10091633_B_Hist1h2ae
  gRNA
cgaggagcucaacaagcugc

SEQ ID NO: 91634 - RNA, 20 nt, Artificial Sequence
  MKO10091634_B_Hist1h2ae
  gRNA
cgccagguacaccggggcgc

SEQ ID NO: 91635 - RNA, 20 nt, Artificial Sequence
  MKO10091635_B_Hist1h2af
  gRNA
cgaggagcucaacaagcugu

SEQ ID NO: 91636 - RNA, 20 nt, Artificial Sequence
  MKO10091636_B_Hist1h2af
  gRNA
augguggcucucggucuucu

SEQ ID NO: 91637 - RNA, 20 nt, Artificial Sequence
  MKO10091637_B_Hist1h2af
  gRNA
cgccagguacaccggggcgc

SEQ ID NO: 91638 - RNA, 20 nt, Artificial Sequence
  MKO10091638_B_Hist1h2ag
  gRNA
cgcgugaccaucgcgcaggg

SEQ ID NO: 91639 - RNA, 20 nt, Artificial Sequence
  MKO10091639_B_Hist1h2ag
  gRNA
gcuccgaguaguugcccuug

SEQ ID NO: 91640 - RNA, 20 nt, Artificial Sequence
  MKO10091640_B_Hist1h2ag
  gRNA
gaagaccgagagccaccaca

SEQ ID NO: 91641 - RNA, 20 nt, Artificial Sequence
  MKO10091641_B_Hist1h2ah
  gRNA
gcuccgaguaguugcccuug

SEQ ID NO: 91642 - RNA, 20 nt, Artificial Sequence
  MKO10091642_B_Hist1h2ah
  gRNA
cgcgugaccaucgcgcaggg

SEQ ID NO: 91643 - RNA, 20 nt, Artificial Sequence
  MKO10091643_B_Hist1h2ah
  gRNA
cagccggugcacgcggccca

SEQ ID NO: 91644 - RNA, 20 nt, Artificial Sequence
  MKO10091644_B_Hist1h2ai
  gRNA
cgaggagcucaacaagcugc

SEQ ID NO: 91645 - RNA, 20 nt, Artificial Sequence
  MKO10091645_B_Hist1h2ai
  gRNA
gcuccgaguaguugcccuug

SEQ ID NO: 91646 - RNA, 20 nt, Artificial Sequence
  MKO10091646_B_Hist1h2ai
  gRNA
cgcgugaccaucgcgcaggg

SEQ ID NO: 91647 - RNA, 20 nt, Artificial Sequence
  MKO10091647_B_Hist1h2ak
  gRNA
ggccgucagguacucuagca

SEQ ID NO: 91648 - RNA, 20 nt, Artificial Sequence
  MKO10091648_B_Hist1h2ak
  gRNA
agccgugcuagaguaccuga

SEQ ID NO: 91649 - RNA, 20 nt, Artificial Sequence
  MKO10091649_B_Hist1h2ak
  gRNA
gaagaccgagacccaccaca

SEQ ID NO: 91650 - RNA, 20 nt, Artificial Sequence
  MKO10091650_B_Hist1h2an
  gRNA
cgccagguacaccggggcgc

SEQ ID NO: 91651 - RNA, 20 nt, Artificial Sequence
  MKO10091651_B_Hist1h2an
  gRNA
cgcgugaccaucgcgcaggg

SEQ ID NO: 91652 - RNA, 20 nt, Artificial Sequence
  MKO10091652_B_Hist1h2an
  gRNA
gcuccgaguaguugcccuug

SEQ ID NO: 91653 - RNA, 20 nt, Artificial Sequence
  MKO10091653_B_Hist1h2ao
  gRNA
gcuccgaguaguugcccuug

SEQ ID NO: 91654 - RNA, 20 nt, Artificial Sequence
  MKO10091654_B_Hist1h2ao
  gRNA
cgcgugaccaucgcgcaggg

SEQ ID NO: 91655 - RNA, 20 nt, Artificial Sequence
  MKO10091655_B_Hist1h2ao
  gRNA
cagccggugcacgcggccca

SEQ ID NO: 91656 - RNA, 20 nt, Artificial Sequence
  MKO10091656_B_Hist1h2ap
  gRNA
cgcgugaccaucgcgcaggg

SEQ ID NO: 91657 - RNA, 20 nt, Artificial Sequence
  MKO10091657_B_Hist1h2ap
  gRNA
gcuccgaguaguugcccuug

SEQ ID NO: 91658 - RNA, 20 nt, Artificial Sequence
  MKO10091658_B_Hist1h2ap
  gRNA
gaagaccgagagccaccaca

SEQ ID NO: 91659 - RNA, 20 nt, Artificial Sequence
  MKO10091659_B_Hist1h2ba
  gRNA
uacuugagccaugccggagg

SEQ ID NO: 91660 - RNA, 20 nt, Artificial Sequence
  MKO10091660_B_Hist1h2ba
  gRNA
cagcaccuuauagauguaaa

SEQ ID NO: 91661 - RNA, 20 nt, Artificial Sequence
  MKO10091661_B_Hist1h2ba
  gRNA
ggugcuacuauuuccaagaa

SEQ ID NO: 91662 - RNA, 20 nt, Artificial Sequence
  MKO10091662_B_Hist1h2bb
  gRNA
cuucuucugcgccuuagaga

SEQ ID NO: 91663 - RNA, 20 nt, Artificial Sequence
  MKO10091663_B_Hist1h2bb
  gRNA
aucuaagaaagccaucucua

SEQ ID NO: 91664 - RNA, 20 nt, Artificial Sequence
  MKO10091664_B_Hist1h2bb
  gRNA
ccuacgagcucacuuggagc

SEQ ID NO: 91665 - RNA, 20 nt, Artificial Sequence
  MKO10091665_B_Hist1h2bc
  gRNA
ggagcggacuucgcaggcuc

SEQ ID NO: 91666 - RNA, 20 nt, Artificial Sequence
  MKO10091666_B_Hist1h2bc
  gRNA
gcccuccgacaccgcgugcu

SEQ ID NO: 91667 - RNA, 20 nt, Artificial Sequence
  MKO10091667_B_Hist1h2bc
  gRNA
cuccaagaaggccgugacca

SEQ ID NO: 91668 - RNA, 20 nt, Artificial Sequence
  MKO10091668_B_Hist1h2be
  gRNA
uaaaugaacucacuuggagc

SEQ ID NO: 91669 - RNA, 20 nt, Artificial Sequence
  MKO10091669_B_Hist1h2be
  gRNA
gccuucuuggagcccuucuu

SEQ ID NO: 91670 - RNA, 20 nt, Artificial Sequence
  MKO10091670_B_Hist1h2be
  gRNA
gcccuccgacaccgcgugcu

SEQ ID NO: 91671 - RNA, 20 nt, Artificial Sequence
  MKO10091671_B_Hist1h2bf
  gRNA
gccuucuuggagcccuucuu

SEQ ID NO: 91672 - RNA, 20 nt, Artificial Sequence
  MKO10091672_B_Hist1h2bf
  gRNA
cuccaagaaggccgugacca

SEQ ID NO: 91673 - RNA, 20 nt, Artificial Sequence
  MKO10091673_B_Hist1h2bf
  gRNA
agccuuggugcccuccgaca

SEQ ID NO: 91674 - RNA, 20 nt, Artificial Sequence
  MKO10091674_B_Hist1h2bg
  gRNA
gccuucuuggagcccuucuu

SEQ ID NO: 91675 - RNA, 20 nt, Artificial Sequence
  MKO10091675_B_Hist1h2bg
  gRNA
agccuuggugcccuccgaca

SEQ ID NO: 91676 - RNA, 20 nt, Artificial Sequence
  MKO10091676_B_Hist1h2bg
  gRNA
cuccaagaaggccgugacca

SEQ ID NO: 91677 - RNA, 20 nt, Artificial Sequence
  MKO10091677_B_Hist1h2bh
  gRNA
guccgcuccugccccgaaga

SEQ ID NO: 91678 - RNA, 20 nt, Artificial Sequence
  MKO10091678_B_Hist1h2bh
  gRNA
gccuucuuggagcccuucuu

SEQ ID NO: 91679 - RNA, 20 nt, Artificial Sequence
  MKO10091679_B_Hist1h2bh
  gRNA
ggagcggacuuggcgggcuc

SEQ ID NO: 91680 - RNA, 20 nt, Artificial Sequence
  MKO10091680_B_Hist1h2bj
  gRNA
guccgcucccgccccgaaga

SEQ ID NO: 91681 - RNA, 20 nt, Artificial Sequence
  MKO10091681_B_Hist1h2bj
  gRNA
gccuucuuggagcccuucuu

SEQ ID NO: 91682 - RNA, 20 nt, Artificial Sequence
  MKO10091682_B_Hist1h2bj
  gRNA
ggagcggacuucgcaggcuc

SEQ ID NO: 91683 - RNA, 20 nt, Artificial Sequence
  MKO10091683_B_Hist1h2bk
  gRNA
ggagcggacuucgcaggcuc

SEQ ID NO: 91684 - RNA, 20 nt, Artificial Sequence
  MKO10091684_B_Hist1h2bk
  gRNA
agccuuggugcccuccgaca

SEQ ID NO: 91685 - RNA, 20 nt, Artificial Sequence
  MKO10091685_B_Hist1h2bk
  gRNA
cuccaagaaggccgucacca

SEQ ID NO: 91686 - RNA, 20 nt, Artificial Sequence
  MKO10091686_B_Hist1h2bl
  gRNA
ggagcggacuuggcgggcuc

SEQ ID NO: 91687 - RNA, 20 nt, Artificial Sequence
  MKO10091687_B_Hist1h2bl
  gRNA
cuccaagaaggccgucacca

SEQ ID NO: 91688 - RNA, 20 nt, Artificial Sequence
  MKO10091688_B_Hist1h2bl
  gRNA
gcccuccgacaccgcgugcu

SEQ ID NO: 91689 - RNA, 20 nt, Artificial Sequence
  MKO10091689_B_Hist1h2bm
  gRNA
gccuucuuggagcccuucuu

SEQ ID NO: 91690 - RNA, 20 nt, Artificial Sequence
  MKO10091690_B_Hist1h2bm
  gRNA
gcccuccgacaccgcgugcu

SEQ ID NO: 91691 - RNA, 20 nt, Artificial Sequence
  MKO10091691_B_Hist1h2bm
  gRNA
cuccaagaaggccgucacca

SEQ ID NO: 91692 - RNA, 20 nt, Artificial Sequence
  MKO10091692_B_Hist1h2bn
  gRNA
uaaaggaacucacuuggagc

SEQ ID NO: 91693 - RNA, 20 nt, Artificial Sequence
  MKO10091693_B_Hist1h2bn
  gRNA
guccgcucccgccccgaaga

SEQ ID NO: 91694 - RNA, 20 nt, Artificial Sequence
  MKO10091694_B_Hist1h2bn
  gRNA
agccuuggugcccuccgaca

SEQ ID NO: 91695 - RNA, 20 nt, Artificial Sequence
  MKO10091695_B_Hist1h2bp
  gRNA
gcuucuugccauccuucuuu

SEQ ID NO: 91696 - RNA, 20 nt, Artificial Sequence
  MKO10091696_B_Hist1h2bp
  gRNA
guccguucccgccccgaaga

SEQ ID NO: 91697 - RNA, 20 nt, Artificial Sequence
  MKO10091697_B_Hist1h2bp
  gRNA
ucacuuggagcugguguacu

SEQ ID NO: 91698 - RNA, 20 nt, Artificial Sequence
  MKO10091698_B_Hist1h2bq
  gRNA
ggagcggacuucgcaggcuc

SEQ ID NO: 91699 - RNA, 20 nt, Artificial Sequence
  MKO10091699_B_Hist1h2bq
  gRNA
cuccaagaaggccgucacca

SEQ ID NO: 91700 - RNA, 20 nt, Artificial Sequence
  MKO10091700_B_Hist1h2bq
  gRNA
gcccuccgacaccgcgugcu

SEQ ID NO: 91701 - RNA, 20 nt, Artificial Sequence
  MKO10091701_B_Hist1h2br
  gRNA
ggagcggacuucgcaggcuc

SEQ ID NO: 91702 - RNA, 20 nt, Artificial Sequence
  MKO10091702_B_Hist1h2br
  gRNA
gcccuccgacaccgcgugcu

SEQ ID NO: 91703 - RNA, 20 nt, Artificial Sequence
  MKO10091703_B_Hist1h2br
  gRNA
cuccaagaaggccgucacca

SEQ ID NO: 91704 - RNA, 20 nt, Artificial Sequence
  MKO10091704_B_Hist1h3a
  gRNA
uugguggcuagcugcuugcg

SEQ ID NO: 91705 - RNA, 20 nt, Artificial Sequence
  MKO10091705_B_Hist1h3a
  gRNA
cagaccgcucgcaaguccac

SEQ ID NO: 91706 - RNA, 20 nt, Artificial Sequence
  MKO10091706_B_Hist1h3a
  gRNA
gugaggcuucuucacgccgc

SEQ ID NO: 91707 - RNA, 20 nt, Artificial Sequence
  MKO10091707_B_Hist1h3b
  gRNA
gugaggcuucuucacgccgc

SEQ ID NO: 91708 - RNA, 20 nt, Artificial Sequence
  MKO10091708_B_Hist1h3b
  gRNA
gcgugucaccaucaugccca

SEQ ID NO: 91709 - RNA, 20 nt, Artificial Sequence
  MKO10091709_B_Hist1h3b
  gRNA
ggccggggcgcucuugcggg

SEQ ID NO: 91710 - RNA, 20 nt, Artificial Sequence
  MKO10091710_B_Hist1h3c
  gRNA
gcgugucaccaucaugccca

SEQ ID NO: 91711 - RNA, 20 nt, Artificial Sequence
  MKO10091711_B_Hist1h3c
  gRNA
ggccggggcgcucuugcggg

SEQ ID NO: 91712 - RNA, 20 nt, Artificial Sequence
  MKO10091712_B_Hist1h3c
  gRNA
uugguggccagcugcuugcg

SEQ ID NO: 91713 - RNA, 20 nt, Artificial Sequence
  MKO10091713_B_Hist1h3d
  gRNA
gugaggcuucuucacgccgc

SEQ ID NO: 91714 - RNA, 20 nt, Artificial Sequence
  MKO10091714_B_Hist1h3d
  gRNA
gcgugucaccaucaugccca

SEQ ID NO: 91715 - RNA, 20 nt, Artificial Sequence
  MKO10091715_B_Hist1h3d
  gRNA
ggccggggcgcucuugcggg

SEQ ID NO: 91716 - RNA, 20 nt, Artificial Sequence
  MKO10091716_B_Hist1h3e
  gRNA
ccuauuaagcccgcucgccg

SEQ ID NO: 91717 - RNA, 20 nt, Artificial Sequence
  MKO10091717_B_Hist1h3e
  gRNA
gcgugucaccaucaugccca

SEQ ID NO: 91718 - RNA, 20 nt, Artificial Sequence
  MKO10091718_B_Hist1h3e
  gRNA
gugaggcuucuucacgccgc

SEQ ID NO: 91719 - RNA, 20 nt, Artificial Sequence
  MKO10091719_B_Hist1h3f
  gRNA
ccuauuaagcccgcucgccg

SEQ ID NO: 91720 - RNA, 20 nt, Artificial Sequence
  MKO10091720_B_Hist1h3f
  gRNA
cagaccgcucgcaaguccac

SEQ ID NO: 91721 - RNA, 20 nt, Artificial Sequence
  MKO10091721_B_Hist1h3f
  gRNA
gcgugucaccaucaugccca

SEQ ID NO: 91722 - RNA, 20 nt, Artificial Sequence
  MKO10091722_B_Hist1h3g
  gRNA
cagcuggcccgucgcauccg

SEQ ID NO: 91723 - RNA, 20 nt, Artificial Sequence
  MKO10091723_B_Hist1h3g
  gRNA
gccgccgguagacuugcgag

SEQ ID NO: 91724 - RNA, 20 nt, Artificial Sequence
  MKO10091724_B_Hist1h3g
  gRNA
cuguggcgcugcgcgagauc

SEQ ID NO: 91725 - RNA, 20 nt, Artificial Sequence
  MKO10091725_B_Hist1h3h
  gRNA
gugaggcuucuucacgccgc

SEQ ID NO: 91726 - RNA, 20 nt, Artificial Sequence
  MKO10091726_B_Hist1h3h
  gRNA
gcgugucaccaucaugccca

SEQ ID NO: 91727 - RNA, 20 nt, Artificial Sequence
  MKO10091727_B_Hist1h3h
  gRNA
ggccggggcgcucuugcggg

SEQ ID NO: 91728 - RNA, 20 nt, Artificial Sequence
  MKO10091728_B_Hist1h3i
  gRNA
ggccggggcgcucuugcggg

SEQ ID NO: 91729 - RNA, 20 nt, Artificial Sequence
  MKO10091729_B_Hist1h3i
  gRNA
cagcuggcccgucgcauucg

SEQ ID NO: 91730 - RNA, 20 nt, Artificial Sequence
  MKO10091730_B_Hist1h3i
  gRNA
uugguggccagcugcuugcg

SEQ ID NO: 91731 - RNA, 20 nt, Artificial Sequence
  MKO10091731_B_Hist1h4a
  gRNA
cgcacccucuacggauucgg

SEQ ID NO: 91732 - RNA, 20 nt, Artificial Sequence
  MKO10091732_B_Hist1h4a
  gRNA
ggaggaaaaggccugggcaa

SEQ ID NO: 91733 - RNA, 20 nt, Artificial Sequence
  MKO10091733_B_Hist1h4a
  gRNA
gagcgcguagaccacgucca

SEQ ID NO: 91734 - RNA, 20 nt, Artificial Sequence
  MKO10091734_B_Hist1h4b
  gRNA
gcuuagcgccaccuuugccc

SEQ ID NO: 91735 - RNA, 20 nt, Artificial Sequence
  MKO10091735_B_Hist1h4b
  gRNA
cuuaacccccgaauccguag

SEQ ID NO: 91736 - RNA, 20 nt, Artificial Sequence
  MKO10091736_B_Hist1h4b
  gRNA
gagcgcguagaccacgucca

SEQ ID NO: 91737 - RNA, 20 nt, Artificial Sequence
  MKO10091737_B_Hist1h4c
  gRNA
ggugguaaaggccuugggaa

SEQ ID NO: 91738 - RNA, 20 nt, Artificial Sequence
  MKO10091738_B_Hist1h4c
  gRNA
uaaugcccuggauguuauca

SEQ ID NO: 91739 - RNA, 20 nt, Artificial Sequence
  MKO10091739_B_Hist1h4c
  gRNA
cgccgaauccguagagagug

SEQ ID NO: 91740 - RNA, 20 nt, Artificial Sequence
  MKO10091740_B_Hist1h4d
  gRNA
aguucugcgcgacaacaucc

SEQ ID NO: 91741 - RNA, 20 nt, Artificial Sequence
  MKO10091741_B_Hist1h4d
  gRNA
gagcgcguagacaacgucca

SEQ ID NO: 91742 - RNA, 20 nt, Artificial Sequence
  MKO10091742_B_Hist1h4d
  gRNA
uuuagccgccgaauccguag

SEQ ID NO: 91743 - RNA, 20 nt, Artificial Sequence
  MKO10091743_B_Hist1h4f
  gRNA
gguuuccucguagaugagac

SEQ ID NO: 91744 - RNA, 20 nt, Artificial Sequence
  MKO10091744_B_Hist1h4f
  gRNA
cucaucuacgaggaaacccg

SEQ ID NO: 91745 - RNA, 20 nt, Artificial Sequence
  MKO10091745_B_Hist1h4f
  gRNA
cuuaaccgccgaauccguag

SEQ ID NO: 91746 - RNA, 20 nt, Artificial Sequence
  MKO10091746_B_Hist1h4h
  gRNA
uguugucacgcagcacuuug

SEQ ID NO: 91747 - RNA, 20 nt, Artificial Sequence
  MKO10091747_B_Hist1h4h
  gRNA
agugcugcgugacaacaucc

SEQ ID NO: 91748 - RNA, 20 nt, Artificial Sequence
  MKO10091748_B_Hist1h4h
  gRNA
cuuaaccgccgaauccguag

SEQ ID NO: 91749 - RNA, 20 nt, Artificial Sequence
  MKO10091749_B_Hist1h4i
  gRNA
uguugucccgaagcacuuug

SEQ ID NO: 91750 - RNA, 20 nt, Artificial Sequence
  MKO10091750_B_Hist1h4i
  gRNA
gucuucaucaugucuggucg

SEQ ID NO: 91751 - RNA, 20 nt, Artificial Sequence
  MKO10091751_B_Hist1h4i
  gRNA
ggaggaaaaggccugggcaa

SEQ ID NO: 91752 - RNA, 20 nt, Artificial Sequence
  MKO10091752_B_Hist1h4j
  gRNA
agugcagucaugucuggcag

SEQ ID NO: 91753 - RNA, 20 nt, Artificial Sequence
  MKO10091753_B_Hist1h4j
  gRNA
gagcgcguagaccacgucca

SEQ ID NO: 91754 - RNA, 20 nt, Artificial Sequence
  MKO10091754_B_Hist1h4j
  gRNA
ggcgggaaagggcucgguaa

SEQ ID NO: 91755 - RNA, 20 nt, Artificial Sequence
  MKO10091755_B_Hist1h4k
  gRNA
ggcgggaaagggcucgguaa

SEQ ID NO: 91756 - RNA, 20 nt, Artificial Sequence
  MKO10091756_B_Hist1h4k
  gRNA
gagcgcguagaccacgucca

SEQ ID NO: 91757 - RNA, 20 nt, Artificial Sequence
  MKO10091757_B_Hist1h4k
  gRNA
agugcugcgcgauaacaucc

SEQ ID NO: 91758 - RNA, 20 nt, Artificial Sequence
  MKO10091758_B_Hist1h4m
  gRNA
gagcgcguagaccacgucca

SEQ ID NO: 91759 - RNA, 20 nt, Artificial Sequence
  MKO10091759_B_Hist1h4m
  gRNA
ggaggaaaaggccugggcaa

SEQ ID NO: 91760 - RNA, 20 nt, Artificial Sequence
  MKO10091760_B_Hist1h4m
  gRNA
gcgcuuggcgugcuccgugu

SEQ ID NO: 91761 - RNA, 20 nt, Artificial Sequence
  MKO10091761_B_Hist1h4n
  gRNA
ggaggaaaaggccugggcaa

SEQ ID NO: 91762 - RNA, 20 nt, Artificial Sequence
  MKO10091762_B_Hist1h4n
  gRNA
gagcgcguagaccacgucca

SEQ ID NO: 91763 - RNA, 20 nt, Artificial Sequence
  MKO10091763_B_Hist1h4n
  gRNA
agugcugcgcgauaacaucc

SEQ ID NO: 91764 - RNA, 20 nt, Artificial Sequence
  MKO10091764_B_Hist2h2aa1
  gRNA
cgaggagcucaacaagcugc

SEQ ID NO: 91765 - RNA, 20 nt, Artificial Sequence
  MKO10091765_B_Hist2h2aa1
  gRNA
gccuccuugcuugccacgac

SEQ ID NO: 91766 - RNA, 20 nt, Artificial Sequence
  MKO10091766_B_Hist2h2aa1
  gRNA
aaagugacgaucgcgcaggg

SEQ ID NO: 91767 - RNA, 20 nt, Artificial Sequence
  MKO10091767_B_Hist2h2aa2
  gRNA
ggaagaccgcgacuuggccu

SEQ ID NO: 91768 - RNA, 20 nt, Artificial Sequence
  MKO10091768_B_Hist2h2aa2
  gRNA
aaagugacgaucgcgcaggg

SEQ ID NO: 91769 - RNA, 20 nt, Artificial Sequence
  MKO10091769_B_Hist2h2aa2
  gRNA
gccuccuugcuugccacgac

SEQ ID NO: 91770 - RNA, 20 nt, Artificial Sequence
  MKO10091770_B_Hist2h2ab
  gRNA
ggacgaccgcgacuucgccu

SEQ ID NO: 91771 - RNA, 20 nt, Artificial Sequence
  MKO10091771_B_Hist2h2ab
  gRNA
ggagucaccaucgcccaggg

SEQ ID NO: 91772 - RNA, 20 nt, Artificial Sequence
  MKO10091772_B_Hist2h2ab
  gRNA
gccaucugcaacuagcugug

SEQ ID NO: 91773 - RNA, 20 nt, Artificial Sequence
  MKO10091773_B_Hist2h2ac
  gRNA
ccuugccucccuguuugcca

SEQ ID NO: 91774 - RNA, 20 nt, Artificial Sequence
  MKO10091774_B_Hist2h2ac
  gRNA
caagaagaccgagagccaca

SEQ ID NO: 91775 - RNA, 20 nt, Artificial Sequence
  MKO10091775_B_Hist2h2ac
  gRNA
auggccagcugcagauggcg

SEQ ID NO: 91776 - RNA, 20 nt, Artificial Sequence
  MKO10091776_B_Hist2h2bb
  gRNA
guuggcuaaacacgcugugu

SEQ ID NO: 91777 - RNA, 20 nt, Artificial Sequence
  MKO10091777_B_Hist2h2bb
  gRNA
cuuagaugagaugcccgugu

SEQ ID NO: 91778 - RNA, 20 nt, Artificial Sequence
  MKO10091778_B_Hist2h2bb
  gRNA
gcguguuuagccaacucucc

SEQ ID NO: 91779 - RNA, 20 nt, Artificial Sequence
  MKO10091779_B_Hist2h2be
  gRNA
cuuugagcgcauagcaaacg

SEQ ID NO: 91780 - RNA, 20 nt, Artificial Sequence
  MKO10091780_B_Hist2h2be
  gRNA
ccaguucuccgggcaguaga

SEQ ID NO: 91781 - RNA, 20 nt, Artificial Sequence
  MKO10091781_B_Hist2h2be
  gRNA
agccuucuuggaacccuucu

SEQ ID NO: 91782 - RNA, 20 nt, Artificial Sequence
  MKO10091782_B_Hist2h3b
  gRNA
ggcgcucuugcgggcggccu

SEQ ID NO: 91783 - RNA, 20 nt, Artificial Sequence
  MKO10091783_B_Hist2h3b
  gRNA
acgcgucaccaucaugccca

SEQ ID NO: 91784 - RNA, 20 nt, Artificial Sequence
  MKO10091784_B_Hist2h3b
  gRNA
cuugcgcggggccuugccgc

SEQ ID NO: 91785 - RNA, 20 nt, Artificial Sequence
  MKO10091785_B_Hist2h3c1
  gRNA
acgcgucaccaucaugccca

SEQ ID NO: 91786 - RNA, 20 nt, Artificial Sequence
  MKO10091786_B_Hist2h3c1
  gRNA
cuugcgcggggccuugccgc

SEQ ID NO: 91787 - RNA, 20 nt, Artificial Sequence
  MKO10091787_B_Hist2h3c1
  gRNA
caguuggcccgccgcauccg

SEQ ID NO: 91788 - RNA, 20 nt, Artificial Sequence
  MKO10091788_B_Hist2h3c2
  gRNA
ggcgcucuugcgggcggccu

SEQ ID NO: 91789 - RNA, 20 nt, Artificial Sequence
  MKO10091789_B_Hist2h3c2
  gRNA
caguuggcccgccgcauccg

SEQ ID NO: 91790 - RNA, 20 nt, Artificial Sequence
  MKO10091790_B_Hist2h3c2
  gRNA
cuugcgcggggccuugccgc

SEQ ID NO: 91791 - RNA, 20 nt, Artificial Sequence
  MKO10091791_B_Hist2h4
  gRNA
agcguacaccacauccauag

SEQ ID NO: 91792 - RNA, 20 nt, Artificial Sequence
  MKO10091792_B_Hist2h4
  gRNA
acauuagccaugucuggcag

SEQ ID NO: 91793 - RNA, 20 nt, Artificial Sequence
  MKO10091793_B_Hist2h4
  gRNA
agucuugcgugacaacaucc

SEQ ID NO: 91794 - RNA, 20 nt, Artificial Sequence
  MKO10091794_B_Hist3h2a
  gRNA
guaggggccucacuugcccu

SEQ ID NO: 91795 - RNA, 20 nt, Artificial Sequence
  MKO10091795_B_Hist3h2a
  gRNA
caguggaagaugucuggucg

SEQ ID NO: 91796 - RNA, 20 nt, Artificial Sequence
  MKO10091796_B_Hist3h2a
  gRNA
ccgcauuaccagccaauucc

SEQ ID NO: 91797 - RNA, 20 nt, Artificial Sequence
  MKO10091797_B_Hist3h2ba
  gRNA
ggaguggagcgggaaggcuc

SEQ ID NO: 91798 - RNA, 20 nt, Artificial Sequence
  MKO10091798_B_Hist3h2ba
  gRNA
gcuuucuuggagccuuucuu

SEQ ID NO: 91799 - RNA, 20 nt, Artificial Sequence
  MKO10091799_B_Hist3h2ba
  gRNA
ggcaugcuuggccagcuccc

SEQ ID NO: 91800 - RNA, 20 nt, Artificial Sequence
  MKO10091800_B_Hist3h2bb-ps
  gRNA
cuccaaaaaggcggucacca

SEQ ID NO: 91801 - RNA, 20 nt, Artificial Sequence
  MKO10091801_B_Hist3h2bb-ps
  gRNA
ggccaagcaugcuguguccg

SEQ ID NO: 91802 - RNA, 20 nt, Artificial Sequence
  MKO10091802_B_Hist3h2bb-ps
  gRNA
gcacggcugucugcaccucg

SEQ ID NO: 91803 - RNA, 20 nt, Artificial Sequence
  MKO10091803_B_Hist4h4
  gRNA
agccguaaccgucuugcgcu

SEQ ID NO: 91804 - RNA, 20 nt, Artificial Sequence
  MKO10091804_B_Hist4h4
  gRNA
uuuacuaauaugucaggacg

SEQ ID NO: 91805 - RNA, 20 nt, Artificial Sequence
  MKO10091805_B_Hist4h4
  gRNA
cgccacgccgagccaaccgc

SEQ ID NO: 91806 - RNA, 20 nt, Artificial Sequence
  MKO10091806_B_Hivep1
  gRNA
augugcuucuucaacauacu

SEQ ID NO: 91807 - RNA, 20 nt, Artificial Sequence
  MKO10091807_B_Hivep1
  gRNA
gagagcauuagguaaucaaa

SEQ ID NO: 91808 - RNA, 20 nt, Artificial Sequence
  MKO10091808_B_Hivep1
  gRNA
auugcugaauucaacuacug

SEQ ID NO: 91809 - RNA, 20 nt, Artificial Sequence
  MKO10091809_B_Hivep2
  gRNA
auucacggagauaaagaucu

SEQ ID NO: 91810 - RNA, 20 nt, Artificial Sequence
  MKO10091810_B_Hivep2
  gRNA
auccgaauuaagaucuuuga

SEQ ID NO: 91811 - RNA, 20 nt, Artificial Sequence
  MKO10091811_B_Hivep2
  gRNA
uuacauaacuugcauacaua

SEQ ID NO: 91812 - RNA, 20 nt, Artificial Sequence
  MKO10091812_B_Hivep3
  gRNA
ucgaagaucuugacccucgc

SEQ ID NO: 91813 - RNA, 20 nt, Artificial Sequence
  MKO10091813_B_Hivep3
  gRNA
uccgcacccacacugacguc

SEQ ID NO: 91814 - RNA, 20 nt, Artificial Sequence
  MKO10091814_B_Hivep3
  gRNA
ccucacaaacauaucucccu

SEQ ID NO: 91815 - RNA, 20 nt, Artificial Sequence
  MKO10091815_B_Hjurp
  gRNA
cucaucgcugagcugcaaga

SEQ ID NO: 91816 - RNA, 20 nt, Artificial Sequence
  MKO10091816_B_Hjurp
  gRNA
uuucuuaaggguugagaguu

SEQ ID NO: 91817 - RNA, 20 nt, Artificial Sequence
  MKO10091817_B_Hjurp
  gRNA
aaggugauugacagauuaaa

SEQ ID NO: 91818 - RNA, 20 nt, Artificial Sequence
  MKO10091818_B_Hk1
  gRNA
cucaggccguacugaucacg

SEQ ID NO: 91819 - RNA, 20 nt, Artificial Sequence
  MKO10091819_B_Hk1
  gRNA
cugcacccgcaggauucgaa

SEQ ID NO: 91820 - RNA, 20 nt, Artificial Sequence
  MKO10091820_B_Hk1
  gRNA
ccuccauaccucgucuauuu

SEQ ID NO: 91821 - RNA, 20 nt, Artificial Sequence
  MKO10091821_B_Hk2
  gRNA
cacuacucaccccucugcgc

SEQ ID NO: 91822 - RNA, 20 nt, Artificial Sequence
  MKO10091822_B_Hk2
  gRNA
ccagaucuacgccauucccg

SEQ ID NO: 91823 - RNA, 20 nt, Artificial Sequence
  MKO10091823_B_Hk2
  gRNA
ccccugccaccagacgaaac

SEQ ID NO: 91824 - RNA, 20 nt, Artificial Sequence
  MKO10091824_B_Hk3
  gRNA
cacacguagugaugcuccug

SEQ ID NO: 91825 - RNA, 20 nt, Artificial Sequence
  MKO10091825_B_Hk3
  gRNA
ugcauaccccguggagaauc

SEQ ID NO: 91826 - RNA, 20 nt, Artificial Sequence
  MKO10091826_B_Hk3
  gRNA
uuagcaacuggaccacaucc

SEQ ID NO: 91827 - RNA, 20 nt, Artificial Sequence
  MKO10091827_B_Hkdc1
  gRNA
caccuucaagacccgaaacu

SEQ ID NO: 91828 - RNA, 20 nt, Artificial Sequence
  MKO10091828_B_Hkdc1
  gRNA
ccgagagccgcaugugauac

SEQ ID NO: 91829 - RNA, 20 nt, Artificial Sequence
  MKO10091829_B_Hkdc1
  gRNA
ccccgcuuaccugagccauc

SEQ ID NO: 91830 - RNA, 20 nt, Artificial Sequence
  MKO10091830_B_Hlcs
  gRNA
cucccgagccacugcaugaa

SEQ ID NO: 91831 - RNA, 20 nt, Artificial Sequence
  MKO10091831_B_Hlcs
  gRNA
ucugagcugugacgcaccac

SEQ ID NO: 91832 - RNA, 20 nt, Artificial Sequence
  MKO10091832_B_Hlcs
  gRNA
aacgccccuguacuuacugc

SEQ ID NO: 91833 - RNA, 20 nt, Artificial Sequence
  MKO10091833_B_Hlf
  gRNA
ucagagaacuuccguuugcg

SEQ ID NO: 91834 - RNA, 20 nt, Artificial Sequence
  MKO10091834_B_Hlf
  gRNA
aucuuacaggggcccgugcc

SEQ ID NO: 91835 - RNA, 20 nt, Artificial Sequence
  MKO10091835_B_Hlf
  gRNA
cgucccccaguccgccuucu

SEQ ID NO: 91836 - RNA, 20 nt, Artificial Sequence
  MKO10091836_B_Hltf
  gRNA
gacugcgaauacuuccaaac

SEQ ID NO: 91837 - RNA, 20 nt, Artificial Sequence
  MKO10091837_B_Hltf
  gRNA
aaaguauuacuugcaccaaa

SEQ ID NO: 91838 - RNA, 20 nt, Artificial Sequence
  MKO10091838_B_Hltf
  gRNA
uguaauaguguaguuccuuu

SEQ ID NO: 91839 - RNA, 20 nt, Artificial Sequence
  MKO10091839_B_Hlx
  gRNA
aucucuagaucccauuagcg

SEQ ID NO: 91840 - RNA, 20 nt, Artificial Sequence
  MKO10091840_B_Hlx
  gRNA
accacccgcguccccgaagu

SEQ ID NO: 91841 - RNA, 20 nt, Artificial Sequence
  MKO10091841_B_Hlx
  gRNA
gaucucacaucgcugcuaac

SEQ ID NO: 91842 - RNA, 20 nt, Artificial Sequence
  MKO10091842_B_Hmbox1
  gRNA
aauccuccgauuggcaagaa

SEQ ID NO: 91843 - RNA, 20 nt, Artificial Sequence
  MKO10091843_B_Hmbox1
  gRNA
aucuacucccucgucgaagc

SEQ ID NO: 91844 - RNA, 20 nt, Artificial Sequence
  MKO10091844_B_Hmbox1
  gRNA
ggacagcagugugauaaaag

SEQ ID NO: 91845 - RNA, 20 nt, Artificial Sequence
  MKO10091845_B_Hmbs
  gRNA
cucaguugcuauguccacca

SEQ ID NO: 91846 - RNA, 20 nt, Artificial Sequence
  MKO10091846_B_Hmbs
  gRNA
aucaagaaucuugucucccg

SEQ ID NO: 91847 - RNA, 20 nt, Artificial Sequence
  MKO10091847_B_Hmbs
  gRNA
augcugaaagccuuguaccc

SEQ ID NO: 91848 - RNA, 20 nt, Artificial Sequence
  MKO10091848_B_Hmces
  gRNA
gacacuccggaguguuguuu

SEQ ID NO: 91849 - RNA, 20 nt, Artificial Sequence
  MKO10091849_B_Hmces
  gRNA
auaauuauucccaugcgaug

SEQ ID NO: 91850 - RNA, 20 nt, Artificial Sequence
  MKO10091850_B_Hmces
  gRNA
agaugaaguaugguugccuc

SEQ ID NO: 91851 - RNA, 20 nt, Artificial Sequence
  MKO10091851_B_Hmcn1
  gRNA
uuucacugaugcacgaucca

SEQ ID NO: 91852 - RNA, 20 nt, Artificial Sequence
  MKO10091852_B_Hmcn1
  gRNA
cacuugaccagaacuuguag

SEQ ID NO: 91853 - RNA, 20 nt, Artificial Sequence
  MKO10091853_B_Hmcn1
  gRNA
ugugaugacaggaaucauau

SEQ ID NO: 91854 - RNA, 20 nt, Artificial Sequence
  MKO10091854_B_Hmg20a
  gRNA
uuuccuacugaagaccuugu

SEQ ID NO: 91855 - RNA, 20 nt, Artificial Sequence
  MKO10091855_B_Hmg20a
  gRNA
aauuaccucaugaucaugag

SEQ ID NO: 91856 - RNA, 20 nt, Artificial Sequence
  MKO10091856_B_Hmg20a
  gRNA
gauguggcugcacugccaua

SEQ ID NO: 91857 - RNA, 20 nt, Artificial Sequence
  MKO10091857_B_Hmg20b
  gRNA
cccggagaucacgaagaugu

SEQ ID NO: 91858 - RNA, 20 nt, Artificial Sequence
  MKO10091858_B_Hmg20b
  gRNA
cuccuagcgguaccuggaug

SEQ ID NO: 91859 - RNA, 20 nt, Artificial Sequence
  MKO10091859_B_Hmg20b
  gRNA
cccuuaccuugugcccauuc

SEQ ID NO: 91860 - RNA, 20 nt, Artificial Sequence
  MKO10091860_B_Hmga1-rs1
  gRNA
ugaucacugcuccuccucag

SEQ ID NO: 91861 - RNA, 20 nt, Artificial Sequence
  MKO10091861_B_Hmga1-rs1
  gRNA
gagaaggagaaugagcgagu

SEQ ID NO: 91862 - RNA, 20 nt, Artificial Sequence
  MKO10091862_B_Hmga1-rs1
  gRNA
ggaagaggagggcaucuccc

SEQ ID NO: 91863 - RNA, 20 nt, Artificial Sequence
  MKO10091863_B_Hmga1
  gRNA
cccacaggagaaggaggaag

SEQ ID NO: 91864 - RNA, 20 nt, Artificial Sequence
  MKO10091864_B_Hmga1
  gRNA
cucaccggaggcugcuugcg

SEQ ID NO: 91865 - RNA, 20 nt, Artificial Sequence
  MKO10091865_B_Hmga1
  gRNA
gagaaggagaaugagcgagu

SEQ ID NO: 91866 - RNA, 20 nt, Artificial Sequence
  MKO10091866_B_Hmga2
  gRNA
uccuuacucacccauuuccu

SEQ ID NO: 91867 - RNA, 20 nt, Artificial Sequence
  MKO10091867_B_Hmga2
  gRNA
uugcagaaagcagagaccau

SEQ ID NO: 91868 - RNA, 20 nt, Artificial Sequence
  MKO10091868_B_Hmga2
  gRNA
cguucagaagaagccugcuc

SEQ ID NO: 91869 - RNA, 20 nt, Artificial Sequence
  MKO10091869_B_Hmgb1
  gRNA
gaccaugucugcuaaagaaa

SEQ ID NO: 91870 - RNA, 20 nt, Artificial Sequence
  MKO10091870_B_Hmgb1
  gRNA
gaguaccgccccaaaaucaa

SEQ ID NO: 91871 - RNA, 20 nt, Artificial Sequence
  MKO10091871_B_Hmgb1
  gRNA
cucauacuucuccuucagcu

SEQ ID NO: 91872 - RNA, 20 nt, Artificial Sequence
  MKO10091872_B_Hmgb2
  gRNA
ggaagaugacgaggaagaag

SEQ ID NO: 91873 - RNA, 20 nt, Artificial Sequence
  MKO10091873_B_Hmgb2
  gRNA
agggugaccccaacaagccg

SEQ ID NO: 91874 - RNA, 20 nt, Artificial Sequence
  MKO10091874_B_Hmgb2
  gRNA
uuagcugcuuucugcucaua

SEQ ID NO: 91875 - RNA, 20 nt, Artificial Sequence
  MKO10091875_B_Hmgb3
  gRNA
gaaaucaaaguuugaugaaa

SEQ ID NO: 91876 - RNA, 20 nt, Artificial Sequence
  MKO10091876_B_Hmgb3
  gRNA
cuccuucagcuuugcugccu

SEQ ID NO: 91877 - RNA, 20 nt, Artificial Sequence
  MKO10091877_B_Hmgb3
  gRNA
aagaucaaauccacaaaccc

SEQ ID NO: 91878 - RNA, 20 nt, Artificial Sequence
  MKO10091878_B_Hmgb4
  gRNA
ugaagcaagagaaccccgac

SEQ ID NO: 91879 - RNA, 20 nt, Artificial Sequence
  MKO10091879_B_Hmgb4
  gRNA
gggggcuuccgcggugccuu

SEQ ID NO: 91880 - RNA, 20 nt, Artificial Sequence
  MKO10091880_B_Hmgb4
  gRNA
uagcagagcucgauaaagcc

SEQ ID NO: 91881 - RNA, 20 nt, Artificial Sequence
  MKO10091881_B_Hmgcll1
  gRNA
gaccaugcugaagugaugcg

SEQ ID NO: 91882 - RNA, 20 nt, Artificial Sequence
  MKO10091882_B_Hmgcll1
  gRNA
uaugugaaaauagucgaagu

SEQ ID NO: 91883 - RNA, 20 nt, Artificial Sequence
  MKO10091883_B_Hmgcll1
  gRNA
aucaaucaacuuucccaaac

SEQ ID NO: 91884 - RNA, 20 nt, Artificial Sequence
  MKO10091884_B_Hmgcl
  gRNA
uacccaccccagugaagauc

SEQ ID NO: 91885 - RNA, 20 nt, Artificial Sequence
  MKO10091885_B_Hmgcl
  gRNA
ugaccacucugacgucuuga

SEQ ID NO: 91886 - RNA, 20 nt, Artificial Sequence
  MKO10091886_B_Hmgcl
  gRNA
gccaaagcaggugaagaucg

SEQ ID NO: 91887 - RNA, 20 nt, Artificial Sequence
  MKO10091887_B_Hmgcr
  gRNA
agcucguggaauggcaaucc

SEQ ID NO: 91888 - RNA, 20 nt, Artificial Sequence
  MKO10091888_B_Hmgcr
  gRNA
uuccucgacaaagaacugac

SEQ ID NO: 91889 - RNA, 20 nt, Artificial Sequence
  MKO10091889_B_Hmgcr
  gRNA
agccugucaguucuuugucg

SEQ ID NO: 91890 - RNA, 20 nt, Artificial Sequence
  MKO10091890_B_Hmgcs1
  gRNA
agcguuuggcccaauuagca

SEQ ID NO: 91891 - RNA, 20 nt, Artificial Sequence
  MKO10091891_B_Hmgcs1
  gRNA
uucugcaccaguuuacaaua

SEQ ID NO: 91892 - RNA, 20 nt, Artificial Sequence
  MKO10091892_B_Hmgcs1
  gRNA
ucaugaagccaaaaucauuc

SEQ ID NO: 91893 - RNA, 20 nt, Artificial Sequence
  MKO10091893_B_Hmgcs2
  gRNA
ucauauacugcacaucaucg

SEQ ID NO: 91894 - RNA, 20 nt, Artificial Sequence
  MKO10091894_B_Hmgcs2
  gRNA
ggcugcauagcaucgaucca

SEQ ID NO: 91895 - RNA, 20 nt, Artificial Sequence
  MKO10091895_B_Hmgcs2
  gRNA
gacauugcagucuacccgag

SEQ ID NO: 91896 - RNA, 20 nt, Artificial Sequence
  MKO10091896_B_Hmgn1
  gRNA
ccagaagcccgccccugcca

SEQ ID NO: 91897 - RNA, 20 nt, Artificial Sequence
  MKO10091897_B_Hmgn1
  gRNA
cgcgaagccgaaaaaggccg

SEQ ID NO: 91898 - RNA, 20 nt, Artificial Sequence
  MKO10091898_B_Hmgn1
  gRNA
agcccaagcgccgcuccgcg

SEQ ID NO: 91899 - RNA, 20 nt, Artificial Sequence
  MKO10091899_B_Hmgn2
  gRNA
agccacagagaagaucugcg

SEQ ID NO: 91900 - RNA, 20 nt, Artificial Sequence
  MKO10091900_B_Hmgn2
  gRNA
aaccucgcagaucuucucug

SEQ ID NO: 91901 - RNA, 20 nt, Artificial Sequence
  MKO10091901_B_Hmgn2
  gRNA
gccagagcccaaaccuaaaa

SEQ ID NO: 91902 - RNA, 20 nt, Artificial Sequence
  MKO10091902_B_Hmgn3
  gRNA
uggaaccaagcuaacuaagc

SEQ ID NO: 91903 - RNA, 20 nt, Artificial Sequence
  MKO10091903_B_Hmgn3
  gRNA
gaaaccuguuccaccaaaac

SEQ ID NO: 91904 - RNA, 20 nt, Artificial Sequence
  MKO10091904_B_Hmgn3
  gRNA
acaggacuuaccuuucucuu

SEQ ID NO: 91905 - RNA, 20 nt, Artificial Sequence
  MKO10091905_B_Hmgn5
  gRNA
ggcugcaggugaugugagcc

SEQ ID NO: 91906 - RNA, 20 nt, Artificial Sequence
  MKO10091906_B_Hmgn5
  gRNA
cuaaaagagcaucaacuuca

SEQ ID NO: 91907 - RNA, 20 nt, Artificial Sequence
  MKO10091907_B_Hmgn5
  gRNA
aaccaagaccacaaaugucg

SEQ ID NO: 91908 - RNA, 20 nt, Artificial Sequence
  MKO10091908_B_Hmgxb3
  gRNA
uucuccacgaccgaguaagc

SEQ ID NO: 91909 - RNA, 20 nt, Artificial Sequence
  MKO10091909_B_Hmgxb3
  gRNA
ccaccuaagugcccuacuug

SEQ ID NO: 91910 - RNA, 20 nt, Artificial Sequence
  MKO10091910_B_Hmgxb3
  gRNA
agacuacaacauacacccgu

SEQ ID NO: 91911 - RNA, 20 nt, Artificial Sequence
  MKO10091911_B_Hmgxb4
  gRNA
aagaagucgccgcgcagguc

SEQ ID NO: 91912 - RNA, 20 nt, Artificial Sequence
  MKO10091912_B_Hmgxb4
  gRNA
uccccugacgauuacuacua

SEQ ID NO: 91913 - RNA, 20 nt, Artificial Sequence
  MKO10091913_B_Hmgxb4
  gRNA
gguucuuaccuauaccugga

SEQ ID NO: 91914 - RNA, 20 nt, Artificial Sequence
  MKO10091914_B_Hmha1
  gRNA
agcucugcgagucaugcgcc

SEQ ID NO: 91915 - RNA, 20 nt, Artificial Sequence
  MKO10091915_B_Hmha1
  gRNA
caguguguccgaguuccuuu

SEQ ID NO: 91916 - RNA, 20 nt, Artificial Sequence
  MKO10091916_B_Hmha1
  gRNA
aguggacagcaguacucucc

SEQ ID NO: 91917 - RNA, 20 nt, Artificial Sequence
  MKO10091917_B_Hmmr
  gRNA
agcaaagaagucugugucaa

SEQ ID NO: 91918 - RNA, 20 nt, Artificial Sequence
  MKO10091918_B_Hmmr
  gRNA
aaaacuucagaagcaacuaa

SEQ ID NO: 91919 - RNA, 20 nt, Artificial Sequence
  MKO10091919_B_Hmmr
  gRNA
ugugaagagauuagaaaaag

SEQ ID NO: 91920 - RNA, 20 nt, Artificial Sequence
  MKO10091920_B_Hmox1
  gRNA
gggaugagcuagugcugauc

SEQ ID NO: 91921 - RNA, 20 nt, Artificial Sequence
  MKO10091921_B_Hmox1
  gRNA
ucgucagaggccugcuagcc

SEQ ID NO: 91922 - RNA, 20 nt, Artificial Sequence
  MKO10091922_B_Hmox1
  gRNA
gccccugcagagacaccccg

SEQ ID NO: 91923 - RNA, 20 nt, Artificial Sequence
  MKO10091923_B_Hmox2
  gRNA
ucagcacagccacgguuguc

SEQ ID NO: 91924 - RNA, 20 nt, Artificial Sequence
  MKO10091924_B_Hmox2
  gRNA
gguccuucacauguaguacc

SEQ ID NO: 91925 - RNA, 20 nt, Artificial Sequence
  MKO10091925_B_Hmox2
  gRNA
gucuggcugagcagcauaaa

SEQ ID NO: 91926 - RNA, 20 nt, Artificial Sequence
  MKO10091926_B_Hmx1
  gRNA
agagcaccggcacgcggacc

SEQ ID NO: 91927 - RNA, 20 nt, Artificial Sequence
  MKO10091927_B_Hmx1
  gRNA
cgcgcgaaggaagggcaccg

SEQ ID NO: 91928 - RNA, 20 nt, Artificial Sequence
  MKO10091928_B_Hmx1
  gRNA
acgacgcagggcccggcgac

SEQ ID NO: 91929 - RNA, 20 nt, Artificial Sequence
  MKO10091929_B_Hmx2
  gRNA
gggcucccgcggugccucgg

SEQ ID NO: 91930 - RNA, 20 nt, Artificial Sequence
  MKO10091930_B_Hmx2
  gRNA
agccaacauggcacacgcgu

SEQ ID NO: 91931 - RNA, 20 nt, Artificial Sequence
  MKO10091931_B_Hmx2
  gRNA
ugggcaugccgcucguguuu

SEQ ID NO: 91932 - RNA, 20 nt, Artificial Sequence
  MKO10091932_B_Hmx3
  gRNA
cugcgagagcgcgaagcccg

SEQ ID NO: 91933 - RNA, 20 nt, Artificial Sequence
  MKO10091933_B_Hmx3
  gRNA
gacgaccguaggggcgacua

SEQ ID NO: 91934 - RNA, 20 nt, Artificial Sequence
  MKO10091934_B_Hmx3
  gRNA
ugaggugaagcgacgcggcc

SEQ ID NO: 91935 - RNA, 20 nt, Artificial Sequence
  MKO10091935_B_Hn1l
  gRNA
augucacuggucuucccccc

SEQ ID NO: 91936 - RNA, 20 nt, Artificial Sequence
  MKO10091936_B_Hn1l
  gRNA
ugacagucaugaacccagac

SEQ ID NO: 91937 - RNA, 20 nt, Artificial Sequence
  MKO10091937_B_Hn1l
  gRNA
gguucaugacugucaacugu

SEQ ID NO: 91938 - RNA, 20 nt, Artificial Sequence
  MKO10091938_B_Hn1
  gRNA
ggcacaggagcagcgggcac

SEQ ID NO: 91939 - RNA, 20 nt, Artificial Sequence
  MKO10091939_B_Hn1
  gRNA
cggaagagaaccccccaucu

SEQ ID NO: 91940 - RNA, 20 nt, Artificial Sequence
  MKO10091940_B_Hn1
  gRNA
agccagcagaacagccugug

SEQ ID NO: 91941 - RNA, 20 nt, Artificial Sequence
  MKO10091941_B_Hnf1a
  gRNA
accaucuucgccacgcgcca

SEQ ID NO: 91942 - RNA, 20 nt, Artificial Sequence
  MKO10091942_B_Hnf1a
  gRNA
cucacucuagguguacggua

SEQ ID NO: 91943 - RNA, 20 nt, Artificial Sequence
  MKO10091943_B_Hnf1a
  gRNA
guacguccgcaagcagcgag

SEQ ID NO: 91944 - RNA, 20 nt, Artificial Sequence
  MKO10091944_B_Hnf1b
  gRNA
augcgggcccccauuuaaac

SEQ ID NO: 91945 - RNA, 20 nt, Artificial Sequence
  MKO10091945_B_Hnf1b
  gRNA
agacuugcuguaaaaccgac

SEQ ID NO: 91946 - RNA, 20 nt, Artificial Sequence
  MKO10091946_B_Hnf1b
  gRNA
ucuucgacaaucagucacca

SEQ ID NO: 91947 - RNA, 20 nt, Artificial Sequence
  MKO10091947_B_Hnf4a
  gRNA
agcugcugguccuggucgag

SEQ ID NO: 91948 - RNA, 20 nt, Artificial Sequence
  MKO10091948_B_Hnf4a
  gRNA
uaagccugcaguaacgacac

SEQ ID NO: 91949 - RNA, 20 nt, Artificial Sequence
  MKO10091949_B_Hnf4a
  gRNA
ggccuucugcgaacuccuuc

SEQ ID NO: 91950 - RNA, 20 nt, Artificial Sequence
  MKO10091950_B_Hnf4g
  gRNA
acaucauaccuggucaucca

SEQ ID NO: 91951 - RNA, 20 nt, Artificial Sequence
  MKO10091951_B_Hnf4g
  gRNA
uauucauacuuguggucucu

SEQ ID NO: 91952 - RNA, 20 nt, Artificial Sequence
  MKO10091952_B_Hnf4g
  gRNA
gccuuugcagccaucacaac

SEQ ID NO: 91953 - RNA, 20 nt, Artificial Sequence
  MKO10091953_B_Hnmt
  gRNA
uugacaauuuguucagcacu

SEQ ID NO: 91954 - RNA, 20 nt, Artificial Sequence
  MKO10091954_B_Hnmt
  gRNA
gaaauuaagauucugagugu

SEQ ID NO: 91955 - RNA, 20 nt, Artificial Sequence
  MKO10091955_B_Hnmt
  gRNA
uuagaugcuguauuauguaa

SEQ ID NO: 91956 - RNA, 20 nt, Artificial Sequence
  MKO10091956_B_Hnrnpa0
  gRNA
agcgacuacggcaacggcuu

SEQ ID NO: 91957 - RNA, 20 nt, Artificial Sequence
  MKO10091957_B_Hnrnpa0
  gRNA
agcugaagcgcgccgugucg

SEQ ID NO: 91958 - RNA, 20 nt, Artificial Sequence
  MKO10091958_B_Hnrnpa0
  gRNA
cuucgugaccuacucgaacg

SEQ ID NO: 91959 - RNA, 20 nt, Artificial Sequence
  MKO10091959_B_Hnrnpa1
  gRNA
ucucuugagacagcucucuu

SEQ ID NO: 91960 - RNA, 20 nt, Artificial Sequence
  MKO10091960_B_Hnrnpa1
  gRNA
auccaaacaccaagagaucc

SEQ ID NO: 91961 - RNA, 20 nt, Artificial Sequence
  MKO10091961_B_Hnrnpa1
  gRNA
caaucuuauccacagaguca

SEQ ID NO: 91962 - RNA, 20 nt, Artificial Sequence
  MKO10091962_B_Hnrnpa2b1
  gRNA
aaaacgugcuguagcaagag

SEQ ID NO: 91963 - RNA, 20 nt, Artificial Sequence
  MKO10091963_B_Hnrnpa2b1
  gRNA
uggaauuaaggaagauacug

SEQ ID NO: 91964 - RNA, 20 nt, Artificial Sequence
  MKO10091964_B_Hnrnpa2b1
  gRNA
uugcaggagucuggaaaacc

SEQ ID NO: 91965 - RNA, 20 nt, Artificial Sequence
  MKO10091965_B_Hnrnpa3
  gRNA
uucucuuaagcuaucaucug

SEQ ID NO: 91966 - RNA, 20 nt, Artificial Sequence
  MKO10091966_B_Hnrnpa3
  gRNA
ucucuagaaacagcucucuu

SEQ ID NO: 91967 - RNA, 20 nt, Artificial Sequence
  MKO10091967_B_Hnrnpa3
  gRNA
ccccaaacaaaacguuccag

SEQ ID NO: 91968 - RNA, 20 nt, Artificial Sequence
  MKO10091968_B_Hnrnpab
  gRNA
ucgugucauugacccuaaaa

SEQ ID NO: 91969 - RNA, 20 nt, Artificial Sequence
  MKO10091969_B_Hnrnpab
  gRNA
cccucuugaucguccagugu

SEQ ID NO: 91970 - RNA, 20 nt, Artificial Sequence
  MKO10091970_B_Hnrnpab
  gRNA
uacacaggucuuagaucaga

SEQ ID NO: 91971 - RNA, 20 nt, Artificial Sequence
  MKO10091971_B_Hnrnpc
  gRNA
cuucuccguccccucuacuc

SEQ ID NO: 91972 - RNA, 20 nt, Artificial Sequence
  MKO10091972_B_Hnrnpc
  gRNA
uuucaguuccucauuugacu

SEQ ID NO: 91973 - RNA, 20 nt, Artificial Sequence
  MKO10091973_B_Hnrnpc
  gRNA
ggauguacaguuacccagcg

SEQ ID NO: 91974 - RNA, 20 nt, Artificial Sequence
  MKO10091974_B_Hnrnpdl
  gRNA
gcaaauugauagaccccaaa

SEQ ID NO: 91975 - RNA, 20 nt, Artificial Sequence
  MKO10091975_B_Hnrnpdl
  gRNA
ccuagcaccuccucuuccgc

SEQ ID NO: 91976 - RNA, 20 nt, Artificial Sequence
  MKO10091976_B_Hnrnpdl
  gRNA
cuuucuaacaguuucuuuac

SEQ ID NO: 91977 - RNA, 20 nt, Artificial Sequence
  MKO10091977_B_Hnrnpd
  gRNA
ugaauccauagagcucccua

SEQ ID NO: 91978 - RNA, 20 nt, Artificial Sequence
  MKO10091978_B_Hnrnpd
  gRNA
gaaagucauugauccuaaaa

SEQ ID NO: 91979 - RNA, 20 nt, Artificial Sequence
  MKO10091979_B_Hnrnpd
  gRNA
ccccuugaucgcccugugau

SEQ ID NO: 91980 - RNA, 20 nt, Artificial Sequence
  MKO10091980_B_Hnrnpf
  gRNA
guccaugaugcugggcccug

SEQ ID NO: 91981 - RNA, 20 nt, Artificial Sequence
  MKO10091981_B_Hnrnpf
  gRNA
gcccucucauguggacgcag

SEQ ID NO: 91982 - RNA, 20 nt, Artificial Sequence
  MKO10091982_B_Hnrnpf
  gRNA
aggcuucggggacucccauu

SEQ ID NO: 91983 - RNA, 20 nt, Artificial Sequence
  MKO10091983_B_Hnrnph1
  gRNA
ugacccaccacgaaaacuua

SEQ ID NO: 91984 - RNA, 20 nt, Artificial Sequence
  MKO10091984_B_Hnrnph1
  gRNA
cggcuuagaggacucccuuu

SEQ ID NO: 91985 - RNA, 20 nt, Artificial Sequence
  MKO10091985_B_Hnrnph1
  gRNA
caagucaaacaacguugaaa

SEQ ID NO: 91986 - RNA, 20 nt, Artificial Sequence
  MKO10091986_B_Hnrnph2
  gRNA
ggcacuguguacauaugagg

SEQ ID NO: 91987 - RNA, 20 nt, Artificial Sequence
  MKO10091987_B_Hnrnph2
  gRNA
uggauaugaccaaguucuuc

SEQ ID NO: 91988 - RNA, 20 nt, Artificial Sequence
  MKO10091988_B_Hnrnph2
  gRNA
uauuucaaugugcacucuca

SEQ ID NO: 91989 - RNA, 20 nt, Artificial Sequence
  MKO10091989_B_Hnrnph3
  gRNA
aacauugacgauggacuacc

SEQ ID NO: 91990 - RNA, 20 nt, Artificial Sequence
  MKO10091990_B_Hnrnph3
  gRNA
ggcuauaauaauuauggcua

SEQ ID NO: 91991 - RNA, 20 nt, Artificial Sequence
  MKO10091991_B_Hnrnph3
  gRNA
aucgucaauguuaucccauu

SEQ ID NO: 91992 - RNA, 20 nt, Artificial Sequence
  MKO10091992_B_Hnrnpk
  gRNA
aucuagaaauacugaugaga

SEQ ID NO: 91993 - RNA, 20 nt, Artificial Sequence
  MKO10091993_B_Hnrnpk
  gRNA
aaaaggaggcaagaauauua

SEQ ID NO: 91994 - RNA, 20 nt, Artificial Sequence
  MKO10091994_B_Hnrnpk
  gRNA
guuucagucccagacagcag

SEQ ID NO: 91995 - RNA, 20 nt, Artificial Sequence
  MKO10091995_B_Hnrnpll
  gRNA
gucaguccuuugcgcccaga

SEQ ID NO: 91996 - RNA, 20 nt, Artificial Sequence
  MKO10091996_B_Hnrnpll
  gRNA
uccccuguuguccauguucg

SEQ ID NO: 91997 - RNA, 20 nt, Artificial Sequence
  MKO10091997_B_Hnrnpll
  gRNA
ugagugcugcuuuagccuuc

SEQ ID NO: 91998 - RNA, 20 nt, Artificial Sequence
  MKO10091998_B_Hnrnpl
  gRNA
gaugucagccccauugagug

SEQ ID NO: 91999 - RNA, 20 nt, Artificial Sequence
  MKO10091999_B_Hnrnpl
  gRNA
gcaaagugcccagcgcgcca

SEQ ID NO: 92000 - RNA, 20 nt, Artificial Sequence
  MKO10092000_B_Hnrnpl
  gRNA
uagccugaacuccguucuuc

SEQ ID NO: 92001 - RNA, 20 nt, Artificial Sequence
  MKO10092001_B_Hnrnpm
  gRNA
gaccuacucagaaugagaag

SEQ ID NO: 92002 - RNA, 20 nt, Artificial Sequence
  MKO10092002_B_Hnrnpm
  gRNA
uggacgcugaaggaaaguca

SEQ ID NO: 92003 - RNA, 20 nt, Artificial Sequence
  MKO10092003_B_Hnrnpm
  gRNA
aguuggugagguaacauacg

SEQ ID NO: 92004 - RNA, 20 nt, Artificial Sequence
  MKO10092004_B_Hnrnpr
  gRNA
uuuaggauugguagcuuaug

SEQ ID NO: 92005 - RNA, 20 nt, Artificial Sequence
  MKO10092005_B_Hnrnpr
  gRNA
aucucuaggccuugcuugag

SEQ ID NO: 92006 - RNA, 20 nt, Artificial Sequence
  MKO10092006_B_Hnrnpr
  gRNA
uuauacuuuggaugugacca

SEQ ID NO: 92007 - RNA, 20 nt, Artificial Sequence
  MKO10092007_B_Hnrnpul1
  gRNA
acggccucgauucucuucaa

SEQ ID NO: 92008 - RNA, 20 nt, Artificial Sequence
  MKO10092008_B_Hnrnpul1
  gRNA
cucguagaauugguucuguc

SEQ ID NO: 92009 - RNA, 20 nt, Artificial Sequence
  MKO10092009_B_Hnrnpul1
  gRNA
cagcagcaaguauaucaccc

SEQ ID NO: 92010 - RNA, 20 nt, Artificial Sequence
  MKO10092010_B_Hnrnpul2
  gRNA
caaauaagcaaagaccgaua

SEQ ID NO: 92011 - RNA, 20 nt, Artificial Sequence
  MKO10092011_B_Hnrnpul2
  gRNA
uacuucuugccccagaccaa

SEQ ID NO: 92012 - RNA, 20 nt, Artificial Sequence
  MKO10092012_B_Hnrnpul2
  gRNA
caccuuaccaagcugugaac

SEQ ID NO: 92013 - RNA, 20 nt, Artificial Sequence
  MKO10092013_B_Hnrnpu
  gRNA
ggcuggucacuaaccacaag

SEQ ID NO: 92014 - RNA, 20 nt, Artificial Sequence
  MKO10092014_B_Hnrnpu
  gRNA
ucgaagaaaacaaguacagc

SEQ ID NO: 92015 - RNA, 20 nt, Artificial Sequence
  MKO10092015_B_Hnrnpu
  gRNA
aaaagaccgcgagaagauca

SEQ ID NO: 92016 - RNA, 20 nt, Artificial Sequence
  MKO10092016_B_Hoga1
  gRNA
gguggugagccgcgugcgcc

SEQ ID NO: 92017 - RNA, 20 nt, Artificial Sequence
  MKO10092017_B_Hoga1
  gRNA
cgcucgaggcuggucaggaa

SEQ ID NO: 92018 - RNA, 20 nt, Artificial Sequence
  MKO10092018_B_Hoga1
  gRNA
gggacacuguacaacaccac

SEQ ID NO: 92019 - RNA, 20 nt, Artificial Sequence
  MKO10092019_B_Homer1
  gRNA
acccaccugugaagggguac

SEQ ID NO: 92020 - RNA, 20 nt, Artificial Sequence
  MKO10092020_B_Homer1
  gRNA
guccauaaacaguguuugcc

SEQ ID NO: 92021 - RNA, 20 nt, Artificial Sequence
  MKO10092021_B_Homer1
  gRNA
uugacaccagaaaguaucaa

SEQ ID NO: 92022 - RNA, 20 nt, Artificial Sequence
  MKO10092022_B_Homer2
  gRNA
cccgaacuucugugacguuu

SEQ ID NO: 92023 - RNA, 20 nt, Artificial Sequence
  MKO10092023_B_Homer2
  gRNA
gucggcugggcucgcgugag

SEQ ID NO: 92024 - RNA, 20 nt, Artificial Sequence
  MKO10092024_B_Homer2
  gRNA
agcagagccaacaccguguu

SEQ ID NO: 92025 - RNA, 20 nt, Artificial Sequence
  MKO10092025_B_Homer3
  gRNA
ccauugcccgaacuucugag

SEQ ID NO: 92026 - RNA, 20 nt, Artificial Sequence
  MKO10092026_B_Homer3
  gRNA
agaauucacuaguacuggcc

SEQ ID NO: 92027 - RNA, 20 nt, Artificial Sequence
  MKO10092027_B_Homer3
  gRNA
agauuucucucgagccagcc

SEQ ID NO: 92028 - RNA, 20 nt, Artificial Sequence
  MKO10092028_B_Homez
  gRNA
cucgcccggagaucauucaa

SEQ ID NO: 92029 - RNA, 20 nt, Artificial Sequence
  MKO10092029_B_Homez
  gRNA
aucaaguaaugagaccgaug

SEQ ID NO: 92030 - RNA, 20 nt, Artificial Sequence
  MKO10092030_B_Homez
  gRNA
aaucuucucgucgugcccau

SEQ ID NO: 92031 - RNA, 20 nt, Artificial Sequence
  MKO10092031_B_Hook1
  gRNA
gauaguaacuuguaauucca

SEQ ID NO: 92032 - RNA, 20 nt, Artificial Sequence
  MKO10092032_B_Hook1
  gRNA
uugaugaagaacuugugcca

SEQ ID NO: 92033 - RNA, 20 nt, Artificial Sequence
  MKO10092033_B_Hook1
  gRNA
cacugagugugcagauccug

SEQ ID NO: 92034 - RNA, 20 nt, Artificial Sequence
  MKO10092034_B_Hook2
  gRNA
cauucguuguugaaccagga

SEQ ID NO: 92035 - RNA, 20 nt, Artificial Sequence
  MKO10092035_B_Hook2
  gRNA
ucgccaaugaggcucacauc

SEQ ID NO: 92036 - RNA, 20 nt, Artificial Sequence
  MKO10092036_B_Hook2
  gRNA
uucaacaacgaauggcucca

SEQ ID NO: 92037 - RNA, 20 nt, Artificial Sequence
  MKO10092037_B_Hook3
  gRNA
cuuccugacgugaaccucau

SEQ ID NO: 92038 - RNA, 20 nt, Artificial Sequence
  MKO10092038_B_Hook3
  gRNA
gaacggcguugucauguccc

SEQ ID NO: 92039 - RNA, 20 nt, Artificial Sequence
  MKO10092039_B_Hook3
  gRNA
cauccgaaugcuccccaaug

SEQ ID NO: 92040 - RNA, 20 nt, Artificial Sequence
  MKO10092040_B_Hopx
  gRNA
gaaaugguuuaagcagcgcc

SEQ ID NO: 92041 - RNA, 20 nt, Artificial Sequence
  MKO10092041_B_Hopx
  gRNA
cuccuccgugagacccgccu

SEQ ID NO: 92042 - RNA, 20 nt, Artificial Sequence
  MKO10092042_B_Hopx
  gRNA
gcugugccucaucgcagccg

SEQ ID NO: 92043 - RNA, 20 nt, Artificial Sequence
  MKO10092043_B_Hormad1
  gRNA
aaagaagauaaaaauugucc

SEQ ID NO: 92044 - RNA, 20 nt, Artificial Sequence
  MKO10092044_B_Hormad1
  gRNA
ugcaagauacugaaacagcu

SEQ ID NO: 92045 - RNA, 20 nt, Artificial Sequence
  MKO10092045_B_Hormad1
  gRNA
aaucuuugauguuugugaag

SEQ ID NO: 92046 - RNA, 20 nt, Artificial Sequence
  MKO10092046_B_Hormad2
  gRNA
ggucauuacauauuauuaaa

SEQ ID NO: 92047 - RNA, 20 nt, Artificial Sequence
  MKO10092047_B_Hormad2
  gRNA
caacuuuaccauccaaacgg

SEQ ID NO: 92048 - RNA, 20 nt, Artificial Sequence
  MKO10092048_B_Hormad2
  gRNA
acucaugcucauuugucacu

SEQ ID NO: 92049 - RNA, 20 nt, Artificial Sequence
  MKO10092049_B_Hoxa10
  gRNA
ggacgcuacggcugaucucu

SEQ ID NO: 92050 - RNA, 20 nt, Artificial Sequence
  MKO10092050_B_Hoxa10
  gRNA
ccgugccguaggccugcgac

SEQ ID NO: 92051 - RNA, 20 nt, Artificial Sequence
  MKO10092051_B_Hoxa10
  gRNA
ggcgggucgaaaccgcgccc

SEQ ID NO: 92052 - RNA, 20 nt, Artificial Sequence
  MKO10092052_B_Hoxa11
  gRNA
uagcugaguaguacuguaac

SEQ ID NO: 92053 - RNA, 20 nt, Artificial Sequence
  MKO10092053_B_Hoxa11
  gRNA
uaugucauugggcgcgaaga

SEQ ID NO: 92054 - RNA, 20 nt, Artificial Sequence
  MKO10092054_B_Hoxa11
  gRNA
cagcacgucgccaggcacgc

SEQ ID NO: 92055 - RNA, 20 nt, Artificial Sequence
  MKO10092055_B_Hoxa13
  gRNA
gcagcuugaagaaacgcuua

SEQ ID NO: 92056 - RNA, 20 nt, Artificial Sequence
  MKO10092056_B_Hoxa13
  gRNA
gcgccaucagguugcggcac

SEQ ID NO: 92057 - RNA, 20 nt, Artificial Sequence
  MKO10092057_B_Hoxa13
  gRNA
caccgagaaguugccccccg

SEQ ID NO: 92058 - RNA, 20 nt, Artificial Sequence
  MKO10092058_B_Hoxa1
  gRNA
aaguucugcgcgccauagcu

SEQ ID NO: 92059 - RNA, 20 nt, Artificial Sequence
  MKO10092059_B_Hoxa1
  gRNA
cagaacuucagugcgccuua

SEQ ID NO: 92060 - RNA, 20 nt, Artificial Sequence
  MKO10092060_B_Hoxa1
  gRNA
cggcgacgaccgcuuccuag

SEQ ID NO: 92061 - RNA, 20 nt, Artificial Sequence
  MKO10092061_B_Hoxa2
  gRNA
aguaccuuugcagaccccgc

SEQ ID NO: 92062 - RNA, 20 nt, Artificial Sequence
  MKO10092062_B_Hoxa2
  gRNA
cgggcugccgcgacugcccg

SEQ ID NO: 92063 - RNA, 20 nt, Artificial Sequence
  MKO10092063_B_Hoxa2
  gRNA
uacgaauuugagcgagagau

SEQ ID NO: 92064 - RNA, 20 nt, Artificial Sequence
  MKO10092064_B_Hoxa3
  gRNA
aggcaacccauaggcgccuu

SEQ ID NO: 92065 - RNA, 20 nt, Artificial Sequence
  MKO10092065_B_Hoxa3
  gRNA
uacgacagcucagcgaucua

SEQ ID NO: 92066 - RNA, 20 nt, Artificial Sequence
  MKO10092066_B_Hoxa3
  gRNA
gaucgcugagcugucguagu

SEQ ID NO: 92067 - RNA, 20 nt, Artificial Sequence
  MKO10092067_B_Hoxa4
  gRNA
cgaucucgaugcggcgccgc

SEQ ID NO: 92068 - RNA, 20 nt, Artificial Sequence
  MKO10092068_B_Hoxa4
  gRNA
uccuugcccuucgggcccgc

SEQ ID NO: 92069 - RNA, 20 nt, Artificial Sequence
  MKO10092069_B_Hoxa4
  gRNA
cugccccccgucgcgacagc

SEQ ID NO: 92070 - RNA, 20 nt, Artificial Sequence
  MKO10092070_B_Hoxa5
  gRNA
gcggaaagcccccccugccg

SEQ ID NO: 92071 - RNA, 20 nt, Artificial Sequence
  MKO10092071_B_Hoxa5
  gRNA
guuccgugagcgaacaauuc

SEQ ID NO: 92072 - RNA, 20 nt, Artificial Sequence
  MKO10092072_B_Hoxa5
  gRNA
gacucggcgagcaugcacuc

SEQ ID NO: 92073 - RNA, 20 nt, Artificial Sequence
  MKO10092073_B_Hoxa6
  gRNA
cugcccacaggugccgugua

SEQ ID NO: 92074 - RNA, 20 nt, Artificial Sequence
  MKO10092074_B_Hoxa6
  gRNA
aaccgggcauccuacgagua

SEQ ID NO: 92075 - RNA, 20 nt, Artificial Sequence
  MKO10092075_B_Hoxa6
  gRNA
ccccguacucguaggaugcc

SEQ ID NO: 92076 - RNA, 20 nt, Artificial Sequence
  MKO10092076_B_Hoxa7
  gRNA
cacugcagccccggaagacg

SEQ ID NO: 92077 - RNA, 20 nt, Artificial Sequence
  MKO10092077_B_Hoxa7
  gRNA
gcccucguccgccuugucgc

SEQ ID NO: 92078 - RNA, 20 nt, Artificial Sequence
  MKO10092078_B_Hoxa7
  gRNA
guagccgcuucucugcgagu

SEQ ID NO: 92079 - RNA, 20 nt, Artificial Sequence
  MKO10092079_B_Hoxa9
  gRNA
gcucaaccucaccgaaaggc

SEQ ID NO: 92080 - RNA, 20 nt, Artificial Sequence
  MKO10092080_B_Hoxa9
  gRNA
caaacaccgccgccuuggac

SEQ ID NO: 92081 - RNA, 20 nt, Artificial Sequence
  MKO10092081_B_Hoxa9
  gRNA
cgcgugcacuggguuccacg

SEQ ID NO: 92082 - RNA, 20 nt, Artificial Sequence
  MKO10092082_B_Hoxb13
  gRNA
cugaacgccagauuaccauc

SEQ ID NO: 92083 - RNA, 20 nt, Artificial Sequence
  MKO10092083_B_Hoxb13
  gRNA
gcccggcaauuaugccaccu

SEQ ID NO: 92084 - RNA, 20 nt, Artificial Sequence
  MKO10092084_B_Hoxb13
  gRNA
ugcaggaguuuccgaagggu

SEQ ID NO: 92085 - RNA, 20 nt, Artificial Sequence
  MKO10092085_B_Hoxb1
  gRNA
gggggguugcccgacagcua

SEQ ID NO: 92086 - RNA, 20 nt, Artificial Sequence
  MKO10092086_B_Hoxb1
  gRNA
ccuagcgaagguguccgagc

SEQ ID NO: 92087 - RNA, 20 nt, Artificial Sequence
  MKO10092087_B_Hoxb1
  gRNA
agcugggcuccguagcucga

SEQ ID NO: 92088 - RNA, 20 nt, Artificial Sequence
  MKO10092088_B_Hoxb2
  gRNA
accugauggugauccgaccu

SEQ ID NO: 92089 - RNA, 20 nt, Artificial Sequence
  MKO10092089_B_Hoxb2
  gRNA
cuggcucucccgcgucgucc

SEQ ID NO: 92090 - RNA, 20 nt, Artificial Sequence
  MKO10092090_B_Hoxb2
  gRNA
aaaaggcgaauccugccgcu

SEQ ID NO: 92091 - RNA, 20 nt, Artificial Sequence
  MKO10092091_B_Hoxb3
  gRNA
aaaagcggcccccccaagug

SEQ ID NO: 92092 - RNA, 20 nt, Artificial Sequence
  MKO10092092_B_Hoxb3
  gRNA
guuggagccggcaccgcacu

SEQ ID NO: 92093 - RNA, 20 nt, Artificial Sequence
  MKO10092093_B_Hoxb3
  gRNA
ucggguccagcagaagguug

SEQ ID NO: 92094 - RNA, 20 nt, Artificial Sequence
  MKO10092094_B_Hoxb4
  gRNA
gacgacgggcucuuugcacg

SEQ ID NO: 92095 - RNA, 20 nt, Artificial Sequence
  MKO10092095_B_Hoxb4
  gRNA
gugcacugugcagcgcuacg

SEQ ID NO: 92096 - RNA, 20 nt, Artificial Sequence
  MKO10092096_B_Hoxb4
  gRNA
aucgcuaccugacgcgccgc

SEQ ID NO: 92097 - RNA, 20 nt, Artificial Sequence
  MKO10092097_B_Hoxb5
  gRNA
gguagcgaguauaggcgguc

SEQ ID NO: 92098 - RNA, 20 nt, Artificial Sequence
  MKO10092098_B_Hoxb5
  gRNA
cgcgcuggccucgucuauuu

SEQ ID NO: 92099 - RNA, 20 nt, Artificial Sequence
  MKO10092099_B_Hoxb5
  gRNA
caccucuacggccgcgcccg

SEQ ID NO: 92100 - RNA, 20 nt, Artificial Sequence
  MKO10092100_B_Hoxb6
  gRNA
uugcagcaccuucacucggc

SEQ ID NO: 92101 - RNA, 20 nt, Artificial Sequence
  MKO10092101_B_Hoxb6
  gRNA
gcuccacgcccgucuacccg

SEQ ID NO: 92102 - RNA, 20 nt, Artificial Sequence
  MKO10092102_B_Hoxb6
  gRNA
cgcguccuucucccgguaga

SEQ ID NO: 92103 - RNA, 20 nt, Artificial Sequence
  MKO10092103_B_Hoxb7
  gRNA
ccuccgcuuccgccuugucc

SEQ ID NO: 92104 - RNA, 20 nt, Artificial Sequence
  MKO10092104_B_Hoxb7
  gRNA
gccgccuuggcggggucgcc

SEQ ID NO: 92105 - RNA, 20 nt, Artificial Sequence
  MKO10092105_B_Hoxb7
  gRNA
uggagcgaaaaccgaacuug

SEQ ID NO: 92106 - RNA, 20 nt, Artificial Sequence
  MKO10092106_B_Hoxb8
  gRNA
ccugggcggccgacccaccg

SEQ ID NO: 92107 - RNA, 20 nt, Artificial Sequence
  MKO10092107_B_Hoxb8
  gRNA
ggcaccagagaccgccgagc

SEQ ID NO: 92108 - RNA, 20 nt, Artificial Sequence
  MKO10092108_B_Hoxb8
  gRNA
ccuccgcuugcgagucagau

SEQ ID NO: 92109 - RNA, 20 nt, Artificial Sequence
  MKO10092109_B_Hoxb9
  gRNA
cuugucucucacucagauug

SEQ ID NO: 92110 - RNA, 20 nt, Artificial Sequence
  MKO10092110_B_Hoxb9
  gRNA
gggcacgcccgaguacaguu

SEQ ID NO: 92111 - RNA, 20 nt, Artificial Sequence
  MKO10092111_B_Hoxb9
  gRNA
guacgcgaacccgcggcagc

SEQ ID NO: 92112 - RNA, 20 nt, Artificial Sequence
  MKO10092112_B_Hoxc10
  gRNA
guucccggauccgauucucu

SEQ ID NO: 92113 - RNA, 20 nt, Artificial Sequence
  MKO10092113_B_Hoxc10
  gRNA
uguaacuccgaacucguacg

SEQ ID NO: 92114 - RNA, 20 nt, Artificial Sequence
  MKO10092114_B_Hoxc10
  gRNA
caacccgcgcaccgaacauc

SEQ ID NO: 92115 - RNA, 20 nt, Artificial Sequence
  MKO10092115_B_Hoxc11
  gRNA
uuccugaaaaauacugcagc

SEQ ID NO: 92116 - RNA, 20 nt, Artificial Sequence
  MKO10092116_B_Hoxc11
  gRNA
ggcgcugacuucggcgaacg

SEQ ID NO: 92117 - RNA, 20 nt, Artificial Sequence
  MKO10092117_B_Hoxc11
  gRNA
aagacgaguagcuguuccga

SEQ ID NO: 92118 - RNA, 20 nt, Artificial Sequence
  MKO10092118_B_Hoxc12
  gRNA
ccgagaguucccuccgacgc

SEQ ID NO: 92119 - RNA, 20 nt, Artificial Sequence
  MKO10092119_B_Hoxc12
  gRNA
aaguacgacuacacggcgag

SEQ ID NO: 92120 - RNA, 20 nt, Artificial Sequence
  MKO10092120_B_Hoxc12
  gRNA
cacgugcgaguuggcucgcg

SEQ ID NO: 92121 - RNA, 20 nt, Artificial Sequence
  MKO10092121_B_Hoxc13
  gRNA
ucucuuucacgcgucgauuc

SEQ ID NO: 92122 - RNA, 20 nt, Artificial Sequence
  MKO10092122_B_Hoxc13
  gRNA
gcgcauuggcgcgccgccuc

SEQ ID NO: 92123 - RNA, 20 nt, Artificial Sequence
  MKO10092123_B_Hoxc13
  gRNA
agcgcgucgugacgcggcuc

SEQ ID NO: 92124 - RNA, 20 nt, Artificial Sequence
  MKO10092124_B_Hoxc4
  gRNA
guaggcuguccucgagcgcu

SEQ ID NO: 92125 - RNA, 20 nt, Artificial Sequence
  MKO10092125_B_Hoxc4
  gRNA
ccuggcaauucgcgagccca

SEQ ID NO: 92126 - RNA, 20 nt, Artificial Sequence
  MKO10092126_B_Hoxc4
  gRNA
ccgugggcucgcgaauugcc

SEQ ID NO: 92127 - RNA, 20 nt, Artificial Sequence
  MKO10092127_B_Hoxc5
  gRNA
caauccgccguagcaguacc

SEQ ID NO: 92128 - RNA, 20 nt, Artificial Sequence
  MKO10092128_B_Hoxc5
  gRNA
accgcuaccucacucgccgc

SEQ ID NO: 92129 - RNA, 20 nt, Artificial Sequence
  MKO10092129_B_Hoxc5
  gRNA
uuagcucgcuccuccagcgc

SEQ ID NO: 92130 - RNA, 20 nt, Artificial Sequence
  MKO10092130_B_Hoxc6
  gRNA
uccuuauccugccaccucgc

SEQ ID NO: 92131 - RNA, 20 nt, Artificial Sequence
  MKO10092131_B_Hoxc6
  gRNA
aggggcaaccgccgacagcc

SEQ ID NO: 92132 - RNA, 20 nt, Artificial Sequence
  MKO10092132_B_Hoxc6
  gRNA
ucugguaccgagaguagauc

SEQ ID NO: 92133 - RNA, 20 nt, Artificial Sequence
  MKO10092133_B_Hoxc8
  gRNA
ugucgaccgcugcgccgccc

SEQ ID NO: 92134 - RNA, 20 nt, Artificial Sequence
  MKO10092134_B_Hoxc8
  gRNA
ggacucgccgccuuuguauu

SEQ ID NO: 92135 - RNA, 20 nt, Artificial Sequence
  MKO10092135_B_Hoxc8
  gRNA
uuacagccgguaucagaccu

SEQ ID NO: 92136 - RNA, 20 nt, Artificial Sequence
  MKO10092136_B_Hoxc9
  gRNA
caccucguaccgacgguccc

SEQ ID NO: 92137 - RNA, 20 nt, Artificial Sequence
  MKO10092137_B_Hoxc9
  gRNA
gcgagccguacauguagucc

SEQ ID NO: 92138 - RNA, 20 nt, Artificial Sequence
  MKO10092138_B_Hoxc9
  gRNA
cagcgcguccgccucgggcg

SEQ ID NO: 92139 - RNA, 20 nt, Artificial Sequence
  MKO10092139_B_Hoxd10
  gRNA
uuacaccaagcaccaaacgc

SEQ ID NO: 92140 - RNA, 20 nt, Artificial Sequence
  MKO10092140_B_Hoxd10
  gRNA
cggggcuguuauuguacucu

SEQ ID NO: 92141 - RNA, 20 nt, Artificial Sequence
  MKO10092141_B_Hoxd10
  gRNA
cugagucagaccuacgccac

SEQ ID NO: 92142 - RNA, 20 nt, Artificial Sequence
  MKO10092142_B_Hoxd11
  gRNA
aaaacucgcguuccaguucg

SEQ ID NO: 92143 - RNA, 20 nt, Artificial Sequence
  MKO10092143_B_Hoxd11
  gRNA
cgcgccaaguggccguaccg

SEQ ID NO: 92144 - RNA, 20 nt, Artificial Sequence
  MKO10092144_B_Hoxd11
  gRNA
guaguagggagcguagcccc

SEQ ID NO: 92145 - RNA, 20 nt, Artificial Sequence
  MKO10092145_B_Hoxd12
  gRNA
agcguaaggaauugucuaac

SEQ ID NO: 92146 - RNA, 20 nt, Artificial Sequence
  MKO10092146_B_Hoxd12
  gRNA
aggcaccaaguaugacuacg

SEQ ID NO: 92147 - RNA, 20 nt, Artificial Sequence
  MKO10092147_B_Hoxd12
  gRNA
ugaugcgcccaccgcaucug

SEQ ID NO: 92148 - RNA, 20 nt, Artificial Sequence
  MKO10092148_B_Hoxd13
  gRNA
ugugcgucuaccgacgggga

SEQ ID NO: 92149 - RNA, 20 nt, Artificial Sequence
  MKO10092149_B_Hoxd13
  gRNA
gaauguguccccgcgaacac

SEQ ID NO: 92150 - RNA, 20 nt, Artificial Sequence
  MKO10092150_B_Hoxd13
  gRNA
agccuacgccgugcgacaug

SEQ ID NO: 92151 - RNA, 20 nt, Artificial Sequence
  MKO10092151_B_Hoxd1
  gRNA
ugaccggggaagcuuaaucg

SEQ ID NO: 92152 - RNA, 20 nt, Artificial Sequence
  MKO10092152_B_Hoxd1
  gRNA
cgggccggcguuugacuucc

SEQ ID NO: 92153 - RNA, 20 nt, Artificial Sequence
  MKO10092153_B_Hoxd1
  gRNA
cccgccggagaagaccgccg

SEQ ID NO: 92154 - RNA, 20 nt, Artificial Sequence
  MKO10092154_B_Hoxd3
  gRNA
ccguagccuccaaagagucc

SEQ ID NO: 92155 - RNA, 20 nt, Artificial Sequence
  MKO10092155_B_Hoxd3
  gRNA
gcaggcgucccugagacgag

SEQ ID NO: 92156 - RNA, 20 nt, Artificial Sequence
  MKO10092156_B_Hoxd3
  gRNA
ugaggcucgaacucgggcgc

SEQ ID NO: 92157 - RNA, 20 nt, Artificial Sequence
  MKO10092157_B_Hoxd4
  gRNA
gggcuccccgccgguguagu

SEQ ID NO: 92158 - RNA, 20 nt, Artificial Sequence
  MKO10092158_B_Hoxd4
  gRNA
ugcucgccgaagucgggccg

SEQ ID NO: 92159 - RNA, 20 nt, Artificial Sequence
  MKO10092159_B_Hoxd4
  gRNA
guucaccauauacgaacuca

SEQ ID NO: 92160 - RNA, 20 nt, Artificial Sequence
  MKO10092160_B_Hoxd8
  gRNA
aagacaaguuuccugcgucc

SEQ ID NO: 92161 - RNA, 20 nt, Artificial Sequence
  MKO10092161_B_Hoxd8
  gRNA
auugauggccucgcccgccg

SEQ ID NO: 92162 - RNA, 20 nt, Artificial Sequence
  MKO10092162_B_Hoxd8
  gRNA
ggccaggacuacuuccacgc

SEQ ID NO: 92163 - RNA, 20 nt, Artificial Sequence
  MKO10092163_B_Hoxd9
  gRNA
accggcgcuacgagguggcc

SEQ ID NO: 92164 - RNA, 20 nt, Artificial Sequence
  MKO10092164_B_Hoxd9
  gRNA
cgggacgcuacguacgcucc

SEQ ID NO: 92165 - RNA, 20 nt, Artificial Sequence
  MKO10092165_B_Hoxd9
  gRNA
aacgaguugcacgggaauuc

SEQ ID NO: 92166 - RNA, 20 nt, Artificial Sequence
  MKO10092166_B_Hp1bp3
  gRNA
gauggacgcaaucuuaacug

SEQ ID NO: 92167 - RNA, 20 nt, Artificial Sequence
  MKO10092167_B_Hp1bp3
  gRNA
aguuucccggguagaauuca

SEQ ID NO: 92168 - RNA, 20 nt, Artificial Sequence
  MKO10092168_B_Hp1bp3
  gRNA
cauucauaaguacccgucuc

SEQ ID NO: 92169 - RNA, 20 nt, Artificial Sequence
  MKO10092169_B_Hpcal1
  gRNA
caccuuugaugaauucuucc

SEQ ID NO: 92170 - RNA, 20 nt, Artificial Sequence
  MKO10092170_B_Hpcal1
  gRNA
uuugcaggccaucuacaaga

SEQ ID NO: 92171 - RNA, 20 nt, Artificial Sequence
  MKO10092171_B_Hpcal1
  gRNA
guccucaggcaucuucauca

SEQ ID NO: 92172 - RNA, 20 nt, Artificial Sequence
  MKO10092172_B_Hpcal4
  gRNA
uaaggaugaccagauuacgc

SEQ ID NO: 92173 - RNA, 20 nt, Artificial Sequence
  MKO10092173_B_Hpcal4
  gRNA
gcucgcugaacuccguguuc

SEQ ID NO: 92174 - RNA, 20 nt, Artificial Sequence
  MKO10092174_B_Hpcal4
  gRNA
gaacacggaguucagcgagc

SEQ ID NO: 92175 - RNA, 20 nt, Artificial Sequence
  MKO10092175_B_Hpca
  gRNA
cccugcaggcaagcugucgc

SEQ ID NO: 92176 - RNA, 20 nt, Artificial Sequence
  MKO10092176_B_Hpca
  gRNA
cgucauuguuuguguccauu

SEQ ID NO: 92177 - RNA, 20 nt, Artificial Sequence
  MKO10092177_B_Hpca
  gRNA
ugcugggaucacacugcagc

SEQ ID NO: 92178 - RNA, 20 nt, Artificial Sequence
  MKO10092178_B_Hpdl
  gRNA
ggcucgcggcugcaucaugc

SEQ ID NO: 92179 - RNA, 20 nt, Artificial Sequence
  MKO10092179_B_Hpdl
  gRNA
agaaagugucuucggcgaag

SEQ ID NO: 92180 - RNA, 20 nt, Artificial Sequence
  MKO10092180_B_Hpdl
  gRNA
agacagcguccccgcugcgc

SEQ ID NO: 92181 - RNA, 20 nt, Artificial Sequence
  MKO10092181_B_Hpd
  gRNA
cuuggcauugccaacccaga

SEQ ID NO: 92182 - RNA, 20 nt, Artificial Sequence
  MKO10092182_B_Hpd
  gRNA
augucccucaccuuuguucc

SEQ ID NO: 92183 - RNA, 20 nt, Artificial Sequence
  MKO10092183_B_Hpd
  gRNA
uagacaaccuacaacaacaa

SEQ ID NO: 92184 - RNA, 20 nt, Artificial Sequence
  MKO10092184_B_Hpgds
  gRNA
uuuggcugggaagacagcgu

SEQ ID NO: 92185 - RNA, 20 nt, Artificial Sequence
  MKO10092185_B_Hpgds
  gRNA
accucgccuucugaaagauu

SEQ ID NO: 92186 - RNA, 20 nt, Artificial Sequence
  MKO10092186_B_Hpgds
  gRNA
agauauuugaccaaaaacac

SEQ ID NO: 92187 - RNA, 20 nt, Artificial Sequence
  MKO10092187_B_Hpgd
  gRNA
acuguucguccagugugaug

SEQ ID NO: 92188 - RNA, 20 nt, Artificial Sequence
  MKO10092188_B_Hpgd
  gRNA
cgugaacaaugagaaaaacu

SEQ ID NO: 92189 - RNA, 20 nt, Artificial Sequence
  MKO10092189_B_Hpgd
  gRNA
aucaauaugucuucauuagc

SEQ ID NO: 92190 - RNA, 20 nt, Artificial Sequence
  MKO10092190_B_Hpn
  gRNA
gcuugcgguguuugacaaga

SEQ ID NO: 92191 - RNA, 20 nt, Artificial Sequence
  MKO10092191_B_Hpn
  gRNA
ggggccgcguccugggccau

SEQ ID NO: 92192 - RNA, 20 nt, Artificial Sequence
  MKO10092192_B_Hpn
  gRNA
cucuacucaccuugguacag

SEQ ID NO: 92193 - RNA, 20 nt, Artificial Sequence
  MKO10092193_B_Hprt
  gRNA
caacuagaaugaucagucaa

SEQ ID NO: 92194 - RNA, 20 nt, Artificial Sequence
  MKO10092194_B_Hprt
  gRNA
acuugcucgagaugucauga

SEQ ID NO: 92195 - RNA, 20 nt, Artificial Sequence
  MKO10092195_B_Hprt
  gRNA
gaugaucucucaacuuuaac

SEQ ID NO: 92196 - RNA, 20 nt, Artificial Sequence
  MKO10092196_B_Hps1
  gRNA
ccaucaacgccagccccgag

SEQ ID NO: 92197 - RNA, 20 nt, Artificial Sequence
  MKO10092197_B_Hps1
  gRNA
caggcuucguccacccgacc

SEQ ID NO: 92198 - RNA, 20 nt, Artificial Sequence
  MKO10092198_B_Hps1
  gRNA
ccuacagcuaccugcgggac

SEQ ID NO: 92199 - RNA, 20 nt, Artificial Sequence
  MKO10092199_B_Hps3
  gRNA
uguuaucugucuaaaaccca

SEQ ID NO: 92200 - RNA, 20 nt, Artificial Sequence
  MKO10092200_B_Hps3
  gRNA
auacuuaccacuuuggugaa

SEQ ID NO: 92201 - RNA, 20 nt, Artificial Sequence
  MKO10092201_B_Hps3
  gRNA
ucuguuaaacuggaguccac

SEQ ID NO: 92202 - RNA, 20 nt, Artificial Sequence
  MKO10092202_B_Hps4
  gRNA
gccuuacuuuggugcggucc

SEQ ID NO: 92203 - RNA, 20 nt, Artificial Sequence
  MKO10092203_B_Hps4
  gRNA
caaacuugagguuccgcaua

SEQ ID NO: 92204 - RNA, 20 nt, Artificial Sequence
  MKO10092204_B_Hps4
  gRNA
gcacucuuaccuuguaggcc

SEQ ID NO: 92205 - RNA, 20 nt, Artificial Sequence
  MKO10092205_B_Hps5
  gRNA
gucaaggucuuguaguuguu

SEQ ID NO: 92206 - RNA, 20 nt, Artificial Sequence
  MKO10092206_B_Hps5
  gRNA
cuguaggcuucugguaucac

SEQ ID NO: 92207 - RNA, 20 nt, Artificial Sequence
  MKO10092207_B_Hps5
  gRNA
auuauguugcuguagcuacc

SEQ ID NO: 92208 - RNA, 20 nt, Artificial Sequence
  MKO10092208_B_Hps6
  gRNA
caacccgaggccgccuaguu

SEQ ID NO: 92209 - RNA, 20 nt, Artificial Sequence
  MKO10092209_B_Hps6
  gRNA
cgaggggucgcccuccggcc

SEQ ID NO: 92210 - RNA, 20 nt, Artificial Sequence
  MKO10092210_B_Hps6
  gRNA
gcugcaccgagcccuugucc

SEQ ID NO: 92211 - RNA, 20 nt, Artificial Sequence
  MKO10092211_B_Hpse2
  gRNA
aacgucauugcucuccuaga

SEQ ID NO: 92212 - RNA, 20 nt, Artificial Sequence
  MKO10092212_B_Hpse2
  gRNA
uccuauuaccuguuaauaug

SEQ ID NO: 92213 - RNA, 20 nt, Artificial Sequence
  MKO10092213_B_Hpse2
  gRNA
uuugcccccgaagcgcagaa

SEQ ID NO: 92214 - RNA, 20 nt, Artificial Sequence
  MKO10092214_B_Hpse
  gRNA
ccugacaucggucagccucg

SEQ ID NO: 92215 - RNA, 20 nt, Artificial Sequence
  MKO10092215_B_Hpse
  gRNA
aaagcucacauucucaucga

SEQ ID NO: 92216 - RNA, 20 nt, Artificial Sequence
  MKO10092216_B_Hpse
  gRNA
ccgccaaaucucaaguaugc

SEQ ID NO: 92217 - RNA, 20 nt, Artificial Sequence
  MKO10092217_B_Hpx
  gRNA
accucgcugagaucaacucc

SEQ ID NO: 92218 - RNA, 20 nt, Artificial Sequence
  MKO10092218_B_Hpx
  gRNA
ucaccggguacaucugaauc

SEQ ID NO: 92219 - RNA, 20 nt, Artificial Sequence
  MKO10092219_B_Hpx
  gRNA
auacccaccagacgcagcug

SEQ ID NO: 92220 - RNA, 20 nt, Artificial Sequence
  MKO10092220_B_Hp
  gRNA
acauagccguuugcaaucuc

SEQ ID NO: 92221 - RNA, 20 nt, Artificial Sequence
  MKO10092221_B_Hp
  gRNA
ccuuaaacgacgagaagcaa

SEQ ID NO: 92222 - RNA, 20 nt, Artificial Sequence
  MKO10092222_B_Hp
  gRNA
gccgacaguucuacagacua

SEQ ID NO: 92223 - RNA, 20 nt, Artificial Sequence
  MKO10092223_B_Hrasls5
  gRNA
ggauacgcaccucaacugcu

SEQ ID NO: 92224 - RNA, 20 nt, Artificial Sequence
  MKO10092224_B_Hrasls5
  gRNA
gcucacaguuccccucaauu

SEQ ID NO: 92225 - RNA, 20 nt, Artificial Sequence
  MKO10092225_B_Hrasls5
  gRNA
caauucgaaaaaucucaauc

SEQ ID NO: 92226 - RNA, 20 nt, Artificial Sequence
  MKO10092226_B_Hrasls
  gRNA
uuuguaaccuugcugcgcua

SEQ ID NO: 92227 - RNA, 20 nt, Artificial Sequence
  MKO10092227_B_Hrasls
  gRNA
uccguccuugcuaucagcac

SEQ ID NO: 92228 - RNA, 20 nt, Artificial Sequence
  MKO10092228_B_Hrasls
  gRNA
accaucggauugguggcagc

SEQ ID NO: 92229 - RNA, 20 nt, Artificial Sequence
  MKO10092229_B_Hras
  gRNA
cucacggacuaguguauaga

SEQ ID NO: 92230 - RNA, 20 nt, Artificial Sequence
  MKO10092230_B_Hras
  gRNA
gcagagcucaccucuauagu

SEQ ID NO: 92231 - RNA, 20 nt, Artificial Sequence
  MKO10092231_B_Hras
  gRNA
caucaaugaccaccuguuuc

SEQ ID NO: 92232 - RNA, 20 nt, Artificial Sequence
  MKO10092232_B_Hrcu1
  gRNA
ucaccccggucacaugguga

SEQ ID NO: 92233 - RNA, 20 nt, Artificial Sequence
  MKO10092233_B_Hrcu1
  gRNA
agcggcgggcuccaugagca

SEQ ID NO: 92234 - RNA, 20 nt, Artificial Sequence
  MKO10092234_B_Hrcu1
  gRNA
cuuccagauguuaggccuuc

SEQ ID NO: 92235 - RNA, 20 nt, Artificial Sequence
  MKO10092235_B_Hrc
  gRNA
ggaacacugugaccaguguc

SEQ ID NO: 92236 - RNA, 20 nt, Artificial Sequence
  MKO10092236_B_Hrc
  gRNA
acacacuuacugauacagag

SEQ ID NO: 92237 - RNA, 20 nt, Artificial Sequence
  MKO10092237_B_Hrc
  gRNA
acagugacagcuuucacauu

SEQ ID NO: 92238 - RNA, 20 nt, Artificial Sequence
  MKO10092238_B_Hrg
  gRNA
aaagcaagcccguaaagccc

SEQ ID NO: 92239 - RNA, 20 nt, Artificial Sequence
  MKO10092239_B_Hrg
  gRNA
gaugaccuuaccagaacuug

SEQ ID NO: 92240 - RNA, 20 nt, Artificial Sequence
  MKO10092240_B_Hrg
  gRNA
augugauagagucugacugu

SEQ ID NO: 92241 - RNA, 20 nt, Artificial Sequence
  MKO10092241_B_Hrh1
  gRNA
gcacuugaaccgagagcgga

SEQ ID NO: 92242 - RNA, 20 nt, Artificial Sequence
  MKO10092242_B_Hrh1
  gRNA
cuggcaucacuucacgcccc

SEQ ID NO: 92243 - RNA, 20 nt, Artificial Sequence
  MKO10092243_B_Hrh1
  gRNA
agcgguagcgaucaauacac

SEQ ID NO: 92244 - RNA, 20 nt, Artificial Sequence
  MKO10092244_B_Hrh2
  gRNA
uaagcacugauauguaguga

SEQ ID NO: 92245 - RNA, 20 nt, Artificial Sequence
  MKO10092245_B_Hrh2
  gRNA
gcgaacaggggugaccaaca

SEQ ID NO: 92246 - RNA, 20 nt, Artificial Sequence
  MKO10092246_B_Hrh2
  gRNA
agagcuguugguacgccaug

SEQ ID NO: 92247 - RNA, 20 nt, Artificial Sequence
  MKO10092247_B_Hrh3
  gRNA
gaggcucgaauccgccacga

SEQ ID NO: 92248 - RNA, 20 nt, Artificial Sequence
  MKO10092248_B_Hrh3
  gRNA
uauguacccuaugugcugac

SEQ ID NO: 92249 - RNA, 20 nt, Artificial Sequence
  MKO10092249_B_Hrh3
  gRNA
cagcacgauguugaagacug

SEQ ID NO: 92250 - RNA, 20 nt, Artificial Sequence
  MKO10092250_B_Hrh4
  gRNA
aauaauuacuucgaugucua

SEQ ID NO: 92251 - RNA, 20 nt, Artificial Sequence
  MKO10092251_B_Hrh4
  gRNA
uuccaguuaaacaacacgug

SEQ ID NO: 92252 - RNA, 20 nt, Artificial Sequence
  MKO10092252_B_Hrh4
  gRNA
gaaguggaaucugcauguuu

SEQ ID NO: 92253 - RNA, 20 nt, Artificial Sequence
  MKO10092253_B_Hrk
  gRNA
cggcgcaggugaccgcgcug

SEQ ID NO: 92254 - RNA, 20 nt, Artificial Sequence
  MKO10092254_B_Hrk
  gRNA
gggccgcgcgcgacgccgca

SEQ ID NO: 92255 - RNA, 20 nt, Artificial Sequence
  MKO10092255_B_Hrk
  gRNA
acgcucgccccgggcugcgc

SEQ ID NO: 92256 - RNA, 20 nt, Artificial Sequence
  MKO10092256_B_Hrnr
  gRNA
uguucccaacacgauguuuc

SEQ ID NO: 92257 - RNA, 20 nt, Artificial Sequence
  MKO10092257_B_Hrnr
  gRNA
uaccaguaugccacugaaua

SEQ ID NO: 92258 - RNA, 20 nt, Artificial Sequence
  MKO10092258_B_Hrnr
  gRNA
gucacaguucccauauucag

SEQ ID NO: 92259 - RNA, 20 nt, Artificial Sequence
  MKO10092259_B_Hrsp12
  gRNA
uuucagucaagcugugcaag

SEQ ID NO: 92260 - RNA, 20 nt, Artificial Sequence
  MKO10092260_B_Hrsp12
  gRNA
uucacaggcucuuaaaaacu

SEQ ID NO: 92261 - RNA, 20 nt, Artificial Sequence
  MKO10092261_B_Hrsp12
  gRNA
uccaggguagccuuccugcc

SEQ ID NO: 92262 - RNA, 20 nt, Artificial Sequence
  MKO10092262_B_Hr
  gRNA
uauccacaagucuggacucc

SEQ ID NO: 92263 - RNA, 20 nt, Artificial Sequence
  MKO10092263_B_Hr
  gRNA
uggcaucgacugcagcaaug

SEQ ID NO: 92264 - RNA, 20 nt, Artificial Sequence
  MKO10092264_B_Hr
  gRNA
acacucaccuacgugauuuc

SEQ ID NO: 92265 - RNA, 20 nt, Artificial Sequence
  MKO10092265_B_Hs1bp3
  gRNA
gagcugaagagccccgcguc

SEQ ID NO: 92266 - RNA, 20 nt, Artificial Sequence
  MKO10092266_B_Hs1bp3
  gRNA
cgaagaugucguccaguucu

SEQ ID NO: 92267 - RNA, 20 nt, Artificial Sequence
  MKO10092267_B_Hs1bp3
  gRNA
cuaggaucugguacuccaca

SEQ ID NO: 92268 - RNA, 20 nt, Artificial Sequence
  MKO10092268_B_Hs2st1
  gRNA
augaagccaggcuucuauca

SEQ ID NO: 92269 - RNA, 20 nt, Artificial Sequence
  MKO10092269_B_Hs2st1
  gRNA
auguguccgugauagaagcc

SEQ ID NO: 92270 - RNA, 20 nt, Artificial Sequence
  MKO10092270_B_Hs2st1
  gRNA
uaggaaacuagccucucaau

SEQ ID NO: 92271 - RNA, 20 nt, Artificial Sequence
  MKO10092271_B_Hs3st1
  gRNA
accuccuaaugcgggacggu

SEQ ID NO: 92272 - RNA, 20 nt, Artificial Sequence
  MKO10092272_B_Hs3st1
  gRNA
cgugcuguccgacuacaccc

SEQ ID NO: 92273 - RNA, 20 nt, Artificial Sequence
  MKO10092273_B_Hs3st1
  gRNA
cuugcgcaccccaaugauga

SEQ ID NO: 92274 - RNA, 20 nt, Artificial Sequence
  MKO10092274_B_Hs3st2
  gRNA
gacugcgguugcggaaggac

SEQ ID NO: 92275 - RNA, 20 nt, Artificial Sequence
  MKO10092275_B_Hs3st2
  gRNA
gcucacugggcgucggcccc

SEQ ID NO: 92276 - RNA, 20 nt, Artificial Sequence
  MKO10092276_B_Hs3st2
  gRNA
gccgcucuccacugacgaag

SEQ ID NO: 92277 - RNA, 20 nt, Artificial Sequence
  MKO10092277_B_Hs3st3a1
  gRNA
gcgcucaccccaccauugcg

SEQ ID NO: 92278 - RNA, 20 nt, Artificial Sequence
  MKO10092278_B_Hs3st3a1
  gRNA
ccucuacgucuucuacugcc

SEQ ID NO: 92279 - RNA, 20 nt, Artificial Sequence
  MKO10092279_B_Hs3st3a1
  gRNA
gaacuggcgauguggcccgc

SEQ ID NO: 92280 - RNA, 20 nt, Artificial Sequence
  MKO10092280_B_Hs3st3b1
  gRNA
cuggcugagcgugaguagcg

SEQ ID NO: 92281 - RNA, 20 nt, Artificial Sequence
  MKO10092281_B_Hs3st3b1
  gRNA
ccgguccugucucgaugucc

SEQ ID NO: 92282 - RNA, 20 nt, Artificial Sequence
  MKO10092282_B_Hs3st3b1
  gRNA
ccgcagcaccucgcgcgcga

SEQ ID NO: 92283 - RNA, 20 nt, Artificial Sequence
  MKO10092283_B_Hs3st4
  gRNA
ucuuggagcgccauucgcau

SEQ ID NO: 92284 - RNA, 20 nt, Artificial Sequence
  MKO10092284_B_Hs3st4
  gRNA
ggguucgcugcaguucccgc

SEQ ID NO: 92285 - RNA, 20 nt, Artificial Sequence
  MKO10092285_B_Hs3st4
  gRNA
cgcaggagucgugaagcgcu

SEQ ID NO: 92286 - RNA, 20 nt, Artificial Sequence
  MKO10092286_B_Hs3st5
  gRNA
ggccaugcuauucaaacagc

SEQ ID NO: 92287 - RNA, 20 nt, Artificial Sequence
  MKO10092287_B_Hs3st5
  gRNA
gaacaguuucauaucguaga

SEQ ID NO: 92288 - RNA, 20 nt, Artificial Sequence
  MKO10092288_B_Hs3st5
  gRNA
ugcccuguugaaagucgauu

SEQ ID NO: 92289 - RNA, 20 nt, Artificial Sequence
  MKO10092289_B_Hs3st6
  gRNA
cgccuggucagugauccagc

SEQ ID NO: 92290 - RNA, 20 nt, Artificial Sequence
  MKO10092290_B_Hs3st6
  gRNA
auggccgguagaaagccugc

SEQ ID NO: 92291 - RNA, 20 nt, Artificial Sequence
  MKO10092291_B_Hs3st6
  gRNA
caccccgacguccgugcacu

SEQ ID NO: 92292 - RNA, 20 nt, Artificial Sequence
  MKO10092292_B_Hs6st1
  gRNA
cuggucgggcugcacguugc

SEQ ID NO: 92293 - RNA, 20 nt, Artificial Sequence
  MKO10092293_B_Hs6st1
  gRNA
cuagaccgccgcgacccagc

SEQ ID NO: 92294 - RNA, 20 nt, Artificial Sequence
  MKO10092294_B_Hs6st1
  gRNA
agugcagaacgugcgccucg

SEQ ID NO: 92295 - RNA, 20 nt, Artificial Sequence
  MKO10092295_B_Hs6st2
  gRNA
uugcuccugacgcuuccgcc

SEQ ID NO: 92296 - RNA, 20 nt, Artificial Sequence
  MKO10092296_B_Hs6st2
  gRNA
ucccacucuucgaugugcuc

SEQ ID NO: 92297 - RNA, 20 nt, Artificial Sequence
  MKO10092297_B_Hs6st2
  gRNA
gguucuucaaacuucaacuc

SEQ ID NO: 92298 - RNA, 20 nt, Artificial Sequence
  MKO10092298_B_Hs6st3
  gRNA
gcggagcugcuccccgaagu

SEQ ID NO: 92299 - RNA, 20 nt, Artificial Sequence
  MKO10092299_B_Hs6st3
  gRNA
caccacguucggccggcacc

SEQ ID NO: 92300 - RNA, 20 nt, Artificial Sequence
  MKO10092300_B_Hs6st3
  gRNA
ggucgcggcucccgaggaug

SEQ ID NO: 92301 - RNA, 20 nt, Artificial Sequence
  MKO10092301_B_Hsbp1l1
  gRNA
uuaauguuguagucagagcu

SEQ ID NO: 92302 - RNA, 20 nt, Artificial Sequence
  MKO10092302_B_Hsbp1l1
  gRNA
augaccucaugacucaggcc

SEQ ID NO: 92303 - RNA, 20 nt, Artificial Sequence
  MKO10092303_B_Hsbp1l1
  gRNA
guucugcagcaaguccccac

SEQ ID NO: 92304 - RNA, 20 nt, Artificial Sequence
  MKO10092304_B_Hsbp1
  gRNA
gaccaugcaggacaucaccu

SEQ ID NO: 92305 - RNA, 20 nt, Artificial Sequence
  MKO10092305_B_Hsbp1
  gRNA
ggucagcgauauucuucucc

SEQ ID NO: 92306 - RNA, 20 nt, Artificial Sequence
  MKO10092306_B_Hsbp1
  gRNA
uaucgcugaccucaugaccc

SEQ ID NO: 92307 - RNA, 20 nt, Artificial Sequence
  MKO10092307_B_Hscb
  gRNA
cuuccauggcggccucacuu

SEQ ID NO: 92308 - RNA, 20 nt, Artificial Sequence
  MKO10092308_B_Hscb
  gRNA
ugaugccuauaagacucuuc

SEQ ID NO: 92309 - RNA, 20 nt, Artificial Sequence
  MKO10092309_B_Hscb
  gRNA
ccuuacaagauauaguccuc

SEQ ID NO: 92310 - RNA, 20 nt, Artificial Sequence
  MKO10092310_B_Hsd11b1
  gRNA
uugacugccaggucggagga

SEQ ID NO: 92311 - RNA, 20 nt, Artificial Sequence
  MKO10092311_B_Hsd11b1
  gRNA
ugucaaggcgggaaagcuca

SEQ ID NO: 92312 - RNA, 20 nt, Artificial Sequence
  MKO10092312_B_Hsd11b1
  gRNA
cucugcaagcaaguuugcuc

SEQ ID NO: 92313 - RNA, 20 nt, Artificial Sequence
  MKO10092313_B_Hsd11b2
  gRNA
ccuggguaguagcggcuucg

SEQ ID NO: 92314 - RNA, 20 nt, Artificial Sequence
  MKO10092314_B_Hsd11b2
  gRNA
ugccaugggcuucacggugc

SEQ ID NO: 92315 - RNA, 20 nt, Artificial Sequence
  MKO10092315_B_Hsd11b2
  gRNA
ggcagcaauagcacugcuua

SEQ ID NO: 92316 - RNA, 20 nt, Artificial Sequence
  MKO10092316_B_Hsd17b10
  gRNA
ccuagcuacggccaaaagac

SEQ ID NO: 92317 - RNA, 20 nt, Artificial Sequence
  MKO10092317_B_Hsd17b10
  gRNA
cguagcuaggccaaggcccg

SEQ ID NO: 92318 - RNA, 20 nt, Artificial Sequence
  MKO10092318_B_Hsd17b10
  gRNA
caugcccacuaugcccccuu

SEQ ID NO: 92319 - RNA, 20 nt, Artificial Sequence
  MKO10092319_B_Hsd17b11
  gRNA
ucgcacuccuguucguccca

SEQ ID NO: 92320 - RNA, 20 nt, Artificial Sequence
  MKO10092320_B_Hsd17b11
  gRNA
agcauucugguaaauaacgc

SEQ ID NO: 92321 - RNA, 20 nt, Artificial Sequence
  MKO10092321_B_Hsd17b11
  gRNA
gccaacggcagcaaacuugc

SEQ ID NO: 92322 - RNA, 20 nt, Artificial Sequence
  MKO10092322_B_Hsd17b12
  gRNA
cgccaaucucaagaccagac

SEQ ID NO: 92323 - RNA, 20 nt, Artificial Sequence
  MKO10092323_B_Hsd17b12
  gRNA
uacaaacuuacugauguugu

SEQ ID NO: 92324 - RNA, 20 nt, Artificial Sequence
  MKO10092324_B_Hsd17b12
  gRNA
uguaucucaguuguuacagg

SEQ ID NO: 92325 - RNA, 20 nt, Artificial Sequence
  MKO10092325_B_Hsd17b13
  gRNA
cagccugccuauuccguguc

SEQ ID NO: 92326 - RNA, 20 nt, Artificial Sequence
  MKO10092326_B_Hsd17b13
  gRNA
caccacaaacacgugcacga

SEQ ID NO: 92327 - RNA, 20 nt, Artificial Sequence
  MKO10092327_B_Hsd17b13
  gRNA
gggccggacacggaauaggc

SEQ ID NO: 92328 - RNA, 20 nt, Artificial Sequence
  MKO10092328_B_Hsd17b14
  gRNA
ucuuuccugugucacgucac

SEQ ID NO: 92329 - RNA, 20 nt, Artificial Sequence
  MKO10092329_B_Hsd17b14
  gRNA
ccagaagcugacggaagccc

SEQ ID NO: 92330 - RNA, 20 nt, Artificial Sequence
  MKO10092330_B_Hsd17b14
  gRNA
ucaagguguauguccccagc

SEQ ID NO: 92331 - RNA, 20 nt, Artificial Sequence
  MKO10092331_B_Hsd17b1
  gRNA
uuaugagcaagcccugagcg

SEQ ID NO: 92332 - RNA, 20 nt, Artificial Sequence
  MKO10092332_B_Hsd17b1
  gRNA
agcacaugaauugaacgcug

SEQ ID NO: 92333 - RNA, 20 nt, Artificial Sequence
  MKO10092333_B_Hsd17b1
  gRNA
gacccucagucacgcaugcc

SEQ ID NO: 92334 - RNA, 20 nt, Artificial Sequence
  MKO10092334_B_Hsd17b2
  gRNA
ugcuggaugucccgaagcac

SEQ ID NO: 92335 - RNA, 20 nt, Artificial Sequence
  MKO10092335_B_Hsd17b2
  gRNA
aacccacgccgagagcuuua

SEQ ID NO: 92336 - RNA, 20 nt, Artificial Sequence
  MKO10092336_B_Hsd17b2
  gRNA
ucacgguuuggccaagcacc

SEQ ID NO: 92337 - RNA, 20 nt, Artificial Sequence
  MKO10092337_B_Hsd17b3
  gRNA
cgggaaagccuauucauuug

SEQ ID NO: 92338 - RNA, 20 nt, Artificial Sequence
  MKO10092338_B_Hsd17b3
  gRNA
uacaacauugaguccauguc

SEQ ID NO: 92339 - RNA, 20 nt, Artificial Sequence
  MKO10092339_B_Hsd17b3
  gRNA
ucucacgcagagaggaccac

SEQ ID NO: 92340 - RNA, 20 nt, Artificial Sequence
  MKO10092340_B_Hsd17b4
  gRNA
cuccucuuucugcaaacgcc

SEQ ID NO: 92341 - RNA, 20 nt, Artificial Sequence
  MKO10092341_B_Hsd17b4
  gRNA
gacguuguggucaacaaugc

SEQ ID NO: 92342 - RNA, 20 nt, Artificial Sequence
  MKO10092342_B_Hsd17b4
  gRNA
uucucagauucaguugaagc

SEQ ID NO: 92343 - RNA, 20 nt, Artificial Sequence
  MKO10092343_B_Hsd17b6
  gRNA
acacuucaucaacucucguu

SEQ ID NO: 92344 - RNA, 20 nt, Artificial Sequence
  MKO10092344_B_Hsd17b6
  gRNA
aucuuucaagugaaccucau

SEQ ID NO: 92345 - RNA, 20 nt, Artificial Sequence
  MKO10092345_B_Hsd17b6
  gRNA
ugccccgagccuucuuuacc

SEQ ID NO: 92346 - RNA, 20 nt, Artificial Sequence
  MKO10092346_B_Hsd17b7
  gRNA
cacugccgacggguugcagg

SEQ ID NO: 92347 - RNA, 20 nt, Artificial Sequence
  MKO10092347_B_Hsd17b7
  gRNA
cuucauucagauucgggaac

SEQ ID NO: 92348 - RNA, 20 nt, Artificial Sequence
  MKO10092348_B_Hsd17b7
  gRNA
guccucucgcaaugcaaaga

SEQ ID NO: 92349 - RNA, 20 nt, Artificial Sequence
  MKO10092349_B_Hsd3b1
  gRNA
ccaacaucuugaugauccuc

SEQ ID NO: 92350 - RNA, 20 nt, Artificial Sequence
  MKO10092350_B_Hsd3b1
  gRNA
gcugcugucauugaugucac

SEQ ID NO: 92351 - RNA, 20 nt, Artificial Sequence
  MKO10092351_B_Hsd3b1
  gRNA
caucaaugacagcagcagug

SEQ ID NO: 92352 - RNA, 20 nt, Artificial Sequence
  MKO10092352_B_Hsd3b2
  gRNA
gcagaggaucauccaguugu

SEQ ID NO: 92353 - RNA, 20 nt, Artificial Sequence
  MKO10092353_B_Hsd3b2
  gRNA
ucaccuugaugcuugucucu

SEQ ID NO: 92354 - RNA, 20 nt, Artificial Sequence
  MKO10092354_B_Hsd3b2
  gRNA
agaccuagagacaagcauca

SEQ ID NO: 92355 - RNA, 20 nt, Artificial Sequence
  MKO10092355_B_Hsd3b3
  gRNA
ucaccuugaugcuugucccu

SEQ ID NO: 92356 - RNA, 20 nt, Artificial Sequence
  MKO10092356_B_Hsd3b3
  gRNA
aggucuucaaaccugaaacc

SEQ ID NO: 92357 - RNA, 20 nt, Artificial Sequence
  MKO10092357_B_Hsd3b3
  gRNA
agaccuagggacaagcauca

SEQ ID NO: 92358 - RNA, 20 nt, Artificial Sequence
  MKO10092358_B_Hsd3b4
  gRNA
caccuuucagauugacaucu

SEQ ID NO: 92359 - RNA, 20 nt, Artificial Sequence
  MKO10092359_B_Hsd3b4
  gRNA
ggcagguacucagcuccuac

SEQ ID NO: 92360 - RNA, 20 nt, Artificial Sequence
  MKO10092360_B_Hsd3b4
  gRNA
uaguguuccgauccacucug

SEQ ID NO: 92361 - RNA, 20 nt, Artificial Sequence
  MKO10092361_B_Hsd3b5
  gRNA
cuucggucgaaaacaugaag

SEQ ID NO: 92362 - RNA, 20 nt, Artificial Sequence
  MKO10092362_B_Hsd3b5
  gRNA
cuguguugaacaugccugga

SEQ ID NO: 92363 - RNA, 20 nt, Artificial Sequence
  MKO10092363_B_Hsd3b5
  gRNA
augccugaagagagccugcc

SEQ ID NO: 92364 - RNA, 20 nt, Artificial Sequence
  MKO10092364_B_Hsd3b6
  gRNA
gcucuuccucguugccauuc

SEQ ID NO: 92365 - RNA, 20 nt, Artificial Sequence
  MKO10092365_B_Hsd3b6
  gRNA
ucaccuugauguuuguaucu

SEQ ID NO: 92366 - RNA, 20 nt, Artificial Sequence
  MKO10092366_B_Hsd3b6
  gRNA
caucaaugacagcugcagug

SEQ ID NO: 92367 - RNA, 20 nt, Artificial Sequence
  MKO10092367_B_Hsd3b7
  gRNA
ccaugcugcucguguagacc

SEQ ID NO: 92368 - RNA, 20 nt, Artificial Sequence
  MKO10092368_B_Hsd3b7
  gRNA
cacccugcacguugacuuug

SEQ ID NO: 92369 - RNA, 20 nt, Artificial Sequence
  MKO10092369_B_Hsd3b7
  gRNA
ccuggucuacacgagcagca

SEQ ID NO: 92370 - RNA, 20 nt, Artificial Sequence
  MKO10092370_B_Hsdl1
  gRNA
agcacauagccgacaccuac

SEQ ID NO: 92371 - RNA, 20 nt, Artificial Sequence
  MKO10092371_B_Hsdl1
  gRNA
gcugcacuucaucccucgcc

SEQ ID NO: 92372 - RNA, 20 nt, Artificial Sequence
  MKO10092372_B_Hsdl1
  gRNA
ggaugggggcguaaaucucc

SEQ ID NO: 92373 - RNA, 20 nt, Artificial Sequence
  MKO10092373_B_Hsdl2
  gRNA
uuuaucacaggugcaagccg

SEQ ID NO: 92374 - RNA, 20 nt, Artificial Sequence
  MKO10092374_B_Hsdl2
  gRNA
cagugcuguuugaaccacag

SEQ ID NO: 92375 - RNA, 20 nt, Artificial Sequence
  MKO10092375_B_Hsdl2
  gRNA
cccugaaccuaaacccacug

SEQ ID NO: 92376 - RNA, 20 nt, Artificial Sequence
  MKO10092376_B_Hsf1
  gRNA
gcagcgagaacgaggcccug

SEQ ID NO: 92377 - RNA, 20 nt, Artificial Sequence
  MKO10092377_B_Hsf1
  gRNA
uacgccaggacagugucacc

SEQ ID NO: 92378 - RNA, 20 nt, Artificial Sequence
  MKO10092378_B_Hsf1
  gRNA
cagcauccuuguuucuugcg

SEQ ID NO: 92379 - RNA, 20 nt, Artificial Sequence
  MKO10092379_B_Hsf2bp
  gRNA
cgacggaagugaugcaaaua

SEQ ID NO: 92380 - RNA, 20 nt, Artificial Sequence
  MKO10092380_B_Hsf2bp
  gRNA
accgugaacacuucaaagcc

SEQ ID NO: 92381 - RNA, 20 nt, Artificial Sequence
  MKO10092381_B_Hsf2bp
  gRNA
ucacaaaacucuccaucguc

SEQ ID NO: 92382 - RNA, 20 nt, Artificial Sequence
  MKO10092382_B_Hsf2
  gRNA
aauuauuaguagugcucaga

SEQ ID NO: 92383 - RNA, 20 nt, Artificial Sequence
  MKO10092383_B_Hsf2
  gRNA
cagcauccuuauuucaagca

SEQ ID NO: 92384 - RNA, 20 nt, Artificial Sequence
  MKO10092384_B_Hsf2
  gRNA
aacaagaaacuauugagucc

SEQ ID NO: 92385 - RNA, 20 nt, Artificial Sequence
  MKO10092385_B_Hsf3
  gRNA
gugcacaguacuucuuucuu

SEQ ID NO: 92386 - RNA, 20 nt, Artificial Sequence
  MKO10092386_B_Hsf3
  gRNA
accauacaguacuaaaaaag

SEQ ID NO: 92387 - RNA, 20 nt, Artificial Sequence
  MKO10092387_B_Hsf3
  gRNA
ucaucaaauccaagauaaaa

SEQ ID NO: 92388 - RNA, 20 nt, Artificial Sequence
  MKO10092388_B_Hsf4
  gRNA
cgcgcuccaguagcugcucg

SEQ ID NO: 92389 - RNA, 20 nt, Artificial Sequence
  MKO10092389_B_Hsf4
  gRNA
gcaccgaccaccucauccgc

SEQ ID NO: 92390 - RNA, 20 nt, Artificial Sequence
  MKO10092390_B_Hsf4
  gRNA
ggcaagcuaugggcgcuggu

SEQ ID NO: 92391 - RNA, 20 nt, Artificial Sequence
  MKO10092391_B_Hsf5
  gRNA
gcuaccauucagcacaccgc

SEQ ID NO: 92392 - RNA, 20 nt, Artificial Sequence
  MKO10092392_B_Hsf5
  gRNA
cuucgcucucuguaucuagc

SEQ ID NO: 92393 - RNA, 20 nt, Artificial Sequence
  MKO10092393_B_Hsf5
  gRNA
caacccaucuuccaccaguc

SEQ ID NO: 92394 - RNA, 20 nt, Artificial Sequence
  MKO10092394_B_Hsfy2
  gRNA
gaacccccuugagcaagaga

SEQ ID NO: 92395 - RNA, 20 nt, Artificial Sequence
  MKO10092395_B_Hsfy2
  gRNA
gaaacagccugcauuuccga

SEQ ID NO: 92396 - RNA, 20 nt, Artificial Sequence
  MKO10092396_B_Hsfy2
  gRNA
cucagcgauucuugauaaag

SEQ ID NO: 92397 - RNA, 20 nt, Artificial Sequence
  MKO10092397_B_Hsh2d
  gRNA
caacugaaugcucgagucac

SEQ ID NO: 92398 - RNA, 20 nt, Artificial Sequence
  MKO10092398_B_Hsh2d
  gRNA
ccuuaccaccuuuccacgcc

SEQ ID NO: 92399 - RNA, 20 nt, Artificial Sequence
  MKO10092399_B_Hsh2d
  gRNA
cauggccuuacuuguaggaa

SEQ ID NO: 92400 - RNA, 20 nt, Artificial Sequence
  MKO10092400_B_Hsp90aa1
  gRNA
cuuccccgaguccaguuuac

SEQ ID NO: 92401 - RNA, 20 nt, Artificial Sequence
  MKO10092401_B_Hsp90aa1
  gRNA
gguggagaaggaacgagaua

SEQ ID NO: 92402 - RNA, 20 nt, Artificial Sequence
  MKO10092402_B_Hsp90aa1
  gRNA
aauccguuacgagagccuga

SEQ ID NO: 92403 - RNA, 20 nt, Artificial Sequence
  MKO10092403_B_Hsp90ab1
  gRNA
gauucgauaugagagccuga

SEQ ID NO: 92404 - RNA, 20 nt, Artificial Sequence
  MKO10092404_B_Hsp90ab1
  gRNA
uucucuguaggugagcccau

SEQ ID NO: 92405 - RNA, 20 nt, Artificial Sequence
  MKO10092405_B_Hsp90ab1
  gRNA
uucucaccuugacugccaag

SEQ ID NO: 92406 - RNA, 20 nt, Artificial Sequence
  MKO10092406_B_Hsp90b1
  gRNA
acugaugaaaaugcacucgc

SEQ ID NO: 92407 - RNA, 20 nt, Artificial Sequence
  MKO10092407_B_Hsp90b1
  gRNA
ggaguuaacggucaagauua

SEQ ID NO: 92408 - RNA, 20 nt, Artificial Sequence
  MKO10092408_B_Hsp90b1
  gRNA
ccuuccaagcugaagugaac

SEQ ID NO: 92409 - RNA, 20 nt, Artificial Sequence
  MKO10092409_B_Hspa12a
  gRNA
cagaauguauccacgugaug

SEQ ID NO: 92410 - RNA, 20 nt, Artificial Sequence
  MKO10092410_B_Hspa12a
  gRNA
uggcagcguacccaaagcug

SEQ ID NO: 92411 - RNA, 20 nt, Artificial Sequence
  MKO10092411_B_Hspa12a
  gRNA
uuucuuaccaagauauggga

SEQ ID NO: 92412 - RNA, 20 nt, Artificial Sequence
  MKO10092412_B_Hspa12b
  gRNA
gagcgauaccacagcuuucc

SEQ ID NO: 92413 - RNA, 20 nt, Artificial Sequence
  MKO10092413_B_Hspa12b
  gRNA
gggcgugcuccuugaagaaa

SEQ ID NO: 92414 - RNA, 20 nt, Artificial Sequence
  MKO10092414_B_Hspa12b
  gRNA
cuacaggcucuagcccagag

SEQ ID NO: 92415 - RNA, 20 nt, Artificial Sequence
  MKO10092415_B_Hspa13
  gRNA
cgaggaauaccucggcaugc

SEQ ID NO: 92416 - RNA, 20 nt, Artificial Sequence
  MKO10092416_B_Hspa13
  gRNA
aaucgagagccgacaaacuc

SEQ ID NO: 92417 - RNA, 20 nt, Artificial Sequence
  MKO10092417_B_Hspa13
  gRNA
gugccaaguagcccgccaag

SEQ ID NO: 92418 - RNA, 20 nt, Artificial Sequence
  MKO10092418_B_Hspa14
  gRNA
uuaugccauaccuucugcca

SEQ ID NO: 92419 - RNA, 20 nt, Artificial Sequence
  MKO10092419_B_Hspa14
  gRNA
gugaaagugaaacagauccu

SEQ ID NO: 92420 - RNA, 20 nt, Artificial Sequence
  MKO10092420_B_Hspa14
  gRNA
cugauauucaguaaaaugaa

SEQ ID NO: 92421 - RNA, 20 nt, Artificial Sequence
  MKO10092421_B_Hspa1a
  gRNA
ucaguucgaagcgccccagc

SEQ ID NO: 92422 - RNA, 20 nt, Artificial Sequence
  MKO10092422_B_Hspa1a
  gRNA
caggggcgugccacagaucg

SEQ ID NO: 92423 - RNA, 20 nt, Artificial Sequence
  MKO10092423_B_Hspa1a
  gRNA
cccaagggagccucuggcuc

SEQ ID NO: 92424 - RNA, 20 nt, Artificial Sequence
  MKO10092424_B_Hspa1b
  gRNA
ggcugcgcacggcgugugag

SEQ ID NO: 92425 - RNA, 20 nt, Artificial Sequence
  MKO10092425_B_Hspa1b
  gRNA
ucagcucgaagcgccccagc

SEQ ID NO: 92426 - RNA, 20 nt, Artificial Sequence
  MKO10092426_B_Hspa1b
  gRNA
ggacgccgccaagaaccagg

SEQ ID NO: 92427 - RNA, 20 nt, Artificial Sequence
  MKO10092427_B_Hspa1l
  gRNA
uauccugaacgucacggcca

SEQ ID NO: 92428 - RNA, 20 nt, Artificial Sequence
  MKO10092428_B_Hspa1l
  gRNA
acuuccuuuauccaagccgu

SEQ ID NO: 92429 - RNA, 20 nt, Artificial Sequence
  MKO10092429_B_Hspa1l
  gRNA
uccguaggcgacugccucau

SEQ ID NO: 92430 - RNA, 20 nt, Artificial Sequence
  MKO10092430_B_Hspa2
  gRNA
ccggcgcacagcgcgcuugu

SEQ ID NO: 92431 - RNA, 20 nt, Artificial Sequence
  MKO10092431_B_Hspa2
  gRNA
cccaggucgaugccgauagc

SEQ ID NO: 92432 - RNA, 20 nt, Artificial Sequence
  MKO10092432_B_Hspa2
  gRNA
ugaugaugcgcaacacguug

SEQ ID NO: 92433 - RNA, 20 nt, Artificial Sequence
  MKO10092433_B_Hspa4l
  gRNA
ugaugaccccauugugcaaa

SEQ ID NO: 92434 - RNA, 20 nt, Artificial Sequence
  MKO10092434_B_Hspa4l
  gRNA
gauccucuccguuugcacaa

SEQ ID NO: 92435 - RNA, 20 nt, Artificial Sequence
  MKO10092435_B_Hspa4l
  gRNA
ucuggaucccaaagauauac

SEQ ID NO: 92436 - RNA, 20 nt, Artificial Sequence
  MKO10092436_B_Hspa4
  gRNA
uuuguugcagguuacauaua

SEQ ID NO: 92437 - RNA, 20 nt, Artificial Sequence
  MKO10092437_B_Hspa4
  gRNA
auugagaccagcaaucugug

SEQ ID NO: 92438 - RNA, 20 nt, Artificial Sequence
  MKO10092438_B_Hspa4
  gRNA
gagacaacacagucuaccac

SEQ ID NO: 92439 - RNA, 20 nt, Artificial Sequence
  MKO10092439_B_Hspa5
  gRNA
gaacauccuuguguuugacc

SEQ ID NO: 92440 - RNA, 20 nt, Artificial Sequence
  MKO10092440_B_Hspa5
  gRNA
uugcuggacugaaugucaug

SEQ ID NO: 92441 - RNA, 20 nt, Artificial Sequence
  MKO10092441_B_Hspa5
  gRNA
cgacaagcaaccaaagaugc

SEQ ID NO: 92442 - RNA, 20 nt, Artificial Sequence
  MKO10092442_B_Hspa8
  gRNA
uauguauuuaccugcaccau

SEQ ID NO: 92443 - RNA, 20 nt, Artificial Sequence
  MKO10092443_B_Hspa8
  gRNA
acagaugccaaacgucugau

SEQ ID NO: 92444 - RNA, 20 nt, Artificial Sequence
  MKO10092444_B_Hspa8
  gRNA
cauaccugaaugaguacacc

SEQ ID NO: 92445 - RNA, 20 nt, Artificial Sequence
  MKO10092445_B_Hspa9
  gRNA
acaaaugcuccaaucugacu

SEQ ID NO: 92446 - RNA, 20 nt, Artificial Sequence
  MKO10092446_B_Hspa9
  gRNA
uuacagaucagaagcaauca

SEQ ID NO: 92447 - RNA, 20 nt, Artificial Sequence
  MKO10092447_B_Hspa9
  gRNA
uccccccaggauggcuggaa

SEQ ID NO: 92448 - RNA, 20 nt, Artificial Sequence
  MKO10092448_B_Hspb11
  gRNA
uuugagcaguggguugaaaa

SEQ ID NO: 92449 - RNA, 20 nt, Artificial Sequence
  MKO10092449_B_Hspb11
  gRNA
uuuagauuuaguacacacag

SEQ ID NO: 92450 - RNA, 20 nt, Artificial Sequence
  MKO10092450_B_Hspb11
  gRNA
ugugcacagcauuucugcag

SEQ ID NO: 92451 - RNA, 20 nt, Artificial Sequence
  MKO10092451_B_Hspb1
  gRNA
ccacaggcaagcacgaagaa

SEQ ID NO: 92452 - RNA, 20 nt, Artificial Sequence
  MKO10092452_B_Hspb1
  gRNA
gaucuccaccacgccuuccu

SEQ ID NO: 92453 - RNA, 20 nt, Artificial Sequence
  MKO10092453_B_Hspb1
  gRNA
gcgugcccuucucgcugcug

SEQ ID NO: 92454 - RNA, 20 nt, Artificial Sequence
  MKO10092454_B_Hspb2
  gRNA
cgaagcgcugcucgcccaga

SEQ ID NO: 92455 - RNA, 20 nt, Artificial Sequence
  MKO10092455_B_Hspb2
  gRNA
cccgcggcgccuccaaguua

SEQ ID NO: 92456 - RNA, 20 nt, Artificial Sequence
  MKO10092456_B_Hspb2
  gRNA
gaacauaguagccgugauag

SEQ ID NO: 92457 - RNA, 20 nt, Artificial Sequence
  MKO10092457_B_Hspb3
  gRNA
agagaccccagugcguuauc

SEQ ID NO: 92458 - RNA, 20 nt, Artificial Sequence
  MKO10092458_B_Hspb3
  gRNA
cauacacuauacgcacugcc

SEQ ID NO: 92459 - RNA, 20 nt, Artificial Sequence
  MKO10092459_B_Hspb3
  gRNA
aacuccuccugauaacgcac

SEQ ID NO: 92460 - RNA, 20 nt, Artificial Sequence
  MKO10092460_B_Hspb6
  gRNA
ggcgcuccucgugccgagca

SEQ ID NO: 92461 - RNA, 20 nt, Artificial Sequence
  MKO10092461_B_Hspb6
  gRNA
cgccgauaccgccugccucc

SEQ ID NO: 92462 - RNA, 20 nt, Artificial Sequence
  MKO10092462_B_Hspb6
  gRNA
uggugacggaaguugggccu

SEQ ID NO: 92463 - RNA, 20 nt, Artificial Sequence
  MKO10092463_B_Hspb7
  gRNA
accauccucucgaagggccg

SEQ ID NO: 92464 - RNA, 20 nt, Artificial Sequence
  MKO10092464_B_Hspb7
  gRNA
cucccgugcccuuccagccc

SEQ ID NO: 92465 - RNA, 20 nt, Artificial Sequence
  MKO10092465_B_Hspb7
  gRNA
gaagcuucucuccgcucuga

SEQ ID NO: 92466 - RNA, 20 nt, Artificial Sequence
  MKO10092466_B_Hspb8
  gRNA
gccugcgccgagaccccuuu

SEQ ID NO: 92467 - RNA, 20 nt, Artificial Sequence
  MKO10092467_B_Hspb8
  gRNA
caaacaugaagagaagcagc

SEQ ID NO: 92468 - RNA, 20 nt, Artificial Sequence
  MKO10092468_B_Hspb8
  gRNA
accgcucuccucccgccuuc

SEQ ID NO: 92469 - RNA, 20 nt, Artificial Sequence
  MKO10092469_B_Hspb9
  gRNA
uggggagcccucgcgcccuc

SEQ ID NO: 92470 - RNA, 20 nt, Artificial Sequence
  MKO10092470_B_Hspb9
  gRNA
ccacuugauuccguucagca

SEQ ID NO: 92471 - RNA, 20 nt, Artificial Sequence
  MKO10092471_B_Hspb9
  gRNA
aucugacggugaccggccag

SEQ ID NO: 92472 - RNA, 20 nt, Artificial Sequence
  MKO10092472_B_Hspbap1
  gRNA
ugugaccagucuaguaucuc

SEQ ID NO: 92473 - RNA, 20 nt, Artificial Sequence
  MKO10092473_B_Hspbap1
  gRNA
ccagaaagcucgaagacaua

SEQ ID NO: 92474 - RNA, 20 nt, Artificial Sequence
  MKO10092474_B_Hspbap1
  gRNA
ggcauuaccuuccuuguacc

SEQ ID NO: 92475 - RNA, 20 nt, Artificial Sequence
  MKO10092475_B_Hspbp1
  gRNA
cauuguccauguucucgcac

SEQ ID NO: 92476 - RNA, 20 nt, Artificial Sequence
  MKO10092476_B_Hspbp1
  gRNA
uccaggucuuguccgagagc

SEQ ID NO: 92477 - RNA, 20 nt, Artificial Sequence
  MKO10092477_B_Hspbp1
  gRNA
guugcugcaguuccuccgcc

SEQ ID NO: 92478 - RNA, 20 nt, Artificial Sequence
  MKO10092478_B_Hspd1
  gRNA
cugugauuauugaacagagu

SEQ ID NO: 92479 - RNA, 20 nt, Artificial Sequence
  MKO10092479_B_Hspd1
  gRNA
guugcuacaauuucugcaaa

SEQ ID NO: 92480 - RNA, 20 nt, Artificial Sequence
  MKO10092480_B_Hspd1
  gRNA
cauuucugaugcaaugaaaa

SEQ ID NO: 92481 - RNA, 20 nt, Artificial Sequence
  MKO10092481_B_Hspe1
  gRNA
gagccugucagugugaaagu

SEQ ID NO: 92482 - RNA, 20 nt, Artificial Sequence
  MKO10092482_B_Hspe1
  gRNA
uuuagagauagugacauucu

SEQ ID NO: 92483 - RNA, 20 nt, Artificial Sequence
  MKO10092483_B_Hspe1
  gRNA
gccaccuuugguuacaguuu

SEQ ID NO: 92484 - RNA, 20 nt, Artificial Sequence
  MKO10092484_B_Hspg2
  gRNA
cacagcuggagcccgaauac

SEQ ID NO: 92485 - RNA, 20 nt, Artificial Sequence
  MKO10092485_B_Hspg2
  gRNA
cugcuggcagaugaugcauc

SEQ ID NO: 92486 - RNA, 20 nt, Artificial Sequence
  MKO10092486_B_Hspg2
  gRNA
ugaacaccacacugacaauc

SEQ ID NO: 92487 - RNA, 20 nt, Artificial Sequence
  MKO10092487_B_Hsph1
  gRNA
cccaaugaaaaaugguggcg

SEQ ID NO: 92488 - RNA, 20 nt, Artificial Sequence
  MKO10092488_B_Hsph1
  gRNA
cuuuaacuuagucagcagca

SEQ ID NO: 92489 - RNA, 20 nt, Artificial Sequence
  MKO10092489_B_Hsph1
  gRNA
uggaguugcagccaaaaacc

SEQ ID NO: 92490 - RNA, 20 nt, Artificial Sequence
  MKO10092490_B_Huauip2
  gRNA
uugaucgacucucaguguuu

SEQ ID NO: 92491 - RNA, 20 nt, Artificial Sequence
  MKO10092491_B_Huauip2
  gRNA
cagacuugagcacauaaucu

SEQ ID NO: 92492 - RNA, 20 nt, Artificial Sequence
  MKO10092492_B_Huauip2
  gRNA
caccgcuccagccuugcuuc

SEQ ID NO: 92493 - RNA, 20 nt, Artificial Sequence
  MKO10092493_B_Huausf1
  gRNA
aauacaaauguauacguguc

SEQ ID NO: 92494 - RNA, 20 nt, Artificial Sequence
  MKO10092494_B_Huausf1
  gRNA
aauucauccacugugauguc

SEQ ID NO: 92495 - RNA, 20 nt, Artificial Sequence
  MKO10092495_B_Huausf1
  gRNA
ucucccuccagacaucacag

SEQ ID NO: 92496 - RNA, 20 nt, Artificial Sequence
  MKO10092496_B_Htr1a
  gRNA
caccagcuucggaacaucgu

SEQ ID NO: 92497 - RNA, 20 nt, Artificial Sequence
  MKO10092497_B_Htr1a
  gRNA
aucguugccgccugucccga

SEQ ID NO: 92498 - RNA, 20 nt, Artificial Sequence
  MKO10092498_B_Htr1a
  gRNA
gggacaggcggcaacgauac

SEQ ID NO: 92499 - RNA, 20 nt, Artificial Sequence
  MKO10092499_B_Htr1b
  gRNA
caacgccuuuguaaucgcua

SEQ ID NO: 92500 - RNA, 20 nt, Artificial Sequence
  MKO10092500_B_Htr1b
  gRNA
ucccacaacugcagcgccga

SEQ ID NO: 92501 - RNA, 20 nt, Artificial Sequence
  MKO10092501_B_Htr1b
  gRNA
ccacaccagcacgaucauga

SEQ ID NO: 92502 - RNA, 20 nt, Artificial Sequence
  MKO10092502_B_Htr1d
  gRNA
gaagcgcuucccguagaggg

SEQ ID NO: 92503 - RNA, 20 nt, Artificial Sequence
  MKO10092503_B_Htr1d
  gRNA
ccacguauaugcggccauac

SEQ ID NO: 92504 - RNA, 20 nt, Artificial Sequence
  MKO10092504_B_Htr1d
  gRNA
cgaggagauguccgacugcc

SEQ ID NO: 92505 - RNA, 20 nt, Artificial Sequence
  MKO10092505_B_Htr1f
  gRNA
aguggcugcuuugcguucuc

SEQ ID NO: 92506 - RNA, 20 nt, Artificial Sequence
  MKO10092506_B_Htr1f
  gRNA
caccgugaaaagucccagau

SEQ ID NO: 92507 - RNA, 20 nt, Artificial Sequence
  MKO10092507_B_Htr1f
  gRNA
uccacaauuuacuccacguu

SEQ ID NO: 92508 - RNA, 20 nt, Artificial Sequence
  MKO10092508_B_Htr2a
  gRNA
gaccaguauguuucccgcaa

SEQ ID NO: 92509 - RNA, 20 nt, Artificial Sequence
  MKO10092509_B_Htr2a
  gRNA
gcacugaauguaccgugaga

SEQ ID NO: 92510 - RNA, 20 nt, Artificial Sequence
  MKO10092510_B_Htr2a
  gRNA
gguucuggauagccacguag

SEQ ID NO: 92511 - RNA, 20 nt, Artificial Sequence
  MKO10092511_B_Htr2b
  gRNA
gccaucccagucccuauuaa

SEQ ID NO: 92512 - RNA, 20 nt, Artificial Sequence
  MKO10092512_B_Htr2b
  gRNA
uugcacugauuggccugaau

SEQ ID NO: 92513 - RNA, 20 nt, Artificial Sequence
  MKO10092513_B_Htr2b
  gRNA
caguugaaaagagaacaucg

SEQ ID NO: 92514 - RNA, 20 nt, Artificial Sequence
  MKO10092514_B_Htr2c
  gRNA
cuagauauuugugccccguc

SEQ ID NO: 92515 - RNA, 20 nt, Artificial Sequence
  MKO10092515_B_Htr2c
  gRNA
aucacgacuauugaaagugc

SEQ ID NO: 92516 - RNA, 20 nt, Artificial Sequence
  MKO10092516_B_Htr2c
  gRNA
gggcaacauucucguuauca

SEQ ID NO: 92517 - RNA, 20 nt, Artificial Sequence
  MKO10092517_B_Htr3a
  gRNA
gggugcggccugugcgggac

SEQ ID NO: 92518 - RNA, 20 nt, Artificial Sequence
  MKO10092518_B_Htr3a
  gRNA
guuguagaugucaaggcuac

SEQ ID NO: 92519 - RNA, 20 nt, Artificial Sequence
  MKO10092519_B_Htr3a
  gRNA
gugacauugucgaaguccuc

SEQ ID NO: 92520 - RNA, 20 nt, Artificial Sequence
  MKO10092520_B_Htr3b
  gRNA
agaccaccuggaugggcuug

SEQ ID NO: 92521 - RNA, 20 nt, Artificial Sequence
  MKO10092521_B_Htr3b
  gRNA
aucgaacagacuagaguucc

SEQ ID NO: 92522 - RNA, 20 nt, Artificial Sequence
  MKO10092522_B_Htr3b
  gRNA
aaaaauuaaagacaagcgug

SEQ ID NO: 92523 - RNA, 20 nt, Artificial Sequence
  MKO10092523_B_Htr4
  gRNA
caugcacucaccuuaguaca

SEQ ID NO: 92524 - RNA, 20 nt, Artificial Sequence
  MKO10092524_B_Htr4
  gRNA
ucaccagcaccgaaaccagc

SEQ ID NO: 92525 - RNA, 20 nt, Artificial Sequence
  MKO10092525_B_Htr4
  gRNA
uaugaaaggguccacaauau

SEQ ID NO: 92526 - RNA, 20 nt, Artificial Sequence
  MKO10092526_B_Htr5a
  gRNA
agagcacaaacacuccgaug

SEQ ID NO: 92527 - RNA, 20 nt, Artificial Sequence
  MKO10092527_B_Htr5a
  gRNA
caauagcucuggaccgcuac

SEQ ID NO: 92528 - RNA, 20 nt, Artificial Sequence
  MKO10092528_B_Htr5a
  gRNA
cuacaccguguucuccaccg

SEQ ID NO: 92529 - RNA, 20 nt, Artificial Sequence
  MKO10092529_B_Htr5b
  gRNA
gccacgagucuccgcuuguc

SEQ ID NO: 92530 - RNA, 20 nt, Artificial Sequence
  MKO10092530_B_Htr5b
  gRNA
aguuguccguugggcgacgu

SEQ ID NO: 92531 - RNA, 20 nt, Artificial Sequence
  MKO10092531_B_Htr5b
  gRNA
guaccaccgcccgccgucug

SEQ ID NO: 92532 - RNA, 20 nt, Artificial Sequence
  MKO10092532_B_Htr6
  gRNA
aguggaugcugccguaucuc

SEQ ID NO: 92533 - RNA, 20 nt, Artificial Sequence
  MKO10092533_B_Htr6
  gRNA
gucugaccaccaagcauagc

SEQ ID NO: 92534 - RNA, 20 nt, Artificial Sequence
  MKO10092534_B_Htr6
  gRNA
gugcccaggacaccacgccc

SEQ ID NO: 92535 - RNA, 20 nt, Artificial Sequence
  MKO10092535_B_Htr7
  gRNA
cgugcagcacaugacgucca

SEQ ID NO: 92536 - RNA, 20 nt, Artificial Sequence
  MKO10092536_B_Htr7
  gRNA
agacaaaacugugaccacug

SEQ ID NO: 92537 - RNA, 20 nt, Artificial Sequence
  MKO10092537_B_Htr7
  gRNA
auuguccgggggcgcguccc

SEQ ID NO: 92538 - RNA, 20 nt, Artificial Sequence
  MKO10092538_B_Htra1
  gRNA
ggagaagaucgccccggcug

SEQ ID NO: 92539 - RNA, 20 nt, Artificial Sequence
  MKO10092539_B_Htra1
  gRNA
gauugugacaaaugcucacg

SEQ ID NO: 92540 - RNA, 20 nt, Artificial Sequence
  MKO10092540_B_Htra1
  gRNA
caccaacaaaaaccggguca

SEQ ID NO: 92541 - RNA, 20 nt, Artificial Sequence
  MKO10092541_B_Htra2
  gRNA
cgcgaugcagaaacucccua

SEQ ID NO: 92542 - RNA, 20 nt, Artificial Sequence
  MKO10092542_B_Htra2
  gRNA
ccaucccuucugaucgccuu

SEQ ID NO: 92543 - RNA, 20 nt, Artificial Sequence
  MKO10092543_B_Htra2
  gRNA
cugcagaacacgaucacauc

SEQ ID NO: 92544 - RNA, 20 nt, Artificial Sequence
  MKO10092544_B_Htra3
  gRNA
guucaacuucaucgccgaug

SEQ ID NO: 92545 - RNA, 20 nt, Artificial Sequence
  MKO10092545_B_Htra3
  gRNA
cuugggguggauuacaaucg

SEQ ID NO: 92546 - RNA, 20 nt, Artificial Sequence
  MKO10092546_B_Htra3
  gRNA
gcggcacauuccggccaaac

SEQ ID NO: 92547 - RNA, 20 nt, Artificial Sequence
  MKO10092547_B_Htra4
  gRNA
uccacuugcagcuguuccgc

SEQ ID NO: 92548 - RNA, 20 nt, Artificial Sequence
  MKO10092548_B_Htra4
  gRNA
cugcagaacaccgugacugc

SEQ ID NO: 92549 - RNA, 20 nt, Artificial Sequence
  MKO10092549_B_Htra4
  gRNA
cagaucaccucucaccaacc

SEQ ID NO: 92550 - RNA, 20 nt, Artificial Sequence
  MKO10092550_B_Huu
  gRNA
gaaguuugcgugcugcccug

SEQ ID NO: 92551 - RNA, 20 nt, Artificial Sequence
  MKO10092551_B_Huu
  gRNA
ugauggauucuaaucuucca

SEQ ID NO: 92552 - RNA, 20 nt, Artificial Sequence
  MKO10092552_B_Huu
  gRNA
cccaagaguuucugaaauuc

SEQ ID NO: 92553 - RNA, 20 nt, Artificial Sequence
  MKO10092553_B_Hunk
  gRNA
augcauuaccuguggagagc

SEQ ID NO: 92554 - RNA, 20 nt, Artificial Sequence
  MKO10092554_B_Hunk
  gRNA
gacaauaauaucaagcugau

SEQ ID NO: 92555 - RNA, 20 nt, Artificial Sequence
  MKO10092555_B_Hunk
  gRNA
cugcgccagaacugcuugcc

SEQ ID NO: 92556 - RNA, 20 nt, Artificial Sequence
  MKO10092556_B_Hus1b
  gRNA
gcagucuuuccaucgccuuc

SEQ ID NO: 92557 - RNA, 20 nt, Artificial Sequence
  MKO10092557_B_Hus1b
  gRNA
gcacccucacaggcaaaucg

SEQ ID NO: 92558 - RNA, 20 nt, Artificial Sequence
  MKO10092558_B_Hus1b
  gRNA
ugguccacgauuugccugug

SEQ ID NO: 92559 - RNA, 20 nt, Artificial Sequence
  MKO10092559_B_Hus1
  gRNA
ucuuaccgugucuguagagc

SEQ ID NO: 92560 - RNA, 20 nt, Artificial Sequence
  MKO10092560_B_Hus1
  gRNA
agguucuuccgagaagacug

SEQ ID NO: 92561 - RNA, 20 nt, Artificial Sequence
  MKO10092561_B_Hus1
  gRNA
ccacaugcucacgccuccac

SEQ ID NO: 92562 - RNA, 20 nt, Artificial Sequence
  MKO10092562_B_Huwe1
  gRNA
ucaaacuauaucacacgucu

SEQ ID NO: 92563 - RNA, 20 nt, Artificial Sequence
  MKO10092563_B_Huwe1
  gRNA
ugauuugcugcaguuccaag

SEQ ID NO: 92564 - RNA, 20 nt, Artificial Sequence
  MKO10092564_B_Huwe1
  gRNA
uaaugaugagcaacuccucu

SEQ ID NO: 92565 - RNA, 20 nt, Artificial Sequence
  MKO10092565_B_Hvcn1
  gRNA
caccuugguucugcgaguga

SEQ ID NO: 92566 - RNA, 20 nt, Artificial Sequence
  MKO10092566_B_Hvcn1
  gRNA
uugaaacacuuuacgguggu

SEQ ID NO: 92567 - RNA, 20 nt, Artificial Sequence
  MKO10092567_B_Hvcn1
  gRNA
agccaccacuucgaagcucu

SEQ ID NO: 92568 - RNA, 20 nt, Artificial Sequence
  MKO10092568_B_Hyal1
  gRNA
cgcagauggcuaugaaauuc

SEQ ID NO: 92569 - RNA, 20 nt, Artificial Sequence
  MKO10092569_B_Hyal1
  gRNA
cucagacaaaacaaguacca

SEQ ID NO: 92570 - RNA, 20 nt, Artificial Sequence
  MKO10092570_B_Hyal1
  gRNA
aaugaagcccuucaguccug

SEQ ID NO: 92571 - RNA, 20 nt, Artificial Sequence
  MKO10092571_B_Hyal2
  gRNA
ugaaccccagcuucgacccg

SEQ ID NO: 92572 - RNA, 20 nt, Artificial Sequence
  MKO10092572_B_Hyal2
  gRNA
cgucaucuucuggggcgacu

SEQ ID NO: 92573 - RNA, 20 nt, Artificial Sequence
  MKO10092573_B_Hyal2
  gRNA
guggaccuuaucucuaccau

SEQ ID NO: 92574 - RNA, 20 nt, Artificial Sequence
  MKO10092574_B_Hyal3
  gRNA
cagcccaacccgaauaacaa

SEQ ID NO: 92575 - RNA, 20 nt, Artificial Sequence
  MKO10092575_B_Hyal3
  gRNA
gacgaccugaugcagacuau

SEQ ID NO: 92576 - RNA, 20 nt, Artificial Sequence
  MKO10092576_B_Hyal3
  gRNA
ucacuccaauagucugcauc

SEQ ID NO: 92577 - RNA, 20 nt, Artificial Sequence
  MKO10092577_B_Hyal4
  gRNA
cgucaccuuugcaagaauaa

SEQ ID NO: 92578 - RNA, 20 nt, Artificial Sequence
  MKO10092578_B_Hyal4
  gRNA
caagaucuaauuaguaccau

SEQ ID NO: 92579 - RNA, 20 nt, Artificial Sequence
  MKO10092579_B_Hyal4
  gRNA
agaaagugcugcguugggag

SEQ ID NO: 92580 - RNA, 20 nt, Artificial Sequence
  MKO10092580_B_Hyal5
  gRNA
uacuuaccucauauagauau

SEQ ID NO: 92581 - RNA, 20 nt, Artificial Sequence
  MKO10092581_B_Hyal5
  gRNA
uccccacauuaccauuccag

SEQ ID NO: 92582 - RNA, 20 nt, Artificial Sequence
  MKO10092582_B_Hyal5
  gRNA
ucuuaguuuaucacaaacua

SEQ ID NO: 92583 - RNA, 20 nt, Artificial Sequence
  MKO10092583_B_Hyal6
  gRNA
ucugugagacaaacuguuca

SEQ ID NO: 92584 - RNA, 20 nt, Artificial Sequence
  MKO10092584_B_Hyal6
  gRNA
guggggaggauaugaauauu

SEQ ID NO: 92585 - RNA, 20 nt, Artificial Sequence
  MKO10092585_B_Hyal6
  gRNA
gaggauuuagugcacacaau

SEQ ID NO: 92586 - RNA, 20 nt, Artificial Sequence
  MKO10092586_B_Hydin
  gRNA
cuuccgaugcauggccccca

SEQ ID NO: 92587 - RNA, 20 nt, Artificial Sequence
  MKO10092587_B_Hydin
  gRNA
cuucacagggagaauaguuc

SEQ ID NO: 92588 - RNA, 20 nt, Artificial Sequence
  MKO10092588_B_Hydin
  gRNA
aauaugauuucagacggaaa

SEQ ID NO: 92589 - RNA, 20 nt, Artificial Sequence
  MKO10092589_B_Hyi
  gRNA
acccaaucugcaguugcaga

SEQ ID NO: 92590 - RNA, 20 nt, Artificial Sequence
  MKO10092590_B_Hyi
  gRNA
gcaggcugugcuguaugcca

SEQ ID NO: 92591 - RNA, 20 nt, Artificial Sequence
  MKO10092591_B_Hyi
  gRNA
caccaucugcaacugcagau

SEQ ID NO: 92592 - RNA, 20 nt, Artificial Sequence
  MKO10092592_B_Hykk
  gRNA
cccugagccaaagucgaaac

SEQ ID NO: 92593 - RNA, 20 nt, Artificial Sequence
  MKO10092593_B_Hykk
  gRNA
ccaauuggauaaagcccuag

SEQ ID NO: 92594 - RNA, 20 nt, Artificial Sequence
  MKO10092594_B_Hykk
  gRNA
ccugccucucuacagccguc

SEQ ID NO: 92595 - RNA, 20 nt, Artificial Sequence
  MKO10092595_B_Hyls1
  gRNA
gucacuagcacuuccccguc

SEQ ID NO: 92596 - RNA, 20 nt, Artificial Sequence
  MKO10092596_B_Hyls1
  gRNA
gcagcuaacauucguucuuc

SEQ ID NO: 92597 - RNA, 20 nt, Artificial Sequence
  MKO10092597_B_Hyls1
  gRNA
cuuggacggagguucuguuc

SEQ ID NO: 92598 - RNA, 20 nt, Artificial Sequence
  MKO10092598_B_Hyou1
  gRNA
cuuguucaauacaaucucca

SEQ ID NO: 92599 - RNA, 20 nt, Artificial Sequence
  MKO10092599_B_Hyou1
  gRNA
aagguggccauugucaagcc

SEQ ID NO: 92600 - RNA, 20 nt, Artificial Sequence
  MKO10092600_B_Hyou1
  gRNA
gcagcugcaguucucucccg

SEQ ID NO: 92601 - RNA, 20 nt, Artificial Sequence
  MKO10092601_B_Hypk
  gRNA
uuaaacuuaccgcucuuguu

SEQ ID NO: 92602 - RNA, 20 nt, Artificial Sequence
  MKO10092602_B_Hypk
  gRNA
aagcacauuaucaguugguu

SEQ ID NO: 92603 - RNA, 20 nt, Artificial Sequence
  MKO10092603_B_Hypk
  gRNA
cacuaucaagaaggaagauc

SEQ ID NO: 92604 - RNA, 20 nt, Artificial Sequence
  MKO10092604_B_I830012O16Rik
  gRNA
cagaguuuaaauguucgagc

SEQ ID NO: 92605 - RNA, 20 nt, Artificial Sequence
  MKO10092605_B_I830012O16Rik
  gRNA
agagguuaaacagcaaacau

SEQ ID NO: 92606 - RNA, 20 nt, Artificial Sequence
  MKO10092606_B_I830012O16Rik
  gRNA
ucacguggggaaacuacgcc

SEQ ID NO: 92607 - RNA, 20 nt, Artificial Sequence
  MKO10092607_B_I830077J02Rik
  gRNA
cagcagaaccccagcaaaaa

SEQ ID NO: 92608 - RNA, 20 nt, Artificial Sequence
  MKO10092608_B_I830077J02Rik
  gRNA
gcuggucacuggggcugucg

SEQ ID NO: 92609 - RNA, 20 nt, Artificial Sequence
  MKO10092609_B_I830077J02Rik
  gRNA
uuacuugggguugaagaaau

SEQ ID NO: 92610 - RNA, 20 nt, Artificial Sequence
  MKO10092610_B_Iah1
  gRNA
aaccgccugaacucaguugu

SEQ ID NO: 92611 - RNA, 20 nt, Artificial Sequence
  MKO10092611_B_Iah1
  gRNA
aagaagauuguaacggccac

SEQ ID NO: 92612 - RNA, 20 nt, Artificial Sequence
  MKO10092612_B_Iah1
  gRNA
uuacaaguagcccgagacug

SEQ ID NO: 92613 - RNA, 20 nt, Artificial Sequence
  MKO10092613_B_Iapp
  gRNA
ugacagguguagcucucaag

SEQ ID NO: 92614 - RNA, 20 nt, Artificial Sequence
  MKO10092614_B_Iapp
  gRNA
aguccucccaccaaccaacg

SEQ ID NO: 92615 - RNA, 20 nt, Artificial Sequence
  MKO10092615_B_Iapp
  gRNA
gaucgaauacauauggcaag

SEQ ID NO: 92616 - RNA, 20 nt, Artificial Sequence
  MKO10092616_B_Iars2
  gRNA
agcugcuuggcuucguacuu

SEQ ID NO: 92617 - RNA, 20 nt, Artificial Sequence
  MKO10092617_B_Iars2
  gRNA
gaugagggagaccaauauac

SEQ ID NO: 92618 - RNA, 20 nt, Artificial Sequence
  MKO10092618_B_Iars2
  gRNA
ucuagccagaucauuugcuc

SEQ ID NO: 92619 - RNA, 20 nt, Artificial Sequence
  MKO10092619_B_Iars
  gRNA
ccucguguacagaggcguga

SEQ ID NO: 92620 - RNA, 20 nt, Artificial Sequence
  MKO10092620_B_Iars
  gRNA
ugaugagauacuccgcugag

SEQ ID NO: 92621 - RNA, 20 nt, Artificial Sequence
  MKO10092621_B_Iars
  gRNA
guacgaaaucgauaagacac

SEQ ID NO: 92622 - RNA, 20 nt, Artificial Sequence
  MKO10092622_B_Iba57
  gRNA
cauuggucgauagucccaac

SEQ ID NO: 92623 - RNA, 20 nt, Artificial Sequence
  MKO10092623_B_Iba57
  gRNA
gcuccacggugaccuuccgc

SEQ ID NO: 92624 - RNA, 20 nt, Artificial Sequence
  MKO10092624_B_Iba57
  gRNA
ggcugugacugccguggugc

SEQ ID NO: 92625 - RNA, 20 nt, Artificial Sequence
  MKO10092625_B_Ibsp
  gRNA
ccaggagacuucaaacgaag

SEQ ID NO: 92626 - RNA, 20 nt, Artificial Sequence
  MKO10092626_B_Ibsp
  gRNA
agcuguuacacccgagagug

SEQ ID NO: 92627 - RNA, 20 nt, Artificial Sequence
  MKO10092627_B_Ibsp
  gRNA
ugcuuauaaagaaaguagcg

SEQ ID NO: 92628 - RNA, 20 nt, Artificial Sequence
  MKO10092628_B_Ibtk
  gRNA
caaacaucaccccgagcugc

SEQ ID NO: 92629 - RNA, 20 nt, Artificial Sequence
  MKO10092629_B_Ibtk
  gRNA
gagugggguuuaugucaagc

SEQ ID NO: 92630 - RNA, 20 nt, Artificial Sequence
  MKO10092630_B_Ibtk
  gRNA
agguguaaaccugcccuuuc

SEQ ID NO: 92631 - RNA, 20 nt, Artificial Sequence
  MKO10092631_B_Ica1l
  gRNA
gacucaagcuggcgaaauga

SEQ ID NO: 92632 - RNA, 20 nt, Artificial Sequence
  MKO10092632_B_Ica1l
  gRNA
ucacucacucacuaccuacc

SEQ ID NO: 92633 - RNA, 20 nt, Artificial Sequence
  MKO10092633_B_Ica1l
  gRNA
caaguucauugcaugucucc

SEQ ID NO: 92634 - RNA, 20 nt, Artificial Sequence
  MKO10092634_B_Ica1
  gRNA
ggaaaguuucuucgaucuca

SEQ ID NO: 92635 - RNA, 20 nt, Artificial Sequence
  MKO10092635_B_Ica1
  gRNA
cugacuuaucuugagcaaac

SEQ ID NO: 92636 - RNA, 20 nt, Artificial Sequence
  MKO10092636_B_Ica1
  gRNA
cuggcugacagugaaccgca

SEQ ID NO: 92637 - RNA, 20 nt, Artificial Sequence
  MKO10092637_B_Icam1
  gRNA
cuguuugagcugagcgagau

SEQ ID NO: 92638 - RNA, 20 nt, Artificial Sequence
  MKO10092638_B_Icam1
  gRNA
uuucucaugccgcacagaac

SEQ ID NO: 92639 - RNA, 20 nt, Artificial Sequence
  MKO10092639_B_Icam1
  gRNA
ccacucacaauacacgguga

SEQ ID NO: 92640 - RNA, 20 nt, Artificial Sequence
  MKO10092640_B_Icam2
  gRNA
ggaccauauguagaccucaa

SEQ ID NO: 92641 - RNA, 20 nt, Artificial Sequence
  MKO10092641_B_Icam2
  gRNA
gcuuucccgaacacgugaaa

SEQ ID NO: 92642 - RNA, 20 nt, Artificial Sequence
  MKO10092642_B_Icam2
  gRNA
guauaucauccgcagcaucu

SEQ ID NO: 92643 - RNA, 20 nt, Artificial Sequence
  MKO10092643_B_Icam4
  gRNA
cgcugcgucgucacuugcgc

SEQ ID NO: 92644 - RNA, 20 nt, Artificial Sequence
  MKO10092644_B_Icam4
  gRNA
agugacgacgcagcgcaccu

SEQ ID NO: 92645 - RNA, 20 nt, Artificial Sequence
  MKO10092645_B_Icam4
  gRNA
cucuaccuccaucgcaaccc

SEQ ID NO: 92646 - RNA, 20 nt, Artificial Sequence
  MKO10092646_B_Icam5
  gRNA
cccuugcagagcgaccggau

SEQ ID NO: 92647 - RNA, 20 nt, Artificial Sequence
  MKO10092647_B_Icam5
  gRNA
gucaaugugaggcucgcucg

SEQ ID NO: 92648 - RNA, 20 nt, Artificial Sequence
  MKO10092648_B_Icam5
  gRNA
cacgacgcacaucagcuguu

SEQ ID NO: 92649 - RNA, 20 nt, Artificial Sequence
  MKO10092649_B_Ick
  gRNA
agaaugcaugaaccuucggg

SEQ ID NO: 92650 - RNA, 20 nt, Artificial Sequence
  MKO10092650_B_Ick
  gRNA
augccaguccuugcaauauc

SEQ ID NO: 92651 - RNA, 20 nt, Artificial Sequence
  MKO10092651_B_Ick
  gRNA
cuugugaaaaucgccgacuu

SEQ ID NO: 92652 - RNA, 20 nt, Artificial Sequence
  MKO10092652_B_Icmt
  gRNA
ggcauagaccacgccacaga

SEQ ID NO: 92653 - RNA, 20 nt, Artificial Sequence
  MKO10092653_B_Icmt
  gRNA
ucacgcucgagaacaucuuc

SEQ ID NO: 92654 - RNA, 20 nt, Artificial Sequence
  MKO10092654_B_Icmt
  gRNA
ccagccaaagugauuccaag

SEQ ID NO: 92655 - RNA, 20 nt, Artificial Sequence
  MKO10092655_B_Icosl
  gRNA
agacgccauuucaacuugag

SEQ ID NO: 92656 - RNA, 20 nt, Artificial Sequence
  MKO10092656_B_Icosl
  gRNA
ugcagguguagguacguucc

SEQ ID NO: 92657 - RNA, 20 nt, Artificial Sequence
  MKO10092657_B_Icosl
  gRNA
auacccggcaugugaacucc

SEQ ID NO: 92658 - RNA, 20 nt, Artificial Sequence
  MKO10092658_B_Icos
  gRNA
ugcagaaguaauagcuuccc

SEQ ID NO: 92659 - RNA, 20 nt, Artificial Sequence
  MKO10092659_B_Icos
  gRNA
augaacauguauucacuauu

SEQ ID NO: 92660 - RNA, 20 nt, Artificial Sequence
  MKO10092660_B_Icos
  gRNA
uaauagugaauacauguuca

SEQ ID NO: 92661 - RNA, 20 nt, Artificial Sequence
  MKO10092661_B_Icu1
  gRNA
cccguccgcagugaauucca

SEQ ID NO: 92662 - RNA, 20 nt, Artificial Sequence
  MKO10092662_B_Icu1
  gRNA
acccagagggauguaacugc

SEQ ID NO: 92663 - RNA, 20 nt, Artificial Sequence
  MKO10092663_B_Icu1
  gRNA
gguuaagcauaucuuacugu

SEQ ID NO: 92664 - RNA, 20 nt, Artificial Sequence
  MKO10092664_B_Id1
  gRNA
gaucgcaucuugugucgcug

SEQ ID NO: 92665 - RNA, 20 nt, Artificial Sequence
  MKO10092665_B_Id1
  gRNA
gaucagugccuuggcggccg

SEQ ID NO: 92666 - RNA, 20 nt, Artificial Sequence
  MKO10092666_B_Id1
  gRNA
agcauguaaucgacuacauc

SEQ ID NO: 92667 - RNA, 20 nt, Artificial Sequence
  MKO10092667_B_Id2
  gRNA
ucauucgacauaagcucaga

SEQ ID NO: 92668 - RNA, 20 nt, Artificial Sequence
  MKO10092668_B_Id2
  gRNA
cgauagugggaugcgagucc

SEQ ID NO: 92669 - RNA, 20 nt, Artificial Sequence
  MKO10092669_B_Id2
  gRNA
uguaaucgaugacgugcugc

SEQ ID NO: 92670 - RNA, 20 nt, Artificial Sequence
  MKO10092670_B_Id3
  gRNA
uugugaucuccaaggacaag

SEQ ID NO: 92671 - RNA, 20 nt, Artificial Sequence
  MKO10092671_B_Id3
  gRNA
accacugcuacucgcgccug

SEQ ID NO: 92672 - RNA, 20 nt, Artificial Sequence
  MKO10092672_B_Id3
  gRNA
cuaagaggcuccucggucga

SEQ ID NO: 92673 - RNA, 20 nt, Artificial Sequence
  MKO10092673_B_Id4
  gRNA
gcugucacccugcuuguuca

SEQ ID NO: 92674 - RNA, 20 nt, Artificial Sequence
  MKO10092674_B_Id4
  gRNA
uugcggcccgaggggcgcac

SEQ ID NO: 92675 - RNA, 20 nt, Artificial Sequence
  MKO10092675_B_Id4
  gRNA
agucguucauaucgcacugc

SEQ ID NO: 92676 - RNA, 20 nt, Artificial Sequence
  MKO10092676_B_Ide
  gRNA
gcuucaccaccagguuagug

SEQ ID NO: 92677 - RNA, 20 nt, Artificial Sequence
  MKO10092677_B_Ide
  gRNA
agaaugugaugaacgaugcc

SEQ ID NO: 92678 - RNA, 20 nt, Artificial Sequence
  MKO10092678_B_Ide
  gRNA
ucagacccuccaaauauucc

SEQ ID NO: 92679 - RNA, 20 nt, Artificial Sequence
  MKO10092679_B_Idh1
  gRNA
ucgugaugccaccaaugacc

SEQ ID NO: 92680 - RNA, 20 nt, Artificial Sequence
  MKO10092680_B_Idh1
  gRNA
uggcaccauccgaaacauuc

SEQ ID NO: 92681 - RNA, 20 nt, Artificial Sequence
  MKO10092681_B_Idh1
  gRNA
acuauucugaagaaguauga

SEQ ID NO: 92682 - RNA, 20 nt, Artificial Sequence
  MKO10092682_B_Idh2
  gRNA
ggggauguacaacaccgacg

SEQ ID NO: 92683 - RNA, 20 nt, Artificial Sequence
  MKO10092683_B_Idh2
  gRNA
uggacggugacgagaugacc

SEQ ID NO: 92684 - RNA, 20 nt, Artificial Sequence
  MKO10092684_B_Idh2
  gRNA
caagguggagaagccgguag

SEQ ID NO: 92685 - RNA, 20 nt, Artificial Sequence
  MKO10092685_B_Idh3a
  gRNA
gcuucuaggcaccuauucag

SEQ ID NO: 92686 - RNA, 20 nt, Artificial Sequence
  MKO10092686_B_Idh3a
  gRNA
gggaucauccacuuuccucc

SEQ ID NO: 92687 - RNA, 20 nt, Artificial Sequence
  MKO10092687_B_Idh3a
  gRNA
ugcauuccacaacacaaaac

SEQ ID NO: 92688 - RNA, 20 nt, Artificial Sequence
  MKO10092688_B_Idh3b
  gRNA
ucacgccgcuucccagagcc

SEQ ID NO: 92689 - RNA, 20 nt, Artificial Sequence
  MKO10092689_B_Idh3b
  gRNA
ugaugcuccuuaaauuccac

SEQ ID NO: 92690 - RNA, 20 nt, Artificial Sequence
  MKO10092690_B_Idh3b
  gRNA
cacgccgucuccaggcagca

SEQ ID NO: 92691 - RNA, 20 nt, Artificial Sequence
  MKO10092691_B_Idh3g
  gRNA
ugcauguuaagucuguauuc

SEQ ID NO: 92692 - RNA, 20 nt, Artificial Sequence
  MKO10092692_B_Idh3g
  gRNA
cauacagugacuaugauccc

SEQ ID NO: 92693 - RNA, 20 nt, Artificial Sequence
  MKO10092693_B_Idh3g
  gRNA
acagguucuggcugcccaug

SEQ ID NO: 92694 - RNA, 20 nt, Artificial Sequence
  MKO10092694_B_Idi1
  gRNA
gaugaaaaugacaauaaaau

SEQ ID NO: 92695 - RNA, 20 nt, Artificial Sequence
  MKO10092695_B_Idi1
  gRNA
caucugaucucugcuguaac

SEQ ID NO: 92696 - RNA, 20 nt, Artificial Sequence
  MKO10092696_B_Idi1
  gRNA
gaugcuaaaauuaccuuucc

SEQ ID NO: 92697 - RNA, 20 nt, Artificial Sequence
  MKO10092697_B_Idi2
  gRNA
ugaacuccagcucaaacguc

SEQ ID NO: 92698 - RNA, 20 nt, Artificial Sequence
  MKO10092698_B_Idi2
  gRNA
ucuccuccagacguuugagc

SEQ ID NO: 92699 - RNA, 20 nt, Artificial Sequence
  MKO10092699_B_Idi2
  gRNA
cucaccuggaaauguguacu

SEQ ID NO: 92700 - RNA, 20 nt, Artificial Sequence
  MKO10092700_B_Idnk
  gRNA
agcacggucauggaggcacc

SEQ ID NO: 92701 - RNA, 20 nt, Artificial Sequence
  MKO10092701_B_Idnk
  gRNA
ggggcgcaucacuuccuccu

SEQ ID NO: 92702 - RNA, 20 nt, Artificial Sequence
  MKO10092702_B_Idnk
  gRNA
ggccagcagcgcacccacag

SEQ ID NO: 92703 - RNA, 20 nt, Artificial Sequence
  MKO10092703_B_Ido1
  gRNA
aggggaugacgauguucgaa

SEQ ID NO: 92704 - RNA, 20 nt, Artificial Sequence
  MKO10092704_B_Ido1
  gRNA
cuucucugagagcucgcagu

SEQ ID NO: 92705 - RNA, 20 nt, Artificial Sequence
  MKO10092705_B_Ido1
  gRNA
gucuuaugcagacugugucc

SEQ ID NO: 92706 - RNA, 20 nt, Artificial Sequence
  MKO10092706_B_Ido2
  gRNA
uggcgguucucgauuaagug

SEQ ID NO: 92707 - RNA, 20 nt, Artificial Sequence
  MKO10092707_B_Ido2
  gRNA
cuugggacucccgccuaucc

SEQ ID NO: 92708 - RNA, 20 nt, Artificial Sequence
  MKO10092708_B_Ido2
  gRNA
cgaccagaccguuggaaauc

SEQ ID NO: 92709 - RNA, 20 nt, Artificial Sequence
  MKO10092709_B_Ids
  gRNA
gcuugugguacccaacugcc

SEQ ID NO: 92710 - RNA, 20 nt, Artificial Sequence
  MKO10092710_B_Ids
  gRNA
ucugcuuuguccugucgaug

SEQ ID NO: 92711 - RNA, 20 nt, Artificial Sequence
  MKO10092711_B_Ids
  gRNA
gaugccagcuggucaauguu

SEQ ID NO: 92712 - RNA, 20 nt, Artificial Sequence
  MKO10092712_B_Idua
  gRNA
acacguugucaaagucaugg

SEQ ID NO: 92713 - RNA, 20 nt, Artificial Sequence
  MKO10092713_B_Idua
  gRNA
gguccaagaaugcauccaag

SEQ ID NO: 92714 - RNA, 20 nt, Artificial Sequence
  MKO10092714_B_Idua
  gRNA
cuauucaccaauguaucucc

SEQ ID NO: 92715 - RNA, 20 nt, Artificial Sequence
  MKO10092715_B_Ier2
  gRNA
uaccacucucgcaugcagcg

SEQ ID NO: 92716 - RNA, 20 nt, Artificial Sequence
  MKO10092716_B_Ier2
  gRNA
accucgcccgcguccuccaa

SEQ ID NO: 92717 - RNA, 20 nt, Artificial Sequence
  MKO10092717_B_Ier2
  gRNA
gccgacgccccccacgugcg

SEQ ID NO: 92718 - RNA, 20 nt, Artificial Sequence
  MKO10092718_B_Ier3ip1
  gRNA
cgccaucgccgugcugcacg

SEQ ID NO: 92719 - RNA, 20 nt, Artificial Sequence
  MKO10092719_B_Ier3ip1
  gRNA
auugaguuuacuauuaucaa

SEQ ID NO: 92720 - RNA, 20 nt, Artificial Sequence
  MKO10092720_B_Ier3ip1
  gRNA
auuguauugcuucuguuauu

SEQ ID NO: 92721 - RNA, 20 nt, Artificial Sequence
  MKO10092721_B_Ier3
  gRNA
ccggcgccagcuaccaaccg

SEQ ID NO: 92722 - RNA, 20 nt, Artificial Sequence
  MKO10092722_B_Ier3
  gRNA
gcgagaaguguucaaacgcg

SEQ ID NO: 92723 - RNA, 20 nt, Artificial Sequence
  MKO10092723_B_Ier3
  gRNA
ugcgcccauuacugcgcccc

SEQ ID NO: 92724 - RNA, 20 nt, Artificial Sequence
  MKO10092724_B_Ier5l
  gRNA
cgcgccccgguagaagccag

SEQ ID NO: 92725 - RNA, 20 nt, Artificial Sequence
  MKO10092725_B_Ier5l
  gRNA
uuugagauguuggacgcguc

SEQ ID NO: 92726 - RNA, 20 nt, Artificial Sequence
  MKO10092726_B_Ier5l
  gRNA
cuucuaccggggcgcguacc

SEQ ID NO: 92727 - RNA, 20 nt, Artificial Sequence
  MKO10092727_B_Ier5
  gRNA
ccgggggacagccgcacggg

SEQ ID NO: 92728 - RNA, 20 nt, Artificial Sequence
  MKO10092728_B_Ier5
  gRNA
uggcucggacgcgugccccg

SEQ ID NO: 92729 - RNA, 20 nt, Artificial Sequence
  MKO10092729_B_Ier5
  gRNA
uucccccgauccggccaccg

SEQ ID NO: 92730 - RNA, 20 nt, Artificial Sequence
  MKO10092730_B_Iffo1
  gRNA
gauguccaugucgacuuuca

SEQ ID NO: 92731 - RNA, 20 nt, Artificial Sequence
  MKO10092731_B_Iffo1
  gRNA
cuggcuguaggaggcccaag

SEQ ID NO: 92732 - RNA, 20 nt, Artificial Sequence
  MKO10092732_B_Iffo1
  gRNA
uagcuccucuuggcaggcau

SEQ ID NO: 92733 - RNA, 20 nt, Artificial Sequence
  MKO10092733_B_Iffo2
  gRNA
acgcaugaaccuucagacca

SEQ ID NO: 92734 - RNA, 20 nt, Artificial Sequence
  MKO10092734_B_Iffo2
  gRNA
cccuaagaagaaagaucgua

SEQ ID NO: 92735 - RNA, 20 nt, Artificial Sequence
  MKO10092735_B_Iffo2
  gRNA
ggcuucggaugaagacaucu

SEQ ID NO: 92736 - RNA, 20 nt, Artificial Sequence
  MKO10092736_B_Ifi202b
  gRNA
ugauuuccagaguguaauau

SEQ ID NO: 92737 - RNA, 20 nt, Artificial Sequence
  MKO10092737_B_Ifi202b
  gRNA
gccacugcuguugaaguauu

SEQ ID NO: 92738 - RNA, 20 nt, Artificial Sequence
  MKO10092738_B_Ifi202b
  gRNA
uccaaauacuucaacagcag

SEQ ID NO: 92739 - RNA, 20 nt, Artificial Sequence
  MKO10092739_B_Ifi203
  gRNA
uuugucuaguccagcaucuu

SEQ ID NO: 92740 - RNA, 20 nt, Artificial Sequence
  MKO10092740_B_Ifi203
  gRNA
uggugaccuucuucucuaga

SEQ ID NO: 92741 - RNA, 20 nt, Artificial Sequence
  MKO10092741_B_Ifi203
  gRNA
cccuacaguucaaaagaaaa

SEQ ID NO: 92742 - RNA, 20 nt, Artificial Sequence
  MKO10092742_B_Ifi204
  gRNA
cagaaucagaacauucccag

SEQ ID NO: 92743 - RNA, 20 nt, Artificial Sequence
  MKO10092743_B_Ifi204
  gRNA
auuaugagagaagaagagac

SEQ ID NO: 92744 - RNA, 20 nt, Artificial Sequence
  MKO10092744_B_Ifi204
  gRNA
aguaacaggagaaacaucac

SEQ ID NO: 92745 - RNA, 20 nt, Artificial Sequence
  MKO10092745_B_Ifi205
  gRNA
aguaacagaagaaacaucac

SEQ ID NO: 92746 - RNA, 20 nt, Artificial Sequence
  MKO10092746_B_Ifi205
  gRNA
cagaaccagaacauucccag

SEQ ID NO: 92747 - RNA, 20 nt, Artificial Sequence
  MKO10092747_B_Ifi205
  gRNA
cucagagccccugacaguga

SEQ ID NO: 92748 - RNA, 20 nt, Artificial Sequence
  MKO10092748_B_Ifi27l2a
  gRNA
cagagacaaaccuccuccua

SEQ ID NO: 92749 - RNA, 20 nt, Artificial Sequence
  MKO10092749_B_Ifi27l2a
  gRNA
uggaguugcagcaggaagcc

SEQ ID NO: 92750 - RNA, 20 nt, Artificial Sequence
  MKO10092750_B_Ifi27l2a
  gRNA
uuguugauguggagagucca

SEQ ID NO: 92751 - RNA, 20 nt, Artificial Sequence
  MKO10092751_B_Ifi27l2b
  gRNA
uuucucccuaggaaaauuug

SEQ ID NO: 92752 - RNA, 20 nt, Artificial Sequence
  MKO10092752_B_Ifi27l2b
  gRNA
ucucccuacagcucuggcug

SEQ ID NO: 92753 - RNA, 20 nt, Artificial Sequence
  MKO10092753_B_Ifi27l2b
  gRNA
aacagccaccaggaugaugu

SEQ ID NO: 92754 - RNA, 20 nt, Artificial Sequence
  MKO10092754_B_Ifi27
  gRNA
acccuucgaaccagcuagaa

SEQ ID NO: 92755 - RNA, 20 nt, Artificial Sequence
  MKO10092755_B_Ifi27
  gRNA
ccuguuaacacagagugccc

SEQ ID NO: 92756 - RNA, 20 nt, Artificial Sequence
  MKO10092756_B_Ifi27
  gRNA
gggccaguuaccuccaaugg

SEQ ID NO: 92757 - RNA, 20 nt, Artificial Sequence
  MKO10092757_B_Ifi30
  gRNA
uacacuccagcuccccgugc

SEQ ID NO: 92758 - RNA, 20 nt, Artificial Sequence
  MKO10092758_B_Ifi30
  gRNA
caucuccuccauacagacga

SEQ ID NO: 92759 - RNA, 20 nt, Artificial Sequence
  MKO10092759_B_Ifi30
  gRNA
gggaguuccacgugccagca

SEQ ID NO: 92760 - RNA, 20 nt, Artificial Sequence
  MKO10092760_B_Ifi35
  gRNA
aaccacuaacgagcacccug

SEQ ID NO: 92761 - RNA, 20 nt, Artificial Sequence
  MKO10092761_B_Ifi35
  gRNA
auuccaaggccaaacuaagc

SEQ ID NO: 92762 - RNA, 20 nt, Artificial Sequence
  MKO10092762_B_Ifi35
  gRNA
uggaauaccagaggaacuuc

SEQ ID NO: 92763 - RNA, 20 nt, Artificial Sequence
  MKO10092763_B_Ifi44l
  gRNA
guagaccuugugaugagcuu

SEQ ID NO: 92764 - RNA, 20 nt, Artificial Sequence
  MKO10092764_B_Ifi44l
  gRNA
aacugugacuucucuaagcc

SEQ ID NO: 92765 - RNA, 20 nt, Artificial Sequence
  MKO10092765_B_Ifi44l
  gRNA
gagagaguuucacuugucuc

SEQ ID NO: 92766 - RNA, 20 nt, Artificial Sequence
  MKO10092766_B_Ifi44
  gRNA
guacaggacauauuccauca

SEQ ID NO: 92767 - RNA, 20 nt, Artificial Sequence
  MKO10092767_B_Ifi44
  gRNA
uacaucaucugugugcaagc

SEQ ID NO: 92768 - RNA, 20 nt, Artificial Sequence
  MKO10092768_B_Ifi44
  gRNA
cgaagagacuugauaaaaca

SEQ ID NO: 92769 - RNA, 20 nt, Artificial Sequence
  MKO10092769_B_Ifi47
  gRNA
gcagaugaauccgcugaugu

SEQ ID NO: 92770 - RNA, 20 nt, Artificial Sequence
  MKO10092770_B_Ifi47
  gRNA
cuucguggcccagcccucga

SEQ ID NO: 92771 - RNA, 20 nt, Artificial Sequence
  MKO10092771_B_Ifi47
  gRNA
gugacuaaucucaucaaaac

SEQ ID NO: 92772 - RNA, 20 nt, Artificial Sequence
  MKO10092772_B_Ifih1
  gRNA
acuucugauuaacgaugucu

SEQ ID NO: 92773 - RNA, 20 nt, Artificial Sequence
  MKO10092773_B_Ifih1
  gRNA
ggcaccaugggaagugauuc

SEQ ID NO: 92774 - RNA, 20 nt, Artificial Sequence
  MKO10092774_B_Ifih1
  gRNA
agcugcuucgaugaaagucu

SEQ ID NO: 92775 - RNA, 20 nt, Artificial Sequence
  MKO10092775_B_Ifit1
  gRNA
augcagccaaauauuuccgu

SEQ ID NO: 92776 - RNA, 20 nt, Artificial Sequence
  MKO10092776_B_Ifit1
  gRNA
acugaacaacaagacccucg

SEQ ID NO: 92777 - RNA, 20 nt, Artificial Sequence
  MKO10092777_B_Ifit1
  gRNA
aggagguugugcauccccaa

SEQ ID NO: 92778 - RNA, 20 nt, Artificial Sequence
  MKO10092778_B_Ifit2
  gRNA
acugaaaguugccauaccga

SEQ ID NO: 92779 - RNA, 20 nt, Artificial Sequence
  MKO10092779_B_Ifit2
  gRNA
gucucacaguacaacgagua

SEQ ID NO: 92780 - RNA, 20 nt, Artificial Sequence
  MKO10092780_B_Ifit2
  gRNA
ccccauauaguaaugcacau

SEQ ID NO: 92781 - RNA, 20 nt, Artificial Sequence
  MKO10092781_B_Ifit3
  gRNA
ccaggagaacuuucagguac

SEQ ID NO: 92782 - RNA, 20 nt, Artificial Sequence
  MKO10092782_B_Ifit3
  gRNA
ucaccuggggaaacuacgcc

SEQ ID NO: 92783 - RNA, 20 nt, Artificial Sequence
  MKO10092783_B_Ifit3
  gRNA
ggucgaacauuuaaacucug

SEQ ID NO: 92784 - RNA, 20 nt, Artificial Sequence
  MKO10092784_B_Ifitm10
  gRNA
gugaucucuuacauagcaga

SEQ ID NO: 92785 - RNA, 20 nt, Artificial Sequence
  MKO10092785_B_Ifitm10
  gRNA
acucugacuaauacgaauag

SEQ ID NO: 92786 - RNA, 20 nt, Artificial Sequence
  MKO10092786_B_Ifitm10
  gRNA
guugucucgcugugccaucc

SEQ ID NO: 92787 - RNA, 20 nt, Artificial Sequence
  MKO10092787_B_Ifitm1
  gRNA
acagacaacgaugacgacga

SEQ ID NO: 92788 - RNA, 20 nt, Artificial Sequence
  MKO10092788_B_Ifitm1
  gRNA
ccagaccacauggucaggcg

SEQ ID NO: 92789 - RNA, 20 nt, Artificial Sequence
  MKO10092789_B_Ifitm1
  gRNA
ccgugaggauggugaagaac

SEQ ID NO: 92790 - RNA, 20 nt, Artificial Sequence
  MKO10092790_B_Ifitm2
  gRNA
aagauggugggcgauguggu

SEQ ID NO: 92791 - RNA, 20 nt, Artificial Sequence
  MKO10092791_B_Ifitm2
  gRNA
cacacucaccuucacagagu

SEQ ID NO: 92792 - RNA, 20 nt, Artificial Sequence
  MKO10092792_B_Ifitm2
  gRNA
ccucacaacagcugaguugc

SEQ ID NO: 92793 - RNA, 20 nt, Artificial Sequence
  MKO10092793_B_Ifitm3
  gRNA
cugacagaagccgauccgug

SEQ ID NO: 92794 - RNA, 20 nt, Artificial Sequence
  MKO10092794_B_Ifitm3
  gRNA
gggcuguccuccacuggcag

SEQ ID NO: 92795 - RNA, 20 nt, Artificial Sequence
  MKO10092795_B_Ifitm3
  gRNA
aaugaugaugacacuaacaa

SEQ ID NO: 92796 - RNA, 20 nt, Artificial Sequence
  MKO10092796_B_Ifitm5
  gRNA
auaguccuccucaucaaacu

SEQ ID NO: 92797 - RNA, 20 nt, Artificial Sequence
  MKO10092797_B_Ifitm5
  gRNA
gaccagagcaugugaucucg

SEQ ID NO: 92798 - RNA, 20 nt, Artificial Sequence
  MKO10092798_B_Ifitm5
  gRNA
ccgggcuccaucaucccgca

SEQ ID NO: 92799 - RNA, 20 nt, Artificial Sequence
  MKO10092799_B_Ifitm6
  gRNA
aagauggugggcgacaugac

SEQ ID NO: 92800 - RNA, 20 nt, Artificial Sequence
  MKO10092800_B_Ifitm6
  gRNA
uuauacagcuuuaacuuacu

SEQ ID NO: 92801 - RNA, 20 nt, Artificial Sequence
  MKO10092801_B_Ifitm6
  gRNA
uuucauugccuacaucuacu

SEQ ID NO: 92802 - RNA, 20 nt, Artificial Sequence
  MKO10092802_B_Ifitm7
  gRNA
uugucgaagaaguugaggug

SEQ ID NO: 92803 - RNA, 20 nt, Artificial Sequence
  MKO10092803_B_Ifitm7
  gRNA
ucauauguagcuucuacccc

SEQ ID NO: 92804 - RNA, 20 nt, Artificial Sequence
  MKO10092804_B_Ifitm7
  gRNA
cuaagagucugugcuuauaa

SEQ ID NO: 92805 - RNA, 20 nt, Artificial Sequence
  MKO10092805_B_Ifltd1
  gRNA
guucgcucacguucucggcu

SEQ ID NO: 92806 - RNA, 20 nt, Artificial Sequence
  MKO10092806_B_Ifltd1
  gRNA
cacaagauggucgugcaguc

SEQ ID NO: 92807 - RNA, 20 nt, Artificial Sequence
  MKO10092807_B_Ifltd1
  gRNA
agcuccaccuuaucguccag

SEQ ID NO: 92808 - RNA, 20 nt, Artificial Sequence
  MKO10092808_B_Ifna11
  gRNA
uggguaagaucucgcagcac

SEQ ID NO: 92809 - RNA, 20 nt, Artificial Sequence
  MKO10092809_B_Ifna11
  gRNA
gcugcaucagacaaccuugc

SEQ ID NO: 92810 - RNA, 20 nt, Artificial Sequence
  MKO10092810_B_Ifna11
  gRNA
ugagccuccucauuugugcc

SEQ ID NO: 92811 - RNA, 20 nt, Artificial Sequence
  MKO10092811_B_Ifna12
  gRNA
gcaggagccuccccugaccc

SEQ ID NO: 92812 - RNA, 20 nt, Artificial Sequence
  MKO10092812_B_Ifna12
  gRNA
cccugcuagugaugagcuac

SEQ ID NO: 92813 - RNA, 20 nt, Artificial Sequence
  MKO10092813_B_Ifna12
  gRNA
cuugagccuucuugaucugc

SEQ ID NO: 92814 - RNA, 20 nt, Artificial Sequence
  MKO10092814_B_Ifna13
  gRNA
gucuuccucagccaacuugc

SEQ ID NO: 92815 - RNA, 20 nt, Artificial Sequence
  MKO10092815_B_Ifna13
  gRNA
uaggccuugugcuuuccuga

SEQ ID NO: 92816 - RNA, 20 nt, Artificial Sequence
  MKO10092816_B_Ifna13
  gRNA
agagucuccucauuuguucc

SEQ ID NO: 92817 - RNA, 20 nt, Artificial Sequence
  MKO10092817_B_Ifna14
  gRNA
accaguagcucaucaccagc

SEQ ID NO: 92818 - RNA, 20 nt, Artificial Sequence
  MKO10092818_B_Ifna14
  gRNA
aguguugaggucauugcaga

SEQ ID NO: 92819 - RNA, 20 nt, Artificial Sequence
  MKO10092819_B_Ifna14
  gRNA
ggacucacuucucuucuuuc

SEQ ID NO: 92820 - RNA, 20 nt, Artificial Sequence
  MKO10092820_B_Ifna1
  gRNA
cugucugaugcagcaggugg

SEQ ID NO: 92821 - RNA, 20 nt, Artificial Sequence
  MKO10092821_B_Ifna1
  gRNA
agagucuccucauuuguacc

SEQ ID NO: 92822 - RNA, 20 nt, Artificial Sequence
  MKO10092822_B_Ifna1
  gRNA
gcaggaauuuccccugaccc

SEQ ID NO: 92823 - RNA, 20 nt, Artificial Sequence
  MKO10092823_B_Ifna2
  gRNA
ggagccuccucaucugugcc

SEQ ID NO: 92824 - RNA, 20 nt, Artificial Sequence
  MKO10092824_B_Ifna2
  gRNA
gcaaaccugucugaugcagc

SEQ ID NO: 92825 - RNA, 20 nt, Artificial Sequence
  MKO10092825_B_Ifna2
  gRNA
ggauaaccagcagauccaga

SEQ ID NO: 92826 - RNA, 20 nt, Artificial Sequence
  MKO10092826_B_Ifna4
  gRNA
cucuuccucaaccaacuugc

SEQ ID NO: 92827 - RNA, 20 nt, Artificial Sequence
  MKO10092827_B_Ifna4
  gRNA
caagagggccuugacagucc

SEQ ID NO: 92828 - RNA, 20 nt, Artificial Sequence
  MKO10092828_B_Ifna4
  gRNA
cugugcuuuccucaugaucc

SEQ ID NO: 92829 - RNA, 20 nt, Artificial Sequence
  MKO10092829_B_Ifna5
  gRNA
cuucauugcagaaugagucu

SEQ ID NO: 92830 - RNA, 20 nt, Artificial Sequence
  MKO10092830_B_Ifna5
  gRNA
ggugggugcccagcagaucc

SEQ ID NO: 92831 - RNA, 20 nt, Artificial Sequence
  MKO10092831_B_Ifna5
  gRNA
ccugcugggucagcucacuc

SEQ ID NO: 92832 - RNA, 20 nt, Artificial Sequence
  MKO10092832_B_Ifna6
  gRNA
cagggauggcuugagccucc

SEQ ID NO: 92833 - RNA, 20 nt, Artificial Sequence
  MKO10092833_B_Ifna6
  gRNA
gcaggaaucuccccugaccc

SEQ ID NO: 92834 - RNA, 20 nt, Artificial Sequence
  MKO10092834_B_Ifna6
  gRNA
cugggcauccaccuucucca

SEQ ID NO: 92835 - RNA, 20 nt, Artificial Sequence
  MKO10092835_B_Ifna7
  gRNA
gcaucuuccugggucagagg

SEQ ID NO: 92836 - RNA, 20 nt, Artificial Sequence
  MKO10092836_B_Ifna7
  gRNA
acucaaucuugccagcaacu

SEQ ID NO: 92837 - RNA, 20 nt, Artificial Sequence
  MKO10092837_B_Ifna7
  gRNA
aaggucauauccuagagagc

SEQ ID NO: 92838 - RNA, 20 nt, Artificial Sequence
  MKO10092838_B_Ifna9
  gRNA
caagaaaaucuugacacucc

SEQ ID NO: 92839 - RNA, 20 nt, Artificial Sequence
  MKO10092839_B_Ifna9
  gRNA
aauauuucuucauagccagc

SEQ ID NO: 92840 - RNA, 20 nt, Artificial Sequence
  MKO10092840_B_Ifna9
  gRNA
uuaucaccaccaagaccauc

SEQ ID NO: 92841 - RNA, 20 nt, Artificial Sequence
  MKO10092841_B_Ifnab
  gRNA
accaguagcucaucacugcc

SEQ ID NO: 92842 - RNA, 20 nt, Artificial Sequence
  MKO10092842_B_Ifnab
  gRNA
gaaagugcugagccuagcca

SEQ ID NO: 92843 - RNA, 20 nt, Artificial Sequence
  MKO10092843_B_Ifnab
  gRNA
uccuggcagugaugagcuac

SEQ ID NO: 92844 - RNA, 20 nt, Artificial Sequence
  MKO10092844_B_Ifnar1
  gRNA
auguagacgucuauauucuc

SEQ ID NO: 92845 - RNA, 20 nt, Artificial Sequence
  MKO10092845_B_Ifnar1
  gRNA
aagggaacagcacaucuucg

SEQ ID NO: 92846 - RNA, 20 nt, Artificial Sequence
  MKO10092846_B_Ifnar1
  gRNA
ccguuuauuccauucuacac

SEQ ID NO: 92847 - RNA, 20 nt, Artificial Sequence
  MKO10092847_B_Ifnar2
  gRNA
agacuuguucucuaauuccc

SEQ ID NO: 92848 - RNA, 20 nt, Artificial Sequence
  MKO10092848_B_Ifnar2
  gRNA
agcugagcaggaugcguuca

SEQ ID NO: 92849 - RNA, 20 nt, Artificial Sequence
  MKO10092849_B_Ifnar2
  gRNA
ucuccucagcuugugucuug

SEQ ID NO: 92850 - RNA, 20 nt, Artificial Sequence
  MKO10092850_B_Ifnb1
  gRNA
gaucuugaaguccgcccugu

SEQ ID NO: 92851 - RNA, 20 nt, Artificial Sequence
  MKO10092851_B_Ifnb1
  gRNA
gaaagaucaaccucaccuac

SEQ ID NO: 92852 - RNA, 20 nt, Artificial Sequence
  MKO10092852_B_Ifnb1
  gRNA
uccacuugaagagcuauuac

SEQ ID NO: 92853 - RNA, 20 nt, Artificial Sequence
  MKO10092853_B_Ifne
  gRNA
ggagcgugaagaucugcuga

SEQ ID NO: 92854 - RNA, 20 nt, Artificial Sequence
  MKO10092854_B_Ifne
  gRNA
agggaauccguuucgguucu

SEQ ID NO: 92855 - RNA, 20 nt, Artificial Sequence
  MKO10092855_B_Ifne
  gRNA
gaguccucaccaguaccaag

SEQ ID NO: 92856 - RNA, 20 nt, Artificial Sequence
  MKO10092856_B_Ifngr1
  gRNA
ccaggaaaggucgggccccc

SEQ ID NO: 92857 - RNA, 20 nt, Artificial Sequence
  MKO10092857_B_Ifngr1
  gRNA
ugguauucccagcauacgac

SEQ ID NO: 92858 - RNA, 20 nt, Artificial Sequence
  MKO10092858_B_Ifngr1
  gRNA
gauccuacauacgaaacaua

SEQ ID NO: 92859 - RNA, 20 nt, Artificial Sequence
  MKO10092859_B_Ifngr2
  gRNA
ucugugauguccguacaguu

SEQ ID NO: 92860 - RNA, 20 nt, Artificial Sequence
  MKO10092860_B_Ifngr2
  gRNA
uucaguaucuuguccacuac

SEQ ID NO: 92861 - RNA, 20 nt, Artificial Sequence
  MKO10092861_B_Ifngr2
  gRNA
cacuggucuugggucauugc

SEQ ID NO: 92862 - RNA, 20 nt, Artificial Sequence
  MKO10092862_B_Ifng
  gRNA
gaacgcuacacacugcaucu

SEQ ID NO: 92863 - RNA, 20 nt, Artificial Sequence
  MKO10092863_B_Ifng
  gRNA
agagucucuucuuggauauc

SEQ ID NO: 92864 - RNA, 20 nt, Artificial Sequence
  MKO10092864_B_Ifng
  gRNA
aagagauaaucuggcucugc

SEQ ID NO: 92865 - RNA, 20 nt, Artificial Sequence
  MKO10092865_B_Ifnk
  gRNA
cagggaacauccucacuccg

SEQ ID NO: 92866 - RNA, 20 nt, Artificial Sequence
  MKO10092866_B_Ifnk
  gRNA
cuaacuaucuucaaucuuaa

SEQ ID NO: 92867 - RNA, 20 nt, Artificial Sequence
  MKO10092867_B_Ifnk
  gRNA
acacugggaacguaucagau

SEQ ID NO: 92868 - RNA, 20 nt, Artificial Sequence
  MKO10092868_B_Ifnl2
  gRNA
gcaguucccaccucuucccc

SEQ ID NO: 92869 - RNA, 20 nt, Artificial Sequence
  MKO10092869_B_Ifnl2
  gRNA
cgagccgccgccucucccgc

SEQ ID NO: 92870 - RNA, 20 nt, Artificial Sequence
  MKO10092870_B_Ifnl2
  gRNA
cggggaccugggcucugcug

SEQ ID NO: 92871 - RNA, 20 nt, Artificial Sequence
  MKO10092871_B_Ifnl3
  gRNA
gcaguucccaccucaucucc

SEQ ID NO: 92872 - RNA, 20 nt, Artificial Sequence
  MKO10092872_B_Ifnl3
  gRNA
cgagucgccgccucucccgc

SEQ ID NO: 92873 - RNA, 20 nt, Artificial Sequence
  MKO10092873_B_Ifnl3
  gRNA
cgggggcuugggcucugcug

SEQ ID NO: 92874 - RNA, 20 nt, Artificial Sequence
  MKO10092874_B_Ifnlr1
  gRNA
ccuauuucgugaccuaccaa

SEQ ID NO: 92875 - RNA, 20 nt, Artificial Sequence
  MKO10092875_B_Ifnlr1
  gRNA
uaccgucaaaaagguauucc

SEQ ID NO: 92876 - RNA, 20 nt, Artificial Sequence
  MKO10092876_B_Ifnlr1
  gRNA
cgaccaguggagcauugugc

SEQ ID NO: 92877 - RNA, 20 nt, Artificial Sequence
  MKO10092877_B_Ifnz
  gRNA
augccuuugccuucagauag

SEQ ID NO: 92878 - RNA, 20 nt, Artificial Sequence
  MKO10092878_B_Ifnz
  gRNA
gggccucuucucgcagacag

SEQ ID NO: 92879 - RNA, 20 nt, Artificial Sequence
  MKO10092879_B_Ifnz
  gRNA
gcugccugugcaucuauucc

SEQ ID NO: 92880 - RNA, 20 nt, Artificial Sequence
  MKO10092880_B_Ifrd1
  gRNA
caauagugcgaagacaagac

SEQ ID NO: 92881 - RNA, 20 nt, Artificial Sequence
  MKO10092881_B_Ifrd1
  gRNA
uugaccuaacccuugauaag

SEQ ID NO: 92882 - RNA, 20 nt, Artificial Sequence
  MKO10092882_B_Ifrd1
  gRNA
agacuuagaguacaaguuga

SEQ ID NO: 92883 - RNA, 20 nt, Artificial Sequence
  MKO10092883_B_Ifrd2
  gRNA
guacagcaagccccacugcc

SEQ ID NO: 92884 - RNA, 20 nt, Artificial Sequence
  MKO10092884_B_Ifrd2
  gRNA
ccuggccucccgccuacuuc

SEQ ID NO: 92885 - RNA, 20 nt, Artificial Sequence
  MKO10092885_B_Ifrd2
  gRNA
agagguaccucuugucaguc

SEQ ID NO: 92886 - RNA, 20 nt, Artificial Sequence
  MKO10092886_B_Ift122
  gRNA
cugacaagagcaucauuauc

SEQ ID NO: 92887 - RNA, 20 nt, Artificial Sequence
  MKO10092887_B_Ift122
  gRNA
caaagacaccguguacugug

SEQ ID NO: 92888 - RNA, 20 nt, Artificial Sequence
  MKO10092888_B_Ift122
  gRNA
uuugucucuccacgucaaca

SEQ ID NO: 92889 - RNA, 20 nt, Artificial Sequence
  MKO10092889_B_Ift140
  gRNA
ccucuugagaccccgucuuc

SEQ ID NO: 92890 - RNA, 20 nt, Artificial Sequence
  MKO10092890_B_Ift140
  gRNA
auggcaaugucagucguaug

SEQ ID NO: 92891 - RNA, 20 nt, Artificial Sequence
  MKO10092891_B_Ift140
  gRNA
acaaggcuuauccuggcuau

SEQ ID NO: 92892 - RNA, 20 nt, Artificial Sequence
  MKO10092892_B_Ift172
  gRNA
uccgcaggauggagcugcga

SEQ ID NO: 92893 - RNA, 20 nt, Artificial Sequence
  MKO10092893_B_Ift172
  gRNA
caucauacagaaguaccacu

SEQ ID NO: 92894 - RNA, 20 nt, Artificial Sequence
  MKO10092894_B_Ift172
  gRNA
aucaucuaugucuacaagau

SEQ ID NO: 92895 - RNA, 20 nt, Artificial Sequence
  MKO10092895_B_Ift20
  gRNA
ggccaguuucagaaaauugu

SEQ ID NO: 92896 - RNA, 20 nt, Artificial Sequence
  MKO10092896_B_Ift20
  gRNA
cagcaaguuccgagcaccaa

SEQ ID NO: 92897 - RNA, 20 nt, Artificial Sequence
  MKO10092897_B_Ift20
  gRNA
cuucucguucucugcuucuu

SEQ ID NO: 92898 - RNA, 20 nt, Artificial Sequence
  MKO10092898_B_Ift27
  gRNA
uccccugcagacaacuggag

SEQ ID NO: 92899 - RNA, 20 nt, Artificial Sequence
  MKO10092899_B_Ift27
  gRNA
cauuggucacaucauagaca

SEQ ID NO: 92900 - RNA, 20 nt, Artificial Sequence
  MKO10092900_B_Ift27
  gRNA
ggagcuguucucugaaaugc

SEQ ID NO: 92901 - RNA, 20 nt, Artificial Sequence
  MKO10092901_B_Ift43
  gRNA
cgucgucgucugaccccauc

SEQ ID NO: 92902 - RNA, 20 nt, Artificial Sequence
  MKO10092902_B_Ift43
  gRNA
ccuccgacagcagaaccuga

SEQ ID NO: 92903 - RNA, 20 nt, Artificial Sequence
  MKO10092903_B_Ift43
  gRNA
gcccagccucccugccuucg

SEQ ID NO: 92904 - RNA, 20 nt, Artificial Sequence
  MKO10092904_B_Ift46
  gRNA
gacuggcagaugcucguagu

SEQ ID NO: 92905 - RNA, 20 nt, Artificial Sequence
  MKO10092905_B_Ift46
  gRNA
cucccagcugacaccgcagc

SEQ ID NO: 92906 - RNA, 20 nt, Artificial Sequence
  MKO10092906_B_Ift46
  gRNA
cgacgaugacuccucugaga

SEQ ID NO: 92907 - RNA, 20 nt, Artificial Sequence
  MKO10092907_B_Ift52
  gRNA
gugaaacuauggaucacagc

SEQ ID NO: 92908 - RNA, 20 nt, Artificial Sequence
  MKO10092908_B_Ift52
  gRNA
cugaagaaguaucuugacag

SEQ ID NO: 92909 - RNA, 20 nt, Artificial Sequence
  MKO10092909_B_Ift52
  gRNA
uggggauauccuugugaugc

SEQ ID NO: 92910 - RNA, 20 nt, Artificial Sequence
  MKO10092910_B_Ift57
  gRNA
uuugcucugccuaccaaccc

SEQ ID NO: 92911 - RNA, 20 nt, Artificial Sequence
  MKO10092911_B_Ift57
  gRNA
cgaguuaacauuaaguaaag

SEQ ID NO: 92912 - RNA, 20 nt, Artificial Sequence
  MKO10092912_B_Ift57
  gRNA
ccuccuucaaaauuaaaguc

SEQ ID NO: 92913 - RNA, 20 nt, Artificial Sequence
  MKO10092913_B_Ift74
  gRNA
uuagacaaaucuuacuaucu

SEQ ID NO: 92914 - RNA, 20 nt, Artificial Sequence
  MKO10092914_B_Ift74
  gRNA
uguauuugucauaugaaaag

SEQ ID NO: 92915 - RNA, 20 nt, Artificial Sequence
  MKO10092915_B_Ift74
  gRNA
guugaaauuaaagacuuuca

SEQ ID NO: 92916 - RNA, 20 nt, Artificial Sequence
  MKO10092916_B_Ift80
  gRNA
caccaguguacucaguagcc

SEQ ID NO: 92917 - RNA, 20 nt, Artificial Sequence
  MKO10092917_B_Ift80
  gRNA
agaucaacuuuagcccagca

SEQ ID NO: 92918 - RNA, 20 nt, Artificial Sequence
  MKO10092918_B_Ift80
  gRNA
gaaaagguucuuuauacagc

SEQ ID NO: 92919 - RNA, 20 nt, Artificial Sequence
  MKO10092919_B_Ift81
  gRNA
guuucuucaagaugagaccg

SEQ ID NO: 92920 - RNA, 20 nt, Artificial Sequence
  MKO10092920_B_Ift81
  gRNA
uauccuuaaguacaaaccuc

SEQ ID NO: 92921 - RNA, 20 nt, Artificial Sequence
  MKO10092921_B_Ift81
  gRNA
ugugagcagcucaaaacauc

SEQ ID NO: 92922 - RNA, 20 nt, Artificial Sequence
  MKO10092922_B_Ift88
  gRNA
accgaugacagggacaauuc

SEQ ID NO: 92923 - RNA, 20 nt, Artificial Sequence
  MKO10092923_B_Ift88
  gRNA
ccaaccucgcaaagcugccu

SEQ ID NO: 92924 - RNA, 20 nt, Artificial Sequence
  MKO10092924_B_Ift88
  gRNA
ucuucccauugaugauguca

SEQ ID NO: 92925 - RNA, 20 nt, Artificial Sequence
  MKO10092925_B_Igbp1b
  gRNA
aacacuucgagugaggacga

SEQ ID NO: 92926 - RNA, 20 nt, Artificial Sequence
  MKO10092926_B_Igbp1b
  gRNA
aggcugacgaugagcguguc

SEQ ID NO: 92927 - RNA, 20 nt, Artificial Sequence
  MKO10092927_B_Igbp1b
  gRNA
gggcgcgcugacgcugaagc

SEQ ID NO: 92928 - RNA, 20 nt, Artificial Sequence
  MKO10092928_B_Igbp1
  gRNA
ugacagcaauccaccuccga

SEQ ID NO: 92929 - RNA, 20 nt, Artificial Sequence
  MKO10092929_B_Igbp1
  gRNA
caaaugaucuagacgcuugc

SEQ ID NO: 92930 - RNA, 20 nt, Artificial Sequence
  MKO10092930_B_Igbp1
  gRNA
cacucaccgucauaguugcc

SEQ ID NO: 92931 - RNA, 20 nt, Artificial Sequence
  MKO10092931_B_Igdcc3
  gRNA
cagucggaaggcucgucucc

SEQ ID NO: 92932 - RNA, 20 nt, Artificial Sequence
  MKO10092932_B_Igdcc3
  gRNA
accacccuccucacccguga

SEQ ID NO: 92933 - RNA, 20 nt, Artificial Sequence
  MKO10092933_B_Igdcc3
  gRNA
cacacuccagcaccgcaguc

SEQ ID NO: 92934 - RNA, 20 nt, Artificial Sequence
  MKO10092934_B_Igdcc4
  gRNA
gcaccccgagucccagauug

SEQ ID NO: 92935 - RNA, 20 nt, Artificial Sequence
  MKO10092935_B_Igdcc4
  gRNA
gaguguagugauggagugcg

SEQ ID NO: 92936 - RNA, 20 nt, Artificial Sequence
  MKO10092936_B_Igdcc4
  gRNA
cagcugcugggccuccgacc

SEQ ID NO: 92937 - RNA, 20 nt, Artificial Sequence
  MKO10092937_B_Igf1r
  gRNA
acucuucuacaacuacgcac

SEQ ID NO: 92938 - RNA, 20 nt, Artificial Sequence
  MKO10092938_B_Igf1r
  gRNA
caugaaguucuccaacuccg

SEQ ID NO: 92939 - RNA, 20 nt, Artificial Sequence
  MKO10092939_B_Igf1r
  gRNA
ccacgacgaugagugcaugc

SEQ ID NO: 92940 - RNA, 20 nt, Artificial Sequence
  MKO10092940_B_Igf1
  gRNA
uuguggaugaguguugcuuc

SEQ ID NO: 92941 - RNA, 20 nt, Artificial Sequence
  MKO10092941_B_Igf1
  gRNA
acaagaaaacgaagcugcaa

SEQ ID NO: 92942 - RNA, 20 nt, Artificial Sequence
  MKO10092942_B_Igf1
  gRNA
gacccuuugcggggcugagc

SEQ ID NO: 92943 - RNA, 20 nt, Artificial Sequence
  MKO10092943_B_Igf2bp1
  gRNA
cuuacuucccaucggagcug

SEQ ID NO: 92944 - RNA, 20 nt, Artificial Sequence
  MKO10092944_B_Igf2bp1
  gRNA
cuguaccguacugagccagc

SEQ ID NO: 92945 - RNA, 20 nt, Artificial Sequence
  MKO10092945_B_Igf2bp1
  gRNA
cacugaaagugagacagcug

SEQ ID NO: 92946 - RNA, 20 nt, Artificial Sequence
  MKO10092946_B_Igf2bp2
  gRNA
caccuauaugacaagagaag

SEQ ID NO: 92947 - RNA, 20 nt, Artificial Sequence
  MKO10092947_B_Igf2bp2
  gRNA
ugccucuucucuugucauau

SEQ ID NO: 92948 - RNA, 20 nt, Artificial Sequence
  MKO10092948_B_Igf2bp2
  gRNA
guuggcugaauaugggacag

SEQ ID NO: 92949 - RNA, 20 nt, Artificial Sequence
  MKO10092949_B_Igf2bp3
  gRNA
cuccccagugaacacggauu

SEQ ID NO: 92950 - RNA, 20 nt, Artificial Sequence
  MKO10092950_B_Igf2bp3
  gRNA
cucuuaccucccauuguaag

SEQ ID NO: 92951 - RNA, 20 nt, Artificial Sequence
  MKO10092951_B_Igf2bp3
  gRNA
uccgcucaccucugccguuu

SEQ ID NO: 92952 - RNA, 20 nt, Artificial Sequence
  MKO10092952_B_Igf2r
  gRNA
ccaccauuuagcuugaucag

SEQ ID NO: 92953 - RNA, 20 nt, Artificial Sequence
  MKO10092953_B_Igf2r
  gRNA
gacagagaacugccgcucag

SEQ ID NO: 92954 - RNA, 20 nt, Artificial Sequence
  MKO10092954_B_Igf2r
  gRNA
ccauagugguguugaauucc

SEQ ID NO: 92955 - RNA, 20 nt, Artificial Sequence
  MKO10092955_B_Igf2
  gRNA
ugcgaccccggcgggcacgc

SEQ ID NO: 92956 - RNA, 20 nt, Artificial Sequence
  MKO10092956_B_Igf2
  gRNA
uugugcugcaucgcugcuua

SEQ ID NO: 92957 - RNA, 20 nt, Artificial Sequence
  MKO10092957_B_Igf2
  gRNA
gagaugggcggcagcgucgc

SEQ ID NO: 92958 - RNA, 20 nt, Artificial Sequence
  MKO10092958_B_Igfals
  gRNA
cuaacugccugauacgauug

SEQ ID NO: 92959 - RNA, 20 nt, Artificial Sequence
  MKO10092959_B_Igfals
  gRNA
agcucggccacaaucguauc

SEQ ID NO: 92960 - RNA, 20 nt, Artificial Sequence
  MKO10092960_B_Igfals
  gRNA
auccgccugcacacuuucgc

SEQ ID NO: 92961 - RNA, 20 nt, Artificial Sequence
  MKO10092961_B_Igfbp1
  gRNA
ccucgcgggauggggccauc

SEQ ID NO: 92962 - RNA, 20 nt, Artificial Sequence
  MKO10092962_B_Igfbp1
  gRNA
ccgggcccgcaugcugcuau

SEQ ID NO: 92963 - RNA, 20 nt, Artificial Sequence
  MKO10092963_B_Igfbp1
  gRNA
aauccauucuuguugcaguu

SEQ ID NO: 92964 - RNA, 20 nt, Artificial Sequence
  MKO10092964_B_Igfbp2
  gRNA
ccaugcgccuuccggaugau

SEQ ID NO: 92965 - RNA, 20 nt, Artificial Sequence
  MKO10092965_B_Igfbp2
  gRNA
cucggggucuccccggaugg

SEQ ID NO: 92966 - RNA, 20 nt, Artificial Sequence
  MKO10092966_B_Igfbp2
  gRNA
ggccggaagccccucaaguc

SEQ ID NO: 92967 - RNA, 20 nt, Artificial Sequence
  MKO10092967_B_Igfbp3
  gRNA
uucugucucccgcuuagacu

SEQ ID NO: 92968 - RNA, 20 nt, Artificial Sequence
  MKO10092968_B_Igfbp3
  gRNA
auguacgucgucuuuccccu

SEQ ID NO: 92969 - RNA, 20 nt, Artificial Sequence
  MKO10092969_B_Igfbp3
  gRNA
ucuacuggcucugcacgcug

SEQ ID NO: 92970 - RNA, 20 nt, Artificial Sequence
  MKO10092970_B_Igfbp4
  gRNA
acggacagcguggcaagugc

SEQ ID NO: 92971 - RNA, 20 nt, Artificial Sequence
  MKO10092971_B_Igfbp4
  gRNA
acuugccacgcuguccgucc

SEQ ID NO: 92972 - RNA, 20 nt, Artificial Sequence
  MKO10092972_B_Igfbp4
  gRNA
cuugcuccgaucucuaauuu

SEQ ID NO: 92973 - RNA, 20 nt, Artificial Sequence
  MKO10092973_B_Igfbp5
  gRNA
caaguacggaaugaagcugc

SEQ ID NO: 92974 - RNA, 20 nt, Artificial Sequence
  MKO10092974_B_Igfbp5
  gRNA
cugcccaacugugaccgcaa

SEQ ID NO: 92975 - RNA, 20 nt, Artificial Sequence
  MKO10092975_B_Igfbp5
  gRNA
cacucgcauuuccgagcuga

SEQ ID NO: 92976 - RNA, 20 nt, Artificial Sequence
  MKO10092976_B_Igfbp6
  gRNA
ucuuccgaggcggagcacgu

SEQ ID NO: 92977 - RNA, 20 nt, Artificial Sequence
  MKO10092977_B_Igfbp6
  gRNA
ggaaucgccguggccccugc

SEQ ID NO: 92978 - RNA, 20 nt, Artificial Sequence
  MKO10092978_B_Igfbp6
  gRNA
accaucucacuaucuugaac

SEQ ID NO: 92979 - RNA, 20 nt, Artificial Sequence
  MKO10092979_B_Igfbp7
  gRNA
cgcggcagccaaaauuacag

SEQ ID NO: 92980 - RNA, 20 nt, Artificial Sequence
  MKO10092980_B_Igfbp7
  gRNA
gcagguaucuccucuaagua

SEQ ID NO: 92981 - RNA, 20 nt, Artificial Sequence
  MKO10092981_B_Igfbp7
  gRNA
uacugaccuuguuccagaug

SEQ ID NO: 92982 - RNA, 20 nt, Artificial Sequence
  MKO10092982_B_Igfbpl1
  gRNA
gugacauugugaauaucucg

SEQ ID NO: 92983 - RNA, 20 nt, Artificial Sequence
  MKO10092983_B_Igfbpl1
  gRNA
cagaagggcccccucgcacc

SEQ ID NO: 92984 - RNA, 20 nt, Artificial Sequence
  MKO10092984_B_Igfbpl1
  gRNA
uccaaccccucggugcccuc

SEQ ID NO: 92985 - RNA, 20 nt, Artificial Sequence
  MKO10092985_B_Igfl3
  gRNA
uaacuccuucaaguauaaac

SEQ ID NO: 92986 - RNA, 20 nt, Artificial Sequence
  MKO10092986_B_Igfl3
  gRNA
guacuccuguuuauacuuga

SEQ ID NO: 92987 - RNA, 20 nt, Artificial Sequence
  MKO10092987_B_Igfl3
  gRNA
ccgugcaaucccaaguguga

SEQ ID NO: 92988 - RNA, 20 nt, Artificial Sequence
  MKO10092988_B_Igflr1
  gRNA
aggcuuccauugacgcagcc

SEQ ID NO: 92989 - RNA, 20 nt, Artificial Sequence
  MKO10092989_B_Igflr1
  gRNA
agaaaaguccguucccgucc

SEQ ID NO: 92990 - RNA, 20 nt, Artificial Sequence
  MKO10092990_B_Igflr1
  gRNA
ugagacaaaaccuggucggc

SEQ ID NO: 92991 - RNA, 20 nt, Artificial Sequence
  MKO10092991_B_Igfn1
  gRNA
augaauuguuuacgauagcc

SEQ ID NO: 92992 - RNA, 20 nt, Artificial Sequence
  MKO10092992_B_Igfn1
  gRNA
gacucagagccggagccguc

SEQ ID NO: 92993 - RNA, 20 nt, Artificial Sequence
  MKO10092993_B_Igfn1
  gRNA
gagcuucuagaguacaaccu

SEQ ID NO: 92994 - RNA, 20 nt, Artificial Sequence
  MKO10092994_B_Ighmbp2
  gRNA
cacugcagguccaaacuucc

SEQ ID NO: 92995 - RNA, 20 nt, Artificial Sequence
  MKO10092995_B_Ighmbp2
  gRNA
aaaauccucacguauuucca

SEQ ID NO: 92996 - RNA, 20 nt, Artificial Sequence
  MKO10092996_B_Ighmbp2
  gRNA
ggaugauggcaaguucuuuc

SEQ ID NO: 92997 - RNA, 20 nt, Artificial Sequence
  MKO10092997_B_Igip
  gRNA
caagacuuugguaaauuaac

SEQ ID NO: 92998 - RNA, 20 nt, Artificial Sequence
  MKO10092998_B_Igip
  gRNA
caguggacuaaguuuauaag

SEQ ID NO: 92999 - RNA, 20 nt, Artificial Sequence
  MKO10092999_B_Igip
  gRNA
agcuuuaaucuggguaacua

SEQ ID NO: 93000 - RNA, 20 nt, Artificial Sequence
  MKO10093000_B_Igj
  gRNA
uguguacccgaguuaccucu

SEQ ID NO: 93001 - RNA, 20 nt, Artificial Sequence
  MKO10093001_B_Igj
  gRNA
aaucuuacacgucugacaaa

SEQ ID NO: 93002 - RNA, 20 nt, Artificial Sequence
  MKO10093002_B_Igj
  gRNA
caaggcugcuugcaccauuu

SEQ ID NO: 93003 - RNA, 20 nt, Artificial Sequence
  MKO10093003_B_Igll1
  gRNA
aucuacugugaggcauccac

SEQ ID NO: 93004 - RNA, 20 nt, Artificial Sequence
  MKO10093004_B_Igll1
  gRNA
acuuaccuaggauugugagc

SEQ ID NO: 93005 - RNA, 20 nt, Artificial Sequence
  MKO10093005_B_Igll1
  gRNA
aggagaacuucacacugccu

SEQ ID NO: 93006 - RNA, 20 nt, Artificial Sequence
  MKO10093006_B_Iglon5
  gRNA
gcccgacagccgccgugugc

SEQ ID NO: 93007 - RNA, 20 nt, Artificial Sequence
  MKO10093007_B_Iglon5
  gRNA
accguuggaccagugauccc

SEQ ID NO: 93008 - RNA, 20 nt, Artificial Sequence
  MKO10093008_B_Iglon5
  gRNA
ugugaacaucuccucacccg

SEQ ID NO: 93009 - RNA, 20 nt, Artificial Sequence
  MKO10093009_B_Igsf10
  gRNA
caaagugcacaccccgcaac

SEQ ID NO: 93010 - RNA, 20 nt, Artificial Sequence
  MKO10093010_B_Igsf10
  gRNA
uucaccuaaaacgccaacga

SEQ ID NO: 93011 - RNA, 20 nt, Artificial Sequence
  MKO10093011_B_Igsf10
  gRNA
gucuacaccuaguggauuag

SEQ ID NO: 93012 - RNA, 20 nt, Artificial Sequence
  MKO10093012_B_Igsf11
  gRNA
caaugcaaaccagcccgaac

SEQ ID NO: 93013 - RNA, 20 nt, Artificial Sequence
  MKO10093013_B_Igsf11
  gRNA
cgguaaauccuacccucccg

SEQ ID NO: 93014 - RNA, 20 nt, Artificial Sequence
  MKO10093014_B_Igsf11
  gRNA
ugacgucacugccgaggucc

SEQ ID NO: 93015 - RNA, 20 nt, Artificial Sequence
  MKO10093015_B_Igsf1
  gRNA
ucucuucucagggcucaauc

SEQ ID NO: 93016 - RNA, 20 nt, Artificial Sequence
  MKO10093016_B_Igsf1
  gRNA
gauguaaaccccuucauucu

SEQ ID NO: 93017 - RNA, 20 nt, Artificial Sequence
  MKO10093017_B_Igsf1
  gRNA
uuacccagugaagucauacc

SEQ ID NO: 93018 - RNA, 20 nt, Artificial Sequence
  MKO10093018_B_Igsf21
  gRNA
cuccaugugcgaguaguucg

SEQ ID NO: 93019 - RNA, 20 nt, Artificial Sequence
  MKO10093019_B_Igsf21
  gRNA
ugguaccggcuaaagggggc

SEQ ID NO: 93020 - RNA, 20 nt, Artificial Sequence
  MKO10093020_B_Igsf21
  gRNA
accacacgaucucacgcaua

SEQ ID NO: 93021 - RNA, 20 nt, Artificial Sequence
  MKO10093021_B_Igsf23
  gRNA
uggcuagugcgaggacgucc

SEQ ID NO: 93022 - RNA, 20 nt, Artificial Sequence
  MKO10093022_B_Igsf23
  gRNA
gucacuguagauuaugcccu

SEQ ID NO: 93023 - RNA, 20 nt, Artificial Sequence
  MKO10093023_B_Igsf23
  gRNA
agguaagugcccagcugauc

SEQ ID NO: 93024 - RNA, 20 nt, Artificial Sequence
  MKO10093024_B_Igsf3
  gRNA
agagcgccgcgccaguaccc

SEQ ID NO: 93025 - RNA, 20 nt, Artificial Sequence
  MKO10093025_B_Igsf3
  gRNA
uguggugucagcgcagcgac

SEQ ID NO: 93026 - RNA, 20 nt, Artificial Sequence
  MKO10093026_B_Igsf3
  gRNA
ccgggacggcaccuugcagc

SEQ ID NO: 93027 - RNA, 20 nt, Artificial Sequence
  MKO10093027_B_Igsf5
  gRNA
aaggcccagcacugccgacc

SEQ ID NO: 93028 - RNA, 20 nt, Artificial Sequence
  MKO10093028_B_Igsf5
  gRNA
accuaccugucagcugagcc

SEQ ID NO: 93029 - RNA, 20 nt, Artificial Sequence
  MKO10093029_B_Igsf5
  gRNA
augcugagauggagggcagc

SEQ ID NO: 93030 - RNA, 20 nt, Artificial Sequence
  MKO10093030_B_Igsf6
  gRNA
ucuuggcagucaaaaucuaa

SEQ ID NO: 93031 - RNA, 20 nt, Artificial Sequence
  MKO10093031_B_Igsf6
  gRNA
uacuuugaagaggacuauga

SEQ ID NO: 93032 - RNA, 20 nt, Artificial Sequence
  MKO10093032_B_Igsf6
  gRNA
auuauaccauaagagauaug

SEQ ID NO: 93033 - RNA, 20 nt, Artificial Sequence
  MKO10093033_B_Igsf8
  gRNA
accacuguacggccgcugag

SEQ ID NO: 93034 - RNA, 20 nt, Artificial Sequence
  MKO10093034_B_Igsf8
  gRNA
gcccagguacugcguaucug

SEQ ID NO: 93035 - RNA, 20 nt, Artificial Sequence
  MKO10093035_B_Igsf8
  gRNA
agggacugaucgguaccgaa

SEQ ID NO: 93036 - RNA, 20 nt, Artificial Sequence
  MKO10093036_B_Igsf9b
  gRNA
acguaccguuaauggugaga

SEQ ID NO: 93037 - RNA, 20 nt, Artificial Sequence
  MKO10093037_B_Igsf9b
  gRNA
cccgaaagcaguacacguca

SEQ ID NO: 93038 - RNA, 20 nt, Artificial Sequence
  MKO10093038_B_Igsf9b
  gRNA
gcaagugugaucagcacccg

SEQ ID NO: 93039 - RNA, 20 nt, Artificial Sequence
  MKO10093039_B_Igsf9
  gRNA
cgcugccucgcuccacccga

SEQ ID NO: 93040 - RNA, 20 nt, Artificial Sequence
  MKO10093040_B_Igsf9
  gRNA
ggcgguuaccuugcgcugug

SEQ ID NO: 93041 - RNA, 20 nt, Artificial Sequence
  MKO10093041_B_Igsf9
  gRNA
aaauuccgaggacaagaccu

SEQ ID NO: 93042 - RNA, 20 nt, Artificial Sequence
  MKO10093042_B_Igup
  gRNA
caacuuugugacuaaaucca

SEQ ID NO: 93043 - RNA, 20 nt, Artificial Sequence
  MKO10093043_B_Igup
  gRNA
ucaagcgccucaucagcccg

SEQ ID NO: 93044 - RNA, 20 nt, Artificial Sequence
  MKO10093044_B_Igup
  gRNA
uauccgggagaaucuccagc

SEQ ID NO: 93045 - RNA, 20 nt, Artificial Sequence
  MKO10093045_B_Ihh
  gRNA
cagggucuucuccggcacgu

SEQ ID NO: 93046 - RNA, 20 nt, Artificial Sequence
  MKO10093046_B_Ihh
  gRNA
agacucaggauccuccgcgu

SEQ ID NO: 93047 - RNA, 20 nt, Artificial Sequence
  MKO10093047_B_Ihh
  gRNA
cuugccuucguagcgcccgc

SEQ ID NO: 93048 - RNA, 20 nt, Artificial Sequence
  MKO10093048_B_Iigp1
  gRNA
aguuaaggcggauguccugc

SEQ ID NO: 93049 - RNA, 20 nt, Artificial Sequence
  MKO10093049_B_Iigp1
  gRNA
uguuaugucagaguccaccu

SEQ ID NO: 93050 - RNA, 20 nt, Artificial Sequence
  MKO10093050_B_Iigp1
  gRNA
acaccccaauauacccaaug

SEQ ID NO: 93051 - RNA, 20 nt, Artificial Sequence
  MKO10093051_B_Ikbip
  gRNA
ggaagaucuucuacgagucg

SEQ ID NO: 93052 - RNA, 20 nt, Artificial Sequence
  MKO10093052_B_Ikbip
  gRNA
acaaucagaaaaguuugcga

SEQ ID NO: 93053 - RNA, 20 nt, Artificial Sequence
  MKO10093053_B_Ikbip
  gRNA
ugauggcaggaaaaaccccg

SEQ ID NO: 93054 - RNA, 20 nt, Artificial Sequence
  MKO10093054_B_Ikbkap
  gRNA
agaagcagcaguucuugauc

SEQ ID NO: 93055 - RNA, 20 nt, Artificial Sequence
  MKO10093055_B_Ikbkap
  gRNA
augcagccacuuccauccuc

SEQ ID NO: 93056 - RNA, 20 nt, Artificial Sequence
  MKO10093056_B_Ikbkap
  gRNA
gugguaucucugucaugagc

SEQ ID NO: 93057 - RNA, 20 nt, Artificial Sequence
  MKO10093057_B_Ikbkb
  gRNA
cuccugucggcauugcuuga

SEQ ID NO: 93058 - RNA, 20 nt, Artificial Sequence
  MKO10093058_B_Ikbkb
  gRNA
uaggcugaaccaucccaaug

SEQ ID NO: 93059 - RNA, 20 nt, Artificial Sequence
  MKO10093059_B_Ikbkb
  gRNA
uaaggacagcuccuucccgc

SEQ ID NO: 93060 - RNA, 20 nt, Artificial Sequence
  MKO10093060_B_Ikbke
  gRNA
guccaucgggacaucaaacc

SEQ ID NO: 93061 - RNA, 20 nt, Artificial Sequence
  MKO10093061_B_Ikbke
  gRNA
gaagacccugagaacacguu

SEQ ID NO: 93062 - RNA, 20 nt, Artificial Sequence
  MKO10093062_B_Ikbke
  gRNA
ucccagguuugaugucccga

SEQ ID NO: 93063 - RNA, 20 nt, Artificial Sequence
  MKO10093063_B_Ikbkg
  gRNA
aggcugccuugcgaauggag

SEQ ID NO: 93064 - RNA, 20 nt, Artificial Sequence
  MKO10093064_B_Ikbkg
  gRNA
guuggaugaacaagcacccc

SEQ ID NO: 93065 - RNA, 20 nt, Artificial Sequence
  MKO10093065_B_Ikbkg
  gRNA
ucuccucccgcuggcugacc

SEQ ID NO: 93066 - RNA, 20 nt, Artificial Sequence
  MKO10093066_B_Ikzf1
  gRNA
ggccuuccgggcauguaccc

SEQ ID NO: 93067 - RNA, 20 nt, Artificial Sequence
  MKO10093067_B_Ikzf1
  gRNA
gaagacaauggaugucgaug

SEQ ID NO: 93068 - RNA, 20 nt, Artificial Sequence
  MKO10093068_B_Ikzf1
  gRNA
ggccggugagggcgucccuc

SEQ ID NO: 93069 - RNA, 20 nt, Artificial Sequence
  MKO10093069_B_Ikzf2
  gRNA
cauauuggcguguuccccuu

SEQ ID NO: 93070 - RNA, 20 nt, Artificial Sequence
  MKO10093070_B_Ikzf2
  gRNA
accccuaauugagagcagcg

SEQ ID NO: 93071 - RNA, 20 nt, Artificial Sequence
  MKO10093071_B_Ikzf2
  gRNA
cuacaagcagcgcagcucac

SEQ ID NO: 93072 - RNA, 20 nt, Artificial Sequence
  MKO10093072_B_Ikzf3
  gRNA
cuguagucauucagagcguc

SEQ ID NO: 93073 - RNA, 20 nt, Artificial Sequence
  MKO10093073_B_Ikzf3
  gRNA
aagaugaacugcgacgugug

SEQ ID NO: 93074 - RNA, 20 nt, Artificial Sequence
  MKO10093074_B_Ikzf3
  gRNA
uuuagauauacaaccgacug

SEQ ID NO: 93075 - RNA, 20 nt, Artificial Sequence
  MKO10093075_B_Ikzf4
  gRNA
cccccgagugcagcuugaug

SEQ ID NO: 93076 - RNA, 20 nt, Artificial Sequence
  MKO10093076_B_Ikzf4
  gRNA
aagcucaagugcgacgucug

SEQ ID NO: 93077 - RNA, 20 nt, Artificial Sequence
  MKO10093077_B_Ikzf4
  gRNA
ucacccagccgcucgcucag

SEQ ID NO: 93078 - RNA, 20 nt, Artificial Sequence
  MKO10093078_B_Ikzf5
  gRNA
ugaaaagaaaccagagccuu

SEQ ID NO: 93079 - RNA, 20 nt, Artificial Sequence
  MKO10093079_B_Ikzf5
  gRNA
uguucacaugaugcgucugc

SEQ ID NO: 93080 - RNA, 20 nt, Artificial Sequence
  MKO10093080_B_Ikzf5
  gRNA
ccugaugugcucaaugagcc

SEQ ID NO: 93081 - RNA, 20 nt, Artificial Sequence
  MKO10093081_B_Ik
  gRNA
ucauccucauuguacucccu

SEQ ID NO: 93082 - RNA, 20 nt, Artificial Sequence
  MKO10093082_B_Ik
  gRNA
ucauccacaucguggccauc

SEQ ID NO: 93083 - RNA, 20 nt, Artificial Sequence
  MKO10093083_B_Ik
  gRNA
gagaacucgcagagaaauac

SEQ ID NO: 93084 - RNA, 20 nt, Artificial Sequence
  MKO10093084_B_Il10ra
  gRNA
ggugaacguugugagaucac

SEQ ID NO: 93085 - RNA, 20 nt, Artificial Sequence
  MKO10093085_B_Il10ra
  gRNA
ugaguacgaacaagucuuca

SEQ ID NO: 93086 - RNA, 20 nt, Artificial Sequence
  MKO10093086_B_Il10ra
  gRNA
cuuggaaucccgaauuaaca

SEQ ID NO: 93087 - RNA, 20 nt, Artificial Sequence
  MKO10093087_B_Il10rb
  gRNA
ugaauuggcggaugaacauu

SEQ ID NO: 93088 - RNA, 20 nt, Artificial Sequence
  MKO10093088_B_Il10rb
  gRNA
aaugauuccacccccugaga

SEQ ID NO: 93089 - RNA, 20 nt, Artificial Sequence
  MKO10093089_B_Il10rb
  gRNA
gaauucauucugaccuucuc

SEQ ID NO: 93090 - RNA, 20 nt, Artificial Sequence
  MKO10093090_B_Il10
  gRNA
cuuggguugccaagccuuau

SEQ ID NO: 93091 - RNA, 20 nt, Artificial Sequence
  MKO10093091_B_Il10
  gRNA
gaagaugucaaauucauuca

SEQ ID NO: 93092 - RNA, 20 nt, Artificial Sequence
  MKO10093092_B_Il10
  gRNA
cccacacagcuccaagacca

SEQ ID NO: 93093 - RNA, 20 nt, Artificial Sequence
  MKO10093093_B_Il11ra1
  gRNA
cacagcaucacgggccugcc

SEQ ID NO: 93094 - RNA, 20 nt, Artificial Sequence
  MKO10093094_B_Il11ra1
  gRNA
cuaacucacagcccagcuuc

SEQ ID NO: 93095 - RNA, 20 nt, Artificial Sequence
  MKO10093095_B_Il11ra1
  gRNA
ccuccaggacuccagugucc

SEQ ID NO: 93096 - RNA, 20 nt, Artificial Sequence
  MKO10093096_B_Il11ra2
  gRNA
cuaacucacagcccagcuuc

SEQ ID NO: 93097 - RNA, 20 nt, Artificial Sequence
  MKO10093097_B_Il11ra2
  gRNA
uccugaagucucuugccaag

SEQ ID NO: 93098 - RNA, 20 nt, Artificial Sequence
  MKO10093098_B_Il11ra2
  gRNA
acacauaccuguaggaagua

SEQ ID NO: 93099 - RNA, 20 nt, Artificial Sequence
  MKO10093099_B_Il11
  gRNA
uucagacccucgagcagauc

SEQ ID NO: 93100 - RNA, 20 nt, Artificial Sequence
  MKO10093100_B_Il11
  gRNA
agacugugaucuccgucagc

SEQ ID NO: 93101 - RNA, 20 nt, Artificial Sequence
  MKO10093101_B_Il11
  gRNA
ucccaaugucccagcgcuca

SEQ ID NO: 93102 - RNA, 20 nt, Artificial Sequence
  MKO10093102_B_Il12a
  gRNA
aagaagucucucuaguagcc

SEQ ID NO: 93103 - RNA, 20 nt, Artificial Sequence
  MKO10093103_B_Il12a
  gRNA
ucuucagcagguuucgggac

SEQ ID NO: 93104 - RNA, 20 nt, Artificial Sequence
  MKO10093104_B_Il12a
  gRNA
ccuccuaaaccaccucaguu

SEQ ID NO: 93105 - RNA, 20 nt, Artificial Sequence
  MKO10093105_B_Il12b
  gRNA
gacuggacucccgaugcccc

SEQ ID NO: 93106 - RNA, 20 nt, Artificial Sequence
  MKO10093106_B_Il12b
  gRNA
aauuuggugcuucacacuuc

SEQ ID NO: 93107 - RNA, 20 nt, Artificial Sequence
  MKO10093107_B_Il12b
  gRNA
caguacaccugccacaaagg

SEQ ID NO: 93108 - RNA, 20 nt, Artificial Sequence
  MKO10093108_B_Il12rb1
  gRNA
cgcugccgcuacuucuccuc

SEQ ID NO: 93109 - RNA, 20 nt, Artificial Sequence
  MKO10093109_B_Il12rb1
  gRNA
ccuccgaaccauacccacac

SEQ ID NO: 93110 - RNA, 20 nt, Artificial Sequence
  MKO10093110_B_Il12rb1
  gRNA
gucggaccugaggcucccuc

SEQ ID NO: 93111 - RNA, 20 nt, Artificial Sequence
  MKO10093111_B_Il12rb2
  gRNA
gagaucuccaccccacauac

SEQ ID NO: 93112 - RNA, 20 nt, Artificial Sequence
  MKO10093112_B_Il12rb2
  gRNA
uuccaggacgugcuguuaag

SEQ ID NO: 93113 - RNA, 20 nt, Artificial Sequence
  MKO10093113_B_Il12rb2
  gRNA
ucaaaacauaucaugugucc

SEQ ID NO: 93114 - RNA, 20 nt, Artificial Sequence
  MKO10093114_B_Il13ra1
  gRNA
aaaaucucugcacgauaaua

SEQ ID NO: 93115 - RNA, 20 nt, Artificial Sequence
  MKO10093115_B_Il13ra1
  gRNA
ugacugagcucaagugcauu

SEQ ID NO: 93116 - RNA, 20 nt, Artificial Sequence
  MKO10093116_B_Il13ra1
  gRNA
acaucagaacguucaaauaa

SEQ ID NO: 93117 - RNA, 20 nt, Artificial Sequence
  MKO10093117_B_Il13ra2
  gRNA
ucagaauauacugucuugcc

SEQ ID NO: 93118 - RNA, 20 nt, Artificial Sequence
  MKO10093118_B_Il13ra2
  gRNA
ucaaacagacuauaauuacu

SEQ ID NO: 93119 - RNA, 20 nt, Artificial Sequence
  MKO10093119_B_Il13ra2
  gRNA
gauggguuugaucuuaauaa

SEQ ID NO: 93120 - RNA, 20 nt, Artificial Sequence
  MKO10093120_B_Il13
  gRNA
acaaagcaacuguuucgcca

SEQ ID NO: 93121 - RNA, 20 nt, Artificial Sequence
  MKO10093121_B_Il13
  gRNA
cucugggcuucauggcgcuc

SEQ ID NO: 93122 - RNA, 20 nt, Artificial Sequence
  MKO10093122_B_Il13
  gRNA
cuccucauuagaaggggccg

SEQ ID NO: 93123 - RNA, 20 nt, Artificial Sequence
  MKO10093123_B_Il15ra
  gRNA
cacaguuccaaaaugacgaa

SEQ ID NO: 93124 - RNA, 20 nt, Artificial Sequence
  MKO10093124_B_Il15ra
  gRNA
uaguuccugcagaaguuguu

SEQ ID NO: 93125 - RNA, 20 nt, Artificial Sequence
  MKO10093125_B_Il15ra
  gRNA
ucaccuugauuugauguacc

SEQ ID NO: 93126 - RNA, 20 nt, Artificial Sequence
  MKO10093126_B_Il15
  gRNA
auaucuuacaucuauccagu

SEQ ID NO: 93127 - RNA, 20 nt, Artificial Sequence
  MKO10093127_B_Il15
  gRNA
gucacugucaguguauaaag

SEQ ID NO: 93128 - RNA, 20 nt, Artificial Sequence
  MKO10093128_B_Il15
  gRNA
cagcacucugucuucuaaca

SEQ ID NO: 93129 - RNA, 20 nt, Artificial Sequence
  MKO10093129_B_Il16
  gRNA
gcugugcucagugaccgagu

SEQ ID NO: 93130 - RNA, 20 nt, Artificial Sequence
  MKO10093130_B_Il16
  gRNA
gcccuucaucagcacuaugu

SEQ ID NO: 93131 - RNA, 20 nt, Artificial Sequence
  MKO10093131_B_Il16
  gRNA
cucuucacauaaauuccaau

SEQ ID NO: 93132 - RNA, 20 nt, Artificial Sequence
  MKO10093132_B_Il17a
  gRNA
ccuccgcauugacacagcgc

SEQ ID NO: 93133 - RNA, 20 nt, Artificial Sequence
  MKO10093133_B_Il17a
  gRNA
cugccuucacuguagccgcc

SEQ ID NO: 93134 - RNA, 20 nt, Artificial Sequence
  MKO10093134_B_Il17a
  gRNA
accacagaugaagcucuccc

SEQ ID NO: 93135 - RNA, 20 nt, Artificial Sequence
  MKO10093135_B_Il17b
  gRNA
ggacagaggcggcggcgcac

SEQ ID NO: 93136 - RNA, 20 nt, Artificial Sequence
  MKO10093136_B_Il17b
  gRNA
gauggacuggccgcacagcc

SEQ ID NO: 93137 - RNA, 20 nt, Artificial Sequence
  MKO10093137_B_Il17b
  gRNA
gcaccacguaccaggcugug

SEQ ID NO: 93138 - RNA, 20 nt, Artificial Sequence
  MKO10093138_B_Il17c
  gRNA
aggauugugaugcgccacag

SEQ ID NO: 93139 - RNA, 20 nt, Artificial Sequence
  MKO10093139_B_Il17c
  gRNA
cccaccaagaucccccgucc

SEQ ID NO: 93140 - RNA, 20 nt, Artificial Sequence
  MKO10093140_B_Il17c
  gRNA
ccucagcagaguagcaccgc

SEQ ID NO: 93141 - RNA, 20 nt, Artificial Sequence
  MKO10093141_B_Il17d
  gRNA
ugcugcuggggcccgccgac

SEQ ID NO: 93142 - RNA, 20 nt, Artificial Sequence
  MKO10093142_B_Il17d
  gRNA
cgacgcgauguuggggacac

SEQ ID NO: 93143 - RNA, 20 nt, Artificial Sequence
  MKO10093143_B_Il17d
  gRNA
agacgggugugcugcgaaag

SEQ ID NO: 93144 - RNA, 20 nt, Artificial Sequence
  MKO10093144_B_Il17f
  gRNA
gcaucacucgagacccccac

SEQ ID NO: 93145 - RNA, 20 nt, Artificial Sequence
  MKO10093145_B_Il17f
  gRNA
cucucacaguguuauccucc

SEQ ID NO: 93146 - RNA, 20 nt, Artificial Sequence
  MKO10093146_B_Il17f
  gRNA
cacucaccauggcuguuuca

SEQ ID NO: 93147 - RNA, 20 nt, Artificial Sequence
  MKO10093147_B_Il17ra
  gRNA
guccacucaacaugcaacac

SEQ ID NO: 93148 - RNA, 20 nt, Artificial Sequence
  MKO10093148_B_Il17ra
  gRNA
gaacagucacuucauacucc

SEQ ID NO: 93149 - RNA, 20 nt, Artificial Sequence
  MKO10093149_B_Il17ra
  gRNA
agccagcauccuguaccucg

SEQ ID NO: 93150 - RNA, 20 nt, Artificial Sequence
  MKO10093150_B_Il17rb
  gRNA
uugucuugacgaguuccacu

SEQ ID NO: 93151 - RNA, 20 nt, Artificial Sequence
  MKO10093151_B_Il17rb
  gRNA
agacuugagggaccuccaag

SEQ ID NO: 93152 - RNA, 20 nt, Artificial Sequence
  MKO10093152_B_Il17rb
  gRNA
uuccugcagacuauucagug

SEQ ID NO: 93153 - RNA, 20 nt, Artificial Sequence
  MKO10093153_B_Il17rc
  gRNA
uugcgcccucuguguccgug

SEQ ID NO: 93154 - RNA, 20 nt, Artificial Sequence
  MKO10093154_B_Il17rc
  gRNA
gguccaggugcccgcugacc

SEQ ID NO: 93155 - RNA, 20 nt, Artificial Sequence
  MKO10093155_B_Il17rc
  gRNA
ccucaccguuccuagacucc

SEQ ID NO: 93156 - RNA, 20 nt, Artificial Sequence
  MKO10093156_B_Il17rd
  gRNA
gugccaacagcugauucuaa

SEQ ID NO: 93157 - RNA, 20 nt, Artificial Sequence
  MKO10093157_B_Il17rd
  gRNA
ccgucucaaauuucauauuc

SEQ ID NO: 93158 - RNA, 20 nt, Artificial Sequence
  MKO10093158_B_Il17rd
  gRNA
accccguguucugaagaaga

SEQ ID NO: 93159 - RNA, 20 nt, Artificial Sequence
  MKO10093159_B_Il17re
  gRNA
aggguuucgcagggugugag

SEQ ID NO: 93160 - RNA, 20 nt, Artificial Sequence
  MKO10093160_B_Il17re
  gRNA
guuguaccuuaaagcagagc

SEQ ID NO: 93161 - RNA, 20 nt, Artificial Sequence
  MKO10093161_B_Il17re
  gRNA
ucugcccugcaugugcauag

SEQ ID NO: 93162 - RNA, 20 nt, Artificial Sequence
  MKO10093162_B_Il18bp
  gRNA
ugagcuuccaguuaagacag

SEQ ID NO: 93163 - RNA, 20 nt, Artificial Sequence
  MKO10093163_B_Il18bp
  gRNA
aaccauugcccagccaguag

SEQ ID NO: 93164 - RNA, 20 nt, Artificial Sequence
  MKO10093164_B_Il18bp
  gRNA
agugcuggguacugcuuagu

SEQ ID NO: 93165 - RNA, 20 nt, Artificial Sequence
  MKO10093165_B_Il18r1
  gRNA
uguuguaccgugucccauua

SEQ ID NO: 93166 - RNA, 20 nt, Artificial Sequence
  MKO10093166_B_Il18r1
  gRNA
cuaccacaugaauuugugau

SEQ ID NO: 93167 - RNA, 20 nt, Artificial Sequence
  MKO10093167_B_Il18r1
  gRNA
uaacuaugaagagcugaucc

SEQ ID NO: 93168 - RNA, 20 nt, Artificial Sequence
  MKO10093168_B_Il18rap
  gRNA
gugguuaaagugagaaccau

SEQ ID NO: 93169 - RNA, 20 nt, Artificial Sequence
  MKO10093169_B_Il18rap
  gRNA
uaagacugucuugauacaac

SEQ ID NO: 93170 - RNA, 20 nt, Artificial Sequence
  MKO10093170_B_Il18rap
  gRNA
ggaucccauuacagauacac

SEQ ID NO: 93171 - RNA, 20 nt, Artificial Sequence
  MKO10093171_B_Il18
  gRNA
ggaaaugaucuuguucuuac

SEQ ID NO: 93172 - RNA, 20 nt, Artificial Sequence
  MKO10093172_B_Il18
  gRNA
uucuuucagaaacguguucc

SEQ ID NO: 93173 - RNA, 20 nt, Artificial Sequence
  MKO10093173_B_Il18
  gRNA
aacuccaucuuguugugucc

SEQ ID NO: 93174 - RNA, 20 nt, Artificial Sequence
  MKO10093174_B_Il19
  gRNA
cauccaugacaacuacaauc

SEQ ID NO: 93175 - RNA, 20 nt, Artificial Sequence
  MKO10093175_B_Il19
  gRNA
gucaugcagcacacaucucc

SEQ ID NO: 93176 - RNA, 20 nt, Artificial Sequence
  MKO10093176_B_Il19
  gRNA
augguaccuuaaugcuccug

SEQ ID NO: 93177 - RNA, 20 nt, Artificial Sequence
  MKO10093177_B_Il1a
  gRNA
aacacuaucucagcaccacu

SEQ ID NO: 93178 - RNA, 20 nt, Artificial Sequence
  MKO10093178_B_Il1a
  gRNA
guaucagcaacgucaagcaa

SEQ ID NO: 93179 - RNA, 20 nt, Artificial Sequence
  MKO10093179_B_Il1a
  gRNA
uccuucuaugaugcaagcua

SEQ ID NO: 93180 - RNA, 20 nt, Artificial Sequence
  MKO10093180_B_Il1b
  gRNA
guccgucaacuucaaagaac

SEQ ID NO: 93181 - RNA, 20 nt, Artificial Sequence
  MKO10093181_B_Il1b
  gRNA
gcugcugcgagauuugaagc

SEQ ID NO: 93182 - RNA, 20 nt, Artificial Sequence
  MKO10093182_B_Il1b
  gRNA
ccuguagugcaguugucuaa

SEQ ID NO: 93183 - RNA, 20 nt, Artificial Sequence
  MKO10093183_B_Il1f10
  gRNA
uggggaccuuggagcggucu

SEQ ID NO: 93184 - RNA, 20 nt, Artificial Sequence
  MKO10093184_B_Il1f10
  gRNA
acggaauggccagcuccugc

SEQ ID NO: 93185 - RNA, 20 nt, Artificial Sequence
  MKO10093185_B_Il1f10
  gRNA
uuuguucaccucccuuguau

SEQ ID NO: 93186 - RNA, 20 nt, Artificial Sequence
  MKO10093186_B_Il1f5
  gRNA
cuggcauccagugcccgauu

SEQ ID NO: 93187 - RNA, 20 nt, Artificial Sequence
  MKO10093187_B_Il1f5
  gRNA
gugcagauacaguaccuuca

SEQ ID NO: 93188 - RNA, 20 nt, Artificial Sequence
  MKO10093188_B_Il1f5
  gRNA
uggaggacugcacgcagaga

SEQ ID NO: 93189 - RNA, 20 nt, Artificial Sequence
  MKO10093189_B_Il1f6
  gRNA
cagacagcgaugaaccaacc

SEQ ID NO: 93190 - RNA, 20 nt, Artificial Sequence
  MKO10093190_B_Il1f6
  gRNA
acacucuugagacgaacagg

SEQ ID NO: 93191 - RNA, 20 nt, Artificial Sequence
  MKO10093191_B_Il1f6
  gRNA
cuugcucccaugccaauauc

SEQ ID NO: 93192 - RNA, 20 nt, Artificial Sequence
  MKO10093192_B_Il1f8
  gRNA
gcuagcaacaaugucaagcc

SEQ ID NO: 93193 - RNA, 20 nt, Artificial Sequence
  MKO10093193_B_Il1f8
  gRNA
gauuucuguucuugauuccc

SEQ ID NO: 93194 - RNA, 20 nt, Artificial Sequence
  MKO10093194_B_Il1f8
  gRNA
gauuaccuuucuuuacaucu

SEQ ID NO: 93195 - RNA, 20 nt, Artificial Sequence
  MKO10093195_B_Il1f9
  gRNA
auguuccaccuguccgggug

SEQ ID NO: 93196 - RNA, 20 nt, Artificial Sequence
  MKO10093196_B_Il1f9
  gRNA
guacccagagucucuugaac

SEQ ID NO: 93197 - RNA, 20 nt, Artificial Sequence
  MKO10093197_B_Il1f9
  gRNA
uauauugccuccuccaagac

SEQ ID NO: 93198 - RNA, 20 nt, Artificial Sequence
  MKO10093198_B_Il1r1
  gRNA
cagcaagacccccauaucag

SEQ ID NO: 93199 - RNA, 20 nt, Artificial Sequence
  MKO10093199_B_Il1r1
  gRNA
acgaaauuaccuuauaccac

SEQ ID NO: 93200 - RNA, 20 nt, Artificial Sequence
  MKO10093200_B_Il1r1
  gRNA
ugaaaauaaugaguuacccg

SEQ ID NO: 93201 - RNA, 20 nt, Artificial Sequence
  MKO10093201_B_Il1r2
  gRNA
gaugucggagugaggugcca

SEQ ID NO: 93202 - RNA, 20 nt, Artificial Sequence
  MKO10093202_B_Il1r2
  gRNA
uucaucuccagcaacgcuga

SEQ ID NO: 93203 - RNA, 20 nt, Artificial Sequence
  MKO10093203_B_Il1r2
  gRNA
ggagacaacugucaguuucg

SEQ ID NO: 93204 - RNA, 20 nt, Artificial Sequence
  MKO10093204_B_Il1rapl1
  gRNA
gaauccauaccuuguaccaa

SEQ ID NO: 93205 - RNA, 20 nt, Artificial Sequence
  MKO10093205_B_Il1rapl1
  gRNA
acgacugaguuaacuguuac

SEQ ID NO: 93206 - RNA, 20 nt, Artificial Sequence
  MKO10093206_B_Il1rapl1
  gRNA
acaguucaggagacucaacu

SEQ ID NO: 93207 - RNA, 20 nt, Artificial Sequence
  MKO10093207_B_Il1rapl2
  gRNA
guaccgggcucaggcucaug

SEQ ID NO: 93208 - RNA, 20 nt, Artificial Sequence
  MKO10093208_B_Il1rapl2
  gRNA
uauccgcaccaacuacagca

SEQ ID NO: 93209 - RNA, 20 nt, Artificial Sequence
  MKO10093209_B_Il1rapl2
  gRNA
agcuggacaucuauaacacu

SEQ ID NO: 93210 - RNA, 20 nt, Artificial Sequence
  MKO10093210_B_Il1rap
  gRNA
cuuucauaauguacuacccg

SEQ ID NO: 93211 - RNA, 20 nt, Artificial Sequence
  MKO10093211_B_Il1rap
  gRNA
ggaaaguauccgucuacauu

SEQ ID NO: 93212 - RNA, 20 nt, Artificial Sequence
  MKO10093212_B_Il1rap
  gRNA
cacccgaagcaugacucugc

SEQ ID NO: 93213 - RNA, 20 nt, Artificial Sequence
  MKO10093213_B_Il1rl1
  gRNA
gucgaguacaucaaauaauc

SEQ ID NO: 93214 - RNA, 20 nt, Artificial Sequence
  MKO10093214_B_Il1rl1
  gRNA
uggaaccaacuacaucguga

SEQ ID NO: 93215 - RNA, 20 nt, Artificial Sequence
  MKO10093215_B_Il1rl1
  gRNA
cacguugucaaugaacaagu

SEQ ID NO: 93216 - RNA, 20 nt, Artificial Sequence
  MKO10093216_B_Il1rl2
  gRNA
uuaucagaggaaguugagua

SEQ ID NO: 93217 - RNA, 20 nt, Artificial Sequence
  MKO10093217_B_Il1rl2
  gRNA
aacuccauugaaguuccacu

SEQ ID NO: 93218 - RNA, 20 nt, Artificial Sequence
  MKO10093218_B_Il1rl2
  gRNA
acaagaagcuuugcuccuga

SEQ ID NO: 93219 - RNA, 20 nt, Artificial Sequence
  MKO10093219_B_Il1rn
  gRNA
ggcaguacuauuggucuucc

SEQ ID NO: 93220 - RNA, 20 nt, Artificial Sequence
  MKO10093220_B_Il1rn
  gRNA
ccugaaggcuugcaucuugc

SEQ ID NO: 93221 - RNA, 20 nt, Artificial Sequence
  MKO10093221_B_Il1rn
  gRNA
gaggcagccugccgcccuuc

SEQ ID NO: 93222 - RNA, 20 nt, Artificial Sequence
  MKO10093222_B_Il20ra
  gRNA
cacucuguauuguguccacg

SEQ ID NO: 93223 - RNA, 20 nt, Artificial Sequence
  MKO10093223_B_Il20ra
  gRNA
ucaacuccguguagacucuc

SEQ ID NO: 93224 - RNA, 20 nt, Artificial Sequence
  MKO10093224_B_Il20ra
  gRNA
acaugaagaauguccugcau

SEQ ID NO: 93225 - RNA, 20 nt, Artificial Sequence
  MKO10093225_B_Il20rb
  gRNA
ccuugcaucuccacacacgu

SEQ ID NO: 93226 - RNA, 20 nt, Artificial Sequence
  MKO10093226_B_Il20rb
  gRNA
gcucuauuguguggaguauc

SEQ ID NO: 93227 - RNA, 20 nt, Artificial Sequence
  MKO10093227_B_Il20rb
  gRNA
cacugaacaugggcugcauc

SEQ ID NO: 93228 - RNA, 20 nt, Artificial Sequence
  MKO10093228_B_Il20
  gRNA
aauucugagucacuucauag

SEQ ID NO: 93229 - RNA, 20 nt, Artificial Sequence
  MKO10093229_B_Il20
  gRNA
cauucuucugagauggaugg

SEQ ID NO: 93230 - RNA, 20 nt, Artificial Sequence
  MKO10093230_B_Il20
  gRNA
ugagucuuugaaagacauaa

SEQ ID NO: 93231 - RNA, 20 nt, Artificial Sequence
  MKO10093231_B_Il21r
  gRNA
ccaggugagacugaguaugc

SEQ ID NO: 93232 - RNA, 20 nt, Artificial Sequence
  MKO10093232_B_Il21r
  gRNA
gguuggggcuccgugucucc

SEQ ID NO: 93233 - RNA, 20 nt, Artificial Sequence
  MKO10093233_B_Il21r
  gRNA
agaccuucugcagccuacac

SEQ ID NO: 93234 - RNA, 20 nt, Artificial Sequence
  MKO10093234_B_Il21
  gRNA
gaguuuggccuucugaaaac

SEQ ID NO: 93235 - RNA, 20 nt, Artificial Sequence
  MKO10093235_B_Il21
  gRNA
aucagcuccacaagauguaa

SEQ ID NO: 93236 - RNA, 20 nt, Artificial Sequence
  MKO10093236_B_Il21
  gRNA
aauuccuagaaagacuaaaa

SEQ ID NO: 93237 - RNA, 20 nt, Artificial Sequence
  MKO10093237_B_Il22ra1
  gRNA
cgaucagucaucuuugugac

SEQ ID NO: 93238 - RNA, 20 nt, Artificial Sequence
  MKO10093238_B_Il22ra1
  gRNA
gauccgcuggcagcccgccu

SEQ ID NO: 93239 - RNA, 20 nt, Artificial Sequence
  MKO10093239_B_Il22ra1
  gRNA
acuuugagaacaucuugacg

SEQ ID NO: 93240 - RNA, 20 nt, Artificial Sequence
  MKO10093240_B_Il22ra2
  gRNA
gacccauacgagcuguauua

SEQ ID NO: 93241 - RNA, 20 nt, Artificial Sequence
  MKO10093241_B_Il22ra2
  gRNA
ucauuccagcuacugcguag

SEQ ID NO: 93242 - RNA, 20 nt, Artificial Sequence
  MKO10093242_B_Il22ra2
  gRNA
ggcgucagagauacacgagc

SEQ ID NO: 93243 - RNA, 20 nt, Artificial Sequence
  MKO10093243_B_Il22
  gRNA
gcugagcugauugcugaguu

SEQ ID NO: 93244 - RNA, 20 nt, Artificial Sequence
  MKO10093244_B_Il22
  gRNA
ucagugcuaccugaugaagc

SEQ ID NO: 93245 - RNA, 20 nt, Artificial Sequence
  MKO10093245_B_Il22
  gRNA
ucagccuucugacauucuuc

SEQ ID NO: 93246 - RNA, 20 nt, Artificial Sequence
  MKO10093246_B_Il23a
  gRNA
caagauccuucgaagccucc

SEQ ID NO: 93247 - RNA, 20 nt, Artificial Sequence
  MKO10093247_B_Il23a
  gRNA
caacuucacaccucccuacu

SEQ ID NO: 93248 - RNA, 20 nt, Artificial Sequence
  MKO10093248_B_Il23a
  gRNA
aaccaucuucacacuggaua

SEQ ID NO: 93249 - RNA, 20 nt, Artificial Sequence
  MKO10093249_B_Il23r
  gRNA
ugugucauuuaugaauacuc

SEQ ID NO: 93250 - RNA, 20 nt, Artificial Sequence
  MKO10093250_B_Il23r
  gRNA
accaucugaagagcacauaa

SEQ ID NO: 93251 - RNA, 20 nt, Artificial Sequence
  MKO10093251_B_Il23r
  gRNA
aucuccacugacucacugca

SEQ ID NO: 93252 - RNA, 20 nt, Artificial Sequence
  MKO10093252_B_Il24
  gRNA
uguugaagccgcagguucug

SEQ ID NO: 93253 - RNA, 20 nt, Artificial Sequence
  MKO10093253_B_Il24
  gRNA
uuugggucuugccaagugac

SEQ ID NO: 93254 - RNA, 20 nt, Artificial Sequence
  MKO10093254_B_Il24
  gRNA
uguucaaguagaacuucagc

SEQ ID NO: 93255 - RNA, 20 nt, Artificial Sequence
  MKO10093255_B_Il25
  gRNA
aggauggcccccucaacagc

SEQ ID NO: 93256 - RNA, 20 nt, Artificial Sequence
  MKO10093256_B_Il25
  gRNA
agugggacggaguugcccag

SEQ ID NO: 93257 - RNA, 20 nt, Artificial Sequence
  MKO10093257_B_Il25
  gRNA
cccacuuuaccacaaccaga

SEQ ID NO: 93258 - RNA, 20 nt, Artificial Sequence
  MKO10093258_B_Il27ra
  gRNA
ccacugcagugcuacagcgu

SEQ ID NO: 93259 - RNA, 20 nt, Artificial Sequence
  MKO10093259_B_Il27ra
  gRNA
aauggucacccaacucuguu

SEQ ID NO: 93260 - RNA, 20 nt, Artificial Sequence
  MKO10093260_B_Il27ra
  gRNA
ccucaccuaagaauggcguc

SEQ ID NO: 93261 - RNA, 20 nt, Artificial Sequence
  MKO10093261_B_Il27
  gRNA
ggucccgaacagcccgagac

SEQ ID NO: 93262 - RNA, 20 nt, Artificial Sequence
  MKO10093262_B_Il27
  gRNA
gcuuccucgcuaccacacuu

SEQ ID NO: 93263 - RNA, 20 nt, Artificial Sequence
  MKO10093263_B_Il27
  gRNA
gcacaggcaccuccgcuuuc

SEQ ID NO: 93264 - RNA, 20 nt, Artificial Sequence
  MKO10093264_B_Il2ra
  gRNA
uuuccgaagacuaaaggaau

SEQ ID NO: 93265 - RNA, 20 nt, Artificial Sequence
  MKO10093265_B_Il2ra
  gRNA
gugucuguaugacccacccg

SEQ ID NO: 93266 - RNA, 20 nt, Artificial Sequence
  MKO10093266_B_Il2ra
  gRNA
ucuuaccuguaagguucucu

SEQ ID NO: 93267 - RNA, 20 nt, Artificial Sequence
  MKO10093267_B_Il2rb
  gRNA
uuaccucugggaacgacccg

SEQ ID NO: 93268 - RNA, 20 nt, Artificial Sequence
  MKO10093268_B_Il2rb
  gRNA
uccaugccaagucgaaccug

SEQ ID NO: 93269 - RNA, 20 nt, Artificial Sequence
  MKO10093269_B_Il2rb
  gRNA
ucugucugcaguucgccugg

SEQ ID NO: 93270 - RNA, 20 nt, Artificial Sequence
  MKO10093270_B_Il2rg
  gRNA
ccaaccucacgcugcacuau

SEQ ID NO: 93271 - RNA, 20 nt, Artificial Sequence
  MKO10093271_B_Il2rg
  gRNA
agcugaaacgguacacauuu

SEQ ID NO: 93272 - RNA, 20 nt, Artificial Sequence
  MKO10093272_B_Il2rg
  gRNA
cccgauuaccaagauucugu

SEQ ID NO: 93273 - RNA, 20 nt, Artificial Sequence
  MKO10093273_B_Il2
  gRNA
cuccacuucaagcucuacag

SEQ ID NO: 93274 - RNA, 20 nt, Artificial Sequence
  MKO10093274_B_Il2
  gRNA
aaauccagaacaugccgcag

SEQ ID NO: 93275 - RNA, 20 nt, Artificial Sequence
  MKO10093275_B_Il2
  gRNA
acaggaaccugaaacucccc

SEQ ID NO: 93276 - RNA, 20 nt, Artificial Sequence
  MKO10093276_B_Il31ra
  gRNA
ucugucgaaguaaaagacgc

SEQ ID NO: 93277 - RNA, 20 nt, Artificial Sequence
  MKO10093277_B_Il31ra
  gRNA
ugaaccugaaucguagagcc

SEQ ID NO: 93278 - RNA, 20 nt, Artificial Sequence
  MKO10093278_B_Il31ra
  gRNA
gaacugucaacaguagccac

SEQ ID NO: 93279 - RNA, 20 nt, Artificial Sequence
  MKO10093279_B_Il31
  gRNA
ugcuaugaugaccgagaugu

SEQ ID NO: 93280 - RNA, 20 nt, Artificial Sequence
  MKO10093280_B_Il31
  gRNA
gucgccaugaucuuccacac

SEQ ID NO: 93281 - RNA, 20 nt, Artificial Sequence
  MKO10093281_B_Il31
  gRNA
gguaccuguguggaagauca

SEQ ID NO: 93282 - RNA, 20 nt, Artificial Sequence
  MKO10093282_B_Il33
  gRNA
uacugcaugagacuccguuc

SEQ ID NO: 93283 - RNA, 20 nt, Artificial Sequence
  MKO10093283_B_Il33
  gRNA
gaucucuuccuagaaucccg

SEQ ID NO: 93284 - RNA, 20 nt, Artificial Sequence
  MKO10093284_B_Il33
  gRNA
guugacacauugagcaucca

SEQ ID NO: 93285 - RNA, 20 nt, Artificial Sequence
  MKO10093285_B_Il34
  gRNA
gaacguacagcggagccuca

SEQ ID NO: 93286 - RNA, 20 nt, Artificial Sequence
  MKO10093286_B_Il34
  gRNA
auuacuuccccaucaacuac

SEQ ID NO: 93287 - RNA, 20 nt, Artificial Sequence
  MKO10093287_B_Il34
  gRNA
cacagcaauccuguaguuga

SEQ ID NO: 93288 - RNA, 20 nt, Artificial Sequence
  MKO10093288_B_Il3ra
  gRNA
agcgcggccacugccguuga

SEQ ID NO: 93289 - RNA, 20 nt, Artificial Sequence
  MKO10093289_B_Il3ra
  gRNA
ugcacgucacccguugcuuu

SEQ ID NO: 93290 - RNA, 20 nt, Artificial Sequence
  MKO10093290_B_Il3ra
  gRNA
agccuugaugucaacaccgc

SEQ ID NO: 93291 - RNA, 20 nt, Artificial Sequence
  MKO10093291_B_Il3
  gRNA
uugauaacguaucuguccuc

SEQ ID NO: 93292 - RNA, 20 nt, Artificial Sequence
  MKO10093292_B_Il3
  gRNA
gcagagucauucgcagaugu

SEQ ID NO: 93293 - RNA, 20 nt, Artificial Sequence
  MKO10093293_B_Il3
  gRNA
uacaucugcgaaugacucug

SEQ ID NO: 93294 - RNA, 20 nt, Artificial Sequence
  MKO10093294_B_Il4i1
  gRNA
uggccgccaggacaagacgc

SEQ ID NO: 93295 - RNA, 20 nt, Artificial Sequence
  MKO10093295_B_Il4i1
  gRNA
cacaguaugaugagaacacg

SEQ ID NO: 93296 - RNA, 20 nt, Artificial Sequence
  MKO10093296_B_Il4i1
  gRNA
ccaccuuguugagugccauc

SEQ ID NO: 93297 - RNA, 20 nt, Artificial Sequence
  MKO10093297_B_Il4ra
  gRNA
ugcaguccacagcgcuaucc

SEQ ID NO: 93298 - RNA, 20 nt, Artificial Sequence
  MKO10093298_B_Il4ra
  gRNA
gaaaccucacaugcaucccg

SEQ ID NO: 93299 - RNA, 20 nt, Artificial Sequence
  MKO10093299_B_Il4ra
  gRNA
guugaucgggaagcucagcc

SEQ ID NO: 93300 - RNA, 20 nt, Artificial Sequence
  MKO10093300_B_Il4
  gRNA
cagagagugagcucgucugu

SEQ ID NO: 93301 - RNA, 20 nt, Artificial Sequence
  MKO10093301_B_Il4
  gRNA
ucuucuuucucgaauguacc

SEQ ID NO: 93302 - RNA, 20 nt, Artificial Sequence
  MKO10093302_B_Il4
  gRNA
aaucacuugagagagaucau

SEQ ID NO: 93303 - RNA, 20 nt, Artificial Sequence
  MKO10093303_B_Il5ra
  gRNA
acacuuacuucgucuucuug

SEQ ID NO: 93304 - RNA, 20 nt, Artificial Sequence
  MKO10093304_B_Il5ra
  gRNA
gaagagcagccauacaacuc

SEQ ID NO: 93305 - RNA, 20 nt, Artificial Sequence
  MKO10093305_B_Il5ra
  gRNA
cuguucaguccacuugccau

SEQ ID NO: 93306 - RNA, 20 nt, Artificial Sequence
  MKO10093306_B_Il5
  gRNA
agauuucuccaaugcauagc

SEQ ID NO: 93307 - RNA, 20 nt, Artificial Sequence
  MKO10093307_B_Il5
  gRNA
agcucuguugacaagcaaug

SEQ ID NO: 93308 - RNA, 20 nt, Artificial Sequence
  MKO10093308_B_Il5
  gRNA
cauugcuugucaacagagcu

SEQ ID NO: 93309 - RNA, 20 nt, Artificial Sequence
  MKO10093309_B_Il6ra
  gRNA
accguuacccugauuugccc

SEQ ID NO: 93310 - RNA, 20 nt, Artificial Sequence
  MKO10093310_B_Il6ra
  gRNA
ccauaccuggaaggccgcgc

SEQ ID NO: 93311 - RNA, 20 nt, Artificial Sequence
  MKO10093311_B_Il6ra
  gRNA
uugucaacgccaucugugag

SEQ ID NO: 93312 - RNA, 20 nt, Artificial Sequence
  MKO10093312_B_Il6st
  gRNA
ccaguauauuaaagcuauca

SEQ ID NO: 93313 - RNA, 20 nt, Artificial Sequence
  MKO10093313_B_Il6st
  gRNA
cuucuaaguaccuuuaucca

SEQ ID NO: 93314 - RNA, 20 nt, Artificial Sequence
  MKO10093314_B_Il6st
  gRNA
acaaugcaagucaaauuugu

SEQ ID NO: 93315 - RNA, 20 nt, Artificial Sequence
  MKO10093315_B_Il6
  gRNA
ccuucccuacuucacaaguc

SEQ ID NO: 93316 - RNA, 20 nt, Artificial Sequence
  MKO10093316_B_Il6
  gRNA
uugugaaguagggaaggccg

SEQ ID NO: 93317 - RNA, 20 nt, Artificial Sequence
  MKO10093317_B_Il6
  gRNA
aagucacuuugagaucuacu

SEQ ID NO: 93318 - RNA, 20 nt, Artificial Sequence
  MKO10093318_B_Il7r
  gRNA
agccuuugaaguaaucguua

SEQ ID NO: 93319 - RNA, 20 nt, Artificial Sequence
  MKO10093319_B_Il7r
  gRNA
agacaucaacacagcuaauc

SEQ ID NO: 93320 - RNA, 20 nt, Artificial Sequence
  MKO10093320_B_Il7r
  gRNA
cuugcagcuuguuaagaguu

SEQ ID NO: 93321 - RNA, 20 nt, Artificial Sequence
  MKO10093321_B_Il7
  gRNA
uuauuacaggacaaaaugac

SEQ ID NO: 93322 - RNA, 20 nt, Artificial Sequence
  MKO10093322_B_Il7
  gRNA
acauguaugugaugauacaa

SEQ ID NO: 93323 - RNA, 20 nt, Artificial Sequence
  MKO10093323_B_Il7
  gRNA
uuucucucaguagucucuuu

SEQ ID NO: 93324 - RNA, 20 nt, Artificial Sequence
  MKO10093324_B_Il9r
  gRNA
uccacccucaccugguaaag

SEQ ID NO: 93325 - RNA, 20 nt, Artificial Sequence
  MKO10093325_B_Il9r
  gRNA
cuuccgcaaugcaucuuccc

SEQ ID NO: 93326 - RNA, 20 nt, Artificial Sequence
  MKO10093326_B_Il9r
  gRNA
ggagucucggucccagagca

SEQ ID NO: 93327 - RNA, 20 nt, Artificial Sequence
  MKO10093327_B_Il9
  gRNA
ccgucaaaaugcagcugcag

SEQ ID NO: 93328 - RNA, 20 nt, Artificial Sequence
  MKO10093328_B_Il9
  gRNA
ugacaguguguugccugcca

SEQ ID NO: 93329 - RNA, 20 nt, Artificial Sequence
  MKO10093329_B_Il9
  gRNA
gacggagagacacaagcagc

SEQ ID NO: 93330 - RNA, 20 nt, Artificial Sequence
  MKO10093330_B_Ildr1
  gRNA
cgugucuccuggagccucga

SEQ ID NO: 93331 - RNA, 20 nt, Artificial Sequence
  MKO10093331_B_Ildr1
  gRNA
cacgucaggagacccagaua

SEQ ID NO: 93332 - RNA, 20 nt, Artificial Sequence
  MKO10093332_B_Ildr1
  gRNA
uacccgcuguugcugcccug

SEQ ID NO: 93333 - RNA, 20 nt, Artificial Sequence
  MKO10093333_B_Ildr2
  gRNA
cuacuguaucaucaccaccc

SEQ ID NO: 93334 - RNA, 20 nt, Artificial Sequence
  MKO10093334_B_Ildr2
  gRNA
cuuccagaguggguguuugu

SEQ ID NO: 93335 - RNA, 20 nt, Artificial Sequence
  MKO10093335_B_Ildr2
  gRNA
cauaaucuccacagcaaaac

SEQ ID NO: 93336 - RNA, 20 nt, Artificial Sequence
  MKO10093336_B_Ilf2
  gRNA
ugugauugacaacuugauug

SEQ ID NO: 93337 - RNA, 20 nt, Artificial Sequence
  MKO10093337_B_Ilf2
  gRNA
cucaccacuucaaauguucc

SEQ ID NO: 93338 - RNA, 20 nt, Artificial Sequence
  MKO10093338_B_Ilf2
  gRNA
uccagaggagggccuggugg

SEQ ID NO: 93339 - RNA, 20 nt, Artificial Sequence
  MKO10093339_B_Ilf3
  gRNA
gaagcccacaaccgcccuuc

SEQ ID NO: 93340 - RNA, 20 nt, Artificial Sequence
  MKO10093340_B_Ilf3
  gRNA
guaugaaauacuccagucug

SEQ ID NO: 93341 - RNA, 20 nt, Artificial Sequence
  MKO10093341_B_Ilf3
  gRNA
ucgcagcaucauccacagac

SEQ ID NO: 93342 - RNA, 20 nt, Artificial Sequence
  MKO10093342_B_Ilkap
  gRNA
uguaccugagucaguacugc

SEQ ID NO: 93343 - RNA, 20 nt, Artificial Sequence
  MKO10093343_B_Ilkap
  gRNA
gcucuuugaggaccugcccc

SEQ ID NO: 93344 - RNA, 20 nt, Artificial Sequence
  MKO10093344_B_Ilkap
  gRNA
cuagguucucuugccacauc

SEQ ID NO: 93345 - RNA, 20 nt, Artificial Sequence
  MKO10093345_B_Ilk
  gRNA
ccccuuagagagcuucuccg

SEQ ID NO: 93346 - RNA, 20 nt, Artificial Sequence
  MKO10093346_B_Ilk
  gRNA
aaccucggagaagcucucua

SEQ ID NO: 93347 - RNA, 20 nt, Artificial Sequence
  MKO10093347_B_Ilk
  gRNA
ggaaggggaccacucgcaca

SEQ ID NO: 93348 - RNA, 20 nt, Artificial Sequence
  MKO10093348_B_Iltifb
  gRNA
ucagugcuaccugaugaagc

SEQ ID NO: 93349 - RNA, 20 nt, Artificial Sequence
  MKO10093349_B_Iltifb
  gRNA
gcugagcugauugcugaguu

SEQ ID NO: 93350 - RNA, 20 nt, Artificial Sequence
  MKO10093350_B_Iltifb
  gRNA
acauccagaagaaugucaga

SEQ ID NO: 93351 - RNA, 20 nt, Artificial Sequence
  MKO10093351_B_Ilvbl
  gRNA
caaguugcccaauagccuca

SEQ ID NO: 93352 - RNA, 20 nt, Artificial Sequence
  MKO10093352_B_Ilvbl
  gRNA
ucggauacccagcuucucac

SEQ ID NO: 93353 - RNA, 20 nt, Artificial Sequence
  MKO10093353_B_Ilvbl
  gRNA
caugaggcuauugggcaacu

SEQ ID NO: 93354 - RNA, 20 nt, Artificial Sequence
  MKO10093354_B_Immp1l
  gRNA
auuaaucaucagaaaaucuc

SEQ ID NO: 93355 - RNA, 20 nt, Artificial Sequence
  MKO10093355_B_Immp1l
  gRNA
uuuggaugccauaaaaaugu

SEQ ID NO: 93356 - RNA, 20 nt, Artificial Sequence
  MKO10093356_B_Immp1l
  gRNA
cggcucuuaaauacaucaga

SEQ ID NO: 93357 - RNA, 20 nt, Artificial Sequence
  MKO10093357_B_Immp2l
  gRNA
aagagagugaucgcucuuga

SEQ ID NO: 93358 - RNA, 20 nt, Artificial Sequence
  MKO10093358_B_Immp2l
  gRNA
aaaguaccacaucugaggac

SEQ ID NO: 93359 - RNA, 20 nt, Artificial Sequence
  MKO10093359_B_Immp2l
  gRNA
ccacuuaccccuucucaccg

SEQ ID NO: 93360 - RNA, 20 nt, Artificial Sequence
  MKO10093360_B_Immt
  gRNA
uacuccacuucaagcaguuc

SEQ ID NO: 93361 - RNA, 20 nt, Artificial Sequence
  MKO10093361_B_Immt
  gRNA
uuucaucaccucugauacac

SEQ ID NO: 93362 - RNA, 20 nt, Artificial Sequence
  MKO10093362_B_Immt
  gRNA
gcacuauccuguaugccaaa

SEQ ID NO: 93363 - RNA, 20 nt, Artificial Sequence
  MKO10093363_B_Imp3
  gRNA
gcgccagcucgcgcaccgcu

SEQ ID NO: 93364 - RNA, 20 nt, Artificial Sequence
  MKO10093364_B_Imp3
  gRNA
guaccggcugcagcggcgcg

SEQ ID NO: 93365 - RNA, 20 nt, Artificial Sequence
  MKO10093365_B_Imp3
  gRNA
ggagcagggucauguccgcg

SEQ ID NO: 93366 - RNA, 20 nt, Artificial Sequence
  MKO10093366_B_Imp4
  gRNA
uguucucuagcuccgucggg

SEQ ID NO: 93367 - RNA, 20 nt, Artificial Sequence
  MKO10093367_B_Imp4
  gRNA
guaacucggugggaaucagc

SEQ ID NO: 93368 - RNA, 20 nt, Artificial Sequence
  MKO10093368_B_Imp4
  gRNA
ugauucccaccgaguuacgc

SEQ ID NO: 93369 - RNA, 20 nt, Artificial Sequence
  MKO10093369_B_Impa1
  gRNA
gaaguuagucguuccaucaa

SEQ ID NO: 93370 - RNA, 20 nt, Artificial Sequence
  MKO10093370_B_Impa1
  gRNA
aagauaagauguacaccggc

SEQ ID NO: 93371 - RNA, 20 nt, Artificial Sequence
  MKO10093371_B_Impa1
  gRNA
gccaauugaaacagcuacaa

SEQ ID NO: 93372 - RNA, 20 nt, Artificial Sequence
  MKO10093372_B_Impa2
  gRNA
ugcucacccacagcccgacc

SEQ ID NO: 93373 - RNA, 20 nt, Artificial Sequence
  MKO10093373_B_Impa2
  gRNA
uuguuucugaguugcgaaag

SEQ ID NO: 93374 - RNA, 20 nt, Artificial Sequence
  MKO10093374_B_Impa2
  gRNA
acgaaccccaccugucuccc

SEQ ID NO: 93375 - RNA, 20 nt, Artificial Sequence
  MKO10093375_B_Impacu
  gRNA
cuuagcgcucccuggcugaa

SEQ ID NO: 93376 - RNA, 20 nt, Artificial Sequence
  MKO10093376_B_Impacu
  gRNA
gauguugccaagugaguacc

SEQ ID NO: 93377 - RNA, 20 nt, Artificial Sequence
  MKO10093377_B_Impacu
  gRNA
cuguaaacaaaguguccauu

SEQ ID NO: 93378 - RNA, 20 nt, Artificial Sequence
  MKO10093378_B_Impad1
  gRNA
cucccacuagauaaauacug

SEQ ID NO: 93379 - RNA, 20 nt, Artificial Sequence
  MKO10093379_B_Impad1
  gRNA
ucgaaaguaugucacuacca

SEQ ID NO: 93380 - RNA, 20 nt, Artificial Sequence
  MKO10093380_B_Impad1
  gRNA
cagguugcucuucagacguu

SEQ ID NO: 93381 - RNA, 20 nt, Artificial Sequence
  MKO10093381_B_Impdh1
  gRNA
caaugaaguacggaagguca

SEQ ID NO: 93382 - RNA, 20 nt, Artificial Sequence
  MKO10093382_B_Impdh1
  gRNA
acaucacccacaguauguga

SEQ ID NO: 93383 - RNA, 20 nt, Artificial Sequence
  MKO10093383_B_Impdh1
  gRNA
agcgacuuccugauccuccc

SEQ ID NO: 93384 - RNA, 20 nt, Artificial Sequence
  MKO10093384_B_Impdh2
  gRNA
caaugaaguucggaaaguga

SEQ ID NO: 93385 - RNA, 20 nt, Artificial Sequence
  MKO10093385_B_Impdh2
  gRNA
uuguagcuuacaggagguau

SEQ ID NO: 93386 - RNA, 20 nt, Artificial Sequence
  MKO10093386_B_Impdh2
  gRNA
cacccaccucuuccaagaac

SEQ ID NO: 93387 - RNA, 20 nt, Artificial Sequence
  MKO10093387_B_Impg1
  gRNA
gcaccuagaucuucuucagc

SEQ ID NO: 93388 - RNA, 20 nt, Artificial Sequence
  MKO10093388_B_Impg1
  gRNA
cuuucaauuguuucgauucu

SEQ ID NO: 93389 - RNA, 20 nt, Artificial Sequence
  MKO10093389_B_Impg1
  gRNA
agcaccuacugaagccccug

SEQ ID NO: 93390 - RNA, 20 nt, Artificial Sequence
  MKO10093390_B_Impg2
  gRNA
cgaucuauucuguucccaaa

SEQ ID NO: 93391 - RNA, 20 nt, Artificial Sequence
  MKO10093391_B_Impg2
  gRNA
cccacaggacugauccuugc

SEQ ID NO: 93392 - RNA, 20 nt, Artificial Sequence
  MKO10093392_B_Impg2
  gRNA
uccugcaaggaucaguccug

SEQ ID NO: 93393 - RNA, 20 nt, Artificial Sequence
  MKO10093393_B_Inadl
  gRNA
agaaugugauagcuccggga

SEQ ID NO: 93394 - RNA, 20 nt, Artificial Sequence
  MKO10093394_B_Inadl
  gRNA
cucaccgguuuggagcuuuc

SEQ ID NO: 93395 - RNA, 20 nt, Artificial Sequence
  MKO10093395_B_Inadl
  gRNA
uuauuaagacugccccaacc

SEQ ID NO: 93396 - RNA, 20 nt, Artificial Sequence
  MKO10093396_B_Ina
  gRNA
gaagagacgcgguuuagcac

SEQ ID NO: 93397 - RNA, 20 nt, Artificial Sequence
  MKO10093397_B_Ina
  gRNA
acgccaccuucgggaauacc

SEQ ID NO: 93398 - RNA, 20 nt, Artificial Sequence
  MKO10093398_B_Ina
  gRNA
acauugagaucgcagcuuac

SEQ ID NO: 93399 - RNA, 20 nt, Artificial Sequence
  MKO10093399_B_Inca1
  gRNA
cacuacaaaauacuuugacg

SEQ ID NO: 93400 - RNA, 20 nt, Artificial Sequence
  MKO10093400_B_Inca1
  gRNA
guuuguccuaccagaauugg

SEQ ID NO: 93401 - RNA, 20 nt, Artificial Sequence
  MKO10093401_B_Inca1
  gRNA
ccuagccugcacccucuuga

SEQ ID NO: 93402 - RNA, 20 nt, Artificial Sequence
  MKO10093402_B_Incenp
  gRNA
gaggcgggugucuaacauuc

SEQ ID NO: 93403 - RNA, 20 nt, Artificial Sequence
  MKO10093403_B_Incenp
  gRNA
uccuucaggucacaguuacc

SEQ ID NO: 93404 - RNA, 20 nt, Artificial Sequence
  MKO10093404_B_Incenp
  gRNA
guugaagugccucagaaugu

SEQ ID NO: 93405 - RNA, 20 nt, Artificial Sequence
  MKO10093405_B_Inf2
  gRNA
agcgucagugcguggcccuc

SEQ ID NO: 93406 - RNA, 20 nt, Artificial Sequence
  MKO10093406_B_Inf2
  gRNA
cacucaugaugacgcugaag

SEQ ID NO: 93407 - RNA, 20 nt, Artificial Sequence
  MKO10093407_B_Inf2
  gRNA
cauuccagggcuacagcugc

SEQ ID NO: 93408 - RNA, 20 nt, Artificial Sequence
  MKO10093408_B_Ing1
  gRNA
cucgcucuccccacggcacu

SEQ ID NO: 93409 - RNA, 20 nt, Artificial Sequence
  MKO10093409_B_Ing1
  gRNA
ucagcgagacguuccucugc

SEQ ID NO: 93410 - RNA, 20 nt, Artificial Sequence
  MKO10093410_B_Ing1
  gRNA
uggaucugcuccccguuggc

SEQ ID NO: 93411 - RNA, 20 nt, Artificial Sequence
  MKO10093411_B_Ing2
  gRNA
ugucacccagaugcucgaau

SEQ ID NO: 93412 - RNA, 20 nt, Artificial Sequence
  MKO10093412_B_Ing2
  gRNA
ucuccaccaauucgagcauc

SEQ ID NO: 93413 - RNA, 20 nt, Artificial Sequence
  MKO10093413_B_Ing2
  gRNA
agaagaucuuuccgguugac

SEQ ID NO: 93414 - RNA, 20 nt, Artificial Sequence
  MKO10093414_B_Ing3
  gRNA
caaagaagaauaaacccgag

SEQ ID NO: 93415 - RNA, 20 nt, Artificial Sequence
  MKO10093415_B_Ing3
  gRNA
caucuguucuucucgccacu

SEQ ID NO: 93416 - RNA, 20 nt, Artificial Sequence
  MKO10093416_B_Ing3
  gRNA
uacuuaccaaaucauaaauc

SEQ ID NO: 93417 - RNA, 20 nt, Artificial Sequence
  MKO10093417_B_Ing4
  gRNA
ccuucagaucagccucaaaa

SEQ ID NO: 93418 - RNA, 20 nt, Artificial Sequence
  MKO10093418_B_Ing4
  gRNA
uguacguacccucuguccuu

SEQ ID NO: 93419 - RNA, 20 nt, Artificial Sequence
  MKO10093419_B_Ing4
  gRNA
uaugacagcucuucuagcaa

SEQ ID NO: 93420 - RNA, 20 nt, Artificial Sequence
  MKO10093420_B_Ing5
  gRNA
ccaggucagcaucaagucuu

SEQ ID NO: 93421 - RNA, 20 nt, Artificial Sequence
  MKO10093421_B_Ing5
  gRNA
aggccggcggacgucagaag

SEQ ID NO: 93422 - RNA, 20 nt, Artificial Sequence
  MKO10093422_B_Ing5
  gRNA
accuucccugugaacuucag

SEQ ID NO: 93423 - RNA, 20 nt, Artificial Sequence
  MKO10093423_B_Inha
  gRNA
cgaggcagacgccuuauucc

SEQ ID NO: 93424 - RNA, 20 nt, Artificial Sequence
  MKO10093424_B_Inha
  gRNA
cguagggaccucaugcuccc

SEQ ID NO: 93425 - RNA, 20 nt, Artificial Sequence
  MKO10093425_B_Inha
  gRNA
ggcaugcgcagcggguuccu

SEQ ID NO: 93426 - RNA, 20 nt, Artificial Sequence
  MKO10093426_B_Inhba
  gRNA
cggggcugagccgugccccu

SEQ ID NO: 93427 - RNA, 20 nt, Artificial Sequence
  MKO10093427_B_Inhba
  gRNA
ccccgccuacgccugcgaug

SEQ ID NO: 93428 - RNA, 20 nt, Artificial Sequence
  MKO10093428_B_Inhba
  gRNA
ccgaagaccacccucaucgc

SEQ ID NO: 93429 - RNA, 20 nt, Artificial Sequence
  MKO10093429_B_Inhbb
  gRNA
ucaccgggguccacgaacac

SEQ ID NO: 93430 - RNA, 20 nt, Artificial Sequence
  MKO10093430_B_Inhbb
  gRNA
ggcggcccccaacgcccgac

SEQ ID NO: 93431 - RNA, 20 nt, Artificial Sequence
  MKO10093431_B_Inhbb
  gRNA
gcagacaucgcauccgcaaa

SEQ ID NO: 93432 - RNA, 20 nt, Artificial Sequence
  MKO10093432_B_Inhbc
  gRNA
caccacguacugacuuguca

SEQ ID NO: 93433 - RNA, 20 nt, Artificial Sequence
  MKO10093433_B_Inhbc
  gRNA
ccuggcaaucgauaccucgc

SEQ ID NO: 93434 - RNA, 20 nt, Artificial Sequence
  MKO10093434_B_Inhbc
  gRNA
cauaagcuaacuacacccgc

SEQ ID NO: 93435 - RNA, 20 nt, Artificial Sequence
  MKO10093435_B_Inhbe
  gRNA
agaucugcgugcccguccug

SEQ ID NO: 93436 - RNA, 20 nt, Artificial Sequence
  MKO10093436_B_Inhbe
  gRNA
cucacuccgcaagccgcuag

SEQ ID NO: 93437 - RNA, 20 nt, Artificial Sequence
  MKO10093437_B_Inhbe
  gRNA
gucccgcagcggugcuguua

SEQ ID NO: 93438 - RNA, 20 nt, Artificial Sequence
  MKO10093438_B_Inip
  gRNA
gcuuucuucauucgggguca

SEQ ID NO: 93439 - RNA, 20 nt, Artificial Sequence
  MKO10093439_B_Inip
  gRNA
caugcucacgcacauuccuc

SEQ ID NO: 93440 - RNA, 20 nt, Artificial Sequence
  MKO10093440_B_Inip
  gRNA
cuccagacccucucuuacca

SEQ ID NO: 93441 - RNA, 20 nt, Artificial Sequence
  MKO10093441_B_Inmt
  gRNA
guccugaucgacauuggcuc

SEQ ID NO: 93442 - RNA, 20 nt, Artificial Sequence
  MKO10093442_B_Inmt
  gRNA
cucuaccagaccuucucuac

SEQ ID NO: 93443 - RNA, 20 nt, Artificial Sequence
  MKO10093443_B_Inmt
  gRNA
gccagaguggaagcuguagu

SEQ ID NO: 93444 - RNA, 20 nt, Artificial Sequence
  MKO10093444_B_Ino80b
  gRNA
ccgcuccuagcgggcgugga

SEQ ID NO: 93445 - RNA, 20 nt, Artificial Sequence
  MKO10093445_B_Ino80b
  gRNA
uccuuccgcaggggaaacgc

SEQ ID NO: 93446 - RNA, 20 nt, Artificial Sequence
  MKO10093446_B_Ino80b
  gRNA
cucuggagcaguaccgcgcc

SEQ ID NO: 93447 - RNA, 20 nt, Artificial Sequence
  MKO10093447_B_Ino80c
  gRNA
uuaggaucguucaguugcca

SEQ ID NO: 93448 - RNA, 20 nt, Artificial Sequence
  MKO10093448_B_Ino80c
  gRNA
cauaugcuuaccacaaaguu

SEQ ID NO: 93449 - RNA, 20 nt, Artificial Sequence
  MKO10093449_B_Ino80c
  gRNA
agccaugaaugagaguaaaa

SEQ ID NO: 93450 - RNA, 20 nt, Artificial Sequence
  MKO10093450_B_Ino80d
  gRNA
uagccugacggugccuaccc

SEQ ID NO: 93451 - RNA, 20 nt, Artificial Sequence
  MKO10093451_B_Ino80d
  gRNA
caggucagacgacgacgaca

SEQ ID NO: 93452 - RNA, 20 nt, Artificial Sequence
  MKO10093452_B_Ino80d
  gRNA
gucgagacucugcccgcucc

SEQ ID NO: 93453 - RNA, 20 nt, Artificial Sequence
  MKO10093453_B_Ino80e
  gRNA
cagcagauguucagcgaugc

SEQ ID NO: 93454 - RNA, 20 nt, Artificial Sequence
  MKO10093454_B_Ino80e
  gRNA
caacucaccgagcucaggua

SEQ ID NO: 93455 - RNA, 20 nt, Artificial Sequence
  MKO10093455_B_Ino80e
  gRNA
cugacacgccagccccuaag

SEQ ID NO: 93456 - RNA, 20 nt, Artificial Sequence
  MKO10093456_B_Ino80
  gRNA
caguaccaguacuacagugc

SEQ ID NO: 93457 - RNA, 20 nt, Artificial Sequence
  MKO10093457_B_Ino80
  gRNA
uuuaagugaugaguccagug

SEQ ID NO: 93458 - RNA, 20 nt, Artificial Sequence
  MKO10093458_B_Ino80
  gRNA
uccagaaucaaaaucugaca

SEQ ID NO: 93459 - RNA, 20 nt, Artificial Sequence
  MKO10093459_B_Inpp1
  gRNA
ugagccagcgcuuccgaugc

SEQ ID NO: 93460 - RNA, 20 nt, Artificial Sequence
  MKO10093460_B_Inpp1
  gRNA
gcugauugaugacucccauu

SEQ ID NO: 93461 - RNA, 20 nt, Artificial Sequence
  MKO10093461_B_Inpp1
  gRNA
cccaaaaccuaacuacuuua

SEQ ID NO: 93462 - RNA, 20 nt, Artificial Sequence
  MKO10093462_B_Inpp4a
  gRNA
ugaggaugauagucugauac

SEQ ID NO: 93463 - RNA, 20 nt, Artificial Sequence
  MKO10093463_B_Inpp4a
  gRNA
augcgaguucaagaugaugg

SEQ ID NO: 93464 - RNA, 20 nt, Artificial Sequence
  MKO10093464_B_Inpp4a
  gRNA
gaccuccugacuuaaaaccu

SEQ ID NO: 93465 - RNA, 20 nt, Artificial Sequence
  MKO10093465_B_Inpp4b
  gRNA
cucgucagggucugcuccac

SEQ ID NO: 93466 - RNA, 20 nt, Artificial Sequence
  MKO10093466_B_Inpp4b
  gRNA
gccagccugcagggaucuug

SEQ ID NO: 93467 - RNA, 20 nt, Artificial Sequence
  MKO10093467_B_Inpp4b
  gRNA
ccgagaaugaauuccaacug

SEQ ID NO: 93468 - RNA, 20 nt, Artificial Sequence
  MKO10093468_B_Inpp5a
  gRNA
cgaggccuccaugucccaug

SEQ ID NO: 93469 - RNA, 20 nt, Artificial Sequence
  MKO10093469_B_Inpp5a
  gRNA
acgcaaugaaagaauacaac

SEQ ID NO: 93470 - RNA, 20 nt, Artificial Sequence
  MKO10093470_B_Inpp5a
  gRNA
cagugcaaggccaugaagug

SEQ ID NO: 93471 - RNA, 20 nt, Artificial Sequence
  MKO10093471_B_Inpp5b
  gRNA
acacaccagaacguuccucc

SEQ ID NO: 93472 - RNA, 20 nt, Artificial Sequence
  MKO10093472_B_Inpp5b
  gRNA
uuaccuaccuggacaggcuc

SEQ ID NO: 93473 - RNA, 20 nt, Artificial Sequence
  MKO10093473_B_Inpp5b
  gRNA
aggauguagaguucaccauc

SEQ ID NO: 93474 - RNA, 20 nt, Artificial Sequence
  MKO10093474_B_Inpp5d
  gRNA
cauccgaagguguccccaug

SEQ ID NO: 93475 - RNA, 20 nt, Artificial Sequence
  MKO10093475_B_Inpp5d
  gRNA
ucuuguaaaagucgaugagc

SEQ ID NO: 93476 - RNA, 20 nt, Artificial Sequence
  MKO10093476_B_Inpp5d
  gRNA
ggaauuguguuuacacuuac

SEQ ID NO: 93477 - RNA, 20 nt, Artificial Sequence
  MKO10093477_B_Inpp5e
  gRNA
acaugucccuguuuauccgu

SEQ ID NO: 93478 - RNA, 20 nt, Artificial Sequence
  MKO10093478_B_Inpp5e
  gRNA
cugaguguagucagccucgg

SEQ ID NO: 93479 - RNA, 20 nt, Artificial Sequence
  MKO10093479_B_Inpp5e
  gRNA
cgugucucagaucaagacca

SEQ ID NO: 93480 - RNA, 20 nt, Artificial Sequence
  MKO10093480_B_Inpp5f
  gRNA
ccaggcaagaagcagauccg

SEQ ID NO: 93481 - RNA, 20 nt, Artificial Sequence
  MKO10093481_B_Inpp5f
  gRNA
ccacggaucugcuucuugcc

SEQ ID NO: 93482 - RNA, 20 nt, Artificial Sequence
  MKO10093482_B_Inpp5f
  gRNA
aagugacaauacagcaaucu

SEQ ID NO: 93483 - RNA, 20 nt, Artificial Sequence
  MKO10093483_B_Inpp5j
  gRNA
agucgccucagucucaaucc

SEQ ID NO: 93484 - RNA, 20 nt, Artificial Sequence
  MKO10093484_B_Inpp5j
  gRNA
ccaugaagagcucacuccac

SEQ ID NO: 93485 - RNA, 20 nt, Artificial Sequence
  MKO10093485_B_Inpp5j
  gRNA
cuugagccgcuuguugauca

SEQ ID NO: 93486 - RNA, 20 nt, Artificial Sequence
  MKO10093486_B_Inpp5k
  gRNA
uccuuacccaguacccguag

SEQ ID NO: 93487 - RNA, 20 nt, Artificial Sequence
  MKO10093487_B_Inpp5k
  gRNA
guauaacaaugaccagcgcc

SEQ ID NO: 93488 - RNA, 20 nt, Artificial Sequence
  MKO10093488_B_Inpp5k
  gRNA
gaacaaccaagaccugaauc

SEQ ID NO: 93489 - RNA, 20 nt, Artificial Sequence
  MKO10093489_B_Inppl1
  gRNA
auaggccuauaagcucaccc

SEQ ID NO: 93490 - RNA, 20 nt, Artificial Sequence
  MKO10093490_B_Inppl1
  gRNA
accuaccgcauucugccaga

SEQ ID NO: 93491 - RNA, 20 nt, Artificial Sequence
  MKO10093491_B_Inppl1
  gRNA
ucuccuggaagcacuccuaa

SEQ ID NO: 93492 - RNA, 20 nt, Artificial Sequence
  MKO10093492_B_Ins1
  gRNA
ccuccaacgccaaggucuga

SEQ ID NO: 93493 - RNA, 20 nt, Artificial Sequence
  MKO10093493_B_Ins1
  gRNA
acccaagucccgccgugaag

SEQ ID NO: 93494 - RNA, 20 nt, Artificial Sequence
  MKO10093494_B_Ins1
  gRNA
uagagagccucuaccaggug

SEQ ID NO: 93495 - RNA, 20 nt, Artificial Sequence
  MKO10093495_B_Ins2
  gRNA
cucccuggcaguggcacaac

SEQ ID NO: 93496 - RNA, 20 nt, Artificial Sequence
  MKO10093496_B_Ins2
  gRNA
acccaugucccgccgugaag

SEQ ID NO: 93497 - RNA, 20 nt, Artificial Sequence
  MKO10093497_B_Ins2
  gRNA
auuguuucaacauggcccug

SEQ ID NO: 93498 - RNA, 20 nt, Artificial Sequence
  MKO10093498_B_Insc
  gRNA
ucugugccgcaucauagcca

SEQ ID NO: 93499 - RNA, 20 nt, Artificial Sequence
  MKO10093499_B_Insc
  gRNA
cgagcacuuuggucagcuac

SEQ ID NO: 93500 - RNA, 20 nt, Artificial Sequence
  MKO10093500_B_Insc
  gRNA
cgugauguagauauugucug

SEQ ID NO: 93501 - RNA, 20 nt, Artificial Sequence
  MKO10093501_B_Insig1
  gRNA
cgaugguaaucccaagccca

SEQ ID NO: 93502 - RNA, 20 nt, Artificial Sequence
  MKO10093502_B_Insig1
  gRNA
auuuccucuauauccguucu

SEQ ID NO: 93503 - RNA, 20 nt, Artificial Sequence
  MKO10093503_B_Insig1
  gRNA
ggagccaagaacggauauag

SEQ ID NO: 93504 - RNA, 20 nt, Artificial Sequence
  MKO10093504_B_Insig2
  gRNA
acccaacuguuagucuacaa

SEQ ID NO: 93505 - RNA, 20 nt, Artificial Sequence
  MKO10093505_B_Insig2
  gRNA
caccauuguagacuaacagu

SEQ ID NO: 93506 - RNA, 20 nt, Artificial Sequence
  MKO10093506_B_Insig2
  gRNA
agcuuaccauugccaguuga

SEQ ID NO: 93507 - RNA, 20 nt, Artificial Sequence
  MKO10093507_B_Insl3
  gRNA
gugcaccgcugcugucuuac

SEQ ID NO: 93508 - RNA, 20 nt, Artificial Sequence
  MKO10093508_B_Insl3
  gRNA
gcagagcuuggcgcgugccu

SEQ ID NO: 93509 - RNA, 20 nt, Artificial Sequence
  MKO10093509_B_Insl3
  gRNA
cccgcaccagcgugcgcacc

SEQ ID NO: 93510 - RNA, 20 nt, Artificial Sequence
  MKO10093510_B_Insl5
  gRNA
uaacuguucucacguagucc

SEQ ID NO: 93511 - RNA, 20 nt, Artificial Sequence
  MKO10093511_B_Insl5
  gRNA
cagagcuugcagaucucguc

SEQ ID NO: 93512 - RNA, 20 nt, Artificial Sequence
  MKO10093512_B_Insl5
  gRNA
cuguccugagagauccgucu

SEQ ID NO: 93513 - RNA, 20 nt, Artificial Sequence
  MKO10093513_B_Insl6
  gRNA
uuugcuccuccaucucgaac

SEQ ID NO: 93514 - RNA, 20 nt, Artificial Sequence
  MKO10093514_B_Insl6
  gRNA
uucuucugagagacgccugc

SEQ ID NO: 93515 - RNA, 20 nt, Artificial Sequence
  MKO10093515_B_Insl6
  gRNA
cuuuccccacuacucacgca

SEQ ID NO: 93516 - RNA, 20 nt, Artificial Sequence
  MKO10093516_B_Insm1
  gRNA
cucgggguugccgaagugcg

SEQ ID NO: 93517 - RNA, 20 nt, Artificial Sequence
  MKO10093517_B_Insm1
  gRNA
uugugcugcgccagcgcgaa

SEQ ID NO: 93518 - RNA, 20 nt, Artificial Sequence
  MKO10093518_B_Insm1
  gRNA
ccacccgucugagaauagac

SEQ ID NO: 93519 - RNA, 20 nt, Artificial Sequence
  MKO10093519_B_Insm2
  gRNA
gguacucgacgcgcacgaug

SEQ ID NO: 93520 - RNA, 20 nt, Artificial Sequence
  MKO10093520_B_Insm2
  gRNA
cacgggccgagcccgucuca

SEQ ID NO: 93521 - RNA, 20 nt, Artificial Sequence
  MKO10093521_B_Insm2
  gRNA
cgucguccugcggaggugcg

SEQ ID NO: 93522 - RNA, 20 nt, Artificial Sequence
  MKO10093522_B_Insrr
  gRNA
cacagcgccaggacucauau

SEQ ID NO: 93523 - RNA, 20 nt, Artificial Sequence
  MKO10093523_B_Insrr
  gRNA
gcugcccucguagaugccga

SEQ ID NO: 93524 - RNA, 20 nt, Artificial Sequence
  MKO10093524_B_Insrr
  gRNA
ggaugagguuucccuccacg

SEQ ID NO: 93525 - RNA, 20 nt, Artificial Sequence
  MKO10093525_B_Insr
  gRNA
ccccucggauguugaugauc

SEQ ID NO: 93526 - RNA, 20 nt, Artificial Sequence
  MKO10093526_B_Insr
  gRNA
uuguuccggauguccauacc

SEQ ID NO: 93527 - RNA, 20 nt, Artificial Sequence
  MKO10093527_B_Insr
  gRNA
ucuucucaccuucgaggauu

SEQ ID NO: 93528 - RNA, 20 nt, Artificial Sequence
  MKO10093528_B_Ints10
  gRNA
uguacucacuccguaagaac

SEQ ID NO: 93529 - RNA, 20 nt, Artificial Sequence
  MKO10093529_B_Ints10
  gRNA
gcaucaucacgucagcauug

SEQ ID NO: 93530 - RNA, 20 nt, Artificial Sequence
  MKO10093530_B_Ints10
  gRNA
gguuuauuugaaacccuucc

SEQ ID NO: 93531 - RNA, 20 nt, Artificial Sequence
  MKO10093531_B_Ints12
  gRNA
augggagaggaucgugucuc

SEQ ID NO: 93532 - RNA, 20 nt, Artificial Sequence
  MKO10093532_B_Ints12
  gRNA
auucaagagaaccgaaguua

SEQ ID NO: 93533 - RNA, 20 nt, Artificial Sequence
  MKO10093533_B_Ints12
  gRNA
agccauacucaaauccuugc

SEQ ID NO: 93534 - RNA, 20 nt, Artificial Sequence
  MKO10093534_B_Ints1
  gRNA
gguauacauugaagacucgc

SEQ ID NO: 93535 - RNA, 20 nt, Artificial Sequence
  MKO10093535_B_Ints1
  gRNA
agccauuucuccaucgauua

SEQ ID NO: 93536 - RNA, 20 nt, Artificial Sequence
  MKO10093536_B_Ints1
  gRNA
cgagauugaagccgcugagc

SEQ ID NO: 93537 - RNA, 20 nt, Artificial Sequence
  MKO10093537_B_Ints2
  gRNA
uguaggggccugaucaaaaa

SEQ ID NO: 93538 - RNA, 20 nt, Artificial Sequence
  MKO10093538_B_Ints2
  gRNA
cuuugagagugcaguguacu

SEQ ID NO: 93539 - RNA, 20 nt, Artificial Sequence
  MKO10093539_B_Ints2
  gRNA
uccauuucuaacacgcagca

SEQ ID NO: 93540 - RNA, 20 nt, Artificial Sequence
  MKO10093540_B_Ints3
  gRNA
cucucucucggagacaccag

SEQ ID NO: 93541 - RNA, 20 nt, Artificial Sequence
  MKO10093541_B_Ints3
  gRNA
acuaguaaagaguggaguuc

SEQ ID NO: 93542 - RNA, 20 nt, Artificial Sequence
  MKO10093542_B_Ints3
  gRNA
cuaggcagaucuccucaugc

SEQ ID NO: 93543 - RNA, 20 nt, Artificial Sequence
  MKO10093543_B_Ints4
  gRNA
uggcuuuacacagaucuaug

SEQ ID NO: 93544 - RNA, 20 nt, Artificial Sequence
  MKO10093544_B_Ints4
  gRNA
auucucuccagacugcauaa

SEQ ID NO: 93545 - RNA, 20 nt, Artificial Sequence
  MKO10093545_B_Ints4
  gRNA
ggggguagucaggauucucu

SEQ ID NO: 93546 - RNA, 20 nt, Artificial Sequence
  MKO10093546_B_Ints5
  gRNA
cucugacuaccugagaggcg

SEQ ID NO: 93547 - RNA, 20 nt, Artificial Sequence
  MKO10093547_B_Ints5
  gRNA
ugaagcggccacguucagac

SEQ ID NO: 93548 - RNA, 20 nt, Artificial Sequence
  MKO10093548_B_Ints5
  gRNA
cagggccacccgcacauuaa

SEQ ID NO: 93549 - RNA, 20 nt, Artificial Sequence
  MKO10093549_B_Ints6
  gRNA
cuguucugauuccaccgaca

SEQ ID NO: 93550 - RNA, 20 nt, Artificial Sequence
  MKO10093550_B_Ints6
  gRNA
cgacucuuggccaaucccua

SEQ ID NO: 93551 - RNA, 20 nt, Artificial Sequence
  MKO10093551_B_Ints6
  gRNA
ggcuguuaccuugauagcau

SEQ ID NO: 93552 - RNA, 20 nt, Artificial Sequence
  MKO10093552_B_Ints7
  gRNA
gacucuggcggauacuguga

SEQ ID NO: 93553 - RNA, 20 nt, Artificial Sequence
  MKO10093553_B_Ints7
  gRNA
caaacucggggagcagugug

SEQ ID NO: 93554 - RNA, 20 nt, Artificial Sequence
  MKO10093554_B_Ints7
  gRNA
cggguacuucuggaaaagcc

SEQ ID NO: 93555 - RNA, 20 nt, Artificial Sequence
  MKO10093555_B_Ints8
  gRNA
ccagguuuagccuguuugac

SEQ ID NO: 93556 - RNA, 20 nt, Artificial Sequence
  MKO10093556_B_Ints8
  gRNA
aaguugcugcacauuugaag

SEQ ID NO: 93557 - RNA, 20 nt, Artificial Sequence
  MKO10093557_B_Ints8
  gRNA
ccaacuuacacauuuaguug

SEQ ID NO: 93558 - RNA, 20 nt, Artificial Sequence
  MKO10093558_B_Ints9
  gRNA
acaguccaacauaauaguag

SEQ ID NO: 93559 - RNA, 20 nt, Artificial Sequence
  MKO10093559_B_Ints9
  gRNA
uaggagcuaaaagagugcuc

SEQ ID NO: 93560 - RNA, 20 nt, Artificial Sequence
  MKO10093560_B_Ints9
  gRNA
gccugaauucugcuuaccag

SEQ ID NO: 93561 - RNA, 20 nt, Artificial Sequence
  MKO10093561_B_Intu
  gRNA
gaaacuccucugcgggucag

SEQ ID NO: 93562 - RNA, 20 nt, Artificial Sequence
  MKO10093562_B_Intu
  gRNA
guccacaccugcauuggccc

SEQ ID NO: 93563 - RNA, 20 nt, Artificial Sequence
  MKO10093563_B_Intu
  gRNA
cucagaaacucaagagcgug

SEQ ID NO: 93564 - RNA, 20 nt, Artificial Sequence
  MKO10093564_B_Invs
  gRNA
ggagggcuguucuccggcua

SEQ ID NO: 93565 - RNA, 20 nt, Artificial Sequence
  MKO10093565_B_Invs
  gRNA
uauuucgaaccccacuucac

SEQ ID NO: 93566 - RNA, 20 nt, Artificial Sequence
  MKO10093566_B_Invs
  gRNA
ggcuccugugccgagugcuc

SEQ ID NO: 93567 - RNA, 20 nt, Artificial Sequence
  MKO10093567_B_Ip6k1
  gRNA
uggccguggacucuccaucg

SEQ ID NO: 93568 - RNA, 20 nt, Artificial Sequence
  MKO10093568_B_Ip6k1
  gRNA
cgcauugcggaagcccucga

SEQ ID NO: 93569 - RNA, 20 nt, Artificial Sequence
  MKO10093569_B_Ip6k1
  gRNA
gguguaccacguucucaagc

SEQ ID NO: 93570 - RNA, 20 nt, Artificial Sequence
  MKO10093570_B_Ip6k2
  gRNA
gguacgccagcaccggaaag

SEQ ID NO: 93571 - RNA, 20 nt, Artificial Sequence
  MKO10093571_B_Ip6k2
  gRNA
gcagaugaguuuggggccuc

SEQ ID NO: 93572 - RNA, 20 nt, Artificial Sequence
  MKO10093572_B_Ip6k2
  gRNA
ugcuggcguacccaguccuu

SEQ ID NO: 93573 - RNA, 20 nt, Artificial Sequence
  MKO10093573_B_Ip6k3
  gRNA
guaccaucacagugcgucuc

SEQ ID NO: 93574 - RNA, 20 nt, Artificial Sequence
  MKO10093574_B_Ip6k3
  gRNA
cugccagagagcuaccgcuc

SEQ ID NO: 93575 - RNA, 20 nt, Artificial Sequence
  MKO10093575_B_Ip6k3
  gRNA
acugggagcacagacgaguc

SEQ ID NO: 93576 - RNA, 20 nt, Artificial Sequence
  MKO10093576_B_Ipcef1
  gRNA
auguuacagugagagcgagc

SEQ ID NO: 93577 - RNA, 20 nt, Artificial Sequence
  MKO10093577_B_Ipcef1
  gRNA
ccaccaggaauccaucacaa

SEQ ID NO: 93578 - RNA, 20 nt, Artificial Sequence
  MKO10093578_B_Ipcef1
  gRNA
cuuugcagcagagaauuugc

SEQ ID NO: 93579 - RNA, 20 nt, Artificial Sequence
  MKO10093579_B_Ipmk
  gRNA
uuacccucaugccgagcacc

SEQ ID NO: 93580 - RNA, 20 nt, Artificial Sequence
  MKO10093580_B_Ipmk
  gRNA
uuaggccucuuccauagugc

SEQ ID NO: 93581 - RNA, 20 nt, Artificial Sequence
  MKO10093581_B_Ipmk
  gRNA
ccuaacgaaagagacccuga

SEQ ID NO: 93582 - RNA, 20 nt, Artificial Sequence
  MKO10093582_B_Ipo11
  gRNA
cgaacacugcuaucguuaaa

SEQ ID NO: 93583 - RNA, 20 nt, Artificial Sequence
  MKO10093583_B_Ipo11
  gRNA
gccaccguacauuuauauca

SEQ ID NO: 93584 - RNA, 20 nt, Artificial Sequence
  MKO10093584_B_Ipo11
  gRNA
cuuuaaugaaccaauaaacc

SEQ ID NO: 93585 - RNA, 20 nt, Artificial Sequence
  MKO10093585_B_Ipo13
  gRNA
aauccauacuccucgucaga

SEQ ID NO: 93586 - RNA, 20 nt, Artificial Sequence
  MKO10093586_B_Ipo13
  gRNA
ccggccagucuacuuccagc

SEQ ID NO: 93587 - RNA, 20 nt, Artificial Sequence
  MKO10093587_B_Ipo13
  gRNA
cagcaauacggcagaugcca

SEQ ID NO: 93588 - RNA, 20 nt, Artificial Sequence
  MKO10093588_B_Ipo4
  gRNA
gcagaaggcugaacaaucgc

SEQ ID NO: 93589 - RNA, 20 nt, Artificial Sequence
  MKO10093589_B_Ipo4
  gRNA
ccagauccgccaguuugcag

SEQ ID NO: 93590 - RNA, 20 nt, Artificial Sequence
  MKO10093590_B_Ipo4
  gRNA
agugccaguaccucuuucuc

SEQ ID NO: 93591 - RNA, 20 nt, Artificial Sequence
  MKO10093591_B_Ipo5
  gRNA
aguucaguguaugcaagauc

SEQ ID NO: 93592 - RNA, 20 nt, Artificial Sequence
  MKO10093592_B_Ipo5
  gRNA
aagcugcccuucacauauuu

SEQ ID NO: 93593 - RNA, 20 nt, Artificial Sequence
  MKO10093593_B_Ipo5
  gRNA
cuauuucuaggcuagacaaa

SEQ ID NO: 93594 - RNA, 20 nt, Artificial Sequence
  MKO10093594_B_Ipo7
  gRNA
uaaacauaccugauaagcuc

SEQ ID NO: 93595 - RNA, 20 nt, Artificial Sequence
  MKO10093595_B_Ipo7
  gRNA
auaaagcgauccuucagaac

SEQ ID NO: 93596 - RNA, 20 nt, Artificial Sequence
  MKO10093596_B_Ipo7
  gRNA
ccugguguggcuucccgauc

SEQ ID NO: 93597 - RNA, 20 nt, Artificial Sequence
  MKO10093597_B_Ipo8
  gRNA
guggccuaccucaccaaauc

SEQ ID NO: 93598 - RNA, 20 nt, Artificial Sequence
  MKO10093598_B_Ipo8
  gRNA
aauauucuaugcucucguuc

SEQ ID NO: 93599 - RNA, 20 nt, Artificial Sequence
  MKO10093599_B_Ipo8
  gRNA
gacuaugauccgaagcaagc

SEQ ID NO: 93600 - RNA, 20 nt, Artificial Sequence
  MKO10093600_B_Ipo9
  gRNA
agucaucuugaaacaguaug

SEQ ID NO: 93601 - RNA, 20 nt, Artificial Sequence
  MKO10093601_B_Ipo9
  gRNA
gauguauaagauauucacca

SEQ ID NO: 93602 - RNA, 20 nt, Artificial Sequence
  MKO10093602_B_Ipo9
  gRNA
uucagaauuugguguucacc

SEQ ID NO: 93603 - RNA, 20 nt, Artificial Sequence
  MKO10093603_B_Ippk
  gRNA
aaccuuaccuucuucuuauu

SEQ ID NO: 93604 - RNA, 20 nt, Artificial Sequence
  MKO10093604_B_Ippk
  gRNA
augcugaaguaucucuucug

SEQ ID NO: 93605 - RNA, 20 nt, Artificial Sequence
  MKO10093605_B_Ippk
  gRNA
aagauacagugugaaagacc

SEQ ID NO: 93606 - RNA, 20 nt, Artificial Sequence
  MKO10093606_B_Ipp
  gRNA
uugauaccuucagccaguac

SEQ ID NO: 93607 - RNA, 20 nt, Artificial Sequence
  MKO10093607_B_Ipp
  gRNA
cauagcugugacuaaugucc

SEQ ID NO: 93608 - RNA, 20 nt, Artificial Sequence
  MKO10093608_B_Ipp
  gRNA
ucuucuuagcugcaaugcag

SEQ ID NO: 93609 - RNA, 20 nt, Artificial Sequence
  MKO10093609_B_Iqca
  gRNA
uggagugaugggucgcauuc

SEQ ID NO: 93610 - RNA, 20 nt, Artificial Sequence
  MKO10093610_B_Iqca
  gRNA
guguccguacuuucuggauc

SEQ ID NO: 93611 - RNA, 20 nt, Artificial Sequence
  MKO10093611_B_Iqca
  gRNA
augcggacugaaccucccug

SEQ ID NO: 93612 - RNA, 20 nt, Artificial Sequence
  MKO10093612_B_Iqcb1
  gRNA
cauguucaacugauacagaa

SEQ ID NO: 93613 - RNA, 20 nt, Artificial Sequence
  MKO10093613_B_Iqcb1
  gRNA
agaauauacuacagaucaac

SEQ ID NO: 93614 - RNA, 20 nt, Artificial Sequence
  MKO10093614_B_Iqcb1
  gRNA
auguuuguaaccuucucccc

SEQ ID NO: 93615 - RNA, 20 nt, Artificial Sequence
  MKO10093615_B_Iqcc
  gRNA
aagagccaacccccgagugc

SEQ ID NO: 93616 - RNA, 20 nt, Artificial Sequence
  MKO10093616_B_Iqcc
  gRNA
gcaggccaucaacagucgaa

SEQ ID NO: 93617 - RNA, 20 nt, Artificial Sequence
  MKO10093617_B_Iqcc
  gRNA
uaccuccuuucgacuguuga

SEQ ID NO: 93618 - RNA, 20 nt, Artificial Sequence
  MKO10093618_B_Iqcd
  gRNA
gguacugugcccgaagcgcc

SEQ ID NO: 93619 - RNA, 20 nt, Artificial Sequence
  MKO10093619_B_Iqcd
  gRNA
auggccaguccgugguagga

SEQ ID NO: 93620 - RNA, 20 nt, Artificial Sequence
  MKO10093620_B_Iqcd
  gRNA
ucuccgaaaacuugaacacc

SEQ ID NO: 93621 - RNA, 20 nt, Artificial Sequence
  MKO10093621_B_Iqce
  gRNA
cccgagccccacgcuuaccu

SEQ ID NO: 93622 - RNA, 20 nt, Artificial Sequence
  MKO10093622_B_Iqce
  gRNA
gccauacuuacuuggugaug

SEQ ID NO: 93623 - RNA, 20 nt, Artificial Sequence
  MKO10093623_B_Iqce
  gRNA
cgacucaaugucagauucaa

SEQ ID NO: 93624 - RNA, 20 nt, Artificial Sequence
  MKO10093624_B_Iqcf1
  gRNA
guaggugcauuaaguucuuc

SEQ ID NO: 93625 - RNA, 20 nt, Artificial Sequence
  MKO10093625_B_Iqcf1
  gRNA
gccgguugcuuaaggcuguc

SEQ ID NO: 93626 - RNA, 20 nt, Artificial Sequence
  MKO10093626_B_Iqcf1
  gRNA
uccgcauguggcguauccgc

SEQ ID NO: 93627 - RNA, 20 nt, Artificial Sequence
  MKO10093627_B_Iqcf3
  gRNA
ugaaucacuccucucaagaa

SEQ ID NO: 93628 - RNA, 20 nt, Artificial Sequence
  MKO10093628_B_Iqcf3
  gRNA
cagauaaagccauucuugag

SEQ ID NO: 93629 - RNA, 20 nt, Artificial Sequence
  MKO10093629_B_Iqcf3
  gRNA
agaaacagaaaacguuaacg

SEQ ID NO: 93630 - RNA, 20 nt, Artificial Sequence
  MKO10093630_B_Iqcf4
  gRNA
agggcuuaccucuaacuucg

SEQ ID NO: 93631 - RNA, 20 nt, Artificial Sequence
  MKO10093631_B_Iqcf4
  gRNA
uauaccagcgccacgacgcc

SEQ ID NO: 93632 - RNA, 20 nt, Artificial Sequence
  MKO10093632_B_Iqcf4
  gRNA
ccugcguccuuauucagucg

SEQ ID NO: 93633 - RNA, 20 nt, Artificial Sequence
  MKO10093633_B_Iqcf5
  gRNA
gaagaaacggcggauggcuc

SEQ ID NO: 93634 - RNA, 20 nt, Artificial Sequence
  MKO10093634_B_Iqcf5
  gRNA
agccgcagauguuucuguca

SEQ ID NO: 93635 - RNA, 20 nt, Artificial Sequence
  MKO10093635_B_Iqcf5
  gRNA
gaaugcuguucgcaucaucc

SEQ ID NO: 93636 - RNA, 20 nt, Artificial Sequence
  MKO10093636_B_Iqcf6
  gRNA
acacucugcucauuauccac

SEQ ID NO: 93637 - RNA, 20 nt, Artificial Sequence
  MKO10093637_B_Iqcf6
  gRNA
ggcccgcagacgauuccucc

SEQ ID NO: 93638 - RNA, 20 nt, Artificial Sequence
  MKO10093638_B_Iqcf6
  gRNA
cuuugaccucauagcggcug

SEQ ID NO: 93639 - RNA, 20 nt, Artificial Sequence
  MKO10093639_B_Iqcg
  gRNA
agaaucuugcaucuccauca

SEQ ID NO: 93640 - RNA, 20 nt, Artificial Sequence
  MKO10093640_B_Iqcg
  gRNA
aacaguuacuugaugucaaa

SEQ ID NO: 93641 - RNA, 20 nt, Artificial Sequence
  MKO10093641_B_Iqcg
  gRNA
cagugucuccagagucauca

SEQ ID NO: 93642 - RNA, 20 nt, Artificial Sequence
  MKO10093642_B_Iqch
  gRNA
gcugcuguaacugcuagcua

SEQ ID NO: 93643 - RNA, 20 nt, Artificial Sequence
  MKO10093643_B_Iqch
  gRNA
ugaggaccuucaucaguuaa

SEQ ID NO: 93644 - RNA, 20 nt, Artificial Sequence
  MKO10093644_B_Iqch
  gRNA
uggcgaccucaaaagcaucg

SEQ ID NO: 93645 - RNA, 20 nt, Artificial Sequence
  MKO10093645_B_Iqcj
  gRNA
ucugcagcauccagcgagca

SEQ ID NO: 93646 - RNA, 20 nt, Artificial Sequence
  MKO10093646_B_Iqcj
  gRNA
uucuagucaccagcuggcca

SEQ ID NO: 93647 - RNA, 20 nt, Artificial Sequence
  MKO10093647_B_Iqcj
  gRNA
aauguuauucuccacaucca

SEQ ID NO: 93648 - RNA, 20 nt, Artificial Sequence
  MKO10093648_B_Iqck
  gRNA
ugaagcaggcuggccauucc

SEQ ID NO: 93649 - RNA, 20 nt, Artificial Sequence
  MKO10093649_B_Iqck
  gRNA
cagggcacaggaggcaucgc

SEQ ID NO: 93650 - RNA, 20 nt, Artificial Sequence
  MKO10093650_B_Iqck
  gRNA
ccugcgauuuccugacugag

SEQ ID NO: 93651 - RNA, 20 nt, Artificial Sequence
  MKO10093651_B_Iqgap1
  gRNA
caagguagacuccguuucua

SEQ ID NO: 93652 - RNA, 20 nt, Artificial Sequence
  MKO10093652_B_Iqgap1
  gRNA
gcccugguuaccugagggcg

SEQ ID NO: 93653 - RNA, 20 nt, Artificial Sequence
  MKO10093653_B_Iqgap1
  gRNA
aggcaacccaaucucaucca

SEQ ID NO: 93654 - RNA, 20 nt, Artificial Sequence
  MKO10093654_B_Iqgap2
  gRNA
uagcaaucguggaugaugaa

SEQ ID NO: 93655 - RNA, 20 nt, Artificial Sequence
  MKO10093655_B_Iqgap2
  gRNA
caaguucuucgcuccaaaaa

SEQ ID NO: 93656 - RNA, 20 nt, Artificial Sequence
  MKO10093656_B_Iqgap2
  gRNA
uaucugugugucgaaaauga

SEQ ID NO: 93657 - RNA, 20 nt, Artificial Sequence
  MKO10093657_B_Iqgap3
  gRNA
ccacgucguagaucuucuuc

SEQ ID NO: 93658 - RNA, 20 nt, Artificial Sequence
  MKO10093658_B_Iqgap3
  gRNA
ucgccuaucaguaccucugc

SEQ ID NO: 93659 - RNA, 20 nt, Artificial Sequence
  MKO10093659_B_Iqgap3
  gRNA
cucucugcgguagcccacau

SEQ ID NO: 93660 - RNA, 20 nt, Artificial Sequence
  MKO10093660_B_Iqsec1
  gRNA
ggccuccgugugcgcuguug

SEQ ID NO: 93661 - RNA, 20 nt, Artificial Sequence
  MKO10093661_B_Iqsec1
  gRNA
cuucgugcccgacacgccag

SEQ ID NO: 93662 - RNA, 20 nt, Artificial Sequence
  MKO10093662_B_Iqsec1
  gRNA
agccgcgcucaaugagauac

SEQ ID NO: 93663 - RNA, 20 nt, Artificial Sequence
  MKO10093663_B_Iqsec2
  gRNA
ccgggaagaugguagccgug

SEQ ID NO: 93664 - RNA, 20 nt, Artificial Sequence
  MKO10093664_B_Iqsec2
  gRNA
gcccugaacugccacccauc

SEQ ID NO: 93665 - RNA, 20 nt, Artificial Sequence
  MKO10093665_B_Iqsec2
  gRNA
agcacagcgguugauagucc

SEQ ID NO: 93666 - RNA, 20 nt, Artificial Sequence
  MKO10093666_B_Iqsec3
  gRNA
acgggcuggcccccuccgcg

SEQ ID NO: 93667 - RNA, 20 nt, Artificial Sequence
  MKO10093667_B_Iqsec3
  gRNA
gccacaccgauggggguguc

SEQ ID NO: 93668 - RNA, 20 nt, Artificial Sequence
  MKO10093668_B_Iqsec3
  gRNA
auccaguuccugaucucacg

SEQ ID NO: 93669 - RNA, 20 nt, Artificial Sequence
  MKO10093669_B_Iqub
  gRNA
guuauuugcaguacauaaug

SEQ ID NO: 93670 - RNA, 20 nt, Artificial Sequence
  MKO10093670_B_Iqub
  gRNA
aagcccucuauucuucugac

SEQ ID NO: 93671 - RNA, 20 nt, Artificial Sequence
  MKO10093671_B_Iqub
  gRNA
auauccagucagaagaauag

SEQ ID NO: 93672 - RNA, 20 nt, Artificial Sequence
  MKO10093672_B_Irak1bp1
  gRNA
ccuaaggcggcaggccuguc

SEQ ID NO: 93673 - RNA, 20 nt, Artificial Sequence
  MKO10093673_B_Irak1bp1
  gRNA
aguagaaaaugcguaucaca

SEQ ID NO: 93674 - RNA, 20 nt, Artificial Sequence
  MKO10093674_B_Irak1bp1
  gRNA
cgaagauucucaacagaacc

SEQ ID NO: 93675 - RNA, 20 nt, Artificial Sequence
  MKO10093675_B_Irak1
  gRNA
gccuuggggcagcggugcuu

SEQ ID NO: 93676 - RNA, 20 nt, Artificial Sequence
  MKO10093676_B_Irak1
  gRNA
ugcgcgaccagacagagcug

SEQ ID NO: 93677 - RNA, 20 nt, Artificial Sequence
  MKO10093677_B_Irak1
  gRNA
aagaugguagugguggcccg

SEQ ID NO: 93678 - RNA, 20 nt, Artificial Sequence
  MKO10093678_B_Irak2
  gRNA
ccaaagccaccgaaucagcg

SEQ ID NO: 93679 - RNA, 20 nt, Artificial Sequence
  MKO10093679_B_Irak2
  gRNA
acaucuaccagcugccgucc

SEQ ID NO: 93680 - RNA, 20 nt, Artificial Sequence
  MKO10093680_B_Irak2
  gRNA
gguggauuuaccuuagacug

SEQ ID NO: 93681 - RNA, 20 nt, Artificial Sequence
  MKO10093681_B_Irak3
  gRNA
gauauucgaaguauacagag

SEQ ID NO: 93682 - RNA, 20 nt, Artificial Sequence
  MKO10093682_B_Irak3
  gRNA
uaccauaguugaugauuaag

SEQ ID NO: 93683 - RNA, 20 nt, Artificial Sequence
  MKO10093683_B_Irak3
  gRNA
agcuuccagaguauccuaga

SEQ ID NO: 93684 - RNA, 20 nt, Artificial Sequence
  MKO10093684_B_Irak4
  gRNA
gagcuucuucaccgccacga

SEQ ID NO: 93685 - RNA, 20 nt, Artificial Sequence
  MKO10093685_B_Irak4
  gRNA
agaacacagcugcgagccac

SEQ ID NO: 93686 - RNA, 20 nt, Artificial Sequence
  MKO10093686_B_Irak4
  gRNA
cgggggcaaacagcucaauc

SEQ ID NO: 93687 - RNA, 20 nt, Artificial Sequence
  MKO10093687_B_Ireb2
  gRNA
uucguacagcagcuuccaau

SEQ ID NO: 93688 - RNA, 20 nt, Artificial Sequence
  MKO10093688_B_Ireb2
  gRNA
cagguagucuggccucgaca

SEQ ID NO: 93689 - RNA, 20 nt, Artificial Sequence
  MKO10093689_B_Ireb2
  gRNA
ugccggggaucgugugauuc

SEQ ID NO: 93690 - RNA, 20 nt, Artificial Sequence
  MKO10093690_B_Irf1
  gRNA
gcucugcugugcggguguac

SEQ ID NO: 93691 - RNA, 20 nt, Artificial Sequence
  MKO10093691_B_Irf1
  gRNA
agcacgcugcuaagcacggc

SEQ ID NO: 93692 - RNA, 20 nt, Artificial Sequence
  MKO10093692_B_Irf1
  gRNA
acccugcccaccugugugaa

SEQ ID NO: 93693 - RNA, 20 nt, Artificial Sequence
  MKO10093693_B_Irf2bp1
  gRNA
ccguggcggaaggggcacgc

SEQ ID NO: 93694 - RNA, 20 nt, Artificial Sequence
  MKO10093694_B_Irf2bp1
  gRNA
uucuggcaauguuuacgcgg

SEQ ID NO: 93695 - RNA, 20 nt, Artificial Sequence
  MKO10093695_B_Irf2bp1
  gRNA
ugcaagcgucccgccgccag

SEQ ID NO: 93696 - RNA, 20 nt, Artificial Sequence
  MKO10093696_B_Irf2bp2
  gRNA
ccgcuucaggcggugugguc

SEQ ID NO: 93697 - RNA, 20 nt, Artificial Sequence
  MKO10093697_B_Irf2bp2
  gRNA
ccucguaguugacgcagccg

SEQ ID NO: 93698 - RNA, 20 nt, Artificial Sequence
  MKO10093698_B_Irf2bp2
  gRNA
ggucaacgguucugccgcgc

SEQ ID NO: 93699 - RNA, 20 nt, Artificial Sequence
  MKO10093699_B_Irf2bpl
  gRNA
ugcgugaugccaggcgacgc

SEQ ID NO: 93700 - RNA, 20 nt, Artificial Sequence
  MKO10093700_B_Irf2bpl
  gRNA
ccauaacgcuccagaccgga

SEQ ID NO: 93701 - RNA, 20 nt, Artificial Sequence
  MKO10093701_B_Irf2bpl
  gRNA
uucuccgaacccguaugccg

SEQ ID NO: 93702 - RNA, 20 nt, Artificial Sequence
  MKO10093702_B_Irf2
  gRNA
acaacgccuucagagucuac

SEQ ID NO: 93703 - RNA, 20 nt, Artificial Sequence
  MKO10093703_B_Irf2
  gRNA
agaaccaguugagucaucuu

SEQ ID NO: 93704 - RNA, 20 nt, Artificial Sequence
  MKO10093704_B_Irf2
  gRNA
agagagaguuaagcacauca

SEQ ID NO: 93705 - RNA, 20 nt, Artificial Sequence
  MKO10093705_B_Irf3
  gRNA
acguccggcuuauccuuccc

SEQ ID NO: 93706 - RNA, 20 nt, Artificial Sequence
  MKO10093706_B_Irf3
  gRNA
cuaaccgcaacacuucuuuc

SEQ ID NO: 93707 - RNA, 20 nt, Artificial Sequence
  MKO10093707_B_Irf3
  gRNA
aaccuaccgaaguuauuuga

SEQ ID NO: 93708 - RNA, 20 nt, Artificial Sequence
  MKO10093708_B_Irf4
  gRNA
cugacccauacaagguguac

SEQ ID NO: 93709 - RNA, 20 nt, Artificial Sequence
  MKO10093709_B_Irf4
  gRNA
acaauccuguacaccuugua

SEQ ID NO: 93710 - RNA, 20 nt, Artificial Sequence
  MKO10093710_B_Irf4
  gRNA
gcugaagccuuggcgcucuc

SEQ ID NO: 93711 - RNA, 20 nt, Artificial Sequence
  MKO10093711_B_Irf5
  gRNA
uugggaggcccagguagcgc

SEQ ID NO: 93712 - RNA, 20 nt, Artificial Sequence
  MKO10093712_B_Irf5
  gRNA
ugucccagacccaaaucucc

SEQ ID NO: 93713 - RNA, 20 nt, Artificial Sequence
  MKO10093713_B_Irf5
  gRNA
ucccagaacguaaucaucag

SEQ ID NO: 93714 - RNA, 20 nt, Artificial Sequence
  MKO10093714_B_Irf6
  gRNA
cugcuccuaaccugauugag

SEQ ID NO: 93715 - RNA, 20 nt, Artificial Sequence
  MKO10093715_B_Irf6
  gRNA
caggaucgucuaccccuucc

SEQ ID NO: 93716 - RNA, 20 nt, Artificial Sequence
  MKO10093716_B_Irf6
  gRNA
agagagcugauccauagcuc

SEQ ID NO: 93717 - RNA, 20 nt, Artificial Sequence
  MKO10093717_B_Irf7
  gRNA
uacgaacuuagccgggagcu

SEQ ID NO: 93718 - RNA, 20 nt, Artificial Sequence
  MKO10093718_B_Irf7
  gRNA
acggagcaauggcugaagug

SEQ ID NO: 93719 - RNA, 20 nt, Artificial Sequence
  MKO10093719_B_Irf7
  gRNA
cagcaaugcucugcccacac

SEQ ID NO: 93720 - RNA, 20 nt, Artificial Sequence
  MKO10093720_B_Irf8
  gRNA
acuucgcucaugcagccugc

SEQ ID NO: 93721 - RNA, 20 nt, Artificial Sequence
  MKO10093721_B_Irf8
  gRNA
gccuucuguggaugaguaca

SEQ ID NO: 93722 - RNA, 20 nt, Artificial Sequence
  MKO10093722_B_Irf8
  gRNA
gccuaugacacacaccauuc

SEQ ID NO: 93723 - RNA, 20 nt, Artificial Sequence
  MKO10093723_B_Irf9
  gRNA
caacaagaguuccgaauuug

SEQ ID NO: 93724 - RNA, 20 nt, Artificial Sequence
  MKO10093724_B_Irf9
  gRNA
cgauccagcuccgcagcuuu

SEQ ID NO: 93725 - RNA, 20 nt, Artificial Sequence
  MKO10093725_B_Irf9
  gRNA
aacauaggcggugguggcaa

SEQ ID NO: 93726 - RNA, 20 nt, Artificial Sequence
  MKO10093726_B_Irg1
  gRNA
caacguugaacgccagcagc

SEQ ID NO: 93727 - RNA, 20 nt, Artificial Sequence
  MKO10093727_B_Irg1
  gRNA
uccgaaugauaccaucuguc

SEQ ID NO: 93728 - RNA, 20 nt, Artificial Sequence
  MKO10093728_B_Irg1
  gRNA
uggucgaccccaaacagugc

SEQ ID NO: 93729 - RNA, 20 nt, Artificial Sequence
  MKO10093729_B_Irgc1
  gRNA
cggggguaucagcuucggca

SEQ ID NO: 93730 - RNA, 20 nt, Artificial Sequence
  MKO10093730_B_Irgc1
  gRNA
ccaccagcgugccgaaaaca

SEQ ID NO: 93731 - RNA, 20 nt, Artificial Sequence
  MKO10093731_B_Irgc1
  gRNA
gggagcggaugacggagcgc

SEQ ID NO: 93732 - RNA, 20 nt, Artificial Sequence
  MKO10093732_B_Irgm1
  gRNA
accaucacacaguuccugcg

SEQ ID NO: 93733 - RNA, 20 nt, Artificial Sequence
  MKO10093733_B_Irgm1
  gRNA
gaaguacccccccguguucc

SEQ ID NO: 93734 - RNA, 20 nt, Artificial Sequence
  MKO10093734_B_Irgm1
  gRNA
uuugucacgucauaccaaac

SEQ ID NO: 93735 - RNA, 20 nt, Artificial Sequence
  MKO10093735_B_Irgm2
  gRNA
cuggcucgguuguaucgcac

SEQ ID NO: 93736 - RNA, 20 nt, Artificial Sequence
  MKO10093736_B_Irgm2
  gRNA
agauaaaguauugccgucuu

SEQ ID NO: 93737 - RNA, 20 nt, Artificial Sequence
  MKO10093737_B_Irgm2
  gRNA
uauccgggauagucuucaga

SEQ ID NO: 93738 - RNA, 20 nt, Artificial Sequence
  MKO10093738_B_Irgq
  gRNA
cagggcggacuuucccgagc

SEQ ID NO: 93739 - RNA, 20 nt, Artificial Sequence
  MKO10093739_B_Irgq
  gRNA
ggcgcgcucacgucgugcua

SEQ ID NO: 93740 - RNA, 20 nt, Artificial Sequence
  MKO10093740_B_Irgq
  gRNA
ggcaacgcgcacgcgcuucc

SEQ ID NO: 93741 - RNA, 20 nt, Artificial Sequence
  MKO10093741_B_Irs1
  gRNA
augcaccacuuggaacgucg

SEQ ID NO: 93742 - RNA, 20 nt, Artificial Sequence
  MKO10093742_B_Irs1
  gRNA
ccaucagcguuccccugcgc

SEQ ID NO: 93743 - RNA, 20 nt, Artificial Sequence
  MKO10093743_B_Irs1
  gRNA
ccugcgcaggggaacgcuga

SEQ ID NO: 93744 - RNA, 20 nt, Artificial Sequence
  MKO10093744_B_Irs2
  gRNA
cuuaugaacauucgccgcug

SEQ ID NO: 93745 - RNA, 20 nt, Artificial Sequence
  MKO10093745_B_Irs2
  gRNA
cguucggccgucaccggucc

SEQ ID NO: 93746 - RNA, 20 nt, Artificial Sequence
  MKO10093746_B_Irs2
  gRNA
cggcuaaggggcgcgcgcac

SEQ ID NO: 93747 - RNA, 20 nt, Artificial Sequence
  MKO10093747_B_Irs3
  gRNA
gcgcugagcgcccgaguucc

SEQ ID NO: 93748 - RNA, 20 nt, Artificial Sequence
  MKO10093748_B_Irs3
  gRNA
cgcgcgcuugcuaauagugc

SEQ ID NO: 93749 - RNA, 20 nt, Artificial Sequence
  MKO10093749_B_Irs3
  gRNA
cacagagccgcacgucgggc

SEQ ID NO: 93750 - RNA, 20 nt, Artificial Sequence
  MKO10093750_B_Irs4
  gRNA
cgguaguauucgagucgagc

SEQ ID NO: 93751 - RNA, 20 nt, Artificial Sequence
  MKO10093751_B_Irs4
  gRNA
uacaggaugaucacgcgccg

SEQ ID NO: 93752 - RNA, 20 nt, Artificial Sequence
  MKO10093752_B_Irs4
  gRNA
gcugugucuuaccgacgaag

SEQ ID NO: 93753 - RNA, 20 nt, Artificial Sequence
  MKO10093753_B_Irx1
  gRNA
gugcggaggccuucucacca

SEQ ID NO: 93754 - RNA, 20 nt, Artificial Sequence
  MKO10093754_B_Irx1
  gRNA
agcacucacuugucgcgcac

SEQ ID NO: 93755 - RNA, 20 nt, Artificial Sequence
  MKO10093755_B_Irx1
  gRNA
auacagcucgcuggccccgc

SEQ ID NO: 93756 - RNA, 20 nt, Artificial Sequence
  MKO10093756_B_Irx2
  gRNA
ccgcgguauuguaccgcaga

SEQ ID NO: 93757 - RNA, 20 nt, Artificial Sequence
  MKO10093757_B_Irx2
  gRNA
ugguugcuugagguccgacg

SEQ ID NO: 93758 - RNA, 20 nt, Artificial Sequence
  MKO10093758_B_Irx2
  gRNA
uccgcguucagcccguaccc

SEQ ID NO: 93759 - RNA, 20 nt, Artificial Sequence
  MKO10093759_B_Irx3
  gRNA
ggcgccguaacccugagcgg

SEQ ID NO: 93760 - RNA, 20 nt, Artificial Sequence
  MKO10093760_B_Irx3
  gRNA
gucucuuaccgccuuggcac

SEQ ID NO: 93761 - RNA, 20 nt, Artificial Sequence
  MKO10093761_B_Irx3
  gRNA
uacagaucgcuguagugccu

SEQ ID NO: 93762 - RNA, 20 nt, Artificial Sequence
  MKO10093762_B_Irx4
  gRNA
gucgucgcagauacacccgu

SEQ ID NO: 93763 - RNA, 20 nt, Artificial Sequence
  MKO10093763_B_Irx4
  gRNA
cucaauucugccgccgcgcu

SEQ ID NO: 93764 - RNA, 20 nt, Artificial Sequence
  MKO10093764_B_Irx4
  gRNA
cgcggcgcaagaaugccacc

SEQ ID NO: 93765 - RNA, 20 nt, Artificial Sequence
  MKO10093765_B_Irx5
  gRNA
guaccagccguccgccucgc

SEQ ID NO: 93766 - RNA, 20 nt, Artificial Sequence
  MKO10093766_B_Irx5
  gRNA
acggaaccgcagcgaggacg

SEQ ID NO: 93767 - RNA, 20 nt, Artificial Sequence
  MKO10093767_B_Irx5
  gRNA
ucacuaccccgcgagugugc

SEQ ID NO: 93768 - RNA, 20 nt, Artificial Sequence
  MKO10093768_B_Irx6
  gRNA
aggagaauccucuucgccuu

SEQ ID NO: 93769 - RNA, 20 nt, Artificial Sequence
  MKO10093769_B_Irx6
  gRNA
aauugagcagugcuggccgc

SEQ ID NO: 93770 - RNA, 20 nt, Artificial Sequence
  MKO10093770_B_Irx6
  gRNA
gcccagcagccgacugucau

SEQ ID NO: 93771 - RNA, 20 nt, Artificial Sequence
  MKO10093771_B_Isca1
  gRNA
gugcgaaccaggggcuguaa

SEQ ID NO: 93772 - RNA, 20 nt, Artificial Sequence
  MKO10093772_B_Isca1
  gRNA
aaagcacagcuaacccuguu

SEQ ID NO: 93773 - RNA, 20 nt, Artificial Sequence
  MKO10093773_B_Isca1
  gRNA
aaagcucucaccgcagccac

SEQ ID NO: 93774 - RNA, 20 nt, Artificial Sequence
  MKO10093774_B_Isca2
  gRNA
caccugggcucccuuaacga

SEQ ID NO: 93775 - RNA, 20 nt, Artificial Sequence
  MKO10093775_B_Isca2
  gRNA
augagcuucggaucaguucu

SEQ ID NO: 93776 - RNA, 20 nt, Artificial Sequence
  MKO10093776_B_Isca2
  gRNA
cgauaccuucccgagcgccu

SEQ ID NO: 93777 - RNA, 20 nt, Artificial Sequence
  MKO10093777_B_Iscu
  gRNA
uucaugacgucaccacaugc

SEQ ID NO: 93778 - RNA, 20 nt, Artificial Sequence
  MKO10093778_B_Iscu
  gRNA
cuggagcagugcaguuucac

SEQ ID NO: 93779 - RNA, 20 nt, Artificial Sequence
  MKO10093779_B_Iscu
  gRNA
uccagggcucacugcuucuc

SEQ ID NO: 93780 - RNA, 20 nt, Artificial Sequence
  MKO10093780_B_Isg15
  gRNA
ggaggggaccagugugccua

SEQ ID NO: 93781 - RNA, 20 nt, Artificial Sequence
  MKO10093781_B_Isg15
  gRNA
cggucuuacccuuuccaguc

SEQ ID NO: 93782 - RNA, 20 nt, Artificial Sequence
  MKO10093782_B_Isg15
  gRNA
gaugggggccuuaggcacac

SEQ ID NO: 93783 - RNA, 20 nt, Artificial Sequence
  MKO10093783_B_Isg20l2
  gRNA
uuccucgguggaagaugccc

SEQ ID NO: 93784 - RNA, 20 nt, Artificial Sequence
  MKO10093784_B_Isg20l2
  gRNA
uccgggaagugucucuggug

SEQ ID NO: 93785 - RNA, 20 nt, Artificial Sequence
  MKO10093785_B_Isg20l2
  gRNA
uuccuuuagguuggaaauac

SEQ ID NO: 93786 - RNA, 20 nt, Artificial Sequence
  MKO10093786_B_Isg20
  gRNA
ugaagucgugcuucagguca

SEQ ID NO: 93787 - RNA, 20 nt, Artificial Sequence
  MKO10093787_B_Isg20
  gRNA
cagcgacucagagcccagcg

SEQ ID NO: 93788 - RNA, 20 nt, Artificial Sequence
  MKO10093788_B_Isg20
  gRNA
ugugucugcagaacaacugg

SEQ ID NO: 93789 - RNA, 20 nt, Artificial Sequence
  MKO10093789_B_Isl1
  gRNA
gauugccgcaaccaacacac

SEQ ID NO: 93790 - RNA, 20 nt, Artificial Sequence
  MKO10093790_B_Isl1
  gRNA
gucccagagucauccgagug

SEQ ID NO: 93791 - RNA, 20 nt, Artificial Sequence
  MKO10093791_B_Isl1
  gRNA
ucccaugguggcugcuaguc

SEQ ID NO: 93792 - RNA, 20 nt, Artificial Sequence
  MKO10093792_B_Isl2
  gRNA
gcgugucgcccgaccucgag

SEQ ID NO: 93793 - RNA, 20 nt, Artificial Sequence
  MKO10093793_B_Isl2
  gRNA
ccccauccgccaugagaacg

SEQ ID NO: 93794 - RNA, 20 nt, Artificial Sequence
  MKO10093794_B_Isl2
  gRNA
ugucccgcgcccgcaucacc

SEQ ID NO: 93795 - RNA, 20 nt, Artificial Sequence
  MKO10093795_B_Islr2
  gRNA
gcgagccggucuccagacuc

SEQ ID NO: 93796 - RNA, 20 nt, Artificial Sequence
  MKO10093796_B_Islr2
  gRNA
ggccuucgucaacgucacgc

SEQ ID NO: 93797 - RNA, 20 nt, Artificial Sequence
  MKO10093797_B_Islr2
  gRNA
gcagcgcgcucaaguuacga

SEQ ID NO: 93798 - RNA, 20 nt, Artificial Sequence
  MKO10093798_B_Islr
  gRNA
cagcgcggugagcggugcga

SEQ ID NO: 93799 - RNA, 20 nt, Artificial Sequence
  MKO10093799_B_Islr
  gRNA
aggcugcuaaaggcgucccg

SEQ ID NO: 93800 - RNA, 20 nt, Artificial Sequence
  MKO10093800_B_Islr
  gRNA
cauucacaccccgggcggca

SEQ ID NO: 93801 - RNA, 20 nt, Artificial Sequence
  MKO10093801_B_Ism1
  gRNA
uacugucauacuugucaucc

SEQ ID NO: 93802 - RNA, 20 nt, Artificial Sequence
  MKO10093802_B_Ism1
  gRNA
gcuggacggucccauccucu

SEQ ID NO: 93803 - RNA, 20 nt, Artificial Sequence
  MKO10093803_B_Ism1
  gRNA
ggaaggguugguggacaacc

SEQ ID NO: 93804 - RNA, 20 nt, Artificial Sequence
  MKO10093804_B_Isoc1
  gRNA
gcuggucggccgaggcaucg

SEQ ID NO: 93805 - RNA, 20 nt, Artificial Sequence
  MKO10093805_B_Isoc1
  gRNA
gaucaucgugaccacuagug

SEQ ID NO: 93806 - RNA, 20 nt, Artificial Sequence
  MKO10093806_B_Isoc1
  gRNA
cgaugugaaccucgaugccu

SEQ ID NO: 93807 - RNA, 20 nt, Artificial Sequence
  MKO10093807_B_Isoc2a
  gRNA
gucucaccaagaugcaggcu

SEQ ID NO: 93808 - RNA, 20 nt, Artificial Sequence
  MKO10093808_B_Isoc2a
  gRNA
aggcucagcagcccgcuguc

SEQ ID NO: 93809 - RNA, 20 nt, Artificial Sequence
  MKO10093809_B_Isoc2a
  gRNA
guacugcucugucagcaaaa

SEQ ID NO: 93810 - RNA, 20 nt, Artificial Sequence
  MKO10093810_B_Isoc2b
  gRNA
gcccccgcuucaacaggagu

SEQ ID NO: 93811 - RNA, 20 nt, Artificial Sequence
  MKO10093811_B_Isoc2b
  gRNA
ccuccuggaccgugggcuac

SEQ ID NO: 93812 - RNA, 20 nt, Artificial Sequence
  MKO10093812_B_Isoc2b
  gRNA
aacaguccgaugucugugac

SEQ ID NO: 93813 - RNA, 20 nt, Artificial Sequence
  MKO10093813_B_Ispd
  gRNA
caucuaugaagcguaucagc

SEQ ID NO: 93814 - RNA, 20 nt, Artificial Sequence
  MKO10093814_B_Ispd
  gRNA
gcagcugaagccaugauuaa

SEQ ID NO: 93815 - RNA, 20 nt, Artificial Sequence
  MKO10093815_B_Ispd
  gRNA
uggaacagagugcuugcagu

SEQ ID NO: 93816 - RNA, 20 nt, Artificial Sequence
  MKO10093816_B_Ist1
  gRNA
uaucauucacagucccgauc

SEQ ID NO: 93817 - RNA, 20 nt, Artificial Sequence
  MKO10093817_B_Ist1
  gRNA
agccccacccaaaauccuag

SEQ ID NO: 93818 - RNA, 20 nt, Artificial Sequence
  MKO10093818_B_Ist1
  gRNA
gccacuucugacugaagccg

SEQ ID NO: 93819 - RNA, 20 nt, Artificial Sequence
  MKO10093819_B_Isx
  gRNA
acccacugcuaugacuacau

SEQ ID NO: 93820 - RNA, 20 nt, Artificial Sequence
  MKO10093820_B_Isx
  gRNA
uccaggcagacaacuauccc

SEQ ID NO: 93821 - RNA, 20 nt, Artificial Sequence
  MKO10093821_B_Isx
  gRNA
agggccaagccggccucacc

SEQ ID NO: 93822 - RNA, 20 nt, Artificial Sequence
  MKO10093822_B_Isy1
  gRNA
ucgucaagcucagcuggaag

SEQ ID NO: 93823 - RNA, 20 nt, Artificial Sequence
  MKO10093823_B_Isy1
  gRNA
cauuggcgagaucucaaaaa

SEQ ID NO: 93824 - RNA, 20 nt, Artificial Sequence
  MKO10093824_B_Isy1
  gRNA
ccugcaggacugcccuggcg

SEQ ID NO: 93825 - RNA, 20 nt, Artificial Sequence
  MKO10093825_B_Isyna1
  gRNA
cugcgcgcgccgcauggccu

SEQ ID NO: 93826 - RNA, 20 nt, Artificial Sequence
  MKO10093826_B_Isyna1
  gRNA
ccaaucggcugcgccuaacc

SEQ ID NO: 93827 - RNA, 20 nt, Artificial Sequence
  MKO10093827_B_Isyna1
  gRNA
gaccuuauccaaucccgcac

SEQ ID NO: 93828 - RNA, 20 nt, Artificial Sequence
  MKO10093828_B_Iuch
  gRNA
ccaauaaaacaucagacuuc

SEQ ID NO: 93829 - RNA, 20 nt, Artificial Sequence
  MKO10093829_B_Iuch
  gRNA
gguacuacacagaaugauga

SEQ ID NO: 93830 - RNA, 20 nt, Artificial Sequence
  MKO10093830_B_Iuch
  gRNA
ugugaggggcugcuuccacu

SEQ ID NO: 93831 - RNA, 20 nt, Artificial Sequence
  MKO10093831_B_Itfg1
  gRNA
gaucuaauuccugauguguu

SEQ ID NO: 93832 - RNA, 20 nt, Artificial Sequence
  MKO10093832_B_Itfg1
  gRNA
gaauccccaucauaaucacc

SEQ ID NO: 93833 - RNA, 20 nt, Artificial Sequence
  MKO10093833_B_Itfg1
  gRNA
cacccuccuagcaguaucug

SEQ ID NO: 93834 - RNA, 20 nt, Artificial Sequence
  MKO10093834_B_Itfg2
  gRNA
gguaggauacacagaccgug

SEQ ID NO: 93835 - RNA, 20 nt, Artificial Sequence
  MKO10093835_B_Itfg2
  gRNA
gcaguuaaaugagcuaguug

SEQ ID NO: 93836 - RNA, 20 nt, Artificial Sequence
  MKO10093836_B_Itfg2
  gRNA
gugguagcagucagcgcaga

SEQ ID NO: 93837 - RNA, 20 nt, Artificial Sequence
  MKO10093837_B_Itfg3
  gRNA
aacguucccacuaaagcugc

SEQ ID NO: 93838 - RNA, 20 nt, Artificial Sequence
  MKO10093838_B_Itfg3
  gRNA
agaccuccugauccucgccc

SEQ ID NO: 93839 - RNA, 20 nt, Artificial Sequence
  MKO10093839_B_Itfg3
  gRNA
caguauauucuccugcccug

SEQ ID NO: 93840 - RNA, 20 nt, Artificial Sequence
  MKO10093840_B_Iuga10
  gRNA
cacagugcuccauguaccaa

SEQ ID NO: 93841 - RNA, 20 nt, Artificial Sequence
  MKO10093841_B_Iuga10
  gRNA
gguggcccugugaagagucg

SEQ ID NO: 93842 - RNA, 20 nt, Artificial Sequence
  MKO10093842_B_Iuga10
  gRNA
ccugcugugaauaugcaccu

SEQ ID NO: 93843 - RNA, 20 nt, Artificial Sequence
  MKO10093843_B_Iuga11
  gRNA
caacugcaccaagcucaacc

SEQ ID NO: 93844 - RNA, 20 nt, Artificial Sequence
  MKO10093844_B_Iuga11
  gRNA
guacagcagcaugauaucag

SEQ ID NO: 93845 - RNA, 20 nt, Artificial Sequence
  MKO10093845_B_Iuga11
  gRNA
ggaagcuccuacuacaccac

SEQ ID NO: 93846 - RNA, 20 nt, Artificial Sequence
  MKO10093846_B_Iuga1
  gRNA
gaugucuauaaguguccagu

SEQ ID NO: 93847 - RNA, 20 nt, Artificial Sequence
  MKO10093847_B_Iuga1
  gRNA
aucaaugccuugugugaagu

SEQ ID NO: 93848 - RNA, 20 nt, Artificial Sequence
  MKO10093848_B_Iuga1
  gRNA
caacaguaugaaaacgaaga

SEQ ID NO: 93849 - RNA, 20 nt, Artificial Sequence
  MKO10093849_B_Iuga2b
  gRNA
ggcccuaaacgcaagucaag

SEQ ID NO: 93850 - RNA, 20 nt, Artificial Sequence
  MKO10093850_B_Iuga2b
  gRNA
ccuacacagcguguccaucg

SEQ ID NO: 93851 - RNA, 20 nt, Artificial Sequence
  MKO10093851_B_Iuga2b
  gRNA
gacaagcgauacugugaagc

SEQ ID NO: 93852 - RNA, 20 nt, Artificial Sequence
  MKO10093852_B_Iuga2
  gRNA
acuuguacacaucucccauu

SEQ ID NO: 93853 - RNA, 20 nt, Artificial Sequence
  MKO10093853_B_Iuga2
  gRNA
aacacucacuagaaagccuc

SEQ ID NO: 93854 - RNA, 20 nt, Artificial Sequence
  MKO10093854_B_Iuga2
  gRNA
uggcuucccugagaaccgaa

SEQ ID NO: 93855 - RNA, 20 nt, Artificial Sequence
  MKO10093855_B_Iuga3
  gRNA
gaugacuauaccaaccggac

SEQ ID NO: 93856 - RNA, 20 nt, Artificial Sequence
  MKO10093856_B_Iuga3
  gRNA
cuuaccaggacucuaccugc

SEQ ID NO: 93857 - RNA, 20 nt, Artificial Sequence
  MKO10093857_B_Iuga3
  gRNA
gggcccugcagguagagucc

SEQ ID NO: 93858 - RNA, 20 nt, Artificial Sequence
  MKO10093858_B_Iuga4
  gRNA
uuauccagacuugugggcac

SEQ ID NO: 93859 - RNA, 20 nt, Artificial Sequence
  MKO10093859_B_Iuga4
  gRNA
uuagauuauacgagaaaauu

SEQ ID NO: 93860 - RNA, 20 nt, Artificial Sequence
  MKO10093860_B_Iuga4
  gRNA
aaagggugacccccagccac

SEQ ID NO: 93861 - RNA, 20 nt, Artificial Sequence
  MKO10093861_B_Iuga5
  gRNA
ggagcaacaguucgggccca

SEQ ID NO: 93862 - RNA, 20 nt, Artificial Sequence
  MKO10093862_B_Iuga5
  gRNA
ucugugcgccagcuauacag

SEQ ID NO: 93863 - RNA, 20 nt, Artificial Sequence
  MKO10093863_B_Iuga5
  gRNA
aaggcuaacacuagccagcc

SEQ ID NO: 93864 - RNA, 20 nt, Artificial Sequence
  MKO10093864_B_Iuga6
  gRNA
ucaacacgaagcaggagucg

SEQ ID NO: 93865 - RNA, 20 nt, Artificial Sequence
  MKO10093865_B_Iuga6
  gRNA
aggugaugucacagcuguac

SEQ ID NO: 93866 - RNA, 20 nt, Artificial Sequence
  MKO10093866_B_Iuga6
  gRNA
gaacagugacucccauccac

SEQ ID NO: 93867 - RNA, 20 nt, Artificial Sequence
  MKO10093867_B_Iuga7
  gRNA
cucucugucgagacucauau

SEQ ID NO: 93868 - RNA, 20 nt, Artificial Sequence
  MKO10093868_B_Iuga7
  gRNA
aaacuuuggacccugcugac

SEQ ID NO: 93869 - RNA, 20 nt, Artificial Sequence
  MKO10093869_B_Iuga7
  gRNA
gcuacagaguggacauugac

SEQ ID NO: 93870 - RNA, 20 nt, Artificial Sequence
  MKO10093870_B_Iuga8
  gRNA
cacuuacugguggugucaaa

SEQ ID NO: 93871 - RNA, 20 nt, Artificial Sequence
  MKO10093871_B_Iuga8
  gRNA
cuugugccccuuuguaucac

SEQ ID NO: 93872 - RNA, 20 nt, Artificial Sequence
  MKO10093872_B_Iuga8
  gRNA
ucugaaaccuaauccagcga

SEQ ID NO: 93873 - RNA, 20 nt, Artificial Sequence
  MKO10093873_B_Iuga9
  gRNA
cccuucuuccagcgaagcac

SEQ ID NO: 93874 - RNA, 20 nt, Artificial Sequence
  MKO10093874_B_Iuga9
  gRNA
gugcugccgaccugcagcuu

SEQ ID NO: 93875 - RNA, 20 nt, Artificial Sequence
  MKO10093875_B_Iuga9
  gRNA
uuucaugaggucaaagucua

SEQ ID NO: 93876 - RNA, 20 nt, Artificial Sequence
  MKO10093876_B_Iugad
  gRNA
gacauguucacugccucuag

SEQ ID NO: 93877 - RNA, 20 nt, Artificial Sequence
  MKO10093877_B_Iugad
  gRNA
uguuccucuagacucguggu

SEQ ID NO: 93878 - RNA, 20 nt, Artificial Sequence
  MKO10093878_B_Iugad
  gRNA
gcacaagcucucugugcagu

SEQ ID NO: 93879 - RNA, 20 nt, Artificial Sequence
  MKO10093879_B_Iugae
  gRNA
ucccgaccaaugucacuccc

SEQ ID NO: 93880 - RNA, 20 nt, Artificial Sequence
  MKO10093880_B_Iugae
  gRNA
ccaguccacauccaaauuga

SEQ ID NO: 93881 - RNA, 20 nt, Artificial Sequence
  MKO10093881_B_Iugae
  gRNA
ccuucaauuuggauguggac

SEQ ID NO: 93882 - RNA, 20 nt, Artificial Sequence
  MKO10093882_B_Iugal
  gRNA
acggccuacgcagagcuucu

SEQ ID NO: 93883 - RNA, 20 nt, Artificial Sequence
  MKO10093883_B_Iugal
  gRNA
gcuggcaacagaugccgcca

SEQ ID NO: 93884 - RNA, 20 nt, Artificial Sequence
  MKO10093884_B_Iugal
  gRNA
cccguguugucccccucacc

SEQ ID NO: 93885 - RNA, 20 nt, Artificial Sequence
  MKO10093885_B_Iugam
  gRNA
accuuccaagagaaugcaaa

SEQ ID NO: 93886 - RNA, 20 nt, Artificial Sequence
  MKO10093886_B_Iugam
  gRNA
aaggacauauucacagccuc

SEQ ID NO: 93887 - RNA, 20 nt, Artificial Sequence
  MKO10093887_B_Iugam
  gRNA
uauguccuugggccuguccc

SEQ ID NO: 93888 - RNA, 20 nt, Artificial Sequence
  MKO10093888_B_Iugav
  gRNA
uuuaagucccaccagugguu

SEQ ID NO: 93889 - RNA, 20 nt, Artificial Sequence
  MKO10093889_B_Iugav
  gRNA
uuaugccaaagaugacccac

SEQ ID NO: 93890 - RNA, 20 nt, Artificial Sequence
  MKO10093890_B_Iugav
  gRNA
ccugugcuccauuguaccac

SEQ ID NO: 93891 - RNA, 20 nt, Artificial Sequence
  MKO10093891_B_Iugax
  gRNA
ugugauagccacauuuguag

SEQ ID NO: 93892 - RNA, 20 nt, Artificial Sequence
  MKO10093892_B_Iugax
  gRNA
uaacucacccuggagggaga

SEQ ID NO: 93893 - RNA, 20 nt, Artificial Sequence
  MKO10093893_B_Iugax
  gRNA
agagagaauauauacuugac

SEQ ID NO: 93894 - RNA, 20 nt, Artificial Sequence
  MKO10093894_B_Iugb1bp1
  gRNA
gaguuccgaauaaaguaugu

SEQ ID NO: 93895 - RNA, 20 nt, Artificial Sequence
  MKO10093895_B_Iugb1bp1
  gRNA
aaauuacauagaugucgccc

SEQ ID NO: 93896 - RNA, 20 nt, Artificial Sequence
  MKO10093896_B_Iugb1bp1
  gRNA
augcccuguaucuaaucauc

SEQ ID NO: 93897 - RNA, 20 nt, Artificial Sequence
  MKO10093897_B_Iugb1bp2
  gRNA
gauuccugucgcuaucaccc

SEQ ID NO: 93898 - RNA, 20 nt, Artificial Sequence
  MKO10093898_B_Iugb1bp2
  gRNA
cucuuuacuuaggccuuucu

SEQ ID NO: 93899 - RNA, 20 nt, Artificial Sequence
  MKO10093899_B_Iugb1bp2
  gRNA
uauaagaagugguagcaguu

SEQ ID NO: 93900 - RNA, 20 nt, Artificial Sequence
  MKO10093900_B_Iugb1
  gRNA
auuacuucagacuuccgcau

SEQ ID NO: 93901 - RNA, 20 nt, Artificial Sequence
  MKO10093901_B_Iugb1
  gRNA
gcaacgcauaucuggaaacu

SEQ ID NO: 93902 - RNA, 20 nt, Artificial Sequence
  MKO10093902_B_Iugb1
  gRNA
uauacauucuccgcaagauu

SEQ ID NO: 93903 - RNA, 20 nt, Artificial Sequence
  MKO10093903_B_Iugb2l
  gRNA
ucaagcggcaacauucaaag

SEQ ID NO: 93904 - RNA, 20 nt, Artificial Sequence
  MKO10093904_B_Iugb2l
  gRNA
ugaccggauacaguccugac

SEQ ID NO: 93905 - RNA, 20 nt, Artificial Sequence
  MKO10093905_B_Iugb2l
  gRNA
gcaccugucaggacuguauc

SEQ ID NO: 93906 - RNA, 20 nt, Artificial Sequence
  MKO10093906_B_Iugb2
  gRNA
cucaccgaugcggccagacu

SEQ ID NO: 93907 - RNA, 20 nt, Artificial Sequence
  MKO10093907_B_Iugb2
  gRNA
cucaacgagaucaccgaguc

SEQ ID NO: 93908 - RNA, 20 nt, Artificial Sequence
  MKO10093908_B_Iugb2
  gRNA
gcaacugauuuccggaaacc

SEQ ID NO: 93909 - RNA, 20 nt, Artificial Sequence
  MKO10093909_B_Iugb3bp
  gRNA
acagcuuauucuccuacuac

SEQ ID NO: 93910 - RNA, 20 nt, Artificial Sequence
  MKO10093910_B_Iugb3bp
  gRNA
aguuaaaagaucacugaaac

SEQ ID NO: 93911 - RNA, 20 nt, Artificial Sequence
  MKO10093911_B_Iugb3bp
  gRNA
cccaucccugucuuucacug

SEQ ID NO: 93912 - RNA, 20 nt, Artificial Sequence
  MKO10093912_B_Iugb3
  gRNA
cgugcugacgcuaaccgacc

SEQ ID NO: 93913 - RNA, 20 nt, Artificial Sequence
  MKO10093913_B_Iugb3
  gRNA
cggcuuugacgccaucaugc

SEQ ID NO: 93914 - RNA, 20 nt, Artificial Sequence
  MKO10093914_B_Iugb3
  gRNA
aguaagcuugcgcaucugag

SEQ ID NO: 93915 - RNA, 20 nt, Artificial Sequence
  MKO10093915_B_Iugb4
  gRNA
cucaccagcgacuacaccau

SEQ ID NO: 93916 - RNA, 20 nt, Artificial Sequence
  MKO10093916_B_Iugb4
  gRNA
gagauaccuggcugcggugc

SEQ ID NO: 93917 - RNA, 20 nt, Artificial Sequence
  MKO10093917_B_Iugb4
  gRNA
cugcagccagaagcuccgcc

SEQ ID NO: 93918 - RNA, 20 nt, Artificial Sequence
  MKO10093918_B_Iugb5
  gRNA
auugcagugagccuccggcc

SEQ ID NO: 93919 - RNA, 20 nt, Artificial Sequence
  MKO10093919_B_Iugb5
  gRNA
uagagggucgcgggcacccg

SEQ ID NO: 93920 - RNA, 20 nt, Artificial Sequence
  MKO10093920_B_Iugb5
  gRNA
gggcucaacauaugcacuag

SEQ ID NO: 93921 - RNA, 20 nt, Artificial Sequence
  MKO10093921_B_Iugb6
  gRNA
gcuaauauugacacaccuga

SEQ ID NO: 93922 - RNA, 20 nt, Artificial Sequence
  MKO10093922_B_Iugb6
  gRNA
aaagcccagucuaaaguugc

SEQ ID NO: 93923 - RNA, 20 nt, Artificial Sequence
  MKO10093923_B_Iugb6
  gRNA
auuuaccuccugggagcacc

SEQ ID NO: 93924 - RNA, 20 nt, Artificial Sequence
  MKO10093924_B_Iugb7
  gRNA
ccacccaugccccagccgac

SEQ ID NO: 93925 - RNA, 20 nt, Artificial Sequence
  MKO10093925_B_Iugb7
  gRNA
gucacacauucugugcgcau

SEQ ID NO: 93926 - RNA, 20 nt, Artificial Sequence
  MKO10093926_B_Iugb7
  gRNA
cauaagguaauauaggucca

SEQ ID NO: 93927 - RNA, 20 nt, Artificial Sequence
  MKO10093927_B_Iugb8
  gRNA
agacuucucccggugucacc

SEQ ID NO: 93928 - RNA, 20 nt, Artificial Sequence
  MKO10093928_B_Iugb8
  gRNA
gucucaguccaacugcaucc

SEQ ID NO: 93929 - RNA, 20 nt, Artificial Sequence
  MKO10093929_B_Iugb8
  gRNA
cuccagcuggguccggaaug

SEQ ID NO: 93930 - RNA, 20 nt, Artificial Sequence
  MKO10093930_B_Iugbl1
  gRNA
ggccacgguaauugugacug

SEQ ID NO: 93931 - RNA, 20 nt, Artificial Sequence
  MKO10093931_B_Iugbl1
  gRNA
uugcuacagacuuugccauc

SEQ ID NO: 93932 - RNA, 20 nt, Artificial Sequence
  MKO10093932_B_Iugbl1
  gRNA
uccagugugacaucacccca

SEQ ID NO: 93933 - RNA, 20 nt, Artificial Sequence
  MKO10093933_B_Itih1
  gRNA
gccagcgcucuccccuaaaa

SEQ ID NO: 93934 - RNA, 20 nt, Artificial Sequence
  MKO10093934_B_Itih1
  gRNA
uuugcagaagcgacacgcug

SEQ ID NO: 93935 - RNA, 20 nt, Artificial Sequence
  MKO10093935_B_Itih1
  gRNA
cuacgucaucaccagccaag

SEQ ID NO: 93936 - RNA, 20 nt, Artificial Sequence
  MKO10093936_B_Itih2
  gRNA
cuuccauucucuugcacaaa

SEQ ID NO: 93937 - RNA, 20 nt, Artificial Sequence
  MKO10093937_B_Itih2
  gRNA
uugccugugaauaaagagcu

SEQ ID NO: 93938 - RNA, 20 nt, Artificial Sequence
  MKO10093938_B_Itih2
  gRNA
cucccauuugugcaagagaa

SEQ ID NO: 93939 - RNA, 20 nt, Artificial Sequence
  MKO10093939_B_Itih3
  gRNA
aaguucuuacccccucuggg

SEQ ID NO: 93940 - RNA, 20 nt, Artificial Sequence
  MKO10093940_B_Itih3
  gRNA
ucaaucugcaggaccauuga

SEQ ID NO: 93941 - RNA, 20 nt, Artificial Sequence
  MKO10093941_B_Itih3
  gRNA
auucacagugucugucaacg

SEQ ID NO: 93942 - RNA, 20 nt, Artificial Sequence
  MKO10093942_B_Itih4
  gRNA
uaccuucgaacucauauacc

SEQ ID NO: 93943 - RNA, 20 nt, Artificial Sequence
  MKO10093943_B_Itih4
  gRNA
agacccgggaguccaccgug

SEQ ID NO: 93944 - RNA, 20 nt, Artificial Sequence
  MKO10093944_B_Itih4
  gRNA
uccgaccacuacugccgaga

SEQ ID NO: 93945 - RNA, 20 nt, Artificial Sequence
  MKO10093945_B_Itih5
  gRNA
uacuuacucauuaucgucug

SEQ ID NO: 93946 - RNA, 20 nt, Artificial Sequence
  MKO10093946_B_Itih5
  gRNA
uuauaggagacagcguguau

SEQ ID NO: 93947 - RNA, 20 nt, Artificial Sequence
  MKO10093947_B_Itih5
  gRNA
acaccguggugaaggcauag

SEQ ID NO: 93948 - RNA, 20 nt, Artificial Sequence
  MKO10093948_B_Itk
  gRNA
cccuacgacccauccaagaa

SEQ ID NO: 93949 - RNA, 20 nt, Artificial Sequence
  MKO10093949_B_Itk
  gRNA
ugggugcugacccuuaaaga

SEQ ID NO: 93950 - RNA, 20 nt, Artificial Sequence
  MKO10093950_B_Itk
  gRNA
ccugaaaaggguauuuauag

SEQ ID NO: 93951 - RNA, 20 nt, Artificial Sequence
  MKO10093951_B_Itln1
  gRNA
cacuugggacauaaucuguu

SEQ ID NO: 93952 - RNA, 20 nt, Artificial Sequence
  MKO10093952_B_Itln1
  gRNA
uuuccuucuccguauuucac

SEQ ID NO: 93953 - RNA, 20 nt, Artificial Sequence
  MKO10093953_B_Itln1
  gRNA
ggaaaguguuggacugacaa

SEQ ID NO: 93954 - RNA, 20 nt, Artificial Sequence
  MKO10093954_B_Itm2a
  gRNA
ggagcucagaguugucccgc

SEQ ID NO: 93955 - RNA, 20 nt, Artificial Sequence
  MKO10093955_B_Itm2a
  gRNA
caguuucucugauagcgauc

SEQ ID NO: 93956 - RNA, 20 nt, Artificial Sequence
  MKO10093956_B_Itm2a
  gRNA
uuacaaguacuucaugccca

SEQ ID NO: 93957 - RNA, 20 nt, Artificial Sequence
  MKO10093957_B_Itm2b
  gRNA
ggaucgcuguccgcaaacuc

SEQ ID NO: 93958 - RNA, 20 nt, Artificial Sequence
  MKO10093958_B_Itm2b
  gRNA
auuccaggacccgggugacg

SEQ ID NO: 93959 - RNA, 20 nt, Artificial Sequence
  MKO10093959_B_Itm2b
  gRNA
guugaagucgugcacaaugu

SEQ ID NO: 93960 - RNA, 20 nt, Artificial Sequence
  MKO10093960_B_Itm2c
  gRNA
agccuccuuuccgggagcgg

SEQ ID NO: 93961 - RNA, 20 nt, Artificial Sequence
  MKO10093961_B_Itm2c
  gRNA
guaccuguagauguagaccg

SEQ ID NO: 93962 - RNA, 20 nt, Artificial Sequence
  MKO10093962_B_Itm2c
  gRNA
cgaugacguagcacuugucu

SEQ ID NO: 93963 - RNA, 20 nt, Artificial Sequence
  MKO10093963_B_Itpa
  gRNA
uucugagccuccaaagugca

SEQ ID NO: 93964 - RNA, 20 nt, Artificial Sequence
  MKO10093964_B_Itpa
  gRNA
ugccucccgacacuucugua

SEQ ID NO: 93965 - RNA, 20 nt, Artificial Sequence
  MKO10093965_B_Itpa
  gRNA
acaggugcagggcccugucc

SEQ ID NO: 93966 - RNA, 20 nt, Artificial Sequence
  MKO10093966_B_Itpk1
  gRNA
gaucuuucggauaaguucgu

SEQ ID NO: 93967 - RNA, 20 nt, Artificial Sequence
  MKO10093967_B_Itpk1
  gRNA
aaucugcucgccgccuuuca

SEQ ID NO: 93968 - RNA, 20 nt, Artificial Sequence
  MKO10093968_B_Itpk1
  gRNA
gcugaccgaugucauccucg

SEQ ID NO: 93969 - RNA, 20 nt, Artificial Sequence
  MKO10093969_B_Itpka
  gRNA
cuuucgcauugagggcauca

SEQ ID NO: 93970 - RNA, 20 nt, Artificial Sequence
  MKO10093970_B_Itpka
  gRNA
gcaagugacccgugucuuug

SEQ ID NO: 93971 - RNA, 20 nt, Artificial Sequence
  MKO10093971_B_Itpka
  gRNA
cuuucagaaagcgcuacucc

SEQ ID NO: 93972 - RNA, 20 nt, Artificial Sequence
  MKO10093972_B_Itpkb
  gRNA
ucccgccacugcauguaacg

SEQ ID NO: 93973 - RNA, 20 nt, Artificial Sequence
  MKO10093973_B_Itpkb
  gRNA
cgucacucaccaagauguuc

SEQ ID NO: 93974 - RNA, 20 nt, Artificial Sequence
  MKO10093974_B_Itpkb
  gRNA
ccuucaagaagaaguacccc

SEQ ID NO: 93975 - RNA, 20 nt, Artificial Sequence
  MKO10093975_B_Itpkc
  gRNA
ugcaccaugccauaauaagc

SEQ ID NO: 93976 - RNA, 20 nt, Artificial Sequence
  MKO10093976_B_Itpkc
  gRNA
caucuugcaguccaugauag

SEQ ID NO: 93977 - RNA, 20 nt, Artificial Sequence
  MKO10093977_B_Itpkc
  gRNA
uuaccuugaugccuucaauc

SEQ ID NO: 93978 - RNA, 20 nt, Artificial Sequence
  MKO10093978_B_Itpr1
  gRNA
uucuacaagcuucgcuccau

SEQ ID NO: 93979 - RNA, 20 nt, Artificial Sequence
  MKO10093979_B_Itpr1
  gRNA
cucguccaacgucacccuca

SEQ ID NO: 93980 - RNA, 20 nt, Artificial Sequence
  MKO10093980_B_Itpr1
  gRNA
cacugcaucuguagugcugu

SEQ ID NO: 93981 - RNA, 20 nt, Artificial Sequence
  MKO10093981_B_Itpr2
  gRNA
uuggcaaggucucccgccuc

SEQ ID NO: 93982 - RNA, 20 nt, Artificial Sequence
  MKO10093982_B_Itpr2
  gRNA
ugggcagaguaucgauucau

SEQ ID NO: 93983 - RNA, 20 nt, Artificial Sequence
  MKO10093983_B_Itpr2
  gRNA
cuuguagcaugcugcagagc

SEQ ID NO: 93984 - RNA, 20 nt, Artificial Sequence
  MKO10093984_B_Itpr3
  gRNA
aacccccccaagaaguuccg

SEQ ID NO: 93985 - RNA, 20 nt, Artificial Sequence
  MKO10093985_B_Itpr3
  gRNA
cacggggacguggugaagua

SEQ ID NO: 93986 - RNA, 20 nt, Artificial Sequence
  MKO10093986_B_Itpr3
  gRNA
uuuguccuguuuagucugcu

SEQ ID NO: 93987 - RNA, 20 nt, Artificial Sequence
  MKO10093987_B_Itpripl1
  gRNA
gacccagaauuucgaugucc

SEQ ID NO: 93988 - RNA, 20 nt, Artificial Sequence
  MKO10093988_B_Itpripl1
  gRNA
uggaccuggacacgcuagcu

SEQ ID NO: 93989 - RNA, 20 nt, Artificial Sequence
  MKO10093989_B_Itpripl1
  gRNA
cucccggggguaagaucuga

SEQ ID NO: 93990 - RNA, 20 nt, Artificial Sequence
  MKO10093990_B_Itpripl2
  gRNA
cagcgcgguugcuguccacg

SEQ ID NO: 93991 - RNA, 20 nt, Artificial Sequence
  MKO10093991_B_Itpripl2
  gRNA
auccgccagcgccuguugcc

SEQ ID NO: 93992 - RNA, 20 nt, Artificial Sequence
  MKO10093992_B_Itpripl2
  gRNA
ggcagcagccauaguccgug

SEQ ID NO: 93993 - RNA, 20 nt, Artificial Sequence
  MKO10093993_B_Itprip
  gRNA
aagaguccgcugcaagacga

SEQ ID NO: 93994 - RNA, 20 nt, Artificial Sequence
  MKO10093994_B_Itprip
  gRNA
gaauacucgcuaaugagcgc

SEQ ID NO: 93995 - RNA, 20 nt, Artificial Sequence
  MKO10093995_B_Itprip
  gRNA
acucauacuugugggcgaug

SEQ ID NO: 93996 - RNA, 20 nt, Artificial Sequence
  MKO10093996_B_Itsn1
  gRNA
aaacuuaccaccgaaaggug

SEQ ID NO: 93997 - RNA, 20 nt, Artificial Sequence
  MKO10093997_B_Itsn1
  gRNA
acuuuacaggugaucaagcg

SEQ ID NO: 93998 - RNA, 20 nt, Artificial Sequence
  MKO10093998_B_Itsn1
  gRNA
gcucaguuucccacaccuuu

SEQ ID NO: 93999 - RNA, 20 nt, Artificial Sequence
  MKO10093999_B_Itsn2
  gRNA
cuaggggagcaggcaucauu

SEQ ID NO: 94000 - RNA, 20 nt, Artificial Sequence
  MKO10094000_B_Itsn2
  gRNA
uuugauaaccucaaaccuuc

SEQ ID NO: 94001 - RNA, 20 nt, Artificial Sequence
  MKO10094001_B_Itsn2
  gRNA
aguacauccucauuaccaaa

SEQ ID NO: 94002 - RNA, 20 nt, Artificial Sequence
  MKO10094002_B_Ivd
  gRNA
gccaugagugaacccaaugc

SEQ ID NO: 94003 - RNA, 20 nt, Artificial Sequence
  MKO10094003_B_Ivd
  gRNA
uugaucaaucucuugggccu

SEQ ID NO: 94004 - RNA, 20 nt, Artificial Sequence
  MKO10094004_B_Ivd
  gRNA
cucaucaguggugaguucau

SEQ ID NO: 94005 - RNA, 20 nt, Artificial Sequence
  MKO10094005_B_Ivl
  gRNA
uuaucaaggaccaaaaagcc

SEQ ID NO: 94006 - RNA, 20 nt, Artificial Sequence
  MKO10094006_B_Ivl
  gRNA
uuuacuagugcuugauccag

SEQ ID NO: 94007 - RNA, 20 nt, Artificial Sequence
  MKO10094007_B_Ivl
  gRNA
agauuacucacaucuagaac

SEQ ID NO: 94008 - RNA, 20 nt, Artificial Sequence
  MKO10094008_B_Ivns1abp
  gRNA
gccaugagaugcuagcacac

SEQ ID NO: 94009 - RNA, 20 nt, Artificial Sequence
  MKO10094009_B_Ivns1abp
  gRNA
cuacuccuuaccuuuagucu

SEQ ID NO: 94010 - RNA, 20 nt, Artificial Sequence
  MKO10094010_B_Ivns1abp
  gRNA
uucacaugagaaacuccaug

SEQ ID NO: 94011 - RNA, 20 nt, Artificial Sequence
  MKO10094011_B_Iws1
  gRNA
caaaccccgagucagcgacu

SEQ ID NO: 94012 - RNA, 20 nt, Artificial Sequence
  MKO10094012_B_Iws1
  gRNA
cucugauagugauguuguau

SEQ ID NO: 94013 - RNA, 20 nt, Artificial Sequence
  MKO10094013_B_Iws1
  gRNA
uuugggagugacagugaguc

SEQ ID NO: 94014 - RNA, 20 nt, Artificial Sequence
  MKO10094014_B_Iyd
  gRNA
uccucgucugagggugcucc

SEQ ID NO: 94015 - RNA, 20 nt, Artificial Sequence
  MKO10094015_B_Iyd
  gRNA
cacugaucucguuguaguag

SEQ ID NO: 94016 - RNA, 20 nt, Artificial Sequence
  MKO10094016_B_Iyd
  gRNA
gaucagagagauuaucgaag

SEQ ID NO: 94017 - RNA, 20 nt, Artificial Sequence
  MKO10094017_B_Izumo1
  gRNA
ccuaggagagcucuuuauaa

SEQ ID NO: 94018 - RNA, 20 nt, Artificial Sequence
  MKO10094018_B_Izumo1
  gRNA
guggaugcuucgucaucaaa

SEQ ID NO: 94019 - RNA, 20 nt, Artificial Sequence
  MKO10094019_B_Izumo1
  gRNA
guucuuugucccaacaaaug

SEQ ID NO: 94020 - RNA, 20 nt, Artificial Sequence
  MKO10094020_B_Izumo2
  gRNA
gaaccaagcccaguauauaa

SEQ ID NO: 94021 - RNA, 20 nt, Artificial Sequence
  MKO10094021_B_Izumo2
  gRNA
cuucagggaacaugccauca

SEQ ID NO: 94022 - RNA, 20 nt, Artificial Sequence
  MKO10094022_B_Izumo2
  gRNA
uuccucagacguuccucugc

SEQ ID NO: 94023 - RNA, 20 nt, Artificial Sequence
  MKO10094023_B_Izumo3
  gRNA
uaaggagucuuuaucauuca

SEQ ID NO: 94024 - RNA, 20 nt, Artificial Sequence
  MKO10094024_B_Izumo3
  gRNA
augugaucaaauugagagaa

SEQ ID NO: 94025 - RNA, 20 nt, Artificial Sequence
  MKO10094025_B_Izumo3
  gRNA
ucgauuguuggaacugucuu

SEQ ID NO: 94026 - RNA, 20 nt, Artificial Sequence
  MKO10094026_B_Izumo4
  gRNA
auugacugucagcgucacug

SEQ ID NO: 94027 - RNA, 20 nt, Artificial Sequence
  MKO10094027_B_Izumo4
  gRNA
aguagccaaagcaaaugacg

SEQ ID NO: 94028 - RNA, 20 nt, Artificial Sequence
  MKO10094028_B_Izumo4
  gRNA
caggggaagauguacuuccc

SEQ ID NO: 94029 - RNA, 20 nt, Artificial Sequence
  MKO10094029_B_Jade1
  gRNA
ucguugccguccucgccauc

SEQ ID NO: 94030 - RNA, 20 nt, Artificial Sequence
  MKO10094030_B_Jade1
  gRNA
ccucaggcuugucaacgaca

SEQ ID NO: 94031 - RNA, 20 nt, Artificial Sequence
  MKO10094031_B_Jade1
  gRNA
agguacuacuccucccaugc

SEQ ID NO: 94032 - RNA, 20 nt, Artificial Sequence
  MKO10094032_B_Jade2
  gRNA
gcugggcaucgaguacgacg

SEQ ID NO: 94033 - RNA, 20 nt, Artificial Sequence
  MKO10094033_B_Jade2
  gRNA
aguacgcaucgaucucaucc

SEQ ID NO: 94034 - RNA, 20 nt, Artificial Sequence
  MKO10094034_B_Jade2
  gRNA
uucucccauucuugucgcca

SEQ ID NO: 94035 - RNA, 20 nt, Artificial Sequence
  MKO10094035_B_Jade3
  gRNA
cucugagaucuuccaacgua

SEQ ID NO: 94036 - RNA, 20 nt, Artificial Sequence
  MKO10094036_B_Jade3
  gRNA
cugauccaaucugcuagacu

SEQ ID NO: 94037 - RNA, 20 nt, Artificial Sequence
  MKO10094037_B_Jade3
  gRNA
agccuugcuucuguugucua

SEQ ID NO: 94038 - RNA, 20 nt, Artificial Sequence
  MKO10094038_B_Jag1
  gRNA
auggguccugauugcaacaa

SEQ ID NO: 94039 - RNA, 20 nt, Artificial Sequence
  MKO10094039_B_Jag1
  gRNA
cuuacgaauagugucauuac

SEQ ID NO: 94040 - RNA, 20 nt, Artificial Sequence
  MKO10094040_B_Jag1
  gRNA
ggccuccaccagcaaagugu

SEQ ID NO: 94041 - RNA, 20 nt, Artificial Sequence
  MKO10094041_B_Jag2
  gRNA
cacuauaccugcgaccagua

SEQ ID NO: 94042 - RNA, 20 nt, Artificial Sequence
  MKO10094042_B_Jag2
  gRNA
ggcauacucaccaucuggag

SEQ ID NO: 94043 - RNA, 20 nt, Artificial Sequence
  MKO10094043_B_Jag2
  gRNA
agucccaggccuccacgaug

SEQ ID NO: 94044 - RNA, 20 nt, Artificial Sequence
  MKO10094044_B_Jagn1
  gRNA
agcgauaggccuugccaugg

SEQ ID NO: 94045 - RNA, 20 nt, Artificial Sequence
  MKO10094045_B_Jagn1
  gRNA
gcaacucuaccgccauggca

SEQ ID NO: 94046 - RNA, 20 nt, Artificial Sequence
  MKO10094046_B_Jagn1
  gRNA
gcuucuugauuucguacuug

SEQ ID NO: 94047 - RNA, 20 nt, Artificial Sequence
  MKO10094047_B_Jak1
  gRNA
gaaggcguaccugaugucuu

SEQ ID NO: 94048 - RNA, 20 nt, Artificial Sequence
  MKO10094048_B_Jak1
  gRNA
guaugauuugaucaaaugcc

SEQ ID NO: 94049 - RNA, 20 nt, Artificial Sequence
  MKO10094049_B_Jak1
  gRNA
uagaaagucaccuccacucc

SEQ ID NO: 94050 - RNA, 20 nt, Artificial Sequence
  MKO10094050_B_Jak2
  gRNA
cguuaaugagugaaaccgaa

SEQ ID NO: 94051 - RNA, 20 nt, Artificial Sequence
  MKO10094051_B_Jak2
  gRNA
aucuguaccugauucgcuuc

SEQ ID NO: 94052 - RNA, 20 nt, Artificial Sequence
  MKO10094052_B_Jak2
  gRNA
cugccacuacaguaccaaug

SEQ ID NO: 94053 - RNA, 20 nt, Artificial Sequence
  MKO10094053_B_Jak3
  gRNA
aaucuuugcgcagcccaaag

SEQ ID NO: 94054 - RNA, 20 nt, Artificial Sequence
  MKO10094054_B_Jak3
  gRNA
gacccagcaccgcagugacc

SEQ ID NO: 94055 - RNA, 20 nt, Artificial Sequence
  MKO10094055_B_Jak3
  gRNA
cccggugggccuuagcauga

SEQ ID NO: 94056 - RNA, 20 nt, Artificial Sequence
  MKO10094056_B_Jakmip1
  gRNA
ucuccacguucucccucgug

SEQ ID NO: 94057 - RNA, 20 nt, Artificial Sequence
  MKO10094057_B_Jakmip1
  gRNA
ugcugcagcugaagcgcucu

SEQ ID NO: 94058 - RNA, 20 nt, Artificial Sequence
  MKO10094058_B_Jakmip1
  gRNA
uaccagauggacgagaucaa

SEQ ID NO: 94059 - RNA, 20 nt, Artificial Sequence
  MKO10094059_B_Jakmip2
  gRNA
gucuucuaacuuucguauag

SEQ ID NO: 94060 - RNA, 20 nt, Artificial Sequence
  MKO10094060_B_Jakmip2
  gRNA
auuccgcucaucuccaagca

SEQ ID NO: 94061 - RNA, 20 nt, Artificial Sequence
  MKO10094061_B_Jakmip2
  gRNA
caucaguucaucguuucucu

SEQ ID NO: 94062 - RNA, 20 nt, Artificial Sequence
  MKO10094062_B_Jakmip3
  gRNA
auccacgccaaacucuuggc

SEQ ID NO: 94063 - RNA, 20 nt, Artificial Sequence
  MKO10094063_B_Jakmip3
  gRNA
cgggaacuuccuuaugcaag

SEQ ID NO: 94064 - RNA, 20 nt, Artificial Sequence
  MKO10094064_B_Jakmip3
  gRNA
ucuccugcaccgcuugcaua

SEQ ID NO: 94065 - RNA, 20 nt, Artificial Sequence
  MKO10094065_B_Jam2
  gRNA
cuccuuggucuacuaccaac

SEQ ID NO: 94066 - RNA, 20 nt, Artificial Sequence
  MKO10094066_B_Jam2
  gRNA
guuguuccuagaggcuauuu

SEQ ID NO: 94067 - RNA, 20 nt, Artificial Sequence
  MKO10094067_B_Jam2
  gRNA
aaagucaugcuagaaguacu

SEQ ID NO: 94068 - RNA, 20 nt, Artificial Sequence
  MKO10094068_B_Jam3
  gRNA
aguguugccgucuugccuac

SEQ ID NO: 94069 - RNA, 20 nt, Artificial Sequence
  MKO10094069_B_Jam3
  gRNA
uucagccaucuaucgcugug

SEQ ID NO: 94070 - RNA, 20 nt, Artificial Sequence
  MKO10094070_B_Jam3
  gRNA
cccuuuaggcugcaugauag

SEQ ID NO: 94071 - RNA, 20 nt, Artificial Sequence
  MKO10094071_B_Jarid2
  gRNA
acucaccauuuaccgccuuc

SEQ ID NO: 94072 - RNA, 20 nt, Artificial Sequence
  MKO10094072_B_Jarid2
  gRNA
gcccguuguguacaugcuua

SEQ ID NO: 94073 - RNA, 20 nt, Artificial Sequence
  MKO10094073_B_Jarid2
  gRNA
cacaacuccagugaagauag

SEQ ID NO: 94074 - RNA, 20 nt, Artificial Sequence
  MKO10094074_B_Jazf1
  gRNA
uccgcaaaccauucaaaugc

SEQ ID NO: 94075 - RNA, 20 nt, Artificial Sequence
  MKO10094075_B_Jazf1
  gRNA
cacaggcagcgaguaugaug

SEQ ID NO: 94076 - RNA, 20 nt, Artificial Sequence
  MKO10094076_B_Jazf1
  gRNA
gcugcagcagccgaccuaug

SEQ ID NO: 94077 - RNA, 20 nt, Artificial Sequence
  MKO10094077_B_Jdp2
  gRNA
ucgugcgcacagauagcguc

SEQ ID NO: 94078 - RNA, 20 nt, Artificial Sequence
  MKO10094078_B_Jdp2
  gRNA
aacgcacagaguuucugcag

SEQ ID NO: 94079 - RNA, 20 nt, Artificial Sequence
  MKO10094079_B_Jdp2
  gRNA
ugcguuccuucuucuuguuc

SEQ ID NO: 94080 - RNA, 20 nt, Artificial Sequence
  MKO10094080_B_Jkamp
  gRNA
uagagccagucguaaaguuc

SEQ ID NO: 94081 - RNA, 20 nt, Artificial Sequence
  MKO10094081_B_Jkamp
  gRNA
gcaugccuuggacucuacug

SEQ ID NO: 94082 - RNA, 20 nt, Artificial Sequence
  MKO10094082_B_Jkamp
  gRNA
ucuucccacaguagagucca

SEQ ID NO: 94083 - RNA, 20 nt, Artificial Sequence
  MKO10094083_B_Jmjd1c
  gRNA
caugaucguuaugaaugauc

SEQ ID NO: 94084 - RNA, 20 nt, Artificial Sequence
  MKO10094084_B_Jmjd1c
  gRNA
gacaagauucugccacccag

SEQ ID NO: 94085 - RNA, 20 nt, Artificial Sequence
  MKO10094085_B_Jmjd1c
  gRNA
aaauaugauuguguaucacg

SEQ ID NO: 94086 - RNA, 20 nt, Artificial Sequence
  MKO10094086_B_Jmjd4
  gRNA
ugcaggagacgcgguuguac

SEQ ID NO: 94087 - RNA, 20 nt, Artificial Sequence
  MKO10094087_B_Jmjd4
  gRNA
ggcguucggggucugaauga

SEQ ID NO: 94088 - RNA, 20 nt, Artificial Sequence
  MKO10094088_B_Jmjd4
  gRNA
uuaccagguuguacacuuga

SEQ ID NO: 94089 - RNA, 20 nt, Artificial Sequence
  MKO10094089_B_Jmjd6
  gRNA
ugaguccgagucugacgagc

SEQ ID NO: 94090 - RNA, 20 nt, Artificial Sequence
  MKO10094090_B_Jmjd6
  gRNA
ggccaccgcguucuggaacu

SEQ ID NO: 94091 - RNA, 20 nt, Artificial Sequence
  MKO10094091_B_Jmjd6
  gRNA
accgucuugugccacacaac

SEQ ID NO: 94092 - RNA, 20 nt, Artificial Sequence
  MKO10094092_B_Jmjd7
  gRNA
caccuuaccuuaaguaggac

SEQ ID NO: 94093 - RNA, 20 nt, Artificial Sequence
  MKO10094093_B_Jmjd7
  gRNA
uguuacauccacccagcgac

SEQ ID NO: 94094 - RNA, 20 nt, Artificial Sequence
  MKO10094094_B_Jmjd7
  gRNA
aaucuguacuguguagucuc

SEQ ID NO: 94095 - RNA, 20 nt, Artificial Sequence
  MKO10094095_B_Jmjd8
  gRNA
cucaagcccgucaucuugca

SEQ ID NO: 94096 - RNA, 20 nt, Artificial Sequence
  MKO10094096_B_Jmjd8
  gRNA
agcguugcacaguggagcgu

SEQ ID NO: 94097 - RNA, 20 nt, Artificial Sequence
  MKO10094097_B_Jmjd8
  gRNA
cacauacugcugcaugaauu

SEQ ID NO: 94098 - RNA, 20 nt, Artificial Sequence
  MKO10094098_B_Jmy
  gRNA
uguagacucucaauucuucg

SEQ ID NO: 94099 - RNA, 20 nt, Artificial Sequence
  MKO10094099_B_Jmy
  gRNA
aguucucgcaugucucggaa

SEQ ID NO: 94100 - RNA, 20 nt, Artificial Sequence
  MKO10094100_B_Jmy
  gRNA
uuccauggagaaugauuauu

SEQ ID NO: 94101 - RNA, 20 nt, Artificial Sequence
  MKO10094101_B_Josd1
  gRNA
aaaacaugaguugcgugcca

SEQ ID NO: 94102 - RNA, 20 nt, Artificial Sequence
  MKO10094102_B_Josd1
  gRNA
ccaaacagcuucauagccuu

SEQ ID NO: 94103 - RNA, 20 nt, Artificial Sequence
  MKO10094103_B_Josd1
  gRNA
cauugcucuuacuaauguca

SEQ ID NO: 94104 - RNA, 20 nt, Artificial Sequence
  MKO10094104_B_Josd2
  gRNA
ugacuccauccucguccccc

SEQ ID NO: 94105 - RNA, 20 nt, Artificial Sequence
  MKO10094105_B_Josd2
  gRNA
acccagugucggcggcgcag

SEQ ID NO: 94106 - RNA, 20 nt, Artificial Sequence
  MKO10094106_B_Josd2
  gRNA
gaacccccaucgcagucucu

SEQ ID NO: 94107 - RNA, 20 nt, Artificial Sequence
  MKO10094107_B_Jph1
  gRNA
uuagggggaccccacuuguu

SEQ ID NO: 94108 - RNA, 20 nt, Artificial Sequence
  MKO10094108_B_Jph1
  gRNA
cucuugcuaugucgcacucc

SEQ ID NO: 94109 - RNA, 20 nt, Artificial Sequence
  MKO10094109_B_Jph1
  gRNA
uaauuccaucaugauugucc

SEQ ID NO: 94110 - RNA, 20 nt, Artificial Sequence
  MKO10094110_B_Jph2
  gRNA
cagccggcccgccacgccgu

SEQ ID NO: 94111 - RNA, 20 nt, Artificial Sequence
  MKO10094111_B_Jph2
  gRNA
guccaacaucgcccguacau

SEQ ID NO: 94112 - RNA, 20 nt, Artificial Sequence
  MKO10094112_B_Jph2
  gRNA
gaucuugcugaacaucggcc

SEQ ID NO: 94113 - RNA, 20 nt, Artificial Sequence
  MKO10094113_B_Jph3
  gRNA
gauguccugcgaugauaucg

SEQ ID NO: 94114 - RNA, 20 nt, Artificial Sequence
  MKO10094114_B_Jph3
  gRNA
auggugauccugcucaacau

SEQ ID NO: 94115 - RNA, 20 nt, Artificial Sequence
  MKO10094115_B_Jph3
  gRNA
gaucaccaugacgaccaaga

SEQ ID NO: 94116 - RNA, 20 nt, Artificial Sequence
  MKO10094116_B_Jph4
  gRNA
agccuucuccgcgacgcugc

SEQ ID NO: 94117 - RNA, 20 nt, Artificial Sequence
  MKO10094117_B_Jph4
  gRNA
cacuccucgggccaagcuuu

SEQ ID NO: 94118 - RNA, 20 nt, Artificial Sequence
  MKO10094118_B_Jph4
  gRNA
agccagcagcgucgcggaga

SEQ ID NO: 94119 - RNA, 20 nt, Artificial Sequence
  MKO10094119_B_Jrkl
  gRNA
auguguugcaccaaugcaac

SEQ ID NO: 94120 - RNA, 20 nt, Artificial Sequence
  MKO10094120_B_Jrkl
  gRNA
aggcucauccaagcaauugg

SEQ ID NO: 94121 - RNA, 20 nt, Artificial Sequence
  MKO10094121_B_Jrkl
  gRNA
aaaaaagaacucugcccguu

SEQ ID NO: 94122 - RNA, 20 nt, Artificial Sequence
  MKO10094122_B_Jrk
  gRNA
gggcccuaugcucaucgaaa

SEQ ID NO: 94123 - RNA, 20 nt, Artificial Sequence
  MKO10094123_B_Jrk
  gRNA
cgccugccgagagucugagc

SEQ ID NO: 94124 - RNA, 20 nt, Artificial Sequence
  MKO10094124_B_Jrk
  gRNA
uggaccgggugcucuaugag

SEQ ID NO: 94125 - RNA, 20 nt, Artificial Sequence
  MKO10094125_B_Jsrp1
  gRNA
acucacauggguccagucac

SEQ ID NO: 94126 - RNA, 20 nt, Artificial Sequence
  MKO10094126_B_Jsrp1
  gRNA
gcuggcgacgcuuccuucuu

SEQ ID NO: 94127 - RNA, 20 nt, Artificial Sequence
  MKO10094127_B_Jsrp1
  gRNA
ugccuuucagacgcaguggc

SEQ ID NO: 94128 - RNA, 20 nt, Artificial Sequence
  MKO10094128_B_Jtb
  gRNA
gcacuucaacuucgccaugu

SEQ ID NO: 94129 - RNA, 20 nt, Artificial Sequence
  MKO10094129_B_Jtb
  gRNA
acaaucuggaaguuagaaca

SEQ ID NO: 94130 - RNA, 20 nt, Artificial Sequence
  MKO10094130_B_Jtb
  gRNA
uacccuguagaaccacacuc

SEQ ID NO: 94131 - RNA, 20 nt, Artificial Sequence
  MKO10094131_B_Junb
  gRNA
acacguuggggggcgucacg

SEQ ID NO: 94132 - RNA, 20 nt, Artificial Sequence
  MKO10094132_B_Junb
  gRNA
uaagagucgucgugauagaa

SEQ ID NO: 94133 - RNA, 20 nt, Artificial Sequence
  MKO10094133_B_Junb
  gRNA
auccgccagguugagcgcca

SEQ ID NO: 94134 - RNA, 20 nt, Artificial Sequence
  MKO10094134_B_Jund
  gRNA
cgaagccagcagcccgucgg

SEQ ID NO: 94135 - RNA, 20 nt, Artificial Sequence
  MKO10094135_B_Jund
  gRNA
gcgggugcgucgagcgucgc

SEQ ID NO: 94136 - RNA, 20 nt, Artificial Sequence
  MKO10094136_B_Jund
  gRNA
gguaguggucaccagcccgu

SEQ ID NO: 94137 - RNA, 20 nt, Artificial Sequence
  MKO10094137_B_Jun
  gRNA
ucguuccuccaguccgagag

SEQ ID NO: 94138 - RNA, 20 nt, Artificial Sequence
  MKO10094138_B_Jun
  gRNA
cuuaggguuacuguagccgu

SEQ ID NO: 94139 - RNA, 20 nt, Artificial Sequence
  MKO10094139_B_Jun
  gRNA
gaaagcgcaaaacuccgagc

SEQ ID NO: 94140 - RNA, 20 nt, Artificial Sequence
  MKO10094140_B_Jup
  gRNA
uagcaacaagcccgccaucg

SEQ ID NO: 94141 - RNA, 20 nt, Artificial Sequence
  MKO10094141_B_Jup
  gRNA
gacaaccaaucugcagcgcc

SEQ ID NO: 94142 - RNA, 20 nt, Artificial Sequence
  MKO10094142_B_Jup
  gRNA
cgauggccgacuugagcaac

SEQ ID NO: 94143 - RNA, 20 nt, Artificial Sequence
  MKO10094143_B_Kalrn
  gRNA
uucaccuuaccuuggcacgc

SEQ ID NO: 94144 - RNA, 20 nt, Artificial Sequence
  MKO10094144_B_Kalrn
  gRNA
agggguccaccagcuucgug

SEQ ID NO: 94145 - RNA, 20 nt, Artificial Sequence
  MKO10094145_B_Kalrn
  gRNA
gccccgcaugucgaugauga

SEQ ID NO: 94146 - RNA, 20 nt, Artificial Sequence
  MKO10094146_B_Kank1
  gRNA
gucacacucgucaucugacu

SEQ ID NO: 94147 - RNA, 20 nt, Artificial Sequence
  MKO10094147_B_Kank1
  gRNA
agacuuaccguagaggccag

SEQ ID NO: 94148 - RNA, 20 nt, Artificial Sequence
  MKO10094148_B_Kank1
  gRNA
gggcaggguacuuccuugca

SEQ ID NO: 94149 - RNA, 20 nt, Artificial Sequence
  MKO10094149_B_Kank2
  gRNA
ugcaguggccacgaccaguc

SEQ ID NO: 94150 - RNA, 20 nt, Artificial Sequence
  MKO10094150_B_Kank2
  gRNA
cgccauugacucccacaaac

SEQ ID NO: 94151 - RNA, 20 nt, Artificial Sequence
  MKO10094151_B_Kank2
  gRNA
cagacccugaagucaaccag

SEQ ID NO: 94152 - RNA, 20 nt, Artificial Sequence
  MKO10094152_B_Kank3
  gRNA
cccaagagucugcaguucgu

SEQ ID NO: 94153 - RNA, 20 nt, Artificial Sequence
  MKO10094153_B_Kank3
  gRNA
aucgcuguugccauccucac

SEQ ID NO: 94154 - RNA, 20 nt, Artificial Sequence
  MKO10094154_B_Kank3
  gRNA
cccugacuggauugugcacc

SEQ ID NO: 94155 - RNA, 20 nt, Artificial Sequence
  MKO10094155_B_Kank4
  gRNA
ugcucagcucgauuucgucc

SEQ ID NO: 94156 - RNA, 20 nt, Artificial Sequence
  MKO10094156_B_Kank4
  gRNA
cgcguuaagaaauuccucug

SEQ ID NO: 94157 - RNA, 20 nt, Artificial Sequence
  MKO10094157_B_Kank4
  gRNA
ugguauccccaguuuccggc

SEQ ID NO: 94158 - RNA, 20 nt, Artificial Sequence
  MKO10094158_B_Kansl1l
  gRNA
uaaaggcucuucacuccucu

SEQ ID NO: 94159 - RNA, 20 nt, Artificial Sequence
  MKO10094159_B_Kansl1l
  gRNA
uagaggcacgaaucugccug

SEQ ID NO: 94160 - RNA, 20 nt, Artificial Sequence
  MKO10094160_B_Kansl1l
  gRNA
ugccauuagccagacauuug

SEQ ID NO: 94161 - RNA, 20 nt, Artificial Sequence
  MKO10094161_B_Kansl1
  gRNA
cuguuaacaacuccauugac

SEQ ID NO: 94162 - RNA, 20 nt, Artificial Sequence
  MKO10094162_B_Kansl1
  gRNA
gagcagcuauugucagccgc

SEQ ID NO: 94163 - RNA, 20 nt, Artificial Sequence
  MKO10094163_B_Kansl1
  gRNA
aguaagucuguuguaugauc

SEQ ID NO: 94164 - RNA, 20 nt, Artificial Sequence
  MKO10094164_B_Kansl2
  gRNA
caaaugaagaagagcaaccc

SEQ ID NO: 94165 - RNA, 20 nt, Artificial Sequence
  MKO10094165_B_Kansl2
  gRNA
uugaucacugucuaugcuau

SEQ ID NO: 94166 - RNA, 20 nt, Artificial Sequence
  MKO10094166_B_Kansl2
  gRNA
ugucuauacagcugaagaag

SEQ ID NO: 94167 - RNA, 20 nt, Artificial Sequence
  MKO10094167_B_Kansl3
  gRNA
gucagacguuccaauagaug

SEQ ID NO: 94168 - RNA, 20 nt, Artificial Sequence
  MKO10094168_B_Kansl3
  gRNA
acagccacgcgacgcagcac

SEQ ID NO: 94169 - RNA, 20 nt, Artificial Sequence
  MKO10094169_B_Kansl3
  gRNA
gugaccgucuccacaucuau

SEQ ID NO: 94170 - RNA, 20 nt, Artificial Sequence
  MKO10094170_B_Kap
  gRNA
gagacuggauucccagcuaa

SEQ ID NO: 94171 - RNA, 20 nt, Artificial Sequence
  MKO10094171_B_Kap
  gRNA
uacacauaccuaauucugac

SEQ ID NO: 94172 - RNA, 20 nt, Artificial Sequence
  MKO10094172_B_Kap
  gRNA
cuggugaucacugucuucug

SEQ ID NO: 94173 - RNA, 20 nt, Artificial Sequence
  MKO10094173_B_Kars
  gRNA
ccacgccauugucagccgug

SEQ ID NO: 94174 - RNA, 20 nt, Artificial Sequence
  MKO10094174_B_Kars
  gRNA
ugcuuccgcucccaaccaca

SEQ ID NO: 94175 - RNA, 20 nt, Artificial Sequence
  MKO10094175_B_Kars
  gRNA
cucaucuucuaugaccugcg

SEQ ID NO: 94176 - RNA, 20 nt, Artificial Sequence
  MKO10094176_B_Kau2a
  gRNA
cuggagguccaugcggggug

SEQ ID NO: 94177 - RNA, 20 nt, Artificial Sequence
  MKO10094177_B_Kau2a
  gRNA
cgcccuaccuguucaauguu

SEQ ID NO: 94178 - RNA, 20 nt, Artificial Sequence
  MKO10094178_B_Kau2a
  gRNA
ccguagcugugagcacccuu

SEQ ID NO: 94179 - RNA, 20 nt, Artificial Sequence
  MKO10094179_B_Kau2b
  gRNA
uaugcuuaccuguucaauac

SEQ ID NO: 94180 - RNA, 20 nt, Artificial Sequence
  MKO10094180_B_Kau2b
  gRNA
uagguagaaguacacuuguu

SEQ ID NO: 94181 - RNA, 20 nt, Artificial Sequence
  MKO10094181_B_Kau2b
  gRNA
ugagaagcccaguauugaac

SEQ ID NO: 94182 - RNA, 20 nt, Artificial Sequence
  MKO10094182_B_Kau5
  gRNA
ggacccaggaaguccguucu

SEQ ID NO: 94183 - RNA, 20 nt, Artificial Sequence
  MKO10094183_B_Kau5
  gRNA
gccacucaucuucguugucc

SEQ ID NO: 94184 - RNA, 20 nt, Artificial Sequence
  MKO10094184_B_Kau5
  gRNA
uccccagggggagauaaucg

SEQ ID NO: 94185 - RNA, 20 nt, Artificial Sequence
  MKO10094185_B_Kau6a
  gRNA
ugcagcuccugucgugacca

SEQ ID NO: 94186 - RNA, 20 nt, Artificial Sequence
  MKO10094186_B_Kau6a
  gRNA
gcuauugccgcaguccgcgc

SEQ ID NO: 94187 - RNA, 20 nt, Artificial Sequence
  MKO10094187_B_Kau6a
  gRNA
cucgucuccugcgcggacug

SEQ ID NO: 94188 - RNA, 20 nt, Artificial Sequence
  MKO10094188_B_Kau6b
  gRNA
cccaaacagaagcuacauau

SEQ ID NO: 94189 - RNA, 20 nt, Artificial Sequence
  MKO10094189_B_Kau6b
  gRNA
ugccacaaucugcacaagac

SEQ ID NO: 94190 - RNA, 20 nt, Artificial Sequence
  MKO10094190_B_Kau6b
  gRNA
ccacuuuccagaaugccaaa

SEQ ID NO: 94191 - RNA, 20 nt, Artificial Sequence
  MKO10094191_B_Kau7
  gRNA
ccucucagcugacgaaugca

SEQ ID NO: 94192 - RNA, 20 nt, Artificial Sequence
  MKO10094192_B_Kau7
  gRNA
ccuugcauucgucagcugag

SEQ ID NO: 94193 - RNA, 20 nt, Artificial Sequence
  MKO10094193_B_Kau7
  gRNA
cucgagaucuguagaaaaau

SEQ ID NO: 94194 - RNA, 20 nt, Artificial Sequence
  MKO10094194_B_Kau8
  gRNA
uuucgagugaucuugcgcuc

SEQ ID NO: 94195 - RNA, 20 nt, Artificial Sequence
  MKO10094195_B_Kau8
  gRNA
gaagagcuaccgcuuccacc

SEQ ID NO: 94196 - RNA, 20 nt, Artificial Sequence
  MKO10094196_B_Kau8
  gRNA
ccagucucgagugaaugacc

SEQ ID NO: 94197 - RNA, 20 nt, Artificial Sequence
  MKO10094197_B_Kauna1
  gRNA
caaggacuuaguagaagcuu

SEQ ID NO: 94198 - RNA, 20 nt, Artificial Sequence
  MKO10094198_B_Kauna1
  gRNA
ugccuguaccuguugagcga

SEQ ID NO: 94199 - RNA, 20 nt, Artificial Sequence
  MKO10094199_B_Kauna1
  gRNA
cguuuccuagguccugguaa

SEQ ID NO: 94200 - RNA, 20 nt, Artificial Sequence
  MKO10094200_B_Kaunal1
  gRNA
uaguccuugucccgacuugc

SEQ ID NO: 94201 - RNA, 20 nt, Artificial Sequence
  MKO10094201_B_Kaunal1
  gRNA
cguuuagagacccugcagua

SEQ ID NO: 94202 - RNA, 20 nt, Artificial Sequence
  MKO10094202_B_Kaunal1
  gRNA
agcgagauucccaaguuuga

SEQ ID NO: 94203 - RNA, 20 nt, Artificial Sequence
  MKO10094203_B_Kaunal2
  gRNA
ugucaaggaacaccuuaaac

SEQ ID NO: 94204 - RNA, 20 nt, Artificial Sequence
  MKO10094204_B_Kaunal2
  gRNA
cagucaccuugaccuguuua

SEQ ID NO: 94205 - RNA, 20 nt, Artificial Sequence
  MKO10094205_B_Kaunal2
  gRNA
uucuucccuccacuucguga

SEQ ID NO: 94206 - RNA, 20 nt, Artificial Sequence
  MKO10094206_B_Kaunb1
  gRNA
auuaguucuucgaacacuca

SEQ ID NO: 94207 - RNA, 20 nt, Artificial Sequence
  MKO10094207_B_Kaunb1
  gRNA
augacugccgagucaaccug

SEQ ID NO: 94208 - RNA, 20 nt, Artificial Sequence
  MKO10094208_B_Kaunb1
  gRNA
uuauggaccacagguugacu

SEQ ID NO: 94209 - RNA, 20 nt, Artificial Sequence
  MKO10094209_B_Kaunbl1
  gRNA
ggcaaucuaccacaacucca

SEQ ID NO: 94210 - RNA, 20 nt, Artificial Sequence
  MKO10094210_B_Kaunbl1
  gRNA
aauuccugcugaauagaacc

SEQ ID NO: 94211 - RNA, 20 nt, Artificial Sequence
  MKO10094211_B_Kaunbl1
  gRNA
aacuuguagcuuauuuagug

SEQ ID NO: 94212 - RNA, 20 nt, Artificial Sequence
  MKO10094212_B_Kazald1
  gRNA
cgguaggugcccucaucacu

SEQ ID NO: 94213 - RNA, 20 nt, Artificial Sequence
  MKO10094213_B_Kazald1
  gRNA
acaaacuccgugauugcagc

SEQ ID NO: 94214 - RNA, 20 nt, Artificial Sequence
  MKO10094214_B_Kazald1
  gRNA
agaguugggcgauuacuacu

SEQ ID NO: 94215 - RNA, 20 nt, Artificial Sequence
  MKO10094215_B_Kazn
  gRNA
gacucaccuugccggucugc

SEQ ID NO: 94216 - RNA, 20 nt, Artificial Sequence
  MKO10094216_B_Kazn
  gRNA
ugagguccagcugggagcgc

SEQ ID NO: 94217 - RNA, 20 nt, Artificial Sequence
  MKO10094217_B_Kazn
  gRNA
cccacuucucucgcuccagc

SEQ ID NO: 94218 - RNA, 20 nt, Artificial Sequence
  MKO10094218_B_Kbtbd11
  gRNA
acgacccgcgagcugaccga

SEQ ID NO: 94219 - RNA, 20 nt, Artificial Sequence
  MKO10094219_B_Kbtbd11
  gRNA
cguuuauugcuaccaggcgg

SEQ ID NO: 94220 - RNA, 20 nt, Artificial Sequence
  MKO10094220_B_Kbtbd11
  gRNA
ccgccuuaugcgcccguagu

SEQ ID NO: 94221 - RNA, 20 nt, Artificial Sequence
  MKO10094221_B_Kbtbd12
  gRNA
ccuugcagguaucaugauag

SEQ ID NO: 94222 - RNA, 20 nt, Artificial Sequence
  MKO10094222_B_Kbtbd12
  gRNA
caacguucagaccguagcca

SEQ ID NO: 94223 - RNA, 20 nt, Artificial Sequence
  MKO10094223_B_Kbtbd12
  gRNA
uggucuccaugccauagcga

SEQ ID NO: 94224 - RNA, 20 nt, Artificial Sequence
  MKO10094224_B_Kbtbd13
  gRNA
gugcgugcucaccgccacgu

SEQ ID NO: 94225 - RNA, 20 nt, Artificial Sequence
  MKO10094225_B_Kbtbd13
  gRNA
gggucgcagcgccgccacgu

SEQ ID NO: 94226 - RNA, 20 nt, Artificial Sequence
  MKO10094226_B_Kbtbd13
  gRNA
cacugccguugucgaguaug

SEQ ID NO: 94227 - RNA, 20 nt, Artificial Sequence
  MKO10094227_B_Kbtbd2
  gRNA
cggcagcguccacauuccuc

SEQ ID NO: 94228 - RNA, 20 nt, Artificial Sequence
  MKO10094228_B_Kbtbd2
  gRNA
cgaauaugcuguguccuuau

SEQ ID NO: 94229 - RNA, 20 nt, Artificial Sequence
  MKO10094229_B_Kbtbd2
  gRNA
caacauguagcuccuauuuc

SEQ ID NO: 94230 - RNA, 20 nt, Artificial Sequence
  MKO10094230_B_Kbtbd3
  gRNA
gcuaacugauguccacucuc

SEQ ID NO: 94231 - RNA, 20 nt, Artificial Sequence
  MKO10094231_B_Kbtbd3
  gRNA
agaaccuuguacacacuuaa

SEQ ID NO: 94232 - RNA, 20 nt, Artificial Sequence
  MKO10094232_B_Kbtbd3
  gRNA
uuaaguacaacuuagagucc

SEQ ID NO: 94233 - RNA, 20 nt, Artificial Sequence
  MKO10094233_B_Kbtbd4
  gRNA
ggcuaccauggagucaccag

SEQ ID NO: 94234 - RNA, 20 nt, Artificial Sequence
  MKO10094234_B_Kbtbd4
  gRNA
caagcuaguccuuagugacu

SEQ ID NO: 94235 - RNA, 20 nt, Artificial Sequence
  MKO10094235_B_Kbtbd4
  gRNA
uuggaucaauuucaauaaag

SEQ ID NO: 94236 - RNA, 20 nt, Artificial Sequence
  MKO10094236_B_Kbtbd7
  gRNA
gcgaaaugcaccagaucagu

SEQ ID NO: 94237 - RNA, 20 nt, Artificial Sequence
  MKO10094237_B_Kbtbd7
  gRNA
uaucaccaaaucgcagcugc

SEQ ID NO: 94238 - RNA, 20 nt, Artificial Sequence
  MKO10094238_B_Kbtbd7
  gRNA
gccgucuccuuugacuagcu

SEQ ID NO: 94239 - RNA, 20 nt, Artificial Sequence
  MKO10094239_B_Kbtbd8
  gRNA
cccuguaguaauggccgcgu

SEQ ID NO: 94240 - RNA, 20 nt, Artificial Sequence
  MKO10094240_B_Kbtbd8
  gRNA
cucaaaacaauguacgauga

SEQ ID NO: 94241 - RNA, 20 nt, Artificial Sequence
  MKO10094241_B_Kbtbd8
  gRNA
auuggagggcguguuuacga

SEQ ID NO: 94242 - RNA, 20 nt, Artificial Sequence
  MKO10094242_B_Kcmf1
  gRNA
cgaugcagugcauauuaaca

SEQ ID NO: 94243 - RNA, 20 nt, Artificial Sequence
  MKO10094243_B_Kcmf1
  gRNA
uccagguaacgcugcacaua

SEQ ID NO: 94244 - RNA, 20 nt, Artificial Sequence
  MKO10094244_B_Kcmf1
  gRNA
cuuguuaauaugcacugcau

SEQ ID NO: 94245 - RNA, 20 nt, Artificial Sequence
  MKO10094245_B_Kcna10
  gRNA
cucgcuacccaguucauaga

SEQ ID NO: 94246 - RNA, 20 nt, Artificial Sequence
  MKO10094246_B_Kcna10
  gRNA
aagcuuucucgacacucuaa

SEQ ID NO: 94247 - RNA, 20 nt, Artificial Sequence
  MKO10094247_B_Kcna10
  gRNA
ucaccagacgaaugauccuc

SEQ ID NO: 94248 - RNA, 20 nt, Artificial Sequence
  MKO10094248_B_Kcna1
  gRNA
cgagaaggaguaccagcgcc

SEQ ID NO: 94249 - RNA, 20 nt, Artificial Sequence
  MKO10094249_B_Kcna1
  gRNA
aaguagcgcaugcguuucuu

SEQ ID NO: 94250 - RNA, 20 nt, Artificial Sequence
  MKO10094250_B_Kcna1
  gRNA
ggcuccuugugugccaucgc

SEQ ID NO: 94251 - RNA, 20 nt, Artificial Sequence
  MKO10094251_B_Kcna2
  gRNA
cgugcccuuagauaucuucu

SEQ ID NO: 94252 - RNA, 20 nt, Artificial Sequence
  MKO10094252_B_Kcna2
  gRNA
agcuugucacuugcaaguac

SEQ ID NO: 94253 - RNA, 20 nt, Artificial Sequence
  MKO10094253_B_Kcna2
  gRNA
cccgauggugcuguuggaau

SEQ ID NO: 94254 - RNA, 20 nt, Artificial Sequence
  MKO10094254_B_Kcna3
  gRNA
agauugcugcggcgagcgug

SEQ ID NO: 94255 - RNA, 20 nt, Artificial Sequence
  MKO10094255_B_Kcna3
  gRNA
gcagcaaucuugcucgcccg

SEQ ID NO: 94256 - RNA, 20 nt, Artificial Sequence
  MKO10094256_B_Kcna3
  gRNA
gucuuucucaucgcgaaacu

SEQ ID NO: 94257 - RNA, 20 nt, Artificial Sequence
  MKO10094257_B_Kcna4
  gRNA
gagcgagucucucccgcucu

SEQ ID NO: 94258 - RNA, 20 nt, Artificial Sequence
  MKO10094258_B_Kcna4
  gRNA
ucuucaggcggccuccugac

SEQ ID NO: 94259 - RNA, 20 nt, Artificial Sequence
  MKO10094259_B_Kcna4
  gRNA
caauagagauuaagaugacc

SEQ ID NO: 94260 - RNA, 20 nt, Artificial Sequence
  MKO10094260_B_Kcna5
  gRNA
ugauuauugaguccagccgu

SEQ ID NO: 94261 - RNA, 20 nt, Artificial Sequence
  MKO10094261_B_Kcna5
  gRNA
gggcauacagagaccuucgc

SEQ ID NO: 94262 - RNA, 20 nt, Artificial Sequence
  MKO10094262_B_Kcna5
  gRNA
ggcugacccauucuucaucg

SEQ ID NO: 94263 - RNA, 20 nt, Artificial Sequence
  MKO10094263_B_Kcna6
  gRNA
gaugaccaauacugagacga

SEQ ID NO: 94264 - RNA, 20 nt, Artificial Sequence
  MKO10094264_B_Kcna6
  gRNA
uggaaacucuguguaucguc

SEQ ID NO: 94265 - RNA, 20 nt, Artificial Sequence
  MKO10094265_B_Kcna6
  gRNA
caguauacccacgucacuug

SEQ ID NO: 94266 - RNA, 20 nt, Artificial Sequence
  MKO10094266_B_Kcna7
  gRNA
gaugaaccuaauugacuucg

SEQ ID NO: 94267 - RNA, 20 nt, Artificial Sequence
  MKO10094267_B_Kcna7
  gRNA
gucggucgaagaaauacucg

SEQ ID NO: 94268 - RNA, 20 nt, Artificial Sequence
  MKO10094268_B_Kcna7
  gRNA
cgugcgccggccgucucagc

SEQ ID NO: 94269 - RNA, 20 nt, Artificial Sequence
  MKO10094269_B_Kcnab1
  gRNA
ucuaggaaucuugggaaauc

SEQ ID NO: 94270 - RNA, 20 nt, Artificial Sequence
  MKO10094270_B_Kcnab1
  gRNA
agaguuucaugcuugggucu

SEQ ID NO: 94271 - RNA, 20 nt, Artificial Sequence
  MKO10094271_B_Kcnab1
  gRNA
ccaggaacaugggugacauu

SEQ ID NO: 94272 - RNA, 20 nt, Artificial Sequence
  MKO10094272_B_Kcnab2
  gRNA
aucuuaccucauccgugauc

SEQ ID NO: 94273 - RNA, 20 nt, Artificial Sequence
  MKO10094273_B_Kcnab2
  gRNA
gaugccauuaucguaggcca

SEQ ID NO: 94274 - RNA, 20 nt, Artificial Sequence
  MKO10094274_B_Kcnab2
  gRNA
auacuuaccaagccccaggc

SEQ ID NO: 94275 - RNA, 20 nt, Artificial Sequence
  MKO10094275_B_Kcnab3
  gRNA
uaacucaccaaggccaagac

SEQ ID NO: 94276 - RNA, 20 nt, Artificial Sequence
  MKO10094276_B_Kcnab3
  gRNA
cugagagccaaacgugaccc

SEQ ID NO: 94277 - RNA, 20 nt, Artificial Sequence
  MKO10094277_B_Kcnab3
  gRNA
ugcucuugagaauauugcca

SEQ ID NO: 94278 - RNA, 20 nt, Artificial Sequence
  MKO10094278_B_Kcnb1
  gRNA
gaugacgcccucugugcgcg

SEQ ID NO: 94279 - RNA, 20 nt, Artificial Sequence
  MKO10094279_B_Kcnb1
  gRNA
gugcgacgacuacagccucg

SEQ ID NO: 94280 - RNA, 20 nt, Artificial Sequence
  MKO10094280_B_Kcnb1
  gRNA
gcagcaaggcgugcucgcgc

SEQ ID NO: 94281 - RNA, 20 nt, Artificial Sequence
  MKO10094281_B_Kcnb2
  gRNA
uaacucguccguggcugcaa

SEQ ID NO: 94282 - RNA, 20 nt, Artificial Sequence
  MKO10094282_B_Kcnb2
  gRNA
cugcaagaaaacgacgaguu

SEQ ID NO: 94283 - RNA, 20 nt, Artificial Sequence
  MKO10094283_B_Kcnb2
  gRNA
aucuuacgagaauaaguacc

SEQ ID NO: 94284 - RNA, 20 nt, Artificial Sequence
  MKO10094284_B_Kcnc1
  gRNA
gcagucuucguucgccagcg

SEQ ID NO: 94285 - RNA, 20 nt, Artificial Sequence
  MKO10094285_B_Kcnc1
  gRNA
cacccaagugcgguacuacc

SEQ ID NO: 94286 - RNA, 20 nt, Artificial Sequence
  MKO10094286_B_Kcnc1
  gRNA
ugcccgagcggguaaagggc

SEQ ID NO: 94287 - RNA, 20 nt, Artificial Sequence
  MKO10094287_B_Kcnc2
  gRNA
gccugguacccccgacauug

SEQ ID NO: 94288 - RNA, 20 nt, Artificial Sequence
  MKO10094288_B_Kcnc2
  gRNA
uguaaucaccugucgucaac

SEQ ID NO: 94289 - RNA, 20 nt, Artificial Sequence
  MKO10094289_B_Kcnc2
  gRNA
gauuacacgugcgcuucuga

SEQ ID NO: 94290 - RNA, 20 nt, Artificial Sequence
  MKO10094290_B_Kcnc3
  gRNA
uugaggaccccuacucgucg

SEQ ID NO: 94291 - RNA, 20 nt, Artificial Sequence
  MKO10094291_B_Kcnc3
  gRNA
ggucccggcuguagcgaccc

SEQ ID NO: 94292 - RNA, 20 nt, Artificial Sequence
  MKO10094292_B_Kcnc3
  gRNA
aucuacuaugccgaacgcau

SEQ ID NO: 94293 - RNA, 20 nt, Artificial Sequence
  MKO10094293_B_Kcnc4
  gRNA
ccgaaugugggcgcucuucg

SEQ ID NO: 94294 - RNA, 20 nt, Artificial Sequence
  MKO10094294_B_Kcnc4
  gRNA
auaucaccagcgugcgcuuc

SEQ ID NO: 94295 - RNA, 20 nt, Artificial Sequence
  MKO10094295_B_Kcnc4
  gRNA
gacacugggacgcacgcuuu

SEQ ID NO: 94296 - RNA, 20 nt, Artificial Sequence
  MKO10094296_B_Kcnd1
  gRNA
accagcgugcugacaagcgc

SEQ ID NO: 94297 - RNA, 20 nt, Artificial Sequence
  MKO10094297_B_Kcnd1
  gRNA
aguacuuacguuugaggggc

SEQ ID NO: 94298 - RNA, 20 nt, Artificial Sequence
  MKO10094298_B_Kcnd1
  gRNA
agacgagcuaacuuucagug

SEQ ID NO: 94299 - RNA, 20 nt, Artificial Sequence
  MKO10094299_B_Kcnd2
  gRNA
cccagguaccuguuggauag

SEQ ID NO: 94300 - RNA, 20 nt, Artificial Sequence
  MKO10094300_B_Kcnd2
  gRNA
acaguccucggaggaugaac

SEQ ID NO: 94301 - RNA, 20 nt, Artificial Sequence
  MKO10094301_B_Kcnd2
  gRNA
aggauccgagcagccaaaag

SEQ ID NO: 94302 - RNA, 20 nt, Artificial Sequence
  MKO10094302_B_Kcnd3
  gRNA
ggcauuggagcuucccguuu

SEQ ID NO: 94303 - RNA, 20 nt, Artificial Sequence
  MKO10094303_B_Kcnd3
  gRNA
cuaaaguuggagacuaucac

SEQ ID NO: 94304 - RNA, 20 nt, Artificial Sequence
  MKO10094304_B_Kcnd3
  gRNA
caaugaccaggacaccgcug

SEQ ID NO: 94305 - RNA, 20 nt, Artificial Sequence
  MKO10094305_B_Kcne1l
  gRNA
caucggaaccggcccgagca

SEQ ID NO: 94306 - RNA, 20 nt, Artificial Sequence
  MKO10094306_B_Kcne1l
  gRNA
ccgcgaggcgaccagcgcca

SEQ ID NO: 94307 - RNA, 20 nt, Artificial Sequence
  MKO10094307_B_Kcne1l
  gRNA
ccuuggccucgacgagcuug

SEQ ID NO: 94308 - RNA, 20 nt, Artificial Sequence
  MKO10094308_B_Kcne1
  gRNA
gaaaggcaaggccgucuucc

SEQ ID NO: 94309 - RNA, 20 nt, Artificial Sequence
  MKO10094309_B_Kcne1
  gRNA
uuacauccgauccaagaagc

SEQ ID NO: 94310 - RNA, 20 nt, Artificial Sequence
  MKO10094310_B_Kcne1
  gRNA
gcucuacauccucauggugc

SEQ ID NO: 94311 - RNA, 20 nt, Artificial Sequence
  MKO10094311_B_Kcne2
  gRNA
ugagcacggugaagucgaag

SEQ ID NO: 94312 - RNA, 20 nt, Artificial Sequence
  MKO10094312_B_Kcne2
  gRNA
gaugacguaguagaaguucu

SEQ ID NO: 94313 - RNA, 20 nt, Artificial Sequence
  MKO10094313_B_Kcne2
  gRNA
cggcauguucucguucaucg

SEQ ID NO: 94314 - RNA, 20 nt, Artificial Sequence
  MKO10094314_B_Kcne3
  gRNA
cgauccucaguuugauuguc

SEQ ID NO: 94315 - RNA, 20 nt, Artificial Sequence
  MKO10094315_B_Kcne3
  gRNA
guaccaggucucagucccgu

SEQ ID NO: 94316 - RNA, 20 nt, Artificial Sequence
  MKO10094316_B_Kcne3
  gRNA
aguugucauuacgaccagga

SEQ ID NO: 94317 - RNA, 20 nt, Artificial Sequence
  MKO10094317_B_Kcne4
  gRNA
ccuucacugcugucguugag

SEQ ID NO: 94318 - RNA, 20 nt, Artificial Sequence
  MKO10094318_B_Kcne4
  gRNA
ggagggggcugaugacgagc

SEQ ID NO: 94319 - RNA, 20 nt, Artificial Sequence
  MKO10094319_B_Kcne4
  gRNA
cggcaauucaaugcugagga

SEQ ID NO: 94320 - RNA, 20 nt, Artificial Sequence
  MKO10094320_B_Kcnf1
  gRNA
uaccauacccgagcugcaag

SEQ ID NO: 94321 - RNA, 20 nt, Artificial Sequence
  MKO10094321_B_Kcnf1
  gRNA
cggggguucucgcagcgacc

SEQ ID NO: 94322 - RNA, 20 nt, Artificial Sequence
  MKO10094322_B_Kcnf1
  gRNA
augacacacuugaacgcguc

SEQ ID NO: 94323 - RNA, 20 nt, Artificial Sequence
  MKO10094323_B_Kcng1
  gRNA
gucgaagaagaacucguugc

SEQ ID NO: 94324 - RNA, 20 nt, Artificial Sequence
  MKO10094324_B_Kcng1
  gRNA
caacgucuucaucgucgagu

SEQ ID NO: 94325 - RNA, 20 nt, Artificial Sequence
  MKO10094325_B_Kcng1
  gRNA
agccgccgcaagccgagcac

SEQ ID NO: 94326 - RNA, 20 nt, Artificial Sequence
  MKO10094326_B_Kcng2
  gRNA
gugccgcaaccuguucgugc

SEQ ID NO: 94327 - RNA, 20 nt, Artificial Sequence
  MKO10094327_B_Kcng2
  gRNA
cgccacgucauuaucaacgu

SEQ ID NO: 94328 - RNA, 20 nt, Artificial Sequence
  MKO10094328_B_Kcng2
  gRNA
ccgacagcgccugcgcgacg

SEQ ID NO: 94329 - RNA, 20 nt, Artificial Sequence
  MKO10094329_B_Kcng3
  gRNA
ccgaucuaaacuugagcucg

SEQ ID NO: 94330 - RNA, 20 nt, Artificial Sequence
  MKO10094330_B_Kcng3
  gRNA
aagugugcgacgacuacgac

SEQ ID NO: 94331 - RNA, 20 nt, Artificial Sequence
  MKO10094331_B_Kcng3
  gRNA
gcgcccgguacucgcugucc

SEQ ID NO: 94332 - RNA, 20 nt, Artificial Sequence
  MKO10094332_B_Kcng4
  gRNA
gaagcucacgaucaccccga

SEQ ID NO: 94333 - RNA, 20 nt, Artificial Sequence
  MKO10094333_B_Kcng4
  gRNA
acugcgagcgacacauagua

SEQ ID NO: 94334 - RNA, 20 nt, Artificial Sequence
  MKO10094334_B_Kcng4
  gRNA
gagccaggcgcauuacguag

SEQ ID NO: 94335 - RNA, 20 nt, Artificial Sequence
  MKO10094335_B_Kcnh1
  gRNA
uuugcaggagucguccucga

SEQ ID NO: 94336 - RNA, 20 nt, Artificial Sequence
  MKO10094336_B_Kcnh1
  gRNA
ggccccgcagaacacguuuc

SEQ ID NO: 94337 - RNA, 20 nt, Artificial Sequence
  MKO10094337_B_Kcnh1
  gRNA
uccaucauugcuguacacga

SEQ ID NO: 94338 - RNA, 20 nt, Artificial Sequence
  MKO10094338_B_Kcnh2
  gRNA
uaaugguucgguagcguaca

SEQ ID NO: 94339 - RNA, 20 nt, Artificial Sequence
  MKO10094339_B_Kcnh2
  gRNA
acaggggccccucuaccagc

SEQ ID NO: 94340 - RNA, 20 nt, Artificial Sequence
  MKO10094340_B_Kcnh2
  gRNA
ccucaaaggcgacccuuucc

SEQ ID NO: 94341 - RNA, 20 nt, Artificial Sequence
  MKO10094341_B_Kcnh3
  gRNA
gguccgccaacagauccgaa

SEQ ID NO: 94342 - RNA, 20 nt, Artificial Sequence
  MKO10094342_B_Kcnh3
  gRNA
aucagcgagaccaagaaccg

SEQ ID NO: 94343 - RNA, 20 nt, Artificial Sequence
  MKO10094343_B_Kcnh3
  gRNA
ccugcuugccacacucuacg

SEQ ID NO: 94344 - RNA, 20 nt, Artificial Sequence
  MKO10094344_B_Kcnh4
  gRNA
ccucgccacauucuacgucg

SEQ ID NO: 94345 - RNA, 20 nt, Artificial Sequence
  MKO10094345_B_Kcnh4
  gRNA
auuccuggugagccaagucc

SEQ ID NO: 94346 - RNA, 20 nt, Artificial Sequence
  MKO10094346_B_Kcnh4
  gRNA
uaccgugauuauugucccca

SEQ ID NO: 94347 - RNA, 20 nt, Artificial Sequence
  MKO10094347_B_Kcnh5
  gRNA
uugucaaagcccgugucaau

SEQ ID NO: 94348 - RNA, 20 nt, Artificial Sequence
  MKO10094348_B_Kcnh5
  gRNA
gaaaugcccaaauuguggac

SEQ ID NO: 94349 - RNA, 20 nt, Artificial Sequence
  MKO10094349_B_Kcnh5
  gRNA
ccgucauuacuauaaacuac

SEQ ID NO: 94350 - RNA, 20 nt, Artificial Sequence
  MKO10094350_B_Kcnh6
  gRNA
gggccagguccucgaaauug

SEQ ID NO: 94351 - RNA, 20 nt, Artificial Sequence
  MKO10094351_B_Kcnh6
  gRNA
aaucgccguccacuauuuca

SEQ ID NO: 94352 - RNA, 20 nt, Artificial Sequence
  MKO10094352_B_Kcnh6
  gRNA
aaccuggagaagcaccgcuc

SEQ ID NO: 94353 - RNA, 20 nt, Artificial Sequence
  MKO10094353_B_Kcnh7
  gRNA
gacaauggucgaaaugucaa

SEQ ID NO: 94354 - RNA, 20 nt, Artificial Sequence
  MKO10094354_B_Kcnh7
  gRNA
cugggcaauaucaugccucu

SEQ ID NO: 94355 - RNA, 20 nt, Artificial Sequence
  MKO10094355_B_Kcnh7
  gRNA
auuaccauucuugugauagu

SEQ ID NO: 94356 - RNA, 20 nt, Artificial Sequence
  MKO10094356_B_Kcnh8
  gRNA
accagcguuuccagaguaua

SEQ ID NO: 94357 - RNA, 20 nt, Artificial Sequence
  MKO10094357_B_Kcnh8
  gRNA
gccguccuuuaucacaucuc

SEQ ID NO: 94358 - RNA, 20 nt, Artificial Sequence
  MKO10094358_B_Kcnh8
  gRNA
acccuuugccacuugggcau

SEQ ID NO: 94359 - RNA, 20 nt, Artificial Sequence
  MKO10094359_B_Kcnip1
  gRNA
ccaccacaggagugcccuag

SEQ ID NO: 94360 - RNA, 20 nt, Artificial Sequence
  MKO10094360_B_Kcnip1
  gRNA
ucuucauugaccacaccgcu

SEQ ID NO: 94361 - RNA, 20 nt, Artificial Sequence
  MKO10094361_B_Kcnip1
  gRNA
uuuagagggucgccuuuguu

SEQ ID NO: 94362 - RNA, 20 nt, Artificial Sequence
  MKO10094362_B_Kcnip2
  gRNA
cuccucguugacaauuccgc

SEQ ID NO: 94363 - RNA, 20 nt, Artificial Sequence
  MKO10094363_B_Kcnip2
  gRNA
gagaaaaguagcguaguugc

SEQ ID NO: 94364 - RNA, 20 nt, Artificial Sequence
  MKO10094364_B_Kcnip2
  gRNA
guucacacgcagagaguugc

SEQ ID NO: 94365 - RNA, 20 nt, Artificial Sequence
  MKO10094365_B_Kcnip3
  gRNA
uucaaugccuucgaugcuga

SEQ ID NO: 94366 - RNA, 20 nt, Artificial Sequence
  MKO10094366_B_Kcnip3
  gRNA
cacggugcgccaucagccag

SEQ ID NO: 94367 - RNA, 20 nt, Artificial Sequence
  MKO10094367_B_Kcnip3
  gRNA
ccccugcaggagugucccac

SEQ ID NO: 94368 - RNA, 20 nt, Artificial Sequence
  MKO10094368_B_Kcnip4
  gRNA
caaagcucacagcuccauug

SEQ ID NO: 94369 - RNA, 20 nt, Artificial Sequence
  MKO10094369_B_Kcnip4
  gRNA
uuacucacaguucuuuccac

SEQ ID NO: 94370 - RNA, 20 nt, Artificial Sequence
  MKO10094370_B_Kcnip4
  gRNA
agacagcguggaagaugagc

SEQ ID NO: 94371 - RNA, 20 nt, Artificial Sequence
  MKO10094371_B_Kcnj10
  gRNA
cgcgauagcaccguacgcua

SEQ ID NO: 94372 - RNA, 20 nt, Artificial Sequence
  MKO10094372_B_Kcnj10
  gRNA
aaagaucucccgcuccgcag

SEQ ID NO: 94373 - RNA, 20 nt, Artificial Sequence
  MKO10094373_B_Kcnj10
  gRNA
gaggagacucuuccgcauau

SEQ ID NO: 94374 - RNA, 20 nt, Artificial Sequence
  MKO10094374_B_Kcnj11
  gRNA
cggagccaugcugucccgaa

SEQ ID NO: 94375 - RNA, 20 nt, Artificial Sequence
  MKO10094375_B_Kcnj11
  gRNA
cccugacccucgccucgucg

SEQ ID NO: 94376 - RNA, 20 nt, Artificial Sequence
  MKO10094376_B_Kcnj11
  gRNA
cucauugugcagaauaucgu

SEQ ID NO: 94377 - RNA, 20 nt, Artificial Sequence
  MKO10094377_B_Kcnj12
  gRNA
gccucuaggccacacaagcc

SEQ ID NO: 94378 - RNA, 20 nt, Artificial Sequence
  MKO10094378_B_Kcnj12
  gRNA
cgagaagucacaacgcuacc

SEQ ID NO: 94379 - RNA, 20 nt, Artificial Sequence
  MKO10094379_B_Kcnj12
  gRNA
acuguuuggcauuagccguc

SEQ ID NO: 94380 - RNA, 20 nt, Artificial Sequence
  MKO10094380_B_Kcnj13
  gRNA
uacagcagagacacgaacgu

SEQ ID NO: 94381 - RNA, 20 nt, Artificial Sequence
  MKO10094381_B_Kcnj13
  gRNA
uuugcagcucuaaugacucg

SEQ ID NO: 94382 - RNA, 20 nt, Artificial Sequence
  MKO10094382_B_Kcnj13
  gRNA
cggccacagcacacuucaga

SEQ ID NO: 94383 - RNA, 20 nt, Artificial Sequence
  MKO10094383_B_Kcnj14
  gRNA
ccacuuccaucgaacauaug

SEQ ID NO: 94384 - RNA, 20 nt, Artificial Sequence
  MKO10094384_B_Kcnj14
  gRNA
cacuuagguagcgcgcgccc

SEQ ID NO: 94385 - RNA, 20 nt, Artificial Sequence
  MKO10094385_B_Kcnj14
  gRNA
ccacccauugcggcacaguc

SEQ ID NO: 94386 - RNA, 20 nt, Artificial Sequence
  MKO10094386_B_Kcnj15
  gRNA
cucgcuccccuucucccacc

SEQ ID NO: 94387 - RNA, 20 nt, Artificial Sequence
  MKO10094387_B_Kcnj15
  gRNA
ugaccaguugggcgacuaag

SEQ ID NO: 94388 - RNA, 20 nt, Artificial Sequence
  MKO10094388_B_Kcnj15
  gRNA
caaccgucaucgacaugaag

SEQ ID NO: 94389 - RNA, 20 nt, Artificial Sequence
  MKO10094389_B_Kcnj16
  gRNA
uagcuacaggaucgucaaug

SEQ ID NO: 94390 - RNA, 20 nt, Artificial Sequence
  MKO10094390_B_Kcnj16
  gRNA
ugauaucuggaucgcuuaau

SEQ ID NO: 94391 - RNA, 20 nt, Artificial Sequence
  MKO10094391_B_Kcnj16
  gRNA
ucccgucucucauaccaaug

SEQ ID NO: 94392 - RNA, 20 nt, Artificial Sequence
  MKO10094392_B_Kcnj1
  gRNA
ccaccgucuuaccaaaguua

SEQ ID NO: 94393 - RNA, 20 nt, Artificial Sequence
  MKO10094393_B_Kcnj1
  gRNA
guaugaugugcggacuuggc

SEQ ID NO: 94394 - RNA, 20 nt, Artificial Sequence
  MKO10094394_B_Kcnj1
  gRNA
cgaguggauuuccauaacuu

SEQ ID NO: 94395 - RNA, 20 nt, Artificial Sequence
  MKO10094395_B_Kcnj2
  gRNA
gcucuagagguacgcuugcc

SEQ ID NO: 94396 - RNA, 20 nt, Artificial Sequence
  MKO10094396_B_Kcnj2
  gRNA
uccugcacuguugucgggua

SEQ ID NO: 94397 - RNA, 20 nt, Artificial Sequence
  MKO10094397_B_Kcnj2
  gRNA
uccauacccgacaacagugc

SEQ ID NO: 94398 - RNA, 20 nt, Artificial Sequence
  MKO10094398_B_Kcnj3
  gRNA
aucacguggcaaauugugag

SEQ ID NO: 94399 - RNA, 20 nt, Artificial Sequence
  MKO10094399_B_Kcnj3
  gRNA
agcucgaacaucauacacag

SEQ ID NO: 94400 - RNA, 20 nt, Artificial Sequence
  MKO10094400_B_Kcnj3
  gRNA
cucagaaaaagccuauaguu

SEQ ID NO: 94401 - RNA, 20 nt, Artificial Sequence
  MKO10094401_B_Kcnj4
  gRNA
gccguuuacgugcaugauac

SEQ ID NO: 94402 - RNA, 20 nt, Artificial Sequence
  MKO10094402_B_Kcnj4
  gRNA
gcugucaucuccguucgaga

SEQ ID NO: 94403 - RNA, 20 nt, Artificial Sequence
  MKO10094403_B_Kcnj4
  gRNA
gcgccagcgcguguccacgc

SEQ ID NO: 94404 - RNA, 20 nt, Artificial Sequence
  MKO10094404_B_Kcnj5
  gRNA
cuggcggagaugaagcggag

SEQ ID NO: 94405 - RNA, 20 nt, Artificial Sequence
  MKO10094405_B_Kcnj5
  gRNA
gcucuucucguugaucucgu

SEQ ID NO: 94406 - RNA, 20 nt, Artificial Sequence
  MKO10094406_B_Kcnj5
  gRNA
aguuucggagguccccuacc

SEQ ID NO: 94407 - RNA, 20 nt, Artificial Sequence
  MKO10094407_B_Kcnj6
  gRNA
ugauguaggagcuucgggcu

SEQ ID NO: 94408 - RNA, 20 nt, Artificial Sequence
  MKO10094408_B_Kcnj6
  gRNA
accccacguugauaucaguc

SEQ ID NO: 94409 - RNA, 20 nt, Artificial Sequence
  MKO10094409_B_Kcnj6
  gRNA
gguggcugauugcguacauc

SEQ ID NO: 94410 - RNA, 20 nt, Artificial Sequence
  MKO10094410_B_Kcnj8
  gRNA
cuccgcucuuggcgaugaag

SEQ ID NO: 94411 - RNA, 20 nt, Artificial Sequence
  MKO10094411_B_Kcnj8
  gRNA
aagauauuauugcucucgau

SEQ ID NO: 94412 - RNA, 20 nt, Artificial Sequence
  MKO10094412_B_Kcnj8
  gRNA
ggcuacgcuugucaaucacg

SEQ ID NO: 94413 - RNA, 20 nt, Artificial Sequence
  MKO10094413_B_Kcnj9
  gRNA
ccaagcucgaagcucguacc

SEQ ID NO: 94414 - RNA, 20 nt, Artificial Sequence
  MKO10094414_B_Kcnj9
  gRNA
cggucgcuguaacgugcagc

SEQ ID NO: 94415 - RNA, 20 nt, Artificial Sequence
  MKO10094415_B_Kcnj9
  gRNA
aggcggccacgaagccguug

SEQ ID NO: 94416 - RNA, 20 nt, Artificial Sequence
  MKO10094416_B_Kcnk10
  gRNA
aauauugcuccgagcacuga

SEQ ID NO: 94417 - RNA, 20 nt, Artificial Sequence
  MKO10094417_B_Kcnk10
  gRNA
gaccaacuuggaaccaucuu

SEQ ID NO: 94418 - RNA, 20 nt, Artificial Sequence
  MKO10094418_B_Kcnk10
  gRNA
acgcugaccacaguaggcuu

SEQ ID NO: 94419 - RNA, 20 nt, Artificial Sequence
  MKO10094419_B_Kcnk12
  gRNA
ccagcgcgggcgcagcgcgu

SEQ ID NO: 94420 - RNA, 20 nt, Artificial Sequence
  MKO10094420_B_Kcnk12
  gRNA
ccggcaggcgcgcaugauga

SEQ ID NO: 94421 - RNA, 20 nt, Artificial Sequence
  MKO10094421_B_Kcnk12
  gRNA
cgcgcagccgaacaguccgu

SEQ ID NO: 94422 - RNA, 20 nt, Artificial Sequence
  MKO10094422_B_Kcnk13
  gRNA
ugacagugaucagccgcucc

SEQ ID NO: 94423 - RNA, 20 nt, Artificial Sequence
  MKO10094423_B_Kcnk13
  gRNA
guccaugcggaugcccgccc

SEQ ID NO: 94424 - RNA, 20 nt, Artificial Sequence
  MKO10094424_B_Kcnk13
  gRNA
uggcuuccucguaguggcgg

SEQ ID NO: 94425 - RNA, 20 nt, Artificial Sequence
  MKO10094425_B_Kcnk15
  gRNA
cuccagcucgcgguagucgu

SEQ ID NO: 94426 - RNA, 20 nt, Artificial Sequence
  MKO10094426_B_Kcnk15
  gRNA
ccagcccucgaagugcgcga

SEQ ID NO: 94427 - RNA, 20 nt, Artificial Sequence
  MKO10094427_B_Kcnk15
  gRNA
acuuugcccgaguccgugcc

SEQ ID NO: 94428 - RNA, 20 nt, Artificial Sequence
  MKO10094428_B_Kcnk16
  gRNA
acgcgaaguagaagcccuca

SEQ ID NO: 94429 - RNA, 20 nt, Artificial Sequence
  MKO10094429_B_Kcnk16
  gRNA
aacauaguccccgaagccaa

SEQ ID NO: 94430 - RNA, 20 nt, Artificial Sequence
  MKO10094430_B_Kcnk16
  gRNA
gaccugcccugccuccgugc

SEQ ID NO: 94431 - RNA, 20 nt, Artificial Sequence
  MKO10094431_B_Kcnk18
  gRNA
ccuggggcgccuugagccac

SEQ ID NO: 94432 - RNA, 20 nt, Artificial Sequence
  MKO10094432_B_Kcnk18
  gRNA
ccccagugguugaagguagc

SEQ ID NO: 94433 - RNA, 20 nt, Artificial Sequence
  MKO10094433_B_Kcnk18
  gRNA
agcagcacccaccagcgcau

SEQ ID NO: 94434 - RNA, 20 nt, Artificial Sequence
  MKO10094434_B_Kcnk1
  gRNA
cacgcuggaccacggccguc

SEQ ID NO: 94435 - RNA, 20 nt, Artificial Sequence
  MKO10094435_B_Kcnk1
  gRNA
cgugcuccaugaugugaacc

SEQ ID NO: 94436 - RNA, 20 nt, Artificial Sequence
  MKO10094436_B_Kcnk1
  gRNA
uucacagguuaccugcuccu

SEQ ID NO: 94437 - RNA, 20 nt, Artificial Sequence
  MKO10094437_B_Kcnk2
  gRNA
aguggcggccccugacuugc

SEQ ID NO: 94438 - RNA, 20 nt, Artificial Sequence
  MKO10094438_B_Kcnk2
  gRNA
cugcgucaacuccaccgagc

SEQ ID NO: 94439 - RNA, 20 nt, Artificial Sequence
  MKO10094439_B_Kcnk2
  gRNA
aacaucuccccacgaacuga

SEQ ID NO: 94440 - RNA, 20 nt, Artificial Sequence
  MKO10094440_B_Kcnk3
  gRNA
cgcugccgcucgaucaucuc

SEQ ID NO: 94441 - RNA, 20 nt, Artificial Sequence
  MKO10094441_B_Kcnk3
  gRNA
gaaaguccagcgcucguagu

SEQ ID NO: 94442 - RNA, 20 nt, Artificial Sequence
  MKO10094442_B_Kcnk3
  gRNA
cuccacgcaggugucggacg

SEQ ID NO: 94443 - RNA, 20 nt, Artificial Sequence
  MKO10094443_B_Kcnk4
  gRNA
cuggguuugcgcccccuccc

SEQ ID NO: 94444 - RNA, 20 nt, Artificial Sequence
  MKO10094444_B_Kcnk4
  gRNA
ccaagaagauugcuucgaug

SEQ ID NO: 94445 - RNA, 20 nt, Artificial Sequence
  MKO10094445_B_Kcnk4
  gRNA
ccacaucgaagcaaucuucu

SEQ ID NO: 94446 - RNA, 20 nt, Artificial Sequence
  MKO10094446_B_Kcnk5
  gRNA
cuucucagguuauggcaaug

SEQ ID NO: 94447 - RNA, 20 nt, Artificial Sequence
  MKO10094447_B_Kcnk5
  gRNA
gucccccgaagaacuugccc

SEQ ID NO: 94448 - RNA, 20 nt, Artificial Sequence
  MKO10094448_B_Kcnk5
  gRNA
gaucccgcccuuuguguuca

SEQ ID NO: 94449 - RNA, 20 nt, Artificial Sequence
  MKO10094449_B_Kcnk6
  gRNA
uucaagguaggcgaagaccg

SEQ ID NO: 94450 - RNA, 20 nt, Artificial Sequence
  MKO10094450_B_Kcnk6
  gRNA
cgccguguuuccgaccucca

SEQ ID NO: 94451 - RNA, 20 nt, Artificial Sequence
  MKO10094451_B_Kcnk6
  gRNA
ccuaggggacuacgugccug

SEQ ID NO: 94452 - RNA, 20 nt, Artificial Sequence
  MKO10094452_B_Kcnk7
  gRNA
ccagcaggugggccauaagc

SEQ ID NO: 94453 - RNA, 20 nt, Artificial Sequence
  MKO10094453_B_Kcnk7
  gRNA
gcugccugacgccccagucu

SEQ ID NO: 94454 - RNA, 20 nt, Artificial Sequence
  MKO10094454_B_Kcnk7
  gRNA
ccgauaccugcuccugcuua

SEQ ID NO: 94455 - RNA, 20 nt, Artificial Sequence
  MKO10094455_B_Kcnk9
  gRNA
gccgaagaaguccgucucag

SEQ ID NO: 94456 - RNA, 20 nt, Artificial Sequence
  MKO10094456_B_Kcnk9
  gRNA
ccugaccaugaauaccgaug

SEQ ID NO: 94457 - RNA, 20 nt, Artificial Sequence
  MKO10094457_B_Kcnk9
  gRNA
acuucuugauacguuucagc

SEQ ID NO: 94458 - RNA, 20 nt, Artificial Sequence
  MKO10094458_B_Kcnma1
  gRNA
uuacccgcaagccaaaguag

SEQ ID NO: 94459 - RNA, 20 nt, Artificial Sequence
  MKO10094459_B_Kcnma1
  gRNA
uuucacauuacagaucgaca

SEQ ID NO: 94460 - RNA, 20 nt, Artificial Sequence
  MKO10094460_B_Kcnma1
  gRNA
agucuaugaaguauauuacg

SEQ ID NO: 94461 - RNA, 20 nt, Artificial Sequence
  MKO10094461_B_Kcnmb1
  gRNA
gaauaagacccccggucagc

SEQ ID NO: 94462 - RNA, 20 nt, Artificial Sequence
  MKO10094462_B_Kcnmb1
  gRNA
cagcugauacauugacccaa

SEQ ID NO: 94463 - RNA, 20 nt, Artificial Sequence
  MKO10094463_B_Kcnmb1
  gRNA
gucuuccgugugauacagca

SEQ ID NO: 94464 - RNA, 20 nt, Artificial Sequence
  MKO10094464_B_Kcnmb2
  gRNA
uacgugaaccugacaucuuc

SEQ ID NO: 94465 - RNA, 20 nt, Artificial Sequence
  MKO10094465_B_Kcnmb2
  gRNA
ugcugcgcuccuacaugcag

SEQ ID NO: 94466 - RNA, 20 nt, Artificial Sequence
  MKO10094466_B_Kcnmb2
  gRNA
gcagcagugugauucccagc

SEQ ID NO: 94467 - RNA, 20 nt, Artificial Sequence
  MKO10094467_B_Kcnmb3
  gRNA
gccaucgggacuguagaaac

SEQ ID NO: 94468 - RNA, 20 nt, Artificial Sequence
  MKO10094468_B_Kcnmb3
  gRNA
cccuguagcgugauuuggac

SEQ ID NO: 94469 - RNA, 20 nt, Artificial Sequence
  MKO10094469_B_Kcnmb3
  gRNA
ccaaagcuuccaucaagcgc

SEQ ID NO: 94470 - RNA, 20 nt, Artificial Sequence
  MKO10094470_B_Kcnmb4
  gRNA
ucucuuacagggcgggauau

SEQ ID NO: 94471 - RNA, 20 nt, Artificial Sequence
  MKO10094471_B_Kcnmb4
  gRNA
cgccuugaccgccaggcucu

SEQ ID NO: 94472 - RNA, 20 nt, Artificial Sequence
  MKO10094472_B_Kcnmb4
  gRNA
ugacgcucuccgaguucuuc

SEQ ID NO: 94473 - RNA, 20 nt, Artificial Sequence
  MKO10094473_B_Kcnn1
  gRNA
uuccaacuuccgagccacga

SEQ ID NO: 94474 - RNA, 20 nt, Artificial Sequence
  MKO10094474_B_Kcnn1
  gRNA
guaccacgcccgagagaucc

SEQ ID NO: 94475 - RNA, 20 nt, Artificial Sequence
  MKO10094475_B_Kcnn1
  gRNA
ggccgucguggcucggaagu

SEQ ID NO: 94476 - RNA, 20 nt, Artificial Sequence
  MKO10094476_B_Kcnn2
  gRNA
ugaucguggagagacugaua

SEQ ID NO: 94477 - RNA, 20 nt, Artificial Sequence
  MKO10094477_B_Kcnn2
  gRNA
uagugacauccuguugauca

SEQ ID NO: 94478 - RNA, 20 nt, Artificial Sequence
  MKO10094478_B_Kcnn2
  gRNA
uuucagguaccaugaucaac

SEQ ID NO: 94479 - RNA, 20 nt, Artificial Sequence
  MKO10094479_B_Kcnn3
  gRNA
uuauccaccgucauccugcu

SEQ ID NO: 94480 - RNA, 20 nt, Artificial Sequence
  MKO10094480_B_Kcnn3
  gRNA
cggcagguaccaugaucagc

SEQ ID NO: 94481 - RNA, 20 nt, Artificial Sequence
  MKO10094481_B_Kcnn3
  gRNA
uccaucacguuccuuuccau

SEQ ID NO: 94482 - RNA, 20 nt, Artificial Sequence
  MKO10094482_B_Kcnn4
  gRNA
gccucaccucuuuggcauaa

SEQ ID NO: 94483 - RNA, 20 nt, Artificial Sequence
  MKO10094483_B_Kcnn4
  gRNA
acgugguaccuggcaccaug

SEQ ID NO: 94484 - RNA, 20 nt, Artificial Sequence
  MKO10094484_B_Kcnn4
  gRNA
gggugaucaaacacuuaacc

SEQ ID NO: 94485 - RNA, 20 nt, Artificial Sequence
  MKO10094485_B_Kcnq1
  gRNA
gcuuccgggcaaaacguagc

SEQ ID NO: 94486 - RNA, 20 nt, Artificial Sequence
  MKO10094486_B_Kcnq1
  gRNA
guccuuuggaacccacgcag

SEQ ID NO: 94487 - RNA, 20 nt, Artificial Sequence
  MKO10094487_B_Kcnq1
  gRNA
caccgggacccucuucugga

SEQ ID NO: 94488 - RNA, 20 nt, Artificial Sequence
  MKO10094488_B_Kcnq2
  gRNA
ccaggaaaucgugacuaucg

SEQ ID NO: 94489 - RNA, 20 nt, Artificial Sequence
  MKO10094489_B_Kcnq2
  gRNA
ugccaccccuccgguccaua

SEQ ID NO: 94490 - RNA, 20 nt, Artificial Sequence
  MKO10094490_B_Kcnq2
  gRNA
gcucuucucguacuccuuga

SEQ ID NO: 94491 - RNA, 20 nt, Artificial Sequence
  MKO10094491_B_Kcnq3
  gRNA
guggacggcuaaaguuugcc

SEQ ID NO: 94492 - RNA, 20 nt, Artificial Sequence
  MKO10094492_B_Kcnq3
  gRNA
ggccgugcucaccaccuuca

SEQ ID NO: 94493 - RNA, 20 nt, Artificial Sequence
  MKO10094493_B_Kcnq3
  gRNA
cacagucucauauuccuuga

SEQ ID NO: 94494 - RNA, 20 nt, Artificial Sequence
  MKO10094494_B_Kcnq4
  gRNA
cguggucuaugcgcacagua

SEQ ID NO: 94495 - RNA, 20 nt, Artificial Sequence
  MKO10094495_B_Kcnq4
  gRNA
uggaguauauaauccguguc

SEQ ID NO: 94496 - RNA, 20 nt, Artificial Sequence
  MKO10094496_B_Kcnq4
  gRNA
caagauaaggagacacucgu

SEQ ID NO: 94497 - RNA, 20 nt, Artificial Sequence
  MKO10094497_B_Kcnq5
  gRNA
uggaguucaucauucgaauc

SEQ ID NO: 94498 - RNA, 20 nt, Artificial Sequence
  MKO10094498_B_Kcnq5
  gRNA
gauccugcguauggugcgca

SEQ ID NO: 94499 - RNA, 20 nt, Artificial Sequence
  MKO10094499_B_Kcnq5
  gRNA
uucgugaugaucguugucuu

SEQ ID NO: 94500 - RNA, 20 nt, Artificial Sequence
  MKO10094500_B_Kcnrg
  gRNA
aacaaaugucuugggccuac

SEQ ID NO: 94501 - RNA, 20 nt, Artificial Sequence
  MKO10094501_B_Kcnrg
  gRNA
ccaaucaagaucugcuguca

SEQ ID NO: 94502 - RNA, 20 nt, Artificial Sequence
  MKO10094502_B_Kcnrg
  gRNA
auaacaaccccucaaguccu

SEQ ID NO: 94503 - RNA, 20 nt, Artificial Sequence
  MKO10094503_B_Kcns1
  gRNA
gcggccucgggcugcauccu

SEQ ID NO: 94504 - RNA, 20 nt, Artificial Sequence
  MKO10094504_B_Kcns1
  gRNA
gccgcuccagauaccgcgcg

SEQ ID NO: 94505 - RNA, 20 nt, Artificial Sequence
  MKO10094505_B_Kcns1
  gRNA
uggccacgugcugccgcgcg

SEQ ID NO: 94506 - RNA, 20 nt, Artificial Sequence
  MKO10094506_B_Kcns2
  gRNA
gcuccucugccacucgcgag

SEQ ID NO: 94507 - RNA, 20 nt, Artificial Sequence
  MKO10094507_B_Kcns2
  gRNA
cagggguugcccaucgaacu

SEQ ID NO: 94508 - RNA, 20 nt, Artificial Sequence
  MKO10094508_B_Kcns2
  gRNA
uccauccucgacgucgguau

SEQ ID NO: 94509 - RNA, 20 nt, Artificial Sequence
  MKO10094509_B_Kcns3
  gRNA
uccagauccuucggcucaug

SEQ ID NO: 94510 - RNA, 20 nt, Artificial Sequence
  MKO10094510_B_Kcns3
  gRNA
cauucccuucuaugccacgu

SEQ ID NO: 94511 - RNA, 20 nt, Artificial Sequence
  MKO10094511_B_Kcns3
  gRNA
aucacugaccacgaugccaa

SEQ ID NO: 94512 - RNA, 20 nt, Artificial Sequence
  MKO10094512_B_Kcnt1
  gRNA
cauugacauagaacuccacc

SEQ ID NO: 94513 - RNA, 20 nt, Artificial Sequence
  MKO10094513_B_Kcnt1
  gRNA
aacucaccaguggaacucag

SEQ ID NO: 94514 - RNA, 20 nt, Artificial Sequence
  MKO10094514_B_Kcnt1
  gRNA
ucauguggaagauuucagcc

SEQ ID NO: 94515 - RNA, 20 nt, Artificial Sequence
  MKO10094515_B_Kcnt2
  gRNA
guaaccuguaaaccccauaa

SEQ ID NO: 94516 - RNA, 20 nt, Artificial Sequence
  MKO10094516_B_Kcnt2
  gRNA
ccuuauaacugagauaacca

SEQ ID NO: 94517 - RNA, 20 nt, Artificial Sequence
  MKO10094517_B_Kcnt2
  gRNA
auaagcagcuuaacaacuuc

SEQ ID NO: 94518 - RNA, 20 nt, Artificial Sequence
  MKO10094518_B_Kcnu1
  gRNA
uucuuuccaguccuguucga

SEQ ID NO: 94519 - RNA, 20 nt, Artificial Sequence
  MKO10094519_B_Kcnu1
  gRNA
cgaugcuuaguacaaagaca

SEQ ID NO: 94520 - RNA, 20 nt, Artificial Sequence
  MKO10094520_B_Kcnu1
  gRNA
cuuauuauuugaagaguaau

SEQ ID NO: 94521 - RNA, 20 nt, Artificial Sequence
  MKO10094521_B_Kcnv1
  gRNA
ugucuaugcccggagcauaa

SEQ ID NO: 94522 - RNA, 20 nt, Artificial Sequence
  MKO10094522_B_Kcnv1
  gRNA
gugugcaucagcugguucac

SEQ ID NO: 94523 - RNA, 20 nt, Artificial Sequence
  MKO10094523_B_Kcnv1
  gRNA
gcaaggaggucuaugauguu

SEQ ID NO: 94524 - RNA, 20 nt, Artificial Sequence
  MKO10094524_B_Kcnv2
  gRNA
cauguacccggagacccacc

SEQ ID NO: 94525 - RNA, 20 nt, Artificial Sequence
  MKO10094525_B_Kcnv2
  gRNA
uuccagaggcguugacguug

SEQ ID NO: 94526 - RNA, 20 nt, Artificial Sequence
  MKO10094526_B_Kcnv2
  gRNA
caacuaccccaaaacgcgcc

SEQ ID NO: 94527 - RNA, 20 nt, Artificial Sequence
  MKO10094527_B_Kcp
  gRNA
gaccauaagacugcccauug

SEQ ID NO: 94528 - RNA, 20 nt, Artificial Sequence
  MKO10094528_B_Kcp
  gRNA
cuguaccaccugccgcuguc

SEQ ID NO: 94529 - RNA, 20 nt, Artificial Sequence
  MKO10094529_B_Kcp
  gRNA
ggcaggaaccgugcagugcc

SEQ ID NO: 94530 - RNA, 20 nt, Artificial Sequence
  MKO10094530_B_Kcud10
  gRNA
ugccuacuuguagggcggcc

SEQ ID NO: 94531 - RNA, 20 nt, Artificial Sequence
  MKO10094531_B_Kcud10
  gRNA
cacguucagcuucacguacu

SEQ ID NO: 94532 - RNA, 20 nt, Artificial Sequence
  MKO10094532_B_Kcud10
  gRNA
gaugacggguaccuugcaga

SEQ ID NO: 94533 - RNA, 20 nt, Artificial Sequence
  MKO10094533_B_Kcud11
  gRNA
ggccuagccgcaaaaaauug

SEQ ID NO: 94534 - RNA, 20 nt, Artificial Sequence
  MKO10094534_B_Kcud11
  gRNA
gcuaccucccgacgaucuuc

SEQ ID NO: 94535 - RNA, 20 nt, Artificial Sequence
  MKO10094535_B_Kcud11
  gRNA
uugcgcuuugugcgccacug

SEQ ID NO: 94536 - RNA, 20 nt, Artificial Sequence
  MKO10094536_B_Kcud12b
  gRNA
aaacugccgcacuccucggu

SEQ ID NO: 94537 - RNA, 20 nt, Artificial Sequence
  MKO10094537_B_Kcud12b
  gRNA
auugaacguagugucaaugc

SEQ ID NO: 94538 - RNA, 20 nt, Artificial Sequence
  MKO10094538_B_Kcud12b
  gRNA
cuaucgaggcuccuauacuc

SEQ ID NO: 94539 - RNA, 20 nt, Artificial Sequence
  MKO10094539_B_Kcud12
  gRNA
cccacuagaucacgacaauc

SEQ ID NO: 94540 - RNA, 20 nt, Artificial Sequence
  MKO10094540_B_Kcud12
  gRNA
ugcugcgcgcucgcaccgcg

SEQ ID NO: 94541 - RNA, 20 nt, Artificial Sequence
  MKO10094541_B_Kcud12
  gRNA
cagcgacgucuugccgcaca

SEQ ID NO: 94542 - RNA, 20 nt, Artificial Sequence
  MKO10094542_B_Kcud13
  gRNA
aaacuagcccugcgcuucca

SEQ ID NO: 94543 - RNA, 20 nt, Artificial Sequence
  MKO10094543_B_Kcud13
  gRNA
uuguguagaagcuucaccac

SEQ ID NO: 94544 - RNA, 20 nt, Artificial Sequence
  MKO10094544_B_Kcud13
  gRNA
gggccucaccuuggaggugc

SEQ ID NO: 94545 - RNA, 20 nt, Artificial Sequence
  MKO10094545_B_Kcud14
  gRNA
cagcacugagcuagacgcca

SEQ ID NO: 94546 - RNA, 20 nt, Artificial Sequence
  MKO10094546_B_Kcud14
  gRNA
uagacacuacaaagacgcgc

SEQ ID NO: 94547 - RNA, 20 nt, Artificial Sequence
  MKO10094547_B_Kcud14
  gRNA
cauacaaaguccuccgucau

SEQ ID NO: 94548 - RNA, 20 nt, Artificial Sequence
  MKO10094548_B_Kcud15
  gRNA
cgaggcagcgccuaguccag

SEQ ID NO: 94549 - RNA, 20 nt, Artificial Sequence
  MKO10094549_B_Kcud15
  gRNA
ggcugcgacgucuuugcucu

SEQ ID NO: 94550 - RNA, 20 nt, Artificial Sequence
  MKO10094550_B_Kcud15
  gRNA
aaagaacauauucgcugaac

SEQ ID NO: 94551 - RNA, 20 nt, Artificial Sequence
  MKO10094551_B_Kcud16
  gRNA
uuucgcucagggaagcgauc

SEQ ID NO: 94552 - RNA, 20 nt, Artificial Sequence
  MKO10094552_B_Kcud16
  gRNA
cgaggaugucaagcaaagcc

SEQ ID NO: 94553 - RNA, 20 nt, Artificial Sequence
  MKO10094553_B_Kcud16
  gRNA
cugcaccggaccuuucuuga

SEQ ID NO: 94554 - RNA, 20 nt, Artificial Sequence
  MKO10094554_B_Kcud17
  gRNA
gaagcucuucgcccugacac

SEQ ID NO: 94555 - RNA, 20 nt, Artificial Sequence
  MKO10094555_B_Kcud17
  gRNA
ugauucgaaucaucaaagac

SEQ ID NO: 94556 - RNA, 20 nt, Artificial Sequence
  MKO10094556_B_Kcud17
  gRNA
ucuuugaugauucgaaucag

SEQ ID NO: 94557 - RNA, 20 nt, Artificial Sequence
  MKO10094557_B_Kcud18
  gRNA
agagucuuugugccgcuuua

SEQ ID NO: 94558 - RNA, 20 nt, Artificial Sequence
  MKO10094558_B_Kcud18
  gRNA
ugacgcaggcuuccguguaa

SEQ ID NO: 94559 - RNA, 20 nt, Artificial Sequence
  MKO10094559_B_Kcud18
  gRNA
agccacccacauucagccga

SEQ ID NO: 94560 - RNA, 20 nt, Artificial Sequence
  MKO10094560_B_Kcud19
  gRNA
ugcagcgaguuccgcuucau

SEQ ID NO: 94561 - RNA, 20 nt, Artificial Sequence
  MKO10094561_B_Kcud19
  gRNA
gcaacauacccauauucauc

SEQ ID NO: 94562 - RNA, 20 nt, Artificial Sequence
  MKO10094562_B_Kcud19
  gRNA
ggagacaccaccuccgugug

SEQ ID NO: 94563 - RNA, 20 nt, Artificial Sequence
  MKO10094563_B_Kcud1
  gRNA
ucagugaauauguccuccga

SEQ ID NO: 94564 - RNA, 20 nt, Artificial Sequence
  MKO10094564_B_Kcud1
  gRNA
ucaccaaauaccccgaaucc

SEQ ID NO: 94565 - RNA, 20 nt, Artificial Sequence
  MKO10094565_B_Kcud1
  gRNA
uguggccgcccacgucgaug

SEQ ID NO: 94566 - RNA, 20 nt, Artificial Sequence
  MKO10094566_B_Kcud20
  gRNA
aaagggggaguaugugaucg

SEQ ID NO: 94567 - RNA, 20 nt, Artificial Sequence
  MKO10094567_B_Kcud20
  gRNA
ucccaggauuauuacaaaac

SEQ ID NO: 94568 - RNA, 20 nt, Artificial Sequence
  MKO10094568_B_Kcud20
  gRNA
ccgcuguuuccaaaucucuc

SEQ ID NO: 94569 - RNA, 20 nt, Artificial Sequence
  MKO10094569_B_Kcud21
  gRNA
aacugcuucauugaccguga

SEQ ID NO: 94570 - RNA, 20 nt, Artificial Sequence
  MKO10094570_B_Kcud21
  gRNA
aggagaugggucugcugcgc

SEQ ID NO: 94571 - RNA, 20 nt, Artificial Sequence
  MKO10094571_B_Kcud21
  gRNA
ccuccaugcuggaagacgac

SEQ ID NO: 94572 - RNA, 20 nt, Artificial Sequence
  MKO10094572_B_Kcud2
  gRNA
acaauaucgcaucucucgug

SEQ ID NO: 94573 - RNA, 20 nt, Artificial Sequence
  MKO10094573_B_Kcud2
  gRNA
gcucuuccucuugacacugc

SEQ ID NO: 94574 - RNA, 20 nt, Artificial Sequence
  MKO10094574_B_Kcud2
  gRNA
guuuaggauaggaccaaagu

SEQ ID NO: 94575 - RNA, 20 nt, Artificial Sequence
  MKO10094575_B_Kcud3
  gRNA
augauuccuaguuugcugag

SEQ ID NO: 94576 - RNA, 20 nt, Artificial Sequence
  MKO10094576_B_Kcud3
  gRNA
gagucagcauuaauguucuc

SEQ ID NO: 94577 - RNA, 20 nt, Artificial Sequence
  MKO10094577_B_Kcud3
  gRNA
acuugcagauauuuauugau

SEQ ID NO: 94578 - RNA, 20 nt, Artificial Sequence
  MKO10094578_B_Kcud4
  gRNA
guccuaaacuuccuacgaaa

SEQ ID NO: 94579 - RNA, 20 nt, Artificial Sequence
  MKO10094579_B_Kcud4
  gRNA
cgaagggaggcacaacagcg

SEQ ID NO: 94580 - RNA, 20 nt, Artificial Sequence
  MKO10094580_B_Kcud4
  gRNA
gcugugaacaauugacccuu

SEQ ID NO: 94581 - RNA, 20 nt, Artificial Sequence
  MKO10094581_B_Kcud5
  gRNA
cucaccuuggcuuucucgcu

SEQ ID NO: 94582 - RNA, 20 nt, Artificial Sequence
  MKO10094582_B_Kcud5
  gRNA
guaccgugugcugcagugcc

SEQ ID NO: 94583 - RNA, 20 nt, Artificial Sequence
  MKO10094583_B_Kcud5
  gRNA
uucauuuccauaguuguaag

SEQ ID NO: 94584 - RNA, 20 nt, Artificial Sequence
  MKO10094584_B_Kcud6
  gRNA
uaccacguugacacgcuacc

SEQ ID NO: 94585 - RNA, 20 nt, Artificial Sequence
  MKO10094585_B_Kcud6
  gRNA
ugugaugcacccgaguauug

SEQ ID NO: 94586 - RNA, 20 nt, Artificial Sequence
  MKO10094586_B_Kcud6
  gRNA
guuucacgauccgcaauacu

SEQ ID NO: 94587 - RNA, 20 nt, Artificial Sequence
  MKO10094587_B_Kcud7
  gRNA
gucgucuucggcuucggagc

SEQ ID NO: 94588 - RNA, 20 nt, Artificial Sequence
  MKO10094588_B_Kcud7
  gRNA
cccggcuucgcgcaguacag

SEQ ID NO: 94589 - RNA, 20 nt, Artificial Sequence
  MKO10094589_B_Kcud7
  gRNA
cgaagccgaagacgacuucc

SEQ ID NO: 94590 - RNA, 20 nt, Artificial Sequence
  MKO10094590_B_Kcud8
  gRNA
cuauccaagguuaagguguu

SEQ ID NO: 94591 - RNA, 20 nt, Artificial Sequence
  MKO10094591_B_Kcud8
  gRNA
ugccugguuaucucgcaccg

SEQ ID NO: 94592 - RNA, 20 nt, Artificial Sequence
  MKO10094592_B_Kcud8
  gRNA
ggucgaugaagaagcgcgcg

SEQ ID NO: 94593 - RNA, 20 nt, Artificial Sequence
  MKO10094593_B_Kcud9
  gRNA
ccgcuuaccuugccguugcu

SEQ ID NO: 94594 - RNA, 20 nt, Artificial Sequence
  MKO10094594_B_Kcud9
  gRNA
aaagccaccaguguauauaa

SEQ ID NO: 94595 - RNA, 20 nt, Artificial Sequence
  MKO10094595_B_Kcud9
  gRNA
cagacagaugcuagaccacc

SEQ ID NO: 94596 - RNA, 20 nt, Artificial Sequence
  MKO10094596_B_Kdelc1
  gRNA
cguccuuucgaucuaaaacc

SEQ ID NO: 94597 - RNA, 20 nt, Artificial Sequence
  MKO10094597_B_Kdelc1
  gRNA
ccugugucacuauaccuuaa

SEQ ID NO: 94598 - RNA, 20 nt, Artificial Sequence
  MKO10094598_B_Kdelc1
  gRNA
uuucuagaacagagucaguc

SEQ ID NO: 94599 - RNA, 20 nt, Artificial Sequence
  MKO10094599_B_Kdelc2
  gRNA
acuccacacucgaagcaaug

SEQ ID NO: 94600 - RNA, 20 nt, Artificial Sequence
  MKO10094600_B_Kdelc2
  gRNA
gagauacaggaugcacgaga

SEQ ID NO: 94601 - RNA, 20 nt, Artificial Sequence
  MKO10094601_B_Kdelc2
  gRNA
uaaauacggaccagcucuuu

SEQ ID NO: 94602 - RNA, 20 nt, Artificial Sequence
  MKO10094602_B_Kdelr1
  gRNA
aucuggcgcuaccacuucga

SEQ ID NO: 94603 - RNA, 20 nt, Artificial Sequence
  MKO10094603_B_Kdelr1
  gRNA
acucuacaacaccugcauga

SEQ ID NO: 94604 - RNA, 20 nt, Artificial Sequence
  MKO10094604_B_Kdelr1
  gRNA
gagccaaguccuguuugcug

SEQ ID NO: 94605 - RNA, 20 nt, Artificial Sequence
  MKO10094605_B_Kdelr2
  gRNA
ccucuaccgcgcucuguacc

SEQ ID NO: 94606 - RNA, 20 nt, Artificial Sequence
  MKO10094606_B_Kdelr2
  gRNA
cuuauacaacacgucuauga

SEQ ID NO: 94607 - RNA, 20 nt, Artificial Sequence
  MKO10094607_B_Kdelr2
  gRNA
gguaucgugauuuccaucau

SEQ ID NO: 94608 - RNA, 20 nt, Artificial Sequence
  MKO10094608_B_Kdelr3
  gRNA
uuccuccugguccccgugac

SEQ ID NO: 94609 - RNA, 20 nt, Artificial Sequence
  MKO10094609_B_Kdelr3
  gRNA
ugaaguucgagaagaggucc

SEQ ID NO: 94610 - RNA, 20 nt, Artificial Sequence
  MKO10094610_B_Kdelr3
  gRNA
agaccaaagcgaaaagaauc

SEQ ID NO: 94611 - RNA, 20 nt, Artificial Sequence
  MKO10094611_B_Kdm1a
  gRNA
aacucaccagacggcucuuc

SEQ ID NO: 94612 - RNA, 20 nt, Artificial Sequence
  MKO10094612_B_Kdm1a
  gRNA
ccaugaccgaaugaccucuc

SEQ ID NO: 94613 - RNA, 20 nt, Artificial Sequence
  MKO10094613_B_Kdm1a
  gRNA
uguaaggcgcuuccagcugc

SEQ ID NO: 94614 - RNA, 20 nt, Artificial Sequence
  MKO10094614_B_Kdm1b
  gRNA
cgaugguaucaccuuuccug

SEQ ID NO: 94615 - RNA, 20 nt, Artificial Sequence
  MKO10094615_B_Kdm1b
  gRNA
gcuuugaccacuacuacaga

SEQ ID NO: 94616 - RNA, 20 nt, Artificial Sequence
  MKO10094616_B_Kdm1b
  gRNA
gcuuugcaagcgcuucugaa

SEQ ID NO: 94617 - RNA, 20 nt, Artificial Sequence
  MKO10094617_B_Kdm2a
  gRNA
uauggugcagcggccuucca

SEQ ID NO: 94618 - RNA, 20 nt, Artificial Sequence
  MKO10094618_B_Kdm2a
  gRNA
uuaauguagaguauauccag

SEQ ID NO: 94619 - RNA, 20 nt, Artificial Sequence
  MKO10094619_B_Kdm2a
  gRNA
acaucauucacugugaaguc

SEQ ID NO: 94620 - RNA, 20 nt, Artificial Sequence
  MKO10094620_B_Kdm2b
  gRNA
uuggaggcauacuuaaagcc

SEQ ID NO: 94621 - RNA, 20 nt, Artificial Sequence
  MKO10094621_B_Kdm2b
  gRNA
guggaugaucucguugcaga

SEQ ID NO: 94622 - RNA, 20 nt, Artificial Sequence
  MKO10094622_B_Kdm2b
  gRNA
uguccgaaguguaaccaugc

SEQ ID NO: 94623 - RNA, 20 nt, Artificial Sequence
  MKO10094623_B_Kdm3a
  gRNA
ugacugucugauuaucagua

SEQ ID NO: 94624 - RNA, 20 nt, Artificial Sequence
  MKO10094624_B_Kdm3a
  gRNA
aacucuucaagucaacugug

SEQ ID NO: 94625 - RNA, 20 nt, Artificial Sequence
  MKO10094625_B_Kdm3a
  gRNA
ugggagccauaacuucuguu

SEQ ID NO: 94626 - RNA, 20 nt, Artificial Sequence
  MKO10094626_B_Kdm3b
  gRNA
aacgaagcucucgauccaca

SEQ ID NO: 94627 - RNA, 20 nt, Artificial Sequence
  MKO10094627_B_Kdm3b
  gRNA
caccccccuaguagauaagc

SEQ ID NO: 94628 - RNA, 20 nt, Artificial Sequence
  MKO10094628_B_Kdm3b
  gRNA
uuuaggucccuauagugucc

SEQ ID NO: 94629 - RNA, 20 nt, Artificial Sequence
  MKO10094629_B_Kdm4a
  gRNA
uguggaagacguccuucgcc

SEQ ID NO: 94630 - RNA, 20 nt, Artificial Sequence
  MKO10094630_B_Kdm4a
  gRNA
gcccagcccgaugagcuccu

SEQ ID NO: 94631 - RNA, 20 nt, Artificial Sequence
  MKO10094631_B_Kdm4a
  gRNA
aagaacuugagcguaaauac

SEQ ID NO: 94632 - RNA, 20 nt, Artificial Sequence
  MKO10094632_B_Kdm4b
  gRNA
uguauucacgcccucaauga

SEQ ID NO: 94633 - RNA, 20 nt, Artificial Sequence
  MKO10094633_B_Kdm4b
  gRNA
gcgguacucccccacaguca

SEQ ID NO: 94634 - RNA, 20 nt, Artificial Sequence
  MKO10094634_B_Kdm4b
  gRNA
ucauagguacgccauaccac

SEQ ID NO: 94635 - RNA, 20 nt, Artificial Sequence
  MKO10094635_B_Kdm4c
  gRNA
aauaccccuuaucucuauuu

SEQ ID NO: 94636 - RNA, 20 nt, Artificial Sequence
  MKO10094636_B_Kdm4c
  gRNA
aagauuuggaacgcaaauac

SEQ ID NO: 94637 - RNA, 20 nt, Artificial Sequence
  MKO10094637_B_Kdm4c
  gRNA
auacuguacuccaagauacu

SEQ ID NO: 94638 - RNA, 20 nt, Artificial Sequence
  MKO10094638_B_Kdm4d
  gRNA
ggagacuuaauagucgacuc

SEQ ID NO: 94639 - RNA, 20 nt, Artificial Sequence
  MKO10094639_B_Kdm4d
  gRNA
aucgugagaccuggcgaagc

SEQ ID NO: 94640 - RNA, 20 nt, Artificial Sequence
  MKO10094640_B_Kdm4d
  gRNA
uuccacaguucauaucgcuc

SEQ ID NO: 94641 - RNA, 20 nt, Artificial Sequence
  MKO10094641_B_Kdm5a
  gRNA
uacucaccucaaguucauuc

SEQ ID NO: 94642 - RNA, 20 nt, Artificial Sequence
  MKO10094642_B_Kdm5a
  gRNA
uggaucaacuggcaaaauuu

SEQ ID NO: 94643 - RNA, 20 nt, Artificial Sequence
  MKO10094643_B_Kdm5a
  gRNA
ccagcgccugaaugaacuug

SEQ ID NO: 94644 - RNA, 20 nt, Artificial Sequence
  MKO10094644_B_Kdm5b
  gRNA
auaaacuucauuucaccccg

SEQ ID NO: 94645 - RNA, 20 nt, Artificial Sequence
  MKO10094645_B_Kdm5b
  gRNA
gcucccaauacuuugcaauc

SEQ ID NO: 94646 - RNA, 20 nt, Artificial Sequence
  MKO10094646_B_Kdm5b
  gRNA
acccaucuugguggcaauuu

SEQ ID NO: 94647 - RNA, 20 nt, Artificial Sequence
  MKO10094647_B_Kdm5c
  gRNA
uucauagugagagcguagca

SEQ ID NO: 94648 - RNA, 20 nt, Artificial Sequence
  MKO10094648_B_Kdm5c
  gRNA
cacacgcccauuugauaaug

SEQ ID NO: 94649 - RNA, 20 nt, Artificial Sequence
  MKO10094649_B_Kdm5c
  gRNA
cccuaugaaauguaccaguc

SEQ ID NO: 94650 - RNA, 20 nt, Artificial Sequence
  MKO10094650_B_Kdm5d
  gRNA
caacgccuuaauuacccauc

SEQ ID NO: 94651 - RNA, 20 nt, Artificial Sequence
  MKO10094651_B_Kdm5d
  gRNA
ucauuuagccucugaauucg

SEQ ID NO: 94652 - RNA, 20 nt, Artificial Sequence
  MKO10094652_B_Kdm5d
  gRNA
uuaccuuauuaaggcuguaa

SEQ ID NO: 94653 - RNA, 20 nt, Artificial Sequence
  MKO10094653_B_Kdm6a
  gRNA
cgccaggaugaaggcccugc

SEQ ID NO: 94654 - RNA, 20 nt, Artificial Sequence
  MKO10094654_B_Kdm6a
  gRNA
acuguaaacuguaguaccuc

SEQ ID NO: 94655 - RNA, 20 nt, Artificial Sequence
  MKO10094655_B_Kdm6a
  gRNA
accacugaaaugcauuguaa

SEQ ID NO: 94656 - RNA, 20 nt, Artificial Sequence
  MKO10094656_B_Kdm6b
  gRNA
aacaaacccuauuaugcucc

SEQ ID NO: 94657 - RNA, 20 nt, Artificial Sequence
  MKO10094657_B_Kdm6b
  gRNA
gguucagcagaucucuucac

SEQ ID NO: 94658 - RNA, 20 nt, Artificial Sequence
  MKO10094658_B_Kdm6b
  gRNA
cggcaugaaaguuccagagc

SEQ ID NO: 94659 - RNA, 20 nt, Artificial Sequence
  MKO10094659_B_Kdm7a
  gRNA
uggauuugaugucccuauua

SEQ ID NO: 94660 - RNA, 20 nt, Artificial Sequence
  MKO10094660_B_Kdm7a
  gRNA
acuuuguauccgaaaauuca

SEQ ID NO: 94661 - RNA, 20 nt, Artificial Sequence
  MKO10094661_B_Kdm7a
  gRNA
acauccaucacugaaaaagc

SEQ ID NO: 94662 - RNA, 20 nt, Artificial Sequence
  MKO10094662_B_Kdm8
  gRNA
auccgcucuaacaugacauc

SEQ ID NO: 94663 - RNA, 20 nt, Artificial Sequence
  MKO10094663_B_Kdm8
  gRNA
acuggccgugcaugaagaag

SEQ ID NO: 94664 - RNA, 20 nt, Artificial Sequence
  MKO10094664_B_Kdm8
  gRNA
ucagcaccagcucuucgacc

SEQ ID NO: 94665 - RNA, 20 nt, Artificial Sequence
  MKO10094665_B_Kdr
  gRNA
gagccuacaagugcucguac

SEQ ID NO: 94666 - RNA, 20 nt, Artificial Sequence
  MKO10094666_B_Kdr
  gRNA
aaagccuaucucgcuguccc

SEQ ID NO: 94667 - RNA, 20 nt, Artificial Sequence
  MKO10094667_B_Kdr
  gRNA
auuuccugggacagcgagau

SEQ ID NO: 94668 - RNA, 20 nt, Artificial Sequence
  MKO10094668_B_Kdsr
  gRNA
gacaugcuggucaacugugc

SEQ ID NO: 94669 - RNA, 20 nt, Artificial Sequence
  MKO10094669_B_Kdsr
  gRNA
gcuauugagugcuacaaaca

SEQ ID NO: 94670 - RNA, 20 nt, Artificial Sequence
  MKO10094670_B_Kdsr
  gRNA
gcacucuauuaaugacaaac

SEQ ID NO: 94671 - RNA, 20 nt, Artificial Sequence
  MKO10094671_B_Keap1
  gRNA
uagucgcgccaauguugaca

SEQ ID NO: 94672 - RNA, 20 nt, Artificial Sequence
  MKO10094672_B_Keap1
  gRNA
ggggcuuugacgggacuaac

SEQ ID NO: 94673 - RNA, 20 nt, Artificial Sequence
  MKO10094673_B_Keap1
  gRNA
uugaucaauuugcuuccgac

SEQ ID NO: 94674 - RNA, 20 nt, Artificial Sequence
  MKO10094674_B_Keg1
  gRNA
cuugaccuugcccaaguuag

SEQ ID NO: 94675 - RNA, 20 nt, Artificial Sequence
  MKO10094675_B_Keg1
  gRNA
cuagauaaguguuguuguag

SEQ ID NO: 94676 - RNA, 20 nt, Artificial Sequence
  MKO10094676_B_Keg1
  gRNA
aagucuuggagccacuaacu

SEQ ID NO: 94677 - RNA, 20 nt, Artificial Sequence
  MKO10094677_B_Kel
  gRNA
gacagcuagcagcacccauc

SEQ ID NO: 94678 - RNA, 20 nt, Artificial Sequence
  MKO10094678_B_Kel
  gRNA
uccaggagcuccauacacac

SEQ ID NO: 94679 - RNA, 20 nt, Artificial Sequence
  MKO10094679_B_Kel
  gRNA
ucuuacaaggaccacaguuc

SEQ ID NO: 94680 - RNA, 20 nt, Artificial Sequence
  MKO10094680_B_Kera
  gRNA
ccccuucucaaucccguagu

SEQ ID NO: 94681 - RNA, 20 nt, Artificial Sequence
  MKO10094681_B_Kera
  gRNA
acaacugagcuaccugcguc

SEQ ID NO: 94682 - RNA, 20 nt, Artificial Sequence
  MKO10094682_B_Kera
  gRNA
caccacacugcgugcagaac

SEQ ID NO: 94683 - RNA, 20 nt, Artificial Sequence
  MKO10094683_B_Khdc1a
  gRNA
ugaugaauaccuucacaccc

SEQ ID NO: 94684 - RNA, 20 nt, Artificial Sequence
  MKO10094684_B_Khdc1a
  gRNA
cccaaagcauuuaccaaugg

SEQ ID NO: 94685 - RNA, 20 nt, Artificial Sequence
  MKO10094685_B_Khdc1a
  gRNA
agaugaugcuacugcagauc

SEQ ID NO: 94686 - RNA, 20 nt, Artificial Sequence
  MKO10094686_B_Khdc1b
  gRNA
uaccaaauauguagucuucc

SEQ ID NO: 94687 - RNA, 20 nt, Artificial Sequence
  MKO10094687_B_Khdc1b
  gRNA
caggaaugagugaccuccgc

SEQ ID NO: 94688 - RNA, 20 nt, Artificial Sequence
  MKO10094688_B_Khdc1b
  gRNA
acccacagccuugccuuaag

SEQ ID NO: 94689 - RNA, 20 nt, Artificial Sequence
  MKO10094689_B_Khdc1c
  gRNA
ugaugaauaccuucacaccc

SEQ ID NO: 94690 - RNA, 20 nt, Artificial Sequence
  MKO10094690_B_Khdc1c
  gRNA
cccaaagcauuuaccaaugg

SEQ ID NO: 94691 - RNA, 20 nt, Artificial Sequence
  MKO10094691_B_Khdc1c
  gRNA
agaugaugcuacugcagauc

SEQ ID NO: 94692 - RNA, 20 nt, Artificial Sequence
  MKO10094692_B_Khdc3
  gRNA
cauucgacauggaaccacuu

SEQ ID NO: 94693 - RNA, 20 nt, Artificial Sequence
  MKO10094693_B_Khdc3
  gRNA
cugcaccgaagccgacugcg

SEQ ID NO: 94694 - RNA, 20 nt, Artificial Sequence
  MKO10094694_B_Khdc3
  gRNA
aacaugauuuccaguagccg

SEQ ID NO: 94695 - RNA, 20 nt, Artificial Sequence
  MKO10094695_B_Khdrbs1
  gRNA
gugugaagcuuaugcucuua

SEQ ID NO: 94696 - RNA, 20 nt, Artificial Sequence
  MKO10094696_B_Khdrbs1
  gRNA
accuuuggauacugcuugac

SEQ ID NO: 94697 - RNA, 20 nt, Artificial Sequence
  MKO10094697_B_Khdrbs1
  gRNA
ucuuugcaccagucucuucc

SEQ ID NO: 94698 - RNA, 20 nt, Artificial Sequence
  MKO10094698_B_Khdrbs2
  gRNA
aaauucgucaagagcaacuc

SEQ ID NO: 94699 - RNA, 20 nt, Artificial Sequence
  MKO10094699_B_Khdrbs2
  gRNA
cauucaaguaagacaacucc

SEQ ID NO: 94700 - RNA, 20 nt, Artificial Sequence
  MKO10094700_B_Khdrbs2
  gRNA
gggugcuaaaaugucuaucc

SEQ ID NO: 94701 - RNA, 20 nt, Artificial Sequence
  MKO10094701_B_Khdrbs3
  gRNA
acacuucaaugagcacgugc

SEQ ID NO: 94702 - RNA, 20 nt, Artificial Sequence
  MKO10094702_B_Khdrbs3
  gRNA
auccgggcauaugcuucugc

SEQ ID NO: 94703 - RNA, 20 nt, Artificial Sequence
  MKO10094703_B_Khdrbs3
  gRNA
ggaagagaaguacauugacg

SEQ ID NO: 94704 - RNA, 20 nt, Artificial Sequence
  MKO10094704_B_Khk
  gRNA
gccccagggccggaaugcau

SEQ ID NO: 94705 - RNA, 20 nt, Artificial Sequence
  MKO10094705_B_Khk
  gRNA
ucucuaucuccaccgacacc

SEQ ID NO: 94706 - RNA, 20 nt, Artificial Sequence
  MKO10094706_B_Khk
  gRNA
ugcaucgucaacaacuccaa

SEQ ID NO: 94707 - RNA, 20 nt, Artificial Sequence
  MKO10094707_B_Khnyn
  gRNA
cuugccauccaugacucgug

SEQ ID NO: 94708 - RNA, 20 nt, Artificial Sequence
  MKO10094708_B_Khnyn
  gRNA
caaagacgguuaugucacgg

SEQ ID NO: 94709 - RNA, 20 nt, Artificial Sequence
  MKO10094709_B_Khnyn
  gRNA
ccugacacccucacgaguca

SEQ ID NO: 94710 - RNA, 20 nt, Artificial Sequence
  MKO10094710_B_Khsrp
  gRNA
cucaagcccaccaugccauc

SEQ ID NO: 94711 - RNA, 20 nt, Artificial Sequence
  MKO10094711_B_Khsrp
  gRNA
aguggacuuacagucucccu

SEQ ID NO: 94712 - RNA, 20 nt, Artificial Sequence
  MKO10094712_B_Khsrp
  gRNA
cccuagauugcagccaaaau

SEQ ID NO: 94713 - RNA, 20 nt, Artificial Sequence
  MKO10094713_B_Kidins220
  gRNA
ggugccaacccaagugucac

SEQ ID NO: 94714 - RNA, 20 nt, Artificial Sequence
  MKO10094714_B_Kidins220
  gRNA
acugaugauagcugcugaac

SEQ ID NO: 94715 - RNA, 20 nt, Artificial Sequence
  MKO10094715_B_Kidins220
  gRNA
caaaggcaggacggauguug

SEQ ID NO: 94716 - RNA, 20 nt, Artificial Sequence
  MKO10094716_B_Kif11
  gRNA
uaauuucaggauccucuggc

SEQ ID NO: 94717 - RNA, 20 nt, Artificial Sequence
  MKO10094717_B_Kif11
  gRNA
uuucacagauauggucagac

SEQ ID NO: 94718 - RNA, 20 nt, Artificial Sequence
  MKO10094718_B_Kif11
  gRNA
auaauaacuucaucuagaau

SEQ ID NO: 94719 - RNA, 20 nt, Artificial Sequence
  MKO10094719_B_Kif12
  gRNA
acguuuggccagacugguuc

SEQ ID NO: 94720 - RNA, 20 nt, Artificial Sequence
  MKO10094720_B_Kif12
  gRNA
gcagagugcauugcacuguu

SEQ ID NO: 94721 - RNA, 20 nt, Artificial Sequence
  MKO10094721_B_Kif12
  gRNA
ggugcgucccaugagcacag

SEQ ID NO: 94722 - RNA, 20 nt, Artificial Sequence
  MKO10094722_B_Kif13a
  gRNA
acaagcauuguaucccugaa

SEQ ID NO: 94723 - RNA, 20 nt, Artificial Sequence
  MKO10094723_B_Kif13a
  gRNA
uccuccuuccaacacuaagc

SEQ ID NO: 94724 - RNA, 20 nt, Artificial Sequence
  MKO10094724_B_Kif13a
  gRNA
aauucucgagaaagccuuuc

SEQ ID NO: 94725 - RNA, 20 nt, Artificial Sequence
  MKO10094725_B_Kif13b
  gRNA
cugcccauaagcaaagauac

SEQ ID NO: 94726 - RNA, 20 nt, Artificial Sequence
  MKO10094726_B_Kif13b
  gRNA
uugcuuaugaucacuguuuc

SEQ ID NO: 94727 - RNA, 20 nt, Artificial Sequence
  MKO10094727_B_Kif13b
  gRNA
ucugaagaauguucucccca

SEQ ID NO: 94728 - RNA, 20 nt, Artificial Sequence
  MKO10094728_B_Kif14
  gRNA
agaguaaacuuguuucauau

SEQ ID NO: 94729 - RNA, 20 nt, Artificial Sequence
  MKO10094729_B_Kif14
  gRNA
agccuucaaaagcucugucc

SEQ ID NO: 94730 - RNA, 20 nt, Artificial Sequence
  MKO10094730_B_Kif14
  gRNA
aagagaucuucacagaaucu

SEQ ID NO: 94731 - RNA, 20 nt, Artificial Sequence
  MKO10094731_B_Kif15
  gRNA
auuguggaaucaugcaugag

SEQ ID NO: 94732 - RNA, 20 nt, Artificial Sequence
  MKO10094732_B_Kif15
  gRNA
aacaacuuacuaugcaaaga

SEQ ID NO: 94733 - RNA, 20 nt, Artificial Sequence
  MKO10094733_B_Kif15
  gRNA
auucucauucuaaccagcca

SEQ ID NO: 94734 - RNA, 20 nt, Artificial Sequence
  MKO10094734_B_Kif16b
  gRNA
ggccaaguucaucauucaaa

SEQ ID NO: 94735 - RNA, 20 nt, Artificial Sequence
  MKO10094735_B_Kif16b
  gRNA
auuucuugugagacauaauc

SEQ ID NO: 94736 - RNA, 20 nt, Artificial Sequence
  MKO10094736_B_Kif16b
  gRNA
guugugaaaucugcauuuga

SEQ ID NO: 94737 - RNA, 20 nt, Artificial Sequence
  MKO10094737_B_Kif17
  gRNA
ggcccagugcgagcgcguca

SEQ ID NO: 94738 - RNA, 20 nt, Artificial Sequence
  MKO10094738_B_Kif17
  gRNA
ucaggguguagccaaccgca

SEQ ID NO: 94739 - RNA, 20 nt, Artificial Sequence
  MKO10094739_B_Kif17
  gRNA
cucgugcagggugucaccga

SEQ ID NO: 94740 - RNA, 20 nt, Artificial Sequence
  MKO10094740_B_Kif18a
  gRNA
agacacugcauucacgucag

SEQ ID NO: 94741 - RNA, 20 nt, Artificial Sequence
  MKO10094741_B_Kif18a
  gRNA
uagcacugccgugucauacc

SEQ ID NO: 94742 - RNA, 20 nt, Artificial Sequence
  MKO10094742_B_Kif18a
  gRNA
ccccuagccuaaaucuucag

SEQ ID NO: 94743 - RNA, 20 nt, Artificial Sequence
  MKO10094743_B_Kif18b
  gRNA
cagacgccuguacaguucca

SEQ ID NO: 94744 - RNA, 20 nt, Artificial Sequence
  MKO10094744_B_Kif18b
  gRNA
caggcgucuggaagcccgcc

SEQ ID NO: 94745 - RNA, 20 nt, Artificial Sequence
  MKO10094745_B_Kif18b
  gRNA
aggaccccucaccauccgug

SEQ ID NO: 94746 - RNA, 20 nt, Artificial Sequence
  MKO10094746_B_Kif19a
  gRNA
ucuccucgauggcucggaac

SEQ ID NO: 94747 - RNA, 20 nt, Artificial Sequence
  MKO10094747_B_Kif19a
  gRNA
cguccaucuugugagcgaug

SEQ ID NO: 94748 - RNA, 20 nt, Artificial Sequence
  MKO10094748_B_Kif19a
  gRNA
ugugcccgcagaaugucguc

SEQ ID NO: 94749 - RNA, 20 nt, Artificial Sequence
  MKO10094749_B_Kif1a
  gRNA
caccgagguaugugaccagu

SEQ ID NO: 94750 - RNA, 20 nt, Artificial Sequence
  MKO10094750_B_Kif1a
  gRNA
acgcaccgccaccuucacag

SEQ ID NO: 94751 - RNA, 20 nt, Artificial Sequence
  MKO10094751_B_Kif1a
  gRNA
gcucauuucccgggaguuga

SEQ ID NO: 94752 - RNA, 20 nt, Artificial Sequence
  MKO10094752_B_Kif1b
  gRNA
ugggaaauccuacacgauga

SEQ ID NO: 94753 - RNA, 20 nt, Artificial Sequence
  MKO10094753_B_Kif1b
  gRNA
caccgaggugugggaccagu

SEQ ID NO: 94754 - RNA, 20 nt, Artificial Sequence
  MKO10094754_B_Kif1b
  gRNA
ucagcuuugacuacuccuac

SEQ ID NO: 94755 - RNA, 20 nt, Artificial Sequence
  MKO10094755_B_Kif1c
  gRNA
ucaccuucgacuauucuuac

SEQ ID NO: 94756 - RNA, 20 nt, Artificial Sequence
  MKO10094756_B_Kif1c
  gRNA
ggggcuuaccucuacugaau

SEQ ID NO: 94757 - RNA, 20 nt, Artificial Sequence
  MKO10094757_B_Kif1c
  gRNA
cccagcccccgucugcccgu

SEQ ID NO: 94758 - RNA, 20 nt, Artificial Sequence
  MKO10094758_B_Kif20a
  gRNA
aacuggcucaucuacaccua

SEQ ID NO: 94759 - RNA, 20 nt, Artificial Sequence
  MKO10094759_B_Kif20a
  gRNA
uugccuugaagaguaaugag

SEQ ID NO: 94760 - RNA, 20 nt, Artificial Sequence
  MKO10094760_B_Kif20a
  gRNA
ucuguuacaggcucuacugg

SEQ ID NO: 94761 - RNA, 20 nt, Artificial Sequence
  MKO10094761_B_Kif20b
  gRNA
cuagggcugugugcaaguuu

SEQ ID NO: 94762 - RNA, 20 nt, Artificial Sequence
  MKO10094762_B_Kif20b
  gRNA
auuaucaucugaucaagaga

SEQ ID NO: 94763 - RNA, 20 nt, Artificial Sequence
  MKO10094763_B_Kif20b
  gRNA
cagagcucuucucacuuaag

SEQ ID NO: 94764 - RNA, 20 nt, Artificial Sequence
  MKO10094764_B_Kif21a
  gRNA
gcucggugcgcguggcuguc

SEQ ID NO: 94765 - RNA, 20 nt, Artificial Sequence
  MKO10094765_B_Kif21a
  gRNA
uacuuguccauaggcaaaca

SEQ ID NO: 94766 - RNA, 20 nt, Artificial Sequence
  MKO10094766_B_Kif21a
  gRNA
cgcaggcauguugggcgcug

SEQ ID NO: 94767 - RNA, 20 nt, Artificial Sequence
  MKO10094767_B_Kif21b
  gRNA
accugcggugucgggcaucg

SEQ ID NO: 94768 - RNA, 20 nt, Artificial Sequence
  MKO10094768_B_Kif21b
  gRNA
cuggggcucucccgggguaa

SEQ ID NO: 94769 - RNA, 20 nt, Artificial Sequence
  MKO10094769_B_Kif21b
  gRNA
cacacacgcgcaucuggcac

SEQ ID NO: 94770 - RNA, 20 nt, Artificial Sequence
  MKO10094770_B_Kif22
  gRNA
uguucccucggcagucuucg

SEQ ID NO: 94771 - RNA, 20 nt, Artificial Sequence
  MKO10094771_B_Kif22
  gRNA
agugcucuucucgccauaga

SEQ ID NO: 94772 - RNA, 20 nt, Artificial Sequence
  MKO10094772_B_Kif22
  gRNA
gcccauccuaaggcacuugc

SEQ ID NO: 94773 - RNA, 20 nt, Artificial Sequence
  MKO10094773_B_Kif23
  gRNA
cuguugagucgauagcccuc

SEQ ID NO: 94774 - RNA, 20 nt, Artificial Sequence
  MKO10094774_B_Kif23
  gRNA
gaccucauucauggcaagaa

SEQ ID NO: 94775 - RNA, 20 nt, Artificial Sequence
  MKO10094775_B_Kif23
  gRNA
gacaaaccuuaaagauccag

SEQ ID NO: 94776 - RNA, 20 nt, Artificial Sequence
  MKO10094776_B_Kif24
  gRNA
cagccagagcauacaauccu

SEQ ID NO: 94777 - RNA, 20 nt, Artificial Sequence
  MKO10094777_B_Kif24
  gRNA
uggccuucgagagcuccaag

SEQ ID NO: 94778 - RNA, 20 nt, Artificial Sequence
  MKO10094778_B_Kif24
  gRNA
aaacccaggauuguaugcuc

SEQ ID NO: 94779 - RNA, 20 nt, Artificial Sequence
  MKO10094779_B_Kif26a
  gRNA
cgggugaugcuucuugcgcu

SEQ ID NO: 94780 - RNA, 20 nt, Artificial Sequence
  MKO10094780_B_Kif26a
  gRNA
cacgccuucgacauacguuc

SEQ ID NO: 94781 - RNA, 20 nt, Artificial Sequence
  MKO10094781_B_Kif26a
  gRNA
agcauugggguccucgugac

SEQ ID NO: 94782 - RNA, 20 nt, Artificial Sequence
  MKO10094782_B_Kif26b
  gRNA
caucucuuaccgugcgaaga

SEQ ID NO: 94783 - RNA, 20 nt, Artificial Sequence
  MKO10094783_B_Kif26b
  gRNA
aucaauaucuagacggcacc

SEQ ID NO: 94784 - RNA, 20 nt, Artificial Sequence
  MKO10094784_B_Kif26b
  gRNA
aggggagccuccgcaacaga

SEQ ID NO: 94785 - RNA, 20 nt, Artificial Sequence
  MKO10094785_B_Kif27
  gRNA
ccaacucuagaagaucucuu

SEQ ID NO: 94786 - RNA, 20 nt, Artificial Sequence
  MKO10094786_B_Kif27
  gRNA
gucguauauagaaguuuaua

SEQ ID NO: 94787 - RNA, 20 nt, Artificial Sequence
  MKO10094787_B_Kif27
  gRNA
ccugcaaucuauucacuuuc

SEQ ID NO: 94788 - RNA, 20 nt, Artificial Sequence
  MKO10094788_B_Kif2a
  gRNA
gacgaggguggagguaguuc

SEQ ID NO: 94789 - RNA, 20 nt, Artificial Sequence
  MKO10094789_B_Kif2a
  gRNA
ugugcagaagacgauugcuc

SEQ ID NO: 94790 - RNA, 20 nt, Artificial Sequence
  MKO10094790_B_Kif2a
  gRNA
cugggcucaauaucuucauc

SEQ ID NO: 94791 - RNA, 20 nt, Artificial Sequence
  MKO10094791_B_Kif2b
  gRNA
cgagacuaugcgcaugauug

SEQ ID NO: 94792 - RNA, 20 nt, Artificial Sequence
  MKO10094792_B_Kif2b
  gRNA
augaucgcgacaaucucacc

SEQ ID NO: 94793 - RNA, 20 nt, Artificial Sequence
  MKO10094793_B_Kif2b
  gRNA
augcgcauagucucgaaguu

SEQ ID NO: 94794 - RNA, 20 nt, Artificial Sequence
  MKO10094794_B_Kif2c
  gRNA
aucgaaggagguaccacaaa

SEQ ID NO: 94795 - RNA, 20 nt, Artificial Sequence
  MKO10094795_B_Kif2c
  gRNA
aacugcuugcgagaguuugu

SEQ ID NO: 94796 - RNA, 20 nt, Artificial Sequence
  MKO10094796_B_Kif2c
  gRNA
gauccauuccaccgaaacac

SEQ ID NO: 94797 - RNA, 20 nt, Artificial Sequence
  MKO10094797_B_Kif3a
  gRNA
uuugguucgagugucauacu

SEQ ID NO: 94798 - RNA, 20 nt, Artificial Sequence
  MKO10094798_B_Kif3a
  gRNA
ugaagaaguucgagaccuuu

SEQ ID NO: 94799 - RNA, 20 nt, Artificial Sequence
  MKO10094799_B_Kif3a
  gRNA
ucagggaccaucuuugcaua

SEQ ID NO: 94800 - RNA, 20 nt, Artificial Sequence
  MKO10094800_B_Kif3b
  gRNA
cucgacucuccauuugcugc

SEQ ID NO: 94801 - RNA, 20 nt, Artificial Sequence
  MKO10094801_B_Kif3b
  gRNA
agaacacaucaaagagcgcc

SEQ ID NO: 94802 - RNA, 20 nt, Artificial Sequence
  MKO10094802_B_Kif3b
  gRNA
aaacgaacagcagaagaucc

SEQ ID NO: 94803 - RNA, 20 nt, Artificial Sequence
  MKO10094803_B_Kif3c
  gRNA
guagguaccacguagcucca

SEQ ID NO: 94804 - RNA, 20 nt, Artificial Sequence
  MKO10094804_B_Kif3c
  gRNA
caacaucuucuguugcucgu

SEQ ID NO: 94805 - RNA, 20 nt, Artificial Sequence
  MKO10094805_B_Kif3c
  gRNA
ugagaacuucauccccccug

SEQ ID NO: 94806 - RNA, 20 nt, Artificial Sequence
  MKO10094806_B_Kif4
  gRNA
aucuggaaaaacguauucaa

SEQ ID NO: 94807 - RNA, 20 nt, Artificial Sequence
  MKO10094807_B_Kif4
  gRNA
uuacaaucuccauugagcaa

SEQ ID NO: 94808 - RNA, 20 nt, Artificial Sequence
  MKO10094808_B_Kif4
  gRNA
gcaguagcuccacucauaaa

SEQ ID NO: 94809 - RNA, 20 nt, Artificial Sequence
  MKO10094809_B_Kif5a
  gRNA
aauggcacaaucuucgcuua

SEQ ID NO: 94810 - RNA, 20 nt, Artificial Sequence
  MKO10094810_B_Kif5a
  gRNA
cuuaccuuugacgaucugca

SEQ ID NO: 94811 - RNA, 20 nt, Artificial Sequence
  MKO10094811_B_Kif5a
  gRNA
cucagggaaaacgcauacca

SEQ ID NO: 94812 - RNA, 20 nt, Artificial Sequence
  MKO10094812_B_Kif5b
  gRNA
gaaacauuaccuccaucgug

SEQ ID NO: 94813 - RNA, 20 nt, Artificial Sequence
  MKO10094813_B_Kif5b
  gRNA
gguaaacuucaugauccaga

SEQ ID NO: 94814 - RNA, 20 nt, Artificial Sequence
  MKO10094814_B_Kif5b
  gRNA
aagauaagggacuuguuaga

SEQ ID NO: 94815 - RNA, 20 nt, Artificial Sequence
  MKO10094815_B_Kif5c
  gRNA
gcugccgcccaacacaaccc

SEQ ID NO: 94816 - RNA, 20 nt, Artificial Sequence
  MKO10094816_B_Kif5c
  gRNA
uuaccuugauaugaaacucc

SEQ ID NO: 94817 - RNA, 20 nt, Artificial Sequence
  MKO10094817_B_Kif5c
  gRNA
aaaauaucaugugcaauccu

SEQ ID NO: 94818 - RNA, 20 nt, Artificial Sequence
  MKO10094818_B_Kif6
  gRNA
acugcucaaaaauguacgac

SEQ ID NO: 94819 - RNA, 20 nt, Artificial Sequence
  MKO10094819_B_Kif6
  gRNA
aauugucuuaccccgagacc

SEQ ID NO: 94820 - RNA, 20 nt, Artificial Sequence
  MKO10094820_B_Kif6
  gRNA
cgaauguggcuaugaccugc

SEQ ID NO: 94821 - RNA, 20 nt, Artificial Sequence
  MKO10094821_B_Kif7
  gRNA
gggaaaugucauuagcgccc

SEQ ID NO: 94822 - RNA, 20 nt, Artificial Sequence
  MKO10094822_B_Kif7
  gRNA
cccgaucaucuucccgaagc

SEQ ID NO: 94823 - RNA, 20 nt, Artificial Sequence
  MKO10094823_B_Kif7
  gRNA
ccuggugcauguauccuacc

SEQ ID NO: 94824 - RNA, 20 nt, Artificial Sequence
  MKO10094824_B_Kif9
  gRNA
acggagaauuacaagcaccg

SEQ ID NO: 94825 - RNA, 20 nt, Artificial Sequence
  MKO10094825_B_Kif9
  gRNA
gcagguaccaucauguguua

SEQ ID NO: 94826 - RNA, 20 nt, Artificial Sequence
  MKO10094826_B_Kif9
  gRNA
cuccagcuaaaauggguacu

SEQ ID NO: 94827 - RNA, 20 nt, Artificial Sequence
  MKO10094827_B_Kifap3
  gRNA
ccaucccucaaagcuaagcg

SEQ ID NO: 94828 - RNA, 20 nt, Artificial Sequence
  MKO10094828_B_Kifap3
  gRNA
aucucccauuucuccaagaa

SEQ ID NO: 94829 - RNA, 20 nt, Artificial Sequence
  MKO10094829_B_Kifap3
  gRNA
uuccuuucguucucccaaca

SEQ ID NO: 94830 - RNA, 20 nt, Artificial Sequence
  MKO10094830_B_Kifc1
  gRNA
gccaccuacugccaggcuuc

SEQ ID NO: 94831 - RNA, 20 nt, Artificial Sequence
  MKO10094831_B_Kifc1
  gRNA
gcccaccugcaguguggccc

SEQ ID NO: 94832 - RNA, 20 nt, Artificial Sequence
  MKO10094832_B_Kifc1
  gRNA
ccaauagcagagcacccacg

SEQ ID NO: 94833 - RNA, 20 nt, Artificial Sequence
  MKO10094833_B_Kifc2
  gRNA
ugaguuccucuccguccagu

SEQ ID NO: 94834 - RNA, 20 nt, Artificial Sequence
  MKO10094834_B_Kifc2
  gRNA
accggccaggcuguucagcu

SEQ ID NO: 94835 - RNA, 20 nt, Artificial Sequence
  MKO10094835_B_Kifc2
  gRNA
uggcauggacacggagcccc

SEQ ID NO: 94836 - RNA, 20 nt, Artificial Sequence
  MKO10094836_B_Kifc3
  gRNA
gaaggcaguacacgagaacc

SEQ ID NO: 94837 - RNA, 20 nt, Artificial Sequence
  MKO10094837_B_Kifc3
  gRNA
ccagccgguggugcccugcg

SEQ ID NO: 94838 - RNA, 20 nt, Artificial Sequence
  MKO10094838_B_Kifc3
  gRNA
ucagacuggcgauagucuca

SEQ ID NO: 94839 - RNA, 20 nt, Artificial Sequence
  MKO10094839_B_Kifc5b
  gRNA
gcccaccugcauuguggccc

SEQ ID NO: 94840 - RNA, 20 nt, Artificial Sequence
  MKO10094840_B_Kifc5b
  gRNA
ugucagcaagcagccucaag

SEQ ID NO: 94841 - RNA, 20 nt, Artificial Sequence
  MKO10094841_B_Kifc5b
  gRNA
ccuggugggugcucugcugu

SEQ ID NO: 94842 - RNA, 20 nt, Artificial Sequence
  MKO10094842_B_Kin
  gRNA
agucggucagugucucccac

SEQ ID NO: 94843 - RNA, 20 nt, Artificial Sequence
  MKO10094843_B_Kin
  gRNA
ggaauuccgaaaugacuuuc

SEQ ID NO: 94844 - RNA, 20 nt, Artificial Sequence
  MKO10094844_B_Kin
  gRNA
ucaucaaagacaacuguugc

SEQ ID NO: 94845 - RNA, 20 nt, Artificial Sequence
  MKO10094845_B_Kir3dl1
  gRNA
ccugcauguucuguugucac

SEQ ID NO: 94846 - RNA, 20 nt, Artificial Sequence
  MKO10094846_B_Kir3dl1
  gRNA
acuggagucugaccauucau

SEQ ID NO: 94847 - RNA, 20 nt, Artificial Sequence
  MKO10094847_B_Kir3dl1
  gRNA
ucacaugucagcuacucaau

SEQ ID NO: 94848 - RNA, 20 nt, Artificial Sequence
  MKO10094848_B_Kir3dl2
  gRNA
ccuggagugcagauccacag

SEQ ID NO: 94849 - RNA, 20 nt, Artificial Sequence
  MKO10094849_B_Kir3dl2
  gRNA
agcaucuauaguuccccuuu

SEQ ID NO: 94850 - RNA, 20 nt, Artificial Sequence
  MKO10094850_B_Kir3dl2
  gRNA
guagguuccugcauguucug

SEQ ID NO: 94851 - RNA, 20 nt, Artificial Sequence
  MKO10094851_B_Kirrel2
  gRNA
cuccaggguggucccgguac

SEQ ID NO: 94852 - RNA, 20 nt, Artificial Sequence
  MKO10094852_B_Kirrel2
  gRNA
gaucugcagagcgcgaagcc

SEQ ID NO: 94853 - RNA, 20 nt, Artificial Sequence
  MKO10094853_B_Kirrel2
  gRNA
cgagaugggauccggcugga

SEQ ID NO: 94854 - RNA, 20 nt, Artificial Sequence
  MKO10094854_B_Kirrel3
  gRNA
uccaucaucuggcuacguaa

SEQ ID NO: 94855 - RNA, 20 nt, Artificial Sequence
  MKO10094855_B_Kirrel3
  gRNA
cuccuucagccagcaacccc

SEQ ID NO: 94856 - RNA, 20 nt, Artificial Sequence
  MKO10094856_B_Kirrel3
  gRNA
ccaagccaucuuugauccac

SEQ ID NO: 94857 - RNA, 20 nt, Artificial Sequence
  MKO10094857_B_Kirrel
  gRNA
guacaaucccagaguaguua

SEQ ID NO: 94858 - RNA, 20 nt, Artificial Sequence
  MKO10094858_B_Kirrel
  gRNA
cugcagccuggccacgguac

SEQ ID NO: 94859 - RNA, 20 nt, Artificial Sequence
  MKO10094859_B_Kirrel
  gRNA
aaccugcugccaccaucauu

SEQ ID NO: 94860 - RNA, 20 nt, Artificial Sequence
  MKO10094860_B_Kiss1r
  gRNA
gugcggggcguacagccgca

SEQ ID NO: 94861 - RNA, 20 nt, Artificial Sequence
  MKO10094861_B_Kiss1r
  gRNA
cuucgcgcucuacaaccugc

SEQ ID NO: 94862 - RNA, 20 nt, Artificial Sequence
  MKO10094862_B_Kiss1r
  gRNA
auucgucaacuacauccagc

SEQ ID NO: 94863 - RNA, 20 nt, Artificial Sequence
  MKO10094863_B_Kiss1
  gRNA
cagugcguaccuguggaucc

SEQ ID NO: 94864 - RNA, 20 nt, Artificial Sequence
  MKO10094864_B_Kiss1
  gRNA
cugcagggcugcgcgcucgu

SEQ ID NO: 94865 - RNA, 20 nt, Artificial Sequence
  MKO10094865_B_Kiss1
  gRNA
cgccugaucccugcgccccg

SEQ ID NO: 94866 - RNA, 20 nt, Artificial Sequence
  MKO10094866_B_Kitl
  gRNA
aggguuaucauauagucauu

SEQ ID NO: 94867 - RNA, 20 nt, Artificial Sequence
  MKO10094867_B_Kitl
  gRNA
uagauccauugaugccuuua

SEQ ID NO: 94868 - RNA, 20 nt, Artificial Sequence
  MKO10094868_B_Kitl
  gRNA
auauaaaagaaucuccgaag

SEQ ID NO: 94869 - RNA, 20 nt, Artificial Sequence
  MKO10094869_B_Kit
  gRNA
ucggcaagaguugacgauuc

SEQ ID NO: 94870 - RNA, 20 nt, Artificial Sequence
  MKO10094870_B_Kit
  gRNA
ccguaccugcccgcacuuug

SEQ ID NO: 94871 - RNA, 20 nt, Artificial Sequence
  MKO10094871_B_Kit
  gRNA
ugacuucaauuaugaacgcc

SEQ ID NO: 94872 - RNA, 20 nt, Artificial Sequence
  MKO10094872_B_Klb
  gRNA
uuugaugaaauccgcguguu

SEQ ID NO: 94873 - RNA, 20 nt, Artificial Sequence
  MKO10094873_B_Klb
  gRNA
guagucgccguccccgugga

SEQ ID NO: 94874 - RNA, 20 nt, Artificial Sequence
  MKO10094874_B_Klb
  gRNA
accaggcacauucgaaagug

SEQ ID NO: 94875 - RNA, 20 nt, Artificial Sequence
  MKO10094875_B_Klc1
  gRNA
gcggcuacgagaucccugca

SEQ ID NO: 94876 - RNA, 20 nt, Artificial Sequence
  MKO10094876_B_Klc1
  gRNA
cugauaccugcgccucgcuc

SEQ ID NO: 94877 - RNA, 20 nt, Artificial Sequence
  MKO10094877_B_Klc1
  gRNA
ugauucuuccaaagagccgu

SEQ ID NO: 94878 - RNA, 20 nt, Artificial Sequence
  MKO10094878_B_Klc2
  gRNA
ccagcuccucacgcaaccac

SEQ ID NO: 94879 - RNA, 20 nt, Artificial Sequence
  MKO10094879_B_Klc2
  gRNA
ucaccugcucaaugaugccc

SEQ ID NO: 94880 - RNA, 20 nt, Artificial Sequence
  MKO10094880_B_Klc2
  gRNA
uagccagggcaucauugagc

SEQ ID NO: 94881 - RNA, 20 nt, Artificial Sequence
  MKO10094881_B_Klc3
  gRNA
ccccccucgccgagacagcu

SEQ ID NO: 94882 - RNA, 20 nt, Artificial Sequence
  MKO10094882_B_Klc3
  gRNA
gaggcaguaugacccgcccg

SEQ ID NO: 94883 - RNA, 20 nt, Artificial Sequence
  MKO10094883_B_Klc3
  gRNA
gcgucuguucccggaucugc

SEQ ID NO: 94884 - RNA, 20 nt, Artificial Sequence
  MKO10094884_B_Klc4
  gRNA
acucugcaagcaagcgcuag

SEQ ID NO: 94885 - RNA, 20 nt, Artificial Sequence
  MKO10094885_B_Klc4
  gRNA
caccuaggugaugcuggcgc

SEQ ID NO: 94886 - RNA, 20 nt, Artificial Sequence
  MKO10094886_B_Klc4
  gRNA
uacugacggcuggguggucc

SEQ ID NO: 94887 - RNA, 20 nt, Artificial Sequence
  MKO10094887_B_Klf10
  gRNA
ucuuggcugauagguggcgu

SEQ ID NO: 94888 - RNA, 20 nt, Artificial Sequence
  MKO10094888_B_Klf10
  gRNA
ggucgcuccucauaaaccga

SEQ ID NO: 94889 - RNA, 20 nt, Artificial Sequence
  MKO10094889_B_Klf10
  gRNA
ucauguccaugagcugcgac

SEQ ID NO: 94890 - RNA, 20 nt, Artificial Sequence
  MKO10094890_B_Klf11
  gRNA
augaacugucucgccaccgc

SEQ ID NO: 94891 - RNA, 20 nt, Artificial Sequence
  MKO10094891_B_Klf11
  gRNA
guugacggcuccgugagcuc

SEQ ID NO: 94892 - RNA, 20 nt, Artificial Sequence
  MKO10094892_B_Klf11
  gRNA
gcuccaccggccccggcgac

SEQ ID NO: 94893 - RNA, 20 nt, Artificial Sequence
  MKO10094893_B_Klf12
  gRNA
aguuucauuaacgcuaucua

SEQ ID NO: 94894 - RNA, 20 nt, Artificial Sequence
  MKO10094894_B_Klf12
  gRNA
uacuuacucuuguacugcuc

SEQ ID NO: 94895 - RNA, 20 nt, Artificial Sequence
  MKO10094895_B_Klf12
  gRNA
cagagucaaaaccgagcuug

SEQ ID NO: 94896 - RNA, 20 nt, Artificial Sequence
  MKO10094896_B_Klf13
  gRNA
acggcacuaucgcacgcaca

SEQ ID NO: 94897 - RNA, 20 nt, Artificial Sequence
  MKO10094897_B_Klf13
  gRNA
cgcguugacgagcgccgcga

SEQ ID NO: 94898 - RNA, 20 nt, Artificial Sequence
  MKO10094898_B_Klf13
  gRNA
gccggcgcgccugcuugucc

SEQ ID NO: 94899 - RNA, 20 nt, Artificial Sequence
  MKO10094899_B_Klf14
  gRNA
agccgcugcgcucgcgccuu

SEQ ID NO: 94900 - RNA, 20 nt, Artificial Sequence
  MKO10094900_B_Klf14
  gRNA
acucggcagcgaaguagucc

SEQ ID NO: 94901 - RNA, 20 nt, Artificial Sequence
  MKO10094901_B_Klf14
  gRNA
cguugcgcgccggugcagca

SEQ ID NO: 94902 - RNA, 20 nt, Artificial Sequence
  MKO10094902_B_Klf15
  gRNA
gaucugcaguagcaccggca

SEQ ID NO: 94903 - RNA, 20 nt, Artificial Sequence
  MKO10094903_B_Klf15
  gRNA
aguugauggcgcguacugcg

SEQ ID NO: 94904 - RNA, 20 nt, Artificial Sequence
  MKO10094904_B_Klf15
  gRNA
ugugcgagaagaaauucgcg

SEQ ID NO: 94905 - RNA, 20 nt, Artificial Sequence
  MKO10094905_B_Klf16
  gRNA
gcggaagccgggaugucgcc

SEQ ID NO: 94906 - RNA, 20 nt, Artificial Sequence
  MKO10094906_B_Klf16
  gRNA
gaccggagaggugccccccg

SEQ ID NO: 94907 - RNA, 20 nt, Artificial Sequence
  MKO10094907_B_Klf16
  gRNA
ugugcgcgccacgcgccgcg

SEQ ID NO: 94908 - RNA, 20 nt, Artificial Sequence
  MKO10094908_B_Klf17
  gRNA
cggcauggagcaggacaaua

SEQ ID NO: 94909 - RNA, 20 nt, Artificial Sequence
  MKO10094909_B_Klf17
  gRNA
ggcuaugcaccagccuccca

SEQ ID NO: 94910 - RNA, 20 nt, Artificial Sequence
  MKO10094910_B_Klf17
  gRNA
ucacacucaucgcauuuaug

SEQ ID NO: 94911 - RNA, 20 nt, Artificial Sequence
  MKO10094911_B_Klf1
  gRNA
acgaacugacgcgccacuac

SEQ ID NO: 94912 - RNA, 20 nt, Artificial Sequence
  MKO10094912_B_Klf1
  gRNA
caucaguacacucaccaccc

SEQ ID NO: 94913 - RNA, 20 nt, Artificial Sequence
  MKO10094913_B_Klf1
  gRNA
ccaccuugaggaaguccucc

SEQ ID NO: 94914 - RNA, 20 nt, Artificial Sequence
  MKO10094914_B_Klf2
  gRNA
uucgccagcccgugcgagcg

SEQ ID NO: 94915 - RNA, 20 nt, Artificial Sequence
  MKO10094915_B_Klf2
  gRNA
agaagccuuaucauugcaac

SEQ ID NO: 94916 - RNA, 20 nt, Artificial Sequence
  MKO10094916_B_Klf2
  gRNA
gucgcacaaguggcacugaa

SEQ ID NO: 94917 - RNA, 20 nt, Artificial Sequence
  MKO10094917_B_Klf3
  gRNA
ccuuccgucaucgugcagcc

SEQ ID NO: 94918 - RNA, 20 nt, Artificial Sequence
  MKO10094918_B_Klf3
  gRNA
cuucccaggcugcacgauga

SEQ ID NO: 94919 - RNA, 20 nt, Artificial Sequence
  MKO10094919_B_Klf3
  gRNA
ggguaauagucaguccucug

SEQ ID NO: 94920 - RNA, 20 nt, Artificial Sequence
  MKO10094920_B_Klf4
  gRNA
cuagaggcccauuugagcgc

SEQ ID NO: 94921 - RNA, 20 nt, Artificial Sequence
  MKO10094921_B_Klf4
  gRNA
accgcaaacacacagggcac

SEQ ID NO: 94922 - RNA, 20 nt, Artificial Sequence
  MKO10094922_B_Klf4
  gRNA
ccuuaccugugugaguucgc

SEQ ID NO: 94923 - RNA, 20 nt, Artificial Sequence
  MKO10094923_B_Klf5
  gRNA
accuacccguaugaguccuc

SEQ ID NO: 94924 - RNA, 20 nt, Artificial Sequence
  MKO10094924_B_Klf5
  gRNA
uggguugugaaucgccaguu

SEQ ID NO: 94925 - RNA, 20 nt, Artificial Sequence
  MKO10094925_B_Klf5
  gRNA
gcuucaugugcagcgcgagg

SEQ ID NO: 94926 - RNA, 20 nt, Artificial Sequence
  MKO10094926_B_Klf6
  gRNA
acuucgaaccuucccaggug

SEQ ID NO: 94927 - RNA, 20 nt, Artificial Sequence
  MKO10094927_B_Klf6
  gRNA
agacacuuccgaaagcauac

SEQ ID NO: 94928 - RNA, 20 nt, Artificial Sequence
  MKO10094928_B_Klf6
  gRNA
uuaaaugcucccacugugac

SEQ ID NO: 94929 - RNA, 20 nt, Artificial Sequence
  MKO10094929_B_Klf7
  gRNA
gucguucuagguguuucucc

SEQ ID NO: 94930 - RNA, 20 nt, Artificial Sequence
  MKO10094930_B_Klf7
  gRNA
cuacaacuuguccacgacac

SEQ ID NO: 94931 - RNA, 20 nt, Artificial Sequence
  MKO10094931_B_Klf7
  gRNA
agucaccuuaccugucgcag

SEQ ID NO: 94932 - RNA, 20 nt, Artificial Sequence
  MKO10094932_B_Klf8
  gRNA
uuugcuuaggccagcgacaa

SEQ ID NO: 94933 - RNA, 20 nt, Artificial Sequence
  MKO10094933_B_Klf8
  gRNA
auguaaaaucggcuggccac

SEQ ID NO: 94934 - RNA, 20 nt, Artificial Sequence
  MKO10094934_B_Klf8
  gRNA
gcacucucaucacuaucacu

SEQ ID NO: 94935 - RNA, 20 nt, Artificial Sequence
  MKO10094935_B_Klf9
  gRNA
ccuuaaaaaguucucgcgcu

SEQ ID NO: 94936 - RNA, 20 nt, Artificial Sequence
  MKO10094936_B_Klf9
  gRNA
cacggcggcgcgguuggaga

SEQ ID NO: 94937 - RNA, 20 nt, Artificial Sequence
  MKO10094937_B_Klf9
  gRNA
agcgacgugaccaccgaauc

SEQ ID NO: 94938 - RNA, 20 nt, Artificial Sequence
  MKO10094938_B_Klhdc10
  gRNA
caaguuagaucucaacacca

SEQ ID NO: 94939 - RNA, 20 nt, Artificial Sequence
  MKO10094939_B_Klhdc10
  gRNA
ccucccgauucaucauaguc

SEQ ID NO: 94940 - RNA, 20 nt, Artificial Sequence
  MKO10094940_B_Klhdc10
  gRNA
ccacacaacgguguccacug

SEQ ID NO: 94941 - RNA, 20 nt, Artificial Sequence
  MKO10094941_B_Klhdc1
  gRNA
aguuuaucacgugguguggg

SEQ ID NO: 94942 - RNA, 20 nt, Artificial Sequence
  MKO10094942_B_Klhdc1
  gRNA
acgauauugauagugggcug

SEQ ID NO: 94943 - RNA, 20 nt, Artificial Sequence
  MKO10094943_B_Klhdc1
  gRNA
gucaauuuacgaacaagaga

SEQ ID NO: 94944 - RNA, 20 nt, Artificial Sequence
  MKO10094944_B_Klhdc2
  gRNA
ucauagaguaaucaagugag

SEQ ID NO: 94945 - RNA, 20 nt, Artificial Sequence
  MKO10094945_B_Klhdc2
  gRNA
guucccaauacuuuaucuuc

SEQ ID NO: 94946 - RNA, 20 nt, Artificial Sequence
  MKO10094946_B_Klhdc2
  gRNA
cuucugacaguucuacaugc

SEQ ID NO: 94947 - RNA, 20 nt, Artificial Sequence
  MKO10094947_B_Klhdc3
  gRNA
cgugugaggacagucgagcc

SEQ ID NO: 94948 - RNA, 20 nt, Artificial Sequence
  MKO10094948_B_Klhdc3
  gRNA
auccagcuuguggaugucgu

SEQ ID NO: 94949 - RNA, 20 nt, Artificial Sequence
  MKO10094949_B_Klhdc3
  gRNA
gaauguccgucccgugcccc

SEQ ID NO: 94950 - RNA, 20 nt, Artificial Sequence
  MKO10094950_B_Klhdc4
  gRNA
ugaaauauucaccuccgaaa

SEQ ID NO: 94951 - RNA, 20 nt, Artificial Sequence
  MKO10094951_B_Klhdc4
  gRNA
ucccaggcgcugugcucauc

SEQ ID NO: 94952 - RNA, 20 nt, Artificial Sequence
  MKO10094952_B_Klhdc4
  gRNA
aaugggcuaugagggccucc

SEQ ID NO: 94953 - RNA, 20 nt, Artificial Sequence
  MKO10094953_B_Klhdc7a
  gRNA
gcugcuccgauucucgaccc

SEQ ID NO: 94954 - RNA, 20 nt, Artificial Sequence
  MKO10094954_B_Klhdc7a
  gRNA
caaggaccgcacggccgaga

SEQ ID NO: 94955 - RNA, 20 nt, Artificial Sequence
  MKO10094955_B_Klhdc7a
  gRNA
gacgaagccgcuaacacagc

SEQ ID NO: 94956 - RNA, 20 nt, Artificial Sequence
  MKO10094956_B_Klhdc7b
  gRNA
augcgcuacaacacagugac

SEQ ID NO: 94957 - RNA, 20 nt, Artificial Sequence
  MKO10094957_B_Klhdc7b
  gRNA
uguugcccaauaccgugcag

SEQ ID NO: 94958 - RNA, 20 nt, Artificial Sequence
  MKO10094958_B_Klhdc7b
  gRNA
caccuuucccguggcccacg

SEQ ID NO: 94959 - RNA, 20 nt, Artificial Sequence
  MKO10094959_B_Klhdc8a
  gRNA
cuaccgcaucgcucaguccc

SEQ ID NO: 94960 - RNA, 20 nt, Artificial Sequence
  MKO10094960_B_Klhdc8a
  gRNA
aaggagguggcagcguaucu

SEQ ID NO: 94961 - RNA, 20 nt, Artificial Sequence
  MKO10094961_B_Klhdc8a
  gRNA
cacagcggggcgugggcaug

SEQ ID NO: 94962 - RNA, 20 nt, Artificial Sequence
  MKO10094962_B_Klhdc8b
  gRNA
agugcuuccaccgcuugacu

SEQ ID NO: 94963 - RNA, 20 nt, Artificial Sequence
  MKO10094963_B_Klhdc8b
  gRNA
gaagcacugugucuacggga

SEQ ID NO: 94964 - RNA, 20 nt, Artificial Sequence
  MKO10094964_B_Klhdc8b
  gRNA
ggccccacaauuucuacucc

SEQ ID NO: 94965 - RNA, 20 nt, Artificial Sequence
  MKO10094965_B_Klhdc9
  gRNA
ggacccuucgcuguacuauu

SEQ ID NO: 94966 - RNA, 20 nt, Artificial Sequence
  MKO10094966_B_Klhdc9
  gRNA
ugccacacaaccucacgauc

SEQ ID NO: 94967 - RNA, 20 nt, Artificial Sequence
  MKO10094967_B_Klhdc9
  gRNA
cacuuccccaguacagaccg

SEQ ID NO: 94968 - RNA, 20 nt, Artificial Sequence
  MKO10094968_B_Klhl10
  gRNA
uuuaacccucguagcaauuu

SEQ ID NO: 94969 - RNA, 20 nt, Artificial Sequence
  MKO10094969_B_Klhl10
  gRNA
uuauugaguaugcguacacu

SEQ ID NO: 94970 - RNA, 20 nt, Artificial Sequence
  MKO10094970_B_Klhl10
  gRNA
ccagacacagcuccgacuug

SEQ ID NO: 94971 - RNA, 20 nt, Artificial Sequence
  MKO10094971_B_Klhl11
  gRNA
ugucaaaccagagcggcuag

SEQ ID NO: 94972 - RNA, 20 nt, Artificial Sequence
  MKO10094972_B_Klhl11
  gRNA
gguguacauguacucgauaa

SEQ ID NO: 94973 - RNA, 20 nt, Artificial Sequence
  MKO10094973_B_Klhl11
  gRNA
agcauggagacugccgucgc

SEQ ID NO: 94974 - RNA, 20 nt, Artificial Sequence
  MKO10094974_B_Klhl12
  gRNA
aagccguauguugacauuca

SEQ ID NO: 94975 - RNA, 20 nt, Artificial Sequence
  MKO10094975_B_Klhl12
  gRNA
gcauccgaacauacuguaag

SEQ ID NO: 94976 - RNA, 20 nt, Artificial Sequence
  MKO10094976_B_Klhl12
  gRNA
cccagaacaagggcccggcu

SEQ ID NO: 94977 - RNA, 20 nt, Artificial Sequence
  MKO10094977_B_Klhl13
  gRNA
ugugaugugacacugaugcc

SEQ ID NO: 94978 - RNA, 20 nt, Artificial Sequence
  MKO10094978_B_Klhl13
  gRNA
cagcacuugaaacugugccu

SEQ ID NO: 94979 - RNA, 20 nt, Artificial Sequence
  MKO10094979_B_Klhl13
  gRNA
uuucagaucacuuguggaag

SEQ ID NO: 94980 - RNA, 20 nt, Artificial Sequence
  MKO10094980_B_Klhl14
  gRNA
guuggauccaacuauuaaau

SEQ ID NO: 94981 - RNA, 20 nt, Artificial Sequence
  MKO10094981_B_Klhl14
  gRNA
uuucuaccucuacaacgcag

SEQ ID NO: 94982 - RNA, 20 nt, Artificial Sequence
  MKO10094982_B_Klhl14
  gRNA
caguuucuaugcaugccgcu

SEQ ID NO: 94983 - RNA, 20 nt, Artificial Sequence
  MKO10094983_B_Klhl15
  gRNA
guggcacgaaguugucuagc

SEQ ID NO: 94984 - RNA, 20 nt, Artificial Sequence
  MKO10094984_B_Klhl15
  gRNA
acaacccagauaccgaucag

SEQ ID NO: 94985 - RNA, 20 nt, Artificial Sequence
  MKO10094985_B_Klhl15
  gRNA
cgcaaguagucaccaacugc

SEQ ID NO: 94986 - RNA, 20 nt, Artificial Sequence
  MKO10094986_B_Klhl17
  gRNA
ucaaacaugacguagacacu

SEQ ID NO: 94987 - RNA, 20 nt, Artificial Sequence
  MKO10094987_B_Klhl17
  gRNA
gccgagcucgcucugccucg

SEQ ID NO: 94988 - RNA, 20 nt, Artificial Sequence
  MKO10094988_B_Klhl17
  gRNA
uccaacugccugggcauucg

SEQ ID NO: 94989 - RNA, 20 nt, Artificial Sequence
  MKO10094989_B_Klhl18
  gRNA
ugucguucguaaacauagca

SEQ ID NO: 94990 - RNA, 20 nt, Artificial Sequence
  MKO10094990_B_Klhl18
  gRNA
cuuggaagacgugcuugagc

SEQ ID NO: 94991 - RNA, 20 nt, Artificial Sequence
  MKO10094991_B_Klhl18
  gRNA
gcacucgaucugauaagaac

SEQ ID NO: 94992 - RNA, 20 nt, Artificial Sequence
  MKO10094992_B_Klhl1
  gRNA
ugaagagcuccauaaacuac

SEQ ID NO: 94993 - RNA, 20 nt, Artificial Sequence
  MKO10094993_B_Klhl1
  gRNA
ugcccuuauuccuaaacagu

SEQ ID NO: 94994 - RNA, 20 nt, Artificial Sequence
  MKO10094994_B_Klhl1
  gRNA
aguuuauggagcucuucagc

SEQ ID NO: 94995 - RNA, 20 nt, Artificial Sequence
  MKO10094995_B_Klhl20
  gRNA
guaacaagccgcugcacccu

SEQ ID NO: 94996 - RNA, 20 nt, Artificial Sequence
  MKO10094996_B_Klhl20
  gRNA
cugggucaaauacaguauuc

SEQ ID NO: 94997 - RNA, 20 nt, Artificial Sequence
  MKO10094997_B_Klhl20
  gRNA
cugaauacuguauuugaccc

SEQ ID NO: 94998 - RNA, 20 nt, Artificial Sequence
  MKO10094998_B_Klhl21
  gRNA
acaaccccacuaaagacgaa

SEQ ID NO: 94999 - RNA, 20 nt, Artificial Sequence
  MKO10094999_B_Klhl21
  gRNA
uugacccacagguacacguu

SEQ ID NO: 95000 - RNA, 20 nt, Artificial Sequence
  MKO10095000_B_Klhl21
  gRNA
augaccaugccaccgacucc

SEQ ID NO: 95001 - RNA, 20 nt, Artificial Sequence
  MKO10095001_B_Klhl22
  gRNA
acgggccugugcgacgggcc

SEQ ID NO: 95002 - RNA, 20 nt, Artificial Sequence
  MKO10095002_B_Klhl22
  gRNA
uggcauuguaagacacaccg

SEQ ID NO: 95003 - RNA, 20 nt, Artificial Sequence
  MKO10095003_B_Klhl22
  gRNA
uggaaccagcgauugugccu

SEQ ID NO: 95004 - RNA, 20 nt, Artificial Sequence
  MKO10095004_B_Klhl23
  gRNA
ccuaucgcaaacaugauuaa

SEQ ID NO: 95005 - RNA, 20 nt, Artificial Sequence
  MKO10095005_B_Klhl23
  gRNA
acgauccagaucuuaauaag

SEQ ID NO: 95006 - RNA, 20 nt, Artificial Sequence
  MKO10095006_B_Klhl23
  gRNA
auuacugcgagcccacaccc

SEQ ID NO: 95007 - RNA, 20 nt, Artificial Sequence
  MKO10095007_B_Klhl24
  gRNA
uuccguccaacgauuugaaa

SEQ ID NO: 95008 - RNA, 20 nt, Artificial Sequence
  MKO10095008_B_Klhl24
  gRNA
uaggucuacuggcuauucag

SEQ ID NO: 95009 - RNA, 20 nt, Artificial Sequence
  MKO10095009_B_Klhl24
  gRNA
ccugcagugacaagcuguau

SEQ ID NO: 95010 - RNA, 20 nt, Artificial Sequence
  MKO10095010_B_Klhl25
  gRNA
ccuaugcugauugcccgcuu

SEQ ID NO: 95011 - RNA, 20 nt, Artificial Sequence
  MKO10095011_B_Klhl25
  gRNA
augagaacucguagagccgu

SEQ ID NO: 95012 - RNA, 20 nt, Artificial Sequence
  MKO10095012_B_Klhl25
  gRNA
uguccccaauccgcguccac

SEQ ID NO: 95013 - RNA, 20 nt, Artificial Sequence
  MKO10095013_B_Klhl26
  gRNA
ugaagccuuucaugcgcaca

SEQ ID NO: 95014 - RNA, 20 nt, Artificial Sequence
  MKO10095014_B_Klhl26
  gRNA
agagccccgagcgcccgagc

SEQ ID NO: 95015 - RNA, 20 nt, Artificial Sequence
  MKO10095015_B_Klhl26
  gRNA
guccuugcagcuuggccgac

SEQ ID NO: 95016 - RNA, 20 nt, Artificial Sequence
  MKO10095016_B_Klhl28
  gRNA
auggccccgcucacaugaac

SEQ ID NO: 95017 - RNA, 20 nt, Artificial Sequence
  MKO10095017_B_Klhl28
  gRNA
aaugaaaacugugcccguau

SEQ ID NO: 95018 - RNA, 20 nt, Artificial Sequence
  MKO10095018_B_Klhl28
  gRNA
cugggagaugguugcgccca

SEQ ID NO: 95019 - RNA, 20 nt, Artificial Sequence
  MKO10095019_B_Klhl29
  gRNA
caaugccaagacucuacucg

SEQ ID NO: 95020 - RNA, 20 nt, Artificial Sequence
  MKO10095020_B_Klhl29
  gRNA
ggccgccucgaguagagucu

SEQ ID NO: 95021 - RNA, 20 nt, Artificial Sequence
  MKO10095021_B_Klhl29
  gRNA
augcuuucgcucugcguugc

SEQ ID NO: 95022 - RNA, 20 nt, Artificial Sequence
  MKO10095022_B_Klhl2
  gRNA
cuucccacagcggguugaag

SEQ ID NO: 95023 - RNA, 20 nt, Artificial Sequence
  MKO10095023_B_Klhl2
  gRNA
gcauguuaaugaagagcgug

SEQ ID NO: 95024 - RNA, 20 nt, Artificial Sequence
  MKO10095024_B_Klhl2
  gRNA
accaaaggcuauccgaagug

SEQ ID NO: 95025 - RNA, 20 nt, Artificial Sequence
  MKO10095025_B_Klhl30
  gRNA
aagccccacuugugguaauc

SEQ ID NO: 95026 - RNA, 20 nt, Artificial Sequence
  MKO10095026_B_Klhl30
  gRNA
ccaggccuggguggucgacc

SEQ ID NO: 95027 - RNA, 20 nt, Artificial Sequence
  MKO10095027_B_Klhl30
  gRNA
aacagugauguuuacgucac

SEQ ID NO: 95028 - RNA, 20 nt, Artificial Sequence
  MKO10095028_B_Klhl31
  gRNA
auuauguucaaaccguaccg

SEQ ID NO: 95029 - RNA, 20 nt, Artificial Sequence
  MKO10095029_B_Klhl31
  gRNA
cgcacugccgauguagccgc

SEQ ID NO: 95030 - RNA, 20 nt, Artificial Sequence
  MKO10095030_B_Klhl31
  gRNA
gcccaaagcgccgcucgagg

SEQ ID NO: 95031 - RNA, 20 nt, Artificial Sequence
  MKO10095031_B_Klhl32
  gRNA
ggaguucgcauauacaggac

SEQ ID NO: 95032 - RNA, 20 nt, Artificial Sequence
  MKO10095032_B_Klhl32
  gRNA
ccucuuucaccucacuuugu

SEQ ID NO: 95033 - RNA, 20 nt, Artificial Sequence
  MKO10095033_B_Klhl32
  gRNA
ccgccugacgucccugagug

SEQ ID NO: 95034 - RNA, 20 nt, Artificial Sequence
  MKO10095034_B_Klhl33
  gRNA
caugggucugguacgaacug

SEQ ID NO: 95035 - RNA, 20 nt, Artificial Sequence
  MKO10095035_B_Klhl33
  gRNA
caccauugucucguccaccu

SEQ ID NO: 95036 - RNA, 20 nt, Artificial Sequence
  MKO10095036_B_Klhl33
  gRNA
gauggacagcuuuaugcccu

SEQ ID NO: 95037 - RNA, 20 nt, Artificial Sequence
  MKO10095037_B_Klhl34
  gRNA
gugcuguauuguacgccacc

SEQ ID NO: 95038 - RNA, 20 nt, Artificial Sequence
  MKO10095038_B_Klhl34
  gRNA
ugccgauucugaacuaccuc

SEQ ID NO: 95039 - RNA, 20 nt, Artificial Sequence
  MKO10095039_B_Klhl34
  gRNA
cgcuguaggccggccgcuga

SEQ ID NO: 95040 - RNA, 20 nt, Artificial Sequence
  MKO10095040_B_Klhl35
  gRNA
cgaaaugacauuuacguuuc

SEQ ID NO: 95041 - RNA, 20 nt, Artificial Sequence
  MKO10095041_B_Klhl35
  gRNA
acaucaacagccgugacguc

SEQ ID NO: 95042 - RNA, 20 nt, Artificial Sequence
  MKO10095042_B_Klhl35
  gRNA
cucaagacaccgcugcaaga

SEQ ID NO: 95043 - RNA, 20 nt, Artificial Sequence
  MKO10095043_B_Klhl36
  gRNA
cagcacaucgaagcgcucca

SEQ ID NO: 95044 - RNA, 20 nt, Artificial Sequence
  MKO10095044_B_Klhl36
  gRNA
guccaugaaccagcgccgug

SEQ ID NO: 95045 - RNA, 20 nt, Artificial Sequence
  MKO10095045_B_Klhl36
  gRNA
gucgguggccggaacgagaa

SEQ ID NO: 95046 - RNA, 20 nt, Artificial Sequence
  MKO10095046_B_Klhl38
  gRNA
aaagaccgaaggaugcacca

SEQ ID NO: 95047 - RNA, 20 nt, Artificial Sequence
  MKO10095047_B_Klhl38
  gRNA
ggggaacagaucgucauugu

SEQ ID NO: 95048 - RNA, 20 nt, Artificial Sequence
  MKO10095048_B_Klhl38
  gRNA
aucagguuuaccacauuucc

SEQ ID NO: 95049 - RNA, 20 nt, Artificial Sequence
  MKO10095049_B_Klhl3
  gRNA
aggucaugaaugagcugcga

SEQ ID NO: 95050 - RNA, 20 nt, Artificial Sequence
  MKO10095050_B_Klhl3
  gRNA
uccaggcugaccuccgcauc

SEQ ID NO: 95051 - RNA, 20 nt, Artificial Sequence
  MKO10095051_B_Klhl3
  gRNA
cuuggacgagaguugcagca

SEQ ID NO: 95052 - RNA, 20 nt, Artificial Sequence
  MKO10095052_B_Klhl40
  gRNA
ccguggccccaaagagcgau

SEQ ID NO: 95053 - RNA, 20 nt, Artificial Sequence
  MKO10095053_B_Klhl40
  gRNA
ggcucucaacgccaucuacg

SEQ ID NO: 95054 - RNA, 20 nt, Artificial Sequence
  MKO10095054_B_Klhl40
  gRNA
ugccaccaaugacauagacc

SEQ ID NO: 95055 - RNA, 20 nt, Artificial Sequence
  MKO10095055_B_Klhl41
  gRNA
aaaggcaagauugugaucgc

SEQ ID NO: 95056 - RNA, 20 nt, Artificial Sequence
  MKO10095056_B_Klhl41
  gRNA
cggcaaagaccuucaaacag

SEQ ID NO: 95057 - RNA, 20 nt, Artificial Sequence
  MKO10095057_B_Klhl41
  gRNA
cacaggaucguagcauagca

SEQ ID NO: 95058 - RNA, 20 nt, Artificial Sequence
  MKO10095058_B_Klhl42
  gRNA
acaaucccgagcaagaugcg

SEQ ID NO: 95059 - RNA, 20 nt, Artificial Sequence
  MKO10095059_B_Klhl42
  gRNA
aggucucaaacagcguccag

SEQ ID NO: 95060 - RNA, 20 nt, Artificial Sequence
  MKO10095060_B_Klhl42
  gRNA
gcagugcgcaugucaaguuc

SEQ ID NO: 95061 - RNA, 20 nt, Artificial Sequence
  MKO10095061_B_Klhl4
  gRNA
aggguauuuaccggugagcu

SEQ ID NO: 95062 - RNA, 20 nt, Artificial Sequence
  MKO10095062_B_Klhl4
  gRNA
cuccaaaugagcgaaucccu

SEQ ID NO: 95063 - RNA, 20 nt, Artificial Sequence
  MKO10095063_B_Klhl4
  gRNA
acugccauuacucucaccac

SEQ ID NO: 95064 - RNA, 20 nt, Artificial Sequence
  MKO10095064_B_Klhl5
  gRNA
cgguccuucgcggaugccca

SEQ ID NO: 95065 - RNA, 20 nt, Artificial Sequence
  MKO10095065_B_Klhl5
  gRNA
ugacaugaacaucccgaacg

SEQ ID NO: 95066 - RNA, 20 nt, Artificial Sequence
  MKO10095066_B_Klhl5
  gRNA
ccgcgaaggaccgaaucccc

SEQ ID NO: 95067 - RNA, 20 nt, Artificial Sequence
  MKO10095067_B_Klhl6
  gRNA
uccgugguacuucguggaga

SEQ ID NO: 95068 - RNA, 20 nt, Artificial Sequence
  MKO10095068_B_Klhl6
  gRNA
aacccgcugaacauucugcu

SEQ ID NO: 95069 - RNA, 20 nt, Artificial Sequence
  MKO10095069_B_Klhl6
  gRNA
gaggcauaagauggucguau

SEQ ID NO: 95070 - RNA, 20 nt, Artificial Sequence
  MKO10095070_B_Klhl7
  gRNA
ugggcgucaugaacaacaug

SEQ ID NO: 95071 - RNA, 20 nt, Artificial Sequence
  MKO10095071_B_Klhl7
  gRNA
caugaaccccgccagcagcu

SEQ ID NO: 95072 - RNA, 20 nt, Artificial Sequence
  MKO10095072_B_Klhl7
  gRNA
uggaauuugcuuauacugcu

SEQ ID NO: 95073 - RNA, 20 nt, Artificial Sequence
  MKO10095073_B_Klhl8
  gRNA
ccaugaugggaacgaacacc

SEQ ID NO: 95074 - RNA, 20 nt, Artificial Sequence
  MKO10095074_B_Klhl8
  gRNA
gaccagaaaugaacagccgc

SEQ ID NO: 95075 - RNA, 20 nt, Artificial Sequence
  MKO10095075_B_Klhl8
  gRNA
ucacacccacaugucgccug

SEQ ID NO: 95076 - RNA, 20 nt, Artificial Sequence
  MKO10095076_B_Klhl9
  gRNA
ugcauccacuuauuauaacg

SEQ ID NO: 95077 - RNA, 20 nt, Artificial Sequence
  MKO10095077_B_Klhl9
  gRNA
aaccgaacugugcguguugc

SEQ ID NO: 95078 - RNA, 20 nt, Artificial Sequence
  MKO10095078_B_Klhl9
  gRNA
gcgaauaguauucgcagcuu

SEQ ID NO: 95079 - RNA, 20 nt, Artificial Sequence
  MKO10095079_B_Klk10
  gRNA
ucguggggcauuuacccaug

SEQ ID NO: 95080 - RNA, 20 nt, Artificial Sequence
  MKO10095080_B_Klk10
  gRNA
ucgccaacucgagcucucag

SEQ ID NO: 95081 - RNA, 20 nt, Artificial Sequence
  MKO10095081_B_Klk10
  gRNA
auggguaaaugccccacgag

SEQ ID NO: 95082 - RNA, 20 nt, Artificial Sequence
  MKO10095082_B_Klk11
  gRNA
agccauuacgugauccuccu

SEQ ID NO: 95083 - RNA, 20 nt, Artificial Sequence
  MKO10095083_B_Klk11
  gRNA
gcacccacggcuugcggcag

SEQ ID NO: 95084 - RNA, 20 nt, Artificial Sequence
  MKO10095084_B_Klk11
  gRNA
uccccacacugugucgcugc

SEQ ID NO: 95085 - RNA, 20 nt, Artificial Sequence
  MKO10095085_B_Klk12
  gRNA
gggccacgggccggacagca

SEQ ID NO: 95086 - RNA, 20 nt, Artificial Sequence
  MKO10095086_B_Klk12
  gRNA
guguccuuguggaccgcaag

SEQ ID NO: 95087 - RNA, 20 nt, Artificial Sequence
  MKO10095087_B_Klk12
  gRNA
cucagguacguggugcgccu

SEQ ID NO: 95088 - RNA, 20 nt, Artificial Sequence
  MKO10095088_B_Klk13
  gRNA
aucugagcgcaguucaaugu

SEQ ID NO: 95089 - RNA, 20 nt, Artificial Sequence
  MKO10095089_B_Klk13
  gRNA
cauugaacugcgcucagaug

SEQ ID NO: 95090 - RNA, 20 nt, Artificial Sequence
  MKO10095090_B_Klk13
  gRNA
caggcagcucuacugauccg

SEQ ID NO: 95091 - RNA, 20 nt, Artificial Sequence
  MKO10095091_B_Klk14
  gRNA
gcaugccaucgagccuaccc

SEQ ID NO: 95092 - RNA, 20 nt, Artificial Sequence
  MKO10095092_B_Klk14
  gRNA
ccacacaggaagcgaugccc

SEQ ID NO: 95093 - RNA, 20 nt, Artificial Sequence
  MKO10095093_B_Klk14
  gRNA
uccagcugugguaauugcac

SEQ ID NO: 95094 - RNA, 20 nt, Artificial Sequence
  MKO10095094_B_Klk15
  gRNA
gcucuggaccaucgaacuug

SEQ ID NO: 95095 - RNA, 20 nt, Artificial Sequence
  MKO10095095_B_Klk15
  gRNA
ggaaagcgccacaauuaaac

SEQ ID NO: 95096 - RNA, 20 nt, Artificial Sequence
  MKO10095096_B_Klk15
  gRNA
gcggcagucaacacccagcg

SEQ ID NO: 95097 - RNA, 20 nt, Artificial Sequence
  MKO10095097_B_Klk1b11
  gRNA
uuacuuaccugacauggcag

SEQ ID NO: 95098 - RNA, 20 nt, Artificial Sequence
  MKO10095098_B_Klk1b11
  gRNA
cuggguuguggauuaugagg

SEQ ID NO: 95099 - RNA, 20 nt, Artificial Sequence
  MKO10095099_B_Klk1b11
  gRNA
gaguccuguuggaccguaac

SEQ ID NO: 95100 - RNA, 20 nt, Artificial Sequence
  MKO10095100_B_Klk1b16
  gRNA
caugcuguguacaauagaga

SEQ ID NO: 95101 - RNA, 20 nt, Artificial Sequence
  MKO10095101_B_Klk1b16
  gRNA
gauagcacaugucuaguguc

SEQ ID NO: 95102 - RNA, 20 nt, Artificial Sequence
  MKO10095102_B_Klk1b16
  gRNA
ccccgcaaauguguuccuug

SEQ ID NO: 95103 - RNA, 20 nt, Artificial Sequence
  MKO10095103_B_Klk1b1
  gRNA
cgcauauauauuccuuguag

SEQ ID NO: 95104 - RNA, 20 nt, Artificial Sequence
  MKO10095104_B_Klk1b1
  gRNA
ucauggggcuauaacccaug

SEQ ID NO: 95105 - RNA, 20 nt, Artificial Sequence
  MKO10095105_B_Klk1b1
  gRNA
agugugucacucagggguuu

SEQ ID NO: 95106 - RNA, 20 nt, Artificial Sequence
  MKO10095106_B_Klk1b21
  gRNA
gugggguguggucauucaug

SEQ ID NO: 95107 - RNA, 20 nt, Artificial Sequence
  MKO10095107_B_Klk1b21
  gRNA
gugagaagaauucucaaccc

SEQ ID NO: 95108 - RNA, 20 nt, Artificial Sequence
  MKO10095108_B_Klk1b21
  gRNA
uuacucacuugccauagcag

SEQ ID NO: 95109 - RNA, 20 nt, Artificial Sequence
  MKO10095109_B_Klk1b22
  gRNA
ugugaaagcccauauacuga

SEQ ID NO: 95110 - RNA, 20 nt, Artificial Sequence
  MKO10095110_B_Klk1b22
  gRNA
uacuuagaugaguaccuaug

SEQ ID NO: 95111 - RNA, 20 nt, Artificial Sequence
  MKO10095111_B_Klk1b22
  gRNA
ggugcauuggguucaccaca

SEQ ID NO: 95112 - RNA, 20 nt, Artificial Sequence
  MKO10095112_B_Klk1b24
  gRNA
uugcucuuguccuuagguug

SEQ ID NO: 95113 - RNA, 20 nt, Artificial Sequence
  MKO10095113_B_Klk1b24
  gRNA
gcuugaugaacacacacuga

SEQ ID NO: 95114 - RNA, 20 nt, Artificial Sequence
  MKO10095114_B_Klk1b24
  gRNA
aucugugacuuuauguaagu

SEQ ID NO: 95115 - RNA, 20 nt, Artificial Sequence
  MKO10095115_B_Klk1b26
  gRNA
ccccacaaauguguuccuuu

SEQ ID NO: 95116 - RNA, 20 nt, Artificial Sequence
  MKO10095116_B_Klk1b26
  gRNA
gguggcuguguacuaccaaa

SEQ ID NO: 95117 - RNA, 20 nt, Artificial Sequence
  MKO10095117_B_Klk1b26
  gRNA
ggccauuugaugugguuccu

SEQ ID NO: 95118 - RNA, 20 nt, Artificial Sequence
  MKO10095118_B_Klk1b27
  gRNA
aucugugacuuuauguacgu

SEQ ID NO: 95119 - RNA, 20 nt, Artificial Sequence
  MKO10095119_B_Klk1b27
  gRNA
uugcucuuguccucaggaug

SEQ ID NO: 95120 - RNA, 20 nt, Artificial Sequence
  MKO10095120_B_Klk1b27
  gRNA
acaccagccagcauaauguu

SEQ ID NO: 95121 - RNA, 20 nt, Artificial Sequence
  MKO10095121_B_Klk1b3
  gRNA
acucuagcaacuacaagguu

SEQ ID NO: 95122 - RNA, 20 nt, Artificial Sequence
  MKO10095122_B_Klk1b3
  gRNA
ucauggggccauaccccaug

SEQ ID NO: 95123 - RNA, 20 nt, Artificial Sequence
  MKO10095123_B_Klk1b3
  gRNA
cgauacacccaauauuuaug

SEQ ID NO: 95124 - RNA, 20 nt, Artificial Sequence
  MKO10095124_B_Klk1b4
  gRNA
auaaguuugguguagacacu

SEQ ID NO: 95125 - RNA, 20 nt, Artificial Sequence
  MKO10095125_B_Klk1b4
  gRNA
acugugagaauucccaaccc

SEQ ID NO: 95126 - RNA, 20 nt, Artificial Sequence
  MKO10095126_B_Klk1b4
  gRNA
ugguggcucauacacuugug

SEQ ID NO: 95127 - RNA, 20 nt, Artificial Sequence
  MKO10095127_B_Klk1b5
  gRNA
acagauguuauguugugugc

SEQ ID NO: 95128 - RNA, 20 nt, Artificial Sequence
  MKO10095128_B_Klk1b5
  gRNA
agaguuaaacuuaauaaguu

SEQ ID NO: 95129 - RNA, 20 nt, Artificial Sequence
  MKO10095129_B_Klk1b5
  gRNA
gcuuugacacaguccucauu

SEQ ID NO: 95130 - RNA, 20 nt, Artificial Sequence
  MKO10095130_B_Klk1b8
  gRNA
gaacccaguugcguuccaac

SEQ ID NO: 95131 - RNA, 20 nt, Artificial Sequence
  MKO10095131_B_Klk1b8
  gRNA
uauagaaaaccacaauguga

SEQ ID NO: 95132 - RNA, 20 nt, Artificial Sequence
  MKO10095132_B_Klk1b8
  gRNA
caucugucaccuucacauug

SEQ ID NO: 95133 - RNA, 20 nt, Artificial Sequence
  MKO10095133_B_Klk1b9
  gRNA
ucauggggcuuuaccccaug

SEQ ID NO: 95134 - RNA, 20 nt, Artificial Sequence
  MKO10095134_B_Klk1b9
  gRNA
guguccuguuggaugccaac

SEQ ID NO: 95135 - RNA, 20 nt, Artificial Sequence
  MKO10095135_B_Klk1b9
  gRNA
ugccauagugucuuugaucc

SEQ ID NO: 95136 - RNA, 20 nt, Artificial Sequence
  MKO10095136_B_Klk1
  gRNA
cacauugauauuuggugaag

SEQ ID NO: 95137 - RNA, 20 nt, Artificial Sequence
  MKO10095137_B_Klk1
  gRNA
agccauaguuucucuuaucc

SEQ ID NO: 95138 - RNA, 20 nt, Artificial Sequence
  MKO10095138_B_Klk1
  gRNA
acagaugacauguugugugc

SEQ ID NO: 95139 - RNA, 20 nt, Artificial Sequence
  MKO10095139_B_Klk4
  gRNA
gucagcagcacauugcuuac

SEQ ID NO: 95140 - RNA, 20 nt, Artificial Sequence
  MKO10095140_B_Klk4
  gRNA
gauccggcugcugacacuug

SEQ ID NO: 95141 - RNA, 20 nt, Artificial Sequence
  MKO10095141_B_Klk4
  gRNA
guuagugaacuugcagagau

SEQ ID NO: 95142 - RNA, 20 nt, Artificial Sequence
  MKO10095142_B_Klk5
  gRNA
ugcuugugacugugccaccg

SEQ ID NO: 95143 - RNA, 20 nt, Artificial Sequence
  MKO10095143_B_Klk5
  gRNA
agcagcucucgaauugugaa

SEQ ID NO: 95144 - RNA, 20 nt, Artificial Sequence
  MKO10095144_B_Klk5
  gRNA
cagaguguucagaauccguc

SEQ ID NO: 95145 - RNA, 20 nt, Artificial Sequence
  MKO10095145_B_Klk6
  gRNA
ccacgacaaugacaucauga

SEQ ID NO: 95146 - RNA, 20 nt, Artificial Sequence
  MKO10095146_B_Klk6
  gRNA
ggguccucauugacccacag

SEQ ID NO: 95147 - RNA, 20 nt, Artificial Sequence
  MKO10095147_B_Klk6
  gRNA
ccaucaugaugucauugucg

SEQ ID NO: 95148 - RNA, 20 nt, Artificial Sequence
  MKO10095148_B_Klk7
  gRNA
agggcucacauugcacgugu

SEQ ID NO: 95149 - RNA, 20 nt, Artificial Sequence
  MKO10095149_B_Klk7
  gRNA
guuccccauagggugacuca

SEQ ID NO: 95150 - RNA, 20 nt, Artificial Sequence
  MKO10095150_B_Klk7
  gRNA
guaaagaaggcucgcaccca

SEQ ID NO: 95151 - RNA, 20 nt, Artificial Sequence
  MKO10095151_B_Klk8
  gRNA
ggugugcgacgggaugcucc

SEQ ID NO: 95152 - RNA, 20 nt, Artificial Sequence
  MKO10095152_B_Klk8
  gRNA
cacagaucagucucucgccc

SEQ ID NO: 95153 - RNA, 20 nt, Artificial Sequence
  MKO10095153_B_Klk8
  gRNA
guauacacucucgaccuucc

SEQ ID NO: 95154 - RNA, 20 nt, Artificial Sequence
  MKO10095154_B_Klk9
  gRNA
cacuaacgucuuugacuacc

SEQ ID NO: 95155 - RNA, 20 nt, Artificial Sequence
  MKO10095155_B_Klk9
  gRNA
agguaccuguggguccgccu

SEQ ID NO: 95156 - RNA, 20 nt, Artificial Sequence
  MKO10095156_B_Klk9
  gRNA
ggguggccgaggcucuugcc

SEQ ID NO: 95157 - RNA, 20 nt, Artificial Sequence
  MKO10095157_B_Klkb1
  gRNA
ugcacaucuucugacaguac

SEQ ID NO: 95158 - RNA, 20 nt, Artificial Sequence
  MKO10095158_B_Klkb1
  gRNA
caaguccuuuguauaugucu

SEQ ID NO: 95159 - RNA, 20 nt, Artificial Sequence
  MKO10095159_B_Klkb1
  gRNA
aauuauuugugcacaguuuc

SEQ ID NO: 95160 - RNA, 20 nt, Artificial Sequence
  MKO10095160_B_Klra10
  gRNA
gucuuaugacaagaaaaaaa

SEQ ID NO: 95161 - RNA, 20 nt, Artificial Sequence
  MKO10095161_B_Klra10
  gRNA
cugcaacuauuaccagaaga

SEQ ID NO: 95162 - RNA, 20 nt, Artificial Sequence
  MKO10095162_B_Klra10
  gRNA
auaacugcagcaacaugcaa

SEQ ID NO: 95163 - RNA, 20 nt, Artificial Sequence
  MKO10095163_B_Klra12
  gRNA
caaguugaugucacuuugcg

SEQ ID NO: 95164 - RNA, 20 nt, Artificial Sequence
  MKO10095164_B_Klra12
  gRNA
ccuucugaagauagacgaug

SEQ ID NO: 95165 - RNA, 20 nt, Artificial Sequence
  MKO10095165_B_Klra12
  gRNA
agcuaucacaaugagcugca

SEQ ID NO: 95166 - RNA, 20 nt, Artificial Sequence
  MKO10095166_B_Klra15
  gRNA
cucuguuuacaucuacucca

SEQ ID NO: 95167 - RNA, 20 nt, Artificial Sequence
  MKO10095167_B_Klra15
  gRNA
gcagagguguuaaaguauac

SEQ ID NO: 95168 - RNA, 20 nt, Artificial Sequence
  MKO10095168_B_Klra15
  gRNA
cugaaacagcuaccagaaga

SEQ ID NO: 95169 - RNA, 20 nt, Artificial Sequence
  MKO10095169_B_Klra17
  gRNA
cucuauuguagguggaagcc

SEQ ID NO: 95170 - RNA, 20 nt, Artificial Sequence
  MKO10095170_B_Klra17
  gRNA
agcagaaccaguguauuucc

SEQ ID NO: 95171 - RNA, 20 nt, Artificial Sequence
  MKO10095171_B_Klra17
  gRNA
agcuaucacaaugagaugcc

SEQ ID NO: 95172 - RNA, 20 nt, Artificial Sequence
  MKO10095172_B_Klra18
  gRNA
gcagaacgagaugaggcuca

SEQ ID NO: 95173 - RNA, 20 nt, Artificial Sequence
  MKO10095173_B_Klra18
  gRNA
cugcaacaguuaccagucga

SEQ ID NO: 95174 - RNA, 20 nt, Artificial Sequence
  MKO10095174_B_Klra18
  gRNA
cucuguuuacaucuacucca

SEQ ID NO: 95175 - RNA, 20 nt, Artificial Sequence
  MKO10095175_B_Klra19
  gRNA
uuuaagaguguucaguaugc

SEQ ID NO: 95176 - RNA, 20 nt, Artificial Sequence
  MKO10095176_B_Klra19
  gRNA
uagggacagguguuaaauac

SEQ ID NO: 95177 - RNA, 20 nt, Artificial Sequence
  MKO10095177_B_Klra19
  gRNA
cugcaacuguuauaagaaga

SEQ ID NO: 95178 - RNA, 20 nt, Artificial Sequence
  MKO10095178_B_Klra1
  gRNA
ccuucagacaguugcugggu

SEQ ID NO: 95179 - RNA, 20 nt, Artificial Sequence
  MKO10095179_B_Klra1
  gRNA
ccaacccagcaacugucuga

SEQ ID NO: 95180 - RNA, 20 nt, Artificial Sequence
  MKO10095180_B_Klra1
  gRNA
cugaaacagcuaccagaaga

SEQ ID NO: 95181 - RNA, 20 nt, Artificial Sequence
  MKO10095181_B_Klra21
  gRNA
uauucccaagaugagugagc

SEQ ID NO: 95182 - RNA, 20 nt, Artificial Sequence
  MKO10095182_B_Klra21
  gRNA
gaguccccucaagucucacc

SEQ ID NO: 95183 - RNA, 20 nt, Artificial Sequence
  MKO10095183_B_Klra21
  gRNA
uuuaaguguguucagucccu

SEQ ID NO: 95184 - RNA, 20 nt, Artificial Sequence
  MKO10095184_B_Klra22
  gRNA
cucuguuuacaucuacucca

SEQ ID NO: 95185 - RNA, 20 nt, Artificial Sequence
  MKO10095185_B_Klra22
  gRNA
gcagagguguuaaaguauac

SEQ ID NO: 95186 - RNA, 20 nt, Artificial Sequence
  MKO10095186_B_Klra22
  gRNA
cugaaacagcuaccagaaga

SEQ ID NO: 95187 - RNA, 20 nt, Artificial Sequence
  MKO10095187_B_Klra23
  gRNA
gauuccagaagaucagugcc

SEQ ID NO: 95188 - RNA, 20 nt, Artificial Sequence
  MKO10095188_B_Klra23
  gRNA
caaguugaugucacuuugcg

SEQ ID NO: 95189 - RNA, 20 nt, Artificial Sequence
  MKO10095189_B_Klra23
  gRNA
cugucuccucaagccucacc

SEQ ID NO: 95190 - RNA, 20 nt, Artificial Sequence
  MKO10095190_B_Klra2
  gRNA
aaagaguuaaguuguaagcc

SEQ ID NO: 95191 - RNA, 20 nt, Artificial Sequence
  MKO10095191_B_Klra2
  gRNA
accucuguggcccacaucuc

SEQ ID NO: 95192 - RNA, 20 nt, Artificial Sequence
  MKO10095192_B_Klra2
  gRNA
aacuaucacaaugaacuucc

SEQ ID NO: 95193 - RNA, 20 nt, Artificial Sequence
  MKO10095193_B_Klra33
  gRNA
cucuguuuacaucuacucca

SEQ ID NO: 95194 - RNA, 20 nt, Artificial Sequence
  MKO10095194_B_Klra33
  gRNA
gcagagguguuaaaguauac

SEQ ID NO: 95195 - RNA, 20 nt, Artificial Sequence
  MKO10095195_B_Klra33
  gRNA
uuuaaguguguucaguuccc

SEQ ID NO: 95196 - RNA, 20 nt, Artificial Sequence
  MKO10095196_B_Klra3
  gRNA
aauccaauccaguaauucuc

SEQ ID NO: 95197 - RNA, 20 nt, Artificial Sequence
  MKO10095197_B_Klra3
  gRNA
ucaucaugaacaaaacgaca

SEQ ID NO: 95198 - RNA, 20 nt, Artificial Sequence
  MKO10095198_B_Klra3
  gRNA
cugcaacuguuacaagaaga

SEQ ID NO: 95199 - RNA, 20 nt, Artificial Sequence
  MKO10095199_B_Klra4
  gRNA
cucuguuuacaucuacucca

SEQ ID NO: 95200 - RNA, 20 nt, Artificial Sequence
  MKO10095200_B_Klra4
  gRNA
gcagagguguuaaaguauac

SEQ ID NO: 95201 - RNA, 20 nt, Artificial Sequence
  MKO10095201_B_Klra4
  gRNA
uuuaaguguguucaguuccc

SEQ ID NO: 95202 - RNA, 20 nt, Artificial Sequence
  MKO10095202_B_Klra5
  gRNA
uagggacagguguuaaacac

SEQ ID NO: 95203 - RNA, 20 nt, Artificial Sequence
  MKO10095203_B_Klra5
  gRNA
cugcaacuguuacuagaaga

SEQ ID NO: 95204 - RNA, 20 nt, Artificial Sequence
  MKO10095204_B_Klra5
  gRNA
acagaaauuccuucaguucc

SEQ ID NO: 95205 - RNA, 20 nt, Artificial Sequence
  MKO10095205_B_Klra6
  gRNA
uuagaguuucauggauuucu

SEQ ID NO: 95206 - RNA, 20 nt, Artificial Sequence
  MKO10095206_B_Klra6
  gRNA
uuuaagaguguucaguaugc

SEQ ID NO: 95207 - RNA, 20 nt, Artificial Sequence
  MKO10095207_B_Klra6
  gRNA
uagggacagguguuaaauac

SEQ ID NO: 95208 - RNA, 20 nt, Artificial Sequence
  MKO10095208_B_Klra7
  gRNA
cccagagaagcuugcuacag

SEQ ID NO: 95209 - RNA, 20 nt, Artificial Sequence
  MKO10095209_B_Klra7
  gRNA
aagcucauugugauagcuug

SEQ ID NO: 95210 - RNA, 20 nt, Artificial Sequence
  MKO10095210_B_Klra7
  gRNA
gcagaaacuagugaggacug

SEQ ID NO: 95211 - RNA, 20 nt, Artificial Sequence
  MKO10095211_B_Klra8
  gRNA
auguuauucuagagaguuac

SEQ ID NO: 95212 - RNA, 20 nt, Artificial Sequence
  MKO10095212_B_Klra8
  gRNA
uauuccagaaguucauagcu

SEQ ID NO: 95213 - RNA, 20 nt, Artificial Sequence
  MKO10095213_B_Klra8
  gRNA
uuuaaguguguucagucccu

SEQ ID NO: 95214 - RNA, 20 nt, Artificial Sequence
  MKO10095214_B_Klra9
  gRNA
ggauuacaucaaaagagaac

SEQ ID NO: 95215 - RNA, 20 nt, Artificial Sequence
  MKO10095215_B_Klra9
  gRNA
cugcaacuauuaccagaaga

SEQ ID NO: 95216 - RNA, 20 nt, Artificial Sequence
  MKO10095216_B_Klra9
  gRNA
uucaucuucuaucuucacaa

SEQ ID NO: 95217 - RNA, 20 nt, Artificial Sequence
  MKO10095217_B_Klrb1a
  gRNA
uugauuguagagauuccuac

SEQ ID NO: 95218 - RNA, 20 nt, Artificial Sequence
  MKO10095218_B_Klrb1a
  gRNA
acacauugccagacaugaac

SEQ ID NO: 95219 - RNA, 20 nt, Artificial Sequence
  MKO10095219_B_Klrb1a
  gRNA
gacaucuuaccaguucuucu

SEQ ID NO: 95220 - RNA, 20 nt, Artificial Sequence
  MKO10095220_B_Klrb1b
  gRNA
ucgacauuccuuccaagugu

SEQ ID NO: 95221 - RNA, 20 nt, Artificial Sequence
  MKO10095221_B_Klrb1b
  gRNA
cgaauugauugugauaaaaa

SEQ ID NO: 95222 - RNA, 20 nt, Artificial Sequence
  MKO10095222_B_Klrb1b
  gRNA
gagaacagaacacauacaac

SEQ ID NO: 95223 - RNA, 20 nt, Artificial Sequence
  MKO10095223_B_Klrb1c
  gRNA
gaggaaggucaagcugacug

SEQ ID NO: 95224 - RNA, 20 nt, Artificial Sequence
  MKO10095224_B_Klrb1c
  gRNA
cuaagacacucaucccaauc

SEQ ID NO: 95225 - RNA, 20 nt, Artificial Sequence
  MKO10095225_B_Klrb1c
  gRNA
cuccuuguccugacccugau

SEQ ID NO: 95226 - RNA, 20 nt, Artificial Sequence
  MKO10095226_B_Klrb1f
  gRNA
auuugugcagaacuugauaa

SEQ ID NO: 95227 - RNA, 20 nt, Artificial Sequence
  MKO10095227_B_Klrb1f
  gRNA
cuucuucucuugagccugau

SEQ ID NO: 95228 - RNA, 20 nt, Artificial Sequence
  MKO10095228_B_Klrb1f
  gRNA
gagaacaggacugaacuaac

SEQ ID NO: 95229 - RNA, 20 nt, Artificial Sequence
  MKO10095229_B_Klrb1
  gRNA
auuauugcagaacuucucaa

SEQ ID NO: 95230 - RNA, 20 nt, Artificial Sequence
  MKO10095230_B_Klrb1
  gRNA
gaaaacaggacugaaccaac

SEQ ID NO: 95231 - RNA, 20 nt, Artificial Sequence
  MKO10095231_B_Klrb1
  gRNA
gcucuucuuagaugccuguc

SEQ ID NO: 95232 - RNA, 20 nt, Artificial Sequence
  MKO10095232_B_Klrc1
  gRNA
ccuccagagaaacucauugc

SEQ ID NO: 95233 - RNA, 20 nt, Artificial Sequence
  MKO10095233_B_Klrc1
  gRNA
aaucucuuucacugaucuca

SEQ ID NO: 95234 - RNA, 20 nt, Artificial Sequence
  MKO10095234_B_Klrc1
  gRNA
gcuuuacauagauagugaag

SEQ ID NO: 95235 - RNA, 20 nt, Artificial Sequence
  MKO10095235_B_Klrc2
  gRNA
ccugaccucugcccuuccga

SEQ ID NO: 95236 - RNA, 20 nt, Artificial Sequence
  MKO10095236_B_Klrc2
  gRNA
agagucaugagucaccugcu

SEQ ID NO: 95237 - RNA, 20 nt, Artificial Sequence
  MKO10095237_B_Klrc2
  gRNA
ccuccagagaagcucaucgc

SEQ ID NO: 95238 - RNA, 20 nt, Artificial Sequence
  MKO10095238_B_Klrc3
  gRNA
cuuucugcaaucccuuucac

SEQ ID NO: 95239 - RNA, 20 nt, Artificial Sequence
  MKO10095239_B_Klrc3
  gRNA
ccuccagagaagcucaucgc

SEQ ID NO: 95240 - RNA, 20 nt, Artificial Sequence
  MKO10095240_B_Klrc3
  gRNA
cuuacauggagaaacaauuc

SEQ ID NO: 95241 - RNA, 20 nt, Artificial Sequence
  MKO10095241_B_Klrd1
  gRNA
aaccaccacuguagaauucc

SEQ ID NO: 95242 - RNA, 20 nt, Artificial Sequence
  MKO10095242_B_Klrd1
  gRNA
uuauaguuucuaggaucacu

SEQ ID NO: 95243 - RNA, 20 nt, Artificial Sequence
  MKO10095243_B_Klrd1
  gRNA
augcauuccaauccagaaaa

SEQ ID NO: 95244 - RNA, 20 nt, Artificial Sequence
  MKO10095244_B_Klre1
  gRNA
cucacacuuugugguaaaag

SEQ ID NO: 95245 - RNA, 20 nt, Artificial Sequence
  MKO10095245_B_Klre1
  gRNA
ucuucuacuauucagcaaga

SEQ ID NO: 95246 - RNA, 20 nt, Artificial Sequence
  MKO10095246_B_Klre1
  gRNA
cucuuaacuccagucucaua

SEQ ID NO: 95247 - RNA, 20 nt, Artificial Sequence
  MKO10095247_B_Klrg1
  gRNA
uuaccaacagcuugauacag

SEQ ID NO: 95248 - RNA, 20 nt, Artificial Sequence
  MKO10095248_B_Klrg1
  gRNA
gaagcuguuuggagaguacc

SEQ ID NO: 95249 - RNA, 20 nt, Artificial Sequence
  MKO10095249_B_Klrg1
  gRNA
gcaccucuguaucaagcugu

SEQ ID NO: 95250 - RNA, 20 nt, Artificial Sequence
  MKO10095250_B_Klrg2
  gRNA
uuuggaagaaggcaggcucg

SEQ ID NO: 95251 - RNA, 20 nt, Artificial Sequence
  MKO10095251_B_Klrg2
  gRNA
agcuagcauaccuccucuag

SEQ ID NO: 95252 - RNA, 20 nt, Artificial Sequence
  MKO10095252_B_Klrg2
  gRNA
acugcaguucuccuagaccc

SEQ ID NO: 95253 - RNA, 20 nt, Artificial Sequence
  MKO10095253_B_Klri1
  gRNA
uggguggauucuucacaaaa

SEQ ID NO: 95254 - RNA, 20 nt, Artificial Sequence
  MKO10095254_B_Klri1
  gRNA
gaaccaacaguuccugguug

SEQ ID NO: 95255 - RNA, 20 nt, Artificial Sequence
  MKO10095255_B_Klri1
  gRNA
guggugcugaugacaaccac

SEQ ID NO: 95256 - RNA, 20 nt, Artificial Sequence
  MKO10095256_B_Klri2
  gRNA
ccaucauuccugucacauag

SEQ ID NO: 95257 - RNA, 20 nt, Artificial Sequence
  MKO10095257_B_Klri2
  gRNA
cgcagacugacucucuaccc

SEQ ID NO: 95258 - RNA, 20 nt, Artificial Sequence
  MKO10095258_B_Klri2
  gRNA
agagagucagucugcgugug

SEQ ID NO: 95259 - RNA, 20 nt, Artificial Sequence
  MKO10095259_B_Klrk1
  gRNA
uucaaagagacguuucagcc

SEQ ID NO: 95260 - RNA, 20 nt, Artificial Sequence
  MKO10095260_B_Klrk1
  gRNA
cuugacaguauugugcaaca

SEQ ID NO: 95261 - RNA, 20 nt, Artificial Sequence
  MKO10095261_B_Klrk1
  gRNA
cacuuaccucuugaggaaac

SEQ ID NO: 95262 - RNA, 20 nt, Artificial Sequence
  MKO10095262_B_Kl
  gRNA
uaacaugaaguuccgccaau

SEQ ID NO: 95263 - RNA, 20 nt, Artificial Sequence
  MKO10095263_B_Kl
  gRNA
gacccgcauuucucgaagua

SEQ ID NO: 95264 - RNA, 20 nt, Artificial Sequence
  MKO10095264_B_Kl
  gRNA
uacacugugugcaccgaaug

SEQ ID NO: 95265 - RNA, 20 nt, Artificial Sequence
  MKO10095265_B_Kmo
  gRNA
acuucuuucccgaaagagag

SEQ ID NO: 95266 - RNA, 20 nt, Artificial Sequence
  MKO10095266_B_Kmo
  gRNA
ggcuuucaugggcacaccuu

SEQ ID NO: 95267 - RNA, 20 nt, Artificial Sequence
  MKO10095267_B_Kmo
  gRNA
auuccucuuugcaagaaagc

SEQ ID NO: 95268 - RNA, 20 nt, Artificial Sequence
  MKO10095268_B_Kmt2a
  gRNA
acacagcucguuugcggcca

SEQ ID NO: 95269 - RNA, 20 nt, Artificial Sequence
  MKO10095269_B_Kmt2a
  gRNA
aggcggugcggacaaugucc

SEQ ID NO: 95270 - RNA, 20 nt, Artificial Sequence
  MKO10095270_B_Kmt2a
  gRNA
ccaccuugagugccuuaccg

SEQ ID NO: 95271 - RNA, 20 nt, Artificial Sequence
  MKO10095271_B_Kmt2b
  gRNA
cugaggcgggguacaucuuc

SEQ ID NO: 95272 - RNA, 20 nt, Artificial Sequence
  MKO10095272_B_Kmt2b
  gRNA
aagcccugcaguacaaaccg

SEQ ID NO: 95273 - RNA, 20 nt, Artificial Sequence
  MKO10095273_B_Kmt2b
  gRNA
agcuaagagagaucgagccu

SEQ ID NO: 95274 - RNA, 20 nt, Artificial Sequence
  MKO10095274_B_Kmt2c
  gRNA
uuggcguagaagccaaaauc

SEQ ID NO: 95275 - RNA, 20 nt, Artificial Sequence
  MKO10095275_B_Kmt2c
  gRNA
uuccaagguaagguaagucc

SEQ ID NO: 95276 - RNA, 20 nt, Artificial Sequence
  MKO10095276_B_Kmt2c
  gRNA
cauggauggacuggagacga

SEQ ID NO: 95277 - RNA, 20 nt, Artificial Sequence
  MKO10095277_B_Kmt2d
  gRNA
cagagagcacaacgccgugc

SEQ ID NO: 95278 - RNA, 20 nt, Artificial Sequence
  MKO10095278_B_Kmt2d
  gRNA
cacaucauuggugugcagcg

SEQ ID NO: 95279 - RNA, 20 nt, Artificial Sequence
  MKO10095279_B_Kmt2d
  gRNA
uguccaucccucucuccgac

SEQ ID NO: 95280 - RNA, 20 nt, Artificial Sequence
  MKO10095280_B_Kmt2e
  gRNA
uaugugaacguugucagccc

SEQ ID NO: 95281 - RNA, 20 nt, Artificial Sequence
  MKO10095281_B_Kmt2e
  gRNA
auccguagaagcuagcccug

SEQ ID NO: 95282 - RNA, 20 nt, Artificial Sequence
  MKO10095282_B_Kmt2e
  gRNA
uuggauuucucaacuaccac

SEQ ID NO: 95283 - RNA, 20 nt, Artificial Sequence
  MKO10095283_B_Kncn
  gRNA
cugaguuaggauggauucuc

SEQ ID NO: 95284 - RNA, 20 nt, Artificial Sequence
  MKO10095284_B_Kncn
  gRNA
cugagaauccauccuaacuc

SEQ ID NO: 95285 - RNA, 20 nt, Artificial Sequence
  MKO10095285_B_Kncn
  gRNA
ucucuuccaggagcccgcag

SEQ ID NO: 95286 - RNA, 20 nt, Artificial Sequence
  MKO10095286_B_Kndc1
  gRNA
cuuacccuggaaugcuccga

SEQ ID NO: 95287 - RNA, 20 nt, Artificial Sequence
  MKO10095287_B_Kndc1
  gRNA
caugaagcacacguuuccac

SEQ ID NO: 95288 - RNA, 20 nt, Artificial Sequence
  MKO10095288_B_Kndc1
  gRNA
ugccgcagucucucagccau

SEQ ID NO: 95289 - RNA, 20 nt, Artificial Sequence
  MKO10095289_B_Kng1
  gRNA
agucacaguccugccaugcg

SEQ ID NO: 95290 - RNA, 20 nt, Artificial Sequence
  MKO10095290_B_Kng1
  gRNA
aucgacagauaguccagacc

SEQ ID NO: 95291 - RNA, 20 nt, Artificial Sequence
  MKO10095291_B_Kng1
  gRNA
cuccuugauuagauacuuga

SEQ ID NO: 95292 - RNA, 20 nt, Artificial Sequence
  MKO10095292_B_Kng2
  gRNA
cagaccugcaagauuacucc

SEQ ID NO: 95293 - RNA, 20 nt, Artificial Sequence
  MKO10095293_B_Kng2
  gRNA
gugguacuccucugucacua

SEQ ID NO: 95294 - RNA, 20 nt, Artificial Sequence
  MKO10095294_B_Kng2
  gRNA
cccaccuggaguaaucuugc

SEQ ID NO: 95295 - RNA, 20 nt, Artificial Sequence
  MKO10095295_B_Knop1
  gRNA
uuauagacgcuucuccuccg

SEQ ID NO: 95296 - RNA, 20 nt, Artificial Sequence
  MKO10095296_B_Knop1
  gRNA
agaagagauugaucgugagu

SEQ ID NO: 95297 - RNA, 20 nt, Artificial Sequence
  MKO10095297_B_Knop1
  gRNA
ggguuugucggucaagacag

SEQ ID NO: 95298 - RNA, 20 nt, Artificial Sequence
  MKO10095298_B_Knstrn
  gRNA
ucguagccggguggcuuggc

SEQ ID NO: 95299 - RNA, 20 nt, Artificial Sequence
  MKO10095299_B_Knstrn
  gRNA
accguuuaauaagcaaaaac

SEQ ID NO: 95300 - RNA, 20 nt, Artificial Sequence
  MKO10095300_B_Knstrn
  gRNA
cuuccauaggcaggugaaag

SEQ ID NO: 95301 - RNA, 20 nt, Artificial Sequence
  MKO10095301_B_Knuc1
  gRNA
auguugcuucuaacgaacaa

SEQ ID NO: 95302 - RNA, 20 nt, Artificial Sequence
  MKO10095302_B_Knuc1
  gRNA
cugcaacgauuauaaaccca

SEQ ID NO: 95303 - RNA, 20 nt, Artificial Sequence
  MKO10095303_B_Knuc1
  gRNA
gaagcaaacgcuguucacca

SEQ ID NO: 95304 - RNA, 20 nt, Artificial Sequence
  MKO10095304_B_Kpna1
  gRNA
cuaagcaacucgaugaaaau

SEQ ID NO: 95305 - RNA, 20 nt, Artificial Sequence
  MKO10095305_B_Kpna1
  gRNA
ccaucuccauguuauuuauc

SEQ ID NO: 95306 - RNA, 20 nt, Artificial Sequence
  MKO10095306_B_Kpna1
  gRNA
uaucauaucagucaugucag

SEQ ID NO: 95307 - RNA, 20 nt, Artificial Sequence
  MKO10095307_B_Kpna2
  gRNA
ccgccgaauagaaguuaaug

SEQ ID NO: 95308 - RNA, 20 nt, Artificial Sequence
  MKO10095308_B_Kpna2
  gRNA
ucuguugaggacauuguuaa

SEQ ID NO: 95309 - RNA, 20 nt, Artificial Sequence
  MKO10095309_B_Kpna2
  gRNA
cuccuauagacaacaucauc

SEQ ID NO: 95310 - RNA, 20 nt, Artificial Sequence
  MKO10095310_B_Kpna3
  gRNA
aacacuagaagcuauauuac

SEQ ID NO: 95311 - RNA, 20 nt, Artificial Sequence
  MKO10095311_B_Kpna3
  gRNA
aaucuucuaagcuuucuucu

SEQ ID NO: 95312 - RNA, 20 nt, Artificial Sequence
  MKO10095312_B_Kpna4
  gRNA
cugcacuuaauugaauuccu

SEQ ID NO: 95313 - RNA, 20 nt, Artificial Sequence
  MKO10095313_B_Kpna4
  gRNA
uugaacaauagcuucuagag

SEQ ID NO: 95314 - RNA, 20 nt, Artificial Sequence
  MKO10095314_B_Kpna4
  gRNA
augaaguuguaguugaauua

SEQ ID NO: 95315 - RNA, 20 nt, Artificial Sequence
  MKO10095315_B_Kpna6
  gRNA
gaacaaugccuuaaacccug

SEQ ID NO: 95316 - RNA, 20 nt, Artificial Sequence
  MKO10095316_B_Kpna6
  gRNA
uagcaaccacgcagaaauuc

SEQ ID NO: 95317 - RNA, 20 nt, Artificial Sequence
  MKO10095317_B_Kpna6
  gRNA
auucgauaauuguccuuccc

SEQ ID NO: 95318 - RNA, 20 nt, Artificial Sequence
  MKO10095318_B_Kpna7
  gRNA
gaagcaauccucuguugucg

SEQ ID NO: 95319 - RNA, 20 nt, Artificial Sequence
  MKO10095319_B_Kpna7
  gRNA
cacugugguaccuggcagcc

SEQ ID NO: 95320 - RNA, 20 nt, Artificial Sequence
  MKO10095320_B_Kpna7
  gRNA
cgaucuguucuccagugaca

SEQ ID NO: 95321 - RNA, 20 nt, Artificial Sequence
  MKO10095321_B_Kpnb1
  gRNA
guaaccaauagcuuccaaug

SEQ ID NO: 95322 - RNA, 20 nt, Artificial Sequence
  MKO10095322_B_Kpnb1
  gRNA
gccuaguaacaaugugaagc

SEQ ID NO: 95323 - RNA, 20 nt, Artificial Sequence
  MKO10095323_B_Kpnb1
  gRNA
ggcacgcaccagauucucca

SEQ ID NO: 95324 - RNA, 20 nt, Artificial Sequence
  MKO10095324_B_Kprp
  gRNA
ccuucgguauccaggcgaca

SEQ ID NO: 95325 - RNA, 20 nt, Artificial Sequence
  MKO10095325_B_Kprp
  gRNA
cuguggacgaggauacggac

SEQ ID NO: 95326 - RNA, 20 nt, Artificial Sequence
  MKO10095326_B_Kprp
  gRNA
cguggauauggacguggugc

SEQ ID NO: 95327 - RNA, 20 nt, Artificial Sequence
  MKO10095327_B_Kptn
  gRNA
acucaccugcaauagagucc

SEQ ID NO: 95328 - RNA, 20 nt, Artificial Sequence
  MKO10095328_B_Kptn
  gRNA
uccuuguagagaugaauagc

SEQ ID NO: 95329 - RNA, 20 nt, Artificial Sequence
  MKO10095329_B_Kptn
  gRNA
uacaaccuggacucuauugc

SEQ ID NO: 95330 - RNA, 20 nt, Artificial Sequence
  MKO10095330_B_Kras
  gRNA
aaucacacuuauucccuacc

SEQ ID NO: 95331 - RNA, 20 nt, Artificial Sequence
  MKO10095331_B_Kras
  gRNA
ccuccccaguucucauguac

SEQ ID NO: 95332 - RNA, 20 nt, Artificial Sequence
  MKO10095332_B_Kras
  gRNA
ucucgacacagcaggucaag

SEQ ID NO: 95333 - RNA, 20 nt, Artificial Sequence
  MKO10095333_B_Krba1
  gRNA
uaagggacaaaaaccccauu

SEQ ID NO: 95334 - RNA, 20 nt, Artificial Sequence
  MKO10095334_B_Krba1
  gRNA
ccugggaacuaugcuccaaa

SEQ ID NO: 95335 - RNA, 20 nt, Artificial Sequence
  MKO10095335_B_Krba1
  gRNA
ucuccggaagagaauugagc

SEQ ID NO: 95336 - RNA, 20 nt, Artificial Sequence
  MKO10095336_B_Krcc1
  gRNA
cuuugggaccagucuauucu

SEQ ID NO: 95337 - RNA, 20 nt, Artificial Sequence
  MKO10095337_B_Krcc1
  gRNA
ugugaacuacugcaugaucu

SEQ ID NO: 95338 - RNA, 20 nt, Artificial Sequence
  MKO10095338_B_Krcc1
  gRNA
agucuuaucuugucaugagc

SEQ ID NO: 95339 - RNA, 20 nt, Artificial Sequence
  MKO10095339_B_Kremen1
  gRNA
ucagcguguuguacggaugc

SEQ ID NO: 95340 - RNA, 20 nt, Artificial Sequence
  MKO10095340_B_Kremen1
  gRNA
agcaugaggacggagucuac

SEQ ID NO: 95341 - RNA, 20 nt, Artificial Sequence
  MKO10095341_B_Kremen1
  gRNA
gaccacacgcagcccugcgg

SEQ ID NO: 95342 - RNA, 20 nt, Artificial Sequence
  MKO10095342_B_Kremen2
  gRNA
ggacgacuaggcaucuauga

SEQ ID NO: 95343 - RNA, 20 nt, Artificial Sequence
  MKO10095343_B_Kremen2
  gRNA
ugugcagcccuggugcuacg

SEQ ID NO: 95344 - RNA, 20 nt, Artificial Sequence
  MKO10095344_B_Kremen2
  gRNA
ugucucugccacguagcacc

SEQ ID NO: 95345 - RNA, 20 nt, Artificial Sequence
  MKO10095345_B_Kri1
  gRNA
aggagccgccagcagccuug

SEQ ID NO: 95346 - RNA, 20 nt, Artificial Sequence
  MKO10095346_B_Kri1
  gRNA
gcaucuuucugguaaauucg

SEQ ID NO: 95347 - RNA, 20 nt, Artificial Sequence
  MKO10095347_B_Kri1
  gRNA
cuaggaauuugauccccagc

SEQ ID NO: 95348 - RNA, 20 nt, Artificial Sequence
  MKO10095348_B_Krit1
  gRNA
aaguguugcaaagugaguac

SEQ ID NO: 95349 - RNA, 20 nt, Artificial Sequence
  MKO10095349_B_Krit1
  gRNA
uugcaugaaguucccauuga

SEQ ID NO: 95350 - RNA, 20 nt, Artificial Sequence
  MKO10095350_B_Krit1
  gRNA
accaauuucuccugcaaacc

SEQ ID NO: 95351 - RNA, 20 nt, Artificial Sequence
  MKO10095351_B_Krr1
  gRNA
guagcauguuaaagcaacgc

SEQ ID NO: 95352 - RNA, 20 nt, Artificial Sequence
  MKO10095352_B_Krr1
  gRNA
cuguucaaaggaaacgcucc

SEQ ID NO: 95353 - RNA, 20 nt, Artificial Sequence
  MKO10095353_B_Krr1
  gRNA
ccaugacguagcaguuuguc

SEQ ID NO: 95354 - RNA, 20 nt, Artificial Sequence
  MKO10095354_B_Krt10
  gRNA
uuucugcaaguuguucguau

SEQ ID NO: 95355 - RNA, 20 nt, Artificial Sequence
  MKO10095355_B_Krt10
  gRNA
uugcuucagauacgagaaug

SEQ ID NO: 95356 - RNA, 20 nt, Artificial Sequence
  MKO10095356_B_Krt10
  gRNA
cgaaagucugaacgaagagc

SEQ ID NO: 95357 - RNA, 20 nt, Artificial Sequence
  MKO10095357_B_Krt12
  gRNA
accuuggugagauccacucc

SEQ ID NO: 95358 - RNA, 20 nt, Artificial Sequence
  MKO10095358_B_Krt12
  gRNA
gccuugcguugucaaucugc

SEQ ID NO: 95359 - RNA, 20 nt, Artificial Sequence
  MKO10095359_B_Krt12
  gRNA
auuucuacauugaccucacc

SEQ ID NO: 95360 - RNA, 20 nt, Artificial Sequence
  MKO10095360_B_Krt13
  gRNA
gacucuggcuaagacugacc

SEQ ID NO: 95361 - RNA, 20 nt, Artificial Sequence
  MKO10095361_B_Krt13
  gRNA
gcugaccuugcgccagagcg

SEQ ID NO: 95362 - RNA, 20 nt, Artificial Sequence
  MKO10095362_B_Krt13
  gRNA
cagaugguaccaugcucagc

SEQ ID NO: 95363 - RNA, 20 nt, Artificial Sequence
  MKO10095363_B_Krt14
  gRNA
gauggacgccgccccuggug

SEQ ID NO: 95364 - RNA, 20 nt, Artificial Sequence
  MKO10095364_B_Krt14
  gRNA
gcagaucgacaaugcccgcc

SEQ ID NO: 95365 - RNA, 20 nt, Artificial Sequence
  MKO10095365_B_Krt14
  gRNA
gcauccguaccaugcugagc

SEQ ID NO: 95366 - RNA, 20 nt, Artificial Sequence
  MKO10095366_B_Krt15
  gRNA
cggccuccacgcccugacgc

SEQ ID NO: 95367 - RNA, 20 nt, Artificial Sequence
  MKO10095367_B_Krt15
  gRNA
cuauugcagagaaaaaccgu

SEQ ID NO: 95368 - RNA, 20 nt, Artificial Sequence
  MKO10095368_B_Krt15
  gRNA
gaaugagcugacccugcguc

SEQ ID NO: 95369 - RNA, 20 nt, Artificial Sequence
  MKO10095369_B_Krt16
  gRNA
gacccuguccagagcugacc

SEQ ID NO: 95370 - RNA, 20 nt, Artificial Sequence
  MKO10095370_B_Krt16
  gRNA
ccuaggagaugcuugccuug

SEQ ID NO: 95371 - RNA, 20 nt, Artificial Sequence
  MKO10095371_B_Krt16
  gRNA
ccccaccuuucucaggaacc

SEQ ID NO: 95372 - RNA, 20 nt, Artificial Sequence
  MKO10095372_B_Krt17
  gRNA
ccagauccuuguggccaccg

SEQ ID NO: 95373 - RNA, 20 nt, Artificial Sequence
  MKO10095373_B_Krt17
  gRNA
caccucgcgguucagcuccu

SEQ ID NO: 95374 - RNA, 20 nt, Artificial Sequence
  MKO10095374_B_Krt17
  gRNA
gaugcagauugagaaucuca

SEQ ID NO: 95375 - RNA, 20 nt, Artificial Sequence
  MKO10095375_B_Krt18
  gRNA
cgacauccauggacuccgca

SEQ ID NO: 95376 - RNA, 20 nt, Artificial Sequence
  MKO10095376_B_Krt18
  gRNA
ucugagccagcgcuucauac

SEQ ID NO: 95377 - RNA, 20 nt, Artificial Sequence
  MKO10095377_B_Krt18
  gRNA
cuuggacuccaugaaaaacc

SEQ ID NO: 95378 - RNA, 20 nt, Artificial Sequence
  MKO10095378_B_Krt19
  gRNA
aucuuggcuaggucgacacc

SEQ ID NO: 95379 - RNA, 20 nt, Artificial Sequence
  MKO10095379_B_Krt19
  gRNA
ucugcauacccgagcaaggu

SEQ ID NO: 95380 - RNA, 20 nt, Artificial Sequence
  MKO10095380_B_Krt19
  gRNA
gucaaucuguaggacaaucu

SEQ ID NO: 95381 - RNA, 20 nt, Artificial Sequence
  MKO10095381_B_Krt1
  gRNA
ugguccuguacucuuccacc

SEQ ID NO: 95382 - RNA, 20 nt, Artificial Sequence
  MKO10095382_B_Krt1
  gRNA
agguaccuugcucugguaaa

SEQ ID NO: 95383 - RNA, 20 nt, Artificial Sequence
  MKO10095383_B_Krt1
  gRNA
cuuggccugaagcucaacuu

SEQ ID NO: 95384 - RNA, 20 nt, Artificial Sequence
  MKO10095384_B_Krt20
  gRNA
aggaaguugagguucuucgc

SEQ ID NO: 95385 - RNA, 20 nt, Artificial Sequence
  MKO10095385_B_Krt20
  gRNA
gagacgcaccuaccagaacc

SEQ ID NO: 95386 - RNA, 20 nt, Artificial Sequence
  MKO10095386_B_Krt20
  gRNA
aggauucgagguucaaguca

SEQ ID NO: 95387 - RNA, 20 nt, Artificial Sequence
  MKO10095387_B_Krt222
  gRNA
ugcuucucaacacgaagaug

SEQ ID NO: 95388 - RNA, 20 nt, Artificial Sequence
  MKO10095388_B_Krt222
  gRNA
agauauuaugguuguaucca

SEQ ID NO: 95389 - RNA, 20 nt, Artificial Sequence
  MKO10095389_B_Krt222
  gRNA
uuacuuacugaauggugccg

SEQ ID NO: 95390 - RNA, 20 nt, Artificial Sequence
  MKO10095390_B_Krt23
  gRNA
ggcccuagagauugaccugc

SEQ ID NO: 95391 - RNA, 20 nt, Artificial Sequence
  MKO10095391_B_Krt23
  gRNA
gugaagguggacacuacucc

SEQ ID NO: 95392 - RNA, 20 nt, Artificial Sequence
  MKO10095392_B_Krt23
  gRNA
acagauaguggacgguaaga

SEQ ID NO: 95393 - RNA, 20 nt, Artificial Sequence
  MKO10095393_B_Krt24
  gRNA
uugcgccaggagugaaguaa

SEQ ID NO: 95394 - RNA, 20 nt, Artificial Sequence
  MKO10095394_B_Krt24
  gRNA
gauggccgagcagaaccgcc

SEQ ID NO: 95395 - RNA, 20 nt, Artificial Sequence
  MKO10095395_B_Krt24
  gRNA
caauuccauuacuucacucc

SEQ ID NO: 95396 - RNA, 20 nt, Artificial Sequence
  MKO10095396_B_Krt25
  gRNA
gaagcgaacgcuccaaaccc

SEQ ID NO: 95397 - RNA, 20 nt, Artificial Sequence
  MKO10095397_B_Krt25
  gRNA
gucaaucugcaguacagcgu

SEQ ID NO: 95398 - RNA, 20 nt, Artificial Sequence
  MKO10095398_B_Krt25
  gRNA
caacaugagagcugaguaug

SEQ ID NO: 95399 - RNA, 20 nt, Artificial Sequence
  MKO10095399_B_Krt26
  gRNA
gcucguccaacacucugcga

SEQ ID NO: 95400 - RNA, 20 nt, Artificial Sequence
  MKO10095400_B_Krt26
  gRNA
gugguucugcaaaaugcauc

SEQ ID NO: 95401 - RNA, 20 nt, Artificial Sequence
  MKO10095401_B_Krt26
  gRNA
gaugaacgcagcccccagcg

SEQ ID NO: 95402 - RNA, 20 nt, Artificial Sequence
  MKO10095402_B_Krt27
  gRNA
caacaugagagccgaguacg

SEQ ID NO: 95403 - RNA, 20 nt, Artificial Sequence
  MKO10095403_B_Krt27
  gRNA
cagcagauuucagacgaugc

SEQ ID NO: 95404 - RNA, 20 nt, Artificial Sequence
  MKO10095404_B_Krt27
  gRNA
aaaugacaacgcaagacuga

SEQ ID NO: 95405 - RNA, 20 nt, Artificial Sequence
  MKO10095405_B_Krt28
  gRNA
ugaugucugccucgacauuu

SEQ ID NO: 95406 - RNA, 20 nt, Artificial Sequence
  MKO10095406_B_Krt28
  gRNA
aaaguccugcagugcgcagc

SEQ ID NO: 95407 - RNA, 20 nt, Artificial Sequence
  MKO10095407_B_Krt28
  gRNA
cacccuucaccaaaaugucg

SEQ ID NO: 95408 - RNA, 20 nt, Artificial Sequence
  MKO10095408_B_Krt2
  gRNA
aggcagccgcaccacaaacc

SEQ ID NO: 95409 - RNA, 20 nt, Artificial Sequence
  MKO10095409_B_Krt2
  gRNA
cugugcuaguauguccagcc

SEQ ID NO: 95410 - RNA, 20 nt, Artificial Sequence
  MKO10095410_B_Krt2
  gRNA
gaugaucgcccauaagagca

SEQ ID NO: 95411 - RNA, 20 nt, Artificial Sequence
  MKO10095411_B_Krt31
  gRNA
cauucucugauuugcugcac

SEQ ID NO: 95412 - RNA, 20 nt, Artificial Sequence
  MKO10095412_B_Krt31
  gRNA
ccuccaggucagacuugcac

SEQ ID NO: 95413 - RNA, 20 nt, Artificial Sequence
  MKO10095413_B_Krt31
  gRNA
gagacgcacagucaacgccc

SEQ ID NO: 95414 - RNA, 20 nt, Artificial Sequence
  MKO10095414_B_Krt32
  gRNA
gaguauugacuguucgucuc

SEQ ID NO: 95415 - RNA, 20 nt, Artificial Sequence
  MKO10095415_B_Krt32
  gRNA
ccucuagaucagccuuauua

SEQ ID NO: 95416 - RNA, 20 nt, Artificial Sequence
  MKO10095416_B_Krt32
  gRNA
ggcucaaguagagucccuga

SEQ ID NO: 95417 - RNA, 20 nt, Artificial Sequence
  MKO10095417_B_Krt33a
  gRNA
guggcaaaucugagaacgcc

SEQ ID NO: 95418 - RNA, 20 nt, Artificial Sequence
  MKO10095418_B_Krt33a
  gRNA
gcugcaggcccagcaugaac

SEQ ID NO: 95419 - RNA, 20 nt, Artificial Sequence
  MKO10095419_B_Krt33a
  gRNA
ucucguugaguacucgguuc

SEQ ID NO: 95420 - RNA, 20 nt, Artificial Sequence
  MKO10095420_B_Krt33b
  gRNA
gugucucaagcaaaaccaug

SEQ ID NO: 95421 - RNA, 20 nt, Artificial Sequence
  MKO10095421_B_Krt33b
  gRNA
cacuacacaccaugcugugc

SEQ ID NO: 95422 - RNA, 20 nt, Artificial Sequence
  MKO10095422_B_Krt33b
  gRNA
ucagcucgaugaucucugcc

SEQ ID NO: 95423 - RNA, 20 nt, Artificial Sequence
  MKO10095423_B_Krt34
  gRNA
gacccucugcaagucugacu

SEQ ID NO: 95424 - RNA, 20 nt, Artificial Sequence
  MKO10095424_B_Krt34
  gRNA
aagacgcacagucaacgccc

SEQ ID NO: 95425 - RNA, 20 nt, Artificial Sequence
  MKO10095425_B_Krt34
  gRNA
cuugguccugaagucaucag

SEQ ID NO: 95426 - RNA, 20 nt, Artificial Sequence
  MKO10095426_B_Krt35
  gRNA
uccccagacucuuugcagca

SEQ ID NO: 95427 - RNA, 20 nt, Artificial Sequence
  MKO10095427_B_Krt35
  gRNA
ugcacagagucagaucaucc

SEQ ID NO: 95428 - RNA, 20 nt, Artificial Sequence
  MKO10095428_B_Krt35
  gRNA
gagacgcacugucaacucuc

SEQ ID NO: 95429 - RNA, 20 nt, Artificial Sequence
  MKO10095429_B_Krt36
  gRNA
gcgaugccaguaugagacgc

SEQ ID NO: 95430 - RNA, 20 nt, Artificial Sequence
  MKO10095430_B_Krt36
  gRNA
ggaguugucccugcgacagc

SEQ ID NO: 95431 - RNA, 20 nt, Artificial Sequence
  MKO10095431_B_Krt36
  gRNA
ucagcucaaugaucucuguc

SEQ ID NO: 95432 - RNA, 20 nt, Artificial Sequence
  MKO10095432_B_Krt39
  gRNA
cucaaucucgagggcacuua

SEQ ID NO: 95433 - RNA, 20 nt, Artificial Sequence
  MKO10095433_B_Krt39
  gRNA
gugccucaaaacgaaccaug

SEQ ID NO: 95434 - RNA, 20 nt, Artificial Sequence
  MKO10095434_B_Krt39
  gRNA
gucaauuugugagaccaguc

SEQ ID NO: 95435 - RNA, 20 nt, Artificial Sequence
  MKO10095435_B_Krt40
  gRNA
caucuuucauagacuccacg

SEQ ID NO: 95436 - RNA, 20 nt, Artificial Sequence
  MKO10095436_B_Krt40
  gRNA
cgccaagcugcucacgaagc

SEQ ID NO: 95437 - RNA, 20 nt, Artificial Sequence
  MKO10095437_B_Krt40
  gRNA
uuugcaguuguccaccugaa

SEQ ID NO: 95438 - RNA, 20 nt, Artificial Sequence
  MKO10095438_B_Krt42
  gRNA
ggagcuccgugaucucuguc

SEQ ID NO: 95439 - RNA, 20 nt, Artificial Sequence
  MKO10095439_B_Krt42
  gRNA
gcagauugacaacgcucgcc

SEQ ID NO: 95440 - RNA, 20 nt, Artificial Sequence
  MKO10095440_B_Krt42
  gRNA
ggugggcggggacgucaaug

SEQ ID NO: 95441 - RNA, 20 nt, Artificial Sequence
  MKO10095441_B_Krt4
  gRNA
ccucugcgaugaugccaucc

SEQ ID NO: 95442 - RNA, 20 nt, Artificial Sequence
  MKO10095442_B_Krt4
  gRNA
auggcaucaucgcagagguc

SEQ ID NO: 95443 - RNA, 20 nt, Artificial Sequence
  MKO10095443_B_Krt4
  gRNA
agcugcagagaaugacuucg

SEQ ID NO: 95444 - RNA, 20 nt, Artificial Sequence
  MKO10095444_B_Krt5
  gRNA
ugccaaccgcagccgaacag

SEQ ID NO: 95445 - RNA, 20 nt, Artificial Sequence
  MKO10095445_B_Krt5
  gRNA
acucagccucuguucggcug

SEQ ID NO: 95446 - RNA, 20 nt, Artificial Sequence
  MKO10095446_B_Krt5
  gRNA
uaacaaccuccguagacagc

SEQ ID NO: 95447 - RNA, 20 nt, Artificial Sequence
  MKO10095447_B_Krt6a
  gRNA
ugaauucgugacccugaaga

SEQ ID NO: 95448 - RNA, 20 nt, Artificial Sequence
  MKO10095448_B_Krt6a
  gRNA
uguuccucagcucugagucc

SEQ ID NO: 95449 - RNA, 20 nt, Artificial Sequence
  MKO10095449_B_Krt6a
  gRNA
ucacaucucagacacaucug

SEQ ID NO: 95450 - RNA, 20 nt, Artificial Sequence
  MKO10095450_B_Krt6b
  gRNA
uguuccucagcucugagucc

SEQ ID NO: 95451 - RNA, 20 nt, Artificial Sequence
  MKO10095451_B_Krt6b
  gRNA
ugaauuuguaaccgugaaaa

SEQ ID NO: 95452 - RNA, 20 nt, Artificial Sequence
  MKO10095452_B_Krt6b
  gRNA
ucacaucucagacacaucug

SEQ ID NO: 95453 - RNA, 20 nt, Artificial Sequence
  MKO10095453_B_Krt71
  gRNA
cauucucugcagcuguccgc

SEQ ID NO: 95454 - RNA, 20 nt, Artificial Sequence
  MKO10095454_B_Krt71
  gRNA
ugccaacaagguggaacugc

SEQ ID NO: 95455 - RNA, 20 nt, Artificial Sequence
  MKO10095455_B_Krt71
  gRNA
caagguggacaccauggacc

SEQ ID NO: 95456 - RNA, 20 nt, Artificial Sequence
  MKO10095456_B_Krt72
  gRNA
cagcugccgguuauugucca

SEQ ID NO: 95457 - RNA, 20 nt, Artificial Sequence
  MKO10095457_B_Krt72
  gRNA
cugauguaacucucaugcac

SEQ ID NO: 95458 - RNA, 20 nt, Artificial Sequence
  MKO10095458_B_Krt72
  gRNA
uggaccuaaacaacuccaag

SEQ ID NO: 95459 - RNA, 20 nt, Artificial Sequence
  MKO10095459_B_Krt73
  gRNA
acucggagcugaggggcaug

SEQ ID NO: 95460 - RNA, 20 nt, Artificial Sequence
  MKO10095460_B_Krt73
  gRNA
caauguccucguacugagcu

SEQ ID NO: 95461 - RNA, 20 nt, Artificial Sequence
  MKO10095461_B_Krt73
  gRNA
cugaugugggccucauaaac

SEQ ID NO: 95462 - RNA, 20 nt, Artificial Sequence
  MKO10095462_B_Krt75
  gRNA
aggacauugccaaccgaagc

SEQ ID NO: 95463 - RNA, 20 nt, Artificial Sequence
  MKO10095463_B_Krt75
  gRNA
agacgaaauuaacaagcgug

SEQ ID NO: 95464 - RNA, 20 nt, Artificial Sequence
  MKO10095464_B_Krt75
  gRNA
cugaccagaucaacuucuac

SEQ ID NO: 95465 - RNA, 20 nt, Artificial Sequence
  MKO10095465_B_Krt76
  gRNA
cacugacaugacucuguauc

SEQ ID NO: 95466 - RNA, 20 nt, Artificial Sequence
  MKO10095466_B_Krt76
  gRNA
cagaugaaaucaacuuucug

SEQ ID NO: 95467 - RNA, 20 nt, Artificial Sequence
  MKO10095467_B_Krt76
  gRNA
uggagcuuucaugaacaaag

SEQ ID NO: 95468 - RNA, 20 nt, Artificial Sequence
  MKO10095468_B_Krt77
  gRNA
uguucuuuaggugcgguucc

SEQ ID NO: 95469 - RNA, 20 nt, Artificial Sequence
  MKO10095469_B_Krt77
  gRNA
cccauacagugugucuacuu

SEQ ID NO: 95470 - RNA, 20 nt, Artificial Sequence
  MKO10095470_B_Krt77
  gRNA
uaccaaugucaucuugucaa

SEQ ID NO: 95471 - RNA, 20 nt, Artificial Sequence
  MKO10095471_B_Krt78
  gRNA
aaaccugccuagcccgacuc

SEQ ID NO: 95472 - RNA, 20 nt, Artificial Sequence
  MKO10095472_B_Krt78
  gRNA
cugugcccaggacguggaug

SEQ ID NO: 95473 - RNA, 20 nt, Artificial Sequence
  MKO10095473_B_Krt78
  gRNA
uuuccagagcaagauggauu

SEQ ID NO: 95474 - RNA, 20 nt, Artificial Sequence
  MKO10095474_B_Krt79
  gRNA
caccaacgugauacugucca

SEQ ID NO: 95475 - RNA, 20 nt, Artificial Sequence
  MKO10095475_B_Krt79
  gRNA
ggauguagaugccgcauaca

SEQ ID NO: 95476 - RNA, 20 nt, Artificial Sequence
  MKO10095476_B_Krt79
  gRNA
aaucaacaaacgcacugccc

SEQ ID NO: 95477 - RNA, 20 nt, Artificial Sequence
  MKO10095477_B_Krt7
  gRNA
ggaugccgccuacacgaaca

SEQ ID NO: 95478 - RNA, 20 nt, Artificial Sequence
  MKO10095478_B_Krt7
  gRNA
ccagcuuccccgaaucuuug

SEQ ID NO: 95479 - RNA, 20 nt, Artificial Sequence
  MKO10095479_B_Krt7
  gRNA
accccuccagguacgcuucc

SEQ ID NO: 95480 - RNA, 20 nt, Artificial Sequence
  MKO10095480_B_Krt80
  gRNA
gaucuccaagcgcacagacc

SEQ ID NO: 95481 - RNA, 20 nt, Artificial Sequence
  MKO10095481_B_Krt80
  gRNA
accaacugcuggagacccga

SEQ ID NO: 95482 - RNA, 20 nt, Artificial Sequence
  MKO10095482_B_Krt80
  gRNA
aaacuccaggucugugcgcu

SEQ ID NO: 95483 - RNA, 20 nt, Artificial Sequence
  MKO10095483_B_Krt81
  gRNA
cagagccacaaacucauucu

SEQ ID NO: 95484 - RNA, 20 nt, Artificial Sequence
  MKO10095484_B_Krt81
  gRNA
cuaccugcgcaagucagauc

SEQ ID NO: 95485 - RNA, 20 nt, Artificial Sequence
  MKO10095485_B_Krt81
  gRNA
ccucgucauacauucuccuc

SEQ ID NO: 95486 - RNA, 20 nt, Artificial Sequence
  MKO10095486_B_Krt82
  gRNA
ccgugaauaccuccucaaac

SEQ ID NO: 95487 - RNA, 20 nt, Artificial Sequence
  MKO10095487_B_Krt82
  gRNA
ccuuacccggcacugguacc

SEQ ID NO: 95488 - RNA, 20 nt, Artificial Sequence
  MKO10095488_B_Krt82
  gRNA
gacaaacucauucucagcac

SEQ ID NO: 95489 - RNA, 20 nt, Artificial Sequence
  MKO10095489_B_Krt83
  gRNA
agccgagcucaaccaugugc

SEQ ID NO: 95490 - RNA, 20 nt, Artificial Sequence
  MKO10095490_B_Krt83
  gRNA
cacaaauucauucucagaag

SEQ ID NO: 95491 - RNA, 20 nt, Artificial Sequence
  MKO10095491_B_Krt83
  gRNA
acucagccucagcacggcua

SEQ ID NO: 95492 - RNA, 20 nt, Artificial Sequence
  MKO10095492_B_Krt84
  gRNA
cuuccagaucagauuuguuc

SEQ ID NO: 95493 - RNA, 20 nt, Artificial Sequence
  MKO10095493_B_Krt84
  gRNA
cuggaucagaguauccacau

SEQ ID NO: 95494 - RNA, 20 nt, Artificial Sequence
  MKO10095494_B_Krt84
  gRNA
auaacuauaucaccaaccug

SEQ ID NO: 95495 - RNA, 20 nt, Artificial Sequence
  MKO10095495_B_Krt85
  gRNA
ugcugagcucaaccaugcgc

SEQ ID NO: 95496 - RNA, 20 nt, Artificial Sequence
  MKO10095496_B_Krt85
  gRNA
ugacagaugugucugagaug

SEQ ID NO: 95497 - RNA, 20 nt, Artificial Sequence
  MKO10095497_B_Krt85
  gRNA
uugggucagagccucugcgu

SEQ ID NO: 95498 - RNA, 20 nt, Artificial Sequence
  MKO10095498_B_Krt86
  gRNA
ccuccaggucugacuugcgc

SEQ ID NO: 95499 - RNA, 20 nt, Artificial Sequence
  MKO10095499_B_Krt86
  gRNA
ccucuucuuguagcccucca

SEQ ID NO: 95500 - RNA, 20 nt, Artificial Sequence
  MKO10095500_B_Krt86
  gRNA
ucucaccuuggugcgguacc

SEQ ID NO: 95501 - RNA, 20 nt, Artificial Sequence
  MKO10095501_B_Krt8
  gRNA
cuuuaccuuaaucugguaca

SEQ ID NO: 95502 - RNA, 20 nt, Artificial Sequence
  MKO10095502_B_Krt8
  gRNA
agacccucaccuucuugaug

SEQ ID NO: 95503 - RNA, 20 nt, Artificial Sequence
  MKO10095503_B_Krt8
  gRNA
ccccaugcaggugcgcuucc

SEQ ID NO: 95504 - RNA, 20 nt, Artificial Sequence
  MKO10095504_B_Krt9
  gRNA
uugucauuugcugcucaauc

SEQ ID NO: 95505 - RNA, 20 nt, Artificial Sequence
  MKO10095505_B_Krt9
  gRNA
gguuauggcgaaaucugauc

SEQ ID NO: 95506 - RNA, 20 nt, Artificial Sequence
  MKO10095506_B_Krt9
  gRNA
gaggaacaacaaaacucucg

SEQ ID NO: 95507 - RNA, 20 nt, Artificial Sequence
  MKO10095507_B_Kruap1-3
  gRNA
ggugccaccaguggaacaug

SEQ ID NO: 95508 - RNA, 20 nt, Artificial Sequence
  MKO10095508_B_Kruap1-3
  gRNA
ccgugagcugccguguuaga

SEQ ID NO: 95509 - RNA, 20 nt, Artificial Sequence
  MKO10095509_B_Kruap1-3
  gRNA
acagaagcuaguagcgcagc

SEQ ID NO: 95510 - RNA, 20 nt, Artificial Sequence
  MKO10095510_B_Kruap1-4
  gRNA
acagaaacuaguagcgcagc

SEQ ID NO: 95511 - RNA, 20 nt, Artificial Sequence
  MKO10095511_B_Kruap1-4
  gRNA
gaaccugguucuuaacagcu

SEQ ID NO: 95512 - RNA, 20 nt, Artificial Sequence
  MKO10095512_B_Kruap1-4
  gRNA
gccugagcugccguguuaga

SEQ ID NO: 95513 - RNA, 20 nt, Artificial Sequence
  MKO10095513_B_Kruap1-5
  gRNA
uagccugucccacagcagcu

SEQ ID NO: 95514 - RNA, 20 nt, Artificial Sequence
  MKO10095514_B_Kruap1-5
  gRNA
uauacagcucaccacacagc

SEQ ID NO: 95515 - RNA, 20 nt, Artificial Sequence
  MKO10095515_B_Kruap1-5
  gRNA
ugcugugcuacuagcuucug

SEQ ID NO: 95516 - RNA, 20 nt, Artificial Sequence
  MKO10095516_B_Kruap10-10
  gRNA
ccagaauaucuggccaccca

SEQ ID NO: 95517 - RNA, 20 nt, Artificial Sequence
  MKO10095517_B_Kruap10-10
  gRNA
uaugaggcugaacccaguug

SEQ ID NO: 95518 - RNA, 20 nt, Artificial Sequence
  MKO10095518_B_Kruap10-10
  gRNA
ccucagagcuaaguugaccu

SEQ ID NO: 95519 - RNA, 20 nt, Artificial Sequence
  MKO10095519_B_Kruap10-4
  gRNA
uuccuggugacagcugacuu

SEQ ID NO: 95520 - RNA, 20 nt, Artificial Sequence
  MKO10095520_B_Kruap10-4
  gRNA
uuuccagucugacucugacc

SEQ ID NO: 95521 - RNA, 20 nt, Artificial Sequence
  MKO10095521_B_Kruap10-4
  gRNA
gaucucuccuccugcuuccu

SEQ ID NO: 95522 - RNA, 20 nt, Artificial Sequence
  MKO10095522_B_Kruap11-1
  gRNA
ucugucgauugcaaguuacc

SEQ ID NO: 95523 - RNA, 20 nt, Artificial Sequence
  MKO10095523_B_Kruap11-1
  gRNA
gcaguguaacguccuccaac

SEQ ID NO: 95524 - RNA, 20 nt, Artificial Sequence
  MKO10095524_B_Kruap11-1
  gRNA
cgugacgcagacugccugag

SEQ ID NO: 95525 - RNA, 20 nt, Artificial Sequence
  MKO10095525_B_Kruap12-1
  gRNA
ggacuagacacacaacagga

SEQ ID NO: 95526 - RNA, 20 nt, Artificial Sequence
  MKO10095526_B_Kruap12-1
  gRNA
uggacacaaagcaggaugcc

SEQ ID NO: 95527 - RNA, 20 nt, Artificial Sequence
  MKO10095527_B_Kruap12-1
  gRNA
ccagcccuccugccccacuc

SEQ ID NO: 95528 - RNA, 20 nt, Artificial Sequence
  MKO10095528_B_Kruap13-1
  gRNA
ccaguggcuuuagaccacaa

SEQ ID NO: 95529 - RNA, 20 nt, Artificial Sequence
  MKO10095529_B_Kruap13-1
  gRNA
guuuccagaauagcagccgu

SEQ ID NO: 95530 - RNA, 20 nt, Artificial Sequence
  MKO10095530_B_Kruap13-1
  gRNA
aacuucucuucccgcuccag

SEQ ID NO: 95531 - RNA, 20 nt, Artificial Sequence
  MKO10095531_B_Kruap13
  gRNA
agcuucuagagccauagccc

SEQ ID NO: 95532 - RNA, 20 nt, Artificial Sequence
  MKO10095532_B_Kruap13
  gRNA
ggcuucagaucucugaauua

SEQ ID NO: 95533 - RNA, 20 nt, Artificial Sequence
  MKO10095533_B_Kruap13
  gRNA
cagcagcuccacacccugcc

SEQ ID NO: 95534 - RNA, 20 nt, Artificial Sequence
  MKO10095534_B_Kruap14
  gRNA
uacucaugaguuccuguaau

SEQ ID NO: 95535 - RNA, 20 nt, Artificial Sequence
  MKO10095535_B_Kruap14
  gRNA
cucuuaacacaguagguagu

SEQ ID NO: 95536 - RNA, 20 nt, Artificial Sequence
  MKO10095536_B_Kruap14
  gRNA
aaccccuggaaccaaauccc

SEQ ID NO: 95537 - RNA, 20 nt, Artificial Sequence
  MKO10095537_B_Kruap15
  gRNA
aaaugucuucgccaacauuu

SEQ ID NO: 95538 - RNA, 20 nt, Artificial Sequence
  MKO10095538_B_Kruap15
  gRNA
acucagcaucgugauacacc

SEQ ID NO: 95539 - RNA, 20 nt, Artificial Sequence
  MKO10095539_B_Kruap15
  gRNA
aagcucuggcauucgcucuc

SEQ ID NO: 95540 - RNA, 20 nt, Artificial Sequence
  MKO10095540_B_Kruap16-1
  gRNA
aacaggauuucaguagaaac

SEQ ID NO: 95541 - RNA, 20 nt, Artificial Sequence
  MKO10095541_B_Kruap16-1
  gRNA
ggcuauggaggcuucggaua

SEQ ID NO: 95542 - RNA, 20 nt, Artificial Sequence
  MKO10095542_B_Kruap16-1
  gRNA
ucuggcuauggaggcuuugg

SEQ ID NO: 95543 - RNA, 20 nt, Artificial Sequence
  MKO10095543_B_Kruap16-3
  gRNA
uguuauagagaagacaucua

SEQ ID NO: 95544 - RNA, 20 nt, Artificial Sequence
  MKO10095544_B_Kruap16-3
  gRNA
agaugaagccauaaauucga

SEQ ID NO: 95545 - RNA, 20 nt, Artificial Sequence
  MKO10095545_B_Kruap16-3
  gRNA
agcacuuuccucucuaaaga

SEQ ID NO: 95546 - RNA, 20 nt, Artificial Sequence
  MKO10095546_B_Kruap17-1
  gRNA
cagcaauugaggcagucucc

SEQ ID NO: 95547 - RNA, 20 nt, Artificial Sequence
  MKO10095547_B_Kruap17-1
  gRNA
ggcugcgggucuagcugcug

SEQ ID NO: 95548 - RNA, 20 nt, Artificial Sequence
  MKO10095548_B_Kruap17-1
  gRNA
gccgccaccaccgcagcauc

SEQ ID NO: 95549 - RNA, 20 nt, Artificial Sequence
  MKO10095549_B_Kruap19-1
  gRNA
ggcucugacuauggaggcua

SEQ ID NO: 95550 - RNA, 20 nt, Artificial Sequence
  MKO10095550_B_Kruap19-1
  gRNA
aaaaucaugagcuacuacag

SEQ ID NO: 95551 - RNA, 20 nt, Artificial Sequence
  MKO10095551_B_Kruap19-1
  gRNA
uacuauggaggccugggcua

SEQ ID NO: 95552 - RNA, 20 nt, Artificial Sequence
  MKO10095552_B_Kruap19-3
  gRNA
agccacuacagcagcuacua

SEQ ID NO: 95553 - RNA, 20 nt, Artificial Sequence
  MKO10095553_B_Kruap19-3
  gRNA
uucggauauggcucuggaua

SEQ ID NO: 95554 - RNA, 20 nt, Artificial Sequence
  MKO10095554_B_Kruap19-3
  gRNA
agcugccauagccguagccc

SEQ ID NO: 95555 - RNA, 20 nt, Artificial Sequence
  MKO10095555_B_Kruap19-4
  gRNA
guagcuguuguaguaacuca

SEQ ID NO: 95556 - RNA, 20 nt, Artificial Sequence
  MKO10095556_B_Kruap19-4
  gRNA
uucagccuuucaguagaagg

SEQ ID NO: 95557 - RNA, 20 nt, Artificial Sequence
  MKO10095557_B_Kruap19-4
  gRNA
aguuacuacaacagcuacua

SEQ ID NO: 95558 - RNA, 20 nt, Artificial Sequence
  MKO10095558_B_Kruap19-5
  gRNA
guagcugccguaguagcuca

SEQ ID NO: 95559 - RNA, 20 nt, Artificial Sequence
  MKO10095559_B_Kruap19-5
  gRNA
auccauauccuccauaauaa

SEQ ID NO: 95560 - RNA, 20 nt, Artificial Sequence
  MKO10095560_B_Kruap19-5
  gRNA
ggaaugcauuucaguagaau

SEQ ID NO: 95561 - RNA, 20 nt, Artificial Sequence
  MKO10095561_B_Kruap19-9b
  gRNA
uacuucagucccucuuucua

SEQ ID NO: 95562 - RNA, 20 nt, Artificial Sequence
  MKO10095562_B_Kruap19-9b
  gRNA
uauggcuaugguuccagcua

SEQ ID NO: 95563 - RNA, 20 nt, Artificial Sequence
  MKO10095563_B_Kruap19-9b
  gRNA
cuugggggcuaugguggcua

SEQ ID NO: 95564 - RNA, 20 nt, Artificial Sequence
  MKO10095564_B_Kruap2-4
  gRNA
cagggcgacacacugugguc

SEQ ID NO: 95565 - RNA, 20 nt, Artificial Sequence
  MKO10095565_B_Kruap2-4
  gRNA
ggacacugggcggcagcagc

SEQ ID NO: 95566 - RNA, 20 nt, Artificial Sequence
  MKO10095566_B_Kruap2-4
  gRNA
ggucccugcagcagcagggc

SEQ ID NO: 95567 - RNA, 20 nt, Artificial Sequence
  MKO10095567_B_Kruap20-2
  gRNA
uacuauggaggccugggcug

SEQ ID NO: 95568 - RNA, 20 nt, Artificial Sequence
  MKO10095568_B_Kruap20-2
  gRNA
ccugacaccauguguuacua

SEQ ID NO: 95569 - RNA, 20 nt, Artificial Sequence
  MKO10095569_B_Kruap20-2
  gRNA
cacagccauagccauagccu

SEQ ID NO: 95570 - RNA, 20 nt, Artificial Sequence
  MKO10095570_B_Kruap21-1
  gRNA
accaugugcugcaacuacua

SEQ ID NO: 95571 - RNA, 20 nt, Artificial Sequence
  MKO10095571_B_Kruap21-1
  gRNA
uauggcuccagguauggcug

SEQ ID NO: 95572 - RNA, 20 nt, Artificial Sequence
  MKO10095572_B_Kruap21-1
  gRNA
uauggcucaggcuaugguug

SEQ ID NO: 95573 - RNA, 20 nt, Artificial Sequence
  MKO10095573_B_Kruap22-2
  gRNA
gggcuacggcuaugguagcc

SEQ ID NO: 95574 - RNA, 20 nt, Artificial Sequence
  MKO10095574_B_Kruap22-2
  gRNA
cacagccauagccguagccc

SEQ ID NO: 95575 - RNA, 20 nt, Artificial Sequence
  MKO10095575_B_Kruap22-2
  gRNA
ggcuaugguggucugggcua

SEQ ID NO: 95576 - RNA, 20 nt, Artificial Sequence
  MKO10095576_B_Kruap24-1
  gRNA
aucgaucaguagcaaugcag

SEQ ID NO: 95577 - RNA, 20 nt, Artificial Sequence
  MKO10095577_B_Kruap24-1
  gRNA
ugcggggccugaagauucuu

SEQ ID NO: 95578 - RNA, 20 nt, Artificial Sequence
  MKO10095578_B_Kruap24-1
  gRNA
gaugauguaaacccuaccuu

SEQ ID NO: 95579 - RNA, 20 nt, Artificial Sequence
  MKO10095579_B_Kruap26-1
  gRNA
auccaauagcugccgaccuc

SEQ ID NO: 95580 - RNA, 20 nt, Artificial Sequence
  MKO10095580_B_Kruap26-1
  gRNA
gugccaaacacagggaucga

SEQ ID NO: 95581 - RNA, 20 nt, Artificial Sequence
  MKO10095581_B_Kruap26-1
  gRNA
cguccuguaagcuguguauc

SEQ ID NO: 95582 - RNA, 20 nt, Artificial Sequence
  MKO10095582_B_Kruap27-1
  gRNA
cacuuggccauguaacuugc

SEQ ID NO: 95583 - RNA, 20 nt, Artificial Sequence
  MKO10095583_B_Kruap27-1
  gRNA
cuaccaaccugcaaguuaca

SEQ ID NO: 95584 - RNA, 20 nt, Artificial Sequence
  MKO10095584_B_Kruap27-1
  gRNA
uagcccagagacaauacugc

SEQ ID NO: 95585 - RNA, 20 nt, Artificial Sequence
  MKO10095585_B_Kruap3-1
  gRNA
cugaccaccuacgugcagcc

SEQ ID NO: 95586 - RNA, 20 nt, Artificial Sequence
  MKO10095586_B_Kruap3-1
  gRNA
uggucagguugaugccacuc

SEQ ID NO: 95587 - RNA, 20 nt, Artificial Sequence
  MKO10095587_B_Kruap3-1
  gRNA
gcaagaguugagcagccagc

SEQ ID NO: 95588 - RNA, 20 nt, Artificial Sequence
  MKO10095588_B_Kruap3-2
  gRNA
ucagacaaguccugccgcug

SEQ ID NO: 95589 - RNA, 20 nt, Artificial Sequence
  MKO10095589_B_Kruap3-2
  gRNA
acacagggcuccucacagcc

SEQ ID NO: 95590 - RNA, 20 nt, Artificial Sequence
  MKO10095590_B_Kruap3-2
  gRNA
gcaccugcccacacaccauu

SEQ ID NO: 95591 - RNA, 20 nt, Artificial Sequence
  MKO10095591_B_Kruap3-3
  gRNA
ucagacaaguccugccgcug

SEQ ID NO: 95592 - RNA, 20 nt, Artificial Sequence
  MKO10095592_B_Kruap3-3
  gRNA
acacagggcuccucacagcc

SEQ ID NO: 95593 - RNA, 20 nt, Artificial Sequence
  MKO10095593_B_Kruap3-3
  gRNA
gcaccugcccacacaccauu

SEQ ID NO: 95594 - RNA, 20 nt, Artificial Sequence
  MKO10095594_B_Kruap31-1
  gRNA
gcugcaagaccgccuccugc

SEQ ID NO: 95595 - RNA, 20 nt, Artificial Sequence
  MKO10095595_B_Kruap31-1
  gRNA
gaggcggucuugcagcagca

SEQ ID NO: 95596 - RNA, 20 nt, Artificial Sequence
  MKO10095596_B_Kruap31-1
  gRNA
ggagguggucuugcagcagc

SEQ ID NO: 95597 - RNA, 20 nt, Artificial Sequence
  MKO10095597_B_Kruap31-2
  gRNA
gcugcaagaccaccuccugc

SEQ ID NO: 95598 - RNA, 20 nt, Artificial Sequence
  MKO10095598_B_Kruap31-2
  gRNA
gagguggucuugcagcagca

SEQ ID NO: 95599 - RNA, 20 nt, Artificial Sequence
  MKO10095599_B_Kruap31-2
  gRNA
agagguggcuucgugcacac

SEQ ID NO: 95600 - RNA, 20 nt, Artificial Sequence
  MKO10095600_B_Kruap4-13
  gRNA
ugggcuggcagcacacagac

SEQ ID NO: 95601 - RNA, 20 nt, Artificial Sequence
  MKO10095601_B_Kruap4-13
  gRNA
gcacugaggccugcagcagc

SEQ ID NO: 95602 - RNA, 20 nt, Artificial Sequence
  MKO10095602_B_Kruap4-13
  gRNA
gcagcuggggcggcagcagc

SEQ ID NO: 95603 - RNA, 20 nt, Artificial Sequence
  MKO10095603_B_Kruap4-16
  gRNA
gcggcagcagguggucuggc

SEQ ID NO: 95604 - RNA, 20 nt, Artificial Sequence
  MKO10095604_B_Kruap4-16
  gRNA
cuggccgcagcucuccuggc

SEQ ID NO: 95605 - RNA, 20 nt, Artificial Sequence
  MKO10095605_B_Kruap4-16
  gRNA
uccgcagcuggggcggcaag

SEQ ID NO: 95606 - RNA, 20 nt, Artificial Sequence
  MKO10095606_B_Kruap4-1
  gRNA
acaggaaggucgacagcagc

SEQ ID NO: 95607 - RNA, 20 nt, Artificial Sequence
  MKO10095607_B_Kruap4-1
  gRNA
gcugcagacccaguugcugc

SEQ ID NO: 95608 - RNA, 20 nt, Artificial Sequence
  MKO10095608_B_Kruap4-1
  gRNA
guguggcacagcacaugggg

SEQ ID NO: 95609 - RNA, 20 nt, Artificial Sequence
  MKO10095609_B_Kruap4-2
  gRNA
cggcaacaggggcugcagca

SEQ ID NO: 95610 - RNA, 20 nt, Artificial Sequence
  MKO10095610_B_Kruap4-2
  gRNA
gcaacuagaaccacagcagc

SEQ ID NO: 95611 - RNA, 20 nt, Artificial Sequence
  MKO10095611_B_Kruap4-2
  gRNA
gcggcagcagggucggcagc

SEQ ID NO: 95612 - RNA, 20 nt, Artificial Sequence
  MKO10095612_B_Kruap4-6
  gRNA
uaccgcccagcgugcucuag

SEQ ID NO: 95613 - RNA, 20 nt, Artificial Sequence
  MKO10095613_B_Kruap4-6
  gRNA
uggucuggcaacagaugggg

SEQ ID NO: 95614 - RNA, 20 nt, Artificial Sequence
  MKO10095614_B_Kruap4-6
  gRNA
guagcaggugguccugcagc

SEQ ID NO: 95615 - RNA, 20 nt, Artificial Sequence
  MKO10095615_B_Kruap4-7
  gRNA
gcugucgccccagcugcugu

SEQ ID NO: 95616 - RNA, 20 nt, Artificial Sequence
  MKO10095616_B_Kruap4-7
  gRNA
ucugaggagggcuguagcca

SEQ ID NO: 95617 - RNA, 20 nt, Artificial Sequence
  MKO10095617_B_Kruap4-7
  gRNA
ugggcuggcagcacgcagac

SEQ ID NO: 95618 - RNA, 20 nt, Artificial Sequence
  MKO10095618_B_Kruap4-8
  gRNA
gcagcagcuagaaaugcaac

SEQ ID NO: 95619 - RNA, 20 nt, Artificial Sequence
  MKO10095619_B_Kruap4-8
  gRNA
accauggucagcuccuguug

SEQ ID NO: 95620 - RNA, 20 nt, Artificial Sequence
  MKO10095620_B_Kruap4-8
  gRNA
gcagcuggaaaugcagcagc

SEQ ID NO: 95621 - RNA, 20 nt, Artificial Sequence
  MKO10095621_B_Kruap4-9
  gRNA
gcugccagacuaccugcugu

SEQ ID NO: 95622 - RNA, 20 nt, Artificial Sequence
  MKO10095622_B_Kruap4-9
  gRNA
ugguccuacagcagguaguc

SEQ ID NO: 95623 - RNA, 20 nt, Artificial Sequence
  MKO10095623_B_Kruap4-9
  gRNA
gcaacaagugguccugcagc

SEQ ID NO: 95624 - RNA, 20 nt, Artificial Sequence
  MKO10095624_B_Kruap5-1
  gRNA
acacacaggcuugcagcagc

SEQ ID NO: 95625 - RNA, 20 nt, Artificial Sequence
  MKO10095625_B_Kruap5-1
  gRNA
accagaaccaugaccugcug

SEQ ID NO: 95626 - RNA, 20 nt, Artificial Sequence
  MKO10095626_B_Kruap5-1
  gRNA
ucagcagcuguccugacagc

SEQ ID NO: 95627 - RNA, 20 nt, Artificial Sequence
  MKO10095627_B_Kruap5-2
  gRNA
gaaagugucagaucuuacac

SEQ ID NO: 95628 - RNA, 20 nt, Artificial Sequence
  MKO10095628_B_Kruap5-2
  gRNA
gcuucccuugcacccaccac

SEQ ID NO: 95629 - RNA, 20 nt, Artificial Sequence
  MKO10095629_B_Kruap5-2
  gRNA
ggugggugcaagggaagcug

SEQ ID NO: 95630 - RNA, 20 nt, Artificial Sequence
  MKO10095630_B_Kruap5-3
  gRNA
caaaucauccuaucuguuug

SEQ ID NO: 95631 - RNA, 20 nt, Artificial Sequence
  MKO10095631_B_Kruap5-3
  gRNA
uccugcccaucaccucuaau

SEQ ID NO: 95632 - RNA, 20 nt, Artificial Sequence
  MKO10095632_B_Kruap5-3
  gRNA
gaagaauggauggggcucua

SEQ ID NO: 95633 - RNA, 20 nt, Artificial Sequence
  MKO10095633_B_Kruap5-4
  gRNA
ggaaccacagccuccacagc

SEQ ID NO: 95634 - RNA, 20 nt, Artificial Sequence
  MKO10095634_B_Kruap5-4
  gRNA
gcagcaggguuuacagcagc

SEQ ID NO: 95635 - RNA, 20 nt, Artificial Sequence
  MKO10095635_B_Kruap5-4
  gRNA
gccuccuuugcagcccccac

SEQ ID NO: 95636 - RNA, 20 nt, Artificial Sequence
  MKO10095636_B_Kruap5-5
  gRNA
aaggguggcuguggcuccug

SEQ ID NO: 95637 - RNA, 20 nt, Artificial Sequence
  MKO10095637_B_Kruap5-5
  gRNA
accagaaccaugaccugcug

SEQ ID NO: 95638 - RNA, 20 nt, Artificial Sequence
  MKO10095638_B_Kruap5-5
  gRNA
guaaaccucagaucuugcac

SEQ ID NO: 95639 - RNA, 20 nt, Artificial Sequence
  MKO10095639_B_Kruap6-1
  gRNA
aggagccauaaccacagccc

SEQ ID NO: 95640 - RNA, 20 nt, Artificial Sequence
  MKO10095640_B_Kruap6-1
  gRNA
uacuauggcggcagaggcua

SEQ ID NO: 95641 - RNA, 20 nt, Artificial Sequence
  MKO10095641_B_Kruap6-1
  gRNA
guuuccguaguagccacaca

SEQ ID NO: 95642 - RNA, 20 nt, Artificial Sequence
  MKO10095642_B_Kruap6-2
  gRNA
uagauguaacagccauguuc

SEQ ID NO: 95643 - RNA, 20 nt, Artificial Sequence
  MKO10095643_B_Kruap6-2
  gRNA
uauggcucuuacuacagauc

SEQ ID NO: 95644 - RNA, 20 nt, Artificial Sequence
  MKO10095644_B_Kruap6-2
  gRNA
gagacgagacugcagaugcc

SEQ ID NO: 95645 - RNA, 20 nt, Artificial Sequence
  MKO10095645_B_Kruap6-5
  gRNA
agccuccauagccauagccc

SEQ ID NO: 95646 - RNA, 20 nt, Artificial Sequence
  MKO10095646_B_Kruap6-5
  gRNA
agcaccauguguggcuacua

SEQ ID NO: 95647 - RNA, 20 nt, Artificial Sequence
  MKO10095647_B_Kruap6-5
  gRNA
cauagccacagcccagucca

SEQ ID NO: 95648 - RNA, 20 nt, Artificial Sequence
  MKO10095648_B_Kruap7-1
  gRNA
gcuacggcagcagccucuac

SEQ ID NO: 95649 - RNA, 20 nt, Artificial Sequence
  MKO10095649_B_Kruap7-1
  gRNA
guuccauagcagggauaccc

SEQ ID NO: 95650 - RNA, 20 nt, Artificial Sequence
  MKO10095650_B_Kruap7-1
  gRNA
gcagcagaaauagcgaguca

SEQ ID NO: 95651 - RNA, 20 nt, Artificial Sequence
  MKO10095651_B_Kruap8-1
  gRNA
uagcugccccaguagcaucc

SEQ ID NO: 95652 - RNA, 20 nt, Artificial Sequence
  MKO10095652_B_Kruap8-1
  gRNA
gaagacagagcccucagcgc

SEQ ID NO: 95653 - RNA, 20 nt, Artificial Sequence
  MKO10095653_B_Kruap8-1
  gRNA
ggcuauggcuacaauggcug

SEQ ID NO: 95654 - RNA, 20 nt, Artificial Sequence
  MKO10095654_B_Kruap9-1
  gRNA
ccaacauguguuugugugcc

SEQ ID NO: 95655 - RNA, 20 nt, Artificial Sequence
  MKO10095655_B_Kruap9-1
  gRNA
uccagcuguugugagcccug

SEQ ID NO: 95656 - RNA, 20 nt, Artificial Sequence
  MKO10095656_B_Kruap9-1
  gRNA
aacagcuggacccacagccu

SEQ ID NO: 95657 - RNA, 20 nt, Artificial Sequence
  MKO10095657_B_Kruap9-3
  gRNA
uugccagcccagcuguugug

SEQ ID NO: 95658 - RNA, 20 nt, Artificial Sequence
  MKO10095658_B_Kruap9-3
  gRNA
ugcugugcuacaagcuucug

SEQ ID NO: 95659 - RNA, 20 nt, Artificial Sequence
  MKO10095659_B_Kruap9-3
  gRNA
uuuggggguggcauuggcug

SEQ ID NO: 95660 - RNA, 20 nt, Artificial Sequence
  MKO10095660_B_Kruap9-5
  gRNA
uggaaaguugaucaguagca

SEQ ID NO: 95661 - RNA, 20 nt, Artificial Sequence
  MKO10095661_B_Kruap9-5
  gRNA
ugcuccccuugcagucagcu

SEQ ID NO: 95662 - RNA, 20 nt, Artificial Sequence
  MKO10095662_B_Kruap9-5
  gRNA
acagacugguuugcaacaag

SEQ ID NO: 95663 - RNA, 20 nt, Artificial Sequence
  MKO10095663_B_Krucap2
  gRNA
accgaguuugugucaccacu

SEQ ID NO: 95664 - RNA, 20 nt, Artificial Sequence
  MKO10095664_B_Krucap2
  gRNA
cacccaggccuucaauaauc

SEQ ID NO: 95665 - RNA, 20 nt, Artificial Sequence
  MKO10095665_B_Krucap2
  gRNA
cuugcccuugccagugauuu

SEQ ID NO: 95666 - RNA, 20 nt, Artificial Sequence
  MKO10095666_B_Krucap3
  gRNA
cccugguccagcgguaugga

SEQ ID NO: 95667 - RNA, 20 nt, Artificial Sequence
  MKO10095667_B_Krucap3
  gRNA
gcuuccgcagagcguuucag

SEQ ID NO: 95668 - RNA, 20 nt, Artificial Sequence
  MKO10095668_B_Krucap3
  gRNA
ucaccagucgugggcgaaga

SEQ ID NO: 95669 - RNA, 20 nt, Artificial Sequence
  MKO10095669_B_Krtdap
  gRNA
aagaagucccaguuaaugaa

SEQ ID NO: 95670 - RNA, 20 nt, Artificial Sequence
  MKO10095670_B_Krtdap
  gRNA
acuguagccucuuaaaguuc

SEQ ID NO: 95671 - RNA, 20 nt, Artificial Sequence
  MKO10095671_B_Krtdap
  gRNA
augaguuccugaacuuuaag

SEQ ID NO: 95672 - RNA, 20 nt, Artificial Sequence
  MKO10095672_B_Ksr1
  gRNA
uuagugugaccccaagcgac

SEQ ID NO: 95673 - RNA, 20 nt, Artificial Sequence
  MKO10095673_B_Ksr1
  gRNA
ccaggccagucaccuuccga

SEQ ID NO: 95674 - RNA, 20 nt, Artificial Sequence
  MKO10095674_B_Ksr1
  gRNA
ccagcgccgcagcaucuccu

SEQ ID NO: 95675 - RNA, 20 nt, Artificial Sequence
  MKO10095675_B_Ksr2
  gRNA
gggcccguggcccacaaaga

SEQ ID NO: 95676 - RNA, 20 nt, Artificial Sequence
  MKO10095676_B_Ksr2
  gRNA
ccggaucguggauguccgaa

SEQ ID NO: 95677 - RNA, 20 nt, Artificial Sequence
  MKO10095677_B_Ksr2
  gRNA
ccaaccaggaagagugcgcc

SEQ ID NO: 95678 - RNA, 20 nt, Artificial Sequence
  MKO10095678_B_Kti12
  gRNA
aucccagcgguuccgggagu

SEQ ID NO: 95679 - RNA, 20 nt, Artificial Sequence
  MKO10095679_B_Kti12
  gRNA
cguccaccacauacaccgcg

SEQ ID NO: 95680 - RNA, 20 nt, Artificial Sequence
  MKO10095680_B_Kti12
  gRNA
cagaacucccccguuggcua

SEQ ID NO: 95681 - RNA, 20 nt, Artificial Sequence
  MKO10095681_B_Ktn1
  gRNA
gauggcaccuucaaaagagc

SEQ ID NO: 95682 - RNA, 20 nt, Artificial Sequence
  MKO10095682_B_Ktn1
  gRNA
ucgaauaaaggagaacugag

SEQ ID NO: 95683 - RNA, 20 nt, Artificial Sequence
  MKO10095683_B_Ktn1
  gRNA
caucaagacacuaagcaaga

SEQ ID NO: 95684 - RNA, 20 nt, Artificial Sequence
  MKO10095684_B_Kxd1
  gRNA
ggagcccgugcucugcuccg

SEQ ID NO: 95685 - RNA, 20 nt, Artificial Sequence
  MKO10095685_B_Kxd1
  gRNA
ugugauagguccucaaagcc

SEQ ID NO: 95686 - RNA, 20 nt, Artificial Sequence
  MKO10095686_B_Kxd1
  gRNA
gcggccacagaagacccuug

SEQ ID NO: 95687 - RNA, 20 nt, Artificial Sequence
  MKO10095687_B_Kynu
  gRNA
gaaauccuuacaugaucaga

SEQ ID NO: 95688 - RNA, 20 nt, Artificial Sequence
  MKO10095688_B_Kynu
  gRNA
ucuuuaagccuacuccaaag

SEQ ID NO: 95689 - RNA, 20 nt, Artificial Sequence
  MKO10095689_B_Kynu
  gRNA
ugaugaugccaucuauuucc

SEQ ID NO: 95690 - RNA, 20 nt, Artificial Sequence
  MKO10095690_B_Ky
  gRNA
aauccggaaguggcaagagu

SEQ ID NO: 95691 - RNA, 20 nt, Artificial Sequence
  MKO10095691_B_Ky
  gRNA
ccgugggcaucuuucccucc

SEQ ID NO: 95692 - RNA, 20 nt, Artificial Sequence
  MKO10095692_B_Ky
  gRNA
aagagaacuucuuaagcagc

SEQ ID NO: 95693 - RNA, 20 nt, Artificial Sequence
  MKO10095693_B_L1cam
  gRNA
uacagucuccuucggccacu

SEQ ID NO: 95694 - RNA, 20 nt, Artificial Sequence
  MKO10095694_B_L1cam
  gRNA
ggagacuguuccgugaugac

SEQ ID NO: 95695 - RNA, 20 nt, Artificial Sequence
  MKO10095695_B_L1cam
  gRNA
cacccagugcagccccacuu

SEQ ID NO: 95696 - RNA, 20 nt, Artificial Sequence
  MKO10095696_B_L1td1
  gRNA
cugccugccgacauccagcg

SEQ ID NO: 95697 - RNA, 20 nt, Artificial Sequence
  MKO10095697_B_L1td1
  gRNA
aacuucuaggguaaaacgcu

SEQ ID NO: 95698 - RNA, 20 nt, Artificial Sequence
  MKO10095698_B_L1td1
  gRNA
cuucuaccucuuugaugaac

SEQ ID NO: 95699 - RNA, 20 nt, Artificial Sequence
  MKO10095699_B_L2hgdh
  gRNA
ggccuucgacuccauucugc

SEQ ID NO: 95700 - RNA, 20 nt, Artificial Sequence
  MKO10095700_B_L2hgdh
  gRNA
ucccuacaggcaauguggca

SEQ ID NO: 95701 - RNA, 20 nt, Artificial Sequence
  MKO10095701_B_L2hgdh
  gRNA
gcuauugauuguccauacac

SEQ ID NO: 95702 - RNA, 20 nt, Artificial Sequence
  MKO10095702_B_L3hypdh
  gRNA
augcacuugccgcauccaca

SEQ ID NO: 95703 - RNA, 20 nt, Artificial Sequence
  MKO10095703_B_L3hypdh
  gRNA
gccuucaaaagcagcgcaac

SEQ ID NO: 95704 - RNA, 20 nt, Artificial Sequence
  MKO10095704_B_L3hypdh
  gRNA
aucggcaaacacgcagaugu

SEQ ID NO: 95705 - RNA, 20 nt, Artificial Sequence
  MKO10095705_B_L3mbtl1
  gRNA
cggggaccaauagcacaguc

SEQ ID NO: 95706 - RNA, 20 nt, Artificial Sequence
  MKO10095706_B_L3mbtl1
  gRNA
cugacccgcaugccgcuacc

SEQ ID NO: 95707 - RNA, 20 nt, Artificial Sequence
  MKO10095707_B_L3mbtl1
  gRNA
uugcaggaacucgcaucuac

SEQ ID NO: 95708 - RNA, 20 nt, Artificial Sequence
  MKO10095708_B_L3mbtl2
  gRNA
gaacaggacaacuagcagau

SEQ ID NO: 95709 - RNA, 20 nt, Artificial Sequence
  MKO10095709_B_L3mbtl2
  gRNA
ccgcacugcuguuguaacuc

SEQ ID NO: 95710 - RNA, 20 nt, Artificial Sequence
  MKO10095710_B_L3mbtl2
  gRNA
ccuuguaacuaugauccuuc

SEQ ID NO: 95711 - RNA, 20 nt, Artificial Sequence
  MKO10095711_B_L3mbtl3
  gRNA
cgacuucucccccgagcucc

SEQ ID NO: 95712 - RNA, 20 nt, Artificial Sequence
  MKO10095712_B_L3mbtl3
  gRNA
uggaggcgaagacaacgaug

SEQ ID NO: 95713 - RNA, 20 nt, Artificial Sequence
  MKO10095713_B_L3mbtl3
  gRNA
auggucccaacugcucaaga

SEQ ID NO: 95714 - RNA, 20 nt, Artificial Sequence
  MKO10095714_B_L3mbtl4
  gRNA
gugaccacaccuucaaagcg

SEQ ID NO: 95715 - RNA, 20 nt, Artificial Sequence
  MKO10095715_B_L3mbtl4
  gRNA
ucaugcgcucuguagacucu

SEQ ID NO: 95716 - RNA, 20 nt, Artificial Sequence
  MKO10095716_B_L3mbtl4
  gRNA
gcaagauugucucauuuagu

SEQ ID NO: 95717 - RNA, 20 nt, Artificial Sequence
  MKO10095717_B_LOC100038947
  gRNA
agcugucccucagcagacag

SEQ ID NO: 95718 - RNA, 20 nt, Artificial Sequence
  MKO10095718_B_LOC100038947
  gRNA
agcuaaaccaucuucaccua

SEQ ID NO: 95719 - RNA, 20 nt, Artificial Sequence
  MKO10095719_B_LOC100038947
  gRNA
guucagugaccaccacagua

SEQ ID NO: 95720 - RNA, 20 nt, Artificial Sequence
  MKO10095720_B_LOC100040786
  gRNA
uggauucuagcgccuccaag

SEQ ID NO: 95721 - RNA, 20 nt, Artificial Sequence
  MKO10095721_B_LOC100040786
  gRNA
uaaaaauaguccuguaagaa

SEQ ID NO: 95722 - RNA, 20 nt, Artificial Sequence
  MKO10095722_B_LOC100040786
  gRNA
aacaaacccuucucuuuauu

SEQ ID NO: 95723 - RNA, 20 nt, Artificial Sequence
  MKO10095723_B_LOC100048884
  gRNA
gucagcaaccauagauaauu

SEQ ID NO: 95724 - RNA, 20 nt, Artificial Sequence
  MKO10095724_B_LOC100048884
  gRNA
agacuaugauaacuuucuua

SEQ ID NO: 95725 - RNA, 20 nt, Artificial Sequence
  MKO10095725_B_LOC100048884
  gRNA
uaccauagagccccaucagc

SEQ ID NO: 95726 - RNA, 20 nt, Artificial Sequence
  MKO10095726_B_LOC100502896
  gRNA
gaaaugacaaagaagccaau

SEQ ID NO: 95727 - RNA, 20 nt, Artificial Sequence
  MKO10095727_B_LOC100502896
  gRNA
aaagugcauaccuagagaga

SEQ ID NO: 95728 - RNA, 20 nt, Artificial Sequence
  MKO10095728_B_LOC100502896
  gRNA
cacucagguccuugguuuga

SEQ ID NO: 95729 - RNA, 20 nt, Artificial Sequence
  MKO10095729_B_LOC100503280
  gRNA
acaaacaaaaaaaucguagu

SEQ ID NO: 95730 - RNA, 20 nt, Artificial Sequence
  MKO10095730_B_LOC100503280
  gRNA
agugccuuucucuucugcug

SEQ ID NO: 95731 - RNA, 20 nt, Artificial Sequence
  MKO10095731_B_LOC100503280
  gRNA
ucauucacaguguacuccug

SEQ ID NO: 95732 - RNA, 20 nt, Artificial Sequence
  MKO10095732_B_LOC100504608
  gRNA
cucccgugggaacacggauu

SEQ ID NO: 95733 - RNA, 20 nt, Artificial Sequence
  MKO10095733_B_LOC100504608
  gRNA
gacucucgaaauagucacac

SEQ ID NO: 95734 - RNA, 20 nt, Artificial Sequence
  MKO10095734_B_LOC100504608
  gRNA
cucgggugugcgccuugucc

SEQ ID NO: 95735 - RNA, 20 nt, Artificial Sequence
  MKO10095735_B_LOC100861615
  gRNA
guuaucuucuaucaguuccu

SEQ ID NO: 95736 - RNA, 20 nt, Artificial Sequence
  MKO10095736_B_LOC100861615
  gRNA
cucaacucaacgaaaacgua

SEQ ID NO: 95737 - RNA, 20 nt, Artificial Sequence
  MKO10095737_B_LOC100861615
  gRNA
ucauccuaccugcuguuccu

SEQ ID NO: 95738 - RNA, 20 nt, Artificial Sequence
  MKO10095738_B_LOC100862015
  gRNA
cagguccgugugauagcccg

SEQ ID NO: 95739 - RNA, 20 nt, Artificial Sequence
  MKO10095739_B_LOC100862015
  gRNA
aaagugcauaccuagagaga

SEQ ID NO: 95740 - RNA, 20 nt, Artificial Sequence
  MKO10095740_B_LOC100862015
  gRNA
cacucagguccuugguuuga

SEQ ID NO: 95741 - RNA, 20 nt, Artificial Sequence
  MKO10095741_B_LOC101055863
  gRNA
cagguccgugugauagcccg

SEQ ID NO: 95742 - RNA, 20 nt, Artificial Sequence
  MKO10095742_B_LOC101055863
  gRNA
aaagugcauaccuagagaga

SEQ ID NO: 95743 - RNA, 20 nt, Artificial Sequence
  MKO10095743_B_LOC101055863
  gRNA
cacucagguccuugguuuga

SEQ ID NO: 95744 - RNA, 20 nt, Artificial Sequence
  MKO10095744_B_LOC102308570
  gRNA
ccucuaccacaauagagggc

SEQ ID NO: 95745 - RNA, 20 nt, Artificial Sequence
  MKO10095745_B_LOC102308570
  gRNA
aaaucguguucuauagaugc

SEQ ID NO: 95746 - RNA, 20 nt, Artificial Sequence
  MKO10095746_B_LOC102308570
  gRNA
gccccgccugcccucuauug

SEQ ID NO: 95747 - RNA, 20 nt, Artificial Sequence
  MKO10095747_B_LOC666331
  gRNA
ccuugguuuagaucugccau

SEQ ID NO: 95748 - RNA, 20 nt, Artificial Sequence
  MKO10095748_B_LOC666331
  gRNA
ucgugcucugaguugagaag

SEQ ID NO: 95749 - RNA, 20 nt, Artificial Sequence
  MKO10095749_B_LOC666331
  gRNA
cacgaacaugaauauuuaug

SEQ ID NO: 95750 - RNA, 20 nt, Artificial Sequence
  MKO10095750_B_Lacc1
  gRNA
agauaugcccccuguccgug

SEQ ID NO: 95751 - RNA, 20 nt, Artificial Sequence
  MKO10095751_B_Lacc1
  gRNA
aaauuucucugcguuaaauc

SEQ ID NO: 95752 - RNA, 20 nt, Artificial Sequence
  MKO10095752_B_Lacc1
  gRNA
cuuaacuucgguacacagau

SEQ ID NO: 95753 - RNA, 20 nt, Artificial Sequence
  MKO10095753_B_Lace1
  gRNA
ccaaagggccucuauguuua

SEQ ID NO: 95754 - RNA, 20 nt, Artificial Sequence
  MKO10095754_B_Lace1
  gRNA
ccagcaugaagccgugaaaa

SEQ ID NO: 95755 - RNA, 20 nt, Artificial Sequence
  MKO10095755_B_Lace1
  gRNA
caacgucuccauaaacauag

SEQ ID NO: 95756 - RNA, 20 nt, Artificial Sequence
  MKO10095756_B_Lacub2
  gRNA
agaccgagggagccacucuc

SEQ ID NO: 95757 - RNA, 20 nt, Artificial Sequence
  MKO10095757_B_Lacub2
  gRNA
auggcucaccagugucaaug

SEQ ID NO: 95758 - RNA, 20 nt, Artificial Sequence
  MKO10095758_B_Lacub2
  gRNA
ugcugugucaaacucaacca

SEQ ID NO: 95759 - RNA, 20 nt, Artificial Sequence
  MKO10095759_B_Lacubl1
  gRNA
ugcugaugcuguaucgccug

SEQ ID NO: 95760 - RNA, 20 nt, Artificial Sequence
  MKO10095760_B_Lacubl1
  gRNA
ccccggugaagauguguccc

SEQ ID NO: 95761 - RNA, 20 nt, Artificial Sequence
  MKO10095761_B_Lacubl1
  gRNA
cugcucucagcgaccaugac

SEQ ID NO: 95762 - RNA, 20 nt, Artificial Sequence
  MKO10095762_B_Lacub
  gRNA
gcgauucucaugaccguuuc

SEQ ID NO: 95763 - RNA, 20 nt, Artificial Sequence
  MKO10095763_B_Lacub
  gRNA
agaaacuccaaccacgaugc

SEQ ID NO: 95764 - RNA, 20 nt, Artificial Sequence
  MKO10095764_B_Lacub
  gRNA
caugcugacaacuguccagg

SEQ ID NO: 95765 - RNA, 20 nt, Artificial Sequence
  MKO10095765_B_Lad1
  gRNA
ugccucgccggagacugagu

SEQ ID NO: 95766 - RNA, 20 nt, Artificial Sequence
  MKO10095766_B_Lad1
  gRNA
ggcagcucaccugcggguua

SEQ ID NO: 95767 - RNA, 20 nt, Artificial Sequence
  MKO10095767_B_Lad1
  gRNA
cuccuagccuugcccgacag

SEQ ID NO: 95768 - RNA, 20 nt, Artificial Sequence
  MKO10095768_B_Lag3
  gRNA
gaugaccgccaacgugacag

SEQ ID NO: 95769 - RNA, 20 nt, Artificial Sequence
  MKO10095769_B_Lag3
  gRNA
ccuaacuuucuacgaagagg

SEQ ID NO: 95770 - RNA, 20 nt, Artificial Sequence
  MKO10095770_B_Lag3
  gRNA
cugacaguguacgcugcuga

SEQ ID NO: 95771 - RNA, 20 nt, Artificial Sequence
  MKO10095771_B_Lage3
  gRNA
cagacuagccgcuguugucc

SEQ ID NO: 95772 - RNA, 20 nt, Artificial Sequence
  MKO10095772_B_Lage3
  gRNA
uucccuaccaguccucgaug

SEQ ID NO: 95773 - RNA, 20 nt, Artificial Sequence
  MKO10095773_B_Lage3
  gRNA
gcuguaugguguucaccacu

SEQ ID NO: 95774 - RNA, 20 nt, Artificial Sequence
  MKO10095774_B_Lair1
  gRNA
gccugaggaagcagaacaga

SEQ ID NO: 95775 - RNA, 20 nt, Artificial Sequence
  MKO10095775_B_Lair1
  gRNA
cccuucuguucugcuuccuc

SEQ ID NO: 95776 - RNA, 20 nt, Artificial Sequence
  MKO10095776_B_Lair1
  gRNA
acaacaaaagacagcagcag

SEQ ID NO: 95777 - RNA, 20 nt, Artificial Sequence
  MKO10095777_B_Lalba
  gRNA
agaguuauuggaugacgagu

SEQ ID NO: 95778 - RNA, 20 nt, Artificial Sequence
  MKO10095778_B_Lalba
  gRNA
gcaacgacaaaauacacacc

SEQ ID NO: 95779 - RNA, 20 nt, Artificial Sequence
  MKO10095779_B_Lalba
  gRNA
gcucugagaagcuugaacag

SEQ ID NO: 95780 - RNA, 20 nt, Artificial Sequence
  MKO10095780_B_Lama1
  gRNA
cuguucgacacgcccaaugc

SEQ ID NO: 95781 - RNA, 20 nt, Artificial Sequence
  MKO10095781_B_Lama1
  gRNA
caccucguauuauucaaagc

SEQ ID NO: 95782 - RNA, 20 nt, Artificial Sequence
  MKO10095782_B_Lama1
  gRNA
caccagcuuugaauaauacg

SEQ ID NO: 95783 - RNA, 20 nt, Artificial Sequence
  MKO10095783_B_Lama2
  gRNA
ggaacguucccuggaugacg

SEQ ID NO: 95784 - RNA, 20 nt, Artificial Sequence
  MKO10095784_B_Lama2
  gRNA
gugcauucgaagcaagauuc

SEQ ID NO: 95785 - RNA, 20 nt, Artificial Sequence
  MKO10095785_B_Lama2
  gRNA
acccgagauguacugcaagu

SEQ ID NO: 95786 - RNA, 20 nt, Artificial Sequence
  MKO10095786_B_Lama3
  gRNA
guuccgauccaucaauugca

SEQ ID NO: 95787 - RNA, 20 nt, Artificial Sequence
  MKO10095787_B_Lama3
  gRNA
agcaaacauggcaauuaccc

SEQ ID NO: 95788 - RNA, 20 nt, Artificial Sequence
  MKO10095788_B_Lama3
  gRNA
uuacgagcaaaauacugcca

SEQ ID NO: 95789 - RNA, 20 nt, Artificial Sequence
  MKO10095789_B_Lama4
  gRNA
acagcguucacacuugaauc

SEQ ID NO: 95790 - RNA, 20 nt, Artificial Sequence
  MKO10095790_B_Lama4
  gRNA
cuguuucagagaugugacgc

SEQ ID NO: 95791 - RNA, 20 nt, Artificial Sequence
  MKO10095791_B_Lama4
  gRNA
cugacuuaccagacagaauc

SEQ ID NO: 95792 - RNA, 20 nt, Artificial Sequence
  MKO10095792_B_Lama5
  gRNA
uuggugaagucucgaaguaa

SEQ ID NO: 95793 - RNA, 20 nt, Artificial Sequence
  MKO10095793_B_Lama5
  gRNA
ucggucacacuuaucagccg

SEQ ID NO: 95794 - RNA, 20 nt, Artificial Sequence
  MKO10095794_B_Lama5
  gRNA
ccagcgcuccgugccaucga

SEQ ID NO: 95795 - RNA, 20 nt, Artificial Sequence
  MKO10095795_B_Lamb1
  gRNA
ccgauugccaccagaucuua

SEQ ID NO: 95796 - RNA, 20 nt, Artificial Sequence
  MKO10095796_B_Lamb1
  gRNA
cagccgccaugcugaucgag

SEQ ID NO: 95797 - RNA, 20 nt, Artificial Sequence
  MKO10095797_B_Lamb1
  gRNA
agaagaccgcucgaucagca

SEQ ID NO: 95798 - RNA, 20 nt, Artificial Sequence
  MKO10095798_B_Lamb2
  gRNA
gcaccuugaacgucauaaug

SEQ ID NO: 95799 - RNA, 20 nt, Artificial Sequence
  MKO10095799_B_Lamb2
  gRNA
accaacaggucaccgguggc

SEQ ID NO: 95800 - RNA, 20 nt, Artificial Sequence
  MKO10095800_B_Lamb2
  gRNA
ccaccucauuaugacguuca

SEQ ID NO: 95801 - RNA, 20 nt, Artificial Sequence
  MKO10095801_B_Lamb3
  gRNA
auggaggguguaccaguacc

SEQ ID NO: 95802 - RNA, 20 nt, Artificial Sequence
  MKO10095802_B_Lamb3
  gRNA
acgaugcgacauucuccacu

SEQ ID NO: 95803 - RNA, 20 nt, Artificial Sequence
  MKO10095803_B_Lamb3
  gRNA
auaacaggccccucgggagc

SEQ ID NO: 95804 - RNA, 20 nt, Artificial Sequence
  MKO10095804_B_Lamc1
  gRNA
ucgccaucuauaagcgcacu

SEQ ID NO: 95805 - RNA, 20 nt, Artificial Sequence
  MKO10095805_B_Lamc1
  gRNA
cucaaucgccugaacaccuu

SEQ ID NO: 95806 - RNA, 20 nt, Artificial Sequence
  MKO10095806_B_Lamc1
  gRNA
uucccgagugcgcuuauaga

SEQ ID NO: 95807 - RNA, 20 nt, Artificial Sequence
  MKO10095807_B_Lamc2
  gRNA
uucugcugcaggugccgacc

SEQ ID NO: 95808 - RNA, 20 nt, Artificial Sequence
  MKO10095808_B_Lamc2
  gRNA
auccagcaucggugagcaua

SEQ ID NO: 95809 - RNA, 20 nt, Artificial Sequence
  MKO10095809_B_Lamc2
  gRNA
cacugaagucggcagaggcg

SEQ ID NO: 95810 - RNA, 20 nt, Artificial Sequence
  MKO10095810_B_Lamc3
  gRNA
cugaggagugcacguuugac

SEQ ID NO: 95811 - RNA, 20 nt, Artificial Sequence
  MKO10095811_B_Lamc3
  gRNA
ucggcggugccucgggccca

SEQ ID NO: 95812 - RNA, 20 nt, Artificial Sequence
  MKO10095812_B_Lamc3
  gRNA
acgcucgcaguccacuccug

SEQ ID NO: 95813 - RNA, 20 nt, Artificial Sequence
  MKO10095813_B_Lamp1
  gRNA
accaccuacgagacugcgaa

SEQ ID NO: 95814 - RNA, 20 nt, Artificial Sequence
  MKO10095814_B_Lamp1
  gRNA
guauccaaguacaauguuac

SEQ ID NO: 95815 - RNA, 20 nt, Artificial Sequence
  MKO10095815_B_Lamp1
  gRNA
agaaugugaccguugugcuc

SEQ ID NO: 95816 - RNA, 20 nt, Artificial Sequence
  MKO10095816_B_Lamp2
  gRNA
gccaaaauaaugauacaauu

SEQ ID NO: 95817 - RNA, 20 nt, Artificial Sequence
  MKO10095817_B_Lamp2
  gRNA
cuccugucguucagaaauau

SEQ ID NO: 95818 - RNA, 20 nt, Artificial Sequence
  MKO10095818_B_Lamp2
  gRNA
gaucacgaugugccucucuc

SEQ ID NO: 95819 - RNA, 20 nt, Artificial Sequence
  MKO10095819_B_Lamp3
  gRNA
cccagccuaacccaugcauc

SEQ ID NO: 95820 - RNA, 20 nt, Artificial Sequence
  MKO10095820_B_Lamp3
  gRNA
cuucgaaaucaaaggccuga

SEQ ID NO: 95821 - RNA, 20 nt, Artificial Sequence
  MKO10095821_B_Lamp3
  gRNA
ugauauucacagauccaccc

SEQ ID NO: 95822 - RNA, 20 nt, Artificial Sequence
  MKO10095822_B_Lamp5
  gRNA
ccuccagcuccgacucguug

SEQ ID NO: 95823 - RNA, 20 nt, Artificial Sequence
  MKO10095823_B_Lamp5
  gRNA
aaaugggacgacgugucuca

SEQ ID NO: 95824 - RNA, 20 nt, Artificial Sequence
  MKO10095824_B_Lamp5
  gRNA
ccacuguggccacaacgagu

SEQ ID NO: 95825 - RNA, 20 nt, Artificial Sequence
  MKO10095825_B_Lamtor1
  gRNA
caccugcugcaagucagaga

SEQ ID NO: 95826 - RNA, 20 nt, Artificial Sequence
  MKO10095826_B_Lamtor1
  gRNA
acgguggcagcuucuuccaa

SEQ ID NO: 95827 - RNA, 20 nt, Artificial Sequence
  MKO10095827_B_Lamtor1
  gRNA
cuuaccuguacugccuugcc

SEQ ID NO: 95828 - RNA, 20 nt, Artificial Sequence
  MKO10095828_B_Lamtor2
  gRNA
cgcaggcaugcugcguccca

SEQ ID NO: 95829 - RNA, 20 nt, Artificial Sequence
  MKO10095829_B_Lamtor2
  gRNA
uagcaccugcgucaaagccu

SEQ ID NO: 95830 - RNA, 20 nt, Artificial Sequence
  MKO10095830_B_Lamtor2
  gRNA
cguaggcuucggaaugcuca

SEQ ID NO: 95831 - RNA, 20 nt, Artificial Sequence
  MKO10095831_B_Lamtor3
  gRNA
auuguugugucagauagaga

SEQ ID NO: 95832 - RNA, 20 nt, Artificial Sequence
  MKO10095832_B_Lamtor3
  gRNA
aaaguccgaguuugcugccu

SEQ ID NO: 95833 - RNA, 20 nt, Artificial Sequence
  MKO10095833_B_Lamtor3
  gRNA
ccagagcacgcccugagacc

SEQ ID NO: 95834 - RNA, 20 nt, Artificial Sequence
  MKO10095834_B_Lamtor4
  gRNA
uagacuuccgcacugaccca

SEQ ID NO: 95835 - RNA, 20 nt, Artificial Sequence
  MKO10095835_B_Lamtor4
  gRNA
cuuuggugaacacacgcugc

SEQ ID NO: 95836 - RNA, 20 nt, Artificial Sequence
  MKO10095836_B_Lamtor4
  gRNA
agaggguguuuguagugaag

SEQ ID NO: 95837 - RNA, 20 nt, Artificial Sequence
  MKO10095837_B_Lamtor5
  gRNA
cuccagcgugcucauccgac

SEQ ID NO: 95838 - RNA, 20 nt, Artificial Sequence
  MKO10095838_B_Lamtor5
  gRNA
guccuugugaaucugugcau

SEQ ID NO: 95839 - RNA, 20 nt, Artificial Sequence
  MKO10095839_B_Lamtor5
  gRNA
augaagaauccauccauugu

SEQ ID NO: 95840 - RNA, 20 nt, Artificial Sequence
  MKO10095840_B_Lancl1
  gRNA
agagcauuucauuugguacg

SEQ ID NO: 95841 - RNA, 20 nt, Artificial Sequence
  MKO10095841_B_Lancl1
  gRNA
gucaagcgaugugagaacuc

SEQ ID NO: 95842 - RNA, 20 nt, Artificial Sequence
  MKO10095842_B_Lancl1
  gRNA
cagcccccacguaauauucc

SEQ ID NO: 95843 - RNA, 20 nt, Artificial Sequence
  MKO10095843_B_Lancl2
  gRNA
cguccauacagcaguucauc

SEQ ID NO: 95844 - RNA, 20 nt, Artificial Sequence
  MKO10095844_B_Lancl2
  gRNA
uggugagacagcuauuaaag

SEQ ID NO: 95845 - RNA, 20 nt, Artificial Sequence
  MKO10095845_B_Lancl2
  gRNA
caucuacuacaugcuaaugc

SEQ ID NO: 95846 - RNA, 20 nt, Artificial Sequence
  MKO10095846_B_Lancl3
  gRNA
aauauaucuaccgugcccaa

SEQ ID NO: 95847 - RNA, 20 nt, Artificial Sequence
  MKO10095847_B_Lancl3
  gRNA
uuccguaguaagaauacauc

SEQ ID NO: 95848 - RNA, 20 nt, Artificial Sequence
  MKO10095848_B_Lancl3
  gRNA
cacaccagcucccgaucuga

SEQ ID NO: 95849 - RNA, 20 nt, Artificial Sequence
  MKO10095849_B_Lao1
  gRNA
aguggcagcuaagacccuac

SEQ ID NO: 95850 - RNA, 20 nt, Artificial Sequence
  MKO10095850_B_Lao1
  gRNA
uuaugacucuuacuccacca

SEQ ID NO: 95851 - RNA, 20 nt, Artificial Sequence
  MKO10095851_B_Lao1
  gRNA
agagcaggaucccccaaaca

SEQ ID NO: 95852 - RNA, 20 nt, Artificial Sequence
  MKO10095852_B_Lap3
  gRNA
ucucccgcacuuguaaauug

SEQ ID NO: 95853 - RNA, 20 nt, Artificial Sequence
  MKO10095853_B_Lap3
  gRNA
aaccuucuauggucugcauc

SEQ ID NO: 95854 - RNA, 20 nt, Artificial Sequence
  MKO10095854_B_Lap3
  gRNA
agcagcuugcgcaucuccac

SEQ ID NO: 95855 - RNA, 20 nt, Artificial Sequence
  MKO10095855_B_Laptm4a
  gRNA
auuuggaugagucaccucca

SEQ ID NO: 95856 - RNA, 20 nt, Artificial Sequence
  MKO10095856_B_Laptm4a
  gRNA
guuuauaaucaguucaaugc

SEQ ID NO: 95857 - RNA, 20 nt, Artificial Sequence
  MKO10095857_B_Laptm4a
  gRNA
ucaucuuuguaugggaaauc

SEQ ID NO: 95858 - RNA, 20 nt, Artificial Sequence
  MKO10095858_B_Laptm4b
  gRNA
ucugcagaucaucaaugcug

SEQ ID NO: 95859 - RNA, 20 nt, Artificial Sequence
  MKO10095859_B_Laptm4b
  gRNA
gccugaaaagugauacugau

SEQ ID NO: 95860 - RNA, 20 nt, Artificial Sequence
  MKO10095860_B_Laptm4b
  gRNA
caugauccugauaugugcca

SEQ ID NO: 95861 - RNA, 20 nt, Artificial Sequence
  MKO10095861_B_Laptm5
  gRNA
ucuucaagaugccguaccuc

SEQ ID NO: 95862 - RNA, 20 nt, Artificial Sequence
  MKO10095862_B_Laptm5
  gRNA
cagcguacuugaagcuugcc

SEQ ID NO: 95863 - RNA, 20 nt, Artificial Sequence
  MKO10095863_B_Laptm5
  gRNA
guaggugggcacuuccaugu

SEQ ID NO: 95864 - RNA, 20 nt, Artificial Sequence
  MKO10095864_B_Large
  gRNA
agugcguguucgagaaguug

SEQ ID NO: 95865 - RNA, 20 nt, Artificial Sequence
  MKO10095865_B_Large
  gRNA
auuguauccggcacagacga

SEQ ID NO: 95866 - RNA, 20 nt, Artificial Sequence
  MKO10095866_B_Large
  gRNA
cugucuagucugaagugucc

SEQ ID NO: 95867 - RNA, 20 nt, Artificial Sequence
  MKO10095867_B_Larp1b
  gRNA
aucauaguaauacaucaugc

SEQ ID NO: 95868 - RNA, 20 nt, Artificial Sequence
  MKO10095868_B_Larp1b
  gRNA
ucucagaguguuaucaacca

SEQ ID NO: 95869 - RNA, 20 nt, Artificial Sequence
  MKO10095869_B_Larp1b
  gRNA
uccuacugagaacaucagcg

SEQ ID NO: 95870 - RNA, 20 nt, Artificial Sequence
  MKO10095870_B_Larp1
  gRNA
acgggaggccaauuucucuc

SEQ ID NO: 95871 - RNA, 20 nt, Artificial Sequence
  MKO10095871_B_Larp1
  gRNA
ucuucuucugcccgccucgc

SEQ ID NO: 95872 - RNA, 20 nt, Artificial Sequence
  MKO10095872_B_Larp1
  gRNA
cuuaccuugcugcccuuacg

SEQ ID NO: 95873 - RNA, 20 nt, Artificial Sequence
  MKO10095873_B_Larp4b
  gRNA
cuguuggugugaaugcugcg

SEQ ID NO: 95874 - RNA, 20 nt, Artificial Sequence
  MKO10095874_B_Larp4b
  gRNA
cgcaaaccacuucucaaaca

SEQ ID NO: 95875 - RNA, 20 nt, Artificial Sequence
  MKO10095875_B_Larp4b
  gRNA
ugaauuaccugagucaaagc

SEQ ID NO: 95876 - RNA, 20 nt, Artificial Sequence
  MKO10095876_B_Larp4
  gRNA
guuuagcaggugacaucuaa

SEQ ID NO: 95877 - RNA, 20 nt, Artificial Sequence
  MKO10095877_B_Larp4
  gRNA
uuucagagaaaauuuaucaa

SEQ ID NO: 95878 - RNA, 20 nt, Artificial Sequence
  MKO10095878_B_Larp4
  gRNA
cucagggugagauccagaug

SEQ ID NO: 95879 - RNA, 20 nt, Artificial Sequence
  MKO10095879_B_Larp6
  gRNA
gggugguccuccuaaccuuc

SEQ ID NO: 95880 - RNA, 20 nt, Artificial Sequence
  MKO10095880_B_Larp6
  gRNA
ggcgacacggaucugcaccg

SEQ ID NO: 95881 - RNA, 20 nt, Artificial Sequence
  MKO10095881_B_Larp6
  gRNA
uacaguagugccacgacaag

SEQ ID NO: 95882 - RNA, 20 nt, Artificial Sequence
  MKO10095882_B_Larp7
  gRNA
ugagagaccaaaggacgagg

SEQ ID NO: 95883 - RNA, 20 nt, Artificial Sequence
  MKO10095883_B_Larp7
  gRNA
agauguggacauuucucucc

SEQ ID NO: 95884 - RNA, 20 nt, Artificial Sequence
  MKO10095884_B_Larp7
  gRNA
ccaaaaauguuacucauagc

SEQ ID NO: 95885 - RNA, 20 nt, Artificial Sequence
  MKO10095885_B_Lars2
  gRNA
cccucagcgacaccauugca

SEQ ID NO: 95886 - RNA, 20 nt, Artificial Sequence
  MKO10095886_B_Lars2
  gRNA
gccucggccugugcuucagc

SEQ ID NO: 95887 - RNA, 20 nt, Artificial Sequence
  MKO10095887_B_Lars2
  gRNA
augucagguuaucaacccca

SEQ ID NO: 95888 - RNA, 20 nt, Artificial Sequence
  MKO10095888_B_Lars
  gRNA
ugcuaaaguagacuucuuga

SEQ ID NO: 95889 - RNA, 20 nt, Artificial Sequence
  MKO10095889_B_Lars
  gRNA
accaguacagugcaacccaa

SEQ ID NO: 95890 - RNA, 20 nt, Artificial Sequence
  MKO10095890_B_Lars
  gRNA
aaaacgugugucccaaauga

SEQ ID NO: 95891 - RNA, 20 nt, Artificial Sequence
  MKO10095891_B_Las1l
  gRNA
guuaggcaacgaacugcccc

SEQ ID NO: 95892 - RNA, 20 nt, Artificial Sequence
  MKO10095892_B_Las1l
  gRNA
gaugaacuuagacugcucua

SEQ ID NO: 95893 - RNA, 20 nt, Artificial Sequence
  MKO10095893_B_Las1l
  gRNA
uaucucuucaaguacaucau

SEQ ID NO: 95894 - RNA, 20 nt, Artificial Sequence
  MKO10095894_B_Lasp1
  gRNA
aaaacucacgcauugcagua

SEQ ID NO: 95895 - RNA, 20 nt, Artificial Sequence
  MKO10095895_B_Lasp1
  gRNA
cauaucccgaccagugcccc

SEQ ID NO: 95896 - RNA, 20 nt, Artificial Sequence
  MKO10095896_B_Lasp1
  gRNA
agggucucacauugcugauc

SEQ ID NO: 95897 - RNA, 20 nt, Artificial Sequence
  MKO10095897_B_Lau2
  gRNA
cuccaaacaagucauuugaa

SEQ ID NO: 95898 - RNA, 20 nt, Artificial Sequence
  MKO10095898_B_Lau2
  gRNA
gcuguguccaucuggggucc

SEQ ID NO: 95899 - RNA, 20 nt, Artificial Sequence
  MKO10095899_B_Lau2
  gRNA
aaaugcacagagcucagcug

SEQ ID NO: 95900 - RNA, 20 nt, Artificial Sequence
  MKO10095900_B_Laus1
  gRNA
ggugguggaccuugauagcu

SEQ ID NO: 95901 - RNA, 20 nt, Artificial Sequence
  MKO10095901_B_Laus1
  gRNA
gcgaugucuagcccauucuc

SEQ ID NO: 95902 - RNA, 20 nt, Artificial Sequence
  MKO10095902_B_Laus1
  gRNA
ccugaagugcuacugcgaac

SEQ ID NO: 95903 - RNA, 20 nt, Artificial Sequence
  MKO10095903_B_Laus2
  gRNA
augagagccaccccgaaguu

SEQ ID NO: 95904 - RNA, 20 nt, Artificial Sequence
  MKO10095904_B_Laus2
  gRNA
ucgcacaaucugcucauucc

SEQ ID NO: 95905 - RNA, 20 nt, Artificial Sequence
  MKO10095905_B_Laus2
  gRNA
gacggcuggcuccgugcuuc

SEQ ID NO: 95906 - RNA, 20 nt, Artificial Sequence
  MKO10095906_B_Lau
  gRNA
cucuguggaagugcugucau

SEQ ID NO: 95907 - RNA, 20 nt, Artificial Sequence
  MKO10095907_B_Lau
  gRNA
uggcugccucagggguggga

SEQ ID NO: 95908 - RNA, 20 nt, Artificial Sequence
  MKO10095908_B_Lau
  gRNA
aggagauccccacagccccu

SEQ ID NO: 95909 - RNA, 20 nt, Artificial Sequence
  MKO10095909_B_Lax1
  gRNA
gucaggagcacgacaaagcc

SEQ ID NO: 95910 - RNA, 20 nt, Artificial Sequence
  MKO10095910_B_Lax1
  gRNA
uacaggcagcuaugaugacc

SEQ ID NO: 95911 - RNA, 20 nt, Artificial Sequence
  MKO10095911_B_Lax1
  gRNA
gcagggagacaucaguugag

SEQ ID NO: 95912 - RNA, 20 nt, Artificial Sequence
  MKO10095912_B_Layn
  gRNA
uccucugggguccaaguccg

SEQ ID NO: 95913 - RNA, 20 nt, Artificial Sequence
  MKO10095913_B_Layn
  gRNA
cuagggcagcuggucugccg

SEQ ID NO: 95914 - RNA, 20 nt, Artificial Sequence
  MKO10095914_B_Layn
  gRNA
cuuaccuccaggccaaauag

SEQ ID NO: 95915 - RNA, 20 nt, Artificial Sequence
  MKO10095915_B_Lbh
  gRNA
ugaccguugcugcaagcuga

SEQ ID NO: 95916 - RNA, 20 nt, Artificial Sequence
  MKO10095916_B_Lbh
  gRNA
aggauacucaccagugaaug

SEQ ID NO: 95917 - RNA, 20 nt, Artificial Sequence
  MKO10095917_B_Lbh
  gRNA
cuguauauuuccccauucac

SEQ ID NO: 95918 - RNA, 20 nt, Artificial Sequence
  MKO10095918_B_Lbp
  gRNA
cagcagccgcauuugugauu

SEQ ID NO: 95919 - RNA, 20 nt, Artificial Sequence
  MKO10095919_B_Lbp
  gRNA
cauuucaguggaccuccucc

SEQ ID NO: 95920 - RNA, 20 nt, Artificial Sequence
  MKO10095920_B_Lbp
  gRNA
gucgaagcuccagaaaguac

SEQ ID NO: 95921 - RNA, 20 nt, Artificial Sequence
  MKO10095921_B_Lbr
  gRNA
agguaaacgccgcacacccu

SEQ ID NO: 95922 - RNA, 20 nt, Artificial Sequence
  MKO10095922_B_Lbr
  gRNA
uacgccguauaaagacaagc

SEQ ID NO: 95923 - RNA, 20 nt, Artificial Sequence
  MKO10095923_B_Lbr
  gRNA
ugugcggcguuuaccuccuc

SEQ ID NO: 95924 - RNA, 20 nt, Artificial Sequence
  MKO10095924_B_Lbx1
  gRNA
ggccgcggacaagcacgcgc

SEQ ID NO: 95925 - RNA, 20 nt, Artificial Sequence
  MKO10095925_B_Lbx1
  gRNA
gcagauggacaucguggcgc

SEQ ID NO: 95926 - RNA, 20 nt, Artificial Sequence
  MKO10095926_B_Lbx1
  gRNA
cacgauguccaucugcccgc

SEQ ID NO: 95927 - RNA, 20 nt, Artificial Sequence
  MKO10095927_B_Lbx2
  gRNA
uuuaguaucgcagacauccu

SEQ ID NO: 95928 - RNA, 20 nt, Artificial Sequence
  MKO10095928_B_Lbx2
  gRNA
cgacggacuugcugcgcgac

SEQ ID NO: 95929 - RNA, 20 nt, Artificial Sequence
  MKO10095929_B_Lbx2
  gRNA
uccggagacgccgcaagucu

SEQ ID NO: 95930 - RNA, 20 nt, Artificial Sequence
  MKO10095930_B_Lca5l
  gRNA
gagaaaaggaaguacaacgc

SEQ ID NO: 95931 - RNA, 20 nt, Artificial Sequence
  MKO10095931_B_Lca5l
  gRNA
gacagcuggccaaagaaaau

SEQ ID NO: 95932 - RNA, 20 nt, Artificial Sequence
  MKO10095932_B_Lca5l
  gRNA
ucaggagaaggaccgugagc

SEQ ID NO: 95933 - RNA, 20 nt, Artificial Sequence
  MKO10095933_B_Lca5
  gRNA
acaggagcuaucgaagaacc

SEQ ID NO: 95934 - RNA, 20 nt, Artificial Sequence
  MKO10095934_B_Lca5
  gRNA
uuucagcgagcagcugccgc

SEQ ID NO: 95935 - RNA, 20 nt, Artificial Sequence
  MKO10095935_B_Lca5
  gRNA
ucagacgaauaaugagagua

SEQ ID NO: 95936 - RNA, 20 nt, Artificial Sequence
  MKO10095936_B_Lcau
  gRNA
gaggagauguaugccgcuua

SEQ ID NO: 95937 - RNA, 20 nt, Artificial Sequence
  MKO10095937_B_Lcau
  gRNA
ugcgggccgcacccuaugac

SEQ ID NO: 95938 - RNA, 20 nt, Artificial Sequence
  MKO10095938_B_Lcau
  gRNA
ugguuaacaacggauaugug

SEQ ID NO: 95939 - RNA, 20 nt, Artificial Sequence
  MKO10095939_B_Lce1a1
  gRNA
cccagaacccagacuacagc

SEQ ID NO: 95940 - RNA, 20 nt, Artificial Sequence
  MKO10095940_B_Lce1a1
  gRNA
gacacagggggacacuuggg

SEQ ID NO: 95941 - RNA, 20 nt, Artificial Sequence
  MKO10095941_B_Lce1a1
  gRNA
agcagcagccuccagacugc

SEQ ID NO: 95942 - RNA, 20 nt, Artificial Sequence
  MKO10095942_B_Lce1a2
  gRNA
cacagcaacccccagaaccc

SEQ ID NO: 95943 - RNA, 20 nt, Artificial Sequence
  MKO10095943_B_Lce1a2
  gRNA
gguugcuguggcuccagcuc

SEQ ID NO: 95944 - RNA, 20 nt, Artificial Sequence
  MKO10095944_B_Lce1a2
  gRNA
ugugucuuccugcuguagcc

SEQ ID NO: 95945 - RNA, 20 nt, Artificial Sequence
  MKO10095945_B_Lce1b
  gRNA
gggugcacuugggagggggc

SEQ ID NO: 95946 - RNA, 20 nt, Artificial Sequence
  MKO10095946_B_Lce1b
  gRNA
cugcugcugguucugcuggc

SEQ ID NO: 95947 - RNA, 20 nt, Artificial Sequence
  MKO10095947_B_Lce1b
  gRNA
gguuguuguggcuccagcuc

SEQ ID NO: 95948 - RNA, 20 nt, Artificial Sequence
  MKO10095948_B_Lce1c
  gRNA
cugcugcuggcucugcuggc

SEQ ID NO: 95949 - RNA, 20 nt, Artificial Sequence
  MKO10095949_B_Lce1c
  gRNA
agcauccagagcugugacga

SEQ ID NO: 95950 - RNA, 20 nt, Artificial Sequence
  MKO10095950_B_Lce1c
  gRNA
ggcugcuguggcuccagcuc

SEQ ID NO: 95951 - RNA, 20 nt, Artificial Sequence
  MKO10095951_B_Lce1d
  gRNA
gggugcacuugggaggaggc

SEQ ID NO: 95952 - RNA, 20 nt, Artificial Sequence
  MKO10095952_B_Lce1d
  gRNA
cugcuguuggcuuugcuggc

SEQ ID NO: 95953 - RNA, 20 nt, Artificial Sequence
  MKO10095953_B_Lce1d
  gRNA
ggcugcuguggcuccagcuc

SEQ ID NO: 95954 - RNA, 20 nt, Artificial Sequence
  MKO10095954_B_Lce1e
  gRNA
agcagcaguccccagacugc

SEQ ID NO: 95955 - RNA, 20 nt, Artificial Sequence
  MKO10095955_B_Lce1e
  gRNA
cugcugcuggcucugcugac

SEQ ID NO: 95956 - RNA, 20 nt, Artificial Sequence
  MKO10095956_B_Lce1e
  gRNA
ggcugcuguggcuccagcuc

SEQ ID NO: 95957 - RNA, 20 nt, Artificial Sequence
  MKO10095957_B_Lce1f
  gRNA
aacauccagagcugugacga

SEQ ID NO: 95958 - RNA, 20 nt, Artificial Sequence
  MKO10095958_B_Lce1f
  gRNA
ugugucuuccugcuguagcc

SEQ ID NO: 95959 - RNA, 20 nt, Artificial Sequence
  MKO10095959_B_Lce1f
  gRNA
gagggggcuggcacugcugc

SEQ ID NO: 95960 - RNA, 20 nt, Artificial Sequence
  MKO10095960_B_Lce1g
  gRNA
agcagcaguccccagacugc

SEQ ID NO: 95961 - RNA, 20 nt, Artificial Sequence
  MKO10095961_B_Lce1g
  gRNA
caggggcuuggcacugcugc

SEQ ID NO: 95962 - RNA, 20 nt, Artificial Sequence
  MKO10095962_B_Lce1g
  gRNA
ggcuguuguggcuccagcuc

SEQ ID NO: 95963 - RNA, 20 nt, Artificial Sequence
  MKO10095963_B_Lce1h
  gRNA
uguggcagcaguggcagcag

SEQ ID NO: 95964 - RNA, 20 nt, Artificial Sequence
  MKO10095964_B_Lce1h
  gRNA
ugugucuuccugcuguagcu

SEQ ID NO: 95965 - RNA, 20 nt, Artificial Sequence
  MKO10095965_B_Lce1h
  gRNA
agcagcagcccccagacugc

SEQ ID NO: 95966 - RNA, 20 nt, Artificial Sequence
  MKO10095966_B_Lce1i
  gRNA
agcagcagcccccagacugc

SEQ ID NO: 95967 - RNA, 20 nt, Artificial Sequence
  MKO10095967_B_Lce1i
  gRNA
uguggcagcagugguggcag

SEQ ID NO: 95968 - RNA, 20 nt, Artificial Sequence
  MKO10095968_B_Lce1i
  gRNA
uguggcaguagccagcaguc

SEQ ID NO: 95969 - RNA, 20 nt, Artificial Sequence
  MKO10095969_B_Lce1j
  gRNA
ugugucuuccugcuguagcc

SEQ ID NO: 95970 - RNA, 20 nt, Artificial Sequence
  MKO10095970_B_Lce1j
  gRNA
agcagcagcccccagacugc

SEQ ID NO: 95971 - RNA, 20 nt, Artificial Sequence
  MKO10095971_B_Lce1j
  gRNA
caggggcuuggcacugcugc

SEQ ID NO: 95972 - RNA, 20 nt, Artificial Sequence
  MKO10095972_B_Lce1k
  gRNA
ugcagcaacccccagaaccc

SEQ ID NO: 95973 - RNA, 20 nt, Artificial Sequence
  MKO10095973_B_Lce1k
  gRNA
ugacgacggagagaucugcg

SEQ ID NO: 95974 - RNA, 20 nt, Artificial Sequence
  MKO10095974_B_Lce1k
  gRNA
gcugcugccugagucaccac

SEQ ID NO: 95975 - RNA, 20 nt, Artificial Sequence
  MKO10095975_B_Lce1l
  gRNA
gcacuugggagggcacuuag

SEQ ID NO: 95976 - RNA, 20 nt, Artificial Sequence
  MKO10095976_B_Lce1l
  gRNA
agcauccagagcugugucga

SEQ ID NO: 95977 - RNA, 20 nt, Artificial Sequence
  MKO10095977_B_Lce1l
  gRNA
cgucgccaucgacacagcuc

SEQ ID NO: 95978 - RNA, 20 nt, Artificial Sequence
  MKO10095978_B_Lce1m
  gRNA
ggagagagaaucggggcuug

SEQ ID NO: 95979 - RNA, 20 nt, Artificial Sequence
  MKO10095979_B_Lce1m
  gRNA
cgucgccgacgucacagcuc

SEQ ID NO: 95980 - RNA, 20 nt, Artificial Sequence
  MKO10095980_B_Lce1m
  gRNA
agcaacagccaucagcaguc

SEQ ID NO: 95981 - RNA, 20 nt, Artificial Sequence
  MKO10095981_B_Lce3a
  gRNA
cugcuucugacucugcuggc

SEQ ID NO: 95982 - RNA, 20 nt, Artificial Sequence
  MKO10095982_B_Lce3a
  gRNA
agcagcagcccccagagcug

SEQ ID NO: 95983 - RNA, 20 nt, Artificial Sequence
  MKO10095983_B_Lce3a
  gRNA
cugcaguguccccagcucug

SEQ ID NO: 95984 - RNA, 20 nt, Artificial Sequence
  MKO10095984_B_Lce3b
  gRNA
acacugugcugugcucuucc

SEQ ID NO: 95985 - RNA, 20 nt, Artificial Sequence
  MKO10095985_B_Lce3b
  gRNA
cagcagccucccucagaucu

SEQ ID NO: 95986 - RNA, 20 nt, Artificial Sequence
  MKO10095986_B_Lce3b
  gRNA
gaggagguuggcacugcuuc

SEQ ID NO: 95987 - RNA, 20 nt, Artificial Sequence
  MKO10095987_B_Lce3c
  gRNA
uccugcugugcuacaagcuc

SEQ ID NO: 95988 - RNA, 20 nt, Artificial Sequence
  MKO10095988_B_Lce3c
  gRNA
cugcuucuggcucugcuggc

SEQ ID NO: 95989 - RNA, 20 nt, Artificial Sequence
  MKO10095989_B_Lce3c
  gRNA
cagacugcugaccacugcca

SEQ ID NO: 95990 - RNA, 20 nt, Artificial Sequence
  MKO10095990_B_Lce3d
  gRNA
cagacugcugaccacugcca

SEQ ID NO: 95991 - RNA, 20 nt, Artificial Sequence
  MKO10095991_B_Lce3d
  gRNA
cugcaguguccccagcucug

SEQ ID NO: 95992 - RNA, 20 nt, Artificial Sequence
  MKO10095992_B_Lce3d
  gRNA
agcuccugcgccugcaucug

SEQ ID NO: 95993 - RNA, 20 nt, Artificial Sequence
  MKO10095993_B_Lce3e
  gRNA
cagacugcugaccacugcca

SEQ ID NO: 95994 - RNA, 20 nt, Artificial Sequence
  MKO10095994_B_Lce3e
  gRNA
cugcagucuccccagcucug

SEQ ID NO: 95995 - RNA, 20 nt, Artificial Sequence
  MKO10095995_B_Lce3e
  gRNA
agcuccugcgccugcaucug

SEQ ID NO: 95996 - RNA, 20 nt, Artificial Sequence
  MKO10095996_B_Lce3f
  gRNA
cagacugcugaccacugcca

SEQ ID NO: 95997 - RNA, 20 nt, Artificial Sequence
  MKO10095997_B_Lce3f
  gRNA
cugcagucuccccagcucug

SEQ ID NO: 95998 - RNA, 20 nt, Artificial Sequence
  MKO10095998_B_Lce3f
  gRNA
agcuccugcgccugcaucug

SEQ ID NO: 95999 - RNA, 20 nt, Artificial Sequence
  MKO10095999_B_Lce6a
  gRNA
cccauauauucaccuccuaa

SEQ ID NO: 96000 - RNA, 20 nt, Artificial Sequence
  MKO10096000_B_Lce6a
  gRNA
ccagaacacugucagccaua

SEQ ID NO: 96001 - RNA, 20 nt, Artificial Sequence
  MKO10096001_B_Lce6a
  gRNA
gcuguucuuccuacucaaaa

SEQ ID NO: 96002 - RNA, 20 nt, Artificial Sequence
  MKO10096002_B_Lck
  gRNA
gaugaagucaccuugcagcg

SEQ ID NO: 96003 - RNA, 20 nt, Artificial Sequence
  MKO10096003_B_Lck
  gRNA
agccuucuuggccagucguc

SEQ ID NO: 96004 - RNA, 20 nt, Artificial Sequence
  MKO10096004_B_Lck
  gRNA
cuaccccgcagcugcccauc

SEQ ID NO: 96005 - RNA, 20 nt, Artificial Sequence
  MKO10096005_B_Lclau1
  gRNA
uaaugagguacagcuaccuc

SEQ ID NO: 96006 - RNA, 20 nt, Artificial Sequence
  MKO10096006_B_Lclau1
  gRNA
gagagucagcuggauaccgc

SEQ ID NO: 96007 - RNA, 20 nt, Artificial Sequence
  MKO10096007_B_Lclau1
  gRNA
ccugugaggucaguuccuuc

SEQ ID NO: 96008 - RNA, 20 nt, Artificial Sequence
  MKO10096008_B_Lcmt1
  gRNA
cugggauggauaccaccuuc

SEQ ID NO: 96009 - RNA, 20 nt, Artificial Sequence
  MKO10096009_B_Lcmt1
  gRNA
cccagaggacacgcuucaaa

SEQ ID NO: 96010 - RNA, 20 nt, Artificial Sequence
  MKO10096010_B_Lcmt1
  gRNA
gcugacugacaccaugaacu

SEQ ID NO: 96011 - RNA, 20 nt, Artificial Sequence
  MKO10096011_B_Lcmt2
  gRNA
gcgcgcgcacguaauagccg

SEQ ID NO: 96012 - RNA, 20 nt, Artificial Sequence
  MKO10096012_B_Lcmt2
  gRNA
cguccaggccggcgccaucc

SEQ ID NO: 96013 - RNA, 20 nt, Artificial Sequence
  MKO10096013_B_Lcmt2
  gRNA
auacgugcgcgaccccuuug

SEQ ID NO: 96014 - RNA, 20 nt, Artificial Sequence
  MKO10096014_B_Lcn10
  gRNA
ccugagucugcgagaauuuc

SEQ ID NO: 96015 - RNA, 20 nt, Artificial Sequence
  MKO10096015_B_Lcn10
  gRNA
ucacggguauuccugaacac

SEQ ID NO: 96016 - RNA, 20 nt, Artificial Sequence
  MKO10096016_B_Lcn10
  gRNA
ggccucggggcugccagucc

SEQ ID NO: 96017 - RNA, 20 nt, Artificial Sequence
  MKO10096017_B_Lcn11
  gRNA
accguggaacucaauuacaa

SEQ ID NO: 96018 - RNA, 20 nt, Artificial Sequence
  MKO10096018_B_Lcn11
  gRNA
uucccauccgagcucaucug

SEQ ID NO: 96019 - RNA, 20 nt, Artificial Sequence
  MKO10096019_B_Lcn11
  gRNA
aagucagagaguuucugccu

SEQ ID NO: 96020 - RNA, 20 nt, Artificial Sequence
  MKO10096020_B_Lcn12
  gRNA
ggcugacccuugugauguuc

SEQ ID NO: 96021 - RNA, 20 nt, Artificial Sequence
  MKO10096021_B_Lcn12
  gRNA
cacucaccgagucauggagu

SEQ ID NO: 96022 - RNA, 20 nt, Artificial Sequence
  MKO10096022_B_Lcn12
  gRNA
aauugcccaggcuugguugc

SEQ ID NO: 96023 - RNA, 20 nt, Artificial Sequence
  MKO10096023_B_Lcn2
  gRNA
auuucuugcaguuccggggc

SEQ ID NO: 96024 - RNA, 20 nt, Artificial Sequence
  MKO10096024_B_Lcn2
  gRNA
cacccgcuuugccaagucuc

SEQ ID NO: 96025 - RNA, 20 nt, Artificial Sequence
  MKO10096025_B_Lcn2
  gRNA
gugaaacguuccuucaguuc

SEQ ID NO: 96026 - RNA, 20 nt, Artificial Sequence
  MKO10096026_B_Lcn3
  gRNA
guucagcaccaagauuaaca

SEQ ID NO: 96027 - RNA, 20 nt, Artificial Sequence
  MKO10096027_B_Lcn3
  gRNA
agacgacaucccaauaaaca

SEQ ID NO: 96028 - RNA, 20 nt, Artificial Sequence
  MKO10096028_B_Lcn3
  gRNA
uuccacagguagggaccccc

SEQ ID NO: 96029 - RNA, 20 nt, Artificial Sequence
  MKO10096029_B_Lcn4
  gRNA
ggauaccuuggaaguauuua

SEQ ID NO: 96030 - RNA, 20 nt, Artificial Sequence
  MKO10096030_B_Lcn4
  gRNA
uuucacaguauaugauguag

SEQ ID NO: 96031 - RNA, 20 nt, Artificial Sequence
  MKO10096031_B_Lcn4
  gRNA
auccucuuaccccucuguuc

SEQ ID NO: 96032 - RNA, 20 nt, Artificial Sequence
  MKO10096032_B_Lcn5
  gRNA
aguauacgucauguagucug

SEQ ID NO: 96033 - RNA, 20 nt, Artificial Sequence
  MKO10096033_B_Lcn5
  gRNA
uacaaggucaccagaauauc

SEQ ID NO: 96034 - RNA, 20 nt, Artificial Sequence
  MKO10096034_B_Lcn5
  gRNA
ugugauugauaucaccucuc

SEQ ID NO: 96035 - RNA, 20 nt, Artificial Sequence
  MKO10096035_B_Lcn6
  gRNA
ccauuuggugaauagcugca

SEQ ID NO: 96036 - RNA, 20 nt, Artificial Sequence
  MKO10096036_B_Lcn6
  gRNA
gggcuucuugucucaacagc

SEQ ID NO: 96037 - RNA, 20 nt, Artificial Sequence
  MKO10096037_B_Lcn6
  gRNA
ugcugaagcaagagucccga

SEQ ID NO: 96038 - RNA, 20 nt, Artificial Sequence
  MKO10096038_B_Lcn8
  gRNA
uaacagggagauccacgugc

SEQ ID NO: 96039 - RNA, 20 nt, Artificial Sequence
  MKO10096039_B_Lcn8
  gRNA
agucucuuaccuguuguaca

SEQ ID NO: 96040 - RNA, 20 nt, Artificial Sequence
  MKO10096040_B_Lcn8
  gRNA
cuggcucauccucguucuca

SEQ ID NO: 96041 - RNA, 20 nt, Artificial Sequence
  MKO10096041_B_Lcn9
  gRNA
aucaucgacaugacaaaaaa

SEQ ID NO: 96042 - RNA, 20 nt, Artificial Sequence
  MKO10096042_B_Lcn9
  gRNA
acccaagugcuggcacucua

SEQ ID NO: 96043 - RNA, 20 nt, Artificial Sequence
  MKO10096043_B_Lcn9
  gRNA
uaccauagagugccagcacu

SEQ ID NO: 96044 - RNA, 20 nt, Artificial Sequence
  MKO10096044_B_Lcorl
  gRNA
ugacucuucagacuuuaugc

SEQ ID NO: 96045 - RNA, 20 nt, Artificial Sequence
  MKO10096045_B_Lcorl
  gRNA
uaacauucccuuaguugcuc

SEQ ID NO: 96046 - RNA, 20 nt, Artificial Sequence
  MKO10096046_B_Lcorl
  gRNA
uccuucuucugaaaaugcag

SEQ ID NO: 96047 - RNA, 20 nt, Artificial Sequence
  MKO10096047_B_Lcor
  gRNA
uuacccguucccuugaguac

SEQ ID NO: 96048 - RNA, 20 nt, Artificial Sequence
  MKO10096048_B_Lcor
  gRNA
cgugcucagcaaacugcuca

SEQ ID NO: 96049 - RNA, 20 nt, Artificial Sequence
  MKO10096049_B_Lcor
  gRNA
ugcuccaguacucaagggaa

SEQ ID NO: 96050 - RNA, 20 nt, Artificial Sequence
  MKO10096050_B_Lcp1
  gRNA
gucacagauaccgauggcaa

SEQ ID NO: 96051 - RNA, 20 nt, Artificial Sequence
  MKO10096051_B_Lcp1
  gRNA
accaacgcuggacugcucag

SEQ ID NO: 96052 - RNA, 20 nt, Artificial Sequence
  MKO10096052_B_Lcp1
  gRNA
agacccaccugaauggugaa

SEQ ID NO: 96053 - RNA, 20 nt, Artificial Sequence
  MKO10096053_B_Lcp2
  gRNA
ucucuguacagcugaacuac

SEQ ID NO: 96054 - RNA, 20 nt, Artificial Sequence
  MKO10096054_B_Lcp2
  gRNA
uuugcagaccccagauucca

SEQ ID NO: 96055 - RNA, 20 nt, Artificial Sequence
  MKO10096055_B_Lcp2
  gRNA
uucagaaguucccuaagcug

SEQ ID NO: 96056 - RNA, 20 nt, Artificial Sequence
  MKO10096056_B_Lcul
  gRNA
ggcagaacugcccacgcccc

SEQ ID NO: 96057 - RNA, 20 nt, Artificial Sequence
  MKO10096057_B_Lcul
  gRNA
aacuuuauaguagcugucac

SEQ ID NO: 96058 - RNA, 20 nt, Artificial Sequence
  MKO10096058_B_Lcul
  gRNA
ugacuuguaguuccuucagc

SEQ ID NO: 96059 - RNA, 20 nt, Artificial Sequence
  MKO10096059_B_Lcu
  gRNA
aaagaccaaguccagacugu

SEQ ID NO: 96060 - RNA, 20 nt, Artificial Sequence
  MKO10096060_B_Lcu
  gRNA
ugacaucaaacccaacaguc

SEQ ID NO: 96061 - RNA, 20 nt, Artificial Sequence
  MKO10096061_B_Lcu
  gRNA
ucugccagacccauccucag

SEQ ID NO: 96062 - RNA, 20 nt, Artificial Sequence
  MKO10096062_B_Ldb1
  gRNA
ccccacaucccgauccagca

SEQ ID NO: 96063 - RNA, 20 nt, Artificial Sequence
  MKO10096063_B_Ldb1
  gRNA
cccaggaggcacacaccaua

SEQ ID NO: 96064 - RNA, 20 nt, Artificial Sequence
  MKO10096064_B_Ldb1
  gRNA
uucaggagugugacaaucuc

SEQ ID NO: 96065 - RNA, 20 nt, Artificial Sequence
  MKO10096065_B_Ldb2
  gRNA
acuucacccucaacuaccuc

SEQ ID NO: 96066 - RNA, 20 nt, Artificial Sequence
  MKO10096066_B_Ldb2
  gRNA
acuuuaccauuagacaguac

SEQ ID NO: 96067 - RNA, 20 nt, Artificial Sequence
  MKO10096067_B_Ldb2
  gRNA
accucaugagaauaaaaacg

SEQ ID NO: 96068 - RNA, 20 nt, Artificial Sequence
  MKO10096068_B_Ldb3
  gRNA
cacuuacccgggagauagug

SEQ ID NO: 96069 - RNA, 20 nt, Artificial Sequence
  MKO10096069_B_Ldb3
  gRNA
gccagugaucccccaccaga

SEQ ID NO: 96070 - RNA, 20 nt, Artificial Sequence
  MKO10096070_B_Ldb3
  gRNA
gucuguguugacgccaucaa

SEQ ID NO: 96071 - RNA, 20 nt, Artificial Sequence
  MKO10096071_B_Ldhal6b
  gRNA
gccggcauuaaagguauucu

SEQ ID NO: 96072 - RNA, 20 nt, Artificial Sequence
  MKO10096072_B_Ldhal6b
  gRNA
cguuucgcuggacuaaauuc

SEQ ID NO: 96073 - RNA, 20 nt, Artificial Sequence
  MKO10096073_B_Ldhal6b
  gRNA
gcgucuguacugccuagcaa

SEQ ID NO: 96074 - RNA, 20 nt, Artificial Sequence
  MKO10096074_B_Ldha
  gRNA
cgcgggggcccgucagcaag

SEQ ID NO: 96075 - RNA, 20 nt, Artificial Sequence
  MKO10096075_B_Ldha
  gRNA
uaccuucauuaagauacuga

SEQ ID NO: 96076 - RNA, 20 nt, Artificial Sequence
  MKO10096076_B_Ldha
  gRNA
ccaaaaauugucuccagcaa

SEQ ID NO: 96077 - RNA, 20 nt, Artificial Sequence
  MKO10096077_B_Ldhb
  gRNA
gggcuguacuugacgaucug

SEQ ID NO: 96078 - RNA, 20 nt, Artificial Sequence
  MKO10096078_B_Ldhb
  gRNA
agguagcccgcucaguuucc

SEQ ID NO: 96079 - RNA, 20 nt, Artificial Sequence
  MKO10096079_B_Ldhb
  gRNA
ucuggcugaugaacuugccc

SEQ ID NO: 96080 - RNA, 20 nt, Artificial Sequence
  MKO10096080_B_Ldhc
  gRNA
gucaacccuacaagcugcca

SEQ ID NO: 96081 - RNA, 20 nt, Artificial Sequence
  MKO10096081_B_Ldhc
  gRNA
uacagccacuuccgaucaca

SEQ ID NO: 96082 - RNA, 20 nt, Artificial Sequence
  MKO10096082_B_Ldhc
  gRNA
agcacuccaaaaaucgucuu

SEQ ID NO: 96083 - RNA, 20 nt, Artificial Sequence
  MKO10096083_B_Ldhd
  gRNA
cccaucaucccauuuggcac

SEQ ID NO: 96084 - RNA, 20 nt, Artificial Sequence
  MKO10096084_B_Ldhd
  gRNA
gccugugccaaaugggauga

SEQ ID NO: 96085 - RNA, 20 nt, Artificial Sequence
  MKO10096085_B_Ldhd
  gRNA
aauacccaccugcgugacag

SEQ ID NO: 96086 - RNA, 20 nt, Artificial Sequence
  MKO10096086_B_Ldlrad1
  gRNA
ggacauccaccccgcacacc

SEQ ID NO: 96087 - RNA, 20 nt, Artificial Sequence
  MKO10096087_B_Ldlrad1
  gRNA
gugacuacgugcccgcccug

SEQ ID NO: 96088 - RNA, 20 nt, Artificial Sequence
  MKO10096088_B_Ldlrad1
  gRNA
aguacugcagcugugucccg

SEQ ID NO: 96089 - RNA, 20 nt, Artificial Sequence
  MKO10096089_B_Ldlrad2
  gRNA
caaggcgcugacucuucuug

SEQ ID NO: 96090 - RNA, 20 nt, Artificial Sequence
  MKO10096090_B_Ldlrad2
  gRNA
gacuggaacauggacaacug

SEQ ID NO: 96091 - RNA, 20 nt, Artificial Sequence
  MKO10096091_B_Ldlrad2
  gRNA
cgaucacugaccuccacagc

SEQ ID NO: 96092 - RNA, 20 nt, Artificial Sequence
  MKO10096092_B_Ldlrad3
  gRNA
ccugcagugguagcgagccg

SEQ ID NO: 96093 - RNA, 20 nt, Artificial Sequence
  MKO10096093_B_Ldlrad3
  gRNA
ugaagcucuugucgaugcac

SEQ ID NO: 96094 - RNA, 20 nt, Artificial Sequence
  MKO10096094_B_Ldlrad3
  gRNA
accaacgagugcaacauccc

SEQ ID NO: 96095 - RNA, 20 nt, Artificial Sequence
  MKO10096095_B_Ldlrad4
  gRNA
aacucaaccgagaguccgug

SEQ ID NO: 96096 - RNA, 20 nt, Artificial Sequence
  MKO10096096_B_Ldlrad4
  gRNA
uguccccacagucguucugu

SEQ ID NO: 96097 - RNA, 20 nt, Artificial Sequence
  MKO10096097_B_Ldlrad4
  gRNA
cgcugcacggagcuaucaga

SEQ ID NO: 96098 - RNA, 20 nt, Artificial Sequence
  MKO10096098_B_Ldlrap1
  gRNA
ucgagaacguguccauuuac

SEQ ID NO: 96099 - RNA, 20 nt, Artificial Sequence
  MKO10096099_B_Ldlrap1
  gRNA
agaggaaggcguggcacucg

SEQ ID NO: 96100 - RNA, 20 nt, Artificial Sequence
  MKO10096100_B_Ldlrap1
  gRNA
ugcagacaagaugcacgaca

SEQ ID NO: 96101 - RNA, 20 nt, Artificial Sequence
  MKO10096101_B_Ldlr
  gRNA
aucggagccauccgggcacu

SEQ ID NO: 96102 - RNA, 20 nt, Artificial Sequence
  MKO10096102_B_Ldlr
  gRNA
cgucacagacccagcugcga

SEQ ID NO: 96103 - RNA, 20 nt, Artificial Sequence
  MKO10096103_B_Ldlr
  gRNA
aaaaugcaucgcuagcaagu

SEQ ID NO: 96104 - RNA, 20 nt, Artificial Sequence
  MKO10096104_B_Ldoc1l
  gRNA
cucgcgccucagcgcggagu

SEQ ID NO: 96105 - RNA, 20 nt, Artificial Sequence
  MKO10096105_B_Ldoc1l
  gRNA
ccgcguccaauagggcugug

SEQ ID NO: 96106 - RNA, 20 nt, Artificial Sequence
  MKO10096106_B_Ldoc1l
  gRNA
ggugcgcagcagaguuaguu

SEQ ID NO: 96107 - RNA, 20 nt, Artificial Sequence
  MKO10096107_B_Ldoc1
  gRNA
uagcuauuugacucgaugua

SEQ ID NO: 96108 - RNA, 20 nt, Artificial Sequence
  MKO10096108_B_Ldoc1
  gRNA
gucgcuucugcacgcgcuuc

SEQ ID NO: 96109 - RNA, 20 nt, Artificial Sequence
  MKO10096109_B_Ldoc1
  gRNA
gucuuacaugcuugcgaaug

SEQ ID NO: 96110 - RNA, 20 nt, Artificial Sequence
  MKO10096110_B_Leap2
  gRNA
uccaaaauggggucauucuc

SEQ ID NO: 96111 - RNA, 20 nt, Artificial Sequence
  MKO10096111_B_Leap2
  gRNA
uuaccugacccagcagcagc

SEQ ID NO: 96112 - RNA, 20 nt, Artificial Sequence
  MKO10096112_B_Leap2
  gRNA
ccugacuugccugcugcugc

SEQ ID NO: 96113 - RNA, 20 nt, Artificial Sequence
  MKO10096113_B_Lecu1
  gRNA
accgucaccgugaagcccuc

SEQ ID NO: 96114 - RNA, 20 nt, Artificial Sequence
  MKO10096114_B_Lecu1
  gRNA
cauuacaguaugaguaucaa

SEQ ID NO: 96115 - RNA, 20 nt, Artificial Sequence
  MKO10096115_B_Lecu1
  gRNA
cuuuaaaaugggaagcggag

SEQ ID NO: 96116 - RNA, 20 nt, Artificial Sequence
  MKO10096116_B_Lecu2
  gRNA
guggacguccugugcucgga

SEQ ID NO: 96117 - RNA, 20 nt, Artificial Sequence
  MKO10096117_B_Lecu2
  gRNA
ugcccggguaaacuuucugc

SEQ ID NO: 96118 - RNA, 20 nt, Artificial Sequence
  MKO10096118_B_Lecu2
  gRNA
ccacagauccauccgagcac

SEQ ID NO: 96119 - RNA, 20 nt, Artificial Sequence
  MKO10096119_B_Lef1
  gRNA
aggagggucccuuguuguac

SEQ ID NO: 96120 - RNA, 20 nt, Artificial Sequence
  MKO10096120_B_Lef1
  gRNA
agcgacccguacaugucaaa

SEQ ID NO: 96121 - RNA, 20 nt, Artificial Sequence
  MKO10096121_B_Lef1
  gRNA
ggacagaucaccccacccau

SEQ ID NO: 96122 - RNA, 20 nt, Artificial Sequence
  MKO10096122_B_Lefty1
  gRNA
gcucgaucaaccgccagucc

SEQ ID NO: 96123 - RNA, 20 nt, Artificial Sequence
  MKO10096123_B_Lefty1
  gRNA
gcccaugauugucagcguga

SEQ ID NO: 96124 - RNA, 20 nt, Artificial Sequence
  MKO10096124_B_Lefty1
  gRNA
augcuuacccauaguccuug

SEQ ID NO: 96125 - RNA, 20 nt, Artificial Sequence
  MKO10096125_B_Lefty2
  gRNA
ccccagaaauggccacccga

SEQ ID NO: 96126 - RNA, 20 nt, Artificial Sequence
  MKO10096126_B_Lefty2
  gRNA
gcacugcccucaucgacucu

SEQ ID NO: 96127 - RNA, 20 nt, Artificial Sequence
  MKO10096127_B_Lefty2
  gRNA
cagccuacccguaguccuug

SEQ ID NO: 96128 - RNA, 20 nt, Artificial Sequence
  MKO10096128_B_Lekr1
  gRNA
aaagcugcagucucuuagcc

SEQ ID NO: 96129 - RNA, 20 nt, Artificial Sequence
  MKO10096129_B_Lekr1
  gRNA
aagugacagcgaguccaaga

SEQ ID NO: 96130 - RNA, 20 nt, Artificial Sequence
  MKO10096130_B_Lekr1
  gRNA
cuugaaacuaaauaagagac

SEQ ID NO: 96131 - RNA, 20 nt, Artificial Sequence
  MKO10096131_B_Lelp1
  gRNA
uagcagcuuguuuagacagc

SEQ ID NO: 96132 - RNA, 20 nt, Artificial Sequence
  MKO10096132_B_Lelp1
  gRNA
aacacugcgacugacacacc

SEQ ID NO: 96133 - RNA, 20 nt, Artificial Sequence
  MKO10096133_B_Lelp1
  gRNA
aagucuagugacucuaagaa

SEQ ID NO: 96134 - RNA, 20 nt, Artificial Sequence
  MKO10096134_B_Lemd1
  gRNA
ucgcuguccucagagccgug

SEQ ID NO: 96135 - RNA, 20 nt, Artificial Sequence
  MKO10096135_B_Lemd1
  gRNA
cacaagcaucuuaugaagcu

SEQ ID NO: 96136 - RNA, 20 nt, Artificial Sequence
  MKO10096136_B_Lemd1
  gRNA
cugcaccagcuucuucucgu

SEQ ID NO: 96137 - RNA, 20 nt, Artificial Sequence
  MKO10096137_B_Lemd2
  gRNA
guucgugcagcagcuccaac

SEQ ID NO: 96138 - RNA, 20 nt, Artificial Sequence
  MKO10096138_B_Lemd2
  gRNA
gagcaagugcaucccagucc

SEQ ID NO: 96139 - RNA, 20 nt, Artificial Sequence
  MKO10096139_B_Lemd2
  gRNA
cgucucagugaaauuguugc

SEQ ID NO: 96140 - RNA, 20 nt, Artificial Sequence
  MKO10096140_B_Lemd3
  gRNA
uuaaauacaucuucauacuc

SEQ ID NO: 96141 - RNA, 20 nt, Artificial Sequence
  MKO10096141_B_Lemd3
  gRNA
uuaaauaugcagcugcuucu

SEQ ID NO: 96142 - RNA, 20 nt, Artificial Sequence
  MKO10096142_B_Lemd3
  gRNA
uaaaauaauaccugcaaucu

SEQ ID NO: 96143 - RNA, 20 nt, Artificial Sequence
  MKO10096143_B_Lenep
  gRNA
ucucucagagaugcccuucg

SEQ ID NO: 96144 - RNA, 20 nt, Artificial Sequence
  MKO10096144_B_Lenep
  gRNA
ccaggugccugucauuaaaa

SEQ ID NO: 96145 - RNA, 20 nt, Artificial Sequence
  MKO10096145_B_Lenep
  gRNA
ccuacauccuucuuuguugc

SEQ ID NO: 96146 - RNA, 20 nt, Artificial Sequence
  MKO10096146_B_Leng1
  gRNA
cggacgugccagcucuucuu

SEQ ID NO: 96147 - RNA, 20 nt, Artificial Sequence
  MKO10096147_B_Leng1
  gRNA
cccgcugaagacgcucagca

SEQ ID NO: 96148 - RNA, 20 nt, Artificial Sequence
  MKO10096148_B_Leng1
  gRNA
agccgagagagcucgagcag

SEQ ID NO: 96149 - RNA, 20 nt, Artificial Sequence
  MKO10096149_B_Leng8
  gRNA
uggcgggccuucucccacuc

SEQ ID NO: 96150 - RNA, 20 nt, Artificial Sequence
  MKO10096150_B_Leng8
  gRNA
augggguaguaguagcuaua

SEQ ID NO: 96151 - RNA, 20 nt, Artificial Sequence
  MKO10096151_B_Leng8
  gRNA
cuaugcacgagaacccagag

SEQ ID NO: 96152 - RNA, 20 nt, Artificial Sequence
  MKO10096152_B_Leng9
  gRNA
gccuccgguugcguaaccac

SEQ ID NO: 96153 - RNA, 20 nt, Artificial Sequence
  MKO10096153_B_Leng9
  gRNA
ugcggcacugccaacacgcc

SEQ ID NO: 96154 - RNA, 20 nt, Artificial Sequence
  MKO10096154_B_Leng9
  gRNA
aacaggucuugauucgggcc

SEQ ID NO: 96155 - RNA, 20 nt, Artificial Sequence
  MKO10096155_B_Leo1
  gRNA
cugucugcuucggaauccga

SEQ ID NO: 96156 - RNA, 20 nt, Artificial Sequence
  MKO10096156_B_Leo1
  gRNA
ccccaaaguaaacacggacu

SEQ ID NO: 96157 - RNA, 20 nt, Artificial Sequence
  MKO10096157_B_Leo1
  gRNA
gcccaaguccguguuuacuu

SEQ ID NO: 96158 - RNA, 20 nt, Artificial Sequence
  MKO10096158_B_Lepre1
  gRNA
gcaggucuuacuguuguagu

SEQ ID NO: 96159 - RNA, 20 nt, Artificial Sequence
  MKO10096159_B_Lepre1
  gRNA
ccuuucagaucauuacgucc

SEQ ID NO: 96160 - RNA, 20 nt, Artificial Sequence
  MKO10096160_B_Lepre1
  gRNA
gacuauuaccaaaccauguc

SEQ ID NO: 96161 - RNA, 20 nt, Artificial Sequence
  MKO10096161_B_Leprel1
  gRNA
ucucaccucccgggccucaa

SEQ ID NO: 96162 - RNA, 20 nt, Artificial Sequence
  MKO10096162_B_Leprel1
  gRNA
ucgucuacagcucaaccagc

SEQ ID NO: 96163 - RNA, 20 nt, Artificial Sequence
  MKO10096163_B_Leprel1
  gRNA
agugccgugcucuaugugag

SEQ ID NO: 96164 - RNA, 20 nt, Artificial Sequence
  MKO10096164_B_Leprel2
  gRNA
ccucgugcagccgucucagc

SEQ ID NO: 96165 - RNA, 20 nt, Artificial Sequence
  MKO10096165_B_Leprel2
  gRNA
ggguuaccucucgugguccc

SEQ ID NO: 96166 - RNA, 20 nt, Artificial Sequence
  MKO10096166_B_Leprel2
  gRNA
gaaccaguaccaaacucagu

SEQ ID NO: 96167 - RNA, 20 nt, Artificial Sequence
  MKO10096167_B_Leprel4
  gRNA
aagacgaggacuuucaaccc

SEQ ID NO: 96168 - RNA, 20 nt, Artificial Sequence
  MKO10096168_B_Leprel4
  gRNA
agaugagucccucaccgacc

SEQ ID NO: 96169 - RNA, 20 nt, Artificial Sequence
  MKO10096169_B_Leprel4
  gRNA
ccacgagcagguagacuuca

SEQ ID NO: 96170 - RNA, 20 nt, Artificial Sequence
  MKO10096170_B_Leprotl1
  gRNA
cuccuuacacgcguugcuca

SEQ ID NO: 96171 - RNA, 20 nt, Artificial Sequence
  MKO10096171_B_Leprotl1
  gRNA
cagcccgaucgcuccuccaa

SEQ ID NO: 96172 - RNA, 20 nt, Artificial Sequence
  MKO10096172_B_Leprotl1
  gRNA
cgucguugcuuccaaagacc

SEQ ID NO: 96173 - RNA, 20 nt, Artificial Sequence
  MKO10096173_B_Leprot
  gRNA
acgcgaccagcagugccugu

SEQ ID NO: 96174 - RNA, 20 nt, Artificial Sequence
  MKO10096174_B_Leprot
  gRNA
caucuccucuuccaaagacg

SEQ ID NO: 96175 - RNA, 20 nt, Artificial Sequence
  MKO10096175_B_Leprot
  gRNA
uucuuccucgucuuuggaag

SEQ ID NO: 96176 - RNA, 20 nt, Artificial Sequence
  MKO10096176_B_Lepr
  gRNA
cagaagagcguaguugaguu

SEQ ID NO: 96177 - RNA, 20 nt, Artificial Sequence
  MKO10096177_B_Lepr
  gRNA
cuucaagaauuaugacucua

SEQ ID NO: 96178 - RNA, 20 nt, Artificial Sequence
  MKO10096178_B_Lepr
  gRNA
cuuagagucauaauucuuga

SEQ ID NO: 96179 - RNA, 20 nt, Artificial Sequence
  MKO10096179_B_Lep
  gRNA
ugcuugaacauaagacagau

SEQ ID NO: 96180 - RNA, 20 nt, Artificial Sequence
  MKO10096180_B_Lep
  gRNA
gcugcagauagccaaugacc

SEQ ID NO: 96181 - RNA, 20 nt, Artificial Sequence
  MKO10096181_B_Lep
  gRNA
guugauagacugccagaguc

SEQ ID NO: 96182 - RNA, 20 nt, Artificial Sequence
  MKO10096182_B_Letm1
  gRNA
ggaagagguccgcacaaauc

SEQ ID NO: 96183 - RNA, 20 nt, Artificial Sequence
  MKO10096183_B_Letm1
  gRNA
guucgugguggugcccuuca

SEQ ID NO: 96184 - RNA, 20 nt, Artificial Sequence
  MKO10096184_B_Letm1
  gRNA
gagcuugucucagcuguacc

SEQ ID NO: 96185 - RNA, 20 nt, Artificial Sequence
  MKO10096185_B_Letm2
  gRNA
uacccuucgccucucucguc

SEQ ID NO: 96186 - RNA, 20 nt, Artificial Sequence
  MKO10096186_B_Letm2
  gRNA
aggucacaagcccuccacga

SEQ ID NO: 96187 - RNA, 20 nt, Artificial Sequence
  MKO10096187_B_Letm2
  gRNA
augcaucucccagcuucgcu

SEQ ID NO: 96188 - RNA, 20 nt, Artificial Sequence
  MKO10096188_B_Letmd1
  gRNA
gacacuuggugauaucucgu

SEQ ID NO: 96189 - RNA, 20 nt, Artificial Sequence
  MKO10096189_B_Letmd1
  gRNA
aucaccaagugucucuucgu

SEQ ID NO: 96190 - RNA, 20 nt, Artificial Sequence
  MKO10096190_B_Letmd1
  gRNA
aguuucaucaacucucuuac

SEQ ID NO: 96191 - RNA, 20 nt, Artificial Sequence
  MKO10096191_B_Lfng
  gRNA
gcuggcuucugcaucagccg

SEQ ID NO: 96192 - RNA, 20 nt, Artificial Sequence
  MKO10096192_B_Lfng
  gRNA
agccuggcggcugugggccg

SEQ ID NO: 96193 - RNA, 20 nt, Artificial Sequence
  MKO10096193_B_Lfng
  gRNA
uggcccuaaagaugggccca

SEQ ID NO: 96194 - RNA, 20 nt, Artificial Sequence
  MKO10096194_B_Lgals12
  gRNA
cuuguucaggugauuccuua

SEQ ID NO: 96195 - RNA, 20 nt, Artificial Sequence
  MKO10096195_B_Lgals12
  gRNA
gacucuggcaaaaagagauc

SEQ ID NO: 96196 - RNA, 20 nt, Artificial Sequence
  MKO10096196_B_Lgals12
  gRNA
gauggucacgcugcagggug

SEQ ID NO: 96197 - RNA, 20 nt, Artificial Sequence
  MKO10096197_B_Lgals1
  gRNA
aauccucgcuucaaugccca

SEQ ID NO: 96198 - RNA, 20 nt, Artificial Sequence
  MKO10096198_B_Lgals1
  gRNA
augucucaaaguucggggag

SEQ ID NO: 96199 - RNA, 20 nt, Artificial Sequence
  MKO10096199_B_Lgals1
  gRNA
ugaagcgaggauugaagugu

SEQ ID NO: 96200 - RNA, 20 nt, Artificial Sequence
  MKO10096200_B_Lgals2
  gRNA
cucguugcucuuguccccag

SEQ ID NO: 96201 - RNA, 20 nt, Artificial Sequence
  MKO10096201_B_Lgals2
  gRNA
ccaacugcacuacuugagca

SEQ ID NO: 96202 - RNA, 20 nt, Artificial Sequence
  MKO10096202_B_Lgals2
  gRNA
guugcuccaggagaaauuug

SEQ ID NO: 96203 - RNA, 20 nt, Artificial Sequence
  MKO10096203_B_Lgals3bp
  gRNA
uggcccgugcguacgcauaa

SEQ ID NO: 96204 - RNA, 20 nt, Artificial Sequence
  MKO10096204_B_Lgals3bp
  gRNA
gagccgcugugggcacgaga

SEQ ID NO: 96205 - RNA, 20 nt, Artificial Sequence
  MKO10096205_B_Lgals3bp
  gRNA
gcaggcguggucugcuccaa

SEQ ID NO: 96206 - RNA, 20 nt, Artificial Sequence
  MKO10096206_B_Lgals3
  gRNA
uagcuuaacgaugccuuagc

SEQ ID NO: 96207 - RNA, 20 nt, Artificial Sequence
  MKO10096207_B_Lgals3
  gRNA
ggugcaugggggaaccagcc

SEQ ID NO: 96208 - RNA, 20 nt, Artificial Sequence
  MKO10096208_B_Lgals3
  gRNA
cagugaaacccaacgcaaac

SEQ ID NO: 96209 - RNA, 20 nt, Artificial Sequence
  MKO10096209_B_Lgals4
  gRNA
accggauauggggcugcagc

SEQ ID NO: 96210 - RNA, 20 nt, Artificial Sequence
  MKO10096210_B_Lgals4
  gRNA
ccuucuaugaauacgggcac

SEQ ID NO: 96211 - RNA, 20 nt, Artificial Sequence
  MKO10096211_B_Lgals4
  gRNA
gggauguccguuuacaucca

SEQ ID NO: 96212 - RNA, 20 nt, Artificial Sequence
  MKO10096212_B_Lgals6
  gRNA
gccccacagcgaaguucacg

SEQ ID NO: 96213 - RNA, 20 nt, Artificial Sequence
  MKO10096213_B_Lgals6
  gRNA
ccggugcccguauucauaga

SEQ ID NO: 96214 - RNA, 20 nt, Artificial Sequence
  MKO10096214_B_Lgals6
  gRNA
gggauguccguuuacaucca

SEQ ID NO: 96215 - RNA, 20 nt, Artificial Sequence
  MKO10096215_B_Lgals7
  gRNA
gcggcauccggugguggaag

SEQ ID NO: 96216 - RNA, 20 nt, Artificial Sequence
  MKO10096216_B_Lgals7
  gRNA
ggcacugucaugagaauucg

SEQ ID NO: 96217 - RNA, 20 nt, Artificial Sequence
  MKO10096217_B_Lgals7
  gRNA
ugggauaucaccugccagcc

SEQ ID NO: 96218 - RNA, 20 nt, Artificial Sequence
  MKO10096218_B_Lgals8
  gRNA
acuuuaacccucgguucaaa

SEQ ID NO: 96219 - RNA, 20 nt, Artificial Sequence
  MKO10096219_B_Lgals8
  gRNA
ccuuagauaauccccuaugu

SEQ ID NO: 96220 - RNA, 20 nt, Artificial Sequence
  MKO10096220_B_Lgals8
  gRNA
cggauuacaaucagagagcc

SEQ ID NO: 96221 - RNA, 20 nt, Artificial Sequence
  MKO10096221_B_Lgals9
  gRNA
gcucaaagggcauccccuuc

SEQ ID NO: 96222 - RNA, 20 nt, Artificial Sequence
  MKO10096222_B_Lgals9
  gRNA
guuugcaacacgaagcagaa

SEQ ID NO: 96223 - RNA, 20 nt, Artificial Sequence
  MKO10096223_B_Lgals9
  gRNA
cugcagaucauccccuuuac

SEQ ID NO: 96224 - RNA, 20 nt, Artificial Sequence
  MKO10096224_B_Lgalsl
  gRNA
cagucgugggaaguacacgu

SEQ ID NO: 96225 - RNA, 20 nt, Artificial Sequence
  MKO10096225_B_Lgalsl
  gRNA
uccacaaacacucugaaacg

SEQ ID NO: 96226 - RNA, 20 nt, Artificial Sequence
  MKO10096226_B_Lgalsl
  gRNA
ucaaagcuguguucacagac

SEQ ID NO: 96227 - RNA, 20 nt, Artificial Sequence
  MKO10096227_B_Lgi1
  gRNA
gaaucaaagacuugaguccc

SEQ ID NO: 96228 - RNA, 20 nt, Artificial Sequence
  MKO10096228_B_Lgi1
  gRNA
uucagauccuuugugagauc

SEQ ID NO: 96229 - RNA, 20 nt, Artificial Sequence
  MKO10096229_B_Lgi1
  gRNA
aucaucacugaucacaucaa

SEQ ID NO: 96230 - RNA, 20 nt, Artificial Sequence
  MKO10096230_B_Lgi2
  gRNA
gcccguaggagccuaguaaa

SEQ ID NO: 96231 - RNA, 20 nt, Artificial Sequence
  MKO10096231_B_Lgi2
  gRNA
auaagacuuacaggugaguc

SEQ ID NO: 96232 - RNA, 20 nt, Artificial Sequence
  MKO10096232_B_Lgi2
  gRNA
ccgaaaggcauuucuugaaa

SEQ ID NO: 96233 - RNA, 20 nt, Artificial Sequence
  MKO10096233_B_Lgi3
  gRNA
ccauacaagaacugcaacaa

SEQ ID NO: 96234 - RNA, 20 nt, Artificial Sequence
  MKO10096234_B_Lgi3
  gRNA
cucuccaaguuuaccuucag

SEQ ID NO: 96235 - RNA, 20 nt, Artificial Sequence
  MKO10096235_B_Lgi3
  gRNA
caguccucugaagguaaacu

SEQ ID NO: 96236 - RNA, 20 nt, Artificial Sequence
  MKO10096236_B_Lgi4
  gRNA
ccuggccaacaaccaccucg

SEQ ID NO: 96237 - RNA, 20 nt, Artificial Sequence
  MKO10096237_B_Lgi4
  gRNA
gcuauacucacagguacugc

SEQ ID NO: 96238 - RNA, 20 nt, Artificial Sequence
  MKO10096238_B_Lgi4
  gRNA
ggaaucuggguagagccucg

SEQ ID NO: 96239 - RNA, 20 nt, Artificial Sequence
  MKO10096239_B_Lgmn
  gRNA
aauuuccucgccgugcugag

SEQ ID NO: 96240 - RNA, 20 nt, Artificial Sequence
  MKO10096240_B_Lgmn
  gRNA
acgccuaccagaucauccac

SEQ ID NO: 96241 - RNA, 20 nt, Artificial Sequence
  MKO10096241_B_Lgmn
  gRNA
ccucuccgguguaguccuuc

SEQ ID NO: 96242 - RNA, 20 nt, Artificial Sequence
  MKO10096242_B_Lgr4
  gRNA
auucaccaaccuuucaagcu

SEQ ID NO: 96243 - RNA, 20 nt, Artificial Sequence
  MKO10096243_B_Lgr4
  gRNA
auccacccaaaagccuuguc

SEQ ID NO: 96244 - RNA, 20 nt, Artificial Sequence
  MKO10096244_B_Lgr4
  gRNA
gaguucuuucaacccagaca

SEQ ID NO: 96245 - RNA, 20 nt, Artificial Sequence
  MKO10096245_B_Lgr5
  gRNA
ggaccccacagacgucuugc

SEQ ID NO: 96246 - RNA, 20 nt, Artificial Sequence
  MKO10096246_B_Lgr5
  gRNA
aaauucuguagcgcuuccuc

SEQ ID NO: 96247 - RNA, 20 nt, Artificial Sequence
  MKO10096247_B_Lgr5
  gRNA
gugguacuuacaacucuucu

SEQ ID NO: 96248 - RNA, 20 nt, Artificial Sequence
  MKO10096248_B_Lgr6
  gRNA
gagagcucugacggggaucu

SEQ ID NO: 96249 - RNA, 20 nt, Artificial Sequence
  MKO10096249_B_Lgr6
  gRNA
ccgugagguuguucauacug

SEQ ID NO: 96250 - RNA, 20 nt, Artificial Sequence
  MKO10096250_B_Lgr6
  gRNA
cuuccaccaccugcgcuucc

SEQ ID NO: 96251 - RNA, 20 nt, Artificial Sequence
  MKO10096251_B_Lgsn
  gRNA
gcugaauucagcccgaauac

SEQ ID NO: 96252 - RNA, 20 nt, Artificial Sequence
  MKO10096252_B_Lgsn
  gRNA
uugcuucaaaucguacaaac

SEQ ID NO: 96253 - RNA, 20 nt, Artificial Sequence
  MKO10096253_B_Lgsn
  gRNA
uaaaacucugagcauuguac

SEQ ID NO: 96254 - RNA, 20 nt, Artificial Sequence
  MKO10096254_B_Lhb
  gRNA
gcccccuucggccacugugc

SEQ ID NO: 96255 - RNA, 20 nt, Artificial Sequence
  MKO10096255_B_Lhb
  gRNA
aucaagaauggagaggcucc

SEQ ID NO: 96256 - RNA, 20 nt, Artificial Sequence
  MKO10096256_B_Lhb
  gRNA
gcaaagcagccggcaguacu

SEQ ID NO: 96257 - RNA, 20 nt, Artificial Sequence
  MKO10096257_B_Lhcgr
  gRNA
cuuacauuucagacagauug

SEQ ID NO: 96258 - RNA, 20 nt, Artificial Sequence
  MKO10096258_B_Lhcgr
  gRNA
aaucucucagagugauuccc

SEQ ID NO: 96259 - RNA, 20 nt, Artificial Sequence
  MKO10096259_B_Lhcgr
  gRNA
gauuacuuugacagggagau

SEQ ID NO: 96260 - RNA, 20 nt, Artificial Sequence
  MKO10096260_B_Lhfpl1
  gRNA
gugcauuauauccuuuagga

SEQ ID NO: 96261 - RNA, 20 nt, Artificial Sequence
  MKO10096261_B_Lhfpl1
  gRNA
cagccauguugaucugcacc

SEQ ID NO: 96262 - RNA, 20 nt, Artificial Sequence
  MKO10096262_B_Lhfpl1
  gRNA
uucacaggaaccuguagacu

SEQ ID NO: 96263 - RNA, 20 nt, Artificial Sequence
  MKO10096263_B_Lhfpl2
  gRNA
cgcauaccguccacagucua

SEQ ID NO: 96264 - RNA, 20 nt, Artificial Sequence
  MKO10096264_B_Lhfpl2
  gRNA
gaucuucauucucugcguag

SEQ ID NO: 96265 - RNA, 20 nt, Artificial Sequence
  MKO10096265_B_Lhfpl2
  gRNA
ucaccugccgcucgaugcuc

SEQ ID NO: 96266 - RNA, 20 nt, Artificial Sequence
  MKO10096266_B_Lhfpl3
  gRNA
agcccgaaauagccggcuug

SEQ ID NO: 96267 - RNA, 20 nt, Artificial Sequence
  MKO10096267_B_Lhfpl3
  gRNA
gcuugggaaccuacgauguc

SEQ ID NO: 96268 - RNA, 20 nt, Artificial Sequence
  MKO10096268_B_Lhfpl3
  gRNA
ucguuucuagcguuugugcu

SEQ ID NO: 96269 - RNA, 20 nt, Artificial Sequence
  MKO10096269_B_Lhfpl4
  gRNA
gggcaccaugcugcccucgc

SEQ ID NO: 96270 - RNA, 20 nt, Artificial Sequence
  MKO10096270_B_Lhfpl4
  gRNA
aguuccgcauguagugcuca

SEQ ID NO: 96271 - RNA, 20 nt, Artificial Sequence
  MKO10096271_B_Lhfpl4
  gRNA
caggaggugaugugucuggc

SEQ ID NO: 96272 - RNA, 20 nt, Artificial Sequence
  MKO10096272_B_Lhfpl5
  gRNA
acacauacgccgcaccucac

SEQ ID NO: 96273 - RNA, 20 nt, Artificial Sequence
  MKO10096273_B_Lhfpl5
  gRNA
cuagccacgggccuaaugau

SEQ ID NO: 96274 - RNA, 20 nt, Artificial Sequence
  MKO10096274_B_Lhfpl5
  gRNA
agugaggugcggcguaugug

SEQ ID NO: 96275 - RNA, 20 nt, Artificial Sequence
  MKO10096275_B_Lhfp
  gRNA
uccuuaggcaagugugagau

SEQ ID NO: 96276 - RNA, 20 nt, Artificial Sequence
  MKO10096276_B_Lhfp
  gRNA
cagacuuguggcuacaucuc

SEQ ID NO: 96277 - RNA, 20 nt, Artificial Sequence
  MKO10096277_B_Lhfp
  gRNA
agauguagccacaagucugc

SEQ ID NO: 96278 - RNA, 20 nt, Artificial Sequence
  MKO10096278_B_Lhpp
  gRNA
ggccucgcuccuucaggauc

SEQ ID NO: 96279 - RNA, 20 nt, Artificial Sequence
  MKO10096279_B_Lhpp
  gRNA
aacaguccccgcugaaagug

SEQ ID NO: 96280 - RNA, 20 nt, Artificial Sequence
  MKO10096280_B_Lhpp
  gRNA
cgaugucaucaaauucugag

SEQ ID NO: 96281 - RNA, 20 nt, Artificial Sequence
  MKO10096281_B_Lhx1
  gRNA
agacaaaugguucccguagc

SEQ ID NO: 96282 - RNA, 20 nt, Artificial Sequence
  MKO10096282_B_Lhx1
  gRNA
acgccauauccgugagcaac

SEQ ID NO: 96283 - RNA, 20 nt, Artificial Sequence
  MKO10096283_B_Lhx1
  gRNA
gcggccgcugguggaccgcc

SEQ ID NO: 96284 - RNA, 20 nt, Artificial Sequence
  MKO10096284_B_Lhx2
  gRNA
gguagggcuggucacgaucc

SEQ ID NO: 96285 - RNA, 20 nt, Artificial Sequence
  MKO10096285_B_Lhx2
  gRNA
ggcgagucauuagaaaaggu

SEQ ID NO: 96286 - RNA, 20 nt, Artificial Sequence
  MKO10096286_B_Lhx2
  gRNA
cgagaacgaugcugaacacc

SEQ ID NO: 96287 - RNA, 20 nt, Artificial Sequence
  MKO10096287_B_Lhx3
  gRNA
cuacaacacuucgcccaagc

SEQ ID NO: 96288 - RNA, 20 nt, Artificial Sequence
  MKO10096288_B_Lhx3
  gRNA
ccugcauugcuucgccugcg

SEQ ID NO: 96289 - RNA, 20 nt, Artificial Sequence
  MKO10096289_B_Lhx3
  gRNA
cggcuugggcgaaguguugu

SEQ ID NO: 96290 - RNA, 20 nt, Artificial Sequence
  MKO10096290_B_Lhx4
  gRNA
uuucgcuacagaugacucgg

SEQ ID NO: 96291 - RNA, 20 nt, Artificial Sequence
  MKO10096291_B_Lhx4
  gRNA
aguucuacaagagugucaag

SEQ ID NO: 96292 - RNA, 20 nt, Artificial Sequence
  MKO10096292_B_Lhx4
  gRNA
ccuucaggaugaacuuaucc

SEQ ID NO: 96293 - RNA, 20 nt, Artificial Sequence
  MKO10096293_B_Lhx5
  gRNA
cgcuuuggcacaaagugcgc

SEQ ID NO: 96294 - RNA, 20 nt, Artificial Sequence
  MKO10096294_B_Lhx5
  gRNA
agguaucucuccgagcgacc

SEQ ID NO: 96295 - RNA, 20 nt, Artificial Sequence
  MKO10096295_B_Lhx5
  gRNA
ccaaagugacuacuacgcuc

SEQ ID NO: 96296 - RNA, 20 nt, Artificial Sequence
  MKO10096296_B_Lhx6
  gRNA
ccgugugucgcacaucgcug

SEQ ID NO: 96297 - RNA, 20 nt, Artificial Sequence
  MKO10096297_B_Lhx6
  gRNA
ccucagcgaugugcgacaca

SEQ ID NO: 96298 - RNA, 20 nt, Artificial Sequence
  MKO10096298_B_Lhx6
  gRNA
gucgcuuugcagccggaccc

SEQ ID NO: 96299 - RNA, 20 nt, Artificial Sequence
  MKO10096299_B_Lhx8
  gRNA
gcagugccccgggcucaugu

SEQ ID NO: 96300 - RNA, 20 nt, Artificial Sequence
  MKO10096300_B_Lhx8
  gRNA
gucguccucgccccagucca

SEQ ID NO: 96301 - RNA, 20 nt, Artificial Sequence
  MKO10096301_B_Lhx8
  gRNA
ucgggcuccgugugcccgcc

SEQ ID NO: 96302 - RNA, 20 nt, Artificial Sequence
  MKO10096302_B_Lhx9
  gRNA
ggagaucuugcccccgcagc

SEQ ID NO: 96303 - RNA, 20 nt, Artificial Sequence
  MKO10096303_B_Lhx9
  gRNA
cuccgacagguacuaucugc

SEQ ID NO: 96304 - RNA, 20 nt, Artificial Sequence
  MKO10096304_B_Lhx9
  gRNA
uguggccuccggagauuccg

SEQ ID NO: 96305 - RNA, 20 nt, Artificial Sequence
  MKO10096305_B_Lias
  gRNA
ggaaacuuaaagcgccagaa

SEQ ID NO: 96306 - RNA, 20 nt, Artificial Sequence
  MKO10096306_B_Lias
  gRNA
ccuuaccaugaucguggcug

SEQ ID NO: 96307 - RNA, 20 nt, Artificial Sequence
  MKO10096307_B_Lias
  gRNA
cuaggcuaagacuaccucca

SEQ ID NO: 96308 - RNA, 20 nt, Artificial Sequence
  MKO10096308_B_Lifr
  gRNA
gucguuccacuucaguagua

SEQ ID NO: 96309 - RNA, 20 nt, Artificial Sequence
  MKO10096309_B_Lifr
  gRNA
uugcaugcaucgucagaugc

SEQ ID NO: 96310 - RNA, 20 nt, Artificial Sequence
  MKO10096310_B_Lifr
  gRNA
caaccaacaacaugcgagug

SEQ ID NO: 96311 - RNA, 20 nt, Artificial Sequence
  MKO10096311_B_Lif
  gRNA
gugccaguugauucuugauc

SEQ ID NO: 96312 - RNA, 20 nt, Artificial Sequence
  MKO10096312_B_Lif
  gRNA
ccagcccauaaugaaggucu

SEQ ID NO: 96313 - RNA, 20 nt, Artificial Sequence
  MKO10096313_B_Lif
  gRNA
augcuacuauagacgucaug

SEQ ID NO: 96314 - RNA, 20 nt, Artificial Sequence
  MKO10096314_B_Lig1
  gRNA
acuggaaccuaccuggacuu

SEQ ID NO: 96315 - RNA, 20 nt, Artificial Sequence
  MKO10096315_B_Lig1
  gRNA
ucccuuacauacuuuggagg

SEQ ID NO: 96316 - RNA, 20 nt, Artificial Sequence
  MKO10096316_B_Lig1
  gRNA
cauaauacuucucugcaugu

SEQ ID NO: 96317 - RNA, 20 nt, Artificial Sequence
  MKO10096317_B_Lig3
  gRNA
cuugcagacagacucguucc

SEQ ID NO: 96318 - RNA, 20 nt, Artificial Sequence
  MKO10096318_B_Lig3
  gRNA
ccaccauggcgcacagcuuc

SEQ ID NO: 96319 - RNA, 20 nt, Artificial Sequence
  MKO10096319_B_Lig3
  gRNA
uaaacacucuugaugacacc

SEQ ID NO: 96320 - RNA, 20 nt, Artificial Sequence
  MKO10096320_B_Lig4
  gRNA
auuaguccacugacguacuc

SEQ ID NO: 96321 - RNA, 20 nt, Artificial Sequence
  MKO10096321_B_Lig4
  gRNA
uacaacuauaccgaccaguu

SEQ ID NO: 96322 - RNA, 20 nt, Artificial Sequence
  MKO10096322_B_Lig4
  gRNA
acuuagaaugucguuauucc

SEQ ID NO: 96323 - RNA, 20 nt, Artificial Sequence
  MKO10096323_B_Lilra5
  gRNA
auguauuuccaagagaucgc

SEQ ID NO: 96324 - RNA, 20 nt, Artificial Sequence
  MKO10096324_B_Lilra5
  gRNA
uagaagccgaucagccccuc

SEQ ID NO: 96325 - RNA, 20 nt, Artificial Sequence
  MKO10096325_B_Lilra5
  gRNA
ccagaucguuguucaauuga

SEQ ID NO: 96326 - RNA, 20 nt, Artificial Sequence
  MKO10096326_B_Lilra6
  gRNA
cacacuuggaccacagaguc

SEQ ID NO: 96327 - RNA, 20 nt, Artificial Sequence
  MKO10096327_B_Lilra6
  gRNA
gcauguugucgucucacaga

SEQ ID NO: 96328 - RNA, 20 nt, Artificial Sequence
  MKO10096328_B_Lilra6
  gRNA
agcucugcgaagacucacac

SEQ ID NO: 96329 - RNA, 20 nt, Artificial Sequence
  MKO10096329_B_Lilrb4
  gRNA
aaugaaucugccaaauacua

SEQ ID NO: 96330 - RNA, 20 nt, Artificial Sequence
  MKO10096330_B_Lilrb4
  gRNA
cccucacuuaccaucuucag

SEQ ID NO: 96331 - RNA, 20 nt, Artificial Sequence
  MKO10096331_B_Lilrb4
  gRNA
uccucuacacccacugaaga

SEQ ID NO: 96332 - RNA, 20 nt, Artificial Sequence
  MKO10096332_B_Lim2
  gRNA
gacacccaugaugaugcccg

SEQ ID NO: 96333 - RNA, 20 nt, Artificial Sequence
  MKO10096333_B_Lim2
  gRNA
gaagguggauugcugcgcaa

SEQ ID NO: 96334 - RNA, 20 nt, Artificial Sequence
  MKO10096334_B_Lim2
  gRNA
gacuccaguguaaauagcca

SEQ ID NO: 96335 - RNA, 20 nt, Artificial Sequence
  MKO10096335_B_Lima1
  gRNA
cgaggccugcagcguccauc

SEQ ID NO: 96336 - RNA, 20 nt, Artificial Sequence
  MKO10096336_B_Lima1
  gRNA
gccuccuuccacccgcauuu

SEQ ID NO: 96337 - RNA, 20 nt, Artificial Sequence
  MKO10096337_B_Lima1
  gRNA
acaccuacuguguagcuggc

SEQ ID NO: 96338 - RNA, 20 nt, Artificial Sequence
  MKO10096338_B_Limch1
  gRNA
agucgauguagccacugucu

SEQ ID NO: 96339 - RNA, 20 nt, Artificial Sequence
  MKO10096339_B_Limch1
  gRNA
cagcggugcugccgcacagc

SEQ ID NO: 96340 - RNA, 20 nt, Artificial Sequence
  MKO10096340_B_Limch1
  gRNA
gcacgaguauguuugacaug

SEQ ID NO: 96341 - RNA, 20 nt, Artificial Sequence
  MKO10096341_B_Limd1
  gRNA
ucuuuguggacaccugauca

SEQ ID NO: 96342 - RNA, 20 nt, Artificial Sequence
  MKO10096342_B_Limd1
  gRNA
uccugugugaaaugcagcaa

SEQ ID NO: 96343 - RNA, 20 nt, Artificial Sequence
  MKO10096343_B_Limd1
  gRNA
cacucaccauguccaugauc

SEQ ID NO: 96344 - RNA, 20 nt, Artificial Sequence
  MKO10096344_B_Limd2
  gRNA
gcauugcagcauaacugccc

SEQ ID NO: 96345 - RNA, 20 nt, Artificial Sequence
  MKO10096345_B_Limd2
  gRNA
ucugccaccagccgcuccau

SEQ ID NO: 96346 - RNA, 20 nt, Artificial Sequence
  MKO10096346_B_Limd2
  gRNA
ccugggcggcuccggcagcu

SEQ ID NO: 96347 - RNA, 20 nt, Artificial Sequence
  MKO10096347_B_Lime1
  gRNA
gggagaacaagucugccgcu

SEQ ID NO: 96348 - RNA, 20 nt, Artificial Sequence
  MKO10096348_B_Lime1
  gRNA
agacugcaugagcugcaccg

SEQ ID NO: 96349 - RNA, 20 nt, Artificial Sequence
  MKO10096349_B_Lime1
  gRNA
ucggugcagcucaugcaguc

SEQ ID NO: 96350 - RNA, 20 nt, Artificial Sequence
  MKO10096350_B_Limk1
  gRNA
guccauccuucucguaguac

SEQ ID NO: 96351 - RNA, 20 nt, Artificial Sequence
  MKO10096351_B_Limk1
  gRNA
cuaugacggccaguaccucc

SEQ ID NO: 96352 - RNA, 20 nt, Artificial Sequence
  MKO10096352_B_Limk1
  gRNA
acuggccgucauagauccuc

SEQ ID NO: 96353 - RNA, 20 nt, Artificial Sequence
  MKO10096353_B_Limk2
  gRNA
ccuccucuacucgcagagua

SEQ ID NO: 96354 - RNA, 20 nt, Artificial Sequence
  MKO10096354_B_Limk2
  gRNA
caugaccaucacuuugccug

SEQ ID NO: 96355 - RNA, 20 nt, Artificial Sequence
  MKO10096355_B_Limk2
  gRNA
gcugagcaugagcguguguc

SEQ ID NO: 96356 - RNA, 20 nt, Artificial Sequence
  MKO10096356_B_Lims1
  gRNA
gggucguucuugaagaucag

SEQ ID NO: 96357 - RNA, 20 nt, Artificial Sequence
  MKO10096357_B_Lims1
  gRNA
aggucacaucggaagcacuc

SEQ ID NO: 96358 - RNA, 20 nt, Artificial Sequence
  MKO10096358_B_Lims1
  gRNA
auaggguuugucaagaaugc

SEQ ID NO: 96359 - RNA, 20 nt, Artificial Sequence
  MKO10096359_B_Lims2
  gRNA
ucaaggccaugaacgccaac

SEQ ID NO: 96360 - RNA, 20 nt, Artificial Sequence
  MKO10096360_B_Lims2
  gRNA
uuaccacagaauccgcagca

SEQ ID NO: 96361 - RNA, 20 nt, Artificial Sequence
  MKO10096361_B_Lims2
  gRNA
aggaugccaguuggcguuca

SEQ ID NO: 96362 - RNA, 20 nt, Artificial Sequence
  MKO10096362_B_Lin28a
  gRNA
agcucgaaccugcaaacugc

SEQ ID NO: 96363 - RNA, 20 nt, Artificial Sequence
  MKO10096363_B_Lin28a
  gRNA
guguccacugaaggcccagc

SEQ ID NO: 96364 - RNA, 20 nt, Artificial Sequence
  MKO10096364_B_Lin28a
  gRNA
ugggcuagaccaucaugcca

SEQ ID NO: 96365 - RNA, 20 nt, Artificial Sequence
  MKO10096365_B_Lin28b
  gRNA
gcacguugaaccauuuacag

SEQ ID NO: 96366 - RNA, 20 nt, Artificial Sequence
  MKO10096366_B_Lin28b
  gRNA
cuguuacccguauugacuca

SEQ ID NO: 96367 - RNA, 20 nt, Artificial Sequence
  MKO10096367_B_Lin28b
  gRNA
acgaaagcguuugcagcaau

SEQ ID NO: 96368 - RNA, 20 nt, Artificial Sequence
  MKO10096368_B_Lin37
  gRNA
ucuacccucagagauggaga

SEQ ID NO: 96369 - RNA, 20 nt, Artificial Sequence
  MKO10096369_B_Lin37
  gRNA
gauuguuccauugcugccac

SEQ ID NO: 96370 - RNA, 20 nt, Artificial Sequence
  MKO10096370_B_Lin37
  gRNA
gaacgccuggaugaagaagc

SEQ ID NO: 96371 - RNA, 20 nt, Artificial Sequence
  MKO10096371_B_Lin52
  gRNA
cacacucauccagccccagc

SEQ ID NO: 96372 - RNA, 20 nt, Artificial Sequence
  MKO10096372_B_Lin52
  gRNA
gaugacauugauauguugaa

SEQ ID NO: 96373 - RNA, 20 nt, Artificial Sequence
  MKO10096373_B_Lin52
  gRNA
gcugcaaauucagcgacacc

SEQ ID NO: 96374 - RNA, 20 nt, Artificial Sequence
  MKO10096374_B_Lin54
  gRNA
gcaucuccacccgucgucac

SEQ ID NO: 96375 - RNA, 20 nt, Artificial Sequence
  MKO10096375_B_Lin54
  gRNA
aauggaacugacauccguac

SEQ ID NO: 96376 - RNA, 20 nt, Artificial Sequence
  MKO10096376_B_Lin54
  gRNA
ggauacaaaccuugcuggag

SEQ ID NO: 96377 - RNA, 20 nt, Artificial Sequence
  MKO10096377_B_Lin7a
  gRNA
caugaaacgauuacuguuaa

SEQ ID NO: 96378 - RNA, 20 nt, Artificial Sequence
  MKO10096378_B_Lin7a
  gRNA
aggcucguuucgagaagcug

SEQ ID NO: 96379 - RNA, 20 nt, Artificial Sequence
  MKO10096379_B_Lin7a
  gRNA
gaccagcugcuaucagugaa

SEQ ID NO: 96380 - RNA, 20 nt, Artificial Sequence
  MKO10096380_B_Lin7b
  gRNA
ggcguggcugaucgccaugg

SEQ ID NO: 96381 - RNA, 20 nt, Artificial Sequence
  MKO10096381_B_Lin7b
  gRNA
cagaucgcaucuucucgaag

SEQ ID NO: 96382 - RNA, 20 nt, Artificial Sequence
  MKO10096382_B_Lin7b
  gRNA
ucacuggcagcgccgaggug

SEQ ID NO: 96383 - RNA, 20 nt, Artificial Sequence
  MKO10096383_B_Lin7c
  gRNA
guucugcaaugcuguaagag

SEQ ID NO: 96384 - RNA, 20 nt, Artificial Sequence
  MKO10096384_B_Lin7c
  gRNA
gagagccaaugcaacugcaa

SEQ ID NO: 96385 - RNA, 20 nt, Artificial Sequence
  MKO10096385_B_Lin7c
  gRNA
cgacuaauuuaaccuucccu

SEQ ID NO: 96386 - RNA, 20 nt, Artificial Sequence
  MKO10096386_B_Lin9
  gRNA
ugcgggcccugcuguagaaa

SEQ ID NO: 96387 - RNA, 20 nt, Artificial Sequence
  MKO10096387_B_Lin9
  gRNA
agggaaguuuaucuaacaca

SEQ ID NO: 96388 - RNA, 20 nt, Artificial Sequence
  MKO10096388_B_Lin9
  gRNA
accuaaaagaaaccagagag

SEQ ID NO: 96389 - RNA, 20 nt, Artificial Sequence
  MKO10096389_B_Lingo1
  gRNA
uguugagaugucguagccgc

SEQ ID NO: 96390 - RNA, 20 nt, Artificial Sequence
  MKO10096390_B_Lingo1
  gRNA
aaugagcgucuugaugucga

SEQ ID NO: 96391 - RNA, 20 nt, Artificial Sequence
  MKO10096391_B_Lingo1
  gRNA
agcccucgauuguaccgauu

SEQ ID NO: 96392 - RNA, 20 nt, Artificial Sequence
  MKO10096392_B_Lingo2
  gRNA
guggugauaaaacgccuucg

SEQ ID NO: 96393 - RNA, 20 nt, Artificial Sequence
  MKO10096393_B_Lingo2
  gRNA
accgcuuccuuuacgcaaac

SEQ ID NO: 96394 - RNA, 20 nt, Artificial Sequence
  MKO10096394_B_Lingo2
  gRNA
aguauuggcauuagugccgu

SEQ ID NO: 96395 - RNA, 20 nt, Artificial Sequence
  MKO10096395_B_Lingo3
  gRNA
cccggccgaaacucgcaugc

SEQ ID NO: 96396 - RNA, 20 nt, Artificial Sequence
  MKO10096396_B_Lingo3
  gRNA
ggcuggcagccguaaccgag

SEQ ID NO: 96397 - RNA, 20 nt, Artificial Sequence
  MKO10096397_B_Lingo3
  gRNA
ggagccugccgucgaaguuc

SEQ ID NO: 96398 - RNA, 20 nt, Artificial Sequence
  MKO10096398_B_Lingo4
  gRNA
augccaccccccagcuucuc

SEQ ID NO: 96399 - RNA, 20 nt, Artificial Sequence
  MKO10096399_B_Lingo4
  gRNA
gaauaguguccagucgccug

SEQ ID NO: 96400 - RNA, 20 nt, Artificial Sequence
  MKO10096400_B_Lingo4
  gRNA
ugucccgcagcuguaccgag

SEQ ID NO: 96401 - RNA, 20 nt, Artificial Sequence
  MKO10096401_B_Lins
  gRNA
gugaagcagugcguugccuc

SEQ ID NO: 96402 - RNA, 20 nt, Artificial Sequence
  MKO10096402_B_Lins
  gRNA
augcucuagauauucuugcc

SEQ ID NO: 96403 - RNA, 20 nt, Artificial Sequence
  MKO10096403_B_Lins
  gRNA
uucaaccuggaugcagacuc

SEQ ID NO: 96404 - RNA, 20 nt, Artificial Sequence
  MKO10096404_B_Lipa
  gRNA
ccgugcugaagauacacaac

SEQ ID NO: 96405 - RNA, 20 nt, Artificial Sequence
  MKO10096405_B_Lipa
  gRNA
ugcuggcagauucuaguaac

SEQ ID NO: 96406 - RNA, 20 nt, Artificial Sequence
  MKO10096406_B_Lipa
  gRNA
ggcccaaguaccuugagaag

SEQ ID NO: 96407 - RNA, 20 nt, Artificial Sequence
  MKO10096407_B_Lipc
  gRNA
ccaagaugaaaacgaucgcc

SEQ ID NO: 96408 - RNA, 20 nt, Artificial Sequence
  MKO10096408_B_Lipc
  gRNA
guuaguggacuggaucuccc

SEQ ID NO: 96409 - RNA, 20 nt, Artificial Sequence
  MKO10096409_B_Lipc
  gRNA
uguucaaaacacccguauug

SEQ ID NO: 96410 - RNA, 20 nt, Artificial Sequence
  MKO10096410_B_Lipe
  gRNA
gcccgauggagagagucugc

SEQ ID NO: 96411 - RNA, 20 nt, Artificial Sequence
  MKO10096411_B_Lipe
  gRNA
aucuccuaugaccuacggga

SEQ ID NO: 96412 - RNA, 20 nt, Artificial Sequence
  MKO10096412_B_Lipe
  gRNA
gcguuuguagugcuccccga

SEQ ID NO: 96413 - RNA, 20 nt, Artificial Sequence
  MKO10096413_B_Lipf
  gRNA
gcccagaauucaacugaguc

SEQ ID NO: 96414 - RNA, 20 nt, Artificial Sequence
  MKO10096414_B_Lipf
  gRNA
cauaccuugagaagaaacuu

SEQ ID NO: 96415 - RNA, 20 nt, Artificial Sequence
  MKO10096415_B_Lipf
  gRNA
uucuuacagcuuugaugaaa

SEQ ID NO: 96416 - RNA, 20 nt, Artificial Sequence
  MKO10096416_B_Lipg
  gRNA
agagaaagaugcuaacgucg

SEQ ID NO: 96417 - RNA, 20 nt, Artificial Sequence
  MKO10096417_B_Lipg
  gRNA
ggcgguagcugguacuccag

SEQ ID NO: 96418 - RNA, 20 nt, Artificial Sequence
  MKO10096418_B_Lipg
  gRNA
ccguguacagcugaugagcc

SEQ ID NO: 96419 - RNA, 20 nt, Artificial Sequence
  MKO10096419_B_Liph
  gRNA
agccuguuggccggaaaccg

SEQ ID NO: 96420 - RNA, 20 nt, Artificial Sequence
  MKO10096420_B_Liph
  gRNA
cgagucguaugaggggaagc

SEQ ID NO: 96421 - RNA, 20 nt, Artificial Sequence
  MKO10096421_B_Liph
  gRNA
uacaugauuggaguaagucu

SEQ ID NO: 96422 - RNA, 20 nt, Artificial Sequence
  MKO10096422_B_Lipi
  gRNA
auuucaggucuugacccagc

SEQ ID NO: 96423 - RNA, 20 nt, Artificial Sequence
  MKO10096423_B_Lipi
  gRNA
agcuuaggggcucauauuag

SEQ ID NO: 96424 - RNA, 20 nt, Artificial Sequence
  MKO10096424_B_Lipi
  gRNA
aauugucaagugaugcccca

SEQ ID NO: 96425 - RNA, 20 nt, Artificial Sequence
  MKO10096425_B_Lipk
  gRNA
ccccggcagcugggacgaga

SEQ ID NO: 96426 - RNA, 20 nt, Artificial Sequence
  MKO10096426_B_Lipk
  gRNA
auucucuacgaauccagagc

SEQ ID NO: 96427 - RNA, 20 nt, Artificial Sequence
  MKO10096427_B_Lipk
  gRNA
gcuacauccuuggaacuuac

SEQ ID NO: 96428 - RNA, 20 nt, Artificial Sequence
  MKO10096428_B_Lipm
  gRNA
ccauguugcaguaacaccac

SEQ ID NO: 96429 - RNA, 20 nt, Artificial Sequence
  MKO10096429_B_Lipm
  gRNA
cuacucacagggcaccacca

SEQ ID NO: 96430 - RNA, 20 nt, Artificial Sequence
  MKO10096430_B_Lipm
  gRNA
ugaggaguaugaaguugcaa

SEQ ID NO: 96431 - RNA, 20 nt, Artificial Sequence
  MKO10096431_B_Lipn
  gRNA
cauucacucggcacuacaau

SEQ ID NO: 96432 - RNA, 20 nt, Artificial Sequence
  MKO10096432_B_Lipn
  gRNA
caucugcuaguaugaacccu

SEQ ID NO: 96433 - RNA, 20 nt, Artificial Sequence
  MKO10096433_B_Lipn
  gRNA
acaaugaaaucuauuauccc

SEQ ID NO: 96434 - RNA, 20 nt, Artificial Sequence
  MKO10096434_B_Lipo1
  gRNA
agagcgagauuauuaaacac

SEQ ID NO: 96435 - RNA, 20 nt, Artificial Sequence
  MKO10096435_B_Lipo1
  gRNA
uuagcauuguucuucccaug

SEQ ID NO: 96436 - RNA, 20 nt, Artificial Sequence
  MKO10096436_B_Lipo1
  gRNA
caagaaggguuccuugagaa

SEQ ID NO: 96437 - RNA, 20 nt, Artificial Sequence
  MKO10096437_B_Lipt1
  gRNA
gcggcgcaucaucaaguuga

SEQ ID NO: 96438 - RNA, 20 nt, Artificial Sequence
  MKO10096438_B_Lipt1
  gRNA
ucgcugaagagcccguacug

SEQ ID NO: 96439 - RNA, 20 nt, Artificial Sequence
  MKO10096439_B_Lipt1
  gRNA
guuucaugugccguaugagc

SEQ ID NO: 96440 - RNA, 20 nt, Artificial Sequence
  MKO10096440_B_Lipt2
  gRNA
acuguucaaccgaccucaca

SEQ ID NO: 96441 - RNA, 20 nt, Artificial Sequence
  MKO10096441_B_Lipt2
  gRNA
acgcgguggccugacacccg

SEQ ID NO: 96442 - RNA, 20 nt, Artificial Sequence
  MKO10096442_B_Lipt2
  gRNA
ccgcgcgaugucgcugccug

SEQ ID NO: 96443 - RNA, 20 nt, Artificial Sequence
  MKO10096443_B_Liuaf
  gRNA
caaguccuacaagcgcuugu

SEQ ID NO: 96444 - RNA, 20 nt, Artificial Sequence
  MKO10096444_B_Liuaf
  gRNA
ggucacgaucaucuugcugc

SEQ ID NO: 96445 - RNA, 20 nt, Artificial Sequence
  MKO10096445_B_Liuaf
  gRNA
ggugagggcucccgcauugu

SEQ ID NO: 96446 - RNA, 20 nt, Artificial Sequence
  MKO10096446_B_Lix1l
  gRNA
aagcugacaacccaaauacg

SEQ ID NO: 96447 - RNA, 20 nt, Artificial Sequence
  MKO10096447_B_Lix1l
  gRNA
cagagugacauagcagacgu

SEQ ID NO: 96448 - RNA, 20 nt, Artificial Sequence
  MKO10096448_B_Lix1l
  gRNA
auggcagccuuaaggccaug

SEQ ID NO: 96449 - RNA, 20 nt, Artificial Sequence
  MKO10096449_B_Lix1
  gRNA
auagaccaccagucccucac

SEQ ID NO: 96450 - RNA, 20 nt, Artificial Sequence
  MKO10096450_B_Lix1
  gRNA
ugacuccagcauguagugau

SEQ ID NO: 96451 - RNA, 20 nt, Artificial Sequence
  MKO10096451_B_Lix1
  gRNA
caagggcacguuagaugaug

SEQ ID NO: 96452 - RNA, 20 nt, Artificial Sequence
  MKO10096452_B_Llgl1
  gRNA
cgauccugagcuccgcauca

SEQ ID NO: 96453 - RNA, 20 nt, Artificial Sequence
  MKO10096453_B_Llgl1
  gRNA
ccccaaucagcccagcgccu

SEQ ID NO: 96454 - RNA, 20 nt, Artificial Sequence
  MKO10096454_B_Llgl1
  gRNA
ggugggcgcagccauuauga

SEQ ID NO: 96455 - RNA, 20 nt, Artificial Sequence
  MKO10096455_B_Llgl2
  gRNA
uauagccaagggcgcugggc

SEQ ID NO: 96456 - RNA, 20 nt, Artificial Sequence
  MKO10096456_B_Llgl2
  gRNA
ccuuccagauauggcgcccc

SEQ ID NO: 96457 - RNA, 20 nt, Artificial Sequence
  MKO10096457_B_Llgl2
  gRNA
acaccccgcccuugaccuuc

SEQ ID NO: 96458 - RNA, 20 nt, Artificial Sequence
  MKO10096458_B_Llph
  gRNA
ucuuuaaggucuaccaggcc

SEQ ID NO: 96459 - RNA, 20 nt, Artificial Sequence
  MKO10096459_B_Llph
  gRNA
guaaguggaagaggaagaug

SEQ ID NO: 96460 - RNA, 20 nt, Artificial Sequence
  MKO10096460_B_Llph
  gRNA
uucagucuguugagcucccu

SEQ ID NO: 96461 - RNA, 20 nt, Artificial Sequence
  MKO10096461_B_Lman1l
  gRNA
ccgcuccgguucuucaugga

SEQ ID NO: 96462 - RNA, 20 nt, Artificial Sequence
  MKO10096462_B_Lman1l
  gRNA
gccgcacuuccucuaagccu

SEQ ID NO: 96463 - RNA, 20 nt, Artificial Sequence
  MKO10096463_B_Lman1l
  gRNA
acccgagcucggaaggggaa

SEQ ID NO: 96464 - RNA, 20 nt, Artificial Sequence
  MKO10096464_B_Lman1
  gRNA
uguuuggaucagcugauacg

SEQ ID NO: 96465 - RNA, 20 nt, Artificial Sequence
  MKO10096465_B_Lman1
  gRNA
auucgaaucugaucugcacu

SEQ ID NO: 96466 - RNA, 20 nt, Artificial Sequence
  MKO10096466_B_Lman1
  gRNA
guaucagcugauccaaacac

SEQ ID NO: 96467 - RNA, 20 nt, Artificial Sequence
  MKO10096467_B_Lman2l
  gRNA
ucuuaccacccgguuccaca

SEQ ID NO: 96468 - RNA, 20 nt, Artificial Sequence
  MKO10096468_B_Lman2l
  gRNA
caggugcacuucaagauuca

SEQ ID NO: 96469 - RNA, 20 nt, Artificial Sequence
  MKO10096469_B_Lman2l
  gRNA
cuuggcaaucugguacacaa

SEQ ID NO: 96470 - RNA, 20 nt, Artificial Sequence
  MKO10096470_B_Lman2
  gRNA
uucaccaucaccgagaugua

SEQ ID NO: 96471 - RNA, 20 nt, Artificial Sequence
  MKO10096471_B_Lman2
  gRNA
ccuccucaccugguacgagg

SEQ ID NO: 96472 - RNA, 20 nt, Artificial Sequence
  MKO10096472_B_Lman2
  gRNA
ccaguacgugcgccugaccc

SEQ ID NO: 96473 - RNA, 20 nt, Artificial Sequence
  MKO10096473_B_Lmbr1l
  gRNA
guaccuguggugaacucagc

SEQ ID NO: 96474 - RNA, 20 nt, Artificial Sequence
  MKO10096474_B_Lmbr1l
  gRNA
ugaagcgggucaggaagaua

SEQ ID NO: 96475 - RNA, 20 nt, Artificial Sequence
  MKO10096475_B_Lmbr1l
  gRNA
aaggaagacgagggacagau

SEQ ID NO: 96476 - RNA, 20 nt, Artificial Sequence
  MKO10096476_B_Lmbr1
  gRNA
auaagauacaagagaaaauc

SEQ ID NO: 96477 - RNA, 20 nt, Artificial Sequence
  MKO10096477_B_Lmbr1
  gRNA
uucugauuccagaaagaaaa

SEQ ID NO: 96478 - RNA, 20 nt, Artificial Sequence
  MKO10096478_B_Lmbr1
  gRNA
ugcagaugaacaagaagaug

SEQ ID NO: 96479 - RNA, 20 nt, Artificial Sequence
  MKO10096479_B_Lmbrd1
  gRNA
guacuucuacuacgaagaga

SEQ ID NO: 96480 - RNA, 20 nt, Artificial Sequence
  MKO10096480_B_Lmbrd1
  gRNA
ugcgcucugcugcuucucgu

SEQ ID NO: 96481 - RNA, 20 nt, Artificial Sequence
  MKO10096481_B_Lmbrd1
  gRNA
ucguaguagaaguacacaaa

SEQ ID NO: 96482 - RNA, 20 nt, Artificial Sequence
  MKO10096482_B_Lmbrd2
  gRNA
agacaauauauaaccgaugc

SEQ ID NO: 96483 - RNA, 20 nt, Artificial Sequence
  MKO10096483_B_Lmbrd2
  gRNA
cuaucccaaucgucugaagu

SEQ ID NO: 96484 - RNA, 20 nt, Artificial Sequence
  MKO10096484_B_Lmbrd2
  gRNA
aggaaccaacuucagacgau

SEQ ID NO: 96485 - RNA, 20 nt, Artificial Sequence
  MKO10096485_B_Lmcd1
  gRNA
auccauuaccuccacgagug

SEQ ID NO: 96486 - RNA, 20 nt, Artificial Sequence
  MKO10096486_B_Lmcd1
  gRNA
cucucgaugccguggacuug

SEQ ID NO: 96487 - RNA, 20 nt, Artificial Sequence
  MKO10096487_B_Lmcd1
  gRNA
gagggguccuggucauagau

SEQ ID NO: 96488 - RNA, 20 nt, Artificial Sequence
  MKO10096488_B_Lmf1
  gRNA
cugcauggacuuccacuaug

SEQ ID NO: 96489 - RNA, 20 nt, Artificial Sequence
  MKO10096489_B_Lmf1
  gRNA
ggaucuuucugagcccucuc

SEQ ID NO: 96490 - RNA, 20 nt, Artificial Sequence
  MKO10096490_B_Lmf1
  gRNA
ugauucugaagaucagccag

SEQ ID NO: 96491 - RNA, 20 nt, Artificial Sequence
  MKO10096491_B_Lmf2
  gRNA
ggccgcaguguucuucgagc

SEQ ID NO: 96492 - RNA, 20 nt, Artificial Sequence
  MKO10096492_B_Lmf2
  gRNA
ggcuagcacggugcccaaua

SEQ ID NO: 96493 - RNA, 20 nt, Artificial Sequence
  MKO10096493_B_Lmf2
  gRNA
gacuggcuuccuagcuauac

SEQ ID NO: 96494 - RNA, 20 nt, Artificial Sequence
  MKO10096494_B_Lmln
  gRNA
acucuucuaggucauaaaua

SEQ ID NO: 96495 - RNA, 20 nt, Artificial Sequence
  MKO10096495_B_Lmln
  gRNA
agacuuacucuucaaugcuc

SEQ ID NO: 96496 - RNA, 20 nt, Artificial Sequence
  MKO10096496_B_Lmln
  gRNA
cuaaguaagauccugccagc

SEQ ID NO: 96497 - RNA, 20 nt, Artificial Sequence
  MKO10096497_B_Lmna
  gRNA
ucucagugagaagcgcacau

SEQ ID NO: 96498 - RNA, 20 nt, Artificial Sequence
  MKO10096498_B_Lmna
  gRNA
ccucgcuguaaauguucuuc

SEQ ID NO: 96499 - RNA, 20 nt, Artificial Sequence
  MKO10096499_B_Lmna
  gRNA
cccugcagcuggauaaugcc

SEQ ID NO: 96500 - RNA, 20 nt, Artificial Sequence
  MKO10096500_B_Lmnb1
  gRNA
agaggcucucgauccucauc

SEQ ID NO: 96501 - RNA, 20 nt, Artificial Sequence
  MKO10096501_B_Lmnb1
  gRNA
cauacucucgaagcuugauc

SEQ ID NO: 96502 - RNA, 20 nt, Artificial Sequence
  MKO10096502_B_Lmnb1
  gRNA
ucgcugucagagccuuacug

SEQ ID NO: 96503 - RNA, 20 nt, Artificial Sequence
  MKO10096503_B_Lmnb2
  gRNA
gcuccaguucuacccgguac

SEQ ID NO: 96504 - RNA, 20 nt, Artificial Sequence
  MKO10096504_B_Lmnb2
  gRNA
ggcagaagauggucaugcug

SEQ ID NO: 96505 - RNA, 20 nt, Artificial Sequence
  MKO10096505_B_Lmnb2
  gRNA
gaaccgaugccagagccugc

SEQ ID NO: 96506 - RNA, 20 nt, Artificial Sequence
  MKO10096506_B_Lmo1
  gRNA
agcgcccgagaugauggugc

SEQ ID NO: 96507 - RNA, 20 nt, Artificial Sequence
  MKO10096507_B_Lmo1
  gRNA
gccccuccucauaguccacc

SEQ ID NO: 96508 - RNA, 20 nt, Artificial Sequence
  MKO10096508_B_Lmo1
  gRNA
caaggugauacacauugucu

SEQ ID NO: 96509 - RNA, 20 nt, Artificial Sequence
  MKO10096509_B_Lmo2
  gRNA
acacuuacucagacgggucc

SEQ ID NO: 96510 - RNA, 20 nt, Artificial Sequence
  MKO10096510_B_Lmo2
  gRNA
gugaacaagacaucuacgag

SEQ ID NO: 96511 - RNA, 20 nt, Artificial Sequence
  MKO10096511_B_Lmo2
  gRNA
uccgucccagcuuguaguag

SEQ ID NO: 96512 - RNA, 20 nt, Artificial Sequence
  MKO10096512_B_Lmo3
  gRNA
gaaagaaggcuaugcacccc

SEQ ID NO: 96513 - RNA, 20 nt, Artificial Sequence
  MKO10096513_B_Lmo3
  gRNA
ucuuugccagacagacuacg

SEQ ID NO: 96514 - RNA, 20 nt, Artificial Sequence
  MKO10096514_B_Lmo3
  gRNA
caaggauaauguguaccacc

SEQ ID NO: 96515 - RNA, 20 nt, Artificial Sequence
  MKO10096515_B_Lmo4
  gRNA
cugcaagugagcucgucaug

SEQ ID NO: 96516 - RNA, 20 nt, Artificial Sequence
  MKO10096516_B_Lmo4
  gRNA
auguagugaaaccgaucucc

SEQ ID NO: 96517 - RNA, 20 nt, Artificial Sequence
  MKO10096517_B_Lmo4
  gRNA
ugagaugauacacguugccu

SEQ ID NO: 96518 - RNA, 20 nt, Artificial Sequence
  MKO10096518_B_Lmo7
  gRNA
gauaaguccuguagaucccc

SEQ ID NO: 96519 - RNA, 20 nt, Artificial Sequence
  MKO10096519_B_Lmo7
  gRNA
uuucgagccucucuagaaaa

SEQ ID NO: 96520 - RNA, 20 nt, Artificial Sequence
  MKO10096520_B_Lmo7
  gRNA
acaggcaagaagagacugac

SEQ ID NO: 96521 - RNA, 20 nt, Artificial Sequence
  MKO10096521_B_Lmod1
  gRNA
ggacagcaggcuaucgaugu

SEQ ID NO: 96522 - RNA, 20 nt, Artificial Sequence
  MKO10096522_B_Lmod1
  gRNA
ggugcccaagcuacuucaau

SEQ ID NO: 96523 - RNA, 20 nt, Artificial Sequence
  MKO10096523_B_Lmod1
  gRNA
ccuguccuauugaaguagcu

SEQ ID NO: 96524 - RNA, 20 nt, Artificial Sequence
  MKO10096524_B_Lmod2
  gRNA
cuucagccgagaggcgcuga

SEQ ID NO: 96525 - RNA, 20 nt, Artificial Sequence
  MKO10096525_B_Lmod2
  gRNA
aucggucuaucucagagcuu

SEQ ID NO: 96526 - RNA, 20 nt, Artificial Sequence
  MKO10096526_B_Lmod2
  gRNA
gcccagcgcgcccuacaaaa

SEQ ID NO: 96527 - RNA, 20 nt, Artificial Sequence
  MKO10096527_B_Lmod3
  gRNA
cuucaucgagcuccucacua

SEQ ID NO: 96528 - RNA, 20 nt, Artificial Sequence
  MKO10096528_B_Lmod3
  gRNA
aacgcaggugcaacugccaa

SEQ ID NO: 96529 - RNA, 20 nt, Artificial Sequence
  MKO10096529_B_Lmod3
  gRNA
ucaucuuacuccagcuccuu

SEQ ID NO: 96530 - RNA, 20 nt, Artificial Sequence
  MKO10096530_B_Lmtk2
  gRNA
ccacagucucaacuacauac

SEQ ID NO: 96531 - RNA, 20 nt, Artificial Sequence
  MKO10096531_B_Lmtk2
  gRNA
auggacggggugucuucugc

SEQ ID NO: 96532 - RNA, 20 nt, Artificial Sequence
  MKO10096532_B_Lmtk2
  gRNA
cuccuuguuugugauccugu

SEQ ID NO: 96533 - RNA, 20 nt, Artificial Sequence
  MKO10096533_B_Lmtk3
  gRNA
ugaugucuauauucugccgc

SEQ ID NO: 96534 - RNA, 20 nt, Artificial Sequence
  MKO10096534_B_Lmtk3
  gRNA
uggggaguacacccccccug

SEQ ID NO: 96535 - RNA, 20 nt, Artificial Sequence
  MKO10096535_B_Lmtk3
  gRNA
agaugaacuugcgcuguucc

SEQ ID NO: 96536 - RNA, 20 nt, Artificial Sequence
  MKO10096536_B_Lmx1a
  gRNA
uuuaggcaaaagcgaugaug

SEQ ID NO: 96537 - RNA, 20 nt, Artificial Sequence
  MKO10096537_B_Lmx1a
  gRNA
agcagguuaccuuggcucgc

SEQ ID NO: 96538 - RNA, 20 nt, Artificial Sequence
  MKO10096538_B_Lmx1a
  gRNA
gacagggcugaguguccgug

SEQ ID NO: 96539 - RNA, 20 nt, Artificial Sequence
  MKO10096539_B_Lmx1b
  gRNA
cagcgcccgcaugacgaacu

SEQ ID NO: 96540 - RNA, 20 nt, Artificial Sequence
  MKO10096540_B_Lmx1b
  gRNA
augacgggaaagacccgaga

SEQ ID NO: 96541 - RNA, 20 nt, Artificial Sequence
  MKO10096541_B_Lmx1b
  gRNA
gaggaugguucggggccguu

SEQ ID NO: 96542 - RNA, 20 nt, Artificial Sequence
  MKO10096542_B_Lnpep
  gRNA
cucuuacccaauuucuuaag

SEQ ID NO: 96543 - RNA, 20 nt, Artificial Sequence
  MKO10096543_B_Lnpep
  gRNA
ugcguuaucaaauaugccua

SEQ ID NO: 96544 - RNA, 20 nt, Artificial Sequence
  MKO10096544_B_Lnpep
  gRNA
cuuucauuguaggggagaug

SEQ ID NO: 96545 - RNA, 20 nt, Artificial Sequence
  MKO10096545_B_Lnp
  gRNA
aguucuagaaaauauagaua

SEQ ID NO: 96546 - RNA, 20 nt, Artificial Sequence
  MKO10096546_B_Lnp
  gRNA
acuauuucucucuguucucu

SEQ ID NO: 96547 - RNA, 20 nt, Artificial Sequence
  MKO10096547_B_Lnp
  gRNA
agucuugcuguaaacucauc

SEQ ID NO: 96548 - RNA, 20 nt, Artificial Sequence
  MKO10096548_B_Lnx1
  gRNA
ucucauaguggagcgcucaa

SEQ ID NO: 96549 - RNA, 20 nt, Artificial Sequence
  MKO10096549_B_Lnx1
  gRNA
ccagcgaaagccucuccaua

SEQ ID NO: 96550 - RNA, 20 nt, Artificial Sequence
  MKO10096550_B_Lnx1
  gRNA
auccuccaccgaggacacgu

SEQ ID NO: 96551 - RNA, 20 nt, Artificial Sequence
  MKO10096551_B_Lnx2
  gRNA
gccacccucgcacagccgac

SEQ ID NO: 96552 - RNA, 20 nt, Artificial Sequence
  MKO10096552_B_Lnx2
  gRNA
gcucugucgagucucgcuug

SEQ ID NO: 96553 - RNA, 20 nt, Artificial Sequence
  MKO10096553_B_Lnx2
  gRNA
ucuaacccguacauccaguu

SEQ ID NO: 96554 - RNA, 20 nt, Artificial Sequence
  MKO10096554_B_Loh12cr1
  gRNA
caccacgauaucguccaucu

SEQ ID NO: 96555 - RNA, 20 nt, Artificial Sequence
  MKO10096555_B_Loh12cr1
  gRNA
ccgacaucucauucaccuuc

SEQ ID NO: 96556 - RNA, 20 nt, Artificial Sequence
  MKO10096556_B_Loh12cr1
  gRNA
ccgucuggucuaugcccauc

SEQ ID NO: 96557 - RNA, 20 nt, Artificial Sequence
  MKO10096557_B_Lonp1
  gRNA
ccucagcaaugagucggacg

SEQ ID NO: 96558 - RNA, 20 nt, Artificial Sequence
  MKO10096558_B_Lonp1
  gRNA
ucgccuugaacccucuguac

SEQ ID NO: 96559 - RNA, 20 nt, Artificial Sequence
  MKO10096559_B_Lonp1
  gRNA
caacauagggcugugcaagu

SEQ ID NO: 96560 - RNA, 20 nt, Artificial Sequence
  MKO10096560_B_Lonp2
  gRNA
gaagacuaaccugguaauga

SEQ ID NO: 96561 - RNA, 20 nt, Artificial Sequence
  MKO10096561_B_Lonp2
  gRNA
agaagauagagauugcccac

SEQ ID NO: 96562 - RNA, 20 nt, Artificial Sequence
  MKO10096562_B_Lonp2
  gRNA
auggagaucauucagguucc

SEQ ID NO: 96563 - RNA, 20 nt, Artificial Sequence
  MKO10096563_B_Lonrf1
  gRNA
cgccuagaaagccggcaucc

SEQ ID NO: 96564 - RNA, 20 nt, Artificial Sequence
  MKO10096564_B_Lonrf1
  gRNA
agagguuugcucuuaaugca

SEQ ID NO: 96565 - RNA, 20 nt, Artificial Sequence
  MKO10096565_B_Lonrf1
  gRNA
cgccggccugcaggaguuua

SEQ ID NO: 96566 - RNA, 20 nt, Artificial Sequence
  MKO10096566_B_Lonrf2
  gRNA
aaccgaagaguugauauccg

SEQ ID NO: 96567 - RNA, 20 nt, Artificial Sequence
  MKO10096567_B_Lonrf2
  gRNA
gauucgucuggccuucacac

SEQ ID NO: 96568 - RNA, 20 nt, Artificial Sequence
  MKO10096568_B_Lonrf2
  gRNA
uuuaaacccugagugcaacu

SEQ ID NO: 96569 - RNA, 20 nt, Artificial Sequence
  MKO10096569_B_Lonrf3
  gRNA
uugaaugcucacuguguaug

SEQ ID NO: 96570 - RNA, 20 nt, Artificial Sequence
  MKO10096570_B_Lonrf3
  gRNA
cacccuuugagcuucagauc

SEQ ID NO: 96571 - RNA, 20 nt, Artificial Sequence
  MKO10096571_B_Lonrf3
  gRNA
ccuuguuuggagacuuuauu

SEQ ID NO: 96572 - RNA, 20 nt, Artificial Sequence
  MKO10096572_B_Lor
  gRNA
uagaaccgccuccguagcuc

SEQ ID NO: 96573 - RNA, 20 nt, Artificial Sequence
  MKO10096573_B_Lor
  gRNA
acccggugaccuuacuugca

SEQ ID NO: 96574 - RNA, 20 nt, Artificial Sequence
  MKO10096574_B_Lor
  gRNA
ggcaaguacucugguggcgg

SEQ ID NO: 96575 - RNA, 20 nt, Artificial Sequence
  MKO10096575_B_Loxhd1
  gRNA
aggaucgagcaugauaacac

SEQ ID NO: 96576 - RNA, 20 nt, Artificial Sequence
  MKO10096576_B_Loxhd1
  gRNA
acuggugacgugauuggugc

SEQ ID NO: 96577 - RNA, 20 nt, Artificial Sequence
  MKO10096577_B_Loxhd1
  gRNA
ugcaccacgaacauccccug

SEQ ID NO: 96578 - RNA, 20 nt, Artificial Sequence
  MKO10096578_B_Loxl1
  gRNA
cgaccugcuugaugcaucca

SEQ ID NO: 96579 - RNA, 20 nt, Artificial Sequence
  MKO10096579_B_Loxl1
  gRNA
caucaguuaugucgauccac

SEQ ID NO: 96580 - RNA, 20 nt, Artificial Sequence
  MKO10096580_B_Loxl1
  gRNA
cagcggacuuucuccccaac

SEQ ID NO: 96581 - RNA, 20 nt, Artificial Sequence
  MKO10096581_B_Loxl2
  gRNA
uucacagagccuaaauauac

SEQ ID NO: 96582 - RNA, 20 nt, Artificial Sequence
  MKO10096582_B_Loxl2
  gRNA
agcccuuaccucuggcuugu

SEQ ID NO: 96583 - RNA, 20 nt, Artificial Sequence
  MKO10096583_B_Loxl2
  gRNA
ccugcagaaccuuugccucg

SEQ ID NO: 96584 - RNA, 20 nt, Artificial Sequence
  MKO10096584_B_Loxl3
  gRNA
ccagcauaccgcagacuacg

SEQ ID NO: 96585 - RNA, 20 nt, Artificial Sequence
  MKO10096585_B_Loxl3
  gRNA
ggaggugcgacuccgaccug

SEQ ID NO: 96586 - RNA, 20 nt, Artificial Sequence
  MKO10096586_B_Loxl3
  gRNA
gucuuacauaccuccccuug

SEQ ID NO: 96587 - RNA, 20 nt, Artificial Sequence
  MKO10096587_B_Loxl4
  gRNA
ugucacccacggcgccagca

SEQ ID NO: 96588 - RNA, 20 nt, Artificial Sequence
  MKO10096588_B_Loxl4
  gRNA
ucucagagugauauccgugc

SEQ ID NO: 96589 - RNA, 20 nt, Artificial Sequence
  MKO10096589_B_Loxl4
  gRNA
ggggccaacggacagaccag

SEQ ID NO: 96590 - RNA, 20 nt, Artificial Sequence
  MKO10096590_B_Lox
  gRNA
cagugcacgcaaagcgccug

SEQ ID NO: 96591 - RNA, 20 nt, Artificial Sequence
  MKO10096591_B_Lox
  gRNA
gaaaucguagcaguacccug

SEQ ID NO: 96592 - RNA, 20 nt, Artificial Sequence
  MKO10096592_B_Lox
  gRNA
acuucuuaccaagccgcccu

SEQ ID NO: 96593 - RNA, 20 nt, Artificial Sequence
  MKO10096593_B_Lpar1
  gRNA
uucuaccugauguucaauac

SEQ ID NO: 96594 - RNA, 20 nt, Artificial Sequence
  MKO10096594_B_Lpar1
  gRNA
cccuguaauuucacagcccc

SEQ ID NO: 96595 - RNA, 20 nt, Artificial Sequence
  MKO10096595_B_Lpar1
  gRNA
accuggggcugugaaauuac

SEQ ID NO: 96596 - RNA, 20 nt, Artificial Sequence
  MKO10096596_B_Lpar2
  gRNA
aggaagcaugauccgcgugc

SEQ ID NO: 96597 - RNA, 20 nt, Artificial Sequence
  MKO10096597_B_Lpar2
  gRNA
ccguguggucacacucaucg

SEQ ID NO: 96598 - RNA, 20 nt, Artificial Sequence
  MKO10096598_B_Lpar2
  gRNA
uagggcccacgcagccaagu

SEQ ID NO: 96599 - RNA, 20 nt, Artificial Sequence
  MKO10096599_B_Lpar3
  gRNA
acagcagaucaucuuccgca

SEQ ID NO: 96600 - RNA, 20 nt, Artificial Sequence
  MKO10096600_B_Lpar3
  gRNA
agaagaacguccccacgcac

SEQ ID NO: 96601 - RNA, 20 nt, Artificial Sequence
  MKO10096601_B_Lpar3
  gRNA
acgugcaacacgugaagcgc

SEQ ID NO: 96602 - RNA, 20 nt, Artificial Sequence
  MKO10096602_B_Lpar4
  gRNA
gcguuccucaccaacaucua

SEQ ID NO: 96603 - RNA, 20 nt, Artificial Sequence
  MKO10096603_B_Lpar4
  gRNA
cgaucggaagggauagacaa

SEQ ID NO: 96604 - RNA, 20 nt, Artificial Sequence
  MKO10096604_B_Lpar4
  gRNA
gcgaccaccacuugcuuuga

SEQ ID NO: 96605 - RNA, 20 nt, Artificial Sequence
  MKO10096605_B_Lpar5
  gRNA
caguauucaggaccgcgauc

SEQ ID NO: 96606 - RNA, 20 nt, Artificial Sequence
  MKO10096606_B_Lpar5
  gRNA
cgugcccuauaacuccacgc

SEQ ID NO: 96607 - RNA, 20 nt, Artificial Sequence
  MKO10096607_B_Lpar5
  gRNA
gcacggucuuccgucgccgu

SEQ ID NO: 96608 - RNA, 20 nt, Artificial Sequence
  MKO10096608_B_Lpar6
  gRNA
uacaacguacaugauuaacc

SEQ ID NO: 96609 - RNA, 20 nt, Artificial Sequence
  MKO10096609_B_Lpar6
  gRNA
aauguauaucgcaacacagu

SEQ ID NO: 96610 - RNA, 20 nt, Artificial Sequence
  MKO10096610_B_Lpar6
  gRNA
uuuacuuugcaacacggaau

SEQ ID NO: 96611 - RNA, 20 nt, Artificial Sequence
  MKO10096611_B_Lpcau1
  gRNA
gccgccccuucacagcuaca

SEQ ID NO: 96612 - RNA, 20 nt, Artificial Sequence
  MKO10096612_B_Lpcau1
  gRNA
ggcugcucuggcuccuuauc

SEQ ID NO: 96613 - RNA, 20 nt, Artificial Sequence
  MKO10096613_B_Lpcau1
  gRNA
gaagccgccagcaaaccaca

SEQ ID NO: 96614 - RNA, 20 nt, Artificial Sequence
  MKO10096614_B_Lpcau2b
  gRNA
ggaccaauaugcuucguuug

SEQ ID NO: 96615 - RNA, 20 nt, Artificial Sequence
  MKO10096615_B_Lpcau2b
  gRNA
caacacaguccgaaucaaga

SEQ ID NO: 96616 - RNA, 20 nt, Artificial Sequence
  MKO10096616_B_Lpcau2b
  gRNA
ucucugauagucagcuugcg

SEQ ID NO: 96617 - RNA, 20 nt, Artificial Sequence
  MKO10096617_B_Lpcau2
  gRNA
ucaacacgggauaccaaaac

SEQ ID NO: 96618 - RNA, 20 nt, Artificial Sequence
  MKO10096618_B_Lpcau2
  gRNA
gcucccaguccgugcuuuac

SEQ ID NO: 96619 - RNA, 20 nt, Artificial Sequence
  MKO10096619_B_Lpcau2
  gRNA
cgauuaguacaaguaccuuc

SEQ ID NO: 96620 - RNA, 20 nt, Artificial Sequence
  MKO10096620_B_Lpcau3
  gRNA
cuguguauugacuacuacga

SEQ ID NO: 96621 - RNA, 20 nt, Artificial Sequence
  MKO10096621_B_Lpcau3
  gRNA
ccacuugauaucguagucac

SEQ ID NO: 96622 - RNA, 20 nt, Artificial Sequence
  MKO10096622_B_Lpcau3
  gRNA
guuccucauccugcgacuca

SEQ ID NO: 96623 - RNA, 20 nt, Artificial Sequence
  MKO10096623_B_Lpcau4
  gRNA
aggcccuuugaccccgaaca

SEQ ID NO: 96624 - RNA, 20 nt, Artificial Sequence
  MKO10096624_B_Lpcau4
  gRNA
cuuccuucggauccguguuc

SEQ ID NO: 96625 - RNA, 20 nt, Artificial Sequence
  MKO10096625_B_Lpcau4
  gRNA
uacuuccuccauccuguaau

SEQ ID NO: 96626 - RNA, 20 nt, Artificial Sequence
  MKO10096626_B_Lpgau1
  gRNA
aagcgcuucugguauaucga

SEQ ID NO: 96627 - RNA, 20 nt, Artificial Sequence
  MKO10096627_B_Lpgau1
  gRNA
agcaccuugaacauaauuac

SEQ ID NO: 96628 - RNA, 20 nt, Artificial Sequence
  MKO10096628_B_Lpgau1
  gRNA
uggagacuucuuuauaagac

SEQ ID NO: 96629 - RNA, 20 nt, Artificial Sequence
  MKO10096629_B_Lphn1
  gRNA
cacagucguacugcaccucc

SEQ ID NO: 96630 - RNA, 20 nt, Artificial Sequence
  MKO10096630_B_Lphn1
  gRNA
agggcuaccccaucgagcug

SEQ ID NO: 96631 - RNA, 20 nt, Artificial Sequence
  MKO10096631_B_Lphn1
  gRNA
guacucaccucgaguucccu

SEQ ID NO: 96632 - RNA, 20 nt, Artificial Sequence
  MKO10096632_B_Lphn2
  gRNA
gucuauagaauaacccucac

SEQ ID NO: 96633 - RNA, 20 nt, Artificial Sequence
  MKO10096633_B_Lphn2
  gRNA
uauuuguaaguuccgggaca

SEQ ID NO: 96634 - RNA, 20 nt, Artificial Sequence
  MKO10096634_B_Lphn2
  gRNA
guauuuccugauccaugucc

SEQ ID NO: 96635 - RNA, 20 nt, Artificial Sequence
  MKO10096635_B_Lphn3
  gRNA
aucaugaugacgucugugcc

SEQ ID NO: 96636 - RNA, 20 nt, Artificial Sequence
  MKO10096636_B_Lphn3
  gRNA
uauuuauauguucccggaca

SEQ ID NO: 96637 - RNA, 20 nt, Artificial Sequence
  MKO10096637_B_Lphn3
  gRNA
cacauucauacugcacuuca

SEQ ID NO: 96638 - RNA, 20 nt, Artificial Sequence
  MKO10096638_B_Lpin1
  gRNA
gucagcaucguaucccaguu

SEQ ID NO: 96639 - RNA, 20 nt, Artificial Sequence
  MKO10096639_B_Lpin1
  gRNA
ucaagagacugacaacgauc

SEQ ID NO: 96640 - RNA, 20 nt, Artificial Sequence
  MKO10096640_B_Lpin1
  gRNA
gggcagcuguagugggaucc

SEQ ID NO: 96641 - RNA, 20 nt, Artificial Sequence
  MKO10096641_B_Lpin2
  gRNA
gauaacuaccccuuaucuga

SEQ ID NO: 96642 - RNA, 20 nt, Artificial Sequence
  MKO10096642_B_Lpin2
  gRNA
gaaguccuuaccuugcugcc

SEQ ID NO: 96643 - RNA, 20 nt, Artificial Sequence
  MKO10096643_B_Lpin2
  gRNA
uucagacguuucucacaccu

SEQ ID NO: 96644 - RNA, 20 nt, Artificial Sequence
  MKO10096644_B_Lpin3
  gRNA
uucuccgcccuguaaugacu

SEQ ID NO: 96645 - RNA, 20 nt, Artificial Sequence
  MKO10096645_B_Lpin3
  gRNA
cggcgaggccuucuuugucc

SEQ ID NO: 96646 - RNA, 20 nt, Artificial Sequence
  MKO10096646_B_Lpin3
  gRNA
gagcugagucucacaugcag

SEQ ID NO: 96647 - RNA, 20 nt, Artificial Sequence
  MKO10096647_B_Lpl
  gRNA
ccagucuacuacaaugacau

SEQ ID NO: 96648 - RNA, 20 nt, Artificial Sequence
  MKO10096648_B_Lpl
  gRNA
ccaaugucauuguaguagac

SEQ ID NO: 96649 - RNA, 20 nt, Artificial Sequence
  MKO10096649_B_Lpl
  gRNA
cuccaaggcuguacccuaag

SEQ ID NO: 96650 - RNA, 20 nt, Artificial Sequence
  MKO10096650_B_Lpo
  gRNA
augaugucagucucggcagu

SEQ ID NO: 96651 - RNA, 20 nt, Artificial Sequence
  MKO10096651_B_Lpo
  gRNA
gcaacauaaguagcccuuac

SEQ ID NO: 96652 - RNA, 20 nt, Artificial Sequence
  MKO10096652_B_Lpo
  gRNA
acacgcacagccauccggag

SEQ ID NO: 96653 - RNA, 20 nt, Artificial Sequence
  MKO10096653_B_Lpp
  gRNA
acggaggauccgcuccauga

SEQ ID NO: 96654 - RNA, 20 nt, Artificial Sequence
  MKO10096654_B_Lpp
  gRNA
auacgcagcuucccgcuucc

SEQ ID NO: 96655 - RNA, 20 nt, Artificial Sequence
  MKO10096655_B_Lpp
  gRNA
cucaccaaaguaaucgucag

SEQ ID NO: 96656 - RNA, 20 nt, Artificial Sequence
  MKO10096656_B_Lpxn
  gRNA
gagaugccuugugauccugc

SEQ ID NO: 96657 - RNA, 20 nt, Artificial Sequence
  MKO10096657_B_Lpxn
  gRNA
uccugccagaagccaauugc

SEQ ID NO: 96658 - RNA, 20 nt, Artificial Sequence
  MKO10096658_B_Lpxn
  gRNA
ggcccaccugagugaaaugc

SEQ ID NO: 96659 - RNA, 20 nt, Artificial Sequence
  MKO10096659_B_Lrau
  gRNA
aucacgaaugauuaucuuca

SEQ ID NO: 96660 - RNA, 20 nt, Artificial Sequence
  MKO10096660_B_Lrau
  gRNA
gcgacguguuggagguguca

SEQ ID NO: 96661 - RNA, 20 nt, Artificial Sequence
  MKO10096661_B_Lrau
  gRNA
caagguggcuagcauccgug

SEQ ID NO: 96662 - RNA, 20 nt, Artificial Sequence
  MKO10096662_B_Lrba
  gRNA
gguaggaggccaguuugauu

SEQ ID NO: 96663 - RNA, 20 nt, Artificial Sequence
  MKO10096663_B_Lrba
  gRNA
aaaguugacaguaugauugc

SEQ ID NO: 96664 - RNA, 20 nt, Artificial Sequence
  MKO10096664_B_Lrba
  gRNA
gacagcagcuucccagcgug

SEQ ID NO: 96665 - RNA, 20 nt, Artificial Sequence
  MKO10096665_B_Lrch1
  gRNA
aucgcaagcaacaacaagcu

SEQ ID NO: 96666 - RNA, 20 nt, Artificial Sequence
  MKO10096666_B_Lrch1
  gRNA
uguugacccaccuaaacuug

SEQ ID NO: 96667 - RNA, 20 nt, Artificial Sequence
  MKO10096667_B_Lrch1
  gRNA
gcugugccaauuuguaucac

SEQ ID NO: 96668 - RNA, 20 nt, Artificial Sequence
  MKO10096668_B_Lrch2
  gRNA
ggaaggucaaauaaguauuu

SEQ ID NO: 96669 - RNA, 20 nt, Artificial Sequence
  MKO10096669_B_Lrch2
  gRNA
aauuucuguaaaacgauuuc

SEQ ID NO: 96670 - RNA, 20 nt, Artificial Sequence
  MKO10096670_B_Lrch2
  gRNA
guauccauucccgaagaaau

SEQ ID NO: 96671 - RNA, 20 nt, Artificial Sequence
  MKO10096671_B_Lrch3
  gRNA
ugaucaccuggaggugccgg

SEQ ID NO: 96672 - RNA, 20 nt, Artificial Sequence
  MKO10096672_B_Lrch3
  gRNA
uccagauuaccaauuuggga

SEQ ID NO: 96673 - RNA, 20 nt, Artificial Sequence
  MKO10096673_B_Lrch3
  gRNA
caucuucuacgcuugccuga

SEQ ID NO: 96674 - RNA, 20 nt, Artificial Sequence
  MKO10096674_B_Lrch4
  gRNA
ugucugacaagucguaacug

SEQ ID NO: 96675 - RNA, 20 nt, Artificial Sequence
  MKO10096675_B_Lrch4
  gRNA
cguuugaagcacuucccccg

SEQ ID NO: 96676 - RNA, 20 nt, Artificial Sequence
  MKO10096676_B_Lrch4
  gRNA
uuauucucacaagcugccgc

SEQ ID NO: 96677 - RNA, 20 nt, Artificial Sequence
  MKO10096677_B_Lrcol1
  gRNA
gccacagcaacuguugcauc

SEQ ID NO: 96678 - RNA, 20 nt, Artificial Sequence
  MKO10096678_B_Lrcol1
  gRNA
uuugaugagcagaaccuguc

SEQ ID NO: 96679 - RNA, 20 nt, Artificial Sequence
  MKO10096679_B_Lrcol1
  gRNA
uuucuguggguucaagcugu

SEQ ID NO: 96680 - RNA, 20 nt, Artificial Sequence
  MKO10096680_B_Lrdd
  gRNA
guuccccugcaggcgcacaa

SEQ ID NO: 96681 - RNA, 20 nt, Artificial Sequence
  MKO10096681_B_Lrdd
  gRNA
cccuugugcagacauauccc

SEQ ID NO: 96682 - RNA, 20 nt, Artificial Sequence
  MKO10096682_B_Lrdd
  gRNA
accuagaccugagcuucaac

SEQ ID NO: 96683 - RNA, 20 nt, Artificial Sequence
  MKO10096683_B_Lrfn1
  gRNA
cgacggggccaccgcucugc

SEQ ID NO: 96684 - RNA, 20 nt, Artificial Sequence
  MKO10096684_B_Lrfn1
  gRNA
agggcucaggcagaagcaag

SEQ ID NO: 96685 - RNA, 20 nt, Artificial Sequence
  MKO10096685_B_Lrfn1
  gRNA
cuuuguaguucuagcugucc

SEQ ID NO: 96686 - RNA, 20 nt, Artificial Sequence
  MKO10096686_B_Lrfn2
  gRNA
agaccuuguaccgcaccaug

SEQ ID NO: 96687 - RNA, 20 nt, Artificial Sequence
  MKO10096687_B_Lrfn2
  gRNA
ugcccccgaugaccgcuugg

SEQ ID NO: 96688 - RNA, 20 nt, Artificial Sequence
  MKO10096688_B_Lrfn2
  gRNA
guuucccaccaagcggucau

SEQ ID NO: 96689 - RNA, 20 nt, Artificial Sequence
  MKO10096689_B_Lrfn3
  gRNA
acuguggccccuaccgaccg

SEQ ID NO: 96690 - RNA, 20 nt, Artificial Sequence
  MKO10096690_B_Lrfn3
  gRNA
agacgacugugccgagaccc

SEQ ID NO: 96691 - RNA, 20 nt, Artificial Sequence
  MKO10096691_B_Lrfn3
  gRNA
cagggcacguaggucggcga

SEQ ID NO: 96692 - RNA, 20 nt, Artificial Sequence
  MKO10096692_B_Lrfn4
  gRNA
cggcggagccacucuguaca

SEQ ID NO: 96693 - RNA, 20 nt, Artificial Sequence
  MKO10096693_B_Lrfn4
  gRNA
agcgggccacccuacggugc

SEQ ID NO: 96694 - RNA, 20 nt, Artificial Sequence
  MKO10096694_B_Lrfn4
  gRNA
gcuggcccggcccgaugacc

SEQ ID NO: 96695 - RNA, 20 nt, Artificial Sequence
  MKO10096695_B_Lrfn5
  gRNA
agcauucgagccugacuuag

SEQ ID NO: 96696 - RNA, 20 nt, Artificial Sequence
  MKO10096696_B_Lrfn5
  gRNA
uguugcuuccccugccggau

SEQ ID NO: 96697 - RNA, 20 nt, Artificial Sequence
  MKO10096697_B_Lrfn5
  gRNA
auccaaugaaucgcagguuc

SEQ ID NO: 96698 - RNA, 20 nt, Artificial Sequence
  MKO10096698_B_Lrg1
  gRNA
cauucaggaacaggacgcgc

SEQ ID NO: 96699 - RNA, 20 nt, Artificial Sequence
  MKO10096699_B_Lrg1
  gRNA
acagaacgacacgcgcugug

SEQ ID NO: 96700 - RNA, 20 nt, Artificial Sequence
  MKO10096700_B_Lrg1
  gRNA
aacucagcugguucuccgcc

SEQ ID NO: 96701 - RNA, 20 nt, Artificial Sequence
  MKO10096701_B_Lrguk
  gRNA
auaaguauaccuugagauuu

SEQ ID NO: 96702 - RNA, 20 nt, Artificial Sequence
  MKO10096702_B_Lrguk
  gRNA
ccgaaagauucaacuucugc

SEQ ID NO: 96703 - RNA, 20 nt, Artificial Sequence
  MKO10096703_B_Lrguk
  gRNA
aaauuaguugagugagagua

SEQ ID NO: 96704 - RNA, 20 nt, Artificial Sequence
  MKO10096704_B_Lrif1
  gRNA
cgucauucugaaaaccgcag

SEQ ID NO: 96705 - RNA, 20 nt, Artificial Sequence
  MKO10096705_B_Lrif1
  gRNA
augaugccuuaauauuagua

SEQ ID NO: 96706 - RNA, 20 nt, Artificial Sequence
  MKO10096706_B_Lrif1
  gRNA
aauugagaaugcugaugaca

SEQ ID NO: 96707 - RNA, 20 nt, Artificial Sequence
  MKO10096707_B_Lrig1
  gRNA
cuuacaguucccuuauacgc

SEQ ID NO: 96708 - RNA, 20 nt, Artificial Sequence
  MKO10096708_B_Lrig1
  gRNA
agcagcgcccagugauggua

SEQ ID NO: 96709 - RNA, 20 nt, Artificial Sequence
  MKO10096709_B_Lrig1
  gRNA
gcugacagccauaccaucac

SEQ ID NO: 96710 - RNA, 20 nt, Artificial Sequence
  MKO10096710_B_Lrig2
  gRNA
ucagggauuugagucauaac

SEQ ID NO: 96711 - RNA, 20 nt, Artificial Sequence
  MKO10096711_B_Lrig2
  gRNA
agguauuucagugacauucg

SEQ ID NO: 96712 - RNA, 20 nt, Artificial Sequence
  MKO10096712_B_Lrig2
  gRNA
cuugauuucugauauuauau

SEQ ID NO: 96713 - RNA, 20 nt, Artificial Sequence
  MKO10096713_B_Lrig3
  gRNA
augggacucacacuucuuga

SEQ ID NO: 96714 - RNA, 20 nt, Artificial Sequence
  MKO10096714_B_Lrig3
  gRNA
caaaauccucccugaacagc

SEQ ID NO: 96715 - RNA, 20 nt, Artificial Sequence
  MKO10096715_B_Lrig3
  gRNA
gccaaauugucaaaauaccc

SEQ ID NO: 96716 - RNA, 20 nt, Artificial Sequence
  MKO10096716_B_Lrit1
  gRNA
gucuagccucgaugaagauc

SEQ ID NO: 96717 - RNA, 20 nt, Artificial Sequence
  MKO10096717_B_Lrit1
  gRNA
gcagcucucguaggcgucuc

SEQ ID NO: 96718 - RNA, 20 nt, Artificial Sequence
  MKO10096718_B_Lrit1
  gRNA
augacacauugcuccuucgu

SEQ ID NO: 96719 - RNA, 20 nt, Artificial Sequence
  MKO10096719_B_Lrit2
  gRNA
acggcguauguguugauucc

SEQ ID NO: 96720 - RNA, 20 nt, Artificial Sequence
  MKO10096720_B_Lrit2
  gRNA
gccaaaacucuccucugaac

SEQ ID NO: 96721 - RNA, 20 nt, Artificial Sequence
  MKO10096721_B_Lrit2
  gRNA
uuacuguuucuugcaaguuc

SEQ ID NO: 96722 - RNA, 20 nt, Artificial Sequence
  MKO10096722_B_Lrit3
  gRNA
caagauuccuuggaagcgcu

SEQ ID NO: 96723 - RNA, 20 nt, Artificial Sequence
  MKO10096723_B_Lrit3
  gRNA
uuagugaaugcagacgacua

SEQ ID NO: 96724 - RNA, 20 nt, Artificial Sequence
  MKO10096724_B_Lrit3
  gRNA
agugaacccgagcgcuucca

SEQ ID NO: 96725 - RNA, 20 nt, Artificial Sequence
  MKO10096725_B_Lrmp
  gRNA
agacuguaccagaaugaacg

SEQ ID NO: 96726 - RNA, 20 nt, Artificial Sequence
  MKO10096726_B_Lrmp
  gRNA
ugacgucacagugcucuccg

SEQ ID NO: 96727 - RNA, 20 nt, Artificial Sequence
  MKO10096727_B_Lrmp
  gRNA
cauuguaccuugcauggcag

SEQ ID NO: 96728 - RNA, 20 nt, Artificial Sequence
  MKO10096728_B_Lrp10
  gRNA
cggaucacuuucccacguuc

SEQ ID NO: 96729 - RNA, 20 nt, Artificial Sequence
  MKO10096729_B_Lrp10
  gRNA
gccagaaggggccucacaca

SEQ ID NO: 96730 - RNA, 20 nt, Artificial Sequence
  MKO10096730_B_Lrp10
  gRNA
ucccccucuaggaggugcuc

SEQ ID NO: 96731 - RNA, 20 nt, Artificial Sequence
  MKO10096731_B_Lrp11
  gRNA
gcagggugacccaucgucag

SEQ ID NO: 96732 - RNA, 20 nt, Artificial Sequence
  MKO10096732_B_Lrp11
  gRNA
guggaguggauccucgucuc

SEQ ID NO: 96733 - RNA, 20 nt, Artificial Sequence
  MKO10096733_B_Lrp11
  gRNA
ccugaggcugucccgccuga

SEQ ID NO: 96734 - RNA, 20 nt, Artificial Sequence
  MKO10096734_B_Lrp12
  gRNA
cgcugucaucugaguggaac

SEQ ID NO: 96735 - RNA, 20 nt, Artificial Sequence
  MKO10096735_B_Lrp12
  gRNA
caggggagaucauuacuaua

SEQ ID NO: 96736 - RNA, 20 nt, Artificial Sequence
  MKO10096736_B_Lrp12
  gRNA
gaacaaauucgagcaccgag

SEQ ID NO: 96737 - RNA, 20 nt, Artificial Sequence
  MKO10096737_B_Lrp1b
  gRNA
caauucaacugcugacaacu

SEQ ID NO: 96738 - RNA, 20 nt, Artificial Sequence
  MKO10096738_B_Lrp1b
  gRNA
cuccaucgcacagccaacuc

SEQ ID NO: 96739 - RNA, 20 nt, Artificial Sequence
  MKO10096739_B_Lrp1b
  gRNA
uaucuaaagacucaucugac

SEQ ID NO: 96740 - RNA, 20 nt, Artificial Sequence
  MKO10096740_B_Lrp1
  gRNA
agcgguuguccgguugcagc

SEQ ID NO: 96741 - RNA, 20 nt, Artificial Sequence
  MKO10096741_B_Lrp1
  gRNA
gcugcuguuacaguagcacg

SEQ ID NO: 96742 - RNA, 20 nt, Artificial Sequence
  MKO10096742_B_Lrp1
  gRNA
ggugaaagagauugccccga

SEQ ID NO: 96743 - RNA, 20 nt, Artificial Sequence
  MKO10096743_B_Lrp2bp
  gRNA
ugcgccuucacacuagcuuu

SEQ ID NO: 96744 - RNA, 20 nt, Artificial Sequence
  MKO10096744_B_Lrp2bp
  gRNA
uggcugcuugcugccgacaa

SEQ ID NO: 96745 - RNA, 20 nt, Artificial Sequence
  MKO10096745_B_Lrp2bp
  gRNA
agugauguauuaugaugggc

SEQ ID NO: 96746 - RNA, 20 nt, Artificial Sequence
  MKO10096746_B_Lrp2
  gRNA
auggucacaccuguacucga

SEQ ID NO: 96747 - RNA, 20 nt, Artificial Sequence
  MKO10096747_B_Lrp2
  gRNA
cuucugacucguguuauagc

SEQ ID NO: 96748 - RNA, 20 nt, Artificial Sequence
  MKO10096748_B_Lrp2
  gRNA
acugcaguuagcuucgucag

SEQ ID NO: 96749 - RNA, 20 nt, Artificial Sequence
  MKO10096749_B_Lrp3
  gRNA
gaacagcacacugaacgucg

SEQ ID NO: 96750 - RNA, 20 nt, Artificial Sequence
  MKO10096750_B_Lrp3
  gRNA
guggugacaugaucacuauc

SEQ ID NO: 96751 - RNA, 20 nt, Artificial Sequence
  MKO10096751_B_Lrp3
  gRNA
acagugaaccucuuucucac

SEQ ID NO: 96752 - RNA, 20 nt, Artificial Sequence
  MKO10096752_B_Lrp4
  gRNA
gacaacagugacgagcaaug

SEQ ID NO: 96753 - RNA, 20 nt, Artificial Sequence
  MKO10096753_B_Lrp4
  gRNA
ucggagccacuucacaugug

SEQ ID NO: 96754 - RNA, 20 nt, Artificial Sequence
  MKO10096754_B_Lrp4
  gRNA
auuguccccgucacacaccc

SEQ ID NO: 96755 - RNA, 20 nt, Artificial Sequence
  MKO10096755_B_Lrp5
  gRNA
ccaccguuguccuccucgca

SEQ ID NO: 96756 - RNA, 20 nt, Artificial Sequence
  MKO10096756_B_Lrp5
  gRNA
caaugggcugaccaucgacc

SEQ ID NO: 96757 - RNA, 20 nt, Artificial Sequence
  MKO10096757_B_Lrp5
  gRNA
accaguccacacaccaugcg

SEQ ID NO: 96758 - RNA, 20 nt, Artificial Sequence
  MKO10096758_B_Lrp6
  gRNA
uuggucauggcuugauauac

SEQ ID NO: 96759 - RNA, 20 nt, Artificial Sequence
  MKO10096759_B_Lrp6
  gRNA
uguguccucaaauaacguca

SEQ ID NO: 96760 - RNA, 20 nt, Artificial Sequence
  MKO10096760_B_Lrp6
  gRNA
uaucagugugcuugcccaac

SEQ ID NO: 96761 - RNA, 20 nt, Artificial Sequence
  MKO10096761_B_Lrp8
  gRNA
cucuccgucgcagcgccaug

SEQ ID NO: 96762 - RNA, 20 nt, Artificial Sequence
  MKO10096762_B_Lrp8
  gRNA
cuugcguucuugccaucaaa

SEQ ID NO: 96763 - RNA, 20 nt, Artificial Sequence
  MKO10096763_B_Lrp8
  gRNA
ccgucgcacuuccaccgcuc

SEQ ID NO: 96764 - RNA, 20 nt, Artificial Sequence
  MKO10096764_B_Lrpap1
  gRNA
uggaaggcuuggauaaggau

SEQ ID NO: 96765 - RNA, 20 nt, Artificial Sequence
  MKO10096765_B_Lrpap1
  gRNA
cgcccucaaugaagacaccc

SEQ ID NO: 96766 - RNA, 20 nt, Artificial Sequence
  MKO10096766_B_Lrpap1
  gRNA
ggaagguaccguugagguug

SEQ ID NO: 96767 - RNA, 20 nt, Artificial Sequence
  MKO10096767_B_Lrpprc
  gRNA
aauguccccaacauuacagu

SEQ ID NO: 96768 - RNA, 20 nt, Artificial Sequence
  MKO10096768_B_Lrpprc
  gRNA
agcagagcuugauugcuccc

SEQ ID NO: 96769 - RNA, 20 nt, Artificial Sequence
  MKO10096769_B_Lrpprc
  gRNA
uuugagagcacguguagcuc

SEQ ID NO: 96770 - RNA, 20 nt, Artificial Sequence
  MKO10096770_B_Lrr1
  gRNA
acagcauacgcauaucaacu

SEQ ID NO: 96771 - RNA, 20 nt, Artificial Sequence
  MKO10096771_B_Lrr1
  gRNA
uaaccuuaaugacaaucagc

SEQ ID NO: 96772 - RNA, 20 nt, Artificial Sequence
  MKO10096772_B_Lrr1
  gRNA
acacucuguugcgcacacug

SEQ ID NO: 96773 - RNA, 20 nt, Artificial Sequence
  MKO10096773_B_Lrrc10b
  gRNA
agcgcgacgaacccauuccg

SEQ ID NO: 96774 - RNA, 20 nt, Artificial Sequence
  MKO10096774_B_Lrrc10b
  gRNA
gcgcucagccaugcgcucga

SEQ ID NO: 96775 - RNA, 20 nt, Artificial Sequence
  MKO10096775_B_Lrrc10b
  gRNA
acccgcggggguccagugac

SEQ ID NO: 96776 - RNA, 20 nt, Artificial Sequence
  MKO10096776_B_Lrrc10
  gRNA
gcuggccggguagcagacgu

SEQ ID NO: 96777 - RNA, 20 nt, Artificial Sequence
  MKO10096777_B_Lrrc10
  gRNA
cacgucgaucaccuccagaa

SEQ ID NO: 96778 - RNA, 20 nt, Artificial Sequence
  MKO10096778_B_Lrrc10
  gRNA
ggcaguuggauucgagccac

SEQ ID NO: 96779 - RNA, 20 nt, Artificial Sequence
  MKO10096779_B_Lrrc14b
  gRNA
aacucaauauggcgaagccu

SEQ ID NO: 96780 - RNA, 20 nt, Artificial Sequence
  MKO10096780_B_Lrrc14b
  gRNA
cggugaaaucagcuacccga

SEQ ID NO: 96781 - RNA, 20 nt, Artificial Sequence
  MKO10096781_B_Lrrc14b
  gRNA
guucgcagagugcagcaaaa

SEQ ID NO: 96782 - RNA, 20 nt, Artificial Sequence
  MKO10096782_B_Lrrc14
  gRNA
uugaguggcaacgaccuguc

SEQ ID NO: 96783 - RNA, 20 nt, Artificial Sequence
  MKO10096783_B_Lrrc14
  gRNA
gaaggaccugacgcgugcug

SEQ ID NO: 96784 - RNA, 20 nt, Artificial Sequence
  MKO10096784_B_Lrrc14
  gRNA
uguguuccucagcacgcguc

SEQ ID NO: 96785 - RNA, 20 nt, Artificial Sequence
  MKO10096785_B_Lrrc15
  gRNA
ccgggaacagguacauucgc

SEQ ID NO: 96786 - RNA, 20 nt, Artificial Sequence
  MKO10096786_B_Lrrc15
  gRNA
guagucaucaucgguagacc

SEQ ID NO: 96787 - RNA, 20 nt, Artificial Sequence
  MKO10096787_B_Lrrc15
  gRNA
ugggaaugucuuccgaucac

SEQ ID NO: 96788 - RNA, 20 nt, Artificial Sequence
  MKO10096788_B_Lrrc16a
  gRNA
uucaguuaucuagagauuca

SEQ ID NO: 96789 - RNA, 20 nt, Artificial Sequence
  MKO10096789_B_Lrrc16a
  gRNA
augaaucucuagauaacuga

SEQ ID NO: 96790 - RNA, 20 nt, Artificial Sequence
  MKO10096790_B_Lrrc16a
  gRNA
cucacauaggcaccugcuug

SEQ ID NO: 96791 - RNA, 20 nt, Artificial Sequence
  MKO10096791_B_Lrrc16b
  gRNA
uuaccuuagcuggaacuuua

SEQ ID NO: 96792 - RNA, 20 nt, Artificial Sequence
  MKO10096792_B_Lrrc16b
  gRNA
agcucacaugccgugucacc

SEQ ID NO: 96793 - RNA, 20 nt, Artificial Sequence
  MKO10096793_B_Lrrc16b
  gRNA
auucugacugaguguguuga

SEQ ID NO: 96794 - RNA, 20 nt, Artificial Sequence
  MKO10096794_B_Lrrc17
  gRNA
ugcauuccagaccguuauag

SEQ ID NO: 96795 - RNA, 20 nt, Artificial Sequence
  MKO10096795_B_Lrrc17
  gRNA
gguaguuaacuaccccacaa

SEQ ID NO: 96796 - RNA, 20 nt, Artificial Sequence
  MKO10096796_B_Lrrc17
  gRNA
aggucaagcuucacuauguc

SEQ ID NO: 96797 - RNA, 20 nt, Artificial Sequence
  MKO10096797_B_Lrrc18
  gRNA
acugagccgcaagauacacu

SEQ ID NO: 96798 - RNA, 20 nt, Artificial Sequence
  MKO10096798_B_Lrrc18
  gRNA
uguucguagacuccaucaaa

SEQ ID NO: 96799 - RNA, 20 nt, Artificial Sequence
  MKO10096799_B_Lrrc18
  gRNA
cggugcggauguucuugagu

SEQ ID NO: 96800 - RNA, 20 nt, Artificial Sequence
  MKO10096800_B_Lrrc19
  gRNA
aacacgucuaaugugacauu

SEQ ID NO: 96801 - RNA, 20 nt, Artificial Sequence
  MKO10096801_B_Lrrc19
  gRNA
gucuacuugaguugcacaac

SEQ ID NO: 96802 - RNA, 20 nt, Artificial Sequence
  MKO10096802_B_Lrrc19
  gRNA
uuugacagaugguaguagca

SEQ ID NO: 96803 - RNA, 20 nt, Artificial Sequence
  MKO10096803_B_Lrrc1
  gRNA
cgccuucuguaaagcgcugc

SEQ ID NO: 96804 - RNA, 20 nt, Artificial Sequence
  MKO10096804_B_Lrrc1
  gRNA
cacguuaaguucuguaguuc

SEQ ID NO: 96805 - RNA, 20 nt, Artificial Sequence
  MKO10096805_B_Lrrc1
  gRNA
ugcaugaaguuugcuauuuc

SEQ ID NO: 96806 - RNA, 20 nt, Artificial Sequence
  MKO10096806_B_Lrrc20
  gRNA
auugaccuuccucgcaacuc

SEQ ID NO: 96807 - RNA, 20 nt, Artificial Sequence
  MKO10096807_B_Lrrc20
  gRNA
aggccguggccagaguugcg

SEQ ID NO: 96808 - RNA, 20 nt, Artificial Sequence
  MKO10096808_B_Lrrc20
  gRNA
uccuguggcagagcuacgcc

SEQ ID NO: 96809 - RNA, 20 nt, Artificial Sequence
  MKO10096809_B_Lrrc23
  gRNA
cgcugcaguaccucaacuug

SEQ ID NO: 96810 - RNA, 20 nt, Artificial Sequence
  MKO10096810_B_Lrrc23
  gRNA
uaagcugaagaaucucuacc

SEQ ID NO: 96811 - RNA, 20 nt, Artificial Sequence
  MKO10096811_B_Lrrc23
  gRNA
ucacccccgucugggaagcc

SEQ ID NO: 96812 - RNA, 20 nt, Artificial Sequence
  MKO10096812_B_Lrrc24
  gRNA
cuacaagugcuacgccucac

SEQ ID NO: 96813 - RNA, 20 nt, Artificial Sequence
  MKO10096813_B_Lrrc24
  gRNA
cgcaggcaaguacgaaugcg

SEQ ID NO: 96814 - RNA, 20 nt, Artificial Sequence
  MKO10096814_B_Lrrc24
  gRNA
uggcgcucuacgguugcgcg

SEQ ID NO: 96815 - RNA, 20 nt, Artificial Sequence
  MKO10096815_B_Lrrc25
  gRNA
gacuccagguugcaauagac

SEQ ID NO: 96816 - RNA, 20 nt, Artificial Sequence
  MKO10096816_B_Lrrc25
  gRNA
agccggccgaggacugcuca

SEQ ID NO: 96817 - RNA, 20 nt, Artificial Sequence
  MKO10096817_B_Lrrc25
  gRNA
accauuggagcccuuguugc

SEQ ID NO: 96818 - RNA, 20 nt, Artificial Sequence
  MKO10096818_B_Lrrc26
  gRNA
cgagagcguagaccaccgcc

SEQ ID NO: 96819 - RNA, 20 nt, Artificial Sequence
  MKO10096819_B_Lrrc26
  gRNA
caugcaagcgcaacacaucg

SEQ ID NO: 96820 - RNA, 20 nt, Artificial Sequence
  MKO10096820_B_Lrrc26
  gRNA
aggaaacuaagcgcgcgcag

SEQ ID NO: 96821 - RNA, 20 nt, Artificial Sequence
  MKO10096821_B_Lrrc27
  gRNA
ggaagcaauuacaccugcag

SEQ ID NO: 96822 - RNA, 20 nt, Artificial Sequence
  MKO10096822_B_Lrrc27
  gRNA
ccaagccuuucugcacaauc

SEQ ID NO: 96823 - RNA, 20 nt, Artificial Sequence
  MKO10096823_B_Lrrc27
  gRNA
uugugagagccaaucccaga

SEQ ID NO: 96824 - RNA, 20 nt, Artificial Sequence
  MKO10096824_B_Lrrc28
  gRNA
gagaucguuugcccagaaau

SEQ ID NO: 96825 - RNA, 20 nt, Artificial Sequence
  MKO10096825_B_Lrrc28
  gRNA
caacuauguuauuugaguga

SEQ ID NO: 96826 - RNA, 20 nt, Artificial Sequence
  MKO10096826_B_Lrrc28
  gRNA
ucagaagcuuccaaaccuug

SEQ ID NO: 96827 - RNA, 20 nt, Artificial Sequence
  MKO10096827_B_Lrrc29
  gRNA
cugcagccaccucagugacg

SEQ ID NO: 96828 - RNA, 20 nt, Artificial Sequence
  MKO10096828_B_Lrrc29
  gRNA
gagcggucgggagcuggccc

SEQ ID NO: 96829 - RNA, 20 nt, Artificial Sequence
  MKO10096829_B_Lrrc29
  gRNA
cacgugcacugacuucccuc

SEQ ID NO: 96830 - RNA, 20 nt, Artificial Sequence
  MKO10096830_B_Lrrc2
  gRNA
cuugacucgcgcacucugcc

SEQ ID NO: 96831 - RNA, 20 nt, Artificial Sequence
  MKO10096831_B_Lrrc2
  gRNA
ccauuugaagaguauucccc

SEQ ID NO: 96832 - RNA, 20 nt, Artificial Sequence
  MKO10096832_B_Lrrc2
  gRNA
acuuuguggccgagugcagg

SEQ ID NO: 96833 - RNA, 20 nt, Artificial Sequence
  MKO10096833_B_Lrrc30
  gRNA
ggugacgagacagagcgacc

SEQ ID NO: 96834 - RNA, 20 nt, Artificial Sequence
  MKO10096834_B_Lrrc30
  gRNA
ucagcuuccgaagucuggag

SEQ ID NO: 96835 - RNA, 20 nt, Artificial Sequence
  MKO10096835_B_Lrrc30
  gRNA
ccaacgacaaggaccccaag

SEQ ID NO: 96836 - RNA, 20 nt, Artificial Sequence
  MKO10096836_B_Lrrc32
  gRNA
cugugucuuaccguccuaca

SEQ ID NO: 96837 - RNA, 20 nt, Artificial Sequence
  MKO10096837_B_Lrrc32
  gRNA
aggucuaauugcuccaccgc

SEQ ID NO: 96838 - RNA, 20 nt, Artificial Sequence
  MKO10096838_B_Lrrc32
  gRNA
gacacagcccgcguccaagc

SEQ ID NO: 96839 - RNA, 20 nt, Artificial Sequence
  MKO10096839_B_Lrrc34
  gRNA
gcaaacuuaccacugauaca

SEQ ID NO: 96840 - RNA, 20 nt, Artificial Sequence
  MKO10096840_B_Lrrc34
  gRNA
ggaucugggcgacugugacc

SEQ ID NO: 96841 - RNA, 20 nt, Artificial Sequence
  MKO10096841_B_Lrrc34
  gRNA
gcaaucaauucuccaccuuc

SEQ ID NO: 96842 - RNA, 20 nt, Artificial Sequence
  MKO10096842_B_Lrrc36
  gRNA
ccgcucuccucucgcuguca

SEQ ID NO: 96843 - RNA, 20 nt, Artificial Sequence
  MKO10096843_B_Lrrc36
  gRNA
aaaacgucuaauuucugagc

SEQ ID NO: 96844 - RNA, 20 nt, Artificial Sequence
  MKO10096844_B_Lrrc36
  gRNA
uuuaauauagacgcaaacaa

SEQ ID NO: 96845 - RNA, 20 nt, Artificial Sequence
  MKO10096845_B_Lrrc38
  gRNA
cauccaguguucacugccca

SEQ ID NO: 96846 - RNA, 20 nt, Artificial Sequence
  MKO10096846_B_Lrrc38
  gRNA
cccgcgaucgcgacagucca

SEQ ID NO: 96847 - RNA, 20 nt, Artificial Sequence
  MKO10096847_B_Lrrc38
  gRNA
cuagcagcuugcgcacgucc

SEQ ID NO: 96848 - RNA, 20 nt, Artificial Sequence
  MKO10096848_B_Lrrc39
  gRNA
uauaagugaccucccaccag

SEQ ID NO: 96849 - RNA, 20 nt, Artificial Sequence
  MKO10096849_B_Lrrc39
  gRNA
ucauugugcuagauuuaucu

SEQ ID NO: 96850 - RNA, 20 nt, Artificial Sequence
  MKO10096850_B_Lrrc39
  gRNA
caugccugcccucgaguggc

SEQ ID NO: 96851 - RNA, 20 nt, Artificial Sequence
  MKO10096851_B_Lrrc3b
  gRNA
gccaaacauagugacgagca

SEQ ID NO: 96852 - RNA, 20 nt, Artificial Sequence
  MKO10096852_B_Lrrc3b
  gRNA
auugacgagcaugcauucaa

SEQ ID NO: 96853 - RNA, 20 nt, Artificial Sequence
  MKO10096853_B_Lrrc3b
  gRNA
gccaugcucgucacuauguu

SEQ ID NO: 96854 - RNA, 20 nt, Artificial Sequence
  MKO10096854_B_Lrrc3
  gRNA
cgacaucgguggucuuccgg

SEQ ID NO: 96855 - RNA, 20 nt, Artificial Sequence
  MKO10096855_B_Lrrc3
  gRNA
ugugggcaagccgcugaucc

SEQ ID NO: 96856 - RNA, 20 nt, Artificial Sequence
  MKO10096856_B_Lrrc3
  gRNA
gccacggccccagcaugguc

SEQ ID NO: 96857 - RNA, 20 nt, Artificial Sequence
  MKO10096857_B_Lrrc40
  gRNA
aucuucagaaacuuaauguc

SEQ ID NO: 96858 - RNA, 20 nt, Artificial Sequence
  MKO10096858_B_Lrrc40
  gRNA
ucuagcucucuuauagcuga

SEQ ID NO: 96859 - RNA, 20 nt, Artificial Sequence
  MKO10096859_B_Lrrc40
  gRNA
ugagcugacuugcauccccg

SEQ ID NO: 96860 - RNA, 20 nt, Artificial Sequence
  MKO10096860_B_Lrrc41
  gRNA
cucuaauaucuuccgccucc

SEQ ID NO: 96861 - RNA, 20 nt, Artificial Sequence
  MKO10096861_B_Lrrc41
  gRNA
augcuuugaaguauugggcc

SEQ ID NO: 96862 - RNA, 20 nt, Artificial Sequence
  MKO10096862_B_Lrrc41
  gRNA
accucaacuuaccuccaaac

SEQ ID NO: 96863 - RNA, 20 nt, Artificial Sequence
  MKO10096863_B_Lrrc42
  gRNA
ggucuagacgggucagcucc

SEQ ID NO: 96864 - RNA, 20 nt, Artificial Sequence
  MKO10096864_B_Lrrc42
  gRNA
aacccugagauaacagacgc

SEQ ID NO: 96865 - RNA, 20 nt, Artificial Sequence
  MKO10096865_B_Lrrc42
  gRNA
ucacuccaaagugccuuuga

SEQ ID NO: 96866 - RNA, 20 nt, Artificial Sequence
  MKO10096866_B_Lrrc43
  gRNA
uuccucaaaaaugucgaguc

SEQ ID NO: 96867 - RNA, 20 nt, Artificial Sequence
  MKO10096867_B_Lrrc43
  gRNA
ucucuggugccuuacuaccg

SEQ ID NO: 96868 - RNA, 20 nt, Artificial Sequence
  MKO10096868_B_Lrrc43
  gRNA
gcuaggccacaacaaauugc

SEQ ID NO: 96869 - RNA, 20 nt, Artificial Sequence
  MKO10096869_B_Lrrc45
  gRNA
uucggagguccagcugccgc

SEQ ID NO: 96870 - RNA, 20 nt, Artificial Sequence
  MKO10096870_B_Lrrc45
  gRNA
aggcaucuucccacgugcca

SEQ ID NO: 96871 - RNA, 20 nt, Artificial Sequence
  MKO10096871_B_Lrrc45
  gRNA
gaauagacuuguucugucga

SEQ ID NO: 96872 - RNA, 20 nt, Artificial Sequence
  MKO10096872_B_Lrrc46
  gRNA
aaguaaucccuuccccgucc

SEQ ID NO: 96873 - RNA, 20 nt, Artificial Sequence
  MKO10096873_B_Lrrc46
  gRNA
cuagcuucagcguuucuauc

SEQ ID NO: 96874 - RNA, 20 nt, Artificial Sequence
  MKO10096874_B_Lrrc46
  gRNA
ugauaagggcuucaguaaug

SEQ ID NO: 96875 - RNA, 20 nt, Artificial Sequence
  MKO10096875_B_Lrrc47
  gRNA
uuggccucuuuccgucccaa

SEQ ID NO: 96876 - RNA, 20 nt, Artificial Sequence
  MKO10096876_B_Lrrc47
  gRNA
acgacgaccucugcgagaag

SEQ ID NO: 96877 - RNA, 20 nt, Artificial Sequence
  MKO10096877_B_Lrrc47
  gRNA
ggagaacuaccccugucuug

SEQ ID NO: 96878 - RNA, 20 nt, Artificial Sequence
  MKO10096878_B_Lrrc48
  gRNA
uccuccgcaucgauaaccuc

SEQ ID NO: 96879 - RNA, 20 nt, Artificial Sequence
  MKO10096879_B_Lrrc48
  gRNA
acugccagagguuaucgaug

SEQ ID NO: 96880 - RNA, 20 nt, Artificial Sequence
  MKO10096880_B_Lrrc48
  gRNA
caggguauccaggcccucga

SEQ ID NO: 96881 - RNA, 20 nt, Artificial Sequence
  MKO10096881_B_Lrrc49
  gRNA
augagcucaccagacuaaug

SEQ ID NO: 96882 - RNA, 20 nt, Artificial Sequence
  MKO10096882_B_Lrrc49
  gRNA
ggugaacuguggacuucauc

SEQ ID NO: 96883 - RNA, 20 nt, Artificial Sequence
  MKO10096883_B_Lrrc49
  gRNA
uagacuguuacagcaugacc

SEQ ID NO: 96884 - RNA, 20 nt, Artificial Sequence
  MKO10096884_B_Lrrc4b
  gRNA
auggcgcaggcccacauccg

SEQ ID NO: 96885 - RNA, 20 nt, Artificial Sequence
  MKO10096885_B_Lrrc4b
  gRNA
ugcgucaugagcgugccguu

SEQ ID NO: 96886 - RNA, 20 nt, Artificial Sequence
  MKO10096886_B_Lrrc4b
  gRNA
gccgccguagugcgccuuga

SEQ ID NO: 96887 - RNA, 20 nt, Artificial Sequence
  MKO10096887_B_Lrrc4c
  gRNA
cgucuuacuaccauaccgaa

SEQ ID NO: 96888 - RNA, 20 nt, Artificial Sequence
  MKO10096888_B_Lrrc4c
  gRNA
agcucgucaaguuugaugag

SEQ ID NO: 96889 - RNA, 20 nt, Artificial Sequence
  MKO10096889_B_Lrrc4c
  gRNA
ugagguuagggauuucccga

SEQ ID NO: 96890 - RNA, 20 nt, Artificial Sequence
  MKO10096890_B_Lrrc4
  gRNA
caaaagcauuccgcucaauc

SEQ ID NO: 96891 - RNA, 20 nt, Artificial Sequence
  MKO10096891_B_Lrrc4
  gRNA
gcuucccgucgucuaccuca

SEQ ID NO: 96892 - RNA, 20 nt, Artificial Sequence
  MKO10096892_B_Lrrc4
  gRNA
uugagauaccggguguugga

SEQ ID NO: 96893 - RNA, 20 nt, Artificial Sequence
  MKO10096893_B_Lrrc51
  gRNA
gccaaggacaggucuacgac

SEQ ID NO: 96894 - RNA, 20 nt, Artificial Sequence
  MKO10096894_B_Lrrc51
  gRNA
cuccuucaaaagcguccaaa

SEQ ID NO: 96895 - RNA, 20 nt, Artificial Sequence
  MKO10096895_B_Lrrc51
  gRNA
cuauaugaacacuuccgugc

SEQ ID NO: 96896 - RNA, 20 nt, Artificial Sequence
  MKO10096896_B_Lrrc52
  gRNA
uugcacaucaucgaccauaa

SEQ ID NO: 96897 - RNA, 20 nt, Artificial Sequence
  MKO10096897_B_Lrrc52
  gRNA
uaucauccccgcucgacguu

SEQ ID NO: 96898 - RNA, 20 nt, Artificial Sequence
  MKO10096898_B_Lrrc52
  gRNA
gugaaauguucagccgcacc

SEQ ID NO: 96899 - RNA, 20 nt, Artificial Sequence
  MKO10096899_B_Lrrc55
  gRNA
uuaccucuucaucgcauuug

SEQ ID NO: 96900 - RNA, 20 nt, Artificial Sequence
  MKO10096900_B_Lrrc55
  gRNA
uguuucgcaaauccagcacg

SEQ ID NO: 96901 - RNA, 20 nt, Artificial Sequence
  MKO10096901_B_Lrrc55
  gRNA
guacagcugcaaugcgauug

SEQ ID NO: 96902 - RNA, 20 nt, Artificial Sequence
  MKO10096902_B_Lrrc56
  gRNA
cagagaccugggcacuucgc

SEQ ID NO: 96903 - RNA, 20 nt, Artificial Sequence
  MKO10096903_B_Lrrc56
  gRNA
ggacacccguaagaacagcc

SEQ ID NO: 96904 - RNA, 20 nt, Artificial Sequence
  MKO10096904_B_Lrrc56
  gRNA
caaugccauccaagucaguc

SEQ ID NO: 96905 - RNA, 20 nt, Artificial Sequence
  MKO10096905_B_Lrrc57
  gRNA
gugaacuuuccuauuaucag

SEQ ID NO: 96906 - RNA, 20 nt, Artificial Sequence
  MKO10096906_B_Lrrc57
  gRNA
gaccuugaggcgaggacagc

SEQ ID NO: 96907 - RNA, 20 nt, Artificial Sequence
  MKO10096907_B_Lrrc57
  gRNA
auccugcuguccucgccuca

SEQ ID NO: 96908 - RNA, 20 nt, Artificial Sequence
  MKO10096908_B_Lrrc58
  gRNA
guaugacccuccgacucuuc

SEQ ID NO: 96909 - RNA, 20 nt, Artificial Sequence
  MKO10096909_B_Lrrc58
  gRNA
cuucugagucagauucacuc

SEQ ID NO: 96910 - RNA, 20 nt, Artificial Sequence
  MKO10096910_B_Lrrc58
  gRNA
ccauugcugcucaaccaaga

SEQ ID NO: 96911 - RNA, 20 nt, Artificial Sequence
  MKO10096911_B_Lrrc59
  gRNA
aagaguacucaguuuauugc

SEQ ID NO: 96912 - RNA, 20 nt, Artificial Sequence
  MKO10096912_B_Lrrc59
  gRNA
cgccggcuggaaguggagcg

SEQ ID NO: 96913 - RNA, 20 nt, Artificial Sequence
  MKO10096913_B_Lrrc59
  gRNA
ggaucugaaggacaaucccc

SEQ ID NO: 96914 - RNA, 20 nt, Artificial Sequence
  MKO10096914_B_Lrrc61
  gRNA
ucggcaggccuccuccagaa

SEQ ID NO: 96915 - RNA, 20 nt, Artificial Sequence
  MKO10096915_B_Lrrc61
  gRNA
gugagcuguaccaguuaugc

SEQ ID NO: 96916 - RNA, 20 nt, Artificial Sequence
  MKO10096916_B_Lrrc61
  gRNA
ggaggccugccgacaguucc

SEQ ID NO: 96917 - RNA, 20 nt, Artificial Sequence
  MKO10096917_B_Lrrc63
  gRNA
ccagaugcccaugucuuacg

SEQ ID NO: 96918 - RNA, 20 nt, Artificial Sequence
  MKO10096918_B_Lrrc63
  gRNA
agccuuccccucguaagaca

SEQ ID NO: 96919 - RNA, 20 nt, Artificial Sequence
  MKO10096919_B_Lrrc63
  gRNA
uauaccaauugaaaagccac

SEQ ID NO: 96920 - RNA, 20 nt, Artificial Sequence
  MKO10096920_B_Lrrc66
  gRNA
aguggccuccguggcgcuuu

SEQ ID NO: 96921 - RNA, 20 nt, Artificial Sequence
  MKO10096921_B_Lrrc66
  gRNA
uuggcuuggcugauaaccag

SEQ ID NO: 96922 - RNA, 20 nt, Artificial Sequence
  MKO10096922_B_Lrrc66
  gRNA
ugcucuagaauugccccacc

SEQ ID NO: 96923 - RNA, 20 nt, Artificial Sequence
  MKO10096923_B_Lrrc69
  gRNA
uaagcaugaucaagcgaugu

SEQ ID NO: 96924 - RNA, 20 nt, Artificial Sequence
  MKO10096924_B_Lrrc69
  gRNA
ucagaucguguacaucccug

SEQ ID NO: 96925 - RNA, 20 nt, Artificial Sequence
  MKO10096925_B_Lrrc69
  gRNA
acgagucuuccucaagaaau

SEQ ID NO: 96926 - RNA, 20 nt, Artificial Sequence
  MKO10096926_B_Lrrc6
  gRNA
aagaaauagagcguucugaa

SEQ ID NO: 96927 - RNA, 20 nt, Artificial Sequence
  MKO10096927_B_Lrrc6
  gRNA
uaucuucaaaauaaccucau

SEQ ID NO: 96928 - RNA, 20 nt, Artificial Sequence
  MKO10096928_B_Lrrc6
  gRNA
uucuauuucuugcugaugca

SEQ ID NO: 96929 - RNA, 20 nt, Artificial Sequence
  MKO10096929_B_Lrrc71
  gRNA
acuuucccaaaguugucacc

SEQ ID NO: 96930 - RNA, 20 nt, Artificial Sequence
  MKO10096930_B_Lrrc71
  gRNA
aggcaaaagggcgaugaaag

SEQ ID NO: 96931 - RNA, 20 nt, Artificial Sequence
  MKO10096931_B_Lrrc71
  gRNA
cacaacugaccugagugugg

SEQ ID NO: 96932 - RNA, 20 nt, Artificial Sequence
  MKO10096932_B_Lrrc72
  gRNA
ccgaucaagcaacuccaguc

SEQ ID NO: 96933 - RNA, 20 nt, Artificial Sequence
  MKO10096933_B_Lrrc72
  gRNA
gguggaagauuauauacaau

SEQ ID NO: 96934 - RNA, 20 nt, Artificial Sequence
  MKO10096934_B_Lrrc72
  gRNA
aguuaccaauaaagcaaaag

SEQ ID NO: 96935 - RNA, 20 nt, Artificial Sequence
  MKO10096935_B_Lrrc73
  gRNA
gagccgccucgccauugcug

SEQ ID NO: 96936 - RNA, 20 nt, Artificial Sequence
  MKO10096936_B_Lrrc73
  gRNA
cacccaggggguuguagucc

SEQ ID NO: 96937 - RNA, 20 nt, Artificial Sequence
  MKO10096937_B_Lrrc73
  gRNA
cuuaccacuggggcacaucc

SEQ ID NO: 96938 - RNA, 20 nt, Artificial Sequence
  MKO10096938_B_Lrrc7
  gRNA
auucgaggaaugcgucauuc

SEQ ID NO: 96939 - RNA, 20 nt, Artificial Sequence
  MKO10096939_B_Lrrc7
  gRNA
gaacucgacaucaguaaaaa

SEQ ID NO: 96940 - RNA, 20 nt, Artificial Sequence
  MKO10096940_B_Lrrc7
  gRNA
cuuagaaaugggauugacac

SEQ ID NO: 96941 - RNA, 20 nt, Artificial Sequence
  MKO10096941_B_Lrrc8a
  gRNA
ccgcauccacguaguuguac

SEQ ID NO: 96942 - RNA, 20 nt, Artificial Sequence
  MKO10096942_B_Lrrc8a
  gRNA
gagcccguagcuuccgacac

SEQ ID NO: 96943 - RNA, 20 nt, Artificial Sequence
  MKO10096943_B_Lrrc8a
  gRNA
ucgacaccaguacaacuacg

SEQ ID NO: 96944 - RNA, 20 nt, Artificial Sequence
  MKO10096944_B_Lrrc8b
  gRNA
uagauugagaugcuaccaga

SEQ ID NO: 96945 - RNA, 20 nt, Artificial Sequence
  MKO10096945_B_Lrrc8b
  gRNA
ggucguacuggucggccagg

SEQ ID NO: 96946 - RNA, 20 nt, Artificial Sequence
  MKO10096946_B_Lrrc8b
  gRNA
aagcccaacuucuagcgucc

SEQ ID NO: 96947 - RNA, 20 nt, Artificial Sequence
  MKO10096947_B_Lrrc8c
  gRNA
aacugccggaacucggucac

SEQ ID NO: 96948 - RNA, 20 nt, Artificial Sequence
  MKO10096948_B_Lrrc8c
  gRNA
ucuuauagcccgucaugucc

SEQ ID NO: 96949 - RNA, 20 nt, Artificial Sequence
  MKO10096949_B_Lrrc8c
  gRNA
gacgggaaucgaugacauuc

SEQ ID NO: 96950 - RNA, 20 nt, Artificial Sequence
  MKO10096950_B_Lrrc8d
  gRNA
caagcucgagucuuuaccga

SEQ ID NO: 96951 - RNA, 20 nt, Artificial Sequence
  MKO10096951_B_Lrrc8d
  gRNA
ugaugaucuccucgaucguc

SEQ ID NO: 96952 - RNA, 20 nt, Artificial Sequence
  MKO10096952_B_Lrrc8d
  gRNA
cuugaucggcaauuugaacu

SEQ ID NO: 96953 - RNA, 20 nt, Artificial Sequence
  MKO10096953_B_Lrrc8e
  gRNA
gguauucgggugcacccucc

SEQ ID NO: 96954 - RNA, 20 nt, Artificial Sequence
  MKO10096954_B_Lrrc8e
  gRNA
caaaaaguuccgagugcacg

SEQ ID NO: 96955 - RNA, 20 nt, Artificial Sequence
  MKO10096955_B_Lrrc8e
  gRNA
caaccaccuucggucuaucg

SEQ ID NO: 96956 - RNA, 20 nt, Artificial Sequence
  MKO10096956_B_Lrrc9
  gRNA
ccaaauuucuacauccuuga

SEQ ID NO: 96957 - RNA, 20 nt, Artificial Sequence
  MKO10096957_B_Lrrc9
  gRNA
gaaagugaaaaccuaaaucg

SEQ ID NO: 96958 - RNA, 20 nt, Artificial Sequence
  MKO10096958_B_Lrrc9
  gRNA
cuaaaagaccucaaccuugc

SEQ ID NO: 96959 - RNA, 20 nt, Artificial Sequence
  MKO10096959_B_Lrrcc1
  gRNA
gcuacacaccgccgccucca

SEQ ID NO: 96960 - RNA, 20 nt, Artificial Sequence
  MKO10096960_B_Lrrcc1
  gRNA
auaccugguauaaggcagau

SEQ ID NO: 96961 - RNA, 20 nt, Artificial Sequence
  MKO10096961_B_Lrrcc1
  gRNA
cugcaauuugaucacaagag

SEQ ID NO: 96962 - RNA, 20 nt, Artificial Sequence
  MKO10096962_B_Lrrd1
  gRNA
gucauaugagacaccucuuc

SEQ ID NO: 96963 - RNA, 20 nt, Artificial Sequence
  MKO10096963_B_Lrrd1
  gRNA
auuuguuucagugauacugu

SEQ ID NO: 96964 - RNA, 20 nt, Artificial Sequence
  MKO10096964_B_Lrrd1
  gRNA
uuugcaacaaaaacuaaaca

SEQ ID NO: 96965 - RNA, 20 nt, Artificial Sequence
  MKO10096965_B_Lrrfip1
  gRNA
cucguauugccgcugagacu

SEQ ID NO: 96966 - RNA, 20 nt, Artificial Sequence
  MKO10096966_B_Lrrfip1
  gRNA
cagacaggcuaggcauguua

SEQ ID NO: 96967 - RNA, 20 nt, Artificial Sequence
  MKO10096967_B_Lrrfip1
  gRNA
agcauccaucagggaaauca

SEQ ID NO: 96968 - RNA, 20 nt, Artificial Sequence
  MKO10096968_B_Lrrfip2
  gRNA
cuggaugaguucccacuuag

SEQ ID NO: 96969 - RNA, 20 nt, Artificial Sequence
  MKO10096969_B_Lrrfip2
  gRNA
uuugaguaacaucgccagag

SEQ ID NO: 96970 - RNA, 20 nt, Artificial Sequence
  MKO10096970_B_Lrrfip2
  gRNA
uucuggaaggaaaagaacgc

SEQ ID NO: 96971 - RNA, 20 nt, Artificial Sequence
  MKO10096971_B_Lrriq1
  gRNA
uauuacuccugacacaccca

SEQ ID NO: 96972 - RNA, 20 nt, Artificial Sequence
  MKO10096972_B_Lrriq1
  gRNA
agaagaaaucgaagcugaau

SEQ ID NO: 96973 - RNA, 20 nt, Artificial Sequence
  MKO10096973_B_Lrriq1
  gRNA
cuuucucuagguuguaacca

SEQ ID NO: 96974 - RNA, 20 nt, Artificial Sequence
  MKO10096974_B_Lrriq3
  gRNA
ccuuuaugaaugugaugucu

SEQ ID NO: 96975 - RNA, 20 nt, Artificial Sequence
  MKO10096975_B_Lrriq3
  gRNA
aagccugaaugcaacauaaa

SEQ ID NO: 96976 - RNA, 20 nt, Artificial Sequence
  MKO10096976_B_Lrriq3
  gRNA
ucauaguuaggaaacacuua

SEQ ID NO: 96977 - RNA, 20 nt, Artificial Sequence
  MKO10096977_B_Lrriq4
  gRNA
auacauagagaacaaccgac

SEQ ID NO: 96978 - RNA, 20 nt, Artificial Sequence
  MKO10096978_B_Lrriq4
  gRNA
auuauauauuggacaagacc

SEQ ID NO: 96979 - RNA, 20 nt, Artificial Sequence
  MKO10096979_B_Lrriq4
  gRNA
auccccgauaccuguguagc

SEQ ID NO: 96980 - RNA, 20 nt, Artificial Sequence
  MKO10096980_B_Lrrk1
  gRNA
gcauccaguucaguagccgc

SEQ ID NO: 96981 - RNA, 20 nt, Artificial Sequence
  MKO10096981_B_Lrrk1
  gRNA
aauaggcuccgugccgaagc

SEQ ID NO: 96982 - RNA, 20 nt, Artificial Sequence
  MKO10096982_B_Lrrk1
  gRNA
ugaagagagcgaauccucac

SEQ ID NO: 96983 - RNA, 20 nt, Artificial Sequence
  MKO10096983_B_Lrrk2
  gRNA
auuaagcuuugcaauguccc

SEQ ID NO: 96984 - RNA, 20 nt, Artificial Sequence
  MKO10096984_B_Lrrk2
  gRNA
auuggcugaauaucugugca

SEQ ID NO: 96985 - RNA, 20 nt, Artificial Sequence
  MKO10096985_B_Lrrk2
  gRNA
uaaacucaccuugcugauac

SEQ ID NO: 96986 - RNA, 20 nt, Artificial Sequence
  MKO10096986_B_Lrrn1
  gRNA
ugaaagugaucgauagccgc

SEQ ID NO: 96987 - RNA, 20 nt, Artificial Sequence
  MKO10096987_B_Lrrn1
  gRNA
gggggguacagcucguucag

SEQ ID NO: 96988 - RNA, 20 nt, Artificial Sequence
  MKO10096988_B_Lrrn1
  gRNA
aauguaucgugcgauaucau

SEQ ID NO: 96989 - RNA, 20 nt, Artificial Sequence
  MKO10096989_B_Lrrn2
  gRNA
acugggcggcgcugaagguc

SEQ ID NO: 96990 - RNA, 20 nt, Artificial Sequence
  MKO10096990_B_Lrrn2
  gRNA
uggcuucacgguaggacgag

SEQ ID NO: 96991 - RNA, 20 nt, Artificial Sequence
  MKO10096991_B_Lrrn2
  gRNA
cacuaaaaccgucaguguug

SEQ ID NO: 96992 - RNA, 20 nt, Artificial Sequence
  MKO10096992_B_Lrrn3
  gRNA
acuucaaaucagcaccgacu

SEQ ID NO: 96993 - RNA, 20 nt, Artificial Sequence
  MKO10096993_B_Lrrn3
  gRNA
aagcaucagaaucucgagau

SEQ ID NO: 96994 - RNA, 20 nt, Artificial Sequence
  MKO10096994_B_Lrrn3
  gRNA
agagucuuugccgaaccuca

SEQ ID NO: 96995 - RNA, 20 nt, Artificial Sequence
  MKO10096995_B_Lrrn4cl
  gRNA
auagucgcaacggacagcua

SEQ ID NO: 96996 - RNA, 20 nt, Artificial Sequence
  MKO10096996_B_Lrrn4cl
  gRNA
cggcaugauaaacuugcgac

SEQ ID NO: 96997 - RNA, 20 nt, Artificial Sequence
  MKO10096997_B_Lrrn4cl
  gRNA
auuucugccuucgugagcga

SEQ ID NO: 96998 - RNA, 20 nt, Artificial Sequence
  MKO10096998_B_Lrrn4
  gRNA
aucugggaaucaauccguag

SEQ ID NO: 96999 - RNA, 20 nt, Artificial Sequence
  MKO10096999_B_Lrrn4
  gRNA
ucaagaugacucccaaccug

SEQ ID NO: 97000 - RNA, 20 nt, Artificial Sequence
  MKO10097000_B_Lrrn4
  gRNA
cuccacaauccagcugccgc

SEQ ID NO: 97001 - RNA, 20 nt, Artificial Sequence
  MKO10097001_B_Lrrtm1
  gRNA
uccucguacucuacguaucc

SEQ ID NO: 97002 - RNA, 20 nt, Artificial Sequence
  MKO10097002_B_Lrrtm1
  gRNA
cggccagagugaugcucgua

SEQ ID NO: 97003 - RNA, 20 nt, Artificial Sequence
  MKO10097003_B_Lrrtm1
  gRNA
ucagaaacugcgccgaguua

SEQ ID NO: 97004 - RNA, 20 nt, Artificial Sequence
  MKO10097004_B_Lrrtm2
  gRNA
cuaucccaguacgccuguuc

SEQ ID NO: 97005 - RNA, 20 nt, Artificial Sequence
  MKO10097005_B_Lrrtm2
  gRNA
cucgaacacugucaagucga

SEQ ID NO: 97006 - RNA, 20 nt, Artificial Sequence
  MKO10097006_B_Lrrtm2
  gRNA
cugucguagucuagaguuuc

SEQ ID NO: 97007 - RNA, 20 nt, Artificial Sequence
  MKO10097007_B_Lrrtm3
  gRNA
guccuuugaaacgaaugcac

SEQ ID NO: 97008 - RNA, 20 nt, Artificial Sequence
  MKO10097008_B_Lrrtm3
  gRNA
uucggauccgguuguauccc

SEQ ID NO: 97009 - RNA, 20 nt, Artificial Sequence
  MKO10097009_B_Lrrtm3
  gRNA
cagauccaaguuccguaaau

SEQ ID NO: 97010 - RNA, 20 nt, Artificial Sequence
  MKO10097010_B_Lrrtm4
  gRNA
ucguacucaugauccguacc

SEQ ID NO: 97011 - RNA, 20 nt, Artificial Sequence
  MKO10097011_B_Lrrtm4
  gRNA
gcagucuugaaaaacccgua

SEQ ID NO: 97012 - RNA, 20 nt, Artificial Sequence
  MKO10097012_B_Lrrtm4
  gRNA
gaucgcagguugaagagacg

SEQ ID NO: 97013 - RNA, 20 nt, Artificial Sequence
  MKO10097013_B_Lrsam1
  gRNA
gggcugucagcugguucuca

SEQ ID NO: 97014 - RNA, 20 nt, Artificial Sequence
  MKO10097014_B_Lrsam1
  gRNA
gggaggugaggugguuugua

SEQ ID NO: 97015 - RNA, 20 nt, Artificial Sequence
  MKO10097015_B_Lrsam1
  gRNA
gugcaaaguucuacagaaaa

SEQ ID NO: 97016 - RNA, 20 nt, Artificial Sequence
  MKO10097016_B_Lrtm1
  gRNA
ccacccaucaucaaacuccg

SEQ ID NO: 97017 - RNA, 20 nt, Artificial Sequence
  MKO10097017_B_Lrtm1
  gRNA
acauuuaaaacccgcaaaug

SEQ ID NO: 97018 - RNA, 20 nt, Artificial Sequence
  MKO10097018_B_Lrtm1
  gRNA
ugcggagccugggccaugaa

SEQ ID NO: 97019 - RNA, 20 nt, Artificial Sequence
  MKO10097019_B_Lrtm2
  gRNA
gugagugugcggcgagccau

SEQ ID NO: 97020 - RNA, 20 nt, Artificial Sequence
  MKO10097020_B_Lrtm2
  gRNA
gguuucaccauguuggcacc

SEQ ID NO: 97021 - RNA, 20 nt, Artificial Sequence
  MKO10097021_B_Lrtm2
  gRNA
gccaccgccuggugccaaca

SEQ ID NO: 97022 - RNA, 20 nt, Artificial Sequence
  MKO10097022_B_Lrwd1
  gRNA
gugaacucgaugagcgacuc

SEQ ID NO: 97023 - RNA, 20 nt, Artificial Sequence
  MKO10097023_B_Lrwd1
  gRNA
uacagcgaaggaugcgcaga

SEQ ID NO: 97024 - RNA, 20 nt, Artificial Sequence
  MKO10097024_B_Lrwd1
  gRNA
cgcuguaccaacaaccagcu

SEQ ID NO: 97025 - RNA, 20 nt, Artificial Sequence
  MKO10097025_B_Lsamp
  gRNA
caaguuuacuugaucguaca

SEQ ID NO: 97026 - RNA, 20 nt, Artificial Sequence
  MKO10097026_B_Lsamp
  gRNA
gacuuguuugacauccgccg

SEQ ID NO: 97027 - RNA, 20 nt, Artificial Sequence
  MKO10097027_B_Lsamp
  gRNA
guugcuuaccuaguggugua

SEQ ID NO: 97028 - RNA, 20 nt, Artificial Sequence
  MKO10097028_B_Lsg1
  gRNA
caguugcaagaaaguccucc

SEQ ID NO: 97029 - RNA, 20 nt, Artificial Sequence
  MKO10097029_B_Lsg1
  gRNA
gacaguucuuguguauacca

SEQ ID NO: 97030 - RNA, 20 nt, Artificial Sequence
  MKO10097030_B_Lsg1
  gRNA
cuugcaacugcagaacuugc

SEQ ID NO: 97031 - RNA, 20 nt, Artificial Sequence
  MKO10097031_B_Lsm10
  gRNA
augucaccuauaccgaccgc

SEQ ID NO: 97032 - RNA, 20 nt, Artificial Sequence
  MKO10097032_B_Lsm10
  gRNA
ugcuuucaugaauauccgcc

SEQ ID NO: 97033 - RNA, 20 nt, Artificial Sequence
  MKO10097033_B_Lsm10
  gRNA
auccaccgugugcgcaacuu

SEQ ID NO: 97034 - RNA, 20 nt, Artificial Sequence
  MKO10097034_B_Lsm11
  gRNA
acugcaccgcugcauccgag

SEQ ID NO: 97035 - RNA, 20 nt, Artificial Sequence
  MKO10097035_B_Lsm11
  gRNA
guggcuucgguauggggacg

SEQ ID NO: 97036 - RNA, 20 nt, Artificial Sequence
  MKO10097036_B_Lsm11
  gRNA
accuaccguaaaccugucuu

SEQ ID NO: 97037 - RNA, 20 nt, Artificial Sequence
  MKO10097037_B_Lsm12
  gRNA
ucagcauuaaagacuguaaa

SEQ ID NO: 97038 - RNA, 20 nt, Artificial Sequence
  MKO10097038_B_Lsm12
  gRNA
ccuagcuugccagcaaagca

SEQ ID NO: 97039 - RNA, 20 nt, Artificial Sequence
  MKO10097039_B_Lsm12
  gRNA
ccagaaugucccucuuccag

SEQ ID NO: 97040 - RNA, 20 nt, Artificial Sequence
  MKO10097040_B_Lsm14a
  gRNA
uggucugucuucuguaccga

SEQ ID NO: 97041 - RNA, 20 nt, Artificial Sequence
  MKO10097041_B_Lsm14a
  gRNA
ugcugcccaacuaauguacu

SEQ ID NO: 97042 - RNA, 20 nt, Artificial Sequence
  MKO10097042_B_Lsm14a
  gRNA
uuucucaaagggucuaacug

SEQ ID NO: 97043 - RNA, 20 nt, Artificial Sequence
  MKO10097043_B_Lsm14b
  gRNA
aaccccuaagugagguccuu

SEQ ID NO: 97044 - RNA, 20 nt, Artificial Sequence
  MKO10097044_B_Lsm14b
  gRNA
cagcaguaugccgcuuccuu

SEQ ID NO: 97045 - RNA, 20 nt, Artificial Sequence
  MKO10097045_B_Lsm14b
  gRNA
caccuuagauguaguccagc

SEQ ID NO: 97046 - RNA, 20 nt, Artificial Sequence
  MKO10097046_B_Lsm1
  gRNA
uuaagaagcauugaucaauu

SEQ ID NO: 97047 - RNA, 20 nt, Artificial Sequence
  MKO10097047_B_Lsm1
  gRNA
gaauucgcuccacagucuga

SEQ ID NO: 97048 - RNA, 20 nt, Artificial Sequence
  MKO10097048_B_Lsm1
  gRNA
guguucuuccaucucgaagu

SEQ ID NO: 97049 - RNA, 20 nt, Artificial Sequence
  MKO10097049_B_Lsm2
  gRNA
gcccacaagagacuugaaaa

SEQ ID NO: 97050 - RNA, 20 nt, Artificial Sequence
  MKO10097050_B_Lsm2
  gRNA
uggaacucaagaaugaccug

SEQ ID NO: 97051 - RNA, 20 nt, Artificial Sequence
  MKO10097051_B_Lsm2
  gRNA
cuguggaacccuccacucug

SEQ ID NO: 97052 - RNA, 20 nt, Artificial Sequence
  MKO10097052_B_Lsm3
  gRNA
cuagaacgacgccaucuccc

SEQ ID NO: 97053 - RNA, 20 nt, Artificial Sequence
  MKO10097053_B_Lsm3
  gRNA
gucgccccuccauugagagu

SEQ ID NO: 97054 - RNA, 20 nt, Artificial Sequence
  MKO10097054_B_Lsm3
  gRNA
gacaacgauagagauugaug

SEQ ID NO: 97055 - RNA, 20 nt, Artificial Sequence
  MKO10097055_B_Lsm4
  gRNA
ggccagcgccgcccaugccu

SEQ ID NO: 97056 - RNA, 20 nt, Artificial Sequence
  MKO10097056_B_Lsm4
  gRNA
gacagcgcagaaucacccca

SEQ ID NO: 97057 - RNA, 20 nt, Artificial Sequence
  MKO10097057_B_Lsm4
  gRNA
cgcugucuucagcagcgaca

SEQ ID NO: 97058 - RNA, 20 nt, Artificial Sequence
  MKO10097058_B_Lsm5
  gRNA
gagcuuguggacaaauguau

SEQ ID NO: 97059 - RNA, 20 nt, Artificial Sequence
  MKO10097059_B_Lsm5
  gRNA
aagagugauaaagaaauugu

SEQ ID NO: 97060 - RNA, 20 nt, Artificial Sequence
  MKO10097060_B_Lsm5
  gRNA
uuuguaauucuucuuccuuc

SEQ ID NO: 97061 - RNA, 20 nt, Artificial Sequence
  MKO10097061_B_Lsm6
  gRNA
gaauuuaauuucaccacaac

SEQ ID NO: 97062 - RNA, 20 nt, Artificial Sequence
  MKO10097062_B_Lsm6
  gRNA
uguacauaaguacacagaag

SEQ ID NO: 97063 - RNA, 20 nt, Artificial Sequence
  MKO10097063_B_Lsm6
  gRNA
gacuucuuaaagcagaucau

SEQ ID NO: 97064 - RNA, 20 nt, Artificial Sequence
  MKO10097064_B_Lsm7
  gRNA
aaguuccaggguggccggga

SEQ ID NO: 97065 - RNA, 20 nt, Artificial Sequence
  MKO10097065_B_Lsm7
  gRNA
ugaugaccaguacaagcuga

SEQ ID NO: 97066 - RNA, 20 nt, Artificial Sequence
  MKO10097066_B_Lsm7
  gRNA
aguguccugcugcugcacga

SEQ ID NO: 97067 - RNA, 20 nt, Artificial Sequence
  MKO10097067_B_Lsm8
  gRNA
cagcagcaugacgucugcuu

SEQ ID NO: 97068 - RNA, 20 nt, Artificial Sequence
  MKO10097068_B_Lsm8
  gRNA
guggcuguuauuacuucuga

SEQ ID NO: 97069 - RNA, 20 nt, Artificial Sequence
  MKO10097069_B_Lsm8
  gRNA
auuaauaacagagcagucau

SEQ ID NO: 97070 - RNA, 20 nt, Artificial Sequence
  MKO10097070_B_Lsmd1
  gRNA
ucguuucuauugaaguccaa

SEQ ID NO: 97071 - RNA, 20 nt, Artificial Sequence
  MKO10097071_B_Lsmd1
  gRNA
auucuccucucguaguagca

SEQ ID NO: 97072 - RNA, 20 nt, Artificial Sequence
  MKO10097072_B_Lsmd1
  gRNA
cccccgacagacucucccuu

SEQ ID NO: 97073 - RNA, 20 nt, Artificial Sequence
  MKO10097073_B_Lsmem1
  gRNA
ccaggcugaccgucaacacc

SEQ ID NO: 97074 - RNA, 20 nt, Artificial Sequence
  MKO10097074_B_Lsmem1
  gRNA
aguucuguucagaguccagc

SEQ ID NO: 97075 - RNA, 20 nt, Artificial Sequence
  MKO10097075_B_Lsmem1
  gRNA
guugacggucagccuggcuc

SEQ ID NO: 97076 - RNA, 20 nt, Artificial Sequence
  MKO10097076_B_Lsp1
  gRNA
uuagcaucugauacgucauc

SEQ ID NO: 97077 - RNA, 20 nt, Artificial Sequence
  MKO10097077_B_Lsp1
  gRNA
gcucccguugacgcugcuca

SEQ ID NO: 97078 - RNA, 20 nt, Artificial Sequence
  MKO10097078_B_Lsp1
  gRNA
cccgauccagaggaugcugu

SEQ ID NO: 97079 - RNA, 20 nt, Artificial Sequence
  MKO10097079_B_Lsr
  gRNA
aggcgccccagcacacgcgc

SEQ ID NO: 97080 - RNA, 20 nt, Artificial Sequence
  MKO10097080_B_Lsr
  gRNA
gacggccgcgauggcgccgg

SEQ ID NO: 97081 - RNA, 20 nt, Artificial Sequence
  MKO10097081_B_Lsr
  gRNA
guacccauagggaggacgca

SEQ ID NO: 97082 - RNA, 20 nt, Artificial Sequence
  MKO10097082_B_Lss
  gRNA
ucaugggcuguuugcgcuuu

SEQ ID NO: 97083 - RNA, 20 nt, Artificial Sequence
  MKO10097083_B_Lss
  gRNA
uuccgagcgcgcacaagguc

SEQ ID NO: 97084 - RNA, 20 nt, Artificial Sequence
  MKO10097084_B_Lss
  gRNA
auccugaccuugugcgcgcu

SEQ ID NO: 97085 - RNA, 20 nt, Artificial Sequence
  MKO10097085_B_Lst1
  gRNA
caugucugugauaucacuac

SEQ ID NO: 97086 - RNA, 20 nt, Artificial Sequence
  MKO10097086_B_Lst1
  gRNA
ugucugaugacaaugggauc

SEQ ID NO: 97087 - RNA, 20 nt, Artificial Sequence
  MKO10097087_B_Lst1
  gRNA
cacucaagugggugugcucc

SEQ ID NO: 97088 - RNA, 20 nt, Artificial Sequence
  MKO10097088_B_Lua4h
  gRNA
agguuacaaagggucaccga

SEQ ID NO: 97089 - RNA, 20 nt, Artificial Sequence
  MKO10097089_B_Lua4h
  gRNA
ugcgguguacguuaauuuca

SEQ ID NO: 97090 - RNA, 20 nt, Artificial Sequence
  MKO10097090_B_Lua4h
  gRNA
ccaaauccucugcgcuucag

SEQ ID NO: 97091 - RNA, 20 nt, Artificial Sequence
  MKO10097091_B_Lua
  gRNA
aaaccugcugcucaccuugu

SEQ ID NO: 97092 - RNA, 20 nt, Artificial Sequence
  MKO10097092_B_Lua
  gRNA
ugccucaccugggccccuag

SEQ ID NO: 97093 - RNA, 20 nt, Artificial Sequence
  MKO10097093_B_Lua
  gRNA
guucuccacaugacacugcu

SEQ ID NO: 97094 - RNA, 20 nt, Artificial Sequence
  MKO10097094_B_Ltb4r1
  gRNA
cccgcgcacgcguacagcac

SEQ ID NO: 97095 - RNA, 20 nt, Artificial Sequence
  MKO10097095_B_Ltb4r1
  gRNA
ccacgcccgccgaacgcagc

SEQ ID NO: 97096 - RNA, 20 nt, Artificial Sequence
  MKO10097096_B_Ltb4r1
  gRNA
uuccgccguagucgccgcac

SEQ ID NO: 97097 - RNA, 20 nt, Artificial Sequence
  MKO10097097_B_Ltb4r2
  gRNA
agcccucgaagagucgagua

SEQ ID NO: 97098 - RNA, 20 nt, Artificial Sequence
  MKO10097098_B_Ltb4r2
  gRNA
cgcgguugcgaggagcgcgc

SEQ ID NO: 97099 - RNA, 20 nt, Artificial Sequence
  MKO10097099_B_Ltb4r2
  gRNA
ucugucugcuaccguccgcc

SEQ ID NO: 97100 - RNA, 20 nt, Artificial Sequence
  MKO10097100_B_Ltbp1
  gRNA
acaacuuggccgaugcuucc

SEQ ID NO: 97101 - RNA, 20 nt, Artificial Sequence
  MKO10097101_B_Ltbp1
  gRNA
aguacguagaauggacuguc

SEQ ID NO: 97102 - RNA, 20 nt, Artificial Sequence
  MKO10097102_B_Ltbp1
  gRNA
caccauucauacacggaaga

SEQ ID NO: 97103 - RNA, 20 nt, Artificial Sequence
  MKO10097103_B_Ltbp2
  gRNA
cuuccguggggcgcgcugug

SEQ ID NO: 97104 - RNA, 20 nt, Artificial Sequence
  MKO10097104_B_Ltbp2
  gRNA
ugguaccagcggcuguauuc

SEQ ID NO: 97105 - RNA, 20 nt, Artificial Sequence
  MKO10097105_B_Ltbp2
  gRNA
caccaccaccuuguacaguc

SEQ ID NO: 97106 - RNA, 20 nt, Artificial Sequence
  MKO10097106_B_Ltbp3
  gRNA
gaucaccugcaccgcguaaa

SEQ ID NO: 97107 - RNA, 20 nt, Artificial Sequence
  MKO10097107_B_Ltbp3
  gRNA
gcugaccauacccuggcagu

SEQ ID NO: 97108 - RNA, 20 nt, Artificial Sequence
  MKO10097108_B_Ltbp3
  gRNA
gcacccaccuccccacguac

SEQ ID NO: 97109 - RNA, 20 nt, Artificial Sequence
  MKO10097109_B_Ltbp4
  gRNA
gggcccccgaagaaugcaau

SEQ ID NO: 97110 - RNA, 20 nt, Artificial Sequence
  MKO10097110_B_Ltbp4
  gRNA
ggcccgacacacguuccacu

SEQ ID NO: 97111 - RNA, 20 nt, Artificial Sequence
  MKO10097111_B_Ltbp4
  gRNA
cccauuaacucucucgaagc

SEQ ID NO: 97112 - RNA, 20 nt, Artificial Sequence
  MKO10097112_B_Ltbr
  gRNA
agccgagugccgcugucagc

SEQ ID NO: 97113 - RNA, 20 nt, Artificial Sequence
  MKO10097113_B_Ltbr
  gRNA
cauaggcgaguuugucuuug

SEQ ID NO: 97114 - RNA, 20 nt, Artificial Sequence
  MKO10097114_B_Ltbr
  gRNA
accugguaugggguugacag

SEQ ID NO: 97115 - RNA, 20 nt, Artificial Sequence
  MKO10097115_B_Ltb
  gRNA
acccgacgucccugauccug

SEQ ID NO: 97116 - RNA, 20 nt, Artificial Sequence
  MKO10097116_B_Ltb
  gRNA
ugccgcaggaucagggacgu

SEQ ID NO: 97117 - RNA, 20 nt, Artificial Sequence
  MKO10097117_B_Ltb
  gRNA
agggguucaacagcugccaa

SEQ ID NO: 97118 - RNA, 20 nt, Artificial Sequence
  MKO10097118_B_Luc4s
  gRNA
gagcgcaguccguagcgugc

SEQ ID NO: 97119 - RNA, 20 nt, Artificial Sequence
  MKO10097119_B_Luc4s
  gRNA
uacggacugcgcucuucaga

SEQ ID NO: 97120 - RNA, 20 nt, Artificial Sequence
  MKO10097120_B_Luc4s
  gRNA
gugucgccgccgcucaccuc

SEQ ID NO: 97121 - RNA, 20 nt, Artificial Sequence
  MKO10097121_B_Ltf
  gRNA
ucccugcacacgagcuacac

SEQ ID NO: 97122 - RNA, 20 nt, Artificial Sequence
  MKO10097122_B_Ltf
  gRNA
aaccuguguagcucgugugc

SEQ ID NO: 97123 - RNA, 20 nt, Artificial Sequence
  MKO10097123_B_Ltf
  gRNA
cccaggacucugucuagcua

SEQ ID NO: 97124 - RNA, 20 nt, Artificial Sequence
  MKO10097124_B_Ltk
  gRNA
cgagaggcuggagacccgcg

SEQ ID NO: 97125 - RNA, 20 nt, Artificial Sequence
  MKO10097125_B_Ltk
  gRNA
cugccacuacagcucccauc

SEQ ID NO: 97126 - RNA, 20 nt, Artificial Sequence
  MKO10097126_B_Ltk
  gRNA
acauccuuuguccaccccag

SEQ ID NO: 97127 - RNA, 20 nt, Artificial Sequence
  MKO10097127_B_Ltn1
  gRNA
uguagauuccgauuuccgaa

SEQ ID NO: 97128 - RNA, 20 nt, Artificial Sequence
  MKO10097128_B_Ltn1
  gRNA
guauggaagaaccccuuuga

SEQ ID NO: 97129 - RNA, 20 nt, Artificial Sequence
  MKO10097129_B_Ltn1
  gRNA
agagacacagaagccgucaa

SEQ ID NO: 97130 - RNA, 20 nt, Artificial Sequence
  MKO10097130_B_Ltv1
  gRNA
ggucuucugucuugucgcag

SEQ ID NO: 97131 - RNA, 20 nt, Artificial Sequence
  MKO10097131_B_Ltv1
  gRNA
cuaaaggaucucgcuggcuc

SEQ ID NO: 97132 - RNA, 20 nt, Artificial Sequence
  MKO10097132_B_Ltv1
  gRNA
uguguuugcauccgaguuug

SEQ ID NO: 97133 - RNA, 20 nt, Artificial Sequence
  MKO10097133_B_Luc7l2
  gRNA
agaagagauaagugcugaag

SEQ ID NO: 97134 - RNA, 20 nt, Artificial Sequence
  MKO10097134_B_Luc7l2
  gRNA
aaccacauacuguuccagaa

SEQ ID NO: 97135 - RNA, 20 nt, Artificial Sequence
  MKO10097135_B_Luc7l2
  gRNA
ugcccccacgauguccuuuc

SEQ ID NO: 97136 - RNA, 20 nt, Artificial Sequence
  MKO10097136_B_Luc7l3
  gRNA
cuuacagaguuuacuugccg

SEQ ID NO: 97137 - RNA, 20 nt, Artificial Sequence
  MKO10097137_B_Luc7l3
  gRNA
aauugaugugcuucuacagc

SEQ ID NO: 97138 - RNA, 20 nt, Artificial Sequence
  MKO10097138_B_Luc7l3
  gRNA
uuauaggcugcugguccaac

SEQ ID NO: 97139 - RNA, 20 nt, Artificial Sequence
  MKO10097139_B_Luc7l
  gRNA
ucuccacagcgcauggauuu

SEQ ID NO: 97140 - RNA, 20 nt, Artificial Sequence
  MKO10097140_B_Luc7l
  gRNA
augcaccuaccgucccagca

SEQ ID NO: 97141 - RNA, 20 nt, Artificial Sequence
  MKO10097141_B_Luc7l
  gRNA
ccgaucacacucugcaauga

SEQ ID NO: 97142 - RNA, 20 nt, Artificial Sequence
  MKO10097142_B_Lum
  gRNA
caagaucaagcaucugcgcu

SEQ ID NO: 97143 - RNA, 20 nt, Artificial Sequence
  MKO10097143_B_Lum
  gRNA
aacaaccugaccgaguccgu

SEQ ID NO: 97144 - RNA, 20 nt, Artificial Sequence
  MKO10097144_B_Lum
  gRNA
caaguugaccagcccgucga

SEQ ID NO: 97145 - RNA, 20 nt, Artificial Sequence
  MKO10097145_B_Lurap1l
  gRNA
gcuguuguagcugccacgua

SEQ ID NO: 97146 - RNA, 20 nt, Artificial Sequence
  MKO10097146_B_Lurap1l
  gRNA
ccccgcgcagcgagcgcgcu

SEQ ID NO: 97147 - RNA, 20 nt, Artificial Sequence
  MKO10097147_B_Lurap1l
  gRNA
agucagaguaccuccuuacg

SEQ ID NO: 97148 - RNA, 20 nt, Artificial Sequence
  MKO10097148_B_Lurap1
  gRNA
ucuucacaucgauagcucgc

SEQ ID NO: 97149 - RNA, 20 nt, Artificial Sequence
  MKO10097149_B_Lurap1
  gRNA
cccuccacgucucgcaaguc

SEQ ID NO: 97150 - RNA, 20 nt, Artificial Sequence
  MKO10097150_B_Lurap1
  gRNA
cugccccgccuugagcgucc

SEQ ID NO: 97151 - RNA, 20 nt, Artificial Sequence
  MKO10097151_B_Luzp1
  gRNA
agccgcuccucaguccaaac

SEQ ID NO: 97152 - RNA, 20 nt, Artificial Sequence
  MKO10097152_B_Luzp1
  gRNA
gaacagggcgcucgaagagu

SEQ ID NO: 97153 - RNA, 20 nt, Artificial Sequence
  MKO10097153_B_Luzp1
  gRNA
uuauaauugcucuagaccgc

SEQ ID NO: 97154 - RNA, 20 nt, Artificial Sequence
  MKO10097154_B_Luzp2
  gRNA
ugggaucaaagugaaccuuc

SEQ ID NO: 97155 - RNA, 20 nt, Artificial Sequence
  MKO10097155_B_Luzp2
  gRNA
ucucuuuaagcugauucugc

SEQ ID NO: 97156 - RNA, 20 nt, Artificial Sequence
  MKO10097156_B_Luzp2
  gRNA
uuaccucauucuguaaguca

SEQ ID NO: 97157 - RNA, 20 nt, Artificial Sequence
  MKO10097157_B_Luzp4
  gRNA
ucacuuaccagaugaaguag

SEQ ID NO: 97158 - RNA, 20 nt, Artificial Sequence
  MKO10097158_B_Luzp4
  gRNA
caggacacagacgugacagu

SEQ ID NO: 97159 - RNA, 20 nt, Artificial Sequence
  MKO10097159_B_Luzp4
  gRNA
uguuucuaccugucaauuuc

SEQ ID NO: 97160 - RNA, 20 nt, Artificial Sequence
  MKO10097160_B_Lxn
  gRNA
cugccacauuacauaaccgc

SEQ ID NO: 97161 - RNA, 20 nt, Artificial Sequence
  MKO10097161_B_Lxn
  gRNA
caugucucugaagagaccgc

SEQ ID NO: 97162 - RNA, 20 nt, Artificial Sequence
  MKO10097162_B_Lxn
  gRNA
gaagucaacuucacauucga

SEQ ID NO: 97163 - RNA, 20 nt, Artificial Sequence
  MKO10097163_B_Ly6a
  gRNA
ugaguaacacagacuccauc

SEQ ID NO: 97164 - RNA, 20 nt, Artificial Sequence
  MKO10097164_B_Ly6a
  gRNA
cuguuugcugauucuucuug

SEQ ID NO: 97165 - RNA, 20 nt, Artificial Sequence
  MKO10097165_B_Ly6a
  gRNA
caccucuuucugcacacagu

SEQ ID NO: 97166 - RNA, 20 nt, Artificial Sequence
  MKO10097166_B_Ly6c1
  gRNA
cacaagaagaaugagcacac

SEQ ID NO: 97167 - RNA, 20 nt, Artificial Sequence
  MKO10097167_B_Ly6c1
  gRNA
cugcagugcuacgagugcua

SEQ ID NO: 97168 - RNA, 20 nt, Artificial Sequence
  MKO10097168_B_Ly6c1
  gRNA
agcaaugcagaauccaucag

SEQ ID NO: 97169 - RNA, 20 nt, Artificial Sequence
  MKO10097169_B_Ly6c2
  gRNA
cuguuugcugauucuucuug

SEQ ID NO: 97170 - RNA, 20 nt, Artificial Sequence
  MKO10097170_B_Ly6c2
  gRNA
cugcagugcuacgagugcua

SEQ ID NO: 97171 - RNA, 20 nt, Artificial Sequence
  MKO10097171_B_Ly6c2
  gRNA
agcaaugcagaauccaucag

SEQ ID NO: 97172 - RNA, 20 nt, Artificial Sequence
  MKO10097172_B_Ly6d
  gRNA
ugccaacuguaagaacccuc

SEQ ID NO: 97173 - RNA, 20 nt, Artificial Sequence
  MKO10097173_B_Ly6d
  gRNA
cagccgcucaccugggcuag

SEQ ID NO: 97174 - RNA, 20 nt, Artificial Sequence
  MKO10097174_B_Ly6d
  gRNA
ucugcucguccuccuugucu

SEQ ID NO: 97175 - RNA, 20 nt, Artificial Sequence
  MKO10097175_B_Ly6e
  gRNA
caugcagggaaugucaaccu

SEQ ID NO: 97176 - RNA, 20 nt, Artificial Sequence
  MKO10097176_B_Ly6e
  gRNA
gcccuucugggcauggagca

SEQ ID NO: 97177 - RNA, 20 nt, Artificial Sequence
  MKO10097177_B_Ly6e
  gRNA
uaccuugcuccaugcccaga

SEQ ID NO: 97178 - RNA, 20 nt, Artificial Sequence
  MKO10097178_B_Ly6f
  gRNA
ucacguugacaguaguaccc

SEQ ID NO: 97179 - RNA, 20 nt, Artificial Sequence
  MKO10097179_B_Ly6f
  gRNA
cacaagaaggaugaguacac

SEQ ID NO: 97180 - RNA, 20 nt, Artificial Sequence
  MKO10097180_B_Ly6f
  gRNA
caccucuuucugcacacaau

SEQ ID NO: 97181 - RNA, 20 nt, Artificial Sequence
  MKO10097181_B_Ly6g5b
  gRNA
gaccauggugggcuuugcga

SEQ ID NO: 97182 - RNA, 20 nt, Artificial Sequence
  MKO10097182_B_Ly6g5b
  gRNA
gcuguccacagccccguacg

SEQ ID NO: 97183 - RNA, 20 nt, Artificial Sequence
  MKO10097183_B_Ly6g5b
  gRNA
cagccuuccaucgccgugua

SEQ ID NO: 97184 - RNA, 20 nt, Artificial Sequence
  MKO10097184_B_Ly6g5c
  gRNA
ugcuguccucuuaacagugc

SEQ ID NO: 97185 - RNA, 20 nt, Artificial Sequence
  MKO10097185_B_Ly6g5c
  gRNA
uucauauacccgugcuuccc

SEQ ID NO: 97186 - RNA, 20 nt, Artificial Sequence
  MKO10097186_B_Ly6g5c
  gRNA
aagcacggguauaugaacaa

SEQ ID NO: 97187 - RNA, 20 nt, Artificial Sequence
  MKO10097187_B_Ly6g6c
  gRNA
cugacaacaaacguguaccu

SEQ ID NO: 97188 - RNA, 20 nt, Artificial Sequence
  MKO10097188_B_Ly6g6c
  gRNA
ugucugcccuacucuacugc

SEQ ID NO: 97189 - RNA, 20 nt, Artificial Sequence
  MKO10097189_B_Ly6g6c
  gRNA
cugagacccagcaguagagu

SEQ ID NO: 97190 - RNA, 20 nt, Artificial Sequence
  MKO10097190_B_Ly6g6d
  gRNA
cacuugauugcaaugaugcg

SEQ ID NO: 97191 - RNA, 20 nt, Artificial Sequence
  MKO10097191_B_Ly6g6d
  gRNA
ugagcaggaucccgaccaac

SEQ ID NO: 97192 - RNA, 20 nt, Artificial Sequence
  MKO10097192_B_Ly6g6d
  gRNA
uacccagggcaaccccuagc

SEQ ID NO: 97193 - RNA, 20 nt, Artificial Sequence
  MKO10097193_B_Ly6g6e
  gRNA
ggcccguccagcgccuuccu

SEQ ID NO: 97194 - RNA, 20 nt, Artificial Sequence
  MKO10097194_B_Ly6g6e
  gRNA
cucguccucucgacacuccc

SEQ ID NO: 97195 - RNA, 20 nt, Artificial Sequence
  MKO10097195_B_Ly6g6e
  gRNA
ccuuacccaguguccccgag

SEQ ID NO: 97196 - RNA, 20 nt, Artificial Sequence
  MKO10097196_B_Ly6g6f
  gRNA
cagaccaucuacguagccuc

SEQ ID NO: 97197 - RNA, 20 nt, Artificial Sequence
  MKO10097197_B_Ly6g6f
  gRNA
cacgucccagcucgggagag

SEQ ID NO: 97198 - RNA, 20 nt, Artificial Sequence
  MKO10097198_B_Ly6g6f
  gRNA
ggcgucuggacucugugacc

SEQ ID NO: 97199 - RNA, 20 nt, Artificial Sequence
  MKO10097199_B_Ly6h
  gRNA
gauccgcacgcuggcacaaa

SEQ ID NO: 97200 - RNA, 20 nt, Artificial Sequence
  MKO10097200_B_Ly6h
  gRNA
cgccagaccgaggcucuuca

SEQ ID NO: 97201 - RNA, 20 nt, Artificial Sequence
  MKO10097201_B_Ly6h
  gRNA
ccugcagccaugaagagccu

SEQ ID NO: 97202 - RNA, 20 nt, Artificial Sequence
  MKO10097202_B_Ly6i
  gRNA
cacaagaaggaucagcacac

SEQ ID NO: 97203 - RNA, 20 nt, Artificial Sequence
  MKO10097203_B_Ly6i
  gRNA
ugagcaacacagaauccauc

SEQ ID NO: 97204 - RNA, 20 nt, Artificial Sequence
  MKO10097204_B_Ly6i
  gRNA
uaccucuuucugcacacagu

SEQ ID NO: 97205 - RNA, 20 nt, Artificial Sequence
  MKO10097205_B_Ly6k
  gRNA
uaagcccagaacuacgagca

SEQ ID NO: 97206 - RNA, 20 nt, Artificial Sequence
  MKO10097206_B_Ly6k
  gRNA
cuacggggguuggacaccuu

SEQ ID NO: 97207 - RNA, 20 nt, Artificial Sequence
  MKO10097207_B_Ly6k
  gRNA
ucgaauccgucccagugccc

SEQ ID NO: 97208 - RNA, 20 nt, Artificial Sequence
  MKO10097208_B_Ly75
  gRNA
gacaucagauguauucguau

SEQ ID NO: 97209 - RNA, 20 nt, Artificial Sequence
  MKO10097209_B_Ly75
  gRNA
aaucagcucuauucugcgag

SEQ ID NO: 97210 - RNA, 20 nt, Artificial Sequence
  MKO10097210_B_Ly75
  gRNA
gaauucacaaggucucccgu

SEQ ID NO: 97211 - RNA, 20 nt, Artificial Sequence
  MKO10097211_B_Ly86
  gRNA
guccuccucacaaaggggau

SEQ ID NO: 97212 - RNA, 20 nt, Artificial Sequence
  MKO10097212_B_Ly86
  gRNA
accuguggaacaucaagucc

SEQ ID NO: 97213 - RNA, 20 nt, Artificial Sequence
  MKO10097213_B_Ly86
  gRNA
gggagaauaucagcucuugc

SEQ ID NO: 97214 - RNA, 20 nt, Artificial Sequence
  MKO10097214_B_Ly96
  gRNA
aguauucccucgaaagagaa

SEQ ID NO: 97215 - RNA, 20 nt, Artificial Sequence
  MKO10097215_B_Ly96
  gRNA
cugaacccugcauaagacug

SEQ ID NO: 97216 - RNA, 20 nt, Artificial Sequence
  MKO10097216_B_Ly96
  gRNA
gcauauucuaauugacauca

SEQ ID NO: 97217 - RNA, 20 nt, Artificial Sequence
  MKO10097217_B_Ly9
  gRNA
ccgaguggcccgaaauucca

SEQ ID NO: 97218 - RNA, 20 nt, Artificial Sequence
  MKO10097218_B_Ly9
  gRNA
acccauuuaaauacauacga

SEQ ID NO: 97219 - RNA, 20 nt, Artificial Sequence
  MKO10097219_B_Ly9
  gRNA
ccucucggguccagcuguac

SEQ ID NO: 97220 - RNA, 20 nt, Artificial Sequence
  MKO10097220_B_Lyar
  gRNA
cggaagcggccaaagcacuc

SEQ ID NO: 97221 - RNA, 20 nt, Artificial Sequence
  MKO10097221_B_Lyar
  gRNA
gaaacccaacgucagcccca

SEQ ID NO: 97222 - RNA, 20 nt, Artificial Sequence
  MKO10097222_B_Lyar
  gRNA
cuucacugaugcacuucaca

SEQ ID NO: 97223 - RNA, 20 nt, Artificial Sequence
  MKO10097223_B_Lyg1
  gRNA
accgccgaccagcaucugag

SEQ ID NO: 97224 - RNA, 20 nt, Artificial Sequence
  MKO10097224_B_Lyg1
  gRNA
aacuucggccagccguucag

SEQ ID NO: 97225 - RNA, 20 nt, Artificial Sequence
  MKO10097225_B_Lyg1
  gRNA
guuaacuaccgcaauagguc

SEQ ID NO: 97226 - RNA, 20 nt, Artificial Sequence
  MKO10097226_B_Lyg2
  gRNA
caucagauuauuuaugucgc

SEQ ID NO: 97227 - RNA, 20 nt, Artificial Sequence
  MKO10097227_B_Lyg2
  gRNA
aagucaccgucuaugucugc

SEQ ID NO: 97228 - RNA, 20 nt, Artificial Sequence
  MKO10097228_B_Lyg2
  gRNA
gucacuccugcagacauaga

SEQ ID NO: 97229 - RNA, 20 nt, Artificial Sequence
  MKO10097229_B_Lyl1
  gRNA
cagguuuaucacuggcacgc

SEQ ID NO: 97230 - RNA, 20 nt, Artificial Sequence
  MKO10097230_B_Lyl1
  gRNA
accccuuacagugucuacau

SEQ ID NO: 97231 - RNA, 20 nt, Artificial Sequence
  MKO10097231_B_Lyl1
  gRNA
cugcgcuucagccggcuguu

SEQ ID NO: 97232 - RNA, 20 nt, Artificial Sequence
  MKO10097232_B_Lynx1
  gRNA
ugccacgugugugccuacaa

SEQ ID NO: 97233 - RNA, 20 nt, Artificial Sequence
  MKO10097233_B_Lynx1
  gRNA
ccaucugcucacaguguucc

SEQ ID NO: 97234 - RNA, 20 nt, Artificial Sequence
  MKO10097234_B_Lynx1
  gRNA
uacccacaggcaggcccauc

SEQ ID NO: 97235 - RNA, 20 nt, Artificial Sequence
  MKO10097235_B_Lyn
  gRNA
ugggauguauuaaaucaaaa

SEQ ID NO: 97236 - RNA, 20 nt, Artificial Sequence
  MKO10097236_B_Lyn
  gRNA
aacucacucuucaguuucua

SEQ ID NO: 97237 - RNA, 20 nt, Artificial Sequence
  MKO10097237_B_Lyn
  gRNA
ucuauuccaggcauggggaa

SEQ ID NO: 97238 - RNA, 20 nt, Artificial Sequence
  MKO10097238_B_Lypd1
  gRNA
guguuauagggaucauguac

SEQ ID NO: 97239 - RNA, 20 nt, Artificial Sequence
  MKO10097239_B_Lypd1
  gRNA
uccgggaggauguggguucu

SEQ ID NO: 97240 - RNA, 20 nt, Artificial Sequence
  MKO10097240_B_Lypd1
  gRNA
acacaugucuugaacguuca

SEQ ID NO: 97241 - RNA, 20 nt, Artificial Sequence
  MKO10097241_B_Lypd2
  gRNA
augcucaccaagcuccccga

SEQ ID NO: 97242 - RNA, 20 nt, Artificial Sequence
  MKO10097242_B_Lypd2
  gRNA
cgcacagguguagcacugua

SEQ ID NO: 97243 - RNA, 20 nt, Artificial Sequence
  MKO10097243_B_Lypd2
  gRNA
ccucgaccaugcaggggacc

SEQ ID NO: 97244 - RNA, 20 nt, Artificial Sequence
  MKO10097244_B_Lypd3
  gRNA
ccgccacagagaauugcccg

SEQ ID NO: 97245 - RNA, 20 nt, Artificial Sequence
  MKO10097245_B_Lypd3
  gRNA
ucucguccuggacgcagccu

SEQ ID NO: 97246 - RNA, 20 nt, Artificial Sequence
  MKO10097246_B_Lypd3
  gRNA
cucgguacagacguccaccc

SEQ ID NO: 97247 - RNA, 20 nt, Artificial Sequence
  MKO10097247_B_Lypd4
  gRNA
ucgugcuugcccacgcagcu

SEQ ID NO: 97248 - RNA, 20 nt, Artificial Sequence
  MKO10097248_B_Lypd4
  gRNA
caauguccuagauaaguccg

SEQ ID NO: 97249 - RNA, 20 nt, Artificial Sequence
  MKO10097249_B_Lypd4
  gRNA
acacggaaccaugauacugc

SEQ ID NO: 97250 - RNA, 20 nt, Artificial Sequence
  MKO10097250_B_Lypd5
  gRNA
ccacuacuggccaucgcucu

SEQ ID NO: 97251 - RNA, 20 nt, Artificial Sequence
  MKO10097251_B_Lypd5
  gRNA
aguagucaguggcgcaacca

SEQ ID NO: 97252 - RNA, 20 nt, Artificial Sequence
  MKO10097252_B_Lypd5
  gRNA
cucugagguggucuugucgc

SEQ ID NO: 97253 - RNA, 20 nt, Artificial Sequence
  MKO10097253_B_Lypd6b
  gRNA
ugauggacguacuucuuccg

SEQ ID NO: 97254 - RNA, 20 nt, Artificial Sequence
  MKO10097254_B_Lypd6b
  gRNA
auaauuauaacugcaaucga

SEQ ID NO: 97255 - RNA, 20 nt, Artificial Sequence
  MKO10097255_B_Lypd6b
  gRNA
agaagacaagugguguccgc

SEQ ID NO: 97256 - RNA, 20 nt, Artificial Sequence
  MKO10097256_B_Lypd6
  gRNA
caccaaacgcugugucccgc

SEQ ID NO: 97257 - RNA, 20 nt, Artificial Sequence
  MKO10097257_B_Lypd6
  gRNA
ugcccauucgucugguuuau

SEQ ID NO: 97258 - RNA, 20 nt, Artificial Sequence
  MKO10097258_B_Lypd6
  gRNA
cagugaucguguccugcuug

SEQ ID NO: 97259 - RNA, 20 nt, Artificial Sequence
  MKO10097259_B_Lypd8
  gRNA
cucaccucuguuacccgacc

SEQ ID NO: 97260 - RNA, 20 nt, Artificial Sequence
  MKO10097260_B_Lypd8
  gRNA
aaaccccaaaaguguuacga

SEQ ID NO: 97261 - RNA, 20 nt, Artificial Sequence
  MKO10097261_B_Lypd8
  gRNA
ggacugcucauugcauucag

SEQ ID NO: 97262 - RNA, 20 nt, Artificial Sequence
  MKO10097262_B_Lypla1
  gRNA
guggacagauguauuugaug

SEQ ID NO: 97263 - RNA, 20 nt, Artificial Sequence
  MKO10097263_B_Lypla1
  gRNA
gauucccaggaagaugaauc

SEQ ID NO: 97264 - RNA, 20 nt, Artificial Sequence
  MKO10097264_B_Lypla1
  gRNA
agucacauuaaauaugaaua

SEQ ID NO: 97265 - RNA, 20 nt, Artificial Sequence
  MKO10097265_B_Lypla2
  gRNA
uugaugccagcuucauccuc

SEQ ID NO: 97266 - RNA, 20 nt, Artificial Sequence
  MKO10097266_B_Lypla2
  gRNA
gcugaguccggaugccccag

SEQ ID NO: 97267 - RNA, 20 nt, Artificial Sequence
  MKO10097267_B_Lypla2
  gRNA
ugugacacucaacaugaaga

SEQ ID NO: 97268 - RNA, 20 nt, Artificial Sequence
  MKO10097268_B_Lyplal1
  gRNA
ugugcuggaauguuaagucu

SEQ ID NO: 97269 - RNA, 20 nt, Artificial Sequence
  MKO10097269_B_Lyplal1
  gRNA
ccucccuucagaggaguaua

SEQ ID NO: 97270 - RNA, 20 nt, Artificial Sequence
  MKO10097270_B_Lyplal1
  gRNA
uaaagcaucuguuguuuacc

SEQ ID NO: 97271 - RNA, 20 nt, Artificial Sequence
  MKO10097271_B_Lyrm1
  gRNA
aaugcaguccaaucucaauc

SEQ ID NO: 97272 - RNA, 20 nt, Artificial Sequence
  MKO10097272_B_Lyrm1
  gRNA
gugcaagccugaaaaugcuu

SEQ ID NO: 97273 - RNA, 20 nt, Artificial Sequence
  MKO10097273_B_Lyrm1
  gRNA
cggaaauggcaggcagcauc

SEQ ID NO: 97274 - RNA, 20 nt, Artificial Sequence
  MKO10097274_B_Lyrm2
  gRNA
cgcagcccugacgcugaagc

SEQ ID NO: 97275 - RNA, 20 nt, Artificial Sequence
  MKO10097275_B_Lyrm2
  gRNA
uucugaccgaaaauaccuuc

SEQ ID NO: 97276 - RNA, 20 nt, Artificial Sequence
  MKO10097276_B_Lyrm2
  gRNA
uuccaguuacgaguuggcua

SEQ ID NO: 97277 - RNA, 20 nt, Artificial Sequence
  MKO10097277_B_Lyrm4
  gRNA
ccugucugcggauuauuuca

SEQ ID NO: 97278 - RNA, 20 nt, Artificial Sequence
  MKO10097278_B_Lyrm4
  gRNA
gcuugucaguugaguauagu

SEQ ID NO: 97279 - RNA, 20 nt, Artificial Sequence
  MKO10097279_B_Lyrm4
  gRNA
gugcuggcuuccuauguccu

SEQ ID NO: 97280 - RNA, 20 nt, Artificial Sequence
  MKO10097280_B_Lyrm5
  gRNA
uuaaaauagucugcuccuuu

SEQ ID NO: 97281 - RNA, 20 nt, Artificial Sequence
  MKO10097281_B_Lyrm5
  gRNA
auuuguaaugaaggagcuag

SEQ ID NO: 97282 - RNA, 20 nt, Artificial Sequence
  MKO10097282_B_Lyrm5
  gRNA
ucauagcucuguauuuccua

SEQ ID NO: 97283 - RNA, 20 nt, Artificial Sequence
  MKO10097283_B_Lyrm7
  gRNA
agcucuuuaaaacacugcac

SEQ ID NO: 97284 - RNA, 20 nt, Artificial Sequence
  MKO10097284_B_Lyrm7
  gRNA
uucugugagaagaucuuucc

SEQ ID NO: 97285 - RNA, 20 nt, Artificial Sequence
  MKO10097285_B_Lyrm7
  gRNA
uucuucauuuaucuuuacuc

SEQ ID NO: 97286 - RNA, 20 nt, Artificial Sequence
  MKO10097286_B_Lyrm9
  gRNA
uacuuuguucaugauccagu

SEQ ID NO: 97287 - RNA, 20 nt, Artificial Sequence
  MKO10097287_B_Lyrm9
  gRNA
ucgcacauggccccucugcc

SEQ ID NO: 97288 - RNA, 20 nt, Artificial Sequence
  MKO10097288_B_Lyrm9
  gRNA
cagcaugcuuguagugcucc

SEQ ID NO: 97289 - RNA, 20 nt, Artificial Sequence
  MKO10097289_B_Lysmd1
  gRNA
ucuccccuuuccucagcuuc

SEQ ID NO: 97290 - RNA, 20 nt, Artificial Sequence
  MKO10097290_B_Lysmd1
  gRNA
gagcccagagacuuguuuaa

SEQ ID NO: 97291 - RNA, 20 nt, Artificial Sequence
  MKO10097291_B_Lysmd1
  gRNA
guuugaagauuucaucuucc

SEQ ID NO: 97292 - RNA, 20 nt, Artificial Sequence
  MKO10097292_B_Lysmd2
  gRNA
cugucgacaguuucacuuuc

SEQ ID NO: 97293 - RNA, 20 nt, Artificial Sequence
  MKO10097293_B_Lysmd2
  gRNA
ucacuaacuaugauaaagag

SEQ ID NO: 97294 - RNA, 20 nt, Artificial Sequence
  MKO10097294_B_Lysmd2
  gRNA
cgcgcucaaguacggaguca

SEQ ID NO: 97295 - RNA, 20 nt, Artificial Sequence
  MKO10097295_B_Lysmd3
  gRNA
augcugaagucuacgaacuu

SEQ ID NO: 97296 - RNA, 20 nt, Artificial Sequence
  MKO10097296_B_Lysmd3
  gRNA
ucggaccuguugugcuguua

SEQ ID NO: 97297 - RNA, 20 nt, Artificial Sequence
  MKO10097297_B_Lysmd3
  gRNA
gcuagaacgucauggcgggg

SEQ ID NO: 97298 - RNA, 20 nt, Artificial Sequence
  MKO10097298_B_Lysmd4
  gRNA
cauuguugaacauguaaacg

SEQ ID NO: 97299 - RNA, 20 nt, Artificial Sequence
  MKO10097299_B_Lysmd4
  gRNA
aaugcgcuuaggccccugcc

SEQ ID NO: 97300 - RNA, 20 nt, Artificial Sequence
  MKO10097300_B_Lysmd4
  gRNA
ccgacugugggauucagugg

SEQ ID NO: 97301 - RNA, 20 nt, Artificial Sequence
  MKO10097301_B_Lyst
  gRNA
cauguagauccaacgacaca

SEQ ID NO: 97302 - RNA, 20 nt, Artificial Sequence
  MKO10097302_B_Lyst
  gRNA
ugcccugcuucgaguagccc

SEQ ID NO: 97303 - RNA, 20 nt, Artificial Sequence
  MKO10097303_B_Lyst
  gRNA
cauucagcagauuugggccc

SEQ ID NO: 97304 - RNA, 20 nt, Artificial Sequence
  MKO10097304_B_Lyve1
  gRNA
cugacucaccggaugaguug

SEQ ID NO: 97305 - RNA, 20 nt, Artificial Sequence
  MKO10097305_B_Lyve1
  gRNA
cuuuggugcugccgcugugc

SEQ ID NO: 97306 - RNA, 20 nt, Artificial Sequence
  MKO10097306_B_Lyve1
  gRNA
gaauuucacagaagccaacg

SEQ ID NO: 97307 - RNA, 20 nt, Artificial Sequence
  MKO10097307_B_Lyz1
  gRNA
cugucuuucagcucugcugc

SEQ ID NO: 97308 - RNA, 20 nt, Artificial Sequence
  MKO10097308_B_Lyz1
  gRNA
cgagcuacaaacuacaaccg

SEQ ID NO: 97309 - RNA, 20 nt, Artificial Sequence
  MKO10097309_B_Lyz1
  gRNA
ccuaccaugcucgaaugccu

SEQ ID NO: 97310 - RNA, 20 nt, Artificial Sequence
  MKO10097310_B_Lyz2
  gRNA
auaucccauagucagugcuu

SEQ ID NO: 97311 - RNA, 20 nt, Artificial Sequence
  MKO10097311_B_Lyz2
  gRNA
uugucuuucagcucugcugc

SEQ ID NO: 97312 - RNA, 20 nt, Artificial Sequence
  MKO10097312_B_Lyz2
  gRNA
ccuaccaugcucgaaugccu

SEQ ID NO: 97313 - RNA, 20 nt, Artificial Sequence
  MKO10097313_B_Lyzl1
  gRNA
ucucggcuguaguguuguag

SEQ ID NO: 97314 - RNA, 20 nt, Artificial Sequence
  MKO10097314_B_Lyzl1
  gRNA
agaacaaagacaugucagag

SEQ ID NO: 97315 - RNA, 20 nt, Artificial Sequence
  MKO10097315_B_Lyzl1
  gRNA
cacagagaauggcaucugug

SEQ ID NO: 97316 - RNA, 20 nt, Artificial Sequence
  MKO10097316_B_Lyzl4
  gRNA
cauugucacgaaucugaaag

SEQ ID NO: 97317 - RNA, 20 nt, Artificial Sequence
  MKO10097317_B_Lyzl4
  gRNA
ugugccaagaaaaucgugaa

SEQ ID NO: 97318 - RNA, 20 nt, Artificial Sequence
  MKO10097318_B_Lyzl4
  gRNA
cugccagcugucugacguuc

SEQ ID NO: 97319 - RNA, 20 nt, Artificial Sequence
  MKO10097319_B_Lyzl6
  gRNA
cccgucauccaguaggagag

SEQ ID NO: 97320 - RNA, 20 nt, Artificial Sequence
  MKO10097320_B_Lyzl6
  gRNA
guccucuucauacagaaucu

SEQ ID NO: 97321 - RNA, 20 nt, Artificial Sequence
  MKO10097321_B_Lyzl6
  gRNA
ugugcaaaaaagauuguguc

SEQ ID NO: 97322 - RNA, 20 nt, Artificial Sequence
  MKO10097322_B_Lzic
  gRNA
ucgcugaagaagauuauguc

SEQ ID NO: 97323 - RNA, 20 nt, Artificial Sequence
  MKO10097323_B_Lzic
  gRNA
acuuugguagaugaacucag

SEQ ID NO: 97324 - RNA, 20 nt, Artificial Sequence
  MKO10097324_B_Lzic
  gRNA
gcugagcacagcacuugcau

SEQ ID NO: 97325 - RNA, 20 nt, Artificial Sequence
  MKO10097325_B_Lztfl1
  gRNA
auuuguaucuucaaguaaaa

SEQ ID NO: 97326 - RNA, 20 nt, Artificial Sequence
  MKO10097326_B_Lztfl1
  gRNA
aacgguagauuccugcuuuc

SEQ ID NO: 97327 - RNA, 20 nt, Artificial Sequence
  MKO10097327_B_Lztfl1
  gRNA
ggagacuuucaccauugaug

SEQ ID NO: 97328 - RNA, 20 nt, Artificial Sequence
  MKO10097328_B_Lztr1
  gRNA
gcgcagcaagcacacagucg

SEQ ID NO: 97329 - RNA, 20 nt, Artificial Sequence
  MKO10097329_B_Lztr1
  gRNA
ugucuuccagggggcuauac

SEQ ID NO: 97330 - RNA, 20 nt, Artificial Sequence
  MKO10097330_B_Lztr1
  gRNA
ccguuaccaccacucugcug

SEQ ID NO: 97331 - RNA, 20 nt, Artificial Sequence
  MKO10097331_B_Lzts1
  gRNA
gagagugcccugcgcaccaa

SEQ ID NO: 97332 - RNA, 20 nt, Artificial Sequence
  MKO10097332_B_Lzts1
  gRNA
gggcuguguagucugggcga

SEQ ID NO: 97333 - RNA, 20 nt, Artificial Sequence
  MKO10097333_B_Lzts1
  gRNA
aguaucgauugagcuucuug

SEQ ID NO: 97334 - RNA, 20 nt, Artificial Sequence
  MKO10097334_B_Lzts2
  gRNA
uccuuggggggucguguagc

SEQ ID NO: 97335 - RNA, 20 nt, Artificial Sequence
  MKO10097335_B_Lzts2
  gRNA
ccgcugcucccguucaaaag

SEQ ID NO: 97336 - RNA, 20 nt, Artificial Sequence
  MKO10097336_B_Lzts2
  gRNA
gcugcuaccggguggcuacg

SEQ ID NO: 97337 - RNA, 20 nt, Artificial Sequence
  MKO10097337_B_Lzts3
  gRNA
uagggccucgcuccgggaga

SEQ ID NO: 97338 - RNA, 20 nt, Artificial Sequence
  MKO10097338_B_Lzts3
  gRNA
acuuguccaguccgccuuug

SEQ ID NO: 97339 - RNA, 20 nt, Artificial Sequence
  MKO10097339_B_Lzts3
  gRNA
cccagauccccgccugacua

SEQ ID NO: 97340 - RNA, 20 nt, Artificial Sequence
  MKO10097340_B_M1ap
  gRNA
cauucgaagcuccgagaugc

SEQ ID NO: 97341 - RNA, 20 nt, Artificial Sequence
  MKO10097341_B_M1ap
  gRNA
auggugagucugaacgcucc

SEQ ID NO: 97342 - RNA, 20 nt, Artificial Sequence
  MKO10097342_B_M1ap
  gRNA
accucacgccuuacuacccc

SEQ ID NO: 97343 - RNA, 20 nt, Artificial Sequence
  MKO10097343_B_M6pr
  gRNA
agaccucuggugaacaggcc

SEQ ID NO: 97344 - RNA, 20 nt, Artificial Sequence
  MKO10097344_B_M6pr
  gRNA
aacgagacucacaucuucaa

SEQ ID NO: 97345 - RNA, 20 nt, Artificial Sequence
  MKO10097345_B_M6pr
  gRNA
ccugucuagauuugcaucau

SEQ ID NO: 97346 - RNA, 20 nt, Artificial Sequence
  MKO10097346_B_Maaus1
  gRNA
accgcuauaaguucuuugac

SEQ ID NO: 97347 - RNA, 20 nt, Artificial Sequence
  MKO10097347_B_Maaus1
  gRNA
gaugaagauccggauguuuc

SEQ ID NO: 97348 - RNA, 20 nt, Artificial Sequence
  MKO10097348_B_Maaus1
  gRNA
cacccugauucgaagcagac

SEQ ID NO: 97349 - RNA, 20 nt, Artificial Sequence
  MKO10097349_B_Mab21l1
  gRNA
aacccugcgugaucgccacc

SEQ ID NO: 97350 - RNA, 20 nt, Artificial Sequence
  MKO10097350_B_Mab21l1
  gRNA
acgaaucuugccugggcgau

SEQ ID NO: 97351 - RNA, 20 nt, Artificial Sequence
  MKO10097351_B_Mab21l1
  gRNA
acuccagguggcgaucacgc

SEQ ID NO: 97352 - RNA, 20 nt, Artificial Sequence
  MKO10097352_B_Mab21l2
  gRNA
gaugaucgccgacacuagug

SEQ ID NO: 97353 - RNA, 20 nt, Artificial Sequence
  MKO10097353_B_Mab21l2
  gRNA
gccgugcucaaacuaagcga

SEQ ID NO: 97354 - RNA, 20 nt, Artificial Sequence
  MKO10097354_B_Mab21l2
  gRNA
ucgucccaguccguuucccu

SEQ ID NO: 97355 - RNA, 20 nt, Artificial Sequence
  MKO10097355_B_Mab21l3
  gRNA
aguaccgccagcgcugccuc

SEQ ID NO: 97356 - RNA, 20 nt, Artificial Sequence
  MKO10097356_B_Mab21l3
  gRNA
aaccacagaaaucagccgcc

SEQ ID NO: 97357 - RNA, 20 nt, Artificial Sequence
  MKO10097357_B_Mab21l3
  gRNA
uggcccaguccgccuaucac

SEQ ID NO: 97358 - RNA, 20 nt, Artificial Sequence
  MKO10097358_B_Macc1
  gRNA
cuacuucgaccaauuucucg

SEQ ID NO: 97359 - RNA, 20 nt, Artificial Sequence
  MKO10097359_B_Macc1
  gRNA
auuggucgaaguagaucuga

SEQ ID NO: 97360 - RNA, 20 nt, Artificial Sequence
  MKO10097360_B_Macc1
  gRNA
acaagaucuucaaucagcuu

SEQ ID NO: 97361 - RNA, 20 nt, Artificial Sequence
  MKO10097361_B_Macf1
  gRNA
gcagaaugugcagaucgccc

SEQ ID NO: 97362 - RNA, 20 nt, Artificial Sequence
  MKO10097362_B_Macf1
  gRNA
agagaucauugaugugcuug

SEQ ID NO: 97363 - RNA, 20 nt, Artificial Sequence
  MKO10097363_B_Macf1
  gRNA
uucuuaccugccgcugcuuu

SEQ ID NO: 97364 - RNA, 20 nt, Artificial Sequence
  MKO10097364_B_Macrod1
  gRNA
ucacucaccagcguugacaa

SEQ ID NO: 97365 - RNA, 20 nt, Artificial Sequence
  MKO10097365_B_Macrod1
  gRNA
agcugaagaagauccccacg

SEQ ID NO: 97366 - RNA, 20 nt, Artificial Sequence
  MKO10097366_B_Macrod1
  gRNA
ugccccugcagccuuucuga

SEQ ID NO: 97367 - RNA, 20 nt, Artificial Sequence
  MKO10097367_B_Macrod2
  gRNA
cgagagagugaacuuccuga

SEQ ID NO: 97368 - RNA, 20 nt, Artificial Sequence
  MKO10097368_B_Macrod2
  gRNA
gagucuuucuugauucaaaa

SEQ ID NO: 97369 - RNA, 20 nt, Artificial Sequence
  MKO10097369_B_Macrod2
  gRNA
gaagaaaagcuugagugaaa

SEQ ID NO: 97370 - RNA, 20 nt, Artificial Sequence
  MKO10097370_B_Mad1l1
  gRNA
gccgcuugaccuguaccuuc

SEQ ID NO: 97371 - RNA, 20 nt, Artificial Sequence
  MKO10097371_B_Mad1l1
  gRNA
gagccacaagagagcccgag

SEQ ID NO: 97372 - RNA, 20 nt, Artificial Sequence
  MKO10097372_B_Mad1l1
  gRNA
cucagcucucucaucuugac

SEQ ID NO: 97373 - RNA, 20 nt, Artificial Sequence
  MKO10097373_B_Mad2l1bp
  gRNA
ggcuccauucgguguggacc

SEQ ID NO: 97374 - RNA, 20 nt, Artificial Sequence
  MKO10097374_B_Mad2l1bp
  gRNA
cuugggcaaaagggcuccgc

SEQ ID NO: 97375 - RNA, 20 nt, Artificial Sequence
  MKO10097375_B_Mad2l1bp
  gRNA
uucggacauauccuccucac

SEQ ID NO: 97376 - RNA, 20 nt, Artificial Sequence
  MKO10097376_B_Mad2l1
  gRNA
caagugcucaguucagaaac

SEQ ID NO: 97377 - RNA, 20 nt, Artificial Sequence
  MKO10097377_B_Mad2l1
  gRNA
auugagauacuuuaugagcu

SEQ ID NO: 97378 - RNA, 20 nt, Artificial Sequence
  MKO10097378_B_Mad2l1
  gRNA
auauuucugcacucuaguaa

SEQ ID NO: 97379 - RNA, 20 nt, Artificial Sequence
  MKO10097379_B_Mad2l2
  gRNA
caccuggaggguugugaucc

SEQ ID NO: 97380 - RNA, 20 nt, Artificial Sequence
  MKO10097380_B_Mad2l2
  gRNA
caucacacacacuaaucuua

SEQ ID NO: 97381 - RNA, 20 nt, Artificial Sequence
  MKO10097381_B_Mad2l2
  gRNA
ugacgcaguggagugugucc

SEQ ID NO: 97382 - RNA, 20 nt, Artificial Sequence
  MKO10097382_B_Madcam1
  gRNA
accgccagcguugugucauu

SEQ ID NO: 97383 - RNA, 20 nt, Artificial Sequence
  MKO10097383_B_Madcam1
  gRNA
cuggaagcuucgacucccgc

SEQ ID NO: 97384 - RNA, 20 nt, Artificial Sequence
  MKO10097384_B_Madcam1
  gRNA
cuggccgguagcauuuccac

SEQ ID NO: 97385 - RNA, 20 nt, Artificial Sequence
  MKO10097385_B_Madd
  gRNA
acgagauagucaaguaaccg

SEQ ID NO: 97386 - RNA, 20 nt, Artificial Sequence
  MKO10097386_B_Madd
  gRNA
cguggcaaugaucuaccccc

SEQ ID NO: 97387 - RNA, 20 nt, Artificial Sequence
  MKO10097387_B_Madd
  gRNA
acguagcaaccgauagaucc

SEQ ID NO: 97388 - RNA, 20 nt, Artificial Sequence
  MKO10097388_B_Maea
  gRNA
ggacuuguuaucauggcacc

SEQ ID NO: 97389 - RNA, 20 nt, Artificial Sequence
  MKO10097389_B_Maea
  gRNA
ucuguggucagccuauugga

SEQ ID NO: 97390 - RNA, 20 nt, Artificial Sequence
  MKO10097390_B_Maea
  gRNA
agagacuagccacgucacca

SEQ ID NO: 97391 - RNA, 20 nt, Artificial Sequence
  MKO10097391_B_Mael
  gRNA
cuguguuaaauacucccucc

SEQ ID NO: 97392 - RNA, 20 nt, Artificial Sequence
  MKO10097392_B_Mael
  gRNA
ucuccccaagcucuugaggg

SEQ ID NO: 97393 - RNA, 20 nt, Artificial Sequence
  MKO10097393_B_Mael
  gRNA
aacuuguaucuacaccacug

SEQ ID NO: 97394 - RNA, 20 nt, Artificial Sequence
  MKO10097394_B_Maf1
  gRNA
auccuuacccagcggaggcu

SEQ ID NO: 97395 - RNA, 20 nt, Artificial Sequence
  MKO10097395_B_Maf1
  gRNA
ugaaagcuacucguguaaga

SEQ ID NO: 97396 - RNA, 20 nt, Artificial Sequence
  MKO10097396_B_Maf1
  gRNA
agcuguucgugaagacuuca

SEQ ID NO: 97397 - RNA, 20 nt, Artificial Sequence
  MKO10097397_B_Mafa
  gRNA
aauacgagaaguuggcgggc

SEQ ID NO: 97398 - RNA, 20 nt, Artificial Sequence
  MKO10097398_B_Mafa
  gRNA
gggcaguguggugugcgccg

SEQ ID NO: 97399 - RNA, 20 nt, Artificial Sequence
  MKO10097399_B_Mafa
  gRNA
gguugagcgccucgggguuc

SEQ ID NO: 97400 - RNA, 20 nt, Artificial Sequence
  MKO10097400_B_Mafb
  gRNA
cgucucucucgcgggccagc

SEQ ID NO: 97401 - RNA, 20 nt, Artificial Sequence
  MKO10097401_B_Mafb
  gRNA
ugaaccgaagacccaucucg

SEQ ID NO: 97402 - RNA, 20 nt, Artificial Sequence
  MKO10097402_B_Mafb
  gRNA
gagcgccuccaccgcguccu

SEQ ID NO: 97403 - RNA, 20 nt, Artificial Sequence
  MKO10097403_B_Maff
  gRNA
cuuaucuagcaaagcccuga

SEQ ID NO: 97404 - RNA, 20 nt, Artificial Sequence
  MKO10097404_B_Maff
  gRNA
cggcaagugugaagcgcugc

SEQ ID NO: 97405 - RNA, 20 nt, Artificial Sequence
  MKO10097405_B_Maff
  gRNA
gcuggcgggcgccaccagug

SEQ ID NO: 97406 - RNA, 20 nt, Artificial Sequence
  MKO10097406_B_Mafg
  gRNA
uaaggccuuguuuccuuuau

SEQ ID NO: 97407 - RNA, 20 nt, Artificial Sequence
  MKO10097407_B_Mafg
  gRNA
cagcuccucgucggucaagc

SEQ ID NO: 97408 - RNA, 20 nt, Artificial Sequence
  MKO10097408_B_Mafg
  gRNA
cggccagcugccgcgucaag

SEQ ID NO: 97409 - RNA, 20 nt, Artificial Sequence
  MKO10097409_B_Mafk
  gRNA
ccuuaccuucaaugccuugu

SEQ ID NO: 97410 - RNA, 20 nt, Artificial Sequence
  MKO10097410_B_Mafk
  gRNA
uguucuuagcgaugaugagc

SEQ ID NO: 97411 - RNA, 20 nt, Artificial Sequence
  MKO10097411_B_Mafk
  gRNA
agcucaucaucgcuaagaac

SEQ ID NO: 97412 - RNA, 20 nt, Artificial Sequence
  MKO10097412_B_Maf
  gRNA
ggcgcgucugccucugcgag

SEQ ID NO: 97413 - RNA, 20 nt, Artificial Sequence
  MKO10097413_B_Maf
  gRNA
caccaccaccauccgacggc

SEQ ID NO: 97414 - RNA, 20 nt, Artificial Sequence
  MKO10097414_B_Maf
  gRNA
cgccggccgucggauggugg

SEQ ID NO: 97415 - RNA, 20 nt, Artificial Sequence
  MKO10097415_B_Magea10
  gRNA
ucaaguccucauaguccucc

SEQ ID NO: 97416 - RNA, 20 nt, Artificial Sequence
  MKO10097416_B_Magea10
  gRNA
ccagcuccuggaggacuaug

SEQ ID NO: 97417 - RNA, 20 nt, Artificial Sequence
  MKO10097417_B_Magea10
  gRNA
uuaucaucaugccuagaccc

SEQ ID NO: 97418 - RNA, 20 nt, Artificial Sequence
  MKO10097418_B_Magea1
  gRNA
caauacacuagaaugugagc

SEQ ID NO: 97419 - RNA, 20 nt, Artificial Sequence
  MKO10097419_B_Magea1
  gRNA
cagccuccaagagagugcuc

SEQ ID NO: 97420 - RNA, 20 nt, Artificial Sequence
  MKO10097420_B_Magea1
  gRNA
cacuaccaaagcagaaaugu

SEQ ID NO: 97421 - RNA, 20 nt, Artificial Sequence
  MKO10097421_B_Magea2
  gRNA
uaccugucuugggcauaccc

SEQ ID NO: 97422 - RNA, 20 nt, Artificial Sequence
  MKO10097422_B_Magea2
  gRNA
aaguauugguagagaguaug

SEQ ID NO: 97423 - RNA, 20 nt, Artificial Sequence
  MKO10097423_B_Magea2
  gRNA
aucagucaucaugccaucau

SEQ ID NO: 97424 - RNA, 20 nt, Artificial Sequence
  MKO10097424_B_Magea3
  gRNA
gcauugugcaacaaaugaag

SEQ ID NO: 97425 - RNA, 20 nt, Artificial Sequence
  MKO10097425_B_Magea3
  gRNA
cuuuacaagaugagauagac

SEQ ID NO: 97426 - RNA, 20 nt, Artificial Sequence
  MKO10097426_B_Magea3
  gRNA
auagcuagggggaucacuau

SEQ ID NO: 97427 - RNA, 20 nt, Artificial Sequence
  MKO10097427_B_Magea4
  gRNA
agagcuguagaacuaucugc

SEQ ID NO: 97428 - RNA, 20 nt, Artificial Sequence
  MKO10097428_B_Magea4
  gRNA
acuacuguacaccuucuuug

SEQ ID NO: 97429 - RNA, 20 nt, Artificial Sequence
  MKO10097429_B_Magea4
  gRNA
agcuuccaccaaccaaguag

SEQ ID NO: 97430 - RNA, 20 nt, Artificial Sequence
  MKO10097430_B_Magea5
  gRNA
acucccauacacuuuauuug

SEQ ID NO: 97431 - RNA, 20 nt, Artificial Sequence
  MKO10097431_B_Magea5
  gRNA
caaccuccaagagagugcuc

SEQ ID NO: 97432 - RNA, 20 nt, Artificial Sequence
  MKO10097432_B_Magea5
  gRNA
cacuacacuagaaugugagc

SEQ ID NO: 97433 - RNA, 20 nt, Artificial Sequence
  MKO10097433_B_Magea6
  gRNA
aauagugauccuccuaucua

SEQ ID NO: 97434 - RNA, 20 nt, Artificial Sequence
  MKO10097434_B_Magea6
  gRNA
augucagugaggagguuauc

SEQ ID NO: 97435 - RNA, 20 nt, Artificial Sequence
  MKO10097435_B_Magea6
  gRNA
accugggguuagaagggaaa

SEQ ID NO: 97436 - RNA, 20 nt, Artificial Sequence
  MKO10097436_B_Magea8
  gRNA
cuccuccugugaugucacca

SEQ ID NO: 97437 - RNA, 20 nt, Artificial Sequence
  MKO10097437_B_Magea8
  gRNA
cauugcaagaugagauagac

SEQ ID NO: 97438 - RNA, 20 nt, Artificial Sequence
  MKO10097438_B_Magea8
  gRNA
uccuaccaaagcagaaaugu

SEQ ID NO: 97439 - RNA, 20 nt, Artificial Sequence
  MKO10097439_B_Mageb16
  gRNA
uuacaugcuguacaaguauc

SEQ ID NO: 97440 - RNA, 20 nt, Artificial Sequence
  MKO10097440_B_Mageb16
  gRNA
aucauugcgcaucccaucau

SEQ ID NO: 97441 - RNA, 20 nt, Artificial Sequence
  MKO10097441_B_Mageb16
  gRNA
aaugacacucauugucagag

SEQ ID NO: 97442 - RNA, 20 nt, Artificial Sequence
  MKO10097442_B_Mageb18
  gRNA
uggaccccacgugaauucaa

SEQ ID NO: 97443 - RNA, 20 nt, Artificial Sequence
  MKO10097443_B_Mageb18
  gRNA
gcaccaguaaaacuacuuug

SEQ ID NO: 97444 - RNA, 20 nt, Artificial Sequence
  MKO10097444_B_Mageb18
  gRNA
cacaccguggcucuugaaua

SEQ ID NO: 97445 - RNA, 20 nt, Artificial Sequence
  MKO10097445_B_Mageb1
  gRNA
uugccagaccucuugcucag

SEQ ID NO: 97446 - RNA, 20 nt, Artificial Sequence
  MKO10097446_B_Mageb1
  gRNA
ccugauacaaaaaguucaga

SEQ ID NO: 97447 - RNA, 20 nt, Artificial Sequence
  MKO10097447_B_Mageb1
  gRNA
ccuucaugaagaucacaccu

SEQ ID NO: 97448 - RNA, 20 nt, Artificial Sequence
  MKO10097448_B_Mageb2
  gRNA
agaugaaagaagcaguuaca

SEQ ID NO: 97449 - RNA, 20 nt, Artificial Sequence
  MKO10097449_B_Mageb2
  gRNA
caaaacgacagcagucacgc

SEQ ID NO: 97450 - RNA, 20 nt, Artificial Sequence
  MKO10097450_B_Mageb2
  gRNA
uugccagaccucuugcucag

SEQ ID NO: 97451 - RNA, 20 nt, Artificial Sequence
  MKO10097451_B_Mageb3
  gRNA
caagaccaaagaccaauucu

SEQ ID NO: 97452 - RNA, 20 nt, Artificial Sequence
  MKO10097452_B_Mageb3
  gRNA
ugacuuuagcuaaaacuuuc

SEQ ID NO: 97453 - RNA, 20 nt, Artificial Sequence
  MKO10097453_B_Mageb3
  gRNA
gacccagcacucaggucaac

SEQ ID NO: 97454 - RNA, 20 nt, Artificial Sequence
  MKO10097454_B_Mageb4
  gRNA
cacagaaugaucuucuaaca

SEQ ID NO: 97455 - RNA, 20 nt, Artificial Sequence
  MKO10097455_B_Mageb4
  gRNA
ugagucuaaagucacacuug

SEQ ID NO: 97456 - RNA, 20 nt, Artificial Sequence
  MKO10097456_B_Mageb4
  gRNA
uggcuccucucacaaauaca

SEQ ID NO: 97457 - RNA, 20 nt, Artificial Sequence
  MKO10097457_B_Mageb5
  gRNA
ggcagggguuuaccaaaaac

SEQ ID NO: 97458 - RNA, 20 nt, Artificial Sequence
  MKO10097458_B_Mageb5
  gRNA
uaaauaaaaugcuuccuccc

SEQ ID NO: 97459 - RNA, 20 nt, Artificial Sequence
  MKO10097459_B_Mageb5
  gRNA
cguucauaaaaaucauagcc

SEQ ID NO: 97460 - RNA, 20 nt, Artificial Sequence
  MKO10097460_B_Maged1
  gRNA
caugcgcgcucaaugauuuc

SEQ ID NO: 97461 - RNA, 20 nt, Artificial Sequence
  MKO10097461_B_Maged1
  gRNA
cucucaggcacguaaugcca

SEQ ID NO: 97462 - RNA, 20 nt, Artificial Sequence
  MKO10097462_B_Maged1
  gRNA
acugguccuuucccuccgac

SEQ ID NO: 97463 - RNA, 20 nt, Artificial Sequence
  MKO10097463_B_Maged2
  gRNA
cagcugugguaccgauccaa

SEQ ID NO: 97464 - RNA, 20 nt, Artificial Sequence
  MKO10097464_B_Maged2
  gRNA
gacucuaccugagcgucuga

SEQ ID NO: 97465 - RNA, 20 nt, Artificial Sequence
  MKO10097465_B_Maged2
  gRNA
ccugaaaucauugaacgagc

SEQ ID NO: 97466 - RNA, 20 nt, Artificial Sequence
  MKO10097466_B_Magee1
  gRNA
agggcuauucgggcccuccg

SEQ ID NO: 97467 - RNA, 20 nt, Artificial Sequence
  MKO10097467_B_Magee1
  gRNA
ugguuucugcgcgggaucgu

SEQ ID NO: 97468 - RNA, 20 nt, Artificial Sequence
  MKO10097468_B_Magee1
  gRNA
acucucgaccgauguaauac

SEQ ID NO: 97469 - RNA, 20 nt, Artificial Sequence
  MKO10097469_B_Magee2
  gRNA
cgccgauuacagcaacagcc

SEQ ID NO: 97470 - RNA, 20 nt, Artificial Sequence
  MKO10097470_B_Magee2
  gRNA
cccugagcgcccccaaacgu

SEQ ID NO: 97471 - RNA, 20 nt, Artificial Sequence
  MKO10097471_B_Magee2
  gRNA
ggucucugcuagccguucag

SEQ ID NO: 97472 - RNA, 20 nt, Artificial Sequence
  MKO10097472_B_Mageh1
  gRNA
ggggcuacagaagccgccau

SEQ ID NO: 97473 - RNA, 20 nt, Artificial Sequence
  MKO10097473_B_Mageh1
  gRNA
ucgcaacaaucgcaagagcc

SEQ ID NO: 97474 - RNA, 20 nt, Artificial Sequence
  MKO10097474_B_Mageh1
  gRNA
cuagauuccacgugugcucg

SEQ ID NO: 97475 - RNA, 20 nt, Artificial Sequence
  MKO10097475_B_Magel2
  gRNA
gggcuccacucgaucacgua

SEQ ID NO: 97476 - RNA, 20 nt, Artificial Sequence
  MKO10097476_B_Magel2
  gRNA
ugcaguccauagccgcccua

SEQ ID NO: 97477 - RNA, 20 nt, Artificial Sequence
  MKO10097477_B_Magel2
  gRNA
ugcaccuucgauuacuccga

SEQ ID NO: 97478 - RNA, 20 nt, Artificial Sequence
  MKO10097478_B_Magi1
  gRNA
cauaguccacccggagaaug

SEQ ID NO: 97479 - RNA, 20 nt, Artificial Sequence
  MKO10097479_B_Magi1
  gRNA
ugcuguuuguucaggcaccg

SEQ ID NO: 97480 - RNA, 20 nt, Artificial Sequence
  MKO10097480_B_Magi1
  gRNA
gaaaugaacaguagcuuuac

SEQ ID NO: 97481 - RNA, 20 nt, Artificial Sequence
  MKO10097481_B_Magi2
  gRNA
uuggcuuuguaucguccauc

SEQ ID NO: 97482 - RNA, 20 nt, Artificial Sequence
  MKO10097482_B_Magi2
  gRNA
cucuucgggcuggcuguaca

SEQ ID NO: 97483 - RNA, 20 nt, Artificial Sequence
  MKO10097483_B_Magi2
  gRNA
cuucauaggucccgcuuucu

SEQ ID NO: 97484 - RNA, 20 nt, Artificial Sequence
  MKO10097484_B_Magi3
  gRNA
ccagcccgauccaguugauc

SEQ ID NO: 97485 - RNA, 20 nt, Artificial Sequence
  MKO10097485_B_Magi3
  gRNA
agcggagcauuguuagaaag

SEQ ID NO: 97486 - RNA, 20 nt, Artificial Sequence
  MKO10097486_B_Magi3
  gRNA
ucucuccuuaggcacuacaa

SEQ ID NO: 97487 - RNA, 20 nt, Artificial Sequence
  MKO10097487_B_Magix
  gRNA
aaacgaccacaucgcugugc

SEQ ID NO: 97488 - RNA, 20 nt, Artificial Sequence
  MKO10097488_B_Magix
  gRNA
gaccucgugcucuauaucaa

SEQ ID NO: 97489 - RNA, 20 nt, Artificial Sequence
  MKO10097489_B_Magix
  gRNA
gaugggccagcacagcgaug

SEQ ID NO: 97490 - RNA, 20 nt, Artificial Sequence
  MKO10097490_B_Magohb
  gRNA
guucuuccauuacacucuug

SEQ ID NO: 97491 - RNA, 20 nt, Artificial Sequence
  MKO10097491_B_Magohb
  gRNA
ccaaauaguaaaauacacga

SEQ ID NO: 97492 - RNA, 20 nt, Artificial Sequence
  MKO10097492_B_Magohb
  gRNA
ugacgugaugaucagaaaag

SEQ ID NO: 97493 - RNA, 20 nt, Artificial Sequence
  MKO10097493_B_Magoh
  gRNA
uaggagcuugaaauugucau

SEQ ID NO: 97494 - RNA, 20 nt, Artificial Sequence
  MKO10097494_B_Magoh
  gRNA
uggacugguugacaucaaua

SEQ ID NO: 97495 - RNA, 20 nt, Artificial Sequence
  MKO10097495_B_Magoh
  gRNA
acaaaaaugacgucaugauc

SEQ ID NO: 97496 - RNA, 20 nt, Artificial Sequence
  MKO10097496_B_Magu1
  gRNA
guaucugcgaagaagcaaua

SEQ ID NO: 97497 - RNA, 20 nt, Artificial Sequence
  MKO10097497_B_Magu1
  gRNA
uucaucaacuuuccuccgaa

SEQ ID NO: 97498 - RNA, 20 nt, Artificial Sequence
  MKO10097498_B_Magu1
  gRNA
acgacaacugaguaauuucu

SEQ ID NO: 97499 - RNA, 20 nt, Artificial Sequence
  MKO10097499_B_Mag
  gRNA
caacaccaccuugcaguucg

SEQ ID NO: 97500 - RNA, 20 nt, Artificial Sequence
  MKO10097500_B_Mag
  gRNA
cugacucucauagaugaccg

SEQ ID NO: 97501 - RNA, 20 nt, Artificial Sequence
  MKO10097501_B_Mag
  gRNA
gcauagacgccguccucucc

SEQ ID NO: 97502 - RNA, 20 nt, Artificial Sequence
  MKO10097502_B_Mak16
  gRNA
gcauccuagaaccaagacuc

SEQ ID NO: 97503 - RNA, 20 nt, Artificial Sequence
  MKO10097503_B_Mak16
  gRNA
cagguaaucuggaauacacu

SEQ ID NO: 97504 - RNA, 20 nt, Artificial Sequence
  MKO10097504_B_Mak16
  gRNA
uacauuugugucugauaaag

SEQ ID NO: 97505 - RNA, 20 nt, Artificial Sequence
  MKO10097505_B_Mak
  gRNA
ugucuuucauuagcugauag

SEQ ID NO: 97506 - RNA, 20 nt, Artificial Sequence
  MKO10097506_B_Mak
  gRNA
ucuaucagcuaaugaaagac

SEQ ID NO: 97507 - RNA, 20 nt, Artificial Sequence
  MKO10097507_B_Mak
  gRNA
ucagcaaucuucaccagcuc

SEQ ID NO: 97508 - RNA, 20 nt, Artificial Sequence
  MKO10097508_B_Mal2
  gRNA
cggccacguugauguuauac

SEQ ID NO: 97509 - RNA, 20 nt, Artificial Sequence
  MKO10097509_B_Mal2
  gRNA
uucaugacaacagcuuguua

SEQ ID NO: 97510 - RNA, 20 nt, Artificial Sequence
  MKO10097510_B_Mal2
  gRNA
aggugcuuggaggacuuguc

SEQ ID NO: 97511 - RNA, 20 nt, Artificial Sequence
  MKO10097511_B_Mall
  gRNA
aauagaugcugaaagcgugc

SEQ ID NO: 97512 - RNA, 20 nt, Artificial Sequence
  MKO10097512_B_Mall
  gRNA
ucuuccagguguucggguuc

SEQ ID NO: 97513 - RNA, 20 nt, Artificial Sequence
  MKO10097513_B_Mall
  gRNA
cuacaucaauguugcagccu

SEQ ID NO: 97514 - RNA, 20 nt, Artificial Sequence
  MKO10097514_B_Malsu1
  gRNA
cacccgacacuuacacgcua

SEQ ID NO: 97515 - RNA, 20 nt, Artificial Sequence
  MKO10097515_B_Malsu1
  gRNA
cagcauaucgaugucaaacu

SEQ ID NO: 97516 - RNA, 20 nt, Artificial Sequence
  MKO10097516_B_Malsu1
  gRNA
uuccccucgaucuugacaua

SEQ ID NO: 97517 - RNA, 20 nt, Artificial Sequence
  MKO10097517_B_Malt1
  gRNA
aaguggaacuguuguuaacc

SEQ ID NO: 97518 - RNA, 20 nt, Artificial Sequence
  MKO10097518_B_Malt1
  gRNA
agaacugagcgacuuccuac

SEQ ID NO: 97519 - RNA, 20 nt, Artificial Sequence
  MKO10097519_B_Malt1
  gRNA
aguuuguaaaacugugcugc

SEQ ID NO: 97520 - RNA, 20 nt, Artificial Sequence
  MKO10097520_B_Mal
  gRNA
cgcaggcauggcuccggcag

SEQ ID NO: 97521 - RNA, 20 nt, Artificial Sequence
  MKO10097521_B_Mal
  gRNA
gccaccaucucaauguuuga

SEQ ID NO: 97522 - RNA, 20 nt, Artificial Sequence
  MKO10097522_B_Mal
  gRNA
cugccacccgaagccgcugc

SEQ ID NO: 97523 - RNA, 20 nt, Artificial Sequence
  MKO10097523_B_Mamdc2
  gRNA
agagcuucgaucgcuugcuu

SEQ ID NO: 97524 - RNA, 20 nt, Artificial Sequence
  MKO10097524_B_Mamdc2
  gRNA
gcuggaaucccaaugugaac

SEQ ID NO: 97525 - RNA, 20 nt, Artificial Sequence
  MKO10097525_B_Mamdc2
  gRNA
ucacucaccaauacaguagc

SEQ ID NO: 97526 - RNA, 20 nt, Artificial Sequence
  MKO10097526_B_Mamdc4
  gRNA
gcguucuccugucaugcgug

SEQ ID NO: 97527 - RNA, 20 nt, Artificial Sequence
  MKO10097527_B_Mamdc4
  gRNA
uugccuagcgacugugcagc

SEQ ID NO: 97528 - RNA, 20 nt, Artificial Sequence
  MKO10097528_B_Mamdc4
  gRNA
cugccagcugcacagucgcu

SEQ ID NO: 97529 - RNA, 20 nt, Artificial Sequence
  MKO10097529_B_Maml1
  gRNA
ggaggcguucuggcccacgu

SEQ ID NO: 97530 - RNA, 20 nt, Artificial Sequence
  MKO10097530_B_Maml1
  gRNA
gugaacuguccaaccuguug

SEQ ID NO: 97531 - RNA, 20 nt, Artificial Sequence
  MKO10097531_B_Maml1
  gRNA
aguaggcuggguucccacac

SEQ ID NO: 97532 - RNA, 20 nt, Artificial Sequence
  MKO10097532_B_Maml2
  gRNA
gggugcccguauuucuucuu

SEQ ID NO: 97533 - RNA, 20 nt, Artificial Sequence
  MKO10097533_B_Maml2
  gRNA
ccaucaucugcugauucaac

SEQ ID NO: 97534 - RNA, 20 nt, Artificial Sequence
  MKO10097534_B_Maml2
  gRNA
ccuguugaaucagcagauga

SEQ ID NO: 97535 - RNA, 20 nt, Artificial Sequence
  MKO10097535_B_Maml3
  gRNA
cuuggcugaccggcuugcaa

SEQ ID NO: 97536 - RNA, 20 nt, Artificial Sequence
  MKO10097536_B_Maml3
  gRNA
gaccaugcugcccgaccccg

SEQ ID NO: 97537 - RNA, 20 nt, Artificial Sequence
  MKO10097537_B_Maml3
  gRNA
cagcaggucaaccaguuuca

SEQ ID NO: 97538 - RNA, 20 nt, Artificial Sequence
  MKO10097538_B_Mamld1
  gRNA
augucauccaguagcuuauc

SEQ ID NO: 97539 - RNA, 20 nt, Artificial Sequence
  MKO10097539_B_Mamld1
  gRNA
caggucaaacaauggaugac

SEQ ID NO: 97540 - RNA, 20 nt, Artificial Sequence
  MKO10097540_B_Mamld1
  gRNA
uguuuaggggucauugccau

SEQ ID NO: 97541 - RNA, 20 nt, Artificial Sequence
  MKO10097541_B_Mamstr
  gRNA
ggcucaggggacaagacgcc

SEQ ID NO: 97542 - RNA, 20 nt, Artificial Sequence
  MKO10097542_B_Mamstr
  gRNA
ugcagucuugauuccgucug

SEQ ID NO: 97543 - RNA, 20 nt, Artificial Sequence
  MKO10097543_B_Mamstr
  gRNA
accuucuuuggagcccucca

SEQ ID NO: 97544 - RNA, 20 nt, Artificial Sequence
  MKO10097544_B_Man1a2
  gRNA
uaccuuaccgaauauguuag

SEQ ID NO: 97545 - RNA, 20 nt, Artificial Sequence
  MKO10097545_B_Man1a2
  gRNA
augaacuaaggccuauugca

SEQ ID NO: 97546 - RNA, 20 nt, Artificial Sequence
  MKO10097546_B_Man1a2
  gRNA
gaaguuaacauucgcuuuau

SEQ ID NO: 97547 - RNA, 20 nt, Artificial Sequence
  MKO10097547_B_Man1a
  gRNA
aauuucaagaagcuaaaucg

SEQ ID NO: 97548 - RNA, 20 nt, Artificial Sequence
  MKO10097548_B_Man1a
  gRNA
cugucagccuacuauuuguc

SEQ ID NO: 97549 - RNA, 20 nt, Artificial Sequence
  MKO10097549_B_Man1a
  gRNA
ccugcauuucauacucccuc

SEQ ID NO: 97550 - RNA, 20 nt, Artificial Sequence
  MKO10097550_B_Man1b1
  gRNA
ugucuuaccagcgccucaga

SEQ ID NO: 97551 - RNA, 20 nt, Artificial Sequence
  MKO10097551_B_Man1b1
  gRNA
auuccuguacucucuucaua

SEQ ID NO: 97552 - RNA, 20 nt, Artificial Sequence
  MKO10097552_B_Man1b1
  gRNA
ugccaaaaccagagguuuga

SEQ ID NO: 97553 - RNA, 20 nt, Artificial Sequence
  MKO10097553_B_Man1c1
  gRNA
uuugaaguugaccacgcccu

SEQ ID NO: 97554 - RNA, 20 nt, Artificial Sequence
  MKO10097554_B_Man1c1
  gRNA
ucugacucaccacguucagg

SEQ ID NO: 97555 - RNA, 20 nt, Artificial Sequence
  MKO10097555_B_Man1c1
  gRNA
cccucagguguuccgaguga

SEQ ID NO: 97556 - RNA, 20 nt, Artificial Sequence
  MKO10097556_B_Man2a1
  gRNA
cucccuaguuuacuacagaa

SEQ ID NO: 97557 - RNA, 20 nt, Artificial Sequence
  MKO10097557_B_Man2a1
  gRNA
uauuauagauauuccgaaga

SEQ ID NO: 97558 - RNA, 20 nt, Artificial Sequence
  MKO10097558_B_Man2a1
  gRNA
ugcuuccaaacuccaccauc

SEQ ID NO: 97559 - RNA, 20 nt, Artificial Sequence
  MKO10097559_B_Man2a2
  gRNA
cugcccuaccauaccgccaa

SEQ ID NO: 97560 - RNA, 20 nt, Artificial Sequence
  MKO10097560_B_Man2a2
  gRNA
ccucacucccacaacgaucc

SEQ ID NO: 97561 - RNA, 20 nt, Artificial Sequence
  MKO10097561_B_Man2a2
  gRNA
aagucuccuucuucgccaag

SEQ ID NO: 97562 - RNA, 20 nt, Artificial Sequence
  MKO10097562_B_Man2b1
  gRNA
cacccgucgcuucaucuaug

SEQ ID NO: 97563 - RNA, 20 nt, Artificial Sequence
  MKO10097563_B_Man2b1
  gRNA
cuugauagucaaugcgccca

SEQ ID NO: 97564 - RNA, 20 nt, Artificial Sequence
  MKO10097564_B_Man2b1
  gRNA
acucacugccguaauaguau

SEQ ID NO: 97565 - RNA, 20 nt, Artificial Sequence
  MKO10097565_B_Man2b2
  gRNA
gucguugcugaugcaccgaa

SEQ ID NO: 97566 - RNA, 20 nt, Artificial Sequence
  MKO10097566_B_Man2b2
  gRNA
ggaaaucuucacucacguca

SEQ ID NO: 97567 - RNA, 20 nt, Artificial Sequence
  MKO10097567_B_Man2b2
  gRNA
cgccuggaguuuguucucgg

SEQ ID NO: 97568 - RNA, 20 nt, Artificial Sequence
  MKO10097568_B_Man2c1
  gRNA
ccagcuuccugacgcccgag

SEQ ID NO: 97569 - RNA, 20 nt, Artificial Sequence
  MKO10097569_B_Man2c1
  gRNA
guuccccaucacgccagaca

SEQ ID NO: 97570 - RNA, 20 nt, Artificial Sequence
  MKO10097570_B_Man2c1
  gRNA
ugcgagcaucagacccucgg

SEQ ID NO: 97571 - RNA, 20 nt, Artificial Sequence
  MKO10097571_B_Manbal
  gRNA
ccucuuguugguggaagcga

SEQ ID NO: 97572 - RNA, 20 nt, Artificial Sequence
  MKO10097572_B_Manbal
  gRNA
gaauggguacgaugauggcc

SEQ ID NO: 97573 - RNA, 20 nt, Artificial Sequence
  MKO10097573_B_Manbal
  gRNA
aggugagaagcccaggucgg

SEQ ID NO: 97574 - RNA, 20 nt, Artificial Sequence
  MKO10097574_B_Manba
  gRNA
cuguucaacaaugucaccau

SEQ ID NO: 97575 - RNA, 20 nt, Artificial Sequence
  MKO10097575_B_Manba
  gRNA
auccagaugagcaauguuau

SEQ ID NO: 97576 - RNA, 20 nt, Artificial Sequence
  MKO10097576_B_Manba
  gRNA
uuaaaauccccuuuaaucuc

SEQ ID NO: 97577 - RNA, 20 nt, Artificial Sequence
  MKO10097577_B_Maneal
  gRNA
guggcggccacgcggguaac

SEQ ID NO: 97578 - RNA, 20 nt, Artificial Sequence
  MKO10097578_B_Maneal
  gRNA
gaugucaucccggcccuugu

SEQ ID NO: 97579 - RNA, 20 nt, Artificial Sequence
  MKO10097579_B_Maneal
  gRNA
ugauguacuugauguugucg

SEQ ID NO: 97580 - RNA, 20 nt, Artificial Sequence
  MKO10097580_B_Manea
  gRNA
uagauacaagcauccgacca

SEQ ID NO: 97581 - RNA, 20 nt, Artificial Sequence
  MKO10097581_B_Manea
  gRNA
ccugauucaagggaugacaa

SEQ ID NO: 97582 - RNA, 20 nt, Artificial Sequence
  MKO10097582_B_Manea
  gRNA
ugaucaucucgauugcuaua

SEQ ID NO: 97583 - RNA, 20 nt, Artificial Sequence
  MKO10097583_B_Manf
  gRNA
uugcugcagugcuacuacau

SEQ ID NO: 97584 - RNA, 20 nt, Artificial Sequence
  MKO10097584_B_Manf
  gRNA
cgacaccucauugaugaucu

SEQ ID NO: 97585 - RNA, 20 nt, Artificial Sequence
  MKO10097585_B_Manf
  gRNA
ugagcgugcugccugacagc

SEQ ID NO: 97586 - RNA, 20 nt, Artificial Sequence
  MKO10097586_B_Mansc1
  gRNA
auccaaucgucgcuuucaaa

SEQ ID NO: 97587 - RNA, 20 nt, Artificial Sequence
  MKO10097587_B_Mansc1
  gRNA
auuugaugaucuuugacacc

SEQ ID NO: 97588 - RNA, 20 nt, Artificial Sequence
  MKO10097588_B_Mansc1
  gRNA
ccucgcugggacagaaaaac

SEQ ID NO: 97589 - RNA, 20 nt, Artificial Sequence
  MKO10097589_B_Mansc4
  gRNA
cgcucucaccauccuuccgg

SEQ ID NO: 97590 - RNA, 20 nt, Artificial Sequence
  MKO10097590_B_Mansc4
  gRNA
gaaggcaguugacauugucg

SEQ ID NO: 97591 - RNA, 20 nt, Artificial Sequence
  MKO10097591_B_Mansc4
  gRNA
auacuguauaacauaacagc

SEQ ID NO: 97592 - RNA, 20 nt, Artificial Sequence
  MKO10097592_B_Maoa
  gRNA
gggaaaacuuacccauuccg

SEQ ID NO: 97593 - RNA, 20 nt, Artificial Sequence
  MKO10097593_B_Maoa
  gRNA
agaucccuguugaugcacca

SEQ ID NO: 97594 - RNA, 20 nt, Artificial Sequence
  MKO10097594_B_Maoa
  gRNA
cuggaagcccgggauagagu

SEQ ID NO: 97595 - RNA, 20 nt, Artificial Sequence
  MKO10097595_B_Maob
  gRNA
accuagauaauaacaaccuc

SEQ ID NO: 97596 - RNA, 20 nt, Artificial Sequence
  MKO10097596_B_Maob
  gRNA
gaggcaggacuuacacaauu

SEQ ID NO: 97597 - RNA, 20 nt, Artificial Sequence
  MKO10097597_B_Maob
  gRNA
aauugcuagauaagaucugc

SEQ ID NO: 97598 - RNA, 20 nt, Artificial Sequence
  MKO10097598_B_Map10
  gRNA
gccgcugcucgucuucccgc

SEQ ID NO: 97599 - RNA, 20 nt, Artificial Sequence
  MKO10097599_B_Map10
  gRNA
gccggcgggaagacgagcag

SEQ ID NO: 97600 - RNA, 20 nt, Artificial Sequence
  MKO10097600_B_Map10
  gRNA
caucagcuucgggcgcggca

SEQ ID NO: 97601 - RNA, 20 nt, Artificial Sequence
  MKO10097601_B_Map1a
  gRNA
agucaccuccguaucaugag

SEQ ID NO: 97602 - RNA, 20 nt, Artificial Sequence
  MKO10097602_B_Map1a
  gRNA
ccugaagguucuccccccau

SEQ ID NO: 97603 - RNA, 20 nt, Artificial Sequence
  MKO10097603_B_Map1a
  gRNA
acagcagcaacugaacgucc

SEQ ID NO: 97604 - RNA, 20 nt, Artificial Sequence
  MKO10097604_B_Map1b
  gRNA
ucagguuugugucccacgau

SEQ ID NO: 97605 - RNA, 20 nt, Artificial Sequence
  MKO10097605_B_Map1b
  gRNA
ccuccacagggauccgaucg

SEQ ID NO: 97606 - RNA, 20 nt, Artificial Sequence
  MKO10097606_B_Map1b
  gRNA
cuguuucuaagacgucacuu

SEQ ID NO: 97607 - RNA, 20 nt, Artificial Sequence
  MKO10097607_B_Map1lc3a
  gRNA
ggugaucaucgagcgcuaca

SEQ ID NO: 97608 - RNA, 20 nt, Artificial Sequence
  MKO10097608_B_Map1lc3a
  gRNA
gagacucaccgggaucuuac

SEQ ID NO: 97609 - RNA, 20 nt, Artificial Sequence
  MKO10097609_B_Map1lc3a
  gRNA
ccauguuaacaugagcgagu

SEQ ID NO: 97610 - RNA, 20 nt, Artificial Sequence
  MKO10097610_B_Map1lc3b
  gRNA
aaagcuccggcgcugcuuga

SEQ ID NO: 97611 - RNA, 20 nt, Artificial Sequence
  MKO10097611_B_Map1lc3b
  gRNA
agaagaccuucaagcagcgc

SEQ ID NO: 97612 - RNA, 20 nt, Artificial Sequence
  MKO10097612_B_Map1lc3b
  gRNA
ugagcucgcucauguucacg

SEQ ID NO: 97613 - RNA, 20 nt, Artificial Sequence
  MKO10097613_B_Map1s
  gRNA
ugccugcagguguucgcucc

SEQ ID NO: 97614 - RNA, 20 nt, Artificial Sequence
  MKO10097614_B_Map1s
  gRNA
cagcggagccugcaccaccg

SEQ ID NO: 97615 - RNA, 20 nt, Artificial Sequence
  MKO10097615_B_Map1s
  gRNA
cgggguccaucaggagguuc

SEQ ID NO: 97616 - RNA, 20 nt, Artificial Sequence
  MKO10097616_B_Map2k1
  gRNA
caacgguggaguggucuuca

SEQ ID NO: 97617 - RNA, 20 nt, Artificial Sequence
  MKO10097617_B_Map2k1
  gRNA
ucggggcaggaccaaccugg

SEQ ID NO: 97618 - RNA, 20 nt, Artificial Sequence
  MKO10097618_B_Map2k1
  gRNA
uaaaaggccugaccuaucuu

SEQ ID NO: 97619 - RNA, 20 nt, Artificial Sequence
  MKO10097619_B_Map2k2
  gRNA
uggucaccaaggcccggcau

SEQ ID NO: 97620 - RNA, 20 nt, Artificial Sequence
  MKO10097620_B_Map2k2
  gRNA
gcuuaccucugugcaugauc

SEQ ID NO: 97621 - RNA, 20 nt, Artificial Sequence
  MKO10097621_B_Map2k2
  gRNA
gcuucucucggagguaggcc

SEQ ID NO: 97622 - RNA, 20 nt, Artificial Sequence
  MKO10097622_B_Map2k3
  gRNA
ugcucagagugguaccauca

SEQ ID NO: 97623 - RNA, 20 nt, Artificial Sequence
  MKO10097623_B_Map2k3
  gRNA
gccucuuaagaacuucgaag

SEQ ID NO: 97624 - RNA, 20 nt, Artificial Sequence
  MKO10097624_B_Map2k3
  gRNA
ccgugcgcauguugaugucu

SEQ ID NO: 97625 - RNA, 20 nt, Artificial Sequence
  MKO10097625_B_Map2k4
  gRNA
uguguuagaugacguuauuc

SEQ ID NO: 97626 - RNA, 20 nt, Artificial Sequence
  MKO10097626_B_Map2k4
  gRNA
ccagagaauucggucaacug

SEQ ID NO: 97627 - RNA, 20 nt, Artificial Sequence
  MKO10097627_B_Map2k4
  gRNA
acugccauuaucugcccacu

SEQ ID NO: 97628 - RNA, 20 nt, Artificial Sequence
  MKO10097628_B_Map2k5
  gRNA
ccgcugcagauauuuccaag

SEQ ID NO: 97629 - RNA, 20 nt, Artificial Sequence
  MKO10097629_B_Map2k5
  gRNA
uguuuaggaugugauaggcc

SEQ ID NO: 97630 - RNA, 20 nt, Artificial Sequence
  MKO10097630_B_Map2k5
  gRNA
ccucuuggaaauaucugcag

SEQ ID NO: 97631 - RNA, 20 nt, Artificial Sequence
  MKO10097631_B_Map2k6
  gRNA
acgggccacaguuaauagcc

SEQ ID NO: 97632 - RNA, 20 nt, Artificial Sequence
  MKO10097632_B_Map2k6
  gRNA
agcugggacgaggugcguac

SEQ ID NO: 97633 - RNA, 20 nt, Artificial Sequence
  MKO10097633_B_Map2k6
  gRNA
gccucgggauuuagacucca

SEQ ID NO: 97634 - RNA, 20 nt, Artificial Sequence
  MKO10097634_B_Map2k7
  gRNA
gaagauggcggcguccuccc

SEQ ID NO: 97635 - RNA, 20 nt, Artificial Sequence
  MKO10097635_B_Map2k7
  gRNA
agaaccgugaggcccgcagg

SEQ ID NO: 97636 - RNA, 20 nt, Artificial Sequence
  MKO10097636_B_Map2k7
  gRNA
ucaggcagaaaucaaugacu

SEQ ID NO: 97637 - RNA, 20 nt, Artificial Sequence
  MKO10097637_B_Map2
  gRNA
guuuguucugaggcuggcga

SEQ ID NO: 97638 - RNA, 20 nt, Artificial Sequence
  MKO10097638_B_Map2
  gRNA
gaagcuguagcaguccugaa

SEQ ID NO: 97639 - RNA, 20 nt, Artificial Sequence
  MKO10097639_B_Map2
  gRNA
aacagcagcaaguggugacu

SEQ ID NO: 97640 - RNA, 20 nt, Artificial Sequence
  MKO10097640_B_Map3k10
  gRNA
ggagcuauugcgggcugcac

SEQ ID NO: 97641 - RNA, 20 nt, Artificial Sequence
  MKO10097641_B_Map3k10
  gRNA
gaaccacaaccucgcugaca

SEQ ID NO: 97642 - RNA, 20 nt, Artificial Sequence
  MKO10097642_B_Map3k10
  gRNA
gcccaggguccgaaaacgca

SEQ ID NO: 97643 - RNA, 20 nt, Artificial Sequence
  MKO10097643_B_Map3k11
  gRNA
uuccaugucgucacccucga

SEQ ID NO: 97644 - RNA, 20 nt, Artificial Sequence
  MKO10097644_B_Map3k11
  gRNA
cggcaagacagucgaugcca

SEQ ID NO: 97645 - RNA, 20 nt, Artificial Sequence
  MKO10097645_B_Map3k11
  gRNA
aggugcccgcagcacucauc

SEQ ID NO: 97646 - RNA, 20 nt, Artificial Sequence
  MKO10097646_B_Map3k12
  gRNA
ccucaaaggggacuucccaa

SEQ ID NO: 97647 - RNA, 20 nt, Artificial Sequence
  MKO10097647_B_Map3k12
  gRNA
ccuuugggaaguccccuuug

SEQ ID NO: 97648 - RNA, 20 nt, Artificial Sequence
  MKO10097648_B_Map3k12
  gRNA
ugaggaaucuacaucuuugu

SEQ ID NO: 97649 - RNA, 20 nt, Artificial Sequence
  MKO10097649_B_Map3k13
  gRNA
uuugaauccauccgggcaag

SEQ ID NO: 97650 - RNA, 20 nt, Artificial Sequence
  MKO10097650_B_Map3k13
  gRNA
cucuggugccauccacgcga

SEQ ID NO: 97651 - RNA, 20 nt, Artificial Sequence
  MKO10097651_B_Map3k13
  gRNA
gcugccgacaccccaaauga

SEQ ID NO: 97652 - RNA, 20 nt, Artificial Sequence
  MKO10097652_B_Map3k14
  gRNA
ucucgauacucauaauccac

SEQ ID NO: 97653 - RNA, 20 nt, Artificial Sequence
  MKO10097653_B_Map3k14
  gRNA
gaugaaaaugcgcucugaga

SEQ ID NO: 97654 - RNA, 20 nt, Artificial Sequence
  MKO10097654_B_Map3k14
  gRNA
gagcuguaccaucccaguac

SEQ ID NO: 97655 - RNA, 20 nt, Artificial Sequence
  MKO10097655_B_Map3k15
  gRNA
cuuucgccaguucaucaccu

SEQ ID NO: 97656 - RNA, 20 nt, Artificial Sequence
  MKO10097656_B_Map3k15
  gRNA
uagccaugucaaaacucucu

SEQ ID NO: 97657 - RNA, 20 nt, Artificial Sequence
  MKO10097657_B_Map3k15
  gRNA
gauaucacucauguccacaa

SEQ ID NO: 97658 - RNA, 20 nt, Artificial Sequence
  MKO10097658_B_Map3k19
  gRNA
gauuauugugacguuuccac

SEQ ID NO: 97659 - RNA, 20 nt, Artificial Sequence
  MKO10097659_B_Map3k19
  gRNA
ccuucccuagccaauaugaa

SEQ ID NO: 97660 - RNA, 20 nt, Artificial Sequence
  MKO10097660_B_Map3k19
  gRNA
acugcuugacaucugucaug

SEQ ID NO: 97661 - RNA, 20 nt, Artificial Sequence
  MKO10097661_B_Map3k1
  gRNA
ugcccgccuggaagcacgag

SEQ ID NO: 97662 - RNA, 20 nt, Artificial Sequence
  MKO10097662_B_Map3k1
  gRNA
cucucaucacuuuguucacg

SEQ ID NO: 97663 - RNA, 20 nt, Artificial Sequence
  MKO10097663_B_Map3k1
  gRNA
aaugauccgggagaagcuca

SEQ ID NO: 97664 - RNA, 20 nt, Artificial Sequence
  MKO10097664_B_Map3k2
  gRNA
cgagucaaauuugaacauag

SEQ ID NO: 97665 - RNA, 20 nt, Artificial Sequence
  MKO10097665_B_Map3k2
  gRNA
cuguccuucauaaggccagu

SEQ ID NO: 97666 - RNA, 20 nt, Artificial Sequence
  MKO10097666_B_Map3k2
  gRNA
guuaacuacccaagaugacu

SEQ ID NO: 97667 - RNA, 20 nt, Artificial Sequence
  MKO10097667_B_Map3k3
  gRNA
auacgaagauguggagcaca

SEQ ID NO: 97668 - RNA, 20 nt, Artificial Sequence
  MKO10097668_B_Map3k3
  gRNA
agaaucaaguuugaacacaa

SEQ ID NO: 97669 - RNA, 20 nt, Artificial Sequence
  MKO10097669_B_Map3k3
  gRNA
gcucaaguaugaaaagccuu

SEQ ID NO: 97670 - RNA, 20 nt, Artificial Sequence
  MKO10097670_B_Map3k4
  gRNA
gacaggcguuucaucugucg

SEQ ID NO: 97671 - RNA, 20 nt, Artificial Sequence
  MKO10097671_B_Map3k4
  gRNA
acucguggaucacguucagc

SEQ ID NO: 97672 - RNA, 20 nt, Artificial Sequence
  MKO10097672_B_Map3k4
  gRNA
gcuagugcgagaguguaaag

SEQ ID NO: 97673 - RNA, 20 nt, Artificial Sequence
  MKO10097673_B_Map3k5
  gRNA
uuuccugauaucgcugagua

SEQ ID NO: 97674 - RNA, 20 nt, Artificial Sequence
  MKO10097674_B_Map3k5
  gRNA
aauccauacucagcgauauc

SEQ ID NO: 97675 - RNA, 20 nt, Artificial Sequence
  MKO10097675_B_Map3k5
  gRNA
cggggguuaccuucagggac

SEQ ID NO: 97676 - RNA, 20 nt, Artificial Sequence
  MKO10097676_B_Map3k6
  gRNA
ugaagcucucacgcacgccg

SEQ ID NO: 97677 - RNA, 20 nt, Artificial Sequence
  MKO10097677_B_Map3k6
  gRNA
gggccggcuuguccgucugu

SEQ ID NO: 97678 - RNA, 20 nt, Artificial Sequence
  MKO10097678_B_Map3k6
  gRNA
guccacagauguaguggugc

SEQ ID NO: 97679 - RNA, 20 nt, Artificial Sequence
  MKO10097679_B_Map3k7cl
  gRNA
uuuagccucaaugaugcccc

SEQ ID NO: 97680 - RNA, 20 nt, Artificial Sequence
  MKO10097680_B_Map3k7cl
  gRNA
gucucaguguguagagcaac

SEQ ID NO: 97681 - RNA, 20 nt, Artificial Sequence
  MKO10097681_B_Map3k7cl
  gRNA
ggagaaccggacgcugaaga

SEQ ID NO: 97682 - RNA, 20 nt, Artificial Sequence
  MKO10097682_B_Map3k7
  gRNA
gaguaguuugcaaagcuaag

SEQ ID NO: 97683 - RNA, 20 nt, Artificial Sequence
  MKO10097683_B_Map3k7
  gRNA
uuaacucagguugucggaag

SEQ ID NO: 97684 - RNA, 20 nt, Artificial Sequence
  MKO10097684_B_Map3k7
  gRNA
gaggggggcucauuguauaa

SEQ ID NO: 97685 - RNA, 20 nt, Artificial Sequence
  MKO10097685_B_Map3k8
  gRNA
cucugguuucguuccucggg

SEQ ID NO: 97686 - RNA, 20 nt, Artificial Sequence
  MKO10097686_B_Map3k8
  gRNA
gccuggauuuccacauccga

SEQ ID NO: 97687 - RNA, 20 nt, Artificial Sequence
  MKO10097687_B_Map3k8
  gRNA
uuguggaauggccccgacau

SEQ ID NO: 97688 - RNA, 20 nt, Artificial Sequence
  MKO10097688_B_Map3k9
  gRNA
cccaucuuucacgaguaucc

SEQ ID NO: 97689 - RNA, 20 nt, Artificial Sequence
  MKO10097689_B_Map3k9
  gRNA
agcucgucacgacccugaug

SEQ ID NO: 97690 - RNA, 20 nt, Artificial Sequence
  MKO10097690_B_Map3k9
  gRNA
ccggaccaccaagaugagug

SEQ ID NO: 97691 - RNA, 20 nt, Artificial Sequence
  MKO10097691_B_Map4k1
  gRNA
ucuaaccuugguagaugucc

SEQ ID NO: 97692 - RNA, 20 nt, Artificial Sequence
  MKO10097692_B_Map4k1
  gRNA
uccagaucagcuaugugugc

SEQ ID NO: 97693 - RNA, 20 nt, Artificial Sequence
  MKO10097693_B_Map4k1
  gRNA
uucucaccugaagcacuucc

SEQ ID NO: 97694 - RNA, 20 nt, Artificial Sequence
  MKO10097694_B_Map4k2
  gRNA
augccgccaccccaaugucg

SEQ ID NO: 97695 - RNA, 20 nt, Artificial Sequence
  MKO10097695_B_Map4k2
  gRNA
ggcagauugccuauguuugc

SEQ ID NO: 97696 - RNA, 20 nt, Artificial Sequence
  MKO10097696_B_Map4k2
  gRNA
ccugagguagcugccgaugu

SEQ ID NO: 97697 - RNA, 20 nt, Artificial Sequence
  MKO10097697_B_Map4k3
  gRNA
uguuagcagagaaacucuac

SEQ ID NO: 97698 - RNA, 20 nt, Artificial Sequence
  MKO10097698_B_Map4k3
  gRNA
ccaaaauaagcaacaauguu

SEQ ID NO: 97699 - RNA, 20 nt, Artificial Sequence
  MKO10097699_B_Map4k3
  gRNA
ccaaacauuguugcuuauuu

SEQ ID NO: 97700 - RNA, 20 nt, Artificial Sequence
  MKO10097700_B_Map4k4
  gRNA
aaugaaagcaccauaguacg

SEQ ID NO: 97701 - RNA, 20 nt, Artificial Sequence
  MKO10097701_B_Map4k4
  gRNA
ccuuacccugaggauuuccc

SEQ ID NO: 97702 - RNA, 20 nt, Artificial Sequence
  MKO10097702_B_Map4k4
  gRNA
gaccuugugaagaacaccaa

SEQ ID NO: 97703 - RNA, 20 nt, Artificial Sequence
  MKO10097703_B_Map4k5
  gRNA
ucacuucaagauaucuauca

SEQ ID NO: 97704 - RNA, 20 nt, Artificial Sequence
  MKO10097704_B_Map4k5
  gRNA
uaggccagaaauguacauac

SEQ ID NO: 97705 - RNA, 20 nt, Artificial Sequence
  MKO10097705_B_Map4k5
  gRNA
uaaggucucucugcagacgu

SEQ ID NO: 97706 - RNA, 20 nt, Artificial Sequence
  MKO10097706_B_Map4
  gRNA
uucuggcugcucugauaauc

SEQ ID NO: 97707 - RNA, 20 nt, Artificial Sequence
  MKO10097707_B_Map4
  gRNA
gcaaguguuagauacugacc

SEQ ID NO: 97708 - RNA, 20 nt, Artificial Sequence
  MKO10097708_B_Map4
  gRNA
auggaggggaauaacacugc

SEQ ID NO: 97709 - RNA, 20 nt, Artificial Sequence
  MKO10097709_B_Map6d1
  gRNA
gcuucacuccaguccaagcu

SEQ ID NO: 97710 - RNA, 20 nt, Artificial Sequence
  MKO10097710_B_Map6d1
  gRNA
ggugugaauuuccucaccuc

SEQ ID NO: 97711 - RNA, 20 nt, Artificial Sequence
  MKO10097711_B_Map6d1
  gRNA
ggucacacauugagagucug

SEQ ID NO: 97712 - RNA, 20 nt, Artificial Sequence
  MKO10097712_B_Map6
  gRNA
accuucgggcauuccuugaa

SEQ ID NO: 97713 - RNA, 20 nt, Artificial Sequence
  MKO10097713_B_Map6
  gRNA
uggggguuuauggcucguug

SEQ ID NO: 97714 - RNA, 20 nt, Artificial Sequence
  MKO10097714_B_Map6
  gRNA
ugcuaccaaacccgacgaca

SEQ ID NO: 97715 - RNA, 20 nt, Artificial Sequence
  MKO10097715_B_Map7d1
  gRNA
ucccaccuuagcggccaaga

SEQ ID NO: 97716 - RNA, 20 nt, Artificial Sequence
  MKO10097716_B_Map7d1
  gRNA
ccaagagccaagaccgucuc

SEQ ID NO: 97717 - RNA, 20 nt, Artificial Sequence
  MKO10097717_B_Map7d1
  gRNA
accaaggcugacaucggugu

SEQ ID NO: 97718 - RNA, 20 nt, Artificial Sequence
  MKO10097718_B_Map7d2
  gRNA
cccucuucugauccucccgu

SEQ ID NO: 97719 - RNA, 20 nt, Artificial Sequence
  MKO10097719_B_Map7d2
  gRNA
gugcugguugcuaaaguuag

SEQ ID NO: 97720 - RNA, 20 nt, Artificial Sequence
  MKO10097720_B_Map7d2
  gRNA
aacuugaggagcagcgccaa

SEQ ID NO: 97721 - RNA, 20 nt, Artificial Sequence
  MKO10097721_B_Map7
  gRNA
aagcugcacgagaaaccguc

SEQ ID NO: 97722 - RNA, 20 nt, Artificial Sequence
  MKO10097722_B_Map7
  gRNA
uccgcuccuccuucagccgu

SEQ ID NO: 97723 - RNA, 20 nt, Artificial Sequence
  MKO10097723_B_Map7
  gRNA
gccaugaagcuguuguccga

SEQ ID NO: 97724 - RNA, 20 nt, Artificial Sequence
  MKO10097724_B_Map9
  gRNA
guauucggaacuucucugcc

SEQ ID NO: 97725 - RNA, 20 nt, Artificial Sequence
  MKO10097725_B_Map9
  gRNA
gccuucgcugcccggagugc

SEQ ID NO: 97726 - RNA, 20 nt, Artificial Sequence
  MKO10097726_B_Map9
  gRNA
gacuuugacagugacgagau

SEQ ID NO: 97727 - RNA, 20 nt, Artificial Sequence
  MKO10097727_B_Mapk10
  gRNA
cuacugcagugaaccaaccu

SEQ ID NO: 97728 - RNA, 20 nt, Artificial Sequence
  MKO10097728_B_Mapk10
  gRNA
uaugguucacacacuucaug

SEQ ID NO: 97729 - RNA, 20 nt, Artificial Sequence
  MKO10097729_B_Mapk10
  gRNA
cacugcaguaguauaagaaa

SEQ ID NO: 97730 - RNA, 20 nt, Artificial Sequence
  MKO10097730_B_Mapk11
  gRNA
cgcccaucagggucgucacg

SEQ ID NO: 97731 - RNA, 20 nt, Artificial Sequence
  MKO10097731_B_Mapk11
  gRNA
cacgccggccacauccaucg

SEQ ID NO: 97732 - RNA, 20 nt, Artificial Sequence
  MKO10097732_B_Mapk11
  gRNA
auugaacaugcucaucgcuc

SEQ ID NO: 97733 - RNA, 20 nt, Artificial Sequence
  MKO10097733_B_Mapk12
  gRNA
cuaccuggugaugccauuca

SEQ ID NO: 97734 - RNA, 20 nt, Artificial Sequence
  MKO10097734_B_Mapk12
  gRNA
ucucguggcgcauguguuug

SEQ ID NO: 97735 - RNA, 20 nt, Artificial Sequence
  MKO10097735_B_Mapk12
  gRNA
guucacaccugaugagucuc

SEQ ID NO: 97736 - RNA, 20 nt, Artificial Sequence
  MKO10097736_B_Mapk13
  gRNA
acaaaucauggaagcuccga

SEQ ID NO: 97737 - RNA, 20 nt, Artificial Sequence
  MKO10097737_B_Mapk13
  gRNA
gauggaauucagcgaggaua

SEQ ID NO: 97738 - RNA, 20 nt, Artificial Sequence
  MKO10097738_B_Mapk13
  gRNA
cacccuguggacgaugccag

SEQ ID NO: 97739 - RNA, 20 nt, Artificial Sequence
  MKO10097739_B_Mapk14
  gRNA
gaauuccuccagugaccuug

SEQ ID NO: 97740 - RNA, 20 nt, Artificial Sequence
  MKO10097740_B_Mapk14
  gRNA
cccccaugagaugggucacc

SEQ ID NO: 97741 - RNA, 20 nt, Artificial Sequence
  MKO10097741_B_Mapk14
  gRNA
cucaucuaccagauccuccg

SEQ ID NO: 97742 - RNA, 20 nt, Artificial Sequence
  MKO10097742_B_Mapk15
  gRNA
ccgugagauuaugcuucuca

SEQ ID NO: 97743 - RNA, 20 nt, Artificial Sequence
  MKO10097743_B_Mapk15
  gRNA
auaucccugucauucuucgc

SEQ ID NO: 97744 - RNA, 20 nt, Artificial Sequence
  MKO10097744_B_Mapk15
  gRNA
ccauuaccugagcaucuauc

SEQ ID NO: 97745 - RNA, 20 nt, Artificial Sequence
  MKO10097745_B_Mapk1ip1l
  gRNA
acacuuacgugggggccacc

SEQ ID NO: 97746 - RNA, 20 nt, Artificial Sequence
  MKO10097746_B_Mapk1ip1l
  gRNA
ggagcacuuggguuacucca

SEQ ID NO: 97747 - RNA, 20 nt, Artificial Sequence
  MKO10097747_B_Mapk1ip1l
  gRNA
gguccugggggugguccggu

SEQ ID NO: 97748 - RNA, 20 nt, Artificial Sequence
  MKO10097748_B_Mapk1ip1
  gRNA
ccaucguguccccaacccag

SEQ ID NO: 97749 - RNA, 20 nt, Artificial Sequence
  MKO10097749_B_Mapk1ip1
  gRNA
gauccugguaguagucuagc

SEQ ID NO: 97750 - RNA, 20 nt, Artificial Sequence
  MKO10097750_B_Mapk1ip1
  gRNA
ggccagggacucguacagca

SEQ ID NO: 97751 - RNA, 20 nt, Artificial Sequence
  MKO10097751_B_Mapk1
  gRNA
uguuggauagcaucucugcc

SEQ ID NO: 97752 - RNA, 20 nt, Artificial Sequence
  MKO10097752_B_Mapk1
  gRNA
gaacaccacuugugaucuca

SEQ ID NO: 97753 - RNA, 20 nt, Artificial Sequence
  MKO10097753_B_Mapk1
  gRNA
aacccugugugaucaugauc

SEQ ID NO: 97754 - RNA, 20 nt, Artificial Sequence
  MKO10097754_B_Mapk3
  gRNA
cgugcucagggucagcaauc

SEQ ID NO: 97755 - RNA, 20 nt, Artificial Sequence
  MKO10097755_B_Mapk3
  gRNA
gacccugagcacgaccacac

SEQ ID NO: 97756 - RNA, 20 nt, Artificial Sequence
  MKO10097756_B_Mapk3
  gRNA
uggcugagaugcucuccaac

SEQ ID NO: 97757 - RNA, 20 nt, Artificial Sequence
  MKO10097757_B_Mapk4
  gRNA
acaacacccuuuccgcauug

SEQ ID NO: 97758 - RNA, 20 nt, Artificial Sequence
  MKO10097758_B_Mapk4
  gRNA
gccagcugcccacauaucga

SEQ ID NO: 97759 - RNA, 20 nt, Artificial Sequence
  MKO10097759_B_Mapk4
  gRNA
acacaaaagccaucgauaug

SEQ ID NO: 97760 - RNA, 20 nt, Artificial Sequence
  MKO10097760_B_Mapk6
  gRNA
cuugagaugggcucauccgu

SEQ ID NO: 97761 - RNA, 20 nt, Artificial Sequence
  MKO10097761_B_Mapk6
  gRNA
auaccuucucggcugauccc

SEQ ID NO: 97762 - RNA, 20 nt, Artificial Sequence
  MKO10097762_B_Mapk6
  gRNA
cgauccuccucgugcacaac

SEQ ID NO: 97763 - RNA, 20 nt, Artificial Sequence
  MKO10097763_B_Mapk7
  gRNA
uucccugcacgaguauacgc

SEQ ID NO: 97764 - RNA, 20 nt, Artificial Sequence
  MKO10097764_B_Mapk7
  gRNA
cagcccacuaguacuccuac

SEQ ID NO: 97765 - RNA, 20 nt, Artificial Sequence
  MKO10097765_B_Mapk7
  gRNA
cagcucccugaggguccguu

SEQ ID NO: 97766 - RNA, 20 nt, Artificial Sequence
  MKO10097766_B_Mapk8ip1
  gRNA
auccugguuggacuccgcuu

SEQ ID NO: 97767 - RNA, 20 nt, Artificial Sequence
  MKO10097767_B_Mapk8ip1
  gRNA
acucgucagugaucuccgaa

SEQ ID NO: 97768 - RNA, 20 nt, Artificial Sequence
  MKO10097768_B_Mapk8ip1
  gRNA
cagcccuuacccggagagac

SEQ ID NO: 97769 - RNA, 20 nt, Artificial Sequence
  MKO10097769_B_Mapk8ip2
  gRNA
ccugggccuuagcuacgacu

SEQ ID NO: 97770 - RNA, 20 nt, Artificial Sequence
  MKO10097770_B_Mapk8ip2
  gRNA
ugugcugcguucgccagccc

SEQ ID NO: 97771 - RNA, 20 nt, Artificial Sequence
  MKO10097771_B_Mapk8ip2
  gRNA
ugagaugaucgacgacaacg

SEQ ID NO: 97772 - RNA, 20 nt, Artificial Sequence
  MKO10097772_B_Mapk8ip3
  gRNA
ccaccuaccuccgcccgggc

SEQ ID NO: 97773 - RNA, 20 nt, Artificial Sequence
  MKO10097773_B_Mapk8ip3
  gRNA
acagaugauccagaccuaug

SEQ ID NO: 97774 - RNA, 20 nt, Artificial Sequence
  MKO10097774_B_Mapk8ip3
  gRNA
gaaacucauaauguucuacc

SEQ ID NO: 97775 - RNA, 20 nt, Artificial Sequence
  MKO10097775_B_Mapk8
  gRNA
cuaacuccaucugaaucacu

SEQ ID NO: 97776 - RNA, 20 nt, Artificial Sequence
  MKO10097776_B_Mapk8
  gRNA
aucaagcaccuucacucugc

SEQ ID NO: 97777 - RNA, 20 nt, Artificial Sequence
  MKO10097777_B_Mapk8
  gRNA
gcaugggucugauucugaaa

SEQ ID NO: 97778 - RNA, 20 nt, Artificial Sequence
  MKO10097778_B_Mapk9
  gRNA
aggcucucuuugcgugcguu

SEQ ID NO: 97779 - RNA, 20 nt, Artificial Sequence
  MKO10097779_B_Mapk9
  gRNA
aauggaugcuaacuuauguc

SEQ ID NO: 97780 - RNA, 20 nt, Artificial Sequence
  MKO10097780_B_Mapk9
  gRNA
uaugauugacacacuuuaag

SEQ ID NO: 97781 - RNA, 20 nt, Artificial Sequence
  MKO10097781_B_Mapkap1
  gRNA
gccaacagaugagcccgaug

SEQ ID NO: 97782 - RNA, 20 nt, Artificial Sequence
  MKO10097782_B_Mapkap1
  gRNA
cuccaggcguacagacaaua

SEQ ID NO: 97783 - RNA, 20 nt, Artificial Sequence
  MKO10097783_B_Mapkap1
  gRNA
aaugagcccauucauaaguu

SEQ ID NO: 97784 - RNA, 20 nt, Artificial Sequence
  MKO10097784_B_Mapkapk2
  gRNA
cccacacauugugcacaucg

SEQ ID NO: 97785 - RNA, 20 nt, Artificial Sequence
  MKO10097785_B_Mapkapk2
  gRNA
agagcucuuuagucgaaucc

SEQ ID NO: 97786 - RNA, 20 nt, Artificial Sequence
  MKO10097786_B_Mapkapk2
  gRNA
acucgaucaacauugcucac

SEQ ID NO: 97787 - RNA, 20 nt, Artificial Sequence
  MKO10097787_B_Mapkapk3
  gRNA
guacuuaaacucaccgauuu

SEQ ID NO: 97788 - RNA, 20 nt, Artificial Sequence
  MKO10097788_B_Mapkapk3
  gRNA
cugcuacacucccuauuaug

SEQ ID NO: 97789 - RNA, 20 nt, Artificial Sequence
  MKO10097789_B_Mapkapk3
  gRNA
cauugcccaccgagauguca

SEQ ID NO: 97790 - RNA, 20 nt, Artificial Sequence
  MKO10097790_B_Mapkapk5
  gRNA
cagugcaaaccguucuugag

SEQ ID NO: 97791 - RNA, 20 nt, Artificial Sequence
  MKO10097791_B_Mapkapk5
  gRNA
ucccucaugaguccagcccc

SEQ ID NO: 97792 - RNA, 20 nt, Artificial Sequence
  MKO10097792_B_Mapkapk5
  gRNA
guguggcacacaucaugugc

SEQ ID NO: 97793 - RNA, 20 nt, Artificial Sequence
  MKO10097793_B_Mapkbp1
  gRNA
cuuaacuuacccugcugggu

SEQ ID NO: 97794 - RNA, 20 nt, Artificial Sequence
  MKO10097794_B_Mapkbp1
  gRNA
gugaccaaguacuugccauc

SEQ ID NO: 97795 - RNA, 20 nt, Artificial Sequence
  MKO10097795_B_Mapkbp1
  gRNA
uggucguccucuucaauccc

SEQ ID NO: 97796 - RNA, 20 nt, Artificial Sequence
  MKO10097796_B_Mapre1
  gRNA
aaaacgacccuguacugcag

SEQ ID NO: 97797 - RNA, 20 nt, Artificial Sequence
  MKO10097797_B_Mapre1
  gRNA
guucuguuuaccugcaguac

SEQ ID NO: 97798 - RNA, 20 nt, Artificial Sequence
  MKO10097798_B_Mapre1
  gRNA
ggcugcauauugucaguuua

SEQ ID NO: 97799 - RNA, 20 nt, Artificial Sequence
  MKO10097799_B_Mapre2
  gRNA
cucgccccucgucugccaaa

SEQ ID NO: 97800 - RNA, 20 nt, Artificial Sequence
  MKO10097800_B_Mapre2
  gRNA
guauucuaccucgauaaccc

SEQ ID NO: 97801 - RNA, 20 nt, Artificial Sequence
  MKO10097801_B_Mapre2
  gRNA
acucaugcuccaacuuugcu

SEQ ID NO: 97802 - RNA, 20 nt, Artificial Sequence
  MKO10097802_B_Mapre3
  gRNA
gacuugaagcugaccguaga

SEQ ID NO: 97803 - RNA, 20 nt, Artificial Sequence
  MKO10097803_B_Mapre3
  gRNA
uaggagguggugcuacgucc

SEQ ID NO: 97804 - RNA, 20 nt, Artificial Sequence
  MKO10097804_B_Mapre3
  gRNA
uucuuugacgcaaacuauga

SEQ ID NO: 97805 - RNA, 20 nt, Artificial Sequence
  MKO10097805_B_Mapt
  gRNA
ggcgaagaucgccacaccuc

SEQ ID NO: 97806 - RNA, 20 nt, Artificial Sequence
  MKO10097806_B_Mapt
  gRNA
cucggaccagccgaagaagc

SEQ ID NO: 97807 - RNA, 20 nt, Artificial Sequence
  MKO10097807_B_Mapt
  gRNA
gacauggaccauggcuuaaa

SEQ ID NO: 97808 - RNA, 20 nt, Artificial Sequence
  MKO10097808_B_Marcksl1
  gRNA
gacuuaacccccaaggguga

SEQ ID NO: 97809 - RNA, 20 nt, Artificial Sequence
  MKO10097809_B_Marcksl1
  gRNA
ccggggcgacgugaccgccg

SEQ ID NO: 97810 - RNA, 20 nt, Artificial Sequence
  MKO10097810_B_Marcksl1
  gRNA
cccggggagccuuagagcuc

SEQ ID NO: 97811 - RNA, 20 nt, Artificial Sequence
  MKO10097811_B_Marcks
  gRNA
gaagccaccgccgagaggcc

SEQ ID NO: 97812 - RNA, 20 nt, Artificial Sequence
  MKO10097812_B_Marcks
  gRNA
ucuggagcuuacucggccgu

SEQ ID NO: 97813 - RNA, 20 nt, Artificial Sequence
  MKO10097813_B_Marcks
  gRNA
ggcggaggacgcaucgcccg

SEQ ID NO: 97814 - RNA, 20 nt, Artificial Sequence
  MKO10097814_B_Marco
  gRNA
gugcaguaccugccgugagc

SEQ ID NO: 97815 - RNA, 20 nt, Artificial Sequence
  MKO10097815_B_Marco
  gRNA
cauccaccugauccugcuca

SEQ ID NO: 97816 - RNA, 20 nt, Artificial Sequence
  MKO10097816_B_Marco
  gRNA
uuauccuccagguccaaaag

SEQ ID NO: 97817 - RNA, 20 nt, Artificial Sequence
  MKO10097817_B_Marf1
  gRNA
aacuccgucagagccugcga

SEQ ID NO: 97818 - RNA, 20 nt, Artificial Sequence
  MKO10097818_B_Marf1
  gRNA
uguccagugacugcaacuuc

SEQ ID NO: 97819 - RNA, 20 nt, Artificial Sequence
  MKO10097819_B_Marf1
  gRNA
guuccacagccauuacacac

SEQ ID NO: 97820 - RNA, 20 nt, Artificial Sequence
  MKO10097820_B_Mark1
  gRNA
aaacccuaccagucuacaga

SEQ ID NO: 97821 - RNA, 20 nt, Artificial Sequence
  MKO10097821_B_Mark1
  gRNA
auacugaaccauccuaacau

SEQ ID NO: 97822 - RNA, 20 nt, Artificial Sequence
  MKO10097822_B_Mark1
  gRNA
aacagagaagacacucuauu

SEQ ID NO: 97823 - RNA, 20 nt, Artificial Sequence
  MKO10097823_B_Mark2
  gRNA
cacuggcauacuccaugaca

SEQ ID NO: 97824 - RNA, 20 nt, Artificial Sequence
  MKO10097824_B_Mark2
  gRNA
ccgagaaguaagaauaauga

SEQ ID NO: 97825 - RNA, 20 nt, Artificial Sequence
  MKO10097825_B_Mark2
  gRNA
gggacucacuuucuguaggc

SEQ ID NO: 97826 - RNA, 20 nt, Artificial Sequence
  MKO10097826_B_Mark3
  gRNA
gugucucguucauucaccgu

SEQ ID NO: 97827 - RNA, 20 nt, Artificial Sequence
  MKO10097827_B_Mark3
  gRNA
gaauccaacaagucuacaaa

SEQ ID NO: 97828 - RNA, 20 nt, Artificial Sequence
  MKO10097828_B_Mark3
  gRNA
acacauccucacaggccgag

SEQ ID NO: 97829 - RNA, 20 nt, Artificial Sequence
  MKO10097829_B_Mark4
  gRNA
cgcuagcguauuccaucacc

SEQ ID NO: 97830 - RNA, 20 nt, Artificial Sequence
  MKO10097830_B_Mark4
  gRNA
cagagaaguccgaauuauga

SEQ ID NO: 97831 - RNA, 20 nt, Artificial Sequence
  MKO10097831_B_Mark4
  gRNA
gaaccccaguagcuugcaga

SEQ ID NO: 97832 - RNA, 20 nt, Artificial Sequence
  MKO10097832_B_Mars2
  gRNA
agaaaugcugcaccgcuacu

SEQ ID NO: 97833 - RNA, 20 nt, Artificial Sequence
  MKO10097833_B_Mars2
  gRNA
acucgaucgcacagcucgau

SEQ ID NO: 97834 - RNA, 20 nt, Artificial Sequence
  MKO10097834_B_Mars2
  gRNA
ccgacuuguccguuucucga

SEQ ID NO: 97835 - RNA, 20 nt, Artificial Sequence
  MKO10097835_B_Mars
  gRNA
uaaggucccugucuugcagc

SEQ ID NO: 97836 - RNA, 20 nt, Artificial Sequence
  MKO10097836_B_Mars
  gRNA
cuugaaccacuagacagugu

SEQ ID NO: 97837 - RNA, 20 nt, Artificial Sequence
  MKO10097837_B_Mars
  gRNA
ugcugcccuacacugucuag

SEQ ID NO: 97838 - RNA, 20 nt, Artificial Sequence
  MKO10097838_B_Marveld1
  gRNA
cgcgcaggaaagcccgcugc

SEQ ID NO: 97839 - RNA, 20 nt, Artificial Sequence
  MKO10097839_B_Marveld1
  gRNA
agccguagagugccgagagu

SEQ ID NO: 97840 - RNA, 20 nt, Artificial Sequence
  MKO10097840_B_Marveld1
  gRNA
gcuuuccugcgcggcccgcu

SEQ ID NO: 97841 - RNA, 20 nt, Artificial Sequence
  MKO10097841_B_Marveld2
  gRNA
ucacgauaggcuucggaaug

SEQ ID NO: 97842 - RNA, 20 nt, Artificial Sequence
  MKO10097842_B_Marveld2
  gRNA
acaucauucugaaaaccgcc

SEQ ID NO: 97843 - RNA, 20 nt, Artificial Sequence
  MKO10097843_B_Marveld2
  gRNA
caagaauucaugaagaguuu

SEQ ID NO: 97844 - RNA, 20 nt, Artificial Sequence
  MKO10097844_B_Marveld3
  gRNA
ugaugcgcaacgccgcauac

SEQ ID NO: 97845 - RNA, 20 nt, Artificial Sequence
  MKO10097845_B_Marveld3
  gRNA
accgagaccaccacgucgag

SEQ ID NO: 97846 - RNA, 20 nt, Artificial Sequence
  MKO10097846_B_Marveld3
  gRNA
gaugcccguguagccccccg

SEQ ID NO: 97847 - RNA, 20 nt, Artificial Sequence
  MKO10097847_B_Mas1
  gRNA
caagggaugucauauuugac

SEQ ID NO: 97848 - RNA, 20 nt, Artificial Sequence
  MKO10097848_B_Mas1
  gRNA
cauucgucugugcccuucug

SEQ ID NO: 97849 - RNA, 20 nt, Artificial Sequence
  MKO10097849_B_Mas1
  gRNA
guggguaauguagaccguga

SEQ ID NO: 97850 - RNA, 20 nt, Artificial Sequence
  MKO10097850_B_Masp1
  gRNA
agcuugauucgaaaccccuc

SEQ ID NO: 97851 - RNA, 20 nt, Artificial Sequence
  MKO10097851_B_Masp1
  gRNA
gauaaggguugggguaaucg

SEQ ID NO: 97852 - RNA, 20 nt, Artificial Sequence
  MKO10097852_B_Masp1
  gRNA
uacuacugcuccugccgcuu

SEQ ID NO: 97853 - RNA, 20 nt, Artificial Sequence
  MKO10097853_B_Masp2
  gRNA
cugaccaucaagaucgaucc

SEQ ID NO: 97854 - RNA, 20 nt, Artificial Sequence
  MKO10097854_B_Masp2
  gRNA
cccugugaacggcuucucau

SEQ ID NO: 97855 - RNA, 20 nt, Artificial Sequence
  MKO10097855_B_Masp2
  gRNA
gaguagaaggugucauugcc

SEQ ID NO: 97856 - RNA, 20 nt, Artificial Sequence
  MKO10097856_B_Mast1
  gRNA
ggagcgaagcaagcgaccau

SEQ ID NO: 97857 - RNA, 20 nt, Artificial Sequence
  MKO10097857_B_Mast1
  gRNA
gcaguugccguaccagcaac

SEQ ID NO: 97858 - RNA, 20 nt, Artificial Sequence
  MKO10097858_B_Mast1
  gRNA
gaguggggucgcgguagagu

SEQ ID NO: 97859 - RNA, 20 nt, Artificial Sequence
  MKO10097859_B_Mast2
  gRNA
cacuuaccaagccagccgua

SEQ ID NO: 97860 - RNA, 20 nt, Artificial Sequence
  MKO10097860_B_Mast2
  gRNA
cgaaugagaaaccaaucccu

SEQ ID NO: 97861 - RNA, 20 nt, Artificial Sequence
  MKO10097861_B_Mast2
  gRNA
acuccagcgacaacuuaguc

SEQ ID NO: 97862 - RNA, 20 nt, Artificial Sequence
  MKO10097862_B_Mast3
  gRNA
caaccguaagagcuuggucg

SEQ ID NO: 97863 - RNA, 20 nt, Artificial Sequence
  MKO10097863_B_Mast3
  gRNA
caguaccgauacaguggagc

SEQ ID NO: 97864 - RNA, 20 nt, Artificial Sequence
  MKO10097864_B_Mast3
  gRNA
aguguuggucccauagcccg

SEQ ID NO: 97865 - RNA, 20 nt, Artificial Sequence
  MKO10097865_B_Mast4
  gRNA
ggguugcugcauuuccgaaa

SEQ ID NO: 97866 - RNA, 20 nt, Artificial Sequence
  MKO10097866_B_Mast4
  gRNA
gagcugagccucccccgaag

SEQ ID NO: 97867 - RNA, 20 nt, Artificial Sequence
  MKO10097867_B_Mast4
  gRNA
acaguugccgaacaagcaac

SEQ ID NO: 97868 - RNA, 20 nt, Artificial Sequence
  MKO10097868_B_Mastl
  gRNA
caauaaaaauaugacucauc

SEQ ID NO: 97869 - RNA, 20 nt, Artificial Sequence
  MKO10097869_B_Mastl
  gRNA
caagauuauucaagaacucc

SEQ ID NO: 97870 - RNA, 20 nt, Artificial Sequence
  MKO10097870_B_Mastl
  gRNA
caauaugcuuauuuccaaug

SEQ ID NO: 97871 - RNA, 20 nt, Artificial Sequence
  MKO10097871_B_Mau1a
  gRNA
caugguugauuaccagcggg

SEQ ID NO: 97872 - RNA, 20 nt, Artificial Sequence
  MKO10097872_B_Mau1a
  gRNA
cacccgcugguaaucaacca

SEQ ID NO: 97873 - RNA, 20 nt, Artificial Sequence
  MKO10097873_B_Mau1a
  gRNA
caagacuugcaaugugcuag

SEQ ID NO: 97874 - RNA, 20 nt, Artificial Sequence
  MKO10097874_B_Mau2a
  gRNA
acaagacccugaugcuaaag

SEQ ID NO: 97875 - RNA, 20 nt, Artificial Sequence
  MKO10097875_B_Mau2a
  gRNA
uuagaaacuguugcuaaaac

SEQ ID NO: 97876 - RNA, 20 nt, Artificial Sequence
  MKO10097876_B_Mau2a
  gRNA
cuacaagacuuguaaugugu

SEQ ID NO: 97877 - RNA, 20 nt, Artificial Sequence
  MKO10097877_B_Mau2b
  gRNA
ucaacuuccccauacagaac

SEQ ID NO: 97878 - RNA, 20 nt, Artificial Sequence
  MKO10097878_B_Mau2b
  gRNA
gaacagcuucagaauccaac

SEQ ID NO: 97879 - RNA, 20 nt, Artificial Sequence
  MKO10097879_B_Mau2b
  gRNA
ucuuaccuaaauuauucucc

SEQ ID NO: 97880 - RNA, 20 nt, Artificial Sequence
  MKO10097880_B_Mauk
  gRNA
ugccaagcuccgaacaaucu

SEQ ID NO: 97881 - RNA, 20 nt, Artificial Sequence
  MKO10097881_B_Mauk
  gRNA
caggugagcccuagauuguu

SEQ ID NO: 97882 - RNA, 20 nt, Artificial Sequence
  MKO10097882_B_Mauk
  gRNA
cucccgcugucgcagagcag

SEQ ID NO: 97883 - RNA, 20 nt, Artificial Sequence
  MKO10097883_B_Maun1
  gRNA
acacguuagaugugucggac

SEQ ID NO: 97884 - RNA, 20 nt, Artificial Sequence
  MKO10097884_B_Maun1
  gRNA
acacgucccgcacgcugucc

SEQ ID NO: 97885 - RNA, 20 nt, Artificial Sequence
  MKO10097885_B_Maun1
  gRNA
ucugcaauucgccaucacca

SEQ ID NO: 97886 - RNA, 20 nt, Artificial Sequence
  MKO10097886_B_Maun2
  gRNA
gaggacgggaagcgauguac

SEQ ID NO: 97887 - RNA, 20 nt, Artificial Sequence
  MKO10097887_B_Maun2
  gRNA
agaccuacucggguaacauc

SEQ ID NO: 97888 - RNA, 20 nt, Artificial Sequence
  MKO10097888_B_Maun2
  gRNA
uguacaucgcuucccguccu

SEQ ID NO: 97889 - RNA, 20 nt, Artificial Sequence
  MKO10097889_B_Maun3
  gRNA
gcugaugggaaaacguguuc

SEQ ID NO: 97890 - RNA, 20 nt, Artificial Sequence
  MKO10097890_B_Maun3
  gRNA
ucuuaccacugcgagugcua

SEQ ID NO: 97891 - RNA, 20 nt, Artificial Sequence
  MKO10097891_B_Maun3
  gRNA
cagcacgugugugucagcga

SEQ ID NO: 97892 - RNA, 20 nt, Artificial Sequence
  MKO10097892_B_Maun4
  gRNA
gccacgaccugcuaccugau

SEQ ID NO: 97893 - RNA, 20 nt, Artificial Sequence
  MKO10097893_B_Maun4
  gRNA
gccuuggaucucugcgcuga

SEQ ID NO: 97894 - RNA, 20 nt, Artificial Sequence
  MKO10097894_B_Maun4
  gRNA
uucuacugcgccugcaacuc

SEQ ID NO: 97895 - RNA, 20 nt, Artificial Sequence
  MKO10097895_B_Maur3
  gRNA
guguguccaguaucauuguc

SEQ ID NO: 97896 - RNA, 20 nt, Artificial Sequence
  MKO10097896_B_Maur3
  gRNA
ccuacauuucaagaagaagc

SEQ ID NO: 97897 - RNA, 20 nt, Artificial Sequence
  MKO10097897_B_Maur3
  gRNA
cuguacacaggugcugguaa

SEQ ID NO: 97898 - RNA, 20 nt, Artificial Sequence
  MKO10097898_B_Mau2
  gRNA
gucagagcuguauugucaag

SEQ ID NO: 97899 - RNA, 20 nt, Artificial Sequence
  MKO10097899_B_Mau2
  gRNA
gacaauacagcucugacaac

SEQ ID NO: 97900 - RNA, 20 nt, Artificial Sequence
  MKO10097900_B_Mau2
  gRNA
uuacagcgagcuggaagagc

SEQ ID NO: 97901 - RNA, 20 nt, Artificial Sequence
  MKO10097901_B_Mavs
  gRNA
ccuacaggcagaucgggaac

SEQ ID NO: 97902 - RNA, 20 nt, Artificial Sequence
  MKO10097902_B_Mavs
  gRNA
uuuguccucagggcaguacg

SEQ ID NO: 97903 - RNA, 20 nt, Artificial Sequence
  MKO10097903_B_Mavs
  gRNA
aguagacgucaucgcagcag

SEQ ID NO: 97904 - RNA, 20 nt, Artificial Sequence
  MKO10097904_B_Max
  gRNA
gaagagcauucugccgcuug

SEQ ID NO: 97905 - RNA, 20 nt, Artificial Sequence
  MKO10097905_B_Max
  gRNA
cacucuccuaggcugacaag

SEQ ID NO: 97906 - RNA, 20 nt, Artificial Sequence
  MKO10097906_B_Max
  gRNA
aguauauccaguauaugcga

SEQ ID NO: 97907 - RNA, 20 nt, Artificial Sequence
  MKO10097907_B_Maz
  gRNA
agcgcacacaguccgacacg

SEQ ID NO: 97908 - RNA, 20 nt, Artificial Sequence
  MKO10097908_B_Maz
  gRNA
ucucccuauagguacuggug

SEQ ID NO: 97909 - RNA, 20 nt, Artificial Sequence
  MKO10097909_B_Maz
  gRNA
gacaagugcacucaacagag

SEQ ID NO: 97910 - RNA, 20 nt, Artificial Sequence
  MKO10097910_B_Mb21d1
  gRNA
auauucuuguagcucaaucc

SEQ ID NO: 97911 - RNA, 20 nt, Artificial Sequence
  MKO10097911_B_Mb21d1
  gRNA
ccgcugagucauuucuuaga

SEQ ID NO: 97912 - RNA, 20 nt, Artificial Sequence
  MKO10097912_B_Mb21d1
  gRNA
aggacccgcaggacagucag

SEQ ID NO: 97913 - RNA, 20 nt, Artificial Sequence
  MKO10097913_B_Mb21d2
  gRNA
auacgacgaccagagagcgc

SEQ ID NO: 97914 - RNA, 20 nt, Artificial Sequence
  MKO10097914_B_Mb21d2
  gRNA
uuaaccccgaugacgucacg

SEQ ID NO: 97915 - RNA, 20 nt, Artificial Sequence
  MKO10097915_B_Mb21d2
  gRNA
acggucaugcagcuuaaggg

SEQ ID NO: 97916 - RNA, 20 nt, Artificial Sequence
  MKO10097916_B_Mbd1
  gRNA
ccuuaaacauucucuguucg

SEQ ID NO: 97917 - RNA, 20 nt, Artificial Sequence
  MKO10097917_B_Mbd1
  gRNA
gacuccacagggggaauaua

SEQ ID NO: 97918 - RNA, 20 nt, Artificial Sequence
  MKO10097918_B_Mbd1
  gRNA
uuucaugggauggugucaaa

SEQ ID NO: 97919 - RNA, 20 nt, Artificial Sequence
  MKO10097919_B_Mbd2
  gRNA
ugguucgugaauuugguuac

SEQ ID NO: 97920 - RNA, 20 nt, Artificial Sequence
  MKO10097920_B_Mbd2
  gRNA
ugacccccucaaucagaaca

SEQ ID NO: 97921 - RNA, 20 nt, Artificial Sequence
  MKO10097921_B_Mbd2
  gRNA
guucagaaguaaaccucagc

SEQ ID NO: 97922 - RNA, 20 nt, Artificial Sequence
  MKO10097922_B_Mbd3l1
  gRNA
ccuugagucaucuucacauu

SEQ ID NO: 97923 - RNA, 20 nt, Artificial Sequence
  MKO10097923_B_Mbd3l1
  gRNA
ugaacaggauauuauuaacc

SEQ ID NO: 97924 - RNA, 20 nt, Artificial Sequence
  MKO10097924_B_Mbd3l1
  gRNA
uaaguacuucaauccccuug

SEQ ID NO: 97925 - RNA, 20 nt, Artificial Sequence
  MKO10097925_B_Mbd3l2
  gRNA
guuucuugaagucuccucca

SEQ ID NO: 97926 - RNA, 20 nt, Artificial Sequence
  MKO10097926_B_Mbd3l2
  gRNA
uggcuuugcaaagaugcaac

SEQ ID NO: 97927 - RNA, 20 nt, Artificial Sequence
  MKO10097927_B_Mbd3l2
  gRNA
uaagcuucaauugacaugac

SEQ ID NO: 97928 - RNA, 20 nt, Artificial Sequence
  MKO10097928_B_Mbd3
  gRNA
gguguguagagcacucgcaa

SEQ ID NO: 97929 - RNA, 20 nt, Artificial Sequence
  MKO10097929_B_Mbd3
  gRNA
gggggcucaccugccucggc

SEQ ID NO: 97930 - RNA, 20 nt, Artificial Sequence
  MKO10097930_B_Mbd3
  gRNA
uauuccacaggagugggccc

SEQ ID NO: 97931 - RNA, 20 nt, Artificial Sequence
  MKO10097931_B_Mbd4
  gRNA
ccgggauugaugcucccuuu

SEQ ID NO: 97932 - RNA, 20 nt, Artificial Sequence
  MKO10097932_B_Mbd4
  gRNA
ugagaaauauagucgcgaug

SEQ ID NO: 97933 - RNA, 20 nt, Artificial Sequence
  MKO10097933_B_Mbd4
  gRNA
guugugaagcaaagguuauc

SEQ ID NO: 97934 - RNA, 20 nt, Artificial Sequence
  MKO10097934_B_Mbd5
  gRNA
ggacagaaaucuccauuucg

SEQ ID NO: 97935 - RNA, 20 nt, Artificial Sequence
  MKO10097935_B_Mbd5
  gRNA
ugcauguuccgucagugagc

SEQ ID NO: 97936 - RNA, 20 nt, Artificial Sequence
  MKO10097936_B_Mbd5
  gRNA
gagaacugcagaagauguua

SEQ ID NO: 97937 - RNA, 20 nt, Artificial Sequence
  MKO10097937_B_Mbd6
  gRNA
accuggggggguguccccga

SEQ ID NO: 97938 - RNA, 20 nt, Artificial Sequence
  MKO10097938_B_Mbd6
  gRNA
gugcuucaaagcccgucuga

SEQ ID NO: 97939 - RNA, 20 nt, Artificial Sequence
  MKO10097939_B_Mbd6
  gRNA
cguagcuaccuccucagcga

SEQ ID NO: 97940 - RNA, 20 nt, Artificial Sequence
  MKO10097940_B_Mbip
  gRNA
gccuugaucugaacuacuuc

SEQ ID NO: 97941 - RNA, 20 nt, Artificial Sequence
  MKO10097941_B_Mbip
  gRNA
aauguuauugauuguaauca

SEQ ID NO: 97942 - RNA, 20 nt, Artificial Sequence
  MKO10097942_B_Mbip
  gRNA
gcugucuuuacuccuuaucc

SEQ ID NO: 97943 - RNA, 20 nt, Artificial Sequence
  MKO10097943_B_Mbl1
  gRNA
acagguuugugacccugaug

SEQ ID NO: 97944 - RNA, 20 nt, Artificial Sequence
  MKO10097944_B_Mbl1
  gRNA
aucagggucacaaaccugug

SEQ ID NO: 97945 - RNA, 20 nt, Artificial Sequence
  MKO10097945_B_Mbl1
  gRNA
uccaggaccaaaaggccaaa

SEQ ID NO: 97946 - RNA, 20 nt, Artificial Sequence
  MKO10097946_B_Mbl2
  gRNA
ggccaaagauauugccuacu

SEQ ID NO: 97947 - RNA, 20 nt, Artificial Sequence
  MKO10097947_B_Mbl2
  gRNA
aaaggagcagugggaccgaa

SEQ ID NO: 97948 - RNA, 20 nt, Artificial Sequence
  MKO10097948_B_Mbl2
  gRNA
uacaggacccccagggaauc

SEQ ID NO: 97949 - RNA, 20 nt, Artificial Sequence
  MKO10097949_B_Mblac1
  gRNA
agucuuagagccgccgucug

SEQ ID NO: 97950 - RNA, 20 nt, Artificial Sequence
  MKO10097950_B_Mblac1
  gRNA
ugaaacgcagcccuugauac

SEQ ID NO: 97951 - RNA, 20 nt, Artificial Sequence
  MKO10097951_B_Mblac1
  gRNA
accgcgucgcccgcucccug

SEQ ID NO: 97952 - RNA, 20 nt, Artificial Sequence
  MKO10097952_B_Mblac2
  gRNA
ccaaagguauugaagugccc

SEQ ID NO: 97953 - RNA, 20 nt, Artificial Sequence
  MKO10097953_B_Mblac2
  gRNA
ugugcaccgcgccgaggccg

SEQ ID NO: 97954 - RNA, 20 nt, Artificial Sequence
  MKO10097954_B_Mblac2
  gRNA
cggucucuaucaguucgacc

SEQ ID NO: 97955 - RNA, 20 nt, Artificial Sequence
  MKO10097955_B_Mbnl1
  gRNA
ggcaccgggcaucauggcau

SEQ ID NO: 97956 - RNA, 20 nt, Artificial Sequence
  MKO10097956_B_Mbnl1
  gRNA
gugcucaccacgggcugcaa

SEQ ID NO: 97957 - RNA, 20 nt, Artificial Sequence
  MKO10097957_B_Mbnl1
  gRNA
gaugcacugguggcuaagcu

SEQ ID NO: 97958 - RNA, 20 nt, Artificial Sequence
  MKO10097958_B_Mbnl2
  gRNA
aguuggguuagucccaacag

SEQ ID NO: 97959 - RNA, 20 nt, Artificial Sequence
  MKO10097959_B_Mbnl2
  gRNA
aauagccgcauuugucccua

SEQ ID NO: 97960 - RNA, 20 nt, Artificial Sequence
  MKO10097960_B_Mbnl2
  gRNA
agcaaacuugcauucuucgu

SEQ ID NO: 97961 - RNA, 20 nt, Artificial Sequence
  MKO10097961_B_Mbnl3
  gRNA
guuugccgugaauuucagcg

SEQ ID NO: 97962 - RNA, 20 nt, Artificial Sequence
  MKO10097962_B_Mbnl3
  gRNA
ucuagcugcgacuuuaagug

SEQ ID NO: 97963 - RNA, 20 nt, Artificial Sequence
  MKO10097963_B_Mbnl3
  gRNA
aagucgcagcuagaaguuaa

SEQ ID NO: 97964 - RNA, 20 nt, Artificial Sequence
  MKO10097964_B_Mboau1
  gRNA
guagcccauggcuacaaaaa

SEQ ID NO: 97965 - RNA, 20 nt, Artificial Sequence
  MKO10097965_B_Mboau1
  gRNA
ugcuguacaucucuuugugc

SEQ ID NO: 97966 - RNA, 20 nt, Artificial Sequence
  MKO10097966_B_Mboau1
  gRNA
agauguaaaugcggcugaug

SEQ ID NO: 97967 - RNA, 20 nt, Artificial Sequence
  MKO10097967_B_Mboau2
  gRNA
uucugcguaaugaucaucau

SEQ ID NO: 97968 - RNA, 20 nt, Artificial Sequence
  MKO10097968_B_Mboau2
  gRNA
acacguaguugcuacccuuu

SEQ ID NO: 97969 - RNA, 20 nt, Artificial Sequence
  MKO10097969_B_Mboau2
  gRNA
uacgcagaagaucacuaguu

SEQ ID NO: 97970 - RNA, 20 nt, Artificial Sequence
  MKO10097970_B_Mboau4
  gRNA
ggccuuuaccucacgggugg

SEQ ID NO: 97971 - RNA, 20 nt, Artificial Sequence
  MKO10097971_B_Mboau4
  gRNA
uccagccuaccuggcccggg

SEQ ID NO: 97972 - RNA, 20 nt, Artificial Sequence
  MKO10097972_B_Mboau4
  gRNA
gccccuugauaaaaugauaa

SEQ ID NO: 97973 - RNA, 20 nt, Artificial Sequence
  MKO10097973_B_Mboau7
  gRNA
acagcauuggugaagggcgu

SEQ ID NO: 97974 - RNA, 20 nt, Artificial Sequence
  MKO10097974_B_Mboau7
  gRNA
ucaggcaggaggcccagcgu

SEQ ID NO: 97975 - RNA, 20 nt, Artificial Sequence
  MKO10097975_B_Mboau7
  gRNA
aggugaauaaggugagcccc

SEQ ID NO: 97976 - RNA, 20 nt, Artificial Sequence
  MKO10097976_B_Mbp
  gRNA
cacacgagaacuacccauua

SEQ ID NO: 97977 - RNA, 20 nt, Artificial Sequence
  MKO10097977_B_Mbp
  gRNA
cugccccagaagucgcagca

SEQ ID NO: 97978 - RNA, 20 nt, Artificial Sequence
  MKO10097978_B_Mbp
  gRNA
ggaggaagagacagccgcuc

SEQ ID NO: 97979 - RNA, 20 nt, Artificial Sequence
  MKO10097979_B_Mbtd1
  gRNA
uuacucgucaaacucuaaga

SEQ ID NO: 97980 - RNA, 20 nt, Artificial Sequence
  MKO10097980_B_Mbtd1
  gRNA
uuccgagauaucaccccagc

SEQ ID NO: 97981 - RNA, 20 nt, Artificial Sequence
  MKO10097981_B_Mbtd1
  gRNA
cagcuucauagcagcuccag

SEQ ID NO: 97982 - RNA, 20 nt, Artificial Sequence
  MKO10097982_B_Mbtps1
  gRNA
gaacgaaagacuuuccgcug

SEQ ID NO: 97983 - RNA, 20 nt, Artificial Sequence
  MKO10097983_B_Mbtps1
  gRNA
gaaccaacuggaccaaugag

SEQ ID NO: 97984 - RNA, 20 nt, Artificial Sequence
  MKO10097984_B_Mbtps1
  gRNA
uccuuggcacucccucaugc

SEQ ID NO: 97985 - RNA, 20 nt, Artificial Sequence
  MKO10097985_B_Mbtps2
  gRNA
agggaacaaguucgauuuaa

SEQ ID NO: 97986 - RNA, 20 nt, Artificial Sequence
  MKO10097986_B_Mbtps2
  gRNA
cuggugauauaaguugcaaa

SEQ ID NO: 97987 - RNA, 20 nt, Artificial Sequence
  MKO10097987_B_Mbtps2
  gRNA
guuugccaucuuauaugaaa

SEQ ID NO: 97988 - RNA, 20 nt, Artificial Sequence
  MKO10097988_B_Mb
  gRNA
ugucauuccggaagagcucc

SEQ ID NO: 97989 - RNA, 20 nt, Artificial Sequence
  MKO10097989_B_Mb
  gRNA
cgaugaggacuuccugucca

SEQ ID NO: 97990 - RNA, 20 nt, Artificial Sequence
  MKO10097990_B_Mb
  gRNA
aagguggaggccgaccuugc

SEQ ID NO: 97991 - RNA, 20 nt, Artificial Sequence
  MKO10097991_B_Mc1r
  gRNA
cacagaugagcacgucaaug

SEQ ID NO: 97992 - RNA, 20 nt, Artificial Sequence
  MKO10097992_B_Mc1r
  gRNA
ugccacccuuacuauccuuc

SEQ ID NO: 97993 - RNA, 20 nt, Artificial Sequence
  MKO10097993_B_Mc1r
  gRNA
aaucgccaugagugccagca

SEQ ID NO: 97994 - RNA, 20 nt, Artificial Sequence
  MKO10097994_B_Mc2r
  gRNA
ggcgcauggucacaaugcua

SEQ ID NO: 97995 - RNA, 20 nt, Artificial Sequence
  MKO10097995_B_Mc2r
  gRNA
ugaucaacaugccauugacc

SEQ ID NO: 97996 - RNA, 20 nt, Artificial Sequence
  MKO10097996_B_Mc2r
  gRNA
agcgggcaaguaagaacaug

SEQ ID NO: 97997 - RNA, 20 nt, Artificial Sequence
  MKO10097997_B_Mc3r
  gRNA
gauggugacguaccugucga

SEQ ID NO: 97998 - RNA, 20 nt, Artificial Sequence
  MKO10097998_B_Mc3r
  gRNA
guugaucacggcgaucauga

SEQ ID NO: 97999 - RNA, 20 nt, Artificial Sequence
  MKO10097999_B_Mc3r
  gRNA
ugaacguguugcgcagcucc

SEQ ID NO: 98000 - RNA, 20 nt, Artificial Sequence
  MKO10098000_B_Mc4r
  gRNA
ugcucauagcauccuccguc

SEQ ID NO: 98001 - RNA, 20 nt, Artificial Sequence
  MKO10098001_B_Mc4r
  gRNA
uaaugugaagccucgccauc

SEQ ID NO: 98002 - RNA, 20 nt, Artificial Sequence
  MKO10098002_B_Mc4r
  gRNA
augcuggugagcguuucgaa

SEQ ID NO: 98003 - RNA, 20 nt, Artificial Sequence
  MKO10098003_B_Mc5r
  gRNA
gaaucaugcuuaccuuugcg

SEQ ID NO: 98004 - RNA, 20 nt, Artificial Sequence
  MKO10098004_B_Mc5r
  gRNA
accaccacaucaugaccgcg

SEQ ID NO: 98005 - RNA, 20 nt, Artificial Sequence
  MKO10098005_B_Mc5r
  gRNA
gggugaucaucgccugcauc

SEQ ID NO: 98006 - RNA, 20 nt, Artificial Sequence
  MKO10098006_B_Mcam
  gRNA
gccaguacccacgcccgacc

SEQ ID NO: 98007 - RNA, 20 nt, Artificial Sequence
  MKO10098007_B_Mcam
  gRNA
aacuauucaagccaaugucg

SEQ ID NO: 98008 - RNA, 20 nt, Artificial Sequence
  MKO10098008_B_Mcam
  gRNA
uccuuagguugcuaccugug

SEQ ID NO: 98009 - RNA, 20 nt, Artificial Sequence
  MKO10098009_B_Mcau
  gRNA
gccguccauuccaaugucag

SEQ ID NO: 98010 - RNA, 20 nt, Artificial Sequence
  MKO10098010_B_Mcau
  gRNA
gcauccgaagccguucccag

SEQ ID NO: 98011 - RNA, 20 nt, Artificial Sequence
  MKO10098011_B_Mcau
  gRNA
caucgacaacuguguugcug

SEQ ID NO: 98012 - RNA, 20 nt, Artificial Sequence
  MKO10098012_B_Mccc1
  gRNA
acguaccauaucuacaugca

SEQ ID NO: 98013 - RNA, 20 nt, Artificial Sequence
  MKO10098013_B_Mccc1
  gRNA
ugggguuguuccauacuuca

SEQ ID NO: 98014 - RNA, 20 nt, Artificial Sequence
  MKO10098014_B_Mccc1
  gRNA
gucgguggcuguguacagug

SEQ ID NO: 98015 - RNA, 20 nt, Artificial Sequence
  MKO10098015_B_Mccc2
  gRNA
cucuggaugugugccgcgcc

SEQ ID NO: 98016 - RNA, 20 nt, Artificial Sequence
  MKO10098016_B_Mccc2
  gRNA
aacgaugccaccgucaaagg

SEQ ID NO: 98017 - RNA, 20 nt, Artificial Sequence
  MKO10098017_B_Mccc2
  gRNA
ccgacucccaugcaucuauc

SEQ ID NO: 98018 - RNA, 20 nt, Artificial Sequence
  MKO10098018_B_Mcc
  gRNA
ggccaagucgcagugcucgc

SEQ ID NO: 98019 - RNA, 20 nt, Artificial Sequence
  MKO10098019_B_Mcc
  gRNA
cccugagaaccagucuacua

SEQ ID NO: 98020 - RNA, 20 nt, Artificial Sequence
  MKO10098020_B_Mcc
  gRNA
cauuaaccucuuguugacuc

SEQ ID NO: 98021 - RNA, 20 nt, Artificial Sequence
  MKO10098021_B_Mcee
  gRNA
ggacaugaggcguguaguga

SEQ ID NO: 98022 - RNA, 20 nt, Artificial Sequence
  MKO10098022_B_Mcee
  gRNA
gauccguagucugagugaug

SEQ ID NO: 98023 - RNA, 20 nt, Artificial Sequence
  MKO10098023_B_Mcee
  gRNA
uuucccaugugcuccuauuu

SEQ ID NO: 98024 - RNA, 20 nt, Artificial Sequence
  MKO10098024_B_Mcf2l
  gRNA
ucaucuuggucauagaccga

SEQ ID NO: 98025 - RNA, 20 nt, Artificial Sequence
  MKO10098025_B_Mcf2l
  gRNA
aagcgcuuugcuuaccuguc

SEQ ID NO: 98026 - RNA, 20 nt, Artificial Sequence
  MKO10098026_B_Mcf2l
  gRNA
cuuguccgggaucucgcuga

SEQ ID NO: 98027 - RNA, 20 nt, Artificial Sequence
  MKO10098027_B_Mcf2
  gRNA
aggacuaaguguaagcuccc

SEQ ID NO: 98028 - RNA, 20 nt, Artificial Sequence
  MKO10098028_B_Mcf2
  gRNA
cuucaacaggugauaccuuu

SEQ ID NO: 98029 - RNA, 20 nt, Artificial Sequence
  MKO10098029_B_Mcf2
  gRNA
uuaugugcugaguacauuca

SEQ ID NO: 98030 - RNA, 20 nt, Artificial Sequence
  MKO10098030_B_Mcfd2
  gRNA
gagcucgucagcaucauaga

SEQ ID NO: 98031 - RNA, 20 nt, Artificial Sequence
  MKO10098031_B_Mcfd2
  gRNA
aggugucaucgaccagccag

SEQ ID NO: 98032 - RNA, 20 nt, Artificial Sequence
  MKO10098032_B_Mcfd2
  gRNA
caugauggacaucagccccg

SEQ ID NO: 98033 - RNA, 20 nt, Artificial Sequence
  MKO10098033_B_Mchr1
  gRNA
aucggagauguugcuggcau

SEQ ID NO: 98034 - RNA, 20 nt, Artificial Sequence
  MKO10098034_B_Mchr1
  gRNA
ugagaccuuucgaaaacgcu

SEQ ID NO: 98035 - RNA, 20 nt, Artificial Sequence
  MKO10098035_B_Mchr1
  gRNA
ucacccucuuuguccgaagc

SEQ ID NO: 98036 - RNA, 20 nt, Artificial Sequence
  MKO10098036_B_Mcidas
  gRNA
cagcccgguggcgguguacg

SEQ ID NO: 98037 - RNA, 20 nt, Artificial Sequence
  MKO10098037_B_Mcidas
  gRNA
guccugccucuccccaucgc

SEQ ID NO: 98038 - RNA, 20 nt, Artificial Sequence
  MKO10098038_B_Mcidas
  gRNA
ccuugugauguuucgucuuu

SEQ ID NO: 98039 - RNA, 20 nt, Artificial Sequence
  MKO10098039_B_Mcl1
  gRNA
ucaaagauggcguaacaaac

SEQ ID NO: 98040 - RNA, 20 nt, Artificial Sequence
  MKO10098040_B_Mcl1
  gRNA
cggcaucagaaaugugcugc

SEQ ID NO: 98041 - RNA, 20 nt, Artificial Sequence
  MKO10098041_B_Mcl1
  gRNA
uuugcggguguugcuggagu

SEQ ID NO: 98042 - RNA, 20 nt, Artificial Sequence
  MKO10098042_B_Mcm10
  gRNA
cggaagccaaagacuccugc

SEQ ID NO: 98043 - RNA, 20 nt, Artificial Sequence
  MKO10098043_B_Mcm10
  gRNA
ggccgguccccagaauuccc

SEQ ID NO: 98044 - RNA, 20 nt, Artificial Sequence
  MKO10098044_B_Mcm10
  gRNA
gaacguuuggccacucucuu

SEQ ID NO: 98045 - RNA, 20 nt, Artificial Sequence
  MKO10098045_B_Mcm2
  gRNA
cacugauccggcgccgcuga

SEQ ID NO: 98046 - RNA, 20 nt, Artificial Sequence
  MKO10098046_B_Mcm2
  gRNA
augcgccgggggcugcucua

SEQ ID NO: 98047 - RNA, 20 nt, Artificial Sequence
  MKO10098047_B_Mcm2
  gRNA
ggucagggcgucagcacguc

SEQ ID NO: 98048 - RNA, 20 nt, Artificial Sequence
  MKO10098048_B_Mcm3ap
  gRNA
cucucagcaagcccaucgug

SEQ ID NO: 98049 - RNA, 20 nt, Artificial Sequence
  MKO10098049_B_Mcm3ap
  gRNA
accagagagaccgcaucaug

SEQ ID NO: 98050 - RNA, 20 nt, Artificial Sequence
  MKO10098050_B_Mcm3ap
  gRNA
gccggcugcaggccucacga

SEQ ID NO: 98051 - RNA, 20 nt, Artificial Sequence
  MKO10098051_B_Mcm3
  gRNA
caccuacgccaagcaguaug

SEQ ID NO: 98052 - RNA, 20 nt, Artificial Sequence
  MKO10098052_B_Mcm3
  gRNA
ccuuuaccugaagguccccg

SEQ ID NO: 98053 - RNA, 20 nt, Artificial Sequence
  MKO10098053_B_Mcm3
  gRNA
gaagaagggcugcuacaccu

SEQ ID NO: 98054 - RNA, 20 nt, Artificial Sequence
  MKO10098054_B_Mcm4
  gRNA
acucccagcucgcgagugga

SEQ ID NO: 98055 - RNA, 20 nt, Artificial Sequence
  MKO10098055_B_Mcm4
  gRNA
ccaaguuguugcauguacaa

SEQ ID NO: 98056 - RNA, 20 nt, Artificial Sequence
  MKO10098056_B_Mcm4
  gRNA
guaccaagugaacagucucu

SEQ ID NO: 98057 - RNA, 20 nt, Artificial Sequence
  MKO10098057_B_Mcm5
  gRNA
gcgcauggcgauauugguga

SEQ ID NO: 98058 - RNA, 20 nt, Artificial Sequence
  MKO10098058_B_Mcm5
  gRNA
agccaguuccucgucaaaac

SEQ ID NO: 98059 - RNA, 20 nt, Artificial Sequence
  MKO10098059_B_Mcm5
  gRNA
ccucgauccaguauucaccc

SEQ ID NO: 98060 - RNA, 20 nt, Artificial Sequence
  MKO10098060_B_Mcm6
  gRNA
uuccccggggaaguauuccc

SEQ ID NO: 98061 - RNA, 20 nt, Artificial Sequence
  MKO10098061_B_Mcm6
  gRNA
gaccuuugucaaagaccgaa

SEQ ID NO: 98062 - RNA, 20 nt, Artificial Sequence
  MKO10098062_B_Mcm6
  gRNA
aacuccggggaauacuuccc

SEQ ID NO: 98063 - RNA, 20 nt, Artificial Sequence
  MKO10098063_B_Mcm7
  gRNA
acauacacuugugaucagug

SEQ ID NO: 98064 - RNA, 20 nt, Artificial Sequence
  MKO10098064_B_Mcm7
  gRNA
cauucucguaauaaaacucu

SEQ ID NO: 98065 - RNA, 20 nt, Artificial Sequence
  MKO10098065_B_Mcm7
  gRNA
guucaaguaugggacccagu

SEQ ID NO: 98066 - RNA, 20 nt, Artificial Sequence
  MKO10098066_B_Mcm8
  gRNA
uauggggcuggcaauacauc

SEQ ID NO: 98067 - RNA, 20 nt, Artificial Sequence
  MKO10098067_B_Mcm8
  gRNA
gaggcuuuauguugcugacc

SEQ ID NO: 98068 - RNA, 20 nt, Artificial Sequence
  MKO10098068_B_Mcm8
  gRNA
ugcuugaaucuucucaauaa

SEQ ID NO: 98069 - RNA, 20 nt, Artificial Sequence
  MKO10098069_B_Mcm9
  gRNA
cgcccgccugcguccgcacc

SEQ ID NO: 98070 - RNA, 20 nt, Artificial Sequence
  MKO10098070_B_Mcm9
  gRNA
agaauaacuuucauagaccg

SEQ ID NO: 98071 - RNA, 20 nt, Artificial Sequence
  MKO10098071_B_Mcm9
  gRNA
auggauaaccccuccgucuc

SEQ ID NO: 98072 - RNA, 20 nt, Artificial Sequence
  MKO10098072_B_Mcmbp
  gRNA
uuugacccacgaagacuccc

SEQ ID NO: 98073 - RNA, 20 nt, Artificial Sequence
  MKO10098073_B_Mcmbp
  gRNA
uucuacuguguccccgugcc

SEQ ID NO: 98074 - RNA, 20 nt, Artificial Sequence
  MKO10098074_B_Mcmbp
  gRNA
gaagguuauugaauacuuca

SEQ ID NO: 98075 - RNA, 20 nt, Artificial Sequence
  MKO10098075_B_Mcmdc2
  gRNA
acuauaaccaaguacacuca

SEQ ID NO: 98076 - RNA, 20 nt, Artificial Sequence
  MKO10098076_B_Mcmdc2
  gRNA
ccuugcaccuugaguguacu

SEQ ID NO: 98077 - RNA, 20 nt, Artificial Sequence
  MKO10098077_B_Mcmdc2
  gRNA
guugcagauucuguagcucc

SEQ ID NO: 98078 - RNA, 20 nt, Artificial Sequence
  MKO10098078_B_Mcoln1
  gRNA
ccuguccgcagacuguaucc

SEQ ID NO: 98079 - RNA, 20 nt, Artificial Sequence
  MKO10098079_B_Mcoln1
  gRNA
caccuuugcagccuacacac

SEQ ID NO: 98080 - RNA, 20 nt, Artificial Sequence
  MKO10098080_B_Mcoln1
  gRNA
acccaucagaguaacccagc

SEQ ID NO: 98081 - RNA, 20 nt, Artificial Sequence
  MKO10098081_B_Mcoln2
  gRNA
uguaagcagcacuacaagac

SEQ ID NO: 98082 - RNA, 20 nt, Artificial Sequence
  MKO10098082_B_Mcoln2
  gRNA
ugcucuagacugcauucacc

SEQ ID NO: 98083 - RNA, 20 nt, Artificial Sequence
  MKO10098083_B_Mcoln2
  gRNA
cagcuguagcauauacacuc

SEQ ID NO: 98084 - RNA, 20 nt, Artificial Sequence
  MKO10098084_B_Mcoln3
  gRNA
caaucacgcuuaugagaaca

SEQ ID NO: 98085 - RNA, 20 nt, Artificial Sequence
  MKO10098085_B_Mcoln3
  gRNA
uucgauccauguagcccuuu

SEQ ID NO: 98086 - RNA, 20 nt, Artificial Sequence
  MKO10098086_B_Mcoln3
  gRNA
gggucacugcaaagaugauc

SEQ ID NO: 98087 - RNA, 20 nt, Artificial Sequence
  MKO10098087_B_Mcph1
  gRNA
uuguggccuauguugaagua

SEQ ID NO: 98088 - RNA, 20 nt, Artificial Sequence
  MKO10098088_B_Mcph1
  gRNA
uucuacagaugcaggauggc

SEQ ID NO: 98089 - RNA, 20 nt, Artificial Sequence
  MKO10098089_B_Mcph1
  gRNA
ugcaaagcaacuugaggaua

SEQ ID NO: 98090 - RNA, 20 nt, Artificial Sequence
  MKO10098090_B_Mcpt1
  gRNA
uguccgugaugaucuucaga

SEQ ID NO: 98091 - RNA, 20 nt, Artificial Sequence
  MKO10098091_B_Mcpt1
  gRNA
cccaugguauuguaucuuau

SEQ ID NO: 98092 - RNA, 20 nt, Artificial Sequence
  MKO10098092_B_Mcpt1
  gRNA
ccccauaagauacaauacca

SEQ ID NO: 98093 - RNA, 20 nt, Artificial Sequence
  MKO10098093_B_Mcpt2
  gRNA
gccacacuaucacacacuag

SEQ ID NO: 98094 - RNA, 20 nt, Artificial Sequence
  MKO10098094_B_Mcpt2
  gRNA
cccaaaguuucaguaccuuu

SEQ ID NO: 98095 - RNA, 20 nt, Artificial Sequence
  MKO10098095_B_Mcpt2
  gRNA
gaaucuccuauuaccugccc

SEQ ID NO: 98096 - RNA, 20 nt, Artificial Sequence
  MKO10098096_B_Mcpt4
  gRNA
gguauuguaucuuauggacg

SEQ ID NO: 98097 - RNA, 20 nt, Artificial Sequence
  MKO10098097_B_Mcpt4
  gRNA
agcugugaacccucucucag

SEQ ID NO: 98098 - RNA, 20 nt, Artificial Sequence
  MKO10098098_B_Mcpt4
  gRNA
uuggaauagaaguuguacuu

SEQ ID NO: 98099 - RNA, 20 nt, Artificial Sequence
  MKO10098099_B_Mcpt8
  gRNA
uuacgaugucucuugccacc

SEQ ID NO: 98100 - RNA, 20 nt, Artificial Sequence
  MKO10098100_B_Mcpt8
  gRNA
gucaguugucgcuuguguac

SEQ ID NO: 98101 - RNA, 20 nt, Artificial Sequence
  MKO10098101_B_Mcpt8
  gRNA
ucauugucaaagcucucgug

SEQ ID NO: 98102 - RNA, 20 nt, Artificial Sequence
  MKO10098102_B_Mcpt9
  gRNA
uuggcaaagucagaggggcc

SEQ ID NO: 98103 - RNA, 20 nt, Artificial Sequence
  MKO10098103_B_Mcpt9
  gRNA
agaagaaugacugucacccu

SEQ ID NO: 98104 - RNA, 20 nt, Artificial Sequence
  MKO10098104_B_Mcpt9
  gRNA
uucucacauuaugagcucca

SEQ ID NO: 98105 - RNA, 20 nt, Artificial Sequence
  MKO10098105_B_Mcrs1
  gRNA
ucagcugccgcuucacccuu

SEQ ID NO: 98106 - RNA, 20 nt, Artificial Sequence
  MKO10098106_B_Mcrs1
  gRNA
ccugcagcacagcauugaug

SEQ ID NO: 98107 - RNA, 20 nt, Artificial Sequence
  MKO10098107_B_Mcrs1
  gRNA
gauagugcccagggccuggg

SEQ ID NO: 98108 - RNA, 20 nt, Artificial Sequence
  MKO10098108_B_Mcup1
  gRNA
cauuauccugaccaugaccu

SEQ ID NO: 98109 - RNA, 20 nt, Artificial Sequence
  MKO10098109_B_Mcup1
  gRNA
gaguuggaaaagauccagua

SEQ ID NO: 98110 - RNA, 20 nt, Artificial Sequence
  MKO10098110_B_Mcup1
  gRNA
auuuacagacaaugcuaaug

SEQ ID NO: 98111 - RNA, 20 nt, Artificial Sequence
  MKO10098111_B_Mcup2
  gRNA
acaacuaucucaucccaaau

SEQ ID NO: 98112 - RNA, 20 nt, Artificial Sequence
  MKO10098112_B_Mcup2
  gRNA
ucagagaucuugaacuuaac

SEQ ID NO: 98113 - RNA, 20 nt, Artificial Sequence
  MKO10098113_B_Mcup2
  gRNA
cuuaaccaagucugauuuca

SEQ ID NO: 98114 - RNA, 20 nt, Artificial Sequence
  MKO10098114_B_Mcus1
  gRNA
ccuuuaucaaccugcugaug

SEQ ID NO: 98115 - RNA, 20 nt, Artificial Sequence
  MKO10098115_B_Mcus1
  gRNA
uuaugaaguaaucuuaaagu

SEQ ID NO: 98116 - RNA, 20 nt, Artificial Sequence
  MKO10098116_B_Mcus1
  gRNA
aaaacaacaugcuuuaugug

SEQ ID NO: 98117 - RNA, 20 nt, Artificial Sequence
  MKO10098117_B_Mcus2
  gRNA
cucugccaugaccgccacga

SEQ ID NO: 98118 - RNA, 20 nt, Artificial Sequence
  MKO10098118_B_Mcus2
  gRNA
acugaaaacuuccguuauua

SEQ ID NO: 98119 - RNA, 20 nt, Artificial Sequence
  MKO10098119_B_Mcus2
  gRNA
uugugaaguagucuuagcgu

SEQ ID NO: 98120 - RNA, 20 nt, Artificial Sequence
  MKO10098120_B_Mcur1
  gRNA
gucugcuaagugccaucagc

SEQ ID NO: 98121 - RNA, 20 nt, Artificial Sequence
  MKO10098121_B_Mcur1
  gRNA
ccaucacuuguugcuuuaac

SEQ ID NO: 98122 - RNA, 20 nt, Artificial Sequence
  MKO10098122_B_Mcur1
  gRNA
agaaaucauugugucugcac

SEQ ID NO: 98123 - RNA, 20 nt, Artificial Sequence
  MKO10098123_B_Mcu
  gRNA
augacuuaacauaccacgua

SEQ ID NO: 98124 - RNA, 20 nt, Artificial Sequence
  MKO10098124_B_Mcu
  gRNA
cguucgagucgcugccucca

SEQ ID NO: 98125 - RNA, 20 nt, Artificial Sequence
  MKO10098125_B_Mcu
  gRNA
ucagcgucgcugcaucuuca

SEQ ID NO: 98126 - RNA, 20 nt, Artificial Sequence
  MKO10098126_B_Mdc1
  gRNA
ucccugccaguaccaucgcc

SEQ ID NO: 98127 - RNA, 20 nt, Artificial Sequence
  MKO10098127_B_Mdc1
  gRNA
gguguguggcgaauggacaa

SEQ ID NO: 98128 - RNA, 20 nt, Artificial Sequence
  MKO10098128_B_Mdc1
  gRNA
uucgccacacaccuuccaga

SEQ ID NO: 98129 - RNA, 20 nt, Artificial Sequence
  MKO10098129_B_Mdfic
  gRNA
gucccacucaccuucgggug

SEQ ID NO: 98130 - RNA, 20 nt, Artificial Sequence
  MKO10098130_B_Mdfic
  gRNA
cggagccaaacauguguccg

SEQ ID NO: 98131 - RNA, 20 nt, Artificial Sequence
  MKO10098131_B_Mdfic
  gRNA
acagucugacgauucacaac

SEQ ID NO: 98132 - RNA, 20 nt, Artificial Sequence
  MKO10098132_B_Mdfi
  gRNA
auggaugcgucugcaacuuc

SEQ ID NO: 98133 - RNA, 20 nt, Artificial Sequence
  MKO10098133_B_Mdfi
  gRNA
aagauccacucacccuguag

SEQ ID NO: 98134 - RNA, 20 nt, Artificial Sequence
  MKO10098134_B_Mdfi
  gRNA
gcauaucuccaagcagucug

SEQ ID NO: 98135 - RNA, 20 nt, Artificial Sequence
  MKO10098135_B_Mdga1
  gRNA
gaugccgcacacauugcgca

SEQ ID NO: 98136 - RNA, 20 nt, Artificial Sequence
  MKO10098136_B_Mdga1
  gRNA
ggcgccuguacccguggugu

SEQ ID NO: 98137 - RNA, 20 nt, Artificial Sequence
  MKO10098137_B_Mdga1
  gRNA
gucugaugcaccguuagcac

SEQ ID NO: 98138 - RNA, 20 nt, Artificial Sequence
  MKO10098138_B_Mdga2
  gRNA
agcaauaaagucgauccgag

SEQ ID NO: 98139 - RNA, 20 nt, Artificial Sequence
  MKO10098139_B_Mdga2
  gRNA
accccccugugcgcuauagc

SEQ ID NO: 98140 - RNA, 20 nt, Artificial Sequence
  MKO10098140_B_Mdga2
  gRNA
ccgaaagggucuauaccauc

SEQ ID NO: 98141 - RNA, 20 nt, Artificial Sequence
  MKO10098141_B_Mdh1b
  gRNA
ucacgcaacauccugacaag

SEQ ID NO: 98142 - RNA, 20 nt, Artificial Sequence
  MKO10098142_B_Mdh1b
  gRNA
agagaguugcuggaucgugg

SEQ ID NO: 98143 - RNA, 20 nt, Artificial Sequence
  MKO10098143_B_Mdh1b
  gRNA
ugucacuuccaacaugacga

SEQ ID NO: 98144 - RNA, 20 nt, Artificial Sequence
  MKO10098144_B_Mdh1
  gRNA
cacccccaugauggguguuc

SEQ ID NO: 98145 - RNA, 20 nt, Artificial Sequence
  MKO10098145_B_Mdh1
  gRNA
cacagucuugcaguuccauc

SEQ ID NO: 98146 - RNA, 20 nt, Artificial Sequence
  MKO10098146_B_Mdh1
  gRNA
guccauagaugucauugcaa

SEQ ID NO: 98147 - RNA, 20 nt, Artificial Sequence
  MKO10098147_B_Mdh2
  gRNA
cgucagagcgaacacguuug

SEQ ID NO: 98148 - RNA, 20 nt, Artificial Sequence
  MKO10098148_B_Mdh2
  gRNA
caguugccagauugccucaa

SEQ ID NO: 98149 - RNA, 20 nt, Artificial Sequence
  MKO10098149_B_Mdh2
  gRNA
gaucaucccaggaaugacac

SEQ ID NO: 98150 - RNA, 20 nt, Artificial Sequence
  MKO10098150_B_Mdk
  gRNA
accccuaggaugcagcaccg

SEQ ID NO: 98151 - RNA, 20 nt, Artificial Sequence
  MKO10098151_B_Mdk
  gRNA
gacccagcgcguccauugca

SEQ ID NO: 98152 - RNA, 20 nt, Artificial Sequence
  MKO10098152_B_Mdk
  gRNA
aggugcagggcuuagucacg

SEQ ID NO: 98153 - RNA, 20 nt, Artificial Sequence
  MKO10098153_B_Mdm1
  gRNA
aagccaugcgccaguuagcg

SEQ ID NO: 98154 - RNA, 20 nt, Artificial Sequence
  MKO10098154_B_Mdm1
  gRNA
uggguggguaccuucuuuac

SEQ ID NO: 98155 - RNA, 20 nt, Artificial Sequence
  MKO10098155_B_Mdm1
  gRNA
cucaugggcaggacuuagau

SEQ ID NO: 98156 - RNA, 20 nt, Artificial Sequence
  MKO10098156_B_Mdm2
  gRNA
uauuguucaaaugaucuccu

SEQ ID NO: 98157 - RNA, 20 nt, Artificial Sequence
  MKO10098157_B_Mdm2
  gRNA
uucagaucacucccaccuuc

SEQ ID NO: 98158 - RNA, 20 nt, Artificial Sequence
  MKO10098158_B_Mdm2
  gRNA
gagagcagacgucagccuga

SEQ ID NO: 98159 - RNA, 20 nt, Artificial Sequence
  MKO10098159_B_Mdm4
  gRNA
accuucagucggucuugacu

SEQ ID NO: 98160 - RNA, 20 nt, Artificial Sequence
  MKO10098160_B_Mdm4
  gRNA
gaagcagcucuaugaucaac

SEQ ID NO: 98161 - RNA, 20 nt, Artificial Sequence
  MKO10098161_B_Mdm4
  gRNA
uuucuuagcaugucauagag

SEQ ID NO: 98162 - RNA, 20 nt, Artificial Sequence
  MKO10098162_B_Mdn1
  gRNA
gcuacucacggaagaacguc

SEQ ID NO: 98163 - RNA, 20 nt, Artificial Sequence
  MKO10098163_B_Mdn1
  gRNA
uacagcuaacugucucgcuu

SEQ ID NO: 98164 - RNA, 20 nt, Artificial Sequence
  MKO10098164_B_Mdn1
  gRNA
aacacaaguuauccuucuua

SEQ ID NO: 98165 - RNA, 20 nt, Artificial Sequence
  MKO10098165_B_Mdp1
  gRNA
ccggguacaauuggauguuc

SEQ ID NO: 98166 - RNA, 20 nt, Artificial Sequence
  MKO10098166_B_Mdp1
  gRNA
auucagcgggaaaucuaccc

SEQ ID NO: 98167 - RNA, 20 nt, Artificial Sequence
  MKO10098167_B_Mdp1
  gRNA
aucauagacguuggcagacu

SEQ ID NO: 98168 - RNA, 20 nt, Artificial Sequence
  MKO10098168_B_Me1
  gRNA
cuggcccuguacacggcaug

SEQ ID NO: 98169 - RNA, 20 nt, Artificial Sequence
  MKO10098169_B_Me1
  gRNA
ccacagguaucuccuguuaa

SEQ ID NO: 98170 - RNA, 20 nt, Artificial Sequence
  MKO10098170_B_Me1
  gRNA
gagcuccuggcugaugaugc

SEQ ID NO: 98171 - RNA, 20 nt, Artificial Sequence
  MKO10098171_B_Me2
  gRNA
uuagaucaauuguggauaac

SEQ ID NO: 98172 - RNA, 20 nt, Artificial Sequence
  MKO10098172_B_Me2
  gRNA
acuguuggcguguacacaau

SEQ ID NO: 98173 - RNA, 20 nt, Artificial Sequence
  MKO10098173_B_Me2
  gRNA
uuacaagagcgacaaaugcu

SEQ ID NO: 98174 - RNA, 20 nt, Artificial Sequence
  MKO10098174_B_Me3
  gRNA
cagccucucuucaaguguaa

SEQ ID NO: 98175 - RNA, 20 nt, Artificial Sequence
  MKO10098175_B_Me3
  gRNA
uguuggugccaacaucuagc

SEQ ID NO: 98176 - RNA, 20 nt, Artificial Sequence
  MKO10098176_B_Me3
  gRNA
ugcccaugccguagcagccc

SEQ ID NO: 98177 - RNA, 20 nt, Artificial Sequence
  MKO10098177_B_Mea1
  gRNA
ggaguaagccugccugcacc

SEQ ID NO: 98178 - RNA, 20 nt, Artificial Sequence
  MKO10098178_B_Mea1
  gRNA
agagcuguggcugcucaaug

SEQ ID NO: 98179 - RNA, 20 nt, Artificial Sequence
  MKO10098179_B_Mea1
  gRNA
ggucuggcagaugaagcccc

SEQ ID NO: 98180 - RNA, 20 nt, Artificial Sequence
  MKO10098180_B_Meaf6
  gRNA
ggaaguucaaggaggccgaa

SEQ ID NO: 98181 - RNA, 20 nt, Artificial Sequence
  MKO10098181_B_Meaf6
  gRNA
auauuauccguggcugggau

SEQ ID NO: 98182 - RNA, 20 nt, Artificial Sequence
  MKO10098182_B_Meaf6
  gRNA
cuggaagacacucagaugua

SEQ ID NO: 98183 - RNA, 20 nt, Artificial Sequence
  MKO10098183_B_Mecom
  gRNA
ggucacauuccuuacagucc

SEQ ID NO: 98184 - RNA, 20 nt, Artificial Sequence
  MKO10098184_B_Mecom
  gRNA
cuguuugaggccugacgaag

SEQ ID NO: 98185 - RNA, 20 nt, Artificial Sequence
  MKO10098185_B_Mecom
  gRNA
cucagucaacuuugucccac

SEQ ID NO: 98186 - RNA, 20 nt, Artificial Sequence
  MKO10098186_B_Mecp2
  gRNA
gacggucagcaucgagguca

SEQ ID NO: 98187 - RNA, 20 nt, Artificial Sequence
  MKO10098187_B_Mecp2
  gRNA
aacaggauuccaugguagcu

SEQ ID NO: 98188 - RNA, 20 nt, Artificial Sequence
  MKO10098188_B_Mecp2
  gRNA
cccuaacaucccagcuacca

SEQ ID NO: 98189 - RNA, 20 nt, Artificial Sequence
  MKO10098189_B_Mecr
  gRNA
agggaacgaaggcguugggc

SEQ ID NO: 98190 - RNA, 20 nt, Artificial Sequence
  MKO10098190_B_Mecr
  gRNA
aggcgaucugaaugacugcu

SEQ ID NO: 98191 - RNA, 20 nt, Artificial Sequence
  MKO10098191_B_Mecr
  gRNA
aaggaucugacguccacgug

SEQ ID NO: 98192 - RNA, 20 nt, Artificial Sequence
  MKO10098192_B_Med10
  gRNA
gcucuacaccaaagaaugcc

SEQ ID NO: 98193 - RNA, 20 nt, Artificial Sequence
  MKO10098193_B_Med10
  gRNA
agcuaaaaacgagcaaguca

SEQ ID NO: 98194 - RNA, 20 nt, Artificial Sequence
  MKO10098194_B_Med10
  gRNA
ucccagaaacuuuauuguua

SEQ ID NO: 98195 - RNA, 20 nt, Artificial Sequence
  MKO10098195_B_Med11
  gRNA
ucgccacaucacuaaucuug

SEQ ID NO: 98196 - RNA, 20 nt, Artificial Sequence
  MKO10098196_B_Med11
  gRNA
ccaaggaaaagacuaacgag

SEQ ID NO: 98197 - RNA, 20 nt, Artificial Sequence
  MKO10098197_B_Med11
  gRNA
ccgccucaagauuagugaug

SEQ ID NO: 98198 - RNA, 20 nt, Artificial Sequence
  MKO10098198_B_Med12l
  gRNA
agcuaaguauucugugccaa

SEQ ID NO: 98199 - RNA, 20 nt, Artificial Sequence
  MKO10098199_B_Med12l
  gRNA
guuguacucccacugcuuca

SEQ ID NO: 98200 - RNA, 20 nt, Artificial Sequence
  MKO10098200_B_Med12l
  gRNA
gccauguucgucuccaguga

SEQ ID NO: 98201 - RNA, 20 nt, Artificial Sequence
  MKO10098201_B_Med12
  gRNA
caucacaggcaccguguauu

SEQ ID NO: 98202 - RNA, 20 nt, Artificial Sequence
  MKO10098202_B_Med12
  gRNA
cgucaacuucaauccugcca

SEQ ID NO: 98203 - RNA, 20 nt, Artificial Sequence
  MKO10098203_B_Med12
  gRNA
gaagucccuaaugaaccaga

SEQ ID NO: 98204 - RNA, 20 nt, Artificial Sequence
  MKO10098204_B_Med13l
  gRNA
uccucguugaucaaauagau

SEQ ID NO: 98205 - RNA, 20 nt, Artificial Sequence
  MKO10098205_B_Med13l
  gRNA
guuugugcggcccuaugaca

SEQ ID NO: 98206 - RNA, 20 nt, Artificial Sequence
  MKO10098206_B_Med13l
  gRNA
caugauguauuacucccacu

SEQ ID NO: 98207 - RNA, 20 nt, Artificial Sequence
  MKO10098207_B_Med13
  gRNA
aaauggcacucucacgggac

SEQ ID NO: 98208 - RNA, 20 nt, Artificial Sequence
  MKO10098208_B_Med13
  gRNA
uuccgccccuauucuguuuc

SEQ ID NO: 98209 - RNA, 20 nt, Artificial Sequence
  MKO10098209_B_Med13
  gRNA
ugccaauucguacaaaguuu

SEQ ID NO: 98210 - RNA, 20 nt, Artificial Sequence
  MKO10098210_B_Med14
  gRNA
acuguaagauuugcuagcug

SEQ ID NO: 98211 - RNA, 20 nt, Artificial Sequence
  MKO10098211_B_Med14
  gRNA
gaccagggcaucucuagcua

SEQ ID NO: 98212 - RNA, 20 nt, Artificial Sequence
  MKO10098212_B_Med14
  gRNA
uuaaucagauucuuagacau

SEQ ID NO: 98213 - RNA, 20 nt, Artificial Sequence
  MKO10098213_B_Med15
  gRNA
uuacccgggucuuggccuuc

SEQ ID NO: 98214 - RNA, 20 nt, Artificial Sequence
  MKO10098214_B_Med15
  gRNA
uauccuugcuagauuuacug

SEQ ID NO: 98215 - RNA, 20 nt, Artificial Sequence
  MKO10098215_B_Med15
  gRNA
ggaugaguaucuuucccuug

SEQ ID NO: 98216 - RNA, 20 nt, Artificial Sequence
  MKO10098216_B_Med16
  gRNA
cuuuacaccguugugcagcc

SEQ ID NO: 98217 - RNA, 20 nt, Artificial Sequence
  MKO10098217_B_Med16
  gRNA
cacccuggucaucauugcgu

SEQ ID NO: 98218 - RNA, 20 nt, Artificial Sequence
  MKO10098218_B_Med16
  gRNA
cgauggggucccccuccacc

SEQ ID NO: 98219 - RNA, 20 nt, Artificial Sequence
  MKO10098219_B_Med17
  gRNA
gugccaagaucaccaauguc

SEQ ID NO: 98220 - RNA, 20 nt, Artificial Sequence
  MKO10098220_B_Med17
  gRNA
uccaagaagaagucccucgc

SEQ ID NO: 98221 - RNA, 20 nt, Artificial Sequence
  MKO10098221_B_Med17
  gRNA
ugacauaccuggcuuggauu

SEQ ID NO: 98222 - RNA, 20 nt, Artificial Sequence
  MKO10098222_B_Med18
  gRNA
caugauggaguaccuccugc

SEQ ID NO: 98223 - RNA, 20 nt, Artificial Sequence
  MKO10098223_B_Med18
  gRNA
ggaagaccaucucgugauca

SEQ ID NO: 98224 - RNA, 20 nt, Artificial Sequence
  MKO10098224_B_Med18
  gRNA
auaccugggacagcccgaaa

SEQ ID NO: 98225 - RNA, 20 nt, Artificial Sequence
  MKO10098225_B_Med19
  gRNA
uuuaaucacacacuacaacc

SEQ ID NO: 98226 - RNA, 20 nt, Artificial Sequence
  MKO10098226_B_Med19
  gRNA
gcacaaacagagccgcaccc

SEQ ID NO: 98227 - RNA, 20 nt, Artificial Sequence
  MKO10098227_B_Med19
  gRNA
cuugagagcugcccauaccu

SEQ ID NO: 98228 - RNA, 20 nt, Artificial Sequence
  MKO10098228_B_Med1
  gRNA
uacuugacgcacaagcuuaa

SEQ ID NO: 98229 - RNA, 20 nt, Artificial Sequence
  MKO10098229_B_Med1
  gRNA
gauguaacacucagugccac

SEQ ID NO: 98230 - RNA, 20 nt, Artificial Sequence
  MKO10098230_B_Med1
  gRNA
auaccacaggauucucccca

SEQ ID NO: 98231 - RNA, 20 nt, Artificial Sequence
  MKO10098231_B_Med20
  gRNA
cacuaacggaucccagccac

SEQ ID NO: 98232 - RNA, 20 nt, Artificial Sequence
  MKO10098232_B_Med20
  gRNA
ggcucccuagaaaacucugu

SEQ ID NO: 98233 - RNA, 20 nt, Artificial Sequence
  MKO10098233_B_Med20
  gRNA
agacucuugcccucagccac

SEQ ID NO: 98234 - RNA, 20 nt, Artificial Sequence
  MKO10098234_B_Med21
  gRNA
agcagcuguagacucuucac

SEQ ID NO: 98235 - RNA, 20 nt, Artificial Sequence
  MKO10098235_B_Med21
  gRNA
agagucuacagcugcuuuac

SEQ ID NO: 98236 - RNA, 20 nt, Artificial Sequence
  MKO10098236_B_Med21
  gRNA
acacugcuguaauacaccaa

SEQ ID NO: 98237 - RNA, 20 nt, Artificial Sequence
  MKO10098237_B_Med22
  gRNA
ucgggcuacucagggcgaac

SEQ ID NO: 98238 - RNA, 20 nt, Artificial Sequence
  MKO10098238_B_Med22
  gRNA
cuuggcggucuugaugaucu

SEQ ID NO: 98239 - RNA, 20 nt, Artificial Sequence
  MKO10098239_B_Med22
  gRNA
cucgacgcagauucugcuga

SEQ ID NO: 98240 - RNA, 20 nt, Artificial Sequence
  MKO10098240_B_Med23
  gRNA
aaaguccacuccaaaacugc

SEQ ID NO: 98241 - RNA, 20 nt, Artificial Sequence
  MKO10098241_B_Med23
  gRNA
ccucuaugacugcuuagcaa

SEQ ID NO: 98242 - RNA, 20 nt, Artificial Sequence
  MKO10098242_B_Med23
  gRNA
cucugcaguugcgucuccau

SEQ ID NO: 98243 - RNA, 20 nt, Artificial Sequence
  MKO10098243_B_Med24
  gRNA
ugugcucaccgccaucagua

SEQ ID NO: 98244 - RNA, 20 nt, Artificial Sequence
  MKO10098244_B_Med24
  gRNA
cauacaggccuccucuaguu

SEQ ID NO: 98245 - RNA, 20 nt, Artificial Sequence
  MKO10098245_B_Med24
  gRNA
gaaguacgccauuaguuccc

SEQ ID NO: 98246 - RNA, 20 nt, Artificial Sequence
  MKO10098246_B_Med25
  gRNA
aggcugcacuaccgagagcc

SEQ ID NO: 98247 - RNA, 20 nt, Artificial Sequence
  MKO10098247_B_Med25
  gRNA
acgggggugaguugcagaug

SEQ ID NO: 98248 - RNA, 20 nt, Artificial Sequence
  MKO10098248_B_Med25
  gRNA
ccacgguguugaacaccaca

SEQ ID NO: 98249 - RNA, 20 nt, Artificial Sequence
  MKO10098249_B_Med26
  gRNA
uacguugcucugggagucga

SEQ ID NO: 98250 - RNA, 20 nt, Artificial Sequence
  MKO10098250_B_Med26
  gRNA
ccaggcaaugacagcggcuc

SEQ ID NO: 98251 - RNA, 20 nt, Artificial Sequence
  MKO10098251_B_Med26
  gRNA
gaugggguaucucuccagac

SEQ ID NO: 98252 - RNA, 20 nt, Artificial Sequence
  MKO10098252_B_Med27
  gRNA
cugauuugcagagcgcuuca

SEQ ID NO: 98253 - RNA, 20 nt, Artificial Sequence
  MKO10098253_B_Med27
  gRNA
aaccacccucuucauaacag

SEQ ID NO: 98254 - RNA, 20 nt, Artificial Sequence
  MKO10098254_B_Med27
  gRNA
ucucagacggcuugccuacc

SEQ ID NO: 98255 - RNA, 20 nt, Artificial Sequence
  MKO10098255_B_Med28
  gRNA
cgaguuggagucauccuucg

SEQ ID NO: 98256 - RNA, 20 nt, Artificial Sequence
  MKO10098256_B_Med28
  gRNA
uguaggaugucucggaacua

SEQ ID NO: 98257 - RNA, 20 nt, Artificial Sequence
  MKO10098257_B_Med28
  gRNA
uugcaauguccaaaaacuuc

SEQ ID NO: 98258 - RNA, 20 nt, Artificial Sequence
  MKO10098258_B_Med29
  gRNA
gcagcgcuuugacaaguguu

SEQ ID NO: 98259 - RNA, 20 nt, Artificial Sequence
  MKO10098259_B_Med29
  gRNA
uuaaaacuagacuuugauga

SEQ ID NO: 98260 - RNA, 20 nt, Artificial Sequence
  MKO10098260_B_Med29
  gRNA
uaguguucugaaucagauuc

SEQ ID NO: 98261 - RNA, 20 nt, Artificial Sequence
  MKO10098261_B_Med30
  gRNA
agaccggcuaacaaagcugc

SEQ ID NO: 98262 - RNA, 20 nt, Artificial Sequence
  MKO10098262_B_Med30
  gRNA
aucaauuacggaaucucauc

SEQ ID NO: 98263 - RNA, 20 nt, Artificial Sequence
  MKO10098263_B_Med30
  gRNA
gauggaccccauuccuguug

SEQ ID NO: 98264 - RNA, 20 nt, Artificial Sequence
  MKO10098264_B_Med31
  gRNA
cguaccugucuccauagcga

SEQ ID NO: 98265 - RNA, 20 nt, Artificial Sequence
  MKO10098265_B_Med31
  gRNA
aacuuacaauuaagguaguu

SEQ ID NO: 98266 - RNA, 20 nt, Artificial Sequence
  MKO10098266_B_Med31
  gRNA
cuuucaguucuugcccaaag

SEQ ID NO: 98267 - RNA, 20 nt, Artificial Sequence
  MKO10098267_B_Med4
  gRNA
ucucuaaagccugcauuucg

SEQ ID NO: 98268 - RNA, 20 nt, Artificial Sequence
  MKO10098268_B_Med4
  gRNA
uuaccuggaacccaagucag

SEQ ID NO: 98269 - RNA, 20 nt, Artificial Sequence
  MKO10098269_B_Med4
  gRNA
aaaucagaagcuauuacagc

SEQ ID NO: 98270 - RNA, 20 nt, Artificial Sequence
  MKO10098270_B_Med6
  gRNA
gccccuuucagucagauggu

SEQ ID NO: 98271 - RNA, 20 nt, Artificial Sequence
  MKO10098271_B_Med6
  gRNA
ucuuguuaccugaacaaauc

SEQ ID NO: 98272 - RNA, 20 nt, Artificial Sequence
  MKO10098272_B_Med6
  gRNA
auuuccacccagauuuguuc

SEQ ID NO: 98273 - RNA, 20 nt, Artificial Sequence
  MKO10098273_B_Med7
  gRNA
gauuugccccauucagaagc

SEQ ID NO: 98274 - RNA, 20 nt, Artificial Sequence
  MKO10098274_B_Med7
  gRNA
agcgccuugaaacagcugag

SEQ ID NO: 98275 - RNA, 20 nt, Artificial Sequence
  MKO10098275_B_Med7
  gRNA
uucuuaugaucaaauugcau

SEQ ID NO: 98276 - RNA, 20 nt, Artificial Sequence
  MKO10098276_B_Med8
  gRNA
gcaauccuuaccaggucagc

SEQ ID NO: 98277 - RNA, 20 nt, Artificial Sequence
  MKO10098277_B_Med8
  gRNA
aguuggaaaacgaguaugac

SEQ ID NO: 98278 - RNA, 20 nt, Artificial Sequence
  MKO10098278_B_Med8
  gRNA
auauuacagcgucaaacuga

SEQ ID NO: 98279 - RNA, 20 nt, Artificial Sequence
  MKO10098279_B_Med9
  gRNA
gcucacguggaugccgggca

SEQ ID NO: 98280 - RNA, 20 nt, Artificial Sequence
  MKO10098280_B_Med9
  gRNA
gggagcgcagcgaccggcag

SEQ ID NO: 98281 - RNA, 20 nt, Artificial Sequence
  MKO10098281_B_Med9
  gRNA
cuucugcagcagcucguucu

SEQ ID NO: 98282 - RNA, 20 nt, Artificial Sequence
  MKO10098282_B_Medag
  gRNA
uguguucacaagaaacgcau

SEQ ID NO: 98283 - RNA, 20 nt, Artificial Sequence
  MKO10098283_B_Medag
  gRNA
aacgauacugagcaaaccua

SEQ ID NO: 98284 - RNA, 20 nt, Artificial Sequence
  MKO10098284_B_Medag
  gRNA
uucagaccaaucagauaagu

SEQ ID NO: 98285 - RNA, 20 nt, Artificial Sequence
  MKO10098285_B_Mef2a
  gRNA
cugaaucuguccuccgagag

SEQ ID NO: 98286 - RNA, 20 nt, Artificial Sequence
  MKO10098286_B_Mef2a
  gRNA
gaguucguccugcuuucaug

SEQ ID NO: 98287 - RNA, 20 nt, Artificial Sequence
  MKO10098287_B_Mef2a
  gRNA
auaacgagccucaugaaagc

SEQ ID NO: 98288 - RNA, 20 nt, Artificial Sequence
  MKO10098288_B_Mef2b
  gRNA
ucacccgggggucgaaagug

SEQ ID NO: 98289 - RNA, 20 nt, Artificial Sequence
  MKO10098289_B_Mef2b
  gRNA
aguccucuuacauagauccg

SEQ ID NO: 98290 - RNA, 20 nt, Artificial Sequence
  MKO10098290_B_Mef2b
  gRNA
ucucacgaauucuagaccaa

SEQ ID NO: 98291 - RNA, 20 nt, Artificial Sequence
  MKO10098291_B_Mef2c
  gRNA
aguguccagccauaacaguu

SEQ ID NO: 98292 - RNA, 20 nt, Artificial Sequence
  MKO10098292_B_Mef2c
  gRNA
ugcuguacaccaaacuguua

SEQ ID NO: 98293 - RNA, 20 nt, Artificial Sequence
  MKO10098293_B_Mef2c
  gRNA
ggagaucugacauccggugc

SEQ ID NO: 98294 - RNA, 20 nt, Artificial Sequence
  MKO10098294_B_Mef2d
  gRNA
caaguaccggcgggccagug

SEQ ID NO: 98295 - RNA, 20 nt, Artificial Sequence
  MKO10098295_B_Mef2d
  gRNA
ccuggugacaucaucccuua

SEQ ID NO: 98296 - RNA, 20 nt, Artificial Sequence
  MKO10098296_B_Mef2d
  gRNA
cagcaauccaaguagcucuc

SEQ ID NO: 98297 - RNA, 20 nt, Artificial Sequence
  MKO10098297_B_Mefv
  gRNA
cuccccaaucaacgauguuu

SEQ ID NO: 98298 - RNA, 20 nt, Artificial Sequence
  MKO10098298_B_Mefv
  gRNA
caagaaaacagacgauuucc

SEQ ID NO: 98299 - RNA, 20 nt, Artificial Sequence
  MKO10098299_B_Mefv
  gRNA
uguuuagcagaugaucacca

SEQ ID NO: 98300 - RNA, 20 nt, Artificial Sequence
  MKO10098300_B_Megf10
  gRNA
cagcuacucggugacugugc

SEQ ID NO: 98301 - RNA, 20 nt, Artificial Sequence
  MKO10098301_B_Megf10
  gRNA
acuuacggacacacaugucu

SEQ ID NO: 98302 - RNA, 20 nt, Artificial Sequence
  MKO10098302_B_Megf10
  gRNA
uuggagcaaugcagcgacca

SEQ ID NO: 98303 - RNA, 20 nt, Artificial Sequence
  MKO10098303_B_Megf11
  gRNA
ugugaggaacucugcgcucc

SEQ ID NO: 98304 - RNA, 20 nt, Artificial Sequence
  MKO10098304_B_Megf11
  gRNA
gaugugcagacauccucaac

SEQ ID NO: 98305 - RNA, 20 nt, Artificial Sequence
  MKO10098305_B_Megf11
  gRNA
ggccccgauggcgccgucug

SEQ ID NO: 98306 - RNA, 20 nt, Artificial Sequence
  MKO10098306_B_Megf6
  gRNA
cgggcccucacagcccccgu

SEQ ID NO: 98307 - RNA, 20 nt, Artificial Sequence
  MKO10098307_B_Megf6
  gRNA
gaugaaugucgaucacacaa

SEQ ID NO: 98308 - RNA, 20 nt, Artificial Sequence
  MKO10098308_B_Megf6
  gRNA
cuguguacuauaugagcuac

SEQ ID NO: 98309 - RNA, 20 nt, Artificial Sequence
  MKO10098309_B_Megf8
  gRNA
auaacuucuccacgaacacc

SEQ ID NO: 98310 - RNA, 20 nt, Artificial Sequence
  MKO10098310_B_Megf8
  gRNA
uguaguuggcaucgcugaag

SEQ ID NO: 98311 - RNA, 20 nt, Artificial Sequence
  MKO10098311_B_Megf8
  gRNA
ggaccaugccgcugugaacc

SEQ ID NO: 98312 - RNA, 20 nt, Artificial Sequence
  MKO10098312_B_Megf9
  gRNA
cggugacacccacuuugcau

SEQ ID NO: 98313 - RNA, 20 nt, Artificial Sequence
  MKO10098313_B_Megf9
  gRNA
uggugcgagaaaugccuaga

SEQ ID NO: 98314 - RNA, 20 nt, Artificial Sequence
  MKO10098314_B_Megf9
  gRNA
gaacaucacaacuaucagac

SEQ ID NO: 98315 - RNA, 20 nt, Artificial Sequence
  MKO10098315_B_Mei1
  gRNA
acaagcucguccgccaaacc

SEQ ID NO: 98316 - RNA, 20 nt, Artificial Sequence
  MKO10098316_B_Mei1
  gRNA
caccuccuuggucgcucagc

SEQ ID NO: 98317 - RNA, 20 nt, Artificial Sequence
  MKO10098317_B_Mei1
  gRNA
auggcagaccucuguauuga

SEQ ID NO: 98318 - RNA, 20 nt, Artificial Sequence
  MKO10098318_B_Mei4
  gRNA
ugaccugggagccaucgauc

SEQ ID NO: 98319 - RNA, 20 nt, Artificial Sequence
  MKO10098319_B_Mei4
  gRNA
gagagacauaacgcuguacc

SEQ ID NO: 98320 - RNA, 20 nt, Artificial Sequence
  MKO10098320_B_Mei4
  gRNA
cauaaguagaacgcaaauaa

SEQ ID NO: 98321 - RNA, 20 nt, Artificial Sequence
  MKO10098321_B_Meig1
  gRNA
caauaagucgugccaagaaa

SEQ ID NO: 98322 - RNA, 20 nt, Artificial Sequence
  MKO10098322_B_Meig1
  gRNA
agacguaaaccuucacuuug

SEQ ID NO: 98323 - RNA, 20 nt, Artificial Sequence
  MKO10098323_B_Meig1
  gRNA
gguacgugaagaaacuucag

SEQ ID NO: 98324 - RNA, 20 nt, Artificial Sequence
  MKO10098324_B_Meiob
  gRNA
aaaauaaucggaauaguuau

SEQ ID NO: 98325 - RNA, 20 nt, Artificial Sequence
  MKO10098325_B_Meiob
  gRNA
gcucgcuguccgagagcuuc

SEQ ID NO: 98326 - RNA, 20 nt, Artificial Sequence
  MKO10098326_B_Meiob
  gRNA
acuuugugaauguauccucc

SEQ ID NO: 98327 - RNA, 20 nt, Artificial Sequence
  MKO10098327_B_Meis1
  gRNA
ggguacugaugcgagugcag

SEQ ID NO: 98328 - RNA, 20 nt, Artificial Sequence
  MKO10098328_B_Meis1
  gRNA
cuuaccaaguuauccaguuc

SEQ ID NO: 98329 - RNA, 20 nt, Artificial Sequence
  MKO10098329_B_Meis1
  gRNA
auucucuucuaauccagaac

SEQ ID NO: 98330 - RNA, 20 nt, Artificial Sequence
  MKO10098330_B_Meis2
  gRNA
agaggaacagacgucuccgc

SEQ ID NO: 98331 - RNA, 20 nt, Artificial Sequence
  MKO10098331_B_Meis2
  gRNA
cuuaccaaauuauccagcuc

SEQ ID NO: 98332 - RNA, 20 nt, Artificial Sequence
  MKO10098332_B_Meis2
  gRNA
uacaagcaauucaaguacua

SEQ ID NO: 98333 - RNA, 20 nt, Artificial Sequence
  MKO10098333_B_Meis3
  gRNA
accggaguaccuggauggcc

SEQ ID NO: 98334 - RNA, 20 nt, Artificial Sequence
  MKO10098334_B_Meis3
  gRNA
gcugggcuggguucaccccc

SEQ ID NO: 98335 - RNA, 20 nt, Artificial Sequence
  MKO10098335_B_Meis3
  gRNA
ccuucaguaccuagagcccc

SEQ ID NO: 98336 - RNA, 20 nt, Artificial Sequence
  MKO10098336_B_Melk
  gRNA
guacucagguggcuuugcaa

SEQ ID NO: 98337 - RNA, 20 nt, Artificial Sequence
  MKO10098337_B_Melk
  gRNA
uagcuaccaucucuccagug

SEQ ID NO: 98338 - RNA, 20 nt, Artificial Sequence
  MKO10098338_B_Melk
  gRNA
augucagcucuaccaugugc

SEQ ID NO: 98339 - RNA, 20 nt, Artificial Sequence
  MKO10098339_B_Memo1
  gRNA
uaaaacuuacggugcaauaa

SEQ ID NO: 98340 - RNA, 20 nt, Artificial Sequence
  MKO10098340_B_Memo1
  gRNA
caugcgggauacacauacug

SEQ ID NO: 98341 - RNA, 20 nt, Artificial Sequence
  MKO10098341_B_Memo1
  gRNA
ucaauacgaagaucauacag

SEQ ID NO: 98342 - RNA, 20 nt, Artificial Sequence
  MKO10098342_B_Men1
  gRNA
agcgcauguacgaccccuuc

SEQ ID NO: 98343 - RNA, 20 nt, Artificial Sequence
  MKO10098343_B_Men1
  gRNA
cacgcccgagcuguccaguu

SEQ ID NO: 98344 - RNA, 20 nt, Artificial Sequence
  MKO10098344_B_Men1
  gRNA
gcuguaugaccucggacauc

SEQ ID NO: 98345 - RNA, 20 nt, Artificial Sequence
  MKO10098345_B_Meox1
  gRNA
cccaccacaacuaccugacc

SEQ ID NO: 98346 - RNA, 20 nt, Artificial Sequence
  MKO10098346_B_Meox1
  gRNA
ggagcaucucacucugaacu

SEQ ID NO: 98347 - RNA, 20 nt, Artificial Sequence
  MKO10098347_B_Meox1
  gRNA
uccucuuucaggucaaaguc

SEQ ID NO: 98348 - RNA, 20 nt, Artificial Sequence
  MKO10098348_B_Meox2
  gRNA
acguuaccugucuuucagug

SEQ ID NO: 98349 - RNA, 20 nt, Artificial Sequence
  MKO10098349_B_Meox2
  gRNA
cgggucaaagggggacagca

SEQ ID NO: 98350 - RNA, 20 nt, Artificial Sequence
  MKO10098350_B_Meox2
  gRNA
cuagugaguccccugucugc

SEQ ID NO: 98351 - RNA, 20 nt, Artificial Sequence
  MKO10098351_B_Mep1a
  gRNA
gcagaucacgauacagaugu

SEQ ID NO: 98352 - RNA, 20 nt, Artificial Sequence
  MKO10098352_B_Mep1a
  gRNA
gcaggccugaaccucuuuca

SEQ ID NO: 98353 - RNA, 20 nt, Artificial Sequence
  MKO10098353_B_Mep1a
  gRNA
ggggagcuuccaucugcuug

SEQ ID NO: 98354 - RNA, 20 nt, Artificial Sequence
  MKO10098354_B_Mep1b
  gRNA
ucuucucuuagguuuggguc

SEQ ID NO: 98355 - RNA, 20 nt, Artificial Sequence
  MKO10098355_B_Mep1b
  gRNA
aaugggaagaauuccaucau

SEQ ID NO: 98356 - RNA, 20 nt, Artificial Sequence
  MKO10098356_B_Mep1b
  gRNA
gguuaauaucaaauaugucu

SEQ ID NO: 98357 - RNA, 20 nt, Artificial Sequence
  MKO10098357_B_Mepce
  gRNA
ccagaauacccccagggcgc

SEQ ID NO: 98358 - RNA, 20 nt, Artificial Sequence
  MKO10098358_B_Mepce
  gRNA
acaccgaauaacaccuccag

SEQ ID NO: 98359 - RNA, 20 nt, Artificial Sequence
  MKO10098359_B_Mepce
  gRNA
uuaccucuggagguguuauu

SEQ ID NO: 98360 - RNA, 20 nt, Artificial Sequence
  MKO10098360_B_Mepe
  gRNA
ugcuccucuucaguaugacc

SEQ ID NO: 98361 - RNA, 20 nt, Artificial Sequence
  MKO10098361_B_Mepe
  gRNA
aauaaucuuacaccgaauaa

SEQ ID NO: 98362 - RNA, 20 nt, Artificial Sequence
  MKO10098362_B_Mepe
  gRNA
agugagugcuccgucggguc

SEQ ID NO: 98363 - RNA, 20 nt, Artificial Sequence
  MKO10098363_B_Mertk
  gRNA
gauuaaacgcaacaggaggu

SEQ ID NO: 98364 - RNA, 20 nt, Artificial Sequence
  MKO10098364_B_Mertk
  gRNA
cgacaguacuauguguccaa

SEQ ID NO: 98365 - RNA, 20 nt, Artificial Sequence
  MKO10098365_B_Mertk
  gRNA
auugucugagcgcugcacac

SEQ ID NO: 98366 - RNA, 20 nt, Artificial Sequence
  MKO10098366_B_Mesdc1
  gRNA
gcgauggcuagcggcagcgc

SEQ ID NO: 98367 - RNA, 20 nt, Artificial Sequence
  MKO10098367_B_Mesdc1
  gRNA
ugaagagcgcgcaacgacug

SEQ ID NO: 98368 - RNA, 20 nt, Artificial Sequence
  MKO10098368_B_Mesdc1
  gRNA
cuccugggagcgccgucggc

SEQ ID NO: 98369 - RNA, 20 nt, Artificial Sequence
  MKO10098369_B_Mesdc2
  gRNA
cgauuacaacgaugccgaca

SEQ ID NO: 98370 - RNA, 20 nt, Artificial Sequence
  MKO10098370_B_Mesdc2
  gRNA
ucuagcuuugagaagucgau

SEQ ID NO: 98371 - RNA, 20 nt, Artificial Sequence
  MKO10098371_B_Mesdc2
  gRNA
ucucuggcuagguucaucgu

SEQ ID NO: 98372 - RNA, 20 nt, Artificial Sequence
  MKO10098372_B_Mesp1
  gRNA
ccacuccugcggcggcgucc

SEQ ID NO: 98373 - RNA, 20 nt, Artificial Sequence
  MKO10098373_B_Mesp1
  gRNA
acaccgcgugccgcugucgc

SEQ ID NO: 98374 - RNA, 20 nt, Artificial Sequence
  MKO10098374_B_Mesp1
  gRNA
ggcaccgucccacggguccg

SEQ ID NO: 98375 - RNA, 20 nt, Artificial Sequence
  MKO10098375_B_Mesp2
  gRNA
cugcuggggccacgaugcag

SEQ ID NO: 98376 - RNA, 20 nt, Artificial Sequence
  MKO10098376_B_Mesp2
  gRNA
cgaacgcgcccagcgcccgc

SEQ ID NO: 98377 - RNA, 20 nt, Artificial Sequence
  MKO10098377_B_Mesp2
  gRNA
acgccgcguccgcacuccgu

SEQ ID NO: 98378 - RNA, 20 nt, Artificial Sequence
  MKO10098378_B_Mest
  gRNA
cagaagggacucuacgaugc

SEQ ID NO: 98379 - RNA, 20 nt, Artificial Sequence
  MKO10098379_B_Mest
  gRNA
caccuugguagaagaugcgu

SEQ ID NO: 98380 - RNA, 20 nt, Artificial Sequence
  MKO10098380_B_Mest
  gRNA
ccuccuagauucugucggug

SEQ ID NO: 98381 - RNA, 20 nt, Artificial Sequence
  MKO10098381_B_Meuap1d
  gRNA
agauagaugcgcuuguucau

SEQ ID NO: 98382 - RNA, 20 nt, Artificial Sequence
  MKO10098382_B_Meuap1d
  gRNA
augccugucgucacguaguc

SEQ ID NO: 98383 - RNA, 20 nt, Artificial Sequence
  MKO10098383_B_Meuap1d
  gRNA
ugugcgggagagacggcagc

SEQ ID NO: 98384 - RNA, 20 nt, Artificial Sequence
  MKO10098384_B_Meuap1
  gRNA
aagggauggucagcauaguc

SEQ ID NO: 98385 - RNA, 20 nt, Artificial Sequence
  MKO10098385_B_Meuap1
  gRNA
cucugaauguaacugggcac

SEQ ID NO: 98386 - RNA, 20 nt, Artificial Sequence
  MKO10098386_B_Meuap1
  gRNA
ugagaguaacuuaaucugag

SEQ ID NO: 98387 - RNA, 20 nt, Artificial Sequence
  MKO10098387_B_Meuap2
  gRNA
guauucacacucuuguccuu

SEQ ID NO: 98388 - RNA, 20 nt, Artificial Sequence
  MKO10098388_B_Meuap2
  gRNA
caagaacuugauaaagaauc

SEQ ID NO: 98389 - RNA, 20 nt, Artificial Sequence
  MKO10098389_B_Meuap2
  gRNA
ucuccuucuccuccagugcu

SEQ ID NO: 98390 - RNA, 20 nt, Artificial Sequence
  MKO10098390_B_Metrnl
  gRNA
cggccggagcaugcggggug

SEQ ID NO: 98391 - RNA, 20 nt, Artificial Sequence
  MKO10098391_B_Metrnl
  gRNA
acuccagcgaccugugcagc

SEQ ID NO: 98392 - RNA, 20 nt, Artificial Sequence
  MKO10098392_B_Metrnl
  gRNA
ucggccuugcagugacacug

SEQ ID NO: 98393 - RNA, 20 nt, Artificial Sequence
  MKO10098393_B_Metrn
  gRNA
auucguaccuugcugcgcug

SEQ ID NO: 98394 - RNA, 20 nt, Artificial Sequence
  MKO10098394_B_Metrn
  gRNA
guacugagggcgcuaucgag

SEQ ID NO: 98395 - RNA, 20 nt, Artificial Sequence
  MKO10098395_B_Metrn
  gRNA
cuucuuugcgcgcucuguug

SEQ ID NO: 98396 - RNA, 20 nt, Artificial Sequence
  MKO10098396_B_Meuul10
  gRNA
aguaugugaugucucucucc

SEQ ID NO: 98397 - RNA, 20 nt, Artificial Sequence
  MKO10098397_B_Meuul10
  gRNA
caugguuucucuaauauaac

SEQ ID NO: 98398 - RNA, 20 nt, Artificial Sequence
  MKO10098398_B_Meuul10
  gRNA
uugcuagaugcauucaguga

SEQ ID NO: 98399 - RNA, 20 nt, Artificial Sequence
  MKO10098399_B_Meuul11b
  gRNA
ugacaucauaucucccuaag

SEQ ID NO: 98400 - RNA, 20 nt, Artificial Sequence
  MKO10098400_B_Meuul11b
  gRNA
acauccuucgaagccuuauu

SEQ ID NO: 98401 - RNA, 20 nt, Artificial Sequence
  MKO10098401_B_Meuul11b
  gRNA
ugcaggguaccugacugaua

SEQ ID NO: 98402 - RNA, 20 nt, Artificial Sequence
  MKO10098402_B_Meuul13
  gRNA
cccagggucgcgagaccgag

SEQ ID NO: 98403 - RNA, 20 nt, Artificial Sequence
  MKO10098403_B_Meuul13
  gRNA
uuuccaugccagcauaccgc

SEQ ID NO: 98404 - RNA, 20 nt, Artificial Sequence
  MKO10098404_B_Meuul13
  gRNA
cucuuaucgauggacugccc

SEQ ID NO: 98405 - RNA, 20 nt, Artificial Sequence
  MKO10098405_B_Meuul14
  gRNA
caucugcuccaaacucaaaa

SEQ ID NO: 98406 - RNA, 20 nt, Artificial Sequence
  MKO10098406_B_Meuul14
  gRNA
acaucccugaugaaauucug

SEQ ID NO: 98407 - RNA, 20 nt, Artificial Sequence
  MKO10098407_B_Meuul14
  gRNA
cuaguugggagcugagagug

SEQ ID NO: 98408 - RNA, 20 nt, Artificial Sequence
  MKO10098408_B_Meuul15
  gRNA
cauuguucacaaagaugcga

SEQ ID NO: 98409 - RNA, 20 nt, Artificial Sequence
  MKO10098409_B_Meuul15
  gRNA
aaguguaccugcaacaaugc

SEQ ID NO: 98410 - RNA, 20 nt, Artificial Sequence
  MKO10098410_B_Meuul15
  gRNA
uguauguccuccugaaccaa

SEQ ID NO: 98411 - RNA, 20 nt, Artificial Sequence
  MKO10098411_B_Meuul16
  gRNA
guggaggucuucgagaauuc

SEQ ID NO: 98412 - RNA, 20 nt, Artificial Sequence
  MKO10098412_B_Meuul16
  gRNA
cauaaucucugugaugcccc

SEQ ID NO: 98413 - RNA, 20 nt, Artificial Sequence
  MKO10098413_B_Meuul16
  gRNA
auuuaagguugcuccaagua

SEQ ID NO: 98414 - RNA, 20 nt, Artificial Sequence
  MKO10098414_B_Meuul17
  gRNA
agcaaaaccaccguccaauc

SEQ ID NO: 98415 - RNA, 20 nt, Artificial Sequence
  MKO10098415_B_Meuul17
  gRNA
ccgacauuuaccuguagagc

SEQ ID NO: 98416 - RNA, 20 nt, Artificial Sequence
  MKO10098416_B_Meuul17
  gRNA
gcccgucuuugcaacuccuc

SEQ ID NO: 98417 - RNA, 20 nt, Artificial Sequence
  MKO10098417_B_Meuul18
  gRNA
cauuuccaagagugaucccg

SEQ ID NO: 98418 - RNA, 20 nt, Artificial Sequence
  MKO10098418_B_Meuul18
  gRNA
uaggaguggccgggugcuuc

SEQ ID NO: 98419 - RNA, 20 nt, Artificial Sequence
  MKO10098419_B_Meuul18
  gRNA
uguaaaugucgcuuguucuc

SEQ ID NO: 98420 - RNA, 20 nt, Artificial Sequence
  MKO10098420_B_Meuul1
  gRNA
cgucggugacgguguacacc

SEQ ID NO: 98421 - RNA, 20 nt, Artificial Sequence
  MKO10098421_B_Meuul1
  gRNA
aaucaucagcccuacgcuuc

SEQ ID NO: 98422 - RNA, 20 nt, Artificial Sequence
  MKO10098422_B_Meuul1
  gRNA
ccuuccuaauuucuuccgca

SEQ ID NO: 98423 - RNA, 20 nt, Artificial Sequence
  MKO10098423_B_Meuul20
  gRNA
cuuugaugcuccacucaucu

SEQ ID NO: 98424 - RNA, 20 nt, Artificial Sequence
  MKO10098424_B_Meuul20
  gRNA
gauaacccugcuguuguuag

SEQ ID NO: 98425 - RNA, 20 nt, Artificial Sequence
  MKO10098425_B_Meuul20
  gRNA
acugaccacaagugcuguau

SEQ ID NO: 98426 - RNA, 20 nt, Artificial Sequence
  MKO10098426_B_Meuul21a
  gRNA
ccacaccauccagauccguc

SEQ ID NO: 98427 - RNA, 20 nt, Artificial Sequence
  MKO10098427_B_Meuul21a
  gRNA
ugucguccuuuccauguauc

SEQ ID NO: 98428 - RNA, 20 nt, Artificial Sequence
  MKO10098428_B_Meuul21a
  gRNA
agcacccaucuccagauaca

SEQ ID NO: 98429 - RNA, 20 nt, Artificial Sequence
  MKO10098429_B_Meuul21c
  gRNA
agucuguaggaacaaauuuc

SEQ ID NO: 98430 - RNA, 20 nt, Artificial Sequence
  MKO10098430_B_Meuul21c
  gRNA
ugguagcgagcagcuugucc

SEQ ID NO: 98431 - RNA, 20 nt, Artificial Sequence
  MKO10098431_B_Meuul21c
  gRNA
auauuuagaagaccauacag

SEQ ID NO: 98432 - RNA, 20 nt, Artificial Sequence
  MKO10098432_B_Meuul21e
  gRNA
caugagauucagauuacuga

SEQ ID NO: 98433 - RNA, 20 nt, Artificial Sequence
  MKO10098433_B_Meuul21e
  gRNA
accaaguaagcuugccacaa

SEQ ID NO: 98434 - RNA, 20 nt, Artificial Sequence
  MKO10098434_B_Meuul21e
  gRNA
acaugccaagcaauauaaca

SEQ ID NO: 98435 - RNA, 20 nt, Artificial Sequence
  MKO10098435_B_Meuul22
  gRNA
guugaguguuccccuggacg

SEQ ID NO: 98436 - RNA, 20 nt, Artificial Sequence
  MKO10098436_B_Meuul22
  gRNA
uguugagggcaacguuucgu

SEQ ID NO: 98437 - RNA, 20 nt, Artificial Sequence
  MKO10098437_B_Meuul22
  gRNA
auccuuuccagagcacacca

SEQ ID NO: 98438 - RNA, 20 nt, Artificial Sequence
  MKO10098438_B_Meuul23
  gRNA
ucgaaguuguaggacugaca

SEQ ID NO: 98439 - RNA, 20 nt, Artificial Sequence
  MKO10098439_B_Meuul23
  gRNA
gaaaugugugcauauuccuc

SEQ ID NO: 98440 - RNA, 20 nt, Artificial Sequence
  MKO10098440_B_Meuul23
  gRNA
uugggccaggacuacagcac

SEQ ID NO: 98441 - RNA, 20 nt, Artificial Sequence
  MKO10098441_B_Meuul24
  gRNA
guuacagaucgacguucuca

SEQ ID NO: 98442 - RNA, 20 nt, Artificial Sequence
  MKO10098442_B_Meuul24
  gRNA
acagauugcaugcgaucaca

SEQ ID NO: 98443 - RNA, 20 nt, Artificial Sequence
  MKO10098443_B_Meuul24
  gRNA
guccuucacaggguucccga

SEQ ID NO: 98444 - RNA, 20 nt, Artificial Sequence
  MKO10098444_B_Meuul25
  gRNA
aguacuuacuaucuuuaugc

SEQ ID NO: 98445 - RNA, 20 nt, Artificial Sequence
  MKO10098445_B_Meuul25
  gRNA
gcacuauucugugcaaaacu

SEQ ID NO: 98446 - RNA, 20 nt, Artificial Sequence
  MKO10098446_B_Meuul25
  gRNA
cagaauagugcuuugcaguu

SEQ ID NO: 98447 - RNA, 20 nt, Artificial Sequence
  MKO10098447_B_Meuul2
  gRNA
guacacccgucaggugacug

SEQ ID NO: 98448 - RNA, 20 nt, Artificial Sequence
  MKO10098448_B_Meuul2
  gRNA
cuugagcaguucaauagccg

SEQ ID NO: 98449 - RNA, 20 nt, Artificial Sequence
  MKO10098449_B_Meuul2
  gRNA
agucacaacaguaaacgaag

SEQ ID NO: 98450 - RNA, 20 nt, Artificial Sequence
  MKO10098450_B_Meuul3
  gRNA
guuggggacagugccgcuuc

SEQ ID NO: 98451 - RNA, 20 nt, Artificial Sequence
  MKO10098451_B_Meuul3
  gRNA
gcagaaacggcgugcagaac

SEQ ID NO: 98452 - RNA, 20 nt, Artificial Sequence
  MKO10098452_B_Meuul3
  gRNA
uaggcacgggacuaucacua

SEQ ID NO: 98453 - RNA, 20 nt, Artificial Sequence
  MKO10098453_B_Meuul4
  gRNA
ucuucgaaguuaauccaaga

SEQ ID NO: 98454 - RNA, 20 nt, Artificial Sequence
  MKO10098454_B_Meuul4
  gRNA
caauugugauugauccacca

SEQ ID NO: 98455 - RNA, 20 nt, Artificial Sequence
  MKO10098455_B_Meuul4
  gRNA
agaugcauugcuuucaauca

SEQ ID NO: 98456 - RNA, 20 nt, Artificial Sequence
  MKO10098456_B_Meuul5
  gRNA
cuuuacacaaguccucaacu

SEQ ID NO: 98457 - RNA, 20 nt, Artificial Sequence
  MKO10098457_B_Meuul5
  gRNA
gucaagauagaaauuauugc

SEQ ID NO: 98458 - RNA, 20 nt, Artificial Sequence
  MKO10098458_B_Meuul5
  gRNA
aauuacuguaucaaauaacu

SEQ ID NO: 98459 - RNA, 20 nt, Artificial Sequence
  MKO10098459_B_Meuul6
  gRNA
uucacguagucaacugcccu

SEQ ID NO: 98460 - RNA, 20 nt, Artificial Sequence
  MKO10098460_B_Meuul6
  gRNA
cuggguccuucggaggcuuc

SEQ ID NO: 98461 - RNA, 20 nt, Artificial Sequence
  MKO10098461_B_Meuul6
  gRNA
cauccacaaagagcugcgcc

SEQ ID NO: 98462 - RNA, 20 nt, Artificial Sequence
  MKO10098462_B_Meuul7a1
  gRNA
caucugcucauuguacauca

SEQ ID NO: 98463 - RNA, 20 nt, Artificial Sequence
  MKO10098463_B_Meuul7a1
  gRNA
gaacaagaacuucucgaagu

SEQ ID NO: 98464 - RNA, 20 nt, Artificial Sequence
  MKO10098464_B_Meuul7a1
  gRNA
cccucuccuggacauuggug

SEQ ID NO: 98465 - RNA, 20 nt, Artificial Sequence
  MKO10098465_B_Meuul7a2Higd1c
  gRNA
gccagcugucccgacuccuc

SEQ ID NO: 98466 - RNA, 20 nt, Artificial Sequence
  MKO10098466_B_Meuul7a2Higd1c
  gRNA
uguucucuacucuauguaua

SEQ ID NO: 98467 - RNA, 20 nt, Artificial Sequence
  MKO10098467_B_Meuul7a2Higd1c
  gRNA
ccaggagaagauucugcgcg

SEQ ID NO: 98468 - RNA, 20 nt, Artificial Sequence
  MKO10098468_B_Meuul7a2
  gRNA
cgcaccaaggucaaggggag

SEQ ID NO: 98469 - RNA, 20 nt, Artificial Sequence
  MKO10098469_B_Meuul7a2
  gRNA
cucggggaagcuaacucugc

SEQ ID NO: 98470 - RNA, 20 nt, Artificial Sequence
  MKO10098470_B_Meuul7a2
  gRNA
ccucgcgcagaaucuucucc

SEQ ID NO: 98471 - RNA, 20 nt, Artificial Sequence
  MKO10098471_B_Meuul7a3
  gRNA
cgcaccaaggucaaggggag

SEQ ID NO: 98472 - RNA, 20 nt, Artificial Sequence
  MKO10098472_B_Meuul7a3
  gRNA
auauuucugcugaacauucu

SEQ ID NO: 98473 - RNA, 20 nt, Artificial Sequence
  MKO10098473_B_Meuul7a3
  gRNA
uagaauguucagcagaaaua

SEQ ID NO: 98474 - RNA, 20 nt, Artificial Sequence
  MKO10098474_B_Meuul7b
  gRNA
gcucuaaaacucgcugccac

SEQ ID NO: 98475 - RNA, 20 nt, Artificial Sequence
  MKO10098475_B_Meuul7b
  gRNA
aaccuacuucccuuacuuca

SEQ ID NO: 98476 - RNA, 20 nt, Artificial Sequence
  MKO10098476_B_Meuul7b
  gRNA
ccaauaugagcgcuucauug

SEQ ID NO: 98477 - RNA, 20 nt, Artificial Sequence
  MKO10098477_B_Meuul8
  gRNA
aaacucacugcaagguguuc

SEQ ID NO: 98478 - RNA, 20 nt, Artificial Sequence
  MKO10098478_B_Meuul8
  gRNA
uuaauagggaucacaugcag

SEQ ID NO: 98479 - RNA, 20 nt, Artificial Sequence
  MKO10098479_B_Meuul8
  gRNA
aaagucgcagcaguagagaa

SEQ ID NO: 98480 - RNA, 20 nt, Artificial Sequence
  MKO10098480_B_Meuul9
  gRNA
caccuaaaucaagaagucua

SEQ ID NO: 98481 - RNA, 20 nt, Artificial Sequence
  MKO10098481_B_Meuul9
  gRNA
uguacaugucgccuucacac

SEQ ID NO: 98482 - RNA, 20 nt, Artificial Sequence
  MKO10098482_B_Meuul9
  gRNA
uagauguucuagacauaaac

SEQ ID NO: 98483 - RNA, 20 nt, Artificial Sequence
  MKO10098483_B_Met
  gRNA
auuugucgugcucucgcuua

SEQ ID NO: 98484 - RNA, 20 nt, Artificial Sequence
  MKO10098484_B_Met
  gRNA
cccaccagcgcgccccuuga

SEQ ID NO: 98485 - RNA, 20 nt, Artificial Sequence
  MKO10098485_B_Met
  gRNA
cucuugaguccauguaccgc

SEQ ID NO: 98486 - RNA, 20 nt, Artificial Sequence
  MKO10098486_B_Mex3a
  gRNA
cgugcccaccuccgagcacg

SEQ ID NO: 98487 - RNA, 20 nt, Artificial Sequence
  MKO10098487_B_Mex3a
  gRNA
cgcgcgugccuuggcugaag

SEQ ID NO: 98488 - RNA, 20 nt, Artificial Sequence
  MKO10098488_B_Mex3a
  gRNA
cgcgcacgcuccacguugcc

SEQ ID NO: 98489 - RNA, 20 nt, Artificial Sequence
  MKO10098489_B_Mex3b
  gRNA
ggagcugucguugcgauagc

SEQ ID NO: 98490 - RNA, 20 nt, Artificial Sequence
  MKO10098490_B_Mex3b
  gRNA
gcccaguucgagcgcucucc

SEQ ID NO: 98491 - RNA, 20 nt, Artificial Sequence
  MKO10098491_B_Mex3b
  gRNA
ugggagggcuauaguccgcc

SEQ ID NO: 98492 - RNA, 20 nt, Artificial Sequence
  MKO10098492_B_Mex3c
  gRNA
agcccguccccuucgagcuc

SEQ ID NO: 98493 - RNA, 20 nt, Artificial Sequence
  MKO10098493_B_Mex3c
  gRNA
cucccagacucagccgaucc

SEQ ID NO: 98494 - RNA, 20 nt, Artificial Sequence
  MKO10098494_B_Mex3c
  gRNA
cggcgcagugccaggcccgg

SEQ ID NO: 98495 - RNA, 20 nt, Artificial Sequence
  MKO10098495_B_Mex3d
  gRNA
cucacgucgggguccaaaag

SEQ ID NO: 98496 - RNA, 20 nt, Artificial Sequence
  MKO10098496_B_Mex3d
  gRNA
ucucucgaagggcgcccaaa

SEQ ID NO: 98497 - RNA, 20 nt, Artificial Sequence
  MKO10098497_B_Mex3d
  gRNA
gcauccgcacccugcacucg

SEQ ID NO: 98498 - RNA, 20 nt, Artificial Sequence
  MKO10098498_B_Mfap1a
  gRNA
ggaacaagaagcaaaacgca

SEQ ID NO: 98499 - RNA, 20 nt, Artificial Sequence
  MKO10098499_B_Mfap1a
  gRNA
agagaccaagaaagagcuag

SEQ ID NO: 98500 - RNA, 20 nt, Artificial Sequence
  MKO10098500_B_Mfap1a
  gRNA
caagcggucucuugcugccc

SEQ ID NO: 98501 - RNA, 20 nt, Artificial Sequence
  MKO10098501_B_Mfap1b
  gRNA
ggaacaagaagcaaaacgca

SEQ ID NO: 98502 - RNA, 20 nt, Artificial Sequence
  MKO10098502_B_Mfap1b
  gRNA
agagaccaagaaagagcuag

SEQ ID NO: 98503 - RNA, 20 nt, Artificial Sequence
  MKO10098503_B_Mfap1b
  gRNA
caagcggucucuugcugccc

SEQ ID NO: 98504 - RNA, 20 nt, Artificial Sequence
  MKO10098504_B_Mfap2
  gRNA
gcagacuacuaugacuacca

SEQ ID NO: 98505 - RNA, 20 nt, Artificial Sequence
  MKO10098505_B_Mfap2
  gRNA
gacagcauuaccugggguag

SEQ ID NO: 98506 - RNA, 20 nt, Artificial Sequence
  MKO10098506_B_Mfap2
  gRNA
cuuccuguugaacuugcugc

SEQ ID NO: 98507 - RNA, 20 nt, Artificial Sequence
  MKO10098507_B_Mfap3l
  gRNA
ugaccauaucauagucaaag

SEQ ID NO: 98508 - RNA, 20 nt, Artificial Sequence
  MKO10098508_B_Mfap3l
  gRNA
guacacgcccaugucuccag

SEQ ID NO: 98509 - RNA, 20 nt, Artificial Sequence
  MKO10098509_B_Mfap3l
  gRNA
cucuucggacgucagcuccg

SEQ ID NO: 98510 - RNA, 20 nt, Artificial Sequence
  MKO10098510_B_Mfap3
  gRNA
aaugacaucaucaccugagu

SEQ ID NO: 98511 - RNA, 20 nt, Artificial Sequence
  MKO10098511_B_Mfap3
  gRNA
cucagccaaaacccucgagc

SEQ ID NO: 98512 - RNA, 20 nt, Artificial Sequence
  MKO10098512_B_Mfap3
  gRNA
cggcaguucagaauaagggg

SEQ ID NO: 98513 - RNA, 20 nt, Artificial Sequence
  MKO10098513_B_Mfap4
  gRNA
ugcugacggggaguacuggc

SEQ ID NO: 98514 - RNA, 20 nt, Artificial Sequence
  MKO10098514_B_Mfap4
  gRNA
ccucgaagccagccacguag

SEQ ID NO: 98515 - RNA, 20 nt, Artificial Sequence
  MKO10098515_B_Mfap4
  gRNA
cuucugcgacaugacaacug

SEQ ID NO: 98516 - RNA, 20 nt, Artificial Sequence
  MKO10098516_B_Mfap5
  gRNA
gggucgucugugaaugucuc

SEQ ID NO: 98517 - RNA, 20 nt, Artificial Sequence
  MKO10098517_B_Mfap5
  gRNA
uugacagacuggcuaccccu

SEQ ID NO: 98518 - RNA, 20 nt, Artificial Sequence
  MKO10098518_B_Mfap5
  gRNA
gaacucaccuaggucaucug

SEQ ID NO: 98519 - RNA, 20 nt, Artificial Sequence
  MKO10098519_B_Mff
  gRNA
cgacaaaaugccacgggcag

SEQ ID NO: 98520 - RNA, 20 nt, Artificial Sequence
  MKO10098520_B_Mff
  gRNA
ugcccuagaccuguguugcg

SEQ ID NO: 98521 - RNA, 20 nt, Artificial Sequence
  MKO10098521_B_Mff
  gRNA
aagcccuacgaguagaagac

SEQ ID NO: 98522 - RNA, 20 nt, Artificial Sequence
  MKO10098522_B_Mfge8
  gRNA
acucaccagacgcggcgaag

SEQ ID NO: 98523 - RNA, 20 nt, Artificial Sequence
  MKO10098523_B_Mfge8
  gRNA
auugucuuggcccgucaagc

SEQ ID NO: 98524 - RNA, 20 nt, Artificial Sequence
  MKO10098524_B_Mfge8
  gRNA
ucgggcauccacugugaaac

SEQ ID NO: 98525 - RNA, 20 nt, Artificial Sequence
  MKO10098525_B_Mfhas1
  gRNA
cugaucacagucgguguagg

SEQ ID NO: 98526 - RNA, 20 nt, Artificial Sequence
  MKO10098526_B_Mfhas1
  gRNA
aucccaucuaggaagaacgu

SEQ ID NO: 98527 - RNA, 20 nt, Artificial Sequence
  MKO10098527_B_Mfhas1
  gRNA
ugcgcaagaccaagacgcga

SEQ ID NO: 98528 - RNA, 20 nt, Artificial Sequence
  MKO10098528_B_Mfi2
  gRNA
acagccguuggugauuauuu

SEQ ID NO: 98529 - RNA, 20 nt, Artificial Sequence
  MKO10098529_B_Mfi2
  gRNA
aguggucagcggaguugccc

SEQ ID NO: 98530 - RNA, 20 nt, Artificial Sequence
  MKO10098530_B_Mfi2
  gRNA
ggaggggccaucuaugaggc

SEQ ID NO: 98531 - RNA, 20 nt, Artificial Sequence
  MKO10098531_B_Mfn1
  gRNA
gcugucucggagacauauga

SEQ ID NO: 98532 - RNA, 20 nt, Artificial Sequence
  MKO10098532_B_Mfn1
  gRNA
uuuaccugucuacuaaaacc

SEQ ID NO: 98533 - RNA, 20 nt, Artificial Sequence
  MKO10098533_B_Mfn1
  gRNA
acuuuagacuguuaaucagc

SEQ ID NO: 98534 - RNA, 20 nt, Artificial Sequence
  MKO10098534_B_Mfn2
  gRNA
augaccucgugcugauggac

SEQ ID NO: 98535 - RNA, 20 nt, Artificial Sequence
  MKO10098535_B_Mfn2
  gRNA
agccaccuucaugugccgcc

SEQ ID NO: 98536 - RNA, 20 nt, Artificial Sequence
  MKO10098536_B_Mfn2
  gRNA
caggacgagcaguugcaugc

SEQ ID NO: 98537 - RNA, 20 nt, Artificial Sequence
  MKO10098537_B_Mfng
  gRNA
ggcaguuaccuagucucucc

SEQ ID NO: 98538 - RNA, 20 nt, Artificial Sequence
  MKO10098538_B_Mfng
  gRNA
cagcccagaugaacgccucc

SEQ ID NO: 98539 - RNA, 20 nt, Artificial Sequence
  MKO10098539_B_Mfng
  gRNA
auuuccaggcccgcaccucg

SEQ ID NO: 98540 - RNA, 20 nt, Artificial Sequence
  MKO10098540_B_Mfrp
  gRNA
gcccuccaccagcguuacag

SEQ ID NO: 98541 - RNA, 20 nt, Artificial Sequence
  MKO10098541_B_Mfrp
  gRNA
ggcagucgggcuguagcccc

SEQ ID NO: 98542 - RNA, 20 nt, Artificial Sequence
  MKO10098542_B_Mfrp
  gRNA
cuguaauccugcuuucgacc

SEQ ID NO: 98543 - RNA, 20 nt, Artificial Sequence
  MKO10098543_B_Mfsd10
  gRNA
gcgccuccccagguaaucag

SEQ ID NO: 98544 - RNA, 20 nt, Artificial Sequence
  MKO10098544_B_Mfsd10
  gRNA
gcugaugccuccgaucaccc

SEQ ID NO: 98545 - RNA, 20 nt, Artificial Sequence
  MKO10098545_B_Mfsd10
  gRNA
ccuggcagcgugggguagac

SEQ ID NO: 98546 - RNA, 20 nt, Artificial Sequence
  MKO10098546_B_Mfsd11
  gRNA
uuaguccuuuggacagcaca

SEQ ID NO: 98547 - RNA, 20 nt, Artificial Sequence
  MKO10098547_B_Mfsd11
  gRNA
uacacagcaucugucuucau

SEQ ID NO: 98548 - RNA, 20 nt, Artificial Sequence
  MKO10098548_B_Mfsd11
  gRNA
ccacacagcaaacugucauc

SEQ ID NO: 98549 - RNA, 20 nt, Artificial Sequence
  MKO10098549_B_Mfsd12
  gRNA
uccaggaugugcccguguuc

SEQ ID NO: 98550 - RNA, 20 nt, Artificial Sequence
  MKO10098550_B_Mfsd12
  gRNA
acccaaugagcacacccccc

SEQ ID NO: 98551 - RNA, 20 nt, Artificial Sequence
  MKO10098551_B_Mfsd12
  gRNA
cuugggcaagcugagagaau

SEQ ID NO: 98552 - RNA, 20 nt, Artificial Sequence
  MKO10098552_B_Mfsd1
  gRNA
ccccgcugcccuucagacuc

SEQ ID NO: 98553 - RNA, 20 nt, Artificial Sequence
  MKO10098553_B_Mfsd1
  gRNA
gugguauauuuaaugcauuu

SEQ ID NO: 98554 - RNA, 20 nt, Artificial Sequence
  MKO10098554_B_Mfsd1
  gRNA
uuuagcugcuuuguuugcau

SEQ ID NO: 98555 - RNA, 20 nt, Artificial Sequence
  MKO10098555_B_Mfsd2a
  gRNA
ucaccuuagccacauccaau

SEQ ID NO: 98556 - RNA, 20 nt, Artificial Sequence
  MKO10098556_B_Mfsd2a
  gRNA
ugugaacuuuccgucccuga

SEQ ID NO: 98557 - RNA, 20 nt, Artificial Sequence
  MKO10098557_B_Mfsd2a
  gRNA
ccgugaccagugucucaaag

SEQ ID NO: 98558 - RNA, 20 nt, Artificial Sequence
  MKO10098558_B_Mfsd2b
  gRNA
gaucauagugagcgcagugu

SEQ ID NO: 98559 - RNA, 20 nt, Artificial Sequence
  MKO10098559_B_Mfsd2b
  gRNA
ggucuggacggcuaaugccu

SEQ ID NO: 98560 - RNA, 20 nt, Artificial Sequence
  MKO10098560_B_Mfsd2b
  gRNA
ucgccucucagucuguacaa

SEQ ID NO: 98561 - RNA, 20 nt, Artificial Sequence
  MKO10098561_B_Mfsd3
  gRNA
ucuggcaagccaaacuccca

SEQ ID NO: 98562 - RNA, 20 nt, Artificial Sequence
  MKO10098562_B_Mfsd3
  gRNA
acagugcugcagcuccgccu

SEQ ID NO: 98563 - RNA, 20 nt, Artificial Sequence
  MKO10098563_B_Mfsd3
  gRNA
gcugugaccugcuccauugc

SEQ ID NO: 98564 - RNA, 20 nt, Artificial Sequence
  MKO10098564_B_Mfsd4
  gRNA
ccccuucugccaugacguga

SEQ ID NO: 98565 - RNA, 20 nt, Artificial Sequence
  MKO10098565_B_Mfsd4
  gRNA
gggaucgucugguuuaucca

SEQ ID NO: 98566 - RNA, 20 nt, Artificial Sequence
  MKO10098566_B_Mfsd4
  gRNA
cugcugcgugauguuggcuc

SEQ ID NO: 98567 - RNA, 20 nt, Artificial Sequence
  MKO10098567_B_Mfsd5
  gRNA
ggccuuggcucuacgaaacu

SEQ ID NO: 98568 - RNA, 20 nt, Artificial Sequence
  MKO10098568_B_Mfsd5
  gRNA
accgcaucgcuaccuccaag

SEQ ID NO: 98569 - RNA, 20 nt, Artificial Sequence
  MKO10098569_B_Mfsd5
  gRNA
uggcugggauccacucggcg

SEQ ID NO: 98570 - RNA, 20 nt, Artificial Sequence
  MKO10098570_B_Mfsd6l
  gRNA
cguccccagggcacuacggg

SEQ ID NO: 98571 - RNA, 20 nt, Artificial Sequence
  MKO10098571_B_Mfsd6l
  gRNA
caguggcgucuacgaaaucc

SEQ ID NO: 98572 - RNA, 20 nt, Artificial Sequence
  MKO10098572_B_Mfsd6l
  gRNA
ggccaccacuaucuuaccgc

SEQ ID NO: 98573 - RNA, 20 nt, Artificial Sequence
  MKO10098573_B_Mfsd6
  gRNA
ggggcugcugcaacuuuccg

SEQ ID NO: 98574 - RNA, 20 nt, Artificial Sequence
  MKO10098574_B_Mfsd6
  gRNA
aauauagcgagcuguauuac

SEQ ID NO: 98575 - RNA, 20 nt, Artificial Sequence
  MKO10098575_B_Mfsd6
  gRNA
gugucacacacgcagccauc

SEQ ID NO: 98576 - RNA, 20 nt, Artificial Sequence
  MKO10098576_B_Mfsd7a
  gRNA
cucuguuggccuccguggag

SEQ ID NO: 98577 - RNA, 20 nt, Artificial Sequence
  MKO10098577_B_Mfsd7a
  gRNA
ccccagcuuggcaucuacau

SEQ ID NO: 98578 - RNA, 20 nt, Artificial Sequence
  MKO10098578_B_Mfsd7a
  gRNA
ggugcugaucauguuagcug

SEQ ID NO: 98579 - RNA, 20 nt, Artificial Sequence
  MKO10098579_B_Mfsd7b
  gRNA
uucuuuguagguaucaugac

SEQ ID NO: 98580 - RNA, 20 nt, Artificial Sequence
  MKO10098580_B_Mfsd7b
  gRNA
uuacagcuuggaacugcagu

SEQ ID NO: 98581 - RNA, 20 nt, Artificial Sequence
  MKO10098581_B_Mfsd7b
  gRNA
uguugauguuaugagccagg

SEQ ID NO: 98582 - RNA, 20 nt, Artificial Sequence
  MKO10098582_B_Mfsd7c
  gRNA
aaaccucaacuucgugcugc

SEQ ID NO: 98583 - RNA, 20 nt, Artificial Sequence
  MKO10098583_B_Mfsd7c
  gRNA
auccacucugcugaaucgca

SEQ ID NO: 98584 - RNA, 20 nt, Artificial Sequence
  MKO10098584_B_Mfsd7c
  gRNA
auguagcuuggaauugcaau

SEQ ID NO: 98585 - RNA, 20 nt, Artificial Sequence
  MKO10098585_B_Mfsd8
  gRNA
aagagcauuacaagaguaga

SEQ ID NO: 98586 - RNA, 20 nt, Artificial Sequence
  MKO10098586_B_Mfsd8
  gRNA
gacauacgcauauaggcagu

SEQ ID NO: 98587 - RNA, 20 nt, Artificial Sequence
  MKO10098587_B_Mfsd8
  gRNA
cuauugugauaauguccauc

SEQ ID NO: 98588 - RNA, 20 nt, Artificial Sequence
  MKO10098588_B_Mfsd9
  gRNA
caagaugaagccuacgccug

SEQ ID NO: 98589 - RNA, 20 nt, Artificial Sequence
  MKO10098589_B_Mfsd9
  gRNA
ggacucuagccagcguaaac

SEQ ID NO: 98590 - RNA, 20 nt, Artificial Sequence
  MKO10098590_B_Mfsd9
  gRNA
gaaggagcgaccacuugucc

SEQ ID NO: 98591 - RNA, 20 nt, Artificial Sequence
  MKO10098591_B_Mgam
  gRNA
cacaaaccuuguuagaugac

SEQ ID NO: 98592 - RNA, 20 nt, Artificial Sequence
  MKO10098592_B_Mgam
  gRNA
cguuccagcucacuuagcac

SEQ ID NO: 98593 - RNA, 20 nt, Artificial Sequence
  MKO10098593_B_Mgam
  gRNA
cagggcacaugugaugagcg

SEQ ID NO: 98594 - RNA, 20 nt, Artificial Sequence
  MKO10098594_B_Mgarp
  gRNA
cacucucgguagucuccacc

SEQ ID NO: 98595 - RNA, 20 nt, Artificial Sequence
  MKO10098595_B_Mgarp
  gRNA
ugacugucacaccuacaacc

SEQ ID NO: 98596 - RNA, 20 nt, Artificial Sequence
  MKO10098596_B_Mgarp
  gRNA
ugaaccgaaagaacaaacaa

SEQ ID NO: 98597 - RNA, 20 nt, Artificial Sequence
  MKO10098597_B_Mgau1
  gRNA
gcuugaugaacuuaagaugc

SEQ ID NO: 98598 - RNA, 20 nt, Artificial Sequence
  MKO10098598_B_Mgau1
  gRNA
gcucacacccuugcgaccaa

SEQ ID NO: 98599 - RNA, 20 nt, Artificial Sequence
  MKO10098599_B_Mgau1
  gRNA
guucguccccuucacccagu

SEQ ID NO: 98600 - RNA, 20 nt, Artificial Sequence
  MKO10098600_B_Mgau2
  gRNA
auuccggccuguuaugcacc

SEQ ID NO: 98601 - RNA, 20 nt, Artificial Sequence
  MKO10098601_B_Mgau2
  gRNA
ccgccugcggcuucguccuc

SEQ ID NO: 98602 - RNA, 20 nt, Artificial Sequence
  MKO10098602_B_Mgau2
  gRNA
gucgcccauugcuacuccag

SEQ ID NO: 98603 - RNA, 20 nt, Artificial Sequence
  MKO10098603_B_Mgau3
  gRNA
cggguggccccgaccuauug

SEQ ID NO: 98604 - RNA, 20 nt, Artificial Sequence
  MKO10098604_B_Mgau3
  gRNA
aacagcacaccaucacgcgc

SEQ ID NO: 98605 - RNA, 20 nt, Artificial Sequence
  MKO10098605_B_Mgau3
  gRNA
cguacucaacacgugccuca

SEQ ID NO: 98606 - RNA, 20 nt, Artificial Sequence
  MKO10098606_B_Mgau4a
  gRNA
ucacagcguuguugccaacc

SEQ ID NO: 98607 - RNA, 20 nt, Artificial Sequence
  MKO10098607_B_Mgau4a
  gRNA
uguguuauagucgucuucau

SEQ ID NO: 98608 - RNA, 20 nt, Artificial Sequence
  MKO10098608_B_Mgau4a
  gRNA
ucuuccacugccaaucugua

SEQ ID NO: 98609 - RNA, 20 nt, Artificial Sequence
  MKO10098609_B_Mgau4b
  gRNA
cucuccaacaggugacgugg

SEQ ID NO: 98610 - RNA, 20 nt, Artificial Sequence
  MKO10098610_B_Mgau4b
  gRNA
ugccugugcgagacguucca

SEQ ID NO: 98611 - RNA, 20 nt, Artificial Sequence
  MKO10098611_B_Mgau4b
  gRNA
aggauccgcgacugaagccg

SEQ ID NO: 98612 - RNA, 20 nt, Artificial Sequence
  MKO10098612_B_Mgau4c
  gRNA
acgcuauguucacacuuuca

SEQ ID NO: 98613 - RNA, 20 nt, Artificial Sequence
  MKO10098613_B_Mgau4c
  gRNA
aaaugagaugcuugcgaaaa

SEQ ID NO: 98614 - RNA, 20 nt, Artificial Sequence
  MKO10098614_B_Mgau4c
  gRNA
cauugaagauagcuauguuc

SEQ ID NO: 98615 - RNA, 20 nt, Artificial Sequence
  MKO10098615_B_Mgau5b
  gRNA
agggcgagucccccaggcgc

SEQ ID NO: 98616 - RNA, 20 nt, Artificial Sequence
  MKO10098616_B_Mgau5b
  gRNA
cacccuugcuaugcagaauc

SEQ ID NO: 98617 - RNA, 20 nt, Artificial Sequence
  MKO10098617_B_Mgau5b
  gRNA
ugugucugacaucgcuguga

SEQ ID NO: 98618 - RNA, 20 nt, Artificial Sequence
  MKO10098618_B_Mgau5
  gRNA
gacaaucuggucaacggcac

SEQ ID NO: 98619 - RNA, 20 nt, Artificial Sequence
  MKO10098619_B_Mgau5
  gRNA
uuugcucuccaagguaaacg

SEQ ID NO: 98620 - RNA, 20 nt, Artificial Sequence
  MKO10098620_B_Mgau5
  gRNA
agaagcugaucauaacucau

SEQ ID NO: 98621 - RNA, 20 nt, Artificial Sequence
  MKO10098621_B_Mga
  gRNA
agugccucuccaaauacucc

SEQ ID NO: 98622 - RNA, 20 nt, Artificial Sequence
  MKO10098622_B_Mga
  gRNA
gacaauaccugaaucauuug

SEQ ID NO: 98623 - RNA, 20 nt, Artificial Sequence
  MKO10098623_B_Mga
  gRNA
cuaguaccuucuugaagagc

SEQ ID NO: 98624 - RNA, 20 nt, Artificial Sequence
  MKO10098624_B_Mgea5
  gRNA
cagguacugauaaauuucau

SEQ ID NO: 98625 - RNA, 20 nt, Artificial Sequence
  MKO10098625_B_Mgea5
  gRNA
caaugaaauuuaucaguacc

SEQ ID NO: 98626 - RNA, 20 nt, Artificial Sequence
  MKO10098626_B_Mgea5
  gRNA
uuucucugcuccauaaccca

SEQ ID NO: 98627 - RNA, 20 nt, Artificial Sequence
  MKO10098627_B_Mgl2
  gRNA
uguugucuaaaauggcucuu

SEQ ID NO: 98628 - RNA, 20 nt, Artificial Sequence
  MKO10098628_B_Mgl2
  gRNA
ccucaucagauucccaguua

SEQ ID NO: 98629 - RNA, 20 nt, Artificial Sequence
  MKO10098629_B_Mgl2
  gRNA
gacuucucuggagagcacac

SEQ ID NO: 98630 - RNA, 20 nt, Artificial Sequence
  MKO10098630_B_Mgll
  gRNA
ggaaucugcaucgacuuuga

SEQ ID NO: 98631 - RNA, 20 nt, Artificial Sequence
  MKO10098631_B_Mgll
  gRNA
cagagaugugcugcaacacg

SEQ ID NO: 98632 - RNA, 20 nt, Artificial Sequence
  MKO10098632_B_Mgll
  gRNA
cuguggccguuaugaugagc

SEQ ID NO: 98633 - RNA, 20 nt, Artificial Sequence
  MKO10098633_B_Mgme1
  gRNA
ugacaacccgcugcaaguug

SEQ ID NO: 98634 - RNA, 20 nt, Artificial Sequence
  MKO10098634_B_Mgme1
  gRNA
auguacgccacaacuugcag

SEQ ID NO: 98635 - RNA, 20 nt, Artificial Sequence
  MKO10098635_B_Mgme1
  gRNA
cgcaggggacccauccuuau

SEQ ID NO: 98636 - RNA, 20 nt, Artificial Sequence
  MKO10098636_B_Mgmt
  gRNA
uccuacugcacgagccgcuu

SEQ ID NO: 98637 - RNA, 20 nt, Artificial Sequence
  MKO10098637_B_Mgmt
  gRNA
cucagagcuggucgacucga

SEQ ID NO: 98638 - RNA, 20 nt, Artificial Sequence
  MKO10098638_B_Mgmt
  gRNA
acggaaauaggcuuccagcc

SEQ ID NO: 98639 - RNA, 20 nt, Artificial Sequence
  MKO10098639_B_Mgp
  gRNA
uuagcucgccaccucugcug

SEQ ID NO: 98640 - RNA, 20 nt, Artificial Sequence
  MKO10098640_B_Mgp
  gRNA
ggcgagcuaaagcccaaaag

SEQ ID NO: 98641 - RNA, 20 nt, Artificial Sequence
  MKO10098641_B_Mgp
  gRNA
uccagaaucucacgaaagca

SEQ ID NO: 98642 - RNA, 20 nt, Artificial Sequence
  MKO10098642_B_Mgrn1
  gRNA
agucuuugcgaauguucacc

SEQ ID NO: 98643 - RNA, 20 nt, Artificial Sequence
  MKO10098643_B_Mgrn1
  gRNA
cucuaccgccugacaauaga

SEQ ID NO: 98644 - RNA, 20 nt, Artificial Sequence
  MKO10098644_B_Mgrn1
  gRNA
ccuggacuggacgacugccc

SEQ ID NO: 98645 - RNA, 20 nt, Artificial Sequence
  MKO10098645_B_Mgst1
  gRNA
gcucugcgaccgcauuccag

SEQ ID NO: 98646 - RNA, 20 nt, Artificial Sequence
  MKO10098646_B_Mgst1
  gRNA
gccaacccagaagacugcgc

SEQ ID NO: 98647 - RNA, 20 nt, Artificial Sequence
  MKO10098647_B_Mgst1
  gRNA
uuacuuugucaauggcuuac

SEQ ID NO: 98648 - RNA, 20 nt, Artificial Sequence
  MKO10098648_B_Mgst2
  gRNA
cccuuguagguuauuucgcu

SEQ ID NO: 98649 - RNA, 20 nt, Artificial Sequence
  MKO10098649_B_Mgst2
  gRNA
cagauuccugaacgaauacc

SEQ ID NO: 98650 - RNA, 20 nt, Artificial Sequence
  MKO10098650_B_Mgst2
  gRNA
aauauucucucgaauuccag

SEQ ID NO: 98651 - RNA, 20 nt, Artificial Sequence
  MKO10098651_B_Mgst3
  gRNA
cuggacccguagccuaagcc

SEQ ID NO: 98652 - RNA, 20 nt, Artificial Sequence
  MKO10098652_B_Mgst3
  gRNA
acgacacucacguguucugg

SEQ ID NO: 98653 - RNA, 20 nt, Artificial Sequence
  MKO10098653_B_Mgst3
  gRNA
aucagaccaggcuuaggcua

SEQ ID NO: 98654 - RNA, 20 nt, Artificial Sequence
  MKO10098654_B_Mia2
  gRNA
cuucucccguagugaaguuc

SEQ ID NO: 98655 - RNA, 20 nt, Artificial Sequence
  MKO10098655_B_Mia2
  gRNA
gagggccuuacaaguuauuu

SEQ ID NO: 98656 - RNA, 20 nt, Artificial Sequence
  MKO10098656_B_Mia2
  gRNA
agaugcagucgagauugaag

SEQ ID NO: 98657 - RNA, 20 nt, Artificial Sequence
  MKO10098657_B_Mia3
  gRNA
uggguacacaaguaccucag

SEQ ID NO: 98658 - RNA, 20 nt, Artificial Sequence
  MKO10098658_B_Mia3
  gRNA
uauacaguguuaauguaccg

SEQ ID NO: 98659 - RNA, 20 nt, Artificial Sequence
  MKO10098659_B_Mia3
  gRNA
acauagguugaacacaguuu

SEQ ID NO: 98660 - RNA, 20 nt, Artificial Sequence
  MKO10098660_B_Mia
  gRNA
cuggaagcugugugcggacg

SEQ ID NO: 98661 - RNA, 20 nt, Artificial Sequence
  MKO10098661_B_Mia
  gRNA
guccucccggacaaugcuac

SEQ ID NO: 98662 - RNA, 20 nt, Artificial Sequence
  MKO10098662_B_Mia
  gRNA
aauagcccaggcgggcugcc

SEQ ID NO: 98663 - RNA, 20 nt, Artificial Sequence
  MKO10098663_B_Mib1
  gRNA
guccacuccucgcaccacuc

SEQ ID NO: 98664 - RNA, 20 nt, Artificial Sequence
  MKO10098664_B_Mib1
  gRNA
ugccgccagcaaccaaucau

SEQ ID NO: 98665 - RNA, 20 nt, Artificial Sequence
  MKO10098665_B_Mib1
  gRNA
agagaucauugcccugugcu

SEQ ID NO: 98666 - RNA, 20 nt, Artificial Sequence
  MKO10098666_B_Mib2
  gRNA
gugugguggacauccguggc

SEQ ID NO: 98667 - RNA, 20 nt, Artificial Sequence
  MKO10098667_B_Mib2
  gRNA
ggccuucuugcauaucccuu

SEQ ID NO: 98668 - RNA, 20 nt, Artificial Sequence
  MKO10098668_B_Mib2
  gRNA
gauccgagggaggcccuguc

SEQ ID NO: 98669 - RNA, 20 nt, Artificial Sequence
  MKO10098669_B_Mical1
  gRNA
caaacucauagcuggccagu

SEQ ID NO: 98670 - RNA, 20 nt, Artificial Sequence
  MKO10098670_B_Mical1
  gRNA
aaucuccacccccaacagua

SEQ ID NO: 98671 - RNA, 20 nt, Artificial Sequence
  MKO10098671_B_Mical1
  gRNA
ccacuuugagaccuuugugc

SEQ ID NO: 98672 - RNA, 20 nt, Artificial Sequence
  MKO10098672_B_Mical2
  gRNA
ccacucacugauguggucga

SEQ ID NO: 98673 - RNA, 20 nt, Artificial Sequence
  MKO10098673_B_Mical2
  gRNA
ggucacaggaacacgcuaga

SEQ ID NO: 98674 - RNA, 20 nt, Artificial Sequence
  MKO10098674_B_Mical2
  gRNA
cgaccguacuuugauucucu

SEQ ID NO: 98675 - RNA, 20 nt, Artificial Sequence
  MKO10098675_B_Mical3
  gRNA
agggauaggauggcgagcau

SEQ ID NO: 98676 - RNA, 20 nt, Artificial Sequence
  MKO10098676_B_Mical3
  gRNA
caaccgcaacacaaccgcag

SEQ ID NO: 98677 - RNA, 20 nt, Artificial Sequence
  MKO10098677_B_Mical3
  gRNA
uuucgucgaaaagaauuucg

SEQ ID NO: 98678 - RNA, 20 nt, Artificial Sequence
  MKO10098678_B_Micalcl
  gRNA
gcuuccugaccugagccuua

SEQ ID NO: 98679 - RNA, 20 nt, Artificial Sequence
  MKO10098679_B_Micalcl
  gRNA
ccuucuccagcuucacgccc

SEQ ID NO: 98680 - RNA, 20 nt, Artificial Sequence
  MKO10098680_B_Micalcl
  gRNA
gaagagguggcuucugucac

SEQ ID NO: 98681 - RNA, 20 nt, Artificial Sequence
  MKO10098681_B_Micall1
  gRNA
acaucacccgcugugcagcc

SEQ ID NO: 98682 - RNA, 20 nt, Artificial Sequence
  MKO10098682_B_Micall1
  gRNA
gcugccucaccacccaaacc

SEQ ID NO: 98683 - RNA, 20 nt, Artificial Sequence
  MKO10098683_B_Micall1
  gRNA
ugcacccuaggccuuugaag

SEQ ID NO: 98684 - RNA, 20 nt, Artificial Sequence
  MKO10098684_B_Micall2
  gRNA
cccagcccugcuagacgcug

SEQ ID NO: 98685 - RNA, 20 nt, Artificial Sequence
  MKO10098685_B_Micall2
  gRNA
gccugccaaguugcccucgc

SEQ ID NO: 98686 - RNA, 20 nt, Artificial Sequence
  MKO10098686_B_Micall2
  gRNA
acugcugacagagcuucccg

SEQ ID NO: 98687 - RNA, 20 nt, Artificial Sequence
  MKO10098687_B_Micu1
  gRNA
ccccugcuagaaaauugccc

SEQ ID NO: 98688 - RNA, 20 nt, Artificial Sequence
  MKO10098688_B_Micu1
  gRNA
gcuuuauuauauacugaucc

SEQ ID NO: 98689 - RNA, 20 nt, Artificial Sequence
  MKO10098689_B_Micu1
  gRNA
ugcggcagagccuuauccug

SEQ ID NO: 98690 - RNA, 20 nt, Artificial Sequence
  MKO10098690_B_Micu2
  gRNA
uugauccacagcgugcuguu

SEQ ID NO: 98691 - RNA, 20 nt, Artificial Sequence
  MKO10098691_B_Micu2
  gRNA
cuuuguugcagguaaaacac

SEQ ID NO: 98692 - RNA, 20 nt, Artificial Sequence
  MKO10098692_B_Micu2
  gRNA
uguaagcaagaaaagauacu

SEQ ID NO: 98693 - RNA, 20 nt, Artificial Sequence
  MKO10098693_B_Micu3
  gRNA
ucucagaaacuccaccaguu

SEQ ID NO: 98694 - RNA, 20 nt, Artificial Sequence
  MKO10098694_B_Micu3
  gRNA
uuugcaucuauagaauguga

SEQ ID NO: 98695 - RNA, 20 nt, Artificial Sequence
  MKO10098695_B_Micu3
  gRNA
cagagccauuacugaagacu

SEQ ID NO: 98696 - RNA, 20 nt, Artificial Sequence
  MKO10098696_B_Mid1ip1
  gRNA
cgacguaccccuguccgagc

SEQ ID NO: 98697 - RNA, 20 nt, Artificial Sequence
  MKO10098697_B_Mid1ip1
  gRNA
aacgccaugaaucgcuucau

SEQ ID NO: 98698 - RNA, 20 nt, Artificial Sequence
  MKO10098698_B_Mid1ip1
  gRNA
ggguacgucgcgcagcagac

SEQ ID NO: 98699 - RNA, 20 nt, Artificial Sequence
  MKO10098699_B_Mid1
  gRNA
auucuagcaguuucuucucc

SEQ ID NO: 98700 - RNA, 20 nt, Artificial Sequence
  MKO10098700_B_Mid1
  gRNA
aucacauucuucugucaguu

SEQ ID NO: 98701 - RNA, 20 nt, Artificial Sequence
  MKO10098701_B_Mid1
  gRNA
cagcaacgaagacaaauuau

SEQ ID NO: 98702 - RNA, 20 nt, Artificial Sequence
  MKO10098702_B_Mid2
  gRNA
cgagaugaaccucaccaacc

SEQ ID NO: 98703 - RNA, 20 nt, Artificial Sequence
  MKO10098703_B_Mid2
  gRNA
uauggaagaaugugacgagu

SEQ ID NO: 98704 - RNA, 20 nt, Artificial Sequence
  MKO10098704_B_Mid2
  gRNA
ggugaauacugcuaugcaug

SEQ ID NO: 98705 - RNA, 20 nt, Artificial Sequence
  MKO10098705_B_Midn
  gRNA
uugacccuggcccugcgagu

SEQ ID NO: 98706 - RNA, 20 nt, Artificial Sequence
  MKO10098706_B_Midn
  gRNA
gcagcuuccccgaacugagc

SEQ ID NO: 98707 - RNA, 20 nt, Artificial Sequence
  MKO10098707_B_Midn
  gRNA
acaguccguuaugcaagccu

SEQ ID NO: 98708 - RNA, 20 nt, Artificial Sequence
  MKO10098708_B_Mief1
  gRNA
uacccgcuuaacugccagug

SEQ ID NO: 98709 - RNA, 20 nt, Artificial Sequence
  MKO10098709_B_Mief1
  gRNA
auuggagagcacaaaaucga

SEQ ID NO: 98710 - RNA, 20 nt, Artificial Sequence
  MKO10098710_B_Mief1
  gRNA
cgaggagagcccauccaguu

SEQ ID NO: 98711 - RNA, 20 nt, Artificial Sequence
  MKO10098711_B_Mief2
  gRNA
ugcucgauuggugcuaggug

SEQ ID NO: 98712 - RNA, 20 nt, Artificial Sequence
  MKO10098712_B_Mief2
  gRNA
uuugccuauagcucaucgac

SEQ ID NO: 98713 - RNA, 20 nt, Artificial Sequence
  MKO10098713_B_Mief2
  gRNA
uucagccagccccuagcuac

SEQ ID NO: 98714 - RNA, 20 nt, Artificial Sequence
  MKO10098714_B_Mien1
  gRNA
gccuucgagauugagaucaa

SEQ ID NO: 98715 - RNA, 20 nt, Artificial Sequence
  MKO10098715_B_Mien1
  gRNA
uccauugaucucaaucucga

SEQ ID NO: 98716 - RNA, 20 nt, Artificial Sequence
  MKO10098716_B_Mien1
  gRNA
aggcaguggaguccacaucg

SEQ ID NO: 98717 - RNA, 20 nt, Artificial Sequence
  MKO10098717_B_Mier1
  gRNA
agacugugagggaucaucau

SEQ ID NO: 98718 - RNA, 20 nt, Artificial Sequence
  MKO10098718_B_Mier1
  gRNA
cacgagcugcucagccucua

SEQ ID NO: 98719 - RNA, 20 nt, Artificial Sequence
  MKO10098719_B_Mier1
  gRNA
ugaaccagcaugucagcuga

SEQ ID NO: 98720 - RNA, 20 nt, Artificial Sequence
  MKO10098720_B_Mier2
  gRNA
agacggggugaggucaucag

SEQ ID NO: 98721 - RNA, 20 nt, Artificial Sequence
  MKO10098721_B_Mier2
  gRNA
accugccguggucugcaagc

SEQ ID NO: 98722 - RNA, 20 nt, Artificial Sequence
  MKO10098722_B_Mier2
  gRNA
accuacacccacucugguua

SEQ ID NO: 98723 - RNA, 20 nt, Artificial Sequence
  MKO10098723_B_Mier3
  gRNA
cugaguuuccucgucaucgc

SEQ ID NO: 98724 - RNA, 20 nt, Artificial Sequence
  MKO10098724_B_Mier3
  gRNA
uccuuuggaaguucgagccc

SEQ ID NO: 98725 - RNA, 20 nt, Artificial Sequence
  MKO10098725_B_Mier3
  gRNA
accugggcucgaacuuccaa

SEQ ID NO: 98726 - RNA, 20 nt, Artificial Sequence
  MKO10098726_B_Mif4gd
  gRNA
gagaguagccaacgugauug

SEQ ID NO: 98727 - RNA, 20 nt, Artificial Sequence
  MKO10098727_B_Mif4gd
  gRNA
cugcugaagaccgcgcucaa

SEQ ID NO: 98728 - RNA, 20 nt, Artificial Sequence
  MKO10098728_B_Mif4gd
  gRNA
gggaggcucaccuuugagcg

SEQ ID NO: 98729 - RNA, 20 nt, Artificial Sequence
  MKO10098729_B_Mif
  gRNA
accgguccgggcugaugugc

SEQ ID NO: 98730 - RNA, 20 nt, Artificial Sequence
  MKO10098730_B_Mif
  gRNA
cgacaugaacgcugccaacg

SEQ ID NO: 98731 - RNA, 20 nt, Artificial Sequence
  MKO10098731_B_Mif
  gRNA
ggccaggacucaagcgaagg

SEQ ID NO: 98732 - RNA, 20 nt, Artificial Sequence
  MKO10098732_B_Miip
  gRNA
ugacuggagagcuauugucc

SEQ ID NO: 98733 - RNA, 20 nt, Artificial Sequence
  MKO10098733_B_Miip
  gRNA
ccacaccgcugcucucuugc

SEQ ID NO: 98734 - RNA, 20 nt, Artificial Sequence
  MKO10098734_B_Miip
  gRNA
ucagcccagagugaccuccc

SEQ ID NO: 98735 - RNA, 20 nt, Artificial Sequence
  MKO10098735_B_Mill1
  gRNA
gcucaucaucgaaguaucuc

SEQ ID NO: 98736 - RNA, 20 nt, Artificial Sequence
  MKO10098736_B_Mill1
  gRNA
ucucuucucgcaccauagac

SEQ ID NO: 98737 - RNA, 20 nt, Artificial Sequence
  MKO10098737_B_Mill1
  gRNA
ccugcuaccgccuguacucu

SEQ ID NO: 98738 - RNA, 20 nt, Artificial Sequence
  MKO10098738_B_Mill2
  gRNA
cccagcagaacaagauguuc

SEQ ID NO: 98739 - RNA, 20 nt, Artificial Sequence
  MKO10098739_B_Mill2
  gRNA
cugguaggucccauccccgc

SEQ ID NO: 98740 - RNA, 20 nt, Artificial Sequence
  MKO10098740_B_Mill2
  gRNA
auccugcagaccguuucuca

SEQ ID NO: 98741 - RNA, 20 nt, Artificial Sequence
  MKO10098741_B_Milr1
  gRNA
acauacagcucguccugugc

SEQ ID NO: 98742 - RNA, 20 nt, Artificial Sequence
  MKO10098742_B_Milr1
  gRNA
uguacgaggguggaaaauaa

SEQ ID NO: 98743 - RNA, 20 nt, Artificial Sequence
  MKO10098743_B_Milr1
  gRNA
aacagugacagccggcauga

SEQ ID NO: 98744 - RNA, 20 nt, Artificial Sequence
  MKO10098744_B_Mina
  gRNA
cgaguacaguguggaaucug

SEQ ID NO: 98745 - RNA, 20 nt, Artificial Sequence
  MKO10098745_B_Mina
  gRNA
gacacacgacuuccugcuga

SEQ ID NO: 98746 - RNA, 20 nt, Artificial Sequence
  MKO10098746_B_Mina
  gRNA
gauuuguuguacuuucccag

SEQ ID NO: 98747 - RNA, 20 nt, Artificial Sequence
  MKO10098747_B_Mink1
  gRNA
cgcaauauugccaccuacua

SEQ ID NO: 98748 - RNA, 20 nt, Artificial Sequence
  MKO10098748_B_Mink1
  gRNA
caccuuguauaccuguccau

SEQ ID NO: 98749 - RNA, 20 nt, Artificial Sequence
  MKO10098749_B_Mink1
  gRNA
cccugcaggaaucuuugagc

SEQ ID NO: 98750 - RNA, 20 nt, Artificial Sequence
  MKO10098750_B_Minos1
  gRNA
agaauguggccauuagccuu

SEQ ID NO: 98751 - RNA, 20 nt, Artificial Sequence
  MKO10098751_B_Minos1
  gRNA
aagucacuuacucuuaaaga

SEQ ID NO: 98752 - RNA, 20 nt, Artificial Sequence
  MKO10098752_B_Minos1
  gRNA
cagaaagugggaccggugca

SEQ ID NO: 98753 - RNA, 20 nt, Artificial Sequence
  MKO10098753_B_Minpp1
  gRNA
auggcuacaccauuaacagc

SEQ ID NO: 98754 - RNA, 20 nt, Artificial Sequence
  MKO10098754_B_Minpp1
  gRNA
ccaaugaacaguuuaaaugc

SEQ ID NO: 98755 - RNA, 20 nt, Artificial Sequence
  MKO10098755_B_Minpp1
  gRNA
cgagacggcucuuuaucaug

SEQ ID NO: 98756 - RNA, 20 nt, Artificial Sequence
  MKO10098756_B_Mios
  gRNA
gcaauccaaauccugaauga

SEQ ID NO: 98757 - RNA, 20 nt, Artificial Sequence
  MKO10098757_B_Mios
  gRNA
cugaagacgccccuucauuc

SEQ ID NO: 98758 - RNA, 20 nt, Artificial Sequence
  MKO10098758_B_Mios
  gRNA
aaaggaucauugguuuaugc

SEQ ID NO: 98759 - RNA, 20 nt, Artificial Sequence
  MKO10098759_B_Miox
  gRNA
cuuccacgcguuccagaccg

SEQ ID NO: 98760 - RNA, 20 nt, Artificial Sequence
  MKO10098760_B_Miox
  gRNA
uaaagacacgauccagcagc

SEQ ID NO: 98761 - RNA, 20 nt, Artificial Sequence
  MKO10098761_B_Miox
  gRNA
ugcugacgaaguccacaguc

SEQ ID NO: 98762 - RNA, 20 nt, Artificial Sequence
  MKO10098762_B_Mipep
  gRNA
uaggcggacuuugugaaaau

SEQ ID NO: 98763 - RNA, 20 nt, Artificial Sequence
  MKO10098763_B_Mipep
  gRNA
cgagcauguuccacaccccc

SEQ ID NO: 98764 - RNA, 20 nt, Artificial Sequence
  MKO10098764_B_Mipep
  gRNA
cccagacccugcauucagag

SEQ ID NO: 98765 - RNA, 20 nt, Artificial Sequence
  MKO10098765_B_Mipol1
  gRNA
ccuugagggcuaacugcagu

SEQ ID NO: 98766 - RNA, 20 nt, Artificial Sequence
  MKO10098766_B_Mipol1
  gRNA
ucucagagcaagcaauacaa

SEQ ID NO: 98767 - RNA, 20 nt, Artificial Sequence
  MKO10098767_B_Mipol1
  gRNA
gaugucucuuuauuuaaguc

SEQ ID NO: 98768 - RNA, 20 nt, Artificial Sequence
  MKO10098768_B_Mip
  gRNA
accugucgaacugaagacuc

SEQ ID NO: 98769 - RNA, 20 nt, Artificial Sequence
  MKO10098769_B_Mip
  gRNA
cccgaucaucggagggggcc

SEQ ID NO: 98770 - RNA, 20 nt, Artificial Sequence
  MKO10098770_B_Mip
  gRNA
cgucaagaagaucuccacag

SEQ ID NO: 98771 - RNA, 20 nt, Artificial Sequence
  MKO10098771_B_Mis12
  gRNA
caggaugucuguggauccga

SEQ ID NO: 98772 - RNA, 20 nt, Artificial Sequence
  MKO10098772_B_Mis12
  gRNA
ucucugugcauuuccgaguc

SEQ ID NO: 98773 - RNA, 20 nt, Artificial Sequence
  MKO10098773_B_Mis12
  gRNA
ucgaguuucucuucacugaa

SEQ ID NO: 98774 - RNA, 20 nt, Artificial Sequence
  MKO10098774_B_Mis18a
  gRNA
cuuauccacagagacguuac

SEQ ID NO: 98775 - RNA, 20 nt, Artificial Sequence
  MKO10098775_B_Mis18a
  gRNA
cugcaccucaguuacaccuu

SEQ ID NO: 98776 - RNA, 20 nt, Artificial Sequence
  MKO10098776_B_Mis18a
  gRNA
aguugaaucuaaacuguccu

SEQ ID NO: 98777 - RNA, 20 nt, Artificial Sequence
  MKO10098777_B_Mis18bp1
  gRNA
cuuaaaaggauugauagacu

SEQ ID NO: 98778 - RNA, 20 nt, Artificial Sequence
  MKO10098778_B_Mis18bp1
  gRNA
aaugaacuuaggaccuuauc

SEQ ID NO: 98779 - RNA, 20 nt, Artificial Sequence
  MKO10098779_B_Mis18bp1
  gRNA
caauguguuccuuccaguug

SEQ ID NO: 98780 - RNA, 20 nt, Artificial Sequence
  MKO10098780_B_Misp
  gRNA
uccacaccagccccgaauuc

SEQ ID NO: 98781 - RNA, 20 nt, Artificial Sequence
  MKO10098781_B_Misp
  gRNA
cacccccguccaccugaauu

SEQ ID NO: 98782 - RNA, 20 nt, Artificial Sequence
  MKO10098782_B_Misp
  gRNA
aaagcggcacaagaaucucu

SEQ ID NO: 98783 - RNA, 20 nt, Artificial Sequence
  MKO10098783_B_Mitd1
  gRNA
gcaccacuccgugacucccg

SEQ ID NO: 98784 - RNA, 20 nt, Artificial Sequence
  MKO10098784_B_Mitd1
  gRNA
uuauauuagacaaacucauc

SEQ ID NO: 98785 - RNA, 20 nt, Artificial Sequence
  MKO10098785_B_Mitd1
  gRNA
ucagcaucucacaaaaccga

SEQ ID NO: 98786 - RNA, 20 nt, Artificial Sequence
  MKO10098786_B_Mitf
  gRNA
cgagagugcguguucauacc

SEQ ID NO: 98787 - RNA, 20 nt, Artificial Sequence
  MKO10098787_B_Mitf
  gRNA
gguggcauggcauggucgcc

SEQ ID NO: 98788 - RNA, 20 nt, Artificial Sequence
  MKO10098788_B_Mitf
  gRNA
ugcucaggugcagacccacc

SEQ ID NO: 98789 - RNA, 20 nt, Artificial Sequence
  MKO10098789_B_Mixl1
  gRNA
uggacuuggcccgucgguuc

SEQ ID NO: 98790 - RNA, 20 nt, Artificial Sequence
  MKO10098790_B_Mixl1
  gRNA
cgcucccgcaaguggauguc

SEQ ID NO: 98791 - RNA, 20 nt, Artificial Sequence
  MKO10098791_B_Mixl1
  gRNA
aagcggcgccuucugcgaac

SEQ ID NO: 98792 - RNA, 20 nt, Artificial Sequence
  MKO10098792_B_Mki67
  gRNA
agcacagaagcuaucucuug

SEQ ID NO: 98793 - RNA, 20 nt, Artificial Sequence
  MKO10098793_B_Mki67
  gRNA
agcaagccaacagaauuucc

SEQ ID NO: 98794 - RNA, 20 nt, Artificial Sequence
  MKO10098794_B_Mki67
  gRNA
gugcacuguagguaugaaga

SEQ ID NO: 98795 - RNA, 20 nt, Artificial Sequence
  MKO10098795_B_Mkks
  gRNA
agucaccccaacucugucga

SEQ ID NO: 98796 - RNA, 20 nt, Artificial Sequence
  MKO10098796_B_Mkks
  gRNA
uacagaagagugccacccua

SEQ ID NO: 98797 - RNA, 20 nt, Artificial Sequence
  MKO10098797_B_Mkks
  gRNA
gcagcagaaaugacaccgcc

SEQ ID NO: 98798 - RNA, 20 nt, Artificial Sequence
  MKO10098798_B_Mkl1
  gRNA
agaccgaggacuauuugaaa

SEQ ID NO: 98799 - RNA, 20 nt, Artificial Sequence
  MKO10098799_B_Mkl1
  gRNA
cucggcugagccuucgcucc

SEQ ID NO: 98800 - RNA, 20 nt, Artificial Sequence
  MKO10098800_B_Mkl1
  gRNA
ucucugcucaugaaaugcag

SEQ ID NO: 98801 - RNA, 20 nt, Artificial Sequence
  MKO10098801_B_Mkl2
  gRNA
uuaacaggaaguauagucuu

SEQ ID NO: 98802 - RNA, 20 nt, Artificial Sequence
  MKO10098802_B_Mkl2
  gRNA
uccuuuguugcagccucagc

SEQ ID NO: 98803 - RNA, 20 nt, Artificial Sequence
  MKO10098803_B_Mkl2
  gRNA
ccugugcucacagacugagc

SEQ ID NO: 98804 - RNA, 20 nt, Artificial Sequence
  MKO10098804_B_Mkln1
  gRNA
ucgugcagcccugucugaac

SEQ ID NO: 98805 - RNA, 20 nt, Artificial Sequence
  MKO10098805_B_Mkln1
  gRNA
aucguucagaauauuacauu

SEQ ID NO: 98806 - RNA, 20 nt, Artificial Sequence
  MKO10098806_B_Mkln1
  gRNA
guugcucucugaagaccauc

SEQ ID NO: 98807 - RNA, 20 nt, Artificial Sequence
  MKO10098807_B_Mknk1
  gRNA
cauugaagugcuuccgcuuc

SEQ ID NO: 98808 - RNA, 20 nt, Artificial Sequence
  MKO10098808_B_Mknk1
  gRNA
uccuucucccagcaauuccg

SEQ ID NO: 98809 - RNA, 20 nt, Artificial Sequence
  MKO10098809_B_Mknk1
  gRNA
gugcugugaaccuacagagu

SEQ ID NO: 98810 - RNA, 20 nt, Artificial Sequence
  MKO10098810_B_Mknk2
  gRNA
acauccgcagcaggguguuc

SEQ ID NO: 98811 - RNA, 20 nt, Artificial Sequence
  MKO10098811_B_Mknk2
  gRNA
cacgcaucuucucaaacacc

SEQ ID NO: 98812 - RNA, 20 nt, Artificial Sequence
  MKO10098812_B_Mknk2
  gRNA
cugguguuugagaagaugcg

SEQ ID NO: 98813 - RNA, 20 nt, Artificial Sequence
  MKO10098813_B_Mkrn1
  gRNA
uacuugcacacuacgccgua

SEQ ID NO: 98814 - RNA, 20 nt, Artificial Sequence
  MKO10098814_B_Mkrn1
  gRNA
auacuuacuacggccacagu

SEQ ID NO: 98815 - RNA, 20 nt, Artificial Sequence
  MKO10098815_B_Mkrn1
  gRNA
acaugucacacgagucuccg

SEQ ID NO: 98816 - RNA, 20 nt, Artificial Sequence
  MKO10098816_B_Mkrn2
  gRNA
accccuuugacccagaacaa

SEQ ID NO: 98817 - RNA, 20 nt, Artificial Sequence
  MKO10098817_B_Mkrn2
  gRNA
auucgaaugaaccuggaaaa

SEQ ID NO: 98818 - RNA, 20 nt, Artificial Sequence
  MKO10098818_B_Mkrn2
  gRNA
ccugaggagggcgaaggguu

SEQ ID NO: 98819 - RNA, 20 nt, Artificial Sequence
  MKO10098819_B_Mkrn3
  gRNA
guggaucaucaagcgcauac

SEQ ID NO: 98820 - RNA, 20 nt, Artificial Sequence
  MKO10098820_B_Mkrn3
  gRNA
ggcggccgcgugggccucaa

SEQ ID NO: 98821 - RNA, 20 nt, Artificial Sequence
  MKO10098821_B_Mkrn3
  gRNA
uugaggccagcgccagccga

SEQ ID NO: 98822 - RNA, 20 nt, Artificial Sequence
  MKO10098822_B_Mks1
  gRNA
auccgcucagccagaaacga

SEQ ID NO: 98823 - RNA, 20 nt, Artificial Sequence
  MKO10098823_B_Mks1
  gRNA
ccgccaagagaucuugaaac

SEQ ID NO: 98824 - RNA, 20 nt, Artificial Sequence
  MKO10098824_B_Mks1
  gRNA
uaaaaguggccaagucuaug

SEQ ID NO: 98825 - RNA, 20 nt, Artificial Sequence
  MKO10098825_B_Mkx
  gRNA
cuuaccugugcgauagacaa

SEQ ID NO: 98826 - RNA, 20 nt, Artificial Sequence
  MKO10098826_B_Mkx
  gRNA
uuuauagacaccccggacau

SEQ ID NO: 98827 - RNA, 20 nt, Artificial Sequence
  MKO10098827_B_Mkx
  gRNA
cgacuccuugagacauguca

SEQ ID NO: 98828 - RNA, 20 nt, Artificial Sequence
  MKO10098828_B_Mlana
  gRNA
cccggcucucagggugaaua

SEQ ID NO: 98829 - RNA, 20 nt, Artificial Sequence
  MKO10098829_B_Mlana
  gRNA
cgauaagcagagcaaucccc

SEQ ID NO: 98830 - RNA, 20 nt, Artificial Sequence
  MKO10098830_B_Mlana
  gRNA
ccccaagaagacauucacuu

SEQ ID NO: 98831 - RNA, 20 nt, Artificial Sequence
  MKO10098831_B_Mlc1
  gRNA
gaacguguuccccuccgaga

SEQ ID NO: 98832 - RNA, 20 nt, Artificial Sequence
  MKO10098832_B_Mlc1
  gRNA
agcgaagcucacaauugcug

SEQ ID NO: 98833 - RNA, 20 nt, Artificial Sequence
  MKO10098833_B_Mlc1
  gRNA
ggcagccacggugaucauuu

SEQ ID NO: 98834 - RNA, 20 nt, Artificial Sequence
  MKO10098834_B_Mlec
  gRNA
gcuauacaucgaguuuguca

SEQ ID NO: 98835 - RNA, 20 nt, Artificial Sequence
  MKO10098835_B_Mlec
  gRNA
gggccgugcugugcccgaca

SEQ ID NO: 98836 - RNA, 20 nt, Artificial Sequence
  MKO10098836_B_Mlec
  gRNA
cugcuguuguccgaggcaua

SEQ ID NO: 98837 - RNA, 20 nt, Artificial Sequence
  MKO10098837_B_Mlf1
  gRNA
ucucuagggccaacuuucaa

SEQ ID NO: 98838 - RNA, 20 nt, Artificial Sequence
  MKO10098838_B_Mlf1
  gRNA
augauggcaaauaugcgaag

SEQ ID NO: 98839 - RNA, 20 nt, Artificial Sequence
  MKO10098839_B_Mlf1
  gRNA
ugaaccaccaaagguguucc

SEQ ID NO: 98840 - RNA, 20 nt, Artificial Sequence
  MKO10098840_B_Mlf2
  gRNA
caccauucccaacaucccga

SEQ ID NO: 98841 - RNA, 20 nt, Artificial Sequence
  MKO10098841_B_Mlf2
  gRNA
ucggagaugcgcucugcccc

SEQ ID NO: 98842 - RNA, 20 nt, Artificial Sequence
  MKO10098842_B_Mlf2
  gRNA
caaagccgccugacaacaug

SEQ ID NO: 98843 - RNA, 20 nt, Artificial Sequence
  MKO10098843_B_Mlh1
  gRNA
uaauagugacaugggccaca

SEQ ID NO: 98844 - RNA, 20 nt, Artificial Sequence
  MKO10098844_B_Mlh1
  gRNA
cuaauucagauccaagacaa

SEQ ID NO: 98845 - RNA, 20 nt, Artificial Sequence
  MKO10098845_B_Mlh1
  gRNA
auuggcaagcauaagccaug

SEQ ID NO: 98846 - RNA, 20 nt, Artificial Sequence
  MKO10098846_B_Mlh3
  gRNA
aguguuugcucgauacccag

SEQ ID NO: 98847 - RNA, 20 nt, Artificial Sequence
  MKO10098847_B_Mlh3
  gRNA
uaaacuuguuauccacuugc

SEQ ID NO: 98848 - RNA, 20 nt, Artificial Sequence
  MKO10098848_B_Mlh3
  gRNA
ucuggguaucgagcaaacac

SEQ ID NO: 98849 - RNA, 20 nt, Artificial Sequence
  MKO10098849_B_Mlip
  gRNA
aagucauuaccuccacuggu

SEQ ID NO: 98850 - RNA, 20 nt, Artificial Sequence
  MKO10098850_B_Mlip
  gRNA
ucagaacccaacauugucug

SEQ ID NO: 98851 - RNA, 20 nt, Artificial Sequence
  MKO10098851_B_Mlip
  gRNA
aggcacuagaugaaccagcc

SEQ ID NO: 98852 - RNA, 20 nt, Artificial Sequence
  MKO10098852_B_Mlkl
  gRNA
caaaguauucaacaaccccc

SEQ ID NO: 98853 - RNA, 20 nt, Artificial Sequence
  MKO10098853_B_Mlkl
  gRNA
cccaaauauacgcaagaugu

SEQ ID NO: 98854 - RNA, 20 nt, Artificial Sequence
  MKO10098854_B_Mlkl
  gRNA
uggccacuuacauugcuuca

SEQ ID NO: 98855 - RNA, 20 nt, Artificial Sequence
  MKO10098855_B_Mllt10
  gRNA
uucuuaccagcuuacuaaag

SEQ ID NO: 98856 - RNA, 20 nt, Artificial Sequence
  MKO10098856_B_Mllt10
  gRNA
gggaaacauaccauguuaca

SEQ ID NO: 98857 - RNA, 20 nt, Artificial Sequence
  MKO10098857_B_Mllt10
  gRNA
gacaggcuuuccauguaaca

SEQ ID NO: 98858 - RNA, 20 nt, Artificial Sequence
  MKO10098858_B_Mllt11
  gRNA
gcugcuauccuugcucucgu

SEQ ID NO: 98859 - RNA, 20 nt, Artificial Sequence
  MKO10098859_B_Mllt11
  gRNA
agcuccgacagauccaguuc

SEQ ID NO: 98860 - RNA, 20 nt, Artificial Sequence
  MKO10098860_B_Mllt11
  gRNA
aguugaaggugcuguacuca

SEQ ID NO: 98861 - RNA, 20 nt, Artificial Sequence
  MKO10098861_B_Mllt1
  gRNA
gagcagcuugcagcgaaacu

SEQ ID NO: 98862 - RNA, 20 nt, Artificial Sequence
  MKO10098862_B_Mllt1
  gRNA
aacucaccacgcuuggguuu

SEQ ID NO: 98863 - RNA, 20 nt, Artificial Sequence
  MKO10098863_B_Mllt1
  gRNA
gcccgacuccuccacuuugu

SEQ ID NO: 98864 - RNA, 20 nt, Artificial Sequence
  MKO10098864_B_Mllt3
  gRNA
ucagugucauuaaccuucug

SEQ ID NO: 98865 - RNA, 20 nt, Artificial Sequence
  MKO10098865_B_Mllt3
  gRNA
cgcagggucagcuugaguga

SEQ ID NO: 98866 - RNA, 20 nt, Artificial Sequence
  MKO10098866_B_Mllt3
  gRNA
ggcggggguucaugauggag

SEQ ID NO: 98867 - RNA, 20 nt, Artificial Sequence
  MKO10098867_B_Mllt4
  gRNA
uugcagugagaacucacgac

SEQ ID NO: 98868 - RNA, 20 nt, Artificial Sequence
  MKO10098868_B_Mllt4
  gRNA
cucuaguuguacaguugaau

SEQ ID NO: 98869 - RNA, 20 nt, Artificial Sequence
  MKO10098869_B_Mllt4
  gRNA
cucuaugaagugcaugucag

SEQ ID NO: 98870 - RNA, 20 nt, Artificial Sequence
  MKO10098870_B_Mllt6
  gRNA
ugcaugaccuguaaccgcca

SEQ ID NO: 98871 - RNA, 20 nt, Artificial Sequence
  MKO10098871_B_Mllt6
  gRNA
agcuugcuauggcaucgucc

SEQ ID NO: 98872 - RNA, 20 nt, Artificial Sequence
  MKO10098872_B_Mllt6
  gRNA
aaucucaggagcgugcagcc

SEQ ID NO: 98873 - RNA, 20 nt, Artificial Sequence
  MKO10098873_B_Mlph
  gRNA
ccugcucuccuuccgagaug

SEQ ID NO: 98874 - RNA, 20 nt, Artificial Sequence
  MKO10098874_B_Mlph
  gRNA
cccgcugccugcagcccuac

SEQ ID NO: 98875 - RNA, 20 nt, Artificial Sequence
  MKO10098875_B_Mlph
  gRNA
cugaggacaggcccaagguu

SEQ ID NO: 98876 - RNA, 20 nt, Artificial Sequence
  MKO10098876_B_Mlst8
  gRNA
agcacucacggcacuauuga

SEQ ID NO: 98877 - RNA, 20 nt, Artificial Sequence
  MKO10098877_B_Mlst8
  gRNA
cgggaaucagcugcucauug

SEQ ID NO: 98878 - RNA, 20 nt, Artificial Sequence
  MKO10098878_B_Mlst8
  gRNA
cugcagcagcaaucaugcuu

SEQ ID NO: 98879 - RNA, 20 nt, Artificial Sequence
  MKO10098879_B_Mlxipl
  gRNA
cauagcuccguaaguccagc

SEQ ID NO: 98880 - RNA, 20 nt, Artificial Sequence
  MKO10098880_B_Mlxipl
  gRNA
ugaugcgcgaauaccacaag

SEQ ID NO: 98881 - RNA, 20 nt, Artificial Sequence
  MKO10098881_B_Mlxipl
  gRNA
gcaagcuggucucucccaag

SEQ ID NO: 98882 - RNA, 20 nt, Artificial Sequence
  MKO10098882_B_Mlxip
  gRNA
uugauguagaugaacaccgu

SEQ ID NO: 98883 - RNA, 20 nt, Artificial Sequence
  MKO10098883_B_Mlxip
  gRNA
gguuaaauaccucuggccga

SEQ ID NO: 98884 - RNA, 20 nt, Artificial Sequence
  MKO10098884_B_Mlxip
  gRNA
ugauucgagaguaccacaag

SEQ ID NO: 98885 - RNA, 20 nt, Artificial Sequence
  MKO10098885_B_Mlx
  gRNA
gcgccucuccggaggacccu

SEQ ID NO: 98886 - RNA, 20 nt, Artificial Sequence
  MKO10098886_B_Mlx
  gRNA
acaaggaguccuacaaagac

SEQ ID NO: 98887 - RNA, 20 nt, Artificial Sequence
  MKO10098887_B_Mlx
  gRNA
aaauccugcugcuggcaggu

SEQ ID NO: 98888 - RNA, 20 nt, Artificial Sequence
  MKO10098888_B_Mlycd
  gRNA
cugugauguggcguaucaac

SEQ ID NO: 98889 - RNA, 20 nt, Artificial Sequence
  MKO10098889_B_Mlycd
  gRNA
agugccaggugacccgcucc

SEQ ID NO: 98890 - RNA, 20 nt, Artificial Sequence
  MKO10098890_B_Mlycd
  gRNA
gaucuucugaaguaccucac

SEQ ID NO: 98891 - RNA, 20 nt, Artificial Sequence
  MKO10098891_B_Mmaa
  gRNA
gagauaugaaugccuacauc

SEQ ID NO: 98892 - RNA, 20 nt, Artificial Sequence
  MKO10098892_B_Mmaa
  gRNA
cucuugacagcucaaucauc

SEQ ID NO: 98893 - RNA, 20 nt, Artificial Sequence
  MKO10098893_B_Mmaa
  gRNA
auuuccagguguagggcagu

SEQ ID NO: 98894 - RNA, 20 nt, Artificial Sequence
  MKO10098894_B_Mmab
  gRNA
gaugagcuaagcucagcuau

SEQ ID NO: 98895 - RNA, 20 nt, Artificial Sequence
  MKO10098895_B_Mmab
  gRNA
auuacuuaagugagccuccc

SEQ ID NO: 98896 - RNA, 20 nt, Artificial Sequence
  MKO10098896_B_Mmab
  gRNA
ccccaagauuuacaccaaga

SEQ ID NO: 98897 - RNA, 20 nt, Artificial Sequence
  MKO10098897_B_Mmachc
  gRNA
acuaugagguacaccccaau

SEQ ID NO: 98898 - RNA, 20 nt, Artificial Sequence
  MKO10098898_B_Mmachc
  gRNA
ugcuucagcucugcgacucg

SEQ ID NO: 98899 - RNA, 20 nt, Artificial Sequence
  MKO10098899_B_Mmachc
  gRNA
cuucgaaguuuaucccuucc

SEQ ID NO: 98900 - RNA, 20 nt, Artificial Sequence
  MKO10098900_B_Mmadhc
  gRNA
aguuugcuauuagccacuuc

SEQ ID NO: 98901 - RNA, 20 nt, Artificial Sequence
  MKO10098901_B_Mmadhc
  gRNA
gcucuguaacagagccagac

SEQ ID NO: 98902 - RNA, 20 nt, Artificial Sequence
  MKO10098902_B_Mmadhc
  gRNA
ugaagauccugcaguugaaa

SEQ ID NO: 98903 - RNA, 20 nt, Artificial Sequence
  MKO10098903_B_Mmd2
  gRNA
uugccgccuccuaugcuccu

SEQ ID NO: 98904 - RNA, 20 nt, Artificial Sequence
  MKO10098904_B_Mmd2
  gRNA
guuuaugaaugaccgagucc

SEQ ID NO: 98905 - RNA, 20 nt, Artificial Sequence
  MKO10098905_B_Mmd2
  gRNA
acuuccuguccgaugacgac

SEQ ID NO: 98906 - RNA, 20 nt, Artificial Sequence
  MKO10098906_B_Mmd
  gRNA
accaacgcauaugagaugcc

SEQ ID NO: 98907 - RNA, 20 nt, Artificial Sequence
  MKO10098907_B_Mmd
  gRNA
agacuaugaagagggcgcaa

SEQ ID NO: 98908 - RNA, 20 nt, Artificial Sequence
  MKO10098908_B_Mmd
  gRNA
cguagcacguugguuuguag

SEQ ID NO: 98909 - RNA, 20 nt, Artificial Sequence
  MKO10098909_B_Mmel1
  gRNA
aguguagcaggcuaguuaag

SEQ ID NO: 98910 - RNA, 20 nt, Artificial Sequence
  MKO10098910_B_Mmel1
  gRNA
cuacucacuuugguucaugc

SEQ ID NO: 98911 - RNA, 20 nt, Artificial Sequence
  MKO10098911_B_Mmel1
  gRNA
uagugucuuggccuucucca

SEQ ID NO: 98912 - RNA, 20 nt, Artificial Sequence
  MKO10098912_B_Mme
  gRNA
auuuauacacgaucuguaca

SEQ ID NO: 98913 - RNA, 20 nt, Artificial Sequence
  MKO10098913_B_Mme
  gRNA
gacuucuucaaguaugcuug

SEQ ID NO: 98914 - RNA, 20 nt, Artificial Sequence
  MKO10098914_B_Mme
  gRNA
ucaucagacugcauaaaauc

SEQ ID NO: 98915 - RNA, 20 nt, Artificial Sequence
  MKO10098915_B_Mmgu1
  gRNA
cuuacgcugcgcagcugaaa

SEQ ID NO: 98916 - RNA, 20 nt, Artificial Sequence
  MKO10098916_B_Mmgu1
  gRNA
uaacuucaacgauguauuag

SEQ ID NO: 98917 - RNA, 20 nt, Artificial Sequence
  MKO10098917_B_Mmgu1
  gRNA
gauaugaacuaugccauaac

SEQ ID NO: 98918 - RNA, 20 nt, Artificial Sequence
  MKO10098918_B_Mmgu2
  gRNA
cauauccuuuaguuccgaag

SEQ ID NO: 98919 - RNA, 20 nt, Artificial Sequence
  MKO10098919_B_Mmgu2
  gRNA
ccuucggaaccaugguggcg

SEQ ID NO: 98920 - RNA, 20 nt, Artificial Sequence
  MKO10098920_B_Mmgu2
  gRNA
cuaccgacuguuccagcguc

SEQ ID NO: 98921 - RNA, 20 nt, Artificial Sequence
  MKO10098921_B_Mmp10
  gRNA
agcauuaccuccaacugcaa

SEQ ID NO: 98922 - RNA, 20 nt, Artificial Sequence
  MKO10098922_B_Mmp10
  gRNA
acuucgaugaugaugagaaa

SEQ ID NO: 98923 - RNA, 20 nt, Artificial Sequence
  MKO10098923_B_Mmp10
  gRNA
gaccuucaaagcuuucucaa

SEQ ID NO: 98924 - RNA, 20 nt, Artificial Sequence
  MKO10098924_B_Mmp11
  gRNA
cacaccacaucguagaggcc

SEQ ID NO: 98925 - RNA, 20 nt, Artificial Sequence
  MKO10098925_B_Mmp11
  gRNA
acaucaugaucgacuucgcc

SEQ ID NO: 98926 - RNA, 20 nt, Artificial Sequence
  MKO10098926_B_Mmp11
  gRNA
cuccagcagugcaaucucau

SEQ ID NO: 98927 - RNA, 20 nt, Artificial Sequence
  MKO10098927_B_Mmp12
  gRNA
cguaacauucagucccucua

SEQ ID NO: 98928 - RNA, 20 nt, Artificial Sequence
  MKO10098928_B_Mmp12
  gRNA
ugaagcgguaccucacuuac

SEQ ID NO: 98929 - RNA, 20 nt, Artificial Sequence
  MKO10098929_B_Mmp12
  gRNA
ugugcaucuccuugaauacc

SEQ ID NO: 98930 - RNA, 20 nt, Artificial Sequence
  MKO10098930_B_Mmp13
  gRNA
auuccuugaacgucaucauc

SEQ ID NO: 98931 - RNA, 20 nt, Artificial Sequence
  MKO10098931_B_Mmp13
  gRNA
ccuaggucuggaucacucca

SEQ ID NO: 98932 - RNA, 20 nt, Artificial Sequence
  MKO10098932_B_Mmp13
  gRNA
accuuuggaacugcuugucc

SEQ ID NO: 98933 - RNA, 20 nt, Artificial Sequence
  MKO10098933_B_Mmp14
  gRNA
auagcgcuuccuccgaacau

SEQ ID NO: 98934 - RNA, 20 nt, Artificial Sequence
  MKO10098934_B_Mmp14
  gRNA
uucggaaggccuuccgagua

SEQ ID NO: 98935 - RNA, 20 nt, Artificial Sequence
  MKO10098935_B_Mmp14
  gRNA
accacagcgagggcgccuca

SEQ ID NO: 98936 - RNA, 20 nt, Artificial Sequence
  MKO10098936_B_Mmp15
  gRNA
aggguucaucugcgucgaaa

SEQ ID NO: 98937 - RNA, 20 nt, Artificial Sequence
  MKO10098937_B_Mmp15
  gRNA
aguugucgguauccauccac

SEQ ID NO: 98938 - RNA, 20 nt, Artificial Sequence
  MKO10098938_B_Mmp15
  gRNA
gaagggugccauaauagcgc

SEQ ID NO: 98939 - RNA, 20 nt, Artificial Sequence
  MKO10098939_B_Mmp16
  gRNA
cgaauugcucuccgggucuc

SEQ ID NO: 98940 - RNA, 20 nt, Artificial Sequence
  MKO10098940_B_Mmp16
  gRNA
gauagacuuaccaucaugau

SEQ ID NO: 98941 - RNA, 20 nt, Artificial Sequence
  MKO10098941_B_Mmp16
  gRNA
gcugccaugcagcaguucua

SEQ ID NO: 98942 - RNA, 20 nt, Artificial Sequence
  MKO10098942_B_Mmp17
  gRNA
auagcguagcgggucaccca

SEQ ID NO: 98943 - RNA, 20 nt, Artificial Sequence
  MKO10098943_B_Mmp17
  gRNA
ggcccacgcaccuccaagaa

SEQ ID NO: 98944 - RNA, 20 nt, Artificial Sequence
  MKO10098944_B_Mmp17
  gRNA
ucugccgcuuccuucucgau

SEQ ID NO: 98945 - RNA, 20 nt, Artificial Sequence
  MKO10098945_B_Mmp19
  gRNA
guagauacccauacugcaac

SEQ ID NO: 98946 - RNA, 20 nt, Artificial Sequence
  MKO10098946_B_Mmp19
  gRNA
uauuggagcaguacaggcuu

SEQ ID NO: 98947 - RNA, 20 nt, Artificial Sequence
  MKO10098947_B_Mmp19
  gRNA
augcagggcugcucggacuc

SEQ ID NO: 98948 - RNA, 20 nt, Artificial Sequence
  MKO10098948_B_Mmp1a
  gRNA
gugugagcaagcuuauaguu

SEQ ID NO: 98949 - RNA, 20 nt, Artificial Sequence
  MKO10098949_B_Mmp1a
  gRNA
gcaucuuccacaacugcuuu

SEQ ID NO: 98950 - RNA, 20 nt, Artificial Sequence
  MKO10098950_B_Mmp1a
  gRNA
uuauuugggcugaaagugac

SEQ ID NO: 98951 - RNA, 20 nt, Artificial Sequence
  MKO10098951_B_Mmp1b
  gRNA
uuacucacaacaauccucgu

SEQ ID NO: 98952 - RNA, 20 nt, Artificial Sequence
  MKO10098952_B_Mmp1b
  gRNA
ggugaccucuacacauuuga

SEQ ID NO: 98953 - RNA, 20 nt, Artificial Sequence
  MKO10098953_B_Mmp1b
  gRNA
uuauuugggcugaaaguaac

SEQ ID NO: 98954 - RNA, 20 nt, Artificial Sequence
  MKO10098954_B_Mmp20
  gRNA
ggggauuccuacccauuuga

SEQ ID NO: 98955 - RNA, 20 nt, Artificial Sequence
  MKO10098955_B_Mmp20
  gRNA
gugaucaagaagccucgcug

SEQ ID NO: 98956 - RNA, 20 nt, Artificial Sequence
  MKO10098956_B_Mmp20
  gRNA
gucccucgaggcccaucaaa

SEQ ID NO: 98957 - RNA, 20 nt, Artificial Sequence
  MKO10098957_B_Mmp21
  gRNA
ccacucccgucaaacacccg

SEQ ID NO: 98958 - RNA, 20 nt, Artificial Sequence
  MKO10098958_B_Mmp21
  gRNA
ccugggccggagaccuaaag

SEQ ID NO: 98959 - RNA, 20 nt, Artificial Sequence
  MKO10098959_B_Mmp21
  gRNA
cgaacagacugccagccagu

SEQ ID NO: 98960 - RNA, 20 nt, Artificial Sequence
  MKO10098960_B_Mmp23
  gRNA
aacaucacuccacauucgaa

SEQ ID NO: 98961 - RNA, 20 nt, Artificial Sequence
  MKO10098961_B_Mmp23
  gRNA
caccucaaugccacauugcg

SEQ ID NO: 98962 - RNA, 20 nt, Artificial Sequence
  MKO10098962_B_Mmp23
  gRNA
uuucuuccaacuguagcgug

SEQ ID NO: 98963 - RNA, 20 nt, Artificial Sequence
  MKO10098963_B_Mmp24
  gRNA
aauaagcgauaugcccuaac

SEQ ID NO: 98964 - RNA, 20 nt, Artificial Sequence
  MKO10098964_B_Mmp24
  gRNA
gaucccagucaccggugugu

SEQ ID NO: 98965 - RNA, 20 nt, Artificial Sequence
  MKO10098965_B_Mmp24
  gRNA
ugaucagggacgccacaucg

SEQ ID NO: 98966 - RNA, 20 nt, Artificial Sequence
  MKO10098966_B_Mmp25
  gRNA
gaagggccgcauaauggagu

SEQ ID NO: 98967 - RNA, 20 nt, Artificial Sequence
  MKO10098967_B_Mmp25
  gRNA
cgacgucgcuauucucugag

SEQ ID NO: 98968 - RNA, 20 nt, Artificial Sequence
  MKO10098968_B_Mmp25
  gRNA
aggaggguccgaacaaucug

SEQ ID NO: 98969 - RNA, 20 nt, Artificial Sequence
  MKO10098969_B_Mmp27
  gRNA
gugacuucuucgaggaucac

SEQ ID NO: 98970 - RNA, 20 nt, Artificial Sequence
  MKO10098970_B_Mmp27
  gRNA
ucacuccacugacguuuacc

SEQ ID NO: 98971 - RNA, 20 nt, Artificial Sequence
  MKO10098971_B_Mmp27
  gRNA
aggauccagggagauguaau

SEQ ID NO: 98972 - RNA, 20 nt, Artificial Sequence
  MKO10098972_B_Mmp28
  gRNA
cagaugacccgcccacgcug

SEQ ID NO: 98973 - RNA, 20 nt, Artificial Sequence
  MKO10098973_B_Mmp28
  gRNA
acucccggagcugcgccagg

SEQ ID NO: 98974 - RNA, 20 nt, Artificial Sequence
  MKO10098974_B_Mmp28
  gRNA
gcagcuccgggaguccgugc

SEQ ID NO: 98975 - RNA, 20 nt, Artificial Sequence
  MKO10098975_B_Mmp2
  gRNA
gccacaucuuggcuuccgca

SEQ ID NO: 98976 - RNA, 20 nt, Artificial Sequence
  MKO10098976_B_Mmp2
  gRNA
cauugguuacacaccugacc

SEQ ID NO: 98977 - RNA, 20 nt, Artificial Sequence
  MKO10098977_B_Mmp2
  gRNA
ccgagcaaaagcaucaucca

SEQ ID NO: 98978 - RNA, 20 nt, Artificial Sequence
  MKO10098978_B_Mmp3
  gRNA
caaguucaugagcagcaacc

SEQ ID NO: 98979 - RNA, 20 nt, Artificial Sequence
  MKO10098979_B_Mmp3
  gRNA
aaauaccuagaaaacuacua

SEQ ID NO: 98980 - RNA, 20 nt, Artificial Sequence
  MKO10098980_B_Mmp3
  gRNA
augcaucagcuccauagugu

SEQ ID NO: 98981 - RNA, 20 nt, Artificial Sequence
  MKO10098981_B_Mmp7
  gRNA
cuaggucaugccuucgcacc

SEQ ID NO: 98982 - RNA, 20 nt, Artificial Sequence
  MKO10098982_B_Mmp7
  gRNA
uuugcugccacccaugaauu

SEQ ID NO: 98983 - RNA, 20 nt, Artificial Sequence
  MKO10098983_B_Mmp7
  gRNA
uaaugccaaacaguccaaaa

SEQ ID NO: 98984 - RNA, 20 nt, Artificial Sequence
  MKO10098984_B_Mmp8
  gRNA
gagcaucuccuccaauaccu

SEQ ID NO: 98985 - RNA, 20 nt, Artificial Sequence
  MKO10098985_B_Mmp8
  gRNA
auuccauuggguccaucaaa

SEQ ID NO: 98986 - RNA, 20 nt, Artificial Sequence
  MKO10098986_B_Mmp8
  gRNA
caugagcagccacgagaaau

SEQ ID NO: 98987 - RNA, 20 nt, Artificial Sequence
  MKO10098987_B_Mmp9
  gRNA
ccgcuucggguccguacacg

SEQ ID NO: 98988 - RNA, 20 nt, Artificial Sequence
  MKO10098988_B_Mmp9
  gRNA
cgccuucgcgcgcgccuucg

SEQ ID NO: 98989 - RNA, 20 nt, Artificial Sequence
  MKO10098989_B_Mmp9
  gRNA
caggcauacuuguaccgcua

SEQ ID NO: 98990 - RNA, 20 nt, Artificial Sequence
  MKO10098990_B_Mmrn1
  gRNA
ccaguguccaguaucacugu

SEQ ID NO: 98991 - RNA, 20 nt, Artificial Sequence
  MKO10098991_B_Mmrn1
  gRNA
gcugucgcuucugcagaaga

SEQ ID NO: 98992 - RNA, 20 nt, Artificial Sequence
  MKO10098992_B_Mmrn1
  gRNA
ugcagccaugauucaaaaac

SEQ ID NO: 98993 - RNA, 20 nt, Artificial Sequence
  MKO10098993_B_Mmrn2
  gRNA
ggcccagaagccaguguacc

SEQ ID NO: 98994 - RNA, 20 nt, Artificial Sequence
  MKO10098994_B_Mmrn2
  gRNA
acuagccuggacuucuggua

SEQ ID NO: 98995 - RNA, 20 nt, Artificial Sequence
  MKO10098995_B_Mmrn2
  gRNA
ccaggagacuugggacucga

SEQ ID NO: 98996 - RNA, 20 nt, Artificial Sequence
  MKO10098996_B_Mms19
  gRNA
ucagccgguucucauagaac

SEQ ID NO: 98997 - RNA, 20 nt, Artificial Sequence
  MKO10098997_B_Mms19
  gRNA
uuguaacacuguauagccac

SEQ ID NO: 98998 - RNA, 20 nt, Artificial Sequence
  MKO10098998_B_Mms19
  gRNA
uguggucccaucugucuuac

SEQ ID NO: 98999 - RNA, 20 nt, Artificial Sequence
  MKO10098999_B_Mms22l
  gRNA
gcgcuguuucuguaacccau

SEQ ID NO: 99000 - RNA, 20 nt, Artificial Sequence
  MKO10099000_B_Mms22l
  gRNA
uaaaugaaagagcucucuac

SEQ ID NO: 99001 - RNA, 20 nt, Artificial Sequence
  MKO10099001_B_Mms22l
  gRNA
uugccuaauacugucugcuu

SEQ ID NO: 99002 - RNA, 20 nt, Artificial Sequence
  MKO10099002_B_Mn1
  gRNA
cacaaaugucccaaaucggu

SEQ ID NO: 99003 - RNA, 20 nt, Artificial Sequence
  MKO10099003_B_Mn1
  gRNA
cagacgaacuuugagcgcga

SEQ ID NO: 99004 - RNA, 20 nt, Artificial Sequence
  MKO10099004_B_Mn1
  gRNA
cuucgcgcucaaaguucguc

SEQ ID NO: 99005 - RNA, 20 nt, Artificial Sequence
  MKO10099005_B_Mnau1
  gRNA
guucuccaaauccacauugu

SEQ ID NO: 99006 - RNA, 20 nt, Artificial Sequence
  MKO10099006_B_Mnau1
  gRNA
uucaaccuccuuaucaacag

SEQ ID NO: 99007 - RNA, 20 nt, Artificial Sequence
  MKO10099007_B_Mnau1
  gRNA
ucauuauacucucuuaaacu

SEQ ID NO: 99008 - RNA, 20 nt, Artificial Sequence
  MKO10099008_B_Mnd1
  gRNA
augcuuuagucaaagaaaag

SEQ ID NO: 99009 - RNA, 20 nt, Artificial Sequence
  MKO10099009_B_Mnd1
  gRNA
cuuacuuaugccuuucucuu

SEQ ID NO: 99010 - RNA, 20 nt, Artificial Sequence
  MKO10099010_B_Mnd1
  gRNA
caaaaaauaucuccaucauc

SEQ ID NO: 99011 - RNA, 20 nt, Artificial Sequence
  MKO10099011_B_Mndal
  gRNA
guggaggcuuaggagaauuc

SEQ ID NO: 99012 - RNA, 20 nt, Artificial Sequence
  MKO10099012_B_Mndal
  gRNA
gcucagcuuccagaaccuuu

SEQ ID NO: 99013 - RNA, 20 nt, Artificial Sequence
  MKO10099013_B_Mndal
  gRNA
acccagcaguuccuuaaaca

SEQ ID NO: 99014 - RNA, 20 nt, Artificial Sequence
  MKO10099014_B_Mnda
  gRNA
aguaacaggagaaacaucac

SEQ ID NO: 99015 - RNA, 20 nt, Artificial Sequence
  MKO10099015_B_Mnda
  gRNA
ggaaguccccgccugagcug

SEQ ID NO: 99016 - RNA, 20 nt, Artificial Sequence
  MKO10099016_B_Mnda
  gRNA
cagaaccagaacauucccag

SEQ ID NO: 99017 - RNA, 20 nt, Artificial Sequence
  MKO10099017_B_Mns1
  gRNA
ucaugauagacgaaauuguc

SEQ ID NO: 99018 - RNA, 20 nt, Artificial Sequence
  MKO10099018_B_Mns1
  gRNA
agagagacuugcaaacgaac

SEQ ID NO: 99019 - RNA, 20 nt, Artificial Sequence
  MKO10099019_B_Mns1
  gRNA
cgccaugaaguaugagcaga

SEQ ID NO: 99020 - RNA, 20 nt, Artificial Sequence
  MKO10099020_B_Mnt
  gRNA
ggagcaggagcgccuucgcc

SEQ ID NO: 99021 - RNA, 20 nt, Artificial Sequence
  MKO10099021_B_Mnt
  gRNA
guggacgccuggucguccuc

SEQ ID NO: 99022 - RNA, 20 nt, Artificial Sequence
  MKO10099022_B_Mnt
  gRNA
cagugguggagccucgauuc

SEQ ID NO: 99023 - RNA, 20 nt, Artificial Sequence
  MKO10099023_B_Mnx1
  gRNA
aggcaagcggccgucgccug

SEQ ID NO: 99024 - RNA, 20 nt, Artificial Sequence
  MKO10099024_B_Mnx1
  gRNA
caaaacgcuugggucgagac

SEQ ID NO: 99025 - RNA, 20 nt, Artificial Sequence
  MKO10099025_B_Mnx1
  gRNA
gcugauggggccuccgguuu

SEQ ID NO: 99026 - RNA, 20 nt, Artificial Sequence
  MKO10099026_B_Moap1
  gRNA
auauugucucaagcgucuuc

SEQ ID NO: 99027 - RNA, 20 nt, Artificial Sequence
  MKO10099027_B_Moap1
  gRNA
cgguugauagagagccuuag

SEQ ID NO: 99028 - RNA, 20 nt, Artificial Sequence
  MKO10099028_B_Moap1
  gRNA
ugacccucucggccuagacc

SEQ ID NO: 99029 - RNA, 20 nt, Artificial Sequence
  MKO10099029_B_Mob1a
  gRNA
cucucggaaguggcaaucug

SEQ ID NO: 99030 - RNA, 20 nt, Artificial Sequence
  MKO10099030_B_Mob1a
  gRNA
guuaacuuaccaaucuuaga

SEQ ID NO: 99031 - RNA, 20 nt, Artificial Sequence
  MKO10099031_B_Mob1a
  gRNA
cuauucugaagcgucucuuc

SEQ ID NO: 99032 - RNA, 20 nt, Artificial Sequence
  MKO10099032_B_Mob1b
  gRNA
agcuguccggugaugucagc

SEQ ID NO: 99033 - RNA, 20 nt, Artificial Sequence
  MKO10099033_B_Mob1b
  gRNA
auaaugucucaucauccagc

SEQ ID NO: 99034 - RNA, 20 nt, Artificial Sequence
  MKO10099034_B_Mob1b
  gRNA
uuugguccagcugacaucac

SEQ ID NO: 99035 - RNA, 20 nt, Artificial Sequence
  MKO10099035_B_Mob2
  gRNA
ccaguggcaccacuguuacc

SEQ ID NO: 99036 - RNA, 20 nt, Artificial Sequence
  MKO10099036_B_Mob2
  gRNA
gucccuacagacaauacuac

SEQ ID NO: 99037 - RNA, 20 nt, Artificial Sequence
  MKO10099037_B_Mob2
  gRNA
cugagauugugcuauacugc

SEQ ID NO: 99038 - RNA, 20 nt, Artificial Sequence
  MKO10099038_B_Mob3a
  gRNA
cgugcgccucagagcccauc

SEQ ID NO: 99039 - RNA, 20 nt, Artificial Sequence
  MKO10099039_B_Mob3a
  gRNA
uacagaaagagaugacauca

SEQ ID NO: 99040 - RNA, 20 nt, Artificial Sequence
  MKO10099040_B_Mob3a
  gRNA
gacaucuuccccacuaaugu

SEQ ID NO: 99041 - RNA, 20 nt, Artificial Sequence
  MKO10099041_B_Mob3b
  gRNA
ggaguguuagugacacaucc

SEQ ID NO: 99042 - RNA, 20 nt, Artificial Sequence
  MKO10099042_B_Mob3b
  gRNA
cugcgcccaucacaaugaca

SEQ ID NO: 99043 - RNA, 20 nt, Artificial Sequence
  MKO10099043_B_Mob3b
  gRNA
uccagaaagagaugacaacc

SEQ ID NO: 99044 - RNA, 20 nt, Artificial Sequence
  MKO10099044_B_Mob3c
  gRNA
guaguaaaagugcuuauagc

SEQ ID NO: 99045 - RNA, 20 nt, Artificial Sequence
  MKO10099045_B_Mob3c
  gRNA
uacagagggagaugacagaa

SEQ ID NO: 99046 - RNA, 20 nt, Artificial Sequence
  MKO10099046_B_Mob3c
  gRNA
ccccggaagcgcuucgagcc

SEQ ID NO: 99047 - RNA, 20 nt, Artificial Sequence
  MKO10099047_B_Mob4
  gRNA
aaaauucuugaaccaccuga

SEQ ID NO: 99048 - RNA, 20 nt, Artificial Sequence
  MKO10099048_B_Mob4
  gRNA
acuuccauacaccuucaucu

SEQ ID NO: 99049 - RNA, 20 nt, Artificial Sequence
  MKO10099049_B_Mob4
  gRNA
ugaugaaucauuugaugaaa

SEQ ID NO: 99050 - RNA, 20 nt, Artificial Sequence
  MKO10099050_B_Mobp
  gRNA
ccagccgcguccccgcccag

SEQ ID NO: 99051 - RNA, 20 nt, Artificial Sequence
  MKO10099051_B_Mobp
  gRNA
cuucucggucacuucuuccu

SEQ ID NO: 99052 - RNA, 20 nt, Artificial Sequence
  MKO10099052_B_Mobp
  gRNA
uauaaaucagauugaggagg

SEQ ID NO: 99053 - RNA, 20 nt, Artificial Sequence
  MKO10099053_B_Mocos
  gRNA
ggaccugcuccacagugucg

SEQ ID NO: 99054 - RNA, 20 nt, Artificial Sequence
  MKO10099054_B_Mocos
  gRNA
gagcccaaagaucuuauaga

SEQ ID NO: 99055 - RNA, 20 nt, Artificial Sequence
  MKO10099055_B_Mocos
  gRNA
caaacucacccacgacacug

SEQ ID NO: 99056 - RNA, 20 nt, Artificial Sequence
  MKO10099056_B_Mocs1
  gRNA
gccgacaacauaguuaccug

SEQ ID NO: 99057 - RNA, 20 nt, Artificial Sequence
  MKO10099057_B_Mocs1
  gRNA
gaauagugcggcagcuccug

SEQ ID NO: 99058 - RNA, 20 nt, Artificial Sequence
  MKO10099058_B_Mocs1
  gRNA
ccuccucgggcaugcaauac

SEQ ID NO: 99059 - RNA, 20 nt, Artificial Sequence
  MKO10099059_B_Mocs2
  gRNA
gccaucaucccgccaaucag

SEQ ID NO: 99060 - RNA, 20 nt, Artificial Sequence
  MKO10099060_B_Mocs2
  gRNA
gcaaaaagugcugaaauagc

SEQ ID NO: 99061 - RNA, 20 nt, Artificial Sequence
  MKO10099061_B_Mocs2
  gRNA
uuggugguguccccucugug

SEQ ID NO: 99062 - RNA, 20 nt, Artificial Sequence
  MKO10099062_B_Mocs3
  gRNA
ugcccgcacacgacgcaguc

SEQ ID NO: 99063 - RNA, 20 nt, Artificial Sequence
  MKO10099063_B_Mocs3
  gRNA
cggccugacugcgucgugug

SEQ ID NO: 99064 - RNA, 20 nt, Artificial Sequence
  MKO10099064_B_Mocs3
  gRNA
gcacgcacgcgucguucacc

SEQ ID NO: 99065 - RNA, 20 nt, Artificial Sequence
  MKO10099065_B_Mogau1
  gRNA
gucuuguauaguucguagcc

SEQ ID NO: 99066 - RNA, 20 nt, Artificial Sequence
  MKO10099066_B_Mogau1
  gRNA
ccaggcacgaauauuccaug

SEQ ID NO: 99067 - RNA, 20 nt, Artificial Sequence
  MKO10099067_B_Mogau1
  gRNA
aguguagaucagcuuccgau

SEQ ID NO: 99068 - RNA, 20 nt, Artificial Sequence
  MKO10099068_B_Mogau2
  gRNA
cucugcaucgucaucuucgu

SEQ ID NO: 99069 - RNA, 20 nt, Artificial Sequence
  MKO10099069_B_Mogau2
  gRNA
caaguucccgccgcccuucc

SEQ ID NO: 99070 - RNA, 20 nt, Artificial Sequence
  MKO10099070_B_Mogau2
  gRNA
gccgcggcuugucccagucc

SEQ ID NO: 99071 - RNA, 20 nt, Artificial Sequence
  MKO10099071_B_Mogs
  gRNA
gcggacguuucucacuacau

SEQ ID NO: 99072 - RNA, 20 nt, Artificial Sequence
  MKO10099072_B_Mogs
  gRNA
guggauaugcugccgaccga

SEQ ID NO: 99073 - RNA, 20 nt, Artificial Sequence
  MKO10099073_B_Mogs
  gRNA
gagguccuacuaccagagau

SEQ ID NO: 99074 - RNA, 20 nt, Artificial Sequence
  MKO10099074_B_Mog
  gRNA
ugugccuacgauccuccugc

SEQ ID NO: 99075 - RNA, 20 nt, Artificial Sequence
  MKO10099075_B_Mog
  gRNA
uaccucucagucugugcugc

SEQ ID NO: 99076 - RNA, 20 nt, Artificial Sequence
  MKO10099076_B_Mog
  gRNA
ggaaaacuucgugcagaagu

SEQ ID NO: 99077 - RNA, 20 nt, Artificial Sequence
  MKO10099077_B_Mon1a
  gRNA
cccgggccacaccggucagc

SEQ ID NO: 99078 - RNA, 20 nt, Artificial Sequence
  MKO10099078_B_Mon1a
  gRNA
ccagcgcaucagcuuaugga

SEQ ID NO: 99079 - RNA, 20 nt, Artificial Sequence
  MKO10099079_B_Mon1a
  gRNA
ccaaugagaaccuccuagcc

SEQ ID NO: 99080 - RNA, 20 nt, Artificial Sequence
  MKO10099080_B_Mon1b
  gRNA
gcacgaacacgugcuuccgc

SEQ ID NO: 99081 - RNA, 20 nt, Artificial Sequence
  MKO10099081_B_Mon1b
  gRNA
cuguugcagucccgagcuag

SEQ ID NO: 99082 - RNA, 20 nt, Artificial Sequence
  MKO10099082_B_Mon1b
  gRNA
uagugacgaagcucuugcgc

SEQ ID NO: 99083 - RNA, 20 nt, Artificial Sequence
  MKO10099083_B_Mon2
  gRNA
ucaugacgaggcacuuucca

SEQ ID NO: 99084 - RNA, 20 nt, Artificial Sequence
  MKO10099084_B_Mon2
  gRNA
ucgugcagccuuuccuaaug

SEQ ID NO: 99085 - RNA, 20 nt, Artificial Sequence
  MKO10099085_B_Mon2
  gRNA
guuccuacaggcugcugaau

SEQ ID NO: 99086 - RNA, 20 nt, Artificial Sequence
  MKO10099086_B_Morc1
  gRNA
acucagccagugcuccaaag

SEQ ID NO: 99087 - RNA, 20 nt, Artificial Sequence
  MKO10099087_B_Morc1
  gRNA
cugaguugcuggacaacgca

SEQ ID NO: 99088 - RNA, 20 nt, Artificial Sequence
  MKO10099088_B_Morc1
  gRNA
gauggauguggcaugagccc

SEQ ID NO: 99089 - RNA, 20 nt, Artificial Sequence
  MKO10099089_B_Morc2a
  gRNA
gcugcuagugugauccaguu

SEQ ID NO: 99090 - RNA, 20 nt, Artificial Sequence
  MKO10099090_B_Morc2a
  gRNA
cugaacugguugauaaugca

SEQ ID NO: 99091 - RNA, 20 nt, Artificial Sequence
  MKO10099091_B_Morc2a
  gRNA
accagcauaaaugucuauuc

SEQ ID NO: 99092 - RNA, 20 nt, Artificial Sequence
  MKO10099092_B_Morc2b
  gRNA
cuuaaaacggugugacguga

SEQ ID NO: 99093 - RNA, 20 nt, Artificial Sequence
  MKO10099093_B_Morc2b
  gRNA
ccgccaccuucugcgggcaa

SEQ ID NO: 99094 - RNA, 20 nt, Artificial Sequence
  MKO10099094_B_Morc2b
  gRNA
auuugagguuacgucuaguu

SEQ ID NO: 99095 - RNA, 20 nt, Artificial Sequence
  MKO10099095_B_Morc3
  gRNA
caaugcuaucauggguaaga

SEQ ID NO: 99096 - RNA, 20 nt, Artificial Sequence
  MKO10099096_B_Morc3
  gRNA
uucuacggaacagaaauuac

SEQ ID NO: 99097 - RNA, 20 nt, Artificial Sequence
  MKO10099097_B_Morc3
  gRNA
aucuguuuagcauucacauc

SEQ ID NO: 99098 - RNA, 20 nt, Artificial Sequence
  MKO10099098_B_Morc4
  gRNA
caguccgccucccggcguuc

SEQ ID NO: 99099 - RNA, 20 nt, Artificial Sequence
  MKO10099099_B_Morc4
  gRNA
accauuaccaaagaccccga

SEQ ID NO: 99100 - RNA, 20 nt, Artificial Sequence
  MKO10099100_B_Morc4
  gRNA
cucaccuagcagcuccgcga

SEQ ID NO: 99101 - RNA, 20 nt, Artificial Sequence
  MKO10099101_B_Morf4l1
  gRNA
cuuauaaauggcgcccaagc

SEQ ID NO: 99102 - RNA, 20 nt, Artificial Sequence
  MKO10099102_B_Morf4l1
  gRNA
guguguaaagguugccauaa

SEQ ID NO: 99103 - RNA, 20 nt, Artificial Sequence
  MKO10099103_B_Morf4l1
  gRNA
aaauacuucauccauuacag

SEQ ID NO: 99104 - RNA, 20 nt, Artificial Sequence
  MKO10099104_B_Morf4l2
  gRNA
ucugcugagaaccccccuuc

SEQ ID NO: 99105 - RNA, 20 nt, Artificial Sequence
  MKO10099105_B_Morf4l2
  gRNA
gcgccgaugucgcagaucua

SEQ ID NO: 99106 - RNA, 20 nt, Artificial Sequence
  MKO10099106_B_Morf4l2
  gRNA
uuucucaucaaggggcguau

SEQ ID NO: 99107 - RNA, 20 nt, Artificial Sequence
  MKO10099107_B_Morn1
  gRNA
ucaggacgggcagguauacc

SEQ ID NO: 99108 - RNA, 20 nt, Artificial Sequence
  MKO10099108_B_Morn1
  gRNA
aauucuuucuuccgcuauga

SEQ ID NO: 99109 - RNA, 20 nt, Artificial Sequence
  MKO10099109_B_Morn1
  gRNA
cuggggaaggcugccagcac

SEQ ID NO: 99110 - RNA, 20 nt, Artificial Sequence
  MKO10099110_B_Morn2
  gRNA
acauguagagcuuuaguuuc

SEQ ID NO: 99111 - RNA, 20 nt, Artificial Sequence
  MKO10099111_B_Morn2
  gRNA
cacaaucagaugaauggcuu

SEQ ID NO: 99112 - RNA, 20 nt, Artificial Sequence
  MKO10099112_B_Morn2
  gRNA
uuuaaggacaacauguuuca

SEQ ID NO: 99113 - RNA, 20 nt, Artificial Sequence
  MKO10099113_B_Morn3
  gRNA
cucacccucguaauacuccu

SEQ ID NO: 99114 - RNA, 20 nt, Artificial Sequence
  MKO10099114_B_Morn3
  gRNA
ggauaagcugaugaagcccg

SEQ ID NO: 99115 - RNA, 20 nt, Artificial Sequence
  MKO10099115_B_Morn3
  gRNA
aagaguggugcggucuauga

SEQ ID NO: 99116 - RNA, 20 nt, Artificial Sequence
  MKO10099116_B_Morn4
  gRNA
cuccccgcuggaguagguaa

SEQ ID NO: 99117 - RNA, 20 nt, Artificial Sequence
  MKO10099117_B_Morn4
  gRNA
uaccugggucacuucgagaa

SEQ ID NO: 99118 - RNA, 20 nt, Artificial Sequence
  MKO10099118_B_Morn4
  gRNA
gcccauucucgaagugaccc

SEQ ID NO: 99119 - RNA, 20 nt, Artificial Sequence
  MKO10099119_B_Morn5
  gRNA
gcuucuauaaccccacgacc

SEQ ID NO: 99120 - RNA, 20 nt, Artificial Sequence
  MKO10099120_B_Morn5
  gRNA
uucuacaccgagaucugcua

SEQ ID NO: 99121 - RNA, 20 nt, Artificial Sequence
  MKO10099121_B_Morn5
  gRNA
cagaugaugacgaacaugag

SEQ ID NO: 99122 - RNA, 20 nt, Artificial Sequence
  MKO10099122_B_Mospd1
  gRNA
ccuuucaggucuuaucacaa

SEQ ID NO: 99123 - RNA, 20 nt, Artificial Sequence
  MKO10099123_B_Mospd1
  gRNA
ccgcaauacauaccacaccc

SEQ ID NO: 99124 - RNA, 20 nt, Artificial Sequence
  MKO10099124_B_Mospd1
  gRNA
agugaagccacagugcugug

SEQ ID NO: 99125 - RNA, 20 nt, Artificial Sequence
  MKO10099125_B_Mospd2
  gRNA
augauucacgugauguugaa

SEQ ID NO: 99126 - RNA, 20 nt, Artificial Sequence
  MKO10099126_B_Mospd2
  gRNA
ccaaguucuaauaaccaucu

SEQ ID NO: 99127 - RNA, 20 nt, Artificial Sequence
  MKO10099127_B_Mospd2
  gRNA
gagcuucuucuuguccauua

SEQ ID NO: 99128 - RNA, 20 nt, Artificial Sequence
  MKO10099128_B_Mospd3
  gRNA
aucuguccuggacgucauag

SEQ ID NO: 99129 - RNA, 20 nt, Artificial Sequence
  MKO10099129_B_Mospd3
  gRNA
acugugcucaccuaagacgu

SEQ ID NO: 99130 - RNA, 20 nt, Artificial Sequence
  MKO10099130_B_Mospd3
  gRNA
agcugagaguucagguccgg

SEQ ID NO: 99131 - RNA, 20 nt, Artificial Sequence
  MKO10099131_B_Mos
  gRNA
cuacaaucugcgccccucac

SEQ ID NO: 99132 - RNA, 20 nt, Artificial Sequence
  MKO10099132_B_Mos
  gRNA
gccggaguaaggcaccuccc

SEQ ID NO: 99133 - RNA, 20 nt, Artificial Sequence
  MKO10099133_B_Mos
  gRNA
ggccagccggcguggcaguc

SEQ ID NO: 99134 - RNA, 20 nt, Artificial Sequence
  MKO10099134_B_Mov10l1
  gRNA
acuccuugaagcugccggaa

SEQ ID NO: 99135 - RNA, 20 nt, Artificial Sequence
  MKO10099135_B_Mov10l1
  gRNA
uccacacgcuuguaccucag

SEQ ID NO: 99136 - RNA, 20 nt, Artificial Sequence
  MKO10099136_B_Mov10l1
  gRNA
uuucaguaagagugcuccau

SEQ ID NO: 99137 - RNA, 20 nt, Artificial Sequence
  MKO10099137_B_Mov10
  gRNA
aguucagcugccgaaagcuc

SEQ ID NO: 99138 - RNA, 20 nt, Artificial Sequence
  MKO10099138_B_Mov10
  gRNA
accuggagacagaucgugag

SEQ ID NO: 99139 - RNA, 20 nt, Artificial Sequence
  MKO10099139_B_Mov10
  gRNA
uuucuacauugcccgauucc

SEQ ID NO: 99140 - RNA, 20 nt, Artificial Sequence
  MKO10099140_B_Moxd1
  gRNA
acacagugaucgaguuuagc

SEQ ID NO: 99141 - RNA, 20 nt, Artificial Sequence
  MKO10099141_B_Moxd1
  gRNA
guggagccaauaauagagag

SEQ ID NO: 99142 - RNA, 20 nt, Artificial Sequence
  MKO10099142_B_Moxd1
  gRNA
auagcaccgugagaguuauc

SEQ ID NO: 99143 - RNA, 20 nt, Artificial Sequence
  MKO10099143_B_Moxd2
  gRNA
cauccgggccauaggcagcc

SEQ ID NO: 99144 - RNA, 20 nt, Artificial Sequence
  MKO10099144_B_Moxd2
  gRNA
guaugcucccgacucaucuu

SEQ ID NO: 99145 - RNA, 20 nt, Artificial Sequence
  MKO10099145_B_Moxd2
  gRNA
uccacaugaucgugacauua

SEQ ID NO: 99146 - RNA, 20 nt, Artificial Sequence
  MKO10099146_B_Mpc1
  gRNA
gagcuacuucguuuguuaca

SEQ ID NO: 99147 - RNA, 20 nt, Artificial Sequence
  MKO10099147_B_Mpc1
  gRNA
auucaugagauuugccuaca

SEQ ID NO: 99148 - RNA, 20 nt, Artificial Sequence
  MKO10099148_B_Mpc1
  gRNA
uccuuguaccgcuaugcaga

SEQ ID NO: 99149 - RNA, 20 nt, Artificial Sequence
  MKO10099149_B_Mpc2
  gRNA
agcucaguccacuguguuga

SEQ ID NO: 99150 - RNA, 20 nt, Artificial Sequence
  MKO10099150_B_Mpc2
  gRNA
ucccuuuagauuugaguucu

SEQ ID NO: 99151 - RNA, 20 nt, Artificial Sequence
  MKO10099151_B_Mpc2
  gRNA
uugcagggauuggugugugc

SEQ ID NO: 99152 - RNA, 20 nt, Artificial Sequence
  MKO10099152_B_Mpdu1
  gRNA
cuagcuccagcauuacugac

SEQ ID NO: 99153 - RNA, 20 nt, Artificial Sequence
  MKO10099153_B_Mpdu1
  gRNA
cucgggcugggcaucguggc

SEQ ID NO: 99154 - RNA, 20 nt, Artificial Sequence
  MKO10099154_B_Mpdu1
  gRNA
uggcaacggucuggaguguc

SEQ ID NO: 99155 - RNA, 20 nt, Artificial Sequence
  MKO10099155_B_Mpdz
  gRNA
gcccaacaacacuaaagccg

SEQ ID NO: 99156 - RNA, 20 nt, Artificial Sequence
  MKO10099156_B_Mpdz
  gRNA
gagcuccuuaaaccuccgug

SEQ ID NO: 99157 - RNA, 20 nt, Artificial Sequence
  MKO10099157_B_Mpdz
  gRNA
ggcuucccauccaugacagc

SEQ ID NO: 99158 - RNA, 20 nt, Artificial Sequence
  MKO10099158_B_Mpeg1
  gRNA
aacaccgugaccgcuucugc

SEQ ID NO: 99159 - RNA, 20 nt, Artificial Sequence
  MKO10099159_B_Mpeg1
  gRNA
ggccaaguaccugacaacuc

SEQ ID NO: 99160 - RNA, 20 nt, Artificial Sequence
  MKO10099160_B_Mpeg1
  gRNA
gagaaccucuggagcuucgu

SEQ ID NO: 99161 - RNA, 20 nt, Artificial Sequence
  MKO10099161_B_Mpg
  gRNA
cggcgggcucguccaagaaa

SEQ ID NO: 99162 - RNA, 20 nt, Artificial Sequence
  MKO10099162_B_Mpg
  gRNA
ggaguuacgaagcugccgca

SEQ ID NO: 99163 - RNA, 20 nt, Artificial Sequence
  MKO10099163_B_Mpg
  gRNA
uuacagcuuucccgaaagau

SEQ ID NO: 99164 - RNA, 20 nt, Artificial Sequence
  MKO10099164_B_Mphosph10
  gRNA
ugauccaguugaaagugacg

SEQ ID NO: 99165 - RNA, 20 nt, Artificial Sequence
  MKO10099165_B_Mphosph10
  gRNA
uccacuuugaccaugcaguc

SEQ ID NO: 99166 - RNA, 20 nt, Artificial Sequence
  MKO10099166_B_Mphosph10
  gRNA
ccauacccauccugacugca

SEQ ID NO: 99167 - RNA, 20 nt, Artificial Sequence
  MKO10099167_B_Mphosph6
  gRNA
ucuuaacaguucaugcaaag

SEQ ID NO: 99168 - RNA, 20 nt, Artificial Sequence
  MKO10099168_B_Mphosph6
  gRNA
uccuaacagauaugagacuu

SEQ ID NO: 99169 - RNA, 20 nt, Artificial Sequence
  MKO10099169_B_Mphosph6
  gRNA
cgaugugucugaugaggaaa

SEQ ID NO: 99170 - RNA, 20 nt, Artificial Sequence
  MKO10099170_B_Mphosph8
  gRNA
ugccaaacagaugagacguc

SEQ ID NO: 99171 - RNA, 20 nt, Artificial Sequence
  MKO10099171_B_Mphosph8
  gRNA
agaaucuuuauaaaguucga

SEQ ID NO: 99172 - RNA, 20 nt, Artificial Sequence
  MKO10099172_B_Mphosph8
  gRNA
auaccagaaaagguaugauu

SEQ ID NO: 99173 - RNA, 20 nt, Artificial Sequence
  MKO10099173_B_Mphosph9
  gRNA
gugguaagucuguaacaucc

SEQ ID NO: 99174 - RNA, 20 nt, Artificial Sequence
  MKO10099174_B_Mphosph9
  gRNA
gacgugcagcaucggcagca

SEQ ID NO: 99175 - RNA, 20 nt, Artificial Sequence
  MKO10099175_B_Mphosph9
  gRNA
uuguucucagcgaauacagg

SEQ ID NO: 99176 - RNA, 20 nt, Artificial Sequence
  MKO10099176_B_Mpi
  gRNA
gguggagcagcuuaaccugu

SEQ ID NO: 99177 - RNA, 20 nt, Artificial Sequence
  MKO10099177_B_Mpi
  gRNA
cccaaccuuacucuucauaa

SEQ ID NO: 99178 - RNA, 20 nt, Artificial Sequence
  MKO10099178_B_Mpi
  gRNA
uauccaggcacacccuaaca

SEQ ID NO: 99179 - RNA, 20 nt, Artificial Sequence
  MKO10099179_B_Mplkip
  gRNA
aaaaagaaugucuaaugagu

SEQ ID NO: 99180 - RNA, 20 nt, Artificial Sequence
  MKO10099180_B_Mplkip
  gRNA
aacuucucgggggcccgcuu

SEQ ID NO: 99181 - RNA, 20 nt, Artificial Sequence
  MKO10099181_B_Mplkip
  gRNA
ugcucccguacggccuagcc

SEQ ID NO: 99182 - RNA, 20 nt, Artificial Sequence
  MKO10099182_B_Mpl
  gRNA
uauccacaaacagcacccgc

SEQ ID NO: 99183 - RNA, 20 nt, Artificial Sequence
  MKO10099183_B_Mpl
  gRNA
agaagaggcgcacuucaucc

SEQ ID NO: 99184 - RNA, 20 nt, Artificial Sequence
  MKO10099184_B_Mpl
  gRNA
cucgguaggcauacagcagc

SEQ ID NO: 99185 - RNA, 20 nt, Artificial Sequence
  MKO10099185_B_Mpnd
  gRNA
accucaucggccguagcuac

SEQ ID NO: 99186 - RNA, 20 nt, Artificial Sequence
  MKO10099186_B_Mpnd
  gRNA
accuuguccauacgcuuccc

SEQ ID NO: 99187 - RNA, 20 nt, Artificial Sequence
  MKO10099187_B_Mpnd
  gRNA
uaacugaccuggcggagucu

SEQ ID NO: 99188 - RNA, 20 nt, Artificial Sequence
  MKO10099188_B_Mpo
  gRNA
aucaagcggagccuccaaag

SEQ ID NO: 99189 - RNA, 20 nt, Artificial Sequence
  MKO10099189_B_Mpo
  gRNA
augcccuuuggcuggacgcc

SEQ ID NO: 99190 - RNA, 20 nt, Artificial Sequence
  MKO10099190_B_Mpo
  gRNA
agaguaccuguaacauugaa

SEQ ID NO: 99191 - RNA, 20 nt, Artificial Sequence
  MKO10099191_B_Mpp1
  gRNA
ccagucaaauguuacuacug

SEQ ID NO: 99192 - RNA, 20 nt, Artificial Sequence
  MKO10099192_B_Mpp1
  gRNA
accaauggguccccugcucc

SEQ ID NO: 99193 - RNA, 20 nt, Artificial Sequence
  MKO10099193_B_Mpp1
  gRNA
cucaguagaucaguugcaga

SEQ ID NO: 99194 - RNA, 20 nt, Artificial Sequence
  MKO10099194_B_Mpp2
  gRNA
ucagggugugacauuccgag

SEQ ID NO: 99195 - RNA, 20 nt, Artificial Sequence
  MKO10099195_B_Mpp2
  gRNA
gcccggggaucgcugcccac

SEQ ID NO: 99196 - RNA, 20 nt, Artificial Sequence
  MKO10099196_B_Mpp2
  gRNA
aaguccgauagucagauccc

SEQ ID NO: 99197 - RNA, 20 nt, Artificial Sequence
  MKO10099197_B_Mpp3
  gRNA
gacucugccucucauaauag

SEQ ID NO: 99198 - RNA, 20 nt, Artificial Sequence
  MKO10099198_B_Mpp3
  gRNA
ggcgugacuacccugaggug

SEQ ID NO: 99199 - RNA, 20 nt, Artificial Sequence
  MKO10099199_B_Mpp3
  gRNA
gagccucaguuauuuaauga

SEQ ID NO: 99200 - RNA, 20 nt, Artificial Sequence
  MKO10099200_B_Mpp4
  gRNA
acgccaccugauccugagaa

SEQ ID NO: 99201 - RNA, 20 nt, Artificial Sequence
  MKO10099201_B_Mpp4
  gRNA
uucuacagccgagaugugaa

SEQ ID NO: 99202 - RNA, 20 nt, Artificial Sequence
  MKO10099202_B_Mpp4
  gRNA
aucugugcaugaguuguauc

SEQ ID NO: 99203 - RNA, 20 nt, Artificial Sequence
  MKO10099203_B_Mpp5
  gRNA
uuacaguuucucccccguaa

SEQ ID NO: 99204 - RNA, 20 nt, Artificial Sequence
  MKO10099204_B_Mpp5
  gRNA
uguacaagaccuuguacaag

SEQ ID NO: 99205 - RNA, 20 nt, Artificial Sequence
  MKO10099205_B_Mpp5
  gRNA
ccugcucagcaaccuuauca

SEQ ID NO: 99206 - RNA, 20 nt, Artificial Sequence
  MKO10099206_B_Mpp6
  gRNA
uuagcaagugacuucacaau

SEQ ID NO: 99207 - RNA, 20 nt, Artificial Sequence
  MKO10099207_B_Mpp6
  gRNA
agcugugagugacaauaacu

SEQ ID NO: 99208 - RNA, 20 nt, Artificial Sequence
  MKO10099208_B_Mpp6
  gRNA
cuccuuacagucgcuccugg

SEQ ID NO: 99209 - RNA, 20 nt, Artificial Sequence
  MKO10099209_B_Mpp7
  gRNA
aauccguugcccauucucca

SEQ ID NO: 99210 - RNA, 20 nt, Artificial Sequence
  MKO10099210_B_Mpp7
  gRNA
gcugucaaaacccaauguca

SEQ ID NO: 99211 - RNA, 20 nt, Artificial Sequence
  MKO10099211_B_Mpp7
  gRNA
cagccaacgcugcugcacca

SEQ ID NO: 99212 - RNA, 20 nt, Artificial Sequence
  MKO10099212_B_Mppe1
  gRNA
cauggucaacagcguugcaa

SEQ ID NO: 99213 - RNA, 20 nt, Artificial Sequence
  MKO10099213_B_Mppe1
  gRNA
uaaacugaauugcucccaag

SEQ ID NO: 99214 - RNA, 20 nt, Artificial Sequence
  MKO10099214_B_Mppe1
  gRNA
aagcgauuugagaaaguguu

SEQ ID NO: 99215 - RNA, 20 nt, Artificial Sequence
  MKO10099215_B_Mpped1
  gRNA
cgaugugcugauccacgcug

SEQ ID NO: 99216 - RNA, 20 nt, Artificial Sequence
  MKO10099216_B_Mpped1
  gRNA
cagccacggcugcacgucuu

SEQ ID NO: 99217 - RNA, 20 nt, Artificial Sequence
  MKO10099217_B_Mpped1
  gRNA
uggggauucaaccucccgag

SEQ ID NO: 99218 - RNA, 20 nt, Artificial Sequence
  MKO10099218_B_Mpped2
  gRNA
uggggcuuuaaccuacccag

SEQ ID NO: 99219 - RNA, 20 nt, Artificial Sequence
  MKO10099219_B_Mpped2
  gRNA
augaguaugucgaugcccuc

SEQ ID NO: 99220 - RNA, 20 nt, Artificial Sequence
  MKO10099220_B_Mpped2
  gRNA
cauggcagaccucguuaaac

SEQ ID NO: 99221 - RNA, 20 nt, Artificial Sequence
  MKO10099221_B_Mprip
  gRNA
uucuaggcaaaacccauuua

SEQ ID NO: 99222 - RNA, 20 nt, Artificial Sequence
  MKO10099222_B_Mprip
  gRNA
gcagcccaccacccucccuc

SEQ ID NO: 99223 - RNA, 20 nt, Artificial Sequence
  MKO10099223_B_Mprip
  gRNA
uuacccacugaugaucuccu

SEQ ID NO: 99224 - RNA, 20 nt, Artificial Sequence
  MKO10099224_B_Mpst
  gRNA
ccccgugcaggcaucgaacc

SEQ ID NO: 99225 - RNA, 20 nt, Artificial Sequence
  MKO10099225_B_Mpst
  gRNA
gcccaagcugcccgcguagu

SEQ ID NO: 99226 - RNA, 20 nt, Artificial Sequence
  MKO10099226_B_Mpst
  gRNA
cgaugcacgacgcgaguuug

SEQ ID NO: 99227 - RNA, 20 nt, Artificial Sequence
  MKO10099227_B_Mptx1
  gRNA
cacaauggagaagcuuauug

SEQ ID NO: 99228 - RNA, 20 nt, Artificial Sequence
  MKO10099228_B_Mptx1
  gRNA
acaagagcaggauuccuaug

SEQ ID NO: 99229 - RNA, 20 nt, Artificial Sequence
  MKO10099229_B_Mptx1
  gRNA
ggugaugcaaugaucacucu

SEQ ID NO: 99230 - RNA, 20 nt, Artificial Sequence
  MKO10099230_B_Mptx2
  gRNA
cugaaagaacagagagaaac

SEQ ID NO: 99231 - RNA, 20 nt, Artificial Sequence
  MKO10099231_B_Mptx2
  gRNA
cuaugugguccccauaaaag

SEQ ID NO: 99232 - RNA, 20 nt, Artificial Sequence
  MKO10099232_B_Mptx2
  gRNA
aagcucuuauucaugaagac

SEQ ID NO: 99233 - RNA, 20 nt, Artificial Sequence
  MKO10099233_B_Mpv17l2
  gRNA
cagugucagcccauugauau

SEQ ID NO: 99234 - RNA, 20 nt, Artificial Sequence
  MKO10099234_B_Mpv17l2
  gRNA
cccugaaccccuucagacuc

SEQ ID NO: 99235 - RNA, 20 nt, Artificial Sequence
  MKO10099235_B_Mpv17l2
  gRNA
caaauucugggacuucuaca

SEQ ID NO: 99236 - RNA, 20 nt, Artificial Sequence
  MKO10099236_B_Mpv17l
  gRNA
ccauauucaucuuccuucgc

SEQ ID NO: 99237 - RNA, 20 nt, Artificial Sequence
  MKO10099237_B_Mpv17l
  gRNA
uccagaguggucucauguac

SEQ ID NO: 99238 - RNA, 20 nt, Artificial Sequence
  MKO10099238_B_Mpv17l
  gRNA
cuggcacuuaccugcacaaa

SEQ ID NO: 99239 - RNA, 20 nt, Artificial Sequence
  MKO10099239_B_Mpv17
  gRNA
uccacucacccgcuucaguu

SEQ ID NO: 99240 - RNA, 20 nt, Artificial Sequence
  MKO10099240_B_Mpv17
  gRNA
cacucugaccaugguauccc

SEQ ID NO: 99241 - RNA, 20 nt, Artificial Sequence
  MKO10099241_B_Mpv17
  gRNA
gaagaagauguuguuagauc

SEQ ID NO: 99242 - RNA, 20 nt, Artificial Sequence
  MKO10099242_B_Mpzl1
  gRNA
cucacacagcccgagcaucg

SEQ ID NO: 99243 - RNA, 20 nt, Artificial Sequence
  MKO10099243_B_Mpzl1
  gRNA
cauucgaagcgggauuauac

SEQ ID NO: 99244 - RNA, 20 nt, Artificial Sequence
  MKO10099244_B_Mpzl1
  gRNA
gucaaccauccaguuguguu

SEQ ID NO: 99245 - RNA, 20 nt, Artificial Sequence
  MKO10099245_B_Mpzl2
  gRNA
gaugaucaucguagugaucg

SEQ ID NO: 99246 - RNA, 20 nt, Artificial Sequence
  MKO10099246_B_Mpzl2
  gRNA
ggacagugcugauaaagccg

SEQ ID NO: 99247 - RNA, 20 nt, Artificial Sequence
  MKO10099247_B_Mpzl2
  gRNA
aagcugcaguuugacgacaa

SEQ ID NO: 99248 - RNA, 20 nt, Artificial Sequence
  MKO10099248_B_Mpzl3
  gRNA
ugcgcguaucguccucuccu

SEQ ID NO: 99249 - RNA, 20 nt, Artificial Sequence
  MKO10099249_B_Mpzl3
  gRNA
uguccgcugugcagaguguc

SEQ ID NO: 99250 - RNA, 20 nt, Artificial Sequence
  MKO10099250_B_Mpzl3
  gRNA
acagcaaugacugcaugacg

SEQ ID NO: 99251 - RNA, 20 nt, Artificial Sequence
  MKO10099251_B_Mpz
  gRNA
ccauugugguuuacacggac

SEQ ID NO: 99252 - RNA, 20 nt, Artificial Sequence
  MKO10099252_B_Mpz
  gRNA
caacaccaccccauaccuag

SEQ ID NO: 99253 - RNA, 20 nt, Artificial Sequence
  MKO10099253_B_Mpz
  gRNA
gagauuucacaaaucuucga

SEQ ID NO: 99254 - RNA, 20 nt, Artificial Sequence
  MKO10099254_B_Mr1
  gRNA
gacgaaaauaucucagcgag

SEQ ID NO: 99255 - RNA, 20 nt, Artificial Sequence
  MKO10099255_B_Mr1
  gRNA
cuucgagugagcacgaucuc

SEQ ID NO: 99256 - RNA, 20 nt, Artificial Sequence
  MKO10099256_B_Mr1
  gRNA
aacugacagccacguuugau

SEQ ID NO: 99257 - RNA, 20 nt, Artificial Sequence
  MKO10099257_B_Mrap2
  gRNA
cucauaguacucguauuccc

SEQ ID NO: 99258 - RNA, 20 nt, Artificial Sequence
  MKO10099258_B_Mrap2
  gRNA
caucgaacucugacuacacc

SEQ ID NO: 99259 - RNA, 20 nt, Artificial Sequence
  MKO10099259_B_Mrap2
  gRNA
cccagacuuacucuuggugu

SEQ ID NO: 99260 - RNA, 20 nt, Artificial Sequence
  MKO10099260_B_Mrap
  gRNA
aaccccagccaauauguuca

SEQ ID NO: 99261 - RNA, 20 nt, Artificial Sequence
  MKO10099261_B_Mrap
  gRNA
ccgaccaggacauguagagc

SEQ ID NO: 99262 - RNA, 20 nt, Artificial Sequence
  MKO10099262_B_Mrap
  gRNA
ggccucccugcagacaacag

SEQ ID NO: 99263 - RNA, 20 nt, Artificial Sequence
  MKO10099263_B_Mras
  gRNA
uuggcacuggucucuauaua

SEQ ID NO: 99264 - RNA, 20 nt, Artificial Sequence
  MKO10099264_B_Mras
  gRNA
gugcaucagauccaccuugu

SEQ ID NO: 99265 - RNA, 20 nt, Artificial Sequence
  MKO10099265_B_Mras
  gRNA
augaccuaguuagaguaauu

SEQ ID NO: 99266 - RNA, 20 nt, Artificial Sequence
  MKO10099266_B_Mrc1
  gRNA
ucggacggauggcucuggug

SEQ ID NO: 99267 - RNA, 20 nt, Artificial Sequence
  MKO10099267_B_Mrc1
  gRNA
acggaugaccugugcucgag

SEQ ID NO: 99268 - RNA, 20 nt, Artificial Sequence
  MKO10099268_B_Mrc1
  gRNA
cugugagguacauuugcucg

SEQ ID NO: 99269 - RNA, 20 nt, Artificial Sequence
  MKO10099269_B_Mrc2
  gRNA
auuaaggccaauccauagcg

SEQ ID NO: 99270 - RNA, 20 nt, Artificial Sequence
  MKO10099270_B_Mrc2
  gRNA
gcucaucuuugccguagucc

SEQ ID NO: 99271 - RNA, 20 nt, Artificial Sequence
  MKO10099271_B_Mrc2
  gRNA
guaacgacugugagaccuuc

SEQ ID NO: 99272 - RNA, 20 nt, Artificial Sequence
  MKO10099272_B_Mre11a
  gRNA
aguccgguucugcugcagaa

SEQ ID NO: 99273 - RNA, 20 nt, Artificial Sequence
  MKO10099273_B_Mre11a
  gRNA
agugaucagucagucaacuu

SEQ ID NO: 99274 - RNA, 20 nt, Artificial Sequence
  MKO10099274_B_Mre11a
  gRNA
uccaugaaaacaagcccucg

SEQ ID NO: 99275 - RNA, 20 nt, Artificial Sequence
  MKO10099275_B_Mreg
  gRNA
ccucuaagauucgucuccau

SEQ ID NO: 99276 - RNA, 20 nt, Artificial Sequence
  MKO10099276_B_Mreg
  gRNA
aacaauccguauuccuccuu

SEQ ID NO: 99277 - RNA, 20 nt, Artificial Sequence
  MKO10099277_B_Mreg
  gRNA
ccucuaucuuccccgccagc

SEQ ID NO: 99278 - RNA, 20 nt, Artificial Sequence
  MKO10099278_B_Mrfap1
  gRNA
gccggcggcgccgagccccg

SEQ ID NO: 99279 - RNA, 20 nt, Artificial Sequence
  MKO10099279_B_Mrfap1
  gRNA
gguggaggugcuggagcccg

SEQ ID NO: 99280 - RNA, 20 nt, Artificial Sequence
  MKO10099280_B_Mrfap1
  gRNA
agcagcggcgaugcggcccc

SEQ ID NO: 99281 - RNA, 20 nt, Artificial Sequence
  MKO10099281_B_Mrgbp
  gRNA
ugucguacauagugcucaga

SEQ ID NO: 99282 - RNA, 20 nt, Artificial Sequence
  MKO10099282_B_Mrgbp
  gRNA
gaggauguggacccccacag

SEQ ID NO: 99283 - RNA, 20 nt, Artificial Sequence
  MKO10099283_B_Mrgbp
  gRNA
ccuuccagaugagaucauuc

SEQ ID NO: 99284 - RNA, 20 nt, Artificial Sequence
  MKO10099284_B_Mrgpra1
  gRNA
uuggcgaggccgauguguuu

SEQ ID NO: 99285 - RNA, 20 nt, Artificial Sequence
  MKO10099285_B_Mrgpra1
  gRNA
agucagcuagagcuaaguuu

SEQ ID NO: 99286 - RNA, 20 nt, Artificial Sequence
  MKO10099286_B_Mrgpra1
  gRNA
guuucuagcccuaaacacau

SEQ ID NO: 99287 - RNA, 20 nt, Artificial Sequence
  MKO10099287_B_Mrgpra2a
  gRNA
accagugacaacaaauccaa

SEQ ID NO: 99288 - RNA, 20 nt, Artificial Sequence
  MKO10099288_B_Mrgpra2a
  gRNA
ugauaaugacaaugaguguc

SEQ ID NO: 99289 - RNA, 20 nt, Artificial Sequence
  MKO10099289_B_Mrgpra2a
  gRNA
gagccaggcuggacagacag

SEQ ID NO: 99290 - RNA, 20 nt, Artificial Sequence
  MKO10099290_B_Mrgpra2b
  gRNA
accagugacaacaaauccaa

SEQ ID NO: 99291 - RNA, 20 nt, Artificial Sequence
  MKO10099291_B_Mrgpra2b
  gRNA
ugauaaugacaaugaguguc

SEQ ID NO: 99292 - RNA, 20 nt, Artificial Sequence
  MKO10099292_B_Mrgpra2b
  gRNA
gagccaggcuggacagacag

SEQ ID NO: 99293 - RNA, 20 nt, Artificial Sequence
  MKO10099293_B_Mrgpra3
  gRNA
acuagauuauagcccucuuc

SEQ ID NO: 99294 - RNA, 20 nt, Artificial Sequence
  MKO10099294_B_Mrgpra3
  gRNA
cucaaguuuacccuacccaa

SEQ ID NO: 99295 - RNA, 20 nt, Artificial Sequence
  MKO10099295_B_Mrgpra3
  gRNA
gucccuguugaucugcauuc

SEQ ID NO: 99296 - RNA, 20 nt, Artificial Sequence
  MKO10099296_B_Mrgpra4
  gRNA
ucuucugguuucuggugccc

SEQ ID NO: 99297 - RNA, 20 nt, Artificial Sequence
  MKO10099297_B_Mrgpra4
  gRNA
ucaugaugaugucaaagcaa

SEQ ID NO: 99298 - RNA, 20 nt, Artificial Sequence
  MKO10099298_B_Mrgpra4
  gRNA
ccagaaaccagaagaagccc

SEQ ID NO: 99299 - RNA, 20 nt, Artificial Sequence
  MKO10099299_B_Mrgpra6
  gRNA
gaagcaccagacccucaaaa

SEQ ID NO: 99300 - RNA, 20 nt, Artificial Sequence
  MKO10099300_B_Mrgpra6
  gRNA
cccauagucaucuucauauu

SEQ ID NO: 99301 - RNA, 20 nt, Artificial Sequence
  MKO10099301_B_Mrgpra6
  gRNA
gaugcugauacuucuaugca

SEQ ID NO: 99302 - RNA, 20 nt, Artificial Sequence
  MKO10099302_B_Mrgpra9
  gRNA
agaucacuggcuucuguaca

SEQ ID NO: 99303 - RNA, 20 nt, Artificial Sequence
  MKO10099303_B_Mrgpra9
  gRNA
cagagcuauuaauagcacuc

SEQ ID NO: 99304 - RNA, 20 nt, Artificial Sequence
  MKO10099304_B_Mrgpra9
  gRNA
ucauuugccuuuacaccuuc

SEQ ID NO: 99305 - RNA, 20 nt, Artificial Sequence
  MKO10099305_B_Mrgprb1
  gRNA
gucacguuacgaaaaccaca

SEQ ID NO: 99306 - RNA, 20 nt, Artificial Sequence
  MKO10099306_B_Mrgprb1
  gRNA
gagucuuccguugaaaccga

SEQ ID NO: 99307 - RNA, 20 nt, Artificial Sequence
  MKO10099307_B_Mrgprb1
  gRNA
gguaccgcugccaacgccca

SEQ ID NO: 99308 - RNA, 20 nt, Artificial Sequence
  MKO10099308_B_Mrgprb2
  gRNA
cauuuagucccaucccaacc

SEQ ID NO: 99309 - RNA, 20 nt, Artificial Sequence
  MKO10099309_B_Mrgprb2
  gRNA
acguuuacagcgauaccaaa

SEQ ID NO: 99310 - RNA, 20 nt, Artificial Sequence
  MKO10099310_B_Mrgprb2
  gRNA
gacuauuacacucacagucu

SEQ ID NO: 99311 - RNA, 20 nt, Artificial Sequence
  MKO10099311_B_Mrgprb3
  gRNA
agaaggcauuccugcauauc

SEQ ID NO: 99312 - RNA, 20 nt, Artificial Sequence
  MKO10099312_B_Mrgprb3
  gRNA
acuaauaaccaccacagcac

SEQ ID NO: 99313 - RNA, 20 nt, Artificial Sequence
  MKO10099313_B_Mrgprb3
  gRNA
ucuucuggauaguugacaaa

SEQ ID NO: 99314 - RNA, 20 nt, Artificial Sequence
  MKO10099314_B_Mrgprb4
  gRNA
cucucuauuguugagccucg

SEQ ID NO: 99315 - RNA, 20 nt, Artificial Sequence
  MKO10099315_B_Mrgprb4
  gRNA
cacucaaguugugcauuccc

SEQ ID NO: 99316 - RNA, 20 nt, Artificial Sequence
  MKO10099316_B_Mrgprb4
  gRNA
agauugugugggggucacac

SEQ ID NO: 99317 - RNA, 20 nt, Artificial Sequence
  MKO10099317_B_Mrgprb5
  gRNA
ugugucuccuauuuaacuga

SEQ ID NO: 99318 - RNA, 20 nt, Artificial Sequence
  MKO10099318_B_Mrgprb5
  gRNA
uugcaaccugugcugccuaa

SEQ ID NO: 99319 - RNA, 20 nt, Artificial Sequence
  MKO10099319_B_Mrgprb5
  gRNA
acugucaucauugccauguu

SEQ ID NO: 99320 - RNA, 20 nt, Artificial Sequence
  MKO10099320_B_Mrgprb8
  gRNA
ucacuacaucgacauucaca

SEQ ID NO: 99321 - RNA, 20 nt, Artificial Sequence
  MKO10099321_B_Mrgprb8
  gRNA
uugcucucaucauaguugua

SEQ ID NO: 99322 - RNA, 20 nt, Artificial Sequence
  MKO10099322_B_Mrgprb8
  gRNA
gagaauucaauuaugccuug

SEQ ID NO: 99323 - RNA, 20 nt, Artificial Sequence
  MKO10099323_B_Mrgprd
  gRNA
ccauccacguguacuaauga

SEQ ID NO: 99324 - RNA, 20 nt, Artificial Sequence
  MKO10099324_B_Mrgprd
  gRNA
gccccggcaccugucaucag

SEQ ID NO: 99325 - RNA, 20 nt, Artificial Sequence
  MKO10099325_B_Mrgprd
  gRNA
aaagcacggagaggcagcgc

SEQ ID NO: 99326 - RNA, 20 nt, Artificial Sequence
  MKO10099326_B_Mrgpre
  gRNA
gagaaucugugugcacgcuc

SEQ ID NO: 99327 - RNA, 20 nt, Artificial Sequence
  MKO10099327_B_Mrgpre
  gRNA
ugcaggcgccgcucagcagc

SEQ ID NO: 99328 - RNA, 20 nt, Artificial Sequence
  MKO10099328_B_Mrgpre
  gRNA
cauugcccagcagcccgccc

SEQ ID NO: 99329 - RNA, 20 nt, Artificial Sequence
  MKO10099329_B_Mrgprf
  gRNA
ucacuccaccaaccagaaca

SEQ ID NO: 99330 - RNA, 20 nt, Artificial Sequence
  MKO10099330_B_Mrgprf
  gRNA
ggaagacagagacgaucgcc

SEQ ID NO: 99331 - RNA, 20 nt, Artificial Sequence
  MKO10099331_B_Mrgprf
  gRNA
cacacagcguucgaugcuaa

SEQ ID NO: 99332 - RNA, 20 nt, Artificial Sequence
  MKO10099332_B_Mrgprg
  gRNA
cuguugccagccaacgccug

SEQ ID NO: 99333 - RNA, 20 nt, Artificial Sequence
  MKO10099333_B_Mrgprg
  gRNA
accccccaaguucugcaagu

SEQ ID NO: 99334 - RNA, 20 nt, Artificial Sequence
  MKO10099334_B_Mrgprg
  gRNA
uuguccucugccucgugauc

SEQ ID NO: 99335 - RNA, 20 nt, Artificial Sequence
  MKO10099335_B_Mrgprh
  gRNA
gcccucucuguucucguguc

SEQ ID NO: 99336 - RNA, 20 nt, Artificial Sequence
  MKO10099336_B_Mrgprh
  gRNA
cccaaaacaccaguccgcug

SEQ ID NO: 99337 - RNA, 20 nt, Artificial Sequence
  MKO10099337_B_Mrgprh
  gRNA
ucuccgugcuuuauccaauc

SEQ ID NO: 99338 - RNA, 20 nt, Artificial Sequence
  MKO10099338_B_Mrgprx1
  gRNA
uccucggauuccgcaugcgc

SEQ ID NO: 99339 - RNA, 20 nt, Artificial Sequence
  MKO10099339_B_Mrgprx1
  gRNA
uguuuccugccaguccaacc

SEQ ID NO: 99340 - RNA, 20 nt, Artificial Sequence
  MKO10099340_B_Mrgprx1
  gRNA
augcucaggccugagauaua

SEQ ID NO: 99341 - RNA, 20 nt, Artificial Sequence
  MKO10099341_B_Mrgprx2
  gRNA
uuaggcaucaucgauuucaa

SEQ ID NO: 99342 - RNA, 20 nt, Artificial Sequence
  MKO10099342_B_Mrgprx2
  gRNA
agaaugcauuccugcgcauc

SEQ ID NO: 99343 - RNA, 20 nt, Artificial Sequence
  MKO10099343_B_Mrgprx2
  gRNA
auuucucaauccacacuaag

SEQ ID NO: 99344 - RNA, 20 nt, Artificial Sequence
  MKO10099344_B_Mri1
  gRNA
cggcggcugccauggcacac

SEQ ID NO: 99345 - RNA, 20 nt, Artificial Sequence
  MKO10099345_B_Mri1
  gRNA
gcugaccguguuguugccaa

SEQ ID NO: 99346 - RNA, 20 nt, Artificial Sequence
  MKO10099346_B_Mri1
  gRNA
accgugguguuuggcgacaa

SEQ ID NO: 99347 - RNA, 20 nt, Artificial Sequence
  MKO10099347_B_Mrm1
  gRNA
caccuccauagccccagcgc

SEQ ID NO: 99348 - RNA, 20 nt, Artificial Sequence
  MKO10099348_B_Mrm1
  gRNA
ugaguccuugaauguaucug

SEQ ID NO: 99349 - RNA, 20 nt, Artificial Sequence
  MKO10099349_B_Mrm1
  gRNA
acccuucuucugacugcaaa

SEQ ID NO: 99350 - RNA, 20 nt, Artificial Sequence
  MKO10099350_B_Mroh1
  gRNA
aucgcuugccaacagccacc

SEQ ID NO: 99351 - RNA, 20 nt, Artificial Sequence
  MKO10099351_B_Mroh1
  gRNA
guaccuugucaugcugccgu

SEQ ID NO: 99352 - RNA, 20 nt, Artificial Sequence
  MKO10099352_B_Mroh1
  gRNA
ggcgagugugugcagcacgg

SEQ ID NO: 99353 - RNA, 20 nt, Artificial Sequence
  MKO10099353_B_Mroh2a
  gRNA
ugugauaucccgcaucugcu

SEQ ID NO: 99354 - RNA, 20 nt, Artificial Sequence
  MKO10099354_B_Mroh2a
  gRNA
ccuggacaugcggaagaccu

SEQ ID NO: 99355 - RNA, 20 nt, Artificial Sequence
  MKO10099355_B_Mroh2a
  gRNA
ccauugccuccaagcagaug

SEQ ID NO: 99356 - RNA, 20 nt, Artificial Sequence
  MKO10099356_B_Mroh2b
  gRNA
ggaauacccaccuauacaga

SEQ ID NO: 99357 - RNA, 20 nt, Artificial Sequence
  MKO10099357_B_Mroh2b
  gRNA
guugauuuauuacacuucua

SEQ ID NO: 99358 - RNA, 20 nt, Artificial Sequence
  MKO10099358_B_Mroh2b
  gRNA
acuuugcacuucauacauca

SEQ ID NO: 99359 - RNA, 20 nt, Artificial Sequence
  MKO10099359_B_Mroh4
  gRNA
gaccuuaucaguagccuucc

SEQ ID NO: 99360 - RNA, 20 nt, Artificial Sequence
  MKO10099360_B_Mroh4
  gRNA
ccccaggaaggcuacugaua

SEQ ID NO: 99361 - RNA, 20 nt, Artificial Sequence
  MKO10099361_B_Mroh4
  gRNA
ccugcucaccagaucgcucc

SEQ ID NO: 99362 - RNA, 20 nt, Artificial Sequence
  MKO10099362_B_Mroh5
  gRNA
ccgcagccuguuguauguga

SEQ ID NO: 99363 - RNA, 20 nt, Artificial Sequence
  MKO10099363_B_Mroh5
  gRNA
acugguugcaguaaaccacu

SEQ ID NO: 99364 - RNA, 20 nt, Artificial Sequence
  MKO10099364_B_Mroh5
  gRNA
ugggcuaucuuagaacaguu

SEQ ID NO: 99365 - RNA, 20 nt, Artificial Sequence
  MKO10099365_B_Mroh6
  gRNA
ccgguccggggguagcgaac

SEQ ID NO: 99366 - RNA, 20 nt, Artificial Sequence
  MKO10099366_B_Mroh6
  gRNA
uauacaacgcaaggucugca

SEQ ID NO: 99367 - RNA, 20 nt, Artificial Sequence
  MKO10099367_B_Mroh6
  gRNA
uguggcggcucccgagucug

SEQ ID NO: 99368 - RNA, 20 nt, Artificial Sequence
  MKO10099368_B_Mroh7
  gRNA
ccccauccagagacagauuc

SEQ ID NO: 99369 - RNA, 20 nt, Artificial Sequence
  MKO10099369_B_Mroh7
  gRNA
ggcaaccgugaagaugauga

SEQ ID NO: 99370 - RNA, 20 nt, Artificial Sequence
  MKO10099370_B_Mroh7
  gRNA
ccaaagcugcuuuguuguca

SEQ ID NO: 99371 - RNA, 20 nt, Artificial Sequence
  MKO10099371_B_Mroh8
  gRNA
cuggaccagucucucaaugc

SEQ ID NO: 99372 - RNA, 20 nt, Artificial Sequence
  MKO10099372_B_Mroh8
  gRNA
gcucaccauguaaaacuucc

SEQ ID NO: 99373 - RNA, 20 nt, Artificial Sequence
  MKO10099373_B_Mroh8
  gRNA
cucgcugcagguguugguac

SEQ ID NO: 99374 - RNA, 20 nt, Artificial Sequence
  MKO10099374_B_Mroh9
  gRNA
cacaugguaccaagucacag

SEQ ID NO: 99375 - RNA, 20 nt, Artificial Sequence
  MKO10099375_B_Mroh9
  gRNA
aauagagcuaucuuucagaa

SEQ ID NO: 99376 - RNA, 20 nt, Artificial Sequence
  MKO10099376_B_Mroh9
  gRNA
cuacaagauacaaaucuuaa

SEQ ID NO: 99377 - RNA, 20 nt, Artificial Sequence
  MKO10099377_B_Mro
  gRNA
aagcgccaucuagcaaugag

SEQ ID NO: 99378 - RNA, 20 nt, Artificial Sequence
  MKO10099378_B_Mro
  gRNA
ggcccgugaagcuccugaca

SEQ ID NO: 99379 - RNA, 20 nt, Artificial Sequence
  MKO10099379_B_Mro
  gRNA
gaaaguuaugcuugaccucc

SEQ ID NO: 99380 - RNA, 20 nt, Artificial Sequence
  MKO10099380_B_Mrp63
  gRNA
agccugggcccgucgcuccg

SEQ ID NO: 99381 - RNA, 20 nt, Artificial Sequence
  MKO10099381_B_Mrp63
  gRNA
gagcaugauccgucgccugg

SEQ ID NO: 99382 - RNA, 20 nt, Artificial Sequence
  MKO10099382_B_Mrp63
  gRNA
ggaucaugcucuccuucgcu

SEQ ID NO: 99383 - RNA, 20 nt, Artificial Sequence
  MKO10099383_B_Mrpl10
  gRNA
ccaaggcugugacccgccac

SEQ ID NO: 99384 - RNA, 20 nt, Artificial Sequence
  MKO10099384_B_Mrpl10
  gRNA
gggaggauguagcuucucau

SEQ ID NO: 99385 - RNA, 20 nt, Artificial Sequence
  MKO10099385_B_Mrpl10
  gRNA
aaacaggccggcuaggcauc

SEQ ID NO: 99386 - RNA, 20 nt, Artificial Sequence
  MKO10099386_B_Mrpl11
  gRNA
cuaguccuuaccuguaugcc

SEQ ID NO: 99387 - RNA, 20 nt, Artificial Sequence
  MKO10099387_B_Mrpl11
  gRNA
cagcugcugggaucgagaag

SEQ ID NO: 99388 - RNA, 20 nt, Artificial Sequence
  MKO10099388_B_Mrpl11
  gRNA
uagccucagugcagaagaac

SEQ ID NO: 99389 - RNA, 20 nt, Artificial Sequence
  MKO10099389_B_Mrpl12
  gRNA
cgacguuggcuuugauuucc

SEQ ID NO: 99390 - RNA, 20 nt, Artificial Sequence
  MKO10099390_B_Mrpl12
  gRNA
agccaacgucgccaaagcug

SEQ ID NO: 99391 - RNA, 20 nt, Artificial Sequence
  MKO10099391_B_Mrpl12
  gRNA
gcugcagcagagacgggacc

SEQ ID NO: 99392 - RNA, 20 nt, Artificial Sequence
  MKO10099392_B_Mrpl13
  gRNA
guucucuuacccaguaugug

SEQ ID NO: 99393 - RNA, 20 nt, Artificial Sequence
  MKO10099393_B_Mrpl13
  gRNA
uaacagcugcgcagcuucac

SEQ ID NO: 99394 - RNA, 20 nt, Artificial Sequence
  MKO10099394_B_Mrpl13
  gRNA
gcaucauuguccuucugugc

SEQ ID NO: 99395 - RNA, 20 nt, Artificial Sequence
  MKO10099395_B_Mrpl14
  gRNA
uuacuuaccugaagcagcgc

SEQ ID NO: 99396 - RNA, 20 nt, Artificial Sequence
  MKO10099396_B_Mrpl14
  gRNA
cucaaugaggaccacguugu

SEQ ID NO: 99397 - RNA, 20 nt, Artificial Sequence
  MKO10099397_B_Mrpl14
  gRNA
ucaucuucuggacggcacug

SEQ ID NO: 99398 - RNA, 20 nt, Artificial Sequence
  MKO10099398_B_Mrpl15
  gRNA
uacauacgaaucccaaaaua

SEQ ID NO: 99399 - RNA, 20 nt, Artificial Sequence
  MKO10099399_B_Mrpl15
  gRNA
gaguuaccucuucaaccagc

SEQ ID NO: 99400 - RNA, 20 nt, Artificial Sequence
  MKO10099400_B_Mrpl15
  gRNA
aauuaauauugaagugcagc

SEQ ID NO: 99401 - RNA, 20 nt, Artificial Sequence
  MKO10099401_B_Mrpl16
  gRNA
gcgcgucaacagccuccaca

SEQ ID NO: 99402 - RNA, 20 nt, Artificial Sequence
  MKO10099402_B_Mrpl16
  gRNA
gagcgucuucagaccagcac

SEQ ID NO: 99403 - RNA, 20 nt, Artificial Sequence
  MKO10099403_B_Mrpl16
  gRNA
agguacucacuuucaaaagu

SEQ ID NO: 99404 - RNA, 20 nt, Artificial Sequence
  MKO10099404_B_Mrpl17
  gRNA
cgaucuugcuccuuccgauu

SEQ ID NO: 99405 - RNA, 20 nt, Artificial Sequence
  MKO10099405_B_Mrpl17
  gRNA
gaaugcuacagaucccgaau

SEQ ID NO: 99406 - RNA, 20 nt, Artificial Sequence
  MKO10099406_B_Mrpl17
  gRNA
uccucacagcucaucgauua

SEQ ID NO: 99407 - RNA, 20 nt, Artificial Sequence
  MKO10099407_B_Mrpl18
  gRNA
ucccgucagccauggcgcuu

SEQ ID NO: 99408 - RNA, 20 nt, Artificial Sequence
  MKO10099408_B_Mrpl18
  gRNA
uuucagcauccacucgagaa

SEQ ID NO: 99409 - RNA, 20 nt, Artificial Sequence
  MKO10099409_B_Mrpl18
  gRNA
uuucauucauagauucuucg

SEQ ID NO: 99410 - RNA, 20 nt, Artificial Sequence
  MKO10099410_B_Mrpl19
  gRNA
aucgcuugaugcaaaucccc

SEQ ID NO: 99411 - RNA, 20 nt, Artificial Sequence
  MKO10099411_B_Mrpl19
  gRNA
acuguauaauccucgaaucc

SEQ ID NO: 99412 - RNA, 20 nt, Artificial Sequence
  MKO10099412_B_Mrpl19
  gRNA
ccgauuccagaguucuaugu

SEQ ID NO: 99413 - RNA, 20 nt, Artificial Sequence
  MKO10099413_B_Mrpl1
  gRNA
accucuacggaggcaccuua

SEQ ID NO: 99414 - RNA, 20 nt, Artificial Sequence
  MKO10099414_B_Mrpl1
  gRNA
agcaaccuuguugacuucug

SEQ ID NO: 99415 - RNA, 20 nt, Artificial Sequence
  MKO10099415_B_Mrpl1
  gRNA
aagucuugauacaucaucaa

SEQ ID NO: 99416 - RNA, 20 nt, Artificial Sequence
  MKO10099416_B_Mrpl20
  gRNA
ucaccgcccugacggccagg

SEQ ID NO: 99417 - RNA, 20 nt, Artificial Sequence
  MKO10099417_B_Mrpl20
  gRNA
gccaaagauuuaaacgucuu

SEQ ID NO: 99418 - RNA, 20 nt, Artificial Sequence
  MKO10099418_B_Mrpl20
  gRNA
accaaagacguuuaaaucuu

SEQ ID NO: 99419 - RNA, 20 nt, Artificial Sequence
  MKO10099419_B_Mrpl21
  gRNA
ucuucucagguccugcuggu

SEQ ID NO: 99420 - RNA, 20 nt, Artificial Sequence
  MKO10099420_B_Mrpl21
  gRNA
ccucccugagcucaccaccc

SEQ ID NO: 99421 - RNA, 20 nt, Artificial Sequence
  MKO10099421_B_Mrpl21
  gRNA
uggugucucgucucuucaac

SEQ ID NO: 99422 - RNA, 20 nt, Artificial Sequence
  MKO10099422_B_Mrpl22
  gRNA
ugucaagagaagcacucgug

SEQ ID NO: 99423 - RNA, 20 nt, Artificial Sequence
  MKO10099423_B_Mrpl22
  gRNA
acaaggaaauuuaccauugu

SEQ ID NO: 99424 - RNA, 20 nt, Artificial Sequence
  MKO10099424_B_Mrpl22
  gRNA
cugcgccaaagccugaucaa

SEQ ID NO: 99425 - RNA, 20 nt, Artificial Sequence
  MKO10099425_B_Mrpl23
  gRNA
cucauccaggaugaccaggg

SEQ ID NO: 99426 - RNA, 20 nt, Artificial Sequence
  MKO10099426_B_Mrpl23
  gRNA
cccucacaggcuccaacagg

SEQ ID NO: 99427 - RNA, 20 nt, Artificial Sequence
  MKO10099427_B_Mrpl23
  gRNA
augcugcacccgugugcgca

SEQ ID NO: 99428 - RNA, 20 nt, Artificial Sequence
  MKO10099428_B_Mrpl24
  gRNA
gcaaaguaguccaagucguu

SEQ ID NO: 99429 - RNA, 20 nt, Artificial Sequence
  MKO10099429_B_Mrpl24
  gRNA
aacuuaccaguccauguuuc

SEQ ID NO: 99430 - RNA, 20 nt, Artificial Sequence
  MKO10099430_B_Mrpl24
  gRNA
ucuugaaucuucgagucucc

SEQ ID NO: 99431 - RNA, 20 nt, Artificial Sequence
  MKO10099431_B_Mrpl27
  gRNA
cguagacaucuuucguguag

SEQ ID NO: 99432 - RNA, 20 nt, Artificial Sequence
  MKO10099432_B_Mrpl27
  gRNA
guguguugcagguggggcuu

SEQ ID NO: 99433 - RNA, 20 nt, Artificial Sequence
  MKO10099433_B_Mrpl27
  gRNA
ugaagcaaauauggcggcgg

SEQ ID NO: 99434 - RNA, 20 nt, Artificial Sequence
  MKO10099434_B_Mrpl28
  gRNA
cgaguggguuggccugacgc

SEQ ID NO: 99435 - RNA, 20 nt, Artificial Sequence
  MKO10099435_B_Mrpl28
  gRNA
cacccuguacuugucauaga

SEQ ID NO: 99436 - RNA, 20 nt, Artificial Sequence
  MKO10099436_B_Mrpl28
  gRNA
ccugggcuccaaguuuggca

SEQ ID NO: 99437 - RNA, 20 nt, Artificial Sequence
  MKO10099437_B_Mrpl2
  gRNA
aacaacguagagagcgagcc

SEQ ID NO: 99438 - RNA, 20 nt, Artificial Sequence
  MKO10099438_B_Mrpl2
  gRNA
ucaugcgauaauucuguuug

SEQ ID NO: 99439 - RNA, 20 nt, Artificial Sequence
  MKO10099439_B_Mrpl2
  gRNA
cuaggccgcauccgagugca

SEQ ID NO: 99440 - RNA, 20 nt, Artificial Sequence
  MKO10099440_B_Mrpl30
  gRNA
gugacaaugugcaguuugug

SEQ ID NO: 99441 - RNA, 20 nt, Artificial Sequence
  MKO10099441_B_Mrpl30
  gRNA
cuguaguccaagcaucuuga

SEQ ID NO: 99442 - RNA, 20 nt, Artificial Sequence
  MKO10099442_B_Mrpl30
  gRNA
agcacaugccucaagagcac

SEQ ID NO: 99443 - RNA, 20 nt, Artificial Sequence
  MKO10099443_B_Mrpl32
  gRNA
gucgcuuugucaguccuccg

SEQ ID NO: 99444 - RNA, 20 nt, Artificial Sequence
  MKO10099444_B_Mrpl32
  gRNA
ucucauagcaauauccacaa

SEQ ID NO: 99445 - RNA, 20 nt, Artificial Sequence
  MKO10099445_B_Mrpl32
  gRNA
guacagcaccauagucucaa

SEQ ID NO: 99446 - RNA, 20 nt, Artificial Sequence
  MKO10099446_B_Mrpl33
  gRNA
uacuuacuuugacuugcucu

SEQ ID NO: 99447 - RNA, 20 nt, Artificial Sequence
  MKO10099447_B_Mrpl33
  gRNA
aauccacuacucagagggaa

SEQ ID NO: 99448 - RNA, 20 nt, Artificial Sequence
  MKO10099448_B_Mrpl33
  gRNA
gaacaaaaaaguucucuuug

SEQ ID NO: 99449 - RNA, 20 nt, Artificial Sequence
  MKO10099449_B_Mrpl34
  gRNA
uggauauggcuuuccuagcc

SEQ ID NO: 99450 - RNA, 20 nt, Artificial Sequence
  MKO10099450_B_Mrpl34
  gRNA
cauccuccgucgcaugcuga

SEQ ID NO: 99451 - RNA, 20 nt, Artificial Sequence
  MKO10099451_B_Mrpl34
  gRNA
ugcuugcgcuugauguugcu

SEQ ID NO: 99452 - RNA, 20 nt, Artificial Sequence
  MKO10099452_B_Mrpl35
  gRNA
cgcuuccuccgacuucauuc

SEQ ID NO: 99453 - RNA, 20 nt, Artificial Sequence
  MKO10099453_B_Mrpl35
  gRNA
uagcucugaacuauacucgu

SEQ ID NO: 99454 - RNA, 20 nt, Artificial Sequence
  MKO10099454_B_Mrpl35
  gRNA
caagagaaagacgguaaagu

SEQ ID NO: 99455 - RNA, 20 nt, Artificial Sequence
  MKO10099455_B_Mrpl36
  gRNA
cacgcuccguacaagcagug

SEQ ID NO: 99456 - RNA, 20 nt, Artificial Sequence
  MKO10099456_B_Mrpl36
  gRNA
aacugagcgcaccucugcgc

SEQ ID NO: 99457 - RNA, 20 nt, Artificial Sequence
  MKO10099457_B_Mrpl36
  gRNA
gcauggccgcacugcuugua

SEQ ID NO: 99458 - RNA, 20 nt, Artificial Sequence
  MKO10099458_B_Mrpl37
  gRNA
guuugcuuucgcaaaugccc

SEQ ID NO: 99459 - RNA, 20 nt, Artificial Sequence
  MKO10099459_B_Mrpl37
  gRNA
cauucuugaagaucgauggu

SEQ ID NO: 99460 - RNA, 20 nt, Artificial Sequence
  MKO10099460_B_Mrpl37
  gRNA
ucaucucccaugcccggcuu

SEQ ID NO: 99461 - RNA, 20 nt, Artificial Sequence
  MKO10099461_B_Mrpl38
  gRNA
gaggcucacccgugcggagg

SEQ ID NO: 99462 - RNA, 20 nt, Artificial Sequence
  MKO10099462_B_Mrpl38
  gRNA
caaaaguggcaccguggaac

SEQ ID NO: 99463 - RNA, 20 nt, Artificial Sequence
  MKO10099463_B_Mrpl38
  gRNA
ugcccguucuucuuccacau

SEQ ID NO: 99464 - RNA, 20 nt, Artificial Sequence
  MKO10099464_B_Mrpl39
  gRNA
agaggcuuauacauguccca

SEQ ID NO: 99465 - RNA, 20 nt, Artificial Sequence
  MKO10099465_B_Mrpl39
  gRNA
gucagagcaccggaaguucc

SEQ ID NO: 99466 - RNA, 20 nt, Artificial Sequence
  MKO10099466_B_Mrpl39
  gRNA
ugacccaaaagaagugaaua

SEQ ID NO: 99467 - RNA, 20 nt, Artificial Sequence
  MKO10099467_B_Mrpl3
  gRNA
aucccuugaaagaugagccg

SEQ ID NO: 99468 - RNA, 20 nt, Artificial Sequence
  MKO10099468_B_Mrpl3
  gRNA
ggagaccaguugcuuaacaa

SEQ ID NO: 99469 - RNA, 20 nt, Artificial Sequence
  MKO10099469_B_Mrpl3
  gRNA
aaaaaucgcagcccugacag

SEQ ID NO: 99470 - RNA, 20 nt, Artificial Sequence
  MKO10099470_B_Mrpl40
  gRNA
cauggggaugagaucccaga

SEQ ID NO: 99471 - RNA, 20 nt, Artificial Sequence
  MKO10099471_B_Mrpl40
  gRNA
ugugugcugcgcgggcucug

SEQ ID NO: 99472 - RNA, 20 nt, Artificial Sequence
  MKO10099472_B_Mrpl40
  gRNA
caaaggaucgcuugaaaaag

SEQ ID NO: 99473 - RNA, 20 nt, Artificial Sequence
  MKO10099473_B_Mrpl41
  gRNA
uguuuccuggaagagcgcuu

SEQ ID NO: 99474 - RNA, 20 nt, Artificial Sequence
  MKO10099474_B_Mrpl41
  gRNA
gaccgccaaagcgcucuucc

SEQ ID NO: 99475 - RNA, 20 nt, Artificial Sequence
  MKO10099475_B_Mrpl41
  gRNA
cacgcaccuucacuaagagu

SEQ ID NO: 99476 - RNA, 20 nt, Artificial Sequence
  MKO10099476_B_Mrpl42
  gRNA
caugagucgucaucugucuc

SEQ ID NO: 99477 - RNA, 20 nt, Artificial Sequence
  MKO10099477_B_Mrpl42
  gRNA
cuugcucaguuguucuauca

SEQ ID NO: 99478 - RNA, 20 nt, Artificial Sequence
  MKO10099478_B_Mrpl42
  gRNA
auccacauacucuucucuuc

SEQ ID NO: 99479 - RNA, 20 nt, Artificial Sequence
  MKO10099479_B_Mrpl43
  gRNA
acgagggcgcaucccggcug

SEQ ID NO: 99480 - RNA, 20 nt, Artificial Sequence
  MKO10099480_B_Mrpl43
  gRNA
gugcgccaugccacgaauag

SEQ ID NO: 99481 - RNA, 20 nt, Artificial Sequence
  MKO10099481_B_Mrpl43
  gRNA
aaacgucaacagcaagucgg

SEQ ID NO: 99482 - RNA, 20 nt, Artificial Sequence
  MKO10099482_B_Mrpl44
  gRNA
gacgccuaccgucgcacugg

SEQ ID NO: 99483 - RNA, 20 nt, Artificial Sequence
  MKO10099483_B_Mrpl44
  gRNA
cgucuucgagaaacugugug

SEQ ID NO: 99484 - RNA, 20 nt, Artificial Sequence
  MKO10099484_B_Mrpl44
  gRNA
ucccaugggacuacucguag

SEQ ID NO: 99485 - RNA, 20 nt, Artificial Sequence
  MKO10099485_B_Mrpl45
  gRNA
ccacuuacuuguuuagacaa

SEQ ID NO: 99486 - RNA, 20 nt, Artificial Sequence
  MKO10099486_B_Mrpl45
  gRNA
uuucuagcucagaccaugac

SEQ ID NO: 99487 - RNA, 20 nt, Artificial Sequence
  MKO10099487_B_Mrpl45
  gRNA
ugagcgauugagaaagaaug

SEQ ID NO: 99488 - RNA, 20 nt, Artificial Sequence
  MKO10099488_B_Mrpl46
  gRNA
aaggcgcccgacaagcgcca

SEQ ID NO: 99489 - RNA, 20 nt, Artificial Sequence
  MKO10099489_B_Mrpl46
  gRNA
cuugaacuuguaguggccac

SEQ ID NO: 99490 - RNA, 20 nt, Artificial Sequence
  MKO10099490_B_Mrpl46
  gRNA
agaccaugagcuccgugcuc

SEQ ID NO: 99491 - RNA, 20 nt, Artificial Sequence
  MKO10099491_B_Mrpl47
  gRNA
uacuucauaccacguuguca

SEQ ID NO: 99492 - RNA, 20 nt, Artificial Sequence
  MKO10099492_B_Mrpl47
  gRNA
guacagguauguccuucuga

SEQ ID NO: 99493 - RNA, 20 nt, Artificial Sequence
  MKO10099493_B_Mrpl47
  gRNA
caguccuuuccuugacaacg

SEQ ID NO: 99494 - RNA, 20 nt, Artificial Sequence
  MKO10099494_B_Mrpl48
  gRNA
uucucuuaggugguauucug

SEQ ID NO: 99495 - RNA, 20 nt, Artificial Sequence
  MKO10099495_B_Mrpl48
  gRNA
cuacuuaccugcagaaaaaa

SEQ ID NO: 99496 - RNA, 20 nt, Artificial Sequence
  MKO10099496_B_Mrpl48
  gRNA
ucuugcaggugcugggugug

SEQ ID NO: 99497 - RNA, 20 nt, Artificial Sequence
  MKO10099497_B_Mrpl49
  gRNA
ggagcaggcgcuccacaaau

SEQ ID NO: 99498 - RNA, 20 nt, Artificial Sequence
  MKO10099498_B_Mrpl49
  gRNA
agcugccucggucggagcua

SEQ ID NO: 99499 - RNA, 20 nt, Artificial Sequence
  MKO10099499_B_Mrpl49
  gRNA
uccugauaaccccggcuuug

SEQ ID NO: 99500 - RNA, 20 nt, Artificial Sequence
  MKO10099500_B_Mrpl4
  gRNA
ccgcgccuuccgcuagagag

SEQ ID NO: 99501 - RNA, 20 nt, Artificial Sequence
  MKO10099501_B_Mrpl4
  gRNA
accggcguccggugcaagcc

SEQ ID NO: 99502 - RNA, 20 nt, Artificial Sequence
  MKO10099502_B_Mrpl4
  gRNA
ggaugcugccaugccgagca

SEQ ID NO: 99503 - RNA, 20 nt, Artificial Sequence
  MKO10099503_B_Mrpl50
  gRNA
aaauucucuacguguugcca

SEQ ID NO: 99504 - RNA, 20 nt, Artificial Sequence
  MKO10099504_B_Mrpl50
  gRNA
ccaggcuucaccaaaugugc

SEQ ID NO: 99505 - RNA, 20 nt, Artificial Sequence
  MKO10099505_B_Mrpl50
  gRNA
uggcaacacguagagaauuu

SEQ ID NO: 99506 - RNA, 20 nt, Artificial Sequence
  MKO10099506_B_Mrpl51
  gRNA
uaauggcagggagugucccu

SEQ ID NO: 99507 - RNA, 20 nt, Artificial Sequence
  MKO10099507_B_Mrpl51
  gRNA
ccuaucuguacuucccaugu

SEQ ID NO: 99508 - RNA, 20 nt, Artificial Sequence
  MKO10099508_B_Mrpl51
  gRNA
gcacccaaaagaacugauca

SEQ ID NO: 99509 - RNA, 20 nt, Artificial Sequence
  MKO10099509_B_Mrpl52
  gRNA
cuccgugaggggcccauagc

SEQ ID NO: 99510 - RNA, 20 nt, Artificial Sequence
  MKO10099510_B_Mrpl52
  gRNA
cgcccugcacccccaaugaa

SEQ ID NO: 99511 - RNA, 20 nt, Artificial Sequence
  MKO10099511_B_Mrpl52
  gRNA
acgaguuguacugcugacac

SEQ ID NO: 99512 - RNA, 20 nt, Artificial Sequence
  MKO10099512_B_Mrpl53
  gRNA
cagcggcggguacucguacc

SEQ ID NO: 99513 - RNA, 20 nt, Artificial Sequence
  MKO10099513_B_Mrpl53
  gRNA
agagccgucgugccucacgu

SEQ ID NO: 99514 - RNA, 20 nt, Artificial Sequence
  MKO10099514_B_Mrpl53
  gRNA
cgccgcggcagcaucugcac

SEQ ID NO: 99515 - RNA, 20 nt, Artificial Sequence
  MKO10099515_B_Mrpl54
  gRNA
caagggcggcguggccgcug

SEQ ID NO: 99516 - RNA, 20 nt, Artificial Sequence
  MKO10099516_B_Mrpl54
  gRNA
ugcacaccucgggguccuuc

SEQ ID NO: 99517 - RNA, 20 nt, Artificial Sequence
  MKO10099517_B_Mrpl54
  gRNA
aaccagagucccgagaguac

SEQ ID NO: 99518 - RNA, 20 nt, Artificial Sequence
  MKO10099518_B_Mrpl55
  gRNA
ucaaaacuguccacuaccuc

SEQ ID NO: 99519 - RNA, 20 nt, Artificial Sequence
  MKO10099519_B_Mrpl55
  gRNA
uuaugcuuaccuaagcagaa

SEQ ID NO: 99520 - RNA, 20 nt, Artificial Sequence
  MKO10099520_B_Mrpl55
  gRNA
ugccuuuggccauucugcuu

SEQ ID NO: 99521 - RNA, 20 nt, Artificial Sequence
  MKO10099521_B_Mrpl9
  gRNA
cauugacagaaauuggaguc

SEQ ID NO: 99522 - RNA, 20 nt, Artificial Sequence
  MKO10099522_B_Mrpl9
  gRNA
ucguaacaagcuccuuucuc

SEQ ID NO: 99523 - RNA, 20 nt, Artificial Sequence
  MKO10099523_B_Mrpl9
  gRNA
ccgccucuccugccuuuguc

SEQ ID NO: 99524 - RNA, 20 nt, Artificial Sequence
  MKO10099524_B_Mrps10
  gRNA
gguggccauggaagugacaa

SEQ ID NO: 99525 - RNA, 20 nt, Artificial Sequence
  MKO10099525_B_Mrps10
  gRNA
guaggucuggucacauccuu

SEQ ID NO: 99526 - RNA, 20 nt, Artificial Sequence
  MKO10099526_B_Mrps10
  gRNA
ugucuaacacagcccuguca

SEQ ID NO: 99527 - RNA, 20 nt, Artificial Sequence
  MKO10099527_B_Mrps11
  gRNA
uaguaacuuacccagcgucc

SEQ ID NO: 99528 - RNA, 20 nt, Artificial Sequence
  MKO10099528_B_Mrps11
  gRNA
cucugccaccaaugcguccc

SEQ ID NO: 99529 - RNA, 20 nt, Artificial Sequence
  MKO10099529_B_Mrps11
  gRNA
guugcuuuaaugugugcaau

SEQ ID NO: 99530 - RNA, 20 nt, Artificial Sequence
  MKO10099530_B_Mrps12
  gRNA
ggcggcgagauguccuggcc

SEQ ID NO: 99531 - RNA, 20 nt, Artificial Sequence
  MKO10099531_B_Mrps12
  gRNA
cugaaccagaugcaccgcuu

SEQ ID NO: 99532 - RNA, 20 nt, Artificial Sequence
  MKO10099532_B_Mrps12
  gRNA
guuccuuccgggggccuaag

SEQ ID NO: 99533 - RNA, 20 nt, Artificial Sequence
  MKO10099533_B_Mrps14
  gRNA
cgaacuugaccugacgcuga

SEQ ID NO: 99534 - RNA, 20 nt, Artificial Sequence
  MKO10099534_B_Mrps14
  gRNA
uggcuaaccugaagguccuu

SEQ ID NO: 99535 - RNA, 20 nt, Artificial Sequence
  MKO10099535_B_Mrps14
  gRNA
gcugcugcggaccuuccggc

SEQ ID NO: 99536 - RNA, 20 nt, Artificial Sequence
  MKO10099536_B_Mrps15
  gRNA
ccucguaccugguuucugga

SEQ ID NO: 99537 - RNA, 20 nt, Artificial Sequence
  MKO10099537_B_Mrps15
  gRNA
ggaccaacuuugagcuucca

SEQ ID NO: 99538 - RNA, 20 nt, Artificial Sequence
  MKO10099538_B_Mrps15
  gRNA
acaauugaugaacaagauug

SEQ ID NO: 99539 - RNA, 20 nt, Artificial Sequence
  MKO10099539_B_Mrps16
  gRNA
ccuccguagucucucagcau

SEQ ID NO: 99540 - RNA, 20 nt, Artificial Sequence
  MKO10099540_B_Mrps16
  gRNA
ugaucaucauuggaugaagg

SEQ ID NO: 99541 - RNA, 20 nt, Artificial Sequence
  MKO10099541_B_Mrps16
  gRNA
agcccaacugcuccacaaau

SEQ ID NO: 99542 - RNA, 20 nt, Artificial Sequence
  MKO10099542_B_Mrps17
  gRNA
aagagcgaccagacuuguuu

SEQ ID NO: 99543 - RNA, 20 nt, Artificial Sequence
  MKO10099543_B_Mrps17
  gRNA
agagcccccucagcgaaccu

SEQ ID NO: 99544 - RNA, 20 nt, Artificial Sequence
  MKO10099544_B_Mrps17
  gRNA
gcccuucagcagugcagcgu

SEQ ID NO: 99545 - RNA, 20 nt, Artificial Sequence
  MKO10099545_B_Mrps18a
  gRNA
gaagcacaaauauaccuaug

SEQ ID NO: 99546 - RNA, 20 nt, Artificial Sequence
  MKO10099546_B_Mrps18a
  gRNA
uccagcggcagauggggcac

SEQ ID NO: 99547 - RNA, 20 nt, Artificial Sequence
  MKO10099547_B_Mrps18a
  gRNA
uccuuugguaagcauccuuc

SEQ ID NO: 99548 - RNA, 20 nt, Artificial Sequence
  MKO10099548_B_Mrps18b
  gRNA
gaauccuugcccaaucugcc

SEQ ID NO: 99549 - RNA, 20 nt, Artificial Sequence
  MKO10099549_B_Mrps18b
  gRNA
uuccaaggcucgcucucaua

SEQ ID NO: 99550 - RNA, 20 nt, Artificial Sequence
  MKO10099550_B_Mrps18b
  gRNA
gccaagcuaaccuguguaug

SEQ ID NO: 99551 - RNA, 20 nt, Artificial Sequence
  MKO10099551_B_Mrps18c
  gRNA
auuuauggaaggcacauaac

SEQ ID NO: 99552 - RNA, 20 nt, Artificial Sequence
  MKO10099552_B_Mrps18c
  gRNA
gugccuuccauaaaugcauc

SEQ ID NO: 99553 - RNA, 20 nt, Artificial Sequence
  MKO10099553_B_Mrps18c
  gRNA
ucucuuuaguuucugugauu

SEQ ID NO: 99554 - RNA, 20 nt, Artificial Sequence
  MKO10099554_B_Mrps21
  gRNA
aacaucugaaguucauugcc

SEQ ID NO: 99555 - RNA, 20 nt, Artificial Sequence
  MKO10099555_B_Mrps21
  gRNA
uuuauacagaauccucacca

SEQ ID NO: 99556 - RNA, 20 nt, Artificial Sequence
  MKO10099556_B_Mrps21
  gRNA
gaugguucaggaggggaacg

SEQ ID NO: 99557 - RNA, 20 nt, Artificial Sequence
  MKO10099557_B_Mrps22
  gRNA
ugccugugucauuaacuuau

SEQ ID NO: 99558 - RNA, 20 nt, Artificial Sequence
  MKO10099558_B_Mrps22
  gRNA
aggauccucaccaagauuac

SEQ ID NO: 99559 - RNA, 20 nt, Artificial Sequence
  MKO10099559_B_Mrps22
  gRNA
acucaccuugauauacucag

SEQ ID NO: 99560 - RNA, 20 nt, Artificial Sequence
  MKO10099560_B_Mrps23
  gRNA
ucaccugcccccgcugcgcc

SEQ ID NO: 99561 - RNA, 20 nt, Artificial Sequence
  MKO10099561_B_Mrps23
  gRNA
gccucaggaagacgaugacc

SEQ ID NO: 99562 - RNA, 20 nt, Artificial Sequence
  MKO10099562_B_Mrps23
  gRNA
aggaaauucuuugcaaccua

SEQ ID NO: 99563 - RNA, 20 nt, Artificial Sequence
  MKO10099563_B_Mrps24
  gRNA
ugcgccuccucguagcucac

SEQ ID NO: 99564 - RNA, 20 nt, Artificial Sequence
  MKO10099564_B_Mrps24
  gRNA
caagauggcgugguccgcgu

SEQ ID NO: 99565 - RNA, 20 nt, Artificial Sequence
  MKO10099565_B_Mrps24
  gRNA
guuugcagguggagucgcac

SEQ ID NO: 99566 - RNA, 20 nt, Artificial Sequence
  MKO10099566_B_Mrps25
  gRNA
ucuucgucuccacgucuacc

SEQ ID NO: 99567 - RNA, 20 nt, Artificial Sequence
  MKO10099567_B_Mrps25
  gRNA
uuccgggggccaaaguugcc

SEQ ID NO: 99568 - RNA, 20 nt, Artificial Sequence
  MKO10099568_B_Mrps25
  gRNA
acucaccuagauagaaccgc

SEQ ID NO: 99569 - RNA, 20 nt, Artificial Sequence
  MKO10099569_B_Mrps26
  gRNA
ggcacggauagaagaagcgu

SEQ ID NO: 99570 - RNA, 20 nt, Artificial Sequence
  MKO10099570_B_Mrps26
  gRNA
ccccaggcuagaguucacgu

SEQ ID NO: 99571 - RNA, 20 nt, Artificial Sequence
  MKO10099571_B_Mrps26
  gRNA
acggcccaguuguaacucuu

SEQ ID NO: 99572 - RNA, 20 nt, Artificial Sequence
  MKO10099572_B_Mrps27
  gRNA
agcugaucuugcauccuuaa

SEQ ID NO: 99573 - RNA, 20 nt, Artificial Sequence
  MKO10099573_B_Mrps27
  gRNA
gacacugucuaauccagcug

SEQ ID NO: 99574 - RNA, 20 nt, Artificial Sequence
  MKO10099574_B_Mrps27
  gRNA
uucauacgcuuuguccauua

SEQ ID NO: 99575 - RNA, 20 nt, Artificial Sequence
  MKO10099575_B_Mrps28
  gRNA
agagaucguccuccacgaua

SEQ ID NO: 99576 - RNA, 20 nt, Artificial Sequence
  MKO10099576_B_Mrps28
  gRNA
agcgcaguccauuacuugcu

SEQ ID NO: 99577 - RNA, 20 nt, Artificial Sequence
  MKO10099577_B_Mrps28
  gRNA
caggguccggcugcgucucc

SEQ ID NO: 99578 - RNA, 20 nt, Artificial Sequence
  MKO10099578_B_Mrps2
  gRNA
agauacgccauuacagcauu

SEQ ID NO: 99579 - RNA, 20 nt, Artificial Sequence
  MKO10099579_B_Mrps2
  gRNA
gaucuuuaccgucgccaucc

SEQ ID NO: 99580 - RNA, 20 nt, Artificial Sequence
  MKO10099580_B_Mrps2
  gRNA
cacggccggagcgggcgcca

SEQ ID NO: 99581 - RNA, 20 nt, Artificial Sequence
  MKO10099581_B_Mrps30
  gRNA
cugcuaccaguuaaauacuu

SEQ ID NO: 99582 - RNA, 20 nt, Artificial Sequence
  MKO10099582_B_Mrps30
  gRNA
ggugaagaacgcauuccugc

SEQ ID NO: 99583 - RNA, 20 nt, Artificial Sequence
  MKO10099583_B_Mrps30
  gRNA
ggagcacaagcuauguacca

SEQ ID NO: 99584 - RNA, 20 nt, Artificial Sequence
  MKO10099584_B_Mrps31
  gRNA
gugaaaacaccaaagccacg

SEQ ID NO: 99585 - RNA, 20 nt, Artificial Sequence
  MKO10099585_B_Mrps31
  gRNA
uguccuuaauaauguccagc

SEQ ID NO: 99586 - RNA, 20 nt, Artificial Sequence
  MKO10099586_B_Mrps31
  gRNA
ugucuucgucaaacugaauc

SEQ ID NO: 99587 - RNA, 20 nt, Artificial Sequence
  MKO10099587_B_Mrps33
  gRNA
cgcagugcauacuccgaaag

SEQ ID NO: 99588 - RNA, 20 nt, Artificial Sequence
  MKO10099588_B_Mrps33
  gRNA
ugacucaaaguccaugaaag

SEQ ID NO: 99589 - RNA, 20 nt, Artificial Sequence
  MKO10099589_B_Mrps34
  gRNA
uuucgcagugaacgcaguga

SEQ ID NO: 99590 - RNA, 20 nt, Artificial Sequence
  MKO10099590_B_Mrps34
  gRNA
uggggcauccugacuuucaa

SEQ ID NO: 99591 - RNA, 20 nt, Artificial Sequence
  MKO10099591_B_Mrps34
  gRNA
guucugcagaacuuggacca

SEQ ID NO: 99592 - RNA, 20 nt, Artificial Sequence
  MKO10099592_B_Mrps35
  gRNA
acuggguaucccauucgaac

SEQ ID NO: 99593 - RNA, 20 nt, Artificial Sequence
  MKO10099593_B_Mrps35
  gRNA
acguguaccuuucuccucau

SEQ ID NO: 99594 - RNA, 20 nt, Artificial Sequence
  MKO10099594_B_Mrps35
  gRNA
aggcacugugcagcauugaa

SEQ ID NO: 99595 - RNA, 20 nt, Artificial Sequence
  MKO10099595_B_Mrps36
  gRNA
uuccgccaccagggucgugc

SEQ ID NO: 99596 - RNA, 20 nt, Artificial Sequence
  MKO10099596_B_Mrps36
  gRNA
gcaauuucacagcauucuaa

SEQ ID NO: 99597 - RNA, 20 nt, Artificial Sequence
  MKO10099597_B_Mrps36
  gRNA
uccauuuccucuugagacau

SEQ ID NO: 99598 - RNA, 20 nt, Artificial Sequence
  MKO10099598_B_Mrps5
  gRNA
cggcuaccuccauugggucc

SEQ ID NO: 99599 - RNA, 20 nt, Artificial Sequence
  MKO10099599_B_Mrps5
  gRNA
gcucaccuucaccaaugauc

SEQ ID NO: 99600 - RNA, 20 nt, Artificial Sequence
  MKO10099600_B_Mrps5
  gRNA
gugaagacagcucuuagcca

SEQ ID NO: 99601 - RNA, 20 nt, Artificial Sequence
  MKO10099601_B_Mrps6
  gRNA
uuaugcuccgacaagugcug

SEQ ID NO: 99602 - RNA, 20 nt, Artificial Sequence
  MKO10099602_B_Mrps6
  gRNA
acguacaauagaaucccuga

SEQ ID NO: 99603 - RNA, 20 nt, Artificial Sequence
  MKO10099603_B_Mrps6
  gRNA
gaaucaaagccaacucguag

SEQ ID NO: 99604 - RNA, 20 nt, Artificial Sequence
  MKO10099604_B_Mrps7
  gRNA
ccuguagggguuccguucaa

SEQ ID NO: 99605 - RNA, 20 nt, Artificial Sequence
  MKO10099605_B_Mrps7
  gRNA
gccgcuaugcccccgaauuc

SEQ ID NO: 99606 - RNA, 20 nt, Artificial Sequence
  MKO10099606_B_Mrps7
  gRNA
gaggcaacaaaguucuggcc

SEQ ID NO: 99607 - RNA, 20 nt, Artificial Sequence
  MKO10099607_B_Mrps9
  gRNA
cagauugaagaauucaauau

SEQ ID NO: 99608 - RNA, 20 nt, Artificial Sequence
  MKO10099608_B_Mrps9
  gRNA
gaggcacuuagccaacauga

SEQ ID NO: 99609 - RNA, 20 nt, Artificial Sequence
  MKO10099609_B_Mrps9
  gRNA
gcaaacuuaccucuuuguuu

SEQ ID NO: 99610 - RNA, 20 nt, Artificial Sequence
  MKO10099610_B_Mrrf
  gRNA
aagguugcucuaaaucagau

SEQ ID NO: 99611 - RNA, 20 nt, Artificial Sequence
  MKO10099611_B_Mrrf
  gRNA
gcaccuuaccucugggaagc

SEQ ID NO: 99612 - RNA, 20 nt, Artificial Sequence
  MKO10099612_B_Mrrf
  gRNA
cugcuucucgaugagucuaa

SEQ ID NO: 99613 - RNA, 20 nt, Artificial Sequence
  MKO10099613_B_Mrs2
  gRNA
auaccaugaguuagcacucc

SEQ ID NO: 99614 - RNA, 20 nt, Artificial Sequence
  MKO10099614_B_Mrs2
  gRNA
gcuggcuaaaguggcuugag

SEQ ID NO: 99615 - RNA, 20 nt, Artificial Sequence
  MKO10099615_B_Mrs2
  gRNA
gucuucugauacuagauuau

SEQ ID NO: 99616 - RNA, 20 nt, Artificial Sequence
  MKO10099616_B_Mrto4
  gRNA
gaagcagaaccugauagaag

SEQ ID NO: 99617 - RNA, 20 nt, Artificial Sequence
  MKO10099617_B_Mrto4
  gRNA
cuuugugguaggauguucuu

SEQ ID NO: 99618 - RNA, 20 nt, Artificial Sequence
  MKO10099618_B_Mrto4
  gRNA
uugucuuuguauucaucaga

SEQ ID NO: 99619 - RNA, 20 nt, Artificial Sequence
  MKO10099619_B_Mrvi1
  gRNA
cccucccacaaucguccuga

SEQ ID NO: 99620 - RNA, 20 nt, Artificial Sequence
  MKO10099620_B_Mrvi1
  gRNA
ccggggggcuccucauccuc

SEQ ID NO: 99621 - RNA, 20 nt, Artificial Sequence
  MKO10099621_B_Mrvi1
  gRNA
caggucaaugacaugccccg

SEQ ID NO: 99622 - RNA, 20 nt, Artificial Sequence
  MKO10099622_B_Ms4a10
  gRNA
accccgacaggaagaucucc

SEQ ID NO: 99623 - RNA, 20 nt, Artificial Sequence
  MKO10099623_B_Ms4a10
  gRNA
ugaagugcugguauccacuc

SEQ ID NO: 99624 - RNA, 20 nt, Artificial Sequence
  MKO10099624_B_Ms4a10
  gRNA
accagcacuucaacaccacc

SEQ ID NO: 99625 - RNA, 20 nt, Artificial Sequence
  MKO10099625_B_Ms4a13
  gRNA
uuuguugugcuccuaccccc

SEQ ID NO: 99626 - RNA, 20 nt, Artificial Sequence
  MKO10099626_B_Ms4a13
  gRNA
ugcagccagccuaacaauag

SEQ ID NO: 99627 - RNA, 20 nt, Artificial Sequence
  MKO10099627_B_Ms4a13
  gRNA
aauggcgaauuccagggggu

SEQ ID NO: 99628 - RNA, 20 nt, Artificial Sequence
  MKO10099628_B_Ms4a15
  gRNA
ggccucgccgaaccauaagc

SEQ ID NO: 99629 - RNA, 20 nt, Artificial Sequence
  MKO10099629_B_Ms4a15
  gRNA
gacuuaccaggcaacuggug

SEQ ID NO: 99630 - RNA, 20 nt, Artificial Sequence
  MKO10099630_B_Ms4a15
  gRNA
uguccccgcgaaggcugcca

SEQ ID NO: 99631 - RNA, 20 nt, Artificial Sequence
  MKO10099631_B_Ms4a18
  gRNA
aauugaguguuguagaguug

SEQ ID NO: 99632 - RNA, 20 nt, Artificial Sequence
  MKO10099632_B_Ms4a18
  gRNA
cagugagauuaguccucuga

SEQ ID NO: 99633 - RNA, 20 nt, Artificial Sequence
  MKO10099633_B_Ms4a18
  gRNA
aaagaauuccaacaguugug

SEQ ID NO: 99634 - RNA, 20 nt, Artificial Sequence
  MKO10099634_B_Ms4a1
  gRNA
cugcagcagaaaaaaccucc

SEQ ID NO: 99635 - RNA, 20 nt, Artificial Sequence
  MKO10099635_B_Ms4a1
  gRNA
cuguuacaguacuguguaga

SEQ ID NO: 99636 - RNA, 20 nt, Artificial Sequence
  MKO10099636_B_Ms4a1
  gRNA
ccaacuuacagauuuggauc

SEQ ID NO: 99637 - RNA, 20 nt, Artificial Sequence
  MKO10099637_B_Ms4a2
  gRNA
uccauucuggggugcagugc

SEQ ID NO: 99638 - RNA, 20 nt, Artificial Sequence
  MKO10099638_B_Ms4a2
  gRNA
gguuugauaugccuuuguuu

SEQ ID NO: 99639 - RNA, 20 nt, Artificial Sequence
  MKO10099639_B_Ms4a2
  gRNA
gcuuccaagaguucaauguc

SEQ ID NO: 99640 - RNA, 20 nt, Artificial Sequence
  MKO10099640_B_Ms4a3
  gRNA
auuggcaacccuugaaagcc

SEQ ID NO: 99641 - RNA, 20 nt, Artificial Sequence
  MKO10099641_B_Ms4a3
  gRNA
uggucacggacagcuccagc

SEQ ID NO: 99642 - RNA, 20 nt, Artificial Sequence
  MKO10099642_B_Ms4a3
  gRNA
cuagaaucaguauuccauuc

SEQ ID NO: 99643 - RNA, 20 nt, Artificial Sequence
  MKO10099643_B_Ms4a4b
  gRNA
gaccauuaacaucacugaag

SEQ ID NO: 99644 - RNA, 20 nt, Artificial Sequence
  MKO10099644_B_Ms4a4b
  gRNA
caccucacgggaguuacaac

SEQ ID NO: 99645 - RNA, 20 nt, Artificial Sequence
  MKO10099645_B_Ms4a4b
  gRNA
agugacaccuacaaaaugcc

SEQ ID NO: 99646 - RNA, 20 nt, Artificial Sequence
  MKO10099646_B_Ms4a4c
  gRNA
uucugaaccacucauuucug

SEQ ID NO: 99647 - RNA, 20 nt, Artificial Sequence
  MKO10099647_B_Ms4a4c
  gRNA
agugaaaccuacaaaaagcc

SEQ ID NO: 99648 - RNA, 20 nt, Artificial Sequence
  MKO10099648_B_Ms4a4c
  gRNA
caugaccaguucauugucuc

SEQ ID NO: 99649 - RNA, 20 nt, Artificial Sequence
  MKO10099649_B_Ms4a4d
  gRNA
accauuauugauccccaaaa

SEQ ID NO: 99650 - RNA, 20 nt, Artificial Sequence
  MKO10099650_B_Ms4a4d
  gRNA
agugaaaccuacaaaagcca

SEQ ID NO: 99651 - RNA, 20 nt, Artificial Sequence
  MKO10099651_B_Ms4a4d
  gRNA
uuccuguuguaacuccagug

SEQ ID NO: 99652 - RNA, 20 nt, Artificial Sequence
  MKO10099652_B_Ms4a5
  gRNA
uucuuguaguucauuaacuc

SEQ ID NO: 99653 - RNA, 20 nt, Artificial Sequence
  MKO10099653_B_Ms4a5
  gRNA
aaaaguucaugauuccaaac

SEQ ID NO: 99654 - RNA, 20 nt, Artificial Sequence
  MKO10099654_B_Ms4a5
  gRNA
ccuuccugauugcucugaaa

SEQ ID NO: 99655 - RNA, 20 nt, Artificial Sequence
  MKO10099655_B_Ms4a6b
  gRNA
acucguuccuguccaagaau

SEQ ID NO: 99656 - RNA, 20 nt, Artificial Sequence
  MKO10099656_B_Ms4a6b
  gRNA
cagagucacucuaacauccc

SEQ ID NO: 99657 - RNA, 20 nt, Artificial Sequence
  MKO10099657_B_Ms4a6b
  gRNA
ucugagcaguuuauagucuc

SEQ ID NO: 99658 - RNA, 20 nt, Artificial Sequence
  MKO10099658_B_Ms4a6c
  gRNA
acuuacagucagaauagacu

SEQ ID NO: 99659 - RNA, 20 nt, Artificial Sequence
  MKO10099659_B_Ms4a6c
  gRNA
acccucucucaaccacagca

SEQ ID NO: 99660 - RNA, 20 nt, Artificial Sequence
  MKO10099660_B_Ms4a6c
  gRNA
ugaugaucagcaucacugaa

SEQ ID NO: 99661 - RNA, 20 nt, Artificial Sequence
  MKO10099661_B_Ms4a6d
  gRNA
guagccagauucuaacagga

SEQ ID NO: 99662 - RNA, 20 nt, Artificial Sequence
  MKO10099662_B_Ms4a6d
  gRNA
gaugcuaaucagcagugugu

SEQ ID NO: 99663 - RNA, 20 nt, Artificial Sequence
  MKO10099663_B_Ms4a6d
  gRNA
gcucuguuuccaccacagug

SEQ ID NO: 99664 - RNA, 20 nt, Artificial Sequence
  MKO10099664_B_Ms4a7
  gRNA
ccccaaagcuugcaaguauc

SEQ ID NO: 99665 - RNA, 20 nt, Artificial Sequence
  MKO10099665_B_Ms4a7
  gRNA
guuuccaccacuuugauauc

SEQ ID NO: 99666 - RNA, 20 nt, Artificial Sequence
  MKO10099666_B_Ms4a7
  gRNA
caccuauugucugauagccc

SEQ ID NO: 99667 - RNA, 20 nt, Artificial Sequence
  MKO10099667_B_Ms4a8a
  gRNA
agcccaggccgaugugcacc

SEQ ID NO: 99668 - RNA, 20 nt, Artificial Sequence
  MKO10099668_B_Ms4a8a
  gRNA
uccccuucuggggaggcauc

SEQ ID NO: 99669 - RNA, 20 nt, Artificial Sequence
  MKO10099669_B_Ms4a8a
  gRNA
acagacaucaguaucucauc

SEQ ID NO: 99670 - RNA, 20 nt, Artificial Sequence
  MKO10099670_B_Msantd1
  gRNA
cgccucggucugggacguag

SEQ ID NO: 99671 - RNA, 20 nt, Artificial Sequence
  MKO10099671_B_Msantd1
  gRNA
ccagcacacggcgcaccucu

SEQ ID NO: 99672 - RNA, 20 nt, Artificial Sequence
  MKO10099672_B_Msantd1
  gRNA
ggagcgaaugaugagccuac

SEQ ID NO: 99673 - RNA, 20 nt, Artificial Sequence
  MKO10099673_B_Msantd2
  gRNA
gaauuggcuauaacacccgc

SEQ ID NO: 99674 - RNA, 20 nt, Artificial Sequence
  MKO10099674_B_Msantd2
  gRNA
ccacuacuguuaauaaguac

SEQ ID NO: 99675 - RNA, 20 nt, Artificial Sequence
  MKO10099675_B_Msantd2
  gRNA
cccgacuguaacaccugcga

SEQ ID NO: 99676 - RNA, 20 nt, Artificial Sequence
  MKO10099676_B_Msantd3
  gRNA
cgaguuguacucgugggcca

SEQ ID NO: 99677 - RNA, 20 nt, Artificial Sequence
  MKO10099677_B_Msantd3
  gRNA
gggccgguuaaacgaggaga

SEQ ID NO: 99678 - RNA, 20 nt, Artificial Sequence
  MKO10099678_B_Msantd3
  gRNA
gaaagaguucgggcccuuuc

SEQ ID NO: 99679 - RNA, 20 nt, Artificial Sequence
  MKO10099679_B_Msantd4
  gRNA
aauaaacgugaugaagcgaa

SEQ ID NO: 99680 - RNA, 20 nt, Artificial Sequence
  MKO10099680_B_Msantd4
  gRNA
aaaacgccgacuugauauug

SEQ ID NO: 99681 - RNA, 20 nt, Artificial Sequence
  MKO10099681_B_Msantd4
  gRNA
ggagcacgagcgcuuacagc

SEQ ID NO: 99682 - RNA, 20 nt, Artificial Sequence
  MKO10099682_B_Msc
  gRNA
acgucuuugcugucagaguc

SEQ ID NO: 99683 - RNA, 20 nt, Artificial Sequence
  MKO10099683_B_Msc
  gRNA
auaggcgauguccaccggcu

SEQ ID NO: 99684 - RNA, 20 nt, Artificial Sequence
  MKO10099684_B_Msc
  gRNA
gaagaagccgcucccgccua

SEQ ID NO: 99685 - RNA, 20 nt, Artificial Sequence
  MKO10099685_B_Msgn1
  gRNA
gcagguaauuccggagcgug

SEQ ID NO: 99686 - RNA, 20 nt, Artificial Sequence
  MKO10099686_B_Msgn1
  gRNA
ccgaugcccuccacacgcuc

SEQ ID NO: 99687 - RNA, 20 nt, Artificial Sequence
  MKO10099687_B_Msgn1
  gRNA
gaguuccccgauguacuuga

SEQ ID NO: 99688 - RNA, 20 nt, Artificial Sequence
  MKO10099688_B_Msh2
  gRNA
uagugcugcccuaccagaga

SEQ ID NO: 99689 - RNA, 20 nt, Artificial Sequence
  MKO10099689_B_Msh2
  gRNA
uuaucagacgauucaaauuu

SEQ ID NO: 99690 - RNA, 20 nt, Artificial Sequence
  MKO10099690_B_Msh2
  gRNA
ugcuaagcacaacacucugc

SEQ ID NO: 99691 - RNA, 20 nt, Artificial Sequence
  MKO10099691_B_Msh3
  gRNA
ucugcaacgugcaaagaaug

SEQ ID NO: 99692 - RNA, 20 nt, Artificial Sequence
  MKO10099692_B_Msh3
  gRNA
ucaguagcagcucaccaccc

SEQ ID NO: 99693 - RNA, 20 nt, Artificial Sequence
  MKO10099693_B_Msh3
  gRNA
ucuaaguacugcaguucuaa

SEQ ID NO: 99694 - RNA, 20 nt, Artificial Sequence
  MKO10099694_B_Msh4
  gRNA
acaccacaaguaggauauuc

SEQ ID NO: 99695 - RNA, 20 nt, Artificial Sequence
  MKO10099695_B_Msh4
  gRNA
gucaaauacugcuuguguug

SEQ ID NO: 99696 - RNA, 20 nt, Artificial Sequence
  MKO10099696_B_Msh4
  gRNA
uuaauuucacuacaguccaa

SEQ ID NO: 99697 - RNA, 20 nt, Artificial Sequence
  MKO10099697_B_Msh5
  gRNA
agucauagccucauccuguu

SEQ ID NO: 99698 - RNA, 20 nt, Artificial Sequence
  MKO10099698_B_Msh5
  gRNA
ugucauaguaagcaaugccc

SEQ ID NO: 99699 - RNA, 20 nt, Artificial Sequence
  MKO10099699_B_Msh5
  gRNA
agacgcuguuugcuuaucuc

SEQ ID NO: 99700 - RNA, 20 nt, Artificial Sequence
  MKO10099700_B_Msh6
  gRNA
guagacuugccccccauauu

SEQ ID NO: 99701 - RNA, 20 nt, Artificial Sequence
  MKO10099701_B_Msh6
  gRNA
ccggaugaacguuccaucaa

SEQ ID NO: 99702 - RNA, 20 nt, Artificial Sequence
  MKO10099702_B_Msh6
  gRNA
agcaaugcaacgugcagaug

SEQ ID NO: 99703 - RNA, 20 nt, Artificial Sequence
  MKO10099703_B_Msi1
  gRNA
uuucucgcagauugacccca

SEQ ID NO: 99704 - RNA, 20 nt, Artificial Sequence
  MKO10099704_B_Msi1
  gRNA
accuuaggcugugcucuucg

SEQ ID NO: 99705 - RNA, 20 nt, Artificial Sequence
  MKO10099705_B_Msi1
  gRNA
acucuuucaccuccccgaac

SEQ ID NO: 99706 - RNA, 20 nt, Artificial Sequence
  MKO10099706_B_Msi2
  gRNA
aacgacucccagcacgaccc

SEQ ID NO: 99707 - RNA, 20 nt, Artificial Sequence
  MKO10099707_B_Msi2
  gRNA
gcaaguguagauaaaguauu

SEQ ID NO: 99708 - RNA, 20 nt, Artificial Sequence
  MKO10099708_B_Msi2
  gRNA
aauacuuuaucuacacuugc

SEQ ID NO: 99709 - RNA, 20 nt, Artificial Sequence
  MKO10099709_B_Msl1
  gRNA
ccuaauaggaaaaccccauu

SEQ ID NO: 99710 - RNA, 20 nt, Artificial Sequence
  MKO10099710_B_Msl1
  gRNA
ugggaggucucgcaaagcuc

SEQ ID NO: 99711 - RNA, 20 nt, Artificial Sequence
  MKO10099711_B_Msl1
  gRNA
guuucuccugcaacacuuga

SEQ ID NO: 99712 - RNA, 20 nt, Artificial Sequence
  MKO10099712_B_Msl2
  gRNA
cagccaaaaaugucguuaca

SEQ ID NO: 99713 - RNA, 20 nt, Artificial Sequence
  MKO10099713_B_Msl2
  gRNA
cuagugcucaacuacgaccc

SEQ ID NO: 99714 - RNA, 20 nt, Artificial Sequence
  MKO10099714_B_Msl2
  gRNA
ccuccgcgacgucgcugcga

SEQ ID NO: 99715 - RNA, 20 nt, Artificial Sequence
  MKO10099715_B_Msl3l2
  gRNA
cuucgaccacgcgcuccccu

SEQ ID NO: 99716 - RNA, 20 nt, Artificial Sequence
  MKO10099716_B_Msl3l2
  gRNA
ccagcacgcucgccgagaag

SEQ ID NO: 99717 - RNA, 20 nt, Artificial Sequence
  MKO10099717_B_Msl3l2
  gRNA
acuguuacuacaucaaccgc

SEQ ID NO: 99718 - RNA, 20 nt, Artificial Sequence
  MKO10099718_B_Msl3
  gRNA
uuuaagacagagucgacacc

SEQ ID NO: 99719 - RNA, 20 nt, Artificial Sequence
  MKO10099719_B_Msl3
  gRNA
augacuguuacuauaucaac

SEQ ID NO: 99720 - RNA, 20 nt, Artificial Sequence
  MKO10099720_B_Msl3
  gRNA
ccaauuugcgcuguaaucuc

SEQ ID NO: 99721 - RNA, 20 nt, Artificial Sequence
  MKO10099721_B_Mslnl
  gRNA
acccagcugugcagcgaggu

SEQ ID NO: 99722 - RNA, 20 nt, Artificial Sequence
  MKO10099722_B_Mslnl
  gRNA
cgcucaccugacccaugugu

SEQ ID NO: 99723 - RNA, 20 nt, Artificial Sequence
  MKO10099723_B_Mslnl
  gRNA
ugcccugcagcgcacagccu

SEQ ID NO: 99724 - RNA, 20 nt, Artificial Sequence
  MKO10099724_B_Msln
  gRNA
uacagccauagccagccccu

SEQ ID NO: 99725 - RNA, 20 nt, Artificial Sequence
  MKO10099725_B_Msln
  gRNA
aacccaccuggcaaagucag

SEQ ID NO: 99726 - RNA, 20 nt, Artificial Sequence
  MKO10099726_B_Msln
  gRNA
guucacagcauggaggagug

SEQ ID NO: 99727 - RNA, 20 nt, Artificial Sequence
  MKO10099727_B_Msmb
  gRNA
ucucuuauuccuugcuacca

SEQ ID NO: 99728 - RNA, 20 nt, Artificial Sequence
  MKO10099728_B_Msmb
  gRNA
agcauuuccuuaacacuccc

SEQ ID NO: 99729 - RNA, 20 nt, Artificial Sequence
  MKO10099729_B_Msmb
  gRNA
uuaccaucagacauuugauu

SEQ ID NO: 99730 - RNA, 20 nt, Artificial Sequence
  MKO10099730_B_Msmp
  gRNA
ccagccuccgaggauccccu

SEQ ID NO: 99731 - RNA, 20 nt, Artificial Sequence
  MKO10099731_B_Msmp
  gRNA
gagcagcaggaauggcccua

SEQ ID NO: 99732 - RNA, 20 nt, Artificial Sequence
  MKO10099732_B_Msmp
  gRNA
ccuagcucccugccacuacg

SEQ ID NO: 99733 - RNA, 20 nt, Artificial Sequence
  MKO10099733_B_Msn
  gRNA
cagugugcgugucaccacca

SEQ ID NO: 99734 - RNA, 20 nt, Artificial Sequence
  MKO10099734_B_Msn
  gRNA
gccauucagcccaacaccac

SEQ ID NO: 99735 - RNA, 20 nt, Artificial Sequence
  MKO10099735_B_Msn
  gRNA
uuccagguggugaaaacuau

SEQ ID NO: 99736 - RNA, 20 nt, Artificial Sequence
  MKO10099736_B_Msr1
  gRNA
gcaguacuaauaccuguugu

SEQ ID NO: 99737 - RNA, 20 nt, Artificial Sequence
  MKO10099737_B_Msr1
  gRNA
ggagaaguugaaguccuuca

SEQ ID NO: 99738 - RNA, 20 nt, Artificial Sequence
  MKO10099738_B_Msr1
  gRNA
ucagcauccucuuguucaug

SEQ ID NO: 99739 - RNA, 20 nt, Artificial Sequence
  MKO10099739_B_Msra
  gRNA
ucaccuucaggcaugcgcca

SEQ ID NO: 99740 - RNA, 20 nt, Artificial Sequence
  MKO10099740_B_Msra
  gRNA
cgcaaguucugggucuugaa

SEQ ID NO: 99741 - RNA, 20 nt, Artificial Sequence
  MKO10099741_B_Msra
  gRNA
ucaacccaagugggcuuugc

SEQ ID NO: 99742 - RNA, 20 nt, Artificial Sequence
  MKO10099742_B_Msrb1
  gRNA
ucacugaaguucgucccuaa

SEQ ID NO: 99743 - RNA, 20 nt, Artificial Sequence
  MKO10099743_B_Msrb1
  gRNA
aguacgcacacucauccccg

SEQ ID NO: 99744 - RNA, 20 nt, Artificial Sequence
  MKO10099744_B_Msrb1
  gRNA
uaccuggcucgaagugauuc

SEQ ID NO: 99745 - RNA, 20 nt, Artificial Sequence
  MKO10099745_B_Msrb2
  gRNA
cauggagguggucugcaagc

SEQ ID NO: 99746 - RNA, 20 nt, Artificial Sequence
  MKO10099746_B_Msrb2
  gRNA
ccugauggacccaagcccac

SEQ ID NO: 99747 - RNA, 20 nt, Artificial Sequence
  MKO10099747_B_Msrb2
  gRNA
gcucucuaagcgaagcagac

SEQ ID NO: 99748 - RNA, 20 nt, Artificial Sequence
  MKO10099748_B_Msrb3
  gRNA
ccuacaguaccaugucacuc

SEQ ID NO: 99749 - RNA, 20 nt, Artificial Sequence
  MKO10099749_B_Msrb3
  gRNA
ucagaaaccaaauuugacuc

SEQ ID NO: 99750 - RNA, 20 nt, Artificial Sequence
  MKO10099750_B_Msrb3
  gRNA
uacacacaucacaaagaucc

SEQ ID NO: 99751 - RNA, 20 nt, Artificial Sequence
  MKO10099751_B_Mss51
  gRNA
ccuggaacaauucagcuuag

SEQ ID NO: 99752 - RNA, 20 nt, Artificial Sequence
  MKO10099752_B_Mss51
  gRNA
cacgucaccucuuacagugc

SEQ ID NO: 99753 - RNA, 20 nt, Artificial Sequence
  MKO10099753_B_Mss51
  gRNA
gagacauuucuuauucguuc

SEQ ID NO: 99754 - RNA, 20 nt, Artificial Sequence
  MKO10099754_B_Mst1r
  gRNA
agccucguagugccccuuag

SEQ ID NO: 99755 - RNA, 20 nt, Artificial Sequence
  MKO10099755_B_Mst1r
  gRNA
cggcugacaucccgaugaac

SEQ ID NO: 99756 - RNA, 20 nt, Artificial Sequence
  MKO10099756_B_Mst1r
  gRNA
ccacgcuagcuucacccgug

SEQ ID NO: 99757 - RNA, 20 nt, Artificial Sequence
  MKO10099757_B_Mst1
  gRNA
uuaugugcggaccugcauua

SEQ ID NO: 99758 - RNA, 20 nt, Artificial Sequence
  MKO10099758_B_Mst1
  gRNA
ccacucaccgacaguccaga

SEQ ID NO: 99759 - RNA, 20 nt, Artificial Sequence
  MKO10099759_B_Mst1
  gRNA
cagccgcuuacccucccugc

SEQ ID NO: 99760 - RNA, 20 nt, Artificial Sequence
  MKO10099760_B_Mstn
  gRNA
gugcugccgcuacccccuca

SEQ ID NO: 99761 - RNA, 20 nt, Artificial Sequence
  MKO10099761_B_Mstn
  gRNA
auaccuuguaccgucuuuca

SEQ ID NO: 99762 - RNA, 20 nt, Artificial Sequence
  MKO10099762_B_Mstn
  gRNA
gaucuugcuguaaccuuccc

SEQ ID NO: 99763 - RNA, 20 nt, Artificial Sequence
  MKO10099763_B_Msto1
  gRNA
cagggagugcggaguaguga

SEQ ID NO: 99764 - RNA, 20 nt, Artificial Sequence
  MKO10099764_B_Msto1
  gRNA
cuacugcagccucuagcugu

SEQ ID NO: 99765 - RNA, 20 nt, Artificial Sequence
  MKO10099765_B_Msto1
  gRNA
cccuggagguuuggguucuu

SEQ ID NO: 99766 - RNA, 20 nt, Artificial Sequence
  MKO10099766_B_Msx1
  gRNA
cggaugcgcccuccucgccg

SEQ ID NO: 99767 - RNA, 20 nt, Artificial Sequence
  MKO10099767_B_Msx1
  gRNA
uagagucccacgggcgcuac

SEQ ID NO: 99768 - RNA, 20 nt, Artificial Sequence
  MKO10099768_B_Msx1
  gRNA
ccugucuauugccgagcgcg

SEQ ID NO: 99769 - RNA, 20 nt, Artificial Sequence
  MKO10099769_B_Msx2
  gRNA
gaacucggcccgcucugcua

SEQ ID NO: 99770 - RNA, 20 nt, Artificial Sequence
  MKO10099770_B_Msx2
  gRNA
uggcaccgcgggcgauuccu

SEQ ID NO: 99771 - RNA, 20 nt, Artificial Sequence
  MKO10099771_B_Msx2
  gRNA
aagucggaaaauuccgaaga

SEQ ID NO: 99772 - RNA, 20 nt, Artificial Sequence
  MKO10099772_B_Msx3
  gRNA
cguucaugucgaaugucgcc

SEQ ID NO: 99773 - RNA, 20 nt, Artificial Sequence
  MKO10099773_B_Msx3
  gRNA
aaccgcguugccgccgaaag

SEQ ID NO: 99774 - RNA, 20 nt, Artificial Sequence
  MKO10099774_B_Msx3
  gRNA
gauccucgccgggccugucg

SEQ ID NO: 99775 - RNA, 20 nt, Artificial Sequence
  MKO10099775_B_Mt1
  gRNA
ucccaacucacucuucuugc

SEQ ID NO: 99776 - RNA, 20 nt, Artificial Sequence
  MKO10099776_B_Mt1
  gRNA
cccaacugcuccugcuccac

SEQ ID NO: 99777 - RNA, 20 nt, Artificial Sequence
  MKO10099777_B_Mt1
  gRNA
ggugcacuugcaguucuugc

SEQ ID NO: 99778 - RNA, 20 nt, Artificial Sequence
  MKO10099778_B_Mt2
  gRNA
cccaacugcuccugugccuc

SEQ ID NO: 99779 - RNA, 20 nt, Artificial Sequence
  MKO10099779_B_Mt2
  gRNA
gagcacuucgcacagcccac

SEQ ID NO: 99780 - RNA, 20 nt, Artificial Sequence
  MKO10099780_B_Mt2
  gRNA
uuugcauuguuugcauuugc

SEQ ID NO: 99781 - RNA, 20 nt, Artificial Sequence
  MKO10099781_B_Mt3
  gRNA
aaggggcucaccaguaggac

SEQ ID NO: 99782 - RNA, 20 nt, Artificial Sequence
  MKO10099782_B_Mt3
  gRNA
gccaaggacugugugugcaa

SEQ ID NO: 99783 - RNA, 20 nt, Artificial Sequence
  MKO10099783_B_Mt3
  gRNA
aggugguuccugcaccugcu

SEQ ID NO: 99784 - RNA, 20 nt, Artificial Sequence
  MKO10099784_B_Mt4
  gRNA
gcacacuuggcacagccugg

SEQ ID NO: 99785 - RNA, 20 nt, Artificial Sequence
  MKO10099785_B_Mt4
  gRNA
cuaggagggaucugcaucug

SEQ ID NO: 99786 - RNA, 20 nt, Artificial Sequence
  MKO10099786_B_Mt4
  gRNA
ugcugucccugcuguccccc

SEQ ID NO: 99787 - RNA, 20 nt, Artificial Sequence
  MKO10099787_B_Mua1
  gRNA
gagacuccaacugccgagac

SEQ ID NO: 99788 - RNA, 20 nt, Artificial Sequence
  MKO10099788_B_Mua1
  gRNA
uuccagcagccucaucgcgc

SEQ ID NO: 99789 - RNA, 20 nt, Artificial Sequence
  MKO10099789_B_Mua1
  gRNA
caaguccuacuuggagcgug

SEQ ID NO: 99790 - RNA, 20 nt, Artificial Sequence
  MKO10099790_B_Mua2
  gRNA
uucuaguagccucaacagcu

SEQ ID NO: 99791 - RNA, 20 nt, Artificial Sequence
  MKO10099791_B_Mua2
  gRNA
acggauugaggagcucaaua

SEQ ID NO: 99792 - RNA, 20 nt, Artificial Sequence
  MKO10099792_B_Mua2
  gRNA
cacuauucuaggggaguuug

SEQ ID NO: 99793 - RNA, 20 nt, Artificial Sequence
  MKO10099793_B_Mua3
  gRNA
uuagacugcaaguggcaaug

SEQ ID NO: 99794 - RNA, 20 nt, Artificial Sequence
  MKO10099794_B_Mua3
  gRNA
gcaacccguaccucaucaga

SEQ ID NO: 99795 - RNA, 20 nt, Artificial Sequence
  MKO10099795_B_Mua3
  gRNA
ucacuuacuagcaugcuugu

SEQ ID NO: 99796 - RNA, 20 nt, Artificial Sequence
  MKO10099796_B_Muap7d3
  gRNA
aagagaucgucaaguacacc

SEQ ID NO: 99797 - RNA, 20 nt, Artificial Sequence
  MKO10099797_B_Muap7d3
  gRNA
cuguuguucucugcguucuu

SEQ ID NO: 99798 - RNA, 20 nt, Artificial Sequence
  MKO10099798_B_Muap7d3
  gRNA
agaaaaacaccguaaacuga

SEQ ID NO: 99799 - RNA, 20 nt, Artificial Sequence
  MKO10099799_B_Muap
  gRNA
cuccccuagauuggaauaau

SEQ ID NO: 99800 - RNA, 20 nt, Artificial Sequence
  MKO10099800_B_Muap
  gRNA
ggcaaaacgguucagccaug

SEQ ID NO: 99801 - RNA, 20 nt, Artificial Sequence
  MKO10099801_B_Muap
  gRNA
aucuuccuaggacaucccua

SEQ ID NO: 99802 - RNA, 20 nt, Artificial Sequence
  MKO10099802_B_Mtbp
  gRNA
ccagaugacaguacauuccc

SEQ ID NO: 99803 - RNA, 20 nt, Artificial Sequence
  MKO10099803_B_Mtbp
  gRNA
ccagggaauguacugucauc

SEQ ID NO: 99804 - RNA, 20 nt, Artificial Sequence
  MKO10099804_B_Mtbp
  gRNA
caccgcaaagaaccacuucc

SEQ ID NO: 99805 - RNA, 20 nt, Artificial Sequence
  MKO10099805_B_Much1
  gRNA
ugcucuuaccguguaaggga

SEQ ID NO: 99806 - RNA, 20 nt, Artificial Sequence
  MKO10099806_B_Much1
  gRNA
cugccgagcuucuucaccua

SEQ ID NO: 99807 - RNA, 20 nt, Artificial Sequence
  MKO10099807_B_Much1
  gRNA
cucacucaagaaaguuguga

SEQ ID NO: 99808 - RNA, 20 nt, Artificial Sequence
  MKO10099808_B_Much2
  gRNA
uugacuccaagacuguguuc

SEQ ID NO: 99809 - RNA, 20 nt, Artificial Sequence
  MKO10099809_B_Much2
  gRNA
uuaccuguaagacuuuccca

SEQ ID NO: 99810 - RNA, 20 nt, Artificial Sequence
  MKO10099810_B_Much2
  gRNA
cucuuaccucuuugauaacu

SEQ ID NO: 99811 - RNA, 20 nt, Artificial Sequence
  MKO10099811_B_Mucp1
  gRNA
uguugugcucgauaucccaa

SEQ ID NO: 99812 - RNA, 20 nt, Artificial Sequence
  MKO10099812_B_Mucp1
  gRNA
uacauaccagguuaaucauc

SEQ ID NO: 99813 - RNA, 20 nt, Artificial Sequence
  MKO10099813_B_Mucp1
  gRNA
cugacaggucaggggaguac

SEQ ID NO: 99814 - RNA, 20 nt, Artificial Sequence
  MKO10099814_B_Mtdh
  gRNA
gauaaagugcugacugauuc

SEQ ID NO: 99815 - RNA, 20 nt, Artificial Sequence
  MKO10099815_B_Mtdh
  gRNA
aaaaggagauucuacacugc

SEQ ID NO: 99816 - RNA, 20 nt, Artificial Sequence
  MKO10099816_B_Mtdh
  gRNA
caaguuagcaacuuuaaguc

SEQ ID NO: 99817 - RNA, 20 nt, Artificial Sequence
  MKO10099817_B_Mterf1a
  gRNA
gaaguuauuccuucugucca

SEQ ID NO: 99818 - RNA, 20 nt, Artificial Sequence
  MKO10099818_B_Mterf1a
  gRNA
uucucuuugauuuaagagac

SEQ ID NO: 99819 - RNA, 20 nt, Artificial Sequence
  MKO10099819_B_Mterf1a
  gRNA
uuauggcaucaagaaacauc

SEQ ID NO: 99820 - RNA, 20 nt, Artificial Sequence
  MKO10099820_B_Mterf1b
  gRNA
aacuuucucuuugauuuaag

SEQ ID NO: 99821 - RNA, 20 nt, Artificial Sequence
  MKO10099821_B_Mterf1b
  gRNA
gaagauauuccuucugucca

SEQ ID NO: 99822 - RNA, 20 nt, Artificial Sequence
  MKO10099822_B_Mterf1b
  gRNA
uucauaucuucucugacucc

SEQ ID NO: 99823 - RNA, 20 nt, Artificial Sequence
  MKO10099823_B_Mterfd1
  gRNA
uccguuacagucaguuucag

SEQ ID NO: 99824 - RNA, 20 nt, Artificial Sequence
  MKO10099824_B_Mterfd1
  gRNA
uacguaaucugcaaguguga

SEQ ID NO: 99825 - RNA, 20 nt, Artificial Sequence
  MKO10099825_B_Mterfd1
  gRNA
auuucuguugagcuucuccg

SEQ ID NO: 99826 - RNA, 20 nt, Artificial Sequence
  MKO10099826_B_Mterfd2
  gRNA
aucgucuacuggcccucucc

SEQ ID NO: 99827 - RNA, 20 nt, Artificial Sequence
  MKO10099827_B_Mterfd2
  gRNA
uccaguuaccuucggaagcu

SEQ ID NO: 99828 - RNA, 20 nt, Artificial Sequence
  MKO10099828_B_Mterfd2
  gRNA
gguaccguccaaggcgcucc

SEQ ID NO: 99829 - RNA, 20 nt, Artificial Sequence
  MKO10099829_B_Mterfd3
  gRNA
caguauauuagaacgcuguc

SEQ ID NO: 99830 - RNA, 20 nt, Artificial Sequence
  MKO10099830_B_Mterfd3
  gRNA
ccgcugcuguuaacaccaaa

SEQ ID NO: 99831 - RNA, 20 nt, Artificial Sequence
  MKO10099831_B_Mterfd3
  gRNA
ucaaccuuuaaugaugccac

SEQ ID NO: 99832 - RNA, 20 nt, Artificial Sequence
  MKO10099832_B_Mtf1
  gRNA
aagcacauucggacccauac

SEQ ID NO: 99833 - RNA, 20 nt, Artificial Sequence
  MKO10099833_B_Mtf1
  gRNA
cgucuucucacagccguugc

SEQ ID NO: 99834 - RNA, 20 nt, Artificial Sequence
  MKO10099834_B_Mtf1
  gRNA
uaaacuuaccagugugcguc

SEQ ID NO: 99835 - RNA, 20 nt, Artificial Sequence
  MKO10099835_B_Mtf2
  gRNA
gagcugcuucaucauauuug

SEQ ID NO: 99836 - RNA, 20 nt, Artificial Sequence
  MKO10099836_B_Mtf2
  gRNA
gaccauuuccccacucccag

SEQ ID NO: 99837 - RNA, 20 nt, Artificial Sequence
  MKO10099837_B_Mtf2
  gRNA
guuccaaauccuggguucuc

SEQ ID NO: 99838 - RNA, 20 nt, Artificial Sequence
  MKO10099838_B_Mtfmt
  gRNA
cugauucagagacggcaaag

SEQ ID NO: 99839 - RNA, 20 nt, Artificial Sequence
  MKO10099839_B_Mtfmt
  gRNA
cugcccgaaagucugaacaa

SEQ ID NO: 99840 - RNA, 20 nt, Artificial Sequence
  MKO10099840_B_Mtfmt
  gRNA
ggagcgggaccacgccaccu

SEQ ID NO: 99841 - RNA, 20 nt, Artificial Sequence
  MKO10099841_B_Mtfp1
  gRNA
gcgcaagcuguacccgucag

SEQ ID NO: 99842 - RNA, 20 nt, Artificial Sequence
  MKO10099842_B_Mtfp1
  gRNA
gggggaggcuuuccgcucgc

SEQ ID NO: 99843 - RNA, 20 nt, Artificial Sequence
  MKO10099843_B_Mtfp1
  gRNA
cugacggguacagcuugcgc

SEQ ID NO: 99844 - RNA, 20 nt, Artificial Sequence
  MKO10099844_B_Mtfr1l
  gRNA
gccucagugcccaaccuucg

SEQ ID NO: 99845 - RNA, 20 nt, Artificial Sequence
  MKO10099845_B_Mtfr1l
  gRNA
cgaagagacauucgaacuuc

SEQ ID NO: 99846 - RNA, 20 nt, Artificial Sequence
  MKO10099846_B_Mtfr1l
  gRNA
uguucugguuugcaacacuc

SEQ ID NO: 99847 - RNA, 20 nt, Artificial Sequence
  MKO10099847_B_Mtfr1
  gRNA
uuuccuuagguacuaugguc

SEQ ID NO: 99848 - RNA, 20 nt, Artificial Sequence
  MKO10099848_B_Mtfr1
  gRNA
ucgcuggccagcguccucuc

SEQ ID NO: 99849 - RNA, 20 nt, Artificial Sequence
  MKO10099849_B_Mtfr1
  gRNA
caagggcagagaucuucugc

SEQ ID NO: 99850 - RNA, 20 nt, Artificial Sequence
  MKO10099850_B_Mtfr2
  gRNA
uuacucgcagacauagucua

SEQ ID NO: 99851 - RNA, 20 nt, Artificial Sequence
  MKO10099851_B_Mtfr2
  gRNA
aaauauauuaagaaacgugc

SEQ ID NO: 99852 - RNA, 20 nt, Artificial Sequence
  MKO10099852_B_Mtfr2
  gRNA
uuaccgaaaucugagacaac

SEQ ID NO: 99853 - RNA, 20 nt, Artificial Sequence
  MKO10099853_B_Mug1
  gRNA
agaggguuucgaccugaaaa

SEQ ID NO: 99854 - RNA, 20 nt, Artificial Sequence
  MKO10099854_B_Mug1
  gRNA
ucgugaagagaacguugcuc

SEQ ID NO: 99855 - RNA, 20 nt, Artificial Sequence
  MKO10099855_B_Mug1
  gRNA
ucugcuuguccucaacaaaa

SEQ ID NO: 99856 - RNA, 20 nt, Artificial Sequence
  MKO10099856_B_Mug2
  gRNA
caccggagagugcugguccg

SEQ ID NO: 99857 - RNA, 20 nt, Artificial Sequence
  MKO10099857_B_Mug2
  gRNA
uggugccacccucuacauuc

SEQ ID NO: 99858 - RNA, 20 nt, Artificial Sequence
  MKO10099858_B_Mug2
  gRNA
cuuccacagugagccccgca

SEQ ID NO: 99859 - RNA, 20 nt, Artificial Sequence
  MKO10099859_B_Mthfd1l
  gRNA
cuucaucaaauugucaucac

SEQ ID NO: 99860 - RNA, 20 nt, Artificial Sequence
  MKO10099860_B_Mthfd1l
  gRNA
uaugaaccagaauuuggcca

SEQ ID NO: 99861 - RNA, 20 nt, Artificial Sequence
  MKO10099861_B_Mthfd1l
  gRNA
augaaucuucagagaucuga

SEQ ID NO: 99862 - RNA, 20 nt, Artificial Sequence
  MKO10099862_B_Mthfd1
  gRNA
cacgcucaccucggacucug

SEQ ID NO: 99863 - RNA, 20 nt, Artificial Sequence
  MKO10099863_B_Mthfd1
  gRNA
auaugucaucucccugaacg

SEQ ID NO: 99864 - RNA, 20 nt, Artificial Sequence
  MKO10099864_B_Mthfd1
  gRNA
aagaacauccacagaguccg

SEQ ID NO: 99865 - RNA, 20 nt, Artificial Sequence
  MKO10099865_B_Mthfd2l
  gRNA
ggagagcacgagcguccugg

SEQ ID NO: 99866 - RNA, 20 nt, Artificial Sequence
  MKO10099866_B_Mthfd2l
  gRNA
gcuccagaaaaggacguuga

SEQ ID NO: 99867 - RNA, 20 nt, Artificial Sequence
  MKO10099867_B_Mthfd2l
  gRNA
cugccacugccagugccguu

SEQ ID NO: 99868 - RNA, 20 nt, Artificial Sequence
  MKO10099868_B_Mthfd2
  gRNA
gugugcagcaacauugcaau

SEQ ID NO: 99869 - RNA, 20 nt, Artificial Sequence
  MKO10099869_B_Mthfd2
  gRNA
uuugcaggcauuccaaccuu

SEQ ID NO: 99870 - RNA, 20 nt, Artificial Sequence
  MKO10099870_B_Mthfd2
  gRNA
gccacaccucagugucauuc

SEQ ID NO: 99871 - RNA, 20 nt, Artificial Sequence
  MKO10099871_B_Mthfr
  gRNA
accugaauagggaagauccc

SEQ ID NO: 99872 - RNA, 20 nt, Artificial Sequence
  MKO10099872_B_Mthfr
  gRNA
gaugugcuucaccaggucug

SEQ ID NO: 99873 - RNA, 20 nt, Artificial Sequence
  MKO10099873_B_Mthfr
  gRNA
gucaaaauagucagcaaacu

SEQ ID NO: 99874 - RNA, 20 nt, Artificial Sequence
  MKO10099874_B_Mthfsd
  gRNA
gcguuucucugaggagcguc

SEQ ID NO: 99875 - RNA, 20 nt, Artificial Sequence
  MKO10099875_B_Mthfsd
  gRNA
gauccugugaugaacggguc

SEQ ID NO: 99876 - RNA, 20 nt, Artificial Sequence
  MKO10099876_B_Mthfsd
  gRNA
uuccccgacccguucaucac

SEQ ID NO: 99877 - RNA, 20 nt, Artificial Sequence
  MKO10099877_B_Mthfs
  gRNA
gccaggaauggcggcgguca

SEQ ID NO: 99878 - RNA, 20 nt, Artificial Sequence
  MKO10099878_B_Mthfs
  gRNA
agaugccuuaccaguggaua

SEQ ID NO: 99879 - RNA, 20 nt, Artificial Sequence
  MKO10099879_B_Mthfs
  gRNA
cuugaccucaucuuccuucc

SEQ ID NO: 99880 - RNA, 20 nt, Artificial Sequence
  MKO10099880_B_Mtif2
  gRNA
ggaggcaucacucaacacau

SEQ ID NO: 99881 - RNA, 20 nt, Artificial Sequence
  MKO10099881_B_Mtif2
  gRNA
acucacauuuagaugaaguc

SEQ ID NO: 99882 - RNA, 20 nt, Artificial Sequence
  MKO10099882_B_Mtif2
  gRNA
ugggguaaugaaacaaacug

SEQ ID NO: 99883 - RNA, 20 nt, Artificial Sequence
  MKO10099883_B_Mtif3
  gRNA
acguucaagucacgauaaag

SEQ ID NO: 99884 - RNA, 20 nt, Artificial Sequence
  MKO10099884_B_Mtif3
  gRNA
acuuugagcaaagacgacga

SEQ ID NO: 99885 - RNA, 20 nt, Artificial Sequence
  MKO10099885_B_Mtif3
  gRNA
cuugagaagguugcuauguc

SEQ ID NO: 99886 - RNA, 20 nt, Artificial Sequence
  MKO10099886_B_Mtl5
  gRNA
gccuggaaagcugcgucuuc

SEQ ID NO: 99887 - RNA, 20 nt, Artificial Sequence
  MKO10099887_B_Mtl5
  gRNA
gaaguuaaaucucaucacac

SEQ ID NO: 99888 - RNA, 20 nt, Artificial Sequence
  MKO10099888_B_Mtl5
  gRNA
caacaggauuccugagccag

SEQ ID NO: 99889 - RNA, 20 nt, Artificial Sequence
  MKO10099889_B_Mtm1
  gRNA
ccaggggaguuacuaauuac

SEQ ID NO: 99890 - RNA, 20 nt, Artificial Sequence
  MKO10099890_B_Mtm1
  gRNA
ucuaauacuugauguuccuc

SEQ ID NO: 99891 - RNA, 20 nt, Artificial Sequence
  MKO10099891_B_Mtm1
  gRNA
ucgucuuuauuuaagaaguu

SEQ ID NO: 99892 - RNA, 20 nt, Artificial Sequence
  MKO10099892_B_Mtmr10
  gRNA
gcaaauaccuguaauggcau

SEQ ID NO: 99893 - RNA, 20 nt, Artificial Sequence
  MKO10099893_B_Mtmr10
  gRNA
agaugacccaaugccauuac

SEQ ID NO: 99894 - RNA, 20 nt, Artificial Sequence
  MKO10099894_B_Mtmr10
  gRNA
aucuguucaauacaugucaa

SEQ ID NO: 99895 - RNA, 20 nt, Artificial Sequence
  MKO10099895_B_Mtmr11
  gRNA
uaggggagcauauccuagca

SEQ ID NO: 99896 - RNA, 20 nt, Artificial Sequence
  MKO10099896_B_Mtmr11
  gRNA
agagugcagcuucuccgucc

SEQ ID NO: 99897 - RNA, 20 nt, Artificial Sequence
  MKO10099897_B_Mtmr11
  gRNA
gcuccggcauccuguucccu

SEQ ID NO: 99898 - RNA, 20 nt, Artificial Sequence
  MKO10099898_B_Mtmr12
  gRNA
ugacgugccacugcacugug

SEQ ID NO: 99899 - RNA, 20 nt, Artificial Sequence
  MKO10099899_B_Mtmr12
  gRNA
gucacucuucacuuguugcc

SEQ ID NO: 99900 - RNA, 20 nt, Artificial Sequence
  MKO10099900_B_Mtmr12
  gRNA
caguuuaagaauaagaucau

SEQ ID NO: 99901 - RNA, 20 nt, Artificial Sequence
  MKO10099901_B_Mtmr14
  gRNA
gacaaaccgaccucugcacc

SEQ ID NO: 99902 - RNA, 20 nt, Artificial Sequence
  MKO10099902_B_Mtmr14
  gRNA
accuuaccuugccuuugaac

SEQ ID NO: 99903 - RNA, 20 nt, Artificial Sequence
  MKO10099903_B_Mtmr14
  gRNA
uugucucccagcauauuugc

SEQ ID NO: 99904 - RNA, 20 nt, Artificial Sequence
  MKO10099904_B_Mtmr1
  gRNA
cuacagggucacauguugaa

SEQ ID NO: 99905 - RNA, 20 nt, Artificial Sequence
  MKO10099905_B_Mtmr1
  gRNA
ucuugccaggcucuaaggga

SEQ ID NO: 99906 - RNA, 20 nt, Artificial Sequence
  MKO10099906_B_Mtmr1
  gRNA
acaauuucuagucagauuuc

SEQ ID NO: 99907 - RNA, 20 nt, Artificial Sequence
  MKO10099907_B_Mtmr2
  gRNA
aauauacauacccucaaguc

SEQ ID NO: 99908 - RNA, 20 nt, Artificial Sequence
  MKO10099908_B_Mtmr2
  gRNA
guugucugcagagguugaaa

SEQ ID NO: 99909 - RNA, 20 nt, Artificial Sequence
  MKO10099909_B_Mtmr2
  gRNA
uuaccuugcacacaguuucc

SEQ ID NO: 99910 - RNA, 20 nt, Artificial Sequence
  MKO10099910_B_Mtmr3
  gRNA
ucgggaggaugagaaucuuc

SEQ ID NO: 99911 - RNA, 20 nt, Artificial Sequence
  MKO10099911_B_Mtmr3
  gRNA
cuagccuaccuggucugcac

SEQ ID NO: 99912 - RNA, 20 nt, Artificial Sequence
  MKO10099912_B_Mtmr3
  gRNA
acgcuuucaauaagcuguaa

SEQ ID NO: 99913 - RNA, 20 nt, Artificial Sequence
  MKO10099913_B_Mtmr4
  gRNA
gggggaacagauccuuggcu

SEQ ID NO: 99914 - RNA, 20 nt, Artificial Sequence
  MKO10099914_B_Mtmr4
  gRNA
gguacccuucacagugcugc

SEQ ID NO: 99915 - RNA, 20 nt, Artificial Sequence
  MKO10099915_B_Mtmr4
  gRNA
uuccacugcaggugccccuc

SEQ ID NO: 99916 - RNA, 20 nt, Artificial Sequence
  MKO10099916_B_Mtmr6
  gRNA
gcugagcgucaauaaauaau

SEQ ID NO: 99917 - RNA, 20 nt, Artificial Sequence
  MKO10099917_B_Mtmr6
  gRNA
uccucucauacuccgcagca

SEQ ID NO: 99918 - RNA, 20 nt, Artificial Sequence
  MKO10099918_B_Mtmr6
  gRNA
ggaugccaaccgagaguaca

SEQ ID NO: 99919 - RNA, 20 nt, Artificial Sequence
  MKO10099919_B_Mtmr7
  gRNA
cuagguugaaaacgugcgcu

SEQ ID NO: 99920 - RNA, 20 nt, Artificial Sequence
  MKO10099920_B_Mtmr7
  gRNA
cguacaacuugucauuccac

SEQ ID NO: 99921 - RNA, 20 nt, Artificial Sequence
  MKO10099921_B_Mtmr7
  gRNA
ucuggggacguacaguuccg

SEQ ID NO: 99922 - RNA, 20 nt, Artificial Sequence
  MKO10099922_B_Mtmr9
  gRNA
uuccaggugauuaugcgaag

SEQ ID NO: 99923 - RNA, 20 nt, Artificial Sequence
  MKO10099923_B_Mtmr9
  gRNA
cauacuuaccucaauggaac

SEQ ID NO: 99924 - RNA, 20 nt, Artificial Sequence
  MKO10099924_B_Mtmr9
  gRNA
gguagaagaaaggguacauc

SEQ ID NO: 99925 - RNA, 20 nt, Artificial Sequence
  MKO10099925_B_Mtnr1a
  gRNA
cucgcugacauugcccuuca

SEQ ID NO: 99926 - RNA, 20 nt, Artificial Sequence
  MKO10099926_B_Mtnr1a
  gRNA
ugccucaacgcaauuauaua

SEQ ID NO: 99927 - RNA, 20 nt, Artificial Sequence
  MKO10099927_B_Mtnr1a
  gRNA
cucagcguacacgauagcag

SEQ ID NO: 99928 - RNA, 20 nt, Artificial Sequence
  MKO10099928_B_Mtnr1b
  gRNA
ugggccccccucaacuguau

SEQ ID NO: 99929 - RNA, 20 nt, Artificial Sequence
  MKO10099929_B_Mtnr1b
  gRNA
gcaccaguacccagauucgc

SEQ ID NO: 99930 - RNA, 20 nt, Artificial Sequence
  MKO10099930_B_Mtnr1b
  gRNA
gacgacuacuguagauagca

SEQ ID NO: 99931 - RNA, 20 nt, Artificial Sequence
  MKO10099931_B_Mto1
  gRNA
gacucacaccaacccccgag

SEQ ID NO: 99932 - RNA, 20 nt, Artificial Sequence
  MKO10099932_B_Mto1
  gRNA
ccccuuuccgaugccaccaa

SEQ ID NO: 99933 - RNA, 20 nt, Artificial Sequence
  MKO10099933_B_Mto1
  gRNA
ccgggaacacagaccaucca

SEQ ID NO: 99934 - RNA, 20 nt, Artificial Sequence
  MKO10099934_B_Mtor
  gRNA
cgcuacagcgccuucccgga

SEQ ID NO: 99935 - RNA, 20 nt, Artificial Sequence
  MKO10099935_B_Mtor
  gRNA
aaucgagaugaucgaaucca

SEQ ID NO: 99936 - RNA, 20 nt, Artificial Sequence
  MKO10099936_B_Mtor
  gRNA
aaguguccccugccaucgcc

SEQ ID NO: 99937 - RNA, 20 nt, Artificial Sequence
  MKO10099937_B_Mtpap
  gRNA
uguccagauacuuggcuaga

SEQ ID NO: 99938 - RNA, 20 nt, Artificial Sequence
  MKO10099938_B_Mtpap
  gRNA
gugaucugacugcuaacaau

SEQ ID NO: 99939 - RNA, 20 nt, Artificial Sequence
  MKO10099939_B_Mtpap
  gRNA
ggcuccucagugaacacauu

SEQ ID NO: 99940 - RNA, 20 nt, Artificial Sequence
  MKO10099940_B_Mtpn
  gRNA
caaucugcagcauaaugaag

SEQ ID NO: 99941 - RNA, 20 nt, Artificial Sequence
  MKO10099941_B_Mtpn
  gRNA
cuucauuaugcugcagauug

SEQ ID NO: 99942 - RNA, 20 nt, Artificial Sequence
  MKO10099942_B_Mtpn
  gRNA
cgugaaauugcuucugucaa

SEQ ID NO: 99943 - RNA, 20 nt, Artificial Sequence
  MKO10099943_B_Mtrf1l
  gRNA
aucgauacuaaaagagcgag

SEQ ID NO: 99944 - RNA, 20 nt, Artificial Sequence
  MKO10099944_B_Mtrf1l
  gRNA
uauccgaacagcacugucug

SEQ ID NO: 99945 - RNA, 20 nt, Artificial Sequence
  MKO10099945_B_Mtrf1l
  gRNA
aguacgcugcauuuaaaaga

SEQ ID NO: 99946 - RNA, 20 nt, Artificial Sequence
  MKO10099946_B_Mtrf1
  gRNA
auaugcuuaccauaaucggc

SEQ ID NO: 99947 - RNA, 20 nt, Artificial Sequence
  MKO10099947_B_Mtrf1
  gRNA
uuuggagcguuuagugccua

SEQ ID NO: 99948 - RNA, 20 nt, Artificial Sequence
  MKO10099948_B_Mtrf1
  gRNA
auaccucacuauacagucug

SEQ ID NO: 99949 - RNA, 20 nt, Artificial Sequence
  MKO10099949_B_Mtrr
  gRNA
ugacuccucgcuugugcacu

SEQ ID NO: 99950 - RNA, 20 nt, Artificial Sequence
  MKO10099950_B_Mtrr
  gRNA
ggggaccgagugcacaagcg

SEQ ID NO: 99951 - RNA, 20 nt, Artificial Sequence
  MKO10099951_B_Mtrr
  gRNA
ggugaugguuguaucuacca

SEQ ID NO: 99952 - RNA, 20 nt, Artificial Sequence
  MKO10099952_B_Mtr
  gRNA
uuacugauguuccuauaauc

SEQ ID NO: 99953 - RNA, 20 nt, Artificial Sequence
  MKO10099953_B_Mtr
  gRNA
cugcagagcacuuguucauc

SEQ ID NO: 99954 - RNA, 20 nt, Artificial Sequence
  MKO10099954_B_Mtr
  gRNA
caggccaagggacugcugga

SEQ ID NO: 99955 - RNA, 20 nt, Artificial Sequence
  MKO10099955_B_Mtss1l
  gRNA
cuuggugaacugccgcagcu

SEQ ID NO: 99956 - RNA, 20 nt, Artificial Sequence
  MKO10099956_B_Mtss1l
  gRNA
ggaguugaaguccucccaga

SEQ ID NO: 99957 - RNA, 20 nt, Artificial Sequence
  MKO10099957_B_Mtss1l
  gRNA
uggccaugucagcuacuuuc

SEQ ID NO: 99958 - RNA, 20 nt, Artificial Sequence
  MKO10099958_B_Mtss1
  gRNA
ccuaggggagcuauccaguu

SEQ ID NO: 99959 - RNA, 20 nt, Artificial Sequence
  MKO10099959_B_Mtss1
  gRNA
uugcgugguccuuguccagc

SEQ ID NO: 99960 - RNA, 20 nt, Artificial Sequence
  MKO10099960_B_Mtss1
  gRNA
uuuaugaagucuucccaaac

SEQ ID NO: 99961 - RNA, 20 nt, Artificial Sequence
  MKO10099961_B_Muup
  gRNA
agcuguuaacguugaaaaug

SEQ ID NO: 99962 - RNA, 20 nt, Artificial Sequence
  MKO10099962_B_Muup
  gRNA
aggaaaaccgcaagacagcg

SEQ ID NO: 99963 - RNA, 20 nt, Artificial Sequence
  MKO10099963_B_Muup
  gRNA
cuguuccagguagauaucuc

SEQ ID NO: 99964 - RNA, 20 nt, Artificial Sequence
  MKO10099964_B_Mturn
  gRNA
gcacguguggagcgagagcg

SEQ ID NO: 99965 - RNA, 20 nt, Artificial Sequence
  MKO10099965_B_Mturn
  gRNA
uucacuuacggacacuuaaa

SEQ ID NO: 99966 - RNA, 20 nt, Artificial Sequence
  MKO10099966_B_Mturn
  gRNA
ugcugacugacccccauuug

SEQ ID NO: 99967 - RNA, 20 nt, Artificial Sequence
  MKO10099967_B_Mtus1
  gRNA
agcuucaaucucaagcuuag

SEQ ID NO: 99968 - RNA, 20 nt, Artificial Sequence
  MKO10099968_B_Mtus1
  gRNA
cucaagaacuugucagccuc

SEQ ID NO: 99969 - RNA, 20 nt, Artificial Sequence
  MKO10099969_B_Mtus1
  gRNA
ggcugacaaguucuugagag

SEQ ID NO: 99970 - RNA, 20 nt, Artificial Sequence
  MKO10099970_B_Mtus2
  gRNA
gccaccaaaccucacucgcc

SEQ ID NO: 99971 - RNA, 20 nt, Artificial Sequence
  MKO10099971_B_Mtus2
  gRNA
ccaaugcaacaacaccacgc

SEQ ID NO: 99972 - RNA, 20 nt, Artificial Sequence
  MKO10099972_B_Mtus2
  gRNA
ccgcuguuucgucucccaag

SEQ ID NO: 99973 - RNA, 20 nt, Artificial Sequence
  MKO10099973_B_Mtx1
  gRNA
caccuaccucuuuacgaaga

SEQ ID NO: 99974 - RNA, 20 nt, Artificial Sequence
  MKO10099974_B_Mtx1
  gRNA
gcuguagccgcuccauguac

SEQ ID NO: 99975 - RNA, 20 nt, Artificial Sequence
  MKO10099975_B_Mtx1
  gRNA
cagaccuauaccagauuuac

SEQ ID NO: 99976 - RNA, 20 nt, Artificial Sequence
  MKO10099976_B_Mtx2
  gRNA
aguccaauuuguuaaagcca

SEQ ID NO: 99977 - RNA, 20 nt, Artificial Sequence
  MKO10099977_B_Mtx2
  gRNA
ugcagcaucucuugcugugc

SEQ ID NO: 99978 - RNA, 20 nt, Artificial Sequence
  MKO10099978_B_Mtx2
  gRNA
uuaccuuggcuuuaacaaau

SEQ ID NO: 99979 - RNA, 20 nt, Artificial Sequence
  MKO10099979_B_Mtx3
  gRNA
uguaccucuugacccucucc

SEQ ID NO: 99980 - RNA, 20 nt, Artificial Sequence
  MKO10099980_B_Mtx3
  gRNA
ucaauauuauagauaacacc

SEQ ID NO: 99981 - RNA, 20 nt, Artificial Sequence
  MKO10099981_B_Mtx3
  gRNA
cugucuucaguugucaaaau

SEQ ID NO: 99982 - RNA, 20 nt, Artificial Sequence
  MKO10099982_B_Muc13
  gRNA
acacucaugcuaaugucccc

SEQ ID NO: 99983 - RNA, 20 nt, Artificial Sequence
  MKO10099983_B_Muc13
  gRNA
agcucuuccaccgugccuag

SEQ ID NO: 99984 - RNA, 20 nt, Artificial Sequence
  MKO10099984_B_Muc13
  gRNA
acauuuaauaagacugacua

SEQ ID NO: 99985 - RNA, 20 nt, Artificial Sequence
  MKO10099985_B_Muc15
  gRNA
aguggagguauagcauccau

SEQ ID NO: 99986 - RNA, 20 nt, Artificial Sequence
  MKO10099986_B_Muc15
  gRNA
gcuucacugcuuagccuugu

SEQ ID NO: 99987 - RNA, 20 nt, Artificial Sequence
  MKO10099987_B_Muc15
  gRNA
gaaccuuaugaugucaauuu

SEQ ID NO: 99988 - RNA, 20 nt, Artificial Sequence
  MKO10099988_B_Muc19
  gRNA
aaguaaauuaccugaaguac

SEQ ID NO: 99989 - RNA, 20 nt, Artificial Sequence
  MKO10099989_B_Muc19
  gRNA
ugaaucaucuuauugcugaa

SEQ ID NO: 99990 - RNA, 20 nt, Artificial Sequence
  MKO10099990_B_Muc19
  gRNA
gaagaaucuugucucuaaag

SEQ ID NO: 99991 - RNA, 20 nt, Artificial Sequence
  MKO10099991_B_Muc1
  gRNA
ugugaccaggucaggcuccg

SEQ ID NO: 99992 - RNA, 20 nt, Artificial Sequence
  MKO10099992_B_Muc1
  gRNA
aggcuggggcauugcccugc

SEQ ID NO: 99993 - RNA, 20 nt, Artificial Sequence
  MKO10099993_B_Muc1
  gRNA
uaucgucuauuuccuugccc

SEQ ID NO: 99994 - RNA, 20 nt, Artificial Sequence
  MKO10099994_B_Muc20
  gRNA
ccuccuuguacggcugaccg

SEQ ID NO: 99995 - RNA, 20 nt, Artificial Sequence
  MKO10099995_B_Muc20
  gRNA
caggcacgaugggcucuguc

SEQ ID NO: 99996 - RNA, 20 nt, Artificial Sequence
  MKO10099996_B_Muc20
  gRNA
acauguggacaaguggcaug

SEQ ID NO: 99997 - RNA, 20 nt, Artificial Sequence
  MKO10099997_B_Muc2
  gRNA
ccucgcccaagccccgcuuc

SEQ ID NO: 99998 - RNA, 20 nt, Artificial Sequence
  MKO10099998_B_Muc2
  gRNA
guggcucacguguucagagc

SEQ ID NO: 99999 - RNA, 20 nt, Artificial Sequence
  MKO10099999_B_Muc2
  gRNA
uccgguucuuguacugccuc

SEQ ID NO: 100000 - RNA, 20 nt, Artificial Sequence
  MKO10100000_B_Muc4
  gRNA
aacacacagcacgucuacuc

SEQ ID NO: 100001 - RNA, 20 nt, Artificial Sequence
  MKO10100001_B_Muc4
  gRNA
ugguugggcuggggcuagua

SEQ ID NO: 100002 - RNA, 20 nt, Artificial Sequence
  MKO10100002_B_Muc4
  gRNA
cccugaucugguaaaagaga

SEQ ID NO: 100003 - RNA, 20 nt, Artificial Sequence
  MKO10100003_B_Muc5ac
  gRNA
gcugcucuucguguggaacg

SEQ ID NO: 100004 - RNA, 20 nt, Artificial Sequence
  MKO10100004_B_Muc5ac
  gRNA
cagcugcccuuuagccaguc

SEQ ID NO: 100005 - RNA, 20 nt, Artificial Sequence
  MKO10100005_B_Muc5ac
  gRNA
gaacaucagagcgguguuca

SEQ ID NO: 100006 - RNA, 20 nt, Artificial Sequence
  MKO10100006_B_Muc5b
  gRNA
aagcugcccuacagucgugc

SEQ ID NO: 100007 - RNA, 20 nt, Artificial Sequence
  MKO10100007_B_Muc5b
  gRNA
acugucuucccuagcaugag

SEQ ID NO: 100008 - RNA, 20 nt, Artificial Sequence
  MKO10100008_B_Muc5b
  gRNA
ucagaacaucuagaacucac

SEQ ID NO: 100009 - RNA, 20 nt, Artificial Sequence
  MKO10100009_B_Muc6
  gRNA
agcugcacgcucuggccgua

SEQ ID NO: 100010 - RNA, 20 nt, Artificial Sequence
  MKO10100010_B_Muc6
  gRNA
auuauacucauggccgucaa

SEQ ID NO: 100011 - RNA, 20 nt, Artificial Sequence
  MKO10100011_B_Muc6
  gRNA
ggugguacuguuggucuccg

SEQ ID NO: 100012 - RNA, 20 nt, Artificial Sequence
  MKO10100012_B_Mucl1
  gRNA
uguucuagucugugucagaa

SEQ ID NO: 100013 - RNA, 20 nt, Artificial Sequence
  MKO10100013_B_Mucl1
  gRNA
guuucaguacuguuugucuc

SEQ ID NO: 100014 - RNA, 20 nt, Artificial Sequence
  MKO10100014_B_Mucl1
  gRNA
acaaacaguacugaaacuuc

SEQ ID NO: 100015 - RNA, 20 nt, Artificial Sequence
  MKO10100015_B_Mug1
  gRNA
aaaauccuccucaucagaag

SEQ ID NO: 100016 - RNA, 20 nt, Artificial Sequence
  MKO10100016_B_Mug1
  gRNA
ucuuuguccaguuaaauuuc

SEQ ID NO: 100017 - RNA, 20 nt, Artificial Sequence
  MKO10100017_B_Mug1
  gRNA
uagacucuccucuucugaug

SEQ ID NO: 100018 - RNA, 20 nt, Artificial Sequence
  MKO10100018_B_Mug2
  gRNA
uacacucaacucuccugaug

SEQ ID NO: 100019 - RNA, 20 nt, Artificial Sequence
  MKO10100019_B_Mug2
  gRNA
aaagacucaccaacucauuc

SEQ ID NO: 100020 - RNA, 20 nt, Artificial Sequence
  MKO10100020_B_Mug2
  gRNA
ucucucuccaguuaaauuuc

SEQ ID NO: 100021 - RNA, 20 nt, Artificial Sequence
  MKO10100021_B_Mul1
  gRNA
ccuugaguuccugcgcgacc

SEQ ID NO: 100022 - RNA, 20 nt, Artificial Sequence
  MKO10100022_B_Mul1
  gRNA
gucgcuucaggagcauaaga

SEQ ID NO: 100023 - RNA, 20 nt, Artificial Sequence
  MKO10100023_B_Mul1
  gRNA
gcuccugaagcgacagccgc

SEQ ID NO: 100024 - RNA, 20 nt, Artificial Sequence
  MKO10100024_B_Mum1l1
  gRNA
uggcauuaauggccuucguu

SEQ ID NO: 100025 - RNA, 20 nt, Artificial Sequence
  MKO10100025_B_Mum1l1
  gRNA
gugcaccugcaacuuaucau

SEQ ID NO: 100026 - RNA, 20 nt, Artificial Sequence
  MKO10100026_B_Mum1l1
  gRNA
caaaugcacgugucucauaa

SEQ ID NO: 100027 - RNA, 20 nt, Artificial Sequence
  MKO10100027_B_Mum1
  gRNA
cucucucaccgugauacaga

SEQ ID NO: 100028 - RNA, 20 nt, Artificial Sequence
  MKO10100028_B_Mum1
  gRNA
uguucagauacucucgcuga

SEQ ID NO: 100029 - RNA, 20 nt, Artificial Sequence
  MKO10100029_B_Mum1
  gRNA
ucucaaugugcgacuucugc

SEQ ID NO: 100030 - RNA, 20 nt, Artificial Sequence
  MKO10100030_B_Mup10
  gRNA
gucagcaaccauagauaauu

SEQ ID NO: 100031 - RNA, 20 nt, Artificial Sequence
  MKO10100031_B_Mup10
  gRNA
agacuaugauaacuuucuua

SEQ ID NO: 100032 - RNA, 20 nt, Artificial Sequence
  MKO10100032_B_Mup10
  gRNA
uaccauagagccccaucagc

SEQ ID NO: 100033 - RNA, 20 nt, Artificial Sequence
  MKO10100033_B_Mup11
  gRNA
gguugcugacaaaacagaaa

SEQ ID NO: 100034 - RNA, 20 nt, Artificial Sequence
  MKO10100034_B_Mup11
  gRNA
agacuaugauaacuuucuua

SEQ ID NO: 100035 - RNA, 20 nt, Artificial Sequence
  MKO10100035_B_Mup11
  gRNA
uaccauagagccccaucagc

SEQ ID NO: 100036 - RNA, 20 nt, Artificial Sequence
  MKO10100036_B_Mup12
  gRNA
gguugcugacaaaacagaaa

SEQ ID NO: 100037 - RNA, 20 nt, Artificial Sequence
  MKO10100037_B_Mup12
  gRNA
agacuaugauaacuuucuua

SEQ ID NO: 100038 - RNA, 20 nt, Artificial Sequence
  MKO10100038_B_Mup12
  gRNA
uaccauagagccccaucagc

SEQ ID NO: 100039 - RNA, 20 nt, Artificial Sequence
  MKO10100039_B_Mup13
  gRNA
gguugcugacaaaacagaaa

SEQ ID NO: 100040 - RNA, 20 nt, Artificial Sequence
  MKO10100040_B_Mup13
  gRNA
agacuaugauaacuuucuua

SEQ ID NO: 100041 - RNA, 20 nt, Artificial Sequence
  MKO10100041_B_Mup13
  gRNA
uaccauagagccccaucagc

SEQ ID NO: 100042 - RNA, 20 nt, Artificial Sequence
  MKO10100042_B_Mup14
  gRNA
gguugcugacaaaacagaaa

SEQ ID NO: 100043 - RNA, 20 nt, Artificial Sequence
  MKO10100043_B_Mup14
  gRNA
agacuaugauaacuuucuua

SEQ ID NO: 100044 - RNA, 20 nt, Artificial Sequence
  MKO10100044_B_Mup14
  gRNA
uaccauagagccccaucagc

SEQ ID NO: 100045 - RNA, 20 nt, Artificial Sequence
  MKO10100045_B_Mup15
  gRNA
gguugcugacaaaacagaaa

SEQ ID NO: 100046 - RNA, 20 nt, Artificial Sequence
  MKO10100046_B_Mup15
  gRNA
agacuaugauaacuuucuua

SEQ ID NO: 100047 - RNA, 20 nt, Artificial Sequence
  MKO10100047_B_Mup15
  gRNA
uaccauagagccccaucagc

SEQ ID NO: 100048 - RNA, 20 nt, Artificial Sequence
  MKO10100048_B_Mup16
  gRNA
gucagcaaccauagauaauu

SEQ ID NO: 100049 - RNA, 20 nt, Artificial Sequence
  MKO10100049_B_Mup16
  gRNA
agacuaugauaacuuucuua

SEQ ID NO: 100050 - RNA, 20 nt, Artificial Sequence
  MKO10100050_B_Mup16
  gRNA
uaccauagagccccaucagc

SEQ ID NO: 100051 - RNA, 20 nt, Artificial Sequence
  MKO10100051_B_Mup17
  gRNA
agagugcuccgaauuaucua

SEQ ID NO: 100052 - RNA, 20 nt, Artificial Sequence
  MKO10100052_B_Mup17
  gRNA
gucagcaaccauagauaauu

SEQ ID NO: 100053 - RNA, 20 nt, Artificial Sequence
  MKO10100053_B_Mup17
  gRNA
agacuaugauaacuuucuua

SEQ ID NO: 100054 - RNA, 20 nt, Artificial Sequence
  MKO10100054_B_Mup19
  gRNA
gucagcaaccauagauaauu

SEQ ID NO: 100055 - RNA, 20 nt, Artificial Sequence
  MKO10100055_B_Mup19
  gRNA
agacuaugauaacuuucuua

SEQ ID NO: 100056 - RNA, 20 nt, Artificial Sequence
  MKO10100056_B_Mup19
  gRNA
uaccauagagccccaucagc

SEQ ID NO: 100057 - RNA, 20 nt, Artificial Sequence
  MKO10100057_B_Mup1
  gRNA
aguauggaauuuaagaacua

SEQ ID NO: 100058 - RNA, 20 nt, Artificial Sequence
  MKO10100058_B_Mup1
  gRNA
cagaagagaugaagagugcu

SEQ ID NO: 100059 - RNA, 20 nt, Artificial Sequence
  MKO10100059_B_Mup1
  gRNA
gguugcugacaaaacagaaa

SEQ ID NO: 100060 - RNA, 20 nt, Artificial Sequence
  MKO10100060_B_Mup20
  gRNA
gcugacaaaacagaaaaggc

SEQ ID NO: 100061 - RNA, 20 nt, Artificial Sequence
  MKO10100061_B_Mup20
  gRNA
gauucaucucauuaacaaaa

SEQ ID NO: 100062 - RNA, 20 nt, Artificial Sequence
  MKO10100062_B_Mup20
  gRNA
agauuugaguucagacauca

SEQ ID NO: 100063 - RNA, 20 nt, Artificial Sequence
  MKO10100063_B_Mup21
  gRNA
uucaccaaucaaagucauuu

SEQ ID NO: 100064 - RNA, 20 nt, Artificial Sequence
  MKO10100064_B_Mup21
  gRNA
aaaauggaauuuaaagacua

SEQ ID NO: 100065 - RNA, 20 nt, Artificial Sequence
  MKO10100065_B_Mup21
  gRNA
uaucucauuaacgaaaaaga

SEQ ID NO: 100066 - RNA, 20 nt, Artificial Sequence
  MKO10100066_B_Mup2
  gRNA
gguugcugacaaaacagaaa

SEQ ID NO: 100067 - RNA, 20 nt, Artificial Sequence
  MKO10100067_B_Mup2
  gRNA
agacuaugauaacuuucuua

SEQ ID NO: 100068 - RNA, 20 nt, Artificial Sequence
  MKO10100068_B_Mup2
  gRNA
uaccauagagccccaucagc

SEQ ID NO: 100069 - RNA, 20 nt, Artificial Sequence
  MKO10100069_B_Mup3
  gRNA
uaaauggaauuuaaagacua

SEQ ID NO: 100070 - RNA, 20 nt, Artificial Sequence
  MKO10100070_B_Mup3
  gRNA
augacuuacugacauugguu

SEQ ID NO: 100071 - RNA, 20 nt, Artificial Sequence
  MKO10100071_B_Mup3
  gRNA
agauuugaguuuagacauca

SEQ ID NO: 100072 - RNA, 20 nt, Artificial Sequence
  MKO10100072_B_Mup4
  gRNA
agauuugaauucagacauca

SEQ ID NO: 100073 - RNA, 20 nt, Artificial Sequence
  MKO10100073_B_Mup4
  gRNA
uauuacagauuaauggggaa

SEQ ID NO: 100074 - RNA, 20 nt, Artificial Sequence
  MKO10100074_B_Mup4
  gRNA
uaccauagagcuccaucagc

SEQ ID NO: 100075 - RNA, 20 nt, Artificial Sequence
  MKO10100075_B_Mup5
  gRNA
ugaggaaaacuuccagcuga

SEQ ID NO: 100076 - RNA, 20 nt, Artificial Sequence
  MKO10100076_B_Mup5
  gRNA
gcugacaaaacagaaaaagc

SEQ ID NO: 100077 - RNA, 20 nt, Artificial Sequence
  MKO10100077_B_Mup5
  gRNA
aaaguuugcaaaacuaugug

SEQ ID NO: 100078 - RNA, 20 nt, Artificial Sequence
  MKO10100078_B_Mup6
  gRNA
aguauggaauuuaaaaccua

SEQ ID NO: 100079 - RNA, 20 nt, Artificial Sequence
  MKO10100079_B_Mup6
  gRNA
agagcaaagauagaagaaca

SEQ ID NO: 100080 - RNA, 20 nt, Artificial Sequence
  MKO10100080_B_Mup6
  gRNA
gucagcaaccaaaaauauuu

SEQ ID NO: 100081 - RNA, 20 nt, Artificial Sequence
  MKO10100081_B_Mup7
  gRNA
gucagcaaccauagauaauu

SEQ ID NO: 100082 - RNA, 20 nt, Artificial Sequence
  MKO10100082_B_Mup7
  gRNA
agacuaugauaacuuucuua

SEQ ID NO: 100083 - RNA, 20 nt, Artificial Sequence
  MKO10100083_B_Mup7
  gRNA
uaccauagagccccaucagc

SEQ ID NO: 100084 - RNA, 20 nt, Artificial Sequence
  MKO10100084_B_Mup8
  gRNA
gguugcugacaaaacagaaa

SEQ ID NO: 100085 - RNA, 20 nt, Artificial Sequence
  MKO10100085_B_Mup8
  gRNA
agacuaugauaacuuucuua

SEQ ID NO: 100086 - RNA, 20 nt, Artificial Sequence
  MKO10100086_B_Mup8
  gRNA
uaccauagagccccaucagc

SEQ ID NO: 100087 - RNA, 20 nt, Artificial Sequence
  MKO10100087_B_Mup9
  gRNA
gucagcaaccauagauaauu

SEQ ID NO: 100088 - RNA, 20 nt, Artificial Sequence
  MKO10100088_B_Mup9
  gRNA
agacuaugauaacuuucuua

SEQ ID NO: 100089 - RNA, 20 nt, Artificial Sequence
  MKO10100089_B_Mup9
  gRNA
uaccauagagccccaucagc

SEQ ID NO: 100090 - RNA, 20 nt, Artificial Sequence
  MKO10100090_B_Murc
  gRNA
ggaggguacaguccccaaga

SEQ ID NO: 100091 - RNA, 20 nt, Artificial Sequence
  MKO10100091_B_Murc
  gRNA
uuccagugccgcucccucaa

SEQ ID NO: 100092 - RNA, 20 nt, Artificial Sequence
  MKO10100092_B_Murc
  gRNA
ugggggaucgaagacuucuu

SEQ ID NO: 100093 - RNA, 20 nt, Artificial Sequence
  MKO10100093_B_Mus81
  gRNA
uugcucagguggcccuuugc

SEQ ID NO: 100094 - RNA, 20 nt, Artificial Sequence
  MKO10100094_B_Mus81
  gRNA
gcucccuguagaguugcagc

SEQ ID NO: 100095 - RNA, 20 nt, Artificial Sequence
  MKO10100095_B_Mus81
  gRNA
ucacuggcauggaagagucc

SEQ ID NO: 100096 - RNA, 20 nt, Artificial Sequence
  MKO10100096_B_Musk
  gRNA
agucgcuacuucuucaacca

SEQ ID NO: 100097 - RNA, 20 nt, Artificial Sequence
  MKO10100097_B_Musk
  gRNA
agcgacuuucaugugugccg

SEQ ID NO: 100098 - RNA, 20 nt, Artificial Sequence
  MKO10100098_B_Musk
  gRNA
acugucuuccacgcucagaa

SEQ ID NO: 100099 - RNA, 20 nt, Artificial Sequence
  MKO10100099_B_Mustn1
  gRNA
gucucagccaaacacgcucu

SEQ ID NO: 100100 - RNA, 20 nt, Artificial Sequence
  MKO10100100_B_Mustn1
  gRNA
caucaagucuaagacauacc

SEQ ID NO: 100101 - RNA, 20 nt, Artificial Sequence
  MKO10100101_B_Mustn1
  gRNA
cgguugcggcugaauacaga

SEQ ID NO: 100102 - RNA, 20 nt, Artificial Sequence
  MKO10100102_B_Muuyh
  gRNA
auaucaucucuucagcgacg

SEQ ID NO: 100103 - RNA, 20 nt, Artificial Sequence
  MKO10100103_B_Muuyh
  gRNA
ucggacaggagggccuaugc

SEQ ID NO: 100104 - RNA, 20 nt, Artificial Sequence
  MKO10100104_B_Muuyh
  gRNA
aguauaauagucgaucacug

SEQ ID NO: 100105 - RNA, 20 nt, Artificial Sequence
  MKO10100105_B_Muu
  gRNA
aucauguacgacccucccca

SEQ ID NO: 100106 - RNA, 20 nt, Artificial Sequence
  MKO10100106_B_Muu
  gRNA
cuauaccaucgcagaugggu

SEQ ID NO: 100107 - RNA, 20 nt, Artificial Sequence
  MKO10100107_B_Muu
  gRNA
uccaacaucuccacgaacuc

SEQ ID NO: 100108 - RNA, 20 nt, Artificial Sequence
  MKO10100108_B_Mvb12a
  gRNA
ccgggaugcccagcgugcuc

SEQ ID NO: 100109 - RNA, 20 nt, Artificial Sequence
  MKO10100109_B_Mvb12a
  gRNA
gggagaggccucgcaugucc

SEQ ID NO: 100110 - RNA, 20 nt, Artificial Sequence
  MKO10100110_B_Mvb12a
  gRNA
aguggacaugcagaucguga

SEQ ID NO: 100111 - RNA, 20 nt, Artificial Sequence
  MKO10100111_B_Mvb12b
  gRNA
caugaagcucaucgauguca

SEQ ID NO: 100112 - RNA, 20 nt, Artificial Sequence
  MKO10100112_B_Mvb12b
  gRNA
ccgccccaguacacguuuau

SEQ ID NO: 100113 - RNA, 20 nt, Artificial Sequence
  MKO10100113_B_Mvb12b
  gRNA
cuuaccacgucguagccugu

SEQ ID NO: 100114 - RNA, 20 nt, Artificial Sequence
  MKO10100114_B_Mvd
  gRNA
gaauggucgcgaggaggacg

SEQ ID NO: 100115 - RNA, 20 nt, Artificial Sequence
  MKO10100115_B_Mvd
  gRNA
ccacgugcaccuuauagcug

SEQ ID NO: 100116 - RNA, 20 nt, Artificial Sequence
  MKO10100116_B_Mvd
  gRNA
gcuccgaauccuuauccuug

SEQ ID NO: 100117 - RNA, 20 nt, Artificial Sequence
  MKO10100117_B_Mvk
  gRNA
acggagaccccguccuugag

SEQ ID NO: 100118 - RNA, 20 nt, Artificial Sequence
  MKO10100118_B_Mvk
  gRNA
guguggucggaacuuccccc

SEQ ID NO: 100119 - RNA, 20 nt, Artificial Sequence
  MKO10100119_B_Mvk
  gRNA
uggacaaugccgucagcacc

SEQ ID NO: 100120 - RNA, 20 nt, Artificial Sequence
  MKO10100120_B_Mvp
  gRNA
cccgcaaggaaugcuuugac

SEQ ID NO: 100121 - RNA, 20 nt, Artificial Sequence
  MKO10100121_B_Mvp
  gRNA
gcugcaaucagguuaggccg

SEQ ID NO: 100122 - RNA, 20 nt, Artificial Sequence
  MKO10100122_B_Mvp
  gRNA
ggaagucguggagaucauuc

SEQ ID NO: 100123 - RNA, 20 nt, Artificial Sequence
  MKO10100123_B_Mx1
  gRNA
uugaccucaucgacacccug

SEQ ID NO: 100124 - RNA, 20 nt, Artificial Sequence
  MKO10100124_B_Mx1
  gRNA
aggauacugacccuuguuaa

SEQ ID NO: 100125 - RNA, 20 nt, Artificial Sequence
  MKO10100125_B_Mx1
  gRNA
ugagcuuaucacugaucccc

SEQ ID NO: 100126 - RNA, 20 nt, Artificial Sequence
  MKO10100126_B_Mx2
  gRNA
agaauacugacccuuguuga

SEQ ID NO: 100127 - RNA, 20 nt, Artificial Sequence
  MKO10100127_B_Mx2
  gRNA
ucuguacuagaagcacuguc

SEQ ID NO: 100128 - RNA, 20 nt, Artificial Sequence
  MKO10100128_B_Mx2
  gRNA
uggccuaggagagaaagacc

SEQ ID NO: 100129 - RNA, 20 nt, Artificial Sequence
  MKO10100129_B_Mxd1
  gRNA
accuaccuuuauaugcaauu

SEQ ID NO: 100130 - RNA, 20 nt, Artificial Sequence
  MKO10100130_B_Mxd1
  gRNA
acagagaugccuucaaacgg

SEQ ID NO: 100131 - RNA, 20 nt, Artificial Sequence
  MKO10100131_B_Mxd1
  gRNA
cuccaugcugccauacagca

SEQ ID NO: 100132 - RNA, 20 nt, Artificial Sequence
  MKO10100132_B_Mxd3
  gRNA
cgcccacuguucagcgcgcc

SEQ ID NO: 100133 - RNA, 20 nt, Artificial Sequence
  MKO10100133_B_Mxd3
  gRNA
cuacacuaagccuccugcgc

SEQ ID NO: 100134 - RNA, 20 nt, Artificial Sequence
  MKO10100134_B_Mxd3
  gRNA
gucugagucugagcgcucag

SEQ ID NO: 100135 - RNA, 20 nt, Artificial Sequence
  MKO10100135_B_Mxd4
  gRNA
ucgcuuccuaaagagacguu

SEQ ID NO: 100136 - RNA, 20 nt, Artificial Sequence
  MKO10100136_B_Mxd4
  gRNA
gcugcuccaaacgucucuuu

SEQ ID NO: 100137 - RNA, 20 nt, Artificial Sequence
  MKO10100137_B_Mxd4
  gRNA
gcgugcuaagaugcacauca

SEQ ID NO: 100138 - RNA, 20 nt, Artificial Sequence
  MKO10100138_B_Mxi1
  gRNA
uacagcacucgaagccccca

SEQ ID NO: 100139 - RNA, 20 nt, Artificial Sequence
  MKO10100139_B_Mxi1
  gRNA
cuugaaaguucugaucccgc

SEQ ID NO: 100140 - RNA, 20 nt, Artificial Sequence
  MKO10100140_B_Mxi1
  gRNA
cuuucaagcguucuaaacac

SEQ ID NO: 100141 - RNA, 20 nt, Artificial Sequence
  MKO10100141_B_Mxra7
  gRNA
gccacgcgcucggacuggcu

SEQ ID NO: 100142 - RNA, 20 nt, Artificial Sequence
  MKO10100142_B_Mxra7
  gRNA
gccacccacugaagaaccug

SEQ ID NO: 100143 - RNA, 20 nt, Artificial Sequence
  MKO10100143_B_Mxra7
  gRNA
ugcucaccgucuucuuccuc

SEQ ID NO: 100144 - RNA, 20 nt, Artificial Sequence
  MKO10100144_B_Mxra8
  gRNA
gcugcaugaucgccagcgcg

SEQ ID NO: 100145 - RNA, 20 nt, Artificial Sequence
  MKO10100145_B_Mxra8
  gRNA
ugugcgccucgagguuacag

SEQ ID NO: 100146 - RNA, 20 nt, Artificial Sequence
  MKO10100146_B_Mxra8
  gRNA
cugccaccucgaugagagcc

SEQ ID NO: 100147 - RNA, 20 nt, Artificial Sequence
  MKO10100147_B_Myadml2
  gRNA
uccagguagccccaugucaa

SEQ ID NO: 100148 - RNA, 20 nt, Artificial Sequence
  MKO10100148_B_Myadml2
  gRNA
acacagcagggucgccaaca

SEQ ID NO: 100149 - RNA, 20 nt, Artificial Sequence
  MKO10100149_B_Myadml2
  gRNA
uacagcccgaaugcugcagc

SEQ ID NO: 100150 - RNA, 20 nt, Artificial Sequence
  MKO10100150_B_Myadm
  gRNA
gcagaagagggccgcguagc

SEQ ID NO: 100151 - RNA, 20 nt, Artificial Sequence
  MKO10100151_B_Myadm
  gRNA
ggauggacaccgccagucgu

SEQ ID NO: 100152 - RNA, 20 nt, Artificial Sequence
  MKO10100152_B_Myadm
  gRNA
acacguugguacaauccccc

SEQ ID NO: 100153 - RNA, 20 nt, Artificial Sequence
  MKO10100153_B_Mybbp1a
  gRNA
gcaccuuguucauggcuugu

SEQ ID NO: 100154 - RNA, 20 nt, Artificial Sequence
  MKO10100154_B_Mybbp1a
  gRNA
aagcucuuaccuucacuagg

SEQ ID NO: 100155 - RNA, 20 nt, Artificial Sequence
  MKO10100155_B_Mybbp1a
  gRNA
ccaacaccccaaccacuuac

SEQ ID NO: 100156 - RNA, 20 nt, Artificial Sequence
  MKO10100156_B_Mybl1
  gRNA
uaugaaguaccucaacaaaa

SEQ ID NO: 100157 - RNA, 20 nt, Artificial Sequence
  MKO10100157_B_Mybl1
  gRNA
acuucuucacuucaggguuc

SEQ ID NO: 100158 - RNA, 20 nt, Artificial Sequence
  MKO10100158_B_Mybl1
  gRNA
aaucaugaucagcauauuga

SEQ ID NO: 100159 - RNA, 20 nt, Artificial Sequence
  MKO10100159_B_Mybl2
  gRNA
uuugaaucccgaccuuguua

SEQ ID NO: 100160 - RNA, 20 nt, Artificial Sequence
  MKO10100160_B_Mybl2
  gRNA
ccauggucccuuaacaaggu

SEQ ID NO: 100161 - RNA, 20 nt, Artificial Sequence
  MKO10100161_B_Mybl2
  gRNA
ggcaguuuggacagcaagac

SEQ ID NO: 100162 - RNA, 20 nt, Artificial Sequence
  MKO10100162_B_Mybpc1
  gRNA
cuuaacuuaccuuccggggg

SEQ ID NO: 100163 - RNA, 20 nt, Artificial Sequence
  MKO10100163_B_Mybpc1
  gRNA
uccugcucuuccccgccagc

SEQ ID NO: 100164 - RNA, 20 nt, Artificial Sequence
  MKO10100164_B_Mybpc1
  gRNA
guucuuacccucuuucuuag

SEQ ID NO: 100165 - RNA, 20 nt, Artificial Sequence
  MKO10100165_B_Mybpc2
  gRNA
cuauguuacagcggccaaaa

SEQ ID NO: 100166 - RNA, 20 nt, Artificial Sequence
  MKO10100166_B_Mybpc2
  gRNA
aaagccggacucugugucag

SEQ ID NO: 100167 - RNA, 20 nt, Artificial Sequence
  MKO10100167_B_Mybpc2
  gRNA
caggcaagccgaccaucaag

SEQ ID NO: 100168 - RNA, 20 nt, Artificial Sequence
  MKO10100168_B_Mybpc3
  gRNA
cagccuccugaaaccgccug

SEQ ID NO: 100169 - RNA, 20 nt, Artificial Sequence
  MKO10100169_B_Mybpc3
  gRNA
cauugucuucucagcccgag

SEQ ID NO: 100170 - RNA, 20 nt, Artificial Sequence
  MKO10100170_B_Mybpc3
  gRNA
acggucaccucaccauccug

SEQ ID NO: 100171 - RNA, 20 nt, Artificial Sequence
  MKO10100171_B_Mybphl
  gRNA
uuggggcgccaaugcuacuc

SEQ ID NO: 100172 - RNA, 20 nt, Artificial Sequence
  MKO10100172_B_Mybphl
  gRNA
uaagucugcuucagggcccg

SEQ ID NO: 100173 - RNA, 20 nt, Artificial Sequence
  MKO10100173_B_Mybphl
  gRNA
agcauccugagucagugcgu

SEQ ID NO: 100174 - RNA, 20 nt, Artificial Sequence
  MKO10100174_B_Mybph
  gRNA
ugugaauccccggcccguga

SEQ ID NO: 100175 - RNA, 20 nt, Artificial Sequence
  MKO10100175_B_Mybph
  gRNA
cgcugcgcacauuaacucuc

SEQ ID NO: 100176 - RNA, 20 nt, Artificial Sequence
  MKO10100176_B_Mybph
  gRNA
uguguuggaguucugucgag

SEQ ID NO: 100177 - RNA, 20 nt, Artificial Sequence
  MKO10100177_B_Myb
  gRNA
gcagcagcccaucguaguca

SEQ ID NO: 100178 - RNA, 20 nt, Artificial Sequence
  MKO10100178_B_Myb
  gRNA
augugugaccaugacuacga

SEQ ID NO: 100179 - RNA, 20 nt, Artificial Sequence
  MKO10100179_B_Myb
  gRNA
aacagaacggaacagacgac

SEQ ID NO: 100180 - RNA, 20 nt, Artificial Sequence
  MKO10100180_B_Mycbp2
  gRNA
auaaucuuaccuaggacuuc

SEQ ID NO: 100181 - RNA, 20 nt, Artificial Sequence
  MKO10100181_B_Mycbp2
  gRNA
ggccuugaagcacauucagc

SEQ ID NO: 100182 - RNA, 20 nt, Artificial Sequence
  MKO10100182_B_Mycbp2
  gRNA
ucaacauuuacuguaacgug

SEQ ID NO: 100183 - RNA, 20 nt, Artificial Sequence
  MKO10100183_B_Mycbpap
  gRNA
ugccuugcggaagaagcaac

SEQ ID NO: 100184 - RNA, 20 nt, Artificial Sequence
  MKO10100184_B_Mycbpap
  gRNA
agaugccgccaccaagccuc

SEQ ID NO: 100185 - RNA, 20 nt, Artificial Sequence
  MKO10100185_B_Mycbpap
  gRNA
ucuugccuuggccauuaaaa

SEQ ID NO: 100186 - RNA, 20 nt, Artificial Sequence
  MKO10100186_B_Mycbp
  gRNA
agagcugcuucgccuagaau

SEQ ID NO: 100187 - RNA, 20 nt, Artificial Sequence
  MKO10100187_B_Mycbp
  gRNA
aaaaggauacuccagagcac

SEQ ID NO: 100188 - RNA, 20 nt, Artificial Sequence
  MKO10100188_B_Mycbp
  gRNA
agagaagcccaccagugcuc

SEQ ID NO: 100189 - RNA, 20 nt, Artificial Sequence
  MKO10100189_B_Mycl
  gRNA
ggaggaaugaccuccgcucc

SEQ ID NO: 100190 - RNA, 20 nt, Artificial Sequence
  MKO10100190_B_Mycl
  gRNA
gcggcuucuccgcccgagaa

SEQ ID NO: 100191 - RNA, 20 nt, Artificial Sequence
  MKO10100191_B_Mycl
  gRNA
agaggauuucuaccgcucca

SEQ ID NO: 100192 - RNA, 20 nt, Artificial Sequence
  MKO10100192_B_Mycn
  gRNA
gaggaggaugcguucggucu

SEQ ID NO: 100193 - RNA, 20 nt, Artificial Sequence
  MKO10100193_B_Mycn
  gRNA
gcgucccaagaccuccgcuc

SEQ ID NO: 100194 - RNA, 20 nt, Artificial Sequence
  MKO10100194_B_Mycn
  gRNA
ggccgaccuguggggcaacc

SEQ ID NO: 100195 - RNA, 20 nt, Artificial Sequence
  MKO10100195_B_Mycs
  gRNA
uagcccucaaaugcgucuuc

SEQ ID NO: 100196 - RNA, 20 nt, Artificial Sequence
  MKO10100196_B_Mycs
  gRNA
uaagcgcuacgaccucauuc

SEQ ID NO: 100197 - RNA, 20 nt, Artificial Sequence
  MKO10100197_B_Mycs
  gRNA
ggccaaggugccugcgccga

SEQ ID NO: 100198 - RNA, 20 nt, Artificial Sequence
  MKO10100198_B_Mycu1
  gRNA
ccaaggacucccuaagcucg

SEQ ID NO: 100199 - RNA, 20 nt, Artificial Sequence
  MKO10100199_B_Mycu1
  gRNA
gauugcaagcccaaucgcca

SEQ ID NO: 100200 - RNA, 20 nt, Artificial Sequence
  MKO10100200_B_Mycu1
  gRNA
uucgccguucauagccacug

SEQ ID NO: 100201 - RNA, 20 nt, Artificial Sequence
  MKO10100201_B_Myc
  gRNA
ugagcccgacuccgaccucu

SEQ ID NO: 100202 - RNA, 20 nt, Artificial Sequence
  MKO10100202_B_Myc
  gRNA
ccgggguuuccaacgcccaa

SEQ ID NO: 100203 - RNA, 20 nt, Artificial Sequence
  MKO10100203_B_Myc
  gRNA
uuugaaggcuggauuuccuu

SEQ ID NO: 100204 - RNA, 20 nt, Artificial Sequence
  MKO10100204_B_Myd88
  gRNA
cgcauauagugaugaaccgc

SEQ ID NO: 100205 - RNA, 20 nt, Artificial Sequence
  MKO10100205_B_Myd88
  gRNA
ugacgauuaucuacagagca

SEQ ID NO: 100206 - RNA, 20 nt, Artificial Sequence
  MKO10100206_B_Myd88
  gRNA
ccuuaccuagggggucauca

SEQ ID NO: 100207 - RNA, 20 nt, Artificial Sequence
  MKO10100207_B_Myef2
  gRNA
ggagaaugaugagucaguga

SEQ ID NO: 100208 - RNA, 20 nt, Artificial Sequence
  MKO10100208_B_Myef2
  gRNA
aguuggugagguuacauacg

SEQ ID NO: 100209 - RNA, 20 nt, Artificial Sequence
  MKO10100209_B_Myef2
  gRNA
aggaugcggaaggaaaauca

SEQ ID NO: 100210 - RNA, 20 nt, Artificial Sequence
  MKO10100210_B_Myeov2
  gRNA
auuaaaaaagucugcaugaa

SEQ ID NO: 100211 - RNA, 20 nt, Artificial Sequence
  MKO10100211_B_Myeov2
  gRNA
ggacaucaucaucaucaaaa

SEQ ID NO: 100212 - RNA, 20 nt, Artificial Sequence
  MKO10100212_B_Myeov2
  gRNA
gaugaugaugauguccagug

SEQ ID NO: 100213 - RNA, 20 nt, Artificial Sequence
  MKO10100213_B_Myf5
  gRNA
uaauacgugauagauaaguc

SEQ ID NO: 100214 - RNA, 20 nt, Artificial Sequence
  MKO10100214_B_Myf5
  gRNA
cagacagggcuguuacauuc

SEQ ID NO: 100215 - RNA, 20 nt, Artificial Sequence
  MKO10100215_B_Myf5
  gRNA
uacuguccugauguaucaaa

SEQ ID NO: 100216 - RNA, 20 nt, Artificial Sequence
  MKO10100216_B_Myf6
  gRNA
ggaacgcaaacuccccagcg

SEQ ID NO: 100217 - RNA, 20 nt, Artificial Sequence
  MKO10100217_B_Myf6
  gRNA
cuggaaugauccgaaacacu

SEQ ID NO: 100218 - RNA, 20 nt, Artificial Sequence
  MKO10100218_B_Myf6
  gRNA
ucagcgccuuucuuccaucg

SEQ ID NO: 100219 - RNA, 20 nt, Artificial Sequence
  MKO10100219_B_Myg1
  gRNA
gccagcccgggccuuaguag

SEQ ID NO: 100220 - RNA, 20 nt, Artificial Sequence
  MKO10100220_B_Myg1
  gRNA
agcaauggaccugguacaag

SEQ ID NO: 100221 - RNA, 20 nt, Artificial Sequence
  MKO10100221_B_Myg1
  gRNA
guuggcuucgugugacaucg

SEQ ID NO: 100222 - RNA, 20 nt, Artificial Sequence
  MKO10100222_B_Myh10
  gRNA
gcuuacagaugcaugcuuca

SEQ ID NO: 100223 - RNA, 20 nt, Artificial Sequence
  MKO10100223_B_Myh10
  gRNA
uuuacaagcaaauccaauuc

SEQ ID NO: 100224 - RNA, 20 nt, Artificial Sequence
  MKO10100224_B_Myh10
  gRNA
cacagucuucgcauuuccaa

SEQ ID NO: 100225 - RNA, 20 nt, Artificial Sequence
  MKO10100225_B_Myh11
  gRNA
ugugguggcauccucccaca

SEQ ID NO: 100226 - RNA, 20 nt, Artificial Sequence
  MKO10100226_B_Myh11
  gRNA
gccuacagaagcaugcuaca

SEQ ID NO: 100227 - RNA, 20 nt, Artificial Sequence
  MKO10100227_B_Myh11
  gRNA
augucuuucagaggugaguc

SEQ ID NO: 100228 - RNA, 20 nt, Artificial Sequence
  MKO10100228_B_Myh13
  gRNA
uccucgaucuugucaaacuu

SEQ ID NO: 100229 - RNA, 20 nt, Artificial Sequence
  MKO10100229_B_Myh13
  gRNA
cugcaauuguugcaaaguau

SEQ ID NO: 100230 - RNA, 20 nt, Artificial Sequence
  MKO10100230_B_Myh13
  gRNA
acuuaccuguuagcaugaac

SEQ ID NO: 100231 - RNA, 20 nt, Artificial Sequence
  MKO10100231_B_Myh14
  gRNA
guguggcuuacagggacacc

SEQ ID NO: 100232 - RNA, 20 nt, Artificial Sequence
  MKO10100232_B_Myh14
  gRNA
gacaacucacgugcagagaa

SEQ ID NO: 100233 - RNA, 20 nt, Artificial Sequence
  MKO10100233_B_Myh14
  gRNA
cauccaguaccuggcccaug

SEQ ID NO: 100234 - RNA, 20 nt, Artificial Sequence
  MKO10100234_B_Myh15
  gRNA
augaccucuuucugauacac

SEQ ID NO: 100235 - RNA, 20 nt, Artificial Sequence
  MKO10100235_B_Myh15
  gRNA
ucuaucauuucaagcucuuc

SEQ ID NO: 100236 - RNA, 20 nt, Artificial Sequence
  MKO10100236_B_Myh15
  gRNA
ugggaagaaugcuuauauug

SEQ ID NO: 100237 - RNA, 20 nt, Artificial Sequence
  MKO10100237_B_Myh1
  gRNA
uguaacaguaaaagaugauc

SEQ ID NO: 100238 - RNA, 20 nt, Artificial Sequence
  MKO10100238_B_Myh1
  gRNA
cauacgugaucaaaauagac

SEQ ID NO: 100239 - RNA, 20 nt, Artificial Sequence
  MKO10100239_B_Myh1
  gRNA
cgaacucacguagaucaucc

SEQ ID NO: 100240 - RNA, 20 nt, Artificial Sequence
  MKO10100240_B_Myh2
  gRNA
cagccauuuguaaggguuga

SEQ ID NO: 100241 - RNA, 20 nt, Artificial Sequence
  MKO10100241_B_Myh2
  gRNA
gucacucacguagaucaucc

SEQ ID NO: 100242 - RNA, 20 nt, Artificial Sequence
  MKO10100242_B_Myh2
  gRNA
cugcaauuguugcaaaguac

SEQ ID NO: 100243 - RNA, 20 nt, Artificial Sequence
  MKO10100243_B_Myh3
  gRNA
gacccuggugguuaagccag

SEQ ID NO: 100244 - RNA, 20 nt, Artificial Sequence
  MKO10100244_B_Myh3
  gRNA
cuaccgaggcaaaaaacgcc

SEQ ID NO: 100245 - RNA, 20 nt, Artificial Sequence
  MKO10100245_B_Myh3
  gRNA
ggaagacggugaacaccaag

SEQ ID NO: 100246 - RNA, 20 nt, Artificial Sequence
  MKO10100246_B_Myh4
  gRNA
gaagacuugaucauccuuga

SEQ ID NO: 100247 - RNA, 20 nt, Artificial Sequence
  MKO10100247_B_Myh4
  gRNA
aagaaggaggaggcgacuuc

SEQ ID NO: 100248 - RNA, 20 nt, Artificial Sequence
  MKO10100248_B_Myh4
  gRNA
acucacccgucagcaugaac

SEQ ID NO: 100249 - RNA, 20 nt, Artificial Sequence
  MKO10100249_B_Myh6
  gRNA
gcuugcucacgugaugagga

SEQ ID NO: 100250 - RNA, 20 nt, Artificial Sequence
  MKO10100250_B_Myh6
  gRNA
cuucuugcuacgguccccua

SEQ ID NO: 100251 - RNA, 20 nt, Artificial Sequence
  MKO10100251_B_Myh6
  gRNA
ccgccuaccggggcaagaag

SEQ ID NO: 100252 - RNA, 20 nt, Artificial Sequence
  MKO10100252_B_Myh7b
  gRNA
acugcggagcaugucguugu

SEQ ID NO: 100253 - RNA, 20 nt, Artificial Sequence
  MKO10100253_B_Myh7b
  gRNA
ccccacucacgugaucagca

SEQ ID NO: 100254 - RNA, 20 nt, Artificial Sequence
  MKO10100254_B_Myh7b
  gRNA
ugaugagcaggaugccuaug

SEQ ID NO: 100255 - RNA, 20 nt, Artificial Sequence
  MKO10100255_B_Myh7
  gRNA
ugucacaacagcggagaauc

SEQ ID NO: 100256 - RNA, 20 nt, Artificial Sequence
  MKO10100256_B_Myh7
  gRNA
guuccagacggugacuguga

SEQ ID NO: 100257 - RNA, 20 nt, Artificial Sequence
  MKO10100257_B_Myh7
  gRNA
gacgcagaagaggcccgagu

SEQ ID NO: 100258 - RNA, 20 nt, Artificial Sequence
  MKO10100258_B_Myh8
  gRNA
gacaagaagaaggaggaguc

SEQ ID NO: 100259 - RNA, 20 nt, Artificial Sequence
  MKO10100259_B_Myh8
  gRNA
acucacccgucagcaugaac

SEQ ID NO: 100260 - RNA, 20 nt, Artificial Sequence
  MKO10100260_B_Myh8
  gRNA
ucaccgucaaccccuacaag

SEQ ID NO: 100261 - RNA, 20 nt, Artificial Sequence
  MKO10100261_B_Myh9
  gRNA
acaggccaacccuauccuag

SEQ ID NO: 100262 - RNA, 20 nt, Artificial Sequence
  MKO10100262_B_Myh9
  gRNA
aaacacuuacgugcacagga

SEQ ID NO: 100263 - RNA, 20 nt, Artificial Sequence
  MKO10100263_B_Myh9
  gRNA
uuuccaaaggccucuaggau

SEQ ID NO: 100264 - RNA, 20 nt, Artificial Sequence
  MKO10100264_B_Myl10
  gRNA
ccaucaggccuucacuauca

SEQ ID NO: 100265 - RNA, 20 nt, Artificial Sequence
  MKO10100265_B_Myl10
  gRNA
uuacucacccagugcagcaa

SEQ ID NO: 100266 - RNA, 20 nt, Artificial Sequence
  MKO10100266_B_Myl10
  gRNA
ugaccgguucagugaggagg

SEQ ID NO: 100267 - RNA, 20 nt, Artificial Sequence
  MKO10100267_B_Myl12a
  gRNA
uugacgccagcaugucgugc

SEQ ID NO: 100268 - RNA, 20 nt, Artificial Sequence
  MKO10100268_B_Myl12a
  gRNA
uaaaggcuucuuugaacucc

SEQ ID NO: 100269 - RNA, 20 nt, Artificial Sequence
  MKO10100269_B_Myl12a
  gRNA
ugucuuucgcgccgugcuuc

SEQ ID NO: 100270 - RNA, 20 nt, Artificial Sequence
  MKO10100270_B_Myl12b
  gRNA
ccgcuucacagacgaggaag

SEQ ID NO: 100271 - RNA, 20 nt, Artificial Sequence
  MKO10100271_B_Myl12b
  gRNA
guuugaccagucccagaucc

SEQ ID NO: 100272 - RNA, 20 nt, Artificial Sequence
  MKO10100272_B_Myl12b
  gRNA
gagacgccagcaugucgugc

SEQ ID NO: 100273 - RNA, 20 nt, Artificial Sequence
  MKO10100273_B_Myl1
  gRNA
caccaaucccaccaaugcag

SEQ ID NO: 100274 - RNA, 20 nt, Artificial Sequence
  MKO10100274_B_Myl1
  gRNA
gcaagcuaucuccaacaaca

SEQ ID NO: 100275 - RNA, 20 nt, Artificial Sequence
  MKO10100275_B_Myl1
  gRNA
uucauaguugaugcagccau

SEQ ID NO: 100276 - RNA, 20 nt, Artificial Sequence
  MKO10100276_B_Myl2
  gRNA
acggugaaguuaauuggacc

SEQ ID NO: 100277 - RNA, 20 nt, Artificial Sequence
  MKO10100277_B_Myl2
  gRNA
caccuugaaugcguugagaa

SEQ ID NO: 100278 - RNA, 20 nt, Artificial Sequence
  MKO10100278_B_Myl2
  gRNA
ucaucgacaagaaugaccua

SEQ ID NO: 100279 - RNA, 20 nt, Artificial Sequence
  MKO10100279_B_Myl3
  gRNA
ugcagagcuccgacacgugc

SEQ ID NO: 100280 - RNA, 20 nt, Artificial Sequence
  MKO10100280_B_Myl3
  gRNA
ugcucaccuucaaucuguuc

SEQ ID NO: 100281 - RNA, 20 nt, Artificial Sequence
  MKO10100281_B_Myl3
  gRNA
gaaacugauggcuggucaag

SEQ ID NO: 100282 - RNA, 20 nt, Artificial Sequence
  MKO10100282_B_Myl4
  gRNA
gggcaccuaugaggacuucg

SEQ ID NO: 100283 - RNA, 20 nt, Artificial Sequence
  MKO10100283_B_Myl4
  gRNA
cggacguacccaggguagca

SEQ ID NO: 100284 - RNA, 20 nt, Artificial Sequence
  MKO10100284_B_Myl4
  gRNA
gagguggagcagcuguuguc

SEQ ID NO: 100285 - RNA, 20 nt, Artificial Sequence
  MKO10100285_B_Myl6b
  gRNA
ccuacagaucgaguuuaaca

SEQ ID NO: 100286 - RNA, 20 nt, Artificial Sequence
  MKO10100286_B_Myl6b
  gRNA
guggccaagaaccgggacca

SEQ ID NO: 100287 - RNA, 20 nt, Artificial Sequence
  MKO10100287_B_Myl6b
  gRNA
gagguagagacuguucuggc

SEQ ID NO: 100288 - RNA, 20 nt, Artificial Sequence
  MKO10100288_B_Myl6
  gRNA
ugaauccucagaauucaagg

SEQ ID NO: 100289 - RNA, 20 nt, Artificial Sequence
  MKO10100289_B_Myl6
  gRNA
gaaaugcucaccaucacucu

SEQ ID NO: 100290 - RNA, 20 nt, Artificial Sequence
  MKO10100290_B_Myl6
  gRNA
aaugguugcaucaacuauga

SEQ ID NO: 100291 - RNA, 20 nt, Artificial Sequence
  MKO10100291_B_Myl7
  gRNA
ccuagggaggguaaguguuc

SEQ ID NO: 100292 - RNA, 20 nt, Artificial Sequence
  MKO10100292_B_Myl7
  gRNA
caucugcaaaucagaccuga

SEQ ID NO: 100293 - RNA, 20 nt, Artificial Sequence
  MKO10100293_B_Myl7
  gRNA
ccacucaccgagcugggaau

SEQ ID NO: 100294 - RNA, 20 nt, Artificial Sequence
  MKO10100294_B_Myl9
  gRNA
gaaccccacagacgaguauc

SEQ ID NO: 100295 - RNA, 20 nt, Artificial Sequence
  MKO10100295_B_Myl9
  gRNA
augauugaucagaaccgaga

SEQ ID NO: 100296 - RNA, 20 nt, Artificial Sequence
  MKO10100296_B_Myl9
  gRNA
gaugucgagcaagagagcca

SEQ ID NO: 100297 - RNA, 20 nt, Artificial Sequence
  MKO10100297_B_Mylip
  gRNA
caccgcccaauacagcuaug

SEQ ID NO: 100298 - RNA, 20 nt, Artificial Sequence
  MKO10100298_B_Mylip
  gRNA
aucaucgagguugauuauuu

SEQ ID NO: 100299 - RNA, 20 nt, Artificial Sequence
  MKO10100299_B_Mylip
  gRNA
agcuguauugggcgguguuc

SEQ ID NO: 100300 - RNA, 20 nt, Artificial Sequence
  MKO10100300_B_Mylk2
  gRNA
cagacaccccuguaaagacg

SEQ ID NO: 100301 - RNA, 20 nt, Artificial Sequence
  MKO10100301_B_Mylk2
  gRNA
cccgggucuuucuucgcguu

SEQ ID NO: 100302 - RNA, 20 nt, Artificial Sequence
  MKO10100302_B_Mylk2
  gRNA
gccuguggcucucuccgugc

SEQ ID NO: 100303 - RNA, 20 nt, Artificial Sequence
  MKO10100303_B_Mylk3
  gRNA
ccguguagccugcugagauc

SEQ ID NO: 100304 - RNA, 20 nt, Artificial Sequence
  MKO10100304_B_Mylk3
  gRNA
ggacauaccugugcgaacag

SEQ ID NO: 100305 - RNA, 20 nt, Artificial Sequence
  MKO10100305_B_Mylk3
  gRNA
acccuccuaagacuucaugu

SEQ ID NO: 100306 - RNA, 20 nt, Artificial Sequence
  MKO10100306_B_Mylk4
  gRNA
uucuuuggcagggggcguuu

SEQ ID NO: 100307 - RNA, 20 nt, Artificial Sequence
  MKO10100307_B_Mylk4
  gRNA
ccaaccgugcacuagaugaa

SEQ ID NO: 100308 - RNA, 20 nt, Artificial Sequence
  MKO10100308_B_Mylk4
  gRNA
gcuaaaaucauuaagacuag

SEQ ID NO: 100309 - RNA, 20 nt, Artificial Sequence
  MKO10100309_B_Mylk
  gRNA
ggagccacagccaaguucga

SEQ ID NO: 100310 - RNA, 20 nt, Artificial Sequence
  MKO10100310_B_Mylk
  gRNA
uggcuccuucuuugacgcag

SEQ ID NO: 100311 - RNA, 20 nt, Artificial Sequence
  MKO10100311_B_Mylk
  gRNA
aggccggccagugaucuugc

SEQ ID NO: 100312 - RNA, 20 nt, Artificial Sequence
  MKO10100312_B_Mylpf
  gRNA
gcuccagugaucacauccuc

SEQ ID NO: 100313 - RNA, 20 nt, Artificial Sequence
  MKO10100313_B_Mylpf
  gRNA
gucaaacauggagaagacgu

SEQ ID NO: 100314 - RNA, 20 nt, Artificial Sequence
  MKO10100314_B_Mylpf
  gRNA
guuugaccagacucagaucc

SEQ ID NO: 100315 - RNA, 20 nt, Artificial Sequence
  MKO10100315_B_Mynn
  gRNA
ccuuaugugugcgacaccug

SEQ ID NO: 100316 - RNA, 20 nt, Artificial Sequence
  MKO10100316_B_Mynn
  gRNA
aaacacuuucgaucccauac

SEQ ID NO: 100317 - RNA, 20 nt, Artificial Sequence
  MKO10100317_B_Mynn
  gRNA
auuugcucagaaaugccagc

SEQ ID NO: 100318 - RNA, 20 nt, Artificial Sequence
  MKO10100318_B_Myo10
  gRNA
agcuaugcacccccugcacg

SEQ ID NO: 100319 - RNA, 20 nt, Artificial Sequence
  MKO10100319_B_Myo10
  gRNA
cguggacgacauggcuuccc

SEQ ID NO: 100320 - RNA, 20 nt, Artificial Sequence
  MKO10100320_B_Myo10
  gRNA
gaccacgacgccuucugcac

SEQ ID NO: 100321 - RNA, 20 nt, Artificial Sequence
  MKO10100321_B_Myo15
  gRNA
cauagaaggcagguugcgua

SEQ ID NO: 100322 - RNA, 20 nt, Artificial Sequence
  MKO10100322_B_Myo15
  gRNA
caccagaauacugccaauau

SEQ ID NO: 100323 - RNA, 20 nt, Artificial Sequence
  MKO10100323_B_Myo15
  gRNA
uacgcaaccugccuucuaug

SEQ ID NO: 100324 - RNA, 20 nt, Artificial Sequence
  MKO10100324_B_Myo16
  gRNA
uugcagaaguccucauugac

SEQ ID NO: 100325 - RNA, 20 nt, Artificial Sequence
  MKO10100325_B_Myo16
  gRNA
gcuaccuuucucauccagau

SEQ ID NO: 100326 - RNA, 20 nt, Artificial Sequence
  MKO10100326_B_Myo16
  gRNA
cauugacgccccugucaaug

SEQ ID NO: 100327 - RNA, 20 nt, Artificial Sequence
  MKO10100327_B_Myo18a
  gRNA
gcucagccuacccgagggga

SEQ ID NO: 100328 - RNA, 20 nt, Artificial Sequence
  MKO10100328_B_Myo18a
  gRNA
agagcagauugccgcugaag

SEQ ID NO: 100329 - RNA, 20 nt, Artificial Sequence
  MKO10100329_B_Myo18a
  gRNA
gacuaccagcuuucagcauc

SEQ ID NO: 100330 - RNA, 20 nt, Artificial Sequence
  MKO10100330_B_Myo18b
  gRNA
ggcucugcaucgaugcagac

SEQ ID NO: 100331 - RNA, 20 nt, Artificial Sequence
  MKO10100331_B_Myo18b
  gRNA
aacggugcuuaaaccagaug

SEQ ID NO: 100332 - RNA, 20 nt, Artificial Sequence
  MKO10100332_B_Myo18b
  gRNA
gggccauucaccucuacuuc

SEQ ID NO: 100333 - RNA, 20 nt, Artificial Sequence
  MKO10100333_B_Myo19
  gRNA
caaggugaaucccgugacac

SEQ ID NO: 100334 - RNA, 20 nt, Artificial Sequence
  MKO10100334_B_Myo19
  gRNA
gacauauucuauaccaaugc

SEQ ID NO: 100335 - RNA, 20 nt, Artificial Sequence
  MKO10100335_B_Myo19
  gRNA
acucucuccacugaccacga

SEQ ID NO: 100336 - RNA, 20 nt, Artificial Sequence
  MKO10100336_B_Myo1a
  gRNA
cuccacucucgccugugaug

SEQ ID NO: 100337 - RNA, 20 nt, Artificial Sequence
  MKO10100337_B_Myo1a
  gRNA
uacgagcagcuucccaucua

SEQ ID NO: 100338 - RNA, 20 nt, Artificial Sequence
  MKO10100338_B_Myo1a
  gRNA
ggucccgauccuucagugac

SEQ ID NO: 100339 - RNA, 20 nt, Artificial Sequence
  MKO10100339_B_Myo1b
  gRNA
uuauaucuguuaaccccuac

SEQ ID NO: 100340 - RNA, 20 nt, Artificial Sequence
  MKO10100340_B_Myo1b
  gRNA
gaucaaugcauucucauuac

SEQ ID NO: 100341 - RNA, 20 nt, Artificial Sequence
  MKO10100341_B_Myo1b
  gRNA
uccuaugucgcugccgugug

SEQ ID NO: 100342 - RNA, 20 nt, Artificial Sequence
  MKO10100342_B_Myo1c
  gRNA
cagcauauggaacgcuaccg

SEQ ID NO: 100343 - RNA, 20 nt, Artificial Sequence
  MKO10100343_B_Myo1c
  gRNA
ccgccggagguucucaauga

SEQ ID NO: 100344 - RNA, 20 nt, Artificial Sequence
  MKO10100344_B_Myo1c
  gRNA
guuaucguugcggagagucu

SEQ ID NO: 100345 - RNA, 20 nt, Artificial Sequence
  MKO10100345_B_Myo1d
  gRNA
gacaccuguauuaugauauc

SEQ ID NO: 100346 - RNA, 20 nt, Artificial Sequence
  MKO10100346_B_Myo1d
  gRNA
auacugcaugauguacuuac

SEQ ID NO: 100347 - RNA, 20 nt, Artificial Sequence
  MKO10100347_B_Myo1d
  gRNA
cgugugauugugcagcagcc

SEQ ID NO: 100348 - RNA, 20 nt, Artificial Sequence
  MKO10100348_B_Myo1e
  gRNA
gacauagcucauaauguacu

SEQ ID NO: 100349 - RNA, 20 nt, Artificial Sequence
  MKO10100349_B_Myo1e
  gRNA
aaagaagucgaaauguacca

SEQ ID NO: 100350 - RNA, 20 nt, Artificial Sequence
  MKO10100350_B_Myo1e
  gRNA
uucuguacauacuaucagca

SEQ ID NO: 100351 - RNA, 20 nt, Artificial Sequence
  MKO10100351_B_Myo1f
  gRNA
guugcucacaauggcguccu

SEQ ID NO: 100352 - RNA, 20 nt, Artificial Sequence
  MKO10100352_B_Myo1f
  gRNA
cacagucgaucagcauauuc

SEQ ID NO: 100353 - RNA, 20 nt, Artificial Sequence
  MKO10100353_B_Myo1f
  gRNA
ccgagaaauugaccucuauc

SEQ ID NO: 100354 - RNA, 20 nt, Artificial Sequence
  MKO10100354_B_Myo1g
  gRNA
aguugugguugcgauuggug

SEQ ID NO: 100355 - RNA, 20 nt, Artificial Sequence
  MKO10100355_B_Myo1g
  gRNA
aggguucucaagcaacaugu

SEQ ID NO: 100356 - RNA, 20 nt, Artificial Sequence
  MKO10100356_B_Myo1g
  gRNA
guacugcaugaugugcuugc

SEQ ID NO: 100357 - RNA, 20 nt, Artificial Sequence
  MKO10100357_B_Myo1h
  gRNA
ggacauacaguucgacuucc

SEQ ID NO: 100358 - RNA, 20 nt, Artificial Sequence
  MKO10100358_B_Myo1h
  gRNA
aagucaccgcgaaguacugg

SEQ ID NO: 100359 - RNA, 20 nt, Artificial Sequence
  MKO10100359_B_Myo1h
  gRNA
guugucguuacggagggucu

SEQ ID NO: 100360 - RNA, 20 nt, Artificial Sequence
  MKO10100360_B_Myo3a
  gRNA
cuacgggauuuacuuuaaaa

SEQ ID NO: 100361 - RNA, 20 nt, Artificial Sequence
  MKO10100361_B_Myo3a
  gRNA
aacauccuguugacuacuga

SEQ ID NO: 100362 - RNA, 20 nt, Artificial Sequence
  MKO10100362_B_Myo3a
  gRNA
ggaguaaaacuaguagauuu

SEQ ID NO: 100363 - RNA, 20 nt, Artificial Sequence
  MKO10100363_B_Myo3b
  gRNA
gccuucugaggugcggcaag

SEQ ID NO: 100364 - RNA, 20 nt, Artificial Sequence
  MKO10100364_B_Myo3b
  gRNA
cccauaaaacuuuacaacgu

SEQ ID NO: 100365 - RNA, 20 nt, Artificial Sequence
  MKO10100365_B_Myo3b
  gRNA
gccucuugccgcaccucaga

SEQ ID NO: 100366 - RNA, 20 nt, Artificial Sequence
  MKO10100366_B_Myo5a
  gRNA
aaacuuauuuauacguauug

SEQ ID NO: 100367 - RNA, 20 nt, Artificial Sequence
  MKO10100367_B_Myo5a
  gRNA
uaugagcagcugccuauuua

SEQ ID NO: 100368 - RNA, 20 nt, Artificial Sequence
  MKO10100368_B_Myo5a
  gRNA
agugcuccugcuucaccucg

SEQ ID NO: 100369 - RNA, 20 nt, Artificial Sequence
  MKO10100369_B_Myo5b
  gRNA
uaggaccuucucuucaaugu

SEQ ID NO: 100370 - RNA, 20 nt, Artificial Sequence
  MKO10100370_B_Myo5b
  gRNA
cgcaguucugcauaacuuaa

SEQ ID NO: 100371 - RNA, 20 nt, Artificial Sequence
  MKO10100371_B_Myo5b
  gRNA
cggaauccagauaucuuagu

SEQ ID NO: 100372 - RNA, 20 nt, Artificial Sequence
  MKO10100372_B_Myo5c
  gRNA
augauggcauccccguauau

SEQ ID NO: 100373 - RNA, 20 nt, Artificial Sequence
  MKO10100373_B_Myo5c
  gRNA
gcuucggaacccugacaucc

SEQ ID NO: 100374 - RNA, 20 nt, Artificial Sequence
  MKO10100374_B_Myo5c
  gRNA
aaucgcaaaggacuacagag

SEQ ID NO: 100375 - RNA, 20 nt, Artificial Sequence
  MKO10100375_B_Myo6
  gRNA
uccuccacaaugucaaaguu

SEQ ID NO: 100376 - RNA, 20 nt, Artificial Sequence
  MKO10100376_B_Myo6
  gRNA
ccaccccaugucuuugccau

SEQ ID NO: 100377 - RNA, 20 nt, Artificial Sequence
  MKO10100377_B_Myo6
  gRNA
auucacugcaaucagaaugu

SEQ ID NO: 100378 - RNA, 20 nt, Artificial Sequence
  MKO10100378_B_Myo7a
  gRNA
gaugugcucuggcgaguaga

SEQ ID NO: 100379 - RNA, 20 nt, Artificial Sequence
  MKO10100379_B_Myo7a
  gRNA
cgagucgcagagcuucacca

SEQ ID NO: 100380 - RNA, 20 nt, Artificial Sequence
  MKO10100380_B_Myo7a
  gRNA
gcuggaggccaccccgaucc

SEQ ID NO: 100381 - RNA, 20 nt, Artificial Sequence
  MKO10100381_B_Myo7b
  gRNA
ggggaggcagcucgcccaug

SEQ ID NO: 100382 - RNA, 20 nt, Artificial Sequence
  MKO10100382_B_Myo7b
  gRNA
aaucuacuacagccgccaca

SEQ ID NO: 100383 - RNA, 20 nt, Artificial Sequence
  MKO10100383_B_Myo7b
  gRNA
ucacauagaucuugugcugc

SEQ ID NO: 100384 - RNA, 20 nt, Artificial Sequence
  MKO10100384_B_Myo9a
  gRNA
uuauugcuaugauucugagc

SEQ ID NO: 100385 - RNA, 20 nt, Artificial Sequence
  MKO10100385_B_Myo9a
  gRNA
uuuaucaagagcauaaugaa

SEQ ID NO: 100386 - RNA, 20 nt, Artificial Sequence
  MKO10100386_B_Myo9a
  gRNA
caaguacagugccuguuucu

SEQ ID NO: 100387 - RNA, 20 nt, Artificial Sequence
  MKO10100387_B_Myo9b
  gRNA
agacuauuucuaccucaacc

SEQ ID NO: 100388 - RNA, 20 nt, Artificial Sequence
  MKO10100388_B_Myo9b
  gRNA
ugucagugaggaggagcgcc

SEQ ID NO: 100389 - RNA, 20 nt, Artificial Sequence
  MKO10100389_B_Myo9b
  gRNA
cuuggaugaacuucccgaag

SEQ ID NO: 100390 - RNA, 20 nt, Artificial Sequence
  MKO10100390_B_Myocd
  gRNA
aacacucuuugcugauuaga

SEQ ID NO: 100391 - RNA, 20 nt, Artificial Sequence
  MKO10100391_B_Myocd
  gRNA
ccaugacccgagaaaacaau

SEQ ID NO: 100392 - RNA, 20 nt, Artificial Sequence
  MKO10100392_B_Myocd
  gRNA
gagacucaccaugacacucc

SEQ ID NO: 100393 - RNA, 20 nt, Artificial Sequence
  MKO10100393_B_Myoc
  gRNA
aaaauccaucuggccgaccc

SEQ ID NO: 100394 - RNA, 20 nt, Artificial Sequence
  MKO10100394_B_Myoc
  gRNA
caaucuccuucgagauaagu

SEQ ID NO: 100395 - RNA, 20 nt, Artificial Sequence
  MKO10100395_B_Myoc
  gRNA
uccugcuucccaaaucuuga

SEQ ID NO: 100396 - RNA, 20 nt, Artificial Sequence
  MKO10100396_B_Myod1
  gRNA
gcgcgccgccucacuguagu

SEQ ID NO: 100397 - RNA, 20 nt, Artificial Sequence
  MKO10100397_B_Myod1
  gRNA
agcggcccccggcggcagaa

SEQ ID NO: 100398 - RNA, 20 nt, Artificial Sequence
  MKO10100398_B_Myod1
  gRNA
cggcgucgggagacgggguc

SEQ ID NO: 100399 - RNA, 20 nt, Artificial Sequence
  MKO10100399_B_Myof
  gRNA
gaccucccugcuaaaugaaa

SEQ ID NO: 100400 - RNA, 20 nt, Artificial Sequence
  MKO10100400_B_Myof
  gRNA
auaaugaacucaacccuguc

SEQ ID NO: 100401 - RNA, 20 nt, Artificial Sequence
  MKO10100401_B_Myof
  gRNA
aaucuuugacaacaaucacc

SEQ ID NO: 100402 - RNA, 20 nt, Artificial Sequence
  MKO10100402_B_Myog
  gRNA
caccgugaugcuguccacga

SEQ ID NO: 100403 - RNA, 20 nt, Artificial Sequence
  MKO10100403_B_Myog
  gRNA
gauucacuuaccuccugggu

SEQ ID NO: 100404 - RNA, 20 nt, Artificial Sequence
  MKO10100404_B_Myog
  gRNA
gcugugggaguugcauucac

SEQ ID NO: 100405 - RNA, 20 nt, Artificial Sequence
  MKO10100405_B_Myom1
  gRNA
aguggcucauggucgugcga

SEQ ID NO: 100406 - RNA, 20 nt, Artificial Sequence
  MKO10100406_B_Myom1
  gRNA
aagcuugccaggcaacuacc

SEQ ID NO: 100407 - RNA, 20 nt, Artificial Sequence
  MKO10100407_B_Myom1
  gRNA
auagccguaaucauaugcag

SEQ ID NO: 100408 - RNA, 20 nt, Artificial Sequence
  MKO10100408_B_Myom2
  gRNA
cccauagguggaagacaauc

SEQ ID NO: 100409 - RNA, 20 nt, Artificial Sequence
  MKO10100409_B_Myom2
  gRNA
gcaaggauuccccacgccug

SEQ ID NO: 100410 - RNA, 20 nt, Artificial Sequence
  MKO10100410_B_Myom2
  gRNA
cuccguaccugcucucaauc

SEQ ID NO: 100411 - RNA, 20 nt, Artificial Sequence
  MKO10100411_B_Myom3
  gRNA
ugcugcgucagaggcgagac

SEQ ID NO: 100412 - RNA, 20 nt, Artificial Sequence
  MKO10100412_B_Myom3
  gRNA
acagguacaagaacgacauc

SEQ ID NO: 100413 - RNA, 20 nt, Artificial Sequence
  MKO10100413_B_Myom3
  gRNA
gguaggcuuuggcaaugacc

SEQ ID NO: 100414 - RNA, 20 nt, Artificial Sequence
  MKO10100414_B_Myot
  gRNA
agaagcguugauucaagauu

SEQ ID NO: 100415 - RNA, 20 nt, Artificial Sequence
  MKO10100415_B_Myot
  gRNA
aauguaccuguggugaaucu

SEQ ID NO: 100416 - RNA, 20 nt, Artificial Sequence
  MKO10100416_B_Myot
  gRNA
acgugcagccgugcuugcuc

SEQ ID NO: 100417 - RNA, 20 nt, Artificial Sequence
  MKO10100417_B_Myoz1
  gRNA
ggagcauguagacuacaacg

SEQ ID NO: 100418 - RNA, 20 nt, Artificial Sequence
  MKO10100418_B_Myoz1
  gRNA
uggcucugaccgucaucagc

SEQ ID NO: 100419 - RNA, 20 nt, Artificial Sequence
  MKO10100419_B_Myoz1
  gRNA
ucaaucgaaccccuauuccc

SEQ ID NO: 100420 - RNA, 20 nt, Artificial Sequence
  MKO10100420_B_Myoz2
  gRNA
aggcucaguugugaucacga

SEQ ID NO: 100421 - RNA, 20 nt, Artificial Sequence
  MKO10100421_B_Myoz2
  gRNA
gcaggcgauuggcagcgauc

SEQ ID NO: 100422 - RNA, 20 nt, Artificial Sequence
  MKO10100422_B_Myoz2
  gRNA
ucuugcagauguugacggca

SEQ ID NO: 100423 - RNA, 20 nt, Artificial Sequence
  MKO10100423_B_Myoz3
  gRNA
ugcugccacucgaguagucu

SEQ ID NO: 100424 - RNA, 20 nt, Artificial Sequence
  MKO10100424_B_Myoz3
  gRNA
accggagaaguucaaccaca

SEQ ID NO: 100425 - RNA, 20 nt, Artificial Sequence
  MKO10100425_B_Myoz3
  gRNA
cugucucuacgaaacaaccg

SEQ ID NO: 100426 - RNA, 20 nt, Artificial Sequence
  MKO10100426_B_Mypn
  gRNA
uuaguuaccuucguaaacac

SEQ ID NO: 100427 - RNA, 20 nt, Artificial Sequence
  MKO10100427_B_Mypn
  gRNA
ugcagcgccaguguuuacga

SEQ ID NO: 100428 - RNA, 20 nt, Artificial Sequence
  MKO10100428_B_Mypn
  gRNA
cagaguguccaccguccagc

SEQ ID NO: 100429 - RNA, 20 nt, Artificial Sequence
  MKO10100429_B_Mypop
  gRNA
ugccacuugggccagcgccg

SEQ ID NO: 100430 - RNA, 20 nt, Artificial Sequence
  MKO10100430_B_Mypop
  gRNA
guggucuccuccgcuucgcc

SEQ ID NO: 100431 - RNA, 20 nt, Artificial Sequence
  MKO10100431_B_Mypop
  gRNA
cucugcgcgccguagagcug

SEQ ID NO: 100432 - RNA, 20 nt, Artificial Sequence
  MKO10100432_B_Myrfl
  gRNA
cgugggucggaugcagagua

SEQ ID NO: 100433 - RNA, 20 nt, Artificial Sequence
  MKO10100433_B_Myrfl
  gRNA
aaagcacucgcagauacaag

SEQ ID NO: 100434 - RNA, 20 nt, Artificial Sequence
  MKO10100434_B_Myrfl
  gRNA
gcucacuuggucugaaguag

SEQ ID NO: 100435 - RNA, 20 nt, Artificial Sequence
  MKO10100435_B_Myrf
  gRNA
auacuggugucuauauugga

SEQ ID NO: 100436 - RNA, 20 nt, Artificial Sequence
  MKO10100436_B_Myrf
  gRNA
ccggccauucccggcuccag

SEQ ID NO: 100437 - RNA, 20 nt, Artificial Sequence
  MKO10100437_B_Myrf
  gRNA
cuuugccaauguacuccucc

SEQ ID NO: 100438 - RNA, 20 nt, Artificial Sequence
  MKO10100438_B_Myrip
  gRNA
aaaagccgcuucaagcgcuu

SEQ ID NO: 100439 - RNA, 20 nt, Artificial Sequence
  MKO10100439_B_Myrip
  gRNA
gguaccuaggaugucgaagc

SEQ ID NO: 100440 - RNA, 20 nt, Artificial Sequence
  MKO10100440_B_Myrip
  gRNA
guccuaccaggcugucccca

SEQ ID NO: 100441 - RNA, 20 nt, Artificial Sequence
  MKO10100441_B_Mysm1
  gRNA
uuaucuaauaaaucacuucc

SEQ ID NO: 100442 - RNA, 20 nt, Artificial Sequence
  MKO10100442_B_Mysm1
  gRNA
agcucuguucucaucacuga

SEQ ID NO: 100443 - RNA, 20 nt, Artificial Sequence
  MKO10100443_B_Mysm1
  gRNA
auaauaaaaaauacacaaac

SEQ ID NO: 100444 - RNA, 20 nt, Artificial Sequence
  MKO10100444_B_Myt1l
  gRNA
aggcuuaccucgaaccccuu

SEQ ID NO: 100445 - RNA, 20 nt, Artificial Sequence
  MKO10100445_B_Myt1l
  gRNA
ugaccacugccgucgcagcc

SEQ ID NO: 100446 - RNA, 20 nt, Artificial Sequence
  MKO10100446_B_Myt1l
  gRNA
cagccauacaagagcuguuc

SEQ ID NO: 100447 - RNA, 20 nt, Artificial Sequence
  MKO10100447_B_Myt1
  gRNA
auaguaccuucagcugucug

SEQ ID NO: 100448 - RNA, 20 nt, Artificial Sequence
  MKO10100448_B_Myt1
  gRNA
ucuggaugaggguuaccgca

SEQ ID NO: 100449 - RNA, 20 nt, Artificial Sequence
  MKO10100449_B_Myt1
  gRNA
gcacugaccucggagggucu

SEQ ID NO: 100450 - RNA, 20 nt, Artificial Sequence
  MKO10100450_B_Myzap
  gRNA
agcuauccagggccgaugcc

SEQ ID NO: 100451 - RNA, 20 nt, Artificial Sequence
  MKO10100451_B_Myzap
  gRNA
acacgaccauuuccuucugc

SEQ ID NO: 100452 - RNA, 20 nt, Artificial Sequence
  MKO10100452_B_Myzap
  gRNA
acaccauagacaacacccug

SEQ ID NO: 100453 - RNA, 20 nt, Artificial Sequence
  MKO10100453_B_Mzb1
  gRNA
augcuauuaccuauugggcc

SEQ ID NO: 100454 - RNA, 20 nt, Artificial Sequence
  MKO10100454_B_Mzb1
  gRNA
accugcgcugcgaugccugc

SEQ ID NO: 100455 - RNA, 20 nt, Artificial Sequence
  MKO10100455_B_Mzb1
  gRNA
gaaccagaugaagcgucuca

SEQ ID NO: 100456 - RNA, 20 nt, Artificial Sequence
  MKO10100456_B_Mzf1
  gRNA
ggcauaggguccucacucca

SEQ ID NO: 100457 - RNA, 20 nt, Artificial Sequence
  MKO10100457_B_Mzf1
  gRNA
acagaguuguuggggaaucc

SEQ ID NO: 100458 - RNA, 20 nt, Artificial Sequence
  MKO10100458_B_Mzf1
  gRNA
aggguuccaucuucucugau

SEQ ID NO: 100459 - RNA, 20 nt, Artificial Sequence
  MKO10100459_B_Mzt1
  gRNA
caaggguacugaggcacuaa

SEQ ID NO: 100460 - RNA, 20 nt, Artificial Sequence
  MKO10100460_B_Mzt1
  gRNA
ggccucggccaaccugaacg

SEQ ID NO: 100461 - RNA, 20 nt, Artificial Sequence
  MKO10100461_B_Mzt1
  gRNA
uuggccgaggccgccgcgcc

SEQ ID NO: 100462 - RNA, 20 nt, Artificial Sequence
  MKO10100462_B_Mzt2
  gRNA
gagauaugggcaccgagucc

SEQ ID NO: 100463 - RNA, 20 nt, Artificial Sequence
  MKO10100463_B_Mzt2
  gRNA
cacgccagcccagugcgacu

SEQ ID NO: 100464 - RNA, 20 nt, Artificial Sequence
  MKO10100464_B_Mzt2
  gRNA
caacucccgaagcagcccau

SEQ ID NO: 100465 - RNA, 20 nt, Artificial Sequence
  MKO10100465_B_N28178
  gRNA
agcagaggcgagcgcccccg

SEQ ID NO: 100466 - RNA, 20 nt, Artificial Sequence
  MKO10100466_B_N28178
  gRNA
gagcggcuccgagaugggcg

SEQ ID NO: 100467 - RNA, 20 nt, Artificial Sequence
  MKO10100467_B_N28178
  gRNA
gaugacuuuacaccgcugaa

SEQ ID NO: 100468 - RNA, 20 nt, Artificial Sequence
  MKO10100468_B_N4bp1
  gRNA
ugggccucaccugugauauu

SEQ ID NO: 100469 - RNA, 20 nt, Artificial Sequence
  MKO10100469_B_N4bp1
  gRNA
agacgggauccuaauaucac

SEQ ID NO: 100470 - RNA, 20 nt, Artificial Sequence
  MKO10100470_B_N4bp1
  gRNA
cagagaguuugugaccgagu

SEQ ID NO: 100471 - RNA, 20 nt, Artificial Sequence
  MKO10100471_B_N4bp2l1
  gRNA
guugaauuuccagcgagugu

SEQ ID NO: 100472 - RNA, 20 nt, Artificial Sequence
  MKO10100472_B_N4bp2l1
  gRNA
auaacaccaaccugcacgcc

SEQ ID NO: 100473 - RNA, 20 nt, Artificial Sequence
  MKO10100473_B_N4bp2l1
  gRNA
ucucccuaccaugacugcau

SEQ ID NO: 100474 - RNA, 20 nt, Artificial Sequence
  MKO10100474_B_N4bp2l2
  gRNA
acaacacuaauacacaagcc

SEQ ID NO: 100475 - RNA, 20 nt, Artificial Sequence
  MKO10100475_B_N4bp2l2
  gRNA
gcaaaacaagcuauugacca

SEQ ID NO: 100476 - RNA, 20 nt, Artificial Sequence
  MKO10100476_B_N4bp2l2
  gRNA
cagaguagaguuucaugaac

SEQ ID NO: 100477 - RNA, 20 nt, Artificial Sequence
  MKO10100477_B_N4bp2
  gRNA
ucaagccgaaggagcuugcg

SEQ ID NO: 100478 - RNA, 20 nt, Artificial Sequence
  MKO10100478_B_N4bp2
  gRNA
uugaacuuccaccacguguc

SEQ ID NO: 100479 - RNA, 20 nt, Artificial Sequence
  MKO10100479_B_N4bp2
  gRNA
auaauacaaaccuccaagcg

SEQ ID NO: 100480 - RNA, 20 nt, Artificial Sequence
  MKO10100480_B_N4bp3
  gRNA
ggacauguaccgccgcaacc

SEQ ID NO: 100481 - RNA, 20 nt, Artificial Sequence
  MKO10100481_B_N4bp3
  gRNA
cgcuaccagcgagaaaucca

SEQ ID NO: 100482 - RNA, 20 nt, Artificial Sequence
  MKO10100482_B_N4bp3
  gRNA
augcucccgguaguagaggg

SEQ ID NO: 100483 - RNA, 20 nt, Artificial Sequence
  MKO10100483_B_N6amt1
  gRNA
aggggggguuaaacaccagc

SEQ ID NO: 100484 - RNA, 20 nt, Artificial Sequence
  MKO10100484_B_N6amt1
  gRNA
gugcacugauaucaacccug

SEQ ID NO: 100485 - RNA, 20 nt, Artificial Sequence
  MKO10100485_B_N6amt1
  gRNA
cagauccugcuccuacuuca

SEQ ID NO: 100486 - RNA, 20 nt, Artificial Sequence
  MKO10100486_B_N6amt2
  gRNA
agucauaguucguguaacag

SEQ ID NO: 100487 - RNA, 20 nt, Artificial Sequence
  MKO10100487_B_N6amt2
  gRNA
ggaugauaaauauaacguug

SEQ ID NO: 100488 - RNA, 20 nt, Artificial Sequence
  MKO10100488_B_N6amt2
  gRNA
aagcaauccgucaaccccag

SEQ ID NO: 100489 - RNA, 20 nt, Artificial Sequence
  MKO10100489_B_Naa10
  gRNA
ugcccaccuggggccaagag

SEQ ID NO: 100490 - RNA, 20 nt, Artificial Sequence
  MKO10100490_B_Naa10
  gRNA
gacccagacgaugugcccca

SEQ ID NO: 100491 - RNA, 20 nt, Artificial Sequence
  MKO10100491_B_Naa10
  gRNA
cgaugaacauccgcaaugcu

SEQ ID NO: 100492 - RNA, 20 nt, Artificial Sequence
  MKO10100492_B_Naa11
  gRNA
cgggcgaugaucgagaacuu

SEQ ID NO: 100493 - RNA, 20 nt, Artificial Sequence
  MKO10100493_B_Naa11
  gRNA
ccagcgaggugaugugcccg

SEQ ID NO: 100494 - RNA, 20 nt, Artificial Sequence
  MKO10100494_B_Naa11
  gRNA
aguacgugucccugcacguc

SEQ ID NO: 100495 - RNA, 20 nt, Artificial Sequence
  MKO10100495_B_Naa15
  gRNA
gauaccaguugcuucagcuu

SEQ ID NO: 100496 - RNA, 20 nt, Artificial Sequence
  MKO10100496_B_Naa15
  gRNA
accuccaugcucugcaaauu

SEQ ID NO: 100497 - RNA, 20 nt, Artificial Sequence
  MKO10100497_B_Naa15
  gRNA
gauucaaaugcgagaucuug

SEQ ID NO: 100498 - RNA, 20 nt, Artificial Sequence
  MKO10100498_B_Naa16
  gRNA
ccuccauguucagcaaacuu

SEQ ID NO: 100499 - RNA, 20 nt, Artificial Sequence
  MKO10100499_B_Naa16
  gRNA
auccaggaagcacgcugugu

SEQ ID NO: 100500 - RNA, 20 nt, Artificial Sequence
  MKO10100500_B_Naa16
  gRNA
gcauaugaauuuguucguaa

SEQ ID NO: 100501 - RNA, 20 nt, Artificial Sequence
  MKO10100501_B_Naa20
  gRNA
uucaucgucgcugaagcacc

SEQ ID NO: 100502 - RNA, 20 nt, Artificial Sequence
  MKO10100502_B_Naa20
  gRNA
gccccugaauuccgccgucu

SEQ ID NO: 100503 - RNA, 20 nt, Artificial Sequence
  MKO10100503_B_Naa20
  gRNA
uaacccauuaguucuccgcc

SEQ ID NO: 100504 - RNA, 20 nt, Artificial Sequence
  MKO10100504_B_Naa25
  gRNA
cccauagauuaucuugauaa

SEQ ID NO: 100505 - RNA, 20 nt, Artificial Sequence
  MKO10100505_B_Naa25
  gRNA
guuagucacaaagcucuaug

SEQ ID NO: 100506 - RNA, 20 nt, Artificial Sequence
  MKO10100506_B_Naa25
  gRNA
ccaaaaacccuuacuacuuu

SEQ ID NO: 100507 - RNA, 20 nt, Artificial Sequence
  MKO10100507_B_Naa30
  gRNA
uuauauagccauguuagccg

SEQ ID NO: 100508 - RNA, 20 nt, Artificial Sequence
  MKO10100508_B_Naa30
  gRNA
cacaaaaagauguuccgcag

SEQ ID NO: 100509 - RNA, 20 nt, Artificial Sequence
  MKO10100509_B_Naa30
  gRNA
uuauauucuagguacuaacu

SEQ ID NO: 100510 - RNA, 20 nt, Artificial Sequence
  MKO10100510_B_Naa35
  gRNA
agucgggauuaugaauguaa

SEQ ID NO: 100511 - RNA, 20 nt, Artificial Sequence
  MKO10100511_B_Naa35
  gRNA
caacagaucacauggcucga

SEQ ID NO: 100512 - RNA, 20 nt, Artificial Sequence
  MKO10100512_B_Naa35
  gRNA
uccauuauuccuaucaguuc

SEQ ID NO: 100513 - RNA, 20 nt, Artificial Sequence
  MKO10100513_B_Naa40
  gRNA
gcuggaaggaccgagaaaaa

SEQ ID NO: 100514 - RNA, 20 nt, Artificial Sequence
  MKO10100514_B_Naa40
  gRNA
ugcuuacaucgucugcauau

SEQ ID NO: 100515 - RNA, 20 nt, Artificial Sequence
  MKO10100515_B_Naa40
  gRNA
agacacucgcuuacauucaa

SEQ ID NO: 100516 - RNA, 20 nt, Artificial Sequence
  MKO10100516_B_Naa50
  gRNA
cuugcaccuuaccgaagacu

SEQ ID NO: 100517 - RNA, 20 nt, Artificial Sequence
  MKO10100517_B_Naa50
  gRNA
ucgcugacucauugcugauc

SEQ ID NO: 100518 - RNA, 20 nt, Artificial Sequence
  MKO10100518_B_Naa50
  gRNA
uguccuaaacaucugugaga

SEQ ID NO: 100519 - RNA, 20 nt, Artificial Sequence
  MKO10100519_B_Naa60
  gRNA
ucauauuucaaccaccgccc

SEQ ID NO: 100520 - RNA, 20 nt, Artificial Sequence
  MKO10100520_B_Naa60
  gRNA
cccaauggcauuacauggua

SEQ ID NO: 100521 - RNA, 20 nt, Artificial Sequence
  MKO10100521_B_Naa60
  gRNA
ucccuugcugcaaccuacag

SEQ ID NO: 100522 - RNA, 20 nt, Artificial Sequence
  MKO10100522_B_Naaa
  gRNA
gguuccggccgugguaaaua

SEQ ID NO: 100523 - RNA, 20 nt, Artificial Sequence
  MKO10100523_B_Naaa
  gRNA
ggucggagaaauugugucga

SEQ ID NO: 100524 - RNA, 20 nt, Artificial Sequence
  MKO10100524_B_Naaa
  gRNA
cggaaccuggacuauccuuu

SEQ ID NO: 100525 - RNA, 20 nt, Artificial Sequence
  MKO10100525_B_Naalad2
  gRNA
guaacauucucauauccauc

SEQ ID NO: 100526 - RNA, 20 nt, Artificial Sequence
  MKO10100526_B_Naalad2
  gRNA
gaaaugaacaucaacugcac

SEQ ID NO: 100527 - RNA, 20 nt, Artificial Sequence
  MKO10100527_B_Naalad2
  gRNA
uaccuugaaccaccaccaga

SEQ ID NO: 100528 - RNA, 20 nt, Artificial Sequence
  MKO10100528_B_Naaladl1
  gRNA
accaucgcucugacucgcua

SEQ ID NO: 100529 - RNA, 20 nt, Artificial Sequence
  MKO10100529_B_Naaladl1
  gRNA
ucaccgacuuccacgcuguu

SEQ ID NO: 100530 - RNA, 20 nt, Artificial Sequence
  MKO10100530_B_Naaladl1
  gRNA
gggaaucgggggaaauccug

SEQ ID NO: 100531 - RNA, 20 nt, Artificial Sequence
  MKO10100531_B_Nab1
  gRNA
gguccuguaaguguacuugu

SEQ ID NO: 100532 - RNA, 20 nt, Artificial Sequence
  MKO10100532_B_Nab1
  gRNA
ugugccaacacucuuccagc

SEQ ID NO: 100533 - RNA, 20 nt, Artificial Sequence
  MKO10100533_B_Nab1
  gRNA
aacuucucgagaaaccugcc

SEQ ID NO: 100534 - RNA, 20 nt, Artificial Sequence
  MKO10100534_B_Nab2
  gRNA
gccacagcugaccaucaacg

SEQ ID NO: 100535 - RNA, 20 nt, Artificial Sequence
  MKO10100535_B_Nab2
  gRNA
uguugucccucaugcagaac

SEQ ID NO: 100536 - RNA, 20 nt, Artificial Sequence
  MKO10100536_B_Nab2
  gRNA
uggcuguuccgcugugggag

SEQ ID NO: 100537 - RNA, 20 nt, Artificial Sequence
  MKO10100537_B_Nabp1
  gRNA
gguggugaacuucaaaaaau

SEQ ID NO: 100538 - RNA, 20 nt, Artificial Sequence
  MKO10100538_B_Nabp1
  gRNA
gagccaaacccagauuauag

SEQ ID NO: 100539 - RNA, 20 nt, Artificial Sequence
  MKO10100539_B_Nabp1
  gRNA
uucugcuguccucuauaauc

SEQ ID NO: 100540 - RNA, 20 nt, Artificial Sequence
  MKO10100540_B_Nabp2
  gRNA
gccugcugcguguuauacuc

SEQ ID NO: 100541 - RNA, 20 nt, Artificial Sequence
  MKO10100541_B_Nabp2
  gRNA
uaauguccccagguuggauc

SEQ ID NO: 100542 - RNA, 20 nt, Artificial Sequence
  MKO10100542_B_Nabp2
  gRNA
cagagacucaccgauuuguu

SEQ ID NO: 100543 - RNA, 20 nt, Artificial Sequence
  MKO10100543_B_Nacad
  gRNA
accucagaaaucgcagugcc

SEQ ID NO: 100544 - RNA, 20 nt, Artificial Sequence
  MKO10100544_B_Nacad
  gRNA
cccucccccagacgcgcaga

SEQ ID NO: 100545 - RNA, 20 nt, Artificial Sequence
  MKO10100545_B_Nacad
  gRNA
gggcccggcaggcagcaacg

SEQ ID NO: 100546 - RNA, 20 nt, Artificial Sequence
  MKO10100546_B_Naca
  gRNA
caccuaccugucucagccug

SEQ ID NO: 100547 - RNA, 20 nt, Artificial Sequence
  MKO10100547_B_Naca
  gRNA
aaccgucccugcuacagagc

SEQ ID NO: 100548 - RNA, 20 nt, Artificial Sequence
  MKO10100548_B_Naca
  gRNA
cuucucacuucgacucugcu

SEQ ID NO: 100549 - RNA, 20 nt, Artificial Sequence
  MKO10100549_B_Nacc1
  gRNA
cgacacuugcaagauagaac

SEQ ID NO: 100550 - RNA, 20 nt, Artificial Sequence
  MKO10100550_B_Nacc1
  gRNA
gccgcgugccugcacugacg

SEQ ID NO: 100551 - RNA, 20 nt, Artificial Sequence
  MKO10100551_B_Nacc1
  gRNA
aacacucacacuugacagca

SEQ ID NO: 100552 - RNA, 20 nt, Artificial Sequence
  MKO10100552_B_Nacc2
  gRNA
acucacguuucacagcguuc

SEQ ID NO: 100553 - RNA, 20 nt, Artificial Sequence
  MKO10100553_B_Nacc2
  gRNA
ggacacaggagcggcucucc

SEQ ID NO: 100554 - RNA, 20 nt, Artificial Sequence
  MKO10100554_B_Nacc2
  gRNA
uguccucauccgucgagacc

SEQ ID NO: 100555 - RNA, 20 nt, Artificial Sequence
  MKO10100555_B_Nadk2
  gRNA
aggugauggcacgaugcuuc

SEQ ID NO: 100556 - RNA, 20 nt, Artificial Sequence
  MKO10100556_B_Nadk2
  gRNA
acgaugaagagacaguucga

SEQ ID NO: 100557 - RNA, 20 nt, Artificial Sequence
  MKO10100557_B_Nadk2
  gRNA
ucaguguugaccccaaugac

SEQ ID NO: 100558 - RNA, 20 nt, Artificial Sequence
  MKO10100558_B_Nadk
  gRNA
auagacuucaucauaugccu

SEQ ID NO: 100559 - RNA, 20 nt, Artificial Sequence
  MKO10100559_B_Nadk
  gRNA
uccaggacccugcaagucaa

SEQ ID NO: 100560 - RNA, 20 nt, Artificial Sequence
  MKO10100560_B_Nadk
  gRNA
uaugaugaagucuaucuggu

SEQ ID NO: 100561 - RNA, 20 nt, Artificial Sequence
  MKO10100561_B_Nadsyn1
  gRNA
ucugcaggccuauaaugcac

SEQ ID NO: 100562 - RNA, 20 nt, Artificial Sequence
  MKO10100562_B_Nadsyn1
  gRNA
ucuggacucuccggucacuc

SEQ ID NO: 100563 - RNA, 20 nt, Artificial Sequence
  MKO10100563_B_Nadsyn1
  gRNA
ucuucagcggcuauggaugu

SEQ ID NO: 100564 - RNA, 20 nt, Artificial Sequence
  MKO10100564_B_Nae1
  gRNA
ggaucauuuacaauuauuga

SEQ ID NO: 100565 - RNA, 20 nt, Artificial Sequence
  MKO10100565_B_Nae1
  gRNA
cuggucagcggagaagaugc

SEQ ID NO: 100566 - RNA, 20 nt, Artificial Sequence
  MKO10100566_B_Nae1
  gRNA
uuccuucaaaaaagcaguau

SEQ ID NO: 100567 - RNA, 20 nt, Artificial Sequence
  MKO10100567_B_Naf1
  gRNA
ucaagcauuauugaacaauu

SEQ ID NO: 100568 - RNA, 20 nt, Artificial Sequence
  MKO10100568_B_Naf1
  gRNA
uucuagauauuugagauauu

SEQ ID NO: 100569 - RNA, 20 nt, Artificial Sequence
  MKO10100569_B_Naf1
  gRNA
uuuccuccuguguugucaga

SEQ ID NO: 100570 - RNA, 20 nt, Artificial Sequence
  MKO10100570_B_Naga
  gRNA
guccaccuuccacuccgcga

SEQ ID NO: 100571 - RNA, 20 nt, Artificial Sequence
  MKO10100571_B_Naga
  gRNA
gcuggacgcggaaaccuucg

SEQ ID NO: 100572 - RNA, 20 nt, Artificial Sequence
  MKO10100572_B_Naga
  gRNA
aggacccgaagaacugcauc

SEQ ID NO: 100573 - RNA, 20 nt, Artificial Sequence
  MKO10100573_B_Nagk
  gRNA
ggccacaugaugggagacga

SEQ ID NO: 100574 - RNA, 20 nt, Artificial Sequence
  MKO10100574_B_Nagk
  gRNA
uguaggcuuaucaacccuga

SEQ ID NO: 100575 - RNA, 20 nt, Artificial Sequence
  MKO10100575_B_Nagk
  gRNA
gauuggcacagaccagugug

SEQ ID NO: 100576 - RNA, 20 nt, Artificial Sequence
  MKO10100576_B_Naglu
  gRNA
guaggaagagguucccgaug

SEQ ID NO: 100577 - RNA, 20 nt, Artificial Sequence
  MKO10100577_B_Naglu
  gRNA
ucccucccagcaucgaaucc

SEQ ID NO: 100578 - RNA, 20 nt, Artificial Sequence
  MKO10100578_B_Naglu
  gRNA
ucaugccaaaggagcgcauc

SEQ ID NO: 100579 - RNA, 20 nt, Artificial Sequence
  MKO10100579_B_Nagpa
  gRNA
gcagaagcgccgcgcuacug

SEQ ID NO: 100580 - RNA, 20 nt, Artificial Sequence
  MKO10100580_B_Nagpa
  gRNA
caucgagugugacgagacac

SEQ ID NO: 100581 - RNA, 20 nt, Artificial Sequence
  MKO10100581_B_Nagpa
  gRNA
cucugcacagccuuaaccua

SEQ ID NO: 100582 - RNA, 20 nt, Artificial Sequence
  MKO10100582_B_Nags
  gRNA
accuuguuaccaacgcugag

SEQ ID NO: 100583 - RNA, 20 nt, Artificial Sequence
  MKO10100583_B_Nags
  gRNA
gcgcgcagccguuuccccaa

SEQ ID NO: 100584 - RNA, 20 nt, Artificial Sequence
  MKO10100584_B_Nags
  gRNA
acauagaucgagugcaaccg

SEQ ID NO: 100585 - RNA, 20 nt, Artificial Sequence
  MKO10100585_B_Naif1
  gRNA
ggcaaccuugcgacggaccu

SEQ ID NO: 100586 - RNA, 20 nt, Artificial Sequence
  MKO10100586_B_Naif1
  gRNA
gggcgaucuccuuuaugugc

SEQ ID NO: 100587 - RNA, 20 nt, Artificial Sequence
  MKO10100587_B_Naif1
  gRNA
cgagaccaccuaccacacgc

SEQ ID NO: 100588 - RNA, 20 nt, Artificial Sequence
  MKO10100588_B_Naip1
  gRNA
cacuuacuuggggaaccacu

SEQ ID NO: 100589 - RNA, 20 nt, Artificial Sequence
  MKO10100589_B_Naip1
  gRNA
agcuugggcaacugggaaga

SEQ ID NO: 100590 - RNA, 20 nt, Artificial Sequence
  MKO10100590_B_Naip1
  gRNA
agagaauuaccuaugguauc

SEQ ID NO: 100591 - RNA, 20 nt, Artificial Sequence
  MKO10100591_B_Naip2
  gRNA
caauauguacaaagcuauga

SEQ ID NO: 100592 - RNA, 20 nt, Artificial Sequence
  MKO10100592_B_Naip2
  gRNA
ucaaaguaagaaguccccag

SEQ ID NO: 100593 - RNA, 20 nt, Artificial Sequence
  MKO10100593_B_Naip2
  gRNA
aacucacuuggggaaccacu

SEQ ID NO: 100594 - RNA, 20 nt, Artificial Sequence
  MKO10100594_B_Naip5
  gRNA
guugaagcucuagucagagc

SEQ ID NO: 100595 - RNA, 20 nt, Artificial Sequence
  MKO10100595_B_Naip5
  gRNA
gaggcuuuaccugauaccau

SEQ ID NO: 100596 - RNA, 20 nt, Artificial Sequence
  MKO10100596_B_Naip5
  gRNA
acugugcaguguuucuccug

SEQ ID NO: 100597 - RNA, 20 nt, Artificial Sequence
  MKO10100597_B_Naip6
  gRNA
uuugaagcucuagucagagc

SEQ ID NO: 100598 - RNA, 20 nt, Artificial Sequence
  MKO10100598_B_Naip6
  gRNA
acugugcaguguuucuccug

SEQ ID NO: 100599 - RNA, 20 nt, Artificial Sequence
  MKO10100599_B_Naip6
  gRNA
agcucacuuggggaaccacu

SEQ ID NO: 100600 - RNA, 20 nt, Artificial Sequence
  MKO10100600_B_Naip7
  gRNA
ccaguauauucaagacuacg

SEQ ID NO: 100601 - RNA, 20 nt, Artificial Sequence
  MKO10100601_B_Naip7
  gRNA
acugugcaguguuucuccug

SEQ ID NO: 100602 - RNA, 20 nt, Artificial Sequence
  MKO10100602_B_Naip7
  gRNA
agcucacuuggggaaccacu

SEQ ID NO: 100603 - RNA, 20 nt, Artificial Sequence
  MKO10100603_B_Nalcn
  gRNA
ggcggucaggagaacaaaua

SEQ ID NO: 100604 - RNA, 20 nt, Artificial Sequence
  MKO10100604_B_Nalcn
  gRNA
aagaggaggauagugcucaa

SEQ ID NO: 100605 - RNA, 20 nt, Artificial Sequence
  MKO10100605_B_Nalcn
  gRNA
gggugauagcuccuauguga

SEQ ID NO: 100606 - RNA, 20 nt, Artificial Sequence
  MKO10100606_B_Nampt
  gRNA
ugugaacagcacguucccuc

SEQ ID NO: 100607 - RNA, 20 nt, Artificial Sequence
  MKO10100607_B_Nampt
  gRNA
agacuauucuuguucagucc

SEQ ID NO: 100608 - RNA, 20 nt, Artificial Sequence
  MKO10100608_B_Nampt
  gRNA
ggaauaaacuuugcuugugu

SEQ ID NO: 100609 - RNA, 20 nt, Artificial Sequence
  MKO10100609_B_Nanog
  gRNA
gcggagcagcauuccaaggc

SEQ ID NO: 100610 - RNA, 20 nt, Artificial Sequence
  MKO10100610_B_Nanog
  gRNA
accccaccugcuuauagcuc

SEQ ID NO: 100611 - RNA, 20 nt, Artificial Sequence
  MKO10100611_B_Nanog
  gRNA
uuguaagcaagaauaguucu

SEQ ID NO: 100612 - RNA, 20 nt, Artificial Sequence
  MKO10100612_B_Nanos1
  gRNA
cccggccguccgggcccuug

SEQ ID NO: 100613 - RNA, 20 nt, Artificial Sequence
  MKO10100613_B_Nanos1
  gRNA
cacguguagcggcgcaagac

SEQ ID NO: 100614 - RNA, 20 nt, Artificial Sequence
  MKO10100614_B_Nanos1
  gRNA
gcccgaggcgcucacguagc

SEQ ID NO: 100615 - RNA, 20 nt, Artificial Sequence
  MKO10100615_B_Nanos2
  gRNA
gaauuauauccaucaccacc

SEQ ID NO: 100616 - RNA, 20 nt, Artificial Sequence
  MKO10100616_B_Nanos2
  gRNA
accuaccgcccuuugacaug

SEQ ID NO: 100617 - RNA, 20 nt, Artificial Sequence
  MKO10100617_B_Nanos2
  gRNA
ccccuucaggcgucuucagc

SEQ ID NO: 100618 - RNA, 20 nt, Artificial Sequence
  MKO10100618_B_Nanos3
  gRNA
gugggcaaaagcgucgagug

SEQ ID NO: 100619 - RNA, 20 nt, Artificial Sequence
  MKO10100619_B_Nanos3
  gRNA
acacacauaaucccgcaaaa

SEQ ID NO: 100620 - RNA, 20 nt, Artificial Sequence
  MKO10100620_B_Nanos3
  gRNA
cugucuacugcuacaccacc

SEQ ID NO: 100621 - RNA, 20 nt, Artificial Sequence
  MKO10100621_B_Nanp
  gRNA
ucuaugcuuugcaagagagc

SEQ ID NO: 100622 - RNA, 20 nt, Artificial Sequence
  MKO10100622_B_Nanp
  gRNA
ccgcgcggucuucuuugacc

SEQ ID NO: 100623 - RNA, 20 nt, Artificial Sequence
  MKO10100623_B_Nanp
  gRNA
ugucgaugaguguguugucc

SEQ ID NO: 100624 - RNA, 20 nt, Artificial Sequence
  MKO10100624_B_Nans
  gRNA
cgcguacccacuacagcccg

SEQ ID NO: 100625 - RNA, 20 nt, Artificial Sequence
  MKO10100625_B_Nans
  gRNA
caaguuuaaccggaaggccc

SEQ ID NO: 100626 - RNA, 20 nt, Artificial Sequence
  MKO10100626_B_Nans
  gRNA
cuucugaaacuuagcgcagu

SEQ ID NO: 100627 - RNA, 20 nt, Artificial Sequence
  MKO10100627_B_Nap1l1
  gRNA
uaccuuucaauguauccugu

SEQ ID NO: 100628 - RNA, 20 nt, Artificial Sequence
  MKO10100628_B_Nap1l1
  gRNA
gucugaacuugaucaagauu

SEQ ID NO: 100629 - RNA, 20 nt, Artificial Sequence
  MKO10100629_B_Nap1l1
  gRNA
agaaguagaagaagaagaaa

SEQ ID NO: 100630 - RNA, 20 nt, Artificial Sequence
  MKO10100630_B_Nap1l2
  gRNA
ugcgacauagauuggaacga

SEQ ID NO: 100631 - RNA, 20 nt, Artificial Sequence
  MKO10100631_B_Nap1l2
  gRNA
acugccauugaguacgccac

SEQ ID NO: 100632 - RNA, 20 nt, Artificial Sequence
  MKO10100632_B_Nap1l2
  gRNA
ugggagacuuucaacgaaau

SEQ ID NO: 100633 - RNA, 20 nt, Artificial Sequence
  MKO10100633_B_Nap1l3
  gRNA
ugccugcacccgauuucuua

SEQ ID NO: 100634 - RNA, 20 nt, Artificial Sequence
  MKO10100634_B_Nap1l3
  gRNA
auguuacggugacaaccacc

SEQ ID NO: 100635 - RNA, 20 nt, Artificial Sequence
  MKO10100635_B_Nap1l3
  gRNA
agggcccagcgacgucccuc

SEQ ID NO: 100636 - RNA, 20 nt, Artificial Sequence
  MKO10100636_B_Nap1l4
  gRNA
uacguuucuauguaacuaga

SEQ ID NO: 100637 - RNA, 20 nt, Artificial Sequence
  MKO10100637_B_Nap1l4
  gRNA
ccacagaugcagagucagcg

SEQ ID NO: 100638 - RNA, 20 nt, Artificial Sequence
  MKO10100638_B_Nap1l4
  gRNA
gcuaaaaaugccaguaauac

SEQ ID NO: 100639 - RNA, 20 nt, Artificial Sequence
  MKO10100639_B_Nap1l5
  gRNA
ugacagugccgcugcucccg

SEQ ID NO: 100640 - RNA, 20 nt, Artificial Sequence
  MKO10100640_B_Nap1l5
  gRNA
cgagguaauggaaggcgccc

SEQ ID NO: 100641 - RNA, 20 nt, Artificial Sequence
  MKO10100641_B_Nap1l5
  gRNA
gcuugggcgcguucuccgcg

SEQ ID NO: 100642 - RNA, 20 nt, Artificial Sequence
  MKO10100642_B_Napa
  gRNA
ugcugggaacgcuuucugcc

SEQ ID NO: 100643 - RNA, 20 nt, Artificial Sequence
  MKO10100643_B_Napa
  gRNA
ugucucauagaucucagcga

SEQ ID NO: 100644 - RNA, 20 nt, Artificial Sequence
  MKO10100644_B_Napa
  gRNA
ugagaucuaugagacagaac

SEQ ID NO: 100645 - RNA, 20 nt, Artificial Sequence
  MKO10100645_B_Napb
  gRNA
caugucuguguaaaugucga

SEQ ID NO: 100646 - RNA, 20 nt, Artificial Sequence
  MKO10100646_B_Napb
  gRNA
agcugcaaauauguucaaga

SEQ ID NO: 100647 - RNA, 20 nt, Artificial Sequence
  MKO10100647_B_Napb
  gRNA
uagcagagucaugcuugcuc

SEQ ID NO: 100648 - RNA, 20 nt, Artificial Sequence
  MKO10100648_B_Napepld
  gRNA
acgggagauuuguuaaccca

SEQ ID NO: 100649 - RNA, 20 nt, Artificial Sequence
  MKO10100649_B_Napepld
  gRNA
caaacuuaccucauuagcua

SEQ ID NO: 100650 - RNA, 20 nt, Artificial Sequence
  MKO10100650_B_Napepld
  gRNA
aucagccaucugagcacauu

SEQ ID NO: 100651 - RNA, 20 nt, Artificial Sequence
  MKO10100651_B_Napg
  gRNA
cuguugcccaugaaaauaac

SEQ ID NO: 100652 - RNA, 20 nt, Artificial Sequence
  MKO10100652_B_Napg
  gRNA
cuuugcuugcucaaauuguu

SEQ ID NO: 100653 - RNA, 20 nt, Artificial Sequence
  MKO10100653_B_Napg
  gRNA
ugcuuucccauauucagaag

SEQ ID NO: 100654 - RNA, 20 nt, Artificial Sequence
  MKO10100654_B_Naprt1
  gRNA
cggcgagcucagggucccga

SEQ ID NO: 100655 - RNA, 20 nt, Artificial Sequence
  MKO10100655_B_Naprt1
  gRNA
cagagcaaucaagggcucga

SEQ ID NO: 100656 - RNA, 20 nt, Artificial Sequence
  MKO10100656_B_Naprt1
  gRNA
cuucgagcccuugauugcuc

SEQ ID NO: 100657 - RNA, 20 nt, Artificial Sequence
  MKO10100657_B_Napsa
  gRNA
gagacucacguucaugaacu

SEQ ID NO: 100658 - RNA, 20 nt, Artificial Sequence
  MKO10100658_B_Napsa
  gRNA
ugcuccaccaucgcauccag

SEQ ID NO: 100659 - RNA, 20 nt, Artificial Sequence
  MKO10100659_B_Napsa
  gRNA
cacccacagucagauugucc

SEQ ID NO: 100660 - RNA, 20 nt, Artificial Sequence
  MKO10100660_B_Narfl
  gRNA
aaggcugaaguuccucgcga

SEQ ID NO: 100661 - RNA, 20 nt, Artificial Sequence
  MKO10100661_B_Narfl
  gRNA
accaccagccgcugcugacc

SEQ ID NO: 100662 - RNA, 20 nt, Artificial Sequence
  MKO10100662_B_Narfl
  gRNA
ggguccuuacuugguucacu

SEQ ID NO: 100663 - RNA, 20 nt, Artificial Sequence
  MKO10100663_B_Narf
  gRNA
gugucacugaugcaucuaga

SEQ ID NO: 100664 - RNA, 20 nt, Artificial Sequence
  MKO10100664_B_Narf
  gRNA
accauaccuuauuaagauuc

SEQ ID NO: 100665 - RNA, 20 nt, Artificial Sequence
  MKO10100665_B_Narf
  gRNA
gaagggagaguuccauaaau

SEQ ID NO: 100666 - RNA, 20 nt, Artificial Sequence
  MKO10100666_B_Narg2
  gRNA
uuauaauaugcucucugaug

SEQ ID NO: 100667 - RNA, 20 nt, Artificial Sequence
  MKO10100667_B_Narg2
  gRNA
agggauguuacacccaaaaa

SEQ ID NO: 100668 - RNA, 20 nt, Artificial Sequence
  MKO10100668_B_Narg2
  gRNA
cuuguucaaugcaagcucuu

SEQ ID NO: 100669 - RNA, 20 nt, Artificial Sequence
  MKO10100669_B_Nars2
  gRNA
uugaauccgcaacaaucuga

SEQ ID NO: 100670 - RNA, 20 nt, Artificial Sequence
  MKO10100670_B_Nars2
  gRNA
gagcauuaguccugcaccuc

SEQ ID NO: 100671 - RNA, 20 nt, Artificial Sequence
  MKO10100671_B_Nars2
  gRNA
cagucguuggaugugaguac

SEQ ID NO: 100672 - RNA, 20 nt, Artificial Sequence
  MKO10100672_B_Nars
  gRNA
cccaaggcuuugaugacagu

SEQ ID NO: 100673 - RNA, 20 nt, Artificial Sequence
  MKO10100673_B_Nars
  gRNA
ugacccgagccugccagagc

SEQ ID NO: 100674 - RNA, 20 nt, Artificial Sequence
  MKO10100674_B_Nars
  gRNA
gccauuucccaccauuuaug

SEQ ID NO: 100675 - RNA, 20 nt, Artificial Sequence
  MKO10100675_B_Nasp
  gRNA
ugacuucccauaaaaaaaga

SEQ ID NO: 100676 - RNA, 20 nt, Artificial Sequence
  MKO10100676_B_Nasp
  gRNA
acaaaagacuagcugcuucc

SEQ ID NO: 100677 - RNA, 20 nt, Artificial Sequence
  MKO10100677_B_Nasp
  gRNA
agcagcuguuaaugcauucc

SEQ ID NO: 100678 - RNA, 20 nt, Artificial Sequence
  MKO10100678_B_Nau10
  gRNA
gacugaggcccaucaggacg

SEQ ID NO: 100679 - RNA, 20 nt, Artificial Sequence
  MKO10100679_B_Nau10
  gRNA
aucuucccaccacguccuga

SEQ ID NO: 100680 - RNA, 20 nt, Artificial Sequence
  MKO10100680_B_Nau10
  gRNA
ccgagccuucacaguugccu

SEQ ID NO: 100681 - RNA, 20 nt, Artificial Sequence
  MKO10100681_B_Nau14
  gRNA
ccccuaaccaccugucagug

SEQ ID NO: 100682 - RNA, 20 nt, Artificial Sequence
  MKO10100682_B_Nau14
  gRNA
cuggaggucgugucagagcg

SEQ ID NO: 100683 - RNA, 20 nt, Artificial Sequence
  MKO10100683_B_Nau14
  gRNA
ucuggccccuggugccaacg

SEQ ID NO: 100684 - RNA, 20 nt, Artificial Sequence
  MKO10100684_B_Nau1
  gRNA
ugggcuccaccuuuacaagu

SEQ ID NO: 100685 - RNA, 20 nt, Artificial Sequence
  MKO10100685_B_Nau1
  gRNA
gauguacugaaaaccgcauu

SEQ ID NO: 100686 - RNA, 20 nt, Artificial Sequence
  MKO10100686_B_Nau1
  gRNA
acaucgaagcauacuuugaa

SEQ ID NO: 100687 - RNA, 20 nt, Artificial Sequence
  MKO10100687_B_Nau2
  gRNA
ccucacaauuugaucaaaga

SEQ ID NO: 100688 - RNA, 20 nt, Artificial Sequence
  MKO10100688_B_Nau2
  gRNA
gauguacugagaacuauauu

SEQ ID NO: 100689 - RNA, 20 nt, Artificial Sequence
  MKO10100689_B_Nau2
  gRNA
aaggacuacauuguugaugc

SEQ ID NO: 100690 - RNA, 20 nt, Artificial Sequence
  MKO10100690_B_Nau3
  gRNA
gaauggugcccauuaagcca

SEQ ID NO: 100691 - RNA, 20 nt, Artificial Sequence
  MKO10100691_B_Nau3
  gRNA
ucacagauguucgagauacc

SEQ ID NO: 100692 - RNA, 20 nt, Artificial Sequence
  MKO10100692_B_Nau3
  gRNA
cugcaaguccaguuuguugc

SEQ ID NO: 100693 - RNA, 20 nt, Artificial Sequence
  MKO10100693_B_Nau6
  gRNA
uuuggucgccgccucaugga

SEQ ID NO: 100694 - RNA, 20 nt, Artificial Sequence
  MKO10100694_B_Nau6
  gRNA
agcucgggucggcaguguac

SEQ ID NO: 100695 - RNA, 20 nt, Artificial Sequence
  MKO10100695_B_Nau6
  gRNA
gacaugcuaucgagaucuga

SEQ ID NO: 100696 - RNA, 20 nt, Artificial Sequence
  MKO10100696_B_Nau8l
  gRNA
uccgcggaaacgcgagucca

SEQ ID NO: 100697 - RNA, 20 nt, Artificial Sequence
  MKO10100697_B_Nau8l
  gRNA
gguagcggugguagcggacc

SEQ ID NO: 100698 - RNA, 20 nt, Artificial Sequence
  MKO10100698_B_Nau8l
  gRNA
ugcggcuguaguaguagcgc

SEQ ID NO: 100699 - RNA, 20 nt, Artificial Sequence
  MKO10100699_B_Nau8
  gRNA
ugugacucucuacuacagca

SEQ ID NO: 100700 - RNA, 20 nt, Artificial Sequence
  MKO10100700_B_Nau8
  gRNA
ccaugugaguauguccacga

SEQ ID NO: 100701 - RNA, 20 nt, Artificial Sequence
  MKO10100701_B_Nau8
  gRNA
ucacagcaccuugcugcaaa

SEQ ID NO: 100702 - RNA, 20 nt, Artificial Sequence
  MKO10100702_B_Nau9
  gRNA
uucuccuagagccuagcuac

SEQ ID NO: 100703 - RNA, 20 nt, Artificial Sequence
  MKO10100703_B_Nau9
  gRNA
gagaucgaggucaugauugc

SEQ ID NO: 100704 - RNA, 20 nt, Artificial Sequence
  MKO10100704_B_Nau9
  gRNA
caugaccucgaucuccccca

SEQ ID NO: 100705 - RNA, 20 nt, Artificial Sequence
  MKO10100705_B_Nav1
  gRNA
gagcugcgaugacgcaucca

SEQ ID NO: 100706 - RNA, 20 nt, Artificial Sequence
  MKO10100706_B_Nav1
  gRNA
gaaaccauguccagccugcg

SEQ ID NO: 100707 - RNA, 20 nt, Artificial Sequence
  MKO10100707_B_Nav1
  gRNA
gagaacaguacagaacguuc

SEQ ID NO: 100708 - RNA, 20 nt, Artificial Sequence
  MKO10100708_B_Nav2
  gRNA
agcuaagggaaucaacaccc

SEQ ID NO: 100709 - RNA, 20 nt, Artificial Sequence
  MKO10100709_B_Nav2
  gRNA
uccaaagaacagaucgcaaa

SEQ ID NO: 100710 - RNA, 20 nt, Artificial Sequence
  MKO10100710_B_Nav2
  gRNA
cggggcgccuucccagugcc

SEQ ID NO: 100711 - RNA, 20 nt, Artificial Sequence
  MKO10100711_B_Nav3
  gRNA
cucgggcugccagaaagcua

SEQ ID NO: 100712 - RNA, 20 nt, Artificial Sequence
  MKO10100712_B_Nav3
  gRNA
gagaaagucgaagauaucaa

SEQ ID NO: 100713 - RNA, 20 nt, Artificial Sequence
  MKO10100713_B_Nav3
  gRNA
accuggacugcauaucuugc

SEQ ID NO: 100714 - RNA, 20 nt, Artificial Sequence
  MKO10100714_B_Nbas
  gRNA
ugcuguccaggaccagugug

SEQ ID NO: 100715 - RNA, 20 nt, Artificial Sequence
  MKO10100715_B_Nbas
  gRNA
augcagcaauggcaagcuuc

SEQ ID NO: 100716 - RNA, 20 nt, Artificial Sequence
  MKO10100716_B_Nbas
  gRNA
uggucaauaaacagauaaac

SEQ ID NO: 100717 - RNA, 20 nt, Artificial Sequence
  MKO10100717_B_Nbeal1
  gRNA
uguaugauccauauagaaau

SEQ ID NO: 100718 - RNA, 20 nt, Artificial Sequence
  MKO10100718_B_Nbeal1
  gRNA
cugaauauacaguguuguca

SEQ ID NO: 100719 - RNA, 20 nt, Artificial Sequence
  MKO10100719_B_Nbeal1
  gRNA
acuuugaaaagcugccuaca

SEQ ID NO: 100720 - RNA, 20 nt, Artificial Sequence
  MKO10100720_B_Nbeal2
  gRNA
agaugcucuacaugcacuag

SEQ ID NO: 100721 - RNA, 20 nt, Artificial Sequence
  MKO10100721_B_Nbeal2
  gRNA
caggaaccuagagaacguag

SEQ ID NO: 100722 - RNA, 20 nt, Artificial Sequence
  MKO10100722_B_Nbeal2
  gRNA
ucuuugacccuuaccagacu

SEQ ID NO: 100723 - RNA, 20 nt, Artificial Sequence
  MKO10100723_B_Nbea
  gRNA
gcaguagaugacaugauagc

SEQ ID NO: 100724 - RNA, 20 nt, Artificial Sequence
  MKO10100724_B_Nbea
  gRNA
cauugccucccauugcaaag

SEQ ID NO: 100725 - RNA, 20 nt, Artificial Sequence
  MKO10100725_B_Nbea
  gRNA
agagugaagccauucugaua

SEQ ID NO: 100726 - RNA, 20 nt, Artificial Sequence
  MKO10100726_B_Nbl1
  gRNA
ugggcuccuugccgcaagcc

SEQ ID NO: 100727 - RNA, 20 nt, Artificial Sequence
  MKO10100727_B_Nbl1
  gRNA
uguacucacaaucucccaca

SEQ ID NO: 100728 - RNA, 20 nt, Artificial Sequence
  MKO10100728_B_Nbl1
  gRNA
uguggacugcgggaaggugu

SEQ ID NO: 100729 - RNA, 20 nt, Artificial Sequence
  MKO10100729_B_Nbn
  gRNA
aucuccugucuucaacgugc

SEQ ID NO: 100730 - RNA, 20 nt, Artificial Sequence
  MKO10100730_B_Nbn
  gRNA
cagaguagaauacgagcccu

SEQ ID NO: 100731 - RNA, 20 nt, Artificial Sequence
  MKO10100731_B_Nbn
  gRNA
cuuuccugcacguugaagac

SEQ ID NO: 100732 - RNA, 20 nt, Artificial Sequence
  MKO10100732_B_Nbr1
  gRNA
uagauauccaucaauaguca

SEQ ID NO: 100733 - RNA, 20 nt, Artificial Sequence
  MKO10100733_B_Nbr1
  gRNA
uacuauccagauaaaauacc

SEQ ID NO: 100734 - RNA, 20 nt, Artificial Sequence
  MKO10100734_B_Nbr1
  gRNA
ugaauaugaagaagcacuua

SEQ ID NO: 100735 - RNA, 20 nt, Artificial Sequence
  MKO10100735_B_Ncald
  gRNA
ucccuaggcgaucuacaaaa

SEQ ID NO: 100736 - RNA, 20 nt, Artificial Sequence
  MKO10100736_B_Ncald
  gRNA
agaaaagaucuuccgccaga

SEQ ID NO: 100737 - RNA, 20 nt, Artificial Sequence
  MKO10100737_B_Ncald
  gRNA
gugcagggcucagaacuggc

SEQ ID NO: 100738 - RNA, 20 nt, Artificial Sequence
  MKO10100738_B_Ncam1
  gRNA
ugggaacaauaucuaccugc

SEQ ID NO: 100739 - RNA, 20 nt, Artificial Sequence
  MKO10100739_B_Ncam1
  gRNA
guuuacaaugcugcgaacua

SEQ ID NO: 100740 - RNA, 20 nt, Artificial Sequence
  MKO10100740_B_Ncam1
  gRNA
caagaaugcaccaaccccac

SEQ ID NO: 100741 - RNA, 20 nt, Artificial Sequence
  MKO10100741_B_Ncam2
  gRNA
aaaauacuaacugucgggga

SEQ ID NO: 100742 - RNA, 20 nt, Artificial Sequence
  MKO10100742_B_Ncam2
  gRNA
gugagccugagaguaucgac

SEQ ID NO: 100743 - RNA, 20 nt, Artificial Sequence
  MKO10100743_B_Ncam2
  gRNA
uagcaaaguagagcuuagug

SEQ ID NO: 100744 - RNA, 20 nt, Artificial Sequence
  MKO10100744_B_Ncan
  gRNA
cuacgggagacgcgacccgc

SEQ ID NO: 100745 - RNA, 20 nt, Artificial Sequence
  MKO10100745_B_Ncan
  gRNA
accuuaguccacuugauccg

SEQ ID NO: 100746 - RNA, 20 nt, Artificial Sequence
  MKO10100746_B_Ncan
  gRNA
guaucgcugccaagugguaa

SEQ ID NO: 100747 - RNA, 20 nt, Artificial Sequence
  MKO10100747_B_Ncapd2
  gRNA
cacuuucgaaguauagaacc

SEQ ID NO: 100748 - RNA, 20 nt, Artificial Sequence
  MKO10100748_B_Ncapd2
  gRNA
auaggugacggauguccagc

SEQ ID NO: 100749 - RNA, 20 nt, Artificial Sequence
  MKO10100749_B_Ncapd2
  gRNA
caauugaagaagaauuuguc

SEQ ID NO: 100750 - RNA, 20 nt, Artificial Sequence
  MKO10100750_B_Ncapd3
  gRNA
auuguucugucacuucgucc

SEQ ID NO: 100751 - RNA, 20 nt, Artificial Sequence
  MKO10100751_B_Ncapd3
  gRNA
cucguauuugacaaaggucc

SEQ ID NO: 100752 - RNA, 20 nt, Artificial Sequence
  MKO10100752_B_Ncapd3
  gRNA
gucuauucaaacuuguauag

SEQ ID NO: 100753 - RNA, 20 nt, Artificial Sequence
  MKO10100753_B_Ncapg2
  gRNA
gagugugcuguuauauugaa

SEQ ID NO: 100754 - RNA, 20 nt, Artificial Sequence
  MKO10100754_B_Ncapg2
  gRNA
acagauccugaauagaguuc

SEQ ID NO: 100755 - RNA, 20 nt, Artificial Sequence
  MKO10100755_B_Ncapg2
  gRNA
aaauguuaauuacaucaaga

SEQ ID NO: 100756 - RNA, 20 nt, Artificial Sequence
  MKO10100756_B_Ncapg
  gRNA
uucauuucaccagucugaug

SEQ ID NO: 100757 - RNA, 20 nt, Artificial Sequence
  MKO10100757_B_Ncapg
  gRNA
ccauacauaccaucaacuac

SEQ ID NO: 100758 - RNA, 20 nt, Artificial Sequence
  MKO10100758_B_Ncapg
  gRNA
uuugacaaagucuuugcuga

SEQ ID NO: 100759 - RNA, 20 nt, Artificial Sequence
  MKO10100759_B_Ncaph2
  gRNA
cagggaagucguccagugac

SEQ ID NO: 100760 - RNA, 20 nt, Artificial Sequence
  MKO10100760_B_Ncaph2
  gRNA
caccuucuuacuguagacac

SEQ ID NO: 100761 - RNA, 20 nt, Artificial Sequence
  MKO10100761_B_Ncaph2
  gRNA
ugccucaaugaaguucauug

SEQ ID NO: 100762 - RNA, 20 nt, Artificial Sequence
  MKO10100762_B_Ncaph
  gRNA
uucagaagaaagcuugauac

SEQ ID NO: 100763 - RNA, 20 nt, Artificial Sequence
  MKO10100763_B_Ncaph
  gRNA
ugucuuugcccagcccccca

SEQ ID NO: 100764 - RNA, 20 nt, Artificial Sequence
  MKO10100764_B_Ncaph
  gRNA
cuccuuacuuuaaaguuggu

SEQ ID NO: 100765 - RNA, 20 nt, Artificial Sequence
  MKO10100765_B_Ncbp1
  gRNA
acuacaagagcaagaucuua

SEQ ID NO: 100766 - RNA, 20 nt, Artificial Sequence
  MKO10100766_B_Ncbp1
  gRNA
uccuccaaaguuguaauucc

SEQ ID NO: 100767 - RNA, 20 nt, Artificial Sequence
  MKO10100767_B_Ncbp1
  gRNA
acaauuuacacaacauuagu

SEQ ID NO: 100768 - RNA, 20 nt, Artificial Sequence
  MKO10100768_B_Ncbp2
  gRNA
aguaccgggaccagcacuuu

SEQ ID NO: 100769 - RNA, 20 nt, Artificial Sequence
  MKO10100769_B_Ncbp2
  gRNA
gucuggaugaccggaucaua

SEQ ID NO: 100770 - RNA, 20 nt, Artificial Sequence
  MKO10100770_B_Ncbp2
  gRNA
gaggacuacgaugcuggaag

SEQ ID NO: 100771 - RNA, 20 nt, Artificial Sequence
  MKO10100771_B_Nccrp1
  gRNA
gguccucucccauugguccg

SEQ ID NO: 100772 - RNA, 20 nt, Artificial Sequence
  MKO10100772_B_Nccrp1
  gRNA
aggcauuaauaucuaccagc

SEQ ID NO: 100773 - RNA, 20 nt, Artificial Sequence
  MKO10100773_B_Nccrp1
  gRNA
cggggcucaccaguccauga

SEQ ID NO: 100774 - RNA, 20 nt, Artificial Sequence
  MKO10100774_B_Ncdn
  gRNA
auccccgggccaugauaccu

SEQ ID NO: 100775 - RNA, 20 nt, Artificial Sequence
  MKO10100775_B_Ncdn
  gRNA
aggccgaucuccacgcuguc

SEQ ID NO: 100776 - RNA, 20 nt, Artificial Sequence
  MKO10100776_B_Ncdn
  gRNA
aaacugcucgcugucauucu

SEQ ID NO: 100777 - RNA, 20 nt, Artificial Sequence
  MKO10100777_B_Nceh1
  gRNA
ugacagacaccgacuucgau

SEQ ID NO: 100778 - RNA, 20 nt, Artificial Sequence
  MKO10100778_B_Nceh1
  gRNA
cagauacaggcuagucccac

SEQ ID NO: 100779 - RNA, 20 nt, Artificial Sequence
  MKO10100779_B_Nceh1
  gRNA
ccagaaauaccgacucuucc

SEQ ID NO: 100780 - RNA, 20 nt, Artificial Sequence
  MKO10100780_B_Ncf1
  gRNA
gauggcaagaauaacguagc

SEQ ID NO: 100781 - RNA, 20 nt, Artificial Sequence
  MKO10100781_B_Ncf1
  gRNA
uguagaccaccuucuccgac

SEQ ID NO: 100782 - RNA, 20 nt, Artificial Sequence
  MKO10100782_B_Ncf1
  gRNA
uacguuauucuugccaucuu

SEQ ID NO: 100783 - RNA, 20 nt, Artificial Sequence
  MKO10100783_B_Ncf2
  gRNA
uuucuuccauuccucuuucu

SEQ ID NO: 100784 - RNA, 20 nt, Artificial Sequence
  MKO10100784_B_Ncf2
  gRNA
uguaguagagcauuccucuc

SEQ ID NO: 100785 - RNA, 20 nt, Artificial Sequence
  MKO10100785_B_Ncf2
  gRNA
cagagacaagcacucugcag

SEQ ID NO: 100786 - RNA, 20 nt, Artificial Sequence
  MKO10100786_B_Ncf4
  gRNA
guaccuucauguaggcauug

SEQ ID NO: 100787 - RNA, 20 nt, Artificial Sequence
  MKO10100787_B_Ncf4
  gRNA
gugcagccuaccuggcaaug

SEQ ID NO: 100788 - RNA, 20 nt, Artificial Sequence
  MKO10100788_B_Ncf4
  gRNA
ugcugauggaccccgacguc

SEQ ID NO: 100789 - RNA, 20 nt, Artificial Sequence
  MKO10100789_B_Nck1
  gRNA
ccuugcucacuuguaaagau

SEQ ID NO: 100790 - RNA, 20 nt, Artificial Sequence
  MKO10100790_B_Nck1
  gRNA
ccgaucuuuacaagugagca

SEQ ID NO: 100791 - RNA, 20 nt, Artificial Sequence
  MKO10100791_B_Nck1
  gRNA
ucaagaagaaugagcgauua

SEQ ID NO: 100792 - RNA, 20 nt, Artificial Sequence
  MKO10100792_B_Nck2
  gRNA
ccacagcauggacgagcuug

SEQ ID NO: 100793 - RNA, 20 nt, Artificial Sequence
  MKO10100793_B_Nck2
  gRNA
acucaccuaguguguccuug

SEQ ID NO: 100794 - RNA, 20 nt, Artificial Sequence
  MKO10100794_B_Nck2
  gRNA
aggcacguagccuguccugu

SEQ ID NO: 100795 - RNA, 20 nt, Artificial Sequence
  MKO10100795_B_Nckap1l
  gRNA
aaguucucaccgugcuauuu

SEQ ID NO: 100796 - RNA, 20 nt, Artificial Sequence
  MKO10100796_B_Nckap1l
  gRNA
ccaugacauccacaaaugac

SEQ ID NO: 100797 - RNA, 20 nt, Artificial Sequence
  MKO10100797_B_Nckap1l
  gRNA
uaacuauuaccagucauuug

SEQ ID NO: 100798 - RNA, 20 nt, Artificial Sequence
  MKO10100798_B_Nckap1
  gRNA
gaagaacggaaggcaaucau

SEQ ID NO: 100799 - RNA, 20 nt, Artificial Sequence
  MKO10100799_B_Nckap1
  gRNA
ucacaauaucaaagaagacu

SEQ ID NO: 100800 - RNA, 20 nt, Artificial Sequence
  MKO10100800_B_Nckap1
  gRNA
uauucagcaagucacagaca

SEQ ID NO: 100801 - RNA, 20 nt, Artificial Sequence
  MKO10100801_B_Nckap5l
  gRNA
ggggagguuggucguucuga

SEQ ID NO: 100802 - RNA, 20 nt, Artificial Sequence
  MKO10100802_B_Nckap5l
  gRNA
uccccagguugccaaccacg

SEQ ID NO: 100803 - RNA, 20 nt, Artificial Sequence
  MKO10100803_B_Nckap5l
  gRNA
uuacgaacgcugucuggaug

SEQ ID NO: 100804 - RNA, 20 nt, Artificial Sequence
  MKO10100804_B_Nckap5
  gRNA
cgaagucuguugcagagcca

SEQ ID NO: 100805 - RNA, 20 nt, Artificial Sequence
  MKO10100805_B_Nckap5
  gRNA
ccaugugguggcagcugaug

SEQ ID NO: 100806 - RNA, 20 nt, Artificial Sequence
  MKO10100806_B_Nckap5
  gRNA
aagaagcgagcacaguagug

SEQ ID NO: 100807 - RNA, 20 nt, Artificial Sequence
  MKO10100807_B_Nckipsd
  gRNA
agcuauugaccgugccauug

SEQ ID NO: 100808 - RNA, 20 nt, Artificial Sequence
  MKO10100808_B_Nckipsd
  gRNA
guacuugccgccaucucgca

SEQ ID NO: 100809 - RNA, 20 nt, Artificial Sequence
  MKO10100809_B_Nckipsd
  gRNA
cccaguucgacacaccccau

SEQ ID NO: 100810 - RNA, 20 nt, Artificial Sequence
  MKO10100810_B_Ncln
  gRNA
cucuccacaggggcggcuaa

SEQ ID NO: 100811 - RNA, 20 nt, Artificial Sequence
  MKO10100811_B_Ncln
  gRNA
gggcuccacuggucaccauc

SEQ ID NO: 100812 - RNA, 20 nt, Artificial Sequence
  MKO10100812_B_Ncln
  gRNA
acuuacuggggcuaccccaa

SEQ ID NO: 100813 - RNA, 20 nt, Artificial Sequence
  MKO10100813_B_Ncl
  gRNA
gaaccuguuaaagcagcacc

SEQ ID NO: 100814 - RNA, 20 nt, Artificial Sequence
  MKO10100814_B_Ncl
  gRNA
gaaaauggcuccuccuccaa

SEQ ID NO: 100815 - RNA, 20 nt, Artificial Sequence
  MKO10100815_B_Ncl
  gRNA
uucaggggcuucuuucugcu

SEQ ID NO: 100816 - RNA, 20 nt, Artificial Sequence
  MKO10100816_B_Ncmap
  gRNA
ucuucucgcugaacaugacc

SEQ ID NO: 100817 - RNA, 20 nt, Artificial Sequence
  MKO10100817_B_Ncmap
  gRNA
ggucauguucagcgagaaga

SEQ ID NO: 100818 - RNA, 20 nt, Artificial Sequence
  MKO10100818_B_Ncmap
  gRNA
ugcaggcucuggagccaucg

SEQ ID NO: 100819 - RNA, 20 nt, Artificial Sequence
  MKO10100819_B_Ncoa1
  gRNA
acugcauuacuucauagcgc

SEQ ID NO: 100820 - RNA, 20 nt, Artificial Sequence
  MKO10100820_B_Ncoa1
  gRNA
augcaguaugcuguagacgc

SEQ ID NO: 100821 - RNA, 20 nt, Artificial Sequence
  MKO10100821_B_Ncoa1
  gRNA
gacaucuccucgagcagcca

SEQ ID NO: 100822 - RNA, 20 nt, Artificial Sequence
  MKO10100822_B_Ncoa2
  gRNA
aaggaaugucccgaccagcu

SEQ ID NO: 100823 - RNA, 20 nt, Artificial Sequence
  MKO10100823_B_Ncoa2
  gRNA
caacgaagaagaacccaucg

SEQ ID NO: 100824 - RNA, 20 nt, Artificial Sequence
  MKO10100824_B_Ncoa2
  gRNA
gcacccuguaggcccucgau

SEQ ID NO: 100825 - RNA, 20 nt, Artificial Sequence
  MKO10100825_B_Ncoa3
  gRNA
uguagacacuuguguuaacc

SEQ ID NO: 100826 - RNA, 20 nt, Artificial Sequence
  MKO10100826_B_Ncoa3
  gRNA
caucucgauucaccacaaac

SEQ ID NO: 100827 - RNA, 20 nt, Artificial Sequence
  MKO10100827_B_Ncoa3
  gRNA
acaccuaccuguaguaaaag

SEQ ID NO: 100828 - RNA, 20 nt, Artificial Sequence
  MKO10100828_B_Ncoa4
  gRNA
guucauugagccacaccucu

SEQ ID NO: 100829 - RNA, 20 nt, Artificial Sequence
  MKO10100829_B_Ncoa4
  gRNA
cagcugcauaagucgccacc

SEQ ID NO: 100830 - RNA, 20 nt, Artificial Sequence
  MKO10100830_B_Ncoa4
  gRNA
caagcacacagagacuugau

SEQ ID NO: 100831 - RNA, 20 nt, Artificial Sequence
  MKO10100831_B_Ncoa5
  gRNA
guagagaggagcuuuaucgu

SEQ ID NO: 100832 - RNA, 20 nt, Artificial Sequence
  MKO10100832_B_Ncoa5
  gRNA
gcagagacauucgagauccu

SEQ ID NO: 100833 - RNA, 20 nt, Artificial Sequence
  MKO10100833_B_Ncoa5
  gRNA
uuugcucgagauugacucuc

SEQ ID NO: 100834 - RNA, 20 nt, Artificial Sequence
  MKO10100834_B_Ncoa6
  gRNA
uaacgaaccuucaaucugaa

SEQ ID NO: 100835 - RNA, 20 nt, Artificial Sequence
  MKO10100835_B_Ncoa6
  gRNA
ugccgcuguuaugacgcccc

SEQ ID NO: 100836 - RNA, 20 nt, Artificial Sequence
  MKO10100836_B_Ncoa6
  gRNA
aagaugacauguucccgccc

SEQ ID NO: 100837 - RNA, 20 nt, Artificial Sequence
  MKO10100837_B_Ncoa7
  gRNA
cgagcuugaagacucucuac

SEQ ID NO: 100838 - RNA, 20 nt, Artificial Sequence
  MKO10100838_B_Ncoa7
  gRNA
gagcacuugcagcuacuacg

SEQ ID NO: 100839 - RNA, 20 nt, Artificial Sequence
  MKO10100839_B_Ncoa7
  gRNA
acagccccacagugcacucc

SEQ ID NO: 100840 - RNA, 20 nt, Artificial Sequence
  MKO10100840_B_Ncor1
  gRNA
aguuaauacagaguauggac

SEQ ID NO: 100841 - RNA, 20 nt, Artificial Sequence
  MKO10100841_B_Ncor1
  gRNA
ucccaguacccgacaccagc

SEQ ID NO: 100842 - RNA, 20 nt, Artificial Sequence
  MKO10100842_B_Ncor1
  gRNA
uuccauuaccugucagaacc

SEQ ID NO: 100843 - RNA, 20 nt, Artificial Sequence
  MKO10100843_B_Ncor2
  gRNA
cauugauggcuugucugagc

SEQ ID NO: 100844 - RNA, 20 nt, Artificial Sequence
  MKO10100844_B_Ncor2
  gRNA
ggaaccacgcgcgcaagcag

SEQ ID NO: 100845 - RNA, 20 nt, Artificial Sequence
  MKO10100845_B_Ncor2
  gRNA
guacuacgagaaacaguucc

SEQ ID NO: 100846 - RNA, 20 nt, Artificial Sequence
  MKO10100846_B_Ncr1
  gRNA
gucgagcaacccccugaaac

SEQ ID NO: 100847 - RNA, 20 nt, Artificial Sequence
  MKO10100847_B_Ncr1
  gRNA
accgacccuacuucuucucu

SEQ ID NO: 100848 - RNA, 20 nt, Artificial Sequence
  MKO10100848_B_Ncr1
  gRNA
uagggcuaugucugagccag

SEQ ID NO: 100849 - RNA, 20 nt, Artificial Sequence
  MKO10100849_B_Ncs1
  gRNA
agcgggcagcuggaugccgc

SEQ ID NO: 100850 - RNA, 20 nt, Artificial Sequence
  MKO10100850_B_Ncs1
  gRNA
uugaggucaccgacagugcc

SEQ ID NO: 100851 - RNA, 20 nt, Artificial Sequence
  MKO10100851_B_Ncs1
  gRNA
auaacgauggcuacaucacc

SEQ ID NO: 100852 - RNA, 20 nt, Artificial Sequence
  MKO10100852_B_Ncstn
  gRNA
uacagggguuauccauguag

SEQ ID NO: 100853 - RNA, 20 nt, Artificial Sequence
  MKO10100853_B_Ncstn
  gRNA
gguauuuacuccaacuccua

SEQ ID NO: 100854 - RNA, 20 nt, Artificial Sequence
  MKO10100854_B_Ncstn
  gRNA
cuggcagccaaucugaugag

SEQ ID NO: 100855 - RNA, 20 nt, Artificial Sequence
  MKO10100855_B_Ndc1
  gRNA
cacuacugaccaaacgaugc

SEQ ID NO: 100856 - RNA, 20 nt, Artificial Sequence
  MKO10100856_B_Ndc1
  gRNA
gcuauagcccaugaaugcuc

SEQ ID NO: 100857 - RNA, 20 nt, Artificial Sequence
  MKO10100857_B_Ndc1
  gRNA
ggauaguuaccagcaucguu

SEQ ID NO: 100858 - RNA, 20 nt, Artificial Sequence
  MKO10100858_B_Ndc80
  gRNA
ucacacguggccucacaucg

SEQ ID NO: 100859 - RNA, 20 nt, Artificial Sequence
  MKO10100859_B_Ndc80
  gRNA
gaucuuuaggaacucuuuag

SEQ ID NO: 100860 - RNA, 20 nt, Artificial Sequence
  MKO10100860_B_Ndc80
  gRNA
acgaugugaggccacgugug

SEQ ID NO: 100861 - RNA, 20 nt, Artificial Sequence
  MKO10100861_B_Nde1
  gRNA
ccuaccguuuggcucuuucc

SEQ ID NO: 100862 - RNA, 20 nt, Artificial Sequence
  MKO10100862_B_Nde1
  gRNA
cagagccacaaucauguccc

SEQ ID NO: 100863 - RNA, 20 nt, Artificial Sequence
  MKO10100863_B_Nde1
  gRNA
ugccuuccuagagagugagc

SEQ ID NO: 100864 - RNA, 20 nt, Artificial Sequence
  MKO10100864_B_Ndel1
  gRNA
aagggcaacaauaguuucac

SEQ ID NO: 100865 - RNA, 20 nt, Artificial Sequence
  MKO10100865_B_Ndel1
  gRNA
uaaggcaagaacuagcaguu

SEQ ID NO: 100866 - RNA, 20 nt, Artificial Sequence
  MKO10100866_B_Ndel1
  gRNA
cuagcucaucccgagcuucc

SEQ ID NO: 100867 - RNA, 20 nt, Artificial Sequence
  MKO10100867_B_Ndfip1
  gRNA
ugcaacuuacccugacaaua

SEQ ID NO: 100868 - RNA, 20 nt, Artificial Sequence
  MKO10100868_B_Ndfip1
  gRNA
uauggggccaucucaggauu

SEQ ID NO: 100869 - RNA, 20 nt, Artificial Sequence
  MKO10100869_B_Ndfip1
  gRNA
uugaugauacugaccagcug

SEQ ID NO: 100870 - RNA, 20 nt, Artificial Sequence
  MKO10100870_B_Ndfip2
  gRNA
aagaggaagacuguacgcca

SEQ ID NO: 100871 - RNA, 20 nt, Artificial Sequence
  MKO10100871_B_Ndfip2
  gRNA
acaucacugaagucaucccg

SEQ ID NO: 100872 - RNA, 20 nt, Artificial Sequence
  MKO10100872_B_Ndfip2
  gRNA
agagagguagcaacacugua

SEQ ID NO: 100873 - RNA, 20 nt, Artificial Sequence
  MKO10100873_B_Ndnf
  gRNA
gaagcugcccacccgagaug

SEQ ID NO: 100874 - RNA, 20 nt, Artificial Sequence
  MKO10100874_B_Ndnf
  gRNA
gacaccuugcgaugcaccuu

SEQ ID NO: 100875 - RNA, 20 nt, Artificial Sequence
  MKO10100875_B_Ndnf
  gRNA
cgugaaaaaauuccuuaucc

SEQ ID NO: 100876 - RNA, 20 nt, Artificial Sequence
  MKO10100876_B_Ndnl2
  gRNA
gguacacuccgagccgucgc

SEQ ID NO: 100877 - RNA, 20 nt, Artificial Sequence
  MKO10100877_B_Ndnl2
  gRNA
ugggacuuccugcgacggcu

SEQ ID NO: 100878 - RNA, 20 nt, Artificial Sequence
  MKO10100878_B_Ndnl2
  gRNA
ccgcggucggcccagcacgc

SEQ ID NO: 100879 - RNA, 20 nt, Artificial Sequence
  MKO10100879_B_Ndn
  gRNA
agaaggcgcacgagcucaug

SEQ ID NO: 100880 - RNA, 20 nt, Artificial Sequence
  MKO10100880_B_Ndn
  gRNA
cgcggcccuucacauagaug

SEQ ID NO: 100881 - RNA, 20 nt, Artificial Sequence
  MKO10100881_B_Ndn
  gRNA
gcagcccgaacacucuggcg

SEQ ID NO: 100882 - RNA, 20 nt, Artificial Sequence
  MKO10100882_B_Ndor1
  gRNA
ucuggcugccgaaaagcacc

SEQ ID NO: 100883 - RNA, 20 nt, Artificial Sequence
  MKO10100883_B_Ndor1
  gRNA
cacuggcccccaacacuuuc

SEQ ID NO: 100884 - RNA, 20 nt, Artificial Sequence
  MKO10100884_B_Ndor1
  gRNA
acccucugguuggugaucac

SEQ ID NO: 100885 - RNA, 20 nt, Artificial Sequence
  MKO10100885_B_Ndp
  gRNA
uuugagcuacauuuguacag

SEQ ID NO: 100886 - RNA, 20 nt, Artificial Sequence
  MKO10100886_B_Ndp
  gRNA
aggaacggaaagguugcuug

SEQ ID NO: 100887 - RNA, 20 nt, Artificial Sequence
  MKO10100887_B_Ndp
  gRNA
cucugcgucugcgcugcuca

SEQ ID NO: 100888 - RNA, 20 nt, Artificial Sequence
  MKO10100888_B_Ndrg1
  gRNA
ccugaacaucgaacucuugc

SEQ ID NO: 100889 - RNA, 20 nt, Artificial Sequence
  MKO10100889_B_Ndrg1
  gRNA
cagguacauguaccccucaa

SEQ ID NO: 100890 - RNA, 20 nt, Artificial Sequence
  MKO10100890_B_Ndrg1
  gRNA
gcucuuacccaaacugguga

SEQ ID NO: 100891 - RNA, 20 nt, Artificial Sequence
  MKO10100891_B_Ndrg2
  gRNA
agaucauacagaacuucgug

SEQ ID NO: 100892 - RNA, 20 nt, Artificial Sequence
  MKO10100892_B_Ndrg2
  gRNA
gaggagaagccgcuguugcc

SEQ ID NO: 100893 - RNA, 20 nt, Artificial Sequence
  MKO10100893_B_Ndrg2
  gRNA
ccucucacuuuagguacugc

SEQ ID NO: 100894 - RNA, 20 nt, Artificial Sequence
  MKO10100894_B_Ndrg3
  gRNA
caaaccgcuucuaaaugaua

SEQ ID NO: 100895 - RNA, 20 nt, Artificial Sequence
  MKO10100895_B_Ndrg3
  gRNA
gcacuuugcugucugucacg

SEQ ID NO: 100896 - RNA, 20 nt, Artificial Sequence
  MKO10100896_B_Ndrg3
  gRNA
ggugcugcuucuuguuggcc

SEQ ID NO: 100897 - RNA, 20 nt, Artificial Sequence
  MKO10100897_B_Ndrg4
  gRNA
uacgauugagacccacauca

SEQ ID NO: 100898 - RNA, 20 nt, Artificial Sequence
  MKO10100898_B_Ndrg4
  gRNA
guggcacaccacaaaguguu

SEQ ID NO: 100899 - RNA, 20 nt, Artificial Sequence
  MKO10100899_B_Ndrg4
  gRNA
ggccgccaugcucccgagug

SEQ ID NO: 100900 - RNA, 20 nt, Artificial Sequence
  MKO10100900_B_Ndst1
  gRNA
cgccguggcuuuauccacaa

SEQ ID NO: 100901 - RNA, 20 nt, Artificial Sequence
  MKO10100901_B_Ndst1
  gRNA
cgacagcgaacuucuuguuc

SEQ ID NO: 100902 - RNA, 20 nt, Artificial Sequence
  MKO10100902_B_Ndst1
  gRNA
ugccauagguacggaugcug

SEQ ID NO: 100903 - RNA, 20 nt, Artificial Sequence
  MKO10100903_B_Ndst2
  gRNA
acagcauaccccagauccgu

SEQ ID NO: 100904 - RNA, 20 nt, Artificial Sequence
  MKO10100904_B_Ndst2
  gRNA
cagcuagcacagagcgguug

SEQ ID NO: 100905 - RNA, 20 nt, Artificial Sequence
  MKO10100905_B_Ndst2
  gRNA
acaugcugcugaagcaccgc

SEQ ID NO: 100906 - RNA, 20 nt, Artificial Sequence
  MKO10100906_B_Ndst3
  gRNA
guucucccaagacaaaccug

SEQ ID NO: 100907 - RNA, 20 nt, Artificial Sequence
  MKO10100907_B_Ndst3
  gRNA
aagagcccacagguuugucu

SEQ ID NO: 100908 - RNA, 20 nt, Artificial Sequence
  MKO10100908_B_Ndst3
  gRNA
ugaaggggaugauugucugc

SEQ ID NO: 100909 - RNA, 20 nt, Artificial Sequence
  MKO10100909_B_Ndst4
  gRNA
ccacaaugaaucaucuuuag

SEQ ID NO: 100910 - RNA, 20 nt, Artificial Sequence
  MKO10100910_B_Ndst4
  gRNA
ccacuaaagaugauucauug

SEQ ID NO: 100911 - RNA, 20 nt, Artificial Sequence
  MKO10100911_B_Ndst4
  gRNA
aguaugugugaacagcccac

SEQ ID NO: 100912 - RNA, 20 nt, Artificial Sequence
  MKO10100912_B_Ndufa10
  gRNA
gcuguugccaucguugcucu

SEQ ID NO: 100913 - RNA, 20 nt, Artificial Sequence
  MKO10100913_B_Ndufa10
  gRNA
agccgagugauaacaguaga

SEQ ID NO: 100914 - RNA, 20 nt, Artificial Sequence
  MKO10100914_B_Ndufa10
  gRNA
gguugucuuaucaccaagaa

SEQ ID NO: 100915 - RNA, 20 nt, Artificial Sequence
  MKO10100915_B_Ndufa11
  gRNA
cacugcgagcucccaauguc

SEQ ID NO: 100916 - RNA, 20 nt, Artificial Sequence
  MKO10100916_B_Ndufa11
  gRNA
gcggccgcccuguucaagau

SEQ ID NO: 100917 - RNA, 20 nt, Artificial Sequence
  MKO10100917_B_Ndufa11
  gRNA
caaccccgcagauuccaccc

SEQ ID NO: 100918 - RNA, 20 nt, Artificial Sequence
  MKO10100918_B_Ndufa12
  gRNA
cuuaaagggcaaaugauaua

SEQ ID NO: 100919 - RNA, 20 nt, Artificial Sequence
  MKO10100919_B_Ndufa12
  gRNA
cuggugggagaagacaaaua

SEQ ID NO: 100920 - RNA, 20 nt, Artificial Sequence
  MKO10100920_B_Ndufa12
  gRNA
ugguguagaugacccaucgg

SEQ ID NO: 100921 - RNA, 20 nt, Artificial Sequence
  MKO10100921_B_Ndufa13
  gRNA
acccauacaucucgccaaug

SEQ ID NO: 100922 - RNA, 20 nt, Artificial Sequence
  MKO10100922_B_Ndufa13
  gRNA
gcagggccuaccugcgcucc

SEQ ID NO: 100923 - RNA, 20 nt, Artificial Sequence
  MKO10100923_B_Ndufa13
  gRNA
ccuccaaguccucaaucagc

SEQ ID NO: 100924 - RNA, 20 nt, Artificial Sequence
  MKO10100924_B_Ndufa1
  gRNA
cgccauuaugggggugugcu

SEQ ID NO: 100925 - RNA, 20 nt, Artificial Sequence
  MKO10100925_B_Ndufa1
  gRNA
ggccuggaaaacauugacua

SEQ ID NO: 100926 - RNA, 20 nt, Artificial Sequence
  MKO10100926_B_Ndufa1
  gRNA
uugcucguguucaguaccag

SEQ ID NO: 100927 - RNA, 20 nt, Artificial Sequence
  MKO10100927_B_Ndufa2
  gRNA
gcugcaccuccgagcauucg

SEQ ID NO: 100928 - RNA, 20 nt, Artificial Sequence
  MKO10100928_B_Ndufa2
  gRNA
ucagagacaccgucuucucu

SEQ ID NO: 100929 - RNA, 20 nt, Artificial Sequence
  MKO10100929_B_Ndufa2
  gRNA
gccgcuuagcacauucugca

SEQ ID NO: 100930 - RNA, 20 nt, Artificial Sequence
  MKO10100930_B_Ndufa3
  gRNA
cucuggguccaagcuuggac

SEQ ID NO: 100931 - RNA, 20 nt, Artificial Sequence
  MKO10100931_B_Ndufa3
  gRNA
cugccuuccucaagaaugcc

SEQ ID NO: 100932 - RNA, 20 nt, Artificial Sequence
  MKO10100932_B_Ndufa3
  gRNA
cugcucaccuggguaguugu

SEQ ID NO: 100933 - RNA, 20 nt, Artificial Sequence
  MKO10100933_B_Ndufa4l2
  gRNA
aagucgcagcaaguagaguc

SEQ ID NO: 100934 - RNA, 20 nt, Artificial Sequence
  MKO10100934_B_Ndufa4l2
  gRNA
cggcagauaaaaagacaccc

SEQ ID NO: 100935 - RNA, 20 nt, Artificial Sequence
  MKO10100935_B_Ndufa4l2
  gRNA
aagauggcaggaacuagucu

SEQ ID NO: 100936 - RNA, 20 nt, Artificial Sequence
  MKO10100936_B_Ndufa4
  gRNA
cacuguuuaauccagauguc

SEQ ID NO: 100937 - RNA, 20 nt, Artificial Sequence
  MKO10100937_B_Ndufa4
  gRNA
aacaugcuccgccagauccu

SEQ ID NO: 100938 - RNA, 20 nt, Artificial Sequence
  MKO10100938_B_Ndufa4
  gRNA
agcacuguaugugaugcgcu

SEQ ID NO: 100939 - RNA, 20 nt, Artificial Sequence
  MKO10100939_B_Ndufa5
  gRNA
gucauauuggccacuuccac

SEQ ID NO: 100940 - RNA, 20 nt, Artificial Sequence
  MKO10100940_B_Ndufa5
  gRNA
cacuucaccacccugaagca

SEQ ID NO: 100941 - RNA, 20 nt, Artificial Sequence
  MKO10100941_B_Ndufa5
  gRNA
acagaucaccaacgagaagc

SEQ ID NO: 100942 - RNA, 20 nt, Artificial Sequence
  MKO10100942_B_Ndufa6
  gRNA
gaccagcagaucaaccacuc

SEQ ID NO: 100943 - RNA, 20 nt, Artificial Sequence
  MKO10100943_B_Ndufa6
  gRNA
uuuagugcacuuaaugcagc

SEQ ID NO: 100944 - RNA, 20 nt, Artificial Sequence
  MKO10100944_B_Ndufa6
  gRNA
acagggaaagauggagcucc

SEQ ID NO: 100945 - RNA, 20 nt, Artificial Sequence
  MKO10100945_B_Ndufa7
  gRNA
cggcggccuugccugacacc

SEQ ID NO: 100946 - RNA, 20 nt, Artificial Sequence
  MKO10100946_B_Ndufa7
  gRNA
cucgcguuauccaaaagcug

SEQ ID NO: 100947 - RNA, 20 nt, Artificial Sequence
  MKO10100947_B_Ndufa7
  gRNA
acgcccaguuccgcagcuuu

SEQ ID NO: 100948 - RNA, 20 nt, Artificial Sequence
  MKO10100948_B_Ndufa8
  gRNA
cccaaggcgcugccugaagg

SEQ ID NO: 100949 - RNA, 20 nt, Artificial Sequence
  MKO10100949_B_Ndufa8
  gRNA
gaucugaaacccgccaagca

SEQ ID NO: 100950 - RNA, 20 nt, Artificial Sequence
  MKO10100950_B_Ndufa8
  gRNA
gugacgaaacagcugcaugu

SEQ ID NO: 100951 - RNA, 20 nt, Artificial Sequence
  MKO10100951_B_Ndufa9
  gRNA
ucaaucuuauugggcgggag

SEQ ID NO: 100952 - RNA, 20 nt, Artificial Sequence
  MKO10100952_B_Ndufa9
  gRNA
uauuccucgagcaauagcuc

SEQ ID NO: 100953 - RNA, 20 nt, Artificial Sequence
  MKO10100953_B_Ndufa9
  gRNA
cacaagugaucauaccauau

SEQ ID NO: 100954 - RNA, 20 nt, Artificial Sequence
  MKO10100954_B_Ndufab1
  gRNA
cuguguccgccgccugcccg

SEQ ID NO: 100955 - RNA, 20 nt, Artificial Sequence
  MKO10100955_B_Ndufab1
  gRNA
gcacccccacugacguuaga

SEQ ID NO: 100956 - RNA, 20 nt, Artificial Sequence
  MKO10100956_B_Ndufab1
  gRNA
cuuagacaguuuggaccaag

SEQ ID NO: 100957 - RNA, 20 nt, Artificial Sequence
  MKO10100957_B_Ndufaf1
  gRNA
aguuacuucauguucacccg

SEQ ID NO: 100958 - RNA, 20 nt, Artificial Sequence
  MKO10100958_B_Ndufaf1
  gRNA
aucaccuuguccaauacgag

SEQ ID NO: 100959 - RNA, 20 nt, Artificial Sequence
  MKO10100959_B_Ndufaf1
  gRNA
ggccuuggaugguaaauauc

SEQ ID NO: 100960 - RNA, 20 nt, Artificial Sequence
  MKO10100960_B_Ndufaf2
  gRNA
caggagacaucccaaccgag

SEQ ID NO: 100961 - RNA, 20 nt, Artificial Sequence
  MKO10100961_B_Ndufaf2
  gRNA
ggcagacuauucgagagaaa

SEQ ID NO: 100962 - RNA, 20 nt, Artificial Sequence
  MKO10100962_B_Ndufaf2
  gRNA
ugaaggcaagaguucuucac

SEQ ID NO: 100963 - RNA, 20 nt, Artificial Sequence
  MKO10100963_B_Ndufaf3
  gRNA
uccacccuuagagauuguug

SEQ ID NO: 100964 - RNA, 20 nt, Artificial Sequence
  MKO10100964_B_Ndufaf3
  gRNA
agcaauuccccgcugccuca

SEQ ID NO: 100965 - RNA, 20 nt, Artificial Sequence
  MKO10100965_B_Ndufaf3
  gRNA
cauacaggugggaucucauc

SEQ ID NO: 100966 - RNA, 20 nt, Artificial Sequence
  MKO10100966_B_Ndufaf4
  gRNA
aggcaagauuacuguuguag

SEQ ID NO: 100967 - RNA, 20 nt, Artificial Sequence
  MKO10100967_B_Ndufaf4
  gRNA
uuaucaaagugauuuccuau

SEQ ID NO: 100968 - RNA, 20 nt, Artificial Sequence
  MKO10100968_B_Ndufaf4
  gRNA
gaaacaacuucuucgauuuc

SEQ ID NO: 100969 - RNA, 20 nt, Artificial Sequence
  MKO10100969_B_Ndufaf5
  gRNA
caugcucugcaaugucuguu

SEQ ID NO: 100970 - RNA, 20 nt, Artificial Sequence
  MKO10100970_B_Ndufaf5
  gRNA
cucuuccacauccuaugucc

SEQ ID NO: 100971 - RNA, 20 nt, Artificial Sequence
  MKO10100971_B_Ndufaf5
  gRNA
cagagacuuuccccuugccc

SEQ ID NO: 100972 - RNA, 20 nt, Artificial Sequence
  MKO10100972_B_Ndufaf6
  gRNA
cugagccaguuccacauuga

SEQ ID NO: 100973 - RNA, 20 nt, Artificial Sequence
  MKO10100973_B_Ndufaf6
  gRNA
ugacaacccaccacaccagc

SEQ ID NO: 100974 - RNA, 20 nt, Artificial Sequence
  MKO10100974_B_Ndufaf6
  gRNA
gcaguucuggaaaaaagcug

SEQ ID NO: 100975 - RNA, 20 nt, Artificial Sequence
  MKO10100975_B_Ndufaf7
  gRNA
uacauaagaugccgcagcau

SEQ ID NO: 100976 - RNA, 20 nt, Artificial Sequence
  MKO10100976_B_Ndufaf7
  gRNA
ucagggauauuaugugcauc

SEQ ID NO: 100977 - RNA, 20 nt, Artificial Sequence
  MKO10100977_B_Ndufaf7
  gRNA
ugucauagcuacuaggggug

SEQ ID NO: 100978 - RNA, 20 nt, Artificial Sequence
  MKO10100978_B_Ndufb10
  gRNA
aucuuucagcaaaguugacc

SEQ ID NO: 100979 - RNA, 20 nt, Artificial Sequence
  MKO10100979_B_Ndufb10
  gRNA
cuauucugccagaaaguguc

SEQ ID NO: 100980 - RNA, 20 nt, Artificial Sequence
  MKO10100980_B_Ndufb10
  gRNA
guacugucggugguaguagu

SEQ ID NO: 100981 - RNA, 20 nt, Artificial Sequence
  MKO10100981_B_Ndufb11
  gRNA
uggcuuaugugccugauuac

SEQ ID NO: 100982 - RNA, 20 nt, Artificial Sequence
  MKO10100982_B_Ndufb11
  gRNA
auauuccagacguccaccac

SEQ ID NO: 100983 - RNA, 20 nt, Artificial Sequence
  MKO10100983_B_Ndufb11
  gRNA
guaagccaucagucaucuuc

SEQ ID NO: 100984 - RNA, 20 nt, Artificial Sequence
  MKO10100984_B_Ndufb2
  gRNA
uugucuuccagcgcuggcgg

SEQ ID NO: 100985 - RNA, 20 nt, Artificial Sequence
  MKO10100985_B_Ndufb2
  gRNA
uacauauucagccccgguac

SEQ ID NO: 100986 - RNA, 20 nt, Artificial Sequence
  MKO10100986_B_Ndufb2
  gRNA
cagugucaguccucgucauc

SEQ ID NO: 100987 - RNA, 20 nt, Artificial Sequence
  MKO10100987_B_Ndufb3
  gRNA
agauacaugggcggcuuugc

SEQ ID NO: 100988 - RNA, 20 nt, Artificial Sequence
  MKO10100988_B_Ndufb3
  gRNA
cccauggaucccucagcccu

SEQ ID NO: 100989 - RNA, 20 nt, Artificial Sequence
  MKO10100989_B_Ndufb3
  gRNA
uucuucugcaccguuucuaa

SEQ ID NO: 100990 - RNA, 20 nt, Artificial Sequence
  MKO10100990_B_Ndufb4
  gRNA
aaacauaauaccagaagaug

SEQ ID NO: 100991 - RNA, 20 nt, Artificial Sequence
  MKO10100991_B_Ndufb4
  gRNA
cagaaaggaaagacuuaucc

SEQ ID NO: 100992 - RNA, 20 nt, Artificial Sequence
  MKO10100992_B_Ndufb4
  gRNA
ugccgaguaugacgugucuc

SEQ ID NO: 100993 - RNA, 20 nt, Artificial Sequence
  MKO10100993_B_Ndufb5
  gRNA
acuaugacgcucgcuucuug

SEQ ID NO: 100994 - RNA, 20 nt, Artificial Sequence
  MKO10100994_B_Ndufb5
  gRNA
ugaacacugggaguauuaca

SEQ ID NO: 100995 - RNA, 20 nt, Artificial Sequence
  MKO10100995_B_Ndufb5
  gRNA
aaauucuaccuuauguugac

SEQ ID NO: 100996 - RNA, 20 nt, Artificial Sequence
  MKO10100996_B_Ndufb6
  gRNA
uucgagcuaacaauggugua

SEQ ID NO: 100997 - RNA, 20 nt, Artificial Sequence
  MKO10100997_B_Ndufb6
  gRNA
ccauuguuagcucgaagccc

SEQ ID NO: 100998 - RNA, 20 nt, Artificial Sequence
  MKO10100998_B_Ndufb6
  gRNA
uaauagugaacaaaccacau

SEQ ID NO: 100999 - RNA, 20 nt, Artificial Sequence
  MKO10100999_B_Ndufb7
  gRNA
ucaccucgcuccuugcgcuc

SEQ ID NO: 101000 - RNA, 20 nt, Artificial Sequence
  MKO10101000_B_Ndufb7
  gRNA
gcaagcacgagcagcacgac

SEQ ID NO: 101001 - RNA, 20 nt, Artificial Sequence
  MKO10101001_B_Ndufb7
  gRNA
aaucccuacagggccaccuc

SEQ ID NO: 101002 - RNA, 20 nt, Artificial Sequence
  MKO10101002_B_Ndufb8
  gRNA
ccaaccgaucacagcaugag

SEQ ID NO: 101003 - RNA, 20 nt, Artificial Sequence
  MKO10101003_B_Ndufb8
  gRNA
uuauuguaaggguacugcuu

SEQ ID NO: 101004 - RNA, 20 nt, Artificial Sequence
  MKO10101004_B_Ndufb8
  gRNA
gaucccucucaugcugugau

SEQ ID NO: 101005 - RNA, 20 nt, Artificial Sequence
  MKO10101005_B_Ndufb9
  gRNA
gcuucagucauaauaccauc

SEQ ID NO: 101006 - RNA, 20 nt, Artificial Sequence
  MKO10101006_B_Ndufb9
  gRNA
cuucuagguuaagcagcugc

SEQ ID NO: 101007 - RNA, 20 nt, Artificial Sequence
  MKO10101007_B_Ndufb9
  gRNA
uguggauacaccaugacucg

SEQ ID NO: 101008 - RNA, 20 nt, Artificial Sequence
  MKO10101008_B_Ndufc1
  gRNA
acucacagcagcucggcagc

SEQ ID NO: 101009 - RNA, 20 nt, Artificial Sequence
  MKO10101009_B_Ndufc1
  gRNA
guauaaaagaagaaauggau

SEQ ID NO: 101010 - RNA, 20 nt, Artificial Sequence
  MKO10101010_B_Ndufc1
  gRNA
aacacacaaugaagauguuu

SEQ ID NO: 101011 - RNA, 20 nt, Artificial Sequence
  MKO10101011_B_Ndufc2
  gRNA
acguaacgaacagaagcugg

SEQ ID NO: 101012 - RNA, 20 nt, Artificial Sequence
  MKO10101012_B_Ndufc2
  gRNA
uggcucaagaauuucagcau

SEQ ID NO: 101013 - RNA, 20 nt, Artificial Sequence
  MKO10101013_B_Ndufc2
  gRNA
gccucaagaugaugaacggc

SEQ ID NO: 101014 - RNA, 20 nt, Artificial Sequence
  MKO10101014_B_Ndufs1
  gRNA
ugucuucuaggcuugcgaga

SEQ ID NO: 101015 - RNA, 20 nt, Artificial Sequence
  MKO10101015_B_Ndufs1
  gRNA
cucgauucuguuaccaugaa

SEQ ID NO: 101016 - RNA, 20 nt, Artificial Sequence
  MKO10101016_B_Ndufs1
  gRNA
auauuccagcccuucauuac

SEQ ID NO: 101017 - RNA, 20 nt, Artificial Sequence
  MKO10101017_B_Ndufs2
  gRNA
cuucuccacagcuaucgaau

SEQ ID NO: 101018 - RNA, 20 nt, Artificial Sequence
  MKO10101018_B_Ndufs2
  gRNA
uccccagaggugcucggcag

SEQ ID NO: 101019 - RNA, 20 nt, Artificial Sequence
  MKO10101019_B_Ndufs2
  gRNA
ucaguuccagcacgagucuc

SEQ ID NO: 101020 - RNA, 20 nt, Artificial Sequence
  MKO10101020_B_Ndufs3
  gRNA
uuccagccacugucagaccc

SEQ ID NO: 101021 - RNA, 20 nt, Artificial Sequence
  MKO10101021_B_Ndufs3
  gRNA
caccucccucucauaccaau

SEQ ID NO: 101022 - RNA, 20 nt, Artificial Sequence
  MKO10101022_B_Ndufs3
  gRNA
aguugaaccgcagagacagc

SEQ ID NO: 101023 - RNA, 20 nt, Artificial Sequence
  MKO10101023_B_Ndufs4
  gRNA
uaagcugugugucccgaguc

SEQ ID NO: 101024 - RNA, 20 nt, Artificial Sequence
  MKO10101024_B_Ndufs4
  gRNA
aaaguuugcaccauaagacu

SEQ ID NO: 101025 - RNA, 20 nt, Artificial Sequence
  MKO10101025_B_Ndufs4
  gRNA
cgcugacccccucuccaaca

SEQ ID NO: 101026 - RNA, 20 nt, Artificial Sequence
  MKO10101026_B_Ndufs5
  gRNA
agcugccccgcucagggccu

SEQ ID NO: 101027 - RNA, 20 nt, Artificial Sequence
  MKO10101027_B_Ndufs5
  gRNA
gccacgcauuugaaaaagag

SEQ ID NO: 101028 - RNA, 20 nt, Artificial Sequence
  MKO10101028_B_Ndufs5
  gRNA
ccuugacauacagaaaaagc

SEQ ID NO: 101029 - RNA, 20 nt, Artificial Sequence
  MKO10101029_B_Ndufs6
  gRNA
cggugcuccaccucauucac

SEQ ID NO: 101030 - RNA, 20 nt, Artificial Sequence
  MKO10101030_B_Ndufs6
  gRNA
ucaggacaaagaaacaaaaa

SEQ ID NO: 101031 - RNA, 20 nt, Artificial Sequence
  MKO10101031_B_Ndufs6
  gRNA
uguaugaugaaaaagacuac

SEQ ID NO: 101032 - RNA, 20 nt, Artificial Sequence
  MKO10101032_B_Ndufs7
  gRNA
cccggcgugcccaguugaug

SEQ ID NO: 101033 - RNA, 20 nt, Artificial Sequence
  MKO10101033_B_Ndufs7
  gRNA
gacacacucaccgcagaccc

SEQ ID NO: 101034 - RNA, 20 nt, Artificial Sequence
  MKO10101034_B_Ndufs7
  gRNA
gcucgggcucgggcccucag

SEQ ID NO: 101035 - RNA, 20 nt, Artificial Sequence
  MKO10101035_B_Ndufs8
  gRNA
ccuucaggccaucaccauug

SEQ ID NO: 101036 - RNA, 20 nt, Artificial Sequence
  MKO10101036_B_Ndufs8
  gRNA
ccgccacugcgcugcuauga

SEQ ID NO: 101037 - RNA, 20 nt, Artificial Sequence
  MKO10101037_B_Ndufs8
  gRNA
ccgcaacugacaaugcagcu

SEQ ID NO: 101038 - RNA, 20 nt, Artificial Sequence
  MKO10101038_B_Ndufv1
  gRNA
gccgccuauaucuacauccg

SEQ ID NO: 101039 - RNA, 20 nt, Artificial Sequence
  MKO10101039_B_Ndufv1
  gRNA
uguaccagucaccccgucuc

SEQ ID NO: 101040 - RNA, 20 nt, Artificial Sequence
  MKO10101040_B_Ndufv1
  gRNA
gccaaucagaccugcuucau

SEQ ID NO: 101041 - RNA, 20 nt, Artificial Sequence
  MKO10101041_B_Ndufv2
  gRNA
gugaaaucaaauggaguauc

SEQ ID NO: 101042 - RNA, 20 nt, Artificial Sequence
  MKO10101042_B_Ndufv2
  gRNA
auucaauaccuuguucauag

SEQ ID NO: 101043 - RNA, 20 nt, Artificial Sequence
  MKO10101043_B_Ndufv2
  gRNA
ucgcccaaaggcagaaugga

SEQ ID NO: 101044 - RNA, 20 nt, Artificial Sequence
  MKO10101044_B_Ndufv3
  gRNA
cuucaggacgagagucaccu

SEQ ID NO: 101045 - RNA, 20 nt, Artificial Sequence
  MKO10101045_B_Ndufv3
  gRNA
ucucguccugaagacggcug

SEQ ID NO: 101046 - RNA, 20 nt, Artificial Sequence
  MKO10101046_B_Ndufv3
  gRNA
aaggguguucccgggagaac

SEQ ID NO: 101047 - RNA, 20 nt, Artificial Sequence
  MKO10101047_B_Nebl
  gRNA
ccacugcgaggucugcaaga

SEQ ID NO: 101048 - RNA, 20 nt, Artificial Sequence
  MKO10101048_B_Nebl
  gRNA
uucagguguauccgccacug

SEQ ID NO: 101049 - RNA, 20 nt, Artificial Sequence
  MKO10101049_B_Nebl
  gRNA
gcaguucacuuugcugcuuc

SEQ ID NO: 101050 - RNA, 20 nt, Artificial Sequence
  MKO10101050_B_Neb
  gRNA
ucugcagguuaaguaucgaa

SEQ ID NO: 101051 - RNA, 20 nt, Artificial Sequence
  MKO10101051_B_Neb
  gRNA
ccaccucacugaguugaucc

SEQ ID NO: 101052 - RNA, 20 nt, Artificial Sequence
  MKO10101052_B_Neb
  gRNA
acaguuuacgaagaggugcc

SEQ ID NO: 101053 - RNA, 20 nt, Artificial Sequence
  MKO10101053_B_Necab1
  gRNA
cuugguauugugugugucaa

SEQ ID NO: 101054 - RNA, 20 nt, Artificial Sequence
  MKO10101054_B_Necab1
  gRNA
gagauucaggucuucaagug

SEQ ID NO: 101055 - RNA, 20 nt, Artificial Sequence
  MKO10101055_B_Necab1
  gRNA
cugaggagagcagacaaaaa

SEQ ID NO: 101056 - RNA, 20 nt, Artificial Sequence
  MKO10101056_B_Necab2
  gRNA
uccugccccagacuacuuug

SEQ ID NO: 101057 - RNA, 20 nt, Artificial Sequence
  MKO10101057_B_Necab2
  gRNA
uuucaacucuucuucgcaga

SEQ ID NO: 101058 - RNA, 20 nt, Artificial Sequence
  MKO10101058_B_Necab2
  gRNA
guaccuaccacacaguuccu

SEQ ID NO: 101059 - RNA, 20 nt, Artificial Sequence
  MKO10101059_B_Necab3
  gRNA
uucucagcucugcggagcug

SEQ ID NO: 101060 - RNA, 20 nt, Artificial Sequence
  MKO10101060_B_Necab3
  gRNA
uuccgaagagcagacaaaaa

SEQ ID NO: 101061 - RNA, 20 nt, Artificial Sequence
  MKO10101061_B_Necab3
  gRNA
uuagagacagagaaacugug

SEQ ID NO: 101062 - RNA, 20 nt, Artificial Sequence
  MKO10101062_B_Necap1
  gRNA
ccugaucacaaaguagcggc

SEQ ID NO: 101063 - RNA, 20 nt, Artificial Sequence
  MKO10101063_B_Necap1
  gRNA
aauggauaaucgucccaagu

SEQ ID NO: 101064 - RNA, 20 nt, Artificial Sequence
  MKO10101064_B_Necap1
  gRNA
uccccaaagguggguaaagc

SEQ ID NO: 101065 - RNA, 20 nt, Artificial Sequence
  MKO10101065_B_Necap2
  gRNA
uucgucauccgaauugaaga

SEQ ID NO: 101066 - RNA, 20 nt, Artificial Sequence
  MKO10101066_B_Necap2
  gRNA
cacugcgauguugaucuuga

SEQ ID NO: 101067 - RNA, 20 nt, Artificial Sequence
  MKO10101067_B_Necap2
  gRNA
ugacuucaacguggcauuac

SEQ ID NO: 101068 - RNA, 20 nt, Artificial Sequence
  MKO10101068_B_Nedd1
  gRNA
ucuuacuugaaguaucauag

SEQ ID NO: 101069 - RNA, 20 nt, Artificial Sequence
  MKO10101069_B_Nedd1
  gRNA
aggugugcuggauguauuag

SEQ ID NO: 101070 - RNA, 20 nt, Artificial Sequence
  MKO10101070_B_Nedd1
  gRNA
ggcuuuguguguacugucaa

SEQ ID NO: 101071 - RNA, 20 nt, Artificial Sequence
  MKO10101071_B_Nedd4l
  gRNA
agcgucggugugcagccucc

SEQ ID NO: 101072 - RNA, 20 nt, Artificial Sequence
  MKO10101072_B_Nedd4l
  gRNA
agccucaccuucuaggucgc

SEQ ID NO: 101073 - RNA, 20 nt, Artificial Sequence
  MKO10101073_B_Nedd4l
  gRNA
guacucacaucaagcugggu

SEQ ID NO: 101074 - RNA, 20 nt, Artificial Sequence
  MKO10101074_B_Nedd4
  gRNA
aacauacguuguggagcucc

SEQ ID NO: 101075 - RNA, 20 nt, Artificial Sequence
  MKO10101075_B_Nedd4
  gRNA
ggcucccaagaugucuuucu

SEQ ID NO: 101076 - RNA, 20 nt, Artificial Sequence
  MKO10101076_B_Nedd4
  gRNA
ccuggccaagaaagacaucu

SEQ ID NO: 101077 - RNA, 20 nt, Artificial Sequence
  MKO10101077_B_Nedd8
  gRNA
gcagcugauuacaagauucu

SEQ ID NO: 101078 - RNA, 20 nt, Artificial Sequence
  MKO10101078_B_Nedd8
  gRNA
accugacucaccuugucugu

SEQ ID NO: 101079 - RNA, 20 nt, Artificial Sequence
  MKO10101079_B_Nedd8
  gRNA
gaagaugcuaauuaaaguga

SEQ ID NO: 101080 - RNA, 20 nt, Artificial Sequence
  MKO10101080_B_Nedd9
  gRNA
ggacaucguagacauccuuu

SEQ ID NO: 101081 - RNA, 20 nt, Artificial Sequence
  MKO10101081_B_Nedd9
  gRNA
ggaaugucauauaccccuug

SEQ ID NO: 101082 - RNA, 20 nt, Artificial Sequence
  MKO10101082_B_Nedd9
  gRNA
aguaggcugcucaugaccgg

SEQ ID NO: 101083 - RNA, 20 nt, Artificial Sequence
  MKO10101083_B_Nefh
  gRNA
gaagagugucggauuggcuu

SEQ ID NO: 101084 - RNA, 20 nt, Artificial Sequence
  MKO10101084_B_Nefh
  gRNA
gagguuggaccgacucucag

SEQ ID NO: 101085 - RNA, 20 nt, Artificial Sequence
  MKO10101085_B_Nefh
  gRNA
acauugagauugccgcuuac

SEQ ID NO: 101086 - RNA, 20 nt, Artificial Sequence
  MKO10101086_B_Nefl
  gRNA
cuacuauaccagccacgucc

SEQ ID NO: 101087 - RNA, 20 nt, Artificial Sequence
  MKO10101087_B_Nefl
  gRNA
acaucgagauugcagcuuac

SEQ ID NO: 101088 - RNA, 20 nt, Artificial Sequence
  MKO10101088_B_Nefl
  gRNA
agcugcaaucucgaugucca

SEQ ID NO: 101089 - RNA, 20 nt, Artificial Sequence
  MKO10101089_B_Nefm
  gRNA
agcaccaucgccccccucgc

SEQ ID NO: 101090 - RNA, 20 nt, Artificial Sequence
  MKO10101090_B_Nefm
  gRNA
agggagugaccguagcccgc

SEQ ID NO: 101091 - RNA, 20 nt, Artificial Sequence
  MKO10101091_B_Nefm
  gRNA
acaucgagaucgccgcguac

SEQ ID NO: 101092 - RNA, 20 nt, Artificial Sequence
  MKO10101092_B_Negr1
  gRNA
agaugaaccugcauuguccg

SEQ ID NO: 101093 - RNA, 20 nt, Artificial Sequence
  MKO10101093_B_Negr1
  gRNA
acucucacuuucuucacguc

SEQ ID NO: 101094 - RNA, 20 nt, Artificial Sequence
  MKO10101094_B_Negr1
  gRNA
caaugucacccuuacuuguu

SEQ ID NO: 101095 - RNA, 20 nt, Artificial Sequence
  MKO10101095_B_Neil1
  gRNA
auggcauuggcaacuaucug

SEQ ID NO: 101096 - RNA, 20 nt, Artificial Sequence
  MKO10101096_B_Neil1
  gRNA
ucaccggccggcacuguugc

SEQ ID NO: 101097 - RNA, 20 nt, Artificial Sequence
  MKO10101097_B_Neil1
  gRNA
acuguacgagccuucucaaa

SEQ ID NO: 101098 - RNA, 20 nt, Artificial Sequence
  MKO10101098_B_Neil2
  gRNA
gccagaagguggucaagacg

SEQ ID NO: 101099 - RNA, 20 nt, Artificial Sequence
  MKO10101099_B_Neil2
  gRNA
ucugcugaaacauauaaucu

SEQ ID NO: 101100 - RNA, 20 nt, Artificial Sequence
  MKO10101100_B_Neil2
  gRNA
cagcagcccacagccuauac

SEQ ID NO: 101101 - RNA, 20 nt, Artificial Sequence
  MKO10101101_B_Neil3
  gRNA
uuuaucuuaccguaaagcuc

SEQ ID NO: 101102 - RNA, 20 nt, Artificial Sequence
  MKO10101102_B_Neil3
  gRNA
ggcugcuccaaugaaugcua

SEQ ID NO: 101103 - RNA, 20 nt, Artificial Sequence
  MKO10101103_B_Neil3
  gRNA
gcuccaucuugauuaaccca

SEQ ID NO: 101104 - RNA, 20 nt, Artificial Sequence
  MKO10101104_B_Nek10
  gRNA
ucaagagaucuucacagcuc

SEQ ID NO: 101105 - RNA, 20 nt, Artificial Sequence
  MKO10101105_B_Nek10
  gRNA
guucaaccaaccugauaaca

SEQ ID NO: 101106 - RNA, 20 nt, Artificial Sequence
  MKO10101106_B_Nek10
  gRNA
cguucagucaagcaaacagc

SEQ ID NO: 101107 - RNA, 20 nt, Artificial Sequence
  MKO10101107_B_Nek11
  gRNA
aaauccaaaugagaccgugc

SEQ ID NO: 101108 - RNA, 20 nt, Artificial Sequence
  MKO10101108_B_Nek11
  gRNA
gaguugacuacaugcaugag

SEQ ID NO: 101109 - RNA, 20 nt, Artificial Sequence
  MKO10101109_B_Nek11
  gRNA
uggcuacagaaagguacuga

SEQ ID NO: 101110 - RNA, 20 nt, Artificial Sequence
  MKO10101110_B_Nek1
  gRNA
acagugcagcuuggagauuu

SEQ ID NO: 101111 - RNA, 20 nt, Artificial Sequence
  MKO10101111_B_Nek1
  gRNA
ucaccgagacauaaagucac

SEQ ID NO: 101112 - RNA, 20 nt, Artificial Sequence
  MKO10101112_B_Nek1
  gRNA
auaccugugacuuuaugucu

SEQ ID NO: 101113 - RNA, 20 nt, Artificial Sequence
  MKO10101113_B_Nek2
  gRNA
cacaacccuguacaucguaa

SEQ ID NO: 101114 - RNA, 20 nt, Artificial Sequence
  MKO10101114_B_Nek2
  gRNA
ucaacugagucaucacucga

SEQ ID NO: 101115 - RNA, 20 nt, Artificial Sequence
  MKO10101115_B_Nek2
  gRNA
aauucagcauccgagugaug

SEQ ID NO: 101116 - RNA, 20 nt, Artificial Sequence
  MKO10101116_B_Nek3
  gRNA
aauacuccaucacaauguac

SEQ ID NO: 101117 - RNA, 20 nt, Artificial Sequence
  MKO10101117_B_Nek3
  gRNA
agcccuggccaaucacucuc

SEQ ID NO: 101118 - RNA, 20 nt, Artificial Sequence
  MKO10101118_B_Nek3
  gRNA
uuuccuuacagauacuuaau

SEQ ID NO: 101119 - RNA, 20 nt, Artificial Sequence
  MKO10101119_B_Nek4
  gRNA
gcgaaggaggugaucuguac

SEQ ID NO: 101120 - RNA, 20 nt, Artificial Sequence
  MKO10101120_B_Nek4
  gRNA
uugcauuaaaagcgugcuuc

SEQ ID NO: 101121 - RNA, 20 nt, Artificial Sequence
  MKO10101121_B_Nek4
  gRNA
cgcacagagggccucuccuc

SEQ ID NO: 101122 - RNA, 20 nt, Artificial Sequence
  MKO10101122_B_Nek5
  gRNA
accuucuucagcucguuuca

SEQ ID NO: 101123 - RNA, 20 nt, Artificial Sequence
  MKO10101123_B_Nek5
  gRNA
agugauguucagcgaagacc

SEQ ID NO: 101124 - RNA, 20 nt, Artificial Sequence
  MKO10101124_B_Nek5
  gRNA
accuugaaacgagcugaaga

SEQ ID NO: 101125 - RNA, 20 nt, Artificial Sequence
  MKO10101125_B_Nek6
  gRNA
uccgaauaucaucaaguauc

SEQ ID NO: 101126 - RNA, 20 nt, Artificial Sequence
  MKO10101126_B_Nek6
  gRNA
ccagugagcagcgaaaagac

SEQ ID NO: 101127 - RNA, 20 nt, Artificial Sequence
  MKO10101127_B_Nek6
  gRNA
acaguucagugagguuuaca

SEQ ID NO: 101128 - RNA, 20 nt, Artificial Sequence
  MKO10101128_B_Nek7
  gRNA
ugaccucuccagaaugauaa

SEQ ID NO: 101129 - RNA, 20 nt, Artificial Sequence
  MKO10101129_B_Nek7
  gRNA
cugaacgaaguauuuccaaa

SEQ ID NO: 101130 - RNA, 20 nt, Artificial Sequence
  MKO10101130_B_Nek7
  gRNA
aaaguauuauagcccauauc

SEQ ID NO: 101131 - RNA, 20 nt, Artificial Sequence
  MKO10101131_B_Nek8
  gRNA
uguacucacugcagccucga

SEQ ID NO: 101132 - RNA, 20 nt, Artificial Sequence
  MKO10101132_B_Nek8
  gRNA
gcgcugcaacucucugcuag

SEQ ID NO: 101133 - RNA, 20 nt, Artificial Sequence
  MKO10101133_B_Nek8
  gRNA
caugcgcacgcugcccacau

SEQ ID NO: 101134 - RNA, 20 nt, Artificial Sequence
  MKO10101134_B_Nek9
  gRNA
aguacuccagcucaaucagc

SEQ ID NO: 101135 - RNA, 20 nt, Artificial Sequence
  MKO10101135_B_Nek9
  gRNA
acuuaauucugaguacucua

SEQ ID NO: 101136 - RNA, 20 nt, Artificial Sequence
  MKO10101136_B_Nek9
  gRNA
cugcugaaacaaucugaaaa

SEQ ID NO: 101137 - RNA, 20 nt, Artificial Sequence
  MKO10101137_B_Nelfa
  gRNA
ggacuccaauaccaccuucg

SEQ ID NO: 101138 - RNA, 20 nt, Artificial Sequence
  MKO10101138_B_Nelfa
  gRNA
cagcaguucugcccgcagcg

SEQ ID NO: 101139 - RNA, 20 nt, Artificial Sequence
  MKO10101139_B_Nelfa
  gRNA
uuuagcugaaaaugcuugac

SEQ ID NO: 101140 - RNA, 20 nt, Artificial Sequence
  MKO10101140_B_Nelfb
  gRNA
ugucccguguagauccaaga

SEQ ID NO: 101141 - RNA, 20 nt, Artificial Sequence
  MKO10101141_B_Nelfb
  gRNA
uggcugacaaggaguuguac

SEQ ID NO: 101142 - RNA, 20 nt, Artificial Sequence
  MKO10101142_B_Nelfb
  gRNA
ucugugcagguacaagaagc

SEQ ID NO: 101143 - RNA, 20 nt, Artificial Sequence
  MKO10101143_B_Nelfcd
  gRNA
agcaucguccucuccuucuc

SEQ ID NO: 101144 - RNA, 20 nt, Artificial Sequence
  MKO10101144_B_Nelfcd
  gRNA
cccaggcguugagccugugc

SEQ ID NO: 101145 - RNA, 20 nt, Artificial Sequence
  MKO10101145_B_Nelfcd
  gRNA
agaugaucgcacacacaaca

SEQ ID NO: 101146 - RNA, 20 nt, Artificial Sequence
  MKO10101146_B_Nelfe
  gRNA
gcuguggcaguguccaccac

SEQ ID NO: 101147 - RNA, 20 nt, Artificial Sequence
  MKO10101147_B_Nelfe
  gRNA
agccauccagacguccccag

SEQ ID NO: 101148 - RNA, 20 nt, Artificial Sequence
  MKO10101148_B_Nelfe
  gRNA
caucagcagacaugcuccuc

SEQ ID NO: 101149 - RNA, 20 nt, Artificial Sequence
  MKO10101149_B_Nell1
  gRNA
uacuccaugucgacugcaau

SEQ ID NO: 101150 - RNA, 20 nt, Artificial Sequence
  MKO10101150_B_Nell1
  gRNA
gggcaacguaaucaaaagca

SEQ ID NO: 101151 - RNA, 20 nt, Artificial Sequence
  MKO10101151_B_Nell1
  gRNA
cagccaccugagugacgccc

SEQ ID NO: 101152 - RNA, 20 nt, Artificial Sequence
  MKO10101152_B_Nell2
  gRNA
ggauaacucccgaauuuaag

SEQ ID NO: 101153 - RNA, 20 nt, Artificial Sequence
  MKO10101153_B_Nell2
  gRNA
uuucaggaucuaugaacgag

SEQ ID NO: 101154 - RNA, 20 nt, Artificial Sequence
  MKO10101154_B_Nell2
  gRNA
ggugagugccagagcgguag

SEQ ID NO: 101155 - RNA, 20 nt, Artificial Sequence
  MKO10101155_B_Nemf
  gRNA
aguaaacaacguuuaugaug

SEQ ID NO: 101156 - RNA, 20 nt, Artificial Sequence
  MKO10101156_B_Nemf
  gRNA
uaaucauugagcucuaugac

SEQ ID NO: 101157 - RNA, 20 nt, Artificial Sequence
  MKO10101157_B_Nemf
  gRNA
accuucauggcaaaacucga

SEQ ID NO: 101158 - RNA, 20 nt, Artificial Sequence
  MKO10101158_B_Nenf
  gRNA
agcccgaaggauccucaacg

SEQ ID NO: 101159 - RNA, 20 nt, Artificial Sequence
  MKO10101159_B_Nenf
  gRNA
ggaggaucagcccaucuacu

SEQ ID NO: 101160 - RNA, 20 nt, Artificial Sequence
  MKO10101160_B_Nenf
  gRNA
gugguguucgaugucaccuc

SEQ ID NO: 101161 - RNA, 20 nt, Artificial Sequence
  MKO10101161_B_Neo1
  gRNA
gguuccaagauuauccacag

SEQ ID NO: 101162 - RNA, 20 nt, Artificial Sequence
  MKO10101162_B_Neo1
  gRNA
cuugcuagcaggagguugcu

SEQ ID NO: 101163 - RNA, 20 nt, Artificial Sequence
  MKO10101163_B_Neo1
  gRNA
uccugaggaaauuguagacu

SEQ ID NO: 101164 - RNA, 20 nt, Artificial Sequence
  MKO10101164_B_Nepn
  gRNA
cuugcagucuccuacgagcc

SEQ ID NO: 101165 - RNA, 20 nt, Artificial Sequence
  MKO10101165_B_Nepn
  gRNA
caauguugucagcuuguucg

SEQ ID NO: 101166 - RNA, 20 nt, Artificial Sequence
  MKO10101166_B_Nepn
  gRNA
ucaagcuucuguaaccucga

SEQ ID NO: 101167 - RNA, 20 nt, Artificial Sequence
  MKO10101167_B_Nes
  gRNA
caggcagcgcuaacaguccc

SEQ ID NO: 101168 - RNA, 20 nt, Artificial Sequence
  MKO10101168_B_Nes
  gRNA
gagucagaucgcucagaucc

SEQ ID NO: 101169 - RNA, 20 nt, Artificial Sequence
  MKO10101169_B_Nes
  gRNA
aacucucgcuugcagacacc

SEQ ID NO: 101170 - RNA, 20 nt, Artificial Sequence
  MKO10101170_B_Net1
  gRNA
caaagcugaccuucgugcag

SEQ ID NO: 101171 - RNA, 20 nt, Artificial Sequence
  MKO10101171_B_Net1
  gRNA
ucuagcucgggucacaucuu

SEQ ID NO: 101172 - RNA, 20 nt, Artificial Sequence
  MKO10101172_B_Net1
  gRNA
uggaccugcugaaugacuuc

SEQ ID NO: 101173 - RNA, 20 nt, Artificial Sequence
  MKO10101173_B_Neto1
  gRNA
uuaaucauccuccauucuuc

SEQ ID NO: 101174 - RNA, 20 nt, Artificial Sequence
  MKO10101174_B_Neto1
  gRNA
gagugugucuacaucauaga

SEQ ID NO: 101175 - RNA, 20 nt, Artificial Sequence
  MKO10101175_B_Neto1
  gRNA
gcaaugguuucaaaacucca

SEQ ID NO: 101176 - RNA, 20 nt, Artificial Sequence
  MKO10101176_B_Neto2
  gRNA
gcugauaacaguacuugucg

SEQ ID NO: 101177 - RNA, 20 nt, Artificial Sequence
  MKO10101177_B_Neto2
  gRNA
ccuccaagguaaguaaaguc

SEQ ID NO: 101178 - RNA, 20 nt, Artificial Sequence
  MKO10101178_B_Neto2
  gRNA
auuuggguucgaaccagcaa

SEQ ID NO: 101179 - RNA, 20 nt, Artificial Sequence
  MKO10101179_B_Neu1
  gRNA
auaacuaccauugccgcugc

SEQ ID NO: 101180 - RNA, 20 nt, Artificial Sequence
  MKO10101180_B_Neu1
  gRNA
acagccuucaucguagacga

SEQ ID NO: 101181 - RNA, 20 nt, Artificial Sequence
  MKO10101181_B_Neu1
  gRNA
ccuccucauggcgaugaacu

SEQ ID NO: 101182 - RNA, 20 nt, Artificial Sequence
  MKO10101182_B_Neu2
  gRNA
ugcgugcucauccgucuugc

SEQ ID NO: 101183 - RNA, 20 nt, Artificial Sequence
  MKO10101183_B_Neu2
  gRNA
cugaacuuaccggaaaacca

SEQ ID NO: 101184 - RNA, 20 nt, Artificial Sequence
  MKO10101184_B_Neu2
  gRNA
ugacaguccaaccuucucca

SEQ ID NO: 101185 - RNA, 20 nt, Artificial Sequence
  MKO10101185_B_Neu3
  gRNA
gcggaccucagucagagaug

SEQ ID NO: 101186 - RNA, 20 nt, Artificial Sequence
  MKO10101186_B_Neu3
  gRNA
gcccacgguucaagauccac

SEQ ID NO: 101187 - RNA, 20 nt, Artificial Sequence
  MKO10101187_B_Neu3
  gRNA
accuaggcaucuacuacaac

SEQ ID NO: 101188 - RNA, 20 nt, Artificial Sequence
  MKO10101188_B_Neu4
  gRNA
gcgugccccuccguagcacc

SEQ ID NO: 101189 - RNA, 20 nt, Artificial Sequence
  MKO10101189_B_Neu4
  gRNA
uccacccucaaucgagccuc

SEQ ID NO: 101190 - RNA, 20 nt, Artificial Sequence
  MKO10101190_B_Neu4
  gRNA
cuugccaguggcgauuugca

SEQ ID NO: 101191 - RNA, 20 nt, Artificial Sequence
  MKO10101191_B_Neurl1a
  gRNA
uggacgucuacggccucacg

SEQ ID NO: 101192 - RNA, 20 nt, Artificial Sequence
  MKO10101192_B_Neurl1a
  gRNA
gcagcuggacaccccgcgug

SEQ ID NO: 101193 - RNA, 20 nt, Artificial Sequence
  MKO10101193_B_Neurl1a
  gRNA
agccccccaccugacagcgu

SEQ ID NO: 101194 - RNA, 20 nt, Artificial Sequence
  MKO10101194_B_Neurl1b
  gRNA
cagcucguuguugucgaagu

SEQ ID NO: 101195 - RNA, 20 nt, Artificial Sequence
  MKO10101195_B_Neurl1b
  gRNA
uucuccgcacccgagccgac

SEQ ID NO: 101196 - RNA, 20 nt, Artificial Sequence
  MKO10101196_B_Neurl1b
  gRNA
cacagugugcuucgacagcg

SEQ ID NO: 101197 - RNA, 20 nt, Artificial Sequence
  MKO10101197_B_Neurl2
  gRNA
gaugugcuccaccugcccaa

SEQ ID NO: 101198 - RNA, 20 nt, Artificial Sequence
  MKO10101198_B_Neurl2
  gRNA
uuccaccaagagcgugcguc

SEQ ID NO: 101199 - RNA, 20 nt, Artificial Sequence
  MKO10101199_B_Neurl2
  gRNA
cgcguggagaguuucgccca

SEQ ID NO: 101200 - RNA, 20 nt, Artificial Sequence
  MKO10101200_B_Neurl3
  gRNA
uccagagggcuucguucgug

SEQ ID NO: 101201 - RNA, 20 nt, Artificial Sequence
  MKO10101201_B_Neurl3
  gRNA
aggcucaccacuacgaaucc

SEQ ID NO: 101202 - RNA, 20 nt, Artificial Sequence
  MKO10101202_B_Neurl3
  gRNA
uagaucccaaagccaacgcc

SEQ ID NO: 101203 - RNA, 20 nt, Artificial Sequence
  MKO10101203_B_Neurl4
  gRNA
aacagccuugauucgcauaa

SEQ ID NO: 101204 - RNA, 20 nt, Artificial Sequence
  MKO10101204_B_Neurl4
  gRNA
ugcuacagacuuugccagua

SEQ ID NO: 101205 - RNA, 20 nt, Artificial Sequence
  MKO10101205_B_Neurl4
  gRNA
gucuccggccgugccugcgc

SEQ ID NO: 101206 - RNA, 20 nt, Artificial Sequence
  MKO10101206_B_Neurod1
  gRNA
ugaaggccaacgcccgcgag

SEQ ID NO: 101207 - RNA, 20 nt, Artificial Sequence
  MKO10101207_B_Neurod1
  gRNA
ugacucgcucaugaugcgaa

SEQ ID NO: 101208 - RNA, 20 nt, Artificial Sequence
  MKO10101208_B_Neurod1
  gRNA
gcacuacccugcagcgacgc

SEQ ID NO: 101209 - RNA, 20 nt, Artificial Sequence
  MKO10101209_B_Neurod2
  gRNA
gacggcgccggccgcuuuca

SEQ ID NO: 101210 - RNA, 20 nt, Artificial Sequence
  MKO10101210_B_Neurod2
  gRNA
ggagcgcuccagacgcgccu

SEQ ID NO: 101211 - RNA, 20 nt, Artificial Sequence
  MKO10101211_B_Neurod2
  gRNA
acggcgacgacgacgagccg

SEQ ID NO: 101212 - RNA, 20 nt, Artificial Sequence
  MKO10101212_B_Neurod4
  gRNA
cugcaguacccccccuuaug

SEQ ID NO: 101213 - RNA, 20 nt, Artificial Sequence
  MKO10101213_B_Neurod4
  gRNA
ucuacaggaacaucauagcg

SEQ ID NO: 101214 - RNA, 20 nt, Artificial Sequence
  MKO10101214_B_Neurod4
  gRNA
aggggagccgucuugcuuua

SEQ ID NO: 101215 - RNA, 20 nt, Artificial Sequence
  MKO10101215_B_Neurod6
  gRNA
aaagaccaccaaacuacgac

SEQ ID NO: 101216 - RNA, 20 nt, Artificial Sequence
  MKO10101216_B_Neurod6
  gRNA
gacccuuuccagucguaguu

SEQ ID NO: 101217 - RNA, 20 nt, Artificial Sequence
  MKO10101217_B_Neurod6
  gRNA
gcacggccucaaugaugcuc

SEQ ID NO: 101218 - RNA, 20 nt, Artificial Sequence
  MKO10101218_B_Neurog1
  gRNA
gcgguugcgcucgcgaucgu

SEQ ID NO: 101219 - RNA, 20 nt, Artificial Sequence
  MKO10101219_B_Neurog1
  gRNA
ugacgcgacgacuccuccgc

SEQ ID NO: 101220 - RNA, 20 nt, Artificial Sequence
  MKO10101220_B_Neurog1
  gRNA
cuuggugucgucggggaacg

SEQ ID NO: 101221 - RNA, 20 nt, Artificial Sequence
  MKO10101221_B_Neurog2
  gRNA
ccaguaguccacgucugacc

SEQ ID NO: 101222 - RNA, 20 nt, Artificial Sequence
  MKO10101222_B_Neurog2
  gRNA
cugcaccgucuccgccgucu

SEQ ID NO: 101223 - RNA, 20 nt, Artificial Sequence
  MKO10101223_B_Neurog2
  gRNA
gcacaaccuaaacgccgcgc

SEQ ID NO: 101224 - RNA, 20 nt, Artificial Sequence
  MKO10101224_B_Neurog3
  gRNA
gcgauugcgcucccgaucau

SEQ ID NO: 101225 - RNA, 20 nt, Artificial Sequence
  MKO10101225_B_Neurog3
  gRNA
gacucagacgcugcgcauag

SEQ ID NO: 101226 - RNA, 20 nt, Artificial Sequence
  MKO10101226_B_Neurog3
  gRNA
gauagagccccaguccccgu

SEQ ID NO: 101227 - RNA, 20 nt, Artificial Sequence
  MKO10101227_B_Nexn
  gRNA
guguguuuagggacaguuaa

SEQ ID NO: 101228 - RNA, 20 nt, Artificial Sequence
  MKO10101228_B_Nexn
  gRNA
gauugaggacauaaacaaua

SEQ ID NO: 101229 - RNA, 20 nt, Artificial Sequence
  MKO10101229_B_Nexn
  gRNA
aggcucucaccuguuagcuu

SEQ ID NO: 101230 - RNA, 20 nt, Artificial Sequence
  MKO10101230_B_Nf1
  gRNA
gaccagagaaaacuuguauu

SEQ ID NO: 101231 - RNA, 20 nt, Artificial Sequence
  MKO10101231_B_Nf1
  gRNA
ucucucucaguugaucauau

SEQ ID NO: 101232 - RNA, 20 nt, Artificial Sequence
  MKO10101232_B_Nf1
  gRNA
auuguuacaguauaucaaug

SEQ ID NO: 101233 - RNA, 20 nt, Artificial Sequence
  MKO10101233_B_Nf2
  gRNA
cacuggggcuucgggaaacc

SEQ ID NO: 101234 - RNA, 20 nt, Artificial Sequence
  MKO10101234_B_Nf2
  gRNA
uggacugcaguauacaauca

SEQ ID NO: 101235 - RNA, 20 nt, Artificial Sequence
  MKO10101235_B_Nf2
  gRNA
guuggaucaugauguuucga

SEQ ID NO: 101236 - RNA, 20 nt, Artificial Sequence
  MKO10101236_B_Nfam1
  gRNA
cacacugcuaagacuuguuc

SEQ ID NO: 101237 - RNA, 20 nt, Artificial Sequence
  MKO10101237_B_Nfam1
  gRNA
uaccagccugaugagcgucc

SEQ ID NO: 101238 - RNA, 20 nt, Artificial Sequence
  MKO10101238_B_Nfam1
  gRNA
gaguuuaaccaugcaauccc

SEQ ID NO: 101239 - RNA, 20 nt, Artificial Sequence
  MKO10101239_B_Nfasc
  gRNA
uagcaaccgcauccgccugc

SEQ ID NO: 101240 - RNA, 20 nt, Artificial Sequence
  MKO10101240_B_Nfasc
  gRNA
aggggccaucgagauuccga

SEQ ID NO: 101241 - RNA, 20 nt, Artificial Sequence
  MKO10101241_B_Nfasc
  gRNA
uaucucgaggguccacgaug

SEQ ID NO: 101242 - RNA, 20 nt, Artificial Sequence
  MKO10101242_B_Nfau5
  gRNA
caaucucgucguuugacccc

SEQ ID NO: 101243 - RNA, 20 nt, Artificial Sequence
  MKO10101243_B_Nfau5
  gRNA
cugaaacccaacaccgagcc

SEQ ID NO: 101244 - RNA, 20 nt, Artificial Sequence
  MKO10101244_B_Nfau5
  gRNA
acaguauccgguuaaaagug

SEQ ID NO: 101245 - RNA, 20 nt, Artificial Sequence
  MKO10101245_B_Nfauc1
  gRNA
cgcguauggguaggaguagu

SEQ ID NO: 101246 - RNA, 20 nt, Artificial Sequence
  MKO10101246_B_Nfauc1
  gRNA
agacagucuuccccgugauc

SEQ ID NO: 101247 - RNA, 20 nt, Artificial Sequence
  MKO10101247_B_Nfauc1
  gRNA
augaacagcuguagcgugag

SEQ ID NO: 101248 - RNA, 20 nt, Artificial Sequence
  MKO10101248_B_Nfauc2ip
  gRNA
uucaagagggaugaauuauc

SEQ ID NO: 101249 - RNA, 20 nt, Artificial Sequence
  MKO10101249_B_Nfauc2ip
  gRNA
uuaccaucuucaggcucuga

SEQ ID NO: 101250 - RNA, 20 nt, Artificial Sequence
  MKO10101250_B_Nfauc2ip
  gRNA
gaggaugaugcccugccuuc

SEQ ID NO: 101251 - RNA, 20 nt, Artificial Sequence
  MKO10101251_B_Nfauc2
  gRNA
uuggagaguggccacucgag

SEQ ID NO: 101252 - RNA, 20 nt, Artificial Sequence
  MKO10101252_B_Nfauc2
  gRNA
uacgaucuucucauagcucg

SEQ ID NO: 101253 - RNA, 20 nt, Artificial Sequence
  MKO10101253_B_Nfauc2
  gRNA
gcagcucgaugucagcguuu

SEQ ID NO: 101254 - RNA, 20 nt, Artificial Sequence
  MKO10101254_B_Nfauc3
  gRNA
uaccaacucaccgaaauaua

SEQ ID NO: 101255 - RNA, 20 nt, Artificial Sequence
  MKO10101255_B_Nfauc3
  gRNA
gguuacuuacagcacucaac

SEQ ID NO: 101256 - RNA, 20 nt, Artificial Sequence
  MKO10101256_B_Nfauc3
  gRNA
ggggcagugaaagccucuac

SEQ ID NO: 101257 - RNA, 20 nt, Artificial Sequence
  MKO10101257_B_Nfauc4
  gRNA
caugggggccgcaagcugcg

SEQ ID NO: 101258 - RNA, 20 nt, Artificial Sequence
  MKO10101258_B_Nfauc4
  gRNA
ccaccaucuugccaguaauc

SEQ ID NO: 101259 - RNA, 20 nt, Artificial Sequence
  MKO10101259_B_Nfauc4
  gRNA
ggaaaaggagccccccccgc

SEQ ID NO: 101260 - RNA, 20 nt, Artificial Sequence
  MKO10101260_B_Nfe2l1
  gRNA
ugaccagcaggcucggcgac

SEQ ID NO: 101261 - RNA, 20 nt, Artificial Sequence
  MKO10101261_B_Nfe2l1
  gRNA
gcaagaucucauguccauca

SEQ ID NO: 101262 - RNA, 20 nt, Artificial Sequence
  MKO10101262_B_Nfe2l1
  gRNA
uccuaccugcauuuccauga

SEQ ID NO: 101263 - RNA, 20 nt, Artificial Sequence
  MKO10101263_B_Nfe2l2
  gRNA
agaauuccucccaauucagc

SEQ ID NO: 101264 - RNA, 20 nt, Artificial Sequence
  MKO10101264_B_Nfe2l2
  gRNA
ugaagacugaacuuucagcg

SEQ ID NO: 101265 - RNA, 20 nt, Artificial Sequence
  MKO10101265_B_Nfe2l2
  gRNA
cugccuccagagagcuauug

SEQ ID NO: 101266 - RNA, 20 nt, Artificial Sequence
  MKO10101266_B_Nfe2l3
  gRNA
uuccucuucgccugauauca

SEQ ID NO: 101267 - RNA, 20 nt, Artificial Sequence
  MKO10101267_B_Nfe2l3
  gRNA
aucgcgacagcagaguaaga

SEQ ID NO: 101268 - RNA, 20 nt, Artificial Sequence
  MKO10101268_B_Nfe2l3
  gRNA
gcuuaccucguuccuagccu

SEQ ID NO: 101269 - RNA, 20 nt, Artificial Sequence
  MKO10101269_B_Nfe2
  gRNA
acucaccugcagcucaguaa

SEQ ID NO: 101270 - RNA, 20 nt, Artificial Sequence
  MKO10101270_B_Nfe2
  gRNA
ccuuguucuugccccgucga

SEQ ID NO: 101271 - RNA, 20 nt, Artificial Sequence
  MKO10101271_B_Nfe2
  gRNA
guacgcggacauguacccag

SEQ ID NO: 101272 - RNA, 20 nt, Artificial Sequence
  MKO10101272_B_Nfia
  gRNA
gccaagugaagcugacauua

SEQ ID NO: 101273 - RNA, 20 nt, Artificial Sequence
  MKO10101273_B_Nfia
  gRNA
cugaugugacaaagcugucc

SEQ ID NO: 101274 - RNA, 20 nt, Artificial Sequence
  MKO10101274_B_Nfia
  gRNA
uucuccgcucugucucaccc

SEQ ID NO: 101275 - RNA, 20 nt, Artificial Sequence
  MKO10101275_B_Nfib
  gRNA
auauuuaccuggaggauucu

SEQ ID NO: 101276 - RNA, 20 nt, Artificial Sequence
  MKO10101276_B_Nfib
  gRNA
cucugauacauugaagacuc

SEQ ID NO: 101277 - RNA, 20 nt, Artificial Sequence
  MKO10101277_B_Nfib
  gRNA
uucucccaucugucucacuc

SEQ ID NO: 101278 - RNA, 20 nt, Artificial Sequence
  MKO10101278_B_Nfic
  gRNA
gacacucacuccgagacacu

SEQ ID NO: 101279 - RNA, 20 nt, Artificial Sequence
  MKO10101279_B_Nfic
  gRNA
cuccccgcucugccugaccc

SEQ ID NO: 101280 - RNA, 20 nt, Artificial Sequence
  MKO10101280_B_Nfic
  gRNA
cguaccugggucaggcagag

SEQ ID NO: 101281 - RNA, 20 nt, Artificial Sequence
  MKO10101281_B_Nfil3
  gRNA
cauagccacacaaccgaucu

SEQ ID NO: 101282 - RNA, 20 nt, Artificial Sequence
  MKO10101282_B_Nfil3
  gRNA
ggaggaaugggccauacccg

SEQ ID NO: 101283 - RNA, 20 nt, Artificial Sequence
  MKO10101283_B_Nfil3
  gRNA
acacaucggagagcgagcuc

SEQ ID NO: 101284 - RNA, 20 nt, Artificial Sequence
  MKO10101284_B_Nfix
  gRNA
ucgccccagugcucgaaccc

SEQ ID NO: 101285 - RNA, 20 nt, Artificial Sequence
  MKO10101285_B_Nfix
  gRNA
ugauguccgcaucuccuugc

SEQ ID NO: 101286 - RNA, 20 nt, Artificial Sequence
  MKO10101286_B_Nfix
  gRNA
gcuuugugacgucugggguc

SEQ ID NO: 101287 - RNA, 20 nt, Artificial Sequence
  MKO10101287_B_Nfkb1
  gRNA
aacugaacgauaaccuuugc

SEQ ID NO: 101288 - RNA, 20 nt, Artificial Sequence
  MKO10101288_B_Nfkb1
  gRNA
aauauuagagcaaccaaaac

SEQ ID NO: 101289 - RNA, 20 nt, Artificial Sequence
  MKO10101289_B_Nfkb1
  gRNA
ccagaaauaccacugucaac

SEQ ID NO: 101290 - RNA, 20 nt, Artificial Sequence
  MKO10101290_B_Nfkb2
  gRNA
uccagcugauggccccuauc

SEQ ID NO: 101291 - RNA, 20 nt, Artificial Sequence
  MKO10101291_B_Nfkb2
  gRNA
cuguuccacaaucaccagau

SEQ ID NO: 101292 - RNA, 20 nt, Artificial Sequence
  MKO10101292_B_Nfkb2
  gRNA
uggauccuuaggcuccacga

SEQ ID NO: 101293 - RNA, 20 nt, Artificial Sequence
  MKO10101293_B_Nfkbia
  gRNA
ggcagaccuaccauuguagu

SEQ ID NO: 101294 - RNA, 20 nt, Artificial Sequence
  MKO10101294_B_Nfkbia
  gRNA
acucccccuaccagcuuacc

SEQ ID NO: 101295 - RNA, 20 nt, Artificial Sequence
  MKO10101295_B_Nfkbia
  gRNA
gguagccguggauagaggcu

SEQ ID NO: 101296 - RNA, 20 nt, Artificial Sequence
  MKO10101296_B_Nfkbib
  gRNA
gaccccaccgcccgcaugua

SEQ ID NO: 101297 - RNA, 20 nt, Artificial Sequence
  MKO10101297_B_Nfkbib
  gRNA
aggccaagugcaaugccgug

SEQ ID NO: 101298 - RNA, 20 nt, Artificial Sequence
  MKO10101298_B_Nfkbib
  gRNA
agugucuuaccgguuuauug

SEQ ID NO: 101299 - RNA, 20 nt, Artificial Sequence
  MKO10101299_B_Nfkbid
  gRNA
cccugguggucaguggcguu

SEQ ID NO: 101300 - RNA, 20 nt, Artificial Sequence
  MKO10101300_B_Nfkbid
  gRNA
uccaggacccuaccugugac

SEQ ID NO: 101301 - RNA, 20 nt, Artificial Sequence
  MKO10101301_B_Nfkbid
  gRNA
guucacgaauauccagcugu

SEQ ID NO: 101302 - RNA, 20 nt, Artificial Sequence
  MKO10101302_B_Nfkbie
  gRNA
guagaugcccgcaugcuuaa

SEQ ID NO: 101303 - RNA, 20 nt, Artificial Sequence
  MKO10101303_B_Nfkbie
  gRNA
agugauucacgaagccccgu

SEQ ID NO: 101304 - RNA, 20 nt, Artificial Sequence
  MKO10101304_B_Nfkbie
  gRNA
cuucgugaaucacugccagg

SEQ ID NO: 101305 - RNA, 20 nt, Artificial Sequence
  MKO10101305_B_Nfkbil1
  gRNA
uccgaagccagauugagacc

SEQ ID NO: 101306 - RNA, 20 nt, Artificial Sequence
  MKO10101306_B_Nfkbil1
  gRNA
ggcgcuuuggcgaugugccc

SEQ ID NO: 101307 - RNA, 20 nt, Artificial Sequence
  MKO10101307_B_Nfkbil1
  gRNA
cugccgccauucccgcuccu

SEQ ID NO: 101308 - RNA, 20 nt, Artificial Sequence
  MKO10101308_B_Nfkbiz
  gRNA
cuucacgcgaacaccuugaa

SEQ ID NO: 101309 - RNA, 20 nt, Artificial Sequence
  MKO10101309_B_Nfkbiz
  gRNA
agccccacauggggguuggc

SEQ ID NO: 101310 - RNA, 20 nt, Artificial Sequence
  MKO10101310_B_Nfkbiz
  gRNA
agagcuggccucuugcaaac

SEQ ID NO: 101311 - RNA, 20 nt, Artificial Sequence
  MKO10101311_B_Nfrkb
  gRNA
agcacguucuccuaguccug

SEQ ID NO: 101312 - RNA, 20 nt, Artificial Sequence
  MKO10101312_B_Nfrkb
  gRNA
ugugcagcggguuuccgaag

SEQ ID NO: 101313 - RNA, 20 nt, Artificial Sequence
  MKO10101313_B_Nfrkb
  gRNA
aucgcccagaagcucuuccg

SEQ ID NO: 101314 - RNA, 20 nt, Artificial Sequence
  MKO10101314_B_Nfs1
  gRNA
guccaacaacauagcaauua

SEQ ID NO: 101315 - RNA, 20 nt, Artificial Sequence
  MKO10101315_B_Nfs1
  gRNA
augaucccgcucuucugcac

SEQ ID NO: 101316 - RNA, 20 nt, Artificial Sequence
  MKO10101316_B_Nfs1
  gRNA
uuuccuugaccuguagaacc

SEQ ID NO: 101317 - RNA, 20 nt, Artificial Sequence
  MKO10101317_B_Nfu1
  gRNA
acagcgcuaccugcuucucc

SEQ ID NO: 101318 - RNA, 20 nt, Artificial Sequence
  MKO10101318_B_Nfu1
  gRNA
agaaacaguaccuggccaga

SEQ ID NO: 101319 - RNA, 20 nt, Artificial Sequence
  MKO10101319_B_Nfu1
  gRNA
agacauuuaugccacaauua

SEQ ID NO: 101320 - RNA, 20 nt, Artificial Sequence
  MKO10101320_B_Nfx1
  gRNA
cuccuguagaaaaccuguag

SEQ ID NO: 101321 - RNA, 20 nt, Artificial Sequence
  MKO10101321_B_Nfx1
  gRNA
caaaccucaccacaacuaug

SEQ ID NO: 101322 - RNA, 20 nt, Artificial Sequence
  MKO10101322_B_Nfx1
  gRNA
gcagaaacauucugacaagc

SEQ ID NO: 101323 - RNA, 20 nt, Artificial Sequence
  MKO10101323_B_Nfxl1
  gRNA
acaacauacacuacucacac

SEQ ID NO: 101324 - RNA, 20 nt, Artificial Sequence
  MKO10101324_B_Nfxl1
  gRNA
auaugcccuguauucagaag

SEQ ID NO: 101325 - RNA, 20 nt, Artificial Sequence
  MKO10101325_B_Nfxl1
  gRNA
gugcuccuccaacagcuuuc

SEQ ID NO: 101326 - RNA, 20 nt, Artificial Sequence
  MKO10101326_B_Nfya
  gRNA
auugugccaucugcauuaac

SEQ ID NO: 101327 - RNA, 20 nt, Artificial Sequence
  MKO10101327_B_Nfya
  gRNA
cagauacaguuggugccucc

SEQ ID NO: 101328 - RNA, 20 nt, Artificial Sequence
  MKO10101328_B_Nfya
  gRNA
uaccaaccaguuaaugcaga

SEQ ID NO: 101329 - RNA, 20 nt, Artificial Sequence
  MKO10101329_B_Nfyb
  gRNA
ggagcagucuccgccacaga

SEQ ID NO: 101330 - RNA, 20 nt, Artificial Sequence
  MKO10101330_B_Nfyb
  gRNA
aagcgaagagcucacggaag

SEQ ID NO: 101331 - RNA, 20 nt, Artificial Sequence
  MKO10101331_B_Nfyb
  gRNA
uggccuuaccaucauggggc

SEQ ID NO: 101332 - RNA, 20 nt, Artificial Sequence
  MKO10101332_B_Nfyc
  gRNA
aucuucuuaauacgagccag

SEQ ID NO: 101333 - RNA, 20 nt, Artificial Sequence
  MKO10101333_B_Nfyc
  gRNA
gcuccgcaggagucacagac

SEQ ID NO: 101334 - RNA, 20 nt, Artificial Sequence
  MKO10101334_B_Nfyc
  gRNA
acgccagucugugacuccug

SEQ ID NO: 101335 - RNA, 20 nt, Artificial Sequence
  MKO10101335_B_Ngb
  gRNA
auggcacuguccuguucgcc

SEQ ID NO: 101336 - RNA, 20 nt, Artificial Sequence
  MKO10101336_B_Ngb
  gRNA
agaacuggcggccauuguac

SEQ ID NO: 101337 - RNA, 20 nt, Artificial Sequence
  MKO10101337_B_Ngb
  gRNA
gguacuccuccaaugaagac

SEQ ID NO: 101338 - RNA, 20 nt, Artificial Sequence
  MKO10101338_B_Ngdn
  gRNA
gagccaccucauccuggaca

SEQ ID NO: 101339 - RNA, 20 nt, Artificial Sequence
  MKO10101339_B_Ngdn
  gRNA
gaaguaucaaauugacaaac

SEQ ID NO: 101340 - RNA, 20 nt, Artificial Sequence
  MKO10101340_B_Ngdn
  gRNA
acauacucaccugcuccugg

SEQ ID NO: 101341 - RNA, 20 nt, Artificial Sequence
  MKO10101341_B_Ngef
  gRNA
ccaugaagugcgacaccagc

SEQ ID NO: 101342 - RNA, 20 nt, Artificial Sequence
  MKO10101342_B_Ngef
  gRNA
uguccagcacgccacugcuc

SEQ ID NO: 101343 - RNA, 20 nt, Artificial Sequence
  MKO10101343_B_Ngef
  gRNA
acccaccuauuuguucaaug

SEQ ID NO: 101344 - RNA, 20 nt, Artificial Sequence
  MKO10101344_B_Ngfrap1
  gRNA
gguuagacagcucccccaua

SEQ ID NO: 101345 - RNA, 20 nt, Artificial Sequence
  MKO10101345_B_Ngfrap1
  gRNA
aaauugucuacgcauccuua

SEQ ID NO: 101346 - RNA, 20 nt, Artificial Sequence
  MKO10101346_B_Ngfrap1
  gRNA
augaccgaagucaaggcaua

SEQ ID NO: 101347 - RNA, 20 nt, Artificial Sequence
  MKO10101347_B_Ngfr
  gRNA
ggggugucugguucaccggc

SEQ ID NO: 101348 - RNA, 20 nt, Artificial Sequence
  MKO10101348_B_Ngfr
  gRNA
caucacaguggucaccguau

SEQ ID NO: 101349 - RNA, 20 nt, Artificial Sequence
  MKO10101349_B_Ngfr
  gRNA
gcguagaccuugugauccau

SEQ ID NO: 101350 - RNA, 20 nt, Artificial Sequence
  MKO10101350_B_Ngf
  gRNA
uuuauugggcccagacacug

SEQ ID NO: 101351 - RNA, 20 nt, Artificial Sequence
  MKO10101351_B_Ngf
  gRNA
ugccucaagccagugaaauu

SEQ ID NO: 101352 - RNA, 20 nt, Artificial Sequence
  MKO10101352_B_Ngf
  gRNA
agccuaauuucacuggcuug

SEQ ID NO: 101353 - RNA, 20 nt, Artificial Sequence
  MKO10101353_B_Ngly1
  gRNA
uucuacuggagcuccuacac

SEQ ID NO: 101354 - RNA, 20 nt, Artificial Sequence
  MKO10101354_B_Ngly1
  gRNA
aaauacagauccauccguau

SEQ ID NO: 101355 - RNA, 20 nt, Artificial Sequence
  MKO10101355_B_Ngly1
  gRNA
uacaagucaaugcuuucucc

SEQ ID NO: 101356 - RNA, 20 nt, Artificial Sequence
  MKO10101356_B_Ngp
  gRNA
guugccgaugauaucauacu

SEQ ID NO: 101357 - RNA, 20 nt, Artificial Sequence
  MKO10101357_B_Ngp
  gRNA
gccuaaagacugcgacuucc

SEQ ID NO: 101358 - RNA, 20 nt, Artificial Sequence
  MKO10101358_B_Ngp
  gRNA
gucuugcuuaucauuaaaac

SEQ ID NO: 101359 - RNA, 20 nt, Artificial Sequence
  MKO10101359_B_Ngrn
  gRNA
cgcaccucucucgcucgcug

SEQ ID NO: 101360 - RNA, 20 nt, Artificial Sequence
  MKO10101360_B_Ngrn
  gRNA
ucagcacugauguuauccga

SEQ ID NO: 101361 - RNA, 20 nt, Artificial Sequence
  MKO10101361_B_Ngrn
  gRNA
caccacccagaacacugacg

SEQ ID NO: 101362 - RNA, 20 nt, Artificial Sequence
  MKO10101362_B_Nhej1
  gRNA
ucaccaacagcacacgccuc

SEQ ID NO: 101363 - RNA, 20 nt, Artificial Sequence
  MKO10101363_B_Nhej1
  gRNA
cucaccacaggcucauauuc

SEQ ID NO: 101364 - RNA, 20 nt, Artificial Sequence
  MKO10101364_B_Nhej1
  gRNA
gagucugcagagucuguaug

SEQ ID NO: 101365 - RNA, 20 nt, Artificial Sequence
  MKO10101365_B_Nhlh1
  gRNA
gagucgggcuuuagcgacug

SEQ ID NO: 101366 - RNA, 20 nt, Artificial Sequence
  MKO10101366_B_Nhlh1
  gRNA
ggaccgggccccgauggugc

SEQ ID NO: 101367 - RNA, 20 nt, Artificial Sequence
  MKO10101367_B_Nhlh1
  gRNA
acagucgcuaaagcccgacu

SEQ ID NO: 101368 - RNA, 20 nt, Artificial Sequence
  MKO10101368_B_Nhlh2
  gRNA
cgccacggccaaguaccgau

SEQ ID NO: 101369 - RNA, 20 nt, Artificial Sequence
  MKO10101369_B_Nhlh2
  gRNA
cgugucggaccuagagccag

SEQ ID NO: 101370 - RNA, 20 nt, Artificial Sequence
  MKO10101370_B_Nhlh2
  gRNA
acuuggccguggcgcgccgg

SEQ ID NO: 101371 - RNA, 20 nt, Artificial Sequence
  MKO10101371_B_Nhlrc1
  gRNA
uagggucccccacccgccga

SEQ ID NO: 101372 - RNA, 20 nt, Artificial Sequence
  MKO10101372_B_Nhlrc1
  gRNA
uuggugacggcgacauccag

SEQ ID NO: 101373 - RNA, 20 nt, Artificial Sequence
  MKO10101373_B_Nhlrc1
  gRNA
gagaggccgugagugauuau

SEQ ID NO: 101374 - RNA, 20 nt, Artificial Sequence
  MKO10101374_B_Nhlrc2
  gRNA
gcaucugcaucguuaaccac

SEQ ID NO: 101375 - RNA, 20 nt, Artificial Sequence
  MKO10101375_B_Nhlrc2
  gRNA
gacguugcgcuugggaccuc

SEQ ID NO: 101376 - RNA, 20 nt, Artificial Sequence
  MKO10101376_B_Nhlrc2
  gRNA
ucugcuauagcuacacccug

SEQ ID NO: 101377 - RNA, 20 nt, Artificial Sequence
  MKO10101377_B_Nhlrc3
  gRNA
auggcuauuuccuacgagcc

SEQ ID NO: 101378 - RNA, 20 nt, Artificial Sequence
  MKO10101378_B_Nhlrc3
  gRNA
gcgucaaguguaacgcugug

SEQ ID NO: 101379 - RNA, 20 nt, Artificial Sequence
  MKO10101379_B_Nhlrc3
  gRNA
uuuggguuggcccaagaauu

SEQ ID NO: 101380 - RNA, 20 nt, Artificial Sequence
  MKO10101380_B_Nhlrc4
  gRNA
ggccaaaguuaugcccaguc

SEQ ID NO: 101381 - RNA, 20 nt, Artificial Sequence
  MKO10101381_B_Nhlrc4
  gRNA
cuggagggcccuuguugggu

SEQ ID NO: 101382 - RNA, 20 nt, Artificial Sequence
  MKO10101382_B_Nhlrc4
  gRNA
cugcaucugccaccacuagu

SEQ ID NO: 101383 - RNA, 20 nt, Artificial Sequence
  MKO10101383_B_Nhp2l1
  gRNA
ccuuucaauagacugcugaa

SEQ ID NO: 101384 - RNA, 20 nt, Artificial Sequence
  MKO10101384_B_Nhp2l1
  gRNA
ccaccucaccaagaagcugc

SEQ ID NO: 101385 - RNA, 20 nt, Artificial Sequence
  MKO10101385_B_Nhp2l1
  gRNA
ccagcagcuucuuggugagg

SEQ ID NO: 101386 - RNA, 20 nt, Artificial Sequence
  MKO10101386_B_Nhp2
  gRNA
gcgcuucucaccgucuuaga

SEQ ID NO: 101387 - RNA, 20 nt, Artificial Sequence
  MKO10101387_B_Nhp2
  gRNA
gaccuacgacaagugccugg

SEQ ID NO: 101388 - RNA, 20 nt, Artificial Sequence
  MKO10101388_B_Nhp2
  gRNA
gaagccccaugaagaauauc

SEQ ID NO: 101389 - RNA, 20 nt, Artificial Sequence
  MKO10101389_B_Nhsl1
  gRNA
ucgauggacuguccacuaca

SEQ ID NO: 101390 - RNA, 20 nt, Artificial Sequence
  MKO10101390_B_Nhsl1
  gRNA
ucgacucuccucguccaagu

SEQ ID NO: 101391 - RNA, 20 nt, Artificial Sequence
  MKO10101391_B_Nhsl1
  gRNA
ccagacgguccaggcugacg

SEQ ID NO: 101392 - RNA, 20 nt, Artificial Sequence
  MKO10101392_B_Nhsl2
  gRNA
guauucggaggccagacuuc

SEQ ID NO: 101393 - RNA, 20 nt, Artificial Sequence
  MKO10101393_B_Nhsl2
  gRNA
cuugugccaaucaacaucuc

SEQ ID NO: 101394 - RNA, 20 nt, Artificial Sequence
  MKO10101394_B_Nhsl2
  gRNA
caguacaaacuccagacgcu

SEQ ID NO: 101395 - RNA, 20 nt, Artificial Sequence
  MKO10101395_B_Nhs
  gRNA
uuugcucucugcgaucacuc

SEQ ID NO: 101396 - RNA, 20 nt, Artificial Sequence
  MKO10101396_B_Nhs
  gRNA
aacgauaccggugacauuga

SEQ ID NO: 101397 - RNA, 20 nt, Artificial Sequence
  MKO10101397_B_Nhs
  gRNA
ccacaauguucccucuacac

SEQ ID NO: 101398 - RNA, 20 nt, Artificial Sequence
  MKO10101398_B_Niacr1
  gRNA
cauaguaacuuaacgagaug

SEQ ID NO: 101399 - RNA, 20 nt, Artificial Sequence
  MKO10101399_B_Niacr1
  gRNA
gauggaccacccggaaguag

SEQ ID NO: 101400 - RNA, 20 nt, Artificial Sequence
  MKO10101400_B_Niacr1
  gRNA
gggucagccauuagcgcccc

SEQ ID NO: 101401 - RNA, 20 nt, Artificial Sequence
  MKO10101401_B_Nicn1
  gRNA
uggagcuuuguugacgaaca

SEQ ID NO: 101402 - RNA, 20 nt, Artificial Sequence
  MKO10101402_B_Nicn1
  gRNA
ggaacugcagaucuaccaac

SEQ ID NO: 101403 - RNA, 20 nt, Artificial Sequence
  MKO10101403_B_Nicn1
  gRNA
uguaucacuguucaagcacc

SEQ ID NO: 101404 - RNA, 20 nt, Artificial Sequence
  MKO10101404_B_Nid1
  gRNA
gccucuaggagcagcaacgc

SEQ ID NO: 101405 - RNA, 20 nt, Artificial Sequence
  MKO10101405_B_Nid1
  gRNA
agguguguggccaacuacac

SEQ ID NO: 101406 - RNA, 20 nt, Artificial Sequence
  MKO10101406_B_Nid1
  gRNA
gagugcagagacuaugcuac

SEQ ID NO: 101407 - RNA, 20 nt, Artificial Sequence
  MKO10101407_B_Nid2
  gRNA
cccgcgacugaccuccucgu

SEQ ID NO: 101408 - RNA, 20 nt, Artificial Sequence
  MKO10101408_B_Nid2
  gRNA
ggcggaacgugaccagacuc

SEQ ID NO: 101409 - RNA, 20 nt, Artificial Sequence
  MKO10101409_B_Nid2
  gRNA
ucuucagucuucacguauaa

SEQ ID NO: 101410 - RNA, 20 nt, Artificial Sequence
  MKO10101410_B_Nif3l1
  gRNA
gguucacacugaauucuagu

SEQ ID NO: 101411 - RNA, 20 nt, Artificial Sequence
  MKO10101411_B_Nif3l1
  gRNA
ucugggggcaguguucuaca

SEQ ID NO: 101412 - RNA, 20 nt, Artificial Sequence
  MKO10101412_B_Nif3l1
  gRNA
gaggccgaccuuuaccucac

SEQ ID NO: 101413 - RNA, 20 nt, Artificial Sequence
  MKO10101413_B_Nifk
  gRNA
ugucgcucauagagauucug

SEQ ID NO: 101414 - RNA, 20 nt, Artificial Sequence
  MKO10101414_B_Nifk
  gRNA
uauaacuacugugcccaguu

SEQ ID NO: 101415 - RNA, 20 nt, Artificial Sequence
  MKO10101415_B_Nifk
  gRNA
ugagcgacagcaauguucuu

SEQ ID NO: 101416 - RNA, 20 nt, Artificial Sequence
  MKO10101416_B_Nim1
  gRNA
aucacgcuggggaaacgcau

SEQ ID NO: 101417 - RNA, 20 nt, Artificial Sequence
  MKO10101417_B_Nim1
  gRNA
acccuucgagaaacugacuc

SEQ ID NO: 101418 - RNA, 20 nt, Artificial Sequence
  MKO10101418_B_Nim1
  gRNA
guccaagcuacaccuaguga

SEQ ID NO: 101419 - RNA, 20 nt, Artificial Sequence
  MKO10101419_B_Ninj1
  gRNA
ccccgguucccccgacgccu

SEQ ID NO: 101420 - RNA, 20 nt, Artificial Sequence
  MKO10101420_B_Ninj1
  gRNA
cgugcuuggccggguuguug

SEQ ID NO: 101421 - RNA, 20 nt, Artificial Sequence
  MKO10101421_B_Ninj1
  gRNA
ugccaacaagaagagcgcug

SEQ ID NO: 101422 - RNA, 20 nt, Artificial Sequence
  MKO10101422_B_Ninj2
  gRNA
uagucaucaaauaggauugc

SEQ ID NO: 101423 - RNA, 20 nt, Artificial Sequence
  MKO10101423_B_Ninj2
  gRNA
agaacuuacuugaaggugga

SEQ ID NO: 101424 - RNA, 20 nt, Artificial Sequence
  MKO10101424_B_Ninj2
  gRNA
cagcacugauuucagccgca

SEQ ID NO: 101425 - RNA, 20 nt, Artificial Sequence
  MKO10101425_B_Ninl
  gRNA
guggcagagucaccgagcuc

SEQ ID NO: 101426 - RNA, 20 nt, Artificial Sequence
  MKO10101426_B_Ninl
  gRNA
cuucaggccagcugcgaucc

SEQ ID NO: 101427 - RNA, 20 nt, Artificial Sequence
  MKO10101427_B_Ninl
  gRNA
cgucggagccuaccugagcu

SEQ ID NO: 101428 - RNA, 20 nt, Artificial Sequence
  MKO10101428_B_Nin
  gRNA
cuggaagacacaacgcagug

SEQ ID NO: 101429 - RNA, 20 nt, Artificial Sequence
  MKO10101429_B_Nin
  gRNA
gcugcaacagacgcuacucc

SEQ ID NO: 101430 - RNA, 20 nt, Artificial Sequence
  MKO10101430_B_Nin
  gRNA
gucuagaacucuauccagug

SEQ ID NO: 101431 - RNA, 20 nt, Artificial Sequence
  MKO10101431_B_Nip7
  gRNA
ccggaaacaguacgugccgu

SEQ ID NO: 101432 - RNA, 20 nt, Artificial Sequence
  MKO10101432_B_Nip7
  gRNA
uacccaagacugccgaaaag

SEQ ID NO: 101433 - RNA, 20 nt, Artificial Sequence
  MKO10101433_B_Nip7
  gRNA
cguacuccccaaugucugcu

SEQ ID NO: 101434 - RNA, 20 nt, Artificial Sequence
  MKO10101434_B_Nipa1
  gRNA
acaguggcugucggccagau

SEQ ID NO: 101435 - RNA, 20 nt, Artificial Sequence
  MKO10101435_B_Nipa1
  gRNA
guggucacacucucagacuu

SEQ ID NO: 101436 - RNA, 20 nt, Artificial Sequence
  MKO10101436_B_Nipa1
  gRNA
gcucaacaucuugggcaagu

SEQ ID NO: 101437 - RNA, 20 nt, Artificial Sequence
  MKO10101437_B_Nipa2
  gRNA
aggaggccaugcauaucuua

SEQ ID NO: 101438 - RNA, 20 nt, Artificial Sequence
  MKO10101438_B_Nipa2
  gRNA
aaugaagacgacuuacccug

SEQ ID NO: 101439 - RNA, 20 nt, Artificial Sequence
  MKO10101439_B_Nipa2
  gRNA
uauggucauucaugcuccaa

SEQ ID NO: 101440 - RNA, 20 nt, Artificial Sequence
  MKO10101440_B_Nipal1
  gRNA
ggcgaaguucgcagccucuc

SEQ ID NO: 101441 - RNA, 20 nt, Artificial Sequence
  MKO10101441_B_Nipal1
  gRNA
gaccaagguggcaggcgcaa

SEQ ID NO: 101442 - RNA, 20 nt, Artificial Sequence
  MKO10101442_B_Nipal1
  gRNA
aaugagcgcuugaauauuca

SEQ ID NO: 101443 - RNA, 20 nt, Artificial Sequence
  MKO10101443_B_Nipal2
  gRNA
gauaaccagguuuccuaaaa

SEQ ID NO: 101444 - RNA, 20 nt, Artificial Sequence
  MKO10101444_B_Nipal2
  gRNA
cagcauuucccuaaauaucc

SEQ ID NO: 101445 - RNA, 20 nt, Artificial Sequence
  MKO10101445_B_Nipal2
  gRNA
gguaugacacuagcauuugc

SEQ ID NO: 101446 - RNA, 20 nt, Artificial Sequence
  MKO10101446_B_Nipal3
  gRNA
gaccaccaggugcccaaaaa

SEQ ID NO: 101447 - RNA, 20 nt, Artificial Sequence
  MKO10101447_B_Nipal3
  gRNA
ggccaagccgcagccaacaa

SEQ ID NO: 101448 - RNA, 20 nt, Artificial Sequence
  MKO10101448_B_Nipal3
  gRNA
uuuccagcaagcgccaucau

SEQ ID NO: 101449 - RNA, 20 nt, Artificial Sequence
  MKO10101449_B_Nipal4
  gRNA
cuaugcauuugcaccugcga

SEQ ID NO: 101450 - RNA, 20 nt, Artificial Sequence
  MKO10101450_B_Nipal4
  gRNA
accugaaggacccaaugugg

SEQ ID NO: 101451 - RNA, 20 nt, Artificial Sequence
  MKO10101451_B_Nipal4
  gRNA
ucuacagugaauggaggcua

SEQ ID NO: 101452 - RNA, 20 nt, Artificial Sequence
  MKO10101452_B_Nipbl
  gRNA
cuucgggaucaucacugcca

SEQ ID NO: 101453 - RNA, 20 nt, Artificial Sequence
  MKO10101453_B_Nipbl
  gRNA
acacauccgcagaugcagca

SEQ ID NO: 101454 - RNA, 20 nt, Artificial Sequence
  MKO10101454_B_Nipbl
  gRNA
guguuguguaacuugaagga

SEQ ID NO: 101455 - RNA, 20 nt, Artificial Sequence
  MKO10101455_B_Nipsnap1
  gRNA
agccaccugagaaccgccau

SEQ ID NO: 101456 - RNA, 20 nt, Artificial Sequence
  MKO10101456_B_Nipsnap1
  gRNA
cacucacgucagacuguugu

SEQ ID NO: 101457 - RNA, 20 nt, Artificial Sequence
  MKO10101457_B_Nipsnap1
  gRNA
ccccaacaguacaccuaugg

SEQ ID NO: 101458 - RNA, 20 nt, Artificial Sequence
  MKO10101458_B_Nipsnap3a
  gRNA
aaugcuucaccccauagagc

SEQ ID NO: 101459 - RNA, 20 nt, Artificial Sequence
  MKO10101459_B_Nipsnap3a
  gRNA
gaucccagagucgugucugc

SEQ ID NO: 101460 - RNA, 20 nt, Artificial Sequence
  MKO10101460_B_Nipsnap3a
  gRNA
cucucuuguuugucaaugag

SEQ ID NO: 101461 - RNA, 20 nt, Artificial Sequence
  MKO10101461_B_Nipsnap3b
  gRNA
gaaugugccauugcuuugcc

SEQ ID NO: 101462 - RNA, 20 nt, Artificial Sequence
  MKO10101462_B_Nipsnap3b
  gRNA
gccgccaggcuucaucugaa

SEQ ID NO: 101463 - RNA, 20 nt, Artificial Sequence
  MKO10101463_B_Nipsnap3b
  gRNA
gucucacgaggacccuagag

SEQ ID NO: 101464 - RNA, 20 nt, Artificial Sequence
  MKO10101464_B_Nisch
  gRNA
gcaucaccacuggcacaagu

SEQ ID NO: 101465 - RNA, 20 nt, Artificial Sequence
  MKO10101465_B_Nisch
  gRNA
ucuuuaccuuaagauacuua

SEQ ID NO: 101466 - RNA, 20 nt, Artificial Sequence
  MKO10101466_B_Nisch
  gRNA
aaauggugucacugcagcac

SEQ ID NO: 101467 - RNA, 20 nt, Artificial Sequence
  MKO10101467_B_Nit1
  gRNA
uagcaaucuguuaugacaug

SEQ ID NO: 101468 - RNA, 20 nt, Artificial Sequence
  MKO10101468_B_Nit1
  gRNA
uucggacaggaguaaugucu

SEQ ID NO: 101469 - RNA, 20 nt, Artificial Sequence
  MKO10101469_B_Nit1
  gRNA
guauaguugcuuucucucau

SEQ ID NO: 101470 - RNA, 20 nt, Artificial Sequence
  MKO10101470_B_Nit2
  gRNA
uuaaaucagauaaccuuacc

SEQ ID NO: 101471 - RNA, 20 nt, Artificial Sequence
  MKO10101471_B_Nit2
  gRNA
ggaaucuucucugcauaguc

SEQ ID NO: 101472 - RNA, 20 nt, Artificial Sequence
  MKO10101472_B_Nit2
  gRNA
gagugcuucaauucuccaua

SEQ ID NO: 101473 - RNA, 20 nt, Artificial Sequence
  MKO10101473_B_Nkain1
  gRNA
gacauaccaggaugagauac

SEQ ID NO: 101474 - RNA, 20 nt, Artificial Sequence
  MKO10101474_B_Nkain1
  gRNA
gccaacccagaguacaagcc

SEQ ID NO: 101475 - RNA, 20 nt, Artificial Sequence
  MKO10101475_B_Nkain1
  gRNA
acuuucugcaguaugcagcc

SEQ ID NO: 101476 - RNA, 20 nt, Artificial Sequence
  MKO10101476_B_Nkain2
  gRNA
cacuuacugcgaggacaauc

SEQ ID NO: 101477 - RNA, 20 nt, Artificial Sequence
  MKO10101477_B_Nkain2
  gRNA
cuuacuccuguuacguaacg

SEQ ID NO: 101478 - RNA, 20 nt, Artificial Sequence
  MKO10101478_B_Nkain2
  gRNA
auauuucaaugcaccgaucu

SEQ ID NO: 101479 - RNA, 20 nt, Artificial Sequence
  MKO10101479_B_Nkain3
  gRNA
uacacauacgucucagucac

SEQ ID NO: 101480 - RNA, 20 nt, Artificial Sequence
  MKO10101480_B_Nkain3
  gRNA
cagguuagaagaaccaagac

SEQ ID NO: 101481 - RNA, 20 nt, Artificial Sequence
  MKO10101481_B_Nkain3
  gRNA
uuccuauagcagaccugucu

SEQ ID NO: 101482 - RNA, 20 nt, Artificial Sequence
  MKO10101482_B_Nkain4
  gRNA
ggucucccuaguauguugua

SEQ ID NO: 101483 - RNA, 20 nt, Artificial Sequence
  MKO10101483_B_Nkain4
  gRNA
agagcgcaagaagcgugcag

SEQ ID NO: 101484 - RNA, 20 nt, Artificial Sequence
  MKO10101484_B_Nkain4
  gRNA
ugccauggugcacagcuaug

SEQ ID NO: 101485 - RNA, 20 nt, Artificial Sequence
  MKO10101485_B_Nkapl
  gRNA
aucccgaucucgcccuaaug

SEQ ID NO: 101486 - RNA, 20 nt, Artificial Sequence
  MKO10101486_B_Nkapl
  gRNA
acgcccugagcaccccgcgg

SEQ ID NO: 101487 - RNA, 20 nt, Artificial Sequence
  MKO10101487_B_Nkapl
  gRNA
ugguagcaggcaucgccgaa

SEQ ID NO: 101488 - RNA, 20 nt, Artificial Sequence
  MKO10101488_B_Nkap
  gRNA
gaaucugacacagacuccag

SEQ ID NO: 101489 - RNA, 20 nt, Artificial Sequence
  MKO10101489_B_Nkap
  gRNA
acuucagcaucuaguucaga

SEQ ID NO: 101490 - RNA, 20 nt, Artificial Sequence
  MKO10101490_B_Nkap
  gRNA
agcaaagaaagcuaagaaaa

SEQ ID NO: 101491 - RNA, 20 nt, Artificial Sequence
  MKO10101491_B_Nkd1
  gRNA
agaagcagcgagccccacuc

SEQ ID NO: 101492 - RNA, 20 nt, Artificial Sequence
  MKO10101492_B_Nkd1
  gRNA
ggagucaaccacuucauaga

SEQ ID NO: 101493 - RNA, 20 nt, Artificial Sequence
  MKO10101493_B_Nkd1
  gRNA
gagugaaaguccacucuugc

SEQ ID NO: 101494 - RNA, 20 nt, Artificial Sequence
  MKO10101494_B_Nkd2
  gRNA
gacgacaaggguucccuaga

SEQ ID NO: 101495 - RNA, 20 nt, Artificial Sequence
  MKO10101495_B_Nkd2
  gRNA
ucauggcccucagacuucuc

SEQ ID NO: 101496 - RNA, 20 nt, Artificial Sequence
  MKO10101496_B_Nkd2
  gRNA
cagccgcagcagccugcaag

SEQ ID NO: 101497 - RNA, 20 nt, Artificial Sequence
  MKO10101497_B_Nkg7
  gRNA
cccagcucucuccauauuag

SEQ ID NO: 101498 - RNA, 20 nt, Artificial Sequence
  MKO10101498_B_Nkg7
  gRNA
caguguacaccaguaugaga

SEQ ID NO: 101499 - RNA, 20 nt, Artificial Sequence
  MKO10101499_B_Nkg7
  gRNA
gccaugacaguugagaccag

SEQ ID NO: 101500 - RNA, 20 nt, Artificial Sequence
  MKO10101500_B_Nkiras1
  gRNA
gcaaaugagaaguaaugcuu

SEQ ID NO: 101501 - RNA, 20 nt, Artificial Sequence
  MKO10101501_B_Nkiras1
  gRNA
caauagugugauucccauaa

SEQ ID NO: 101502 - RNA, 20 nt, Artificial Sequence
  MKO10101502_B_Nkiras1
  gRNA
auuuguggguugcugucugu

SEQ ID NO: 101503 - RNA, 20 nt, Artificial Sequence
  MKO10101503_B_Nkiras2
  gRNA
cuuguugccaaggaccacga

SEQ ID NO: 101504 - RNA, 20 nt, Artificial Sequence
  MKO10101504_B_Nkiras2
  gRNA
cgugugcggccaggcaucug

SEQ ID NO: 101505 - RNA, 20 nt, Artificial Sequence
  MKO10101505_B_Nkiras2
  gRNA
ucccguacagaagcugcuca

SEQ ID NO: 101506 - RNA, 20 nt, Artificial Sequence
  MKO10101506_B_Nkpd1
  gRNA
gcguagaaacccaccgucac

SEQ ID NO: 101507 - RNA, 20 nt, Artificial Sequence
  MKO10101507_B_Nkpd1
  gRNA
cagcggcucgguccaguucg

SEQ ID NO: 101508 - RNA, 20 nt, Artificial Sequence
  MKO10101508_B_Nkpd1
  gRNA
cccgaguuggggcaccaaaa

SEQ ID NO: 101509 - RNA, 20 nt, Artificial Sequence
  MKO10101509_B_Nkrf
  gRNA
ggcagcauuagaucauauga

SEQ ID NO: 101510 - RNA, 20 nt, Artificial Sequence
  MKO10101510_B_Nkrf
  gRNA
aggucuccgcuggaaaugca

SEQ ID NO: 101511 - RNA, 20 nt, Artificial Sequence
  MKO10101511_B_Nkrf
  gRNA
uugagguuagaguuguccga

SEQ ID NO: 101512 - RNA, 20 nt, Artificial Sequence
  MKO10101512_B_Nktr
  gRNA
auuuaugguggauacuuuaa

SEQ ID NO: 101513 - RNA, 20 nt, Artificial Sequence
  MKO10101513_B_Nktr
  gRNA
gguuaaaaacuuuaugauuc

SEQ ID NO: 101514 - RNA, 20 nt, Artificial Sequence
  MKO10101514_B_Nktr
  gRNA
acucaccugagcacaggcau

SEQ ID NO: 101515 - RNA, 20 nt, Artificial Sequence
  MKO10101515_B_Nkx1-2
  gRNA
ggggucuccugugacccgau

SEQ ID NO: 101516 - RNA, 20 nt, Artificial Sequence
  MKO10101516_B_Nkx1-2
  gRNA
gcacaccgacagauagcgcg

SEQ ID NO: 101517 - RNA, 20 nt, Artificial Sequence
  MKO10101517_B_Nkx1-2
  gRNA
acaccgggcgcgguagcggg

SEQ ID NO: 101518 - RNA, 20 nt, Artificial Sequence
  MKO10101518_B_Nkx2-1
  gRNA
ggcgccauaguccgagcccg

SEQ ID NO: 101519 - RNA, 20 nt, Artificial Sequence
  MKO10101519_B_Nkx2-1
  gRNA
gggcuacugcaacggcaacc

SEQ ID NO: 101520 - RNA, 20 nt, Artificial Sequence
  MKO10101520_B_Nkx2-1
  gRNA
ccaugcagcagcacgccgug

SEQ ID NO: 101521 - RNA, 20 nt, Artificial Sequence
  MKO10101521_B_Nkx2-2
  gRNA
uugucgcugcugucguagaa

SEQ ID NO: 101522 - RNA, 20 nt, Artificial Sequence
  MKO10101522_B_Nkx2-2
  gRNA
ugcccauaguguccgcaagg

SEQ ID NO: 101523 - RNA, 20 nt, Artificial Sequence
  MKO10101523_B_Nkx2-2
  gRNA
gggcaccgcagcuucgaucc

SEQ ID NO: 101524 - RNA, 20 nt, Artificial Sequence
  MKO10101524_B_Nkx2-3
  gRNA
gaacucacuagcugcugccg

SEQ ID NO: 101525 - RNA, 20 nt, Artificial Sequence
  MKO10101525_B_Nkx2-3
  gRNA
ggcgcgcaacccuugcauca

SEQ ID NO: 101526 - RNA, 20 nt, Artificial Sequence
  MKO10101526_B_Nkx2-3
  gRNA
cacgccguagggcgagccgu

SEQ ID NO: 101527 - RNA, 20 nt, Artificial Sequence
  MKO10101527_B_Nkx2-4
  gRNA
gccacguucacgcccgccga

SEQ ID NO: 101528 - RNA, 20 nt, Artificial Sequence
  MKO10101528_B_Nkx2-4
  gRNA
cgcucacuugacgaguagcg

SEQ ID NO: 101529 - RNA, 20 nt, Artificial Sequence
  MKO10101529_B_Nkx2-4
  gRNA
ggguucgcugaccggcaucg

SEQ ID NO: 101530 - RNA, 20 nt, Artificial Sequence
  MKO10101530_B_Nkx2-5
  gRNA
cgaggcggcagcguccggcc

SEQ ID NO: 101531 - RNA, 20 nt, Artificial Sequence
  MKO10101531_B_Nkx2-5
  gRNA
ucucucggcgccauccgucu

SEQ ID NO: 101532 - RNA, 20 nt, Artificial Sequence
  MKO10101532_B_Nkx2-5
  gRNA
cuacgcucccgccuacggcg

SEQ ID NO: 101533 - RNA, 20 nt, Artificial Sequence
  MKO10101533_B_Nkx2-6
  gRNA
ugguucauucuuagguaccg

SEQ ID NO: 101534 - RNA, 20 nt, Artificial Sequence
  MKO10101534_B_Nkx2-6
  gRNA
cucgcauagcuagcgucgua

SEQ ID NO: 101535 - RNA, 20 nt, Artificial Sequence
  MKO10101535_B_Nkx2-6
  gRNA
cucggcgcaugucgccacuc

SEQ ID NO: 101536 - RNA, 20 nt, Artificial Sequence
  MKO10101536_B_Nkx2-9
  gRNA
ggcugcgcaccgugaagccg

SEQ ID NO: 101537 - RNA, 20 nt, Artificial Sequence
  MKO10101537_B_Nkx2-9
  gRNA
cuccaggccgcucucguccg

SEQ ID NO: 101538 - RNA, 20 nt, Artificial Sequence
  MKO10101538_B_Nkx2-9
  gRNA
ggacaagugcagcgcacgcc

SEQ ID NO: 101539 - RNA, 20 nt, Artificial Sequence
  MKO10101539_B_Nkx3-1
  gRNA
ggacuuagcaagugcccccc

SEQ ID NO: 101540 - RNA, 20 nt, Artificial Sequence
  MKO10101540_B_Nkx3-1
  gRNA
aggcaauccgcagcacucgc

SEQ ID NO: 101541 - RNA, 20 nt, Artificial Sequence
  MKO10101541_B_Nkx3-1
  gRNA
ggugagccgcuuggacugcg

SEQ ID NO: 101542 - RNA, 20 nt, Artificial Sequence
  MKO10101542_B_Nkx3-2
  gRNA
gcccgggagcgcuucuuucg

SEQ ID NO: 101543 - RNA, 20 nt, Artificial Sequence
  MKO10101543_B_Nkx3-2
  gRNA
cugcgagcugcacgccgcca

SEQ ID NO: 101544 - RNA, 20 nt, Artificial Sequence
  MKO10101544_B_Nkx3-2
  gRNA
gucgcuacaagaccaaacgc

SEQ ID NO: 101545 - RNA, 20 nt, Artificial Sequence
  MKO10101545_B_Nkx6-1
  gRNA
uuucgaacaaacgaaguacu

SEQ ID NO: 101546 - RNA, 20 nt, Artificial Sequence
  MKO10101546_B_Nkx6-1
  gRNA
cuccgucauccccagagaau

SEQ ID NO: 101547 - RNA, 20 nt, Artificial Sequence
  MKO10101547_B_Nkx6-1
  gRNA
cugaaaaagcacaaaucgag

SEQ ID NO: 101548 - RNA, 20 nt, Artificial Sequence
  MKO10101548_B_Nkx6-2
  gRNA
uuaccggagccggccagucg

SEQ ID NO: 101549 - RNA, 20 nt, Artificial Sequence
  MKO10101549_B_Nkx6-2
  gRNA
cggccagcagaucuucgcgc

SEQ ID NO: 101550 - RNA, 20 nt, Artificial Sequence
  MKO10101550_B_Nkx6-2
  gRNA
cgcgcggcuugccuacucuc

SEQ ID NO: 101551 - RNA, 20 nt, Artificial Sequence
  MKO10101551_B_Nkx6-3
  gRNA
uaagccagccucgcccgcuc

SEQ ID NO: 101552 - RNA, 20 nt, Artificial Sequence
  MKO10101552_B_Nkx6-3
  gRNA
cuggaaaugaguacccgacc

SEQ ID NO: 101553 - RNA, 20 nt, Artificial Sequence
  MKO10101553_B_Nkx6-3
  gRNA
cgguccccgcucgcaccucc

SEQ ID NO: 101554 - RNA, 20 nt, Artificial Sequence
  MKO10101554_B_Nle1
  gRNA
cuuucuuaggacaccggcac

SEQ ID NO: 101555 - RNA, 20 nt, Artificial Sequence
  MKO10101555_B_Nle1
  gRNA
gagacaccacugugcgcuuc

SEQ ID NO: 101556 - RNA, 20 nt, Artificial Sequence
  MKO10101556_B_Nle1
  gRNA
gacgcggugcaccagcucau

SEQ ID NO: 101557 - RNA, 20 nt, Artificial Sequence
  MKO10101557_B_Nlgn1
  gRNA
gcagaccuucacucgaacuu

SEQ ID NO: 101558 - RNA, 20 nt, Artificial Sequence
  MKO10101558_B_Nlgn1
  gRNA
ccauugguuacuacuaacuu

SEQ ID NO: 101559 - RNA, 20 nt, Artificial Sequence
  MKO10101559_B_Nlgn1
  gRNA
uccaaacacagugauucgca

SEQ ID NO: 101560 - RNA, 20 nt, Artificial Sequence
  MKO10101560_B_Nlgn2
  gRNA
ccaaagauagugaugcguuc

SEQ ID NO: 101561 - RNA, 20 nt, Artificial Sequence
  MKO10101561_B_Nlgn2
  gRNA
gcucacaaaaaaacgugacg

SEQ ID NO: 101562 - RNA, 20 nt, Artificial Sequence
  MKO10101562_B_Nlgn2
  gRNA
ugagccgucaaacauguucc

SEQ ID NO: 101563 - RNA, 20 nt, Artificial Sequence
  MKO10101563_B_Nlgn3
  gRNA
gccauagcgggcgugcagau

SEQ ID NO: 101564 - RNA, 20 nt, Artificial Sequence
  MKO10101564_B_Nlgn3
  gRNA
aggauccggcgcuaagaaac

SEQ ID NO: 101565 - RNA, 20 nt, Artificial Sequence
  MKO10101565_B_Nlgn3
  gRNA
ccccguagaauuacugucuu

SEQ ID NO: 101566 - RNA, 20 nt, Artificial Sequence
  MKO10101566_B_Nlk
  gRNA
ucucuugcaaaagagucuuc

SEQ ID NO: 101567 - RNA, 20 nt, Artificial Sequence
  MKO10101567_B_Nlk
  gRNA
ucuucaaaauagucaaugug

SEQ ID NO: 101568 - RNA, 20 nt, Artificial Sequence
  MKO10101568_B_Nlk
  gRNA
cucuccucagccacucagcu

SEQ ID NO: 101569 - RNA, 20 nt, Artificial Sequence
  MKO10101569_B_Nln
  gRNA
cugucagacgacacgugcug

SEQ ID NO: 101570 - RNA, 20 nt, Artificial Sequence
  MKO10101570_B_Nln
  gRNA
gggacgugucauccucauug

SEQ ID NO: 101571 - RNA, 20 nt, Artificial Sequence
  MKO10101571_B_Nln
  gRNA
caagcacagaagcggacaaa

SEQ ID NO: 101572 - RNA, 20 nt, Artificial Sequence
  MKO10101572_B_Nlrc3
  gRNA
ucuguuaaccaggagggauc

SEQ ID NO: 101573 - RNA, 20 nt, Artificial Sequence
  MKO10101573_B_Nlrc3
  gRNA
gcuggacaacaaccaguucc

SEQ ID NO: 101574 - RNA, 20 nt, Artificial Sequence
  MKO10101574_B_Nlrc3
  gRNA
agcuggggagccaacacugu

SEQ ID NO: 101575 - RNA, 20 nt, Artificial Sequence
  MKO10101575_B_Nlrc4
  gRNA
acagacgagcccuuauucaa

SEQ ID NO: 101576 - RNA, 20 nt, Artificial Sequence
  MKO10101576_B_Nlrc4
  gRNA
cauccaguaugagucucucg

SEQ ID NO: 101577 - RNA, 20 nt, Artificial Sequence
  MKO10101577_B_Nlrc4
  gRNA
ucgggcggcuuccugcucca

SEQ ID NO: 101578 - RNA, 20 nt, Artificial Sequence
  MKO10101578_B_Nlrc5
  gRNA
uaguaggcaaacuccugcag

SEQ ID NO: 101579 - RNA, 20 nt, Artificial Sequence
  MKO10101579_B_Nlrc5
  gRNA
gaggacccauagcucugaaa

SEQ ID NO: 101580 - RNA, 20 nt, Artificial Sequence
  MKO10101580_B_Nlrc5
  gRNA
acagaauucucuaagcagcu

SEQ ID NO: 101581 - RNA, 20 nt, Artificial Sequence
  MKO10101581_B_Nlrp10
  gRNA
gcuuguagacuaccucaacc

SEQ ID NO: 101582 - RNA, 20 nt, Artificial Sequence
  MKO10101582_B_Nlrp10
  gRNA
augucgccguucacccaaca

SEQ ID NO: 101583 - RNA, 20 nt, Artificial Sequence
  MKO10101583_B_Nlrp10
  gRNA
gaacugcaucgacuaccgag

SEQ ID NO: 101584 - RNA, 20 nt, Artificial Sequence
  MKO10101584_B_Nlrp12
  gRNA
cagccgcugucaucgccaac

SEQ ID NO: 101585 - RNA, 20 nt, Artificial Sequence
  MKO10101585_B_Nlrp12
  gRNA
cagcucgaucagguuggagu

SEQ ID NO: 101586 - RNA, 20 nt, Artificial Sequence
  MKO10101586_B_Nlrp12
  gRNA
ugacagcggcugcgaggucc

SEQ ID NO: 101587 - RNA, 20 nt, Artificial Sequence
  MKO10101587_B_Nlrp14
  gRNA
ccaaugcucuccaaaccaau

SEQ ID NO: 101588 - RNA, 20 nt, Artificial Sequence
  MKO10101588_B_Nlrp14
  gRNA
cauacagauccauuucuauc

SEQ ID NO: 101589 - RNA, 20 nt, Artificial Sequence
  MKO10101589_B_Nlrp14
  gRNA
caucauuugauagauuguug

SEQ ID NO: 101590 - RNA, 20 nt, Artificial Sequence
  MKO10101590_B_Nlrp1a
  gRNA
uguacugcauaguagcucag

SEQ ID NO: 101591 - RNA, 20 nt, Artificial Sequence
  MKO10101591_B_Nlrp1a
  gRNA
agaccugcagcugaaugacc

SEQ ID NO: 101592 - RNA, 20 nt, Artificial Sequence
  MKO10101592_B_Nlrp1a
  gRNA
gcugcaggucuagcucaguc

SEQ ID NO: 101593 - RNA, 20 nt, Artificial Sequence
  MKO10101593_B_Nlrp1b
  gRNA
guguaggaugccacaaauga

SEQ ID NO: 101594 - RNA, 20 nt, Artificial Sequence
  MKO10101594_B_Nlrp1b
  gRNA
ccccaaucacuaaugccagu

SEQ ID NO: 101595 - RNA, 20 nt, Artificial Sequence
  MKO10101595_B_Nlrp1b
  gRNA
uccugagcucuguaaucacc

SEQ ID NO: 101596 - RNA, 20 nt, Artificial Sequence
  MKO10101596_B_Nlrp2
  gRNA
aacaacgcauguuaacuuuc

SEQ ID NO: 101597 - RNA, 20 nt, Artificial Sequence
  MKO10101597_B_Nlrp2
  gRNA
gcuccuugaacaaaauucca

SEQ ID NO: 101598 - RNA, 20 nt, Artificial Sequence
  MKO10101598_B_Nlrp2
  gRNA
cucucuuucaggagaacccu

SEQ ID NO: 101599 - RNA, 20 nt, Artificial Sequence
  MKO10101599_B_Nlrp3
  gRNA
gccagacucaccacaguuuc

SEQ ID NO: 101600 - RNA, 20 nt, Artificial Sequence
  MKO10101600_B_Nlrp3
  gRNA
caguucagugaggcuccggu

SEQ ID NO: 101601 - RNA, 20 nt, Artificial Sequence
  MKO10101601_B_Nlrp3
  gRNA
agaugucgaagcagcauuga

SEQ ID NO: 101602 - RNA, 20 nt, Artificial Sequence
  MKO10101602_B_Nlrp4a
  gRNA
aagugcucgagaaugcaguc

SEQ ID NO: 101603 - RNA, 20 nt, Artificial Sequence
  MKO10101603_B_Nlrp4a
  gRNA
gaccuugaagcaucuuaauu

SEQ ID NO: 101604 - RNA, 20 nt, Artificial Sequence
  MKO10101604_B_Nlrp4a
  gRNA
cucuguguucauaaucagua

SEQ ID NO: 101605 - RNA, 20 nt, Artificial Sequence
  MKO10101605_B_Nlrp4b
  gRNA
gaaaacacaaguuauccagc

SEQ ID NO: 101606 - RNA, 20 nt, Artificial Sequence
  MKO10101606_B_Nlrp4b
  gRNA
ggggaaagcuacucauacuu

SEQ ID NO: 101607 - RNA, 20 nt, Artificial Sequence
  MKO10101607_B_Nlrp4b
  gRNA
agcugauguuuagguaucuc

SEQ ID NO: 101608 - RNA, 20 nt, Artificial Sequence
  MKO10101608_B_Nlrp4c
  gRNA
gguccaagugcugcaaacac

SEQ ID NO: 101609 - RNA, 20 nt, Artificial Sequence
  MKO10101609_B_Nlrp4c
  gRNA
augacuauauaacaccaaag

SEQ ID NO: 101610 - RNA, 20 nt, Artificial Sequence
  MKO10101610_B_Nlrp4c
  gRNA
uaacuuacacaagugcuuua

SEQ ID NO: 101611 - RNA, 20 nt, Artificial Sequence
  MKO10101611_B_Nlrp4e
  gRNA
ucaccaaacugaaaauuucc

SEQ ID NO: 101612 - RNA, 20 nt, Artificial Sequence
  MKO10101612_B_Nlrp4e
  gRNA
ugaaauuagugucuuucacu

SEQ ID NO: 101613 - RNA, 20 nt, Artificial Sequence
  MKO10101613_B_Nlrp4e
  gRNA
uuacuuacucaaguacuuua

SEQ ID NO: 101614 - RNA, 20 nt, Artificial Sequence
  MKO10101614_B_Nlrp4f
  gRNA
gcauccaacaauuugaauca

SEQ ID NO: 101615 - RNA, 20 nt, Artificial Sequence
  MKO10101615_B_Nlrp4f
  gRNA
cagcaacugcauuugaugag

SEQ ID NO: 101616 - RNA, 20 nt, Artificial Sequence
  MKO10101616_B_Nlrp4f
  gRNA
agauucauauaaaacucgaa

SEQ ID NO: 101617 - RNA, 20 nt, Artificial Sequence
  MKO10101617_B_Nlrp4g
  gRNA
gaaucaauucaaagaaugcg

SEQ ID NO: 101618 - RNA, 20 nt, Artificial Sequence
  MKO10101618_B_Nlrp4g
  gRNA
gaacugcaguuugcaauauu

SEQ ID NO: 101619 - RNA, 20 nt, Artificial Sequence
  MKO10101619_B_Nlrp4g
  gRNA
ggaaaaaacuaaucaucugu

SEQ ID NO: 101620 - RNA, 20 nt, Artificial Sequence
  MKO10101620_B_Nlrp5
  gRNA
aaagcaaucuugaaagcacg

SEQ ID NO: 101621 - RNA, 20 nt, Artificial Sequence
  MKO10101621_B_Nlrp5
  gRNA
uuggaagaggaacagaaguc

SEQ ID NO: 101622 - RNA, 20 nt, Artificial Sequence
  MKO10101622_B_Nlrp5
  gRNA
ccugaugucugcuccugcuc

SEQ ID NO: 101623 - RNA, 20 nt, Artificial Sequence
  MKO10101623_B_Nlrp6
  gRNA
ggggcgcaucccuuagcuug

SEQ ID NO: 101624 - RNA, 20 nt, Artificial Sequence
  MKO10101624_B_Nlrp6
  gRNA
aggccuggaaggagcguuac

SEQ ID NO: 101625 - RNA, 20 nt, Artificial Sequence
  MKO10101625_B_Nlrp6
  gRNA
ugacacggagagaagcaccg

SEQ ID NO: 101626 - RNA, 20 nt, Artificial Sequence
  MKO10101626_B_Nlrp9a
  gRNA
uaacucacaucagugauucc

SEQ ID NO: 101627 - RNA, 20 nt, Artificial Sequence
  MKO10101627_B_Nlrp9a
  gRNA
agcuucccuuaucaauucug

SEQ ID NO: 101628 - RNA, 20 nt, Artificial Sequence
  MKO10101628_B_Nlrp9a
  gRNA
aucuccaaaguuagucguga

SEQ ID NO: 101629 - RNA, 20 nt, Artificial Sequence
  MKO10101629_B_Nlrp9b
  gRNA
uucgaugucuccaacuccua

SEQ ID NO: 101630 - RNA, 20 nt, Artificial Sequence
  MKO10101630_B_Nlrp9b
  gRNA
acauguagguuggguaaaug

SEQ ID NO: 101631 - RNA, 20 nt, Artificial Sequence
  MKO10101631_B_Nlrp9b
  gRNA
uaacucacaucagugacugc

SEQ ID NO: 101632 - RNA, 20 nt, Artificial Sequence
  MKO10101632_B_Nlrp9c
  gRNA
aaaacagucagaggcauauu

SEQ ID NO: 101633 - RNA, 20 nt, Artificial Sequence
  MKO10101633_B_Nlrp9c
  gRNA
cacugaucucucuaaugaug

SEQ ID NO: 101634 - RNA, 20 nt, Artificial Sequence
  MKO10101634_B_Nlrp9c
  gRNA
aucaaacuuacaacaaucuu

SEQ ID NO: 101635 - RNA, 20 nt, Artificial Sequence
  MKO10101635_B_Nlrx1
  gRNA
ugggcgccgcgugcagaccg

SEQ ID NO: 101636 - RNA, 20 nt, Artificial Sequence
  MKO10101636_B_Nlrx1
  gRNA
agggccuuuauccguuacca

SEQ ID NO: 101637 - RNA, 20 nt, Artificial Sequence
  MKO10101637_B_Nlrx1
  gRNA
ggucucaccuagggggccuc

SEQ ID NO: 101638 - RNA, 20 nt, Artificial Sequence
  MKO10101638_B_Nmbr
  gRNA
uucuuacugcugacgagcug

SEQ ID NO: 101639 - RNA, 20 nt, Artificial Sequence
  MKO10101639_B_Nmbr
  gRNA
cgcgguggucccaucugagu

SEQ ID NO: 101640 - RNA, 20 nt, Artificial Sequence
  MKO10101640_B_Nmbr
  gRNA
agacguccgguguguugcug

SEQ ID NO: 101641 - RNA, 20 nt, Artificial Sequence
  MKO10101641_B_Nmb
  gRNA
ugccuagagcuuucuuucgc

SEQ ID NO: 101642 - RNA, 20 nt, Artificial Sequence
  MKO10101642_B_Nmb
  gRNA
uggcaucacuucugcaguag

SEQ ID NO: 101643 - RNA, 20 nt, Artificial Sequence
  MKO10101643_B_Nmb
  gRNA
ccuucaguacaggaggcugc

SEQ ID NO: 101644 - RNA, 20 nt, Artificial Sequence
  MKO10101644_B_Nmd3
  gRNA
gcacacuguacccaugaugc

SEQ ID NO: 101645 - RNA, 20 nt, Artificial Sequence
  MKO10101645_B_Nmd3
  gRNA
agaccugcuuuggaacaccu

SEQ ID NO: 101646 - RNA, 20 nt, Artificial Sequence
  MKO10101646_B_Nmd3
  gRNA
ggaaggcugugauccaaguc

SEQ ID NO: 101647 - RNA, 20 nt, Artificial Sequence
  MKO10101647_B_Nme1
  gRNA
ucaagucuuaccugccaacu

SEQ ID NO: 101648 - RNA, 20 nt, Artificial Sequence
  MKO10101648_B_Nme1
  gRNA
acaagagcugugcgcagaac

SEQ ID NO: 101649 - RNA, 20 nt, Artificial Sequence
  MKO10101649_B_Nme1
  gRNA
ucucgcccaccagcccccgc

SEQ ID NO: 101650 - RNA, 20 nt, Artificial Sequence
  MKO10101650_B_Nme2
  gRNA
uuucuuaggaacaucauuca

SEQ ID NO: 101651 - RNA, 20 nt, Artificial Sequence
  MKO10101651_B_Nme2
  gRNA
gucuggugaaggucugggag

SEQ ID NO: 101652 - RNA, 20 nt, Artificial Sequence
  MKO10101652_B_Nme2
  gRNA
cugagaaagagauccaucug

SEQ ID NO: 101653 - RNA, 20 nt, Artificial Sequence
  MKO10101653_B_Nme3
  gRNA
auacaugaguucuggccccg

SEQ ID NO: 101654 - RNA, 20 nt, Artificial Sequence
  MKO10101654_B_Nme3
  gRNA
guaccgggcauggcgucccc

SEQ ID NO: 101655 - RNA, 20 nt, Artificial Sequence
  MKO10101655_B_Nme3
  gRNA
ccgcacaggaauguaauuca

SEQ ID NO: 101656 - RNA, 20 nt, Artificial Sequence
  MKO10101656_B_Nme4
  gRNA
cauccaugcuagcgauucug

SEQ ID NO: 101657 - RNA, 20 nt, Artificial Sequence
  MKO10101657_B_Nme4
  gRNA
ugagucgguguguccuauca

SEQ ID NO: 101658 - RNA, 20 nt, Artificial Sequence
  MKO10101658_B_Nme4
  gRNA
ggucugggaaggccccaaug

SEQ ID NO: 101659 - RNA, 20 nt, Artificial Sequence
  MKO10101659_B_Nme5
  gRNA
cauagcucuggcucgcugau

SEQ ID NO: 101660 - RNA, 20 nt, Artificial Sequence
  MKO10101660_B_Nme5
  gRNA
auguaucuuacguaaggguc

SEQ ID NO: 101661 - RNA, 20 nt, Artificial Sequence
  MKO10101661_B_Nme5
  gRNA
gcuaauaucauagcaacaag

SEQ ID NO: 101662 - RNA, 20 nt, Artificial Sequence
  MKO10101662_B_Nme6
  gRNA
aaacuuccacgaauugaauc

SEQ ID NO: 101663 - RNA, 20 nt, Artificial Sequence
  MKO10101663_B_Nme6
  gRNA
cugacuucagugaacagcgc

SEQ ID NO: 101664 - RNA, 20 nt, Artificial Sequence
  MKO10101664_B_Nme6
  gRNA
gaaggcugcaaucucucugc

SEQ ID NO: 101665 - RNA, 20 nt, Artificial Sequence
  MKO10101665_B_Nme7
  gRNA
cauuucaacagauccgucug

SEQ ID NO: 101666 - RNA, 20 nt, Artificial Sequence
  MKO10101666_B_Nme7
  gRNA
caaaccagaugcagugucaa

SEQ ID NO: 101667 - RNA, 20 nt, Artificial Sequence
  MKO10101667_B_Nme7
  gRNA
uccgaaugaugacucugaca

SEQ ID NO: 101668 - RNA, 20 nt, Artificial Sequence
  MKO10101668_B_Nme8
  gRNA
ugauugauguuuaccaagcc

SEQ ID NO: 101669 - RNA, 20 nt, Artificial Sequence
  MKO10101669_B_Nme8
  gRNA
gaugagauguugcugaacaa

SEQ ID NO: 101670 - RNA, 20 nt, Artificial Sequence
  MKO10101670_B_Nme8
  gRNA
ugcaagguccacaccaggcu

SEQ ID NO: 101671 - RNA, 20 nt, Artificial Sequence
  MKO10101671_B_Nme9
  gRNA
caaccucgauccucaucuuu

SEQ ID NO: 101672 - RNA, 20 nt, Artificial Sequence
  MKO10101672_B_Nme9
  gRNA
aacuucugggugcacucaag

SEQ ID NO: 101673 - RNA, 20 nt, Artificial Sequence
  MKO10101673_B_Nme9
  gRNA
uuuguccuaggcuacugaug

SEQ ID NO: 101674 - RNA, 20 nt, Artificial Sequence
  MKO10101674_B_Nmi
  gRNA
cacccagucccacuaaacac

SEQ ID NO: 101675 - RNA, 20 nt, Artificial Sequence
  MKO10101675_B_Nmi
  gRNA
agcgcucaucaccuuugaga

SEQ ID NO: 101676 - RNA, 20 nt, Artificial Sequence
  MKO10101676_B_Nmi
  gRNA
acaaauucucuaugagcugc

SEQ ID NO: 101677 - RNA, 20 nt, Artificial Sequence
  MKO10101677_B_Nmnau1
  gRNA
agcccaccaccgaaucauca

SEQ ID NO: 101678 - RNA, 20 nt, Artificial Sequence
  MKO10101678_B_Nmnau1
  gRNA
ccccaagagcccaaaccaac

SEQ ID NO: 101679 - RNA, 20 nt, Artificial Sequence
  MKO10101679_B_Nmnau1
  gRNA
ccaucaccaacaugcaccuc

SEQ ID NO: 101680 - RNA, 20 nt, Artificial Sequence
  MKO10101680_B_Nmnau2
  gRNA
uuaccuucaucaggucucga

SEQ ID NO: 101681 - RNA, 20 nt, Artificial Sequence
  MKO10101681_B_Nmnau2
  gRNA
uccagaauuccgacuggauc

SEQ ID NO: 101682 - RNA, 20 nt, Artificial Sequence
  MKO10101682_B_Nmnau2
  gRNA
gcagacaaccugcagugugu

SEQ ID NO: 101683 - RNA, 20 nt, Artificial Sequence
  MKO10101683_B_Nmnau3
  gRNA
ucacccgucaaugacagcua

SEQ ID NO: 101684 - RNA, 20 nt, Artificial Sequence
  MKO10101684_B_Nmnau3
  gRNA
agagaccaccuacaccaaac

SEQ ID NO: 101685 - RNA, 20 nt, Artificial Sequence
  MKO10101685_B_Nmnau3
  gRNA
ccagccgggccauggccacu

SEQ ID NO: 101686 - RNA, 20 nt, Artificial Sequence
  MKO10101686_B_Nmral1
  gRNA
acaucgggcucaguaccugc

SEQ ID NO: 101687 - RNA, 20 nt, Artificial Sequence
  MKO10101687_B_Nmral1
  gRNA
gcccgugcauugcuagaaga

SEQ ID NO: 101688 - RNA, 20 nt, Artificial Sequence
  MKO10101688_B_Nmral1
  gRNA
uucugcccuacguacucuuc

SEQ ID NO: 101689 - RNA, 20 nt, Artificial Sequence
  MKO10101689_B_Nmrk1
  gRNA
cugagauaugacgcugcagu

SEQ ID NO: 101690 - RNA, 20 nt, Artificial Sequence
  MKO10101690_B_Nmrk1
  gRNA
cuccucuuacauucuucaua

SEQ ID NO: 101691 - RNA, 20 nt, Artificial Sequence
  MKO10101691_B_Nmrk1
  gRNA
ucuuggcucagugugacaaa

SEQ ID NO: 101692 - RNA, 20 nt, Artificial Sequence
  MKO10101692_B_Nmrk2
  gRNA
caggguggucuucccaccgu

SEQ ID NO: 101693 - RNA, 20 nt, Artificial Sequence
  MKO10101693_B_Nmrk2
  gRNA
ugagcgcgugcaaacuugug

SEQ ID NO: 101694 - RNA, 20 nt, Artificial Sequence
  MKO10101694_B_Nmrk2
  gRNA
cacaaguuugcacgcgcuca

SEQ ID NO: 101695 - RNA, 20 nt, Artificial Sequence
  MKO10101695_B_Nms
  gRNA
auccacaauauccaagccgu

SEQ ID NO: 101696 - RNA, 20 nt, Artificial Sequence
  MKO10101696_B_Nms
  gRNA
aauacauucuaaccaaccua

SEQ ID NO: 101697 - RNA, 20 nt, Artificial Sequence
  MKO10101697_B_Nms
  gRNA
uggcauacuuucugaagcag

SEQ ID NO: 101698 - RNA, 20 nt, Artificial Sequence
  MKO10101698_B_Nmt1
  gRNA
ccuccugaacgagaacuacg

SEQ ID NO: 101699 - RNA, 20 nt, Artificial Sequence
  MKO10101699_B_Nmt1
  gRNA
ugacaaagacaacauucgcc

SEQ ID NO: 101700 - RNA, 20 nt, Artificial Sequence
  MKO10101700_B_Nmt1
  gRNA
uccagguuaccuucacgggc

SEQ ID NO: 101701 - RNA, 20 nt, Artificial Sequence
  MKO10101701_B_Nmt2
  gRNA
gucagaugcagagucggacu

SEQ ID NO: 101702 - RNA, 20 nt, Artificial Sequence
  MKO10101702_B_Nmt2
  gRNA
caaaacgcagauaccaguuu

SEQ ID NO: 101703 - RNA, 20 nt, Artificial Sequence
  MKO10101703_B_Nmt2
  gRNA
acugcugaaucuuaaucucc

SEQ ID NO: 101704 - RNA, 20 nt, Artificial Sequence
  MKO10101704_B_Nmur1
  gRNA
ccguugaguguccauacacc

SEQ ID NO: 101705 - RNA, 20 nt, Artificial Sequence
  MKO10101705_B_Nmur1
  gRNA
ggaucugaaccuuaccgaug

SEQ ID NO: 101706 - RNA, 20 nt, Artificial Sequence
  MKO10101706_B_Nmur1
  gRNA
ugcgcauagucuuguugcgc

SEQ ID NO: 101707 - RNA, 20 nt, Artificial Sequence
  MKO10101707_B_Nmur2
  gRNA
ggucuuuaccugauaccacg

SEQ ID NO: 101708 - RNA, 20 nt, Artificial Sequence
  MKO10101708_B_Nmur2
  gRNA
gaggccccugugggcgaugc

SEQ ID NO: 101709 - RNA, 20 nt, Artificial Sequence
  MKO10101709_B_Nmur2
  gRNA
uguguucaaccucauccacg

SEQ ID NO: 101710 - RNA, 20 nt, Artificial Sequence
  MKO10101710_B_Nmu
  gRNA
cacaauuguaguucuuguuc

SEQ ID NO: 101711 - RNA, 20 nt, Artificial Sequence
  MKO10101711_B_Nmu
  gRNA
agagccuuaccugaggcuuc

SEQ ID NO: 101712 - RNA, 20 nt, Artificial Sequence
  MKO10101712_B_Nmu
  gRNA
ccuuucuguccauugauucc

SEQ ID NO: 101713 - RNA, 20 nt, Artificial Sequence
  MKO10101713_B_Nnau
  gRNA
uuucggaaccauggccgcag

SEQ ID NO: 101714 - RNA, 20 nt, Artificial Sequence
  MKO10101714_B_Nnau
  gRNA
caucuuccgcgugcugcugc

SEQ ID NO: 101715 - RNA, 20 nt, Artificial Sequence
  MKO10101715_B_Nnau
  gRNA
ggcaggugcugggggagcgc

SEQ ID NO: 101716 - RNA, 20 nt, Artificial Sequence
  MKO10101716_B_Nnmt
  gRNA
agagacaaugaucuccguga

SEQ ID NO: 101717 - RNA, 20 nt, Artificial Sequence
  MKO10101717_B_Nnmt
  gRNA
augacuuagauaaguguccu

SEQ ID NO: 101718 - RNA, 20 nt, Artificial Sequence
  MKO10101718_B_Nnmt
  gRNA
ggaaucuggcuucaccucca

SEQ ID NO: 101719 - RNA, 20 nt, Artificial Sequence
  MKO10101719_B_Nnt
  gRNA
acgaacgcuucguacucacc

SEQ ID NO: 101720 - RNA, 20 nt, Artificial Sequence
  MKO10101720_B_Nnt
  gRNA
guuauacauaccuucgcagg

SEQ ID NO: 101721 - RNA, 20 nt, Artificial Sequence
  MKO10101721_B_Nnt
  gRNA
uucaauguugucguggaauc

SEQ ID NO: 101722 - RNA, 20 nt, Artificial Sequence
  MKO10101722_B_Noa1
  gRNA
agaagaugcgaccaaagcug

SEQ ID NO: 101723 - RNA, 20 nt, Artificial Sequence
  MKO10101723_B_Noa1
  gRNA
uuaccuguaggaaaucuauu

SEQ ID NO: 101724 - RNA, 20 nt, Artificial Sequence
  MKO10101724_B_Noa1
  gRNA
gcucuguaugagaaacaugc

SEQ ID NO: 101725 - RNA, 20 nt, Artificial Sequence
  MKO10101725_B_Nob1
  gRNA
ucucgggcccaucagcugcg

SEQ ID NO: 101726 - RNA, 20 nt, Artificial Sequence
  MKO10101726_B_Nob1
  gRNA
gcuggcucugacuuaccagc

SEQ ID NO: 101727 - RNA, 20 nt, Artificial Sequence
  MKO10101727_B_Nob1
  gRNA
ccucucugccacagauaucc

SEQ ID NO: 101728 - RNA, 20 nt, Artificial Sequence
  MKO10101728_B_Nobox
  gRNA
gggaccacaugcggcugcug

SEQ ID NO: 101729 - RNA, 20 nt, Artificial Sequence
  MKO10101729_B_Nobox
  gRNA
gguaaccccccaaagaauca

SEQ ID NO: 101730 - RNA, 20 nt, Artificial Sequence
  MKO10101730_B_Nobox
  gRNA
acgccaugagauuucccaga

SEQ ID NO: 101731 - RNA, 20 nt, Artificial Sequence
  MKO10101731_B_Noc2l
  gRNA
cgcgaggagccgcguggaac

SEQ ID NO: 101732 - RNA, 20 nt, Artificial Sequence
  MKO10101732_B_Noc2l
  gRNA
ccaggaagcgagcgaaacag

SEQ ID NO: 101733 - RNA, 20 nt, Artificial Sequence
  MKO10101733_B_Noc2l
  gRNA
gguuucaccuccagcguguc

SEQ ID NO: 101734 - RNA, 20 nt, Artificial Sequence
  MKO10101734_B_Noc3l
  gRNA
gauucaccugcucccuauca

SEQ ID NO: 101735 - RNA, 20 nt, Artificial Sequence
  MKO10101735_B_Noc3l
  gRNA
ggaugaccuacagcugauga

SEQ ID NO: 101736 - RNA, 20 nt, Artificial Sequence
  MKO10101736_B_Noc3l
  gRNA
cacugacgugcagcaagaag

SEQ ID NO: 101737 - RNA, 20 nt, Artificial Sequence
  MKO10101737_B_Noc4l
  gRNA
cgcacgugcagccgacucuu

SEQ ID NO: 101738 - RNA, 20 nt, Artificial Sequence
  MKO10101738_B_Noc4l
  gRNA
ggcccgggccaugaugcuag

SEQ ID NO: 101739 - RNA, 20 nt, Artificial Sequence
  MKO10101739_B_Noc4l
  gRNA
caaacuucaugagugucuug

SEQ ID NO: 101740 - RNA, 20 nt, Artificial Sequence
  MKO10101740_B_Nod1
  gRNA
gguccgaaagauccuugacc

SEQ ID NO: 101741 - RNA, 20 nt, Artificial Sequence
  MKO10101741_B_Nod1
  gRNA
uggcuccgauaucaguuauc

SEQ ID NO: 101742 - RNA, 20 nt, Artificial Sequence
  MKO10101742_B_Nod1
  gRNA
gaacgucacgaucuuauacu

SEQ ID NO: 101743 - RNA, 20 nt, Artificial Sequence
  MKO10101743_B_Nod2
  gRNA
gagcacacucaaccagcgug

SEQ ID NO: 101744 - RNA, 20 nt, Artificial Sequence
  MKO10101744_B_Nod2
  gRNA
aaggcugcuugaucucgcug

SEQ ID NO: 101745 - RNA, 20 nt, Artificial Sequence
  MKO10101745_B_Nod2
  gRNA
gauaacaauaucucagaccg

SEQ ID NO: 101746 - RNA, 20 nt, Artificial Sequence
  MKO10101746_B_Nodal
  gRNA
gcccucgucaccguccccuc

SEQ ID NO: 101747 - RNA, 20 nt, Artificial Sequence
  MKO10101747_B_Nodal
  gRNA
cagucagcggggucccgcuc

SEQ ID NO: 101748 - RNA, 20 nt, Artificial Sequence
  MKO10101748_B_Nodal
  gRNA
cuucacgggggcacagcacg

SEQ ID NO: 101749 - RNA, 20 nt, Artificial Sequence
  MKO10101749_B_Nog
  gRNA
ucauuccacgcguacagcac

SEQ ID NO: 101750 - RNA, 20 nt, Artificial Sequence
  MKO10101750_B_Nog
  gRNA
agcgccaccgcagcaccgug

SEQ ID NO: 101751 - RNA, 20 nt, Artificial Sequence
  MKO10101751_B_Nog
  gRNA
ucugcccggugcuguacgcg

SEQ ID NO: 101752 - RNA, 20 nt, Artificial Sequence
  MKO10101752_B_Nol10
  gRNA
uuuaucagaugacuauucaa

SEQ ID NO: 101753 - RNA, 20 nt, Artificial Sequence
  MKO10101753_B_Nol10
  gRNA
ccaagcaccuuucaaacuuc

SEQ ID NO: 101754 - RNA, 20 nt, Artificial Sequence
  MKO10101754_B_Nol10
  gRNA
ucucguaguggcuuucugac

SEQ ID NO: 101755 - RNA, 20 nt, Artificial Sequence
  MKO10101755_B_Nol11
  gRNA
uauuaugguacaugaccaua

SEQ ID NO: 101756 - RNA, 20 nt, Artificial Sequence
  MKO10101756_B_Nol11
  gRNA
gguuucugaccagaaaccgu

SEQ ID NO: 101757 - RNA, 20 nt, Artificial Sequence
  MKO10101757_B_Nol11
  gRNA
uuccgaggaggcgcugcucg

SEQ ID NO: 101758 - RNA, 20 nt, Artificial Sequence
  MKO10101758_B_Nol12
  gRNA
cucucaggggcccggcugcu

SEQ ID NO: 101759 - RNA, 20 nt, Artificial Sequence
  MKO10101759_B_Nol12
  gRNA
guuucucuagcaaggggacc

SEQ ID NO: 101760 - RNA, 20 nt, Artificial Sequence
  MKO10101760_B_Nol12
  gRNA
gggaugacaucuccucuucc

SEQ ID NO: 101761 - RNA, 20 nt, Artificial Sequence
  MKO10101761_B_Nol3
  gRNA
aagggucauagcugcgguuc

SEQ ID NO: 101762 - RNA, 20 nt, Artificial Sequence
  MKO10101762_B_Nol3
  gRNA
agcagaaaugggcaacgugc

SEQ ID NO: 101763 - RNA, 20 nt, Artificial Sequence
  MKO10101763_B_Nol3
  gRNA
cuaccagccguuuccguucc

SEQ ID NO: 101764 - RNA, 20 nt, Artificial Sequence
  MKO10101764_B_Nol4
  gRNA
uucauguacgccauugugau

SEQ ID NO: 101765 - RNA, 20 nt, Artificial Sequence
  MKO10101765_B_Nol4
  gRNA
cauguuguagucgaucaugc

SEQ ID NO: 101766 - RNA, 20 nt, Artificial Sequence
  MKO10101766_B_Nol4
  gRNA
caucaucuauuccaugcaug

SEQ ID NO: 101767 - RNA, 20 nt, Artificial Sequence
  MKO10101767_B_Nol6
  gRNA
acguacuuguaaacgaagca

SEQ ID NO: 101768 - RNA, 20 nt, Artificial Sequence
  MKO10101768_B_Nol6
  gRNA
ccaagugcccuaugccguga

SEQ ID NO: 101769 - RNA, 20 nt, Artificial Sequence
  MKO10101769_B_Nol6
  gRNA
aggcacuuucuggauccgcu

SEQ ID NO: 101770 - RNA, 20 nt, Artificial Sequence
  MKO10101770_B_Nol7
  gRNA
guacagaaagugcagucugu

SEQ ID NO: 101771 - RNA, 20 nt, Artificial Sequence
  MKO10101771_B_Nol7
  gRNA
agcugcucuaauacagcauc

SEQ ID NO: 101772 - RNA, 20 nt, Artificial Sequence
  MKO10101772_B_Nol7
  gRNA
aaaagugaacagcaugcaaa

SEQ ID NO: 101773 - RNA, 20 nt, Artificial Sequence
  MKO10101773_B_Nol8
  gRNA
uuccaggcacagccuucaua

SEQ ID NO: 101774 - RNA, 20 nt, Artificial Sequence
  MKO10101774_B_Nol8
  gRNA
uaacauucaaauaacagaag

SEQ ID NO: 101775 - RNA, 20 nt, Artificial Sequence
  MKO10101775_B_Nol8
  gRNA
agaaaugaagcgccucuuug

SEQ ID NO: 101776 - RNA, 20 nt, Artificial Sequence
  MKO10101776_B_Nol9
  gRNA
aacucagaauugacccgaac

SEQ ID NO: 101777 - RNA, 20 nt, Artificial Sequence
  MKO10101777_B_Nol9
  gRNA
ugcguacggaaccccauuga

SEQ ID NO: 101778 - RNA, 20 nt, Artificial Sequence
  MKO10101778_B_Nol9
  gRNA
acacgcugacuaacucuucc

SEQ ID NO: 101779 - RNA, 20 nt, Artificial Sequence
  MKO10101779_B_Nolc1
  gRNA
cgccaaugccucgucccucu

SEQ ID NO: 101780 - RNA, 20 nt, Artificial Sequence
  MKO10101780_B_Nolc1
  gRNA
caguagugaagaauccagug

SEQ ID NO: 101781 - RNA, 20 nt, Artificial Sequence
  MKO10101781_B_Nolc1
  gRNA
ggacgaggacaaaaaagccc

SEQ ID NO: 101782 - RNA, 20 nt, Artificial Sequence
  MKO10101782_B_Nom1
  gRNA
agaugacgccuugucacuua

SEQ ID NO: 101783 - RNA, 20 nt, Artificial Sequence
  MKO10101783_B_Nom1
  gRNA
uucuauaagugggcagcuag

SEQ ID NO: 101784 - RNA, 20 nt, Artificial Sequence
  MKO10101784_B_Nom1
  gRNA
ccuuaagguacgguuuaugu

SEQ ID NO: 101785 - RNA, 20 nt, Artificial Sequence
  MKO10101785_B_Nomo1
  gRNA
auccacucgcagcuccacgu

SEQ ID NO: 101786 - RNA, 20 nt, Artificial Sequence
  MKO10101786_B_Nomo1
  gRNA
caggcugcgugacuguagac

SEQ ID NO: 101787 - RNA, 20 nt, Artificial Sequence
  MKO10101787_B_Nomo1
  gRNA
uaugauccccuuguaugaua

SEQ ID NO: 101788 - RNA, 20 nt, Artificial Sequence
  MKO10101788_B_Nono
  gRNA
ggcugcacgucaugagcacc

SEQ ID NO: 101789 - RNA, 20 nt, Artificial Sequence
  MKO10101789_B_Nono
  gRNA
uacucauacucaaaggagcc

SEQ ID NO: 101790 - RNA, 20 nt, Artificial Sequence
  MKO10101790_B_Nono
  gRNA
auuuccucggccugugacug

SEQ ID NO: 101791 - RNA, 20 nt, Artificial Sequence
  MKO10101791_B_Nop10
  gRNA
ggagaaccgagcaggauggg

SEQ ID NO: 101792 - RNA, 20 nt, Artificial Sequence
  MKO10101792_B_Nop10
  gRNA
ccaauauuaccucaacgagc

SEQ ID NO: 101793 - RNA, 20 nt, Artificial Sequence
  MKO10101793_B_Nop10
  gRNA
ugagcagaaauuugacccua

SEQ ID NO: 101794 - RNA, 20 nt, Artificial Sequence
  MKO10101794_B_Nop14
  gRNA
acuuaccugacaaugccccc

SEQ ID NO: 101795 - RNA, 20 nt, Artificial Sequence
  MKO10101795_B_Nop14
  gRNA
gaugaagaauugacucauua

SEQ ID NO: 101796 - RNA, 20 nt, Artificial Sequence
  MKO10101796_B_Nop14
  gRNA
gaacugacugcuucccacuu

SEQ ID NO: 101797 - RNA, 20 nt, Artificial Sequence
  MKO10101797_B_Nop16
  gRNA
acucugcagagaaucgauga

SEQ ID NO: 101798 - RNA, 20 nt, Artificial Sequence
  MKO10101798_B_Nop16
  gRNA
cuccgccagguucugccgca

SEQ ID NO: 101799 - RNA, 20 nt, Artificial Sequence
  MKO10101799_B_Nop16
  gRNA
caugguagagaaucacgggg

SEQ ID NO: 101800 - RNA, 20 nt, Artificial Sequence
  MKO10101800_B_Nop2
  gRNA
acucuucucaggagcagucc

SEQ ID NO: 101801 - RNA, 20 nt, Artificial Sequence
  MKO10101801_B_Nop2
  gRNA
auucuuucagggcagccaag

SEQ ID NO: 101802 - RNA, 20 nt, Artificial Sequence
  MKO10101802_B_Nop2
  gRNA
uaaccuuuggauaacucucc

SEQ ID NO: 101803 - RNA, 20 nt, Artificial Sequence
  MKO10101803_B_Nop56
  gRNA
ccaccagacgaacgacauug

SEQ ID NO: 101804 - RNA, 20 nt, Artificial Sequence
  MKO10101804_B_Nop56
  gRNA
cuacgcgcuguuggcgcuga

SEQ ID NO: 101805 - RNA, 20 nt, Artificial Sequence
  MKO10101805_B_Nop56
  gRNA
gugauagcugagauccuucg

SEQ ID NO: 101806 - RNA, 20 nt, Artificial Sequence
  MKO10101806_B_Nop58
  gRNA
uuagcaucagcgacagccag

SEQ ID NO: 101807 - RNA, 20 nt, Artificial Sequence
  MKO10101807_B_Nop58
  gRNA
gaaugagaagaaacuucaag

SEQ ID NO: 101808 - RNA, 20 nt, Artificial Sequence
  MKO10101808_B_Nop58
  gRNA
aucucacgugguucuacccc

SEQ ID NO: 101809 - RNA, 20 nt, Artificial Sequence
  MKO10101809_B_Nop9
  gRNA
guccugaaggcgauucaaga

SEQ ID NO: 101810 - RNA, 20 nt, Artificial Sequence
  MKO10101810_B_Nop9
  gRNA
gcauccagcaagcgcugcaa

SEQ ID NO: 101811 - RNA, 20 nt, Artificial Sequence
  MKO10101811_B_Nop9
  gRNA
ucgucugaucccgaagaaac

SEQ ID NO: 101812 - RNA, 20 nt, Artificial Sequence
  MKO10101812_B_Nos1ap
  gRNA
uggcugccaugcgcagaauc

SEQ ID NO: 101813 - RNA, 20 nt, Artificial Sequence
  MKO10101813_B_Nos1ap
  gRNA
guuacaucugaagauauugc

SEQ ID NO: 101814 - RNA, 20 nt, Artificial Sequence
  MKO10101814_B_Nos1ap
  gRNA
uucagcuauauugccagaga

SEQ ID NO: 101815 - RNA, 20 nt, Artificial Sequence
  MKO10101815_B_Nos1
  gRNA
gucagaagauguccgcacca

SEQ ID NO: 101816 - RNA, 20 nt, Artificial Sequence
  MKO10101816_B_Nos1
  gRNA
cuuugugcaguuugccgucg

SEQ ID NO: 101817 - RNA, 20 nt, Artificial Sequence
  MKO10101817_B_Nos1
  gRNA
ccugcaccugaagagcacgc

SEQ ID NO: 101818 - RNA, 20 nt, Artificial Sequence
  MKO10101818_B_Nos2
  gRNA
gaguucaucaaccaguauua

SEQ ID NO: 101819 - RNA, 20 nt, Artificial Sequence
  MKO10101819_B_Nos2
  gRNA
aaccccaagaguuugaccag

SEQ ID NO: 101820 - RNA, 20 nt, Artificial Sequence
  MKO10101820_B_Nos2
  gRNA
uucuuaccgauguggccuug

SEQ ID NO: 101821 - RNA, 20 nt, Artificial Sequence
  MKO10101821_B_Nos3
  gRNA
acuucccaauucuuuacucg

SEQ ID NO: 101822 - RNA, 20 nt, Artificial Sequence
  MKO10101822_B_Nos3
  gRNA
cuguaccucaagacgcugcu

SEQ ID NO: 101823 - RNA, 20 nt, Artificial Sequence
  MKO10101823_B_Nos3
  gRNA
aguacugauugaugaagucc

SEQ ID NO: 101824 - RNA, 20 nt, Artificial Sequence
  MKO10101824_B_Nosip
  gRNA
ggaucgcuucccucucauac

SEQ ID NO: 101825 - RNA, 20 nt, Artificial Sequence
  MKO10101825_B_Nosip
  gRNA
cagacggcuaccuguaugag

SEQ ID NO: 101826 - RNA, 20 nt, Artificial Sequence
  MKO10101826_B_Nosip
  gRNA
cgcuccucgcugcuucucau

SEQ ID NO: 101827 - RNA, 20 nt, Artificial Sequence
  MKO10101827_B_Nostrin
  gRNA
cugaaagaguuugcccaaca

SEQ ID NO: 101828 - RNA, 20 nt, Artificial Sequence
  MKO10101828_B_Nostrin
  gRNA
ugcagaaauugucuccaugu

SEQ ID NO: 101829 - RNA, 20 nt, Artificial Sequence
  MKO10101829_B_Nostrin
  gRNA
acuuggcaaagcaauugagu

SEQ ID NO: 101830 - RNA, 20 nt, Artificial Sequence
  MKO10101830_B_Nouch1
  gRNA
cacacaggcuucagugccgu

SEQ ID NO: 101831 - RNA, 20 nt, Artificial Sequence
  MKO10101831_B_Nouch1
  gRNA
acgugccacguuguggacca

SEQ ID NO: 101832 - RNA, 20 nt, Artificial Sequence
  MKO10101832_B_Nouch1
  gRNA
gccugccgugccacccauac

SEQ ID NO: 101833 - RNA, 20 nt, Artificial Sequence
  MKO10101833_B_Nouch2
  gRNA
gcacccucgcccugcgucaa

SEQ ID NO: 101834 - RNA, 20 nt, Artificial Sequence
  MKO10101834_B_Nouch2
  gRNA
cauuaccugugaagccgacu

SEQ ID NO: 101835 - RNA, 20 nt, Artificial Sequence
  MKO10101835_B_Nouch2
  gRNA
auugccgcugucccccucag

SEQ ID NO: 101836 - RNA, 20 nt, Artificial Sequence
  MKO10101836_B_Nouch3
  gRNA
ggugggugagcggugccagc

SEQ ID NO: 101837 - RNA, 20 nt, Artificial Sequence
  MKO10101837_B_Nouch3
  gRNA
aggcguuugccagaguucag

SEQ ID NO: 101838 - RNA, 20 nt, Artificial Sequence
  MKO10101838_B_Nouch3
  gRNA
ccuggacaucggugucucaa

SEQ ID NO: 101839 - RNA, 20 nt, Artificial Sequence
  MKO10101839_B_Nouch4
  gRNA
cgacaucaacgagugcuucc

SEQ ID NO: 101840 - RNA, 20 nt, Artificial Sequence
  MKO10101840_B_Nouch4
  gRNA
ccugacagguuucacggggc

SEQ ID NO: 101841 - RNA, 20 nt, Artificial Sequence
  MKO10101841_B_Nouch4
  gRNA
cuuguccccgagauagccuc

SEQ ID NO: 101842 - RNA, 20 nt, Artificial Sequence
  MKO10101842_B_Noto
  gRNA
cucucaccugauucuccguc

SEQ ID NO: 101843 - RNA, 20 nt, Artificial Sequence
  MKO10101843_B_Noto
  gRNA
cccguggucccgaaggucca

SEQ ID NO: 101844 - RNA, 20 nt, Artificial Sequence
  MKO10101844_B_Noto
  gRNA
uccaauuauaggugaggauc

SEQ ID NO: 101845 - RNA, 20 nt, Artificial Sequence
  MKO10101845_B_Notum
  gRNA
cuuacugcuccagugacguu

SEQ ID NO: 101846 - RNA, 20 nt, Artificial Sequence
  MKO10101846_B_Notum
  gRNA
aguccaagggcagucggcgg

SEQ ID NO: 101847 - RNA, 20 nt, Artificial Sequence
  MKO10101847_B_Notum
  gRNA
agccccacuccaaacgucac

SEQ ID NO: 101848 - RNA, 20 nt, Artificial Sequence
  MKO10101848_B_Nova1
  gRNA
gaagcgcugaacgcaguuca

SEQ ID NO: 101849 - RNA, 20 nt, Artificial Sequence
  MKO10101849_B_Nova1
  gRNA
cagcacggcugguggaacgg

SEQ ID NO: 101850 - RNA, 20 nt, Artificial Sequence
  MKO10101850_B_Nova1
  gRNA
gaccaccuccagagccaauc

SEQ ID NO: 101851 - RNA, 20 nt, Artificial Sequence
  MKO10101851_B_Nova2
  gRNA
accccucgagacgccccccg

SEQ ID NO: 101852 - RNA, 20 nt, Artificial Sequence
  MKO10101852_B_Nova2
  gRNA
accuuugccgaugauugagc

SEQ ID NO: 101853 - RNA, 20 nt, Artificial Sequence
  MKO10101853_B_Nova2
  gRNA
cucauccccagcuacgccgc

SEQ ID NO: 101854 - RNA, 20 nt, Artificial Sequence
  MKO10101854_B_Nov
  gRNA
agacucgucucugcaucguu

SEQ ID NO: 101855 - RNA, 20 nt, Artificial Sequence
  MKO10101855_B_Nov
  gRNA
ggcgcaggucggugauauac

SEQ ID NO: 101856 - RNA, 20 nt, Artificial Sequence
  MKO10101856_B_Nov
  gRNA
uagugcaauucucgaacugu

SEQ ID NO: 101857 - RNA, 20 nt, Artificial Sequence
  MKO10101857_B_Nox1
  gRNA
ucauauaugccaccagcuua

SEQ ID NO: 101858 - RNA, 20 nt, Artificial Sequence
  MKO10101858_B_Nox1
  gRNA
caaccucaccuuccauaagc

SEQ ID NO: 101859 - RNA, 20 nt, Artificial Sequence
  MKO10101859_B_Nox1
  gRNA
aaaaauguucagccccaacc

SEQ ID NO: 101860 - RNA, 20 nt, Artificial Sequence
  MKO10101860_B_Nox3
  gRNA
ugcccgggcccaugccaaug

SEQ ID NO: 101861 - RNA, 20 nt, Artificial Sequence
  MKO10101861_B_Nox3
  gRNA
auggauaguccgcauuggca

SEQ ID NO: 101862 - RNA, 20 nt, Artificial Sequence
  MKO10101862_B_Nox3
  gRNA
aucccuaguuauccacauug

SEQ ID NO: 101863 - RNA, 20 nt, Artificial Sequence
  MKO10101863_B_Nox4
  gRNA
acaguccuggcuuaucuucg

SEQ ID NO: 101864 - RNA, 20 nt, Artificial Sequence
  MKO10101864_B_Nox4
  gRNA
cuguccggcacauagguaaa

SEQ ID NO: 101865 - RNA, 20 nt, Artificial Sequence
  MKO10101865_B_Nox4
  gRNA
aagacucuacacaucacaug

SEQ ID NO: 101866 - RNA, 20 nt, Artificial Sequence
  MKO10101866_B_Noxa1
  gRNA
gauugccuccacuagaguau

SEQ ID NO: 101867 - RNA, 20 nt, Artificial Sequence
  MKO10101867_B_Noxa1
  gRNA
auuugaccaagcagugacua

SEQ ID NO: 101868 - RNA, 20 nt, Artificial Sequence
  MKO10101868_B_Noxa1
  gRNA
ggcaaucuccaaauggccag

SEQ ID NO: 101869 - RNA, 20 nt, Artificial Sequence
  MKO10101869_B_Noxo1
  gRNA
auauuacuacgacauccuuc

SEQ ID NO: 101870 - RNA, 20 nt, Artificial Sequence
  MKO10101870_B_Noxo1
  gRNA
cauuugccuucuccgugugc

SEQ ID NO: 101871 - RNA, 20 nt, Artificial Sequence
  MKO10101871_B_Noxo1
  gRNA
ggugauccugccuacaccag

SEQ ID NO: 101872 - RNA, 20 nt, Artificial Sequence
  MKO10101872_B_Noxred1
  gRNA
aaacacgcuccuugacguac

SEQ ID NO: 101873 - RNA, 20 nt, Artificial Sequence
  MKO10101873_B_Noxred1
  gRNA
cagcguugucauagacgcac

SEQ ID NO: 101874 - RNA, 20 nt, Artificial Sequence
  MKO10101874_B_Noxred1
  gRNA
ucaucaaugccuguacguca

SEQ ID NO: 101875 - RNA, 20 nt, Artificial Sequence
  MKO10101875_B_Npas1
  gRNA
gaagucuucgagcaacaccu

SEQ ID NO: 101876 - RNA, 20 nt, Artificial Sequence
  MKO10101876_B_Npas1
  gRNA
cuucguguucgcuuugaacc

SEQ ID NO: 101877 - RNA, 20 nt, Artificial Sequence
  MKO10101877_B_Npas1
  gRNA
cccgcaauccaaguugcucu

SEQ ID NO: 101878 - RNA, 20 nt, Artificial Sequence
  MKO10101878_B_Npas2
  gRNA
ucucuugcaggcggauguca

SEQ ID NO: 101879 - RNA, 20 nt, Artificial Sequence
  MKO10101879_B_Npas2
  gRNA
cuucucagacuuauuucgag

SEQ ID NO: 101880 - RNA, 20 nt, Artificial Sequence
  MKO10101880_B_Npas2
  gRNA
aacucaccgguaaaugucca

SEQ ID NO: 101881 - RNA, 20 nt, Artificial Sequence
  MKO10101881_B_Npas3
  gRNA
caucaccagccagcucgaca

SEQ ID NO: 101882 - RNA, 20 nt, Artificial Sequence
  MKO10101882_B_Npas3
  gRNA
uuagagguaccugcaaaaug

SEQ ID NO: 101883 - RNA, 20 nt, Artificial Sequence
  MKO10101883_B_Npas3
  gRNA
gugcaaauacgaagccaucc

SEQ ID NO: 101884 - RNA, 20 nt, Artificial Sequence
  MKO10101884_B_Npas4
  gRNA
guucgcugcgcucaaagccc

SEQ ID NO: 101885 - RNA, 20 nt, Artificial Sequence
  MKO10101885_B_Npas4
  gRNA
acugcuacaccccgaggacc

SEQ ID NO: 101886 - RNA, 20 nt, Artificial Sequence
  MKO10101886_B_Npas4
  gRNA
ucacccuacaggcacuccuu

SEQ ID NO: 101887 - RNA, 20 nt, Artificial Sequence
  MKO10101887_B_Npau
  gRNA
gcagaacacuguacugauga

SEQ ID NO: 101888 - RNA, 20 nt, Artificial Sequence
  MKO10101888_B_Npau
  gRNA
uaaauaccaaccucucugau

SEQ ID NO: 101889 - RNA, 20 nt, Artificial Sequence
  MKO10101889_B_Npau
  gRNA
aggagcaugcacaguucucc

SEQ ID NO: 101890 - RNA, 20 nt, Artificial Sequence
  MKO10101890_B_Npbwr1
  gRNA
caaauuaccccguagacgac

SEQ ID NO: 101891 - RNA, 20 nt, Artificial Sequence
  MKO10101891_B_Npbwr1
  gRNA
ccuuggcguggcuaucuagc

SEQ ID NO: 101892 - RNA, 20 nt, Artificial Sequence
  MKO10101892_B_Npbwr1
  gRNA
caugagcgccgaccgauacc

SEQ ID NO: 101893 - RNA, 20 nt, Artificial Sequence
  MKO10101893_B_Npb
  gRNA
agaagacguccgcuuuacac

SEQ ID NO: 101894 - RNA, 20 nt, Artificial Sequence
  MKO10101894_B_Npb
  gRNA
cgcaucucuaaauugcgcag

SEQ ID NO: 101895 - RNA, 20 nt, Artificial Sequence
  MKO10101895_B_Npb
  gRNA
cgcggcccaccgaguagugg

SEQ ID NO: 101896 - RNA, 20 nt, Artificial Sequence
  MKO10101896_B_Npc1l1
  gRNA
ccccgcugaugauccccgca

SEQ ID NO: 101897 - RNA, 20 nt, Artificial Sequence
  MKO10101897_B_Npc1l1
  gRNA
gugccaucuuuguacgugag

SEQ ID NO: 101898 - RNA, 20 nt, Artificial Sequence
  MKO10101898_B_Npc1l1
  gRNA
caccgcaacucggcuccauc

SEQ ID NO: 101899 - RNA, 20 nt, Artificial Sequence
  MKO10101899_B_Npc1
  gRNA
ggagaguguggaauugcgac

SEQ ID NO: 101900 - RNA, 20 nt, Artificial Sequence
  MKO10101900_B_Npc1
  gRNA
ucugaaugugacagcaacug

SEQ ID NO: 101901 - RNA, 20 nt, Artificial Sequence
  MKO10101901_B_Npc1
  gRNA
ccuaccuggacaggaacugc

SEQ ID NO: 101902 - RNA, 20 nt, Artificial Sequence
  MKO10101902_B_Npc2
  gRNA
gucaacaucaccuuuaccag

SEQ ID NO: 101903 - RNA, 20 nt, Artificial Sequence
  MKO10101903_B_Npc2
  gRNA
ggcggagccccugcacuuca

SEQ ID NO: 101904 - RNA, 20 nt, Artificial Sequence
  MKO10101904_B_Npc2
  gRNA
gccuagcuugugaucugaac

SEQ ID NO: 101905 - RNA, 20 nt, Artificial Sequence
  MKO10101905_B_Npcd
  gRNA
uccaacucacuucugcucga

SEQ ID NO: 101906 - RNA, 20 nt, Artificial Sequence
  MKO10101906_B_Npcd
  gRNA
gacucggcagguacagcacu

SEQ ID NO: 101907 - RNA, 20 nt, Artificial Sequence
  MKO10101907_B_Npcd
  gRNA
gaaagggaacgugagcugua

SEQ ID NO: 101908 - RNA, 20 nt, Artificial Sequence
  MKO10101908_B_Npdc1
  gRNA
gccucuucagugcacaaucc

SEQ ID NO: 101909 - RNA, 20 nt, Artificial Sequence
  MKO10101909_B_Npdc1
  gRNA
ggagaucgauucucuggccc

SEQ ID NO: 101910 - RNA, 20 nt, Artificial Sequence
  MKO10101910_B_Npdc1
  gRNA
gccuggauugugcacugaag

SEQ ID NO: 101911 - RNA, 20 nt, Artificial Sequence
  MKO10101911_B_Npepl1
  gRNA
cugccacuguggcgcaguuc

SEQ ID NO: 101912 - RNA, 20 nt, Artificial Sequence
  MKO10101912_B_Npepl1
  gRNA
ugaugaagugggcugcggac

SEQ ID NO: 101913 - RNA, 20 nt, Artificial Sequence
  MKO10101913_B_Npepl1
  gRNA
ccacaaugcgagcugcuagu

SEQ ID NO: 101914 - RNA, 20 nt, Artificial Sequence
  MKO10101914_B_Npepps
  gRNA
gauaguuaaauccugucgca

SEQ ID NO: 101915 - RNA, 20 nt, Artificial Sequence
  MKO10101915_B_Npepps
  gRNA
agcagauacaccaccccugc

SEQ ID NO: 101916 - RNA, 20 nt, Artificial Sequence
  MKO10101916_B_Npepps
  gRNA
cagaguggcuuuaucaaaua

SEQ ID NO: 101917 - RNA, 20 nt, Artificial Sequence
  MKO10101917_B_Npffr1
  gRNA
gagugaugcugaaaccgccc

SEQ ID NO: 101918 - RNA, 20 nt, Artificial Sequence
  MKO10101918_B_Npffr1
  gRNA
ugugaaaaccgacgcagaca

SEQ ID NO: 101919 - RNA, 20 nt, Artificial Sequence
  MKO10101919_B_Npffr1
  gRNA
uucucaccucuccacggcaa

SEQ ID NO: 101920 - RNA, 20 nt, Artificial Sequence
  MKO10101920_B_Npffr2
  gRNA
cuauguugcguuucgcucuc

SEQ ID NO: 101921 - RNA, 20 nt, Artificial Sequence
  MKO10101921_B_Npffr2
  gRNA
uugcacaugcugcuuccgaa

SEQ ID NO: 101922 - RNA, 20 nt, Artificial Sequence
  MKO10101922_B_Npffr2
  gRNA
ccccaugcaggauggccauu

SEQ ID NO: 101923 - RNA, 20 nt, Artificial Sequence
  MKO10101923_B_Npff
  gRNA
ccucuuucguguucugcucc

SEQ ID NO: 101924 - RNA, 20 nt, Artificial Sequence
  MKO10101924_B_Npff
  gRNA
guucacucacugcaaagacu

SEQ ID NO: 101925 - RNA, 20 nt, Artificial Sequence
  MKO10101925_B_Npff
  gRNA
auggcagcauggacuccaag

SEQ ID NO: 101926 - RNA, 20 nt, Artificial Sequence
  MKO10101926_B_Nphp1
  gRNA
ucuguuguagguugauaguu

SEQ ID NO: 101927 - RNA, 20 nt, Artificial Sequence
  MKO10101927_B_Nphp1
  gRNA
uagauguauccaguuaaaac

SEQ ID NO: 101928 - RNA, 20 nt, Artificial Sequence
  MKO10101928_B_Nphp1
  gRNA
gacuucgcugcucagcagac

SEQ ID NO: 101929 - RNA, 20 nt, Artificial Sequence
  MKO10101929_B_Nphp3
  gRNA
accucgguugauguuugcaa

SEQ ID NO: 101930 - RNA, 20 nt, Artificial Sequence
  MKO10101930_B_Nphp3
  gRNA
agaugaaacacagcccgaaa

SEQ ID NO: 101931 - RNA, 20 nt, Artificial Sequence
  MKO10101931_B_Nphp3
  gRNA
aaaugugaccgcucucucca

SEQ ID NO: 101932 - RNA, 20 nt, Artificial Sequence
  MKO10101932_B_Nphp4
  gRNA
uucagguugaggcuguauca

SEQ ID NO: 101933 - RNA, 20 nt, Artificial Sequence
  MKO10101933_B_Nphp4
  gRNA
caagcuccgacagcaugucu

SEQ ID NO: 101934 - RNA, 20 nt, Artificial Sequence
  MKO10101934_B_Nphp4
  gRNA
agcuuacccguguccccaug

SEQ ID NO: 101935 - RNA, 20 nt, Artificial Sequence
  MKO10101935_B_Nphs1
  gRNA
guugucccaagguggacgca

SEQ ID NO: 101936 - RNA, 20 nt, Artificial Sequence
  MKO10101936_B_Nphs1
  gRNA
cucugaucccucauucacgc

SEQ ID NO: 101937 - RNA, 20 nt, Artificial Sequence
  MKO10101937_B_Nphs1
  gRNA
cgucagggcccccggcagug

SEQ ID NO: 101938 - RNA, 20 nt, Artificial Sequence
  MKO10101938_B_Nphs2
  gRNA
ucccuaggcaucaagcccuc

SEQ ID NO: 101939 - RNA, 20 nt, Artificial Sequence
  MKO10101939_B_Nphs2
  gRNA
acggagaucaaccuugugau

SEQ ID NO: 101940 - RNA, 20 nt, Artificial Sequence
  MKO10101940_B_Nphs2
  gRNA
uguuagcuuaccucauggaa

SEQ ID NO: 101941 - RNA, 20 nt, Artificial Sequence
  MKO10101941_B_Nploc4
  gRNA
gugauccucuucacgccauc

SEQ ID NO: 101942 - RNA, 20 nt, Artificial Sequence
  MKO10101942_B_Nploc4
  gRNA
aaacugagaagccguuguuu

SEQ ID NO: 101943 - RNA, 20 nt, Artificial Sequence
  MKO10101943_B_Nploc4
  gRNA
auccguguccaguccccuga

SEQ ID NO: 101944 - RNA, 20 nt, Artificial Sequence
  MKO10101944_B_Npl
  gRNA
cucccacgugaaucaccacc

SEQ ID NO: 101945 - RNA, 20 nt, Artificial Sequence
  MKO10101945_B_Npl
  gRNA
guauguggauuaccugguga

SEQ ID NO: 101946 - RNA, 20 nt, Artificial Sequence
  MKO10101946_B_Npl
  gRNA
cuccaauuucugcugcaugu

SEQ ID NO: 101947 - RNA, 20 nt, Artificial Sequence
  MKO10101947_B_Npm1
  gRNA
uuaccgaaaagguaguucug

SEQ ID NO: 101948 - RNA, 20 nt, Artificial Sequence
  MKO10101948_B_Npm1
  gRNA
auaccguucuuaaugacaac

SEQ ID NO: 101949 - RNA, 20 nt, Artificial Sequence
  MKO10101949_B_Npm1
  gRNA
guguaauuucaaagcccccu

SEQ ID NO: 101950 - RNA, 20 nt, Artificial Sequence
  MKO10101950_B_Npm2
  gRNA
uucagcguagcaauagugau

SEQ ID NO: 101951 - RNA, 20 nt, Artificial Sequence
  MKO10101951_B_Npm2
  gRNA
cagagacuucggaccugacc

SEQ ID NO: 101952 - RNA, 20 nt, Artificial Sequence
  MKO10101952_B_Npm2
  gRNA
acaacuuaccauaacauucc

SEQ ID NO: 101953 - RNA, 20 nt, Artificial Sequence
  MKO10101953_B_Npm3
  gRNA
cuugcagguugugagcucuc

SEQ ID NO: 101954 - RNA, 20 nt, Artificial Sequence
  MKO10101954_B_Npm3
  gRNA
aggccugccccugugcuucu

SEQ ID NO: 101955 - RNA, 20 nt, Artificial Sequence
  MKO10101955_B_Npm3
  gRNA
cuccucaaccuugaaaguga

SEQ ID NO: 101956 - RNA, 20 nt, Artificial Sequence
  MKO10101956_B_Npnt
  gRNA
auacuugagcaggacccguc

SEQ ID NO: 101957 - RNA, 20 nt, Artificial Sequence
  MKO10101957_B_Npnt
  gRNA
gguuugccuaccuugguugc

SEQ ID NO: 101958 - RNA, 20 nt, Artificial Sequence
  MKO10101958_B_Npnt
  gRNA
uccugccuccauagcgacau

SEQ ID NO: 101959 - RNA, 20 nt, Artificial Sequence
  MKO10101959_B_Nppa
  gRNA
acacaggauuugcuccaaua

SEQ ID NO: 101960 - RNA, 20 nt, Artificial Sequence
  MKO10101960_B_Nppa
  gRNA
gugcucuagggcgcagcccc

SEQ ID NO: 101961 - RNA, 20 nt, Artificial Sequence
  MKO10101961_B_Nppa
  gRNA
agaucuaucggagggguccc

SEQ ID NO: 101962 - RNA, 20 nt, Artificial Sequence
  MKO10101962_B_Nppb
  gRNA
accugcaucuugaauugcuc

SEQ ID NO: 101963 - RNA, 20 nt, Artificial Sequence
  MKO10101963_B_Nppb
  gRNA
cacagcacugaaguuguugu

SEQ ID NO: 101964 - RNA, 20 nt, Artificial Sequence
  MKO10101964_B_Nppb
  gRNA
gggugcugccuugagaccga

SEQ ID NO: 101965 - RNA, 20 nt, Artificial Sequence
  MKO10101965_B_Nppc
  gRNA
ugcucgcgcuacucucgcuc

SEQ ID NO: 101966 - RNA, 20 nt, Artificial Sequence
  MKO10101966_B_Nppc
  gRNA
gccuuuguauuugcgcgcgu

SEQ ID NO: 101967 - RNA, 20 nt, Artificial Sequence
  MKO10101967_B_Nppc
  gRNA
caggucccgagaaccccgcc

SEQ ID NO: 101968 - RNA, 20 nt, Artificial Sequence
  MKO10101968_B_Npr1
  gRNA
gcaggauaggagagcccgcc

SEQ ID NO: 101969 - RNA, 20 nt, Artificial Sequence
  MKO10101969_B_Npr1
  gRNA
aaacauaguccuccccaguc

SEQ ID NO: 101970 - RNA, 20 nt, Artificial Sequence
  MKO10101970_B_Npr1
  gRNA
uacccugaaggcaccugucu

SEQ ID NO: 101971 - RNA, 20 nt, Artificial Sequence
  MKO10101971_B_Npr2
  gRNA
aguccugaaugagacuauac

SEQ ID NO: 101972 - RNA, 20 nt, Artificial Sequence
  MKO10101972_B_Npr2
  gRNA
aucgccugcugaucagagcc

SEQ ID NO: 101973 - RNA, 20 nt, Artificial Sequence
  MKO10101973_B_Npr2
  gRNA
uaucuuagguguaacuggac

SEQ ID NO: 101974 - RNA, 20 nt, Artificial Sequence
  MKO10101974_B_Npr3
  gRNA
caccauucggagaaucaugu

SEQ ID NO: 101975 - RNA, 20 nt, Artificial Sequence
  MKO10101975_B_Npr3
  gRNA
cgccauccuccucuacguuc

SEQ ID NO: 101976 - RNA, 20 nt, Artificial Sequence
  MKO10101976_B_Npr3
  gRNA
uccaaacagucacccuacug

SEQ ID NO: 101977 - RNA, 20 nt, Artificial Sequence
  MKO10101977_B_Nprl2
  gRNA
cuccagcguggucaaguagc

SEQ ID NO: 101978 - RNA, 20 nt, Artificial Sequence
  MKO10101978_B_Nprl2
  gRNA
cucgcgagaacuguuugaca

SEQ ID NO: 101979 - RNA, 20 nt, Artificial Sequence
  MKO10101979_B_Nprl2
  gRNA
cccaucguuaaaaagcuggc

SEQ ID NO: 101980 - RNA, 20 nt, Artificial Sequence
  MKO10101980_B_Nprl3
  gRNA
uugacagcauaucugcuccg

SEQ ID NO: 101981 - RNA, 20 nt, Artificial Sequence
  MKO10101981_B_Nprl3
  gRNA
ggagcuucccgcuuuggaga

SEQ ID NO: 101982 - RNA, 20 nt, Artificial Sequence
  MKO10101982_B_Nprl3
  gRNA
uaccacguuaaaaagaauca

SEQ ID NO: 101983 - RNA, 20 nt, Artificial Sequence
  MKO10101983_B_Npsr1
  gRNA
cagagucguccgcuacuugc

SEQ ID NO: 101984 - RNA, 20 nt, Artificial Sequence
  MKO10101984_B_Npsr1
  gRNA
ccacaauagugacgacaaac

SEQ ID NO: 101985 - RNA, 20 nt, Artificial Sequence
  MKO10101985_B_Npsr1
  gRNA
cguagguagaggcauacagc

SEQ ID NO: 101986 - RNA, 20 nt, Artificial Sequence
  MKO10101986_B_Nps
  gRNA
ugucuguaaugcacgugcuu

SEQ ID NO: 101987 - RNA, 20 nt, Artificial Sequence
  MKO10101987_B_Nps
  gRNA
aucgaugucuucuccaaaau

SEQ ID NO: 101988 - RNA, 20 nt, Artificial Sequence
  MKO10101988_B_Nps
  gRNA
uuauccgguccucucuucca

SEQ ID NO: 101989 - RNA, 20 nt, Artificial Sequence
  MKO10101989_B_Nptn
  gRNA
ucgaauaaugaccucuucac

SEQ ID NO: 101990 - RNA, 20 nt, Artificial Sequence
  MKO10101990_B_Nptn
  gRNA
augauguacugcaagucagu

SEQ ID NO: 101991 - RNA, 20 nt, Artificial Sequence
  MKO10101991_B_Nptn
  gRNA
ggcuguaccuuucacuucaa

SEQ ID NO: 101992 - RNA, 20 nt, Artificial Sequence
  MKO10101992_B_Nptx1
  gRNA
ccgcaagcugacccccgggg

SEQ ID NO: 101993 - RNA, 20 nt, Artificial Sequence
  MKO10101993_B_Nptx1
  gRNA
gagucccagaucgagaucuu

SEQ ID NO: 101994 - RNA, 20 nt, Artificial Sequence
  MKO10101994_B_Nptx1
  gRNA
ucuccagcucgcugauccgu

SEQ ID NO: 101995 - RNA, 20 nt, Artificial Sequence
  MKO10101995_B_Nptx2
  gRNA
cugcgguccagugccucgcc

SEQ ID NO: 101996 - RNA, 20 nt, Artificial Sequence
  MKO10101996_B_Nptx2
  gRNA
uucccacaugccgucucgag

SEQ ID NO: 101997 - RNA, 20 nt, Artificial Sequence
  MKO10101997_B_Nptx2
  gRNA
cuccguacaaacuaccugua

SEQ ID NO: 101998 - RNA, 20 nt, Artificial Sequence
  MKO10101998_B_Nptxr
  gRNA
ggcgucaaaucggccuccca

SEQ ID NO: 101999 - RNA, 20 nt, Artificial Sequence
  MKO10101999_B_Nptxr
  gRNA
agcgagccgcccucagucac

SEQ ID NO: 102000 - RNA, 20 nt, Artificial Sequence
  MKO10102000_B_Nptxr
  gRNA
ccacgcucugacaccggccc

SEQ ID NO: 102001 - RNA, 20 nt, Artificial Sequence
  MKO10102001_B_Npvf
  gRNA
caugaacucaucuguacaga

SEQ ID NO: 102002 - RNA, 20 nt, Artificial Sequence
  MKO10102002_B_Npvf
  gRNA
ccuucuuugcugugaaaaug

SEQ ID NO: 102003 - RNA, 20 nt, Artificial Sequence
  MKO10102003_B_Npvf
  gRNA
agaaaggaaaccagaaaaau

SEQ ID NO: 102004 - RNA, 20 nt, Artificial Sequence
  MKO10102004_B_Npw
  gRNA
ggcacgaagcgucucuccga

SEQ ID NO: 102005 - RNA, 20 nt, Artificial Sequence
  MKO10102005_B_Npw
  gRNA
ugaaggcuuagcgacugcuc

SEQ ID NO: 102006 - RNA, 20 nt, Artificial Sequence
  MKO10102006_B_Npw
  gRNA
agcugugggagguacgaagc

SEQ ID NO: 102007 - RNA, 20 nt, Artificial Sequence
  MKO10102007_B_Npy1r
  gRNA
acgccgcaagugacacauuu

SEQ ID NO: 102008 - RNA, 20 nt, Artificial Sequence
  MKO10102008_B_Npy1r
  gRNA
auccguaugcaugguagaca

SEQ ID NO: 102009 - RNA, 20 nt, Artificial Sequence
  MKO10102009_B_Npy1r
  gRNA
cagcaugauguugauucgcu

SEQ ID NO: 102010 - RNA, 20 nt, Artificial Sequence
  MKO10102010_B_Npy2r
  gRNA
ccagggcacacuacuccuag

SEQ ID NO: 102011 - RNA, 20 nt, Artificial Sequence
  MKO10102011_B_Npy2r
  gRNA
cgaaucagcuuccugaucau

SEQ ID NO: 102012 - RNA, 20 nt, Artificial Sequence
  MKO10102012_B_Npy2r
  gRNA
ugucgauguccacagcgagu

SEQ ID NO: 102013 - RNA, 20 nt, Artificial Sequence
  MKO10102013_B_Npy4r
  gRNA
gcacgcuugcagcucacgag

SEQ ID NO: 102014 - RNA, 20 nt, Artificial Sequence
  MKO10102014_B_Npy4r
  gRNA
gcuguuggccaggaacggca

SEQ ID NO: 102015 - RNA, 20 nt, Artificial Sequence
  MKO10102015_B_Npy4r
  gRNA
gaaacucuacaaccuuagag

SEQ ID NO: 102016 - RNA, 20 nt, Artificial Sequence
  MKO10102016_B_Npy5r
  gRNA
uaauaucgauugccauuguc

SEQ ID NO: 102017 - RNA, 20 nt, Artificial Sequence
  MKO10102017_B_Npy5r
  gRNA
uaagaucggauuaagacaac

SEQ ID NO: 102018 - RNA, 20 nt, Artificial Sequence
  MKO10102018_B_Npy5r
  gRNA
gccacuccacgucuuccacg

SEQ ID NO: 102019 - RNA, 20 nt, Artificial Sequence
  MKO10102019_B_Npy6r
  gRNA
aaacuacaaauaccaggucg

SEQ ID NO: 102020 - RNA, 20 nt, Artificial Sequence
  MKO10102020_B_Npy6r
  gRNA
cagcugauugugaacccccg

SEQ ID NO: 102021 - RNA, 20 nt, Artificial Sequence
  MKO10102021_B_Npy6r
  gRNA
aacugagacacuuugcacgu

SEQ ID NO: 102022 - RNA, 20 nt, Artificial Sequence
  MKO10102022_B_Npy
  gRNA
cagaaaacgcccccagaaca

SEQ ID NO: 102023 - RNA, 20 nt, Artificial Sequence
  MKO10102023_B_Npy
  gRNA
gauuucagaccucuuaauga

SEQ ID NO: 102024 - RNA, 20 nt, Artificial Sequence
  MKO10102024_B_Npy
  gRNA
auuucccaucaccacaugga

SEQ ID NO: 102025 - RNA, 20 nt, Artificial Sequence
  MKO10102025_B_Nqo1
  gRNA
gaaaggaccguugucguaca

SEQ ID NO: 102026 - RNA, 20 nt, Artificial Sequence
  MKO10102026_B_Nqo1
  gRNA
acgccugagcccagauauug

SEQ ID NO: 102027 - RNA, 20 nt, Artificial Sequence
  MKO10102027_B_Nqo1
  gRNA
cauggagccgcuacccccag

SEQ ID NO: 102028 - RNA, 20 nt, Artificial Sequence
  MKO10102028_B_Nqo2
  gRNA
aucccauaacugaagacguc

SEQ ID NO: 102029 - RNA, 20 nt, Artificial Sequence
  MKO10102029_B_Nqo2
  gRNA
gcggagauguacacaaaaga

SEQ ID NO: 102030 - RNA, 20 nt, Artificial Sequence
  MKO10102030_B_Nqo2
  gRNA
gccacaagaaaugauaucac

SEQ ID NO: 102031 - RNA, 20 nt, Artificial Sequence
  MKO10102031_B_Nr0b1
  gRNA
caauguauuucacgcacugc

SEQ ID NO: 102032 - RNA, 20 nt, Artificial Sequence
  MKO10102032_B_Nr0b1
  gRNA
cuugcggggucgcugguguu

SEQ ID NO: 102033 - RNA, 20 nt, Artificial Sequence
  MKO10102033_B_Nr0b1
  gRNA
aagcauuuccugcgucgugu

SEQ ID NO: 102034 - RNA, 20 nt, Artificial Sequence
  MKO10102034_B_Nr0b2
  gRNA
ccacaucgcacaccugcaac

SEQ ID NO: 102035 - RNA, 20 nt, Artificial Sequence
  MKO10102035_B_Nr0b2
  gRNA
ggcggcugcuagagugcugc

SEQ ID NO: 102036 - RNA, 20 nt, Artificial Sequence
  MKO10102036_B_Nr0b2
  gRNA
augucaacgucucccaugau

SEQ ID NO: 102037 - RNA, 20 nt, Artificial Sequence
  MKO10102037_B_Nr1d1
  gRNA
caggacccugcccgcucuuu

SEQ ID NO: 102038 - RNA, 20 nt, Artificial Sequence
  MKO10102038_B_Nr1d1
  gRNA
cuaguggcuccuccccgagc

SEQ ID NO: 102039 - RNA, 20 nt, Artificial Sequence
  MKO10102039_B_Nr1d1
  gRNA
uucaagaagugucucuccgu

SEQ ID NO: 102040 - RNA, 20 nt, Artificial Sequence
  MKO10102040_B_Nr1d2
  gRNA
ugcccuagaauuuaguggca

SEQ ID NO: 102041 - RNA, 20 nt, Artificial Sequence
  MKO10102041_B_Nr1d2
  gRNA
caugccguuuguauugcaaa

SEQ ID NO: 102042 - RNA, 20 nt, Artificial Sequence
  MKO10102042_B_Nr1d2
  gRNA
cagacagacacuucuuaaag

SEQ ID NO: 102043 - RNA, 20 nt, Artificial Sequence
  MKO10102043_B_Nr1h2
  gRNA
cuggcacuugcgccgcauga

SEQ ID NO: 102044 - RNA, 20 nt, Artificial Sequence
  MKO10102044_B_Nr1h2
  gRNA
ccccaucucacccacgaugu

SEQ ID NO: 102045 - RNA, 20 nt, Artificial Sequence
  MKO10102045_B_Nr1h2
  gRNA
cgccacgucacccacuauua

SEQ ID NO: 102046 - RNA, 20 nt, Artificial Sequence
  MKO10102046_B_Nr1h3
  gRNA
ccgccgcauguaggugucca

SEQ ID NO: 102047 - RNA, 20 nt, Artificial Sequence
  MKO10102047_B_Nr1h3
  gRNA
cucugagggucgggugcaau

SEQ ID NO: 102048 - RNA, 20 nt, Artificial Sequence
  MKO10102048_B_Nr1h3
  gRNA
agcgcuguugucgggcuucc

SEQ ID NO: 102049 - RNA, 20 nt, Artificial Sequence
  MKO10102049_B_Nr1h4
  gRNA
ugauggacauguacaugcgc

SEQ ID NO: 102050 - RNA, 20 nt, Artificial Sequence
  MKO10102050_B_Nr1h4
  gRNA
uuagccguuuagauuuacac

SEQ ID NO: 102051 - RNA, 20 nt, Artificial Sequence
  MKO10102051_B_Nr1h4
  gRNA
acgaauccauaauauaaucc

SEQ ID NO: 102052 - RNA, 20 nt, Artificial Sequence
  MKO10102052_B_Nr1h5
  gRNA
ccuguacccugccauccaag

SEQ ID NO: 102053 - RNA, 20 nt, Artificial Sequence
  MKO10102053_B_Nr1h5
  gRNA
gcaguguauucuugcaagaa

SEQ ID NO: 102054 - RNA, 20 nt, Artificial Sequence
  MKO10102054_B_Nr1h5
  gRNA
caacaugacucuaacucaag

SEQ ID NO: 102055 - RNA, 20 nt, Artificial Sequence
  MKO10102055_B_Nr1i2
  gRNA
gaucucuuucccgucgcucu

SEQ ID NO: 102056 - RNA, 20 nt, Artificial Sequence
  MKO10102056_B_Nr1i2
  gRNA
cugaggugccccuuccgcaa

SEQ ID NO: 102057 - RNA, 20 nt, Artificial Sequence
  MKO10102057_B_Nr1i2
  gRNA
gggccaugaaacgcaauguc

SEQ ID NO: 102058 - RNA, 20 nt, Artificial Sequence
  MKO10102058_B_Nr1i3
  gRNA
gggggcccacacucgccaug

SEQ ID NO: 102059 - RNA, 20 nt, Artificial Sequence
  MKO10102059_B_Nr1i3
  gRNA
ccggaagagcggcagauccu

SEQ ID NO: 102060 - RNA, 20 nt, Artificial Sequence
  MKO10102060_B_Nr1i3
  gRNA
gugaagaagaauaugggccg

SEQ ID NO: 102061 - RNA, 20 nt, Artificial Sequence
  MKO10102061_B_Nr2c1
  gRNA
gcguugcggcuagagggcuu

SEQ ID NO: 102062 - RNA, 20 nt, Artificial Sequence
  MKO10102062_B_Nr2c1
  gRNA
guucauucuggcaaaccacg

SEQ ID NO: 102063 - RNA, 20 nt, Artificial Sequence
  MKO10102063_B_Nr2c1
  gRNA
uaacagacagcgagacugcc

SEQ ID NO: 102064 - RNA, 20 nt, Artificial Sequence
  MKO10102064_B_Nr2c2ap
  gRNA
gacgugcuggaacucugacc

SEQ ID NO: 102065 - RNA, 20 nt, Artificial Sequence
  MKO10102065_B_Nr2c2ap
  gRNA
gacuacacggccaaaaaagu

SEQ ID NO: 102066 - RNA, 20 nt, Artificial Sequence
  MKO10102066_B_Nr2c2ap
  gRNA
ccuucucacccagcacccgc

SEQ ID NO: 102067 - RNA, 20 nt, Artificial Sequence
  MKO10102067_B_Nr2c2
  gRNA
acuucuucagccggcagaac

SEQ ID NO: 102068 - RNA, 20 nt, Artificial Sequence
  MKO10102068_B_Nr2c2
  gRNA
ccacugagaagaucuauauc

SEQ ID NO: 102069 - RNA, 20 nt, Artificial Sequence
  MKO10102069_B_Nr2c2
  gRNA
cauccacugcggugacuauc

SEQ ID NO: 102070 - RNA, 20 nt, Artificial Sequence
  MKO10102070_B_Nr2e1
  gRNA
guagaccccguagugcuucc

SEQ ID NO: 102071 - RNA, 20 nt, Artificial Sequence
  MKO10102071_B_Nr2e1
  gRNA
ccacuucguagagauacauu

SEQ ID NO: 102072 - RNA, 20 nt, Artificial Sequence
  MKO10102072_B_Nr2e1
  gRNA
ucuucaagaggagcauucga

SEQ ID NO: 102073 - RNA, 20 nt, Artificial Sequence
  MKO10102073_B_Nr2e3
  gRNA
ggcacaucccugccccgacu

SEQ ID NO: 102074 - RNA, 20 nt, Artificial Sequence
  MKO10102074_B_Nr2e3
  gRNA
cuguguaccuggucccggaa

SEQ ID NO: 102075 - RNA, 20 nt, Artificial Sequence
  MKO10102075_B_Nr2e3
  gRNA
ucugguugcagacacagacg

SEQ ID NO: 102076 - RNA, 20 nt, Artificial Sequence
  MKO10102076_B_Nr2f1
  gRNA
gauccgcaggacgacguggc

SEQ ID NO: 102077 - RNA, 20 nt, Artificial Sequence
  MKO10102077_B_Nr2f1
  gRNA
cgaugugggcagcauccgac

SEQ ID NO: 102078 - RNA, 20 nt, Artificial Sequence
  MKO10102078_B_Nr2f1
  gRNA
gcugccugcgcugcgggguu

SEQ ID NO: 102079 - RNA, 20 nt, Artificial Sequence
  MKO10102079_B_Nr2f2
  gRNA
aagagcuuuccgaaccgugu

SEQ ID NO: 102080 - RNA, 20 nt, Artificial Sequence
  MKO10102080_B_Nr2f2
  gRNA
gcgugcuggccgggcccccu

SEQ ID NO: 102081 - RNA, 20 nt, Artificial Sequence
  MKO10102081_B_Nr2f2
  gRNA
ugccggacaguaacauaucc

SEQ ID NO: 102082 - RNA, 20 nt, Artificial Sequence
  MKO10102082_B_Nr2f6
  gRNA
gucgcccggcuccgcgucgc

SEQ ID NO: 102083 - RNA, 20 nt, Artificial Sequence
  MKO10102083_B_Nr2f6
  gRNA
cuaucacuagcccgagccau

SEQ ID NO: 102084 - RNA, 20 nt, Artificial Sequence
  MKO10102084_B_Nr2f6
  gRNA
guacugggcacgcacauacu

SEQ ID NO: 102085 - RNA, 20 nt, Artificial Sequence
  MKO10102085_B_Nr3c1
  gRNA
aagugauugccgcagugaaa

SEQ ID NO: 102086 - RNA, 20 nt, Artificial Sequence
  MKO10102086_B_Nr3c1
  gRNA
gaagcuucgggaugccauua

SEQ ID NO: 102087 - RNA, 20 nt, Artificial Sequence
  MKO10102087_B_Nr3c1
  gRNA
acauccaugaguacuguaga

SEQ ID NO: 102088 - RNA, 20 nt, Artificial Sequence
  MKO10102088_B_Nr3c2
  gRNA
cuuaccuccuaaguucaugc

SEQ ID NO: 102089 - RNA, 20 nt, Artificial Sequence
  MKO10102089_B_Nr3c2
  gRNA
acuuuacgaaguguuucuac

SEQ ID NO: 102090 - RNA, 20 nt, Artificial Sequence
  MKO10102090_B_Nr3c2
  gRNA
uaucaucguuugccuugagu

SEQ ID NO: 102091 - RNA, 20 nt, Artificial Sequence
  MKO10102091_B_Nr4a1
  gRNA
cgggccuagcacugccaaau

SEQ ID NO: 102092 - RNA, 20 nt, Artificial Sequence
  MKO10102092_B_Nr4a1
  gRNA
aagcgccaaguacaucugcc

SEQ ID NO: 102093 - RNA, 20 nt, Artificial Sequence
  MKO10102093_B_Nr4a1
  gRNA
ccuucugccagaucuaaacc

SEQ ID NO: 102094 - RNA, 20 nt, Artificial Sequence
  MKO10102094_B_Nr4a2
  gRNA
cacagguugcaaugcgugcg

SEQ ID NO: 102095 - RNA, 20 nt, Artificial Sequence
  MKO10102095_B_Nr4a2
  gRNA
uaauugcagguccaacccag

SEQ ID NO: 102096 - RNA, 20 nt, Artificial Sequence
  MKO10102096_B_Nr4a2
  gRNA
ugaccugcccaaagccgacc

SEQ ID NO: 102097 - RNA, 20 nt, Artificial Sequence
  MKO10102097_B_Nr4a3
  gRNA
uuucggcgucucuuguccac

SEQ ID NO: 102098 - RNA, 20 nt, Artificial Sequence
  MKO10102098_B_Nr4a3
  gRNA
accaaagagcccacuacaac

SEQ ID NO: 102099 - RNA, 20 nt, Artificial Sequence
  MKO10102099_B_Nr4a3
  gRNA
gugcguacagacagucugaa

SEQ ID NO: 102100 - RNA, 20 nt, Artificial Sequence
  MKO10102100_B_Nr5a1
  gRNA
ccaggcgcaugcccaccguc

SEQ ID NO: 102101 - RNA, 20 nt, Artificial Sequence
  MKO10102101_B_Nr5a1
  gRNA
acguguaaugcuuguuguuc

SEQ ID NO: 102102 - RNA, 20 nt, Artificial Sequence
  MKO10102102_B_Nr5a1
  gRNA
ccagcugcagugcaugcaac

SEQ ID NO: 102103 - RNA, 20 nt, Artificial Sequence
  MKO10102103_B_Nr5a2
  gRNA
ccaggacugguccgaucgca

SEQ ID NO: 102104 - RNA, 20 nt, Artificial Sequence
  MKO10102104_B_Nr5a2
  gRNA
gacacuuuaucgccacacac

SEQ ID NO: 102105 - RNA, 20 nt, Artificial Sequence
  MKO10102105_B_Nr5a2
  gRNA
gccccuguuccccaugcgau

SEQ ID NO: 102106 - RNA, 20 nt, Artificial Sequence
  MKO10102106_B_Nr6a1
  gRNA
gcugaugucagccgaagacc

SEQ ID NO: 102107 - RNA, 20 nt, Artificial Sequence
  MKO10102107_B_Nr6a1
  gRNA
agcucaccuggaugauagug

SEQ ID NO: 102108 - RNA, 20 nt, Artificial Sequence
  MKO10102108_B_Nr6a1
  gRNA
gcccccacaagcucgaagcc

SEQ ID NO: 102109 - RNA, 20 nt, Artificial Sequence
  MKO10102109_B_Nradd
  gRNA
ugccagccuauacccugcua

SEQ ID NO: 102110 - RNA, 20 nt, Artificial Sequence
  MKO10102110_B_Nradd
  gRNA
cuaccauuugaaggccacau

SEQ ID NO: 102111 - RNA, 20 nt, Artificial Sequence
  MKO10102111_B_Nradd
  gRNA
gacaggaaugauguugcucg

SEQ ID NO: 102112 - RNA, 20 nt, Artificial Sequence
  MKO10102112_B_Nrap
  gRNA
gaagaucagcugcauagauc

SEQ ID NO: 102113 - RNA, 20 nt, Artificial Sequence
  MKO10102113_B_Nrap
  gRNA
agcuagccggcugaugaaug

SEQ ID NO: 102114 - RNA, 20 nt, Artificial Sequence
  MKO10102114_B_Nrap
  gRNA
acacuccaagaugaaugugc

SEQ ID NO: 102115 - RNA, 20 nt, Artificial Sequence
  MKO10102115_B_Nrarp
  gRNA
ccaaguacgcggccagcggc

SEQ ID NO: 102116 - RNA, 20 nt, Artificial Sequence
  MKO10102116_B_Nrarp
  gRNA
ggguggcuaucaccggccgc

SEQ ID NO: 102117 - RNA, 20 nt, Artificial Sequence
  MKO10102117_B_Nrarp
  gRNA
guagcgcgcuccagccgucg

SEQ ID NO: 102118 - RNA, 20 nt, Artificial Sequence
  MKO10102118_B_Nras
  gRNA
cuucgccuguccucauguac

SEQ ID NO: 102119 - RNA, 20 nt, Artificial Sequence
  MKO10102119_B_Nras
  gRNA
aagcucaacagcagugacga

SEQ ID NO: 102120 - RNA, 20 nt, Artificial Sequence
  MKO10102120_B_Nras
  gRNA
cugggccucaccucuauggu

SEQ ID NO: 102121 - RNA, 20 nt, Artificial Sequence
  MKO10102121_B_Nrbf2
  gRNA
auggcucaccugcucagacu

SEQ ID NO: 102122 - RNA, 20 nt, Artificial Sequence
  MKO10102122_B_Nrbf2
  gRNA
cccgggguuuauggaaguga

SEQ ID NO: 102123 - RNA, 20 nt, Artificial Sequence
  MKO10102123_B_Nrbf2
  gRNA
gcagaccguuuguuagcugc

SEQ ID NO: 102124 - RNA, 20 nt, Artificial Sequence
  MKO10102124_B_Nrbp1
  gRNA
ugacagugcauaccuggcca

SEQ ID NO: 102125 - RNA, 20 nt, Artificial Sequence
  MKO10102125_B_Nrbp1
  gRNA
guuugauaaucugauucagc

SEQ ID NO: 102126 - RNA, 20 nt, Artificial Sequence
  MKO10102126_B_Nrbp1
  gRNA
ucagauuaucaaacacugca

SEQ ID NO: 102127 - RNA, 20 nt, Artificial Sequence
  MKO10102127_B_Nrbp2
  gRNA
gcugagaugccgcagcccca

SEQ ID NO: 102128 - RNA, 20 nt, Artificial Sequence
  MKO10102128_B_Nrbp2
  gRNA
acaaauuccuagaggauguc

SEQ ID NO: 102129 - RNA, 20 nt, Artificial Sequence
  MKO10102129_B_Nrbp2
  gRNA
acuacucaccgccacugcau

SEQ ID NO: 102130 - RNA, 20 nt, Artificial Sequence
  MKO10102130_B_Nrcam
  gRNA
uaccuccggccauaauauuu

SEQ ID NO: 102131 - RNA, 20 nt, Artificial Sequence
  MKO10102131_B_Nrcam
  gRNA
ugggcggacaacaauguuau

SEQ ID NO: 102132 - RNA, 20 nt, Artificial Sequence
  MKO10102132_B_Nrcam
  gRNA
uggauuacaauauucucccg

SEQ ID NO: 102133 - RNA, 20 nt, Artificial Sequence
  MKO10102133_B_Nrd1
  gRNA
gauuucagaucuaaguaaug

SEQ ID NO: 102134 - RNA, 20 nt, Artificial Sequence
  MKO10102134_B_Nrd1
  gRNA
uccaaaaagugugccagccc

SEQ ID NO: 102135 - RNA, 20 nt, Artificial Sequence
  MKO10102135_B_Nrd1
  gRNA
auugcaucucugaucaucag

SEQ ID NO: 102136 - RNA, 20 nt, Artificial Sequence
  MKO10102136_B_Nrde2
  gRNA
gaugaaugugacgggcucgg

SEQ ID NO: 102137 - RNA, 20 nt, Artificial Sequence
  MKO10102137_B_Nrde2
  gRNA
cuuaucaguccugaagacgu

SEQ ID NO: 102138 - RNA, 20 nt, Artificial Sequence
  MKO10102138_B_Nrde2
  gRNA
agcaacccaagcuuucgugu

SEQ ID NO: 102139 - RNA, 20 nt, Artificial Sequence
  MKO10102139_B_Nrep
  gRNA
ccaagaaccguuugcauaca

SEQ ID NO: 102140 - RNA, 20 nt, Artificial Sequence
  MKO10102140_B_Nrep
  gRNA
aauggagggaggucuuauua

SEQ ID NO: 102141 - RNA, 20 nt, Artificial Sequence
  MKO10102141_B_Nrep
  gRNA
gguuuacuacccagaacucu

SEQ ID NO: 102142 - RNA, 20 nt, Artificial Sequence
  MKO10102142_B_Nrf1
  gRNA
agaacacgccccugcgccac

SEQ ID NO: 102143 - RNA, 20 nt, Artificial Sequence
  MKO10102143_B_Nrf1
  gRNA
cauacugugcucaguguacg

SEQ ID NO: 102144 - RNA, 20 nt, Artificial Sequence
  MKO10102144_B_Nrf1
  gRNA
caggaaacucagagccacgu

SEQ ID NO: 102145 - RNA, 20 nt, Artificial Sequence
  MKO10102145_B_Nrg1
  gRNA
uggcaucuguaucgcccugu

SEQ ID NO: 102146 - RNA, 20 nt, Artificial Sequence
  MKO10102146_B_Nrg1
  gRNA
aguggacguacuguagaagc

SEQ ID NO: 102147 - RNA, 20 nt, Artificial Sequence
  MKO10102147_B_Nrg1
  gRNA
cagccaucucauaaagugug

SEQ ID NO: 102148 - RNA, 20 nt, Artificial Sequence
  MKO10102148_B_Nrg2
  gRNA
ugccggggaguacgucugug

SEQ ID NO: 102149 - RNA, 20 nt, Artificial Sequence
  MKO10102149_B_Nrg2
  gRNA
gacaccuaccgcuguugaca

SEQ ID NO: 102150 - RNA, 20 nt, Artificial Sequence
  MKO10102150_B_Nrg2
  gRNA
uggcggucucauugcacuuc

SEQ ID NO: 102151 - RNA, 20 nt, Artificial Sequence
  MKO10102151_B_Nrg3
  gRNA
cuucaaacccugucgagaca

SEQ ID NO: 102152 - RNA, 20 nt, Artificial Sequence
  MKO10102152_B_Nrg3
  gRNA
gggcuuaccgacagugcuua

SEQ ID NO: 102153 - RNA, 20 nt, Artificial Sequence
  MKO10102153_B_Nrg3
  gRNA
ucggcagaaauugaucacaa

SEQ ID NO: 102154 - RNA, 20 nt, Artificial Sequence
  MKO10102154_B_Nrg4
  gRNA
uuacucacugugacggguuc

SEQ ID NO: 102155 - RNA, 20 nt, Artificial Sequence
  MKO10102155_B_Nrg4
  gRNA
gcggcacucaccuacagaau

SEQ ID NO: 102156 - RNA, 20 nt, Artificial Sequence
  MKO10102156_B_Nrg4
  gRNA
ccaggaagggccaccuucag

SEQ ID NO: 102157 - RNA, 20 nt, Artificial Sequence
  MKO10102157_B_Nrgn
  gRNA
ucaccuggccuagucuccgc

SEQ ID NO: 102158 - RNA, 20 nt, Artificial Sequence
  MKO10102158_B_Nrgn
  gRNA
cgccgcugcagccaaaaucc

SEQ ID NO: 102159 - RNA, 20 nt, Artificial Sequence
  MKO10102159_B_Nrgn
  gRNA
ccggaaacucgccuggauuu

SEQ ID NO: 102160 - RNA, 20 nt, Artificial Sequence
  MKO10102160_B_Nrip1
  gRNA
cugugcccguucaucggcgu

SEQ ID NO: 102161 - RNA, 20 nt, Artificial Sequence
  MKO10102161_B_Nrip1
  gRNA
aggcgcgguguucgugagcu

SEQ ID NO: 102162 - RNA, 20 nt, Artificial Sequence
  MKO10102162_B_Nrip1
  gRNA
ugauccgucacacaacugcc

SEQ ID NO: 102163 - RNA, 20 nt, Artificial Sequence
  MKO10102163_B_Nrip2
  gRNA
cagcaggaccagugcgacac

SEQ ID NO: 102164 - RNA, 20 nt, Artificial Sequence
  MKO10102164_B_Nrip2
  gRNA
acucccccugaagccgccuc

SEQ ID NO: 102165 - RNA, 20 nt, Artificial Sequence
  MKO10102165_B_Nrip2
  gRNA
ccacagccacucgaagcauc

SEQ ID NO: 102166 - RNA, 20 nt, Artificial Sequence
  MKO10102166_B_Nrip3
  gRNA
uuaccccaaucuguccacac

SEQ ID NO: 102167 - RNA, 20 nt, Artificial Sequence
  MKO10102167_B_Nrip3
  gRNA
ccuucagggaucuaagaguc

SEQ ID NO: 102168 - RNA, 20 nt, Artificial Sequence
  MKO10102168_B_Nrip3
  gRNA
gucaaaucucacaagcauga

SEQ ID NO: 102169 - RNA, 20 nt, Artificial Sequence
  MKO10102169_B_Nrk
  gRNA
uccauaaguaccaagaccaa

SEQ ID NO: 102170 - RNA, 20 nt, Artificial Sequence
  MKO10102170_B_Nrk
  gRNA
auacccaaaguuggugcuga

SEQ ID NO: 102171 - RNA, 20 nt, Artificial Sequence
  MKO10102171_B_Nrk
  gRNA
ucuagugagaauauuccagu

SEQ ID NO: 102172 - RNA, 20 nt, Artificial Sequence
  MKO10102172_B_Nrl
  gRNA
gggccucuuggcuacuauuc

SEQ ID NO: 102173 - RNA, 20 nt, Artificial Sequence
  MKO10102173_B_Nrl
  gRNA
uguguguggucgucggaccc

SEQ ID NO: 102174 - RNA, 20 nt, Artificial Sequence
  MKO10102174_B_Nrl
  gRNA
gcgggccgagguggcacgcc

SEQ ID NO: 102175 - RNA, 20 nt, Artificial Sequence
  MKO10102175_B_Nrm
  gRNA
uccccaccuugggcaccgau

SEQ ID NO: 102176 - RNA, 20 nt, Artificial Sequence
  MKO10102176_B_Nrm
  gRNA
gaaacgcacgaauuccacuc

SEQ ID NO: 102177 - RNA, 20 nt, Artificial Sequence
  MKO10102177_B_Nrm
  gRNA
ucacugccucagucgccaua

SEQ ID NO: 102178 - RNA, 20 nt, Artificial Sequence
  MKO10102178_B_Nrn1l
  gRNA
acaggcguggaagucauucc

SEQ ID NO: 102179 - RNA, 20 nt, Artificial Sequence
  MKO10102179_B_Nrn1l
  gRNA
cacaggguagccgcugacag

SEQ ID NO: 102180 - RNA, 20 nt, Artificial Sequence
  MKO10102180_B_Nrn1l
  gRNA
guaguagcagcaacagcguc

SEQ ID NO: 102181 - RNA, 20 nt, Artificial Sequence
  MKO10102181_B_Nrn1
  gRNA
cacagcucuuacggauugcc

SEQ ID NO: 102182 - RNA, 20 nt, Artificial Sequence
  MKO10102182_B_Nrn1
  gRNA
cagcauggccaacuacccgc

SEQ ID NO: 102183 - RNA, 20 nt, Artificial Sequence
  MKO10102183_B_Nrn1
  gRNA
auauauuucacugauccucg

SEQ ID NO: 102184 - RNA, 20 nt, Artificial Sequence
  MKO10102184_B_Nrp1
  gRNA
gagcaagacucgaauccucc

SEQ ID NO: 102185 - RNA, 20 nt, Artificial Sequence
  MKO10102185_B_Nrp1
  gRNA
guaggugcacuccaagcugu

SEQ ID NO: 102186 - RNA, 20 nt, Artificial Sequence
  MKO10102186_B_Nrp1
  gRNA
cuguccuccaaaucgaaaug

SEQ ID NO: 102187 - RNA, 20 nt, Artificial Sequence
  MKO10102187_B_Nrp2
  gRNA
cgcuaugagaucuucaaaac

SEQ ID NO: 102188 - RNA, 20 nt, Artificial Sequence
  MKO10102188_B_Nrp2
  gRNA
aguucaccucagacuacgcc

SEQ ID NO: 102189 - RNA, 20 nt, Artificial Sequence
  MKO10102189_B_Nrp2
  gRNA
agcaugacccucuacaagug

SEQ ID NO: 102190 - RNA, 20 nt, Artificial Sequence
  MKO10102190_B_Nrp
  gRNA
cgccucugagaagucgauga

SEQ ID NO: 102191 - RNA, 20 nt, Artificial Sequence
  MKO10102191_B_Nrp
  gRNA
cagugcgcuuagccccuuua

SEQ ID NO: 102192 - RNA, 20 nt, Artificial Sequence
  MKO10102192_B_Nrp
  gRNA
agccgucaucgacuucucag

SEQ ID NO: 102193 - RNA, 20 nt, Artificial Sequence
  MKO10102193_B_Nrros
  gRNA
uucacuucuugauuguggaa

SEQ ID NO: 102194 - RNA, 20 nt, Artificial Sequence
  MKO10102194_B_Nrros
  gRNA
acuggaagcauugaauccuc

SEQ ID NO: 102195 - RNA, 20 nt, Artificial Sequence
  MKO10102195_B_Nrros
  gRNA
ucaaugcuuccagucuccaa

SEQ ID NO: 102196 - RNA, 20 nt, Artificial Sequence
  MKO10102196_B_Nrsn1
  gRNA
cucuaggucggacucaucuc

SEQ ID NO: 102197 - RNA, 20 nt, Artificial Sequence
  MKO10102197_B_Nrsn1
  gRNA
ccccccaaaaucgaagcuuu

SEQ ID NO: 102198 - RNA, 20 nt, Artificial Sequence
  MKO10102198_B_Nrsn1
  gRNA
accagcagcgcuauggaguu

SEQ ID NO: 102199 - RNA, 20 nt, Artificial Sequence
  MKO10102199_B_Nrsn2
  gRNA
ggauucucucuggguuauag

SEQ ID NO: 102200 - RNA, 20 nt, Artificial Sequence
  MKO10102200_B_Nrsn2
  gRNA
ugcagacuuacaagucccgc

SEQ ID NO: 102201 - RNA, 20 nt, Artificial Sequence
  MKO10102201_B_Nrsn2
  gRNA
agcccucaugaccugccgug

SEQ ID NO: 102202 - RNA, 20 nt, Artificial Sequence
  MKO10102202_B_Nrtn
  gRNA
agcugcagaugagcgacacc

SEQ ID NO: 102203 - RNA, 20 nt, Artificial Sequence
  MKO10102203_B_Nrtn
  gRNA
ggccauccgcaucuacgacc

SEQ ID NO: 102204 - RNA, 20 nt, Artificial Sequence
  MKO10102204_B_Nrtn
  gRNA
ucgagcucgcgcagcccaca

SEQ ID NO: 102205 - RNA, 20 nt, Artificial Sequence
  MKO10102205_B_Nrxn1
  gRNA
uguuaccugacgcagauucc

SEQ ID NO: 102206 - RNA, 20 nt, Artificial Sequence
  MKO10102206_B_Nrxn1
  gRNA
uaccuuggucgcccaucauc

SEQ ID NO: 102207 - RNA, 20 nt, Artificial Sequence
  MKO10102207_B_Nrxn1
  gRNA
aggucuggcacaccugauga

SEQ ID NO: 102208 - RNA, 20 nt, Artificial Sequence
  MKO10102208_B_Nrxn2
  gRNA
uaccuucgcuguuuaacguc

SEQ ID NO: 102209 - RNA, 20 nt, Artificial Sequence
  MKO10102209_B_Nrxn2
  gRNA
gaugugcaccagccgacaaa

SEQ ID NO: 102210 - RNA, 20 nt, Artificial Sequence
  MKO10102210_B_Nrxn2
  gRNA
gacuuuagaggaacacccca

SEQ ID NO: 102211 - RNA, 20 nt, Artificial Sequence
  MKO10102211_B_Nrxn3
  gRNA
ccgucuagagcugucucgcu

SEQ ID NO: 102212 - RNA, 20 nt, Artificial Sequence
  MKO10102212_B_Nrxn3
  gRNA
caucacgcugaauauccacg

SEQ ID NO: 102213 - RNA, 20 nt, Artificial Sequence
  MKO10102213_B_Nrxn3
  gRNA
ucgcugugacaugaagcgga

SEQ ID NO: 102214 - RNA, 20 nt, Artificial Sequence
  MKO10102214_B_Nsa2
  gRNA
ucugcuuaaucauguuagaa

SEQ ID NO: 102215 - RNA, 20 nt, Artificial Sequence
  MKO10102215_B_Nsa2
  gRNA
cuaaugaaccuuucauauuu

SEQ ID NO: 102216 - RNA, 20 nt, Artificial Sequence
  MKO10102216_B_Nsa2
  gRNA
cuacccaaaguucgugccca

SEQ ID NO: 102217 - RNA, 20 nt, Artificial Sequence
  MKO10102217_B_Nsd1
  gRNA
gcucggccacaguugcgccu

SEQ ID NO: 102218 - RNA, 20 nt, Artificial Sequence
  MKO10102218_B_Nsd1
  gRNA
caaaauucaagagacgcccu

SEQ ID NO: 102219 - RNA, 20 nt, Artificial Sequence
  MKO10102219_B_Nsd1
  gRNA
ggucagagaagaaacgccuc

SEQ ID NO: 102220 - RNA, 20 nt, Artificial Sequence
  MKO10102220_B_Nsdhl
  gRNA
guaauagucaauaggcuuca

SEQ ID NO: 102221 - RNA, 20 nt, Artificial Sequence
  MKO10102221_B_Nsdhl
  gRNA
accgcagccauucguccuca

SEQ ID NO: 102222 - RNA, 20 nt, Artificial Sequence
  MKO10102222_B_Nsdhl
  gRNA
uccgccguacaguaacaaca

SEQ ID NO: 102223 - RNA, 20 nt, Artificial Sequence
  MKO10102223_B_Nsfl1c
  gRNA
cuuccuccuccucuucaucu

SEQ ID NO: 102224 - RNA, 20 nt, Artificial Sequence
  MKO10102224_B_Nsfl1c
  gRNA
acuugggguugcuugugaaa

SEQ ID NO: 102225 - RNA, 20 nt, Artificial Sequence
  MKO10102225_B_Nsfl1c
  gRNA
agcuacagccccaugcucuu

SEQ ID NO: 102226 - RNA, 20 nt, Artificial Sequence
  MKO10102226_B_Nsf
  gRNA
caucgcguucagcuugccuc

SEQ ID NO: 102227 - RNA, 20 nt, Artificial Sequence
  MKO10102227_B_Nsf
  gRNA
cagcuacucacuggccagac

SEQ ID NO: 102228 - RNA, 20 nt, Artificial Sequence
  MKO10102228_B_Nsf
  gRNA
aacgaaaaagauuuccaguc

SEQ ID NO: 102229 - RNA, 20 nt, Artificial Sequence
  MKO10102229_B_Nsg1
  gRNA
ggggcucauaccuuaucugg

SEQ ID NO: 102230 - RNA, 20 nt, Artificial Sequence
  MKO10102230_B_Nsg1
  gRNA
uguacacuuuguagacaacc

SEQ ID NO: 102231 - RNA, 20 nt, Artificial Sequence
  MKO10102231_B_Nsg1
  gRNA
acugcagcugguugacaucg

SEQ ID NO: 102232 - RNA, 20 nt, Artificial Sequence
  MKO10102232_B_Nsg2
  gRNA
accguaaauucagcgaucuu

SEQ ID NO: 102233 - RNA, 20 nt, Artificial Sequence
  MKO10102233_B_Nsg2
  gRNA
cugcaaaugauuaaccucca

SEQ ID NO: 102234 - RNA, 20 nt, Artificial Sequence
  MKO10102234_B_Nsg2
  gRNA
gccaaagaucgcugaauuua

SEQ ID NO: 102235 - RNA, 20 nt, Artificial Sequence
  MKO10102235_B_Nsl1
  gRNA
ucacccuguuguacauccuc

SEQ ID NO: 102236 - RNA, 20 nt, Artificial Sequence
  MKO10102236_B_Nsl1
  gRNA
gacacucucaaggauccuuc

SEQ ID NO: 102237 - RNA, 20 nt, Artificial Sequence
  MKO10102237_B_Nsl1
  gRNA
augcucuuuagcuuccuccc

SEQ ID NO: 102238 - RNA, 20 nt, Artificial Sequence
  MKO10102238_B_Nsmaf
  gRNA
uucauuucagggcaaaauca

SEQ ID NO: 102239 - RNA, 20 nt, Artificial Sequence
  MKO10102239_B_Nsmaf
  gRNA
uuccuuacugcuucucaacu

SEQ ID NO: 102240 - RNA, 20 nt, Artificial Sequence
  MKO10102240_B_Nsmaf
  gRNA
cuacuuugcaaaguguuuau

SEQ ID NO: 102241 - RNA, 20 nt, Artificial Sequence
  MKO10102241_B_Nsmce1
  gRNA
cucgcauaccagugcauaaa

SEQ ID NO: 102242 - RNA, 20 nt, Artificial Sequence
  MKO10102242_B_Nsmce1
  gRNA
aaacuucugcagcaccugcu

SEQ ID NO: 102243 - RNA, 20 nt, Artificial Sequence
  MKO10102243_B_Nsmce1
  gRNA
ccucgugcugcccugcaugu

SEQ ID NO: 102244 - RNA, 20 nt, Artificial Sequence
  MKO10102244_B_Nsmce2
  gRNA
acugcacagccuuaacauaa

SEQ ID NO: 102245 - RNA, 20 nt, Artificial Sequence
  MKO10102245_B_Nsmce2
  gRNA
agugaguagugaguacagua

SEQ ID NO: 102246 - RNA, 20 nt, Artificial Sequence
  MKO10102246_B_Nsmce2
  gRNA
ugcaguucaagcaacagcug

SEQ ID NO: 102247 - RNA, 20 nt, Artificial Sequence
  MKO10102247_B_Nsmce4a
  gRNA
uccguuguagcugacacaua

SEQ ID NO: 102248 - RNA, 20 nt, Artificial Sequence
  MKO10102248_B_Nsmce4a
  gRNA
ggaugcccaguuucuuguuc

SEQ ID NO: 102249 - RNA, 20 nt, Artificial Sequence
  MKO10102249_B_Nsmce4a
  gRNA
cgggaagacauacugaaugc

SEQ ID NO: 102250 - RNA, 20 nt, Artificial Sequence
  MKO10102250_B_Nsmf
  gRNA
agucacccugagaaccgcaa

SEQ ID NO: 102251 - RNA, 20 nt, Artificial Sequence
  MKO10102251_B_Nsmf
  gRNA
ugugccuaccugcaccguug

SEQ ID NO: 102252 - RNA, 20 nt, Artificial Sequence
  MKO10102252_B_Nsmf
  gRNA
ggacccgucguggccagagu

SEQ ID NO: 102253 - RNA, 20 nt, Artificial Sequence
  MKO10102253_B_Nsun2
  gRNA
caagggaaacaucagccgcc

SEQ ID NO: 102254 - RNA, 20 nt, Artificial Sequence
  MKO10102254_B_Nsun2
  gRNA
ggcaaaguuccaucaguucc

SEQ ID NO: 102255 - RNA, 20 nt, Artificial Sequence
  MKO10102255_B_Nsun2
  gRNA
cucggagugacuccaugaau

SEQ ID NO: 102256 - RNA, 20 nt, Artificial Sequence
  MKO10102256_B_Nsun3
  gRNA
uucggucugggguucggcug

SEQ ID NO: 102257 - RNA, 20 nt, Artificial Sequence
  MKO10102257_B_Nsun3
  gRNA
cauguucaaaugaucgaagc

SEQ ID NO: 102258 - RNA, 20 nt, Artificial Sequence
  MKO10102258_B_Nsun3
  gRNA
aguaccuugucaaauguugc

SEQ ID NO: 102259 - RNA, 20 nt, Artificial Sequence
  MKO10102259_B_Nsun4
  gRNA
ggcuucacugacgaaguccu

SEQ ID NO: 102260 - RNA, 20 nt, Artificial Sequence
  MKO10102260_B_Nsun4
  gRNA
ucucauggacuacuaccuga

SEQ ID NO: 102261 - RNA, 20 nt, Artificial Sequence
  MKO10102261_B_Nsun4
  gRNA
auucugcagagcaagccgac

SEQ ID NO: 102262 - RNA, 20 nt, Artificial Sequence
  MKO10102262_B_Nsun5
  gRNA
aaauaaucgauugcauccuc

SEQ ID NO: 102263 - RNA, 20 nt, Artificial Sequence
  MKO10102263_B_Nsun5
  gRNA
gugcgagacgcagcgcuacu

SEQ ID NO: 102264 - RNA, 20 nt, Artificial Sequence
  MKO10102264_B_Nsun5
  gRNA
guguucacacgcacgaaccg

SEQ ID NO: 102265 - RNA, 20 nt, Artificial Sequence
  MKO10102265_B_Nsun6
  gRNA
cacaaaccuugguccaguca

SEQ ID NO: 102266 - RNA, 20 nt, Artificial Sequence
  MKO10102266_B_Nsun6
  gRNA
gugauuguuggcgcacagug

SEQ ID NO: 102267 - RNA, 20 nt, Artificial Sequence
  MKO10102267_B_Nsun6
  gRNA
uuugaagcugacacaauucc

SEQ ID NO: 102268 - RNA, 20 nt, Artificial Sequence
  MKO10102268_B_Nsun7
  gRNA
gaagucgagaaccuucuaaa

SEQ ID NO: 102269 - RNA, 20 nt, Artificial Sequence
  MKO10102269_B_Nsun7
  gRNA
uuaagacauugaagcagugc

SEQ ID NO: 102270 - RNA, 20 nt, Artificial Sequence
  MKO10102270_B_Nsun7
  gRNA
aauuauuauagacuucuuca

SEQ ID NO: 102271 - RNA, 20 nt, Artificial Sequence
  MKO10102271_B_Nt5c1a
  gRNA
gacgaugcgcucugacucau

SEQ ID NO: 102272 - RNA, 20 nt, Artificial Sequence
  MKO10102272_B_Nt5c1a
  gRNA
aggcugugaacaagcgacuu

SEQ ID NO: 102273 - RNA, 20 nt, Artificial Sequence
  MKO10102273_B_Nt5c1a
  gRNA
ucaaagauaucuucgcuauc

SEQ ID NO: 102274 - RNA, 20 nt, Artificial Sequence
  MKO10102274_B_Nt5c1b
  gRNA
gauuucguacaacguaaccu

SEQ ID NO: 102275 - RNA, 20 nt, Artificial Sequence
  MKO10102275_B_Nt5c1b
  gRNA
aaucuacgaagaggaagguc

SEQ ID NO: 102276 - RNA, 20 nt, Artificial Sequence
  MKO10102276_B_Nt5c1b
  gRNA
aucaguggucccgaacauca

SEQ ID NO: 102277 - RNA, 20 nt, Artificial Sequence
  MKO10102277_B_Nt5c2
  gRNA
cuugucuuugacacgcucua

SEQ ID NO: 102278 - RNA, 20 nt, Artificial Sequence
  MKO10102278_B_Nt5c2
  gRNA
ucuccagaauaugaaucccu

SEQ ID NO: 102279 - RNA, 20 nt, Artificial Sequence
  MKO10102279_B_Nt5c2
  gRNA
augauucuacauucccuacc

SEQ ID NO: 102280 - RNA, 20 nt, Artificial Sequence
  MKO10102280_B_Nt5c3b
  gRNA
cagcggcgugauggcggagg

SEQ ID NO: 102281 - RNA, 20 nt, Artificial Sequence
  MKO10102281_B_Nt5c3b
  gRNA
uaacagcaaaauuaucagug

SEQ ID NO: 102282 - RNA, 20 nt, Artificial Sequence
  MKO10102282_B_Nt5c3b
  gRNA
cugagcagauuugcuuacaa

SEQ ID NO: 102283 - RNA, 20 nt, Artificial Sequence
  MKO10102283_B_Nt5c3
  gRNA
uacagaugaaugucgaagaa

SEQ ID NO: 102284 - RNA, 20 nt, Artificial Sequence
  MKO10102284_B_Nt5c3
  gRNA
aguucccuuacaugguagag

SEQ ID NO: 102285 - RNA, 20 nt, Artificial Sequence
  MKO10102285_B_Nt5c3
  gRNA
auaauuucuucuacucuugu

SEQ ID NO: 102286 - RNA, 20 nt, Artificial Sequence
  MKO10102286_B_Nt5c
  gRNA
aaagcagccgucuccuggug

SEQ ID NO: 102287 - RNA, 20 nt, Artificial Sequence
  MKO10102287_B_Nt5c
  gRNA
gccaguguguaugaaucucc

SEQ ID NO: 102288 - RNA, 20 nt, Artificial Sequence
  MKO10102288_B_Nt5c
  gRNA
gccuagaggagaccccaagc

SEQ ID NO: 102289 - RNA, 20 nt, Artificial Sequence
  MKO10102289_B_Nt5dc1
  gRNA
cacacagaagagcccccggc

SEQ ID NO: 102290 - RNA, 20 nt, Artificial Sequence
  MKO10102290_B_Nt5dc1
  gRNA
cuuugcucaguucuuaguca

SEQ ID NO: 102291 - RNA, 20 nt, Artificial Sequence
  MKO10102291_B_Nt5dc1
  gRNA
aucagcugcaaguuuaauga

SEQ ID NO: 102292 - RNA, 20 nt, Artificial Sequence
  MKO10102292_B_Nt5dc2
  gRNA
auuugcggugcugagccgcc

SEQ ID NO: 102293 - RNA, 20 nt, Artificial Sequence
  MKO10102293_B_Nt5dc2
  gRNA
ugugcugggugccgccguac

SEQ ID NO: 102294 - RNA, 20 nt, Artificial Sequence
  MKO10102294_B_Nt5dc2
  gRNA
cugugugguggacuacuuuc

SEQ ID NO: 102295 - RNA, 20 nt, Artificial Sequence
  MKO10102295_B_Nt5dc3
  gRNA
cauauauuucgaugucugac

SEQ ID NO: 102296 - RNA, 20 nt, Artificial Sequence
  MKO10102296_B_Nt5dc3
  gRNA
accuguacacuguccccauc

SEQ ID NO: 102297 - RNA, 20 nt, Artificial Sequence
  MKO10102297_B_Nt5dc3
  gRNA
gagcagaugagugacuucua

SEQ ID NO: 102298 - RNA, 20 nt, Artificial Sequence
  MKO10102298_B_Nt5e
  gRNA
augaauggguacuuccccgc

SEQ ID NO: 102299 - RNA, 20 nt, Artificial Sequence
  MKO10102299_B_Nt5e
  gRNA
uuaauguuugcgcucagaau

SEQ ID NO: 102300 - RNA, 20 nt, Artificial Sequence
  MKO10102300_B_Nt5e
  gRNA
ccucuagcacaucagauauc

SEQ ID NO: 102301 - RNA, 20 nt, Artificial Sequence
  MKO10102301_B_Nt5m
  gRNA
guuacuccaguaugccuggg

SEQ ID NO: 102302 - RNA, 20 nt, Artificial Sequence
  MKO10102302_B_Nt5m
  gRNA
ggacuccuuaccuucucaua

SEQ ID NO: 102303 - RNA, 20 nt, Artificial Sequence
  MKO10102303_B_Nt5m
  gRNA
aggagaaggcgaucagcauc

SEQ ID NO: 102304 - RNA, 20 nt, Artificial Sequence
  MKO10102304_B_Nuan1
  gRNA
ucaucauaccuguaugucuc

SEQ ID NO: 102305 - RNA, 20 nt, Artificial Sequence
  MKO10102305_B_Nuan1
  gRNA
uguucaacaagugggacccc

SEQ ID NO: 102306 - RNA, 20 nt, Artificial Sequence
  MKO10102306_B_Nuan1
  gRNA
uccuaaccuaccauccuuug

SEQ ID NO: 102307 - RNA, 20 nt, Artificial Sequence
  MKO10102307_B_Ntf3
  gRNA
ugccaugguuacuucugcca

SEQ ID NO: 102308 - RNA, 20 nt, Artificial Sequence
  MKO10102308_B_Ntf3
  gRNA
ccggucaaaaacgguugcag

SEQ ID NO: 102309 - RNA, 20 nt, Artificial Sequence
  MKO10102309_B_Ntf3
  gRNA
ggauuaugugggcaacccgg

SEQ ID NO: 102310 - RNA, 20 nt, Artificial Sequence
  MKO10102310_B_Ntf5
  gRNA
ugcagucaacgcccgcacau

SEQ ID NO: 102311 - RNA, 20 nt, Artificial Sequence
  MKO10102311_B_Ntf5
  gRNA
gaauccagcgccagccuacg

SEQ ID NO: 102312 - RNA, 20 nt, Artificial Sequence
  MKO10102312_B_Ntf5
  gRNA
ugcacgcuccucagccgaac

SEQ ID NO: 102313 - RNA, 20 nt, Artificial Sequence
  MKO10102313_B_Nthl1
  gRNA
ugaugcaagugccuccccga

SEQ ID NO: 102314 - RNA, 20 nt, Artificial Sequence
  MKO10102314_B_Nthl1
  gRNA
cucaccauuagccgcuucau

SEQ ID NO: 102315 - RNA, 20 nt, Artificial Sequence
  MKO10102315_B_Nthl1
  gRNA
cgacucaccuaugccugaua

SEQ ID NO: 102316 - RNA, 20 nt, Artificial Sequence
  MKO10102316_B_Ntmt1
  gRNA
cuggcuccuaugacgugauc

SEQ ID NO: 102317 - RNA, 20 nt, Artificial Sequence
  MKO10102317_B_Ntmt1
  gRNA
cugcagugcggaugauccgg

SEQ ID NO: 102318 - RNA, 20 nt, Artificial Sequence
  MKO10102318_B_Ntmt1
  gRNA
cccgagcaugccguccaccg

SEQ ID NO: 102319 - RNA, 20 nt, Artificial Sequence
  MKO10102319_B_Ntm
  gRNA
acuguucccgagugaugccc

SEQ ID NO: 102320 - RNA, 20 nt, Artificial Sequence
  MKO10102320_B_Ntm
  gRNA
uguaggcuccggucuaccug

SEQ ID NO: 102321 - RNA, 20 nt, Artificial Sequence
  MKO10102321_B_Ntm
  gRNA
gaccggagccuacaguaacc

SEQ ID NO: 102322 - RNA, 20 nt, Artificial Sequence
  MKO10102322_B_Ntn1
  gRNA
aguggcggcccgcaguguug

SEQ ID NO: 102323 - RNA, 20 nt, Artificial Sequence
  MKO10102323_B_Ntn1
  gRNA
agaagcccuccuugcaguag

SEQ ID NO: 102324 - RNA, 20 nt, Artificial Sequence
  MKO10102324_B_Ntn1
  gRNA
gcagugguggguggcgccac

SEQ ID NO: 102325 - RNA, 20 nt, Artificial Sequence
  MKO10102325_B_Ntn3
  gRNA
ucacuaacgcaaggugccac

SEQ ID NO: 102326 - RNA, 20 nt, Artificial Sequence
  MKO10102326_B_Ntn3
  gRNA
gcagccuaccauaguccuuc

SEQ ID NO: 102327 - RNA, 20 nt, Artificial Sequence
  MKO10102327_B_Ntn3
  gRNA
accuguaaccgcugugcccc

SEQ ID NO: 102328 - RNA, 20 nt, Artificial Sequence
  MKO10102328_B_Ntn4
  gRNA
ccuaccacguggaacgcucc

SEQ ID NO: 102329 - RNA, 20 nt, Artificial Sequence
  MKO10102329_B_Ntn4
  gRNA
gaaagcaugcaacccucgca

SEQ ID NO: 102330 - RNA, 20 nt, Artificial Sequence
  MKO10102330_B_Ntn4
  gRNA
gugcaccauuguacaaugac

SEQ ID NO: 102331 - RNA, 20 nt, Artificial Sequence
  MKO10102331_B_Ntn5
  gRNA
uuaccugaucgagaugcaac

SEQ ID NO: 102332 - RNA, 20 nt, Artificial Sequence
  MKO10102332_B_Ntn5
  gRNA
ggccugacaugcaaucgcug

SEQ ID NO: 102333 - RNA, 20 nt, Artificial Sequence
  MKO10102333_B_Ntn5
  gRNA
gagcggcucugcugguagcc

SEQ ID NO: 102334 - RNA, 20 nt, Artificial Sequence
  MKO10102334_B_Ntng1
  gRNA
gggucuccacagguaauauc

SEQ ID NO: 102335 - RNA, 20 nt, Artificial Sequence
  MKO10102335_B_Ntng1
  gRNA
guguuacucacagguguuug

SEQ ID NO: 102336 - RNA, 20 nt, Artificial Sequence
  MKO10102336_B_Ntng1
  gRNA
gaaugugagcacaacacuac

SEQ ID NO: 102337 - RNA, 20 nt, Artificial Sequence
  MKO10102337_B_Ntng2
  gRNA
ugccccuacaggugcggccg

SEQ ID NO: 102338 - RNA, 20 nt, Artificial Sequence
  MKO10102338_B_Ntng2
  gRNA
ugcccucucgcacugugcac

SEQ ID NO: 102339 - RNA, 20 nt, Artificial Sequence
  MKO10102339_B_Ntng2
  gRNA
gcgccugaaggauuauguca

SEQ ID NO: 102340 - RNA, 20 nt, Artificial Sequence
  MKO10102340_B_Ntpcr
  gRNA
uucgaugucgucacccuguc

SEQ ID NO: 102341 - RNA, 20 nt, Artificial Sequence
  MKO10102341_B_Ntpcr
  gRNA
gugccaaccacgauaaugcc

SEQ ID NO: 102342 - RNA, 20 nt, Artificial Sequence
  MKO10102342_B_Ntpcr
  gRNA
acacucacguuucuuaggac

SEQ ID NO: 102343 - RNA, 20 nt, Artificial Sequence
  MKO10102343_B_Ntrk1
  gRNA
gcccuuccugcucccaacgc

SEQ ID NO: 102344 - RNA, 20 nt, Artificial Sequence
  MKO10102344_B_Ntrk1
  gRNA
gaaucuguccuccaaugcgu

SEQ ID NO: 102345 - RNA, 20 nt, Artificial Sequence
  MKO10102345_B_Ntrk1
  gRNA
ccagcagcaccugcaacgcu

SEQ ID NO: 102346 - RNA, 20 nt, Artificial Sequence
  MKO10102346_B_Ntrk2
  gRNA
acaagcugacgaguuugucc

SEQ ID NO: 102347 - RNA, 20 nt, Artificial Sequence
  MKO10102347_B_Ntrk2
  gRNA
gcucuacucacaugugccgc

SEQ ID NO: 102348 - RNA, 20 nt, Artificial Sequence
  MKO10102348_B_Ntrk2
  gRNA
guaagccacaaacuuuaagc

SEQ ID NO: 102349 - RNA, 20 nt, Artificial Sequence
  MKO10102349_B_Ntrk3
  gRNA
cuacucacauauaacgcaag

SEQ ID NO: 102350 - RNA, 20 nt, Artificial Sequence
  MKO10102350_B_Ntrk3
  gRNA
gcagaaacuugucaaguaac

SEQ ID NO: 102351 - RNA, 20 nt, Artificial Sequence
  MKO10102351_B_Ntrk3
  gRNA
ggguucuuggcgaaggcucu

SEQ ID NO: 102352 - RNA, 20 nt, Artificial Sequence
  MKO10102352_B_Ntsr1
  gRNA
aucgucuccaguccgaacug

SEQ ID NO: 102353 - RNA, 20 nt, Artificial Sequence
  MKO10102353_B_Ntsr1
  gRNA
uucaacauguccaucgagcc

SEQ ID NO: 102354 - RNA, 20 nt, Artificial Sequence
  MKO10102354_B_Ntsr1
  gRNA
gcugacguagaagagagcgu

SEQ ID NO: 102355 - RNA, 20 nt, Artificial Sequence
  MKO10102355_B_Ntsr2
  gRNA
ggcugccguaccaugcccgc

SEQ ID NO: 102356 - RNA, 20 nt, Artificial Sequence
  MKO10102356_B_Ntsr2
  gRNA
accuucacaggugaacgugc

SEQ ID NO: 102357 - RNA, 20 nt, Artificial Sequence
  MKO10102357_B_Ntsr2
  gRNA
uacugcuacauccccgauga

SEQ ID NO: 102358 - RNA, 20 nt, Artificial Sequence
  MKO10102358_B_Nts
  gRNA
uugucaauagaucugccucc

SEQ ID NO: 102359 - RNA, 20 nt, Artificial Sequence
  MKO10102359_B_Nts
  gRNA
auuagcuucucaguaguagu

SEQ ID NO: 102360 - RNA, 20 nt, Artificial Sequence
  MKO10102360_B_Nts
  gRNA
gagaggaaugaaucuccagc

SEQ ID NO: 102361 - RNA, 20 nt, Artificial Sequence
  MKO10102361_B_Nuak1
  gRNA
ugcuauaaaauccauccgua

SEQ ID NO: 102362 - RNA, 20 nt, Artificial Sequence
  MKO10102362_B_Nuak1
  gRNA
aaucugccggaagaaguguc

SEQ ID NO: 102363 - RNA, 20 nt, Artificial Sequence
  MKO10102363_B_Nuak1
  gRNA
ugcagaauggugugguccac

SEQ ID NO: 102364 - RNA, 20 nt, Artificial Sequence
  MKO10102364_B_Nuak2
  gRNA
agguggccaucaaguccauc

SEQ ID NO: 102365 - RNA, 20 nt, Artificial Sequence
  MKO10102365_B_Nuak2
  gRNA
ucaccugguggcaguagugc

SEQ ID NO: 102366 - RNA, 20 nt, Artificial Sequence
  MKO10102366_B_Nuak2
  gRNA
gcucaccuugauguuuccau

SEQ ID NO: 102367 - RNA, 20 nt, Artificial Sequence
  MKO10102367_B_Nub1
  gRNA
acagaacgaggccgagcuga

SEQ ID NO: 102368 - RNA, 20 nt, Artificial Sequence
  MKO10102368_B_Nub1
  gRNA
gcacgauaagaaaagcuugu

SEQ ID NO: 102369 - RNA, 20 nt, Artificial Sequence
  MKO10102369_B_Nub1
  gRNA
cucuaccagugacaugcaag

SEQ ID NO: 102370 - RNA, 20 nt, Artificial Sequence
  MKO10102370_B_Nubp1
  gRNA
guguaucuccauccuccgcu

SEQ ID NO: 102371 - RNA, 20 nt, Artificial Sequence
  MKO10102371_B_Nubp1
  gRNA
ggccugggcgcugucggccc

SEQ ID NO: 102372 - RNA, 20 nt, Artificial Sequence
  MKO10102372_B_Nubp1
  gRNA
uucccacagguucaccagag

SEQ ID NO: 102373 - RNA, 20 nt, Artificial Sequence
  MKO10102373_B_Nubp2
  gRNA
cuaagacucacagcgcagug

SEQ ID NO: 102374 - RNA, 20 nt, Artificial Sequence
  MKO10102374_B_Nubp2
  gRNA
uggaagcccugcgccccuac

SEQ ID NO: 102375 - RNA, 20 nt, Artificial Sequence
  MKO10102375_B_Nubp2
  gRNA
gccgugcaccagugugacaa

SEQ ID NO: 102376 - RNA, 20 nt, Artificial Sequence
  MKO10102376_B_Nubpl
  gRNA
agugaaccuugcucuugcgc

SEQ ID NO: 102377 - RNA, 20 nt, Artificial Sequence
  MKO10102377_B_Nubpl
  gRNA
uugcugccagcgcaagagca

SEQ ID NO: 102378 - RNA, 20 nt, Artificial Sequence
  MKO10102378_B_Nubpl
  gRNA
uuauuccagauaaccuaaug

SEQ ID NO: 102379 - RNA, 20 nt, Artificial Sequence
  MKO10102379_B_Nucb1
  gRNA
gugcagcgucauacugggcg

SEQ ID NO: 102380 - RNA, 20 nt, Artificial Sequence
  MKO10102380_B_Nucb1
  gRNA
cuagcacguugaugaccucc

SEQ ID NO: 102381 - RNA, 20 nt, Artificial Sequence
  MKO10102381_B_Nucb1
  gRNA
caccuuaauguccucagcgu

SEQ ID NO: 102382 - RNA, 20 nt, Artificial Sequence
  MKO10102382_B_Nucb2
  gRNA
agacuucaaucacuugcuug

SEQ ID NO: 102383 - RNA, 20 nt, Artificial Sequence
  MKO10102383_B_Nucb2
  gRNA
gaugcucaucaaagcuaagc

SEQ ID NO: 102384 - RNA, 20 nt, Artificial Sequence
  MKO10102384_B_Nucb2
  gRNA
caagcaagugauugaagucu

SEQ ID NO: 102385 - RNA, 20 nt, Artificial Sequence
  MKO10102385_B_Nucks1
  gRNA
cccgagaggcuaaaaauaag

SEQ ID NO: 102386 - RNA, 20 nt, Artificial Sequence
  MKO10102386_B_Nucks1
  gRNA
cgagugagaaucauccuucu

SEQ ID NO: 102387 - RNA, 20 nt, Artificial Sequence
  MKO10102387_B_Nucks1
  gRNA
uuucaggaaucagaugaugc

SEQ ID NO: 102388 - RNA, 20 nt, Artificial Sequence
  MKO10102388_B_Nudcd1
  gRNA
uaugcugcaauugaaccuaa

SEQ ID NO: 102389 - RNA, 20 nt, Artificial Sequence
  MKO10102389_B_Nudcd1
  gRNA
gucuacuacauugauaaccu

SEQ ID NO: 102390 - RNA, 20 nt, Artificial Sequence
  MKO10102390_B_Nudcd1
  gRNA
gcauguguucuaauguauac

SEQ ID NO: 102391 - RNA, 20 nt, Artificial Sequence
  MKO10102391_B_Nudcd2
  gRNA
gcuccacuaaagucaaaacc

SEQ ID NO: 102392 - RNA, 20 nt, Artificial Sequence
  MKO10102392_B_Nudcd2
  gRNA
gauucuacaauugcugauga

SEQ ID NO: 102393 - RNA, 20 nt, Artificial Sequence
  MKO10102393_B_Nudcd2
  gRNA
acaguuugcugcaucucucu

SEQ ID NO: 102394 - RNA, 20 nt, Artificial Sequence
  MKO10102394_B_Nudcd3
  gRNA
gagugagcuuccccuccaug

SEQ ID NO: 102395 - RNA, 20 nt, Artificial Sequence
  MKO10102395_B_Nudcd3
  gRNA
cgacaucgacaagaucaaca

SEQ ID NO: 102396 - RNA, 20 nt, Artificial Sequence
  MKO10102396_B_Nudcd3
  gRNA
cucggauggugccacugcua

SEQ ID NO: 102397 - RNA, 20 nt, Artificial Sequence
  MKO10102397_B_Nudc
  gRNA
caaggcugccguucuugagc

SEQ ID NO: 102398 - RNA, 20 nt, Artificial Sequence
  MKO10102398_B_Nudc
  gRNA
ugaacaggaugcggaggacg

SEQ ID NO: 102399 - RNA, 20 nt, Artificial Sequence
  MKO10102399_B_Nudc
  gRNA
accacagaaaaaggaugcag

SEQ ID NO: 102400 - RNA, 20 nt, Artificial Sequence
  MKO10102400_B_Nudt10
  gRNA
caagaucgaagaugccauca

SEQ ID NO: 102401 - RNA, 20 nt, Artificial Sequence
  MKO10102401_B_Nudt10
  gRNA
cgauccagcggucgggguag

SEQ ID NO: 102402 - RNA, 20 nt, Artificial Sequence
  MKO10102402_B_Nudt10
  gRNA
gcccgugcacgccgaguacc

SEQ ID NO: 102403 - RNA, 20 nt, Artificial Sequence
  MKO10102403_B_Nudt11
  gRNA
cgauccagcggucgggguag

SEQ ID NO: 102404 - RNA, 20 nt, Artificial Sequence
  MKO10102404_B_Nudt11
  gRNA
caagaucgaagaugccauca

SEQ ID NO: 102405 - RNA, 20 nt, Artificial Sequence
  MKO10102405_B_Nudt11
  gRNA
ccucguccucgcgcucgcug

SEQ ID NO: 102406 - RNA, 20 nt, Artificial Sequence
  MKO10102406_B_Nudt12
  gRNA
augcccuccucguuaaugau

SEQ ID NO: 102407 - RNA, 20 nt, Artificial Sequence
  MKO10102407_B_Nudt12
  gRNA
agcuggcaaagccggacuuc

SEQ ID NO: 102408 - RNA, 20 nt, Artificial Sequence
  MKO10102408_B_Nudt12
  gRNA
gccaaguaacccuuuacauc

SEQ ID NO: 102409 - RNA, 20 nt, Artificial Sequence
  MKO10102409_B_Nudt13
  gRNA
ugcugcccgccacguucuuc

SEQ ID NO: 102410 - RNA, 20 nt, Artificial Sequence
  MKO10102410_B_Nudt13
  gRNA
gggaacuaccgugaacagca

SEQ ID NO: 102411 - RNA, 20 nt, Artificial Sequence
  MKO10102411_B_Nudt13
  gRNA
ccuuaccugcucggcuaagc

SEQ ID NO: 102412 - RNA, 20 nt, Artificial Sequence
  MKO10102412_B_Nudt14
  gRNA
gagguagagcgucacuuccc

SEQ ID NO: 102413 - RNA, 20 nt, Artificial Sequence
  MKO10102413_B_Nudt14
  gRNA
ggaacuguuucaccaacacc

SEQ ID NO: 102414 - RNA, 20 nt, Artificial Sequence
  MKO10102414_B_Nudt14
  gRNA
augugucuucauaaaguccc

SEQ ID NO: 102415 - RNA, 20 nt, Artificial Sequence
  MKO10102415_B_Nudt15
  gRNA
aaugcgcucagagagaaacc

SEQ ID NO: 102416 - RNA, 20 nt, Artificial Sequence
  MKO10102416_B_Nudt15
  gRNA
uucccuucuagguugggagu

SEQ ID NO: 102417 - RNA, 20 nt, Artificial Sequence
  MKO10102417_B_Nudt15
  gRNA
uccuuucaaggugcucuccu

SEQ ID NO: 102418 - RNA, 20 nt, Artificial Sequence
  MKO10102418_B_Nudt16l1
  gRNA
aaucagcuucgguaaggcgu

SEQ ID NO: 102419 - RNA, 20 nt, Artificial Sequence
  MKO10102419_B_Nudt16l1
  gRNA
auauuuggcagugcugacga

SEQ ID NO: 102420 - RNA, 20 nt, Artificial Sequence
  MKO10102420_B_Nudt16l1
  gRNA
uacacacagaaggaucgagu

SEQ ID NO: 102421 - RNA, 20 nt, Artificial Sequence
  MKO10102421_B_Nudt16
  gRNA
gucagagcguucaacgcgga

SEQ ID NO: 102422 - RNA, 20 nt, Artificial Sequence
  MKO10102422_B_Nudt16
  gRNA
caccaucacggaggacguac

SEQ ID NO: 102423 - RNA, 20 nt, Artificial Sequence
  MKO10102423_B_Nudt16
  gRNA
guccgauucuacuuagaauc

SEQ ID NO: 102424 - RNA, 20 nt, Artificial Sequence
  MKO10102424_B_Nudt17
  gRNA
cuacguacucgugaucuccc

SEQ ID NO: 102425 - RNA, 20 nt, Artificial Sequence
  MKO10102425_B_Nudt17
  gRNA
ucacgaguacguagagaaug

SEQ ID NO: 102426 - RNA, 20 nt, Artificial Sequence
  MKO10102426_B_Nudt17
  gRNA
acagagccgcucacaaauag

SEQ ID NO: 102427 - RNA, 20 nt, Artificial Sequence
  MKO10102427_B_Nudt18
  gRNA
gcggaagaaugucugcuacg

SEQ ID NO: 102428 - RNA, 20 nt, Artificial Sequence
  MKO10102428_B_Nudt18
  gRNA
augccgccccuuuguuccau

SEQ ID NO: 102429 - RNA, 20 nt, Artificial Sequence
  MKO10102429_B_Nudt18
  gRNA
aagacgagcccccaaagauu

SEQ ID NO: 102430 - RNA, 20 nt, Artificial Sequence
  MKO10102430_B_Nudt19
  gRNA
cauguagauuucguacacau

SEQ ID NO: 102431 - RNA, 20 nt, Artificial Sequence
  MKO10102431_B_Nudt19
  gRNA
acagugguuguccccaucag

SEQ ID NO: 102432 - RNA, 20 nt, Artificial Sequence
  MKO10102432_B_Nudt19
  gRNA
aaacauucaguugccucuga

SEQ ID NO: 102433 - RNA, 20 nt, Artificial Sequence
  MKO10102433_B_Nudt1
  gRNA
gauggacgugcauaucuucu

SEQ ID NO: 102434 - RNA, 20 nt, Artificial Sequence
  MKO10102434_B_Nudt1
  gRNA
cuggaauggcuucgggggca

SEQ ID NO: 102435 - RNA, 20 nt, Artificial Sequence
  MKO10102435_B_Nudt1
  gRNA
ugcccccgaagccauuccag

SEQ ID NO: 102436 - RNA, 20 nt, Artificial Sequence
  MKO10102436_B_Nudt21
  gRNA
cagauacuuggucgucaaga

SEQ ID NO: 102437 - RNA, 20 nt, Artificial Sequence
  MKO10102437_B_Nudt21
  gRNA
ccgcuuaccaauuauacuuu

SEQ ID NO: 102438 - RNA, 20 nt, Artificial Sequence
  MKO10102438_B_Nudt21
  gRNA
aaguuguccccagcugcagc

SEQ ID NO: 102439 - RNA, 20 nt, Artificial Sequence
  MKO10102439_B_Nudt22
  gRNA
cgccauccaccucuacaguc

SEQ ID NO: 102440 - RNA, 20 nt, Artificial Sequence
  MKO10102440_B_Nudt22
  gRNA
uucucguaccaccagcaacc

SEQ ID NO: 102441 - RNA, 20 nt, Artificial Sequence
  MKO10102441_B_Nudt22
  gRNA
ccugaggcccacgagucuac

SEQ ID NO: 102442 - RNA, 20 nt, Artificial Sequence
  MKO10102442_B_Nudt2
  gRNA
caucagacggcauucaucac

SEQ ID NO: 102443 - RNA, 20 nt, Artificial Sequence
  MKO10102443_B_Nudt2
  gRNA
uuuccucccgagucucucgc

SEQ ID NO: 102444 - RNA, 20 nt, Artificial Sequence
  MKO10102444_B_Nudt2
  gRNA
aaacagcccugcgagagacu

SEQ ID NO: 102445 - RNA, 20 nt, Artificial Sequence
  MKO10102445_B_Nudt3
  gRNA
cgucauacuuugagacguug

SEQ ID NO: 102446 - RNA, 20 nt, Artificial Sequence
  MKO10102446_B_Nudt3
  gRNA
gacgaugagcacauacacgu

SEQ ID NO: 102447 - RNA, 20 nt, Artificial Sequence
  MKO10102447_B_Nudt3
  gRNA
guaccuccucacacacuucc

SEQ ID NO: 102448 - RNA, 20 nt, Artificial Sequence
  MKO10102448_B_Nudt4
  gRNA
ugggaagacuccgugaauau

SEQ ID NO: 102449 - RNA, 20 nt, Artificial Sequence
  MKO10102449_B_Nudt4
  gRNA
ucccucacagcagcaccgcc

SEQ ID NO: 102450 - RNA, 20 nt, Artificial Sequence
  MKO10102450_B_Nudt4
  gRNA
uauucaagcagaaucaagac

SEQ ID NO: 102451 - RNA, 20 nt, Artificial Sequence
  MKO10102451_B_Nudt5
  gRNA
gaaguugcggaaugcucucc

SEQ ID NO: 102452 - RNA, 20 nt, Artificial Sequence
  MKO10102452_B_Nudt5
  gRNA
aaacagugaaacuuacaacc

SEQ ID NO: 102453 - RNA, 20 nt, Artificial Sequence
  MKO10102453_B_Nudt5
  gRNA
auuugaaaaaacaacuuaua

SEQ ID NO: 102454 - RNA, 20 nt, Artificial Sequence
  MKO10102454_B_Nudt6
  gRNA
acacaccaaguuggaguugc

SEQ ID NO: 102455 - RNA, 20 nt, Artificial Sequence
  MKO10102455_B_Nudt6
  gRNA
cuguauuugauguuagcacc

SEQ ID NO: 102456 - RNA, 20 nt, Artificial Sequence
  MKO10102456_B_Nudt6
  gRNA
cagaaggacggauagcugcc

SEQ ID NO: 102457 - RNA, 20 nt, Artificial Sequence
  MKO10102457_B_Nudt7
  gRNA
accugauaccgucuugugaa

SEQ ID NO: 102458 - RNA, 20 nt, Artificial Sequence
  MKO10102458_B_Nudt7
  gRNA
uccuuucacaagacgguauc

SEQ ID NO: 102459 - RNA, 20 nt, Artificial Sequence
  MKO10102459_B_Nudt7
  gRNA
ggggcugcauccccaccaag

SEQ ID NO: 102460 - RNA, 20 nt, Artificial Sequence
  MKO10102460_B_Nudt8
  gRNA
uggcucacccggucauacac

SEQ ID NO: 102461 - RNA, 20 nt, Artificial Sequence
  MKO10102461_B_Nudt8
  gRNA
agucccaguacuugccaacg

SEQ ID NO: 102462 - RNA, 20 nt, Artificial Sequence
  MKO10102462_B_Nudt8
  gRNA
accauucaccuccucaaggu

SEQ ID NO: 102463 - RNA, 20 nt, Artificial Sequence
  MKO10102463_B_Nudt9
  gRNA
ugcaguucguugccaucaag

SEQ ID NO: 102464 - RNA, 20 nt, Artificial Sequence
  MKO10102464_B_Nudt9
  gRNA
agauugaaaacggaagaccc

SEQ ID NO: 102465 - RNA, 20 nt, Artificial Sequence
  MKO10102465_B_Nudt9
  gRNA
ggucuuuaccugguuauaau

SEQ ID NO: 102466 - RNA, 20 nt, Artificial Sequence
  MKO10102466_B_Nuf2
  gRNA
ucacuucagagaaacgugcc

SEQ ID NO: 102467 - RNA, 20 nt, Artificial Sequence
  MKO10102467_B_Nuf2
  gRNA
caaucucaaagucauucacc

SEQ ID NO: 102468 - RNA, 20 nt, Artificial Sequence
  MKO10102468_B_Nuf2
  gRNA
auuccuuuaugcccauuugc

SEQ ID NO: 102469 - RNA, 20 nt, Artificial Sequence
  MKO10102469_B_Nufip1
  gRNA
agaagauuguccaguuccau

SEQ ID NO: 102470 - RNA, 20 nt, Artificial Sequence
  MKO10102470_B_Nufip1
  gRNA
aaucuucucaugugcacuaa

SEQ ID NO: 102471 - RNA, 20 nt, Artificial Sequence
  MKO10102471_B_Nufip1
  gRNA
ucacagaaaaaauggaaaac

SEQ ID NO: 102472 - RNA, 20 nt, Artificial Sequence
  MKO10102472_B_Nufip2
  gRNA
auuguaagugauuauccuuu

SEQ ID NO: 102473 - RNA, 20 nt, Artificial Sequence
  MKO10102473_B_Nufip2
  gRNA
ccaugcugcagguauuggug

SEQ ID NO: 102474 - RNA, 20 nt, Artificial Sequence
  MKO10102474_B_Nufip2
  gRNA
cuuucaauggaggagaagcc

SEQ ID NO: 102475 - RNA, 20 nt, Artificial Sequence
  MKO10102475_B_Nuggc
  gRNA
guuuaccaggggaaacgccu

SEQ ID NO: 102476 - RNA, 20 nt, Artificial Sequence
  MKO10102476_B_Nuggc
  gRNA
agcauaccugaucggacaga

SEQ ID NO: 102477 - RNA, 20 nt, Artificial Sequence
  MKO10102477_B_Nuggc
  gRNA
aguguugcucaagacccucc

SEQ ID NO: 102478 - RNA, 20 nt, Artificial Sequence
  MKO10102478_B_Numa1
  gRNA
uccuucaucuacacaaugcc

SEQ ID NO: 102479 - RNA, 20 nt, Artificial Sequence
  MKO10102479_B_Numa1
  gRNA
aauccuacagcagccacuac

SEQ ID NO: 102480 - RNA, 20 nt, Artificial Sequence
  MKO10102480_B_Numa1
  gRNA
gacugggagcaguuugaaua

SEQ ID NO: 102481 - RNA, 20 nt, Artificial Sequence
  MKO10102481_B_Numbl
  gRNA
acccaaguaccugggccacg

SEQ ID NO: 102482 - RNA, 20 nt, Artificial Sequence
  MKO10102482_B_Numbl
  gRNA
gucagcugaugggcuccgag

SEQ ID NO: 102483 - RNA, 20 nt, Artificial Sequence
  MKO10102483_B_Numbl
  gRNA
cuucacaaacgugcauuccc

SEQ ID NO: 102484 - RNA, 20 nt, Artificial Sequence
  MKO10102484_B_Numb
  gRNA
guucugugggugucagcgga

SEQ ID NO: 102485 - RNA, 20 nt, Artificial Sequence
  MKO10102485_B_Numb
  gRNA
aaaguguagcuucccaguua

SEQ ID NO: 102486 - RNA, 20 nt, Artificial Sequence
  MKO10102486_B_Numb
  gRNA
guagaaguugaugagucaag

SEQ ID NO: 102487 - RNA, 20 nt, Artificial Sequence
  MKO10102487_B_Nup107
  gRNA
agagcaucauaguaugaccg

SEQ ID NO: 102488 - RNA, 20 nt, Artificial Sequence
  MKO10102488_B_Nup107
  gRNA
uuggcguucgaggaaugauc

SEQ ID NO: 102489 - RNA, 20 nt, Artificial Sequence
  MKO10102489_B_Nup107
  gRNA
uccucgucaccuccgcaucc

SEQ ID NO: 102490 - RNA, 20 nt, Artificial Sequence
  MKO10102490_B_Nup133
  gRNA
gaggcugggccaauagcgga

SEQ ID NO: 102491 - RNA, 20 nt, Artificial Sequence
  MKO10102491_B_Nup133
  gRNA
cuuucuguccaugucgauga

SEQ ID NO: 102492 - RNA, 20 nt, Artificial Sequence
  MKO10102492_B_Nup133
  gRNA
agggccguuaccuuagugac

SEQ ID NO: 102493 - RNA, 20 nt, Artificial Sequence
  MKO10102493_B_Nup153
  gRNA
aaguaucuuuguagccaccc

SEQ ID NO: 102494 - RNA, 20 nt, Artificial Sequence
  MKO10102494_B_Nup153
  gRNA
cacgguggaaaguguuccaa

SEQ ID NO: 102495 - RNA, 20 nt, Artificial Sequence
  MKO10102495_B_Nup153
  gRNA
acauccucugcguucccaau

SEQ ID NO: 102496 - RNA, 20 nt, Artificial Sequence
  MKO10102496_B_Nup155
  gRNA
gacauggauuacccucugca

SEQ ID NO: 102497 - RNA, 20 nt, Artificial Sequence
  MKO10102497_B_Nup155
  gRNA
accucauguaagacacuugc

SEQ ID NO: 102498 - RNA, 20 nt, Artificial Sequence
  MKO10102498_B_Nup155
  gRNA
cucacugaguccaucaaaau

SEQ ID NO: 102499 - RNA, 20 nt, Artificial Sequence
  MKO10102499_B_Nup160
  gRNA
ugugaguaaucgcugcauca

SEQ ID NO: 102500 - RNA, 20 nt, Artificial Sequence
  MKO10102500_B_Nup160
  gRNA
gugaugcagcgauuacucac

SEQ ID NO: 102501 - RNA, 20 nt, Artificial Sequence
  MKO10102501_B_Nup160
  gRNA
uacuuaccagguacgucaua

SEQ ID NO: 102502 - RNA, 20 nt, Artificial Sequence
  MKO10102502_B_Nup188
  gRNA
uuucuuacuacaaaccuccc

SEQ ID NO: 102503 - RNA, 20 nt, Artificial Sequence
  MKO10102503_B_Nup188
  gRNA
ccaagaacuugcugacucuu

SEQ ID NO: 102504 - RNA, 20 nt, Artificial Sequence
  MKO10102504_B_Nup188
  gRNA
uaccccuguaauccuccuga

SEQ ID NO: 102505 - RNA, 20 nt, Artificial Sequence
  MKO10102505_B_Nup205
  gRNA
cagcuaccaauccccuggug

SEQ ID NO: 102506 - RNA, 20 nt, Artificial Sequence
  MKO10102506_B_Nup205
  gRNA
gucugguuccuuguugcccc

SEQ ID NO: 102507 - RNA, 20 nt, Artificial Sequence
  MKO10102507_B_Nup205
  gRNA
uuccucgucuagacuguauc

SEQ ID NO: 102508 - RNA, 20 nt, Artificial Sequence
  MKO10102508_B_Nup210l
  gRNA
cucucgaugacucauugucc

SEQ ID NO: 102509 - RNA, 20 nt, Artificial Sequence
  MKO10102509_B_Nup210l
  gRNA
guuugaguggaguauugccc

SEQ ID NO: 102510 - RNA, 20 nt, Artificial Sequence
  MKO10102510_B_Nup210l
  gRNA
cccugacuauauaauugaga

SEQ ID NO: 102511 - RNA, 20 nt, Artificial Sequence
  MKO10102511_B_Nup210
  gRNA
cuucgacuggacaauuguga

SEQ ID NO: 102512 - RNA, 20 nt, Artificial Sequence
  MKO10102512_B_Nup210
  gRNA
ggcgacaccauccuaguguc

SEQ ID NO: 102513 - RNA, 20 nt, Artificial Sequence
  MKO10102513_B_Nup210
  gRNA
gccaucguugaucucaucca

SEQ ID NO: 102514 - RNA, 20 nt, Artificial Sequence
  MKO10102514_B_Nup214
  gRNA
gaagagcauaccauacuuau

SEQ ID NO: 102515 - RNA, 20 nt, Artificial Sequence
  MKO10102515_B_Nup214
  gRNA
guauucacuagacaucaugc

SEQ ID NO: 102516 - RNA, 20 nt, Artificial Sequence
  MKO10102516_B_Nup214
  gRNA
ugcaugaugucuagugaaua

SEQ ID NO: 102517 - RNA, 20 nt, Artificial Sequence
  MKO10102517_B_Nup35
  gRNA
aggaucugaaccaaugaugu

SEQ ID NO: 102518 - RNA, 20 nt, Artificial Sequence
  MKO10102518_B_Nup35
  gRNA
ccugcucauaaagauaagag

SEQ ID NO: 102519 - RNA, 20 nt, Artificial Sequence
  MKO10102519_B_Nup35
  gRNA
ggaguuguagcuccaacaag

SEQ ID NO: 102520 - RNA, 20 nt, Artificial Sequence
  MKO10102520_B_Nup37
  gRNA
gaguguaugcuggcaucccg

SEQ ID NO: 102521 - RNA, 20 nt, Artificial Sequence
  MKO10102521_B_Nup37
  gRNA
ugagugacgaccacaccugc

SEQ ID NO: 102522 - RNA, 20 nt, Artificial Sequence
  MKO10102522_B_Nup37
  gRNA
ugccagcauacacucauucc

SEQ ID NO: 102523 - RNA, 20 nt, Artificial Sequence
  MKO10102523_B_Nup43
  gRNA
cccuguccgucaaucagcag

SEQ ID NO: 102524 - RNA, 20 nt, Artificial Sequence
  MKO10102524_B_Nup43
  gRNA
ccacugcugauugacggaca

SEQ ID NO: 102525 - RNA, 20 nt, Artificial Sequence
  MKO10102525_B_Nup43
  gRNA
uuacagugauaguaucugac

SEQ ID NO: 102526 - RNA, 20 nt, Artificial Sequence
  MKO10102526_B_Nup50
  gRNA
ugacgagccacccaagguag

SEQ ID NO: 102527 - RNA, 20 nt, Artificial Sequence
  MKO10102527_B_Nup50
  gRNA
ucugcgcuuugccuucuuua

SEQ ID NO: 102528 - RNA, 20 nt, Artificial Sequence
  MKO10102528_B_Nup50
  gRNA
cuacucaccaaaggcugccu

SEQ ID NO: 102529 - RNA, 20 nt, Artificial Sequence
  MKO10102529_B_Nup54
  gRNA
uguucugagugccaccgaga

SEQ ID NO: 102530 - RNA, 20 nt, Artificial Sequence
  MKO10102530_B_Nup54
  gRNA
auucuaccaauugcuguugc

SEQ ID NO: 102531 - RNA, 20 nt, Artificial Sequence
  MKO10102531_B_Nup54
  gRNA
ggaacaacaacuacaacugc

SEQ ID NO: 102532 - RNA, 20 nt, Artificial Sequence
  MKO10102532_B_Nup62-il4i1
  gRNA
uggccgccaggacaagacgc

SEQ ID NO: 102533 - RNA, 20 nt, Artificial Sequence
  MKO10102533_B_Nup62-il4i1
  gRNA
cacaguaugaugagaacacg

SEQ ID NO: 102534 - RNA, 20 nt, Artificial Sequence
  MKO10102534_B_Nup62-il4i1
  gRNA
ccaccuuguugagugccauc

SEQ ID NO: 102535 - RNA, 20 nt, Artificial Sequence
  MKO10102535_B_Nup62cl
  gRNA
aaccaagcacugauugaguc

SEQ ID NO: 102536 - RNA, 20 nt, Artificial Sequence
  MKO10102536_B_Nup62cl
  gRNA
gagugaaaauugaucagagc

SEQ ID NO: 102537 - RNA, 20 nt, Artificial Sequence
  MKO10102537_B_Nup62cl
  gRNA
acaaauguugacuccuauag

SEQ ID NO: 102538 - RNA, 20 nt, Artificial Sequence
  MKO10102538_B_Nup62
  gRNA
ugcgcuccuguuccuugcgc

SEQ ID NO: 102539 - RNA, 20 nt, Artificial Sequence
  MKO10102539_B_Nup62
  gRNA
gcgugagaagaccuacaagc

SEQ ID NO: 102540 - RNA, 20 nt, Artificial Sequence
  MKO10102540_B_Nup62
  gRNA
guuguuccaaaguugaaucc

SEQ ID NO: 102541 - RNA, 20 nt, Artificial Sequence
  MKO10102541_B_Nup85
  gRNA
gaaacuuccuucaaccaaac

SEQ ID NO: 102542 - RNA, 20 nt, Artificial Sequence
  MKO10102542_B_Nup85
  gRNA
gcugcuaaagauccagccag

SEQ ID NO: 102543 - RNA, 20 nt, Artificial Sequence
  MKO10102543_B_Nup85
  gRNA
aaaauuaccguucagucaua

SEQ ID NO: 102544 - RNA, 20 nt, Artificial Sequence
  MKO10102544_B_Nup88
  gRNA
cgauaagugcuacaugaugu

SEQ ID NO: 102545 - RNA, 20 nt, Artificial Sequence
  MKO10102545_B_Nup88
  gRNA
gugaaaaaucucucagcaau

SEQ ID NO: 102546 - RNA, 20 nt, Artificial Sequence
  MKO10102546_B_Nup88
  gRNA
uggcauuagaauuaccucag

SEQ ID NO: 102547 - RNA, 20 nt, Artificial Sequence
  MKO10102547_B_Nup93
  gRNA
cugucggcagaccuuuggca

SEQ ID NO: 102548 - RNA, 20 nt, Artificial Sequence
  MKO10102548_B_Nup93
  gRNA
cucgagagguucaaaagugg

SEQ ID NO: 102549 - RNA, 20 nt, Artificial Sequence
  MKO10102549_B_Nup93
  gRNA
ugaauguccguguccuucac

SEQ ID NO: 102550 - RNA, 20 nt, Artificial Sequence
  MKO10102550_B_Nup98
  gRNA
uuuggguuuggcacaucaac

SEQ ID NO: 102551 - RNA, 20 nt, Artificial Sequence
  MKO10102551_B_Nup98
  gRNA
gaccauaguaucuguaccag

SEQ ID NO: 102552 - RNA, 20 nt, Artificial Sequence
  MKO10102552_B_Nup98
  gRNA
ucccacugguacagauacua

SEQ ID NO: 102553 - RNA, 20 nt, Artificial Sequence
  MKO10102553_B_Nupl1
  gRNA
ccugccacuggauuuacucu

SEQ ID NO: 102554 - RNA, 20 nt, Artificial Sequence
  MKO10102554_B_Nupl1
  gRNA
gagaguaagaccacuagcug

SEQ ID NO: 102555 - RNA, 20 nt, Artificial Sequence
  MKO10102555_B_Nupl1
  gRNA
ugaaccucccaaaccagcua

SEQ ID NO: 102556 - RNA, 20 nt, Artificial Sequence
  MKO10102556_B_Nupl2
  gRNA
cguagaaguuugggagucgu

SEQ ID NO: 102557 - RNA, 20 nt, Artificial Sequence
  MKO10102557_B_Nupl2
  gRNA
uucaacagcuuguaagucag

SEQ ID NO: 102558 - RNA, 20 nt, Artificial Sequence
  MKO10102558_B_Nupl2
  gRNA
uauucaagccucaacuccuc

SEQ ID NO: 102559 - RNA, 20 nt, Artificial Sequence
  MKO10102559_B_Nupr1l
  gRNA
uggcgcagauacugcucaac

SEQ ID NO: 102560 - RNA, 20 nt, Artificial Sequence
  MKO10102560_B_Nupr1l
  gRNA
gcagcuacgcaccaacuacc

SEQ ID NO: 102561 - RNA, 20 nt, Artificial Sequence
  MKO10102561_B_Nupr1l
  gRNA
cacgcagguaguaguaaucc

SEQ ID NO: 102562 - RNA, 20 nt, Artificial Sequence
  MKO10102562_B_Nupr1
  gRNA
aaaccuuaccgacacaggga

SEQ ID NO: 102563 - RNA, 20 nt, Artificial Sequence
  MKO10102563_B_Nupr1
  gRNA
ugaauaugaucaguacagcc

SEQ ID NO: 102564 - RNA, 20 nt, Artificial Sequence
  MKO10102564_B_Nupr1
  gRNA
uguacugaucauauucaucc

SEQ ID NO: 102565 - RNA, 20 nt, Artificial Sequence
  MKO10102565_B_Nus1
  gRNA
cucagucaaucugauuugcc

SEQ ID NO: 102566 - RNA, 20 nt, Artificial Sequence
  MKO10102566_B_Nus1
  gRNA
ucugcugcugggcuacuaac

SEQ ID NO: 102567 - RNA, 20 nt, Artificial Sequence
  MKO10102567_B_Nus1
  gRNA
aguaaugacaaagacgauca

SEQ ID NO: 102568 - RNA, 20 nt, Artificial Sequence
  MKO10102568_B_Nusap1
  gRNA
acgucaccaaaacgaggagg

SEQ ID NO: 102569 - RNA, 20 nt, Artificial Sequence
  MKO10102569_B_Nusap1
  gRNA
gggccuccgggcuaacauga

SEQ ID NO: 102570 - RNA, 20 nt, Artificial Sequence
  MKO10102570_B_Nusap1
  gRNA
uuccuuucagacuuuguugc

SEQ ID NO: 102571 - RNA, 20 nt, Artificial Sequence
  MKO10102571_B_Nuuf2
  gRNA
uugaugcaucaugccuuaca

SEQ ID NO: 102572 - RNA, 20 nt, Artificial Sequence
  MKO10102572_B_Nuuf2
  gRNA
augcugaugaugcagcuauc

SEQ ID NO: 102573 - RNA, 20 nt, Artificial Sequence
  MKO10102573_B_Nuuf2
  gRNA
gaaaauucagcauagcauca

SEQ ID NO: 102574 - RNA, 20 nt, Artificial Sequence
  MKO10102574_B_Nuum1
  gRNA
uagcccagugcuucguuccc

SEQ ID NO: 102575 - RNA, 20 nt, Artificial Sequence
  MKO10102575_B_Nuum1
  gRNA
ggcggcaacgcaaaccucaa

SEQ ID NO: 102576 - RNA, 20 nt, Artificial Sequence
  MKO10102576_B_Nuum1
  gRNA
agcgcuacaaagucuuggcc

SEQ ID NO: 102577 - RNA, 20 nt, Artificial Sequence
  MKO10102577_B_Nvl
  gRNA
guuugucuuaccuguggauc

SEQ ID NO: 102578 - RNA, 20 nt, Artificial Sequence
  MKO10102578_B_Nvl
  gRNA
aaucuuaaagaacuagaaga

SEQ ID NO: 102579 - RNA, 20 nt, Artificial Sequence
  MKO10102579_B_Nvl
  gRNA
aagagcaagacaagaugaag

SEQ ID NO: 102580 - RNA, 20 nt, Artificial Sequence
  MKO10102580_B_Nwd1
  gRNA
uagucaguggccugcguauu

SEQ ID NO: 102581 - RNA, 20 nt, Artificial Sequence
  MKO10102581_B_Nwd1
  gRNA
acgagcgugagccuuguucu

SEQ ID NO: 102582 - RNA, 20 nt, Artificial Sequence
  MKO10102582_B_Nwd1
  gRNA
cugccuagucaggaggcccg

SEQ ID NO: 102583 - RNA, 20 nt, Artificial Sequence
  MKO10102583_B_Nxf1
  gRNA
ucuuaccucgaugggauuga

SEQ ID NO: 102584 - RNA, 20 nt, Artificial Sequence
  MKO10102584_B_Nxf1
  gRNA
cuaaucgucggggagauggu

SEQ ID NO: 102585 - RNA, 20 nt, Artificial Sequence
  MKO10102585_B_Nxf1
  gRNA
uguccccuucaaucccaucg

SEQ ID NO: 102586 - RNA, 20 nt, Artificial Sequence
  MKO10102586_B_Nxf2
  gRNA
agagaggugugaauuauauc

SEQ ID NO: 102587 - RNA, 20 nt, Artificial Sequence
  MKO10102587_B_Nxf2
  gRNA
ucuuacaucaacagggauga

SEQ ID NO: 102588 - RNA, 20 nt, Artificial Sequence
  MKO10102588_B_Nxf2
  gRNA
gaugauaguaaaacugagga

SEQ ID NO: 102589 - RNA, 20 nt, Artificial Sequence
  MKO10102589_B_Nxf3
  gRNA
gcaucucauucuucuucgca

SEQ ID NO: 102590 - RNA, 20 nt, Artificial Sequence
  MKO10102590_B_Nxf3
  gRNA
guacacugacucucugauaa

SEQ ID NO: 102591 - RNA, 20 nt, Artificial Sequence
  MKO10102591_B_Nxf3
  gRNA
gugcagcaucccuuucacuc

SEQ ID NO: 102592 - RNA, 20 nt, Artificial Sequence
  MKO10102592_B_Nxf7
  gRNA
cuccuauguugcccaacaua

SEQ ID NO: 102593 - RNA, 20 nt, Artificial Sequence
  MKO10102593_B_Nxf7
  gRNA
ucucauagcacaccuuaugu

SEQ ID NO: 102594 - RNA, 20 nt, Artificial Sequence
  MKO10102594_B_Nxf7
  gRNA
cuuacccauggggcuuugcc

SEQ ID NO: 102595 - RNA, 20 nt, Artificial Sequence
  MKO10102595_B_Nxnl1
  gRNA
gccgcacgaagaagucuuug

SEQ ID NO: 102596 - RNA, 20 nt, Artificial Sequence
  MKO10102596_B_Nxnl1
  gRNA
cgguacuugcgacggcgcag

SEQ ID NO: 102597 - RNA, 20 nt, Artificial Sequence
  MKO10102597_B_Nxnl1
  gRNA
cccgcucccggccgacaucc

SEQ ID NO: 102598 - RNA, 20 nt, Artificial Sequence
  MKO10102598_B_Nxnl2
  gRNA
cggaagcagauccgagagcg

SEQ ID NO: 102599 - RNA, 20 nt, Artificial Sequence
  MKO10102599_B_Nxnl2
  gRNA
uccccacucacugccgguag

SEQ ID NO: 102600 - RNA, 20 nt, Artificial Sequence
  MKO10102600_B_Nxnl2
  gRNA
cguggcgaugguggacgugc

SEQ ID NO: 102601 - RNA, 20 nt, Artificial Sequence
  MKO10102601_B_Nxn
  gRNA
acccuuccgggaaguuauug

SEQ ID NO: 102602 - RNA, 20 nt, Artificial Sequence
  MKO10102602_B_Nxn
  gRNA
auauuccuagacgccaccac

SEQ ID NO: 102603 - RNA, 20 nt, Artificial Sequence
  MKO10102603_B_Nxn
  gRNA
ccgccgggccucaucagugu

SEQ ID NO: 102604 - RNA, 20 nt, Artificial Sequence
  MKO10102604_B_Nxpe2
  gRNA
gguaaagaaucuguccaucg

SEQ ID NO: 102605 - RNA, 20 nt, Artificial Sequence
  MKO10102605_B_Nxpe2
  gRNA
gcaguguugaaucacccaug

SEQ ID NO: 102606 - RNA, 20 nt, Artificial Sequence
  MKO10102606_B_Nxpe2
  gRNA
auuucuugaagguucaacau

SEQ ID NO: 102607 - RNA, 20 nt, Artificial Sequence
  MKO10102607_B_Nxpe3
  gRNA
cagugguggccauagccgua

SEQ ID NO: 102608 - RNA, 20 nt, Artificial Sequence
  MKO10102608_B_Nxpe3
  gRNA
uaaugaccccgacaacauua

SEQ ID NO: 102609 - RNA, 20 nt, Artificial Sequence
  MKO10102609_B_Nxpe3
  gRNA
guauggcggagauuaccugc

SEQ ID NO: 102610 - RNA, 20 nt, Artificial Sequence
  MKO10102610_B_Nxpe4
  gRNA
uagaccaaugacccgauaag

SEQ ID NO: 102611 - RNA, 20 nt, Artificial Sequence
  MKO10102611_B_Nxpe4
  gRNA
gaccaaguuccagcgauuga

SEQ ID NO: 102612 - RNA, 20 nt, Artificial Sequence
  MKO10102612_B_Nxpe4
  gRNA
uuccacaauccgccagugga

SEQ ID NO: 102613 - RNA, 20 nt, Artificial Sequence
  MKO10102613_B_Nxpe5
  gRNA
ugccagacaacauccaccca

SEQ ID NO: 102614 - RNA, 20 nt, Artificial Sequence
  MKO10102614_B_Nxpe5
  gRNA
augucucagaauccaucgac

SEQ ID NO: 102615 - RNA, 20 nt, Artificial Sequence
  MKO10102615_B_Nxpe5
  gRNA
cucccaccacugccgaagug

SEQ ID NO: 102616 - RNA, 20 nt, Artificial Sequence
  MKO10102616_B_Nxph1
  gRNA
ccugcagcccaccgucuacu

SEQ ID NO: 102617 - RNA, 20 nt, Artificial Sequence
  MKO10102617_B_Nxph1
  gRNA
aaaaaucguggaauucgauu

SEQ ID NO: 102618 - RNA, 20 nt, Artificial Sequence
  MKO10102618_B_Nxph1
  gRNA
ccuguucaucuucauccgga

SEQ ID NO: 102619 - RNA, 20 nt, Artificial Sequence
  MKO10102619_B_Nxph2
  gRNA
cugccucuccuuguaguccc

SEQ ID NO: 102620 - RNA, 20 nt, Artificial Sequence
  MKO10102620_B_Nxph2
  gRNA
cccauccaaaaucugcuacc

SEQ ID NO: 102621 - RNA, 20 nt, Artificial Sequence
  MKO10102621_B_Nxph2
  gRNA
aaacuuaacuugcucaucac

SEQ ID NO: 102622 - RNA, 20 nt, Artificial Sequence
  MKO10102622_B_Nxph3
  gRNA
cugcuucguguuccuagugc

SEQ ID NO: 102623 - RNA, 20 nt, Artificial Sequence
  MKO10102623_B_Nxph3
  gRNA
cuagggcuguuagccccacc

SEQ ID NO: 102624 - RNA, 20 nt, Artificial Sequence
  MKO10102624_B_Nxph3
  gRNA
acaccccaaaccuccccggg

SEQ ID NO: 102625 - RNA, 20 nt, Artificial Sequence
  MKO10102625_B_Nxph4
  gRNA
cgggaagaugcggcugcucc

SEQ ID NO: 102626 - RNA, 20 nt, Artificial Sequence
  MKO10102626_B_Nxph4
  gRNA
auuaaaagcgcgcgacucuu

SEQ ID NO: 102627 - RNA, 20 nt, Artificial Sequence
  MKO10102627_B_Nxph4
  gRNA
gcggcacgauacugacgcuu

SEQ ID NO: 102628 - RNA, 20 nt, Artificial Sequence
  MKO10102628_B_Nxt1
  gRNA
ggcagucuaccacgcugauu

SEQ ID NO: 102629 - RNA, 20 nt, Artificial Sequence
  MKO10102629_B_Nxt1
  gRNA
uaucuuccacaccguguuac

SEQ ID NO: 102630 - RNA, 20 nt, Artificial Sequence
  MKO10102630_B_Nxt1
  gRNA
caaugucuauuacacgacua

SEQ ID NO: 102631 - RNA, 20 nt, Artificial Sequence
  MKO10102631_B_Nxt2
  gRNA
acagugcucguugugaccag

SEQ ID NO: 102632 - RNA, 20 nt, Artificial Sequence
  MKO10102632_B_Nxt2
  gRNA
ucaggcauguagagcugccg

SEQ ID NO: 102633 - RNA, 20 nt, Artificial Sequence
  MKO10102633_B_Nxt2
  gRNA
caauauuuacuaugagacaa

SEQ ID NO: 102634 - RNA, 20 nt, Artificial Sequence
  MKO10102634_B_Nyap1
  gRNA
caugacgaugcccgcguccc

SEQ ID NO: 102635 - RNA, 20 nt, Artificial Sequence
  MKO10102635_B_Nyap1
  gRNA
ccucgcuucgacgaucccuc

SEQ ID NO: 102636 - RNA, 20 nt, Artificial Sequence
  MKO10102636_B_Nyap1
  gRNA
uugggccuagauuucacggg

SEQ ID NO: 102637 - RNA, 20 nt, Artificial Sequence
  MKO10102637_B_Nyap2
  gRNA
auggcccaggucgucgaaaa

SEQ ID NO: 102638 - RNA, 20 nt, Artificial Sequence
  MKO10102638_B_Nyap2
  gRNA
aggccaggacgccaguuacg

SEQ ID NO: 102639 - RNA, 20 nt, Artificial Sequence
  MKO10102639_B_Nyap2
  gRNA
cuugccaucgcuaugaauag

SEQ ID NO: 102640 - RNA, 20 nt, Artificial Sequence
  MKO10102640_B_Nynrin
  gRNA
agcugguggcacgguugcgc

SEQ ID NO: 102641 - RNA, 20 nt, Artificial Sequence
  MKO10102641_B_Nynrin
  gRNA
ggcauaccuguaaucguaag

SEQ ID NO: 102642 - RNA, 20 nt, Artificial Sequence
  MKO10102642_B_Nynrin
  gRNA
ccauggccgugcaguacuuc

SEQ ID NO: 102643 - RNA, 20 nt, Artificial Sequence
  MKO10102643_B_Nyx
  gRNA
aggacucaccaugaagaagc

SEQ ID NO: 102644 - RNA, 20 nt, Artificial Sequence
  MKO10102644_B_Nyx
  gRNA
gguuauuguggcgcagcgac

SEQ ID NO: 102645 - RNA, 20 nt, Artificial Sequence
  MKO10102645_B_Nyx
  gRNA
cuuuggcgacugcggcgccc

SEQ ID NO: 102646 - RNA, 20 nt, Artificial Sequence
  MKO10102646_B_OTTMUSG00000016609
  gRNA
uauagcugugagauucuuau

SEQ ID NO: 102647 - RNA, 20 nt, Artificial Sequence
  MKO10102647_B_OTTMUSG00000016609
  gRNA
uacuggguuuagguuacauu

SEQ ID NO: 102648 - RNA, 20 nt, Artificial Sequence
  MKO10102648_B_OTTMUSG00000016609
  gRNA
gacuucuagaaguuugaaaa

SEQ ID NO: 102649 - RNA, 20 nt, Artificial Sequence
  MKO10102649_B_Oacyl
  gRNA
guucagaaacacgucauucu

SEQ ID NO: 102650 - RNA, 20 nt, Artificial Sequence
  MKO10102650_B_Oacyl
  gRNA
ugcagguucaucaccuugcu

SEQ ID NO: 102651 - RNA, 20 nt, Artificial Sequence
  MKO10102651_B_Oacyl
  gRNA
ggauggaacagacuauagug

SEQ ID NO: 102652 - RNA, 20 nt, Artificial Sequence
  MKO10102652_B_Oaf
  gRNA
augccacacuuguagggcgc

SEQ ID NO: 102653 - RNA, 20 nt, Artificial Sequence
  MKO10102653_B_Oaf
  gRNA
uuaccucguuguggacgagu

SEQ ID NO: 102654 - RNA, 20 nt, Artificial Sequence
  MKO10102654_B_Oaf
  gRNA
ccucagccugccgcacugcg

SEQ ID NO: 102655 - RNA, 20 nt, Artificial Sequence
  MKO10102655_B_Oard1
  gRNA
uuuguucucaggauuggaug

SEQ ID NO: 102656 - RNA, 20 nt, Artificial Sequence
  MKO10102656_B_Oard1
  gRNA
uggccuccaaacucuucugu

SEQ ID NO: 102657 - RNA, 20 nt, Artificial Sequence
  MKO10102657_B_Oard1
  gRNA
gacaauccucacugauacaa

SEQ ID NO: 102658 - RNA, 20 nt, Artificial Sequence
  MKO10102658_B_Oas1a
  gRNA
ccaccggccacauucccugu

SEQ ID NO: 102659 - RNA, 20 nt, Artificial Sequence
  MKO10102659_B_Oas1a
  gRNA
acauccauucccuuguuccc

SEQ ID NO: 102660 - RNA, 20 nt, Artificial Sequence
  MKO10102660_B_Oas1a
  gRNA
gggcaagucagacgcugacc

SEQ ID NO: 102661 - RNA, 20 nt, Artificial Sequence
  MKO10102661_B_Oas1b
  gRNA
aaggacuggaggcgucuagc

SEQ ID NO: 102662 - RNA, 20 nt, Artificial Sequence
  MKO10102662_B_Oas1b
  gRNA
uucuacgccaaucucaucag

SEQ ID NO: 102663 - RNA, 20 nt, Artificial Sequence
  MKO10102663_B_Oas1b
  gRNA
gcguaccccgccggggaagg

SEQ ID NO: 102664 - RNA, 20 nt, Artificial Sequence
  MKO10102664_B_Oas1c
  gRNA
gggucucaccgacaaauccc

SEQ ID NO: 102665 - RNA, 20 nt, Artificial Sequence
  MKO10102665_B_Oas1c
  gRNA
gcgacggggagaguucguug

SEQ ID NO: 102666 - RNA, 20 nt, Artificial Sequence
  MKO10102666_B_Oas1c
  gRNA
accuccaucagaacuucaug

SEQ ID NO: 102667 - RNA, 20 nt, Artificial Sequence
  MKO10102667_B_Oas1d
  gRNA
gaaccaugauauguccauug

SEQ ID NO: 102668 - RNA, 20 nt, Artificial Sequence
  MKO10102668_B_Oas1d
  gRNA
guagacuuuguuguaguuac

SEQ ID NO: 102669 - RNA, 20 nt, Artificial Sequence
  MKO10102669_B_Oas1d
  gRNA
caaagcuugugagauugaua

SEQ ID NO: 102670 - RNA, 20 nt, Artificial Sequence
  MKO10102670_B_Oas1e
  gRNA
acaaaugccuucuaaucuac

SEQ ID NO: 102671 - RNA, 20 nt, Artificial Sequence
  MKO10102671_B_Oas1e
  gRNA
guagacuuuguuguaguuaa

SEQ ID NO: 102672 - RNA, 20 nt, Artificial Sequence
  MKO10102672_B_Oas1e
  gRNA
ugugauaugucccuugugaa

SEQ ID NO: 102673 - RNA, 20 nt, Artificial Sequence
  MKO10102673_B_Oas1f
  gRNA
gcuugggugcacgauccucc

SEQ ID NO: 102674 - RNA, 20 nt, Artificial Sequence
  MKO10102674_B_Oas1f
  gRNA
cugguaccaaccuacuaggc

SEQ ID NO: 102675 - RNA, 20 nt, Artificial Sequence
  MKO10102675_B_Oas1f
  gRNA
gauucgaagccacuuguacu

SEQ ID NO: 102676 - RNA, 20 nt, Artificial Sequence
  MKO10102676_B_Oas1g
  gRNA
cauagacagugaguagcucc

SEQ ID NO: 102677 - RNA, 20 nt, Artificial Sequence
  MKO10102677_B_Oas1g
  gRNA
gcuuccagccuuugaugucc

SEQ ID NO: 102678 - RNA, 20 nt, Artificial Sequence
  MKO10102678_B_Oas1g
  gRNA
uggcuuacccaggacaucaa

SEQ ID NO: 102679 - RNA, 20 nt, Artificial Sequence
  MKO10102679_B_Oas1h
  gRNA
agguuggauaaguucauaga

SEQ ID NO: 102680 - RNA, 20 nt, Artificial Sequence
  MKO10102680_B_Oas1h
  gRNA
gagcuaccccaaguuucagc

SEQ ID NO: 102681 - RNA, 20 nt, Artificial Sequence
  MKO10102681_B_Oas1h
  gRNA
agugcuugaccagacaaaug

SEQ ID NO: 102682 - RNA, 20 nt, Artificial Sequence
  MKO10102682_B_Oas2
  gRNA
aauuccuagaccagucaucu

SEQ ID NO: 102683 - RNA, 20 nt, Artificial Sequence
  MKO10102683_B_Oas2
  gRNA
accuugacgucauugaacug

SEQ ID NO: 102684 - RNA, 20 nt, Artificial Sequence
  MKO10102684_B_Oas2
  gRNA
ucaguuggauccaagaugac

SEQ ID NO: 102685 - RNA, 20 nt, Artificial Sequence
  MKO10102685_B_Oas3
  gRNA
aggcccgggguggccccccc

SEQ ID NO: 102686 - RNA, 20 nt, Artificial Sequence
  MKO10102686_B_Oas3
  gRNA
cgcaagaacucuccaacugc

SEQ ID NO: 102687 - RNA, 20 nt, Artificial Sequence
  MKO10102687_B_Oas3
  gRNA
gcaacauucgcauggcaccc

SEQ ID NO: 102688 - RNA, 20 nt, Artificial Sequence
  MKO10102688_B_Oasl1
  gRNA
gcacuacacgcugcagcacc

SEQ ID NO: 102689 - RNA, 20 nt, Artificial Sequence
  MKO10102689_B_Oasl1
  gRNA
ucaucuucacgauccagacc

SEQ ID NO: 102690 - RNA, 20 nt, Artificial Sequence
  MKO10102690_B_Oasl1
  gRNA
gcucaggagcacuacagacg

SEQ ID NO: 102691 - RNA, 20 nt, Artificial Sequence
  MKO10102691_B_Oasl2
  gRNA
ugaaggguucguagccguga

SEQ ID NO: 102692 - RNA, 20 nt, Artificial Sequence
  MKO10102692_B_Oasl2
  gRNA
ucucgccugcucuucgaaac

SEQ ID NO: 102693 - RNA, 20 nt, Artificial Sequence
  MKO10102693_B_Oasl2
  gRNA
uuacccaaagcaucguaagc

SEQ ID NO: 102694 - RNA, 20 nt, Artificial Sequence
  MKO10102694_B_Oau
  gRNA
uguacuccucguauucacca

SEQ ID NO: 102695 - RNA, 20 nt, Artificial Sequence
  MKO10102695_B_Oau
  gRNA
ccggauccaggauaccugac

SEQ ID NO: 102696 - RNA, 20 nt, Artificial Sequence
  MKO10102696_B_Oau
  gRNA
agaguucccgaacuccuguc

SEQ ID NO: 102697 - RNA, 20 nt, Artificial Sequence
  MKO10102697_B_Oaz1
  gRNA
ccuuaauugcuguaguaacc

SEQ ID NO: 102698 - RNA, 20 nt, Artificial Sequence
  MKO10102698_B_Oaz1
  gRNA
ugacuguucccucgcccacc

SEQ ID NO: 102699 - RNA, 20 nt, Artificial Sequence
  MKO10102699_B_Oaz1
  gRNA
cacccaccccugaagauccc

SEQ ID NO: 102700 - RNA, 20 nt, Artificial Sequence
  MKO10102700_B_Oaz2
  gRNA
ccgaggugaaggucucuucc

SEQ ID NO: 102701 - RNA, 20 nt, Artificial Sequence
  MKO10102701_B_Oaz2
  gRNA
acugcucaccucugucuucc

SEQ ID NO: 102702 - RNA, 20 nt, Artificial Sequence
  MKO10102702_B_Oaz2
  gRNA
uauauuagagcugagagaga

SEQ ID NO: 102703 - RNA, 20 nt, Artificial Sequence
  MKO10102703_B_Oaz3
  gRNA
acauguuuagggaggcucac

SEQ ID NO: 102704 - RNA, 20 nt, Artificial Sequence
  MKO10102704_B_Oaz3
  gRNA
ccauaucaggccuuggauca

SEQ ID NO: 102705 - RNA, 20 nt, Artificial Sequence
  MKO10102705_B_Oaz3
  gRNA
cucgaagcccauguagcuaa

SEQ ID NO: 102706 - RNA, 20 nt, Artificial Sequence
  MKO10102706_B_Obfc1
  gRNA
gcgauuugcauguuccacac

SEQ ID NO: 102707 - RNA, 20 nt, Artificial Sequence
  MKO10102707_B_Obfc1
  gRNA
aauaaggcggguagauauca

SEQ ID NO: 102708 - RNA, 20 nt, Artificial Sequence
  MKO10102708_B_Obfc1
  gRNA
ugcgcacagagccucggacu

SEQ ID NO: 102709 - RNA, 20 nt, Artificial Sequence
  MKO10102709_B_Obox1
  gRNA
caaguacugccagagucaaa

SEQ ID NO: 102710 - RNA, 20 nt, Artificial Sequence
  MKO10102710_B_Obox1
  gRNA
cuacuuaagcaagagucuca

SEQ ID NO: 102711 - RNA, 20 nt, Artificial Sequence
  MKO10102711_B_Obox1
  gRNA
aaauauguuaacaaacaaac

SEQ ID NO: 102712 - RNA, 20 nt, Artificial Sequence
  MKO10102712_B_Obox2
  gRNA
cuacuuaagcaagagucuga

SEQ ID NO: 102713 - RNA, 20 nt, Artificial Sequence
  MKO10102713_B_Obox2
  gRNA
ucaucugccuguacuuagcu

SEQ ID NO: 102714 - RNA, 20 nt, Artificial Sequence
  MKO10102714_B_Obox2
  gRNA
agaacaaccgagcuaaguac

SEQ ID NO: 102715 - RNA, 20 nt, Artificial Sequence
  MKO10102715_B_Obox3
  gRNA
cgaaacuuucuuaaagccau

SEQ ID NO: 102716 - RNA, 20 nt, Artificial Sequence
  MKO10102716_B_Obox3
  gRNA
uuaacauaucuaucugacag

SEQ ID NO: 102717 - RNA, 20 nt, Artificial Sequence
  MKO10102717_B_Obox3
  gRNA
cuugcauccaaaacuccaag

SEQ ID NO: 102718 - RNA, 20 nt, Artificial Sequence
  MKO10102718_B_Obox5
  gRNA
uuugaagccacuugaaguuu

SEQ ID NO: 102719 - RNA, 20 nt, Artificial Sequence
  MKO10102719_B_Obox5
  gRNA
cccaaacgagaagaaaauua

SEQ ID NO: 102720 - RNA, 20 nt, Artificial Sequence
  MKO10102720_B_Obox5
  gRNA
aaauauguuaacaaacaaac

SEQ ID NO: 102721 - RNA, 20 nt, Artificial Sequence
  MKO10102721_B_Obox6
  gRNA
auucuggagacucucccgcu

SEQ ID NO: 102722 - RNA, 20 nt, Artificial Sequence
  MKO10102722_B_Obox6
  gRNA
gagucacaaggcugacucgu

SEQ ID NO: 102723 - RNA, 20 nt, Artificial Sequence
  MKO10102723_B_Obox6
  gRNA
aauacgcacuguauacaccg

SEQ ID NO: 102724 - RNA, 20 nt, Artificial Sequence
  MKO10102724_B_Obp1a
  gRNA
cuauaaaauguuaaguucuc

SEQ ID NO: 102725 - RNA, 20 nt, Artificial Sequence
  MKO10102725_B_Obp1a
  gRNA
agaguagacaagauagagag

SEQ ID NO: 102726 - RNA, 20 nt, Artificial Sequence
  MKO10102726_B_Obp1a
  gRNA
ucguagccuuaccugugaaa

SEQ ID NO: 102727 - RNA, 20 nt, Artificial Sequence
  MKO10102727_B_Obp2a
  gRNA
aucugcaguucauaacacga

SEQ ID NO: 102728 - RNA, 20 nt, Artificial Sequence
  MKO10102728_B_Obp2a
  gRNA
ucacaagcgguguauuugcc

SEQ ID NO: 102729 - RNA, 20 nt, Artificial Sequence
  MKO10102729_B_Obp2a
  gRNA
uggagaccacaguuguauuc

SEQ ID NO: 102730 - RNA, 20 nt, Artificial Sequence
  MKO10102730_B_Obp2b
  gRNA
agaagucuccuguauauaga

SEQ ID NO: 102731 - RNA, 20 nt, Artificial Sequence
  MKO10102731_B_Obp2b
  gRNA
acacucaccagaauguuagc

SEQ ID NO: 102732 - RNA, 20 nt, Artificial Sequence
  MKO10102732_B_Obp2b
  gRNA
caagaaauuugcaaugagca

SEQ ID NO: 102733 - RNA, 20 nt, Artificial Sequence
  MKO10102733_B_Obscn
  gRNA
cagcgccaaguacgacaucg

SEQ ID NO: 102734 - RNA, 20 nt, Artificial Sequence
  MKO10102734_B_Obscn
  gRNA
uguccgguggcuacggaacc

SEQ ID NO: 102735 - RNA, 20 nt, Artificial Sequence
  MKO10102735_B_Obscn
  gRNA
gaccgcccugucacuauuga

SEQ ID NO: 102736 - RNA, 20 nt, Artificial Sequence
  MKO10102736_B_Obsl1
  gRNA
cagaaccguugaacacgaca

SEQ ID NO: 102737 - RNA, 20 nt, Artificial Sequence
  MKO10102737_B_Obsl1
  gRNA
ccauccugaagcguuuaccc

SEQ ID NO: 102738 - RNA, 20 nt, Artificial Sequence
  MKO10102738_B_Obsl1
  gRNA
guuaccaaccuuggauagug

SEQ ID NO: 102739 - RNA, 20 nt, Artificial Sequence
  MKO10102739_B_Oc90
  gRNA
gcugcugcuuccagcaucgc

SEQ ID NO: 102740 - RNA, 20 nt, Artificial Sequence
  MKO10102740_B_Oc90
  gRNA
gccuagguucccacuucacc

SEQ ID NO: 102741 - RNA, 20 nt, Artificial Sequence
  MKO10102741_B_Oc90
  gRNA
aauccccaggaauugccucc

SEQ ID NO: 102742 - RNA, 20 nt, Artificial Sequence
  MKO10102742_B_Oca2
  gRNA
aggaaaguucuggcagcugu

SEQ ID NO: 102743 - RNA, 20 nt, Artificial Sequence
  MKO10102743_B_Oca2
  gRNA
ggaauucaucccaaaagaaa

SEQ ID NO: 102744 - RNA, 20 nt, Artificial Sequence
  MKO10102744_B_Oca2
  gRNA
acagcugccagaacuuuccu

SEQ ID NO: 102745 - RNA, 20 nt, Artificial Sequence
  MKO10102745_B_Ocel1
  gRNA
ccgcuaugccgcaguguucc

SEQ ID NO: 102746 - RNA, 20 nt, Artificial Sequence
  MKO10102746_B_Ocel1
  gRNA
gcugcccccgccacgaagcc

SEQ ID NO: 102747 - RNA, 20 nt, Artificial Sequence
  MKO10102747_B_Ocel1
  gRNA
ggcucgcuguaacuaccuga

SEQ ID NO: 102748 - RNA, 20 nt, Artificial Sequence
  MKO10102748_B_Ociad1
  gRNA
auauuccgacagaggaggag

SEQ ID NO: 102749 - RNA, 20 nt, Artificial Sequence
  MKO10102749_B_Ociad1
  gRNA
cugucaagucauccaaaaua

SEQ ID NO: 102750 - RNA, 20 nt, Artificial Sequence
  MKO10102750_B_Ociad1
  gRNA
ugaaccagaagcacucuuca

SEQ ID NO: 102751 - RNA, 20 nt, Artificial Sequence
  MKO10102751_B_Ociad2
  gRNA
uuagccgcuaauccaagauu

SEQ ID NO: 102752 - RNA, 20 nt, Artificial Sequence
  MKO10102752_B_Ociad2
  gRNA
uugacacucucugauaaucu

SEQ ID NO: 102753 - RNA, 20 nt, Artificial Sequence
  MKO10102753_B_Ociad2
  gRNA
uaugacuuacaugcaacuuu

SEQ ID NO: 102754 - RNA, 20 nt, Artificial Sequence
  MKO10102754_B_Ocln
  gRNA
uuaccauugcugcuguaccg

SEQ ID NO: 102755 - RNA, 20 nt, Artificial Sequence
  MKO10102755_B_Ocln
  gRNA
cauaccgauccaucuuucuu

SEQ ID NO: 102756 - RNA, 20 nt, Artificial Sequence
  MKO10102756_B_Ocln
  gRNA
ccaauggccuacuccuccaa

SEQ ID NO: 102757 - RNA, 20 nt, Artificial Sequence
  MKO10102757_B_Ocm
  gRNA
gcagcggacaacgauggaga

SEQ ID NO: 102758 - RNA, 20 nt, Artificial Sequence
  MKO10102758_B_Ocm
  gRNA
agucaccuuggcauuccugc

SEQ ID NO: 102759 - RNA, 20 nt, Artificial Sequence
  MKO10102759_B_Ocm
  gRNA
gagcgcugaugacauugcag

SEQ ID NO: 102760 - RNA, 20 nt, Artificial Sequence
  MKO10102760_B_Ocrl
  gRNA
agguuaauaauccaguugca

SEQ ID NO: 102761 - RNA, 20 nt, Artificial Sequence
  MKO10102761_B_Ocrl
  gRNA
guuguuccuuuccaugcaac

SEQ ID NO: 102762 - RNA, 20 nt, Artificial Sequence
  MKO10102762_B_Ocrl
  gRNA
acucauacugcccauuccuc

SEQ ID NO: 102763 - RNA, 20 nt, Artificial Sequence
  MKO10102763_B_Ocsuamp
  gRNA
cuauggccacccgggaaucc

SEQ ID NO: 102764 - RNA, 20 nt, Artificial Sequence
  MKO10102764_B_Ocsuamp
  gRNA
agacguaccccaagccaaag

SEQ ID NO: 102765 - RNA, 20 nt, Artificial Sequence
  MKO10102765_B_Ocsuamp
  gRNA
gcagccacggaacaccucuu

SEQ ID NO: 102766 - RNA, 20 nt, Artificial Sequence
  MKO10102766_B_Odam
  gRNA
guugaccauuauuaagauuc

SEQ ID NO: 102767 - RNA, 20 nt, Artificial Sequence
  MKO10102767_B_Odam
  gRNA
ucagauaccuuuaucaagac

SEQ ID NO: 102768 - RNA, 20 nt, Artificial Sequence
  MKO10102768_B_Odam
  gRNA
gucugcuagcaacagucaug

SEQ ID NO: 102769 - RNA, 20 nt, Artificial Sequence
  MKO10102769_B_Odc1
  gRNA
ugauccugagaccuucguuc

SEQ ID NO: 102770 - RNA, 20 nt, Artificial Sequence
  MKO10102770_B_Odc1
  gRNA
uuguauuucagcuuccaugu

SEQ ID NO: 102771 - RNA, 20 nt, Artificial Sequence
  MKO10102771_B_Odc1
  gRNA
gcauagauaacccucucugc

SEQ ID NO: 102772 - RNA, 20 nt, Artificial Sequence
  MKO10102772_B_Odf1
  gRNA
acggguaguagaggucacac

SEQ ID NO: 102773 - RNA, 20 nt, Artificial Sequence
  MKO10102773_B_Odf1
  gRNA
aggucugcgugucggccgag

SEQ ID NO: 102774 - RNA, 20 nt, Artificial Sequence
  MKO10102774_B_Odf1
  gRNA
gucaaagugcgcgugaaaga

SEQ ID NO: 102775 - RNA, 20 nt, Artificial Sequence
  MKO10102775_B_Odf2l
  gRNA
auggagaugccuacuaguga

SEQ ID NO: 102776 - RNA, 20 nt, Artificial Sequence
  MKO10102776_B_Odf2l
  gRNA
cagcuugcuaugcuuguuga

SEQ ID NO: 102777 - RNA, 20 nt, Artificial Sequence
  MKO10102777_B_Odf2l
  gRNA
gaaacagacacgagaguuca

SEQ ID NO: 102778 - RNA, 20 nt, Artificial Sequence
  MKO10102778_B_Odf2
  gRNA
gaguguccgggugaaaacca

SEQ ID NO: 102779 - RNA, 20 nt, Artificial Sequence
  MKO10102779_B_Odf2
  gRNA
cauuucagccuccacuaguu

SEQ ID NO: 102780 - RNA, 20 nt, Artificial Sequence
  MKO10102780_B_Odf2
  gRNA
aaggggacaccgugaaugua

SEQ ID NO: 102781 - RNA, 20 nt, Artificial Sequence
  MKO10102781_B_Odf3b
  gRNA
auaccaucgcuccccgaaac

SEQ ID NO: 102782 - RNA, 20 nt, Artificial Sequence
  MKO10102782_B_Odf3b
  gRNA
agccccgcaguucacgaugc

SEQ ID NO: 102783 - RNA, 20 nt, Artificial Sequence
  MKO10102783_B_Odf3b
  gRNA
cuacaccgugccuucgcucu

SEQ ID NO: 102784 - RNA, 20 nt, Artificial Sequence
  MKO10102784_B_Odf3l1
  gRNA
cguguaugcagacuguaagc

SEQ ID NO: 102785 - RNA, 20 nt, Artificial Sequence
  MKO10102785_B_Odf3l1
  gRNA
uauagccaguacaggaugac

SEQ ID NO: 102786 - RNA, 20 nt, Artificial Sequence
  MKO10102786_B_Odf3l1
  gRNA
uauuccaaaacgaguuacuu

SEQ ID NO: 102787 - RNA, 20 nt, Artificial Sequence
  MKO10102787_B_Odf3l2
  gRNA
cggccaaagcgaguaacuuu

SEQ ID NO: 102788 - RNA, 20 nt, Artificial Sequence
  MKO10102788_B_Odf3l2
  gRNA
uauguucuuccguccaccgu

SEQ ID NO: 102789 - RNA, 20 nt, Artificial Sequence
  MKO10102789_B_Odf3l2
  gRNA
uguguccaucagccacccgc

SEQ ID NO: 102790 - RNA, 20 nt, Artificial Sequence
  MKO10102790_B_Odf3
  gRNA
cuucagcgacgaccugcaca

SEQ ID NO: 102791 - RNA, 20 nt, Artificial Sequence
  MKO10102791_B_Odf3
  gRNA
ucacuugaaccucagucuga

SEQ ID NO: 102792 - RNA, 20 nt, Artificial Sequence
  MKO10102792_B_Odf3
  gRNA
gggcuccacccgggcagcca

SEQ ID NO: 102793 - RNA, 20 nt, Artificial Sequence
  MKO10102793_B_Odf4
  gRNA
aagcaacaaacaacucucgc

SEQ ID NO: 102794 - RNA, 20 nt, Artificial Sequence
  MKO10102794_B_Odf4
  gRNA
auuccaaucaggccaaagaa

SEQ ID NO: 102795 - RNA, 20 nt, Artificial Sequence
  MKO10102795_B_Odf4
  gRNA
uccauccacaguauguccac

SEQ ID NO: 102796 - RNA, 20 nt, Artificial Sequence
  MKO10102796_B_Ofcc1
  gRNA
uaagcagaagaaauccacgu

SEQ ID NO: 102797 - RNA, 20 nt, Artificial Sequence
  MKO10102797_B_Ofcc1
  gRNA
uuuauuuccuccuccgucag

SEQ ID NO: 102798 - RNA, 20 nt, Artificial Sequence
  MKO10102798_B_Ofcc1
  gRNA
ccagcuucagcgggacccaa

SEQ ID NO: 102799 - RNA, 20 nt, Artificial Sequence
  MKO10102799_B_Ofd1
  gRNA
aaagcuauaccagacguuua

SEQ ID NO: 102800 - RNA, 20 nt, Artificial Sequence
  MKO10102800_B_Ofd1
  gRNA
uaccaaugauuuauagagac

SEQ ID NO: 102801 - RNA, 20 nt, Artificial Sequence
  MKO10102801_B_Ofd1
  gRNA
auccagucucuauaaaucau

SEQ ID NO: 102802 - RNA, 20 nt, Artificial Sequence
  MKO10102802_B_Ogdhl
  gRNA
agcaccuacugccagcauau

SEQ ID NO: 102803 - RNA, 20 nt, Artificial Sequence
  MKO10102803_B_Ogdhl
  gRNA
uuccaccagcuugcuggucu

SEQ ID NO: 102804 - RNA, 20 nt, Artificial Sequence
  MKO10102804_B_Ogdhl
  gRNA
cuagauccgaggccaccaug

SEQ ID NO: 102805 - RNA, 20 nt, Artificial Sequence
  MKO10102805_B_Ogdh
  gRNA
gacuaguucgaacuaugugg

SEQ ID NO: 102806 - RNA, 20 nt, Artificial Sequence
  MKO10102806_B_Ogdh
  gRNA
agaagcggaccuugcuggcc

SEQ ID NO: 102807 - RNA, 20 nt, Artificial Sequence
  MKO10102807_B_Ogdh
  gRNA
cuccugucccccgaugaaag

SEQ ID NO: 102808 - RNA, 20 nt, Artificial Sequence
  MKO10102808_B_Ogfod1
  gRNA
cggcggauccuggcccagcg

SEQ ID NO: 102809 - RNA, 20 nt, Artificial Sequence
  MKO10102809_B_Ogfod1
  gRNA
uccaacagaagcuauugccu

SEQ ID NO: 102810 - RNA, 20 nt, Artificial Sequence
  MKO10102810_B_Ogfod1
  gRNA
agccccauaucucagcuuua

SEQ ID NO: 102811 - RNA, 20 nt, Artificial Sequence
  MKO10102811_B_Ogfod2
  gRNA
gcgccgccgcaggcugggac

SEQ ID NO: 102812 - RNA, 20 nt, Artificial Sequence
  MKO10102812_B_Ogfod2
  gRNA
cagaggagaagcgcaucuau

SEQ ID NO: 102813 - RNA, 20 nt, Artificial Sequence
  MKO10102813_B_Ogfod2
  gRNA
cagaacuuggccgagaacac

SEQ ID NO: 102814 - RNA, 20 nt, Artificial Sequence
  MKO10102814_B_Ogfod3
  gRNA
ccccuccauccgauccaccu

SEQ ID NO: 102815 - RNA, 20 nt, Artificial Sequence
  MKO10102815_B_Ogfod3
  gRNA
ucacugacaucgucaucacc

SEQ ID NO: 102816 - RNA, 20 nt, Artificial Sequence
  MKO10102816_B_Ogfod3
  gRNA
aggaggcggagcagauucgc

SEQ ID NO: 102817 - RNA, 20 nt, Artificial Sequence
  MKO10102817_B_Ogfrl1
  gRNA
guccuagggcggcgagucca

SEQ ID NO: 102818 - RNA, 20 nt, Artificial Sequence
  MKO10102818_B_Ogfrl1
  gRNA
gaaaggggacuacgagaagc

SEQ ID NO: 102819 - RNA, 20 nt, Artificial Sequence
  MKO10102819_B_Ogfrl1
  gRNA
cauuaccucgauuucauaug

SEQ ID NO: 102820 - RNA, 20 nt, Artificial Sequence
  MKO10102820_B_Ogfr
  gRNA
auccacucaccacuggaugu

SEQ ID NO: 102821 - RNA, 20 nt, Artificial Sequence
  MKO10102821_B_Ogfr
  gRNA
uugacagaucaagacugcaa

SEQ ID NO: 102822 - RNA, 20 nt, Artificial Sequence
  MKO10102822_B_Ogfr
  gRNA
agaaucacuccuacauccag

SEQ ID NO: 102823 - RNA, 20 nt, Artificial Sequence
  MKO10102823_B_Ogg1
  gRNA
aacaacauugcucgcauuac

SEQ ID NO: 102824 - RNA, 20 nt, Artificial Sequence
  MKO10102824_B_Ogg1
  gRNA
agcacgccacuccagugagc

SEQ ID NO: 102825 - RNA, 20 nt, Artificial Sequence
  MKO10102825_B_Ogg1
  gRNA
ucaucaagcugaaugagucg

SEQ ID NO: 102826 - RNA, 20 nt, Artificial Sequence
  MKO10102826_B_Ogn
  gRNA
ugcuguaccaccauugccaa

SEQ ID NO: 102827 - RNA, 20 nt, Artificial Sequence
  MKO10102827_B_Ogn
  gRNA
gaacuggaagucuuaguagu

SEQ ID NO: 102828 - RNA, 20 nt, Artificial Sequence
  MKO10102828_B_Ogn
  gRNA
acgcaugucugcaaaauccu

SEQ ID NO: 102829 - RNA, 20 nt, Artificial Sequence
  MKO10102829_B_Ogu
  gRNA
agcagaagccuauucgaauu

SEQ ID NO: 102830 - RNA, 20 nt, Artificial Sequence
  MKO10102830_B_Ogu
  gRNA
uggcuucuuccaagcgaccc

SEQ ID NO: 102831 - RNA, 20 nt, Artificial Sequence
  MKO10102831_B_Ogu
  gRNA
aacacagccgagauuacucc

SEQ ID NO: 102832 - RNA, 20 nt, Artificial Sequence
  MKO10102832_B_Oip5
  gRNA
accuucuaugccaaccaaaa

SEQ ID NO: 102833 - RNA, 20 nt, Artificial Sequence
  MKO10102833_B_Oip5
  gRNA
uuuaccagaaaagauugcag

SEQ ID NO: 102834 - RNA, 20 nt, Artificial Sequence
  MKO10102834_B_Oip5
  gRNA
uuucuagugauaaaaugcug

SEQ ID NO: 102835 - RNA, 20 nt, Artificial Sequence
  MKO10102835_B_Oit1
  gRNA
ugcaggucugauccguguug

SEQ ID NO: 102836 - RNA, 20 nt, Artificial Sequence
  MKO10102836_B_Oit1
  gRNA
uagauacucacggauguccu

SEQ ID NO: 102837 - RNA, 20 nt, Artificial Sequence
  MKO10102837_B_Oit1
  gRNA
cauuucgucuucaaagcaca

SEQ ID NO: 102838 - RNA, 20 nt, Artificial Sequence
  MKO10102838_B_Oit3
  gRNA
aacucacaccgcugcgcaug

SEQ ID NO: 102839 - RNA, 20 nt, Artificial Sequence
  MKO10102839_B_Oit3
  gRNA
accgagugugcaugcucucc

SEQ ID NO: 102840 - RNA, 20 nt, Artificial Sequence
  MKO10102840_B_Oit3
  gRNA
gaagauaaucacacuugcca

SEQ ID NO: 102841 - RNA, 20 nt, Artificial Sequence
  MKO10102841_B_Ola1
  gRNA
gccaguaccauaaaccagca

SEQ ID NO: 102842 - RNA, 20 nt, Artificial Sequence
  MKO10102842_B_Ola1
  gRNA
auuaaaccgccuccaauuau

SEQ ID NO: 102843 - RNA, 20 nt, Artificial Sequence
  MKO10102843_B_Ola1
  gRNA
aucguuggauugccaaaugu

SEQ ID NO: 102844 - RNA, 20 nt, Artificial Sequence
  MKO10102844_B_Olah
  gRNA
gaacuguuugugucaaaagc

SEQ ID NO: 102845 - RNA, 20 nt, Artificial Sequence
  MKO10102845_B_Olah
  gRNA
uccagugcaugcuguaagac

SEQ ID NO: 102846 - RNA, 20 nt, Artificial Sequence
  MKO10102846_B_Olah
  gRNA
ccgaaagauuaauggcuuau

SEQ ID NO: 102847 - RNA, 20 nt, Artificial Sequence
  MKO10102847_B_Olfm1
  gRNA
gccauaagcagcaucuagcc

SEQ ID NO: 102848 - RNA, 20 nt, Artificial Sequence
  MKO10102848_B_Olfm1
  gRNA
ucgccuguccaagacuucua

SEQ ID NO: 102849 - RNA, 20 nt, Artificial Sequence
  MKO10102849_B_Olfm1
  gRNA
gguguugcccaccaaccccg

SEQ ID NO: 102850 - RNA, 20 nt, Artificial Sequence
  MKO10102850_B_Olfm2
  gRNA
uggggucccgcuucgguucc

SEQ ID NO: 102851 - RNA, 20 nt, Artificial Sequence
  MKO10102851_B_Olfm2
  gRNA
ucuccaguauguucgcagca

SEQ ID NO: 102852 - RNA, 20 nt, Artificial Sequence
  MKO10102852_B_Olfm2
  gRNA
ucuccaugcugcgaacauac

SEQ ID NO: 102853 - RNA, 20 nt, Artificial Sequence
  MKO10102853_B_Olfm3
  gRNA
ucgauuuggugcuuggauga

SEQ ID NO: 102854 - RNA, 20 nt, Artificial Sequence
  MKO10102854_B_Olfm3
  gRNA
ugggcgaugcauuuguacug

SEQ ID NO: 102855 - RNA, 20 nt, Artificial Sequence
  MKO10102855_B_Olfm3
  gRNA
uuucaugcagucacgaagcc

SEQ ID NO: 102856 - RNA, 20 nt, Artificial Sequence
  MKO10102856_B_Olfm4
  gRNA
ggccuagcaggaaagcuguu

SEQ ID NO: 102857 - RNA, 20 nt, Artificial Sequence
  MKO10102857_B_Olfm4
  gRNA
gauaaggaauaugacccucu

SEQ ID NO: 102858 - RNA, 20 nt, Artificial Sequence
  MKO10102858_B_Olfm4
  gRNA
cgccuuucccgcugacagag

SEQ ID NO: 102859 - RNA, 20 nt, Artificial Sequence
  MKO10102859_B_Olfml1
  gRNA
cacgcuccacucuuagggca

SEQ ID NO: 102860 - RNA, 20 nt, Artificial Sequence
  MKO10102860_B_Olfml1
  gRNA
gcaaaaguguaucuauuagc

SEQ ID NO: 102861 - RNA, 20 nt, Artificial Sequence
  MKO10102861_B_Olfml1
  gRNA
ggucaccuaccucgaggacu

SEQ ID NO: 102862 - RNA, 20 nt, Artificial Sequence
  MKO10102862_B_Olfml2a
  gRNA
ugcugcugagccagcgcacg

SEQ ID NO: 102863 - RNA, 20 nt, Artificial Sequence
  MKO10102863_B_Olfml2a
  gRNA
ccgaggcuucaccuacuaca

SEQ ID NO: 102864 - RNA, 20 nt, Artificial Sequence
  MKO10102864_B_Olfml2a
  gRNA
agccucaagccccgacagca

SEQ ID NO: 102865 - RNA, 20 nt, Artificial Sequence
  MKO10102865_B_Olfml2b
  gRNA
cucgcuuguucagcuccguu

SEQ ID NO: 102866 - RNA, 20 nt, Artificial Sequence
  MKO10102866_B_Olfml2b
  gRNA
cugcguccucaggaguucga

SEQ ID NO: 102867 - RNA, 20 nt, Artificial Sequence
  MKO10102867_B_Olfml2b
  gRNA
ggcugacagccgagauuuga

SEQ ID NO: 102868 - RNA, 20 nt, Artificial Sequence
  MKO10102868_B_Olfml3
  gRNA
caugccgacuacucugaucc

SEQ ID NO: 102869 - RNA, 20 nt, Artificial Sequence
  MKO10102869_B_Olfml3
  gRNA
aagaguggaccgucuugaaa

SEQ ID NO: 102870 - RNA, 20 nt, Artificial Sequence
  MKO10102870_B_Olfml3
  gRNA
ucaccucuaaggcagcuagu

SEQ ID NO: 102871 - RNA, 20 nt, Artificial Sequence
  MKO10102871_B_Olfr1000
  gRNA
augccacggaagagaaacuc

SEQ ID NO: 102872 - RNA, 20 nt, Artificial Sequence
  MKO10102872_B_Olfr1000
  gRNA
agcgacagucaccaagugag

SEQ ID NO: 102873 - RNA, 20 nt, Artificial Sequence
  MKO10102873_B_Olfr1000
  gRNA
ugccuucaagaugcauacau

SEQ ID NO: 102874 - RNA, 20 nt, Artificial Sequence
  MKO10102874_B_Olfr1002
  gRNA
caucagcagaauugaucuuu

SEQ ID NO: 102875 - RNA, 20 nt, Artificial Sequence
  MKO10102875_B_Olfr1002
  gRNA
gcauuuauucuuccauacug

SEQ ID NO: 102876 - RNA, 20 nt, Artificial Sequence
  MKO10102876_B_Olfr1002
  gRNA
gauguugucugacaucuuug

SEQ ID NO: 102877 - RNA, 20 nt, Artificial Sequence
  MKO10102877_B_Olfr1006
  gRNA
gguguuugcaguaugggcua

SEQ ID NO: 102878 - RNA, 20 nt, Artificial Sequence
  MKO10102878_B_Olfr1006
  gRNA
aucuacuuguugacauuguc

SEQ ID NO: 102879 - RNA, 20 nt, Artificial Sequence
  MKO10102879_B_Olfr1006
  gRNA
ccgugaagcccaccacaccc

SEQ ID NO: 102880 - RNA, 20 nt, Artificial Sequence
  MKO10102880_B_Olfr1008
  gRNA
uccucucuucugauaguccu

SEQ ID NO: 102881 - RNA, 20 nt, Artificial Sequence
  MKO10102881_B_Olfr1008
  gRNA
acucuuuaucuuguccucaa

SEQ ID NO: 102882 - RNA, 20 nt, Artificial Sequence
  MKO10102882_B_Olfr1008
  gRNA
uuguaggcgagaguccagcu

SEQ ID NO: 102883 - RNA, 20 nt, Artificial Sequence
  MKO10102883_B_Olfr1009
  gRNA
gagauaccacccuaaucugc

SEQ ID NO: 102884 - RNA, 20 nt, Artificial Sequence
  MKO10102884_B_Olfr1009
  gRNA
uuuagcaacuguccugccca

SEQ ID NO: 102885 - RNA, 20 nt, Artificial Sequence
  MKO10102885_B_Olfr1009
  gRNA
uggcggaugagaacuauaca

SEQ ID NO: 102886 - RNA, 20 nt, Artificial Sequence
  MKO10102886_B_Olfr100
  gRNA
ugucauuacagagugaagua

SEQ ID NO: 102887 - RNA, 20 nt, Artificial Sequence
  MKO10102887_B_Olfr100
  gRNA
caucuuuggcagugucacag

SEQ ID NO: 102888 - RNA, 20 nt, Artificial Sequence
  MKO10102888_B_Olfr100
  gRNA
cugugauauuaagccauugu

SEQ ID NO: 102889 - RNA, 20 nt, Artificial Sequence
  MKO10102889_B_Olfr1010
  gRNA
cagaagaauaccacagaucc

SEQ ID NO: 102890 - RNA, 20 nt, Artificial Sequence
  MKO10102890_B_Olfr1010
  gRNA
uuggccgggaguaaauaaag

SEQ ID NO: 102891 - RNA, 20 nt, Artificial Sequence
  MKO10102891_B_Olfr1010
  gRNA
uauugucucgacagaaacuc

SEQ ID NO: 102892 - RNA, 20 nt, Artificial Sequence
  MKO10102892_B_Olfr1012
  gRNA
aacuagcaacacauucacau

SEQ ID NO: 102893 - RNA, 20 nt, Artificial Sequence
  MKO10102893_B_Olfr1012
  gRNA
aucaacccagggucgucuca

SEQ ID NO: 102894 - RNA, 20 nt, Artificial Sequence
  MKO10102894_B_Olfr1012
  gRNA
agaaggccuugagacgaccc

SEQ ID NO: 102895 - RNA, 20 nt, Artificial Sequence
  MKO10102895_B_Olfr1013
  gRNA
cauugcagauuaacauaaug

SEQ ID NO: 102896 - RNA, 20 nt, Artificial Sequence
  MKO10102896_B_Olfr1013
  gRNA
gaagaacugagcuacacaac

SEQ ID NO: 102897 - RNA, 20 nt, Artificial Sequence
  MKO10102897_B_Olfr1013
  gRNA
aaccuaucauuccuggaccu

SEQ ID NO: 102898 - RNA, 20 nt, Artificial Sequence
  MKO10102898_B_Olfr1014
  gRNA
aacaaacccugucaugcagc

SEQ ID NO: 102899 - RNA, 20 nt, Artificial Sequence
  MKO10102899_B_Olfr1014
  gRNA
agcagaaccagcugcaugac

SEQ ID NO: 102900 - RNA, 20 nt, Artificial Sequence
  MKO10102900_B_Olfr1014
  gRNA
gaucuuugguguauagacug

SEQ ID NO: 102901 - RNA, 20 nt, Artificial Sequence
  MKO10102901_B_Olfr1015
  gRNA
ugugcagccuggaaucgaug

SEQ ID NO: 102902 - RNA, 20 nt, Artificial Sequence
  MKO10102902_B_Olfr1015
  gRNA
ggauccucaguauagccagc

SEQ ID NO: 102903 - RNA, 20 nt, Artificial Sequence
  MKO10102903_B_Olfr1015
  gRNA
agucugcaucaacuucuuaa

SEQ ID NO: 102904 - RNA, 20 nt, Artificial Sequence
  MKO10102904_B_Olfr1016
  gRNA
cucugacccuaccacacaau

SEQ ID NO: 102905 - RNA, 20 nt, Artificial Sequence
  MKO10102905_B_Olfr1016
  gRNA
cuacagugaguguuaccugc

SEQ ID NO: 102906 - RNA, 20 nt, Artificial Sequence
  MKO10102906_B_Olfr1016
  gRNA
agcaauggguaucauuacau

SEQ ID NO: 102907 - RNA, 20 nt, Artificial Sequence
  MKO10102907_B_Olfr1018
  gRNA
gguccauaauaacaguguag

SEQ ID NO: 102908 - RNA, 20 nt, Artificial Sequence
  MKO10102908_B_Olfr1018
  gRNA
ucuccacuacacuguuauua

SEQ ID NO: 102909 - RNA, 20 nt, Artificial Sequence
  MKO10102909_B_Olfr1018
  gRNA
aaugaccuucccaccagccc

SEQ ID NO: 102910 - RNA, 20 nt, Artificial Sequence
  MKO10102910_B_Olfr1019
  gRNA
augcugggcucuuacuucgc

SEQ ID NO: 102911 - RNA, 20 nt, Artificial Sequence
  MKO10102911_B_Olfr1019
  gRNA
accaguaagaugagacccgc

SEQ ID NO: 102912 - RNA, 20 nt, Artificial Sequence
  MKO10102912_B_Olfr1019
  gRNA
caauagcugaugaguagccc

SEQ ID NO: 102913 - RNA, 20 nt, Artificial Sequence
  MKO10102913_B_Olfr101
  gRNA
gaccaugcugcugccaguga

SEQ ID NO: 102914 - RNA, 20 nt, Artificial Sequence
  MKO10102914_B_Olfr101
  gRNA
ugucauuacagagugaagca

SEQ ID NO: 102915 - RNA, 20 nt, Artificial Sequence
  MKO10102915_B_Olfr101
  gRNA
caucgccaucauguacagug

SEQ ID NO: 102916 - RNA, 20 nt, Artificial Sequence
  MKO10102916_B_Olfr1020
  gRNA
acaacugaugacauugaaac

SEQ ID NO: 102917 - RNA, 20 nt, Artificial Sequence
  MKO10102917_B_Olfr1020
  gRNA
caagaugcuagugaaccuca

SEQ ID NO: 102918 - RNA, 20 nt, Artificial Sequence
  MKO10102918_B_Olfr1020
  gRNA
cuguuccauagaguagcuag

SEQ ID NO: 102919 - RNA, 20 nt, Artificial Sequence
  MKO10102919_B_Olfr1022
  gRNA
gagcaagcuagcaugauaag

SEQ ID NO: 102920 - RNA, 20 nt, Artificial Sequence
  MKO10102920_B_Olfr1022
  gRNA
ugaucagcacaaucauacac

SEQ ID NO: 102921 - RNA, 20 nt, Artificial Sequence
  MKO10102921_B_Olfr1022
  gRNA
ugacacucacguuaaaaaga

SEQ ID NO: 102922 - RNA, 20 nt, Artificial Sequence
  MKO10102922_B_Olfr1023
  gRNA
ugucaucaaugccaugaaac

SEQ ID NO: 102923 - RNA, 20 nt, Artificial Sequence
  MKO10102923_B_Olfr1023
  gRNA
cuuaaaccauacugcaauga

SEQ ID NO: 102924 - RNA, 20 nt, Artificial Sequence
  MKO10102924_B_Olfr1023
  gRNA
auauggugacuguugucaug

SEQ ID NO: 102925 - RNA, 20 nt, Artificial Sequence
  MKO10102925_B_Olfr1024
  gRNA
uaguauggugggcacaaugc

SEQ ID NO: 102926 - RNA, 20 nt, Artificial Sequence
  MKO10102926_B_Olfr1024
  gRNA
accauacuaccccagaagua

SEQ ID NO: 102927 - RNA, 20 nt, Artificial Sequence
  MKO10102927_B_Olfr1024
  gRNA
acugcccucuuugugucagc

SEQ ID NO: 102928 - RNA, 20 nt, Artificial Sequence
  MKO10102928_B_Olfr1026
  gRNA
uacauuuacggcuuuguaaa

SEQ ID NO: 102929 - RNA, 20 nt, Artificial Sequence
  MKO10102929_B_Olfr1026
  gRNA
gguuaaacgaagcaucagaa

SEQ ID NO: 102930 - RNA, 20 nt, Artificial Sequence
  MKO10102930_B_Olfr1026
  gRNA
cauuguucugcaugcaccug

SEQ ID NO: 102931 - RNA, 20 nt, Artificial Sequence
  MKO10102931_B_Olfr1028
  gRNA
ugauuguaagggagcuggaa

SEQ ID NO: 102932 - RNA, 20 nt, Artificial Sequence
  MKO10102932_B_Olfr1028
  gRNA
uugccugaguauugucuuca

SEQ ID NO: 102933 - RNA, 20 nt, Artificial Sequence
  MKO10102933_B_Olfr1028
  gRNA
cagcucccuuacaaucaucc

SEQ ID NO: 102934 - RNA, 20 nt, Artificial Sequence
  MKO10102934_B_Olfr1029
  gRNA
auucagcagaggacuuacaa

SEQ ID NO: 102935 - RNA, 20 nt, Artificial Sequence
  MKO10102935_B_Olfr1029
  gRNA
caacucccuuacaaucaucc

SEQ ID NO: 102936 - RNA, 20 nt, Artificial Sequence
  MKO10102936_B_Olfr1029
  gRNA
caagcccauguugccuaaga

SEQ ID NO: 102937 - RNA, 20 nt, Artificial Sequence
  MKO10102937_B_Olfr102
  gRNA
ugucauuacagagugaagua

SEQ ID NO: 102938 - RNA, 20 nt, Artificial Sequence
  MKO10102938_B_Olfr102
  gRNA
caucuuuggcagugucacag

SEQ ID NO: 102939 - RNA, 20 nt, Artificial Sequence
  MKO10102939_B_Olfr102
  gRNA
cugugauauuaagccauugu

SEQ ID NO: 102940 - RNA, 20 nt, Artificial Sequence
  MKO10102940_B_Olfr1030
  gRNA
acauaucgcuugaccuucug

SEQ ID NO: 102941 - RNA, 20 nt, Artificial Sequence
  MKO10102941_B_Olfr1030
  gRNA
ugccaccagaugagauccac

SEQ ID NO: 102942 - RNA, 20 nt, Artificial Sequence
  MKO10102942_B_Olfr1030
  gRNA
uaaacacgcagcauaugaaa

SEQ ID NO: 102943 - RNA, 20 nt, Artificial Sequence
  MKO10102943_B_Olfr1031
  gRNA
gagcuaauccucagaauagc

SEQ ID NO: 102944 - RNA, 20 nt, Artificial Sequence
  MKO10102944_B_Olfr1031
  gRNA
uccacagacucucuagaugu

SEQ ID NO: 102945 - RNA, 20 nt, Artificial Sequence
  MKO10102945_B_Olfr1031
  gRNA
augcaaugaagagguaacau

SEQ ID NO: 102946 - RNA, 20 nt, Artificial Sequence
  MKO10102946_B_Olfr1032
  gRNA
uuuacuuaguuaagcccuuu

SEQ ID NO: 102947 - RNA, 20 nt, Artificial Sequence
  MKO10102947_B_Olfr1032
  gRNA
guucaacauggggaucacgg

SEQ ID NO: 102948 - RNA, 20 nt, Artificial Sequence
  MKO10102948_B_Olfr1032
  gRNA
aagucgaaugcaaaccaccc

SEQ ID NO: 102949 - RNA, 20 nt, Artificial Sequence
  MKO10102949_B_Olfr1033
  gRNA
aaaauaugccaacugcugua

SEQ ID NO: 102950 - RNA, 20 nt, Artificial Sequence
  MKO10102950_B_Olfr1033
  gRNA
gagucgaaugcaaaccaccc

SEQ ID NO: 102951 - RNA, 20 nt, Artificial Sequence
  MKO10102951_B_Olfr1033
  gRNA
uacauugggcuacugagcug

SEQ ID NO: 102952 - RNA, 20 nt, Artificial Sequence
  MKO10102952_B_Olfr1034
  gRNA
agucuacaagauaguugcca

SEQ ID NO: 102953 - RNA, 20 nt, Artificial Sequence
  MKO10102953_B_Olfr1034
  gRNA
cauguaucugagaagaccaa

SEQ ID NO: 102954 - RNA, 20 nt, Artificial Sequence
  MKO10102954_B_Olfr1034
  gRNA
acacuacaaaaaagagaacc

SEQ ID NO: 102955 - RNA, 20 nt, Artificial Sequence
  MKO10102955_B_Olfr1036
  gRNA
cuucacauauuccuugucag

SEQ ID NO: 102956 - RNA, 20 nt, Artificial Sequence
  MKO10102956_B_Olfr1036
  gRNA
acaccacaaaaaagagaacc

SEQ ID NO: 102957 - RNA, 20 nt, Artificial Sequence
  MKO10102957_B_Olfr1036
  gRNA
ucaaaaacuauuucuuaugu

SEQ ID NO: 102958 - RNA, 20 nt, Artificial Sequence
  MKO10102958_B_Olfr1037
  gRNA
gaucuauagcuuaagaaauc

SEQ ID NO: 102959 - RNA, 20 nt, Artificial Sequence
  MKO10102959_B_Olfr1037
  gRNA
uacgccugugcaacccaacu

SEQ ID NO: 102960 - RNA, 20 nt, Artificial Sequence
  MKO10102960_B_Olfr1037
  gRNA
augaccaccauauacagaag

SEQ ID NO: 102961 - RNA, 20 nt, Artificial Sequence
  MKO10102961_B_Olfr1038-ps
  gRNA
uuauguugauuuauuuaagu

SEQ ID NO: 102962 - RNA, 20 nt, Artificial Sequence
  MKO10102962_B_Olfr1038-ps
  gRNA
uuggguugauugucauaauc

SEQ ID NO: 102963 - RNA, 20 nt, Artificial Sequence
  MKO10102963_B_Olfr1038-ps
  gRNA
aucauuuauuauguaugagc

SEQ ID NO: 102964 - RNA, 20 nt, Artificial Sequence
  MKO10102964_B_Olfr1039
  gRNA
caugaggaccacauagagga

SEQ ID NO: 102965 - RNA, 20 nt, Artificial Sequence
  MKO10102965_B_Olfr1039
  gRNA
aaugauuguuccauaaaaua

SEQ ID NO: 102966 - RNA, 20 nt, Artificial Sequence
  MKO10102966_B_Olfr1039
  gRNA
gaugaaacagcaaaccugag

SEQ ID NO: 102967 - RNA, 20 nt, Artificial Sequence
  MKO10102967_B_Olfr103
  gRNA
guaugucucucacucccaaa

SEQ ID NO: 102968 - RNA, 20 nt, Artificial Sequence
  MKO10102968_B_Olfr103
  gRNA
aagugaggagugcauugaau

SEQ ID NO: 102969 - RNA, 20 nt, Artificial Sequence
  MKO10102969_B_Olfr103
  gRNA
augccaucacugcuagcagc

SEQ ID NO: 102970 - RNA, 20 nt, Artificial Sequence
  MKO10102970_B_Olfr1040
  gRNA
accuuccacuucucauucug

SEQ ID NO: 102971 - RNA, 20 nt, Artificial Sequence
  MKO10102971_B_Olfr1040
  gRNA
auugcuagcacauacauuua

SEQ ID NO: 102972 - RNA, 20 nt, Artificial Sequence
  MKO10102972_B_Olfr1040
  gRNA
agaaaguuuauaauugugcu

SEQ ID NO: 102973 - RNA, 20 nt, Artificial Sequence
  MKO10102973_B_Olfr1042
  gRNA
uucugucacuccaaacacuc

SEQ ID NO: 102974 - RNA, 20 nt, Artificial Sequence
  MKO10102974_B_Olfr1042
  gRNA
caugcggaccgcauagagga

SEQ ID NO: 102975 - RNA, 20 nt, Artificial Sequence
  MKO10102975_B_Olfr1042
  gRNA
agaaaauucaccagaguguu

SEQ ID NO: 102976 - RNA, 20 nt, Artificial Sequence
  MKO10102976_B_Olfr1043
  gRNA
guauuaacacaaccaacccu

SEQ ID NO: 102977 - RNA, 20 nt, Artificial Sequence
  MKO10102977_B_Olfr1043
  gRNA
ucuaugucauucucaugccg

SEQ ID NO: 102978 - RNA, 20 nt, Artificial Sequence
  MKO10102978_B_Olfr1043
  gRNA
aucugaaugcagagucuccg

SEQ ID NO: 102979 - RNA, 20 nt, Artificial Sequence
  MKO10102979_B_Olfr1044
  gRNA
gugaugauaugccucuccuc

SEQ ID NO: 102980 - RNA, 20 nt, Artificial Sequence
  MKO10102980_B_Olfr1044
  gRNA
uuguaacccucuacucuaua

SEQ ID NO: 102981 - RNA, 20 nt, Artificial Sequence
  MKO10102981_B_Olfr1044
  gRNA
aaauggucacugcuagcaua

SEQ ID NO: 102982 - RNA, 20 nt, Artificial Sequence
  MKO10102982_B_Olfr1045
  gRNA
cugucagaagguagauaacu

SEQ ID NO: 102983 - RNA, 20 nt, Artificial Sequence
  MKO10102983_B_Olfr1045
  gRNA
agauaccaacacuauacuca

SEQ ID NO: 102984 - RNA, 20 nt, Artificial Sequence
  MKO10102984_B_Olfr1045
  gRNA
ucuuaucaguaucuagugag

SEQ ID NO: 102985 - RNA, 20 nt, Artificial Sequence
  MKO10102985_B_Olfr1046
  gRNA
acuguuuauccucucagcca

SEQ ID NO: 102986 - RNA, 20 nt, Artificial Sequence
  MKO10102986_B_Olfr1046
  gRNA
ucuucucuaugugaucauca

SEQ ID NO: 102987 - RNA, 20 nt, Artificial Sequence
  MKO10102987_B_Olfr1046
  gRNA
aggaaaaguacguugggggc

SEQ ID NO: 102988 - RNA, 20 nt, Artificial Sequence
  MKO10102988_B_Olfr1047
  gRNA
uuaugucacaaaaguuaugu

SEQ ID NO: 102989 - RNA, 20 nt, Artificial Sequence
  MKO10102989_B_Olfr1047
  gRNA
agcagaguucauccucacaa

SEQ ID NO: 102990 - RNA, 20 nt, Artificial Sequence
  MKO10102990_B_Olfr1047
  gRNA
aucuaucuaauuucacugau

SEQ ID NO: 102991 - RNA, 20 nt, Artificial Sequence
  MKO10102991_B_Olfr1048
  gRNA
uacuaguuaucaucacagcu

SEQ ID NO: 102992 - RNA, 20 nt, Artificial Sequence
  MKO10102992_B_Olfr1048
  gRNA
gugaaggcgagaguccaacu

SEQ ID NO: 102993 - RNA, 20 nt, Artificial Sequence
  MKO10102993_B_Olfr1048
  gRNA
caugcucauguugccuauca

SEQ ID NO: 102994 - RNA, 20 nt, Artificial Sequence
  MKO10102994_B_Olfr1049
  gRNA
uuaugcuugugccacacaaa

SEQ ID NO: 102995 - RNA, 20 nt, Artificial Sequence
  MKO10102995_B_Olfr1049
  gRNA
aaugaagcaugccauuugug

SEQ ID NO: 102996 - RNA, 20 nt, Artificial Sequence
  MKO10102996_B_Olfr1049
  gRNA
gugaggaagacugcaaacag

SEQ ID NO: 102997 - RNA, 20 nt, Artificial Sequence
  MKO10102997_B_Olfr1051
  gRNA
gcaaggaagacugcaaacag

SEQ ID NO: 102998 - RNA, 20 nt, Artificial Sequence
  MKO10102998_B_Olfr1051
  gRNA
aaugaagcaugccaucugug

SEQ ID NO: 102999 - RNA, 20 nt, Artificial Sequence
  MKO10102999_B_Olfr1051
  gRNA
uuaugcuugugccacacaga

SEQ ID NO: 103000 - RNA, 20 nt, Artificial Sequence
  MKO10103000_B_Olfr1052
  gRNA
caugagaguaucagcagcga

SEQ ID NO: 103001 - RNA, 20 nt, Artificial Sequence
  MKO10103001_B_Olfr1052
  gRNA
ugcaaugacugaugaauaac

SEQ ID NO: 103002 - RNA, 20 nt, Artificial Sequence
  MKO10103002_B_Olfr1052
  gRNA
acucugguauuaacaugaga

SEQ ID NO: 103003 - RNA, 20 nt, Artificial Sequence
  MKO10103003_B_Olfr1053
  gRNA
uagucaaaaugaucauaccc

SEQ ID NO: 103004 - RNA, 20 nt, Artificial Sequence
  MKO10103004_B_Olfr1053
  gRNA
agguuaaaaaugccuucuac

SEQ ID NO: 103005 - RNA, 20 nt, Artificial Sequence
  MKO10103005_B_Olfr1053
  gRNA
auucagugauaauaaacaua

SEQ ID NO: 103006 - RNA, 20 nt, Artificial Sequence
  MKO10103006_B_Olfr1054
  gRNA
acgauccuguaaucacaaaa

SEQ ID NO: 103007 - RNA, 20 nt, Artificial Sequence
  MKO10103007_B_Olfr1054
  gRNA
gucaaaugagugacuugauu

SEQ ID NO: 103008 - RNA, 20 nt, Artificial Sequence
  MKO10103008_B_Olfr1054
  gRNA
ucacucauuugacacugaua

SEQ ID NO: 103009 - RNA, 20 nt, Artificial Sequence
  MKO10103009_B_Olfr1055
  gRNA
cugaaguauuucauucuaac

SEQ ID NO: 103010 - RNA, 20 nt, Artificial Sequence
  MKO10103010_B_Olfr1055
  gRNA
caccaaauauaggaaauugu

SEQ ID NO: 103011 - RNA, 20 nt, Artificial Sequence
  MKO10103011_B_Olfr1055
  gRNA
gagcauaacaucaauaucaa

SEQ ID NO: 103012 - RNA, 20 nt, Artificial Sequence
  MKO10103012_B_Olfr1056
  gRNA
ugcacaccaauuauagggga

SEQ ID NO: 103013 - RNA, 20 nt, Artificial Sequence
  MKO10103013_B_Olfr1056
  gRNA
caugauuguccuuaccaagu

SEQ ID NO: 103014 - RNA, 20 nt, Artificial Sequence
  MKO10103014_B_Olfr1056
  gRNA
cacagaucgcccugaacuac

SEQ ID NO: 103015 - RNA, 20 nt, Artificial Sequence
  MKO10103015_B_Olfr1057
  gRNA
cguggcacauucguaguaua

SEQ ID NO: 103016 - RNA, 20 nt, Artificial Sequence
  MKO10103016_B_Olfr1057
  gRNA
guucaacauuggaauuauua

SEQ ID NO: 103017 - RNA, 20 nt, Artificial Sequence
  MKO10103017_B_Olfr1057
  gRNA
aucugaccguccagaacugc

SEQ ID NO: 103018 - RNA, 20 nt, Artificial Sequence
  MKO10103018_B_Olfr1058
  gRNA
aauaauggaggcugcaguuc

SEQ ID NO: 103019 - RNA, 20 nt, Artificial Sequence
  MKO10103019_B_Olfr1058
  gRNA
ggagaaccauaaccucacaa

SEQ ID NO: 103020 - RNA, 20 nt, Artificial Sequence
  MKO10103020_B_Olfr1058
  gRNA
ucauucucauagcuauuauc

SEQ ID NO: 103021 - RNA, 20 nt, Artificial Sequence
  MKO10103021_B_Olfr1061
  gRNA
cacuaaccaccaugaguuuc

SEQ ID NO: 103022 - RNA, 20 nt, Artificial Sequence
  MKO10103022_B_Olfr1061
  gRNA
ucaugucacaaaaagcaugu

SEQ ID NO: 103023 - RNA, 20 nt, Artificial Sequence
  MKO10103023_B_Olfr1061
  gRNA
gcuauccaaucaucuuucuu

SEQ ID NO: 103024 - RNA, 20 nt, Artificial Sequence
  MKO10103024_B_Olfr1062
  gRNA
cagaaauccucccagcugcg

SEQ ID NO: 103025 - RNA, 20 nt, Artificial Sequence
  MKO10103025_B_Olfr1062
  gRNA
aacugaccguccagaacugc

SEQ ID NO: 103026 - RNA, 20 nt, Artificial Sequence
  MKO10103026_B_Olfr1062
  gRNA
agcgaucuugucagugucua

SEQ ID NO: 103027 - RNA, 20 nt, Artificial Sequence
  MKO10103027_B_Olfr1065
  gRNA
ucauccuuauagcuauacuu

SEQ ID NO: 103028 - RNA, 20 nt, Artificial Sequence
  MKO10103028_B_Olfr1065
  gRNA
cuguguagcacaaagguuaa

SEQ ID NO: 103029 - RNA, 20 nt, Artificial Sequence
  MKO10103029_B_Olfr1065
  gRNA
gccuggaguccaccauugua

SEQ ID NO: 103030 - RNA, 20 nt, Artificial Sequence
  MKO10103030_B_Olfr1066
  gRNA
gacaauuauacuauagagau

SEQ ID NO: 103031 - RNA, 20 nt, Artificial Sequence
  MKO10103031_B_Olfr1066
  gRNA
guccuaucuacuuauccuua

SEQ ID NO: 103032 - RNA, 20 nt, Artificial Sequence
  MKO10103032_B_Olfr1066
  gRNA
ucgucucuucuuauaguaau

SEQ ID NO: 103033 - RNA, 20 nt, Artificial Sequence
  MKO10103033_B_Olfr1076
  gRNA
cacugaccgcccugaacugc

SEQ ID NO: 103034 - RNA, 20 nt, Artificial Sequence
  MKO10103034_B_Olfr1076
  gRNA
uaacuugauuucuucaccag

SEQ ID NO: 103035 - RNA, 20 nt, Artificial Sequence
  MKO10103035_B_Olfr1076
  gRNA
ucacaccuuaaacacugaca

SEQ ID NO: 103036 - RNA, 20 nt, Artificial Sequence
  MKO10103036_B_Olfr1079
  gRNA
ucaugucacaaacuguaugu

SEQ ID NO: 103037 - RNA, 20 nt, Artificial Sequence
  MKO10103037_B_Olfr1079
  gRNA
uugcagccuugauuccacua

SEQ ID NO: 103038 - RNA, 20 nt, Artificial Sequence
  MKO10103038_B_Olfr1079
  gRNA
auuuaacauagggauaacua

SEQ ID NO: 103039 - RNA, 20 nt, Artificial Sequence
  MKO10103039_B_Olfr107
  gRNA
augaacuguaguaagacucc

SEQ ID NO: 103040 - RNA, 20 nt, Artificial Sequence
  MKO10103040_B_Olfr107
  gRNA
guucagagugggaguaacca

SEQ ID NO: 103041 - RNA, 20 nt, Artificial Sequence
  MKO10103041_B_Olfr107
  gRNA
aagaggggcugccauuucuc

SEQ ID NO: 103042 - RNA, 20 nt, Artificial Sequence
  MKO10103042_B_Olfr1080
  gRNA
ucaugucccauaaaguaugu

SEQ ID NO: 103043 - RNA, 20 nt, Artificial Sequence
  MKO10103043_B_Olfr1080
  gRNA
cgccaauguauuucuuucuc

SEQ ID NO: 103044 - RNA, 20 nt, Artificial Sequence
  MKO10103044_B_Olfr1080
  gRNA
ugccugagaaagaaauacau

SEQ ID NO: 103045 - RNA, 20 nt, Artificial Sequence
  MKO10103045_B_Olfr1082
  gRNA
cauaaauguauaguaaagau

SEQ ID NO: 103046 - RNA, 20 nt, Artificial Sequence
  MKO10103046_B_Olfr1082
  gRNA
ucaugucacauaaaguaugu

SEQ ID NO: 103047 - RNA, 20 nt, Artificial Sequence
  MKO10103047_B_Olfr1082
  gRNA
cgccaauguauuucuuucuu

SEQ ID NO: 103048 - RNA, 20 nt, Artificial Sequence
  MKO10103048_B_Olfr1084
  gRNA
ucgugucucauaaaguaugu

SEQ ID NO: 103049 - RNA, 20 nt, Artificial Sequence
  MKO10103049_B_Olfr1084
  gRNA
agucaucuaccugaccucag

SEQ ID NO: 103050 - RNA, 20 nt, Artificial Sequence
  MKO10103050_B_Olfr1084
  gRNA
ugagcaaagcaaugauauua

SEQ ID NO: 103051 - RNA, 20 nt, Artificial Sequence
  MKO10103051_B_Olfr1085
  gRNA
augaagagcagcccaaagag

SEQ ID NO: 103052 - RNA, 20 nt, Artificial Sequence
  MKO10103052_B_Olfr1085
  gRNA
gaauaaacagauaagacaga

SEQ ID NO: 103053 - RNA, 20 nt, Artificial Sequence
  MKO10103053_B_Olfr1085
  gRNA
cacugaccguccugagcugc

SEQ ID NO: 103054 - RNA, 20 nt, Artificial Sequence
  MKO10103054_B_Olfr1086
  gRNA
aaauuuaggacugauuacuc

SEQ ID NO: 103055 - RNA, 20 nt, Artificial Sequence
  MKO10103055_B_Olfr1086
  gRNA
uugaagacacgcucuacuga

SEQ ID NO: 103056 - RNA, 20 nt, Artificial Sequence
  MKO10103056_B_Olfr1086
  gRNA
accaagugacagcuaugccu

SEQ ID NO: 103057 - RNA, 20 nt, Artificial Sequence
  MKO10103057_B_Olfr1087
  gRNA
uugagcucaaguagaugacu

SEQ ID NO: 103058 - RNA, 20 nt, Artificial Sequence
  MKO10103058_B_Olfr1087
  gRNA
aucuacuugagcucaauguu

SEQ ID NO: 103059 - RNA, 20 nt, Artificial Sequence
  MKO10103059_B_Olfr1087
  gRNA
auccgugucaaaagagugac

SEQ ID NO: 103060 - RNA, 20 nt, Artificial Sequence
  MKO10103060_B_Olfr1089
  gRNA
aacaauggacccuucagcuc

SEQ ID NO: 103061 - RNA, 20 nt, Artificial Sequence
  MKO10103061_B_Olfr1089
  gRNA
acugucgucaccgucuucua

SEQ ID NO: 103062 - RNA, 20 nt, Artificial Sequence
  MKO10103062_B_Olfr1089
  gRNA
caucuaucugaucucauuaa

SEQ ID NO: 103063 - RNA, 20 nt, Artificial Sequence
  MKO10103063_B_Olfr108
  gRNA
caccacagcuccuaaaacac

SEQ ID NO: 103064 - RNA, 20 nt, Artificial Sequence
  MKO10103064_B_Olfr108
  gRNA
agauauggauaaccugcuuc

SEQ ID NO: 103065 - RNA, 20 nt, Artificial Sequence
  MKO10103065_B_Olfr108
  gRNA
acuagaaccucacaucuaca

SEQ ID NO: 103066 - RNA, 20 nt, Artificial Sequence
  MKO10103066_B_Olfr1090
  gRNA
gcaaggaacagcccaaauaa

SEQ ID NO: 103067 - RNA, 20 nt, Artificial Sequence
  MKO10103067_B_Olfr1090
  gRNA
aguggucacugauacccauu

SEQ ID NO: 103068 - RNA, 20 nt, Artificial Sequence
  MKO10103068_B_Olfr1090
  gRNA
auguaaaauuugcccuacau

SEQ ID NO: 103069 - RNA, 20 nt, Artificial Sequence
  MKO10103069_B_Olfr1093
  gRNA
acuggagucucuauuuacca

SEQ ID NO: 103070 - RNA, 20 nt, Artificial Sequence
  MKO10103070_B_Olfr1093
  gRNA
caacccacuucuguauacag

SEQ ID NO: 103071 - RNA, 20 nt, Artificial Sequence
  MKO10103071_B_Olfr1093
  gRNA
ugagcuucuagucuuguacu

SEQ ID NO: 103072 - RNA, 20 nt, Artificial Sequence
  MKO10103072_B_Olfr1094
  gRNA
gaauaacaagcuauaaugag

SEQ ID NO: 103073 - RNA, 20 nt, Artificial Sequence
  MKO10103073_B_Olfr1094
  gRNA
agugacaacgguggaauaac

SEQ ID NO: 103074 - RNA, 20 nt, Artificial Sequence
  MKO10103074_B_Olfr1094
  gRNA
accuaguuccaacuaugccu

SEQ ID NO: 103075 - RNA, 20 nt, Artificial Sequence
  MKO10103075_B_Olfr1095
  gRNA
augcucacugcauacaguag

SEQ ID NO: 103076 - RNA, 20 nt, Artificial Sequence
  MKO10103076_B_Olfr1095
  gRNA
cauuuccuauuagaguaaaa

SEQ ID NO: 103077 - RNA, 20 nt, Artificial Sequence
  MKO10103077_B_Olfr1095
  gRNA
cuacaaaagacaaugcacug

SEQ ID NO: 103078 - RNA, 20 nt, Artificial Sequence
  MKO10103078_B_Olfr1097
  gRNA
agucccacaagcgugaacuc

SEQ ID NO: 103079 - RNA, 20 nt, Artificial Sequence
  MKO10103079_B_Olfr1097
  gRNA
augagaguauaugagcgccu

SEQ ID NO: 103080 - RNA, 20 nt, Artificial Sequence
  MKO10103080_B_Olfr1097
  gRNA
ugauuacaguugaguaacug

SEQ ID NO: 103081 - RNA, 20 nt, Artificial Sequence
  MKO10103081_B_Olfr1098
  gRNA
acauucagaaccugcuaaga

SEQ ID NO: 103082 - RNA, 20 nt, Artificial Sequence
  MKO10103082_B_Olfr1098
  gRNA
ugaaccugaguucaugcuug

SEQ ID NO: 103083 - RNA, 20 nt, Artificial Sequence
  MKO10103083_B_Olfr1098
  gRNA
aaagaagugaugaauuaccg

SEQ ID NO: 103084 - RNA, 20 nt, Artificial Sequence
  MKO10103084_B_Olfr1099
  gRNA
gaucauaguaccauaaaaua

SEQ ID NO: 103085 - RNA, 20 nt, Artificial Sequence
  MKO10103085_B_Olfr1099
  gRNA
agauuccaaggagguucagc

SEQ ID NO: 103086 - RNA, 20 nt, Artificial Sequence
  MKO10103086_B_Olfr1099
  gRNA
aguggaacugaucuucaaaa

SEQ ID NO: 103087 - RNA, 20 nt, Artificial Sequence
  MKO10103087_B_Olfr109
  gRNA
augauagcaguguagcgaag

SEQ ID NO: 103088 - RNA, 20 nt, Artificial Sequence
  MKO10103088_B_Olfr109
  gRNA
aaguacggaggccaucuugc

SEQ ID NO: 103089 - RNA, 20 nt, Artificial Sequence
  MKO10103089_B_Olfr109
  gRNA
ccuggauauuuguuacucau

SEQ ID NO: 103090 - RNA, 20 nt, Artificial Sequence
  MKO10103090_B_Olfr10
  gRNA
cuaggaagagcuacagucac

SEQ ID NO: 103091 - RNA, 20 nt, Artificial Sequence
  MKO10103091_B_Olfr10
  gRNA
ugucuucacagaccaacuug

SEQ ID NO: 103092 - RNA, 20 nt, Artificial Sequence
  MKO10103092_B_Olfr10
  gRNA
uguguagucgaaggucuguu

SEQ ID NO: 103093 - RNA, 20 nt, Artificial Sequence
  MKO10103093_B_Olfr1100
  gRNA
gauaagagacaccacuagag

SEQ ID NO: 103094 - RNA, 20 nt, Artificial Sequence
  MKO10103094_B_Olfr1100
  gRNA
caguugaguaacugagaucg

SEQ ID NO: 103095 - RNA, 20 nt, Artificial Sequence
  MKO10103095_B_Olfr1100
  gRNA
caugauaacuggguauugua

SEQ ID NO: 103096 - RNA, 20 nt, Artificial Sequence
  MKO10103096_B_Olfr1101
  gRNA
cugugauauucccccuuuac

SEQ ID NO: 103097 - RNA, 20 nt, Artificial Sequence
  MKO10103097_B_Olfr1101
  gRNA
gcaucuucaagauagcaaac

SEQ ID NO: 103098 - RNA, 20 nt, Artificial Sequence
  MKO10103098_B_Olfr1101
  gRNA
acaaaacgacaagcuagcag

SEQ ID NO: 103099 - RNA, 20 nt, Artificial Sequence
  MKO10103099_B_Olfr1102
  gRNA
aaucacugucuuuauacuac

SEQ ID NO: 103100 - RNA, 20 nt, Artificial Sequence
  MKO10103100_B_Olfr1102
  gRNA
ggacaaauccauaagagacc

SEQ ID NO: 103101 - RNA, 20 nt, Artificial Sequence
  MKO10103101_B_Olfr1102
  gRNA
cucuuauggauuuguccugu

SEQ ID NO: 103102 - RNA, 20 nt, Artificial Sequence
  MKO10103102_B_Olfr1104
  gRNA
uuggugaucuuuguucuagc

SEQ ID NO: 103103 - RNA, 20 nt, Artificial Sequence
  MKO10103103_B_Olfr1104
  gRNA
aacagacugacuuguaauuc

SEQ ID NO: 103104 - RNA, 20 nt, Artificial Sequence
  MKO10103104_B_Olfr1104
  gRNA
ccagccaguugcacaccuuc

SEQ ID NO: 103105 - RNA, 20 nt, Artificial Sequence
  MKO10103105_B_Olfr1105
  gRNA
aaccagcucaagcuuuccac

SEQ ID NO: 103106 - RNA, 20 nt, Artificial Sequence
  MKO10103106_B_Olfr1105
  gRNA
uaaagccuuauaacuucccc

SEQ ID NO: 103107 - RNA, 20 nt, Artificial Sequence
  MKO10103107_B_Olfr1105
  gRNA
ccaacucacuuacccacuug

SEQ ID NO: 103108 - RNA, 20 nt, Artificial Sequence
  MKO10103108_B_Olfr1106
  gRNA
ugcaucacuacuuaccacag

SEQ ID NO: 103109 - RNA, 20 nt, Artificial Sequence
  MKO10103109_B_Olfr1106
  gRNA
gguaucuguauucuauacac

SEQ ID NO: 103110 - RNA, 20 nt, Artificial Sequence
  MKO10103110_B_Olfr1106
  gRNA
aaacccacuaacuuacacag

SEQ ID NO: 103111 - RNA, 20 nt, Artificial Sequence
  MKO10103111_B_Olfr1107
  gRNA
aguguaucucaucauacuug

SEQ ID NO: 103112 - RNA, 20 nt, Artificial Sequence
  MKO10103112_B_Olfr1107
  gRNA
cucccuaccaaugaacuucu

SEQ ID NO: 103113 - RNA, 20 nt, Artificial Sequence
  MKO10103113_B_Olfr1107
  gRNA
guaaaccuauugugugaguc

SEQ ID NO: 103114 - RNA, 20 nt, Artificial Sequence
  MKO10103114_B_Olfr1109
  gRNA
uacgccuccccucaguugag

SEQ ID NO: 103115 - RNA, 20 nt, Artificial Sequence
  MKO10103115_B_Olfr1109
  gRNA
gaagaagugauucacaacgu

SEQ ID NO: 103116 - RNA, 20 nt, Artificial Sequence
  MKO10103116_B_Olfr1109
  gRNA
guagacuuauugugugaguc

SEQ ID NO: 103117 - RNA, 20 nt, Artificial Sequence
  MKO10103117_B_Olfr110
  gRNA
uuccuuagcguauaaauuac

SEQ ID NO: 103118 - RNA, 20 nt, Artificial Sequence
  MKO10103118_B_Olfr110
  gRNA
gaucugauuguuaccacaaa

SEQ ID NO: 103119 - RNA, 20 nt, Artificial Sequence
  MKO10103119_B_Olfr110
  gRNA
gaaaggaugacgcacaggaa

SEQ ID NO: 103120 - RNA, 20 nt, Artificial Sequence
  MKO10103120_B_Olfr1110
  gRNA
cuacugaaaacauggcaauu

SEQ ID NO: 103121 - RNA, 20 nt, Artificial Sequence
  MKO10103121_B_Olfr1110
  gRNA
ugucacagcugucaaaugug

SEQ ID NO: 103122 - RNA, 20 nt, Artificial Sequence
  MKO10103122_B_Olfr1110
  gRNA
aauuccaugauucauacaau

SEQ ID NO: 103123 - RNA, 20 nt, Artificial Sequence
  MKO10103123_B_Olfr1111
  gRNA
ccgauaaauauaaacucugu

SEQ ID NO: 103124 - RNA, 20 nt, Artificial Sequence
  MKO10103124_B_Olfr1111
  gRNA
cauaguuuacaccuuaacuu

SEQ ID NO: 103125 - RNA, 20 nt, Artificial Sequence
  MKO10103125_B_Olfr1111
  gRNA
aauccagaccagcacuuuca

SEQ ID NO: 103126 - RNA, 20 nt, Artificial Sequence
  MKO10103126_B_Olfr1112
  gRNA
auuugucuacuccugcugag

SEQ ID NO: 103127 - RNA, 20 nt, Artificial Sequence
  MKO10103127_B_Olfr1112
  gRNA
agacuauuguucauaaugag

SEQ ID NO: 103128 - RNA, 20 nt, Artificial Sequence
  MKO10103128_B_Olfr1112
  gRNA
caauagucucuguauacaac

SEQ ID NO: 103129 - RNA, 20 nt, Artificial Sequence
  MKO10103129_B_Olfr1113
  gRNA
cccaggaaccaacuacuaac

SEQ ID NO: 103130 - RNA, 20 nt, Artificial Sequence
  MKO10103130_B_Olfr1113
  gRNA
caucuacaugauuauccuuc

SEQ ID NO: 103131 - RNA, 20 nt, Artificial Sequence
  MKO10103131_B_Olfr1113
  gRNA
cauaccuccacuacucaagu

SEQ ID NO: 103132 - RNA, 20 nt, Artificial Sequence
  MKO10103132_B_Olfr1115
  gRNA
cccaggaaccaaccacuaac

SEQ ID NO: 103133 - RNA, 20 nt, Artificial Sequence
  MKO10103133_B_Olfr1115
  gRNA
caugccuccacuacucagau

SEQ ID NO: 103134 - RNA, 20 nt, Artificial Sequence
  MKO10103134_B_Olfr1115
  gRNA
caucuacaugucuauccuuc

SEQ ID NO: 103135 - RNA, 20 nt, Artificial Sequence
  MKO10103135_B_Olfr1116-ps
  gRNA
augaaacuaucuucagccaa

SEQ ID NO: 103136 - RNA, 20 nt, Artificial Sequence
  MKO10103136_B_Olfr1116-ps
  gRNA
cugauggaauucauucuucu

SEQ ID NO: 103137 - RNA, 20 nt, Artificial Sequence
  MKO10103137_B_Olfr1116-ps
  gRNA
auaguuguaaucuuguucua

SEQ ID NO: 103138 - RNA, 20 nt, Artificial Sequence
  MKO10103138_B_Olfr1118
  gRNA
auaaguagagaauauuguag

SEQ ID NO: 103139 - RNA, 20 nt, Artificial Sequence
  MKO10103139_B_Olfr1118
  gRNA
ugcaguguauguuguugcag

SEQ ID NO: 103140 - RNA, 20 nt, Artificial Sequence
  MKO10103140_B_Olfr1118
  gRNA
uacauaggaguauggagagc

SEQ ID NO: 103141 - RNA, 20 nt, Artificial Sequence
  MKO10103141_B_Olfr111
  gRNA
gaucugauuguuaccacaga

SEQ ID NO: 103142 - RNA, 20 nt, Artificial Sequence
  MKO10103142_B_Olfr111
  gRNA
aaacccacauguccagcaug

SEQ ID NO: 103143 - RNA, 20 nt, Artificial Sequence
  MKO10103143_B_Olfr111
  gRNA
uuccucagugcauaaauuau

SEQ ID NO: 103144 - RNA, 20 nt, Artificial Sequence
  MKO10103144_B_Olfr1120
  gRNA
augcauugaaguguccccac

SEQ ID NO: 103145 - RNA, 20 nt, Artificial Sequence
  MKO10103145_B_Olfr1120
  gRNA
aucaguuccuacagaaugaa

SEQ ID NO: 103146 - RNA, 20 nt, Artificial Sequence
  MKO10103146_B_Olfr1120
  gRNA
cuccacuuguucuucacauc

SEQ ID NO: 103147 - RNA, 20 nt, Artificial Sequence
  MKO10103147_B_Olfr1121
  gRNA
caaaugcuguacagaacccu

SEQ ID NO: 103148 - RNA, 20 nt, Artificial Sequence
  MKO10103148_B_Olfr1121
  gRNA
auuaaguagguaauagaugc

SEQ ID NO: 103149 - RNA, 20 nt, Artificial Sequence
  MKO10103149_B_Olfr1121
  gRNA
gauguuaguauuaguauaaa

SEQ ID NO: 103150 - RNA, 20 nt, Artificial Sequence
  MKO10103150_B_Olfr1122
  gRNA
uaaguuuguccagucacaac

SEQ ID NO: 103151 - RNA, 20 nt, Artificial Sequence
  MKO10103151_B_Olfr1122
  gRNA
gaccuuauuguucaugacca

SEQ ID NO: 103152 - RNA, 20 nt, Artificial Sequence
  MKO10103152_B_Olfr1122
  gRNA
acaaccaaaagcauaucagu

SEQ ID NO: 103153 - RNA, 20 nt, Artificial Sequence
  MKO10103153_B_Olfr1123
  gRNA
auucuuuagucaugaaccac

SEQ ID NO: 103154 - RNA, 20 nt, Artificial Sequence
  MKO10103154_B_Olfr1123
  gRNA
cuuaguaagauacuagugug

SEQ ID NO: 103155 - RNA, 20 nt, Artificial Sequence
  MKO10103155_B_Olfr1123
  gRNA
cucacacuaguaucuuacua

SEQ ID NO: 103156 - RNA, 20 nt, Artificial Sequence
  MKO10103156_B_Olfr1124
  gRNA
cauucccccaauacuucacc

SEQ ID NO: 103157 - RNA, 20 nt, Artificial Sequence
  MKO10103157_B_Olfr1124
  gRNA
aaugugcugcauucuuaucc

SEQ ID NO: 103158 - RNA, 20 nt, Artificial Sequence
  MKO10103158_B_Olfr1124
  gRNA
cacaacuggugauuggcucc

SEQ ID NO: 103159 - RNA, 20 nt, Artificial Sequence
  MKO10103159_B_Olfr1126
  gRNA
cacaaaagaagugaucuauu

SEQ ID NO: 103160 - RNA, 20 nt, Artificial Sequence
  MKO10103160_B_Olfr1126
  gRNA
cuuaccucccauucucaagc

SEQ ID NO: 103161 - RNA, 20 nt, Artificial Sequence
  MKO10103161_B_Olfr1126
  gRNA
gaggcaaguaucaacaagaa

SEQ ID NO: 103162 - RNA, 20 nt, Artificial Sequence
  MKO10103162_B_Olfr1128
  gRNA
auccaccaagccuacugcau

SEQ ID NO: 103163 - RNA, 20 nt, Artificial Sequence
  MKO10103163_B_Olfr1128
  gRNA
guuggaauguacaggaugug

SEQ ID NO: 103164 - RNA, 20 nt, Artificial Sequence
  MKO10103164_B_Olfr1128
  gRNA
acccagcucacuuuacucca

SEQ ID NO: 103165 - RNA, 20 nt, Artificial Sequence
  MKO10103165_B_Olfr1129
  gRNA
cauaccacccuuucucaagc

SEQ ID NO: 103166 - RNA, 20 nt, Artificial Sequence
  MKO10103166_B_Olfr1129
  gRNA
auguaucagucacucuuccu

SEQ ID NO: 103167 - RNA, 20 nt, Artificial Sequence
  MKO10103167_B_Olfr1129
  gRNA
aacagaaucccuuguaaguu

SEQ ID NO: 103168 - RNA, 20 nt, Artificial Sequence
  MKO10103168_B_Olfr112
  gRNA
ucaggaacauuguacauaac

SEQ ID NO: 103169 - RNA, 20 nt, Artificial Sequence
  MKO10103169_B_Olfr112
  gRNA
agacgauaaagaauguugua

SEQ ID NO: 103170 - RNA, 20 nt, Artificial Sequence
  MKO10103170_B_Olfr112
  gRNA
guuuccuuugccuguuucac

SEQ ID NO: 103171 - RNA, 20 nt, Artificial Sequence
  MKO10103171_B_Olfr1130
  gRNA
auuuauugacgugucuccgc

SEQ ID NO: 103172 - RNA, 20 nt, Artificial Sequence
  MKO10103172_B_Olfr1130
  gRNA
guuguguuucuuccuuaugc

SEQ ID NO: 103173 - RNA, 20 nt, Artificial Sequence
  MKO10103173_B_Olfr1130
  gRNA
gugguaugucacacaagaag

SEQ ID NO: 103174 - RNA, 20 nt, Artificial Sequence
  MKO10103174_B_Olfr1131
  gRNA
aagaugcugcuagauauguu

SEQ ID NO: 103175 - RNA, 20 nt, Artificial Sequence
  MKO10103175_B_Olfr1131
  gRNA
auuuacuugaguaucuaagc

SEQ ID NO: 103176 - RNA, 20 nt, Artificial Sequence
  MKO10103176_B_Olfr1131
  gRNA
cauaaauaguaaauagugcc

SEQ ID NO: 103177 - RNA, 20 nt, Artificial Sequence
  MKO10103177_B_Olfr1132
  gRNA
aagaaggucacucucauguc

SEQ ID NO: 103178 - RNA, 20 nt, Artificial Sequence
  MKO10103178_B_Olfr1132
  gRNA
gacugcuguugcaguauucc

SEQ ID NO: 103179 - RNA, 20 nt, Artificial Sequence
  MKO10103179_B_Olfr1132
  gRNA
caccaggguguagaagagug

SEQ ID NO: 103180 - RNA, 20 nt, Artificial Sequence
  MKO10103180_B_Olfr1133
  gRNA
guggaaggucacaaaaaaag

SEQ ID NO: 103181 - RNA, 20 nt, Artificial Sequence
  MKO10103181_B_Olfr1133
  gRNA
agccaugaggugggaagcac

SEQ ID NO: 103182 - RNA, 20 nt, Artificial Sequence
  MKO10103182_B_Olfr1133
  gRNA
auccaccaagccuauugcau

SEQ ID NO: 103183 - RNA, 20 nt, Artificial Sequence
  MKO10103183_B_Olfr1134
  gRNA
aauggucauauugauuaaac

SEQ ID NO: 103184 - RNA, 20 nt, Artificial Sequence
  MKO10103184_B_Olfr1134
  gRNA
cugugacaucccacccuuac

SEQ ID NO: 103185 - RNA, 20 nt, Artificial Sequence
  MKO10103185_B_Olfr1134
  gRNA
gaagcucugcauccaacuug

SEQ ID NO: 103186 - RNA, 20 nt, Artificial Sequence
  MKO10103186_B_Olfr1135
  gRNA
caguaucuaucauuccuacu

SEQ ID NO: 103187 - RNA, 20 nt, Artificial Sequence
  MKO10103187_B_Olfr1135
  gRNA
caccaggguauaaaaaagug

SEQ ID NO: 103188 - RNA, 20 nt, Artificial Sequence
  MKO10103188_B_Olfr1135
  gRNA
uuaaaaauccgcuccacuga

SEQ ID NO: 103189 - RNA, 20 nt, Artificial Sequence
  MKO10103189_B_Olfr1136
  gRNA
uacguuugucagaagaauag

SEQ ID NO: 103190 - RNA, 20 nt, Artificial Sequence
  MKO10103190_B_Olfr1136
  gRNA
ugguuucauacauaccucau

SEQ ID NO: 103191 - RNA, 20 nt, Artificial Sequence
  MKO10103191_B_Olfr1136
  gRNA
acauaagcugaaugccaaug

SEQ ID NO: 103192 - RNA, 20 nt, Artificial Sequence
  MKO10103192_B_Olfr1137
  gRNA
cucugcuacuccaccgcagu

SEQ ID NO: 103193 - RNA, 20 nt, Artificial Sequence
  MKO10103193_B_Olfr1137
  gRNA
uuaucauggggauaaugagg

SEQ ID NO: 103194 - RNA, 20 nt, Artificial Sequence
  MKO10103194_B_Olfr1137
  gRNA
aaccaucuauaguacuuguc

SEQ ID NO: 103195 - RNA, 20 nt, Artificial Sequence
  MKO10103195_B_Olfr1138
  gRNA
acgucacuuuaucuugaucu

SEQ ID NO: 103196 - RNA, 20 nt, Artificial Sequence
  MKO10103196_B_Olfr1138
  gRNA
uguaugcaguagacaugucc

SEQ ID NO: 103197 - RNA, 20 nt, Artificial Sequence
  MKO10103197_B_Olfr1138
  gRNA
acaugucuacugcauacaaa

SEQ ID NO: 103198 - RNA, 20 nt, Artificial Sequence
  MKO10103198_B_Olfr113
  gRNA
agacgauaaaaaguguuaua

SEQ ID NO: 103199 - RNA, 20 nt, Artificial Sequence
  MKO10103199_B_Olfr113
  gRNA
gacauuugccugacacagag

SEQ ID NO: 103200 - RNA, 20 nt, Artificial Sequence
  MKO10103200_B_Olfr113
  gRNA
guugacaaucccaaugaagc

SEQ ID NO: 103201 - RNA, 20 nt, Artificial Sequence
  MKO10103201_B_Olfr1140
  gRNA
cauaaacuccagccagaagc

SEQ ID NO: 103202 - RNA, 20 nt, Artificial Sequence
  MKO10103202_B_Olfr1140
  gRNA
acaugucuacaacauacauc

SEQ ID NO: 103203 - RNA, 20 nt, Artificial Sequence
  MKO10103203_B_Olfr1140
  gRNA
ucuaaggaguaugaagaacu

SEQ ID NO: 103204 - RNA, 20 nt, Artificial Sequence
  MKO10103204_B_Olfr1141
  gRNA
aagcaucugucauuccuaca

SEQ ID NO: 103205 - RNA, 20 nt, Artificial Sequence
  MKO10103205_B_Olfr1141
  gRNA
uauggcuuuguacugaucaa

SEQ ID NO: 103206 - RNA, 20 nt, Artificial Sequence
  MKO10103206_B_Olfr1141
  gRNA
ugcaacagcagucagaugca

SEQ ID NO: 103207 - RNA, 20 nt, Artificial Sequence
  MKO10103207_B_Olfr1143
  gRNA
auacaacaaacaugucuaac

SEQ ID NO: 103208 - RNA, 20 nt, Artificial Sequence
  MKO10103208_B_Olfr1143
  gRNA
acuguccugcucagauacac

SEQ ID NO: 103209 - RNA, 20 nt, Artificial Sequence
  MKO10103209_B_Olfr1143
  gRNA
cuuuacugaauucauacuaa

SEQ ID NO: 103210 - RNA, 20 nt, Artificial Sequence
  MKO10103210_B_Olfr1145
  gRNA
aguggcauuccaauucagau

SEQ ID NO: 103211 - RNA, 20 nt, Artificial Sequence
  MKO10103211_B_Olfr1145
  gRNA
cuuuggccucaaguauguaa

SEQ ID NO: 103212 - RNA, 20 nt, Artificial Sequence
  MKO10103212_B_Olfr1145
  gRNA
agugauacaauuuguucugc

SEQ ID NO: 103213 - RNA, 20 nt, Artificial Sequence
  MKO10103213_B_Olfr1148
  gRNA
ccacaagccagcgugagaau

SEQ ID NO: 103214 - RNA, 20 nt, Artificial Sequence
  MKO10103214_B_Olfr1148
  gRNA
caaugguguagaacagagac

SEQ ID NO: 103215 - RNA, 20 nt, Artificial Sequence
  MKO10103215_B_Olfr1148
  gRNA
ggcugcauuccccuuuauau

SEQ ID NO: 103216 - RNA, 20 nt, Artificial Sequence
  MKO10103216_B_Olfr114
  gRNA
gcugacuuccugucaguaau

SEQ ID NO: 103217 - RNA, 20 nt, Artificial Sequence
  MKO10103217_B_Olfr114
  gRNA
cuuccuuacaacacucuuua

SEQ ID NO: 103218 - RNA, 20 nt, Artificial Sequence
  MKO10103218_B_Olfr114
  gRNA
gacacaugaugaucucauag

SEQ ID NO: 103219 - RNA, 20 nt, Artificial Sequence
  MKO10103219_B_Olfr1151
  gRNA
cacugugaacaugucuagca

SEQ ID NO: 103220 - RNA, 20 nt, Artificial Sequence
  MKO10103220_B_Olfr1151
  gRNA
ugcacagcacaaccaaaaaa

SEQ ID NO: 103221 - RNA, 20 nt, Artificial Sequence
  MKO10103221_B_Olfr1151
  gRNA
ggcaacuguggugagaugag

SEQ ID NO: 103222 - RNA, 20 nt, Artificial Sequence
  MKO10103222_B_Olfr1152
  gRNA
agcagguccaauaacaucuu

SEQ ID NO: 103223 - RNA, 20 nt, Artificial Sequence
  MKO10103223_B_Olfr1152
  gRNA
uguaaacuacagccagaagu

SEQ ID NO: 103224 - RNA, 20 nt, Artificial Sequence
  MKO10103224_B_Olfr1152
  gRNA
aguaauugaauugcugcucu

SEQ ID NO: 103225 - RNA, 20 nt, Artificial Sequence
  MKO10103225_B_Olfr1153
  gRNA
ucagcucaauaaacccaaau

SEQ ID NO: 103226 - RNA, 20 nt, Artificial Sequence
  MKO10103226_B_Olfr1153
  gRNA
aaauugcaacaacaguuaga

SEQ ID NO: 103227 - RNA, 20 nt, Artificial Sequence
  MKO10103227_B_Olfr1153
  gRNA
cauaucuaccgcauacauca

SEQ ID NO: 103228 - RNA, 20 nt, Artificial Sequence
  MKO10103228_B_Olfr1154
  gRNA
caaaagagucuguacucacc

SEQ ID NO: 103229 - RNA, 20 nt, Artificial Sequence
  MKO10103229_B_Olfr1154
  gRNA
auuggaaaguauuaguagua

SEQ ID NO: 103230 - RNA, 20 nt, Artificial Sequence
  MKO10103230_B_Olfr1154
  gRNA
acaguaguuacuauuuauca

SEQ ID NO: 103231 - RNA, 20 nt, Artificial Sequence
  MKO10103231_B_Olfr1155
  gRNA
cucugugcacugcuagugcu

SEQ ID NO: 103232 - RNA, 20 nt, Artificial Sequence
  MKO10103232_B_Olfr1155
  gRNA
ugaaccuuguuguagaagau

SEQ ID NO: 103233 - RNA, 20 nt, Artificial Sequence
  MKO10103233_B_Olfr1155
  gRNA
cucagauuacccagaacugc

SEQ ID NO: 103234 - RNA, 20 nt, Artificial Sequence
  MKO10103234_B_Olfr1156
  gRNA
aaauaaaaaggaucguucca

SEQ ID NO: 103235 - RNA, 20 nt, Artificial Sequence
  MKO10103235_B_Olfr1156
  gRNA
cccaaagcuccgucuuguac

SEQ ID NO: 103236 - RNA, 20 nt, Artificial Sequence
  MKO10103236_B_Olfr1156
  gRNA
augaugacaguguacaauag

SEQ ID NO: 103237 - RNA, 20 nt, Artificial Sequence
  MKO10103237_B_Olfr1157
  gRNA
ccucuacagagcgcauucuc

SEQ ID NO: 103238 - RNA, 20 nt, Artificial Sequence
  MKO10103238_B_Olfr1157
  gRNA
ccugagaaugcgcucuguag

SEQ ID NO: 103239 - RNA, 20 nt, Artificial Sequence
  MKO10103239_B_Olfr1157
  gRNA
agaauuggaccauacaugcc

SEQ ID NO: 103240 - RNA, 20 nt, Artificial Sequence
  MKO10103240_B_Olfr1158
  gRNA
gcuggcauuugaagcauucu

SEQ ID NO: 103241 - RNA, 20 nt, Artificial Sequence
  MKO10103241_B_Olfr1158
  gRNA
ggaggaacaugcaucuauga

SEQ ID NO: 103242 - RNA, 20 nt, Artificial Sequence
  MKO10103242_B_Olfr1158
  gRNA
auacuguaauuauguccaag

SEQ ID NO: 103243 - RNA, 20 nt, Artificial Sequence
  MKO10103243_B_Olfr115
  gRNA
gguuggguuuagauaugcaa

SEQ ID NO: 103244 - RNA, 20 nt, Artificial Sequence
  MKO10103244_B_Olfr115
  gRNA
aaugauuaccuuguaacaau

SEQ ID NO: 103245 - RNA, 20 nt, Artificial Sequence
  MKO10103245_B_Olfr115
  gRNA
cucugcugaaagcagguaua

SEQ ID NO: 103246 - RNA, 20 nt, Artificial Sequence
  MKO10103246_B_Olfr1160
  gRNA
uguaaaauagguucugcaga

SEQ ID NO: 103247 - RNA, 20 nt, Artificial Sequence
  MKO10103247_B_Olfr1160
  gRNA
caagagagucuguauucagu

SEQ ID NO: 103248 - RNA, 20 nt, Artificial Sequence
  MKO10103248_B_Olfr1160
  gRNA
acuggaaaguauuaguugua

SEQ ID NO: 103249 - RNA, 20 nt, Artificial Sequence
  MKO10103249_B_Olfr1161
  gRNA
cucccagcucacauucaaag

SEQ ID NO: 103250 - RNA, 20 nt, Artificial Sequence
  MKO10103250_B_Olfr1161
  gRNA
uacucaagaugcaaucaucc

SEQ ID NO: 103251 - RNA, 20 nt, Artificial Sequence
  MKO10103251_B_Olfr1161
  gRNA
gaaacucugcaucagucuag

SEQ ID NO: 103252 - RNA, 20 nt, Artificial Sequence
  MKO10103252_B_Olfr1162
  gRNA
ggagauuaucuucucccugu

SEQ ID NO: 103253 - RNA, 20 nt, Artificial Sequence
  MKO10103253_B_Olfr1162
  gRNA
gaaaaauugugauggcaguc

SEQ ID NO: 103254 - RNA, 20 nt, Artificial Sequence
  MKO10103254_B_Olfr1162
  gRNA
ucuuugugcucacuaauuuc

SEQ ID NO: 103255 - RNA, 20 nt, Artificial Sequence
  MKO10103255_B_Olfr1163
  gRNA
ugaugagcacugucaugcca

SEQ ID NO: 103256 - RNA, 20 nt, Artificial Sequence
  MKO10103256_B_Olfr1163
  gRNA
uauguacaucaucacuguag

SEQ ID NO: 103257 - RNA, 20 nt, Artificial Sequence
  MKO10103257_B_Olfr1163
  gRNA
uaccgaacuccaaaaauucu

SEQ ID NO: 103258 - RNA, 20 nt, Artificial Sequence
  MKO10103258_B_Olfr1164
  gRNA
cauguacaugguuacugugu

SEQ ID NO: 103259 - RNA, 20 nt, Artificial Sequence
  MKO10103259_B_Olfr1164
  gRNA
gcaacaagccucauuaaaca

SEQ ID NO: 103260 - RNA, 20 nt, Artificial Sequence
  MKO10103260_B_Olfr1164
  gRNA
auuugucuucuacaaucaag

SEQ ID NO: 103261 - RNA, 20 nt, Artificial Sequence
  MKO10103261_B_Olfr1166
  gRNA
caccaauguuacugaguaga

SEQ ID NO: 103262 - RNA, 20 nt, Artificial Sequence
  MKO10103262_B_Olfr1166
  gRNA
caucuacucaguaacauugg

SEQ ID NO: 103263 - RNA, 20 nt, Artificial Sequence
  MKO10103263_B_Olfr1166
  gRNA
agcauauaucuaaaaaugau

SEQ ID NO: 103264 - RNA, 20 nt, Artificial Sequence
  MKO10103264_B_Olfr1167
  gRNA
gaaaccgaccaagaugaaug

SEQ ID NO: 103265 - RNA, 20 nt, Artificial Sequence
  MKO10103265_B_Olfr1167
  gRNA
gaaagugauggcuuaugaag

SEQ ID NO: 103266 - RNA, 20 nt, Artificial Sequence
  MKO10103266_B_Olfr1167
  gRNA
uucugcuaccacauucaucu

SEQ ID NO: 103267 - RNA, 20 nt, Artificial Sequence
  MKO10103267_B_Olfr1168
  gRNA
gagcucucuuauugugaacc

SEQ ID NO: 103268 - RNA, 20 nt, Artificial Sequence
  MKO10103268_B_Olfr1168
  gRNA
ugcaaagagcucaaagcugc

SEQ ID NO: 103269 - RNA, 20 nt, Artificial Sequence
  MKO10103269_B_Olfr1168
  gRNA
ccaaagugaucaaugaugcc

SEQ ID NO: 103270 - RNA, 20 nt, Artificial Sequence
  MKO10103270_B_Olfr116
  gRNA
gaggagaaauccgcucauug

SEQ ID NO: 103271 - RNA, 20 nt, Artificial Sequence
  MKO10103271_B_Olfr116
  gRNA
gguuaguuucaugacugcag

SEQ ID NO: 103272 - RNA, 20 nt, Artificial Sequence
  MKO10103272_B_Olfr116
  gRNA
aaugaucaccuuguaguaau

SEQ ID NO: 103273 - RNA, 20 nt, Artificial Sequence
  MKO10103273_B_Olfr1170
  gRNA
caugacuguguaaagagcag

SEQ ID NO: 103274 - RNA, 20 nt, Artificial Sequence
  MKO10103274_B_Olfr1170
  gRNA
caucuacucaguaacauuga

SEQ ID NO: 103275 - RNA, 20 nt, Artificial Sequence
  MKO10103275_B_Olfr1170
  gRNA
uucugcgaccacauucaucu

SEQ ID NO: 103276 - RNA, 20 nt, Artificial Sequence
  MKO10103276_B_Olfr1173
  gRNA
ucuugaugauugugacaaug

SEQ ID NO: 103277 - RNA, 20 nt, Artificial Sequence
  MKO10103277_B_Olfr1173
  gRNA
gaaaccgaccagaauaaaug

SEQ ID NO: 103278 - RNA, 20 nt, Artificial Sequence
  MKO10103278_B_Olfr1173
  gRNA
uuucugaguccaccuuuaga

SEQ ID NO: 103279 - RNA, 20 nt, Artificial Sequence
  MKO10103279_B_Olfr1176
  gRNA
acuugagcacgcaguauaga

SEQ ID NO: 103280 - RNA, 20 nt, Artificial Sequence
  MKO10103280_B_Olfr1176
  gRNA
guuagaccuucugauaacag

SEQ ID NO: 103281 - RNA, 20 nt, Artificial Sequence
  MKO10103281_B_Olfr1176
  gRNA
caucaagugaaucagaguac

SEQ ID NO: 103282 - RNA, 20 nt, Artificial Sequence
  MKO10103282_B_Olfr1178
  gRNA
cugcgucaugcaaccauugu

SEQ ID NO: 103283 - RNA, 20 nt, Artificial Sequence
  MKO10103283_B_Olfr1178
  gRNA
aaaaagucgauuuccuacaa

SEQ ID NO: 103284 - RNA, 20 nt, Artificial Sequence
  MKO10103284_B_Olfr1178
  gRNA
uuccuucacucccugacaua

SEQ ID NO: 103285 - RNA, 20 nt, Artificial Sequence
  MKO10103285_B_Olfr1179
  gRNA
agaccacaucaagacuacga

SEQ ID NO: 103286 - RNA, 20 nt, Artificial Sequence
  MKO10103286_B_Olfr1179
  gRNA
cagucccaucaugccugaau

SEQ ID NO: 103287 - RNA, 20 nt, Artificial Sequence
  MKO10103287_B_Olfr1179
  gRNA
ugcaccaauacgcacagagu

SEQ ID NO: 103288 - RNA, 20 nt, Artificial Sequence
  MKO10103288_B_Olfr117
  gRNA
aagcuguauagcacagccug

SEQ ID NO: 103289 - RNA, 20 nt, Artificial Sequence
  MKO10103289_B_Olfr117
  gRNA
caugaagagcugcacuucau

SEQ ID NO: 103290 - RNA, 20 nt, Artificial Sequence
  MKO10103290_B_Olfr117
  gRNA
ggucaaaugccauaacugcg

SEQ ID NO: 103291 - RNA, 20 nt, Artificial Sequence
  MKO10103291_B_Olfr1180
  gRNA
auccuugcagcuuguuguac

SEQ ID NO: 103292 - RNA, 20 nt, Artificial Sequence
  MKO10103292_B_Olfr1180
  gRNA
caaacuccugacugauuuac

SEQ ID NO: 103293 - RNA, 20 nt, Artificial Sequence
  MKO10103293_B_Olfr1180
  gRNA
uaguucucauauaaccauug

SEQ ID NO: 103294 - RNA, 20 nt, Artificial Sequence
  MKO10103294_B_Olfr1181
  gRNA
aagcagauccccaaucaauu

SEQ ID NO: 103295 - RNA, 20 nt, Artificial Sequence
  MKO10103295_B_Olfr1181
  gRNA
gugcaagcaacuuucagcaa

SEQ ID NO: 103296 - RNA, 20 nt, Artificial Sequence
  MKO10103296_B_Olfr1181
  gRNA
aacugcaucuaauugagaaa

SEQ ID NO: 103297 - RNA, 20 nt, Artificial Sequence
  MKO10103297_B_Olfr1182
  gRNA
aauaauaaauggaaugccag

SEQ ID NO: 103298 - RNA, 20 nt, Artificial Sequence
  MKO10103298_B_Olfr1182
  gRNA
uuccugaauuggcaaccaug

SEQ ID NO: 103299 - RNA, 20 nt, Artificial Sequence
  MKO10103299_B_Olfr1182
  gRNA
aacugcaccuaauugagaaa

SEQ ID NO: 103300 - RNA, 20 nt, Artificial Sequence
  MKO10103300_B_Olfr1183
  gRNA
cauauuagugauucuugccu

SEQ ID NO: 103301 - RNA, 20 nt, Artificial Sequence
  MKO10103301_B_Olfr1183
  gRNA
caugcaggcaaguuucaaua

SEQ ID NO: 103302 - RNA, 20 nt, Artificial Sequence
  MKO10103302_B_Olfr1183
  gRNA
auuauaguuguauaucugag

SEQ ID NO: 103303 - RNA, 20 nt, Artificial Sequence
  MKO10103303_B_Olfr1184
  gRNA
gucuucuaagcggaacauug

SEQ ID NO: 103304 - RNA, 20 nt, Artificial Sequence
  MKO10103304_B_Olfr1184
  gRNA
ugacccgaacaagacaacaa

SEQ ID NO: 103305 - RNA, 20 nt, Artificial Sequence
  MKO10103305_B_Olfr1184
  gRNA
uagaagaucuccaaucaguu

SEQ ID NO: 103306 - RNA, 20 nt, Artificial Sequence
  MKO10103306_B_Olfr1186
  gRNA
augcacuucucauaucauug

SEQ ID NO: 103307 - RNA, 20 nt, Artificial Sequence
  MKO10103307_B_Olfr1186
  gRNA
uuagugauucuugccuggau

SEQ ID NO: 103308 - RNA, 20 nt, Artificial Sequence
  MKO10103308_B_Olfr1186
  gRNA
gccacagaaugguagucuua

SEQ ID NO: 103309 - RNA, 20 nt, Artificial Sequence
  MKO10103309_B_Olfr1188
  gRNA
ccauaugugcugucuucuag

SEQ ID NO: 103310 - RNA, 20 nt, Artificial Sequence
  MKO10103310_B_Olfr1188
  gRNA
uugcacaaucccuaagaugc

SEQ ID NO: 103311 - RNA, 20 nt, Artificial Sequence
  MKO10103311_B_Olfr1188
  gRNA
gauucuguguuagucccaug

SEQ ID NO: 103312 - RNA, 20 nt, Artificial Sequence
  MKO10103312_B_Olfr1189
  gRNA
cuuuggaaaucuacucauug

SEQ ID NO: 103313 - RNA, 20 nt, Artificial Sequence
  MKO10103313_B_Olfr1189
  gRNA
cauugcuccaaaauugauua

SEQ ID NO: 103314 - RNA, 20 nt, Artificial Sequence
  MKO10103314_B_Olfr1189
  gRNA
aaugugagcuacauguagag

SEQ ID NO: 103315 - RNA, 20 nt, Artificial Sequence
  MKO10103315_B_Olfr118
  gRNA
cccaaaucuagccacuuacc

SEQ ID NO: 103316 - RNA, 20 nt, Artificial Sequence
  MKO10103316_B_Olfr118
  gRNA
aacaaguguagccgaucucc

SEQ ID NO: 103317 - RNA, 20 nt, Artificial Sequence
  MKO10103317_B_Olfr118
  gRNA
acaugguccacagaaguuca

SEQ ID NO: 103318 - RNA, 20 nt, Artificial Sequence
  MKO10103318_B_Olfr1193
  gRNA
ugcacugacacuuacauugu

SEQ ID NO: 103319 - RNA, 20 nt, Artificial Sequence
  MKO10103319_B_Olfr1193
  gRNA
acaucuuauugcaucuuucc

SEQ ID NO: 103320 - RNA, 20 nt, Artificial Sequence
  MKO10103320_B_Olfr1193
  gRNA
aucauagucauauaguggag

SEQ ID NO: 103321 - RNA, 20 nt, Artificial Sequence
  MKO10103321_B_Olfr1195
  gRNA
cauagcggucaacagccaug

SEQ ID NO: 103322 - RNA, 20 nt, Artificial Sequence
  MKO10103322_B_Olfr1195
  gRNA
agugaguuuccuuaugcuca

SEQ ID NO: 103323 - RNA, 20 nt, Artificial Sequence
  MKO10103323_B_Olfr1195
  gRNA
auaugugaucaaccuucucc

SEQ ID NO: 103324 - RNA, 20 nt, Artificial Sequence
  MKO10103324_B_Olfr1196
  gRNA
cuuguuccugcuuugcuauc

SEQ ID NO: 103325 - RNA, 20 nt, Artificial Sequence
  MKO10103325_B_Olfr1196
  gRNA
agauagccagauagcaaagc

SEQ ID NO: 103326 - RNA, 20 nt, Artificial Sequence
  MKO10103326_B_Olfr1196
  gRNA
ucacaguagagguguagcag

SEQ ID NO: 103327 - RNA, 20 nt, Artificial Sequence
  MKO10103327_B_Olfr1197
  gRNA
uccuuguucucacuuccuac

SEQ ID NO: 103328 - RNA, 20 nt, Artificial Sequence
  MKO10103328_B_Olfr1197
  gRNA
aacaaccaccaucccagagu

SEQ ID NO: 103329 - RNA, 20 nt, Artificial Sequence
  MKO10103329_B_Olfr1197
  gRNA
aacaaguaguacaauaaaaa

SEQ ID NO: 103330 - RNA, 20 nt, Artificial Sequence
  MKO10103330_B_Olfr1198
  gRNA
ugccaagacaaacuguuuga

SEQ ID NO: 103331 - RNA, 20 nt, Artificial Sequence
  MKO10103331_B_Olfr1198
  gRNA
cauauucccccugcugaaac

SEQ ID NO: 103332 - RNA, 20 nt, Artificial Sequence
  MKO10103332_B_Olfr1198
  gRNA
gauuauauaagaaaugacca

SEQ ID NO: 103333 - RNA, 20 nt, Artificial Sequence
  MKO10103333_B_Olfr1199
  gRNA
uguagcuccuagaacaauug

SEQ ID NO: 103334 - RNA, 20 nt, Artificial Sequence
  MKO10103334_B_Olfr1199
  gRNA
uauucuucuuggcuugacac

SEQ ID NO: 103335 - RNA, 20 nt, Artificial Sequence
  MKO10103335_B_Olfr1199
  gRNA
acaugggacucccaagagcc

SEQ ID NO: 103336 - RNA, 20 nt, Artificial Sequence
  MKO10103336_B_Olfr119
  gRNA
cagcaucuauuacuuacuug

SEQ ID NO: 103337 - RNA, 20 nt, Artificial Sequence
  MKO10103337_B_Olfr119
  gRNA
cuuguagucacaauguucua

SEQ ID NO: 103338 - RNA, 20 nt, Artificial Sequence
  MKO10103338_B_Olfr119
  gRNA
agcaaguguagccaaucucc

SEQ ID NO: 103339 - RNA, 20 nt, Artificial Sequence
  MKO10103339_B_Olfr11
  gRNA
cguaaguuuaccagcauuug

SEQ ID NO: 103340 - RNA, 20 nt, Artificial Sequence
  MKO10103340_B_Olfr11
  gRNA
uuggcuuuggaaacucggug

SEQ ID NO: 103341 - RNA, 20 nt, Artificial Sequence
  MKO10103341_B_Olfr11
  gRNA
ugccagucauguccuucgac

SEQ ID NO: 103342 - RNA, 20 nt, Artificial Sequence
  MKO10103342_B_Olfr1200
  gRNA
aucuuagcaauuguuaacuc

SEQ ID NO: 103343 - RNA, 20 nt, Artificial Sequence
  MKO10103343_B_Olfr1200
  gRNA
ccgagaccacacuuugugca

SEQ ID NO: 103344 - RNA, 20 nt, Artificial Sequence
  MKO10103344_B_Olfr1200
  gRNA
uuguacuuucugugaccugu

SEQ ID NO: 103345 - RNA, 20 nt, Artificial Sequence
  MKO10103345_B_Olfr1201
  gRNA
ugcguuacucagucaucaug

SEQ ID NO: 103346 - RNA, 20 nt, Artificial Sequence
  MKO10103346_B_Olfr1201
  gRNA
guugagaaaugguguuccaa

SEQ ID NO: 103347 - RNA, 20 nt, Artificial Sequence
  MKO10103347_B_Olfr1201
  gRNA
acuguuaccaucuuguccau

SEQ ID NO: 103348 - RNA, 20 nt, Artificial Sequence
  MKO10103348_B_Olfr1202
  gRNA
agugaaucagcaaucacuuu

SEQ ID NO: 103349 - RNA, 20 nt, Artificial Sequence
  MKO10103349_B_Olfr1202
  gRNA
cgugaccgaguuuguucucc

SEQ ID NO: 103350 - RNA, 20 nt, Artificial Sequence
  MKO10103350_B_Olfr1202
  gRNA
caaaguaacugcuuuaucaa

SEQ ID NO: 103351 - RNA, 20 nt, Artificial Sequence
  MKO10103351_B_Olfr1204
  gRNA
cuuacugcuuguguccuacu

SEQ ID NO: 103352 - RNA, 20 nt, Artificial Sequence
  MKO10103352_B_Olfr1204
  gRNA
cagacaaaugaaaccacuau

SEQ ID NO: 103353 - RNA, 20 nt, Artificial Sequence
  MKO10103353_B_Olfr1204
  gRNA
acgacucuguaacauccuag

SEQ ID NO: 103354 - RNA, 20 nt, Artificial Sequence
  MKO10103354_B_Olfr1205
  gRNA
accugccgccucaugaugac

SEQ ID NO: 103355 - RNA, 20 nt, Artificial Sequence
  MKO10103355_B_Olfr1205
  gRNA
ugcauuacccagucaucaug

SEQ ID NO: 103356 - RNA, 20 nt, Artificial Sequence
  MKO10103356_B_Olfr1205
  gRNA
gucaccgaguuuauacuacu

SEQ ID NO: 103357 - RNA, 20 nt, Artificial Sequence
  MKO10103357_B_Olfr1206
  gRNA
caugaugacuggguaucgua

SEQ ID NO: 103358 - RNA, 20 nt, Artificial Sequence
  MKO10103358_B_Olfr1206
  gRNA
gauacccagucaucaugagc

SEQ ID NO: 103359 - RNA, 20 nt, Artificial Sequence
  MKO10103359_B_Olfr1206
  gRNA
uacugcuaccaucuugucca

SEQ ID NO: 103360 - RNA, 20 nt, Artificial Sequence
  MKO10103360_B_Olfr1208
  gRNA
cagaauggacaucaccccug

SEQ ID NO: 103361 - RNA, 20 nt, Artificial Sequence
  MKO10103361_B_Olfr1208
  gRNA
ccuuacagaauuuaucuuac

SEQ ID NO: 103362 - RNA, 20 nt, Artificial Sequence
  MKO10103362_B_Olfr1208
  gRNA
ccaguaagauaaauucugua

SEQ ID NO: 103363 - RNA, 20 nt, Artificial Sequence
  MKO10103363_B_Olfr1209
  gRNA
agugaguuuccucaugcuga

SEQ ID NO: 103364 - RNA, 20 nt, Artificial Sequence
  MKO10103364_B_Olfr1209
  gRNA
gcacucagugaaagauauag

SEQ ID NO: 103365 - RNA, 20 nt, Artificial Sequence
  MKO10103365_B_Olfr1209
  gRNA
aaagaguccacaauuguucu

SEQ ID NO: 103366 - RNA, 20 nt, Artificial Sequence
  MKO10103366_B_Olfr120
  gRNA
uauaacugaguguugccuac

SEQ ID NO: 103367 - RNA, 20 nt, Artificial Sequence
  MKO10103367_B_Olfr120
  gRNA
gccaagaguuuaucuauucc

SEQ ID NO: 103368 - RNA, 20 nt, Artificial Sequence
  MKO10103368_B_Olfr120
  gRNA
caaaggccauagcugccagu

SEQ ID NO: 103369 - RNA, 20 nt, Artificial Sequence
  MKO10103369_B_Olfr1211
  gRNA
caaucacuucuacugcugca

SEQ ID NO: 103370 - RNA, 20 nt, Artificial Sequence
  MKO10103370_B_Olfr1211
  gRNA
aagagaagcaugcauccaau

SEQ ID NO: 103371 - RNA, 20 nt, Artificial Sequence
  MKO10103371_B_Olfr1211
  gRNA
uucugucaucacaccaaaga

SEQ ID NO: 103372 - RNA, 20 nt, Artificial Sequence
  MKO10103372_B_Olfr1212
  gRNA
cugaaguaaugcaugcaucc

SEQ ID NO: 103373 - RNA, 20 nt, Artificial Sequence
  MKO10103373_B_Olfr1212
  gRNA
acagagucaacaaucaucuu

SEQ ID NO: 103374 - RNA, 20 nt, Artificial Sequence
  MKO10103374_B_Olfr1212
  gRNA
gugcaugccaacuccaguaa

SEQ ID NO: 103375 - RNA, 20 nt, Artificial Sequence
  MKO10103375_B_Olfr1213
  gRNA
agcaaguccacaguuaccuu

SEQ ID NO: 103376 - RNA, 20 nt, Artificial Sequence
  MKO10103376_B_Olfr1213
  gRNA
ggugauugucuugauaucca

SEQ ID NO: 103377 - RNA, 20 nt, Artificial Sequence
  MKO10103377_B_Olfr1213
  gRNA
acagagccuccuguucauaa

SEQ ID NO: 103378 - RNA, 20 nt, Artificial Sequence
  MKO10103378_B_Olfr1214
  gRNA
ugucacaccuaagaugauug

SEQ ID NO: 103379 - RNA, 20 nt, Artificial Sequence
  MKO10103379_B_Olfr1214
  gRNA
uagugcaggacuguagacaa

SEQ ID NO: 103380 - RNA, 20 nt, Artificial Sequence
  MKO10103380_B_Olfr1214
  gRNA
ugaacucauugacauagcuc

SEQ ID NO: 103381 - RNA, 20 nt, Artificial Sequence
  MKO10103381_B_Olfr1215
  gRNA
cgaacucaguuacaaugguu

SEQ ID NO: 103382 - RNA, 20 nt, Artificial Sequence
  MKO10103382_B_Olfr1215
  gRNA
gaauaaaucuauaaucaucg

SEQ ID NO: 103383 - RNA, 20 nt, Artificial Sequence
  MKO10103383_B_Olfr1215
  gRNA
caacacaggacucgaagcaa

SEQ ID NO: 103384 - RNA, 20 nt, Artificial Sequence
  MKO10103384_B_Olfr1216
  gRNA
guuaccgaguucauaaucuu

SEQ ID NO: 103385 - RNA, 20 nt, Artificial Sequence
  MKO10103385_B_Olfr1216
  gRNA
uugugucaugcaacagccaa

SEQ ID NO: 103386 - RNA, 20 nt, Artificial Sequence
  MKO10103386_B_Olfr1216
  gRNA
aggggguaacaugauuauug

SEQ ID NO: 103387 - RNA, 20 nt, Artificial Sequence
  MKO10103387_B_Olfr1217
  gRNA
cuaaaauuccacagagccuc

SEQ ID NO: 103388 - RNA, 20 nt, Artificial Sequence
  MKO10103388_B_Olfr1217
  gRNA
gaagcagucuacaauuaucu

SEQ ID NO: 103389 - RNA, 20 nt, Artificial Sequence
  MKO10103389_B_Olfr1217
  gRNA
acuuucacagaaccugaaug

SEQ ID NO: 103390 - RNA, 20 nt, Artificial Sequence
  MKO10103390_B_Olfr1218
  gRNA
ccaaaaugcuacagagccuc

SEQ ID NO: 103391 - RNA, 20 nt, Artificial Sequence
  MKO10103391_B_Olfr1218
  gRNA
ugaacucaguaacaaaacuc

SEQ ID NO: 103392 - RNA, 20 nt, Artificial Sequence
  MKO10103392_B_Olfr1218
  gRNA
uguuacugaguucauaaucu

SEQ ID NO: 103393 - RNA, 20 nt, Artificial Sequence
  MKO10103393_B_Olfr1219
  gRNA
uccuuauugcuugucucuua

SEQ ID NO: 103394 - RNA, 20 nt, Artificial Sequence
  MKO10103394_B_Olfr1219
  gRNA
accauaagagacaagcaaua

SEQ ID NO: 103395 - RNA, 20 nt, Artificial Sequence
  MKO10103395_B_Olfr1219
  gRNA
aauguggaagagauuaauag

SEQ ID NO: 103396 - RNA, 20 nt, Artificial Sequence
  MKO10103396_B_Olfr121
  gRNA
ucuagccaacuugucucuuc

SEQ ID NO: 103397 - RNA, 20 nt, Artificial Sequence
  MKO10103397_B_Olfr121
  gRNA
gcuacagagccuuguaagug

SEQ ID NO: 103398 - RNA, 20 nt, Artificial Sequence
  MKO10103398_B_Olfr121
  gRNA
cccaagucuagccacuuacc

SEQ ID NO: 103399 - RNA, 20 nt, Artificial Sequence
  MKO10103399_B_Olfr1220
  gRNA
agaagugcaaguauccaaua

SEQ ID NO: 103400 - RNA, 20 nt, Artificial Sequence
  MKO10103400_B_Olfr1220
  gRNA
aaugugcagaagaucuaaag

SEQ ID NO: 103401 - RNA, 20 nt, Artificial Sequence
  MKO10103401_B_Olfr1220
  gRNA
acuuugcagcuaccguucug

SEQ ID NO: 103402 - RNA, 20 nt, Artificial Sequence
  MKO10103402_B_Olfr1221
  gRNA
gaugcagauagaacuacuau

SEQ ID NO: 103403 - RNA, 20 nt, Artificial Sequence
  MKO10103403_B_Olfr1221
  gRNA
acuuugcaauuaccauucug

SEQ ID NO: 103404 - RNA, 20 nt, Artificial Sequence
  MKO10103404_B_Olfr1221
  gRNA
guguguugguaggcauagca

SEQ ID NO: 103405 - RNA, 20 nt, Artificial Sequence
  MKO10103405_B_Olfr1222
  gRNA
uuuacuagccacuucuuugc

SEQ ID NO: 103406 - RNA, 20 nt, Artificial Sequence
  MKO10103406_B_Olfr1222
  gRNA
uagaggaagugcaagcaucc

SEQ ID NO: 103407 - RNA, 20 nt, Artificial Sequence
  MKO10103407_B_Olfr1222
  gRNA
cgugcauauauuagcauaca

SEQ ID NO: 103408 - RNA, 20 nt, Artificial Sequence
  MKO10103408_B_Olfr1223
  gRNA
ccagaaugacacagagucuc

SEQ ID NO: 103409 - RNA, 20 nt, Artificial Sequence
  MKO10103409_B_Olfr1223
  gRNA
uuguaccauacaacauucaa

SEQ ID NO: 103410 - RNA, 20 nt, Artificial Sequence
  MKO10103410_B_Olfr1223
  gRNA
cagaagaaaugcaugcaucc

SEQ ID NO: 103411 - RNA, 20 nt, Artificial Sequence
  MKO10103411_B_Olfr1225
  gRNA
ggugauaguacugucagcca

SEQ ID NO: 103412 - RNA, 20 nt, Artificial Sequence
  MKO10103412_B_Olfr1225
  gRNA
auucuguaguuuauacuuuc

SEQ ID NO: 103413 - RNA, 20 nt, Artificial Sequence
  MKO10103413_B_Olfr1225
  gRNA
caccaaaaugacaaauauau

SEQ ID NO: 103414 - RNA, 20 nt, Artificial Sequence
  MKO10103414_B_Olfr1226
  gRNA
uuccugaaaguauauaccau

SEQ ID NO: 103415 - RNA, 20 nt, Artificial Sequence
  MKO10103415_B_Olfr1226
  gRNA
cuuaauauuccuguccuuuc

SEQ ID NO: 103416 - RNA, 20 nt, Artificial Sequence
  MKO10103416_B_Olfr1226
  gRNA
agagaacaagaugacacuau

SEQ ID NO: 103417 - RNA, 20 nt, Artificial Sequence
  MKO10103417_B_Olfr1228
  gRNA
cgugcauauauuaaaaagca

SEQ ID NO: 103418 - RNA, 20 nt, Artificial Sequence
  MKO10103418_B_Olfr1228
  gRNA
acuacuccuccauuaugacc

SEQ ID NO: 103419 - RNA, 20 nt, Artificial Sequence
  MKO10103419_B_Olfr1228
  gRNA
caucaucuuaggggugacag

SEQ ID NO: 103420 - RNA, 20 nt, Artificial Sequence
  MKO10103420_B_Olfr1229
  gRNA
uggaaagcucuauccacuug

SEQ ID NO: 103421 - RNA, 20 nt, Artificial Sequence
  MKO10103421_B_Olfr1229
  gRNA
ugcauccaauagagacaaga

SEQ ID NO: 103422 - RNA, 20 nt, Artificial Sequence
  MKO10103422_B_Olfr1229
  gRNA
cuagaguaccacagagccuc

SEQ ID NO: 103423 - RNA, 20 nt, Artificial Sequence
  MKO10103423_B_Olfr122
  gRNA
uacaaggcucuguaacaucu

SEQ ID NO: 103424 - RNA, 20 nt, Artificial Sequence
  MKO10103424_B_Olfr122
  gRNA
cuuguagucacacucuucua

SEQ ID NO: 103425 - RNA, 20 nt, Artificial Sequence
  MKO10103425_B_Olfr122
  gRNA
ucccauuccccaugaaacua

SEQ ID NO: 103426 - RNA, 20 nt, Artificial Sequence
  MKO10103426_B_Olfr1230
  gRNA
uaacagugaguccgaaucug

SEQ ID NO: 103427 - RNA, 20 nt, Artificial Sequence
  MKO10103427_B_Olfr1230
  gRNA
ggaacagaggauuacuacau

SEQ ID NO: 103428 - RNA, 20 nt, Artificial Sequence
  MKO10103428_B_Olfr1230
  gRNA
cuuguauuaucuuguacaug

SEQ ID NO: 103429 - RNA, 20 nt, Artificial Sequence
  MKO10103429_B_Olfr1231
  gRNA
acagucaccagcuuauccac

SEQ ID NO: 103430 - RNA, 20 nt, Artificial Sequence
  MKO10103430_B_Olfr1231
  gRNA
aaugagcagauuagccaaca

SEQ ID NO: 103431 - RNA, 20 nt, Artificial Sequence
  MKO10103431_B_Olfr1231
  gRNA
cuaugaggaaucuauugaag

SEQ ID NO: 103432 - RNA, 20 nt, Artificial Sequence
  MKO10103432_B_Olfr1232
  gRNA
aguuguuuacauugcaacua

SEQ ID NO: 103433 - RNA, 20 nt, Artificial Sequence
  MKO10103433_B_Olfr1232
  gRNA
gugcgacuuauuuccauuac

SEQ ID NO: 103434 - RNA, 20 nt, Artificial Sequence
  MKO10103434_B_Olfr1232
  gRNA
acaagaccacaacagcaacg

SEQ ID NO: 103435 - RNA, 20 nt, Artificial Sequence
  MKO10103435_B_Olfr1233
  gRNA
cuauggucccgacaaugagc

SEQ ID NO: 103436 - RNA, 20 nt, Artificial Sequence
  MKO10103436_B_Olfr1233
  gRNA
gcagaaaugguccaugacau

SEQ ID NO: 103437 - RNA, 20 nt, Artificial Sequence
  MKO10103437_B_Olfr1233
  gRNA
ucuguaugaaaaguuguuac

SEQ ID NO: 103438 - RNA, 20 nt, Artificial Sequence
  MKO10103438_B_Olfr1234
  gRNA
ugcaccaauaccuaccuuau

SEQ ID NO: 103439 - RNA, 20 nt, Artificial Sequence
  MKO10103439_B_Olfr1234
  gRNA
caaucauacaaagcccuaua

SEQ ID NO: 103440 - RNA, 20 nt, Artificial Sequence
  MKO10103440_B_Olfr1234
  gRNA
cuuuguaugauugcuaaugg

SEQ ID NO: 103441 - RNA, 20 nt, Artificial Sequence
  MKO10103441_B_Olfr1238
  gRNA
aacaaugcuuucuguccagc

SEQ ID NO: 103442 - RNA, 20 nt, Artificial Sequence
  MKO10103442_B_Olfr1238
  gRNA
ccaugauugacaaauaagca

SEQ ID NO: 103443 - RNA, 20 nt, Artificial Sequence
  MKO10103443_B_Olfr1238
  gRNA
ucacuguggccacaauaagc

SEQ ID NO: 103444 - RNA, 20 nt, Artificial Sequence
  MKO10103444_B_Olfr1239
  gRNA
cucacaguuguugccaauga

SEQ ID NO: 103445 - RNA, 20 nt, Artificial Sequence
  MKO10103445_B_Olfr1239
  gRNA
cucccugaagaaucucaguc

SEQ ID NO: 103446 - RNA, 20 nt, Artificial Sequence
  MKO10103446_B_Olfr1239
  gRNA
gacucugagucaggcccaag

SEQ ID NO: 103447 - RNA, 20 nt, Artificial Sequence
  MKO10103447_B_Olfr123
  gRNA
agccacagguggccacaacg

SEQ ID NO: 103448 - RNA, 20 nt, Artificial Sequence
  MKO10103448_B_Olfr123
  gRNA
gccaaagagugauuguuccu

SEQ ID NO: 103449 - RNA, 20 nt, Artificial Sequence
  MKO10103449_B_Olfr123
  gRNA
ccagggcucuacgccaagcc

SEQ ID NO: 103450 - RNA, 20 nt, Artificial Sequence
  MKO10103450_B_Olfr1240
  gRNA
gugaccaaaaccuccagcac

SEQ ID NO: 103451 - RNA, 20 nt, Artificial Sequence
  MKO10103451_B_Olfr1240
  gRNA
guacaugcuaagcccaguaa

SEQ ID NO: 103452 - RNA, 20 nt, Artificial Sequence
  MKO10103452_B_Olfr1240
  gRNA
uaugaccaucaugaaucguc

SEQ ID NO: 103453 - RNA, 20 nt, Artificial Sequence
  MKO10103453_B_Olfr1241
  gRNA
guugagcuacagagugugca

SEQ ID NO: 103454 - RNA, 20 nt, Artificial Sequence
  MKO10103454_B_Olfr1241
  gRNA
gugcaugcaaguccuaauaa

SEQ ID NO: 103455 - RNA, 20 nt, Artificial Sequence
  MKO10103455_B_Olfr1241
  gRNA
gguuugcuuccuccuauugg

SEQ ID NO: 103456 - RNA, 20 nt, Artificial Sequence
  MKO10103456_B_Olfr1242
  gRNA
acagcaauauauuuauccac

SEQ ID NO: 103457 - RNA, 20 nt, Artificial Sequence
  MKO10103457_B_Olfr1242
  gRNA
auagaagaaugcacacccuc

SEQ ID NO: 103458 - RNA, 20 nt, Artificial Sequence
  MKO10103458_B_Olfr1242
  gRNA
gucuuagucaagauccugcu

SEQ ID NO: 103459 - RNA, 20 nt, Artificial Sequence
  MKO10103459_B_Olfr1243
  gRNA
uaaccugcucauugcaguga

SEQ ID NO: 103460 - RNA, 20 nt, Artificial Sequence
  MKO10103460_B_Olfr1243
  gRNA
ucccagcaggaucuugagua

SEQ ID NO: 103461 - RNA, 20 nt, Artificial Sequence
  MKO10103461_B_Olfr1243
  gRNA
gcacacccgcugauucauga

SEQ ID NO: 103462 - RNA, 20 nt, Artificial Sequence
  MKO10103462_B_Olfr1245
  gRNA
ggugaagaucacaauacaca

SEQ ID NO: 103463 - RNA, 20 nt, Artificial Sequence
  MKO10103463_B_Olfr1245
  gRNA
ugauuccauaggagccuagg

SEQ ID NO: 103464 - RNA, 20 nt, Artificial Sequence
  MKO10103464_B_Olfr1245
  gRNA
ugacugucaccacaauaagc

SEQ ID NO: 103465 - RNA, 20 nt, Artificial Sequence
  MKO10103465_B_Olfr1246
  gRNA
uuccauaagacacuaugaga

SEQ ID NO: 103466 - RNA, 20 nt, Artificial Sequence
  MKO10103466_B_Olfr1246
  gRNA
auccuucucauagugucuua

SEQ ID NO: 103467 - RNA, 20 nt, Artificial Sequence
  MKO10103467_B_Olfr1246
  gRNA
gugcacacaagucccaauaa

SEQ ID NO: 103468 - RNA, 20 nt, Artificial Sequence
  MKO10103468_B_Olfr1247
  gRNA
aacuaagucuuuaagcaacu

SEQ ID NO: 103469 - RNA, 20 nt, Artificial Sequence
  MKO10103469_B_Olfr1247
  gRNA
gugcacacaagugccaauaa

SEQ ID NO: 103470 - RNA, 20 nt, Artificial Sequence
  MKO10103470_B_Olfr1247
  gRNA
ugcacugacaccuacuuuau

SEQ ID NO: 103471 - RNA, 20 nt, Artificial Sequence
  MKO10103471_B_Olfr1248
  gRNA
gcaaaccugccguuucauua

SEQ ID NO: 103472 - RNA, 20 nt, Artificial Sequence
  MKO10103472_B_Olfr1248
  gRNA
acuaucugaccauaaugaaa

SEQ ID NO: 103473 - RNA, 20 nt, Artificial Sequence
  MKO10103473_B_Olfr1248
  gRNA
gguuugcauucucuuggugg

SEQ ID NO: 103474 - RNA, 20 nt, Artificial Sequence
  MKO10103474_B_Olfr1249
  gRNA
augugcaagaccucccgccc

SEQ ID NO: 103475 - RNA, 20 nt, Artificial Sequence
  MKO10103475_B_Olfr1249
  gRNA
uguacugauacauacuuccu

SEQ ID NO: 103476 - RNA, 20 nt, Artificial Sequence
  MKO10103476_B_Olfr1249
  gRNA
guacaugcaaguaguaauag

SEQ ID NO: 103477 - RNA, 20 nt, Artificial Sequence
  MKO10103477_B_Olfr124
  gRNA
cuaagguugaccaacaucug

SEQ ID NO: 103478 - RNA, 20 nt, Artificial Sequence
  MKO10103478_B_Olfr124
  gRNA
ccuuuguuagugcccuccuc

SEQ ID NO: 103479 - RNA, 20 nt, Artificial Sequence
  MKO10103479_B_Olfr124
  gRNA
gaagcugagcuuaauguucu

SEQ ID NO: 103480 - RNA, 20 nt, Artificial Sequence
  MKO10103480_B_Olfr1250
  gRNA
agagaacaaccaccaugaug

SEQ ID NO: 103481 - RNA, 20 nt, Artificial Sequence
  MKO10103481_B_Olfr1250
  gRNA
uguuacagaguuuauccucc

SEQ ID NO: 103482 - RNA, 20 nt, Artificial Sequence
  MKO10103482_B_Olfr1250
  gRNA
uuuaaucuccauguuucuca

SEQ ID NO: 103483 - RNA, 20 nt, Artificial Sequence
  MKO10103483_B_Olfr1251
  gRNA
uguacugauaccuauuucau

SEQ ID NO: 103484 - RNA, 20 nt, Artificial Sequence
  MKO10103484_B_Olfr1251
  gRNA
augugcaaaaccucccgccc

SEQ ID NO: 103485 - RNA, 20 nt, Artificial Sequence
  MKO10103485_B_Olfr1251
  gRNA
cuuucugucauuggcaauaa

SEQ ID NO: 103486 - RNA, 20 nt, Artificial Sequence
  MKO10103486_B_Olfr1252
  gRNA
uccaaaguggucaaugacau

SEQ ID NO: 103487 - RNA, 20 nt, Artificial Sequence
  MKO10103487_B_Olfr1252
  gRNA
guccuccuccuugucucuua

SEQ ID NO: 103488 - RNA, 20 nt, Artificial Sequence
  MKO10103488_B_Olfr1252
  gRNA
cccaaugucauugaccacuu

SEQ ID NO: 103489 - RNA, 20 nt, Artificial Sequence
  MKO10103489_B_Olfr1253
  gRNA
ggauuauugcauaagaaagu

SEQ ID NO: 103490 - RNA, 20 nt, Artificial Sequence
  MKO10103490_B_Olfr1253
  gRNA
auguacaaaaccucccaccc

SEQ ID NO: 103491 - RNA, 20 nt, Artificial Sequence
  MKO10103491_B_Olfr1253
  gRNA
ucccuuccuuacugugauuc

SEQ ID NO: 103492 - RNA, 20 nt, Artificial Sequence
  MKO10103492_B_Olfr1254
  gRNA
uauuacauucagauagacua

SEQ ID NO: 103493 - RNA, 20 nt, Artificial Sequence
  MKO10103493_B_Olfr1254
  gRNA
uucuccuggugauggcaacc

SEQ ID NO: 103494 - RNA, 20 nt, Artificial Sequence
  MKO10103494_B_Olfr1254
  gRNA
guuauucuguuagccuccua

SEQ ID NO: 103495 - RNA, 20 nt, Artificial Sequence
  MKO10103495_B_Olfr1255
  gRNA
uacugugaugugugacacac

SEQ ID NO: 103496 - RNA, 20 nt, Artificial Sequence
  MKO10103496_B_Olfr1255
  gRNA
cauaagccaucacugucaac

SEQ ID NO: 103497 - RNA, 20 nt, Artificial Sequence
  MKO10103497_B_Olfr1255
  gRNA
gaucauccuguugacaguga

SEQ ID NO: 103498 - RNA, 20 nt, Artificial Sequence
  MKO10103498_B_Olfr1256
  gRNA
uguauugacaccuaugucau

SEQ ID NO: 103499 - RNA, 20 nt, Artificial Sequence
  MKO10103499_B_Olfr1256
  gRNA
uguaacuaccaguaacagcc

SEQ ID NO: 103500 - RNA, 20 nt, Artificial Sequence
  MKO10103500_B_Olfr1256
  gRNA
ucccaccauagucaaaacau

SEQ ID NO: 103501 - RNA, 20 nt, Artificial Sequence
  MKO10103501_B_Olfr1257
  gRNA
agugaaucugcuaucaguuu

SEQ ID NO: 103502 - RNA, 20 nt, Artificial Sequence
  MKO10103502_B_Olfr1257
  gRNA
ugcaccgauacucacacucu

SEQ ID NO: 103503 - RNA, 20 nt, Artificial Sequence
  MKO10103503_B_Olfr1257
  gRNA
gccaugacacucccacuagc

SEQ ID NO: 103504 - RNA, 20 nt, Artificial Sequence
  MKO10103504_B_Olfr1258
  gRNA
aguguugacagaggaauaac

SEQ ID NO: 103505 - RNA, 20 nt, Artificial Sequence
  MKO10103505_B_Olfr1258
  gRNA
ugaacguagaaugaccacau

SEQ ID NO: 103506 - RNA, 20 nt, Artificial Sequence
  MKO10103506_B_Olfr1258
  gRNA
augcacugauacccacauuc

SEQ ID NO: 103507 - RNA, 20 nt, Artificial Sequence
  MKO10103507_B_Olfr1259
  gRNA
cugugugucucauaucacag

SEQ ID NO: 103508 - RNA, 20 nt, Artificial Sequence
  MKO10103508_B_Olfr1259
  gRNA
cacugugauaugagacacac

SEQ ID NO: 103509 - RNA, 20 nt, Artificial Sequence
  MKO10103509_B_Olfr1259
  gRNA
gaucauccuauugacaguga

SEQ ID NO: 103510 - RNA, 20 nt, Artificial Sequence
  MKO10103510_B_Olfr125
  gRNA
acugcaguaugagacaauua

SEQ ID NO: 103511 - RNA, 20 nt, Artificial Sequence
  MKO10103511_B_Olfr125
  gRNA
agaaugcagacguuggucca

SEQ ID NO: 103512 - RNA, 20 nt, Artificial Sequence
  MKO10103512_B_Olfr125
  gRNA
auaauugucucauacugcag

SEQ ID NO: 103513 - RNA, 20 nt, Artificial Sequence
  MKO10103513_B_Olfr1260
  gRNA
agucaucucuagcccgacac

SEQ ID NO: 103514 - RNA, 20 nt, Artificial Sequence
  MKO10103514_B_Olfr1260
  gRNA
uccuucuuauccuucguaga

SEQ ID NO: 103515 - RNA, 20 nt, Artificial Sequence
  MKO10103515_B_Olfr1260
  gRNA
acuacaugaucacaaugaac

SEQ ID NO: 103516 - RNA, 20 nt, Artificial Sequence
  MKO10103516_B_Olfr1261
  gRNA
acaaaaucuguaucccucca

SEQ ID NO: 103517 - RNA, 20 nt, Artificial Sequence
  MKO10103517_B_Olfr1261
  gRNA
uccuacuuguccgucauaga

SEQ ID NO: 103518 - RNA, 20 nt, Artificial Sequence
  MKO10103518_B_Olfr1261
  gRNA
uaaacacagugacccgcugu

SEQ ID NO: 103519 - RNA, 20 nt, Artificial Sequence
  MKO10103519_B_Olfr1262
  gRNA
auagcccaauuacccuucug

SEQ ID NO: 103520 - RNA, 20 nt, Artificial Sequence
  MKO10103520_B_Olfr1262
  gRNA
augugauuuaauaccacuuu

SEQ ID NO: 103521 - RNA, 20 nt, Artificial Sequence
  MKO10103521_B_Olfr1262
  gRNA
uaaacacauugacccgcugu

SEQ ID NO: 103522 - RNA, 20 nt, Artificial Sequence
  MKO10103522_B_Olfr1263
  gRNA
gaugguauugggaccacaga

SEQ ID NO: 103523 - RNA, 20 nt, Artificial Sequence
  MKO10103523_B_Olfr1263
  gRNA
caaacacagugacccgcugu

SEQ ID NO: 103524 - RNA, 20 nt, Artificial Sequence
  MKO10103524_B_Olfr1263
  gRNA
agcaauacaaacuuuauuua

SEQ ID NO: 103525 - RNA, 20 nt, Artificial Sequence
  MKO10103525_B_Olfr1264
  gRNA
ggaucugaaccaacgaaugc

SEQ ID NO: 103526 - RNA, 20 nt, Artificial Sequence
  MKO10103526_B_Olfr1264
  gRNA
gaugacguauguguuggugc

SEQ ID NO: 103527 - RNA, 20 nt, Artificial Sequence
  MKO10103527_B_Olfr1264
  gRNA
gggugguuuccugcauucgu

SEQ ID NO: 103528 - RNA, 20 nt, Artificial Sequence
  MKO10103528_B_Olfr1265
  gRNA
caacaaucaguaggccaaua

SEQ ID NO: 103529 - RNA, 20 nt, Artificial Sequence
  MKO10103529_B_Olfr1265
  gRNA
aaugugugugcaguccucgu

SEQ ID NO: 103530 - RNA, 20 nt, Artificial Sequence
  MKO10103530_B_Olfr1265
  gRNA
acucucuucuaacaaagagg

SEQ ID NO: 103531 - RNA, 20 nt, Artificial Sequence
  MKO10103531_B_Olfr1269
  gRNA
aacagcucccaaacucaucu

SEQ ID NO: 103532 - RNA, 20 nt, Artificial Sequence
  MKO10103532_B_Olfr1269
  gRNA
uaggagauccaagaugaguu

SEQ ID NO: 103533 - RNA, 20 nt, Artificial Sequence
  MKO10103533_B_Olfr1269
  gRNA
aagugugugugcaguccuca

SEQ ID NO: 103534 - RNA, 20 nt, Artificial Sequence
  MKO10103534_B_Olfr126
  gRNA
gucuacuuucaugucuguaa

SEQ ID NO: 103535 - RNA, 20 nt, Artificial Sequence
  MKO10103535_B_Olfr126
  gRNA
ccaugaauugcagaucuuac

SEQ ID NO: 103536 - RNA, 20 nt, Artificial Sequence
  MKO10103536_B_Olfr126
  gRNA
ugcuaagugaagaauucauu

SEQ ID NO: 103537 - RNA, 20 nt, Artificial Sequence
  MKO10103537_B_Olfr1270
  gRNA
ucaucauccuugucaauuug

SEQ ID NO: 103538 - RNA, 20 nt, Artificial Sequence
  MKO10103538_B_Olfr1270
  gRNA
uguggagagugucauuguaa

SEQ ID NO: 103539 - RNA, 20 nt, Artificial Sequence
  MKO10103539_B_Olfr1270
  gRNA
cagacagcccuucagcgaga

SEQ ID NO: 103540 - RNA, 20 nt, Artificial Sequence
  MKO10103540_B_Olfr1271
  gRNA
uuuauuguaauggcuaacag

SEQ ID NO: 103541 - RNA, 20 nt, Artificial Sequence
  MKO10103541_B_Olfr1271
  gRNA
cugcaagcaagcuuaaguaa

SEQ ID NO: 103542 - RNA, 20 nt, Artificial Sequence
  MKO10103542_B_Olfr1271
  gRNA
aagaccguugcccagcaaug

SEQ ID NO: 103543 - RNA, 20 nt, Artificial Sequence
  MKO10103543_B_Olfr1272
  gRNA
caucacugacuuacuuguua

SEQ ID NO: 103544 - RNA, 20 nt, Artificial Sequence
  MKO10103544_B_Olfr1272
  gRNA
ugcugagauucuccugcuug

SEQ ID NO: 103545 - RNA, 20 nt, Artificial Sequence
  MKO10103545_B_Olfr1272
  gRNA
uucugcagagggaagacgca

SEQ ID NO: 103546 - RNA, 20 nt, Artificial Sequence
  MKO10103546_B_Olfr1273-ps
  gRNA
agagauuugcuacuccucua

SEQ ID NO: 103547 - RNA, 20 nt, Artificial Sequence
  MKO10103547_B_Olfr1273-ps
  gRNA
ugccugcacugauaccuuua

SEQ ID NO: 103548 - RNA, 20 nt, Artificial Sequence
  MKO10103548_B_Olfr1273-ps
  gRNA
gaaguaguggucaauuacau

SEQ ID NO: 103549 - RNA, 20 nt, Artificial Sequence
  MKO10103549_B_Olfr1274-ps
  gRNA
uuuguuuauugucaugcauc

SEQ ID NO: 103550 - RNA, 20 nt, Artificial Sequence
  MKO10103550_B_Olfr1274-ps
  gRNA
agggcaagcggaagaugaga

SEQ ID NO: 103551 - RNA, 20 nt, Artificial Sequence
  MKO10103551_B_Olfr1274-ps
  gRNA
gagaagauuuccaaacacaa

SEQ ID NO: 103552 - RNA, 20 nt, Artificial Sequence
  MKO10103552_B_Olfr1275
  gRNA
cgaaugaaagauuagcuaaa

SEQ ID NO: 103553 - RNA, 20 nt, Artificial Sequence
  MKO10103553_B_Olfr1275
  gRNA
ucucacauccccccaguaga

SEQ ID NO: 103554 - RNA, 20 nt, Artificial Sequence
  MKO10103554_B_Olfr1275
  gRNA
ugaguguucaacuccugagu

SEQ ID NO: 103555 - RNA, 20 nt, Artificial Sequence
  MKO10103555_B_Olfr1276
  gRNA
aauggacaacaaaaccuagu

SEQ ID NO: 103556 - RNA, 20 nt, Artificial Sequence
  MKO10103556_B_Olfr1276
  gRNA
ggcaucugagaugguauugc

SEQ ID NO: 103557 - RNA, 20 nt, Artificial Sequence
  MKO10103557_B_Olfr1276
  gRNA
uuuguuccucagcguguaaa

SEQ ID NO: 103558 - RNA, 20 nt, Artificial Sequence
  MKO10103558_B_Olfr1277
  gRNA
augccccauccuuagaguga

SEQ ID NO: 103559 - RNA, 20 nt, Artificial Sequence
  MKO10103559_B_Olfr1277
  gRNA
gaugaucaucgacuuccuca

SEQ ID NO: 103560 - RNA, 20 nt, Artificial Sequence
  MKO10103560_B_Olfr1277
  gRNA
gauuuacaauuauaaccagu

SEQ ID NO: 103561 - RNA, 20 nt, Artificial Sequence
  MKO10103561_B_Olfr1278
  gRNA
aaggguauugcccagcacga

SEQ ID NO: 103562 - RNA, 20 nt, Artificial Sequence
  MKO10103562_B_Olfr1278
  gRNA
acuugauaauaaacgcuaau

SEQ ID NO: 103563 - RNA, 20 nt, Artificial Sequence
  MKO10103563_B_Olfr1278
  gRNA
caacaguggguuuauuucca

SEQ ID NO: 103564 - RNA, 20 nt, Artificial Sequence
  MKO10103564_B_Olfr1279
  gRNA
uauuugucgaucgaugaugu

SEQ ID NO: 103565 - RNA, 20 nt, Artificial Sequence
  MKO10103565_B_Olfr1279
  gRNA
cccacacaucguucaaagac

SEQ ID NO: 103566 - RNA, 20 nt, Artificial Sequence
  MKO10103566_B_Olfr1279
  gRNA
augaugcucaaguagcgcag

SEQ ID NO: 103567 - RNA, 20 nt, Artificial Sequence
  MKO10103567_B_Olfr127
  gRNA
agaaacaugacaacagugag

SEQ ID NO: 103568 - RNA, 20 nt, Artificial Sequence
  MKO10103568_B_Olfr127
  gRNA
cucacuguugucauguuucu

SEQ ID NO: 103569 - RNA, 20 nt, Artificial Sequence
  MKO10103569_B_Olfr127
  gRNA
cgaaguggcuauauuucaua

SEQ ID NO: 103570 - RNA, 20 nt, Artificial Sequence
  MKO10103570_B_Olfr1280
  gRNA
auagugauaaaugcugauag

SEQ ID NO: 103571 - RNA, 20 nt, Artificial Sequence
  MKO10103571_B_Olfr1280
  gRNA
cuaccacagucaucauguag

SEQ ID NO: 103572 - RNA, 20 nt, Artificial Sequence
  MKO10103572_B_Olfr1280
  gRNA
uccacccaagugaugcugac

SEQ ID NO: 103573 - RNA, 20 nt, Artificial Sequence
  MKO10103573_B_Olfr1281
  gRNA
cuggcucaugcagccgccaa

SEQ ID NO: 103574 - RNA, 20 nt, Artificial Sequence
  MKO10103574_B_Olfr1281
  gRNA
ggaagacucuaaucaaacug

SEQ ID NO: 103575 - RNA, 20 nt, Artificial Sequence
  MKO10103575_B_Olfr1281
  gRNA
aaagaucucaaguugccuug

SEQ ID NO: 103576 - RNA, 20 nt, Artificial Sequence
  MKO10103576_B_Olfr1282
  gRNA
aucuauggucaguuuggggg

SEQ ID NO: 103577 - RNA, 20 nt, Artificial Sequence
  MKO10103577_B_Olfr1282
  gRNA
aaucaagagcaucugacuaa

SEQ ID NO: 103578 - RNA, 20 nt, Artificial Sequence
  MKO10103578_B_Olfr1282
  gRNA
cugcaugaauacugauacuc

SEQ ID NO: 103579 - RNA, 20 nt, Artificial Sequence
  MKO10103579_B_Olfr1283
  gRNA
aaguauaagauaucaguaag

SEQ ID NO: 103580 - RNA, 20 nt, Artificial Sequence
  MKO10103580_B_Olfr1283
  gRNA
cugcaugaauacugauacac

SEQ ID NO: 103581 - RNA, 20 nt, Artificial Sequence
  MKO10103581_B_Olfr1283
  gRNA
ggaagaaggaaaccagacug

SEQ ID NO: 103582 - RNA, 20 nt, Artificial Sequence
  MKO10103582_B_Olfr1284
  gRNA
uauuugucagucgaugaugu

SEQ ID NO: 103583 - RNA, 20 nt, Artificial Sequence
  MKO10103583_B_Olfr1284
  gRNA
cagcaaagucaacaaugaac

SEQ ID NO: 103584 - RNA, 20 nt, Artificial Sequence
  MKO10103584_B_Olfr1284
  gRNA
gaucugcuccauccacauua

SEQ ID NO: 103585 - RNA, 20 nt, Artificial Sequence
  MKO10103585_B_Olfr1286
  gRNA
caccuggguugacaaguuuc

SEQ ID NO: 103586 - RNA, 20 nt, Artificial Sequence
  MKO10103586_B_Olfr1286
  gRNA
ugcacaaauccaacaaucca

SEQ ID NO: 103587 - RNA, 20 nt, Artificial Sequence
  MKO10103587_B_Olfr1286
  gRNA
uaggagaucuauagucaguu

SEQ ID NO: 103588 - RNA, 20 nt, Artificial Sequence
  MKO10103588_B_Olfr1287
  gRNA
cuccaaagaaguacacacag

SEQ ID NO: 103589 - RNA, 20 nt, Artificial Sequence
  MKO10103589_B_Olfr1287
  gRNA
uguguccaguuagcaucacc

SEQ ID NO: 103590 - RNA, 20 nt, Artificial Sequence
  MKO10103590_B_Olfr1287
  gRNA
gugguuuaucagcuucuuua

SEQ ID NO: 103591 - RNA, 20 nt, Artificial Sequence
  MKO10103591_B_Olfr1288
  gRNA
caugcaaguuuaaugacccu

SEQ ID NO: 103592 - RNA, 20 nt, Artificial Sequence
  MKO10103592_B_Olfr1288
  gRNA
gucagcucacaucacuguag

SEQ ID NO: 103593 - RNA, 20 nt, Artificial Sequence
  MKO10103593_B_Olfr1288
  gRNA
auaugagguuggccaucaga

SEQ ID NO: 103594 - RNA, 20 nt, Artificial Sequence
  MKO10103594_B_Olfr1289
  gRNA
gaugguaacccuuguagcca

SEQ ID NO: 103595 - RNA, 20 nt, Artificial Sequence
  MKO10103595_B_Olfr1289
  gRNA
gcuauaagcuuacccuucug

SEQ ID NO: 103596 - RNA, 20 nt, Artificial Sequence
  MKO10103596_B_Olfr1289
  gRNA
uaaugggacucuccaauucu

SEQ ID NO: 103597 - RNA, 20 nt, Artificial Sequence
  MKO10103597_B_Olfr128
  gRNA
cucauuguugucauguuucu

SEQ ID NO: 103598 - RNA, 20 nt, Artificial Sequence
  MKO10103598_B_Olfr128
  gRNA
auggggauugccuucuccua

SEQ ID NO: 103599 - RNA, 20 nt, Artificial Sequence
  MKO10103599_B_Olfr128
  gRNA
ugagaacuguagagaauauu

SEQ ID NO: 103600 - RNA, 20 nt, Artificial Sequence
  MKO10103600_B_Olfr1290
  gRNA
gcaucucuucauauucauga

SEQ ID NO: 103601 - RNA, 20 nt, Artificial Sequence
  MKO10103601_B_Olfr1290
  gRNA
augaauaugaagagaugcac

SEQ ID NO: 103602 - RNA, 20 nt, Artificial Sequence
  MKO10103602_B_Olfr1290
  gRNA
gacuucaauccucugugagc

SEQ ID NO: 103603 - RNA, 20 nt, Artificial Sequence
  MKO10103603_B_Olfr1294
  gRNA
gccacaugucaacaaaagac

SEQ ID NO: 103604 - RNA, 20 nt, Artificial Sequence
  MKO10103604_B_Olfr1294
  gRNA
ugcaaaaaauuuguccaacc

SEQ ID NO: 103605 - RNA, 20 nt, Artificial Sequence
  MKO10103605_B_Olfr1294
  gRNA
agaccugaauauucuuugaa

SEQ ID NO: 103606 - RNA, 20 nt, Artificial Sequence
  MKO10103606_B_Olfr1295
  gRNA
agcucuugcuaacagugaca

SEQ ID NO: 103607 - RNA, 20 nt, Artificial Sequence
  MKO10103607_B_Olfr1295
  gRNA
cuuuaucuguucauuguguc

SEQ ID NO: 103608 - RNA, 20 nt, Artificial Sequence
  MKO10103608_B_Olfr1295
  gRNA
uaaauucugacacaacagac

SEQ ID NO: 103609 - RNA, 20 nt, Artificial Sequence
  MKO10103609_B_Olfr1297
  gRNA
gcuagccugcauggauuccc

SEQ ID NO: 103610 - RNA, 20 nt, Artificial Sequence
  MKO10103610_B_Olfr1297
  gRNA
uguuuccccuaaauaucacc

SEQ ID NO: 103611 - RNA, 20 nt, Artificial Sequence
  MKO10103611_B_Olfr1297
  gRNA
ugcaggcuagcuugauuacc

SEQ ID NO: 103612 - RNA, 20 nt, Artificial Sequence
  MKO10103612_B_Olfr1298
  gRNA
accuauccuuuguugacaug

SEQ ID NO: 103613 - RNA, 20 nt, Artificial Sequence
  MKO10103613_B_Olfr1298
  gRNA
caggcuagcuuaauuaccag

SEQ ID NO: 103614 - RNA, 20 nt, Artificial Sequence
  MKO10103614_B_Olfr1298
  gRNA
ucucuccuccagcaauacaa

SEQ ID NO: 103615 - RNA, 20 nt, Artificial Sequence
  MKO10103615_B_Olfr1299
  gRNA
gcugcagaacugcuacaagc

SEQ ID NO: 103616 - RNA, 20 nt, Artificial Sequence
  MKO10103616_B_Olfr1299
  gRNA
guguugacuuccuggaccgu

SEQ ID NO: 103617 - RNA, 20 nt, Artificial Sequence
  MKO10103617_B_Olfr1299
  gRNA
aagcacaaauucugacaccg

SEQ ID NO: 103618 - RNA, 20 nt, Artificial Sequence
  MKO10103618_B_Olfr129
  gRNA
uacuucugauuagccacucc

SEQ ID NO: 103619 - RNA, 20 nt, Artificial Sequence
  MKO10103619_B_Olfr129
  gRNA
ugaagcugaacuuagaccca

SEQ ID NO: 103620 - RNA, 20 nt, Artificial Sequence
  MKO10103620_B_Olfr129
  gRNA
auacuuacuuguugucucag

SEQ ID NO: 103621 - RNA, 20 nt, Artificial Sequence
  MKO10103621_B_Olfr12
  gRNA
acccaggaccagacggguac

SEQ ID NO: 103622 - RNA, 20 nt, Artificial Sequence
  MKO10103622_B_Olfr12
  gRNA
ccaggacagucaccacguac

SEQ ID NO: 103623 - RNA, 20 nt, Artificial Sequence
  MKO10103623_B_Olfr12
  gRNA
cuacacagaagcauucccuc

SEQ ID NO: 103624 - RNA, 20 nt, Artificial Sequence
  MKO10103624_B_Olfr1301
  gRNA
gcaugccaugagucagcuuu

SEQ ID NO: 103625 - RNA, 20 nt, Artificial Sequence
  MKO10103625_B_Olfr1301
  gRNA
augagccugaaaagaugugc

SEQ ID NO: 103626 - RNA, 20 nt, Artificial Sequence
  MKO10103626_B_Olfr1301
  gRNA
guuuaucugcucauucuauc

SEQ ID NO: 103627 - RNA, 20 nt, Artificial Sequence
  MKO10103627_B_Olfr1302
  gRNA
ugugcaugccuugagucacc

SEQ ID NO: 103628 - RNA, 20 nt, Artificial Sequence
  MKO10103628_B_Olfr1302
  gRNA
auauccuuaucacuguucga

SEQ ID NO: 103629 - RNA, 20 nt, Artificial Sequence
  MKO10103629_B_Olfr1302
  gRNA
cugaagacacaugaguaaaa

SEQ ID NO: 103630 - RNA, 20 nt, Artificial Sequence
  MKO10103630_B_Olfr1303
  gRNA
caggccaaucugagaaguuu

SEQ ID NO: 103631 - RNA, 20 nt, Artificial Sequence
  MKO10103631_B_Olfr1303
  gRNA
uauuuaugaaauaccucuaa

SEQ ID NO: 103632 - RNA, 20 nt, Artificial Sequence
  MKO10103632_B_Olfr1303
  gRNA
ccuuccuaaacuucucagau

SEQ ID NO: 103633 - RNA, 20 nt, Artificial Sequence
  MKO10103633_B_Olfr1305
  gRNA
caugcaagcuugacaagucg

SEQ ID NO: 103634 - RNA, 20 nt, Artificial Sequence
  MKO10103634_B_Olfr1305
  gRNA
ugcuaauauuaguugcugcu

SEQ ID NO: 103635 - RNA, 20 nt, Artificial Sequence
  MKO10103635_B_Olfr1305
  gRNA
cucaugauuacugccaauag

SEQ ID NO: 103636 - RNA, 20 nt, Artificial Sequence
  MKO10103636_B_Olfr1306
  gRNA
ugugagcagaaagaguagau

SEQ ID NO: 103637 - RNA, 20 nt, Artificial Sequence
  MKO10103637_B_Olfr1306
  gRNA
aacacaucuugauaaguuuc

SEQ ID NO: 103638 - RNA, 20 nt, Artificial Sequence
  MKO10103638_B_Olfr1306
  gRNA
uaugcauucuuugauucaac

SEQ ID NO: 103639 - RNA, 20 nt, Artificial Sequence
  MKO10103639_B_Olfr1307
  gRNA
agugugcaaaaacauucuuc

SEQ ID NO: 103640 - RNA, 20 nt, Artificial Sequence
  MKO10103640_B_Olfr1307
  gRNA
caugcuagccacaaaaaaca

SEQ ID NO: 103641 - RNA, 20 nt, Artificial Sequence
  MKO10103641_B_Olfr1307
  gRNA
gacacaccuugauaaguuuc

SEQ ID NO: 103642 - RNA, 20 nt, Artificial Sequence
  MKO10103642_B_Olfr1308
  gRNA
aaccacuugaagaguguuua

SEQ ID NO: 103643 - RNA, 20 nt, Artificial Sequence
  MKO10103643_B_Olfr1308
  gRNA
guccauaaacacucuucaag

SEQ ID NO: 103644 - RNA, 20 nt, Artificial Sequence
  MKO10103644_B_Olfr1308
  gRNA
aucuaaucauuaugagccca

SEQ ID NO: 103645 - RNA, 20 nt, Artificial Sequence
  MKO10103645_B_Olfr1309
  gRNA
ggagacuauggggcuaucuu

SEQ ID NO: 103646 - RNA, 20 nt, Artificial Sequence
  MKO10103646_B_Olfr1309
  gRNA
cacguauagaaaaacauuag

SEQ ID NO: 103647 - RNA, 20 nt, Artificial Sequence
  MKO10103647_B_Olfr1309
  gRNA
aagcucuugaguguuugugc

SEQ ID NO: 103648 - RNA, 20 nt, Artificial Sequence
  MKO10103648_B_Olfr130
  gRNA
caaugaagugcagcuauuca

SEQ ID NO: 103649 - RNA, 20 nt, Artificial Sequence
  MKO10103649_B_Olfr130
  gRNA
cagcuccuaugcacacaguc

SEQ ID NO: 103650 - RNA, 20 nt, Artificial Sequence
  MKO10103650_B_Olfr130
  gRNA
aagcugaauagcacagccug

SEQ ID NO: 103651 - RNA, 20 nt, Artificial Sequence
  MKO10103651_B_Olfr1310
  gRNA
uugccuaauaggaaguacau

SEQ ID NO: 103652 - RNA, 20 nt, Artificial Sequence
  MKO10103652_B_Olfr1310
  gRNA
ggauuguaacugagggucug

SEQ ID NO: 103653 - RNA, 20 nt, Artificial Sequence
  MKO10103653_B_Olfr1310
  gRNA
gaugcaacccccaaaagaga

SEQ ID NO: 103654 - RNA, 20 nt, Artificial Sequence
  MKO10103654_B_Olfr1311
  gRNA
cacacucgcuauguagaaca

SEQ ID NO: 103655 - RNA, 20 nt, Artificial Sequence
  MKO10103655_B_Olfr1311
  gRNA
uugcacagagaccaguaaau

SEQ ID NO: 103656 - RNA, 20 nt, Artificial Sequence
  MKO10103656_B_Olfr1311
  gRNA
ccuuggacuuauucacucag

SEQ ID NO: 103657 - RNA, 20 nt, Artificial Sequence
  MKO10103657_B_Olfr1312
  gRNA
ugugacaauugcaucaaaua

SEQ ID NO: 103658 - RNA, 20 nt, Artificial Sequence
  MKO10103658_B_Olfr1312
  gRNA
aguaacaugagcugaaagug

SEQ ID NO: 103659 - RNA, 20 nt, Artificial Sequence
  MKO10103659_B_Olfr1312
  gRNA
acuuucagcucauguuacug

SEQ ID NO: 103660 - RNA, 20 nt, Artificial Sequence
  MKO10103660_B_Olfr1313
  gRNA
agaguauucagacaucuaau

SEQ ID NO: 103661 - RNA, 20 nt, Artificial Sequence
  MKO10103661_B_Olfr1313
  gRNA
guuauccucaguguuguaug

SEQ ID NO: 103662 - RNA, 20 nt, Artificial Sequence
  MKO10103662_B_Olfr1313
  gRNA
caagcaaguuugaugaauug

SEQ ID NO: 103663 - RNA, 20 nt, Artificial Sequence
  MKO10103663_B_Olfr1314
  gRNA
ugugucagaauuuauguucg

SEQ ID NO: 103664 - RNA, 20 nt, Artificial Sequence
  MKO10103664_B_Olfr1314
  gRNA
caacagcaucaaauauagcc

SEQ ID NO: 103665 - RNA, 20 nt, Artificial Sequence
  MKO10103665_B_Olfr1314
  gRNA
gagaagcacuugcaucuucc

SEQ ID NO: 103666 - RNA, 20 nt, Artificial Sequence
  MKO10103666_B_Olfr1316
  gRNA
uuccugaauguauagaucac

SEQ ID NO: 103667 - RNA, 20 nt, Artificial Sequence
  MKO10103667_B_Olfr1316
  gRNA
ucuucuuuguaguuauugcu

SEQ ID NO: 103668 - RNA, 20 nt, Artificial Sequence
  MKO10103668_B_Olfr1316
  gRNA
gcugagccagagaguguaua

SEQ ID NO: 103669 - RNA, 20 nt, Artificial Sequence
  MKO10103669_B_Olfr1317
  gRNA
agaugauuuaugaccucuuc

SEQ ID NO: 103670 - RNA, 20 nt, Artificial Sequence
  MKO10103670_B_Olfr1317
  gRNA
ugacuuugugcuuccugaag

SEQ ID NO: 103671 - RNA, 20 nt, Artificial Sequence
  MKO10103671_B_Olfr1317
  gRNA
uacuaggccucaccaauuca

SEQ ID NO: 103672 - RNA, 20 nt, Artificial Sequence
  MKO10103672_B_Olfr1318
  gRNA
ugugucuuacaucuucauuc

SEQ ID NO: 103673 - RNA, 20 nt, Artificial Sequence
  MKO10103673_B_Olfr1318
  gRNA
acuuagaaauaaugagauga

SEQ ID NO: 103674 - RNA, 20 nt, Artificial Sequence
  MKO10103674_B_Olfr1318
  gRNA
uuccuggucgcugccaacag

SEQ ID NO: 103675 - RNA, 20 nt, Artificial Sequence
  MKO10103675_B_Olfr131
  gRNA
acuucuuuguuaccucguug

SEQ ID NO: 103676 - RNA, 20 nt, Artificial Sequence
  MKO10103676_B_Olfr131
  gRNA
gucauaaaaguuaucccccu

SEQ ID NO: 103677 - RNA, 20 nt, Artificial Sequence
  MKO10103677_B_Olfr131
  gRNA
caucaguggauaugcauaca

SEQ ID NO: 103678 - RNA, 20 nt, Artificial Sequence
  MKO10103678_B_Olfr1320
  gRNA
cgcugaaaaaauuuagcauc

SEQ ID NO: 103679 - RNA, 20 nt, Artificial Sequence
  MKO10103679_B_Olfr1320
  gRNA
uggacuuacugcgggaacau

SEQ ID NO: 103680 - RNA, 20 nt, Artificial Sequence
  MKO10103680_B_Olfr1320
  gRNA
gccagaaaaugccacuaugg

SEQ ID NO: 103681 - RNA, 20 nt, Artificial Sequence
  MKO10103681_B_Olfr1321
  gRNA
gaugagaauauuccccauua

SEQ ID NO: 103682 - RNA, 20 nt, Artificial Sequence
  MKO10103682_B_Olfr1321
  gRNA
aaguuguauaccagaucuca

SEQ ID NO: 103683 - RNA, 20 nt, Artificial Sequence
  MKO10103683_B_Olfr1321
  gRNA
uuacccauaucuaugagauu

SEQ ID NO: 103684 - RNA, 20 nt, Artificial Sequence
  MKO10103684_B_Olfr1322
  gRNA
uaaaugauaggauuggcagc

SEQ ID NO: 103685 - RNA, 20 nt, Artificial Sequence
  MKO10103685_B_Olfr1322
  gRNA
ggguuguuuccagcuagcau

SEQ ID NO: 103686 - RNA, 20 nt, Artificial Sequence
  MKO10103686_B_Olfr1322
  gRNA
caauugagccuguaaugcug

SEQ ID NO: 103687 - RNA, 20 nt, Artificial Sequence
  MKO10103687_B_Olfr1323
  gRNA
caacuuguuaucucaacuac

SEQ ID NO: 103688 - RNA, 20 nt, Artificial Sequence
  MKO10103688_B_Olfr1323
  gRNA
ugcagucaagugugacgcac

SEQ ID NO: 103689 - RNA, 20 nt, Artificial Sequence
  MKO10103689_B_Olfr1323
  gRNA
guaaagcaauggccgacaga

SEQ ID NO: 103690 - RNA, 20 nt, Artificial Sequence
  MKO10103690_B_Olfr1324
  gRNA
ggaaauuguccaaguccacc

SEQ ID NO: 103691 - RNA, 20 nt, Artificial Sequence
  MKO10103691_B_Olfr1324
  gRNA
aauucaucuucaucguuaaa

SEQ ID NO: 103692 - RNA, 20 nt, Artificial Sequence
  MKO10103692_B_Olfr1324
  gRNA
uacagcagaaccaugcacca

SEQ ID NO: 103693 - RNA, 20 nt, Artificial Sequence
  MKO10103693_B_Olfr1325
  gRNA
uuuaagaauccauccaacua

SEQ ID NO: 103694 - RNA, 20 nt, Artificial Sequence
  MKO10103694_B_Olfr1325
  gRNA
augugccucucacuugauug

SEQ ID NO: 103695 - RNA, 20 nt, Artificial Sequence
  MKO10103695_B_Olfr1325
  gRNA
aguaaccacaaucaagugag

SEQ ID NO: 103696 - RNA, 20 nt, Artificial Sequence
  MKO10103696_B_Olfr1328
  gRNA
auagcgcaauggauagcaua

SEQ ID NO: 103697 - RNA, 20 nt, Artificial Sequence
  MKO10103697_B_Olfr1328
  gRNA
aaguacacucaguuauaccc

SEQ ID NO: 103698 - RNA, 20 nt, Artificial Sequence
  MKO10103698_B_Olfr1328
  gRNA
caaaguccaccaucucaaug

SEQ ID NO: 103699 - RNA, 20 nt, Artificial Sequence
  MKO10103699_B_Olfr1329
  gRNA
uguuccaauuucccuuauug

SEQ ID NO: 103700 - RNA, 20 nt, Artificial Sequence
  MKO10103700_B_Olfr1329
  gRNA
cucugucuugauugucauuu

SEQ ID NO: 103701 - RNA, 20 nt, Artificial Sequence
  MKO10103701_B_Olfr1329
  gRNA
uuccccugagcgagacaagc

SEQ ID NO: 103702 - RNA, 20 nt, Artificial Sequence
  MKO10103702_B_Olfr132
  gRNA
cuguuacuguaccauagaac

SEQ ID NO: 103703 - RNA, 20 nt, Artificial Sequence
  MKO10103703_B_Olfr132
  gRNA
uacuacccgcugagagcaaa

SEQ ID NO: 103704 - RNA, 20 nt, Artificial Sequence
  MKO10103704_B_Olfr132
  gRNA
uaauggccaaggguaacacu

SEQ ID NO: 103705 - RNA, 20 nt, Artificial Sequence
  MKO10103705_B_Olfr1330
  gRNA
cuguccuagaaccacccaca

SEQ ID NO: 103706 - RNA, 20 nt, Artificial Sequence
  MKO10103706_B_Olfr1330
  gRNA
agccuugcagcgccccucug

SEQ ID NO: 103707 - RNA, 20 nt, Artificial Sequence
  MKO10103707_B_Olfr1330
  gRNA
gggccucauguagauguaag

SEQ ID NO: 103708 - RNA, 20 nt, Artificial Sequence
  MKO10103708_B_Olfr1331
  gRNA
cugcugccaaccguaugcag

SEQ ID NO: 103709 - RNA, 20 nt, Artificial Sequence
  MKO10103709_B_Olfr1331
  gRNA
ucucaaaccaucuccuuuac

SEQ ID NO: 103710 - RNA, 20 nt, Artificial Sequence
  MKO10103710_B_Olfr1331
  gRNA
uaacaaaggucauauccaac

SEQ ID NO: 103711 - RNA, 20 nt, Artificial Sequence
  MKO10103711_B_Olfr1333
  gRNA
cggccucauguagauguaac

SEQ ID NO: 103712 - RNA, 20 nt, Artificial Sequence
  MKO10103712_B_Olfr1333
  gRNA
ugacaaagcucauauccaau

SEQ ID NO: 103713 - RNA, 20 nt, Artificial Sequence
  MKO10103713_B_Olfr1333
  gRNA
auaagccaucacaacaaaaa

SEQ ID NO: 103714 - RNA, 20 nt, Artificial Sequence
  MKO10103714_B_Olfr1335
  gRNA
uuguccugacauccuccaca

SEQ ID NO: 103715 - RNA, 20 nt, Artificial Sequence
  MKO10103715_B_Olfr1335
  gRNA
gucucuuucagaagagcugc

SEQ ID NO: 103716 - RNA, 20 nt, Artificial Sequence
  MKO10103716_B_Olfr1335
  gRNA
ucuauguguugucugacaca

SEQ ID NO: 103717 - RNA, 20 nt, Artificial Sequence
  MKO10103717_B_Olfr1336
  gRNA
cuuuccacagaaccaugcgc

SEQ ID NO: 103718 - RNA, 20 nt, Artificial Sequence
  MKO10103718_B_Olfr1336
  gRNA
auugcaagccuguccuauug

SEQ ID NO: 103719 - RNA, 20 nt, Artificial Sequence
  MKO10103719_B_Olfr1336
  gRNA
gccuagaacuguccuaccaa

SEQ ID NO: 103720 - RNA, 20 nt, Artificial Sequence
  MKO10103720_B_Olfr1337
  gRNA
cugagcucagguacaugaga

SEQ ID NO: 103721 - RNA, 20 nt, Artificial Sequence
  MKO10103721_B_Olfr1337
  gRNA
uggccucauguagauguaac

SEQ ID NO: 103722 - RNA, 20 nt, Artificial Sequence
  MKO10103722_B_Olfr1337
  gRNA
guuucugaguucaucuugau

SEQ ID NO: 103723 - RNA, 20 nt, Artificial Sequence
  MKO10103723_B_Olfr1338
  gRNA
uggccuaauguagauguaaa

SEQ ID NO: 103724 - RNA, 20 nt, Artificial Sequence
  MKO10103724_B_Olfr1338
  gRNA
gauguauauguucagugccc

SEQ ID NO: 103725 - RNA, 20 nt, Artificial Sequence
  MKO10103725_B_Olfr1338
  gRNA
uuucucaagguaaugggacu

SEQ ID NO: 103726 - RNA, 20 nt, Artificial Sequence
  MKO10103726_B_Olfr1339
  gRNA
agaugcagacguaagaggcc

SEQ ID NO: 103727 - RNA, 20 nt, Artificial Sequence
  MKO10103727_B_Olfr1339
  gRNA
guguauggagacgggagucc

SEQ ID NO: 103728 - RNA, 20 nt, Artificial Sequence
  MKO10103728_B_Olfr1339
  gRNA
aucaugaggccuuggcugug

SEQ ID NO: 103729 - RNA, 20 nt, Artificial Sequence
  MKO10103729_B_Olfr133
  gRNA
uaauauagacacgagaauga

SEQ ID NO: 103730 - RNA, 20 nt, Artificial Sequence
  MKO10103730_B_Olfr133
  gRNA
uagaugaagggguucaaugu

SEQ ID NO: 103731 - RNA, 20 nt, Artificial Sequence
  MKO10103731_B_Olfr133
  gRNA
cuuuaaaaucaaaucuucag

SEQ ID NO: 103732 - RNA, 20 nt, Artificial Sequence
  MKO10103732_B_Olfr1340
  gRNA
uaacaaugaguccauuaccc

SEQ ID NO: 103733 - RNA, 20 nt, Artificial Sequence
  MKO10103733_B_Olfr1340
  gRNA
auauguuauccacuccacua

SEQ ID NO: 103734 - RNA, 20 nt, Artificial Sequence
  MKO10103734_B_Olfr1340
  gRNA
acuaagacuaucucuuacac

SEQ ID NO: 103735 - RNA, 20 nt, Artificial Sequence
  MKO10103735_B_Olfr1341
  gRNA
cuucuagggacucauucugg

SEQ ID NO: 103736 - RNA, 20 nt, Artificial Sequence
  MKO10103736_B_Olfr1341
  gRNA
uacaucagucaaugaccaug

SEQ ID NO: 103737 - RNA, 20 nt, Artificial Sequence
  MKO10103737_B_Olfr1341
  gRNA
acccaaguaugaaguccaca

SEQ ID NO: 103738 - RNA, 20 nt, Artificial Sequence
  MKO10103738_B_Olfr1342
  gRNA
ggcgagagucuagguaaauc

SEQ ID NO: 103739 - RNA, 20 nt, Artificial Sequence
  MKO10103739_B_Olfr1342
  gRNA
cuuaagaauccgcucauccc

SEQ ID NO: 103740 - RNA, 20 nt, Artificial Sequence
  MKO10103740_B_Olfr1342
  gRNA
cacucugaccugggauucgc

SEQ ID NO: 103741 - RNA, 20 nt, Artificial Sequence
  MKO10103741_B_Olfr1344
  gRNA
gcugcgugccacaacguacc

SEQ ID NO: 103742 - RNA, 20 nt, Artificial Sequence
  MKO10103742_B_Olfr1344
  gRNA
cuacagccuucgaaaccgug

SEQ ID NO: 103743 - RNA, 20 nt, Artificial Sequence
  MKO10103743_B_Olfr1344
  gRNA
gcguagugcagccaccgcau

SEQ ID NO: 103744 - RNA, 20 nt, Artificial Sequence
  MKO10103744_B_Olfr1346
  gRNA
caccaugcccacccuacucg

SEQ ID NO: 103745 - RNA, 20 nt, Artificial Sequence
  MKO10103745_B_Olfr1346
  gRNA
aggccaauccccaacagacc

SEQ ID NO: 103746 - RNA, 20 nt, Artificial Sequence
  MKO10103746_B_Olfr1346
  gRNA
aguaaaaaagacccauuaca

SEQ ID NO: 103747 - RNA, 20 nt, Artificial Sequence
  MKO10103747_B_Olfr1347
  gRNA
auugcaagccugaucuacug

SEQ ID NO: 103748 - RNA, 20 nt, Artificial Sequence
  MKO10103748_B_Olfr1347
  gRNA
uugugucaugcaaguuauaa

SEQ ID NO: 103749 - RNA, 20 nt, Artificial Sequence
  MKO10103749_B_Olfr1347
  gRNA
aaccuaacagcacaaacugu

SEQ ID NO: 103750 - RNA, 20 nt, Artificial Sequence
  MKO10103750_B_Olfr1348
  gRNA
aggugggcugauugucucag

SEQ ID NO: 103751 - RNA, 20 nt, Artificial Sequence
  MKO10103751_B_Olfr1348
  gRNA
ggggccacaguaagacagac

SEQ ID NO: 103752 - RNA, 20 nt, Artificial Sequence
  MKO10103752_B_Olfr1348
  gRNA
uguucuccacaagugucagc

SEQ ID NO: 103753 - RNA, 20 nt, Artificial Sequence
  MKO10103753_B_Olfr1349
  gRNA
ggccaccguccucgucauca

SEQ ID NO: 103754 - RNA, 20 nt, Artificial Sequence
  MKO10103754_B_Olfr1349
  gRNA
agcuggccuuggggcgcaag

SEQ ID NO: 103755 - RNA, 20 nt, Artificial Sequence
  MKO10103755_B_Olfr1349
  gRNA
uccacagcauacacgcccaa

SEQ ID NO: 103756 - RNA, 20 nt, Artificial Sequence
  MKO10103756_B_Olfr134
  gRNA
gagaaccacaauuagaugag

SEQ ID NO: 103757 - RNA, 20 nt, Artificial Sequence
  MKO10103757_B_Olfr134
  gRNA
auguuccucucaucuaauug

SEQ ID NO: 103758 - RNA, 20 nt, Artificial Sequence
  MKO10103758_B_Olfr134
  gRNA
uaauauagacacgagaauua

SEQ ID NO: 103759 - RNA, 20 nt, Artificial Sequence
  MKO10103759_B_Olfr1350
  gRNA
uccguucugcagcuggccgc

SEQ ID NO: 103760 - RNA, 20 nt, Artificial Sequence
  MKO10103760_B_Olfr1350
  gRNA
ucugcggaagcuuuauccac

SEQ ID NO: 103761 - RNA, 20 nt, Artificial Sequence
  MKO10103761_B_Olfr1350
  gRNA
aucuacagaccccugacaua

SEQ ID NO: 103762 - RNA, 20 nt, Artificial Sequence
  MKO10103762_B_Olfr1351
  gRNA
ugacaucucucuuaaugaca

SEQ ID NO: 103763 - RNA, 20 nt, Artificial Sequence
  MKO10103763_B_Olfr1351
  gRNA
caggugggagucggcaguga

SEQ ID NO: 103764 - RNA, 20 nt, Artificial Sequence
  MKO10103764_B_Olfr1351
  gRNA
gaugcaguuugcauagguga

SEQ ID NO: 103765 - RNA, 20 nt, Artificial Sequence
  MKO10103765_B_Olfr1352
  gRNA
gaugcaaucugcauagcuaa

SEQ ID NO: 103766 - RNA, 20 nt, Artificial Sequence
  MKO10103766_B_Olfr1352
  gRNA
ugccuuguuacaaagcauga

SEQ ID NO: 103767 - RNA, 20 nt, Artificial Sequence
  MKO10103767_B_Olfr1352
  gRNA
caugaccacaucauugagaa

SEQ ID NO: 103768 - RNA, 20 nt, Artificial Sequence
  MKO10103768_B_Olfr1353
  gRNA
augauaacuguguagcgcau

SEQ ID NO: 103769 - RNA, 20 nt, Artificial Sequence
  MKO10103769_B_Olfr1353
  gRNA
aacuacaguguacgugacug

SEQ ID NO: 103770 - RNA, 20 nt, Artificial Sequence
  MKO10103770_B_Olfr1353
  gRNA
gaccugcaacccauuauuua

SEQ ID NO: 103771 - RNA, 20 nt, Artificial Sequence
  MKO10103771_B_Olfr1354
  gRNA
ugggaaccugcuuaucauca

SEQ ID NO: 103772 - RNA, 20 nt, Artificial Sequence
  MKO10103772_B_Olfr1354
  gRNA
ugaugaccaugaugauaagc

SEQ ID NO: 103773 - RNA, 20 nt, Artificial Sequence
  MKO10103773_B_Olfr1354
  gRNA
gguaaaacagauguccacaa

SEQ ID NO: 103774 - RNA, 20 nt, Artificial Sequence
  MKO10103774_B_Olfr1355
  gRNA
gugcaggggagacuguguga

SEQ ID NO: 103775 - RNA, 20 nt, Artificial Sequence
  MKO10103775_B_Olfr1355
  gRNA
acaaugacuguguaauacaa

SEQ ID NO: 103776 - RNA, 20 nt, Artificial Sequence
  MKO10103776_B_Olfr1355
  gRNA
uacaauugagcucuguaaga

SEQ ID NO: 103777 - RNA, 20 nt, Artificial Sequence
  MKO10103777_B_Olfr1356
  gRNA
caauuuacuccuaucaguga

SEQ ID NO: 103778 - RNA, 20 nt, Artificial Sequence
  MKO10103778_B_Olfr1356
  gRNA
cugccaucccuugcacuaug

SEQ ID NO: 103779 - RNA, 20 nt, Artificial Sequence
  MKO10103779_B_Olfr1356
  gRNA
uucuuauggaaguccuacca

SEQ ID NO: 103780 - RNA, 20 nt, Artificial Sequence
  MKO10103780_B_Olfr1357
  gRNA
caggugagagucugauauga

SEQ ID NO: 103781 - RNA, 20 nt, Artificial Sequence
  MKO10103781_B_Olfr1357
  gRNA
uagauaaagggguuuaaugu

SEQ ID NO: 103782 - RNA, 20 nt, Artificial Sequence
  MKO10103782_B_Olfr1357
  gRNA
augagcacugaguagcggag

SEQ ID NO: 103783 - RNA, 20 nt, Artificial Sequence
  MKO10103783_B_Olfr1359
  gRNA
aggccaggaaaaugaaaagc

SEQ ID NO: 103784 - RNA, 20 nt, Artificial Sequence
  MKO10103784_B_Olfr1359
  gRNA
uggccaaugagagcaucuca

SEQ ID NO: 103785 - RNA, 20 nt, Artificial Sequence
  MKO10103785_B_Olfr1359
  gRNA
acuuccuuguguccacacag

SEQ ID NO: 103786 - RNA, 20 nt, Artificial Sequence
  MKO10103786_B_Olfr135
  gRNA
caaagaccaucagcuacuug

SEQ ID NO: 103787 - RNA, 20 nt, Artificial Sequence
  MKO10103787_B_Olfr135
  gRNA
acucuguaccucccauugug

SEQ ID NO: 103788 - RNA, 20 nt, Artificial Sequence
  MKO10103788_B_Olfr135
  gRNA
ggucaaaggacauaagagcu

SEQ ID NO: 103789 - RNA, 20 nt, Artificial Sequence
  MKO10103789_B_Olfr1360
  gRNA
uggccaaugagagcaucuca

SEQ ID NO: 103790 - RNA, 20 nt, Artificial Sequence
  MKO10103790_B_Olfr1360
  gRNA
acuuccuuguguccacacag

SEQ ID NO: 103791 - RNA, 20 nt, Artificial Sequence
  MKO10103791_B_Olfr1360
  gRNA
uccaacaugcagccgccaac

SEQ ID NO: 103792 - RNA, 20 nt, Artificial Sequence
  MKO10103792_B_Olfr1361
  gRNA
cauauacauguaccuccagc

SEQ ID NO: 103793 - RNA, 20 nt, Artificial Sequence
  MKO10103793_B_Olfr1361
  gRNA
acauugcccgagcaguguuu

SEQ ID NO: 103794 - RNA, 20 nt, Artificial Sequence
  MKO10103794_B_Olfr1361
  gRNA
acuguacuuugucuuagccc

SEQ ID NO: 103795 - RNA, 20 nt, Artificial Sequence
  MKO10103795_B_Olfr1362
  gRNA
caccgggcgagcauccacac

SEQ ID NO: 103796 - RNA, 20 nt, Artificial Sequence
  MKO10103796_B_Olfr1362
  gRNA
gaggguccaauauacacacc

SEQ ID NO: 103797 - RNA, 20 nt, Artificial Sequence
  MKO10103797_B_Olfr1362
  gRNA
accauacucagagcugucgu

SEQ ID NO: 103798 - RNA, 20 nt, Artificial Sequence
  MKO10103798_B_Olfr1364
  gRNA
auguaaagggcgcacugaag

SEQ ID NO: 103799 - RNA, 20 nt, Artificial Sequence
  MKO10103799_B_Olfr1364
  gRNA
guugaggagucccacacucc

SEQ ID NO: 103800 - RNA, 20 nt, Artificial Sequence
  MKO10103800_B_Olfr1364
  gRNA
uguaacugaugcucuugucc

SEQ ID NO: 103801 - RNA, 20 nt, Artificial Sequence
  MKO10103801_B_Olfr1366
  gRNA
uaccagucucaaucaguuga

SEQ ID NO: 103802 - RNA, 20 nt, Artificial Sequence
  MKO10103802_B_Olfr1366
  gRNA
uuccuaugucucuauuuaac

SEQ ID NO: 103803 - RNA, 20 nt, Artificial Sequence
  MKO10103803_B_Olfr1366
  gRNA
guaggagauggacugagacu

SEQ ID NO: 103804 - RNA, 20 nt, Artificial Sequence
  MKO10103804_B_Olfr1367
  gRNA
acuguaguagugaguuagcc

SEQ ID NO: 103805 - RNA, 20 nt, Artificial Sequence
  MKO10103805_B_Olfr1367
  gRNA
uaaaguaaccucauugacug

SEQ ID NO: 103806 - RNA, 20 nt, Artificial Sequence
  MKO10103806_B_Olfr1367
  gRNA
ucauauccccuuaguugaaa

SEQ ID NO: 103807 - RNA, 20 nt, Artificial Sequence
  MKO10103807_B_Olfr1368
  gRNA
caagccaucuugaucaaugc

SEQ ID NO: 103808 - RNA, 20 nt, Artificial Sequence
  MKO10103808_B_Olfr1368
  gRNA
cagagaugaugugcuccagu

SEQ ID NO: 103809 - RNA, 20 nt, Artificial Sequence
  MKO10103809_B_Olfr1368
  gRNA
ccaaagaagucuauuacaua

SEQ ID NO: 103810 - RNA, 20 nt, Artificial Sequence
  MKO10103810_B_Olfr136
  gRNA
acauuacaauugccauugug

SEQ ID NO: 103811 - RNA, 20 nt, Artificial Sequence
  MKO10103811_B_Olfr136
  gRNA
cuaacaaaaugcacacucuu

SEQ ID NO: 103812 - RNA, 20 nt, Artificial Sequence
  MKO10103812_B_Olfr136
  gRNA
gcuguggagacgagggucua

SEQ ID NO: 103813 - RNA, 20 nt, Artificial Sequence
  MKO10103813_B_Olfr1370
  gRNA
cuguauccuccucgugucca

SEQ ID NO: 103814 - RNA, 20 nt, Artificial Sequence
  MKO10103814_B_Olfr1370
  gRNA
gcaugaucgcuggguaccuu

SEQ ID NO: 103815 - RNA, 20 nt, Artificial Sequence
  MKO10103815_B_Olfr1370
  gRNA
uguacguacaugcuaauuac

SEQ ID NO: 103816 - RNA, 20 nt, Artificial Sequence
  MKO10103816_B_Olfr1371
  gRNA
aggaacugagugugugcuuu

SEQ ID NO: 103817 - RNA, 20 nt, Artificial Sequence
  MKO10103817_B_Olfr1371
  gRNA
acagaggcauggccaucaca

SEQ ID NO: 103818 - RNA, 20 nt, Artificial Sequence
  MKO10103818_B_Olfr1371
  gRNA
cccuguucucugcagagcau

SEQ ID NO: 103819 - RNA, 20 nt, Artificial Sequence
  MKO10103819_B_Olfr1373
  gRNA
cagugcuggcgguguagcag

SEQ ID NO: 103820 - RNA, 20 nt, Artificial Sequence
  MKO10103820_B_Olfr1373
  gRNA
aguaguacaugagugugugc

SEQ ID NO: 103821 - RNA, 20 nt, Artificial Sequence
  MKO10103821_B_Olfr1373
  gRNA
cuauuugaacaccaguucag

SEQ ID NO: 103822 - RNA, 20 nt, Artificial Sequence
  MKO10103822_B_Olfr1377
  gRNA
aaggacgcauguagacaccc

SEQ ID NO: 103823 - RNA, 20 nt, Artificial Sequence
  MKO10103823_B_Olfr1377
  gRNA
ggcuacugucaucuuuacag

SEQ ID NO: 103824 - RNA, 20 nt, Artificial Sequence
  MKO10103824_B_Olfr1377
  gRNA
aggauaugaaaggagcccua

SEQ ID NO: 103825 - RNA, 20 nt, Artificial Sequence
  MKO10103825_B_Olfr1378
  gRNA
cuuugacaucacgauuccuc

SEQ ID NO: 103826 - RNA, 20 nt, Artificial Sequence
  MKO10103826_B_Olfr1378
  gRNA
aauugcugggcagucaaagg

SEQ ID NO: 103827 - RNA, 20 nt, Artificial Sequence
  MKO10103827_B_Olfr1378
  gRNA
uguacugaauauguagacga

SEQ ID NO: 103828 - RNA, 20 nt, Artificial Sequence
  MKO10103828_B_Olfr137
  gRNA
uuccaggacaguccaugcaa

SEQ ID NO: 103829 - RNA, 20 nt, Artificial Sequence
  MKO10103829_B_Olfr137
  gRNA
cccagcugcuauuuaaccuc

SEQ ID NO: 103830 - RNA, 20 nt, Artificial Sequence
  MKO10103830_B_Olfr137
  gRNA
cccagagguuaaauagcagc

SEQ ID NO: 103831 - RNA, 20 nt, Artificial Sequence
  MKO10103831_B_Olfr1380
  gRNA
gaucaucauccugucucaac

SEQ ID NO: 103832 - RNA, 20 nt, Artificial Sequence
  MKO10103832_B_Olfr1380
  gRNA
uuccucagcguauagaucag

SEQ ID NO: 103833 - RNA, 20 nt, Artificial Sequence
  MKO10103833_B_Olfr1380
  gRNA
uuugaacaccaguucagaag

SEQ ID NO: 103834 - RNA, 20 nt, Artificial Sequence
  MKO10103834_B_Olfr1381
  gRNA
cacagaagaagugauucagu

SEQ ID NO: 103835 - RNA, 20 nt, Artificial Sequence
  MKO10103835_B_Olfr1381
  gRNA
aggaacugagugugugcuuu

SEQ ID NO: 103836 - RNA, 20 nt, Artificial Sequence
  MKO10103836_B_Olfr1381
  gRNA
acagaggcauggccaucaca

SEQ ID NO: 103837 - RNA, 20 nt, Artificial Sequence
  MKO10103837_B_Olfr1382
  gRNA
acccucugaucuauacguug

SEQ ID NO: 103838 - RNA, 20 nt, Artificial Sequence
  MKO10103838_B_Olfr1382
  gRNA
agguuggagguacguggaga

SEQ ID NO: 103839 - RNA, 20 nt, Artificial Sequence
  MKO10103839_B_Olfr1382
  gRNA
gugagagcauuaugaagagc

SEQ ID NO: 103840 - RNA, 20 nt, Artificial Sequence
  MKO10103840_B_Olfr1383
  gRNA
aaaaagauauguuccaguug

SEQ ID NO: 103841 - RNA, 20 nt, Artificial Sequence
  MKO10103841_B_Olfr1383
  gRNA
cauucgugagauugugauga

SEQ ID NO: 103842 - RNA, 20 nt, Artificial Sequence
  MKO10103842_B_Olfr1383
  gRNA
caaccuguccauguguauuc

SEQ ID NO: 103843 - RNA, 20 nt, Artificial Sequence
  MKO10103843_B_Olfr1384
  gRNA
guucuucauagcacucuuac

SEQ ID NO: 103844 - RNA, 20 nt, Artificial Sequence
  MKO10103844_B_Olfr1384
  gRNA
cuucuaaucagucuuucccg

SEQ ID NO: 103845 - RNA, 20 nt, Artificial Sequence
  MKO10103845_B_Olfr1384
  gRNA
aggcuggagauacguguaca

SEQ ID NO: 103846 - RNA, 20 nt, Artificial Sequence
  MKO10103846_B_Olfr1385
  gRNA
cagcuucucauaaaucuuca

SEQ ID NO: 103847 - RNA, 20 nt, Artificial Sequence
  MKO10103847_B_Olfr1385
  gRNA
acucucagaauaacugcucu

SEQ ID NO: 103848 - RNA, 20 nt, Artificial Sequence
  MKO10103848_B_Olfr1385
  gRNA
agcaguuauucugagaguga

SEQ ID NO: 103849 - RNA, 20 nt, Artificial Sequence
  MKO10103849_B_Olfr1386
  gRNA
gcuuucagaauaacugcucu

SEQ ID NO: 103850 - RNA, 20 nt, Artificial Sequence
  MKO10103850_B_Olfr1386
  gRNA
gagcaguuauucugaaagca

SEQ ID NO: 103851 - RNA, 20 nt, Artificial Sequence
  MKO10103851_B_Olfr1386
  gRNA
cagcuccucaucaaccucua

SEQ ID NO: 103852 - RNA, 20 nt, Artificial Sequence
  MKO10103852_B_Olfr1387
  gRNA
uuaugaaccccauccucugc

SEQ ID NO: 103853 - RNA, 20 nt, Artificial Sequence
  MKO10103853_B_Olfr1387
  gRNA
acauagguuugugcagucga

SEQ ID NO: 103854 - RNA, 20 nt, Artificial Sequence
  MKO10103854_B_Olfr1387
  gRNA
agccuuagcaaugugaacau

SEQ ID NO: 103855 - RNA, 20 nt, Artificial Sequence
  MKO10103855_B_Olfr1388
  gRNA
ggcagaccaaaacuauuguu

SEQ ID NO: 103856 - RNA, 20 nt, Artificial Sequence
  MKO10103856_B_Olfr1388
  gRNA
guuccuaugcucauaucacc

SEQ ID NO: 103857 - RNA, 20 nt, Artificial Sequence
  MKO10103857_B_Olfr1388
  gRNA
ucacaccuauucugaaagug

SEQ ID NO: 103858 - RNA, 20 nt, Artificial Sequence
  MKO10103858_B_Olfr1389
  gRNA
agaagaagugauucagccga

SEQ ID NO: 103859 - RNA, 20 nt, Artificial Sequence
  MKO10103859_B_Olfr1389
  gRNA
cuuuccugcugcacugauuc

SEQ ID NO: 103860 - RNA, 20 nt, Artificial Sequence
  MKO10103860_B_Olfr1389
  gRNA
uaugcacccucagcuguguc

SEQ ID NO: 103861 - RNA, 20 nt, Artificial Sequence
  MKO10103861_B_Olfr138
  gRNA
gcuguagagacgagggucua

SEQ ID NO: 103862 - RNA, 20 nt, Artificial Sequence
  MKO10103862_B_Olfr138
  gRNA
agccuucuucaucuaucaca

SEQ ID NO: 103863 - RNA, 20 nt, Artificial Sequence
  MKO10103863_B_Olfr138
  gRNA
ucccuugugauagaugaaga

SEQ ID NO: 103864 - RNA, 20 nt, Artificial Sequence
  MKO10103864_B_Olfr1390
  gRNA
ccagcuucugauuaaccucc

SEQ ID NO: 103865 - RNA, 20 nt, Artificial Sequence
  MKO10103865_B_Olfr1390
  gRNA
acgaaacaauagcuagugag

SEQ ID NO: 103866 - RNA, 20 nt, Artificial Sequence
  MKO10103866_B_Olfr1390
  gRNA
ccuggagguuaaucagaagc

SEQ ID NO: 103867 - RNA, 20 nt, Artificial Sequence
  MKO10103867_B_Olfr1391
  gRNA
caucaucgcucugucacaac

SEQ ID NO: 103868 - RNA, 20 nt, Artificial Sequence
  MKO10103868_B_Olfr1391
  gRNA
caguugugacagagcgauga

SEQ ID NO: 103869 - RNA, 20 nt, Artificial Sequence
  MKO10103869_B_Olfr1391
  gRNA
gggaagcuuuaaugccaguu

SEQ ID NO: 103870 - RNA, 20 nt, Artificial Sequence
  MKO10103870_B_Olfr1392
  gRNA
caucaucgcucucucccgaa

SEQ ID NO: 103871 - RNA, 20 nt, Artificial Sequence
  MKO10103871_B_Olfr1392
  gRNA
cauucgggagagagcgauga

SEQ ID NO: 103872 - RNA, 20 nt, Artificial Sequence
  MKO10103872_B_Olfr1392
  gRNA
aaaaagaugaguucuagugc

SEQ ID NO: 103873 - RNA, 20 nt, Artificial Sequence
  MKO10103873_B_Olfr1393
  gRNA
aaugaagccuccucccaaac

SEQ ID NO: 103874 - RNA, 20 nt, Artificial Sequence
  MKO10103874_B_Olfr1393
  gRNA
gcuguuuauauuucuugcuc

SEQ ID NO: 103875 - RNA, 20 nt, Artificial Sequence
  MKO10103875_B_Olfr1393
  gRNA
cagcuccucaucaaccugca

SEQ ID NO: 103876 - RNA, 20 nt, Artificial Sequence
  MKO10103876_B_Olfr1394
  gRNA
ccccagugguguucuagccg

SEQ ID NO: 103877 - RNA, 20 nt, Artificial Sequence
  MKO10103877_B_Olfr1394
  gRNA
cccguaguagaggcccacca

SEQ ID NO: 103878 - RNA, 20 nt, Artificial Sequence
  MKO10103878_B_Olfr1394
  gRNA
gggaagcucaucucgcuggg

SEQ ID NO: 103879 - RNA, 20 nt, Artificial Sequence
  MKO10103879_B_Olfr1395
  gRNA
guugagcaugggcgugauca

SEQ ID NO: 103880 - RNA, 20 nt, Artificial Sequence
  MKO10103880_B_Olfr1395
  gRNA
ccugguagaugggcugaucc

SEQ ID NO: 103881 - RNA, 20 nt, Artificial Sequence
  MKO10103881_B_Olfr1395
  gRNA
guagcggggucuuggcucuu

SEQ ID NO: 103882 - RNA, 20 nt, Artificial Sequence
  MKO10103882_B_Olfr1396
  gRNA
uccuaggaugcggguauaag

SEQ ID NO: 103883 - RNA, 20 nt, Artificial Sequence
  MKO10103883_B_Olfr1396
  gRNA
cagaccaucugcuaucccaa

SEQ ID NO: 103884 - RNA, 20 nt, Artificial Sequence
  MKO10103884_B_Olfr1396
  gRNA
gccucuuauacccgcauccu

SEQ ID NO: 103885 - RNA, 20 nt, Artificial Sequence
  MKO10103885_B_Olfr139
  gRNA
ggacacugagauaaguauca

SEQ ID NO: 103886 - RNA, 20 nt, Artificial Sequence
  MKO10103886_B_Olfr139
  gRNA
caaaaagcaguugcccauug

SEQ ID NO: 103887 - RNA, 20 nt, Artificial Sequence
  MKO10103887_B_Olfr139
  gRNA
gaacucugcacucaugagcc

SEQ ID NO: 103888 - RNA, 20 nt, Artificial Sequence
  MKO10103888_B_Olfr13
  gRNA
ggguccaacguacaugacaa

SEQ ID NO: 103889 - RNA, 20 nt, Artificial Sequence
  MKO10103889_B_Olfr13
  gRNA
aggacaucaccacuaggaga

SEQ ID NO: 103890 - RNA, 20 nt, Artificial Sequence
  MKO10103890_B_Olfr13
  gRNA
ugcauaagagaccacaauug

SEQ ID NO: 103891 - RNA, 20 nt, Artificial Sequence
  MKO10103891_B_Olfr1402
  gRNA
ggugcgcugagaaaacugac

SEQ ID NO: 103892 - RNA, 20 nt, Artificial Sequence
  MKO10103892_B_Olfr1402
  gRNA
gccuuccuuaacaauagcag

SEQ ID NO: 103893 - RNA, 20 nt, Artificial Sequence
  MKO10103893_B_Olfr1402
  gRNA
cuaucaugaguguguucccc

SEQ ID NO: 103894 - RNA, 20 nt, Artificial Sequence
  MKO10103894_B_Olfr1404
  gRNA
ccaugaugacugaauaccuu

SEQ ID NO: 103895 - RNA, 20 nt, Artificial Sequence
  MKO10103895_B_Olfr1404
  gRNA
auacacucugcggaauaagg

SEQ ID NO: 103896 - RNA, 20 nt, Artificial Sequence
  MKO10103896_B_Olfr1404
  gRNA
ucugccacauggcucugcgu

SEQ ID NO: 103897 - RNA, 20 nt, Artificial Sequence
  MKO10103897_B_Olfr1406
  gRNA
guacaggccagaucuaaaau

SEQ ID NO: 103898 - RNA, 20 nt, Artificial Sequence
  MKO10103898_B_Olfr1406
  gRNA
ucacugagaucaacugaucc

SEQ ID NO: 103899 - RNA, 20 nt, Artificial Sequence
  MKO10103899_B_Olfr1406
  gRNA
uguccuauauauccugacuc

SEQ ID NO: 103900 - RNA, 20 nt, Artificial Sequence
  MKO10103900_B_Olfr1408
  gRNA
uuucuuaggcuauacacaac

SEQ ID NO: 103901 - RNA, 20 nt, Artificial Sequence
  MKO10103901_B_Olfr1408
  gRNA
ugacauugccagucagcguc

SEQ ID NO: 103902 - RNA, 20 nt, Artificial Sequence
  MKO10103902_B_Olfr1408
  gRNA
gaaucacuacuacagucaga

SEQ ID NO: 103903 - RNA, 20 nt, Artificial Sequence
  MKO10103903_B_Olfr140
  gRNA
caaacaacauccucugcacc

SEQ ID NO: 103904 - RNA, 20 nt, Artificial Sequence
  MKO10103904_B_Olfr140
  gRNA
gcgcaggaugacaauguacg

SEQ ID NO: 103905 - RNA, 20 nt, Artificial Sequence
  MKO10103905_B_Olfr140
  gRNA
guucuuuguggcucauuuau

SEQ ID NO: 103906 - RNA, 20 nt, Artificial Sequence
  MKO10103906_B_Olfr1410
  gRNA
gaccugugcccgucuugucc

SEQ ID NO: 103907 - RNA, 20 nt, Artificial Sequence
  MKO10103907_B_Olfr1410
  gRNA
aagcucauugauagcugugc

SEQ ID NO: 103908 - RNA, 20 nt, Artificial Sequence
  MKO10103908_B_Olfr1410
  gRNA
ugucauuaucccuaaugccc

SEQ ID NO: 103909 - RNA, 20 nt, Artificial Sequence
  MKO10103909_B_Olfr1411
  gRNA
guucaggcagccaccacagu

SEQ ID NO: 103910 - RNA, 20 nt, Artificial Sequence
  MKO10103910_B_Olfr1411
  gRNA
gauaucugucuucuacaccc

SEQ ID NO: 103911 - RNA, 20 nt, Artificial Sequence
  MKO10103911_B_Olfr1411
  gRNA
ccaggauggugaccacguac

SEQ ID NO: 103912 - RNA, 20 nt, Artificial Sequence
  MKO10103912_B_Olfr1412
  gRNA
agccucacuuguucccagaa

SEQ ID NO: 103913 - RNA, 20 nt, Artificial Sequence
  MKO10103913_B_Olfr1412
  gRNA
accagcaacuccaaugacuu

SEQ ID NO: 103914 - RNA, 20 nt, Artificial Sequence
  MKO10103914_B_Olfr1412
  gRNA
ccaggacggucaccauguac

SEQ ID NO: 103915 - RNA, 20 nt, Artificial Sequence
  MKO10103915_B_Olfr1413
  gRNA
ccaggacggucacuacauac

SEQ ID NO: 103916 - RNA, 20 nt, Artificial Sequence
  MKO10103916_B_Olfr1413
  gRNA
augugaaggacgccccgagg

SEQ ID NO: 103917 - RNA, 20 nt, Artificial Sequence
  MKO10103917_B_Olfr1413
  gRNA
agccuucaguuguaaccaga

SEQ ID NO: 103918 - RNA, 20 nt, Artificial Sequence
  MKO10103918_B_Olfr1414
  gRNA
aggaagccguccagcaucuu

SEQ ID NO: 103919 - RNA, 20 nt, Artificial Sequence
  MKO10103919_B_Olfr1414
  gRNA
cuugggucaagcucccuugu

SEQ ID NO: 103920 - RNA, 20 nt, Artificial Sequence
  MKO10103920_B_Olfr1414
  gRNA
acaaacauaccagaucucca

SEQ ID NO: 103921 - RNA, 20 nt, Artificial Sequence
  MKO10103921_B_Olfr1415
  gRNA
uuggccaccauucuuuccua

SEQ ID NO: 103922 - RNA, 20 nt, Artificial Sequence
  MKO10103922_B_Olfr1415
  gRNA
aggaaacgcaucucuuucac

SEQ ID NO: 103923 - RNA, 20 nt, Artificial Sequence
  MKO10103923_B_Olfr1415
  gRNA
cuucacagucucugugauua

SEQ ID NO: 103924 - RNA, 20 nt, Artificial Sequence
  MKO10103924_B_Olfr1416
  gRNA
uuggccaccauucucuccua

SEQ ID NO: 103925 - RNA, 20 nt, Artificial Sequence
  MKO10103925_B_Olfr1416
  gRNA
ucgcacauacaugaagauca

SEQ ID NO: 103926 - RNA, 20 nt, Artificial Sequence
  MKO10103926_B_Olfr1416
  gRNA
cuucaccaucucugugauua

SEQ ID NO: 103927 - RNA, 20 nt, Artificial Sequence
  MKO10103927_B_Olfr1417
  gRNA
acugccuuucuguagcagua

SEQ ID NO: 103928 - RNA, 20 nt, Artificial Sequence
  MKO10103928_B_Olfr1417
  gRNA
accguuguccuccugcagua

SEQ ID NO: 103929 - RNA, 20 nt, Artificial Sequence
  MKO10103929_B_Olfr1417
  gRNA
gacacugaccacaaacagag

SEQ ID NO: 103930 - RNA, 20 nt, Artificial Sequence
  MKO10103930_B_Olfr1418
  gRNA
gauauacccucaucaugagc

SEQ ID NO: 103931 - RNA, 20 nt, Artificial Sequence
  MKO10103931_B_Olfr1418
  gRNA
auucagcacaggggugauga

SEQ ID NO: 103932 - RNA, 20 nt, Artificial Sequence
  MKO10103932_B_Olfr1418
  gRNA
auugccuuucuguagcagua

SEQ ID NO: 103933 - RNA, 20 nt, Artificial Sequence
  MKO10103933_B_Olfr1419
  gRNA
gcauuguggcuaccauccug

SEQ ID NO: 103934 - RNA, 20 nt, Artificial Sequence
  MKO10103934_B_Olfr1419
  gRNA
cucauuggaaaccucaccau

SEQ ID NO: 103935 - RNA, 20 nt, Artificial Sequence
  MKO10103935_B_Olfr1419
  gRNA
ccucugcugacgucauccuc

SEQ ID NO: 103936 - RNA, 20 nt, Artificial Sequence
  MKO10103936_B_Olfr141
  gRNA
auaaagccuacuagcauauu

SEQ ID NO: 103937 - RNA, 20 nt, Artificial Sequence
  MKO10103937_B_Olfr141
  gRNA
ucaucuucagaauugacaac

SEQ ID NO: 103938 - RNA, 20 nt, Artificial Sequence
  MKO10103938_B_Olfr141
  gRNA
cuuaucauugcauccuaugc

SEQ ID NO: 103939 - RNA, 20 nt, Artificial Sequence
  MKO10103939_B_Olfr1420
  gRNA
caugccugcagucauacgcc

SEQ ID NO: 103940 - RNA, 20 nt, Artificial Sequence
  MKO10103940_B_Olfr1420
  gRNA
cugcuccucucacaucguag

SEQ ID NO: 103941 - RNA, 20 nt, Artificial Sequence
  MKO10103941_B_Olfr1420
  gRNA
cguccauucucaccugaccc

SEQ ID NO: 103942 - RNA, 20 nt, Artificial Sequence
  MKO10103942_B_Olfr1423
  gRNA
cugugggacaucgcaguaga

SEQ ID NO: 103943 - RNA, 20 nt, Artificial Sequence
  MKO10103943_B_Olfr1423
  gRNA
cagcccucaucgcggccucc

SEQ ID NO: 103944 - RNA, 20 nt, Artificial Sequence
  MKO10103944_B_Olfr1423
  gRNA
ugaccaucaugaguaguaag

SEQ ID NO: 103945 - RNA, 20 nt, Artificial Sequence
  MKO10103945_B_Olfr1424
  gRNA
augcauccacucccccaaua

SEQ ID NO: 103946 - RNA, 20 nt, Artificial Sequence
  MKO10103946_B_Olfr1424
  gRNA
gaaaauaaguucuuugaucc

SEQ ID NO: 103947 - RNA, 20 nt, Artificial Sequence
  MKO10103947_B_Olfr1424
  gRNA
gacagagaugacuuuaucug

SEQ ID NO: 103948 - RNA, 20 nt, Artificial Sequence
  MKO10103948_B_Olfr1425
  gRNA
gagaagguccaccagaaccu

SEQ ID NO: 103949 - RNA, 20 nt, Artificial Sequence
  MKO10103949_B_Olfr1425
  gRNA
accccuugaucuacacucua

SEQ ID NO: 103950 - RNA, 20 nt, Artificial Sequence
  MKO10103950_B_Olfr1425
  gRNA
cagaggggagaugacuguaa

SEQ ID NO: 103951 - RNA, 20 nt, Artificial Sequence
  MKO10103951_B_Olfr1426
  gRNA
augagauggaaaacuacacc

SEQ ID NO: 103952 - RNA, 20 nt, Artificial Sequence
  MKO10103952_B_Olfr1426
  gRNA
gcaacgcccucugcucauga

SEQ ID NO: 103953 - RNA, 20 nt, Artificial Sequence
  MKO10103953_B_Olfr1426
  gRNA
gagaaggucuaccagaaccu

SEQ ID NO: 103954 - RNA, 20 nt, Artificial Sequence
  MKO10103954_B_Olfr1427
  gRNA
ugucagugcaggcgaguuug

SEQ ID NO: 103955 - RNA, 20 nt, Artificial Sequence
  MKO10103955_B_Olfr1427
  gRNA
gcaccgcccucuacucauga

SEQ ID NO: 103956 - RNA, 20 nt, Artificial Sequence
  MKO10103956_B_Olfr1427
  gRNA
aucgauacauggccaucuuc

SEQ ID NO: 103957 - RNA, 20 nt, Artificial Sequence
  MKO10103957_B_Olfr1428
  gRNA
gaagacgaauucuuucacau

SEQ ID NO: 103958 - RNA, 20 nt, Artificial Sequence
  MKO10103958_B_Olfr1428
  gRNA
gcagggguuuagcaauugca

SEQ ID NO: 103959 - RNA, 20 nt, Artificial Sequence
  MKO10103959_B_Olfr1428
  gRNA
uguuccgucccuccccagaa

SEQ ID NO: 103960 - RNA, 20 nt, Artificial Sequence
  MKO10103960_B_Olfr142
  gRNA
gggcaacagucuuauucuug

SEQ ID NO: 103961 - RNA, 20 nt, Artificial Sequence
  MKO10103961_B_Olfr142
  gRNA
uuuauugugauggccaacag

SEQ ID NO: 103962 - RNA, 20 nt, Artificial Sequence
  MKO10103962_B_Olfr142
  gRNA
cacaagcuuaucuucaguga

SEQ ID NO: 103963 - RNA, 20 nt, Artificial Sequence
  MKO10103963_B_Olfr1431
  gRNA
cuguggaaguaacaaagcag

SEQ ID NO: 103964 - RNA, 20 nt, Artificial Sequence
  MKO10103964_B_Olfr1431
  gRNA
cacaucugucuucuacacug

SEQ ID NO: 103965 - RNA, 20 nt, Artificial Sequence
  MKO10103965_B_Olfr1431
  gRNA
agcuacacagcaggacucac

SEQ ID NO: 103966 - RNA, 20 nt, Artificial Sequence
  MKO10103966_B_Olfr1433
  gRNA
uauaaacgccuuagccauca

SEQ ID NO: 103967 - RNA, 20 nt, Artificial Sequence
  MKO10103967_B_Olfr1433
  gRNA
ugcaucugucuucuauagug

SEQ ID NO: 103968 - RNA, 20 nt, Artificial Sequence
  MKO10103968_B_Olfr1433
  gRNA
aaaaagguaaucugcagcua

SEQ ID NO: 103969 - RNA, 20 nt, Artificial Sequence
  MKO10103969_B_Olfr1434
  gRNA
uauaaacgccuuagccauca

SEQ ID NO: 103970 - RNA, 20 nt, Artificial Sequence
  MKO10103970_B_Olfr1434
  gRNA
ugcaucugucuucuauagug

SEQ ID NO: 103971 - RNA, 20 nt, Artificial Sequence
  MKO10103971_B_Olfr1434
  gRNA
aaaaagguaaucugcagcua

SEQ ID NO: 103972 - RNA, 20 nt, Artificial Sequence
  MKO10103972_B_Olfr1436
  gRNA
gugcuguaauauacagugua

SEQ ID NO: 103973 - RNA, 20 nt, Artificial Sequence
  MKO10103973_B_Olfr1436
  gRNA
acuaaaauagacaaaagcag

SEQ ID NO: 103974 - RNA, 20 nt, Artificial Sequence
  MKO10103974_B_Olfr1436
  gRNA
augcugcagcuccacuucug

SEQ ID NO: 103975 - RNA, 20 nt, Artificial Sequence
  MKO10103975_B_Olfr1437
  gRNA
acccacacuuugcgcucaga

SEQ ID NO: 103976 - RNA, 20 nt, Artificial Sequence
  MKO10103976_B_Olfr1437
  gRNA
auacuuuauguuugccacaa

SEQ ID NO: 103977 - RNA, 20 nt, Artificial Sequence
  MKO10103977_B_Olfr1437
  gRNA
gauuccuauguugaacccuu

SEQ ID NO: 103978 - RNA, 20 nt, Artificial Sequence
  MKO10103978_B_Olfr143
  gRNA
gagaagaauaccaucucuuu

SEQ ID NO: 103979 - RNA, 20 nt, Artificial Sequence
  MKO10103979_B_Olfr143
  gRNA
accaucuucugcuaagacug

SEQ ID NO: 103980 - RNA, 20 nt, Artificial Sequence
  MKO10103980_B_Olfr143
  gRNA
cccacagucuuagcagaaga

SEQ ID NO: 103981 - RNA, 20 nt, Artificial Sequence
  MKO10103981_B_Olfr1440
  gRNA
acccaagagaccaguacuau

SEQ ID NO: 103982 - RNA, 20 nt, Artificial Sequence
  MKO10103982_B_Olfr1440
  gRNA
ugggccucaucaucuugauu

SEQ ID NO: 103983 - RNA, 20 nt, Artificial Sequence
  MKO10103983_B_Olfr1440
  gRNA
ugugccaaugauauaaccau

SEQ ID NO: 103984 - RNA, 20 nt, Artificial Sequence
  MKO10103984_B_Olfr1441
  gRNA
cagccaaguagugaacuucc

SEQ ID NO: 103985 - RNA, 20 nt, Artificial Sequence
  MKO10103985_B_Olfr1441
  gRNA
cuguauagcacagccuauaa

SEQ ID NO: 103986 - RNA, 20 nt, Artificial Sequence
  MKO10103986_B_Olfr1441
  gRNA
gguguaugagacaucaacaa

SEQ ID NO: 103987 - RNA, 20 nt, Artificial Sequence
  MKO10103987_B_Olfr1442
  gRNA
aucuauuucaccaaugugau

SEQ ID NO: 103988 - RNA, 20 nt, Artificial Sequence
  MKO10103988_B_Olfr1442
  gRNA
agugagauaguacucauuua

SEQ ID NO: 103989 - RNA, 20 nt, Artificial Sequence
  MKO10103989_B_Olfr1442
  gRNA
aauaacagucccguagaaaa

SEQ ID NO: 103990 - RNA, 20 nt, Artificial Sequence
  MKO10103990_B_Olfr1443
  gRNA
ugaaguagauaagagugaac

SEQ ID NO: 103991 - RNA, 20 nt, Artificial Sequence
  MKO10103991_B_Olfr1443
  gRNA
cugugauguuccagccguca

SEQ ID NO: 103992 - RNA, 20 nt, Artificial Sequence
  MKO10103992_B_Olfr1443
  gRNA
aggaguaaaagaugucuacc

SEQ ID NO: 103993 - RNA, 20 nt, Artificial Sequence
  MKO10103993_B_Olfr1444
  gRNA
cagcauggauugaggcauua

SEQ ID NO: 103994 - RNA, 20 nt, Artificial Sequence
  MKO10103994_B_Olfr1444
  gRNA
ugaguaucccagaucuacaa

SEQ ID NO: 103995 - RNA, 20 nt, Artificial Sequence
  MKO10103995_B_Olfr1444
  gRNA
aucagcuguagcucccaaga

SEQ ID NO: 103996 - RNA, 20 nt, Artificial Sequence
  MKO10103996_B_Olfr1445
  gRNA
gccacaagcauuguguguua

SEQ ID NO: 103997 - RNA, 20 nt, Artificial Sequence
  MKO10103997_B_Olfr1445
  gRNA
gucacucccaaaguaaugcc

SEQ ID NO: 103998 - RNA, 20 nt, Artificial Sequence
  MKO10103998_B_Olfr1445
  gRNA
ugugaaugcuagagaaauuu

SEQ ID NO: 103999 - RNA, 20 nt, Artificial Sequence
  MKO10103999_B_Olfr1446
  gRNA
uagaagcucagucaucacug

SEQ ID NO: 104000 - RNA, 20 nt, Artificial Sequence
  MKO10104000_B_Olfr1446
  gRNA
uacuguggagaauuaucugu

SEQ ID NO: 104001 - RNA, 20 nt, Artificial Sequence
  MKO10104001_B_Olfr1446
  gRNA
agccgagugcaucuuuaaga

SEQ ID NO: 104002 - RNA, 20 nt, Artificial Sequence
  MKO10104002_B_Olfr1447
  gRNA
ugacuaaaaguauguauaca

SEQ ID NO: 104003 - RNA, 20 nt, Artificial Sequence
  MKO10104003_B_Olfr1447
  gRNA
gagugaauaugucugcaaua

SEQ ID NO: 104004 - RNA, 20 nt, Artificial Sequence
  MKO10104004_B_Olfr1447
  gRNA
ugauaaacaggggaagcugc

SEQ ID NO: 104005 - RNA, 20 nt, Artificial Sequence
  MKO10104005_B_Olfr1448
  gRNA
aaucacagucucacugauau

SEQ ID NO: 104006 - RNA, 20 nt, Artificial Sequence
  MKO10104006_B_Olfr1448
  gRNA
uucaucugaaggacgccaca

SEQ ID NO: 104007 - RNA, 20 nt, Artificial Sequence
  MKO10104007_B_Olfr1448
  gRNA
gucacucccaaaguaauguc

SEQ ID NO: 104008 - RNA, 20 nt, Artificial Sequence
  MKO10104008_B_Olfr1449
  gRNA
ggauaucagucaaucccaaa

SEQ ID NO: 104009 - RNA, 20 nt, Artificial Sequence
  MKO10104009_B_Olfr1449
  gRNA
cugugauauaccuccaaucc

SEQ ID NO: 104010 - RNA, 20 nt, Artificial Sequence
  MKO10104010_B_Olfr1449
  gRNA
ggugacuacauuuauccuuu

SEQ ID NO: 104011 - RNA, 20 nt, Artificial Sequence
  MKO10104011_B_Olfr1450
  gRNA
guuuaacaugggaacuacug

SEQ ID NO: 104012 - RNA, 20 nt, Artificial Sequence
  MKO10104012_B_Olfr1450
  gRNA
agaagcccaaccaucacuuu

SEQ ID NO: 104013 - RNA, 20 nt, Artificial Sequence
  MKO10104013_B_Olfr1450
  gRNA
gcugaaucuucugucuauac

SEQ ID NO: 104014 - RNA, 20 nt, Artificial Sequence
  MKO10104014_B_Olfr1451
  gRNA
ugagggugaacaugauacaa

SEQ ID NO: 104015 - RNA, 20 nt, Artificial Sequence
  MKO10104015_B_Olfr1451
  gRNA
uguuuccaaccacaucaaug

SEQ ID NO: 104016 - RNA, 20 nt, Artificial Sequence
  MKO10104016_B_Olfr1451
  gRNA
gaagaacaucugugcagcgc

SEQ ID NO: 104017 - RNA, 20 nt, Artificial Sequence
  MKO10104017_B_Olfr1453
  gRNA
cagugcuuccaucuauacua

SEQ ID NO: 104018 - RNA, 20 nt, Artificial Sequence
  MKO10104018_B_Olfr1453
  gRNA
gcugaucuugaugauucucu

SEQ ID NO: 104019 - RNA, 20 nt, Artificial Sequence
  MKO10104019_B_Olfr1453
  gRNA
ugugauauccugcagaugag

SEQ ID NO: 104020 - RNA, 20 nt, Artificial Sequence
  MKO10104020_B_Olfr1454
  gRNA
guuaguaaaaaugaaugugu

SEQ ID NO: 104021 - RNA, 20 nt, Artificial Sequence
  MKO10104021_B_Olfr1454
  gRNA
ggcaaaaaagauauugaagc

SEQ ID NO: 104022 - RNA, 20 nt, Artificial Sequence
  MKO10104022_B_Olfr1454
  gRNA
gucacuccaaaagucauagc

SEQ ID NO: 104023 - RNA, 20 nt, Artificial Sequence
  MKO10104023_B_Olfr1457
  gRNA
cugaaugccuccaucaacac

SEQ ID NO: 104024 - RNA, 20 nt, Artificial Sequence
  MKO10104024_B_Olfr1457
  gRNA
ccucauuuacaccaucaccc

SEQ ID NO: 104025 - RNA, 20 nt, Artificial Sequence
  MKO10104025_B_Olfr1457
  gRNA
ugauuaaaagaugucucuga

SEQ ID NO: 104026 - RNA, 20 nt, Artificial Sequence
  MKO10104026_B_Olfr1459
  gRNA
cuaaagaugcauucagcuuc

SEQ ID NO: 104027 - RNA, 20 nt, Artificial Sequence
  MKO10104027_B_Olfr1459
  gRNA
cuccuucugugagucuaaug

SEQ ID NO: 104028 - RNA, 20 nt, Artificial Sequence
  MKO10104028_B_Olfr1459
  gRNA
cagucccagguuuccuacaa

SEQ ID NO: 104029 - RNA, 20 nt, Artificial Sequence
  MKO10104029_B_Olfr145
  gRNA
gugcaagagcguuccagaag

SEQ ID NO: 104030 - RNA, 20 nt, Artificial Sequence
  MKO10104030_B_Olfr145
  gRNA
ccuucgcaucaguuccacag

SEQ ID NO: 104031 - RNA, 20 nt, Artificial Sequence
  MKO10104031_B_Olfr145
  gRNA
gugugacauucucccucuuc

SEQ ID NO: 104032 - RNA, 20 nt, Artificial Sequence
  MKO10104032_B_Olfr1461
  gRNA
cuagauaaacugagacauug

SEQ ID NO: 104033 - RNA, 20 nt, Artificial Sequence
  MKO10104033_B_Olfr1461
  gRNA
agcagcccagcuaugacuuu

SEQ ID NO: 104034 - RNA, 20 nt, Artificial Sequence
  MKO10104034_B_Olfr1461
  gRNA
cucaaugucucaguuuaucu

SEQ ID NO: 104035 - RNA, 20 nt, Artificial Sequence
  MKO10104035_B_Olfr1462
  gRNA
aaauacauccacuguauaga

SEQ ID NO: 104036 - RNA, 20 nt, Artificial Sequence
  MKO10104036_B_Olfr1462
  gRNA
ugacaaauauauuaaugaac

SEQ ID NO: 104037 - RNA, 20 nt, Artificial Sequence
  MKO10104037_B_Olfr1462
  gRNA
gccaaccuccagucacucca

SEQ ID NO: 104038 - RNA, 20 nt, Artificial Sequence
  MKO10104038_B_Olfr1463
  gRNA
cugagcagcacagcuauugu

SEQ ID NO: 104039 - RNA, 20 nt, Artificial Sequence
  MKO10104039_B_Olfr1463
  gRNA
agcuaucacaccaaaaguca

SEQ ID NO: 104040 - RNA, 20 nt, Artificial Sequence
  MKO10104040_B_Olfr1463
  gRNA
uugugacaugccagcacuca

SEQ ID NO: 104041 - RNA, 20 nt, Artificial Sequence
  MKO10104041_B_Olfr1465
  gRNA
uuuaaaaugcacucagaugc

SEQ ID NO: 104042 - RNA, 20 nt, Artificial Sequence
  MKO10104042_B_Olfr1465
  gRNA
cugauugccuccauucacau

SEQ ID NO: 104043 - RNA, 20 nt, Artificial Sequence
  MKO10104043_B_Olfr1465
  gRNA
gacaaggucauauccuauaa

SEQ ID NO: 104044 - RNA, 20 nt, Artificial Sequence
  MKO10104044_B_Olfr1466
  gRNA
ggauguuauuuacucuucag

SEQ ID NO: 104045 - RNA, 20 nt, Artificial Sequence
  MKO10104045_B_Olfr1466
  gRNA
ucucaucuacaucauuaccc

SEQ ID NO: 104046 - RNA, 20 nt, Artificial Sequence
  MKO10104046_B_Olfr1466
  gRNA
augagaccagccaugacuuu

SEQ ID NO: 104047 - RNA, 20 nt, Artificial Sequence
  MKO10104047_B_Olfr1467
  gRNA
ugcuauuuauacaaucaccg

SEQ ID NO: 104048 - RNA, 20 nt, Artificial Sequence
  MKO10104048_B_Olfr1467
  gRNA
guauacaagaaccagcucac

SEQ ID NO: 104049 - RNA, 20 nt, Artificial Sequence
  MKO10104049_B_Olfr1467
  gRNA
aaauguaucuccuaugugga

SEQ ID NO: 104050 - RNA, 20 nt, Artificial Sequence
  MKO10104050_B_Olfr1469
  gRNA
uauuagcccagucaugacug

SEQ ID NO: 104051 - RNA, 20 nt, Artificial Sequence
  MKO10104051_B_Olfr1469
  gRNA
ccucaucuauaccaucaccc

SEQ ID NO: 104052 - RNA, 20 nt, Artificial Sequence
  MKO10104052_B_Olfr1469
  gRNA
gaugcacacauuugcaguca

SEQ ID NO: 104053 - RNA, 20 nt, Artificial Sequence
  MKO10104053_B_Olfr146
  gRNA
caugaugcuacuguaaagua

SEQ ID NO: 104054 - RNA, 20 nt, Artificial Sequence
  MKO10104054_B_Olfr146
  gRNA
uguuucagaaaguuacaugc

SEQ ID NO: 104055 - RNA, 20 nt, Artificial Sequence
  MKO10104055_B_Olfr146
  gRNA
gugaacaaauucuuccuuuc

SEQ ID NO: 104056 - RNA, 20 nt, Artificial Sequence
  MKO10104056_B_Olfr1471
  gRNA
gacaaaaugccagagcaaca

SEQ ID NO: 104057 - RNA, 20 nt, Artificial Sequence
  MKO10104057_B_Olfr1471
  gRNA
gaacaagaaauguccagcag

SEQ ID NO: 104058 - RNA, 20 nt, Artificial Sequence
  MKO10104058_B_Olfr1471
  gRNA
uuugauggagaauauuucag

SEQ ID NO: 104059 - RNA, 20 nt, Artificial Sequence
  MKO10104059_B_Olfr1472
  gRNA
caaaguugacccaaagaaga

SEQ ID NO: 104060 - RNA, 20 nt, Artificial Sequence
  MKO10104060_B_Olfr1472
  gRNA
cuucaacugaacgcauucuc

SEQ ID NO: 104061 - RNA, 20 nt, Artificial Sequence
  MKO10104061_B_Olfr1472
  gRNA
acccugucguauacaguuua

SEQ ID NO: 104062 - RNA, 20 nt, Artificial Sequence
  MKO10104062_B_Olfr1474
  gRNA
gaaaaagugauuaauuacgu

SEQ ID NO: 104063 - RNA, 20 nt, Artificial Sequence
  MKO10104063_B_Olfr1474
  gRNA
gaugaucauacugauucugc

SEQ ID NO: 104064 - RNA, 20 nt, Artificial Sequence
  MKO10104064_B_Olfr1474
  gRNA
ccaagugacaauuagaaugc

SEQ ID NO: 104065 - RNA, 20 nt, Artificial Sequence
  MKO10104065_B_Olfr1475
  gRNA
aucacuguauucaucuucuu

SEQ ID NO: 104066 - RNA, 20 nt, Artificial Sequence
  MKO10104066_B_Olfr1475
  gRNA
cuucagcugaacgcauucuc

SEQ ID NO: 104067 - RNA, 20 nt, Artificial Sequence
  MKO10104067_B_Olfr1475
  gRNA
uuacugaauuuauucucaug

SEQ ID NO: 104068 - RNA, 20 nt, Artificial Sequence
  MKO10104068_B_Olfr1477
  gRNA
auaugugucuugcuucuugu

SEQ ID NO: 104069 - RNA, 20 nt, Artificial Sequence
  MKO10104069_B_Olfr1477
  gRNA
cuaucagaauuuauucuugu

SEQ ID NO: 104070 - RNA, 20 nt, Artificial Sequence
  MKO10104070_B_Olfr1477
  gRNA
agcaagaaacagcuaauagu

SEQ ID NO: 104071 - RNA, 20 nt, Artificial Sequence
  MKO10104071_B_Olfr147
  gRNA
uacuggugcaggaaaguuga

SEQ ID NO: 104072 - RNA, 20 nt, Artificial Sequence
  MKO10104072_B_Olfr147
  gRNA
gaagaaugucacauaaguaa

SEQ ID NO: 104073 - RNA, 20 nt, Artificial Sequence
  MKO10104073_B_Olfr147
  gRNA
auggugaccuuauacaauag

SEQ ID NO: 104074 - RNA, 20 nt, Artificial Sequence
  MKO10104074_B_Olfr1480
  gRNA
aaugcauucaagaaaguugc

SEQ ID NO: 104075 - RNA, 20 nt, Artificial Sequence
  MKO10104075_B_Olfr1480
  gRNA
acuuacuugacaacauuguu

SEQ ID NO: 104076 - RNA, 20 nt, Artificial Sequence
  MKO10104076_B_Olfr1480
  gRNA
ugccaacuugucagugucca

SEQ ID NO: 104077 - RNA, 20 nt, Artificial Sequence
  MKO10104077_B_Olfr1484
  gRNA
aagaagucaagaaugcaguc

SEQ ID NO: 104078 - RNA, 20 nt, Artificial Sequence
  MKO10104078_B_Olfr1484
  gRNA
aguaagauccagcaagaagc

SEQ ID NO: 104079 - RNA, 20 nt, Artificial Sequence
  MKO10104079_B_Olfr1484
  gRNA
aauuucauuuaugugaauac

SEQ ID NO: 104080 - RNA, 20 nt, Artificial Sequence
  MKO10104080_B_Olfr1487
  gRNA
aauuucauuugugugaauac

SEQ ID NO: 104081 - RNA, 20 nt, Artificial Sequence
  MKO10104081_B_Olfr1487
  gRNA
caagaaagggcuaauagugg

SEQ ID NO: 104082 - RNA, 20 nt, Artificial Sequence
  MKO10104082_B_Olfr1487
  gRNA
auuuauuugacaacauuguu

SEQ ID NO: 104083 - RNA, 20 nt, Artificial Sequence
  MKO10104083_B_Olfr1489
  gRNA
gagaaacccuucuauuaccu

SEQ ID NO: 104084 - RNA, 20 nt, Artificial Sequence
  MKO10104084_B_Olfr1489
  gRNA
acacagauguucuucuuaau

SEQ ID NO: 104085 - RNA, 20 nt, Artificial Sequence
  MKO10104085_B_Olfr1489
  gRNA
acauauuguuguugucaugg

SEQ ID NO: 104086 - RNA, 20 nt, Artificial Sequence
  MKO10104086_B_Olfr148
  gRNA
guacugacaguaaguuggcc

SEQ ID NO: 104087 - RNA, 20 nt, Artificial Sequence
  MKO10104087_B_Olfr148
  gRNA
gaccaugaaauguuauauuc

SEQ ID NO: 104088 - RNA, 20 nt, Artificial Sequence
  MKO10104088_B_Olfr148
  gRNA
cuacugugcauccaaccaag

SEQ ID NO: 104089 - RNA, 20 nt, Artificial Sequence
  MKO10104089_B_Olfr1490
  gRNA
uauguagacguguuucaguc

SEQ ID NO: 104090 - RNA, 20 nt, Artificial Sequence
  MKO10104090_B_Olfr1490
  gRNA
gcuuauggauugauaaucuc

SEQ ID NO: 104091 - RNA, 20 nt, Artificial Sequence
  MKO10104091_B_Olfr1490
  gRNA
aacauagcucuaucccugag

SEQ ID NO: 104092 - RNA, 20 nt, Artificial Sequence
  MKO10104092_B_Olfr1491
  gRNA
cucgagcagcucugaugaug

SEQ ID NO: 104093 - RNA, 20 nt, Artificial Sequence
  MKO10104093_B_Olfr1491
  gRNA
caccaaugcuccugaauucc

SEQ ID NO: 104094 - RNA, 20 nt, Artificial Sequence
  MKO10104094_B_Olfr1491
  gRNA
caucaucagagcugcucgag

SEQ ID NO: 104095 - RNA, 20 nt, Artificial Sequence
  MKO10104095_B_Olfr1494
  gRNA
aagucuguccucaaucaguc

SEQ ID NO: 104096 - RNA, 20 nt, Artificial Sequence
  MKO10104096_B_Olfr1494
  gRNA
cgugacaaagguguagacca

SEQ ID NO: 104097 - RNA, 20 nt, Artificial Sequence
  MKO10104097_B_Olfr1494
  gRNA
ucuucgcaugcgcucugcag

SEQ ID NO: 104098 - RNA, 20 nt, Artificial Sequence
  MKO10104098_B_Olfr1495
  gRNA
ucaaggcggugucuacagaa

SEQ ID NO: 104099 - RNA, 20 nt, Artificial Sequence
  MKO10104099_B_Olfr1495
  gRNA
ucaaagagccuauuaccauc

SEQ ID NO: 104100 - RNA, 20 nt, Artificial Sequence
  MKO10104100_B_Olfr1495
  gRNA
cuaggauacuaacuacauag

SEQ ID NO: 104101 - RNA, 20 nt, Artificial Sequence
  MKO10104101_B_Olfr1496
  gRNA
auacaaacaucaugcacccc

SEQ ID NO: 104102 - RNA, 20 nt, Artificial Sequence
  MKO10104102_B_Olfr1496
  gRNA
acaauauugcuuagagccca

SEQ ID NO: 104103 - RNA, 20 nt, Artificial Sequence
  MKO10104103_B_Olfr1496
  gRNA
auugaucauugcaucugagc

SEQ ID NO: 104104 - RNA, 20 nt, Artificial Sequence
  MKO10104104_B_Olfr1497
  gRNA
auuaugcaaauccgcucagc

SEQ ID NO: 104105 - RNA, 20 nt, Artificial Sequence
  MKO10104105_B_Olfr1497
  gRNA
gacaguccgaauaaagccac

SEQ ID NO: 104106 - RNA, 20 nt, Artificial Sequence
  MKO10104106_B_Olfr1497
  gRNA
agcugagcggauuugcauaa

SEQ ID NO: 104107 - RNA, 20 nt, Artificial Sequence
  MKO10104107_B_Olfr1499
  gRNA
gcuuuacugaccauccagag

SEQ ID NO: 104108 - RNA, 20 nt, Artificial Sequence
  MKO10104108_B_Olfr1499
  gRNA
cccagauaacccacauacau

SEQ ID NO: 104109 - RNA, 20 nt, Artificial Sequence
  MKO10104109_B_Olfr1499
  gRNA
ugaauucaguuacuguugug

SEQ ID NO: 104110 - RNA, 20 nt, Artificial Sequence
  MKO10104110_B_Olfr149
  gRNA
uuucuacaucuucacucucg

SEQ ID NO: 104111 - RNA, 20 nt, Artificial Sequence
  MKO10104111_B_Olfr149
  gRNA
gccgaaaacugcugucccca

SEQ ID NO: 104112 - RNA, 20 nt, Artificial Sequence
  MKO10104112_B_Olfr149
  gRNA
ugaacaguugcauccaacca

SEQ ID NO: 104113 - RNA, 20 nt, Artificial Sequence
  MKO10104113_B_Olfr1500
  gRNA
ugagagcuauauccaggaau

SEQ ID NO: 104114 - RNA, 20 nt, Artificial Sequence
  MKO10104114_B_Olfr1500
  gRNA
auccaucgauugcuaccucu

SEQ ID NO: 104115 - RNA, 20 nt, Artificial Sequence
  MKO10104115_B_Olfr1500
  gRNA
ccacaggucagcuuuaacag

SEQ ID NO: 104116 - RNA, 20 nt, Artificial Sequence
  MKO10104116_B_Olfr1501
  gRNA
gaccaucuuauuacucccca

SEQ ID NO: 104117 - RNA, 20 nt, Artificial Sequence
  MKO10104117_B_Olfr1501
  gRNA
cugguugcugcagcauauuc

SEQ ID NO: 104118 - RNA, 20 nt, Artificial Sequence
  MKO10104118_B_Olfr1501
  gRNA
acacaaucuugucuugccag

SEQ ID NO: 104119 - RNA, 20 nt, Artificial Sequence
  MKO10104119_B_Olfr1502
  gRNA
cuaagaaauaccagcaauag

SEQ ID NO: 104120 - RNA, 20 nt, Artificial Sequence
  MKO10104120_B_Olfr1502
  gRNA
acacaacuuuaucuucaucc

SEQ ID NO: 104121 - RNA, 20 nt, Artificial Sequence
  MKO10104121_B_Olfr1502
  gRNA
caugcccaaauuucccagca

SEQ ID NO: 104122 - RNA, 20 nt, Artificial Sequence
  MKO10104122_B_Olfr1504
  gRNA
acacucaguacuagcauaaa

SEQ ID NO: 104123 - RNA, 20 nt, Artificial Sequence
  MKO10104123_B_Olfr1504
  gRNA
ucauggccauggcauaaagg

SEQ ID NO: 104124 - RNA, 20 nt, Artificial Sequence
  MKO10104124_B_Olfr1504
  gRNA
uaacaugggcaaaucccucu

SEQ ID NO: 104125 - RNA, 20 nt, Artificial Sequence
  MKO10104125_B_Olfr1505
  gRNA
uagaaugaauuccguuacug

SEQ ID NO: 104126 - RNA, 20 nt, Artificial Sequence
  MKO10104126_B_Olfr1505
  gRNA
caugcccaaguuucccagca

SEQ ID NO: 104127 - RNA, 20 nt, Artificial Sequence
  MKO10104127_B_Olfr1505
  gRNA
cuaagaaauaccagaaauag

SEQ ID NO: 104128 - RNA, 20 nt, Artificial Sequence
  MKO10104128_B_Olfr1506
  gRNA
gaaauaauggucaaugauau

SEQ ID NO: 104129 - RNA, 20 nt, Artificial Sequence
  MKO10104129_B_Olfr1506
  gRNA
aucuuccgcuugcccuucug

SEQ ID NO: 104130 - RNA, 20 nt, Artificial Sequence
  MKO10104130_B_Olfr1506
  gRNA
agcggaagaugagaagaacu

SEQ ID NO: 104131 - RNA, 20 nt, Artificial Sequence
  MKO10104131_B_Olfr1507
  gRNA
gcagauacaaucuuguccuc

SEQ ID NO: 104132 - RNA, 20 nt, Artificial Sequence
  MKO10104132_B_Olfr1507
  gRNA
uacaaauccgaaaguacaga

SEQ ID NO: 104133 - RNA, 20 nt, Artificial Sequence
  MKO10104133_B_Olfr1507
  gRNA
auuauugucauauaccucaa

SEQ ID NO: 104134 - RNA, 20 nt, Artificial Sequence
  MKO10104134_B_Olfr1508
  gRNA
caagccaguuugaucacuug

SEQ ID NO: 104135 - RNA, 20 nt, Artificial Sequence
  MKO10104135_B_Olfr1508
  gRNA
uguaccucaagugaucaaac

SEQ ID NO: 104136 - RNA, 20 nt, Artificial Sequence
  MKO10104136_B_Olfr1508
  gRNA
auuauugucauauacugcaa

SEQ ID NO: 104137 - RNA, 20 nt, Artificial Sequence
  MKO10104137_B_Olfr1509
  gRNA
auucugaucguguccaauag

SEQ ID NO: 104138 - RNA, 20 nt, Artificial Sequence
  MKO10104138_B_Olfr1509
  gRNA
aaguagcuaucgauaauguu

SEQ ID NO: 104139 - RNA, 20 nt, Artificial Sequence
  MKO10104139_B_Olfr1509
  gRNA
gagacguggcgugaagacua

SEQ ID NO: 104140 - RNA, 20 nt, Artificial Sequence
  MKO10104140_B_Olfr150
  gRNA
aauaaucaccccuaaaaugc

SEQ ID NO: 104141 - RNA, 20 nt, Artificial Sequence
  MKO10104141_B_Olfr150
  gRNA
cugagucauacauuccugau

SEQ ID NO: 104142 - RNA, 20 nt, Artificial Sequence
  MKO10104142_B_Olfr150
  gRNA
uauuccaacauugacuaucc

SEQ ID NO: 104143 - RNA, 20 nt, Artificial Sequence
  MKO10104143_B_Olfr1510
  gRNA
gugaaguuuaaaauaagucg

SEQ ID NO: 104144 - RNA, 20 nt, Artificial Sequence
  MKO10104144_B_Olfr1510
  gRNA
gagugguuugaauagaccca

SEQ ID NO: 104145 - RNA, 20 nt, Artificial Sequence
  MKO10104145_B_Olfr1510
  gRNA
aaaauuaugcacaauccuag

SEQ ID NO: 104146 - RNA, 20 nt, Artificial Sequence
  MKO10104146_B_Olfr1511
  gRNA
gaguagcuugaauagaccca

SEQ ID NO: 104147 - RNA, 20 nt, Artificial Sequence
  MKO10104147_B_Olfr1511
  gRNA
gaagaaguaauccacuuccu

SEQ ID NO: 104148 - RNA, 20 nt, Artificial Sequence
  MKO10104148_B_Olfr1511
  gRNA
aaacuucacucccgccagca

SEQ ID NO: 104149 - RNA, 20 nt, Artificial Sequence
  MKO10104149_B_Olfr1512
  gRNA
gcgcguuccccagcugaguc

SEQ ID NO: 104150 - RNA, 20 nt, Artificial Sequence
  MKO10104150_B_Olfr1512
  gRNA
aggaggugaaguuagccuug

SEQ ID NO: 104151 - RNA, 20 nt, Artificial Sequence
  MKO10104151_B_Olfr1512
  gRNA
cgaagggccuucucaacaug

SEQ ID NO: 104152 - RNA, 20 nt, Artificial Sequence
  MKO10104152_B_Olfr1513
  gRNA
auguuaucucuacaccacua

SEQ ID NO: 104153 - RNA, 20 nt, Artificial Sequence
  MKO10104153_B_Olfr1513
  gRNA
uggguggcuggcuuaaucca

SEQ ID NO: 104154 - RNA, 20 nt, Artificial Sequence
  MKO10104154_B_Olfr1513
  gRNA
uaccugcgaccugacagcca

SEQ ID NO: 104155 - RNA, 20 nt, Artificial Sequence
  MKO10104155_B_Olfr151
  gRNA
cuacgaggauccccagaaag

SEQ ID NO: 104156 - RNA, 20 nt, Artificial Sequence
  MKO10104156_B_Olfr151
  gRNA
ccuucgcaucagcuccaacg

SEQ ID NO: 104157 - RNA, 20 nt, Artificial Sequence
  MKO10104157_B_Olfr151
  gRNA
agaguugggugagcuugcag

SEQ ID NO: 104158 - RNA, 20 nt, Artificial Sequence
  MKO10104158_B_Olfr152
  gRNA
gcacaauuaaccauaugcag

SEQ ID NO: 104159 - RNA, 20 nt, Artificial Sequence
  MKO10104159_B_Olfr152
  gRNA
gaguggcuacuuuccacuua

SEQ ID NO: 104160 - RNA, 20 nt, Artificial Sequence
  MKO10104160_B_Olfr152
  gRNA
cuccacagaacucccauaag

SEQ ID NO: 104161 - RNA, 20 nt, Artificial Sequence
  MKO10104161_B_Olfr1532-ps1
  gRNA
uauaugaugggguucagcau

SEQ ID NO: 104162 - RNA, 20 nt, Artificial Sequence
  MKO10104162_B_Olfr1532-ps1
  gRNA
cuuucacauccuuguuucuc

SEQ ID NO: 104163 - RNA, 20 nt, Artificial Sequence
  MKO10104163_B_Olfr1532-ps1
  gRNA
ugugacagaauucaucuucc

SEQ ID NO: 104164 - RNA, 20 nt, Artificial Sequence
  MKO10104164_B_Olfr1535
  gRNA
ugcaugaguaauguagccau

SEQ ID NO: 104165 - RNA, 20 nt, Artificial Sequence
  MKO10104165_B_Olfr1535
  gRNA
ucagacgcuguuuaacuuca

SEQ ID NO: 104166 - RNA, 20 nt, Artificial Sequence
  MKO10104166_B_Olfr1535
  gRNA
cagguuagcuucagcaucac

SEQ ID NO: 104167 - RNA, 20 nt, Artificial Sequence
  MKO10104167_B_Olfr1537
  gRNA
cugagccaugcauucagagu

SEQ ID NO: 104168 - RNA, 20 nt, Artificial Sequence
  MKO10104168_B_Olfr1537
  gRNA
ccauccucuccauucacucc

SEQ ID NO: 104169 - RNA, 20 nt, Artificial Sequence
  MKO10104169_B_Olfr1537
  gRNA
aucuaucugaucaccauggc

SEQ ID NO: 104170 - RNA, 20 nt, Artificial Sequence
  MKO10104170_B_Olfr153
  gRNA
aaacauaucuaccagcaucu

SEQ ID NO: 104171 - RNA, 20 nt, Artificial Sequence
  MKO10104171_B_Olfr153
  gRNA
auuuacuugaguaucugagc

SEQ ID NO: 104172 - RNA, 20 nt, Artificial Sequence
  MKO10104172_B_Olfr153
  gRNA
aagaugcugguagauauguu

SEQ ID NO: 104173 - RNA, 20 nt, Artificial Sequence
  MKO10104173_B_Olfr154
  gRNA
caucagcagaacugaucuuu

SEQ ID NO: 104174 - RNA, 20 nt, Artificial Sequence
  MKO10104174_B_Olfr154
  gRNA
uauuugcacaugccagugag

SEQ ID NO: 104175 - RNA, 20 nt, Artificial Sequence
  MKO10104175_B_Olfr154
  gRNA
aacaugucagacaacaucuu

SEQ ID NO: 104176 - RNA, 20 nt, Artificial Sequence
  MKO10104176_B_Olfr155
  gRNA
gacugccaagaagaucaugu

SEQ ID NO: 104177 - RNA, 20 nt, Artificial Sequence
  MKO10104177_B_Olfr155
  gRNA
ccaggagaaugaagccggac

SEQ ID NO: 104178 - RNA, 20 nt, Artificial Sequence
  MKO10104178_B_Olfr155
  gRNA
caaugcggcugcccuucugu

SEQ ID NO: 104179 - RNA, 20 nt, Artificial Sequence
  MKO10104179_B_Olfr156
  gRNA
ggucagcaccccauaaaaua

SEQ ID NO: 104180 - RNA, 20 nt, Artificial Sequence
  MKO10104180_B_Olfr156
  gRNA
uagcugaauuugucuugcug

SEQ ID NO: 104181 - RNA, 20 nt, Artificial Sequence
  MKO10104181_B_Olfr156
  gRNA
uuccucacuaucacugaauc

SEQ ID NO: 104182 - RNA, 20 nt, Artificial Sequence
  MKO10104182_B_Olfr157
  gRNA
uccguucccuuaguccuuga

SEQ ID NO: 104183 - RNA, 20 nt, Artificial Sequence
  MKO10104183_B_Olfr157
  gRNA
gggucagcaguccauagaag

SEQ ID NO: 104184 - RNA, 20 nt, Artificial Sequence
  MKO10104184_B_Olfr157
  gRNA
acuugccagguuccucacag

SEQ ID NO: 104185 - RNA, 20 nt, Artificial Sequence
  MKO10104185_B_Olfr159
  gRNA
aucaccacuugaaguguuuc

SEQ ID NO: 104186 - RNA, 20 nt, Artificial Sequence
  MKO10104186_B_Olfr159
  gRNA
agugaugcuuccagauaccc

SEQ ID NO: 104187 - RNA, 20 nt, Artificial Sequence
  MKO10104187_B_Olfr159
  gRNA
gggcaaugucguccucaucc

SEQ ID NO: 104188 - RNA, 20 nt, Artificial Sequence
  MKO10104188_B_Olfr15
  gRNA
agugaugaagauccgcucug

SEQ ID NO: 104189 - RNA, 20 nt, Artificial Sequence
  MKO10104189_B_Olfr15
  gRNA
ugcuuucgcgccuugaugcu

SEQ ID NO: 104190 - RNA, 20 nt, Artificial Sequence
  MKO10104190_B_Olfr15
  gRNA
ucauggcggguaccucacac

SEQ ID NO: 104191 - RNA, 20 nt, Artificial Sequence
  MKO10104191_B_Olfr160
  gRNA
gacagccauuucuauaucau

SEQ ID NO: 104192 - RNA, 20 nt, Artificial Sequence
  MKO10104192_B_Olfr160
  gRNA
gaucuacauaaucaccaugg

SEQ ID NO: 104193 - RNA, 20 nt, Artificial Sequence
  MKO10104193_B_Olfr160
  gRNA
uguugagccuaugaguccca

SEQ ID NO: 104194 - RNA, 20 nt, Artificial Sequence
  MKO10104194_B_Olfr161
  gRNA
ucaggauggcacaagcaaua

SEQ ID NO: 104195 - RNA, 20 nt, Artificial Sequence
  MKO10104195_B_Olfr161
  gRNA
cuguguagauauaaaucuca

SEQ ID NO: 104196 - RNA, 20 nt, Artificial Sequence
  MKO10104196_B_Olfr161
  gRNA
gcugccuggagagucccaga

SEQ ID NO: 104197 - RNA, 20 nt, Artificial Sequence
  MKO10104197_B_Olfr164
  gRNA
uucuggucguucucccaccc

SEQ ID NO: 104198 - RNA, 20 nt, Artificial Sequence
  MKO10104198_B_Olfr164
  gRNA
acuacaugaaagugugagua

SEQ ID NO: 104199 - RNA, 20 nt, Artificial Sequence
  MKO10104199_B_Olfr164
  gRNA
uaacacuuucaugaaugcuc

SEQ ID NO: 104200 - RNA, 20 nt, Artificial Sequence
  MKO10104200_B_Olfr165
  gRNA
uguugcggaggcuguaaauu

SEQ ID NO: 104201 - RNA, 20 nt, Artificial Sequence
  MKO10104201_B_Olfr165
  gRNA
caccaugacgugagaugaac

SEQ ID NO: 104202 - RNA, 20 nt, Artificial Sequence
  MKO10104202_B_Olfr165
  gRNA
uaauaccuucaugaaugccc

SEQ ID NO: 104203 - RNA, 20 nt, Artificial Sequence
  MKO10104203_B_Olfr166
  gRNA
ugaugagcaucaaaaguagc

SEQ ID NO: 104204 - RNA, 20 nt, Artificial Sequence
  MKO10104204_B_Olfr166
  gRNA
aguaccaaggacucuuguca

SEQ ID NO: 104205 - RNA, 20 nt, Artificial Sequence
  MKO10104205_B_Olfr166
  gRNA
cccaacagaagauaagauuc

SEQ ID NO: 104206 - RNA, 20 nt, Artificial Sequence
  MKO10104206_B_Olfr167
  gRNA
ugcauauccaguaugagcac

SEQ ID NO: 104207 - RNA, 20 nt, Artificial Sequence
  MKO10104207_B_Olfr167
  gRNA
aucccuccgauccccagaag

SEQ ID NO: 104208 - RNA, 20 nt, Artificial Sequence
  MKO10104208_B_Olfr167
  gRNA
cacccccaaaagucaagaag

SEQ ID NO: 104209 - RNA, 20 nt, Artificial Sequence
  MKO10104209_B_Olfr168
  gRNA
uaucacagcuuccuauggua

SEQ ID NO: 104210 - RNA, 20 nt, Artificial Sequence
  MKO10104210_B_Olfr168
  gRNA
cauuaucuugcucaugcgaa

SEQ ID NO: 104211 - RNA, 20 nt, Artificial Sequence
  MKO10104211_B_Olfr168
  gRNA
caagcccucagaaccugcca

SEQ ID NO: 104212 - RNA, 20 nt, Artificial Sequence
  MKO10104212_B_Olfr169
  gRNA
ucguaauaaagauguccuua

SEQ ID NO: 104213 - RNA, 20 nt, Artificial Sequence
  MKO10104213_B_Olfr169
  gRNA
gccugcagccaggagccuac

SEQ ID NO: 104214 - RNA, 20 nt, Artificial Sequence
  MKO10104214_B_Olfr169
  gRNA
guauuccaaaugcagucauc

SEQ ID NO: 104215 - RNA, 20 nt, Artificial Sequence
  MKO10104215_B_Olfr16
  gRNA
uuuaggcacuggccugguua

SEQ ID NO: 104216 - RNA, 20 nt, Artificial Sequence
  MKO10104216_B_Olfr16
  gRNA
aagguuguaaaaaaucaggc

SEQ ID NO: 104217 - RNA, 20 nt, Artificial Sequence
  MKO10104217_B_Olfr16
  gRNA
uuuguaauucuugugcccau

SEQ ID NO: 104218 - RNA, 20 nt, Artificial Sequence
  MKO10104218_B_Olfr170
  gRNA
cucauauaugugaaaaugac

SEQ ID NO: 104219 - RNA, 20 nt, Artificial Sequence
  MKO10104219_B_Olfr170
  gRNA
uuugcuacccugugcugaug

SEQ ID NO: 104220 - RNA, 20 nt, Artificial Sequence
  MKO10104220_B_Olfr170
  gRNA
ugacugagcagaaaauacau

SEQ ID NO: 104221 - RNA, 20 nt, Artificial Sequence
  MKO10104221_B_Olfr171
  gRNA
aggacaugacugccaagaga

SEQ ID NO: 104222 - RNA, 20 nt, Artificial Sequence
  MKO10104222_B_Olfr171
  gRNA
uucagugggcuccuggcugc

SEQ ID NO: 104223 - RNA, 20 nt, Artificial Sequence
  MKO10104223_B_Olfr171
  gRNA
cuuuauucagaauauuacuu

SEQ ID NO: 104224 - RNA, 20 nt, Artificial Sequence
  MKO10104224_B_Olfr172
  gRNA
gcagucugcaguuucaacag

SEQ ID NO: 104225 - RNA, 20 nt, Artificial Sequence
  MKO10104225_B_Olfr172
  gRNA
caauacaagcucauugacau

SEQ ID NO: 104226 - RNA, 20 nt, Artificial Sequence
  MKO10104226_B_Olfr172
  gRNA
gcucugccuucagaugauca

SEQ ID NO: 104227 - RNA, 20 nt, Artificial Sequence
  MKO10104227_B_Olfr173
  gRNA
ggugugaagagaacguucuu

SEQ ID NO: 104228 - RNA, 20 nt, Artificial Sequence
  MKO10104228_B_Olfr173
  gRNA
cacaaccuauugugaagacu

SEQ ID NO: 104229 - RNA, 20 nt, Artificial Sequence
  MKO10104229_B_Olfr173
  gRNA
gcucugccuucagaugacga

SEQ ID NO: 104230 - RNA, 20 nt, Artificial Sequence
  MKO10104230_B_Olfr175-ps1
  gRNA
cuuaaagauacuucuauucc

SEQ ID NO: 104231 - RNA, 20 nt, Artificial Sequence
  MKO10104231_B_Olfr175-ps1
  gRNA
aauagaaguaucuuuaaguc

SEQ ID NO: 104232 - RNA, 20 nt, Artificial Sequence
  MKO10104232_B_Olfr175-ps1
  gRNA
cugcauuccaugauucacau

SEQ ID NO: 104233 - RNA, 20 nt, Artificial Sequence
  MKO10104233_B_Olfr176
  gRNA
gaggaugaacucuguugcca

SEQ ID NO: 104234 - RNA, 20 nt, Artificial Sequence
  MKO10104234_B_Olfr176
  gRNA
acgagguucuauguagauca

SEQ ID NO: 104235 - RNA, 20 nt, Artificial Sequence
  MKO10104235_B_Olfr176
  gRNA
aacagaagugucuuuaaguc

SEQ ID NO: 104236 - RNA, 20 nt, Artificial Sequence
  MKO10104236_B_Olfr177
  gRNA
gaggaugaacucuguugcca

SEQ ID NO: 104237 - RNA, 20 nt, Artificial Sequence
  MKO10104237_B_Olfr177
  gRNA
acgagguucuauguagauca

SEQ ID NO: 104238 - RNA, 20 nt, Artificial Sequence
  MKO10104238_B_Olfr177
  gRNA
aacagaagugucuuuaaguc

SEQ ID NO: 104239 - RNA, 20 nt, Artificial Sequence
  MKO10104239_B_Olfr178
  gRNA
cuguacaggagagucuauac

SEQ ID NO: 104240 - RNA, 20 nt, Artificial Sequence
  MKO10104240_B_Olfr178
  gRNA
uuacuaccucaguauuucuc

SEQ ID NO: 104241 - RNA, 20 nt, Artificial Sequence
  MKO10104241_B_Olfr178
  gRNA
uuugaccacacaauucaucc

SEQ ID NO: 104242 - RNA, 20 nt, Artificial Sequence
  MKO10104242_B_Olfr17
  gRNA
gaucacagaucgccauguag

SEQ ID NO: 104243 - RNA, 20 nt, Artificial Sequence
  MKO10104243_B_Olfr17
  gRNA
gcacagacuagggcuaugac

SEQ ID NO: 104244 - RNA, 20 nt, Artificial Sequence
  MKO10104244_B_Olfr17
  gRNA
guugaguacucugauacucc

SEQ ID NO: 104245 - RNA, 20 nt, Artificial Sequence
  MKO10104245_B_Olfr180
  gRNA
cugcauuccuugauucaugu

SEQ ID NO: 104246 - RNA, 20 nt, Artificial Sequence
  MKO10104246_B_Olfr180
  gRNA
cuguacaggagagucuauau

SEQ ID NO: 104247 - RNA, 20 nt, Artificial Sequence
  MKO10104247_B_Olfr180
  gRNA
acgaggcuccaaguagauca

SEQ ID NO: 104248 - RNA, 20 nt, Artificial Sequence
  MKO10104248_B_Olfr181
  gRNA
acaguagaguucauccucau

SEQ ID NO: 104249 - RNA, 20 nt, Artificial Sequence
  MKO10104249_B_Olfr181
  gRNA
cagacagccuguauguauca

SEQ ID NO: 104250 - RNA, 20 nt, Artificial Sequence
  MKO10104250_B_Olfr181
  gRNA
ugugaucugagaauccuaug

SEQ ID NO: 104251 - RNA, 20 nt, Artificial Sequence
  MKO10104251_B_Olfr183
  gRNA
auauacuucaugaccauugu

SEQ ID NO: 104252 - RNA, 20 nt, Artificial Sequence
  MKO10104252_B_Olfr183
  gRNA
aaagccaccuauaaaugaua

SEQ ID NO: 104253 - RNA, 20 nt, Artificial Sequence
  MKO10104253_B_Olfr183
  gRNA
uaucauccacagugacaccg

SEQ ID NO: 104254 - RNA, 20 nt, Artificial Sequence
  MKO10104254_B_Olfr186
  gRNA
agaaggccuuccuuauaccu

SEQ ID NO: 104255 - RNA, 20 nt, Artificial Sequence
  MKO10104255_B_Olfr186
  gRNA
gauauaucaucaagaauagu

SEQ ID NO: 104256 - RNA, 20 nt, Artificial Sequence
  MKO10104256_B_Olfr186
  gRNA
cacagaucaucaagggcugc

SEQ ID NO: 104257 - RNA, 20 nt, Artificial Sequence
  MKO10104257_B_Olfr187
  gRNA
caaacugacguuucccacaa

SEQ ID NO: 104258 - RNA, 20 nt, Artificial Sequence
  MKO10104258_B_Olfr187
  gRNA
gaucacucucucugaaugua

SEQ ID NO: 104259 - RNA, 20 nt, Artificial Sequence
  MKO10104259_B_Olfr187
  gRNA
ugagaacaaacucuguuagc

SEQ ID NO: 104260 - RNA, 20 nt, Artificial Sequence
  MKO10104260_B_Olfr18
  gRNA
agcauagagaugacacaguc

SEQ ID NO: 104261 - RNA, 20 nt, Artificial Sequence
  MKO10104261_B_Olfr18
  gRNA
cacacuaccaaagaugauag

SEQ ID NO: 104262 - RNA, 20 nt, Artificial Sequence
  MKO10104262_B_Olfr18
  gRNA
cagcuucagccuauacucuu

SEQ ID NO: 104263 - RNA, 20 nt, Artificial Sequence
  MKO10104263_B_Olfr190
  gRNA
agaaagccuucuucaugcuu

SEQ ID NO: 104264 - RNA, 20 nt, Artificial Sequence
  MKO10104264_B_Olfr190
  gRNA
uacuacagaauguuucuugu

SEQ ID NO: 104265 - RNA, 20 nt, Artificial Sequence
  MKO10104265_B_Olfr190
  gRNA
gucuguccaaagcaugaaga

SEQ ID NO: 104266 - RNA, 20 nt, Artificial Sequence
  MKO10104266_B_Olfr191
  gRNA
ugccaagagaaaacauuccg

SEQ ID NO: 104267 - RNA, 20 nt, Artificial Sequence
  MKO10104267_B_Olfr191
  gRNA
gauaaaugaccaaaaacagc

SEQ ID NO: 104268 - RNA, 20 nt, Artificial Sequence
  MKO10104268_B_Olfr191
  gRNA
gcauaacaucacaauaaaaa

SEQ ID NO: 104269 - RNA, 20 nt, Artificial Sequence
  MKO10104269_B_Olfr192
  gRNA
accagaaaaaaacaagaaua

SEQ ID NO: 104270 - RNA, 20 nt, Artificial Sequence
  MKO10104270_B_Olfr192
  gRNA
agaaagccuucuucauaccu

SEQ ID NO: 104271 - RNA, 20 nt, Artificial Sequence
  MKO10104271_B_Olfr192
  gRNA
aucuaucuuaucacuauugu

SEQ ID NO: 104272 - RNA, 20 nt, Artificial Sequence
  MKO10104272_B_Olfr193
  gRNA
auucaugcuuuaauucauga

SEQ ID NO: 104273 - RNA, 20 nt, Artificial Sequence
  MKO10104273_B_Olfr193
  gRNA
cucccaagaaaaaaguacau

SEQ ID NO: 104274 - RNA, 20 nt, Artificial Sequence
  MKO10104274_B_Olfr193
  gRNA
caucuaucucaucaccauug

SEQ ID NO: 104275 - RNA, 20 nt, Artificial Sequence
  MKO10104275_B_Olfr194
  gRNA
cauggaggugaacagaagcc

SEQ ID NO: 104276 - RNA, 20 nt, Artificial Sequence
  MKO10104276_B_Olfr194
  gRNA
cuucauuuaugucaccacca

SEQ ID NO: 104277 - RNA, 20 nt, Artificial Sequence
  MKO10104277_B_Olfr194
  gRNA
agaugagaaagauuaaacca

SEQ ID NO: 104278 - RNA, 20 nt, Artificial Sequence
  MKO10104278_B_Olfr195
  gRNA
cugcauccuaugauugaagu

SEQ ID NO: 104279 - RNA, 20 nt, Artificial Sequence
  MKO10104279_B_Olfr195
  gRNA
ugugacaaaugaauucaucc

SEQ ID NO: 104280 - RNA, 20 nt, Artificial Sequence
  MKO10104280_B_Olfr195
  gRNA
guacaggagauucuguauaa

SEQ ID NO: 104281 - RNA, 20 nt, Artificial Sequence
  MKO10104281_B_Olfr196
  gRNA
auugagagaagggucauuac

SEQ ID NO: 104282 - RNA, 20 nt, Artificial Sequence
  MKO10104282_B_Olfr196
  gRNA
uaagcaaguaaaaaauucac

SEQ ID NO: 104283 - RNA, 20 nt, Artificial Sequence
  MKO10104283_B_Olfr196
  gRNA
ugccaagagaaaacauucug

SEQ ID NO: 104284 - RNA, 20 nt, Artificial Sequence
  MKO10104284_B_Olfr197
  gRNA
guuuagcucuuguugauacu

SEQ ID NO: 104285 - RNA, 20 nt, Artificial Sequence
  MKO10104285_B_Olfr197
  gRNA
auuugugaugugugcaacua

SEQ ID NO: 104286 - RNA, 20 nt, Artificial Sequence
  MKO10104286_B_Olfr197
  gRNA
gagcuaaacacccaagaaau

SEQ ID NO: 104287 - RNA, 20 nt, Artificial Sequence
  MKO10104287_B_Olfr198
  gRNA
gucuggaucaggugaagaua

SEQ ID NO: 104288 - RNA, 20 nt, Artificial Sequence
  MKO10104288_B_Olfr198
  gRNA
caaacacugccaccacaguc

SEQ ID NO: 104289 - RNA, 20 nt, Artificial Sequence
  MKO10104289_B_Olfr198
  gRNA
agaugagagcaaugagccca

SEQ ID NO: 104290 - RNA, 20 nt, Artificial Sequence
  MKO10104290_B_Olfr199
  gRNA
cuguacucaguuuauagccg

SEQ ID NO: 104291 - RNA, 20 nt, Artificial Sequence
  MKO10104291_B_Olfr199
  gRNA
agacuuguauagaaguugca

SEQ ID NO: 104292 - RNA, 20 nt, Artificial Sequence
  MKO10104292_B_Olfr199
  gRNA
auugaacaaagcacucagcc

SEQ ID NO: 104293 - RNA, 20 nt, Artificial Sequence
  MKO10104293_B_Olfr19
  gRNA
uguuugugagcuuaaucaac

SEQ ID NO: 104294 - RNA, 20 nt, Artificial Sequence
  MKO10104294_B_Olfr19
  gRNA
gauuaagcucacaaacaaag

SEQ ID NO: 104295 - RNA, 20 nt, Artificial Sequence
  MKO10104295_B_Olfr19
  gRNA
acgugcaaucucaucaucac

SEQ ID NO: 104296 - RNA, 20 nt, Artificial Sequence
  MKO10104296_B_Olfr1
  gRNA
cucugacacccguguuaaug

SEQ ID NO: 104297 - RNA, 20 nt, Artificial Sequence
  MKO10104297_B_Olfr1
  gRNA
guuccaucgauucccuaugc

SEQ ID NO: 104298 - RNA, 20 nt, Artificial Sequence
  MKO10104298_B_Olfr1
  gRNA
caguaauaauucuacuguga

SEQ ID NO: 104299 - RNA, 20 nt, Artificial Sequence
  MKO10104299_B_Olfr201
  gRNA
gaacagggcagccuuuagcg

SEQ ID NO: 104300 - RNA, 20 nt, Artificial Sequence
  MKO10104300_B_Olfr201
  gRNA
auugagcaaagcacucaacc

SEQ ID NO: 104301 - RNA, 20 nt, Artificial Sequence
  MKO10104301_B_Olfr201
  gRNA
guacuuauuccucaguagcc

SEQ ID NO: 104302 - RNA, 20 nt, Artificial Sequence
  MKO10104302_B_Olfr202
  gRNA
auagaaauagucuauaacgu

SEQ ID NO: 104303 - RNA, 20 nt, Artificial Sequence
  MKO10104303_B_Olfr202
  gRNA
auguaacccccuccuuuauc

SEQ ID NO: 104304 - RNA, 20 nt, Artificial Sequence
  MKO10104304_B_Olfr202
  gRNA
accacaagcauguuaauuga

SEQ ID NO: 104305 - RNA, 20 nt, Artificial Sequence
  MKO10104305_B_Olfr203
  gRNA
gcugcaaguucccauguucu

SEQ ID NO: 104306 - RNA, 20 nt, Artificial Sequence
  MKO10104306_B_Olfr203
  gRNA
gugacugcguuuauucucag

SEQ ID NO: 104307 - RNA, 20 nt, Artificial Sequence
  MKO10104307_B_Olfr203
  gRNA
gugugcacuugccugauaag

SEQ ID NO: 104308 - RNA, 20 nt, Artificial Sequence
  MKO10104308_B_Olfr204
  gRNA
agagacuacgauagucacag

SEQ ID NO: 104309 - RNA, 20 nt, Artificial Sequence
  MKO10104309_B_Olfr204
  gRNA
uaacacaguacagagucucu

SEQ ID NO: 104310 - RNA, 20 nt, Artificial Sequence
  MKO10104310_B_Olfr204
  gRNA
ugcacagauccaucucuuaa

SEQ ID NO: 104311 - RNA, 20 nt, Artificial Sequence
  MKO10104311_B_Olfr205
  gRNA
agaugcaucucugaaugcau

SEQ ID NO: 104312 - RNA, 20 nt, Artificial Sequence
  MKO10104312_B_Olfr205
  gRNA
aagaacaaacucagucaaca

SEQ ID NO: 104313 - RNA, 20 nt, Artificial Sequence
  MKO10104313_B_Olfr205
  gRNA
gucugcaccaggugaaaacc

SEQ ID NO: 104314 - RNA, 20 nt, Artificial Sequence
  MKO10104314_B_Olfr206
  gRNA
guaaacuguggacuuaauau

SEQ ID NO: 104315 - RNA, 20 nt, Artificial Sequence
  MKO10104315_B_Olfr206
  gRNA
ucucaucuaugucaccacua

SEQ ID NO: 104316 - RNA, 20 nt, Artificial Sequence
  MKO10104316_B_Olfr206
  gRNA
aucaguauauccuauauaau

SEQ ID NO: 104317 - RNA, 20 nt, Artificial Sequence
  MKO10104317_B_Olfr207
  gRNA
auguuucauccugguagcga

SEQ ID NO: 104318 - RNA, 20 nt, Artificial Sequence
  MKO10104318_B_Olfr207
  gRNA
ggggugugauggagcugaac

SEQ ID NO: 104319 - RNA, 20 nt, Artificial Sequence
  MKO10104319_B_Olfr207
  gRNA
cucugacaaagauaauuauc

SEQ ID NO: 104320 - RNA, 20 nt, Artificial Sequence
  MKO10104320_B_Olfr208
  gRNA
auguuucauccugguagcga

SEQ ID NO: 104321 - RNA, 20 nt, Artificial Sequence
  MKO10104321_B_Olfr208
  gRNA
ggggugugauggagcugaac

SEQ ID NO: 104322 - RNA, 20 nt, Artificial Sequence
  MKO10104322_B_Olfr208
  gRNA
cucugacaaagauaauuauc

SEQ ID NO: 104323 - RNA, 20 nt, Artificial Sequence
  MKO10104323_B_Olfr209
  gRNA
auguuucauccugguagcga

SEQ ID NO: 104324 - RNA, 20 nt, Artificial Sequence
  MKO10104324_B_Olfr209
  gRNA
ggggugugauggagcugaac

SEQ ID NO: 104325 - RNA, 20 nt, Artificial Sequence
  MKO10104325_B_Olfr209
  gRNA
cucugacaaagauaauuauc

SEQ ID NO: 104326 - RNA, 20 nt, Artificial Sequence
  MKO10104326_B_Olfr20
  gRNA
ggugacccagcauggcagaa

SEQ ID NO: 104327 - RNA, 20 nt, Artificial Sequence
  MKO10104327_B_Olfr20
  gRNA
caauuugugcauaggacaca

SEQ ID NO: 104328 - RNA, 20 nt, Artificial Sequence
  MKO10104328_B_Olfr20
  gRNA
guacagcugcugaugcucug

SEQ ID NO: 104329 - RNA, 20 nt, Artificial Sequence
  MKO10104329_B_Olfr211
  gRNA
gaaguucaauaugccauaaa

SEQ ID NO: 104330 - RNA, 20 nt, Artificial Sequence
  MKO10104330_B_Olfr211
  gRNA
aaucaugacacuguucacgu

SEQ ID NO: 104331 - RNA, 20 nt, Artificial Sequence
  MKO10104331_B_Olfr211
  gRNA
uaccuccuccauuaugccca

SEQ ID NO: 104332 - RNA, 20 nt, Artificial Sequence
  MKO10104332_B_Olfr212
  gRNA
uuaugagcguguugcccaug

SEQ ID NO: 104333 - RNA, 20 nt, Artificial Sequence
  MKO10104333_B_Olfr212
  gRNA
aguaggccagcaagugcauc

SEQ ID NO: 104334 - RNA, 20 nt, Artificial Sequence
  MKO10104334_B_Olfr212
  gRNA
cuuaucccuggaucgcuauc

SEQ ID NO: 104335 - RNA, 20 nt, Artificial Sequence
  MKO10104335_B_Olfr213
  gRNA
cuuaucccuggaccgcuauc

SEQ ID NO: 104336 - RNA, 20 nt, Artificial Sequence
  MKO10104336_B_Olfr213
  gRNA
ugcacugcuccugugauauc

SEQ ID NO: 104337 - RNA, 20 nt, Artificial Sequence
  MKO10104337_B_Olfr213
  gRNA
cauaauuagcaucaccugcg

SEQ ID NO: 104338 - RNA, 20 nt, Artificial Sequence
  MKO10104338_B_Olfr214
  gRNA
cucaaucaugcgucuuccau

SEQ ID NO: 104339 - RNA, 20 nt, Artificial Sequence
  MKO10104339_B_Olfr214
  gRNA
cuauacucugcgcaacaagc

SEQ ID NO: 104340 - RNA, 20 nt, Artificial Sequence
  MKO10104340_B_Olfr214
  gRNA
cuccaaaaagaaagaucgcc

SEQ ID NO: 104341 - RNA, 20 nt, Artificial Sequence
  MKO10104341_B_Olfr215
  gRNA
aacuguccaggaauuuaccc

SEQ ID NO: 104342 - RNA, 20 nt, Artificial Sequence
  MKO10104342_B_Olfr215
  gRNA
caaggcaggccauaauuaga

SEQ ID NO: 104343 - RNA, 20 nt, Artificial Sequence
  MKO10104343_B_Olfr215
  gRNA
cgugagagcuucagcagaac

SEQ ID NO: 104344 - RNA, 20 nt, Artificial Sequence
  MKO10104344_B_Olfr218
  gRNA
ggccaaacacugauguaacc

SEQ ID NO: 104345 - RNA, 20 nt, Artificial Sequence
  MKO10104345_B_Olfr218
  gRNA
gaggcucuacgaaaggccau

SEQ ID NO: 104346 - RNA, 20 nt, Artificial Sequence
  MKO10104346_B_Olfr218
  gRNA
caagacucauggguaacaca

SEQ ID NO: 104347 - RNA, 20 nt, Artificial Sequence
  MKO10104347_B_Olfr220
  gRNA
acuccucaaugucuccugcg

SEQ ID NO: 104348 - RNA, 20 nt, Artificial Sequence
  MKO10104348_B_Olfr220
  gRNA
gucuacuagcucugccugag

SEQ ID NO: 104349 - RNA, 20 nt, Artificial Sequence
  MKO10104349_B_Olfr220
  gRNA
gacaagagcaucucauucaa

SEQ ID NO: 104350 - RNA, 20 nt, Artificial Sequence
  MKO10104350_B_Olfr221
  gRNA
ccuacaaaugcguucaaacc

SEQ ID NO: 104351 - RNA, 20 nt, Artificial Sequence
  MKO10104351_B_Olfr221
  gRNA
aguagcuggacuuagggcgc

SEQ ID NO: 104352 - RNA, 20 nt, Artificial Sequence
  MKO10104352_B_Olfr221
  gRNA
agaacgccuugaaccugccc

SEQ ID NO: 104353 - RNA, 20 nt, Artificial Sequence
  MKO10104353_B_Olfr222
  gRNA
auucgccguaguaucagcac

SEQ ID NO: 104354 - RNA, 20 nt, Artificial Sequence
  MKO10104354_B_Olfr222
  gRNA
guugccgaagccgcugagcc

SEQ ID NO: 104355 - RNA, 20 nt, Artificial Sequence
  MKO10104355_B_Olfr222
  gRNA
cgugcagccaccguaacuga

SEQ ID NO: 104356 - RNA, 20 nt, Artificial Sequence
  MKO10104356_B_Olfr223
  gRNA
cugcaccgaaagcgcucugc

SEQ ID NO: 104357 - RNA, 20 nt, Artificial Sequence
  MKO10104357_B_Olfr223
  gRNA
caugccaguuuaaucaaagc

SEQ ID NO: 104358 - RNA, 20 nt, Artificial Sequence
  MKO10104358_B_Olfr223
  gRNA
gaugcaugaugagcacauau

SEQ ID NO: 104359 - RNA, 20 nt, Artificial Sequence
  MKO10104359_B_Olfr224
  gRNA
uccuccugauaucaaccugu

SEQ ID NO: 104360 - RNA, 20 nt, Artificial Sequence
  MKO10104360_B_Olfr224
  gRNA
guucaacagagggguaagua

SEQ ID NO: 104361 - RNA, 20 nt, Artificial Sequence
  MKO10104361_B_Olfr224
  gRNA
gggugucagagaguaucaac

SEQ ID NO: 104362 - RNA, 20 nt, Artificial Sequence
  MKO10104362_B_Olfr225
  gRNA
ggcggcagcaauguagccgu

SEQ ID NO: 104363 - RNA, 20 nt, Artificial Sequence
  MKO10104363_B_Olfr225
  gRNA
cggaagaccaucagcuucgu

SEQ ID NO: 104364 - RNA, 20 nt, Artificial Sequence
  MKO10104364_B_Olfr225
  gRNA
ccggcaucucgcacacaaag

SEQ ID NO: 104365 - RNA, 20 nt, Artificial Sequence
  MKO10104365_B_Olfr228
  gRNA
uaacuugauuacuucaccac

SEQ ID NO: 104366 - RNA, 20 nt, Artificial Sequence
  MKO10104366_B_Olfr228
  gRNA
aaaucugcucuuagaaaaac

SEQ ID NO: 104367 - RNA, 20 nt, Artificial Sequence
  MKO10104367_B_Olfr228
  gRNA
aaaaaauauuuaugcugauu

SEQ ID NO: 104368 - RNA, 20 nt, Artificial Sequence
  MKO10104368_B_Olfr229
  gRNA
acucugcaauugcgaaaaca

SEQ ID NO: 104369 - RNA, 20 nt, Artificial Sequence
  MKO10104369_B_Olfr229
  gRNA
uccaucgaacuuacugauga

SEQ ID NO: 104370 - RNA, 20 nt, Artificial Sequence
  MKO10104370_B_Olfr229
  gRNA
ggugugagcugaguagaauc

SEQ ID NO: 104371 - RNA, 20 nt, Artificial Sequence
  MKO10104371_B_Olfr231
  gRNA
cuuuguauccaacuaacagc

SEQ ID NO: 104372 - RNA, 20 nt, Artificial Sequence
  MKO10104372_B_Olfr231
  gRNA
gucgcaauccaugcaaucuc

SEQ ID NO: 104373 - RNA, 20 nt, Artificial Sequence
  MKO10104373_B_Olfr231
  gRNA
uauaggacagggcaauuaca

SEQ ID NO: 104374 - RNA, 20 nt, Artificial Sequence
  MKO10104374_B_Olfr235
  gRNA
uggggaaaucugagaauccc

SEQ ID NO: 104375 - RNA, 20 nt, Artificial Sequence
  MKO10104375_B_Olfr235
  gRNA
agauucagucagccccauag

SEQ ID NO: 104376 - RNA, 20 nt, Artificial Sequence
  MKO10104376_B_Olfr235
  gRNA
ccaaucuuauuaaagcaaua

SEQ ID NO: 104377 - RNA, 20 nt, Artificial Sequence
  MKO10104377_B_Olfr237-ps1
  gRNA
gugugugcagucuguggucc

SEQ ID NO: 104378 - RNA, 20 nt, Artificial Sequence
  MKO10104378_B_Olfr237-ps1
  gRNA
gaaugaaagccaaccagaca

SEQ ID NO: 104379 - RNA, 20 nt, Artificial Sequence
  MKO10104379_B_Olfr237-ps1
  gRNA
agaugauuccauuccccaga

SEQ ID NO: 104380 - RNA, 20 nt, Artificial Sequence
  MKO10104380_B_Olfr239
  gRNA
augcggagagaauguacugg

SEQ ID NO: 104381 - RNA, 20 nt, Artificial Sequence
  MKO10104381_B_Olfr239
  gRNA
cauuggguccacagaaggug

SEQ ID NO: 104382 - RNA, 20 nt, Artificial Sequence
  MKO10104382_B_Olfr239
  gRNA
ccgcaugccaacuucaauag

SEQ ID NO: 104383 - RNA, 20 nt, Artificial Sequence
  MKO10104383_B_Olfr23
  gRNA
gaguuuacuccuuguugcca

SEQ ID NO: 104384 - RNA, 20 nt, Artificial Sequence
  MKO10104384_B_Olfr23
  gRNA
auaaaacucucuucuaacua

SEQ ID NO: 104385 - RNA, 20 nt, Artificial Sequence
  MKO10104385_B_Olfr23
  gRNA
gaguuaaugauaaugauaau

SEQ ID NO: 104386 - RNA, 20 nt, Artificial Sequence
  MKO10104386_B_Olfr242
  gRNA
aagaacaucaucucuuacuc

SEQ ID NO: 104387 - RNA, 20 nt, Artificial Sequence
  MKO10104387_B_Olfr242
  gRNA
aagcaugaagccaguguuua

SEQ ID NO: 104388 - RNA, 20 nt, Artificial Sequence
  MKO10104388_B_Olfr242
  gRNA
ccauccucugcauucacucc

SEQ ID NO: 104389 - RNA, 20 nt, Artificial Sequence
  MKO10104389_B_Olfr243
  gRNA
gucuaguccaagaauacuga

SEQ ID NO: 104390 - RNA, 20 nt, Artificial Sequence
  MKO10104390_B_Olfr243
  gRNA
uuuguggccuucaguauucu

SEQ ID NO: 104391 - RNA, 20 nt, Artificial Sequence
  MKO10104391_B_Olfr243
  gRNA
ugcaucuuaccaaaaauguu

SEQ ID NO: 104392 - RNA, 20 nt, Artificial Sequence
  MKO10104392_B_Olfr247
  gRNA
aauuguuccugcuccacaaa

SEQ ID NO: 104393 - RNA, 20 nt, Artificial Sequence
  MKO10104393_B_Olfr247
  gRNA
uauggcuuaugaucgcuuug

SEQ ID NO: 104394 - RNA, 20 nt, Artificial Sequence
  MKO10104394_B_Olfr247
  gRNA
gagugaagauccaggugguc

SEQ ID NO: 104395 - RNA, 20 nt, Artificial Sequence
  MKO10104395_B_Olfr248
  gRNA
uugcaagagcgaccauauac

SEQ ID NO: 104396 - RNA, 20 nt, Artificial Sequence
  MKO10104396_B_Olfr248
  gRNA
ugcaagcaaccugaccauca

SEQ ID NO: 104397 - RNA, 20 nt, Artificial Sequence
  MKO10104397_B_Olfr248
  gRNA
gaucaaccaaacaaucuuac

SEQ ID NO: 104398 - RNA, 20 nt, Artificial Sequence
  MKO10104398_B_Olfr24
  gRNA
caagaucuuugugcucauug

SEQ ID NO: 104399 - RNA, 20 nt, Artificial Sequence
  MKO10104399_B_Olfr24
  gRNA
gccugcugguugguguccca

SEQ ID NO: 104400 - RNA, 20 nt, Artificial Sequence
  MKO10104400_B_Olfr24
  gRNA
augaagcaggaauauaccca

SEQ ID NO: 104401 - RNA, 20 nt, Artificial Sequence
  MKO10104401_B_Olfr250
  gRNA
uauccauuugucaucaucua

SEQ ID NO: 104402 - RNA, 20 nt, Artificial Sequence
  MKO10104402_B_Olfr250
  gRNA
cuaaagacaguuacaaucca

SEQ ID NO: 104403 - RNA, 20 nt, Artificial Sequence
  MKO10104403_B_Olfr250
  gRNA
aaugcuugcugcacacuuga

SEQ ID NO: 104404 - RNA, 20 nt, Artificial Sequence
  MKO10104404_B_Olfr251
  gRNA
ucauaaacccuguaugaguc

SEQ ID NO: 104405 - RNA, 20 nt, Artificial Sequence
  MKO10104405_B_Olfr251
  gRNA
cuguguaguuuaacaagaau

SEQ ID NO: 104406 - RNA, 20 nt, Artificial Sequence
  MKO10104406_B_Olfr251
  gRNA
cuugugagcucugcuguagu

SEQ ID NO: 104407 - RNA, 20 nt, Artificial Sequence
  MKO10104407_B_Olfr257
  gRNA
cugacgaauacaaaagaucc

SEQ ID NO: 104408 - RNA, 20 nt, Artificial Sequence
  MKO10104408_B_Olfr257
  gRNA
cgcuacgucaugcccaccuc

SEQ ID NO: 104409 - RNA, 20 nt, Artificial Sequence
  MKO10104409_B_Olfr257
  gRNA
uacccuccuagcugugaguu

SEQ ID NO: 104410 - RNA, 20 nt, Artificial Sequence
  MKO10104410_B_Olfr259
  gRNA
aauuccaugauucacacaau

SEQ ID NO: 104411 - RNA, 20 nt, Artificial Sequence
  MKO10104411_B_Olfr259
  gRNA
aacagaaaacccuaauuggc

SEQ ID NO: 104412 - RNA, 20 nt, Artificial Sequence
  MKO10104412_B_Olfr259
  gRNA
ugccucacaccuaacagcug

SEQ ID NO: 104413 - RNA, 20 nt, Artificial Sequence
  MKO10104413_B_Olfr25
  gRNA
ugagucaugcauccuguaaa

SEQ ID NO: 104414 - RNA, 20 nt, Artificial Sequence
  MKO10104414_B_Olfr25
  gRNA
guuugcuagugccaugguuc

SEQ ID NO: 104415 - RNA, 20 nt, Artificial Sequence
  MKO10104415_B_Olfr25
  gRNA
uuguaagccuuuacuguaca

SEQ ID NO: 104416 - RNA, 20 nt, Artificial Sequence
  MKO10104416_B_Olfr262
  gRNA
aacauagcaaagaucuauga

SEQ ID NO: 104417 - RNA, 20 nt, Artificial Sequence
  MKO10104417_B_Olfr262
  gRNA
guaaaucugugaaucccaag

SEQ ID NO: 104418 - RNA, 20 nt, Artificial Sequence
  MKO10104418_B_Olfr262
  gRNA
acaagacucacucaacccca

SEQ ID NO: 104419 - RNA, 20 nt, Artificial Sequence
  MKO10104419_B_Olfr263
  gRNA
aggauguuguguccacaucg

SEQ ID NO: 104420 - RNA, 20 nt, Artificial Sequence
  MKO10104420_B_Olfr263
  gRNA
augcacugaaaaaacucaug

SEQ ID NO: 104421 - RNA, 20 nt, Artificial Sequence
  MKO10104421_B_Olfr263
  gRNA
cuucuaguuucuccuuacuu

SEQ ID NO: 104422 - RNA, 20 nt, Artificial Sequence
  MKO10104422_B_Olfr266
  gRNA
guuggcugagggcacaagau

SEQ ID NO: 104423 - RNA, 20 nt, Artificial Sequence
  MKO10104423_B_Olfr266
  gRNA
cgauaccccauccucaugac

SEQ ID NO: 104424 - RNA, 20 nt, Artificial Sequence
  MKO10104424_B_Olfr266
  gRNA
auaguggaguuuguucuucg

SEQ ID NO: 104425 - RNA, 20 nt, Artificial Sequence
  MKO10104425_B_Olfr267
  gRNA
cuucagccuugucauguauc

SEQ ID NO: 104426 - RNA, 20 nt, Artificial Sequence
  MKO10104426_B_Olfr267
  gRNA
cgccagaaguauacacucug

SEQ ID NO: 104427 - RNA, 20 nt, Artificial Sequence
  MKO10104427_B_Olfr267
  gRNA
uacugaccaccagcauaacc

SEQ ID NO: 104428 - RNA, 20 nt, Artificial Sequence
  MKO10104428_B_Olfr26
  gRNA
auuaucaaagaaugggcacu

SEQ ID NO: 104429 - RNA, 20 nt, Artificial Sequence
  MKO10104429_B_Olfr26
  gRNA
gagcuucuccuauuuauuau

SEQ ID NO: 104430 - RNA, 20 nt, Artificial Sequence
  MKO10104430_B_Olfr26
  gRNA
auugagauguguguuagaac

SEQ ID NO: 104431 - RNA, 20 nt, Artificial Sequence
  MKO10104431_B_Olfr270
  gRNA
ccauuuguagagcacaacca

SEQ ID NO: 104432 - RNA, 20 nt, Artificial Sequence
  MKO10104432_B_Olfr270
  gRNA
auucagacagccuaugaccc

SEQ ID NO: 104433 - RNA, 20 nt, Artificial Sequence
  MKO10104433_B_Olfr270
  gRNA
caaaguauuauaugugcaca

SEQ ID NO: 104434 - RNA, 20 nt, Artificial Sequence
  MKO10104434_B_Olfr272
  gRNA
aauaaaaccgucugcagcuu

SEQ ID NO: 104435 - RNA, 20 nt, Artificial Sequence
  MKO10104435_B_Olfr272
  gRNA
aucaacgugaucagccuaac

SEQ ID NO: 104436 - RNA, 20 nt, Artificial Sequence
  MKO10104436_B_Olfr272
  gRNA
gggccuccaucacgcuuuga

SEQ ID NO: 104437 - RNA, 20 nt, Artificial Sequence
  MKO10104437_B_Olfr273
  gRNA
ggccauauuugauaugacca

SEQ ID NO: 104438 - RNA, 20 nt, Artificial Sequence
  MKO10104438_B_Olfr273
  gRNA
cccaaaucucaagaucugac

SEQ ID NO: 104439 - RNA, 20 nt, Artificial Sequence
  MKO10104439_B_Olfr273
  gRNA
gcugccagagaaccaugaug

SEQ ID NO: 104440 - RNA, 20 nt, Artificial Sequence
  MKO10104440_B_Olfr275
  gRNA
aagagagaaguacaucugcg

SEQ ID NO: 104441 - RNA, 20 nt, Artificial Sequence
  MKO10104441_B_Olfr275
  gRNA
gacccuccuguucauaauaa

SEQ ID NO: 104442 - RNA, 20 nt, Artificial Sequence
  MKO10104442_B_Olfr275
  gRNA
uucugcucucacuccuaugc

SEQ ID NO: 104443 - RNA, 20 nt, Artificial Sequence
  MKO10104443_B_Olfr279
  gRNA
auguguagccgaucuccagc

SEQ ID NO: 104444 - RNA, 20 nt, Artificial Sequence
  MKO10104444_B_Olfr279
  gRNA
agcacaugcccgccuugcuc

SEQ ID NO: 104445 - RNA, 20 nt, Artificial Sequence
  MKO10104445_B_Olfr279
  gRNA
ucaugaggaccggguaauga

SEQ ID NO: 104446 - RNA, 20 nt, Artificial Sequence
  MKO10104446_B_Olfr27
  gRNA
aagaacaucaucucuuacuc

SEQ ID NO: 104447 - RNA, 20 nt, Artificial Sequence
  MKO10104447_B_Olfr27
  gRNA
aagcaugaagccaguguuua

SEQ ID NO: 104448 - RNA, 20 nt, Artificial Sequence
  MKO10104448_B_Olfr27
  gRNA
ccauccucugcauucacucc

SEQ ID NO: 104449 - RNA, 20 nt, Artificial Sequence
  MKO10104449_B_Olfr281
  gRNA
cagcagcuucgguaccguga

SEQ ID NO: 104450 - RNA, 20 nt, Artificial Sequence
  MKO10104450_B_Olfr281
  gRNA
acagcgcgaaaaguagagcc

SEQ ID NO: 104451 - RNA, 20 nt, Artificial Sequence
  MKO10104451_B_Olfr281
  gRNA
cauaagauaacgaaucaagc

SEQ ID NO: 104452 - RNA, 20 nt, Artificial Sequence
  MKO10104452_B_Olfr282
  gRNA
uguggucaucucauggggcg

SEQ ID NO: 104453 - RNA, 20 nt, Artificial Sequence
  MKO10104453_B_Olfr282
  gRNA
agauaucggaacaggacaag

SEQ ID NO: 104454 - RNA, 20 nt, Artificial Sequence
  MKO10104454_B_Olfr282
  gRNA
uugagcaucaguuccaccac

SEQ ID NO: 104455 - RNA, 20 nt, Artificial Sequence
  MKO10104455_B_Olfr283
  gRNA
cgugaccguucuucucacag

SEQ ID NO: 104456 - RNA, 20 nt, Artificial Sequence
  MKO10104456_B_Olfr283
  gRNA
gucuucuuuguguucgcuac

SEQ ID NO: 104457 - RNA, 20 nt, Artificial Sequence
  MKO10104457_B_Olfr283
  gRNA
cgcuaccucaugccaaauuc

SEQ ID NO: 104458 - RNA, 20 nt, Artificial Sequence
  MKO10104458_B_Olfr284
  gRNA
uaugaccgcuacguugccau

SEQ ID NO: 104459 - RNA, 20 nt, Artificial Sequence
  MKO10104459_B_Olfr284
  gRNA
guuuaucaguuaucucuuac

SEQ ID NO: 104460 - RNA, 20 nt, Artificial Sequence
  MKO10104460_B_Olfr284
  gRNA
ggccugucugcuugcagcga

SEQ ID NO: 104461 - RNA, 20 nt, Artificial Sequence
  MKO10104461_B_Olfr285
  gRNA
cugacgaauacaaaagaucc

SEQ ID NO: 104462 - RNA, 20 nt, Artificial Sequence
  MKO10104462_B_Olfr285
  gRNA
cgcuacgucaugcccaccuc

SEQ ID NO: 104463 - RNA, 20 nt, Artificial Sequence
  MKO10104463_B_Olfr285
  gRNA
uacccuccuagcugugaguu

SEQ ID NO: 104464 - RNA, 20 nt, Artificial Sequence
  MKO10104464_B_Olfr286
  gRNA
gguccugucgauccuuacau

SEQ ID NO: 104465 - RNA, 20 nt, Artificial Sequence
  MKO10104465_B_Olfr286
  gRNA
gccgagcuuuguacaccaug

SEQ ID NO: 104466 - RNA, 20 nt, Artificial Sequence
  MKO10104466_B_Olfr286
  gRNA
uuucucugcagaacggaccu

SEQ ID NO: 104467 - RNA, 20 nt, Artificial Sequence
  MKO10104467_B_Olfr287
  gRNA
aaaugaagggggcuaugggg

SEQ ID NO: 104468 - RNA, 20 nt, Artificial Sequence
  MKO10104468_B_Olfr287
  gRNA
cuccgcagggccuccuccuc

SEQ ID NO: 104469 - RNA, 20 nt, Artificial Sequence
  MKO10104469_B_Olfr287
  gRNA
ugugacugaguucauccucg

SEQ ID NO: 104470 - RNA, 20 nt, Artificial Sequence
  MKO10104470_B_Olfr288
  gRNA
aaguagaaaaggucuuccua

SEQ ID NO: 104471 - RNA, 20 nt, Artificial Sequence
  MKO10104471_B_Olfr288
  gRNA
uugaggaggaggcccugugg

SEQ ID NO: 104472 - RNA, 20 nt, Artificial Sequence
  MKO10104472_B_Olfr288
  gRNA
ugggagaggcagccuggcuu

SEQ ID NO: 104473 - RNA, 20 nt, Artificial Sequence
  MKO10104473_B_Olfr290
  gRNA
cagucccagcuagagccacc

SEQ ID NO: 104474 - RNA, 20 nt, Artificial Sequence
  MKO10104474_B_Olfr290
  gRNA
aacucccauguauuaccugu

SEQ ID NO: 104475 - RNA, 20 nt, Artificial Sequence
  MKO10104475_B_Olfr290
  gRNA
auuugccaacagguaauaca

SEQ ID NO: 104476 - RNA, 20 nt, Artificial Sequence
  MKO10104476_B_Olfr291
  gRNA
uuagugauagcaaguaucuu

SEQ ID NO: 104477 - RNA, 20 nt, Artificial Sequence
  MKO10104477_B_Olfr291
  gRNA
aagaagcacuucugccauau

SEQ ID NO: 104478 - RNA, 20 nt, Artificial Sequence
  MKO10104478_B_Olfr291
  gRNA
ugcgcuuuccuucugcugac

SEQ ID NO: 104479 - RNA, 20 nt, Artificial Sequence
  MKO10104479_B_Olfr292
  gRNA
auaaucacaggauacaugag

SEQ ID NO: 104480 - RNA, 20 nt, Artificial Sequence
  MKO10104480_B_Olfr292
  gRNA
ugaugauaagauucccaaac

SEQ ID NO: 104481 - RNA, 20 nt, Artificial Sequence
  MKO10104481_B_Olfr292
  gRNA
agcaaucccagaaauaauug

SEQ ID NO: 104482 - RNA, 20 nt, Artificial Sequence
  MKO10104482_B_Olfr293
  gRNA
uguacaugggaagccuguua

SEQ ID NO: 104483 - RNA, 20 nt, Artificial Sequence
  MKO10104483_B_Olfr293
  gRNA
aagaccuccaguaguaacau

SEQ ID NO: 104484 - RNA, 20 nt, Artificial Sequence
  MKO10104484_B_Olfr293
  gRNA
agcauaugauauagcaauga

SEQ ID NO: 104485 - RNA, 20 nt, Artificial Sequence
  MKO10104485_B_Olfr294
  gRNA
aaaugugaggcacuauacca

SEQ ID NO: 104486 - RNA, 20 nt, Artificial Sequence
  MKO10104486_B_Olfr294
  gRNA
gaguucuaaguaucugucca

SEQ ID NO: 104487 - RNA, 20 nt, Artificial Sequence
  MKO10104487_B_Olfr294
  gRNA
ugaugagcgugaugagaagu

SEQ ID NO: 104488 - RNA, 20 nt, Artificial Sequence
  MKO10104488_B_Olfr295
  gRNA
auuucuuuggcugggugugc

SEQ ID NO: 104489 - RNA, 20 nt, Artificial Sequence
  MKO10104489_B_Olfr295
  gRNA
agcaaucucagaaauaguug

SEQ ID NO: 104490 - RNA, 20 nt, Artificial Sequence
  MKO10104490_B_Olfr295
  gRNA
acaagaacagcacagugagu

SEQ ID NO: 104491 - RNA, 20 nt, Artificial Sequence
  MKO10104491_B_Olfr297
  gRNA
cuuaccucacuuauccuuuc

SEQ ID NO: 104492 - RNA, 20 nt, Artificial Sequence
  MKO10104492_B_Olfr297
  gRNA
ugaaaguguucauaccugaa

SEQ ID NO: 104493 - RNA, 20 nt, Artificial Sequence
  MKO10104493_B_Olfr297
  gRNA
aacauagcacaugucuaaga

SEQ ID NO: 104494 - RNA, 20 nt, Artificial Sequence
  MKO10104494_B_Olfr298
  gRNA
caacaaaaucucuguccaag

SEQ ID NO: 104495 - RNA, 20 nt, Artificial Sequence
  MKO10104495_B_Olfr298
  gRNA
uccaaugacacuagaauaac

SEQ ID NO: 104496 - RNA, 20 nt, Artificial Sequence
  MKO10104496_B_Olfr298
  gRNA
gcuugacaucacuauuucuc

SEQ ID NO: 104497 - RNA, 20 nt, Artificial Sequence
  MKO10104497_B_Olfr299
  gRNA
accaacauuagaaguaguua

SEQ ID NO: 104498 - RNA, 20 nt, Artificial Sequence
  MKO10104498_B_Olfr299
  gRNA
cuaaucucugccauuaucau

SEQ ID NO: 104499 - RNA, 20 nt, Artificial Sequence
  MKO10104499_B_Olfr299
  gRNA
gcuuguuucaacucucucac

SEQ ID NO: 104500 - RNA, 20 nt, Artificial Sequence
  MKO10104500_B_Olfr2
  gRNA
aaaaauaguagugcccgcag

SEQ ID NO: 104501 - RNA, 20 nt, Artificial Sequence
  MKO10104501_B_Olfr2
  gRNA
uucagucagcaccaacacgu

SEQ ID NO: 104502 - RNA, 20 nt, Artificial Sequence
  MKO10104502_B_Olfr2
  gRNA
auugguuccgaggagaauca

SEQ ID NO: 104503 - RNA, 20 nt, Artificial Sequence
  MKO10104503_B_Olfr301
  gRNA
gcagcuaccacugaccaaaa

SEQ ID NO: 104504 - RNA, 20 nt, Artificial Sequence
  MKO10104504_B_Olfr301
  gRNA
aacguagcauauaucuaaaa

SEQ ID NO: 104505 - RNA, 20 nt, Artificial Sequence
  MKO10104505_B_Olfr301
  gRNA
aauuaggaguuuguuauuaa

SEQ ID NO: 104506 - RNA, 20 nt, Artificial Sequence
  MKO10104506_B_Olfr303
  gRNA
auugugaaguuguacuuagc

SEQ ID NO: 104507 - RNA, 20 nt, Artificial Sequence
  MKO10104507_B_Olfr303
  gRNA
ugugaccacgauguugccau

SEQ ID NO: 104508 - RNA, 20 nt, Artificial Sequence
  MKO10104508_B_Olfr303
  gRNA
cuucucacaaugagcuccua

SEQ ID NO: 104509 - RNA, 20 nt, Artificial Sequence
  MKO10104509_B_Olfr304
  gRNA
cccaaugacacuagaguaac

SEQ ID NO: 104510 - RNA, 20 nt, Artificial Sequence
  MKO10104510_B_Olfr304
  gRNA
augauugccucauaacacag

SEQ ID NO: 104511 - RNA, 20 nt, Artificial Sequence
  MKO10104511_B_Olfr304
  gRNA
acacuugcuuguaacuugug

SEQ ID NO: 104512 - RNA, 20 nt, Artificial Sequence
  MKO10104512_B_Olfr305
  gRNA
gugauguuccaucacucuua

SEQ ID NO: 104513 - RNA, 20 nt, Artificial Sequence
  MKO10104513_B_Olfr305
  gRNA
caaauacuucuccugaucca

SEQ ID NO: 104514 - RNA, 20 nt, Artificial Sequence
  MKO10104514_B_Olfr305
  gRNA
cugaaaugcacauccaagua

SEQ ID NO: 104515 - RNA, 20 nt, Artificial Sequence
  MKO10104515_B_Olfr307
  gRNA
cgucaggagaaauccaguga

SEQ ID NO: 104516 - RNA, 20 nt, Artificial Sequence
  MKO10104516_B_Olfr307
  gRNA
uaauaauucuauuuccguuc

SEQ ID NO: 104517 - RNA, 20 nt, Artificial Sequence
  MKO10104517_B_Olfr307
  gRNA
gggcuuccagguauauccca

SEQ ID NO: 104518 - RNA, 20 nt, Artificial Sequence
  MKO10104518_B_Olfr308
  gRNA
gcagacuguucauaauaguc

SEQ ID NO: 104519 - RNA, 20 nt, Artificial Sequence
  MKO10104519_B_Olfr308
  gRNA
uaauauggcaaucuugcuau

SEQ ID NO: 104520 - RNA, 20 nt, Artificial Sequence
  MKO10104520_B_Olfr308
  gRNA
accagaucucuaagaaugac

SEQ ID NO: 104521 - RNA, 20 nt, Artificial Sequence
  MKO10104521_B_Olfr309
  gRNA
acccaauaguauauagcuuc

SEQ ID NO: 104522 - RNA, 20 nt, Artificial Sequence
  MKO10104522_B_Olfr309
  gRNA
cuauugcuguaaccaauucc

SEQ ID NO: 104523 - RNA, 20 nt, Artificial Sequence
  MKO10104523_B_Olfr309
  gRNA
uaccaccuugucuuuaucaa

SEQ ID NO: 104524 - RNA, 20 nt, Artificial Sequence
  MKO10104524_B_Olfr30
  gRNA
gaucuuccgugauccacagu

SEQ ID NO: 104525 - RNA, 20 nt, Artificial Sequence
  MKO10104525_B_Olfr30
  gRNA
gguuggacgagcaucucuuu

SEQ ID NO: 104526 - RNA, 20 nt, Artificial Sequence
  MKO10104526_B_Olfr30
  gRNA
ugcucauggucguggccucc

SEQ ID NO: 104527 - RNA, 20 nt, Artificial Sequence
  MKO10104527_B_Olfr310
  gRNA
aauguagcccaugucuaaaa

SEQ ID NO: 104528 - RNA, 20 nt, Artificial Sequence
  MKO10104528_B_Olfr310
  gRNA
ugugcacacuugcaaugaca

SEQ ID NO: 104529 - RNA, 20 nt, Artificial Sequence
  MKO10104529_B_Olfr310
  gRNA
cucagucacuaggguggaau

SEQ ID NO: 104530 - RNA, 20 nt, Artificial Sequence
  MKO10104530_B_Olfr311
  gRNA
uccauaaaacaagaugaccg

SEQ ID NO: 104531 - RNA, 20 nt, Artificial Sequence
  MKO10104531_B_Olfr311
  gRNA
gcucuacagaaacuuuacug

SEQ ID NO: 104532 - RNA, 20 nt, Artificial Sequence
  MKO10104532_B_Olfr311
  gRNA
gagcuccuucgcccucacag

SEQ ID NO: 104533 - RNA, 20 nt, Artificial Sequence
  MKO10104533_B_Olfr312
  gRNA
guagauagcuccacccaccc

SEQ ID NO: 104534 - RNA, 20 nt, Artificial Sequence
  MKO10104534_B_Olfr312
  gRNA
ccaaugcagaacaauauuuc

SEQ ID NO: 104535 - RNA, 20 nt, Artificial Sequence
  MKO10104535_B_Olfr312
  gRNA
cuucgcauccccucaguaga

SEQ ID NO: 104536 - RNA, 20 nt, Artificial Sequence
  MKO10104536_B_Olfr313
  gRNA
agcccaccuccucacugaga

SEQ ID NO: 104537 - RNA, 20 nt, Artificial Sequence
  MKO10104537_B_Olfr313
  gRNA
uguaugaaaggcugaguaga

SEQ ID NO: 104538 - RNA, 20 nt, Artificial Sequence
  MKO10104538_B_Olfr313
  gRNA
cuuugcauccccucaguaga

SEQ ID NO: 104539 - RNA, 20 nt, Artificial Sequence
  MKO10104539_B_Olfr314
  gRNA
guguguggagccggcggucc

SEQ ID NO: 104540 - RNA, 20 nt, Artificial Sequence
  MKO10104540_B_Olfr314
  gRNA
cugugcugcccuaacuagua

SEQ ID NO: 104541 - RNA, 20 nt, Artificial Sequence
  MKO10104541_B_Olfr314
  gRNA
augcugacacuaccuuaucg

SEQ ID NO: 104542 - RNA, 20 nt, Artificial Sequence
  MKO10104542_B_Olfr315
  gRNA
acucgcccccugccaaagug

SEQ ID NO: 104543 - RNA, 20 nt, Artificial Sequence
  MKO10104543_B_Olfr315
  gRNA
ucucgugcucgucaaguagu

SEQ ID NO: 104544 - RNA, 20 nt, Artificial Sequence
  MKO10104544_B_Olfr315
  gRNA
gaucccgcugucccucgucc

SEQ ID NO: 104545 - RNA, 20 nt, Artificial Sequence
  MKO10104545_B_Olfr316
  gRNA
auccuggaaaagaccaacca

SEQ ID NO: 104546 - RNA, 20 nt, Artificial Sequence
  MKO10104546_B_Olfr316
  gRNA
gagucaggaaaccgcagcug

SEQ ID NO: 104547 - RNA, 20 nt, Artificial Sequence
  MKO10104547_B_Olfr316
  gRNA
uucauuucauuugucuccuc

SEQ ID NO: 104548 - RNA, 20 nt, Artificial Sequence
  MKO10104548_B_Olfr317
  gRNA
acucucagccuaccccgcug

SEQ ID NO: 104549 - RNA, 20 nt, Artificial Sequence
  MKO10104549_B_Olfr317
  gRNA
aaguaagggcuaguucuaga

SEQ ID NO: 104550 - RNA, 20 nt, Artificial Sequence
  MKO10104550_B_Olfr317
  gRNA
uugcgaaucagcucagcugc

SEQ ID NO: 104551 - RNA, 20 nt, Artificial Sequence
  MKO10104551_B_Olfr318
  gRNA
uuggacugcacagcccagaa

SEQ ID NO: 104552 - RNA, 20 nt, Artificial Sequence
  MKO10104552_B_Olfr318
  gRNA
ccacacuccuuacauucucc

SEQ ID NO: 104553 - RNA, 20 nt, Artificial Sequence
  MKO10104553_B_Olfr318
  gRNA
ucucaugggcaacaucacac

SEQ ID NO: 104554 - RNA, 20 nt, Artificial Sequence
  MKO10104554_B_Olfr319
  gRNA
ugacaaucauaugcucauau

SEQ ID NO: 104555 - RNA, 20 nt, Artificial Sequence
  MKO10104555_B_Olfr319
  gRNA
aggaggucauuggggcgcug

SEQ ID NO: 104556 - RNA, 20 nt, Artificial Sequence
  MKO10104556_B_Olfr319
  gRNA
uuuauguuuaugagucuugc

SEQ ID NO: 104557 - RNA, 20 nt, Artificial Sequence
  MKO10104557_B_Olfr31
  gRNA
ccccaugaaagugaaguccg

SEQ ID NO: 104558 - RNA, 20 nt, Artificial Sequence
  MKO10104558_B_Olfr31
  gRNA
aucucucgugaucuacagaa

SEQ ID NO: 104559 - RNA, 20 nt, Artificial Sequence
  MKO10104559_B_Olfr31
  gRNA
aagauaaucaacuagcaucu

SEQ ID NO: 104560 - RNA, 20 nt, Artificial Sequence
  MKO10104560_B_Olfr320
  gRNA
gucugcaguccagccugaug

SEQ ID NO: 104561 - RNA, 20 nt, Artificial Sequence
  MKO10104561_B_Olfr320
  gRNA
gagacaggaaaccgcagcug

SEQ ID NO: 104562 - RNA, 20 nt, Artificial Sequence
  MKO10104562_B_Olfr320
  gRNA
gccacuacuuugucccuucc

SEQ ID NO: 104563 - RNA, 20 nt, Artificial Sequence
  MKO10104563_B_Olfr322
  gRNA
gcccgcagcgggguagacug

SEQ ID NO: 104564 - RNA, 20 nt, Artificial Sequence
  MKO10104564_B_Olfr322
  gRNA
cugugucaacacugccgcag

SEQ ID NO: 104565 - RNA, 20 nt, Artificial Sequence
  MKO10104565_B_Olfr322
  gRNA
cuucucugaccggcccgagc

SEQ ID NO: 104566 - RNA, 20 nt, Artificial Sequence
  MKO10104566_B_Olfr323
  gRNA
gaucauggucccguaguaga

SEQ ID NO: 104567 - RNA, 20 nt, Artificial Sequence
  MKO10104567_B_Olfr323
  gRNA
gaaaugaccuuguugaguuc

SEQ ID NO: 104568 - RNA, 20 nt, Artificial Sequence
  MKO10104568_B_Olfr323
  gRNA
gaucaccauguugccuguaa

SEQ ID NO: 104569 - RNA, 20 nt, Artificial Sequence
  MKO10104569_B_Olfr324
  gRNA
caagucccuuuacuccgccg

SEQ ID NO: 104570 - RNA, 20 nt, Artificial Sequence
  MKO10104570_B_Olfr324
  gRNA
aggccaugauggccguugga

SEQ ID NO: 104571 - RNA, 20 nt, Artificial Sequence
  MKO10104571_B_Olfr324
  gRNA
ccgugcugaagaauccauug

SEQ ID NO: 104572 - RNA, 20 nt, Artificial Sequence
  MKO10104572_B_Olfr325
  gRNA
uccugcugaugucuuuaugu

SEQ ID NO: 104573 - RNA, 20 nt, Artificial Sequence
  MKO10104573_B_Olfr325
  gRNA
ggcacacccugugguucaug

SEQ ID NO: 104574 - RNA, 20 nt, Artificial Sequence
  MKO10104574_B_Olfr325
  gRNA
cucccuccacagcccugaga

SEQ ID NO: 104575 - RNA, 20 nt, Artificial Sequence
  MKO10104575_B_Olfr328
  gRNA
gacaaauccugugguucaug

SEQ ID NO: 104576 - RNA, 20 nt, Artificial Sequence
  MKO10104576_B_Olfr328
  gRNA
guucaacagaggggugacua

SEQ ID NO: 104577 - RNA, 20 nt, Artificial Sequence
  MKO10104577_B_Olfr328
  gRNA
uaaagccauccaaagauccc

SEQ ID NO: 104578 - RNA, 20 nt, Artificial Sequence
  MKO10104578_B_Olfr329-ps
  gRNA
cuccaaguucaucuccucac

SEQ ID NO: 104579 - RNA, 20 nt, Artificial Sequence
  MKO10104579_B_Olfr329-ps
  gRNA
cugaugcagagaacacagca

SEQ ID NO: 104580 - RNA, 20 nt, Artificial Sequence
  MKO10104580_B_Olfr329-ps
  gRNA
ggagaagcagagaccagaaa

SEQ ID NO: 104581 - RNA, 20 nt, Artificial Sequence
  MKO10104581_B_Olfr32
  gRNA
gacaaccaccaugaugugag

SEQ ID NO: 104582 - RNA, 20 nt, Artificial Sequence
  MKO10104582_B_Olfr32
  gRNA
caccacaaaagugucagugc

SEQ ID NO: 104583 - RNA, 20 nt, Artificial Sequence
  MKO10104583_B_Olfr32
  gRNA
ccaacuugaauaagggaugg

SEQ ID NO: 104584 - RNA, 20 nt, Artificial Sequence
  MKO10104584_B_Olfr330
  gRNA
agauagcagcaccauagaag

SEQ ID NO: 104585 - RNA, 20 nt, Artificial Sequence
  MKO10104585_B_Olfr330
  gRNA
ugaagccauccaaagauccc

SEQ ID NO: 104586 - RNA, 20 nt, Artificial Sequence
  MKO10104586_B_Olfr330
  gRNA
uccaacagacagacaucagg

SEQ ID NO: 104587 - RNA, 20 nt, Artificial Sequence
  MKO10104587_B_Olfr331
  gRNA
uccugcugaugucugucugu

SEQ ID NO: 104588 - RNA, 20 nt, Artificial Sequence
  MKO10104588_B_Olfr331
  gRNA
auacuggaguggaugacaga

SEQ ID NO: 104589 - RNA, 20 nt, Artificial Sequence
  MKO10104589_B_Olfr331
  gRNA
uguggagguggauugguaug

SEQ ID NO: 104590 - RNA, 20 nt, Artificial Sequence
  MKO10104590_B_Olfr332
  gRNA
gccagaugaggaguaucaag

SEQ ID NO: 104591 - RNA, 20 nt, Artificial Sequence
  MKO10104591_B_Olfr332
  gRNA
cccucuugauacuccucauc

SEQ ID NO: 104592 - RNA, 20 nt, Artificial Sequence
  MKO10104592_B_Olfr332
  gRNA
aacugcuccgauccaggugg

SEQ ID NO: 104593 - RNA, 20 nt, Artificial Sequence
  MKO10104593_B_Olfr338
  gRNA
agcuugauccucugcucgaa

SEQ ID NO: 104594 - RNA, 20 nt, Artificial Sequence
  MKO10104594_B_Olfr338
  gRNA
agacaccaccaucaaucaac

SEQ ID NO: 104595 - RNA, 20 nt, Artificial Sequence
  MKO10104595_B_Olfr338
  gRNA
aaacugugaaaaaauacucc

SEQ ID NO: 104596 - RNA, 20 nt, Artificial Sequence
  MKO10104596_B_Olfr339
  gRNA
ucaggacagaguacaaagcu

SEQ ID NO: 104597 - RNA, 20 nt, Artificial Sequence
  MKO10104597_B_Olfr339
  gRNA
uuuguacucuguccugaucc

SEQ ID NO: 104598 - RNA, 20 nt, Artificial Sequence
  MKO10104598_B_Olfr339
  gRNA
auaacaucaucaugaaucug

SEQ ID NO: 104599 - RNA, 20 nt, Artificial Sequence
  MKO10104599_B_Olfr33
  gRNA
ccauguucagagugcuaagu

SEQ ID NO: 104600 - RNA, 20 nt, Artificial Sequence
  MKO10104600_B_Olfr33
  gRNA
ccuacuuagcacucugaaca

SEQ ID NO: 104601 - RNA, 20 nt, Artificial Sequence
  MKO10104601_B_Olfr33
  gRNA
guaagagggacaaaguagcu

SEQ ID NO: 104602 - RNA, 20 nt, Artificial Sequence
  MKO10104602_B_Olfr340
  gRNA
uucuucuaauaguaguaucc

SEQ ID NO: 104603 - RNA, 20 nt, Artificial Sequence
  MKO10104603_B_Olfr340
  gRNA
gcgcugagaaauauccucag

SEQ ID NO: 104604 - RNA, 20 nt, Artificial Sequence
  MKO10104604_B_Olfr340
  gRNA
ucauaauggugacaccaaug

SEQ ID NO: 104605 - RNA, 20 nt, Artificial Sequence
  MKO10104605_B_Olfr341
  gRNA
auuggcagaggauaaaaccc

SEQ ID NO: 104606 - RNA, 20 nt, Artificial Sequence
  MKO10104606_B_Olfr341
  gRNA
cccauucagccagaggauca

SEQ ID NO: 104607 - RNA, 20 nt, Artificial Sequence
  MKO10104607_B_Olfr341
  gRNA
cauugagaaauauccucaac

SEQ ID NO: 104608 - RNA, 20 nt, Artificial Sequence
  MKO10104608_B_Olfr342
  gRNA
ucagaauugugacaccuaua

SEQ ID NO: 104609 - RNA, 20 nt, Artificial Sequence
  MKO10104609_B_Olfr342
  gRNA
aagggcauugccugaagaua

SEQ ID NO: 104610 - RNA, 20 nt, Artificial Sequence
  MKO10104610_B_Olfr342
  gRNA
acccagcauaugagauagau

SEQ ID NO: 104611 - RNA, 20 nt, Artificial Sequence
  MKO10104611_B_Olfr344
  gRNA
agucacaguuccaaagaugc

SEQ ID NO: 104612 - RNA, 20 nt, Artificial Sequence
  MKO10104612_B_Olfr344
  gRNA
agccucuguguucuucuagu

SEQ ID NO: 104613 - RNA, 20 nt, Artificial Sequence
  MKO10104613_B_Olfr344
  gRNA
ugacugcauuaccuaaaaca

SEQ ID NO: 104614 - RNA, 20 nt, Artificial Sequence
  MKO10104614_B_Olfr345
  gRNA
cccauucgagcagaggaaca

SEQ ID NO: 104615 - RNA, 20 nt, Artificial Sequence
  MKO10104615_B_Olfr345
  gRNA
uucuucuaguacuuguaucc

SEQ ID NO: 104616 - RNA, 20 nt, Artificial Sequence
  MKO10104616_B_Olfr345
  gRNA
augaacacagucuccuacca

SEQ ID NO: 104617 - RNA, 20 nt, Artificial Sequence
  MKO10104617_B_Olfr346
  gRNA
ugagcuugacagcuuaagca

SEQ ID NO: 104618 - RNA, 20 nt, Artificial Sequence
  MKO10104618_B_Olfr346
  gRNA
agcauauucacaagcauccu

SEQ ID NO: 104619 - RNA, 20 nt, Artificial Sequence
  MKO10104619_B_Olfr346
  gRNA
ucucaucagucacuguucca

SEQ ID NO: 104620 - RNA, 20 nt, Artificial Sequence
  MKO10104620_B_Olfr347
  gRNA
aagaaguauaaccagcuugu

SEQ ID NO: 104621 - RNA, 20 nt, Artificial Sequence
  MKO10104621_B_Olfr347
  gRNA
aucauugugguauaguguag

SEQ ID NO: 104622 - RNA, 20 nt, Artificial Sequence
  MKO10104622_B_Olfr347
  gRNA
ucagaauggugacagcuaug

SEQ ID NO: 104623 - RNA, 20 nt, Artificial Sequence
  MKO10104623_B_Olfr348
  gRNA
gagcuugucauucuuguugu

SEQ ID NO: 104624 - RNA, 20 nt, Artificial Sequence
  MKO10104624_B_Olfr348
  gRNA
cuagaagaauagugugcaca

SEQ ID NO: 104625 - RNA, 20 nt, Artificial Sequence
  MKO10104625_B_Olfr348
  gRNA
ugugccauuuguaugcauuc

SEQ ID NO: 104626 - RNA, 20 nt, Artificial Sequence
  MKO10104626_B_Olfr350
  gRNA
gaucauaugccauugaagug

SEQ ID NO: 104627 - RNA, 20 nt, Artificial Sequence
  MKO10104627_B_Olfr350
  gRNA
uuucauauuauucacugauc

SEQ ID NO: 104628 - RNA, 20 nt, Artificial Sequence
  MKO10104628_B_Olfr350
  gRNA
agacaucucccucaaugaac

SEQ ID NO: 104629 - RNA, 20 nt, Artificial Sequence
  MKO10104629_B_Olfr351
  gRNA
cauuguauuugccauccuaa

SEQ ID NO: 104630 - RNA, 20 nt, Artificial Sequence
  MKO10104630_B_Olfr351
  gRNA
cuuaggggguacaguacuca

SEQ ID NO: 104631 - RNA, 20 nt, Artificial Sequence
  MKO10104631_B_Olfr351
  gRNA
cacucaugucaaugaacuua

SEQ ID NO: 104632 - RNA, 20 nt, Artificial Sequence
  MKO10104632_B_Olfr352
  gRNA
cagucaguccaucucauaua

SEQ ID NO: 104633 - RNA, 20 nt, Artificial Sequence
  MKO10104633_B_Olfr352
  gRNA
uacuacuguuaauugugucc

SEQ ID NO: 104634 - RNA, 20 nt, Artificial Sequence
  MKO10104634_B_Olfr352
  gRNA
gaguacaugccauucaguuc

SEQ ID NO: 104635 - RNA, 20 nt, Artificial Sequence
  MKO10104635_B_Olfr353
  gRNA
ugcuacaacauccuucuccg

SEQ ID NO: 104636 - RNA, 20 nt, Artificial Sequence
  MKO10104636_B_Olfr353
  gRNA
gucaaugaguuagugcuuuc

SEQ ID NO: 104637 - RNA, 20 nt, Artificial Sequence
  MKO10104637_B_Olfr353
  gRNA
gugggucacagcuaauagcu

SEQ ID NO: 104638 - RNA, 20 nt, Artificial Sequence
  MKO10104638_B_Olfr354
  gRNA
acagcauuaaugcacaaagu

SEQ ID NO: 104639 - RNA, 20 nt, Artificial Sequence
  MKO10104639_B_Olfr354
  gRNA
guguuggguaucccuucuuc

SEQ ID NO: 104640 - RNA, 20 nt, Artificial Sequence
  MKO10104640_B_Olfr354
  gRNA
aauagaagaggcugcucccc

SEQ ID NO: 104641 - RNA, 20 nt, Artificial Sequence
  MKO10104641_B_Olfr355
  gRNA
uguaacaaggauucugaugu

SEQ ID NO: 104642 - RNA, 20 nt, Artificial Sequence
  MKO10104642_B_Olfr355
  gRNA
uugacaguauaaguagacac

SEQ ID NO: 104643 - RNA, 20 nt, Artificial Sequence
  MKO10104643_B_Olfr355
  gRNA
uaacagugauagcugucuuc

SEQ ID NO: 104644 - RNA, 20 nt, Artificial Sequence
  MKO10104644_B_Olfr356
  gRNA
caucuaguccaaugaaccac

SEQ ID NO: 104645 - RNA, 20 nt, Artificial Sequence
  MKO10104645_B_Olfr356
  gRNA
cuauccccuucacuacaccu

SEQ ID NO: 104646 - RNA, 20 nt, Artificial Sequence
  MKO10104646_B_Olfr356
  gRNA
guggaucagagacaauugcc

SEQ ID NO: 104647 - RNA, 20 nt, Artificial Sequence
  MKO10104647_B_Olfr357
  gRNA
ugugagagugccguagaaua

SEQ ID NO: 104648 - RNA, 20 nt, Artificial Sequence
  MKO10104648_B_Olfr357
  gRNA
gauagucaucaauggagcuc

SEQ ID NO: 104649 - RNA, 20 nt, Artificial Sequence
  MKO10104649_B_Olfr357
  gRNA
accuugaugauucauacaga

SEQ ID NO: 104650 - RNA, 20 nt, Artificial Sequence
  MKO10104650_B_Olfr358
  gRNA
aacaaaaccuaugcgaaugu

SEQ ID NO: 104651 - RNA, 20 nt, Artificial Sequence
  MKO10104651_B_Olfr358
  gRNA
ucgauccugguuuaagucau

SEQ ID NO: 104652 - RNA, 20 nt, Artificial Sequence
  MKO10104652_B_Olfr358
  gRNA
uuucuuuaucugagccaacc

SEQ ID NO: 104653 - RNA, 20 nt, Artificial Sequence
  MKO10104653_B_Olfr360
  gRNA
guagccccuucuucuucauu

SEQ ID NO: 104654 - RNA, 20 nt, Artificial Sequence
  MKO10104654_B_Olfr360
  gRNA
uucuagccaaagugccaaaa

SEQ ID NO: 104655 - RNA, 20 nt, Artificial Sequence
  MKO10104655_B_Olfr360
  gRNA
ugcacacacucucuguaaau

SEQ ID NO: 104656 - RNA, 20 nt, Artificial Sequence
  MKO10104656_B_Olfr361
  gRNA
aucuuguucuagauuguagc

SEQ ID NO: 104657 - RNA, 20 nt, Artificial Sequence
  MKO10104657_B_Olfr361
  gRNA
aguauggaaguucacuugcu

SEQ ID NO: 104658 - RNA, 20 nt, Artificial Sequence
  MKO10104658_B_Olfr361
  gRNA
gauuuauggcuacuaaaaac

SEQ ID NO: 104659 - RNA, 20 nt, Artificial Sequence
  MKO10104659_B_Olfr362
  gRNA
ccacgcaagagauaauacau

SEQ ID NO: 104660 - RNA, 20 nt, Artificial Sequence
  MKO10104660_B_Olfr362
  gRNA
ccuauguauuaucucuugcg

SEQ ID NO: 104661 - RNA, 20 nt, Artificial Sequence
  MKO10104661_B_Olfr362
  gRNA
ggauagucccaagucuauca

SEQ ID NO: 104662 - RNA, 20 nt, Artificial Sequence
  MKO10104662_B_Olfr365
  gRNA
ccaugaaugacaaguugcua

SEQ ID NO: 104663 - RNA, 20 nt, Artificial Sequence
  MKO10104663_B_Olfr365
  gRNA
agaugauacucccauagaac

SEQ ID NO: 104664 - RNA, 20 nt, Artificial Sequence
  MKO10104664_B_Olfr365
  gRNA
ucucagucaugaccacaauc

SEQ ID NO: 104665 - RNA, 20 nt, Artificial Sequence
  MKO10104665_B_Olfr366
  gRNA
uguguagucgggcaucucuc

SEQ ID NO: 104666 - RNA, 20 nt, Artificial Sequence
  MKO10104666_B_Olfr366
  gRNA
gaccagcaaccccaaacaac

SEQ ID NO: 104667 - RNA, 20 nt, Artificial Sequence
  MKO10104667_B_Olfr366
  gRNA
ugguaaagcagauguccacc

SEQ ID NO: 104668 - RNA, 20 nt, Artificial Sequence
  MKO10104668_B_Olfr367-ps
  gRNA
gugaaacuggccagaccucc

SEQ ID NO: 104669 - RNA, 20 nt, Artificial Sequence
  MKO10104669_B_Olfr367-ps
  gRNA
gguggucagagaagcccgua

SEQ ID NO: 104670 - RNA, 20 nt, Artificial Sequence
  MKO10104670_B_Olfr367-ps
  gRNA
aauguaccuggugaccuuau

SEQ ID NO: 104671 - RNA, 20 nt, Artificial Sequence
  MKO10104671_B_Olfr368
  gRNA
aucgauucugcugcccgggg

SEQ ID NO: 104672 - RNA, 20 nt, Artificial Sequence
  MKO10104672_B_Olfr368
  gRNA
uagacguggugacauaacug

SEQ ID NO: 104673 - RNA, 20 nt, Artificial Sequence
  MKO10104673_B_Olfr368
  gRNA
uacucauucguauagaugcc

SEQ ID NO: 104674 - RNA, 20 nt, Artificial Sequence
  MKO10104674_B_Olfr370
  gRNA
cacaaugacgaagguguagc

SEQ ID NO: 104675 - RNA, 20 nt, Artificial Sequence
  MKO10104675_B_Olfr370
  gRNA
ccaagaccagcgcgcaaagc

SEQ ID NO: 104676 - RNA, 20 nt, Artificial Sequence
  MKO10104676_B_Olfr370
  gRNA
uugccacccucugcgcuaca

SEQ ID NO: 104677 - RNA, 20 nt, Artificial Sequence
  MKO10104677_B_Olfr371
  gRNA
guaugcuuauaagccaugcc

SEQ ID NO: 104678 - RNA, 20 nt, Artificial Sequence
  MKO10104678_B_Olfr371
  gRNA
gagauucaguccguucucuu

SEQ ID NO: 104679 - RNA, 20 nt, Artificial Sequence
  MKO10104679_B_Olfr371
  gRNA
ggguguaccucaguucuauc

SEQ ID NO: 104680 - RNA, 20 nt, Artificial Sequence
  MKO10104680_B_Olfr372
  gRNA
uuaugggcaggucugauuuc

SEQ ID NO: 104681 - RNA, 20 nt, Artificial Sequence
  MKO10104681_B_Olfr372
  gRNA
ccugcccauaaccuugacca

SEQ ID NO: 104682 - RNA, 20 nt, Artificial Sequence
  MKO10104682_B_Olfr372
  gRNA
ggcagcuguauucauguaca

SEQ ID NO: 104683 - RNA, 20 nt, Artificial Sequence
  MKO10104683_B_Olfr373
  gRNA
ugggagcuguccugcucaug

SEQ ID NO: 104684 - RNA, 20 nt, Artificial Sequence
  MKO10104684_B_Olfr373
  gRNA
ccugcccaugaacuugacca

SEQ ID NO: 104685 - RNA, 20 nt, Artificial Sequence
  MKO10104685_B_Olfr373
  gRNA
ucaugagcaccugguagugc

SEQ ID NO: 104686 - RNA, 20 nt, Artificial Sequence
  MKO10104686_B_Olfr374
  gRNA
aguccuauggcuaccuaaca

SEQ ID NO: 104687 - RNA, 20 nt, Artificial Sequence
  MKO10104687_B_Olfr374
  gRNA
cccugaugaccuuuguccga

SEQ ID NO: 104688 - RNA, 20 nt, Artificial Sequence
  MKO10104688_B_Olfr374
  gRNA
guguccgaguucuugcugcu

SEQ ID NO: 104689 - RNA, 20 nt, Artificial Sequence
  MKO10104689_B_Olfr376
  gRNA
uuucaaggucugcaaaaaac

SEQ ID NO: 104690 - RNA, 20 nt, Artificial Sequence
  MKO10104690_B_Olfr376
  gRNA
ucuugcaaagaacacuaauu

SEQ ID NO: 104691 - RNA, 20 nt, Artificial Sequence
  MKO10104691_B_Olfr376
  gRNA
gaugggaguccagaugaaua

SEQ ID NO: 104692 - RNA, 20 nt, Artificial Sequence
  MKO10104692_B_Olfr378
  gRNA
cauaagauacaaugaugaga

SEQ ID NO: 104693 - RNA, 20 nt, Artificial Sequence
  MKO10104693_B_Olfr378
  gRNA
guauuaccaucauaggaaga

SEQ ID NO: 104694 - RNA, 20 nt, Artificial Sequence
  MKO10104694_B_Olfr378
  gRNA
caaccugcauaaggaauaga

SEQ ID NO: 104695 - RNA, 20 nt, Artificial Sequence
  MKO10104695_B_Olfr380
  gRNA
guaagaauggaaugaccaua

SEQ ID NO: 104696 - RNA, 20 nt, Artificial Sequence
  MKO10104696_B_Olfr380
  gRNA
gcuguaaaguuauuagcuga

SEQ ID NO: 104697 - RNA, 20 nt, Artificial Sequence
  MKO10104697_B_Olfr380
  gRNA
uauugccauaauguacacag

SEQ ID NO: 104698 - RNA, 20 nt, Artificial Sequence
  MKO10104698_B_Olfr381
  gRNA
caucacccaguuuauucucc

SEQ ID NO: 104699 - RNA, 20 nt, Artificial Sequence
  MKO10104699_B_Olfr381
  gRNA
ccccaagcucuguguuuguc

SEQ ID NO: 104700 - RNA, 20 nt, Artificial Sequence
  MKO10104700_B_Olfr381
  gRNA
cauaggccaugaucacaagg

SEQ ID NO: 104701 - RNA, 20 nt, Artificial Sequence
  MKO10104701_B_Olfr382
  gRNA
cauaagccaugaccaaaaga

SEQ ID NO: 104702 - RNA, 20 nt, Artificial Sequence
  MKO10104702_B_Olfr382
  gRNA
cucucauaucucuauuccuc

SEQ ID NO: 104703 - RNA, 20 nt, Artificial Sequence
  MKO10104703_B_Olfr382
  gRNA
cuugggguaugggcaggccc

SEQ ID NO: 104704 - RNA, 20 nt, Artificial Sequence
  MKO10104704_B_Olfr384
  gRNA
uagaacauuugcugcugcuc

SEQ ID NO: 104705 - RNA, 20 nt, Artificial Sequence
  MKO10104705_B_Olfr384
  gRNA
caucccucaguucauccucc

SEQ ID NO: 104706 - RNA, 20 nt, Artificial Sequence
  MKO10104706_B_Olfr384
  gRNA
aggcccaggaggaugaacug

SEQ ID NO: 104707 - RNA, 20 nt, Artificial Sequence
  MKO10104707_B_Olfr385
  gRNA
gauuagaguccuuugcaaga

SEQ ID NO: 104708 - RNA, 20 nt, Artificial Sequence
  MKO10104708_B_Olfr385
  gRNA
aauaaguacagugugcaaug

SEQ ID NO: 104709 - RNA, 20 nt, Artificial Sequence
  MKO10104709_B_Olfr385
  gRNA
augaugcugguauaacgaag

SEQ ID NO: 104710 - RNA, 20 nt, Artificial Sequence
  MKO10104710_B_Olfr389
  gRNA
guaccaucuauaucuuaugu

SEQ ID NO: 104711 - RNA, 20 nt, Artificial Sequence
  MKO10104711_B_Olfr389
  gRNA
cacuagugaaguacagaacu

SEQ ID NO: 104712 - RNA, 20 nt, Artificial Sequence
  MKO10104712_B_Olfr389
  gRNA
cagccaacauaagauauaga

SEQ ID NO: 104713 - RNA, 20 nt, Artificial Sequence
  MKO10104713_B_Olfr38
  gRNA
uugugccucucaccuuacua

SEQ ID NO: 104714 - RNA, 20 nt, Artificial Sequence
  MKO10104714_B_Olfr38
  gRNA
aucuaacaagauugcaauca

SEQ ID NO: 104715 - RNA, 20 nt, Artificial Sequence
  MKO10104715_B_Olfr38
  gRNA
gagacaucaacuucuccuga

SEQ ID NO: 104716 - RNA, 20 nt, Artificial Sequence
  MKO10104716_B_Olfr390
  gRNA
caucucucaguucuuacucc

SEQ ID NO: 104717 - RNA, 20 nt, Artificial Sequence
  MKO10104717_B_Olfr390
  gRNA
acaauuauuggcaucuacuu

SEQ ID NO: 104718 - RNA, 20 nt, Artificial Sequence
  MKO10104718_B_Olfr390
  gRNA
agaacugagagaugauaguc

SEQ ID NO: 104719 - RNA, 20 nt, Artificial Sequence
  MKO10104719_B_Olfr391-ps
  gRNA
aaaacugucauaaauaaccu

SEQ ID NO: 104720 - RNA, 20 nt, Artificial Sequence
  MKO10104720_B_Olfr391-ps
  gRNA
ccuauuuguucuccuaaagc

SEQ ID NO: 104721 - RNA, 20 nt, Artificial Sequence
  MKO10104721_B_Olfr391-ps
  gRNA
acaaggcauagaacaagugu

SEQ ID NO: 104722 - RNA, 20 nt, Artificial Sequence
  MKO10104722_B_Olfr392
  gRNA
aagacaaucuagccgugagu

SEQ ID NO: 104723 - RNA, 20 nt, Artificial Sequence
  MKO10104723_B_Olfr392
  gRNA
agaguagaauuauuacuuga

SEQ ID NO: 104724 - RNA, 20 nt, Artificial Sequence
  MKO10104724_B_Olfr392
  gRNA
acaacuucagaagagcuggu

SEQ ID NO: 104725 - RNA, 20 nt, Artificial Sequence
  MKO10104725_B_Olfr393
  gRNA
cauuagacaaguacagagcu

SEQ ID NO: 104726 - RNA, 20 nt, Artificial Sequence
  MKO10104726_B_Olfr393
  gRNA
ggcacaaauauacuuccuua

SEQ ID NO: 104727 - RNA, 20 nt, Artificial Sequence
  MKO10104727_B_Olfr393
  gRNA
acagcuuuaggacagcaaau

SEQ ID NO: 104728 - RNA, 20 nt, Artificial Sequence
  MKO10104728_B_Olfr394
  gRNA
cagucuaaaggggucugcca

SEQ ID NO: 104729 - RNA, 20 nt, Artificial Sequence
  MKO10104729_B_Olfr394
  gRNA
uagaauagguguugguacuc

SEQ ID NO: 104730 - RNA, 20 nt, Artificial Sequence
  MKO10104730_B_Olfr394
  gRNA
ugugagcagaauuugcauug

SEQ ID NO: 104731 - RNA, 20 nt, Artificial Sequence
  MKO10104731_B_Olfr395
  gRNA
ggaauuccaagaugagaguu

SEQ ID NO: 104732 - RNA, 20 nt, Artificial Sequence
  MKO10104732_B_Olfr395
  gRNA
aagacaaucuagccaugagu

SEQ ID NO: 104733 - RNA, 20 nt, Artificial Sequence
  MKO10104733_B_Olfr395
  gRNA
aaagaaccaaacucucaucu

SEQ ID NO: 104734 - RNA, 20 nt, Artificial Sequence
  MKO10104734_B_Olfr397
  gRNA
cucuucuagaagcauccgca

SEQ ID NO: 104735 - RNA, 20 nt, Artificial Sequence
  MKO10104735_B_Olfr397
  gRNA
ucuugcuggugugguucaau

SEQ ID NO: 104736 - RNA, 20 nt, Artificial Sequence
  MKO10104736_B_Olfr397
  gRNA
aaucacauuguuagcacaga

SEQ ID NO: 104737 - RNA, 20 nt, Artificial Sequence
  MKO10104737_B_Olfr398
  gRNA
guguguagaccgcugcacua

SEQ ID NO: 104738 - RNA, 20 nt, Artificial Sequence
  MKO10104738_B_Olfr398
  gRNA
agccaugucuuaugaccgug

SEQ ID NO: 104739 - RNA, 20 nt, Artificial Sequence
  MKO10104739_B_Olfr398
  gRNA
gugcauaggaaagggacacg

SEQ ID NO: 104740 - RNA, 20 nt, Artificial Sequence
  MKO10104740_B_Olfr399
  gRNA
aagaggaugggccgcaaaac

SEQ ID NO: 104741 - RNA, 20 nt, Artificial Sequence
  MKO10104741_B_Olfr399
  gRNA
uugggucagugcauuacuaa

SEQ ID NO: 104742 - RNA, 20 nt, Artificial Sequence
  MKO10104742_B_Olfr399
  gRNA
ucugaauccuccaacucaua

SEQ ID NO: 104743 - RNA, 20 nt, Artificial Sequence
  MKO10104743_B_Olfr39
  gRNA
acuaucacaauuccugcuac

SEQ ID NO: 104744 - RNA, 20 nt, Artificial Sequence
  MKO10104744_B_Olfr39
  gRNA
ucauuaauagacuaugaaac

SEQ ID NO: 104745 - RNA, 20 nt, Artificial Sequence
  MKO10104745_B_Olfr39
  gRNA
aagaauaucccgaaaagaau

SEQ ID NO: 104746 - RNA, 20 nt, Artificial Sequence
  MKO10104746_B_Olfr3
  gRNA
cuaugcauccucaucucuua

SEQ ID NO: 104747 - RNA, 20 nt, Artificial Sequence
  MKO10104747_B_Olfr3
  gRNA
caaggcuuuacagauacccu

SEQ ID NO: 104748 - RNA, 20 nt, Artificial Sequence
  MKO10104748_B_Olfr3
  gRNA
ugacacaucacucaaccaac

SEQ ID NO: 104749 - RNA, 20 nt, Artificial Sequence
  MKO10104749_B_Olfr401
  gRNA
agcugccacauugauauaag

SEQ ID NO: 104750 - RNA, 20 nt, Artificial Sequence
  MKO10104750_B_Olfr401
  gRNA
caagagccgacccaacauag

SEQ ID NO: 104751 - RNA, 20 nt, Artificial Sequence
  MKO10104751_B_Olfr401
  gRNA
ugugugagacaagcuccaua

SEQ ID NO: 104752 - RNA, 20 nt, Artificial Sequence
  MKO10104752_B_Olfr402
  gRNA
cauaauggcaggaaccccua

SEQ ID NO: 104753 - RNA, 20 nt, Artificial Sequence
  MKO10104753_B_Olfr402
  gRNA
gaccaagagccgaaccaaca

SEQ ID NO: 104754 - RNA, 20 nt, Artificial Sequence
  MKO10104754_B_Olfr402
  gRNA
caaaagcauacaauuccaua

SEQ ID NO: 104755 - RNA, 20 nt, Artificial Sequence
  MKO10104755_B_Olfr403
  gRNA
gucucacaugagggaagaag

SEQ ID NO: 104756 - RNA, 20 nt, Artificial Sequence
  MKO10104756_B_Olfr403
  gRNA
cagagaagacccccacccca

SEQ ID NO: 104757 - RNA, 20 nt, Artificial Sequence
  MKO10104757_B_Olfr403
  gRNA
uccacaacuuuguguccugc

SEQ ID NO: 104758 - RNA, 20 nt, Artificial Sequence
  MKO10104758_B_Olfr406
  gRNA
ugaugauggcugacacaaug

SEQ ID NO: 104759 - RNA, 20 nt, Artificial Sequence
  MKO10104759_B_Olfr406
  gRNA
acuuucucugcagaaguccc

SEQ ID NO: 104760 - RNA, 20 nt, Artificial Sequence
  MKO10104760_B_Olfr406
  gRNA
auguaccuggucacuguagc

SEQ ID NO: 104761 - RNA, 20 nt, Artificial Sequence
  MKO10104761_B_Olfr410
  gRNA
uuucaccucuuauaugcaug

SEQ ID NO: 104762 - RNA, 20 nt, Artificial Sequence
  MKO10104762_B_Olfr410
  gRNA
gaugccagcaccauagaaua

SEQ ID NO: 104763 - RNA, 20 nt, Artificial Sequence
  MKO10104763_B_Olfr410
  gRNA
gaaugaaccacacuauccag

SEQ ID NO: 104764 - RNA, 20 nt, Artificial Sequence
  MKO10104764_B_Olfr411
  gRNA
gcccccaacugugagcaagu

SEQ ID NO: 104765 - RNA, 20 nt, Artificial Sequence
  MKO10104765_B_Olfr411
  gRNA
gucuucagcuacaugcggcu

SEQ ID NO: 104766 - RNA, 20 nt, Artificial Sequence
  MKO10104766_B_Olfr411
  gRNA
cacaagcgcacaguucccua

SEQ ID NO: 104767 - RNA, 20 nt, Artificial Sequence
  MKO10104767_B_Olfr412
  gRNA
agacccacagaagguuacuc

SEQ ID NO: 104768 - RNA, 20 nt, Artificial Sequence
  MKO10104768_B_Olfr412
  gRNA
cacagccagaugggacgcac

SEQ ID NO: 104769 - RNA, 20 nt, Artificial Sequence
  MKO10104769_B_Olfr412
  gRNA
acauuucgcagaagauguag

SEQ ID NO: 104770 - RNA, 20 nt, Artificial Sequence
  MKO10104770_B_Olfr414
  gRNA
gaaucaugaccagcgccagc

SEQ ID NO: 104771 - RNA, 20 nt, Artificial Sequence
  MKO10104771_B_Olfr414
  gRNA
uacucauuguuucgacaauc

SEQ ID NO: 104772 - RNA, 20 nt, Artificial Sequence
  MKO10104772_B_Olfr414
  gRNA
caggacgguagagucucuua

SEQ ID NO: 104773 - RNA, 20 nt, Artificial Sequence
  MKO10104773_B_Olfr417
  gRNA
gacagccgcauuucagucac

SEQ ID NO: 104774 - RNA, 20 nt, Artificial Sequence
  MKO10104774_B_Olfr417
  gRNA
cauaccccaucaaagugaga

SEQ ID NO: 104775 - RNA, 20 nt, Artificial Sequence
  MKO10104775_B_Olfr417
  gRNA
uaucagauccaccagcaucu

SEQ ID NO: 104776 - RNA, 20 nt, Artificial Sequence
  MKO10104776_B_Olfr418-ps1
  gRNA
acucgguuaucaugaacaag

SEQ ID NO: 104777 - RNA, 20 nt, Artificial Sequence
  MKO10104777_B_Olfr418-ps1
  gRNA
caugauaaccgaguaccuca

SEQ ID NO: 104778 - RNA, 20 nt, Artificial Sequence
  MKO10104778_B_Olfr418-ps1
  gRNA
cauugccagucagaguuagc

SEQ ID NO: 104779 - RNA, 20 nt, Artificial Sequence
  MKO10104779_B_Olfr419
  gRNA
aauccucauccuuagucugc

SEQ ID NO: 104780 - RNA, 20 nt, Artificial Sequence
  MKO10104780_B_Olfr419
  gRNA
gaagcaguugguacaagccc

SEQ ID NO: 104781 - RNA, 20 nt, Artificial Sequence
  MKO10104781_B_Olfr419
  gRNA
caggauugcuaccaaaauau

SEQ ID NO: 104782 - RNA, 20 nt, Artificial Sequence
  MKO10104782_B_Olfr420
  gRNA
cagugguguaccauaucucc

SEQ ID NO: 104783 - RNA, 20 nt, Artificial Sequence
  MKO10104783_B_Olfr420
  gRNA
ccacaccaucgucaugauuc

SEQ ID NO: 104784 - RNA, 20 nt, Artificial Sequence
  MKO10104784_B_Olfr420
  gRNA
ccguaauuaucuccacagca

SEQ ID NO: 104785 - RNA, 20 nt, Artificial Sequence
  MKO10104785_B_Olfr421-ps1
  gRNA
uuacagcaaaaaagaucauc

SEQ ID NO: 104786 - RNA, 20 nt, Artificial Sequence
  MKO10104786_B_Olfr421-ps1
  gRNA
acccaaacaucaugacaccc

SEQ ID NO: 104787 - RNA, 20 nt, Artificial Sequence
  MKO10104787_B_Olfr421-ps1
  gRNA
cuucgguauuuccaagugaa

SEQ ID NO: 104788 - RNA, 20 nt, Artificial Sequence
  MKO10104788_B_Olfr424
  gRNA
cuuugaaccuguguugcguu

SEQ ID NO: 104789 - RNA, 20 nt, Artificial Sequence
  MKO10104789_B_Olfr424
  gRNA
gaaucaucaccgugauccug

SEQ ID NO: 104790 - RNA, 20 nt, Artificial Sequence
  MKO10104790_B_Olfr424
  gRNA
acccaacuaucaugacuccc

SEQ ID NO: 104791 - RNA, 20 nt, Artificial Sequence
  MKO10104791_B_Olfr426
  gRNA
guaguccugaagauuccauc

SEQ ID NO: 104792 - RNA, 20 nt, Artificial Sequence
  MKO10104792_B_Olfr426
  gRNA
gcaaugaccuucuccaauag

SEQ ID NO: 104793 - RNA, 20 nt, Artificial Sequence
  MKO10104793_B_Olfr426
  gRNA
ugcuccucccagagauugug

SEQ ID NO: 104794 - RNA, 20 nt, Artificial Sequence
  MKO10104794_B_Olfr427
  gRNA
gcaaugaccuucuccaauag

SEQ ID NO: 104795 - RNA, 20 nt, Artificial Sequence
  MKO10104795_B_Olfr427
  gRNA
ugcuccucccagagauugug

SEQ ID NO: 104796 - RNA, 20 nt, Artificial Sequence
  MKO10104796_B_Olfr427
  gRNA
uaagcuuucugugacuccaa

SEQ ID NO: 104797 - RNA, 20 nt, Artificial Sequence
  MKO10104797_B_Olfr429
  gRNA
cauuuauagcuugcgcaaca

SEQ ID NO: 104798 - RNA, 20 nt, Artificial Sequence
  MKO10104798_B_Olfr429
  gRNA
caaucuugauacaaagugac

SEQ ID NO: 104799 - RNA, 20 nt, Artificial Sequence
  MKO10104799_B_Olfr429
  gRNA
gccucccaaccagcaaccaa

SEQ ID NO: 104800 - RNA, 20 nt, Artificial Sequence
  MKO10104800_B_Olfr430
  gRNA
gaugagcauauuaccaccaa

SEQ ID NO: 104801 - RNA, 20 nt, Artificial Sequence
  MKO10104801_B_Olfr430
  gRNA
uguuagcacagaguagacua

SEQ ID NO: 104802 - RNA, 20 nt, Artificial Sequence
  MKO10104802_B_Olfr430
  gRNA
aacucauucaggccaucaag

SEQ ID NO: 104803 - RNA, 20 nt, Artificial Sequence
  MKO10104803_B_Olfr432
  gRNA
ggugagcaaaguauauacca

SEQ ID NO: 104804 - RNA, 20 nt, Artificial Sequence
  MKO10104804_B_Olfr432
  gRNA
cagagacaagcuuauugccu

SEQ ID NO: 104805 - RNA, 20 nt, Artificial Sequence
  MKO10104805_B_Olfr432
  gRNA
acucggucaugcccaaggag

SEQ ID NO: 104806 - RNA, 20 nt, Artificial Sequence
  MKO10104806_B_Olfr433
  gRNA
cagguacagcuauggcuugc

SEQ ID NO: 104807 - RNA, 20 nt, Artificial Sequence
  MKO10104807_B_Olfr433
  gRNA
acuaccaugcacucaugagc

SEQ ID NO: 104808 - RNA, 20 nt, Artificial Sequence
  MKO10104808_B_Olfr433
  gRNA
gauagaugcacagggucccc

SEQ ID NO: 104809 - RNA, 20 nt, Artificial Sequence
  MKO10104809_B_Olfr434
  gRNA
caaggagcacacauucagug

SEQ ID NO: 104810 - RNA, 20 nt, Artificial Sequence
  MKO10104810_B_Olfr434
  gRNA
gaggaaacuaccaagauuua

SEQ ID NO: 104811 - RNA, 20 nt, Artificial Sequence
  MKO10104811_B_Olfr434
  gRNA
ugugcaaagaaagucauucc

SEQ ID NO: 104812 - RNA, 20 nt, Artificial Sequence
  MKO10104812_B_Olfr435
  gRNA
ugcucccaaaugucaaaaau

SEQ ID NO: 104813 - RNA, 20 nt, Artificial Sequence
  MKO10104813_B_Olfr435
  gRNA
cauugcacagugaccuccua

SEQ ID NO: 104814 - RNA, 20 nt, Artificial Sequence
  MKO10104814_B_Olfr435
  gRNA
agccuguguguuugccuuag

SEQ ID NO: 104815 - RNA, 20 nt, Artificial Sequence
  MKO10104815_B_Olfr437
  gRNA
aucuucagccugcucgcaaa

SEQ ID NO: 104816 - RNA, 20 nt, Artificial Sequence
  MKO10104816_B_Olfr437
  gRNA
uaucuuacacgcacauccuc

SEQ ID NO: 104817 - RNA, 20 nt, Artificial Sequence
  MKO10104817_B_Olfr437
  gRNA
cccugacucugaucagcgag

SEQ ID NO: 104818 - RNA, 20 nt, Artificial Sequence
  MKO10104818_B_Olfr43
  gRNA
gucuagcugugaguagggug

SEQ ID NO: 104819 - RNA, 20 nt, Artificial Sequence
  MKO10104819_B_Olfr43
  gRNA
uaccacagauuucacucucc

SEQ ID NO: 104820 - RNA, 20 nt, Artificial Sequence
  MKO10104820_B_Olfr43
  gRNA
ggcauggucucacaugaggg

SEQ ID NO: 104821 - RNA, 20 nt, Artificial Sequence
  MKO10104821_B_Olfr441
  gRNA
ccauaauggcugcugucucc

SEQ ID NO: 104822 - RNA, 20 nt, Artificial Sequence
  MKO10104822_B_Olfr441
  gRNA
cucugugauccaugucugau

SEQ ID NO: 104823 - RNA, 20 nt, Artificial Sequence
  MKO10104823_B_Olfr441
  gRNA
gccauccugagaauccaguc

SEQ ID NO: 104824 - RNA, 20 nt, Artificial Sequence
  MKO10104824_B_Olfr444
  gRNA
cugaggucaagggcgcccuc

SEQ ID NO: 104825 - RNA, 20 nt, Artificial Sequence
  MKO10104825_B_Olfr444
  gRNA
ucaugaugacaguauaguga

SEQ ID NO: 104826 - RNA, 20 nt, Artificial Sequence
  MKO10104826_B_Olfr444
  gRNA
ccccacuaagaugaacacac

SEQ ID NO: 104827 - RNA, 20 nt, Artificial Sequence
  MKO10104827_B_Olfr446
  gRNA
gccauucucggaauccacuc

SEQ ID NO: 104828 - RNA, 20 nt, Artificial Sequence
  MKO10104828_B_Olfr446
  gRNA
cugugcuaucgccauguaca

SEQ ID NO: 104829 - RNA, 20 nt, Artificial Sequence
  MKO10104829_B_Olfr446
  gRNA
agucuccuauacacgaaucc

SEQ ID NO: 104830 - RNA, 20 nt, Artificial Sequence
  MKO10104830_B_Olfr447
  gRNA
gguugagcauaggauuaaaa

SEQ ID NO: 104831 - RNA, 20 nt, Artificial Sequence
  MKO10104831_B_Olfr447
  gRNA
uacccgcaucaaugaguuaa

SEQ ID NO: 104832 - RNA, 20 nt, Artificial Sequence
  MKO10104832_B_Olfr447
  gRNA
uuaaaggaggacaccucuug

SEQ ID NO: 104833 - RNA, 20 nt, Artificial Sequence
  MKO10104833_B_Olfr448
  gRNA
gcagagugaaaguauagagc

SEQ ID NO: 104834 - RNA, 20 nt, Artificial Sequence
  MKO10104834_B_Olfr448
  gRNA
gcucuauacuuucacucugc

SEQ ID NO: 104835 - RNA, 20 nt, Artificial Sequence
  MKO10104835_B_Olfr448
  gRNA
uccacguuguucuuauccug

SEQ ID NO: 104836 - RNA, 20 nt, Artificial Sequence
  MKO10104836_B_Olfr449
  gRNA
cuaggcggaaacagagucca

SEQ ID NO: 104837 - RNA, 20 nt, Artificial Sequence
  MKO10104837_B_Olfr449
  gRNA
acuguguuacgcaugccaac

SEQ ID NO: 104838 - RNA, 20 nt, Artificial Sequence
  MKO10104838_B_Olfr449
  gRNA
uucagcuacagucagaauau

SEQ ID NO: 104839 - RNA, 20 nt, Artificial Sequence
  MKO10104839_B_Olfr44
  gRNA
auuuauaugaucacuguagc

SEQ ID NO: 104840 - RNA, 20 nt, Artificial Sequence
  MKO10104840_B_Olfr44
  gRNA
ugccuucaguggagcgaaug

SEQ ID NO: 104841 - RNA, 20 nt, Artificial Sequence
  MKO10104841_B_Olfr44
  gRNA
aucugugcaucagcucacac

SEQ ID NO: 104842 - RNA, 20 nt, Artificial Sequence
  MKO10104842_B_Olfr450
  gRNA
uaguauugccccacaaaugc

SEQ ID NO: 104843 - RNA, 20 nt, Artificial Sequence
  MKO10104843_B_Olfr450
  gRNA
gugagacccuugcagugcuu

SEQ ID NO: 104844 - RNA, 20 nt, Artificial Sequence
  MKO10104844_B_Olfr450
  gRNA
gccacaaucuucacuuaccu

SEQ ID NO: 104845 - RNA, 20 nt, Artificial Sequence
  MKO10104845_B_Olfr452
  gRNA
aaauguccacacaggccaau

SEQ ID NO: 104846 - RNA, 20 nt, Artificial Sequence
  MKO10104846_B_Olfr452
  gRNA
caaggcuggucaucacaucg

SEQ ID NO: 104847 - RNA, 20 nt, Artificial Sequence
  MKO10104847_B_Olfr452
  gRNA
aaccaugaucacaaucucau

SEQ ID NO: 104848 - RNA, 20 nt, Artificial Sequence
  MKO10104848_B_Olfr453
  gRNA
cauaggccaucauugcuaau

SEQ ID NO: 104849 - RNA, 20 nt, Artificial Sequence
  MKO10104849_B_Olfr453
  gRNA
gggcuguauauacgugaaaa

SEQ ID NO: 104850 - RNA, 20 nt, Artificial Sequence
  MKO10104850_B_Olfr453
  gRNA
uauguacacguucgugcaca

SEQ ID NO: 104851 - RNA, 20 nt, Artificial Sequence
  MKO10104851_B_Olfr455
  gRNA
auccaguuacuccccucgac

SEQ ID NO: 104852 - RNA, 20 nt, Artificial Sequence
  MKO10104852_B_Olfr455
  gRNA
cacugccaccguuagcccca

SEQ ID NO: 104853 - RNA, 20 nt, Artificial Sequence
  MKO10104853_B_Olfr455
  gRNA
uggaggacuagcuguauccg

SEQ ID NO: 104854 - RNA, 20 nt, Artificial Sequence
  MKO10104854_B_Olfr456
  gRNA
ccaugagagaaaacaugacc

SEQ ID NO: 104855 - RNA, 20 nt, Artificial Sequence
  MKO10104855_B_Olfr456
  gRNA
accaugugccuuccuaccug

SEQ ID NO: 104856 - RNA, 20 nt, Artificial Sequence
  MKO10104856_B_Olfr456
  gRNA
caugaagauccauucuaccc

SEQ ID NO: 104857 - RNA, 20 nt, Artificial Sequence
  MKO10104857_B_Olfr457
  gRNA
caugaagauccguucuaccc

SEQ ID NO: 104858 - RNA, 20 nt, Artificial Sequence
  MKO10104858_B_Olfr457
  gRNA
uguggagcggggcugcaugu

SEQ ID NO: 104859 - RNA, 20 nt, Artificial Sequence
  MKO10104859_B_Olfr457
  gRNA
cauugcccagcagagucaac

SEQ ID NO: 104860 - RNA, 20 nt, Artificial Sequence
  MKO10104860_B_Olfr458
  gRNA
accaugcgccuucccaccug

SEQ ID NO: 104861 - RNA, 20 nt, Artificial Sequence
  MKO10104861_B_Olfr458
  gRNA
cacaaguaccaaaggcuuug

SEQ ID NO: 104862 - RNA, 20 nt, Artificial Sequence
  MKO10104862_B_Olfr458
  gRNA
gaucuuugagucaaagaauu

SEQ ID NO: 104863 - RNA, 20 nt, Artificial Sequence
  MKO10104863_B_Olfr459
  gRNA
cuucuauucagugacacugc

SEQ ID NO: 104864 - RNA, 20 nt, Artificial Sequence
  MKO10104864_B_Olfr459
  gRNA
cucuuccuuuaccucgcucu

SEQ ID NO: 104865 - RNA, 20 nt, Artificial Sequence
  MKO10104865_B_Olfr459
  gRNA
augaugacgcuauaccucaa

SEQ ID NO: 104866 - RNA, 20 nt, Artificial Sequence
  MKO10104866_B_Olfr45
  gRNA
aaaauugacgccuccaaaaa

SEQ ID NO: 104867 - RNA, 20 nt, Artificial Sequence
  MKO10104867_B_Olfr45
  gRNA
aucucccaaaagagucauaa

SEQ ID NO: 104868 - RNA, 20 nt, Artificial Sequence
  MKO10104868_B_Olfr45
  gRNA
cugagacauacauuccuuga

SEQ ID NO: 104869 - RNA, 20 nt, Artificial Sequence
  MKO10104869_B_Olfr460
  gRNA
cccuauuguagucggcugcc

SEQ ID NO: 104870 - RNA, 20 nt, Artificial Sequence
  MKO10104870_B_Olfr460
  gRNA
gcacaauaacaguuguaacc

SEQ ID NO: 104871 - RNA, 20 nt, Artificial Sequence
  MKO10104871_B_Olfr460
  gRNA
uuauugugcccgugaugcuc

SEQ ID NO: 104872 - RNA, 20 nt, Artificial Sequence
  MKO10104872_B_Olfr461
  gRNA
ugagcagcuauacuuguacc

SEQ ID NO: 104873 - RNA, 20 nt, Artificial Sequence
  MKO10104873_B_Olfr461
  gRNA
guaacagugucauggguagu

SEQ ID NO: 104874 - RNA, 20 nt, Artificial Sequence
  MKO10104874_B_Olfr461
  gRNA
cugucccuuauaugcuccag

SEQ ID NO: 104875 - RNA, 20 nt, Artificial Sequence
  MKO10104875_B_Olfr462
  gRNA
gauggauacugccuugucca

SEQ ID NO: 104876 - RNA, 20 nt, Artificial Sequence
  MKO10104876_B_Olfr462
  gRNA
cacucaacacuguguaguac

SEQ ID NO: 104877 - RNA, 20 nt, Artificial Sequence
  MKO10104877_B_Olfr462
  gRNA
agaccgugacuaugaugagg

SEQ ID NO: 104878 - RNA, 20 nt, Artificial Sequence
  MKO10104878_B_Olfr463
  gRNA
caugaacagccagcuuugua

SEQ ID NO: 104879 - RNA, 20 nt, Artificial Sequence
  MKO10104879_B_Olfr463
  gRNA
gcgcuuugcuagucucuuca

SEQ ID NO: 104880 - RNA, 20 nt, Artificial Sequence
  MKO10104880_B_Olfr463
  gRNA
gcaugggggucaugaccgua

SEQ ID NO: 104881 - RNA, 20 nt, Artificial Sequence
  MKO10104881_B_Olfr464
  gRNA
agaagaccgucccaccuccc

SEQ ID NO: 104882 - RNA, 20 nt, Artificial Sequence
  MKO10104882_B_Olfr464
  gRNA
acuccagaaacuccuauuug

SEQ ID NO: 104883 - RNA, 20 nt, Artificial Sequence
  MKO10104883_B_Olfr464
  gRNA
ugaugcugaggucgcacuca

SEQ ID NO: 104884 - RNA, 20 nt, Artificial Sequence
  MKO10104884_B_Olfr466
  gRNA
acucugugaguaugucccac

SEQ ID NO: 104885 - RNA, 20 nt, Artificial Sequence
  MKO10104885_B_Olfr466
  gRNA
aauagcaacauuuguauacc

SEQ ID NO: 104886 - RNA, 20 nt, Artificial Sequence
  MKO10104886_B_Olfr466
  gRNA
uuggcaugauuauaauuauc

SEQ ID NO: 104887 - RNA, 20 nt, Artificial Sequence
  MKO10104887_B_Olfr467
  gRNA
aggaaacucacaaucaugac

SEQ ID NO: 104888 - RNA, 20 nt, Artificial Sequence
  MKO10104888_B_Olfr467
  gRNA
cuuauugguuauuuccuaug

SEQ ID NO: 104889 - RNA, 20 nt, Artificial Sequence
  MKO10104889_B_Olfr467
  gRNA
guacaggacagcuccaccag

SEQ ID NO: 104890 - RNA, 20 nt, Artificial Sequence
  MKO10104890_B_Olfr469
  gRNA
caaaaugcuugccaacuucc

SEQ ID NO: 104891 - RNA, 20 nt, Artificial Sequence
  MKO10104891_B_Olfr469
  gRNA
uacugugacuauaaugacaa

SEQ ID NO: 104892 - RNA, 20 nt, Artificial Sequence
  MKO10104892_B_Olfr469
  gRNA
aaaaagcaccugagaaaagc

SEQ ID NO: 104893 - RNA, 20 nt, Artificial Sequence
  MKO10104893_B_Olfr46
  gRNA
uucugugccuauaucagucc

SEQ ID NO: 104894 - RNA, 20 nt, Artificial Sequence
  MKO10104894_B_Olfr46
  gRNA
cuggauacuccacucaacaa

SEQ ID NO: 104895 - RNA, 20 nt, Artificial Sequence
  MKO10104895_B_Olfr46
  gRNA
ugccccugcauuacagcucu

SEQ ID NO: 104896 - RNA, 20 nt, Artificial Sequence
  MKO10104896_B_Olfr470
  gRNA
cacugugacuauaaugacaa

SEQ ID NO: 104897 - RNA, 20 nt, Artificial Sequence
  MKO10104897_B_Olfr470
  gRNA
aaugcuugccaacuuccugc

SEQ ID NO: 104898 - RNA, 20 nt, Artificial Sequence
  MKO10104898_B_Olfr470
  gRNA
uccguggaguagcuggauuu

SEQ ID NO: 104899 - RNA, 20 nt, Artificial Sequence
  MKO10104899_B_Olfr472
  gRNA
ggcugaaaaccauaccacug

SEQ ID NO: 104900 - RNA, 20 nt, Artificial Sequence
  MKO10104900_B_Olfr472
  gRNA
guauauauuaucacuuuagu

SEQ ID NO: 104901 - RNA, 20 nt, Artificial Sequence
  MKO10104901_B_Olfr472
  gRNA
gaugauuagcucugccacag

SEQ ID NO: 104902 - RNA, 20 nt, Artificial Sequence
  MKO10104902_B_Olfr473
  gRNA
ggaggcugaaaaccauacca

SEQ ID NO: 104903 - RNA, 20 nt, Artificial Sequence
  MKO10104903_B_Olfr473
  gRNA
uucaguagaauaguucgacu

SEQ ID NO: 104904 - RNA, 20 nt, Artificial Sequence
  MKO10104904_B_Olfr473
  gRNA
auaaugcauauggagcuccu

SEQ ID NO: 104905 - RNA, 20 nt, Artificial Sequence
  MKO10104905_B_Olfr474
  gRNA
guaucuauuccucaaccacc

SEQ ID NO: 104906 - RNA, 20 nt, Artificial Sequence
  MKO10104906_B_Olfr474
  gRNA
aaugaauaacucugucaugc

SEQ ID NO: 104907 - RNA, 20 nt, Artificial Sequence
  MKO10104907_B_Olfr474
  gRNA
cucuguaucacaguauuauu

SEQ ID NO: 104908 - RNA, 20 nt, Artificial Sequence
  MKO10104908_B_Olfr476
  gRNA
ugaacucugucacaguugug

SEQ ID NO: 104909 - RNA, 20 nt, Artificial Sequence
  MKO10104909_B_Olfr476
  gRNA
aucacaccaacaauguuuaa

SEQ ID NO: 104910 - RNA, 20 nt, Artificial Sequence
  MKO10104910_B_Olfr476
  gRNA
ugaaggaauaauuccaauga

SEQ ID NO: 104911 - RNA, 20 nt, Artificial Sequence
  MKO10104911_B_Olfr477
  gRNA
cauuauaggugugauugaug

SEQ ID NO: 104912 - RNA, 20 nt, Artificial Sequence
  MKO10104912_B_Olfr477
  gRNA
aauucucuguuaaccccaaa

SEQ ID NO: 104913 - RNA, 20 nt, Artificial Sequence
  MKO10104913_B_Olfr477
  gRNA
agaguguuacuguaugucca

SEQ ID NO: 104914 - RNA, 20 nt, Artificial Sequence
  MKO10104914_B_Olfr478
  gRNA
uucuauucguuagucuucug

SEQ ID NO: 104915 - RNA, 20 nt, Artificial Sequence
  MKO10104915_B_Olfr478
  gRNA
agacauacaaucuccuacau

SEQ ID NO: 104916 - RNA, 20 nt, Artificial Sequence
  MKO10104916_B_Olfr478
  gRNA
gugaaugaaggaacaguugc

SEQ ID NO: 104917 - RNA, 20 nt, Artificial Sequence
  MKO10104917_B_Olfr479
  gRNA
ucauaucuuuaugaccccaa

SEQ ID NO: 104918 - RNA, 20 nt, Artificial Sequence
  MKO10104918_B_Olfr479
  gRNA
uuucugugauauuucacccc

SEQ ID NO: 104919 - RNA, 20 nt, Artificial Sequence
  MKO10104919_B_Olfr479
  gRNA
ugccaacaacuguuucauca

SEQ ID NO: 104920 - RNA, 20 nt, Artificial Sequence
  MKO10104920_B_Olfr47
  gRNA
agccuguguguucacuuuag

SEQ ID NO: 104921 - RNA, 20 nt, Artificial Sequence
  MKO10104921_B_Olfr47
  gRNA
caggaaacuaccaaggcuug

SEQ ID NO: 104922 - RNA, 20 nt, Artificial Sequence
  MKO10104922_B_Olfr47
  gRNA
caggagaaagcugacuaucc

SEQ ID NO: 104923 - RNA, 20 nt, Artificial Sequence
  MKO10104923_B_Olfr480
  gRNA
acagucugcauccuccuagu

SEQ ID NO: 104924 - RNA, 20 nt, Artificial Sequence
  MKO10104924_B_Olfr480
  gRNA
caguuacacccaucaugcug

SEQ ID NO: 104925 - RNA, 20 nt, Artificial Sequence
  MKO10104925_B_Olfr480
  gRNA
aaagggaacauuuaucccug

SEQ ID NO: 104926 - RNA, 20 nt, Artificial Sequence
  MKO10104926_B_Olfr481
  gRNA
uucagcugaccaagucaaag

SEQ ID NO: 104927 - RNA, 20 nt, Artificial Sequence
  MKO10104927_B_Olfr481
  gRNA
aacuaccgagugcuuccugc

SEQ ID NO: 104928 - RNA, 20 nt, Artificial Sequence
  MKO10104928_B_Olfr481
  gRNA
ucaguauaauccuccuaauu

SEQ ID NO: 104929 - RNA, 20 nt, Artificial Sequence
  MKO10104929_B_Olfr482
  gRNA
aauuaagccagcagaacaug

SEQ ID NO: 104930 - RNA, 20 nt, Artificial Sequence
  MKO10104930_B_Olfr482
  gRNA
aauaauaccaucuccuacau

SEQ ID NO: 104931 - RNA, 20 nt, Artificial Sequence
  MKO10104931_B_Olfr482
  gRNA
gaacaagagagcucaaucaa

SEQ ID NO: 104932 - RNA, 20 nt, Artificial Sequence
  MKO10104932_B_Olfr483
  gRNA
aaaaaaugaucgauucuauu

SEQ ID NO: 104933 - RNA, 20 nt, Artificial Sequence
  MKO10104933_B_Olfr483
  gRNA
uauaagaucccacaaccagc

SEQ ID NO: 104934 - RNA, 20 nt, Artificial Sequence
  MKO10104934_B_Olfr483
  gRNA
agccaaaaggaagcauucaa

SEQ ID NO: 104935 - RNA, 20 nt, Artificial Sequence
  MKO10104935_B_Olfr484
  gRNA
ucuguggaguaucuugacuu

SEQ ID NO: 104936 - RNA, 20 nt, Artificial Sequence
  MKO10104936_B_Olfr484
  gRNA
agagauccugacaucagaac

SEQ ID NO: 104937 - RNA, 20 nt, Artificial Sequence
  MKO10104937_B_Olfr484
  gRNA
aggacuugaaugcuuccuuc

SEQ ID NO: 104938 - RNA, 20 nt, Artificial Sequence
  MKO10104938_B_Olfr485
  gRNA
agacauagcaucuccuaccu

SEQ ID NO: 104939 - RNA, 20 nt, Artificial Sequence
  MKO10104939_B_Olfr485
  gRNA
agaugcuaugucucucaguc

SEQ ID NO: 104940 - RNA, 20 nt, Artificial Sequence
  MKO10104940_B_Olfr485
  gRNA
acugcagucacucuuucuua

SEQ ID NO: 104941 - RNA, 20 nt, Artificial Sequence
  MKO10104941_B_Olfr486
  gRNA
aguggaacgaaucuucaaga

SEQ ID NO: 104942 - RNA, 20 nt, Artificial Sequence
  MKO10104942_B_Olfr486
  gRNA
uagaagagacuccaaugaga

SEQ ID NO: 104943 - RNA, 20 nt, Artificial Sequence
  MKO10104943_B_Olfr486
  gRNA
agagagugacugcaguaaga

SEQ ID NO: 104944 - RNA, 20 nt, Artificial Sequence
  MKO10104944_B_Olfr487
  gRNA
uggaagaaacuccaaugaga

SEQ ID NO: 104945 - RNA, 20 nt, Artificial Sequence
  MKO10104945_B_Olfr487
  gRNA
ugcugaagagaaugacuuua

SEQ ID NO: 104946 - RNA, 20 nt, Artificial Sequence
  MKO10104946_B_Olfr487
  gRNA
ucccuggaguagauggacuu

SEQ ID NO: 104947 - RNA, 20 nt, Artificial Sequence
  MKO10104947_B_Olfr488
  gRNA
uguucugaugcgagugucuc

SEQ ID NO: 104948 - RNA, 20 nt, Artificial Sequence
  MKO10104948_B_Olfr488
  gRNA
ugccaaaguccaccuacucc

SEQ ID NO: 104949 - RNA, 20 nt, Artificial Sequence
  MKO10104949_B_Olfr488
  gRNA
ugacagaagaugaaaugccu

SEQ ID NO: 104950 - RNA, 20 nt, Artificial Sequence
  MKO10104950_B_Olfr48
  gRNA
auaaugaucguguagcgcag

SEQ ID NO: 104951 - RNA, 20 nt, Artificial Sequence
  MKO10104951_B_Olfr48
  gRNA
agcagccccgaaaaaaugcu

SEQ ID NO: 104952 - RNA, 20 nt, Artificial Sequence
  MKO10104952_B_Olfr48
  gRNA
guuuaacauaggaguaauca

SEQ ID NO: 104953 - RNA, 20 nt, Artificial Sequence
  MKO10104953_B_Olfr490
  gRNA
agaagcacaauuucauaccu

SEQ ID NO: 104954 - RNA, 20 nt, Artificial Sequence
  MKO10104954_B_Olfr490
  gRNA
auuaagaaacccagcaaugu

SEQ ID NO: 104955 - RNA, 20 nt, Artificial Sequence
  MKO10104955_B_Olfr490
  gRNA
cuucaguggaacgcaucuug

SEQ ID NO: 104956 - RNA, 20 nt, Artificial Sequence
  MKO10104956_B_Olfr491
  gRNA
augaauccuauuaacauuau

SEQ ID NO: 104957 - RNA, 20 nt, Artificial Sequence
  MKO10104957_B_Olfr491
  gRNA
auauacauugucaccuuagu

SEQ ID NO: 104958 - RNA, 20 nt, Artificial Sequence
  MKO10104958_B_Olfr491
  gRNA
agaacagaguugugcuucac

SEQ ID NO: 104959 - RNA, 20 nt, Artificial Sequence
  MKO10104959_B_Olfr492
  gRNA
cacuguaauaauaguaacug

SEQ ID NO: 104960 - RNA, 20 nt, Artificial Sequence
  MKO10104960_B_Olfr492
  gRNA
gaacaagagaguuccacuaa

SEQ ID NO: 104961 - RNA, 20 nt, Artificial Sequence
  MKO10104961_B_Olfr492
  gRNA
gccacauccaagguaggcaa

SEQ ID NO: 104962 - RNA, 20 nt, Artificial Sequence
  MKO10104962_B_Olfr493
  gRNA
ucaguggagaagcucgacuu

SEQ ID NO: 104963 - RNA, 20 nt, Artificial Sequence
  MKO10104963_B_Olfr493
  gRNA
aaaaagcagcuaagcugagc

SEQ ID NO: 104964 - RNA, 20 nt, Artificial Sequence
  MKO10104964_B_Olfr493
  gRNA
aaaaauaccauuuccuaucu

SEQ ID NO: 104965 - RNA, 20 nt, Artificial Sequence
  MKO10104965_B_Olfr494
  gRNA
auugcauguucuauucaguu

SEQ ID NO: 104966 - RNA, 20 nt, Artificial Sequence
  MKO10104966_B_Olfr494
  gRNA
cugaauagaacaugcaaugu

SEQ ID NO: 104967 - RNA, 20 nt, Artificial Sequence
  MKO10104967_B_Olfr494
  gRNA
ugcacaagaugaugguaaag

SEQ ID NO: 104968 - RNA, 20 nt, Artificial Sequence
  MKO10104968_B_Olfr495
  gRNA
agcgagagugacaucagaac

SEQ ID NO: 104969 - RNA, 20 nt, Artificial Sequence
  MKO10104969_B_Olfr495
  gRNA
ugaacucugucacuauagua

SEQ ID NO: 104970 - RNA, 20 nt, Artificial Sequence
  MKO10104970_B_Olfr495
  gRNA
gagugaaaaaggaagcauua

SEQ ID NO: 104971 - RNA, 20 nt, Artificial Sequence
  MKO10104971_B_Olfr497
  gRNA
cugacccaaagaaaucagcc

SEQ ID NO: 104972 - RNA, 20 nt, Artificial Sequence
  MKO10104972_B_Olfr497
  gRNA
ggccuugugucugcccucaa

SEQ ID NO: 104973 - RNA, 20 nt, Artificial Sequence
  MKO10104973_B_Olfr497
  gRNA
ugggugugacagaugaugaa

SEQ ID NO: 104974 - RNA, 20 nt, Artificial Sequence
  MKO10104974_B_Olfr498
  gRNA
ugucccaaaaaaagcagccg

SEQ ID NO: 104975 - RNA, 20 nt, Artificial Sequence
  MKO10104975_B_Olfr498
  gRNA
gaggcucuaaagagacaccu

SEQ ID NO: 104976 - RNA, 20 nt, Artificial Sequence
  MKO10104976_B_Olfr498
  gRNA
auguucuauucaguuuaccu

SEQ ID NO: 104977 - RNA, 20 nt, Artificial Sequence
  MKO10104977_B_Olfr49
  gRNA
augcuaaccaacaucaucac

SEQ ID NO: 104978 - RNA, 20 nt, Artificial Sequence
  MKO10104978_B_Olfr49
  gRNA
ccuguccauucuugccagac

SEQ ID NO: 104979 - RNA, 20 nt, Artificial Sequence
  MKO10104979_B_Olfr49
  gRNA
cugugacaacuuuccacuua

SEQ ID NO: 104980 - RNA, 20 nt, Artificial Sequence
  MKO10104980_B_Olfr502
  gRNA
gggaaccacacugcagugac

SEQ ID NO: 104981 - RNA, 20 nt, Artificial Sequence
  MKO10104981_B_Olfr502
  gRNA
agaaaacagcugaaccaagc

SEQ ID NO: 104982 - RNA, 20 nt, Artificial Sequence
  MKO10104982_B_Olfr502
  gRNA
ugcacaagaugaugacaaag

SEQ ID NO: 104983 - RNA, 20 nt, Artificial Sequence
  MKO10104983_B_Olfr503
  gRNA
ucuguagccaaguugcccug

SEQ ID NO: 104984 - RNA, 20 nt, Artificial Sequence
  MKO10104984_B_Olfr503
  gRNA
ugcccucagaaucaugauau

SEQ ID NO: 104985 - RNA, 20 nt, Artificial Sequence
  MKO10104985_B_Olfr503
  gRNA
agaaugguggaguaaugcag

SEQ ID NO: 104986 - RNA, 20 nt, Artificial Sequence
  MKO10104986_B_Olfr504
  gRNA
cuucaauaguuccaaguucc

SEQ ID NO: 104987 - RNA, 20 nt, Artificial Sequence
  MKO10104987_B_Olfr504
  gRNA
uucuugaacaauaauuccac

SEQ ID NO: 104988 - RNA, 20 nt, Artificial Sequence
  MKO10104988_B_Olfr504
  gRNA
caagccuggcaugugaugac

SEQ ID NO: 104989 - RNA, 20 nt, Artificial Sequence
  MKO10104989_B_Olfr506
  gRNA
gccacauccuagguauguaa

SEQ ID NO: 104990 - RNA, 20 nt, Artificial Sequence
  MKO10104990_B_Olfr506
  gRNA
auucuugccacuauaucugu

SEQ ID NO: 104991 - RNA, 20 nt, Artificial Sequence
  MKO10104991_B_Olfr506
  gRNA
gaacaagagaguucaacuag

SEQ ID NO: 104992 - RNA, 20 nt, Artificial Sequence
  MKO10104992_B_Olfr507
  gRNA
caucauugugaucacagugu

SEQ ID NO: 104993 - RNA, 20 nt, Artificial Sequence
  MKO10104993_B_Olfr507
  gRNA
cccauccuucaggauaccca

SEQ ID NO: 104994 - RNA, 20 nt, Artificial Sequence
  MKO10104994_B_Olfr507
  gRNA
aaaaugaaucaagaauuagc

SEQ ID NO: 104995 - RNA, 20 nt, Artificial Sequence
  MKO10104995_B_Olfr508
  gRNA
gaaacauuuauccuuguguc

SEQ ID NO: 104996 - RNA, 20 nt, Artificial Sequence
  MKO10104996_B_Olfr508
  gRNA
aaucuacucugucaccuuaa

SEQ ID NO: 104997 - RNA, 20 nt, Artificial Sequence
  MKO10104997_B_Olfr508
  gRNA
cacagucuguauucuccuag

SEQ ID NO: 104998 - RNA, 20 nt, Artificial Sequence
  MKO10104998_B_Olfr509
  gRNA
aucaggauuggauaaugcag

SEQ ID NO: 104999 - RNA, 20 nt, Artificial Sequence
  MKO10104999_B_Olfr509
  gRNA
ugagaagccaagcacacccg

SEQ ID NO: 105000 - RNA, 20 nt, Artificial Sequence
  MKO10105000_B_Olfr509
  gRNA
aaagcugccuaccaacacaa

SEQ ID NO: 105001 - RNA, 20 nt, Artificial Sequence
  MKO10105001_B_Olfr50
  gRNA
aaguacacagcuugauccuc

SEQ ID NO: 105002 - RNA, 20 nt, Artificial Sequence
  MKO10105002_B_Olfr50
  gRNA
ugcucaucauucuucucauu

SEQ ID NO: 105003 - RNA, 20 nt, Artificial Sequence
  MKO10105003_B_Olfr50
  gRNA
uguaccauucauaugcaucc

SEQ ID NO: 105004 - RNA, 20 nt, Artificial Sequence
  MKO10105004_B_Olfr510
  gRNA
uauaagacccuacaagcaau

SEQ ID NO: 105005 - RNA, 20 nt, Artificial Sequence
  MKO10105005_B_Olfr510
  gRNA
ugcuauugaauguuuccuuc

SEQ ID NO: 105006 - RNA, 20 nt, Artificial Sequence
  MKO10105006_B_Olfr510
  gRNA
uucuucugucacaccaaaua

SEQ ID NO: 105007 - RNA, 20 nt, Artificial Sequence
  MKO10105007_B_Olfr512
  gRNA
gcacaugccaguucuagcac

SEQ ID NO: 105008 - RNA, 20 nt, Artificial Sequence
  MKO10105008_B_Olfr512
  gRNA
ugaguacucuacagaccaca

SEQ ID NO: 105009 - RNA, 20 nt, Artificial Sequence
  MKO10105009_B_Olfr512
  gRNA
gacuccuccugugcuagaac

SEQ ID NO: 105010 - RNA, 20 nt, Artificial Sequence
  MKO10105010_B_Olfr513
  gRNA
uucucggcagugaaucucac

SEQ ID NO: 105011 - RNA, 20 nt, Artificial Sequence
  MKO10105011_B_Olfr513
  gRNA
aaauaacgucccauagaaga

SEQ ID NO: 105012 - RNA, 20 nt, Artificial Sequence
  MKO10105012_B_Olfr513
  gRNA
gucugcaaggaacuggugau

SEQ ID NO: 105013 - RNA, 20 nt, Artificial Sequence
  MKO10105013_B_Olfr514
  gRNA
ggaagugagaaaaucccaac

SEQ ID NO: 105014 - RNA, 20 nt, Artificial Sequence
  MKO10105014_B_Olfr514
  gRNA
acauggggauauguaggcug

SEQ ID NO: 105015 - RNA, 20 nt, Artificial Sequence
  MKO10105015_B_Olfr514
  gRNA
uaucaugacagcuacugugu

SEQ ID NO: 105016 - RNA, 20 nt, Artificial Sequence
  MKO10105016_B_Olfr516
  gRNA
acauagggaugugcaaacuc

SEQ ID NO: 105017 - RNA, 20 nt, Artificial Sequence
  MKO10105017_B_Olfr516
  gRNA
ucugcaaaauuuaucuuuag

SEQ ID NO: 105018 - RNA, 20 nt, Artificial Sequence
  MKO10105018_B_Olfr516
  gRNA
uacaguugaauucauccucu

SEQ ID NO: 105019 - RNA, 20 nt, Artificial Sequence
  MKO10105019_B_Olfr517
  gRNA
acauggggauaugcaggcuc

SEQ ID NO: 105020 - RNA, 20 nt, Artificial Sequence
  MKO10105020_B_Olfr517
  gRNA
caugcaagcuccaguacugc

SEQ ID NO: 105021 - RNA, 20 nt, Artificial Sequence
  MKO10105021_B_Olfr517
  gRNA
ggggaaacugaacacccaua

SEQ ID NO: 105022 - RNA, 20 nt, Artificial Sequence
  MKO10105022_B_Olfr518
  gRNA
gauggcagauugcagcaaau

SEQ ID NO: 105023 - RNA, 20 nt, Artificial Sequence
  MKO10105023_B_Olfr518
  gRNA
ggcuccacugcagcaacaag

SEQ ID NO: 105024 - RNA, 20 nt, Artificial Sequence
  MKO10105024_B_Olfr518
  gRNA
uaccagcauuucagguguaa

SEQ ID NO: 105025 - RNA, 20 nt, Artificial Sequence
  MKO10105025_B_Olfr519
  gRNA
acccagugauuaugagcaaa

SEQ ID NO: 105026 - RNA, 20 nt, Artificial Sequence
  MKO10105026_B_Olfr519
  gRNA
acacaucaccaauuucacaa

SEQ ID NO: 105027 - RNA, 20 nt, Artificial Sequence
  MKO10105027_B_Olfr519
  gRNA
gaucaaaauggugcuuguga

SEQ ID NO: 105028 - RNA, 20 nt, Artificial Sequence
  MKO10105028_B_Olfr51
  gRNA
aucggagaauuaucuuccuc

SEQ ID NO: 105029 - RNA, 20 nt, Artificial Sequence
  MKO10105029_B_Olfr51
  gRNA
cugaaguuaaaaucugccca

SEQ ID NO: 105030 - RNA, 20 nt, Artificial Sequence
  MKO10105030_B_Olfr51
  gRNA
cauaugauucaccaaugccu

SEQ ID NO: 105031 - RNA, 20 nt, Artificial Sequence
  MKO10105031_B_Olfr520
  gRNA
uggcucuaccgucuucuacc

SEQ ID NO: 105032 - RNA, 20 nt, Artificial Sequence
  MKO10105032_B_Olfr520
  gRNA
auggaggcuacaacuugcaa

SEQ ID NO: 105033 - RNA, 20 nt, Artificial Sequence
  MKO10105033_B_Olfr520
  gRNA
uacagaagcccaugagcguc

SEQ ID NO: 105034 - RNA, 20 nt, Artificial Sequence
  MKO10105034_B_Olfr521
  gRNA
uagggcuuuccaauacucuu

SEQ ID NO: 105035 - RNA, 20 nt, Artificial Sequence
  MKO10105035_B_Olfr521
  gRNA
acaggaugcgggcauaggag

SEQ ID NO: 105036 - RNA, 20 nt, Artificial Sequence
  MKO10105036_B_Olfr521
  gRNA
agccacauaggcuauggcga

SEQ ID NO: 105037 - RNA, 20 nt, Artificial Sequence
  MKO10105037_B_Olfr522
  gRNA
ccaccacuuucauguaugcc

SEQ ID NO: 105038 - RNA, 20 nt, Artificial Sequence
  MKO10105038_B_Olfr522
  gRNA
ccuagagaaccuggucauug

SEQ ID NO: 105039 - RNA, 20 nt, Artificial Sequence
  MKO10105039_B_Olfr522
  gRNA
uuccaggaggggcaggccgc

SEQ ID NO: 105040 - RNA, 20 nt, Artificial Sequence
  MKO10105040_B_Olfr523
  gRNA
gcuuuccugcacggacacgc

SEQ ID NO: 105041 - RNA, 20 nt, Artificial Sequence
  MKO10105041_B_Olfr523
  gRNA
cacgugagccgcagaaagag

SEQ ID NO: 105042 - RNA, 20 nt, Artificial Sequence
  MKO10105042_B_Olfr523
  gRNA
uaccaccugcguguccgugc

SEQ ID NO: 105043 - RNA, 20 nt, Artificial Sequence
  MKO10105043_B_Olfr524
  gRNA
cuucugccugccaccggcgg

SEQ ID NO: 105044 - RNA, 20 nt, Artificial Sequence
  MKO10105044_B_Olfr524
  gRNA
ggucaagcaagcgcuacaua

SEQ ID NO: 105045 - RNA, 20 nt, Artificial Sequence
  MKO10105045_B_Olfr524
  gRNA
guagcgcuugcuugaccucu

SEQ ID NO: 105046 - RNA, 20 nt, Artificial Sequence
  MKO10105046_B_Olfr525
  gRNA
uccggagccaggcugcaaau

SEQ ID NO: 105047 - RNA, 20 nt, Artificial Sequence
  MKO10105047_B_Olfr525
  gRNA
uccggauccuccuuggagaa

SEQ ID NO: 105048 - RNA, 20 nt, Artificial Sequence
  MKO10105048_B_Olfr525
  gRNA
cagcucagccccuagaaacc

SEQ ID NO: 105049 - RNA, 20 nt, Artificial Sequence
  MKO10105049_B_Olfr527
  gRNA
ugcuccaacgcaauugaaug

SEQ ID NO: 105050 - RNA, 20 nt, Artificial Sequence
  MKO10105050_B_Olfr527
  gRNA
cugcucugcacaccuuaucg

SEQ ID NO: 105051 - RNA, 20 nt, Artificial Sequence
  MKO10105051_B_Olfr527
  gRNA
ccacaauggccaaguugacc

SEQ ID NO: 105052 - RNA, 20 nt, Artificial Sequence
  MKO10105052_B_Olfr52
  gRNA
gagugugaaucaaugccaug

SEQ ID NO: 105053 - RNA, 20 nt, Artificial Sequence
  MKO10105053_B_Olfr52
  gRNA
uauuguccaugacccucuuc

SEQ ID NO: 105054 - RNA, 20 nt, Artificial Sequence
  MKO10105054_B_Olfr52
  gRNA
ugugggccucacagaucgca

SEQ ID NO: 105055 - RNA, 20 nt, Artificial Sequence
  MKO10105055_B_Olfr530
  gRNA
gcuggcgaugaugaagacau

SEQ ID NO: 105056 - RNA, 20 nt, Artificial Sequence
  MKO10105056_B_Olfr530
  gRNA
ccuugucaaucuuucccuga

SEQ ID NO: 105057 - RNA, 20 nt, Artificial Sequence
  MKO10105057_B_Olfr530
  gRNA
cuguucucuauacuuauguc

SEQ ID NO: 105058 - RNA, 20 nt, Artificial Sequence
  MKO10105058_B_Olfr531
  gRNA
ugcuccaacacaauugaacg

SEQ ID NO: 105059 - RNA, 20 nt, Artificial Sequence
  MKO10105059_B_Olfr531
  gRNA
aguuuaugcugguguuaguc

SEQ ID NO: 105060 - RNA, 20 nt, Artificial Sequence
  MKO10105060_B_Olfr531
  gRNA
accauucugcagcuccaaug

SEQ ID NO: 105061 - RNA, 20 nt, Artificial Sequence
  MKO10105061_B_Olfr532
  gRNA
ccugcgcauucgcucagccg

SEQ ID NO: 105062 - RNA, 20 nt, Artificial Sequence
  MKO10105062_B_Olfr532
  gRNA
agaaauugagucgcaccagc

SEQ ID NO: 105063 - RNA, 20 nt, Artificial Sequence
  MKO10105063_B_Olfr532
  gRNA
augugaagguagcccucaaa

SEQ ID NO: 105064 - RNA, 20 nt, Artificial Sequence
  MKO10105064_B_Olfr533
  gRNA
gaagagaacauccuggaccc

SEQ ID NO: 105065 - RNA, 20 nt, Artificial Sequence
  MKO10105065_B_Olfr533
  gRNA
uuauugacaaugacauccua

SEQ ID NO: 105066 - RNA, 20 nt, Artificial Sequence
  MKO10105066_B_Olfr533
  gRNA
ucauugucaauaaaaaguuc

SEQ ID NO: 105067 - RNA, 20 nt, Artificial Sequence
  MKO10105067_B_Olfr535
  gRNA
auaacacuauucacauaugu

SEQ ID NO: 105068 - RNA, 20 nt, Artificial Sequence
  MKO10105068_B_Olfr535
  gRNA
cacuaggccaaucagagccu

SEQ ID NO: 105069 - RNA, 20 nt, Artificial Sequence
  MKO10105069_B_Olfr535
  gRNA
ccauuagagccacuguguag

SEQ ID NO: 105070 - RNA, 20 nt, Artificial Sequence
  MKO10105070_B_Olfr536
  gRNA
gauggggucacaguugugua

SEQ ID NO: 105071 - RNA, 20 nt, Artificial Sequence
  MKO10105071_B_Olfr536
  gRNA
aacugcugggcuccuggaca

SEQ ID NO: 105072 - RNA, 20 nt, Artificial Sequence
  MKO10105072_B_Olfr536
  gRNA
agucaugacauuguugauaa

SEQ ID NO: 105073 - RNA, 20 nt, Artificial Sequence
  MKO10105073_B_Olfr538
  gRNA
ugugagcagcagcacuucag

SEQ ID NO: 105074 - RNA, 20 nt, Artificial Sequence
  MKO10105074_B_Olfr538
  gRNA
gccagagcugcacacagcug

SEQ ID NO: 105075 - RNA, 20 nt, Artificial Sequence
  MKO10105075_B_Olfr538
  gRNA
gaggacugaguaaaaaaaug

SEQ ID NO: 105076 - RNA, 20 nt, Artificial Sequence
  MKO10105076_B_Olfr539
  gRNA
gaaguugaugccuacaaaaa

SEQ ID NO: 105077 - RNA, 20 nt, Artificial Sequence
  MKO10105077_B_Olfr539
  gRNA
augcuaaccuuguugucuua

SEQ ID NO: 105078 - RNA, 20 nt, Artificial Sequence
  MKO10105078_B_Olfr539
  gRNA
accgaugaaccauacaacca

SEQ ID NO: 105079 - RNA, 20 nt, Artificial Sequence
  MKO10105079_B_Olfr53
  gRNA
ccugauuggccuaguaucug

SEQ ID NO: 105080 - RNA, 20 nt, Artificial Sequence
  MKO10105080_B_Olfr53
  gRNA
auuuaccucagugcuauacu

SEQ ID NO: 105081 - RNA, 20 nt, Artificial Sequence
  MKO10105081_B_Olfr53
  gRNA
caucaccuucaagggaugua

SEQ ID NO: 105082 - RNA, 20 nt, Artificial Sequence
  MKO10105082_B_Olfr541
  gRNA
augaggaacaaucuuagauc

SEQ ID NO: 105083 - RNA, 20 nt, Artificial Sequence
  MKO10105083_B_Olfr541
  gRNA
gcugccaaugauguagccau

SEQ ID NO: 105084 - RNA, 20 nt, Artificial Sequence
  MKO10105084_B_Olfr541
  gRNA
cuuccugucccucuacauga

SEQ ID NO: 105085 - RNA, 20 nt, Artificial Sequence
  MKO10105085_B_Olfr543
  gRNA
aucaggucaguauagcggag

SEQ ID NO: 105086 - RNA, 20 nt, Artificial Sequence
  MKO10105086_B_Olfr543
  gRNA
ugcauagaugauacggguau

SEQ ID NO: 105087 - RNA, 20 nt, Artificial Sequence
  MKO10105087_B_Olfr543
  gRNA
gcaaaucccaucucacuccg

SEQ ID NO: 105088 - RNA, 20 nt, Artificial Sequence
  MKO10105088_B_Olfr544
  gRNA
uccaggaagcucucuauucg

SEQ ID NO: 105089 - RNA, 20 nt, Artificial Sequence
  MKO10105089_B_Olfr544
  gRNA
ccucaggcgucaugucaggg

SEQ ID NO: 105090 - RNA, 20 nt, Artificial Sequence
  MKO10105090_B_Olfr544
  gRNA
auucagcgagauguccccac

SEQ ID NO: 105091 - RNA, 20 nt, Artificial Sequence
  MKO10105091_B_Olfr545
  gRNA
aguggcggaucacaucugag

SEQ ID NO: 105092 - RNA, 20 nt, Artificial Sequence
  MKO10105092_B_Olfr545
  gRNA
uauggacugcaacauccucc

SEQ ID NO: 105093 - RNA, 20 nt, Artificial Sequence
  MKO10105093_B_Olfr545
  gRNA
ugccuagaaggagcauaucc

SEQ ID NO: 105094 - RNA, 20 nt, Artificial Sequence
  MKO10105094_B_Olfr547
  gRNA
ggccagggaugcccaacaaa

SEQ ID NO: 105095 - RNA, 20 nt, Artificial Sequence
  MKO10105095_B_Olfr547
  gRNA
ggucuugauuccguaaauga

SEQ ID NO: 105096 - RNA, 20 nt, Artificial Sequence
  MKO10105096_B_Olfr547
  gRNA
acuuacaacaguguaguuua

SEQ ID NO: 105097 - RNA, 20 nt, Artificial Sequence
  MKO10105097_B_Olfr549
  gRNA
uguuaggaucggcuuggcug

SEQ ID NO: 105098 - RNA, 20 nt, Artificial Sequence
  MKO10105098_B_Olfr549
  gRNA
caucgagcacuacaguagag

SEQ ID NO: 105099 - RNA, 20 nt, Artificial Sequence
  MKO10105099_B_Olfr549
  gRNA
cugauauucgcgucaauguu

SEQ ID NO: 105100 - RNA, 20 nt, Artificial Sequence
  MKO10105100_B_Olfr54
  gRNA
caggcggggaucggagauga

SEQ ID NO: 105101 - RNA, 20 nt, Artificial Sequence
  MKO10105101_B_Olfr54
  gRNA
ggaggaccaccauggugauu

SEQ ID NO: 105102 - RNA, 20 nt, Artificial Sequence
  MKO10105102_B_Olfr54
  gRNA
ucuguucuauggcacaguac

SEQ ID NO: 105103 - RNA, 20 nt, Artificial Sequence
  MKO10105103_B_Olfr550
  gRNA
gacuugauacaguagaccac

SEQ ID NO: 105104 - RNA, 20 nt, Artificial Sequence
  MKO10105104_B_Olfr550
  gRNA
caagucgaagcagauccguc

SEQ ID NO: 105105 - RNA, 20 nt, Artificial Sequence
  MKO10105105_B_Olfr550
  gRNA
cauccacgccuucaccuaug

SEQ ID NO: 105106 - RNA, 20 nt, Artificial Sequence
  MKO10105106_B_Olfr551
  gRNA
ugagcaugggcggcacgacg

SEQ ID NO: 105107 - RNA, 20 nt, Artificial Sequence
  MKO10105107_B_Olfr551
  gRNA
cauuugcccaaaagagugcg

SEQ ID NO: 105108 - RNA, 20 nt, Artificial Sequence
  MKO10105108_B_Olfr551
  gRNA
aucugccgaccauugcacua

SEQ ID NO: 105109 - RNA, 20 nt, Artificial Sequence
  MKO10105109_B_Olfr552
  gRNA
cccgaucccugaaccagaac

SEQ ID NO: 105110 - RNA, 20 nt, Artificial Sequence
  MKO10105110_B_Olfr552
  gRNA
cuucugcucagccuauaccu

SEQ ID NO: 105111 - RNA, 20 nt, Artificial Sequence
  MKO10105111_B_Olfr552
  gRNA
aggcucgcuacaaggccuuu

SEQ ID NO: 105112 - RNA, 20 nt, Artificial Sequence
  MKO10105112_B_Olfr553
  gRNA
agccuuaggcgaauuagaag

SEQ ID NO: 105113 - RNA, 20 nt, Artificial Sequence
  MKO10105113_B_Olfr553
  gRNA
aaugauuuggguucgaaaaa

SEQ ID NO: 105114 - RNA, 20 nt, Artificial Sequence
  MKO10105114_B_Olfr553
  gRNA
aguacugauguaugguguag

SEQ ID NO: 105115 - RNA, 20 nt, Artificial Sequence
  MKO10105115_B_Olfr554
  gRNA
cuguucguaccaagcagauc

SEQ ID NO: 105116 - RNA, 20 nt, Artificial Sequence
  MKO10105116_B_Olfr554
  gRNA
gauggggcuggccacucccg

SEQ ID NO: 105117 - RNA, 20 nt, Artificial Sequence
  MKO10105117_B_Olfr554
  gRNA
gguacgaacagcauagacaa

SEQ ID NO: 105118 - RNA, 20 nt, Artificial Sequence
  MKO10105118_B_Olfr555
  gRNA
aggcuaaccucauugcaucu

SEQ ID NO: 105119 - RNA, 20 nt, Artificial Sequence
  MKO10105119_B_Olfr555
  gRNA
gccauccacggguucuuguc

SEQ ID NO: 105120 - RNA, 20 nt, Artificial Sequence
  MKO10105120_B_Olfr555
  gRNA
agacaaagcagauacguaga

SEQ ID NO: 105121 - RNA, 20 nt, Artificial Sequence
  MKO10105121_B_Olfr556
  gRNA
gcagacuccauauccgcucc

SEQ ID NO: 105122 - RNA, 20 nt, Artificial Sequence
  MKO10105122_B_Olfr556
  gRNA
guccuaauaccauaaaugau

SEQ ID NO: 105123 - RNA, 20 nt, Artificial Sequence
  MKO10105123_B_Olfr556
  gRNA
uuaaggugggugggaugauc

SEQ ID NO: 105124 - RNA, 20 nt, Artificial Sequence
  MKO10105124_B_Olfr557
  gRNA
ggaugggccaaacuuccauu

SEQ ID NO: 105125 - RNA, 20 nt, Artificial Sequence
  MKO10105125_B_Olfr557
  gRNA
guaccacugauagcccaaug

SEQ ID NO: 105126 - RNA, 20 nt, Artificial Sequence
  MKO10105126_B_Olfr557
  gRNA
agaccaaggagauccguuca

SEQ ID NO: 105127 - RNA, 20 nt, Artificial Sequence
  MKO10105127_B_Olfr558
  gRNA
uggugcaccguuucagcaag

SEQ ID NO: 105128 - RNA, 20 nt, Artificial Sequence
  MKO10105128_B_Olfr558
  gRNA
gaagcccaggcaaaagcguu

SEQ ID NO: 105129 - RNA, 20 nt, Artificial Sequence
  MKO10105129_B_Olfr558
  gRNA
gagaagugaguccaaaccaa

SEQ ID NO: 105130 - RNA, 20 nt, Artificial Sequence
  MKO10105130_B_Olfr559
  gRNA
gagugcuacaguguacauga

SEQ ID NO: 105131 - RNA, 20 nt, Artificial Sequence
  MKO10105131_B_Olfr559
  gRNA
gccauguucaaaguucugag

SEQ ID NO: 105132 - RNA, 20 nt, Artificial Sequence
  MKO10105132_B_Olfr559
  gRNA
ugaggacucuaccacagaga

SEQ ID NO: 105133 - RNA, 20 nt, Artificial Sequence
  MKO10105133_B_Olfr55
  gRNA
auguggagagaauguacugg

SEQ ID NO: 105134 - RNA, 20 nt, Artificial Sequence
  MKO10105134_B_Olfr55
  gRNA
uuccuuucuacucacuguca

SEQ ID NO: 105135 - RNA, 20 nt, Artificial Sequence
  MKO10105135_B_Olfr55
  gRNA
gguugccuagcagagugaag

SEQ ID NO: 105136 - RNA, 20 nt, Artificial Sequence
  MKO10105136_B_Olfr560
  gRNA
gacuguaauguugacaccga

SEQ ID NO: 105137 - RNA, 20 nt, Artificial Sequence
  MKO10105137_B_Olfr560
  gRNA
caccccaauuugagcuauuc

SEQ ID NO: 105138 - RNA, 20 nt, Artificial Sequence
  MKO10105138_B_Olfr560
  gRNA
ggauauucugguucaacgcc

SEQ ID NO: 105139 - RNA, 20 nt, Artificial Sequence
  MKO10105139_B_Olfr561
  gRNA
gccaaaggcacuauugaucc

SEQ ID NO: 105140 - RNA, 20 nt, Artificial Sequence
  MKO10105140_B_Olfr561
  gRNA
auuagagugugcacaaaggg

SEQ ID NO: 105141 - RNA, 20 nt, Artificial Sequence
  MKO10105141_B_Olfr561
  gRNA
uccuaugaucagccugucau

SEQ ID NO: 105142 - RNA, 20 nt, Artificial Sequence
  MKO10105142_B_Olfr564
  gRNA
gaccuuaaaauagcucagau

SEQ ID NO: 105143 - RNA, 20 nt, Artificial Sequence
  MKO10105143_B_Olfr564
  gRNA
cacacugauacugacuccua

SEQ ID NO: 105144 - RNA, 20 nt, Artificial Sequence
  MKO10105144_B_Olfr564
  gRNA
agucaguaucagugugcccc

SEQ ID NO: 105145 - RNA, 20 nt, Artificial Sequence
  MKO10105145_B_Olfr566
  gRNA
aacuaguccacagaugcuau

SEQ ID NO: 105146 - RNA, 20 nt, Artificial Sequence
  MKO10105146_B_Olfr566
  gRNA
acucgagccaauagcaucug

SEQ ID NO: 105147 - RNA, 20 nt, Artificial Sequence
  MKO10105147_B_Olfr566
  gRNA
cauaucgauguaccagagac

SEQ ID NO: 105148 - RNA, 20 nt, Artificial Sequence
  MKO10105148_B_Olfr568
  gRNA
gaagacgaagcagauucgaa

SEQ ID NO: 105149 - RNA, 20 nt, Artificial Sequence
  MKO10105149_B_Olfr568
  gRNA
ucaacacaauugugccaauc

SEQ ID NO: 105150 - RNA, 20 nt, Artificial Sequence
  MKO10105150_B_Olfr568
  gRNA
uuugcacuauucucuacuac

SEQ ID NO: 105151 - RNA, 20 nt, Artificial Sequence
  MKO10105151_B_Olfr569
  gRNA
cuuguuggcuaucacugacc

SEQ ID NO: 105152 - RNA, 20 nt, Artificial Sequence
  MKO10105152_B_Olfr569
  gRNA
gguuggagaauuaucaauuu

SEQ ID NO: 105153 - RNA, 20 nt, Artificial Sequence
  MKO10105153_B_Olfr569
  gRNA
ccccuguucuucauguugcu

SEQ ID NO: 105154 - RNA, 20 nt, Artificial Sequence
  MKO10105154_B_Olfr56
  gRNA
agcccccaagaugcgagcau

SEQ ID NO: 105155 - RNA, 20 nt, Artificial Sequence
  MKO10105155_B_Olfr56
  gRNA
aguuaugcuggucuucaccg

SEQ ID NO: 105156 - RNA, 20 nt, Artificial Sequence
  MKO10105156_B_Olfr56
  gRNA
gacauuuccacagagcgcca

SEQ ID NO: 105157 - RNA, 20 nt, Artificial Sequence
  MKO10105157_B_Olfr570
  gRNA
uagcccaauuugcacaaccc

SEQ ID NO: 105158 - RNA, 20 nt, Artificial Sequence
  MKO10105158_B_Olfr570
  gRNA
cauguaccugacagcuaucc

SEQ ID NO: 105159 - RNA, 20 nt, Artificial Sequence
  MKO10105159_B_Olfr570
  gRNA
agcuggcgugcucugacaac

SEQ ID NO: 105160 - RNA, 20 nt, Artificial Sequence
  MKO10105160_B_Olfr571
  gRNA
aauauggcaugcgagccaac

SEQ ID NO: 105161 - RNA, 20 nt, Artificial Sequence
  MKO10105161_B_Olfr571
  gRNA
uugcugacaguaccacaacc

SEQ ID NO: 105162 - RNA, 20 nt, Artificial Sequence
  MKO10105162_B_Olfr571
  gRNA
ugggaucugcugaggaccgc

SEQ ID NO: 105163 - RNA, 20 nt, Artificial Sequence
  MKO10105163_B_Olfr572
  gRNA
caaggcgcaugacaucuuga

SEQ ID NO: 105164 - RNA, 20 nt, Artificial Sequence
  MKO10105164_B_Olfr572
  gRNA
cuauguguucauacuucgca

SEQ ID NO: 105165 - RNA, 20 nt, Artificial Sequence
  MKO10105165_B_Olfr572
  gRNA
gugucagucauucaucgcuu

SEQ ID NO: 105166 - RNA, 20 nt, Artificial Sequence
  MKO10105166_B_Olfr574
  gRNA
ucgcacuguucugaacaucg

SEQ ID NO: 105167 - RNA, 20 nt, Artificial Sequence
  MKO10105167_B_Olfr574
  gRNA
gauuagaacuugcucacguc

SEQ ID NO: 105168 - RNA, 20 nt, Artificial Sequence
  MKO10105168_B_Olfr574
  gRNA
cgauguucagaacagugcga

SEQ ID NO: 105169 - RNA, 20 nt, Artificial Sequence
  MKO10105169_B_Olfr575
  gRNA
gguugcguauggccaagaag

SEQ ID NO: 105170 - RNA, 20 nt, Artificial Sequence
  MKO10105170_B_Olfr575
  gRNA
gccuggaguaugcucaugcg

SEQ ID NO: 105171 - RNA, 20 nt, Artificial Sequence
  MKO10105171_B_Olfr575
  gRNA
uccacgcaugagcauacucc

SEQ ID NO: 105172 - RNA, 20 nt, Artificial Sequence
  MKO10105172_B_Olfr576
  gRNA
ucgugggcauauuccagucc

SEQ ID NO: 105173 - RNA, 20 nt, Artificial Sequence
  MKO10105173_B_Olfr576
  gRNA
guuaaccuaugugugagaua

SEQ ID NO: 105174 - RNA, 20 nt, Artificial Sequence
  MKO10105174_B_Olfr576
  gRNA
cauguaccuuauugccauca

SEQ ID NO: 105175 - RNA, 20 nt, Artificial Sequence
  MKO10105175_B_Olfr577
  gRNA
ccguauuguccauugccuca

SEQ ID NO: 105176 - RNA, 20 nt, Artificial Sequence
  MKO10105176_B_Olfr577
  gRNA
gggccuguuucccaaagcgg

SEQ ID NO: 105177 - RNA, 20 nt, Artificial Sequence
  MKO10105177_B_Olfr577
  gRNA
uugucuguaauccaccgcuu

SEQ ID NO: 105178 - RNA, 20 nt, Artificial Sequence
  MKO10105178_B_Olfr578
  gRNA
caugggcuaacacgugggau

SEQ ID NO: 105179 - RNA, 20 nt, Artificial Sequence
  MKO10105179_B_Olfr578
  gRNA
gcucaccaaagcgaugcaca

SEQ ID NO: 105180 - RNA, 20 nt, Artificial Sequence
  MKO10105180_B_Olfr578
  gRNA
uuaucccuugugcaucgcuu

SEQ ID NO: 105181 - RNA, 20 nt, Artificial Sequence
  MKO10105181_B_Olfr57
  gRNA
uugcaguagcaugugaguuu

SEQ ID NO: 105182 - RNA, 20 nt, Artificial Sequence
  MKO10105182_B_Olfr57
  gRNA
auguauauauugacuuucac

SEQ ID NO: 105183 - RNA, 20 nt, Artificial Sequence
  MKO10105183_B_Olfr57
  gRNA
caggugggagucaacaauga

SEQ ID NO: 105184 - RNA, 20 nt, Artificial Sequence
  MKO10105184_B_Olfr582
  gRNA
uaugaugcauucucucaugu

SEQ ID NO: 105185 - RNA, 20 nt, Artificial Sequence
  MKO10105185_B_Olfr582
  gRNA
uaguuugaugacuacagaug

SEQ ID NO: 105186 - RNA, 20 nt, Artificial Sequence
  MKO10105186_B_Olfr582
  gRNA
ccaugugcucacaguaagac

SEQ ID NO: 105187 - RNA, 20 nt, Artificial Sequence
  MKO10105187_B_Olfr583
  gRNA
cuuuaugccaccgcccucuc

SEQ ID NO: 105188 - RNA, 20 nt, Artificial Sequence
  MKO10105188_B_Olfr583
  gRNA
cuucagagaaagcaauauug

SEQ ID NO: 105189 - RNA, 20 nt, Artificial Sequence
  MKO10105189_B_Olfr583
  gRNA
ucuagaauucauaagaauca

SEQ ID NO: 105190 - RNA, 20 nt, Artificial Sequence
  MKO10105190_B_Olfr584
  gRNA
uaugauguauucucucaugu

SEQ ID NO: 105191 - RNA, 20 nt, Artificial Sequence
  MKO10105191_B_Olfr584
  gRNA
uuuguggcuuucucuguugu

SEQ ID NO: 105192 - RNA, 20 nt, Artificial Sequence
  MKO10105192_B_Olfr584
  gRNA
ccagaguauagccagcauuu

SEQ ID NO: 105193 - RNA, 20 nt, Artificial Sequence
  MKO10105193_B_Olfr585
  gRNA
guagagugcgcauuaucacu

SEQ ID NO: 105194 - RNA, 20 nt, Artificial Sequence
  MKO10105194_B_Olfr585
  gRNA
cuugugucguucuucagaug

SEQ ID NO: 105195 - RNA, 20 nt, Artificial Sequence
  MKO10105195_B_Olfr585
  gRNA
ccgugagcagacucuagucc

SEQ ID NO: 105196 - RNA, 20 nt, Artificial Sequence
  MKO10105196_B_Olfr586
  gRNA
ugaaguuucuacguuccauu

SEQ ID NO: 105197 - RNA, 20 nt, Artificial Sequence
  MKO10105197_B_Olfr586
  gRNA
caaggcgauagaugacagca

SEQ ID NO: 105198 - RNA, 20 nt, Artificial Sequence
  MKO10105198_B_Olfr586
  gRNA
agccaugagaaucuuagaua

SEQ ID NO: 105199 - RNA, 20 nt, Artificial Sequence
  MKO10105199_B_Olfr589
  gRNA
uuggcauugcugugcuagug

SEQ ID NO: 105200 - RNA, 20 nt, Artificial Sequence
  MKO10105200_B_Olfr589
  gRNA
accaaagcgaugugucauga

SEQ ID NO: 105201 - RNA, 20 nt, Artificial Sequence
  MKO10105201_B_Olfr589
  gRNA
cagcaccauucucaccaaua

SEQ ID NO: 105202 - RNA, 20 nt, Artificial Sequence
  MKO10105202_B_Olfr58
  gRNA
cagggaaaguaugguagcuu

SEQ ID NO: 105203 - RNA, 20 nt, Artificial Sequence
  MKO10105203_B_Olfr58
  gRNA
cauuuccaagcauagugagc

SEQ ID NO: 105204 - RNA, 20 nt, Artificial Sequence
  MKO10105204_B_Olfr58
  gRNA
uuucuuucaagcaucauugu

SEQ ID NO: 105205 - RNA, 20 nt, Artificial Sequence
  MKO10105205_B_Olfr591
  gRNA
auacuuaacuucagacucuu

SEQ ID NO: 105206 - RNA, 20 nt, Artificial Sequence
  MKO10105206_B_Olfr591
  gRNA
gaaucagaaauacuugagug

SEQ ID NO: 105207 - RNA, 20 nt, Artificial Sequence
  MKO10105207_B_Olfr591
  gRNA
aaaauguagcccaugcaaaa

SEQ ID NO: 105208 - RNA, 20 nt, Artificial Sequence
  MKO10105208_B_Olfr592
  gRNA
agccaccgaaguuuauuuca

SEQ ID NO: 105209 - RNA, 20 nt, Artificial Sequence
  MKO10105209_B_Olfr592
  gRNA
gcucugucuugauaacuacc

SEQ ID NO: 105210 - RNA, 20 nt, Artificial Sequence
  MKO10105210_B_Olfr592
  gRNA
ucuuguugccaaccucuauu

SEQ ID NO: 105211 - RNA, 20 nt, Artificial Sequence
  MKO10105211_B_Olfr593
  gRNA
cccucaaccuuuauccucau

SEQ ID NO: 105212 - RNA, 20 nt, Artificial Sequence
  MKO10105212_B_Olfr593
  gRNA
gccaaugaggauaaagguug

SEQ ID NO: 105213 - RNA, 20 nt, Artificial Sequence
  MKO10105213_B_Olfr593
  gRNA
cuaucuucuugugccaccca

SEQ ID NO: 105214 - RNA, 20 nt, Artificial Sequence
  MKO10105214_B_Olfr594
  gRNA
accaaagcggugugucauaa

SEQ ID NO: 105215 - RNA, 20 nt, Artificial Sequence
  MKO10105215_B_Olfr594
  gRNA
gacuagagucucaccacacc

SEQ ID NO: 105216 - RNA, 20 nt, Artificial Sequence
  MKO10105216_B_Olfr594
  gRNA
caugcuagccaccauugacu

SEQ ID NO: 105217 - RNA, 20 nt, Artificial Sequence
  MKO10105217_B_Olfr596
  gRNA
cucuauucucaccaacaaag

SEQ ID NO: 105218 - RNA, 20 nt, Artificial Sequence
  MKO10105218_B_Olfr596
  gRNA
aucagauaaacaacaaagaa

SEQ ID NO: 105219 - RNA, 20 nt, Artificial Sequence
  MKO10105219_B_Olfr596
  gRNA
guccucacuccauaaaugac

SEQ ID NO: 105220 - RNA, 20 nt, Artificial Sequence
  MKO10105220_B_Olfr597
  gRNA
agccauugccaauagaaugc

SEQ ID NO: 105221 - RNA, 20 nt, Artificial Sequence
  MKO10105221_B_Olfr597
  gRNA
cauccauaccuuacagugca

SEQ ID NO: 105222 - RNA, 20 nt, Artificial Sequence
  MKO10105222_B_Olfr597
  gRNA
caauuugaauggaccaaaaa

SEQ ID NO: 105223 - RNA, 20 nt, Artificial Sequence
  MKO10105223_B_Olfr598
  gRNA
acuccaugcccugaagggua

SEQ ID NO: 105224 - RNA, 20 nt, Artificial Sequence
  MKO10105224_B_Olfr598
  gRNA
uagcguucugggauuugaca

SEQ ID NO: 105225 - RNA, 20 nt, Artificial Sequence
  MKO10105225_B_Olfr598
  gRNA
auucuuacacccucaauucu

SEQ ID NO: 105226 - RNA, 20 nt, Artificial Sequence
  MKO10105226_B_Olfr599
  gRNA
uugguguagacugcguucug

SEQ ID NO: 105227 - RNA, 20 nt, Artificial Sequence
  MKO10105227_B_Olfr599
  gRNA
guccguauuaauaaaucaua

SEQ ID NO: 105228 - RNA, 20 nt, Artificial Sequence
  MKO10105228_B_Olfr599
  gRNA
uucuccucaagcgacugcaa

SEQ ID NO: 105229 - RNA, 20 nt, Artificial Sequence
  MKO10105229_B_Olfr59
  gRNA
ggugacaaauagcuacaaag

SEQ ID NO: 105230 - RNA, 20 nt, Artificial Sequence
  MKO10105230_B_Olfr59
  gRNA
caccuccaccacagugccca

SEQ ID NO: 105231 - RNA, 20 nt, Artificial Sequence
  MKO10105231_B_Olfr59
  gRNA
agacauaaggaugagcaaaa

SEQ ID NO: 105232 - RNA, 20 nt, Artificial Sequence
  MKO10105232_B_Olfr5
  gRNA
uugggucauacaagcuauga

SEQ ID NO: 105233 - RNA, 20 nt, Artificial Sequence
  MKO10105233_B_Olfr5
  gRNA
guacaugacagguugaguaa

SEQ ID NO: 105234 - RNA, 20 nt, Artificial Sequence
  MKO10105234_B_Olfr5
  gRNA
ucaacuucaggaccagugca

SEQ ID NO: 105235 - RNA, 20 nt, Artificial Sequence
  MKO10105235_B_Olfr600
  gRNA
uacagccauguacgcacagu

SEQ ID NO: 105236 - RNA, 20 nt, Artificial Sequence
  MKO10105236_B_Olfr600
  gRNA
uucggacugcauauauuaag

SEQ ID NO: 105237 - RNA, 20 nt, Artificial Sequence
  MKO10105237_B_Olfr600
  gRNA
uacccgcucccuuaucuguu

SEQ ID NO: 105238 - RNA, 20 nt, Artificial Sequence
  MKO10105238_B_Olfr601
  gRNA
cuaugagaauaugaguucgg

SEQ ID NO: 105239 - RNA, 20 nt, Artificial Sequence
  MKO10105239_B_Olfr601
  gRNA
caggaagguaaacccagcug

SEQ ID NO: 105240 - RNA, 20 nt, Artificial Sequence
  MKO10105240_B_Olfr601
  gRNA
gaaucccaauccacacauga

SEQ ID NO: 105241 - RNA, 20 nt, Artificial Sequence
  MKO10105241_B_Olfr603
  gRNA
ucauugcuuucuccuaugcu

SEQ ID NO: 105242 - RNA, 20 nt, Artificial Sequence
  MKO10105242_B_Olfr603
  gRNA
ccccucucucuuccaucugc

SEQ ID NO: 105243 - RNA, 20 nt, Artificial Sequence
  MKO10105243_B_Olfr603
  gRNA
guccucacuccauaaaugac

SEQ ID NO: 105244 - RNA, 20 nt, Artificial Sequence
  MKO10105244_B_Olfr605
  gRNA
caacagucgcaucgccaaga

SEQ ID NO: 105245 - RNA, 20 nt, Artificial Sequence
  MKO10105245_B_Olfr605
  gRNA
gcgacuguuggugagaauag

SEQ ID NO: 105246 - RNA, 20 nt, Artificial Sequence
  MKO10105246_B_Olfr605
  gRNA
augcaucgaaggugauauca

SEQ ID NO: 105247 - RNA, 20 nt, Artificial Sequence
  MKO10105247_B_Olfr606
  gRNA
aaaagaaugcuagacgaacc

SEQ ID NO: 105248 - RNA, 20 nt, Artificial Sequence
  MKO10105248_B_Olfr606
  gRNA
uuaccccaauaauguagaua

SEQ ID NO: 105249 - RNA, 20 nt, Artificial Sequence
  MKO10105249_B_Olfr606
  gRNA
ccgaaacuuauugcuaaaau

SEQ ID NO: 105250 - RNA, 20 nt, Artificial Sequence
  MKO10105250_B_Olfr608
  gRNA
agcuuccuaacucaucgcau

SEQ ID NO: 105251 - RNA, 20 nt, Artificial Sequence
  MKO10105251_B_Olfr608
  gRNA
gauuauauagccuguguagu

SEQ ID NO: 105252 - RNA, 20 nt, Artificial Sequence
  MKO10105252_B_Olfr608
  gRNA
aaagccggaacacugcuuga

SEQ ID NO: 105253 - RNA, 20 nt, Artificial Sequence
  MKO10105253_B_Olfr609
  gRNA
cacggaagauuuagugaccc

SEQ ID NO: 105254 - RNA, 20 nt, Artificial Sequence
  MKO10105254_B_Olfr609
  gRNA
cuuucuaugauccaccgauu

SEQ ID NO: 105255 - RNA, 20 nt, Artificial Sequence
  MKO10105255_B_Olfr609
  gRNA
aagaagcauugggcauaucc

SEQ ID NO: 105256 - RNA, 20 nt, Artificial Sequence
  MKO10105256_B_Olfr60
  gRNA
ccauuagagccauuacauag

SEQ ID NO: 105257 - RNA, 20 nt, Artificial Sequence
  MKO10105257_B_Olfr60
  gRNA
cuaauagcagaugucuucua

SEQ ID NO: 105258 - RNA, 20 nt, Artificial Sequence
  MKO10105258_B_Olfr60
  gRNA
cuucuugucccucuauguaa

SEQ ID NO: 105259 - RNA, 20 nt, Artificial Sequence
  MKO10105259_B_Olfr610
  gRNA
guguucaucccgauguccua

SEQ ID NO: 105260 - RNA, 20 nt, Artificial Sequence
  MKO10105260_B_Olfr610
  gRNA
guuucuuuccaugcugucga

SEQ ID NO: 105261 - RNA, 20 nt, Artificial Sequence
  MKO10105261_B_Olfr610
  gRNA
agaauaguagcauaacgcaa

SEQ ID NO: 105262 - RNA, 20 nt, Artificial Sequence
  MKO10105262_B_Olfr611
  gRNA
auguacacugccuccagacc

SEQ ID NO: 105263 - RNA, 20 nt, Artificial Sequence
  MKO10105263_B_Olfr611
  gRNA
aaaaguagagccuccucaag

SEQ ID NO: 105264 - RNA, 20 nt, Artificial Sequence
  MKO10105264_B_Olfr611
  gRNA
ggcaggcaccugcagaguua

SEQ ID NO: 105265 - RNA, 20 nt, Artificial Sequence
  MKO10105265_B_Olfr612
  gRNA
gagaggcaccugcacaguua

SEQ ID NO: 105266 - RNA, 20 nt, Artificial Sequence
  MKO10105266_B_Olfr612
  gRNA
gaggaggaagucaagcccca

SEQ ID NO: 105267 - RNA, 20 nt, Artificial Sequence
  MKO10105267_B_Olfr612
  gRNA
auguacacugccuccagccc

SEQ ID NO: 105268 - RNA, 20 nt, Artificial Sequence
  MKO10105268_B_Olfr613
  gRNA
auagaguggcuccucguaug

SEQ ID NO: 105269 - RNA, 20 nt, Artificial Sequence
  MKO10105269_B_Olfr613
  gRNA
gggauuuccaguuucgaucu

SEQ ID NO: 105270 - RNA, 20 nt, Artificial Sequence
  MKO10105270_B_Olfr613
  gRNA
gcugaaugugacaucuccgc

SEQ ID NO: 105271 - RNA, 20 nt, Artificial Sequence
  MKO10105271_B_Olfr615
  gRNA
caaggcagagcgaaucugcu

SEQ ID NO: 105272 - RNA, 20 nt, Artificial Sequence
  MKO10105272_B_Olfr615
  gRNA
ucucuuaagcaguauaggca

SEQ ID NO: 105273 - RNA, 20 nt, Artificial Sequence
  MKO10105273_B_Olfr615
  gRNA
ggcuggugggugcccgccug

SEQ ID NO: 105274 - RNA, 20 nt, Artificial Sequence
  MKO10105274_B_Olfr616
  gRNA
uagaugauguugacccugac

SEQ ID NO: 105275 - RNA, 20 nt, Artificial Sequence
  MKO10105275_B_Olfr616
  gRNA
ucucuaguucucuguucguu

SEQ ID NO: 105276 - RNA, 20 nt, Artificial Sequence
  MKO10105276_B_Olfr616
  gRNA
uaggacuugcagcuguuguu

SEQ ID NO: 105277 - RNA, 20 nt, Artificial Sequence
  MKO10105277_B_Olfr617
  gRNA
acaccaaugucagagacauc

SEQ ID NO: 105278 - RNA, 20 nt, Artificial Sequence
  MKO10105278_B_Olfr617
  gRNA
agucuucacuccauaaauga

SEQ ID NO: 105279 - RNA, 20 nt, Artificial Sequence
  MKO10105279_B_Olfr617
  gRNA
auaccagaugucucugacau

SEQ ID NO: 105280 - RNA, 20 nt, Artificial Sequence
  MKO10105280_B_Olfr618
  gRNA
gcacucaacccuaucauaua

SEQ ID NO: 105281 - RNA, 20 nt, Artificial Sequence
  MKO10105281_B_Olfr618
  gRNA
acaccaaccuuagagacauu

SEQ ID NO: 105282 - RNA, 20 nt, Artificial Sequence
  MKO10105282_B_Olfr618
  gRNA
caggagguaccaccacauag

SEQ ID NO: 105283 - RNA, 20 nt, Artificial Sequence
  MKO10105283_B_Olfr619
  gRNA
cagaaaauugcuaauaccuu

SEQ ID NO: 105284 - RNA, 20 nt, Artificial Sequence
  MKO10105284_B_Olfr619
  gRNA
caauagagaucagcaauauu

SEQ ID NO: 105285 - RNA, 20 nt, Artificial Sequence
  MKO10105285_B_Olfr619
  gRNA
acaccauucucagagacauc

SEQ ID NO: 105286 - RNA, 20 nt, Artificial Sequence
  MKO10105286_B_Olfr61
  gRNA
ccucuacacaaucgcucuaa

SEQ ID NO: 105287 - RNA, 20 nt, Artificial Sequence
  MKO10105287_B_Olfr61
  gRNA
gugcuaaccuuguuauccua

SEQ ID NO: 105288 - RNA, 20 nt, Artificial Sequence
  MKO10105288_B_Olfr61
  gRNA
aaaguugaugcacccauaaa

SEQ ID NO: 105289 - RNA, 20 nt, Artificial Sequence
  MKO10105289_B_Olfr620
  gRNA
guccacugugcacacgguaa

SEQ ID NO: 105290 - RNA, 20 nt, Artificial Sequence
  MKO10105290_B_Olfr620
  gRNA
agauacgagugagaauucag

SEQ ID NO: 105291 - RNA, 20 nt, Artificial Sequence
  MKO10105291_B_Olfr620
  gRNA
guaugguacuucaugugauu

SEQ ID NO: 105292 - RNA, 20 nt, Artificial Sequence
  MKO10105292_B_Olfr622
  gRNA
ucuugccaauacgaugagau

SEQ ID NO: 105293 - RNA, 20 nt, Artificial Sequence
  MKO10105293_B_Olfr622
  gRNA
gcaaaaaugaugugaacgcu

SEQ ID NO: 105294 - RNA, 20 nt, Artificial Sequence
  MKO10105294_B_Olfr622
  gRNA
gaaugcucguucuaaagccc

SEQ ID NO: 105295 - RNA, 20 nt, Artificial Sequence
  MKO10105295_B_Olfr623
  gRNA
guguacuaugguucaaucac

SEQ ID NO: 105296 - RNA, 20 nt, Artificial Sequence
  MKO10105296_B_Olfr623
  gRNA
auaucuuaauggguugcgaa

SEQ ID NO: 105297 - RNA, 20 nt, Artificial Sequence
  MKO10105297_B_Olfr623
  gRNA
caauucagucgaaugauuau

SEQ ID NO: 105298 - RNA, 20 nt, Artificial Sequence
  MKO10105298_B_Olfr624
  gRNA
ccccauuauuggucugacua

SEQ ID NO: 105299 - RNA, 20 nt, Artificial Sequence
  MKO10105299_B_Olfr624
  gRNA
aaccauagucagaccaauaa

SEQ ID NO: 105300 - RNA, 20 nt, Artificial Sequence
  MKO10105300_B_Olfr624
  gRNA
caaagaaguaguagacuucc

SEQ ID NO: 105301 - RNA, 20 nt, Artificial Sequence
  MKO10105301_B_Olfr628
  gRNA
uuuguggccuucaguauacu

SEQ ID NO: 105302 - RNA, 20 nt, Artificial Sequence
  MKO10105302_B_Olfr628
  gRNA
cuccaagcauugcuagaaag

SEQ ID NO: 105303 - RNA, 20 nt, Artificial Sequence
  MKO10105303_B_Olfr628
  gRNA
uccaucuuaccaaaaaugcu

SEQ ID NO: 105304 - RNA, 20 nt, Artificial Sequence
  MKO10105304_B_Olfr629
  gRNA
cacucugucacgaaucuguu

SEQ ID NO: 105305 - RNA, 20 nt, Artificial Sequence
  MKO10105305_B_Olfr629
  gRNA
cauguccgcuucucauuaaa

SEQ ID NO: 105306 - RNA, 20 nt, Artificial Sequence
  MKO10105306_B_Olfr629
  gRNA
gaaugcccgcucuaaagccu

SEQ ID NO: 105307 - RNA, 20 nt, Artificial Sequence
  MKO10105307_B_Olfr62
  gRNA
caaacucgguaagagagcug

SEQ ID NO: 105308 - RNA, 20 nt, Artificial Sequence
  MKO10105308_B_Olfr62
  gRNA
aucaugaguccuuugcugcg

SEQ ID NO: 105309 - RNA, 20 nt, Artificial Sequence
  MKO10105309_B_Olfr62
  gRNA
accagugacccacgcagcaa

SEQ ID NO: 105310 - RNA, 20 nt, Artificial Sequence
  MKO10105310_B_Olfr630
  gRNA
guuaaaaauugcaucccgug

SEQ ID NO: 105311 - RNA, 20 nt, Artificial Sequence
  MKO10105311_B_Olfr630
  gRNA
cagagcagcaguuccaaucu

SEQ ID NO: 105312 - RNA, 20 nt, Artificial Sequence
  MKO10105312_B_Olfr630
  gRNA
gcaaauggaggauuccuuca

SEQ ID NO: 105313 - RNA, 20 nt, Artificial Sequence
  MKO10105313_B_Olfr631
  gRNA
gugcucauugcgcuguccua

SEQ ID NO: 105314 - RNA, 20 nt, Artificial Sequence
  MKO10105314_B_Olfr631
  gRNA
aggacagcgcaaugagcacg

SEQ ID NO: 105315 - RNA, 20 nt, Artificial Sequence
  MKO10105315_B_Olfr631
  gRNA
ccagaccagccaccguguau

SEQ ID NO: 105316 - RNA, 20 nt, Artificial Sequence
  MKO10105316_B_Olfr632
  gRNA
ucgaaccagaugcaagauag

SEQ ID NO: 105317 - RNA, 20 nt, Artificial Sequence
  MKO10105317_B_Olfr632
  gRNA
uaaugccacuaucuugcauc

SEQ ID NO: 105318 - RNA, 20 nt, Artificial Sequence
  MKO10105318_B_Olfr632
  gRNA
ccguguggcauugauaggca

SEQ ID NO: 105319 - RNA, 20 nt, Artificial Sequence
  MKO10105319_B_Olfr633
  gRNA
caugggcaauacccucauuc

SEQ ID NO: 105320 - RNA, 20 nt, Artificial Sequence
  MKO10105320_B_Olfr633
  gRNA
gaaagaguuguauuaacccc

SEQ ID NO: 105321 - RNA, 20 nt, Artificial Sequence
  MKO10105321_B_Olfr633
  gRNA
accugcuguucgccuucucc

SEQ ID NO: 105322 - RNA, 20 nt, Artificial Sequence
  MKO10105322_B_Olfr635
  gRNA
gaagaagaacugggcaaaac

SEQ ID NO: 105323 - RNA, 20 nt, Artificial Sequence
  MKO10105323_B_Olfr635
  gRNA
gaugguguagaggcagaaua

SEQ ID NO: 105324 - RNA, 20 nt, Artificial Sequence
  MKO10105324_B_Olfr635
  gRNA
ucaucacaggaggugcuagc

SEQ ID NO: 105325 - RNA, 20 nt, Artificial Sequence
  MKO10105325_B_Olfr638
  gRNA
gaaguaacuaacaccacuca

SEQ ID NO: 105326 - RNA, 20 nt, Artificial Sequence
  MKO10105326_B_Olfr638
  gRNA
uuucccgaauguugaaccag

SEQ ID NO: 105327 - RNA, 20 nt, Artificial Sequence
  MKO10105327_B_Olfr638
  gRNA
cacacucccuacagucaugc

SEQ ID NO: 105328 - RNA, 20 nt, Artificial Sequence
  MKO10105328_B_Olfr639
  gRNA
ccaguccuggaaugccaguu

SEQ ID NO: 105329 - RNA, 20 nt, Artificial Sequence
  MKO10105329_B_Olfr639
  gRNA
cuccuaucaaucuuccuaac

SEQ ID NO: 105330 - RNA, 20 nt, Artificial Sequence
  MKO10105330_B_Olfr639
  gRNA
acuaaagaguguugcacuca

SEQ ID NO: 105331 - RNA, 20 nt, Artificial Sequence
  MKO10105331_B_Olfr63
  gRNA
ccauaauuuaccucaagucc

SEQ ID NO: 105332 - RNA, 20 nt, Artificial Sequence
  MKO10105332_B_Olfr63
  gRNA
ccacaagccgagcacaaccu

SEQ ID NO: 105333 - RNA, 20 nt, Artificial Sequence
  MKO10105333_B_Olfr63
  gRNA
cauagcccaugaccacgagc

SEQ ID NO: 105334 - RNA, 20 nt, Artificial Sequence
  MKO10105334_B_Olfr640
  gRNA
ucuccaugauccaccgcuuc

SEQ ID NO: 105335 - RNA, 20 nt, Artificial Sequence
  MKO10105335_B_Olfr640
  gRNA
aaaucagggcaauccaagcu

SEQ ID NO: 105336 - RNA, 20 nt, Artificial Sequence
  MKO10105336_B_Olfr640
  gRNA
gcccauagauauuguuaaca

SEQ ID NO: 105337 - RNA, 20 nt, Artificial Sequence
  MKO10105337_B_Olfr641
  gRNA
cauucauucuuucucgauga

SEQ ID NO: 105338 - RNA, 20 nt, Artificial Sequence
  MKO10105338_B_Olfr641
  gRNA
aggcgucaaaagcaaugcug

SEQ ID NO: 105339 - RNA, 20 nt, Artificial Sequence
  MKO10105339_B_Olfr641
  gRNA
gaaucacaguauuugccccg

SEQ ID NO: 105340 - RNA, 20 nt, Artificial Sequence
  MKO10105340_B_Olfr642
  gRNA
gacugccuucgaugcuugcc

SEQ ID NO: 105341 - RNA, 20 nt, Artificial Sequence
  MKO10105341_B_Olfr642
  gRNA
gagacugcacaagauguuac

SEQ ID NO: 105342 - RNA, 20 nt, Artificial Sequence
  MKO10105342_B_Olfr642
  gRNA
caagcaucgaaggcagucuc

SEQ ID NO: 105343 - RNA, 20 nt, Artificial Sequence
  MKO10105343_B_Olfr643
  gRNA
guguccauggcugcucgcua

SEQ ID NO: 105344 - RNA, 20 nt, Artificial Sequence
  MKO10105344_B_Olfr643
  gRNA
ucugcugucacucaaugacc

SEQ ID NO: 105345 - RNA, 20 nt, Artificial Sequence
  MKO10105345_B_Olfr643
  gRNA
uaaaacugaucucucuuaag

SEQ ID NO: 105346 - RNA, 20 nt, Artificial Sequence
  MKO10105346_B_Olfr644
  gRNA
guguccauguuugcucgcua

SEQ ID NO: 105347 - RNA, 20 nt, Artificial Sequence
  MKO10105347_B_Olfr644
  gRNA
ucacugaugcccgagugaug

SEQ ID NO: 105348 - RNA, 20 nt, Artificial Sequence
  MKO10105348_B_Olfr644
  gRNA
ccucccauagcgagcaaaca

SEQ ID NO: 105349 - RNA, 20 nt, Artificial Sequence
  MKO10105349_B_Olfr645
  gRNA
caauccacugcgcuaugcca

SEQ ID NO: 105350 - RNA, 20 nt, Artificial Sequence
  MKO10105350_B_Olfr645
  gRNA
uccaucguguugcucaccuu

SEQ ID NO: 105351 - RNA, 20 nt, Artificial Sequence
  MKO10105351_B_Olfr645
  gRNA
gaucaacuuuaaugcuugcu

SEQ ID NO: 105352 - RNA, 20 nt, Artificial Sequence
  MKO10105352_B_Olfr646
  gRNA
ggcuggaguucgcccaccuc

SEQ ID NO: 105353 - RNA, 20 nt, Artificial Sequence
  MKO10105353_B_Olfr646
  gRNA
auagcccaaauuaucuuugc

SEQ ID NO: 105354 - RNA, 20 nt, Artificial Sequence
  MKO10105354_B_Olfr646
  gRNA
cgaggacucaagagcauaga

SEQ ID NO: 105355 - RNA, 20 nt, Artificial Sequence
  MKO10105355_B_Olfr648
  gRNA
augauacguguccuacagaa

SEQ ID NO: 105356 - RNA, 20 nt, Artificial Sequence
  MKO10105356_B_Olfr648
  gRNA
acguggaagugcuccaagcc

SEQ ID NO: 105357 - RNA, 20 nt, Artificial Sequence
  MKO10105357_B_Olfr648
  gRNA
gagcacuuccacguguggau

SEQ ID NO: 105358 - RNA, 20 nt, Artificial Sequence
  MKO10105358_B_Olfr649
  gRNA
uucgcccaaagcgaugagca

SEQ ID NO: 105359 - RNA, 20 nt, Artificial Sequence
  MKO10105359_B_Olfr649
  gRNA
aucuauaaucacugucauga

SEQ ID NO: 105360 - RNA, 20 nt, Artificial Sequence
  MKO10105360_B_Olfr649
  gRNA
aacgugaguagcuacaacac

SEQ ID NO: 105361 - RNA, 20 nt, Artificial Sequence
  MKO10105361_B_Olfr64
  gRNA
guacuauuuccuugccaugc

SEQ ID NO: 105362 - RNA, 20 nt, Artificial Sequence
  MKO10105362_B_Olfr64
  gRNA
caagacaccugacuccacaa

SEQ ID NO: 105363 - RNA, 20 nt, Artificial Sequence
  MKO10105363_B_Olfr64
  gRNA
ccauaaaacagccauuacag

SEQ ID NO: 105364 - RNA, 20 nt, Artificial Sequence
  MKO10105364_B_Olfr651
  gRNA
ucccaagaaauaaccuucuc

SEQ ID NO: 105365 - RNA, 20 nt, Artificial Sequence
  MKO10105365_B_Olfr651
  gRNA
cgccucagcaggaaaacauc

SEQ ID NO: 105366 - RNA, 20 nt, Artificial Sequence
  MKO10105366_B_Olfr651
  gRNA
uuauggugagcaucauugug

SEQ ID NO: 105367 - RNA, 20 nt, Artificial Sequence
  MKO10105367_B_Olfr652
  gRNA
aggggaucccaauccauacg

SEQ ID NO: 105368 - RNA, 20 nt, Artificial Sequence
  MKO10105368_B_Olfr652
  gRNA
ucuguccuuguccaucguuu

SEQ ID NO: 105369 - RNA, 20 nt, Artificial Sequence
  MKO10105369_B_Olfr652
  gRNA
gaauguagccauuaugguca

SEQ ID NO: 105370 - RNA, 20 nt, Artificial Sequence
  MKO10105370_B_Olfr653
  gRNA
cgugcugcgacugcccucaa

SEQ ID NO: 105371 - RNA, 20 nt, Artificial Sequence
  MKO10105371_B_Olfr653
  gRNA
auccucaaugcuguuguaau

SEQ ID NO: 105372 - RNA, 20 nt, Artificial Sequence
  MKO10105372_B_Olfr653
  gRNA
cuuugagggcagucgcagca

SEQ ID NO: 105373 - RNA, 20 nt, Artificial Sequence
  MKO10105373_B_Olfr654
  gRNA
gugucgauaccacauucaau

SEQ ID NO: 105374 - RNA, 20 nt, Artificial Sequence
  MKO10105374_B_Olfr654
  gRNA
gucuacgaccaccauuccua

SEQ ID NO: 105375 - RNA, 20 nt, Artificial Sequence
  MKO10105375_B_Olfr654
  gRNA
cuugugcagggaacguucca

SEQ ID NO: 105376 - RNA, 20 nt, Artificial Sequence
  MKO10105376_B_Olfr655
  gRNA
cuaggcguccaacuagagaa

SEQ ID NO: 105377 - RNA, 20 nt, Artificial Sequence
  MKO10105377_B_Olfr655
  gRNA
cucgaucaucaaaccagaag

SEQ ID NO: 105378 - RNA, 20 nt, Artificial Sequence
  MKO10105378_B_Olfr655
  gRNA
cuucgugaucuugcuuguag

SEQ ID NO: 105379 - RNA, 20 nt, Artificial Sequence
  MKO10105379_B_Olfr656
  gRNA
gauucgugaaaggguugcca

SEQ ID NO: 105380 - RNA, 20 nt, Artificial Sequence
  MKO10105380_B_Olfr656
  gRNA
cgugggcaauauaaccaucc

SEQ ID NO: 105381 - RNA, 20 nt, Artificial Sequence
  MKO10105381_B_Olfr656
  gRNA
agaagcucagacgaccaaug

SEQ ID NO: 105382 - RNA, 20 nt, Artificial Sequence
  MKO10105382_B_Olfr657
  gRNA
guccgguaucuuccucugca

SEQ ID NO: 105383 - RNA, 20 nt, Artificial Sequence
  MKO10105383_B_Olfr657
  gRNA
cuucaauaguuccaaguccc

SEQ ID NO: 105384 - RNA, 20 nt, Artificial Sequence
  MKO10105384_B_Olfr657
  gRNA
cguuugucccuauugcugaa

SEQ ID NO: 105385 - RNA, 20 nt, Artificial Sequence
  MKO10105385_B_Olfr658
  gRNA
cgcuuggugagaaaugugaa

SEQ ID NO: 105386 - RNA, 20 nt, Artificial Sequence
  MKO10105386_B_Olfr658
  gRNA
uccagacuccauccccguga

SEQ ID NO: 105387 - RNA, 20 nt, Artificial Sequence
  MKO10105387_B_Olfr658
  gRNA
uauaggagauugugaugcac

SEQ ID NO: 105388 - RNA, 20 nt, Artificial Sequence
  MKO10105388_B_Olfr659
  gRNA
aguaguacauugaccuguga

SEQ ID NO: 105389 - RNA, 20 nt, Artificial Sequence
  MKO10105389_B_Olfr659
  gRNA
aauuagcuuuacugauuguc

SEQ ID NO: 105390 - RNA, 20 nt, Artificial Sequence
  MKO10105390_B_Olfr659
  gRNA
cagcucucaagaauguagca

SEQ ID NO: 105391 - RNA, 20 nt, Artificial Sequence
  MKO10105391_B_Olfr65
  gRNA
uugccauucgcaacccacua

SEQ ID NO: 105392 - RNA, 20 nt, Artificial Sequence
  MKO10105392_B_Olfr65
  gRNA
uuggucugacguuuauucac

SEQ ID NO: 105393 - RNA, 20 nt, Artificial Sequence
  MKO10105393_B_Olfr65
  gRNA
caaugcaggcgaaugauuau

SEQ ID NO: 105394 - RNA, 20 nt, Artificial Sequence
  MKO10105394_B_Olfr661
  gRNA
agaccgaagaaucaaagcau

SEQ ID NO: 105395 - RNA, 20 nt, Artificial Sequence
  MKO10105395_B_Olfr661
  gRNA
uccccaugaguguccaagcc

SEQ ID NO: 105396 - RNA, 20 nt, Artificial Sequence
  MKO10105396_B_Olfr661
  gRNA
auucuuaagugcauacacca

SEQ ID NO: 105397 - RNA, 20 nt, Artificial Sequence
  MKO10105397_B_Olfr663
  gRNA
gcagucauggguagugaccu

SEQ ID NO: 105398 - RNA, 20 nt, Artificial Sequence
  MKO10105398_B_Olfr663
  gRNA
aacagugguugauuugauuc

SEQ ID NO: 105399 - RNA, 20 nt, Artificial Sequence
  MKO10105399_B_Olfr663
  gRNA
gucgaucuuccugucaucac

SEQ ID NO: 105400 - RNA, 20 nt, Artificial Sequence
  MKO10105400_B_Olfr665
  gRNA
cacaccuucacgaaucugcu

SEQ ID NO: 105401 - RNA, 20 nt, Artificial Sequence
  MKO10105401_B_Olfr665
  gRNA
ccaguauguuaugcaucuuu

SEQ ID NO: 105402 - RNA, 20 nt, Artificial Sequence
  MKO10105402_B_Olfr665
  gRNA
augagguuuccucuacagua

SEQ ID NO: 105403 - RNA, 20 nt, Artificial Sequence
  MKO10105403_B_Olfr666
  gRNA
aagcgcuugcccuauugcag

SEQ ID NO: 105404 - RNA, 20 nt, Artificial Sequence
  MKO10105404_B_Olfr666
  gRNA
auaucguagaggauagcaga

SEQ ID NO: 105405 - RNA, 20 nt, Artificial Sequence
  MKO10105405_B_Olfr666
  gRNA
cauguacaugauugcuguag

SEQ ID NO: 105406 - RNA, 20 nt, Artificial Sequence
  MKO10105406_B_Olfr667
  gRNA
aauagggcaggcgcuuagug

SEQ ID NO: 105407 - RNA, 20 nt, Artificial Sequence
  MKO10105407_B_Olfr667
  gRNA
gugaaaaucaaugcagucua

SEQ ID NO: 105408 - RNA, 20 nt, Artificial Sequence
  MKO10105408_B_Olfr667
  gRNA
cuagucuugcuacuuucuug

SEQ ID NO: 105409 - RNA, 20 nt, Artificial Sequence
  MKO10105409_B_Olfr668
  gRNA
cacuaugauauugagagcag

SEQ ID NO: 105410 - RNA, 20 nt, Artificial Sequence
  MKO10105410_B_Olfr668
  gRNA
auaucguagaggauugcaga

SEQ ID NO: 105411 - RNA, 20 nt, Artificial Sequence
  MKO10105411_B_Olfr668
  gRNA
uucuuuguucauauguugac

SEQ ID NO: 105412 - RNA, 20 nt, Artificial Sequence
  MKO10105412_B_Olfr669
  gRNA
gucucgaagcagugcauaua

SEQ ID NO: 105413 - RNA, 20 nt, Artificial Sequence
  MKO10105413_B_Olfr669
  gRNA
cagugguugugcaaguaaac

SEQ ID NO: 105414 - RNA, 20 nt, Artificial Sequence
  MKO10105414_B_Olfr669
  gRNA
aguaugguugcauagcguag

SEQ ID NO: 105415 - RNA, 20 nt, Artificial Sequence
  MKO10105415_B_Olfr66
  gRNA
gugcuggcaaguauggaccu

SEQ ID NO: 105416 - RNA, 20 nt, Artificial Sequence
  MKO10105416_B_Olfr66
  gRNA
gauucaaguccuacuguguu

SEQ ID NO: 105417 - RNA, 20 nt, Artificial Sequence
  MKO10105417_B_Olfr66
  gRNA
ccccuugugcaaucucccuc

SEQ ID NO: 105418 - RNA, 20 nt, Artificial Sequence
  MKO10105418_B_Olfr670
  gRNA
agauaaugauguucccaacc

SEQ ID NO: 105419 - RNA, 20 nt, Artificial Sequence
  MKO10105419_B_Olfr670
  gRNA
caacaacauauagauuagcc

SEQ ID NO: 105420 - RNA, 20 nt, Artificial Sequence
  MKO10105420_B_Olfr670
  gRNA
uguggauaggccuagaucaa

SEQ ID NO: 105421 - RNA, 20 nt, Artificial Sequence
  MKO10105421_B_Olfr671
  gRNA
ccucuacaugguucuuccac

SEQ ID NO: 105422 - RNA, 20 nt, Artificial Sequence
  MKO10105422_B_Olfr671
  gRNA
ggacuucugugacguuauac

SEQ ID NO: 105423 - RNA, 20 nt, Artificial Sequence
  MKO10105423_B_Olfr671
  gRNA
cauguuagauuccauugacc

SEQ ID NO: 105424 - RNA, 20 nt, Artificial Sequence
  MKO10105424_B_Olfr672
  gRNA
uugagcuacacagucccuaa

SEQ ID NO: 105425 - RNA, 20 nt, Artificial Sequence
  MKO10105425_B_Olfr672
  gRNA
cauacuggcuguuacugacu

SEQ ID NO: 105426 - RNA, 20 nt, Artificial Sequence
  MKO10105426_B_Olfr672
  gRNA
agaacaaucugcauuauugu

SEQ ID NO: 105427 - RNA, 20 nt, Artificial Sequence
  MKO10105427_B_Olfr675
  gRNA
caauggaauccagcauggcu

SEQ ID NO: 105428 - RNA, 20 nt, Artificial Sequence
  MKO10105428_B_Olfr675
  gRNA
ggacuucugugauguuauac

SEQ ID NO: 105429 - RNA, 20 nt, Artificial Sequence
  MKO10105429_B_Olfr675
  gRNA
cucaaggcucucaauacuug

SEQ ID NO: 105430 - RNA, 20 nt, Artificial Sequence
  MKO10105430_B_Olfr676
  gRNA
uucucaagaugcucgccuaa

SEQ ID NO: 105431 - RNA, 20 nt, Artificial Sequence
  MKO10105431_B_Olfr676
  gRNA
ugcccccaguaauaucacug

SEQ ID NO: 105432 - RNA, 20 nt, Artificial Sequence
  MKO10105432_B_Olfr676
  gRNA
auucuguaguagguugaugu

SEQ ID NO: 105433 - RNA, 20 nt, Artificial Sequence
  MKO10105433_B_Olfr677
  gRNA
cucucaagaugcccgauuga

SEQ ID NO: 105434 - RNA, 20 nt, Artificial Sequence
  MKO10105434_B_Olfr677
  gRNA
gaauucggaaaacagcucga

SEQ ID NO: 105435 - RNA, 20 nt, Artificial Sequence
  MKO10105435_B_Olfr677
  gRNA
gcacauaggaagaggcaauc

SEQ ID NO: 105436 - RNA, 20 nt, Artificial Sequence
  MKO10105436_B_Olfr678
  gRNA
gcuagcaugugccaauauca

SEQ ID NO: 105437 - RNA, 20 nt, Artificial Sequence
  MKO10105437_B_Olfr678
  gRNA
aguaucauacuguaccucag

SEQ ID NO: 105438 - RNA, 20 nt, Artificial Sequence
  MKO10105438_B_Olfr678
  gRNA
auaauccggacaccacagaa

SEQ ID NO: 105439 - RNA, 20 nt, Artificial Sequence
  MKO10105439_B_Olfr679
  gRNA
uaagggcagcagggaugaca

SEQ ID NO: 105440 - RNA, 20 nt, Artificial Sequence
  MKO10105440_B_Olfr679
  gRNA
ucagcacgacuccauuacug

SEQ ID NO: 105441 - RNA, 20 nt, Artificial Sequence
  MKO10105441_B_Olfr679
  gRNA
agaacucaggagauuaagca

SEQ ID NO: 105442 - RNA, 20 nt, Artificial Sequence
  MKO10105442_B_Olfr67
  gRNA
aaaggaaaaccacucgaucu

SEQ ID NO: 105443 - RNA, 20 nt, Artificial Sequence
  MKO10105443_B_Olfr67
  gRNA
gauauugucgcaugccaauc

SEQ ID NO: 105444 - RNA, 20 nt, Artificial Sequence
  MKO10105444_B_Olfr67
  gRNA
uauaucgacuucuguauugu

SEQ ID NO: 105445 - RNA, 20 nt, Artificial Sequence
  MKO10105445_B_Olfr681
  gRNA
uggaggacauugagcaaaau

SEQ ID NO: 105446 - RNA, 20 nt, Artificial Sequence
  MKO10105446_B_Olfr681
  gRNA
uugcccauccccauucuuuc

SEQ ID NO: 105447 - RNA, 20 nt, Artificial Sequence
  MKO10105447_B_Olfr681
  gRNA
ucguccugaaagaaugggga

SEQ ID NO: 105448 - RNA, 20 nt, Artificial Sequence
  MKO10105448_B_Olfr683
  gRNA
ggguccaaccuauaacaaac

SEQ ID NO: 105449 - RNA, 20 nt, Artificial Sequence
  MKO10105449_B_Olfr683
  gRNA
cauaguaagaaucccauuuc

SEQ ID NO: 105450 - RNA, 20 nt, Artificial Sequence
  MKO10105450_B_Olfr683
  gRNA
aaacucuaccaguuuguuau

SEQ ID NO: 105451 - RNA, 20 nt, Artificial Sequence
  MKO10105451_B_Olfr684
  gRNA
cugagcacaguacuuuaguc

SEQ ID NO: 105452 - RNA, 20 nt, Artificial Sequence
  MKO10105452_B_Olfr684
  gRNA
aaacuauaucaacuuguagc

SEQ ID NO: 105453 - RNA, 20 nt, Artificial Sequence
  MKO10105453_B_Olfr684
  gRNA
caaguugauauaguuuauug

SEQ ID NO: 105454 - RNA, 20 nt, Artificial Sequence
  MKO10105454_B_Olfr685
  gRNA
uuaagucuggcuucaccccc

SEQ ID NO: 105455 - RNA, 20 nt, Artificial Sequence
  MKO10105455_B_Olfr685
  gRNA
accacagugaaucgagcuua

SEQ ID NO: 105456 - RNA, 20 nt, Artificial Sequence
  MKO10105456_B_Olfr685
  gRNA
accauaagcucgauucacug

SEQ ID NO: 105457 - RNA, 20 nt, Artificial Sequence
  MKO10105457_B_Olfr686
  gRNA
ggcuuguggggccauaacug

SEQ ID NO: 105458 - RNA, 20 nt, Artificial Sequence
  MKO10105458_B_Olfr686
  gRNA
ccugaaguuguugccaagau

SEQ ID NO: 105459 - RNA, 20 nt, Artificial Sequence
  MKO10105459_B_Olfr686
  gRNA
ucuguggucaugcagcgcuu

SEQ ID NO: 105460 - RNA, 20 nt, Artificial Sequence
  MKO10105460_B_Olfr688
  gRNA
gccugagugaguuugugucu

SEQ ID NO: 105461 - RNA, 20 nt, Artificial Sequence
  MKO10105461_B_Olfr688
  gRNA
cgugucugaguucauucugc

SEQ ID NO: 105462 - RNA, 20 nt, Artificial Sequence
  MKO10105462_B_Olfr688
  gRNA
uauaccacgggguuaaggga

SEQ ID NO: 105463 - RNA, 20 nt, Artificial Sequence
  MKO10105463_B_Olfr689
  gRNA
augauguaaaguagagccau

SEQ ID NO: 105464 - RNA, 20 nt, Artificial Sequence
  MKO10105464_B_Olfr689
  gRNA
acugccaguugacauuggcc
